United States Patent 11,332,783 (SAMPLE ANALYSIS, PRESENCE DETERMINATION OF A TARGET SEQUENCE) - sequence listing, part 3

SEQ ID NO: 36689 - DNA, 75 bp, Artificial Sequence
  Synthetic
cccatccaaagaggcagtcacggaggtgtgcctaaaggatgatgtcagtatgatcaaaacagaagccagatacat

SEQ ID NO: 36690 - DNA, 75 bp, Artificial Sequence
  Synthetic
aacaatgttgcaataaggaaatggttggtctctgattggcatgactgcaggcccaagaaaatcactgggggacat

SEQ ID NO: 36691 - DNA, 75 bp, Artificial Sequence
  Synthetic
aactaagtctgctaaagacatatttttagcgactggcttttataaacaacctaacaagaatgaaataagtgaagg

SEQ ID NO: 36692 - DNA, 75 bp, Artificial Sequence
  Synthetic
tggtctctgattggcatgactgcaggcccaagaaaatcactgggggacatattaatgtgatagaggttggtgatg

SEQ ID NO: 36693 - DNA, 75 bp, Artificial Sequence
  Synthetic
ctaacaagaatgaaataagtgaaggatgggacctgatgatagagagaatacatgagcaaaggaacataactaaat

SEQ ID NO: 36694 - DNA, 75 bp, Artificial Sequence
  Synthetic
tgtttgcagtgcagactgtactataggtgtagacaaggagacggcgcaagtcaggcttcaaacagataccacgaa

SEQ ID NO: 36695 - DNA, 75 bp, Artificial Sequence
  Synthetic
cgttacatgagcagaagccaagcatgcattttatatggggtccacacaatccagggaacagcaataattcaactt

SEQ ID NO: 36696 - DNA, 75 bp, Artificial Sequence
  Synthetic
gcattttatatggggtccacacaatccagggaacagcaataattcaactttcaaattgatattattgtcaaaatc

SEQ ID NO: 36697 - DNA, 75 bp, Artificial Sequence
  Synthetic
ggtgtagacaaggagacggcgcaagtcaggcttcaaacagataccacgaaccattttgaaattgcaggtaccact

SEQ ID NO: 36698 - DNA, 75 bp, Artificial Sequence
  Synthetic
caacatatatcactcttgaccagacttgtgaacatcttaaggtgtcttgcggcccaaaatctgtgcagttccatg

SEQ ID NO: 36699 - DNA, 75 bp, Artificial Sequence
  Synthetic
acttacacagaagcattcaagtctcttgggaaaatgatggacataggtgatagggcaacagaatatgaatcacat

SEQ ID NO: 36700 - DNA, 75 bp, Artificial Sequence
  Synthetic
ttgtgaacatcttaaggtgtcttgcggcccaaaatctgtgcagttccatgcctgcttcaatcagcatatgtcctg

SEQ ID NO: 36701 - DNA, 75 bp, Artificial Sequence
  Synthetic
ctgcccggttctatagctaattctatatgccagaatattgaaatcataattttagtcacactcactctattaatc

SEQ ID NO: 36702 - DNA, 75 bp, Artificial Sequence
  Synthetic
tatgccagaatattgaaatcataattttagtcacactcactctattaatctttatattgttaagtattctaagta

SEQ ID NO: 36703 - DNA, 75 bp, Artificial Sequence
  Synthetic
aatacagccttagttttatgggaacagcagttcatggtcaacaacgaaatcatagataagaatgacaggatcaaa

SEQ ID NO: 36704 - DNA, 75 bp, Artificial Sequence
  Synthetic
agcagttcatggtcaacaacgaaatcatagataagaatgacaggatcaaactgctgaagaacttctgcggaatag

SEQ ID NO: 36705 - DNA, 75 bp, Artificial Sequence
  Synthetic
gcctatattcatccctatagcatatgtgtatggtataatctacaataagtcatgcaaaaaatgcaaactatgcgg

SEQ ID NO: 36706 - DNA, 75 bp, Artificial Sequence
  Synthetic
gtgtatggtataatctacaataagtcatgcaaaaaatgcaaactatgcggtctggtgtatcatccattcacagaa

SEQ ID NO: 36707 - DNA, 75 bp, Artificial Sequence
  Synthetic
aatgctagatgatatagacaattcaaaacccactatattggattttgatgatgaaaatgtgtacctggctagttt

SEQ ID NO: 36708 - DNA, 75 bp, Artificial Sequence
  Synthetic
aaacccactatattggattttgatgatgaaaatgtgtacctggctagtttaacaatgatggagcagactaagagg

SEQ ID NO: 36709 - DNA, 75 bp, Artificial Sequence
  Synthetic
ctcgctatgatacttccgatagaatgaaactgcatagagcctctggactgtgtcctggttataaaagcttgagag

SEQ ID NO: 36710 - DNA, 75 bp, Artificial Sequence
  Synthetic
gaaactgcatagagcctctggactgtgtcctggttataaaagcttgagagctgctagggtcatgtgtaagtcaaa

SEQ ID NO: 36711 - DNA, 75 bp, Artificial Sequence
  Synthetic
agagcgataattttatattaaacgagtttggccaaaggatcaaagactgcaataaggacacatatgaaaatatgt

SEQ ID NO: 36712 - DNA, 75 bp, Artificial Sequence
  Synthetic
gtttggccaaaggatcaaagactgcaataaggacacatatgaaaatatgtaccaaatatttgaaactaggtattg

SEQ ID NO: 36713 - DNA, 75 bp, Artificial Sequence
  Synthetic
attactgcagtactagtcttaacatttgtgacaccaatcaattccatggttttaggggaaagtaaagaagtcttc

SEQ ID NO: 36714 - DNA, 75 bp, Artificial Sequence
  Synthetic
ttgtgacaccaatcaattccatggttttaggggaaagtaaagaagtcttcgaacttgaagagcttccggacgaca

SEQ ID NO: 36715 - DNA, 75 bp, Artificial Sequence
  Synthetic
ctaatgaagaatatactgtctgtatcacagtacaatagacacaataccttcagaatcgcaatgtgtgcaaataat

SEQ ID NO: 36716 - DNA, 75 bp, Artificial Sequence
  Synthetic
cacagtacaatagacacaataccttcagaatcgcaatgtgtgcaaataataatgtttttgcaatagtgttccctt

SEQ ID NO: 36717 - DNA, 75 bp, Artificial Sequence
  Synthetic
ttcctattatttcacctgtattctaaattatgctgtgagctggggccttattatcattggattgttgactgggct

SEQ ID NO: 36718 - DNA, 75 bp, Artificial Sequence
  Synthetic
aattatgctgtgagctggggccttattatcattggattgttgactgggctactatttaaaaagtaccaacataga

SEQ ID NO: 36719 - DNA, 75 bp, Artificial Sequence
  Synthetic
aactgtagtttatagtatcgtggtcttgcacaaagaagaaaccaatgtattgaacccaggatgcttgcatggcac

SEQ ID NO: 36720 - DNA, 75 bp, Artificial Sequence
  Synthetic
ttgcacaaagaagaaaccaatgtattgaacccaggatgcttgcatggcacatttaaatgcatgaatgggtacata

SEQ ID NO: 36721 - DNA, 75 bp, Artificial Sequence
  Synthetic
gtgaagagtgtgacatgtatcatgataaatccgggctgaaaaggcatggtgatttcactaacaaatgcaggcaat

SEQ ID NO: 36722 - DNA, 75 bp, Artificial Sequence
  Synthetic
taaatccgggctgaaaaggcatggtgatttcactaacaaatgcaggcaatgtacatgcggccaatatgaagatgc

SEQ ID NO: 36723 - DNA, 75 bp, Artificial Sequence
  Synthetic
acaaagagagatgccaaagaatagtctcatctccaggtctattcttaacaacctgcttattgtttaaacacgaaa

SEQ ID NO: 36724 - DNA, 75 bp, Artificial Sequence
  Synthetic
ctcatctccaggtctattcttaacaacctgcttattgtttaaacacgaaaatccaacactagttatgaatgacgt

SEQ ID NO: 36725 - DNA, 75 bp, Artificial Sequence
  Synthetic
acttacaattgtttggtgcaatataaagcaaaatggataatgaattttttgatagtttacatatttttgattcta

SEQ ID NO: 36726 - DNA, 75 bp, Artificial Sequence
  Synthetic
aagcaaaatggataatgaattttttgatagtttacatatttttgattctaatcaaggattctgccataattgtac

SEQ ID NO: 36727 - DNA, 75 bp, Artificial Sequence
  Synthetic
ctttcaataacaaaaagtgttttatccctcacagaacctgcaaggtacatgataatgaactctcttgccatctcg

SEQ ID NO: 36728 - DNA, 75 bp, Artificial Sequence
  Synthetic
ccctcacagaacctgcaaggtacatgataatgaactctcttgccatctcgagcaatgtcaaagcttatatagctg

SEQ ID NO: 36729 - DNA, 75 bp, Artificial Sequence
  Synthetic
ctgcttagaaacagaaatcataaattggaactgcactgggccatttttgaatctcgggaattgccaaaggcaaca

SEQ ID NO: 36730 - DNA, 75 bp, Artificial Sequence
  Synthetic
tggaactgcactgggccatttttgaatctcgggaattgccaaaggcaacaaaaaaaggagccttatgctaacatt

SEQ ID NO: 36731 - DNA, 75 bp, Artificial Sequence
  Synthetic
actattcagtgtttatatgacaaaacttataaaaaatgcatgttttgatgcttatggacaaagagagagagtcca

SEQ ID NO: 36732 - DNA, 75 bp, Artificial Sequence
  Synthetic
cttataaaaaatgcatgttttgatgcttatggacaaagagagagagtccaattaagagatatctatctttctgat

SEQ ID NO: 36733 - DNA, 75 bp, Artificial Sequence
  Synthetic
caatttcagtgcttgacatccctatgataacagaaataccagatgacatcgcaagtgcattaagatatatagaag

SEQ ID NO: 36734 - DNA, 75 bp, Artificial Sequence
  Synthetic
gataacagaaataccagatgacatcgcaagtgcattaagatatatagaagagagagaggctttccatgtccaatt

SEQ ID NO: 36735 - DNA, 75 bp, Artificial Sequence
  Synthetic
aagacaacagagaattagttagcatatggtttccagggagtgtgaccctcaaagaatacttaacacaagtatatc

SEQ ID NO: 36736 - DNA, 75 bp, Artificial Sequence
  Synthetic
aaagaatacttaacacaagtatatctcccattttacttcaatgctaaaggcctgcacgaaaaacaccacgtaatg

SEQ ID NO: 36737 - DNA, 75 bp, Artificial Sequence
  Synthetic
agatattgtgattattatacccaattctcagacaactcaggatatagtcagacaacatggagagtatatttgagg

SEQ ID NO: 36738 - DNA, 75 bp, Artificial Sequence
  Synthetic
tctcagacaactcaggatatagtcagacaacatggagagtatatttgaggtctcacgatttcgaggcatgtatac

SEQ ID NO: 36739 - DNA, 75 bp, Artificial Sequence
  Synthetic
agattgaaagtgatcaacgggagaatataactgaaatatggtccacaaattgcacaaagcaaacagttaatctaa

SEQ ID NO: 36740 - DNA, 75 bp, Artificial Sequence
  Synthetic
tataactgaaatatggtccacaaattgcacaaagcaaacagttaatctaaagattttagttcactcattgtgcaa

SEQ ID NO: 36741 - DNA, 75 bp, Artificial Sequence
  Synthetic
atgtgtgaaaaacggtgagaaatgcagcagtgccaattgggattttgccaatgaaatgaaagattattattctgg

SEQ ID NO: 36742 - DNA, 75 bp, Artificial Sequence
  Synthetic
agcagtgccaattgggattttgccaatgaaatgaaagattattattctggaaaacaagcaaagtttgataaagac

SEQ ID NO: 36743 - DNA, 75 bp, Artificial Sequence
  Synthetic
cacaaccatcttaggaataggatagagaatagaaacaactttcgaaggtcaattactacaatatcgacttttaca

SEQ ID NO: 36744 - DNA, 75 bp, Artificial Sequence
  Synthetic
agaatagaaacaactttcgaaggtcaattactacaatatcgacttttacaagctcaaaatcttgtttaaagatag

SEQ ID NO: 36745 - DNA, 75 bp, Artificial Sequence
  Synthetic
accatgccttcagggggacttcatctgcatatatggcagcaatgctctcaaagaagtcaaatgatgacttgatca

SEQ ID NO: 36746 - DNA, 75 bp, Artificial Sequence
  Synthetic
tgcatatatggcagcaatgctctcaaagaagtcaaatgatgacttgatcacatatacaaataaattaaagacaaa

SEQ ID NO: 36747 - DNA, 75 bp, Artificial Sequence
  Synthetic
acaaaatgccaaacagaaaaggctcttagaaaatgagagccgaagacgaagattagccaaccctatttttgttac

SEQ ID NO: 36748 - DNA, 75 bp, Artificial Sequence
  Synthetic
ttagaaaatgagagccgaagacgaagattagccaaccctatttttgttacagatgagcaagttaatttagaagtt

SEQ ID NO: 36749 - DNA, 75 bp, Artificial Sequence
  Synthetic
gccataatagactatatagcatatatgaaaggcttaccaggtatggcaaattttaaacatgatgaattttgggat

SEQ ID NO: 36750 - DNA, 75 bp, Artificial Sequence
  Synthetic
tgaaaggcttaccaggtatggcaaattttaaacatgatgaattttgggatgaattactatacaaacccacaccaa

SEQ ID NO: 36751 - DNA, 75 bp, Artificial Sequence
  Synthetic
gggaagcaatgccaaattacacagattatatatccactaaagtttttgatagattatatgaactactagacacaa

SEQ ID NO: 36752 - DNA, 75 bp, Artificial Sequence
  Synthetic
ttatatatccactaaagtttttgatagattatatgaactactagacacaaaagtcctaagtgataggccagtgat

SEQ ID NO: 36753 - DNA, 75 bp, Artificial Sequence
  Synthetic
aagagaatcatcctacaattttgaattggcaatttcatcaaaatccataaaaacctgcaaaaatgttaaagatgt

SEQ ID NO: 36754 - DNA, 75 bp, Artificial Sequence
  Synthetic
ttggcaatttcatcaaaatccataaaaacctgcaaaaatgttaaagatgttgcttgtttatcacccagatcaggc

SEQ ID NO: 36755 - DNA, 75 bp, Artificial Sequence
  Synthetic
aatcataaaaagttttactttacgtttttcaataaaggtcaaaaaacttctaaagacagagaaatttttgtaggg

SEQ ID NO: 36756 - DNA, 75 bp, Artificial Sequence
  Synthetic
ttttcaataaaggtcaaaaaacttctaaagacagagaaatttttgtaggggagtacgaggcaaagatgtgtatgt

SEQ ID NO: 36757 - DNA, 75 bp, Artificial Sequence
  Synthetic
gtggtgaacccaatgggccaagtgtatacaggaagccatcaggcggtgtcttccagtccagcactgaccaatcta

SEQ ID NO: 36758 - DNA, 75 bp, Artificial Sequence
  Synthetic
atacaggaagccatcaggcggtgtcttccagtccagcactgaccaatctatgtattgtttgctggatagtcattg

SEQ ID NO: 36759 - DNA, 75 bp, Artificial Sequence
  Synthetic
aaggtgcaagctaaatcctgatgaaatgatatccgagccaggcgatgggaagctcaaagttcttgaacaaaaatc

SEQ ID NO: 36760 - DNA, 75 bp, Artificial Sequence
  Synthetic
atgatatccgagccaggcgatgggaagctcaaagttcttgaacaaaaatccgaacaggaaattaggttcttggtg

SEQ ID NO: 36761 - DNA, 75 bp, Artificial Sequence
  Synthetic
caggaagaattggatgcggtgaagaaatcgaaatgttgggaaatagaataccctgacgtaaagctcctccaagaa

SEQ ID NO: 36762 - DNA, 75 bp, Artificial Sequence
  Synthetic
aatcgaaatgttgggaaatagaataccctgacgtaaagctcctccaagaaaatgatggaaccaaaagctgtagaa

SEQ ID NO: 36763 - DNA, 75 bp, Artificial Sequence
  Synthetic
acattgacgaggcaataagtgcactagcctcagaaaacttcgaagaaaatgtagagcgaatagagaagctatcaa

SEQ ID NO: 36764 - DNA, 75 bp, Artificial Sequence
  Synthetic
tgcaaccaacagatggccagtaatacaatgtgaaaatgacaaattttactactcagagcttcaaaaagattatga

SEQ ID NO: 36765 - DNA, 75 bp, Artificial Sequence
  Synthetic
gagggaagtcaagaggactaaaaatggaaataaacgcagatatgtctaaatggagtgctcaagatgtgttttata

SEQ ID NO: 36766 - DNA, 75 bp, Artificial Sequence
  Synthetic
caatgtgaaaatgacaaattttactactcagagcttcaaaaagattatgataagacccaggatattggccactat

SEQ ID NO: 36767 - DNA, 75 bp, Artificial Sequence
  Synthetic
cccaatattgtacccgcaagagaaggagaggatcctctttttcatgtgtaattacatgcagaaagaacttatatt

SEQ ID NO: 36768 - DNA, 75 bp, Artificial Sequence
  Synthetic
tccggtaccccattaatccaaagcatatctctaattgcaattggcaagtgagtagatctagcatagcaaaaatag

SEQ ID NO: 36769 - DNA, 75 bp, Artificial Sequence
  Synthetic
gagaggatcctctttttcatgtgtaattacatgcagaaagaacttatattacctgatgagctattgttcaatcta

SEQ ID NO: 36770 - DNA, 75 bp, Artificial Sequence
  Synthetic
tatctctaattgcaattggcaagtgagtagatctagcatagcaaaaatagatgtgcataatattgaagacattga

SEQ ID NO: 36771 - DNA, 75 bp, Artificial Sequence
  Synthetic
atgacataatatctactatgacaaaccaactgaattcaaatactgttcctataaaaagaaactggcttcaaggga

SEQ ID NO: 36772 - DNA, 75 bp, Artificial Sequence
  Synthetic
aaacttcaaacaagtctatccctttttaaatatgccaaaacaaaaaacttgccgcacatcaaacctatttacaaa

SEQ ID NO: 36773 - DNA, 75 bp, Artificial Sequence
  Synthetic
ccaactgaattcaaatactgttcctataaaaagaaactggcttcaagggaatttcaattacacctctagctatgt

SEQ ID NO: 36774 - DNA, 75 bp, Artificial Sequence
  Synthetic
ttaaatatgccaaaacaaaaaacttgccgcacatcaaacctatttacaaatatataactatagaaggaaccgaaa

SEQ ID NO: 36775 - DNA, 75 bp, Artificial Sequence
  Synthetic
aaggacatccttaaagaagcaataacatttttagatgggtctatattagttaactctctagtccattcagatgac

SEQ ID NO: 36776 - DNA, 75 bp, Artificial Sequence
  Synthetic
tattgaatcagaagtgcctgcattagctgggacatccattggattcaaaatcaactccaaggagggcaaacattt

SEQ ID NO: 36777 - DNA, 75 bp, Artificial Sequence
  Synthetic
catttttagatgggtctatattagttaactctctagtccattcagatgacaatcaaacatctataacaatagtac

SEQ ID NO: 36778 - DNA, 75 bp, Artificial Sequence
  Synthetic
gctgggacatccattggattcaaaatcaactccaaggagggcaaacatttattagatgttatagcttatgtgaaa

SEQ ID NO: 36779 - DNA, 75 bp, Artificial Sequence
  Synthetic
aatagactttgcaatgagggaattcgaaaaatcatgcctaacctttggatgccaggcgaatatgaaaaagaccta

SEQ ID NO: 36780 - DNA, 75 bp, Artificial Sequence
  Synthetic
caaaattgtattcaaccggcccaacatcaggtgtaaacactaagcatgatgaattgtgcactggcccatgcccag

SEQ ID NO: 36781 - DNA, 75 bp, Artificial Sequence
  Synthetic
gaaaaatcatgcctaacctttggatgccaggcgaatatgaaaaagacctatgtaacaaactgcataaaagagttt

SEQ ID NO: 36782 - DNA, 75 bp, Artificial Sequence
  Synthetic
atcaggtgtaaacactaagcatgatgaattgtgcactggcccatgcccagcaaatattaaccatcaggttggatg

SEQ ID NO: 36783 - DNA, 75 bp, Artificial Sequence
  Synthetic
agcctttctcaatatacggtcgttttttactgacttcggtgggggactgcgcatatataggaccctatgaagatc

SEQ ID NO: 36784 - DNA, 75 bp, Artificial Sequence
  Synthetic
agttcatggggctgtgaagagtttggttgcctagcagtaagtgatggatgcgtatttgggtcatgccaagatata

SEQ ID NO: 36785 - DNA, 75 bp, Artificial Sequence
  Synthetic
tttactgacttcggtgggggactgcgcatatataggaccctatgaagatcttgccagtaggatatcgtctgccca

SEQ ID NO: 36786 - DNA, 75 bp, Artificial Sequence
  Synthetic
gttgcctagcagtaagtgatggatgcgtatttgggtcatgccaagatataataaaagaagagctgtctgtctata

SEQ ID NO: 36787 - DNA, 75 bp, Artificial Sequence
  Synthetic
cccagcttggcatgggtatctatagctatcagccactggatgacttatctaacttataacatgctaccagggcaa

SEQ ID NO: 36788 - DNA, 75 bp, Artificial Sequence
  Synthetic
tgtggagctatgtttaacattctcagacaaaacatactgtacaaatttaaatcccgtcacccctattataacaga

SEQ ID NO: 36789 - DNA, 75 bp, Artificial Sequence
  Synthetic
ctatcagccactggatgacttatctaacttataacatgctaccagggcaatctaatgatccaattgattatttcc

SEQ ID NO: 36790 - DNA, 75 bp, Artificial Sequence
  Synthetic
gacaaaacatactgtacaaatttaaatcccgtcacccctattataacagatctatttgaggtgcaattcaaaact

SEQ ID NO: 36791 - DNA, 75 bp, Artificial Sequence
  Synthetic
tatagaattgaatggcatactagatgcaccgctgtctatgataagcacagttggattagaggctgggaacctgaa

SEQ ID NO: 36792 - DNA, 75 bp, Artificial Sequence
  Synthetic
ttgttgccgtacaaaatcatgagatcaagattggtcaaataaatgatttaggagtgtattctaaagggtgtggaa

SEQ ID NO: 36793 - DNA, 75 bp, Artificial Sequence
  Synthetic
gcaccgctgtctatgataagcacagttggattagaggctgggaacctgaattttttgataagtttactgaataaa

SEQ ID NO: 36794 - DNA, 75 bp, Artificial Sequence
  Synthetic
caagattggtcaaataaatgatttaggagtgtattctaaagggtgtggaaatgttcagaaggtcaatgggaccat

SEQ ID NO: 36795 - DNA, 75 bp, Artificial Sequence
  Synthetic
aatctgtggttaatcagatagcagaagtgagatcatggaaggttgaagaattaacagacaatgaaatatttaagc

SEQ ID NO: 36796 - DNA, 75 bp, Artificial Sequence
  Synthetic
gattacttgtgtcatttagctagtagaaaagaggttattgttaggaaatgttttgataatgactatcaagcatgt

SEQ ID NO: 36797 - DNA, 75 bp, Artificial Sequence
  Synthetic
agtgagatcatggaaggttgaagaattaacagacaatgaaatatttaagctcaaaatattaagatttctggtctt

SEQ ID NO: 36798 - DNA, 75 bp, Artificial Sequence
  Synthetic
gaaaagaggttattgttaggaaatgttttgataatgactatcaagcatgtaaattcctccagagccctgctagtt

SEQ ID NO: 36799 - DNA, 75 bp, Artificial Sequence
  Synthetic
ataatgggggagacaagtgatatgagaggcagatccttactgacgcctagaaaattcacaacagcaggtagcttg

SEQ ID NO: 36800 - DNA, 75 bp, Artificial Sequence
  Synthetic
tgtgactataatcgattacaaaaaaatactaggtacaattaagatgaaggcaattttaggggatgttaaatacaa

SEQ ID NO: 36801 - DNA, 75 bp, Artificial Sequence
  Synthetic
gaggcagatccttactgacgcctagaaaattcacaacagcaggtagcttgaggaaactgtattcatttagtaaat

SEQ ID NO: 36802 - DNA, 75 bp, Artificial Sequence
  Synthetic
atactaggtacaattaagatgaaggcaattttaggggatgttaaatacaaaacatttgctgataatgttgatata

SEQ ID NO: 36803 - DNA, 75 bp, Artificial Sequence
  Synthetic
tggaatggaggagctatttacatatttactggaaaagcctgagctgctagttacaaaaggggaagattccaaaga

SEQ ID NO: 36804 - DNA, 75 bp, Artificial Sequence
  Synthetic
gtattaattgctttgagaatatccactgtgaattgacattgcataccacaattgaagccagctgtccaattaaaa

SEQ ID NO: 36805 - DNA, 75 bp, Artificial Sequence
  Synthetic
ttactggaaaagcctgagctgctagttacaaaaggggaagattccaaagattacatggaatctgtcatttttagg

SEQ ID NO: 36806 - DNA, 75 bp, Artificial Sequence
  Synthetic
ctgtgaattgacattgcataccacaattgaagccagctgtccaattaaaagctcatgcacagtgtttcatgatag

SEQ ID NO: 36807 - DNA, 75 bp, Artificial Sequence
  Synthetic
gcttgtcaattcaaaaccctgctcaattattcatagagcagattttattttcacataaaccagttatagattttt

SEQ ID NO: 36808 - DNA, 75 bp, Artificial Sequence
  Synthetic
aaatatgctttgaaagtagtgtgcactgaaaagccagggaatacgctcacaatcaaagtgtgtaacacaaagatt

SEQ ID NO: 36809 - DNA, 75 bp, Artificial Sequence
  Synthetic
attattcatagagcagattttattttcacataaaccagttatagatttttctgggataagagataagtatataaa

SEQ ID NO: 36810 - DNA, 75 bp, Artificial Sequence
  Synthetic
ctgaaaagccagggaatacgctcacaatcaaagtgtgtaacacaaagattgaagctgcaatggctcttgttgacg

SEQ ID NO: 36811 - DNA, 75 bp, Artificial Sequence
  Synthetic
aaagagccagatatattagggaaagttacatttactgaggcttacagattattaatgaaagatttgtcatcgctc

SEQ ID NO: 36812 - DNA, 75 bp, Artificial Sequence
  Synthetic
ggttgatcaaacagcatacataagggaaaaggatgagagatgtaaaacttggatgtgcagagtacgggacgaagg

SEQ ID NO: 36813 - DNA, 75 bp, Artificial Sequence
  Synthetic
ttacatttactgaggcttacagattattaatgaaagatttgtcatcgctcaccctcacaaatgaagatatacagg

SEQ ID NO: 36814 - DNA, 75 bp, Artificial Sequence
  Synthetic
gaaaaggatgagagatgtaaaacttggatgtgcagagtacgggacgaaggattacaggtcattttggaaccattt

SEQ ID NO: 36815 - DNA, 75 bp, Artificial Sequence
  Synthetic
tgatccattaatgataactatagcaaatactcatgttctgtctatctatggcagtccccagaaaagaatgggaat

SEQ ID NO: 36816 - DNA, 75 bp, Artificial Sequence
  Synthetic
ggatattttatacatttattatatccatagtggcattattagtcatcatttacatcttattgcctatatgtttca

SEQ ID NO: 36817 - DNA, 75 bp, Artificial Sequence
  Synthetic
aatactcatgttctgtctatctatggcagtccccagaaaagaatgggaatgtcatgctccactatgccagaattt

SEQ ID NO: 36818 - DNA, 75 bp, Artificial Sequence
  Synthetic
aattaagagatactctcaggaagcatgaggatgcatataagagagagatgaaaattaggtaaaaagccgtgtgaa

SEQ ID NO: 36819 - DNA, 75 bp, Artificial Sequence
  Synthetic
cccctgcactagtactaagagcgtacagtaaaaacaacccagatgtccaaggtgcagacccaaccgagatggcaa

SEQ ID NO: 36820 - DNA, 75 bp, Artificial Sequence
  Synthetic
cagtaaaaacaacccagatgtccaaggtgcagacccaaccgagatggcaagggacttagtacatttaaaagagtt

SEQ ID NO: 36821 - DNA, 75 bp, Artificial Sequence
  Synthetic
aagatgagattaagaattgcccaaaatgaagtagagaaaggccaaagagatattgtctttgaattaaaggaaatg

SEQ ID NO: 36822 - DNA, 75 bp, Artificial Sequence
  Synthetic
atgaagtagagaaaggccaaagagatattgtctttgaattaaaggaaatgaccagattttatcaagtatgttacg

SEQ ID NO: 36823 - DNA, 75 bp, Artificial Sequence
  Synthetic
aatcaaagtctttattcttccagcaaaagcatatacgacaactgatttctgcgcacttatgcagggaaatctaat

SEQ ID NO: 36824 - DNA, 75 bp, Artificial Sequence
  Synthetic
aaagcatatacgacaactgatttctgcgcacttatgcagggaaatctaataaaagacaaagaatggtatacggta

SEQ ID NO: 36825 - DNA, 75 bp, Artificial Sequence
  Synthetic
gtgggcataaggcaatcatgcaacataatgccacgagtgaacaaaatatagcctttgaatgcttcaagttaattg

SEQ ID NO: 36826 - DNA, 75 bp, Artificial Sequence
  Synthetic
agcctcatcaaggtctgcattcttgcaattaattttagagcaatttagctataaggatgtcagagttcacaaatt

SEQ ID NO: 36827 - DNA, 75 bp, Artificial Sequence
  Synthetic
aatcggacagattttatccccttgctctttaggacaggagatcttaaacaaacagacctagataaatatgatgct

SEQ ID NO: 36828 - DNA, 75 bp, Artificial Sequence
  Synthetic
tctttaggacaggagatcttaaacaaacagacctagataaatatgatgctatgaagagccatgagagagtgacct

SEQ ID NO: 36829 - DNA, 75 bp, Artificial Sequence
  Synthetic
tttagatatgggggttattaatctaacaataactggttacaacaggtccattaccataataggtgaagacaataa

SEQ ID NO: 36830 - DNA, 75 bp, Artificial Sequence
  Synthetic
acaataactggttacaacaggtccattaccataataggtgaagacaataagctaacttatgcagaactctgtata

SEQ ID NO: 36831 - DNA, 75 bp, Artificial Sequence
  Synthetic
ctataagtggcagaaaattacttagttcaagacatgggctaaagttcgagaatatggccaagataccaacttacc

SEQ ID NO: 36832 - DNA, 75 bp, Artificial Sequence
  Synthetic
ttcaagacatgggctaaagttcgagaatatggccaagataccaacttacccaggaaattattatataacttttag

SEQ ID NO: 36833 - DNA, 75 bp, Artificial Sequence
  Synthetic
aattatgctgtaagctggggtcttgttatcattggattgttgaccgggctgctatttaagaaatatcagcacaga

SEQ ID NO: 36834 - DNA, 75 bp, Artificial Sequence
  Synthetic
taccaaatacattcacatgagtcaataactagaagaaacgaagagcatatggcaattagaactagaatctttaac

SEQ ID NO: 36835 - DNA, 75 bp, Artificial Sequence
  Synthetic
taactagaagaaacgaagagcatatggcaattagaactagaatctttaacgaaataacaccagtatgtgttgtta

SEQ ID NO: 36836 - DNA, 75 bp, Artificial Sequence
  Synthetic
gaggatactcataaggaaattagatttcctaaataatgatgtcttcacactatcgagaattaaagtcggcataga

SEQ ID NO: 36837 - DNA, 75 bp, Artificial Sequence
  Synthetic
ttcctaaataatgatgtcttcacactatcgagaattaaagtcggcatagatgagtttgcaactataaaaaaagca

SEQ ID NO: 36838 - DNA, 75 bp, Artificial Sequence
  Synthetic
atggcccccccataaagacaggccttctagatctaacagaactcatgaaatcgcaagacttattgaacttaaact

SEQ ID NO: 36839 - DNA, 75 bp, Artificial Sequence
  Synthetic
tctagatctaacagaactcatgaaatcgcaagacttattgaacttaaactatgacaatatccgaaacagcaattt

SEQ ID NO: 36840 - DNA, 75 bp, Artificial Sequence
  Synthetic
aataacaaggataccagatgatattgcaggtgctttaagatatatagaagaaagggaagatttccatgtccagct

SEQ ID NO: 36841 - DNA, 75 bp, Artificial Sequence
  Synthetic
tgcgagggttcagaagatatagatgatgggctagaattcttatcagatgaccctatgaactttacagagggagaa

SEQ ID NO: 36842 - DNA, 75 bp, Artificial Sequence
  Synthetic
atgggctagaattcttatcagatgaccctatgaactttacagagggagaatcaatacattcaacaccaatattta

SEQ ID NO: 36843 - DNA, 75 bp, Artificial Sequence
  Synthetic
gagccatatgacttacagaaatgcaataaagcaactaatagacagggaaacatcatcattcgaagaagctttcac

SEQ ID NO: 36844 - DNA, 75 bp, Artificial Sequence
  Synthetic
ataaagcaactaatagacagggaaacatcatcattcgaagaagctttcactttcagcacaaatgggtttatatcc

SEQ ID NO: 36845 - DNA, 75 bp, Artificial Sequence
  Synthetic
tatatccaaatcagaatttttgcagatgtgtgaaaaatggtgagaaatgcagcagctctaattgggattttgcca

SEQ ID NO: 36846 - DNA, 75 bp, Artificial Sequence
  Synthetic
caatagtgtcgctaattagaatattaaagactaatgagtggtctacagttatagataaatgcatacatatatgcc

SEQ ID NO: 36847 - DNA, 75 bp, Artificial Sequence
  Synthetic
aaagactaatgagtggtctacagttatagataaatgcatacatatatgcctaatcaaaaacgggatggatcacat

SEQ ID NO: 36848 - DNA, 75 bp, Artificial Sequence
  Synthetic
tgtttcatcgataatcctataaacaggaaggtcgattgggtgatgtatagagaatttataaataacttgcctgct

SEQ ID NO: 36849 - DNA, 75 bp, Artificial Sequence
  Synthetic
ggaaggtcgattgggtgatgtatagagaatttataaataacttgcctgctacaagggttcccccttggaatgtaa

SEQ ID NO: 36850 - DNA, 75 bp, Artificial Sequence
  Synthetic
cctggcactaataaattcaaaactggaaactcaacgggatttttccgaatttgttcaaatgatgaaaaaggaagg

SEQ ID NO: 36851 - DNA, 75 bp, Artificial Sequence
  Synthetic
gaaactcaacgggatttttccgaatttgttcaaatgatgaaaaaggaaggtggtagaggcaatttagaattcgat

SEQ ID NO: 36852 - DNA, 75 bp, Artificial Sequence
  Synthetic
tttcaaatctaaattccaaatttgtagggttgaattggggctaattggggttagggcaaataacagctattgtat

SEQ ID NO: 36853 - DNA, 75 bp, Artificial Sequence
  Synthetic
agggttgaattggggctaattggggttagggcaaataacagctattgtatagatttgtagataggagcacactac

SEQ ID NO: 36854 - DNA, 75 bp, Artificial Sequence
  Synthetic
gtggcgaacccaatggaccaagtgtgtatagaaaaccatcaggcggtgtatttcaatctagcactgatcgatcta

SEQ ID NO: 36855 - DNA, 75 bp, Artificial Sequence
  Synthetic
caagtctgggttgaaaagacatggtgatttcaccaacaaatgcagacagtgcacatgtggtcaatatgaagatgc

SEQ ID NO: 36856 - DNA, 75 bp, Artificial Sequence
  Synthetic
gtcttaaacaaagccaatgatgattttcatattgatactgtttgcagtcagtgctgcaagtccagtatatcaacg

SEQ ID NO: 36857 - DNA, 75 bp, Artificial Sequence
  Synthetic
ttcatattgatactgtttgcagtcagtgctgcaagtccagtatatcaacggtgtttccaagatggggctatagtg

SEQ ID NO: 36858 - DNA, 75 bp, Artificial Sequence
  Synthetic
agcagatccagcatagcgaagatagatgtgcacaatattgaagatattgaacagtataagaaggctataactcaa

SEQ ID NO: 36859 - DNA, 75 bp, Artificial Sequence
  Synthetic
gtgctgcaagtccagtatatcaacggtgtttccaagatggggctatagtgaagcaaaacccatctaaggaggctg

SEQ ID NO: 36860 - DNA, 75 bp, Artificial Sequence
  Synthetic
cgttagcatgataaagacagaagccaggtatgtgaagaatgctacaggaatctattctaacaatgtggcaattag

SEQ ID NO: 36861 - DNA, 75 bp, Artificial Sequence
  Synthetic
tctattctaacaatgtggcaattaggaaatggttagtctcagactggcatgactgcaggcctaggaaagtctcag

SEQ ID NO: 36862 - DNA, 75 bp, Artificial Sequence
  Synthetic
gtggacacattaatgttatagaagttggtgatgatctttcacttcatactgaatcttatgtctgcagtgctgatt

SEQ ID NO: 36863 - DNA, 75 bp, Artificial Sequence
  Synthetic
tcaattctaaagagggcaagcacttgctagatgttatagcatatgtaaaaagcgcctcatactcttcagtgtatg

SEQ ID NO: 36864 - DNA, 75 bp, Artificial Sequence
  Synthetic
tggtgatgatctttcacttcatactgaatcttatgtctgcagtgctgattgcacaattggagtggataaagaaac

SEQ ID NO: 36865 - DNA, 75 bp, Artificial Sequence
  Synthetic
acaacaaaccattttgagatagcaggaacaacagtcaagtccggatggtttaaaagcacaacatacataactcta

SEQ ID NO: 36866 - DNA, 75 bp, Artificial Sequence
  Synthetic
tatcttgtggacctaagtcagttcaattccatgcatgctttaatcaacacatgtcctgcgtcagattcttgcata

SEQ ID NO: 36867 - DNA, 75 bp, Artificial Sequence
  Synthetic
attccatgcatgctttaatcaacacatgtcctgcgtcagattcttgcataggacaattctgcctggatccattgc

SEQ ID NO: 36868 - DNA, 75 bp, Artificial Sequence
  Synthetic
atgtcctgcgtcagattcttgcataggacaattctgcctggatccattgccaactcaatatgccagaatatagaa

SEQ ID NO: 36869 - DNA, 75 bp, Artificial Sequence
  Synthetic
tgtagaactatgtttaacattttcagacaaaacatattgtacaaacttaaaccctgttacccctattataacgga

SEQ ID NO: 36870 - DNA, 75 bp, Artificial Sequence
  Synthetic
tactaatttttgtacttttaagtatattgagtaagacatatatctgttatttactaatgcctatctttattccta

SEQ ID NO: 36871 - DNA, 75 bp, Artificial Sequence
  Synthetic
attgagtaagacatatatctgttatttactaatgcctatctttattcctatagcatatgtgtatggtattattta

SEQ ID NO: 36872 - DNA, 75 bp, Artificial Sequence
  Synthetic
atgttcaaaaggtcaatggaactgtttatggcaatggagttcccagatttgactacctatgccatttagctagca

SEQ ID NO: 36873 - DNA, 75 bp, Artificial Sequence
  Synthetic
ttgtgcgggttagtttaccacccattcacagaatgcgggacacattgtgtatgcggtgctcgctatgatacctcc

SEQ ID NO: 36874 - DNA, 75 bp, Artificial Sequence
  Synthetic
gacagaatgaaattgcacagatcttctggtctatgccctgggtataagagtctaagagctgccagagttatgtgt

SEQ ID NO: 36875 - DNA, 75 bp, Artificial Sequence
  Synthetic
caattttaggagatgtcaaatataaaacatttgctgatagtgtcgatataactgcagaagggtcatgcactggct

SEQ ID NO: 36876 - DNA, 75 bp, Artificial Sequence
  Synthetic
tatcgataattacagcaatactggttctaacttttgtcacaccaataaattcaatggttataggagaaagcaaag

SEQ ID NO: 36877 - DNA, 75 bp, Artificial Sequence
  Synthetic
tctaacttttgtcacaccaataaattcaatggttataggagaaagcaaagaggtctttgaattagaagagctccc

SEQ ID NO: 36878 - DNA, 75 bp, Artificial Sequence
  Synthetic
aagattaatctttattattttgtttgtgttatgaattatgctgtgacttggagcctcgtaattgttgccttgcta

SEQ ID NO: 36879 - DNA, 75 bp, Artificial Sequence
  Synthetic
gtgttatgaattatgctgtgacttggagcctcgtaattgttgccttgctaattgcgttaatattcaaaaagtacc

SEQ ID NO: 36880 - DNA, 75 bp, Artificial Sequence
  Synthetic
aatgtactgtgaggaatgtgacatgtatcatgatagaatcggcttgaagaggaatggagatttcacaaacaaatg

SEQ ID NO: 36881 - DNA, 75 bp, Artificial Sequence
  Synthetic
ggaatggagatttcacaaacaaatgcaggcaatgtacatgcggacagtatgaggatgctactgggctaatgacac

SEQ ID NO: 36882 - DNA, 75 bp, Artificial Sequence
  Synthetic
gcaatataagtctaagtggattttgaatttcttgataacttatatggtcttaactctgattaaggactcggctat

SEQ ID NO: 36883 - DNA, 75 bp, Artificial Sequence
  Synthetic
tttagtgcttgtttagaagcacagagtgtggattggaattgcacagggccatttttaaacctcggaaattgccaa

SEQ ID NO: 36884 - DNA, 75 bp, Artificial Sequence
  Synthetic
gtgtggattggaattgcacagggccatttttaaacctcggaaattgccaaaaacagcagaaaaaggagtcctatg

SEQ ID NO: 36885 - DNA, 75 bp, Artificial Sequence
  Synthetic
atttttaaacctcggaaattgccaaaaacagcagaaaaaggagtcctatgcaaatattgccacacaactcaaagg

SEQ ID NO: 36886 - DNA, 75 bp, Artificial Sequence
  Synthetic
gcacgagttgatcagaacaactattatcaacccaattgctgagtctaatggtgtgggatgggatagtgggccaga

SEQ ID NO: 36887 - DNA, 75 bp, Artificial Sequence
  Synthetic
gtgtgggatgggatagtgggccagagatctatctatcatttttcccaggaacagaaatgtttttggaaactttca

SEQ ID NO: 36888 - DNA, 75 bp, Artificial Sequence
  Synthetic
cacacaatttgcagataattctggttatagtcagacgacatggagggtttatttgagatcacacgattttgatgc

SEQ ID NO: 36889 - DNA, 75 bp, Artificial Sequence
  Synthetic
ttttgcaaatgagatgaagaactactactcaggaaagcaaaacaaatttgataaagatttaaatttggccctgat

SEQ ID NO: 36890 - DNA, 75 bp, Artificial Sequence
  Synthetic
tactcaggaaagcaaaacaaatttgataaagatttaaatttggccctgatggcagtacaccatgcattcagaggt

SEQ ID NO: 36891 - DNA, 75 bp, Artificial Sequence
  Synthetic
aaggaaaagttccctggaaatgctttattgaaagctataatggattatatatcatacatgaagggcttatcagaa

SEQ ID NO: 36892 - DNA, 75 bp, Artificial Sequence
  Synthetic
tctgggatgaccttctgcacaagccaagccccacaaatgcccctcctctgtcaagagatagtgaaccatcataca

SEQ ID NO: 36893 - DNA, 75 bp, Artificial Sequence
  Synthetic
acttcaagtcagttatttcctcaagatctgtgaaaagctgcaaaaatgtcaaaaatgtagtgtgtttgtcaccta

SEQ ID NO: 36894 - DNA, 75 bp, Artificial Sequence
  Synthetic
attggcatgcggtgaaccaaatggaccgagtgtgtacaagaagccatctgatggtgtatttcagtccaattcgga

SEQ ID NO: 36895 - DNA, 75 bp, Artificial Sequence
  Synthetic
ccgagtgtgtacaagaagccatctgatggtgtatttcagtccaattcggacaagacaatgtattgcttagctgat

SEQ ID NO: 36896 - DNA, 75 bp, Artificial Sequence
  Synthetic
tggttagtcaggaagaattagatgctataaaaaagtccaagtgttgggtaacagaataccctaatgtaaaattgt

SEQ ID NO: 36897 - DNA, 75 bp, Artificial Sequence
  Synthetic
acagaataccctaatgtaaaattgtccaaattgagtgatgggatcacaagctgcagaatgaaagattcagggaaa

SEQ ID NO: 36898 - DNA, 75 bp, Artificial Sequence
  Synthetic
attctattactcagaattacagaatgattacgataaaacgcaggatatcggacatttttgccttagtccaggatg

SEQ ID NO: 36899 - DNA, 75 bp, Artificial Sequence
  Synthetic
gacatttttgccttagtccaggatgctctacaatccggttcccaattaaccagaagcatatatctaactgtaatt

SEQ ID NO: 36900 - DNA, 75 bp, Artificial Sequence
  Synthetic
aaaaattgatgtgcatgacattgaggacattgatcagtatagaaaggccataactcagaaacttcaaactggtct

SEQ ID NO: 36901 - DNA, 75 bp, Artificial Sequence
  Synthetic
gacattgatcagtatagaaaggccataactcagaaacttcaaactggtctctcattatttaaatatgctaagaca

SEQ ID NO: 36902 - DNA, 75 bp, Artificial Sequence
  Synthetic
tttacaaatatataactattgaaggaactgagactgctgaaggcatagaaagtgcatatattgaatctgagatac

SEQ ID NO: 36903 - DNA, 75 bp, Artificial Sequence
  Synthetic
aactgagactgctgaaggcatagaaagtgcatatattgaatctgagatacctgcattagctgggacatcaattgg

SEQ ID NO: 36904 - DNA, 75 bp, Artificial Sequence
  Synthetic
aagcatttattggatattgttggttatgtcaaaagtgcatcatattcatctgtgtatacaaagctttactcgaca

SEQ ID NO: 36905 - DNA, 75 bp, Artificial Sequence
  Synthetic
tgtgtatacaaagctttactcgacaggtccaacatcaggaataaatacgaaacatgatgagctatgcactgggcc

SEQ ID NO: 36906 - DNA, 75 bp, Artificial Sequence
  Synthetic
acaggatggttgacctttgcgaaagaaagaacaagctcatggggctgtgaagaatttggttgccttgctattagt

SEQ ID NO: 36907 - DNA, 75 bp, Artificial Sequence
  Synthetic
aggatatagtgagagatgaattgtcagtatataggaaagagacagaagaagtaacagatgtagaactttgtctaa

SEQ ID NO: 36908 - DNA, 75 bp, Artificial Sequence
  Synthetic
gtaacagatgtagaactttgtctaaccttctcagacaagacttactgtacaaatttaaatcctataacgccaatc

SEQ ID NO: 36909 - DNA, 75 bp, Artificial Sequence
  Synthetic
aaatttaaatcctataacgccaatcataacagacttatttgaggtccagttcaaaactgtggaaacttacagctt

SEQ ID NO: 36910 - DNA, 75 bp, Artificial Sequence
  Synthetic
ctgatgaaaaatatcttatctgtgtcccaatataacagacacaacacatttaggatagctatgtgtgctaataac

SEQ ID NO: 36911 - DNA, 75 bp, Artificial Sequence
  Synthetic
ttgtggtaacgttcaaaaagtaaatgggacagtttatggcaatggagtcccaaaatttgattacttgtgtcatct

SEQ ID NO: 36912 - DNA, 75 bp, Artificial Sequence
  Synthetic
agcaagctacagactagaggaaaatagtggcacagtgactgttattgattataaaaaaatattggggacaatcaa

SEQ ID NO: 36913 - DNA, 75 bp, Artificial Sequence
  Synthetic
aagtataaaacttttgcagataatgtagacatgactgctgagggatcatgtgccgggtgcataaattgttttgaa

SEQ ID NO: 36914 - DNA, 75 bp, Artificial Sequence
  Synthetic
atacaacaatagatgcaagttgtcctgttacaagcccgtgcacagtatttcatgataggatactaataaccccaa

SEQ ID NO: 36915 - DNA, 75 bp, Artificial Sequence
  Synthetic
tgttacaagcccgtgcacagtatttcatgataggatactaataaccccaaatgagcataagtatgcaatgaaagt

SEQ ID NO: 36916 - DNA, 75 bp, Artificial Sequence
  Synthetic
gatgaaggcttgcaggtcatcttagaacccttcaagaacttatttggttcttatatagggatattttatactttt

SEQ ID NO: 36917 - DNA, 75 bp, Artificial Sequence
  Synthetic
agatgaacaagtgtgccttgaagttgggcactgcaattatgagatgctgaggaatgctatgccgaattatacaga

SEQ ID NO: 36918 - DNA, 75 bp, Artificial Sequence
  Synthetic
ttgtttttacctaagggaattacttggaagtgtaatgtcagatttagtgttttatgatgtcgcatcaacaggtgc

SEQ ID NO: 36919 - DNA, 75 bp, Artificial Sequence
  Synthetic
ggaagtgtaatgtcagatttagtgttttatgatgtcgcatcaacaggtgcaaatggatttgatcctgatgaagga

SEQ ID NO: 36920 - DNA, 75 bp, Artificial Sequence
  Synthetic
cagaatcgatcaatcttgctgcagttaggatcttcttcctcaatgccgcaaaagccaaggctgctctcgcgcgta

SEQ ID NO: 36921 - DNA, 75 bp, Artificial Sequence
  Synthetic
atgcagttgagaggatagcaaaagagagatgtaaattaaatcctgatgaaatgatatctgagccaggggatggca

SEQ ID NO: 36922 - DNA, 75 bp, Artificial Sequence
  Synthetic
ggaacaatccaattggtaacaacgatcttaccgtccacagattgtcaggatatctagccagatgggttcttgagc

SEQ ID NO: 36923 - DNA, 75 bp, Artificial Sequence
  Synthetic
tcagcgcgagttgattaagacaactgtcatcaacccgattgctgaatctaatggggtaagatgggatagtgggcc

SEQ ID NO: 36924 - DNA, 75 bp, Artificial Sequence
  Synthetic
ggaacagagatgtttttggaaacattcaaattttatccgctgaccattggaatatacagagtcaagcagggaatg

SEQ ID NO: 36925 - DNA, 75 bp, Artificial Sequence
  Synthetic
tcaaattttatccgctgaccattggaatatacagagtcaagcagggaatgatggatcctcagtacctgaagaagg

SEQ ID NO: 36926 - DNA, 75 bp, Artificial Sequence
  Synthetic
aatatacagagtcaagcagggaatgatggatcctcagtacctgaagaaggcattgagacagcgctatggcacatt

SEQ ID NO: 36927 - DNA, 75 bp, Artificial Sequence
  Synthetic
ccatagctgcgcaatgtctgtgtataaagaaatattgaaagaggccataacattactggacggatctatattagt

SEQ ID NO: 36928 - DNA, 75 bp, Artificial Sequence
  Synthetic
aaggtgacggctattgctaagagcttgaaggaagtggaacagcttaagtggggaagaggagggctgagcgacact

SEQ ID NO: 36929 - DNA, 75 bp, Artificial Sequence
  Synthetic
tgaaggaagtggaacagcttaagtggggaagaggagggctgagcgacactgcaaggacattcctgcagaagtttg

SEQ ID NO: 36930 - DNA, 75 bp, Artificial Sequence
  Synthetic
ttggggtgctgtaaattaggttttaaattcgaaattttgcattaatttggttcaattggctatccaaaagggttt

SEQ ID NO: 36931 - DNA, 75 bp, Artificial Sequence
  Synthetic
tgaataatggaccaccaagagtatcaacaattcctggccagaataaatgctgccagggatgcttgcattgccaaa

SEQ ID NO: 36932 - DNA, 75 bp, Artificial Sequence
  Synthetic
cagcagaaaatagaaaggacatccctatagaattaaatggcgtattagatgctccgctgtcaatgattagtacag

SEQ ID NO: 36933 - DNA, 75 bp, Artificial Sequence
  Synthetic
gatatagatgttgatttgttaatggccaggcatgactactttgggaaagaattatgcaaatctttgaatatagaa

SEQ ID NO: 36934 - DNA, 75 bp, Artificial Sequence
  Synthetic
ccaggcatgactactttgggaaagaattatgcaaatctttgaatatagaatatagaaacgatgttccatttattg

SEQ ID NO: 36935 - DNA, 75 bp, Artificial Sequence
  Synthetic
ggtagatccattaactttggatgcgccgcatatcacccctgacaattacctgtatataaacaatatcttatatat

SEQ ID NO: 36936 - DNA, 75 bp, Artificial Sequence
  Synthetic
aagctccgatagatttaaagaaatatatcccacactagttgtagatatcaactttaatcagttttttgacttaaa

SEQ ID NO: 36937 - DNA, 75 bp, Artificial Sequence
  Synthetic
agccccatggtgtaaaacaggctgcccagatttctggaaacacccaatatacaaggaatttaagatgagtatgcc

SEQ ID NO: 36938 - DNA, 75 bp, Artificial Sequence
  Synthetic
gaatctgtaagatttaatgcttatgaatctgaaaggtggaatactaatctagttaaagtgagagaatatacaaaa

SEQ ID NO: 36939 - DNA, 75 bp, Artificial Sequence
  Synthetic
aatctgcaaagaatatattcttagcaactggatgttataaacaaccaaataagaatgagatcagtaatgggtggg

SEQ ID NO: 36940 - DNA, 75 bp, Artificial Sequence
  Synthetic
aactggatgttataaacaaccaaataagaatgagatcagtaatgggtgggccttaatgatagaaagggtacaaga

SEQ ID NO: 36941 - DNA, 75 bp, Artificial Sequence
  Synthetic
cacgatcagaaaccaagcatacattttatatggggggctcataacccaggaaatagcaataatgcaacgtttaag

SEQ ID NO: 36942 - DNA, 75 bp, Artificial Sequence
  Synthetic
agagtataaaaggattatctacttacactgaggcttttaaatcattaggaaaaatgatggatataggtgataaaa

SEQ ID NO: 36943 - DNA, 75 bp, Artificial Sequence
  Synthetic
cactgaggcttttaaatcattaggaaaaatgatggatataggtgataaaataagtgagtatgaagaattttgtgt

SEQ ID NO: 36944 - DNA, 75 bp, Artificial Sequence
  Synthetic
tcatggaagcaaataatgaataaaaagttagagccaaaacagataaataatgctcttgttttatgggaacagcaa

SEQ ID NO: 36945 - DNA, 75 bp, Artificial Sequence
  Synthetic
tttatggtgaataatgatttgatagataaaaacgagaagttgaagctgttcaaaaacttctgtggtatagggaag

SEQ ID NO: 36946 - DNA, 75 bp, Artificial Sequence
  Synthetic
ttgacgatgtagacatttcaaagcctaagatattggattttgatgatcctgatatgtacctagcaagtttaacca

SEQ ID NO: 36947 - DNA, 75 bp, Artificial Sequence
  Synthetic
taagatattggattttgatgatcctgatatgtacctagcaagtttaaccatgatggaacaaagtaagagaatact

SEQ ID NO: 36948 - DNA, 75 bp, Artificial Sequence
  Synthetic
gataactttatattgaatgaattcggctcaagaattaaagatgccaataaggaaacatatgaaaatatgcataaa

SEQ ID NO: 36949 - DNA, 75 bp, Artificial Sequence
  Synthetic
tataataggcataatacattcagaattgctatgtgtgcaaataataatgtatttgctatagtattcccatctgca

SEQ ID NO: 36950 - DNA, 75 bp, Artificial Sequence
  Synthetic
tagtttatagtataatagttctacataaggaagaagatagcatatttaacccaggatgccttcatggtacattta

SEQ ID NO: 36951 - DNA, 75 bp, Artificial Sequence
  Synthetic
ttctagagctataagattggataaagaaagatgccagcgcatcgtatcatctccaggactgtttttaactacttg

SEQ ID NO: 36952 - DNA, 75 bp, Artificial Sequence
  Synthetic
atatatattactcaaaaagaggagaaagacatatgacatacagaaatgcaattaaattactgatagagagagaaa

SEQ ID NO: 36953 - DNA, 75 bp, Artificial Sequence
  Synthetic
gaaagatgccagcgcatcgtatcatctccaggactgtttttaactacttgcttgttgttcaaacatgacaaccct

SEQ ID NO: 36954 - DNA, 75 bp, Artificial Sequence
  Synthetic
acttttcaattttcactagtctatctataacaaaaagtgttttatctctaacagagcctgcacgctatatgatta

SEQ ID NO: 36955 - DNA, 75 bp, Artificial Sequence
  Synthetic
tgttaaggattatatagcagagaaattttcaccatatactaagaccctatttagtgtttatatgaccagattgat

SEQ ID NO: 36956 - DNA, 75 bp, Artificial Sequence
  Synthetic
gagatatatacttatctgattacgatataacccaaaaagggataaaagacaacagagagttaataagcatatggt

SEQ ID NO: 36957 - DNA, 75 bp, Artificial Sequence
  Synthetic
gtacttgacacaaatatacctaccattttactttaatgcaaagggattgcatgaaaaacaccatgttatgataga

SEQ ID NO: 36958 - DNA, 75 bp, Artificial Sequence
  Synthetic
accaacaattcctagctaggattaatgctgcaagagatgcatgtgttgccaaagatatagatgtcgatctattaa

SEQ ID NO: 36959 - DNA, 75 bp, Artificial Sequence
  Synthetic
tgctgcaagagatgcatgtgttgccaaagatatagatgtcgatctattaatggccagacatgacttcttcggaaa

SEQ ID NO: 36960 - DNA, 75 bp, Artificial Sequence
  Synthetic
ttttactttaatgcaaagggattgcatgaaaaacaccatgttatgatagacttagccaagactatattggagata

SEQ ID NO: 36961 - DNA, 75 bp, Artificial Sequence
  Synthetic
atatgagtaatggaccatcaagaataccaacaattcctagctaggattaatgctgcaagagatgcatgtgttgcc

SEQ ID NO: 36962 - DNA, 75 bp, Artificial Sequence
  Synthetic
gaatatagaaatgatgtaccctttatagatataatattagatataagaccagaaatagatccactaactatagat

SEQ ID NO: 36963 - DNA, 75 bp, Artificial Sequence
  Synthetic
tagatataatattagatataagaccagaaatagatccactaactatagatgcaccgcatattactccagacaact

SEQ ID NO: 36964 - DNA, 75 bp, Artificial Sequence
  Synthetic
aggaataattttagaaggtcaataactactatatcaacattcacgagctcaaaatcgtgcctcaagataggtgat

SEQ ID NO: 36965 - DNA, 75 bp, Artificial Sequence
  Synthetic
tatcatcgattataaggtttcagtctcaaatgagagtagcgtaataacatatgacaagtactacgaattaactag

SEQ ID NO: 36966 - DNA, 75 bp, Artificial Sequence
  Synthetic
ctactatatcaacattcacgagctcaaaatcgtgcctcaagataggtgatttcagaaaggagaaagagatgcagt

SEQ ID NO: 36967 - DNA, 75 bp, Artificial Sequence
  Synthetic
tcaaatgagagtagcgtaataacatatgacaagtactacgaattaactagagatatatctgcaagactaaatatt

SEQ ID NO: 36968 - DNA, 75 bp, Artificial Sequence
  Synthetic
aacagaaagtaggaagagaaggttagcaaatcctatgtttgtcgcagatgagcaggtatcccttgaggttgggca

SEQ ID NO: 36969 - DNA, 75 bp, Artificial Sequence
  Synthetic
gcaaatcctatgtttgtcgcagatgagcaggtatcccttgaggttgggcattgtaattatggaatgctaagagaa

SEQ ID NO: 36970 - DNA, 75 bp, Artificial Sequence
  Synthetic
tagatcctgtaagcagggacctgcatattagttccgatagatttaaagaaatatatcctacattggtagttgata

SEQ ID NO: 36971 - DNA, 75 bp, Artificial Sequence
  Synthetic
tattagttccgatagatttaaagaaatatatcctacattggtagttgatataaattttaatcaattctttgatct

SEQ ID NO: 36972 - DNA, 75 bp, Artificial Sequence
  Synthetic
ggtgacgatgaagaattccttctaaaagtggcacatggtgactttactctcactgcaccttggtgcaagacagga

SEQ ID NO: 36973 - DNA, 75 bp, Artificial Sequence
  Synthetic
aagtggcacatggtgactttactctcactgcaccttggtgcaagacaggatgtgcagagttttggaaacatccaa

SEQ ID NO: 36974 - DNA, 75 bp, Artificial Sequence
  Synthetic
aacaaagggcagaaaacgtctaaagatagagagatttttgtaggagaatatgaagcaaaaatgtgtatgtatgcc

SEQ ID NO: 36975 - DNA, 75 bp, Artificial Sequence
  Synthetic
gcctgtacctgagcgcagactctttgaagattcagttagattcaatgcctatgaatcagaaaggtggaatacaaa

SEQ ID NO: 36976 - DNA, 75 bp, Artificial Sequence
  Synthetic
tgaagcaaaaatgtgtatgtatgccgtagaaagaatagcgaaggagagatgcaaattgaatccagatgaaatgat

SEQ ID NO: 36977 - DNA, 75 bp, Artificial Sequence
  Synthetic
gaagattcagttagattcaatgcctatgaatcagaaaggtggaatacaaatctagtaaaagtgagggaatacaca

SEQ ID NO: 36978 - DNA, 75 bp, Artificial Sequence
  Synthetic
atctgaacctggagatggtaagctaaaagtcttagagcaaaagtcagaacaagaaattagatttttagtggaaac

SEQ ID NO: 36979 - DNA, 75 bp, Artificial Sequence
  Synthetic
caaaatctgcaaaaaatattttcttagctaccggattttataagcaaccgaacaaaaatgaaattagtgatggat

SEQ ID NO: 36980 - DNA, 75 bp, Artificial Sequence
  Synthetic
agctaccggattttataagcaaccgaacaaaaatgaaattagtgatggatggacattgatggtcgagagggttca

SEQ ID NO: 36981 - DNA, 75 bp, Artificial Sequence
  Synthetic
aacaagacagaagaatagagagattgatgaggcaatagaagcactagctgcagaaggttatgaaaacaatttaaa

SEQ ID NO: 36982 - DNA, 75 bp, Artificial Sequence
  Synthetic
ctgcatgatcagaagcctagtatacacttcatatggggagcccataacccggggaacagtaataatgcgactttc

SEQ ID NO: 36983 - DNA, 75 bp, Artificial Sequence
  Synthetic
aaggcaagaggtctaaaaatggaaataaatgcagatatgtcaaaatggagtgctcaagatgtcttctacaaatac

SEQ ID NO: 36984 - DNA, 75 bp, Artificial Sequence
  Synthetic
acttcatatggggagcccataacccggggaacagtaataatgcgactttcaaacttatactattatcaaaatcgt

SEQ ID NO: 36985 - DNA, 75 bp, Artificial Sequence
  Synthetic
ttacacagaagcttttaaatcactaggaaaaatgatggatataggtgataaagcaagtgagtatgaagaattctg

SEQ ID NO: 36986 - DNA, 75 bp, Artificial Sequence
  Synthetic
ggaaaaatgatggatataggtgataaagcaagtgagtatgaagaattctgtgtttctctaaaaaataaggcaaga

SEQ ID NO: 36987 - DNA, 75 bp, Artificial Sequence
  Synthetic
aaaaacttgaaccaaagcaaataaataatgcccttgtgctgtgggaacagcaattcatggtgaataacgacttga

SEQ ID NO: 36988 - DNA, 75 bp, Artificial Sequence
  Synthetic
tgaattctaacaccgttcctatcaagagaaactggctccagggtaacttcaattatacatctagctatgtgcaca

SEQ ID NO: 36989 - DNA, 75 bp, Artificial Sequence
  Synthetic
gagaaactggctccagggtaacttcaattatacatctagctatgtgcacagttgtgccatgtcagtatacaagga

SEQ ID NO: 36990 - DNA, 75 bp, Artificial Sequence
  Synthetic
taatgcccttgtgctgtgggaacagcaattcatggtgaataacgacttgatagataaaaatgaaaaattaaaatt

SEQ ID NO: 36991 - DNA, 75 bp, Artificial Sequence
  Synthetic
aagcacaagcaattcaaaaacaaaatgctagaagatatagacacatctaagccaaaaatattagattttgatgat

SEQ ID NO: 36992 - DNA, 75 bp, Artificial Sequence
  Synthetic
tgctagaagatatagacacatctaagccaaaaatattagattttgatgatgcaaatatgtacttagcaagcttaa

SEQ ID NO: 36993 - DNA, 75 bp, Artificial Sequence
  Synthetic
attttgctatgaaggaatttgaaaaggcatgcttgacctttggctgccaagcaaatatgaaaaagacttatgtaa

SEQ ID NO: 36994 - DNA, 75 bp, Artificial Sequence
  Synthetic
attgtccaaagacagtgggttaaaaccagacaacttcatactgaacgaatttggatctaggataaaagatgcaaa

SEQ ID NO: 36995 - DNA, 75 bp, Artificial Sequence
  Synthetic
ccagacaacttcatactgaacgaatttggatctaggataaaagatgcaaataaagaaacttatgaaaatatgcat

SEQ ID NO: 36996 - DNA, 75 bp, Artificial Sequence
  Synthetic
actattcaatttgtatggtgaacctttttccatatatgggagattcttattaacatctgtaggagattgtgcata

SEQ ID NO: 36997 - DNA, 75 bp, Artificial Sequence
  Synthetic
ttttccatatatgggagattcttattaacatctgtaggagattgtgcatatataggaccatacgaagatttagca

SEQ ID NO: 36998 - DNA, 75 bp, Artificial Sequence
  Synthetic
aatgtatttctgacttttcaactttaatgaaaaatatattatcagtatcccaatacaataggcataacaccttca

SEQ ID NO: 36999 - DNA, 75 bp, Artificial Sequence
  Synthetic
aatgaaaaatatattatcagtatcccaatacaataggcataacaccttcaggattgccatgtgtgccaacaataa

SEQ ID NO: 37000 - DNA, 75 bp, Artificial Sequence
  Synthetic
gcagatatcaagacaaagaaagcaacagttgtttatagcattattgtcttacacaaagaagaagacaatatattc

SEQ ID NO: 37001 - DNA, 75 bp, Artificial Sequence
  Synthetic
cagttgtttatagcattattgtcttacacaaagaagaagacaatatattcaatccaggctgtctccacggcacat

SEQ ID NO: 37002 - DNA, 75 bp, Artificial Sequence
  Synthetic
gagaataggagggagatacctattgaactaaatggcgtattggatgcccctctttcaatgattagtacagttggt

SEQ ID NO: 37003 - DNA, 75 bp, Artificial Sequence
  Synthetic
tatatctagagcaataagactagataaagagagatgccaacgtatagtgtcatcacctggcttgttcttaacaac

SEQ ID NO: 37004 - DNA, 75 bp, Artificial Sequence
  Synthetic
aactaaatggcgtattggatgcccctctttcaatgattagtacagttggtctagaatcagggaatctgtatttct

SEQ ID NO: 37005 - DNA, 75 bp, Artificial Sequence
  Synthetic
aaagagagatgccaacgtatagtgtcatcacctggcttgttcttaacaacatgcttgctattcaaacatgataat

SEQ ID NO: 37006 - DNA, 75 bp, Artificial Sequence
  Synthetic
accagttatgtctaagagagagtcggtagtcaaccagatagcagaggtaaaaaattggaagatcgatgacctaac

SEQ ID NO: 37007 - DNA, 75 bp, Artificial Sequence
  Synthetic
tgaatttctctatattcaccagcttatcaataacaaaaagcgtcttatctttaacagaacccgcacgatacatga

SEQ ID NO: 37008 - DNA, 75 bp, Artificial Sequence
  Synthetic
atcaataacaaaaagcgtcttatctttaacagaacccgcacgatacatgattatgaattccttagccatttctag

SEQ ID NO: 37009 - DNA, 75 bp, Artificial Sequence
  Synthetic
atacttaggtacttagtgttagatgccgaaatggatccaagcgatatcatgggtgaaacaagtgatatgagagga

SEQ ID NO: 37010 - DNA, 75 bp, Artificial Sequence
  Synthetic
ccgaaatggatccaagcgatatcatgggtgaaacaagtgatatgagaggaagatctatactgacacctagaaagt

SEQ ID NO: 37011 - DNA, 75 bp, Artificial Sequence
  Synthetic
aaattctctccatatactaaaacattatttagtgtttatatgactagactaattaagaatgcttgctttgatgct

SEQ ID NO: 37012 - DNA, 75 bp, Artificial Sequence
  Synthetic
tatttagtgtttatatgactagactaattaagaatgcttgctttgatgcttatgaccaaagacagcatgttcagc

SEQ ID NO: 37013 - DNA, 75 bp, Artificial Sequence
  Synthetic
actgtattcatttggtaagtatcaagatagactatcatcccctggtggcatgcttgaactctttacttatctact

SEQ ID NO: 37014 - DNA, 75 bp, Artificial Sequence
  Synthetic
tgatataactcagaaaggcattaaagacaaccgggagttgacaagtatatggtttcctgggagtgtaacattaaa

SEQ ID NO: 37015 - DNA, 75 bp, Artificial Sequence
  Synthetic
gacaaccgggagttgacaagtatatggtttcctgggagtgtaacattaaaagaatatttaacacagatatacctg

SEQ ID NO: 37016 - DNA, 75 bp, Artificial Sequence
  Synthetic
ttccaaaagattcaaggagagtctatccattcaaaatccagcacaattattcatagagcagatactcttctcgca

SEQ ID NO: 37017 - DNA, 75 bp, Artificial Sequence
  Synthetic
ttcatgagaagcaccatgtaatgatagacttagccaagacgatattggagatagaatgcgagcaaagggagaata

SEQ ID NO: 37018 - DNA, 75 bp, Artificial Sequence
  Synthetic
agacttagccaagacgatattggagatagaatgcgagcaaagggagaatataaaagagatatggtcgacaaattg

SEQ ID NO: 37019 - DNA, 75 bp, Artificial Sequence
  Synthetic
atactacttcactccctgtgtaaaaatctacttgcagatacttccaggcataatcatcttcgcaatcgaatcgaa

SEQ ID NO: 37020 - DNA, 75 bp, Artificial Sequence
  Synthetic
gccagatatattaggaaaagtgacctttacggaagcatacagactgctgattagagatttaactactttggattt

SEQ ID NO: 37021 - DNA, 75 bp, Artificial Sequence
  Synthetic
atctacttgcagatacttccaggcataatcatcttcgcaatcgaatcgaaaataggaataactttaggaggtcaa

SEQ ID NO: 37022 - DNA, 75 bp, Artificial Sequence
  Synthetic
ctcaaagtcgtgccttaaaataggcgatttcaggaaagaaaaagaaatgcagtcggttaagcaaaagaagattct

SEQ ID NO: 37023 - DNA, 75 bp, Artificial Sequence
  Synthetic
gatttcaggaaagaaaaagaaatgcagtcggttaagcaaaagaagattctagaaacagaaagccgcaagagaaga

SEQ ID NO: 37024 - DNA, 75 bp, Artificial Sequence
  Synthetic
tttaaaattaattcatcattctccagccctggttttaagagcatatagtaaaaataatccagatgttcagggtgc

SEQ ID NO: 37025 - DNA, 75 bp, Artificial Sequence
  Synthetic
atgagcaagtatcccttgaagttgggcattgcaactatgggatgctaagggaggctatgccaaattacactgatt

SEQ ID NO: 37026 - DNA, 75 bp, Artificial Sequence
  Synthetic
aaaataatccagatgttcagggtgctgatccaacagaaatggctagagacttaatccatcttaaagagtttgttg

SEQ ID NO: 37027 - DNA, 75 bp, Artificial Sequence
  Synthetic
gcattgcaactatgggatgctaagggaggctatgccaaattacactgattatatttcgaccaaggtttttgatag

SEQ ID NO: 37028 - DNA, 75 bp, Artificial Sequence
  Synthetic
ttaatccatcttaaagagtttgttgagaacacaggcttggaggaaaaaatgaaagccagaatatcactaaatgag

SEQ ID NO: 37029 - DNA, 75 bp, Artificial Sequence
  Synthetic
gaaagccagaatatcactaaatgaggcagaaaaagggcaaagggatattgtttttgaactaaaagagatgactag

SEQ ID NO: 37030 - DNA, 75 bp, Artificial Sequence
  Synthetic
gttttaactgacaagcctgtcatagagcaaataatggacacaatggttaatcacaaaaagttttacttcacattc

SEQ ID NO: 37031 - DNA, 75 bp, Artificial Sequence
  Synthetic
agcaaataatggacacaatggttaatcacaaaaagttttacttcacattcttcaacaaagggcaaaagacatcaa

SEQ ID NO: 37032 - DNA, 75 bp, Artificial Sequence
  Synthetic
gtaaagtcaacagagcataaaataaaagtatttattcttccagcaaaatcttacacaactacagacttttgctca

SEQ ID NO: 37033 - DNA, 75 bp, Artificial Sequence
  Synthetic
atatgaagctaaaatgtgtatgtatgctgttgagagaattgctaaggagagatgcaaattgaatccggatgaaat

SEQ ID NO: 37034 - DNA, 75 bp, Artificial Sequence
  Synthetic
gctgttgagagaattgctaaggagagatgcaaattgaatccggatgaaatgatatctgagccaggagatggtaag

SEQ ID NO: 37035 - DNA, 75 bp, Artificial Sequence
  Synthetic
acaaagagtggtatacagtccattatttgaagcagatcttgtctggaggacacaaagctataatgcagcacaatg

SEQ ID NO: 37036 - DNA, 75 bp, Artificial Sequence
  Synthetic
agcaagaaattagattcttggtggaaactacaaggcaaaaaaacagagagatagatgaagcaattgaagccttgg

SEQ ID NO: 37037 - DNA, 75 bp, Artificial Sequence
  Synthetic
aactacaaggcaaaaaaacagagagatagatgaagcaattgaagccttggctgcggagggatatgaagccaactt

SEQ ID NO: 37038 - DNA, 75 bp, Artificial Sequence
  Synthetic
aatactagatgaattcagctataaggatgttcgagttagtaaactttatgacacaataaagaatggccacaatcg

SEQ ID NO: 37039 - DNA, 75 bp, Artificial Sequence
  Synthetic
agcaaagcaaagggtttgaaaatggaaatcaatgcagacatgtcgaaatggagtgcacaagatgtcttctataaa

SEQ ID NO: 37040 - DNA, 75 bp, Artificial Sequence
  Synthetic
aaatcaatgcagacatgtcgaaatggagtgcacaagatgtcttctataaatacttttggcttatagctttagatc

SEQ ID NO: 37041 - DNA, 75 bp, Artificial Sequence
  Synthetic
gagaatattatatttcatgtgcaattatatggaaaaagaattgatcctgccagatgaactactcttcaacctgtt

SEQ ID NO: 37042 - DNA, 75 bp, Artificial Sequence
  Synthetic
aagtcatgagagggttacgtggaatgattggcaaacatctcgccacttagatatgggtagcataaatttaacaat

SEQ ID NO: 37043 - DNA, 75 bp, Artificial Sequence
  Synthetic
tatatggaaaaagaattgatcctgccagatgaactactcttcaacctgttggatcaaaaagttgtatatcaaaat

SEQ ID NO: 37044 - DNA, 75 bp, Artificial Sequence
  Synthetic
aacttaattctaacacagtaccaattaaaaggaattggctccagggaaactttaattatacatcgagctatgtcc

SEQ ID NO: 37045 - DNA, 75 bp, Artificial Sequence
  Synthetic
taaaaggaattggctccagggaaactttaattatacatcgagctatgtccatagttgtgcaatgtctgtatataa

SEQ ID NO: 37046 - DNA, 75 bp, Artificial Sequence
  Synthetic
ttgctagatggatctgttctagtgaactcgctagtccattctgatgataatcaaacatcaataacgataatacaa

SEQ ID NO: 37047 - DNA, 75 bp, Artificial Sequence
  Synthetic
actcgctagtccattctgatgataatcaaacatcaataacgataatacaagataagttggaaaatgataagatca

SEQ ID NO: 37048 - DNA, 75 bp, Artificial Sequence
  Synthetic
aggagaaatgaggaacatatggcaatcaaaaccagaatatataatgagataactccagtatgcattgtaaatgtt

SEQ ID NO: 37049 - DNA, 75 bp, Artificial Sequence
  Synthetic
aaaagcatgcttgacatttggctgccaagcaaatatgaaaaagacatatgtgaccaattgcataaaggaatttgt

SEQ ID NO: 37050 - DNA, 75 bp, Artificial Sequence
  Synthetic
tcaaaaccagaatatataatgagataactccagtatgcattgtaaatgttgcagaaattgacggtgatcagagaa

SEQ ID NO: 37051 - DNA, 75 bp, Artificial Sequence
  Synthetic
caagcaaatatgaaaaagacatatgtgaccaattgcataaaggaatttgtctcattgttcaacctatatggggag

SEQ ID NO: 37052 - DNA, 75 bp, Artificial Sequence
  Synthetic
aaataatgatgtattttccttatctaggataaaagtaggtcttgaagaatttgcaacaataaaaaaagcacactt

SEQ ID NO: 37053 - DNA, 75 bp, Artificial Sequence
  Synthetic
tattgacatctgtaggagattgtgcctatatagggccttacgaggacttagccagtagaatatcttcagcacaaa

SEQ ID NO: 37054 - DNA, 75 bp, Artificial Sequence
  Synthetic
ctatatagggccttacgaggacttagccagtagaatatcttcagcacaaacagctataaagcatgggtgcccacc

SEQ ID NO: 37055 - DNA, 75 bp, Artificial Sequence
  Synthetic
tagtaaaatggtctcctttgaaggacctccaatcaaaacaggcctcctagatctaacagagctaatgaaatcaca

SEQ ID NO: 37056 - DNA, 75 bp, Artificial Sequence
  Synthetic
ataagccattggatgacagctttgacctataacatgttgccgggccaatctaatgatccgcttgattacttccca

SEQ ID NO: 37057 - DNA, 75 bp, Artificial Sequence
  Synthetic
aatatacggaatagcaatttgatatctttttcaaaattaatatgttgtgaaggttctgaaaatatcaatgatggt

SEQ ID NO: 37058 - DNA, 75 bp, Artificial Sequence
  Synthetic
cctataacatgttgccgggccaatctaatgatccgcttgattacttcccagctgagaacaggaaggatataccta

SEQ ID NO: 37059 - DNA, 75 bp, Artificial Sequence
  Synthetic
accactttctatgataagtacagttggattagagtctggaaatctatattttttaatcaagctattaaataagta

SEQ ID NO: 37060 - DNA, 75 bp, Artificial Sequence
  Synthetic
ggattagagtctggaaatctatattttttaatcaagctattaaataagtacactccagttatgcagaaaagggag

SEQ ID NO: 37061 - DNA, 75 bp, Artificial Sequence
  Synthetic
atatgacatatagaaatgctataaaaatgttgatagaaagggagacaaaagtatttgaagaggctttcactttca

SEQ ID NO: 37062 - DNA, 75 bp, Artificial Sequence
  Synthetic
tcaagaattggaaagttgaagatttaaccgacaatgagatatttagacttaagatccttaggtacctagttctag

SEQ ID NO: 37063 - DNA, 75 bp, Artificial Sequence
  Synthetic
gcagtaatggttttgtatccccggagaatcttggctgtctagaggctatagtgtctttaattaaattattaaaaa

SEQ ID NO: 37064 - DNA, 75 bp, Artificial Sequence
  Synthetic
aaccgacaatgagatatttagacttaagatccttaggtacctagttctagatgctgaaatggatccaagtgatat

SEQ ID NO: 37065 - DNA, 75 bp, Artificial Sequence
  Synthetic
taaatgtattcatatatgcttaatcaaaaacggtatggaccatatgtaccatacctttgatattccaaagtgctt

SEQ ID NO: 37066 - DNA, 75 bp, Artificial Sequence
  Synthetic
ggaaggtcaatactcacacctagaaaattcacaacagcgggtagcttaaggaaactatattcatttggcaaatac

SEQ ID NO: 37067 - DNA, 75 bp, Artificial Sequence
  Synthetic
aattcacaacagcgggtagcttaaggaaactatattcatttggcaaataccaggacagactgtcttcccctggcg

SEQ ID NO: 37068 - DNA, 75 bp, Artificial Sequence
  Synthetic
ataaattgggtgatgtttagagaatttgtaagtagtttgcctagcacagatataccaccttggaatgtcatgaca

SEQ ID NO: 37069 - DNA, 75 bp, Artificial Sequence
  Synthetic
acttgagaaacctgaactcttggtcacaaagggtgaagatatgagagactacatggaatctgtcatcttcagata

SEQ ID NO: 37070 - DNA, 75 bp, Artificial Sequence
  Synthetic
acaaagggtgaagatatgagagactacatggaatctgtcatcttcagatacaattctaaaaggtttaaagagagc

SEQ ID NO: 37071 - DNA, 75 bp, Artificial Sequence
  Synthetic
tatttattgagcaaattttattctcccacaagcctgtaatagacttctcaggcataagggacaagtatataaatt

SEQ ID NO: 37072 - DNA, 75 bp, Artificial Sequence
  Synthetic
aaactaatgaagaaggaaggtggcagaagcaatatagaatttgattaatagaaacaagccaacatatagtaaggt

SEQ ID NO: 37073 - DNA, 75 bp, Artificial Sequence
  Synthetic
ccacaagcctgtaatagacttctcaggcataagggacaagtatataaatttgcatgatagcagagcattagagaa

SEQ ID NO: 37074 - DNA, 75 bp, Artificial Sequence
  Synthetic
acattcattgaggcttataggctattgatgagagatttgtctagtttagaattaaccaatgatgatatccaggta

SEQ ID NO: 37075 - DNA, 75 bp, Artificial Sequence
  Synthetic
tgatgagagatttgtctagtttagaattaaccaatgatgatatccaggtaatctattcatatataatattgaatg

SEQ ID NO: 37076 - DNA, 75 bp, Artificial Sequence
  Synthetic
tacacatatattatctatatatggaagtccacagaagaggatgggtatgtcctgttcaactatgccagagtttag

SEQ ID NO: 37077 - DNA, 75 bp, Artificial Sequence
  Synthetic
agtccacagaagaggatgggtatgtcctgttcaactatgccagagtttaggaacttgaaattaattcatcattcc

SEQ ID NO: 37078 - DNA, 75 bp, Artificial Sequence
  Synthetic
gcaagaacaaccctgatgttcagggtgctgatccaactgaaatggctagggatctagttcaccttaaagaatttg

SEQ ID NO: 37079 - DNA, 75 bp, Artificial Sequence
  Synthetic
tgctgatccaactgaaatggctagggatctagttcaccttaaagaatttgttgagaacacaggattagaagaaaa

SEQ ID NO: 37080 - DNA, 75 bp, Artificial Sequence
  Synthetic
gaagcagaaaaaggccagagagatatagtctttgaactaaaggagatgaccaggttttaccaagtatgctatgag

SEQ ID NO: 37081 - DNA, 75 bp, Artificial Sequence
  Synthetic
tagtctttgaactaaaggagatgaccaggttttaccaagtatgctatgagtatgtgaaatcgacagaacataaga

SEQ ID NO: 37082 - DNA, 75 bp, Artificial Sequence
  Synthetic
gtcctatacaaccacagacttttgttcacttatgcaaggaaacttgataaaagataaagaatggtacacagtgca

SEQ ID NO: 37083 - DNA, 75 bp, Artificial Sequence
  Synthetic
tcacttatgcaaggaaacttgataaaagataaagaatggtacacagtgcattatctaaagcagatattgtctgga

SEQ ID NO: 37084 - DNA, 75 bp, Artificial Sequence
  Synthetic
atgcgacaagtgaacaaaacatagcatttgaatgttttaaattgataacacactttgcagactcattcatagact

SEQ ID NO: 37085 - DNA, 75 bp, Artificial Sequence
  Synthetic
atttgaatgttttaaattgataacacactttgcagactcattcatagactcatcttccagatctgcctttctaca

SEQ ID NO: 37086 - DNA, 75 bp, Artificial Sequence
  Synthetic
aaagatgtaaaagttgctaaactttacgacataataaagaatggacataatcgaaccgattttatccctttgcta

SEQ ID NO: 37087 - DNA, 75 bp, Artificial Sequence
  Synthetic
acgacataataaagaatggacataatcgaaccgattttatccctttgctatttagaactggtgacttgaagcagt

SEQ ID NO: 37088 - DNA, 75 bp, Artificial Sequence
  Synthetic
gaaaagccatgaaagagtgacttggaatgattggcaaacatctcgccatttagatatgggagcaataaatttaac

SEQ ID NO: 37089 - DNA, 75 bp, Artificial Sequence
  Synthetic
aatgattggcaaacatctcgccatttagatatgggagcaataaatttaacaataaccggctataatagatccatc

SEQ ID NO: 37090 - DNA, 75 bp, Artificial Sequence
  Synthetic
taacatatgcagaactatgcctaactagaaagacccctgaaaatattactataagcggcaggaagttgttgagtt

SEQ ID NO: 37091 - DNA, 75 bp, Artificial Sequence
  Synthetic
tagaaagacccctgaaaatattactataagcggcaggaagttgttgagttcacgccatggtttaaaatttgaaaa

SEQ ID NO: 37092 - DNA, 75 bp, Artificial Sequence
  Synthetic
ggcaattactatattacctttagaaaaaaagatcgccaccaatttgtgtatcagatacattcccatgaatctatc

SEQ ID NO: 37093 - DNA, 75 bp, Artificial Sequence
  Synthetic
aaaaagatcgccaccaatttgtgtatcagatacattcccatgaatctatcacaagacgcaatgaagagcatatgg

SEQ ID NO: 37094 - DNA, 75 bp, Artificial Sequence
  Synthetic
gataaccccagtgtgcatagttaacgttgcagaagttgatggagatcagagaatcttgataagatctttagatta

SEQ ID NO: 37095 - DNA, 75 bp, Artificial Sequence
  Synthetic
gttgcagaagttgatggagatcagagaatcttgataagatctttagattacttaaacaatgatgtcttttcctta

SEQ ID NO: 37096 - DNA, 75 bp, Artificial Sequence
  Synthetic
agtttgcaacaattaaaaaggcacactttagcaaaatggtttcatttgacggtcctccaattaaaactgggcttc

SEQ ID NO: 37097 - DNA, 75 bp, Artificial Sequence
  Synthetic
ctttagcaaaatggtttcatttgacggtcctccaattaaaactgggcttcttgatttaacagaattaatgaagtc

SEQ ID NO: 37098 - DNA, 75 bp, Artificial Sequence
  Synthetic
gacaatattaggaatagtaatttgatatctttttccaaattgatttgttgtgaggggtctgacaacataaatgac

SEQ ID NO: 37099 - DNA, 75 bp, Artificial Sequence
  Synthetic
tatctttttccaaattgatttgttgtgaggggtctgacaacataaatgacggcctagaattcttatctgatgacc

SEQ ID NO: 37100 - DNA, 75 bp, Artificial Sequence
  Synthetic
tatacactcaacaccaattttcaatatttattattcaaagagaggtgaaaaacatatgacatacagaaatgcagt

SEQ ID NO: 37101 - DNA, 75 bp, Artificial Sequence
  Synthetic
atttattattcaaagagaggtgaaaaacatatgacatacagaaatgcagttaaattgctaatagaaagagagaca

SEQ ID NO: 37102 - DNA, 75 bp, Artificial Sequence
  Synthetic
tcagtagcaatggctttatatcgccagagaatttaggatgcttagaagcaattgtatcgctaatcaaattactaa

SEQ ID NO: 37103 - DNA, 75 bp, Artificial Sequence
  Synthetic
atgataatataaggaatagcaacttgatatctttttcaaaattgatttgctgtgaggggtcagataatataaatg

SEQ ID NO: 37104 - DNA, 75 bp, Artificial Sequence
  Synthetic
agagaatttaggatgcttagaagcaattgtatcgctaatcaaattactaaaaacaaatgagtggtctacagtcat

SEQ ID NO: 37105 - DNA, 75 bp, Artificial Sequence
  Synthetic
ataaagaatggtatggatcacatgtatcattcctttgatgttccgaagtgctttatggaaaaccccataaccaga

SEQ ID NO: 37106 - DNA, 75 bp, Artificial Sequence
  Synthetic
atcattcctttgatgttccgaagtgctttatggaaaaccccataaccagagatataaattgggttatgtttcgag

SEQ ID NO: 37107 - DNA, 75 bp, Artificial Sequence
  Synthetic
ggatataccaccatggaatgttatgacagaaaactttaagaagaaatgtattgcactgataaactcaagactgga

SEQ ID NO: 37108 - DNA, 75 bp, Artificial Sequence
  Synthetic
acagaaaactttaagaagaaatgtattgcactgataaactcaagactggaaacacagagagacttctctgagttt

SEQ ID NO: 37109 - DNA, 75 bp, Artificial Sequence
  Synthetic
ggagaagcaatatagaatttgattagttgatcagaaggggcaagaaacttaaaaattggatcataaattggggag

SEQ ID NO: 37110 - DNA, 75 bp, Artificial Sequence
  Synthetic
gttgatcagaaggggcaagaaacttaaaaattggatcataaattggggagggtttttatcaattggctagatatc

SEQ ID NO: 37111 - DNA, 75 bp, Artificial Sequence
  Synthetic
agtagtgtactaccaagtatagataacgtctgaattttaaagtgaatatcaaagtgaaaagatgattttcatact

SEQ ID NO: 37112 - DNA, 75 bp, Artificial Sequence
  Synthetic
acgtctgaattttaaagtgaatatcaaagtgaaaagatgattttcatactaatcctatttgcagtggctgctgca

SEQ ID NO: 37113 - DNA, 75 bp, Artificial Sequence
  Synthetic
aaagtgaaaagatgattttcatactaatcctatttgcagtggctgctgcaagccctgtttatcaaaggtgcttcc

SEQ ID NO: 37114 - DNA, 75 bp, Artificial Sequence
  Synthetic
agacttatatatgttatttattaatgcctatattcatccccatagcatatatatacggtataatttacaataagt

SEQ ID NO: 37115 - DNA, 75 bp, Artificial Sequence
  Synthetic
tccatcaaaggaagcagtgacggaagtgtgcctcaaagatgacgtaagcatgataaaaactgaggccagatatac

SEQ ID NO: 37116 - DNA, 75 bp, Artificial Sequence
  Synthetic
gtgtgcctcaaagatgacgtaagcatgataaaaactgaggccagatataccaagaatagtactggagtgttctca

SEQ ID NO: 37117 - DNA, 75 bp, Artificial Sequence
  Synthetic
tagtctcagattggcatgattgcagacccagaaaagtcgttgggggtcatattaatgtcatagaagttggggatg

SEQ ID NO: 37118 - DNA, 75 bp, Artificial Sequence
  Synthetic
tgttggaaatggcatcgagaataaattcttattatctcacctgtatcttgaattatgctgtaagctggggtcttg

SEQ ID NO: 37119 - DNA, 75 bp, Artificial Sequence
  Synthetic
acccagaaaagtcgttgggggtcatattaatgtcatagaagttggggatgacttgacactccatactgagtcata

SEQ ID NO: 37120 - DNA, 75 bp, Artificial Sequence
  Synthetic
ggtgtggacaaagaaacagcccaagttaggttgcagactgatacaacgaatcatttcgagattgcaggaaccaca

SEQ ID NO: 37121 - DNA, 75 bp, Artificial Sequence
  Synthetic
ttaggttgcagactgatacaacgaatcatttcgagattgcaggaaccacagttaaatctggctggttcaaaagca

SEQ ID NO: 37122 - DNA, 75 bp, Artificial Sequence
  Synthetic
atgaaatgaaagattattactctgggaaacaaacaaagtttgacaaggacttaaatctagccctaacagctttgc

SEQ ID NO: 37123 - DNA, 75 bp, Artificial Sequence
  Synthetic
ttgcgaacatttgaaggtttcttgcggtccaaagtccatacaattccatgcctgtttcaatcaacacatgtcatg

SEQ ID NO: 37124 - DNA, 75 bp, Artificial Sequence
  Synthetic
ggtccaaagtccatacaattccatgcctgtttcaatcaacacatgtcatgtgtcagatttttacatagaactatt

SEQ ID NO: 37125 - DNA, 75 bp, Artificial Sequence
  Synthetic
gtggtgaacccaatgggccaagtgtgtataggaaaccatcaggtggtgtattccaatctagcactgatcggtcta

SEQ ID NO: 37126 - DNA, 75 bp, Artificial Sequence
  Synthetic
tatgtcaaaatgttgaaataataatattagtgacattggccttgctgatttttatcctgcttagtatcataagta

SEQ ID NO: 37127 - DNA, 75 bp, Artificial Sequence
  Synthetic
attagtgacattggccttgctgatttttatcctgcttagtatcataagtaaaacatacatatgctatctgttgat

SEQ ID NO: 37128 - DNA, 75 bp, Artificial Sequence
  Synthetic
atgtgcacaatattgaggatattgagcaatataagaaagctataactcagaaacttcaaacgagcctatctctat

SEQ ID NO: 37129 - DNA, 75 bp, Artificial Sequence
  Synthetic
atatatggcctaatttataacaaatcatgcaaaaaatgcaagctgtgtggtttagtttatcacccaattacagag

SEQ ID NO: 37130 - DNA, 75 bp, Artificial Sequence
  Synthetic
catgcaaaaaatgcaagctgtgtggtttagtttatcacccaattacagagtgtggtacccattgcgtctgtggcg

SEQ ID NO: 37131 - DNA, 75 bp, Artificial Sequence
  Synthetic
gaaactccatagagcatcaggtctttgccctgggtacaaaagtcttagagctgctagagttatgtgtaagtcaaa

SEQ ID NO: 37132 - DNA, 75 bp, Artificial Sequence
  Synthetic
tgccctgggtacaaaagtcttagagctgctagagttatgtgtaagtcaaaaggaccagcctctatactgtcaata

SEQ ID NO: 37133 - DNA, 75 bp, Artificial Sequence
  Synthetic
ttgtcacacctataaatgcaatgatggttggagggagcaaagagacctttgaacttgaggagctccctgatgaca

SEQ ID NO: 37134 - DNA, 75 bp, Artificial Sequence
  Synthetic
ggttggagggagcaaagagacctttgaacttgaggagctccctgatgacatgctagaaatggctaacaatttaaa

SEQ ID NO: 37135 - DNA, 75 bp, Artificial Sequence
  Synthetic
aattatgcagttacatggagcctgttgataattgccttagcaataggtttattatttaaaagataccaacatcgg

SEQ ID NO: 37136 - DNA, 75 bp, Artificial Sequence
  Synthetic
tgataattgccttagcaataggtttattatttaaaagataccaacatcggtttttagatatttatgctatgtatt

SEQ ID NO: 37137 - DNA, 75 bp, Artificial Sequence
  Synthetic
taggtctggtattaaatggaacggtgatttcacaaataagtgtggccaatgtacatgcggacagtacgaagatgc

SEQ ID NO: 37138 - DNA, 75 bp, Artificial Sequence
  Synthetic
gatttcacaaataagtgtggccaatgtacatgcggacagtacgaagatgcatccggactcttggtgcaccgaaaa

SEQ ID NO: 37139 - DNA, 75 bp, Artificial Sequence
  Synthetic
aatctaagtggattatgaacttcttgataacttatgtaatcttggtattgcttaaagattctgtagttatcgttc

SEQ ID NO: 37140 - DNA, 75 bp, Artificial Sequence
  Synthetic
gataacttatgtaatcttggtattgcttaaagattctgtagttatcgttcaagcaaaaggaacagatttcagtga

SEQ ID NO: 37141 - DNA, 75 bp, Artificial Sequence
  Synthetic
agtagtgtactcctatctacaaaacttacaaagaattcagtcatatcatattatacgcataatggactatcaaga

SEQ ID NO: 37142 - DNA, 75 bp, Artificial Sequence
  Synthetic
tggaactgtacaggtccttttgttaatctaggaaactgtgagaaaaagcaaaagaaagaaccatactctaatatt

SEQ ID NO: 37143 - DNA, 75 bp, Artificial Sequence
  Synthetic
atctaggaaactgtgagaaaaagcaaaagaaagaaccatactctaatattgctgctcaattgaagggcttgagtg

SEQ ID NO: 37144 - DNA, 75 bp, Artificial Sequence
  Synthetic
aatactgcaagagatgcatgtgttgccaaggatattgatgttgatctgttgatggctagacatgattactttgga

SEQ ID NO: 37145 - DNA, 75 bp, Artificial Sequence
  Synthetic
ccaaggatattgatgttgatctgttgatggctagacatgattactttggaaaagagctatgcaaatctttgaaca

SEQ ID NO: 37146 - DNA, 75 bp, Artificial Sequence
  Synthetic
aattgcaagcatccctgaggatattgctggggcattgagatacatagaagaccagagatcataccactctcagtt

SEQ ID NO: 37147 - DNA, 75 bp, Artificial Sequence
  Synthetic
gctggggcattgagatacatagaagaccagagatcataccactctcagttgactgttgagtatgctatgttaacc

SEQ ID NO: 37148 - DNA, 75 bp, Artificial Sequence
  Synthetic
tatagatataatcttagacataaggcctgaaatagatccactaactatagaagcaccacatattactccagataa

SEQ ID NO: 37149 - DNA, 75 bp, Artificial Sequence
  Synthetic
cctgaaatagatccactaactatagaagcaccacatattactccagataactatctatatataaataatgtatta

SEQ ID NO: 37150 - DNA, 75 bp, Artificial Sequence
  Synthetic
aagcaccacatattactccagataactatctatatataaataatgtattatatattatagactataaagtctctg

SEQ ID NO: 37151 - DNA, 75 bp, Artificial Sequence
  Synthetic
tcagtgacaactctggttatagtcaaacaacctggagagtttaccttagatcacatgtttttgaggcatgcattt

SEQ ID NO: 37152 - DNA, 75 bp, Artificial Sequence
  Synthetic
aacaacctggagagtttaccttagatcacatgtttttgaggcatgcattttgtacccaaatcagcacttctgcag

SEQ ID NO: 37153 - DNA, 75 bp, Artificial Sequence
  Synthetic
atatgacaagtattatgaattaactagagatatatcagataaattaagcatcccgatagaagtagttattatccg

SEQ ID NO: 37154 - DNA, 75 bp, Artificial Sequence
  Synthetic
agcagctccaactgggactttgcctctgaaatgaagaattattactctggtaagcaaaacaagtttaataaagac

SEQ ID NO: 37155 - DNA, 75 bp, Artificial Sequence
  Synthetic
ctgaaatgaagaattattactctggtaagcaaaacaagtttaataaagacttgaatttggcccttacatctctac

SEQ ID NO: 37156 - DNA, 75 bp, Artificial Sequence
  Synthetic
cacatcaactccgataggttcaaagagatttaccctacgatagtagtggatataaacttcaatcagttctttgat

SEQ ID NO: 37157 - DNA, 75 bp, Artificial Sequence
  Synthetic
gtcttacatagcaggattgctatctactaaagcaaatgatgagttagtgcagtatacatctaaaatcagagagaa

SEQ ID NO: 37158 - DNA, 75 bp, Artificial Sequence
  Synthetic
ttggcgatgatgaggaatttttactaaaggtagcacatggtgacttcacccttacggcaccctggtgcaaaacag

SEQ ID NO: 37159 - DNA, 75 bp, Artificial Sequence
  Synthetic
actaaagcaaatgatgagttagtgcagtatacatctaaaatcagagagaagttccccgggaatgcattactaaag

SEQ ID NO: 37160 - DNA, 75 bp, Artificial Sequence
  Synthetic
gatgtccagaattctggaaacatcctatttataaagaattcaaaatgagtatgcctatacctgagcgaaggctct

SEQ ID NO: 37161 - DNA, 75 bp, Artificial Sequence
  Synthetic
tgaagggactcacagagatgagcaacttcaaaaaggatgagttttgggatgagttggtatatgtgcctgacccta

SEQ ID NO: 37162 - DNA, 75 bp, Artificial Sequence
  Synthetic
cttcaaaaaggatgagttttgggatgagttggtatatgtgcctgaccctactaagcctcccaagctatcaagggg

SEQ ID NO: 37163 - DNA, 75 bp, Artificial Sequence
  Synthetic
ctatgaatcagaaagatggaacacaaatttagtcaagattagagagtatacaaagaaggactactcagaacatat

SEQ ID NO: 37164 - DNA, 75 bp, Artificial Sequence
  Synthetic
tcagctacgtccaacttgggtgaaaagaactgtaaggatgtaaagggtgttgtgtgtttatcgcctagatctggt

SEQ ID NO: 37165 - DNA, 75 bp, Artificial Sequence
  Synthetic
agaactgtaaggatgtaaagggtgttgtgtgtttatcgcctagatctggtgtgacatatgactcaataatagcct

SEQ ID NO: 37166 - DNA, 75 bp, Artificial Sequence
  Synthetic
ttggctagtgggttctataaacagccaaacaagaatgagattagtgaagggtggacattaatggttgagagagtt

SEQ ID NO: 37167 - DNA, 75 bp, Artificial Sequence
  Synthetic
caaacaagaatgagattagtgaagggtggacattaatggttgagagagttcaagagcaaagagaaatctcaagat

SEQ ID NO: 37168 - DNA, 75 bp, Artificial Sequence
  Synthetic
ctacaaaataccaaaaacaggagtgtaccaatccaattcagaaccatctaactactgtgtgtcagatagccactg

SEQ ID NO: 37169 - DNA, 75 bp, Artificial Sequence
  Synthetic
taccaatccaattcagaaccatctaactactgtgtgtcagatagccactgtcttgaagattttgaagtaataagc

SEQ ID NO: 37170 - DNA, 75 bp, Artificial Sequence
  Synthetic
acattttatatggggacctcacaattcaggaaatagcaacaattcaacctttaaacttatactgctttctaagtc

SEQ ID NO: 37171 - DNA, 75 bp, Artificial Sequence
  Synthetic
ttaaacttatactgctttctaagtcactgcaaagcataaagggtatatcaacttatacagaagctttcaaatcgt

SEQ ID NO: 37172 - DNA, 75 bp, Artificial Sequence
  Synthetic
agtccaggtgttgggaagttgattacctatatgccaatcctcctaaacaaagtgatggcgtaagaagctgccgta

SEQ ID NO: 37173 - DNA, 75 bp, Artificial Sequence
  Synthetic
cctatatgccaatcctcctaaacaaagtgatggcgtaagaagctgccgtatgaaagatgctgggcactgcaatgt

SEQ ID NO: 37174 - DNA, 75 bp, Artificial Sequence
  Synthetic
tggggaaaatgatggacattggggataagacaattgaatatgaagaattctgtatgtctttaaaaagcaaggcaa

SEQ ID NO: 37175 - DNA, 75 bp, Artificial Sequence
  Synthetic
taagacaattgaatatgaagaattctgtatgtctttaaaaagcaaggcaagatcttcctggaaacaaataatgaa

SEQ ID NO: 37176 - DNA, 75 bp, Artificial Sequence
  Synthetic
caatgtgatgacaataaatactattattctgagctgcagagagactatgataaagagcaggatataggtcatttc

SEQ ID NO: 37177 - DNA, 75 bp, Artificial Sequence
  Synthetic
attctgagctgcagagagactatgataaagagcaggatataggtcatttctgccttagccccaggtgtgccactg

SEQ ID NO: 37178 - DNA, 75 bp, Artificial Sequence
  Synthetic
aataatgctcttgttttatgggagcaacaatttatggtaaataacgacctgatagataagagcgagaagttaaag

SEQ ID NO: 37179 - DNA, 75 bp, Artificial Sequence
  Synthetic
aacaatttatggtaaataacgacctgatagataagagcgagaagttaaagttgttcaaaaacttctgtggtatag

SEQ ID NO: 37180 - DNA, 75 bp, Artificial Sequence
  Synthetic
tataagcaactgcgattggcaagtgagccactccacagtagacaaagtgaatgtacataacctagaagatattga

SEQ ID NO: 37181 - DNA, 75 bp, Artificial Sequence
  Synthetic
agccactccacagtagacaaagtgaatgtacataacctagaagatattgagcagtacaggaaggccataacgcaa

SEQ ID NO: 37182 - DNA, 75 bp, Artificial Sequence
  Synthetic
aatgttggaggatattgagatgtcaaaacccaaaatactagactttgatgacgcaaacatgtatctagctagctt

SEQ ID NO: 37183 - DNA, 75 bp, Artificial Sequence
  Synthetic
gaccatgatggaacaaagcaaaaaaatattgtctaaaagtaatggattgaagccagataattttatactgaatga

SEQ ID NO: 37184 - DNA, 75 bp, Artificial Sequence
  Synthetic
ttaagtatgctagaaccaagaacctcccacacataaagcctatatataaatacataacaattgaaggtacagaaa

SEQ ID NO: 37185 - DNA, 75 bp, Artificial Sequence
  Synthetic
cccacacataaagcctatatataaatacataacaattgaaggtacagaaactgcagaaggaattgaaagtgccta

SEQ ID NO: 37186 - DNA, 75 bp, Artificial Sequence
  Synthetic
aacaaggagacatatgacaacatgcataaaatatttgagactaggtactggcaatgcatatccgatttctctact

SEQ ID NO: 37187 - DNA, 75 bp, Artificial Sequence
  Synthetic
gcagggacttctatcggatttaaaataaataccaaggaggggaaacatttattagatgttatagcttatgttaag

SEQ ID NO: 37188 - DNA, 75 bp, Artificial Sequence
  Synthetic
taaataccaaggaggggaaacatttattagatgttatagcttatgttaagcaagcttcttactcctcattataca

SEQ ID NO: 37189 - DNA, 75 bp, Artificial Sequence
  Synthetic
ctcaatataatagacataatacatttagagtagctatgtgtgctaataacaatgtctttgctatagtattccctt

SEQ ID NO: 37190 - DNA, 75 bp, Artificial Sequence
  Synthetic
tagagtagctatgtgtgctaataacaatgtctttgctatagtattcccttcggctgacataaaaaccaagaaagc

SEQ ID NO: 37191 - DNA, 75 bp, Artificial Sequence
  Synthetic
agtaggcataaatacaaaacatgatgagttgtgcactggcccttgccctgttaatgtcccacattcagacgggtg

SEQ ID NO: 37192 - DNA, 75 bp, Artificial Sequence
  Synthetic
gagttgtgcactggcccttgccctgttaatgtcccacattcagacgggtggctaacatttgctagagaaagaact

SEQ ID NO: 37193 - DNA, 75 bp, Artificial Sequence
  Synthetic
ttacataaagaggaagataacatattcaacccagggtgtttacatggtacattcaagtgcatgaatggatatata

SEQ ID NO: 37194 - DNA, 75 bp, Artificial Sequence
  Synthetic
tcaacccagggtgtttacatggtacattcaagtgcatgaatggatatatatctatatctagagctataaggctag

SEQ ID NO: 37195 - DNA, 75 bp, Artificial Sequence
  Synthetic
ggtgtttagcaattagtgatggatgcgtttttgggtcctgtcaagatctaataaaggaagaactaacagtgtata

SEQ ID NO: 37196 - DNA, 75 bp, Artificial Sequence
  Synthetic
cgtttttgggtcctgtcaagatctaataaaggaagaactaacagtgtataggaaagagacagaagaagcaaccaa

SEQ ID NO: 37197 - DNA, 75 bp, Artificial Sequence
  Synthetic
ttcttcaccgggactatttttgacaacttgcctactgtttaaacatgataacccgaccttagtgatgagtgacat

SEQ ID NO: 37198 - DNA, 75 bp, Artificial Sequence
  Synthetic
gacaagacctactgtacagaattaaatcctgtaacacctataataacgaatctatttgaagtacaattcaagact

SEQ ID NO: 37199 - DNA, 75 bp, Artificial Sequence
  Synthetic
acccgaccttagtgatgagtgacattatgaatttctctatatacactagtttatctatcacgaaaagtgttttat

SEQ ID NO: 37200 - DNA, 75 bp, Artificial Sequence
  Synthetic
atcctgtaacacctataataacgaatctatttgaagtacaattcaagactgtggaaacttatagtctgcccaggg

SEQ ID NO: 37201 - DNA, 75 bp, Artificial Sequence
  Synthetic
gatcatgaactcattggctatttctagtaatgttaaagattacatagctgagaaattttctccttatacgaaaac

SEQ ID NO: 37202 - DNA, 75 bp, Artificial Sequence
  Synthetic
taggataggacagatcaatgacctaggtgtttactctaagggctgtgggaatgtccaaaaagttaataacaccat

SEQ ID NO: 37203 - DNA, 75 bp, Artificial Sequence
  Synthetic
ggtgtttactctaagggctgtgggaatgtccaaaaagttaataacaccatatatggtaatggagttccaaaattc

SEQ ID NO: 37204 - DNA, 75 bp, Artificial Sequence
  Synthetic
ctaattaagaatgcctgcttcgatgcttatgaccaaaggcaacgtgtgcagcttagggatatatacttatctgat

SEQ ID NO: 37205 - DNA, 75 bp, Artificial Sequence
  Synthetic
gaaaagaggtgattgttaggaaatgttttgataacgattttcaggcatgcaaatttttgcaaagcccaccgagct

SEQ ID NO: 37206 - DNA, 75 bp, Artificial Sequence
  Synthetic
tatgatataacccaaaaaggtattaaagacaatagggagttaacaagtatatggtttcctggtagtgtaacacta

SEQ ID NO: 37207 - DNA, 75 bp, Artificial Sequence
  Synthetic
ttttgataacgattttcaggcatgcaaatttttgcaaagcccaccgagctataggcttgaagaggatgatggatc

SEQ ID NO: 37208 - DNA, 75 bp, Artificial Sequence
  Synthetic
taccgttttatttcaatgccaaaggactgcatgaaaaacatcatgttatggtggatttagcaaagactatactag

SEQ ID NO: 37209 - DNA, 75 bp, Artificial Sequence
  Synthetic
atccttggtacaataaagatgaaggctatactaggggatgtaaaatataagacatttgcagagaatatagatata

SEQ ID NO: 37210 - DNA, 75 bp, Artificial Sequence
  Synthetic
ctatactaggggatgtaaaatataagacatttgcagagaatatagatataactgctgaaggagtttgtacaggat

SEQ ID NO: 37211 - DNA, 75 bp, Artificial Sequence
  Synthetic
tataaaagaaatatggtccacaaactgcaccaaacagacggtgaatcttaaaattttgatccattctttatgcaa

SEQ ID NO: 37212 - DNA, 75 bp, Artificial Sequence
  Synthetic
ttgtgagcttacaatacacacaactatagaggccagttgtccagttactagtccttgcactttgttccatgatag

SEQ ID NO: 37213 - DNA, 75 bp, Artificial Sequence
  Synthetic
tgcaccaaacagacggtgaatcttaaaattttgatccattctttatgcaaaaatttgcttgcagatacttccaga

SEQ ID NO: 37214 - DNA, 75 bp, Artificial Sequence
  Synthetic
atagaggccagttgtccagttactagtccttgcactttgttccatgataggatattgatcactccagatgaacac

SEQ ID NO: 37215 - DNA, 75 bp, Artificial Sequence
  Synthetic
agaatagaaataattttaggagatctataaccaccatttcaacatttacaagctcaaaatcttgccttaaaatag

SEQ ID NO: 37216 - DNA, 75 bp, Artificial Sequence
  Synthetic
cagagaaacaaacaggaacattaccattcaaaatctgtaactcaaaaatcgatgccactctgactttagtagaag

SEQ ID NO: 37217 - DNA, 75 bp, Artificial Sequence
  Synthetic
agctcaaaatcttgccttaaaataggagactttagaaaggagaaagagctccagtctgttaaacaaaagaaaatc

SEQ ID NO: 37218 - DNA, 75 bp, Artificial Sequence
  Synthetic
gagactttagaaaggagaaagagctccagtctgttaaacaaaagaaaatcctggaagtgcagagccgcaaaatga

SEQ ID NO: 37219 - DNA, 75 bp, Artificial Sequence
  Synthetic
attcaaaatctgtaactcaaaaatcgatgccactctgactttagtagaagccaaacctattttagagctagcccc

SEQ ID NO: 37220 - DNA, 75 bp, Artificial Sequence
  Synthetic
gaaaaagatgaaaggtgcaaaacatggatgtacagagtaagggatgaagggattcaggttatattggagccattt

SEQ ID NO: 37221 - DNA, 75 bp, Artificial Sequence
  Synthetic
cgatgaacaagtatgccttgaggttgggcactgcaactatgagatgctgagaaatgctatgccaaactacacgga

SEQ ID NO: 37222 - DNA, 75 bp, Artificial Sequence
  Synthetic
gggcactgcaactatgagatgctgagaaatgctatgccaaactacacggactatatatcaactaaagtgtttgat

SEQ ID NO: 37223 - DNA, 75 bp, Artificial Sequence
  Synthetic
ggatgtacagagtaagggatgaagggattcaggttatattggagccatttaaaaatctctttggttcttatatag

SEQ ID NO: 37224 - DNA, 75 bp, Artificial Sequence
  Synthetic
tgttattgcaatgtttataattgtttatgtaatcctgcccatatgttttaaactgaaagacactttacaacggca

SEQ ID NO: 37225 - DNA, 75 bp, Artificial Sequence
  Synthetic
gggttctgacagataagcctgttatagagcaaataatggatatgatggttgaccacaagaagttctacttcacat

SEQ ID NO: 37226 - DNA, 75 bp, Artificial Sequence
  Synthetic
agagcaaataatggatatgatggttgaccacaagaagttctacttcacattttttaataaaggccagaaaacatc

SEQ ID NO: 37227 - DNA, 75 bp, Artificial Sequence
  Synthetic
tatgtaatcctgcccatatgttttaaactgaaagacactttacaacggcatgaagatgcatacaaaagagaaatg

SEQ ID NO: 37228 - DNA, 75 bp, Artificial Sequence
  Synthetic
ttagttaacaagaggggtatatatttagtttagctgtaagggggaggggaatgccaacagcaggagtttatttga

SEQ ID NO: 37229 - DNA, 75 bp, Artificial Sequence
  Synthetic
gaatatgaagctaagatgtgtatgtatgcagttgaaagaatagcaaaagagagatgcaagctgaaccctgacgaa

SEQ ID NO: 37230 - DNA, 75 bp, Artificial Sequence
  Synthetic
tagtttagctgtaagggggaggggaatgccaacagcaggagtttatttgaagaacattattttatacttggtagc

SEQ ID NO: 37231 - DNA, 75 bp, Artificial Sequence
  Synthetic
atgatatctgagccaggagatggcaagttgaaagtattagaacaaaaatcagagcaagagatccggttcttggtg

SEQ ID NO: 37232 - DNA, 75 bp, Artificial Sequence
  Synthetic
aaatagatgaggcaattgaggcattggctgcagaagggtatgagagtaacctggagaagattgaaaagctttcac

SEQ ID NO: 37233 - DNA, 75 bp, Artificial Sequence
  Synthetic
ccctatcctctatcctcaagaaaaagagaggatactatacttcatgtgtaactacatggataaagaattgatact

SEQ ID NO: 37234 - DNA, 75 bp, Artificial Sequence
  Synthetic
gagaggatactatacttcatgtgtaactacatggataaagaattgatactaccagatgagttattatttaatctg

SEQ ID NO: 37235 - DNA, 75 bp, Artificial Sequence
  Synthetic
aagcttcaaacaagcttgtctctattcaagtatgcaaaaacaaaaaacttgccgcacattagaccaatttataaa

SEQ ID NO: 37236 - DNA, 75 bp, Artificial Sequence
  Synthetic
atgatataatagctactatgactaaccaattaaactctaacacagttcttataaagagaaattggcttcaaggaa

SEQ ID NO: 37237 - DNA, 75 bp, Artificial Sequence
  Synthetic
ccatagctgtgcaatgtctgtttataaagaaatcctaaaggaggctataacattactagacgggtctatattagt

SEQ ID NO: 37238 - DNA, 75 bp, Artificial Sequence
  Synthetic
aatcagacatcaataacaatagttcaagataaaatggaaaatgacaagatcatagattttgcaatgaaggaattt

SEQ ID NO: 37239 - DNA, 75 bp, Artificial Sequence
  Synthetic
aagataaaatggaaaatgacaagatcatagattttgcaatgaaggaatttgaaagggcctgtttaacatttggat

SEQ ID NO: 37240 - DNA, 75 bp, Artificial Sequence
  Synthetic
agtagtgtactaccaagtatagataacgttcttgaatagaatcgagagacaaaatgaggaatatgattgtttttg

SEQ ID NO: 37241 - DNA, 75 bp, Artificial Sequence
  Synthetic
acgttcttgaatagaatcgagagacaaaatgaggaatatgattgtttttgctttgctaacaattgtggctgcaag

SEQ ID NO: 37242 - DNA, 75 bp, Artificial Sequence
  Synthetic
aaaatgaggaatatgattgtttttgctttgctaacaattgtggctgcaagtcctgtctacaaaagatgtttccaa

SEQ ID NO: 37243 - DNA, 75 bp, Artificial Sequence
  Synthetic
tgtgacaaactgtataaaagaatttgtttcactattcaacctgtatggtgagcctttctcaatatatggcagatt

SEQ ID NO: 37244 - DNA, 75 bp, Artificial Sequence
  Synthetic
cctattaacttctgtaggcgactgtgcctatataggaccttatgaagatctagccagtcgaatatcatcggccca

SEQ ID NO: 37245 - DNA, 75 bp, Artificial Sequence
  Synthetic
actcaaaaaatgcagttactgaagtctgcttaaaagacgatgttagtatgataaaaacagaggctgaatacttca

SEQ ID NO: 37246 - DNA, 75 bp, Artificial Sequence
  Synthetic
ctgcttaaaagacgatgttagtatgataaaaacagaggctgaatacttcaagaattcaaccggcgttttttcaaa

SEQ ID NO: 37247 - DNA, 75 bp, Artificial Sequence
  Synthetic
cccagcttggcatgggtatccatagcaataagtcattggatgacttctctaacgtataacatgctaccagggcaa

SEQ ID NO: 37248 - DNA, 75 bp, Artificial Sequence
  Synthetic
gtttcagattggaatgagtgcaggccacaaaagtcagcaaatggacacatcaatgtgattgaagttcaaccagac

SEQ ID NO: 37249 - DNA, 75 bp, Artificial Sequence
  Synthetic
cacaaaagtcagcaaatggacacatcaatgtgattgaagttcaaccagacctatctttgcaaactaactcctatg

SEQ ID NO: 37250 - DNA, 75 bp, Artificial Sequence
  Synthetic
tcctatgacccaattgattatttcccagcagaaaacaggagggacatacctattgagttgaatggcgtgctggat

SEQ ID NO: 37251 - DNA, 75 bp, Artificial Sequence
  Synthetic
tattgagttgaatggcgtgctggatgccccactatcaatgattagtacagttgggctagaatctggaaatttata

SEQ ID NO: 37252 - DNA, 75 bp, Artificial Sequence
  Synthetic
tattgataaagaaacagcacaggtacgccttcagacagatacaacaaaccattttgaaatatctggcacaactgt

SEQ ID NO: 37253 - DNA, 75 bp, Artificial Sequence
  Synthetic
gccccactatcaatgattagtacagttgggctagaatctggaaatttatacttcttgatacagttgttaagtaaa

SEQ ID NO: 37254 - DNA, 75 bp, Artificial Sequence
  Synthetic
cgccttcagacagatacaacaaaccattttgaaatatctggcacaactgtgaaatctggatggtttaagagcact

SEQ ID NO: 37255 - DNA, 75 bp, Artificial Sequence
  Synthetic
aatcagtggtcaatcagatagctgaagttaagaactggaaaattgaggatctaacagataatgagatatttagac

SEQ ID NO: 37256 - DNA, 75 bp, Artificial Sequence
  Synthetic
gtgaacatttgaaaatttcatgtggttcaaagtctgtacaactacatgcgtgcttcaatcagcatatgagctgtg

SEQ ID NO: 37257 - DNA, 75 bp, Artificial Sequence
  Synthetic
agttaagaactggaaaattgaggatctaacagataatgagatatttagacttaaaatactcagatacctagtctt

SEQ ID NO: 37258 - DNA, 75 bp, Artificial Sequence
  Synthetic
ttcaaagtctgtacaactacatgcgtgcttcaatcagcatatgagctgtgttagatttctacataggacaattct

SEQ ID NO: 37259 - DNA, 75 bp, Artificial Sequence
  Synthetic
attatgggtgaaacgagtgacatgagagggaggtccatcttgacacctagaaaatttacaacagcaggcagttta

SEQ ID NO: 37260 - DNA, 75 bp, Artificial Sequence
  Synthetic
tgtcaaaatatagaaataatcatactgactagcctaagtctttttatatttttattcttaacaataataagtaag

SEQ ID NO: 37261 - DNA, 75 bp, Artificial Sequence
  Synthetic
gagggaggtccatcttgacacctagaaaatttacaacagcaggcagtttaagaaagttgtactcctttagtaaat

SEQ ID NO: 37262 - DNA, 75 bp, Artificial Sequence
  Synthetic
tgactagcctaagtctttttatatttttattcttaacaataataagtaagacatatatatgttatgtactaatac

SEQ ID NO: 37263 - DNA, 75 bp, Artificial Sequence
  Synthetic
aggcatggtcgaattgtttacttatctgcttgaaaagcctgaattgttagttaccaaaggagaagatatgaaaga

SEQ ID NO: 37264 - DNA, 75 bp, Artificial Sequence
  Synthetic
atatggatttatctacaataaatcatgtaaaaaatgcaaactatgtggactggtatatcacccttttacagaatg

SEQ ID NO: 37265 - DNA, 75 bp, Artificial Sequence
  Synthetic
ctgcttgaaaagcctgaattgttagttaccaaaggagaagatatgaaagattatatggagtctgtaattttccga

SEQ ID NO: 37266 - DNA, 75 bp, Artificial Sequence
  Synthetic
tgtaaaaaatgcaaactatgtggactggtatatcacccttttacagaatgcggcagtcattgtgtttgtggggca

SEQ ID NO: 37267 - DNA, 75 bp, Artificial Sequence
  Synthetic
gtttatcaatacaaaatccagcacaattattcatagagcagatactattttcacataagcctataatagactttt

SEQ ID NO: 37268 - DNA, 75 bp, Artificial Sequence
  Synthetic
aaatgcatagatcatcaggattatgtccagggtataaaagcttaagggctgcaagatctatgtgcaaatcaaaag

SEQ ID NO: 37269 - DNA, 75 bp, Artificial Sequence
  Synthetic
attattcatagagcagatactattttcacataagcctataatagacttttctggtattagagataaatatataaa

SEQ ID NO: 37270 - DNA, 75 bp, Artificial Sequence
  Synthetic
tccagggtataaaagcttaagggctgcaagatctatgtgcaaatcaaaaggaccagctcccatactatcgttatt

SEQ ID NO: 37271 - DNA, 75 bp, Artificial Sequence
  Synthetic
aaagagcctgatatactaggaaaggttacatttacagaagcttataggttattgatgagagacctatccagccta

SEQ ID NO: 37272 - DNA, 75 bp, Artificial Sequence
  Synthetic
gtaacacctataacggccatatcacttaaagatgaagaaaaagaaacatacaaattaccagaattacctgatgat

SEQ ID NO: 37273 - DNA, 75 bp, Artificial Sequence
  Synthetic
ttacatttacagaagcttataggttattgatgagagacctatccagcctagaattgactaacgatgatattcaag

SEQ ID NO: 37274 - DNA, 75 bp, Artificial Sequence
  Synthetic
ttaaagatgaagaaaaagaaacatacaaattaccagaattacctgatgataaggttaatttggaaaccaagattg

SEQ ID NO: 37275 - DNA, 75 bp, Artificial Sequence
  Synthetic
tgatcccatgatgataaccattgccaatacacacatactgtcaatatatgggagcccacaaaaaagaatgggaat

SEQ ID NO: 37276 - DNA, 75 bp, Artificial Sequence
  Synthetic
aaattatgcaactacatgggctctaattttctgtgtattaataactgcatgtttattcaaaaagcttcaacataa

SEQ ID NO: 37277 - DNA, 75 bp, Artificial Sequence
  Synthetic
aatacacacatactgtcaatatatgggagcccacaaaaaagaatgggaatgtcctgttcaacaatgccagagttt

SEQ ID NO: 37278 - DNA, 75 bp, Artificial Sequence
  Synthetic
attttctgtgtattaataactgcatgtttattcaaaaagcttcaacataagtttcttgattattatgctgtctat

SEQ ID NO: 37279 - DNA, 75 bp, Artificial Sequence
  Synthetic
ccccagccttagttttaagagcatatagtaaaaataatcctgatatccagggtgctgaccctacagaaatggcta

SEQ ID NO: 37280 - DNA, 75 bp, Artificial Sequence
  Synthetic
aaaagacgagcctgaaatacaatggtgatttctcaaacaaatgcagacaatgcacatgtgaacagtatgaggatg

SEQ ID NO: 37281 - DNA, 75 bp, Artificial Sequence
  Synthetic
ggtgctgaccctacagaaatggctagagacttggttcatttaagggaatttgttgagaacacaaatttagaagaa

SEQ ID NO: 37282 - DNA, 75 bp, Artificial Sequence
  Synthetic
tgatttctcaaacaaatgcagacaatgcacatgtgaacagtatgaggatgctactggattactaacacatcggaa

SEQ ID NO: 37283 - DNA, 75 bp, Artificial Sequence
  Synthetic
atgaagcagagaaaggacaaagagatatcgtctttgagctaaaagagatgactaggttctatcaggtttgctatg

SEQ ID NO: 37284 - DNA, 75 bp, Artificial Sequence
  Synthetic
aaagcaaaatggacgttgaatttcttgataacatatgctatcttagttatcatcaaagactctgtaatgattgta

SEQ ID NO: 37285 - DNA, 75 bp, Artificial Sequence
  Synthetic
tgataacatatgctatcttagttatcatcaaagactctgtaatgattgtaggtgcaagcaatacagatgtcaagg

SEQ ID NO: 37286 - DNA, 75 bp, Artificial Sequence
  Synthetic
gataaaagtctttatccttccagcaaaatcatacacaacaacagatttttgctcacttatgcagggaaacttaat

SEQ ID NO: 37287 - DNA, 75 bp, Artificial Sequence
  Synthetic
ctggaattgtactggacccttcttgaatatgggaagatgcacaagacctcaaaaaaaggaaaactacggaaatat

SEQ ID NO: 37288 - DNA, 75 bp, Artificial Sequence
  Synthetic
aaatcatacacaacaacagatttttgctcacttatgcagggaaacttaataaaagacaaggagtggtacacagtt

SEQ ID NO: 37289 - DNA, 75 bp, Artificial Sequence
  Synthetic
aatatgggaagatgcacaagacctcaaaaaaaggaaaactacggaaatatagcaactcaactgaaaggcctagat

SEQ ID NO: 37290 - DNA, 75 bp, Artificial Sequence
  Synthetic
ctgtaggtaaaataccagaagatattgctggggcattgtcatacatcgaatctaaaaagacatatcatgaacaat

SEQ ID NO: 37291 - DNA, 75 bp, Artificial Sequence
  Synthetic
tgctggggcattgtcatacatcgaatctaaaaagacatatcatgaacaattaactttagaatttgcaatgctaac

SEQ ID NO: 37292 - DNA, 75 bp, Artificial Sequence
  Synthetic
caattaataatagatgaattcagctataaggatgtgaaagttagcaaactttatgaaataataaagaatgggtac

SEQ ID NO: 37293 - DNA, 75 bp, Artificial Sequence
  Synthetic
tatgctgacaattcaggctacagtcagacaacatggagggcatacataagatctcatgactttggggtttgtata

SEQ ID NO: 37294 - DNA, 75 bp, Artificial Sequence
  Synthetic
ataaggatgtgaaagttagcaaactttatgaaataataaagaatgggtacaaccgaacggatttcataccattgc

SEQ ID NO: 37295 - DNA, 75 bp, Artificial Sequence
  Synthetic
agacaacatggagggcatacataagatctcatgactttggggtttgtataatgtacccgaatcaacatttttgta

SEQ ID NO: 37296 - DNA, 75 bp, Artificial Sequence
  Synthetic
agctgatttagataaatatgatgccatgaaaagtcacgaaagggtaacatggaatgattggcaaacttctcgcca

SEQ ID NO: 37297 - DNA, 75 bp, Artificial Sequence
  Synthetic
tacaagttcaaattgggactttgcaaatcaaatggctaactactataatgggaagcaaaatagatttaacaaaga

SEQ ID NO: 37298 - DNA, 75 bp, Artificial Sequence
  Synthetic
atgaaaagtcacgaaagggtaacatggaatgattggcaaacttctcgccatttagatatgggctcgataaatcta

SEQ ID NO: 37299 - DNA, 75 bp, Artificial Sequence
  Synthetic
aatcaaatggctaactactataatgggaagcaaaatagatttaacaaagatttaaatttagcattatataccatg

SEQ ID NO: 37300 - DNA, 75 bp, Artificial Sequence
  Synthetic
taacaataattggagaagataataaattaacttatgcagaattgtgcctaaccaggagaactcctgaaaatataa

SEQ ID NO: 37301 - DNA, 75 bp, Artificial Sequence
  Synthetic
gttacttaatatctaaagtcctccatgagaaaaaatatgaccaattgactaatcttttaacacaattgaagacaa

SEQ ID NO: 37302 - DNA, 75 bp, Artificial Sequence
  Synthetic
tgagaaaaaatatgaccaattgactaatcttttaacacaattgaagacaaaatatcccggtaatgctttattgaa

SEQ ID NO: 37303 - DNA, 75 bp, Artificial Sequence
  Synthetic
atcaagacacgggcttaaatttgaaaacatgtctaaaatccaaacatacccgggcaactattatataacgtacag

SEQ ID NO: 37304 - DNA, 75 bp, Artificial Sequence
  Synthetic
aacatgtctaaaatccaaacatacccgggcaactattatataacgtacaggaagaaagatcgccaccaatttgtg

SEQ ID NO: 37305 - DNA, 75 bp, Artificial Sequence
  Synthetic
ttaaaaagccttagtgaaatgtctagttttacacctgacgagctctgggatgatctgcaatatgtcccagcccca

SEQ ID NO: 37306 - DNA, 75 bp, Artificial Sequence
  Synthetic
gttttacacctgacgagctctgggatgatctgcaatatgtcccagccccaacatttaaaccaaatctcggcagaa

SEQ ID NO: 37307 - DNA, 75 bp, Artificial Sequence
  Synthetic
taacaagaaggaatgaagagcacatggctattagaactagaatatacaatgaaataacaccagtatgtgtagtta

SEQ ID NO: 37308 - DNA, 75 bp, Artificial Sequence
  Synthetic
ggctattagaactagaatatacaatgaaataacaccagtatgtgtagttaatgttgcagaggtagatggtgacca

SEQ ID NO: 37309 - DNA, 75 bp, Artificial Sequence
  Synthetic
caaatcaagaatagtcgatccacaaactacatgtacctctttgaaaggagtgaattgcttatcgccaagatcgcg

SEQ ID NO: 37310 - DNA, 75 bp, Artificial Sequence
  Synthetic
actacatgtacctctttgaaaggagtgaattgcttatcgccaagatcgcgagcaagtgtgagtgatattatagca

SEQ ID NO: 37311 - DNA, 75 bp, Artificial Sequence
  Synthetic
tatttgaacaatgatatattttctctttcaaggattaaagttggacttgatgagtttgcgacaataaagaaagca

SEQ ID NO: 37312 - DNA, 75 bp, Artificial Sequence
  Synthetic
tgttttatgtaccaaatgataaaatccaccaatctaacacagatcagaatcaatattgtatcggtgattctcatt

SEQ ID NO: 37313 - DNA, 75 bp, Artificial Sequence
  Synthetic
tgagtttgcgacaataaagaaagcacacttcagtaaaatggtttcttttgaagggcccccaatcaagacagggct

SEQ ID NO: 37314 - DNA, 75 bp, Artificial Sequence
  Synthetic
ccaccaatctaacacagatcagaatcaatattgtatcggtgattctcattgcttaacaaaattcacgcccataac

SEQ ID NO: 37315 - DNA, 75 bp, Artificial Sequence
  Synthetic
tcccaagatttactcaatcttaattatgataatataagaaatagcaatctgatatctttctcaaaactaatttgc

SEQ ID NO: 37316 - DNA, 75 bp, Artificial Sequence
  Synthetic
aaatcaaaatgtcaggcttttgatttagacaatattgttaaaactagtacatcaactggggttagaagctgcttg

SEQ ID NO: 37317 - DNA, 75 bp, Artificial Sequence
  Synthetic
gatatctttctcaaaactaatttgctgtgaggggtcagataatataaatgatggtttagagtttctatctgatga

SEQ ID NO: 37318 - DNA, 75 bp, Artificial Sequence
  Synthetic
tagacaatattgttaaaactagtacatcaactggggttagaagctgcttggttaaaaagtttggaaactgcaaca

SEQ ID NO: 37319 - DNA, 75 bp, Artificial Sequence
  Synthetic
gcaatacattcaacaccaatcttcaatatatactattcaaagaaaggggaaaggcatatgacatacagaaatgct

SEQ ID NO: 37320 - DNA, 75 bp, Artificial Sequence
  Synthetic
tatatgctctgacgatcaatattattatacagacacgaaacaatcatatgactcatatcaagatattggacactt

SEQ ID NO: 37321 - DNA, 75 bp, Artificial Sequence
  Synthetic
atatatactattcaaagaaaggggaaaggcatatgacatacagaaatgctattaagcttttgatagagagggaaa

SEQ ID NO: 37322 - DNA, 75 bp, Artificial Sequence
  Synthetic
tatacagacacgaaacaatcatatgactcatatcaagatattggacacttctgcctatctccaaggtgttcaaca

SEQ ID NO: 37323 - DNA, 75 bp, Artificial Sequence
  Synthetic
attcagcgagaatggattcatatcaccagagaatcttgggtgcttagaagctatagtatcactaataagattatt

SEQ ID NO: 37324 - DNA, 75 bp, Artificial Sequence
  Synthetic
atctatctgcatgtacatggacggaagaatatacaccagtcgacaaaatttctgtgacaaatattgaggaaatag

SEQ ID NO: 37325 - DNA, 75 bp, Artificial Sequence
  Synthetic
agaatatacaccagtcgacaaaatttctgtgacaaatattgaggaaatagagcaatataaaaaagctctattaca

SEQ ID NO: 37326 - DNA, 75 bp, Artificial Sequence
  Synthetic
atagataaatgcattcatatatgcttaataaaaaatggcatggatcatatgtaccactcatttgatgtccctaaa

SEQ ID NO: 37327 - DNA, 75 bp, Artificial Sequence
  Synthetic
ttcaaatacaggaagacaagcaatctaccacacatcaagtcaatgtataaatacataacagttcaaggaacaggg

SEQ ID NO: 37328 - DNA, 75 bp, Artificial Sequence
  Synthetic
taataaaaaatggcatggatcatatgtaccactcatttgatgtccctaaatgtttcatgggaaaccccatcacca

SEQ ID NO: 37329 - DNA, 75 bp, Artificial Sequence
  Synthetic
taccacacatcaagtcaatgtataaatacataacagttcaaggaacagggactgctgaaggcgtagaaaatgctt

SEQ ID NO: 37330 - DNA, 75 bp, Artificial Sequence
  Synthetic
agagtttatcaatagtttaccagggacagatataccaccatggaatgtcatgacagaaaattttaagaagaaatg

SEQ ID NO: 37331 - DNA, 75 bp, Artificial Sequence
  Synthetic
ggccggtagttcttctggatttaaagttttatctaaagaaggtaatcatttatttgatgttgtggcctatataaa

SEQ ID NO: 37332 - DNA, 75 bp, Artificial Sequence
  Synthetic
acagatataccaccatggaatgtcatgacagaaaattttaagaagaaatgcattgctttaataaactcaaaattt

SEQ ID NO: 37333 - DNA, 75 bp, Artificial Sequence
  Synthetic
gttttatctaaagaaggtaatcatttatttgatgttgtggcctatataaagtctgcatcatattcctcagtttat

SEQ ID NO: 37334 - DNA, 75 bp, Artificial Sequence
  Synthetic
ttaccaaattaatgaagaaagagggtgggaggagcaatatagaatttgattaatagttatgttcttataggagat

SEQ ID NO: 37335 - DNA, 75 bp, Artificial Sequence
  Synthetic
ccttaggcataaatgtaaaacatgatgagaaatgcacagggccatgtcctgcaaacattccacataagacaggtt

SEQ ID NO: 37336 - DNA, 75 bp, Artificial Sequence
  Synthetic
tgagaaatgcacagggccatgtcctgcaaacattccacataagacaggttggttaacttttgctagagagagaac

SEQ ID NO: 37337 - DNA, 75 bp, Artificial Sequence
  Synthetic
agtagtgtactccacttgaatactttgaaaataatttgttgttgactgttttttacctgagggaaataatcaaga

SEQ ID NO: 37338 - DNA, 75 bp, Artificial Sequence
  Synthetic
ggatgcttggcaattagtgatggatgtgtttttggttcctgtcaagatataattaaacctgagatgactgtttat

SEQ ID NO: 37339 - DNA, 75 bp, Artificial Sequence
  Synthetic
gtgtttttggttcctgtcaagatataattaaacctgagatgactgtttataggaagcaaacagatgaaattgtca

SEQ ID NO: 37340 - DNA, 75 bp, Artificial Sequence
  Synthetic
ggacaaaacttattgcactgaattgaatgctgtaacacctataatatcagacttatttgaggtacaattcaaaac

SEQ ID NO: 37341 - DNA, 75 bp, Artificial Sequence
  Synthetic
aatgctgtaacacctataatatcagacttatttgaggtacaattcaaaacagtagaaagttacagtttacccaaa

SEQ ID NO: 37342 - DNA, 75 bp, Artificial Sequence
  Synthetic
tttttgtaggccaaatcaatgtcattggaactaattcaaaaggctgcggaaatgtgcaggtatttaatggaacaa

SEQ ID NO: 37343 - DNA, 75 bp, Artificial Sequence
  Synthetic
tggaactaattcaaaaggctgcggaaatgtgcaggtatttaatggaacaaattatggttcaggaacccccagatt

SEQ ID NO: 37344 - DNA, 75 bp, Artificial Sequence
  Synthetic
agaagagaagtcataatgaggaagtgttttgacaatgattaccaagcatgtaagtttttacaacaaccctcaagt

SEQ ID NO: 37345 - DNA, 75 bp, Artificial Sequence
  Synthetic
gttttgacaatgattaccaagcatgtaagtttttacaacaaccctcaagttttagacttgaggaagagggagaaa

SEQ ID NO: 37346 - DNA, 75 bp, Artificial Sequence
  Synthetic
cagaaatgtttttggagactttcaaattctacccactgactattggtattcacagagtcaagcaaggcatgatgg

SEQ ID NO: 37347 - DNA, 75 bp, Artificial Sequence
  Synthetic
attctacccactgactattggtattcacagagtcaagcaaggcatgatggaccctcagtacttgaagaaggcctt

SEQ ID NO: 37348 - DNA, 75 bp, Artificial Sequence
  Synthetic
aatattggggacaataaagatgaaagcaattttcggggacgtaaaatatagaacttttagtgaaaaagtggatat

SEQ ID NO: 37349 - DNA, 75 bp, Artificial Sequence
  Synthetic
gcaattttcggggacgtaaaatatagaacttttagtgaaaaagtggatataaatgctgaaggtgtctgcgcaggg

SEQ ID NO: 37350 - DNA, 75 bp, Artificial Sequence
  Synthetic
gcagacaaatggatgtctcagaaagttgctgcaattgctaaaagcctaaaggatgtggagcagcttaagtgggga

SEQ ID NO: 37351 - DNA, 75 bp, Artificial Sequence
  Synthetic
actgtgagttcacaatccacagcactgttgaaacaagttgtcctttagtagcagattgtcaattgttccatgaca

SEQ ID NO: 37352 - DNA, 75 bp, Artificial Sequence
  Synthetic
aaaggaggcctgagtgatactgctaagacattcctgcagaaattcggcatcaggcttccatagagggacaatgag

SEQ ID NO: 37353 - DNA, 75 bp, Artificial Sequence
  Synthetic
tgttgaaacaagttgtcctttagtagcagattgtcaattgttccatgacaggttacttataacaccaaatgaaca

SEQ ID NO: 37354 - DNA, 75 bp, Artificial Sequence
  Synthetic
aaagataaaccttcaaacactttgagatttagtatctgcaacacaaaggttgaagcaacagtcactataatagat

SEQ ID NO: 37355 - DNA, 75 bp, Artificial Sequence
  Synthetic
gatttagtatctgcaacacaaaggttgaagcaacagtcactataatagatgcaaaacctatattggagcttgccc

SEQ ID NO: 37356 - DNA, 75 bp, Artificial Sequence
  Synthetic
ggagaaagatgaaaggtgcaaaacatggctttgtagagtgaaagatgaaggtgtggcagttctattggagccatt

SEQ ID NO: 37357 - DNA, 75 bp, Artificial Sequence
  Synthetic
tggctttgtagagtgaaagatgaaggtgtggcagttctattggagccatttaagaacttgtttggttcatatata

SEQ ID NO: 37358 - DNA, 75 bp, Artificial Sequence
  Synthetic
tcgtcttagctatactagtttgtatatatatcgtcttgccagtatgctttaaaattaaagacactctaaagaagc

SEQ ID NO: 37359 - DNA, 75 bp, Artificial Sequence
  Synthetic
aagaaatgcaacaggagttttttcaaacaatgttgcaataaggaaatggctggtctctgattggcacgactgcag

SEQ ID NO: 37360 - DNA, 75 bp, Artificial Sequence
  Synthetic
atatatcgtcttgccagtatgctttaaaattaaagacactctaaagaagcacgaggatgcttacaaaagagaaat

SEQ ID NO: 37361 - DNA, 75 bp, Artificial Sequence
  Synthetic
gcccaaaaaaattgttgggggacatattaatgtaatagaggttggtgatgatctgtcactccacactgagtcata

SEQ ID NO: 37362 - DNA, 75 bp, Artificial Sequence
  Synthetic
attaatgtaatagaggttggtgatgatctgtcactccacactgagtcatatgtttgcagcgcagattgtactata

SEQ ID NO: 37363 - DNA, 75 bp, Artificial Sequence
  Synthetic
attttgaagaattaaaattagttttatttaaagaaggggatgggggggacaatatagacagctgattttacaaac

SEQ ID NO: 37364 - DNA, 75 bp, Artificial Sequence
  Synthetic
atttaaagaaggggatgggggggacaatatagacagctgattttacaaacatttagagttacttggtagcacact

SEQ ID NO: 37365 - DNA, 75 bp, Artificial Sequence
  Synthetic
ttaggcttcaaacagacactacaaatcattttgagattgcaggcactactgtgaagtcaggatggttcaaaagca

SEQ ID NO: 37366 - DNA, 75 bp, Artificial Sequence
  Synthetic
gtcagacttttattaagtggccaatttatgggtttttattattgcaaagtggggggtgggggactaacaacagcg

SEQ ID NO: 37367 - DNA, 75 bp, Artificial Sequence
  Synthetic
ttgtgaacatctcaaagtttcctgcggtccgaaatctatacaattccatgcttgttttaaccaacacatgtcctg

SEQ ID NO: 37368 - DNA, 75 bp, Artificial Sequence
  Synthetic
ggtccgaaatctatacaattccatgcttgttttaaccaacacatgtcctgtgttagatttttacatagaacgata

SEQ ID NO: 37369 - DNA, 75 bp, Artificial Sequence
  Synthetic
attccatattgcatgaataatggatcaccaagagtaccaacaattcctggctagaataaatgctgccagggatgc

SEQ ID NO: 37370 - DNA, 75 bp, Artificial Sequence
  Synthetic
tatgtcagaatattgagatcataattttagtcacactcgctctattaatctttatattattaagtatcttaagca

SEQ ID NO: 37371 - DNA, 75 bp, Artificial Sequence
  Synthetic
gcctgtattcattcctatagcatatgtgtatggtgtcatttataataagtcgtgtaaaaaatgcaaactatgtgg

SEQ ID NO: 37372 - DNA, 75 bp, Artificial Sequence
  Synthetic
tgtggcacacattgtgtttgcggtgctcgctatgatacttctgatagaatgaaactgcatagagcttctgggcta

SEQ ID NO: 37373 - DNA, 75 bp, Artificial Sequence
  Synthetic
tgtcctggttataaaagcttaagagctgccagagttatgtgcaaatcaaaagggcctgcatcaatattgtctata

SEQ ID NO: 37374 - DNA, 75 bp, Artificial Sequence
  Synthetic
agggcctgcatcaatattgtctataattactgcagtgttggtcttaacctttgtcacaccgatcaattccatggt

SEQ ID NO: 37375 - DNA, 75 bp, Artificial Sequence
  Synthetic
gagcttgaggagcttccagatgatatgctggaaatggcactgaggataaatttttactatttcacctgcattcta

SEQ ID NO: 37376 - DNA, 75 bp, Artificial Sequence
  Synthetic
tgctggaaatggcactgaggataaatttttactatttcacctgcattctaaattatgctgtgagctggagtcttg

SEQ ID NO: 37377 - DNA, 75 bp, Artificial Sequence
  Synthetic
ttcttgttgaaggtcgctcatggtgattttactttaacagccccatggtgcaaaacaggctgcccagatttctgg

SEQ ID NO: 37378 - DNA, 75 bp, Artificial Sequence
  Synthetic
actattcaaaaggtaccagcataagtttttaaatatttatgcaatgtattgtgaagaatgcgatatgtaccatga

SEQ ID NO: 37379 - DNA, 75 bp, Artificial Sequence
  Synthetic
gtgaagaatgcgatatgtaccatgacaaatctgggctgaaacgacatggtgacttcactaataagtgcaggcaat

SEQ ID NO: 37380 - DNA, 75 bp, Artificial Sequence
  Synthetic
gcacatgcggccaatatgaggatgcaacggggttgatgacccataggaaaacctacaattgcctagtgcaatata

SEQ ID NO: 37381 - DNA, 75 bp, Artificial Sequence
  Synthetic
aacggggttgatgacccataggaaaacctacaattgcctagtgcaatataaagcgaaatggataatgaatttcct

SEQ ID NO: 37382 - DNA, 75 bp, Artificial Sequence
  Synthetic
ataaaggattctgctataatcgtgcaagctgctggaaccgactttagctcctgcttagaaaccgaaagtataaat

SEQ ID NO: 37383 - DNA, 75 bp, Artificial Sequence
  Synthetic
ctgcttagaaaccgaaagtataaattggaattgcaccgggccattcttgaatctcgggaattgtcaaaaacaaca

SEQ ID NO: 37384 - DNA, 75 bp, Artificial Sequence
  Synthetic
tggaattgcaccgggccattcttgaatctcgggaattgtcaaaaacaacaaaagaaggagccctatgctaacatc

SEQ ID NO: 37385 - DNA, 75 bp, Artificial Sequence
  Synthetic
caatttcagtgcttgatattcctatgataacagagatcccagatgatattgcaagtgctttaagatatatagaag

SEQ ID NO: 37386 - DNA, 75 bp, Artificial Sequence
  Synthetic
gactgcagaatatgcaatgttgactaggtactgtgattattatacccaattttcagacaattcagggtacagcca

SEQ ID NO: 37387 - DNA, 75 bp, Artificial Sequence
  Synthetic
tttcagacaattcagggtacagccaaacaacatggagagtgtacttgagatcccatgactttgaggcgtgtataa

SEQ ID NO: 37388 - DNA, 75 bp, Artificial Sequence
  Synthetic
atgtgtaaaaaatggtgagaagtgcagcagctccaattgggattttgccaacgaaatgaaggactattactccgg

SEQ ID NO: 37389 - DNA, 75 bp, Artificial Sequence
  Synthetic
agcagctccaattgggattttgccaacgaaatgaaggactattactccggaaaacaagcaaagtttgacaaagat

SEQ ID NO: 37390 - DNA, 75 bp, Artificial Sequence
  Synthetic
accatgcttttaggggaacttcatctgcatacatagcaacaatgctttcaaaaaaatcaaacgatgacttgattg

SEQ ID NO: 37391 - DNA, 75 bp, Artificial Sequence
  Synthetic
catatacaaacaagataaagacaaagttcccaggcaatgcattactaaaagctataatagattatatagcataca

SEQ ID NO: 37392 - DNA, 75 bp, Artificial Sequence
  Synthetic
ctttaaacatgacgagttttgggatgaattattgtacaaacctacaccaacaaaggccccgaatcttgctagagg

SEQ ID NO: 37393 - DNA, 75 bp, Artificial Sequence
  Synthetic
gaattattgtacaaacctacaccaacaaaggccccgaatcttgctagagggagagaatcatcttataatttcaag

SEQ ID NO: 37394 - DNA, 75 bp, Artificial Sequence
  Synthetic
aaacctgcaaaaatgttaaagatgttgcttgcttatcacccagatcaggtgccatatatgcttcaataatagcat

SEQ ID NO: 37395 - DNA, 75 bp, Artificial Sequence
  Synthetic
gccatatatgcttcaataatagcatgtggcgaacctaatggaccaagtgtatatagaaaaccattaaatggtgta

SEQ ID NO: 37396 - DNA, 75 bp, Artificial Sequence
  Synthetic
gtggcgaacctaatggaccaagtgtatatagaaaaccattaaatggtgtatttcaatctagtactgaccaatcaa

SEQ ID NO: 37397 - DNA, 75 bp, Artificial Sequence
  Synthetic
cttagaagaatttgaagctattagccaagaagaattggatgcagtgaaaaagtccaaatgttgggagatagaata

SEQ ID NO: 37398 - DNA, 75 bp, Artificial Sequence
  Synthetic
caagaagaattggatgcagtgaaaaagtccaaatgttgggagatagaataccctgacataaagcctcttcaagaa

SEQ ID NO: 37399 - DNA, 75 bp, Artificial Sequence
  Synthetic
tgaaggattctggaaattgcaatgttgcaaccaacagatggccagtgatacaatgtgaaaatgataaattctact

SEQ ID NO: 37400 - DNA, 75 bp, Artificial Sequence
  Synthetic
attcagaactccagaaagattatgataagactcaagatattggccattactgcttaagtcctgggtgcactactg

SEQ ID NO: 37401 - DNA, 75 bp, Artificial Sequence
  Synthetic
tatctctaattgcaattggcaggtaagtagatctagcatagcgaaaatagatgtgcataatattgaagatattga

SEQ ID NO: 37402 - DNA, 75 bp, Artificial Sequence
  Synthetic
agtagatctagcatagcgaaaatagatgtgcataatattgaagatattgagcagtacaaaaaagctataactcaa

SEQ ID NO: 37403 - DNA, 75 bp, Artificial Sequence
  Synthetic
ttaaatatgctaaaacaaagaacttgccacacatcaaaccaatttataagtatataaccatagaagggaccgaaa

SEQ ID NO: 37404 - DNA, 75 bp, Artificial Sequence
  Synthetic
gccacacatcaaaccaatttataagtatataaccatagaagggaccgaaactgcagaaggaatagagagcgcata

SEQ ID NO: 37405 - DNA, 75 bp, Artificial Sequence
  Synthetic
gctggaacatcaattggattcaaaatcaactccaaagagggtaagcacttactagatgttatagcatatgtaaaa

SEQ ID NO: 37406 - DNA, 75 bp, Artificial Sequence
  Synthetic
tcaactccaaagagggtaagcacttactagatgttatagcatatgtaaaaagtgcctcatattcttcagtgtaca

SEQ ID NO: 37407 - DNA, 75 bp, Artificial Sequence
  Synthetic
atcaggcataaatacgaaacatgatgaattgtgcaccggaccatgtccagcaaacattaatcatcaggttggatg

SEQ ID NO: 37408 - DNA, 75 bp, Artificial Sequence
  Synthetic
gaattgtgcaccggaccatgtccagcaaacattaatcatcaggttggatggctcacatttgcaaaggagaggaca

SEQ ID NO: 37409 - DNA, 75 bp, Artificial Sequence
  Synthetic
gttgcctggctgtaagtgatggatgtgtatttggttcgtgccaagatataataaaagaagagctatccgtctata

SEQ ID NO: 37410 - DNA, 75 bp, Artificial Sequence
  Synthetic
tgtagaattatgcttaacattttctgacaaaacatattgtacaaacttaaacccagtcactcctatcataacaga

SEQ ID NO: 37411 - DNA, 75 bp, Artificial Sequence
  Synthetic
gtagagacttacagcttacctagaattgtcgctgtacagaatcatgagatcaagattggacaaataaatgattta

SEQ ID NO: 37412 - DNA, 75 bp, Artificial Sequence
  Synthetic
ttgtcgctgtacagaatcatgagatcaagattggacaaataaatgatttaggggtatattctaaaggatgcggaa

SEQ ID NO: 37413 - DNA, 75 bp, Artificial Sequence
  Synthetic
ttatggcaatggagttcctagattcgattatttatgccatttagctagtagaaaagaagtcattgttagaaaatg

SEQ ID NO: 37414 - DNA, 75 bp, Artificial Sequence
  Synthetic
ttttgacaatgattatcaggcatgtaaattcctccagagtcctgccagttacagacttgaggaggatagtgggac

SEQ ID NO: 37415 - DNA, 75 bp, Artificial Sequence
  Synthetic
acagacttgaggaggatagtgggactgtaactgtaatcgattataaaaaaatactaggtacaattaagatgaagg

SEQ ID NO: 37416 - DNA, 75 bp, Artificial Sequence
  Synthetic
tgtaactgtaatcgattataaaaaaatactaggtacaattaagatgaaggcaatattgggagatgttaaatacaa

SEQ ID NO: 37417 - DNA, 75 bp, Artificial Sequence
  Synthetic
actgcagaaggatcatgcactggctgcatcaattgttttgaaaacattcactgtgaattaacattgcataccaca

SEQ ID NO: 37418 - DNA, 75 bp, Artificial Sequence
  Synthetic
ctgtgaattaacattgcataccacaattgaggctagttgcccgattaaaagctcatgcacagtgttccatgacag

SEQ ID NO: 37419 - DNA, 75 bp, Artificial Sequence
  Synthetic
aagtatgcattaaaagtagtatgcacagaaaagccaggaaatacactaacaatcaaggtttgtaacactaagatt

SEQ ID NO: 37420 - DNA, 75 bp, Artificial Sequence
  Synthetic
gaagcttcaatggccctcgttgatgcaaaacctatcatagaattagcaccagttgaccaaacggcatatataagg

SEQ ID NO: 37421 - DNA, 75 bp, Artificial Sequence
  Synthetic
ggatgtgcagagtaagagatgaaggattacaagttatcttagagccatttaaaaatttatttggttcctatattg

SEQ ID NO: 37422 - DNA, 75 bp, Artificial Sequence
  Synthetic
attacaagttatcttagagccatttaaaaatttatttggttcctatattgggatattttacacatttataatatc

SEQ ID NO: 37423 - DNA, 75 bp, Artificial Sequence
  Synthetic
tatatcttattgcctatatgtttcaagctaagagatactcttaggaagcatgaagatgcatataagagagagatg

SEQ ID NO: 37424 - DNA, 75 bp, Artificial Sequence
  Synthetic
agctaagagatactcttaggaagcatgaagatgcatataagagagagatgaaaattagataggaggcctatatat

SEQ ID NO: 37425 - DNA, 75 bp, Artificial Sequence
  Synthetic
gatttatttatagtatagctgttgttaagtggggggtggggaattaacaacagcgtaaatttattttgcaaacat

SEQ ID NO: 37426 - DNA, 75 bp, Artificial Sequence
  Synthetic
agtagtgtactccacttgaatactttgaaaatagtttgtcattacttgagataccgagaggaataacttggaagt

SEQ ID NO: 37427 - DNA, 75 bp, Artificial Sequence
  Synthetic
gtgatgtctgatttggttttttatgatgtcgcatccaccggtgcaaatggatttgatcctgatgcagggtatgtg

SEQ ID NO: 37428 - DNA, 75 bp, Artificial Sequence
  Synthetic
gacttctgtattaaacatggggaagcaattaatctccattccgttaggatcttcttccttaatgccgcaaaagcc

SEQ ID NO: 37429 - DNA, 75 bp, Artificial Sequence
  Synthetic
aaagctgctctcgctcgtaagccggagaggaaggctagtcctaaatttggagagtggcaggtggaggtcgtcaat

SEQ ID NO: 37430 - DNA, 75 bp, Artificial Sequence
  Synthetic
acccaattgataacaacgatcttaccatccaccggctgtacgggtatttggctagatgggtgctagagcagttca

SEQ ID NO: 37431 - DNA, 75 bp, Artificial Sequence
  Synthetic
ggagttgattaaaacaaccgttatcaaccccatagctgagtctaatgggatcaggtgggacaatggagcagaaat

SEQ ID NO: 37432 - DNA, 75 bp, Artificial Sequence
  Synthetic
gaaatgtttctggaaacattcaatttttacccgctgacaattggcatttacagagtcaaacaaggaatgatggac

SEQ ID NO: 37433 - DNA, 75 bp, Artificial Sequence
  Synthetic
ggcagcgctatggctctcttactgcagacaagtggatgtcgcagaaaactactgccatagctaagagcctaaagg

SEQ ID NO: 37434 - DNA, 75 bp, Artificial Sequence
  Synthetic
aggcggccttagcgacactgcaagaacattcttgcagaaatttggaatcagactcccataaatgggattaagtct

SEQ ID NO: 37435 - DNA, 75 bp, Artificial Sequence
  Synthetic
ttattgtaataatttggtcataattggctatccaaaagggttccccaagagcccacaataatagcagctaaatgg

SEQ ID NO: 37436 - DNA, 75 bp, Artificial Sequence
  Synthetic
gcccacaataatagcagctaaatgggtgggtggtaggggacacgaaaaaaatagaagttagatcatttattttat

SEQ ID NO: 37437 - DNA, 75 bp, Artificial Sequence
  Synthetic
gtgggtggtaggggacacgaaaaaaatagaagttagatcatttattttataaaaggtattcagtggagcacacta

SEQ ID NO: 37438 - DNA, 75 bp, Artificial Sequence
  Synthetic
atgatgacgagtctcagagagaactcataaggagcaccatcataaatccaattgcagaatccaatggaattcatt

SEQ ID NO: 37439 - DNA, 75 bp, Artificial Sequence
  Synthetic
cataaggagcaccatcataaatccaattgcagaatccaatggaattcattggaacaatggcccagaaatttatct

SEQ ID NO: 37440 - DNA, 75 bp, Artificial Sequence
  Synthetic
ttcctagaaattttcaagttctacccgttaaccatcgggatttacagagtcaaacatggtatgatggatccccag

SEQ ID NO: 37441 - DNA, 75 bp, Artificial Sequence
  Synthetic
cgttaaccatcgggatttacagagtcaaacatggtatgatggatccccagtacttgaagaaggctctcaggcaac

SEQ ID NO: 37442 - DNA, 75 bp, Artificial Sequence
  Synthetic
gtggatggcacagaagacagtgctcattgctaagagcttgaaggatgtcgagcagctcaaatggggaagaggagg

SEQ ID NO: 37443 - DNA, 75 bp, Artificial Sequence
  Synthetic
attgctaagagcttgaaggatgtcgagcagctcaaatggggaagaggaggacttagtgatgctgcaagaaccttc

SEQ ID NO: 37444 - DNA, 75 bp, Artificial Sequence
  Synthetic
cataaacaaaaatagcaatggcatttcagtaatattcgatatataaattggtaaatttcaaattttaaaattggt

SEQ ID NO: 37445 - DNA, 75 bp, Artificial Sequence
  Synthetic
tagcagcacaatgggtgggtggtaggggacagcaacttaatagatctcaggtcattgatttagttaaatgtattc

SEQ ID NO: 37446 - DNA, 75 bp, Artificial Sequence
  Synthetic
aaatactaaagtcttaaaacaaaaccaatgatgattttcatattgatactgtttgcagtcagtgctgcaagtcca

SEQ ID NO: 37447 - DNA, 75 bp, Artificial Sequence
  Synthetic
atgatacctccgatagaatgaaattacacagatcttctggtctatgccctggatataagagtctaagggctgcca

SEQ ID NO: 37448 - DNA, 75 bp, Artificial Sequence
  Synthetic
tggggcaattggctaattttcaaaagaggggggattggaagcaactgtataaatttgtagataggagcacactac

SEQ ID NO: 37449 - DNA, 75 bp, Artificial Sequence
  Synthetic
ggcattcaaattaggttctaaattctaaatttatatatgtcaatttgattaattggttatccaaagggttttcta

SEQ ID NO: 37450 - DNA, 75 bp, Artificial Sequence
  Synthetic
ttgcagattggcatgactgtaggccccaaaagtcatcaggtggtcatattaatgttattgaagttggagatgatc

SEQ ID NO: 37451 - DNA, 75 bp, Artificial Sequence
  Synthetic
aaacataccggaggatatagcaggagcactaagatatatagaagaaaaagacacctttcatgttcaattaactgc

SEQ ID NO: 37452 - DNA, 75 bp, Artificial Sequence
  Synthetic
tcgaataatgatctggttacatacaccaataagataaaggaaaagttccctggaaatgctttattgaaagctata

SEQ ID NO: 37453 - DNA, 75 bp, Artificial Sequence
  Synthetic
cccctcctctgtcaagagatagtgaaccatcatacaacttcaagtcagttatctcctcaagatctgtgaaaagct

SEQ ID NO: 37454 - DNA, 75 bp, Artificial Sequence
  Synthetic
ctagatgatttacccaatgatatggtacaaatggcggagagggtgaatatctattatcaaataaccatcattaat

SEQ ID NO: 37455 - DNA, 75 bp, Artificial Sequence
  Synthetic
tttgtcacctagatctggcgtgtcttacgactctatattggcatgcggtgaaccaaatggaccaagtgtgtacaa

SEQ ID NO: 37456 - DNA, 75 bp, Artificial Sequence
  Synthetic
gccttggtttaattttggcatacttcttcaaaaaatatcaacataaatttctagatttttatgcgatgtattgtg

SEQ ID NO: 37457 - DNA, 75 bp, Artificial Sequence
  Synthetic
gaagccatctgatggtatattccagtccaattcggataagacaatgtattgcttagctgatagtcactgcttaga

SEQ ID NO: 37458 - DNA, 75 bp, Artificial Sequence
  Synthetic
tacaattgtttggtcaaatataaagcgaaatggataagagacatactcatcatatatttggctatgattctgatc

SEQ ID NO: 37459 - DNA, 75 bp, Artificial Sequence
  Synthetic
gaaaatgataaattctattactcagaattacagaatgattacgataaaacacaggatatcggacatttttgcctt

SEQ ID NO: 37460 - DNA, 75 bp, Artificial Sequence
  Synthetic
tgctgaatatgccttcctcaccaggtactgcgactattatacacaatacacagataaatctggctatagtcaaac

SEQ ID NO: 37461 - DNA, 75 bp, Artificial Sequence
  Synthetic
agtatggaggacttatttacgatctcatgattttggtgcatgtgttgtttatccgaatcaacatttttgtagatg

SEQ ID NO: 37462 - DNA, 75 bp, Artificial Sequence
  Synthetic
tggccaaataaatgatttgggagtttactcgaaaggttgtggtaacgttcaaaaagtgaatgggacagtttatgg

SEQ ID NO: 37463 - DNA, 75 bp, Artificial Sequence
  Synthetic
aaaaagtgaatgggacagtttatggcaatggggtcccaaaatttgattatttgtgtcatctagctagcaggaaag

SEQ ID NO: 37464 - DNA, 75 bp, Artificial Sequence
  Synthetic
aggtcattgtgaggaagtgctttgataatgattaccaagcatgcaaattcttacagacaccagcaagttacagac

SEQ ID NO: 37465 - DNA, 75 bp, Artificial Sequence
  Synthetic
gggacaatcaaaatgaaagctatcttaggggatgtcaaatataaaacttttgcagataatgtagatatgactgct

SEQ ID NO: 37466 - DNA, 75 bp, Artificial Sequence
  Synthetic
taggggatgtcaaatataaaacttttgcagataatgtagatatgactgctgaaggatcatgtgccgggtgtataa

SEQ ID NO: 37467 - DNA, 75 bp, Artificial Sequence
  Synthetic
tcattagctcttattgatgctaagccaatactagagttagcaccagttgatcaaacagcttacattagagagaaa

SEQ ID NO: 37468 - DNA, 75 bp, Artificial Sequence
  Synthetic
gtagggtgagagatgaaggcttgcaggtcattttagaacctttcaagaacttatttggctcttatatagggatat

SEQ ID NO: 37469 - DNA, 75 bp, Artificial Sequence
  Synthetic
ggtcattttagaacctttcaagaacttatttggctcttatatagggatattttatacctttattatctgtatgat

SEQ ID NO: 37470 - DNA, 75 bp, Artificial Sequence
  Synthetic
aggtaagataggttggtagattaaggtcagacttttattaagtggccaatttatgggtttttattattgcaaagt

SEQ ID NO: 37471 - DNA, 75 bp, Artificial Sequence
  Synthetic
gtcagacttttattaagtggccaatttatgggtttttattattgcaaagtggggggtgggggactaaacaacagc

SEQ ID NO: 37472 - DNA, 75 bp, Artificial Sequence
  Synthetic
agtagtgtgctccacttgaatactttgaaaatactttgtcgctaattgtttttgcctaagggaattacttggaag

SEQ ID NO: 37473 - DNA, 75 bp, Artificial Sequence
  Synthetic
ttggctatccaaaagggttttcctaagggagcccacaacaatagcagctgaatgggtgggtggtaggggacagca

SEQ ID NO: 37474 - DNA, 75 bp, Artificial Sequence
  Synthetic
tatattatattgcccatttgtttcaaattgagggacaccttaaggcagcatgaagatgcctataaaaaggaaatg

SEQ ID NO: 37475 - DNA, 75 bp, Artificial Sequence
  Synthetic
aatgggtgggtggtaggggacagcaaagaaatagatgtcaggtcattgataaaataaaatgtattcagtggagca

SEQ ID NO: 37476 - DNA, 75 bp, Artificial Sequence
  Synthetic
accaagagtaccaacaattcctggctagaaaaaatgctgccagggatgcttgcattgcaaaagatatagatgttg

SEQ ID NO: 37477 - DNA, 75 bp, Artificial Sequence
  Synthetic
atttgttaatggccaggcatgattactttggaaaagaattatgcaaatctttgaatatagaatatagaaatgacg

SEQ ID NO: 37478 - DNA, 75 bp, Artificial Sequence
  Synthetic
actttagatgcaccgcatatcactcctgacaattatctgtatataaacaatatcttatatattatagattataaa

SEQ ID NO: 37479 - DNA, 75 bp, Artificial Sequence
  Synthetic
ggagataaatgcagacatgtctaaatggagtgctcaggatgttttttacaaatacttctggcttatagccttaga

SEQ ID NO: 37480 - DNA, 75 bp, Artificial Sequence
  Synthetic
gttgaagttgttcaaaaatttctgtggtataggaaagcataagcaattcaaaaacaagatgcttgatgatgtaga

SEQ ID NO: 37481 - DNA, 75 bp, Artificial Sequence
  Synthetic
agatgccaataaggaaacatatgaaaatatgcataaaatttttgaaactagatactggcagtgcatatcagattt

SEQ ID NO: 37482 - DNA, 75 bp, Artificial Sequence
  Synthetic
gaagcatctatggcccttgtcgacgcaaagcctatcatagaactagcaccagttgatcagacagcatatataaga

SEQ ID NO: 37483 - DNA, 75 bp, Artificial Sequence
  Synthetic
ttctacaaatatttctggcttattgcattggaccccattctttacccacaagaaaaagaacggattctatttttc

SEQ ID NO: 37484 - DNA, 75 bp, Artificial Sequence
  Synthetic
atgtgcaattatatgcaaaaagagttgatcttaccagatgagttacttttcaacctattggatcagaagattgta

SEQ ID NO: 37485 - DNA, 75 bp, Artificial Sequence
  Synthetic
caacctattggatcagaagattgtatatcaaaatgacattataaccacaatgacaaatcaattgaattctaacac

SEQ ID NO: 37486 - DNA, 75 bp, Artificial Sequence
  Synthetic
cagggcaactttaattatacatctagctatgtgcacagttgtgccatgtcagtgtacaaagaagtccttaaagaa

SEQ ID NO: 37487 - DNA, 75 bp, Artificial Sequence
  Synthetic
ttgcccgccaagtctggcttgggtttccatagccatcagtcactggatgacatctctaacttataatatgcttcc

SEQ ID NO: 37488 - DNA, 75 bp, Artificial Sequence
  Synthetic
atgatatctgagccgggtgacggcaagttgaaggtgctggagcaaaaatcagaacaagaaattcgattcttggtc

SEQ ID NO: 37489 - DNA, 75 bp, Artificial Sequence
  Synthetic
gagactacaaggcaaaagaatcgtgaaatagatgaggcaattgaagcattagctgcagaaggatatgagagtaat

SEQ ID NO: 37490 - DNA, 75 bp, Artificial Sequence
  Synthetic
tagtattagatgctgaaatggatccgagcgacatcatgggtgaaacaagtgatatgagaggaagatccatactga

SEQ ID NO: 37491 - DNA, 75 bp, Artificial Sequence
  Synthetic
gatatgagaggaagatccatactgacacctagaaaattcaccacagctggtagcctaagaaaactgtattcattc

SEQ ID NO: 37492 - DNA, 75 bp, Artificial Sequence
  Synthetic
tctagaaaaggagccagatatattaggaaaagtgacttttacagaagcatacagactgttgattagagatttaac

SEQ ID NO: 37493 - DNA, 75 bp, Artificial Sequence
  Synthetic
tgggaatgtcctgctcaaccatgccagaatttaggaatttaaaattaatccatcattctccagccttggttttaa

SEQ ID NO: 37494 - DNA, 75 bp, Artificial Sequence
  Synthetic
aaatatagcatttgaatgtttcaagctgataacacactttgcagattctttcatagattcatcatctaggtctgc

SEQ ID NO: 37495 - DNA, 75 bp, Artificial Sequence
  Synthetic
cctctgcttttccgaactggagacctcaaacaagcagacctggataaatatgatgcaatgaaaagtcatgagagg

SEQ ID NO: 37496 - DNA, 75 bp, Artificial Sequence
  Synthetic
gttacatggaatgactggcaaacatctcgccacttagatatgggtagtataaatttaacgatcactggatacaat

SEQ ID NO: 37497 - DNA, 75 bp, Artificial Sequence
  Synthetic
ataataagctaacatatgcggagttatgcctaactaggaagaccccagagaatattactataagtggccggaaat

SEQ ID NO: 37498 - DNA, 75 bp, Artificial Sequence
  Synthetic
cttttagaaagaaggatcgacatcaattcgtgtatcaaatacattcgcatgagtctattacaagaagaaatgagg

SEQ ID NO: 37499 - DNA, 75 bp, Artificial Sequence
  Synthetic
aaaagcacactttagtaaaatggtttcctttgaaggccctccgatcaaaacaggcctcctggatctaacagagct

SEQ ID NO: 37500 - DNA, 75 bp, Artificial Sequence
  Synthetic
tgtggcacacattgtgtctgtggtgcccgctatgatacttcagatagaatgaaactgcacagagcttctggattg

SEQ ID NO: 37501 - DNA, 75 bp, Artificial Sequence
  Synthetic
aaggggagagacatatgacatatagaaatgctataaaaatgttgatagaaagggagacaaaagtatttgaagagg

SEQ ID NO: 37502 - DNA, 75 bp, Artificial Sequence
  Synthetic
ctttcactttcagcagcaatggctttgtacccccggaaaaccttggctgtctagaggctatagtgtccttaatta

SEQ ID NO: 37503 - DNA, 75 bp, Artificial Sequence
  Synthetic
attactgcagtactggtcttaacctttgtaacaccaatcaactctatggttttaggggaaagtaaagaaacgttt

SEQ ID NO: 37504 - DNA, 75 bp, Artificial Sequence
  Synthetic
tttaggggaaagtaaagaaacgtttgaacttgaagagcttccagatgacatgttggaaatggcatcgaggataga

SEQ ID NO: 37505 - DNA, 75 bp, Artificial Sequence
  Synthetic
tgtttagagaatttgtgagtagtttgcctagtaccgatataccaccttggaatgtcatgacagaaaatttcaaga

SEQ ID NO: 37506 - DNA, 75 bp, Artificial Sequence
  Synthetic
aagaaggtggcagaagcaatatagaattcgattaataaaaacaagccaacacatagtaaggttgacaaagtgtaa

SEQ ID NO: 37507 - DNA, 75 bp, Artificial Sequence
  Synthetic
agtagtgtactaccaagtatagataacgttcaaatctcatcttattccaaacatggaagtcctaaacttaatctg

SEQ ID NO: 37508 - DNA, 75 bp, Artificial Sequence
  Synthetic
acgttcaaatctcatcttattccaaacatggaagtcctaaacttaatctggttactagcattgtgttcagctagt

SEQ ID NO: 37509 - DNA, 75 bp, Artificial Sequence
  Synthetic
ccagtatttcaacgatgttttcaagatggagctatagtgaagcaaaacccatctaaggaagcagtgacagaggtg

SEQ ID NO: 37510 - DNA, 75 bp, Artificial Sequence
  Synthetic
atggagctatagtgaagcaaaacccatctaaggaagcagtgacagaggtgtgcttaaaggatgacgtgagcatga

SEQ ID NO: 37511 - DNA, 75 bp, Artificial Sequence
  Synthetic
aaacaccacagggacatttgctaataacatagctatgagaaaatggttggtcgcagattggcatgactgtaggcc

SEQ ID NO: 37512 - DNA, 75 bp, Artificial Sequence
  Synthetic
tcgcagattggcatgactgtaggccccaaaagtcatcaggtggtcatatcaacgttattgaagttggagatgatc

SEQ ID NO: 37513 - DNA, 75 bp, Artificial Sequence
  Synthetic
gaaacaaacaaagtttgataaagacttaaatctagccctaacagctttgcatcatgccttcagggggacctcatc

SEQ ID NO: 37514 - DNA, 75 bp, Artificial Sequence
  Synthetic
ttgcagtgcagattgtgttatcacagttgacaaagaaactgctcagatccgtttgcaaactgacaatacaaacca

SEQ ID NO: 37515 - DNA, 75 bp, Artificial Sequence
  Synthetic
gttgacaaagaaactgctcagatccgtttgcaaactgacaatacaaaccactttgaggttgctgggaccacagta

SEQ ID NO: 37516 - DNA, 75 bp, Artificial Sequence
  Synthetic
cttatattacacttgatcaaacatgtgagcatcttaaagtatcatgcggaccaaaatcgatacagtttcatgctt

SEQ ID NO: 37517 - DNA, 75 bp, Artificial Sequence
  Synthetic
ccaaaatcgatacagtttcatgcttgcttcaatcagcatatgtcttgtgtgcgattcttacatagaacaatacta

SEQ ID NO: 37518 - DNA, 75 bp, Artificial Sequence
  Synthetic
gtcaaaatatagaaataattatcttggttactctctcattagtaatcttcatattcttatcaatagtaagtaaga

SEQ ID NO: 37519 - DNA, 75 bp, Artificial Sequence
  Synthetic
catatgtatgttacttattaatgcctatcttcatcccaatagcttttatctatggatggatatacaataaatcct

SEQ ID NO: 37520 - DNA, 75 bp, Artificial Sequence
  Synthetic
agtttatcacccattcacagagtgtggaacacactgtgtatgtggtgcaagatatgaaacttctgataggatgaa

SEQ ID NO: 37521 - DNA, 75 bp, Artificial Sequence
  Synthetic
ggaacacactgtgtatgtggtgcaagatatgaaacttctgataggatgaaattgcatagagcatctggattgtgt

SEQ ID NO: 37522 - DNA, 75 bp, Artificial Sequence
  Synthetic
ctagagttatgtgcaaatcaaaaggaccagcttctatcctatctataatgactgcaattctcatactaacatttg

SEQ ID NO: 37523 - DNA, 75 bp, Artificial Sequence
  Synthetic
accagcttctatcctatctataatgactgcaattctcatactaacatttgtcactcctattagtgccatggttat

SEQ ID NO: 37524 - DNA, 75 bp, Artificial Sequence
  Synthetic
tgtatttgggtcatgccaagatataataaaagaagaactatctgtctataggaaggagaccgaagaagtgactga

SEQ ID NO: 37525 - DNA, 75 bp, Artificial Sequence
  Synthetic
ctagatgatttacccgatgatatggtacaaatggcagagagggtgaatatctattatcaaataatcatcattaat

SEQ ID NO: 37526 - DNA, 75 bp, Artificial Sequence
  Synthetic
gtagagacttacagcttgcccagaattgttgctgtgcaaaaccatgagattaagattgggcaaataaatgaccta

SEQ ID NO: 37527 - DNA, 75 bp, Artificial Sequence
  Synthetic
tgcttggtttaattttggcatacttcttcaaaaaatatcaacataaatttctagacttttatgcaatgtattgtg

SEQ ID NO: 37528 - DNA, 75 bp, Artificial Sequence
  Synthetic
atctggtttgacacactggggcgactttactaataaatgtagacagtgcacatgcggtcagtttgaagatgttgc

SEQ ID NO: 37529 - DNA, 75 bp, Artificial Sequence
  Synthetic
tacaattgtttggttaaatacaaagcaagatggataagggacatactcatcatgtatttggctatgattctgatc

SEQ ID NO: 37530 - DNA, 75 bp, Artificial Sequence
  Synthetic
gctcgtgcacagtattccatgacaggattcttgtgactccaaatgaacacaaatatgcattaaaaatggtgtgca

SEQ ID NO: 37531 - DNA, 75 bp, Artificial Sequence
  Synthetic
catcagggacagactttgctgcatgtatagatgagaaagtcgttacatggaactgcactgggccattcctaaatt

SEQ ID NO: 37532 - DNA, 75 bp, Artificial Sequence
  Synthetic
tatagatgagaaagtcgttacatggaactgcactgggccattcctaaatttaggtagatgcgacaaatctcagaa

SEQ ID NO: 37533 - DNA, 75 bp, Artificial Sequence
  Synthetic
aattaaagtttgcaacactaagattgaggcatctatggcccttgtcgatgcaaagcctatcatagaactagcacc

SEQ ID NO: 37534 - DNA, 75 bp, Artificial Sequence
  Synthetic
aatcagttgaagggcttaggagttatatctgttttggatatcccgatgataaaaaatatgccagatgaaatatca

SEQ ID NO: 37535 - DNA, 75 bp, Artificial Sequence
  Synthetic
tatctgttttggatatcccgatgataaaaaatatgccagatgaaatatcaggttcactaaagtatatcgatagcc

SEQ ID NO: 37536 - DNA, 75 bp, Artificial Sequence
  Synthetic
tgctgaatatgctttcctcaccaggtactgcgactattatacacaatacacggataactctggctatagtcgaac

SEQ ID NO: 37537 - DNA, 75 bp, Artificial Sequence
  Synthetic
agtatggaggacttacttacgatctcacgattttggtgcatgtgtcgtttatccgaatcaccatttatgtagatg

SEQ ID NO: 37538 - DNA, 75 bp, Artificial Sequence
  Synthetic
agtagtgtacaccacgtgaatactttgaaaatactttgaaataaattctataaaaaattgttgcatagtgagatg

SEQ ID NO: 37539 - DNA, 75 bp, Artificial Sequence
  Synthetic
agtagtgtactccacgtgaatactttgaaaatactttgaaataaattctataaaaaattgttgcatagtgagatg

SEQ ID NO: 37540 - DNA, 75 bp, Artificial Sequence
  Synthetic
agtagtgtaccccacgtgaatactttgaaaatactttgaaataaattctataaaaaattgttgcatagtgagatg

SEQ ID NO: 37541 - DNA, 75 bp, Artificial Sequence
  Synthetic
agtagtgtacgccacgtgaatactttgaaaatactttgaaataaattctataaaaaattgttgcatagtgagatg

SEQ ID NO: 37542 - DNA, 75 bp, Artificial Sequence
  Synthetic
tgaaaatactttgaaataaattctataaaaaattgttgcatagtgagatgtcagagcttgtcttttatgatgctc

SEQ ID NO: 37543 - DNA, 75 bp, Artificial Sequence
  Synthetic
agtgccaagtgggattttgccaatgagatgaaaacattctacacaggccagaaagtgaagtttaataaggattta

SEQ ID NO: 37544 - DNA, 75 bp, Artificial Sequence
  Synthetic
taaaaaattgttgcatagtgagatgtcagagcttgtcttttatgatgctccatcaacaggtgcaaacggatttga

SEQ ID NO: 37545 - DNA, 75 bp, Artificial Sequence
  Synthetic
aacttggcattattggtattacataaagcatttagaggcactggaactgcatatgtcgcggaagctatggctcgg

SEQ ID NO: 37546 - DNA, 75 bp, Artificial Sequence
  Synthetic
attgctgcacatgccggatcgtacgatctttctgctgttaggatcttcttcctcaatgctgccaaggccaagaat

SEQ ID NO: 37547 - DNA, 75 bp, Artificial Sequence
  Synthetic
atctttctgctgttaggatcttcttcctcaatgctgccaaggccaagaatgctctctcgagaaaaccagagggga

SEQ ID NO: 37548 - DNA, 75 bp, Artificial Sequence
  Synthetic
ttgctttggagataagaaaaaagttcccaacaaatgctttgttagcagcattaatagattatatagtttatttac

SEQ ID NO: 37549 - DNA, 75 bp, Artificial Sequence
  Synthetic
cccaacaaatgctttgttagcagcattaatagattatatagtttatttacagtcccttgcagaaatagccacatt

SEQ ID NO: 37550 - DNA, 75 bp, Artificial Sequence
  Synthetic
gtcggtggaggtggtcaataatcattttcctggcaacaggaacaatccaattggtaacaacgatcttaccatcca

SEQ ID NO: 37551 - DNA, 75 bp, Artificial Sequence
  Synthetic
tttcctggcaacaggaacaatccaattggtaacaacgatcttaccatccacagaatttcaggctatctcgcaaga

SEQ ID NO: 37552 - DNA, 75 bp, Artificial Sequence
  Synthetic
tttaaatataagccagagccaacagaatcaacacctcaagctaggtcacacagaaatgatcagtataacttcaaa

SEQ ID NO: 37553 - DNA, 75 bp, Artificial Sequence
  Synthetic
aatcaacacctcaagctaggtcacacagaaatgatcagtataacttcaaaaatgctgaaagtaatagtaatacca

SEQ ID NO: 37554 - DNA, 75 bp, Artificial Sequence
  Synthetic
aagatgatgaagcccagaaggacatcatccgctcaaccattgtgaacccaattgcagaatccaatgggatccact

SEQ ID NO: 37555 - DNA, 75 bp, Artificial Sequence
  Synthetic
catccgctcaaccattgtgaacccaattgcagaatccaatgggatccactgggatagcggtgcagatgcctacct

SEQ ID NO: 37556 - DNA, 75 bp, Artificial Sequence
  Synthetic
actatgtatttcacccaggtcaaaagcaaaattcgaaaatattatagcatgtggagagcatgcaaatccatctgt

SEQ ID NO: 37557 - DNA, 75 bp, Artificial Sequence
  Synthetic
tttctggaatcatttgatttcctcccattagcaattgggatctatagagtcaaaaatggcatgatggatgtccaa

SEQ ID NO: 37558 - DNA, 75 bp, Artificial Sequence
  Synthetic
gtggagagcatgcaaatccatctgtatacatgatgccaaatgtcagtatctaccaatccaattcggaaaggagtc

SEQ ID NO: 37559 - DNA, 75 bp, Artificial Sequence
  Synthetic
cattagcaattgggatctatagagtcaaaaatggcatgatggatgtccaatacctgaaaaaagctctccgtcaaa

SEQ ID NO: 37560 - DNA, 75 bp, Artificial Sequence
  Synthetic
ccttgagaaatatgaagtggtggaaacagaacttttgaatgctttaaagaagtcaaaatgttgggccaaggaaat

SEQ ID NO: 37561 - DNA, 75 bp, Artificial Sequence
  Synthetic
gtggatgtctactaagacaacagtaattgcaaagaccctgaagagagttgagagcttcaaatggggtaagggagg

SEQ ID NO: 37562 - DNA, 75 bp, Artificial Sequence
  Synthetic
acagaacttttgaatgctttaaagaagtcaaaatgttgggccaaggaaatggatgatattgtcttacataagcag

SEQ ID NO: 37563 - DNA, 75 bp, Artificial Sequence
  Synthetic
attgcaaagaccctgaagagagttgagagcttcaaatggggtaagggaggactaagtgaggcagccagagcattc

SEQ ID NO: 37564 - DNA, 75 bp, Artificial Sequence
  Synthetic
taaaagatactgggaactgcaatgttcaagaaaatgattggaccattgtcttatgtgaaaatggcaactattact

SEQ ID NO: 37565 - DNA, 75 bp, Artificial Sequence
  Synthetic
catgagtatgatgctcccctcgtggaattggaattccaaattcaaaattttcgtataaatatttggtaaaatttg

SEQ ID NO: 37566 - DNA, 75 bp, Artificial Sequence
  Synthetic
actctgaggtccacaaagactatgataaagatcaggatgtaggtcatttctgtcttagtcctagatgcactacaa

SEQ ID NO: 37567 - DNA, 75 bp, Artificial Sequence
  Synthetic
acaaatcaagcagcataatgggtgggtggtaggggacagcaagaggaaggaaattaattcattaaataaagtaaa

SEQ ID NO: 37568 - DNA, 75 bp, Artificial Sequence
  Synthetic
gggtggtaggggacagcaagaggaaggaaattaattcattaaataaagtaaatgtattcagtggagcacactact

SEQ ID NO: 37569 - DNA, 75 bp, Artificial Sequence
  Synthetic
tataaggaagtgcgaatggcaaatatcacattcaacaattgataaaatctctgttcaagagttagcagacataga

SEQ ID NO: 37570 - DNA, 75 bp, Artificial Sequence
  Synthetic
tgaaagcattttgttataacttgggataccgagaggattaatttggaagtgtaatgtctgatttagtcttttatg

SEQ ID NO: 37571 - DNA, 75 bp, Artificial Sequence
  Synthetic
tcacattcaacaattgataaaatctctgttcaagagttagcagacatagagcaatataagaaggccatatcacaa

SEQ ID NO: 37572 - DNA, 75 bp, Artificial Sequence
  Synthetic
agtagtgtactccacttgaatactttgaaagcattttgttataacttgggataccgagaggattaatttggaagt

SEQ ID NO: 37573 - DNA, 75 bp, Artificial Sequence
  Synthetic
tcaagtatgtaagaacaaaaaacctcccacatatcaaacccgcatataagtacataactgtagaaggtgtcgaaa

SEQ ID NO: 37574 - DNA, 75 bp, Artificial Sequence
  Synthetic
atttgatcctgatgcagggtatgtggacttttgtgttaaacatggagaatcaatcaatctccattccgttaggat

SEQ ID NO: 37575 - DNA, 75 bp, Artificial Sequence
  Synthetic
cccacatatcaaacccgcatataagtacataactgtagaaggtgtcgaaactattgaaggaatcgaaaacgcctt

SEQ ID NO: 37576 - DNA, 75 bp, Artificial Sequence
  Synthetic
gcaggtacagctataggtttcaaaataaattcaagagaaggcaactatttaatggatgtgataggatatgttaag

SEQ ID NO: 37577 - DNA, 75 bp, Artificial Sequence
  Synthetic
caaaactatatacaactgggcctactataggaataaacaccaaacatgatgaaaaatgcacaggaccttgcccag

SEQ ID NO: 37578 - DNA, 75 bp, Artificial Sequence
  Synthetic
tataggaataaacaccaaacatgatgaaaaatgcacaggaccttgcccagctgtaatagatcataaggatggttg

SEQ ID NO: 37579 - DNA, 75 bp, Artificial Sequence
  Synthetic
aggaaaatgaagatgctgctcagagggaattgatcaagacaactgtcatcaacccaatagctgagtctaacggaa

SEQ ID NO: 37580 - DNA, 75 bp, Artificial Sequence
  Synthetic
ggaattgatcaagacaactgtcatcaacccaatagctgagtctaacggaatcagatgggacaatggggcagaaat

SEQ ID NO: 37581 - DNA, 75 bp, Artificial Sequence
  Synthetic
agcacttggggttgtgaagagttcggttgcttagcagtcagtgatggttgtgtatttggctcttgccaagatata

SEQ ID NO: 37582 - DNA, 75 bp, Artificial Sequence
  Synthetic
gttgcttagcagtcagtgatggttgtgtatttggctcttgccaagatataataaaagatgagttggctgtttaca

SEQ ID NO: 37583 - DNA, 75 bp, Artificial Sequence
  Synthetic
gaaatgttcttggaaacattcaacttttacccgctgacaattggcatctacagagtcaagcatggaatgatggat

SEQ ID NO: 37584 - DNA, 75 bp, Artificial Sequence
  Synthetic
tttacccgctgacaattggcatctacagagtcaagcatggaatgatggatccacagtacctaaaaaaggcattaa

SEQ ID NO: 37585 - DNA, 75 bp, Artificial Sequence
  Synthetic
ggaaaaccactgaagaactcactacagtagaactgtgcttgacattttcagataaaacatattgcaccaacttga

SEQ ID NO: 37586 - DNA, 75 bp, Artificial Sequence
  Synthetic
gataaaacatattgcaccaacttgaatgctataactcctattataacagataaatttgaagtgcagttcaaaact

SEQ ID NO: 37587 - DNA, 75 bp, Artificial Sequence
  Synthetic
agacaaatggatgtcgcaaaaaactgttgccatagccaaaagcctgaaggatgttgaacaactcaaatggggaag

SEQ ID NO: 37588 - DNA, 75 bp, Artificial Sequence
  Synthetic
atgctataactcctattataacagataaatttgaagtgcagttcaaaactgttgaatcttatacactaccaaggg

SEQ ID NO: 37589 - DNA, 75 bp, Artificial Sequence
  Synthetic
gttgccatagccaaaagcctgaaggatgttgaacaactcaaatggggaagaggtggtctcagcgacaccgcaaga

SEQ ID NO: 37590 - DNA, 75 bp, Artificial Sequence
  Synthetic
taaagttggacaaatcaatgacttaggtgtctactcaaaaggatgtggaaatgttcaaaaggtcaatggaacaaa

SEQ ID NO: 37591 - DNA, 75 bp, Artificial Sequence
  Synthetic
aacttccgtgaatacaaaatgtcacaattaggctctaaattacaaattttacttctttaatttggtcgcaattgg

SEQ ID NO: 37592 - DNA, 75 bp, Artificial Sequence
  Synthetic
aattaggctctaaattacaaattttacttctttaatttggtcgcaattggctatccaaaaagggttttaagaacc

SEQ ID NO: 37593 - DNA, 75 bp, Artificial Sequence
  Synthetic
ctatggcaatggttcaccaaggtttgattatctctgccacttggcgagtagaaaggaagtaatcctaaggaaatg

SEQ ID NO: 37594 - DNA, 75 bp, Artificial Sequence
  Synthetic
ggtggtaggggacagataagaaataggattaggatgtcaacctaatgagaaatgtagtagagtatatttcttcga

SEQ ID NO: 37595 - DNA, 75 bp, Artificial Sequence
  Synthetic
aaattcttgcagagtccttcaagttatcgtttagaagagcaccaggggacagtgacagttatagattataaaaag

SEQ ID NO: 37596 - DNA, 75 bp, Artificial Sequence
  Synthetic
atcgtttagaagagcaccaggggacagtgacagttatagattataaaaagattttaggcactataaagatgaagg

SEQ ID NO: 37597 - DNA, 75 bp, Artificial Sequence
  Synthetic
ggtgggtggtaggggacagcaaactaatagaattaaatcatttactttataaaaggtattcagtggagcacacta

SEQ ID NO: 37598 - DNA, 75 bp, Artificial Sequence
  Synthetic
aaattatcaaaataatatagaaatcaatgctgagggaacatgtgctggatgtattgattgctttgaaaatataca

SEQ ID NO: 37599 - DNA, 75 bp, Artificial Sequence
  Synthetic
gtattgattgctttgaaaatatacactgtgaatttactatacatactacagttgaagcaagttgtcctataacaa

SEQ ID NO: 37600 - DNA, 75 bp, Artificial Sequence
  Synthetic
aatattgatcacaccagatgaacataagtatgcattgaagattgtatgccatgataaaccaaaagtgtctcttaa

SEQ ID NO: 37601 - DNA, 75 bp, Artificial Sequence
  Synthetic
aagtatgcattgaagattgtatgccatgataaaccaaaagtgtctcttaaatttaaaatctgtaacacaaatgtt

SEQ ID NO: 37602 - DNA, 75 bp, Artificial Sequence
  Synthetic
ctaaaccaattttagaacttgcgccagtagatcaaacaacatatatcagagagaaagatgaaagatgcaagactt

SEQ ID NO: 37603 - DNA, 75 bp, Artificial Sequence
  Synthetic
gagaaagatgaaagatgcaagacttggatgtgtagagtccgagatgaagggttccaggtgatattagaacctttt

SEQ ID NO: 37604 - DNA, 75 bp, Artificial Sequence
  Synthetic
ggatattttatactggtatactgtctattatttgtttactcattgtcgtctatattatattgcccatttgtttca

SEQ ID NO: 37605 - DNA, 75 bp, Artificial Sequence
  Synthetic
tattatttgtttactcattgtcgtctatattatattgcccatttgtttcaaattaagggacactttaaggcagca

SEQ ID NO: 37606 - DNA, 75 bp, Artificial Sequence
  Synthetic
tatattatattgcccatttgtttcaaattaagggacactttaaggcagcatgaagatgcctatagaaaggaaatg

SEQ ID NO: 37607 - DNA, 75 bp, Artificial Sequence
  Synthetic
gagatagtataatagattttaagtagtttttgggttttatgggggtggggttaaacaaaactgctgagtttattt

SEQ ID NO: 37608 - DNA, 75 bp, Artificial Sequence
  Synthetic
gtttttgggttttatgggggtggggttaaacaaaactgctgagtttattttagaatcatttaaatatacttggta

SEQ ID NO: 37609 - DNA, 75 bp, Artificial Sequence
  Synthetic
ggaattggggtttagatattaaggggagggggggctaacaacagcgtaatctatttgacaaacattattttatac

SEQ ID NO: 37610 - DNA, 75 bp, Artificial Sequence
  Synthetic
ggagatttggttttttatgatgtcgcatccacaggtgcaaatggatttgatccagatgcagggtttgtggcattt

SEQ ID NO: 37611 - DNA, 75 bp, Artificial Sequence
  Synthetic
atctgtcagccgttaggatcttcttccttaatgcagcaaaagccaaagctgctctcgctcgtaaaccggagcgga

SEQ ID NO: 37612 - DNA, 75 bp, Artificial Sequence
  Synthetic
atgaggatgaatcccagagggagcttatacgaagcaccatcataaatccaattgcagagtccaatggaattcatt

SEQ ID NO: 37613 - DNA, 75 bp, Artificial Sequence
  Synthetic
tatacgaagcaccatcataaatccaattgcagagtccaatggaattcattggaacaatggtccagaaatttacct

SEQ ID NO: 37614 - DNA, 75 bp, Artificial Sequence
  Synthetic
tttctggaagctttcaaattctaccctctaaccattggaatttacagagtcaaacatggtatgatggatccccaa

SEQ ID NO: 37615 - DNA, 75 bp, Artificial Sequence
  Synthetic
ctctaaccattggaatttacagagtcaaacatggtatgatggatccccaatacttaaagaaagccctcagacaac

SEQ ID NO: 37616 - DNA, 75 bp, Artificial Sequence
  Synthetic
atggatggcacagaagacagtgctcattgccaagagcctaaaggatgtggagcagcttaaatggggaagaggagg

SEQ ID NO: 37617 - DNA, 75 bp, Artificial Sequence
  Synthetic
ttgatcaaatttggtgtgaaattgccttgaaaaataatggcaagtttcaaccaggtgtataattggcgtattggt

SEQ ID NO: 37618 - DNA, 75 bp, Artificial Sequence
  Synthetic
cttgaaaaataatggcaagtttcaaccaggtgtataattggcgtattggtaaattttacaattgatctaaatttc

SEQ ID NO: 37619 - DNA, 75 bp, Artificial Sequence
  Synthetic
taacgtttaaatactaaagttttaaaacaaagccaaagatgattttcatattagtactgcttgcagtcagtactg

SEQ ID NO: 37620 - DNA, 75 bp, Artificial Sequence
  Synthetic
aacaaagccaaagatgattttcatattagtactgcttgcagtcagtactgcgagtccagtgtatcagcggtgctt

SEQ ID NO: 37621 - DNA, 75 bp, Artificial Sequence
  Synthetic
ttagtactgcttgcagtcagtactgcgagtccagtgtatcagcggtgcttccaggatggggctatagtgaagcag

SEQ ID NO: 37622 - DNA, 75 bp, Artificial Sequence
  Synthetic
aggtgtgccttaaagatgatgttagcatgataaagacagaagcaaggtatatgaagaatgccacaggaacttttt

SEQ ID NO: 37623 - DNA, 75 bp, Artificial Sequence
  Synthetic
catgataaagacagaagcaaggtatatgaagaatgccacaggaactttttccaacaacgtagccatcaggaaatg

SEQ ID NO: 37624 - DNA, 75 bp, Artificial Sequence
  Synthetic
agacctaagaaagtctcgggcgggcatattaatgtcatagaggttggtgatgatctctcactccatactgagtct

SEQ ID NO: 37625 - DNA, 75 bp, Artificial Sequence
  Synthetic
atattaatgtcatagaggttggtgatgatctctcactccatactgagtcttatgtctgcagtgctgattgcacaa

SEQ ID NO: 37626 - DNA, 75 bp, Artificial Sequence
  Synthetic
ggttagactccaaactgacacaacgaaccattttgaaatagcaggcacaaccgtaaaatcagggtggtttaagag

SEQ ID NO: 37627 - DNA, 75 bp, Artificial Sequence
  Synthetic
aaccattttgaaatagcaggcacaaccgtaaaatcagggtggtttaagagcacaacatacataactctagaccaa

SEQ ID NO: 37628 - DNA, 75 bp, Artificial Sequence
  Synthetic
agtagtgtactccacttgaatactttgaaaatagtttgtcattactcgagataccgagagaataacttggaagtg

SEQ ID NO: 37629 - DNA, 75 bp, Artificial Sequence
  Synthetic
gcggacccaaatcagttcaattccatgcatgcttcaaccaacacatgtcctgtgtcagatttttgcacagaacag

SEQ ID NO: 37630 - DNA, 75 bp, Artificial Sequence
  Synthetic
tgcatgcttcaaccaacacatgtcctgtgtcagatttttgcacagaacagtcttgcctggatccattgctaattc

SEQ ID NO: 37631 - DNA, 75 bp, Artificial Sequence
  Synthetic
attttagtgactctcacgctattgatttttgtactcttaagtatactaagtaagacttacatctgctacttgctg

SEQ ID NO: 37632 - DNA, 75 bp, Artificial Sequence
  Synthetic
tttttgtactcttaagtatactaagtaagacttacatctgctacttgctgatgcctatctttatccctatagcat

SEQ ID NO: 37633 - DNA, 75 bp, Artificial Sequence
  Synthetic
gtcttgcaaaaaatgtaagctatgtgggttagtttatcacccattcacggaatgcgggacacattgtgtatgcgg

SEQ ID NO: 37634 - DNA, 75 bp, Artificial Sequence
  Synthetic
gggttagtttatcacccattcacggaatgcgggacacattgtgtatgcggtgctcgctatgacacctctgatagg

SEQ ID NO: 37635 - DNA, 75 bp, Artificial Sequence
  Synthetic
tgtgccctggctacaagagtttaagagctgcaagggtcatgtgtaagtcaaagggtcctgcgtcaatactgtcaa

SEQ ID NO: 37636 - DNA, 75 bp, Artificial Sequence
  Synthetic
agctgcaagggtcatgtgtaagtcaaagggtcctgcgtcaatactgtcaataattacggcaatattggttctaac

SEQ ID NO: 37637 - DNA, 75 bp, Artificial Sequence
  Synthetic
tatttggcattcttcccaggcacagaaatgtttctggaaacattcaatttttacccgctgacaattggcatttac

SEQ ID NO: 37638 - DNA, 75 bp, Artificial Sequence
  Synthetic
gttataggagaaagcaaggaagttttcgaactagaagaactcccagatgacatgctagaaatggctttgaaaata

SEQ ID NO: 37639 - DNA, 75 bp, Artificial Sequence
  Synthetic
tcgaactagaagaactcccagatgacatgctagaaatggctttgaaaataaatttttactattttgtttgcgtca

SEQ ID NO: 37640 - DNA, 75 bp, Artificial Sequence
  Synthetic
catagttgttgctttgctaattgggctggtatttaaaaagtaccagcatagatttttaaacctttatgcgatgta

SEQ ID NO: 37641 - DNA, 75 bp, Artificial Sequence
  Synthetic
ctggtatttaaaaagtaccagcatagatttttaaacctttatgcgatgtattgtgaagagtgcgacatgtatcac

SEQ ID NO: 37642 - DNA, 75 bp, Artificial Sequence
  Synthetic
gagactttacaaataaatgtagacagtgcacatgtggacagtatgaagatgccactggtctaataacgcacagga

SEQ ID NO: 37643 - DNA, 75 bp, Artificial Sequence
  Synthetic
gtgcacatgtggacagtatgaagatgccactggtctaataacgcacaggaagacatataactgccttgtgaaata

SEQ ID NO: 37644 - DNA, 75 bp, Artificial Sequence
  Synthetic
ctaataacttatatggtcttaactttgattaaggattcagctatagttgtgcaggctgctggaacagatttcagt

SEQ ID NO: 37645 - DNA, 75 bp, Artificial Sequence
  Synthetic
atcaacagttcctggccagaattaatgctgctagggatgcttgtatcgccaaagatatagacgttgatttattga

SEQ ID NO: 37646 - DNA, 75 bp, Artificial Sequence
  Synthetic
tgattaaggattcagctatagttgtgcaggctgctggaacagatttcagtgcttgtttagaagcacagagtgtgg

SEQ ID NO: 37647 - DNA, 75 bp, Artificial Sequence
  Synthetic
atatgcataatggaccatcaagagtatcaacagttcctggccagaattaatgctgctagggatgcttgtatcgcc

SEQ ID NO: 37648 - DNA, 75 bp, Artificial Sequence
  Synthetic
gaaccttggtaattgtcaaaaacagcagaagaaggagtcttatgcaaacatcgcaacacaactcaaaggcctaca

SEQ ID NO: 37649 - DNA, 75 bp, Artificial Sequence
  Synthetic
cagaagaaggagtcttatgcaaacatcgcaacacaactcaaaggcctacaggcgatctcagtactcgacatgccc

SEQ ID NO: 37650 - DNA, 75 bp, Artificial Sequence
  Synthetic
tagcaggggcattaagatatatagaagaaaaagaaactttccatgttcaactaactgcagaatatgctatgttaa

SEQ ID NO: 37651 - DNA, 75 bp, Artificial Sequence
  Synthetic
agaaaaagaaactttccatgttcaactaactgcagaatatgctatgttaaccagatattgcgattattatactca

SEQ ID NO: 37652 - DNA, 75 bp, Artificial Sequence
  Synthetic
cagactacatggagagtttatctgagatcacatgactttgatgcttgtatactttatccaaatcaacacttttgc

SEQ ID NO: 37653 - DNA, 75 bp, Artificial Sequence
  Synthetic
gatcacatgactttgatgcttgtatactttatccaaatcaacacttttgccgatgcgttaagcatggagacaaat

SEQ ID NO: 37654 - DNA, 75 bp, Artificial Sequence
  Synthetic
taatgagatgaaaaactactactcagggaaacaaagtaaatttgataaggatttaaatttggccctgatgacagt

SEQ ID NO: 37655 - DNA, 75 bp, Artificial Sequence
  Synthetic
gggaaacaaagtaaatttgataaggatttaaatttggccctgatgacagtacatcatgcattcagagggacctca

SEQ ID NO: 37656 - DNA, 75 bp, Artificial Sequence
  Synthetic
tgcccagatttttggaagcatccaatatacaaagaatttaagatgagtatgcccataccagagcgtagactcttt

SEQ ID NO: 37657 - DNA, 75 bp, Artificial Sequence
  Synthetic
ctaaaaaatcaaataatgacctagttgcatatacaaataagataaaagagaaattccctggaaatgctttgttga

SEQ ID NO: 37658 - DNA, 75 bp, Artificial Sequence
  Synthetic
tgcatatacaaataagataaaagagaaattccctggaaatgctttgttgaaggctgtcatggattacatatcgta

SEQ ID NO: 37659 - DNA, 75 bp, Artificial Sequence
  Synthetic
aatttcaaatacgatgagttctgggacgatctcttgtacaggccgaatcctacaaaagctccttccctctcaaga

SEQ ID NO: 37660 - DNA, 75 bp, Artificial Sequence
  Synthetic
acgatctcttgtacaggccgaatcctacaaaagctccttccctctcaagagaaagcgaaacatcgtacaacttta

SEQ ID NO: 37661 - DNA, 75 bp, Artificial Sequence
  Synthetic
caaaatcggcgaaaaacatattcttggcaactgggtgttacaaacaacctaacaaaaatgagatcagtaatggat

SEQ ID NO: 37662 - DNA, 75 bp, Artificial Sequence
  Synthetic
gaaaagctgcaaaaatgttaaaagtgtagtatgcttatcacccagatctggagcatcatatgattcaatattagc

SEQ ID NO: 37663 - DNA, 75 bp, Artificial Sequence
  Synthetic
agagcagagagaaatttcaaaatcacttcatgatcagaaaccgagtgtacactttatatggggagcccataatcc

SEQ ID NO: 37664 - DNA, 75 bp, Artificial Sequence
  Synthetic
gtagtatgcttatcacccagatctggagcatcatatgattcaatattagcatgtggcgagccaaatgggccaagc

SEQ ID NO: 37665 - DNA, 75 bp, Artificial Sequence
  Synthetic
tattccaatccaattcagataaaacaatgtattgcctagctgatagccattgcttggaggattttgaggtaattg

SEQ ID NO: 37666 - DNA, 75 bp, Artificial Sequence
  Synthetic
aatgtattgcctagctgatagccattgcttggaggattttgaggtaattggtcaagaagagttggatgcaataaa

SEQ ID NO: 37667 - DNA, 75 bp, Artificial Sequence
  Synthetic
tatccagatgtgacattgtctaagttgagcgatggggttaagagttgcagaatgaaggattcaggaaagtgcaat

SEQ ID NO: 37668 - DNA, 75 bp, Artificial Sequence
  Synthetic
tgagcgatggggttaagagttgcagaatgaaggattcaggaaagtgcaatgttgcagctaacagatggccgataa

SEQ ID NO: 37669 - DNA, 75 bp, Artificial Sequence
  Synthetic
ttattcagagctgcaaaatgattatgataaaacacaggacatcggccatttctgtcttagtcctgggtgctcaac

SEQ ID NO: 37670 - DNA, 75 bp, Artificial Sequence
  Synthetic
aaacataagcagttcaaaaataagatgcttgatgatgtagacacttcaaagcctaaaatattggattttgatgac

SEQ ID NO: 37671 - DNA, 75 bp, Artificial Sequence
  Synthetic
gataaaacacaggacatcggccatttctgtcttagtcctgggtgctcaacagtaagattcccaatcaatcagaag

SEQ ID NO: 37672 - DNA, 75 bp, Artificial Sequence
  Synthetic
gcctaaaatattggattttgatgaccctgacatgtatttggcaagcttaactatgatggaacaaagcaaaagaat

SEQ ID NO: 37673 - DNA, 75 bp, Artificial Sequence
  Synthetic
ttagccggtctagcatagcaaagattgatgtgcatgatattgaagatatcgatcagtacagaaaggctataactc

SEQ ID NO: 37674 - DNA, 75 bp, Artificial Sequence
  Synthetic
tgatgtgcatgatattgaagatatcgatcagtacagaaaggctataactcagaagctccaaacaagtctctctct

SEQ ID NO: 37675 - DNA, 75 bp, Artificial Sequence
  Synthetic
ctaccgcatattaaaccaatttacaagtatataactattgaaggcactgaaactgctgaaggtatagaaagcgca

SEQ ID NO: 37676 - DNA, 75 bp, Artificial Sequence
  Synthetic
agtatataactattgaaggcactgaaactgctgaaggtatagaaagcgcatatattgaatctgaaatacctgcat

SEQ ID NO: 37677 - DNA, 75 bp, Artificial Sequence
  Synthetic
aatcaattccaaggagggtaagcacttactggacatcattggttatgttaaaagtgcatcatactcttctgtata

SEQ ID NO: 37678 - DNA, 75 bp, Artificial Sequence
  Synthetic
ttactggacatcattggttatgttaaaagtgcatcatactcttctgtatatactaagctctactcaacaggtccg

SEQ ID NO: 37679 - DNA, 75 bp, Artificial Sequence
  Synthetic
atgaattatgcaccggaccatgccctgcaaatatcaaccaccaaaatgggtggttgacctttgcaaaggagagaa

SEQ ID NO: 37680 - DNA, 75 bp, Artificial Sequence
  Synthetic
tgcaaatatcaaccaccaaaatgggtggttgacctttgcaaaggagagaacaagctcttggggttgtgaggaatt

SEQ ID NO: 37681 - DNA, 75 bp, Artificial Sequence
  Synthetic
ctgtctgttatttaaacatgacaaccctaccttggtaatgagtgacattatgaatttttccattttcactagcct

SEQ ID NO: 37682 - DNA, 75 bp, Artificial Sequence
  Synthetic
tgtgtctttgggtcatgccaagatatagtgagggatgagttgtcagtatataggaaggaaacagaagaggttacc

SEQ ID NO: 37683 - DNA, 75 bp, Artificial Sequence
  Synthetic
tagtgagggatgagttgtcagtatataggaaggaaacagaagaggttaccgatgtagaactgtgtttaacattct

SEQ ID NO: 37684 - DNA, 75 bp, Artificial Sequence
  Synthetic
aaaccccataacgcctattataacagacctattcgaggtgcagttcaaaactgtagaaacctacagtctaccaag

SEQ ID NO: 37685 - DNA, 75 bp, Artificial Sequence
  Synthetic
gacctattcgaggtgcagttcaaaactgtagaaacctacagtctaccaagaatagtagcaattcaaaaccacgag

SEQ ID NO: 37686 - DNA, 75 bp, Artificial Sequence
  Synthetic
tgggagtctactcaaaaggatgcggcaatgtccagaaagtgaatgggacagtttatggtaatggagttccaaaat

SEQ ID NO: 37687 - DNA, 75 bp, Artificial Sequence
  Synthetic
tgatataactcaaaaaggaataaaagacaacagagagttaactagcatatggttccctggcagtgtcactttaaa

SEQ ID NO: 37688 - DNA, 75 bp, Artificial Sequence
  Synthetic
caatgtccagaaagtgaatgggacagtttatggtaatggagttccaaaatttgattatttatgccatttggctag

SEQ ID NO: 37689 - DNA, 75 bp, Artificial Sequence
  Synthetic
tgcttcgataatgattatcaggcttgcaaattcttacaaacgccagctagttacagacttgaagaaaatagtggt

SEQ ID NO: 37690 - DNA, 75 bp, Artificial Sequence
  Synthetic
tacatgaaaaacatcatgttatgatagacttagctaagactatattagaaatagagaatgaacagagagaaagca

SEQ ID NO: 37691 - DNA, 75 bp, Artificial Sequence
  Synthetic
agacttagctaagactatattagaaatagagaatgaacagagagaaagcataaaggaaatttggtcaacagactg

SEQ ID NO: 37692 - DNA, 75 bp, Artificial Sequence
  Synthetic
gcaaattcttacaaacgccagctagttacagacttgaagaaaatagtggtacaataacagtgattgactacaaaa

SEQ ID NO: 37693 - DNA, 75 bp, Artificial Sequence
  Synthetic
agccatcctaggggatgttaagtataagacatttgcagacaatgtagacataactgttgaagggtcatgcgccgg

SEQ ID NO: 37694 - DNA, 75 bp, Artificial Sequence
  Synthetic
aagacatttgcagacaatgtagacataactgttgaagggtcatgcgccgggtgcataaattgctttgagaatatt

SEQ ID NO: 37695 - DNA, 75 bp, Artificial Sequence
  Synthetic
caatagaagcaagttgccctgtcacaagcccatgcacagtatttcacgataggatactaataactccgaatgagc

SEQ ID NO: 37696 - DNA, 75 bp, Artificial Sequence
  Synthetic
aagcccatgcacagtatttcacgataggatactaataactccgaatgagcataagtatgcgatgaaagttgtctg

SEQ ID NO: 37697 - DNA, 75 bp, Artificial Sequence
  Synthetic
actctcaaggtttgcaatactaaagtagatgcatcactagctcttattgatgccaaaccaatattagaattagcg

SEQ ID NO: 37698 - DNA, 75 bp, Artificial Sequence
  Synthetic
tagatgcatcactagctcttattgatgccaaaccaatattagaattagcgccagttgatcagacagcctacatca

SEQ ID NO: 37699 - DNA, 75 bp, Artificial Sequence
  Synthetic
atggatgtgcagagtaagagatgaaggcttgcaggttatactagagcctttcaaaaatttgtttggttcttatat

SEQ ID NO: 37700 - DNA, 75 bp, Artificial Sequence
  Synthetic
ggcttgcaggttatactagagcctttcaaaaatttgtttggttcttatatagggatattttatactattatcatc

SEQ ID NO: 37701 - DNA, 75 bp, Artificial Sequence
  Synthetic
tctacattatcttgcctgtttgtttcaagttaagggatactctaaggcagcatgaggacgcctacaagagagaga

SEQ ID NO: 37702 - DNA, 75 bp, Artificial Sequence
  Synthetic
agatttcttttaggcctttgttaagtggccaatttgtagttttttattattaaaaagtggggggtggggaactaa

SEQ ID NO: 37703 - DNA, 75 bp, Artificial Sequence
  Synthetic
agggatgcttgtatcgccaaagatatagatgttgatttattgatggctaggcatgactactttggaaaggaatta

SEQ ID NO: 37704 - DNA, 75 bp, Artificial Sequence
  Synthetic
tagatgttgatttattgatggctaggcatgactactttggaaaggaattatgtaaatctttgaacatagaatata

SEQ ID NO: 37705 - DNA, 75 bp, Artificial Sequence
  Synthetic
aatattagacataagacctgaggttgatccattgactttggatgcaccacatatcactcctgataattacttata

SEQ ID NO: 37706 - DNA, 75 bp, Artificial Sequence
  Synthetic
gattacaaggtgtctgtatcaaatgagagtagcatgataacatatgataaatattatgagttgactagggacata

SEQ ID NO: 37707 - DNA, 75 bp, Artificial Sequence
  Synthetic
agagtagcatgataacatatgataaatattatgagttgactagggacatatccaatagattaaatattccaatag

SEQ ID NO: 37708 - DNA, 75 bp, Artificial Sequence
  Synthetic
agtaagtagggacctgcacataagctctgacagatttaaggaaatatatcctacattagttgtcgatatcaattt

SEQ ID NO: 37709 - DNA, 75 bp, Artificial Sequence
  Synthetic
acagttgtgctatgtcagtatataaggaagttcttaaggaagcaataacactattggatggatccatcctagtaa

SEQ ID NO: 37710 - DNA, 75 bp, Artificial Sequence
  Synthetic
atgctttatgagaagtttggagatgatgaagaattcttgctgaaagtcgcgcatggtgatttcaccctaacagct

SEQ ID NO: 37711 - DNA, 75 bp, Artificial Sequence
  Synthetic
ccaaacatctataactatcgttcaggacaaggtggaaaatgacaaaatcatagattttgctatgaaagagtttga

SEQ ID NO: 37712 - DNA, 75 bp, Artificial Sequence
  Synthetic
tgaaagatggaacaccaatctggttaaagtgagagaatacacaaaaaaagaatattcagaatatgtatcaaaatc

SEQ ID NO: 37713 - DNA, 75 bp, Artificial Sequence
  Synthetic
aatattcagaatatgtatcaaaatcggcgaaaaacatattcctggcaactgggtgttacaaacaacctaacaaaa

SEQ ID NO: 37714 - DNA, 75 bp, Artificial Sequence
  Synthetic
ggcgaaaaacatattcctggcaactgggtgttacaaacaacctaacaaaagtgagatcagtaatgggtggtctct

SEQ ID NO: 37715 - DNA, 75 bp, Artificial Sequence
  Synthetic
atggggagcccataatccaggtaatagtaataatgcaacatttaaactaatattgctttctaaatcactgcaaag

SEQ ID NO: 37716 - DNA, 75 bp, Artificial Sequence
  Synthetic
agtaataatgcaacatttaaactaatattgctttctaaatcactgcaaagtataaaaggtttgtctacttatact

SEQ ID NO: 37717 - DNA, 75 bp, Artificial Sequence
  Synthetic
tgatggatataggtgatagagtaagcgagtatgaagaattttgtatatctttaaaaggcaaagctagatcatcat

SEQ ID NO: 37718 - DNA, 75 bp, Artificial Sequence
  Synthetic
cgagtatgaagaattttgtatatctttaaaaggcaaagctagatcatcatggaagcagataatgaataaaaaatt

SEQ ID NO: 37719 - DNA, 75 bp, Artificial Sequence
  Synthetic
cttgtcttatgggaacaacagttcatggtgaacaacgaattgatagataaaaatgaaaagttgaaattatttaaa

SEQ ID NO: 37720 - DNA, 75 bp, Artificial Sequence
  Synthetic
agttcaccactgctggtagcttgaggaagctgtattcatttggcaagtatcaggacagactctcatctcctggag

SEQ ID NO: 37721 - DNA, 75 bp, Artificial Sequence
  Synthetic
aaagatagtggtctaaagccagacaatttcattttgaatgaatttggctccagaattaaggatgccaataaagaa

SEQ ID NO: 37722 - DNA, 75 bp, Artificial Sequence
  Synthetic
atttcattttgaatgaatttggctccagaattaaggatgccaataaagaaacatatgaaaatatgcatagaattt

SEQ ID NO: 37723 - DNA, 75 bp, Artificial Sequence
  Synthetic
atcagacttctctaccttgatgaaaaacatattatccgtctctcaatataacaggcataacacatttaggattgc

SEQ ID NO: 37724 - DNA, 75 bp, Artificial Sequence
  Synthetic
tatgtgtgcaaataataatgtgtttgctatagtatttccgtctgcagatataaaaacaaaaaaggccaccgtagt

SEQ ID NO: 37725 - DNA, 75 bp, Artificial Sequence
  Synthetic
ggagccagatatactagggaaagtaaccttcacagaagcatacagattactgattagagatttggccagcctaga

SEQ ID NO: 37726 - DNA, 75 bp, Artificial Sequence
  Synthetic
accttcacagaagcatacagattactgattagagatttggccagcctagatttaaccaatgatgatattcaagtc

SEQ ID NO: 37727 - DNA, 75 bp, Artificial Sequence
  Synthetic
gatgaagatagtgtattcaatccaggatgtcttcatggcacatttaaatgtgcaaatggctacatatctatctct

SEQ ID NO: 37728 - DNA, 75 bp, Artificial Sequence
  Synthetic
ggtgccagcgtattgtgtcatctccaggactattcctgactacctgcctgttgtttaaacatgacaaccctacct

SEQ ID NO: 37729 - DNA, 75 bp, Artificial Sequence
  Synthetic
ttgtttaaacatgacaaccctaccttggtaatgagcgacattatgaatttttctattttcacgagcctgtctata

SEQ ID NO: 37730 - DNA, 75 bp, Artificial Sequence
  Synthetic
agcctgcacgctatatgattatgaattcactagccatttctagtaacgttaaggattatatagcagagaaattct

SEQ ID NO: 37731 - DNA, 75 bp, Artificial Sequence
  Synthetic
ttcactagccatttctagtaacgttaaggattatatagcagagaaattctcaccatataccaaaaccctgtttag

SEQ ID NO: 37732 - DNA, 75 bp, Artificial Sequence
  Synthetic
aacgcttgctttgatgcttatgaccaaagacagcgtgttcagcttagagacatatatctatctgactatgacata

SEQ ID NO: 37733 - DNA, 75 bp, Artificial Sequence
  Synthetic
actcaaaaaggaataaaagacaacagagaattaactagcatatggttccctggcagtgtcactctaaaagagtac

SEQ ID NO: 37734 - DNA, 75 bp, Artificial Sequence
  Synthetic
gggcacaaagctataatgcaacataatgccaccagtgaacagaatatagcttttgaatgtttcaagctgataaca

SEQ ID NO: 37735 - DNA, 75 bp, Artificial Sequence
  Synthetic
acttcaatgcaaagggattacatgaaaagcatcatgttatgatagacttagctaagactatattagaaatagaga

SEQ ID NO: 37736 - DNA, 75 bp, Artificial Sequence
  Synthetic
gctaagactatattagaaatagagaatgaacagagagagagcataaaagaaatttggtcaacagattgcactaag

SEQ ID NO: 37737 - DNA, 75 bp, Artificial Sequence
  Synthetic
tacactctttatgtaagaatctgcttgcagacacttctaggcacaaccaccttcgcaataggatagaaaaccgga

SEQ ID NO: 37738 - DNA, 75 bp, Artificial Sequence
  Synthetic
tatatcaacattcacaagttcgaaatcatgccttaaaataggtgatttcaggaaagagaaagagatgcaatctat

SEQ ID NO: 37739 - DNA, 75 bp, Artificial Sequence
  Synthetic
tcatgccttaaaataggtgatttcaggaaagagaaagagatgcaatctataaaacaaaagaagatactagaaaca

SEQ ID NO: 37740 - DNA, 75 bp, Artificial Sequence
  Synthetic
aaaacaaaagaagatactagaaacagaaagcagaaaaagaaggttagcaaatcccatgtttgtaacagatgagca

SEQ ID NO: 37741 - DNA, 75 bp, Artificial Sequence
  Synthetic
aattatggtatgttaagagaagcaatgcccaattataccgactatatatcaacaaaagtctttgacaggctgtat

SEQ ID NO: 37742 - DNA, 75 bp, Artificial Sequence
  Synthetic
tgcccaattataccgactatatatcaacaaaagtctttgacaggctgtatgaactattagataaagaagttctga

SEQ ID NO: 37743 - DNA, 75 bp, Artificial Sequence
  Synthetic
aatggatatcatgatcaatcacaagaaattttacttcactttcttcaataagggacaaaaaacgtctaaagacag

SEQ ID NO: 37744 - DNA, 75 bp, Artificial Sequence
  Synthetic
aaattttacttcactttcttcaataagggacaaaaaacgtctaaagacagggaaatctttgtaggggaatacgag

SEQ ID NO: 37745 - DNA, 75 bp, Artificial Sequence
  Synthetic
agagaatagcaaaggaaagatgcaaactgaatccagatgagatgatatctgaacctggagatggtaaacttaaag

SEQ ID NO: 37746 - DNA, 75 bp, Artificial Sequence
  Synthetic
actgaatccagatgagatgatatctgaacctggagatggtaaacttaaagtcttagaacaaaaatcagagcaaga

SEQ ID NO: 37747 - DNA, 75 bp, Artificial Sequence
  Synthetic
aggcagaaaaatagagaaattgatgaggcaatagaagcgttagctgctgagggttatgagaacaacttagaaaag

SEQ ID NO: 37748 - DNA, 75 bp, Artificial Sequence
  Synthetic
aggcaatagaagcgttagctgctgagggttatgagaacaacttagaaaagatagaaagattgtcagccagcaagg

SEQ ID NO: 37749 - DNA, 75 bp, Artificial Sequence
  Synthetic
tgcagatatgtcgaaatggagcgctcaagatgtcttctataaatatttctggctcatagcattagaccccattct

SEQ ID NO: 37750 - DNA, 75 bp, Artificial Sequence
  Synthetic
gtatcctcaagagaaggagcgaattctattttttatgtgcaattatatgcaaaaagaattgattttaccagatga

SEQ ID NO: 37751 - DNA, 75 bp, Artificial Sequence
  Synthetic
aagattgtatatcagaacgatattataactacaatgacaaaccaactgaattctaatacagtcccaattaagagg

SEQ ID NO: 37752 - DNA, 75 bp, Artificial Sequence
  Synthetic
atacatctagctatgtgcacagttgtgctatgtcagtatataaggaaattcttaaggaagctataacactattgg

SEQ ID NO: 37753 - DNA, 75 bp, Artificial Sequence
  Synthetic
tgctatgtcagtatataaggaaattcttaaggaagctataacactattggatggatctatcctagtaaactcgtt

SEQ ID NO: 37754 - DNA, 75 bp, Artificial Sequence
  Synthetic
tctataactatcgttcaggataaggtggaaaatgacagaatcatagattttgctatgaaagagtttgaaaaggct

SEQ ID NO: 37755 - DNA, 75 bp, Artificial Sequence
  Synthetic
tggaaaatgacagaatcatagattttgctatgaaagagtttgaaaaggcttgcttgacttttggctgccaagcaa

SEQ ID NO: 37756 - DNA, 75 bp, Artificial Sequence
  Synthetic
tagcattaataacttcaagattagagacacaaagggatttttcggagtttgctaaactgatgaagaaggaaggcg

SEQ ID NO: 37757 - DNA, 75 bp, Artificial Sequence
  Synthetic
ttgtataaaagaatttgtttctttgttcaatttgtatggagaaccattttccatatatggcagattcttattgac

SEQ ID NO: 37758 - DNA, 75 bp, Artificial Sequence
  Synthetic
ttcaatttgtatggagaaccattttccatatatggcagattcttattgacatctgtaggagattgcgcatacata

SEQ ID NO: 37759 - DNA, 75 bp, Artificial Sequence
  Synthetic
ataaagaaaaagattagaaaatgatggggttagcaaaataaagatgacttattataaaattggggggttgggttg

SEQ ID NO: 37760 - DNA, 75 bp, Artificial Sequence
  Synthetic
ggatctcttcagcgcaaacggctataaagcacggttgccctccaagcttagcctgggtttctatagccataagcc

SEQ ID NO: 37761 - DNA, 75 bp, Artificial Sequence
  Synthetic
aaagtcttaaaataaagccaaagatgattttcatattaatactgtttgcagttagcactgcgagtccagtatatc

SEQ ID NO: 37762 - DNA, 75 bp, Artificial Sequence
  Synthetic
gattttcatattaatactgtttgcagttagcactgcgagtccagtatatcaacggtgcttccaggatggggctat

SEQ ID NO: 37763 - DNA, 75 bp, Artificial Sequence
  Synthetic
caagtatagataacgtttaaatactaaagtcttaaaataaagccaaagatgattttcatattaatactgtttgca

SEQ ID NO: 37764 - DNA, 75 bp, Artificial Sequence
  Synthetic
tatgcttcctggacagtcgaatgatcctctagattactttccagctgaaaataggaaagaaatacctattgaatt

SEQ ID NO: 37765 - DNA, 75 bp, Artificial Sequence
  Synthetic
gctgtcacagaggtgtgcctcaaagatgatgtcagtatgattaagacggaggccaggtatattaggaatgccaca

SEQ ID NO: 37766 - DNA, 75 bp, Artificial Sequence
  Synthetic
atgatgtcagtatgattaagacggaggccaggtatattaggaatgccacagggactttctctaacaacgtagcaa

SEQ ID NO: 37767 - DNA, 75 bp, Artificial Sequence
  Synthetic
tcaatgataagtacagtaggtttagaatcaggaaatctatacttcttaataaaattactcaacaaatatacacca

SEQ ID NO: 37768 - DNA, 75 bp, Artificial Sequence
  Synthetic
aaaattactcaacaaatatacaccagtcatgtctaaaagggaatcagttgtcaatcagatagcagaggtgaaaaa

SEQ ID NO: 37769 - DNA, 75 bp, Artificial Sequence
  Synthetic
gcatgattgtagacctaaaaaagtctcaggtgggcacatcaatgtaatagaagtcggtgatgatctctcactcca

SEQ ID NO: 37770 - DNA, 75 bp, Artificial Sequence
  Synthetic
tcaggtgggcacatcaatgtaatagaagtcggtgatgatctctcactccacactgaatcctatgtctgcagtgct

SEQ ID NO: 37771 - DNA, 75 bp, Artificial Sequence
  Synthetic
aatgaaatctttaggctgaagatactccggtacttagtgctagatgctgaaatggatccaagcgacattatgggc

SEQ ID NO: 37772 - DNA, 75 bp, Artificial Sequence
  Synthetic
tccggtacttagtgctagatgctgaaatggatccaagcgacattatgggcgaaacaagtgacatgagagggagat

SEQ ID NO: 37773 - DNA, 75 bp, Artificial Sequence
  Synthetic
aaactgctcaggtcagactccagactgacacaacaaaccattttgagatagcaggcacgacagtcaagtcaggat

SEQ ID NO: 37774 - DNA, 75 bp, Artificial Sequence
  Synthetic
tgacacaacaaaccattttgagatagcaggcacgacagtcaagtcaggatggtttaagagcacaacatatataac

SEQ ID NO: 37775 - DNA, 75 bp, Artificial Sequence
  Synthetic
ccatacttacacctaggaaattcactactgctggtagcttgaggaagctgtactcatttggcaagtatcaggaca

SEQ ID NO: 37776 - DNA, 75 bp, Artificial Sequence
  Synthetic
tactgctggtagcttgaggaagctgtactcatttggcaagtatcaggacagactctcatcccctggaggcatgct

SEQ ID NO: 37777 - DNA, 75 bp, Artificial Sequence
  Synthetic
aaagtctcttgtgggcctaaatcagtccaattccatgcatgctttaaccagcatatgtcttgcgtcagattctta

SEQ ID NO: 37778 - DNA, 75 bp, Artificial Sequence
  Synthetic
tccaattccatgcatgctttaaccagcatatgtcttgcgtcagattcttacatagaacaattctacctggatcta

SEQ ID NO: 37779 - DNA, 75 bp, Artificial Sequence
  Synthetic
aagccagaattacttgtaacaaagggtgaagacatgaaagattatatggaatctgtaatttttagatacaactct

SEQ ID NO: 37780 - DNA, 75 bp, Artificial Sequence
  Synthetic
aaaaggtttaaagagagcttatctatccaaaacccagcacaattatttatagagcaaatacttttttcacataag

SEQ ID NO: 37781 - DNA, 75 bp, Artificial Sequence
  Synthetic
agaaataataattttagtaactcttacattactaatttttgtactcttaagtatattaagcaagacttatatctg

SEQ ID NO: 37782 - DNA, 75 bp, Artificial Sequence
  Synthetic
acattactaatttttgtactcttaagtatattaagcaagacttatatctgttatttactgatgccgatttttatc

SEQ ID NO: 37783 - DNA, 75 bp, Artificial Sequence
  Synthetic
gggataaatacatcaacctacatgatagcagagccttagaaaaggagccagatatactagggaaagtaaccttca

SEQ ID NO: 37784 - DNA, 75 bp, Artificial Sequence
  Synthetic
tttataataaatcttgtaaaaaatgcaaattatgtggactagtgtatcatccgttcacagaatgtgggacgcatt

SEQ ID NO: 37785 - DNA, 75 bp, Artificial Sequence
  Synthetic
caaattatgtggactagtgtatcatccgttcacagaatgtgggacgcattgtgtatgcggtgcccgctatgatac

SEQ ID NO: 37786 - DNA, 75 bp, Artificial Sequence
  Synthetic
cagaagcatacagattactaattagagatttagccagcctagatttaaacaatgatgatatccaagtcatctact

SEQ ID NO: 37787 - DNA, 75 bp, Artificial Sequence
  Synthetic
tcatccggtctatgccctggatacaagagtttgagagctgccagagttatgtgcaagtcaaaggggcctgcatca

SEQ ID NO: 37788 - DNA, 75 bp, Artificial Sequence
  Synthetic
gatgataactattgcaaacacgcacatactgtctatatatggaagtcctcagaaaaggatgggcatgtcttgttc

SEQ ID NO: 37789 - DNA, 75 bp, Artificial Sequence
  Synthetic
atactgtctatatatggaagtcctcagaaaaggatgggcatgtcttgttcaactatgccggagttcaggaatcta

SEQ ID NO: 37790 - DNA, 75 bp, Artificial Sequence
  Synthetic
agagtttgagagctgccagagttatgtgcaagtcaaaggggcctgcatcaatactgtcaataatcacagcaatat

SEQ ID NO: 37791 - DNA, 75 bp, Artificial Sequence
  Synthetic
aaattcaatggttgtaggagaaagtaaagaggtattcgaactggaggagctcccagatgatatgctagagatggc

SEQ ID NO: 37792 - DNA, 75 bp, Artificial Sequence
  Synthetic
tggttctaagggcatatagtaaaaacaacccggatgttcagggtgctgatcctacagaaatggctagggacttag

SEQ ID NO: 37793 - DNA, 75 bp, Artificial Sequence
  Synthetic
caacccggatgttcagggtgctgatcctacagaaatggctagggacttagttcatcttaaggagtttgttgagaa

SEQ ID NO: 37794 - DNA, 75 bp, Artificial Sequence
  Synthetic
aaagaggtattcgaactggaggagctcccagatgatatgctagagatggcattaaaaataaacttctactatttt

SEQ ID NO: 37795 - DNA, 75 bp, Artificial Sequence
  Synthetic
cttggggcctcatagttgttgctctgttaattgggttgattttcaaaaagtaccagcacagatttttgaatcttt

SEQ ID NO: 37796 - DNA, 75 bp, Artificial Sequence
  Synthetic
gccagaatagcattgaatgaagcagaaaaagggcaaagagacattgttttcgagctaaaagaaatgactagattt

SEQ ID NO: 37797 - DNA, 75 bp, Artificial Sequence
  Synthetic
aaaaagggcaaagagacattgttttcgagctaaaagaaatgactagattttaccaagtttgttatgagtatgtaa

SEQ ID NO: 37798 - DNA, 75 bp, Artificial Sequence
  Synthetic
gttaattgggttgattttcaaaaagtaccagcacagatttttgaatctttatgcaatgtattgtgaggaatgtga

SEQ ID NO: 37799 - DNA, 75 bp, Artificial Sequence
  Synthetic
aagaggaatggagactttacgaacaagtgcaggcaatgtacatgtgggcagtacgaagatgctactgggctaatg

SEQ ID NO: 37800 - DNA, 75 bp, Artificial Sequence
  Synthetic
ctttattctcccggcgaagtcttatacaaccactgatttttgttcacttatgcaagggaatttaataaaagataa

SEQ ID NO: 37801 - DNA, 75 bp, Artificial Sequence
  Synthetic
agtgcaggcaatgtacatgtgggcagtacgaagatgctactgggctaatgacacaccggaaaacatacaattgcc

SEQ ID NO: 37802 - DNA, 75 bp, Artificial Sequence
  Synthetic
acaaccactgatttttgttcacttatgcaagggaatttaataaaagataaagagtggtacactgtccactactta

SEQ ID NO: 37803 - DNA, 75 bp, Artificial Sequence
  Synthetic
cttgaatttcctaataacttacatggttttaactttgatcaaggattcagctatagttgtgcaggctacaggaac

SEQ ID NO: 37804 - DNA, 75 bp, Artificial Sequence
  Synthetic
gttttaactttgatcaaggattcagctatagttgtgcaggctacaggaacagattttagctcttgtctggaaaca

SEQ ID NO: 37805 - DNA, 75 bp, Artificial Sequence
  Synthetic
tgtttcaagctgataacacactttgcagattctttcatagactcatcatctagatctgctttcctgcagctaata

SEQ ID NO: 37806 - DNA, 75 bp, Artificial Sequence
  Synthetic
gaccatttctaaaccttgggaattgccaaaaacagcaaaaaaaggagtcttatgcaaatattgcaacgcaactca

SEQ ID NO: 37807 - DNA, 75 bp, Artificial Sequence
  Synthetic
ccaaaaacagcaaaaaaaggagtcttatgcaaatattgcaacgcaactcaaaggcctgcaagcaatctcagttct

SEQ ID NO: 37808 - DNA, 75 bp, Artificial Sequence
  Synthetic
ttcgagttagtaaactctatgatataataaaaaatggccacaatcgaacagatttcatacctctactttttagaa

SEQ ID NO: 37809 - DNA, 75 bp, Artificial Sequence
  Synthetic
aataaaaaatggccacaatcgaacagatttcatacctctactttttagaaccggggaccttaaacaaacagatct

SEQ ID NO: 37810 - DNA, 75 bp, Artificial Sequence
  Synthetic
ccagaagatatagcaggggcactaagatatatagaagagagggagacctttcatgtccaattaactgcagaatat

SEQ ID NO: 37811 - DNA, 75 bp, Artificial Sequence
  Synthetic
gatatatagaagagagggagacctttcatgtccaattaactgcagaatatgctatgttgactaggtattgtgatt

SEQ ID NO: 37812 - DNA, 75 bp, Artificial Sequence
  Synthetic
cacgaaagggttacatggaatgactggcagacatctcgtcacttagatatgggatctataaatttaacaatcact

SEQ ID NO: 37813 - DNA, 75 bp, Artificial Sequence
  Synthetic
gggatctataaatttaacaatcactggatacaataggtctataacaattattggagaggataacaaattaacata

SEQ ID NO: 37814 - DNA, 75 bp, Artificial Sequence
  Synthetic
aggctacagtcaaaccacatggagggtttatctgcgatcacatgactttgatgcttgtatactttacccaaatca

SEQ ID NO: 37815 - DNA, 75 bp, Artificial Sequence
  Synthetic
gtttatctgcgatcacatgactttgatgcttgtatactttacccaaatcaacacttttgccgatgtgtcaagcat

SEQ ID NO: 37816 - DNA, 75 bp, Artificial Sequence
  Synthetic
tgcagagctatgcttaacaaggaagactccagaaaatattactataagtggccgaaaattactgagttcacgcca

SEQ ID NO: 37817 - DNA, 75 bp, Artificial Sequence
  Synthetic
actccagaaaatattactataagtggccgaaaattactgagttcacgccacggtcttaagtttgaaaatatgtct

SEQ ID NO: 37818 - DNA, 75 bp, Artificial Sequence
  Synthetic
gggactttgcaaatgagatgaagaattactattcaggaaagcagaataaatttgataaagatttgaacctagcct

SEQ ID NO: 37819 - DNA, 75 bp, Artificial Sequence
  Synthetic
ttactattcaggaaagcagaataaatttgataaagatttgaacctagccttaatgacaatgcatcatgcattcag

SEQ ID NO: 37820 - DNA, 75 bp, Artificial Sequence
  Synthetic
attatataacattcagaaggaaagaccggcatcaatttgtatatcaaatacattcccacgagtctattacaagaa

SEQ ID NO: 37821 - DNA, 75 bp, Artificial Sequence
  Synthetic
ccggcatcaatttgtatatcaaatacattcccacgagtctattacaagaagaaacgaagaacacatggcaatcaa

SEQ ID NO: 37822 - DNA, 75 bp, Artificial Sequence
  Synthetic
gcattgttgtcaaagaggtcaaatgatgatctagttgcatatacaaataagataaaagagaaatttcctggaaat

SEQ ID NO: 37823 - DNA, 75 bp, Artificial Sequence
  Synthetic
atgatctagttgcatatacaaataagataaaagagaaatttcctggaaatgctctattgaaagccgtgatggatt

SEQ ID NO: 37824 - DNA, 75 bp, Artificial Sequence
  Synthetic
ccagtatgcattgtgaatgttgccgaagttgatggtgatcagagaatcctgataaggtcactagactatctaaat

SEQ ID NO: 37825 - DNA, 75 bp, Artificial Sequence
  Synthetic
tgaaatgtcaaactttaaatatgatgagttctgggatgatcttcttcacaagcccaatcccacaaaagctccttc

SEQ ID NO: 37826 - DNA, 75 bp, Artificial Sequence
  Synthetic
ttaaagtgggcctcgaggagtttgcaacaataaaaaaagcacacttcagtaagatggtttcttttgaaggccctc

SEQ ID NO: 37827 - DNA, 75 bp, Artificial Sequence
  Synthetic
aacaataaaaaaagcacacttcagtaagatggtttcttttgaaggccctccaatcaagacaggtcttctagatct

SEQ ID NO: 37828 - DNA, 75 bp, Artificial Sequence
  Synthetic
aagatggtttcttttgaaggccctccaatcaagacaggtcttctagatctaacagagttgatgaaatcacaggac

SEQ ID NO: 37829 - DNA, 75 bp, Artificial Sequence
  Synthetic
gagttctgggatgatcttcttcacaagcccaatcccacaaaagctccttccctctcaagaggtgacgagccagca

SEQ ID NO: 37830 - DNA, 75 bp, Artificial Sequence
  Synthetic
caaggtctatgaaaagctgcaaaaatgtcaaaagtgtagtatgtttatcgcctagatctggagtgtcgtatgatt

SEQ ID NO: 37831 - DNA, 75 bp, Artificial Sequence
  Synthetic
tgtcaaaagtgtagtatgtttatcgcctagatctggagtgtcgtatgattcaatattagcatgtggcgagccaaa

SEQ ID NO: 37832 - DNA, 75 bp, Artificial Sequence
  Synthetic
tacggaatagcaatttaatatctttttcgaaattaatatgctgtgaaggttctgaaaatatcaatgatggcctcg

SEQ ID NO: 37833 - DNA, 75 bp, Artificial Sequence
  Synthetic
ttcgaaattaatatgctgtgaaggttctgaaaatatcaatgatggcctcgagttcttatccgatgatcctatgaa

SEQ ID NO: 37834 - DNA, 75 bp, Artificial Sequence
  Synthetic
tctgacggtgtatttcaatccaattcagataaaacgatgtattgtctagccgacagccattgcttagaagacttt

SEQ ID NO: 37835 - DNA, 75 bp, Artificial Sequence
  Synthetic
cagataaaacgatgtattgtctagccgacagccattgcttagaagactttgaagtggttagccaagaagaattag

SEQ ID NO: 37836 - DNA, 75 bp, Artificial Sequence
  Synthetic
tcaacaccaatattcaacatatattactcaaagaaaggagagaagcacatgacatatagaaatgcaatcaaaatg

SEQ ID NO: 37837 - DNA, 75 bp, Artificial Sequence
  Synthetic
ggtaacggaatatccaaatgtaaaattatctaaactaagtgatgggatcaagagctgcagaatgaaagattcagg

SEQ ID NO: 37838 - DNA, 75 bp, Artificial Sequence
  Synthetic
ttgaggaggcatttaccttcagcagtaacggctttgtatccccagagaatctcggctgtttagaggctatagtct

SEQ ID NO: 37839 - DNA, 75 bp, Artificial Sequence
  Synthetic
ttatctaaactaagtgatgggatcaagagctgcagaatgaaagattcaggaaaatgcaatgttgcaacaaacaga

SEQ ID NO: 37840 - DNA, 75 bp, Artificial Sequence
  Synthetic
tgagtggtctacagtcatagacaaatgcatccacatatgcttgatcaaaaatggtatggatcatatgtaccattc

SEQ ID NO: 37841 - DNA, 75 bp, Artificial Sequence
  Synthetic
ataaattctactattctgaattgcagaatgattatgataagacacaggacattgggcacttttgtcttagtccag

SEQ ID NO: 37842 - DNA, 75 bp, Artificial Sequence
  Synthetic
atggtatggatcatatgtaccattctttcgacatcccaaaatgcttcatggaaaatcccataaccagggacataa

SEQ ID NO: 37843 - DNA, 75 bp, Artificial Sequence
  Synthetic
gaatgattatgataagacacaggacattgggcacttttgtcttagtccaggatgttctacaatccggttcccaat

SEQ ID NO: 37844 - DNA, 75 bp, Artificial Sequence
  Synthetic
actgggtaatgtttagagaatttgtaaatagtctacctagtacagacataccgccttggaatgtcatgacagaaa

SEQ ID NO: 37845 - DNA, 75 bp, Artificial Sequence
  Synthetic
aactggcaggttagccgttctagtatagcaaaaattgatgtgcataatattgaagacatagagcagtatagaaag

SEQ ID NO: 37846 - DNA, 75 bp, Artificial Sequence
  Synthetic
tagcaaaaattgatgtgcataatattgaagacatagagcagtatagaaaggctataactcagaaacttcaaacta

SEQ ID NO: 37847 - DNA, 75 bp, Artificial Sequence
  Synthetic
atttcaagaaaaagtgcatagcattaataacttcaagattagagacccaaagagatttttcggagtttgctaaac

SEQ ID NO: 37848 - DNA, 75 bp, Artificial Sequence
  Synthetic
aataacttcaagattagagacccaaagagatttttcggagtttgctaaactaatgaagaaggaaggtggcagaag

SEQ ID NO: 37849 - DNA, 75 bp, Artificial Sequence
  Synthetic
gacaaaaaatctgccacatataaagccaatttacaaatatataactattgaaggaactgaaaccgctgaaggtat

SEQ ID NO: 37850 - DNA, 75 bp, Artificial Sequence
  Synthetic
ccaatttacaaatatataactattgaaggaactgaaaccgctgaaggtatagagagtgcatatatagaatctgaa

SEQ ID NO: 37851 - DNA, 75 bp, Artificial Sequence
  Synthetic
gaaagattagaaaatgacggggttagcaaaataaaaatgacttatcataaaattggggggttgggttgattggct

SEQ ID NO: 37852 - DNA, 75 bp, Artificial Sequence
  Synthetic
ttggttttaaaatcaactctaaagaagggaaacatctactagatgttattggttatgtcaaaagtgcttcatatt

SEQ ID NO: 37853 - DNA, 75 bp, Artificial Sequence
  Synthetic
agcccagtgtatcaaaggtgtttccaagatggggctatagtgaagcaaaacccatccaaagaagcagtcacagag

SEQ ID NO: 37854 - DNA, 75 bp, Artificial Sequence
  Synthetic
aagatggggctatagtgaagcaaaacccatccaaagaagcagtcacagaggtgtgcctgaaagatgatgttagca

SEQ ID NO: 37855 - DNA, 75 bp, Artificial Sequence
  Synthetic
agggaaacatctactagatgttattggttatgtcaaaagtgcttcatattcatctgtatatactaagctctattc

SEQ ID NO: 37856 - DNA, 75 bp, Artificial Sequence
  Synthetic
acaaagcatgacgaactgtgtactggaccatgccccgcaaacataaaacaccagactggatggttgacttttgca

SEQ ID NO: 37857 - DNA, 75 bp, Artificial Sequence
  Synthetic
gaccatgccccgcaaacataaaacaccagactggatggttgacttttgcaagagaaagaacaagctcatggggtt

SEQ ID NO: 37858 - DNA, 75 bp, Artificial Sequence
  Synthetic
cagtgatggatgtgttttcggctcatgccaggatatagtgagggatgagttatcagtgtataggaaggaaacaga

SEQ ID NO: 37859 - DNA, 75 bp, Artificial Sequence
  Synthetic
tgccaggatatagtgagggatgagttatcagtgtataggaaggaaacagaagaagtgactgatgtcgagctgtgc

SEQ ID NO: 37860 - DNA, 75 bp, Artificial Sequence
  Synthetic
gcacaaacctgaaccccataacaccaatcataacagatttattcgaagtacaattcaaaactgtggaaacctata

SEQ ID NO: 37861 - DNA, 75 bp, Artificial Sequence
  Synthetic
aatcataacagatttattcgaagtacaattcaaaactgtggaaacctatagcttaccaaggatagtagcaatcca

SEQ ID NO: 37862 - DNA, 75 bp, Artificial Sequence
  Synthetic
ataaatgatttaggagtttactcaaagggatgtggtaatgtccaaaaggtgaatgggacagtttatggtaatggg

SEQ ID NO: 37863 - DNA, 75 bp, Artificial Sequence
  Synthetic
agggatgtggtaatgtccaaaaggtgaatgggacagtttatggtaatggggttccaaaatttgactacttgtgcc

SEQ ID NO: 37864 - DNA, 75 bp, Artificial Sequence
  Synthetic
cctagtgtatcatccattcacagagtgtggcacacattgtgtctgtggtgcccgctatgatacttcagatagaat

SEQ ID NO: 37865 - DNA, 75 bp, Artificial Sequence
  Synthetic
tgtgaggaagtgttttgacaatgattatcaagcatgtaaattcttgcaaacaccggcaagttacaggttagaaga

SEQ ID NO: 37866 - DNA, 75 bp, Artificial Sequence
  Synthetic
tatcaagcatgtaaattcttgcaaacaccggcaagttacaggttagaagagaacagtggcacagtaactgtgatt

SEQ ID NO: 37867 - DNA, 75 bp, Artificial Sequence
  Synthetic
tcaagatgaaagccattctgggagatgttaaatataagacatttgcagataatgtagatataactgctgaggggt

SEQ ID NO: 37868 - DNA, 75 bp, Artificial Sequence
  Synthetic
tgttaaatataagacatttgcagataatgtagatataactgctgaggggtcatgcactggatgcataaattgttt

SEQ ID NO: 37869 - DNA, 75 bp, Artificial Sequence
  Synthetic
tttaggagaaagcaaagaaacgtttgagcttgaagagcttccagatgacatgttgggaatggcatctaggataaa

SEQ ID NO: 37870 - DNA, 75 bp, Artificial Sequence
  Synthetic
atacatactacaatagatgcaagctgccctgtcacaagcccatgcacagtgttccatgatagaatactagtgact

SEQ ID NO: 37871 - DNA, 75 bp, Artificial Sequence
  Synthetic
gccctgtcacaagcccatgcacagtgttccatgatagaatactagtgactccaaatgagcataagtatgcaatga

SEQ ID NO: 37872 - DNA, 75 bp, Artificial Sequence
  Synthetic
aattatgctgtaagctggggtcttgttatcattgggttgttgaccggactgctttttaagaaataccaacacaga

SEQ ID NO: 37873 - DNA, 75 bp, Artificial Sequence
  Synthetic
tagcacattagcaatcaagatctgcaatacaaaaattgatgcttcactggctcttattgatgccaagccgatatt

SEQ ID NO: 37874 - DNA, 75 bp, Artificial Sequence
  Synthetic
aatacaaaaattgatgcttcactggctcttattgatgccaagccgatattagaactagcaccagtcgatcagaca

SEQ ID NO: 37875 - DNA, 75 bp, Artificial Sequence
  Synthetic
ggtgcaaaacctggatgtgcagggtgagagatgaaggcttgcaggttattttagagccttttaagaacttatttg

SEQ ID NO: 37876 - DNA, 75 bp, Artificial Sequence
  Synthetic
gagagatgaaggcttgcaggttattttagagccttttaagaacttatttggctcttatataggaatattttatac

SEQ ID NO: 37877 - DNA, 75 bp, Artificial Sequence
  Synthetic
atcaaagattctgctatagttgtacaagctgctggaaccgatttcaccacctgcctagagactgagagtataaat

SEQ ID NO: 37878 - DNA, 75 bp, Artificial Sequence
  Synthetic
ttaattgttatctacattattttgcctatctgcttcaagctaagagatactcttaggaagcacgaggatgcttat

SEQ ID NO: 37879 - DNA, 75 bp, Artificial Sequence
  Synthetic
agagcttagctgattaagataaggcctttagttaagtggccaatttgtaattttattattgtaaggtggggggtg

SEQ ID NO: 37880 - DNA, 75 bp, Artificial Sequence
  Synthetic
gacaacatggagggtgtacttaaggtctcatgattttgaggcatgtatactatatccaaatcagcatttttgcag

SEQ ID NO: 37881 - DNA, 75 bp, Artificial Sequence
  Synthetic
atatgacaagtattatgaattaactagaggtacatcagatagattaagcatcccgatagaaatagttattatccg

SEQ ID NO: 37882 - DNA, 75 bp, Artificial Sequence
  Synthetic
cacatcaactccgatagattcaaagaaatttaccctacaatagtagtggatataaacttcaatcagttttttgat

SEQ ID NO: 37883 - DNA, 75 bp, Artificial Sequence
  Synthetic
caggaagagctggatgcagtgaaaaaatccaaatgttgggaaattgaatatcctgacgtaaaacccctccaagaa

SEQ ID NO: 37884 - DNA, 75 bp, Artificial Sequence
  Synthetic
ctggctagtgggttctataaacaaccaaacaagaacgagattagtgaaggatggacattaatggttgagagagtt

SEQ ID NO: 37885 - DNA, 75 bp, Artificial Sequence
  Synthetic
caaacaagaacgagattagtgaaggatggacattaatggttgagagagttcaagagcaaagggtgatctcaaaat

SEQ ID NO: 37886 - DNA, 75 bp, Artificial Sequence
  Synthetic
aataatgctcttgttttatgggagcagcaatttatggtaaataacgacttgatagacaaaagcgagaaattgaag

SEQ ID NO: 37887 - DNA, 75 bp, Artificial Sequence
  Synthetic
gaattgtgtactggcccatgcccagcaaatatcaatcatcaggttgggtggctaacatttgcaagagagaggaca

SEQ ID NO: 37888 - DNA, 75 bp, Artificial Sequence
  Synthetic
atcaggaataaacactaaacatgatgaattgtgtactggcccatgcccagcaaatatcaatcatcaggttgggtg

SEQ ID NO: 37889 - DNA, 75 bp, Artificial Sequence
  Synthetic
caaatatcaatcatcaggttgggtggctaacatttgcaagagagaggacaagttcatggggatgtgaagaatttg

SEQ ID NO: 37890 - DNA, 75 bp, Artificial Sequence
  Synthetic
agcaatttatggtaaataacgacttgatagacaaaagcgagaaattgaagttattcaagaacttctgtggtatag

SEQ ID NO: 37891 - DNA, 75 bp, Artificial Sequence
  Synthetic
gactatgatggaacaaacaaaaaaaatattgtctaaaagtactggattgaagctagataattttatactgaatga

SEQ ID NO: 37892 - DNA, 75 bp, Artificial Sequence
  Synthetic
tgtagaactatgtttaacattttcagataaaacatattgtacaaacttgaaccctgttactcctattataacaga

SEQ ID NO: 37893 - DNA, 75 bp, Artificial Sequence
  Synthetic
atgttcaaaaggtcaatggaactgtttatggcaatggagttcccagatttgattacttatgccatttagctagca

SEQ ID NO: 37894 - DNA, 75 bp, Artificial Sequence
  Synthetic
tagagtagctatgtgtgctaataacaatgtctttgctatagtattcccctctgcagacataaaaacaaagaaagc

SEQ ID NO: 37895 - DNA, 75 bp, Artificial Sequence
  Synthetic
cttcgacaatgattaccaggcatgcaaattccttcaaagccctgctagttacagacttgaagaagacagtggtac

SEQ ID NO: 37896 - DNA, 75 bp, Artificial Sequence
  Synthetic
acccgaccttagttatgagtgacattatgaatttttctatatacactagtctatctatcacgaaaagtgttttat

SEQ ID NO: 37897 - DNA, 75 bp, Artificial Sequence
  Synthetic
agtagtgtactaccaagtatagataacgtttaaatattaaagttttgaatcaaagccaaagatgattcgcatact

SEQ ID NO: 37898 - DNA, 75 bp, Artificial Sequence
  Synthetic
tgatcaaaacagaggccaggtatgtaagaaatgcaacaggagttttttcaaacaatgttgcaataaggaaatggc

SEQ ID NO: 37899 - DNA, 75 bp, Artificial Sequence
  Synthetic
aagaaatgcaacaggagttttttcaaacaatgttgcaataaggaaatggctagtctctgattggcatgattgcag

SEQ ID NO: 37900 - DNA, 75 bp, Artificial Sequence
  Synthetic
gagactttagaaaggagaaagagctccagtctgtcaaacaaaagaaaatcttggaagtacagagccgcaaaatga

SEQ ID NO: 37901 - DNA, 75 bp, Artificial Sequence
  Synthetic
tcagacttcagacagataccacaaatcatttcgaaattgcaggcaccactgtgaagtcaggatggttcaaaagca

SEQ ID NO: 37902 - DNA, 75 bp, Artificial Sequence
  Synthetic
atgatatctgagccgggagatggcaagttgaaagtattagaacaaaagtcagagcaagaaatccggttcttggtg

SEQ ID NO: 37903 - DNA, 75 bp, Artificial Sequence
  Synthetic
agggcctgcatcaatattgtctataattactgcagtactggtcctaacctttgtgacaccaatcaactccatggt

SEQ ID NO: 37904 - DNA, 75 bp, Artificial Sequence
  Synthetic
ttgtgacaccaatcaactccatggttttgggggaaagtaaagaaacttttgaacttgaagagcttccagacgaca

SEQ ID NO: 37905 - DNA, 75 bp, Artificial Sequence
  Synthetic
tttgggggaaagtaaagaaacttttgaacttgaagagcttccagacgacatgttagaaatggcatcgaggataaa

SEQ ID NO: 37906 - DNA, 75 bp, Artificial Sequence
  Synthetic
gtgaggaatgtgacatgtatcatgacaagtctgggttgaaaagacatggtgatttcaccaacaaatgcaggcagt

SEQ ID NO: 37907 - DNA, 75 bp, Artificial Sequence
  Synthetic
tggaactgtactgggccatttttgaacctcgggaattgtcaaaaacaacaaaagaaagaaccttacaccaacatt

SEQ ID NO: 37908 - DNA, 75 bp, Artificial Sequence
  Synthetic
gccccactatcaatgattagtacagtcgggctagaatctggaaacttatacttcttgataaagttgttaagtaaa

SEQ ID NO: 37909 - DNA, 75 bp, Artificial Sequence
  Synthetic
agagggaagatttccatgtccagctaactacagaatatgcaatgctgagcaggtactgtgactattacacccaat

SEQ ID NO: 37910 - DNA, 75 bp, Artificial Sequence
  Synthetic
aggcatggccgaattgtttacttatctgcttgaaaaacctgaattgttagtaaccaaaggagaagatatgagaga

SEQ ID NO: 37911 - DNA, 75 bp, Artificial Sequence
  Synthetic
ctgcttgaaaaacctgaattgttagtaaccaaaggagaagatatgagagattatatggagactgtaattttccgg

SEQ ID NO: 37912 - DNA, 75 bp, Artificial Sequence
  Synthetic
attattcatagagcaaatactattttcacataagcctataatagacttttccgggattagagataaatatataaa

SEQ ID NO: 37913 - DNA, 75 bp, Artificial Sequence
  Synthetic
tgacgtttacagaagcttataggttattgatgagagacctatccagcctagaattgactaatgatgacattcaag

SEQ ID NO: 37914 - DNA, 75 bp, Artificial Sequence
  Synthetic
ttccaatctagtactgatcggtctatatactgcttactagatagccattgtctagaggagtttgaggctatcagt

SEQ ID NO: 37915 - DNA, 75 bp, Artificial Sequence
  Synthetic
aatctaaatgttgggagactgaatatcctgaggtgaaacccctccaagaaagtgatgggactaaaagctgcagaa

SEQ ID NO: 37916 - DNA, 75 bp, Artificial Sequence
  Synthetic
ggtgctgaccctacagaaatggctagagatttggttcatttaagagaatttgttgagaatacaaatctagaagaa

SEQ ID NO: 37917 - DNA, 75 bp, Artificial Sequence
  Synthetic
actcagagcttcaaaaagattatgacaaaactcaagatattggtcattattgcttaagccctggatgtactactg

SEQ ID NO: 37918 - DNA, 75 bp, Artificial Sequence
  Synthetic
gaggtcataaagctataatgcagcataatgccactagtgagcaaaatattgcttttgagtgtttcaaattgataa

SEQ ID NO: 37919 - DNA, 75 bp, Artificial Sequence
  Synthetic
ataaggatgtaaaagttagcaaactttatgaaataataaagaatggttacaaccggacggatttcataccgttgc

SEQ ID NO: 37920 - DNA, 75 bp, Artificial Sequence
  Synthetic
ggctgatttagataaatatgatgccatgaagagtcatgaaagggtaacatggaatgattggcaaacttctcgcca

SEQ ID NO: 37921 - DNA, 75 bp, Artificial Sequence
  Synthetic
atgaagagtcatgaaagggtaacatggaatgattggcaaacttctcgccatttagacatgggctcaataaatcta

SEQ ID NO: 37922 - DNA, 75 bp, Artificial Sequence
  Synthetic
gttgcctggctgtaagtgatgggtgtgtatttgggtcatgccaagatataataaaagaagaactatctgtctata

SEQ ID NO: 37923 - DNA, 75 bp, Artificial Sequence
  Synthetic
aacatgtctaaaatccaaacatatccgggcaactattatataacgtacagaaagaaagatcgccaccaatttgtg

SEQ ID NO: 37924 - DNA, 75 bp, Artificial Sequence
  Synthetic
gtggagacttacagcttacccagaattgttgctgtgcaaaaccatgaaattaaaattgggcaaataaatgaccta

SEQ ID NO: 37925 - DNA, 75 bp, Artificial Sequence
  Synthetic
aaatttcttcaaagccctgctagttacagacttgaagaagacagtggcactgtgactataattgactacaagaag

SEQ ID NO: 37926 - DNA, 75 bp, Artificial Sequence
  Synthetic
tgagtttgcgacaataaagaaagcacacttcagcaaaatggtttcctttgaagggcctccaatcaagacagggct

SEQ ID NO: 37927 - DNA, 75 bp, Artificial Sequence
  Synthetic
atattaggcacaatcaagatgaaggcaattttaggagatgtcaaatacaaaacatttgctgaaagtgtcgatata

SEQ ID NO: 37928 - DNA, 75 bp, Artificial Sequence
  Synthetic
gatatctttctcaaaactaatttgctgtgaggggtcggataatataaatgacggtttagagtttctgtctgatga

SEQ ID NO: 37929 - DNA, 75 bp, Artificial Sequence
  Synthetic
aaatatgcattaaaaatggtgtgcacagaaagaccggggaatacactcacaattaaggtttgcaatactaagatt

SEQ ID NO: 37930 - DNA, 75 bp, Artificial Sequence
  Synthetic
tgataaaaaatggcatggatcatatgtaccactcatttgatgtccctaaatgtttcatgggaaaccctatcacta

SEQ ID NO: 37931 - DNA, 75 bp, Artificial Sequence
  Synthetic
agaattcatcaatagcttaccagggacagacataccaccatggaatgtcatgacagagaattttaagaagaaatg

SEQ ID NO: 37932 - DNA, 75 bp, Artificial Sequence
  Synthetic
acagacataccaccatggaatgtcatgacagagaattttaagaagaaatgcattgctttgataaactcaaaattt

SEQ ID NO: 37933 - DNA, 75 bp, Artificial Sequence
  Synthetic
agttaagagacacacttagaaagcatgaagatgcatataagagagaaatgaaaattaggtaggggatctgtgtaa

SEQ ID NO: 37934 - DNA, 75 bp, Artificial Sequence
  Synthetic
ttaccaaattaatgaagaaagagggtgggaggagcaatatagaattcgattaatagttgtgttcttgtaggagat

SEQ ID NO: 37935 - DNA, 75 bp, Artificial Sequence
  Synthetic
agtagtgtactccacttgaatactttgaaataatttgttgttgactgttttttacctaagggaaataatcaagag

SEQ ID NO: 37936 - DNA, 75 bp, Artificial Sequence
  Synthetic
aaacattcctgcagaaatttggcatcaggcttccataaatagggcatgaggcattcaaattaggttctaaattct

SEQ ID NO: 37937 - DNA, 75 bp, Artificial Sequence
  Synthetic
ttacagaaaattcagtcatatcacaatatatgcgtaatggactatcaagaatatcaacaattcttagctaggatt

SEQ ID NO: 37938 - DNA, 75 bp, Artificial Sequence
  Synthetic
ctaaagacattgatgttgacctattaatggccagacatgattattttggaagggagctatgtaagtccttaaata

SEQ ID NO: 37939 - DNA, 75 bp, Artificial Sequence
  Synthetic
aatggccagacatgattattttggaagggagctatgtaagtccttaaatatagaatatagaaatgatgtcccatt

SEQ ID NO: 37940 - DNA, 75 bp, Artificial Sequence
  Synthetic
cctgaaatagatccattaaccatagatgcaccacatattaccccagacaattatctatacataaataatgtattg

SEQ ID NO: 37941 - DNA, 75 bp, Artificial Sequence
  Synthetic
acgtttaaatattaaagttttgaatcaaagccaaagatgatttacatactggtgctaattgcagttacggctgca

SEQ ID NO: 37942 - DNA, 75 bp, Artificial Sequence
  Synthetic
atgcaccacatattaccccagacaattatctatacataaataatgtattgtatattatagattacaaagtctccg

SEQ ID NO: 37943 - DNA, 75 bp, Artificial Sequence
  Synthetic
atatgacaaatattatgagctaactagagatatatctgacagattaagcatcccgatagaaatagttattatccg

SEQ ID NO: 37944 - DNA, 75 bp, Artificial Sequence
  Synthetic
agagatatatctgacagattaagcatcccgatagaaatagttattatccgcatagaccctgtaagcaaagacttg

SEQ ID NO: 37945 - DNA, 75 bp, Artificial Sequence
  Synthetic
agctttaccctgcgatagttgtggacataaacttcaaccaattttttgatctaaaacaattactctatgaaaaat

SEQ ID NO: 37946 - DNA, 75 bp, Artificial Sequence
  Synthetic
attaatgtaatagaggtaggtgatgatctgtcacttcacactgagtcatatgtttgcagcgcagactgtactata

SEQ ID NO: 37947 - DNA, 75 bp, Artificial Sequence
  Synthetic
aaaagtggcacatggcgattttacccttacagcaccctggtgcaagactgggtgcccagaattctggaaacatcc

SEQ ID NO: 37948 - DNA, 75 bp, Artificial Sequence
  Synthetic
cttacagcaccctggtgcaagactgggtgcccagaattctggaaacatcccatttacaaagagtttaagatgagt

SEQ ID NO: 37949 - DNA, 75 bp, Artificial Sequence
  Synthetic
atgccagtgcctgagagaaggctcttcgaagagtcagtcaaatttaatgcttatgaatcagagagatggaatact

SEQ ID NO: 37950 - DNA, 75 bp, Artificial Sequence
  Synthetic
ggtccgaaatccatacaattccatgcttgttttaaccagcacatgtcctgtgttagatttttacatagaacaata

SEQ ID NO: 37951 - DNA, 75 bp, Artificial Sequence
  Synthetic
caaaaaaagactattcagaacatgtttcaaaatctgcaaaaaacattttcctggctagtggattttataagcaac

SEQ ID NO: 37952 - DNA, 75 bp, Artificial Sequence
  Synthetic
ttcaaaatctgcaaaaaacattttcctggctagtggattttataagcaaccaaataagactgagattagtgaagg

SEQ ID NO: 37953 - DNA, 75 bp, Artificial Sequence
  Synthetic
tatgtcaaaatattgagatcataattttagtcacactcactctattaatcttcatattattaagtatcctaagca

SEQ ID NO: 37954 - DNA, 75 bp, Artificial Sequence
  Synthetic
caagaccaaagagaaatctcaagatccctccatgatcagaaacccagcatacattttatatggggagcccataac

SEQ ID NO: 37955 - DNA, 75 bp, Artificial Sequence
  Synthetic
gcctgtatttattcctatagcatatgtgtatggtatcatttacaataagtcgtgtaaaaaatgcaaactatgtgg

SEQ ID NO: 37956 - DNA, 75 bp, Artificial Sequence
  Synthetic
tcaagctcatattgctttctaagtctctgcaaagcataaagggtatatcaacctacacagaggcttttaaatctt

SEQ ID NO: 37957 - DNA, 75 bp, Artificial Sequence
  Synthetic
taaggcaactgaatatgaggaattctgcatgtccctaaaaagcaaagcaagatcatcatggaagcagataatgaa

SEQ ID NO: 37958 - DNA, 75 bp, Artificial Sequence
  Synthetic
agggcctgcatcaatattatctataattactgcagtattggttttaacctttgtaacaccgatcaattctatggt

SEQ ID NO: 37959 - DNA, 75 bp, Artificial Sequence
  Synthetic
tgcatgtccctaaaaagcaaagcaagatcatcatggaagcagataatgaacaaaaaattggaacctaagcaaata

SEQ ID NO: 37960 - DNA, 75 bp, Artificial Sequence
  Synthetic
agcaatttatggtaaacaatgacctgatagataaaagtgagaaattgaagctgtttaagaatttctgcggtatag

SEQ ID NO: 37961 - DNA, 75 bp, Artificial Sequence
  Synthetic
gatagataaaagtgagaaattgaagctgtttaagaatttctgcggtataggtaagcacaagcaattcaagaataa

SEQ ID NO: 37962 - DNA, 75 bp, Artificial Sequence
  Synthetic
aaacccaagatactagattttgatgacgcaaacatgtacctggctagcctaaccatgatggagcaaagcaagaag

SEQ ID NO: 37963 - DNA, 75 bp, Artificial Sequence
  Synthetic
agccagataattttatactaaatgaatttgggtccagagttaaagatgccaataaagaaacatatgacaacatgc

SEQ ID NO: 37964 - DNA, 75 bp, Artificial Sequence
  Synthetic
atttgggtccagagttaaagatgccaataaagaaacatatgacaacatgcacaaaatatttgaaacacggtactg

SEQ ID NO: 37965 - DNA, 75 bp, Artificial Sequence
  Synthetic
aacagggttgatgacccataggaaaacctacaattgcctagtgcaatataaagcaaaatggataatgaacttcct

SEQ ID NO: 37966 - DNA, 75 bp, Artificial Sequence
  Synthetic
ttgatgaaaaatatcctatctgtgtcacagtataatagacacaatacattcagaatagctatgtgtgctaataac

SEQ ID NO: 37967 - DNA, 75 bp, Artificial Sequence
  Synthetic
cagaatagctatgtgtgctaataacaacgttttcgctatagtatttccttcagctgacataaaaactaagaaagc

SEQ ID NO: 37968 - DNA, 75 bp, Artificial Sequence
  Synthetic
tggaattgcaccgggccgttcttgaatctcgggaattgtcagaaacaacaaaagaaggagccctatactaacatc

SEQ ID NO: 37969 - DNA, 75 bp, Artificial Sequence
  Synthetic
aactgtagtttatagtattatagtgctgcataaagaggaagaaaacgtattcaacccaggatgtttgcatggcac

SEQ ID NO: 37970 - DNA, 75 bp, Artificial Sequence
  Synthetic
ctgcataaagaggaagaaaacgtattcaacccaggatgtttgcatggcacgttcaagtgcatgaatgggtacata

SEQ ID NO: 37971 - DNA, 75 bp, Artificial Sequence
  Synthetic
ataaggagaggtgccaaagaattgtttcttcacctggactgtttttaacaacttgcctgctattcaaacatgata

SEQ ID NO: 37972 - DNA, 75 bp, Artificial Sequence
  Synthetic
ttcttcacctggactgtttttaacaacttgcctgctattcaaacatgataacccaaccctagtgctgagtgacat

SEQ ID NO: 37973 - DNA, 75 bp, Artificial Sequence
  Synthetic
tttcagacaattcaggatacagccaaacaacatggagagtgtacttaagatcccatgattttgaggcatgtataa

SEQ ID NO: 37974 - DNA, 75 bp, Artificial Sequence
  Synthetic
ctatctatcacaaagagtgttttatccttaacagagccagcacgctatatgattatgaattctttagcaatctct

SEQ ID NO: 37975 - DNA, 75 bp, Artificial Sequence
  Synthetic
ccttaacagagccagcacgctatatgattatgaattctttagcaatctctagcaatgttaaagactatatagctg

SEQ ID NO: 37976 - DNA, 75 bp, Artificial Sequence
  Synthetic
actgttcagtgtctacatgactagattaattaaaaatgcttgctttgatgcttatgatcagagacagcgtgtcca

SEQ ID NO: 37977 - DNA, 75 bp, Artificial Sequence
  Synthetic
tatgacataacccagaaagggattaaagacaatagagaactaacaagtatatggttccctggcagtgtaacacta

SEQ ID NO: 37978 - DNA, 75 bp, Artificial Sequence
  Synthetic
aagacaatagagaactaacaagtatatggttccctggcagtgtaacactaaaggaatatttaacgcaaatatact

SEQ ID NO: 37979 - DNA, 75 bp, Artificial Sequence
  Synthetic
catatacaaacaagataaagacaaagtttccaggtaatgcattactaaaggctataatagattatatagcataca

SEQ ID NO: 37980 - DNA, 75 bp, Artificial Sequence
  Synthetic
attacatgagaagcaccatgttatggtggatttggcaaagactatattagaaatagagtgcgaacaaagggaaaa

SEQ ID NO: 37981 - DNA, 75 bp, Artificial Sequence
  Synthetic
gtggatttggcaaagactatattagaaatagagtgcgaacaaagggaaaatataaaggagatatggtctacaaat

SEQ ID NO: 37982 - DNA, 75 bp, Artificial Sequence
  Synthetic
ggattttgattcattccttgtgtaaaaatttgctcgcagacacctctagacacaatcacttgcggaacaggatag

SEQ ID NO: 37983 - DNA, 75 bp, Artificial Sequence
  Synthetic
aaatttgctcgcagacacctctagacacaatcacttgcggaacaggatagagaatagaaacaatttcaggagatc

SEQ ID NO: 37984 - DNA, 75 bp, Artificial Sequence
  Synthetic
gtggcgaacctaatggaccaagtgtatatagaaaaccatcaaacggtgtatttcaatctagcactgatcaatcca

SEQ ID NO: 37985 - DNA, 75 bp, Artificial Sequence
  Synthetic
agttcaaagtcttgtctcaaaataggagactttagaaaggagaaagagctacaatcagttaaacaaaagaaaatt

SEQ ID NO: 37986 - DNA, 75 bp, Artificial Sequence
  Synthetic
gagactttagaaaggagaaagagctacaatcagttaaacaaaagaaaattttagaagtacagagtcgcaaaatga

SEQ ID NO: 37987 - DNA, 75 bp, Artificial Sequence
  Synthetic
agacgaacaagtacgccttgaagtcgggcactgcaattatgagatgctaagaaatgctatgccgaattatacaga

SEQ ID NO: 37988 - DNA, 75 bp, Artificial Sequence
  Synthetic
gggcactgcaattatgagatgctaagaaatgctatgccgaattatacagattatatatcaactaaagtatttgat

SEQ ID NO: 37989 - DNA, 75 bp, Artificial Sequence
  Synthetic
tgaaggattctgggaattgcaatgttgcaaccaacagatggccagtaatacaatgtgagaatgataaattctact

SEQ ID NO: 37990 - DNA, 75 bp, Artificial Sequence
  Synthetic
aggttatatgaattactggataaaggggttttaacagacaagcctattatagagcagataatggatatgatggtt

SEQ ID NO: 37991 - DNA, 75 bp, Artificial Sequence
  Synthetic
actcagaactccagaaagattatgataagactcaagatatcggccattactgcttgagtcctgggtgcactaccg

SEQ ID NO: 37992 - DNA, 75 bp, Artificial Sequence
  Synthetic
ttttcaataaaggccagaaaacatcaaaggatagagagatatttgttggagaatatgaagctaaaatgtgcatgt

SEQ ID NO: 37993 - DNA, 75 bp, Artificial Sequence
  Synthetic
atgatatctgaaccaggagatggcaagctgaaagtgctggaacaaaagtcagaacaagaaatccggtttttagta

SEQ ID NO: 37994 - DNA, 75 bp, Artificial Sequence
  Synthetic
gagactacaagacaaaagaatcgtgaaatagatgaggcaattgaggcattagctgcagaggggtatgaaagtaat

SEQ ID NO: 37995 - DNA, 75 bp, Artificial Sequence
  Synthetic
ttggcaaagcaaagggcctaaaaatggaaataaatgcagacatgtccaaatggagtgctcaggacgttttctaca

SEQ ID NO: 37996 - DNA, 75 bp, Artificial Sequence
  Synthetic
ggaaataaatgcagacatgtccaaatggagtgctcaggacgttttctacaaatatttctggctcatagccttaga

SEQ ID NO: 37997 - DNA, 75 bp, Artificial Sequence
  Synthetic
gagagaatactatactttatgtgtaattatatggacaaagaattaatactgccagatgaattgctatttaattta

SEQ ID NO: 37998 - DNA, 75 bp, Artificial Sequence
  Synthetic
atgatataatagccactatgactaatcagttaaattctaacacagttctgataaagagaaattggcttcaaggga

SEQ ID NO: 37999 - DNA, 75 bp, Artificial Sequence
  Synthetic
tcagttaaattctaacacagttctgataaagagaaattggcttcaagggaatttcaactatacctcaagctatgt

SEQ ID NO: 38000 - DNA, 75 bp, Artificial Sequence
  Synthetic
tgtagaattatgtttaacattttctgacaaaacatattgtacaaacttaaatcctgtcacccctattataacaga

SEQ ID NO: 38001 - DNA, 75 bp, Artificial Sequence
  Synthetic
aaagaaatattaaaagaggctataacattgctggatgggtctatattagtcaattcattggttcattctgatgac

SEQ ID NO: 38002 - DNA, 75 bp, Artificial Sequence
  Synthetic
gtctcattgtttaacttgtatggtgaacccttttcaatatatggcagattcctattgacatctgtgggtgattgt

SEQ ID NO: 38003 - DNA, 75 bp, Artificial Sequence
  Synthetic
cctattgacatctgtgggtgattgtgcctatataggaccttacgaggatttggctagtcgaatatcatcagccca

SEQ ID NO: 38004 - DNA, 75 bp, Artificial Sequence
  Synthetic
gcctatataggaccttacgaggatttggctagtcgaatatcatcagcccagacagctataaaacatggttgtcca

SEQ ID NO: 38005 - DNA, 75 bp, Artificial Sequence
  Synthetic
caataagtcactggatgacttctctaacatataacatgctaccgggacaatcaaatgaccctattgattatttcc

SEQ ID NO: 38006 - DNA, 75 bp, Artificial Sequence
  Synthetic
cagcagaaaatagaaaagatatacctatagaattaaatggtgttttagatgctccgttatcaatgatcagcacag

SEQ ID NO: 38007 - DNA, 75 bp, Artificial Sequence
  Synthetic
cttcttgataaagttgttgaacaagtatacaccagtcatgcaaaaaagggaatcagtagtcaaccaaatagccga

SEQ ID NO: 38008 - DNA, 75 bp, Artificial Sequence
  Synthetic
tatacaccagtcatgcaaaaaagggaatcagtagtcaaccaaatagccgaagtcaagaattggaaagttgaagac

SEQ ID NO: 38009 - DNA, 75 bp, Artificial Sequence
  Synthetic
gaagcttcaatggctcttgttgatgcaaaacctatcatagaattggcaccagttgaccagacggcatatataagg

SEQ ID NO: 38010 - DNA, 75 bp, Artificial Sequence
  Synthetic
ttaaaatactcagatatttagttcttgatgcagaaatggaccctagcgacattatgggtgagacaagtgatatga

SEQ ID NO: 38011 - DNA, 75 bp, Artificial Sequence
  Synthetic
tgatgcagaaatggaccctagcgacattatgggtgagacaagtgatatgagagggaggtccatcttgacacctag

SEQ ID NO: 38012 - DNA, 75 bp, Artificial Sequence
  Synthetic
agaaaattgtattcctttggtaagtaccaagatagactgtcttcccctggaggcatggctgaattgttcacttac

SEQ ID NO: 38013 - DNA, 75 bp, Artificial Sequence
  Synthetic
accaagatagactgtcttcccctggaggcatggctgaattgttcacttacttgcttgagaaacctgagttattag

SEQ ID NO: 38014 - DNA, 75 bp, Artificial Sequence
  Synthetic
agctaagagatacccttaggaagcatgaagatgcatataagagagagatgaaaattagataggaaacctatatat

SEQ ID NO: 38015 - DNA, 75 bp, Artificial Sequence
  Synthetic
ttatatggaatctgtaatattccgatataattccaaaagattcaaagaaagtttgtcaatacaaaatccagcaca

SEQ ID NO: 38016 - DNA, 75 bp, Artificial Sequence
  Synthetic
gtttgtcaatacaaaatccagcacaattatttatagaacaaatattgttctcacataaacctataatagactttt

SEQ ID NO: 38017 - DNA, 75 bp, Artificial Sequence
  Synthetic
aaacttacaaaaaattcagttattccatattgcatgaataatggatcaccaagagtaccaacaattcctggctag

SEQ ID NO: 38018 - DNA, 75 bp, Artificial Sequence
  Synthetic
cttacatgatagcagagccctagagaaagaacctgatatattaggaaaagtgacatttacagaggcttatagatt

SEQ ID NO: 38019 - DNA, 75 bp, Artificial Sequence
  Synthetic
aataaatgctgccagggatgcttgcattgcaaaagatatagatgttgatttgttaatggccaggcatgattactt

SEQ ID NO: 38020 - DNA, 75 bp, Artificial Sequence
  Synthetic
aaagaacctgatatattaggaaaagtgacatttacagaggcttatagattattaatgagggatctatctagctta

SEQ ID NO: 38021 - DNA, 75 bp, Artificial Sequence
  Synthetic
tgatctattcttacataattcttaatgatcctatgatgataacaatagcaaacacgcatatattgtcaatatacg

SEQ ID NO: 38022 - DNA, 75 bp, Artificial Sequence
  Synthetic
tgatcctatgatgataacaatagcaaacacgcatatattgtcaatatacggaagcccgcaaaagaggatgggtat

SEQ ID NO: 38023 - DNA, 75 bp, Artificial Sequence
  Synthetic
aagacctgaggtagatccgttaactttagatgcaccgcatatcactcctgacaattatctgtatataaacaatat

SEQ ID NO: 38024 - DNA, 75 bp, Artificial Sequence
  Synthetic
agaaacttaaaattaatacatcattccccagccctagtcttaagagcatatagtaaaaataaccctgacattcag

SEQ ID NO: 38025 - DNA, 75 bp, Artificial Sequence
  Synthetic
ccccagccctagtcttaagagcatatagtaaaaataaccctgacattcagggtgctgatcctacagaaatggcca

SEQ ID NO: 38026 - DNA, 75 bp, Artificial Sequence
  Synthetic
tgttgagaatacaaatttggaagagaagatgaaagtcagaattgctatgaatgaagcagaaaaaggacaacgaga

SEQ ID NO: 38027 - DNA, 75 bp, Artificial Sequence
  Synthetic
actagattttatcaggtttgctatgaatatgttaaatccacggaacacaagataaaagtctttatcctcccagca

SEQ ID NO: 38028 - DNA, 75 bp, Artificial Sequence
  Synthetic
aagtcatacacaacaacagatttttgctcactcatgcagggaaatttaataaaagataatgagtggtacacggtt

SEQ ID NO: 38029 - DNA, 75 bp, Artificial Sequence
  Synthetic
cactatttaaaacagatattgtctggagggcataaagctataatgcagcataatgccactagtgagcaaaatatt

SEQ ID NO: 38030 - DNA, 75 bp, Artificial Sequence
  Synthetic
taatgccactagtgagcaaaatattgcttttgagtgtttcaaattgataacccattttgcagactcattcataga

SEQ ID NO: 38031 - DNA, 75 bp, Artificial Sequence
  Synthetic
caattgataatagatgaattcagttataaagatgtgaaggttagcaaactttatgacataataaagaatggttat

SEQ ID NO: 38032 - DNA, 75 bp, Artificial Sequence
  Synthetic
tttttaggactggcgacttaagacaagccgacttagataaatatgatgctatgaaaagtcatgagagagtaacat

SEQ ID NO: 38033 - DNA, 75 bp, Artificial Sequence
  Synthetic
ggaacgattggcaaacatctcgtcatttggatatgggttctattaatctgacaataactggttacaatagatcta

SEQ ID NO: 38034 - DNA, 75 bp, Artificial Sequence
  Synthetic
tttggatatgggttctattaatctgacaataactggttacaatagatctataacaataattggagaagacaataa

SEQ ID NO: 38035 - DNA, 75 bp, Artificial Sequence
  Synthetic
actaggaaaactcctgaaaacataactataagtggtaggaaactgctgggctcaagacatggacttaaatttgaa

SEQ ID NO: 38036 - DNA, 75 bp, Artificial Sequence
  Synthetic
ctcaagacatggacttaaatttgaaaacatgtctaggattcagacatacccaggcaattattatataacatatag

SEQ ID NO: 38037 - DNA, 75 bp, Artificial Sequence
  Synthetic
taccaaatacactctcatgaatcaataacaagaaggaatgaagaacacatggctattagaaccagaatatacaat

SEQ ID NO: 38038 - DNA, 75 bp, Artificial Sequence
  Synthetic
taacaagaaggaatgaagaacacatggctattagaaccagaatatacaatgaaataactccagtatgtgtagtta

SEQ ID NO: 38039 - DNA, 75 bp, Artificial Sequence
  Synthetic
acgcattttaataaggtccttagattatctaaacaatgatatattttctctttcaaggatcaaagttggacttga

SEQ ID NO: 38040 - DNA, 75 bp, Artificial Sequence
  Synthetic
cgaatttgcaacaataaaaaaagcacacttcagtaagatggtctcatttgaaggacccccaattaagacagggct

SEQ ID NO: 38041 - DNA, 75 bp, Artificial Sequence
  Synthetic
tcttgatcttactgaattgatgaaatctcaggatttgctaaacctcaactacgataatataaggaatagtaattt

SEQ ID NO: 38042 - DNA, 75 bp, Artificial Sequence
  Synthetic
tgtgagggatcagataatataaatgatggtttagagtttttgtctgatgaccctatgaactttacagagggtgaa

SEQ ID NO: 38043 - DNA, 75 bp, Artificial Sequence
  Synthetic
atggtttagagtttttgtctgatgaccctatgaactttacagagggtgaagcaatacattcaacaccaatcttca

SEQ ID NO: 38044 - DNA, 75 bp, Artificial Sequence
  Synthetic
gcaatacattcaacaccaatcttcaatatatattactcaaaaagaggagaaagacatatgacatacagaaatgca

SEQ ID NO: 38045 - DNA, 75 bp, Artificial Sequence
  Synthetic
ctaagatttttgaggaggctttcacatttagcgagaatggcttcatatcaccagagaatcttgggtgcttagaag

SEQ ID NO: 38046 - DNA, 75 bp, Artificial Sequence
  Synthetic
ccagagaatcttgggtgcttagaagctatagtatcattaataaaattgttgaagaccaacgagtggtcctcagtt

SEQ ID NO: 38047 - DNA, 75 bp, Artificial Sequence
  Synthetic
gagatataaattgggtgatgtttagagaattcatcaatagtttaccaagcacagatataccaccatggaatgtta

SEQ ID NO: 38048 - DNA, 75 bp, Artificial Sequence
  Synthetic
tatagccttaataaactctaagtttgaaacacagagagatttttcagaattcactaaactgatgaagaaggaagg

SEQ ID NO: 38049 - DNA, 75 bp, Artificial Sequence
  Synthetic
gaaacacagagagatttttcagaattcactaaactgatgaagaaggaaggcggaaggagcaatatagagtttgat

SEQ ID NO: 38050 - DNA, 75 bp, Artificial Sequence
  Synthetic
tacctaccattttacttcaatgcaaagggattgcatgaaaaacaccatgttatgatagatttagccaagactata

SEQ ID NO: 38051 - DNA, 75 bp, Artificial Sequence
  Synthetic
tcacaattaggctataaatttgggagggttttaacaattggctaagattcaaaaagagggggattaacagcaact

SEQ ID NO: 38052 - DNA, 75 bp, Artificial Sequence
  Synthetic
gggttttaacaattggctaagattcaaaaagagggggattaacagcaactgtataaatttgtagataggagcaca

SEQ ID NO: 38053 - DNA, 75 bp, Artificial Sequence
  Synthetic
gtttttacctaagggattgacttggaagtgtgatgtccgatttggtgttttatgatgtcgcatcaacaggtgcaa

SEQ ID NO: 38054 - DNA, 75 bp, Artificial Sequence
  Synthetic
ttggagagtggcaggtggaggttgtcaataatcattttcctggaaacaggaacaatccaattaacagcgacgatc

SEQ ID NO: 38055 - DNA, 75 bp, Artificial Sequence
  Synthetic
tttagccagatgggttcttgagcagtataaagagaatgaagacgagtctcggcgtgagttgatcaagacaacaat

SEQ ID NO: 38056 - DNA, 75 bp, Artificial Sequence
  Synthetic
tataaagagaatgaagacgagtctcggcgtgagttgatcaagacaacaatcatcaaccccattgccgagtcaaat

SEQ ID NO: 38057 - DNA, 75 bp, Artificial Sequence
  Synthetic
agatctatctgtccttcttcccagggactgaaatgtttttggagaccttcaaattctacccgctgaccattggaa

SEQ ID NO: 38058 - DNA, 75 bp, Artificial Sequence
  Synthetic
gactgaaatgtttttggagaccttcaaattctacccgctgaccattggaatttacagagtcaagcagggaatgat

SEQ ID NO: 38059 - DNA, 75 bp, Artificial Sequence
  Synthetic
ttaagacaacgctatggttcactcacagcagacaagtggatgtcgcagaaggtgacggccattgccaagagcctg

SEQ ID NO: 38060 - DNA, 75 bp, Artificial Sequence
  Synthetic
cagatcattcttgcagaagttcggcatcaggctcccataagtaaggaggtgagtgccgcaaattaggcttcaaat

SEQ ID NO: 38061 - DNA, 75 bp, Artificial Sequence
  Synthetic
tgaagccaaagatgatttgcatattgatactgtttgcagtcacagctgcaagtccagtgtatcagaggtgtttcc

SEQ ID NO: 38062 - DNA, 75 bp, Artificial Sequence
  Synthetic
gatactgtttgcagtcacagctgcaagtccagtgtatcagaggtgtttccaagatggggctatagtgaagcaaaa

SEQ ID NO: 38063 - DNA, 75 bp, Artificial Sequence
  Synthetic
gtatgcctaaaggatgacgttagcatgatcaaaacggaggccagatacataaagaatgcaactggggttttctcc

SEQ ID NO: 38064 - DNA, 75 bp, Artificial Sequence
  Synthetic
tgatcaaaacggaggccagatacataaagaatgcaactggggttttctccaataatgttgcaattcgaaaatggc

SEQ ID NO: 38065 - DNA, 75 bp, Artificial Sequence
  Synthetic
accaaagaaaataacaggtggtcatattaatgtcattgaagttggcgatgacctatcattgcacacagaatcgta

SEQ ID NO: 38066 - DNA, 75 bp, Artificial Sequence
  Synthetic
attaatgtcattgaagttggcgatgacctatcattgcacacagaatcgtatgtatgcagtgctgattgtaccata

SEQ ID NO: 38067 - DNA, 75 bp, Artificial Sequence
  Synthetic
ttcggcttcagacggacacaactaaccatttcgagatagcagggaccatagttaaatctgggtggtttaagagta

SEQ ID NO: 38068 - DNA, 75 bp, Artificial Sequence
  Synthetic
ccatttcgagatagcagggaccatagttaaatctgggtggtttaagagtacaacatatataacccttgaccagac

SEQ ID NO: 38069 - DNA, 75 bp, Artificial Sequence
  Synthetic
gggcctaagtcgattcagttccatgcatgcttcaatcagcatatgtcctgtgtcagatttttacataggacaata

SEQ ID NO: 38070 - DNA, 75 bp, Artificial Sequence
  Synthetic
catgcttcaatcagcatatgtcctgtgtcagatttttacataggacaatattgcctggttctattgccaattcaa

SEQ ID NO: 38071 - DNA, 75 bp, Artificial Sequence
  Synthetic
attagttacgcttactctgttaatattcatactcttaagtgtactaagtaagacatatatatgttacctattaat

SEQ ID NO: 38072 - DNA, 75 bp, Artificial Sequence
  Synthetic
ttcatactcttaagtgtactaagtaagacatatatatgttacctattaatgcctgtatttatccctatagcgtat

SEQ ID NO: 38073 - DNA, 75 bp, Artificial Sequence
  Synthetic
cttgtaaaaaatgcaaactgtgtggattagtttatcacccattcacagaatgtgggacacattgtgtctgcggtg

SEQ ID NO: 38074 - DNA, 75 bp, Artificial Sequence
  Synthetic
attagtttatcacccattcacagaatgtgggacacattgtgtctgcggtgctcgttatgacacttctgatagaat

SEQ ID NO: 38075 - DNA, 75 bp, Artificial Sequence
  Synthetic
ttctcgggtattagagataaatacattaatctacatgacagcagagctctagaaaaggagccagatatattagga

SEQ ID NO: 38076 - DNA, 75 bp, Artificial Sequence
  Synthetic
tgtcctggttacaagagcttgagggctgccagagttatgtgcaaatcaaagggtcctgcttcaatactatctgtg

SEQ ID NO: 38077 - DNA, 75 bp, Artificial Sequence
  Synthetic
ctgccagagttatgtgcaaatcaaagggtcctgcttcaatactatctgtgatcacagcaatattgatcttaacat

SEQ ID NO: 38078 - DNA, 75 bp, Artificial Sequence
  Synthetic
tttggagttaacaaatgatgacattcaagtcatctattcatacataattttaaatgatccgatgatgataactat

SEQ ID NO: 38079 - DNA, 75 bp, Artificial Sequence
  Synthetic
agtgggagagagtaaagaagtcttcgagctggaacaacttccagatgacatgctggatatggcactaaggattaa

SEQ ID NO: 38080 - DNA, 75 bp, Artificial Sequence
  Synthetic
gagctggaacaacttccagatgacatgctggatatggcactaaggattaatttctattactttgtctgcatcatg

SEQ ID NO: 38081 - DNA, 75 bp, Artificial Sequence
  Synthetic
taattatcggcctactaattggattgcttttcaagaaataccagcatagattttcgaatctctatgctatgtact

SEQ ID NO: 38082 - DNA, 75 bp, Artificial Sequence
  Synthetic
gcttttcaagaaataccagcatagattttcgaatctctatgctatgtactgcgaagagtgtgacatgtatcatga

SEQ ID NO: 38083 - DNA, 75 bp, Artificial Sequence
  Synthetic
gacttcacaaacaagtgcaggcagtgtacatgtgggcagtatgaggatgcaacaggactaatgacccataggaaa

SEQ ID NO: 38084 - DNA, 75 bp, Artificial Sequence
  Synthetic
gtacatgtgggcagtatgaggatgcaacaggactaatgacccataggaaaacctataattgcttggtacggtata

SEQ ID NO: 38085 - DNA, 75 bp, Artificial Sequence
  Synthetic
gatagcttatatgcttttaacattgataaaagactcagctatagtagtgcaagctgctggaacagacttcacaac

SEQ ID NO: 38086 - DNA, 75 bp, Artificial Sequence
  Synthetic
ataaaagactcagctatagtagtgcaagctgctggaacagacttcacaacttgtttagaaacagaaaatataaac

SEQ ID NO: 38087 - DNA, 75 bp, Artificial Sequence
  Synthetic
accttggaaattgtcaaaaacaacagaaaaaggaaccctacgcaaacatagccactcagctaaaaggtttgcaag

SEQ ID NO: 38088 - DNA, 75 bp, Artificial Sequence
  Synthetic
gaaaaaggaaccctacgcaaacatagccactcagctaaaaggtttgcaagcaatttcagtgctcgatatgcccat

SEQ ID NO: 38089 - DNA, 75 bp, Artificial Sequence
  Synthetic
gcaggggcactaagatacatcgaagaaaaagaaacattccatgttcagctaactgcagaatatgccatgctatct

SEQ ID NO: 38090 - DNA, 75 bp, Artificial Sequence
  Synthetic
aaaaagaaacattccatgttcagctaactgcagaatatgccatgctatctagatactgcgactattacgcccagt

SEQ ID NO: 38091 - DNA, 75 bp, Artificial Sequence
  Synthetic
gacgacatggagagtttatctaaggtcccatgactttgatgcttgcatactctatccaaatcagcatttctgtag

SEQ ID NO: 38092 - DNA, 75 bp, Artificial Sequence
  Synthetic
tcccatgactttgatgcttgcatactctatccaaatcagcatttctgtagatgtgtaaagcgtggagataaatgt

SEQ ID NO: 38093 - DNA, 75 bp, Artificial Sequence
  Synthetic
acgagatgaaaaactactactcaggaaagcaaaacaagtttgacaaagatctaaatttggccttaatggcattac

SEQ ID NO: 38094 - DNA, 75 bp, Artificial Sequence
  Synthetic
aaagcaaaacaagtttgacaaagatctaaatttggccttaatggcattacatcatgcattccggggcacatcgtc

SEQ ID NO: 38095 - DNA, 75 bp, Artificial Sequence
  Synthetic
cgaaaacatgtctaaaattcaaacataccctggcaactattatataacttttagaaagaaggatcgacatcaatt

SEQ ID NO: 38096 - DNA, 75 bp, Artificial Sequence
  Synthetic
aagaagtcaaacgatgatctaattgcatatactaataagattaaagaaaagttcccagggaatgcgctactcaag

SEQ ID NO: 38097 - DNA, 75 bp, Artificial Sequence
  Synthetic
catatactaataagattaaagaaaagttcccagggaatgcgctactcaaggccattgtggattatatagcgtaca

SEQ ID NO: 38098 - DNA, 75 bp, Artificial Sequence
  Synthetic
tttcaagtacgatgaattttgggatgatcttttgtacaaatcagctccaacaaaagctccatctttgtctagagg

SEQ ID NO: 38099 - DNA, 75 bp, Artificial Sequence
  Synthetic
gatcttttgtacaaatcagctccaacaaaagctccatctttgtctagaggtagtgagccatcatataatttcaag

SEQ ID NO: 38100 - DNA, 75 bp, Artificial Sequence
  Synthetic
aaagttgcaaaaatgttaaaagcgttgtttgtctatctcccagatctggggtgtcatatgattcaatcatagcat

SEQ ID NO: 38101 - DNA, 75 bp, Artificial Sequence
  Synthetic
tgtttgtctatctcccagatctggggtgtcatatgattcaatcatagcatgtggtgatcctaatggcccaagtgt

SEQ ID NO: 38102 - DNA, 75 bp, Artificial Sequence
  Synthetic
tttcaatcaaatgcagatcaatcaacatactgcttagcagacagccattgccttgaagattttgaagtagtcagc

SEQ ID NO: 38103 - DNA, 75 bp, Artificial Sequence
  Synthetic
catactgcttagcagacagccattgccttgaagattttgaagtagtcagccaagaagagctggacgcaataaaga

SEQ ID NO: 38104 - DNA, 75 bp, Artificial Sequence
  Synthetic
tccagatgtcaaactatcaaagttgacagatggggttaaaagctgcagaatgaaagattctggaaattgcaatgt

SEQ ID NO: 38105 - DNA, 75 bp, Artificial Sequence
  Synthetic
acagatggggttaaaagctgcagaatgaaagattctggaaattgcaatgttgcagctaacagatggcctataata

SEQ ID NO: 38106 - DNA, 75 bp, Artificial Sequence
  Synthetic
attcagagctgcaaaaggattacgataagacacaagacattggtcacttttgcctaagtcctggatgctctacag

SEQ ID NO: 38107 - DNA, 75 bp, Artificial Sequence
  Synthetic
taagacacaagacattggtcacttttgcctaagtcctggatgctctacagttcgcttcccgatcaacccaaagca

SEQ ID NO: 38108 - DNA, 75 bp, Artificial Sequence
  Synthetic
agtcgatctagcatagcaaagattgatgtgcacaatattgaagatattgatcaatacaggaaggccataactcag

SEQ ID NO: 38109 - DNA, 75 bp, Artificial Sequence
  Synthetic
atgtgcacaatattgaagatattgatcaatacaggaaggccataactcagaaactgcaaacaagcttatctcttt

SEQ ID NO: 38110 - DNA, 75 bp, Artificial Sequence
  Synthetic
gcctcacatcaaaccaatttacaaatacataaccatagagggaactgaaactgcagagggaatagaaagtgccta

SEQ ID NO: 38111 - DNA, 75 bp, Artificial Sequence
  Synthetic
tacataaccatagagggaactgaaactgcagagggaatagaaagtgcctatattgagtctgaaatacctgcacta

SEQ ID NO: 38112 - DNA, 75 bp, Artificial Sequence
  Synthetic
tcacctccaaagaaggcaagcatttattagatgtcataggctatgtaaaaagtgcttcatgctcttctatatata

SEQ ID NO: 38113 - DNA, 75 bp, Artificial Sequence
  Synthetic
attagatgtcataggctatgtaaaaagtgcttcatgctcttctatatatacgaagctttacacaacaggcccaac

SEQ ID NO: 38114 - DNA, 75 bp, Artificial Sequence
  Synthetic
gagttatgtacaggaccttgcccagctaaaatcaaccaccagactggatggttgacctttgcgaaagagaggacg

SEQ ID NO: 38115 - DNA, 75 bp, Artificial Sequence
  Synthetic
ctaaaatcaaccaccagactggatggttgacctttgcgaaagagaggacgagttcatggggctgcgaggagttcg

SEQ ID NO: 38116 - DNA, 75 bp, Artificial Sequence
  Synthetic
tgtcttcggatcatgtcaagacataataagagatgagttaactgtgtacaggaaggaaacagatgaagtaactga

SEQ ID NO: 38117 - DNA, 75 bp, Artificial Sequence
  Synthetic
ataagagatgagttaactgtgtacaggaaggaaacagatgaagtaactgatgtagagttatgtctgacattttca

SEQ ID NO: 38118 - DNA, 75 bp, Artificial Sequence
  Synthetic
acccaattacaccgattataacagatttgttcgaagtgcaatttaaaactgtcgaaacttacagcctgccaagga

SEQ ID NO: 38119 - DNA, 75 bp, Artificial Sequence
  Synthetic
tttgttcgaagtgcaatttaaaactgtcgaaacttacagcctgccaaggatcgttgccatccagaatcacgaaat

SEQ ID NO: 38120 - DNA, 75 bp, Artificial Sequence
  Synthetic
ggagtctactctaagggatgcggaaatgtccaaaaggtaaatgggacagtatatggcaatggggttcccaaattc

SEQ ID NO: 38121 - DNA, 75 bp, Artificial Sequence
  Synthetic
atgtccaaaaggtaaatgggacagtatatggcaatggggttcccaaattcgattatttgtgtcacctagctagta

SEQ ID NO: 38122 - DNA, 75 bp, Artificial Sequence
  Synthetic
cttcgataatgattatcaagcatgcaaatttctacaaagcccagctagctacagactagaagaagacagcggaac

SEQ ID NO: 38123 - DNA, 75 bp, Artificial Sequence
  Synthetic
aaatttctacaaagcccagctagctacagactagaagaagacagcggaactgttactgtgattgattacaagaag

SEQ ID NO: 38124 - DNA, 75 bp, Artificial Sequence
  Synthetic
ctatcttaggagatgtcaaatacaaaacatttgctgataatgttgatatgactgcagaagggtcttgtactggat

SEQ ID NO: 38125 - DNA, 75 bp, Artificial Sequence
  Synthetic
aacatttgctgataatgttgatatgactgcagaagggtcttgtactggatgcataaattgctttgaaaatatcca

SEQ ID NO: 38126 - DNA, 75 bp, Artificial Sequence
  Synthetic
attgaagctagctgcccaatagtaagcacatgtacggtattccatgatagaatacttgtaactccgaacgagcat

SEQ ID NO: 38127 - DNA, 75 bp, Artificial Sequence
  Synthetic
tgtgccctggttataaaagcctaagagctgccagagtcatgtgcaagtcgaaagggcctgcatcaatattgtcta

SEQ ID NO: 38128 - DNA, 75 bp, Artificial Sequence
  Synthetic
gcacatgtacggtattccatgatagaatacttgtaactccgaacgagcataaatatgcattaaaagttgtatgca

SEQ ID NO: 38129 - DNA, 75 bp, Artificial Sequence
  Synthetic
cattaggatatgtaatacaaaagttgaagcttcattagctcttgttgatgctaaacctatactagagttggcacc

SEQ ID NO: 38130 - DNA, 75 bp, Artificial Sequence
  Synthetic
gaagcttcattagctcttgttgatgctaaacctatactagagttggcaccagtagatcaaactgcttacataaga

SEQ ID NO: 38131 - DNA, 75 bp, Artificial Sequence
  Synthetic
ggatgtgcagagtgagggatgaagggttacaggttatattagagccgtttaagaacctttttggctcttacatag

SEQ ID NO: 38132 - DNA, 75 bp, Artificial Sequence
  Synthetic
gttacaggttatattagagccgtttaagaacctttttggctcttacatagggatattttatacatttataatatc

SEQ ID NO: 38133 - DNA, 75 bp, Artificial Sequence
  Synthetic
tatattgtgctacccatatgcttcaagctgagagatactctcaggaagcatgaagatgcatacaagagagagatg

SEQ ID NO: 38134 - DNA, 75 bp, Artificial Sequence
  Synthetic
taaggtggggggtggggaactaacaacagcgtgaatttattttacaaacattattctatacttggtagcacacta

SEQ ID NO: 38135 - DNA, 75 bp, Artificial Sequence
  Synthetic
gaacctcgggaattgccaaaagcaacaaaagaaagaaccttacaccaacattgcaactcagttaaagggactaaa

SEQ ID NO: 38136 - DNA, 75 bp, Artificial Sequence
  Synthetic
ttgcaactcagttaaagggactaaaagcaatttccgtactagatatccctataataacagggataccagatgata

SEQ ID NO: 38137 - DNA, 75 bp, Artificial Sequence
  Synthetic
tagggcaacagaatatgaatcacattgtgaaagtctaaagaacaaggcgagggcttcttggaagcaagttatgaa

SEQ ID NO: 38138 - DNA, 75 bp, Artificial Sequence
  Synthetic
caaaaaagtccaatgatgacttgattgcatacacaaataagataaaaacaaaattcccaggtaatgcattgttga

SEQ ID NO: 38139 - DNA, 75 bp, Artificial Sequence
  Synthetic
aaaaacctgcaagaatgttaaggatgttgcctgcttatcgccaaggtcaggtgctatatatgcttcaataattgc

SEQ ID NO: 38140 - DNA, 75 bp, Artificial Sequence
  Synthetic
gtgtataggaaaccatcaggtggtgtattccaatccagtactgaccggtctatatactgcttgctggatagccat

SEQ ID NO: 38141 - DNA, 75 bp, Artificial Sequence
  Synthetic
ttgccgcacatcaaaccaatttataaatatataactatgaagggaacagaaactgcagaagggatagagagtgca

SEQ ID NO: 38142 - DNA, 75 bp, Artificial Sequence
  Synthetic
agtagtgtactccactcgaatactttgaaaatactttgttgctaattgtttttacctaagggattgacttggaag

SEQ ID NO: 38143 - DNA, 75 bp, Artificial Sequence
  Synthetic
taataaaagaagaactatctgtctataggaaggagaccgaggaggtgaccaatgttgagctatgtttaacatttt

SEQ ID NO: 38144 - DNA, 75 bp, Artificial Sequence
  Synthetic
gaggagggctaagcgacactgccagatcattcttgcagaagttcggcatcaggctcccataagtaaggaggtgag

SEQ ID NO: 38145 - DNA, 75 bp, Artificial Sequence
  Synthetic
cacagaaaagccagggaacacactcacaattaaagtctgcaatactaaaattgaagcatctatggcccttgtcga

SEQ ID NO: 38146 - DNA, 75 bp, Artificial Sequence
  Synthetic
agtagtgtactaccaagtatagataacgtctggaaaacaaagtcattagaaagtgtcgaaatgatacctttgctg

SEQ ID NO: 38147 - DNA, 75 bp, Artificial Sequence
  Synthetic
acgtctggaaaacaaagtcattagaaagtgtcgaaatgatacctttgctgtttttagttacgctggtgtctgcag

SEQ ID NO: 38148 - DNA, 75 bp, Artificial Sequence
  Synthetic
aagtgtcgaaatgatacctttgctgtttttagttacgctggtgtctgcaggcccagtgtttcaacgttgcttcca

SEQ ID NO: 38149 - DNA, 75 bp, Artificial Sequence
  Synthetic
ccatcgaaagaggcagtgacagaagtatgtataaaagatgatgtaagtatgattaaaacagaggctagatatgtc

SEQ ID NO: 38150 - DNA, 75 bp, Artificial Sequence
  Synthetic
tatgtataaaagatgatgtaagtatgattaaaacagaggctagatatgtcaggaattcaagtggagtcttctcaa

SEQ ID NO: 38151 - DNA, 75 bp, Artificial Sequence
  Synthetic
tgaaaattagataggggattcatgtaaaacagaattgagtcctgtattatatattctatttgtagtatagctgtt

SEQ ID NO: 38152 - DNA, 75 bp, Artificial Sequence
  Synthetic
cgtgtcggattggcatgactgcaaaccaaaaaaagtcagtggagggcatattaatgttatcgaggttggtaacga

SEQ ID NO: 38153 - DNA, 75 bp, Artificial Sequence
  Synthetic
ccaaaaaaagtcagtggagggcatattaatgttatcgaggttggtaacgatttaactttacacacagaatcgtat

SEQ ID NO: 38154 - DNA, 75 bp, Artificial Sequence
  Synthetic
ctgttgttaagtggggggtggggaactaacaacagcgtaagtttattttgcaaacattattttatacttggtagc

SEQ ID NO: 38155 - DNA, 75 bp, Artificial Sequence
  Synthetic
gaattgacaaggaaacggcacaaatcagactccaaactgatactacaaatcactttgaagtggcaggaactactg

SEQ ID NO: 38156 - DNA, 75 bp, Artificial Sequence
  Synthetic
cagactccaaactgatactacaaatcactttgaagtggcaggaactactgtaaaatctgggtggttcaaaagcac

SEQ ID NO: 38157 - DNA, 75 bp, Artificial Sequence
  Synthetic
tgcgagcacttgaaagtatcttgcggtcccaaatccatacagttccatgcatgctttaatcagcatatgtcttgt

SEQ ID NO: 38158 - DNA, 75 bp, Artificial Sequence
  Synthetic
gtcccaaatccatacagttccatgcatgctttaatcagcatatgtcttgtgtcaggttcctgcatagaaccatac

SEQ ID NO: 38159 - DNA, 75 bp, Artificial Sequence
  Synthetic
atgccaaaatatagaaataataatcctaaccacactagcattgcttatattcttattattaactattttaagcaa

SEQ ID NO: 38160 - DNA, 75 bp, Artificial Sequence
  Synthetic
ctaaccacactagcattgcttatattcttattattaactattttaagcaaaacatatatctgctacttactaatg

SEQ ID NO: 38161 - DNA, 75 bp, Artificial Sequence
  Synthetic
agtagtgtactaccaagtatagataacgttcaaatctcttctcatttcaaagatggaagtcctaagcttgatctg

SEQ ID NO: 38162 - DNA, 75 bp, Artificial Sequence
  Synthetic
acgttcaaatctcttctcatttcaaagatggaagtcctaagcttgatctggttgctgacattatgctcggctagt

SEQ ID NO: 38163 - DNA, 75 bp, Artificial Sequence
  Synthetic
agatggaagtcctaagcttgatctggttgctgacattatgctcggctagtccagtattccaaaggtgtttccaag

SEQ ID NO: 38164 - DNA, 75 bp, Artificial Sequence
  Synthetic
tatacggattaatttacaataagtcttgtaaaaagtgtcagctatgcggcctagtgtatcatccatttactgagt

SEQ ID NO: 38165 - DNA, 75 bp, Artificial Sequence
  Synthetic
ttgtaaaaagtgtcagctatgcggcctagtgtatcatccatttactgagtgcggcacccactgtgtatgtggtgc

SEQ ID NO: 38166 - DNA, 75 bp, Artificial Sequence
  Synthetic
atcaaaggaagcagtgacagaagtttgccttaaagatgatgtaagtatgattaagactgagacaaaatatgtgaa

SEQ ID NO: 38167 - DNA, 75 bp, Artificial Sequence
  Synthetic
tgccttaaagatgatgtaagtatgattaagactgagacaaaatatgtgaaaaacacaactggtacatttgccaac

SEQ ID NO: 38168 - DNA, 75 bp, Artificial Sequence
  Synthetic
aaattgcatcgtgcatcaggcctttgcccaggatataagagtttgagagctgctagagttatgtgtaaatctaaa

SEQ ID NO: 38169 - DNA, 75 bp, Artificial Sequence
  Synthetic
gcccaggatataagagtttgagagctgctagagttatgtgtaaatctaaaggaccagcatcaaacctatccataa

SEQ ID NO: 38170 - DNA, 75 bp, Artificial Sequence
  Synthetic
ttgcagattggcatgattgcagacctcagaaatcatctggtggccatatcaatgttatcgaagtaggagatgatc

SEQ ID NO: 38171 - DNA, 75 bp, Artificial Sequence
  Synthetic
tcagaaatcatctggtggccatatcaatgttatcgaagtaggagatgatctatcactgcatacagaatcgtacat

SEQ ID NO: 38172 - DNA, 75 bp, Artificial Sequence
  Synthetic
tgtgacacctataaatgggttaacaataggggatagtaaggaagttttaaaccctgatgagctcccagatgacat

SEQ ID NO: 38173 - DNA, 75 bp, Artificial Sequence
  Synthetic
ataggggatagtaaggaagttttaaaccctgatgagctcccagatgacatgttagaaatggctcaaaaattaaac

SEQ ID NO: 38174 - DNA, 75 bp, Artificial Sequence
  Synthetic
gtggacaaagaaacagctcagatccgtttgcagacagacaacacaaaccactttgaggttgctgggacaactgtg

SEQ ID NO: 38175 - DNA, 75 bp, Artificial Sequence
  Synthetic
gtttgcagacagacaacacaaaccactttgaggttgctgggacaactgtgaaatctggatggtttaaaagcacaa

SEQ ID NO: 38176 - DNA, 75 bp, Artificial Sequence
  Synthetic
attatactgcaacatggtctattataattataggtttagctgtcttttacattttcaaaaagtaccagcatagat

SEQ ID NO: 38177 - DNA, 75 bp, Artificial Sequence
  Synthetic
aattataggtttagctgtcttttacattttcaaaaagtaccagcatagattctacaattactatgctatgtattg

SEQ ID NO: 38178 - DNA, 75 bp, Artificial Sequence
  Synthetic
tgagcatttaaaagtatcatgtggccctaagtcaatacagttccatgcatgctttaaccaacatatgtcttgtgt

SEQ ID NO: 38179 - DNA, 75 bp, Artificial Sequence
  Synthetic
cctaagtcaatacagttccatgcatgctttaaccaacatatgtcttgtgtacgattcttgcataggacaatactc

SEQ ID NO: 38180 - DNA, 75 bp, Artificial Sequence
  Synthetic
agatctggcctgaagtggaatggagacttcacaaataagtgcagacagtgcacatgtggtgagtatgaagatgca

SEQ ID NO: 38181 - DNA, 75 bp, Artificial Sequence
  Synthetic
acttcacaaataagtgcagacagtgcacatgtggtgagtatgaagatgcagctggtttaatatctcacaggaaat

SEQ ID NO: 38182 - DNA, 75 bp, Artificial Sequence
  Synthetic
gccaaaatatagaaataataatcttagttacgctgtcattagtaatattcatattcttgactatagtaagtaaga

SEQ ID NO: 38183 - DNA, 75 bp, Artificial Sequence
  Synthetic
agttacgctgtcattagtaatattcatattcttgactatagtaagtaagacatatatctgttacttattaatgcc

SEQ ID NO: 38184 - DNA, 75 bp, Artificial Sequence
  Synthetic
ggttaagtgggtaatgaactttttaaccatatatgttgccttgatcattctgaaagactcaacattgatagtaca

SEQ ID NO: 38185 - DNA, 75 bp, Artificial Sequence
  Synthetic
accatatatgttgccttgatcattctgaaagactcaacattgatagtacaagcagcgggcactgatttctcagat

SEQ ID NO: 38186 - DNA, 75 bp, Artificial Sequence
  Synthetic
tacggatggatctataataagtcatgtaaaaaatgtaaactttgtggtttagtctatcacccgtttactgaatgc

SEQ ID NO: 38187 - DNA, 75 bp, Artificial Sequence
  Synthetic
gtaaaaaatgtaaactttgtggtttagtctatcacccgtttactgaatgcggcacacactgtgtttgtggtgcaa

SEQ ID NO: 38188 - DNA, 75 bp, Artificial Sequence
  Synthetic
ggaactgcactggccctttcttgaatttaggtaattgcgaaaagaaacagaagaaggaatcatattcaaatattg

SEQ ID NO: 38189 - DNA, 75 bp, Artificial Sequence
  Synthetic
tttaggtaattgcgaaaagaaacagaagaaggaatcatattcaaatattgcagaacagttgaaaggtttgcaagc

SEQ ID NO: 38190 - DNA, 75 bp, Artificial Sequence
  Synthetic
actgcatagagcatctggtttatgtccaggatacaaaagtctcagagctgctagagtaatgtgcaaatctaaagg

SEQ ID NO: 38191 - DNA, 75 bp, Artificial Sequence
  Synthetic
ccaggatacaaaagtctcagagctgctagagtaatgtgcaaatctaaaggcccagcatcaattttatccatttta

SEQ ID NO: 38192 - DNA, 75 bp, Artificial Sequence
  Synthetic
attgcaagaatacctgaggacatatctggcggattgagatatatcgaatctatcagaactcatcatgcgcaactt

SEQ ID NO: 38193 - DNA, 75 bp, Artificial Sequence
  Synthetic
ctggcggattgagatatatcgaatctatcagaactcatcatgcgcaacttaccgctgaatatgcaatgttgacta

SEQ ID NO: 38194 - DNA, 75 bp, Artificial Sequence
  Synthetic
tcacacctatcagtgcaatggtcgttggtgaatcaaatgagatctacaccttagacgacttacctgatgacatgg

SEQ ID NO: 38195 - DNA, 75 bp, Artificial Sequence
  Synthetic
tggtgaatcaaatgagatctacaccttagacgacttacctgatgacatggttcagatggcagaaaggataaacat

SEQ ID NO: 38196 - DNA, 75 bp, Artificial Sequence
  Synthetic
tggggacaactctggatacagtcaaacaacatggagaatgtatctaagatcacatgactttggagcatgcatttt

SEQ ID NO: 38197 - DNA, 75 bp, Artificial Sequence
  Synthetic
acaacatggagaatgtatctaagatcacatgactttggagcatgcattttatacccaaatcaacatttttgtagg

SEQ ID NO: 38198 - DNA, 75 bp, Artificial Sequence
  Synthetic
tatggggtgacatgggctttcttattgcttggtttagttttagcatacttcttcaaaaaatatcaacataaattc

SEQ ID NO: 38199 - DNA, 75 bp, Artificial Sequence
  Synthetic
tgcttggtttagttttagcatacttcttcaaaaaatatcaacataaattcttagattattatgcaatgtactgtg

SEQ ID NO: 38200 - DNA, 75 bp, Artificial Sequence
  Synthetic
gcagttcaagctgggactttgccagtgagatgaagaattattactccgggaaacagggaaaatttaacaaagact

SEQ ID NO: 38201 - DNA, 75 bp, Artificial Sequence
  Synthetic
tgagatgaagaattattactccgggaaacagggaaaatttaacaaagacttaaacttggccttacagtctatcca

SEQ ID NO: 38202 - DNA, 75 bp, Artificial Sequence
  Synthetic
atcaggtatgacatattggggggattttacaaataagtgtaggcaatgcacatgtgggcaatttgaagatgccac

SEQ ID NO: 38203 - DNA, 75 bp, Artificial Sequence
  Synthetic
tttacaaataagtgtaggcaatgcacatgtgggcaatttgaagatgccactggcttgatggtgcataaaaaatct

SEQ ID NO: 38204 - DNA, 75 bp, Artificial Sequence
  Synthetic
tcttacatagcaactatcttatcagagaagaggaatgaccaacttgtggaatacatggaaaaactaagggaaaag

SEQ ID NO: 38205 - DNA, 75 bp, Artificial Sequence
  Synthetic
agaagaggaatgaccaacttgtggaatacatggaaaaactaagggaaaagtttattggaaatgctttactcagag

SEQ ID NO: 38206 - DNA, 75 bp, Artificial Sequence
  Synthetic
caaaatggataagaaacattttaattgcatatttgatgataatgttggttaaagattcgctattatttgttggtg

SEQ ID NO: 38207 - DNA, 75 bp, Artificial Sequence
  Synthetic
tgcatatttgatgataatgttggttaaagattcgctattatttgttggtgcaacaagagctgactttgcatcatg

SEQ ID NO: 38208 - DNA, 75 bp, Artificial Sequence
  Synthetic
gaagtctttaactgaaatgacaaactttaaacatgacgaattttgggatgaatttgtccatctgcctgcaccaac

SEQ ID NO: 38209 - DNA, 75 bp, Artificial Sequence
  Synthetic
tttaaacatgacgaattttgggatgaatttgtccatctgcctgcaccaacaaaagccccatctatgaggagatct

SEQ ID NO: 38210 - DNA, 75 bp, Artificial Sequence
  Synthetic
aattgcactgggccatttctgaatctgggtcgatgtgacaaaactcaaaaaaagacaggctataaagacatagct

SEQ ID NO: 38211 - DNA, 75 bp, Artificial Sequence
  Synthetic
tgggtcgatgtgacaaaactcaaaaaaagacaggctataaagacatagctaatcaattgaagggtctgggtgtga

SEQ ID NO: 38212 - DNA, 75 bp, Artificial Sequence
  Synthetic
caccaacatctccagctgggactaaaagttgcaaaaacataaagaacgttgtatgtctctcacctagatccggtg

SEQ ID NO: 38213 - DNA, 75 bp, Artificial Sequence
  Synthetic
aagttgcaaaaacataaagaacgttgtatgtctctcacctagatccggtgcttcctacgaaggcattgtagcttg

SEQ ID NO: 38214 - DNA, 75 bp, Artificial Sequence
  Synthetic
tgagaagatgccagatgaaatctcaggatctttaaaatatattgacagtttagaaacatatcatgagcagctgac

SEQ ID NO: 38215 - DNA, 75 bp, Artificial Sequence
  Synthetic
ggatctttaaaatatattgacagtttagaaacatatcatgagcagctgaccgcagaatatgcattcctcaccagg

SEQ ID NO: 38216 - DNA, 75 bp, Artificial Sequence
  Synthetic
ttcaaaatgccctctgaatctatctatcataacaatgcagaccagtctatgtattgtattgcagatacccactgc

SEQ ID NO: 38217 - DNA, 75 bp, Artificial Sequence
  Synthetic
atcataacaatgcagaccagtctatgtattgtattgcagatacccactgcttgcaagattactccccagttgaag

SEQ ID NO: 38218 - DNA, 75 bp, Artificial Sequence
  Synthetic
ctgacaattcaggttatagccaaacagtatggcgaacctatttacgatcacatgattttggtgcatgtgttgtgt

SEQ ID NO: 38219 - DNA, 75 bp, Artificial Sequence
  Synthetic
agtatggcgaacctatttacgatcacatgattttggtgcatgtgttgtgtatccaaaccaacatttttgcagatg

SEQ ID NO: 38220 - DNA, 75 bp, Artificial Sequence
  Synthetic
atcaaaatgctgggaaacagaatttaccaatgcagtgccatttaaacaaagtgatggaatacgaagctgtagaat

SEQ ID NO: 38221 - DNA, 75 bp, Artificial Sequence
  Synthetic
accaatgcagtgccatttaaacaaagtgatggaatacgaagctgtagaatgagagattctgggaattgtaatgtg

SEQ ID NO: 38222 - DNA, 75 bp, Artificial Sequence
  Synthetic
agtgctaaatgggattttgctaacgagatgaagacattttacactggccggaaagtaaaattcaataaagattta

SEQ ID NO: 38223 - DNA, 75 bp, Artificial Sequence
  Synthetic
agatgaagacattttacactggccggaaagtaaaattcaataaagatttaaatttagcattactagtgctacata

SEQ ID NO: 38224 - DNA, 75 bp, Artificial Sequence
  Synthetic
agtgtgacgatggtaaattttattattctgagcaccaaaaagattatgacaaggatcaagatataggccattttt

SEQ ID NO: 38225 - DNA, 75 bp, Artificial Sequence
  Synthetic
ttctgagcaccaaaaagattatgacaaggatcaagatataggccatttttgcttgagcccaagatgcaatatggt

SEQ ID NO: 38226 - DNA, 75 bp, Artificial Sequence
  Synthetic
atatattgcagaagctatggcccgaaaagacaatggttcaatggcacattttgctttagaaattaggaagaagtt

SEQ ID NO: 38227 - DNA, 75 bp, Artificial Sequence
  Synthetic
aaagacaatggttcaatggcacattttgctttagaaattaggaagaagttcccaacaaatgctctactggcagct

SEQ ID NO: 38228 - DNA, 75 bp, Artificial Sequence
  Synthetic
attttagcatgcgattggatagtcagccatccaaatattgataaaatagatgtccattctcttgaagatctagag

SEQ ID NO: 38229 - DNA, 75 bp, Artificial Sequence
  Synthetic
gccatccaaatattgataaaatagatgtccattctcttgaagatctagagcaatataaaaaggcaataacccaga

SEQ ID NO: 38230 - DNA, 75 bp, Artificial Sequence
  Synthetic
agtcacttgcagagatatcaacattcgagctggaagaagattgggaagactttaaatacaaacctgaaccaacag

SEQ ID NO: 38231 - DNA, 75 bp, Artificial Sequence
  Synthetic
cgagctggaagaagattgggaagactttaaatacaaacctgaaccaacagaatctactctacaacctagatctca

SEQ ID NO: 38232 - DNA, 75 bp, Artificial Sequence
  Synthetic
caaatatgcaaaaactatgaatttaccacatgttaaaccaatatataagtatatttcaattgaaggcacagagac

SEQ ID NO: 38233 - DNA, 75 bp, Artificial Sequence
  Synthetic
ccacatgttaaaccaatatataagtatatttcaattgaaggcacagagactgcagaaggggttgaaaatgctttc

SEQ ID NO: 38234 - DNA, 75 bp, Artificial Sequence
  Synthetic
aatgcagatagcaatagcaatgtcaaagtctgtaaaaatgtcaaaaaagtattgtgtgtctcacctagatctaga

SEQ ID NO: 38235 - DNA, 75 bp, Artificial Sequence
  Synthetic
aagtctgtaaaaatgtcaaaaaagtattgtgtgtctcacctagatctagagctaaatttgagaatataatagctt

SEQ ID NO: 38236 - DNA, 75 bp, Artificial Sequence
  Synthetic
caggaacatcaataggatttaaagtaaattctaaagatgggaagcatattatggatattattggttatgtaaaaa

SEQ ID NO: 38237 - DNA, 75 bp, Artificial Sequence
  Synthetic
aaattctaaagatgggaagcatattatggatattattggttatgtaaaaactgcatcatattcgtctgtatatac

SEQ ID NO: 38238 - DNA, 75 bp, Artificial Sequence
  Synthetic
atatatgatgcctaatatcagtatctatcaatccaattctgaaaggagtcattactgtattgcagactcacactg

SEQ ID NO: 38239 - DNA, 75 bp, Artificial Sequence
  Synthetic
tatcaatccaattctgaaaggagtcattactgtattgcagactcacactgtcttgaggagtatgaaattgtgaac

SEQ ID NO: 38240 - DNA, 75 bp, Artificial Sequence
  Synthetic
acaggggtgaatacaaagcacgatgaattatgcacaggcccgtgtcctaaacagattgaacataaaaatggctgg

SEQ ID NO: 38241 - DNA, 75 bp, Artificial Sequence
  Synthetic
aattatgcacaggcccgtgtcctaaacagattgaacataaaaatggctggataactttttcaaaggaaaggacaa

SEQ ID NO: 38242 - DNA, 75 bp, Artificial Sequence
  Synthetic
aatctagatgctgggctaaggagatggatgatgtcgtactacataaacagagtgatgggttaagaagttgcagaa

SEQ ID NO: 38243 - DNA, 75 bp, Artificial Sequence
  Synthetic
ggatgatgtcgtactacataaacagagtgatgggttaagaagttgcagaattaaagatactgggagttgtaatgt

SEQ ID NO: 38244 - DNA, 75 bp, Artificial Sequence
  Synthetic
atgtctagcaataagtgatgggtgcgtatttggatcttgccaagacattattaaagatgaaatgtctgtttacag

SEQ ID NO: 38245 - DNA, 75 bp, Artificial Sequence
  Synthetic
gtatttggatcttgccaagacattattaaagatgaaatgtctgtttacaggaaagaaacagaggaaactacaatt

SEQ ID NO: 38246 - DNA, 75 bp, Artificial Sequence
  Synthetic
ttatgtgaaaatgggaattactattattcggaaattcataaagattacgacaaagatcaagatgtcgggcatttc

SEQ ID NO: 38247 - DNA, 75 bp, Artificial Sequence
  Synthetic
attcggaaattcataaagattacgacaaagatcaagatgtcgggcatttctgtctaagtcctagatgcagtacaa

SEQ ID NO: 38248 - DNA, 75 bp, Artificial Sequence
  Synthetic
ataaaacttattgtgtcgaattaaacccggttacacccataataacagatcttttcgaagtccaattcaaaacag

SEQ ID NO: 38249 - DNA, 75 bp, Artificial Sequence
  Synthetic
cccggttacacccataataacagatcttttcgaagtccaattcaaaacagtagagtcatatacactacctagaat

SEQ ID NO: 38250 - DNA, 75 bp, Artificial Sequence
  Synthetic
tattaggaaatgtgactggcagatctcacattcaacaatcgacaaaatttcggtgcaagagctagctgatataga

SEQ ID NO: 38251 - DNA, 75 bp, Artificial Sequence
  Synthetic
tcacattcaacaatcgacaaaatttcggtgcaagagctagctgatatagaacaatacaaaaaagctatatcacaa

SEQ ID NO: 38252 - DNA, 75 bp, Artificial Sequence
  Synthetic
atggtaggccaaatcaatgatctaggggtttattcaaaaggctgtggcaatgttcaaaaagtgaacgggactgta

SEQ ID NO: 38253 - DNA, 75 bp, Artificial Sequence
  Synthetic
gggtttattcaaaaggctgtggcaatgttcaaaaagtgaacgggactgtatatggtaatggtgtaccaaaatttg

SEQ ID NO: 38254 - DNA, 75 bp, Artificial Sequence
  Synthetic
ttaagtatgtcaaaactaaaaaccttccacatattaaacctgcttataagtatattaccgtagaggggactgaga

SEQ ID NO: 38255 - DNA, 75 bp, Artificial Sequence
  Synthetic
tccacatattaaacctgcttataagtatattaccgtagaggggactgagaccatcgaagggatagaaaatgcctt

SEQ ID NO: 38256 - DNA, 75 bp, Artificial Sequence
  Synthetic
gaaagaagttataatcaggaagtgttttgacaatgactatcaagcttgtaagttcctacagagcccatccagtta

SEQ ID NO: 38257 - DNA, 75 bp, Artificial Sequence
  Synthetic
tttgacaatgactatcaagcttgtaagttcctacagagcccatccagttacagactagaggaggatgcttctaca

SEQ ID NO: 38258 - DNA, 75 bp, Artificial Sequence
  Synthetic
gctggaacagctattggatttaaaataaattcaagagagggtaattacttaatggatgttattggttatgttaaa

SEQ ID NO: 38259 - DNA, 75 bp, Artificial Sequence
  Synthetic
taaattcaagagagggtaattacttaatggatgttattggttatgttaaaagtgcatcttattcagcaacatata

SEQ ID NO: 38260 - DNA, 75 bp, Artificial Sequence
  Synthetic
ttcttggaacaataaagatgaaggctatcttgggagatgttaggtacaagacattttcagagtctatagacattt

SEQ ID NO: 38261 - DNA, 75 bp, Artificial Sequence
  Synthetic
tatcttgggagatgttaggtacaagacattttcagagtctatagacatttctgcagaggggacatgtacaggatg

SEQ ID NO: 38262 - DNA, 75 bp, Artificial Sequence
  Synthetic
tataggaataaatactagacatgatgaaaaatgcacaggtccttgtcctgttactatagaccacaaagatggctg

SEQ ID NO: 38263 - DNA, 75 bp, Artificial Sequence
  Synthetic
gaaaaatgcacaggtccttgtcctgttactatagaccacaaagatggctggttaacattttcaaaggagaggacc

SEQ ID NO: 38264 - DNA, 75 bp, Artificial Sequence
  Synthetic
tgcgaatttaccatacattcaacagtagaagccagctgtcctgttgttagtacatgtactcttttccatgacaga

SEQ ID NO: 38265 - DNA, 75 bp, Artificial Sequence
  Synthetic
tagaagccagctgtcctgttgttagtacatgtactcttttccatgacagaatcttaatagggccagataatcaca

SEQ ID NO: 38266 - DNA, 75 bp, Artificial Sequence
  Synthetic
gatgcttggcagtaagtgacggatgtgtatttgggtcttgtcaagatattatcaaagatgaattagctgtatata

SEQ ID NO: 38267 - DNA, 75 bp, Artificial Sequence
  Synthetic
tgtatttgggtcttgtcaagatattatcaaagatgaattagctgtatatagaaagaccacggaagaattgactac

SEQ ID NO: 38268 - DNA, 75 bp, Artificial Sequence
  Synthetic
agaggcgcctaaaacaagcttaagtttcaaaatatgtaatacaaaagtagatgctgctatcaccatagttgactc

SEQ ID NO: 38269 - DNA, 75 bp, Artificial Sequence
  Synthetic
ttcaaaatatgtaatacaaaagtagatgctgctatcaccatagttgactcgaaacctatagttgagttagcacca

SEQ ID NO: 38270 - DNA, 75 bp, Artificial Sequence
  Synthetic
gacaagacttattgcactaacttaaatgctataacccctataataacagacaagtttgaagttcaatttaaaaca

SEQ ID NO: 38271 - DNA, 75 bp, Artificial Sequence
  Synthetic
atgctataacccctataataacagacaagtttgaagttcaatttaaaacagtcgaatcatacacattgccaagaa

SEQ ID NO: 38272 - DNA, 75 bp, Artificial Sequence
  Synthetic
aaaaagatgataggtgcaaaacatggatgtgcagagttagagatgaaggtatgcaagtcttgtcagagccattca

SEQ ID NO: 38273 - DNA, 75 bp, Artificial Sequence
  Synthetic
gatgtgcagagttagagatgaaggtatgcaagtcttgtcagagccattcaaaaatttattcggatcctatatagg

SEQ ID NO: 38274 - DNA, 75 bp, Artificial Sequence
  Synthetic
taaagttgggcaaattaacgatctaggtgtttattcgaaaggatgtgggaatgttcaaaaagtaaatggaacaaa

SEQ ID NO: 38275 - DNA, 75 bp, Artificial Sequence
  Synthetic
ggtgtttattcgaaaggatgtgggaatgttcaaaaagtaaatggaacaaattatggcaatggggtaccaaaattc

SEQ ID NO: 38276 - DNA, 75 bp, Artificial Sequence
  Synthetic
ttgataattgccttgatagcagtctacatagtcatgcccatttgctttaaggtaaaagatatattaaagaaacat

SEQ ID NO: 38277 - DNA, 75 bp, Artificial Sequence
  Synthetic
acatagtcatgcccatttgctttaaggtaaaagatatattaaagaaacatgatgatgcctacaggcgggagttaa

SEQ ID NO: 38278 - DNA, 75 bp, Artificial Sequence
  Synthetic
gaaaggaagttattttgaggaagtgctttgataatgattatcaggcctgcaaattcctacaaagtcctgcaagct

SEQ ID NO: 38279 - DNA, 75 bp, Artificial Sequence
  Synthetic
ctttgataatgattatcaggcctgcaaattcctacaaagtcctgcaagctatcgtttagaagaacaccaagggac

SEQ ID NO: 38280 - DNA, 75 bp, Artificial Sequence
  Synthetic
gtgagctgtttaatttagagttaaattttattatattaggggttcaggggtggggtttaataacagcatctgcat

SEQ ID NO: 38281 - DNA, 75 bp, Artificial Sequence
  Synthetic
ttttattatattaggggttcaggggtggggtttaataacagcatctgcatattttacaaaaattatttatacttg

SEQ ID NO: 38282 - DNA, 75 bp, Artificial Sequence
  Synthetic
atattgggcagcataaagatgaaagccatattaggtgatgtaaaatataaaaattatcaaagcaatatagaaatc

SEQ ID NO: 38283 - DNA, 75 bp, Artificial Sequence
  Synthetic
tactgttcgcagtcagtgctgcaagtccagtatatcagcgatgtttccaggatggggctatagtgaagcaaaacc

SEQ ID NO: 38284 - DNA, 75 bp, Artificial Sequence
  Synthetic
tccagtatatcagcgatgtttccaggatggggctatagtgaagcaaaacccatccaaggaagctgtcacagaggt

SEQ ID NO: 38285 - DNA, 75 bp, Artificial Sequence
  Synthetic
ccatattaggtgatgtaaaatataaaaattatcaaagcaatatagaaatcaatgcagaaggaacttgtgctggat

SEQ ID NO: 38286 - DNA, 75 bp, Artificial Sequence
  Synthetic
aagccaaagatgattttcatattaatactgttcgcagtcagtgctgcaagtccagtatatcagcgatgtttccag

SEQ ID NO: 38287 - DNA, 75 bp, Artificial Sequence
  Synthetic
ttgtgaatttactatacatactacagttgaaacaagttgtcctatagtaacagattgtgtatcatttcatgatag

SEQ ID NO: 38288 - DNA, 75 bp, Artificial Sequence
  Synthetic
ataaaaacagaagctaggtatacaaaaaatgccacagggactttctctaacaatgtagcaatcaggaaatggttg

SEQ ID NO: 38289 - DNA, 75 bp, Artificial Sequence
  Synthetic
aaaatgccacagggactttctctaacaatgtagcaatcaggaaatggttggtctcagattggcatgattgcagac

SEQ ID NO: 38290 - DNA, 75 bp, Artificial Sequence
  Synthetic
gttgaaacaagttgtcctatagtaacagattgtgtatcatttcatgataggatactgatcactccagatgagcac

SEQ ID NO: 38291 - DNA, 75 bp, Artificial Sequence
  Synthetic
aagataaacctaaagtgtctctaaaattcaaaatttgcaacacaaatattgatgcttctatgacaatagtggact

SEQ ID NO: 38292 - DNA, 75 bp, Artificial Sequence
  Synthetic
caatgtaatagaagtcggtgatgatctttcactccacactgagtcttatgtctgtagtgctgactgcactattgg

SEQ ID NO: 38293 - DNA, 75 bp, Artificial Sequence
  Synthetic
ctttcactccacactgagtcttatgtctgtagtgctgactgcactattggagtggataaggaaactgcacagatt

SEQ ID NO: 38294 - DNA, 75 bp, Artificial Sequence
  Synthetic
attcaaaatttgcaacacaaatattgatgcttctatgacaatagtggactcaaaaccaattttagaacttgcacc

SEQ ID NO: 38295 - DNA, 75 bp, Artificial Sequence
  Synthetic
gaaaaagatgaaagatgtaaaacttggatgtgcagagtgagagatgaaggcttccaagttatattagaaccattc

SEQ ID NO: 38296 - DNA, 75 bp, Artificial Sequence
  Synthetic
acttcgagatagcaggcacgacagttaaatcaggatggtttaagagcacgacgtacataaccctagatcaaacat

SEQ ID NO: 38297 - DNA, 75 bp, Artificial Sequence
  Synthetic
taaatcaggatggtttaagagcacgacgtacataaccctagatcaaacatgtgagcacttaaaagtctcttgcgg

SEQ ID NO: 38298 - DNA, 75 bp, Artificial Sequence
  Synthetic
ggatgtgcagagtgagagatgaaggcttccaagttatattagaaccattcaagaatctgtttggttcttacatcg

SEQ ID NO: 38299 - DNA, 75 bp, Artificial Sequence
  Synthetic
agttatatgccttctcatcgtcatttatattgtattacccatttgctttaaattgagggatactttaaagcaaca

SEQ ID NO: 38300 - DNA, 75 bp, Artificial Sequence
  Synthetic
tgcttcaatcaacatatgtcttgtgtcagattcttgcatagaacagttctgcccgggtccattgcgaattcaata

SEQ ID NO: 38301 - DNA, 75 bp, Artificial Sequence
  Synthetic
tcagattcttgcatagaacagttctgcccgggtccattgcgaattcaatatgccagaatatagaaataataattc

SEQ ID NO: 38302 - DNA, 75 bp, Artificial Sequence
  Synthetic
tatattgtattacccatttgctttaaattgagggatactttaaagcaacatgaagatgcttataagaaggaaatg

SEQ ID NO: 38303 - DNA, 75 bp, Artificial Sequence
  Synthetic
ctatagtggtaacacagtttatatatttttgggttttataggggtggggtcaaacaaaactgctgagtttatttt

SEQ ID NO: 38304 - DNA, 75 bp, Artificial Sequence
  Synthetic
tgtactcttaagtatattaagtaagacgtatatctgttacttgctgatgcctatttttatccctatagcatatgt

SEQ ID NO: 38305 - DNA, 75 bp, Artificial Sequence
  Synthetic
tttttgggttttataggggtggggtcaaacaaaactgctgagtttattttggaaacatttagatatacttggtag

SEQ ID NO: 38306 - DNA, 75 bp, Artificial Sequence
  Synthetic
acgtatatctgttacttgctgatgcctatttttatccctatagcatatgtatacggtattatttacaataaatct

SEQ ID NO: 38307 - DNA, 75 bp, Artificial Sequence
  Synthetic
tagtttaccatccattcacagaatgtggaacacattgtgtgtgtggcgcccgctacgatacttctgacaggatga

SEQ ID NO: 38308 - DNA, 75 bp, Artificial Sequence
  Synthetic
tggaacacattgtgtgtgtggcgcccgctacgatacttctgacaggatgaagttacacagatcttctggcctgtg

SEQ ID NO: 38309 - DNA, 75 bp, Artificial Sequence
  Synthetic
gccagagttatgtgtaagtcaaaagggcctgcatcagtactgtcaataatcacagcaatattagttctaactttt

SEQ ID NO: 38310 - DNA, 75 bp, Artificial Sequence
  Synthetic
ggcctgcatcagtactgtcaataatcacagcaatattagttctaacttttgtcacaccaataaattcaatggttg

SEQ ID NO: 38311 - DNA, 75 bp, Artificial Sequence
  Synthetic
actagaagagctcccagatgatatgctagaaatggcattgaagataaacttctactacttcatttgcgtcatgaa

SEQ ID NO: 38312 - DNA, 75 bp, Artificial Sequence
  Synthetic
ctagaaatggcattgaagataaacttctactacttcatttgcgtcatgaattatgctgtgacttggggcctcata

SEQ ID NO: 38313 - DNA, 75 bp, Artificial Sequence
  Synthetic
tattcaaaaagtaccagcacagattcttaaacctttatgctatgtactgtgaagaatgtgacatgtatcacgata

SEQ ID NO: 38314 - DNA, 75 bp, Artificial Sequence
  Synthetic
cttaaacctttatgctatgtactgtgaagaatgtgacatgtatcacgatagaactggcttaaagaggaatggaga

SEQ ID NO: 38315 - DNA, 75 bp, Artificial Sequence
  Synthetic
acgtgcggacagtatgaagatgccactgggcttataacacacaggaaaacatacaattgccttgtacagtataaa

SEQ ID NO: 38316 - DNA, 75 bp, Artificial Sequence
  Synthetic
ctgggcttataacacacaggaaaacatacaattgccttgtacagtataaatccaaatggatcttgaatttcttaa

SEQ ID NO: 38317 - DNA, 75 bp, Artificial Sequence
  Synthetic
taaagattcagctataattgtacaggctactggtacagattttatctcttgtctagaaacgcaaagtgtaaattg

SEQ ID NO: 38318 - DNA, 75 bp, Artificial Sequence
  Synthetic
gctactggtacagattttatctcttgtctagaaacgcaaagtgtaaattggaattgcacaggaccatttttgaac

SEQ ID NO: 38319 - DNA, 75 bp, Artificial Sequence
  Synthetic
aaaaggagccatatgcaaatattgcgacacagctcaaaggcttacaagcaatctcagttcttgacatacccatga

SEQ ID NO: 38320 - DNA, 75 bp, Artificial Sequence
  Synthetic
gacacagctcaaaggcttacaagcaatctcagttcttgacatacccatgatagcaaacataccggaagatatagc

SEQ ID NO: 38321 - DNA, 75 bp, Artificial Sequence
  Synthetic
agtagtgtactccacttgaatactttgagaatatattgaaataaacccctatagaaggaatacctggttgatatg

SEQ ID NO: 38322 - DNA, 75 bp, Artificial Sequence
  Synthetic
aaggaaacttttcatgtccaattgactgcagaatatgctatgctgaccagatattgtgattattatactcaattt

SEQ ID NO: 38323 - DNA, 75 bp, Artificial Sequence
  Synthetic
ctgcagaatatgctatgctgaccagatattgtgattattatactcaatttgcagacaactcaggctacagtcaaa

SEQ ID NO: 38324 - DNA, 75 bp, Artificial Sequence
  Synthetic
acatgattttgatgcttgcatattgtacccgaaccagcatttttgccgatgtgtcaagcatggagataagtgcag

SEQ ID NO: 38325 - DNA, 75 bp, Artificial Sequence
  Synthetic
tacccgaaccagcatttttgccgatgtgtcaagcatggagataagtgcagtagctccaactgggattttgcaaat

SEQ ID NO: 38326 - DNA, 75 bp, Artificial Sequence
  Synthetic
aacagagtaaatttgacaaagatttgaacttggcattgatgacaatgcaccatgcattcagagggacatcatctg

SEQ ID NO: 38327 - DNA, 75 bp, Artificial Sequence
  Synthetic
tagataacgtttaaatactaaagttcttaattgaagccaaagatgatttgcatattgatactgtttgcagtcaca

SEQ ID NO: 38328 - DNA, 75 bp, Artificial Sequence
  Synthetic
gaacttggcattgatgacaatgcaccatgcattcagagggacatcatctgcatatattgcaacattgctgtcaaa

SEQ ID NO: 38329 - DNA, 75 bp, Artificial Sequence
  Synthetic
tatacaaacaagataaaggagaaattccctggaaatgccctattgaaggccatgatggactatatatcatatatg

SEQ ID NO: 38330 - DNA, 75 bp, Artificial Sequence
  Synthetic
tccctggaaatgccctattgaaggccatgatggactatatatcatatatgaagagcttatctgaaatggcaaatt

SEQ ID NO: 38331 - DNA, 75 bp, Artificial Sequence
  Synthetic
tcttttgcacaaacctgatcctacaaaagcacccctcctctcaagaggcagtgagccagtgtataacttcaaatt

SEQ ID NO: 38332 - DNA, 75 bp, Artificial Sequence
  Synthetic
aaagcacccctcctctcaagaggcagtgagccagtgtataacttcaaattagtcgtctcttcaaggtctgtgaaa

SEQ ID NO: 38333 - DNA, 75 bp, Artificial Sequence
  Synthetic
tgtgtttgtcgcctaggtctggggtatcatatgattcagtcttggcatgtggcgaaccaaatggtccgagtgtgt

SEQ ID NO: 38334 - DNA, 75 bp, Artificial Sequence
  Synthetic
atcatatgattcagtcttggcatgtggcgaaccaaatggtccgagtgtgtacaggaagccatctgatggcgtgtt

SEQ ID NO: 38335 - DNA, 75 bp, Artificial Sequence
  Synthetic
tattgcttggccgacagccattgcttagaagattttgaagtaattagtcaagaagagttagatgcaataaaaaag

SEQ ID NO: 38336 - DNA, 75 bp, Artificial Sequence
  Synthetic
tagaagattttgaagtaattagtcaagaagagttagatgcaataaaaaagtccgagtgttgggtaattgaatacc

SEQ ID NO: 38337 - DNA, 75 bp, Artificial Sequence
  Synthetic
cgatgggatcaaaagctgcagaatgaaagattcagggaaatgcaatgttgcaactaacagatggccgataataca

SEQ ID NO: 38338 - DNA, 75 bp, Artificial Sequence
  Synthetic
aaagattcagggaaatgcaatgttgcaactaacagatggccgataatacaatgcgaaaacaacaatttttactac

SEQ ID NO: 38339 - DNA, 75 bp, Artificial Sequence
  Synthetic
aaacacaagacattggacacttttgtcttagcccagggtgctctacaatccggtacccaatcaatcagaagcata

SEQ ID NO: 38340 - DNA, 75 bp, Artificial Sequence
  Synthetic
tcttagcccagggtgctctacaatccggtacccaatcaatcagaagcatatatccaattgcaactggcaggttag

SEQ ID NO: 38341 - DNA, 75 bp, Artificial Sequence
  Synthetic
gtgcataatattgaagacatcgagcagtatagaaaagctataactcagaagctccaaactagcctctccctattc

SEQ ID NO: 38342 - DNA, 75 bp, Artificial Sequence
  Synthetic
agtatagaaaagctataactcagaagctccaaactagcctctccctattcaagtatgctaagactaagaatctac

SEQ ID NO: 38343 - DNA, 75 bp, Artificial Sequence
  Synthetic
tataactatcgaaggaactgaaactgccgaaggcatagaaagtgcatatatagaatctgaaatacctgcattggc

SEQ ID NO: 38344 - DNA, 75 bp, Artificial Sequence
  Synthetic
gccgaaggcatagaaagtgcatatatagaatctgaaatacctgcattggctgggacctcaattggcttcaaaatc

SEQ ID NO: 38345 - DNA, 75 bp, Artificial Sequence
  Synthetic
tagatgttattggttatgttaagagtgcatcatattcatctgtatacagcaagctctattcaacaggtccaacat

SEQ ID NO: 38346 - DNA, 75 bp, Artificial Sequence
  Synthetic
tgcatcatattcatctgtatacagcaagctctattcaacaggtccaacatcaggtataaacacaaagcatgatga

SEQ ID NO: 38347 - DNA, 75 bp, Artificial Sequence
  Synthetic
aatataaaacaccaaactggatggttaacctttgcaagagaaagaacaagctcatggggttgtgaagaatttggc

SEQ ID NO: 38348 - DNA, 75 bp, Artificial Sequence
  Synthetic
taacctttgcaagagaaagaacaagctcatggggttgtgaagaatttggctgtctcgctatcagtgatgggtgtg

SEQ ID NO: 38349 - DNA, 75 bp, Artificial Sequence
  Synthetic
gaaagatgagttatcagtgtataggaaggaaacagaagaggtgaccgatgttgagttgtgcctaactttctcaga

SEQ ID NO: 38350 - DNA, 75 bp, Artificial Sequence
  Synthetic
aaggaaacagaagaggtgaccgatgttgagttgtgcctaactttctcagataaaacttattgcacaaatctaaac

SEQ ID NO: 38351 - DNA, 75 bp, Artificial Sequence
  Synthetic
tattcgaagtacaatttaaaactgtggaaacctacagtctaccaagaattgtagctatccaaaatcacgaaataa

SEQ ID NO: 38352 - DNA, 75 bp, Artificial Sequence
  Synthetic
ggaaacctacagtctaccaagaattgtagctatccaaaatcacgaaataaagattgggcagataaatgatttagg

SEQ ID NO: 38353 - DNA, 75 bp, Artificial Sequence
  Synthetic
gttcagaaagtgaatgggacagtttatggcaatggggtaccaaaattcgattatttatgccatctagctagcagg

SEQ ID NO: 38354 - DNA, 75 bp, Artificial Sequence
  Synthetic
atggcaatggggtaccaaaattcgattatttatgccatctagctagcaggaaagaagttattgtaaggaaatgtt

SEQ ID NO: 38355 - DNA, 75 bp, Artificial Sequence
  Synthetic
gttcttacaaacaccggcaagttacagattggaagaaaatagtggtgcaataactgtgattgactacaaaaagat

SEQ ID NO: 38356 - DNA, 75 bp, Artificial Sequence
  Synthetic
agattggaagaaaatagtggtgcaataactgtgattgactacaaaaagatactgggaacaattaaaatgaaagcc

SEQ ID NO: 38357 - DNA, 75 bp, Artificial Sequence
  Synthetic
catttgcagataatgtagacataactgctgaggggtcatgcactggatgcataaattgctttgaaaatattcatt

SEQ ID NO: 38358 - DNA, 75 bp, Artificial Sequence
  Synthetic
tgctgaggggtcatgcactggatgcataaattgctttgaaaatattcattgcgaattgacaatacataccactat

SEQ ID NO: 38359 - DNA, 75 bp, Artificial Sequence
  Synthetic
ccatgcacagtgttccatgatagaatattagtaaccccaaacgaacacaaatatgcaatgaaagttgtctgcacc

SEQ ID NO: 38360 - DNA, 75 bp, Artificial Sequence
  Synthetic
tattagtaaccccaaacgaacacaaatatgcaatgaaagttgtctgcaccgaaaagccaggtagcacactagtaa

SEQ ID NO: 38361 - DNA, 75 bp, Artificial Sequence
  Synthetic
tgcttcattggccctcattgatgctaagccaatactagaattggcgccggtcgaccagacagcttacatcagaga

SEQ ID NO: 38362 - DNA, 75 bp, Artificial Sequence
  Synthetic
aagccaatactagaattggcgccggtcgaccagacagcttacatcagagaaaaagatgagagatgtaagacctgg

SEQ ID NO: 38363 - DNA, 75 bp, Artificial Sequence
  Synthetic
tgcaggttattttggagccttttaagaatttgtttggctcttatatagggatattttataccttcattatttcta

SEQ ID NO: 38364 - DNA, 75 bp, Artificial Sequence
  Synthetic
gaatttgtttggctcttatatagggatattttataccttcattatttctataattgtattactaattgtcatcta

SEQ ID NO: 38365 - DNA, 75 bp, Artificial Sequence
  Synthetic
ctgagggacactcttagaaagcatgaagatgcctacaagagagaaatgaaaattaggtagaagagcttagctagt

SEQ ID NO: 38366 - DNA, 75 bp, Artificial Sequence
  Synthetic
taaagttaggcctttagttaagtggtcaatttgtagttttattatcataaggtggggggtggggaactaacaaca

SEQ ID NO: 38367 - DNA, 75 bp, Artificial Sequence
  Synthetic
agaggaaggctagtcctaaatttggagagtggcaggtggaggttgtcaataatcattttcctggaaacaggaaca

SEQ ID NO: 38368 - DNA, 75 bp, Artificial Sequence
  Synthetic
aatcattttcctggaaacaggaacaacccaattgataacaacgatcttaccatccaccggctgtcagggtatttg

SEQ ID NO: 38369 - DNA, 75 bp, Artificial Sequence
  Synthetic
gaaatgttcctggagacattcaatttttacccgctgacaattggcatttacagagtcaagcaaggaatgatggac

SEQ ID NO: 38370 - DNA, 75 bp, Artificial Sequence
  Synthetic
ggcagcgctacggctctcttactgcagacaagtggatgtcgcagaagactactgccatagccaagagcctgaagg

SEQ ID NO: 38371 - DNA, 75 bp, Artificial Sequence
  Synthetic
tctcagacaactcaggatacagtcagacaacatggagggtgtacttaaggtctcatgattttgaggcatgtatac

SEQ ID NO: 38372 - DNA, 75 bp, Artificial Sequence
  Synthetic
attaggtaagagggtgcagggggctagatttaagcctttaattaagtaatttgtttgtagttttcattatcgtaa

SEQ ID NO: 38373 - DNA, 75 bp, Artificial Sequence
  Synthetic
tatataactatagaaggaacagaaactgcagaaggtatagagagtgcatacattgaatcagaagtgcctgcattg

SEQ ID NO: 38374 - DNA, 75 bp, Artificial Sequence
  Synthetic
ggagagtggcaggtggaggttgtcaataatcattttcctggaaacaggaacaacccaattggtaacaacgatctt

SEQ ID NO: 38375 - DNA, 75 bp, Artificial Sequence
  Synthetic
tccatatctagagctataaggctagataaagagaggtgccaaagaattgtttcctcacctgggctgtttttaaca

SEQ ID NO: 38376 - DNA, 75 bp, Artificial Sequence
  Synthetic
ccatagctgcgcaatgtctgtgtataaagaaatattaaaagaggctataacattactggacgggtctatattagt

SEQ ID NO: 38377 - DNA, 75 bp, Artificial Sequence
  Synthetic
tcaaatgacccaattgattatttcccagcagagaataggaaggatatccctatagaattgaatggtgtattagat

SEQ ID NO: 38378 - DNA, 75 bp, Artificial Sequence
  Synthetic
agtagtgtactccacttgaatactttgagcatacgttgaaataaattgaattacacaaagaaatactctgagtgt

SEQ ID NO: 38379 - DNA, 75 bp, Artificial Sequence
  Synthetic
tgagcatacgttgaaataaattgaattacacaaagaaatactctgagtgtaatgtctgaattggttttctatgat

SEQ ID NO: 38380 - DNA, 75 bp, Artificial Sequence
  Synthetic
ttacacaaagaaatactctgagtgtaatgtctgaattggttttctatgatgtcgcatcaaccggtgcaaatggat

SEQ ID NO: 38381 - DNA, 75 bp, Artificial Sequence
  Synthetic
attctgtgttaaacatggggagtcgatcagtttgtcttcagttaggatcttcttcctcaatgccgcaaaagccaa

SEQ ID NO: 38382 - DNA, 75 bp, Artificial Sequence
  Synthetic
atcagtttgtcttcagttaggatcttcttcctcaatgccgcaaaagccaaagctgctctctcgcgtaaaccagag

SEQ ID NO: 38383 - DNA, 75 bp, Artificial Sequence
  Synthetic
agtggcaggtggagattgtcaataatcattttcctggaaacaggaacaatccaattgacaacctcgatcttacca

SEQ ID NO: 38384 - DNA, 75 bp, Artificial Sequence
  Synthetic
tcattttcctggaaacaggaacaatccaattgacaacctcgatcttaccatccacagattgtctggatacctggc

SEQ ID NO: 38385 - DNA, 75 bp, Artificial Sequence
  Synthetic
gagaatgaggatgaatcgcagagagagctgatcaagacgacagtcataaatcctattgcagaatcaaatgggata

SEQ ID NO: 38386 - DNA, 75 bp, Artificial Sequence
  Synthetic
agctgatcaagacgacagtcataaatcctattgcagaatcaaatgggataaaatgggaaaatggggcagaaatat

SEQ ID NO: 38387 - DNA, 75 bp, Artificial Sequence
  Synthetic
gatgtttttggaaattttcaaattttacccgttgacaattgggatctacagagtaaagcagggaatgatggaccc

SEQ ID NO: 38388 - DNA, 75 bp, Artificial Sequence
  Synthetic
tacccgttgacaattgggatctacagagtaaagcagggaatgatggaccctcagtatttgaaaaaagctcttcgg

SEQ ID NO: 38389 - DNA, 75 bp, Artificial Sequence
  Synthetic
acaaatggatgtcccaaaaggttggtgcaattgctaaaagcttgaaggatattgagcagcttaagtggggcaaag

SEQ ID NO: 38390 - DNA, 75 bp, Artificial Sequence
  Synthetic
tgcaattgctaaaagcttgaaggatattgagcagcttaagtggggcaaaggagggctcagtgatactgccagaac

SEQ ID NO: 38391 - DNA, 75 bp, Artificial Sequence
  Synthetic
ttgccctaaaaaactaatgactttaaaattcggttcaaaattctaaacatttatatatgggtaattaggcttaat

SEQ ID NO: 38392 - DNA, 75 bp, Artificial Sequence
  Synthetic
acccacaacattagcagctaattgggtgggtggtaggggacagcaaagtaatagactcaagtcattaataatata

SEQ ID NO: 38393 - DNA, 75 bp, Artificial Sequence
  Synthetic
gtgggtggtaggggacagcaaagtaatagactcaagtcattaataatataaaatgtattcagtggagcacactac

SEQ ID NO: 38394 - DNA, 75 bp, Artificial Sequence
  Synthetic
atatacggtataatttacaataagtcgtgcaaaaaatgcaaactatgcggcctagtgtatcatccattcacagag

SEQ ID NO: 38395 - DNA, 75 bp, Artificial Sequence
  Synthetic
ttgtaacaccaatcaactctatggttttaggagaaagtaaagaaacgtttgagcttgaagagcttccagatgaca

SEQ ID NO: 38396 - DNA, 75 bp, Artificial Sequence
  Synthetic
agttaagagatacccttagaaagcatgaagatgcatataagagagagatgaagattagatagggggtacatgtag

SEQ ID NO: 38397 - DNA, 75 bp, Artificial Sequence
  Synthetic
agtagtgtactaccaagtatagataacgtttaaaagttgaagtcagttcacaagtttcaagatgatacttgtttt

SEQ ID NO: 38398 - DNA, 75 bp, Artificial Sequence
  Synthetic
acgtttaaaagttgaagtcagttcacaagtttcaagatgatacttgttttgtttttcgttgcactaagtgctgca

SEQ ID NO: 38399 - DNA, 75 bp, Artificial Sequence
  Synthetic
caagtttcaagatgatacttgttttgtttttcgttgcactaagtgctgcagggccagtttatcagagatgtttcc

SEQ ID NO: 38400 - DNA, 75 bp, Artificial Sequence
  Synthetic
cccatccaaacaagctgtgacagaagtatgcttaaaggatgatgtcagcatgataaaaacagaggcaagatactt

SEQ ID NO: 38401 - DNA, 75 bp, Artificial Sequence
  Synthetic
gtatgcttaaaggatgatgtcagcatgataaaaacagaggcaagatacttcaagaataccaccgggatttatgct

SEQ ID NO: 38402 - DNA, 75 bp, Artificial Sequence
  Synthetic
ttgttgcagactggcatgattgtagaccaaaaaaagtctcaggggggcatataaatgttatagaggtgggagatg

SEQ ID NO: 38403 - DNA, 75 bp, Artificial Sequence
  Synthetic
accaaaaaaagtctcaggggggcatataaatgttatagaggtgggagatgacctaacactgcatacagaggctta

SEQ ID NO: 38404 - DNA, 75 bp, Artificial Sequence
  Synthetic
ggtgtagacaaagagactgcacaagtaagattgcaaactgatacaacaaatcactttgaaattgcaggaactaca

SEQ ID NO: 38405 - DNA, 75 bp, Artificial Sequence
  Synthetic
taagattgcaaactgatacaacaaatcactttgaaattgcaggaactacagtcaaatcagggtggtttaagagca

SEQ ID NO: 38406 - DNA, 75 bp, Artificial Sequence
  Synthetic
ttgcgaacatttgaaagtctcctgtggacctaaatctatccaattccatgcatgtttcaatcagcatatgtcttg

SEQ ID NO: 38407 - DNA, 75 bp, Artificial Sequence
  Synthetic
ggacctaaatctatccaattccatgcatgtttcaatcagcatatgtcttgtgttagatttctacatagaacaata

SEQ ID NO: 38408 - DNA, 75 bp, Artificial Sequence
  Synthetic
tatgccagaatatagaaataataattttaacagtactaaccttacttatctttacattactaagtatattaagca

SEQ ID NO: 38409 - DNA, 75 bp, Artificial Sequence
  Synthetic
tttaacagtactaaccttacttatctttacattactaagtatattaagcaaaacatatatatgctatatactcat

SEQ ID NO: 38410 - DNA, 75 bp, Artificial Sequence
  Synthetic
atatatggattaatatataataaatcctgcaaaaagtgtaagctatgtggcctagtataccatccctttacagag

SEQ ID NO: 38411 - DNA, 75 bp, Artificial Sequence
  Synthetic
cctgcaaaaagtgtaagctatgtggcctagtataccatccctttacagagtgtggcactcattgtgtatgcggtg

SEQ ID NO: 38412 - DNA, 75 bp, Artificial Sequence
  Synthetic
gaaactgcacagagcttcaggactatgcccagggtataagagtcttagagctgcaagagtcatgtgtaaatccaa

SEQ ID NO: 38413 - DNA, 75 bp, Artificial Sequence
  Synthetic
tgcccagggtataagagtcttagagctgcaagagtcatgtgtaaatccaaaggcccagcttctgttttatccatt

SEQ ID NO: 38414 - DNA, 75 bp, Artificial Sequence
  Synthetic
ttatcacccctataaatgctatgatagctggagagacgcaagagacttttaaactagaagatttgccagatgata

SEQ ID NO: 38415 - DNA, 75 bp, Artificial Sequence
  Synthetic
agctggagagacgcaagagacttttaaactagaagatttgccagatgatatgttaagtatggcaatgaagataaa

SEQ ID NO: 38416 - DNA, 75 bp, Artificial Sequence
  Synthetic
aattatgttgccacatggtcattcattttctgtgccttaataatagccttaattttcaaaaaatatcaacataag

SEQ ID NO: 38417 - DNA, 75 bp, Artificial Sequence
  Synthetic
ttttctgtgccttaataatagccttaattttcaaaaaatatcaacataagtttctaagctattacgctatgtact

SEQ ID NO: 38418 - DNA, 75 bp, Artificial Sequence
  Synthetic
caggtcaggtctaaaatataacgggggtttcacaaataaatgtaggcaatgcacatgtggacaatatgaggatgc

SEQ ID NO: 38419 - DNA, 75 bp, Artificial Sequence
  Synthetic
ggtttcacaaataaatgtaggcaatgcacatgtggacaatatgaggatgctacaggcttgatggctcataggaaa

SEQ ID NO: 38420 - DNA, 75 bp, Artificial Sequence
  Synthetic
aatcaaaatggttagttaacttcttaattacatatataattctcatgctcatcaaagattctgtattgatagtgc

SEQ ID NO: 38421 - DNA, 75 bp, Artificial Sequence
  Synthetic
aattacatatataattctcatgctcatcaaagattctgtattgatagtgcatgctgagggcacagactttgaaaa

SEQ ID NO: 38422 - DNA, 75 bp, Artificial Sequence
  Synthetic
tggaattgtacagggccatttcttagcttaggcaattgcgaaaagaagcagaaaaaggagtcatacaatgatata

SEQ ID NO: 38423 - DNA, 75 bp, Artificial Sequence
  Synthetic
gcttaggcaattgcgaaaagaagcagaaaaaggagtcatacaatgatatagcggcccagttaaaaggtctagatg

SEQ ID NO: 38424 - DNA, 75 bp, Artificial Sequence
  Synthetic
gatttcgaagatacctgaagatatagctggggcattgagattcatagaggaacagaattcgtaccatgttcagct

SEQ ID NO: 38425 - DNA, 75 bp, Artificial Sequence
  Synthetic
gctggggcattgagattcatagaggaacagaattcgtaccatgttcagctgactgttgagtatgctatgttgact

SEQ ID NO: 38426 - DNA, 75 bp, Artificial Sequence
  Synthetic
ttagtgacaactctggttatagtcagacaacatggagaacatacttgaggtcacatgattttgaggcatgtatat

SEQ ID NO: 38427 - DNA, 75 bp, Artificial Sequence
  Synthetic
gacaacatggagaacatacttgaggtcacatgattttgaggcatgtatattatatccaaatcagcatttttgtag

SEQ ID NO: 38428 - DNA, 75 bp, Artificial Sequence
  Synthetic
tcaagatccaactgggattttgctaatgagatgaagaattattatagtggtaagcagtcgaagtataataaagat

SEQ ID NO: 38429 - DNA, 75 bp, Artificial Sequence
  Synthetic
atgagatgaagaattattatagtggtaagcagtcgaagtataataaagatctaaatttagcattaatgtcattcc

SEQ ID NO: 38430 - DNA, 75 bp, Artificial Sequence
  Synthetic
cttctatactgcaaaacttttaagagaaaagaaaactgaagaacttaaaaactacattgacaaaattagaactga

SEQ ID NO: 38431 - DNA, 75 bp, Artificial Sequence
  Synthetic
gaaaagaaaactgaagaacttaaaaactacattgacaaaattagaactgagtaccctggtaatgcattattaaag

SEQ ID NO: 38432 - DNA, 75 bp, Artificial Sequence
  Synthetic
tgatgggtttgactgaagtaagtaacttcaaacatgacgaaatgtgggatgactttatttttgaaaatccttcaa

SEQ ID NO: 38433 - DNA, 75 bp, Artificial Sequence
  Synthetic
cttcaaacatgacgaaatgtgggatgactttatttttgaaaatccttcaacaagaagttcattgtcaaggaattc

SEQ ID NO: 38434 - DNA, 75 bp, Artificial Sequence
  Synthetic
aatataaattcagatccaacaaatacatgtaaaaacattaaggctgttacatgtttatcaccgaaatcaggagta

SEQ ID NO: 38435 - DNA, 75 bp, Artificial Sequence
  Synthetic
catgtaaaaacattaaggctgttacatgtttatcaccgaaatcaggagtatcatttgattcagtgattgcttgtg

SEQ ID NO: 38436 - DNA, 75 bp, Artificial Sequence
  Synthetic
ccaaaaaccaaggaaacaagtataccagtctaattctgagcaaacgcatttttgtcttctagacacacattgctt

SEQ ID NO: 38437 - DNA, 75 bp, Artificial Sequence
  Synthetic
cagtctaattctgagcaaacgcatttttgtcttctagacacacattgcttggaaggctatgagacagtgggagaa

SEQ ID NO: 38438 - DNA, 75 bp, Artificial Sequence
  Synthetic
caaaatgctgggagacagactttacagaatatatccaattcaaacaaagcgatggtgtaagaagttgtaggatga

SEQ ID NO: 38439 - DNA, 75 bp, Artificial Sequence
  Synthetic
agaatatatccaattcaaacaaagcgatggtgtaagaagttgtaggatgaaagattcaggggaatgcacagtaac

SEQ ID NO: 38440 - DNA, 75 bp, Artificial Sequence
  Synthetic
tgtgaaaacaacagatattattattctgagctacataaagattacgataaagatcaagatataggccatttttgc

SEQ ID NO: 38441 - DNA, 75 bp, Artificial Sequence
  Synthetic
ctgagctacataaagattacgataaagatcaagatataggccatttttgcctcagtcctagatgcaacaccatta

SEQ ID NO: 38442 - DNA, 75 bp, Artificial Sequence
  Synthetic
ctctaattgtacatggcaagttaggcacaacaatatagataaaattgaggtacatgaattagaagatctagagca

SEQ ID NO: 38443 - DNA, 75 bp, Artificial Sequence
  Synthetic
cacaacaatatagataaaattgaggtacatgaattagaagatctagagcaatataggaaagctattacgcaaaaa

SEQ ID NO: 38444 - DNA, 75 bp, Artificial Sequence
  Synthetic
agtactctagaacaaagaacttaccccatatcaaacctatttacaagtatataactatagaaggaacagagactg

SEQ ID NO: 38445 - DNA, 75 bp, Artificial Sequence
  Synthetic
ccatatcaaacctatttacaagtatataactatagaaggaacagagactgctgaaggaatcgaaagtgcttatat

SEQ ID NO: 38446 - DNA, 75 bp, Artificial Sequence
  Synthetic
ggaacatcgataggattcaaaataacatctaaatctgggaaacatttactagatgttattagttatgtcaaaagc

SEQ ID NO: 38447 - DNA, 75 bp, Artificial Sequence
  Synthetic
catctaaatctgggaaacatttactagatgttattagttatgtcaaaagcgcgtcttattcagctgtctatacaa

SEQ ID NO: 38448 - DNA, 75 bp, Artificial Sequence
  Synthetic
aggagtaaatacgaaacacgatgaactgtgcacaggatcatgccctgtcaatgtacctcataatacaggctggct

SEQ ID NO: 38449 - DNA, 75 bp, Artificial Sequence
  Synthetic
ctgtgcacaggatcatgccctgtcaatgtacctcataatacaggctggctcacatttgctagagaaagaacaagc

SEQ ID NO: 38450 - DNA, 75 bp, Artificial Sequence
  Synthetic
gcttagcaattagtgatgggtgtgtttttggttcttgccaagacatcataaaggacgagctgactgtctataggg

SEQ ID NO: 38451 - DNA, 75 bp, Artificial Sequence
  Synthetic
ttttggttcttgccaagacatcataaaggacgagctgactgtctatagggaagaaactgaggaaaccacaaatgt

SEQ ID NO: 38452 - DNA, 75 bp, Artificial Sequence
  Synthetic
aaaacgtattgcactaatctcaatgccataactcccataataactgatcaatttgaagtccaatttaaaacagta

SEQ ID NO: 38453 - DNA, 75 bp, Artificial Sequence
  Synthetic
ccataactcccataataactgatcaatttgaagtccaatttaaaacagtagaagcatatagcttgcctagaatta

SEQ ID NO: 38454 - DNA, 75 bp, Artificial Sequence
  Synthetic
ggtaggacaaataaatgatataggtgtttattcaaaaggctgtgggaatgtacaaaaaataaataatacgaatta

SEQ ID NO: 38455 - DNA, 75 bp, Artificial Sequence
  Synthetic
gtttattcaaaaggctgtgggaatgtacaaaaaataaataatacgaattatgggaatggtgtgcctaaatttgac

SEQ ID NO: 38456 - DNA, 75 bp, Artificial Sequence
  Synthetic
aggaagtaatcattaggaaatgctttgacaacgattatcaagcttgtaagttcttacagacgcctgcaagctata

SEQ ID NO: 38457 - DNA, 75 bp, Artificial Sequence
  Synthetic
tgacaacgattatcaagcttgtaagttcttacagacgcctgcaagctataggctagaagaggaaggaggctcagt

SEQ ID NO: 38458 - DNA, 75 bp, Artificial Sequence
  Synthetic
cttggcactataaaaatgaaggctatcttaggagatgtcaaatacaaaacatttgctgacaatgtagatataaca

SEQ ID NO: 38459 - DNA, 75 bp, Artificial Sequence
  Synthetic
tcttaggagatgtcaaatacaaaacatttgctgacaatgtagatataacagtagagggtgcttgcacaggatgta

SEQ ID NO: 38460 - DNA, 75 bp, Artificial Sequence
  Synthetic
tgagttgacaatacatagtactgtagaagctagctgcccaataacaagctcgtgtacagtattccacgatagaat

SEQ ID NO: 38461 - DNA, 75 bp, Artificial Sequence
  Synthetic
gaagctagctgcccaataacaagctcgtgtacagtattccacgatagaatattaataacaccgaatgagcacaaa

SEQ ID NO: 38462 - DNA, 75 bp, Artificial Sequence
  Synthetic
gaaagcccgggatatcgctaccattcaaaatttgcaacacaaaagtcgatgctgccatgactttaacagatgcaa

SEQ ID NO: 38463 - DNA, 75 bp, Artificial Sequence
  Synthetic
caaaatttgcaacacaaaagtcgatgctgccatgactttaacagatgcaaagcagatattagaactagctcctgt

SEQ ID NO: 38464 - DNA, 75 bp, Artificial Sequence
  Synthetic
aaagatgaaaggtgcaaaacttggatgtgcagggttagggatgaaggccttcaagttatatttgaaccatttaaa

SEQ ID NO: 38465 - DNA, 75 bp, Artificial Sequence
  Synthetic
tgtgcagggttagggatgaaggccttcaagttatatttgaaccatttaaaaacctatttgggtcttatataggaa

SEQ ID NO: 38466 - DNA, 75 bp, Artificial Sequence
  Synthetic
agtcgtaatatttatagttatatatatagtgttacccatatgtttcaaacttagggatacattaagacagcatga

SEQ ID NO: 38467 - DNA, 75 bp, Artificial Sequence
  Synthetic
atagtgttacccatatgtttcaaacttagggatacattaagacagcatgaggatgcttataagagggaaatgaaa

SEQ ID NO: 38468 - DNA, 75 bp, Artificial Sequence
  Synthetic
ggggttggggatttaatattaggagggtgggggctaacgacagcgtaatctatttgacaaacattattttatact

SEQ ID NO: 38469 - DNA, 75 bp, Artificial Sequence
  Synthetic
tttacaaaacttacaaacacaaatagtttccttggaataactatggacaacacagaatatcaacaattccttgct

SEQ ID NO: 38470 - DNA, 75 bp, Artificial Sequence
  Synthetic
gtttccttggaataactatggacaacacagaatatcaacaattccttgctcgcatcaatgctgcaagagatgcat

SEQ ID NO: 38471 - DNA, 75 bp, Artificial Sequence
  Synthetic
cacagaatatcaacaattccttgctcgcatcaatgctgcaagagatgcatgtgtagcaaaggatattgacgtaga

SEQ ID NO: 38472 - DNA, 75 bp, Artificial Sequence
  Synthetic
ttcgggagagagttgtgtaaatcattgaacatagaatataggaatgatataccatttgtagatatattattagac

SEQ ID NO: 38473 - DNA, 75 bp, Artificial Sequence
  Synthetic
tgaacatagaatataggaatgatataccatttgtagatatattattagacataaagcccgacatagatccattga

SEQ ID NO: 38474 - DNA, 75 bp, Artificial Sequence
  Synthetic
agacaactacctatatctgaataatatcctatatatcatagattataaagtttctgtatctaatgaaagtagtgt

SEQ ID NO: 38475 - DNA, 75 bp, Artificial Sequence
  Synthetic
atcctatatatcatagattataaagtttctgtatctaatgaaagtagtgtaataactaacacaaagtattttgaa

SEQ ID NO: 38476 - DNA, 75 bp, Artificial Sequence
  Synthetic
tgaacttgcatatagagatagttattattaggatagatcctattagccgtgatttgtatattagttcagatagat

SEQ ID NO: 38477 - DNA, 75 bp, Artificial Sequence
  Synthetic
tattaggatagatcctattagccgtgatttgtatattagttcagatagatttaaagatttgttcccaacattagt

SEQ ID NO: 38478 - DNA, 75 bp, Artificial Sequence
  Synthetic
tttgatttaaagcaagcattgtatgaaaagtttggcgatgatgaagaatttttactcaaggttgctcatggtgat

SEQ ID NO: 38479 - DNA, 75 bp, Artificial Sequence
  Synthetic
aaaagtttggcgatgatgaagaatttttactcaaggttgctcatggtgatttcacactgacagcaccctggtgca

SEQ ID NO: 38480 - DNA, 75 bp, Artificial Sequence
  Synthetic
acatcccatctacaaagaattcaaaatgagcatgccaatccctgagaggagactttttgaagaatctatgagatt

SEQ ID NO: 38481 - DNA, 75 bp, Artificial Sequence
  Synthetic
atgagcatgccaatccctgagaggagactttttgaagaatctatgagatttaattcatatgaatcagagaggtgg

SEQ ID NO: 38482 - DNA, 75 bp, Artificial Sequence
  Synthetic
agtatacaaagaaagaatatgatgattttgtaacaaaatcagcaaaggaagttttcttagctacaggggattaca

SEQ ID NO: 38483 - DNA, 75 bp, Artificial Sequence
  Synthetic
ttttgtaacaaaatcagcaaaggaagttttcttagctacaggggattacaaacagccaaataaaggcgaaatttt

SEQ ID NO: 38484 - DNA, 75 bp, Artificial Sequence
  Synthetic
agagttcaccagcaaagagaagtaagtaaatctatccatgaccaaaagcctagtatccatttcatatggtcttct

SEQ ID NO: 38485 - DNA, 75 bp, Artificial Sequence
  Synthetic
gtaaatctatccatgaccaaaagcctagtatccatttcatatggtcttctcataatcctaataacagcaataatg

SEQ ID NO: 38486 - DNA, 75 bp, Artificial Sequence
  Synthetic
aaagtcactacaatctataaaaggtaactcaacttatacagattcatttagatcattggggaaaatgatggatat

SEQ ID NO: 38487 - DNA, 75 bp, Artificial Sequence
  Synthetic
aactcaacttatacagattcatttagatcattggggaaaatgatggatattggtgataaaataactgaatatgaa

SEQ ID NO: 38488 - DNA, 75 bp, Artificial Sequence
  Synthetic
aagcaaggcaaagctggcgacaagttatgaacaaaaagctagagccaaaaaagataaacgatgctttagtccttt

SEQ ID NO: 38489 - DNA, 75 bp, Artificial Sequence
  Synthetic
tatgaacaaaaagctagagccaaaaaagataaacgatgctttagtcctttgggaacaacagttcatggtaaactc

SEQ ID NO: 38490 - DNA, 75 bp, Artificial Sequence
  Synthetic
cttaaactctttagagatttctgtgggataggtaagcacaagcaatttaaaaacaaaatgttggaagatattgaa

SEQ ID NO: 38491 - DNA, 75 bp, Artificial Sequence
  Synthetic
ggataggtaagcacaagcaatttaaaaacaaaatgttggaagatattgaattgtcaaaacctaaaatactggatt

SEQ ID NO: 38492 - DNA, 75 bp, Artificial Sequence
  Synthetic
cagcctcaccatgattgaacagtgtaaaattatgttatcagagcaaaatggcttaaaaagtaataactttatact

SEQ ID NO: 38493 - DNA, 75 bp, Artificial Sequence
  Synthetic
aaaattatgttatcagagcaaaatggcttaaaaagtaataactttatactagatgaatttgggaagaaaataggg

SEQ ID NO: 38494 - DNA, 75 bp, Artificial Sequence
  Synthetic
tcatgacgtctatttttgaaactagattttggcaatgtatttctgacttttccacactaatgaagaatattttat

SEQ ID NO: 38495 - DNA, 75 bp, Artificial Sequence
  Synthetic
attttggcaatgtatttctgacttttccacactaatgaagaatattttatctgtatcgcaatataatagacacaa

SEQ ID NO: 38496 - DNA, 75 bp, Artificial Sequence
  Synthetic
aataataacttatttgcaataatctatccttctgcagatataaaaacaaaaaaagcaactgtagtttatagtata

SEQ ID NO: 38497 - DNA, 75 bp, Artificial Sequence
  Synthetic
atccttctgcagatataaaaacaaaaaaagcaactgtagtttatagtataattgctctccataaaaacgagattg

SEQ ID NO: 38498 - DNA, 75 bp, Artificial Sequence
  Synthetic
tggcactttcaaatgcaatagtggctatatttcaatatctaaggcaattagattagacaaggaacgttgtcaaag

SEQ ID NO: 38499 - DNA, 75 bp, Artificial Sequence
  Synthetic
tatatttcaatatctaaggcaattagattagacaaggaacgttgtcaaagaatagtatcctctcctggtcttttt

SEQ ID NO: 38500 - DNA, 75 bp, Artificial Sequence
  Synthetic
atgagaacccaactattagactagatgatgttatgacattctctttatttaccagcttgtctataacaaaaagtg

SEQ ID NO: 38501 - DNA, 75 bp, Artificial Sequence
  Synthetic
tgatgttatgacattctctttatttaccagcttgtctataacaaaaagtgttttgtctttaacagaacctgcacg

SEQ ID NO: 38502 - DNA, 75 bp, Artificial Sequence
  Synthetic
atttcaagtaatgttaaagactatattgctgagaaattctcaccttacacgaaaacactcttcagtgtttatatg

SEQ ID NO: 38503 - DNA, 75 bp, Artificial Sequence
  Synthetic
ttgctgagaaattctcaccttacacgaaaacactcttcagtgtttatatgacaagactaataaagaatgcgtgct

SEQ ID NO: 38504 - DNA, 75 bp, Artificial Sequence
  Synthetic
agtgcaacttagagatatctacctgtcggattatgatataactcaaaagggcattaaagacaatagagaactgac

SEQ ID NO: 38505 - DNA, 75 bp, Artificial Sequence
  Synthetic
tcggattatgatataactcaaaagggcattaaagacaatagagaactgacaagcatatggtttcccggtagtgta

SEQ ID NO: 38506 - DNA, 75 bp, Artificial Sequence
  Synthetic
tctatctaccgttttattttaatgcaaaaggcttgcatgaaaaacatcatgtcatggtggatctagctaaaacaa

SEQ ID NO: 38507 - DNA, 75 bp, Artificial Sequence
  Synthetic
aaaaggcttgcatgaaaaacatcatgtcatggtggatctagctaaaacaatattggaaatagagaatgagcaaag

SEQ ID NO: 38508 - DNA, 75 bp, Artificial Sequence
  Synthetic
aaagatctagctaagcagactgtcaacttacaaatcttgatacattctttatgcaaaaatctacttgctgacact

SEQ ID NO: 38509 - DNA, 75 bp, Artificial Sequence
  Synthetic
acttacaaatcttgatacattctttatgcaaaaatctacttgctgacacttctaggcataaccacctaaggaata

SEQ ID NO: 38510 - DNA, 75 bp, Artificial Sequence
  Synthetic
gcgatcaataacaacaatatcaacatttactagctctaaatcttgtatcaaaatcgggaatttccagaaagaaaa

SEQ ID NO: 38511 - DNA, 75 bp, Artificial Sequence
  Synthetic
tttactagctctaaatcttgtatcaaaatcgggaatttccagaaagaaaaagaagttcagtacacaaaacagaaa

SEQ ID NO: 38512 - DNA, 75 bp, Artificial Sequence
  Synthetic
agaggagactagcaaatcctctttttgtctcagatgaagaattagggctggaagtggggcactgtaattacaata

SEQ ID NO: 38513 - DNA, 75 bp, Artificial Sequence
  Synthetic
tgtctcagatgaagaattagggctggaagtggggcactgtaattacaatatgttaagagaggcaatgccagaata

SEQ ID NO: 38514 - DNA, 75 bp, Artificial Sequence
  Synthetic
tttgaccgcttgtacgaaatgctggacacagaccaagtttctgacaaacctactatagaattaattatggatatg

SEQ ID NO: 38515 - DNA, 75 bp, Artificial Sequence
  Synthetic
acacagaccaagtttctgacaaacctactatagaattaattatggatatgatgactgatcatacagatttttatt

SEQ ID NO: 38516 - DNA, 75 bp, Artificial Sequence
  Synthetic
aacttccaaagatagagaaatatttgtaggggaatatgaggctaaaatgtgtatgtatgctgtagaaagaatagc

SEQ ID NO: 38517 - DNA, 75 bp, Artificial Sequence
  Synthetic
gtaggggaatatgaggctaaaatgtgtatgtatgctgtagaaagaatagccaaagagcgctgcaaactaaaccca

SEQ ID NO: 38518 - DNA, 75 bp, Artificial Sequence
  Synthetic
acgggaaattaaaaatattggagcaaaaatctgaacaagaaattcggtttttagttgaaacaacacggcagaaaa

SEQ ID NO: 38519 - DNA, 75 bp, Artificial Sequence
  Synthetic
aaaatctgaacaagaaattcggtttttagttgaaacaacacggcagaaaaatagagaaatagatgaagcaattga

SEQ ID NO: 38520 - DNA, 75 bp, Artificial Sequence
  Synthetic
gggaacatctcaaaaatcgaaaagttagctgaaggaaaagcaagaggcttgaaaatggagataaatgcagatatg

SEQ ID NO: 38521 - DNA, 75 bp, Artificial Sequence
  Synthetic
tagctgaaggaaaagcaagaggcttgaaaatggagataaatgcagatatgtctaaatggagtgctcaagatgttt

SEQ ID NO: 38522 - DNA, 75 bp, Artificial Sequence
  Synthetic
actggatcctatcttatatcctcaggagaaggagagaatcattttcttcttttgtaattatatgcaaaagaaatt

SEQ ID NO: 38523 - DNA, 75 bp, Artificial Sequence
  Synthetic
gagaaggagagaatcattttcttcttttgtaattatatgcaaaagaaattaatcctgccagatgacctaatgtgt

SEQ ID NO: 38524 - DNA, 75 bp, Artificial Sequence
  Synthetic
ataaagatgatattatatcggttatgaccaaccaattacaaacaaattatgttgagattaaacgcaactggctcc

SEQ ID NO: 38525 - DNA, 75 bp, Artificial Sequence
  Synthetic
gaccaaccaattacaaacaaattatgttgagattaaacgcaactggctccaaggtaatttcaattacactagtag

SEQ ID NO: 38526 - DNA, 75 bp, Artificial Sequence
  Synthetic
gtatacaaagatgttttaaaagaagcaatgtcttatcttgaagggtcaattgtggtaaattcactggtacactcc

SEQ ID NO: 38527 - DNA, 75 bp, Artificial Sequence
  Synthetic
caatgtcttatcttgaagggtcaattgtggtaaattcactggtacactccgatgataaccaaacttctgtaacaa

SEQ ID NO: 38528 - DNA, 75 bp, Artificial Sequence
  Synthetic
agtcttaatagagtttagcatcacacaattccaaaaaatatgtcttgcatttggatgccaggctaacatgaaaaa

SEQ ID NO: 38529 - DNA, 75 bp, Artificial Sequence
  Synthetic
caattccaaaaaatatgtcttgcatttggatgccaggctaacatgaaaaagacatatattactaattgcataaag

SEQ ID NO: 38530 - DNA, 75 bp, Artificial Sequence
  Synthetic
acggagaacccttttccatttatggaaggttcttgttaacatctgtaggcgactgtgcatatataggtccatatg

SEQ ID NO: 38531 - DNA, 75 bp, Artificial Sequence
  Synthetic
aaggttcttgttaacatctgtaggcgactgtgcatatataggtccatatgaagaccttgcaagtaggatttcatc

SEQ ID NO: 38532 - DNA, 75 bp, Artificial Sequence
  Synthetic
tgtccaccaagcttggcatgggtttccatagctataagccattggattactggactaacatacaatatgttacct

SEQ ID NO: 38533 - DNA, 75 bp, Artificial Sequence
  Synthetic
ccatagctataagccattggattactggactaacatacaatatgttacctgggcagagcaatgatcctatggatt

SEQ ID NO: 38534 - DNA, 75 bp, Artificial Sequence
  Synthetic
tataccaatagaattgaatggtgttttagatgccccattatccatgattagcacagtcggattagaggctggaaa

SEQ ID NO: 38535 - DNA, 75 bp, Artificial Sequence
  Synthetic
ttagatgccccattatccatgattagcacagtcggattagaggctggaaatttatggttcttaattaaaatgcta

SEQ ID NO: 38536 - DNA, 75 bp, Artificial Sequence
  Synthetic
aaagagaatcagttgtgaatcagatttctgaaataaagaattgggatctaagccgactggatgataatgaaatat

SEQ ID NO: 38537 - DNA, 75 bp, Artificial Sequence
  Synthetic
ttctgaaataaagaattgggatctaagccgactggatgataatgaaatatttaagcttaaaatattaagatactt

SEQ ID NO: 38538 - DNA, 75 bp, Artificial Sequence
  Synthetic
ttctgaaataaagaattgggatctaagccgactggatgataatgaaatatttaagcttaatatattaagatactt

SEQ ID NO: 38539 - DNA, 75 bp, Artificial Sequence
  Synthetic
ttctgaaataaagaattgggatctaagccgactggatgataatgaaatatttaagcttaacatattaagatactt

SEQ ID NO: 38540 - DNA, 75 bp, Artificial Sequence
  Synthetic
ttctgaaataaagaattgggatctaagccgactggatgataatgaaatatttaagcttaagatattaagatactt

SEQ ID NO: 38541 - DNA, 75 bp, Artificial Sequence
  Synthetic
agtgatatcatgggagaaacaagcgatatgagaggtaggtcaatattaactcctagaaagttcacaactagtggt

SEQ ID NO: 38542 - DNA, 75 bp, Artificial Sequence
  Synthetic
atatgagaggtaggtcaatattaactcctagaaagttcacaactagtggtagtcttaggaaattgtactcattct

SEQ ID NO: 38543 - DNA, 75 bp, Artificial Sequence
  Synthetic
accaggaggtatgaatgaattatttcaatatctccttgataagccagaactgcttgttactaaaggagaagataa

SEQ ID NO: 38544 - DNA, 75 bp, Artificial Sequence
  Synthetic
caatatctccttgataagccagaactgcttgttactaaaggagaagataagaaggactatatggaatctgtaatt

SEQ ID NO: 38545 - DNA, 75 bp, Artificial Sequence
  Synthetic
aagaaagcctctccatccagaatcctgctcagttatttattgagcagatcctattctcaaacaaaccaataattg

SEQ ID NO: 38546 - DNA, 75 bp, Artificial Sequence
  Synthetic
tgctcagttatttattgagcagatcctattctcaaacaaaccaataattgacttctcgggtatcagagataaata

SEQ ID NO: 38547 - DNA, 75 bp, Artificial Sequence
  Synthetic
ctggagagagaacctgatatcatagggaaagtcacatttaaagaagcatatagaatactaatgaaagatttaaat

SEQ ID NO: 38548 - DNA, 75 bp, Artificial Sequence
  Synthetic
ggaaagtcacatttaaagaagcatatagaatactaatgaaagatttaaatagtttacctttaacaaacgatgata

SEQ ID NO: 38549 - DNA, 75 bp, Artificial Sequence
  Synthetic
tctgaatgacccattaatgataacaattgcaaacacgcagatattatctatttatggcagtcctcagaagcggac

SEQ ID NO: 38550 - DNA, 75 bp, Artificial Sequence
  Synthetic
attgcaaacacgcagatattatctatttatggcagtcctcagaagcggactggtatgtcttgctcaacaatgcca

SEQ ID NO: 38551 - DNA, 75 bp, Artificial Sequence
  Synthetic
atcattctcctgcattagtacttagagcatatagtaagaacactccagatatacagggtgcagacccaacggaaa

SEQ ID NO: 38552 - DNA, 75 bp, Artificial Sequence
  Synthetic
agcatatagtaagaacactccagatatacagggtgcagacccaacggaaatgtcaagagatttggttcacttgag

SEQ ID NO: 38553 - DNA, 75 bp, Artificial Sequence
  Synthetic
aggcttaaaatggagaagaggatttcagataatgaattggaaaaaggagctcgagatatcgtctttgaactaaaa

SEQ ID NO: 38554 - DNA, 75 bp, Artificial Sequence
  Synthetic
cagataatgaattggaaaaaggagctcgagatatcgtctttgaactaaaagaaatgacaagattctatcaagttt

SEQ ID NO: 38555 - DNA, 75 bp, Artificial Sequence
  Synthetic
gcataaaataaaagtgtttatcttaccagctaaagcatacactacaactgacttttgttcactaatgcaaggtaa

SEQ ID NO: 38556 - DNA, 75 bp, Artificial Sequence
  Synthetic
ccagctaaagcatacactacaactgacttttgttcactaatgcaaggtaatctcataaaagacaaagaatggtat

SEQ ID NO: 38557 - DNA, 75 bp, Artificial Sequence
  Synthetic
tatcgggaggtcacaaggcaattatgcagcataattcaactagcgaacagaatatagcttttgaatgttttagac

SEQ ID NO: 38558 - DNA, 75 bp, Artificial Sequence
  Synthetic
gcagcataattcaactagcgaacagaatatagcttttgaatgttttagactgataacccactttgcggactcttt

SEQ ID NO: 38559 - DNA, 75 bp, Artificial Sequence
  Synthetic
ttcttacagttgatcttagacagtttcagctacaaagatgtaagggttaataagctgtatgagataataaagaat

SEQ ID NO: 38560 - DNA, 75 bp, Artificial Sequence
  Synthetic
tcagctacaaagatgtaagggttaataagctgtatgagataataaagaatggtcacaatagaacagattttattc

SEQ ID NO: 38561 - DNA, 75 bp, Artificial Sequence
  Synthetic
aactcaacatgatcttgacaaatatgatgccatgaagagtcaagagagagtcacttggaacgattggcaaacatc

SEQ ID NO: 38562 - DNA, 75 bp, Artificial Sequence
  Synthetic
gatgccatgaagagtcaagagagagtcacttggaacgattggcaaacatcaaggcacttagatatgggggcaata

SEQ ID NO: 38563 - DNA, 75 bp, Artificial Sequence
  Synthetic
gggctataacaataattggcgaagataataaattgacttattctgaattgaatatcactaggaagacaccagaaa

SEQ ID NO: 38564 - DNA, 75 bp, Artificial Sequence
  Synthetic
taataaattgacttattctgaattgaatatcactaggaagacaccagaaaatatatcaataagtggcaggaagct

SEQ ID NO: 38565 - DNA, 75 bp, Artificial Sequence
  Synthetic
tttgaaaacatggcaaaagtcacaacatacccagggaattactatattacttatagaaagaaagatagacaccaa

SEQ ID NO: 38566 - DNA, 75 bp, Artificial Sequence
  Synthetic
catacccagggaattactatattacttatagaaagaaagatagacaccaatatatttaccaaatacatacacatg

SEQ ID NO: 38567 - DNA, 75 bp, Artificial Sequence
  Synthetic
acatatggcaataagaaccaggatatttaatgaaattgtgccagtttgcttagtaaatatagctgaaatagatgg

SEQ ID NO: 38568 - DNA, 75 bp, Artificial Sequence
  Synthetic
tttaatgaaattgtgccagtttgcttagtaaatatagctgaaatagatggtgatcagaggattttaattaggaaa

SEQ ID NO: 38569 - DNA, 75 bp, Artificial Sequence
  Synthetic
tttcattagcaaaaataaaagttggtattgatgaatatgcagttataaagaaagcacattttagcaaaatggtat

SEQ ID NO: 38570 - DNA, 75 bp, Artificial Sequence
  Synthetic
tattgatgaatatgcagttataaagaaagcacattttagcaaaatggtatcatttgatgggccgcctataaagac

SEQ ID NO: 38571 - DNA, 75 bp, Artificial Sequence
  Synthetic
atgaagtcccaagatttgttaaatttaaactatgataatataagaaatagcaacttaatatcattttcaaaaata

SEQ ID NO: 38572 - DNA, 75 bp, Artificial Sequence
  Synthetic
taaactatgataatataagaaatagcaacttaatatcattttcaaaaataatttgttgtgaaggaactgataata

SEQ ID NO: 38573 - DNA, 75 bp, Artificial Sequence
  Synthetic
tgacgacccaatggcattcacagaaggagaaactattcattctacacctatatttaatatttactattcaaagaa

SEQ ID NO: 38574 - DNA, 75 bp, Artificial Sequence
  Synthetic
ggagaaactattcattctacacctatatttaatatttactattcaaagaagggtgagagacatatgacatatcgt

SEQ ID NO: 38575 - DNA, 75 bp, Artificial Sequence
  Synthetic
gggaaacagacaaatttgaagaagcattcacattttataaggatggatttctatcccctgaaaatttgggctgtt

SEQ ID NO: 38576 - DNA, 75 bp, Artificial Sequence
  Synthetic
attcacattttataaggatggatttctatcccctgaaaatttgggctgtttggaagctattatatctctgatcag

SEQ ID NO: 38577 - DNA, 75 bp, Artificial Sequence
  Synthetic
acggtgatagacaaatgtatacatatttgtcttataaaaaataatatggattacctctaccacagatttgatatg

SEQ ID NO: 38578 - DNA, 75 bp, Artificial Sequence
  Synthetic
tttgtcttataaaaaataatatggattacctctaccacagatttgatatgccttcttgttttatagatgatccaa

SEQ ID NO: 38579 - DNA, 75 bp, Artificial Sequence
  Synthetic
gtatagggacttcatatctacattgccacctacatatgttgcaccctggaatatcatgctggaacattttaggac

SEQ ID NO: 38580 - DNA, 75 bp, Artificial Sequence
  Synthetic
ccacctacatatgttgcaccctggaatatcatgctggaacattttaggacaaaatgctcaatgttaattatggat

SEQ ID NO: 38581 - DNA, 75 bp, Artificial Sequence
  Synthetic
aagactttgcaaagatgatgaggaggtctgagggacgaaccaatttagacttcaattaaggagaatcaggacata

SEQ ID NO: 38582 - DNA, 75 bp, Artificial Sequence
  Synthetic
gtctgagggacgaaccaatttagacttcaattaaggagaatcaggacataggagaatatttagatataaattcat

SEQ ID NO: 38583 - DNA, 75 bp, Artificial Sequence
  Synthetic
aaatacaacaggaacatttgccaacaacatagccatgagaaaatggttagttgcagattggcatgattgcaggcc

SEQ ID NO: 38584 - DNA, 75 bp, Artificial Sequence
  Synthetic
tgtcacttcatacggaatcatatatttgcagtgctgactgtgtcataacggttgacaaagaaacagctcaaattc

SEQ ID NO: 38585 - DNA, 75 bp, Artificial Sequence
  Synthetic
aaatcagggtggttcaagagtactacatatattacacttgatcaaacatgtgagcatctgaaagtgtcatgcgga

SEQ ID NO: 38586 - DNA, 75 bp, Artificial Sequence
  Synthetic
gctttaatcaacatatgtcatgtgtgcgatttctgcataggacaatacttccaggttcgatagcaaattctatat

SEQ ID NO: 38587 - DNA, 75 bp, Artificial Sequence
  Synthetic
gcgatttctgcataggacaatacttccaggttcgatagcaaattctatatgtcagaatatagaaataattattct

SEQ ID NO: 38588 - DNA, 75 bp, Artificial Sequence
  Synthetic
catatgtatgttacctattaatgcctatatttatcccaatagcatatatttacgggtggatatataacaaatctt

SEQ ID NO: 38589 - DNA, 75 bp, Artificial Sequence
  Synthetic
agtttaccacccatttaccgagtgtgggacacattgtgtttgtggtgcaagatatgaaacttctgataggatgaa

SEQ ID NO: 38590 - DNA, 75 bp, Artificial Sequence
  Synthetic
gggacacattgtgtttgtggtgcaagatatgaaacttctgataggatgaaattgcatagggcatctgggttgtgt

SEQ ID NO: 38591 - DNA, 75 bp, Artificial Sequence
  Synthetic
ccagagttatgtgcaaatcaaaagggccagcatcagttttatccattatgacagcagttctcatactaacgtttg

SEQ ID NO: 38592 - DNA, 75 bp, Artificial Sequence
  Synthetic
gccagcatcagttttatccattatgacagcagttctcatactaacgtttgtcactcctattagtgctatggtcat

SEQ ID NO: 38593 - DNA, 75 bp, Artificial Sequence
  Synthetic
ctaggtgacttgcctgatgatatggtagaaatggcagaaagagtaaatatctactatcagatcattataattaat

SEQ ID NO: 38594 - DNA, 75 bp, Artificial Sequence
  Synthetic
tagaaatggcagaaagagtaaatatctactatcagatcattataattaattacagcataacatgggttttcttac

SEQ ID NO: 38595 - DNA, 75 bp, Artificial Sequence
  Synthetic
ctttaggaaatatcaacatagatttttaagcttttatgcaatgtattgtaaagaatgtgacatgtatcatgaaag

SEQ ID NO: 38596 - DNA, 75 bp, Artificial Sequence
  Synthetic
ttaagcttttatgcaatgtattgtaaagaatgtgacatgtatcatgaaagagctggtttgacctactggggtgac

SEQ ID NO: 38597 - DNA, 75 bp, Artificial Sequence
  Synthetic
catgtgggcaatttgaggatgttactgggttgatggtgcataagaaatcttacaattgcataattaaatacaaag

SEQ ID NO: 38598 - DNA, 75 bp, Artificial Sequence
  Synthetic
tgggttgatggtgcataagaaatcttacaattgcataattaaatacaaagcaaagtggataagagatatgctaat

SEQ ID NO: 38599 - DNA, 75 bp, Artificial Sequence
  Synthetic
aaagattcactattatttgtcggtgcgacaggaacagatttcgctgcatgtatagatgagaaaacagtcacatgg

SEQ ID NO: 38600 - DNA, 75 bp, Artificial Sequence
  Synthetic
cgacaggaacagatttcgctgcatgtatagatgagaaaacagtcacatggaatcgtactggaccatttctaaatt

SEQ ID NO: 38601 - DNA, 75 bp, Artificial Sequence
  Synthetic
gaagactggttatactgatatagctgatcagttgaaaggtttgggtgcgatatcagtgctagatattccaatgat

SEQ ID NO: 38602 - DNA, 75 bp, Artificial Sequence
  Synthetic
aaaaaagatgccagatgagatatctggatcactgaagtgtatagatgatttagagacacatcatgaacaattgac

SEQ ID NO: 38603 - DNA, 75 bp, Artificial Sequence
  Synthetic
aaatgaaaacattctatactggtcagaaagcaaaatttaacaaagatttaaatttggcattattggtattacaca

SEQ ID NO: 38604 - DNA, 75 bp, Artificial Sequence
  Synthetic
aatcacctgcagagatgtctacttttgaacttgatgaggattgggaagatttcaaatacaaacctgaaccaacag

SEQ ID NO: 38605 - DNA, 75 bp, Artificial Sequence
  Synthetic
gcagatagtaatagcaatgttaaagtctgcaaaaatattcaaaaagtgtcatgtatttcacctaggtctagagcc

SEQ ID NO: 38606 - DNA, 75 bp, Artificial Sequence
  Synthetic
gagaacatgcgaacccatcagtatatacgatgcccaatgtcagtatttaccaatctaattcagagaggagccact

SEQ ID NO: 38607 - DNA, 75 bp, Artificial Sequence
  Synthetic
tacgatgcccaatgtcagtatttaccaatctaattcagagaggagccactactgtatagctgactcacattgttt

SEQ ID NO: 38608 - DNA, 75 bp, Artificial Sequence
  Synthetic
gaactcttaaatgcattgaaaaaatctaaatgttgggctagagaaatggatgatattgttctgcacaaacaagtt

SEQ ID NO: 38609 - DNA, 75 bp, Artificial Sequence
  Synthetic
ctaaatgttgggctagagaaatggatgatattgttctgcacaaacaagttgatggcttaaggagttgtagaatga

SEQ ID NO: 38610 - DNA, 75 bp, Artificial Sequence
  Synthetic
agaaaatgattggactattgttttatgtgagaatggcaattattattattcagaagctcacagagactatgataa

SEQ ID NO: 38611 - DNA, 75 bp, Artificial Sequence
  Synthetic
tgtgagaatggcaattattattattcagaagctcacagagactatgataaagatcaagatgtaggtcacttttgt

SEQ ID NO: 38612 - DNA, 75 bp, Artificial Sequence
  Synthetic
gctacccaataagtaaaaggcatattaaaaattgtgattggcagatctcacattcaacaattgacaagatctcag

SEQ ID NO: 38613 - DNA, 75 bp, Artificial Sequence
  Synthetic
taaaaattgtgattggcagatctcacattcaacaattgacaagatctcagttcaggaattagcagatatagagca

SEQ ID NO: 38614 - DNA, 75 bp, Artificial Sequence
  Synthetic
ttacagacaagtctatcgatctttaagtatgtgaaaacaaagaatcttccacatattaaaccagcatacaaatat

SEQ ID NO: 38615 - DNA, 75 bp, Artificial Sequence
  Synthetic
agtatgtgaaaacaaagaatcttccacatattaaaccagcatacaaatatataaccgtggaaggtgttgaaactg

SEQ ID NO: 38616 - DNA, 75 bp, Artificial Sequence
  Synthetic
agaatctgaaattcctgcactagctggcacagccattggtttcaaaataaattcaagagagggcaactacctaat

SEQ ID NO: 38617 - DNA, 75 bp, Artificial Sequence
  Synthetic
ggatcatattcagcaacatacacaaaactatatataactggtccaactataggggtaaatactaagcatgatgaa

SEQ ID NO: 38618 - DNA, 75 bp, Artificial Sequence
  Synthetic
aaagatgaattagctgtccataggaaaactactgaggagcccaccacagtagaattatgcttgacattttcagac

SEQ ID NO: 38619 - DNA, 75 bp, Artificial Sequence
  Synthetic
aaactactgaggagcccaccacagtagaattatgcttgacattttcagacaagacatattgcactaacttgaatg

SEQ ID NO: 38620 - DNA, 75 bp, Artificial Sequence
  Synthetic
atttgaagttcaattcaaaacagttgagtcttacacattaccaaggataatagctataaaaaatcacgaaattaa

SEQ ID NO: 38621 - DNA, 75 bp, Artificial Sequence
  Synthetic
gagtcttacacattaccaaggataatagctataaaaaatcacgaaattaaagttgggcaaatcaatgacctaggt

SEQ ID NO: 38622 - DNA, 75 bp, Artificial Sequence
  Synthetic
ttcaaaaaataaatgggacaaactatggcaatggattaccaaagtttgattatttatgccatttagcaggtagaa

SEQ ID NO: 38623 - DNA, 75 bp, Artificial Sequence
  Synthetic
tggcaatggattaccaaagtttgattatttatgccatttagcaggtagaaaagaagttatcataaggaaatgttt

SEQ ID NO: 38624 - DNA, 75 bp, Artificial Sequence
  Synthetic
tttctacaaagtcctccaagctatcgtttagaggagcatcaaggcacagtaacagtaatagattataaaaaaatt

SEQ ID NO: 38625 - DNA, 75 bp, Artificial Sequence
  Synthetic
aacagtaatagattataaaaaaattctaggcactataaagatggaggctatattaggagatgtgaaatataggaa

SEQ ID NO: 38626 - DNA, 75 bp, Artificial Sequence
  Synthetic
actgatcacaccagacgaacataaatatgcattaaaagttgtatgtcaagaaaaacctaaactgtctctaaaatt

SEQ ID NO: 38627 - DNA, 75 bp, Artificial Sequence
  Synthetic
tatgcattaaaagttgtatgtcaagaaaaacctaaactgtctctaaaatttaagatctgtaacacaaatattgat

SEQ ID NO: 38628 - DNA, 75 bp, Artificial Sequence
  Synthetic
agccgatcctagagcttgcaccagttgatcaaactacatacattagagaaagagatgaaagatgcaaaacttgga

SEQ ID NO: 38629 - DNA, 75 bp, Artificial Sequence
  Synthetic
tgatcaaactacatacattagagaaagagatgaaagatgcaaaacttggatgtgcagggttcgagatgaagggtt

SEQ ID NO: 38630 - DNA, 75 bp, Artificial Sequence
  Synthetic
aacctttttggctcttacattggaatattttatacgggtatattatgtattgtatgtctccttattgttatttat

SEQ ID NO: 38631 - DNA, 75 bp, Artificial Sequence
  Synthetic
tattttatacgggtatattatgtattgtatgtctccttattgttatttatattatactgcctatttgtttcaagt

SEQ ID NO: 38632 - DNA, 75 bp, Artificial Sequence
  Synthetic
ggatgcatataagaaggaggtgaaaataagatgattcaaataagcatgggatgtcagcataggtttaaatagttt

SEQ ID NO: 38633 - DNA, 75 bp, Artificial Sequence
  Synthetic
ttgggttttatgggggtggggtcaaacaaaactgctaaatttatcttagaatcatttaaatatacttggtagcac

SEQ ID NO: 38634 - DNA, 75 bp, Artificial Sequence
  Synthetic
agtagtgtactccacttgaatactttgaaaatatcgtgttattacttgttgcttctggaaagaattgactagagt

SEQ ID NO: 38635 - DNA, 75 bp, Artificial Sequence
  Synthetic
agaattggttaagacgacagtcatcaaccccattgctgagtctaatggcatcagatgggagaatggcccagaaat

SEQ ID NO: 38636 - DNA, 75 bp, Artificial Sequence
  Synthetic
aaccccattgctgagtctaatggcatcagatgggagaatggcccagaaatttatctggcattcttcccaggaacc

SEQ ID NO: 38637 - DNA, 75 bp, Artificial Sequence
  Synthetic
tttatcctctaactattggaatttacagagttaaacatggaatgatggacccccaatatctaaagaaagcattaa

SEQ ID NO: 38638 - DNA, 75 bp, Artificial Sequence
  Synthetic
cagagttaaacatggaatgatggacccccaatatctaaagaaagcattaaggcagagatatggctccttaactgc

SEQ ID NO: 38639 - DNA, 75 bp, Artificial Sequence
  Synthetic
ggcatgattgctaaaagcctaaaggaggttgagcaactcaagtggggcagaggtggtttgagcgatactgccagg

SEQ ID NO: 38640 - DNA, 75 bp, Artificial Sequence
  Synthetic
actttccttcagaaatttggaataagactgccataagcttgagcagtcaggatatttgggacaaaatttaaacaa

SEQ ID NO: 38641 - DNA, 75 bp, Artificial Sequence
  Synthetic
agtagtgtactaccaagtatagataacgtttgaagattaaagtcaattcacaagttccaagatgatgttcgtatt

SEQ ID NO: 38642 - DNA, 75 bp, Artificial Sequence
  Synthetic
acgtttgaagattaaagtcaattcacaagttccaagatgatgttcgtattgtttttcattgcactaagtgctgca

SEQ ID NO: 38643 - DNA, 75 bp, Artificial Sequence
  Synthetic
caagttccaagatgatgttcgtattgtttttcattgcactaagtgctgcaagcccagtttatcagaggtgtttcc

SEQ ID NO: 38644 - DNA, 75 bp, Artificial Sequence
  Synthetic
cccatccaaacaggctgtaacagaggtatgcctaaaggatgacgttagtatgataaaaacagaagctagatattt

SEQ ID NO: 38645 - DNA, 75 bp, Artificial Sequence
  Synthetic
tgataaaaacagaagctagatatttcagaaatgctaccggaacatatgccaacaatgttgccattagaaagtggc

SEQ ID NO: 38646 - DNA, 75 bp, Artificial Sequence
  Synthetic
accaaaaaaagtctcagggggtcacataaatgttatagaagttggagatgacttaacgctgcatacagaggcata

SEQ ID NO: 38647 - DNA, 75 bp, Artificial Sequence
  Synthetic
ataaatgttatagaagttggagatgacttaacgctgcatacagaggcatatgtatgcaatgcagactgcacaata

SEQ ID NO: 38648 - DNA, 75 bp, Artificial Sequence
  Synthetic
taagattgcaaacagatacaacaaatcattttgagatagcaggaacaacagttaagtcagggtggttcaaaagca

SEQ ID NO: 38649 - DNA, 75 bp, Artificial Sequence
  Synthetic
tcattttgagatagcaggaacaacagttaagtcagggtggttcaaaagcacaacttatatcacccttgatcaaac

SEQ ID NO: 38650 - DNA, 75 bp, Artificial Sequence
  Synthetic
gggcctaaatctatacagttccatgcgtgtttcaatcaacacatgtcttgtgttagattcttacataggacaatc

SEQ ID NO: 38651 - DNA, 75 bp, Artificial Sequence
  Synthetic
cgtgtttcaatcaacacatgtcttgtgttagattcttacataggacaatcctacctgggtctattgccagctcca

SEQ ID NO: 38652 - DNA, 75 bp, Artificial Sequence
  Synthetic
attaacagtgctaaccctccttatatttatactattaagcatactgagcaaaacttacatatgttatatactcat

SEQ ID NO: 38653 - DNA, 75 bp, Artificial Sequence
  Synthetic
tttatactattaagcatactgagcaaaacttacatatgttatatactcatgccaatatttatcccgcttgcttat

SEQ ID NO: 38654 - DNA, 75 bp, Artificial Sequence
  Synthetic
cgtgtaaaaaatgtaaactatgcggattagtttaccatcccttcactgagtgcggcacccattgcgtatgtggtg

SEQ ID NO: 38655 - DNA, 75 bp, Artificial Sequence
  Synthetic
attagtttaccatcccttcactgagtgcggcacccattgcgtatgtggtgctagatacgagacatcggataggat

SEQ ID NO: 38656 - DNA, 75 bp, Artificial Sequence
  Synthetic
tgcccaggttataaaagtctcagggctgcaagagtcatgtgcaaatccaaagggccagcttctattttatctata

SEQ ID NO: 38657 - DNA, 75 bp, Artificial Sequence
  Synthetic
ctgcaagagtcatgtgcaaatccaaagggccagcttctattttatctataatcactgcagtgttaatccttactt

SEQ ID NO: 38658 - DNA, 75 bp, Artificial Sequence
  Synthetic
agctggggacacccaagaaacatttaagcttgaggacctaccagatgacatgctaagcatggcaatgaaagtaaa

SEQ ID NO: 38659 - DNA, 75 bp, Artificial Sequence
  Synthetic
aagcttgaggacctaccagatgacatgctaagcatggcaatgaaagtaaatatgtactacattatgtgtatgata

SEQ ID NO: 38660 - DNA, 75 bp, Artificial Sequence
  Synthetic
ttttatgcgccctattaattgctttactcttcaagaagtatcagcatagattcttaaacttttatgccatgtact

SEQ ID NO: 38661 - DNA, 75 bp, Artificial Sequence
  Synthetic
actcttcaagaagtatcagcatagattcttaaacttttatgccatgtactgccacgagtgcgatatgtaccatga

SEQ ID NO: 38662 - DNA, 75 bp, Artificial Sequence
  Synthetic
gacttcacaaacaaatgtagacagtgcacatgcgggcagtacgaagatgccgcaggtctactaacccacagaaaa

SEQ ID NO: 38663 - DNA, 75 bp, Artificial Sequence
  Synthetic
gcacatgcgggcagtacgaagatgccgcaggtctactaacccacagaaaaacatacaactgcctcgtgcagtaca

SEQ ID NO: 38664 - DNA, 75 bp, Artificial Sequence
  Synthetic
aattgtatacataatcttgatgcttattaaagattctgtactaatagtgcatgctgatggcacagactttgaaaa

SEQ ID NO: 38665 - DNA, 75 bp, Artificial Sequence
  Synthetic
attaaagattctgtactaatagtgcatgctgatggcacagactttgaaaaatgcagtggtgaggtggatataaca

SEQ ID NO: 38666 - DNA, 75 bp, Artificial Sequence
  Synthetic
atctaggtaattgtgagaagaagcaaaagaaggagtcatataataatatagcaactcaattaaaagggctagatg

SEQ ID NO: 38667 - DNA, 75 bp, Artificial Sequence
  Synthetic
aaagaaggagtcatataataatatagcaactcaattaaaagggctagatgccatatcggttttagatatccccat

SEQ ID NO: 38668 - DNA, 75 bp, Artificial Sequence
  Synthetic
gctggagccctaagattcattgaagagcaaagatcataccatgtccaactgactgcagaatatgctatgctaact

SEQ ID NO: 38669 - DNA, 75 bp, Artificial Sequence
  Synthetic
gactgcagaatatgctatgctaactagatactgcgattattacacccaattcactgacaattctggatacagtca

SEQ ID NO: 38670 - DNA, 75 bp, Artificial Sequence
  Synthetic
tcccacgattttaaggcatgtattttatatcccaatcagcatttttgcagatgtgtcaagcatggggacaaatgc

SEQ ID NO: 38671 - DNA, 75 bp, Artificial Sequence
  Synthetic
tatatcccaatcagcatttttgcagatgtgtcaagcatggggacaaatgctcaagctccaattgggatttcgcca

SEQ ID NO: 38672 - DNA, 75 bp, Artificial Sequence
  Synthetic
aaaacagtccaaatttgataaagatttaaatttagcattgatgtccttacaccacgcatttagaggaacatctag

SEQ ID NO: 38673 - DNA, 75 bp, Artificial Sequence
  Synthetic
ttaaatttagcattgatgtccttacaccacgcatttagaggaacatctagtttttatattgctaaactcctgaag

SEQ ID NO: 38674 - DNA, 75 bp, Artificial Sequence
  Synthetic
cttatgcagaaaagattaaaggcaaatatccaggcaatgccctgctaaaggcaataattgactacataaagtata

SEQ ID NO: 38675 - DNA, 75 bp, Artificial Sequence
  Synthetic
atatccaggcaatgccctgctaaaggcaataattgactacataaagtatatggaggatttaaccgagatgaacaa

SEQ ID NO: 38676 - DNA, 75 bp, Artificial Sequence
  Synthetic
gacttcatatttgaagttcctcctacaaagagcccatcaataagaagattagagtcttcatatgattttaaaact

SEQ ID NO: 38677 - DNA, 75 bp, Artificial Sequence
  Synthetic
caaagagcccatcaataagaagattagagtcttcatatgattttaaaactaatgtaaattcaaacccatcacaca

SEQ ID NO: 38678 - DNA, 75 bp, Artificial Sequence
  Synthetic
ctgcttgtcaccaaagtcaggagtgtcatatgattcaataattgcctgtggggagccaagccagccaagcattta

SEQ ID NO: 38679 - DNA, 75 bp, Artificial Sequence
  Synthetic
tcatatgattcaataattgcctgtggggagccaagccagccaagcatttacagaaagccagacagccaagttttc

SEQ ID NO: 38680 - DNA, 75 bp, Artificial Sequence
  Synthetic
tttgtttatcagatacacactgcctggaaaattatgagacagttggagaggaaatcattgatgcaattaaaaaat

SEQ ID NO: 38681 - DNA, 75 bp, Artificial Sequence
  Synthetic
ggaaaattatgagacagttggagaggaaatcattgatgcaattaaaaaatcgaaatgctgggaaacagaatttac

SEQ ID NO: 38682 - DNA, 75 bp, Artificial Sequence
  Synthetic
gatggggtaaggagttgcaggatgaaagactcaggagaatgtacagtcaccaccaatagatggcctataatactc

SEQ ID NO: 38683 - DNA, 75 bp, Artificial Sequence
  Synthetic
aagactcaggagaatgtacagtcaccaccaatagatggcctataatactctgcgataacgataaattctactact

SEQ ID NO: 38684 - DNA, 75 bp, Artificial Sequence
  Synthetic
ggaccaggatataggtcacttctgtctcagcccaagatgcaacacaattaggcaccctataaatcggaaacatat

SEQ ID NO: 38685 - DNA, 75 bp, Artificial Sequence
  Synthetic
ctcagcccaagatgcaacacaattaggcaccctataaatcggaaacatatatcaaattgtacgtggcaggttagt

SEQ ID NO: 38686 - DNA, 75 bp, Artificial Sequence
  Synthetic
tacatgaactggaggatcttgaacagtataagaaggccataacacagaagttgcagacaagcctaactctattta

SEQ ID NO: 38687 - DNA, 75 bp, Artificial Sequence
  Synthetic
gtataagaaggccataacacagaagttgcagacaagcctaactctatttaaatactcaaagacaaaaaacttgcc

SEQ ID NO: 38688 - DNA, 75 bp, Artificial Sequence
  Synthetic
ataacaattgaaggaacagagactgctgagggtttagaaagtgcttatatagaatcagagatacccgctctagca

SEQ ID NO: 38689 - DNA, 75 bp, Artificial Sequence
  Synthetic
ctgagggtttagaaagtgcttatatagaatcagagatacccgctctagcaggaacatcaataggtttcaagatca

SEQ ID NO: 38690 - DNA, 75 bp, Artificial Sequence
  Synthetic
agatgtcattggttatgttaagagcgcatcttattcggccgtttatacaaaattgtatacaacaggacctactat

SEQ ID NO: 38691 - DNA, 75 bp, Artificial Sequence
  Synthetic
gcatcttattcggccgtttatacaaaattgtatacaacaggacctactataggtgttaacactaaacatgatgaa

SEQ ID NO: 38692 - DNA, 75 bp, Artificial Sequence
  Synthetic
atgtgcctcatggcacaggttggctcacatttgctaaggagaggacaagctcctgggggtgtgaagaatttggct

SEQ ID NO: 38693 - DNA, 75 bp, Artificial Sequence
  Synthetic
cacatttgctaaggagaggacaagctcctgggggtgtgaagaatttggctgcctggcaattagcgatgggtgtgt

SEQ ID NO: 38694 - DNA, 75 bp, Artificial Sequence
  Synthetic
aaagatgaaataactgtctataggaaggagactgaggagaccacagatgtggaattgtgcctgacatttgcagac

SEQ ID NO: 38695 - DNA, 75 bp, Artificial Sequence
  Synthetic
aggagactgaggagaccacagatgtggaattgtgcctgacatttgcagacaaaacatattgcactaacctcaatg

SEQ ID NO: 38696 - DNA, 75 bp, Artificial Sequence
  Synthetic
gtttgaagtccaatttaaaactgtagaggcttacagtctgcctagaatcattgcagtgcggaatcatgagattat

SEQ ID NO: 38697 - DNA, 75 bp, Artificial Sequence
  Synthetic
gaggcttacagtctgcctagaatcattgcagtgcggaatcatgagattatggttgggcaaataaatgacataggt

SEQ ID NO: 38698 - DNA, 75 bp, Artificial Sequence
  Synthetic
tacagaaagtaaacaacacaaattatggaaatggtgtgcctaagtttgattacctgtgtcatttagcaagtagaa

SEQ ID NO: 38699 - DNA, 75 bp, Artificial Sequence
  Synthetic
tggaaatggtgtgcctaagtttgattacctgtgtcatttagcaagtagaaaagaagtgatagtgaggaaatgctt

SEQ ID NO: 38700 - DNA, 75 bp, Artificial Sequence
  Synthetic
tttctacaaacaccagcaagttataggctagaagaggagggaggttcagttacagtcatagactacaagaaaatc

SEQ ID NO: 38701 - DNA, 75 bp, Artificial Sequence
  Synthetic
tacagtcatagactacaagaaaatccttggcactataaagatgaaggctatccttggagatgtgaaatataaaac

SEQ ID NO: 38702 - DNA, 75 bp, Artificial Sequence
  Synthetic
gttgagggggtatgcactggctgcatcaattgttttgaaaatatacattgtgagttaacaatacacagtacagtt

SEQ ID NO: 38703 - DNA, 75 bp, Artificial Sequence
  Synthetic
tcaattgttttgaaaatatacattgtgagttaacaatacacagtacagttgaagccagctgcccggtagtaagtt

SEQ ID NO: 38704 - DNA, 75 bp, Artificial Sequence
  Synthetic
tttaataaccccaaatgagcacaagtatgctataaaggtgatctgcaatgaaaagccaggtcctacattgccgtt

SEQ ID NO: 38705 - DNA, 75 bp, Artificial Sequence
  Synthetic
tatgctataaaggtgatctgcaatgaaaagccaggtcctacattgccgttcaagatctgcagtgcaaagacagat

SEQ ID NO: 38706 - DNA, 75 bp, Artificial Sequence
  Synthetic
agccaatattagagctagcacctgtagaccaaacaacatatattaaggagaaagatgaaaggtgcaagacttgga

SEQ ID NO: 38707 - DNA, 75 bp, Artificial Sequence
  Synthetic
agaccaaacaacatatattaaggagaaagatgaaaggtgcaagacttggatgtgcagagtaagagatgaaggttt

SEQ ID NO: 38708 - DNA, 75 bp, Artificial Sequence
  Synthetic
aacttatttggttcttatattgggatattttatacatttataatatctttaatggcaatatttatagttatatat

SEQ ID NO: 38709 - DNA, 75 bp, Artificial Sequence
  Synthetic
tattttatacatttataatatctttaatggcaatatttatagttatatatattgtgttgcctatatgtttcaaac

SEQ ID NO: 38710 - DNA, 75 bp, Artificial Sequence
  Synthetic
agacgcttataagagagagatgaaaattaggtaaggagcatagctgctaaggaattggggtttagatattaaggg

SEQ ID NO: 38711 - DNA, 75 bp, Artificial Sequence
  Synthetic
ggaattggggtttagatattaaggggaggggggctaacaacagcgtaatctatttgacaaacattatcttatact

SEQ ID NO: 38712 - DNA, 75 bp, Artificial Sequence
  Synthetic
agtagtgtactcctatctacaaaacttacaaaaaattcagttatatcacaatatacacataatggactatcaaga

SEQ ID NO: 38713 - DNA, 75 bp, Artificial Sequence
  Synthetic
ttacaaaaaattcagttatatcacaatatacacataatggactatcaagagtatcaacaattcttggctaggatc

SEQ ID NO: 38714 - DNA, 75 bp, Artificial Sequence
  Synthetic
atatacacataatggactatcaagagtatcaacaattcttggctaggatcaatactgcaagagacgcatgtgtag

SEQ ID NO: 38715 - DNA, 75 bp, Artificial Sequence
  Synthetic
agagagctatgcaagtccttaaatatagaatatagaaatgatgtaccatttgtagatataattttagacataagg

SEQ ID NO: 38716 - DNA, 75 bp, Artificial Sequence
  Synthetic
acgcaccacatattaccccagataattacttgtatataaataatgtattgtacatcatagattataaggtctctg

SEQ ID NO: 38717 - DNA, 75 bp, Artificial Sequence
  Synthetic
ttacttgtatataaataatgtattgtacatcatagattataaggtctctgtatcgaatgaaagtagtttgataac

SEQ ID NO: 38718 - DNA, 75 bp, Artificial Sequence
  Synthetic
agagatatatctgacagattaggtattccgatagaaatagtcatcatccgtatagatcctgtgagcaaagattta

SEQ ID NO: 38719 - DNA, 75 bp, Artificial Sequence
  Synthetic
ttccgatagaaatagtcatcatccgtatagatcctgtgagcaaagatttacatatcaattccgataggtttaaag

SEQ ID NO: 38720 - DNA, 75 bp, Artificial Sequence
  Synthetic
tataaacttcaatcagttttttgatttaaagcaattgctttatgaaaaattcggtgatgatgaagaatttttact

SEQ ID NO: 38721 - DNA, 75 bp, Artificial Sequence
  Synthetic
ttaaagcaattgctttatgaaaaattcggtgatgatgaagaatttttactaaaagtagcgcatggtgatttcact

SEQ ID NO: 38722 - DNA, 75 bp, Artificial Sequence
  Synthetic
ggtgccctgatttttggaagcatcccatttataaagagttcaagatgagtatgccagtacctgagcgaaggcttt

SEQ ID NO: 38723 - DNA, 75 bp, Artificial Sequence
  Synthetic
catttataaagagttcaagatgagtatgccagtacctgagcgaaggctttttgaagaatcagtcaaattcaatgc

SEQ ID NO: 38724 - DNA, 75 bp, Artificial Sequence
  Synthetic
aacttagttaaaattagagaatatacaaagaaagactatttagagcacatttcaaaatctgcaaagaatattttt

SEQ ID NO: 38725 - DNA, 75 bp, Artificial Sequence
  Synthetic
caaagaaagactatttagagcacatttcaaaatctgcaaagaatatttttctggctagtggattctataaacagc

SEQ ID NO: 38726 - DNA, 75 bp, Artificial Sequence
  Synthetic
atggacattaatggtcgaaagagtgcaagaccagagggaaatctcaaaaaccctccatgatcagaaacccagcat

SEQ ID NO: 38727 - DNA, 75 bp, Artificial Sequence
  Synthetic
caagaccagagggaaatctcaaaaaccctccatgatcagaaacccagcatacattttatatggggggcccataac

SEQ ID NO: 38728 - DNA, 75 bp, Artificial Sequence
  Synthetic
tcaaactcatactgctctcaaagtccctacaaagcataaagggtatatctacctacacagaagcatttaaatctt

SEQ ID NO: 38729 - DNA, 75 bp, Artificial Sequence
  Synthetic
cctacaaagcataaagggtatatctacctacacagaagcatttaaatctttaggtaaaatgatggatatcgggga

SEQ ID NO: 38730 - DNA, 75 bp, Artificial Sequence
  Synthetic
tgcatgtccctaaaaagcaaagcaagatcatcatggaagcaaataatgaataaaaagttagagcccaaacagata

SEQ ID NO: 38731 - DNA, 75 bp, Artificial Sequence
  Synthetic
gatcatcatggaagcaaataatgaataaaaagttagagcccaaacagataaataatgcacttgtcctatgggaac

SEQ ID NO: 38732 - DNA, 75 bp, Artificial Sequence
  Synthetic
aatagacaaaagcgaaaaattgaagttgtttaagaacttctgcggtataggcaagcacaagcaattcaagaataa

SEQ ID NO: 38733 - DNA, 75 bp, Artificial Sequence
  Synthetic
ttgtttaagaacttctgcggtataggcaagcacaagcaattcaagaataagatgctagaagacatagagatgtca

SEQ ID NO: 38734 - DNA, 75 bp, Artificial Sequence
  Synthetic
acccaaatatgtatctggctagcttaaccatgatggaacaaagtaagaagatattgtccaaaagtaatgggttga

SEQ ID NO: 38735 - DNA, 75 bp, Artificial Sequence
  Synthetic
aaccatgatggaacaaagtaagaagatattgtccaaaagtaatgggttgaaaccagataattttatattgaatga

SEQ ID NO: 38736 - DNA, 75 bp, Artificial Sequence
  Synthetic
aataaggaaacatatgataacatgcataaaatttttgagacaagatattggcaatgcatatctgacttctccacc

SEQ ID NO: 38737 - DNA, 75 bp, Artificial Sequence
  Synthetic
ataaaatttttgagacaagatattggcaatgcatatctgacttctccaccctaatgaagaatatcttatctgtgt

SEQ ID NO: 38738 - DNA, 75 bp, Artificial Sequence
  Synthetic
taggatagctatgtgtgctaataacaatgtgttcgctatagtatttccttcagctgatataaaaacaaaaaaagc

SEQ ID NO: 38739 - DNA, 75 bp, Artificial Sequence
  Synthetic
aatgtgttcgctatagtatttccttcagctgatataaaaacaaaaaaagcaactgtagtttatagtatcatagta

SEQ ID NO: 38740 - DNA, 75 bp, Artificial Sequence
  Synthetic
acttgcttattattcaaacatgataatccaaccctagtgatgagtgatatcatgaatttttctatatacactagc

SEQ ID NO: 38741 - DNA, 75 bp, Artificial Sequence
  Synthetic
atccaaccctagtgatgagtgatatcatgaatttttctatatacactagcttgtctatcacaaagagtgttttat

SEQ ID NO: 38742 - DNA, 75 bp, Artificial Sequence
  Synthetic
gattatgaattcattagccatctccagcaatgttaaagattatatagcagagaagttttccccttatacaaagac

SEQ ID NO: 38743 - DNA, 75 bp, Artificial Sequence
  Synthetic
acttagagatatatatttatccgattatgacataacccaaaaaggtatcaaagacaatagagaattaacaagtat

SEQ ID NO: 38744 - DNA, 75 bp, Artificial Sequence
  Synthetic
aaagaatatttaacacaaatatatttaccattttatttcaatgctaaaggattacatgagaaacatcatgttatg

SEQ ID NO: 38745 - DNA, 75 bp, Artificial Sequence
  Synthetic
taccattttatttcaatgctaaaggattacatgagaaacatcatgttatggtagatctagcaaagactatattag

SEQ ID NO: 38746 - DNA, 75 bp, Artificial Sequence
  Synthetic
cataaaggaaatatggtctacaaattgtaccaaacaaacagtgaatcttaaaattctaatccattccttgtgcaa

SEQ ID NO: 38747 - DNA, 75 bp, Artificial Sequence
  Synthetic
tgtaccaaacaaacagtgaatcttaaaattctaatccattccttgtgcaagaatctacttgcagacacctcaaga

SEQ ID NO: 38748 - DNA, 75 bp, Artificial Sequence
  Synthetic
agaacaggaacaatttcagaaggtctataacaactatttcaacattcacaagttcaaagtcttgtctcaaaatag

SEQ ID NO: 38749 - DNA, 75 bp, Artificial Sequence
  Synthetic
tataacaactatttcaacattcacaagttcaaagtcttgtctcaaaataggagactttaagaaagagaaagaatt

SEQ ID NO: 38750 - DNA, 75 bp, Artificial Sequence
  Synthetic
ttagagacacagagtcgcaaaatgaggttagcaaatccaatgtttgtgacagatgaacaagtgtgccttgaagtc

SEQ ID NO: 38751 - DNA, 75 bp, Artificial Sequence
  Synthetic
ggttagcaaatccaatgtttgtgacagatgaacaagtgtgccttgaagtcagtcactgcaattatgagatgctaa

SEQ ID NO: 38752 - DNA, 75 bp, Artificial Sequence
  Synthetic
ttacatatcaactaaagtattcgatagattatatgaattgttggataaaggagttttaacagataaacccgttat

SEQ ID NO: 38753 - DNA, 75 bp, Artificial Sequence
  Synthetic
agattatatgaattgttggataaaggagttttaacagataaacccgttatagagcaaataatggatatgatggtt

SEQ ID NO: 38754 - DNA, 75 bp, Artificial Sequence
  Synthetic
aaaagatagagagatatttgttggagaatatgaagctaaaatgtgcatgtatgcagttgaaaggatagcaaaaga

SEQ ID NO: 38755 - DNA, 75 bp, Artificial Sequence
  Synthetic
atgatatctgagccaggagatggtaagttgaaggtgttggaacaaaaatcagaacaagaaattagattcttggtt

SEQ ID NO: 38756 - DNA, 75 bp, Artificial Sequence
  Synthetic
gagactacaagacaaaaaaaccgtgaaatagatgaagcaattgagacgttagctgcagaaggatatgagagtaat

SEQ ID NO: 38757 - DNA, 75 bp, Artificial Sequence
  Synthetic
ggaaataaatgcagacatgtctaaatggagtgctcaggatgttttttacaaatacttttggctcatagccttgga

SEQ ID NO: 38758 - DNA, 75 bp, Artificial Sequence
  Synthetic
gaaagaatattgtactttatgtgcaattacatggataaggagttgatactgccagatgaattattattcaattta

SEQ ID NO: 38759 - DNA, 75 bp, Artificial Sequence
  Synthetic
atgacataatagctactatgactaatcaattaaattccaacacggttttaataaagaggaattggcttcaaggaa

SEQ ID NO: 38760 - DNA, 75 bp, Artificial Sequence
  Synthetic
aaagaaatattaaaagaggctataacattactggacgggtctatattggtcaattcattagttcattcagatgat

SEQ ID NO: 38761 - DNA, 75 bp, Artificial Sequence
  Synthetic
aggacaaggtggaaaatgataaaattatagactttgcaatgaaagaatttgagaaagcttgtttgacatttggat

SEQ ID NO: 38762 - DNA, 75 bp, Artificial Sequence
  Synthetic
tatagactttgcaatgaaagaatttgagaaagcttgtttgacatttggatgccaagcaaatatgaaaaagacata

SEQ ID NO: 38763 - DNA, 75 bp, Artificial Sequence
  Synthetic
gtttcattatttaatttgtatggtgagcccttttcaatttatggcagattcttactaacatctgtgggcgattgt

SEQ ID NO: 38764 - DNA, 75 bp, Artificial Sequence
  Synthetic
agcccttttcaatttatggcagattcttactaacatctgtgggcgattgtgcttatatagggccttacgaggatt

SEQ ID NO: 38765 - DNA, 75 bp, Artificial Sequence
  Synthetic
gacagccataaaacatggttgcccgcccagtctggcatgggtatctatagcaataagccactggatgacttctct

SEQ ID NO: 38766 - DNA, 75 bp, Artificial Sequence
  Synthetic
cccagtctggcatgggtatctatagcaataagccactggatgacttctctaacatacaatatgctaccagggcaa

SEQ ID NO: 38767 - DNA, 75 bp, Artificial Sequence
  Synthetic
cagcagagagtaggaaagacatacctatagaattgaatggcgtattagatgctccattatcaatgatcagtacag

SEQ ID NO: 38768 - DNA, 75 bp, Artificial Sequence
  Synthetic
tatagaattgaatggcgtattagatgctccattatcaatgatcagtacagttggattagaatctgggaatttata

SEQ ID NO: 38769 - DNA, 75 bp, Artificial Sequence
  Synthetic
tacaccccagttatgcaaaaaagggagtcagtagtcaatcagatagctgaagttaagaactggaaagttgagaat

SEQ ID NO: 38770 - DNA, 75 bp, Artificial Sequence
  Synthetic
agtcagtagtcaatcagatagctgaagttaagaactggaaagttgagaatctaacagataatgaagtattcagac

SEQ ID NO: 38771 - DNA, 75 bp, Artificial Sequence
  Synthetic
agatgctgagatggaccctagtgacattatgggtgagacaagtgatatgagagggagatctattttaacacctag

SEQ ID NO: 38772 - DNA, 75 bp, Artificial Sequence
  Synthetic
agaaaattgtattcatttagtaagtatcaagatagactgtcttcccctggaggcatgattgaactatttacctat

SEQ ID NO: 38773 - DNA, 75 bp, Artificial Sequence
  Synthetic
ctggcattagggacaaatatataaacctacatgatagcagagccctagagaaagagcctgatatattagggaaag

SEQ ID NO: 38774 - DNA, 75 bp, Artificial Sequence
  Synthetic
gttaatgagggatctatctagcttagaactgaccaatgacgatattcaagtgatttattcttatataatactcaa

SEQ ID NO: 38775 - DNA, 75 bp, Artificial Sequence
  Synthetic
gaactgaccaatgacgatattcaagtgatttattcttatataatactcaatgatcctatgatgataacaattgca

SEQ ID NO: 38776 - DNA, 75 bp, Artificial Sequence
  Synthetic
ggagtccacaaagacggatgggtatgtcctgttctacgatgccagaatttagaaatttaaaattgatacaccatt

SEQ ID NO: 38777 - DNA, 75 bp, Artificial Sequence
  Synthetic
gtcctgttctacgatgccagaatttagaaatttaaaattgatacaccattccccagccttggttttaagagcata

SEQ ID NO: 38778 - DNA, 75 bp, Artificial Sequence
  Synthetic
ggtgccgaccccacagaaatggctagagatttagttcatctaaaagaatttgttgaaaatacaaatttggaagag

SEQ ID NO: 38779 - DNA, 75 bp, Artificial Sequence
  Synthetic
gagatttagttcatctaaaagaatttgttgaaaatacaaatttggaagagaaaatgaaggtcagaattgctataa

SEQ ID NO: 38780 - DNA, 75 bp, Artificial Sequence
  Synthetic
tatagtctttgaactaaaagagatgactagattttatcaagtttgctatgagtatgttaagtctacagaacacaa

SEQ ID NO: 38781 - DNA, 75 bp, Artificial Sequence
  Synthetic
actagattttatcaagtttgctatgagtatgttaagtctacagaacacaagataaaagtcttcatccttccagca

SEQ ID NO: 38782 - DNA, 75 bp, Artificial Sequence
  Synthetic
gctcgctcatgcaagggaacttaataaaggacaaagagtggtacacagtccactacttgaagcagatattgtctg

SEQ ID NO: 38783 - DNA, 75 bp, Artificial Sequence
  Synthetic
aaaggacaaagagtggtacacagtccactacttgaagcagatattgtctggtggccacaaagccataatgcagca

SEQ ID NO: 38784 - DNA, 75 bp, Artificial Sequence
  Synthetic
gcttttgagtgttttaggttgataacccattttgcagactcattcatagattcgctatctagatcagccttttta

SEQ ID NO: 38785 - DNA, 75 bp, Artificial Sequence
  Synthetic
cccattttgcagactcattcatagattcgctatctagatcagcctttttacagttgataatagatgaatttagtt

SEQ ID NO: 38786 - DNA, 75 bp, Artificial Sequence
  Synthetic
ctatgacataataaagaatgggtataatcgaactgactttatacctttgctttttaggaccggcgatttaagaca

SEQ ID NO: 38787 - DNA, 75 bp, Artificial Sequence
  Synthetic
aatcgaactgactttatacctttgctttttaggaccggcgatttaagacaagcagacttagataaatatgatgct

SEQ ID NO: 38788 - DNA, 75 bp, Artificial Sequence
  Synthetic
ggaatgactggcagacatctcgtcatttggacatgggctctattaatctaacaataactggttataataggtcaa

SEQ ID NO: 38789 - DNA, 75 bp, Artificial Sequence
  Synthetic
tttggacatgggctctattaatctaacaataactggttataataggtcaataacaataattggagaagacaacaa

SEQ ID NO: 38790 - DNA, 75 bp, Artificial Sequence
  Synthetic
accaggaaaactcctgagaatataactataagcggtagaaagttgctgggctcaagacacggtcttaaatttgaa

SEQ ID NO: 38791 - DNA, 75 bp, Artificial Sequence
  Synthetic
ctataagcggtagaaagttgctgggctcaagacacggtcttaaatttgaaaatatgtctaaaatccaaacatacc

SEQ ID NO: 38792 - DNA, 75 bp, Artificial Sequence
  Synthetic
gaagaaggatcgccaccagtttatataccaggtacattctcatgaatcaataacaaggaggaacgaagaacatat

SEQ ID NO: 38793 - DNA, 75 bp, Artificial Sequence
  Synthetic
taccaggtacattctcatgaatcaataacaaggaggaacgaagaacatatggctattaagactagaatatacaat

SEQ ID NO: 38794 - DNA, 75 bp, Artificial Sequence
  Synthetic
atgttgcagaggtggatggggatcaacgtatattaataagatccttagattatttaaataatgatatattctctc

SEQ ID NO: 38795 - DNA, 75 bp, Artificial Sequence
  Synthetic
acgtatattaataagatccttagattatttaaataatgatatattctctctttcaagaattaaagttgggcttga

SEQ ID NO: 38796 - DNA, 75 bp, Artificial Sequence
  Synthetic
cacttcagcaagatggtttcatttgaaggacccccaattaagacaggccttcttgatcttactgaattgatgaaa

SEQ ID NO: 38797 - DNA, 75 bp, Artificial Sequence
  Synthetic
aaggacccccaattaagacaggccttcttgatcttactgaattgatgaaatcccaagatttacttaaccttaatt

SEQ ID NO: 38798 - DNA, 75 bp, Artificial Sequence
  Synthetic
gatatccttttcaaaactgatttgctgtgaagggtcaaataatataagtgatggcttagagttcctgtctgatga

SEQ ID NO: 38799 - DNA, 75 bp, Artificial Sequence
  Synthetic
gcaatacattcaacaccaatttttaatatatattactcaaagaagggagataaacatatgacatacagaaatgca

SEQ ID NO: 38800 - DNA, 75 bp, Artificial Sequence
  Synthetic
atatatattactcaaagaagggagataaacatatgacatacagaaatgcaatcaaactactgatagagagggaaa

SEQ ID NO: 38801 - DNA, 75 bp, Artificial Sequence
  Synthetic
taataaaaaatggcatggaccatatgtatcattcatttgatgttcccaaatgttttatggggaatcctattacta

SEQ ID NO: 38802 - DNA, 75 bp, Artificial Sequence
  Synthetic
agaatttatcaatagcttaccaggaacagatataccaccatggaatgttatgacagagaacttcaagaagaaatg

SEQ ID NO: 38803 - DNA, 75 bp, Artificial Sequence
  Synthetic
tgacaattagaccataaatttgggaggggtttggaattggctaagattcaaaaagaggggaattaacagcaactg

SEQ ID NO: 38804 - DNA, 75 bp, Artificial Sequence
  Synthetic
ggggtttggaattggctaagattcaaaaagaggggaattaacagcaactgtataaatttgtagataggagcacac

SEQ ID NO: 38805 - DNA, 75 bp, Artificial Sequence
  Synthetic
agtagtgtactccacttgaatactttgaagataatttgttgttgactgttttttgcctaagggaagttatctaga

SEQ ID NO: 38806 - DNA, 75 bp, Artificial Sequence
  Synthetic
tcaatccaattgctgagtccaatggtgtgaggtgggacagtgggccagagatctatctatcgtttttcccaggaa

SEQ ID NO: 38807 - DNA, 75 bp, Artificial Sequence
  Synthetic
gttctacccgctaaccatcggcattcacagagtcaagcagggcatgatggaccctcaatatctgaaaaaggcctt

SEQ ID NO: 38808 - DNA, 75 bp, Artificial Sequence
  Synthetic
cacagagtcaagcagggcatgatggaccctcaatatctgaaaaaggccttaaggcaacgctatggcaccctcaca

SEQ ID NO: 38809 - DNA, 75 bp, Artificial Sequence
  Synthetic
aaacattcctgcagaaatttggcatcaggcttccataaataaagtatggggcatccaaattgggttctaaattct

SEQ ID NO: 38810 - DNA, 75 bp, Artificial Sequence
  Synthetic
acgtttaaatattaaagttttggatcaaagccaaagatgattcgcatgctggtgctgattgtagttacggctgca

SEQ ID NO: 38811 - DNA, 75 bp, Artificial Sequence
  Synthetic
aagatggggctatagtgaagcaaaacccatccaaagaggcagtcacagaagtgtgcctaaaagatgatgttagca

SEQ ID NO: 38812 - DNA, 75 bp, Artificial Sequence
  Synthetic
cccatccaaagaggcagtcacagaagtgtgcctaaaagatgatgttagcatgatcaaaacagaggccaggtatgt

SEQ ID NO: 38813 - DNA, 75 bp, Artificial Sequence
  Synthetic
aacaatgttgcaataaggaagtggttagtctctgattggcatgactgcagacctaagaagatcgttggggggcac

SEQ ID NO: 38814 - DNA, 75 bp, Artificial Sequence
  Synthetic
tagtctctgattggcatgactgcagacctaagaagatcgttggggggcacatcaatgtaatagaagttggtgatg

SEQ ID NO: 38815 - DNA, 75 bp, Artificial Sequence
  Synthetic
tgtttgcagtgcagattgtaccataggtgtagacaaggaaacagcacaggtcagacttcaaacagataccacaaa

SEQ ID NO: 38816 - DNA, 75 bp, Artificial Sequence
  Synthetic
ggtgtagacaaggaaacagcacaggtcagacttcaaacagataccacaaaccattttgaaatagcaggtactact

SEQ ID NO: 38817 - DNA, 75 bp, Artificial Sequence
  Synthetic
caacatatataactctagatcagacctgtgaacacctcaaagtttcctgcggcccaaaatctgtacagttccatg

SEQ ID NO: 38818 - DNA, 75 bp, Artificial Sequence
  Synthetic
cctgcttcaatcagcatatgtcctgtgtcagattcttacacaggacaatattgcctggttccatagctaattcca

SEQ ID NO: 38819 - DNA, 75 bp, Artificial Sequence
  Synthetic
tttagttacacttaccttattaatcttcatactgttaagcattttaagtaagacttatatatgttatttgttaat

SEQ ID NO: 38820 - DNA, 75 bp, Artificial Sequence
  Synthetic
agacttatatatgttatttgttaatgcccatattcatccccatagcatatatgtacggtgtaatttacaataagt

SEQ ID NO: 38821 - DNA, 75 bp, Artificial Sequence
  Synthetic
tttaggggaaagtaaggaaacctttgaacttgaagagcttccagacgacatgctggaaatggcattaaggataaa

SEQ ID NO: 38822 - DNA, 75 bp, Artificial Sequence
  Synthetic
gaacttgaagagcttccagacgacatgctggaaatggcattaaggataaattcttattacttcacctgtatctta

SEQ ID NO: 38823 - DNA, 75 bp, Artificial Sequence
  Synthetic
ttattgctggattattggttggactgatatttaaaaaataccagcataggttcttaaatatttatgcaatgtact

SEQ ID NO: 38824 - DNA, 75 bp, Artificial Sequence
  Synthetic
gatatttaaaaaataccagcataggttcttaaatatttatgcaatgtactgtgaagaatgtaacatgtatcatga

SEQ ID NO: 38825 - DNA, 75 bp, Artificial Sequence
  Synthetic
gacttcaccaacaaatgtagacaatgcacatgtggtcaatatgaagatgctacaggtttgataactcacaggaaa

SEQ ID NO: 38826 - DNA, 75 bp, Artificial Sequence
  Synthetic
gcacatgtggtcaatatgaagatgctacaggtttgataactcacaggaaaacctataactgtttagtgcagtaca

SEQ ID NO: 38827 - DNA, 75 bp, Artificial Sequence
  Synthetic
aataatttacatattcttaattttgatcaaagattctgccatagttgtacaagctactgggacagatttcaccac

SEQ ID NO: 38828 - DNA, 75 bp, Artificial Sequence
  Synthetic
atcaaagattctgccatagttgtacaagctactgggacagatttcaccacctgcctagagactgagagtataaat

SEQ ID NO: 38829 - DNA, 75 bp, Artificial Sequence
  Synthetic
accttggaaactgccaaaagcaacaaaagaaagaaccttacacaaatattgcaacccagctaaaagggctaaaag

SEQ ID NO: 38830 - DNA, 75 bp, Artificial Sequence
  Synthetic
aaagaaagaaccttacacaaatattgcaacccagctaaaagggctaaaagcaatttccgtactagatatccctat

SEQ ID NO: 38831 - DNA, 75 bp, Artificial Sequence
  Synthetic
gcaggtgctttaagatatatagaggaaaaggaagatttccatgtccaactaactacagaatatgcaatgctgagt

SEQ ID NO: 38832 - DNA, 75 bp, Artificial Sequence
  Synthetic
aaaaggaagatttccatgtccaactaactacagaatatgcaatgctgagtaagtactgtgactattatacccagt

SEQ ID NO: 38833 - DNA, 75 bp, Artificial Sequence
  Synthetic
aacaacatggagagtatacttgagatctcatgattttgaggcatgcatactatatccaaatcagcatttctgcaa

SEQ ID NO: 38834 - DNA, 75 bp, Artificial Sequence
  Synthetic
tctcatgattttgaggcatgcatactatatccaaatcagcatttctgcaagtgtgtgaaaaatggtgaaaagtgt

SEQ ID NO: 38835 - DNA, 75 bp, Artificial Sequence
  Synthetic
atgaaatgaagaattattactctgggaaacaagcaaaatttgataaagatttaaacctagctctaacagctttgc

SEQ ID NO: 38836 - DNA, 75 bp, Artificial Sequence
  Synthetic
gaaacaagcaaaatttgataaagatttaaacctagctctaacagctttgcatcatgccttcagagggacctcatc

SEQ ID NO: 38837 - DNA, 75 bp, Artificial Sequence
  Synthetic
aagaagtccaatgatgatttgattgcatatacaaataagataaaagcaaaatttccaggtaatgcactattgaag

SEQ ID NO: 38838 - DNA, 75 bp, Artificial Sequence
  Synthetic
catatacaaataagataaaagcaaaatttccaggtaatgcactattgaaggctataatagattatatagcataca

SEQ ID NO: 38839 - DNA, 75 bp, Artificial Sequence
  Synthetic
tttcaaatatgacgagttctgggatgaattattgtacaaacctaacccagcaaaagcctcaaatcttgctagggg

SEQ ID NO: 38840 - DNA, 75 bp, Artificial Sequence
  Synthetic
gaattattgtacaaacctaacccagcaaaagcctcaaatcttgctaggggaaaagagtcatcctacaacttcaag

SEQ ID NO: 38841 - DNA, 75 bp, Artificial Sequence
  Synthetic
aaacctgtaagaatgttaaggatgttgcctgcttatcaccaaggtcaggtgctatatactcttcaataattgcat

SEQ ID NO: 38842 - DNA, 75 bp, Artificial Sequence
  Synthetic
tgcctgcttatcaccaaggtcaggtgctatatactcttcaataattgcatgcggtgaacccaacgggccaagtgt

SEQ ID NO: 38843 - DNA, 75 bp, Artificial Sequence
  Synthetic
tttcaatccagtactgaccggtctatatattgtttgctagacagccattgtctagaggagtttgaggctatcagt

SEQ ID NO: 38844 - DNA, 75 bp, Artificial Sequence
  Synthetic
tatattgtttgctagacagccattgtctagaggagtttgaggctatcagtcaagaggaactggatgcagtaaaaa

SEQ ID NO: 38845 - DNA, 75 bp, Artificial Sequence
  Synthetic
tcctgacgtaagacccctccaagaaagtgacggggctaaaagctgtagaatgaaagattctgggaattgtaatgt

SEQ ID NO: 38846 - DNA, 75 bp, Artificial Sequence
  Synthetic
caatgcgagaatgacaaattttattattcagaacttcaaaaagattatgacaaaactcaagatattggtcattat

SEQ ID NO: 38847 - DNA, 75 bp, Artificial Sequence
  Synthetic
acaatataaaaaggctataacccaaaagcttcaaacaagcttgtctctattcaagtatgcaaaaacaaaaaatct

SEQ ID NO: 38848 - DNA, 75 bp, Artificial Sequence
  Synthetic
aagcttcaaacaagcttgtctctattcaagtatgcaaaaacaaaaaatctgccgcacattaagccaatttataaa

SEQ ID NO: 38849 - DNA, 75 bp, Artificial Sequence
  Synthetic
ctgcagaagggatagagagcgcatatattgaatcagaagtgcctgcattggctgggacatctgttgggttcaaaa

SEQ ID NO: 38850 - DNA, 75 bp, Artificial Sequence
  Synthetic
ttaattctaaagagggcaaacacttgctagatgttatagcatatgtaaaaagtgcatcgtactcttcagtatatg

SEQ ID NO: 38851 - DNA, 75 bp, Artificial Sequence
  Synthetic
ttgttgccgtgcaaaaccatgagattaagattgggcaaataaatgatctaggggtttactctaagggatgtggga

SEQ ID NO: 38852 - DNA, 75 bp, Artificial Sequence
  Synthetic
ttatggcaatggggtccccagatttgattacttatgtcacttagctagtagaaaggaagtcatcgttagaaaatg

SEQ ID NO: 38853 - DNA, 75 bp, Artificial Sequence
  Synthetic
gattacttatgtcacttagctagtagaaaggaagtcatcgttagaaaatgctttgataatgattaccaagcatgc

SEQ ID NO: 38854 - DNA, 75 bp, Artificial Sequence
  Synthetic
atagacttgaagaagacagcggtactgtgactataattgattataagaaaatattaggcacaatcaagatgaagg

SEQ ID NO: 38855 - DNA, 75 bp, Artificial Sequence
  Synthetic
gtatcaattgctttgagaatattcattgtgaattaacgctgcataccacaattgaagccagctgcccaattaaaa

SEQ ID NO: 38856 - DNA, 75 bp, Artificial Sequence
  Synthetic
ttgtgaattaacgctgcataccacaattgaagccagctgcccaattaaaagttcttgcacagtattccatgatag

SEQ ID NO: 38857 - DNA, 75 bp, Artificial Sequence
  Synthetic
aaatatgcattaaaaatggtatgcacagaaaagccagggaatacactcaccattaaagtctgcaatactagaatt

SEQ ID NO: 38858 - DNA, 75 bp, Artificial Sequence
  Synthetic
cagaaaagccagggaatacactcaccattaaagtctgcaatactagaattgaagcttcaatggcccttgttgatg

SEQ ID NO: 38859 - DNA, 75 bp, Artificial Sequence
  Synthetic
agttgatcagacggcatatataagagaaaaagatgaaagatgcaaaacttggatgtgtagggtaagggatgaagg

SEQ ID NO: 38860 - DNA, 75 bp, Artificial Sequence
  Synthetic
gaaaaagatgaaagatgcaaaacttggatgtgtagggtaagggatgaagggctgcaggttatcttagagccattt

SEQ ID NO: 38861 - DNA, 75 bp, Artificial Sequence
  Synthetic
ggatattttacacatttattatatctataatagcattgttggttatcatctatgtactactgcctatatgcttca

SEQ ID NO: 38862 - DNA, 75 bp, Artificial Sequence
  Synthetic
tataatagcattgttggttatcatctatgtactactgcctatatgcttcaaattaagggatacccttagaaagca

SEQ ID NO: 38863 - DNA, 75 bp, Artificial Sequence
  Synthetic
tgacttgctaatggccaggcatgactactttggaaaagaattgtgtaaatctttgaatatagaatatagaaacga

SEQ ID NO: 38864 - DNA, 75 bp, Artificial Sequence
  Synthetic
tatgataacatatgataaatattacgaactaactagagatatatctactagattaaacattccaatagaaatagt

SEQ ID NO: 38865 - DNA, 75 bp, Artificial Sequence
  Synthetic
gttcttattgaaggtcgctcatggtgattttaccttaacagccccatggtgcaaaacgggctgcccagatttctg

SEQ ID NO: 38866 - DNA, 75 bp, Artificial Sequence
  Synthetic
atgaccagattgataaagaatgcttgctttgatgcttatgaccaaaggcaacgtgttcaacttagagatatatac

SEQ ID NO: 38867 - DNA, 75 bp, Artificial Sequence
  Synthetic
tcaacagactgcaccaagcagacagttaacctaaaagtcttaatacattctttgtgcaaaaatttacttgctgac

SEQ ID NO: 38868 - DNA, 75 bp, Artificial Sequence
  Synthetic
gtctttgacaggttatatgaattactagacaagaatattctaactgataaaccaattatagaacaaataatggat

SEQ ID NO: 38869 - DNA, 75 bp, Artificial Sequence
  Synthetic
atcgatgacctaactgataatgagattttcaggctaaagatacttaggtacttagtgttagacgctgaaatggat

SEQ ID NO: 38870 - DNA, 75 bp, Artificial Sequence
  Synthetic
gacacctagaaaattcaccacagctggtagcttaagaaaactgtattcattcggtaaatatcaagatagactatc

SEQ ID NO: 38871 - DNA, 75 bp, Artificial Sequence
  Synthetic
caatatatggaagtcctcaacgaaggatgggaatgtcctgctcaaccatgccagaatttagaaatttaaaattaa

SEQ ID NO: 38872 - DNA, 75 bp, Artificial Sequence
  Synthetic
ggagcacatggcaattaaaaccagaatatataatgagataactccagtatgcattgtaaacgttgctgaaattga

SEQ ID NO: 38873 - DNA, 75 bp, Artificial Sequence
  Synthetic
tcaagattagagacacaaagagatttctcagagtttgctaaactaatgaagaaagaaggtggcagaagcaatata

SEQ ID NO: 38874 - DNA, 75 bp, Artificial Sequence
  Synthetic
gaaagaaggtggcagaagcaatatagaatttgattaataaaagcaagccagcacatagtaaggctgacaaagtgt

SEQ ID NO: 38875 - DNA, 75 bp, Artificial Sequence
  Synthetic
aatgggtgggtggtaggggacagcaaaaaatagatgtcaggtcattgataaaataaaatgtattcagtggagcac

SEQ ID NO: 38876 - DNA, 75 bp, Artificial Sequence
  Synthetic
agtagtgtactaccaagtatagataacgtttaaatactaaagtcttaaaacaaaaccaatgatgattttcatatt

SEQ ID NO: 38877 - DNA, 75 bp, Artificial Sequence
  Synthetic
gatagcaaacataccggaggatatagcaggagcactaagatatatagaagaaaaagacacatttcatgtccaatt

SEQ ID NO: 38878 - DNA, 75 bp, Artificial Sequence
  Synthetic
tcacacgattttgatgcttgcatactatacccaaaccaacatttttgtcgatgtgtcaagcacggagacaaatgc

SEQ ID NO: 38879 - DNA, 75 bp, Artificial Sequence
  Synthetic
atgagatgaagaactattactcagggaagcaaaacaaatttgataaagatttgaatttggccctgatggcagtgc

SEQ ID NO: 38880 - DNA, 75 bp, Artificial Sequence
  Synthetic
agcatatattgcaacaatgttgtccaaaaaatcgaataatgatctggttacatacaccaataagataaaggaaaa

SEQ ID NO: 38881 - DNA, 75 bp, Artificial Sequence
  Synthetic
gttccccggaaatgctttattaaaagctataatggattatatatcatacatgaagggcttatctgaaatgacaaa

SEQ ID NO: 38882 - DNA, 75 bp, Artificial Sequence
  Synthetic
ctttgataatgattaccaagcatgtaaattcttacaaacaccagcaagctacagactggaggaaagtagtggcac

SEQ ID NO: 38883 - DNA, 75 bp, Artificial Sequence
  Synthetic
aatcaaaatttgcggcactaaaattgacgcttcgttagctcttattgatgctaagccaatactagagttagcacc

SEQ ID NO: 38884 - DNA, 75 bp, Artificial Sequence
  Synthetic
gaaaaagatgaaaggtgcaagacttggatgtgtagagtaagagatgaaggcttgcaggtcattttagaacctttc

SEQ ID NO: 38885 - DNA, 75 bp, Artificial Sequence
  Synthetic
tacattgttttgcctatctgctttaagctaagagacactctcaggcagcatgaggatgcctataaaagagagatg

SEQ ID NO: 38886 - DNA, 75 bp, Artificial Sequence
  Synthetic
attaaggtcaggcttttattaagtggccaatttatggtttttattattgcaaagtggggggtgggggactaaaca

SEQ ID NO: 38887 - DNA, 75 bp, Artificial Sequence
  Synthetic
aaagtggggggtgggggactaaacaacagcgtaaatttattttacaaacgttatctatacttggtagtacactac

SEQ ID NO: 38888 - DNA, 75 bp, Artificial Sequence
  Synthetic
gcaggtggagattgtcaataatcattttcctggaaacaggaacaacccaattggtaacaacgatcttaccatcca

SEQ ID NO: 38889 - DNA, 75 bp, Artificial Sequence
  Synthetic
acacaaagctcctcaaggattgttaactagtgaattactacaccaagatgtcttatgaaaaacttgctgtcgata

SEQ ID NO: 38890 - DNA, 75 bp, Artificial Sequence
  Synthetic
ttgccggccatgaaattgatgccgatactatcaaagcctgggtgcaagcttttgcttatcaaggttttgatgcta

SEQ ID NO: 38891 - DNA, 75 bp, Artificial Sequence
  Synthetic
tactatcaaagcctgggtgcaagcttttgcttatcaaggttttgatgctaagagggtgatggagttgctcgtgga

SEQ ID NO: 38892 - DNA, 75 bp, Artificial Sequence
  Synthetic
gagaggtggagatgattgggttgaagacgccaagcagatgattattctgtgccttacaagaggaaacaagccctc

SEQ ID NO: 38893 - DNA, 75 bp, Artificial Sequence
  Synthetic
taaaatgatggtgaagatgtcagagaagggtaagaagattgtgcaagcccttgtcaagagatactctctcaagga

SEQ ID NO: 38894 - DNA, 75 bp, Artificial Sequence
  Synthetic
gggcaacccttctagagatgatctgacattgtctagagtgactgctgctttagctggttacacttgccaggccac

SEQ ID NO: 38895 - DNA, 75 bp, Artificial Sequence
  Synthetic
agaatatgtagaggaattcctccctgttactggcaagaacatggatgatctctccaaaaactatcccagggcaat

SEQ ID NO: 38896 - DNA, 75 bp, Artificial Sequence
  Synthetic
gttactggcaagaacatggatgatctctccaaaaactatcccagggcaatgatgcatcctagctttgctggactc

SEQ ID NO: 38897 - DNA, 75 bp, Artificial Sequence
  Synthetic
attgatccaaaacttcccccagatgtgttgtcaacaatttgcgacgcattcagccttttcatggtccagttttcc

SEQ ID NO: 38898 - DNA, 75 bp, Artificial Sequence
  Synthetic
aggaccataaaccccaggaatagaggattgtctgtgtcagaagttgctagtacttttgacaggccaatgaatgct

SEQ ID NO: 38899 - DNA, 75 bp, Artificial Sequence
  Synthetic
tacttttgacaggccaatgaatgctgccatgaacagctcattcattagtggtgagcagaggaagtcattcctcag

SEQ ID NO: 38900 - DNA, 75 bp, Artificial Sequence
  Synthetic
atgcagccatccaatcctgtgaaggctgctgccaaagttttccggggtttgaaataatctgccccattaatttct

SEQ ID NO: 38901 - DNA, 75 bp, Artificial Sequence
  Synthetic
ctaatttgcataattgcatgttaattggttttaattcccacccgattatttgattataattttctttaattgacc

SEQ ID NO: 38902 - DNA, 75 bp, Artificial Sequence
  Synthetic
caccttaattaaattaataaaattaaataaattaaataaattaataaaataaaacaaatcaaacaaactaatcaa

SEQ ID NO: 38903 - DNA, 75 bp, Artificial Sequence
  Synthetic
aattaatcacaataaatcatcccatctcaatcaccctcaccccacctggcagctggtccgtctacttccatttct

SEQ ID NO: 38904 - DNA, 75 bp, Artificial Sequence
  Synthetic
tcttctgaatctaaatctgaatcccatgaatcagcaattctagtatacctagggctcatggtgtgcagtggggtc

SEQ ID NO: 38905 - DNA, 75 bp, Artificial Sequence
  Synthetic
cattttctgttccctaacagatgtggagtaatcacctcagacagttctttaacataatcatacaatgaagagtgg

SEQ ID NO: 38906 - DNA, 75 bp, Artificial Sequence
  Synthetic
gcaaggcagtaagcattctcagaatttgaacatatgcaatctctttctcaatattttgaccagtgaaattcaaac

SEQ ID NO: 38907 - DNA, 75 bp, Artificial Sequence
  Synthetic
atgggatatctctctcacccaattctctgatcagtttcttatacaggttgacaagagaatcatctatttgggccc

SEQ ID NO: 38908 - DNA, 75 bp, Artificial Sequence
  Synthetic
tctgatcagtttcttatacaggttgacaagagaatcatctatttgggccccatcaccacttctcatgatcaatgt

SEQ ID NO: 38909 - DNA, 75 bp, Artificial Sequence
  Synthetic
catcaccacttctcatgatcaatgtcataagaaagcatttttcttcccaattaaattcatagctctccactaaag

SEQ ID NO: 38910 - DNA, 75 bp, Artificial Sequence
  Synthetic
agagcttaaaaaatgctagagtaggaacacctaaaggccaactaagtgcttctttaagattgggttctgaccact

SEQ ID NO: 38911 - DNA, 75 bp, Artificial Sequence
  Synthetic
aacacctaaaggccaactaagtgcttctttaagattgggttctgaccactttagctgtctttctaggttaaggtg

SEQ ID NO: 38912 - DNA, 75 bp, Artificial Sequence
  Synthetic
tgaaatcttctcaattgtagtatcaaagaatgagggtgatttccctttcacctggaggaatggtttcccccatga

SEQ ID NO: 38913 - DNA, 75 bp, Artificial Sequence
  Synthetic
aagaatgagggtgatttccctttcacctggaggaatggtttcccccatgatcttggaagctgacctttatctatg

SEQ ID NO: 38914 - DNA, 75 bp, Artificial Sequence
  Synthetic
aagctccttaagcgaaaggaagtcttatctgaaactgtaaatgaagaacaaggaaattctgctcctttgtatctg

SEQ ID NO: 38915 - DNA, 75 bp, Artificial Sequence
  Synthetic
tatctgaaactgtaaatgaagaacaaggaaattctgctcctttgtatctgcagataggcgtgccccagtaaccat

SEQ ID NO: 38916 - DNA, 75 bp, Artificial Sequence
  Synthetic
aggaaattctgctcctttgtatctgcagataggcgtgccccagtaaccattgtatgctgaatactccacatacac

SEQ ID NO: 38917 - DNA, 75 bp, Artificial Sequence
  Synthetic
tgtatgctgaatactccacatacaccttggatctgtctgttgcagatctagttatatgtggtatgtcaaaaacgt

SEQ ID NO: 38918 - DNA, 75 bp, Artificial Sequence
  Synthetic
gttatatgtggtatgtcaaaaacgtaattcagcatgttagacatggtttattttcgtcactatttcgatctcaag

SEQ ID NO: 38919 - DNA, 75 bp, Artificial Sequence
  Synthetic
gtcaaaaacgtaattcagcatgttagacatggtttattttcgtcactatttcgatctcaagaggggactttgtgt

SEQ ID NO: 38920 - DNA, 75 bp, Artificial Sequence
  Synthetic
acacaaagacggctaagaaatgaagatattgtttattattaaaagaattgcgtttgccttagcggcttacacatt

SEQ ID NO: 38921 - DNA, 75 bp, Artificial Sequence
  Synthetic
aacaggatggtcaatggaaggccagacaaaaatatgcttgagcaatgaatcacctctggaagggatagtgtacta

SEQ ID NO: 38922 - DNA, 75 bp, Artificial Sequence
  Synthetic
ttgggaggatctaaaaagaaaaagaaaaaaacaagttaagggagattctaccaatcacttggactgcagaatagg

SEQ ID NO: 38923 - DNA, 75 bp, Artificial Sequence
  Synthetic
tgaaggtgaccctatgctaatgagtaattcttccatgatgaagatgattgagcaggttcaattatcaataacccc

SEQ ID NO: 38924 - DNA, 75 bp, Artificial Sequence
  Synthetic
cttgaaactcacttgttccgggaacttagaaaacagtggtgtgtcagtcaatttcaatggattggatgacactga

SEQ ID NO: 38925 - DNA, 75 bp, Artificial Sequence
  Synthetic
gccaggctacaatattgtagactgtgacaatttcagggttttttctgatttgggaataattgttggtgatgggaa

SEQ ID NO: 38926 - DNA, 75 bp, Artificial Sequence
  Synthetic
aagctgggtagaaaagtataatgcatcttatgatcaaaagctcctatctgcaaaccagaaggttttagatcttga

SEQ ID NO: 38927 - DNA, 75 bp, Artificial Sequence
  Synthetic
atcacaactagaggatgccaaaaatgttagattggatgacaagaatgaaatacagtctctgatcagagaaaacca

SEQ ID NO: 38928 - DNA, 75 bp, Artificial Sequence
  Synthetic
gatgctcttgcacaaaatatctaatttgactggaattgcatacaataccaataatagtcttcgtgctttgcagtc

SEQ ID NO: 38929 - DNA, 75 bp, Artificial Sequence
  Synthetic
agagctgttttctgccaaagaccaccacaaaatcataattgatgaaaagaataaattgagtgaagagaataagag

SEQ ID NO: 38930 - DNA, 75 bp, Artificial Sequence
  Synthetic
aatgagagagaagctgagcatgatagaaaaaagcaacactagcaaatcaaatgtatcctcagtttcttcaattct

SEQ ID NO: 38931 - DNA, 75 bp, Artificial Sequence
  Synthetic
aaaaacagcagtgttattgacaaccaccattccttttcttgatattgtggagctggcagatgcctcaactcatgt

SEQ ID NO: 38932 - DNA, 75 bp, Artificial Sequence
  Synthetic
tgcattgcagaatccatatatccatgtgaagaacaggattggcggtgggctgtataggtttgacagtgaagatga

SEQ ID NO: 38933 - DNA, 75 bp, Artificial Sequence
  Synthetic
tgcaacatgcaaagggttgacttatgggctagcttgtgcaggatttgactacatgataagaccagacaaatatcc

SEQ ID NO: 38934 - DNA, 75 bp, Artificial Sequence
  Synthetic
attctttaattcctatgtcatgcacttgacaccactagaggcatatgcagaagggattgttgaaaaagaagggga

SEQ ID NO: 38935 - DNA, 75 bp, Artificial Sequence
  Synthetic
cagctgcgaaatgggaaagagcaaagaccccaaatgcttggaaggcaggcaattcattaaagcatcttgccctca

SEQ ID NO: 38936 - DNA, 75 bp, Artificial Sequence
  Synthetic
aggggtcaatggtgtgtattaccttaatgataaaggaaaactcagtcactctagatgtaaagaagatgaatatga

SEQ ID NO: 38937 - DNA, 75 bp, Artificial Sequence
  Synthetic
aataacagaggactgtgctttttgtaggaaaatgaagaagaaagggtctaagggagtgatgaagacatcagtgtc

SEQ ID NO: 38938 - DNA, 75 bp, Artificial Sequence
  Synthetic
aatacaagatgctttctgtcaaaaggatgcagaagaatattcaggaccaaagataactgtccaaggaatatgtga

SEQ ID NO: 38939 - DNA, 75 bp, Artificial Sequence
  Synthetic
aataggcacaacagtttataagctgtgtagcaatcatgcccagcattatgaaaacatcccatttgtcatttttaa

SEQ ID NO: 38940 - DNA, 75 bp, Artificial Sequence
  Synthetic
aaatggaggaaagatttacctagaaagattgataacaaagaacttagaattaatagctgatgtctcattcatttg

SEQ ID NO: 38941 - DNA, 75 bp, Artificial Sequence
  Synthetic
ttatgaacacaagggacaagatggtactgaaacagaaaccagagagttaaaaagagtcaaggttggggattgtaa

SEQ ID NO: 38942 - DNA, 75 bp, Artificial Sequence
  Synthetic
aaatgttaattcttctaaatctaagcattgtactggagaccatgtgttttgccagaagtatggttgctcaggatc

SEQ ID NO: 38943 - DNA, 75 bp, Artificial Sequence
  Synthetic
ctatccagaggtcaagtgtataactgcaccaggctcaggaccagtgctggtaaatatattaggctcttgggtcaa

SEQ ID NO: 38944 - DNA, 75 bp, Artificial Sequence
  Synthetic
acccaagtgtcttggatatgagaaagtcctggtaaagagagaagtaaaaagatcatttgtggtgccacaggcaga

SEQ ID NO: 38945 - DNA, 75 bp, Artificial Sequence
  Synthetic
gtgtgagacttgcataagctcttgtgaagatgatggaattagagttacctcaaccgggttcaagataacgtcagc

SEQ ID NO: 38946 - DNA, 75 bp, Artificial Sequence
  Synthetic
agtctcatgtagccatggatcatgtgtctccactcatcaggacccatcaaccacgatagtggttccatatccagg

SEQ ID NO: 38947 - DNA, 75 bp, Artificial Sequence
  Synthetic
actgtccattgcatccggaggtttgattggtgttcagctgtctcacaacgatgatagcactagcttgcacttagt

SEQ ID NO: 38948 - DNA, 75 bp, Artificial Sequence
  Synthetic
tgttaattgtcctcctagggatgtctgtgagactctgcactgtttcttttgcattagaggaatcataaattacca

SEQ ID NO: 38949 - DNA, 75 bp, Artificial Sequence
  Synthetic
atgccacaccatcttgtcatcattattgctgtcatccattctctcaatgatgatttacttcttgttgttctctat

SEQ ID NO: 38950 - DNA, 75 bp, Artificial Sequence
  Synthetic
aggaaagatgttatacttcttcaaagtcattcctaagagactgcgcagcccttttatgtggatatttatgctact

SEQ ID NO: 38951 - DNA, 75 bp, Artificial Sequence
  Synthetic
ctgttggttaatccagctggtaaagaaagggttgagatcaatgagcctcagaataaacaattccattgggtggac

SEQ ID NO: 38952 - DNA, 75 bp, Artificial Sequence
  Synthetic
caatcatgcagaattgcaagaggtgattaatcacaggcccatcgctcagagacgacccatccctagattccaggc

SEQ ID NO: 38953 - DNA, 75 bp, Artificial Sequence
  Synthetic
cactatgttcatcctattctctattttttccttagggctttcttgctcagaaaccaccctttccaattcaaaaca

SEQ ID NO: 38954 - DNA, 75 bp, Artificial Sequence
  Synthetic
gacaaagtgtgttcagtcaggagggaatgtgaagtgcacaataagtgcaaccattactatgaaggctggtattat

SEQ ID NO: 38955 - DNA, 75 bp, Artificial Sequence
  Synthetic
aggaggggaatcttgttttataatcaaagggccaatggacaaccaacagaagactgtaagaataaaaactgtttc

SEQ ID NO: 38956 - DNA, 75 bp, Artificial Sequence
  Synthetic
aagtgaaatcgtgtgtagagaaggaaatagcttctggacaagccattataccccatactgtctgagctctagaag

SEQ ID NO: 38957 - DNA, 75 bp, Artificial Sequence
  Synthetic
gtgccacctggttggtgattgcactggaaatagatgtcaaagctggactgatgatttggtgtcaactgaattcaa

SEQ ID NO: 38958 - DNA, 75 bp, Artificial Sequence
  Synthetic
aaattcgaatgacaacctgcaaatgaatgaaaataagtgttttgagcagtgtggcgcgataggctgtggctgttt

SEQ ID NO: 38959 - DNA, 75 bp, Artificial Sequence
  Synthetic
caacataaatccctcttgtttgtttgtgcacactgttctaaagagtgtcaaacctgaggctataagggttttctc

SEQ ID NO: 38960 - DNA, 75 bp, Artificial Sequence
  Synthetic
ttgtgttgactgggttcatagattgacattactcatcactggtccagatggggaaaaggagaaagtcattttatc

SEQ ID NO: 38961 - DNA, 75 bp, Artificial Sequence
  Synthetic
ctctatggggacaaagtttcttagctggggtacagtatctttaacactagatgcagaaacaatttcaggaactaa

SEQ ID NO: 38962 - DNA, 75 bp, Artificial Sequence
  Synthetic
ctcctacagttttttagagagcagtagaggtggattcgccatctatgatgaggcattttctgaggttccgagaga

SEQ ID NO: 38963 - DNA, 75 bp, Artificial Sequence
  Synthetic
agggttcctgggagagattaggtgctcatctgaatcagcagctgtaactgcacactcttcatgtattagagcccc

SEQ ID NO: 38964 - DNA, 75 bp, Artificial Sequence
  Synthetic
aaatttaataaaatataaacccatgactgacatcattgaatgtactgcttcgctcattgatccgtttgcagcctt

SEQ ID NO: 38965 - DNA, 75 bp, Artificial Sequence
  Synthetic
tgttaagggttctttgcctcaggtgaggaatggaatgacatacacaagctcaatggacaaaaaaaccgtccaagc

SEQ ID NO: 38966 - DNA, 75 bp, Artificial Sequence
  Synthetic
tttcaatagtgggtcaatcagagctttactgaccatcactatggatgatcatgaaattgaatttctatcaaatgc

SEQ ID NO: 38967 - DNA, 75 bp, Artificial Sequence
  Synthetic
tgagaaatgtgatgcgactttcataaatataactggttgctactcatgcaattatggagcccgagtgtgtgtaag

SEQ ID NO: 38968 - DNA, 75 bp, Artificial Sequence
  Synthetic
aataaaagctcaaggaaactccaattttctagctgttaatgagaaagaatcattttatatgtcaataggagcatg

SEQ ID NO: 38969 - DNA, 75 bp, Artificial Sequence
  Synthetic
gacagggacaagagattactgtcaagtgatgcatttttcaacaccagaagtagacattaccacacaatactcttg

SEQ ID NO: 38970 - DNA, 75 bp, Artificial Sequence
  Synthetic
tggaggtgagagtagaccactcagagtgaagggtttgctaatatcattaggagtgtctgatctgagaaataatac

SEQ ID NO: 38971 - DNA, 75 bp, Artificial Sequence
  Synthetic
aggaggatcatcagtggtggtcaacccttctgagacaagatggaacctatctggatggctaagtgggctgacatc

SEQ ID NO: 38972 - DNA, 75 bp, Artificial Sequence
  Synthetic
ttggctaggagggacttgggcagcggttatgaaaataattctttttttattttttggctttttgatgctaattgt

SEQ ID NO: 38973 - DNA, 75 bp, Artificial Sequence
  Synthetic
gctattgttattcttaagatctttaggaatgtcattgttcaaaaagatcaagcttacttagaagcttgaaattca

SEQ ID NO: 38974 - DNA, 75 bp, Artificial Sequence
  Synthetic
aatctcttactaaaatcaacagagtaatctctcatctcgtcccacagtccaaaattcatcatgattatatcactc

SEQ ID NO: 38975 - DNA, 75 bp, Artificial Sequence
  Synthetic
attgatcatcaacgacatcaacaccccatcatagtggcagtagctgaaccattcatcaaacacattaaaacaaaa

SEQ ID NO: 38976 - DNA, 75 bp, Artificial Sequence
  Synthetic
gagaccatgtcttagttgagaggcaggtgaatccgctaatgtgagatattaatacgattgtagtgtgagatggcc

SEQ ID NO: 38977 - DNA, 75 bp, Artificial Sequence
  Synthetic
ttagttgagaggcaggtgaatccgctaatgtgagatattaatacgattgtagtgtgagatggccggtctttgtgt

SEQ ID NO: 38978 - DNA, 75 bp, Artificial Sequence
  Synthetic
gtgagcagaggaagtcattcctcaggaacctcggcattctagatgagaacatgcagccatccaatcctgtgaagg

SEQ ID NO: 38979 - DNA, 75 bp, Artificial Sequence
  Synthetic
catcaccacttctcataattagtgtcataagaaagcatttttcttcccaattaaattcatagctctctactaaag

SEQ ID NO: 38980 - DNA, 75 bp, Artificial Sequence
  Synthetic
cagataggcgtgccccagtaaccattgtatgctgaatactccacatacaccttagatctgtctgtcgcagatcta

SEQ ID NO: 38981 - DNA, 75 bp, Artificial Sequence
  Synthetic
gaaacacacaaagaagcccaaactatggaagaaatactaaacaaacaacaaatccccgagggggtaggattgttt

SEQ ID NO: 38982 - DNA, 75 bp, Artificial Sequence
  Synthetic
tggaagaaatactaaacaaacaacaaatccccgagggggtaggattgtttagaccagagataaagcaatacgatg

SEQ ID NO: 38983 - DNA, 75 bp, Artificial Sequence
  Synthetic
attctatcatggatgttgagataccattcttccacataactaagtgtgatggatacatgaaaatagatttggatc

SEQ ID NO: 38984 - DNA, 75 bp, Artificial Sequence
  Synthetic
taaataacggtgttgattattccactattgggtcatcattgatatccaccattgaagttccagataagtctcttc

SEQ ID NO: 38985 - DNA, 75 bp, Artificial Sequence
  Synthetic
ccaatcttgtccatgatgtggtcttctcacatcttgccagcagcactgatgtgaggttctcatcagtgtttggag

SEQ ID NO: 38986 - DNA, 75 bp, Artificial Sequence
  Synthetic
tgtatgctgattcttatgatcatctgtcccctgacttcattctaaaaacagctgccggatctcatcatgttgttg

SEQ ID NO: 38987 - DNA, 75 bp, Artificial Sequence
  Synthetic
aatttacgactaacaggggtggagagagaggggcttttcaggcatgcaaagacaagttttctaaatatcacattc

SEQ ID NO: 38988 - DNA, 75 bp, Artificial Sequence
  Synthetic
cttgtgagaatagagctgttggaggcagggtatctctttttgtagtttctgtttatgttaggggtgtgtggtcaa

SEQ ID NO: 38989 - DNA, 75 bp, Artificial Sequence
  Synthetic
atcttgatttaacagatgatgaagtcaatgaacttgtgtttagatttagactggcagtggccataatggaggagg

SEQ ID NO: 38990 - DNA, 75 bp, Artificial Sequence
  Synthetic
caaaaagatactatcctgaattaacagaagatgaaagtgagatgaccaagcaagagagagaaattcttggtattg

SEQ ID NO: 38991 - DNA, 75 bp, Artificial Sequence
  Synthetic
tgtcttcaatacaaatggactggaaagagactagcctgaagtttccacacttcaaagaaaaagtatttgaggatt

SEQ ID NO: 38992 - DNA, 75 bp, Artificial Sequence
  Synthetic
tcttgacaatgtctgcagatgaggaatatctctctggcataatatctgaggagattaccgcatgtcaagaggata

SEQ ID NO: 38993 - DNA, 75 bp, Artificial Sequence
  Synthetic
tgatggaatcaggattcattgggaaagtgacaggcattgatgagaggctcaaactgaatgaatcagagtgtaata

SEQ ID NO: 38994 - DNA, 75 bp, Artificial Sequence
  Synthetic
aaatgattgacagttacttgaagagtagaggacccaactgcagagacaaattggatagtaaatccacagtccaga

SEQ ID NO: 38995 - DNA, 75 bp, Artificial Sequence
  Synthetic
ttccgccatgggtgatgactgagtatttagatgggaaatctgtgtcttgtttgtcaggattcgaagtagagggag

SEQ ID NO: 38996 - DNA, 75 bp, Artificial Sequence
  Synthetic
atcacccgatgtgcaaaatatggagatccgtcacaatcgcagctgctatgggtgacatagatcgtgctgatgatg

SEQ ID NO: 38997 - DNA, 75 bp, Artificial Sequence
  Synthetic
atcctgagactgagctcaaaaaggccttagatggcagcatacaaaagagtgatgagagaagtagatatcatcgta

SEQ ID NO: 38998 - DNA, 75 bp, Artificial Sequence
  Synthetic
taaaactaaatttatctaatgaagagataatttatggtgcaactttgggtgttgaagggaaatctcataaaagca

SEQ ID NO: 38999 - DNA, 75 bp, Artificial Sequence
  Synthetic
atgcccaagttgaagagtcgagaaagagaagcaaacttggattttctctagaccacgacattacaaacttggaag

SEQ ID NO: 39000 - DNA, 75 bp, Artificial Sequence
  Synthetic
aatttattaataaacatgatcttgagttatttgcagaatccgatgattattttaaccctttccagattgactttg

SEQ ID NO: 39001 - DNA, 75 bp, Artificial Sequence
  Synthetic
acctgagagagtcagctcagaagatacatcagccagacttgatcatggaccaaggtgaaaatgagttcctagcaa

SEQ ID NO: 39002 - DNA, 75 bp, Artificial Sequence
  Synthetic
accacaagaaattgtgcatgtctaagctaggctcttggtgtcaaatggtttcactgattggtgcggaattatcag

SEQ ID NO: 39003 - DNA, 75 bp, Artificial Sequence
  Synthetic
catcagttaaacagcatgtggggaaaggacaatttgtgatcaaaagagtattgaattctcctcttttcatgctaa

SEQ ID NO: 39004 - DNA, 75 bp, Artificial Sequence
  Synthetic
tcaaacccacatcttctgttagtcatatttttgtttcttttgcactcgtgaaatctagtcacatgggagatctgt

SEQ ID NO: 39005 - DNA, 75 bp, Artificial Sequence
  Synthetic
gggataatggtgtcttcaagcattacatcgatgcaggagacttgttcatcactgattttatttcttacaagctta

SEQ ID NO: 39006 - DNA, 75 bp, Artificial Sequence
  Synthetic
gcaaactgaccaatctttgtaagtgtttccctcttatggagagtgcaatctgtttctggactgaaatatttggtt

SEQ ID NO: 39007 - DNA, 75 bp, Artificial Sequence
  Synthetic
ttgagccttggaattccacatacataatgtctacagacaggagtgggagttcaaaagaagcagcttcaatgatca

SEQ ID NO: 39008 - DNA, 75 bp, Artificial Sequence
  Synthetic
aactgactctgctaacacttatggaagataaagcagtcactgaagagattcagaccattcaaagatacataatta

SEQ ID NO: 39009 - DNA, 75 bp, Artificial Sequence
  Synthetic
tggaagggttcgtttctttgccagaactgccaaaaccacacaaaatgttgtcaaaactaccagctgtgctaaggt

SEQ ID NO: 39010 - DNA, 75 bp, Artificial Sequence
  Synthetic
cagagttgcaagtgtatctagtcttaaggtctctgagaacaatggaaagaatatctagacatccttttaggctgc

SEQ ID NO: 39011 - DNA, 75 bp, Artificial Sequence
  Synthetic
agaaaaaacatagccaaatctcctggtcagggctgttcaatcctttaactggaaactccctcagggagctccaac

SEQ ID NO: 39012 - DNA, 75 bp, Artificial Sequence
  Synthetic
cactaattagcatatgttataatggatatttcaaaaacaaggaggaagaaactgaaccctctgcattatcaagat

SEQ ID NO: 39013 - DNA, 75 bp, Artificial Sequence
  Synthetic
tatacaagaaaattattgaactagagcatctatgcccaactgatgacatctatttaggatcaggcgacccaaaag

SEQ ID NO: 39014 - DNA, 75 bp, Artificial Sequence
  Synthetic
agccaaagatgcatgagtttagcaggtcatttctaaaaaaatgtactgatcatgggaaaaccatattaagaaaaa

SEQ ID NO: 39015 - DNA, 75 bp, Artificial Sequence
  Synthetic
tctatggtcagaattttatgcagcagatagacactcagattatgagggagattagtaccatcactcttgaaaaac

SEQ ID NO: 39016 - DNA, 75 bp, Artificial Sequence
  Synthetic
ttgcaacattgaaagctagtagtaattttgatgagaagtggtatgactatgagaagtgcaacaaagaagactatc

SEQ ID NO: 39017 - DNA, 75 bp, Artificial Sequence
  Synthetic
atcgtgagaaggctattgttaagatgtctgaatttgctgcatctgggaagacattagctatagaagtctttgatg

SEQ ID NO: 39018 - DNA, 75 bp, Artificial Sequence
  Synthetic
aatgtatgaaatttgtggagaaaagaggcaacatgcacatctgtctttttaagaagcaacagcatggtggagata

SEQ ID NO: 39019 - DNA, 75 bp, Artificial Sequence
  Synthetic
gggagatttatgtcttgggtagagaagaaagaataattcaatctatagttgaggcaatatctaggtcaattggta

SEQ ID NO: 39020 - DNA, 75 bp, Artificial Sequence
  Synthetic
gattctttccctcagatactctgtgcaatcctggcaacaagattaaaatacctgaaacacacggaataagagcta

SEQ ID NO: 39021 - DNA, 75 bp, Artificial Sequence
  Synthetic
gaaaacactgtaaaggtgctgtgtggacttgttccacatctgatgacgctaggaaatggaatcaaggtcactttg

SEQ ID NO: 39022 - DNA, 75 bp, Artificial Sequence
  Synthetic
ttacaaaatttgctttaatgctgtgcgagttcacccttcctaaatggtggccaatcatcattaggggatgctcga

SEQ ID NO: 39023 - DNA, 75 bp, Artificial Sequence
  Synthetic
tgttcaccaacaaatacatgatgatgaacatgaggtatatcagcattttaagcaggcacaaggaattggatattg

SEQ ID NO: 39024 - DNA, 75 bp, Artificial Sequence
  Synthetic
aagatgagttttctagaactatattcaaagcttttcatggtgaggtgacagtgccatggatggatgcaggggcca

SEQ ID NO: 39025 - DNA, 75 bp, Artificial Sequence
  Synthetic
cctttctgaaaacaaaaacagggatgatgcaagggatattacatttcacctcttctctcttacacacacttcacc

SEQ ID NO: 39026 - DNA, 75 bp, Artificial Sequence
  Synthetic
aagaattcattaggtcattatcttttaaaatcttcaacaccaaagtgaggccagaaatgtcgcaatcagtagtga

SEQ ID NO: 39027 - DNA, 75 bp, Artificial Sequence
  Synthetic
ttgacatgatgcagggctctgatgatagcagcatgatgatcagcttcccatgttctaatgaagatcaactaatga

SEQ ID NO: 39028 - DNA, 75 bp, Artificial Sequence
  Synthetic
agtgtaagatagctgctgctatttgcttcaggataaagaaaagattaggagtcttcttagccatttatccttcag

SEQ ID NO: 39029 - DNA, 75 bp, Artificial Sequence
  Synthetic
aaaaatccacttctaatactgactttgtgatggaatataattcagagttcttcttccactctcagcatgtccgtc

SEQ ID NO: 39030 - DNA, 75 bp, Artificial Sequence
  Synthetic
caacagttaggtggatagctgcatgctgtaaccttcctgaagtagagactttagttgcaaggcaagaagaggctt

SEQ ID NO: 39031 - DNA, 75 bp, Artificial Sequence
  Synthetic
ctaacttgatgacttctgtgtcagaaggagggggctcattttccttagcagcttgtatccagcaggctcaatgta

SEQ ID NO: 39032 - DNA, 75 bp, Artificial Sequence
  Synthetic
ccctgcattacatgttgatggggatgggggtcagttctttatttgaagaatacaaaaaagcaatcatacggtgga

SEQ ID NO: 39033 - DNA, 75 bp, Artificial Sequence
  Synthetic
aggatcctggcctaggtttcttcttgctagataatccttactgtgcaggattaggaggattcaggttcaacctgt

SEQ ID NO: 39034 - DNA, 75 bp, Artificial Sequence
  Synthetic
ataaagccattgcccagacaccactaaaatgtctttattcatactttatgaagaaggtcagacacggtttagaga

SEQ ID NO: 39035 - DNA, 75 bp, Artificial Sequence
  Synthetic
ccaatgatgggacaataccagagagctgctcagtcagtccaggtggtgctattgtgttgagttcagcacttaggt

SEQ ID NO: 39036 - DNA, 75 bp, Artificial Sequence
  Synthetic
ggggctcaaaacaaaagttttacaaacttagagataagttgaatatccctgaagactggattgatcaaattaatc

SEQ ID NO: 39037 - DNA, 75 bp, Artificial Sequence
  Synthetic
aaaatccatctatattatacagagctcccagatctggtgaagaagtcattcttaggattgctgaaaaagtgcatt

SEQ ID NO: 39038 - DNA, 75 bp, Artificial Sequence
  Synthetic
cacctggagttgtttcatccttatcaacaggcaatgcagtggccaaggtcattgcctcatctgtgtatttcctaa

SEQ ID NO: 39039 - DNA, 75 bp, Artificial Sequence
  Synthetic
gtgcagccatattccaggactctggcagacaagaattctccattttagatgactcaaagtacagcttattgcaaa

SEQ ID NO: 39040 - DNA, 75 bp, Artificial Sequence
  Synthetic
agctgagtaagctagaaggaattaatctaaccaatgcaatcagtgatgaagatctattgttcttatttccaaaca

SEQ ID NO: 39041 - DNA, 75 bp, Artificial Sequence
  Synthetic
ttgaagatctgcaatctcttgatagtttggtgtataatcgaggagctattgagattgtaaaaagaaaacagataa

SEQ ID NO: 39042 - DNA, 75 bp, Artificial Sequence
  Synthetic
aagaaaacacacagtctagagttatcgtctttgagggaaacagaaatctcagaacccctgctgagtatttaataa

SEQ ID NO: 39043 - DNA, 75 bp, Artificial Sequence
  Synthetic
gtgataaatggtttgggactcagaaaagcaaaattgggagaacagcatttgaccaagagtgggtcaaggttacat

SEQ ID NO: 39044 - DNA, 75 bp, Artificial Sequence
  Synthetic
caatcatcccctggctaagagaaagcccacaagaaactcttcagagctctccactggacaatcacatccaaataa

SEQ ID NO: 39045 - DNA, 75 bp, Artificial Sequence
  Synthetic
gaaatttcttctctaggatggatcaaaagccgagggtagttagagtaacaggtgcaccaataaagaaaaggtcag

SEQ ID NO: 39046 - DNA, 75 bp, Artificial Sequence
  Synthetic
gagtcagcaagttgtcgatggtcataagagataacttctcaaaattaggatttattagagacatagaagatataa

SEQ ID NO: 39047 - DNA, 75 bp, Artificial Sequence
  Synthetic
ctggaacaagtagaacaaattctgcagagttgctcaaacacttcatgttttgtgctctacagggtccatattccc

SEQ ID NO: 39048 - DNA, 75 bp, Artificial Sequence
  Synthetic
aggagagaaaacttcagatggtgatagacctcttaaataaatcaaatcctataggcatcaaagacagtgatggaa

SEQ ID NO: 39049 - DNA, 75 bp, Artificial Sequence
  Synthetic
aatcacgatcaaacattttagctattttacagagttatgtgtatagagaaccacatattgcacgacaaattgaag

SEQ ID NO: 39050 - DNA, 75 bp, Artificial Sequence
  Synthetic
atgctggtgctggaattatcggagggtttgtggttcctcaaaaaccaaaaaagattgaaaacacaatatattatt

SEQ ID NO: 39051 - DNA, 75 bp, Artificial Sequence
  Synthetic
atggttatggtgtatggagaggagtgatggatggaaaacaagtgcaaatcgaacttgacaatgcagtgggcagcc

SEQ ID NO: 39052 - DNA, 75 bp, Artificial Sequence
  Synthetic
ctcctgttataatatctgtcactatggaagagtctgctgaaccctggcaaatatgcaagagtataaggtcatggg

SEQ ID NO: 39053 - DNA, 75 bp, Artificial Sequence
  Synthetic
ctgaggatgtgggtgcaaaaaacaatttggatatttccccaaagataaaaaagaggacttgcaaatactggatgt

SEQ ID NO: 39054 - DNA, 75 bp, Artificial Sequence
  Synthetic
ttgactttaaaacattctcttcagacaaagcatatggtgctcctgtttacatgacgaagaagaagatggttgatt

SEQ ID NO: 39055 - DNA, 75 bp, Artificial Sequence
  Synthetic
ttagactaattgatgatgcagaaataagtataaaagttaggaaatccaccgtgaatttgtatgtcagaagtgatg

SEQ ID NO: 39056 - DNA, 75 bp, Artificial Sequence
  Synthetic
gcagagatgtccacatactctcttactcagcatcagactcagatctcagccctgcaagcttgaggattaatgatg

SEQ ID NO: 39057 - DNA, 75 bp, Artificial Sequence
  Synthetic
agtccaaggatgaaatgatggaattattcaataaagagcctagcaagtcttgggcgtcatgctcaccaatcccgg

SEQ ID NO: 39058 - DNA, 75 bp, Artificial Sequence
  Synthetic
ctatcatgatgcacaagatcatcaaagttgtccaaggggaacttaaaatatcatcgttagacagtggtagactgg

SEQ ID NO: 39059 - DNA, 75 bp, Artificial Sequence
  Synthetic
gagagatcatgaaattgtgctgtgaatcatctttgcgatccagaattgggactttattttctgctcttccaagtg

SEQ ID NO: 39060 - DNA, 75 bp, Artificial Sequence
  Synthetic
tgcaaaacacctctagggttgatgtcgatgacctgatagatattgttttgactgactcaaagacagctggcttca

SEQ ID NO: 39061 - DNA, 75 bp, Artificial Sequence
  Synthetic
gagaaattgtgcagtcactagaaaatgacataaaagatgagtacgaggtggaagactttgacttatctgatatag

SEQ ID NO: 39062 - DNA, 75 bp, Artificial Sequence
  Synthetic
acttattcggaccagcacattataaagaattgtcagacctgaacaccataagtcatcccttaatggatgactatg

SEQ ID NO: 39063 - DNA, 75 bp, Artificial Sequence
  Synthetic
tagagttctgtatatcaacagttggtcgaaaggagctgagacggatattggagaccaatagatgtaaaactaaag

SEQ ID NO: 39064 - DNA, 75 bp, Artificial Sequence
  Synthetic
acttacaattgtctaaggatctctttttggtattaggcaggaatccagatgatattaaagtggatgaatataact

SEQ ID NO: 39065 - DNA, 75 bp, Artificial Sequence
  Synthetic
taagagagcaaatggcagtggaagacgacatgataggataagatcctacaacatgtcattaagtgcgaacacaaa

SEQ ID NO: 39066 - DNA, 75 bp, Artificial Sequence
  Synthetic
agagagcaaatggcagtggaagacgacatgataggataagatcctacaacatgtcattaagtgcgaacacaaagt

SEQ ID NO: 39067 - DNA, 75 bp, Artificial Sequence
  Synthetic
acacaaagaagcccaaactatggaagaaatacttaacaaacaacaaatccctgagggtgtcggactgttcagacc

SEQ ID NO: 39068 - DNA, 75 bp, Artificial Sequence
  Synthetic
tgaaataaaacagtacgacgattccatcatggacgttgaaataccattctttcatttaactaaatgtgatggata

SEQ ID NO: 39069 - DNA, 75 bp, Artificial Sequence
  Synthetic
tatgaagattgatctagacctgaacaacggtgtcgactattcaacaattgggtcgtctctaatatccaccataga

SEQ ID NO: 39070 - DNA, 75 bp, Artificial Sequence
  Synthetic
agtgcctgataaatctctgccaaatctagtacatgatgttgtcttctcccatcttgctagtagcactgacattag

SEQ ID NO: 39071 - DNA, 75 bp, Artificial Sequence
  Synthetic
attctcaacagtcttcggagtgtttgctgattcatatgaccacttgtctcctgactttattttaaagactgctgc

SEQ ID NO: 39072 - DNA, 75 bp, Artificial Sequence
  Synthetic
tggatcacatcatgttgttgagttcacaaccaatagaggcggagaaaggggggcttttcaggcctgtaaagataa

SEQ ID NO: 39073 - DNA, 75 bp, Artificial Sequence
  Synthetic
gttttcaaaatatcatatcccgtgtgagaatagagctgtgggaagtagagtatccctatttgtgatctctgtgta

SEQ ID NO: 39074 - DNA, 75 bp, Artificial Sequence
  Synthetic
tgttagaggagtatggtctaaccttgatctgacagatgatgaggttaatgaactggtatttagatttcgactcgc

SEQ ID NO: 39075 - DNA, 75 bp, Artificial Sequence
  Synthetic
agtagcaattatggaggaggcaaaaaggtattaccctgaactcactgaagatgaaagtgagatgacaaaacagga

SEQ ID NO: 39076 - DNA, 75 bp, Artificial Sequence
  Synthetic
gagagagatactaggcattgtatcctctatacaaatggactggaaagagaccagctcgaagtttcctcactttaa

SEQ ID NO: 39077 - DNA, 75 bp, Artificial Sequence
  Synthetic
agaaaagatgtttgaagaattcttaacaacatctgctgatgaggaatatttatccggtgtcatatcagaggagat

SEQ ID NO: 39078 - DNA, 75 bp, Artificial Sequence
  Synthetic
aacagcatgtcaagaagacatgatagagtctgggtttattgggaaggtcactggaattgaggaaaaacttaccct

SEQ ID NO: 39079 - DNA, 75 bp, Artificial Sequence
  Synthetic
aaatgagtcggagtgtaacaagatgattgacagctacctaaagagcagggggtctaactgcagagacagattaga

SEQ ID NO: 39080 - DNA, 75 bp, Artificial Sequence
  Synthetic
tggcaaatccactgttcaaattccaccatggataatgactgaatatctagatggcaaatcagtctcttgcttgtc

SEQ ID NO: 39081 - DNA, 75 bp, Artificial Sequence
  Synthetic
aggttttgatgttgaaggagaacatcccatgtgtaagatatggagatctgtaactatagcagcagctatgggcga

SEQ ID NO: 39082 - DNA, 75 bp, Artificial Sequence
  Synthetic
cattgatagagcagatgatgatccctcaactgaattaaagaaagctctagatggcagcatacaaaagagtgatga

SEQ ID NO: 39083 - DNA, 75 bp, Artificial Sequence
  Synthetic
gagaagtaggtatcaccgaataaagttaaatctatcaaatgaggaaatagtttatggagccactctaggtgttga

SEQ ID NO: 39084 - DNA, 75 bp, Artificial Sequence
  Synthetic
agggaagtcccataagaataatgctcaggtagaagaatctagaaagagaagcaagcttggattttccttagatca

SEQ ID NO: 39085 - DNA, 75 bp, Artificial Sequence
  Synthetic
cgatatcacaaacttagaggaattcattaacaagcatgatttagaattatttgcagaatctgatgactattttaa

SEQ ID NO: 39086 - DNA, 75 bp, Artificial Sequence
  Synthetic
tcctttccagactgattttgacttgagggaatcagctcagaaaatacatcagccagatctaataatggatttagg

SEQ ID NO: 39087 - DNA, 75 bp, Artificial Sequence
  Synthetic
tgagaatgagtttcttgcaaatcataaaagattatgtgcatccaagttgggctcttggtgtcaagtggtctctct

SEQ ID NO: 39088 - DNA, 75 bp, Artificial Sequence
  Synthetic
aattggagctgaattatcagcatctgtaaagcagcatgtaggtaaaggtcagtttgtcataaagagagttctgaa

SEQ ID NO: 39089 - DNA, 75 bp, Artificial Sequence
  Synthetic
ttctcctctcttcatgcttatcaagcccacatcttcagttagtcatatattcgtatcatttgcacttgtgaaatc

SEQ ID NO: 39090 - DNA, 75 bp, Artificial Sequence
  Synthetic
tagtcacatgggagatctatgggataatggtgtcttcaaacactacattgatgcaggtgacttgtttgtgactga

SEQ ID NO: 39091 - DNA, 75 bp, Artificial Sequence
  Synthetic
tttcatttcttataagctgagtaaattaaccaacctctgcaaatgctttccactgatggaaagtgctatctgttt

SEQ ID NO: 39092 - DNA, 75 bp, Artificial Sequence
  Synthetic
ttggactgaaatattcggatttgagccatggaattctacacatataatgtctactgacaggagtggtagctccaa

SEQ ID NO: 39093 - DNA, 75 bp, Artificial Sequence
  Synthetic
agaagcagcatcgatgatcaagttaactctactgaccttgatggaagataaggctgtcactgaagaaattcaaac

SEQ ID NO: 39094 - DNA, 75 bp, Artificial Sequence
  Synthetic
aattcagagatacataattatggaaggatttgtgtcattgccagagctgcccaaacctcataagatgctgtcaaa

SEQ ID NO: 39095 - DNA, 75 bp, Artificial Sequence
  Synthetic
attcccagctgtcttgagatctgaactgcaagtttatctggttctgaggtctttaagaacaatggagagaatttc

SEQ ID NO: 39096 - DNA, 75 bp, Artificial Sequence
  Synthetic
taaacatccctttagacttcagaaaaagcatagtcagatcacttggtctggtttgtttaaccccttgactgggaa

SEQ ID NO: 39097 - DNA, 75 bp, Artificial Sequence
  Synthetic
ttctctcagagaattacaaccgttaatcagcatatgttataatggatacttcaaaaataaagaggaagaaacaga

SEQ ID NO: 39098 - DNA, 75 bp, Artificial Sequence
  Synthetic
accatctgctttatcaaggttgtataagaaaataattgagctagagcatctatgtccgactaatgatgtgtatct

SEQ ID NO: 39099 - DNA, 75 bp, Artificial Sequence
  Synthetic
gggatcaggtgacccaaagaatcccaaaatgcatgaatttagcagatcgttcctgaagaagtgtgcagatcacgg

SEQ ID NO: 39100 - DNA, 75 bp, Artificial Sequence
  Synthetic
aaagaccatcttgagaaagatatatggacagaatttcatgcagcagatagacactcaaattatgagagagataag

SEQ ID NO: 39101 - DNA, 75 bp, Artificial Sequence
  Synthetic
ctctataactctggagaaattagcaacattaaaagccagtagcaattttgatgaaaaatggtatgattacgaaaa

SEQ ID NO: 39102 - DNA, 75 bp, Artificial Sequence
  Synthetic
atgtaataaagaagattaccatcgtgagaaagcaatagtcaaaatgtctgagtttgctgcatctggaaaaactct

SEQ ID NO: 39103 - DNA, 75 bp, Artificial Sequence
  Synthetic
agcaatagaggtttttgatgagtgcatgaaattcgttgaaagaagagggaatatgcacatttgccttttcaagaa

SEQ ID NO: 39104 - DNA, 75 bp, Artificial Sequence
  Synthetic
gcagcaacatggaggtgacagagaaatatatgttcttggccgagaggaaagagtcatacaatcaatagttgaagc

SEQ ID NO: 39105 - DNA, 75 bp, Artificial Sequence
  Synthetic
aatatcaaggtctataggtaggttcttcccatctgacactttatgcaatcctggcaacaagataaagatacctga

SEQ ID NO: 39106 - DNA, 75 bp, Artificial Sequence
  Synthetic
aacgcatgggataagggctcgaaagcattgtaaaggtgcagtatggacctgctccacatcagacgatgcaagaaa

SEQ ID NO: 39107 - DNA, 75 bp, Artificial Sequence
  Synthetic
atggaatcagggacacttcgttactaaatttgcattaatgttgtgtgaattcacactcccaaagtggtggcctat

SEQ ID NO: 39108 - DNA, 75 bp, Artificial Sequence
  Synthetic
catcattagaggatgctcaatgttcacaaacaagtatatgatgatgaacatgagatatattagcatattaagtag

SEQ ID NO: 39109 - DNA, 75 bp, Artificial Sequence
  Synthetic
gcataaagagctagagatagaagatgaattctctagaactattttcaaagcttttcatggtgaagtaaaagtccc

SEQ ID NO: 39110 - DNA, 75 bp, Artificial Sequence
  Synthetic
ttggatggatgcaggctctaccttcttgaaaaccaagactgggatgatgcagggaatactacattttacttcatc

SEQ ID NO: 39111 - DNA, 75 bp, Artificial Sequence
  Synthetic
ccttttacacactctccatcaggaatttataagatctttatcatttaagatcttcaatactaaggttaggccaga

SEQ ID NO: 39112 - DNA, 75 bp, Artificial Sequence
  Synthetic
aatgtctcagtctgtggtgattgatatgatgcagggctctgatgacagcagtatgatgattagctttccatgctc

SEQ ID NO: 39113 - DNA, 75 bp, Artificial Sequence
  Synthetic
caatgaagatgagttaatgaaatgcaaaatagcagcagctatctgttttaggataaaaaagagactgggagtttt

SEQ ID NO: 39114 - DNA, 75 bp, Artificial Sequence
  Synthetic
tcttgctatttatccatcagaaaaatcaacatcaaacactgactttgtgatggagtacaattcggaattcttctt

SEQ ID NO: 39115 - DNA, 75 bp, Artificial Sequence
  Synthetic
ccattctcagcatgttagaccaactgttaggtgggtggctgcatgctgcaatctgcctgaagttgaaactcttgt

SEQ ID NO: 39116 - DNA, 75 bp, Artificial Sequence
  Synthetic
ggctagacaggaagaggcctctaatctaatgacttcagtctcagaaggaggtggttcattttctttagctgcctg

SEQ ID NO: 39117 - DNA, 75 bp, Artificial Sequence
  Synthetic
catacaacaagcccagtgcactttgcactacatgctgatgggaatgggtgttagttcattatttgaagaatataa

SEQ ID NO: 39118 - DNA, 75 bp, Artificial Sequence
  Synthetic
gaaagcaatcatccgatggaaagatcctggcttaggtttcttcttattagacaatccttactgtgcaggattagg

SEQ ID NO: 39119 - DNA, 75 bp, Artificial Sequence
  Synthetic
aggattcagattcaatctatacaaagctatagctcaaacaccgctcaagtgtctatactcttatttcatgaagaa

SEQ ID NO: 39120 - DNA, 75 bp, Artificial Sequence
  Synthetic
agttagacatggtctagaaactaatgatggaacaattccagagagttgctcagtcagcccaggcggtgctattgt

SEQ ID NO: 39121 - DNA, 75 bp, Artificial Sequence
  Synthetic
gctaagttcagctctaaggtgggggtcaaaacagaagttttacaaattaagagacaaactgaatatacctgaaga

SEQ ID NO: 39122 - DNA, 75 bp, Artificial Sequence
  Synthetic
ctggatcgaccagataaatcagaatccttctgtactgtatagagctcctagatcaggtgaggaggttattctcag

SEQ ID NO: 39123 - DNA, 75 bp, Artificial Sequence
  Synthetic
aattgctgagaaagtacattcccctggagttgtgtcatctctatcaactggcaatgcagttgcaaaggttattgc

SEQ ID NO: 39124 - DNA, 75 bp, Artificial Sequence
  Synthetic
atcatcagtctatttcctcagtgcagccattttccaggactctggcaggcaggagttctcaattttggataattc

SEQ ID NO: 39125 - DNA, 75 bp, Artificial Sequence
  Synthetic
aaaatatagcttactgcagaaactaagcaaattagagggcatcaatctcaccaatgcaataagtgatgaagatct

SEQ ID NO: 39126 - DNA, 75 bp, Artificial Sequence
  Synthetic
attgttcttgtttccaaatatagaagaccttcagtctcttgatagcttggtgtacaacagaggagcaattgagat

SEQ ID NO: 39127 - DNA, 75 bp, Artificial Sequence
  Synthetic
tgtcaaaagaaagcaggttaaagaaaatactcagtccagggtgattgtgtttgaagggaatagaaatttgagaac

SEQ ID NO: 39128 - DNA, 75 bp, Artificial Sequence
  Synthetic
tccagcagagtacttaataagtgataagtggtttggaacccagaaaagcaaaattggcaggacagcatttgatca

SEQ ID NO: 39129 - DNA, 75 bp, Artificial Sequence
  Synthetic
agaatgggaaaaggtgacttcgatcatcccttggctaaaggagagccctcaagaaaccttaacaagctcgccact

SEQ ID NO: 39130 - DNA, 75 bp, Artificial Sequence
  Synthetic
agacaatcacatccagatcaggaatttcttctccaggatggaccaaaagccaagaatagttagagtcacgggtgc

SEQ ID NO: 39131 - DNA, 75 bp, Artificial Sequence
  Synthetic
acctatcaagaagagatcaggggtaagcaagttatcaatggtaataagagacaatttctcaaaattaggattcat

SEQ ID NO: 39132 - DNA, 75 bp, Artificial Sequence
  Synthetic
tagggatatagaagacatatctggaacaagtagaacaaactcagcagagatgcttaaacacttcatgttctgtgc

SEQ ID NO: 39133 - DNA, 75 bp, Artificial Sequence
  Synthetic
attgcagggcccatactcacaagagagaaagctacagatggtgatagatttactgagtaagtcaaatccaatcgg

SEQ ID NO: 39134 - DNA, 75 bp, Artificial Sequence
  Synthetic
ggtaaaggatagtgatggcaagtctagatcgaacattctggcaatattgcaaagttatgtgtatcaggaaccaca

SEQ ID NO: 39135 - DNA, 75 bp, Artificial Sequence
  Synthetic
cattgcaagacaaattgaagatgcaggtgccggaatcataggagggtttgtggttcctcagaagcctaagaagat

SEQ ID NO: 39136 - DNA, 75 bp, Artificial Sequence
  Synthetic
tgaaaatactatttattattatgggtatggagtttggagaggagtcatggatggaaagcaagttcagatagagtt

SEQ ID NO: 39137 - DNA, 75 bp, Artificial Sequence
  Synthetic
agacaatgcagtaggcagccccccagtcataatttcagtcaccatggaagaatcagctgaaccttggcagatatg

SEQ ID NO: 39138 - DNA, 75 bp, Artificial Sequence
  Synthetic
taaaagcataaggtcttgggcagatgatgtgggagcaaagaataatttggacatatcccctaaaattaagagaag

SEQ ID NO: 39139 - DNA, 75 bp, Artificial Sequence
  Synthetic
aacttgcaaatactggatgtttgactttaagacattctcgtcggacaaggcgtatggagcaccagtgtacatgac

SEQ ID NO: 39140 - DNA, 75 bp, Artificial Sequence
  Synthetic
aaagaagaaaatggttgattttagattgattgatgacacagaaataaacataaaggttagaaaatcaacagtaaa

SEQ ID NO: 39141 - DNA, 75 bp, Artificial Sequence
  Synthetic
tttgtatgtcaggaatgatggtagagatgtccacatactgtcttattcagcatcagactcagaccttagtcctgc

SEQ ID NO: 39142 - DNA, 75 bp, Artificial Sequence
  Synthetic
aagtctcagaattagtgatgagtcaaaggatgagatgatggacttatttagcaaagagcctagcaaatcatgggc

SEQ ID NO: 39143 - DNA, 75 bp, Artificial Sequence
  Synthetic
atcgtgttctcctattccagctatcatgatgcataagatcataaaagttgttcagggcgagctgaaaattgcatc

SEQ ID NO: 39144 - DNA, 75 bp, Artificial Sequence
  Synthetic
gctagacagtaacagattaggtgagattatgaagctatgttgtgagtcatcactgagatctaggataggcacttt

SEQ ID NO: 39145 - DNA, 75 bp, Artificial Sequence
  Synthetic
gttttctgctctacccagtgtccaaaacacatccagagtagatgtagatgatctgattgatattgtgttaacaga

SEQ ID NO: 39146 - DNA, 75 bp, Artificial Sequence
  Synthetic
ctcaaaaactgcaggattcaaagaaattgtacagtcactggaaaatgacataaaggatgagtatgaaatcgaaga

SEQ ID NO: 39147 - DNA, 75 bp, Artificial Sequence
  Synthetic
ttttgacttgtccgatatagacttgtttggacctgctcattacaaagaactatctgatttaaacacaataagtca

SEQ ID NO: 39148 - DNA, 75 bp, Artificial Sequence
  Synthetic
tcccttaatggatgattatgtggaattctgcatttcaacaattgggagaaaggaattgagaaggatactagagac

SEQ ID NO: 39149 - DNA, 75 bp, Artificial Sequence
  Synthetic
aaacagatgtaaaactaaggatcttcagctatctaaggacttgtttttggtgttgggtagaaatccagatgatat

SEQ ID NO: 39150 - DNA, 75 bp, Artificial Sequence
  Synthetic
taaagttgatgagtataacataagagaacaaatggcagtggaagacgatatgataggatagtattcaacaacaat

SEQ ID NO: 39151 - DNA, 75 bp, Artificial Sequence
  Synthetic
tctataagtgtgaacacaaagtccgcccataattgaacacttttcaatattttataatccaatccctcacttgag

SEQ ID NO: 39152 - DNA, 75 bp, Artificial Sequence
  Synthetic
cacttttcaatattttataatccaatccctcacttgagggcaagtgttcaagaatgggaagaccttgtgttcaca

SEQ ID NO: 39153 - DNA, 75 bp, Artificial Sequence
  Synthetic
tcttatgaaaaacttgctgttgatatcgccggccatgagattgatgccgacactatcaaagcctgggtgcaagct

SEQ ID NO: 39154 - DNA, 75 bp, Artificial Sequence
  Synthetic
tttgcttatcaaggctttgatgctaagagggttatggagttgctggtagagagaggtggagatgactgggttgaa

SEQ ID NO: 39155 - DNA, 75 bp, Artificial Sequence
  Synthetic
gatgctaagcagatgattattctgtgccttacaagaggaaacaagccctccaagatgatggtgaagatgtcagag

SEQ ID NO: 39156 - DNA, 75 bp, Artificial Sequence
  Synthetic
aagggcaagaaaattgttcaagcccttgtcaagagatattctctcaaggagggcaacccttctagagatgatttg

SEQ ID NO: 39157 - DNA, 75 bp, Artificial Sequence
  Synthetic
acactgtctagagtgactgctgctttagctggatacacctgccaggccacagaatatgttgaagagtttctgcct

SEQ ID NO: 39158 - DNA, 75 bp, Artificial Sequence
  Synthetic
gtcactgggaagaacatggatgatctatccaagaactaccccagggcaatgatgcaccccagctttgcaggactc

SEQ ID NO: 39159 - DNA, 75 bp, Artificial Sequence
  Synthetic
attgatcccaaacttcccccagatgtgctgtcaacaatctgtgacgcatttagcctctttatggtccagttctcc

SEQ ID NO: 39160 - DNA, 75 bp, Artificial Sequence
  Synthetic
aggaccataaaccccaggaatagaggattgtctgtgtcagaagtggctagcacttttgacagaccgataaatgca

SEQ ID NO: 39161 - DNA, 75 bp, Artificial Sequence
  Synthetic
gccatgaatagctcattcattagtggtgagcagaggaagtcattcctccgaaacctcggcattctcgatgagaac

SEQ ID NO: 39162 - DNA, 75 bp, Artificial Sequence
  Synthetic
gtgagcagaggaagtcattcctccgaaacctcggcattctcgatgagaacatgcagccctctaatcctgtgaagg

SEQ ID NO: 39163 - DNA, 75 bp, Artificial Sequence
  Synthetic
ctgctgccaaggttttccggggtctgaaataatctgccccattaatttctctgatttgcataattgcatgttaat

SEQ ID NO: 39164 - DNA, 75 bp, Artificial Sequence
  Synthetic
tggttataatccccacccaacaatttgactttaattttccttaattcacccaccttaattaaagcaattaaatca

SEQ ID NO: 39165 - DNA, 75 bp, Artificial Sequence
  Synthetic
attaaatatatcaataaaataaaataaatcaaataaattaatcaaaattaatcatagtaaattaacccacctcaa

SEQ ID NO: 39166 - DNA, 75 bp, Artificial Sequence
  Synthetic
ttaccctcaccccacctggcagctggtccgtctatttccatgtcttcttcagagtccagatctgagtcccatgaa

SEQ ID NO: 39167 - DNA, 75 bp, Artificial Sequence
  Synthetic
tcggcaattctggtatatctggggctcatggtgtgtagtggggtccatttcctattccctaacagatgtggggtt

SEQ ID NO: 39168 - DNA, 75 bp, Artificial Sequence
  Synthetic
atcacctctgatagctctttgacatagtcatataatgaggagtggaaatctgattcataataatcatagggcaga

SEQ ID NO: 39169 - DNA, 75 bp, Artificial Sequence
  Synthetic
gcagtgagcattctaagaacttgaacatatgcaatctctttttcaatattttgaccagtgaaatttaaacatggt

SEQ ID NO: 39170 - DNA, 75 bp, Artificial Sequence
  Synthetic
atatctctttcacctagttctctgattagttttttatacagattgacaagagaatcatctatttgagccccatca

SEQ ID NO: 39171 - DNA, 75 bp, Artificial Sequence
  Synthetic
ccacttctcataatcagagtcatgagaaaacacttttcttcccagttaaattcatagctctctactaaagaaagc

SEQ ID NO: 39172 - DNA, 75 bp, Artificial Sequence
  Synthetic
ttgaagaatgctagagtgggaacacccaagggccaactgagtgcttctttaaggttaggttctgaccacttaagc

SEQ ID NO: 39173 - DNA, 75 bp, Artificial Sequence
  Synthetic
tgtctctccaagttaaggtgtgaaatcttctcaattgtggtatcaaagaatgagggcgacttccccttcacctga

SEQ ID NO: 39174 - DNA, 75 bp, Artificial Sequence
  Synthetic
agaaagggttttccccatgatcttgggagctggcctttatctatgaagcttcttaaacggaaagaagtcttgtca

SEQ ID NO: 39175 - DNA, 75 bp, Artificial Sequence
  Synthetic
gaaactgtaaatgaagaacatggaaattcagctcctttatacctgcagataggagttccccagtatccattgtat

SEQ ID NO: 39176 - DNA, 75 bp, Artificial Sequence
  Synthetic
gctgaatactccacatacactttggatctgtctgttgcagatctagttatatgtggtatgtcaaagacgttattc

SEQ ID NO: 39177 - DNA, 75 bp, Artificial Sequence
  Synthetic
ctagttatatgtggtatgtcaaagacgttattcagcatgttagacatgatttattttcgtcactttttcgatctc

SEQ ID NO: 39178 - DNA, 75 bp, Artificial Sequence
  Synthetic
tacaccaagatgtcttatgaaaaacttgctgttgatatcgccggccatgagattgatgccgacactatcaaagcc

SEQ ID NO: 39179 - DNA, 75 bp, Artificial Sequence
  Synthetic
gaaacacaaagctcctcaaggattttaacaaagtaagaataacaagcataatgtcatttgaacaacttgccatcg

SEQ ID NO: 39180 - DNA, 75 bp, Artificial Sequence
  Synthetic
aattagctggtcatgaagtggatgctaataccattgcttcatgggtgcaggcatttgcgtaccaaggtttcgacg

SEQ ID NO: 39181 - DNA, 75 bp, Artificial Sequence
  Synthetic
cccgtcgggtgatcgaattactgaagaccagagggggtgacacctggatggaagatgcgaagcagatgatcatcc

SEQ ID NO: 39182 - DNA, 75 bp, Artificial Sequence
  Synthetic
tatgcttgaccagaggaaacaagccatcaaagatggtgaacaaaatgtcagaaaagggcaagaagattgtcaatg

SEQ ID NO: 39183 - DNA, 75 bp, Artificial Sequence
  Synthetic
gcctgataaaaaaatattctctaaaagagggtaatccatctcgagatgatctgactctgtccaggattacagctg

SEQ ID NO: 39184 - DNA, 75 bp, Artificial Sequence
  Synthetic
cacttgcaggttatacttgccaagccactgaagtggttgaggagtatctgcctgttacagggaggcatatggacg

SEQ ID NO: 39185 - DNA, 75 bp, Artificial Sequence
  Synthetic
gattgtctaaaaactaccctagaccgatgatgcatcctagttttgctggattgatagatcccagcctgccttctg

SEQ ID NO: 39186 - DNA, 75 bp, Artificial Sequence
  Synthetic
acgtgctgtcctttatcactgatgctttcagcctcttcatggtccagttctctaggacaatcaaccccagaaaca

SEQ ID NO: 39187 - DNA, 75 bp, Artificial Sequence
  Synthetic
gagggctgagcacggctgaagtggttagcacatttgacagacccatgaatgctgccatcaatagctccttcctga

SEQ ID NO: 39188 - DNA, 75 bp, Artificial Sequence
  Synthetic
gtcacgaacaaaggaaatcatttttgaagaatctggggatccttgactccaacatgcaggctgctgagcacgtca

SEQ ID NO: 39189 - DNA, 75 bp, Artificial Sequence
  Synthetic
aggctgctgccaaggtgttcagaaatcagaagtaattaatagctaattatagcctattaatcatcattgattgaa

SEQ ID NO: 39190 - DNA, 75 bp, Artificial Sequence
  Synthetic
ttccttgaaattaaatggattaaaataaagctaaaaaccagaaaaaaacaaaaaaacaacaaaacccaataaaaa

SEQ ID NO: 39191 - DNA, 75 bp, Artificial Sequence
  Synthetic
gaaacccatgacctactcccctttatccttccccaaccccagacaacaggcagccccgtagtcttcggtttccat

SEQ ID NO: 39192 - DNA, 75 bp, Artificial Sequence
  Synthetic
aggttcttctgggtccaagtctgaatcccagtcatccactaatctatcaaataatggatccattgtgcatagagg

SEQ ID NO: 39193 - DNA, 75 bp, Artificial Sequence
  Synthetic
tttccattttctatttccaagcagatctggggagatcactaaggagagttccttaacatagtcgtagatcataga

SEQ ID NO: 39194 - DNA, 75 bp, Artificial Sequence
  Synthetic
atgaaattcagattcataataatcataaggtagtgctgtcagcatcctcaagatttgcacataagcaatctcctt

SEQ ID NO: 39195 - DNA, 75 bp, Artificial Sequence
  Synthetic
ttctataaattgtccagtaaagttgaggtggcttatgtccctctcattcaactccactatcattttcttatacag

SEQ ID NO: 39196 - DNA, 75 bp, Artificial Sequence
  Synthetic
atttactaatgaatcatctatctgctccccttctccgcatctcatgactagggtcatgaagtagcatttctcttc

SEQ ID NO: 39197 - DNA, 75 bp, Artificial Sequence
  Synthetic
ccaattgtaatcatagctttcaactctggacagtttgaaaaatgcaagcgttggcactcctaaaggccagctgag

SEQ ID NO: 39198 - DNA, 75 bp, Artificial Sequence
  Synthetic
ggcttctttgatgttgggctctgaccatttaagctgtctctctatatttaaatatgagatcttttctatagttgt

SEQ ID NO: 39199 - DNA, 75 bp, Artificial Sequence
  Synthetic
gtcaaaaaaagatggtgattttcctcttacttgcaggaaaggtttgccccaagcctttgggagttgtcccttttc

SEQ ID NO: 39200 - DNA, 75 bp, Artificial Sequence
  Synthetic
aataaagttcagcaatctgtaagatgatctttcagacacagcaaaagaagaacatggaaactcagcacctctgta

SEQ ID NO: 39201 - DNA, 75 bp, Artificial Sequence
  Synthetic
tctacaaataggagtatgataggatccgttgtgagcagaatactccacatacactctggatctatccgtagcgga

SEQ ID NO: 39202 - DNA, 75 bp, Artificial Sequence
  Synthetic
tctagtaatgtgtggtagatcaaaagcatagcacagcaactgactcatatttgctagtgttctgtgtttatatct

SEQ ID NO: 39203 - DNA, 75 bp, Artificial Sequence
  Synthetic
atcaaaagcatagcacagcaactgactcatatttgctagtgttctgtgtttatatctcaagaggggactttgtgt

SEQ ID NO: 39204 - DNA, 75 bp, Artificial Sequence
  Synthetic
acacaaagctcctcaaggattgttaacaagtgaatatctaacattttctaataatgtcttttgaagaacttgctg

SEQ ID NO: 39205 - DNA, 75 bp, Artificial Sequence
  Synthetic
ttgagttggcgggagaggaagtggatgaacaaaccattgcttcttggattcaggcatttgcttatcagggttttg

SEQ ID NO: 39206 - DNA, 75 bp, Artificial Sequence
  Synthetic
atgctcgtagggttattgagctgttgcagatcagaggggggaaccactggaaggatgatgcaaagcagatgatca

SEQ ID NO: 39207 - DNA, 75 bp, Artificial Sequence
  Synthetic
tcttatgtctcactaggggcaacaagcccagcaagatgataacaaagatgtctgataaagggaagaaaattgttc

SEQ ID NO: 39208 - DNA, 75 bp, Artificial Sequence
  Synthetic
aagggcttataaagaaatacaacctgaaagaagggaacccatccagggatgatctgaccctatctagagtgacag

SEQ ID NO: 39209 - DNA, 75 bp, Artificial Sequence
  Synthetic
ctgcccttgctggttacacttgccaagctactgaggtggtggaagaatacttgcctgtaacaggaagacacatgg

SEQ ID NO: 39210 - DNA, 75 bp, Artificial Sequence
  Synthetic
atggtctctctaaaaattatccaagaccaatgatgcatccaagctttgctggtcttattgaccctggtcttccct

SEQ ID NO: 39211 - DNA, 75 bp, Artificial Sequence
  Synthetic
cagaagtgctatcagtaatagttgatgctttcagtttgttcatggtgcaattctctcgcactataaacccaagga

SEQ ID NO: 39212 - DNA, 75 bp, Artificial Sequence
  Synthetic
atcgtggactttcagcctctgaagtgttcagcacttttgatagaccaatgaatgctgccataaatagctctttct

SEQ ID NO: 39213 - DNA, 75 bp, Artificial Sequence
  Synthetic
tgagtcgtgatcagagaaaaggatttctcaagagcctgggcatacttgatgctaaccttcagcctgctgaaaatg

SEQ ID NO: 39214 - DNA, 75 bp, Artificial Sequence
  Synthetic
taaaatcagccgctaaagccttccgcactgcaaaatgagctgcctattgaatttggaatagccaattgttagaac

SEQ ID NO: 39215 - DNA, 75 bp, Artificial Sequence
  Synthetic
attcctcacacctcccatcccctgaaccaaaacctcccaatccttccccaacccaccttaggcagagtcatgatt

SEQ ID NO: 39216 - DNA, 75 bp, Artificial Sequence
  Synthetic
gtaatcggctgtggcttcatcatcgaaatctgaatccatctcatcaaacagatcattgaattgatcatcatgagt

SEQ ID NO: 39217 - DNA, 75 bp, Artificial Sequence
  Synthetic
ggatttgggctcccacattctattaccaagaaggtgaggcgttataaccaaagaaagttctttcacatagtcata

SEQ ID NO: 39218 - DNA, 75 bp, Artificial Sequence
  Synthetic
cagtagagagtggaactcagattcgtaatagtcataaggaagggctgtcaacatcctaatgagctgaacatatgc

SEQ ID NO: 39219 - DNA, 75 bp, Artificial Sequence
  Synthetic
tacttccttctctatatcttgaccagtaaagttctcatgccttatgtctcgatttttgagctcccttatgacact

SEQ ID NO: 39220 - DNA, 75 bp, Artificial Sequence
  Synthetic
tttgtaaagattgactaatgaatcatctatctgttcgccatcaccacacctcatcacaagagtcatgaatgagca

SEQ ID NO: 39221 - DNA, 75 bp, Artificial Sequence
  Synthetic
cttttcttcccagtggtagtcataactagatatttgagacagcttaaaaaatgccaaggtgggtttacctaaggg

SEQ ID NO: 39222 - DNA, 75 bp, Artificial Sequence
  Synthetic
ccatgatagagctgtttttaaattgggttcagcccacttcaattgcttgtctaggtttaggtatgaaatcttctc

SEQ ID NO: 39223 - DNA, 75 bp, Artificial Sequence
  Synthetic
tatggtagaatcaaagaaagatggggatttccctttcacttgaagataatctttaccccaattatgcgggagttc

SEQ ID NO: 39224 - DNA, 75 bp, Artificial Sequence
  Synthetic
acccttttcaataaatgtggacaggcgatatcgtgtttttgtgctgactctatatgaagagcatgggaactcagc

SEQ ID NO: 39225 - DNA, 75 bp, Artificial Sequence
  Synthetic
ccctttatacttacaaacaggggtgtcctgatacccattaactgcagaatactcaacatacactttactcctgtc

SEQ ID NO: 39226 - DNA, 75 bp, Artificial Sequence
  Synthetic
cacagccgatcgtgttatgtgtgggtagtcaaacatgtatctcatcatgttagacatatttgctatcaccagtaa

SEQ ID NO: 39227 - DNA, 75 bp, Artificial Sequence
  Synthetic
agtcaaacatgtatctcatcatgttagacatatttgctatcaccagtaatacgatctcaagaggggactttgtgt

SEQ ID NO: 39228 - DNA, 75 bp, Artificial Sequence
  Synthetic
gaaacacaaagaagcccaaacaatggaagaaatcttaagaaaacaaataatcccagttcagaaaggcctaaacaa

SEQ ID NO: 39229 - DNA, 75 bp, Artificial Sequence
  Synthetic
gcctgagcttattcagtatgacgactcaattgttgatgttgagatcccattcttccatatttccaagtgcaacgg

SEQ ID NO: 39230 - DNA, 75 bp, Artificial Sequence
  Synthetic
ttttatgaagattgacttggatttgaacaatggagttgattactcaacaattggatcgtcattgtcttccactat

SEQ ID NO: 39231 - DNA, 75 bp, Artificial Sequence
  Synthetic
agaagtgccagataaaaatcttcccaatctgatacatgatatagttttctcacacttaagtgataaaacagatac

SEQ ID NO: 39232 - DNA, 75 bp, Artificial Sequence
  Synthetic
aaccttttccagcatgttcggtgttaagcaagatacatatgatcacttatctcctgatgtgatcatcaaaactgc

SEQ ID NO: 39233 - DNA, 75 bp, Artificial Sequence
  Synthetic
agcaggggcatattttgttgttgagttcacaactaacagagggggtgagagagcttcttttaactcatgcaaaga

SEQ ID NO: 39234 - DNA, 75 bp, Artificial Sequence
  Synthetic
caaattttccaaatatcacattccgtgtgaaaacagagctgtagggtgcctggttagtttatttgtcatttctgt

SEQ ID NO: 39235 - DNA, 75 bp, Artificial Sequence
  Synthetic
ttatgcacagggggtgtggtcgaacctcgctcttaatgatgaggacgtcaatgagctagtatttagatttcgatt

SEQ ID NO: 39236 - DNA, 75 bp, Artificial Sequence
  Synthetic
agctgtggctatcatggaagaagctaagaagtattaccctgagctgagcggggatgaatcagaattgtctaaaca

SEQ ID NO: 39237 - DNA, 75 bp, Artificial Sequence
  Synthetic
agaacgagagattcttggagttgtttcttcaatacaaatggattgggaaacaaccacagctcaattcccgttttt

SEQ ID NO: 39238 - DNA, 75 bp, Artificial Sequence
  Synthetic
taaagaaaaagtatttgagaatttcttgcaggagccagcagatgaggaatatctatcctccatcatttcaagaga

SEQ ID NO: 39239 - DNA, 75 bp, Artificial Sequence
  Synthetic
attacaagaatctcagaagggtctaatacaaggagcattttataaggagggtctacgtcaggatgagagattaag

SEQ ID NO: 39240 - DNA, 75 bp, Artificial Sequence
  Synthetic
tttaaactttcaagagtgtgaactcaaaattgatgaatacttatcaaatgaggataacaacctcagaaatataaa

SEQ ID NO: 39241 - DNA, 75 bp, Artificial Sequence
  Synthetic
agagtcaaagtccacaattcaaataccaccatgggtcatgaccaaccacacacctgggaagtcagtgtcagagct

SEQ ID NO: 39242 - DNA, 75 bp, Artificial Sequence
  Synthetic
ctctaatgtggtgattctgggagatcaccccatgtgtaaaatttggagatctctggtgatcagtgcatctctagg

SEQ ID NO: 39243 - DNA, 75 bp, Artificial Sequence
  Synthetic
ggagattagcaggtctgaagatgacccaaacctagaatttgaaaaagccctagaagggtctatcgagaagagtga

SEQ ID NO: 39244 - DNA, 75 bp, Artificial Sequence
  Synthetic
tgagagaagcaaataccatagagtgaaattgaggctggaatcagaagagacaatatatgctgcttgcttaggagt

SEQ ID NO: 39245 - DNA, 75 bp, Artificial Sequence
  Synthetic
agagggcaaaacttacaaagccaattctcaagtagagacagctagagagagatcaaaaaaacctttttccataaa

SEQ ID NO: 39246 - DNA, 75 bp, Artificial Sequence
  Synthetic
tcatgacacttcagccctccagaattttttattggtcaatgaaccttatctctttgaggagcagtatgattcttt

SEQ ID NO: 39247 - DNA, 75 bp, Artificial Sequence
  Synthetic
caatccattttctatagattatgaacttaggcagtgtgctcagaagattcaccagccagagctgataaatatgaa

SEQ ID NO: 39248 - DNA, 75 bp, Artificial Sequence
  Synthetic
aggtgagaatgagtttttggagaatcaccgcaagtttgtagcttgtaatttagggtcatggtgtcaaatggtgtc

SEQ ID NO: 39249 - DNA, 75 bp, Artificial Sequence
  Synthetic
cttaattggagcagaattatctgcttcagtgaaacagcatgtgggcccaggacaatttgtcataaagaggctgct

SEQ ID NO: 39250 - DNA, 75 bp, Artificial Sequence
  Synthetic
gaactcagcattatacttattgataaaaccgacgtcttcagttagtcacatatttgtgtcttttggattgctcaa

SEQ ID NO: 39251 - DNA, 75 bp, Artificial Sequence
  Synthetic
aagcaatcatataggagacttgtggaatgatggagtgttcaagcactatatagatgctggagatatgttcataac

SEQ ID NO: 39252 - DNA, 75 bp, Artificial Sequence
  Synthetic
agattttgtttcatataagctgagtaaactgaccaatctctgtaagtgctttcctttgatagagagtgctgcctg

SEQ ID NO: 39253 - DNA, 75 bp, Artificial Sequence
  Synthetic
cttttggacagagctgtttgggtttgaaccttggagagcagtggacatattgagcactgacagaagtggcagtgg

SEQ ID NO: 39254 - DNA, 75 bp, Artificial Sequence
  Synthetic
aaaagaagcttcatccatgctcaaattaactcttctgactcttcttgaggataaggccaccaccgaagagataca

SEQ ID NO: 39255 - DNA, 75 bp, Artificial Sequence
  Synthetic
aacaatgcagaggtatatagtgatggaggggtttgtctctagcccagaggtgccaaagcctcataaaatgctagg

SEQ ID NO: 39256 - DNA, 75 bp, Artificial Sequence
  Synthetic
gaagctacccaaagttatgaggtcagaactccaagtgttcttaactaatagagttttagatgccatgaggaagat

SEQ ID NO: 39257 - DNA, 75 bp, Artificial Sequence
  Synthetic
atcacaaaatccattcagattgcagaagaaacaaggccaaatttcatggactggattgtttaaccctataacagg

SEQ ID NO: 39258 - DNA, 75 bp, Artificial Sequence
  Synthetic
aagtgatcttaaggatgtgcaaccactaataagcatttgttacaacggctatttcaagaataaagaagaagaaac

SEQ ID NO: 39259 - DNA, 75 bp, Artificial Sequence
  Synthetic
tgagccatccgcactatcaaggctttacaaaaagatcatagaattagaacacttgtgtcctcagaatgatgaata

SEQ ID NO: 39260 - DNA, 75 bp, Artificial Sequence
  Synthetic
tctaggactaggtgaccctaatgaacccaagatgcatgagttcagcagatcttttctaaaaaaatgcactgatca

SEQ ID NO: 39261 - DNA, 75 bp, Artificial Sequence
  Synthetic
tagcaagaccatacttagaaaggtgtacggccacaattttatgagccagatagacagtcaaataactcgcgagat

SEQ ID NO: 39262 - DNA, 75 bp, Artificial Sequence
  Synthetic
atcctcaataaccttagagaggctagcgactctaaaagctagtagcaattttgatgaaagttggtattgttacaa

SEQ ID NO: 39263 - DNA, 75 bp, Artificial Sequence
  Synthetic
tgactgctcgaaaaaggaataccatagggaaaaggcaatagtcaaaatgtctaaatttgctgggtcaggtaaaac

SEQ ID NO: 39264 - DNA, 75 bp, Artificial Sequence
  Synthetic
actagccattgaagtttttgataattgcatgaagttgatagagaagagaggaaacatgcatatatgcttattcaa

SEQ ID NO: 39265 - DNA, 75 bp, Artificial Sequence
  Synthetic
gaagcagcaacatgggggtgatagagaaatctatgtgttgggagcagaagaaaggatagtgcaatccatcataga

SEQ ID NO: 39266 - DNA, 75 bp, Artificial Sequence
  Synthetic
agctatatcgcgatctataggtaggttcttcccttccgacactctgtgtaatcccaataataagatgaagatacc

SEQ ID NO: 39267 - DNA, 75 bp, Artificial Sequence
  Synthetic
tgagagccacgggatcagagcaagaaaacactgcagaggccccgtttggacttgttcaacctcagatgatgctag

SEQ ID NO: 39268 - DNA, 75 bp, Artificial Sequence
  Synthetic
aaaatggaatcaggggcacttcgtaacaaagtttgctctcatgctatgcgaattcacacaccaaaaatggtggcc

SEQ ID NO: 39269 - DNA, 75 bp, Artificial Sequence
  Synthetic
tatcataataagagggtgcagcatgttcacaaacaagttcatgatgatgaacctgagatacattgatattcttag

SEQ ID NO: 39270 - DNA, 75 bp, Artificial Sequence
  Synthetic
tagacaccatgagcttaaagttgatgatgaattctctgacacaatttttagagcatatcatggagaagttaaagt

SEQ ID NO: 39271 - DNA, 75 bp, Artificial Sequence
  Synthetic
gccatggatggatgctgggtgcacattcctcaagaccaagacaggcatgatgcagggaatattgcattacacatc

SEQ ID NO: 39272 - DNA, 75 bp, Artificial Sequence
  Synthetic
atcactattacacacaatctatcaagaattcacgagatcactgacattcaagatcttcaatatgaaggtaagccc

SEQ ID NO: 39273 - DNA, 75 bp, Artificial Sequence
  Synthetic
agacatgtcacaaatgatagtctgcgatgtcatgcagggttctgatgacagcagcatgatgataagttttccttg

SEQ ID NO: 39274 - DNA, 75 bp, Artificial Sequence
  Synthetic
tgataatgaggagaaattcactaaatgtaagatagcagcttccattagtttcagaatgaaaaaaagacttggtgt

SEQ ID NO: 39275 - DNA, 75 bp, Artificial Sequence
  Synthetic
ttatcttggaatatatccctctgagaagtcaacatcaaacacagactttgtgatggaatacaactcagaattttt

SEQ ID NO: 39276 - DNA, 75 bp, Artificial Sequence
  Synthetic
cttccactctcaacatgttaggccaaccataagatgggtggcagcatgttgcaacttgcccgaagtagagacatt

SEQ ID NO: 39277 - DNA, 75 bp, Artificial Sequence
  Synthetic
ggtcgctagacaagaggaagcttccaacctgatgacttctgtatcagaaggtggaggatccttctcattatccaa

SEQ ID NO: 39278 - DNA, 75 bp, Artificial Sequence
  Synthetic
ctgcatacaacacagccaatgtacattacattatatgttgattggtatgggagtaagttctttgtttgaacagtt

SEQ ID NO: 39279 - DNA, 75 bp, Artificial Sequence
  Synthetic
caaaaaagccattctaaaatggaaggacccaggattaggcttctttttacttgataatccatattgttcaggttt

SEQ ID NO: 39280 - DNA, 75 bp, Artificial Sequence
  Synthetic
aggagggtttaggttcaatctttataaagcgatatcaacaacctcactgaaaaagctctactcatattttatgaa

SEQ ID NO: 39281 - DNA, 75 bp, Artificial Sequence
  Synthetic
aaaagttagactagagtcagatgaaagtcaggggttggttactgaaagctgctctgtaagtcctgggggtgccat

SEQ ID NO: 39282 - DNA, 75 bp, Artificial Sequence
  Synthetic
agttctgagttctgcactcaagtggggttcaaaacaaaagttttacaagttaagagataaactgaacattccaga

SEQ ID NO: 39283 - DNA, 75 bp, Artificial Sequence
  Synthetic
ggactggattgaaagaattaatgataatccatctgtcctttatagagcacctagaacaggagacgaagttgttct

SEQ ID NO: 39284 - DNA, 75 bp, Artificial Sequence
  Synthetic
tagaatagcagaaaaggtacatagcccaggagtggtttcctctctatccactggcaatgcagtggcaaaagtcat

SEQ ID NO: 39285 - DNA, 75 bp, Artificial Sequence
  Synthetic
agcctcatctgtgtatttcctcagtgctgctatctttcaagattctggaaagcaagaatattctattgttgaaga

SEQ ID NO: 39286 - DNA, 75 bp, Artificial Sequence
  Synthetic
cagcaagtatagcttactacaaaaactatatgccctagaagggaaaactttacagaactcgattagtgattctga

SEQ ID NO: 39287 - DNA, 75 bp, Artificial Sequence
  Synthetic
tatgttgttcttatttcctaatgtagaggacctgaaatccctagatagcttagtttttaacagaggaaatgttga

SEQ ID NO: 39288 - DNA, 75 bp, Artificial Sequence
  Synthetic
gttgacaagaagaaagcataataaagaaaatacacagtctaggatcatagtgtttgaaggaaacagaaacttaag

SEQ ID NO: 39289 - DNA, 75 bp, Artificial Sequence
  Synthetic
aactcctgctgaatatttgatatctgataagtggtttgggacacagaaaagcaaaattggtaaaacagcatttga

SEQ ID NO: 39290 - DNA, 75 bp, Artificial Sequence
  Synthetic
ccaagaatgggacaaggtgacaactataataccttggcttgaggacaaccctgagcagactttaaacaactctcc

SEQ ID NO: 39291 - DNA, 75 bp, Artificial Sequence
  Synthetic
tctctccaatcatgttcaaataagaaactttttttctagaatggatcaaaaacccagggtagtccgtgtcacagg

SEQ ID NO: 39292 - DNA, 75 bp, Artificial Sequence
  Synthetic
agctccaataaagaagagatccggaattagtaagttgtcaatggtgattcgagacaatttctcaaagctgggctt

SEQ ID NO: 39293 - DNA, 75 bp, Artificial Sequence
  Synthetic
cctgaaagatatagaagatgtgtcaggaacaagcagaaccaacactgcagagatactgaaacacttcatgttttg

SEQ ID NO: 39294 - DNA, 75 bp, Artificial Sequence
  Synthetic
tgcactacaaggaccctatgatcagaataaaaaagaacaactagtctataagatactgcatctgtctgacccact

SEQ ID NO: 39295 - DNA, 75 bp, Artificial Sequence
  Synthetic
gggaattcgagattctgatggaaaatcaaggtctaatatactggccattttccaaaattatgtgtatggagacac

SEQ ID NO: 39296 - DNA, 75 bp, Artificial Sequence
  Synthetic
ccatatagctgagcagatagagaaggctggagctggcacaataggaggattcatcatccctcagaaaagtaagaa

SEQ ID NO: 39297 - DNA, 75 bp, Artificial Sequence
  Synthetic
aatagaagactccgtttattactatggtcatggagtgtggagaggtgtcatggatggtaaacaagtgcagattga

SEQ ID NO: 39298 - DNA, 75 bp, Artificial Sequence
  Synthetic
actgaacaactccgttggaaatcctccaatgataacatccatcactctagaaaatggagcagaaccttggcaggt

SEQ ID NO: 39299 - DNA, 75 bp, Artificial Sequence
  Synthetic
atctaagagtgtgagaatgtgggcagaggacattggtgcaaaaaacaacttggatttttcaaaaaattcagggaa

SEQ ID NO: 39300 - DNA, 75 bp, Artificial Sequence
  Synthetic
aggatgcaaatattggatgtttgactttaagatgttcagtgaggataagccatatggggcccctgtattcctatc

SEQ ID NO: 39301 - DNA, 75 bp, Artificial Sequence
  Synthetic
taataggagaatggtcgattttagagaaatggataatgaagagattaagctgaaagtgaggaaatccactatcaa

SEQ ID NO: 39302 - DNA, 75 bp, Artificial Sequence
  Synthetic
cctttatgtaaactcaagtgggagagatgttcacattctatcctacactgcaggtgacaatgacctcagtagcgc

SEQ ID NO: 39303 - DNA, 75 bp, Artificial Sequence
  Synthetic
atgtttaaggatttctagtgagatgaaggactcaatgcttgccttatttccacgagaacctagcaagtcatgggc

SEQ ID NO: 39304 - DNA, 75 bp, Artificial Sequence
  Synthetic
atcctgtgcttccatcccacattttattgtccacagagtcttagatgtagtcagaggcaacttgtatgttgaaca

SEQ ID NO: 39305 - DNA, 75 bp, Artificial Sequence
  Synthetic
tctggaccccactaggctggcagaaatactgaaattgtgctgtgagtcatctttaaggaccagagttgggactat

SEQ ID NO: 39306 - DNA, 75 bp, Artificial Sequence
  Synthetic
attctcgcctattccagcactgggggatagcagatgtcatgttgacatagatgacctgattgacatagtgatcac

SEQ ID NO: 39307 - DNA, 75 bp, Artificial Sequence
  Synthetic
agacataagagattcagattttaagtctgtcgtgaagacgatggaggaagatttaagaggaggatatgaacagga

SEQ ID NO: 39308 - DNA, 75 bp, Artificial Sequence
  Synthetic
agattttgatttctcagacatagatctttttggtccagcacattttaaggagctgtctgatctttcaaccatcag

SEQ ID NO: 39309 - DNA, 75 bp, Artificial Sequence
  Synthetic
ccaccctttgcttgatgactacattgactattgcatctctagtatgggaaggaaagaagtgaggaggttattaga

SEQ ID NO: 39310 - DNA, 75 bp, Artificial Sequence
  Synthetic
acagtccagatgcaagtctaaagacttaaagatctcggaagatttgttcacttgtctgcaaaggccactaagatc

SEQ ID NO: 39311 - DNA, 75 bp, Artificial Sequence
  Synthetic
cattgaagttgatgattttggtctaaatgagggagaatttgtatcagataatatgataggttgaaataacatgag

SEQ ID NO: 39312 - DNA, 75 bp, Artificial Sequence
  Synthetic
agatcaaagttgaggtgaggtacaaaaaacacaaagaccacatggagaattgtaccaattgtgtaaatagagaat

SEQ ID NO: 39313 - DNA, 75 bp, Artificial Sequence
  Synthetic
ggagaattgtaccaattgtgtaaatagagaatattaattaatgacagattattcaattaagggcggtctttgtgt

SEQ ID NO: 39314 - DNA, 75 bp, Artificial Sequence
  Synthetic
gaaacacaaagacggcataactattgagatattgaggaattgtgtaaacatgaggatttctgttttcttgagtag

SEQ ID NO: 39315 - DNA, 75 bp, Artificial Sequence
  Synthetic
atttttactgaccatgtcagcatacattcttacaggatggggcattgacggcacaaccaaactgtgcatgagcaa

SEQ ID NO: 39316 - DNA, 75 bp, Artificial Sequence
  Synthetic
tgaatccccactagagggtttggttcattattgggaagaagagattaagaaaagaaaattgaacagttcagaaaa

SEQ ID NO: 39317 - DNA, 75 bp, Artificial Sequence
  Synthetic
aaactgccgaattggagtcggtgagtataaatctatgtcgaataagacaatcattaaaattttagaagaggttca

SEQ ID NO: 39318 - DNA, 75 bp, Artificial Sequence
  Synthetic
gctatccatttctccattaggattgacatgtgaaggtgggcttgagactgaaggtgtgactcttgaattcaatgg

SEQ ID NO: 39319 - DNA, 75 bp, Artificial Sequence
  Synthetic
gttggatgacacagaaagtggccatcatatagttgactgtgacagtttcaagattgtatctgaccttggagtgat

SEQ ID NO: 39320 - DNA, 75 bp, Artificial Sequence
  Synthetic
tgttggagatggaacaagaataaggggacacaatgatcctgatgacacagctgtcatcaaggaactaactctaga

SEQ ID NO: 39321 - DNA, 75 bp, Artificial Sequence
  Synthetic
aaacagcaatttaaaatccaatcttgagaagagtaagatcactcaaatggataatgtgaatgagatcaagtcttt

SEQ ID NO: 39322 - DNA, 75 bp, Artificial Sequence
  Synthetic
gataagagaaaaccaaatgctacagcacaagatatcaaatctaactggtgttaattttaactataacaacagtct

SEQ ID NO: 39323 - DNA, 75 bp, Artificial Sequence
  Synthetic
tagagctttagaaaatgagatctctctcattaatgaaagcaaggagaatcataagctgcgagcccaagagagcat

SEQ ID NO: 39324 - DNA, 75 bp, Artificial Sequence
  Synthetic
gaaagacaaaaaacagcttgagtttgaccttgtgaagttgaaatctagcatgatgataccccttatcctgacaac

SEQ ID NO: 39325 - DNA, 75 bp, Artificial Sequence
  Synthetic
aatggtgcctatggttgagcccgctatacaagacaagatggcagttccagcagctctcattaattcttacccaca

SEQ ID NO: 39326 - DNA, 75 bp, Artificial Sequence
  Synthetic
tgtcagaaatagaataggccaggggctttacaggtttaatacagatgaggaggctacctgccttggattaaacta

SEQ ID NO: 39327 - DNA, 75 bp, Artificial Sequence
  Synthetic
tgcaactgcttgtgttggatttgatcacatgacaagaccagataaatatcccttttttaattcatttgtcatgca

SEQ ID NO: 39328 - DNA, 75 bp, Artificial Sequence
  Synthetic
gctcacacctcttgaggcctatgctgacggaattttgaagaaagaggatgaatcctgtgagatgggtgacggaaa

SEQ ID NO: 39329 - DNA, 75 bp, Artificial Sequence
  Synthetic
atcaactaaatgtttagagcctagaaagtttatgaaaggttattgtccaaatggaataacaggagtccactacat

SEQ ID NO: 39330 - DNA, 75 bp, Artificial Sequence
  Synthetic
aaatgataagggtaaactggtgcactccaaatgtgccactcaagaccatgaagtcactgaagactgtaccttttg

SEQ ID NO: 39331 - DNA, 75 bp, Artificial Sequence
  Synthetic
taggaaaattaagaagaggccatctcaaaccaaatatgttacaaaaacatctgtgtcactgcaagatgccttttg

SEQ ID NO: 39332 - DNA, 75 bp, Artificial Sequence
  Synthetic
tcaaaaaaatcctagctcttatagtggccctcgggtgcctatgaagggcttctgctcaattggaaacattaacta

SEQ ID NO: 39333 - DNA, 75 bp, Artificial Sequence
  Synthetic
caaatcatgtgataattctgccagcatgtatgaacaagttccatttgtaacattcgaaaactatggtaagatgta

SEQ ID NO: 39334 - DNA, 75 bp, Artificial Sequence
  Synthetic
cctcgacaaactggtcttaaaaaacattgaaactgttgataatgtttctttcatttgtaatgactataaaggtca

SEQ ID NO: 39335 - DNA, 75 bp, Artificial Sequence
  Synthetic
cctcgacaaactggtcttaaaaaacattgaaactgttgataatgtttctttcatttgttatgactataaaggtca

SEQ ID NO: 39336 - DNA, 75 bp, Artificial Sequence
  Synthetic
cctcgacaaactggtcttaaaaaacattgaaactgttgataatgtttctttcatttgtcatgactataaaggtca

SEQ ID NO: 39337 - DNA, 75 bp, Artificial Sequence
  Synthetic
cctcgacaaactggtcttaaaaaacattgaaactgttgataatgtttctttcatttgtgatgactataaaggtca

SEQ ID NO: 39338 - DNA, 75 bp, Artificial Sequence
  Synthetic
ggatggggaagaatctgacaatagagagttaaagagagtaaaagtgagtgattgtagaaacgtggatagtaacaa

SEQ ID NO: 39339 - DNA, 75 bp, Artificial Sequence
  Synthetic
gtctaaggtttgcactggtgatcacatcttctgccaaaaatacaagtgtggtgagaactaccctcaggcaaaatg

SEQ ID NO: 39340 - DNA, 75 bp, Artificial Sequence
  Synthetic
ctttgctgctccaggctctgggccagtactggttaacattcttggagtctggatcaaaccaatgtgtgttgggta

SEQ ID NO: 39341 - DNA, 75 bp, Artificial Sequence
  Synthetic
tgagagtgtcttagttaaaaaagagatcaaagttagtgaaatgaatagaaacccagaatgcgaaacctgcataca

SEQ ID NO: 39342 - DNA, 75 bp, Artificial Sequence
  Synthetic
tagttgtgagaacaacggcataaaaataacatcaacaggttttaggataacatctgctgtatcatgttctcatgg

SEQ ID NO: 39343 - DNA, 75 bp, Artificial Sequence
  Synthetic
gtcatgtgtttctagtcatcaagaaccaagtacaaccattttggtaccttaccctggcatgtcatcagcgatggg

SEQ ID NO: 39344 - DNA, 75 bp, Artificial Sequence
  Synthetic
tggcgagtttgggattcacttgtcacacacagatgattctctaagtctacacatgagagcaagttgtccacccag

SEQ ID NO: 39345 - DNA, 75 bp, Artificial Sequence
  Synthetic
ggatgtttgtgaaacccaccattgctttttttgtatgtcaggtgtaataaactatcaatgccacaacatctggag

SEQ ID NO: 39346 - DNA, 75 bp, Artificial Sequence
  Synthetic
ctccttattcatatcagttctaatctcagccttggtttatttcttattttctcttcttggtaggttcttatactt

SEQ ID NO: 39347 - DNA, 75 bp, Artificial Sequence
  Synthetic
cctaaagctgattccaaaaaagctcaggagtccatttatgtggttgtggacattaatcaaatggataagagggat

SEQ ID NO: 39348 - DNA, 75 bp, Artificial Sequence
  Synthetic
ggtcaagtcagtcttggtaagaacttctcaacgaataaacaattctataggctggcaaaatgatggtcaaggtga

SEQ ID NO: 39349 - DNA, 75 bp, Artificial Sequence
  Synthetic
gctaagagagattagggtaggtagggcaataccaagattctctacaacagccttcatcatagttttactactgcc

SEQ ID NO: 39350 - DNA, 75 bp, Artificial Sequence
  Synthetic
tttatgcttaggttgttctgagagtttagtgtcaaactcaaaacagaccaagtgtactcaagatggagataaagt

SEQ ID NO: 39351 - DNA, 75 bp, Artificial Sequence
  Synthetic
taagtgtaaagtaagcgcaactgtcacagtgaaggctggagtcatcggggctgagacatgttttataataaaggg

SEQ ID NO: 39352 - DNA, 75 bp, Artificial Sequence
  Synthetic
gccaatggaaagtcaacaaaagacaatcagaataaagactatctctagtgagattgtatgcagagaggggaatag

SEQ ID NO: 39353 - DNA, 75 bp, Artificial Sequence
  Synthetic
cttttggacaagtcattatattccatcttgtctgagttctaggagatgtcatcttgttagtgagtgttatgggaa

SEQ ID NO: 39354 - DNA, 75 bp, Artificial Sequence
  Synthetic
caactgtcaaagttggagagatgaagatgtttctaaagaattcaaagggataaaagacaacatggtgatgagtga

SEQ ID NO: 39355 - DNA, 75 bp, Artificial Sequence
  Synthetic
gaataagtgttttgagcaatgcggtgctgtgggctgtggatgcttcaatataaatccctcttgcttatttgtaca

SEQ ID NO: 39356 - DNA, 75 bp, Artificial Sequence
  Synthetic
cacaacatttaggagtgcacgtgcagaggcaattagagtcttttcctgtgtcgactgggtccacaagctaacttt

SEQ ID NO: 39357 - DNA, 75 bp, Artificial Sequence
  Synthetic
aaaaatcacaggtcctgatggtgaacaagaagaagctgttttagggtcattaggaacaaagtttttatcatgggg

SEQ ID NO: 39358 - DNA, 75 bp, Artificial Sequence
  Synthetic
aacaatttcattatctttggatgcagaagggatttctgggagcaactcattcagttttctagaaagcagcaaagg

SEQ ID NO: 39359 - DNA, 75 bp, Artificial Sequence
  Synthetic
aggatttgctttgcatgacgaggctttctcagagataccaagagaaggatttttgggagagataaggtgttcatc

SEQ ID NO: 39360 - DNA, 75 bp, Artificial Sequence
  Synthetic
agaatcagcggcagtggctgcacattcctcttgcttaagggcaccgggattggtcaagtacaagcctatgacaga

SEQ ID NO: 39361 - DNA, 75 bp, Artificial Sequence
  Synthetic
cttgattgactgcacagcatcattggtggatccttttgcagcatttgtcaaggggtcactgccccaagtgaggaa

SEQ ID NO: 39362 - DNA, 75 bp, Artificial Sequence
  Synthetic
tggactaacatacacaagctccaaagataagaaaaccgtgcaagcattcaacagtggctccatcaaagccttcat

SEQ ID NO: 39363 - DNA, 75 bp, Artificial Sequence
  Synthetic
cacaatcaatatggatgagcatgaaattcaattcttatcaacgacaagatcttgtgaggccacatttgtaaatat

SEQ ID NO: 39364 - DNA, 75 bp, Artificial Sequence
  Synthetic
aacagggtgttactcatgtaattatggagcaagagtgtgtattaaaatcaaaagtgatggtaatgcaaactttct

SEQ ID NO: 39365 - DNA, 75 bp, Artificial Sequence
  Synthetic
agccacagaggagaaggggaattatcacatttcattaaatgtttggtctggtactagagactactgccaaattat

SEQ ID NO: 39366 - DNA, 75 bp, Artificial Sequence
  Synthetic
gcactttaatgaaccagaagttgattcaattactcattacacgtgcggagggccagagaagttattgcatataaa

SEQ ID NO: 39367 - DNA, 75 bp, Artificial Sequence
  Synthetic
agggctactcatctctctcggggtgacggacttaaggaatcagacaggcggctcatctgttgttatcaatccctc

SEQ ID NO: 39368 - DNA, 75 bp, Artificial Sequence
  Synthetic
tgaaacatcatggaatatagacagatggattggtggactttttaattggttaggtggaccctggttggccatact

SEQ ID NO: 39369 - DNA, 75 bp, Artificial Sequence
  Synthetic
aaaaatagttggttttttgttgctaggatctttgattttgataattatagtcgtgttactaggatcattagctac

SEQ ID NO: 39370 - DNA, 75 bp, Artificial Sequence
  Synthetic
ctcttatcttaagaagaggaaaactatataaataatgggcccctgcaatagaatgccatggcaagaggagatcaa

SEQ ID NO: 39371 - DNA, 75 bp, Artificial Sequence
  Synthetic
atgctagtgtgacagctcaacgataaaggataagaaagtcaagaaattgttaaaacaaataaaacaaaaaagcca

SEQ ID NO: 39372 - DNA, 75 bp, Artificial Sequence
  Synthetic
aaagagaataattggacaaaatatgagaaaatccagcacagagtggagtagagcattactgggttttggacagaa

SEQ ID NO: 39373 - DNA, 75 bp, Artificial Sequence
  Synthetic
gaaaacaaaattgatatagaagttcaaataaaactaaaaataaattgaaataataggagaggggaaggatatggg

SEQ ID NO: 39374 - DNA, 75 bp, Artificial Sequence
  Synthetic
cagagtgttgatgtcaatcttttggacattaaatttttaagtgagtgttagcaatccagcataatgaaatataag

SEQ ID NO: 39375 - DNA, 75 bp, Artificial Sequence
  Synthetic
tataggtttgctgtcttcttgattagacaatcaaaagactatctaaacactgttagtagaatattaatcaaagtt

SEQ ID NO: 39376 - DNA, 75 bp, Artificial Sequence
  Synthetic
aaggtggagatcatgaacatttattttatagattctaatatttcatagagaaagtgccggtctttgtgtattaca

SEQ ID NO: 39377 - DNA, 75 bp, Artificial Sequence
  Synthetic
tattttatagattctaatatttcatagagaaagtgccggtctttgtgtattacacgtgcggagggccagagagag

SEQ ID NO: 39378 - DNA, 75 bp, Artificial Sequence
  Synthetic
acacaaagacggctaacctattgagatattgagataatagaatataaagtcatgaagatacttgtgttcttgaac

SEQ ID NO: 39379 - DNA, 75 bp, Artificial Sequence
  Synthetic
aggctcttatttgccatgtctgcatacatcctaacaggatgggggatagacgggacaaccaagctatgtattagc

SEQ ID NO: 39380 - DNA, 75 bp, Artificial Sequence
  Synthetic
aatgagtccccgttagagggcctagttcactattgggaagaagaggtaaaaaagaggggattaaatagttcagat

SEQ ID NO: 39381 - DNA, 75 bp, Artificial Sequence
  Synthetic
aagacatgtagaattgggactggtgaatacaaatcgatgacaaataaaactgttgtcaaaattctagaggaagta

SEQ ID NO: 39382 - DNA, 75 bp, Artificial Sequence
  Synthetic
cagctttctatatctcccttaggcctgacatgtgaaggtgggcttggagatgagggcgtgaccctagagttcaac

SEQ ID NO: 39383 - DNA, 75 bp, Artificial Sequence
  Synthetic
ggacttgatgacactgagagtggtcaccacatagtcgactgcgatgataagaaaatcatttctgatttgggagtc

SEQ ID NO: 39384 - DNA, 75 bp, Artificial Sequence
  Synthetic
atcgttggagacggaacaagagtgagacaccatgaggagcacgaggatgtggcagcaattaaggagctgacctca

SEQ ID NO: 39385 - DNA, 75 bp, Artificial Sequence
  Synthetic
gaaaacaacctattaaagtcagccattgagaagaacaaagttgcccagatagataatgtaaatgagatcagatct

SEQ ID NO: 39386 - DNA, 75 bp, Artificial Sequence
  Synthetic
ctaataagagagaatcagatgttacagcatagaatatctaatttgactggtgtgaactacatttataataatagc

SEQ ID NO: 39387 - DNA, 75 bp, Artificial Sequence
  Synthetic
ctcagagctttagaaaatgagatcttagttgtcaatgaaagcaaggaaaatcacaaaaagatagctagagagaat

SEQ ID NO: 39388 - DNA, 75 bp, Artificial Sequence
  Synthetic
ttaagaaacaaagaacgactagaaattgatttagtaaaactgaaatctagtatgatgattcccctagttttaacc

SEQ ID NO: 39389 - DNA, 75 bp, Artificial Sequence
  Synthetic
actatgattcctttagtggagcctgcaatacaagacaaaatggctgttccctctgttcttataaactcatatccc

SEQ ID NO: 39390 - DNA, 75 bp, Artificial Sequence
  Synthetic
catgtaagaaatagaattggccagggtctatatcggttcaatacagatgaggaagtgacatgtttgggactaaat

SEQ ID NO: 39391 - DNA, 75 bp, Artificial Sequence
  Synthetic
tatgcaactgcatgcgttggttttgatcacatgactagacctgataagtaccctttcttcaattcatttgtaatg

SEQ ID NO: 39392 - DNA, 75 bp, Artificial Sequence
  Synthetic
cagttaacacctctggaggcctatgcagatggaatactaaaaaaagaagacgaatcctgtgaaatgggagatgga

SEQ ID NO: 39393 - DNA, 75 bp, Artificial Sequence
  Synthetic
aagtcaaccaaatgtttagagtctagaaagtttataaagggattttgcccaaatggaataactggggtgtatttt

SEQ ID NO: 39394 - DNA, 75 bp, Artificial Sequence
  Synthetic
attaatgacaaaggcaaaataatgcactctaagtgtgcaacacaagatcatgaggtcactgaggactgtactttt

SEQ ID NO: 39395 - DNA, 75 bp, Artificial Sequence
  Synthetic
tgtcgaaagataaaaaagaaaccaacacaaaataaatatgttactaagacatcagtgtccttgcaagatgctttt

SEQ ID NO: 39396 - DNA, 75 bp, Artificial Sequence
  Synthetic
tgtcaaaaggattctgggtcttataatgggccaagagtgccaatgaaaggcttctgctctattggaagtgttaat

SEQ ID NO: 39397 - DNA, 75 bp, Artificial Sequence
  Synthetic
tacaagtcatgtgaaaattctgctagcatgtatgaacaagtgcccttcgtgacatttgagaattatgggaaaatg

SEQ ID NO: 39398 - DNA, 75 bp, Artificial Sequence
  Synthetic
tatcttgataagttaacactaaaaaatatcgagatggtagataatatctccttcatttgttatgataacaaagga

SEQ ID NO: 39399 - DNA, 75 bp, Artificial Sequence
  Synthetic
caggatggtgttgaatctgatactagagaattgaagagagtaaaggttagtgaatgtaggaatgtggacagcaat

SEQ ID NO: 39400 - DNA, 75 bp, Artificial Sequence
  Synthetic
aaatctaagatttgcactggtgaccatatattctgccaaaaatacaaatgtggggatacatatccacaggcgaag

SEQ ID NO: 39401 - DNA, 75 bp, Artificial Sequence
  Synthetic
tgctttgccgcgcctggttcagggccagtgttagttaacatattgggagtatggatgaagcccatgtgtattgga

SEQ ID NO: 39402 - DNA, 75 bp, Artificial Sequence
  Synthetic
tatgagaatgttttagtaaaaaaggagattaaggttagtgacattgacagaaatcctgagtgtgagacatgtatc

SEQ ID NO: 39403 - DNA, 75 bp, Artificial Sequence
  Synthetic
tatagctgtgaggtggatggattaaaaatcacatcaacaggattcagaattacttctgctgtatcttgttctcat

SEQ ID NO: 39404 - DNA, 75 bp, Artificial Sequence
  Synthetic
gggtcatgtgtctctagtcatcaagaacccagtacaaccatcttgattccatatccaggaatgtcctctgccatg

SEQ ID NO: 39405 - DNA, 75 bp, Artificial Sequence
  Synthetic
gggggagaatttggaatccatttgtcacacacagatgactccttgagtttgcacatgagagcgaactgcccccca

SEQ ID NO: 39406 - DNA, 75 bp, Artificial Sequence
  Synthetic
agagatgtttgtgagactcatcattgcttcttctgcttgacaggcatcatcaattaccagtgtcacaacatatgg

SEQ ID NO: 39407 - DNA, 75 bp, Artificial Sequence
  Synthetic
agttctcttactgtctctgtgcttatttctgccgtcatttattttatcttttcattgctaggcagatttctgtat

SEQ ID NO: 39408 - DNA, 75 bp, Artificial Sequence
  Synthetic
ttcttgaaattaatacctaaaaaactaaggagtccatttatgtggctatggactttaatcaagtgggttagacgg

SEQ ID NO: 39409 - DNA, 75 bp, Artificial Sequence
  Synthetic
gtgataaggtccatcttaattagaacctcaagaagaatcaacaattctattggatgggacagtgataatcaagga

SEQ ID NO: 39410 - DNA, 75 bp, Artificial Sequence
  Synthetic
gatctcagagaagttcgggttggcagggctattcccagatatgccaccacagtgtttattttagccctgctcttg

SEQ ID NO: 39411 - DNA, 75 bp, Artificial Sequence
  Synthetic
cctctatgtctagggtgctctgagagcttagtctccaactctaagcaaactagatgcactcaagagggcaataag

SEQ ID NO: 39412 - DNA, 75 bp, Artificial Sequence
  Synthetic
gtgaaatgcaagattagtgccactgtaactgtcaaggcaggagttataggtgcagagacatgctttataatcaaa

SEQ ID NO: 39413 - DNA, 75 bp, Artificial Sequence
  Synthetic
ggaccaattgaaagtcagcagaagacaataagaatcaagacaatgtctagtgaaattgtgtgcagagaaggaaat

SEQ ID NO: 39414 - DNA, 75 bp, Artificial Sequence
  Synthetic
agtttttggacaagccattatataccatcttgtcttagttctagaagatgtcatcttgtgggtgagtgttacagc

SEQ ID NO: 39415 - DNA, 75 bp, Artificial Sequence
  Synthetic
aacaactgtcagagctggagagatgatgatgtgtctaaggaatttaaagggataaaagataacatggtcatgagt

SEQ ID NO: 39416 - DNA, 75 bp, Artificial Sequence
  Synthetic
gaaaacaagtgttttgaacagtgtggagctgctgggtgtggctgttttaacataaatccttcttgtttatttgta

SEQ ID NO: 39417 - DNA, 75 bp, Artificial Sequence
  Synthetic
catacaacattcagaagtgctcgtgcagaagctattagagtgttttcgtgtgtggattgggtgcacaaattgact

SEQ ID NO: 39418 - DNA, 75 bp, Artificial Sequence
  Synthetic
ttgaagataacaggtccagacggagaacaagaagaagctgtcttagggtctcttggaacaaagtttttgacctgg

SEQ ID NO: 39419 - DNA, 75 bp, Artificial Sequence
  Synthetic
ggaacaatttcattaactttagatgctgaaggcatcactggaagcaattcgtttagtttcctgcagagtagcaaa

SEQ ID NO: 39420 - DNA, 75 bp, Artificial Sequence
  Synthetic
ggaggctttgcactccatgatgaggctttttctgaaattccgagggaaggatttctcggagagataagatgctcc

SEQ ID NO: 39421 - DNA, 75 bp, Artificial Sequence
  Synthetic
tcagagtctgctgcagtggctgctcattcttcatgtttgagagccccaggattagttaaatacaagccaatgacc

SEQ ID NO: 39422 - DNA, 75 bp, Artificial Sequence
  Synthetic
gatcaaatagattgcacagcatccttagtagatccctttgctgcttttgtcaaaggctctctgccgcaggtgaga

SEQ ID NO: 39423 - DNA, 75 bp, Artificial Sequence
  Synthetic
aatggactaacatacacaagttctaaagacaagaagactgtccaagcttttaacagcgggtctattaaagctctc

SEQ ID NO: 39424 - DNA, 75 bp, Artificial Sequence
  Synthetic
attaccattaacatggatgagcacgaagtggaattcttgtctacagtgagatcctgtgaagctacattcgtgaac

SEQ ID NO: 39425 - DNA, 75 bp, Artificial Sequence
  Synthetic
ataacaggatgttattcatgtaactatggtgcaagggtttgtttgaaaataaagagtgacggtaatgcaaatttc

SEQ ID NO: 39426 - DNA, 75 bp, Artificial Sequence
  Synthetic
atagcaacagaagaaaaaggaaattatcacatatctttaaatgtctggacagggactagagattactgtcaaata

SEQ ID NO: 39427 - DNA, 75 bp, Artificial Sequence
  Synthetic
atgcatttcagtgagccagaagttgattcaatcacacactatacttgtggagggcctgagaaattactccatatt

SEQ ID NO: 39428 - DNA, 75 bp, Artificial Sequence
  Synthetic
aagggtttacttatatctctaggcctttctgatctgagaaatcaaaccgggggctcttcagttgtaataaaccct

SEQ ID NO: 39429 - DNA, 75 bp, Artificial Sequence
  Synthetic
tctgagacatcatggaacataggcaagtggattggtggattgtttagctggttgggtggcccttggacagcaatt

SEQ ID NO: 39430 - DNA, 75 bp, Artificial Sequence
  Synthetic
ctaaaaatcattggttttttgttgctaggttcattaatattaataattctggtcttgctgtcaggatcactaatc

SEQ ID NO: 39431 - DNA, 75 bp, Artificial Sequence
  Synthetic
tcatcttatcttaaaaagagaaaggtaacataagtgcaggggtactggctgcaggatagctttagagccaaaaac

SEQ ID NO: 39432 - DNA, 75 bp, Artificial Sequence
  Synthetic
aagaaaactaatcaaagtgggaaaatcaaaatttgaaactcaaactaggcaaactcgccaaaataaatttaaaat

SEQ ID NO: 39433 - DNA, 75 bp, Artificial Sequence
  Synthetic
caaacaaggaagtgggggatgaggcagcgattttgagtgtgagaagagccttagcaaattcttatgcacagaagt

SEQ ID NO: 39434 - DNA, 75 bp, Artificial Sequence
  Synthetic
ctaagagaggtcaggcagcctccttgcgttcaccttcccaaatgcgtatgaattcaacaaaagcaccaaaatctt

SEQ ID NO: 39435 - DNA, 75 bp, Artificial Sequence
  Synthetic
accattctagaaataatggagtagaatcaaacaaaggaaaagtaaaggtgggattatccaattaatgttttagat

SEQ ID NO: 39436 - DNA, 75 bp, Artificial Sequence
  Synthetic
aaaagtaaaggtgggattatccaattaatgttttagatatattaaattccatagaattagtgccggtctttgtgt

SEQ ID NO: 39437 - DNA, 75 bp, Artificial Sequence
  Synthetic
acacaaagacggctattcattgtacaattttggattattacagagagtttcttgtcgagaatgaggctcttagct

SEQ ID NO: 39438 - DNA, 75 bp, Artificial Sequence
  Synthetic
tttttattaaactgtgtgatagcacatgctgcttacacagtagaagactggggtttagaaggttcaagtaatgtg

SEQ ID NO: 39439 - DNA, 75 bp, Artificial Sequence
  Synthetic
tgtctcagcaatgaatctcctcttgaaggactagtgcactactgggagcaggcaattaagagacggaagatgaat

SEQ ID NO: 39440 - DNA, 75 bp, Artificial Sequence
  Synthetic
catgacaaaaaggattgcaaaataggctctgaacctttaaaagaaatgactaataagactattatgcagttaatt

SEQ ID NO: 39441 - DNA, 75 bp, Artificial Sequence
  Synthetic
gaacaagtgcaattgtcaatgacaaatttgaggttgacctgcagcaagaatggtggctctcaaggggtctatgtt

SEQ ID NO: 39442 - DNA, 75 bp, Artificial Sequence
  Synthetic
gactttaatggactagatgacactgaacccggcaaacacattgtcgactgtaaaaattatcacacaatagcagac

SEQ ID NO: 39443 - DNA, 75 bp, Artificial Sequence
  Synthetic
ttagggattgaggttggagatggctatatgtgggactcaagatataacatttcttatgataaagaaatcaaggat

SEQ ID NO: 39444 - DNA, 75 bp, Artificial Sequence
  Synthetic
aaagaagataaaataaaagagatggaagctgaaaaagagagattaggtaatgttatgagagatgacaagaatgaa

SEQ ID NO: 39445 - DNA, 75 bp, Artificial Sequence
  Synthetic
atcctttcattaataagagaaaaccagatgctgcaacataaaatatccaatttgactggtgtcgtcttcaattac

SEQ ID NO: 39446 - DNA, 75 bp, Artificial Sequence
  Synthetic
aacaatagcctgtcagccctggcgaacgagttgttgaagaatgaggaagaaaataagatgcactttgaaactctt

SEQ ID NO: 39447 - DNA, 75 bp, Artificial Sequence
  Synthetic
agagggcaattatctgagaaagacaagattattaggactcagcaggatcatataagtttgaaatctgtcactatg

SEQ ID NO: 39448 - DNA, 75 bp, Artificial Sequence
  Synthetic
gcggctctacttgctacttctttagtcgctacaactgaagcatctcctcaaactgcccacaagaatcttcttaat

SEQ ID NO: 39449 - DNA, 75 bp, Artificial Sequence
  Synthetic
ccttatttacacgctaaaaatagaattgggaatggtctttacagatttgatgattctgatgataacacttgtaaa

SEQ ID NO: 39450 - DNA, 75 bp, Artificial Sequence
  Synthetic
ggtttagattatagcttaagctgtgctgggtttgaccacatgctgaaaccttattattatcctttcttcaattca

SEQ ID NO: 39451 - DNA, 75 bp, Artificial Sequence
  Synthetic
catgtcatgcaattaactcctctagaggcatctgcagatgagataatcaagaaagagaatgagagctgtgagatg

SEQ ID NO: 39452 - DNA, 75 bp, Artificial Sequence
  Synthetic
gggaaagataaaaataataggtgtattgaaggccgccgctttatcagaggacattgtcctaatgggatcaatggt

SEQ ID NO: 39453 - DNA, 75 bp, Artificial Sequence
  Synthetic
gtgtactacataaacgacaagggcaaactccaccattccaaatgtaaagaagatttagaaataacagaagattgc

SEQ ID NO: 39454 - DNA, 75 bp, Artificial Sequence
  Synthetic
atgttctgcaggaaattcaaaaagaagggtgcttcaacaacagaagtaatgaagacctctgtatctctgcaagat

SEQ ID NO: 39455 - DNA, 75 bp, Artificial Sequence
  Synthetic
gctatatgccagaaagagtcaactagatatgatgggccaaagatcacatttaaaggggtgtgccagatagggaat

SEQ ID NO: 39456 - DNA, 75 bp, Artificial Sequence
  Synthetic
aaagtctacaaacagtgtccttccgtcactaaagcatatgaaaacattccatttgtgacatttccagatcaagac

SEQ ID NO: 39457 - DNA, 75 bp, Artificial Sequence
  Synthetic
aaaatgtatattgagaaattggttctaaacaacatagaactgatgagcaatgtgtcatttatttgttatgagcac

SEQ ID NO: 39458 - DNA, 75 bp, Artificial Sequence
  Synthetic
aaaggtcaggatgatgttgaaactgatagtagagagtggaaaagagttaaagtgggagagtgcaaaaatgttgtc

SEQ ID NO: 39459 - DNA, 75 bp, Artificial Sequence
  Synthetic
gactcaaagacaaaaatctgtgctggtgaccacatattttgtcaaaaatatatgtgctcagctatgaatccttca

SEQ ID NO: 39460 - DNA, 75 bp, Artificial Sequence
  Synthetic
gcaaagtgctttatggctcctggatctggacccatactagtgaatatcctagggtcatgggtaaaaccccagtgt

SEQ ID NO: 39461 - DNA, 75 bp, Artificial Sequence
  Synthetic
attggctatgagaatgttcttgtcacaagagaggtgaggtcaactcaggttgacagttttactgaatgcgacact

SEQ ID NO: 39462 - DNA, 75 bp, Artificial Sequence
  Synthetic
tgtatttatgaatgtgggtccaatggtgtcactgtgacatcaacaggatttgaaataacttcagcagtctcttgc

SEQ ID NO: 39463 - DNA, 75 bp, Artificial Sequence
  Synthetic
tcacatggatcatgtgtctcagcacatcagagaccatcgaccactatcacaattccctatcctggcatgtctgct

SEQ ID NO: 39464 - DNA, 75 bp, Artificial Sequence
  Synthetic
gctatggggggagatataggaattcacgtgtcacacacgggagactcactcagcctacacatcaaggcgcattgc

SEQ ID NO: 39465 - DNA, 75 bp, Artificial Sequence
  Synthetic
ccgccaaaagattcatgtgagattcataattgcttattatgtattcagggactgattaattatcaatgtcatact

SEQ ID NO: 39466 - DNA, 75 bp, Artificial Sequence
  Synthetic
gttgtgagttcactctttgtgtcttcgttgatctctatggtagtgttcttcttgttatctctaatggggaaattg

SEQ ID NO: 39467 - DNA, 75 bp, Artificial Sequence
  Synthetic
atgtacttctttcatctcattcctaagaaattacggagtcctttcatgtggattgtgttactgctcaaatatctc

SEQ ID NO: 39468 - DNA, 75 bp, Artificial Sequence
  Synthetic
ttcaaaagcttaaataatttgaggaaaagggtttcaaacaggataaatatagtaataggctggcagaatgaagag

SEQ ID NO: 39469 - DNA, 75 bp, Artificial Sequence
  Synthetic
caagcggtgctaagggaagttagggtcagaagggctatccctagattcaatgccactatcctcttggtgatgatc

SEQ ID NO: 39470 - DNA, 75 bp, Artificial Sequence
  Synthetic
ttcatccctctcactttatcatgctctgagacattggtctctaattctaagcaagttaagtgcactcagtctagt

SEQ ID NO: 39471 - DNA, 75 bp, Artificial Sequence
  Synthetic
gatggcgtgaaatgttctgtaacagcaactgtcacacaaaaggctggcatcataggagctgagtcatgttttgtc

SEQ ID NO: 39472 - DNA, 75 bp, Artificial Sequence
  Synthetic
ttaaaaggaccaatgggaggacaacaaaaaaccataaagatacggacagtttctagtgagatggtgtgtagagaa

SEQ ID NO: 39473 - DNA, 75 bp, Artificial Sequence
  Synthetic
ggtactagcttctggacaagtcattattctccacaatgtctaagttcaagacggtgtcatttagttggagaatgt

SEQ ID NO: 39474 - DNA, 75 bp, Artificial Sequence
  Synthetic
caagggaatagatgtcagagttggagtgataaggaggtgtcaaaagaattcaagggaatcagtgacaatgagatc

SEQ ID NO: 39475 - DNA, 75 bp, Artificial Sequence
  Synthetic
atgtctgaaaacaagtgctttgaacaatgtggtgccataggatgtggatgcttcaatgtcaacccatcttgctta

SEQ ID NO: 39476 - DNA, 75 bp, Artificial Sequence
  Synthetic
tttgttcatacttccctaaagagcactagaaacgaagctataagagcattttcctgtgttgactgggttcaccgg

SEQ ID NO: 39477 - DNA, 75 bp, Artificial Sequence
  Synthetic
atgactttggaagtgacagggccaaatgatgaaaaagacaaaatcattcttggatcactagggaccaaattcctc

SEQ ID NO: 39478 - DNA, 75 bp, Artificial Sequence
  Synthetic
agctggggcacaattagcctctcattagacgctgagggaattagtgggacaaattcaataagttttttggaaagc

SEQ ID NO: 39479 - DNA, 75 bp, Artificial Sequence
  Synthetic
agcaaaggaggttttgccctttatgatgaagcattgtctgaaattcctagagagggattcataggagagataaga

SEQ ID NO: 39480 - DNA, 75 bp, Artificial Sequence
  Synthetic
tgctcttctgaatctgctgcaatcatagctcattcttcttgtgcaagagctccaaatctggtgaaatacaaacca

SEQ ID NO: 39481 - DNA, 75 bp, Artificial Sequence
  Synthetic
atgactgacacaattgactgcactgcatccttgattgatccttttgctgctttttacaaaggtgcactgcctcag

SEQ ID NO: 39482 - DNA, 75 bp, Artificial Sequence
  Synthetic
gtgcgaaatggaatgacatacactagctccatagacaagaagactgttcaagcttttaattcaggtgctgttaag

SEQ ID NO: 39483 - DNA, 75 bp, Artificial Sequence
  Synthetic
gctttgataaccataaacatggatgatcacgagatcgagtttttgaatgatatagctaagtgtgatgccactttc

SEQ ID NO: 39484 - DNA, 75 bp, Artificial Sequence
  Synthetic
ataaatataacaggttgttattcttgcaattttggggcaaaaatttgtgtcagaataaaagcagataaaagttca

SEQ ID NO: 39485 - DNA, 75 bp, Artificial Sequence
  Synthetic
gaattcctggctaaagaagaaagaggagaattctacctttcatttgatgtgtctgcatccacaaaagactactgt

SEQ ID NO: 39486 - DNA, 75 bp, Artificial Sequence
  Synthetic
cagataattcacttcaacaagccagacattaatgagagaactaaatacacatgcggaggtgaggaaaaactcttg

SEQ ID NO: 39487 - DNA, 75 bp, Artificial Sequence
  Synthetic
gttattaaagggacattaatatccttgggaattcaagacttgagaaatgtgacagggggttcatcagtggtggtg

SEQ ID NO: 39488 - DNA, 75 bp, Artificial Sequence
  Synthetic
aatcctagtgatagctcatggagtctcggtaagtgggtaactggcttattctcatggctagggggcacgtgggct

SEQ ID NO: 39489 - DNA, 75 bp, Artificial Sequence
  Synthetic
gcaatccttaagatcattggttttctaattttgggctttctattaatggcattaacagcctcaatcattagattc

SEQ ID NO: 39490 - DNA, 75 bp, Artificial Sequence
  Synthetic
tccattaagtcaaccttttcaaaacaaaaggataaatagaccctacacacaagtcaacaaccatatacatccaca

SEQ ID NO: 39491 - DNA, 75 bp, Artificial Sequence
  Synthetic
caacttcaaccaaagacaaaaaccacaaacacactaatcatctcacaaaatcatcaaatcaaccatccactgggc

SEQ ID NO: 39492 - DNA, 75 bp, Artificial Sequence
  Synthetic
agggttagccaatcctcttttaacgaatggtgttgatctgaatttcatcatgttttaacacagtgttatgatgga

SEQ ID NO: 39493 - DNA, 75 bp, Artificial Sequence
  Synthetic
gatgacaaaaaggcaattataagttcattttgttgtgtttcccaatgagttaaggtgagataaaaattatagtga

SEQ ID NO: 39494 - DNA, 75 bp, Artificial Sequence
  Synthetic
tgagttaaggtgagataaaaattatagtgatgttttggttttgaaagatttccagtgttgcgccggtctttgtgt

SEQ ID NO: 39495 - DNA, 75 bp, Artificial Sequence
  Synthetic
tctaatacgactcactatagggtaagcagtggtatcaacgcagagtacgaaacacaaagctcctcaaggattgtt

SEQ ID NO: 39496 - DNA, 75 bp, Artificial Sequence
  Synthetic
aacaggtgaatatctaataaaagatgtcttacgaaaaacttgctattgatattgctggtcatgagatcgatgctg

SEQ ID NO: 39497 - DNA, 75 bp, Artificial Sequence
  Synthetic
agaccatcaaggcatgggtccaagcctttgcgtatcaaggttttgatgcaaaaagggtgatggaactgctcgttg

SEQ ID NO: 39498 - DNA, 75 bp, Artificial Sequence
  Synthetic
agagaggtggagatgactgggttgaagatgctaaacagatgatcattttatgcctcaccagaggtaataagccct

SEQ ID NO: 39499 - DNA, 75 bp, Artificial Sequence
  Synthetic
caaaaatgatggttaaaatgtctgagaagggcaagaagattgttcagacccttgtgaagaggtattctcttaaag

SEQ ID NO: 39500 - DNA, 75 bp, Artificial Sequence
  Synthetic
aaggaaatccttctagagatgacctgactctgtccaggatcacagctgcattagcaggttacacttgccaggcaa

SEQ ID NO: 39501 - DNA, 75 bp, Artificial Sequence
  Synthetic
ctgagtatgtggaagagttcctcccagttactggaaagaacatggatgatctctccaaaaattatccaagggcca

SEQ ID NO: 39502 - DNA, 75 bp, Artificial Sequence
  Synthetic
tgatgcaccccagctttgctgggctgatagatccaaagctgccttcagatgtgctgtctaccatttgtgatgcat

SEQ ID NO: 39503 - DNA, 75 bp, Artificial Sequence
  Synthetic
tcagccttttcatggtgcagttctctagaactatcaacccgagaaatcgtggattgagtgtgtctgaagttgcca

SEQ ID NO: 39504 - DNA, 75 bp, Artificial Sequence
  Synthetic
gcacttttgacaggcctatgaatgctgctatcaacagctcattcattagtggcgagcaaagaaagtcattccttc

SEQ ID NO: 39505 - DNA, 75 bp, Artificial Sequence
  Synthetic
ggaatcttggaattctagatgaaaacatgcagccttcaagcccagtgaaggctgctgccaaagttttcagaggta

SEQ ID NO: 39506 - DNA, 75 bp, Artificial Sequence
  Synthetic
tgaaataatctgcctcagtgattcatcctaattggcataattgctcattaatcaatagataactcaattcaatta

SEQ ID NO: 39507 - DNA, 75 bp, Artificial Sequence
  Synthetic
ttaattttattcaatttaaataatcacatttcaaatcaaatttaattaaataataaaatcaaaattattcaataa

SEQ ID NO: 39508 - DNA, 75 bp, Artificial Sequence
  Synthetic
gattaaagcaaactcccaccaatcatcccaaattaacccaccctaaaccccctcaccccacctggcagctggtcc

SEQ ID NO: 39509 - DNA, 75 bp, Artificial Sequence
  Synthetic
gtctacttccatttcttcctcagaatctagatctgaatcccatgaatcagctattcttgtatatctagggctcat

SEQ ID NO: 39510 - DNA, 75 bp, Artificial Sequence
  Synthetic
tgtatgtaagggagtccactttctgttgcctaaaagttgcggggtgatgacttcagaaagttcttttacataatc

SEQ ID NO: 39511 - DNA, 75 bp, Artificial Sequence
  Synthetic
atatagtgaagaatggaaatcagattcatagtagtcatatggaagagcagtcagcattctcaaaacctggacata

SEQ ID NO: 39512 - DNA, 75 bp, Artificial Sequence
  Synthetic
tgcaacctccttttcaatattttgacctgtgaaatttaagcatggaatatcacgttctcccagttctctgatcaa

SEQ ID NO: 39513 - DNA, 75 bp, Artificial Sequence
  Synthetic
ctttttgtacaaattaactaaggaatcatctatctggacaccttcaccactcctcataattaatgtcatgagaaa

SEQ ID NO: 39514 - DNA, 75 bp, Artificial Sequence
  Synthetic
acacttctcttcccagttgaattcataactctcaatttgagacaatttaaagaaagctaatgttggcacaccaag

SEQ ID NO: 39515 - DNA, 75 bp, Artificial Sequence
  Synthetic
aggccagctcaaagcttctttaagatttggctctgaccatttcaattgacgctcaaggttgagatgagatatctt

SEQ ID NO: 39516 - DNA, 75 bp, Artificial Sequence
  Synthetic
ctctattgttgtatcaaagaaagaaggtgactttcctttaacctgaaggaatggtttcccccaagatcttgggag

SEQ ID NO: 39517 - DNA, 75 bp, Artificial Sequence
  Synthetic
ttgacctttatctataaagcttctcagcctaaaagatgttttatcagaaactgagaatgaggagcaaggaaactc

SEQ ID NO: 39518 - DNA, 75 bp, Artificial Sequence
  Synthetic
agctcctttgtatctacatatgggagtcccccagtagccattataagctgaatactccacatacacttttgatcg

SEQ ID NO: 39519 - DNA, 75 bp, Artificial Sequence
  Synthetic
gtcagttgcagacctagtgatatgtggaatgtcaaagacatagttcagcatgttagacatgatttattttattca

SEQ ID NO: 39520 - DNA, 75 bp, Artificial Sequence
  Synthetic
ctagtgatatgtggaatgtcaaagacatagttcagcatgttagacatgatttattttattcactatttcgatctc

SEQ ID NO: 39521 - DNA, 75 bp, Artificial Sequence
  Synthetic
acacaaagtcccctcttgagatcgtaatattgaacattaaacaaaatgtcttcgatgttgaactatacttacgat

SEQ ID NO: 39522 - DNA, 75 bp, Artificial Sequence
  Synthetic
cttcctcatatcactcgttgtgccaccaacagcaaacgggtttttgtagagtatgaagctttcaatggtcttcat

SEQ ID NO: 39523 - DNA, 75 bp, Artificial Sequence
  Synthetic
cattcacctatatgcaggtataagggggctgaatttccttgcacatcctttaaagcaactgacaagattgcttat

SEQ ID NO: 39524 - DNA, 75 bp, Artificial Sequence
  Synthetic
cgtctctccaagttcattgacaatggagagcttcccagatgttggggtaagcatcatcaacaagttactggatct

SEQ ID NO: 39525 - DNA, 75 bp, Artificial Sequence
  Synthetic
tctccttcattttttgacacaacaataaacaagatttcttatctcaatttagaaagacagctcaaatggtctgaa

SEQ ID NO: 39526 - DNA, 75 bp, Artificial Sequence
  Synthetic
cctaacctcaaagaggctttgagttggcctctaggtgtcccaaccctcgctttttttaagttgtcgagagtggat

SEQ ID NO: 39527 - DNA, 75 bp, Artificial Sequence
  Synthetic
agttatgtctttaactgggaagaaaagtgcctgctaatgactctgatcatgagatgtggggaaggagaccaaatt

SEQ ID NO: 39528 - DNA, 75 bp, Artificial Sequence
  Synthetic
gaccagtctcttgttaacttgtataaaaagatgatagttgaactgaataatagggaaatagcacacctcaacttt

SEQ ID NO: 39529 - DNA, 75 bp, Artificial Sequence
  Synthetic
actggacaagatattgaaaaagagatagcatatgttcaagttctcagaatgctaactgcgatcccctatgactac

SEQ ID NO: 39530 - DNA, 75 bp, Artificial Sequence
  Synthetic
tatgagtctgaatttcactcactactatatgactatgtcaaggagttatcgatggtgataactcctcacctgctt

SEQ ID NO: 39531 - DNA, 75 bp, Artificial Sequence
  Synthetic
ggaaatcgcaaatggacgcctttagcaacaatggacccaagattcatgggactggtggatgagtgggattcagat

SEQ ID NO: 39532 - DNA, 75 bp, Artificial Sequence
  Synthetic
tttgattcagactttgatcaggatgagctactagaatgggatgctgcccctgcctcacaggataggggagatggg

SEQ ID NO: 39533 - DNA, 75 bp, Artificial Sequence
  Synthetic
aaagaggagagggttgagggagttttttagtttttttgttttgttttttattttaaggtttttttgtttaatttt

SEQ ID NO: 39534 - DNA, 75 bp, Artificial Sequence
  Synthetic
gtttttttatgatttttttgtaattttattaattttatttaatttcccttaattgggacagggcagcactttact

SEQ ID NO: 39535 - DNA, 75 bp, Artificial Sequence
  Synthetic
tttggttcctgaagaccttggcagcggccttcacatggttggctggctgcatattgtcatcaagaattccaagat

SEQ ID NO: 39536 - DNA, 75 bp, Artificial Sequence
  Synthetic
tcttcaggaagatcttcctctgatctttagtaaggaaggaactattgatggcagcattcattggtcggtcaaaag

SEQ ID NO: 39537 - DNA, 75 bp, Artificial Sequence
  Synthetic
tactgaccacttctgcattgctaaggcctctgttcctgggattgatggttctggaaaactgaaccatgaagaggc

SEQ ID NO: 39538 - DNA, 75 bp, Artificial Sequence
  Synthetic
tgaaagcatcagttatcgtagacagcacatcagcaggaagacttgcgtcaataagaccagcaaagcttggatgca

SEQ ID NO: 39539 - DNA, 75 bp, Artificial Sequence
  Synthetic
tcatgggcctaggatagcttggggacaggctatccatgtgacggccagtcacaggcagatactcctcaaccactt

SEQ ID NO: 39540 - DNA, 75 bp, Artificial Sequence
  Synthetic
ccgtggcttgacaggtgtatcctgcgagtgctgcagtcactcgagaaagggttaaatcatccctagatgggttcc

SEQ ID NO: 39541 - DNA, 75 bp, Artificial Sequence
  Synthetic
cttctttcaggttgtatttctttatcagcccttgcacaatcttcttccctttctctgacattttggccatcattt

SEQ ID NO: 39542 - DNA, 75 bp, Artificial Sequence
  Synthetic
ttgttggcttgtttcctcttgtcaagcacaagataatcatttgcttggcgtcttccatccaattgtcaccccctc

SEQ ID NO: 39543 - DNA, 75 bp, Artificial Sequence
  Synthetic
tgagcttgaggagttcaatgactctacgagcatcaaatccttggtatgcaaaagcttgcacccaagcactaatgg

SEQ ID NO: 39544 - DNA, 75 bp, Artificial Sequence
  Synthetic
tcgcagtgtcaacctcatgaccagctaattcaacagccaacgattcataagaagtcattatggctatattcactt

SEQ ID NO: 39545 - DNA, 75 bp, Artificial Sequence
  Synthetic
attcaacagccaacgattcataagaagtcattatggctatattcacttgttaacaatccttgaggagctttgtgt

SEQ ID NO: 39546 - DNA, 75 bp, Artificial Sequence
  Synthetic
acacaaagaagcccaaactatggaagagatactaaaaaaacaatcaatcccaactgggacaggtttgaaccggcc

SEQ ID NO: 39547 - DNA, 75 bp, Artificial Sequence
  Synthetic
ggatgttaaacactatgatgacacaattatggatgtggagatcccatttttccatataacaaaatgtgacaactt

SEQ ID NO: 39548 - DNA, 75 bp, Artificial Sequence
  Synthetic
tatgaaaatagatttagatctcaacaatggtgtagactactcaacagtaggatcaagtttgagctcagtaattga

SEQ ID NO: 39549 - DNA, 75 bp, Artificial Sequence
  Synthetic
ggtacctgataaatctttgccaaatttgatacacgatattgtgttctcccatcttgctgattccactgacacaca

SEQ ID NO: 39550 - DNA, 75 bp, Artificial Sequence
  Synthetic
gttttctactcaatttggtgtgagatcagattcatatgatcatctatctcctgatgttattatcaaaactgctgc

SEQ ID NO: 39551 - DNA, 75 bp, Artificial Sequence
  Synthetic
aggatcttattttgttgttgagttcaccaccaacagaggtggtgagaagggagctctccaggcatgcaaagataa

SEQ ID NO: 39552 - DNA, 75 bp, Artificial Sequence
  Synthetic
attttcaaaatatcatatcccatgtgaaaatcgtgccattgattgtgtggtcagtctttttgtcatagcagttca

SEQ ID NO: 39553 - DNA, 75 bp, Artificial Sequence
  Synthetic
cacccgtggtgtgtggaccaacttagacattggcgaggaggactgtaatgaacttgttttcagattcagacttgc

SEQ ID NO: 39554 - DNA, 75 bp, Artificial Sequence
  Synthetic
agttgctatcatggaagaggcgaaaaagtattatccggagttgtctggagatgatagcgagctatctaagcatga

SEQ ID NO: 39555 - DNA, 75 bp, Artificial Sequence
  Synthetic
gagagagattttaggtgtagtctcatcaatccagatgaactgggagaaaaccacaggagcttttccttacttcaa

SEQ ID NO: 39556 - DNA, 75 bp, Artificial Sequence
  Synthetic
agagtctgtctttgaaaaatttctgacaacaccagctgacgaagagtacctatcaaatgttatttctgaagaact

SEQ ID NO: 39557 - DNA, 75 bp, Artificial Sequence
  Synthetic
taaagtttgccaggaggagatgatcaaatcgggttttattggaggttcatctggcattgatgagaagcttgataa

SEQ ID NO: 39558 - DNA, 75 bp, Artificial Sequence
  Synthetic
aaatttagaagaatgtgtggtagaagttgctaagtacttaagtaagttcagtaacactgaatatagaggcactct

SEQ ID NO: 39559 - DNA, 75 bp, Artificial Sequence
  Synthetic
tgaaagcaagtcaactattcaaattccaccttggttgatgtcagaattttcagatggtaaatcagtttcatgcct

SEQ ID NO: 39560 - DNA, 75 bp, Artificial Sequence
  Synthetic
aggtgagtttgaagtttcaggtgaacacccaatgtgtaaaatctggagagcagttacaatatctgcagctctggg

SEQ ID NO: 39561 - DNA, 75 bp, Artificial Sequence
  Synthetic
gcagatcgatagagctgatgactctccagaacaagaattagagaaggctcttaatgggtcaattgacaaaagtga

SEQ ID NO: 39562 - DNA, 75 bp, Artificial Sequence
  Synthetic
tgagagaagtagataccatcgattgaagctaaaccttggaagtgaagaggtaatgtatggcgcatgtcttggcgt

SEQ ID NO: 39563 - DNA, 75 bp, Artificial Sequence
  Synthetic
tgaagggaaaactcatagaaacaacattcaggttgaggagtcaagaaaaagaagcaagctgtgcttttccattga

SEQ ID NO: 39564 - DNA, 75 bp, Artificial Sequence
  Synthetic
gcatgatgtcagcaatctagaagaattcataaataagcatgaattagcattatttgaagaagatgaagatttgtt

SEQ ID NO: 39565 - DNA, 75 bp, Artificial Sequence
  Synthetic
caatccctttgatgtggatactgatctcagaatagcagcacagaaaatacatcaacctgacctaataaacaattg

SEQ ID NO: 39566 - DNA, 75 bp, Artificial Sequence
  Synthetic
tgatgggaatgaattcttagaaaatcatagaaagttcttgtcatctcgtctaggatcctggtgtcaaatggtttc

SEQ ID NO: 39567 - DNA, 75 bp, Artificial Sequence
  Synthetic
tttaataggggcagagctatctgcgtcagtaaaacaacatgtgggtgccggtcagtttgtaattaaaagactttt

SEQ ID NO: 39568 - DNA, 75 bp, Artificial Sequence
  Synthetic
aaactcaccactttttctgctaataaaacccacatcatcagtaagtcatatatttgtgtcatttgccttagtcaa

SEQ ID NO: 39569 - DNA, 75 bp, Artificial Sequence
  Synthetic
aaataatcatatggggaacctatgggatgatggcgttttcaaacattacatagatgctggggatctcctaatcac

SEQ ID NO: 39570 - DNA, 75 bp, Artificial Sequence
  Synthetic
tgacttcatttcttacaaactgagcaagctcaccaatctgtgcaagtgttttccgttggtcgagagctcagtctg

SEQ ID NO: 39571 - DNA, 75 bp, Artificial Sequence
  Synthetic
tttttggacagaagtgtttggttttgagccatggaatgcagtctccaatttgtcaaaagatagaagtggaagctc

SEQ ID NO: 39572 - DNA, 75 bp, Artificial Sequence
  Synthetic
taaagaagccacttctatgataaaactcacactacttactctaatggaggacaaagctgtaacagaagaaattca

SEQ ID NO: 39573 - DNA, 75 bp, Artificial Sequence
  Synthetic
aacaatacagagatacattgtgatggagggtttcgtttcatctccagaaatgccaaagccacacaaaatgattcc

SEQ ID NO: 39574 - DNA, 75 bp, Artificial Sequence
  Synthetic
taagttgccaactgtgttaagatcagaactacaagtttatcttctaaataggtgtttgaggacaatggaaacaat

SEQ ID NO: 39575 - DNA, 75 bp, Artificial Sequence
  Synthetic
atcaaggaaaccctttagactgcaaaagaaacaggggcaaatctcatggtctggactgttcaatcctttgacagg

SEQ ID NO: 39576 - DNA, 75 bp, Artificial Sequence
  Synthetic
aaatgtgctgagagaccttcagcccttaataagtatatgctacaatggctattttaaaaataaggaggaagaaac

SEQ ID NO: 39577 - DNA, 75 bp, Artificial Sequence
  Synthetic
tgaaccctcagcattgtccaggttgtacaagaagataatagagttagaacatttgtgtcctgagagtgatgaatt

SEQ ID NO: 39578 - DNA, 75 bp, Artificial Sequence
  Synthetic
tttaggtgaaggtgatccagtcaaccccaggatgcatgagtttagtagatcatttttaaagaagtgcaccgacca

SEQ ID NO: 39579 - DNA, 75 bp, Artificial Sequence
  Synthetic
tgggaaaacagtcttgaggaaagtttatggccacaactttattcagcagatagacacccaaataattagggaaat

SEQ ID NO: 39580 - DNA, 75 bp, Artificial Sequence
  Synthetic
cagttcaattacactagagaggcttgcaacactcaaagcaagtagtaattttgatgagaaatggtacaattacaa

SEQ ID NO: 39581 - DNA, 75 bp, Artificial Sequence
  Synthetic
cgagtgctcaaaaaaagactatcatagggaaaaggccatagtgaaaatgtcagactttgcagctacagggaaaac

SEQ ID NO: 39582 - DNA, 75 bp, Artificial Sequence
  Synthetic
actagctattgaagtatttgatgaaagtatgaagctcattgaagatagaggcaatatgcatatatgcctattcaa

SEQ ID NO: 39583 - DNA, 75 bp, Artificial Sequence
  Synthetic
gaaacagcagcatggaggagatagggaaatatatgtgctgggaagagaagagaggattgttcagtccatagttga

SEQ ID NO: 39584 - DNA, 75 bp, Artificial Sequence
  Synthetic
agctattgccagatcaattggaagatttttcccatcagacactctttgcaacccagctaataagacaaaaatacc

SEQ ID NO: 39585 - DNA, 75 bp, Artificial Sequence
  Synthetic
agaatcacatggcataagagccaggaaacattgtagagggccagtatggacctgttcaacatctgatgatgctag

SEQ ID NO: 39586 - DNA, 75 bp, Artificial Sequence
  Synthetic
aaaatggaatcaaggtcattttgtaacgaaatttgccctcatgctctgcgaattcacaatgccaaaatggtggcc

SEQ ID NO: 39587 - DNA, 75 bp, Artificial Sequence
  Synthetic
tattataatcagaggatgctctatgtttacaaacaagtacatgatgatgaacatgaggtacattgacattttgag

SEQ ID NO: 39588 - DNA, 75 bp, Artificial Sequence
  Synthetic
ccgacatcaagaacttcatgtggctgatgaattctcacagcagatatttaaagcataccacggggaagtggaagt

SEQ ID NO: 39589 - DNA, 75 bp, Artificial Sequence
  Synthetic
gccgtggatgacctctggaggcacatacctaaaaaccaaaacaggcatgatgcaagggatcttacattttacatc

SEQ ID NO: 39590 - DNA, 75 bp, Artificial Sequence
  Synthetic
ttctctgctacacacactacatcaagagtttgtcaggtcactcacctttaaaatcttcaatagcaaagttcaccc

SEQ ID NO: 39591 - DNA, 75 bp, Artificial Sequence
  Synthetic
agaaatgtcacagtcaattgttgtggacatgatgcagggttctgatgacagtagcatgatgattagttatccttg

SEQ ID NO: 39592 - DNA, 75 bp, Artificial Sequence
  Synthetic
ttctgatgagagtgttctcatgaagtgtaagatagcttcagctatttgtttccgcatgaaaaagagactaggaat

SEQ ID NO: 39593 - DNA, 75 bp, Artificial Sequence
  Synthetic
ctatctggcaatttatccttctgagaaatcaactgcgaacacagattttgtgatggagtacaactcagaattctt

SEQ ID NO: 39594 - DNA, 75 bp, Artificial Sequence
  Synthetic
tttccactctcagcatgtgagaccaactgtaaggtgggttgcagcatgctgcaatcttcctgaagtggaaactct

SEQ ID NO: 39595 - DNA, 75 bp, Artificial Sequence
  Synthetic
ggttgctaggcaggaagaggcatcaaatctaatgacatctatatcagaaggaggagggtcattttctttgtcagc

SEQ ID NO: 39596 - DNA, 75 bp, Artificial Sequence
  Synthetic
atgcatacaacaggctcaatgcacccttcattacatgctaatgggaatgggggttagctctctctttgaagagta

SEQ ID NO: 39597 - DNA, 75 bp, Artificial Sequence
  Synthetic
taaaaaggcaatattaaagtggaaagaccctgggcttggtttctttttgttagacaacccttactgtgctggttt

SEQ ID NO: 39598 - DNA, 75 bp, Artificial Sequence
  Synthetic
ggggggctttagatttaatttatataaagccatcaccactacaaacttaaaaggtttatattcatacttcatgaa

SEQ ID NO: 39599 - DNA, 75 bp, Artificial Sequence
  Synthetic
aaaggttcgacaagaaggtgaattatcaggcaacgtcattccagaaagctgctctgtgagccctggtggtgccat

SEQ ID NO: 39600 - DNA, 75 bp, Artificial Sequence
  Synthetic
tgtactaagttcagctttaagatggggttctaagcagaagttttacaagctgagagacaagcttaagattcctga

SEQ ID NO: 39601 - DNA, 75 bp, Artificial Sequence
  Synthetic
agactggatagaccagataaacaataacccttcagtgctttatagagcacccaaatctggagaagaggtcatatt

SEQ ID NO: 39602 - DNA, 75 bp, Artificial Sequence
  Synthetic
aagaattgcagaaaaagttcacagtccgggtgttgtatcgtcattatccactggcaatgctgtagccaaggtgat

SEQ ID NO: 39603 - DNA, 75 bp, Artificial Sequence
  Synthetic
agcatcttcagtttatttcctaagtgctgccatcttccaagattcaggaaagcaggagtactcaatactcgatca

SEQ ID NO: 39604 - DNA, 75 bp, Artificial Sequence
  Synthetic
atcaaaatatagtttacttcagaagctacacaaatttgaaggaatcaatttgaagaatgccataagtgatgaaga

SEQ ID NO: 39605 - DNA, 75 bp, Artificial Sequence
  Synthetic
cctattgtttttgtttcctaacatagaagacttacagtccttggatagtttggtttacaaccgaggagcaattga

SEQ ID NO: 39606 - DNA, 75 bp, Artificial Sequence
  Synthetic
aattgtcagaagaaagcagagtagagagaacactcagacaagagtcactgtgtttgagggaaatagaaatttgag

SEQ ID NO: 39607 - DNA, 75 bp, Artificial Sequence
  Synthetic
aactcctgcagaatatttaatttcagataaatggtttgggactcaaaagagtaagataggccgaacagcatttga

SEQ ID NO: 39608 - DNA, 75 bp, Artificial Sequence
  Synthetic
acaggaatgggacaagataacatccatcatcccatggttaggagaaacacctgaagaaacattaagcttgtcccc

SEQ ID NO: 39609 - DNA, 75 bp, Artificial Sequence
  Synthetic
tttggataaccacatccaaataaggaatttcttctccagaatggatcaaaaaccaagagttgtgagggtcacagg

SEQ ID NO: 39610 - DNA, 75 bp, Artificial Sequence
  Synthetic
tgcgccggtgaagaaaagatctggtgtaagcaagatatcaatggttattagagacaatttttctaaactcgggta

SEQ ID NO: 39611 - DNA, 75 bp, Artificial Sequence
  Synthetic
tatcaaagacattgaagatattacaggagctagtagaactacagctgcggagatgctcaaacatttcttgttttg

SEQ ID NO: 39612 - DNA, 75 bp, Artificial Sequence
  Synthetic
tgcattgcaaggtccttacactcaagaaatgaagcttcagcttgtcacgaaattgctttcaatttcaaatccaat

SEQ ID NO: 39613 - DNA, 75 bp, Artificial Sequence
  Synthetic
tgggatcaaggatagtgatggcaagtccaggtccaacattttagcaatattccaaaactacatatatggagacag

SEQ ID NO: 39614 - DNA, 75 bp, Artificial Sequence
  Synthetic
acaaattgctaggcagattgaggacgcaggggccggcacgataggtggttttatcattcctcaaaaaccaaagaa

SEQ ID NO: 39615 - DNA, 75 bp, Artificial Sequence
  Synthetic
aattgaaggatcagtatattattacggacctggagtctggaggggcatcatggatggcaaacaagttcaaatcga

SEQ ID NO: 39616 - DNA, 75 bp, Artificial Sequence
  Synthetic
attagacaatgcgataggaaatccaccttctattacagcagtaacaatggaagagtcagcagagccatggatgat

SEQ ID NO: 39617 - DNA, 75 bp, Artificial Sequence
  Synthetic
ttgcaggagcataaaaacctgggccgaagatatgggtgcaaaaaataacattgacatgtcaaagaaatactcaaa

SEQ ID NO: 39618 - DNA, 75 bp, Artificial Sequence
  Synthetic
ggaatgtaagtattggatgttcgacttcaagacatatagtgctgacaaggcatatggggtacctgtttatctgtc

SEQ ID NO: 39619 - DNA, 75 bp, Artificial Sequence
  Synthetic
atcaaaaagaatggtagactttaggcaggttaaagactcagagattgatatcaaggtccgtaaatcaacaatcaa

SEQ ID NO: 39620 - DNA, 75 bp, Artificial Sequence
  Synthetic
tctatttataaaaaatgagggcagagatgttcacatattgtcctatactgcaagtgattctgatctgagccctgc

SEQ ID NO: 39621 - DNA, 75 bp, Artificial Sequence
  Synthetic
agtactaaaaacatctgacaaaattaaagatgaaatgatggaattgtttcctagagaaccaagtagatcctgggc

SEQ ID NO: 39622 - DNA, 75 bp, Artificial Sequence
  Synthetic
ctcttgctcccccatcccttactttgctgttcataaaatacttagagtcacaacaggagaggttaatgtgacttc

SEQ ID NO: 39623 - DNA, 75 bp, Artificial Sequence
  Synthetic
acttgacaaggatagactttctgagataatgaagttatgttgtgaatcatcactgagatcaagagttggcaccat

SEQ ID NO: 39624 - DNA, 75 bp, Artificial Sequence
  Synthetic
attttcacctatacccatgctgtctgagggaaggcaacatgttgatgttgaagatttgatagacattgtactaac

SEQ ID NO: 39625 - DNA, 75 bp, Artificial Sequence
  Synthetic
agatttaaagagcaataacttcaatgaaatagtaaagtctctagaaaatgatttaaaagaggagtatgagttgga

SEQ ID NO: 39626 - DNA, 75 bp, Artificial Sequence
  Synthetic
agaatttgattattcagatatagatctattcgggccggcacattacaaagaactgtcagacctgaccacgataag

SEQ ID NO: 39627 - DNA, 75 bp, Artificial Sequence
  Synthetic
tcacccattgatggatgattttgtagaattctgtatatcatcattgggtcgtaaagagattagaagggttcttga

SEQ ID NO: 39628 - DNA, 75 bp, Artificial Sequence
  Synthetic
gcagggcagatgcaagaataaggatctaaagcttgctcaagatttattctcagctttaagaagaaatcctgatgg

SEQ ID NO: 39629 - DNA, 75 bp, Artificial Sequence
  Synthetic
tatcatagtggatgactacaatacacatattgatcaagagttcgaggacgatatgataggatagaataaaaagga

SEQ ID NO: 39630 - DNA, 75 bp, Artificial Sequence
  Synthetic
gaaaatgcaaatgagaaaacaaaacccttcctctatctggacagcgttcttaaggtgttcaacttgcttgttcac

SEQ ID NO: 39631 - DNA, 75 bp, Artificial Sequence
  Synthetic
ctggacagcgttcttaaggtgttcaacttgcttgttcactaaaataatgtgttcagataagggcggtctttgtgt

SEQ ID NO: 39632 - DNA, 75 bp, Artificial Sequence
  Synthetic
gaaacacaaagaagcccaaactatggaagaaatactaaacaaacaacaaatccccgagggggtaggattgtttag

SEQ ID NO: 39633 - DNA, 75 bp, Artificial Sequence
  Synthetic
gccagagataaagcaatatgatgattctatcatggatgttgagatacctttcttccacataaccaagtgtgatgg

SEQ ID NO: 39634 - DNA, 75 bp, Artificial Sequence
  Synthetic
gtacatgaagatagatttggacctaaataatggtgtcgattattcaactattgggtcatcattaatatcaaccat

SEQ ID NO: 39635 - DNA, 75 bp, Artificial Sequence
  Synthetic
tgaagttccagataaatctcttcccaatcttgttcatgatgtagtcttctcacatcttgctagcaacactgatgt

SEQ ID NO: 39636 - DNA, 75 bp, Artificial Sequence
  Synthetic
aatcttgttcatgatgtagtcttctcacatcttgctagcaacactgatgtgaggttttcatcagtatttggagtg

SEQ ID NO: 39637 - DNA, 75 bp, Artificial Sequence
  Synthetic
tttgcagattcttatgatcatctgtcccctgacttcattctaaaaacagctgctggatctcatcatgttgttgaa

SEQ ID NO: 39638 - DNA, 75 bp, Artificial Sequence
  Synthetic
cccctgacttcattctaaaaacagctgctggatctcatcatgttgttgaatttactaccaatagaggaggagaga

SEQ ID NO: 39639 - DNA, 75 bp, Artificial Sequence
  Synthetic
tttactaccaatagaggaggagagagaggagcttttcaagcatgcaaagataaattctctaagtaccacatccct

SEQ ID NO: 39640 - DNA, 75 bp, Artificial Sequence
  Synthetic
tgtgagaatagagctgtaggaggcagggtttctctttttgtgatttctgtgtatgtcagaggtgtgtggtcaaac

SEQ ID NO: 39641 - DNA, 75 bp, Artificial Sequence
  Synthetic
cttgatttaacagatgatgaagtcaatgagctcgtgtttaggttcaggctggcagtggctataatggaggaggca

SEQ ID NO: 39642 - DNA, 75 bp, Artificial Sequence
  Synthetic
aaaagatattatcctgaactaacagaagatgagagtgagatgacaaagcaggagagagaaattctcggcattgtg

SEQ ID NO: 39643 - DNA, 75 bp, Artificial Sequence
  Synthetic
tcttcaatacaaatggactggaaggagactagcttgaaattcccgcactttaaggaaaaattgttcgaggacttt

SEQ ID NO: 39644 - DNA, 75 bp, Artificial Sequence
  Synthetic
ctgacgatgtctgcagatgaggaatatctctcaggcataatatctgaggagatcactgcgtgtcaggaggatatg

SEQ ID NO: 39645 - DNA, 75 bp, Artificial Sequence
  Synthetic
atgaactcggggttcattgggaaggtgacaggcatagatgagaagcttaaactgaatgaatcagagtgtagcaaa

SEQ ID NO: 39646 - DNA, 75 bp, Artificial Sequence
  Synthetic
tgacaggcatagatgagaagcttaaactgaatgaatcagagtgtagcaaaatgattgacaattacctgaaaggca

SEQ ID NO: 39647 - DNA, 75 bp, Artificial Sequence
  Synthetic
gaggatccaactgcagagacaaattagacagtaaatccacagttcagattccaccatgggtgatgactgagtatt

SEQ ID NO: 39648 - DNA, 75 bp, Artificial Sequence
  Synthetic
ccaccatgggtgatgactgagtatttggatggaaaatcggtatcttgtttgtcagggtttgaagtagaaggtgat

SEQ ID NO: 39649 - DNA, 75 bp, Artificial Sequence
  Synthetic
catccaatgtgtaaaatatggagatctgtcacaattgcagctgccatgggtgatatagatcgtgctgatgatgat

SEQ ID NO: 39650 - DNA, 75 bp, Artificial Sequence
  Synthetic
ctgtcacaattgcagctgccatgggtgatatagatcgtgctgatgatgatcctgatactgagcttaagaaggccc

SEQ ID NO: 39651 - DNA, 75 bp, Artificial Sequence
  Synthetic
tgatatagatcgtgctgatgatgatcctgatactgagcttaagaaggccctagaaggcagcatacagaagagtga

SEQ ID NO: 39652 - DNA, 75 bp, Artificial Sequence
  Synthetic
tgagaggagtaggtatcatcgtataaaactaaatctgtctaatgaggagatagtttatggtgcaactttgggtgt

SEQ ID NO: 39653 - DNA, 75 bp, Artificial Sequence
  Synthetic
tagtttatggtgcaactttgggtgttgaaggaaagtctcataaaaacaatgcccaagttgaagagtcaaggaaga

SEQ ID NO: 39654 - DNA, 75 bp, Artificial Sequence
  Synthetic
gaagtaaacttgggttttctctagaccacgacataacaaatttagaagaattcatcaacaaacatgatcttgagt

SEQ ID NO: 39655 - DNA, 75 bp, Artificial Sequence
  Synthetic
tgtttgcagaatccgatgattattttaaccctttccagattgattttgacttgagagaatcagctcaaaaaatac

SEQ ID NO: 39656 - DNA, 75 bp, Artificial Sequence
  Synthetic
atcagccagatctcatcatggatcagggtgagaatgagtttttagcaaaccataagaagttatgcatgtctaagc

SEQ ID NO: 39657 - DNA, 75 bp, Artificial Sequence
  Synthetic
taggctcttggtgccaaatggtctcattgattggtgctgagttatcagcatcggttaaacaacatgtggggaaag

SEQ ID NO: 39658 - DNA, 75 bp, Artificial Sequence
  Synthetic
gccaatttgtgatcaaaagagttttaaactcccctctcttcatgctaatcaaacccacatcttctgttagtcata

SEQ ID NO: 39659 - DNA, 75 bp, Artificial Sequence
  Synthetic
tttttgtttcttttgcacttttaaaatctagtcacatgggagatctgtgggacaatggtgtctttaagcattata

SEQ ID NO: 39660 - DNA, 75 bp, Artificial Sequence
  Synthetic
ttgatgcaggagacttgttcatcactgattttatttcttataagctaagcaagctaaccaacctttgcaagtgtt

SEQ ID NO: 39661 - DNA, 75 bp, Artificial Sequence
  Synthetic
tcccccttatggaaagtgcaatctgtttttggactgaaatttttggctttgagccctggaattctacacacataa

SEQ ID NO: 39662 - DNA, 75 bp, Artificial Sequence
  Synthetic
tgtcgactgacaggagtggaagctcaaaagaggcagcatcaatgattaaattaactctgctgactctcatggaag

SEQ ID NO: 39663 - DNA, 75 bp, Artificial Sequence
  Synthetic
aaaagaggcagcatcaatgattaaattaactctgctgactctcatggaagataaagcagtcactgaagagattca

SEQ ID NO: 39664 - DNA, 75 bp, Artificial Sequence
  Synthetic
ataaagcagtcactgaagagattcagactattcaaagatatataattatggaagggttcgtatcgttgcctgaat

SEQ ID NO: 39665 - DNA, 75 bp, Artificial Sequence
  Synthetic
taccaaaacctcacaaaatgttgtctaaacttccagccgtgctgagatcagaactgcaagtatatctagttttaa

SEQ ID NO: 39666 - DNA, 75 bp, Artificial Sequence
  Synthetic
gaactgcaagtatatctagttttaagatctctgagaacaatggagaggatatctagacatccttttagattgcag

SEQ ID NO: 39667 - DNA, 75 bp, Artificial Sequence
  Synthetic
aaaaaacatagccagatctcctggtcaggattgtttaatcccttaactggtaattctctcagggagctacaacca

SEQ ID NO: 39668 - DNA, 75 bp, Artificial Sequence
  Synthetic
taattctctcagggagctacaaccactaattagcatatgttataatggatacttcaagaacaaagaggaggaaac

SEQ ID NO: 39669 - DNA, 75 bp, Artificial Sequence
  Synthetic
tgaaccctctgctttgtcaagactatataagaagattatagaattagagcatctgtgtccaactgatgatatcta

SEQ ID NO: 39670 - DNA, 75 bp, Artificial Sequence
  Synthetic
tctaggatcaggtgacccaaaggagccaaagatgcatgagttcagcaggtcatttctaaaaaaatgcactgacca

SEQ ID NO: 39671 - DNA, 75 bp, Artificial Sequence
  Synthetic
tgggaagaccatattaagaaagatctacgggcagaactttctgcaacaaatagacactcagatcatgagagagat

SEQ ID NO: 39672 - DNA, 75 bp, Artificial Sequence
  Synthetic
tagtactattactcttgaaaagctggcaacattaaaagctagtagtaattttgatgagaagtggtatgattatga

SEQ ID NO: 39673 - DNA, 75 bp, Artificial Sequence
  Synthetic
aaaatgtagcaaagaagattaccatcgtgagaaggcaattgtcaagatgtctgaatttgctgcatctggaaagac

SEQ ID NO: 39674 - DNA, 75 bp, Artificial Sequence
  Synthetic
attggccatagaagtctttgatgagtgcatgaaattcgtggagagaagaggcaatatgcatatttgcctttttaa

SEQ ID NO: 39675 - DNA, 75 bp, Artificial Sequence
  Synthetic
gaaacaacaacatggtggagatagggaaatctatgtcctgggtagagaagaaagaataattcaatccatagtcga

SEQ ID NO: 39676 - DNA, 75 bp, Artificial Sequence
  Synthetic
ggcaatatccagatcaattggcaggttctttccctcggacaccctgtgcaatcctggcaacaagattaaaatacc

SEQ ID NO: 39677 - DNA, 75 bp, Artificial Sequence
  Synthetic
tgaaacacatgggataagagctagaaaacactgcaaaggtgctgtgtggacttgctctacatcagatgatgctag

SEQ ID NO: 39678 - DNA, 75 bp, Artificial Sequence
  Synthetic
gaaatggaatcaaggtcactttgtcacaaagtttgctttgatgttatgtgaattcacccttcctaaatggtggcc

SEQ ID NO: 39679 - DNA, 75 bp, Artificial Sequence
  Synthetic
aatcatcattaggggatgctcaatgttcaccaacaagtatatgatgatgaacatgagatatatcagtattctgag

SEQ ID NO: 39680 - DNA, 75 bp, Artificial Sequence
  Synthetic
caggcataaagaattggatattgaagacgaattttctagaactatatttaaagcctttcatggagaagtgacagt

SEQ ID NO: 39681 - DNA, 75 bp, Artificial Sequence
  Synthetic
gccatggatggatgcaggggccactttcttaaaaacgaaaacagggatgatgcagggcatattgcatttcacttc

SEQ ID NO: 39682 - DNA, 75 bp, Artificial Sequence
  Synthetic
tgcagggcatattgcatttcacttcatctctcttacacacacttcatcaagaattcatcagatcattatcattta

SEQ ID NO: 39683 - DNA, 75 bp, Artificial Sequence
  Synthetic
aaatcttcaatactaaggtgaggccagaaatgtcacagtcagttgtgattgatatgatgcagggttctgatgata

SEQ ID NO: 39684 - DNA, 75 bp, Artificial Sequence
  Synthetic
gtagcatgatgattagcttcccatgctctaatgaagatgaactaatgaaatgtaagattgccgctgctatttgct

SEQ ID NO: 39685 - DNA, 75 bp, Artificial Sequence
  Synthetic
ttaggataaagaagagattaggaatcttcttagccatttacccttctgaaaaatctacttctaacactgactttg

SEQ ID NO: 39686 - DNA, 75 bp, Artificial Sequence
  Synthetic
tgatggaatataattcagagtttttcttccactctcagcatgtccgtccgacagttagatggatagccgcatgtt

SEQ ID NO: 39687 - DNA, 75 bp, Artificial Sequence
  Synthetic
gcaaccttcctgaggtagagactctagttgccagacaagaagaggcttctaacctaatgacttctgtgtcagaag

SEQ ID NO: 39688 - DNA, 75 bp, Artificial Sequence
  Synthetic
agttgccagacaagaagaggcttctaacctaatgacttctgtgtcagaaggtgggggctcattttccttagcagc

SEQ ID NO: 39689 - DNA, 75 bp, Artificial Sequence
  Synthetic
ttgtatccagcaggcccaatgcactctacactatatgttgatggggatgggggttagttcattattcgaagagta

SEQ ID NO: 39690 - DNA, 75 bp, Artificial Sequence
  Synthetic
ctacactatatgttgatggggatgggggttagttcattattcgaagagtacaaaaaagcaattatccgatggaaa

SEQ ID NO: 39691 - DNA, 75 bp, Artificial Sequence
  Synthetic
caaaaaagcaattatccgatggaaagatcctggtttaggcttctttctgctagacaatccttattgtgcaggatt

SEQ ID NO: 39692 - DNA, 75 bp, Artificial Sequence
  Synthetic
aggagggtttagatttaacctgtataaagctattgcccagacaccactaaaatgtctttattcgtacttcatgaa

SEQ ID NO: 39693 - DNA, 75 bp, Artificial Sequence
  Synthetic
gaaggttagacatggcttagagactaatgatggaacaattccagagagctgctcagttagcccaggaggtgccat

SEQ ID NO: 39694 - DNA, 75 bp, Artificial Sequence
  Synthetic
tgtgttgagttctgcacttaggtggggatcaaaacagaagttttacaaacttagagataagttaaacatccctga

SEQ ID NO: 39695 - DNA, 75 bp, Artificial Sequence
  Synthetic
agactggattgatcagattaaccaaaacccatccatattatatagagctccaagatctggtgaagaagtcattct

SEQ ID NO: 39696 - DNA, 75 bp, Artificial Sequence
  Synthetic
tagaattgctgaaaaggtgcactcacccggagttgtttcttccttgtcaacaggtaatgctgtagctaaggtcat

SEQ ID NO: 39697 - DNA, 75 bp, Artificial Sequence
  Synthetic
tgcctcatctgtatacttcctaagtgcggctatatttcaggattccggtaggcaagaattctctattctagatga

SEQ ID NO: 39698 - DNA, 75 bp, Artificial Sequence
  Synthetic
ctcaaagtacagcttgctgcagaagttaagtaagctcgaaggaattaatcttactaatgcaatcagtgatgagga

SEQ ID NO: 39699 - DNA, 75 bp, Artificial Sequence
  Synthetic
cttattgttcttattcccaaatattgaagatctacaatctcttgacagtttagtgtacaatagaggagctattga

SEQ ID NO: 39700 - DNA, 75 bp, Artificial Sequence
  Synthetic
gattgtaaaaaggaaacagataaaagagaacacacagtctagagtgattgtctttgaaggtaatagaaatctcag

SEQ ID NO: 39701 - DNA, 75 bp, Artificial Sequence
  Synthetic
aactcccgcagagtatctaataagtgataaatggtttgggacccaaaaaagtaaaattgggagaacagcatttga

SEQ ID NO: 39702 - DNA, 75 bp, Artificial Sequence
  Synthetic
ccaagaatgggttaaagtcacatcaatcatcccctggctaagggagagtccacaagaaactcttcagagctctcc

SEQ ID NO: 39703 - DNA, 75 bp, Artificial Sequence
  Synthetic
atcatcccctggctaagggagagtccacaagaaactcttcagagctctccactggacaatcacatccaaattaga

SEQ ID NO: 39704 - DNA, 75 bp, Artificial Sequence
  Synthetic
aatttcttctccagaatggatcaaaaaccaagagtagttagagttacaggtgcgccaataaagaaaaggtcaggt

SEQ ID NO: 39705 - DNA, 75 bp, Artificial Sequence
  Synthetic
tgcgccaataaagaaaaggtcaggtgttagtaaattgtcaatggtcataagggacaacttctcaaaattaggatt

SEQ ID NO: 39706 - DNA, 75 bp, Artificial Sequence
  Synthetic
tattagagacattgaagacataactggtacaagtagaacaaattctgctgagttgctcaaacacttcatgttttg

SEQ ID NO: 39707 - DNA, 75 bp, Artificial Sequence
  Synthetic
tgctctgcagggtccatactctcaagaaaggaaacttcagatggtgatagatctcttgaacaaatcaaatcccat

SEQ ID NO: 39708 - DNA, 75 bp, Artificial Sequence
  Synthetic
aggcatcaaggacagtgatggtaaatcacggtcaaacattttggcaattttgcagagttatgtgtatggagagcc

SEQ ID NO: 39709 - DNA, 75 bp, Artificial Sequence
  Synthetic
tgcagagttatgtgtatggagagccacatattgcacggcaaattgaagatgctggtgcaggcatcattggaggat

SEQ ID NO: 39710 - DNA, 75 bp, Artificial Sequence
  Synthetic
ttgtagtcccgcaaaaacctaaaaagattgaaaacacagtatattattatggttatggtgtatggagaggggtaa

SEQ ID NO: 39711 - DNA, 75 bp, Artificial Sequence
  Synthetic
tggatggaaagcaggtgcaaatcgagcttgataatgcagtaggcagccctcctgttataatctctgtcactatgg

SEQ ID NO: 39712 - DNA, 75 bp, Artificial Sequence
  Synthetic
aagagtctgctgagccctggcagatatgcaagagcataaggtcctgggctgaagatgtgggtgcaaagaataatt

SEQ ID NO: 39713 - DNA, 75 bp, Artificial Sequence
  Synthetic
gaagatgtgggtgcaaagaataatttggatatctccccgaagataaagaagaggacttgcaaatactggatgttt

SEQ ID NO: 39714 - DNA, 75 bp, Artificial Sequence
  Synthetic
gattttaaaacattttcttctgataaggcatatggtgctcctgtctacatgacaaagaagaagatggttgatttc

SEQ ID NO: 39715 - DNA, 75 bp, Artificial Sequence
  Synthetic
agactaattgatgatgcagaaataagtataaaagtcagaaaatccactgtgaatttgtatatcagaaatgatggt

SEQ ID NO: 39716 - DNA, 75 bp, Artificial Sequence
  Synthetic
agagatgttcatatactttcttactcagcatcagattcagatctcagccctgctagcttgaggattaacgatgaa

SEQ ID NO: 39717 - DNA, 75 bp, Artificial Sequence
  Synthetic
tctaaggatgaaatgatggtgttattcaataaagaacctagcaagtcttgggcgtcatgctcaccaatcccggct

SEQ ID NO: 39718 - DNA, 75 bp, Artificial Sequence
  Synthetic
atcatgatgcataagatcatcaaagttgttcaaggagaacttaaaatagcgtcactagacagtagcagactagga

SEQ ID NO: 39719 - DNA, 75 bp, Artificial Sequence
  Synthetic
gagatcatgaaattgtgctgtgaatcatcattaagatctaggattggaactctgttttctgctcttccaagtgtg

SEQ ID NO: 39720 - DNA, 75 bp, Artificial Sequence
  Synthetic
tctgttttctgctcttccaagtgtgcaaaacacctctagagttgatgttgatgatttgatagatattgtcctgac

SEQ ID NO: 39721 - DNA, 75 bp, Artificial Sequence
  Synthetic
tgactcaaaaacagccggctttagagaaatagtacagtcactagagaatgacataaaagatgagtatgaggtaga

SEQ ID NO: 39722 - DNA, 75 bp, Artificial Sequence
  Synthetic
agattttgacttgtctgacatagatttgttcggaccagcacattataaagaactgtcagacctaaacaccataag

SEQ ID NO: 39723 - DNA, 75 bp, Artificial Sequence
  Synthetic
tcatccgttaatggatgattacgtggagttttgtatatcaacaattggtcgaaaggaattgagacgagtgttaga

SEQ ID NO: 39724 - DNA, 75 bp, Artificial Sequence
  Synthetic
gaccaacagatgtaaaactaaagacttgcagttatctaaggatctctttttggtattaggcaggaatccagatga

SEQ ID NO: 39725 - DNA, 75 bp, Artificial Sequence
  Synthetic
tattaaagtggatgagtacaacttaagagaacaaatggcagtggaagacgacatgataggataaaatcctacaac

SEQ ID NO: 39726 - DNA, 75 bp, Artificial Sequence
  Synthetic
atatctttaggtgtgaacacaaggtctcctcataattgaacactcatccccaagtgagggattggattttgaaat

SEQ ID NO: 39727 - DNA, 75 bp, Artificial Sequence
  Synthetic
ttgaacactcatccccaagtgagggattggattttgaaatattgtaaagtgttcaattatgggcggactttgtgt

SEQ ID NO: 39728 - DNA, 75 bp, Artificial Sequence
  Synthetic
acacaaagctcctcaaggattgttaactagtgaattactacaccaagatgtcttatgaaagacttgctgttgata

SEQ ID NO: 39729 - DNA, 75 bp, Artificial Sequence
  Synthetic
ttgccggccatgaaattgatgccgacactatcaaagcctgggtgcaagcttttgcttatcaaggctttgatgcta

SEQ ID NO: 39730 - DNA, 75 bp, Artificial Sequence
  Synthetic
agagggtgatggagttgctcgtggagagaggtggggatgattgggttgaggacgccaagcagatgattattctgt

SEQ ID NO: 39731 - DNA, 75 bp, Artificial Sequence
  Synthetic
gagaggtggggatgattgggttgaggacgccaagcagatgattattctgtgcctcacaagaggaaacaagccctc

SEQ ID NO: 39732 - DNA, 75 bp, Artificial Sequence
  Synthetic
gggcaacccttctagagatgatctgacattgtccagagtgactgctgccttagctggttacacttgccaggccac

SEQ ID NO: 39733 - DNA, 75 bp, Artificial Sequence
  Synthetic
agaatatgtagaggaattccttcctgttactggcaaaaacatggatgatctctccaaaaactatcccagggcaat

SEQ ID NO: 39734 - DNA, 75 bp, Artificial Sequence
  Synthetic
gttactggcaaaaacatggatgatctctccaaaaactatcccagggcaatgatgcatcctagcttcgctgggctc

SEQ ID NO: 39735 - DNA, 75 bp, Artificial Sequence
  Synthetic
tggttttaattcccacccaataatttgattataattttctttgattgacccaccttaattaaattaataaaatta

SEQ ID NO: 39736 - DNA, 75 bp, Artificial Sequence
  Synthetic
caccttaattaaattaataaaattaaataaattaaataaattaataaatagtacaaattaaacaaactaatcaaa

SEQ ID NO: 39737 - DNA, 75 bp, Artificial Sequence
  Synthetic
acataatcatacaatgaagagtggaagtctgattcataatagtcataaggcaaggcagtaagcattctcagaact

SEQ ID NO: 39738 - DNA, 75 bp, Artificial Sequence
  Synthetic
caaggcagtaagcattctcagaacttggacatatgcaatctctttctcaatattttgaccagtgaaatttaaaca

SEQ ID NO: 39739 - DNA, 75 bp, Artificial Sequence
  Synthetic
atcaccacttctcatgatcagtgtcatgaggaagcatttttcttcccaattaaattcatagctctccactaaaga

SEQ ID NO: 39740 - DNA, 75 bp, Artificial Sequence
  Synthetic
gagcttaaagaatgctagagtaggaacacctaaaggccaactgagtgcttctttaagattgggctctgaccactt

SEQ ID NO: 39741 - DNA, 75 bp, Artificial Sequence
  Synthetic
tagctgtctttccaagttaaggtgtgagatcttctcaattgtggtgtcaaagaatgagggtgatttccctttcac

SEQ ID NO: 39742 - DNA, 75 bp, Artificial Sequence
  Synthetic
agaatgagggtgatttccctttcacctggagaaatggtttcccccatgatcttggaagttgacctttatctatga

SEQ ID NO: 39743 - DNA, 75 bp, Artificial Sequence
  Synthetic
acacaaagaagcccaaactatggaagaaatactaaacaagcaacaaatccctgagggggtaggattgtatagacc

SEQ ID NO: 39744 - DNA, 75 bp, Artificial Sequence
  Synthetic
ggaagtgagacaatatgacgattctataatggatgtcgaaattcctttctttcacataacaaagtgtgatggata

SEQ ID NO: 39745 - DNA, 75 bp, Artificial Sequence
  Synthetic
tatgaagatagatcttgacttgaataatggtgtcgactactcaacaataggatcatccctcctgtccactataga

SEQ ID NO: 39746 - DNA, 75 bp, Artificial Sequence
  Synthetic
agtcccagacaagtctttaccgaatcttgtgcatgatattgttttctctcacttggcaaataacactgatgtcag

SEQ ID NO: 39747 - DNA, 75 bp, Artificial Sequence
  Synthetic
attttcaaccatctttggggtattgtcggactcatatgatcatttgtcaccagatctcatcctgaagactgcagc

SEQ ID NO: 39748 - DNA, 75 bp, Artificial Sequence
  Synthetic
aggatcataccatgtggtggaatttacgacaaatagaggaggagaaagaggagcacatcaggcttgtaaagataa

SEQ ID NO: 39749 - DNA, 75 bp, Artificial Sequence
  Synthetic
gttttctaaatatcacattccttgtgaaaatagagccactacaaatagggtgtcattgttcgtcatatctgttta

SEQ ID NO: 39750 - DNA, 75 bp, Artificial Sequence
  Synthetic
tgtgagaggcgtttggtcaaatcttgatttaactgacgatgaagttaatgaactggtcttcagatttcgtcttgc

SEQ ID NO: 39751 - DNA, 75 bp, Artificial Sequence
  Synthetic
tattgcaattatggaagaagcaaaaagatactacccagaattgacagaagatgagagcgaaatgactaagcagga

SEQ ID NO: 39752 - DNA, 75 bp, Artificial Sequence
  Synthetic
aagagaaattctaggggtggtctcatcaatccaaatggattggagaaccacatcttcaaaattccctcatttcaa

SEQ ID NO: 39753 - DNA, 75 bp, Artificial Sequence
  Synthetic
agaaaagttgtttgaagattttatgaccacctcagcagatgaagagtatttatcaaatgttatttcagaggagct

SEQ ID NO: 39754 - DNA, 75 bp, Artificial Sequence
  Synthetic
aacagcttgtcaagaggagatgataaaatcaggtttcatcggtcaggtggaggggatagatgacaagttacagtt

SEQ ID NO: 39755 - DNA, 75 bp, Artificial Sequence
  Synthetic
aaatgaactagagtgtgctaagatgattagcaaatacttagaaggtcgaagcaatgaatgcagggataaattaga

SEQ ID NO: 39756 - DNA, 75 bp, Artificial Sequence
  Synthetic
gagtaagtccacagtgcagataccaccatggacaatgacagattatattgacggcaagtctgtttcctgcttatc

SEQ ID NO: 39757 - DNA, 75 bp, Artificial Sequence
  Synthetic
agagtttgaagtagagggagagcaccctatgtgtaaaatctggaggtcagttacagttgcagctgcaatgggaga

SEQ ID NO: 39758 - DNA, 75 bp, Artificial Sequence
  Synthetic
catagacagagctgatgatgaccctgaaacagagctaaagaaggctcttgaagggagtgttgagaaaagcgatga

SEQ ID NO: 39759 - DNA, 75 bp, Artificial Sequence
  Synthetic
acgcagtaagtaccacaggataagacttaatctttctaacgaagagataatctatggggccactcttggtgttga

SEQ ID NO: 39760 - DNA, 75 bp, Artificial Sequence
  Synthetic
aggaaaatcacataggaataatgcccaagtggaggaatcacgtaagaggagtaaattgggattctcttttgatca

SEQ ID NO: 39761 - DNA, 75 bp, Artificial Sequence
  Synthetic
tgacataaccaatcttgaagaatttataaacaaacatgatttggaattgttctctgaatcagatgagtactttaa

SEQ ID NO: 39762 - DNA, 75 bp, Artificial Sequence
  Synthetic
tcctttccaagcagattttgatcttagagaatcagctcagaggatccaccagccagatttaataatagagaatgg

SEQ ID NO: 39763 - DNA, 75 bp, Artificial Sequence
  Synthetic
tgagaatgagtttctgagtaatcataagaaattctgcatgtcaaaaataggatcctggtgtcagatggtctcact

SEQ ID NO: 39764 - DNA, 75 bp, Artificial Sequence
  Synthetic
aataggtgcagagctctcagcatcagttaaacagcatgttggtaaaggccagtttgtgataaaaagaatactcaa

SEQ ID NO: 39765 - DNA, 75 bp, Artificial Sequence
  Synthetic
ttctcccttattcatgctgataaaaccaacttcctctgtgagccacatatttgtctcttttgcccttgtgaaatc

SEQ ID NO: 39766 - DNA, 75 bp, Artificial Sequence
  Synthetic
aaaccacatgggagatctgtgggaaaatggagtattcaagcattacattgatgcaggggatctatttataactga

SEQ ID NO: 39767 - DNA, 75 bp, Artificial Sequence
  Synthetic
ttttgtgtcttataaattgagcaaactcactaatctgtgcaagtgtttccctctcatggagagtgcgatctgttt

SEQ ID NO: 39768 - DNA, 75 bp, Artificial Sequence
  Synthetic
ctggactgaagtttttggctttgagccttggggatcagtgcacaccatgtcagttgacaggagtggtagctcaaa

SEQ ID NO: 39769 - DNA, 75 bp, Artificial Sequence
  Synthetic
agaggcagcttcaatgatcaaacttacactattaactctgatggaagacaaggctgtcacagaagaaatacaaac

SEQ ID NO: 39770 - DNA, 75 bp, Artificial Sequence
  Synthetic
cattcagagatacatcatcatggaaggtttcgtatccttgccagaattgccaaagccgcataagatgttgtcaaa

SEQ ID NO: 39771 - DNA, 75 bp, Artificial Sequence
  Synthetic
gttacctgcagtgctgagatcagaattacaggtgtacctaacactgaggtctctcagaactatggaaagaatttc

SEQ ID NO: 39772 - DNA, 75 bp, Artificial Sequence
  Synthetic
cagacacccttttcgattgcagaagaaacaaagtcagatttcatggtcgggcattttcaaccctctaactggtag

SEQ ID NO: 39773 - DNA, 75 bp, Artificial Sequence
  Synthetic
tccactgagggatctacaaccattgattagcatttgctataatggttattttaaaaataaagaggaagagacaga

SEQ ID NO: 39774 - DNA, 75 bp, Artificial Sequence
  Synthetic
gccatctgcattatcaaggctatataagaagatcatagaattagaacatttatgtcccacagatgataaatactt

SEQ ID NO: 39775 - DNA, 75 bp, Artificial Sequence
  Synthetic
ggggagcggagacccaaaagcaccaaagatgcatgaattcagtagatctttcttaaagaagtgtacggatcacgg

SEQ ID NO: 39776 - DNA, 75 bp, Artificial Sequence
  Synthetic
gaagactatactgaggaagatttatggccaaaactttattcagcaaattgatgttcaaattatgagagaaattgg

SEQ ID NO: 39777 - DNA, 75 bp, Artificial Sequence
  Synthetic
aacaatcactttagaaagactggcaactctcaaagctagcagcaattttgacgaaaagtggtataaatattcaaa

SEQ ID NO: 39778 - DNA, 75 bp, Artificial Sequence
  Synthetic
gtgtgaaaaagacgactatcatagagagaaggctatagttaagatgtcagagtttgcttcatctggcaaaacact

SEQ ID NO: 39779 - DNA, 75 bp, Artificial Sequence
  Synthetic
tgcaattgaagtgtttgatgaatgcatgaagcacatagaaaatagaggaaacatgcatatttgcttatttaagaa

SEQ ID NO: 39780 - DNA, 75 bp, Artificial Sequence
  Synthetic
gcaacagcatggtggggatcgagaaatttatgtactagggagagaagagaggattgtgcaatctattattgaagc

SEQ ID NO: 39781 - DNA, 75 bp, Artificial Sequence
  Synthetic
tatatctaggtcaattggaagattcttcccttcagacacattatgcaatcctgggaacaagataaagattcctga

SEQ ID NO: 39782 - DNA, 75 bp, Artificial Sequence
  Synthetic
aactcatggcattagagctaggaaacactgcaagggtgcagtgtggacatgttccacatcagatgacgcaagaaa

SEQ ID NO: 39783 - DNA, 75 bp, Artificial Sequence
  Synthetic
atggaatcagggtcattttgtgactaagtttgcactaatgttgtgtgaattcactcttcctaaatggtggccaat

SEQ ID NO: 39784 - DNA, 75 bp, Artificial Sequence
  Synthetic
aattatacgaggttgctctatgttcacaaacaagtatatgatgatgaacatgagatatataagcattcttagcag

SEQ ID NO: 39785 - DNA, 75 bp, Artificial Sequence
  Synthetic
gcacaaagaacttgaggttgaagatgaattctcaagaacaatttttaaagccttccatggagaggttattgtgcc

SEQ ID NO: 39786 - DNA, 75 bp, Artificial Sequence
  Synthetic
ttggatgagtgatggatccacttatctcaaaactaaaacagggatgatgcaaggaattcttcatttcacctcatc

SEQ ID NO: 39787 - DNA, 75 bp, Artificial Sequence
  Synthetic
actgctccacacactccatcaagaatttataagatctttatcatttaaaatatttaacacgaaagttaagcctga

SEQ ID NO: 39788 - DNA, 75 bp, Artificial Sequence
  Synthetic
aatgtcacaatcaatagttatagacatgatgcagggatcagatgatagcagcatgatgataagttttccttgttc

SEQ ID NO: 39789 - DNA, 75 bp, Artificial Sequence
  Synthetic
taatgaagatgagctgatgaagtgtaaaatagctgctgctatatgctttagaatgaaaaaacgcctaggcatcta

SEQ ID NO: 39790 - DNA, 75 bp, Artificial Sequence
  Synthetic
tctggcaatttatccttcagagaaatcaacctctaacactgattttgtcatggaatataattcagaattcttctt

SEQ ID NO: 39791 - DNA, 75 bp, Artificial Sequence
  Synthetic
ccactcacaacatgtgaggcccacagtgagatgggtggcagcctgttgcaatcttcctgaggttgaaactctagt

SEQ ID NO: 39792 - DNA, 75 bp, Artificial Sequence
  Synthetic
tgcaagacaggaagaagcttcaaatttgatgacatcagtctcagaaggtggaggatcattttctttagcagcatg

SEQ ID NO: 39793 - DNA, 75 bp, Artificial Sequence
  Synthetic
tatacagcaagctcaatgcacactacactatatgctaatgggcatgggtgttagttctttgtttgatgaatataa

SEQ ID NO: 39794 - DNA, 75 bp, Artificial Sequence
  Synthetic
gaaagcaattttgaagtggaaggatccaggtctagggttcttccttctagacaacccttactgtgctggacttgg

SEQ ID NO: 39795 - DNA, 75 bp, Artificial Sequence
  Synthetic
aggctttagattcaacttgtacaaggctatcacaagaacagatttaaaacgtttatattcttacttcatgaaaaa

SEQ ID NO: 39796 - DNA, 75 bp, Artificial Sequence
  Synthetic
agtaagacaaggcacagaagaaagtgatgatactattcctgagagctgctcagttagtccaggtggtgcaatagt

SEQ ID NO: 39797 - DNA, 75 bp, Artificial Sequence
  Synthetic
tttgagttcagccttgagatggggttctaaacagaagttttacaagcttagagataagctgaatataccagagga

SEQ ID NO: 39798 - DNA, 75 bp, Artificial Sequence
  Synthetic
ctggatagatcagataaatcaaaacccctctgtattgtatagagccccaagatcaggagaggaagtaatccttag

SEQ ID NO: 39799 - DNA, 75 bp, Artificial Sequence
  Synthetic
aattgcagaaaaagttcactctccaggtgtcgtatcatctctttcaaccgggaatgccgttgcaaaagtaatagc

SEQ ID NO: 39800 - DNA, 75 bp, Artificial Sequence
  Synthetic
atcttctgtatacttcctgagtgcaacaatattccaggattcagggaggcaagagttctcaattctggatagctc

SEQ ID NO: 39801 - DNA, 75 bp, Artificial Sequence
  Synthetic
caaatacagtttattgcaaaaaatgagcaaattagaaggtatcaatttcaccaatgccattagtgatgaagacct

SEQ ID NO: 39802 - DNA, 75 bp, Artificial Sequence
  Synthetic
actatttttatttcctaacattgaggatttacaatcacttgatagtctagtatataacagaggacgaattgaaat

SEQ ID NO: 39803 - DNA, 75 bp, Artificial Sequence
  Synthetic
tgttaaaagaaagcaaatgaaagaaaacactcagtcaagagtgacagtgtttgaagggaatagaaatctaaggac

SEQ ID NO: 39804 - DNA, 75 bp, Artificial Sequence
  Synthetic
tccagcagaatacctgattagtgacagatggttcggcacacagaagagcaagataggaaggacagcatttgaaca

SEQ ID NO: 39805 - DNA, 75 bp, Artificial Sequence
  Synthetic
ggaatgggacaaagtcacctctatcattccatggttaagagacaatccacaagaaaccctagctagctccccctt

SEQ ID NO: 39806 - DNA, 75 bp, Artificial Sequence
  Synthetic
agacaaccatatacagattagaaatttcttttccaggatggatcaaaaaccaagggtggtcagagtgactggagc

SEQ ID NO: 39807 - DNA, 75 bp, Artificial Sequence
  Synthetic
tcctataaaaaagagatcaggagttagtaaactctccatggtaattagggacaacttctcaaagttaggatttat

SEQ ID NO: 39808 - DNA, 75 bp, Artificial Sequence
  Synthetic
tagagatattgaagatgtgacaggcactagcagaaccaattctgcagagctattaaaacactttatgttttgtgc

SEQ ID NO: 39809 - DNA, 75 bp, Artificial Sequence
  Synthetic
acttcagggtccatactctcccgaaaagaaactgcaaatggttatggaattgcttagtgtgtctaacccaattgg

SEQ ID NO: 39810 - DNA, 75 bp, Artificial Sequence
  Synthetic
ggttaaagatagtgacggaaaatcacgttcaaatattttggccatattgcagagttatattttccaagagcctca

SEQ ID NO: 39811 - DNA, 75 bp, Artificial Sequence
  Synthetic
catagcaagacaaatagaagatgctggggcaggaataatcggaggatttgtggttcctcagaagccaaagaagat

SEQ ID NO: 39812 - DNA, 75 bp, Artificial Sequence
  Synthetic
tgagaatactgtgtactactatggatatggtgtgtggagaggagtgatggacgggaagcaagtccagattgaact

SEQ ID NO: 39813 - DNA, 75 bp, Artificial Sequence
  Synthetic
tgacaatgctgtgggctgtccccctgctatcatatctgtgacaatggaagaatctgcagaaccatggcaaatctg

SEQ ID NO: 39814 - DNA, 75 bp, Artificial Sequence
  Synthetic
cagaagcattcgatcatgggctgacgacgttggtgcaaaaaataacttagacgtttctggtaaaattaagaagaa

SEQ ID NO: 39815 - DNA, 75 bp, Artificial Sequence
  Synthetic
gaactgtaaatactggatgtttgatttcaagacatattcatctgataaggcctatggagtgccggtatacatgac

SEQ ID NO: 39816 - DNA, 75 bp, Artificial Sequence
  Synthetic
aaaaaagaagatggtagactttagattgataaatgactcagaaatcagaataaaggtgaggaagtcaacagtcaa

SEQ ID NO: 39817 - DNA, 75 bp, Artificial Sequence
  Synthetic
cttatatgtgagaagtgatggtagggacattcatatattgtcttattcagctacagattcagaccttagtcctgc

SEQ ID NO: 39818 - DNA, 75 bp, Artificial Sequence
  Synthetic
cagcctaaggatcagtgatgaatcaaaagaccagatgttatccatgttcagcaaagaacctagcaagtcatgggc

SEQ ID NO: 39819 - DNA, 75 bp, Artificial Sequence
  Synthetic
cacatgttctcccattcctgctgtgatgatgcataaaatcataaaagttgtgtcaggggaactcaagattacatc

SEQ ID NO: 39820 - DNA, 75 bp, Artificial Sequence
  Synthetic
tttggacaatgaaagacttggtgagattatgaagctatgttgtgaatcatccttaagatcaagaataggaacact

SEQ ID NO: 39821 - DNA, 75 bp, Artificial Sequence
  Synthetic
attttcggctcttccaagtgtgcagaacacatcaagggttgacgttgatgatctgattgacatagttttaactga

SEQ ID NO: 39822 - DNA, 75 bp, Artificial Sequence
  Synthetic
tgtgaaaacatcaaacttcaaagacatagtcaaatcactagaaaatgatatcaaagatgactatgagattgaaga

SEQ ID NO: 39823 - DNA, 75 bp, Artificial Sequence
  Synthetic
cttcgatctgtctgatattgacttgttcgggccagcacattacaaggagctgtctgatctcaacaccataagcca

SEQ ID NO: 39824 - DNA, 75 bp, Artificial Sequence
  Synthetic
ccctttaatggatgactatgtggaattctgcatttcaaccattggaaggaaggaattgcgtagggtgctagaaac

SEQ ID NO: 39825 - DNA, 75 bp, Artificial Sequence
  Synthetic
aaacaggtgtaagactaaagatcaccaattggttaaagacctattcttagtattgggcagaaatccagatgatgt

SEQ ID NO: 39826 - DNA, 75 bp, Artificial Sequence
  Synthetic
aaaggtggatgaatacaacctcagagagcaaatggcggtggaagacgatatgataggataaaatttttaaattag

SEQ ID NO: 39827 - DNA, 75 bp, Artificial Sequence
  Synthetic
gaggtaagtggaaacacaaagtctgctcataattgaacactatcccccaagtgaggattattctatattaattaa

SEQ ID NO: 39828 - DNA, 75 bp, Artificial Sequence
  Synthetic
tgaacactatcccccaagtgaggattattctatattaattaattaaaagtgttcaattatgggcggactttgtgt

SEQ ID NO: 39829 - DNA, 75 bp, Artificial Sequence
  Synthetic
acacaaagacggcaaaatactttgagatatagagattacagatagtttcaagaatgaatttgatttcattcattc

SEQ ID NO: 39830 - DNA, 75 bp, Artificial Sequence
  Synthetic
tgaatgtagttgtggcaaatgctgcttatacaataaaaaactggggcctagatgggtcagagagtacctgcctaa

SEQ ID NO: 39831 - DNA, 75 bp, Artificial Sequence
  Synthetic
gcaatgagtcaccacttgagggtctcatatattactgggagcagggagcaaaaaagagaggactggtgaatgatt

SEQ ID NO: 39832 - DNA, 75 bp, Artificial Sequence
  Synthetic
tcaaatcatgcaaaattggatctgagcccttaaaggaaatgaggaataaaactgttatgagaatgatagaggaag

SEQ ID NO: 39833 - DNA, 75 bp, Artificial Sequence
  Synthetic
ttcaactatccatgacaaatctaagattcacatgcagcagcaatatgggatctcatggagtttatgttgatttca

SEQ ID NO: 39834 - DNA, 75 bp, Artificial Sequence
  Synthetic
atggtttagatgacacagagccagggaaaaacatagtggattgtgaaaaattccacacagtctcagagcttggaa

SEQ ID NO: 39835 - DNA, 75 bp, Artificial Sequence
  Synthetic
ttgaagtctctgatggacatctatgggattctagatacaatgagtcttatgctgctgagattagaaggcgagaaa

SEQ ID NO: 39836 - DNA, 75 bp, Artificial Sequence
  Synthetic
tggacttagaaaaggcaaactctgaaaaaaagaatatggaaatcatgatgagagatgacaagaatgagattctat

SEQ ID NO: 39837 - DNA, 75 bp, Artificial Sequence
  Synthetic
cattaataagagagaatcaaatgctccaacacaagatatcaaatttgacaggagttatgtttaattataataata

SEQ ID NO: 39838 - DNA, 75 bp, Artificial Sequence
  Synthetic
gcttggatgccctggcaagggagatgtctgctagagaagaggagaatgctaacttattaatggatatgagagaaa

SEQ ID NO: 39839 - DNA, 75 bp, Artificial Sequence
  Synthetic
agatgaaggaaaaggatgttattataagaaaacaaaacgatagcatcagcttgaaatcagttgctctgacagctc

SEQ ID NO: 39840 - DNA, 75 bp, Artificial Sequence
  Synthetic
ttgtggccacaacaataattccactagtctctgggtcttcccaaactgctcacataaacatgttgaacagctacc

SEQ ID NO: 39841 - DNA, 75 bp, Artificial Sequence
  Synthetic
ctcatgctaagaatagaattggaggagggctctacaggtatgatgagagcgaagatgaagacacttgcaaaggtt

SEQ ID NO: 39842 - DNA, 75 bp, Artificial Sequence
  Synthetic
tagattatgggctgtcatgcttgggttttgaccatatgttgaaaccacattattacccattcttcaattctcatg

SEQ ID NO: 39843 - DNA, 75 bp, Artificial Sequence
  Synthetic
tcatgcatttgacccctctagaagcttttgctgataagataattgagagtgagaatgtgagttgtgaaatgggta

SEQ ID NO: 39844 - DNA, 75 bp, Artificial Sequence
  Synthetic
aagataaaaacaacaaatgtattgaaggccgagagttcataagaggtcactgccccaacggaatcaatggagtct

SEQ ID NO: 39845 - DNA, 75 bp, Artificial Sequence
  Synthetic
attatataaatgataaagggaaattgtcacattccaaatgtaaagaagaaggacatgaaataacagaagactgta

SEQ ID NO: 39846 - DNA, 75 bp, Artificial Sequence
  Synthetic
tgttctgtaggaagataaagaaaaggcaatcgtcagcaaaacaagtgatgaaaacctcagtctcgttacaagatg

SEQ ID NO: 39847 - DNA, 75 bp, Artificial Sequence
  Synthetic
ctatttgtcaaaaggagtctaacaggtatgagggtcctaaaatagttgtaaaaggggtctgtagcattgggaatt

SEQ ID NO: 39848 - DNA, 75 bp, Artificial Sequence
  Synthetic
ttgtatacaagcggtgtgagtcaagtgctcagtcttatgaaaatgttccatttgtcacatttgaagggaagggaa

SEQ ID NO: 39849 - DNA, 75 bp, Artificial Sequence
  Synthetic
agttttatcttgaaaaattgatactgtcgaatgttgagctgatgaataatgtttcattcgtttgctacgagcata

SEQ ID NO: 39850 - DNA, 75 bp, Artificial Sequence
  Synthetic
aatggcaagatggagtcgaagtagataacagggaatggaaaagagtcaacatcaaggattgtaaggctgttgaca

SEQ ID NO: 39851 - DNA, 75 bp, Artificial Sequence
  Synthetic
acacgaaacaaaaaatatgtgcaggagacaatatcttctgccagaaatacacttgctcagctgtaaacccctctg

SEQ ID NO: 39852 - DNA, 75 bp, Artificial Sequence
  Synthetic
cgagatgttttatggcaccaggctctggccccatcttggttaacattttaggatcctgggtgaaaccacaatgtg

SEQ ID NO: 39853 - DNA, 75 bp, Artificial Sequence
  Synthetic
taggatatgagaccgtgttggtgactagagaagtcaaaagtctacaacctcaagcatctatcgagtgtgactctt

SEQ ID NO: 39854 - DNA, 75 bp, Artificial Sequence
  Synthetic
gtatatatgagtgtggtccagaatacattaggctaacctcaactggttttgagatcacttcagctgtatcatgtt

SEQ ID NO: 39855 - DNA, 75 bp, Artificial Sequence
  Synthetic
ctcatggatcgtgcatatcaactcatcaggctccatctactatgatagacatcccttatccaggaatgtctgctg

SEQ ID NO: 39856 - DNA, 75 bp, Artificial Sequence
  Synthetic
ccatgggtggagacattgggatttatgtttctcacaccagtgattctgtcagcttacatgtaaaggcacattgca

SEQ ID NO: 39857 - DNA, 75 bp, Artificial Sequence
  Synthetic
atcctagggactcttgcgaggtgcatcattgcactttgtgtgtgcatggattattaaattatcaatgtcacagca

SEQ ID NO: 39858 - DNA, 75 bp, Artificial Sequence
  Synthetic
ttgcaagttctctgttcctgtccactctaatgtcaatggtcatatattttctgttgtctttagtgggaaaactgc

SEQ ID NO: 39859 - DNA, 75 bp, Artificial Sequence
  Synthetic
tctacttctttaagatgatccctaagaaactgaggagtcccttcatgtggatatggctattgattagtcattgta

SEQ ID NO: 39860 - DNA, 75 bp, Artificial Sequence
  Synthetic
tccatgcgctcagatcaattctctcaaagggtttttcaagattgaacaacaccattggctggagagaggacattg

SEQ ID NO: 39861 - DNA, 75 bp, Artificial Sequence
  Synthetic
atagagcacccttgagagaagttcgagtaggccgtgccattccacgttttggcacaactgctttcctggtgctaa

SEQ ID NO: 39862 - DNA, 75 bp, Artificial Sequence
  Synthetic
ttttactccctctcgctctgggttgctctgaaactttgatatctaactcaaagcaagtgaagtgtgttcagtatg

SEQ ID NO: 39863 - DNA, 75 bp, Artificial Sequence
  Synthetic
gaggaggtgtcaaatgctctgtttctgctaccatatctttaaaagctggcgttataggtggagagtcatgttttg

SEQ ID NO: 39864 - DNA, 75 bp, Artificial Sequence
  Synthetic
taatgaaaggtccaatggagggtcaacaaaaaacaattaggataaaaaccatagcaagtgagatgatctgccgtg

SEQ ID NO: 39865 - DNA, 75 bp, Artificial Sequence
  Synthetic
aaggcactagcttttggacaagccactatactccccaatgtatgagctcaagaagatgtcatttggttggtgagt

SEQ ID NO: 39866 - DNA, 75 bp, Artificial Sequence
  Synthetic
gtcaaaagacaagatgtcagagttggtcggatagggaagtctcaaaggaatttaagggagttagtgataatggta

SEQ ID NO: 39867 - DNA, 75 bp, Artificial Sequence
  Synthetic
taatgtcagaaaacaagtgttttgaacagtgtggtgctattggatgtggttgtttcaacataaacccctcctgct

SEQ ID NO: 39868 - DNA, 75 bp, Artificial Sequence
  Synthetic
tatttgtccacacacaattaaaaagcactagaaacgaggctatcagagttttttcttgtgttgattgggttcaca

SEQ ID NO: 39869 - DNA, 75 bp, Artificial Sequence
  Synthetic
ggctcaccctagaggtccatggccctgaaggtgaacgagacattcttgttctaggatctctcggcaccaaatttt

SEQ ID NO: 39870 - DNA, 75 bp, Artificial Sequence
  Synthetic
taaactggggaacggttagtttgtctttagatgcagaggggatcactggaaccaattccattagtttcttagaga

SEQ ID NO: 39871 - DNA, 75 bp, Artificial Sequence
  Synthetic
gcagcaaaggagggtttgctttatatgatgaggctatatcagaaatccctagagagggattcctaggtgaggtga

SEQ ID NO: 39872 - DNA, 75 bp, Artificial Sequence
  Synthetic
gatgttcatcagaatctgctgctatcatggctcatgcctcgtgtttaagagcacccaatctaattaagtataagc

SEQ ID NO: 39873 - DNA, 75 bp, Artificial Sequence
  Synthetic
ctatgacagacgtgatagattgcactgcatccctggtggacccctttgcagcattctataaaggctcccttcctc

SEQ ID NO: 39874 - DNA, 75 bp, Artificial Sequence
  Synthetic
aagtgaggaatggactaacttacacaagctcaatagacaaaaagactgttcaggcatttaactcaggatctataa

SEQ ID NO: 39875 - DNA, 75 bp, Artificial Sequence
  Synthetic
aagcaataataactataaacatggaagatcatgaaatccaatttatgacatctgtgatcagatgtgatgctacat

SEQ ID NO: 39876 - DNA, 75 bp, Artificial Sequence
  Synthetic
tcataaatgtaacaggttgctattcatgtaactatggagctaaggtgtgcctaaagatcaagtcgagtgggaatg

SEQ ID NO: 39877 - DNA, 75 bp, Artificial Sequence
  Synthetic
gggaatttcttgctagagaagaaaatggcctattccatatgtctttatctgtcagagagggaacggatgattatt

SEQ ID NO: 39878 - DNA, 75 bp, Artificial Sequence
  Synthetic
gtcagatccagcattttaataagccagagatcaatgagagaactagatacacttgtggtggagaagaaaaattgt

SEQ ID NO: 39879 - DNA, 75 bp, Artificial Sequence
  Synthetic
tgaacatcaagggaattcttatttcccttggattggaagatcttaggaacaaaactggaggctcttctatcgtag

SEQ ID NO: 39880 - DNA, 75 bp, Artificial Sequence
  Synthetic
taaacccaagtgatgcatcctggagtctttctggttgggtctcaggactcttttcatggctaggtggaacttgga

SEQ ID NO: 39881 - DNA, 75 bp, Artificial Sequence
  Synthetic
tggctgttctaaagattctgggttttttgttattaggtttcctattgctcgttcttattatttctataataagat

SEQ ID NO: 39882 - DNA, 75 bp, Artificial Sequence
  Synthetic
tttcagtcagatccatgttcctaaagcataaaacaaaatgactcaagtaaaccataaagcgaactcatcatgcca

SEQ ID NO: 39883 - DNA, 75 bp, Artificial Sequence
  Synthetic
gaaccaacacactaagcaaacaaaataaaaccattaaaaatcacacaacaaactccaaacaacaatctcaagtca

SEQ ID NO: 39884 - DNA, 75 bp, Artificial Sequence
  Synthetic
ccaatctaaactgttcatacatcatcccaaaacaaaagcagaatcacctcaccacatggcagtgatcatgcaccc

SEQ ID NO: 39885 - DNA, 75 bp, Artificial Sequence
  Synthetic
acaatcgcactagcattacagccaatcaacactgaagacaactgtgttgtagaaagcttcaggtgtttgtggtgt

SEQ ID NO: 39886 - DNA, 75 bp, Artificial Sequence
  Synthetic
gtgttcttgcataaaggtaaaagatttcccaaatcaatcagaagaccaagaaactaatattaaattaatgataaa

SEQ ID NO: 39887 - DNA, 75 bp, Artificial Sequence
  Synthetic
atgttaaggtcagattctgagttattaatgggatttgttgcttcaattctttgatgttgacgccggtctttgtgt

SEQ ID NO: 39888 - DNA, 75 bp, Artificial Sequence
  Synthetic
acacaaagacggctaaatatcttttgaatttatattgttttattgagacaagtccccaaaatgaggattcttgct

SEQ ID NO: 39889 - DNA, 75 bp, Artificial Sequence
  Synthetic
tttttaactaatatcatggttgcttatgcggcgtattctatttctaactggggtttagatgggtcagataaagtg

SEQ ID NO: 39890 - DNA, 75 bp, Artificial Sequence
  Synthetic
tgtctcagtaatgagtcacctctagaaggtcttgtacactactgggaaaacggggtgaagaaaagaaaactggac

SEQ ID NO: 39891 - DNA, 75 bp, Artificial Sequence
  Synthetic
aagaagatcaaaaattgcaagattggatctgaacctttgaaagaaatggataatagaactgtgatgtctataata

SEQ ID NO: 39892 - DNA, 75 bp, Artificial Sequence
  Synthetic
gagcaggtacagctttcaatcaccaatcttaggcttacatgcacatctgaatcaggtattgaaggagtgtacgtt

SEQ ID NO: 39893 - DNA, 75 bp, Artificial Sequence
  Synthetic
gacttcaatggattggatgatactgaggcaggaagaaacattgtagattgtgataacttcaaaataatctcagaa

SEQ ID NO: 39894 - DNA, 75 bp, Artificial Sequence
  Synthetic
cttggtattgatgtgggtgatggatactcatgggtttcccagtacaatggctcatatgcaaaggagattagagaa

SEQ ID NO: 39895 - DNA, 75 bp, Artificial Sequence
  Synthetic
aaagacgaaattatcagaaagctgagggaagggcaagaaaatgcagatatcctaatgagagatgacaaaaatgag

SEQ ID NO: 39896 - DNA, 75 bp, Artificial Sequence
  Synthetic
atcctttctctaatcagagagaaccagatgttacaacacagaatttctaatttgactggagttgtgtacaattat

SEQ ID NO: 39897 - DNA, 75 bp, Artificial Sequence
  Synthetic
aacaatagccttagagcactagaagatgatctagctcttagagaagaagagcacaaaaaagttaaacttgaggca

SEQ ID NO: 39898 - DNA, 75 bp, Artificial Sequence
  Synthetic
gaaaagagcaagatgcatcttcaacagagggaacacaatgctagcatggacattataaaactaaagtcagtgtta

SEQ ID NO: 39899 - DNA, 75 bp, Artificial Sequence
  Synthetic
gcaactgccttaatagccactaccgtcttgcctgttattggtgcctctcctcagagcaatcaggttaatgccatg

SEQ ID NO: 39900 - DNA, 75 bp, Artificial Sequence
  Synthetic
aacacttacatacatgcaaaaaacagagtacatgggggagttttcaggtatgagactgatgaggatgaaacttgc

SEQ ID NO: 39901 - DNA, 75 bp, Artificial Sequence
  Synthetic
agaggtctaaattatggagcaaaatgcatcagttttgaccatatgttaaagcctcattattaccctttcttcaac

SEQ ID NO: 39902 - DNA, 75 bp, Artificial Sequence
  Synthetic
tctcacgtgatgcacatgactcctctggaagcatatgttgaaaatgaactcactgcagatgagaactcaagctgt

SEQ ID NO: 39903 - DNA, 75 bp, Artificial Sequence
  Synthetic
gaaatgggcaaaggaaaatccaataaatgtttagagggtaggagttatattcgaggtcactgtccaattggaata

SEQ ID NO: 39904 - DNA, 75 bp, Artificial Sequence
  Synthetic
acaggagtccactacattaatgataaggggaaaatagtcttgtccaaatgtagtgagcaaaactatgaaataact

SEQ ID NO: 39905 - DNA, 75 bp, Artificial Sequence
  Synthetic
gaggactgcatgttttgcagacaaataaaaaggaattctggtgaaaagggtgttgtcaagacatctgtttcttta

SEQ ID NO: 39906 - DNA, 75 bp, Artificial Sequence
  Synthetic
caagatgtggtatgtcaaaaagattcaatggagtattctggacccagaatctcaattaagggggtttgttctatt

SEQ ID NO: 39907 - DNA, 75 bp, Artificial Sequence
  Synthetic
ggaaatattgaatataaaaaatgcacttcttactctcaaaattatgaaaatgtcccatttgtggttttcaaaggc

SEQ ID NO: 39908 - DNA, 75 bp, Artificial Sequence
  Synthetic
aaaggtaagtattatcttgacaaattgataataaataatgtagaattggttgggaatgtgtcattcatatgccac

SEQ ID NO: 39909 - DNA, 75 bp, Artificial Sequence
  Synthetic
aagcacaaagggcatgacaatgagtcacaacaaagagagtacaaaaaaacaaaactatcagattgcagcaacgtt

SEQ ID NO: 39910 - DNA, 75 bp, Artificial Sequence
  Synthetic
gaaacagggaagagcgaggtgtgcactggcgaccacatattctgtcagaagtacacttgttccactgcaagtcct

SEQ ID NO: 39911 - DNA, 75 bp, Artificial Sequence
  Synthetic
agtgccaaatgttttgtggcccctggttctgggccaattttggttaacatcatgggatcatggataaaaccccaa

SEQ ID NO: 39912 - DNA, 75 bp, Artificial Sequence
  Synthetic
tgtgtgggatatgagaatgttctggtgaggagggaaaatagagcaacaagaccttattctgtgtctgaatgcaga

SEQ ID NO: 39913 - DNA, 75 bp, Artificial Sequence
  Synthetic
acttgtgtatatgagtgcggtctgtcagatatctcaataacatcaactggatttgaaataacatcagcagtatca

SEQ ID NO: 39914 - DNA, 75 bp, Artificial Sequence
  Synthetic
tgctcacatggttcttgtgtgtccacacatcagaagccatcgacatctattagaattccatatcctggcctttta

SEQ ID NO: 39915 - DNA, 75 bp, Artificial Sequence
  Synthetic
gcttcaacagggggagaggtgggaatccacttgtcacacactggagatagtgcaggggtgcatatgaaagttcat

SEQ ID NO: 39916 - DNA, 75 bp, Artificial Sequence
  Synthetic
tgcccttctagagatgtctgtgagacccatcactgcttcttttgcctgaaaggaatcatcaattatcaatgtcat

SEQ ID NO: 39917 - DNA, 75 bp, Artificial Sequence
  Synthetic
acaatagtcacttcaattgtctcttcttcaataatttctctactcttttatgtcgcattctctatcttaggcaag

SEQ ID NO: 39918 - DNA, 75 bp, Artificial Sequence
  Synthetic
ttgttgtattttttccacctcataccaaagaaacttcgtagccctcttatgtgggtatggttattgatttcatac

SEQ ID NO: 39919 - DNA, 75 bp, Artificial Sequence
  Synthetic
atattgtgtacaatctatagatcatacacaggcctgaaaagaaaaattaacatgtccataggttggtcaaataga

SEQ ID NO: 39920 - DNA, 75 bp, Artificial Sequence
  Synthetic
cccaatcaaacccctctctcagaagtgagagttagaagagccattccaagatttgaccggacagtattcattata

SEQ ID NO: 39921 - DNA, 75 bp, Artificial Sequence
  Synthetic
ctcttactacttccactggccctatcttgctcagagtcactaatttccaattcaaaacaagtgcgatgcactcaa

SEQ ID NO: 39922 - DNA, 75 bp, Artificial Sequence
  Synthetic
gacaagagttctctgaagtgcagcgtgactgctactgttactttgaaggcgggtgtgattggtgcagagagctgc

SEQ ID NO: 39923 - DNA, 75 bp, Artificial Sequence
  Synthetic
tttgttctgaaaggccccatggaaggccagcacaaaacaataatgataaaaactgtgtctagtgaggttatctgt

SEQ ID NO: 39924 - DNA, 75 bp, Artificial Sequence
  Synthetic
agggagggaaacagcttctggacaagtcactacatgcctgtctgcttgagctcaaggagatgccacctggttggt

SEQ ID NO: 39925 - DNA, 75 bp, Artificial Sequence
  Synthetic
gagtgtcacaagaatagatgtcagtcttgggctgatagagaggtctcaaaggagtttaaaggagttagtgacaat

SEQ ID NO: 39926 - DNA, 75 bp, Artificial Sequence
  Synthetic
ggaattatgtctgaaaacaaatgttttgagcagtgtggcgcaatgggctgtggctgcttcaacatcaatccttct

SEQ ID NO: 39927 - DNA, 75 bp, Artificial Sequence
  Synthetic
tgtctttttgttcatagctatcttaagagcacaagaaatgaggcaattagagtgttttcatgtgctgactgggta

SEQ ID NO: 39928 - DNA, 75 bp, Artificial Sequence
  Synthetic
cacagactcactctagaagtctcaggcccagatggagagaaagatgtggttgtgctaggctccctagggacaaaa

SEQ ID NO: 39929 - DNA, 75 bp, Artificial Sequence
  Synthetic
tttcttagttggggcaccattagtttgtctttggatgcagaggggataagtgggacaaatgctataagctttctt

SEQ ID NO: 39930 - DNA, 75 bp, Artificial Sequence
  Synthetic
gagagtagtaatggaggatttgcactatatgatgaggcattgtctgaaatgccaagagaaggatttttaggagag

SEQ ID NO: 39931 - DNA, 75 bp, Artificial Sequence
  Synthetic
ataagatgttcttctgaatcagcagccataatggcacattcttcctgcttaagagccccaaatatcataaaatat

SEQ ID NO: 39932 - DNA, 75 bp, Artificial Sequence
  Synthetic
aagccaatgacagacattatagactgcacagctgcattggtagatccatttgcagcgttcacaaaaggctctttg

SEQ ID NO: 39933 - DNA, 75 bp, Artificial Sequence
  Synthetic
ccacaggttagaaatgggatgacattcaccagctcaattgataaaaaaacagtgcaggcctttaattcaggctca

SEQ ID NO: 39934 - DNA, 75 bp, Artificial Sequence
  Synthetic
ataaaagctatgataactattaatatggatgaccatgaaattcagtttttgtcagattttggcagatgtgaatcc

SEQ ID NO: 39935 - DNA, 75 bp, Artificial Sequence
  Synthetic
tcatttgttaatatcactggctgttactcctgtgattatggggctagagtatgtgttagagtcaatgcagacaag

SEQ ID NO: 39936 - DNA, 75 bp, Artificial Sequence
  Synthetic
tctagtatttatctggctagacaggacaataatgaattcttcatgtccttccaagtggaccagggagtaaaggat

SEQ ID NO: 39937 - DNA, 75 bp, Artificial Sequence
  Synthetic
tattgtcaaattctacatttcaactcccccaatgtggaagaaagaatgaagtactcctgtggtgcagaggaaaag

SEQ ID NO: 39938 - DNA, 75 bp, Artificial Sequence
  Synthetic
ttattgaatattaagggtgtcttaatctcactgggggtgagtgatctgcggaatcaaacaggtggacactcaata

SEQ ID NO: 39939 - DNA, 75 bp, Artificial Sequence
  Synthetic
gttgttaatcctagagagactagctggaatctaggagggtgggcttcaggactattttcatggcttggcgggaca

SEQ ID NO: 39940 - DNA, 75 bp, Artificial Sequence
  Synthetic
tggtcaggtattctgaaaatattagcttttttgttactaggtcttcttataatcctcttaaccatttcattacta

SEQ ID NO: 39941 - DNA, 75 bp, Artificial Sequence
  Synthetic
aagcgagtgctactctcagcattcattaaaacaaaggttaaatgatagctccctaagggtcaattatcatcacaa

SEQ ID NO: 39942 - DNA, 75 bp, Artificial Sequence
  Synthetic
tcaaaaccacacatcgcactacatacaatacacagacagagtgaatcaagacaaaactaacaacaaaaacaaaaa

SEQ ID NO: 39943 - DNA, 75 bp, Artificial Sequence
  Synthetic
cacaaaaacatactacacaaactcatattccacataactcatctcaaggcagtgactttgagttctgtgtggcat

SEQ ID NO: 39944 - DNA, 75 bp, Artificial Sequence
  Synthetic
cattcagagaattcctctagtgaaagtgatgatcacttgctacttgttgcatgataatttgatcatcagtgctaa

SEQ ID NO: 39945 - DNA, 75 bp, Artificial Sequence
  Synthetic
gagataaatcatgaaagttgaggtgggaaacagaagtttgttctagagttgtaatttaacattttctattgttga

SEQ ID NO: 39946 - DNA, 75 bp, Artificial Sequence
  Synthetic
agttgaggtgggaaacagaagtttgttctagagttgtaatttaacattttctattgttgacgccggtctttgtgt

SEQ ID NO: 39947 - DNA, 75 bp, Artificial Sequence
  Synthetic
aagtcccctcttgagatcgaaatagcgaataaaataaaatatgtctaacatgctgaattacgtttttgacatacc

SEQ ID NO: 39948 - DNA, 75 bp, Artificial Sequence
  Synthetic
acatataactaggtcagcaacagatcgatcaaaagtatatgtggaatattcggcttataatggctactggggaac

SEQ ID NO: 39949 - DNA, 75 bp, Artificial Sequence
  Synthetic
gcctatatgcagatacaagggagcagagtttccttgctcttcattctcagtatctgacaaaacatcctttagatt

SEQ ID NO: 39950 - DNA, 75 bp, Artificial Sequence
  Synthetic
aagaagctttatagataagagacagctcccaagatcttggggaaaaccctttctccaagttaaggggaaatcacc

SEQ ID NO: 39951 - DNA, 75 bp, Artificial Sequence
  Synthetic
ttctttctttgacacaacaattgagaagatatctcacctcaatcttgagcgccaattgaaatggtcagaaccaaa

SEQ ID NO: 39952 - DNA, 75 bp, Artificial Sequence
  Synthetic
tataaaggaagctttgagttggcctcttggtgttccaacactagccttctttaaattgtctcaaattgaaagcta

SEQ ID NO: 39953 - DNA, 75 bp, Artificial Sequence
  Synthetic
tgagtttaactgggaagaaaaatgctttctgatgacattgattatgagaagtggtgatggtgtccaaatagatga

SEQ ID NO: 39954 - DNA, 75 bp, Artificial Sequence
  Synthetic
ctctttagttaatttatacaagaagttaattagggaactgggagaacgtgatataccatgtttaaatttcactgg

SEQ ID NO: 39955 - DNA, 75 bp, Artificial Sequence
  Synthetic
tcagaatattgagaaagagattgcatatgttcaggtattgcgaatgctcactgctttgccatatgattactatga

SEQ ID NO: 39956 - DNA, 75 bp, Artificial Sequence
  Synthetic
atcggactttcactcttcattgtatgattatgtaaaagaactatctgaagtcatcactccacagctgctagggaa

SEQ ID NO: 39957 - DNA, 75 bp, Artificial Sequence
  Synthetic
tagaaaatgggtcccattgcacacaatgagccccagatacactaggatagctgactcatgggattcagatctaga

SEQ ID NO: 39958 - DNA, 75 bp, Artificial Sequence
  Synthetic
ctctgaagaagaaatggagatagacggacctgctgccaggtggggtgaggggttttagggtgagttgattagggt

SEQ ID NO: 39959 - DNA, 75 bp, Artificial Sequence
  Synthetic
tgattggtgggattttattttactttaattgattgattttgattttgtttatttctatttaatttgaaatgtaat

SEQ ID NO: 39960 - DNA, 75 bp, Artificial Sequence
  Synthetic
taattaaatcaagtaaattttagattaattttaaatttcctgttgatcaatatgcaattatgccaattaatgtaa

SEQ ID NO: 39961 - DNA, 75 bp, Artificial Sequence
  Synthetic
attactgaggcagattatttcatacctctgaaaactttagcagcagccttcacaggacttgatggctgcatgttt

SEQ ID NO: 39962 - DNA, 75 bp, Artificial Sequence
  Synthetic
tcatccagaattccgaggtttcggaggaaagactttctctgctcaccactaataaatgagctgttgatggcggca

SEQ ID NO: 39963 - DNA, 75 bp, Artificial Sequence
  Synthetic
ttcatgggcctatcaaaggtgctggcaacttcagaaacactcaatccacgattccttgggttgatagtcctagag

SEQ ID NO: 39964 - DNA, 75 bp, Artificial Sequence
  Synthetic
aactgcaccatgaagagactgaaagcatcacagatggttgacagtacatctggaggcagctttggatctatcagc

SEQ ID NO: 39965 - DNA, 75 bp, Artificial Sequence
  Synthetic
ccggcaaaactagggtgcatcatggcccttggataattttttgaaagatcatccatgttctttccggtcactgga

SEQ ID NO: 39966 - DNA, 75 bp, Artificial Sequence
  Synthetic
agaaattcttctacatattcagttgcctggcaggtgtagccagccaaagcagctgtgatcctggagagagtcaaa

SEQ ID NO: 39967 - DNA, 75 bp, Artificial Sequence
  Synthetic
tcatctctagatggattcccttctttgagagagtatctcttcacaagggtttggacaatcttcttacccttttca

SEQ ID NO: 39968 - DNA, 75 bp, Artificial Sequence
  Synthetic
gacatcttgaccatcatttttgagggcttgttacctctagtaaggcacaagataatcatctgcttggcatcatca

SEQ ID NO: 39969 - DNA, 75 bp, Artificial Sequence
  Synthetic
acccaatcatctccacctctttctacaagcaattccatcaccctttttgcatcaaatccttgatacgcaaaggct

SEQ ID NO: 39970 - DNA, 75 bp, Artificial Sequence
  Synthetic
tggacccatgccttgatggtctcggcatcaatctcatgaccagcaatatcaatagcaagcttttcgtaagacatc

SEQ ID NO: 39971 - DNA, 75 bp, Artificial Sequence
  Synthetic
tcaatctcatgaccagcaatatcaatagcaagcttttcgtaagacatcttttattagatattcacctatgtgttt

SEQ ID NO: 39972 - DNA, 75 bp, Artificial Sequence
  Synthetic
cacacaaagaagcccaaactatggaagaaatactaaacaaacaacaaatccccgaggggataggattgtttagac

SEQ ID NO: 39973 - DNA, 75 bp, Artificial Sequence
  Synthetic
cagatataaaacaatacgatgactctatcatggatgtggaaattccctttttccatattagcaaatgcgatggtt

SEQ ID NO: 39974 - DNA, 75 bp, Artificial Sequence
  Synthetic
acatgaaaattgatcttgacttaaataacggggttgattactcaactattggatcatcattaatatcaaccattg

SEQ ID NO: 39975 - DNA, 75 bp, Artificial Sequence
  Synthetic
aggttccggacaagtctctaccaaatcttgttcatgatgtcgtattttcacacttagctagcaatacggatgtta

SEQ ID NO: 39976 - DNA, 75 bp, Artificial Sequence
  Synthetic
gattctcgactatatttggcgtttactctgactcttatgatcatctgtctcctgatttgatccttaaaactgcag

SEQ ID NO: 39977 - DNA, 75 bp, Artificial Sequence
  Synthetic
ctggctctcaccatgttgtagagttcactacaaatagagggggtgagagaggtgcgttccaggcctgcaaagata

SEQ ID NO: 39978 - DNA, 75 bp, Artificial Sequence
  Synthetic
agttttcgaaatatcacattccttgtgaaaatcgggctgtggggagcagagtttccttatttgtcatctctgtgt

SEQ ID NO: 39979 - DNA, 75 bp, Artificial Sequence
  Synthetic
atgttagaggtgtttggtctaacttagacttaacagatgacgaagttaatgaactcgtgtttagattcagactgg

SEQ ID NO: 39980 - DNA, 75 bp, Artificial Sequence
  Synthetic
caatagcaataatggaagaagcaaagagatactacccagaactaactgaagatgagagtgagatgactaaacaag

SEQ ID NO: 39981 - DNA, 75 bp, Artificial Sequence
  Synthetic
agagagaaatactaggtgtcatatcttcaatccagatgaactgggaagtgacaagttctaggttccctcacttta

SEQ ID NO: 39982 - DNA, 75 bp, Artificial Sequence
  Synthetic
aggaaaagctgtttgaagattttatgacatcgtctgcagatgaagagtacctgtctaccatcatctcagaagaat

SEQ ID NO: 39983 - DNA, 75 bp, Artificial Sequence
  Synthetic
tgacagcatgtcaagaggacatgataaaatcaggttttatcgggaaagttagtgggattgaggagaaactcaact

SEQ ID NO: 39984 - DNA, 75 bp, Artificial Sequence
  Synthetic
taaatgaggccgaatgtgccacgatgattggggattatctaaagtccaggagtaatgagtgcagggacaagttgg

SEQ ID NO: 39985 - DNA, 75 bp, Artificial Sequence
  Synthetic
acagtaagtctacagttcagataccaccatggacaatgacagacttcattgaaggtaagtctgtctcctgcctct

SEQ ID NO: 39986 - DNA, 75 bp, Artificial Sequence
  Synthetic
caggatttgaggtcgaaggtgatcatcctatgtgtaagatttggagatcagttacaattgcggcagcaatgggag

SEQ ID NO: 39987 - DNA, 75 bp, Artificial Sequence
  Synthetic
atattgatagagctgatgacgatcctaatgcagaattgcaaaaggctctagagggcagcatccaaaagagtgatg

SEQ ID NO: 39988 - DNA, 75 bp, Artificial Sequence
  Synthetic
agagaagcaggtaccacagaataaaattaaacctaacaaatgaagaaattgtttatggggcaactctcggagtgg

SEQ ID NO: 39989 - DNA, 75 bp, Artificial Sequence
  Synthetic
aaggaaagtcacacaagaataatgcacaagtagaggagtcaagaaagcgcagtaagctaggcttttcattagatc

SEQ ID NO: 39990 - DNA, 75 bp, Artificial Sequence
  Synthetic
atgacatcaccaacctggaggagtttatcaataagcatgatctggggctgtttgaagaatcagatgactatttca

SEQ ID NO: 39991 - DNA, 75 bp, Artificial Sequence
  Synthetic
acccttttcaaatagattttgacttaagggaatctgcacagaaaattcatcagcctgatctcatcattaatcaag

SEQ ID NO: 39992 - DNA, 75 bp, Artificial Sequence
  Synthetic
gagaaaatgaattcttagcgaaccacaagagactgtgcatgtcaaaattaggttcatggtgtcagatggtttctc

SEQ ID NO: 39993 - DNA, 75 bp, Artificial Sequence
  Synthetic
taataggtgcagaattgtcagcatctgtaaaacagcatgttgggaaaggtcagtttgtgataaaaagaattttga

SEQ ID NO: 39994 - DNA, 75 bp, Artificial Sequence
  Synthetic
attctcctttattcatgttaataaagccaacatcctctgtgagccacatctttgtgtcctttgcactagtgaagt

SEQ ID NO: 39995 - DNA, 75 bp, Artificial Sequence
  Synthetic
caaatcacatgggtgacttgtgggagaatggtgtatttaagcactatattgacgcaggtgatttgtttgtcacag

SEQ ID NO: 39996 - DNA, 75 bp, Artificial Sequence
  Synthetic
acttcatctcttacaaattgagcaaattaacaaatttgtgcaagtgcttcccacttatggagagtgccatctgct

SEQ ID NO: 39997 - DNA, 75 bp, Artificial Sequence
  Synthetic
tttggacagagatatttggttttgaaccttggaattcaacacacataatgtcaacagacaggagtggaagttcca

SEQ ID NO: 39998 - DNA, 75 bp, Artificial Sequence
  Synthetic
aagaggcagcatctatgattaaattaactttactaacattaatggaggacaaagctgttactgaagagatacaga

SEQ ID NO: 39999 - DNA, 75 bp, Artificial Sequence
  Synthetic
ccatccaaagatacataattatggaaggttttgtgtctttacctgagcttccaaaacctcacaagatgttgtcca

SEQ ID NO: 40000 - DNA, 75 bp, Artificial Sequence
  Synthetic
agttgccagctgtcctgagatctgaacttcaggtgtatctagttttaagatctcttaggacaatggaaaggatat

SEQ ID NO: 40001 - DNA, 75 bp, Artificial Sequence
  Synthetic
cgaaaaatccttttcatctacaaaaaaagcacagccagatcacatggtcaggcctgttcaacccactaactggaa

SEQ ID NO: 40002 - DNA, 75 bp, Artificial Sequence
  Synthetic
atacacttagagacttacagccgctaataagtatttgctataatggatacttcaaaaataaggaagaagagactg

SEQ ID NO: 40003 - DNA, 75 bp, Artificial Sequence
  Synthetic
agccctctgcactctctaggctatacaagaaaattatagaacttgagcacctctgtccaaaagatgacaagttct

SEQ ID NO: 40004 - DNA, 75 bp, Artificial Sequence
  Synthetic
tgggatctggtgatccaagagaacctaaaatgcatgagtttagtagatcatttctaaaaaaatgcactgaccacg

SEQ ID NO: 40005 - DNA, 75 bp, Artificial Sequence
  Synthetic
ggaagaccattctgagaaaaatatatggtcagaatttcatgcaacaggtagacacccaaatcatgagagaaattg

SEQ ID NO: 40006 - DNA, 75 bp, Artificial Sequence
  Synthetic
ggtctataaccttagagaagttggcaacactcaaagccagcagcaactttgacgagaggtggtatgattactcag

SEQ ID NO: 40007 - DNA, 75 bp, Artificial Sequence
  Synthetic
tgtgcagtaaagaggactatcacagggagaaagcaattgttaaaatgtcagaatttgctgcttcaggaaaaacac

SEQ ID NO: 40008 - DNA, 75 bp, Artificial Sequence
  Synthetic
tagccatagaggttttcgatgaatgtatgaaactagttgagaatcgtgggaacatgcatatttgcttattcaaaa

SEQ ID NO: 40009 - DNA, 75 bp, Artificial Sequence
  Synthetic
agcagcaacatggaggggacagagagatctatgtgcttggcagagaagagagaattatacaatcaattgttgagg

SEQ ID NO: 40010 - DNA, 75 bp, Artificial Sequence
  Synthetic
ccatatcaaggtcaattgggagattctttccatcagacacattatgcaatcctggaaataaaataaggatccctg

SEQ ID NO: 40011 - DNA, 75 bp, Artificial Sequence
  Synthetic
agacacatggaatcagggctagaaaacattgtagaggggctgtctggacatgctcaacctcagacgatgctagaa

SEQ ID NO: 40012 - DNA, 75 bp, Artificial Sequence
  Synthetic
agtggaatcaaggacactttgtgactaagtttgccttaatgttgtgtgagtttacacttcctaaatggtggccta

SEQ ID NO: 40013 - DNA, 75 bp, Artificial Sequence
  Synthetic
ttatcattagaggctgttcaatgttcacaaacaagttcatgatgatgaacatgaggtatattagtatacttagta

SEQ ID NO: 40014 - DNA, 75 bp, Artificial Sequence
  Synthetic
gacacaaggaattggaagtagaagacgagttctcaagaacaatattcagagcatttcatggggaagtgagagttc

SEQ ID NO: 40015 - DNA, 75 bp, Artificial Sequence
  Synthetic
cttggatggaagaaggctccacgtatctaaagacaaaaactgggatgatgcaggggatactacacttcacctctt

SEQ ID NO: 40016 - DNA, 75 bp, Artificial Sequence
  Synthetic
ctctcttgcataccctccaccaggaatttataagatctctttcatttaagatattcaacactaaagtgagaccag

SEQ ID NO: 40017 - DNA, 75 bp, Artificial Sequence
  Synthetic
aaatgtctcagtcaatagtgatagacatgatgcagggctctgatgacagcagcatgatgatcagcttcccgtgct

SEQ ID NO: 40018 - DNA, 75 bp, Artificial Sequence
  Synthetic
caaatgaagatgagctgatgaaatgtaagatagcagcagcaatatgctttagaatgaaaaagaggttgggtgtat

SEQ ID NO: 40019 - DNA, 75 bp, Artificial Sequence
  Synthetic
atctggcaatttacccctcagaaaagtcaacatctaatactgattttgtgatggaatataactcagaattcttct

SEQ ID NO: 40020 - DNA, 75 bp, Artificial Sequence
  Synthetic
ttcactcacagcatgtcagacctactgtgagatgggtggcggcctgctgcaacctgcctgaagttgaaacactgg

SEQ ID NO: 40021 - DNA, 75 bp, Artificial Sequence
  Synthetic
ttgctagacaagaagaagcatccaatttgatgacctctgtgtcagaaggtgggggttctttttcccttgcggctt

SEQ ID NO: 40022 - DNA, 75 bp, Artificial Sequence
  Synthetic
gcatacaacaagcccagtgcacccttcattacatgctgatgggaatggggattagctctttattcgaggaataca

SEQ ID NO: 40023 - DNA, 75 bp, Artificial Sequence
  Synthetic
aaaaggctataattcgatggaaggatccaggattaggtttcttcttgcttgataatccttattgtgctggactag

SEQ ID NO: 40024 - DNA, 75 bp, Artificial Sequence
  Synthetic
gaggatttagatttaacttgtataaggctatttcacaaacacccttaaaatgcttatattcatactttatgaaga

SEQ ID NO: 40025 - DNA, 75 bp, Artificial Sequence
  Synthetic
aggtcaggcaggggatagagactaatgatggtgccattccagagagctgttctgtaagcccaggtggcgccattg

SEQ ID NO: 40026 - DNA, 75 bp, Artificial Sequence
  Synthetic
tactaagctctgcactcaggtggggttccaagcagaaattttacaaattgagagataagttgaacatccctgagg

SEQ ID NO: 40027 - DNA, 75 bp, Artificial Sequence
  Synthetic
attgggtagatcaaataaatcagaacccatcagtattatatagagcaccaagatcaggggaagaggtggttctta

SEQ ID NO: 40028 - DNA, 75 bp, Artificial Sequence
  Synthetic
ggattgcagaaaaggtacactctccaggtgttgtttcatctctctcaactggaaatgctgttgcaaaggtcatag

SEQ ID NO: 40029 - DNA, 75 bp, Artificial Sequence
  Synthetic
cctcatctgtgtattttcttagtgcagccatcttccaagactctggtagacaggaattctccatcttagacagct

SEQ ID NO: 40030 - DNA, 75 bp, Artificial Sequence
  Synthetic
ctaaatatagcttattacagaagctgagtaaactggaagggatcaacttcaccaatgctataagtgatgaagact

SEQ ID NO: 40031 - DNA, 75 bp, Artificial Sequence
  Synthetic
tattatttctatttcccaatattgaagatttgcaatcactagatggtcttgtctataacagaggtcctatagaaa

SEQ ID NO: 40032 - DNA, 75 bp, Artificial Sequence
  Synthetic
tagtaaggagaaagcagatcaaagaaaacactcagtctaaagtcatagtgtttgaagggaatagaaatttgcgaa

SEQ ID NO: 40033 - DNA, 75 bp, Artificial Sequence
  Synthetic
cacctgcagaatacttgatcagtgataagtggtttgggactcaaaaaagtaagattggtagaacagcatttgacc

SEQ ID NO: 40034 - DNA, 75 bp, Artificial Sequence
  Synthetic
aagaatgggagaaggtgacatctatcataccttggctgagagatagccctcaggaaacactgtctagctctccat

SEQ ID NO: 40035 - DNA, 75 bp, Artificial Sequence
  Synthetic
tggacaatcacatacaaataagaaatttcttctcaagaatggaccagaagcctagaatagttagagtgactggtg

SEQ ID NO: 40036 - DNA, 75 bp, Artificial Sequence
  Synthetic
caccaataaagaagaggtcaggagtaagcaaactatcaatggtgattagagataatttttcaaaacttggtttta

SEQ ID NO: 40037 - DNA, 75 bp, Artificial Sequence
  Synthetic
taaaagatattgaggacataacagggacaagtcgcacaaactctgctgaaatgctgaaacattttatgttctgtg

SEQ ID NO: 40038 - DNA, 75 bp, Artificial Sequence
  Synthetic
ctttgcaggggccatattcccaagagagaaagctgcagatggtcatggatctactgggaaagtcaaatcccattg

SEQ ID NO: 40039 - DNA, 75 bp, Artificial Sequence
  Synthetic
gtgtgaaagacagtgatgggaaatccagatcaaacatcctagcaatattacaaagttatgtgtatggtgaaccgc

SEQ ID NO: 40040 - DNA, 75 bp, Artificial Sequence
  Synthetic
acatcgcaaggcaaattgaagatgctggtgcaggtattataggggggtttgtggttcctcagaagcccaagaagt

SEQ ID NO: 40041 - DNA, 75 bp, Artificial Sequence
  Synthetic
tagagaatactatatattactatggttatggagtctggagaggagtgatggatgggaaacaggtgcagatagagc

SEQ ID NO: 40042 - DNA, 75 bp, Artificial Sequence
  Synthetic
tagacaatgcagtaggaagtcctcctatgatcatatctgttacaatggaagagtcggctgagccatggcagatat

SEQ ID NO: 40043 - DNA, 75 bp, Artificial Sequence
  Synthetic
gcaagagtattagatcctgggcagatgatgtgggcgcaaaaaacaatctagatatatcatcaaagattaagaaaa

SEQ ID NO: 40044 - DNA, 75 bp, Artificial Sequence
  Synthetic
agacttgtaagtattggatgtttgatttcaaaacattttcatcagataaagcctatggagcccctgtttatatga

SEQ ID NO: 40045 - DNA, 75 bp, Artificial Sequence
  Synthetic
caaagaagaagatggtggacttcagattgattgatgattctgaaattaatattaaagttagaaaatccactgtca

SEQ ID NO: 40046 - DNA, 75 bp, Artificial Sequence
  Synthetic
atctatatgttaaaaatgatggtagagacgtccacattctatcctattcagcatctgactctgacctaagcccag

SEQ ID NO: 40047 - DNA, 75 bp, Artificial Sequence
  Synthetic
ccagtttgagaataagtgatgaatctaaagatgagatgatggatttatttaataaggagccgagtaaatcatggg

SEQ ID NO: 40048 - DNA, 75 bp, Artificial Sequence
  Synthetic
ctacatgctctcctatacctgccatcatgatgcacaagataatcaaagttgtccaaggggagttaaggataacat

SEQ ID NO: 40049 - DNA, 75 bp, Artificial Sequence
  Synthetic
ctttggacagtgagaggttgggagagatcatgaaattgtgctgtgagtcttctctgagatcaagaatagggactc

SEQ ID NO: 40050 - DNA, 75 bp, Artificial Sequence
  Synthetic
tattttcagctctcccaagtgttcagaacacatcaagggtagatgttgatgatctgatagatatagtgttaactg

SEQ ID NO: 40051 - DNA, 75 bp, Artificial Sequence
  Synthetic
attcaaagacaactggctttaaggagatagtgaaatcacttgaaaatgacataaagaatgagtacgaaatggagg

SEQ ID NO: 40052 - DNA, 75 bp, Artificial Sequence
  Synthetic
acttcgatctctcagatattgacttatttggacctgctcactacaaagaattatcagacttaaatactattagcc

SEQ ID NO: 40053 - DNA, 75 bp, Artificial Sequence
  Synthetic
accctctaatggatgactatgttgaattctgtatttcaacaatagggagaaaagagctgagacggattctagaga

SEQ ID NO: 40054 - DNA, 75 bp, Artificial Sequence
  Synthetic
ccaacagatgcaagacaaaagatcttcaattatcaaaagatctattcttagtattgggaagaaatcctaacgata

SEQ ID NO: 40055 - DNA, 75 bp, Artificial Sequence
  Synthetic
ttaaagtggatgaatacaacattggagaacaactggctgtggaagacgacatgataggataaaatccataaacct

SEQ ID NO: 40056 - DNA, 75 bp, Artificial Sequence
  Synthetic
gtggatgaatacaacattggagaacaactggctgtggaagacgacatgataggataaaatccataaacctgtagc

SEQ ID NO: 40057 - DNA, 75 bp, Artificial Sequence
  Synthetic
tgttttaacttactgagccttgaagatgaaaatcttggcttttttcgcaaatataatggttgcatatgcagcata

SEQ ID NO: 40058 - DNA, 75 bp, Artificial Sequence
  Synthetic
ctctatatccaactggggcttagatggatcagaaacagtctgcctcagcaatgagtctccattagagggattggt

SEQ ID NO: 40059 - DNA, 75 bp, Artificial Sequence
  Synthetic
gcattactgggaaaatgggatcaagaagaggaaaatggacagaaagatcaaaaactgtaagattggctcagaacc

SEQ ID NO: 40060 - DNA, 75 bp, Artificial Sequence
  Synthetic
actcaagaccatggacaatagaactgtaatgtcaataatcgaacaagttcaattgtccatcacaaacctcagatt

SEQ ID NO: 40061 - DNA, 75 bp, Artificial Sequence
  Synthetic
gacctgtgcttcagaatctggtctcgagggcgtttatgtggactttaatggactggatgacactgaggccgggag

SEQ ID NO: 40062 - DNA, 75 bp, Artificial Sequence
  Synthetic
aaacatagtggattgtgagaactttaagataatatctgaattaggtattgacataggagatggctactcctgggt

SEQ ID NO: 40063 - DNA, 75 bp, Artificial Sequence
  Synthetic
agcacaatataatgggtcttatgcaaaagaaatcagagaaaaagatgaaatcataaagaaactgagagagggcca

SEQ ID NO: 40064 - DNA, 75 bp, Artificial Sequence
  Synthetic
agaaaatgctgacatactgatgagagatgacaaaaatgaaatcctgtcattaattagagaaaatcagatgttgca

SEQ ID NO: 40065 - DNA, 75 bp, Artificial Sequence
  Synthetic
acataggatctctaacctcacaggagtagtatacaatttcaataatagtttgagagccctagaaaatgatttagc

SEQ ID NO: 40066 - DNA, 75 bp, Artificial Sequence
  Synthetic
cttaagagaacaagagcacagaaaggtaagagcagaagctgagaagaatcatgtgagaaaaggttcacaagaaaa

SEQ ID NO: 40067 - DNA, 75 bp, Artificial Sequence
  Synthetic
aggtagtcactctgatttcattaaactaaagtcagttttgacatcagcattagtggccaccactgttttacccat

SEQ ID NO: 40068 - DNA, 75 bp, Artificial Sequence
  Synthetic
ggtcactgcctcctcacaaaccaatcaaataaataccctgaatccatacatccatgctaagaatagagtgcatgg

SEQ ID NO: 40069 - DNA, 75 bp, Artificial Sequence
  Synthetic
gggtgtcttcagatatgaaactgatgaggatgaaacatgtagggggttaaactacggcgcaaagtgtgttagttt

SEQ ID NO: 40070 - DNA, 75 bp, Artificial Sequence
  Synthetic
tgaccacatgttgaagccttattattatcctttcttcaactcacatgtgatgcatatgacaccattagaagctta

SEQ ID NO: 40071 - DNA, 75 bp, Artificial Sequence
  Synthetic
tgttgaaaatgagctcactgaagatgaaaactctagctgtgagatgggaaagggaaaatcgaacaaatgtttgga

SEQ ID NO: 40072 - DNA, 75 bp, Artificial Sequence
  Synthetic
gggcagaagctatatgagaggccactgtcccataggaataactggtgtccattacattaatgacaagggcaagat

SEQ ID NO: 40073 - DNA, 75 bp, Artificial Sequence
  Synthetic
agtgttgtcgaagtgtagcggtgagaatcatgaaataactgaagattgcatgttttgtagacagatcaaaaggaa

SEQ ID NO: 40074 - DNA, 75 bp, Artificial Sequence
  Synthetic
ttctggagagaaaggtgttgttaaaacatcagtgtctctgcaggatgcaatttgccagaaagattctatggaata

SEQ ID NO: 40075 - DNA, 75 bp, Artificial Sequence
  Synthetic
ctccgggccacgaatttcaataaagggtgtttgttctattggaaatatggagtataagaaatgctctgcgtttac

SEQ ID NO: 40076 - DNA, 75 bp, Artificial Sequence
  Synthetic
acaaaattatgaaaacgtcccctttgttgtttttaagggtaaagggaagtattacttagagaagttgatcattaa

SEQ ID NO: 40077 - DNA, 75 bp, Artificial Sequence
  Synthetic
caatgttgaacttgttggcaatgtatctttcatatgccataagcataaggggcaagataatgaatcacagcatag

SEQ ID NO: 40078 - DNA, 75 bp, Artificial Sequence
  Synthetic
agaatacaaaaaaacaaaactgtccgactgtggcaatgttgaaactgggaaaacagaagtgtgtactggtgatca

SEQ ID NO: 40079 - DNA, 75 bp, Artificial Sequence
  Synthetic
tgtattctgccaaaagtatacttgttcaactgcaagcccaagtgctaagtgctttgttgctccaggatctggtcc

SEQ ID NO: 40080 - DNA, 75 bp, Artificial Sequence
  Synthetic
tgtgtttgtcaatataatgggctcatgggtgaagccacagtgtgttggttatgagaatgttctggttagaagaga

SEQ ID NO: 40081 - DNA, 75 bp, Artificial Sequence
  Synthetic
gagcaagacgtcacgtccattctccatttctcaatgtagaacttgtgtgtatgaatgtggttcctcagatatcac

SEQ ID NO: 40082 - DNA, 75 bp, Artificial Sequence
  Synthetic
aatcacctctacagggtttgaaataacatcagccgtttcttgctctcatggatcatgtgtttctacacaccaaag

SEQ ID NO: 40083 - DNA, 75 bp, Artificial Sequence
  Synthetic
tccctcaacttcagttaagatcccatatcctggcttagtggcttctacagggggtgacataggaatacatctgtc

SEQ ID NO: 40084 - DNA, 75 bp, Artificial Sequence
  Synthetic
tcacacaggtgacacggctggagttcatatgattgtccactgcccctctagagatgtgtgtgaaacacaccattg

SEQ ID NO: 40085 - DNA, 75 bp, Artificial Sequence
  Synthetic
ttttttctgtctaaaaggaattctgaattatcaatgccacactattctaacttcaattatctcatccacaatgat

SEQ ID NO: 40086 - DNA, 75 bp, Artificial Sequence
  Synthetic
ctccctattgttttatgtagctttctcactagttgggaaactgttgtatttctttcacctaataccaaaaaaact

SEQ ID NO: 40087 - DNA, 75 bp, Artificial Sequence
  Synthetic
gcgtagcccgctaatgtggatatggctattgacctcttacattgtgtctacaatttacaagtcttattgtggcct

SEQ ID NO: 40088 - DNA, 75 bp, Artificial Sequence
  Synthetic
taagagaagaataaacgtgtccattgggtggtctgacaggccgaatcaggtagcactttcagaagtgagagtagg

SEQ ID NO: 40089 - DNA, 75 bp, Artificial Sequence
  Synthetic
cagggcaatcccaagatttgacagaacaatgttcatcatcctcctattgctacctttagccctatcctgctctga

SEQ ID NO: 40090 - DNA, 75 bp, Artificial Sequence
  Synthetic
gtcccttattgcaaattccaagcagatcaggtgtgttcaagacaagagttctctgaagtgcagtgtgactgccac

SEQ ID NO: 40091 - DNA, 75 bp, Artificial Sequence
  Synthetic
agtgacactgaaagctggtgtgattggagcagagagctgcttcatcttgaaggggccaatagaagggcagcacaa

SEQ ID NO: 40092 - DNA, 75 bp, Artificial Sequence
  Synthetic
aaccataatggtaaaaacaatatcaagtgaagtggtatgtagagagggaaatagcttctggactagtcattacat

SEQ ID NO: 40093 - DNA, 75 bp, Artificial Sequence
  Synthetic
gccagtctgtctaagttctagaagatgccacttggtaggggaatgccataagaacagatgccaatcttgggctga

SEQ ID NO: 40094 - DNA, 75 bp, Artificial Sequence
  Synthetic
cagagaagtttcaagagaattcaaaggtgtcagtgacaatggaataatgtctgaaaacaagtgtttcgagcaatg

SEQ ID NO: 40095 - DNA, 75 bp, Artificial Sequence
  Synthetic
cggagctctgggatgcggatgctttaacataaacccctcatgtttatttgtccacagctatctaaagagcaccag

SEQ ID NO: 40096 - DNA, 75 bp, Artificial Sequence
  Synthetic
aaatgaggccgtaagggtcttttcgtgtgctgactgggtacacaggctaaatttggaggtaacagggccagatgg

SEQ ID NO: 40097 - DNA, 75 bp, Artificial Sequence
  Synthetic
ggagaaggacattgttgtgctaggatcacttggcacgaaattcttgagctggggcactattagcctctctcttga

SEQ ID NO: 40098 - DNA, 75 bp, Artificial Sequence
  Synthetic
tgccgaggggatcacagggacaaatgctatcagctttctagaaagtagtaaagggggttttgcactctatgatga

SEQ ID NO: 40099 - DNA, 75 bp, Artificial Sequence
  Synthetic
agcactttctgagatgccaagagaggggttcttaggagaaattagatgctcctctgagtctgctgcaataatggc

SEQ ID NO: 40100 - DNA, 75 bp, Artificial Sequence
  Synthetic
tcactcgtcatgtctaagagctccaaacttgattaaatataaaccaatgacagacataatagactgcacagcgtc

SEQ ID NO: 40101 - DNA, 75 bp, Artificial Sequence
  Synthetic
attagttgatccatttgctgccttcacaaaaggctctttgccacaagtcaggaacggtatgacctttacaagttc

SEQ ID NO: 40102 - DNA, 75 bp, Artificial Sequence
  Synthetic
tatggacaaaaagactgtgcaagcattcaattctggatcaatcaaggcaatgataacaattaatatggatgacca

SEQ ID NO: 40103 - DNA, 75 bp, Artificial Sequence
  Synthetic
cgagattcagtttctatctgactttggaagatgtgaatcatctttcataaatattacaggttgttactcttgtga

SEQ ID NO: 40104 - DNA, 75 bp, Artificial Sequence
  Synthetic
ctatggggctagggtttgtgtgagggtaaatgctgacaaacccagcgtgtatctggcccgacaagagaacaatga

SEQ ID NO: 40105 - DNA, 75 bp, Artificial Sequence
  Synthetic
gttttttatctcacttaaggtagaacaagggaccaatgactattgccagatcctgcattttaactctcctaatgt

SEQ ID NO: 40106 - DNA, 75 bp, Artificial Sequence
  Synthetic
agaagaaaagatgaagtactcttgtggggctgaggaaaaactgctcaatatcaaaggcatcctaatctcattagg

SEQ ID NO: 40107 - DNA, 75 bp, Artificial Sequence
  Synthetic
agtgagtgacttaagaaatcaaactggcggccactcaacagttgtgaatcctagagaaactaattggaacttagg

SEQ ID NO: 40108 - DNA, 75 bp, Artificial Sequence
  Synthetic
aggatgggcctccggattattctcctggctaggggggacatggacaggaattttgaaaattcttggttttttatt

SEQ ID NO: 40109 - DNA, 75 bp, Artificial Sequence
  Synthetic
attaggcttaattataattctattagttgtatcattatcaaagcggctcattttctccacttttatcaagacaaa

SEQ ID NO: 40110 - DNA, 75 bp, Artificial Sequence
  Synthetic
taattctattagttgtatcattatcaaagcggctcattttctccacttttatcaagacaaaagtaaaatagacat

SEQ ID NO: 40111 - DNA, 75 bp, Artificial Sequence
  Synthetic
ttaagcagtgggtatcaacgcagagtacgaaacacaaagctcctcaaggattgttaacaggtgaattactaaacc

SEQ ID NO: 40112 - DNA, 75 bp, Artificial Sequence
  Synthetic
aagatgtcttatgaaaaacttgctattgatattgccggccatgagattgatgccgacactatcaaggcctgggtg

SEQ ID NO: 40113 - DNA, 75 bp, Artificial Sequence
  Synthetic
caagcttttgcttaccaaggctttgatgccaaaagggtgatggaactgcttgtggagagaggtggagatgactgg

SEQ ID NO: 40114 - DNA, 75 bp, Artificial Sequence
  Synthetic
gttgaagatgccaagcagatgatcatcctatgccttacaagggggaataagccatctaaaatgatggtgaagatg

SEQ ID NO: 40115 - DNA, 75 bp, Artificial Sequence
  Synthetic
tccgagaagggaaagaagattgtgcagggccttgttaagagatattctcttaaggaggggaacccctctagagat

SEQ ID NO: 40116 - DNA, 75 bp, Artificial Sequence
  Synthetic
gatctcacactgtctagagtgacagctgccttagctggctatacatgccaagcaactgagtacgtggaagaattc

SEQ ID NO: 40117 - DNA, 75 bp, Artificial Sequence
  Synthetic
ttacctgttactgggaagaacatggatgatctgtctaagaactaccctagggcaatgatgcacccaagctttgct

SEQ ID NO: 40118 - DNA, 75 bp, Artificial Sequence
  Synthetic
gggctcattgatcccaagcttcccccggatgtgctgtcaaccatctgtgacgcatttagccttttcatggtccag

SEQ ID NO: 40119 - DNA, 75 bp, Artificial Sequence
  Synthetic
ttttcaaggaccataaacccaagaaatcgagggctgtctgtgtctgaggtggcaagcaccttcgataggccaatg

SEQ ID NO: 40120 - DNA, 75 bp, Artificial Sequence
  Synthetic
aatgcagcaataaatagctcattcatcagtggagaacagaggaagtcatttctcagaaatctcggaatactggac

SEQ ID NO: 40121 - DNA, 75 bp, Artificial Sequence
  Synthetic
gaaaacatgcagccatctagccctgtgaaggctgctgccaaagttttcaggggtttgaaataatctgccccaatg

SEQ ID NO: 40122 - DNA, 75 bp, Artificial Sequence
  Synthetic
atgattgataattagcacaattgcatttaatcattaaaattttaaataatttgttcaaaattggatttcaattaa

SEQ ID NO: 40123 - DNA, 75 bp, Artificial Sequence
  Synthetic
ttcctaatcactacaatctcattaattttacaattaacaaaattaaattaattaaaattgaaatcaaatttaaat

SEQ ID NO: 40124 - DNA, 75 bp, Artificial Sequence
  Synthetic
aattaaataaaatcaccccaattaacccacctcacacctccccaccccacctggcagctggtccgtctacctcca

SEQ ID NO: 40125 - DNA, 75 bp, Artificial Sequence
  Synthetic
tctcttcttctgaatctaaatcagaatcccacgaatctgctatccttgtgtattttgggctcatggtatggagag

SEQ ID NO: 40126 - DNA, 75 bp, Artificial Sequence
  Synthetic
gtgtccattttctgtttcctagcaactgaggagtgatcacctcagagagctctttcacataatcatataaagaag

SEQ ID NO: 40127 - DNA, 75 bp, Artificial Sequence
  Synthetic
agtgaaagtcagactcataataatcatagggaagagcagttagcattcttaatatctgcacataagcaatctcct

SEQ ID NO: 40128 - DNA, 75 bp, Artificial Sequence
  Synthetic
tttctatattttggccagtaaagttcaagcagggtatatctcgctctccaagttctcttatcatcttcttgtaaa

SEQ ID NO: 40129 - DNA, 75 bp, Artificial Sequence
  Synthetic
gattaactaaagaatcatctatttgaactccatctccactcctcatgattaaggtcattaggaagcacttttctt

SEQ ID NO: 40130 - DNA, 75 bp, Artificial Sequence
  Synthetic
cccagttgaactcatagctttcaattaaagataatttaaaaaaagctagtgtgggaacacctagaggccagctaa

SEQ ID NO: 40131 - DNA, 75 bp, Artificial Sequence
  Synthetic
gggcctctttaagattaggctctgaccattttaactgtctttccagattgaggtgagatattttctctatagtgg

SEQ ID NO: 40132 - DNA, 75 bp, Artificial Sequence
  Synthetic
tgtcaaagaaagaaggggattttcccttcacctgaagaaaaggctttccccaggatctgggaagttgacctttgt

SEQ ID NO: 40133 - DNA, 75 bp, Artificial Sequence
  Synthetic
caatgaaactccttagtctgaaagaagttttatctgatacggcaaaagatgagcaaggaaattcagcacctttgt

SEQ ID NO: 40134 - DNA, 75 bp, Artificial Sequence
  Synthetic
acctgcagatgggagtaccccagtagccattgtaagctgagtattccacatacactttagacctgtcagtggcag

SEQ ID NO: 40135 - DNA, 75 bp, Artificial Sequence
  Synthetic
atctagtgatatgtggaatatcaaaaacgtaattcagcatgttagacatgatttactttcttcactatttcgatc

SEQ ID NO: 40136 - DNA, 75 bp, Artificial Sequence
  Synthetic
atcaaaaacgtaattcagcatgttagacatgatttactttcttcactatttcgatctcaagaggggactttgtgt

SEQ ID NO: 40137 - DNA, 75 bp, Artificial Sequence
  Synthetic
tcactatagggtaagcagtgggtatcaacgcagagtacgaaacacaaagaagcccaaactatggaagaaatactg

SEQ ID NO: 40138 - DNA, 75 bp, Artificial Sequence
  Synthetic
aacaaacaacaaatccctgagggtgttgggttgtacagacctgagatacggcaatacgacgattcgatcatggat

SEQ ID NO: 40139 - DNA, 75 bp, Artificial Sequence
  Synthetic
gtggagatccctttctttcacataacaaaatgtgatggttacatgaagattgacctggatttgaataatggagtt

SEQ ID NO: 40140 - DNA, 75 bp, Artificial Sequence
  Synthetic
gattactcaacaattggatcatccctaatatccactattgaggtcccagacaaatctttaccaaatcttgttcac

SEQ ID NO: 40141 - DNA, 75 bp, Artificial Sequence
  Synthetic
gatgtagtgttttcacacctcgctagcaatacagatgtgagattctcagcagtgtttggtgttctttcagattct

SEQ ID NO: 40142 - DNA, 75 bp, Artificial Sequence
  Synthetic
tatgatcatctttcccctgatttcattttgaagactgctgctggatcacaccacgttgttgaatttactactaat

SEQ ID NO: 40143 - DNA, 75 bp, Artificial Sequence
  Synthetic
cggggaggtgaaaggggtgcttttcaagcctgcaaagacaagttttctaagtatcacatcccttgtgagaataga

SEQ ID NO: 40144 - DNA, 75 bp, Artificial Sequence
  Synthetic
gcagtgggtggcagagtgtctttatttgttatttctgtgtatgtcagaggggtttggtcaaatttggaccttaca

SEQ ID NO: 40145 - DNA, 75 bp, Artificial Sequence
  Synthetic
gatgaggaagtgaatgagcttgtgtttaggtttcggcttgcagttgcaattatggaggaagcaagaaagtactat

SEQ ID NO: 40146 - DNA, 75 bp, Artificial Sequence
  Synthetic
cctgagctgacagaagatgaaagtgagatgaccaagcaggagagagaaatattaggtgtgatctcttctatccag

SEQ ID NO: 40147 - DNA, 75 bp, Artificial Sequence
  Synthetic
atggactggggggttactagcttaaaatttcctcattttaaagaaaaagtgtttgagaattttatgacaacatca

SEQ ID NO: 40148 - DNA, 75 bp, Artificial Sequence
  Synthetic
gcagatgaggagtatctatccagtgttatatcagatgaattaacagcctgtcagcaagacatgattaagtctggc

SEQ ID NO: 40149 - DNA, 75 bp, Artificial Sequence
  Synthetic
ttcataggaaaggtcagtggaattgatgaaaaactgtcattgaatgaggctgagtgtgcaagcatgataagcaag

SEQ ID NO: 40150 - DNA, 75 bp, Artificial Sequence
  Synthetic
tacttagaaagtaaagatgggaatcatagagacagattggacagcaagtcaaccgttcaaatcccaccatgggta

SEQ ID NO: 40151 - DNA, 75 bp, Artificial Sequence
  Synthetic
atgacagattacacagaaggaaagtcagtatcatgcctttcaaattttgaagtcgaaggagatcatccaatgtgc

SEQ ID NO: 40152 - DNA, 75 bp, Artificial Sequence
  Synthetic
aaaatctggaggtctgtcaccatagcagcagcaatgggtgatattgacagagcagatgatgatcctattactgaa

SEQ ID NO: 40153 - DNA, 75 bp, Artificial Sequence
  Synthetic
ctaaaaaaagctttggaagggagtattcaaaagagtgatgagagaagcagatatcatagaattaagctcaactta

SEQ ID NO: 40154 - DNA, 75 bp, Artificial Sequence
  Synthetic
acaaatgaagaaatagtatatggagcaactcttggtgtcgaggggaaatctcacaagaataatgcccaggtggaa

SEQ ID NO: 40155 - DNA, 75 bp, Artificial Sequence
  Synthetic
gagtcacggaagaggagtaagctaggattttctctagatcatgatataacaaatctggaagagttcatcaacaaa

SEQ ID NO: 40156 - DNA, 75 bp, Artificial Sequence
  Synthetic
cacgatttagagttgtttgcagagtccgatgattatttcaatccttttcaagctgattttgatctaagagagtct

SEQ ID NO: 40157 - DNA, 75 bp, Artificial Sequence
  Synthetic
gctcagaagattcatcagcctgatctaatcatgaagcaaggagaaaatgaattcttagcaaaccacaagaaatta

SEQ ID NO: 40158 - DNA, 75 bp, Artificial Sequence
  Synthetic
tgcatgtctaagatcggatcgtggtgtcaaatggtttcattaataggtgctgaattatctgcatctgttaaacaa

SEQ ID NO: 40159 - DNA, 75 bp, Artificial Sequence
  Synthetic
catgtagggaaagggcaatttgtcataaagagagttttgaattctcctctctttatgttaataaaacctacgtca

SEQ ID NO: 40160 - DNA, 75 bp, Artificial Sequence
  Synthetic
tctgttagccacatttttgtttcctttgccttggtcaagtccagtcacatgggagatctatgggacaacggcgtt

SEQ ID NO: 40161 - DNA, 75 bp, Artificial Sequence
  Synthetic
tttaagcattacatagatgctggggatctattcataacagactttatctcatataaactaagcaaattgaccaat

SEQ ID NO: 40162 - DNA, 75 bp, Artificial Sequence
  Synthetic
ttatgtaaatgttttcctctcatggaaagtgccatttgcttttggacagagatttttggttttgaaccttgggat

SEQ ID NO: 40163 - DNA, 75 bp, Artificial Sequence
  Synthetic
tctactcacattatgtctactgacaggagtgggagtgcaaaagaagccgcttcaatgataaaattaactttattg

SEQ ID NO: 40164 - DNA, 75 bp, Artificial Sequence
  Synthetic
actcttatggaggacaaggctgttactgaagagatccagaccattcagcggtatataatcatggagggttttgtt

SEQ ID NO: 40165 - DNA, 75 bp, Artificial Sequence
  Synthetic
tcgctacctgagctccccaaaccccataagatgttgtcaaaattgcccgctgttttaagatcggagctgcaggtt

SEQ ID NO: 40166 - DNA, 75 bp, Artificial Sequence
  Synthetic
tatttagttcttcgatctctaagaaccatggagagaatctctagaactcctttcagactccagaagaaacagagt

SEQ ID NO: 40167 - DNA, 75 bp, Artificial Sequence
  Synthetic
cagatcacttggtcgggtctgtttaatcccttaacagggaattccctgagagagttgcaaccacttattagtatt

SEQ ID NO: 40168 - DNA, 75 bp, Artificial Sequence
  Synthetic
tgttacaatgggtacttcaagaataaggaggaggaaaccgaaccatctgccttatctagactttataagaagata

SEQ ID NO: 40169 - DNA, 75 bp, Artificial Sequence
  Synthetic
attgagttggaacacctatgtcccaaagatgatgtgtttttagggtcaggtgatccaaaggatccaaaaatgcat

SEQ ID NO: 40170 - DNA, 75 bp, Artificial Sequence
  Synthetic
gagttcagccgctcatttcttaagaaatgcacagatcatgggaaaaccattctgaggaagatatatggtcagaat

SEQ ID NO: 40171 - DNA, 75 bp, Artificial Sequence
  Synthetic
ttcatgcagcaaattgatacccagataatgagggagattagcacaatcactctagagaagttggctactcttaaa

SEQ ID NO: 40172 - DNA, 75 bp, Artificial Sequence
  Synthetic
gctagtagcaactttgatgagaaatggtatgattatgcaacctgtagcaaagaagattatcacagggggaaagcc

SEQ ID NO: 40173 - DNA, 75 bp, Artificial Sequence
  Synthetic
attgttaagatgtcagaatttgcagcaaccgggaagacactagcgatagaggtgtttgatgagtgcatgaagttc

SEQ ID NO: 40174 - DNA, 75 bp, Artificial Sequence
  Synthetic
attgaaaaaagagggaatatgcacatctgtctatttaagaaacaacaacatggtggggaccgagaaatctatgtc

SEQ ID NO: 40175 - DNA, 75 bp, Artificial Sequence
  Synthetic
ttgggaagagaagagagaatcatccagtcaatagtagaggcaatttcaagatccatagggaggttctttccttcc

SEQ ID NO: 40176 - DNA, 75 bp, Artificial Sequence
  Synthetic
gacacgttgtgcaatcctggcaataagataaagattcctgaaactcatgggatcagagccaggaaacattgcagg

SEQ ID NO: 40177 - DNA, 75 bp, Artificial Sequence
  Synthetic
ggagcagtctggacatgctctacctctgatgatgcaaggaaatggaatcagggccactttgtcaccaaatttgca

SEQ ID NO: 40178 - DNA, 75 bp, Artificial Sequence
  Synthetic
cttatgctgtgtgaattcactctcccaaagtggtggcccataatcatcagaggttgttctatgttcactaataag

SEQ ID NO: 40179 - DNA, 75 bp, Artificial Sequence
  Synthetic
tttatgatgatgaatatgagatatatgagcatcttgagcagacataaagaactatacatagaggatgagttttcg

SEQ ID NO: 40180 - DNA, 75 bp, Artificial Sequence
  Synthetic
aggacaatatttaaagcctttcatggagaggccaaggttccctggatggatgaaggagcaacatttctaaaaact

SEQ ID NO: 40181 - DNA, 75 bp, Artificial Sequence
  Synthetic
aaaacaggcatgatgcaaggtatattgcacttcacgtcttctttactccacaccttacaccaagagttcataaga

SEQ ID NO: 40182 - DNA, 75 bp, Artificial Sequence
  Synthetic
tccttatctttcaagattttcaatacaaaagtgagaccagaaatgtcacaatctattgtgatagatatgatgcag

SEQ ID NO: 40183 - DNA, 75 bp, Artificial Sequence
  Synthetic
gggtcagatgacagcagcatgatgattagcttcccctgcttgaatgaagatgaattgatgaaatgtaaaattgca

SEQ ID NO: 40184 - DNA, 75 bp, Artificial Sequence
  Synthetic
gctgcaatctgcttcaggatgaagaaaagattaggggtatatctagctatttacccatcagaaaaatctacttca

SEQ ID NO: 40185 - DNA, 75 bp, Artificial Sequence
  Synthetic
aacactgattttgtcatggagtacaattcagagttcttctttcattctcaacatgttagacctacagtcagatgg

SEQ ID NO: 40186 - DNA, 75 bp, Artificial Sequence
  Synthetic
gtggctgcctgctgcaatttacctgaagtcgaaactctagttgcaagacaagaagaagcttcaaacttaatgaca

SEQ ID NO: 40187 - DNA, 75 bp, Artificial Sequence
  Synthetic
tcagtctcagagggaggtggttcattttctttggcagcctgcattcaacaagcccagtgtacactccactacatg

SEQ ID NO: 40188 - DNA, 75 bp, Artificial Sequence
  Synthetic
ttgatgggaatgggggtaagctcattatttgaagagtataaaaaagccattattaggtggaaagatcctggcttg

SEQ ID NO: 40189 - DNA, 75 bp, Artificial Sequence
  Synthetic
ggcttctttttattggacaatccttactgtgctgggttaggtggatttagattcaacttatacaaagcaattgct

SEQ ID NO: 40190 - DNA, 75 bp, Artificial Sequence
  Synthetic
cagacatcattaaaatgtctttattcatacttcatgaagaaggtcagacaagggattgagtcaaatgatggtaca

SEQ ID NO: 40191 - DNA, 75 bp, Artificial Sequence
  Synthetic
ataccagaaagttgctcagtcagtccaggtggagcaatagttctgagttctgcattacgatggggctcgaagcaa

SEQ ID NO: 40192 - DNA, 75 bp, Artificial Sequence
  Synthetic
aagttttacaaattgagggataaactaaacatccctgaagactggatagaacagataaaccagaatccatctgtt

SEQ ID NO: 40193 - DNA, 75 bp, Artificial Sequence
  Synthetic
ttgtacagagctccaaggtctggtgaagaagtcattcttagaattgctgaaaaagtgcactctcctggggttgta

SEQ ID NO: 40194 - DNA, 75 bp, Artificial Sequence
  Synthetic
tcctctttatctacaggtaatgctgttgctaaagtgatagcatcatcagtgtatttcttgagtgcagcaattttc

SEQ ID NO: 40195 - DNA, 75 bp, Artificial Sequence
  Synthetic
caggattcaggtaggcaggagttctctattttggatgactcaaaatacagcctattacaaaagttgagtaaactg

SEQ ID NO: 40196 - DNA, 75 bp, Artificial Sequence
  Synthetic
gaaggcatcaatttaaccaatgcaataagtgatgaagacttattgtttttattcccaaatatagaagacctgcag

SEQ ID NO: 40197 - DNA, 75 bp, Artificial Sequence
  Synthetic
gcgttggatagtttagtgtataatagaggagccattgaaatagtcaagaggaaacaagtgaaagaaaatacacag

SEQ ID NO: 40198 - DNA, 75 bp, Artificial Sequence
  Synthetic
tctagagttattgttttcgaaggtaacagaaacttaagaaccccagctgagtacttgataagtgataagtggttt

SEQ ID NO: 40199 - DNA, 75 bp, Artificial Sequence
  Synthetic
ggcacacagaaaagcaagataggaagaacagcatttgatcaagaatgggataaggtcacatcaataataccatgg

SEQ ID NO: 40200 - DNA, 75 bp, Artificial Sequence
  Synthetic
ctcagagacagccctcaagacactctcttgagctcacctctggacaatcacattcagataagaaatttcttttcc

SEQ ID NO: 40201 - DNA, 75 bp, Artificial Sequence
  Synthetic
agaatggatcaaaaacctagagttgttagggttacaggagctcccattaaaaagaggtcaggtgtcagcaagcta

SEQ ID NO: 40202 - DNA, 75 bp, Artificial Sequence
  Synthetic
tctatggtcatcagagataattttactaagcttggatttataagagacattgaagacatgactgggactagtagg

SEQ ID NO: 40203 - DNA, 75 bp, Artificial Sequence
  Synthetic
acaaactcagctgaaatgctaaagcattttatgttctgcgctctgcaagggccatattctcaggagaggaagcta

SEQ ID NO: 40204 - DNA, 75 bp, Artificial Sequence
  Synthetic
caaatggttattgacctgttgagtaggtcaaaccccataggtgttaaagacagtgatgggaaatccaggtcaaac

SEQ ID NO: 40205 - DNA, 75 bp, Artificial Sequence
  Synthetic
atattggcgatactacagagctatgtgtatcaggaaccgcacattgcaagacaaatagaggatgctggtgctggg

SEQ ID NO: 40206 - DNA, 75 bp, Artificial Sequence
  Synthetic
ataataggaggatttgttgtccctcagaagccaaaaaagatagaaaacaccatttattattatggttatggtgtc

SEQ ID NO: 40207 - DNA, 75 bp, Artificial Sequence
  Synthetic
tggagaggggtcatggacgggaagcaagttcagattgaattggacaatgcagtaggaagtcctcctgtgataata

SEQ ID NO: 40208 - DNA, 75 bp, Artificial Sequence
  Synthetic
tcagtgacaatggaggaatcagcagagtcatggcagatatgcaaaagcattaggtcctgggcagatgacgttggt

SEQ ID NO: 40209 - DNA, 75 bp, Artificial Sequence
  Synthetic
gcaaagaacaacctagacatatcctccaagataaggaaaaaaacttgcaaatattggatgtttgacttcaagact

SEQ ID NO: 40210 - DNA, 75 bp, Artificial Sequence
  Synthetic
ttttcttcagacaaagcttatggagcccctgtatacatgacaaaaaagaaaatggtggatttcagactaattgat

SEQ ID NO: 40211 - DNA, 75 bp, Artificial Sequence
  Synthetic
gattcagagattaacatcaaagtgagaaagtcaacagttaatctatatgttaggaatgatggcagagatgttcac

SEQ ID NO: 40212 - DNA, 75 bp, Artificial Sequence
  Synthetic
atcttatcctattctgcatcagattctgacttgagcccagctagccttagaataaatgatgagtcaaaagatagc

SEQ ID NO: 40213 - DNA, 75 bp, Artificial Sequence
  Synthetic
atgatggatttattcaataaagaacccagcaaatcatgggcaacatgctccccgattccagctctcatgatgcac

SEQ ID NO: 40214 - DNA, 75 bp, Artificial Sequence
  Synthetic
aagatcattaaagttgtgcagggagagctcaaaatctcatcgctggacagtgagaggcttggggagattatgaaa

SEQ ID NO: 40215 - DNA, 75 bp, Artificial Sequence
  Synthetic
ttatgctgcgagtcttctctgaggtctagaatagggactttattttcagctctacctagtgtgcagaacacatct

SEQ ID NO: 40216 - DNA, 75 bp, Artificial Sequence
  Synthetic
agagtagatgttgatgatctgatagacattgtattaacagattcaaaatcagctgggttcaaggacatagtgcag

SEQ ID NO: 40217 - DNA, 75 bp, Artificial Sequence
  Synthetic
tcccttgagaatgatataaaagatgagtatgaaatagaagattttgatttgtctgacatcgacttgtttggacca

SEQ ID NO: 40218 - DNA, 75 bp, Artificial Sequence
  Synthetic
gctcattataaagagttgtctgatttgaacactatcagtcaccccttaatggatgattatgttgaattctgcata

SEQ ID NO: 40219 - DNA, 75 bp, Artificial Sequence
  Synthetic
tctacagtaggaagaaaagagttaagaaggatactagaaactaacagatgcaagacaaaagacctacaattatcc

SEQ ID NO: 40220 - DNA, 75 bp, Artificial Sequence
  Synthetic
aaagacctcttcttggtgttaggtagaaatcctgatgatattaaggtggatgaatataacttaagagaacaacta

SEQ ID NO: 40221 - DNA, 75 bp, Artificial Sequence
  Synthetic
gccgtggaagacgacatgataggatgaagtctatcattgtgtcaatatgtggcaaaacaaagtcttctcataatt

SEQ ID NO: 40222 - DNA, 75 bp, Artificial Sequence
  Synthetic
ttgaacactcatccccaggtgaggaattggattttcaaatattgtaaagtgttcaattatgggcggactttgtgt

SEQ ID NO: 40223 - DNA, 75 bp, Artificial Sequence
  Synthetic
acacaaagccggcaaacttattttgatttatttactaacattttaacaaaatgaaggttcttttaattctgttcc

SEQ ID NO: 40224 - DNA, 75 bp, Artificial Sequence
  Synthetic
acttcatagtcgccaaagcctcttactctttgaggtcatgggacatgagaggacagaatgaaatgtgttttagta

SEQ ID NO: 40225 - DNA, 75 bp, Artificial Sequence
  Synthetic
atgacacccctttggagggactattttattattggatggagcagtcaaagaaatatatgaagggccatgaaaagg

SEQ ID NO: 40226 - DNA, 75 bp, Artificial Sequence
  Synthetic
atgagaaaaattgcgcaattggaagtggtgatgttgctatgatttctaacaaaacaatgttctcaataattgagg

SEQ ID NO: 40227 - DNA, 75 bp, Artificial Sequence
  Synthetic
aagtgcagaaaagccttagttcattatcgataacatgttatgagagtttaaatgagagaggagaatcactaagtt

SEQ ID NO: 40228 - DNA, 75 bp, Artificial Sequence
  Synthetic
tcaatggtctagatgatacagaatctggagcttttatatctgactgtgagactcataaatacaagtcagatcttg

SEQ ID NO: 40229 - DNA, 75 bp, Artificial Sequence
  Synthetic
gggtcagagtcagtaatgggacagacaaaaatgacattctgagagagactctagatgcagctgctgcgaatgaag

SEQ ID NO: 40230 - DNA, 75 bp, Artificial Sequence
  Synthetic
aagctgaaaagaagattgctgccttgaatgagataacacagaagattaatgatgacaacaggaaagaagctgaaa

SEQ ID NO: 40231 - DNA, 75 bp, Artificial Sequence
  Synthetic
gattagaatttgacctgaaaaggaaggaaagagagatgagtgatctacaaagtgagctcgaacttctgagattaa

SEQ ID NO: 40232 - DNA, 75 bp, Artificial Sequence
  Synthetic
ggaaagaagaagatgaaaataggataaactccaaaatgttgtctataaattcatcctggttagatcacataaaac

SEQ ID NO: 40233 - DNA, 75 bp, Artificial Sequence
  Synthetic
tcaagtcagctttgataaccccactgattctaacaaccactattacaaatgtcatagcaaacccagatgcttcta

SEQ ID NO: 40234 - DNA, 75 bp, Artificial Sequence
  Synthetic
atcctatcaatccatggccacattcaaaaaatagaccaggaaaaggcctgtttaaattcgaggaaggtgaaatgg

SEQ ID NO: 40235 - DNA, 75 bp, Artificial Sequence
  Synthetic
attcatgcagaccattggattacgacataaactgtcctagttttaactacatgctgagattagacaaatatccat

SEQ ID NO: 40236 - DNA, 75 bp, Artificial Sequence
  Synthetic
tcttcaattcttttgtcactcatttcactccattagaagcttattctgaagggtttctggaaacagaaagctccg

SEQ ID NO: 40237 - DNA, 75 bp, Artificial Sequence
  Synthetic
tgtgtgaggtgggaacgaataaagaatataagtgcttcgaagagagagcatatatgaaaggccactgtcctaatg

SEQ ID NO: 40238 - DNA, 75 bp, Artificial Sequence
  Synthetic
gcatctcaggtgtgcattttttgaatgagaaaggaaagctcaagttaataaaatgtaaggagaatatggagataa

SEQ ID NO: 40239 - DNA, 75 bp, Artificial Sequence
  Synthetic
cagaagactgcaccttttgcaggaagataaagaagaagagctcaacatcagtccacaagacgtcagtgtcaattc

SEQ ID NO: 40240 - DNA, 75 bp, Artificial Sequence
  Synthetic
aagatgccatatgccaaaagcactctgaagcatataatggtccgaagatcacagtcaaaagcgtgtgtaaaattg

SEQ ID NO: 40241 - DNA, 75 bp, Artificial Sequence
  Synthetic
gacacacaagatataaggattgcaatcttaagacatctggttttgaggtaatgccttttgtagtttttgagaatc

SEQ ID NO: 40242 - DNA, 75 bp, Artificial Sequence
  Synthetic
aaggtaaaatgtatctagacaacctaatcttgaagaatatagaggttattactaatatgaccttcttatgttata

SEQ ID NO: 40243 - DNA, 75 bp, Artificial Sequence
  Synthetic
cacataagggtcaagacgacactggtgatggtgctgacactcggggtctcaaaagattcaagtcagaagattgta

SEQ ID NO: 40244 - DNA, 75 bp, Artificial Sequence
  Synthetic
agaacattaataactctaaagagaaaatatgtggcggagaccatgttttttgtgaaagatatgactgtacaggca

SEQ ID NO: 40245 - DNA, 75 bp, Artificial Sequence
  Synthetic
gttatcctgatgtacattgttttcatgctcctgggtctggaccagtttatgttaatatatacggttcatgggtga

SEQ ID NO: 40246 - DNA, 75 bp, Artificial Sequence
  Synthetic
agcccaaatgccttggatatgagagggtcttggtcgaaagagaatctaagccaggggttgaaaggacgcagactg

SEQ ID NO: 40247 - DNA, 75 bp, Artificial Sequence
  Synthetic
aatgtgacacttgtatttctgagtgtcaggatgatggtgttttggtcagatcaactggattcttgatcacatcag

SEQ ID NO: 40248 - DNA, 75 bp, Artificial Sequence
  Synthetic
gagtcatttgctctcatggatcatgcatttcacgacatcaggatccaaaaacagaaattctgatcccataccctg

SEQ ID NO: 40249 - DNA, 75 bp, Artificial Sequence
  Synthetic
ggatgacagcagccttaggtggggaattaggtgtgtacttatcacacactgaggactctctgagtctccacatga

SEQ ID NO: 40250 - DNA, 75 bp, Artificial Sequence
  Synthetic
aagtacactgtgaccccagagatgtgtgtgagactcatcattgcttcttttgtctttacggcgtcattaattacc

SEQ ID NO: 40251 - DNA, 75 bp, Artificial Sequence
  Synthetic
agtgccataccactttaagtctgaccatagtttcaacaatattatcatgtggcatatacataatattgtgccttc

SEQ ID NO: 40252 - DNA, 75 bp, Artificial Sequence
  Synthetic
tagggaaaattttgtatattctaaaaataattccaaagaaattaagaaacccttttgcttggttggccttactaa

SEQ ID NO: 40253 - DNA, 75 bp, Artificial Sequence
  Synthetic
tcacatggatgatctctctgctaagagagatcttctgcaaactcaagtcatccataaacacgaggattggatggt

SEQ ID NO: 40254 - DNA, 75 bp, Artificial Sequence
  Synthetic
actctaaccaaatagacattgaagcacagccactgaggagaagacgtttagagagatttcctgcagctcttttaa

SEQ ID NO: 40255 - DNA, 75 bp, Artificial Sequence
  Synthetic
ttgttgcccttttgctaccagctgctttctgctgctctgaaactctagtttccaactcaaaacaaactaaatgtg

SEQ ID NO: 40256 - DNA, 75 bp, Artificial Sequence
  Synthetic
tgcaagatggtgctaaggtgagatgtagtgtaactgccactataacaatgaaggcaggagtaatcgggggggaat

SEQ ID NO: 40257 - DNA, 75 bp, Artificial Sequence
  Synthetic
catgcttcatgatcaagggtccttctgaaaatcaacagaaaaccatcaaagtgaagaccatatcgagtgaaatca

SEQ ID NO: 40258 - DNA, 75 bp, Artificial Sequence
  Synthetic
tctgccgtgaaggaccaagcttttggacaagccactttgtcccctcatgcttgagctcaagaagatgccatctgg

SEQ ID NO: 40259 - DNA, 75 bp, Artificial Sequence
  Synthetic
taggaggatgcacagggaataaatgtcaatcatggagagatgatatgctctcaggtgagtttgctggtgtcaagg

SEQ ID NO: 40260 - DNA, 75 bp, Artificial Sequence
  Synthetic
acaattcagttatgaatgaaaataagtgttttgagcagtgtggggcagccggctgtggttgttttaatataaacc

SEQ ID NO: 40261 - DNA, 75 bp, Artificial Sequence
  Synthetic
cctcatgtttatttgttcatacaacattaaagagtgccaggaatgaagcaataagagtctttaagtgtgctgatt

SEQ ID NO: 40262 - DNA, 75 bp, Artificial Sequence
  Synthetic
gggttcatcggataacatttgaagtaaatgggccttcagatgaaaaggatctaatagtgctatcaggtctgggaa

SEQ ID NO: 40263 - DNA, 75 bp, Artificial Sequence
  Synthetic
caaagtttctcccttgggggacaatttctttgagcctagatgctgaatcagtagccggctcgaatgacataagct

SEQ ID NO: 40264 - DNA, 75 bp, Artificial Sequence
  Synthetic
ttctagaaagcagtaatgggggttttgctctatatgacgagtcatactctgagatgcctcgcgagggatttctag

SEQ ID NO: 40265 - DNA, 75 bp, Artificial Sequence
  Synthetic
gagaaatcagatgctcatctgcatcagcagccataaacgctcacaagtcttgcataagagccccaaatctcataa

SEQ ID NO: 40266 - DNA, 75 bp, Artificial Sequence
  Synthetic
aatacaaaccaatgactgatcaaattgactgtactgcctctctagtggacccttttgcagtgtttgtccgaggat

SEQ ID NO: 40267 - DNA, 75 bp, Artificial Sequence
  Synthetic
ctctaccacaagttaggaaaggcatgacatacacaagctcaaaagataaaaaaactgtgcaggctttcaacagtg

SEQ ID NO: 40268 - DNA, 75 bp, Artificial Sequence
  Synthetic
gttcgatacaagcattcatcacaatcaatatagaagatcatgatgtgattttcaccagtgacatcataacatgtg

SEQ ID NO: 40269 - DNA, 75 bp, Artificial Sequence
  Synthetic
atgccactttccaaaatataacaggatgctactcttgcaactttggatctcgtgtgtgcttgaaaatcaaatcaa

SEQ ID NO: 40270 - DNA, 75 bp, Artificial Sequence
  Synthetic
gcggaaatggagagttctgggcaaggtctgaagatgcctcgctaaacctattcttcgaagtggcagaaggcacaa

SEQ ID NO: 40271 - DNA, 75 bp, Artificial Sequence
  Synthetic
gtgagtattgtcagacaattcacttccagaaaccccttgtggaggagaatcttaaatactcatgtggatcagcag

SEQ ID NO: 40272 - DNA, 75 bp, Artificial Sequence
  Synthetic
aaaagctcatagtgataaaaggcttattggtttccgtaggattgatagactacaggaatgagacagggggaagtt

SEQ ID NO: 40273 - DNA, 75 bp, Artificial Sequence
  Synthetic
ctgtagttgtaaatccggcttcccaagggtggagtctatcaaattggttcaatggttttatatcatggctaggag

SEQ ID NO: 40274 - DNA, 75 bp, Artificial Sequence
  Synthetic
gccctttaaagggattgctcaaaatcttaggttttttattgttaggcctggcaattggatacattttgtatctta

SEQ ID NO: 40275 - DNA, 75 bp, Artificial Sequence
  Synthetic
tctttaggtacttaattctacacgcactgtccaggaaaaagacaatctaaatctcgctccgcaccaaatcaccgg

SEQ ID NO: 40276 - DNA, 75 bp, Artificial Sequence
  Synthetic
accatcaaaagaagaaaacaaaaccaaaaaaagaaaaaaagagaagagaaaaaagaaagaaaaaagaaaaaagaa

SEQ ID NO: 40277 - DNA, 75 bp, Artificial Sequence
  Synthetic
gaaaagagaggagactggagagaaggaagaaaggggaaaagagaaagaacaacagttgggcctgcaatagacaag

SEQ ID NO: 40278 - DNA, 75 bp, Artificial Sequence
  Synthetic
aataaaaagaaggaggaagtggctgagcagttgcttcctcccagaaccgtaatggcacacagaagatggattatg

SEQ ID NO: 40279 - DNA, 75 bp, Artificial Sequence
  Synthetic
tcaactccattgaaagttgaggtgcgattagagtgtttagaattttcttgagattacatctaatagtggaattgc

SEQ ID NO: 40280 - DNA, 75 bp, Artificial Sequence
  Synthetic
aaagttgaggtgcgattagagtgtttagaattttcttgagattacatctaatagtggaattgccggtctttgtgt

SEQ ID NO: 40281 - DNA, 75 bp, Artificial Sequence
  Synthetic
acacaaagaagcccaaactatggaagaaatactaaaaaaacaagtgatcccaactgggacgggattaaacaggcc

SEQ ID NO: 40282 - DNA, 75 bp, Artificial Sequence
  Synthetic
agagttgaaacattttgatgacacaataatggatgttgagatccctttctttcacataacgaagtgtgacggttt

SEQ ID NO: 40283 - DNA, 75 bp, Artificial Sequence
  Synthetic
catgagaatagatctagatttaaatagtggtgttgattactcaacggtgggatcatcattgaatgccgttattga

SEQ ID NO: 40284 - DNA, 75 bp, Artificial Sequence
  Synthetic
ggtgccagataaatcactgcctaatttaatacatgatgttgtgttttctcatttggctgacactactgatactca

SEQ ID NO: 40285 - DNA, 75 bp, Artificial Sequence
  Synthetic
attttctgaaaaatttggagtgagatctgatacgtatgatcacttatcaccagatataataatcaagactgctgc

SEQ ID NO: 40286 - DNA, 75 bp, Artificial Sequence
  Synthetic
tggctcttattatgtagtagaattcactacaaacagaggtggtgaaagagcagcaatgcaatcttgcagagacaa

SEQ ID NO: 40287 - DNA, 75 bp, Artificial Sequence
  Synthetic
attttccaaataccacattccatgtgagaatagagcagtggattgcagagtgagcttgtttgtgatatcagtgca

SEQ ID NO: 40288 - DNA, 75 bp, Artificial Sequence
  Synthetic
ttctagaggagtgtggactaatctggacatctctgatgatgattgcaatgagatggtgttcagattcagattagc

SEQ ID NO: 40289 - DNA, 75 bp, Artificial Sequence
  Synthetic
tgtttcgataatggaggaagcaaaaaagtattatcctgaactaagtggagatgagactgaattgaccaaacatga

SEQ ID NO: 40290 - DNA, 75 bp, Artificial Sequence
  Synthetic
gagagaaattctcggtgttatttcctcaattcaaatggattgggagaaaaccactagtgtgttcccatacttcaa

SEQ ID NO: 40291 - DNA, 75 bp, Artificial Sequence
  Synthetic
agaagaggtattccagaagttcttgactaccccagctaatgaagagtatctgtcttccataatctctgaggaaat

SEQ ID NO: 40292 - DNA, 75 bp, Artificial Sequence
  Synthetic
caaaagttgtcaagatgatatgattcattcagcattcataggcaccgcctcaggaatagaagaaaagcttgaact

SEQ ID NO: 40293 - DNA, 75 bp, Artificial Sequence
  Synthetic
gaatttggatgaatgtgtgctggctatcaatgattatgcttctaaacgtcctgagaaggttcgcggaactcttga

SEQ ID NO: 40294 - DNA, 75 bp, Artificial Sequence
  Synthetic
gagcaaatcaactgtccaaattcctccttggctgatcacagaatacgatgaaggtaagtcagtatcttgcctctc

SEQ ID NO: 40295 - DNA, 75 bp, Artificial Sequence
  Synthetic
agatgtagaaattctgggagaacacccaatgtccaaaatttggagagcagtgactgtttctgcttctattgggga

SEQ ID NO: 40296 - DNA, 75 bp, Artificial Sequence
  Synthetic
cattgacagggcagacgatgatcctgaacaagaatatgtgagagccttagagggtagcatagaaaagagtgatga

SEQ ID NO: 40297 - DNA, 75 bp, Artificial Sequence
  Synthetic
gcgaagcagataccatagggttaagttacatttagataatgaagagattatttacagtgcatgccttggtgtgga

SEQ ID NO: 40298 - DNA, 75 bp, Artificial Sequence
  Synthetic
gggcaaatcgcacaaaaacaattctcaagtggaagaagcaagggagagaagcaagttaggattttcattagatca

SEQ ID NO: 40299 - DNA, 75 bp, Artificial Sequence
  Synthetic
tgatatctctaatctggaagactttatatctaagcatgacttacccatgtttgaggaatctgaagactatttcaa

SEQ ID NO: 40300 - DNA, 75 bp, Artificial Sequence
  Synthetic
tccattcagtatagatcttgagttaagagagtctgctcagaagattcatcaacctgatctagttcaagactgtgg

SEQ ID NO: 40301 - DNA, 75 bp, Artificial Sequence
  Synthetic
aggaaatgaatttctagaaaatcatagaaagtttctcagctccaagctgggatcttggtgccagatggtctcact

SEQ ID NO: 40302 - DNA, 75 bp, Artificial Sequence
  Synthetic
aataggagcagagctgtctgcctcagtgaaacaacacgtgggtcctggtcaatttgtcattaagagattgcttaa

SEQ ID NO: 40303 - DNA, 75 bp, Artificial Sequence
  Synthetic
ctctcctttatttatgcttataaagccaacttcatcagttagccacatttttgtttcttttggtgtcttgaagag

SEQ ID NO: 40304 - DNA, 75 bp, Artificial Sequence
  Synthetic
ctatcacatgggcaatctatgggatgatggggtcttcaagcattacattgatgccggagacatgctaatcacaga

SEQ ID NO: 40305 - DNA, 75 bp, Artificial Sequence
  Synthetic
ttttgtttcttacaagttgagtaagttaaccaatttgtgcaagtgcttcccattaatggaaagtgcgctttgctt

SEQ ID NO: 40306 - DNA, 75 bp, Artificial Sequence
  Synthetic
ctggacagaggtttttggatttgaaccatggaatgctgttgatgtcttatccaaagataggagtggaagttctaa

SEQ ID NO: 40307 - DNA, 75 bp, Artificial Sequence
  Synthetic
ggaagcagccaccatggtgaagctaacattgttaacactcatggaagacaaggcaaccacagaggaaatacaaac

SEQ ID NO: 40308 - DNA, 75 bp, Artificial Sequence
  Synthetic
gctccagagatatgttgtgatggaaggatttgtttcatcacctgaattacccaaacctcataagatgttatctaa

SEQ ID NO: 40309 - DNA, 75 bp, Artificial Sequence
  Synthetic
gctaccatctgtacttaggtctgaacttcaagtttatctattgaacaggtgtttaagaactatggaaaccatagc

SEQ ID NO: 40310 - DNA, 75 bp, Artificial Sequence
  Synthetic
taggaatccatttaggctacagaagaaatcaggccagatctcttggtctggattattcaacccattaacagggaa

SEQ ID NO: 40311 - DNA, 75 bp, Artificial Sequence
  Synthetic
ttcattaagagatttgcagccactgattagcgtatgttataatggttatttcaagaacaaagaagaagaaacaga

SEQ ID NO: 40312 - DNA, 75 bp, Artificial Sequence
  Synthetic
accatcagccctatcaaggttatacaaaaagataatcgagctagagcacctttgcccggatgatgacacttattt

SEQ ID NO: 40313 - DNA, 75 bp, Artificial Sequence
  Synthetic
gggtgaaggtgaccctattaaccctaagactcatgagttcagtagatcatttctgaagaaatgtactgatcatgg

SEQ ID NO: 40314 - DNA, 75 bp, Artificial Sequence
  Synthetic
aaaaactgtgctgaggaaggtttatggtcataactttatgcagcaaatcgacactcaaattgtgagggaaattag

SEQ ID NO: 40315 - DNA, 75 bp, Artificial Sequence
  Synthetic
ctctataactttagagaggctggccacattaaaagctagtagcaattttgacgagtcatggtataattattcaaa

SEQ ID NO: 40316 - DNA, 75 bp, Artificial Sequence
  Synthetic
tagaccagatagggattatcatagggagaaagcaattgttaagatgtccaaatttgcagcaaatggtaagacact

SEQ ID NO: 40317 - DNA, 75 bp, Artificial Sequence
  Synthetic
agcaatagaagtgtttgatgagagtatgaaacttattgaaaatcgtggaaacatgcatatttgcctattcaagaa

SEQ ID NO: 40318 - DNA, 75 bp, Artificial Sequence
  Synthetic
acaacaacatggtggggatagggagatatatgtgcttggtccggaagagagaattgttcaatcagtagtcgaagc

SEQ ID NO: 40319 - DNA, 75 bp, Artificial Sequence
  Synthetic
aatttcacgatcagtaggaagattttttgcatcagacaccttgtgtaaccctagtaacaagatgaagattccaga

SEQ ID NO: 40320 - DNA, 75 bp, Artificial Sequence
  Synthetic
atcccatggaatcagagccagaaagcactgcaagggtccagtctggacatgttcaacttctgatgatgccaagaa

SEQ ID NO: 40321 - DNA, 75 bp, Artificial Sequence
  Synthetic
atggaaccaaggacactttgtcacaaaattcgcattaatgctgtgtgaattcactcttcccaagtggtggcctat

SEQ ID NO: 40322 - DNA, 75 bp, Artificial Sequence
  Synthetic
aataattagagggtgctccatgttcacgaacaaatacatgatgatgaacttaagatatatagagatcttgagtgg

SEQ ID NO: 40323 - DNA, 75 bp, Artificial Sequence
  Synthetic
acaccaggaattaaatgttcaagatgaattttctagtttaatctttaaggcttaccatggggagtgtgtcgtgcc

SEQ ID NO: 40324 - DNA, 75 bp, Artificial Sequence
  Synthetic
atggatggacagtggttgtacctatctgaaaactaagacaggaatgatgcagggcatattgcactacacttcatc

SEQ ID NO: 40325 - DNA, 75 bp, Artificial Sequence
  Synthetic
acttctgcacactctccaccaggaattcataagatcactgacatttaaggtcttcaacagtaaagtgcagccaga

SEQ ID NO: 40326 - DNA, 75 bp, Artificial Sequence
  Synthetic
gatgtctcaatctatcgtggtggacatgatgcaaggatcagatgatagtagcatgatgatcagtttcccttgttc

SEQ ID NO: 40327 - DNA, 75 bp, Artificial Sequence
  Synthetic
tgatgagactctcatgatgaaatgcaaaattgctgctgccatctgcttcaggatgaaaaagagattaggagtttt

SEQ ID NO: 40328 - DNA, 75 bp, Artificial Sequence
  Synthetic
cttaggcatatatccgtctgaaaaatcaacatccaatacagacttcgtgatggagtacaattcagagttcttctt

SEQ ID NO: 40329 - DNA, 75 bp, Artificial Sequence
  Synthetic
tcattctcaacacgtgaggccaactgtgaggtgggtggccgcatgctgcaatctcccagaggtggagactttagt

SEQ ID NO: 40330 - DNA, 75 bp, Artificial Sequence
  Synthetic
tgccaggcaagaagaagcttctaatttaatgacttctatatctgaaggaggaggatcattttcattatcagcatg

SEQ ID NO: 40331 - DNA, 75 bp, Artificial Sequence
  Synthetic
tatacagcaggcccagtgtacgctacactacatgctgatgggaatggggatcagttctctatttgcccagttcaa

SEQ ID NO: 40332 - DNA, 75 bp, Artificial Sequence
  Synthetic
aaaggcaatcatcaagtggaaggacccaggccttggcttctttctgttggataacccttactgcgctgggctggg

SEQ ID NO: 40333 - DNA, 75 bp, Artificial Sequence
  Synthetic
tgggtttagatttaatctttacaaagccataacaaccacttctctaaaagggctgtattcttacttcatgaagaa

SEQ ID NO: 40334 - DNA, 75 bp, Artificial Sequence
  Synthetic
agtcaaacaaggtagccccagtcatgagggagctttacctgagagttgctcagtgagccctggaggtgctattgt

SEQ ID NO: 40335 - DNA, 75 bp, Artificial Sequence
  Synthetic
actcagttcagctcttagatgggggtcaaaacagaagttctttaaattgagagataagttgaatatacctgaaga

SEQ ID NO: 40336 - DNA, 75 bp, Artificial Sequence
  Synthetic
ctggattgatcagattaatgagaatccttctgtgttgtatagggcacccaagaccggagaagaagtcatactgag

SEQ ID NO: 40337 - DNA, 75 bp, Artificial Sequence
  Synthetic
aatagcagaaaaagtgcacagtcctggggtggtgtcatctttatcaactggcaatgctgttgctaaagtaatatc

SEQ ID NO: 40338 - DNA, 75 bp, Artificial Sequence
  Synthetic
atcatcagtctacttcttgagtgctgctatatttcaagactcaggaaagcaagagtattctatacttgaccaatc

SEQ ID NO: 40339 - DNA, 75 bp, Artificial Sequence
  Synthetic
aaaatatagcttgttgcaaaaactgcataaatttgagggcatcaatctcagaaatgccataagtgacgaagactt

SEQ ID NO: 40340 - DNA, 75 bp, Artificial Sequence
  Synthetic
gctgttcttatttcctaacatagaagacctacagtctttggacagtttggtatacaacaggggagctattgaaat

SEQ ID NO: 40341 - DNA, 75 bp, Artificial Sequence
  Synthetic
agtgagaaggaaacacaacagagaaaacactcagacgagagtcaccgtatttgaaggaaatagaaatctaagaac

SEQ ID NO: 40342 - DNA, 75 bp, Artificial Sequence
  Synthetic
acctgcagaatacctgatctctgacaaatggtttggtacccagaaaagcaaaataggaagaacagctttcgatca

SEQ ID NO: 40343 - DNA, 75 bp, Artificial Sequence
  Synthetic
ggaatgggacaaagtgacatcaataattccttggttgtcagaaagtcctaatgagactctagataagtcaccatt

SEQ ID NO: 40344 - DNA, 75 bp, Artificial Sequence
  Synthetic
aaacaaccacatacagatcagaaatttcttctctagaatggatcagaaaccaagggttgtcagagtgacaggtgc

SEQ ID NO: 40345 - DNA, 75 bp, Artificial Sequence
  Synthetic
cccagtcaaaaaaagatctggggttagtaaattatctatggttattagagataatttcactaagcttgggtatgt

SEQ ID NO: 40346 - DNA, 75 bp, Artificial Sequence
  Synthetic
gaaggacattgaagacatcacaggagctagcaggacagcagcagcagaaatgttgaagcacttcctattttgtgc

SEQ ID NO: 40347 - DNA, 75 bp, Artificial Sequence
  Synthetic
cttgcaggggccatatactcaagaaaaaaagctacagttagccctaaaaatcattgagagctccaatcctatagg

SEQ ID NO: 40348 - DNA, 75 bp, Artificial Sequence
  Synthetic
cataaaagacagtgacgggaagtcaagatctaatgttctagccatcttgcaaaattatgtgtttggcgatagaca

SEQ ID NO: 40349 - DNA, 75 bp, Artificial Sequence
  Synthetic
gattgctagacaaattgaagaagctggagctggcactatagggggcttcacagttcctcagcagcctaagaaaat

SEQ ID NO: 40350 - DNA, 75 bp, Artificial Sequence
  Synthetic
agaagacaccgtttattattatggacctggtgtttggagaggggtcatggatggaaagcaggtgcaaatagaatt

SEQ ID NO: 40351 - DNA, 75 bp, Artificial Sequence
  Synthetic
ggacaactccattggtaacccaccctgcataacatctgtgacaatggaggagtcagcagagccatggcagatctg

SEQ ID NO: 40352 - DNA, 75 bp, Artificial Sequence
  Synthetic
tagaagtattagactctgggctgaagatatgggggcaaagaacaacatagacatgtcgaagaaagttgtcaagaa

SEQ ID NO: 40353 - DNA, 75 bp, Artificial Sequence
  Synthetic
ttgcaagtattggatgtttgacttcaagacatatagtgcagataaggcctacggggtgccagtatacatgtccag

SEQ ID NO: 40354 - DNA, 75 bp, Artificial Sequence
  Synthetic
caagaagatggtggatttcagattagtaagggactcagacatagatattaaggtgaggaagtccacaatcaattt

SEQ ID NO: 40355 - DNA, 75 bp, Artificial Sequence
  Synthetic
gtttataaagaatgatggaagagatgtacatattctgtcttacacagcaagtgattctgatcttagtccagccag

SEQ ID NO: 40356 - DNA, 75 bp, Artificial Sequence
  Synthetic
tttgaaaagcaccagtcaggtaaaggatgaaatgatggcattgttttctagagagcctagcaaatcatgggcttc

SEQ ID NO: 40357 - DNA, 75 bp, Artificial Sequence
  Synthetic
ttgtgccccaataccctacttcatcgtccacaaaatccttcaggtgaccacaggtgagctaacaatagagtactt

SEQ ID NO: 40358 - DNA, 75 bp, Artificial Sequence
  Synthetic
agaaagggaaagactgtctgaaattatcaagttgtgctgtgaatcatcattaaggtcaagagttggaacaatttt

SEQ ID NO: 40359 - DNA, 75 bp, Artificial Sequence
  Synthetic
ctccccattgccttcggtgagggagggtagaactcaagtggatgttgaagacctgattgacattgtcttgacgga

SEQ ID NO: 40360 - DNA, 75 bp, Artificial Sequence
  Synthetic
tcttaagagtaataattttggtgaaattgtgaagtccttagaaaacgatctaaaagaagagtacgactttgagga

SEQ ID NO: 40361 - DNA, 75 bp, Artificial Sequence
  Synthetic
ttttgactactcagatattgatttgtttggacctgcacattataaagagttgtcagacttaaccaccattagcca

SEQ ID NO: 40362 - DNA, 75 bp, Artificial Sequence
  Synthetic
cccattaatggatgactttgttgaattctgcatcatgtcaataggaaggagggaaataaggcgactattggagca

SEQ ID NO: 40363 - DNA, 75 bp, Artificial Sequence
  Synthetic
cggaaggtgcaaaaccaaagatctgaagcttgctgaagatttgtttatctctctcagacgtgacataagaaccat

SEQ ID NO: 40364 - DNA, 75 bp, Artificial Sequence
  Synthetic
cagtgttgatgattactctcaaagagaggaagaatttgtggaagatgacatgattggttaaagccttaatcctaa

SEQ ID NO: 40365 - DNA, 75 bp, Artificial Sequence
  Synthetic
tttaagtgagacacaaagaattaaaccatattggacactcaacttaatgtgtaaacccgagttagacattaatgt

SEQ ID NO: 40366 - DNA, 75 bp, Artificial Sequence
  Synthetic
ttggacactcaacttaatgtgtaaacccgagttagacattaatgtaaagtgttcagataagggcggtctttgtgt

SEQ ID NO: 40367 - DNA, 75 bp, Artificial Sequence
  Synthetic
tatcttgtttatccaggatttgaagtagagggagatcacccaatgtgcaaacacaaagaagcccaaactatggaa

SEQ ID NO: 40368 - DNA, 75 bp, Artificial Sequence
  Synthetic
acacaaagaagcccaaactatggaagaaatactaaacaaacaacaaatccccgagggggtaggattgtttaggcc

SEQ ID NO: 40369 - DNA, 75 bp, Artificial Sequence
  Synthetic
agaaataaagcaatacgatgattctatcatggatgtcgagataccattctttcacataactaagtgtgatggata

SEQ ID NO: 40370 - DNA, 75 bp, Artificial Sequence
  Synthetic
tatgaagatagatttggacctgaataatggtgttgattattcaactattgggtcatcattattatccaccattga

SEQ ID NO: 40371 - DNA, 75 bp, Artificial Sequence
  Synthetic
agttccagataaatctcttcctaatcttgttcatgatgtagtcttctcacatctagctagtagcactgatgtgag

SEQ ID NO: 40372 - DNA, 75 bp, Artificial Sequence
  Synthetic
gttttcatcagtgtttggtgtatttgcagattcttatgaccacttatcacctgactttattctgaagacagctgc

SEQ ID NO: 40373 - DNA, 75 bp, Artificial Sequence
  Synthetic
tggatctcatcatgtagttgaattcacgactaatagaggcggagagaggggggcttttcaggcgtgcaaagacaa

SEQ ID NO: 40374 - DNA, 75 bp, Artificial Sequence
  Synthetic
gttctctaaataccacattccgtgtgaaaatagagctgtcggaggcagagtttctctttttgtaatttctgtgta

SEQ ID NO: 40375 - DNA, 75 bp, Artificial Sequence
  Synthetic
tgttagaggggtatggtcaaatcttgatttaactgacgatgaagttaatgagcttgtgtttagattcaggctggc

SEQ ID NO: 40376 - DNA, 75 bp, Artificial Sequence
  Synthetic
tgtagccataatggaggaagcaaagagatactatcctgaactcacagaagatgaaagtgagatgacaaagcaaga

SEQ ID NO: 40377 - DNA, 75 bp, Artificial Sequence
  Synthetic
gagagagattctcggtattgtatcttcaatacaaatggactggaaggagactagcttgaaatttccgcacttcag

SEQ ID NO: 40378 - DNA, 75 bp, Artificial Sequence
  Synthetic
agagaaagtgtttgaagattttctaacaatgtctgcagatgaagaatatctctcaggtataatttctgaagaaat

SEQ ID NO: 40379 - DNA, 75 bp, Artificial Sequence
  Synthetic
cactgcatgtcaagaggacatgatggagtcaggattcattgggaaagtgacaggcatagatgagaagcttaaact

SEQ ID NO: 40380 - DNA, 75 bp, Artificial Sequence
  Synthetic
gaatgaattagaatgcaataaaatgattgacagttatctaaagagtagaggaaccgattgcagagaaaagttaga

SEQ ID NO: 40381 - DNA, 75 bp, Artificial Sequence
  Synthetic
cagtaaatccacagtccagatcccaccatgggtgatgactgagtacctagatgggaaatcagtatcttgtttatc

SEQ ID NO: 40382 - DNA, 75 bp, Artificial Sequence
  Synthetic
aggatttgaagtagagggagatcacccaatgtgcaaaatatggagatctgtcacaatcgcagctgctatgggtga

SEQ ID NO: 40383 - DNA, 75 bp, Artificial Sequence
  Synthetic
tatagaccgtgctgatgatgaccctaaaactgagctcaagaaggccttagaaggcagtatacaaaagagtgatga

SEQ ID NO: 40384 - DNA, 75 bp, Artificial Sequence
  Synthetic
gagaagtagatatcatcgtataaaactaaatctgtctaatgaagagatagtttatggtgcaactctgggtgttga

SEQ ID NO: 40385 - DNA, 75 bp, Artificial Sequence
  Synthetic
aggaaaatctcacaaaaacaatgctcaagtcgaagaatcaaggacgaggagcaaattaggattttctcttgacca

SEQ ID NO: 40386 - DNA, 75 bp, Artificial Sequence
  Synthetic
cgacattacaaatttggaagaattcattaataaacatgatcttgaattatttgcagagtctgatgactatttcaa

SEQ ID NO: 40387 - DNA, 75 bp, Artificial Sequence
  Synthetic
cccctttcagattgactttgacctgagagagtcagctcaaaaaatacaccagccagatctcatcatggatcaagg

SEQ ID NO: 40388 - DNA, 75 bp, Artificial Sequence
  Synthetic
cgaaaatgagtttttagcaaatcacaagaaattatgtatgtcaaagctaggctcttggtgccaaatggtgtcact

SEQ ID NO: 40389 - DNA, 75 bp, Artificial Sequence
  Synthetic
gattggtgctgagttgtcagcatcagttaaacagcatgtggggaaaagccagtttgtgatcaaaagagtcttaaa

SEQ ID NO: 40390 - DNA, 75 bp, Artificial Sequence
  Synthetic
ctcacctctcttcatgctaatcaaacctacatcttctgttagtcacatttttgtttcttttgcacttgtaaaatc

SEQ ID NO: 40391 - DNA, 75 bp, Artificial Sequence
  Synthetic
tagtcacatgggagatttgtgggacagtggcgtcttcaagcattatatcgatgcaggggacttattcatcactga

SEQ ID NO: 40392 - DNA, 75 bp, Artificial Sequence
  Synthetic
ctttatttcttataagctgagcaagctgaccaacctctgcaagtgcttccctcttatggagagtgcaatctgctt

SEQ ID NO: 40393 - DNA, 75 bp, Artificial Sequence
  Synthetic
ttggaccgaaatttttggttttgagccttggaactccacatatataatgtcaactgacagaagtgggagttcaaa

SEQ ID NO: 40394 - DNA, 75 bp, Artificial Sequence
  Synthetic
agaggcagcatcgatgatcaaattaactctattaacacttatggaagataaagcagtcactgaagagattcagac

SEQ ID NO: 40395 - DNA, 75 bp, Artificial Sequence
  Synthetic
tattcaaagatatataattatggaagggtttgtttctttaccagagttgccaaaaccacataagatgttgtctaa

SEQ ID NO: 40396 - DNA, 75 bp, Artificial Sequence
  Synthetic
gctgccagctgtactgaggtcagagctgcaggtttatctagtcttaaggtctctaagaacaatggagaggatatc

SEQ ID NO: 40397 - DNA, 75 bp, Artificial Sequence
  Synthetic
aagacatccttttagactacagaaaaaacatagccagatctcctggtcagggttgtttaatcctctaactggtaa

SEQ ID NO: 40398 - DNA, 75 bp, Artificial Sequence
  Synthetic
ttcccttagggagttgcaaccactaattagcatatgctataacggatacttcaaaaataaagaagaagaaactga

SEQ ID NO: 40399 - DNA, 75 bp, Artificial Sequence
  Synthetic
accctctgctttgtcaagactatacaagaagattatagaactggaacatctgtgtccaactaacgatatctatct

SEQ ID NO: 40400 - DNA, 75 bp, Artificial Sequence
  Synthetic
aggatcgggtgatccaaaagaaccaaagatgcatgaatttagcaggtcatttctaaaaaaatgcactgatcatgg

SEQ ID NO: 40401 - DNA, 75 bp, Artificial Sequence
  Synthetic
aaagaccatactgagaaagatctatgggcaaaactttatgcagcagatagacactcaaattatgagagagattag

SEQ ID NO: 40402 - DNA, 75 bp, Artificial Sequence
  Synthetic
cacaatcactcttgagaagctggcaacattaaaggctagcagtaattttgatgagaagtggtatgattatgaaaa

SEQ ID NO: 40403 - DNA, 75 bp, Artificial Sequence
  Synthetic
atgcagtaaagaagattatcatcgtgagaaagcaattgttaagatgtctgaatttgctgcatctggaaagacatt

SEQ ID NO: 40404 - DNA, 75 bp, Artificial Sequence
  Synthetic
agctatagaagtttttgatgaatgcatgaaatttgtggaaagaagaggaaacatgcacatctgcctctttaagaa

SEQ ID NO: 40405 - DNA, 75 bp, Artificial Sequence
  Synthetic
acaacagcatggtggagatagggagatttacgtcctgggcagagaagaaagaataatccaatctatagtcgaggc

SEQ ID NO: 40406 - DNA, 75 bp, Artificial Sequence
  Synthetic
aatatctaggtcaattggtaggttctttccatcagatactctgtgtaatcctggtaataagattaaaatacctga

SEQ ID NO: 40407 - DNA, 75 bp, Artificial Sequence
  Synthetic
aacacacgggatacgagctagaaagcactgtaaaggtgctgtgtggacttgttccacatctgatgatgctaggaa

SEQ ID NO: 40408 - DNA, 75 bp, Artificial Sequence
  Synthetic
atggaatcaaggtcattttgttacaaaatttgctttaatgttatgtgaattcacccttcctaaatggtggccaat

SEQ ID NO: 40409 - DNA, 75 bp, Artificial Sequence
  Synthetic
catcattaggggctgctctatgtttaccaacaagtatatgatgatgaatatgaggtatattagtattctaagcag

SEQ ID NO: 40410 - DNA, 75 bp, Artificial Sequence
  Synthetic
gcacaaagaattgaatattgaagacgagttttctagaactatattcaaagcctttcatggtgaagttacagtgcc

SEQ ID NO: 40411 - DNA, 75 bp, Artificial Sequence
  Synthetic
atggatggatgcaggggccactttcttaaaaacaaaaacaggaatgatgcaaggcatattgcattttacttcatc

SEQ ID NO: 40412 - DNA, 75 bp, Artificial Sequence
  Synthetic
tctcttacacacactacaccaggagttcattaggtcattatcgtttaaaatctttaacactaaggtgaggccaga

SEQ ID NO: 40413 - DNA, 75 bp, Artificial Sequence
  Synthetic
gatgtcacaatcagttgtgattgatatgatgcagggctccgatgacagtagtatgatgatcagcttcccatgctc

SEQ ID NO: 40414 - DNA, 75 bp, Artificial Sequence
  Synthetic
taatgaagatgaactaatgaagtgtaagatagctgctgctatttgctttaggataaagaaaagattaggagtttt

SEQ ID NO: 40415 - DNA, 75 bp, Artificial Sequence
  Synthetic
cctagctatttatccttcagagaaatccacttctaacactgattttgtaatggaatacaattcagaattcttctt

SEQ ID NO: 40416 - DNA, 75 bp, Artificial Sequence
  Synthetic
ccactctcagcacgtccgtccgacagttagatggatagctgcatgctgtaaccttccagaagtggagactctagt

SEQ ID NO: 40417 - DNA, 75 bp, Artificial Sequence
  Synthetic
tgccagacaagaagaggcctctaatctaatgacctctgtatcagaaggagggggctctttttctttgtcggcttg

SEQ ID NO: 40418 - DNA, 75 bp, Artificial Sequence
  Synthetic
catccagcaggctcaatgcactctgcattatatgttaatggggatgggagttagttcattgtttgaggagtataa

SEQ ID NO: 40419 - DNA, 75 bp, Artificial Sequence
  Synthetic
gaaggcaattatccggtggaaggatcctggtctaggtttcttcttgctagacaatccttattgcgcaggattagg

SEQ ID NO: 40420 - DNA, 75 bp, Artificial Sequence
  Synthetic
aggatttaggtttaacttgtataaagctattgcccagacaccactaaagtgcctttattcatacttcatgaagaa

SEQ ID NO: 40421 - DNA, 75 bp, Artificial Sequence
  Synthetic
ggttagacacgggttagagactaatgatggaacaattccagagagctgctcagtcagtccaggtggtgccattgt

SEQ ID NO: 40422 - DNA, 75 bp, Artificial Sequence
  Synthetic
gttaagttctgctcttagatggggctcaaaacagaagttttataaacttagagacaagttgaatatccctgaaga

SEQ ID NO: 40423 - DNA, 75 bp, Artificial Sequence
  Synthetic
ttggattgatcagattaatcaaaatccgtccatattatacagagctcccagatctggtgaagaagtcattcttag

SEQ ID NO: 40424 - DNA, 75 bp, Artificial Sequence
  Synthetic
gattgctgaaaaggtgcattcacctggggttgtttcttctttgtcaacaggcaatgcagtggccaaagtgattgc

SEQ ID NO: 40425 - DNA, 75 bp, Artificial Sequence
  Synthetic
ttcatctgtatatttcttaagtgcagccatattccaagattctggtaggcaagaattctctattctagatgactc

SEQ ID NO: 40426 - DNA, 75 bp, Artificial Sequence
  Synthetic
aaagtacagcttactacaaaagctgagcaagctcgaaggaattaatctaaccaatgcaatcagtgatgaagactt

SEQ ID NO: 40427 - DNA, 75 bp, Artificial Sequence
  Synthetic
actattcttattcccaaacattgaagatctacagtctcttgacagtttagtgtacaatcgaggagctattgagat

SEQ ID NO: 40428 - DNA, 75 bp, Artificial Sequence
  Synthetic
tgtaaagagaaaacaaataaaagagaatacacagtctagagtaatagtctttgaaggaaatagaaatctcagaac

SEQ ID NO: 40429 - DNA, 75 bp, Artificial Sequence
  Synthetic
ccccgcagagtatttgataagtgacaaatggtttgggacccagaaaagtaaaattggaagaacagcatttgacca

SEQ ID NO: 40430 - DNA, 75 bp, Artificial Sequence
  Synthetic
agaatgggctaaggtcacatcaatcatcccctggctaagggagagtccacaagaaacccttcagagctctccact

SEQ ID NO: 40431 - DNA, 75 bp, Artificial Sequence
  Synthetic
atcccctggctaagggagagtccacaagaaacccttcagagctctccactggacaatcacatccaaataagaaat

SEQ ID NO: 40432 - DNA, 75 bp, Artificial Sequence
  Synthetic
caagagtagttagagttacaggtgcgccaataaagaaaaggtcaggtgtcagtaaattgtcaatggtcataaggg

SEQ ID NO: 40433 - DNA, 75 bp, Artificial Sequence
  Synthetic
ataacttctcaaagttaggattcattagggatatagaagacataacagggacaagcagaacaaattctgccgagt

SEQ ID NO: 40434 - DNA, 75 bp, Artificial Sequence
  Synthetic
tgctcaaacactttatgttctgtgccctacaaggtccatactctcaggaaagaaagctccaaatggtgatagacc

SEQ ID NO: 40435 - DNA, 75 bp, Artificial Sequence
  Synthetic
tactgaataagtcaaatcctataggcatcaaggacagtgatggaaaatcacgatcaaacattttggcaattttac

SEQ ID NO: 40436 - DNA, 75 bp, Artificial Sequence
  Synthetic
agagctatgtatatagagagccacatattgcacgacaaattgaagatgctggtgctggcattatcggaggatttg

SEQ ID NO: 40437 - DNA, 75 bp, Artificial Sequence
  Synthetic
tggtcccacaaaaaccaaaaaagattgaaaacacagtatattattatggttatggcgtatggaggggggtgatgg

SEQ ID NO: 40438 - DNA, 75 bp, Artificial Sequence
  Synthetic
atggaaagcaggtgcaaattgagcttgacaatgcagtgggcagccctcctgttataatctctgttactatggaag

SEQ ID NO: 40439 - DNA, 75 bp, Artificial Sequence
  Synthetic
agtctgctgagccctggcaaatatgcaagagcataaggtcttgggctgaagatgtgggtgcaaagaataatctgg

SEQ ID NO: 40440 - DNA, 75 bp, Artificial Sequence
  Synthetic
atatatcttcaaagataaagaaaagaacttgcaaatactggatgtttgattttaaaacgttctcttcagacaagg

SEQ ID NO: 40441 - DNA, 75 bp, Artificial Sequence
  Synthetic
catatggtgctcccgtctacatgacgaagaagaaaatggttgatttcaggctaattgacgatgcagagataagca

SEQ ID NO: 40442 - DNA, 75 bp, Artificial Sequence
  Synthetic
taaaagttaggaaatctactgtgaatttgtatgttagaaatgatggaagagatgttcacatactctcttactcag

SEQ ID NO: 40443 - DNA, 75 bp, Artificial Sequence
  Synthetic
catcagattcagatcttagtcctgcaagcctgaggatcaatgatgagtccaaggatgaaatgatggagttgttca

SEQ ID NO: 40444 - DNA, 75 bp, Artificial Sequence
  Synthetic
ataaagagcctagtaagtcctgggcatcatgctcacctatcccggctatcatgatgcataagatcattaaagttg

SEQ ID NO: 40445 - DNA, 75 bp, Artificial Sequence
  Synthetic
tccaaggagagctcaaaatatcatcactagacagtagcagattgggagagatcatgaaattgtgctgtgaatcat

SEQ ID NO: 40446 - DNA, 75 bp, Artificial Sequence
  Synthetic
cattacgatctaggattgggactttgttttctgcccttccaagtgtgcaaaatacctccagagttgatgttgatg

SEQ ID NO: 40447 - DNA, 75 bp, Artificial Sequence
  Synthetic
acttgatagatattgttctgactgactcaaagacagccggctttagagaaattgtgcagtcactggagaatgaca

SEQ ID NO: 40448 - DNA, 75 bp, Artificial Sequence
  Synthetic
taaaagatgagtacgaagtggaagattttgacttgtctgatatagatttattcggaccggcacattataaagaac

SEQ ID NO: 40449 - DNA, 75 bp, Artificial Sequence
  Synthetic
tgtcagacctaaacactataagtcatcccttaatggacgactatgtggagttctgtatatcgacaattggtcgaa

SEQ ID NO: 40450 - DNA, 75 bp, Artificial Sequence
  Synthetic
aagaattgagacgaatattggagactaacaaatgtaaaactaaagacttacaattatctaaggatctctttttag

SEQ ID NO: 40451 - DNA, 75 bp, Artificial Sequence
  Synthetic
tactaggcaggaatccagatgatattaaagtggatgaatacaacttaagagagcaaatggcagtggaagacgata

SEQ ID NO: 40452 - DNA, 75 bp, Artificial Sequence
  Synthetic
tgataggataaaatcctacaatatgtcattaggtgtgaacacaaagtctcctcataattgaacactcttccccaa

SEQ ID NO: 40453 - DNA, 75 bp, Artificial Sequence
  Synthetic
aacactcttccccaagtgagggattggattttaaattattgtaaagtgttcaattatgggcggactttgtgtttc

SEQ ID NO: 40454 - DNA, 75 bp, Artificial Sequence
  Synthetic
acacaaagctcctctaggattgtgaacaagtgaatttttaaaactactaatcgtgatgtcgtttgaagacttggc

SEQ ID NO: 40455 - DNA, 75 bp, Artificial Sequence
  Synthetic
tattgagttggctgggcatgaggtggatgagcaaaccattgcttcttgggtccaagcttttgcgtaccaaggttt

SEQ ID NO: 40456 - DNA, 75 bp, Artificial Sequence
  Synthetic
tgacgcaagaagggtgattgaactcttgaagtctcgcggaggtgatgcctggatggaggacgctaagcaaatgat

SEQ ID NO: 40457 - DNA, 75 bp, Artificial Sequence
  Synthetic
aatcttatgcttaacacgtggtaacaagccaacaaagatgatgactaagatgtcagacaaagggaagaagattgt

SEQ ID NO: 40458 - DNA, 75 bp, Artificial Sequence
  Synthetic
ccaggggctcataaagaaatacaaccttaaagaaggaaacccttctagggatgatctcactttgtcaaggataac

SEQ ID NO: 40459 - DNA, 75 bp, Artificial Sequence
  Synthetic
agctgcattagccggctacacttgtcaagcaaccgaggttgtagaagagtttttacctgttaccgggaggcacat

SEQ ID NO: 40460 - DNA, 75 bp, Artificial Sequence
  Synthetic
ggatggattgtccaaaaattatccaagggccatgatgcatccaagctttgctgggctcattgatccaggacttcc

SEQ ID NO: 40461 - DNA, 75 bp, Artificial Sequence
  Synthetic
tgcggaggtgttagccaccattactgatgctttcagcttgttcatggtgcagttttctagaactatcaacccgag

SEQ ID NO: 40462 - DNA, 75 bp, Artificial Sequence
  Synthetic
aaatcgtggattatccacctcagaagtgttatcaacttttgacagaccaatgaatgctgcaattaacagctcatt

SEQ ID NO: 40463 - DNA, 75 bp, Artificial Sequence
  Synthetic
cttgaccagagatcaaagaaaagcttttctaaaaaatttgggcattctggatggtaacctccagccatctgaaag

SEQ ID NO: 40464 - DNA, 75 bp, Artificial Sequence
  Synthetic
cgttaaagctgccgctaaagcattcagaacggccaagtgagctgccatgttggtttggaatagccaattgattat

SEQ ID NO: 40465 - DNA, 75 bp, Artificial Sequence
  Synthetic
ctgatcgatcccatttccctccccttgtcccttatccactccccaacaaccagaggcagctacgttcagcaggag

SEQ ID NO: 40466 - DNA, 75 bp, Artificial Sequence
  Synthetic
caacatccaccgctttcaaagtctgaatctgtgtcataagtcaggtctcttagggagtcatcccacgttgactga

SEQ ID NO: 40467 - DNA, 75 bp, Artificial Sequence
  Synthetic
ggattccattttttattgcccagcaaagatggagagatcactttgtacaagtccattacgtactggaagagagaa

SEQ ID NO: 40468 - DNA, 75 bp, Artificial Sequence
  Synthetic
gaatggaactcagactcatgataatcataaggtagtgctgtcatcatacgcagcaactgaacatatgcgatttct

SEQ ID NO: 40469 - DNA, 75 bp, Artificial Sequence
  Synthetic
ttctctatattttggccagtaaagttgcctgaaaatatttctctttcagcaagctctacatcaatactcttgtac

SEQ ID NO: 40470 - DNA, 75 bp, Artificial Sequence
  Synthetic
aaatttaccaacgagtcatctatctgctcacctttgccacatctcatgactagtgtggcaaaagcacatttttcc

SEQ ID NO: 40471 - DNA, 75 bp, Artificial Sequence
  Synthetic
tcccagtgatactcatagctgtgaatttgagataacttaaagaatgtgaaagtgggcttcccaagaggccacgaa

SEQ ID NO: 40472 - DNA, 75 bp, Artificial Sequence
  Synthetic
agagcttctctcagattgggttctgaccattttaactgtctgtctaaatttagataggagatcttctccatcgtg

SEQ ID NO: 40473 - DNA, 75 bp, Artificial Sequence
  Synthetic
gtgtcaaaaaatgatggggatgctccctttacttgctggtgagcctgcccccaggataatggtaactcatccctc

SEQ ID NO: 40474 - DNA, 75 bp, Artificial Sequence
  Synthetic
attatgaatgtcgacagcctgtacctaaccttgctgctcaccttgaatgatgtgcatggaaactctgctccctta

SEQ ID NO: 40475 - DNA, 75 bp, Artificial Sequence
  Synthetic
tatctacacactggtgctgagtgatagttgttgaatgccgagtattcaacataaactctattgtagtctgttgca

SEQ ID NO: 40476 - DNA, 75 bp, Artificial Sequence
  Synthetic
ttccttgtgatatgagggaggtcgaaagcgtacctcatcatgttagacattttgtatttagcaaaccagcagatc

SEQ ID NO: 40477 - DNA, 75 bp, Artificial Sequence
  Synthetic
ggtcgaaagcgtacctcatcatgttagacattttgtatttagcaaaccagcagatctcaagaggggactttgtgt

SEQ ID NO: 40478 - DNA, 75 bp, Artificial Sequence
  Synthetic
acacaaagaagcccagaatatggaagaaatattaagtaaacagcaagtccctatggggcaaggtttgaataagcc

SEQ ID NO: 40479 - DNA, 75 bp, Artificial Sequence
  Synthetic
tgagctcattcaatatgatgattccataatagatgtggaaataccatttttccatatcaccaagtgtgatggata

SEQ ID NO: 40480 - DNA, 75 bp, Artificial Sequence
  Synthetic
tatgaaaatcgaccttgaccttgacagcggagtagattactccactgtggggtcatcactaaagtccgtgataca

SEQ ID NO: 40481 - DNA, 75 bp, Artificial Sequence
  Synthetic
tgttccagacaaatctcttgcaaatttgattcacgacatatcatttgctcatctcgcagagagtactgacaccca

SEQ ID NO: 40482 - DNA, 75 bp, Artificial Sequence
  Synthetic
attctctagccaatttggagttaggtcagactcatatgatcacttaactccagatgtgattatcaaaacagcagc

SEQ ID NO: 40483 - DNA, 75 bp, Artificial Sequence
  Synthetic
tggatcattcttcgtaattgagttcacaactaatagaggtggagagagagcagcatttaattcttgcaaggacaa

SEQ ID NO: 40484 - DNA, 75 bp, Artificial Sequence
  Synthetic
attctctaaatatcacatagcttgtgagaacagatcttcagattgtgttgttagtctgtatgtgattagcatata

SEQ ID NO: 40485 - DNA, 75 bp, Artificial Sequence
  Synthetic
tgcacaaggtgtctggtcaaatctccagctaagtgaagatgaagtgaatgagttggtttttagattcaggttagc

SEQ ID NO: 40486 - DNA, 75 bp, Artificial Sequence
  Synthetic
agttgcgattatggaggaagctaagaaattttacccagagctgagtggggatgaaacagatatgaccaaactaga

SEQ ID NO: 40487 - DNA, 75 bp, Artificial Sequence
  Synthetic
aagggaaatgctgggtgtggtgtcatctattcagcttgactggagtgcaaccacgagttcctttccatatttcaa

SEQ ID NO: 40488 - DNA, 75 bp, Artificial Sequence
  Synthetic
agaaaacgtgtttgataagttcttgacagagccttctgatgaagaatacttatctactataatctcttctgagct

SEQ ID NO: 40489 - DNA, 75 bp, Artificial Sequence
  Synthetic
caagaactgccaagaacaactcatgacctcatccttttttgactctgatttgcgtcccgaagacaggatgaaaat

SEQ ID NO: 40490 - DNA, 75 bp, Artificial Sequence
  Synthetic
gaatcttttggagtgtgagcgccacatcaacatgttcaaacaagagttccaaggcccttttagaaacatcaatga

SEQ ID NO: 40491 - DNA, 75 bp, Artificial Sequence
  Synthetic
atccaaatcaacagtgcagatccctccttggttgatgggagaatactatgatggaaaatcagtctctatcttatc

SEQ ID NO: 40492 - DNA, 75 bp, Artificial Sequence
  Synthetic
ggattatgagatagatggagatcatccaatgtgcaatctgtggaggtccttaagtgtgagtgcttcacttggaga

SEQ ID NO: 40493 - DNA, 75 bp, Artificial Sequence
  Synthetic
gattgacagagcagacgatgaccctgatcttgaattaacccaggctctagaaggcactatagagaaaagcgacca

SEQ ID NO: 40494 - DNA, 75 bp, Artificial Sequence
  Synthetic
aaaaagcaaatatcaccgggtcaagttaagagttgatcatcaagatgttatctattatgcaaccttgggagtgga

SEQ ID NO: 40495 - DNA, 75 bp, Artificial Sequence
  Synthetic
ggggaaaactcacaaaaacaacactgtagttgaagaagcacgaaggaggagtaagttggggtttgctttagacca

SEQ ID NO: 40496 - DNA, 75 bp, Artificial Sequence
  Synthetic
caacactgaaggactatcagacttcattaacacctcagacgctcagctattcgagttagatgataatttattttc

SEQ ID NO: 40497 - DNA, 75 bp, Artificial Sequence
  Synthetic
accctttatgatggattatgagcttaggcaagctgcacagaaaatacaccagccggatttgattacagacgtcgg

SEQ ID NO: 40498 - DNA, 75 bp, Artificial Sequence
  Synthetic
tgaaaatgagtttctgaggaatcattgtgattttttgaagacaagactaggctcatggtgtcaaatggtttcttt

SEQ ID NO: 40499 - DNA, 75 bp, Artificial Sequence
  Synthetic
gattggagcagaactgtcagcctctgtcaaacaacatgtgggcccaggacaatatgtgattaagagagttctgga

SEQ ID NO: 40500 - DNA, 75 bp, Artificial Sequence
  Synthetic
ttctccgctattcatgctaataaaacccacatcctcagtgagccacatctttgtgtcatttgctctagttaaaag

SEQ ID NO: 40501 - DNA, 75 bp, Artificial Sequence
  Synthetic
tcatcatttaggagatttatggagtgatggtgtgttcaaacattacatagatgctggtgacctgctaataacgga

SEQ ID NO: 40502 - DNA, 75 bp, Artificial Sequence
  Synthetic
ttttgtttcttataaattaagtaagctaactaacctatgcaaatgctttccattgatggagagcgcatcatgctt

SEQ ID NO: 40503 - DNA, 75 bp, Artificial Sequence
  Synthetic
ctggacagagctgttcggttttgagccttggaggtctagcattatactcgggagagataggagtggtagtgctag

SEQ ID NO: 40504 - DNA, 75 bp, Artificial Sequence
  Synthetic
ggaagcacggtctatgataaaaatgaccttgttaactttaatggaagacaaggccataactgaagaaatccaaac

SEQ ID NO: 40505 - DNA, 75 bp, Artificial Sequence
  Synthetic
aatgcagaggtatgtcattatggaaggattcgtatctacaccagaagtcccaaaacctcataagatgcttggcaa

SEQ ID NO: 40506 - DNA, 75 bp, Artificial Sequence
  Synthetic
gctgcctaaggtgttaagatcggaactccaggtatatttggtgaatcgtgttcttgaaactatgaagatcatatc

SEQ ID NO: 40507 - DNA, 75 bp, Artificial Sequence
  Synthetic
aggtaaaccattcaggcttcaaaagaaaggagggcaaatttcatggtcaggccttttcaaccccataactgggat

SEQ ID NO: 40508 - DNA, 75 bp, Artificial Sequence
  Synthetic
ggacttgaaagatgttcagcctttaataagcatatgttataacggatacttcaagaacaaagaggaggagactga

SEQ ID NO: 40509 - DNA, 75 bp, Artificial Sequence
  Synthetic
accgtcagcattatctaggctatacaaaaaaataattgagttggagcatatgtgccctggcactgatgagaatct

SEQ ID NO: 40510 - DNA, 75 bp, Artificial Sequence
  Synthetic
tggatctggagatcctctaaatccccaaatgcatgaatttagcaggtcgctattgaagaaatgcacagatcatgg

SEQ ID NO: 40511 - DNA, 75 bp, Artificial Sequence
  Synthetic
gaaaactattttaaggagggtttatggacacaactttttgcagcaggttgacgcacagattactagagagatctc

SEQ ID NO: 40512 - DNA, 75 bp, Artificial Sequence
  Synthetic
aacaataactttggagaggctagcaaccttaaaagcaagtagcaactttgatagttcatggtatcaatataaaga

SEQ ID NO: 40513 - DNA, 75 bp, Artificial Sequence
  Synthetic
ctgtgacaaaagagattatcatagagaaaaggcaattgtcaagatgtctaagtttgcatcaacaggaaagacctt

SEQ ID NO: 40514 - DNA, 75 bp, Artificial Sequence
  Synthetic
agcaattgaagtctttgatgactgcatgaaattgattgagtcaagaggcaatatgcacatctgcttgttcaaaaa

SEQ ID NO: 40515 - DNA, 75 bp, Artificial Sequence
  Synthetic
gcagcagcatggaggagatagagaaatttatgtattaggaccagaggaaaggatagtccaatcgattgttgaggc

SEQ ID NO: 40516 - DNA, 75 bp, Artificial Sequence
  Synthetic
catatctagatctattgggaagttttttccatcagatactctttgcaaccccaccaacaagatgaagataccaga

SEQ ID NO: 40517 - DNA, 75 bp, Artificial Sequence
  Synthetic
gactcatggattaagggccaggaaacactgtaagggttctgtttggacctgttccacatcagatgacgcgaaaaa

SEQ ID NO: 40518 - DNA, 75 bp, Artificial Sequence
  Synthetic
atggaatcaggggcattttgtgaccaaatttgctttgatgttatgtgagtttacactgccaaaatggtggcccat

SEQ ID NO: 40519 - DNA, 75 bp, Artificial Sequence
  Synthetic
aatcatcagagggtgtagcatgttcaccaataagtatatgatgatgaatttgaggtacattgacatattgaacag

SEQ ID NO: 40520 - DNA, 75 bp, Artificial Sequence
  Synthetic
acatcaaactattgatgttcaagatgacttttcacaatccattttcaaagcttatcatggtgaaataacagtgcc

SEQ ID NO: 40521 - DNA, 75 bp, Artificial Sequence
  Synthetic
ctggatggatgatgggtgcacttatctgaaaaccaaaacagggatgatgcaaggaattctccattacacgtcatc

SEQ ID NO: 40522 - DNA, 75 bp, Artificial Sequence
  Synthetic
gctgttacacacaatttatcaagagttcttgagatcactgacattcaagatattcaatatgaaagttcacccaga

SEQ ID NO: 40523 - DNA, 75 bp, Artificial Sequence
  Synthetic
aatgtctcagcaaatagtgtgcgacatgatgcagggatctgatgatagtagcatgatgataagctttccatgttc

SEQ ID NO: 40524 - DNA, 75 bp, Artificial Sequence
  Synthetic
agatgagaagttattgatgaaatgcaaaatagcagctgcaatatgcttcagaatgaaaaaaagacttggtgttta

SEQ ID NO: 40525 - DNA, 75 bp, Artificial Sequence
  Synthetic
ccttggcatctatccatctgagaaatcaacacccaatacagacttcgtgatggaatacaattcagagttcttctt

SEQ ID NO: 40526 - DNA, 75 bp, Artificial Sequence
  Synthetic
ccactcacagcatgtgaggccaactatacggtggatagcagcaagctgcaacctgcctgaagttgaaactttggt

SEQ ID NO: 40527 - DNA, 75 bp, Artificial Sequence
  Synthetic
agccaggcaagaggaagcctctaacttgatgacatctgtctcagaaggtgggggatcattctcattatcatattg

SEQ ID NO: 40528 - DNA, 75 bp, Artificial Sequence
  Synthetic
catccagcaagggcaatgttctctacactacatgcttatgggaatgggtattagttctctattcccggagtttaa

SEQ ID NO: 40529 - DNA, 75 bp, Artificial Sequence
  Synthetic
gaaggcaattttaaaatggaaagacccaggtcttggtttcttccttttggacaatccattctgttcaggccttgg

SEQ ID NO: 40530 - DNA, 75 bp, Artificial Sequence
  Synthetic
tggattcagattcaatctttttaaagccatatcaaccacatctctaaagaaaatctactcttacttcatgaaaag

SEQ ID NO: 40531 - DNA, 75 bp, Artificial Sequence
  Synthetic
agtcaggtctcagagtgttgaagatgatgtttacattcctgaaagctgctcagttagccctggtggagccattgt

SEQ ID NO: 40532 - DNA, 75 bp, Artificial Sequence
  Synthetic
gctcagttctgctctgcgctgggggtctaagcaaaagttctacaagctcagggacaagcttggaatccctgaaga

SEQ ID NO: 40533 - DNA, 75 bp, Artificial Sequence
  Synthetic
ttggattgaaaggataaatgagaatccatcagtactatatcgagctccaagaacaggggatgaggtcatgctgag

SEQ ID NO: 40534 - DNA, 75 bp, Artificial Sequence
  Synthetic
aatagcagagaagattcacagtcctggggtgatctcatccctatctacaggaaatgctgtagcaaaagtgatagc

SEQ ID NO: 40535 - DNA, 75 bp, Artificial Sequence
  Synthetic
ttcttcggtgtacttcttgagtgcggcaatatttcaagattctggaaagcaagagtattcagtcctagatgacag

SEQ ID NO: 40536 - DNA, 75 bp, Artificial Sequence
  Synthetic
caagtatagcctattacaaaaaatatctaaacttgatgggaggaatcttgtgaattcaattagtgacacagacat

SEQ ID NO: 40537 - DNA, 75 bp, Artificial Sequence
  Synthetic
gcttttcctcttcccgaatatagaagatctccaatccttagatagcctagtttttaatagaggtccaattgaact

SEQ ID NO: 40538 - DNA, 75 bp, Artificial Sequence
  Synthetic
tgttaagagaaaacaaaacaaagagaacacacaatccagggtagtggtgtttgaggggaacaggaacttaagaac

SEQ ID NO: 40539 - DNA, 75 bp, Artificial Sequence
  Synthetic
accggcagaatatctcatttctgacaaatggtttggcacacagaagagtaagattggcaaaatagcatttgacca

SEQ ID NO: 40540 - DNA, 75 bp, Artificial Sequence
  Synthetic
ggagtgggacaaggttgtttctattatcccttggttggaacagacccctgatatgacgctggaaaagtcaccctt

SEQ ID NO: 40541 - DNA, 75 bp, Artificial Sequence
  Synthetic
gatgaaccatatacagataagaaacttcttctctagaatggatcaaaagcctagggtagttagagttactggggc

SEQ ID NO: 40542 - DNA, 75 bp, Artificial Sequence
  Synthetic
tcccataaagaaacgatctggtgtcagcaagctatccatggtgatccgcgacaatttttccaaactgggatatat

SEQ ID NO: 40543 - DNA, 75 bp, Artificial Sequence
  Synthetic
caaagacattgaagatctttcaggagccagtaggactaacaatgcagagcttgttaaacactttttattctgtgc

SEQ ID NO: 40544 - DNA, 75 bp, Artificial Sequence
  Synthetic
actccaagggccttatactcaggagaggaaggaggacttagtcacaaaaatattacacttatctgatcccatagg

SEQ ID NO: 40545 - DNA, 75 bp, Artificial Sequence
  Synthetic
tcttaaagaatcagacggaaaatcaagatctaacattttggccattctacaaaatttcatctatggagaccagga

SEQ ID NO: 40546 - DNA, 75 bp, Artificial Sequence
  Synthetic
aattgctagacagatagaagatgcgggcgccggtacgattggagggttcgtgataccacagagatcgaagaagat

SEQ ID NO: 40547 - DNA, 75 bp, Artificial Sequence
  Synthetic
cgaatctactgtttactattatgggcctggcatatggagaggagtgatggatgggaaacaaatacaaatagagat

SEQ ID NO: 40548 - DNA, 75 bp, Artificial Sequence
  Synthetic
taacaactccttaggaaaccctccaatgattactagcatcactgttgaaagttcagcagaagtctggcagttatg

SEQ ID NO: 40549 - DNA, 75 bp, Artificial Sequence
  Synthetic
taagagtatcaagttatgggcagaagatgtaggagcaaaaaacaatattgacatgtcaaaaaagagcagcaaagg

SEQ ID NO: 40550 - DNA, 75 bp, Artificial Sequence
  Synthetic
ggccaaatattggatgtttgacttcaagatgtattcagaagataaaccatacggaataccagtgtatttatcaga

SEQ ID NO: 40551 - DNA, 75 bp, Artificial Sequence
  Synthetic
gaagagaatggttgactttagacaggtctcagatgatcatattggattcaaggtgaggaaatccacaatcaactt

SEQ ID NO: 40552 - DNA, 75 bp, Artificial Sequence
  Synthetic
atatgtggtgaataatggtagagacgttcacatcctttcttattctgccaatgacaatgacttgagtagttcgtg

SEQ ID NO: 40553 - DNA, 75 bp, Artificial Sequence
  Synthetic
cttaaagttggctagtcaagtgaaagactctatgttgtctcttttctcaaaggaacctagcaagtcttgggcatc

SEQ ID NO: 40554 - DNA, 75 bp, Artificial Sequence
  Synthetic
gtgtgcacccatacctcacttcctagtgcacagactccttgatctcataagaggtgatttcaccatagattacat

SEQ ID NO: 40555 - DNA, 75 bp, Artificial Sequence
  Synthetic
tgactcaaacagattatctgagattctaaagctatgttgtgagtcatcattgaggactagaatagggaatatctt

SEQ ID NO: 40556 - DNA, 75 bp, Artificial Sequence
  Synthetic
ctcagttctacccactgttaatgagagcaagtcacatgtggatgtggatgatctgatagatataattatatgtga

SEQ ID NO: 40557 - DNA, 75 bp, Artificial Sequence
  Synthetic
ttcaagagagaataacttcattgaagttgcaaaggccctggaggaggacttaaatgaaggatatgatttggatga

SEQ ID NO: 40558 - DNA, 75 bp, Artificial Sequence
  Synthetic
ctttgacttctcagatattgacttatttggaccagctcattataaggagctatcggatctaacagctattagcca

SEQ ID NO: 40559 - DNA, 75 bp, Artificial Sequence
  Synthetic
cccactacttgatgattttgttgatagttgcataacttcaatgggaagaaaaagcattaggaaggttttggaaac

SEQ ID NO: 40560 - DNA, 75 bp, Artificial Sequence
  Synthetic
tggacggtgcaagtcaaaagatgttaagttatgtgaagatctctttacctgcttgaagagagacataaacacctt

SEQ ID NO: 40561 - DNA, 75 bp, Artificial Sequence
  Synthetic
ggttgtggatgattatgatctaagagaggatgaggcggtggcagatgatatgtttggataacgacgtcaacattt

SEQ ID NO: 40562 - DNA, 75 bp, Artificial Sequence
  Synthetic
atttaagtgagtctcaaaaaacacaaagaccatcttcatctggacaccgaatgtgttgttactattattaaataa

SEQ ID NO: 40563 - DNA, 75 bp, Artificial Sequence
  Synthetic
cttcatctggacaccgaatgtgttgttactattattaaataatctcaagtgttcaggtatgggcggtctttgtgt

SEQ ID NO: 40564 - DNA, 75 bp, Artificial Sequence
  Synthetic
cgcagagtacacacaaagctcctcaaggattgttaactagtgaataactaattcaatatgtcgtatgaaaagctt

SEQ ID NO: 40565 - DNA, 75 bp, Artificial Sequence
  Synthetic
gctattgatattgctggccacgagatagatgccgaaactattaaggcatgggttcaggcctttgcttatcaaggg

SEQ ID NO: 40566 - DNA, 75 bp, Artificial Sequence
  Synthetic
tttgatgccaaaagagtgattgagctcctcatggagagaggaggtgaggactgggttgaagatgcaaagaagatg

SEQ ID NO: 40567 - DNA, 75 bp, Artificial Sequence
  Synthetic
atcattctgtgccttactagagggaataaaccatctaagatgatggtgaaaatgtctgagaaaggaaaaaagatg

SEQ ID NO: 40568 - DNA, 75 bp, Artificial Sequence
  Synthetic
gttcaagccctcgtgaagagatattctcttaaggagggaaacccttccagagatgacttaactctttctagagta

SEQ ID NO: 40569 - DNA, 75 bp, Artificial Sequence
  Synthetic
acagctgcccttgcaggatatacctgccaagccacagagtatgtggaagaatatctcccagtcaccggaaagaac

SEQ ID NO: 40570 - DNA, 75 bp, Artificial Sequence
  Synthetic
atggatgatttgtccaaaaattatccaagagctatgatgcaccctagctttgctggtctgattgaccccaagctg

SEQ ID NO: 40571 - DNA, 75 bp, Artificial Sequence
  Synthetic
ccggctgaagtcttaacaactatctgtgatgccttcagccttttcatggttcagttctctaggaccataaaccca

SEQ ID NO: 40572 - DNA, 75 bp, Artificial Sequence
  Synthetic
aggaacagagggctgagtgtgtcagaagttgctagtacttttgacaggcccatgaatgctgccataaacagctct

SEQ ID NO: 40573 - DNA, 75 bp, Artificial Sequence
  Synthetic
ttcttgagcagtgagcagaggaaggctttcctgaggagccttggaattgttgatgacaacatgcaaccatcagcc

SEQ ID NO: 40574 - DNA, 75 bp, Artificial Sequence
  Synthetic
tcagttaaagctgctgctaaggtcttcaaaaacatgaaataagctgccccttttcccctatcatctagcttaatt

SEQ ID NO: 40575 - DNA, 75 bp, Artificial Sequence
  Synthetic
gcaaataattggtttgttttaagatcaaataaattaaattggattaatggtaagttttaataaaaagaattttgt

SEQ ID NO: 40576 - DNA, 75 bp, Artificial Sequence
  Synthetic
atatagtgatttgtcaaaattttggaattaaattaattttaaatcacaatcccaccctaaacctccccaccccac

SEQ ID NO: 40577 - DNA, 75 bp, Artificial Sequence
  Synthetic
ctggcagctggaccgtctacctccatttcttcctctgagtcaagatctgagtcccatgaatcagcaattctagtg

SEQ ID NO: 40578 - DNA, 75 bp, Artificial Sequence
  Synthetic
taccttgggctcattgtatgtagtggctcccatttcctatttcctagcagatgtggtgtgatcacctcagatagt

SEQ ID NO: 40579 - DNA, 75 bp, Artificial Sequence
  Synthetic
tctttgacataatcatataaagatgagtgaaaatcagattcatagtaatcatagggcaatgctgtcagcatcctt

SEQ ID NO: 40580 - DNA, 75 bp, Artificial Sequence
  Synthetic
aagacctgaacatatgcaatttctttttctatattttgaccggtgaaattgagacatggaatatctctctctccc

SEQ ID NO: 40581 - DNA, 75 bp, Artificial Sequence
  Synthetic
aattctctaatcagcttcttataaagatttactaatgaatcatctatttgggtaccatcaccagatctcatgact

SEQ ID NO: 40582 - DNA, 75 bp, Artificial Sequence
  Synthetic
agtgtcatgaagaagcatttctcctcccagttgtactcataactttccacgaaagagagcttaaagaaagctaaa

SEQ ID NO: 40583 - DNA, 75 bp, Artificial Sequence
  Synthetic
gtgggaactcccagaggccagctcagagcctctttcagatttggctcggaccacttcagctgcctttccaagtta

SEQ ID NO: 40584 - DNA, 75 bp, Artificial Sequence
  Synthetic
aggtgagaaatcttttctattgttgtatcaaaaaatgatggcgactttcctttcacctgaaggaaaggctttccc

SEQ ID NO: 40585 - DNA, 75 bp, Artificial Sequence
  Synthetic
catgatctcggaagctgtcccttatcaataaaacttctcagcctgaaagaggtcttatcagagacagtgaatgag

SEQ ID NO: 40586 - DNA, 75 bp, Artificial Sequence
  Synthetic
gaacacgggaattcagcacctttatatctacacacaggggtcccccagtagccattataagcagagtattccaca

SEQ ID NO: 40587 - DNA, 75 bp, Artificial Sequence
  Synthetic
taaactctagatcgatctgtggcagatcttgtaatatgtggaatgtcaaacacgtagttcaacatgttagacata

SEQ ID NO: 40588 - DNA, 75 bp, Artificial Sequence
  Synthetic
ttagacataatttattttattcactaatacgatctcaagaggggactttgtgtgtactctgcgttgataccactg

SEQ ID NO: 40589 - DNA, 75 bp, Artificial Sequence
  Synthetic
atgaatctatttgcattcattctaaacgtggtggtagctaatgctgcctacacaataaagaactggggtttagaa

SEQ ID NO: 40590 - DNA, 75 bp, Artificial Sequence
  Synthetic
ggatctgagagtatatgcctcagcaatgagtctcctctagaggggttgatatactactgggagcagggggcaaaa

SEQ ID NO: 40591 - DNA, 75 bp, Artificial Sequence
  Synthetic
aggagagatatggttaaagatttcaagtcctgtaaaatagggtcagagcctttgaaagaaatgagaaataaaact

SEQ ID NO: 40592 - DNA, 75 bp, Artificial Sequence
  Synthetic
gttatgagaatgatagaagaagttcaactttctatgactaatcttaggttcactagcagtgacaatatgggatct

SEQ ID NO: 40593 - DNA, 75 bp, Artificial Sequence
  Synthetic
catggggtgtacattgatttcaacggcctagatgacacagaacctgggaagaatttggtggattgcgagaaattc

SEQ ID NO: 40594 - DNA, 75 bp, Artificial Sequence
  Synthetic
cacactatctcagaattgggaatagaagtgtcagatggacatctatgggaatctagatacaatgaatcttatgct

SEQ ID NO: 40595 - DNA, 75 bp, Artificial Sequence
  Synthetic
gctgagattaagagacatgagcaagaattagagaaattagcgaatgaaaagaggaatctagagaacgttatgcgt

SEQ ID NO: 40596 - DNA, 75 bp, Artificial Sequence
  Synthetic
gatgacaagaatgagattttatctttaattagagaaaatcagatgctccagcataagatatcaaacctgactggg

SEQ ID NO: 40597 - DNA, 75 bp, Artificial Sequence
  Synthetic
gtggttttcaattacaacaatagtctagatgccctagcaaaagagatggatattaggcagtcaattaataccaaa

SEQ ID NO: 40598 - DNA, 75 bp, Artificial Sequence
  Synthetic
ttgattgaagatatgaaagacgagctggacaagaagaattctatgatgaaaaagcagaatgacactgtcagtttg

SEQ ID NO: 40599 - DNA, 75 bp, Artificial Sequence
  Synthetic
aagtcagttgcaatggctgccttgttggcaactacagttataccaactgtgactgggtctcctcagacagcacaa

SEQ ID NO: 40600 - DNA, 75 bp, Artificial Sequence
  Synthetic
atcaatctcctaaatagctatccacatgctaagaataggattggagggggtttgtataggtatgaagagagtgaa

SEQ ID NO: 40601 - DNA, 75 bp, Artificial Sequence
  Synthetic
gacgaggacacttgcagaggccttgattatggactatcctgtgctggattcgaccacatgctaaaaccacattat

SEQ ID NO: 40602 - DNA, 75 bp, Artificial Sequence
  Synthetic
tatcctttcttcaattctcatgttatgcatttaactcctctggaagcatatgctgacaagatcataggcagtgaa

SEQ ID NO: 40603 - DNA, 75 bp, Artificial Sequence
  Synthetic
aataatagctgtgagatggggaaagacaaagatacaaaatgcgttgaaggtaggaagtacattagaggccattgc

SEQ ID NO: 40604 - DNA, 75 bp, Artificial Sequence
  Synthetic
cctaatgggatcaatggagtttattacataaatgataaaggaaaattatctcactcaaagtgtaaagatgaagga

SEQ ID NO: 40605 - DNA, 75 bp, Artificial Sequence
  Synthetic
catgaaatcactgaggattgcatgttctgtaggaaaatcaagaaaaagcacaatgttcaaaaagcagtgatgaag

SEQ ID NO: 40606 - DNA, 75 bp, Artificial Sequence
  Synthetic
acttccgtatccttgcaggatgccatctgtcaaaaagagtcaaccagatatgaaggaccaaggataactgtcaaa

SEQ ID NO: 40607 - DNA, 75 bp, Artificial Sequence
  Synthetic
ggtgtctgcaagataggaaacttcgtgtacaaacactgtgacacctcagctcaatcttatgaaaatgtgccattt

SEQ ID NO: 40608 - DNA, 75 bp, Artificial Sequence
  Synthetic
gtgacatttgaagataaaggtaaattttatcttgaaaaactgatgttatcaaatgttgagttgatgaataatgta

SEQ ID NO: 40609 - DNA, 75 bp, Artificial Sequence
  Synthetic
tcttttatatgctatgagcataagggccaagatgggaatgaggatgataaccgagaatggaaaagagttagtgtg

SEQ ID NO: 40610 - DNA, 75 bp, Artificial Sequence
  Synthetic
aaagagtgcaagaatgttgacaatgaaaagaagaaaatatgtgctggagacaacatcttttgtcagaaatataca

SEQ ID NO: 40611 - DNA, 75 bp, Artificial Sequence
  Synthetic
tgccctgctctgaatccgacagcaaagtgtttcatggctcctgggtctggaccaatacttgtgaatatatttgga

SEQ ID NO: 40612 - DNA, 75 bp, Artificial Sequence
  Synthetic
tcttgggtgaaaccacagtgtgttgggtacgagaacgtcttggtaactagagaagtgaaaagtctagttacagaa

SEQ ID NO: 40613 - DNA, 75 bp, Artificial Sequence
  Synthetic
acatcaacagagtgtgaaacctgtatttatgagtgtggccctgagtacataagagtgacctcaacaggatttgag

SEQ ID NO: 40614 - DNA, 75 bp, Artificial Sequence
  Synthetic
ataacctcagcagtttcctgctctcacggctcttgcatctcaactcatcaatccccttcaactatgatcgatata

SEQ ID NO: 40615 - DNA, 75 bp, Artificial Sequence
  Synthetic
ccctaccctggtatgtcagcagcaatggggggagatgtaggtatctacgtctctcacactagtgattctgtgagc

SEQ ID NO: 40616 - DNA, 75 bp, Artificial Sequence
  Synthetic
ctccatgtgaaagcacactgcaagcctagagactcttgtgaggttcatcattgcttgttctgtgtttatgggctt

SEQ ID NO: 40617 - DNA, 75 bp, Artificial Sequence
  Synthetic
ttgaactaccagtgtcatagtgtgctaagttctttgtttttgtcctcattattttccatgataatattctttgca

SEQ ID NO: 40618 - DNA, 75 bp, Artificial Sequence
  Synthetic
ttatcactaattggaaaattgctttacttctttcatctgataccaaaaaagctaagaagcccattcatgtgggtg

SEQ ID NO: 40619 - DNA, 75 bp, Artificial Sequence
  Synthetic
tggttattaataaaacattgcgcatgcttcataaaaaacattgtacacaagaatttcaaaagagtgaataacatc

SEQ ID NO: 40620 - DNA, 75 bp, Artificial Sequence
  Synthetic
atagggtgggagaatgaagagagattggcaccacttagagaaatcagggttgcaagggctatccccagattcaat

SEQ ID NO: 40621 - DNA, 75 bp, Artificial Sequence
  Synthetic
acaacagttttccttatcatgctggttttgcctctagtcttgggctgttcagaaacagtgatatccaattcaaaa

SEQ ID NO: 40622 - DNA, 75 bp, Artificial Sequence
  Synthetic
caagtgaagtgtgttcagtatggtgggggagtgaagtgctcagtttctgctacagtctctctaaaggcaggagtc

SEQ ID NO: 40623 - DNA, 75 bp, Artificial Sequence
  Synthetic
ataggaggtgaatcttgttttgtaatgaagggacctatggatggtcaacaaaaatccataaaaataaaaacagtg

SEQ ID NO: 40624 - DNA, 75 bp, Artificial Sequence
  Synthetic
tcaagtgaaatgatttgtcgtgaaggaacaagtttctggactagtcattactcacctcaatgtctaagctcaaga

SEQ ID NO: 40625 - DNA, 75 bp, Artificial Sequence
  Synthetic
agatgtcacctagtgggtgaatgtcagaaaaatagatgccagagttggtcagacaaagaggtgtctaaagaattt

SEQ ID NO: 40626 - DNA, 75 bp, Artificial Sequence
  Synthetic
aaggggttcagtgacaatggcatgatgtcagaaaataaatgttttgagcaatgtggagcagtgggctgtgggtgt

SEQ ID NO: 40627 - DNA, 75 bp, Artificial Sequence
  Synthetic
tttaatataaatccatcatgcctatttgttcacacttatcttaaaagcactaggaatgaggccataagagcattc

SEQ ID NO: 40628 - DNA, 75 bp, Artificial Sequence
  Synthetic
tcctgtgtggattgggtgcatagattaacactagaagtgcagggtcctgaaggagaaaaggatatcctggttctg

SEQ ID NO: 40629 - DNA, 75 bp, Artificial Sequence
  Synthetic
ggatctttaggaactaaatttctcaactggggcacaatcagtctttctctagatgcagaaggaataactgggacg

SEQ ID NO: 40630 - DNA, 75 bp, Artificial Sequence
  Synthetic
aattctataagttttttggagagtagcaaggggggatttgctctttatgatgaggcattgtcagaaataccaagg

SEQ ID NO: 40631 - DNA, 75 bp, Artificial Sequence
  Synthetic
gagggtttcataggagaagttaggtgctcctctgagtcagcagctgtgatggcacactcatcatgtttgagagct

SEQ ID NO: 40632 - DNA, 75 bp, Artificial Sequence
  Synthetic
ccaaatctcgtgaaatacaagccaatgacagatgtgatagattgtactgcttcattagtagatccatttgctgcc

SEQ ID NO: 40633 - DNA, 75 bp, Artificial Sequence
  Synthetic
ttttataagggatccctaccccaagtgaggaatgggatgacgtatactagctccattgacaaaaaaacagttcag

SEQ ID NO: 40634 - DNA, 75 bp, Artificial Sequence
  Synthetic
gcattcaattcggggtcaattaaagcaatcatcacaataaacatggaggatcatgagattcagttcatgacctca

SEQ ID NO: 40635 - DNA, 75 bp, Artificial Sequence
  Synthetic
acagttaggtgcgaaactacgtttgtcaacatcaccggttgttattcatgtaattatggtgctaaggtctgctta

SEQ ID NO: 40636 - DNA, 75 bp, Artificial Sequence
  Synthetic
aagataaagtctagtggcaacggcgagtttttggcaagagaggagtctggtgcattttatatgtccattgctatc

SEQ ID NO: 40637 - DNA, 75 bp, Artificial Sequence
  Synthetic
actgaaggtgtgaaggactattgtcaagttctacatttcaataaacctgagataaatgagaaaactaaatataca

SEQ ID NO: 40638 - DNA, 75 bp, Artificial Sequence
  Synthetic
tgtggaggagaggaaaaattgctaaatattaaaggtgttttgatttctattggacctgaagacttacgaaacaac

SEQ ID NO: 40639 - DNA, 75 bp, Artificial Sequence
  Synthetic
actggaggctcatctatagtggttaatccaagtgagacttcatggagtttttccggctgggtatcaggcttgttt

SEQ ID NO: 40640 - DNA, 75 bp, Artificial Sequence
  Synthetic
tcatggcttggagggacctggactgctatactaaaaatattaggttttttattattaggattcctattgctcctc

SEQ ID NO: 40641 - DNA, 75 bp, Artificial Sequence
  Synthetic
ctattgctcctcttaataatctccttggtgcgagtatcagtaaggtcagtgttatttaagcacaaaactaagtga

SEQ ID NO: 40642 - DNA, 75 bp, Artificial Sequence
  Synthetic
acacaaagacggcatagaaaatttattattgttgataactactagaggatcaacccctgagagtttgtagtgttt

SEQ ID NO: 40643 - DNA, 75 bp, Artificial Sequence
  Synthetic
gaccatcactttctaacacaccactctcaaaaccttgtgcccattgcttgaacttccccagaataccatcactct

SEQ ID NO: 40644 - DNA, 75 bp, Artificial Sequence
  Synthetic
caaccagactcagtcctcataactgcactgataagtagtgaaggataatacactttcacaaatcgctgttgactt

SEQ ID NO: 40645 - DNA, 75 bp, Artificial Sequence
  Synthetic
tgatgtagagatgaagctgatcctattctttgaaagaatcatagcagcattagctgcttacaccatctcaggctg

SEQ ID NO: 40646 - DNA, 75 bp, Artificial Sequence
  Synthetic
ggggattgaaggtgacaatagcatttgttttagcaatgagtccccactcgaaggactggtgcattactgggaaga

SEQ ID NO: 40647 - DNA, 75 bp, Artificial Sequence
  Synthetic
aatgataagaaagagaaggttggactctgaattaaaatcctgcaaaataggtgaaggtgaccttaaagagatgaa

SEQ ID NO: 40648 - DNA, 75 bp, Artificial Sequence
  Synthetic
caacagaacagtcatgacattgatcgaagaagttcaattatcaatctctccacttaggctgacatgtcaaaaaga

SEQ ID NO: 40649 - DNA, 75 bp, Artificial Sequence
  Synthetic
ccttatgaagcaaggagtttcaattgactttaatggccttgatgacacagagcctgggaagaatatagttgactg

SEQ ID NO: 40650 - DNA, 75 bp, Artificial Sequence
  Synthetic
caatagcaagaagtttgtggaagagattggaatatttgcaggagatggacatcagtgggagtccagatttaataa

SEQ ID NO: 40651 - DNA, 75 bp, Artificial Sequence
  Synthetic
atcattcgttgaagagctagaaaagaagtcctcctctctgagaaaggccctaggggatgtagaaaatctgagagt

SEQ ID NO: 40652 - DNA, 75 bp, Artificial Sequence
  Synthetic
gacagggattgatgacaagaatgaaattgcttctttaatcagagaaaaccagatgttacagcacagaatctcaaa

SEQ ID NO: 40653 - DNA, 75 bp, Artificial Sequence
  Synthetic
tctgtcagggacagctttcaatgtgaacaacagcttgagagctttagaagaagagctcagggagaaggatgacat

SEQ ID NO: 40654 - DNA, 75 bp, Artificial Sequence
  Synthetic
gcatgctggtctgcaaaatcagattaggatagaaaaggacaaggcacaccagatgcatctggacatgatcaaatt

SEQ ID NO: 40655 - DNA, 75 bp, Artificial Sequence
  Synthetic
gaaggcaggattaatgacacctctcttattaacaacagttcttccaataacaattgctgcatctcagaaaggcac

SEQ ID NO: 40656 - DNA, 75 bp, Artificial Sequence
  Synthetic
tgtccatccagttttcatgaatccttaccctcatgttaggaatcgcattggcaatggaaattacaagtttagcgc

SEQ ID NO: 40657 - DNA, 75 bp, Artificial Sequence
  Synthetic
agatgatgatgcaacttgcagacccatagattacaacacaaactgtgctggatttgaccatatggtaaggccaga

SEQ ID NO: 40658 - DNA, 75 bp, Artificial Sequence
  Synthetic
aaaatatccattttttaattcgtatgtcatgcatctgacaccattagaggccctagaagaaggcattatagagaa

SEQ ID NO: 40659 - DNA, 75 bp, Artificial Sequence
  Synthetic
ggaaggggaaagttgtgaaatgggaagtgggaaagatgcaaaatgtctggataacaggaggttcataaggggatc

SEQ ID NO: 40660 - DNA, 75 bp, Artificial Sequence
  Synthetic
ctgtccgaacgggatcacgggagtgtatttcatagatgacaaggggaaacttcagcattctaagtgcaaaagtga

SEQ ID NO: 40661 - DNA, 75 bp, Artificial Sequence
  Synthetic
tgattttgaaataactgaagactgcatgttttgccggaaaattaaaaagaaggctggagctagcaagttgtcaat

SEQ ID NO: 40662 - DNA, 75 bp, Artificial Sequence
  Synthetic
gaaaacctctgtgtctctccaagatgccatttgccaaaaggaatctactccttataatggccccaaattggtgat

SEQ ID NO: 40663 - DNA, 75 bp, Artificial Sequence
  Synthetic
aaagggtgtctgtagcattggttcatacaattacaaaagatgtgccaatgcagctcagtcatatgaaaatgtacc

SEQ ID NO: 40664 - DNA, 75 bp, Artificial Sequence
  Synthetic
ttttgtgactttcactaatcaaggtaaaatgtatctagatcgtctaatggtgaagaacgtggagttgatctcaaa

SEQ ID NO: 40665 - DNA, 75 bp, Artificial Sequence
  Synthetic
catatctttcatttgttatgaacacaaaggtcaagatggtacggagtcagacaccagggagcttaagagagtcaa

SEQ ID NO: 40666 - DNA, 75 bp, Artificial Sequence
  Synthetic
accagatgagtgtaaaaacatcaatacatcaaaaagcaagatctgcactggagaccatatcttttgtgaaaaata

SEQ ID NO: 40667 - DNA, 75 bp, Artificial Sequence
  Synthetic
tggttgcactggaacttacccagtggccaagtgtcttgctgcacctggatctggaccaatcctggtcaacattca

SEQ ID NO: 40668 - DNA, 75 bp, Artificial Sequence
  Synthetic
tggaacatggacaaaacctagatgtgttggatatgagaatgttttggttagaagagaggtgaaattgctggactc

SEQ ID NO: 40669 - DNA, 75 bp, Artificial Sequence
  Synthetic
attaagagaagaatcttgtgagacttgcaattatgagtgtgcagaagatggtgttaaagtaacttccacaggctt

SEQ ID NO: 40670 - DNA, 75 bp, Artificial Sequence
  Synthetic
caaaatcacgtctgcagtttcctgttctcatgggtcatgtgtttctgcacatcaggagccatccaccaccatcat

SEQ ID NO: 40671 - DNA, 75 bp, Artificial Sequence
  Synthetic
tgtgccttatcctggaatgtcagcagcaatggggggagaaattgggttacacttatcccacacagatgactcaat

SEQ ID NO: 40672 - DNA, 75 bp, Artificial Sequence
  Synthetic
cagtttgaaattaaaggtcacttgtgaagctagagacatttgtgagacacaccattgctttttttgcactaatgg

SEQ ID NO: 40673 - DNA, 75 bp, Artificial Sequence
  Synthetic
aataattaattaccagtgtcacaccattgctagtggactgattctttcaactttgatttccttctctttatatgt

SEQ ID NO: 40674 - DNA, 75 bp, Artificial Sequence
  Synthetic
ggtgtttatgctattaggcaagctcttttattttttcagattaatccctaagaagttgagaagtccattcatgtg

SEQ ID NO: 40675 - DNA, 75 bp, Artificial Sequence
  Synthetic
gattgctctcttactcaaatggttcctgaggatcttgaagtccagctggcagagattgagcagcagactaaatag

SEQ ID NO: 40676 - DNA, 75 bp, Artificial Sequence
  Synthetic
aaacattggatggaaccatgaggacgtagagatggccgcccctatcagaaatagaagagttattccaagattcaa

SEQ ID NO: 40677 - DNA, 75 bp, Artificial Sequence
  Synthetic
tgctaccttattccttatctttgttttggttcctggagtcctatgctgttctgaaagcttattatctaattcaaa

SEQ ID NO: 40678 - DNA, 75 bp, Artificial Sequence
  Synthetic
gcaaacaaaatgtacacagtcagatggaaaagtgaagtgctctgttactgcgacagtgacagtaaaagctggcat

SEQ ID NO: 40679 - DNA, 75 bp, Artificial Sequence
  Synthetic
cattggagctgagacatgttttatcattaaagggcctatggataaccagcagaagactgtgagaataaagactat

SEQ ID NO: 40680 - DNA, 75 bp, Artificial Sequence
  Synthetic
gtctagtgaagtgatatgcagagaggggaatagcttttggactagccactacacgccctcatgtcttagctcaag

SEQ ID NO: 40681 - DNA, 75 bp, Artificial Sequence
  Synthetic
gaggtgtcatttggttggtgagtgtcaggggaatagatgccaaagttggaatgataatgaggtatcaaaagagtt

SEQ ID NO: 40682 - DNA, 75 bp, Artificial Sequence
  Synthetic
caaaggcgtcaatgataacatgctgatgaatgagaacaagtgcttcgagcagtgtggagcagcaggttgtggatg

SEQ ID NO: 40683 - DNA, 75 bp, Artificial Sequence
  Synthetic
tttcaacataaatccctcatgcttgtttgtacatacagtgctaaggagcgtgagggcagaagctgtccgggtctt

SEQ ID NO: 40684 - DNA, 75 bp, Artificial Sequence
  Synthetic
ttcttgtgtagactggattcatagaatcaccttcttagtcactggaccagaaggagagaaggaagaggtcattct

SEQ ID NO: 40685 - DNA, 75 bp, Artificial Sequence
  Synthetic
gggatcactagggacaaagtttctgtcatgggggaccatatcattatccctagatgctgagggtgtctcaggaag

SEQ ID NO: 40686 - DNA, 75 bp, Artificial Sequence
  Synthetic
caattcattctccttcctggagagcagtagagggggatttgctatttatgacgaagcattttcagaagtaccaag

SEQ ID NO: 40687 - DNA, 75 bp, Artificial Sequence
  Synthetic
agaagggtttcttggagaaataagatgctcgtctgaatcagcagctgttgcagctcactcctcttgcataagggc

SEQ ID NO: 40688 - DNA, 75 bp, Artificial Sequence
  Synthetic
acccaatttgataaagtacaaacccatgacagaccagatagattgcacagcatctttaatagaccccttcgctgc

SEQ ID NO: 40689 - DNA, 75 bp, Artificial Sequence
  Synthetic
ctttgtcaagggttcattaccacaagtcaggaatggaatgacctatacaagctctaaagataagaaaacagtcca

SEQ ID NO: 40690 - DNA, 75 bp, Artificial Sequence
  Synthetic
agcatttaacaatggtgccatcaaagctctggtgacaattaatatggaagatcatgaaatagaatttttgagtga

SEQ ID NO: 40691 - DNA, 75 bp, Artificial Sequence
  Synthetic
agttccaaattgtgaggcctctttcgttaacattactggatgctattcatgcaattatggagctagggtgtgcgt

SEQ ID NO: 40692 - DNA, 75 bp, Artificial Sequence
  Synthetic
gaagatcaaaagtgatggaaatgccaacttcattgcttctgaagagaagggcacataccacatttcatttaatgt

SEQ ID NO: 40693 - DNA, 75 bp, Artificial Sequence
  Synthetic
gtggagaggcaccagagactattgtcagattatgcactttgacacaccaaatgtggattctataacacattactc

SEQ ID NO: 40694 - DNA, 75 bp, Artificial Sequence
  Synthetic
ctgtgggggcaacgagaaactgctaaacatcagaggactcctgatttctgttgggcctcaggacttgagaaatac

SEQ ID NO: 40695 - DNA, 75 bp, Artificial Sequence
  Synthetic
tacaggaggtgcttctgtggtcgtcaacccctcagaaagctcctggagtctgggaaaatgggctggaggtttgtt

SEQ ID NO: 40696 - DNA, 75 bp, Artificial Sequence
  Synthetic
ttcttggctaggggggtcttggacagcaattctaaagattattggttttttattattaggtttcctcatagtagt

SEQ ID NO: 40697 - DNA, 75 bp, Artificial Sequence
  Synthetic
attgttgttgctgttggttggctctgttggtatgtcatatcttaagaaaacaaagattatatgagcctatacaca

SEQ ID NO: 40698 - DNA, 75 bp, Artificial Sequence
  Synthetic
aaattgcagaaagggcaagaccaaatcaaataaacaaaataaatttaaaataaacagacatctcactttattcat

SEQ ID NO: 40699 - DNA, 75 bp, Artificial Sequence
  Synthetic
catgacacacataacaacctatcataactctcatcttactaggcagtttcttcctattcaatatagattaggtta

SEQ ID NO: 40700 - DNA, 75 bp, Artificial Sequence
  Synthetic
ggttaaagtgtgattatggaacatacgagggtaagacatgttgatcatttgaagtggaattgccggtctttgtgt

SEQ ID NO: 40701 - DNA, 75 bp, Artificial Sequence
  Synthetic
acacaaagacggcatattatctgaacatttatattttgttaactgagagtaagtgtacaaacatgaagattttac

SEQ ID NO: 40702 - DNA, 75 bp, Artificial Sequence
  Synthetic
acttattgactaatataatgtatgccctaggggcttacattataactggatggagcatggaagggaccaccagag

SEQ ID NO: 40703 - DNA, 75 bp, Artificial Sequence
  Synthetic
tgtgtctctccaatgagtctccattagaaggaatagtctattattgggaaaccgagaggaaacgaaggggaatgg

SEQ ID NO: 40704 - DNA, 75 bp, Artificial Sequence
  Synthetic
aatcatcttctaatcttgattgcagggtaggagaaggtgaactgaagaggattagcaataagaccttgatcagac

SEQ ID NO: 40705 - DNA, 75 bp, Artificial Sequence
  Synthetic
ttatagaggaagtgcagttgtctacttatgagctaaaggttagttgtgaaaagtcttctaatgatactggattgt

SEQ ID NO: 40706 - DNA, 75 bp, Artificial Sequence
  Synthetic
ctattgattttaatggtttggatgacactgaacctggtcatcatattgttgattgtgaaaagatgagatatgtat

SEQ ID NO: 40707 - DNA, 75 bp, Artificial Sequence
  Synthetic
cagatctaggtgttactgtgggagatggtttggcttgggattcaagatataatgaaagctacaagcaggagttat

SEQ ID NO: 40708 - DNA, 75 bp, Artificial Sequence
  Synthetic
tgaggaaagatgaaaagctaagagaatttgaaaatgaattaagtcacctcaagcttacagggattgatgacaaga

SEQ ID NO: 40709 - DNA, 75 bp, Artificial Sequence
  Synthetic
atgaaatcatgtccctgattagagaaaatcaaatgttgcagcatagaatctccaatttaacagggtccaatgaga

SEQ ID NO: 40710 - DNA, 75 bp, Artificial Sequence
  Synthetic
acaaaaataacagtctaaggatattaaaaaatgagctaatgcaggcagaatctcacagagataatctagagaggg

SEQ ID NO: 40711 - DNA, 75 bp, Artificial Sequence
  Synthetic
aaatcctaaatcataaagacaggcatgctaaacttgagggtgactttattaaattaaagagctcaatgtttagtg

SEQ ID NO: 40712 - DNA, 75 bp, Artificial Sequence
  Synthetic
tccaggttgttactactgttttaccacttctgtctctggttgggaccagtcttgctgcaacaccaataatgctac

SEQ ID NO: 40713 - DNA, 75 bp, Artificial Sequence
  Synthetic
aaaacccgtatcctcatgtaaaaaatagggtgggaagtggactatatagattcactgagaatgaagatgatccaa

SEQ ID NO: 40714 - DNA, 75 bp, Artificial Sequence
  Synthetic
cttgtgccaagcttgactatggtcatgcgtgtgctgggtttgattatatgataaggccagacaagtacccattct

SEQ ID NO: 40715 - DNA, 75 bp, Artificial Sequence
  Synthetic
tcaattcccatgtgatgcaccacactcctcttgaggcttatgttgataaaatcctcgagtcatcaggtgagagct

SEQ ID NO: 40716 - DNA, 75 bp, Artificial Sequence
  Synthetic
gtgaaatagccgcagggaaggacataaaatgcttggaacagagaaaatacatgaaagggcattgcccgaatggca

SEQ ID NO: 40717 - DNA, 75 bp, Artificial Sequence
  Synthetic
ttaatggtgtctactttataaatgacaaggggaagctgagtcatgcaagatgcaaagctgaagatcatgaaataa

SEQ ID NO: 40718 - DNA, 75 bp, Artificial Sequence
  Synthetic
cagaggactgcacattttgcaggagaatgaagaagaaaaacaacaaatctgttgtgatgaaaacatcagtatccc

SEQ ID NO: 40719 - DNA, 75 bp, Artificial Sequence
  Synthetic
tacaggatgccttttgccagaataactctgaaagctacactggtccacagatacctttcaaaggtgtgtgcagta

SEQ ID NO: 40720 - DNA, 75 bp, Artificial Sequence
  Synthetic
ttggatcattcgaatacaaaaggtgtgagcaatccacttctaactttatgaccattccttttgtagtatttaaaa

SEQ ID NO: 40721 - DNA, 75 bp, Artificial Sequence
  Synthetic
ataaagggaaaatatatctagaaaagctaataacaaaaaatatagaagtagttgagagcatcccgtttatttgtt

SEQ ID NO: 40722 - DNA, 75 bp, Artificial Sequence
  Synthetic
tcactcacaaaggtcaagacaatcaagaggtggagataagtagtctgaagagagtccaaatgtctgaatgcaaaa

SEQ ID NO: 40723 - DNA, 75 bp, Artificial Sequence
  Synthetic
acataaataattccaaagaaaaatactgtacaggtgatcacaccttctgtgaaaaatacggttgttcaggaactt

SEQ ID NO: 40724 - DNA, 75 bp, Artificial Sequence
  Synthetic
acccagaatacaaatgcattatggcacctggtgctgggcctgttcttgtgaacatcttaggaaactgggttaagc

SEQ ID NO: 40725 - DNA, 75 bp, Artificial Sequence
  Synthetic
ctcaatgcattggttatgagactgttctagtgaaaaaagaggtgaaggtgaaacgagtggaggcacctacagaat

SEQ ID NO: 40726 - DNA, 75 bp, Artificial Sequence
  Synthetic
gtgaaacatgtatttataactgtgagccagatggcctgaaaataacctctactggatttcagattacatcaggag

SEQ ID NO: 40727 - DNA, 75 bp, Artificial Sequence
  Synthetic
tttcctgctcccatgggtcatgtatttctcagcatcaagagccttctacttcaattaagattccttaccctggga

SEQ ID NO: 40728 - DNA, 75 bp, Artificial Sequence
  Synthetic
tgttttcagcaatgggagggcatattggcatacacctatctcacacagacgactctttgagtctccacatgaggg

SEQ ID NO: 40729 - DNA, 75 bp, Artificial Sequence
  Synthetic
cttattgtgaccctcaagatgtgtgtgagactcatcactgttttttctgtgtcaatggaatagttaattatcagt

SEQ ID NO: 40730 - DNA, 75 bp, Artificial Sequence
  Synthetic
gtcactcaatcctaagctctcttatagtgtcaatcctgttatcaattatcatatattttgttttgatcataattg

SEQ ID NO: 40731 - DNA, 75 bp, Artificial Sequence
  Synthetic
gcaagatgttatacttcttcaaagtcatcccaaagaagttgagaagtcctttcatgtggctagccctattattta

SEQ ID NO: 40732 - DNA, 75 bp, Artificial Sequence
  Synthetic
gatgggtgattgacttggtcaggagcactttatccaagctcaagaccagacttaatagatctattggctgggatg

SEQ ID NO: 40733 - DNA, 75 bp, Artificial Sequence
  Synthetic
gtcaagatagaggcaatgaactgagggaagtcagagtgaggaggcccatccctaggtttgccgcaactctgtcca

SEQ ID NO: 40734 - DNA, 75 bp, Artificial Sequence
  Synthetic
taatttgcttgctcaccactggtgccctggcctgttcagaaacgttaatctcgaattcaaaacaaaccaaatgtg

SEQ ID NO: 40735 - DNA, 75 bp, Artificial Sequence
  Synthetic
tgcagtcatctgataaggtgaaatgctctgtgtcagccacggtgaccttaaaagctggcattattggtgctgagt

SEQ ID NO: 40736 - DNA, 75 bp, Artificial Sequence
  Synthetic
catgttttattttgaagggtccaatggagaatcagagaaagacaatacgtataaaaacattatcaagcgagctag

SEQ ID NO: 40737 - DNA, 75 bp, Artificial Sequence
  Synthetic
tgtgtagagagggcaatagcttctggactagtcactatagtcccacatgtttgagttctcgcagatgccacctga

SEQ ID NO: 40738 - DNA, 75 bp, Artificial Sequence
  Synthetic
tgagtgactgtactggcaatagatgccagagatggactgatgaagaggtttctcaagagtttaaaggagtcaatg

SEQ ID NO: 40739 - DNA, 75 bp, Artificial Sequence
  Synthetic
acaatatggttatgaatgaaaacaaatgctttgaacaatgtggggcagctggctgtggttgttttaatatcaatc

SEQ ID NO: 40740 - DNA, 75 bp, Artificial Sequence
  Synthetic
cttcttgcttatttgttcattcttcttttaggagtgttagaccagaggccataagagtgttttcttgtgctgact

SEQ ID NO: 40741 - DNA, 75 bp, Artificial Sequence
  Synthetic
gggtgcacagattgtcctttttggtttatggacctaatagggaaagagaagagatatctctaggctcactaggca

SEQ ID NO: 40742 - DNA, 75 bp, Artificial Sequence
  Synthetic
caaagtttttgtcatgggggaccatttctttatccctagatgcagaaggaataactggcacaaactctattagtt

SEQ ID NO: 40743 - DNA, 75 bp, Artificial Sequence
  Synthetic
tccttgagagtagcaaaggaggatttgctttacatgatgaggctttttctgaaattccacgtgagggtttccttg

SEQ ID NO: 40744 - DNA, 75 bp, Artificial Sequence
  Synthetic
gtgagatcagatgttcttctgaatcagctgccatatcagcacactcttcgtgcatcagggcacccaacttaataa

SEQ ID NO: 40745 - DNA, 75 bp, Artificial Sequence
  Synthetic
agtataaacctatgacagaccaaatagattgtacagcttctctggttgacccatttgctgcctttgtaaaaggct

SEQ ID NO: 40746 - DNA, 75 bp, Artificial Sequence
  Synthetic
ctctacctcaggtgagaaatggaatgacatttacaagttctaaggacaaaaaaactattcaagcatttaatagtg

SEQ ID NO: 40747 - DNA, 75 bp, Artificial Sequence
  Synthetic
ggtccattaaagcaatggtgacgattaacttggatgactatgaaattgaatttttgtccgacatagccaaatgtg

SEQ ID NO: 40748 - DNA, 75 bp, Artificial Sequence
  Synthetic
aagcaacatttgtcaacttaacaggttgctattcttgtaactatggggctagagtgtgcgttagagtgaaaactg

SEQ ID NO: 40749 - DNA, 75 bp, Artificial Sequence
  Synthetic
atagagatgcagattttgttgccactcaggttgaccaagagttccacttagcttttgctgtttggaatggtgttc

SEQ ID NO: 40750 - DNA, 75 bp, Artificial Sequence
  Synthetic
aagactattgccaaacaatacacttcaataaacctgagatagattcaataaccaaatattcatgtggaggtgaag

SEQ ID NO: 40751 - DNA, 75 bp, Artificial Sequence
  Synthetic
aaagaatgctacatataaaaggacttttaatttctttaggtgttcaggatcttagaaattcaacaggtggggctt

SEQ ID NO: 40752 - DNA, 75 bp, Artificial Sequence
  Synthetic
caattgtagtgaatccctctgattcttcttggagtctaactggctgggcaagtggtctgatctcatggttgggag

SEQ ID NO: 40753 - DNA, 75 bp, Artificial Sequence
  Synthetic
gttcttggatggcagttctaaagattattggttttttactattaggattcctgtgcgcattcattatgctgtcct

SEQ ID NO: 40754 - DNA, 75 bp, Artificial Sequence
  Synthetic
taataaaattcttaggcatatcttatctaagaaagaaaaaactaacatgaggtgaacagagtctcacaacaaagc

SEQ ID NO: 40755 - DNA, 75 bp, Artificial Sequence
  Synthetic
ttcaaggatagaacaagaacaaataatcaagagaggaaaatcaaacataaaaaccatgaaacacacacaccaaat

SEQ ID NO: 40756 - DNA, 75 bp, Artificial Sequence
  Synthetic
cacaccacacacacattaaacaaaatgcaacattcattcacactctccctggcagagaatgaaagtggaaaatta

SEQ ID NO: 40757 - DNA, 75 bp, Artificial Sequence
  Synthetic
gagacatttgacacagatcatcctttaaaacactcatctaagatcaagattgaggtttaggtgggatactgaggg

SEQ ID NO: 40758 - DNA, 75 bp, Artificial Sequence
  Synthetic
gaggtttaggtgggatactgagggtttcctcttctttatattattaagttgatgtggtagtgccggtctttgtgt

SEQ ID NO: 40759 - DNA, 75 bp, Artificial Sequence
  Synthetic
acacaaagacggctgaattatgaagattttgttatatgtaaaacaagtggtgctaacacttgctgtgtacaccat

SEQ ID NO: 40760 - DNA, 75 bp, Artificial Sequence
  Synthetic
gtctggttggtctttagaagggactaatcgattgtgtatgagtaatgagtctccattagaaggtttggtttatta

SEQ ID NO: 40761 - DNA, 75 bp, Artificial Sequence
  Synthetic
ctgggaagaccagatgaagaagaagggaatgaccattgatggtttgtcaggatgtcggataggtgaaggtgagct

SEQ ID NO: 40762 - DNA, 75 bp, Artificial Sequence
  Synthetic
gaaagaaatgagcaacaagacaataatgaaaatgatagaagaggttcagctatcaataagtcctctaagattttc

SEQ ID NO: 40763 - DNA, 75 bp, Artificial Sequence
  Synthetic
ttgccataggagtttgaatgagagtggggtttcaatagaatttaatggtttagacgacacagaccctggctatca

SEQ ID NO: 40764 - DNA, 75 bp, Artificial Sequence
  Synthetic
catagtagactgcgacaatcacaagatatatgaagacttgggagtactggtcggagatggatccgtctgggaatc

SEQ ID NO: 40765 - DNA, 75 bp, Artificial Sequence
  Synthetic
aagatataacaaatcattcaatgaagagatcaaactgaagagtgaccagctgagatctgcaatggctgatcttga

SEQ ID NO: 40766 - DNA, 75 bp, Artificial Sequence
  Synthetic
tagattatcagatcttagagtggatgatcagaatgaaataaactccttgataagggaaaatcaaatgctgatgca

SEQ ID NO: 40767 - DNA, 75 bp, Artificial Sequence
  Synthetic
taagatttccaacataactggtgttgcatataattataataatagtctgcaggctttactggctgaggcacttaa

SEQ ID NO: 40768 - DNA, 75 bp, Artificial Sequence
  Synthetic
gagagatacagaatttgatttgatgaaaaaaagagaagaacagctgaagaaagatttaagagagcatcaagaaag

SEQ ID NO: 40769 - DNA, 75 bp, Artificial Sequence
  Synthetic
gataaagaccatagacaatggcaatatcaagaacaatgataaggctatgaagaaagaagctcacactacaacaac

SEQ ID NO: 40770 - DNA, 75 bp, Artificial Sequence
  Synthetic
cccaaaagccttgttgatgacaacagttgctatatccctattgtcaccatcatatgctatcacccaccctagctt

SEQ ID NO: 40771 - DNA, 75 bp, Artificial Sequence
  Synthetic
gttgaacccatacccacatgtaaaaaatagaatagggagtggattgtatcgcttcgacacagaagatgattccac

SEQ ID NO: 40772 - DNA, 75 bp, Artificial Sequence
  Synthetic
atgtaggggtcttgactataatactaactgcttaggatttgatcacatgcttagaccggatagatatcctttctt

SEQ ID NO: 40773 - DNA, 75 bp, Artificial Sequence
  Synthetic
taattcatttgtgatgcatctgactccccttgaagcttacgcagataatatattggagaaggaaggtgacagttg

SEQ ID NO: 40774 - DNA, 75 bp, Artificial Sequence
  Synthetic
tgagatggggaagaataaagattcaaaatgcttagatggtaggagatttatgaaggcatcttgccctcaggggat

SEQ ID NO: 40775 - DNA, 75 bp, Artificial Sequence
  Synthetic
aaatggtgtctattatataaatgacaaaggtaaattgagccactctagatgcaaagagagtgagtatgaaataac

SEQ ID NO: 40776 - DNA, 75 bp, Artificial Sequence
  Synthetic
tgaggattgcgtgttctgtagaaaaataaagaagaaaggttcgaagagcatcatgaaaacctctgtgtctatcca

SEQ ID NO: 40777 - DNA, 75 bp, Artificial Sequence
  Synthetic
agatgcgatatgccaggcaagtcaagaagaatatagaggccctaaagtgccatttaaaggtgtttgtgaagtagg

SEQ ID NO: 40778 - DNA, 75 bp, Artificial Sequence
  Synthetic
ctcagttagctttaagagttgcacaaaatttgtgcaagggtatgagaatgtaccttttgtgacgttcaaaaatta

SEQ ID NO: 40779 - DNA, 75 bp, Artificial Sequence
  Synthetic
tgggaagatgtacattgacaggatgataactaagaacctagagctagtaaacagtgtttcattcatatgttatga

SEQ ID NO: 40780 - DNA, 75 bp, Artificial Sequence
  Synthetic
gcacaaaggacaagatggtactgagatagagctaagagaattgaaaagggttaagatgagtgagtgtaaaaatgt

SEQ ID NO: 40781 - DNA, 75 bp, Artificial Sequence
  Synthetic
taattcatctaaaacaaagcactgcactggagatcaaacattttgtgagaagtatggctgctctggtacttatcc

SEQ ID NO: 40782 - DNA, 75 bp, Artificial Sequence
  Synthetic
tgaagtcacctgcttaactgcacctggctctggaccagttcttgtcaacatacttgggtcatggctaaaaccaca

SEQ ID NO: 40783 - DNA, 75 bp, Artificial Sequence
  Synthetic
atgcttgggttatgagaaggttttggtcaaaagagaaataaaaacatctcttattaccttcaatcaagaatgtga

SEQ ID NO: 40784 - DNA, 75 bp, Artificial Sequence
  Synthetic
aacttgtgtatacaggtgtgaggaggaggggatacgtgtgacatccactggtttcagaataacaacggctgtgtc

SEQ ID NO: 40785 - DNA, 75 bp, Artificial Sequence
  Synthetic
atgctctcatggactatgcttatcaacacatcagagcccgcaaacgactatattgatcccttacccaggtttatc

SEQ ID NO: 40786 - DNA, 75 bp, Artificial Sequence
  Synthetic
atccgcctctggaggtcccataggggtccacatatcacacactgaagactctgtgagtttgcacctcacagtgta

SEQ ID NO: 40787 - DNA, 75 bp, Artificial Sequence
  Synthetic
ttgtgaaccacaggacatttgcaagacattgcattgtttcttttgtctgaatggcctgattaactaccaatgtca

SEQ ID NO: 40788 - DNA, 75 bp, Artificial Sequence
  Synthetic
ctcagtattaagttctgtaatcacctcaatgatgatttcattatcaatttatgttgtgttagtggtcattggaaa

SEQ ID NO: 40789 - DNA, 75 bp, Artificial Sequence
  Synthetic
attactctacatgtgcaaattgatacccaagaagttgaggagtccattcacatggcttagacttttaggtaaatg

SEQ ID NO: 40790 - DNA, 75 bp, Artificial Sequence
  Synthetic
gattatcacccttgtaaaactgtccttggtaaaattgactaggaaaattaaccagacaattggatgggacagcaa

SEQ ID NO: 40791 - DNA, 75 bp, Artificial Sequence
  Synthetic
taatcagagacctgaagttcacttgagagaggttagagttaggagagccttgcctaggtatgccactacagcttt

SEQ ID NO: 40792 - DNA, 75 bp, Artificial Sequence
  Synthetic
tgtgatattcttactgctccctttatcgctaggatgctctgaaactcttatatctaattcaaaacaaaccaaatg

SEQ ID NO: 40793 - DNA, 75 bp, Artificial Sequence
  Synthetic
tgtgcaatccagtggaacaattaagtgttcggtcagtgcaacaatcacattgaaagcaggggtaatcggggcaga

SEQ ID NO: 40794 - DNA, 75 bp, Artificial Sequence
  Synthetic
gtcttgcttcataataaagggaccaatggacaaccagcacaaaacaattcgggtcagaactatatcaagtgaagt

SEQ ID NO: 40795 - DNA, 75 bp, Artificial Sequence
  Synthetic
tgtctgtagggaaggtaatagcttctggaccagtcattatgtgccaaattgtctaagttccagaagatgtcacct

SEQ ID NO: 40796 - DNA, 75 bp, Artificial Sequence
  Synthetic
ggtgggagagtgcactggaaccagatgtcagtcatggaatgatgatgaaatatccatggaatttaaaaatacaaa

SEQ ID NO: 40797 - DNA, 75 bp, Artificial Sequence
  Synthetic
ggacaacatggtcatgaatgaaaacaaatgcttcgagcagtgtggagcgattggctgtggatgtttcaacataaa

SEQ ID NO: 40798 - DNA, 75 bp, Artificial Sequence
  Synthetic
tccatcatgcctgttcgtgcacactactatgagggctgtaagaccagaggcaattagagtgttttcctgtgctga

SEQ ID NO: 40799 - DNA, 75 bp, Artificial Sequence
  Synthetic
ctggattcacagattaacattagaagtggtgggtccagatggtgagaaagaaaggtttacattgggatctttagg

SEQ ID NO: 40800 - DNA, 75 bp, Artificial Sequence
  Synthetic
aaccaaatttttatcatggggaacagtgtcactaagtttagatgctgaagggatatcagggacaaacagtctgag

SEQ ID NO: 40801 - DNA, 75 bp, Artificial Sequence
  Synthetic
ctttctagaaagtagcaaaggtggatttgctatatatgatgagtccttctctgaggtgcctcgagagggtttcct

SEQ ID NO: 40802 - DNA, 75 bp, Artificial Sequence
  Synthetic
aggggaagtgaggtgctcatcagaatcagctgctatagcagctcactcttcatgtctgagagcccccaatttgat

SEQ ID NO: 40803 - DNA, 75 bp, Artificial Sequence
  Synthetic
taagtataagccaatgacagacctagtggaatgcacagcatctctcattgacccgttcgcagcctttactaaggg

SEQ ID NO: 40804 - DNA, 75 bp, Artificial Sequence
  Synthetic
ctctttgccacaagttcgtaatgggatgacatacacgagttcaattgataagaagacagttcaagcttttaatag

SEQ ID NO: 40805 - DNA, 75 bp, Artificial Sequence
  Synthetic
tggatccataaaagctctcataaccatgactatggatgatcatgagatccaattcctgtcagagtcaaagaaatg

SEQ ID NO: 40806 - DNA, 75 bp, Artificial Sequence
  Synthetic
tgatgcaacatttttaaacataagtggttgttactcttgcaattatgggtctcgagtttgtgtgcgcattaaggt

SEQ ID NO: 40807 - DNA, 75 bp, Artificial Sequence
  Synthetic
ggatgggaatgccaatttcttggcgagcaatccccaagagaacttttatttatcattcaacttatggtctgggac

SEQ ID NO: 40808 - DNA, 75 bp, Artificial Sequence
  Synthetic
cagggattattgccaattgatgcacttcaacagtccagaggtagatttaaccaccacttactcctgcgggggaga

SEQ ID NO: 40809 - DNA, 75 bp, Artificial Sequence
  Synthetic
tggtagaatattgcatatcaaaggactcctaatatcgatgagtctagactacggaaggaacaaaactggaggttc

SEQ ID NO: 40810 - DNA, 75 bp, Artificial Sequence
  Synthetic
ttctacactggtaaacccaagcgaacaaggctggaatattcttaactggattagtggattgacaacgtggcttgg

SEQ ID NO: 40811 - DNA, 75 bp, Artificial Sequence
  Synthetic
aggcacctgggttgccattggaaagatcttaggttttttattattgggtgttgtgatattgttaatattaatatc

SEQ ID NO: 40812 - DNA, 75 bp, Artificial Sequence
  Synthetic
attcttgtcccttttaggaaaatccttgcttaagaagacaaaattgatgtgatgactaaactacgaggaacaaaa

SEQ ID NO: 40813 - DNA, 75 bp, Artificial Sequence
  Synthetic
tgatggaaacaatttgaatgtaacgacattgcacaataaagtaaaaagaaagaggaatgtgatcatcacacctca

SEQ ID NO: 40814 - DNA, 75 bp, Artificial Sequence
  Synthetic
cccacatggcagacaatgagtattaaatgtttgtctgtgtgaaggtgtgctggatagacgtatgtgataagtata

SEQ ID NO: 40815 - DNA, 75 bp, Artificial Sequence
  Synthetic
tgtgtgaaggtgtgctggatagacgtatgtgataagtatatacaatttgacaaaaatgaaggccggtctttgtgt

SEQ ID NO: 40816 - DNA, 75 bp, Artificial Sequence
  Synthetic
gaaacacaagaaccatgagagcatgacactgccgaagtaatctcgaatcctgttgaagttatagaaacatcagag

SEQ ID NO: 40817 - DNA, 75 bp, Artificial Sequence
  Synthetic
accccacactcatataggcatgtcctacattctgacaccgagaaggatctctgaaccttagtttctcttcttact

SEQ ID NO: 40818 - DNA, 75 bp, Artificial Sequence
  Synthetic
aatacattctcataacccacacaaagacggcttatacatttacgaattttataactgacgaacaaactagctatg

SEQ ID NO: 40819 - DNA, 75 bp, Artificial Sequence
  Synthetic
aggctattagcgtttttaacaaatgctgtggttgcctatgcagcctactcgatctctagttggggtcctgatggg

SEQ ID NO: 40820 - DNA, 75 bp, Artificial Sequence
  Synthetic
tcagacaatgtctgtttgagcaatgaatcgccactagaagggttagttcattactgggaaagtgggattaagaag

SEQ ID NO: 40821 - DNA, 75 bp, Artificial Sequence
  Synthetic
agaagaatggacaaaaaaacaaagacatgcaaaattgggtccgaacctctaaaggaaatggataacaaaactgtg

SEQ ID NO: 40822 - DNA, 75 bp, Artificial Sequence
  Synthetic
atgtctattattgagcaagtgcaaccatcaatcactaatttgaggctcacttgctcaacaaactctggtgcagag

SEQ ID NO: 40823 - DNA, 75 bp, Artificial Sequence
  Synthetic
ggtgtgtatgtggacttcaatggtatggatgatactgaagctggcagaaacatagtggactgtaagactttcaaa

SEQ ID NO: 40824 - DNA, 75 bp, Artificial Sequence
  Synthetic
attatctctgagctagggattgatgttggagatgggttttcctgggtatctcagtacaatgagtcttatgcgaaa

SEQ ID NO: 40825 - DNA, 75 bp, Artificial Sequence
  Synthetic
gagattagagaaaaagatgagttgataaggaagcttagagagggacaggccaacacagatatactaatgagagat

SEQ ID NO: 40826 - DNA, 75 bp, Artificial Sequence
  Synthetic
gacaaaaatgaaatattgtctttgatcagagagaaccaaatgctccaacacagaatatccaatctaactggagta

SEQ ID NO: 40827 - DNA, 75 bp, Artificial Sequence
  Synthetic
gtgtacaattacaataacagtttgagagcactagaaaatgacatggctcttagagaagaagaacataaaagatca

SEQ ID NO: 40828 - DNA, 75 bp, Artificial Sequence
  Synthetic
agacttgagagcgaagccaaggaaagggctcaagtcaagaacagttcaattatggattttattagtttaaaatct

SEQ ID NO: 40829 - DNA, 75 bp, Artificial Sequence
  Synthetic
atggttgccacagccctagtggccactaccatcttgccatcaattgctgcctctccacaaagcaatcaggtcaat

SEQ ID NO: 40830 - DNA, 75 bp, Artificial Sequence
  Synthetic
gcaatgaacacatacattcatgctagaaacagggtgcatggaggagtcttcaggtatgacactgacgaagatgag

SEQ ID NO: 40831 - DNA, 75 bp, Artificial Sequence
  Synthetic
acctgtagggggttgaattatggatctagatgcatcagctttgatcatatgctcaagccccattattatccattt

SEQ ID NO: 40832 - DNA, 75 bp, Artificial Sequence
  Synthetic
ttcaattcccatgtcatgcacatgacacccttagaagcatatgtcgagaatgaattgactgctgatgaaaattca

SEQ ID NO: 40833 - DNA, 75 bp, Artificial Sequence
  Synthetic
agttgtgagatgggaaagaataagaataacaagtgtctagaaggcagaagcttcattagaggacattgcccaatt

SEQ ID NO: 40834 - DNA, 75 bp, Artificial Sequence
  Synthetic
gggataacaggagttcactatattaatgacaaggggaaaattgtcctatccaaatgcacagagaataattatgag

SEQ ID NO: 40835 - DNA, 75 bp, Artificial Sequence
  Synthetic
atcactgaagactgcatgttctgcagacaaataaaaagaaattcaggggagaaaggtgttgtgaaaacatcagtc

SEQ ID NO: 40836 - DNA, 75 bp, Artificial Sequence
  Synthetic
tccttacaagatgtgatctgtcaaaaagattctatggagtattcagggcctaagatcacagttaaaggagtttgc

SEQ ID NO: 40837 - DNA, 75 bp, Artificial Sequence
  Synthetic
tctatcggcaatattgagtataagaaatgcgcatctttttctcaaaattatgaaaatgtcccttttgttgtcttc

SEQ ID NO: 40838 - DNA, 75 bp, Artificial Sequence
  Synthetic
aaggggaaaggaaagcattatctagaaaagttgataattaacaatgtagaactggttggaaatgtatcatttata

SEQ ID NO: 40839 - DNA, 75 bp, Artificial Sequence
  Synthetic
tgccataaacataaagggcaagacaatgaatcccagcagagagagtacaaaaaggtaaaactgtcggactgtagc

SEQ ID NO: 40840 - DNA, 75 bp, Artificial Sequence
  Synthetic
aatgtggagactggtaagagtggagtctgcactggtgatcacatattttgtcagaagtatacatgctcttcagcc

SEQ ID NO: 40841 - DNA, 75 bp, Artificial Sequence
  Synthetic
agcccaagtgccaaatgttttgtggctcctggttctggtccagtgtttgtcaacataatgggttcatggattaag

SEQ ID NO: 40842 - DNA, 75 bp, Artificial Sequence
  Synthetic
ccacaatgtgtgggttatgagaatgtattagtaagaagagaaactaaggttcagagatccttctcggtgtcagaa

SEQ ID NO: 40843 - DNA, 75 bp, Artificial Sequence
  Synthetic
tgtaggacatgcctatatgagtgtggggtctctgatgtttctataacttcaacaggattcgagattacttcggca

SEQ ID NO: 40844 - DNA, 75 bp, Artificial Sequence
  Synthetic
gtgtcatgctctcatggttcttgtgtttcaactcatcaaagtccttcaaccagcataaagattccttatcctggt

SEQ ID NO: 40845 - DNA, 75 bp, Artificial Sequence
  Synthetic
ttattggcatctacaggaggagatattggggtgtatttgtcccacactggagacactgcaagtgtgcatatgaaa

SEQ ID NO: 40846 - DNA, 75 bp, Artificial Sequence
  Synthetic
ctgcactgcccagcaagagatgtctgtgaaactcatcactgcttcttttgtgtcaaaggcatattgaactatcaa

SEQ ID NO: 40847 - DNA, 75 bp, Artificial Sequence
  Synthetic
tgtcacactattctgagctcaatcgtgtcctcctctgtgatttctctcttattttatgttgccttctctatcctt

SEQ ID NO: 40848 - DNA, 75 bp, Artificial Sequence
  Synthetic
ggtaaactattatactttttccatttgataccaaaaaaactgcgcagccctctaatgtgggtctggctattagtg

SEQ ID NO: 40849 - DNA, 75 bp, Artificial Sequence
  Synthetic
tcatatataatgctaactgcctacaaatcttataaaggtcttaagaggaaggtgaatacttcaataggatggtca

SEQ ID NO: 40850 - DNA, 75 bp, Artificial Sequence
  Synthetic
gaaagacctagtgagacatcattgtctgaagtcagaattggaagagctatcccaagatttgacaggactgtgttc

SEQ ID NO: 40851 - DNA, 75 bp, Artificial Sequence
  Synthetic
ataattcttctactgatcccactggctttgtcatgctcagagtctctgatatcaaattctaaacaggttaagtgt

SEQ ID NO: 40852 - DNA, 75 bp, Artificial Sequence
  Synthetic
gtgcaagacaaaagttccctgaagtgcagcatcacagcaactgtcactctcaaggcaggaataattggagcagaa

SEQ ID NO: 40853 - DNA, 75 bp, Artificial Sequence
  Synthetic
agctgctttgtaatcaaaggccctatggagggacagcataaaacgattatgatcaagacagtttctagtgaggtc

SEQ ID NO: 40854 - DNA, 75 bp, Artificial Sequence
  Synthetic
atttgcagggagggaaatagcttctggaccagccactacatgcctgtgtgtctcagttctaggaggtgtcactta

SEQ ID NO: 40855 - DNA, 75 bp, Artificial Sequence
  Synthetic
gtaggcgaatgtcacaagaataggtgtcaatcctgggctgacagagaagtttcaaaagaatttaaaggagtgagt

SEQ ID NO: 40856 - DNA, 75 bp, Artificial Sequence
  Synthetic
gacaatggcataatgtcagagaataagtgttttgagcaatgcggagcaatgggatgtggctgttttaacatcaat

SEQ ID NO: 40857 - DNA, 75 bp, Artificial Sequence
  Synthetic
ccctcatgcttatttgttcacagctacctgaaaagcacaaggaatgaagctgttagagtgttttcgtgtgcagac

SEQ ID NO: 40858 - DNA, 75 bp, Artificial Sequence
  Synthetic
tgggtgcatagattgacacttgaggtgtcaggaccagatggagaaagggaaactgttgtgttggggtcattaggc

SEQ ID NO: 40859 - DNA, 75 bp, Artificial Sequence
  Synthetic
acgaagtttctaagctgggggacagtgagcttgtcactagatgctgaggggataacaggaactaatgctattagc

SEQ ID NO: 40860 - DNA, 75 bp, Artificial Sequence
  Synthetic
tttttagaaagcagtaaaggaggttttgctctatatgatgaggccctttctgaaatgcctagagaaggatttctg

SEQ ID NO: 40861 - DNA, 75 bp, Artificial Sequence
  Synthetic
ggagaaataagatgttcatcagaatcagcagccattatggctcattcttcttgcctaagagctccaaatctaatt

SEQ ID NO: 40862 - DNA, 75 bp, Artificial Sequence
  Synthetic
aagtataagcctatgactgacatcatagattgcacagctgctctagtagatccatttgctgcattcactaagggt

SEQ ID NO: 40863 - DNA, 75 bp, Artificial Sequence
  Synthetic
tccttgcctcaggtcagaaatgggatgaccttcactagctccattgacaaaaaaactgtgcaagcattcaattca

SEQ ID NO: 40864 - DNA, 75 bp, Artificial Sequence
  Synthetic
gggtcaataaaagcaatgattacgataagtatggatgatcatgaaattcagtttctttctgacttcgggagatgt

SEQ ID NO: 40865 - DNA, 75 bp, Artificial Sequence
  Synthetic
gaatcatccttcataaacataacaggctgctattcatgcgactatggggccagagtttgtgttagaatcaatgca

SEQ ID NO: 40866 - DNA, 75 bp, Artificial Sequence
  Synthetic
gataagccaagtgttttcttagccagacaagataacaatgagttctttatgtcattcaaggttgagcaaggaact

SEQ ID NO: 40867 - DNA, 75 bp, Artificial Sequence
  Synthetic
aaagactactgtcaaattttacactttaactcaccagaagtggaggagagaatgaaatactcttgtggtgctgag

SEQ ID NO: 40868 - DNA, 75 bp, Artificial Sequence
  Synthetic
gaaaaactactcaacataaaaggaatactcatttctttaggagtgagtgatcttagaaatcagactggtggccat

SEQ ID NO: 40869 - DNA, 75 bp, Artificial Sequence
  Synthetic
tccacagttgtgaacccaagtgaaactagctggaatctaagtgggtgggcatctggattattctcctggttagga

SEQ ID NO: 40870 - DNA, 75 bp, Artificial Sequence
  Synthetic
ggaacctggactggagtgcttaaaatactagcttttttgttgttaggtctgctcatcattttgttaattatatct

SEQ ID NO: 40871 - DNA, 75 bp, Artificial Sequence
  Synthetic
ctttctaaaagggtcatctttgcaaccctaggcaagtccaagcttaaataaactgccatctgctaaaaggagact

SEQ ID NO: 40872 - DNA, 75 bp, Artificial Sequence
  Synthetic
cagattaataggttgacagaccacacaaagtaaaatgaaataaagacaaaataaaaaataaaaaataaaataaaa

SEQ ID NO: 40873 - DNA, 75 bp, Artificial Sequence
  Synthetic
ataaaatgaaataaagtaaaagaacaaaaatacaatctcatcaatctccaatcaaaatcaccatcacacaaatcc

SEQ ID NO: 40874 - DNA, 75 bp, Artificial Sequence
  Synthetic
attattcaccacaaggcagccaacacgattagaaaatgatcaagctagaatgtacaagtaggaagaaagaaacaa

SEQ ID NO: 40875 - DNA, 75 bp, Artificial Sequence
  Synthetic
cagactccacaagattcatctaaaacaaattgtagctaatggtcaaacatttggataaggtgaaggtgagattag

SEQ ID NO: 40876 - DNA, 75 bp, Artificial Sequence
  Synthetic
ggtgaaggtgagattagcccatagagtggaattttttgattgaaagttatccagggttgacgccggtctttgtgt

SEQ ID NO: 40877 - DNA, 75 bp, Artificial Sequence
  Synthetic
acgaagcccaaactatggaagaaatactaaacaaacaacaaatccccgagggggtaggtttgtttagacccgaga

SEQ ID NO: 40878 - DNA, 75 bp, Artificial Sequence
  Synthetic
taaaacaatacgatgactctataatggatgtggaaatacccttcttccacatcagtaaatgcgatggttacatga

SEQ ID NO: 40879 - DNA, 75 bp, Artificial Sequence
  Synthetic
ggatcgatcttgacctgaataacggggtcgattactcaaccattggatcatcattaatatcgaccatagaagttc

SEQ ID NO: 40880 - DNA, 75 bp, Artificial Sequence
  Synthetic
ctgataagtctcttcctaatctagtccatgatattgtgttctcacacttggccactagtacagatgttagatttt

SEQ ID NO: 40881 - DNA, 75 bp, Artificial Sequence
  Synthetic
catctgtatttggcgtttattctgactcttatgaccacttatctcccgatttaattctcaagactgctgcggggt

SEQ ID NO: 40882 - DNA, 75 bp, Artificial Sequence
  Synthetic
ctcaccatgttgtggaattcacgacaaatagaggaggtgagagaggtgcatttcaggcttgcaaggataaatttt

SEQ ID NO: 40883 - DNA, 75 bp, Artificial Sequence
  Synthetic
caaaatatcacataccatgtgaaaatcgagcagtgggaagtagagtttctctatttgtaatctctgtgtatgtta

SEQ ID NO: 40884 - DNA, 75 bp, Artificial Sequence
  Synthetic
gaggtgtatggtccaatttggatttaacagatgacgaagtcaatgagcttgtattcagattcagactggcaatag

SEQ ID NO: 40885 - DNA, 75 bp, Artificial Sequence
  Synthetic
ctataatggaagaggcaaaaaaatattatccagaattgactgaagatgagagtgagatgaccaaacaagagagag

SEQ ID NO: 40886 - DNA, 75 bp, Artificial Sequence
  Synthetic
aaatactaggtgttatatcttcaattcagatgaactgggaggttactagctctaaatttcctcactttaaagaaa

SEQ ID NO: 40887 - DNA, 75 bp, Artificial Sequence
  Synthetic
aactatttgaggattttatgactgcttctgctgatgaagagtatttgtctaatatcatatcggaagaactgactg

SEQ ID NO: 40888 - DNA, 75 bp, Artificial Sequence
  Synthetic
catgccaagaagacatgataaaatcaggatttattggaaaggttagtgggattgaagaaaagcttaatcttaatg

SEQ ID NO: 40889 - DNA, 75 bp, Artificial Sequence
  Synthetic
aggctgaatgtgccaggatgatagaggattaccttcagtctagagggaatgaatgtagggataaacttgatagta

SEQ ID NO: 40890 - DNA, 75 bp, Artificial Sequence
  Synthetic
aatcaactgttcagattcctccatggacaatgacagattttatcgaaggtaagtctgtctcttgcctttctggct

SEQ ID NO: 40891 - DNA, 75 bp, Artificial Sequence
  Synthetic
ttgaggttgaaggagatcatcccatgtgcaaaatttggagatcagtcacaatagctgctgctatgggagacattg

SEQ ID NO: 40892 - DNA, 75 bp, Artificial Sequence
  Synthetic
atagagcggatgatgacccaaacacagaattgcagaaagcattagaggggagcattcaaaaaagtgatgaaagaa

SEQ ID NO: 40893 - DNA, 75 bp, Artificial Sequence
  Synthetic
gcagataccacagaataaagcttaatctgactaatgaagagatagtttatggggcaactcttggtgtagaaggga

SEQ ID NO: 40894 - DNA, 75 bp, Artificial Sequence
  Synthetic
aatcacataagaataatgcccaggttgaagagtctagaaatcgtagtaaattagggttctctttagatcatgata

SEQ ID NO: 40895 - DNA, 75 bp, Artificial Sequence
  Synthetic
tcaccaacctagaggagtttattaacaaacatgatttagggttatttgaagagtcagatgattacttcaaccctt

SEQ ID NO: 40896 - DNA, 75 bp, Artificial Sequence
  Synthetic
tccagatggattttgatttaagagaatctgctcagaaaatccaccagccagatctcatcatcagtcaaggagaaa

SEQ ID NO: 40897 - DNA, 75 bp, Artificial Sequence
  Synthetic
atgagttcttggcaaaccataagaaattttgtatgtcaaggttaggttcatggtgtcagatggtttctctagtag

SEQ ID NO: 40898 - DNA, 75 bp, Artificial Sequence
  Synthetic
gagcagaattgtcagcatctgtaaagcagcatgttgggaaaggccagtttgtgatcaagagaattctgaattctc

SEQ ID NO: 40899 - DNA, 75 bp, Artificial Sequence
  Synthetic
ctctatttatgttaataaagccaacgtcttctgtaagtcacatttttgtgtcttttgcattagtaaagtcaaatc

SEQ ID NO: 40900 - DNA, 75 bp, Artificial Sequence
  Synthetic
acatgggagacttatgggaaaatggtgtgtttaagcactacattgatgcaggtgacttatttgtcaccgactttg

SEQ ID NO: 40901 - DNA, 75 bp, Artificial Sequence
  Synthetic
tttcgtacaagttaagtaagttaacaaactggcaaggtctccctctcatggaaagtgccatttgcttctggactg

SEQ ID NO: 40902 - DNA, 75 bp, Artificial Sequence
  Synthetic
aaatatttggctttgagccctggaattcaacatacataatgtcaacagataggagtgggagctcaaaggaggcag

SEQ ID NO: 40903 - DNA, 75 bp, Artificial Sequence
  Synthetic
catctatgatcaaattgactctgttaacattaatggaagataaagctgtaacagaagagatacaaaccatccaaa

SEQ ID NO: 40904 - DNA, 75 bp, Artificial Sequence
  Synthetic
gatatataattatggagggttttgtctctctgccagaactcccaaagcctcataaaatgttatctaaattaccag

SEQ ID NO: 40905 - DNA, 75 bp, Artificial Sequence
  Synthetic
ctgttctgagatctgaacttcaagtttatcttgttctgaggtccctcaggacgatggagagaatatctaagaatc

SEQ ID NO: 40906 - DNA, 75 bp, Artificial Sequence
  Synthetic
cttttcgactacaaaaaaagcagagtcagataacgtggtcaggtctattcaacccactgactggaaattcactaa

SEQ ID NO: 40907 - DNA, 75 bp, Artificial Sequence
  Synthetic
gggatctacagcctctaataagcatttgttataatggttatttcaaaaacaaagaagaagagactgaaccctctg

SEQ ID NO: 40908 - DNA, 75 bp, Artificial Sequence
  Synthetic
cactttcaagactgtacaagaagattatagaattagagcacctctgtccaaaagatgatatgttcttaggttctg

SEQ ID NO: 40909 - DNA, 75 bp, Artificial Sequence
  Synthetic
gtgatccaaaagagcctaaaatgcatgagtttagcaaatcttttctaaagaaatgcactgatcacgggaagacca

SEQ ID NO: 40910 - DNA, 75 bp, Artificial Sequence
  Synthetic
ttctgaggaagatatatgggcaaaactttatgcaacaaattgatacccagattatgagagagataggttcaataa

SEQ ID NO: 40911 - DNA, 75 bp, Artificial Sequence
  Synthetic
ccttagaaaaactagccacacttaaggctagcagtaactttgatgaaaagtggtatgattactcagtgtgcagca

SEQ ID NO: 40912 - DNA, 75 bp, Artificial Sequence
  Synthetic
aagaggattatcatagagagaaagcaatcgttaagatgtctgagtttgctgcctctggaaaaacattagccatag

SEQ ID NO: 40913 - DNA, 75 bp, Artificial Sequence
  Synthetic
aagtctttgacgaatgtatgaagctagtagagaaccgtgggaacatgcacatttgcttgttcaaaaagcaacaac

SEQ ID NO: 40914 - DNA, 75 bp, Artificial Sequence
  Synthetic
atggaggggacagagagatctatgtgcttggtagggaagaaaggattgtgcagtcaattgttgaggctatatcaa

SEQ ID NO: 40915 - DNA, 75 bp, Artificial Sequence
  Synthetic
ggtcaattggcaggttcttcccgtcagacacactgtgtaacccgggtaataagataaaaattcctgaaacacatg

SEQ ID NO: 40916 - DNA, 75 bp, Artificial Sequence
  Synthetic
gaatcagggctagaaaacattgtaagggagctgtctggacatgttcaacttcagacgatgccagaaagtggaatc

SEQ ID NO: 40917 - DNA, 75 bp, Artificial Sequence
  Synthetic
agggtcattttgtaactaagtttgccttgatgttgtgtgagttcacacttccaaaatggtggcctatcataatta

SEQ ID NO: 40918 - DNA, 75 bp, Artificial Sequence
  Synthetic
gaggttgttcaatgtttacaaataaattcatgatgatgaacatgaggtacataagcatcctaagtagacataaag

SEQ ID NO: 40919 - DNA, 75 bp, Artificial Sequence
  Synthetic
acttacaaatagaagatgagttttcaaggacaatattcaaagcattccacggagaagtgaaggtcccttggatgg

SEQ ID NO: 40920 - DNA, 75 bp, Artificial Sequence
  Synthetic
aagagggctctacttatttgaaaacaaaaactggcatgatgcaggggatcctgcatttcacttcatctctcttac

SEQ ID NO: 40921 - DNA, 75 bp, Artificial Sequence
  Synthetic
acaccctccatcaggaatttgtgagatcactttcttttaaaatatttaatacaaaagtcaggccagagatgtctc

SEQ ID NO: 40922 - DNA, 75 bp, Artificial Sequence
  Synthetic
aatcaatagtaatagatatgatgcagggctcagacgatagtagcatgatgatcagcttcccttgttcaaatgagg

SEQ ID NO: 40923 - DNA, 75 bp, Artificial Sequence
  Synthetic
atgagctgatgaaatgtaagatagctgcagcaatttgcttcagaatgaagaagagattaggcgtgtatcttgcaa

SEQ ID NO: 40924 - DNA, 75 bp, Artificial Sequence
  Synthetic
tttacccttcagaaaagtctacatcaaatactgattttgtgatggaatacaattcagaattcttcttccactccc

SEQ ID NO: 40925 - DNA, 75 bp, Artificial Sequence
  Synthetic
aacatgttaggcctactgtgagatgggtagcagcctgctgtaatctgcctgaagttgagactctagttgcaagac

SEQ ID NO: 40926 - DNA, 75 bp, Artificial Sequence
  Synthetic
aagaagaagcatctaatttaatgacctctgtgtcagaagggggtggctctttctctcttgctgcttgcattcagc

SEQ ID NO: 40927 - DNA, 75 bp, Artificial Sequence
  Synthetic
aagctcagtgcactctacattacatgctaatgggaatgggagtcagctccttgtttgaagagtacaaaaaggcca

SEQ ID NO: 40928 - DNA, 75 bp, Artificial Sequence
  Synthetic
taattcggtggaaagacccaggacttggtttcttcctgttagacaatccctattgtgctgggttaggtggattca

SEQ ID NO: 40929 - DNA, 75 bp, Artificial Sequence
  Synthetic
gatttaacttgtataaagcaatctcacaaacaaccctaaaatgtttatattcatatttcatgaaaaaggttagac

SEQ ID NO: 40930 - DNA, 75 bp, Artificial Sequence
  Synthetic
agggaatagagactaatgatggtgccataccagaaagttgttctgtaagcccaggtggtgcaattgttctgagct

SEQ ID NO: 40931 - DNA, 75 bp, Artificial Sequence
  Synthetic
ctgcactaagatggggatctaaacagaagttttacaaactgagggataagttgaatattcctgaagattggatag

SEQ ID NO: 40932 - DNA, 75 bp, Artificial Sequence
  Synthetic
aacaaataaaccaaaatccatcagtcttatacagggcacccagatcaggagaagaagttgttcttaggattgcag

SEQ ID NO: 40933 - DNA, 75 bp, Artificial Sequence
  Synthetic
aaaaagtgcactcaccaggggttgtttcatctctctcaactgggaatgcagttgctaaagtgattgcatcatctg

SEQ ID NO: 40934 - DNA, 75 bp, Artificial Sequence
  Synthetic
tatattttcttagcgcagctattttccaagactctggtagacaagagttttcgatattggatagctctaaataca

SEQ ID NO: 40935 - DNA, 75 bp, Artificial Sequence
  Synthetic
gtttactgcaaaaattgagcaagctagaggggatcaatttcactaatgccattagtgatgaagacttgttatttt

SEQ ID NO: 40936 - DNA, 75 bp, Artificial Sequence
  Synthetic
tatttcccaacattgaggacttgcagtcgctagatagtctagtatacaatagaggtccaatagaaatagttagga

SEQ ID NO: 40937 - DNA, 75 bp, Artificial Sequence
  Synthetic
gaaaacaagctaaagaaaatactcagtccagggtcatagtgtttgaaggaaatagaaacttacgaacaccagctg

SEQ ID NO: 40938 - DNA, 75 bp, Artificial Sequence
  Synthetic
aatacttgattagtgacaagtggtttggaacccagaagagcaagattgggagaactgcatttgatcaggaatggg

SEQ ID NO: 40939 - DNA, 75 bp, Artificial Sequence
  Synthetic
agaaggttacatctattataccttggctgaaagacagccctcaggacacactgtctagctccccattagataacc

SEQ ID NO: 40940 - DNA, 75 bp, Artificial Sequence
  Synthetic
atatccagataagaaatttcttctcaaggatggatcaaaaaccgagaatagtaagagtcactggggcaccaatta

SEQ ID NO: 40941 - DNA, 75 bp, Artificial Sequence
  Synthetic
agaagagatcgggagtgagcaagttatcaatggtcattagagacaatttttcaaaacttggcttcattagagaca

SEQ ID NO: 40942 - DNA, 75 bp, Artificial Sequence
  Synthetic
tagaagatatcacagggacaagtcgcacaaactctgctgagatgctgaaacattttatgttttgtgcgctacaag

SEQ ID NO: 40943 - DNA, 75 bp, Artificial Sequence
  Synthetic
gtccttactcccaagagaggaaactgcagatggtgatagatcttctagggaaatcgaacccgataggtgtgaaag

SEQ ID NO: 40944 - DNA, 75 bp, Artificial Sequence
  Synthetic
acagtgatggaaaatctagatcaaacatcttggcaatattgcagagttatgtttatggagagcctcatattgcaa

SEQ ID NO: 40945 - DNA, 75 bp, Artificial Sequence
  Synthetic
gacaaattgaagatgctggtgcaggcatcataggaggtttcgtggtccctcagaagcccaaaaagatagaaaata

SEQ ID NO: 40946 - DNA, 75 bp, Artificial Sequence
  Synthetic
ccatatatttatattactatggttatggagtctggaggggggtgatggatggaaaacaggttcaaatagagctgg

SEQ ID NO: 40947 - DNA, 75 bp, Artificial Sequence
  Synthetic
ataatgctgtagggagtcctcctgtgattatatccgtgacaatggaggaatcagctgaaccatggcagatttgta

SEQ ID NO: 40948 - DNA, 75 bp, Artificial Sequence
  Synthetic
aaagcatcagatcttgggcagaggatgtaggagccaagaacaatttggatatatcatcaaaaatcaagagaaaga

SEQ ID NO: 40949 - DNA, 75 bp, Artificial Sequence
  Synthetic
cttgtaagtattggatgtttgattttaaaactttttcatcagacaaagcatatggggctcctgtttacatgacga

SEQ ID NO: 40950 - DNA, 75 bp, Artificial Sequence
  Synthetic
agactaagatggttgactttagattaattgatgactcagagataaacattaaagtcagaaaatctactgtcaatt

SEQ ID NO: 40951 - DNA, 75 bp, Artificial Sequence
  Synthetic
tatatgtgaaaaatgatggtagagatgttcacatactatcttattccgcatctgactctgacttaagcccagcca

SEQ ID NO: 40952 - DNA, 75 bp, Artificial Sequence
  Synthetic
gcttaagaatacatgatgaatctaaagatgagatgatggctttgtttaataaagagccaagtaagtcatgggcca

SEQ ID NO: 40953 - DNA, 75 bp, Artificial Sequence
  Synthetic
catgctctcccattcctgcagtaatgatgcataagataattaaggttgttcagggagagctgagaataccatctc

SEQ ID NO: 40954 - DNA, 75 bp, Artificial Sequence
  Synthetic
tagatagtgagaggcttggagaaattatgaagttgtgctgtgaatcctctttaagatcaagaatagggactttgt

SEQ ID NO: 40955 - DNA, 75 bp, Artificial Sequence
  Synthetic
tttcggcccttcctagtgtccagaacacatcaagagtagatgttgatgacttgattgacatagtgctgactgact

SEQ ID NO: 40956 - DNA, 75 bp, Artificial Sequence
  Synthetic
caaaaacagctggatttaaagaaatagtaaaatcactagaaaatgacattaaaaatgagtatgaaatggaagatt

SEQ ID NO: 40957 - DNA, 75 bp, Artificial Sequence
  Synthetic
ttgacctttctgacattgacctgtttggacctgctcactacaaggaattgtcagacttaaacaccatcagtcatc

SEQ ID NO: 40958 - DNA, 75 bp, Artificial Sequence
  Synthetic
ctctgatggatgattatgtggagttctgcatttcaacagttgggaggaaagaactgcgtcggatattggaaacca

SEQ ID NO: 40959 - DNA, 75 bp, Artificial Sequence
  Synthetic
acagatgtaagacaaaagatcatcaactctcaaaagatttgtttttggtgctgggtagaaatcccgacgacatta

SEQ ID NO: 40960 - DNA, 75 bp, Artificial Sequence
  Synthetic
aggtggatgagtataacattcgagagcagttggccgtggaagacgatatgataggataaaatgctcaagtttata

SEQ ID NO: 40961 - DNA, 75 bp, Artificial Sequence
  Synthetic
gcaatgtcttgacacaaagtccgcccataattgaacactttacaataattgataaacaaattcctcaccagaggg

SEQ ID NO: 40962 - DNA, 75 bp, Artificial Sequence
  Synthetic
gcaatgtcttgacacaaagtccgcccataattgaacactttacaataattgataaacaaattcctcacctgaggg

SEQ ID NO: 40963 - DNA, 75 bp, Artificial Sequence
  Synthetic
gcaatgtcttgacacaaagtccgcccataattgaacactttacaataattgataaacaaattcctcacccgaggg

SEQ ID NO: 40964 - DNA, 75 bp, Artificial Sequence
  Synthetic
gcaatgtcttgacacaaagtccgcccataattgaacactttacaataattgataaacaaattcctcaccggaggg

SEQ ID NO: 40965 - DNA, 75 bp, Artificial Sequence
  Synthetic
acactttacaataattgataaacaaattcctcaccagagggaaagtgttcaagaatggggtgactttgtgtcaag

SEQ ID NO: 40966 - DNA, 75 bp, Artificial Sequence
  Synthetic
acactttacaataattgataaacaaattcctcacctgagggaaagtgttcaagaatggggtgactttgtgtcaag

SEQ ID NO: 40967 - DNA, 75 bp, Artificial Sequence
  Synthetic
acactttacaataattgataaacaaattcctcacccgagggaaagtgttcaagaatggggtgactttgtgtcaag

SEQ ID NO: 40968 - DNA, 75 bp, Artificial Sequence
  Synthetic
acactttacaataattgataaacaaattcctcaccggagggaaagtgttcaagaatggggtgactttgtgtcaag

SEQ ID NO: 40969 - DNA, 75 bp, Artificial Sequence
  Synthetic
atggaagaaatactaaacaaacaacaaatccccgagggggtaggattgtttaggccagagataaagcaatatgat

SEQ ID NO: 40970 - DNA, 75 bp, Artificial Sequence
  Synthetic
gattctatcatggatgttgagatacctttcttccacataaccaagtgtgatggatacatgaaaatagatttggat

SEQ ID NO: 40971 - DNA, 75 bp, Artificial Sequence
  Synthetic
ctaaacaatggtgtcgattattcaactattgggtcatcattaatatcaaccattgaagttccagataaatccctt

SEQ ID NO: 40972 - DNA, 75 bp, Artificial Sequence
  Synthetic
cctaatcttgttcatgatgtagtcttctcacatcttgctagcaacactgatgtgagattttcatcagtgtttgga

SEQ ID NO: 40973 - DNA, 75 bp, Artificial Sequence
  Synthetic
tctcacatcttgctagcaacactgatgtgagattttcatcagtgtttggagtgtttgcagattcttatgatcatc

SEQ ID NO: 40974 - DNA, 75 bp, Artificial Sequence
  Synthetic
agagaggagcttttcaagcgtgcaaagataagttctctaaataccacattccttgtgagaacagagctgttggag

SEQ ID NO: 40975 - DNA, 75 bp, Artificial Sequence
  Synthetic
gcagggtctctctttttgtgatttctgtgtatgtcagaggtgtgtggtcaaaccttgatttaacagatgatgagg

SEQ ID NO: 40976 - DNA, 75 bp, Artificial Sequence
  Synthetic
tcaatgagctcgtgtttagattcaggctggcagtggctataatggaggaggcaaaaagatattaccccgaactaa

SEQ ID NO: 40977 - DNA, 75 bp, Artificial Sequence
  Synthetic
cagaagatgagagtgagatgacaaaacaggagagagagattctcggcattgtgtcttcaatacaaatggactgga

SEQ ID NO: 40978 - DNA, 75 bp, Artificial Sequence
  Synthetic
aggagactagcttgaaatttccgcacttcaaggaaaaaatgttcgaggatttcctgacgatgtctgcagatgaag

SEQ ID NO: 40979 - DNA, 75 bp, Artificial Sequence
  Synthetic
aatatctatctggcataatatctgaggagattactgcgtgtcaggaggacatgatgaactcggggttcattggga

SEQ ID NO: 40980 - DNA, 75 bp, Artificial Sequence
  Synthetic
atttggatggaaagtcggtgtcttgtctgtcagggtttgaagtagagggtgatcacccaatgtgtaaaatatgga

SEQ ID NO: 40981 - DNA, 75 bp, Artificial Sequence
  Synthetic
gatcctgatactgagcttaagaaggccttggaaggcagcatacagaagagtgatgagagaagtaggtatcatcgt

SEQ ID NO: 40982 - DNA, 75 bp, Artificial Sequence
  Synthetic
tgttgaaggaaagtctcataaaaacaatgcccaagttgaagagtcaagaaagagaagtaaactcgggttttctct

SEQ ID NO: 40983 - DNA, 75 bp, Artificial Sequence
  Synthetic
agaccacgatataacaaatttagaggaattcatcaacaaacatgatcttgagttatttgcagagtccgatgacta

SEQ ID NO: 40984 - DNA, 75 bp, Artificial Sequence
  Synthetic
ttttaaccctttccagattgatttcgacttaagagagtcagctcaaaaaatacatcagccagatctgatcatgga

SEQ ID NO: 40985 - DNA, 75 bp, Artificial Sequence
  Synthetic
ccagggcgaaaatgagtttttagcaaaccacaagaagttatgcatgtctaagttaggctcttggtgccaaatggt

SEQ ID NO: 40986 - DNA, 75 bp, Artificial Sequence
  Synthetic
ctcattgattggtgctgaattatcagcttcggttaaacaacatgtggggaaaggccaatttgtgatcaaaagagt

SEQ ID NO: 40987 - DNA, 75 bp, Artificial Sequence
  Synthetic
tttgaactcccctctctttatgttaatcaagccaacatcttctgttagtcatatttttgtttcttttgcacttgt

SEQ ID NO: 40988 - DNA, 75 bp, Artificial Sequence
  Synthetic
gaaatctagtcatatgggagatctgtgggacaatggcgtcttcaagcattatattgatgcaggagacttgtttat

SEQ ID NO: 40989 - DNA, 75 bp, Artificial Sequence
  Synthetic
cactgactttatctcatataagctaagcaagctaaccaacctttgcaagtgtttccccctcatggagagtgcaat

SEQ ID NO: 40990 - DNA, 75 bp, Artificial Sequence
  Synthetic
ctgtttttggactgaaatttttggttttgagccctggaattctacgtacataatgtcgactgacaggagtggaag

SEQ ID NO: 40991 - DNA, 75 bp, Artificial Sequence
  Synthetic
tcagactattcagagatatataattatggaaggatttgtatctttgccagaattaccaaaacctcacaaaatgtt

SEQ ID NO: 40992 - DNA, 75 bp, Artificial Sequence
  Synthetic
gtctaaacttccagctgtgctgagatcagaactacaagtatatctagttttaaggtctctaagaacaatggagag

SEQ ID NO: 40993 - DNA, 75 bp, Artificial Sequence
  Synthetic
taaggtctctaagaacaatggagaggatatctagacatccttttagactgcagaaaaaacatagccagatctcct

SEQ ID NO: 40994 - DNA, 75 bp, Artificial Sequence
  Synthetic
ccactaattagcatatgttataatggatacttcaaaaacaaagaggaggaaactgaaccctccgctttgtcaaga

SEQ ID NO: 40995 - DNA, 75 bp, Artificial Sequence
  Synthetic
ctatataagaaaattatagaattagagcatctgtgtccaactgatgatgtctatctaggatcaggtgatccaaaa

SEQ ID NO: 40996 - DNA, 75 bp, Artificial Sequence
  Synthetic
gagccaaagatgcatgagttcagcaggtcatttctaaaaaagtgtactgatcatgggaagaccatattaagaaag

SEQ ID NO: 40997 - DNA, 75 bp, Artificial Sequence
  Synthetic
atctatgggcagaactttctgcagcagatagacactcagattatgagggagattagtactattactctcgaaaag

SEQ ID NO: 40998 - DNA, 75 bp, Artificial Sequence
  Synthetic
ctggcaacattaaaagctagtagtaattttgatgaaaagtggtatgattacgaaaaatgtagcaaagaagattac

SEQ ID NO: 40999 - DNA, 75 bp, Artificial Sequence
  Synthetic
catcgtgagaaggcaattgtcaagatgtctgaatttgctgcatctgggaagacattagccatagaagtttttgat

SEQ ID NO: 41000 - DNA, 75 bp, Artificial Sequence
  Synthetic
gaatgcatgaaattcgtggagagaagaggtaatatgcatatctgtctttttaagaagcaacaacatggtggagat

SEQ ID NO: 41001 - DNA, 75 bp, Artificial Sequence
  Synthetic
agggaaatctatgtcctgggtagagaaggaagaataattcaatccatagtcgaggctatatccagatcaattggt

SEQ ID NO: 41002 - DNA, 75 bp, Artificial Sequence
  Synthetic
aggttctttccatcggacaccctgtgcaatcctggcaacaagatcaaaatacctgaaacacatggaataagagct

SEQ ID NO: 41003 - DNA, 75 bp, Artificial Sequence
  Synthetic
agaaaacactgtaaaggtgctgtatggacttgctcaacatcagatgatgctcggaaatggaatcaaggacacttt

SEQ ID NO: 41004 - DNA, 75 bp, Artificial Sequence
  Synthetic
gtcacaaaatttgctttgatgttatgtgaattcacccttcccaaatggtggccaattatcattaggggatgctca

SEQ ID NO: 41005 - DNA, 75 bp, Artificial Sequence
  Synthetic
atgttcaccaacaagtatatgatgatgaacatgagatatatcagtattctgagcaggcacaaagaactggatatt

SEQ ID NO: 41006 - DNA, 75 bp, Artificial Sequence
  Synthetic
gaagacgaattttctaggactatatttaaagcctttcatggtgaagtgacagtgccatggatggatgcaggggcc

SEQ ID NO: 41007 - DNA, 75 bp, Artificial Sequence
  Synthetic
actttcttaaaaacaaaaacagggatgatgcagggcatcttgcactttacttcatctctcttacacacacttcat

SEQ ID NO: 41008 - DNA, 75 bp, Artificial Sequence
  Synthetic
ttcatctctcttacacacacttcatcaagagtttatcaggtcattgtcatttaaaatcttcaatactaaggtgag

SEQ ID NO: 41009 - DNA, 75 bp, Artificial Sequence
  Synthetic
atgctctaatgaagatgaactaatgaaatgtaagattgccgctgccatttgctttaggataaagaagagattggg

SEQ ID NO: 41010 - DNA, 75 bp, Artificial Sequence
  Synthetic
agttttcttggccatttacccttctgaaaaatctacttctaacactgactttgtaatggaatataattcagagtt

SEQ ID NO: 41011 - DNA, 75 bp, Artificial Sequence
  Synthetic
cttcttccattctcagcatgtccgtccgacagttagatggatagctgcatgttgtaatcttcctgaggtagagac

SEQ ID NO: 41012 - DNA, 75 bp, Artificial Sequence
  Synthetic
tctagttgccagacaagaagaggcttctaacctaatgacttctgtgtcagaaggcggaggctcattttctttggc

SEQ ID NO: 41013 - DNA, 75 bp, Artificial Sequence
  Synthetic
tctaacctaatgacttctgtgtcagaaggcggaggctcattttctttggcagcttgtatccagcaagcccaatgc

SEQ ID NO: 41014 - DNA, 75 bp, Artificial Sequence
  Synthetic
aaagatcctggtttgggattctttctgctagacaatccttattgtgcaggattaggaggatttagatttaacctg

SEQ ID NO: 41015 - DNA, 75 bp, Artificial Sequence
  Synthetic
tataaagctattgctcagacaccactaaaatgtctttactcgtacttcatgaagaaggttagacatggcttagaa

SEQ ID NO: 41016 - DNA, 75 bp, Artificial Sequence
  Synthetic
actaatgatggaacaattccagaaagctgctcagttagtccaggaggtgctattgtgttaagttctgcacttagg

SEQ ID NO: 41017 - DNA, 75 bp, Artificial Sequence
  Synthetic
tggggatcaaaacagaagttttacaaacttagagataagctaaatatccctgaagactggattgatcagattaac

SEQ ID NO: 41018 - DNA, 75 bp, Artificial Sequence
  Synthetic
caaaacccatctatattatatagagctccgagatctggtgaagaagtcattcttaggattgctgaaaaagtgcac

SEQ ID NO: 41019 - DNA, 75 bp, Artificial Sequence
  Synthetic
tcacccggagttgtttcttccttgtcaacaggtaatgcagtggctaaagtcattgcctcatctgtatacttccta

SEQ ID NO: 41020 - DNA, 75 bp, Artificial Sequence
  Synthetic
agtgcggctatattccaggattctggcaggcaagaattctctattctagatgactcaaagtacagcttactgcag

SEQ ID NO: 41021 - DNA, 75 bp, Artificial Sequence
  Synthetic
aagttaagcaagcttgaaggaattaatcttactaatgcaatcagtgatgaggacttattgttcttatttccaaat

SEQ ID NO: 41022 - DNA, 75 bp, Artificial Sequence
  Synthetic
attgaagatctgcaatctcttgacagcctagtgtacaatcgaggagctattgagattgtaaaaagaaaacagata

SEQ ID NO: 41023 - DNA, 75 bp, Artificial Sequence
  Synthetic
aaagagaacacacagtctagagtgatagtctttgaggggaatcgaaatctcagaactcccgcggagtatctaata

SEQ ID NO: 41024 - DNA, 75 bp, Artificial Sequence
  Synthetic
agtgataaatggtttgggacccaaaaaagtaagattggaagaacagcatttgaccaagaatgggttaaagtcaca

SEQ ID NO: 41025 - DNA, 75 bp, Artificial Sequence
  Synthetic
aggtgcgccaataaagaaaagatcaggtgtcagtaaattgtcaatggtcataagggacaacttctcaaaattagg

SEQ ID NO: 41026 - DNA, 75 bp, Artificial Sequence
  Synthetic
attcattagagatattgaagatataactgggacaagtagaacaaattctgctgagttactcaaacacttcatgtt

SEQ ID NO: 41027 - DNA, 75 bp, Artificial Sequence
  Synthetic
ctgtgctctgcaggggccatactctcaagaaagaaaacttcagatggtgatggacctcttgaacaaatcaaatcc

SEQ ID NO: 41028 - DNA, 75 bp, Artificial Sequence
  Synthetic
cataggcatcaaggacagtgatgggaaatcacggtcaaacattttggcaattttacagagttatgtgtatggaga

SEQ ID NO: 41029 - DNA, 75 bp, Artificial Sequence
  Synthetic
ttttacagagttatgtgtatggagagccacatattgcacggcaaattgaggatgctggtgctggcattatcggag

SEQ ID NO: 41030 - DNA, 75 bp, Artificial Sequence
  Synthetic
gatttgtagtcccgcaaaaacctaaaaagattgaaaacacagtatattattatgggtatggtgtatggagagggg

SEQ ID NO: 41031 - DNA, 75 bp, Artificial Sequence
  Synthetic
tgatggatggaaagcaggtgcaaattgagcttgataatgcagtgggcagccctcctgttataatctctgtcacta

SEQ ID NO: 41032 - DNA, 75 bp, Artificial Sequence
  Synthetic
tggaagaatctgctgagccttggcagatatgcaagagcataaggtcctgggctgaagatgtgggtgcaaagaata

SEQ ID NO: 41033 - DNA, 75 bp, Artificial Sequence
  Synthetic
atttggacatctccccaaagataaagaagaggacttgtaagtactggatgtttgattttaaaacattttcttctg

SEQ ID NO: 41034 - DNA, 75 bp, Artificial Sequence
  Synthetic
ttcagactaattgatgatgcagaaataagtataaaagtcagaaaatccactgtaaatttgtatatcagaaatgat

SEQ ID NO: 41035 - DNA, 75 bp, Artificial Sequence
  Synthetic
ggcagggatattcatatactttcttactcagcatcagattcagatctcagccctgccagcttgagaattaacgat

SEQ ID NO: 41036 - DNA, 75 bp, Artificial Sequence
  Synthetic
gaatctaaggatgaaatgatggtgttattcaataaagaacccagcaagtcttgggcgtcatgctcaccaatcccg

SEQ ID NO: 41037 - DNA, 75 bp, Artificial Sequence
  Synthetic
gccatcatgatgcacaagatcatcaaagttgtccaaggagaactcaaaatatcgtcactagacagtggcagactg

SEQ ID NO: 41038 - DNA, 75 bp, Artificial Sequence
  Synthetic
ggagagatcatgaaattgtgctgtgaatcatcattaagatctcgaattggaactctgttctctgctcttccaagt

SEQ ID NO: 41039 - DNA, 75 bp, Artificial Sequence
  Synthetic
aactctgttctctgctcttccaagtgtgcaaaacacctctagagtggatgttgatgatctaatagatattgtcct

SEQ ID NO: 41040 - DNA, 75 bp, Artificial Sequence
  Synthetic
gactgactcaaaaacagccggctttagagaaatagtgcagtcactagagaatgacataaaagatgagtatgaggt

SEQ ID NO: 41041 - DNA, 75 bp, Artificial Sequence
  Synthetic
ggaagactttgacttgtctgacatagacttgttcggaccagcacattataaagaactgtcagacctaaataccat

SEQ ID NO: 41042 - DNA, 75 bp, Artificial Sequence
  Synthetic
aagtcatcctctgatggatgactatgtggagttttgcatatcaacagttggtcgaaaggaattgagacgagtgtt

SEQ ID NO: 41043 - DNA, 75 bp, Artificial Sequence
  Synthetic
ggagaccaacagatgtaaaactaaagacctacagttgtctaaggatctctttttagtattaggcaggaacccaga

SEQ ID NO: 41044 - DNA, 75 bp, Artificial Sequence
  Synthetic
aacccagatgatattaaagtggatgagtacaacttaagagagcaaatggcagtggaagacgacatgataggataa

SEQ ID NO: 41045 - DNA, 75 bp, Artificial Sequence
  Synthetic
acgaaacacaaagctcctcaaggattgttaactagtgaataactacttcaagatgtcttatgaaaaacttgctgt

SEQ ID NO: 41046 - DNA, 75 bp, Artificial Sequence
  Synthetic
tgatattgccggccatgagattgatgccgacaccattaaggcctgggttcaagcttttgcttaccagggttttga

SEQ ID NO: 41047 - DNA, 75 bp, Artificial Sequence
  Synthetic
tgcaaaaagggtgatggaacttctcgtagagagaggtggagatgactgggttgaagatgccaagcagatgattat

SEQ ID NO: 41048 - DNA, 75 bp, Artificial Sequence
  Synthetic
cctgtgccttacaagggggaataagccctcaaagatgatggtgaagatgtctgagaaggggaagaaaatcgttca

SEQ ID NO: 41049 - DNA, 75 bp, Artificial Sequence
  Synthetic
ggcccttgttaagagatattctctaaaagagggcaacccttccagggatgatctgacactatctagggtgactgc

SEQ ID NO: 41050 - DNA, 75 bp, Artificial Sequence
  Synthetic
tgctcttgctggctacacttgccaggccaccgagtatgtagaagagtttttgcctgttactggaaaaaacatgga

SEQ ID NO: 41051 - DNA, 75 bp, Artificial Sequence
  Synthetic
tgacttatccaaaaattacccaagggcaatgatgcaccctagctttgctgggctcattgaccccaaacttcctcc

SEQ ID NO: 41052 - DNA, 75 bp, Artificial Sequence
  Synthetic
agatgtgctgtcaacaatttgtgacgcatttagtctcttcatggtccagttctctaggaccattaatcccagaaa

SEQ ID NO: 41053 - DNA, 75 bp, Artificial Sequence
  Synthetic
cagagggctctctgtatctgaggtggcaagcacctttgacaggccgatgaatgctgccatgaacagctcattcat

SEQ ID NO: 41054 - DNA, 75 bp, Artificial Sequence
  Synthetic
cagcggtgagcagagaaagtcttttctcagaaaccttggcattctggatgagaacatgcagccatccaaccctgt

SEQ ID NO: 41055 - DNA, 75 bp, Artificial Sequence
  Synthetic
gaaggctgccgccaaggttttccggggtttgaaataatctgccccattgataatactaattagcgtaattgcatt

SEQ ID NO: 41056 - DNA, 75 bp, Artificial Sequence
  Synthetic
ttaattggttttaaattccacttataatttgactctaattttccactcccacctttcacaatcaaattaattgaa

SEQ ID NO: 41057 - DNA, 75 bp, Artificial Sequence
  Synthetic
ataaattaaataaaacagaattaaattaatcaaaattaattgatcaaaattaatcacatagatcatcccacctta

SEQ ID NO: 41058 - DNA, 75 bp, Artificial Sequence
  Synthetic
atctcccccaccccacctggcagctggtccgtctacttccatttcttcttctgagtctaggtctgaatcccatga

SEQ ID NO: 41059 - DNA, 75 bp, Artificial Sequence
  Synthetic
atctgcaatcctagtgtatctagggctcatagtgtgaagtggtgtccactttctattgcccagtaagtgaggagt

SEQ ID NO: 41060 - DNA, 75 bp, Artificial Sequence
  Synthetic
tattacttctgataattctttaacatagtcatacaaagaagaatggaagtctgattcatagtaatcataaggtaa

SEQ ID NO: 41061 - DNA, 75 bp, Artificial Sequence
  Synthetic
tgcagttagcattctaaggatctgtacataagctatctccttttcaatattttgacctgtaaaattcaaacaggg

SEQ ID NO: 41062 - DNA, 75 bp, Artificial Sequence
  Synthetic
tatatctctttcacctagctctctaatcattttcttgtataaattaactaaagagtcatcaatttgagccccatc

SEQ ID NO: 41063 - DNA, 75 bp, Artificial Sequence
  Synthetic
cccactcctcataatcaaagtcattaagaaacatttctcttcccagttgaattcataactctcaatcaaggatag

SEQ ID NO: 41064 - DNA, 75 bp, Artificial Sequence
  Synthetic
tttaaagaaagctaatgtaggaacaccaagaggccagctgagagcttctttaaggtttggctcagaccacttaag

SEQ ID NO: 41065 - DNA, 75 bp, Artificial Sequence
  Synthetic
ctgtctttccaggttaaggtgtgaaatcttctctatagttgtatcaaaaaaagatggagatttccccttaacctg

SEQ ID NO: 41066 - DNA, 75 bp, Artificial Sequence
  Synthetic
aagaaatggctttccccaggatcttggaagttgtcctttgtccagaaagcttcttaacctaaaagaggtcttatc

SEQ ID NO: 41067 - DNA, 75 bp, Artificial Sequence
  Synthetic
tgatactgtaaatgaagagcaaggaaattctgctcctttgtatctacatattggtgttccccaataaccattata

SEQ ID NO: 41068 - DNA, 75 bp, Artificial Sequence
  Synthetic
ttggtgttccccaataaccattatatgctgaatactcaacatatacctttgatctgtctgttgcagacctagtta

SEQ ID NO: 41069 - DNA, 75 bp, Artificial Sequence
  Synthetic
tcaaaaacgtaattcagcatgttagacatggtttactttcgtcactatttcgatctcaagaggggactttgtgtt

SEQ ID NO: 41070 - DNA, 75 bp, Artificial Sequence
  Synthetic
atcgatcaagactcatgttccgtccagttagcgagagcattaaggaaccacatgtgggctaagttggcgaagggt

SEQ ID NO: 41071 - DNA, 75 bp, Artificial Sequence
  Synthetic
acttcagtgatgaacgggtttcagggtataccccagatgtcaacagctccgaatggagtgaatcacgctatgata

SEQ ID NO: 41072 - DNA, 75 bp, Artificial Sequence
  Synthetic
ctccggaggagcaataagagggataaagcatgtcattatagtcctaatcccgggtgattcaagcattgttacaag

SEQ ID NO: 41073 - DNA, 75 bp, Artificial Sequence
  Synthetic
ttatatgataagaagacatgagtcttgtttgctttgtgcatcgggctcctataattatggttggttttttgtacc

SEQ ID NO: 41074 - DNA, 75 bp, Artificial Sequence
  Synthetic
ttgcaactaatggttacttaatatctaactttgatgagtcatcctgtgtattcgtctcagaatcagccatttgta

SEQ ID NO: 41075 - DNA, 75 bp, Artificial Sequence
  Synthetic
aagcatgtcattatagtcctaatcccgggtgattcaagcattgttacaaggtctcgactattggacagacttgtt

SEQ ID NO: 41076 - DNA, 75 bp, Artificial Sequence
  Synthetic
ccttggtgtctgggactatgggcaacaagtttattctgtcaaaaggtaatatcgttgcaaattgtgcttctatac

SEQ ID NO: 41077 - DNA, 75 bp, Artificial Sequence
  Synthetic
tcatgcctcaggggagggaatcacctatagtcaatgtatagaaaattggaaatccttcgcaggaattcgatttaa

SEQ ID NO: 41078 - DNA, 75 bp, Artificial Sequence
  Synthetic
caagaaagtggacacgaactttatttatcagcaaggtatgctcctgggcctggggattctcgagcacttatttag

SEQ ID NO: 41079 - DNA, 75 bp, Artificial Sequence
  Synthetic
ctcaaggacaattaggctggttggagaataaggatattgtagacatagaagttgatgatgctgagcaattcaata

SEQ ID NO: 41080 - DNA, 75 bp, Artificial Sequence
  Synthetic
aacaccgtactgcatttacatgtcgaaacagattgttgtgtaatacccatgagcgaccatccaagggtcccaggt

SEQ ID NO: 41081 - DNA, 75 bp, Artificial Sequence
  Synthetic
ctcagaaaggtcgttataccaagaaatagttgtacaaatcctttgatctacgacagtaaccctattattgagaaa

SEQ ID NO: 41082 - DNA, 75 bp, Artificial Sequence
  Synthetic
aatttggatcctgctcgctaaagcagtgactgctcctgatactgcagccgactcggaaatgaggagatggattaa

SEQ ID NO: 41083 - DNA, 75 bp, Artificial Sequence
  Synthetic
atagttgtacaaatcctttgatctacgacagtaaccctattattgagaaagacgcagtcagactttataaccaga

SEQ ID NO: 41084 - DNA, 75 bp, Artificial Sequence
  Synthetic
ttgttgctaatttactgctgtaaaagacgctaccgacagacattcaagcataatactaaggtcgatccgacattt

SEQ ID NO: 41085 - DNA, 75 bp, Artificial Sequence
  Synthetic
tggctgtgtccggggttccgaaagacaagaaagattcccatcgtggcctcactaaccagcgtaaatccctgaagc

SEQ ID NO: 41086 - DNA, 75 bp, Artificial Sequence
  Synthetic
aaagtttgaaaaagaccacctaaatgaggtctccgctttaattggcgacgatgatatcaatagctttatcactga

SEQ ID NO: 41087 - DNA, 75 bp, Artificial Sequence
  Synthetic
ttcatggtggcactcatcttggacatcaaacgatccccagggaacaagcctagaattgctgaaatgatttgtgat

SEQ ID NO: 41088 - DNA, 75 bp, Artificial Sequence
  Synthetic
accaggacctggaatacgatgttatcatgtttatgatcacagcggtgaagaggttaagggaatcgaagatgctga

SEQ ID NO: 41089 - DNA, 75 bp, Artificial Sequence
  Synthetic
caaactgcaacaaatagtggcgaggactgactccaattattataattaaagaaaacttagggctcaggtagtcca

SEQ ID NO: 41090 - DNA, 75 bp, Artificial Sequence
  Synthetic
ccggagagttaacaactattgaatcccttatgatgctatatcaacagatgggtgaaacagcaccgtacatggtta

SEQ ID NO: 41091 - DNA, 75 bp, Artificial Sequence
  Synthetic
aaatacccaatgggaggggtggaggggtattgtcagaagttatggactattagcaccataccttatctgtacttg

SEQ ID NO: 41092 - DNA, 75 bp, Artificial Sequence
  Synthetic
ttctggaaaattctgttcagaacaaatttagtgcaggatcctacccactgctctggagttatgctatgggagttg

SEQ ID NO: 41093 - DNA, 75 bp, Artificial Sequence
  Synthetic
ctctggagttatgctatgggagttggtgttgaacttgaaaactccatgggagggttaaatttcggtagatcctac

SEQ ID NO: 41094 - DNA, 75 bp, Artificial Sequence
  Synthetic
ccgtacatcaccaagtcatagatgtcttgacaccgctcttcaaaattattggagatgagattgggttacggttgc

SEQ ID NO: 41095 - DNA, 75 bp, Artificial Sequence
  Synthetic
aatgacaaacctatcttgatagatcagtattcatgttccctgacatatctaagaagaggctcaatcaagcagata

SEQ ID NO: 41096 - DNA, 75 bp, Artificial Sequence
  Synthetic
agattgagagtggaccccgggttcatcactgatgctgttggatgcttagaaaaacaatctctaaggaaaagtcct

SEQ ID NO: 41097 - DNA, 75 bp, Artificial Sequence
  Synthetic
atctctaaggcctcagaattgaaatcagaatttgatccaccgaaagatgatctggctacactcctgagccagcta

SEQ ID NO: 41098 - DNA, 75 bp, Artificial Sequence
  Synthetic
gccgagcttggcatcaccaaggaagaggctcagctagtgtcagaaatagcatccaagacaacggaggaccggacg

SEQ ID NO: 41099 - DNA, 75 bp, Artificial Sequence
  Synthetic
aagatccgaagtcactaatcaacaacccccaactatcaacaagaggtccgaaaacccaggaggagacaaatactc

SEQ ID NO: 41100 - DNA, 75 bp, Artificial Sequence
  Synthetic
catccacttcaatgatgaacgattttcagggtacacccctgatgtcaatagctccgaatggagtgaatcacgcta

SEQ ID NO: 41101 - DNA, 75 bp, Artificial Sequence
  Synthetic
agataatcaagcaatactttctaaactggataccttattactgcttaaaggagagactgattcaattaagaaaca

SEQ ID NO: 41102 - DNA, 75 bp, Artificial Sequence
  Synthetic
actcaatacccaggtgactcttcttatttagattgggcaagtgacccttattctgccaatctgccctgtgtccag

SEQ ID NO: 41103 - DNA, 75 bp, Artificial Sequence
  Synthetic
aatcaatatgctaaccgctatctcagacggagtgtatggtaaaacttatttgctagtgcctgattatattgaagg

SEQ ID NO: 41104 - DNA, 75 bp, Artificial Sequence
  Synthetic
ctttgatatcaagaacatcagagataatcaatatgctaaccgctatctcagacggagtgtatggtaaaacttatt

SEQ ID NO: 41105 - DNA, 75 bp, Artificial Sequence
  Synthetic
gctccgaatggagtgaatcacgctatgatacccagaccattcaagatgatggaaacgacgatgaccggaaatcga

SEQ ID NO: 41106 - DNA, 75 bp, Artificial Sequence
  Synthetic
gtctttgagatagggtttatcaaacggtggctgaatgacatgcctttactccagacaaccaactatatggtcctc

SEQ ID NO: 41107 - DNA, 75 bp, Artificial Sequence
  Synthetic
cacggtttattcctaggagagggttcaggtgcaatgctgacagtatataaagagctattgaaattgtcaagatgt

SEQ ID NO: 41108 - DNA, 75 bp, Artificial Sequence
  Synthetic
gtccaacaatcccgatcaaccattcatccgaccaaccgttctatctctaaatggcagaagagcaggcctatcatg

SEQ ID NO: 41109 - DNA, 75 bp, Artificial Sequence
  Synthetic
cgaacttcacccgggttagtagggcacatcctttcatcaaagcagacagcatgtgtgcagtctttgcatggacct

SEQ ID NO: 41110 - DNA, 75 bp, Artificial Sequence
  Synthetic
aggccaagaggatggaaccgcaagcatgcaagaagaagaggtctctcaggatctcgatgaatcacacgagccagc

SEQ ID NO: 41111 - DNA, 75 bp, Artificial Sequence
  Synthetic
aaaaatatcaagggggatgacaatctaaacgagttctaccagatgatcaagagtatcacacatgcttaagctgta

SEQ ID NO: 41112 - DNA, 75 bp, Artificial Sequence
  Synthetic
ccaaacgtcatgggaaccctttggaggggggcagttgccttcttatgggcggttgacattacctctagatccaag

SEQ ID NO: 41113 - DNA, 75 bp, Artificial Sequence
  Synthetic
gtactccaaaataatccgggatgtggagagagcaacactgcacttgtggaggcagagcagccagctaacgatgat

SEQ ID NO: 41114 - DNA, 75 bp, Artificial Sequence
  Synthetic
tttacatatggtccggttatactgaacggagacggtatggattattatgaaagcccacttttggactccggatgg

SEQ ID NO: 41115 - DNA, 75 bp, Artificial Sequence
  Synthetic
ttgctttactcgggagatttatacgaaattaccaggatagttcgaaatctaaaagccagccacataatttttgac

SEQ ID NO: 41116 - DNA, 75 bp, Artificial Sequence
  Synthetic
ccagggaatcaagtggaaattgttatttacctattcaaacatcccagattatggataaagatgtccttactgagt

SEQ ID NO: 41117 - DNA, 75 bp, Artificial Sequence
  Synthetic
caagtcagagtgatagatccaggactcggcgatcgaaaagatgaatgtttcatgtatatttttctactgggtata

SEQ ID NO: 41118 - DNA, 75 bp, Artificial Sequence
  Synthetic
agcactgaggattctggcgaagattattccgagggaaatgcttcatctaactggggatattctttcggccttaaa

SEQ ID NO: 41119 - DNA, 75 bp, Artificial Sequence
  Synthetic
catgtatatttttctactgggtataatagaagacaacgatggcctcggacccccgattggaagaacatttggatc

SEQ ID NO: 41120 - DNA, 75 bp, Artificial Sequence
  Synthetic
ccagatatctgctagcagtcttggattgattcactcggatatcgagtcactacctgataaggacatcattgaaaa

SEQ ID NO: 41121 - DNA, 75 bp, Artificial Sequence
  Synthetic
tatgatatatcccggggcgatcatgcaattgtttattatgtttatgacccaatccggacgatttcttatacatac

SEQ ID NO: 41122 - DNA, 75 bp, Artificial Sequence
  Synthetic
ctcagaaaggtcgtcataccaagaaatatttgtacaaatcctttgatttatgacagtaaccctattattgagaaa

SEQ ID NO: 41123 - DNA, 75 bp, Artificial Sequence
  Synthetic
ctctgcagttcccacacaatcccgaaggtaagacagaggatccggagtgtggatccattaaaaagggcacaggag

SEQ ID NO: 41124 - DNA, 75 bp, Artificial Sequence
  Synthetic
tagggtcagtgttagtaatcaagatcatgcccgctagtggcgactgggttcaaggatttattttgtatgcactcc

SEQ ID NO: 41125 - DNA, 75 bp, Artificial Sequence
  Synthetic
gatagttgctggatcgacaaatggtgcaacccaatctgcactcaagtcaactgggggatcatcagggccaagtgt

SEQ ID NO: 41126 - DNA, 75 bp, Artificial Sequence
  Synthetic
ttcagccgcaagaaaaaccaagcctactctgctgattattgtaaactgaaaattgaaaagatgggattagtgttt

SEQ ID NO: 41127 - DNA, 75 bp, Artificial Sequence
  Synthetic
gcaatgaatgcaaagatgacccagaaatgcaaacccgagtctggtacgcaactccctcccaggacctcaaatgag

SEQ ID NO: 41128 - DNA, 75 bp, Artificial Sequence
  Synthetic
tcaccattcaagttgagggagatgtctgttcaagccgaggtaatttgagcatgttcaaagatcaccaagtgacat

SEQ ID NO: 41129 - DNA, 75 bp, Artificial Sequence
  Synthetic
aatatattcaaaagaggaaatagcatctatagtaaaataacagacggggtcaaaaaatgcttaaacgatattaat

SEQ ID NO: 41130 - DNA, 75 bp, Artificial Sequence
  Synthetic
ctacggcaaatgtcgacattaacccagagctccgccctataatagggagggattcgggaagagcactggcggaag

SEQ ID NO: 41131 - DNA, 75 bp, Artificial Sequence
  Synthetic
agagctccgccctataatagggagggattcgggaagagcactggcggaagttctcaagcaacccgcatcatcccg

SEQ ID NO: 41132 - DNA, 75 bp, Artificial Sequence
  Synthetic
tcagaatttataatgatgttatcatcagcgatgatcagggtcttttcaaaattctctaaatcatcagttcatgaa

SEQ ID NO: 41133 - DNA, 75 bp, Artificial Sequence
  Synthetic
atcaggtatctttgggatctaattgatggatttttcctggacttaggaaattcgacctatcaactggtagctctg

SEQ ID NO: 41134 - DNA, 75 bp, Artificial Sequence
  Synthetic
gttggctaaggatagataaattattggatattttattaaaaacttagggtcaatgatcctaccttagagaacaag

SEQ ID NO: 41135 - DNA, 75 bp, Artificial Sequence
  Synthetic
caggtggcacttttcggggaaatgtgcgcggaacccctatttgtttatttttctaaatacattcaaatatgtatc

SEQ ID NO: 41136 - DNA, 75 bp, Artificial Sequence
  Synthetic
gctagccttctcaagagcctcacattgttcaagaggactcgggaccaacccccacttgcctcgggctccggagga

SEQ ID NO: 41137 - DNA, 75 bp, Artificial Sequence
  Synthetic
gcgcggaacccctatttgtttatttttctaaatacattcaaatatgtatccgctcatgagacaataaccctgata

SEQ ID NO: 41138 - DNA, 75 bp, Artificial Sequence
  Synthetic
ctgtagcatttactaatccgttaacaggctcaaaaatgctttcactatcgcttaaaagcaattataaaaaactta

SEQ ID NO: 41139 - DNA, 75 bp, Artificial Sequence
  Synthetic
ttctaaatacattcaaatatgtatccgctcatgagacaataaccctgataaatgcttcaataatattgaaaaagg

SEQ ID NO: 41140 - DNA, 75 bp, Artificial Sequence
  Synthetic
aagagtatgagtattcaacatttccgtgtcgcccttattcccttttttgcggcattttgccttcctgtttttgct

SEQ ID NO: 41141 - DNA, 75 bp, Artificial Sequence
  Synthetic
gtgtcgcccttattcccttttttgcggcattttgccttcctgtttttgctcacccagaaacgctggtgaaagtaa

SEQ ID NO: 41142 - DNA, 75 bp, Artificial Sequence
  Synthetic
aggttcattggcccccattttgcccaccacctatcccgatggtaggctagtaccccaagtcagagtgatagatcc

SEQ ID NO: 41143 - DNA, 75 bp, Artificial Sequence
  Synthetic
taataattaatcaaaacttagggtccaggacgtagcaagccaacaggccaaccaagtccaccaatccgaggccgg

SEQ ID NO: 41144 - DNA, 75 bp, Artificial Sequence
  Synthetic
aagatgctgaagatcagttgggtgcacgagtgggttacatcgaactggatctcaacagcggtaagatccttgaga

SEQ ID NO: 41145 - DNA, 75 bp, Artificial Sequence
  Synthetic
acgagtgggttacatcgaactggatctcaacagcggtaagatccttgagagttttcgccccgaagaacgttttcc

SEQ ID NO: 41146 - DNA, 75 bp, Artificial Sequence
  Synthetic
aatgatgagcacttttaaagttctgctatgtggcgcggtattatcccgtattgacgccgggcaagagcaactcgg

SEQ ID NO: 41147 - DNA, 75 bp, Artificial Sequence
  Synthetic
agatccaaaacccaaacacacacccaacaagatctcccccaacaacacagcaccaaatccgccgagtccaagacc

SEQ ID NO: 41148 - DNA, 75 bp, Artificial Sequence
  Synthetic
ctatgtggcgcggtattatcccgtattgacgccgggcaagagcaactcggtcgccgcatacactattctcagaat

SEQ ID NO: 41149 - DNA, 75 bp, Artificial Sequence
  Synthetic
attgtggtaaggcgaactgcaggtgtcaaggaacaactggtattttacaataacaccccattgcacatcttaact

SEQ ID NO: 41150 - DNA, 75 bp, Artificial Sequence
  Synthetic
gacttggttgagtactcaccagtcacagaaaagcatcttacggatggcatgacagtaagagaattatgcagtgct

SEQ ID NO: 41151 - DNA, 75 bp, Artificial Sequence
  Synthetic
cagaaaagcatcttacggatggcatgacagtaagagaattatgcagtgctgccataagcatgagtgataacactg

SEQ ID NO: 41152 - DNA, 75 bp, Artificial Sequence
  Synthetic
tcaaggaacaactggtattttacaataacaccccattgcacatcttaactccgtggaagaaggtccttacgagtg

SEQ ID NO: 41153 - DNA, 75 bp, Artificial Sequence
  Synthetic
ttaaatgaaatctacggtctcccctcatttttccaatggttgcacagaagattggaacagtcgatcctatacgta

SEQ ID NO: 41154 - DNA, 75 bp, Artificial Sequence
  Synthetic
ggagtgtgttcagtgctaatcaagtctgtaacgcggtcaatttaataccattggacatagcacagagatttaggg

SEQ ID NO: 41155 - DNA, 75 bp, Artificial Sequence
  Synthetic
cggccaacttacttctgacaacgatcggaggaccgaaggagctaaccgctttttttcacaacatgggggatcatg

SEQ ID NO: 41156 - DNA, 75 bp, Artificial Sequence
  Synthetic
agtgacccccactgccctccagatctcgatcgccatgtggacttgaacacagcccctaactctcaaatattcatc

SEQ ID NO: 41157 - DNA, 75 bp, Artificial Sequence
  Synthetic
cagagacgtgtggtcggggaatttagaatgaacaaaatctggcttgatattgttagaaacaggattgctgaggac

SEQ ID NO: 41158 - DNA, 75 bp, Artificial Sequence
  Synthetic
ggagctgaatgaagccataccaaacgacgagcgtgacaccacgatgcctgtagcaatggcaacaacgttgcgcaa

SEQ ID NO: 41159 - DNA, 75 bp, Artificial Sequence
  Synthetic
aaattaccaggattgtccgaaacctgaaagccaaccacataattttcgacctgcatcgtaatttattcatggata

SEQ ID NO: 41160 - DNA, 75 bp, Artificial Sequence
  Synthetic
ttggacatagcacagagatttagggtggtatatatgagcatcactcgactatcagacgatggaagttacagaatt

SEQ ID NO: 41161 - DNA, 75 bp, Artificial Sequence
  Synthetic
ctagcttcccggcaacaattaatagactggatggaggcggataaagttgcaggaccacttctgcgctcggccctt

SEQ ID NO: 41162 - DNA, 75 bp, Artificial Sequence
  Synthetic
tgagcatgttcaaagatcaccaagtgacattcatggtgcatatcggcaacttcagccgtaagaagaaccaagctt

SEQ ID NO: 41163 - DNA, 75 bp, Artificial Sequence
  Synthetic
cggaggaccgaaggagctaaccgctttttttcacaacatgggggatcatgtaactcgccttgatcgttgggaacc

SEQ ID NO: 41164 - DNA, 75 bp, Artificial Sequence
  Synthetic
ttcagccgtaagaagaaccaagcttactctgctgattactgtaaacttaaaattgaaaagatgggattagtgttt

SEQ ID NO: 41165 - DNA, 75 bp, Artificial Sequence
  Synthetic
aatctggagccggtgagcgtgggtctcgcggtatcattgcagcactggggccagatggtaagccctcccgtatcg

SEQ ID NO: 41166 - DNA, 75 bp, Artificial Sequence
  Synthetic
aattgaaaagatgggattagtgtttgctctaggagggatagggggaaccagtcttcacatacgatgtactggtaa

SEQ ID NO: 41167 - DNA, 75 bp, Artificial Sequence
  Synthetic
gacgagcgtgacaccacgatgcctgtagcaatggcaacaacgttgcgcaaactattaactggcgaactacttact

SEQ ID NO: 41168 - DNA, 75 bp, Artificial Sequence
  Synthetic
actggatggaggcggataaagttgcaggaccacttctgcgctcggcccttccggctggctggtttattgctgata

SEQ ID NO: 41169 - DNA, 75 bp, Artificial Sequence
  Synthetic
ggcaactatggatgaacgaaatagacagatcgctgagataggtgcctcactgattaagcattggtaactgtcaga

SEQ ID NO: 41170 - DNA, 75 bp, Artificial Sequence
  Synthetic
tcgcggtatcattgcagcactggggccagatggtaagccctcccgtatcgtagttatctacacgacgggcagtca

SEQ ID NO: 41171 - DNA, 75 bp, Artificial Sequence
  Synthetic
cagatcgctgagataggtgcctcactgattaagcattggtaactgtcagaccaagtttactcatatatactttag

SEQ ID NO: 41172 - DNA, 75 bp, Artificial Sequence
  Synthetic
attgatttaaaacttcatttttaatttaaaaggatctaggtgaagatcctttttgataatctcatgaccaaaatc

SEQ ID NO: 41173 - DNA, 75 bp, Artificial Sequence
  Synthetic
gagtgcaaaatagtaagaatccaagcagtcttgcaaccatcagtcccacaagatttcagaatttataatgatgtt

SEQ ID NO: 41174 - DNA, 75 bp, Artificial Sequence
  Synthetic
ttaaaaggatctaggtgaagatcctttttgataatctcatgaccaaaatcccttaacgtgagttttcgttccact

SEQ ID NO: 41175 - DNA, 75 bp, Artificial Sequence
  Synthetic
gagcgtcagaccccgtagaaaagatcaaaggatcttcttgagatcctttttttctgcgcgtaatctgctgcttgc

SEQ ID NO: 41176 - DNA, 75 bp, Artificial Sequence
  Synthetic
tgatagaaccccttttacaagatcactgtctcttgaccaagatggcaattcttcctgcacccataggtggtctta

SEQ ID NO: 41177 - DNA, 75 bp, Artificial Sequence
  Synthetic
caaaggatcttcttgagatcctttttttctgcgcgtaatctgctgcttgcaaacaaaaaaaccaccgctaccagc

SEQ ID NO: 41178 - DNA, 75 bp, Artificial Sequence
  Synthetic
aggattacgtcaataatgaactcgtccctgctatgcaacatatgtcgtgtgaattagttgggcagagattagggt

SEQ ID NO: 41179 - DNA, 75 bp, Artificial Sequence
  Synthetic
attacctcaatatgagtaggctttttgtcaggaacatcggggatcccgtgacatcttctattgctgacctcaaac

SEQ ID NO: 41180 - DNA, 75 bp, Artificial Sequence
  Synthetic
gtatacccaacagagacgtgtggtcggggaatttagaatgaacaaaatatggcttgatattgttagaaacagaat

SEQ ID NO: 41181 - DNA, 75 bp, Artificial Sequence
  Synthetic
ggtggtttgtttgccggatcaagagctaccaactctttttccgaaggtaactggcttcagcagagcgcagatacc

SEQ ID NO: 41182 - DNA, 75 bp, Artificial Sequence
  Synthetic
ctaccaactctttttccgaaggtaactggcttcagcagagcgcagataccaaatactgtccttctagtgtagccg

SEQ ID NO: 41183 - DNA, 75 bp, Artificial Sequence
  Synthetic
acccaatacccaggtgactcttcgtatttagattgggcaagtgacccttattctgctaatctgccctgtgtccag

SEQ ID NO: 41184 - DNA, 75 bp, Artificial Sequence
  Synthetic
tagttaggccaccacttcaagaactctgtagcaccgcctacatacctcgctctgctaatcctgttaccagtggct

SEQ ID NO: 41185 - DNA, 75 bp, Artificial Sequence
  Synthetic
ctgtagcaccgcctacatacctcgctctgctaatcctgttaccagtggctgctgccagtggcgataagtcgtgtc

SEQ ID NO: 41186 - DNA, 75 bp, Artificial Sequence
  Synthetic
gggttttgaaattcacctctaggaatctcacttgaccaattacacctccatgcgcttgcccgatctcaaactatt

SEQ ID NO: 41187 - DNA, 75 bp, Artificial Sequence
  Synthetic
atgatatgattgccattttggagagtcgggggataaaaacaaagataacccatgttgatcttcccgggaaattca

SEQ ID NO: 41188 - DNA, 75 bp, Artificial Sequence
  Synthetic
ttaccgggttggactcaagacgatagttaccggataaggcgcagcggtcgggctgaacggggggttcgtgcacac

SEQ ID NO: 41189 - DNA, 75 bp, Artificial Sequence
  Synthetic
ctcaaatcacttttctgcactcagaaagatccgaagtcactaatcaacaacccccagccatcaacaagaggtccg

SEQ ID NO: 41190 - DNA, 75 bp, Artificial Sequence
  Synthetic
gttaccggataaggcgcagcggtcgggctgaacggggggttcgtgcacacagcccagcttggagcgaacgaccta

SEQ ID NO: 41191 - DNA, 75 bp, Artificial Sequence
  Synthetic
atcgttaataattaatcaaaacttagggtccaggacgcagcaagccaacaggccaaccaagtccaccaatccgag

SEQ ID NO: 41192 - DNA, 75 bp, Artificial Sequence
  Synthetic
agaaccaaggaggagacaaataccccatccacttcagtgatgaacggtttccggggtataccccagatgtcaacg

SEQ ID NO: 41193 - DNA, 75 bp, Artificial Sequence
  Synthetic
caccgaactgagatacctacagcgtgagcattgagaaagcgccacgcttcccgaagggagaaaggcggacaggta

SEQ ID NO: 41194 - DNA, 75 bp, Artificial Sequence
  Synthetic
gagcattgagaaagcgccacgcttcccgaagggagaaaggcggacaggtatccggtaagcggcagggtcggaaca

SEQ ID NO: 41195 - DNA, 75 bp, Artificial Sequence
  Synthetic
actaatggttacttaatatctaattttgatgagtcatcctgtgtattcgtctcagaatcagccatttgtagccag

SEQ ID NO: 41196 - DNA, 75 bp, Artificial Sequence
  Synthetic
ggagagcgcacgagggagcttccaggggggaacgcctggtatctttatagtcctgtcgggtttcgccacctctga

SEQ ID NO: 41197 - DNA, 75 bp, Artificial Sequence
  Synthetic
acaagccccatgcacagcacaacccccaaaaattccaaacccctgccacacatccgacaagatcccctccaacaa

SEQ ID NO: 41198 - DNA, 75 bp, Artificial Sequence
  Synthetic
cacagcaccagatccgccgagaccaagacctcccaaggacgatatagcataacatcggctcagcgatccacgtac

SEQ ID NO: 41199 - DNA, 75 bp, Artificial Sequence
  Synthetic
cgtcaggggggccgagcctatggaaaaacgccagcaacgcggcctttttacggttcctggccttttgctggcctt

SEQ ID NO: 41200 - DNA, 75 bp, Artificial Sequence
  Synthetic
gctggaatgcctcaaagccctcagagagaatcctcctgacattgaggagattcaagaggtcagcagtatcagaga

SEQ ID NO: 41201 - DNA, 75 bp, Artificial Sequence
  Synthetic
ggaaccacatgtgggctaagttggcgaagggtcgtcctatttatggtctagaagtcccggatatccttgaatcaa

SEQ ID NO: 41202 - DNA, 75 bp, Artificial Sequence
  Synthetic
gaagggtcgtcctatttatggtctagaagtcccggatatccttgaatcaatgaagggctatatgataagaagaca

SEQ ID NO: 41203 - DNA, 75 bp, Artificial Sequence
  Synthetic
ttattctgtcaaaaggtaatatcgtcgcaaattgtgcttctatactgtgtaagtgttatagcacaagcacaatta

SEQ ID NO: 41204 - DNA, 75 bp, Artificial Sequence
  Synthetic
atcccctgattctgtggataaccgtattaccgcctttgagtgagctgataccgctcgccgcagccgaacgaccga

SEQ ID NO: 41205 - DNA, 75 bp, Artificial Sequence
  Synthetic
gggaccacgagggtatcatccatcacacaccagagagtgttacccgaggagcgagttcttggttcaagaggcggc

SEQ ID NO: 41206 - DNA, 75 bp, Artificial Sequence
  Synthetic
gaagtcccggatatccttgaatcaatgaagggctatatgataagaagacatgagtcttgtttgctttgcgcatca

SEQ ID NO: 41207 - DNA, 75 bp, Artificial Sequence
  Synthetic
gcggaagagcgcccaatacgcaaaccgcctctccccgcgcgttggccgattcattaatgcagctggcacgacagg

SEQ ID NO: 41208 - DNA, 75 bp, Artificial Sequence
  Synthetic
aaacgccagcaacgcggcctttttacggttcctggccttttgctggccttttgctcacatgttctttcctgcgtt

SEQ ID NO: 41209 - DNA, 75 bp, Artificial Sequence
  Synthetic
attaccgcctttgagtgagctgataccgctcgccgcagccgaacgaccgagcgcagcgagtcagtgagcgaggaa

SEQ ID NO: 41210 - DNA, 75 bp, Artificial Sequence
  Synthetic
cgcctctccccgcgcgttggccgattcattaatgcagctggcacgacaggtttcccgactggaaagcgggcagtg

SEQ ID NO: 41211 - DNA, 75 bp, Artificial Sequence
  Synthetic
agcgcaacgcaattaatgtgagttacctcactcattaggcaccccaggctttacactttatgcttccggctccta

SEQ ID NO: 41212 - DNA, 75 bp, Artificial Sequence
  Synthetic
atcggaactgacagtgtccattataagatcatgactaggcccagtcaccagtacttggtcataaaactaatgcct

SEQ ID NO: 41213 - DNA, 75 bp, Artificial Sequence
  Synthetic
tgttgtgtggaattgtgagcggataacaatttcacacaggaaacagctatgaccatgattacgccaagctcggcg

SEQ ID NO: 41214 - DNA, 75 bp, Artificial Sequence
  Synthetic
acaatttcacacaggaaacagctatgaccatgattacgccaagctcggcggccgcgtaatacgactcactataac

SEQ ID NO: 41215 - DNA, 75 bp, Artificial Sequence
  Synthetic
acggatgattaccccaatttctacctctactaatctagctcaccgactcagggacaagagtactcaagtcaaata

SEQ ID NO: 41216 - DNA, 75 bp, Artificial Sequence
  Synthetic
aaattattgaatattttattaaaaacttagggtcaatgatcctaccttaaagaacaaggctagggttcagaccta

SEQ ID NO: 41217 - DNA, 75 bp, Artificial Sequence
  Synthetic
atcaagcattatgatagctatacctggttttgggaaggacacgggagaccctacggcaaatgtcgacattaaccc

SEQ ID NO: 41218 - DNA, 75 bp, Artificial Sequence
  Synthetic
gattcaggaagagcactggcggaagttctcaagcagcccgcatcatcccgcggtaatcggaaggacagtggtatt

SEQ ID NO: 41219 - DNA, 75 bp, Artificial Sequence
  Synthetic
caattttcttcaaaagctatcaaactgcaacaaatagtggagaggactgactacgattatcgtaattaaagaaaa

SEQ ID NO: 41220 - DNA, 75 bp, Artificial Sequence
  Synthetic
tagccttgaacagtccaacaaggctatagaagaaattagggaggcaacccaggaaaccgtcattgctgttcaggg

SEQ ID NO: 41221 - DNA, 75 bp, Artificial Sequence
  Synthetic
cttagggctcaggtagtccaacaatgctctcctaccaagacaaggtgggtgccttctataaggataatgcaagag

SEQ ID NO: 41222 - DNA, 75 bp, Artificial Sequence
  Synthetic
aatgtccgccaacctgcaatgaatgcaaagatgacccagaaatgcaaacccgagtctggtacgcaactccctccc

SEQ ID NO: 41223 - DNA, 75 bp, Artificial Sequence
  Synthetic
aggcgcaaaactgctttcactatcgcttaaaagcaattataaaaaacttaggacacaagagcctaagtcctctcc

SEQ ID NO: 41224 - DNA, 75 bp, Artificial Sequence
  Synthetic
accgagttgttgtcaatatttggcccgagtttacgtgaccctatttcagccgagatatcaattcaagcactgagt

SEQ ID NO: 41225 - DNA, 75 bp, Artificial Sequence
  Synthetic
cttgcttgctatcgctggagttcgatttcgccaggtgtcaactagcaatgtggaatttggcagattgctgaagga

SEQ ID NO: 41226 - DNA, 75 bp, Artificial Sequence
  Synthetic
cgagtttacgtgaccctatttcagccgagatatcaattcaagcactgagttatgctcttgggggagaaattcata

SEQ ID NO: 41227 - DNA, 75 bp, Artificial Sequence
  Synthetic
cgagatatcaattcaagcactgagttatgctcttgggggagaaattcataagatacttgagaagttggggtattc

SEQ ID NO: 41228 - DNA, 75 bp, Artificial Sequence
  Synthetic
taacccatgtcgatctccccgggaaactcatcatattaagtatctcatacccaactttatcagaagtcaaggggg

SEQ ID NO: 41229 - DNA, 75 bp, Artificial Sequence
  Synthetic
tccgaacagagaattcgacttccgcgatctccactggtgcattaacccgcctagtaagatcaaggtgaattttac

SEQ ID NO: 41230 - DNA, 75 bp, Artificial Sequence
  Synthetic
ccaacacagaaatgtgctgtgttatcgaggtacttaaaatcaaaagctctagagtcccatgttggtctgacatgg

SEQ ID NO: 41231 - DNA, 75 bp, Artificial Sequence
  Synthetic
gcttggtgtctgggactatgggcaacaagtttattctgtcaaaaggtaatatcgttgcaaattgtgcttctatat

SEQ ID NO: 41232 - DNA, 75 bp, Artificial Sequence
  Synthetic
aaagcgacctctgaggaaaagtcctatctctaacgcctcagaattaaaatcagaatttgacccaccgaaagatga

SEQ ID NO: 41233 - DNA, 75 bp, Artificial Sequence
  Synthetic
tatgtaagtgttatagcacaagcacaattatcaatcagagtcctgataagttgctgacatttattgcctccgata

SEQ ID NO: 41234 - DNA, 75 bp, Artificial Sequence
  Synthetic
tgagatagggttcatcaaacggtggctgaatgacatgccattactccagacaaccaactatatggtcctcccgga

SEQ ID NO: 41235 - DNA, 75 bp, Artificial Sequence
  Synthetic
ggaccaagaaatttatggatgcttggggttttgaacttcgcctctaggaatctcactttaacaattatacctcca

SEQ ID NO: 41236 - DNA, 75 bp, Artificial Sequence
  Synthetic
atagcagtgggcgagctgacactggcttccttgtgtgtagatgagagcaccgtattattatatcatgacagcaat

SEQ ID NO: 41237 - DNA, 75 bp, Artificial Sequence
  Synthetic
acaaatttagggaacgcccttaagaaactggatgatgctaaagtactgatagactcctctaaccagatccttgag

SEQ ID NO: 41238 - DNA, 75 bp, Artificial Sequence
  Synthetic
gggttttgaacttcgcctctaggaatctcactttaacaattatacctccacgcacttgcccgatctcaagctatc

SEQ ID NO: 41239 - DNA, 75 bp, Artificial Sequence
  Synthetic
agactcctctaaccagatccttgagacagttaagcgctcttcctttaattttggcagtctcctcagcgttcccat

SEQ ID NO: 41240 - DNA, 75 bp, Artificial Sequence
  Synthetic
aactggatgatgctaaagtactgatagactcctctaaccagatccttgagacagttaagcgctcttcctttaatt

SEQ ID NO: 41241 - DNA, 75 bp, Artificial Sequence
  Synthetic
gccgggcaggaacccccacgagcagacaagccccatgcacaacaaaatccccaaaagatccaaaacccaaacaca

SEQ ID NO: 41242 - DNA, 75 bp, Artificial Sequence
  Synthetic
aaaggatacatatcacaaatcaccgtggtttcataaaagattcagtagcaacctggatggtgcctgcattggtct

SEQ ID NO: 41243 - DNA, 75 bp, Artificial Sequence
  Synthetic
cacccaacaagacctccccccacaacacagcaccgaactcgccgagaccaagacctcccgagcacgacacagcac

SEQ ID NO: 41244 - DNA, 75 bp, Artificial Sequence
  Synthetic
attggaagaacatttggatcgctgcctttaggtgttgggcgcactacagccagacctgaagaattattgaaggaa

SEQ ID NO: 41245 - DNA, 75 bp, Artificial Sequence
  Synthetic
cacagcaccgaactcgccgagaccaagacctcccgagcacgacacagcacaacatcggctcagcgatccacgcac

SEQ ID NO: 41246 - DNA, 75 bp, Artificial Sequence
  Synthetic
aatcatatgtaagatcactctgaagcactctggtcacaagtcttacctgattgtcaggcttgaaatccataagtc

SEQ ID NO: 41247 - DNA, 75 bp, Artificial Sequence
  Synthetic
tatggtcctctaacatcggacaggcccatccactacaccatgaacaggatcaggtcccgcaagcaagccagccac

SEQ ID NO: 41248 - DNA, 75 bp, Artificial Sequence
  Synthetic
ggcgaactgcaggtgtcaaggaacaactggtattttacaataacaccccattgcacatcttaactccgtggaaga

SEQ ID NO: 41249 - DNA, 75 bp, Artificial Sequence
  Synthetic
acagttgccatcttacgggcggttgacattacctctagatgcaagcattgaccttcaacttaacatatcgtttac

SEQ ID NO: 41250 - DNA, 75 bp, Artificial Sequence
  Synthetic
ccatccactacaccatgaacaggatcaggtcccgcaagcaagccagccacagatcggagaacatcccggttcacg

SEQ ID NO: 41251 - DNA, 75 bp, Artificial Sequence
  Synthetic
cactctggtcacaagtcttacctgattgtcaggcttgaaatccataagtctcgcctaattcccttctaaagctat

SEQ ID NO: 41252 - DNA, 75 bp, Artificial Sequence
  Synthetic
gagcatcactcgactatcagacgatggaagttacagaattcctcgcgggatgtttgaattccgctccaggaatgc

SEQ ID NO: 41253 - DNA, 75 bp, Artificial Sequence
  Synthetic
aaattaccaggatagttcgagacctgaaagccaaccacataatttttgacttacaccggaatttatttatgaata

SEQ ID NO: 41254 - DNA, 75 bp, Artificial Sequence
  Synthetic
tgtttgaattccgctccaggaatgctttagcatttaatattttagtcaccattcaagttgagggagatgtctgtt

SEQ ID NO: 41255 - DNA, 75 bp, Artificial Sequence
  Synthetic
ggaagttacagaattcctcgcgggatgtttgaattccgctccaggaatgctttagcatttaatattttagtcacc

SEQ ID NO: 41256 - DNA, 75 bp, Artificial Sequence
  Synthetic
ttcgatttcaccaagtatcaactagcaatatggaatttagcagattgctgaaagaggatatggagaaatcagagg

SEQ ID NO: 41257 - DNA, 75 bp, Artificial Sequence
  Synthetic
cacaaaaactaaacgagatcaaacaatttatccttcaaaagacaaacttcttcaatccgaacagggaattcgact

SEQ ID NO: 41258 - DNA, 75 bp, Artificial Sequence
  Synthetic
tagactaactaccaagggtagacctgatttcctaaggattgaatgttttgtgtgggatgacgatttgtggtgtca

SEQ ID NO: 41259 - DNA, 75 bp, Artificial Sequence
  Synthetic
tccgcgatctccactggtgcattaacccacctagcaagatcaaggtgaattttaccaattactgtgatacagttg

SEQ ID NO: 41260 - DNA, 75 bp, Artificial Sequence
  Synthetic
gtataatagaagacaatgatggcctcggacccccaattggaagaacatttggatcgctgcctttgggagttgggc

SEQ ID NO: 41261 - DNA, 75 bp, Artificial Sequence
  Synthetic
cgagatatcaattcaagcactgagttatgctcttgggggagaaattcataagatacttgagaagttgggatattc

SEQ ID NO: 41262 - DNA, 75 bp, Artificial Sequence
  Synthetic
aatcccttaccgccgattgaattaaaccatctccagcattataaaaaaactaaggatccaggatccttttagtca

SEQ ID NO: 41263 - DNA, 75 bp, Artificial Sequence
  Synthetic
tactacttcagtaggcagagtattctccctatccgtgtcattatccatgtctttaatatcaagaacatcagagat

SEQ ID NO: 41264 - DNA, 75 bp, Artificial Sequence
  Synthetic
tgctagtgcctgattatattgaaggggagttcgactcgcaaaagattcgagtctttgagatagggtttatcaaac

SEQ ID NO: 41265 - DNA, 75 bp, Artificial Sequence
  Synthetic
agcaccgtattgttatatcatgacagcaatggttcacaaaatggtattctagtagtgacattgggaatatttggg

SEQ ID NO: 41266 - DNA, 75 bp, Artificial Sequence
  Synthetic
aggtcagtctcacatggaatggggatagttgctggatcgacaagtggtgcaacccaatctgcactcaagtcaact

SEQ ID NO: 41267 - DNA, 75 bp, Artificial Sequence
  Synthetic
agtagtgacattgggaatatttggggcaacacctatggatcaagttgaagaggtgatacctatcgctcacccatc

SEQ ID NO: 41268 - DNA, 75 bp, Artificial Sequence
  Synthetic
aacccccacaaacagacaagccccatgcacaacaaaattcccaaaaaatccaaacccctgccacacacccgacaa

SEQ ID NO: 41269 - DNA, 75 bp, Artificial Sequence
  Synthetic
tatgggtttaggtgatgcactggacaagactattggggccaaaattgatgaagcaggcataattatgcaaagctc

SEQ ID NO: 41270 - DNA, 75 bp, Artificial Sequence
  Synthetic
tccctcccaggacctcaaatgaggctgagtctgacagtgagtacgatgatgagcttttctctgagatacaagaaa

SEQ ID NO: 41271 - DNA, 75 bp, Artificial Sequence
  Synthetic
aatcctatgttagatcactctaaagcactctggtcacacgtcttacccgattgccaggcttgaaatctataaatc

SEQ ID NO: 41272 - DNA, 75 bp, Artificial Sequence
  Synthetic
tcgcccaattttcttcaaaagctatcaaactacaacaaatagtggagaggactgactacgattatcgtaattaaa

SEQ ID NO: 41273 - DNA, 75 bp, Artificial Sequence
  Synthetic
caaactacaacaaatagtggagaggactgactacgattatcgtaattaaagaaaacttagggctcaggtagtcca

SEQ ID NO: 41274 - DNA, 75 bp, Artificial Sequence
  Synthetic
ggaggacagttgccctcttatgggcggttgacattacctctagatccaagcgttgaccttcaacttaacatatca

SEQ ID NO: 41275 - DNA, 75 bp, Artificial Sequence
  Synthetic
cgaattagacatagctatcaactccttgatacaacattagtgcgtaatatcaaagagagaatttcagaagggttc

SEQ ID NO: 41276 - DNA, 75 bp, Artificial Sequence
  Synthetic
acggagacggtatggattattatgaaagcccacttttggaatccggatggctaaccataccccctaagaacggaa

SEQ ID NO: 41277 - DNA, 75 bp, Artificial Sequence
  Synthetic
aaatggtcctgatgtattgtgatgtgatagaagggagactaatgactgatactgctatggcaattgatcaacgtt

SEQ ID NO: 41278 - DNA, 75 bp, Artificial Sequence
  Synthetic
ggagaccaccctatttgttgtttgtccttctcatcctattggttggaatcctggccttgctttctatcactggag

SEQ ID NO: 41279 - DNA, 75 bp, Artificial Sequence
  Synthetic
cagtccttggattgataaacaaagcaagtagaggagaccagttcactgtgaccccccatgtgttgacatttgcgc

SEQ ID NO: 41280 - DNA, 75 bp, Artificial Sequence
  Synthetic
agctccgccctatcatagggagagattcaggaagagcactagcagaagttctcaagcagcccgcatcatcccgcg

SEQ ID NO: 41281 - DNA, 75 bp, Artificial Sequence
  Synthetic
cccacctagtaaggtcaaggtgaattttactaattactgtgatacaattgggatcagaaaatctattgcatcggc

SEQ ID NO: 41282 - DNA, 75 bp, Artificial Sequence
  Synthetic
taggcccagtcaccagtacttggtcataaaactaatgcctaatgtttcacttatagataattgtaccaaagcaga

SEQ ID NO: 41283 - DNA, 75 bp, Artificial Sequence
  Synthetic
atacaaaccgaaggataccgcaccttccaaagctgtacttgcatcattgattagatcaagcagagttgatcaaag

SEQ ID NO: 41284 - DNA, 75 bp, Artificial Sequence
  Synthetic
tatgatatatcccggggcgatcatgcaattgtttattatgtttatgaccctaaccggacgatttcttatacacac

SEQ ID NO: 41285 - DNA, 75 bp, Artificial Sequence
  Synthetic
atacatataacaggagaaatcttttccttttttaggagtttcggtcacccaaggttagaagcaataacagcagca

SEQ ID NO: 41286 - DNA, 75 bp, Artificial Sequence
  Synthetic
tgtgaagcccctacagtcagtagggtcaggtaggagacaaaggcgttttgcaggagtggtgcttgcaggtgcagc

SEQ ID NO: 41287 - DNA, 75 bp, Artificial Sequence
  Synthetic
ccttttttaggagtttcggtcacccaaggttagaagcaataacagcagcagagaatgtacggaaacacatgaacc

SEQ ID NO: 41288 - DNA, 75 bp, Artificial Sequence
  Synthetic
ctaacatcactaactctacaaccagtgttgagaatttagtccgtataagattctcatgtaaccgttcaaaacctt

SEQ ID NO: 41289 - DNA, 75 bp, Artificial Sequence
  Synthetic
tctcaggagagggaatcacctatagtcaatgcatagaaaactggaaatcctttgcaggaattcgattcaaatgct

SEQ ID NO: 41290 - DNA, 75 bp, Artificial Sequence
  Synthetic
gaataaggatattgtagacatagaagttgatgatgctgagcaattcaatatattgctagcttccatcttggctca

SEQ ID NO: 41291 - DNA, 75 bp, Artificial Sequence
  Synthetic
tgtcaatatttggcccgagtttacgtgaccctatttcagccgagatatcaattcaagcactgagttatgctcttg

SEQ ID NO: 41292 - DNA, 75 bp, Artificial Sequence
  Synthetic
cttaccattcctcctaaaaacggaacaatccttggattgataaacaaagcaggtagaggagaccagttcactgta

SEQ ID NO: 41293 - DNA, 75 bp, Artificial Sequence
  Synthetic
ggcttgatattgttagaaacaggattgctgaggacttatccttgaggcggttcatggtggcactcatcttggata

SEQ ID NO: 41294 - DNA, 75 bp, Artificial Sequence
  Synthetic
tcgagtcatctctctgaggttgagaaatatattcaaaagaggaaatagcatctatagtaaaataacagacggggt

SEQ ID NO: 41295 - DNA, 75 bp, Artificial Sequence
  Synthetic
ttcatggtggcactcatcttggatatcaaacgatccccagggaacaagcctagaattgctgaaatgatttgtgat

SEQ ID NO: 41296 - DNA, 75 bp, Artificial Sequence
  Synthetic
attaaaccatctccagcattataaaaaaactaaggatccaggatccttttagtcatggattctgtatctgtgaac

SEQ ID NO: 41297 - DNA, 75 bp, Artificial Sequence
  Synthetic
cttagtattggtttaggaggtgcattggataagaccattggggccaaaattgatgaagcaggcataattatgcag

SEQ ID NO: 41298 - DNA, 75 bp, Artificial Sequence
  Synthetic
cggattagacataactatcagctccttgatacaacgttagtgcgtaatatcaaagagagaatttcagaggggttc

SEQ ID NO: 41299 - DNA, 75 bp, Artificial Sequence
  Synthetic
cagagtcctgataagttgctgacatttattgcctccgatacctgcccactggttgaaatagatggtgtaactatc

SEQ ID NO: 41300 - DNA, 75 bp, Artificial Sequence
  Synthetic
gcagagcttggcatcaccaaggaagaggctcagctagtgtcagaaatagcatccaaaacaacagaggaccggacg

SEQ ID NO: 41301 - DNA, 75 bp, Artificial Sequence
  Synthetic
cttaatattggtttaggggatgcactggacaagactattggggccaaaattgatgaagcaggcataattatgcaa

SEQ ID NO: 41302 - DNA, 75 bp, Artificial Sequence
  Synthetic
attcgcgctgctggtcctaagcagtctcaaatcacttttctgcactcggaaagatccgaagtcactaatcaacaa

SEQ ID NO: 41303 - DNA, 75 bp, Artificial Sequence
  Synthetic
aagatccgaagtcactaatcaacaacccccaacagtcaacaagaggtccgaaaatcaaggaggagacaaataccc

SEQ ID NO: 41304 - DNA, 75 bp, Artificial Sequence
  Synthetic
cctcaggggtgcttttttgagtcactgctttgctgaaatccaggagattttacaggacaatggcttctatactga

SEQ ID NO: 41305 - DNA, 75 bp, Artificial Sequence
  Synthetic
cccgatggggggagtggagggatactgtcagaagttatggactattagcaccataccttatctgtacttggcagc

SEQ ID NO: 41306 - DNA, 75 bp, Artificial Sequence
  Synthetic
ttatcgggatagacatggaggaacctggcctccaatggatcttcctgtccatgcatctcctatcatcaggaatgc

SEQ ID NO: 41307 - DNA, 75 bp, Artificial Sequence
  Synthetic
tcattataaaaaacttaggacccaggtccaacaaacccgatcaactattcatccgaccacccattctatccctaa

SEQ ID NO: 41308 - DNA, 75 bp, Artificial Sequence
  Synthetic
ataaggctttagcagcccttaaaaaagagtgggattcagtgtacccaaaagaattcctcaggtacaacccacctc

SEQ ID NO: 41309 - DNA, 75 bp, Artificial Sequence
  Synthetic
ttcagctatgacacgggatgtgatagaaccccttttacaagatcactgtctcttgaccaagatggcaattctccc

SEQ ID NO: 41310 - DNA, 75 bp, Artificial Sequence
  Synthetic
acgttatctcaggtcaatatctagaagatcctgacttcaacctatcatacagtctcaaggagaaagagattaaag

SEQ ID NO: 41311 - DNA, 75 bp, Artificial Sequence
  Synthetic
cccaacaagaccgccccccacaacccagcaccgaactcgaagagaccaggacctcccgagcacgacacagcacaa

SEQ ID NO: 41312 - DNA, 75 bp, Artificial Sequence
  Synthetic
aggtggggaggctattcgctaaaatgacctacaaaatgcgagcctgtcaggtcatagcagaaaacttgatatcta

SEQ ID NO: 41313 - DNA, 75 bp, Artificial Sequence
  Synthetic
ggaacatcggggatcccgtgacatcttctattgctgacctcaaacgaatgatccgatcaggccttctcggagtgg

SEQ ID NO: 41314 - DNA, 75 bp, Artificial Sequence
  Synthetic
cgatcctgacttcaacctatcatacagtcttaaagagaaagagattaaagaggtggggaggttattcgctaaaat

SEQ ID NO: 41315 - DNA, 75 bp, Artificial Sequence
  Synthetic
aggtggggaggttattcgctaaaatgacatacaaaatgcgagcctgtcaagtcatagcagaaaacttaatatcta

SEQ ID NO: 41316 - DNA, 75 bp, Artificial Sequence
  Synthetic
gcaccagtagaagagaagacaatgacatagagatctatgaaaccgtaagtgcatttataactacagatctcaaaa

SEQ ID NO: 41317 - DNA, 75 bp, Artificial Sequence
  Synthetic
atggaattgggaagtacttcaaggacaatgggatggcaaaggatgaacacgatctcactaaagcattgcacactc

SEQ ID NO: 41318 - DNA, 75 bp, Artificial Sequence
  Synthetic
agtgcacctggttagtcctgtggtgcctcggaatggccagtctctttctttgttccaaggctcagatacattgga

SEQ ID NO: 41319 - DNA, 75 bp, Artificial Sequence
  Synthetic
caatgggatggcaaaggatgaacacgatctcactaaagcattgcacactctggctgtgtccggggttcccaaaga

SEQ ID NO: 41320 - DNA, 75 bp, Artificial Sequence
  Synthetic
gatctcactaaagcattgcacactctggctgtgtccggggttcccaaagacaagaaagactcccatcgcggcctc

SEQ ID NO: 41321 - DNA, 75 bp, Artificial Sequence
  Synthetic
actaatcagtgtaagtctaaaaaaccgacaccttatcgaggagcccttcactccgtctcttctccaagtagtaga

SEQ ID NO: 41322 - DNA, 75 bp, Artificial Sequence
  Synthetic
gaagctttagccgctttcttgatggataggaaaattattatcccaagagctgcacatgaaattctagataacacg

SEQ ID NO: 41323 - DNA, 75 bp, Artificial Sequence
  Synthetic
ggggttcagaaaagggatgggaagactctgcagttcccacacaatcccgaaggtaagacaggggatccggagtgt

SEQ ID NO: 41324 - DNA, 75 bp, Artificial Sequence
  Synthetic
tatatggacccaaacccaaatttttgcaccagtagaagagaagacaatgacatagagatctatgagaccgtaagt

SEQ ID NO: 41325 - DNA, 75 bp, Artificial Sequence
  Synthetic
tgtttcacttatagagaattgtaccaaagcagaattaggtgagtatgagaaattattgaattcagtcctcgaacc

SEQ ID NO: 41326 - DNA, 75 bp, Artificial Sequence
  Synthetic
gcatttataactacagatctcaaaaagtactgtctgaattggcgatatgagaccattagtatatttgctcagaga

SEQ ID NO: 41327 - DNA, 75 bp, Artificial Sequence
  Synthetic
gaccattagtatatttgctcagagattaaatgaaatctacggtctcccctcattttttcaatggttgcacagaag

SEQ ID NO: 41328 - DNA, 75 bp, Artificial Sequence
  Synthetic
cattttttcaatggttgcacagaagattggaacagtcgatcctatacgtaagtgacccccactgccctccagatc

SEQ ID NO: 41329 - DNA, 75 bp, Artificial Sequence
  Synthetic
tatagctaggtgtgtattttggtcagaaacaatagtggatgagacccgagccgcatgcagcaacatttcaacaac

SEQ ID NO: 41330 - DNA, 75 bp, Artificial Sequence
  Synthetic
gctgagtcggacagtgagtacgatgatgagcttttctctgagatacaagaaataagatccgccattactaaacta

SEQ ID NO: 41331 - DNA, 75 bp, Artificial Sequence
  Synthetic
ctaaactggataccttattactgcttaaaggagagactgattcaattaagaaacaaattagcaaacaaaatattg

SEQ ID NO: 41332 - DNA, 75 bp, Artificial Sequence
  Synthetic
aggatgaagctttagcagctttcttgatggataggaaaattattatcccaagagctgcacatgaaattctagata

SEQ ID NO: 41333 - DNA, 75 bp, Artificial Sequence
  Synthetic
tgccttcttatgggcggttgacattacctctagatccaagcattgaccttcaacttaacatatcatttacatatg

SEQ ID NO: 41334 - DNA, 75 bp, Artificial Sequence
  Synthetic
tatagctaggtgcgtattttggtcagaaacaatagtggatgagacccgagccgcctgtagcaacatttcaacaac

SEQ ID NO: 41335 - DNA, 75 bp, Artificial Sequence
  Synthetic
aagagtactcaagtcaaatactcagggacctctcttatcagagtagcacgttatgcaactatctcgaatgataat

SEQ ID NO: 41336 - DNA, 75 bp, Artificial Sequence
  Synthetic
tgaagggttatatgataagaagacatgagtcttgtttgctttgcgcatcaggctctcataactatggttggtttt

SEQ ID NO: 41337 - DNA, 75 bp, Artificial Sequence
  Synthetic
ctgtctcttgactaagatggcaatccttcctgcacccataggtggtcttaattaccttaatatgagtaggctttt

SEQ ID NO: 41338 - DNA, 75 bp, Artificial Sequence
  Synthetic
gaaacaatgactgaggtgtacgacttcgatcagtcttcgtgggacaccaagggctcattgtcccccattttaccc

SEQ ID NO: 41339 - DNA, 75 bp, Artificial Sequence
  Synthetic
tgtcaggaacatcggggatcccgtgacatcttctattgctgacctcaaacgaatgatccgatcaggccttctcgg

SEQ ID NO: 41340 - DNA, 75 bp, Artificial Sequence
  Synthetic
gaatgatccgatcaggccttctcggagtagagattttacatcaagtcatgacccaatacccaggtgactcttcgt

SEQ ID NO: 41341 - DNA, 75 bp, Artificial Sequence
  Synthetic
gtataatagaagacaacgatggcctcggacccccgattggaagaacatttggatcgctgcctttaggtgttgggc

SEQ ID NO: 41342 - DNA, 75 bp, Artificial Sequence
  Synthetic
agcataacccggctccttaaaaatattacggccaggcatgtccttatcaacagtccaaatcccatgctgaaagga

SEQ ID NO: 41343 - DNA, 75 bp, Artificial Sequence
  Synthetic
ttacggccaggcatgtccttatcaacagtccaaatcccatgctgaaaggattgttccatgatgagagtcaggatg

SEQ ID NO: 41344 - DNA, 75 bp, Artificial Sequence
  Synthetic
tgatacacatctcaattgaactgagggatgatgaccgtggtaagaaatcccttaccgacgattgaattaaaccat

SEQ ID NO: 41345 - DNA, 75 bp, Artificial Sequence
  Synthetic
ctatgtctatggttgagatgattacaaagtttgaaaaggaccacctaaatgaagtcaccgcgttaattggcgatg

SEQ ID NO: 41346 - DNA, 75 bp, Artificial Sequence
  Synthetic
acacgatcactggtgcgagggaggcaattgctggaatgctagataccacaaaggggttgataagagcaagcatga

SEQ ID NO: 41347 - DNA, 75 bp, Artificial Sequence
  Synthetic
aattgctggaatgctagataccacaaaggggttgataagagcaagcatgaaaagaggagggctaacccctaggat

SEQ ID NO: 41348 - DNA, 75 bp, Artificial Sequence
  Synthetic
ctgcaatcaactggggctttgaaattcattatcaccgaccttctggaaagtaccaaatgggtgaattgttgttct

SEQ ID NO: 41349 - DNA, 75 bp, Artificial Sequence
  Synthetic
gttgctgatttactgttgtaaaagacgctaccaacagacactcaagcagcatactaaggtcgatccggcatttaa

SEQ ID NO: 41350 - DNA, 75 bp, Artificial Sequence
  Synthetic
ttgagtagaatgagtaaaggagtcttcaaaattttaaccaatgcattgagtcatcccaaagtatatagacggttt

SEQ ID NO: 41351 - DNA, 75 bp, Artificial Sequence
  Synthetic
acctgatctaactggaacttcgaaatcctatgtgagatcactctgaagtattctggtcatatatctcgcttgatt

SEQ ID NO: 41352 - DNA, 75 bp, Artificial Sequence
  Synthetic
cccgctcatcgatcaagactcatgctctgtccagttagcgagagcattaaggaatcacatgtgggctaagttggc

SEQ ID NO: 41353 - DNA, 75 bp, Artificial Sequence
  Synthetic
gagcattgttaatcagaccttgttatcttatcccaaacacaaccatgtgatatatccaaattgcaacaaacttct

SEQ ID NO: 41354 - DNA, 75 bp, Artificial Sequence
  Synthetic
ggctctcataactatggttggttctttgtaccggcaaattgccaattagatagtattacagagggaacatctgca

SEQ ID NO: 41355 - DNA, 75 bp, Artificial Sequence
  Synthetic
tctaaatcgatttttatggagattagagtgcaaaatagtaagaatccaagcagttttgcaaccctcagtcccgca

SEQ ID NO: 41356 - DNA, 75 bp, Artificial Sequence
  Synthetic
attagcattcgtcaaatctcctagtaggtctctaaaatcagcagtgagaatagcaactgtgtactcatgggccta

SEQ ID NO: 41357 - DNA, 75 bp, Artificial Sequence
  Synthetic
tggcgttgtccaggatcccttaatcccctcaaacaaggattgaggctacaagtatcgactatctcgatgttgctc

SEQ ID NO: 41358 - DNA, 75 bp, Artificial Sequence
  Synthetic
ccctcaaacaaggattgaggctacaagtatcgactatctcgatgttgctcctgcattttaagcatgttctatagg

SEQ ID NO: 41359 - DNA, 75 bp, Artificial Sequence
  Synthetic
taagaacgaatttacgtctgaagaacacggattattcctaggagaaggttcaggtgcaatgctgacagtatataa

SEQ ID NO: 41360 - DNA, 75 bp, Artificial Sequence
  Synthetic
tttctaaactgctcattcgtgcttactattctagtgactccgcgatatgaagacagctgaatcaaaccgaatcat

SEQ ID NO: 41361 - DNA, 75 bp, Artificial Sequence
  Synthetic
ctattctagtgactccgcgatatgaagacagctgaatcaaaccgaatcatgcctgagagtaggttgatcattatt

SEQ ID NO: 41362 - DNA, 75 bp, Artificial Sequence
  Synthetic
ctcagggacctctcttatcagagtagcacgttatgcaacaatctcgaatgataatctttcttttgtgatagctga

SEQ ID NO: 41363 - DNA, 75 bp, Artificial Sequence
  Synthetic
ggtccaataactgtatggatgcttgggggtttgaacttcgcttctgggaatctcactttaacaattatacctccc

SEQ ID NO: 41364 - DNA, 75 bp, Artificial Sequence
  Synthetic
actttacatgtcagaatcaggtatctttgggatctaattgatggatttttcccggacttaggaaattcgacctat

SEQ ID NO: 41365 - DNA, 75 bp, Artificial Sequence
  Synthetic
tgcacttgcccgatctcaagctatcactagtagtcctgtttcacgaaatcatgactgtccatctctctatcacca

SEQ ID NO: 41366 - DNA, 75 bp, Artificial Sequence
  Synthetic
aacaccgtactgcatttacatgttgaaacagattgttgcgtaatacccatgagcgaccatccaagggtcccaggg

SEQ ID NO: 41367 - DNA, 75 bp, Artificial Sequence
  Synthetic
agaactggacaacgagagatttcaccttacccttctgaggtcagtcttgtggaacatcaattaggactcgataaa

SEQ ID NO: 41368 - DNA, 75 bp, Artificial Sequence
  Synthetic
acaatccccatgcacgagaaaatccccaaaagatccaaaacccaaacacacacccaacaagatctcccccaacaa

SEQ ID NO: 41369 - DNA, 75 bp, Artificial Sequence
  Synthetic
gaccagaggtaacttgggttgggagtgttgattgttacaagtacatactaagccagatatctgctagcagtcttg

SEQ ID NO: 41370 - DNA, 75 bp, Artificial Sequence
  Synthetic
aacatcggctcagcggtccacgcactatgatcctcgaacagcggactggcccgactactacatcatgaaaaggac

SEQ ID NO: 41371 - DNA, 75 bp, Artificial Sequence
  Synthetic
aaagtttgaaaaagaccacctaaatgaagtctccgcgttaattggcgatgacgatatcaatagctttatcactga

SEQ ID NO: 41372 - DNA, 75 bp, Artificial Sequence
  Synthetic
tatgatcctcgaacagcggactggcccgactactacatcatgaaaaggaccaggtcttgcaagcaagccagctac

SEQ ID NO: 41373 - DNA, 75 bp, Artificial Sequence
  Synthetic
actatagcagtgggtgagttgacactggcttccttgtgtgtagaagagagcactgtattattatatcatgacagc

SEQ ID NO: 41374 - DNA, 75 bp, Artificial Sequence
  Synthetic
agatcggataacatcccggctcacggagaccatgacggtattatccatcacacaccagagagcgtctcccaagga

SEQ ID NO: 41375 - DNA, 75 bp, Artificial Sequence
  Synthetic
gagaccatgacggtattatccatcacacaccagagagcgtctcccaaggagcgaaatcccggctcaaaatgggcc

SEQ ID NO: 41376 - DNA, 75 bp, Artificial Sequence
  Synthetic
tcattatcaccgaccttctggaaagtatcaaatgggtgaattgttgttttctttcttgagtagaatgagtaaagg

SEQ ID NO: 41377 - DNA, 75 bp, Artificial Sequence
  Synthetic
aatccaatgcagtcaaatcaggctctcagtgcacctggttagtcctgtggtgcatcggagtagccagtctctttc

SEQ ID NO: 41378 - DNA, 75 bp, Artificial Sequence
  Synthetic
ttgagtcatcccaaagtatatagacgattttgggacagtgggatgattgaacctgttcacggaccctctcttgac

SEQ ID NO: 41379 - DNA, 75 bp, Artificial Sequence
  Synthetic
tttgttctaaggctcaaatacactggaataatttgtcaactattgggattatcgggaccgacagtgtccattata

SEQ ID NO: 41380 - DNA, 75 bp, Artificial Sequence
  Synthetic
acctgttcacggaccctctcttgactcccagaacctacacataactgtatgcaacctgatctataactgttacat

SEQ ID NO: 41381 - DNA, 75 bp, Artificial Sequence
  Synthetic
ccaaagcagaattagatgagtatgagaaattattaagttcaatccttgaaccaatcaaccaagctttgactctaa

SEQ ID NO: 41382 - DNA, 75 bp, Artificial Sequence
  Synthetic
ttgaccttcaacttaacatatcgttcacatacggtccggttatactgaatggagatggtatggattattatgaaa

SEQ ID NO: 41383 - DNA, 75 bp, Artificial Sequence
  Synthetic
ctgacctttattgtaaccctcgtgattgtccccagattcgtgggttgacaccaacacagaaatgtgctgtgttat

SEQ ID NO: 41384 - DNA, 75 bp, Artificial Sequence
  Synthetic
atctctggattgataaacaaagcaggtagaggagaccagttcactgtactcccccatgtgttaacatttgcgccc

SEQ ID NO: 41385 - DNA, 75 bp, Artificial Sequence
  Synthetic
agctgcacaaatcactgcagggatagctttacatcaatccaacctcaatgctcaagcaatccaatctctgagaac

SEQ ID NO: 41386 - DNA, 75 bp, Artificial Sequence
  Synthetic
gtactccaaaataatccgggatgtggagagagcaacactgcggttgtggaggcagagcagcctgctaaagatgac

SEQ ID NO: 41387 - DNA, 75 bp, Artificial Sequence
  Synthetic
gcaaaggatgaacacgatctcactaaagcattgcacactctggctgtatccggggttcctaaagacaagaaagac

SEQ ID NO: 41388 - DNA, 75 bp, Artificial Sequence
  Synthetic
cggtaatcggaaggacggtggtgttgccttgggctcaaaaggtcaactattgagagacctccagctgaaacctat

SEQ ID NO: 41389 - DNA, 75 bp, Artificial Sequence
  Synthetic
agattgagagtggaccccgggttcatcactgatgctgttggatgcttagaaaagcgacctctgaggaaaagtcct

SEQ ID NO: 41390 - DNA, 75 bp, Artificial Sequence
  Synthetic
attgtttattatgtttatgacccaatccggacgatttcttatacgcacccatttagactaactaccaagggtaga

SEQ ID NO: 41391 - DNA, 75 bp, Artificial Sequence
  Synthetic
cctggttaaactcctgagtcagctatcaacaaggacacataacttacctattacaggattgggagtccgaaacta

SEQ ID NO: 41392 - DNA, 75 bp, Artificial Sequence
  Synthetic
ggagtgtgttcagtgcaaatcaagtctgtaacgcagtcaatttaataccattagacatagcacagagatttaggg

SEQ ID NO: 41393 - DNA, 75 bp, Artificial Sequence
  Synthetic
caggtgcaatgctgacagtatataaagagctactgaggttgtcaagatgttattataacagtggtgtgtcggcag

SEQ ID NO: 41394 - DNA, 75 bp, Artificial Sequence
  Synthetic
tggtacaccactgtcccgaggtatgttgcaactaatggttacttaatatctaattttgatgagtcatcctgtgta

SEQ ID NO: 41395 - DNA, 75 bp, Artificial Sequence
  Synthetic
gattctataccctgaggtccatctagatagcccaattgtaaccaataagctagtatctattttagaatacgcacg

SEQ ID NO: 41396 - DNA, 75 bp, Artificial Sequence
  Synthetic
cttgtggaacatcaattaggactcgataaattggtgactgtgcttttcaatgggagaccagaggtaacttgggtt

SEQ ID NO: 41397 - DNA, 75 bp, Artificial Sequence
  Synthetic
gtccaacaaacccgatcaaccattcatccgaccacccgttccatccctaaatggcagaggagcaggcctatcatg

SEQ ID NO: 41398 - DNA, 75 bp, Artificial Sequence
  Synthetic
tcttggattgattcactcggatatcgagtcactacctgataaggacataattgaaaaattggaagaactgtccgc

SEQ ID NO: 41399 - DNA, 75 bp, Artificial Sequence
  Synthetic
tgtgtaagtgttatagcacaagcacaattatcaatcagagtcctgacaagctgctgacatttattgcctctgata

SEQ ID NO: 41400 - DNA, 75 bp, Artificial Sequence
  Synthetic
aattatcaatcagagtcctgacaagctgctgacatttattgcctctgatacctgcccactggttgagatagacgg

SEQ ID NO: 41401 - DNA, 75 bp, Artificial Sequence
  Synthetic
tgtaactattcaggttgggagcaggcaataccctgatatggtatacgaaagcaaagttgctctaggccctgccat

SEQ ID NO: 41402 - DNA, 75 bp, Artificial Sequence
  Synthetic
gcaaagttgctctaggccctgccatatcacttgagaggttagatgtaggtacgaatttagggaacgccctcaaga

SEQ ID NO: 41403 - DNA, 75 bp, Artificial Sequence
  Synthetic
acaacagattttgcgagtcggtattcgaacttcacccgggttggtagggcacatcctttcatcaaagcagacagc

SEQ ID NO: 41404 - DNA, 75 bp, Artificial Sequence
  Synthetic
ctcgtccctgctatgcaacatatgtcgtgtgaattagttgggcagagattagggttaaaactgcttaggtattat

SEQ ID NO: 41405 - DNA, 75 bp, Artificial Sequence
  Synthetic
gccgggcaggaacccccacgagcagacaagccccatgcacaacaaaatacccaaaaggtccaacactcgaacgca

SEQ ID NO: 41406 - DNA, 75 bp, Artificial Sequence
  Synthetic
agactcctctaaccagattcttgagacggttagacgctcttcctttaattttggcagtctcctcagcgttccaat

SEQ ID NO: 41407 - DNA, 75 bp, Artificial Sequence
  Synthetic
cacccaacaagacctccctccacaacccagcaccaaatccgccgagaccaagacctcccaagcacgacacagcat

SEQ ID NO: 41408 - DNA, 75 bp, Artificial Sequence
  Synthetic
attaagctgtacagccctggctttgttattgctgatttgctgctgtaaaagacgctaccaacagacacacaagca

SEQ ID NO: 41409 - DNA, 75 bp, Artificial Sequence
  Synthetic
ttattgctgatttgctgctgtaaaagacgctaccaacagacacacaagcagaatactaaggtcgatccgacattt

SEQ ID NO: 41410 - DNA, 75 bp, Artificial Sequence
  Synthetic
cccagcaccaaatccgccgagaccaagacctcccaagcacgacacagcataacatcggctcggcgatccacgcac

SEQ ID NO: 41411 - DNA, 75 bp, Artificial Sequence
  Synthetic
catgatcctctaacatcggacagacccatccactacatcatgaacaggatcaggtcctgcaagcaaactagctac

SEQ ID NO: 41412 - DNA, 75 bp, Artificial Sequence
  Synthetic
aaacctgacctgactggaacttcgagatcctatgtaagatcactctgaatcactctggtcacacgtcttacccga

SEQ ID NO: 41413 - DNA, 75 bp, Artificial Sequence
  Synthetic
gatcctatgtaagatcactctgaatcactctggtcacacgtcttacccgattgtcaggcgtgaaatcgataaatc

SEQ ID NO: 41414 - DNA, 75 bp, Artificial Sequence
  Synthetic
gatactgctatggcaattgatcaacgttactcaactttgcatgtcaggatcaggtatctctgggatctaattgac

SEQ ID NO: 41415 - DNA, 75 bp, Artificial Sequence
  Synthetic
gagaccacgagggtattatccatcacacaccagggagtgtcccccaaggatcgggatcccagatcaaaaggcggc

SEQ ID NO: 41416 - DNA, 75 bp, Artificial Sequence
  Synthetic
ccatccactacatcatgaacaggatcaggtcctgcaagcaaactagctacagatcagataacatcccagctcacg

SEQ ID NO: 41417 - DNA, 75 bp, Artificial Sequence
  Synthetic
tcgggatcccagatcaaaaggcggcaatccaatgcaatcaactcaggctctcagtgcacctggttagtcctgtgg

SEQ ID NO: 41418 - DNA, 75 bp, Artificial Sequence
  Synthetic
actgactacgattatcgtaattaaagaaaacttagggctcaggtagtccaacaatgctctcctaccaagacaagg

SEQ ID NO: 41419 - DNA, 75 bp, Artificial Sequence
  Synthetic
accagacaaagttggctaaggatagttaaattattgaatattttattaaaaacttagggtcaatgatcctacctt

SEQ ID NO: 41420 - DNA, 75 bp, Artificial Sequence
  Synthetic
aatccggacgatttcttatacgtacccatttagactaactaccaagggtagacctgatttcctaaggattgaatg

SEQ ID NO: 41421 - DNA, 75 bp, Artificial Sequence
  Synthetic
taccaatatggctagccttcttaaaagcctcacactgttcaagaggactcgggaccaaccccctcttgcctctgg

SEQ ID NO: 41422 - DNA, 75 bp, Artificial Sequence
  Synthetic
gggtcagaaaatccattgcatcggcagcaaatcccatccttttatcagcactctccggaggcagaggtgacatat

SEQ ID NO: 41423 - DNA, 75 bp, Artificial Sequence
  Synthetic
agcaaatcccatccttttatcagcactctccggaggcagaggtgacatattcccaccatacagatgcagtggagc

SEQ ID NO: 41424 - DNA, 75 bp, Artificial Sequence
  Synthetic
aagcatgtcattatagtcctaatcccgggtgattcaagcattgttacaagatctcgactattggatagacttgtt

SEQ ID NO: 41425 - DNA, 75 bp, Artificial Sequence
  Synthetic
tactacttcagtaggcagagttttccccctatcagtatcattatccatgtctttgatctcaaaaacatcagagat

SEQ ID NO: 41426 - DNA, 75 bp, Artificial Sequence
  Synthetic
aggttggttggtgatccagaaatcaacggccctaaattaactgggatcttaatcagtatcctctccttgttcgtg

SEQ ID NO: 41427 - DNA, 75 bp, Artificial Sequence
  Synthetic
aatcagtatgctgaccgccatctcagacggagtgtatggtaaaacttacttgttagtgcctgattatattgaaag

SEQ ID NO: 41428 - DNA, 75 bp, Artificial Sequence
  Synthetic
gtctttgagatagggttcatcaaacggtggctgaatgacatgccattactccagacaaccaactatatggtcctc

SEQ ID NO: 41429 - DNA, 75 bp, Artificial Sequence
  Synthetic
ggattctgaggcagatgagttcttcaaaattgtagacgaagggtcgaaagctcaagggcaattaggctggttgga

SEQ ID NO: 41430 - DNA, 75 bp, Artificial Sequence
  Synthetic
tactcaagtcaaatactcagggacctctcttatcagagtagcacgttatgcaacaatctcgaatgataatctttc

SEQ ID NO: 41431 - DNA, 75 bp, Artificial Sequence
  Synthetic
gaataaggatatagtagacatagaagttgatgatgctgagcaattcaatatattactagcttccatcttggctca

SEQ ID NO: 41432 - DNA, 75 bp, Artificial Sequence
  Synthetic
gacacgaactttatttatcagcaaggtatgctcctggggctggggattctcgagcacttgtttagactgtcttca

SEQ ID NO: 41433 - DNA, 75 bp, Artificial Sequence
  Synthetic
agtagtgacgctgggaatatttggggcaacaccgatgaatcaagtagaagaggtgatacctgtcgctcatccatc

SEQ ID NO: 41434 - DNA, 75 bp, Artificial Sequence
  Synthetic
tcgttataccaagaaatatttgtacaaatcctttgatctatgacagtaaccctattattgagaaagatgcagtca

SEQ ID NO: 41435 - DNA, 75 bp, Artificial Sequence
  Synthetic
attaatatgtacagccctggctttgttgttgctgatttactgttgtaaaagacgctaccaacagacactcaagca

SEQ ID NO: 41436 - DNA, 75 bp, Artificial Sequence
  Synthetic
tagagatctatgaaactgtaagtgcatttataactacagatctcaaaaagtactgtctgaattggcgttatgaga

SEQ ID NO: 41437 - DNA, 75 bp, Artificial Sequence
  Synthetic
tagaattgctgaaatgatttgtgatatagataactacattgtggaagctgggttagctagtttcatcctaactat

SEQ ID NO: 41438 - DNA, 75 bp, Artificial Sequence
  Synthetic
gacgctaccaacagacactcaagcagaatgctaaggtcgatccggcatttaaacctgatctaaccggaacatcga

SEQ ID NO: 41439 - DNA, 75 bp, Artificial Sequence
  Synthetic
caagtttggcattgaaactatgtatccggctcttgggttgcatgagttttccggagaattaacaactattgaatc

SEQ ID NO: 41440 - DNA, 75 bp, Artificial Sequence
  Synthetic
aatcctatgttagatcactctaaagtactctggtcacatgtctcactcgattgccaggcttgaaatctattaatc

SEQ ID NO: 41441 - DNA, 75 bp, Artificial Sequence
  Synthetic
tttacatacggtccggtgatactgaatggagatggtatggattattatgaaaacccacttttggactccggatgg

SEQ ID NO: 41442 - DNA, 75 bp, Artificial Sequence
  Synthetic
cctcatgatgctatatcaacagatgggtgaaacagcaccatacatggttatcttggaaaactctgttcaaaacaa

SEQ ID NO: 41443 - DNA, 75 bp, Artificial Sequence
  Synthetic
cttaccattcctcccaagaacggaacaatacttggattaataaataaagcaagtagaggagaccagttcactgta

SEQ ID NO: 41444 - DNA, 75 bp, Artificial Sequence
  Synthetic
gaaagccaaccacataatcttcgacttacaccgtaatttatttatggataacctgtccagatctgaccggtctct

SEQ ID NO: 41445 - DNA, 75 bp, Artificial Sequence
  Synthetic
accccccatgtattaacatttgcgcccagggagtcgagtggaaattgttatctacctattcaaacatcccagatt

SEQ ID NO: 41446 - DNA, 75 bp, Artificial Sequence
  Synthetic
ttagtgacagaagagcaagggggcaggagaccaccctatttgctgtttgtccttctcatcctactggttggaatc

SEQ ID NO: 41447 - DNA, 75 bp, Artificial Sequence
  Synthetic
gccgagcttggcatcaccaaggaggaagctcagctggtgtcagaaatagcatccaagacaacagaggaccggacg

SEQ ID NO: 41448 - DNA, 75 bp, Artificial Sequence
  Synthetic
ccacagaatactttatagccttgagacagaggttacatgatgtcggacatcatttgaaagcaaatgaaacaataa

SEQ ID NO: 41449 - DNA, 75 bp, Artificial Sequence
  Synthetic
atccaagacaacagaggaccggacgattcgagctactggtcccaagcaatcccaaattaccttcctgcactcgga

SEQ ID NO: 41450 - DNA, 75 bp, Artificial Sequence
  Synthetic
cgattgtttattatgtttatgacccaatccggacaatttcttatacgtacccatttagactaactaccaagggta

SEQ ID NO: 41451 - DNA, 75 bp, Artificial Sequence
  Synthetic
ggagatgagattgggttacggttgccacaaaaactaaacgagatcaaacaatttatccttcaaaagacaaatttc

SEQ ID NO: 41452 - DNA, 75 bp, Artificial Sequence
  Synthetic
ctgatatcaccaactctacaaccagtgtcgaagatttagtccgtataagattctcatgtaatcgttcaaaacctt

SEQ ID NO: 41453 - DNA, 75 bp, Artificial Sequence
  Synthetic
ttctcatgtaatcgttcaaaaccttgacagtatggtgatacacatctcaattggacttaggtatgatgactatgg

SEQ ID NO: 41454 - DNA, 75 bp, Artificial Sequence
  Synthetic
ccagggcacaccccagacgtcaacagctctgaacggagtgagccacgccacgacacccaaattacccaagatgat

SEQ ID NO: 41455 - DNA, 75 bp, Artificial Sequence
  Synthetic
tttactaattactgtgatacaattgggatcagaaaatctattgcatcggcagcaaatcctatccttttatcagca

SEQ ID NO: 41456 - DNA, 75 bp, Artificial Sequence
  Synthetic
tcattataaaaaacttaggacccaggtccaacaaacccgatcaaccattcatccgaccacccgttctatccctaa

SEQ ID NO: 41457 - DNA, 75 bp, Artificial Sequence
  Synthetic
cctcagaattaaaatcagaatttgacccaccgaaagatgacctggttaaactcctgagtcagctatcaacaagga

SEQ ID NO: 41458 - DNA, 75 bp, Artificial Sequence
  Synthetic
tcattcagaagaattgggatcaactcaacggcatgttacaaggcagttgaaatagtctctgttattaagaacgaa

SEQ ID NO: 41459 - DNA, 75 bp, Artificial Sequence
  Synthetic
gcatcagataccaaacctgcaacccaggccaagagaatggaaccacaggcatgcaggaagaggaggactctcaga

SEQ ID NO: 41460 - DNA, 75 bp, Artificial Sequence
  Synthetic
tcgagtcatctctctgaggttgagaaatatattcaaaagaggaaacagcatctatagtaaaataacagacggggt

SEQ ID NO: 41461 - DNA, 75 bp, Artificial Sequence
  Synthetic
aatatattcaaaagaggaaacagcatctatagtaaaataacagacggggtcaaaagatgcttaaacgatattaac

SEQ ID NO: 41462 - DNA, 75 bp, Artificial Sequence
  Synthetic
gttccatgatgaaagtcaggatgaggatgaagctttagcagctttcttgatggataggaaaattattatcccaag

SEQ ID NO: 41463 - DNA, 75 bp, Artificial Sequence
  Synthetic
atctcgatgaatcacacgagccaacaaaaggatcaaactatgtcggccatgtactccaaaataatccgggatgtg

SEQ ID NO: 41464 - DNA, 75 bp, Artificial Sequence
  Synthetic
gtactccaaaataatccgggatgtggagaaagcaactctgcgcttgtggaagcagagcagctccctaaagaggac

SEQ ID NO: 41465 - DNA, 75 bp, Artificial Sequence
  Synthetic
cggcaaagtaagctctgcacttgccgccgagcttggcatcaccaaggaagaggctcagctagtgtcagaaatagc

SEQ ID NO: 41466 - DNA, 75 bp, Artificial Sequence
  Synthetic
gttatcatgtttatgatcacagcggtgaagaggttaagggaatcgaagatgctgacagtctcgtggtacctgcag

SEQ ID NO: 41467 - DNA, 75 bp, Artificial Sequence
  Synthetic
gctgacagtctcgtggtacctgcaggcactgtcggtaatcgaggattcgagagcggagaaggaagccctgatgat

SEQ ID NO: 41468 - DNA, 75 bp, Artificial Sequence
  Synthetic
attccgaaggaaatgcttcatctaactggggatattctttcggccttaaaccagacagggcagctgatgtgagca

SEQ ID NO: 41469 - DNA, 75 bp, Artificial Sequence
  Synthetic
atttgaaatggtcctgatgtattgtgatgtgatagaagggagactaatgactgatactgctatggcaattgatca

SEQ ID NO: 41470 - DNA, 75 bp, Artificial Sequence
  Synthetic
atggagacggtatggattattatgaaagcccacttttggactccggatggcttactattcctcccaagaacggaa

SEQ ID NO: 41471 - DNA, 75 bp, Artificial Sequence
  Synthetic
tgctgatggaagaggaattaagtgctctgctcaagacaagcagaaatgtagggattcagaaaagggatgggaaga

SEQ ID NO: 41472 - DNA, 75 bp, Artificial Sequence
  Synthetic
gggattcagaaaagggatgggaagactctgcagttcccacataatcccgaaggtaagacaagggttccggagtgt

SEQ ID NO: 41473 - DNA, 75 bp, Artificial Sequence
  Synthetic
cccaagatacagcaattttgtgtcaacagaggcctacctcgtttttactggtcttagagcagggagactagtcaa

SEQ ID NO: 41474 - DNA, 75 bp, Artificial Sequence
  Synthetic
ttcaacctatcaattggtagctctactggagcctctttcattggcctacttgcaattgaaagacatcactttctc

SEQ ID NO: 41475 - DNA, 75 bp, Artificial Sequence
  Synthetic
ctctgcagttcccacataatcccgaaggtaagacaagggttccggagtgtggatccattaaaaagggcacagaag

SEQ ID NO: 41476 - DNA, 75 bp, Artificial Sequence
  Synthetic
gtctctaaaatcagcagtgagaatagcaactgtgtactcatgggcctatggtgatgatgacgaatcttggcaaga

SEQ ID NO: 41477 - DNA, 75 bp, Artificial Sequence
  Synthetic
gtctgcggggaatgtccgccaacctgcaatgaatgcaaagatgacccagaaatgcaaactcgagtctggtacgca

SEQ ID NO: 41478 - DNA, 75 bp, Artificial Sequence
  Synthetic
ggatccattaaaaagggcacaggagagaggtcagcctcacatggaatggggatagttgctggatcgacaagtggt

SEQ ID NO: 41479 - DNA, 75 bp, Artificial Sequence
  Synthetic
cagcagagaatgtacggaaacacatgaaccaacccaaagttgtctcctatgagaccatgatgaagggacacgcta

SEQ ID NO: 41480 - DNA, 75 bp, Artificial Sequence
  Synthetic
tgtcaccaattttacagattcgaggctgacagcaccaactctacaaccagtgttgagaatttagtccgtataaga

SEQ ID NO: 41481 - DNA, 75 bp, Artificial Sequence
  Synthetic
gctgaatctgacagtgagtatgacgatgagcttttttctgaaatacaagaaattcgatctgctatcactaagcta

SEQ ID NO: 41482 - DNA, 75 bp, Artificial Sequence
  Synthetic
ttggacttaggtatgatgactgtagtgagaaatcccttacagacgattgtaataaaccatctctagcattataaa

SEQ ID NO: 41483 - DNA, 75 bp, Artificial Sequence
  Synthetic
tgtcttcaaccaccggcgactctaacaccgtgttacatttacatgttgaaacagattgttgcgtaatacccatga

SEQ ID NO: 41484 - DNA, 75 bp, Artificial Sequence
  Synthetic
acgttacgcaactttgcacgtcagaatcaggtatctctgggatctaattgacggatttttcccggacttaggaaa

SEQ ID NO: 41485 - DNA, 75 bp, Artificial Sequence
  Synthetic
aaaactaaggatccaggatccttttagtcatggactctgtttcagtgaaccagattctataccctgaggtccatc

SEQ ID NO: 41486 - DNA, 75 bp, Artificial Sequence
  Synthetic
cttctaaagctgtacttgcatcattgatcagatcaagcagagttgatcaaagtcacaaacataacatgctggctc

SEQ ID NO: 41487 - DNA, 75 bp, Artificial Sequence
  Synthetic
gatcagatcaagcagagttgatcaaagtcacaaacataacatgctggctctgcttaaaaatatcaagggagatga

SEQ ID NO: 41488 - DNA, 75 bp, Artificial Sequence
  Synthetic
atctctaaggtctcagaattaaaatcagaatttaacccaccaaaagatgacctggctaaactcctgagtcagcta

SEQ ID NO: 41489 - DNA, 75 bp, Artificial Sequence
  Synthetic
caacctaaacgagttctaccagatggtcaagagtattactcatgcttaatctgtagcgttgactaatctactaac

SEQ ID NO: 41490 - DNA, 75 bp, Artificial Sequence
  Synthetic
tggccgtctccggggttcctaaagacaagaaagactcccatcgtggcctcactaaccagcgtaagtctataaagc

SEQ ID NO: 41491 - DNA, 75 bp, Artificial Sequence
  Synthetic
gagccatcctaaagtatatagacggttttgggacagtgggatgattgaacctgttcatggaccctctcttgactc

SEQ ID NO: 41492 - DNA, 75 bp, Artificial Sequence
  Synthetic
catagagatctatgaaaccgtaagtgcgtttataactacagatctcaaaaagtactgtctaaattggcgatatga

SEQ ID NO: 41493 - DNA, 75 bp, Artificial Sequence
  Synthetic
tcaaaattctctaaatcattagttcatgaactaaaactcaaatgccttggtggcattgtccaggatcccttaatc

SEQ ID NO: 41494 - DNA, 75 bp, Artificial Sequence
  Synthetic
aaaaccaaggaggagacaaataccccatccacttcagtgatgaacggtttccagggtacaccccagatgtcaaca

SEQ ID NO: 41495 - DNA, 75 bp, Artificial Sequence
  Synthetic
ggattgctgcctttgggagttgggcgtactacagccagacctgaggagttattgaaagaagccaccctgttggat

SEQ ID NO: 41496 - DNA, 75 bp, Artificial Sequence
  Synthetic
gtactccaaaataatccgggatgtggagagagcaacactgcgcttgtggaggcagagcagcccgctaaagatgac

SEQ ID NO: 41497 - DNA, 75 bp, Artificial Sequence
  Synthetic
tcaaggaacaactggtattttataataacaccccattgcacatcttaactccgtggaaaaaggtccttacgagtg

SEQ ID NO: 41498 - DNA, 75 bp, Artificial Sequence
  Synthetic
gggtacttaaaatcaaaagccctagaatcccatgttggtctgacatggaatgacaaacctatcttaatagatcaa

SEQ ID NO: 41499 - DNA, 75 bp, Artificial Sequence
  Synthetic
ctggggatattctttcggccttaaaccagacagagcagctgatgtgagcatgctgatggaagaggaattgagtgc

SEQ ID NO: 41500 - DNA, 75 bp, Artificial Sequence
  Synthetic
gaagtgtgttcagtgcaaatcaagtctgtaacgcagtcaatctaataccattagacatagcacaaatattcaggg

SEQ ID NO: 41501 - DNA, 75 bp, Artificial Sequence
  Synthetic
gaagaggctcaatcaagcagataagattgagagtggatcccggattcatcactgatgctgttggatgcttagaaa

SEQ ID NO: 41502 - DNA, 75 bp, Artificial Sequence
  Synthetic
aatccaatgcaaccaacgcaggctctcaatacacctggttagtcctgtggtgcatcggaatagccagtctctttc

SEQ ID NO: 41503 - DNA, 75 bp, Artificial Sequence
  Synthetic
gggatacagaaaagggatgggaagactctgcagttcccacacaatccagaaggtaagacaggggatccaggttgt

SEQ ID NO: 41504 - DNA, 75 bp, Artificial Sequence
  Synthetic
agatttcagaatttataatgatgttatcatcagcgatgatcagggtcttttcaaaattctctaaatcattagttc

SEQ ID NO: 41505 - DNA, 75 bp, Artificial Sequence
  Synthetic
aacattcatggtccatatcggcaatttcagccgtaagaaaaaccaagcttactctgctgattattgtaaactgaa

SEQ ID NO: 41506 - DNA, 75 bp, Artificial Sequence
  Synthetic
actctgctgattattgtaaactgaaaattgaaaagatgggattagtgtttgctctaggagggataggaggaacaa

SEQ ID NO: 41507 - DNA, 75 bp, Artificial Sequence
  Synthetic
attggcaaaagccattgagaaagggtttgaccggtacttagcctatgcgctgaatattttaaagatcattcaaca

SEQ ID NO: 41508 - DNA, 75 bp, Artificial Sequence
  Synthetic
ccgtccactacataatgaacaggaccaggtcttgcaagcaaactagccacagatcggataacatcccgcctcaca

SEQ ID NO: 41509 - DNA, 75 bp, Artificial Sequence
  Synthetic
gatgagcaaggccttgaatgcccagctaggtttcaagaaaatcctgtgttacccgctcatggagatcaatgaaga

SEQ ID NO: 41510 - DNA, 75 bp, Artificial Sequence
  Synthetic
cagtcttgcaaccatcagtcccacaagatttcagagtttataatgatgttatcatcagcgatgatcagggtcttt

SEQ ID NO: 41511 - DNA, 75 bp, Artificial Sequence
  Synthetic
acatcttctattgctgacctcaaacgaatgatccgatcaggccttctcggagtggagattctacatcaagtcatg

SEQ ID NO: 41512 - DNA, 75 bp, Artificial Sequence
  Synthetic
ttgaactgagtgatgatgaccgtggtaagaaatcccttaccgacgactgaattaaaccatctccagcattataaa

SEQ ID NO: 41513 - DNA, 75 bp, Artificial Sequence
  Synthetic
gagaccatgagggcaccatccatcacacaccagggagtgtctcccaaggagcgggatcccggctcaaaaggcggc

SEQ ID NO: 41514 - DNA, 75 bp, Artificial Sequence
  Synthetic
tagcattgcccaagatcccttgatccccgcaagcgaggattgagggtataaatatcgactgtctagatgttgctc

SEQ ID NO: 41515 - DNA, 75 bp, Artificial Sequence
  Synthetic
atcatcagcgatgatcagggtcttttcaaatttctctaaatcattagttcatgaactaaaactcaaacgccttag

SEQ ID NO: 41516 - DNA, 75 bp, Artificial Sequence
  Synthetic
cccgcaagcgaggattgagggtataaatatcgactgtctagatgttgctcctgcattttgagcgtggcctatagg

SEQ ID NO: 41517 - DNA, 75 bp, Artificial Sequence
  Synthetic
tttctaaactgcccatccgtgcccacaattccagtgacgcctcaatatgaaaatagctgaatcaaaacagttctt

SEQ ID NO: 41518 - DNA, 75 bp, Artificial Sequence
  Synthetic
caattccagtgacgcctcaatatgaaaatagctgaatcaaaacagttcttgcttaagattgggttgatcattatc

SEQ ID NO: 41519 - DNA, 75 bp, Artificial Sequence
  Synthetic
tctcactttaacagttatactcccacgcacttgcctgatctcaagccatcactagtagtcttgtttcacggagtg

SEQ ID NO: 41520 - DNA, 75 bp, Artificial Sequence
  Synthetic
atgactgtccatctttctatcacagctcattaataattaatcaaaacttagggtccaggacatagcaagccaaca

SEQ ID NO: 41521 - DNA, 75 bp, Artificial Sequence
  Synthetic
ctcattaataattaatcaaaacttagggtccaggacatagcaagccaacaggccaaccaagtccaccagcccgag

SEQ ID NO: 41522 - DNA, 75 bp, Artificial Sequence
  Synthetic
gccaggcaggaacccccacaaacagccaagccccatgcacaaggaaatccccaaaagctccaaaacccacacaca

SEQ ID NO: 41523 - DNA, 75 bp, Artificial Sequence
  Synthetic
ccaagccccatgcacaaggaaatccccaaaagctccaaaacccacacacatacccaacaaaaccgccccccacaa

SEQ ID NO: 41524 - DNA, 75 bp, Artificial Sequence
  Synthetic
cccagcaccggacccgacgagaccaggacctcccgagcacgacacagcataacgtcagctcagcgatccacgaac

SEQ ID NO: 41525 - DNA, 75 bp, Artificial Sequence
  Synthetic
cgtcaggcgaggaagggctgaaaggatctatcacgatcctttaccgggaactcgcaaggttcaaggataaccacc

SEQ ID NO: 41526 - DNA, 75 bp, Artificial Sequence
  Synthetic
ggacctcccgagcacgacacagcataacgtcagctcagcgatccacgaactatgatcctcgaacattggacagac

SEQ ID NO: 41527 - DNA, 75 bp, Artificial Sequence
  Synthetic
ccgtctcctacaccatgaacaggaccaggtctcgcaagcaaaccagctacagattggagaacatctcagttcacg

SEQ ID NO: 41528 - DNA, 75 bp, Artificial Sequence
  Synthetic
gaaaccacgaggctattatccagcacatgccagagagtgtctccaaaggagcgagatcccagatcgaaaggcggc

SEQ ID NO: 41529 - DNA, 75 bp, Artificial Sequence
  Synthetic
catgccagagagtgtctccaaaggagcgagatcccagatcgaaaggcggcaacccaatgcaatcaactcaggctc

SEQ ID NO: 41530 - DNA, 75 bp, Artificial Sequence
  Synthetic
gagcgaatatctcgctggaagaattacggatgatcaccccgatttctacttctactaatctagctcaccgactaa

SEQ ID NO: 41531 - DNA, 75 bp, Artificial Sequence
  Synthetic
gcatcgtaatttattcatggataatctgtccagatctgacaggtctctcatcctaacgacaatccccaaaaagaa

SEQ ID NO: 41532 - DNA, 75 bp, Artificial Sequence
  Synthetic
gagataaaggagtggttcaaattattaggttatagtgcactgattagaaatcactgacaggttagtctggctcct

SEQ ID NO: 41533 - DNA, 75 bp, Artificial Sequence
  Synthetic
atatcagagatcaaacccgcaacccaggccaagaggatggaaccgcaagcatgcaggaagaagaggtctctcagg

SEQ ID NO: 41534 - DNA, 75 bp, Artificial Sequence
  Synthetic
tgaccaagaatgtgaagcccttgcagtcattagggtcagctaggagacaaaggcgttttgcaggagtggtacttg

SEQ ID NO: 41535 - DNA, 75 bp, Artificial Sequence
  Synthetic
gtcattagggtcagctaggagacaaaggcgttttgcaggagtggtacttgcaggtgcagctttaggagtggctac

SEQ ID NO: 41536 - DNA, 75 bp, Artificial Sequence
  Synthetic
cccagcctcctcgctggcgccggctgggcaacattccgaggggaccgtcccctcggtaatggcgaatgggacgcg

SEQ ID NO: 41537 - DNA, 75 bp, Artificial Sequence
  Synthetic
gccgatccggctgctaacaaagcccgaaaggaagctgagttggctgctgccaccgctgagcaataactagcataa

SEQ ID NO: 41538 - DNA, 75 bp, Artificial Sequence
  Synthetic
aggtgatacctgttgctcacccatcagtagaaaaaatacatataacaaatcaccgtgggttcataaaagattcaa

SEQ ID NO: 41539 - DNA, 75 bp, Artificial Sequence
  Synthetic
agtagaaaaaatacatataacaaatcaccgtgggttcataaaagattcaatagcaacctggatggtgcctgcatt

SEQ ID NO: 41540 - DNA, 75 bp, Artificial Sequence
  Synthetic
ctcaagcaatccaatctcttagaaccagccttgaacagtctaacaaagctattgaagaaattagggaggctaccc

SEQ ID NO: 41541 - DNA, 75 bp, Artificial Sequence
  Synthetic
gaagtctccgcattaattggtgatgatgatatcaatagctttatcactgagtttcttctggttgagccaaggtta

SEQ ID NO: 41542 - DNA, 75 bp, Artificial Sequence
  Synthetic
gcaataactagcataaccccttggggcctctaaacgggtcttgaggggttttttgctgaaaggaggaactatatc

SEQ ID NO: 41543 - DNA, 75 bp, Artificial Sequence
  Synthetic
ctcgtccctgctatgcaacatatgtcatgtgaattagttgggcagagattagggttaaaactgcttaggtattat

SEQ ID NO: 41544 - DNA, 75 bp, Artificial Sequence
  Synthetic
atgatatcaatagctttatcactgagtttcttctggttgagccaaggttatttactgtgtacttaggtcaatgtg

SEQ ID NO: 41545 - DNA, 75 bp, Artificial Sequence
  Synthetic
agaatcctgtctttgtaagaggtgaatcatttaatgtgttagtgtctcgggatcttgtatgtatcattgacctca

SEQ ID NO: 41546 - DNA, 75 bp, Artificial Sequence
  Synthetic
ccttgcagcacatccccccttcgccagctggcgtaatagcgaagaggcccgcaccgatcgcccttcccaacagtt

SEQ ID NO: 41547 - DNA, 75 bp, Artificial Sequence
  Synthetic
atcccccatgtgttgacatttgcgcccagggaatcaagtggaaattgttatttacctattcaaacatcccagatt

SEQ ID NO: 41548 - DNA, 75 bp, Artificial Sequence
  Synthetic
tatgctcttggaggagaaattcataagatacttgagaagttgggatactctggaggtgatatgattgcaatcttg

SEQ ID NO: 41549 - DNA, 75 bp, Artificial Sequence
  Synthetic
gcctctaaacgggtcttgaggggttttttgctgaaaggaggaactatatccggatggccgccaccggccggtggg

SEQ ID NO: 41550 - DNA, 75 bp, Artificial Sequence
  Synthetic
gcgccctgtagcggcgcattaagcgcggcgggtgtggtggttacgcgcagcgtgaccgctacacttgccagcgcc

SEQ ID NO: 41551 - DNA, 75 bp, Artificial Sequence
  Synthetic
agctggcgtaatagcgaagaggcccgcaccgatcgcccttcccaacagttgcgtagcctgaatggcgaatgggac

SEQ ID NO: 41552 - DNA, 75 bp, Artificial Sequence
  Synthetic
cggcgggtgtggtggttacgcgcagcgtgaccgctacacttgccagcgccctagcgcccgctcctttcgctttct

SEQ ID NO: 41553 - DNA, 75 bp, Artificial Sequence
  Synthetic
tcccttcctttctcgccacgttcgccggctttccccgtcaagctctaaatcgggggctccctttagggttccgat

SEQ ID NO: 41554 - DNA, 75 bp, Artificial Sequence
  Synthetic
ttatagtccacagactggaagcagtttcttacaacataggatcacaagagtggtacaccactgtcccgaggtata

SEQ ID NO: 41555 - DNA, 75 bp, Artificial Sequence
  Synthetic
cggctttccccgtcaagctctaaatcgggggctccctttagggttccgatttagtgctttacggcacctcgaccc

SEQ ID NO: 41556 - DNA, 75 bp, Artificial Sequence
  Synthetic
caaaaaacttgattagggtgatggttcacgtgggccatcgccctgatagacggtttttcgccctttgacgttgga

SEQ ID NO: 41557 - DNA, 75 bp, Artificial Sequence
  Synthetic
ttgtccccaaattcgagggttgacaccaacacagaaatgtgctgtgttatcgagatacttgaaatcaaaagcctt

SEQ ID NO: 41558 - DNA, 75 bp, Artificial Sequence
  Synthetic
ttcgtctcagagtcagccatttgtagccagaactccctgtaccccatgagcccactcttacaacaatgtattagg

SEQ ID NO: 41559 - DNA, 75 bp, Artificial Sequence
  Synthetic
tcacgtgggccatcgccctgatagacggtttttcgccctttgacgttggagtccacgttctttaatagtggactc

SEQ ID NO: 41560 - DNA, 75 bp, Artificial Sequence
  Synthetic
cccactcttacaacaatgtattaggggcgacacttcatcttgtgcccggaccttggtatctgggactatgggcaa

SEQ ID NO: 41561 - DNA, 75 bp, Artificial Sequence
  Synthetic
ttgttccaaactggaacaacactcaaccctatctcggtctattcttttgatttataagggattttgccgatttcg

SEQ ID NO: 41562 - DNA, 75 bp, Artificial Sequence
  Synthetic
aatgacaaacctatcttaatagaccagtattcatgttccctgacatatctaagaagaggctctattaagcagata

SEQ ID NO: 41563 - DNA, 75 bp, Artificial Sequence
  Synthetic
agattgagagtggacccagggttcatcactgatgccgttggatgcttagaaaagcaacctctaaggagaagtcct

SEQ ID NO: 41564 - DNA, 75 bp, Artificial Sequence
  Synthetic
tcactgatgccgttggatgcttagaaaagcaacctctaaggagaagtcctatctctaaggccttagaattaaaat

SEQ ID NO: 41565 - DNA, 75 bp, Artificial Sequence
  Synthetic
gcctattggttaaaaaatgagctgatttaacaaaaatttaacgcgaattttaacaaaatattaacgtttacaatt

SEQ ID NO: 41566 - DNA, 75 bp, Artificial Sequence
  Synthetic
ttgctgacattcattgcctccgatacctgcccactggttgaaatagatggtgtaactatccaagttggaggcagg

SEQ ID NO: 41567 - DNA, 75 bp, Artificial Sequence
  Synthetic
gtgttgaacttgaaaactccatgggagggttaaatttcgagtcgtcttactttgacccagcttacttcagactcg

SEQ ID NO: 41568 - DNA, 75 bp, Artificial Sequence
  Synthetic
ggggtcaactctactgcatgttacaaagcagttgaaattgcttctgttattaagaacgaatttacgtctgaagaa

SEQ ID NO: 41569 - DNA, 75 bp, Artificial Sequence
  Synthetic
gtaccccaaaataatccgggatgtggagaacgcaatactgcgcttgtggaggcagagcagccccctaaagaggac

SEQ ID NO: 41570 - DNA, 75 bp, Artificial Sequence
  Synthetic
agactcctctaaccagatccttgagacagttaggcgctcttcctttaattttggcagtctcctcagcgttcctat

SEQ ID NO: 41571 - DNA, 75 bp, Artificial Sequence
  Synthetic
caaagagagaatttcagaagggttctcaaaccagatgatcattaactgcatcgaaatcgggagcattattaatca

SEQ ID NO: 41572 - DNA, 75 bp, Artificial Sequence
  Synthetic
agtgatttgaccatgtatttgaaagataaggctttggcagcccttaaaaaagagtgggattcagtgtacccaaaa

SEQ ID NO: 41573 - DNA, 75 bp, Artificial Sequence
  Synthetic
aatcctatgtgagatcactctgaagtattctggtcatatatctcgcttgattgccagatttgatatctattaacc

SEQ ID NO: 41574 - DNA, 75 bp, Artificial Sequence
  Synthetic
gcaatgctctcctaccaagacaaggtgggtgccttctacaaggacaatgcaagagccaattcatccaagctgtcc

SEQ ID NO: 41575 - DNA, 75 bp, Artificial Sequence
  Synthetic
agtattaatttcattaggattcactatcaattcagctatgacacgggatgtgatagaaccccttttacaagatca

SEQ ID NO: 41576 - DNA, 75 bp, Artificial Sequence
  Synthetic
ccagtgacagaagagcatgggggcaggagaccaccttatttgttgtttgtccttctcatcctattggttggaatc

SEQ ID NO: 41577 - DNA, 75 bp, Artificial Sequence
  Synthetic
taccccaagtcagagtaatagatccaggactcggcgatcggaaagatgaatgcttcatgtatatttttttactgg

SEQ ID NO: 41578 - DNA, 75 bp, Artificial Sequence
  Synthetic
gaggcttggactttggcaaaacagagagcgaacatctcacttgaagaattacggatgattaccccaatttctact

SEQ ID NO: 41579 - DNA, 75 bp, Artificial Sequence
  Synthetic
acatcctttcatcaaagcagacagcatgtgtgcagtctttgcatggacctccatttcaagctaaatcttttaatc

SEQ ID NO: 41580 - DNA, 75 bp, Artificial Sequence
  Synthetic
acggatgattaccccaatttctacttctactaatctagctcaccgactaagagacaagagtactcaagtcaaata

SEQ ID NO: 41581 - DNA, 75 bp, Artificial Sequence
  Synthetic
ccatttcaagctaaatcttttaatccttacctccagggtttaacaagtattgagaaggttttgatcaattgtggg

SEQ ID NO: 41582 - DNA, 75 bp, Artificial Sequence
  Synthetic
ttcaatccgaacagagaattcgatttccgcgatctccactggtgcattaacccgcctagtaaggtcaaggtgaat

SEQ ID NO: 41583 - DNA, 75 bp, Artificial Sequence
  Synthetic
ctcgtcaggcgaggaagggctgaaaggatctatcacgatcctttatagggaactcgcacggttcaaggataacca

SEQ ID NO: 41584 - DNA, 75 bp, Artificial Sequence
  Synthetic
ggatcagaaaatctattgcatcggcagcaaatcccatccttttatcagccctctctgggggcaggagtgacatat

SEQ ID NO: 41585 - DNA, 75 bp, Artificial Sequence
  Synthetic
gcatacccagtgttaattgcaagtcaggaaagggagctcgtatctatcattgcaaggaagtattgtggctatatt

SEQ ID NO: 41586 - DNA, 75 bp, Artificial Sequence
  Synthetic
gtcacaggaagcacattgtagagtttgtcacatggacaacagggcagctttatcatgtactagctaaatctactg

SEQ ID NO: 41587 - DNA, 75 bp, Artificial Sequence
  Synthetic
tcaacaaggacacacaacttacctattacaggattaggagtccggaactatgaggttcactcattcagaagaatt

SEQ ID NO: 41588 - DNA, 75 bp, Artificial Sequence
  Synthetic
tactacttcagtaggcaaagttttccccctatcagtctcgttatccatgtctttgatctcaagaacctcagagat

SEQ ID NO: 41589 - DNA, 75 bp, Artificial Sequence
  Synthetic
aatcaatatgctgaccgctacctcagacggcgtgtatggcaaaacttacttgctagtgcctgatgatatagaacg

SEQ ID NO: 41590 - DNA, 75 bp, Artificial Sequence
  Synthetic
aggaaagggagctcgtatctatcattgcaaggaagtattgtggctatattttgctttactcgggagacttatacg

SEQ ID NO: 41591 - DNA, 75 bp, Artificial Sequence
  Synthetic
tgcaaggaagtattgtggctatattttgctttactcgggagacttatacgaaattaccaggatagttcgaaacct

SEQ ID NO: 41592 - DNA, 75 bp, Artificial Sequence
  Synthetic
tgctagtgcctgatgatatagaacgggagttcgacactcaagagattcgagtctttgaaatagggttcattaaaa

SEQ ID NO: 41593 - DNA, 75 bp, Artificial Sequence
  Synthetic
ggtggctgaatgacatgccattactccaaacaaccaactatatggtcctcccggagaattccaaagccaaggtat

SEQ ID NO: 41594 - DNA, 75 bp, Artificial Sequence
  Synthetic
ttacaccgtaatttatttatggataacctgtccagatctgaccggtctctcatcctgacaacaatccccaaaaag

SEQ ID NO: 41595 - DNA, 75 bp, Artificial Sequence
  Synthetic
ctaaccctctactattcgctgctattaaacttaattatacgaaaaaaaacaacggttattaataagttatcatac

SEQ ID NO: 41596 - DNA, 75 bp, Artificial Sequence
  Synthetic
actggcttccttgtgtgtagaagagagcactgtattattataccatgacagcaggggttcacaagatggtattct

SEQ ID NO: 41597 - DNA, 75 bp, Artificial Sequence
  Synthetic
cacccaagattagaagcaataacagcagcagaaaacgtacggaaacacatgaatcaacccaaagttgtctcctat

SEQ ID NO: 41598 - DNA, 75 bp, Artificial Sequence
  Synthetic
tcgctgctattaaacttaattatacgaaaaaaaacaacggttattaataagttatcatacccagctttgtctggt

SEQ ID NO: 41599 - DNA, 75 bp, Artificial Sequence
  Synthetic
cccagcaccgaacccgaagagaccaggacctcccgagcacgacacagcataacatcagctcagcgatccacgcac

SEQ ID NO: 41600 - DNA, 75 bp, Artificial Sequence
  Synthetic
gcaacacctatggatcatattgaggaagtgatacctgtcgctcacccatcaatggagaaaatacatataacaaac

SEQ ID NO: 41601 - DNA, 75 bp, Artificial Sequence
  Synthetic
tcattgctattaaatttaattatacgaaaaaaaacaacggttattaataagttatcatacccagctttgtctggt

SEQ ID NO: 41602 - DNA, 75 bp, Artificial Sequence
  Synthetic
ccagacagagcagctgatgtgagcatgctgatggaagaggaattgagtgctctgctcaggacaagcagaaatgta

SEQ ID NO: 41603 - DNA, 75 bp, Artificial Sequence
  Synthetic
ctaaccctctgctattcattgctattaaatttaattatacgaaaaaaaacaacggttattaataagttatcatac

SEQ ID NO: 41604 - DNA, 75 bp, Artificial Sequence
  Synthetic
ttgcaacctggatggtgcctgccctggcctctgagaaacaagaagaacaaaaaggttggctggagtcagcttgtc

SEQ ID NO: 41605 - DNA, 75 bp, Artificial Sequence
  Synthetic
tatgatcctcgaacatcggacagacccgtctcctacaccatggacaggatcaggtcccgcaagcaaactagccac

SEQ ID NO: 41606 - DNA, 75 bp, Artificial Sequence
  Synthetic
aagtgatacctgtcgctcacccatcaatggagaaaatacatataacaaaccaccgtggttttataaaagattcaa

SEQ ID NO: 41607 - DNA, 75 bp, Artificial Sequence
  Synthetic
gtgttgaacttgaaaactccatgggaggattaaatttcggtcgatcttactttgacccagcttacttcagactcg

SEQ ID NO: 41608 - DNA, 75 bp, Artificial Sequence
  Synthetic
ccaaacgtcatgggaacccttcggaggaggacagttgccatcttatgggcggttgacattacctctagatgcaag

SEQ ID NO: 41609 - DNA, 75 bp, Artificial Sequence
  Synthetic
tctgctcaggacaagcagaaatgtagggatacagaaaagggatgggaagactctgcagttcccacgcaatccaga

SEQ ID NO: 41610 - DNA, 75 bp, Artificial Sequence
  Synthetic
accacctatcccgatggtaggctagtaccccaagtcagagtgatagatccaggactcggcgatcgaaaagatgaa

SEQ ID NO: 41611 - DNA, 75 bp, Artificial Sequence
  Synthetic
ccgtctcctacaccatggacaggatcaggtcccgcaagcaaactagccacagattgaagaacatcccagttcacg

SEQ ID NO: 41612 - DNA, 75 bp, Artificial Sequence
  Synthetic
caaaaaatgactgaggtgtacgacttcgatcagtcttcctgggacaccaagggctcactggcccccattctgccc

SEQ ID NO: 41613 - DNA, 75 bp, Artificial Sequence
  Synthetic
aagatccgaagtcgctaatcaacaacccccgaccatcaacaagaggtccgaaaaccagggaggagacaaataccc

SEQ ID NO: 41614 - DNA, 75 bp, Artificial Sequence
  Synthetic
cccccgaccatcaacaagaggtccgaaaaccagggaggagacaaataccccattcacttcagtgatgaaaggctt

SEQ ID NO: 41615 - DNA, 75 bp, Artificial Sequence
  Synthetic
caatccttggattgataaacaaagcaagtagaggagaccagttcactgtgataccccaagtattaacatttgcgc

SEQ ID NO: 41616 - DNA, 75 bp, Artificial Sequence
  Synthetic
ccagggtataccccagatgtcaacagttctgaatggagtgagtcacgctatgacacccgaattatccaagatgat

SEQ ID NO: 41617 - DNA, 75 bp, Artificial Sequence
  Synthetic
ccagggaatcatgtggaaattgttatttacctattcaaacatctcaaattatagatagagatgtcctcatcgagt

SEQ ID NO: 41618 - DNA, 75 bp, Artificial Sequence
  Synthetic
acggatttttcccggacttgggaaattcaacctatcaattggtagctctactggagcctctttcattggcctact

SEQ ID NO: 41619 - DNA, 75 bp, Artificial Sequence
  Synthetic
gagttttagatatgtcatagcaacgtatgatatatcacgaaatgatcatgcgattgtttattatgtttatgaccc

SEQ ID NO: 41620 - DNA, 75 bp, Artificial Sequence
  Synthetic
tttataatgatagagagctactcaattaaatattcaagaccagtcttgcatcagtcaacaattatcattctaaac

SEQ ID NO: 41621 - DNA, 75 bp, Artificial Sequence
  Synthetic
gcagagcttggcatcaccaaggaagaggctcagctagtgtcagaaatagcatccaagacaacggaggaccggacg

SEQ ID NO: 41622 - DNA, 75 bp, Artificial Sequence
  Synthetic
ctaacatcgccaactctacaaccagtgttgagaatttagtccgtataagattctcatgtaaccgttcaaatccct

SEQ ID NO: 41623 - DNA, 75 bp, Artificial Sequence
  Synthetic
gaaattattaaattcagtcctcgagccaatcaatcaagctttgactctaatgaccaagaatgtgaagcccctaca

SEQ ID NO: 41624 - DNA, 75 bp, Artificial Sequence
  Synthetic
ccaactttatcagaagtcaagggggttatagtccacaggctggaagcagtttcttacaacataggatcacaagag

SEQ ID NO: 41625 - DNA, 75 bp, Artificial Sequence
  Synthetic
tgttgagaatttagtccgtataagattctcatgtaaccgttcaaatccctgacagtataatgatacacatctcaa

SEQ ID NO: 41626 - DNA, 75 bp, Artificial Sequence
  Synthetic
atttatccttcaaaagacaaacttcttcaatccgaacagggagttcgacttccgcgatctccactggtgcattaa

SEQ ID NO: 41627 - DNA, 75 bp, Artificial Sequence
  Synthetic
aagagataaaagagtggttcaaattgttggggtatagtgcactgattagaaatcactgacgggttggtctggctc

SEQ ID NO: 41628 - DNA, 75 bp, Artificial Sequence
  Synthetic
ccgcccaattttcttcaaaagtcactcaactgcaataaacattggaaaagactgaccatgattatcgtgattaaa

SEQ ID NO: 41629 - DNA, 75 bp, Artificial Sequence
  Synthetic
cccacctagtaagatcaaagtgaattttactaattactgcgatacaattgggatcagaaaatctattgcatcggc

SEQ ID NO: 41630 - DNA, 75 bp, Artificial Sequence
  Synthetic
accacttatcccgatggtaggctcataccccaagtcagagtaatagatccaggactcggcgatcggaaagatgaa

SEQ ID NO: 41631 - DNA, 75 bp, Artificial Sequence
  Synthetic
gaaaacttagggctcaggtagtccagcaatgctctcctaccaagacaaggtgggtgccttctacaaggataatgc

SEQ ID NO: 41632 - DNA, 75 bp, Artificial Sequence
  Synthetic
gcaatgctctcctaccaagacaaggtgggtgccttctacaaggataatgcaagagccaattcaaccaagctgtcc

SEQ ID NO: 41633 - DNA, 75 bp, Artificial Sequence
  Synthetic
ggcaagaaatggttagacgatctgccggcaaagtaagctccgcacttgctgccgagcttggcatcaccaaggagg

SEQ ID NO: 41634 - DNA, 75 bp, Artificial Sequence
  Synthetic
ctttgatctcaagaacatcagagataatcaatatgctaaccgctatctcagacggagtgtatggtaaaacttatt

SEQ ID NO: 41635 - DNA, 75 bp, Artificial Sequence
  Synthetic
gaccttgttatcttatcccaaacacaaccatgtgatatacccaaattgcaacaaacttctatttcatgcacagga

SEQ ID NO: 41636 - DNA, 75 bp, Artificial Sequence
  Synthetic
ggagaccaccttatttgttgtttgtccttctcatcttattggttggaatcctggccttgcttgctatcactggag

SEQ ID NO: 41637 - DNA, 75 bp, Artificial Sequence
  Synthetic
tatgatatatcccgggaaaatcatgcgattgtttattatgtttatgacccaatccggacaatttctttatcgtac

SEQ ID NO: 41638 - DNA, 75 bp, Artificial Sequence
  Synthetic
aatcaatatgctaaccgctatctcagacggagtgtatggtaaaacttatttgctagttcctgattatattgaagg

SEQ ID NO: 41639 - DNA, 75 bp, Artificial Sequence
  Synthetic
aaccatgtgatatacccaaattgcaacaaacttctatttcatgcacaggatcgagtcatctctctgaggctgaga

SEQ ID NO: 41640 - DNA, 75 bp, Artificial Sequence
  Synthetic
agctcacagtggttcgaacctttccttctatggtttacaattaaaacagaaatgagatcagtgattaaatcctct

SEQ ID NO: 41641 - DNA, 75 bp, Artificial Sequence
  Synthetic
tctatagcaaaataacagacggggtcaaaaaatgcttaaacgatattaatcttaatattggtttagggggtgcac

SEQ ID NO: 41642 - DNA, 75 bp, Artificial Sequence
  Synthetic
aatgagatcagtgattaaatcctctactcacaactgtcgcaagcggaggcagaatcctgtctttgtaaaaggtga

SEQ ID NO: 41643 - DNA, 75 bp, Artificial Sequence
  Synthetic
tgttaatttcacaatccctgaaaagtatagctaggtgcgtattttggtcagaaacaatagtggatgagacccgag

SEQ ID NO: 41644 - DNA, 75 bp, Artificial Sequence
  Synthetic
actcacaactgtcgcaagcggaggcagaatcctgtctttgtaaaaggtgaatcatttaatgtgttagtgtctagg

SEQ ID NO: 41645 - DNA, 75 bp, Artificial Sequence
  Synthetic
gacggcgtgtatggcaaaacttacttgctagtgcctgatgatatagaaagagagttcgacactcaagagattcga

SEQ ID NO: 41646 - DNA, 75 bp, Artificial Sequence
  Synthetic
atttgaaatggtcttgatgtactgtgatgtaatagaagggaggctaatgactgatactgctatggcaattgatca

SEQ ID NO: 41647 - DNA, 75 bp, Artificial Sequence
  Synthetic
atcaggtatctctgggatctaattgacggatttttcccggatctgggaaattcaacctatcaattggtggctcta

SEQ ID NO: 41648 - DNA, 75 bp, Artificial Sequence
  Synthetic
aaagaaaaacctaccccatgtgcaaccaaacgtcatgggaacccttcggaggaagacagttgccatcttatgggc

SEQ ID NO: 41649 - DNA, 75 bp, Artificial Sequence
  Synthetic
atggagatggtatggattattatgaaagcccacttttgaactccggatggcttaccattcctcccaaaaacggaa

SEQ ID NO: 41650 - DNA, 75 bp, Artificial Sequence
  Synthetic
gggttttgaaattcacctctaggaatctcacttaaccaattatacctccacgcgcttgcccgatctcaagctatt

SEQ ID NO: 41651 - DNA, 75 bp, Artificial Sequence
  Synthetic
gggttttgaaattcacctctaggaatctcactttaccaattatacctccacgcgcttgcccgatctcaagctatt

SEQ ID NO: 41652 - DNA, 75 bp, Artificial Sequence
  Synthetic
gggttttgaaattcacctctaggaatctcacttcaccaattatacctccacgcgcttgcccgatctcaagctatt

SEQ ID NO: 41653 - DNA, 75 bp, Artificial Sequence
  Synthetic
gggttttgaaattcacctctaggaatctcacttgaccaattatacctccacgcgcttgcccgatctcaagctatt

SEQ ID NO: 41654 - DNA, 75 bp, Artificial Sequence
  Synthetic
actagtagtcctgtttcacgaaattctgactgtctatctttctatcaccaatcgttaataattaatcaaaactta

SEQ ID NO: 41655 - DNA, 75 bp, Artificial Sequence
  Synthetic
tttacctattcaaacatctcaaattatagatagagatgtcctcattgagtccaatatagtggtgttgcctacaca

SEQ ID NO: 41656 - DNA, 75 bp, Artificial Sequence
  Synthetic
cagcagaaaacgtacggaaacacatgaatcaacccaaagttgtctcttatgagactatgatgaagggacatgcta

SEQ ID NO: 41657 - DNA, 75 bp, Artificial Sequence
  Synthetic
tattctgtgggataatcattaacggttatcgggatagacatgggggaacttggcctccgatggatcttcctgttc

SEQ ID NO: 41658 - DNA, 75 bp, Artificial Sequence
  Synthetic
ttatcgggatagacatgggggaacttggcctccgatggatcttcctgttcatgcatctcccatcatcagaaatgc

SEQ ID NO: 41659 - DNA, 75 bp, Artificial Sequence
  Synthetic
cacaccagagagtgtcacccaaggagcgagttcctggttcaagaggcggcaatccaatgcaaccaacgcaggctc

SEQ ID NO: 41660 - DNA, 75 bp, Artificial Sequence
  Synthetic
tggtaatgatatgattgcaattttggagagtcgggggataaaaacaaaaataacccatgtcgatctccccgggaa

SEQ ID NO: 41661 - DNA, 75 bp, Artificial Sequence
  Synthetic
agtgatttgaccatgtacctgaaagataaggctttggcagccctaagaaaagagtgggactcagtgtacccaaaa

SEQ ID NO: 41662 - DNA, 75 bp, Artificial Sequence
  Synthetic
ttatagtccacagactggaagcagtttcttataacatagggtcacaggagtggtacaccactgtcccgaagtatg

SEQ ID NO: 41663 - DNA, 75 bp, Artificial Sequence
  Synthetic
aagaaaccgtcattgccgttcagggagtccaggattacgtcaacaacgaactcgtccctgctatgcaacatatgt

SEQ ID NO: 41664 - DNA, 75 bp, Artificial Sequence
  Synthetic
ctgcaccttatcgaggagcccttcactccgtctcttccccaagtagtagatatatagacccaaacccaaattttt

SEQ ID NO: 41665 - DNA, 75 bp, Artificial Sequence
  Synthetic
ataaattattgaatattttattaaaaacttagggtcaatgatcctaccttagagaacaaggtcagggttcagacc

SEQ ID NO: 41666 - DNA, 75 bp, Artificial Sequence
  Synthetic
gtcatagcagaaaacttgatatctaatggaattgggaagtacttcaaggacaatgggatggcaaaggatgaacac

SEQ ID NO: 41667 - DNA, 75 bp, Artificial Sequence
  Synthetic
gatggataggaaaattattatcccaagggctgcacatgaaattctagataacacgatcacgggtgcaagagaggc

SEQ ID NO: 41668 - DNA, 75 bp, Artificial Sequence
  Synthetic
caagaaagacttccatcgtggcctcactaaccagagtaaatccctgaaacctgcaccttatcgaggagcacttca

SEQ ID NO: 41669 - DNA, 75 bp, Artificial Sequence
  Synthetic
agtactgtctgaattggcgttatgagaccatcagtatttttgctcagagattaaatgaaatctacggtctcccct

SEQ ID NO: 41670 - DNA, 75 bp, Artificial Sequence
  Synthetic
aactggatgatgctaaggtactgatagactcctctaaccagatccttgagacggttaggcgctcttcctttaatt

SEQ ID NO: 41671 - DNA, 75 bp, Artificial Sequence
  Synthetic
acggttaggcgctcttcctttaattttggcagtctcctcagcgttcctatattaagtggtacagccctggctttg

SEQ ID NO: 41672 - DNA, 75 bp, Artificial Sequence
  Synthetic
tagtattacagagggaacatctgcactgagggtaccatacatcgggtccacaacagaagaaagaacagacatgaa

SEQ ID NO: 41673 - DNA, 75 bp, Artificial Sequence
  Synthetic
ataatctttcttttgtgatagctgacaagaaagtggacacaaactttatttatcagcaaggtatgctcctgggcc

SEQ ID NO: 41674 - DNA, 75 bp, Artificial Sequence
  Synthetic
taccaaatgggtgaattgttgttctctttcttgagtagaatgagtaaaggagtcttcaaaattttaaccaatgca

SEQ ID NO: 41675 - DNA, 75 bp, Artificial Sequence
  Synthetic
ttttatgcgaaagtgatgaggatgtcatacctgaaagatttgacaacatacaagctaggcacctatgcatcctat

SEQ ID NO: 41676 - DNA, 75 bp, Artificial Sequence
  Synthetic
aaatacccaatggggggggtggagggttattgtcagaagttgtggactattagcaccataccttatttgtacttg

SEQ ID NO: 41677 - DNA, 75 bp, Artificial Sequence
  Synthetic
gcggcacatgagagcggtgtcagaattgcatcacttgtccaaggtgataaccaaactattgctgtcactaaaaga

SEQ ID NO: 41678 - DNA, 75 bp, Artificial Sequence
  Synthetic
ccaacacagaaatgtgctgtgttatcgaggtacttaaaatcaaaagccctagagtcccatgttggtctgacatgg

SEQ ID NO: 41679 - DNA, 75 bp, Artificial Sequence
  Synthetic
agagtcccatgttggtctgacatggaatgacaaacctatcttgatagatcagtattcatgttccctgacatatct

SEQ ID NO: 41680 - DNA, 75 bp, Artificial Sequence
  Synthetic
acctctaaggcctcagaattaaagtcagaatttgacccaccgaaagatgacttggctaaacttctgagtcagctg

SEQ ID NO: 41681 - DNA, 75 bp, Artificial Sequence
  Synthetic
ccaaactattgctgtcactaaaagagtaccaagcacctggtcctatgccttgaagaaatctgaagccagtcgagt

SEQ ID NO: 41682 - DNA, 75 bp, Artificial Sequence
  Synthetic
atatcagagatcaaacccgcaatccaagccaggcggatggaaccgcaagcatgcaagaagaagaggtctctcagg

SEQ ID NO: 41683 - DNA, 75 bp, Artificial Sequence
  Synthetic
tcccaccatacagatgcagtggagctactacttcagtaggcaaagttttccccctatcagtctcgttatccatgt

SEQ ID NO: 41684 - DNA, 75 bp, Artificial Sequence
  Synthetic
aattggctctttcaacttgagacaaaagagataaaagagtggttcaaactgttagggtatagtgcactgattaga

SEQ ID NO: 41685 - DNA, 75 bp, Artificial Sequence
  Synthetic
tttgaccgatatttagcctacgcactgaacattttaaaaatcattcaacaagtattaatttcattaggattcact

SEQ ID NO: 41686 - DNA, 75 bp, Artificial Sequence
  Synthetic
tcattgctattaaacttagttatacgaaaaaaaacaacggttattaataagttatcatacccagctttgtctggt

SEQ ID NO: 41687 - DNA, 75 bp, Artificial Sequence
  Synthetic
ttcaacttgagacaaaagagataaaagagtggttcaaactgttagggtatagtgcactgattagaaaccactgac

SEQ ID NO: 41688 - DNA, 75 bp, Artificial Sequence
  Synthetic
ctaaccctctgctattcattgatattaaatttaattatacgaaaaaaaacaacgattattaataagttatcatac

SEQ ID NO: 41689 - DNA, 75 bp, Artificial Sequence
  Synthetic
ctaaccctctgctattcattgatattaaatttaattatacgaaaaaaaacaacgtttattaataagttatcatac

SEQ ID NO: 41690 - DNA, 75 bp, Artificial Sequence
  Synthetic
ctaaccctctgctattcattgatattaaatttaattatacgaaaaaaaacaacgcttattaataagttatcatac

SEQ ID NO: 41691 - DNA, 75 bp, Artificial Sequence
  Synthetic
ctaaccctctgctattcattgatattaaatttaattatacgaaaaaaaacaacggttattaataagttatcatac

SEQ ID NO: 41692 - DNA, 75 bp, Artificial Sequence
  Synthetic
ctaaccctctgctattcattgttattaaatttaattatacgaaaaaaaacaacgattattaataagttatcatac

SEQ ID NO: 41693 - DNA, 75 bp, Artificial Sequence
  Synthetic
ctaaccctctgctattcattgttattaaatttaattatacgaaaaaaaacaacgtttattaataagttatcatac

SEQ ID NO: 41694 - DNA, 75 bp, Artificial Sequence
  Synthetic
ctaaccctctgctattcattgttattaaatttaattatacgaaaaaaaacaacgcttattaataagttatcatac

SEQ ID NO: 41695 - DNA, 75 bp, Artificial Sequence
  Synthetic
ctaaccctctgctattcattgttattaaatttaattatacgaaaaaaaacaacggttattaataagttatcatac

SEQ ID NO: 41696 - DNA, 75 bp, Artificial Sequence
  Synthetic
ctaaccctctgctattcattgctattaaatttaattatacgaaaaaaaacaacgattattaataagttatcatac

SEQ ID NO: 41697 - DNA, 75 bp, Artificial Sequence
  Synthetic
ctaaccctctgctattcattgctattaaatttaattatacgaaaaaaaacaacgtttattaataagttatcatac

SEQ ID NO: 41698 - DNA, 75 bp, Artificial Sequence
  Synthetic
ctaaccctctgctattcattgctattaaatttaattatacgaaaaaaaacaacgcttattaataagttatcatac

SEQ ID NO: 41699 - DNA, 75 bp, Artificial Sequence; identical to SEQ ID NO: 41603
  Synthetic

SEQ ID NO: 41700 - DNA, 75 bp, Artificial Sequence
  Synthetic
ctaaccctctgctattcattggtattaaatttaattatacgaaaaaaaacaacgattattaataagttatcatac

SEQ ID NO: 41701 - DNA, 75 bp, Artificial Sequence
  Synthetic
ctaaccctctgctattcattggtattaaatttaattatacgaaaaaaaacaacgtttattaataagttatcatac

SEQ ID NO: 41702 - DNA, 75 bp, Artificial Sequence
  Synthetic
ctaaccctctgctattcattggtattaaatttaattatacgaaaaaaaacaacgcttattaataagttatcatac

SEQ ID NO: 41703 - DNA, 75 bp, Artificial Sequence
  Synthetic
ctaaccctctgctattcattggtattaaatttaattatacgaaaaaaaacaacggttattaataagttatcatac

SEQ ID NO: 41704 - DNA, 75 bp, Artificial Sequence
  Synthetic
cttaccctctgctattcattgatattaaatttaattatacgaaaaaaaacaacgattattaataagttatcatac

SEQ ID NO: 41705 - DNA, 75 bp, Artificial Sequence
  Synthetic
cttaccctctgctattcattgatattaaatttaattatacgaaaaaaaacaacgtttattaataagttatcatac

SEQ ID NO: 41706 - DNA, 75 bp, Artificial Sequence
  Synthetic
cttaccctctgctattcattgatattaaatttaattatacgaaaaaaaacaacgcttattaataagttatcatac

SEQ ID NO: 41707 - DNA, 75 bp, Artificial Sequence
  Synthetic
cttaccctctgctattcattgatattaaatttaattatacgaaaaaaaacaacggttattaataagttatcatac

SEQ ID NO: 41708 - DNA, 75 bp, Artificial Sequence
  Synthetic
cttaccctctgctattcattgttattaaatttaattatacgaaaaaaaacaacgattattaataagttatcatac

SEQ ID NO: 41709 - DNA, 75 bp, Artificial Sequence
  Synthetic
cttaccctctgctattcattgttattaaatttaattatacgaaaaaaaacaacgtttattaataagttatcatac

SEQ ID NO: 41710 - DNA, 75 bp, Artificial Sequence
  Synthetic
cttaccctctgctattcattgttattaaatttaattatacgaaaaaaaacaacgcttattaataagttatcatac

SEQ ID NO: 41711 - DNA, 75 bp, Artificial Sequence
  Synthetic
cttaccctctgctattcattgttattaaatttaattatacgaaaaaaaacaacggttattaataagttatcatac

SEQ ID NO: 41712 - DNA, 75 bp, Artificial Sequence
  Synthetic
cttaccctctgctattcattgctattaaatttaattatacgaaaaaaaacaacgattattaataagttatcatac

SEQ ID NO: 41713 - DNA, 75 bp, Artificial Sequence
  Synthetic
cttaccctctgctattcattgctattaaatttaattatacgaaaaaaaacaacgtttattaataagttatcatac

SEQ ID NO: 41714 - DNA, 75 bp, Artificial Sequence
  Synthetic
cttaccctctgctattcattgctattaaatttaattatacgaaaaaaaacaacgcttattaataagttatcatac

SEQ ID NO: 41715 - DNA, 75 bp, Artificial Sequence
  Synthetic
cttaccctctgctattcattgctattaaatttaattatacgaaaaaaaacaacggttattaataagttatcatac

SEQ ID NO: 41716 - DNA, 75 bp, Artificial Sequence
  Synthetic
cttaccctctgctattcattggtattaaatttaattatacgaaaaaaaacaacgattattaataagttatcatac

SEQ ID NO: 41717 - DNA, 75 bp, Artificial Sequence
  Synthetic
cttaccctctgctattcattggtattaaatttaattatacgaaaaaaaacaacgtttattaataagttatcatac

SEQ ID NO: 41718 - DNA, 75 bp, Artificial Sequence
  Synthetic
cttaccctctgctattcattggtattaaatttaattatacgaaaaaaaacaacgcttattaataagttatcatac

SEQ ID NO: 41719 - DNA, 75 bp, Artificial Sequence
  Synthetic
cttaccctctgctattcattggtattaaatttaattatacgaaaaaaaacaacggttattaataagttatcatac

SEQ ID NO: 41720 - DNA, 75 bp, Artificial Sequence
  Synthetic
ctcaccctctgctattcattgatattaaatttaattatacgaaaaaaaacaacgattattaataagttatcatac

SEQ ID NO: 41721 - DNA, 75 bp, Artificial Sequence
  Synthetic
ctcaccctctgctattcattgatattaaatttaattatacgaaaaaaaacaacgtttattaataagttatcatac

SEQ ID NO: 41722 - DNA, 75 bp, Artificial Sequence
  Synthetic
ctcaccctctgctattcattgatattaaatttaattatacgaaaaaaaacaacgcttattaataagttatcatac

SEQ ID NO: 41723 - DNA, 75 bp, Artificial Sequence
  Synthetic
ctcaccctctgctattcattgatattaaatttaattatacgaaaaaaaacaacggttattaataagttatcatac

SEQ ID NO: 41724 - DNA, 75 bp, Artificial Sequence
  Synthetic
ctcaccctctgctattcattgttattaaatttaattatacgaaaaaaaacaacgattattaataagttatcatac

SEQ ID NO: 41725 - DNA, 75 bp, Artificial Sequence
  Synthetic
ctcaccctctgctattcattgttattaaatttaattatacgaaaaaaaacaacgtttattaataagttatcatac

SEQ ID NO: 41726 - DNA, 75 bp, Artificial Sequence
  Synthetic
ctcaccctctgctattcattgttattaaatttaattatacgaaaaaaaacaacgcttattaataagttatcatac

SEQ ID NO: 41727 - DNA, 75 bp, Artificial Sequence
  Synthetic
ctcaccctctgctattcattgttattaaatttaattatacgaaaaaaaacaacggttattaataagttatcatac

SEQ ID NO: 41728 - DNA, 75 bp, Artificial Sequence
  Synthetic
ctcaccctctgctattcattgctattaaatttaattatacgaaaaaaaacaacgattattaataagttatcatac

SEQ ID NO: 41729 - DNA, 75 bp, Artificial Sequence
  Synthetic
ctcaccctctgctattcattgctattaaatttaattatacgaaaaaaaacaacgtttattaataagttatcatac

SEQ ID NO: 41730 - DNA, 75 bp, Artificial Sequence
  Synthetic
ctcaccctctgctattcattgctattaaatttaattatacgaaaaaaaacaacgcttattaataagttatcatac

SEQ ID NO: 41731 - DNA, 75 bp, Artificial Sequence
  Synthetic
ctcaccctctgctattcattgctattaaatttaattatacgaaaaaaaacaacggttattaataagttatcatac

SEQ ID NO: 41732 - DNA, 75 bp, Artificial Sequence
  Synthetic
ctcaccctctgctattcattggtattaaatttaattatacgaaaaaaaacaacgattattaataagttatcatac

SEQ ID NO: 41733 - DNA, 75 bp, Artificial Sequence
  Synthetic
ctcaccctctgctattcattggtattaaatttaattatacgaaaaaaaacaacgtttattaataagttatcatac

SEQ ID NO: 41734 - DNA, 75 bp, Artificial Sequence
  Synthetic
ctcaccctctgctattcattggtattaaatttaattatacgaaaaaaaacaacgcttattaataagttatcatac

SEQ ID NO: 41735 - DNA, 75 bp, Artificial Sequence
  Synthetic
ctcaccctctgctattcattggtattaaatttaattatacgaaaaaaaacaacggttattaataagttatcatac

SEQ ID NO: 41736 - DNA, 75 bp, Artificial Sequence
  Synthetic
ctgaccctctgctattcattgatattaaatttaattatacgaaaaaaaacaacgattattaataagttatcatac

SEQ ID NO: 41737 - DNA, 75 bp, Artificial Sequence
  Synthetic
ctgaccctctgctattcattgatattaaatttaattatacgaaaaaaaacaacgtttattaataagttatcatac

SEQ ID NO: 41738 - DNA, 75 bp, Artificial Sequence
  Synthetic
ctgaccctctgctattcattgatattaaatttaattatacgaaaaaaaacaacgcttattaataagttatcatac

SEQ ID NO: 41739 - DNA, 75 bp, Artificial Sequence
  Synthetic
ctgaccctctgctattcattgatattaaatttaattatacgaaaaaaaacaacggttattaataagttatcatac

SEQ ID NO: 41740 - DNA, 75 bp, Artificial Sequence
  Synthetic
ctgaccctctgctattcattgttattaaatttaattatacgaaaaaaaacaacgattattaataagttatcatac

SEQ ID NO: 41741 - DNA, 75 bp, Artificial Sequence
  Synthetic
ctgaccctctgctattcattgttattaaatttaattatacgaaaaaaaacaacgtttattaataagttatcatac

SEQ ID NO: 41742 - DNA, 75 bp, Artificial Sequence
  Synthetic
ctgaccctctgctattcattgttattaaatttaattatacgaaaaaaaacaacgcttattaataagttatcatac

SEQ ID NO: 41743 - DNA, 75 bp, Artificial Sequence
  Synthetic
ctgaccctctgctattcattgttattaaatttaattatacgaaaaaaaacaacggttattaataagttatcatac

SEQ ID NO: 41744 - DNA, 75 bp, Artificial Sequence
  Synthetic
ctgaccctctgctattcattgctattaaatttaattatacgaaaaaaaacaacgattattaataagttatcatac

SEQ ID NO: 41745 - DNA, 75 bp, Artificial Sequence
  Synthetic
ctgaccctctgctattcattgctattaaatttaattatacgaaaaaaaacaacgtttattaataagttatcatac

SEQ ID NO: 41746 - DNA, 75 bp, Artificial Sequence
  Synthetic
ctgaccctctgctattcattgctattaaatttaattatacgaaaaaaaacaacgcttattaataagttatcatac

SEQ ID NO: 41747 - DNA, 75 bp, Artificial Sequence
  Synthetic
ctgaccctctgctattcattgctattaaatttaattatacgaaaaaaaacaacggttattaataagttatcatac

SEQ ID NO: 41748 - DNA, 75 bp, Artificial Sequence
  Synthetic
ctgaccctctgctattcattggtattaaatttaattatacgaaaaaaaacaacgattattaataagttatcatac

SEQ ID NO: 41749 - DNA, 75 bp, Artificial Sequence
  Synthetic
ctgaccctctgctattcattggtattaaatttaattatacgaaaaaaaacaacgtttattaataagttatcatac

SEQ ID NO: 41750 - DNA, 75 bp, Artificial Sequence
  Synthetic
ctgaccctctgctattcattggtattaaatttaattatacgaaaaaaaacaacgcttattaataagttatcatac

SEQ ID NO: 41751 - DNA, 75 bp, Artificial Sequence
  Synthetic
ctgaccctctgctattcattggtattaaatttaattatacgaaaaaaaacaacggttattaataagttatcatac

SEQ ID NO: 41752 - DNA, 75 bp, Artificial Sequence
  Synthetic
cgcaaacaaagttggctaaggatagataaattattgaatattttattaaaaacttagggtcaatgaacccacctt

SEQ ID NO: 41753 - DNA, 75 bp, Artificial Sequence
  Synthetic
caatccttggattgataaacaaagcaagtagaggagaccagttcactgtaataccccatgtattaacatttgcac

SEQ ID NO: 41754 - DNA, 75 bp, Artificial Sequence
  Synthetic
aagcatgtcattatagtcctaatccccggtgattcgagcattattacaagatctcgactattggatagacttgtg

SEQ ID NO: 41755 - DNA, 75 bp, Artificial Sequence
  Synthetic
taatactaaggtcgatccgacatttaaacctgatttgactggaacttcgaagtcatatgttagatcactctaaag

SEQ ID NO: 41756 - DNA, 75 bp, Artificial Sequence
  Synthetic
aggatgaagctttagcagctttcttaatggataggaaaattattatcccaagggctgcacatgaaattctagata

SEQ ID NO: 41757 - DNA, 75 bp, Artificial Sequence
  Synthetic
ttggacttaggcatgatgactatggtgaaaaatcccttacagatgattgaattaaaccatctccagcattataaa

SEQ ID NO: 41758 - DNA, 75 bp, Artificial Sequence
  Synthetic
acacgatcacaggtgcaagagaggcaatcgccggaatgctagacaccacaaaggggttgatacgagcaagcatga

SEQ ID NO: 41759 - DNA, 75 bp, Artificial Sequence
  Synthetic
aatttggatcctgctcgctaaagcagtgactgcccctgacactgcagccgactcggagatgagaagatggatcaa

SEQ ID NO: 41760 - DNA, 75 bp, Artificial Sequence
  Synthetic
gaccttgtatgtattattgatctcaccagtcacaatgtttattacctaacatttgaaatggtcctgatgtactgt

SEQ ID NO: 41761 - DNA, 75 bp, Artificial Sequence
  Synthetic
gactgttgtcagggaaggggcatgatccgctcatcgatcaagactcatgttccgtccagctagcgagagcattaa

SEQ ID NO: 41762 - DNA, 75 bp, Artificial Sequence
  Synthetic
ctgcattttaagcatgttctatagttttctaagctgctcgttcgtgcctgctattctggtgactctgcaatatga

SEQ ID NO: 41763 - DNA, 75 bp, Artificial Sequence
  Synthetic
actagtagtcttgtttcacgaaattaggactgtctatctttctattaccaatcgttgataactaatcaaaactta

SEQ ID NO: 41764 - DNA, 75 bp, Artificial Sequence
  Synthetic
aggactgtctatctttctattaccaatcgttgataactaatcaaaacttagggtccaggacgtagcaagcctaca

SEQ ID NO: 41765 - DNA, 75 bp, Artificial Sequence
  Synthetic
ggccaaccaagtccaccaactctaggccgggcaggaacccccacgaacagacaagccccatgcacaacaaaattc

SEQ ID NO: 41766 - DNA, 75 bp, Artificial Sequence
  Synthetic
tttgacccagcttatttcaggctcggacaagaaatggttagaagatctgctggcaaagtaagttctgcacttgcc

SEQ ID NO: 41767 - DNA, 75 bp, Artificial Sequence
  Synthetic
acaagccccatgcacaacaaaattcccaaaaagtccaacccccggcaacacacccgacaagatcttctccaacaa

SEQ ID NO: 41768 - DNA, 75 bp, Artificial Sequence
  Synthetic
aaatacccaatgggaggggtggaggggtattgtcagaagttgtggactattagcaccataccttatttgtacttg

SEQ ID NO: 41769 - DNA, 75 bp, Artificial Sequence
  Synthetic
agacctcccaaggacgatatagcataacatcggctcagcgatccacgtaccatagtcctctagcattggacaggt

SEQ ID NO: 41770 - DNA, 75 bp, Artificial Sequence
  Synthetic
attagcgaaagccattgagaaagggtttgaccgatatttagcctacgcgctgaacattttaaaaatcattcaaca

SEQ ID NO: 41771 - DNA, 75 bp, Artificial Sequence
  Synthetic
aagatccgaagtcaccaaccaacaaccccctaccatcaacaagagatccgaaaaccaaggaggagacaagtaccc

SEQ ID NO: 41772 - DNA, 75 bp, Artificial Sequence
  Synthetic
caagaaagtggacacaaattttatttatcaacaaggtatgctcctgggcctggggatccttgagcacttatttag

SEQ ID NO: 41773 - DNA, 75 bp, Artificial Sequence
  Synthetic
ggaaatgacgatgaccggaaatcgatggaagcaatcgccaagatgagaatgcttactaagatgctcagtcaacct

SEQ ID NO: 41774 - DNA, 75 bp, Artificial Sequence
  Synthetic
aacaccgtattacatttacatgttgaaacagattgttgcgtaatacccatgagcgaccatccaagagtcccaggg

SEQ ID NO: 41775 - DNA, 75 bp, Artificial Sequence
  Synthetic
tatgagcaatttagggcaggtatcagactgttgtcagggaaggggcatgatccgctcatcgatcaagactcatgt

SEQ ID NO: 41776 - DNA, 75 bp, Artificial Sequence
  Synthetic
tcagtcaacaatcatctttctaaactcattataaaaaactttggacccgggtccaacaaacccgatcaaccatcc

SEQ ID NO: 41777 - DNA, 75 bp, Artificial Sequence
  Synthetic
tgacagtaaccctattattgagaaagatgcagtcagactttataaccagagtcacagaaagcacattgtagagtt

SEQ ID NO: 41778 - DNA, 75 bp, Artificial Sequence
  Synthetic
tgaatcctgtttgctttgcgcatcaggctctcataactatggttggttttttgtaccagcgaattgccaattgga

SEQ ID NO: 41779 - DNA, 75 bp, Artificial Sequence
  Synthetic
atgatatcaatagttttatcactgagtttcttctagttgagcctagattatttactgtatatctaggtcaatgtg

SEQ ID NO: 41780 - DNA, 75 bp, Artificial Sequence
  Synthetic
taccaaatgggtgagttgttgttctctttcctgagtagaatgagtaaaggagtcttcaaaattttaaccaatgca

SEQ ID NO: 41781 - DNA, 75 bp, Artificial Sequence
  Synthetic
ccaactttatcagaagtcaagggggttatagtccacagactggaagcagtttctatcaatatagggtcacaggag

SEQ ID NO: 41782 - DNA, 75 bp, Artificial Sequence
  Synthetic
tggtacaccactgtcccggagtatgttgcaactattggatacttaatatctaatcttgatgagtcaccctgtgta

SEQ ID NO: 41783 - DNA, 75 bp, Artificial Sequence
  Synthetic
tctataatgatagagagctactcaattaaatattcaagaccagtgttacatcagtcaacaattatccttctaaat

SEQ ID NO: 41784 - DNA, 75 bp, Artificial Sequence
  Synthetic
ggttttgggacagtgggatgattgaacctattcatggaccctctcttgactcccaaaacctacatataactgtat

SEQ ID NO: 41785 - DNA, 75 bp, Artificial Sequence
  Synthetic
ttgcaactattggatacttaatatctaatcttgatgagtcaccctgtgtatccgtctcagaatcagctatttgta

SEQ ID NO: 41786 - DNA, 75 bp, Artificial Sequence
  Synthetic
gcaacctgatctataactgttacatgatttacctagaccttctgttaaatgatgaattagatgatttctcattca

SEQ ID NO: 41787 - DNA, 75 bp, Artificial Sequence
  Synthetic
cttaaaagcaattataaaaaacttaggacacaagagcctaagtcctctccaaaaaaatgactgaggtgtacgact

SEQ ID NO: 41788 - DNA, 75 bp, Artificial Sequence
  Synthetic
gccagaacttcctataccccatgagtcggtctacacaacaatgcataaggcgtgacacctcatcttgtgctcgac

SEQ ID NO: 41789 - DNA, 75 bp, Artificial Sequence
  Synthetic
gagtcactaccggacaaagacataattgaaaagttggaggaattgtctgctatattatcaatgactttgatatta

SEQ ID NO: 41790 - DNA, 75 bp, Artificial Sequence
  Synthetic
aaaaaaatgactgaggtgtacgacttcgatcagtcttcatgggacaccaaaggctcattggcccccattttgccc

SEQ ID NO: 41791 - DNA, 75 bp, Artificial Sequence
  Synthetic
gatttacctagaccttctgttaaatgatgaattagatgatttctcattcattttatgcgaaagtgacgaggatgt

SEQ ID NO: 41792 - DNA, 75 bp, Artificial Sequence
  Synthetic
agaatcccatgttggtctgacatggaatgacaaacctatcttaatagatcaatattcatgttccctgacatatct

SEQ ID NO: 41793 - DNA, 75 bp, Artificial Sequence
  Synthetic
cgaacttcacccgggttggtagggcacatcctttcatcaaagcaggcagcatgtgtgcagtctttgcacggacct

SEQ ID NO: 41794 - DNA, 75 bp, Artificial Sequence
  Synthetic
tttcttaactgctcattcgtgcctactattctggtgactctgcaatatgaagacagctgaatcaaaccaattcat

SEQ ID NO: 41795 - DNA, 75 bp, Artificial Sequence
  Synthetic
atgtgtgcagtctttgcacggacctccatttcatgctaaatccttcaatcctcacctccagggtttaacaagtat

SEQ ID NO: 41796 - DNA, 75 bp, Artificial Sequence
  Synthetic
accgagttgttgtcgatatttggcccgagtctacgtgaccctatttcagccgagatatcaattcaagcactgagt

SEQ ID NO: 41797 - DNA, 75 bp, Artificial Sequence
  Synthetic
aaggcgtcctctaagaaataattctacctctaaggcctcagaattaaagtcagaatttgacccaccgaaagatga

SEQ ID NO: 41798 - DNA, 75 bp, Artificial Sequence
  Synthetic
gactcaggaagggcactggcggaagttctcaagcaacctgcatcatcccgcggcaatcggaaggacagtggcacc

SEQ ID NO: 41799 - DNA, 75 bp, Artificial Sequence
  Synthetic
acctctaaggcctcagaattaaagtcagaatttgacccaccgaaagatgacctggccaaacttctgagtcagctg

SEQ ID NO: 41800 - DNA, 75 bp, Artificial Sequence
  Synthetic
ttacaggattaggagtccggaactatgaggttcactcattcagaagaattgggatcaactctactgcatgttaca

SEQ ID NO: 41801 - DNA, 75 bp, Artificial Sequence
  Synthetic
tgaggttcactcattcagaagaattgggatcaactctactgcatgttacaaggcagttgaaatagcttctgtgat

SEQ ID NO: 41802 - DNA, 75 bp, Artificial Sequence
  Synthetic
taccaatatggctagccttcttaagagcctcacattattcaagaggactcgggaccaacccccacttgcctcggg

SEQ ID NO: 41803 - DNA, 75 bp, Artificial Sequence
  Synthetic
agcctcacattattcaagaggactcgggaccaacccccacttgcctcgggctccggaggagcaataagagggata

SEQ ID NO: 41804 - DNA, 75 bp, Artificial Sequence
  Synthetic
cacggattattcctaggagaaggttcaggtgcaatgttgacagtatataaagagctattaagattgtcaagatgt

SEQ ID NO: 41805 - DNA, 75 bp, Artificial Sequence
  Synthetic
ggacacaagagcctaagtcctctccaaaaaaatgaccgaggtgtacgacttcgaccagtcttcgtgggacaccaa

SEQ ID NO: 41806 - DNA, 75 bp, Artificial Sequence
  Synthetic
catcaagttagtagaggtaatcccaagcatcaactctgtttgcggtcttacatttgcatccagaggagcaagttt

SEQ ID NO: 41807 - DNA, 75 bp, Artificial Sequence
  Synthetic
tggcagaccagaagtaacttgggttgggagtgttgattgttacaagtacatactgagccagatctctgctagcag

SEQ ID NO: 41808 - DNA, 75 bp, Artificial Sequence
  Synthetic
ggagaccaccctatttgctgtttgtccttctcatcctactgattggaatcctgaccttgcttgccatcactggag

SEQ ID NO: 41809 - DNA, 75 bp, Artificial Sequence
  Synthetic
tattgctagcttccatcttggctcaaatttggatcctgctcgctaaagcagtgactgctcctgatactgcagccg

SEQ ID NO: 41810 - DNA, 75 bp, Artificial Sequence
  Synthetic
aggctcactggcccccattttacccaccacttatcctgatggtaggctagtaccccaagttagagtgatagatcc

SEQ ID NO: 41811 - DNA, 75 bp, Artificial Sequence
  Synthetic
gggagtgttgattgttacaagtacatactgagccagatctctgctagcagtcttgggttgattcactcggatata

SEQ ID NO: 41812 - DNA, 75 bp, Artificial Sequence
  Synthetic
taccccaagttagagtgatagatccgggacttggcgatcgaaaagatgaatgtttcatgtatatttttttactgg

SEQ ID NO: 41813 - DNA, 75 bp, Artificial Sequence
  Synthetic
gtgttgaacttgaaaactccatgggagggttaaatttcggtagatcctactttgatccagcttatttcaggctcg

SEQ ID NO: 41814 - DNA, 75 bp, Artificial Sequence
  Synthetic
ggcaagaaatggttagaagatctgccggcaaagtaagctctgcacttgccgccgagcttggcatcaccaaggaag

SEQ ID NO: 41815 - DNA, 75 bp, Artificial Sequence
  Synthetic
ctcacctccagggtttaacaagtattgagaaggtattaatcaattgtgggcttacaattaatggtcttaaggtat

SEQ ID NO: 41816 - DNA, 75 bp, Artificial Sequence
  Synthetic
tgagaaggtattaatcaattgtgggcttacaattaatggtcttaaggtatgtaagaacctgcttcaccatgatat

SEQ ID NO: 41817 - DNA, 75 bp, Artificial Sequence
  Synthetic
attcgcgctgctggtcccaagcaatctcaaatcacttttctgcactcagaaagatccgaagtcactaatcaacaa

SEQ ID NO: 41818 - DNA, 75 bp, Artificial Sequence
  Synthetic
aagatccgaagtcactaatcaacaacccccaaccatcaacaagaggtccgaaaaccaaggaggagacaaataccc

SEQ ID NO: 41819 - DNA, 75 bp, Artificial Sequence
  Synthetic
cccccaaccatcaacaagaggtccgaaaaccaaggaggagacaaataccccatccacttcagtgatgaacggttt

SEQ ID NO: 41820 - DNA, 75 bp, Artificial Sequence
  Synthetic
gcataccctgtgttaatcgcaagtcaggaaagggagctcgtatctatcattgcaaagaagtactgtggctatatt

SEQ ID NO: 41821 - DNA, 75 bp, Artificial Sequence
  Synthetic
gctccgaatggagtgaatcacgctatgatacccaaactattcaagatgatggaaacgacgatgaccggaaatcga

SEQ ID NO: 41822 - DNA, 75 bp, Artificial Sequence
  Synthetic
ttgctttactcgggagacttatacgaaattaccaggattgtccgaaacctgaaagccaaccacataattttcgac

SEQ ID NO: 41823 - DNA, 75 bp, Artificial Sequence
  Synthetic
aaattaccaggattgtccgaaacctgaaagccaaccacataattttcgacttgcatcgtaacttatttatggata

SEQ ID NO: 41824 - DNA, 75 bp, Artificial Sequence
  Synthetic
cggcattgtccaggatcccttaatcttctcaaacaagaattaaggctacaagtatccactgtctcgatattactc

SEQ ID NO: 41825 - DNA, 75 bp, Artificial Sequence
  Synthetic
atctgtccagatctgacaggtctctcatcctaacgacaatccccaaaaagaattggctctttcagcttgagacaa

SEQ ID NO: 41826 - DNA, 75 bp, Artificial Sequence
  Synthetic
ttggacttaggtatgatgaccgtggtaagaaattccttaccgacgattgaattaaaccatctccagcattataaa

SEQ ID NO: 41827 - DNA, 75 bp, Artificial Sequence
  Synthetic
ttctcaaacaagaattaaggctacaagtatccactgtctcgatattactcctgcaatttaagcgtgttctataga

SEQ ID NO: 41828 - DNA, 75 bp, Artificial Sequence
  Synthetic
tttctaaactgctcgtttgtgcttactattctggtgactccgcaatatgaagacagctgaatcagaccaattcat

SEQ ID NO: 41829 - DNA, 75 bp, Artificial Sequence
  Synthetic
atggcagaggagcaggcctatcatgtcagcaaagggctggaatgcctcaaagccctcagagagaatcctcctgac

SEQ ID NO: 41830 - DNA, 75 bp, Artificial Sequence
  Synthetic
agccctcagagagaatcctcctgacattgaggagattcaagaggtcagcagcatcagagaccaaacccgcaaccc

SEQ ID NO: 41831 - DNA, 75 bp, Artificial Sequence
  Synthetic
ctattctggtgactccgcaatatgaagacagctgaatcagaccaattcatgcctaagagtaggttgatcattact

SEQ ID NO: 41832 - DNA, 75 bp, Artificial Sequence
  Synthetic
agtccaagaaatgtatgaatgcttagggtcttgagtttcgcctttaggaatctcactttaacaattatacctcca

SEQ ID NO: 41833 - DNA, 75 bp, Artificial Sequence
  Synthetic
tggctaaggatagataaattattggatattttattaaaaacttagggtcaatgatcctaccttagagaacaaggt

SEQ ID NO: 41834 - DNA, 75 bp, Artificial Sequence
  Synthetic
ccctcttgccagatcttaatctaccgctagcggtcttgcttcacgagattatgaatgtctatctttctatcacca

SEQ ID NO: 41835 - DNA, 75 bp, Artificial Sequence
  Synthetic
gggggaacgcctggtatctttatagtcctgtcgggtttcgccacctctgacttgagcgtcgatttttgtgatgct

SEQ ID NO: 41836 - DNA, 75 bp, Artificial Sequence
  Synthetic
ttcgacctataaactggtagctctgctggagcctctttcattggcttacttgcaattaaaagacatcaccttctc

SEQ ID NO: 41837 - DNA, 75 bp, Artificial Sequence
  Synthetic
acaagcctcatgcacaaggaaatccccgaaagatccagaacccaaacacacacccaacaagacctcccccaacaa

SEQ ID NO: 41838 - DNA, 75 bp, Artificial Sequence
  Synthetic
ccgaaagatccagaacccaaacacacacccaacaagacctcccccaacaaaaaagcaccgaatacaccgagatca

SEQ ID NO: 41839 - DNA, 75 bp, Artificial Sequence
  Synthetic
agacctcccgagcacgacacggcataacgccagctcagcgatccacgcactatggtcctcgaacattggacaggc

SEQ ID NO: 41840 - DNA, 75 bp, Artificial Sequence
  Synthetic
cagttgatccagaggatcatagacgaccctgatgtaagcatcaagttagtagaggtaatcccaagcatcaactct

SEQ ID NO: 41841 - DNA, 75 bp, Artificial Sequence
  Synthetic
tttgctcaggacaagcagaaatgtagggacacagaaaagggatgggaagactctgcagttcccacacaattcaga

SEQ ID NO: 41842 - DNA, 75 bp, Artificial Sequence
  Synthetic
aacgccagctcagcgatccacgcactatggtcctcgaacattggacaggctcgtctgctacattatgaacagagc

SEQ ID NO: 41843 - DNA, 75 bp, Artificial Sequence
  Synthetic
catgtcttgcaagcaagccagctacagatcggataacatcccagctcacggagaccacgagggtgttgtccatca

SEQ ID NO: 41844 - DNA, 75 bp, Artificial Sequence
  Synthetic
cacactagagagtgtctcccaaggagcgagatcccagctcaagaggcggccttccaatgcaatcaactcaggatt

SEQ ID NO: 41845 - DNA, 75 bp, Artificial Sequence
  Synthetic
gcaatgagtgcaaagatgacccagaaatgcaaacccgagtctggtacgcaactccctcccaggacctcaaatgag

SEQ ID NO: 41846 - DNA, 75 bp, Artificial Sequence
  Synthetic
ccaaagcagaattaggtgagtatgagaaattattaaattcagtcctcgaaccaatcaaccaagctttgactctaa

SEQ ID NO: 41847 - DNA, 75 bp, Artificial Sequence
  Synthetic
cttccaaagctgtacttgcatcattgattagatcaagcagagttgatcaaagtcacaaacacaacatgctggctc

SEQ ID NO: 41848 - DNA, 75 bp, Artificial Sequence
  Synthetic
gattagatcaagcagagttgatcaaagtcacaaacacaacatgctggctcttctcaaaaatatcaagggggatga

SEQ ID NO: 41849 - DNA, 75 bp, Artificial Sequence
  Synthetic
agtcacaaacacaacatgctggctcttctcaaaaatatcaagggggatgacaatctaaacgagttctaccagatg

SEQ ID NO: 41850 - DNA, 75 bp, Artificial Sequence
  Synthetic
aaaactccatgggagggttaaatttcggtagatcctactttgatccggcttatttcaggctcgggcaagaaatgg

SEQ ID NO: 41851 - DNA, 75 bp, Artificial Sequence
  Synthetic
accacctatcctgatggtaggctagtacctcaagtcagagtgatagatccaggactcggcgatcgaaaagatgaa

SEQ ID NO: 41852 - DNA, 75 bp, Artificial Sequence
  Synthetic
ccaactttatcagaagtcaagggggttatagtccacagactggaagcagtttcttataacatagggtcacaagag

SEQ ID NO: 41853 - DNA, 75 bp, Artificial Sequence
  Synthetic
aacaagaggtccgaaaaccaaggaggagacaaataccccatccacttcaatgatgaacggtttccagggtacacc

SEQ ID NO: 41854 - DNA, 75 bp, Artificial Sequence
  Synthetic
aaacagattgttgcgtaatacccatgagcgaccatccaagggtcccagggttcagaaaggtcgttataccaagaa

SEQ ID NO: 41855 - DNA, 75 bp, Artificial Sequence
  Synthetic
gaccggaaatcgatggaagcaatcgccaagatgagaatgcttactaagatgctcagtcaacctgggaccagtgaa

SEQ ID NO: 41856 - DNA, 75 bp, Artificial Sequence
  Synthetic
atatttgtacaaatcctttgatctatgacagtaaccctattattgagaaagatgcagtcagactttataaccaga

SEQ ID NO: 41857 - DNA, 75 bp, Artificial Sequence
  Synthetic
gctcagtcaacctgggaccagtgaagagagttctcctgtctataatgatagagagctactcaattaaatattcaa

SEQ ID NO: 41858 - DNA, 75 bp, Artificial Sequence
  Synthetic
gatgcagtcagactttataaccagagtcacaggaagcacattgtagagtttgtcacatggacaacggggcagctt

SEQ ID NO: 41859 - DNA, 75 bp, Artificial Sequence
  Synthetic
acccgctcatggagatcaatgaagatttgaatcgatttctatggagattagagtgcaaaatagtaagaatccaag

SEQ ID NO: 41860 - DNA, 75 bp, Artificial Sequence
  Synthetic
gtcttcacatacgatgtactggtaagatgagcaaggctttgaatgcccagctagggttcaagaaaatcctgtgtt

SEQ ID NO: 41861 - DNA, 75 bp, Artificial Sequence
  Synthetic
aaagtttgaaaaagaccacctaaatgaagtctccgcgttaattggcgatgatgatatcaatagctttatcactga

SEQ ID NO: 41862 - DNA, 75 bp, Artificial Sequence
  Synthetic
gagagttctcctgtctataatgatagagagctactcaattaaatattcaagaccagtgttacatcagtcaccaat

SEQ ID NO: 41863 - DNA, 75 bp, Artificial Sequence
  Synthetic
ttgctgacctttattgcctccgacacatgcccactggttgaaatagatggtgtaaccatccaggttggaggcagg

SEQ ID NO: 41864 - DNA, 75 bp, Artificial Sequence
  Synthetic
tatccttctaaactcattataaaaaacttaggacccaggtccaacaatcccgatcaaccattcatccgaccaacc

SEQ ID NO: 41865 - DNA, 75 bp, Artificial Sequence
  Synthetic
gatgagcaaggctttgaatgcccagctagggttcaagaaaatcctgtgttacccgctcatggagatcaatgaaga

SEQ ID NO: 41866 - DNA, 75 bp, Artificial Sequence
  Synthetic
atgaactaaaactcaaatgacttggtggcattgtccaggatcccttaatcccctcgaacaaggattgaggctaca

SEQ ID NO: 41867 - DNA, 75 bp, Artificial Sequence
  Synthetic
attaagctgtgcagtcctggctttgttattgctgatttactgctgtaaaagacgctatcaacagacactcaagcg

SEQ ID NO: 41868 - DNA, 75 bp, Artificial Sequence
  Synthetic
tggcattgtccaggatcccttaatcccctcgaacaaggattgaggctacaagtatcaactgtctcgatgttgctc

SEQ ID NO: 41869 - DNA, 75 bp, Artificial Sequence
  Synthetic
agtatcaactgtctcgatgttgctcctgcactttaagcgtgttctataggtttctaaactgctctttcgtgccta

SEQ ID NO: 41870 - DNA, 75 bp, Artificial Sequence; identical to SEQ ID NO: 41740
  Synthetic

SEQ ID NO: 41871 - DNA, 75 bp, Artificial Sequence
  Synthetic
aaacctgatctgactgggactgctaaatcctatgtaagatcactctgaatcactctagtcacacgtcttacccga

SEQ ID NO: 41872 - DNA, 75 bp, Artificial Sequence
  Synthetic
ctactctggtggctctgcaatatgaagacagctgaatcaaaccaattcatgcctaagagtaggttgatcattatc

SEQ ID NO: 41873 - DNA, 75 bp, Artificial Sequence
  Synthetic
aatcctatgtaagatcactctgaatcactctagtcacacgtcttacccgattgtcagacctgaaatctatccata

SEQ ID NO: 41874 - DNA, 75 bp, Artificial Sequence
  Synthetic
ttattgctgatttactgctgtaaaagacgctatcaacagacactcaagcggaatactaaggtcgatccgacattt

SEQ ID NO: 41875 - DNA, 75 bp, Artificial Sequence
  Synthetic
actgactacgattatcgtaattaaagaaaacttagggctctggtaggagagcaatgctctcctaccaagataagg

SEQ ID NO: 41876 - DNA, 75 bp, Artificial Sequence
  Synthetic
ggccaaccaagtccatcaatccgaggccgggcaggaacccccacgagcagacaagccccatgcacaacaaaatcc

SEQ ID NO: 41877 - DNA, 75 bp, Artificial Sequence
  Synthetic
ctagccttgcttgctatcactggagttcgatttcaccaggtatcaattagcaatatggaatttagcagattgttg

SEQ ID NO: 41878 - DNA, 75 bp, Artificial Sequence
  Synthetic
acaagccccatgcacaacaaaatccccaaaaggtccaacacccgaaaacacacccaacaagatctccccccacaa

SEQ ID NO: 41879 - DNA, 75 bp, Artificial Sequence
  Synthetic
gctgatgtgagcatgctgatggaagaggaattgagtgctctgctcaagacaagcagaaatgtggggattaagaaa

SEQ ID NO: 41880 - DNA, 75 bp, Artificial Sequence
  Synthetic
ccaaaaggtccaacacccgaaaacacacccaacaagatctccccccacaacacagcaccaaatccgccgagacca

SEQ ID NO: 41881 - DNA, 75 bp, Artificial Sequence
  Synthetic
tttcggccttaaaccagacagagcggctgatgtgagcatgctgatggaagaggaattgagtgctctgctcaagac

SEQ ID NO: 41882 - DNA, 75 bp, Artificial Sequence
  Synthetic
tcagtcaacaattatccttctaaactcattataaaaaacttaggacccaggtccaacaatcccgatcaaccattc

SEQ ID NO: 41883 - DNA, 75 bp, Artificial Sequence
  Synthetic
agacctcccaagcacgacacagcacaacatcggctcggcgatccacgcatcatggtcctctaacatcggacaggc

SEQ ID NO: 41884 - DNA, 75 bp, Artificial Sequence
  Synthetic
ggatccggagtgtggatccattaaaaagggcacaggagagaggtcagcctcacatggaatggggatagttgctgg

SEQ ID NO: 41885 - DNA, 75 bp, Artificial Sequence
  Synthetic
ccatccactacatcatgaacaggatcaggtcctgcaagcaagccagccacagatcggataacatcccggctcacg

SEQ ID NO: 41886 - DNA, 75 bp, Artificial Sequence
  Synthetic
ttcgatttcaccaggtatcaattagcaatatggaatttagcagattgttgaaagaggatatggagaagtcagatg

SEQ ID NO: 41887 - DNA, 75 bp, Artificial Sequence
  Synthetic
tccgtgatctccactggtgcattaatccgcctagtaagatcaaagtgaattttactagttactgtgatacaattg

SEQ ID NO: 41888 - DNA, 75 bp, Artificial Sequence
  Synthetic
tccgcctagtaagatcaaagtgaattttactagttactgtgatacaattgggatcagaaaatccattgcattggc

SEQ ID NO: 41889 - DNA, 75 bp, Artificial Sequence
  Synthetic
tacaccagggagtgtctcccaaggagcgggatcccggctcaaaaggcggcaatccaatgcaaccaactcaggctc

SEQ ID NO: 41890 - DNA, 75 bp, Artificial Sequence
  Synthetic
aatccaatgcaaccaactcaggctctcagtgcacctggttagtcctatggtgcattggaatagccagtctctttc

SEQ ID NO: 41891 - DNA, 75 bp, Artificial Sequence
  Synthetic
tgcattggaatagccagtctctttctttgttctaaggctcagatacattggaataatttgtcaactattgggatt

SEQ ID NO: 41892 - DNA, 75 bp, Artificial Sequence
  Synthetic
tcccaccatacagatgcagtggagctactacttcaattggcaaatctttccccctatcagtatcattatccatgt

SEQ ID NO: 41893 - DNA, 75 bp, Artificial Sequence
  Synthetic
aagcaaaatattgctatttccacgattgaggggcatctatcaagcattatgatagctatacctggttttgggaag

SEQ ID NO: 41894 - DNA, 75 bp, Artificial Sequence
  Synthetic
ttgaggggcatctatcaagcattatgatagctatacctggttttgggaaggacactggagaccctacggcaaatg

SEQ ID NO: 41895 - DNA, 75 bp, Artificial Sequence
  Synthetic
gtctttgagatagggttcatcaaaaggtggctgaatgacatgccattattccagacaaccaactatatgatcctc

SEQ ID NO: 41896 - DNA, 75 bp, Artificial Sequence
  Synthetic
gtcagtagggtcaggtaggagacaacggcgttttgcaggagtggtactggcaggtgcagctttaggagtagccac

SEQ ID NO: 41897 - DNA, 75 bp, Artificial Sequence
  Synthetic
ggtggctgaatgacatgccattattccagacaaccaactatatgatcctcccggagaattctaaaaccaaagtat

SEQ ID NO: 41898 - DNA, 75 bp, Artificial Sequence
  Synthetic
caatctaaacgagttctaccagatgatcaagagtatcactcatgcttaatctgaagcatttgtgaagctattaac

SEQ ID NO: 41899 - DNA, 75 bp, Artificial Sequence
  Synthetic
agcactgtattattatatcatgacagcaatgattcacaagatggtattctagtagtgacgctgggaatctttggg

SEQ ID NO: 41900 - DNA, 75 bp, Artificial Sequence
  Synthetic
aaaggtcaactattgagagacctccagctgaaacctattgacaaagagtctagctcggcaatcggatacaaaccg

SEQ ID NO: 41901 - DNA, 75 bp, Artificial Sequence
  Synthetic
aggtgatacctgtcgctcacccatcagtagaaaaaatacatataacaaatcaccgtggttttataaaagattcgg

SEQ ID NO: 41902 - DNA, 75 bp, Artificial Sequence
  Synthetic
aaggataccgcaccttccaaagctgtacttgcatcattgattagatcaagcagaattgatcaaagtcacaaacac

SEQ ID NO: 41903 - DNA, 75 bp, Artificial Sequence
  Synthetic
aaaaattgtctggagtcggcttgtcaaagaaaatcctaccctatgtgcaaccaaacatcatgggaaccctttgga

SEQ ID NO: 41904 - DNA, 75 bp, Artificial Sequence
  Synthetic
gttctaccagatgatcaagagtatcacacatgcttaagctgtagcatttactaatctattaacaggctcagaact

SEQ ID NO: 41905 - DNA, 75 bp, Artificial Sequence
  Synthetic
ccctcaaacaaggattgaggctacaagtgtcaattgtctcggtgttgctcctgcattttaagcatgttctatagg

SEQ ID NO: 41906 - DNA, 75 bp, Artificial Sequence
  Synthetic
agatacttgagaagttgggatattctggaaatgatatgattgcaattttggagagtcgggggataaaaacaaaaa

SEQ ID NO: 41907 - DNA, 75 bp, Artificial Sequence
  Synthetic
ggttgacgttacatctagatgcaagcactgaccgtcaacttaacatatcatttacgtacggtccggttatactga

SEQ ID NO: 41908 - DNA, 75 bp, Artificial Sequence
  Synthetic
tggaaatgatatgattgcaattttggagagtcgggggataaaaacaaaaataacccatgttgatctccccgggaa

SEQ ID NO: 41909 - DNA, 75 bp, Artificial Sequence
  Synthetic
gaggtgtacgacttcgatcagtcttcgtgggacaccaaaggttcattggcccccattttgcccaccacctatccc

SEQ ID NO: 41910 - DNA, 75 bp, Artificial Sequence
  Synthetic
atttagtgcagggtcctacccattgctctggagttatgctatgggagttggtgttgaacttgaaaactccatggg

SEQ ID NO: 41911 - DNA, 75 bp, Artificial Sequence
  Synthetic
actcatcatcttaagtatctcatacccaactttatcagaagtcaagggggttatagtccacagactggaagcagt

SEQ ID NO: 41912 - DNA, 75 bp, Artificial Sequence
  Synthetic
aagcccacttatggactccggatggcttaccattcctcctaagaatggaacaattcttggattgataaacaaagc

SEQ ID NO: 41913 - DNA, 75 bp, Artificial Sequence
  Synthetic
caattcttggattgataaacaaagcaagtagaggagaccagttcactgtgatccctcatgtgttgtcatttgcgc

SEQ ID NO: 41914 - DNA, 75 bp, Artificial Sequence
  Synthetic
ccaactttatcagaagtcaagggggttatagtccacagactggaagcagtttcttataatatagggtcacaggag

SEQ ID NO: 41915 - DNA, 75 bp, Artificial Sequence
  Synthetic
cactgaccgtcaacttaacatatcatttacgtacggtccggttatactgaatggaaatggtatggattattatga

SEQ ID NO: 41916 - DNA, 75 bp, Artificial Sequence
  Synthetic
cccgcttctacaacaatgcattaggggtgacacttcatcttgtgctcggaccttggtgtctgggacgatgggcaa

SEQ ID NO: 41917 - DNA, 75 bp, Artificial Sequence
  Synthetic
ccatttagactaactaccaagggtagatctgatttcctaaggattgaatgttttgtgtgggatgacgacctgtgg

SEQ ID NO: 41918 - DNA, 75 bp, Artificial Sequence
  Synthetic
ttgctgacatttattgcctccgatacctgcccactggttgagatagatggtgtaactatccaggttggagggagg

SEQ ID NO: 41919 - DNA, 75 bp, Artificial Sequence
  Synthetic
caataccctgatatggtatacgaaagcaaagttgccttaggccctgctatatcacttgagaggttagatgtaggt

SEQ ID NO: 41920 - DNA, 75 bp, Artificial Sequence
  Synthetic
tcattataaaaaacttaggacccaggtccaacaaatccgaccaaccatccatccgaccactcgctctatccctaa

SEQ ID NO: 41921 - DNA, 75 bp, Artificial Sequence
  Synthetic
ttggcagtcttctcagcgttcccatattaatatgtacagccctggctttgttgttgctgatttactgctgtaaaa

SEQ ID NO: 41922 - DNA, 75 bp, Artificial Sequence
  Synthetic
ttggacttagatatgatgactgtggtgagaaatcccttactgactattgaattaaaccatctccagcattataaa

SEQ ID NO: 41923 - DNA, 75 bp, Artificial Sequence
  Synthetic
aagatcaccaagtgacattcatggtgcatatcggcaacttcagccgtaagaagaaccaagcttactctgctgatt

SEQ ID NO: 41924 - DNA, 75 bp, Artificial Sequence
  Synthetic
aaacctgatttgactggaacttcgaagtcctatgtgagatcactctaaagcactctggtcacacgtcttacccga

SEQ ID NO: 41925 - DNA, 75 bp, Artificial Sequence
  Synthetic
agtcctatgtgagatcactctaaagcactctggtcacacgtcttacccgattgtcaggattgaaatctataaatc

SEQ ID NO: 41926 - DNA, 75 bp, Artificial Sequence
  Synthetic
tcgatacaacgttagtgcgtaatatcaaagagaggatttcagaagggttatcgaaccagatgatcattaattgta

SEQ ID NO: 41927 - DNA, 75 bp, Artificial Sequence
  Synthetic
tcccccaattttcttcaaaagctatcaaactacaataaatagtggagaggactgactacgattatcgtaattaaa

SEQ ID NO: 41928 - DNA, 75 bp, Artificial Sequence
  Synthetic
taggtgccttctataaggataatgcaagagctaattcatccaggctgtccttagtgacagaagatcaagagggca

SEQ ID NO: 41929 - DNA, 75 bp, Artificial Sequence
  Synthetic
ggagaccaccctatttgctgtttgtcctcctcatcctactggttggaatcatggccttgcttgctatcactggaa

SEQ ID NO: 41930 - DNA, 75 bp, Artificial Sequence
  Synthetic
cttagtatcggtttaggagatgcactgaacaagattatcggggccaaaattgatgaagcaggcataattatgcaa

SEQ ID NO: 41931 - DNA, 75 bp, Artificial Sequence
  Synthetic
ggcgacacttcatcttgtgctcggaccttggtgtctgggactatgggcaacaagtttattctgtcaaaaggtaat

SEQ ID NO: 41932 - DNA, 75 bp, Artificial Sequence
  Synthetic
ctctgcaatatgaagacagctgaatcaaaccaattcatgctcaagagtaggttgatcattatcggaccaagaaat

SEQ ID NO: 41933 - DNA, 75 bp, Artificial Sequence
  Synthetic
tcattcgtgcctactattctggtgactctgcaatatgaagacagctgaatcaaaccaattcatgctcaagagtag

SEQ ID NO: 41934 - DNA, 75 bp, Artificial Sequence
  Synthetic
gttgatcattatcggaccaagaaatgtatggatgcttggggttttgaacttcacctctaggaatctcacttgacc

SEQ ID NO: 41935 - DNA, 75 bp, Artificial Sequence
  Synthetic
ttgttgctgatttactgctgtaaaagacgctaccaacagacactcaagcagaatactaaggtcgctccgacattc

SEQ ID NO: 41936 - DNA, 75 bp, Artificial Sequence
  Synthetic
tccgcgatctccattggtgcataaatccacctagtaagatcaaagtgaattttactacttactgcgatacaattg

SEQ ID NO: 41937 - DNA, 75 bp, Artificial Sequence
  Synthetic
aaacctgatttgactggaacttcgaaatcctatgtaaaatcactctgaagcactctggtcacacgtcgtacccga

SEQ ID NO: 41938 - DNA, 75 bp, Artificial Sequence
  Synthetic
gtcaagtatctttgggatctaattgacggatttttcccagacttaggaaattcaacctatcaattggtagctcta

SEQ ID NO: 41939 - DNA, 75 bp, Artificial Sequence
  Synthetic
cactctggtcacacgtcgtacccgattgtcaggcctgaaatctataaatcctgcccaattttcttcaaaagctat

SEQ ID NO: 41940 - DNA, 75 bp, Artificial Sequence
  Synthetic
atctcaagctattactagtagtcctgtttcacgaaattctgactgtctatctttctatcaccaatcgttaataat

SEQ ID NO: 41941 - DNA, 75 bp, Artificial Sequence
  Synthetic
cagcaagccaacaggccaaccaagtccaccaatccgaggccgggcaggaacccccacaaacagacaagccccatg

SEQ ID NO: 41942 - DNA, 75 bp, Artificial Sequence
  Synthetic
tcccaccatacagatgcagtggagctactacttcagtaggcagagttttccccctatcagtatcattgtccatgt

SEQ ID NO: 41943 - DNA, 75 bp, Artificial Sequence
  Synthetic
ggatcagaaaatctattgcatcggcagcaaatcctatccttttatcagcactctctggaagcagaggtgacatat

SEQ ID NO: 41944 - DNA, 75 bp, Artificial Sequence
  Synthetic
acggatttttcccagacttaggaaattcaacctatcaattggtagctctattggagcccctttcattggcttacc

SEQ ID NO: 41945 - DNA, 75 bp, Artificial Sequence
  Synthetic
ggagttcgacacgcaaaagattcgagtctttgagatagggttcatcaaacggtggctgaatgacatgccattact

SEQ ID NO: 41946 - DNA, 75 bp, Artificial Sequence
  Synthetic
tccgccgagaccaagacctcccaaggacgatatagcataacatcggctcagagatccacgtaccatggtcctcga

SEQ ID NO: 41947 - DNA, 75 bp, Artificial Sequence
  Synthetic
acatcggacaggtccgtccactacataatgaacaggaccaggtcttgcaagcaaactagccacagatcggataac

SEQ ID NO: 41948 - DNA, 75 bp, Artificial Sequence
  Synthetic
actggcttccttgtgtgtaggtgagagtaccatattgttatatcatgacagcaatggttcgcaagatggtattct

SEQ ID NO: 41949 - DNA, 75 bp, Artificial Sequence
  Synthetic
gcaaactagccacagatcggataacatcccgcctcacagagaccacgagggtatcatccatcacacaccagagag

SEQ ID NO: 41950 - DNA, 75 bp, Artificial Sequence
  Synthetic
atcccgcctcacagagaccacgagggtatcatccatcacacaccagagagtgtcacccaaggagcgagttcctgg

SEQ ID NO: 41951 - DNA, 75 bp, Artificial Sequence
  Synthetic
tcccgccgtacagatgcagtggagctactacttcagtaggcagagtattccccctatccgtatcattatccatgt

SEQ ID NO: 41952 - DNA, 75 bp, Artificial Sequence
  Synthetic
gtctttgagatagggtttatcaaacggtggctgaataacatgcctttactccagacaaccaactatatggtcctc

SEQ ID NO: 41953 - DNA, 75 bp, Artificial Sequence
  Synthetic
agtggtgacgctgggaatatttggggcaacacctatggatcaagttgaagaggtgatacctgttgctcacccatc

SEQ ID NO: 41954 - DNA, 75 bp, Artificial Sequence
  Synthetic
gcaacacctatggatcaagttgaagaggtgatacctgttgctcacccatcagtagaaaaaatacatataacaaat

SEQ ID NO: 41955 - DNA, 75 bp, Artificial Sequence
  Synthetic
ctcagatacattggaataatttgtcaacgattgggattatcggaactgacagtgtccattataagatcatgacta

SEQ ID NO: 41956 - DNA, 75 bp, Artificial Sequence
  Synthetic
agtgatttgaccatgtacctgaaagataaggctctggcagctcttaaaagggagtgggattcagtgtacccaaaa

SEQ ID NO: 41957 - DNA, 75 bp, Artificial Sequence
  Synthetic
gttagtcctgtggtgcatcggaatagccagtctctttctttgttctaaggctcagatacattggaataatttgtc

SEQ ID NO: 41958 - DNA, 75 bp, Artificial Sequence
  Synthetic
tagcgacctggatggtgcctgcattggtctctgaaaaacaagaggaacaaaaaaattgtctagagtcggcttgtc

SEQ ID NO: 41959 - DNA, 75 bp, Artificial Sequence
  Synthetic
ggtctctgagaaacaagaggagcaaaaaaactgtctggagtctgcttgtcaaagaaaatcctacccgatgtgcaa

SEQ ID NO: 41960 - DNA, 75 bp, Artificial Sequence
  Synthetic
ccaaacgtcatgggaaccctttggaggaggacagttgccatcttatgggcggttgacattacctctagatccaag

SEQ ID NO: 41961 - DNA, 75 bp, Artificial Sequence
  Synthetic
aaataaaatcctaccctatgtgcaaccaaacgtcatgggaaccctttggaggaggacagttgccatcttatgggc

SEQ ID NO: 41962 - DNA, 75 bp, Artificial Sequence
  Synthetic
cattaaccttcaacttaacatctcgtttacatacggtccggttatactgaatggagaaggtatggattattatgg

SEQ ID NO: 41963 - DNA, 75 bp, Artificial Sequence
  Synthetic
ggagtggtgcttgcaggtgcagctttaggggtggccacagccgcacaaatcactgcagggatagctttacatcag

SEQ ID NO: 41964 - DNA, 75 bp, Artificial Sequence
  Synthetic
caagaaagactcccatcgtggccttgctaaccagcgtaagtctataaaacctgcaccttatcgaggagcccttca

SEQ ID NO: 41965 - DNA, 75 bp, Artificial Sequence
  Synthetic
gctaaccagcgtaagtctataaaacctgcaccttatcgaggagcccttcactccgtctcctccccaagcagtaga

SEQ ID NO: 41966 - DNA, 75 bp, Artificial Sequence
  Synthetic
tgtcacatggacaacagggcagctttatcatgtattagctaaatctactgctatgtctagggtggagatgattac

SEQ ID NO: 41967 - DNA, 75 bp, Artificial Sequence
  Synthetic
accctatttcagccgagatatcaattcaagcactgagttatgctcttgggggagaaattcataaaatacttgaga

SEQ ID NO: 41968 - DNA, 75 bp, Artificial Sequence
  Synthetic
gaagtctccgcattaatgggcgatgatgatatcaatagctttatcactgagtttcttctagttgagcctaggttg

SEQ ID NO: 41969 - DNA, 75 bp, Artificial Sequence
  Synthetic
ggagaaattcataaaatacttgagaagttggggtattctggtaatgatatgatcgcaattttggagagtcggggg

SEQ ID NO: 41970 - DNA, 75 bp, Artificial Sequence
  Synthetic
caaaaaatgcttaaacgatattaatcttagtattggtttaggaggtgcattggataagactattggggccaaaat

SEQ ID NO: 41971 - DNA, 75 bp, Artificial Sequence
  Synthetic
taccaaatgggtgaattgttattttcgtttctgagtagaatgagtaaaggagtcttcaaaattctaatcaatgca

SEQ ID NO: 41972 - DNA, 75 bp, Artificial Sequence
  Synthetic
tggataagactattggggccaaaattgatgaagcaggcataattatgcaaagctcacagtggttcgaacctttcc

SEQ ID NO: 41973 - DNA, 75 bp, Artificial Sequence
  Synthetic
ttggacttaggtatgataattatagtgagaaatccctcgccgacgatcgaatcaaaccatctctagcagtataaa

SEQ ID NO: 41974 - DNA, 75 bp, Artificial Sequence
  Synthetic
tgaagaagtctgaagccagtcgagtgaccacagaatactttatagccttgagacagagattacatgatgtcggac

SEQ ID NO: 41975 - DNA, 75 bp, Artificial Sequence
  Synthetic
atctccccgggaaactcatcatattaagtatctcatacccaactttatcagaagtcaagggggttatagtccaca

SEQ ID NO: 41976 - DNA, 75 bp, Artificial Sequence
  Synthetic
agtcatggactctgtttcagtgaaccagattctataccctgaggtccatctagatagcccaattgtaaccaataa

SEQ ID NO: 41977 - DNA, 75 bp, Artificial Sequence
  Synthetic
gtcatcctgtgtattcgtctcagaatcagccatttgtagccagaactccctataccccatgagcccgattctaca

SEQ ID NO: 41978 - DNA, 75 bp, Artificial Sequence
  Synthetic
cagattctataccctgaggtccatctagatagcccaattgtaaccaataagctagtatctattttagagtatgca

SEQ ID NO: 41979 - DNA, 75 bp, Artificial Sequence
  Synthetic
tataccccatgagcccgattctacaacaatgcattaggggcgacacttcatcttgtgctcggaccttggtgtctg

SEQ ID NO: 41980 - DNA, 75 bp, Artificial Sequence
  Synthetic
tcaaaccagatgatcattaactgtatcgaaattgggagcattgttaatcagaccttgttatcttatcccaaacac

SEQ ID NO: 41981 - DNA, 75 bp, Artificial Sequence
  Synthetic
tctatagtaaaataacagatggggtcaaaagatgcttaaacgatattaatcttaatattggtttaggagatgcac

SEQ ID NO: 41982 - DNA, 75 bp, Artificial Sequence
  Synthetic
ctgtctcttgaccaagatggcgattcttcccgcacccataggcggtcttaattacctcaatatgagtaggctctt

SEQ ID NO: 41983 - DNA, 75 bp, Artificial Sequence
  Synthetic
agattgagagtggaccctgggttcatcactgatgctgttggatgcttaaaacagcgacctctagggaaaagtcct

SEQ ID NO: 41984 - DNA, 75 bp, Artificial Sequence
  Synthetic
ttctatggtttacaattaaaacagaaatgagatcagtgattaaatcctctactcacaactgtcgcaaacgaaggc

SEQ ID NO: 41985 - DNA, 75 bp, Artificial Sequence
  Synthetic
atggtatacgaaagcaaagttgccttaggacctgctatatcacttgagaggttagatgtaggtacaaatttaggg

SEQ ID NO: 41986 - DNA, 75 bp, Artificial Sequence
  Synthetic
cagaatttgacccaccgaaagatgacctggctaaactcctgagtcagctatcaacaaggacacacaacttaccta

SEQ ID NO: 41987 - DNA, 75 bp, Artificial Sequence
  Synthetic
agaatcctgtctttgtaaaaggtgaatcatttaatgtgttagtgtctcgggaccttgtatgtatcattgacctca

SEQ ID NO: 41988 - DNA, 75 bp, Artificial Sequence
  Synthetic
ccagatccttgagacagttaagcgctcttcctttaattttggcagtctcctcagcgttcccatattaatctgtac

SEQ ID NO: 41989 - DNA, 75 bp, Artificial Sequence
  Synthetic
tcactgatgctgttggatgcttaaaacagcgacctctagggaaaagtcctatctctaaggtctcagagttaaagt

SEQ ID NO: 41990 - DNA, 75 bp, Artificial Sequence
  Synthetic
cgatccgacatttaaacctgatttgactggaacttcgaaatcatatgtaagatcactctgaagcactctggtcac

SEQ ID NO: 41991 - DNA, 75 bp, Artificial Sequence
  Synthetic
catggatcattcctaggagagggttccggtgcaatgctaacagtatataaagagctattgagactatcaagatgt

SEQ ID NO: 41992 - DNA, 75 bp, Artificial Sequence
  Synthetic
acgttacgcaactttgcacgtcagaatcaggtatctctgggatctaattgacggatttttcccggacttaggtaa

SEQ ID NO: 41993 - DNA, 75 bp, Artificial Sequence
  Synthetic
ttcaacctataaattggtagctctgctggagcctctttcattggcttacttgcaattaaaagacatcaccttctc

SEQ ID NO: 41994 - DNA, 75 bp, Artificial Sequence
  Synthetic
ctggagcctctttcattggcttacttgcaattaaaagacatcaccttctctctcaggggtgcttttctgagtcac

SEQ ID NO: 41995 - DNA, 75 bp, Artificial Sequence
  Synthetic
cttcaaaagctatcaaactgcaacaaatagtggcgaggactgactccaattattataattaaagaaaacttaggg

SEQ ID NO: 41996 - DNA, 75 bp, Artificial Sequence
  Synthetic
tctcaggggtgcttttctgagtcactgctttgccgaaattcaggagattttacaggacaatggcttctatactga

SEQ ID NO: 41997 - DNA, 75 bp, Artificial Sequence
  Synthetic
tgcaattaaaagacatcaccttctctctcaggggtgcttttctgagtcactgctttgccgaaattcaggagattt

SEQ ID NO: 41998 - DNA, 75 bp, Artificial Sequence
  Synthetic
tacaggacaatggcttctatactgaagagacgttccaaaccttaacccaagctctagacttcgttttcatcacag

SEQ ID NO: 41999 - DNA, 75 bp, Artificial Sequence
  Synthetic
taccaagacaaggtgggtgccttctataaggataatgcaagagctaattcatccaagctgtccttagtgacagaa

SEQ ID NO: 42000 - DNA, 75 bp, Artificial Sequence
  Synthetic
tagcagattgctgaaagaggatatggagaaatcagaggccgtacatcaccaagtcatagatgtcttgacaccgct

SEQ ID NO: 42001 - DNA, 75 bp, Artificial Sequence
  Synthetic
atgtgtgcagtctttgcatggacccccatttcaagataagtcttttaatccttacctccagggtttgacaagtat

SEQ ID NO: 42002 - DNA, 75 bp, Artificial Sequence
  Synthetic
aatcctttgcaggaattcgatttaaatgctttatgcctcttagcctagatagtgatttgaccatgtatttgaaag

SEQ ID NO: 42003 - DNA, 75 bp, Artificial Sequence
  Synthetic
agggaattcgacttccgcgatctccactggtgcattaacccacctagcaagatcaaggtgaattttactaattac

SEQ ID NO: 42004 - DNA, 75 bp, Artificial Sequence
  Synthetic
gaattcctcaggtacaacccacctcgctccactgagtctcggagacttgttaatgtgtttctagaggactctcag

SEQ ID NO: 42005 - DNA, 75 bp, Artificial Sequence
  Synthetic
ctattgcatcggcagcaaatcccatcattttatcagcactctccggagccagaggtgacatattcccgccgtaca

SEQ ID NO: 42006 - DNA, 75 bp, Artificial Sequence
  Synthetic
tttgacccttataacatgattatgtacgttatctcaggtcaatatctagaagatcctgacttcaacctatcatac

SEQ ID NO: 42007 - DNA, 75 bp, Artificial Sequence
  Synthetic
agtcttaaggagaaagagattaaagaggtggggaggctattcgctaaaatgacctacaaaatgcgagcctgtcaa

SEQ ID NO: 42008 - DNA, 75 bp, Artificial Sequence
  Synthetic
gatgcagtggagctactacttcagtaggcagggtattccccctatccgtatcattatccatgtctttgatatcaa

SEQ ID NO: 42009 - DNA, 75 bp, Artificial Sequence
  Synthetic
gatctcactaaagcattgcacactctggctgtgtccggggttccgaaagacaagaaagactcccatcgtggcctc

SEQ ID NO: 42010 - DNA, 75 bp, Artificial Sequence
  Synthetic
actgtctacaagcaccggcgactctaacactgtactgcatttacatgttgaaacagattgttgcgtaatacccat

SEQ ID NO: 42011 - DNA, 75 bp, Artificial Sequence
  Synthetic
tggctgtgtccggggttccgaaagacaagaaagactcccatcgtggcctcactagccagcgtaattctatgaaac

SEQ ID NO: 42012 - DNA, 75 bp, Artificial Sequence
  Synthetic
ggtaaaacttatttgctagtgcctgattatattgaaggggagttcgactcgcaaaagattcgagtctttgagata

SEQ ID NO: 42013 - DNA, 75 bp, Artificial Sequence
  Synthetic
aacactgtactgcatttacatgttgaaacagattgttgcgtaatacccatgaacgatcatccaagggtcccaggg

SEQ ID NO: 42014 - DNA, 75 bp, Artificial Sequence
  Synthetic
aaagccaaggtatgtactatagcagtgggcgagctgacactagcttccttgtgtgtagatgagagcaccgtattg

SEQ ID NO: 42015 - DNA, 75 bp, Artificial Sequence
  Synthetic
agtactgtctgaattggcgatatgagactattagtatattcgctcagagattaaatgaaatttacggtctccctt

SEQ ID NO: 42016 - DNA, 75 bp, Artificial Sequence
  Synthetic
acatataacaaatcaccgtgggttcataaaagattcaatagtaacctggatggtgcctgtattggtctctgagaa

SEQ ID NO: 42017 - DNA, 75 bp, Artificial Sequence
  Synthetic
aaatacccaatgggaggagtggagggatactgtcagaagttatggactattagcaccataccttatctgtacttg

SEQ ID NO: 42018 - DNA, 75 bp, Artificial Sequence
  Synthetic
atccagaggagcaagcttggattctgaggcagatgagttcttcaaaattgtagacgaagggtcgaaagctcaagg

SEQ ID NO: 42019 - DNA, 75 bp, Artificial Sequence
  Synthetic
ttgcatcacttgtccaaggtgataaccaaaccattgctgtcactaaaagagttccaagcacctggtcctatgcct

SEQ ID NO: 42020 - DNA, 75 bp, Artificial Sequence
  Synthetic
atcctgctcgctaaagcagtgactgctcctgatactgcagccgactcggagatgagaaggtggattaagtatacc

SEQ ID NO: 42021 - DNA, 75 bp, Artificial Sequence
  Synthetic
caagctaggcacctatgcatcctatcagacctttattgtaaccctcgtgattgtccccaaatccgtggtctgaca

SEQ ID NO: 42022 - DNA, 75 bp, Artificial Sequence
  Synthetic
gaataaggatattgtagacatagaagtggatgatgctgagcaattcaatatattgctagcctccattttggccca

SEQ ID NO: 42023 - DNA, 75 bp, Artificial Sequence
  Synthetic
tgttaatttcacaatccctgaaaagtatagctaggtgtgtattttggtcagaaacaatagtggatgagacccgag

SEQ ID NO: 42024 - DNA, 75 bp, Artificial Sequence
  Synthetic
aagaagaggctcaatcaagcagataaggttaagagtggatcccgggttcatcactgatgccattggatgcttaga

SEQ ID NO: 42025 - DNA, 75 bp, Artificial Sequence
  Synthetic
cagaatttgacccaccgaaagatgacctagctaagctcctgagtcagctatcaacaaagacacacaacttaccca

SEQ ID NO: 42026 - DNA, 75 bp, Artificial Sequence
  Synthetic
ccggtgagttaacaactattgaatcccttatgacgctgtatcaacagatgggtgaaacagcaccgtacatggtta

SEQ ID NO: 42027 - DNA, 75 bp, Artificial Sequence
  Synthetic
gggatcaactctactgcatgttacaaggcagttgaaatagcttctgctattaagaacgagtttccgtctgaagaa

SEQ ID NO: 42028 - DNA, 75 bp, Artificial Sequence
  Synthetic
acatcttctattgccgacctcaaacgaatgatccgatcaggccttcttggagtagagattctacatcaagtcatg

SEQ ID NO: 42029 - DNA, 75 bp, Artificial Sequence
  Synthetic
actctacaaccagtgttgagaatttagtccgtataagattctcatgtaaccgttcaaaaccttgatggtatgatg

SEQ ID NO: 42030 - DNA, 75 bp, Artificial Sequence
  Synthetic
tttagagtatgcacgaattagacataactatcaactccttgacacaacgttagtgcgtaatatcaaagagagaat

SEQ ID NO: 42031 - DNA, 75 bp, Artificial Sequence
  Synthetic
aaggggttgataagagcaagcatgaaaagaggaggtctgacccctagaataataaaccgtttgtcaacttacgat

SEQ ID NO: 42032 - DNA, 75 bp, Artificial Sequence
  Synthetic
atcattaactgtatcgaaattgggagcattgttaatcagaccttgttatcttatcccaaacacaaccatgtgata

SEQ ID NO: 42033 - DNA, 75 bp, Artificial Sequence
  Synthetic
gcactcccacattttcttcgaagtttcatagtttacccaagatacagcaattttgtgtcaacagaggcctacctc

SEQ ID NO: 42034 - DNA, 75 bp, Artificial Sequence
  Synthetic
tcatagtttacccaagatacagcaattttgtgtcaacagaggcctacctcgtttttactggtcttagagcaggga

SEQ ID NO: 42035 - DNA, 75 bp, Artificial Sequence
  Synthetic
acaattatccttctaaattcattataaaaaacttaggacccaggtccaacaaatccgatcaatcattcctccgac

SEQ ID NO: 42036 - DNA, 75 bp, Artificial Sequence
  Synthetic
aaacgatattaatcttagtattggtttaggaggtgcattggataagactattggagccaaaattgatgaagcagg

SEQ ID NO: 42037 - DNA, 75 bp, Artificial Sequence
  Synthetic
ttaggaggtgcattggataagactattggagccaaaattgatgaagcaggcataattatgcaaagctcacagtgg

SEQ ID NO: 42038 - DNA, 75 bp, Artificial Sequence
  Synthetic
ccatttcaagctaagtcttttaatccttatctccagggtttaacaagtattgagaaggttttgatcaattgcggt

SEQ ID NO: 42039 - DNA, 75 bp, Artificial Sequence
  Synthetic
cttatctccagggtttaacaagtattgagaaggttttgatcaattgcggtcttaccattaatggtcttaaagtat

SEQ ID NO: 42040 - DNA, 75 bp, Artificial Sequence
  Synthetic
ctgggggatcatcagggccaagtgtgtctgcggagaatgtccgccaacctgcaatgagtgcaaagatgacccaga

SEQ ID NO: 42041 - DNA, 75 bp, Artificial Sequence
  Synthetic
gagaatggaaccgcaagcatgcaggaagaggaggtctctcaggatctcgatgaatcacacgagccagcaaaagga

SEQ ID NO: 42042 - DNA, 75 bp, Artificial Sequence
  Synthetic
gcaaaaacctgcttcaccatgatatctcatcaggcgaggaaggactgaaaggatccatcacgatcctttataggg

SEQ ID NO: 42043 - DNA, 75 bp, Artificial Sequence
  Synthetic
ggatccatcacgatcctttatagggaactcgcacggttcagggataaccatcaatcttcacatggaatgttccgt

SEQ ID NO: 42044 - DNA, 75 bp, Artificial Sequence
  Synthetic
gagacaagagtactcaagtcaaatactcagggacctctctcatcagagtagcacgttatgcaacaatctcgaatg

SEQ ID NO: 42045 - DNA, 75 bp, Artificial Sequence
  Synthetic
atcattgacctcaccagtcacaatgtttattacctaacatttgaaatggtcctgatgtattgtgatgtgatagaa

SEQ ID NO: 42046 - DNA, 75 bp, Artificial Sequence
  Synthetic
cctgatgtattgtgatgtgatagaagggagattaatgactgataccgctatggcaattgatcaccgttactcaac

SEQ ID NO: 42047 - DNA, 75 bp, Artificial Sequence
  Synthetic
tgcaaggaagtattgtggctatatcttactttactcgggagacttatatgaaatcaccaggattgttcggaactt

SEQ ID NO: 42048 - DNA, 75 bp, Artificial Sequence
  Synthetic
tatcagcaaggtatgctcctgggcctggggattctcgagcacttatttagactgtcttcaaccaccggcgactct

SEQ ID NO: 42049 - DNA, 75 bp, Artificial Sequence
  Synthetic
tggggattctcgagcacttatttagactgtcttcaaccaccggcgactctaacaccgtactacatttacatgttg

SEQ ID NO: 42050 - DNA, 75 bp, Artificial Sequence
  Synthetic
aacaccgtactacatttacatgttgaaacagattgttgcgtaatacccatgagcgaccatccaagggtcccaggg

SEQ ID NO: 42051 - DNA, 75 bp, Artificial Sequence
  Synthetic
cagtaatcgaggattcgagagaggagaaggaagccttgatgatagcactgaggattctggcgaagattattccga

SEQ ID NO: 42052 - DNA, 75 bp, Artificial Sequence
  Synthetic
aaccttaacccaggctctagacttcgttttcatcacagaggatatacatataacaggagagatcttttccttttt

SEQ ID NO: 42053 - DNA, 75 bp, Artificial Sequence
  Synthetic
tgtcacatggacaacagggcagctttatcatgtactagctaaatctactgctatgtctatggttgagatgattac

SEQ ID NO: 42054 - DNA, 75 bp, Artificial Sequence
  Synthetic
ctaaccctcaaccatccactgctattaaacttaattatatgaaaaaaaacaacggttattaataagttatcatac

SEQ ID NO: 42055 - DNA, 75 bp, Artificial Sequence
  Synthetic
ccactgctattaaacttaattatatgaaaaaaaacaacggttattaataagttatcatacccagctttgtctggt

SEQ ID NO: 42056 - DNA, 75 bp, Artificial Sequence
  Synthetic
agttgtctcctatgagaccatgatgaagggacacgctattttctgtgggataatcattaacggttatcgggatag

SEQ ID NO: 42057 - DNA, 75 bp, Artificial Sequence
  Synthetic
gtttcttctagttgagcctaggttatttactgtgtatctaggtcaatgtgctgcaatcaactggggctttgaaat

SEQ ID NO: 42058 - DNA, 75 bp, Artificial Sequence
  Synthetic
taatcattaacggttatcgggatagacatggaggaacctggcctccaatggatcttcctgtccatgcatctccta

SEQ ID NO: 42059 - DNA, 75 bp, Artificial Sequence
  Synthetic
gatcttcctgtccatgcatctcctatcatcaggaatgctcatgcctcaggagagggaatcacctatagtcaatgt

SEQ ID NO: 42060 - DNA, 75 bp, Artificial Sequence
  Synthetic
agagggaatcacctatagtcaatgtatagaaaattggaaatcctttgcaggaattcgatttaaatgctttatgcc

SEQ ID NO: 42061 - DNA, 75 bp, Artificial Sequence
  Synthetic
ctgacagtgagtatgatgatgagcttttctctgaaatacaagaaattcgatctgccattactaaactaactgaag

SEQ ID NO: 42062 - DNA, 75 bp, Artificial Sequence
  Synthetic
cctcagcctagacagtgatctgaccatgtatttgaaagataaggctttagcagcccttaaaaaagagtgggattc

SEQ ID NO: 42063 - DNA, 75 bp, Artificial Sequence
  Synthetic
catacctgaaagatttgacaacatacaagctaggcacctatgcatcctatctgacctttattgtaaccctcgtga

SEQ ID NO: 42064 - DNA, 75 bp, Artificial Sequence
  Synthetic
caagctaggcacctatgcatcctatctgacctttattgtaaccctcgtgattgtccccagattcgtgggttgaca

SEQ ID NO: 42065 - DNA, 75 bp, Artificial Sequence
  Synthetic
gcactacagccagacctgaagaattattgaaggaagccaccctgttggacattgtggtaaggcgaactgcaggtg

SEQ ID NO: 42066 - DNA, 75 bp, Artificial Sequence
  Synthetic
ctcggagacttgttaatgtgtttctagaggactctcagtttgacccttataatatgattatgtacgttatctcag

SEQ ID NO: 42067 - DNA, 75 bp, Artificial Sequence
  Synthetic
gatgagcaaggctttgaatgcccagctaggattcaagaaaatcctgtgttacccgctcatggagatcaatgaaga

SEQ ID NO: 42068 - DNA, 75 bp, Artificial Sequence
  Synthetic
aaatgtcgacattaacccagagctccgccctataatagggagagattcaggaagagcactggcggaagttctcaa

SEQ ID NO: 42069 - DNA, 75 bp, Artificial Sequence
  Synthetic
tattcgctaaaatgacatacaaaatgcgagcctgtcaggtcatagcagaaaacttaatatctaatggaattggga

SEQ ID NO: 42070 - DNA, 75 bp, Artificial Sequence
  Synthetic
tcaaaattctctaaatcattagttcatgaactagaactcaaatgccttggtggcattgtccgggaccccttaatc

SEQ ID NO: 42071 - DNA, 75 bp, Artificial Sequence
  Synthetic
cggaaggacagcagtattgccttgggctcaaaaggtcaactattaagagacctccagctgaaacctattgacagg

SEQ ID NO: 42072 - DNA, 75 bp, Artificial Sequence
  Synthetic
agattgagagtggacccgggtttcatcactgatgctgttggatgcttagaaaagcgacctctagggaaaagtcct

SEQ ID NO: 42073 - DNA, 75 bp, Artificial Sequence
  Synthetic
gggatcaactctactgcatgttacaaggcagttgaaatagtttctgttattaagaacgaatttacgtctgaagaa

SEQ ID NO: 42074 - DNA, 75 bp, Artificial Sequence
  Synthetic
ggaccaagaaatgtatggatgcttggggttttgaacttcacctctaggaatctcacttaaccaattatacctcca

SEQ ID NO: 42075 - DNA, 75 bp, Artificial Sequence
  Synthetic
caggtgcaatgctgacagtatataaagagctattgagattgtcaagatgttattataacagtggtgtgtcggtag

SEQ ID NO: 42076 - DNA, 75 bp, Artificial Sequence
  Synthetic
tattataacagtggtgtgtcggtagagtctagaactggacaacgagagatttcaccttacccttctgaggtcagt

SEQ ID NO: 42077 - DNA, 75 bp, Artificial Sequence
  Synthetic
gcaattataaaaaacttaggacacaagagcctaagtcctctccaaaaaaatgactgaggtgtacgacttcgatga

SEQ ID NO: 42078 - DNA, 75 bp, Artificial Sequence
  Synthetic
ataaattggtgactgtgcttttcaacgggagacctgaggtaacttgggttgggagtgttgattgttacaagtaca

SEQ ID NO: 42079 - DNA, 75 bp, Artificial Sequence
  Synthetic
agagcctaagtcctctccaaaaaaatgactgaggtgtacgacttcgatgagtcttcgtgggacaccaaaggctca

SEQ ID NO: 42080 - DNA, 75 bp, Artificial Sequence
  Synthetic
cgggagacctgaggtaacttgggttgggagtgttgattgttacaagtacatattaagccagatatctgctagcag

SEQ ID NO: 42081 - DNA, 75 bp, Artificial Sequence
  Synthetic
tcttggattgattcactcggatatcgagtcactacctgataaagacataattgaaaaattggaagagctgtctgc

SEQ ID NO: 42082 - DNA, 75 bp, Artificial Sequence
  Synthetic
gagtcactacctgataaagacataattgaaaaattggaagagctgtctgccatattatcgatgactttgatatta

SEQ ID NO: 42083 - DNA, 75 bp, Artificial Sequence
  Synthetic
ggaggagtagagggatactgtcaaaagttatggactattagcacaataccttatctgtacttggcagcacatgaa

SEQ ID NO: 42084 - DNA, 75 bp, Artificial Sequence
  Synthetic
agcggtgtcagaattgcatcacttgttcaaggtgataaccaaaccattgctgtcactaaaagagttccaagcacc

SEQ ID NO: 42085 - DNA, 75 bp, Artificial Sequence
  Synthetic
tgtcactaaaagagttccaagcacctggtcatatgccttgaagaagtctgaagccagtcgagtcaccacagaata

SEQ ID NO: 42086 - DNA, 75 bp, Artificial Sequence
  Synthetic
ccgtccactacattatgaacaggaccaggtcttgcatgcaaactagccacagatcggataacatcccggatcaca

SEQ ID NO: 42087 - DNA, 75 bp, Artificial Sequence
  Synthetic
gagaccacgagggtatcatccatcacacaccagagagtgttacccaaggagtgggtttctggttcaagaggcggc

SEQ ID NO: 42088 - DNA, 75 bp, Artificial Sequence
  Synthetic
catgatgtcggacatcatttgaaagcaaatgaaacaataatatcttcccacttttttgtatactcaaaaggaatc

SEQ ID NO: 42089 - DNA, 75 bp, Artificial Sequence
  Synthetic
gttcagtgcaaatcaagtctgtaacgcagttaatttaataccgttagacatagcacagagatttagggtggtata

SEQ ID NO: 42090 - DNA, 75 bp, Artificial Sequence
  Synthetic
gactagtcaatccggaggggattaaacaacagattttgcgagtcggtattcgaacttcacccgggttggtagggc

SEQ ID NO: 42091 - DNA, 75 bp, Artificial Sequence
  Synthetic
ctttatagccttaagacagagattacatgatgtcggacatcatttgaaagcaaatgaaacaataatatcttccca

SEQ ID NO: 42092 - DNA, 75 bp, Artificial Sequence
  Synthetic
tgagaaggttttgatcaattgtgggcttacaattaacggtcttaaagtatgcaaaaacctgcttcaccatgatat

SEQ ID NO: 42093 - DNA, 75 bp, Artificial Sequence
  Synthetic
tggaagcaatcgccaagatgagaatgcttaccaagatgctcagtcaacctgggactagcgaagggggttctcccg

SEQ ID NO: 42094 - DNA, 75 bp, Artificial Sequence
  Synthetic
acatttcaacaacattggcaaaggccattgagaaagggtttgaccggtacttagcctatgcgctgaatattttaa

SEQ ID NO: 42095 - DNA, 75 bp, Artificial Sequence
  Synthetic
aactcgcacggttcaaggataaccaccaatcttcacatggaatgttccatgcatacccagtgttaatcgcaagtc

SEQ ID NO: 42096 - DNA, 75 bp, Artificial Sequence
  Synthetic
ccaatcttcacatggaatgttccatgcatacccagtgttaatcgcaagtcaggaaagggagctcgtatctatcat

SEQ ID NO: 42097 - DNA, 75 bp, Artificial Sequence
  Synthetic
ttttacaagatcactgtctcttgaccaagatggcaattcttcctgcacccataggtggtcttaattacctcaata

SEQ ID NO: 42098 - DNA, 75 bp, Artificial Sequence
  Synthetic
cgatttctatggagattagagtgcaaaatagtaagaatccaagcagtcttgcaaccatcagtcccacaagatttc

SEQ ID NO: 42099 - DNA, 75 bp, Artificial Sequence
  Synthetic
gtactccaaaataatccgggaagtggaaagggcaacactgcgcttgtggaggcagagcagcccgctaaagatgtc

SEQ ID NO: 42100 - DNA, 75 bp, Artificial Sequence
  Synthetic
gaaagtcaggatgaggatgaagctttagctgctttcttgatggataggaaaattattatcccaagagctgcacat

SEQ ID NO: 42101 - DNA, 75 bp, Artificial Sequence
  Synthetic
acaagaattgaggctacgagtatcaactgtcccgatgtcgctcctgcaccttaagcgtgttctataggtttctaa

SEQ ID NO: 42102 - DNA, 75 bp, Artificial Sequence
  Synthetic
gtcaacttatgattatgagcaatttagggcaggtatcagactattgtcagggaagggacatgacccgctcatcga

SEQ ID NO: 42103 - DNA, 75 bp, Artificial Sequence
  Synthetic
agtagtgacactggggatatttggggcaacatctatggatcacattgaggaagtgatacctgtcgctcacccatc

SEQ ID NO: 42104 - DNA, 75 bp, Artificial Sequence
  Synthetic
gaaatttatgaatgcttggggttttgaacttcgcctctaggaatctcactttaacaattatacttccacgcactt

SEQ ID NO: 42105 - DNA, 75 bp, Artificial Sequence
  Synthetic
agagctccgccctataatagggagagattcaggaagagcactggcggaagttctcaagcaacccgcatcatcccg

SEQ ID NO: 42106 - DNA, 75 bp, Artificial Sequence
  Synthetic
ggacgtagcaagccaacaggccaaccaggtccatcaatccgaggccgggcaggaaccctcacgaacagacaagcc

SEQ ID NO: 42107 - DNA, 75 bp, Artificial Sequence
  Synthetic
tgataagaagacatgagtcttgtttgctttgcacatcaggctctcataactatggttggttttttgtaccggcaa

SEQ ID NO: 42108 - DNA, 75 bp, Artificial Sequence
  Synthetic
gctttgcacatcaggctctcataactatggttggttttttgtaccggcaaattgccaattagatagtattacaga

SEQ ID NO: 42109 - DNA, 75 bp, Artificial Sequence
  Synthetic
cactctggtcatacgtcttacctgattgtcaggcttgaaatctataagtcccgcccaatttccttcaaaagctat

SEQ ID NO: 42110 - DNA, 75 bp, Artificial Sequence
  Synthetic
ccatgcacaacaaaatccccaaaggatctaaaatcctaacacccacccaacaagacctcccccaacgacataaca

SEQ ID NO: 42111 - DNA, 75 bp, Artificial Sequence
  Synthetic
gggaacatctgcactgagggtaccatacatcgggtccacaacagaagaaagaacagacatgaaattagcattcgt

SEQ ID NO: 42112 - DNA, 75 bp, Artificial Sequence
  Synthetic
atctaaaatcctaacacccacccaacaagacctcccccaacgacataacatcaaatccgccgagaccagaacctc

SEQ ID NO: 42113 - DNA, 75 bp, Artificial Sequence
  Synthetic
actcatgggcctatggtgatgatgacgaatcttggcaagaggcttggaccttggcaaaacagagagcgaacatct

SEQ ID NO: 42114 - DNA, 75 bp, Artificial Sequence
  Synthetic
tgcaagcaagccagccacagatcagataacatcccggctcacggagaccacgagggtattgtccatcacacacca

SEQ ID NO: 42115 - DNA, 75 bp, Artificial Sequence
  Synthetic
ataacatcccggctcacggagaccacgagggtattgtccatcacacaccagagagtgtctctcaaggaatgagat

SEQ ID NO: 42116 - DNA, 75 bp, Artificial Sequence
  Synthetic
cccggttcaaaaggcggcaatccagtgcaaccagctcaggctctcagtgcacctggctagtcctgtggtgcatcg

SEQ ID NO: 42117 - DNA, 75 bp, Artificial Sequence
  Synthetic
atccaagacaacagaggaccggacaattcgagctactggtcctaagcaatcccaaatcacttttctgcactcgga

SEQ ID NO: 42118 - DNA, 75 bp, Artificial Sequence
  Synthetic
aacggggcagctttatcatgtactagctaaatctactgctatgtctatggttgagatgattacaaagtttgaaaa

SEQ ID NO: 42119 - DNA, 75 bp, Artificial Sequence
  Synthetic
aatccaatctctgagaactagccttgaacagtccaacaaggctatagaagaaattagggaggcaacccaggaaac

SEQ ID NO: 42120 - DNA, 75 bp, Artificial Sequence
  Synthetic
gtactatagcagtgggcgagctgacactggcttccttgtgtgtagatgagagcaccgtattgttatatcatgaca

SEQ ID NO: 42121 - DNA, 75 bp, Artificial Sequence
  Synthetic
gaacagtccaacaaggctatagaagaaattagggaggcaacccaggaaaccgtcattgccgttcagggagtccag

SEQ ID NO: 42122 - DNA, 75 bp, Artificial Sequence
  Synthetic
tgagcccaggttatttactgtgtatctaggtcaatgtgctgcaatcaactggggctttgaaattcattatcaccg

SEQ ID NO: 42123 - DNA, 75 bp, Artificial Sequence
  Synthetic
ctaggtcaatgtgctgcaatcaactggggctttgaaattcattatcaccgaccttctggaaagtatcaaatgggt

SEQ ID NO: 42124 - DNA, 75 bp, Artificial Sequence
  Synthetic
atcatcagcgatgatcagggtcttttcaaaattctctaaatcattggttcatgaactaaaaatcaaatgccttgg

SEQ ID NO: 42125 - DNA, 75 bp, Artificial Sequence
  Synthetic
tgagaagttggggtattctggaaatgatatgattgcaattttggagagtcgagggataaaaacaaaaataactca

SEQ ID NO: 42126 - DNA, 75 bp, Artificial Sequence
  Synthetic
tggcattgtccaggatctcttaatcccctcagacaagaattgaggctacaagtatcaactgtctcgatgtcgctc

SEQ ID NO: 42127 - DNA, 75 bp, Artificial Sequence
  Synthetic
aagcccacttttggactccggatggcttaccatacctcccaagaacggaacagtccttggattgataaacaaagc

SEQ ID NO: 42128 - DNA, 75 bp, Artificial Sequence
  Synthetic
ccaaaggatccaaaaccccaacacccacccaacaagacccccccccacaacatagtatcaaatccgccgagacca

SEQ ID NO: 42129 - DNA, 75 bp, Artificial Sequence
  Synthetic
cacccaacaagacccccccccacaacatagtatcaaatccgccgagaccaagacctcccaagcacgatacaacat

SEQ ID NO: 42130 - DNA, 75 bp, Artificial Sequence
  Synthetic
gtacctcaaaataatccgggatgtggagaacgcaatactgcgcttgtggaggcggagcggccccctagagaggac

SEQ ID NO: 42131 - DNA, 75 bp, Artificial Sequence
  Synthetic
gtaaccctcgtgattgtccccagattcgtgggttgacaccaacacagaaatgtgctgtgttatcgaggtacttaa

SEQ ID NO: 42132 - DNA, 75 bp, Artificial Sequence
  Synthetic
aacatcggctcagcaatccacacgccatggtcctcgaacatcggataggccagttcactacatcatgaacaggac

SEQ ID NO: 42133 - DNA, 75 bp, Artificial Sequence
  Synthetic
cttcatcctgtgctcggaccttggtgtctggaactatgggcaacaagtttattctgtcgaagggtaatatcgtag

SEQ ID NO: 42134 - DNA, 75 bp, Artificial Sequence
  Synthetic
agatcagataacatcccggctcacggagaccacgagggtattatccatcacacaccagagagtgtctcccaaggg

SEQ ID NO: 42135 - DNA, 75 bp, Artificial Sequence
  Synthetic
aatcaagcagataagattgagagtggaccccgggttcatcactgatgctgttggatgcttagaaaagcgacctct

SEQ ID NO: 42136 - DNA, 75 bp, Artificial Sequence
  Synthetic
tttgttccaaggctcagatacattggaataatttgtcaactattgggattatcgggactgacagtgtccattata

SEQ ID NO: 42137 - DNA, 75 bp, Artificial Sequence
  Synthetic
ccaaagcagaattaggtgagtatgagaaattattaagttcagtcctcgagccaatcaaccaagctttgactctaa

SEQ ID NO: 42138 - DNA, 75 bp, Artificial Sequence
  Synthetic
tgatttactgctgtaaaagacgctaccaacagacactcaagcagcatactaaggtcgatccgacatttaaacctg

SEQ ID NO: 42139 - DNA, 75 bp, Artificial Sequence
  Synthetic
gactttgatattagggaaggtagggtcagtgttagtaattaagatcatgcccgctagtggcgactgggttcaagg

SEQ ID NO: 42140 - DNA, 75 bp, Artificial Sequence
  Synthetic
ccgctagtggcgactgggttcaaggatttattctgtatgcactcccacattttcttagaagttacataatttacc

SEQ ID NO: 42141 - DNA, 75 bp, Artificial Sequence
  Synthetic
tgcttgctatcactggagttcgatttcaccaagtatcaactagcaatatggaatttagcagattgctgaaagagg

SEQ ID NO: 42142 - DNA, 75 bp, Artificial Sequence
  Synthetic
taaaaaatgactgaggtgtacgacttcgatcagtcctcttggtacaccaaaggctcattggcccctattttgcct

SEQ ID NO: 42143 - DNA, 75 bp, Artificial Sequence
  Synthetic
aggctcattggcccctattttgcctaccacttatcccgatggtaggctcataccccaagtcagagtaatagatcc

SEQ ID NO: 42144 - DNA, 75 bp, Artificial Sequence
  Synthetic
ttactgacatttattgcctccgatacttgcccactggttgaaatagatggtgtaactatccaggttggagggagg

SEQ ID NO: 42145 - DNA, 75 bp, Artificial Sequence
  Synthetic
ttcaccatgatatctcgtcaggcgaggaagggctgaaaggatctatcacaatcctttatagggaactcgcacggt

SEQ ID NO: 42146 - DNA, 75 bp, Artificial Sequence
  Synthetic
aaaatctattgcatcggcagcaaatcccatccttttatcagcactctccggaggcagaggtgacatattcccacc

SEQ ID NO: 42147 - DNA, 75 bp, Artificial Sequence
  Synthetic
tcaaggataaccaccaattttcacatggaatgttccatgcatacccagtgttaatcgcaagtcaggaaagggagc

SEQ ID NO: 42148 - DNA, 75 bp, Artificial Sequence
  Synthetic
gatgtcgattcaagccgaggtaatttgggcatgttcaaagatcaccaagcgacattcatggtacatatcggcaat

SEQ ID NO: 42149 - DNA, 75 bp, Artificial Sequence
  Synthetic
ttgtggttatattttgctttactcgggagacttatacgaaattaccaggatagttcgagacctgaaagccaacca

SEQ ID NO: 42150 - DNA, 75 bp, Artificial Sequence
  Synthetic
ctcaagaacatcagagataaccaatatgctaactgctatctcagacggagtgtatggtaaaacctatttgctagt

SEQ ID NO: 42151 - DNA, 75 bp, Artificial Sequence
  Synthetic
ctgaccggtctctcatcctgacgacaatcccaaaaaggaattggctctttcaacttgagacaaaagagataaaag

SEQ ID NO: 42152 - DNA, 75 bp, Artificial Sequence
  Synthetic
ttgtcaggattgaaatctataaatctcgccctattttctttaaaagctatcaaactgcaacaaatagtggagagg

SEQ ID NO: 42153 - DNA, 75 bp, Artificial Sequence
  Synthetic
agtggttcaaactgttggggtatagtgcactgattagaaaccactgacgggttggtctggctcctaaccctctgc

SEQ ID NO: 42154 - DNA, 75 bp, Artificial Sequence
  Synthetic
gctccactgagtctagaagacttgttaatgtgtttctagaggactctcagtttgacccttataatatgattatgt

SEQ ID NO: 42155 - DNA, 75 bp, Artificial Sequence
  Synthetic
tgggtgccttctataaggataatgcaagagctaattcatccaagctgtccttagtgacagaagagcaagggggca

SEQ ID NO: 42156 - DNA, 75 bp, Artificial Sequence
  Synthetic
tagcactgcccaagatcccttgatccccgcaagcgaggattgagggtataagcaccgaccatccagacgttgctc

SEQ ID NO: 42157 - DNA, 75 bp, Artificial Sequence
  Synthetic
cccgcaagcgaggattgagggtataagcaccgaccatccagacgttgctcctgcattttgagtgtgtcccataag

SEQ ID NO: 42158 - DNA, 75 bp, Artificial Sequence
  Synthetic
acgctggggatatttggggcaacacctatggatcaagttgaagaggtggtacctgtcgctcacccatcagtagag

SEQ ID NO: 42159 - DNA, 75 bp, Artificial Sequence
  Synthetic
taatgtgtttctagaggactctcagtttgacccttataatatgattatgtatgtgatctcaggtcaatatctaga

SEQ ID NO: 42160 - DNA, 75 bp, Artificial Sequence
  Synthetic
cctccaaaccgctcactcgtgcccacaactccagtgacgcctcgatacgaaagcatccgaaccaaaacagctctt

SEQ ID NO: 42161 - DNA, 75 bp, Artificial Sequence
  Synthetic
caactccagtgacgcctcgatacgaaagcatccgaaccaaaacagctcttgcccaagattaggttgatcattatc

SEQ ID NO: 42162 - DNA, 75 bp, Artificial Sequence
  Synthetic
tattcattgttattaaatttaattatacgaaaaaaaacaacgattattaataagttatcatacccagctttgtct

SEQ ID NO: 42163 - DNA, 75 bp, Artificial Sequence
  Synthetic
ctggatggtgcctgcattggtctctgagaaacaagaggaacaaaaaaattgtctggagtcggcttgtcaaagaaa

SEQ ID NO: 42164 - DNA, 75 bp, Artificial Sequence
  Synthetic
agattggtcggtgatccggaaatcaacggacctaaattaactgggattttaatcagtatcctctccttgttcgtg

SEQ ID NO: 42165 - DNA, 75 bp, Artificial Sequence
  Synthetic
ggaccaagaaatgaatggatgcctggggtttttagcttcgcttctaggaatctcactttaacaattatactccca

SEQ ID NO: 42166 - DNA, 75 bp, Artificial Sequence
  Synthetic
tctcactttaacaattatactcccacgcacttgcctgatctcaagctatcactagtagtcctgtttcacggaact

SEQ ID NO: 42167 - DNA, 75 bp, Artificial Sequence
  Synthetic
ctcattaataattaatcaaaacttagggtccaggacatagcaagccaacaggtcaaccaggtccaccagccaggg

SEQ ID NO: 42168 - DNA, 75 bp, Artificial Sequence
  Synthetic
gctggacaggaacccccacaaacagccgagccccatgcacaagggaatccccaaaagctccaaaacccaaacaca

SEQ ID NO: 42169 - DNA, 75 bp, Artificial Sequence
  Synthetic
tcaaacgatccccagggaacaagcctagaattgctgaaatgatttgtgatatagataactacattgtggaagctg

SEQ ID NO: 42170 - DNA, 75 bp, Artificial Sequence
  Synthetic
gattagctagtttcatcttaactatcaaatttggcattgaaactatgtatccggctcttgggttgcatgagtttt

SEQ ID NO: 42171 - DNA, 75 bp, Artificial Sequence
  Synthetic
cccagcaccgaactcgaagagaccaggacctcccgagcacgacacagcacaacatcagctcagcgatccacgcac

SEQ ID NO: 42172 - DNA, 75 bp, Artificial Sequence
  Synthetic
aaatacccaatgggaggggtagaaggatactgtcaaaagttatggactattagcaccataccttatctgtactta

SEQ ID NO: 42173 - DNA, 75 bp, Artificial Sequence
  Synthetic
ggacctcccgagcacgacacagcacaacatcagctcagcgatccacgcactacgatcctcgaacatcggacagac

SEQ ID NO: 42174 - DNA, 75 bp, Artificial Sequence
  Synthetic
aagatgtccttactgagtccaatttagtggtgttgcctacacagaattttagatatgtcatagcaacatatgata

SEQ ID NO: 42175 - DNA, 75 bp, Artificial Sequence
  Synthetic
ccgtctcctacaccatgaacaggaccaggtcccgcaagcaaaccagccacagattgaagaacatcccagttcacg

SEQ ID NO: 42176 - DNA, 75 bp, Artificial Sequence
  Synthetic
agatatgtcatagcaacatatgatatatcccggggcgatcatgcaattgtttattatgtttatgacccaatccgg

SEQ ID NO: 42177 - DNA, 75 bp, Artificial Sequence
  Synthetic
ccggagaattccaaagccaaggtatgtactatagcagtgggcgagttgacactggcttccttgtgtgtagatgag

SEQ ID NO: 42178 - DNA, 75 bp, Artificial Sequence
  Synthetic
gcaatggttcacaagatggtattctagtagtgacgctggggatatttggagcaacacctatggatcaagttgaag

SEQ ID NO: 42179 - DNA, 75 bp, Artificial Sequence
  Synthetic
caggtcccgcaagcaaaccagccacagattgaagaacatcccagttcacggaaaccacgaggccaccatccagca

SEQ ID NO: 42180 - DNA, 75 bp, Artificial Sequence
  Synthetic
actggcttccttgtgtgtagatgagagcaccgtattgttatatcatgacagcaatggttcacaagatggtattct

SEQ ID NO: 42181 - DNA, 75 bp, Artificial Sequence
  Synthetic
tatcccggggcgatcatgcaattgtttattatgtttatgacccaatccggacgatttcttatacgcacccattta

SEQ ID NO: 42182 - DNA, 75 bp, Artificial Sequence
  Synthetic
caccgtgggttcataaaagattcaatagcaacctggatggtgcctgcattggtctctgagaaacaagaggaacaa

SEQ ID NO: 42183 - DNA, 75 bp, Artificial Sequence
  Synthetic
gaataatttgtcaactattgggattatcgggactgatagtgtccattacaagatcatgactaggcccagtcacca

SEQ ID NO: 42184 - DNA, 75 bp, Artificial Sequence
  Synthetic
agatcatgactaggcccagtcaccagtacttggtcataaaactgatgcctaatgtttcacttatagagaattgta

SEQ ID NO: 42185 - DNA, 75 bp, Artificial Sequence
  Synthetic
tagatatgatggctgaggtgagaaatccctcatcgatgattaaattaaaccatctccagcattataaaaaaacta

SEQ ID NO: 42186 - DNA, 75 bp, Artificial Sequence
  Synthetic
ccaaagcagaattaggtgagtatgagaaattattgaattcagtcctcgaaccaatcaaccaagctttgactctaa

SEQ ID NO: 42187 - DNA, 75 bp, Artificial Sequence
  Synthetic
cattgaccttcaacttaacatatcatttacatacggtccggttatactgaatggagacggtatggattattatga

SEQ ID NO: 42188 - DNA, 75 bp, Artificial Sequence
  Synthetic
atggagacggtatggattattatgaaagcccactttcggactccggatggcttaccattcctcccaggaacggaa

SEQ ID NO: 42189 - DNA, 75 bp, Artificial Sequence
  Synthetic
tataccctgaggtccatctagatagcccaattgtaaccaataagctagtagctattttagagtatgcacgaatta

SEQ ID NO: 42190 - DNA, 75 bp, Artificial Sequence
  Synthetic
cagtccttggattgataaacaaagcaagtagaggagaccagttcactgtaatcccccatgtgttgacatttgcgc

SEQ ID NO: 42191 - DNA, 75 bp, Artificial Sequence
  Synthetic
ctcgtccctgccatgcaacatatgtcatgtgaattagttgggcagagattagggttaagactgcttcggtattat

SEQ ID NO: 42192 - DNA, 75 bp, Artificial Sequence
  Synthetic
gacctgatttcctaaggattgaatgttttgtgtgggatgacgatttgtggtgtcaccaattttaccgatttgagg

SEQ ID NO: 42193 - DNA, 75 bp, Artificial Sequence
  Synthetic
ttttgtgtgggatgacgatttgtggtgtcaccaattttaccgatttgaggctgacatcaccaactctacaaccag

SEQ ID NO: 42194 - DNA, 75 bp, Artificial Sequence
  Synthetic
tgttgagaatttagtccgtataagattctcatgtaaccgttcaaaaccttgacagtatgatgatacacatctcaa

SEQ ID NO: 42195 - DNA, 75 bp, Artificial Sequence
  Synthetic
ttctcatgtaaccgttcaaaaccttgacagtatgatgatacacatctcaattggacttagatatgatgactgagg

SEQ ID NO: 42196 - DNA, 75 bp, Artificial Sequence
  Synthetic
tgtttgaacgatattaatcttagtattggtttaggagatgcactggacaagactataggggccaaaattgacgaa

SEQ ID NO: 42197 - DNA, 75 bp, Artificial Sequence
  Synthetic
gagagtcgggggataaaaacaaaaataactcatgttgatcttcccgggaaattcatcatcctaagtatctcatac

SEQ ID NO: 42198 - DNA, 75 bp, Artificial Sequence
  Synthetic
ttgatacaacattagtgcgtaatatcaaagagagaatttcagaagggttatcaaaccagatgatcattaactgta

SEQ ID NO: 42199 - DNA, 75 bp, Artificial Sequence
  Synthetic
caaatttattctgtcaaaaggtaatatcgtcgcaaattgtgcttctatactatgtaagtgttatagcacaagcac

SEQ ID NO: 42200 - DNA, 75 bp, Artificial Sequence
  Synthetic
tgctatggcaattgatcaacgttactcaactctgcatgtcagaatcaggtatctttggaatctaattgacggatt

SEQ ID NO: 42201 - DNA, 75 bp, Artificial Sequence
  Synthetic
acaaacttttgtttcatgcacaggatcgagtcatctctctgaggttgagaaatatattcaaaagagggaacagca

SEQ ID NO: 42202 - DNA, 75 bp, Artificial Sequence
  Synthetic
aatcctatgtgagatcactctgaagtattctggtcatatatctcgcttgattgccaggtttgaaatctattgacc

SEQ ID NO: 42203 - DNA, 75 bp, Artificial Sequence
  Synthetic
ttcaacctatcaattggtagctttactagagcctctttcattggcttacttgcaattaaaagacatcaccttctc

SEQ ID NO: 42204 - DNA, 75 bp, Artificial Sequence
  Synthetic
catggattattcctaggagagggttcaggtgcaatgctgacagtatataaagagctattgagattgtcaagatgt

SEQ ID NO: 42205 - DNA, 75 bp, Artificial Sequence
  Synthetic
ttctcaaaaatattaagggggatgacaatctaaacgagttctaccagatgatcaagagtatcacacatgcttaag

SEQ ID NO: 42206 - DNA, 75 bp, Artificial Sequence
  Synthetic
tacaggacaatggcttctatactgaagagacgttccaaaccttaacccaggctctagacttcgttttcatcacag

SEQ ID NO: 42207 - DNA, 75 bp, Artificial Sequence
  Synthetic
caatctaaacgagttctaccagatgatcaagagtatcacacatgcttaagctgtagcatttactaatctattaac

SEQ ID NO: 42208 - DNA, 75 bp, Artificial Sequence
  Synthetic
aatgtatagaaaactggaaatcctttgcaggaattcgatttaaatgctttatgcctcttagcctagacagtgatt

SEQ ID NO: 42209 - DNA, 75 bp, Artificial Sequence
  Synthetic
tgggtgccttctacaaggataatgcaagagccaattcaaccaagctgtccttagtgacagaaggacatgggggca

SEQ ID NO: 42210 - DNA, 75 bp, Artificial Sequence
  Synthetic
atgcctcttagcctagacagtgatttgaccatgtatttgaaagataaggctttggcagcccttaaaaaagagtgg

SEQ ID NO: 42211 - DNA, 75 bp, Artificial Sequence
  Synthetic
gagaccatgatgaagggacacgctatattctgtgggataattattaacggttatcgggatagacatggaggtaca

SEQ ID NO: 42212 - DNA, 75 bp, Artificial Sequence
  Synthetic
gaggctattcgctaaaatgacctataaaatgcgagcctgtcaagtcatagcagaaaatctgatatccaatgggat

SEQ ID NO: 42213 - DNA, 75 bp, Artificial Sequence
  Synthetic
cgggaaatacttcaaggacaatggaatggcaaaggatgaacacgatcttaccaaagcattgcacactctggctgt

SEQ ID NO: 42214 - DNA, 75 bp, Artificial Sequence
  Synthetic
ggatcagaaaagctattgcatcggcagcaaatcctatccttttatcagccctatctgggggcagaggtgacatat

SEQ ID NO: 42215 - DNA, 75 bp, Artificial Sequence
  Synthetic
ccaaagcattgcacactctggctgtgtccggggtcccgaaagacaagaaagactcccatcgtggcctctctaatc

SEQ ID NO: 42216 - DNA, 75 bp, Artificial Sequence
  Synthetic
tgagcatgtttaaagatcaccaggtgacattcatggtgcatatcggcaacttcggccgtaagaagaaccaagctt

SEQ ID NO: 42217 - DNA, 75 bp, Artificial Sequence
  Synthetic
gtctttgaaatagggttcatcaaaaggtggctgaatgacatgccattactccaaacaaccaactatatggtactc

SEQ ID NO: 42218 - DNA, 75 bp, Artificial Sequence
  Synthetic
tcattgttattaaatttaattatatgaaaaaaaacaacgattattaataagttatcatacccagctttgtctggt

SEQ ID NO: 42219 - DNA, 75 bp, Artificial Sequence
  Synthetic
agggtcaatgatcctaccttagaggacaaggtcagggttcagacctaccaatatggccagccttcttaagagcct

SEQ ID NO: 42220 - DNA, 75 bp, Artificial Sequence
  Synthetic
ctgcaccttatcgggggacccttcactccgtctcttccccaagtagtagatatatagacccaaatccaaattttt

SEQ ID NO: 42221 - DNA, 75 bp, Artificial Sequence
  Synthetic
acaaggtcagggttcagacctaccaatatggccagccttcttaagagcctcacattgttcaagaggactcgggac

SEQ ID NO: 42222 - DNA, 75 bp, Artificial Sequence
  Synthetic
cagtcgatcctatacgtaagtgacccccactgccccccagatctcgatcgccacgtggacttgaacacagcccct

SEQ ID NO: 42223 - DNA, 75 bp, Artificial Sequence
  Synthetic
tggctgtgtccggggttccgaaagacaagaaagactcccatcgtggcctctctactcaacgtaagtctataaaac

SEQ ID NO: 42224 - DNA, 75 bp, Artificial Sequence
  Synthetic
tggcattgtccaggatccctgaatcctctcaaacaaggattgaggctacaagtgtcaattgtctcggtgttgctc

SEQ ID NO: 42225 - DNA, 75 bp, Artificial Sequence
  Synthetic
ctattctggtgactctgcaatatgaagacagctaaatcaaaccaattcatgctcaagagtaggttgatcattatc

SEQ ID NO: 42226 - DNA, 75 bp, Artificial Sequence
  Synthetic
gctcaagagtaggttgatcattatcggaccgagaaatgtatggatgcttggggttctgaaattcacctctaggaa

SEQ ID NO: 42227 - DNA, 75 bp, Artificial Sequence
  Synthetic
gggttctgaaattcacctctaggaatctcacttaaccaattatacctctacgcgcttgcctgatctcaagctatt

SEQ ID NO: 42228 - DNA, 75 bp, Artificial Sequence
  Synthetic
aggtagaggagaccagttcactgtactcccccatgtgttaacatttgcgcccagggaatcaagtggaaattgtta

SEQ ID NO: 42229 - DNA, 75 bp, Artificial Sequence
  Synthetic
ccaatatagtggtgttgcctacacagagtattagatatgtcatagcaacgtatgacatatcacgaagtgatcatg

SEQ ID NO: 42230 - DNA, 75 bp, Artificial Sequence
  Synthetic
tatagctagatgtgtattttggtcagaaacaatagtggacgagacccgagccgcatgcagcaacatatcaacaac

SEQ ID NO: 42231 - DNA, 75 bp, Artificial Sequence
  Synthetic
agacctcccaaggacgatatagcataacatctgctcagcgatccacgtactatagtcctcaagcattggacaggt

SEQ ID NO: 42232 - DNA, 75 bp, Artificial Sequence
  Synthetic
ttggccttaggcatgataactgcggtgagaaatcccttacagacgattgaattaaaccatctctagcattataaa

SEQ ID NO: 42233 - DNA, 75 bp, Artificial Sequence
  Synthetic
agtagagattctacatcaagtcatgacccaataccctggtgactcttcgtacttagattgggcaagtgaccctta

SEQ ID NO: 42234 - DNA, 75 bp, Artificial Sequence
  Synthetic
aatctgccctgtgtccagagcataacccgactccttaaaaatatcacggccaggcatgtccttatcaacagtcca

SEQ ID NO: 42235 - DNA, 75 bp, Artificial Sequence
  Synthetic
tgatgctgtatcaacagatgggtgaaacagcaccgtacatggttattctggaaaattctgttcagaacaaattta

SEQ ID NO: 42236 - DNA, 75 bp, Artificial Sequence
  Synthetic
attaaaccatctctagcattataaaaaaactaaggatccaagatccttttagccatggactctgtatcagtgaac

SEQ ID NO: 42237 - DNA, 75 bp, Artificial Sequence
  Synthetic
aattgctggaatgctagataccacaaaggggttgataagagcaagcatgaaaagaggaggtctaacccctagaat

SEQ ID NO: 42238 - DNA, 75 bp, Artificial Sequence
  Synthetic
aaagaggaggtctaacccctagaataataaaccgtttgtcaacttatgattatgagcaatttagggcaggtatca

SEQ ID NO: 42239 - DNA, 75 bp, Artificial Sequence
  Synthetic
actcacaactgtcgcaagcggaggcagaaccctgtctttgtaaaaggtgaatcattgaatgtgttagtctctagg

SEQ ID NO: 42240 - DNA, 75 bp, Artificial Sequence
  Synthetic
tacgcgaaaaaatgcataccaaacccaccactccgaaaaagttaggacaagtgaagatagctagtctcaaggacc

SEQ ID NO: 42241 - DNA, 75 bp, Artificial Sequence
  Synthetic
ctttgacaaagaatggtatgatgggtttgttacagatcacatgttcctagacttacaactcttcctctctagctt

SEQ ID NO: 42242 - DNA, 75 bp, Artificial Sequence
  Synthetic
agaatcatgggttgtaatgtgatgatggagcttggttatggtggacgagctgcatggttggcattccatataacc

SEQ ID NO: 42243 - DNA, 75 bp, Artificial Sequence
  Synthetic
taaaacatttctcacagtttttaactttgcatatcttagggtaggatcaaacatagaggagataacaggcaatca

SEQ ID NO: 42244 - DNA, 75 bp, Artificial Sequence
  Synthetic
aactttaatagatcagatttggaaacgatcttaagagatgctagggtgtgcagtacatggcaagatcagagactc

SEQ ID NO: 42245 - DNA, 75 bp, Artificial Sequence
  Synthetic
ggctaatttactagaattattagaccttggttactggaaaaacatgtataaagttttcagtgagacaaaagtgag

SEQ ID NO: 42246 - DNA, 75 bp, Artificial Sequence
  Synthetic
tccgtgtacctcgtgggaagggactgcaacttgttaagaccatttgtgcaagctgccaaattcatccataatact

SEQ ID NO: 42247 - DNA, 75 bp, Artificial Sequence
  Synthetic
actagctttattaaaacaagatttgagtttcaactcagtgaaaaattcctccagctttagacattggtttataaa

SEQ ID NO: 42248 - DNA, 75 bp, Artificial Sequence
  Synthetic
agaagaggccaaacattaacacattggttcacaaaagatatcgtgtttagtcctacagggcaagagatagagccc

SEQ ID NO: 42249 - DNA, 75 bp, Artificial Sequence
  Synthetic
ctcactacaggaagttcagtgtactagcgtcccttgggttgttaatgtaactagaaaccctacacaccttaaagg

SEQ ID NO: 42250 - DNA, 75 bp, Artificial Sequence
  Synthetic
cccattgaccccacatgtgagctgttggcagagctgatcagtggttaaagtgacagcacattatgtagttaatta

SEQ ID NO: 42251 - DNA, 75 bp, Artificial Sequence
  Synthetic
tgtgttgcaatatatgaaaatgatagagtcaggcatgattcagggttactcaactaatatcagttcagtcctatc

SEQ ID NO: 42252 - DNA, 75 bp, Artificial Sequence
  Synthetic
aaacaaagggtaggacaaatcctaatgtccacagctatgaacaagttcactcagaccgtttctaaacctgctacc

SEQ ID NO: 42253 - DNA, 75 bp, Artificial Sequence
  Synthetic
aatcccatacaactatcctgacatggcacacatgatgacaaagattattagaaataaaggtcatatgtcttatga

SEQ ID NO: 42254 - DNA, 75 bp, Artificial Sequence
  Synthetic
atcttgaacatttcagacagtgaagaatcgggtgatgaagcaggggtgggcaaagtgtcccgtaccacacagagc

SEQ ID NO: 42255 - DNA, 75 bp, Artificial Sequence
  Synthetic
ttatcccaagataaagaagagtttaacattctcgatgactgacatgtcagattcttacatgctaaatctcttccc

SEQ ID NO: 42256 - DNA, 75 bp, Artificial Sequence
  Synthetic
tcagagaggtggcttgatttgctcattgaaaagttccaaccgagcctacaaaacatcactagatacatcaactgg

SEQ ID NO: 42257 - DNA, 75 bp, Artificial Sequence
  Synthetic
caaagttgtgtgctcatatatgagtggttatttagataaattagatgatacattgcaactgctcaagaagccacc

SEQ ID NO: 42258 - DNA, 75 bp, Artificial Sequence
  Synthetic
aacttcatcaggatctgcaatgatagacttaaaaaagaaaaaatggggtacattgaggccaagcaatatgtggaa

SEQ ID NO: 42259 - DNA, 75 bp, Artificial Sequence
  Synthetic
cgtgggtaggaaagtaccctctgtagcactgccctggcatcactgcaaccgatacaattttgtgttcagttccac

SEQ ID NO: 42260 - DNA, 75 bp, Artificial Sequence
  Synthetic
gacatggcttggatggtaatggcagctgaggcagacagcattgagtggaagtgcataaggaggcaggagaaagta

SEQ ID NO: 42261 - DNA, 75 bp, Artificial Sequence
  Synthetic
aggttgtaaggtatctgtaatagatatgttacctaagcatttccagagaagtaatttgaaggttatgtgtttcat

SEQ ID NO: 42262 - DNA, 75 bp, Artificial Sequence
  Synthetic
actggggtgaaatacccaaagttcttctttgtacaacacaaagaggactgggttgagtgcacaggatgcattcca

SEQ ID NO: 42263 - DNA, 75 bp, Artificial Sequence
  Synthetic
aggtgaaggtgctggaaaccttatgttaagggcagtcttagaagtaggtggaaatattaaacttatttacaggag

SEQ ID NO: 42264 - DNA, 75 bp, Artificial Sequence
  Synthetic
tacccaggccatgacttgatctgcaatgaggacgatgacaactgagctgactcagatcgccccaaccagcagaga

SEQ ID NO: 42265 - DNA, 75 bp, Artificial Sequence
  Synthetic
cctaaaagaccctgatgaccatcatgttcctgtggagtttcttagattaaaaccttgttatccttacatagatac

SEQ ID NO: 42266 - DNA, 75 bp, Artificial Sequence
  Synthetic
attccaccacctatagcaagcaatacagtatttagtctaagattagttatagaaaaatattaggataaatacaca

SEQ ID NO: 42267 - DNA, 75 bp, Artificial Sequence
  Synthetic
aggtggatcactgagtctggcatcaactgatgctactaataaagcacactgggattacctgcatttacattggac

SEQ ID NO: 42268 - DNA, 75 bp, Artificial Sequence
  Synthetic
tcctaaaccgagccaaaatgtctctagacaagttgaagctcaatgatgtctcaaacaaggatagcctgctgtcca

SEQ ID NO: 42269 - DNA, 75 bp, Artificial Sequence
  Synthetic
agatccattaaatttaatagtatgtgatgctgaaattagtggtgttaaacattggttgaaaatattgcatagatg

SEQ ID NO: 42270 - DNA, 75 bp, Artificial Sequence
  Synthetic
actgcaaatacagtgttaccagatccacaggcgatgtaaccagtgtgtctggtcatgccatgcagaaggcccttg

SEQ ID NO: 42271 - DNA, 75 bp, Artificial Sequence
  Synthetic
gtatgaacacatgaccagctgtaagcactgccttaagtcagagcatgataaatatttgattatcaaatatcatgc

SEQ ID NO: 42272 - DNA, 75 bp, Artificial Sequence
  Synthetic
caaggacactcggcatgttcctacttactgctttcaaccgctgtgaagaagtggcagagataggactccaatatg

SEQ ID NO: 42273 - DNA, 75 bp, Artificial Sequence
  Synthetic
acaggatgaccttatagatttacctcatggtgtgcgtctattgaagtgcaacatctgtcttggtagcaaactgtc

SEQ ID NO: 42274 - DNA, 75 bp, Artificial Sequence
  Synthetic
ccatgtccttattaggcagagatgatagcatcaaaatattgagagaagccggctacaatgtaaaatgtgtggaca

SEQ ID NO: 42275 - DNA, 75 bp, Artificial Sequence
  Synthetic
aggctcagagtcttatctgcttataggattggggttatccaataaattacctgtgtatagcgaggtattgcactc

SEQ ID NO: 42276 - DNA, 75 bp, Artificial Sequence
  Synthetic
cacagctcaaggactttacaatcaaattacaaggaaaagactataaaatacaagtcctagatatagtgggaatag

SEQ ID NO: 42277 - DNA, 75 bp, Artificial Sequence
  Synthetic
taaactacttctagcagaatgtcaccaattccatcatcccaaatatctggatgtgtcaggtattaacactaacat

SEQ ID NO: 42278 - DNA, 75 bp, Artificial Sequence
  Synthetic
atgcagccaatttagctgatctggagatacaagccagaggagtggtagcaaaagaactcaaaactggagccgggc

SEQ ID NO: 42279 - DNA, 75 bp, Artificial Sequence
  Synthetic
taaatctcttatacctatgctggattaccccatcacttataataagattacaacattattagaatctgttagaga

SEQ ID NO: 42280 - DNA, 75 bp, Artificial Sequence
  Synthetic
tacctgataatcgtaggcatgatgcaccagattatggtgtgatagttgtctgtggtgcagcattagttgtttcca

SEQ ID NO: 42281 - DNA, 75 bp, Artificial Sequence
  Synthetic
attgtcctcaaataaaaataaaaatacaatgtggattggacgaaaccctgtttaccataacaaatggctgaagag

SEQ ID NO: 42282 - DNA, 75 bp, Artificial Sequence
  Synthetic
aattagctgcaggggacaggggaggacttgatgctgtggaaaggagggctttaaatgtgctgaaagctgagaaag

SEQ ID NO: 42283 - DNA, 75 bp, Artificial Sequence
  Synthetic
aaagtattttaacatacttaaatggttaaagtattgtattgaattaccagcttttagaatggattataattcatt

SEQ ID NO: 42284 - DNA, 75 bp, Artificial Sequence
  Synthetic
ccagataccccaacctggaggtcaagcagatagctgaaagcttttatgacctgtttgaaaggaagccttattaca

SEQ ID NO: 42285 - DNA, 75 bp, Artificial Sequence
  Synthetic
tgaaaggatagaaatgctttaccccaacttaagggatttagttgattctgtgtcaacaagtgaattgaaaaaagt

SEQ ID NO: 42286 - DNA, 75 bp, Artificial Sequence
  Synthetic
ttgatatcttcatcacttttggcctggcccagtctagtgtcaagggaggcagcaaagttgaggggttgttttctg

SEQ ID NO: 42287 - DNA, 75 bp, Artificial Sequence
  Synthetic
tgtaaaagtcacagggattcttttccgatctaacacaatgtaacttaatatgccagtgctaacatgtcatcccca

SEQ ID NO: 42288 - DNA, 75 bp, Artificial Sequence
  Synthetic
gtctcttcatgaatgcatacggggcaggacaagttatgctgaggtggggtttactggcaaaatctgtcaagaaca

SEQ ID NO: 42289 - DNA, 75 bp, Artificial Sequence
  Synthetic
ctacctttatctgttcaatcactctcagtctagacgtacgagatgatcccaaacccaactgcacccctccctctt

SEQ ID NO: 42290 - DNA, 75 bp, Artificial Sequence
  Synthetic
tcatgctaggccatgctagtgttcaagctgagatggaacaggtggttgaggtttacgagtatgctcagaagcaag

SEQ ID NO: 42291 - DNA, 75 bp, Artificial Sequence
  Synthetic
gaaatcagttgtagcctcagcagctccatctgccatgatctttgaccagcagcaaatgtattattattttaattt

SEQ ID NO: 42292 - DNA, 75 bp, Artificial Sequence
  Synthetic
gaggggaggcaggattctatcatattagaaataatccaaaagcttcactcctctctttgaccaattgtcctaatt

SEQ ID NO: 42293 - DNA, 75 bp, Artificial Sequence
  Synthetic
gtccgtagttaacaaaaaattaatatctcacaggttgtaaacataattctattataattattgctagttaaacta

SEQ ID NO: 42294 - DNA, 75 bp, Artificial Sequence
  Synthetic
tcaccagtgtcgtacttggaaatgctgcaggtttaggcatcatagggtcttataagggtgctcctaggaatagag

SEQ ID NO: 42295 - DNA, 75 bp, Artificial Sequence
  Synthetic
tgtaaacataattctattataattattgctagttaaactattgtgtttgacttcttttgggtatttttttcccgt

SEQ ID NO: 42296 - DNA, 75 bp, Artificial Sequence
  Synthetic
aactctttgatgctgccaaagattatgcagaaagattaaaggacaacaatgtaattaactacagtgcattgaact

SEQ ID NO: 42297 - DNA, 75 bp, Artificial Sequence
  Synthetic
tgactacagaagaaagagagctgatcagccaacagctgaacattgttgatgacactcctgatgatgatatttaat

SEQ ID NO: 42298 - DNA, 75 bp, Artificial Sequence
  Synthetic
taaaaactggaaaatgtaggataaatatggagaaatttgcccctgaatttgtcggtgaggatgctaacaagaagg

SEQ ID NO: 42299 - DNA, 75 bp, Artificial Sequence
  Synthetic
cagaggagtttctcaaacacagatccttcccttcggaaaaaccactagctggtataccgaacactgccactcatg

SEQ ID NO: 42300 - DNA, 75 bp, Artificial Sequence
  Synthetic
tcaccaaatataacatgccccccatattgcgcagctcattcaaactctcccccccaagagccgccgcaaaactca

SEQ ID NO: 42301 - DNA, 75 bp, Artificial Sequence
  Synthetic
ccaaaccctccactcccccctccactccgccacccactcctccccaaaacaaggaagagcagcccaaagagtctg

SEQ ID NO: 42302 - DNA, 75 bp, Artificial Sequence
  Synthetic
atgctgacatagagactatacatgtctatgaggttcctgacaatccggaacacagcaagaagccatgttgctcag

SEQ ID NO: 42303 - DNA, 75 bp, Artificial Sequence
  Synthetic
atgataccgatactaagaaaactaggaagccgatggtcacctttgtggaacccgaagagaagtttgtcggattgg

SEQ ID NO: 42304 - DNA, 75 bp, Artificial Sequence
  Synthetic
gagctagcttgtacaaggagaccatgcaaacttttgctgctgatggttatgatgaagaaagtaacctatcatttg

SEQ ID NO: 42305 - DNA, 75 bp, Artificial Sequence
  Synthetic
aggagactaaccaagagccaggctcttcatctgtagaacaaagactagatagaatagaggagaaattgtcctaca

SEQ ID NO: 42306 - DNA, 75 bp, Artificial Sequence
  Synthetic
taataggccttttaaacaccataatggtagcaactgctggacctaccactgctagagatgagatcagggatgccc

SEQ ID NO: 42307 - DNA, 75 bp, Artificial Sequence
  Synthetic
ttataggcactagagaagaacttattgagatgatcaagtctgacatcttgactgtcaatgacagaatagcggcca

SEQ ID NO: 42308 - DNA, 75 bp, Artificial Sequence
  Synthetic
tggagaagctcagagatgaggaatgctccagagctgaaactgatgatggatcagcctgttatttaacagacagag

SEQ ID NO: 42309 - DNA, 75 bp, Artificial Sequence
  Synthetic
caaggatactagacaagatagtgtccagcaatgctgaagaggctaaggaagacttggatgttgatgacatcatgg

SEQ ID NO: 42310 - DNA, 75 bp, Artificial Sequence
  Synthetic
gcattaatttttagttaattaaaataacaggacaaataatggaggcctacttggtagagatgtaccatggcgtcc

SEQ ID NO: 42311 - DNA, 75 bp, Artificial Sequence
  Synthetic
catatacagctgcaatacagctaaacttggttgaaaaacattcagccaacatatcactaactgtgtggataccga

SEQ ID NO: 42312 - DNA, 75 bp, Artificial Sequence
  Synthetic
tgtttcaaacatctctaccaaagaactccgttatggacctgctacatgatgttacagtcatttgtacacaaatat

SEQ ID NO: 42313 - DNA, 75 bp, Artificial Sequence
  Synthetic
caactgtacatggtcccatgatcaaggtagatctgagctcttccaatgcaggtttagctaccatgccaaggcaat

SEQ ID NO: 42314 - DNA, 75 bp, Artificial Sequence
  Synthetic
tcttgataaatgctatcatagctttggatgactggggcaacatggattacgaagtgcctgttgcttttgataaaa

SEQ ID NO: 42315 - DNA, 75 bp, Artificial Sequence
  Synthetic
agagcttctgtgtgacaattctcaagcctaaagacatgctttacactgtgcccagcattactcctactaatcgac

SEQ ID NO: 42316 - DNA, 75 bp, Artificial Sequence
  Synthetic
ctactcatgagctgatagctgtcagctctttccataacagggtaacattaaaatcattcactatacctgtcttca

SEQ ID NO: 42317 - DNA, 75 bp, Artificial Sequence
  Synthetic
ctactcatgagctgatagctgtctgctctttccataacagggtaacattaaaatcattcactatacctgtcttca

SEQ ID NO: 42318 - DNA, 75 bp, Artificial Sequence
  Synthetic
ctactcatgagctgatagctgtccgctctttccataacagggtaacattaaaatcattcactatacctgtcttca

SEQ ID NO: 42319 - DNA, 75 bp, Artificial Sequence
  Synthetic
ctactcatgagctgatagctgtcggctctttccataacagggtaacattaaaatcattcactatacctgtcttca

SEQ ID NO: 42320 - DNA, 75 bp, Artificial Sequence
  Synthetic
tcagagcactgtctatcagacaacaggaccttgatagtgtggagcaggctataagctccgatgtggaccatgcta

SEQ ID NO: 42321 - DNA, 75 bp, Artificial Sequence
  Synthetic
taacaacagctagggtggctccctatgcagggcttacacttgtgatcaacatcacatctactaaaggtgcattca

SEQ ID NO: 42322 - DNA, 75 bp, Artificial Sequence
  Synthetic
aactgctaaaggcaggttgtcaaattctagcagaactgggtccctatctgactcaggtgagcttacatgatgtga

SEQ ID NO: 42323 - DNA, 75 bp, Artificial Sequence
  Synthetic
ttatgaactggaaacatacaggcacttcctacatactcaagagctcctcaacaagtggatgaaaaaatagaaagt

SEQ ID NO: 42324 - DNA, 75 bp, Artificial Sequence
  Synthetic
caccattgatcagctcaatccataactacaaccccacgacttcacctagcataataactatcgccaccaacatcc

SEQ ID NO: 42325 - DNA, 75 bp, Artificial Sequence
  Synthetic
atatgacaaccacacatacacacctacatatatacacacacatatcttagttaaataaaatcaggataagtaatg

SEQ ID NO: 42326 - DNA, 75 bp, Artificial Sequence
  Synthetic
gatcctaacatgacctcataccagatcacttttgagatcaacatgaccagcagccgtattggcacatacattaca

SEQ ID NO: 42327 - DNA, 75 bp, Artificial Sequence
  Synthetic
ctagccctgacagctctcctccttgcatgcgctgttatcaacacagtgtgtgcgctggtaatggcctgcagcagt

SEQ ID NO: 42328 - DNA, 75 bp, Artificial Sequence
  Synthetic
aggagcattgctacatcaggcatcgttagcagccaatgcacggttcatcccaatcaccctccaccaagttatggc

SEQ ID NO: 42329 - DNA, 75 bp, Artificial Sequence
  Synthetic
gtcaatgtaactggtctgccaggcaacctgtactcaaggaacaccacataatgttataaacagcagaaaccatcc

SEQ ID NO: 42330 - DNA, 75 bp, Artificial Sequence
  Synthetic
ctcgacaaaccccgagctagacagccccaccctgccaggcgattcaatcagcccttgtagtatgtcgtctagtta

SEQ ID NO: 42331 - DNA, 75 bp, Artificial Sequence
  Synthetic
acaaaaaattaggataagtactgtcctattggaatcaaatgagacctgcggagcagctcatacaagagaactaca

SEQ ID NO: 42332 - DNA, 75 bp, Artificial Sequence
  Synthetic
agttgacttcacttagtatgggaaggaactttgaagtgagtggcagcactactaatttgaactttgagagaactc

SEQ ID NO: 42333 - DNA, 75 bp, Artificial Sequence
  Synthetic
agtatcctgacacatttagggctgttgtaaaagtgaaccaaatgtgtaagcttattgcaggtgtgctcacaagtg

SEQ ID NO: 42334 - DNA, 75 bp, Artificial Sequence
  Synthetic
ctgctgtggcagtttgtgtgggggtcataatgtattctgtattcacatcaaatcacaaggccaactccatgcaga

SEQ ID NO: 42335 - DNA, 75 bp, Artificial Sequence
  Synthetic
atgccacaatccggaacagcacatccgcccctccccaaccaaccgccggcccgcccaccacagagcaagggacca

SEQ ID NO: 42336 - DNA, 75 bp, Artificial Sequence
  Synthetic
cccccaaattcaccaaaccccccacgaaaaccaccacccaccatgagatcacagagcccgccaaaatggtaacac

SEQ ID NO: 42337 - DNA, 75 bp, Artificial Sequence
  Synthetic
cctcagaggatccctaccaatgctccagcaatggctacctagaccgacctgacctacctgaagatttcaaactcg

SEQ ID NO: 42338 - DNA, 75 bp, Artificial Sequence
  Synthetic
tattggatgttatatgcaagcctccaggtcccgaacatcacagcaccaactgttatgagaaacgtgagatcaact

SEQ ID NO: 42339 - DNA, 75 bp, Artificial Sequence
  Synthetic
taggaagtgtttgccctgatcttgtaacaatgaaggcaaacatgggcttaaacaatggtggaggggaggaagctg

SEQ ID NO: 42340 - DNA, 75 bp, Artificial Sequence
  Synthetic
caccttatatagaggttatcaccctttctacgtactccaacaaaagggcaatgtgtgtccataatgggtgtgatc

SEQ ID NO: 42341 - DNA, 75 bp, Artificial Sequence
  Synthetic
agggcttctgtttcttcctttctggtttaagcactgatcagaagagagctgtgctagagcttggaggccaacaag

SEQ ID NO: 42342 - DNA, 75 bp, Artificial Sequence
  Synthetic
ctatcatggaattgcattatgattcctattggaaacactattggagcaactctaattgtgttgttcccagaacaa

SEQ ID NO: 42343 - DNA, 75 bp, Artificial Sequence
  Synthetic
actgcaacctgacagaccaaactgtgattttgtttcctagttttaacaacaagaatcagtctcagtgtaccacct

SEQ ID NO: 42344 - DNA, 75 bp, Artificial Sequence
  Synthetic
gtgcagactcagctggcttagataacaaattttatctcacatgtgatgggctttcaagaaacctccctctagttg

SEQ ID NO: 42345 - DNA, 75 bp, Artificial Sequence
  Synthetic
gactacccagcctaagtcctcaagcccacaaagctgcactcaaacaatccacaggcaccaccacagcaccaacac

SEQ ID NO: 42346 - DNA, 75 bp, Artificial Sequence
  Synthetic
cagagacaaggaacccaacccctgcacccaggaggtccaaacctctcagtcggaagaaaagagctttatgtggag

SEQ ID NO: 42347 - DNA, 75 bp, Artificial Sequence
  Synthetic
tagactcaagcagagaacccaaaccaacaatgccttattggtgtcctatgctccaattatttccaaggaggtcta

SEQ ID NO: 42348 - DNA, 75 bp, Artificial Sequence
  Synthetic
attcttaagtgacctattcccgaatcaacttcagaataagtaccaaccttgttagtagttaatgaaaaataagct

SEQ ID NO: 42349 - DNA, 75 bp, Artificial Sequence
  Synthetic
atgatataataggacaaatatgattcctggcaggatatttctagtccttctgttgatcttcaacaccaaaccaat

SEQ ID NO: 42350 - DNA, 75 bp, Artificial Sequence
  Synthetic
tcacccaaatacattaacagaaaaattctatgagtccacatgtagtgttgagactgcaggttataagagtgccct

SEQ ID NO: 42351 - DNA, 75 bp, Artificial Sequence
  Synthetic
tagaacaggttggcacatgacagttatgtcaattaagttgtctcaaataaatattgagtcatgcaagagcagcaa

SEQ ID NO: 42352 - DNA, 75 bp, Artificial Sequence
  Synthetic
ctcgttattggctcatgagcttgcaatctatagtagtgcagtggatgaattgagaacgttatcatccaatgcttt

SEQ ID NO: 42353 - DNA, 75 bp, Artificial Sequence
  Synthetic
gaagtccaaaaggaagaagagattcctcggtttgattcttggtctcggagctgcagtcactgccggagtggcttt

SEQ ID NO: 42354 - DNA, 75 bp, Artificial Sequence
  Synthetic
agccaagacagtgcaacttgaaagtgagattgcattgattagagaggcagtgagaaatacaaatgaggctgttgt

SEQ ID NO: 42355 - DNA, 75 bp, Artificial Sequence
  Synthetic
cagcctaaccaatggcatgtcagtgttggctaaagtggtggatgatttgaaaaacttcatatctgaagaattact

SEQ ID NO: 42356 - DNA, 75 bp, Artificial Sequence
  Synthetic
ccctaaaataaaccgagtctcttgtgatgtgcacgacatcactgctgtcattagattccaacagctcaacaaaag

SEQ ID NO: 42357 - DNA, 75 bp, Artificial Sequence
  Synthetic
acttttagaagtgtctcgtgaattttcatctaatgcaggattaacacacactgtttcatcttttatgttaacaga

SEQ ID NO: 42358 - DNA, 75 bp, Artificial Sequence
  Synthetic
ccgggaactcacctccattgtaggcggcatggctgtgtcagcaggccaaaaagagataatgctatctagtagagc

SEQ ID NO: 42359 - DNA, 75 bp, Artificial Sequence
  Synthetic
tataatgagaagaaacgggttagcaatattaagttcagtcaatgctgacacactggtttatataatacaactccc

SEQ ID NO: 42360 - DNA, 75 bp, Artificial Sequence
  Synthetic
gttatttggtgttatggacacagattgttgggtaataagaagttccatagactgtcataacatagcagacaaata

SEQ ID NO: 42361 - DNA, 75 bp, Artificial Sequence
  Synthetic
tgcttgtttggctagagctgataatggctggtattgtcacaatgcaggctcattatcatacttcccatcgccaac

SEQ ID NO: 42362 - DNA, 75 bp, Artificial Sequence
  Synthetic
agattgtgagatccacaatgggtatgttttctgtgacactctgaaaagtctaactgtacctgtaacatcacgaga

SEQ ID NO: 42363 - DNA, 75 bp, Artificial Sequence
  Synthetic
atgcaactcaaacatgtataccactaactacgattgtaagatttccacaagtaaaacttatgtgagcacagcagt

SEQ ID NO: 42364 - DNA, 75 bp, Artificial Sequence
  Synthetic
actaaccacaatgggctgcttggtgtcttgttatggacataacagttgcacagtcatcaataatgacaaaggtat

SEQ ID NO: 42365 - DNA, 75 bp, Artificial Sequence
  Synthetic
aataaggactctgccagatggttgtcactacatctccaacaagggtgtggacaaagttcaagtaggtaacactgt

SEQ ID NO: 42366 - DNA, 75 bp, Artificial Sequence
  Synthetic
ctactatcttagcaaagaagttggcaagtcaattgtagtcagaggggaaccgttggtcttgaaatatgacccttt

SEQ ID NO: 42367 - DNA, 75 bp, Artificial Sequence
  Synthetic
gagtttccctgacgataaatttgatgttgctataagagatgtggagcatagcatcaatcagacacgcacattctt

SEQ ID NO: 42368 - DNA, 75 bp, Artificial Sequence
  Synthetic
gaaggcctctaatcagttattggacttaagtgaaaacagagagaataaaagtttaaacaagtcatatatactaac

SEQ ID NO: 42369 - DNA, 75 bp, Artificial Sequence
  Synthetic
aactctgctcattgttgtaatgcttattataataatggctgtcatagggttcattctgtacaaggtactgaaaat

SEQ ID NO: 42370 - DNA, 75 bp, Artificial Sequence
  Synthetic
tatcagggacaacaagttgaaatccaaaagcacacctggcctcacagttttatcatgacaattgtatcaaaccac

SEQ ID NO: 42371 - DNA, 75 bp, Artificial Sequence
  Synthetic
aattgagttagttaattaaaaaacttaggataagtgacaatccagactcaacacctccctcgactctcaaggaca

SEQ ID NO: 42372 - DNA, 75 bp, Artificial Sequence
  Synthetic
aggcaggatgagtgtgagaccttgcaaatttgaggttcaagggttttgttccagggggaggaattgcaagtatag

SEQ ID NO: 42373 - DNA, 75 bp, Artificial Sequence
  Synthetic
tcataaatattgggaatggcctttgaaaactcttatgctcaggcagaactatatgctcaataggatttataggtt

SEQ ID NO: 42374 - DNA, 75 bp, Artificial Sequence
  Synthetic
ccttgacaccaacacagatgcaatgtccgatgtcagtggatttgatgcaccacaaaggactgctgagtatgcttt

SEQ ID NO: 42375 - DNA, 75 bp, Artificial Sequence
  Synthetic
gggaaccataggtgtgctgaaaagttacctggaaaaaactaacaacatcactaagtcaatagcttgtggcagttt

SEQ ID NO: 42376 - DNA, 75 bp, Artificial Sequence
  Synthetic
gattactgtgttgcagaacttggatgttggtttggtaatacaagcaagagatagcaacgcagaggacaccaatta

SEQ ID NO: 42377 - DNA, 75 bp, Artificial Sequence
  Synthetic
cttgagaagttgcaacactatactatcttatatagataagatacacaagaagagacaagttattcacattctcaa

SEQ ID NO: 42378 - DNA, 75 bp, Artificial Sequence
  Synthetic
gaagctgccagtgggagtattatgcagtctgatccaatctgtcatctccatcgaggagaagataaattcttctat

SEQ ID NO: 42379 - DNA, 75 bp, Artificial Sequence
  Synthetic
gaaaacagaatgataaggctgcctaaatactatccagccatactgcataagatgtatattattggagtaaataga

SEQ ID NO: 42380 - DNA, 75 bp, Artificial Sequence
  Synthetic
aacctcacttacgatgggtctagaccatctacaataatagatgcaggaaagtctgtggtgtggaaccgtgttgat

SEQ ID NO: 42381 - DNA, 75 bp, Artificial Sequence
  Synthetic
gtgatagcttgtgtgaaagaggccttgtgctgcatagaattcagctggagtaaccaagtgatcatagactttgac

SEQ ID NO: 42382 - DNA, 75 bp, Artificial Sequence
  Synthetic
tatagtcaggccagatgatgtggactgtattccttcttttgtcagctatcaatcattaaccccaaattgttaatt

SEQ ID NO: 42383 - DNA, 75 bp, Artificial Sequence
  Synthetic
gtgtagattttaagtcaactaacttcatgttaattcaatagttatataaaaataatcaattaggatcaatatgga

SEQ ID NO: 42384 - DNA, 75 bp, Artificial Sequence
  Synthetic
tcctattgatgaacaagaagttaatgtgtacttaccagatagctacttaaagggtgtcatatcttttagtgaaac

SEQ ID NO: 42385 - DNA, 75 bp, Artificial Sequence
  Synthetic
taatgctctcggcagctgtatcattggtagacctttcttgaaggatgattttactgccactacttcaattcgtaa

SEQ ID NO: 42386 - DNA, 75 bp, Artificial Sequence
  Synthetic
ccccctgattgaacataaaaggataagggatactaaattggttaaaaatatcatttcaaaccctcaatataggtt

SEQ ID NO: 42387 - DNA, 75 bp, Artificial Sequence
  Synthetic
agttgagcccctccaaatgcagcatgagctcttgagtgtactatcgcccaatttcatattgcacactgccaactt

SEQ ID NO: 42388 - DNA, 75 bp, Artificial Sequence
  Synthetic
aaggaaaattatacaaagaagtgttgacataacagataaaaagttgaaccccgttttgcacattttgaatcttaa

SEQ ID NO: 42389 - DNA, 75 bp, Artificial Sequence
  Synthetic
ttcccctaaccatgagggcaaggtgtcggaacggctaactaggctaataaagaaacatctttctcacattcctaa

SEQ ID NO: 42390 - DNA, 75 bp, Artificial Sequence
  Synthetic
ttgggtaagcagctggtacaacatatgggtcaatctcaacaatttgctgcaggaatatcgttcaaaggaagttat

SEQ ID NO: 42391 - DNA, 75 bp, Artificial Sequence
  Synthetic
agaccataactgtgttctgactagacaattgtctggaagtttcatacatgtggtcataagtcaatatggagttgt

SEQ ID NO: 42392 - DNA, 75 bp, Artificial Sequence
  Synthetic
gataattagcaaaaaaagcaaaagatatacagtgtgtacttataaccaattcctaacctggaaagaccttgcctt

SEQ ID NO: 42393 - DNA, 75 bp, Artificial Sequence
  Synthetic
gagcagatttaatgctaattatgtggtctggctaagtaatgtgttaaacacactcaatgaggggttaggattgag

SEQ ID NO: 42394 - DNA, 75 bp, Artificial Sequence
  Synthetic
atgtagattaaaaggtcatctgctcagtaagttgtacatttccactgacatctttttatcttcaacatctaatga

SEQ ID NO: 42395 - DNA, 75 bp, Artificial Sequence
  Synthetic
attttataatgtggtcaaagaatttgagggcttcatcatgtcactgatattgaaacgaactgaggaagccttatt

SEQ ID NO: 42396 - DNA, 75 bp, Artificial Sequence
  Synthetic
tagcataaggttttataataacatgttgaacaacttaattgatgccattgataaggctcgactagaatatctgac

SEQ ID NO: 42397 - DNA, 75 bp, Artificial Sequence
  Synthetic
ccgctgtgccaattcagctgccaggattaatttacctagtacagatgttatgatagcatcattgggtgatatctt

SEQ ID NO: 42398 - DNA, 75 bp, Artificial Sequence
  Synthetic
gtctttgataaacgttttaggtgaatctaatcttaacaacttaagtgagttatattttattttcaggatatttgg

SEQ ID NO: 42399 - DNA, 75 bp, Artificial Sequence
  Synthetic
ccaccctatggttgatgagaggaaggccatggatgcagtcagagataactgttgtgaaacaaagttcctaatggc

SEQ ID NO: 42400 - DNA, 75 bp, Artificial Sequence
  Synthetic
taagaaccttgcatcgttaagaggagcatatgtctatagaattatcaaaggatttgtagcaaattataataggtg

SEQ ID NO: 42401 - DNA, 75 bp, Artificial Sequence
  Synthetic
gccttatataaaaactagagtttgcctcacaccaacatggattaactatcttgataccaattcatgtccttcatt

SEQ ID NO: 42402 - DNA, 75 bp, Artificial Sequence
  Synthetic
attagagatgacaaaagatgattttattgtgttagctggagtacactttataagagaattccacatcccaaagct

SEQ ID NO: 42403 - DNA, 75 bp, Artificial Sequence
  Synthetic
aactgatctggagattatattaaatgacaaggcgatatctcctccaaaatcactcatttggtcatgctttccaaa

SEQ ID NO: 42404 - DNA, 75 bp, Artificial Sequence
  Synthetic
aaactacataccccaggttatacaagatgagtatgcccggaggtattgtagagctaaagcacctttgaagacaag

SEQ ID NO: 42405 - DNA, 75 bp, Artificial Sequence
  Synthetic
acgtgtcttggagttctacttacaggataaggatttcaagttggatcagctccatagagtagtagtgaaccaaga

SEQ ID NO: 42406 - DNA, 75 bp, Artificial Sequence
  Synthetic
ctaccttaatgataaagaacatataatttctttaacaggaaaagagagagagttgagtgttggtaggatgtttgc

SEQ ID NO: 42407 - DNA, 75 bp, Artificial Sequence
  Synthetic
catgcaacccgggaagcagaggcaagtccaaatcttagcagagaagctgttggcagataatatccttcaattctt

SEQ ID NO: 42408 - DNA, 75 bp, Artificial Sequence
  Synthetic
tccagagacactgactagatacggcgatttggaactgcaaaagatactagagttaaaagctggactttcaaataa

SEQ ID NO: 42409 - DNA, 75 bp, Artificial Sequence
  Synthetic
aaatgacaggtctaaagattcctacaataattatataagtaggtgctcattaattactgatttaagtaaatttaa

SEQ ID NO: 42410 - DNA, 75 bp, Artificial Sequence
  Synthetic
ccaagcttttaggtacgagtcgtcctgtgtgtgtagtgatctcttagatgagctgcatgggactcaaagcttatt

SEQ ID NO: 42411 - DNA, 75 bp, Artificial Sequence
  Synthetic
ctcttggctgcatttaacagtacctctgaccactataatgtgtacatacaggcatgcacctccagacactggcaa

SEQ ID NO: 42412 - DNA, 75 bp, Artificial Sequence
  Synthetic
taattataacgttgatgatatagcagaacagagtggcctttataggtatcatatgggtggtatagaaggatggtg

SEQ ID NO: 42413 - DNA, 75 bp, Artificial Sequence
  Synthetic
ccaaaaattgtggaccacagaagccatagcattattggacacagtagcagtcaaaggcagatttcaactaacatc

SEQ ID NO: 42414 - DNA, 75 bp, Artificial Sequence
  Synthetic
ccttataaatggagataatcagtctatagatataagcaaacctacaagattgggaacaagaactcagtcagaggc

SEQ ID NO: 42415 - DNA, 75 bp, Artificial Sequence
  Synthetic
tgactatgatttagccataaactctttaaggcttatatcagctgcttacagagggataggtcataagctgaagga

SEQ ID NO: 42416 - DNA, 75 bp, Artificial Sequence
  Synthetic
aggagaaacttacctatcacgtgacatgcagtttatgagtaaaactattcaacatgagggagtatattatccagc

SEQ ID NO: 42417 - DNA, 75 bp, Artificial Sequence
  Synthetic
ttccatcaaaaagatcctgagagttggtccatggatcaacaccatactagacgatatcaaaactagcacagagag

SEQ ID NO: 42418 - DNA, 75 bp, Artificial Sequence
  Synthetic
tataggtagtttaacacaggaattagagtataagggggaaagtctaatgtccagtttgttattgaggaacttctg

SEQ ID NO: 42419 - DNA, 75 bp, Artificial Sequence
  Synthetic
gctatacaggttatactcagttgacttgaaagaccattctttatgtgggaagcaattatataggtcattgattaa

SEQ ID NO: 42420 - DNA, 75 bp, Artificial Sequence
  Synthetic
agtacttaagcatcttaagagatgtttcaacctggaaaatttaggagaatgtttagaactgtttcttaatgtccc

SEQ ID NO: 42421 - DNA, 75 bp, Artificial Sequence
  Synthetic
aatgcagtttggaggtgctgatcccaatgtcctctataggtcattctatagaaggacaccagatttcttgaccga

SEQ ID NO: 42422 - DNA, 75 bp, Artificial Sequence
  Synthetic
gaccataactcatctaatactgatattaaaacatttcagacgtgatcttgagtttaacaaagataatgtatcaaa

SEQ ID NO: 42423 - DNA, 75 bp, Artificial Sequence
  Synthetic
agcagtgttgtctttactagaatttaccaagaatgattctgctgagtttgtaaccttaatgagagaccctcaagc

SEQ ID NO: 42424 - DNA, 75 bp, Artificial Sequence
  Synthetic
aataggttcagagaggcaagcaaaaataactagtgacattaacaggactgctgttaccaacgtgctctctaatgc

SEQ ID NO: 42425 - DNA, 75 bp, Artificial Sequence
  Synthetic
tcccaatgagatatttagaaccagtgctttgcattattcctctactgagaatgaactaaacagcatagcaagtga

SEQ ID NO: 42426 - DNA, 75 bp, Artificial Sequence
  Synthetic
tattagccctgtatatcctcatggtttaagagtcttatatgaatcactaccattccataaagctgagaaaatagt

SEQ ID NO: 42427 - DNA, 75 bp, Artificial Sequence
  Synthetic
caacatggtgtctgggacaaaatcaatcaccaacatacttgagaaaacctcagctataagttatacagatatcat

SEQ ID NO: 42428 - DNA, 75 bp, Artificial Sequence
  Synthetic
aagagctactaacatgatggtcgagaatttaacactgctgacaagaataatgaaaccaggtgcagacacttctct

SEQ ID NO: 42429 - DNA, 75 bp, Artificial Sequence
  Synthetic
agatccagacaccatagtgattaccatactaagtaagatcattagagataaatcttgggatgtaggagatattat

SEQ ID NO: 42430 - DNA, 75 bp, Artificial Sequence
  Synthetic
aggtgtaacctcaccttcacctgtcagctgctttaaggtagtttacacttcaaccctccaaaataatagtgttgt

SEQ ID NO: 42431 - DNA, 75 bp, Artificial Sequence
  Synthetic
tattgagagatataccactgacacatatacaagaggcaagagagggcctacaaaaccctgggtgggctctagcac

SEQ ID NO: 42432 - DNA, 75 bp, Artificial Sequence
  Synthetic
ccaagaaaagaaatcaatgcctgtatacaataggcaggtgctcacaagaggtcagagagaccaaatagagaacat

SEQ ID NO: 42433 - DNA, 75 bp, Artificial Sequence
  Synthetic
agcaaaactagaatgggttttcagctctgttgcaaacatagactcattattgaatgagctaagcactatgacctt

SEQ ID NO: 42434 - DNA, 75 bp, Artificial Sequence
  Synthetic
gggcttaagtctgagaaaatgtaagcaattatttcccacttatttgagtttaaactttctccatagactatcagt

SEQ ID NO: 42435 - DNA, 75 bp, Artificial Sequence
  Synthetic
gagcagcagacctcgggagtacccctcatcattacctgcttacaggactactaacttccactttgatacaggtcc

SEQ ID NO: 42436 - DNA, 75 bp, Artificial Sequence
  Synthetic
tataaataaagttttgactgagaggtttggagacgaggatattaaccttgtgtttcagaatgcaattagctatgg

SEQ ID NO: 42437 - DNA, 75 bp, Artificial Sequence
  Synthetic
gctaagcactatgagtttggtagaacagtttactggagtgtgtcctaataaggttttgcttgtgccaaagcttca

SEQ ID NO: 42438 - DNA, 75 bp, Artificial Sequence
  Synthetic
agaaatacaactcatgaaagtcccaatatttcaagggggatttaatctgcagtctattatacctataattaggca

SEQ ID NO: 42439 - DNA, 75 bp, Artificial Sequence
  Synthetic
gcaacacatgttcctccctaaccatataacaccggctcaatatatagaattgtttctgagtagtaaacagttcca

SEQ ID NO: 42440 - DNA, 75 bp, Artificial Sequence
  Synthetic
cactcgaattaacttaaatcacaataacaggtttaaattggttttgcagaaagattactttaatggggaaaacat

SEQ ID NO: 42441 - DNA, 75 bp, Artificial Sequence
  Synthetic
gattgaaaccttaagcacatgtcttgctggtcattggatcataatacttatgttgatgaaagagtcacaaggtat

SEQ ID NO: 42442 - DNA, 75 bp, Artificial Sequence
  Synthetic
accagacaaaggaagtctagtctccggattaaatcatattcgtatgattaatcttaggatcccggtatctagaat

SEQ ID NO: 42443 - DNA, 75 bp, Artificial Sequence
  Synthetic
ttcaattgtctatatcaggaataccaagagggaacaaaaacaacaaatcgacgaacgacacaatccacgaaagca

SEQ ID NO: 42444 - DNA, 75 bp, Artificial Sequence
  Synthetic
ctggatctggattcggtttaattgaattgcgatcgtttataaattagaaaggagatttactactcaaaatgtctg

SEQ ID NO: 42445 - DNA, 75 bp, Artificial Sequence
  Synthetic
agatcgagaataaccattcctttaaaaacatccagaatcgatcatttcgaaagacggataacccatacaatagat

SEQ ID NO: 42446 - DNA, 75 bp, Artificial Sequence
  Synthetic
acattttcaatgagactcaatcatttagaaactatcagtccaacttaggcagagatggcagggccagtgcagcaa

SEQ ID NO: 42447 - DNA, 75 bp, Artificial Sequence
  Synthetic
ttaacattgataacccaactttcttatccccaaactgtaaccccaagtataaccgtaagaattcagagacaatag

SEQ ID NO: 42448 - DNA, 75 bp, Artificial Sequence
  Synthetic
cgactactttgacaactaaagtgaggatctttgttccagcgaataataatccaaacctcagatggcgtttaacac

SEQ ID NO: 42449 - DNA, 75 bp, Artificial Sequence
  Synthetic
gtatattctctcgtgcagaaaccaaaagcatgattagagaacagaaaagtcacagagaagtcaaaataaataagc

SEQ ID NO: 42450 - DNA, 75 bp, Artificial Sequence
  Synthetic
tattcttgatggatgtcgtgaggtcacctgcctccgcagagtctatgaaagtgggtgctgggatatccttggtat

SEQ ID NO: 42451 - DNA, 75 bp, Artificial Sequence
  Synthetic
tagatatcggcagtgataatgaagagcaaggaaaagagatagatgccgccaagtacaaaatcacggacaacccaa

SEQ ID NO: 42452 - DNA, 75 bp, Artificial Sequence
  Synthetic
ctatgtatgctgaaaaacccggggctcttgtgagagcattattgaatgacccagatgttgaagcgataatcatag

SEQ ID NO: 42453 - DNA, 75 bp, Artificial Sequence
  Synthetic
atccacacataaatcctcaagatcaacccggaatctgtcaagaagacaaaggcaaagaaggagcaaagtcagatc

SEQ ID NO: 42454 - DNA, 75 bp, Artificial Sequence
  Synthetic
atgtttatggctttgatgaaggtattcctataatggaacgaagaggtgataaagctacagatgacatggattccc

SEQ ID NO: 42455 - DNA, 75 bp, Artificial Sequence
  Synthetic
tcacagaaggcatgagttttctggagatgcacacactctttaacccgagtaagagcgatatcagaacaaatctcg

SEQ ID NO: 42456 - DNA, 75 bp, Artificial Sequence
  Synthetic
taagaaagattgttaaagctgcacatgatttcagcagaggaaggagtttatttgttgatcaaagggtccaggata

SEQ ID NO: 42457 - DNA, 75 bp, Artificial Sequence
  Synthetic
aattggaaaagagttcactttcaaaccctggatttatatcacaaaaagagaaaagaggcaaaacttataatgaat

SEQ ID NO: 42458 - DNA, 75 bp, Artificial Sequence
  Synthetic
ttgttatgtcagatatggggtcatttgtgaatgctattacttccatagagacgcagatatggattttgatcgcaa

SEQ ID NO: 42459 - DNA, 75 bp, Artificial Sequence
  Synthetic
cccattcactgggaaagttctctaaagaggatgaagaaagatacgatgtcatcagtgcattcctgacaacagatt

SEQ ID NO: 42460 - DNA, 75 bp, Artificial Sequence
  Synthetic
aggctgtaactgccccagatacagcagaagagagcgaaggaagaagatgggcaaaatatgttcagcaaaagaggg

SEQ ID NO: 42461 - DNA, 75 bp, Artificial Sequence
  Synthetic
tacgaaaattctgcttaaattggagacatgaatcaatcggcatttttgcaagaaggatggacgaaatctatggtt

SEQ ID NO: 42462 - DNA, 75 bp, Artificial Sequence
  Synthetic
ttaatcctttgttcttgatttctccacaatggatcaatgacatgagatccctgattgcggcaagtctttcgcttc

SEQ ID NO: 42463 - DNA, 75 bp, Artificial Sequence
  Synthetic
tgcctggtttctttaattggatgcacagaagactagagcgatctgtgttatatgttgcggaccctcattgcccgc

SEQ ID NO: 42464 - DNA, 75 bp, Artificial Sequence
  Synthetic
gtaaattcatggttgaactactgatggaagctaagaaaggacgggggacaaaaggaagaataatggagattgtat

SEQ ID NO: 42465 - DNA, 75 bp, Artificial Sequence
  Synthetic
cgtctatcaatgaacatatcgatctaaacgattcacccgaaagagacatatttatacatcatccgaaagggggta

SEQ ID NO: 42466 - DNA, 75 bp, Artificial Sequence
  Synthetic
ccgatatcggaaattacgttgaagagacaggaatggcagggttcttcgctacaataaagttcggtcttgagacca

SEQ ID NO: 42467 - DNA, 75 bp, Artificial Sequence
  Synthetic
tagaaggatacagccaaaaactgtggacaatagcgactatcccttttctattcctcagtgctcatgagacaaaca

SEQ ID NO: 42468 - DNA, 75 bp, Artificial Sequence
  Synthetic
aattccctgctttggcacttaatgagctccagagtgacttgaacacaatgaaaagtctcatgatactgtacagaa

SEQ ID NO: 42469 - DNA, 75 bp, Artificial Sequence
  Synthetic
cccggatagcggcagttgtacaaggtgacaatcaatcaattgcaattacacataaggtccaccctcatttgcctt

SEQ ID NO: 42470 - DNA, 75 bp, Artificial Sequence
  Synthetic
gcataggaccaaaggccccctttatggtgttgttggaagattcaattcagaccaaatttgctccaggaagctatc

SEQ ID NO: 42471 - DNA, 75 bp, Artificial Sequence
  Synthetic
acaaaatgaagaaagaactctctgcaatgcaggcaaaaaaatatttttcaaggttacggcacaacatgaaggcat

SEQ ID NO: 42472 - DNA, 75 bp, Artificial Sequence
  Synthetic
cacttctttggagttttgcgatgggtgtaggcacaactattgacagagctatgggtgccttgaacattaacagaa

SEQ ID NO: 42473 - DNA, 75 bp, Artificial Sequence
  Synthetic
tagggcatgaattgaaggcgaccgagactatcattagtactcatttcttcatttattccaagaaaatccactatg

SEQ ID NO: 42474 - DNA, 75 bp, Artificial Sequence
  Synthetic
gttatcttgaacctgtctattttaggctagggcaacaatcagctaaacatcaagcaggaaatgttgacaaagaaa

SEQ ID NO: 42475 - DNA, 75 bp, Artificial Sequence
  Synthetic
acggggctgttttatcacaatctctgaaatcaatggcaaggtgtgtattttggtcagaaacccttgttgatgaaa

SEQ ID NO: 42476 - DNA, 75 bp, Artificial Sequence
  Synthetic
tggcagaaaagttaggattgacagaagaccagatcgtgcacctatcagctaatgtgaaggatgcaagtcaaggta

SEQ ID NO: 42477 - DNA, 75 bp, Artificial Sequence
  Synthetic
ctagagcagcatgcagtaatatcagcacaacaattgcaaaggctattgagaatggttatagcaggagatctggct

SEQ ID NO: 42478 - DNA, 75 bp, Artificial Sequence
  Synthetic
gagatgacaatcaaatcaacatccgagaagggaagttcacaaatgttgttgatgacatccaggatcatgcccaga

SEQ ID NO: 42479 - DNA, 75 bp, Artificial Sequence
  Synthetic
atctgataaatgttcttaaaaccatccaacaaattaatatatcattgagttttaatataaatgaatgcatgacag

SEQ ID NO: 42480 - DNA, 75 bp, Artificial Sequence
  Synthetic
gttcctctgaggattacaatcctagtaaaaagagtttctcaatattgacgagcatcacatccaccgtagatagtg

SEQ ID NO: 42481 - DNA, 75 bp, Artificial Sequence
  Synthetic
atgacataatcagaccgtttagagataatccaaactggatcaaacatgccgcattaatccccgccagcttgggag

SEQ ID NO: 42482 - DNA, 75 bp, Artificial Sequence
  Synthetic
ctgacagtaggtctgcaatgaatgagtcaatgacaacaacatccttgctgaaattgagacagaggctggcagaga

SEQ ID NO: 42483 - DNA, 75 bp, Artificial Sequence
  Synthetic
gactcaactatatgaacatgtctcgattgtatgtgaggaatataggggatccagtcacagcatcgatagcagatg

SEQ ID NO: 42484 - DNA, 75 bp, Artificial Sequence
  Synthetic
agaaaggagactccaagaacagtcaagacacacctccaaaaccacccagagcaaaagatcaacccactgatgagg

SEQ ID NO: 42485 - DNA, 75 bp, Artificial Sequence
  Synthetic
ttaagagaatgattctcggtggtgtactacccattggaatactccacaatatcatgttgcaagaacccggtgatg

SEQ ID NO: 42486 - DNA, 75 bp, Artificial Sequence
  Synthetic
tctccttcatggattccaatatatgatcagaatgatggttaaaatcaaccaactaagggcgcgtagagtaccttc

SEQ ID NO: 42487 - DNA, 75 bp, Artificial Sequence
  Synthetic
ccacttatttggactggtgtagtgatccatactccatcaacctaaagcagactcaaagtatcacaaaagttataa

SEQ ID NO: 42488 - DNA, 75 bp, Artificial Sequence
  Synthetic
agatagaacactacattaatcgggtgaaacaatagatttatgggtttggtgcttaatttttatttaatcttactt

SEQ ID NO: 42489 - DNA, 75 bp, Artificial Sequence
  Synthetic
agaacataacggcaagagtgatactaaggaattcggtcaatccactgctcaaaggtctatttcatgaaggtgctt

SEQ ID NO: 42490 - DNA, 75 bp, Artificial Sequence
  Synthetic
gcaaaacaggcagctgctacactcgtaaccactcctcacagtaagggcaacacgggtcatagaacttatgcctat

SEQ ID NO: 42491 - DNA, 75 bp, Artificial Sequence
  Synthetic
atgaggaggacactgaattagcaacattcattttggacaggagagtcatcttaccacgagtcggtcacgagatct

SEQ ID NO: 42492 - DNA, 75 bp, Artificial Sequence
  Synthetic
agattacctctatctgtatatctagctatgattaaaatgtatacttctgctgaccggttttctagcaacagtcca

SEQ ID NO: 42493 - DNA, 75 bp, Artificial Sequence
  Synthetic
taaacaactccatcacaggagcaagagaagagatctcgggcttactggataccacaaaaggattgataagaattg

SEQ ID NO: 42494 - DNA, 75 bp, Artificial Sequence
  Synthetic
cattattactttatgggtattttttaatcaaccttttataatcaaatatattacaaaaaacttaggatccaagtg

SEQ ID NO: 42495 - DNA, 75 bp, Artificial Sequence
  Synthetic
gcatagcaaagggaggattaactcagagaacattatctcgaatttccaattatgattatgaacaatttttgaacc

SEQ ID NO: 42496 - DNA, 75 bp, Artificial Sequence
  Synthetic
gtccaaactttttttgatcaagagtcatattggctactttaggaggacactttaaacacaaattgttacaagagg

SEQ ID NO: 42497 - DNA, 75 bp, Artificial Sequence
  Synthetic
taatgaatatgttgaagaacaaagaacaaaacagtgtcatttccctgtcagcttgctctgttgactttgctatag

SEQ ID NO: 42498 - DNA, 75 bp, Artificial Sequence
  Synthetic
atattcatcagatggacaaactacaattgattgaagatggcctctctactatcaattttatacaggaaaataagg

SEQ ID NO: 42499 - DNA, 75 bp, Artificial Sequence
  Synthetic
ctttaagaagcaggatgtggaggaaattggcaaaaggaagattaatatatggtttagaagtccctgatccaatag

SEQ ID NO: 42500 - DNA, 75 bp, Artificial Sequence
  Synthetic
aaaaattacagcattcttacggaagatcctccatcagagagccacccacaagtgtcagggttgaagagtgggaga

SEQ ID NO: 42501 - DNA, 75 bp, Artificial Sequence
  Synthetic
aagcaatgattggctttctcattcttgggagtgaaaattgtctactctgtgattcaggaagcaaaaactatacct

SEQ ID NO: 42502 - DNA, 75 bp, Artificial Sequence
  Synthetic
aatttattcgaaagatcgcttctggacctgaacaagttcaagggggaggatctgagactgagatcacaggcgata

SEQ ID NO: 42503 - DNA, 75 bp, Artificial Sequence
  Synthetic
ggtttttcataccaaaggatgtacagttggataagattgataaagatcacgcatcaataagggtaccctatgtcg

SEQ ID NO: 42504 - DNA, 75 bp, Artificial Sequence
  Synthetic
atggagatagaggcaattttaccaatcctgatcagggaggcggagtcacaggacaattcgaagaaaggtatcaaa

SEQ ID NO: 42505 - DNA, 75 bp, Artificial Sequence
  Synthetic
gatcaactaccgaagaaagatcagagataaagttaggatccgtgaaaaatccaagcaaatccctgaaatctgcta

SEQ ID NO: 42506 - DNA, 75 bp, Artificial Sequence
  Synthetic
aatgggggtcacaagattcagaattacaactggacccaatggttgtacacgatttcttctatgacgagagaaggg

SEQ ID NO: 42507 - DNA, 75 bp, Artificial Sequence
  Synthetic
taagactcgcaactgtgtacacttgggcatttggcacaagtgatgctgaatggtgggaggcttggtacttgtcta

SEQ ID NO: 42508 - DNA, 75 bp, Artificial Sequence
  Synthetic
agaatcccgacaatggaaaatatgaccgcagctctaaaaaacgggataatatcagagaaggaacacgacaggata

SEQ ID NO: 42509 - DNA, 75 bp, Artificial Sequence
  Synthetic
atcaacgagcaaatatacccttagatgttctcaaaacgataacacctatatctacttcaacgaatattgctcata

SEQ ID NO: 42510 - DNA, 75 bp, Artificial Sequence
  Synthetic
agtacaataatcagtctactgatgaattactgtcctgcctacaaccatcttctaagaacgatgtcatcaagaatg

SEQ ID NO: 42511 - DNA, 75 bp, Artificial Sequence
  Synthetic
gattacgagaccgatcaacacaggttaaatacgccagtacatctcttaacagagtatcgcggcatgtaacaatta

SEQ ID NO: 42512 - DNA, 75 bp, Artificial Sequence
  Synthetic
aaagtacatcagtgtcaaatttgcatgttacaggaaataaactgaatcctgacgcaaaaccctttgaacccacct

SEQ ID NO: 42513 - DNA, 75 bp, Artificial Sequence
  Synthetic
gtaacgataacatgaattttgaatttgacggggttaaaatggataccaacttgatttatcaacaagtcatgctgt

SEQ ID NO: 42514 - DNA, 75 bp, Artificial Sequence
  Synthetic
cccagtcgaaagagcacccaaccaccacacagcacaacaaaaatgaccatcagaccgatgatgattataagaata

SEQ ID NO: 42515 - DNA, 75 bp, Artificial Sequence
  Synthetic
tagggctttcatgcttggagagtttattccgaaataggaaaatgacaaatagttacaatatcgtgtaccatttac

SEQ ID NO: 42516 - DNA, 75 bp, Artificial Sequence
  Synthetic
gaagatccagtgaaaacaatgtgatctctgatcatgccaccacaatggaagacaacaacaattttatcccggcga

SEQ ID NO: 42517 - DNA, 75 bp, Artificial Sequence
  Synthetic
acgttcaagaacattgttgtgtaaaggctctgaatgatttaccttatacaccgtcaacacatccagtgccaaatt

SEQ ID NO: 42518 - DNA, 75 bp, Artificial Sequence
  Synthetic
ccaaaagaaagaatgcattgagcgaacccatatacgtccaggtattgccctcaaacacagagggtttctcgggaa

SEQ ID NO: 42519 - DNA, 75 bp, Artificial Sequence
  Synthetic
atacagaagttagagataataggttaatttacgatcctcaacctatattagaatttgatgagctaagattagcaa

SEQ ID NO: 42520 - DNA, 75 bp, Artificial Sequence
  Synthetic
aagattatccactcctcaaggacaactctgtcaagaagcgtgcagagccagtcatcctagaaactgccaaccacc

SEQ ID NO: 42521 - DNA, 75 bp, Artificial Sequence
  Synthetic
ttcagcaaacaaagaaagtagatttggaattttcattgtgggatacaaaagaacttcatgagaatttagctcaaa

SEQ ID NO: 42522 - DNA, 75 bp, Artificial Sequence
  Synthetic
ctgcaggctctgccgaccaagacacaaatcagattgaagaaaacatgcagttcaaccttccaaaactgctcacag

SEQ ID NO: 42523 - DNA, 75 bp, Artificial Sequence
  Synthetic
gtttagcgattacagtaacggatattatgacaaaatctgataaagatcatattaaagaccaaagaagtatagatg

SEQ ID NO: 42524 - DNA, 75 bp, Artificial Sequence
  Synthetic
aagatacagacgatgaaccagaggataacaatgattccatgcctcttgaggaagacattagagagatcggttcca

SEQ ID NO: 42525 - DNA, 75 bp, Artificial Sequence
  Synthetic
ttgatgataatattaagacactaataactgagtttttattagtagaccctgaaatgtttgccgtaaatttaggat

SEQ ID NO: 42526 - DNA, 75 bp, Artificial Sequence
  Synthetic
tgctaaaagatggaaccaaagatatcaagacaaggatgaatgagatagatgacgcaatcaagaagataaataaga

SEQ ID NO: 42527 - DNA, 75 bp, Artificial Sequence
  Synthetic
tgcatatatcaataaaatggtcatttgatattcactttaaaagaccaagaggacgctatagcatgatagaatact

SEQ ID NO: 42528 - DNA, 75 bp, Artificial Sequence
  Synthetic
aatcaaaaaatagaagtctggatctagaatcagacggtaaagatcaggggagaagagatccatcagtagacctcg

SEQ ID NO: 42529 - DNA, 75 bp, Artificial Sequence
  Synthetic
tgactgatcttttggataatacttcttctcatgtttatcgaatccttactaatgtattatctcatcccagagtta

SEQ ID NO: 42530 - DNA, 75 bp, Artificial Sequence
  Synthetic
ggattaaaaaaagaaaggaagggctaaaggccgcaatgcaaaagacaaaagagcaattgtctataaaagtggaga

SEQ ID NO: 42531 - DNA, 75 bp, Artificial Sequence
  Synthetic
tgagaaaattcactaatgccgggctactagtaccgaaatacggtccctaccttacaagtcaagatttcaaaaaga

SEQ ID NO: 42532 - DNA, 75 bp, Artificial Sequence
  Synthetic
gagagattggattgaacgacaggatatgtcaaaattcgaagatgagtacagaaaagaaattgatatatgctggga

SEQ ID NO: 42533 - DNA, 75 bp, Artificial Sequence
  Synthetic
tggcggtagatttcataataacagcgtataccacatttttgaccaattggtgtaataataacaagttttcaattc

SEQ ID NO: 42534 - DNA, 75 bp, Artificial Sequence
  Synthetic
tggaaatggagtatggacaaacgagtactgggtcaggaggtccacaaggatcaaaggatgggacttctgatgatg

SEQ ID NO: 42535 - DNA, 75 bp, Artificial Sequence
  Synthetic
taatacctgaacaagaccctgatatacttgaattaagaaaagacatcactcatgcaaggcatttatgtatgatct

SEQ ID NO: 42536 - DNA, 75 bp, Artificial Sequence
  Synthetic
tccaggtagacgaagactacgatgaaggggaagactatgaggctatgccgtcagataggttttatacaacattat

SEQ ID NO: 42537 - DNA, 75 bp, Artificial Sequence
  Synthetic
cggatctttactgctactctttcaagcaaccttggataaaggagcttacaccacaagagaagatctgcgtcatgg

SEQ ID NO: 42538 - DNA, 75 bp, Artificial Sequence
  Synthetic
caggtgaacaaaaggatagatttgatctagatgctaaccaaatgtctcagtatgacctcgaggcccaggtggatg

SEQ ID NO: 42539 - DNA, 75 bp, Artificial Sequence
  Synthetic
aggacttcatagccaattgtgttgctaatgatcaaacaagtgcgggctggaacataacgcccttaagagtttaca

SEQ ID NO: 42540 - DNA, 75 bp, Artificial Sequence
  Synthetic
aattaaccagaatgaatctcatactctattctagattagaaactactaataagttgcttattgacatattagatc

SEQ ID NO: 42541 - DNA, 75 bp, Artificial Sequence
  Synthetic
atctccctgcatcgaccacatacatcaggagagggataataaaacaattaagaatccgtcaaagcaatgagccta

SEQ ID NO: 42542 - DNA, 75 bp, Artificial Sequence
  Synthetic
tagctaaagaaatgccaaagttagttagaaaagtggataatcttgagagacagatgggtaacttgaatatgttaa

SEQ ID NO: 42543 - DNA, 75 bp, Artificial Sequence
  Synthetic
ttgatctggaagatattaggattggtcagaaccccgattttgtgaataaacctattgagttttgtagcagtgaat

SEQ ID NO: 42544 - DNA, 75 bp, Artificial Sequence
  Synthetic
cctctacccttgagggtcacctatcttctgtaatgattatgatacccggtaaggataagagcgaaaaggaaatcc

SEQ ID NO: 42545 - DNA, 75 bp, Artificial Sequence
  Synthetic
tcggtatcacaatttataaccttgaagaaattcttcaatcaaatgtgcatctcagtgtaaatatgaacattgact

SEQ ID NO: 42546 - DNA, 75 bp, Artificial Sequence
  Synthetic
ctaaaaatccggacctgagaccaatactggggagaagcaacacgtcgttaactgatgttatcgacctagaccatt

SEQ ID NO: 42547 - DNA, 75 bp, Artificial Sequence
  Synthetic
cctcaacaagtaacaatactgaaaatcatttatttagaagggtaggcttgaactctacttcatcttataaagcac

SEQ ID NO: 42548 - DNA, 75 bp, Artificial Sequence
  Synthetic
accctgataaaggctccaaaggtatcaaaccaagtggatctggagacagacagtacatcggctctctagagagca

SEQ ID NO: 42549 - DNA, 75 bp, Artificial Sequence
  Synthetic
tatctttaacacctgttattaaaagatatcatcaacagaacactaataggctgtttataggagaaggatcagggt

SEQ ID NO: 42550 - DNA, 75 bp, Artificial Sequence
  Synthetic
aattttctataaatgatgagtacaattttgctccataccctatcagggacgaactcctattgccaggtttaagag

SEQ ID NO: 42551 - DNA, 75 bp, Artificial Sequence
  Synthetic
ctatgatgtatctttaccagaaaaccttgggggagacaatatgcttctttaattcgggagttcagtacaatgagg

SEQ ID NO: 42552 - DNA, 75 bp, Artificial Sequence
  Synthetic
atgacaaaaccaatgcttcatcgttcatcccagatgacacggacaggtctccaatggtgctcaaaataataattc

SEQ ID NO: 42553 - DNA, 75 bp, Artificial Sequence
  Synthetic
atctgggtcaaagggaacaatcattatacccgagtgaatacagtatctgtgaacaaggagtaaaaaaagaaaacc

SEQ ID NO: 42554 - DNA, 75 bp, Artificial Sequence
  Synthetic
gacagaacatccatgatgaagaagtgaaggatgagctactgtccatactagaacaacataacactgtggaggaat

SEQ ID NO: 42555 - DNA, 75 bp, Artificial Sequence
  Synthetic
ctctcaccgggcatgttataccactattcaatggaagaccagaaaccacatgggtaggcaatgatgattctttca

SEQ ID NO: 42556 - DNA, 75 bp, Artificial Sequence
  Synthetic
tgaatgaaatatggaatactgtgaatgattacctcgatggcaacatctgattaacagatattgagattgatccta

SEQ ID NO: 42557 - DNA, 75 bp, Artificial Sequence
  Synthetic
agtatatattggaacatactataaatagagacatcgggcttgttcactccgatatggaaacaggaatagggaagg

SEQ ID NO: 42558 - DNA, 75 bp, Artificial Sequence
  Synthetic
ttctaaacaagtaatctctgataatgatagtatggaataagaatactaatcacactattgtactcttgtagaatc

SEQ ID NO: 42559 - DNA, 75 bp, Artificial Sequence
  Synthetic
ataattatactatcttaaatgaacatgcacatcttatagcactgagccttacagtaatgattgatgatggaatct

SEQ ID NO: 42560 - DNA, 75 bp, Artificial Sequence
  Synthetic
ttaacgagtgtctaatgtcagattttagcaacacatactaataacttgtaatccatttctccttattccatttaa

SEQ ID NO: 42561 - DNA, 75 bp, Artificial Sequence
  Synthetic
tggtgtctaaggtagcttatgcccctgggttttgcatctcttcattattgaatatgtaccggacatttttttcat

SEQ ID NO: 42562 - DNA, 75 bp, Artificial Sequence
  Synthetic
tctcacattagaaaaaacttaggatcccagatttgcaaagtcaaaacgggatctactatcaggtgttggagctaa

SEQ ID NO: 42563 - DNA, 75 bp, Artificial Sequence
  Synthetic
tagttctatgtgcgtttccaccgtatagcaattttgaatcaactgaattttacctgatttgcttgcaaaaaagta

SEQ ID NO: 42564 - DNA, 75 bp, Artificial Sequence
  Synthetic
caatagcggagtctgcataacaaatagcgttcaaagaagtttgaaaaccatcatagaatatggatccgtcagatt

SEQ ID NO: 42565 - DNA, 75 bp, Artificial Sequence
  Synthetic
tacccggacctatcacaccagctagagccatccaacaaacgacgaagcaatctagagaagaggataatagtataa

SEQ ID NO: 42566 - DNA, 75 bp, Artificial Sequence
  Synthetic
tgaggaggattataatggaggatgataagagtctggtcaacaatgatgatagtacagaaactgattttctcgaga

SEQ ID NO: 42567 - DNA, 75 bp, Artificial Sequence
  Synthetic
ctaataatatcctcaaaatcaaaaatcttgttcagaaagaatttatcaaaacagtaaagaaaaaatacgaaatcc

SEQ ID NO: 42568 - DNA, 75 bp, Artificial Sequence
  Synthetic
aaacttggagagaagggagtaagattgacaagatcacaccagaggttgatgaaaacgggaatatggtccccaagt

SEQ ID NO: 42569 - DNA, 75 bp, Artificial Sequence
  Synthetic
atccttcgtttaactgtcctatcaacttcacaaaggatgataaatatttaatgagtgttgggtttcaagccaatg

SEQ ID NO: 42570 - DNA, 75 bp, Artificial Sequence
  Synthetic
acgttgtcttcaacccggggaaaaatgagaggaaaacatccggatatcaatatatgatttgttatggtttcattg

SEQ ID NO: 42571 - DNA, 75 bp, Artificial Sequence
  Synthetic
gtcctgatatgatacgtaaagagacgggctatgacataggtagcaatgtagagaatctccgagatgtcttaatca

SEQ ID NO: 42572 - DNA, 75 bp, Artificial Sequence
  Synthetic
aggatggacctatcaatggctcaccaagagtcaaaggtaatatcagaaccaccgcttcttttcctttgggtgttg

SEQ ID NO: 42573 - DNA, 75 bp, Artificial Sequence
  Synthetic
agttgtttgcagatgcagtcaccttctatgatgatgtcacaaataaaaagaactttttaaatccttatccagtct

SEQ ID NO: 42574 - DNA, 75 bp, Artificial Sequence
  Synthetic
gaaaaacttactcgtctccagaagagatcttacaagagctgacaacactcaagatcactgtcagaaggacagccg

SEQ ID NO: 42575 - DNA, 75 bp, Artificial Sequence
  Synthetic
acacaagaactcagtataaaattctgatggataaaatatgcaagaaagtcaccttatacaccttaatcatatcat

SEQ ID NO: 42576 - DNA, 75 bp, Artificial Sequence
  Synthetic
gatcaaatgagaagttggtgtatggaataacagggcctttaaatcacctttacccgtggtataaagttttgacag

SEQ ID NO: 42577 - DNA, 75 bp, Artificial Sequence
  Synthetic
gtaaaggatccaatcaatattgctgggaaattaaatcccaaataagaaagcattgtctcatacttgatttgaaaa

SEQ ID NO: 42578 - DNA, 75 bp, Artificial Sequence
  Synthetic
gtggctccatttttagtgcggtgaaggtctgtaggaatgtggatcaaatactattagacagaccccaaatactta

SEQ ID NO: 42579 - DNA, 75 bp, Artificial Sequence
  Synthetic
gtaaggtttttacaaaacttattccaaagggattaagagaaaggggtgactcaaaagggatgaagagcatatggt

SEQ ID NO: 42580 - DNA, 75 bp, Artificial Sequence
  Synthetic
gagtattctttctaagtataactaaattaacagataaaggtgtgtatatgatacccaaaagtgttctcgacttca

SEQ ID NO: 42581 - DNA, 75 bp, Artificial Sequence
  Synthetic
tcactaaactaaccagtcaagaggtgaaaagatggtggaagatgatatcttacatcgtgataataagcaatccat

SEQ ID NO: 42582 - DNA, 75 bp, Artificial Sequence
  Synthetic
gatcggataattcgatggccttcaatctgcttgtgtatctcaagatagacactgacatcaccaaagcaggcatca

SEQ ID NO: 42583 - DNA, 75 bp, Artificial Sequence
  Synthetic
aaccacatccaacttgtcagttaaacacttaaatcacaataaacttgtcatcagattaaagaaaacttataattc

SEQ ID NO: 42584 - DNA, 75 bp, Artificial Sequence
  Synthetic
cttgtcagttaaacacttaaatcacaataaacttgtcatcagattaaagaaaacttataattcccttttttaggt

SEQ ID NO: 42585 - DNA, 75 bp, Artificial Sequence
  Synthetic
gagggattgtcaacaaagaaggggagaggataacgtcattcatgttacacatcggtaactttacaagaagaggag

SEQ ID NO: 42586 - DNA, 75 bp, Artificial Sequence
  Synthetic
gaaaacattactcagtggagtattgcaaaaggaaaattgacaaaatgaagctcacattcgccttaggcactatag

SEQ ID NO: 42587 - DNA, 75 bp, Artificial Sequence
  Synthetic
gcggtctaagcttacatatcaggatcgatggaaggataagtaaaaggctccaagcacaagttggctttcagagaa

SEQ ID NO: 42588 - DNA, 75 bp, Artificial Sequence
  Synthetic
acatttgctactcactaatggacacaaacccatggttgaataaattaacgtggaacaatagttgtgaaatacaca

SEQ ID NO: 42589 - DNA, 75 bp, Artificial Sequence
  Synthetic
aagtcaccgctgtcattcagccatctgtgccaaaggacttcatgttgtatgaggacatcttaatagataatacag

SEQ ID NO: 42590 - DNA, 75 bp, Artificial Sequence
  Synthetic
gcaagatcttaaaataaagtaggagagtcagtcattacccagtatattgaatactaatgacaactttattaatcc

SEQ ID NO: 42591 - DNA, 75 bp, Artificial Sequence
  Synthetic
aattctatctccagttactagaatttctaaaacaattctactgctcagcaacgcatctcaaacattgtgatcttc

SEQ ID NO: 42592 - DNA, 75 bp, Artificial Sequence
  Synthetic
aattatgatcgacgcattgtaatctatatagcttttagttcatgaaatactaaaaagggcttaatcttgtaagtt

SEQ ID NO: 42593 - DNA, 75 bp, Artificial Sequence
  Synthetic
ctcagcaaatactccaatgcaaaagagcgcctcaacatctcaagcagcaccaaaataaaccacaatcaatgtgca

SEQ ID NO: 42594 - DNA, 75 bp, Artificial Sequence
  Synthetic
acaagagcaatcgtctaaagtgtgaaaaccaaaatcacagatcagaaagggcacatatttcagtcctgtaaaaat

SEQ ID NO: 42595 - DNA, 75 bp, Artificial Sequence
  Synthetic
accaagtgggattaataaaagaggatcaatccttatcattttaagaaaaacttaggatcccagagatcctaaaga

SEQ ID NO: 42596 - DNA, 75 bp, Artificial Sequence
  Synthetic
gccaattcctttatattttgatcttgaagggctagaagtcaggctgaaacacagaggtggaggaacacaggaact

SEQ ID NO: 42597 - DNA, 75 bp, Artificial Sequence
  Synthetic
aaaattgatgaaatcaaccttagctcaacatctaatcaatcaagcttaagtcatcctaatactgtatacaaccag

SEQ ID NO: 42598 - DNA, 75 bp, Artificial Sequence
  Synthetic
cagcgtagagagtggatttgatttcggcacccttgcgaagtgaaggctattactgcctgtcctttcaatcagaaa

SEQ ID NO: 42599 - DNA, 75 bp, Artificial Sequence
  Synthetic
attacatttacccataaagtaatctcaacatgtctaacaagaggacaacagtattgatcataataagctatacgt

SEQ ID NO: 42600 - DNA, 75 bp, Artificial Sequence
  Synthetic
tattttatttgaataatgcagcaattgtagggtttgattttgataaattgaataaaataggtgtggtgcaaggga

SEQ ID NO: 42601 - DNA, 75 bp, Artificial Sequence
  Synthetic
gagtcctaaattataaaattaaaggagatccaatgacaaaagaccttgtcttgaaatttatccctaacatagtga

SEQ ID NO: 42602 - DNA, 75 bp, Artificial Sequence
  Synthetic
atatcactgaatgtgtgagagagcccttgagtaggtacaatgagaccgtgaggagattgcttttacctatacaca

SEQ ID NO: 42603 - DNA, 75 bp, Artificial Sequence
  Synthetic
acatgcttgggttatacttgaataacacaaatgctaaaatgactgggttgatgatcgcgggtgtgatcatgggtg

SEQ ID NO: 42604 - DNA, 75 bp, Artificial Sequence
  Synthetic
ggatagcaataggtatagccacagcagctcagatcacagcaggttttgctctttatgaggcaaaaaagaacacag

SEQ ID NO: 42605 - DNA, 75 bp, Artificial Sequence
  Synthetic
aaaatattcagaaattaacagacagcatcatgaaaacacaggactcgattgataaacttactgacagtgtgggga

SEQ ID NO: 42606 - DNA, 75 bp, Artificial Sequence
  Synthetic
caagcatacttatattgaataagctacagacatacatcaacaatcaactggtaccaaatctagagcttctatcct

SEQ ID NO: 42607 - DNA, 75 bp, Artificial Sequence
  Synthetic
gccgacaaaacaaaattgagtttgatctaatgttaaccaagtatttggtggatcttatgactgttattggtccta

SEQ ID NO: 42608 - DNA, 75 bp, Artificial Sequence
  Synthetic
atatcaataatcctgttaataaagatatgactattcaatctttgtcacttctttttgatggcaattatgatataa

SEQ ID NO: 42609 - DNA, 75 bp, Artificial Sequence
  Synthetic
tgatgtcagaacttggttatacacctcaggatttcttagatttgatagagagtaagagtataacagggcaaataa

SEQ ID NO: 42610 - DNA, 75 bp, Artificial Sequence
  Synthetic
tttatgttgatatggaaaacttgtacgttgtgatcaggacatatctacctaccctaattgaagtacctgatgccc

SEQ ID NO: 42611 - DNA, 75 bp, Artificial Sequence
  Synthetic
aaatatatgagttcaacaaaataactatgagtagcaatggaggagaatacttgtcaaccatacctaatttcatat

SEQ ID NO: 42612 - DNA, 75 bp, Artificial Sequence
  Synthetic
taataagaggtaattatatgtctaatatagatgttgcaacatgttatatgaccaaagcaagcgtaatttgtaatc

SEQ ID NO: 42613 - DNA, 75 bp, Artificial Sequence
  Synthetic
aagattattcactcccgatgagccaaaacttaagaagctgttatcaaggtgagacagaatactgtcctgttgagg

SEQ ID NO: 42614 - DNA, 75 bp, Artificial Sequence
  Synthetic
cagtcatcgcgtcacactctccaagatttgctcttacaaatggagttattttcgccaattgtataaatacaattt

SEQ ID NO: 42615 - DNA, 75 bp, Artificial Sequence
  Synthetic
gtaggtgtcaagacaatggtaagactatcactcaaaacataaaccaattcgtaagcatgatcgacaacagtactt

SEQ ID NO: 42616 - DNA, 75 bp, Artificial Sequence
  Synthetic
gtaatgatgtcatggtagataagtttactatcaaggtaggaaaatatatggggagaaaagatatcaataatatta

SEQ ID NO: 42617 - DNA, 75 bp, Artificial Sequence
  Synthetic
atatccagataggaccgcagatcataattgataaggttgacttgtctaatgaaataaacaagatgaatcaatctt

SEQ ID NO: 42618 - DNA, 75 bp, Artificial Sequence
  Synthetic
taaaagatagtattttctacctgagagaagccaagagaattttagactcagtaaatatcagtcttatatctccaa

SEQ ID NO: 42619 - DNA, 75 bp, Artificial Sequence
  Synthetic
gcgttcaattgtttctaataataatatcagtcctctcatttattatattattgattatcatagtatacttgtact

SEQ ID NO: 42620 - DNA, 75 bp, Artificial Sequence
  Synthetic
gtaaatcaaaacattcatataaatataacaaatttatagatgatcctgattattacaatgattacaaaagagaac

SEQ ID NO: 42621 - DNA, 75 bp, Artificial Sequence
  Synthetic
gtattaatggcaaagccagtaagagtaacaatatatattatgtaggtgattaacaatcgataatctaaaggatta

SEQ ID NO: 42622 - DNA, 75 bp, Artificial Sequence
  Synthetic
cctcactatcactaccaaggtaacttccatgtaagatcggaccttccccgaagacattaaataaaacttaggatc

SEQ ID NO: 42623 - DNA, 75 bp, Artificial Sequence
  Synthetic
ccagagtatccctctaagtgatccttctagattggttactgatatatatacatatttatcctctttccgtcgttg

SEQ ID NO: 42624 - DNA, 75 bp, Artificial Sequence
  Synthetic
tttattgatcattaataatgctttctcagctccaaaaaaattacttagacaactcaaaccaacaaggtgataaaa

SEQ ID NO: 42625 - DNA, 75 bp, Artificial Sequence
  Synthetic
tgaacaacccagataagaaattaagtgtcaacttcaaccctttagaattagataaaggtcaaaaagatctcaata

SEQ ID NO: 42626 - DNA, 75 bp, Artificial Sequence
  Synthetic
agtcttattatgttaaaaacaagaattataacgtttcaaatctattaaatgaaagtctgcacgatatcaagtttt

SEQ ID NO: 42627 - DNA, 75 bp, Artificial Sequence
  Synthetic
gtatttattgtatattctcactgctaattatcattacaataatcaatataatcacaatatcaattgttataactc

SEQ ID NO: 42628 - DNA, 75 bp, Artificial Sequence
  Synthetic
gtctgaaagtacatgaagagaataatggcatggaatctcctaatttacaatctattcaagatagtctctcatctc

SEQ ID NO: 42629 - DNA, 75 bp, Artificial Sequence
  Synthetic
ttactaacatgatcaatacagagataactcctagaatagggattttagttacagccacttctgttactctctctt

SEQ ID NO: 42630 - DNA, 75 bp, Artificial Sequence
  Synthetic
catctatcaattatgtcgggactaagacaaatcaactggtcaatgaattaaaagattatataaccaaaagttgtg

SEQ ID NO: 42631 - DNA, 75 bp, Artificial Sequence
  Synthetic
gctttaaggtccctgaattaaagttacatgaatgcaacataagttgtgctgatccaaaaattagcaaatctgcaa

SEQ ID NO: 42632 - DNA, 75 bp, Artificial Sequence
  Synthetic
tgtacagcaccaatgcctatgccgagcttgctggtccacctaagatattttgtaaaagtgtatccaaagaccccg

SEQ ID NO: 42633 - DNA, 75 bp, Artificial Sequence
  Synthetic
actttagactgaagcagatagattatgtaataccagtgcagcaagatcggtctatttgtatgaacaaccctttat

SEQ ID NO: 42634 - DNA, 75 bp, Artificial Sequence
  Synthetic
tggatatttctgatgggttttttacctacatacattatgaaggaataaatagctgtaaaaaatcagattcattta

SEQ ID NO: 42635 - DNA, 75 bp, Artificial Sequence
  Synthetic
aagtgctgctgtcacatggtgaaatagttgacaggggtgattatcgaccatcattatatctattatcaagtcatt

SEQ ID NO: 42636 - DNA, 75 bp, Artificial Sequence
  Synthetic
accatccttattcaatgcaggtaataaactgtgtacctgtgacttgtaaccagtcatcctttgtattctgtcata

SEQ ID NO: 42637 - DNA, 75 bp, Artificial Sequence
  Synthetic
tctccaacaacactaaaacattggacaattcagattactcgtcagacgagtactacataacatatttcaatggca

SEQ ID NO: 42638 - DNA, 75 bp, Artificial Sequence
  Synthetic
tagatcgtcccaaaaccaagaagattcccattaacaatatgacagcagacaatcgttatatccattttacattct

SEQ ID NO: 42639 - DNA, 75 bp, Artificial Sequence
  Synthetic
caggtgggggaggtgtatgtttaggtgaagaatttattattcctgttaccacagtcatcaatactgatgtattca

SEQ ID NO: 42640 - DNA, 75 bp, Artificial Sequence
  Synthetic
cgcatgattattgtgagagtttcaactgttcagtccaaaccggtaaaagtctaaaggagatatgctctgagtcat

SEQ ID NO: 42641 - DNA, 75 bp, Artificial Sequence
  Synthetic
taagatctccaacgaactcatcgcgatacaatttaaacggaatcatgattataagtcaaaacaacatgacagatt

SEQ ID NO: 42642 - DNA, 75 bp, Artificial Sequence
  Synthetic
ttaagattcagttgaatggtataacttataacaaactgtcattcggaagtcctggaagactgagcaagacactgg

SEQ ID NO: 42643 - DNA, 75 bp, Artificial Sequence
  Synthetic
gccaggtcctttattaccaatcttcaatgagttgggatacttatctaaaggcaggatttgtcgagaaatggaaac

SEQ ID NO: 42644 - DNA, 75 bp, Artificial Sequence
  Synthetic
cctttaccccgaattggatgaacaatactgtgatatccagacctaaccaaggtaattgtccaaggtatcataaat

SEQ ID NO: 42645 - DNA, 75 bp, Artificial Sequence
  Synthetic
gccccgagatatgttatggagggacatacaatgatattgctcctttagatctaggaaaagacatgtatgttagcg

SEQ ID NO: 42646 - DNA, 75 bp, Artificial Sequence
  Synthetic
ttattctagattcagatcagcttgcagagaatccagagattacagtatttaactctactactatactttataagg

SEQ ID NO: 42647 - DNA, 75 bp, Artificial Sequence
  Synthetic
agagagtatccaaagatgaactaaacacaagaagtactacaacgagctgttttcttttcctagatgaaccttggt

SEQ ID NO: 42648 - DNA, 75 bp, Artificial Sequence
  Synthetic
gtatatcagtattagaaacaaacagatttaacggcaaatctattaggcccgagatttattcatacaaaattccta

SEQ ID NO: 42649 - DNA, 75 bp, Artificial Sequence
  Synthetic
agtattgttaatttgatgagcttattcctcatacttcaatcaaatttaatataactaatatcaaattgttgcact

SEQ ID NO: 42650 - DNA, 75 bp, Artificial Sequence
  Synthetic
cagctattattaaaactggatcatcagacaataaagatgtatacaaagatatatcgaagagggtattaaagaaaa

SEQ ID NO: 42651 - DNA, 75 bp, Artificial Sequence
  Synthetic
cttaggatcccagatccttcaataaggcagagccttgattgtatcagcgtcatttacaattgaatctcaattaac

SEQ ID NO: 42652 - DNA, 75 bp, Artificial Sequence
  Synthetic
aacactgattaataacttaagcagaatactcctattacagtgtttaattgacttaattttaattgaggattttat

SEQ ID NO: 42653 - DNA, 75 bp, Artificial Sequence
  Synthetic
aatcctataattggagcagatctaaactctcaccgattcagttctaatcctttattaactaaagaacaaattcta

SEQ ID NO: 42654 - DNA, 75 bp, Artificial Sequence
  Synthetic
aataattggatgacgtcacaggagacaagctggaaacaatttagttagaaggaagaaaccttttaccagatatgg

SEQ ID NO: 42655 - DNA, 75 bp, Artificial Sequence
  Synthetic
aaagtgactttgatatatctgttagcgacgtactgtacccagaatgtcatttggacagtcctatagtcggcggta

SEQ ID NO: 42656 - DNA, 75 bp, Artificial Sequence
  Synthetic
agctcattacttctcttgagtatgcgaatttgactcataaccaacctcatgaagatcagacattgctgactaata

SEQ ID NO: 42657 - DNA, 75 bp, Artificial Sequence
  Synthetic
taaatgtcaataaaaagaagaagataaaaagtcctctaatatcccaacaatctttatttggaaatgaggttaata

SEQ ID NO: 42658 - DNA, 75 bp, Artificial Sequence
  Synthetic
aggagattttcgatcttaaaaattattaccatgtcccctatccagaatgtaacagagatttattcttaatctctg

SEQ ID NO: 42659 - DNA, 75 bp, Artificial Sequence
  Synthetic
atgacaaaatagcattcaaactcagtaaaatcatggataattctaataaactgtttgatggtttagagaggaaac

SEQ ID NO: 42660 - DNA, 75 bp, Artificial Sequence
  Synthetic
tgagtcgcttaatttcgaatgtagataatcaactattaaatgcaacctctcttcataataattctgagatggatc

SEQ ID NO: 42661 - DNA, 75 bp, Artificial Sequence
  Synthetic
ggaagggaaaagaacatccttgcttcccagaaaagagcacaattgatgatgtaagacagcagagacagacacgag

SEQ ID NO: 42662 - DNA, 75 bp, Artificial Sequence
  Synthetic
attttccaaagaattcaactagagagggaagatctccaaaacaccctgatgccggtcctacacctgaaaacagtg

SEQ ID NO: 42663 - DNA, 75 bp, Artificial Sequence
  Synthetic
ccaaaaacgatttgcatagagacaacacagacaatatgccaacaggccatagttcgacatctatgaaaaaaccta

SEQ ID NO: 42664 - DNA, 75 bp, Artificial Sequence
  Synthetic
aaatatctggagaagaatatcttagtatgtggctagactcagaggatttgggttctaaacgaatttctgcacaat

SEQ ID NO: 42665 - DNA, 75 bp, Artificial Sequence
  Synthetic
tagggaaggatgtatcatgtaaaggccatctgcacacgacagaagacaaaccgataatagttcctgacactcgat

SEQ ID NO: 42666 - DNA, 75 bp, Artificial Sequence
  Synthetic
atatccaaaatcatgaatctaataacgatattttccccaaaaaagagaaaaaattctgcaaacttccaccgtcat

SEQ ID NO: 42667 - DNA, 75 bp, Artificial Sequence
  Synthetic
cggataatttaaccaaaatcatggtgaattcaaaatggtacaatcctttccttttttggtttactgtcaagactg

SEQ ID NO: 42668 - DNA, 75 bp, Artificial Sequence
  Synthetic
aacttagagcctgccagaaggagaactacaaaaggaaaaacagaaaattgggaattatcacatcgattaaaggtt

SEQ ID NO: 42669 - DNA, 75 bp, Artificial Sequence
  Synthetic
catgctataagttgatactcaaccagaatctagtagcaatattcgaggaagacagcagtggatactcagatcata

SEQ ID NO: 42670 - DNA, 75 bp, Artificial Sequence
  Synthetic
aaaaaagaaaaaaacgatgctactatctaactcccgaaatggtccttatgttctccgatgtaactgaaggaagat

SEQ ID NO: 42671 - DNA, 75 bp, Artificial Sequence
  Synthetic
tgatgattgatgttgcaatgagatttgacaaaaagtacaaaactctagagaaaaaggctttgaaattatggtttc

SEQ ID NO: 42672 - DNA, 75 bp, Artificial Sequence
  Synthetic
ttatagacgagttatttccttctatgggaaatagagtgtataatattatatccatgcttgagcctttgactctcg

SEQ ID NO: 42673 - DNA, 75 bp, Artificial Sequence
  Synthetic
cgatattacaggttaaggatgagtcaaggttgttgagaggtgcattcatgcatcattgtttaggtgacctcttcg

SEQ ID NO: 42674 - DNA, 75 bp, Artificial Sequence
  Synthetic
aagaacttcgagagtccaagaactacccggaagatgagatcaagagatttgccaacgacctaataaatgtcatga

SEQ ID NO: 42675 - DNA, 75 bp, Artificial Sequence
  Synthetic
cctgtcgggacattcatttagtagcagaattcttctcattctttaggactttcggacatccaatattgaacgctc

SEQ ID NO: 42676 - DNA, 75 bp, Artificial Sequence
  Synthetic
aaactgcagccaggaaagttagagagtacatgttagcagataaaatccttgagtacgaacctatcatgaaaggtc

SEQ ID NO: 42677 - DNA, 75 bp, Artificial Sequence
  Synthetic
atgcgattttctgtgctataatcataaatggatttagagatagacatggaggagtttggcctcctcttgatcttc

SEQ ID NO: 42678 - DNA, 75 bp, Artificial Sequence
  Synthetic
caaaacattgttcaaagaacataatatctctcaaaaatacaggtgaaggggtaacttatgaagtagcaataaaca

SEQ ID NO: 42679 - DNA, 75 bp, Artificial Sequence
  Synthetic
attggagatcatttgtcgggttaaagttcaaatgttttatgggtctcaatttagacaatgatctcagcatgtaca

SEQ ID NO: 42680 - DNA, 75 bp, Artificial Sequence
  Synthetic
tgaaagataaagcattatcacctttaagggatctttgggattcaatctattcacgtgaagtaatgtcctaccaac

SEQ ID NO: 42681 - DNA, 75 bp, Artificial Sequence
  Synthetic
cacctagaaacaaaaaatcaagaagattggttgaggttttcgttgatgatcaggactttgatcccgttgatatga

SEQ ID NO: 42682 - DNA, 75 bp, Artificial Sequence
  Synthetic
taaattatgttctgaccggagaatatctcagagatgatgatttcaatgcttcttatagtttaaaagagaaagaga

SEQ ID NO: 42683 - DNA, 75 bp, Artificial Sequence
  Synthetic
ccaaacaagttggcaggttgtttgctaagatgacttataaaatgagggcctgtcaagttattgctgagaatttaa

SEQ ID NO: 42684 - DNA, 75 bp, Artificial Sequence
  Synthetic
ttgcacatgggattgggagatatttccatgaaaacgggatggttaaggatgagcatgagctcagcaaatcactgt

SEQ ID NO: 42685 - DNA, 75 bp, Artificial Sequence
  Synthetic
acttcggcttagctacaccacagttttggttacgcttatattttcaaagcttaagttgtttttaatttttgccga

SEQ ID NO: 42686 - DNA, 75 bp, Artificial Sequence
  Synthetic
ttggttacgcttatattttcaaagcttaagttgtttttaatttttgccgagagaccgtgaggttgaacccggcaa

SEQ ID NO: 42687 - DNA, 75 bp, Artificial Sequence
  Synthetic
aggggggtacttttactatgtgcgggctgatctggggtgtggaattgacaccacgagaaaaaccatctcgtgcgg

SEQ ID NO: 42688 - DNA, 75 bp, Artificial Sequence
  Synthetic
ggaatgaagaggaaggatttggaggcgcgaggaaaagcgccagggagggatttttccaccccgttctggggaaga

SEQ ID NO: 42689 - DNA, 75 bp, Artificial Sequence
  Synthetic
ttgggcgttggcatttccaatgatcatgctgtggaactcgaagattactcgttcactgacttgtacataaaggat

SEQ ID NO: 42690 - DNA, 75 bp, Artificial Sequence
  Synthetic
gaaggtaggagaaaggacaaggaaaagggaggggagtctccctcaaatcggcaagtgaccctgaatacacccatc

SEQ ID NO: 42691 - DNA, 75 bp, Artificial Sequence
  Synthetic
agggaggggagtctccctcaaatcggcaagtgaccctgaatacacccatccagagtgggcgtagggcagggaaaa

SEQ ID NO: 42692 - DNA, 75 bp, Artificial Sequence
  Synthetic
gacagcgtgttggcctgctaggaaggctgggagttggatggggatccttcttacaggaggacatcgtccaagccc

SEQ ID NO: 42693 - DNA, 75 bp, Artificial Sequence
  Synthetic
ttctctgctgttgggtcgatgggttctgaacgggtgtatgtaaatgacacattggcgcgtacattcaagttctcc

SEQ ID NO: 42694 - DNA, 75 bp, Artificial Sequence
  Synthetic
gctgggagttggatggggatccttcttacaggaggacatcgtccaagccctcattcacatggcattggtgcttca

SEQ ID NO: 42695 - DNA, 75 bp, Artificial Sequence
  Synthetic
tcattcacatggcattggtgcttcatgccctgttttcctccatcgaccggcgaattcgctcattatctcgacgtg

SEQ ID NO: 42696 - DNA, 75 bp, Artificial Sequence
  Synthetic
ctgaacgggtgtatgtaaatgacacattggcgcgtacattcaagttctccgaaacagcaaagagaaccatttccg

SEQ ID NO: 42697 - DNA, 75 bp, Artificial Sequence
  Synthetic
cgaattcgctcattatctcgacgtgttaccgctcttgaatctcgacgaaccacaggagatcctatgacgctagct

SEQ ID NO: 42698 - DNA, 75 bp, Artificial Sequence
  Synthetic
cgcgctgagggtgatctggggcttctaccgacaatgtatggaagctaccccgaaaaagaggctgataaggtcatc

SEQ ID NO: 42699 - DNA, 75 bp, Artificial Sequence
  Synthetic
gcaagtttctaccgctaagggcacggaaatttttgaaggaaagacgaaccggacagactacttgcatctggtcaa

SEQ ID NO: 42700 - DNA, 75 bp, Artificial Sequence
  Synthetic
gttacccgctgatggttgctggagtggcattcttgtcacaaagaagtgcccaaaagtgactgacttggcaaagga

SEQ ID NO: 42701 - DNA, 75 bp, Artificial Sequence
  Synthetic
ttccggcgaggcctgtatggttcaaacgttcaggttgaggtctcaaagaactcatcgactgagtgtcccacgtac

SEQ ID NO: 42702 - DNA, 75 bp, Artificial Sequence
  Synthetic
caaaagtgactgacttggcaaaggacctcgagtcaacagattgcggatcaacgtggactgagttcacattgcggt

SEQ ID NO: 42703 - DNA, 75 bp, Artificial Sequence
  Synthetic
ctggcgggcgttgccgtaaagaatggccgaactgtcatcactgacggcatgttttggatggaaagcatagtgttg

SEQ ID NO: 42704 - DNA, 75 bp, Artificial Sequence
  Synthetic
atcggagatgtgccgtgaagaaacgtgaaaagcgatcacgtgaacccccgaaagcggatctgctagctgaaatgg

SEQ ID NO: 42705 - DNA, 75 bp, Artificial Sequence
  Synthetic
gttttggatggaaagcatagtgttggatggagtcgcccagatcacatcactcgagatgcgtcaatcacaccgctg

SEQ ID NO: 42706 - DNA, 75 bp, Artificial Sequence
  Synthetic
agatcatcgcgttcaagaccattcgcgaaaataagacgattttcatcgtggccctactgtgtgtggcaatcgcga

SEQ ID NO: 42707 - DNA, 75 bp, Artificial Sequence
  Synthetic
gacacgctcagtgacccttcagaccaagctctattcattccacctgcttgggggggaccaatttcgcgagtgaat

SEQ ID NO: 42708 - DNA, 75 bp, Artificial Sequence
  Synthetic
agcgttggcccacctgggttgtgattcttctggctattggcacttggaccacagtaaagggggagtttgttgaac

SEQ ID NO: 42709 - DNA, 75 bp, Artificial Sequence
  Synthetic
cgttatacacgctgaaagcggaacagatgaccatgctacagaccattgtgagaccggaggaagggtacgtcgtgg

SEQ ID NO: 42710 - DNA, 75 bp, Artificial Sequence
  Synthetic
cctggcacaaaggtcaaagtggactctcgatgccatgggcgaatgcacgcccaggtaattggaccgaatgacacg

SEQ ID NO: 42711 - DNA, 75 bp, Artificial Sequence
  Synthetic
agaccggaggaagggtacgtcgtggccacgccaaacggtcttctcgagtttaaaacaggaccggcggagatctat

SEQ ID NO: 42712 - DNA, 75 bp, Artificial Sequence
  Synthetic
ctcgatgccatgggcgaatgcacgcccaggtaattggaccgaatgacacggaatcttggtgttgccagtcatgca

SEQ ID NO: 42713 - DNA, 75 bp, Artificial Sequence
  Synthetic
ggggggcaatggctgcgcgagttactcgcagactgccacgtcaacgcatcctattcgactgacgtgtgtcccggt

SEQ ID NO: 42714 - DNA, 75 bp, Artificial Sequence
  Synthetic
caagaatagtccactttcgagtcggtgacctcctatattaccccatggagatccaacttggaaccatgtctgaag

SEQ ID NO: 42715 - DNA, 75 bp, Artificial Sequence
  Synthetic
tcgcagactgccacgtcaacgcatcctattcgactgacgtgtgtcccggtggatcgcagctcaacatggctgaca

SEQ ID NO: 42716 - DNA, 75 bp, Artificial Sequence
  Synthetic
tgacctcctatattaccccatggagatccaacttggaaccatgtctgaagcgtcagagccaaattctaaaatatt

SEQ ID NO: 42717 - DNA, 75 bp, Artificial Sequence
  Synthetic
tcatggccaaggaacgagtatgctcgacccagccatacaaccgcggttggggcactgggtgcttcaagtggggga

SEQ ID NO: 42718 - DNA, 75 bp, Artificial Sequence
  Synthetic
tgaggaaccgatcggcgaggaaccagaaccaacagttgacgacatattgaagagatacgggaaggcgaacgcgca

SEQ ID NO: 42719 - DNA, 75 bp, Artificial Sequence
  Synthetic
atcggatttccggagggtgagccaacgtgcaggagtttggttcgatcgctccctcctaaatctcctgtgcctcgc

SEQ ID NO: 42720 - DNA, 75 bp, Artificial Sequence
  Synthetic
gtttcttccatcgctaggtcagccattgtcatgaacgttacggctagcttccactctgttagcgacacacaacag

SEQ ID NO: 42721 - DNA, 75 bp, Artificial Sequence
  Synthetic
tatctcattgcagcttatcggggcaaaaactagaacatcgacactaactcgcctatttctgacgattctcgcaat

SEQ ID NO: 42722 - DNA, 75 bp, Artificial Sequence
  Synthetic
atggttggcgacataccgcttacatttaggtttgcgaaactcggaaacgcggcgatgacctgcaggttggagtct

SEQ ID NO: 42723 - DNA, 75 bp, Artificial Sequence
  Synthetic
ggcgctctttggactccccaacttgttttcatctgtggggctatctgcgtgggtgttgctggtggcgtcctcatc

SEQ ID NO: 42724 - DNA, 75 bp, Artificial Sequence
  Synthetic
ggcgatgacctgcaggttggagtctgagcagttgctgcttgattactatcacgttacgggaagctctcacgaggg

SEQ ID NO: 42725 - DNA, 75 bp, Artificial Sequence
  Synthetic
ggcgcaaccgcaagacctatcaatgaatctctggattgttcttcagactgggagctcagcagtcctgctgctggg

SEQ ID NO: 42726 - DNA, 75 bp, Artificial Sequence
  Synthetic
gctgtttttgcggtcgcaaattgacagttggcctggtgtgcactctaccgctagtggtcggcatggcatggagaa

SEQ ID NO: 42727 - DNA, 75 bp, Artificial Sequence
  Synthetic
gtatatgattaggaggaagcttgcaatggtgctaggggtccaccacctggtgaccctgatgtgcgtgcagttctt

SEQ ID NO: 42728 - DNA, 75 bp, Artificial Sequence
  Synthetic
agttgttgtgtggggagatgctaggtccaatgagatattggtaaaaaacgtaattgaaccttcgttgtcctggga

SEQ ID NO: 42729 - DNA, 75 bp, Artificial Sequence
  Synthetic
attctccgccgttgatcgatatcaaaaatatctctacggcctcctggagctcatggcttcggtggtcctgctgag

SEQ ID NO: 42730 - DNA, 75 bp, Artificial Sequence
  Synthetic
agacgcgatcgccacccatgatggattccgtgatatctcttttgtttgtcagattatgctcgacaaactagtcag

SEQ ID NO: 42731 - DNA, 75 bp, Artificial Sequence
  Synthetic
cgcctacaagagcgtcctgcaggctctccccccagaggtcctatgcttcagcttggtaatggggtggaagacggc

SEQ ID NO: 42732 - DNA, 75 bp, Artificial Sequence
  Synthetic
tggagcttttcgagactgtccaggcccaaaaacatccacattttcccaagacggctttgggtatagtggagtggt

SEQ ID NO: 42733 - DNA, 75 bp, Artificial Sequence
  Synthetic
cctgtctctcgctaccgttgtgtttttgatcttcagtttgaacgccatgtacaagtacgcatgtcaatatcacaa

SEQ ID NO: 42734 - DNA, 75 bp, Artificial Sequence
  Synthetic
gataactaccctcaccgcttcttcaaatgagacctgttcgcttagcttaacgtgccacggctgtctgctgcaatc

SEQ ID NO: 42735 - DNA, 75 bp, Artificial Sequence
  Synthetic
cacaaaaatgatctttctcgcagggaagacaacttctcgggcatttgtcaagtgtgggaaccatacgagcacctt

SEQ ID NO: 42736 - DNA, 75 bp, Artificial Sequence
  Synthetic
gctcgttgggagcacttcagtttccattgagtgtgcccttaaccctatctcgcaaggatggcgcctggctcgaca

SEQ ID NO: 42737 - DNA, 75 bp, Artificial Sequence
  Synthetic
cgtggtggataggtatcgacggtttggcgtgtctggtgttgcgggagtgtggcaggatctggttggaaagttttc

SEQ ID NO: 42738 - DNA, 75 bp, Artificial Sequence
  Synthetic
agactcccgaaggagtgtcaaccgaaaatgatgacgggataaatattcctgacttaaaagggcgctatggagagg

SEQ ID NO: 42739 - DNA, 75 bp, Artificial Sequence
  Synthetic
ggcaggatctggttggaaagttttcggttggtgcctttttctccaacacaacccttctagtcattttcgtcctcg

SEQ ID NO: 42740 - DNA, 75 bp, Artificial Sequence
  Synthetic
atgggatcgtcgtgggggcggcctcatcgtctggttacctacctgagctcgtgtttgtgttcctcctaggctttg

SEQ ID NO: 42741 - DNA, 75 bp, Artificial Sequence
  Synthetic
ctgccttgattgacaaacgcatagcctttctgttggttttaggggggtacttttactatgtgcgggctgatctgg

SEQ ID NO: 42742 - DNA, 75 bp, Artificial Sequence
  Synthetic
ccgtgacgtccacttcatactttttgggggcactctacctgctcatcgcaaccagcactaacctccccgtggtca

SEQ ID NO: 42743 - DNA, 75 bp, Artificial Sequence
  Synthetic
aaccatctcgtgcggcagcggcgcttttgtgtggaaacacttgggcgttggcatttccaatgatcatgctgtgga

SEQ ID NO: 42744 - DNA, 75 bp, Artificial Sequence
  Synthetic
taatacggatgctgcgtatgaagctcactgctagcaaccgatctgatgatctcttgggactcggcggacctgttg

SEQ ID NO: 42745 - DNA, 75 bp, Artificial Sequence
  Synthetic
tttgtgtggaaacacttgggcgttggcatttccaatgatcatgctgtggaacttgaagattactcattcactgac

SEQ ID NO: 42746 - DNA, 75 bp, Artificial Sequence
  Synthetic
cactgctagcaaccgatctgatgatctcttgggactcggcggacctgttgaaactgacctccagaccagctttca

SEQ ID NO: 42747 - DNA, 75 bp, Artificial Sequence
  Synthetic
ttgtacataaaggatatgtttagctggaccacgaaaccctgcttgatttgtgaggatgctttgcagtgcgtagcc

SEQ ID NO: 42748 - DNA, 75 bp, Artificial Sequence
  Synthetic
ggaccacgaaaccctgcttgatttgtgaggatgctttgcagtgcgtagccctgcgcagagctgctttctctgctg

SEQ ID NO: 42749 - DNA, 75 bp, Artificial Sequence
  Synthetic
ctgcgcagagctgctttctctgctgttgggtcaatgggtcctgaacaggtgtatgtaaatgacacattggcacgt

SEQ ID NO: 42750 - DNA, 75 bp, Artificial Sequence
  Synthetic
ttgggtcaatgggtcctgaacaggtgtatgtaaatgacacattggcacgtacattcaagttctccgaaacaccaa

SEQ ID NO: 42751 - DNA, 75 bp, Artificial Sequence
  Synthetic
agagaaccatttccgtcaccattaacctaattcagtacaagttctcatcttatgttgcacatggacgcgctgagg

SEQ ID NO: 42752 - DNA, 75 bp, Artificial Sequence
  Synthetic
gacgtggtgtcgtatggtggaccttggcagttggacacccccaccaccacggaagacctcgtgctgatggcttgc

SEQ ID NO: 42753 - DNA, 75 bp, Artificial Sequence
  Synthetic
tatgttgcacatggacgcgctgagggtgatctggggcatctaccaacaatgtttggaagctatcccgaaaaagag

SEQ ID NO: 42754 - DNA, 75 bp, Artificial Sequence
  Synthetic
ggaagacctcgtgctgatggcttgcaaaccggataagaccattgagtaccataggtacaggccgggagtcatgag

SEQ ID NO: 42755 - DNA, 75 bp, Artificial Sequence
  Synthetic
gctgataaggttatccggattgtcgcatcgcggcccgatattcgccgactttgcggaaaagctgtctctttccaa

SEQ ID NO: 42756 - DNA, 75 bp, Artificial Sequence
  Synthetic
catcgcggcccgatattcgccgactttgcggaaaagctgtctctttccaattcaagtttacgggcttccggcgag

SEQ ID NO: 42757 - DNA, 75 bp, Artificial Sequence
  Synthetic
ttcaagtttacgggcttccggcgaggcttgtatggttcaaacgttcaggttgaggtctcaaagaactcatcgacc

SEQ ID NO: 42758 - DNA, 75 bp, Artificial Sequence
  Synthetic
cttctggctcaccgttcttcatcaatggcgagcccgtcgggttctatggttttgggttctatgtgaacggtattt

SEQ ID NO: 42759 - DNA, 75 bp, Artificial Sequence
  Synthetic
gagtgtcccacgtacctggcgggcgttgtcgtgaagaatggccgaactgtcatcactgacggcatgttttggttg

SEQ ID NO: 42760 - DNA, 75 bp, Artificial Sequence
  Synthetic
accgctcaacagtagcaggtggcaaaccaaccgatgtcacggagagcttgaactgtgattcgaccaggcggtttg

SEQ ID NO: 42761 - DNA, 75 bp, Artificial Sequence
  Synthetic
catcactgacggcatgttttggttggaaagcacagtgttggatggagttgcccagattacatcacttgagatgcg

SEQ ID NO: 42762 - DNA, 75 bp, Artificial Sequence
  Synthetic
aactgtgattcgaccaggcggtttgtgacatggcatccaggaaaaggaaagacgcgcaaggttattgtcgaagaa

SEQ ID NO: 42763 - DNA, 75 bp, Artificial Sequence
  Synthetic
tcaatcacaccgctgtgtgtggcccagggaatacaccccagacacgctcagtgacccttcagaccaagctttatt

SEQ ID NO: 42764 - DNA, 75 bp, Artificial Sequence
  Synthetic
agggaatacaccccagacacgctcagtgacccttcagaccaagctttatttattccacctgcttgggggggacca

SEQ ID NO: 42765 - DNA, 75 bp, Artificial Sequence
  Synthetic
atttcgcgagtgaaccacataatcgggtacaagacacaaactgactttccgtggaacgttagtgacatcactctc

SEQ ID NO: 42766 - DNA, 75 bp, Artificial Sequence
  Synthetic
ggtacaagacacaaactgactttccgtggaacgttagtgacatcactctcatagagggcccagcccctggcacaa

SEQ ID NO: 42767 - DNA, 75 bp, Artificial Sequence
  Synthetic
atagagggcccagcccctggcacaaaggtcaaggtggactctagatgtcatgggcgaatgcacgcacaggtaatt

SEQ ID NO: 42768 - DNA, 75 bp, Artificial Sequence
  Synthetic
tgggcgaatgcacgcacaggtaattggaccgaatgacacggaatcctggtgttgccaatcatgcacaagaatagt

SEQ ID NO: 42769 - DNA, 75 bp, Artificial Sequence
  Synthetic
gagtgccatttcatggatcctatgtccattgctgcgcgcggaatcctggaacatctccacggccaaggaacaaaa

SEQ ID NO: 42770 - DNA, 75 bp, Artificial Sequence
  Synthetic
ccactttcgagttggtgacctcctatattaccccatggagatccaacttggaaccatgtctgaagcgccagagcc

SEQ ID NO: 42771 - DNA, 75 bp, Artificial Sequence
  Synthetic
gaattatgcaataagtgaccaatccattagcttcccaacttggctgagtccagcgtggattggaaacgtccaaaa

SEQ ID NO: 42772 - DNA, 75 bp, Artificial Sequence
  Synthetic
gaattctaaaatatttgaggaaccgatcggcgaggaaccagaaccaacagttgacgacatattgaagagatacgg

SEQ ID NO: 42773 - DNA, 75 bp, Artificial Sequence
  Synthetic
atccgtgggggctaagaagaccattttattcgtcccatcgcacaaccaagctaacaccctggctagtgctattcc

SEQ ID NO: 42774 - DNA, 75 bp, Artificial Sequence
  Synthetic
gaaggcaaacgctcaatcggatttccggagggtgagcccacgtgcaggagttgggttcgaccgctccctcctaaa

SEQ ID NO: 42775 - DNA, 75 bp, Artificial Sequence
  Synthetic
tggatccgttccattgcatcgagcaaacttttcctctaactatgcacaagcaggtgatgcagccaccgccctggt

SEQ ID NO: 42776 - DNA, 75 bp, Artificial Sequence
  Synthetic
tctcctgtgcctcgctatttcattgcagcttatcggggcaaaaaccagaacatcgacactaacccgtctatttct

SEQ ID NO: 42777 - DNA, 75 bp, Artificial Sequence
  Synthetic
caggtgatgcagccaccgccctggtgatctccaccgacatctcagaaatgggggcgaatttgggcgtcgatctgg

SEQ ID NO: 42778 - DNA, 75 bp, Artificial Sequence
  Synthetic
gacgattctagcaatggcgctctttggactccccaatttgttttcatctgtggggctatctgcttgggtgttgct

SEQ ID NO: 42779 - DNA, 75 bp, Artificial Sequence
  Synthetic
agtggcgtcctcatcatcgcaaccgcaagatctattgatgaatctctggatcatactacagactgggagctcagc

SEQ ID NO: 42780 - DNA, 75 bp, Artificial Sequence
  Synthetic
agggaggacgggtagacgggaaccaggaacgtatgtgtatcctattgatagccaaacggaggaaaatccagtgtc

SEQ ID NO: 42781 - DNA, 75 bp, Artificial Sequence
  Synthetic
agtcctgctgttggggtacatgatcaggaagaaactctcaatagtgctaggggtccaccacttggtgactttgat

SEQ ID NO: 42782 - DNA, 75 bp, Artificial Sequence
  Synthetic
atgggtgtgttggcctgaagcccaaatgatcctggaccagctcggcatgacttttatgctagaggaagctgcata

SEQ ID NO: 42783 - DNA, 75 bp, Artificial Sequence
  Synthetic
gtgcattcagttcctgttctccgccgtcgatcgctatcagaaatatctctacggtctcctagaactcatggcttc

SEQ ID NO: 42784 - DNA, 75 bp, Artificial Sequence
  Synthetic
atgatcctggaccagctcggcatgacttttatgctagaggaagctgcatacagccagcctccggggagattcacc

SEQ ID NO: 42785 - DNA, 75 bp, Artificial Sequence
  Synthetic
ggtggtcctgctgagcgcctacaagagcgtcctgcaggctctccccccagaggttctatgtttcagcctgataat

SEQ ID NO: 42786 - DNA, 75 bp, Artificial Sequence
  Synthetic
cattcccatttggctggcgtggcactgggcagaagctggagaccgacggcactcagccctgtttcagggcgcagg

SEQ ID NO: 42787 - DNA, 75 bp, Artificial Sequence
  Synthetic
ggggtggaagacagccctgtctctcgctaccgttgtgtctctgatcttcagtttgaacgctatgtacaagtacgc

SEQ ID NO: 42788 - DNA, 75 bp, Artificial Sequence
  Synthetic
aaccggaaagatcatcgaaaaccgatttggcaaacaagagtatcgaccacaatacgttgatgaccgctttgagag

SEQ ID NO: 42789 - DNA, 75 bp, Artificial Sequence
  Synthetic
atgtcaatatcacaatccgaggaacggctacagagactctggcgcgaatttatggttttggactgtatccttggc

SEQ ID NO: 42790 - DNA, 75 bp, Artificial Sequence
  Synthetic
cattgagtgggagacgcgaaaggtgtccattgatttctacatgaactgccgcggggggcctaccctctatgagtt

SEQ ID NO: 42791 - DNA, 75 bp, Artificial Sequence
  Synthetic
gagcgctgggggaatctgggcggcggagaaagctcaccaaccaacggtggcagctgtcctagcctttacaatgat

SEQ ID NO: 42792 - DNA, 75 bp, Artificial Sequence
  Synthetic
ttttacagtggttgattggaccgatatatggaggagaacggcatctgctctctgggatttgagtgacgtgatgaa

SEQ ID NO: 42793 - DNA, 75 bp, Artificial Sequence
  Synthetic
agtgctctttctttacatggaacagacgaacgtcagtatggagcttgagttcatctcagctggagagactcccga

SEQ ID NO: 42794 - DNA, 75 bp, Artificial Sequence
  Synthetic
tcatctcagctggagagactcccgaaggagtgtcaaccgaaaatgatgacgggatgaatattcctgacttaaaag

SEQ ID NO: 42795 - DNA, 75 bp, Artificial Sequence
  Synthetic
tggagaagtgcgtgaccggtacacaactgagcgctcccttaccgtggtaatggcctttgtcttgggcgtttcaat

SEQ ID NO: 42796 - DNA, 75 bp, Artificial Sequence
  Synthetic
ggcgctatggggaggatgggatcgtcgtgggggcggcctcatcgtctggccacctacccgagctcgtgtttgtgt

SEQ ID NO: 42797 - DNA, 75 bp, Artificial Sequence
  Synthetic
tatgctctcctgtttcatcgctgtctgggcattgtgcttcctattctccttgtttaggccgaaaaaggcaactta

SEQ ID NO: 42798 - DNA, 75 bp, Artificial Sequence
  Synthetic
tcctcctaggttttgccgtgacgtccacttcatactttttgggggcgctctacctgctcatcgcaaccagcacta

SEQ ID NO: 42799 - DNA, 75 bp, Artificial Sequence
  Synthetic
tgaacaaatgccatctagtgacccacttagcggtggtgtcttggtgtcaacccctagcgtcctttattgtatggg

SEQ ID NO: 42800 - DNA, 75 bp, Artificial Sequence
  Synthetic
accttcccgtgaccataatacggatgctgcgtatgaagctcactgccaacaaccgatctgatgatctcttgggac

SEQ ID NO: 42801 - DNA, 75 bp, Artificial Sequence
  Synthetic
agtccccttggggttctgcgtcgtcataacactggctatgttcttggtgtacccagtattgtacaagtcaattgg

SEQ ID NO: 42802 - DNA, 75 bp, Artificial Sequence
  Synthetic
gctgcgtatgaagctcactgccaacaaccgatctgatgatctcttgggactcggcggacctattgaaactgatct

SEQ ID NO: 42803 - DNA, 75 bp, Artificial Sequence
  Synthetic
ccagaccagctttcaagacattcccaatggagtgtatcgcatcgttgttcgcagcttatttggcgaccggcaacg

SEQ ID NO: 42804 - DNA, 75 bp, Artificial Sequence
  Synthetic
ttggtaaagtgggtcatcttgggatcatgtctgatctgcggagtgctggcttgggaaatgcgaatgttcccgaac

SEQ ID NO: 42805 - DNA, 75 bp, Artificial Sequence
  Synthetic
aatggagtgtatcgcatcgttgttcgcagcttatttggcgaccggcaacgaggggctggcttctcgaaaaatggg

SEQ ID NO: 42806 - DNA, 75 bp, Artificial Sequence
  Synthetic
atacgtagcgacctcatggagctcgtgaaagctgttaaggagcccgaggaggtcgtgaattccgggccatctttc

SEQ ID NO: 42807 - DNA, 75 bp, Artificial Sequence
  Synthetic
gtgtttcacactctcatgcacgtcactcgaggtgaaccagttaaatggcgtgggcgagttgtcgttcctcactct

SEQ ID NO: 42808 - DNA, 75 bp, Artificial Sequence
  Synthetic
ccaagttgggaaatagcgcaaggaaagggagctacaatgttggactctctgcaggtattcttcttcataacagtg

SEQ ID NO: 42809 - DNA, 75 bp, Artificial Sequence
  Synthetic
tgggcgagttgtcgttcctcactctggtagtgccttgcgcgacgtggtgtcgtatggtggaccttggcagttgga

SEQ ID NO: 42810 - DNA, 75 bp, Artificial Sequence
  Synthetic
ttgtcaacaaaattcctgtattggttccaggagaactggactgcacgaatgtacgctatgaaacatccggagatg

SEQ ID NO: 42811 - DNA, 75 bp, Artificial Sequence
  Synthetic
cacccccactaccacggaagacctcgtgctgatggcttgcaaaccggacaagaccgttgagtaccatcggtacag

SEQ ID NO: 42812 - DNA, 75 bp, Artificial Sequence
  Synthetic
gccgggagtcatgagtattgacggtgaacctgtcatgttcattagtgatgatttcggaaaaggatcttctggctc

SEQ ID NO: 42813 - DNA, 75 bp, Artificial Sequence
  Synthetic
gttagctcgattggtggatttagatttgatgaaattcccttcagggctgtccttccctctggttttgccattgtc

SEQ ID NO: 42814 - DNA, 75 bp, Artificial Sequence
  Synthetic
atttcggaaaaggatcttctggctcaccgttcttcattaatggcgagcccgtcgggttctatggttttgggttct

SEQ ID NO: 42815 - DNA, 75 bp, Artificial Sequence
  Synthetic
ccttccctctggttttgccattgtcgcgattgctagcctcccaagcgtggtggtggggcttctggcagctggtgt

SEQ ID NO: 42816 - DNA, 75 bp, Artificial Sequence
  Synthetic
atgtgaacggcatttatcgctcaacagtagcaggtggtaaaccaaccgatgtcacggagaacttggactgtgatt

SEQ ID NO: 42817 - DNA, 75 bp, Artificial Sequence
  Synthetic
tcttgacagcattggacgctcgcgaccagaggcatgatcgtcccactgaaatcactagtagagtgccactcgaaa

SEQ ID NO: 42818 - DNA, 75 bp, Artificial Sequence
  Synthetic
gtcacggagaacttggactgtgattcgaccaggcggttcgtgacatggcatccgggaaaaggaaagacgcgcaag

SEQ ID NO: 42819 - DNA, 75 bp, Artificial Sequence
  Synthetic
ccagaggcatgatcgtcccactgaaatcactagtagagtgccactcgaaaacactcgatccatcatgtatgcctt

SEQ ID NO: 42820 - DNA, 75 bp, Artificial Sequence
  Synthetic
gttattgtcgaagaaactaagaagaactatgattccaaccaacggaccgtgatcttaacacccacccgggtagtc

SEQ ID NO: 42821 - DNA, 75 bp, Artificial Sequence
  Synthetic
atggctgaggtcgttgaggccttgaagaactcaggcatgaggagtgataagaacctgtcgtactgcaccaggaac

SEQ ID NO: 42822 - DNA, 75 bp, Artificial Sequence
  Synthetic
ctgataacggttgcatgtcacgcaacgttcacgaaatttgttcttagccatggcgccaagaaagtgcgggttgcc

SEQ ID NO: 42823 - DNA, 75 bp, Artificial Sequence
  Synthetic
tggcgccaagaaagtgcgggttgccatgatcatcatggatgagtgccatttcatggatcctatgtccattgctgc

SEQ ID NO: 42824 - DNA, 75 bp, Artificial Sequence
  Synthetic
atgatcatcatggatgagtgccatttcatggatcctatgtccattgctgcgcgcgggatcatggagcatctccac

SEQ ID NO: 42825 - DNA, 75 bp, Artificial Sequence
  Synthetic
ctggaaaagtcaacaacgatcggtctgggaatgaaatggaagatgactctgaatgctcttgacggagatgcattc

SEQ ID NO: 42826 - DNA, 75 bp, Artificial Sequence
  Synthetic
agccaaggaacaaaattgatttaccttagtgcaacaccacccggccacgcgcctgatacaggctcgaattatgca

SEQ ID NO: 42827 - DNA, 75 bp, Artificial Sequence
  Synthetic
tgggaatgaaatggaagatgactctgaatgctcttgacggagatgcattcacaagatacaaatcacgcggggtaa

SEQ ID NO: 42828 - DNA, 75 bp, Artificial Sequence
  Synthetic
ataagtgaccaatccattagcttcccaacctggttgagtccagcgtggataggaaacgttcaaaaatccgtgggg

SEQ ID NO: 42829 - DNA, 75 bp, Artificial Sequence
  Synthetic
gaaatcatctcaaagtacgaatggagaccgagtggtcgagtggtggatttgggatgtgggcgcggaggctggagc

SEQ ID NO: 42830 - DNA, 75 bp, Artificial Sequence
  Synthetic
gcgaagaagaccattttattcgtcccatcgcacaaccaagctaacaccctggctagtgctattcctggatccgtc

SEQ ID NO: 42831 - DNA, 75 bp, Artificial Sequence
  Synthetic
gaccgagtggtcgagtggtggatttgggatgtgggcgcggaggctggagccaacgagctgtgatggaggaaacgg

SEQ ID NO: 42832 - DNA, 75 bp, Artificial Sequence
  Synthetic
ccattgcatcgagcaaacttttccactaactatgcacaagcgggtgatgcagccaccgccctggtaatctccacc

SEQ ID NO: 42833 - DNA, 75 bp, Artificial Sequence
  Synthetic
aggtggggcggaaaaagagaatccgcagcgattcgtcacgaagggatataacctggctacgctaaaaactggagt

SEQ ID NO: 42834 - DNA, 75 bp, Artificial Sequence
  Synthetic
ctaactatgcacaagcgggtgatgcagccaccgccctggtaatctccaccgacatctcagaaatgggagcgaatt

SEQ ID NO: 42835 - DNA, 75 bp, Artificial Sequence
  Synthetic
cagcgattcgtcacgaagggatataacctggctacgctaaaaactggagtggatgtgcacagactcaccccattc

SEQ ID NO: 42836 - DNA, 75 bp, Artificial Sequence
  Synthetic
tgggcgtcgatctggttatagacactcgaagagctttgcgaccccttgtggattctgccacgcgtgtgaagctgg

SEQ ID NO: 42837 - DNA, 75 bp, Artificial Sequence
  Synthetic
ttgaaacgaacataaccacatcatccatgatccagaggagagggaggacgggaagacgggaaccaggaacgtatg

SEQ ID NO: 42838 - DNA, 75 bp, Artificial Sequence
  Synthetic
ggaagacgggaaccaggaacgtatgtgtatcctattgatagccaaacggaggaaaatccagtgtcttgggcgtgt

SEQ ID NO: 42839 - DNA, 75 bp, Artificial Sequence
  Synthetic
tggcctgaagcccaaatgatactggaccagctcggcatgacttttatgctagaggaagccgcatacagccaaccc

SEQ ID NO: 42840 - DNA, 75 bp, Artificial Sequence
  Synthetic
agtccctccaacatctgtacaatggcaggttggtgcgtctctcccacagtcgaaatagctcggttgagatgtact

SEQ ID NO: 42841 - DNA, 75 bp, Artificial Sequence
  Synthetic
ccggggagattcaccctagtgggagaggatagaatgcgattttcaaagcttatggaccgggatgacattcccatt

SEQ ID NO: 42842 - DNA, 75 bp, Artificial Sequence
  Synthetic
acatctccggggctaggtctaacgtggtgcgcaccacatacatgacgctggccgccttaatggcccgattctccc

SEQ ID NO: 42843 - DNA, 75 bp, Artificial Sequence
  Synthetic
tggttggcgtggcactgggcagaagctggggaccgacggcactcagccctgtttcagggcgaaggaaccggaaag

SEQ ID NO: 42844 - DNA, 75 bp, Artificial Sequence
  Synthetic
gacacttggacagcgttgtcctcccgagtcctgtgttgcccaaaggcacacgggctgacccggctgctagtgtgg

SEQ ID NO: 42845 - DNA, 75 bp, Artificial Sequence
  Synthetic
cgggctgacccggctgctagtgtggcatccatgaataccagtgacatgatggaccgtgttgaacgcctaatgaac

SEQ ID NO: 42846 - DNA, 75 bp, Artificial Sequence
  Synthetic
atcatcgagaaccgatttggcaaacaagagtatcgaccacaatacgttgatgaccgctttgagagcgttgagtgg

SEQ ID NO: 42847 - DNA, 75 bp, Artificial Sequence
  Synthetic
gagacgcgcaaggtgtccattgatttctacatgaactgccgcggggggcctagcctctatgagtttttcacattg

SEQ ID NO: 42848 - DNA, 75 bp, Artificial Sequence
  Synthetic
attgattggactgacatatggaggagaacgacatctgctctttgggatttgagtgacgtcatgaatggagaactg

SEQ ID NO: 42849 - DNA, 75 bp, Artificial Sequence
  Synthetic
cgtgaccggtccacaactgagcgctcccttaccgtgctaatggcttttgtcttgggcgtctcaattgtgctctcc

SEQ ID NO: 42850 - DNA, 75 bp, Artificial Sequence
  Synthetic
gtcatccccccccacccacagcatatacggcgggtcaacaggacgattacaaagcattttattcggctcttcaag

SEQ ID NO: 42851 - DNA, 75 bp, Artificial Sequence
  Synthetic
tgtttcatcgctgtctgggcattgtgtttcctattctccttgtttaggccgcgaaaggtaacttatgagcaaatg

SEQ ID NO: 42852 - DNA, 75 bp, Artificial Sequence
  Synthetic
aatcgcaacttacgaccgcgtattttatcaaaagaagaattcgtcgccaacgttcgaaatgacgcggctgtggga

SEQ ID NO: 42853 - DNA, 75 bp, Artificial Sequence
  Synthetic
ccatctagtgacccacttagcggtggtgtcttggtgtcaacccctagcctcctttattatatgggagtccccttg

SEQ ID NO: 42854 - DNA, 75 bp, Artificial Sequence
  Synthetic
tcgtggagcagggatgtgccatggcgggatgtgcaagaagccattcaggaccagtgcttctgggatctcgtcgga

SEQ ID NO: 42855 - DNA, 75 bp, Artificial Sequence
  Synthetic
ctatgttcttggtgtacccagtattgtacaagtcaattggaaatcgcagttacatggacagcgatttggtaaagt

SEQ ID NO: 42856 - DNA, 75 bp, Artificial Sequence
  Synthetic
gggtcatcttgggatcatgtctgatctgcggagtgctggcttgggagatgcgaatgttcccgaacatacgtggcg

SEQ ID NO: 42857 - DNA, 75 bp, Artificial Sequence
  Synthetic
acctcatggagctcgtgaaagctgtcaaggagcccgaggaggtcgtgaattccgggccattttttccaagttggg

SEQ ID NO: 42858 - DNA, 75 bp, Artificial Sequence
  Synthetic
aaatagcgcggggaaagggagctacaatgttggactctctgcaggtattcttcttcataacagtgttgtcaacaa

SEQ ID NO: 42859 - DNA, 75 bp, Artificial Sequence
  Synthetic
aggacattgccagcaggggaaaataccttatcgcggacgacattgctggatgggacacaaaaattagtgaggagg

SEQ ID NO: 42860 - DNA, 75 bp, Artificial Sequence
  Synthetic
aattcttgtactggttccaggagaactggactgcacgaatgtacgccatgaaacatccggagatggttagctcga

SEQ ID NO: 42861 - DNA, 75 bp, Artificial Sequence
  Synthetic
atctggaggatgaggaagctcttctaacagccctcacggaagacccctaccacagagcgttgatggcggctacca

SEQ ID NO: 42862 - DNA, 75 bp, Artificial Sequence
  Synthetic
ttggtggattcagatttgatgaaattccattcagggcagtccttccctctggttttgccattgtcgcgattgcta

SEQ ID NO: 42863 - DNA, 75 bp, Artificial Sequence
  Synthetic
tccattcagggcagtccttccctctggttttgccattgtcgcgattgctagcctctcaagtgtggtggtggggct

SEQ ID NO: 42864 - DNA, 75 bp, Artificial Sequence
  Synthetic
tctggcagctggtgtgttcatggccatcatgtactgtcagaacaagtggaatgccaccccaaagatcttgacagc

SEQ ID NO: 42865 - DNA, 75 bp, Artificial Sequence
  Synthetic
aaatacggcagcggcacggtgatggacgtcgttggccgtcgagaccaacgtgggtcagggcaagtagtcacatat

SEQ ID NO: 42866 - DNA, 75 bp, Artificial Sequence
  Synthetic
gcgttgaacaccataacaaatggtaaggtccaggtggcgagagttttagaaagtgaaggactactgcaagcggat

SEQ ID NO: 42867 - DNA, 75 bp, Artificial Sequence
  Synthetic
attggacgctcgcgaccagagacatgatcgtcccactgaaatcactagtagagtgccactcgaaaacactcggtc

SEQ ID NO: 42868 - DNA, 75 bp, Artificial Sequence
  Synthetic
catcatgtatgccttttgcttgatcttcagcctgttttgggctttctgcacacggtctcctggagattttctccg

SEQ ID NO: 42869 - DNA, 75 bp, Artificial Sequence
  Synthetic
aaaaacaccttgaagaagctctcggaaacatggtcattgctggagacgacgttgttgtgtcgacagacaatcgcg

SEQ ID NO: 42870 - DNA, 75 bp, Artificial Sequence
  Synthetic
agggtcattggtggtcggggctagcatgtggcaaattctccatccccggtcaaagatccatgatgtcatggattt

SEQ ID NO: 42871 - DNA, 75 bp, Artificial Sequence
  Synthetic
atttctcatcagctctcgaatatctcgagctgacgggaaagacccggaaaaacgtccctcagggagctccctcca

SEQ ID NO: 42872 - DNA, 75 bp, Artificial Sequence
  Synthetic
tggctccatggtgtctgccatagggttgctagaaatgaactaccttttttataggttcatgcacattgccgctag

SEQ ID NO: 42873 - DNA, 75 bp, Artificial Sequence
  Synthetic
ggatggagagcaactgggaaaaggtggagttttgttctcaccattaccatgaaatgtccctgaaagacggcagaa

SEQ ID NO: 42874 - DNA, 75 bp, Artificial Sequence
  Synthetic
ggagttttgttctcaccattaccatgaaatgtccctgaaagacggcagaatcatcatagcaccctgcagacatga

SEQ ID NO: 42875 - DNA, 75 bp, Artificial Sequence
  Synthetic
agccttgggcgcggtagctcccttcaaccagtttcgagctctggaaaagtcaacaacgatcggtctgggaatgaa

SEQ ID NO: 42876 - DNA, 75 bp, Artificial Sequence
  Synthetic
caacaacgatcggtctgggaatgaaatggaagatgactctgaatgctcttgatggagatgcattcacaaaataca

SEQ ID NO: 42877 - DNA, 75 bp, Artificial Sequence
  Synthetic
aatcacgcggggtaaatgagacggagcggggtgattatgtctctcgtggcggcctcaaattgaatgaaatcatct

SEQ ID NO: 42878 - DNA, 75 bp, Artificial Sequence
  Synthetic
ggcctatgcccagatgtgggcactgtattatttccaccggcgtgatttgcgcctaggtttcattgctatctcatc

SEQ ID NO: 42879 - DNA, 75 bp, Artificial Sequence
  Synthetic
ggctgtgccaaccaattggttcccactaggacgcacctcgtggtcagtccaccagtatcacgaatggatgaccac

SEQ ID NO: 42880 - DNA, 75 bp, Artificial Sequence
  Synthetic
caaagtacgaatggagaccgagtggtcgagtggtggatttgggatgtgggcgcggtggctggagccagcgagctg

SEQ ID NO: 42881 - DNA, 75 bp, Artificial Sequence
  Synthetic
tgatggaggaaacggtgtcctccgctctcgggttcacaataggtggggcggaaaaagagaatcctcagcgattcg

SEQ ID NO: 42882 - DNA, 75 bp, Artificial Sequence
  Synthetic
tgatgatatgcttcgggtttggaatgacgtgtgggtgcacaacaacccgtggatgctaaacaaggagtcgattga

SEQ ID NO: 42883 - DNA, 75 bp, Artificial Sequence
  Synthetic
gaaaaagagaatcctcagcgattcgtcacgaagggatataacctggctacgctaaaaactggagtggatgttcat

SEQ ID NO: 42884 - DNA, 75 bp, Artificial Sequence
  Synthetic
atcctgggatgacatcccttacctgcacaagaaacaggacataacctgcggaagcctgatcggggtcaaggagcg

SEQ ID NO: 42885 - DNA, 75 bp, Artificial Sequence
  Synthetic
aggctcaccccattccggtgtgacaccattatgtgtgacatcggagagagtgatcccagcccaatcaaggaaaag

SEQ ID NO: 42886 - DNA, 75 bp, Artificial Sequence
  Synthetic
ccattatgtgtgacatcggagagagtgatcccagcccaatcaaggaaaagaccagaactctcaaagtcttgcaat

SEQ ID NO: 42887 - DNA, 75 bp, Artificial Sequence
  Synthetic
gaagcctgatcggggtcaaggagcgcgcaacgtgggcacgggaaattgagaatagtgtcatcagcgtccggagga

SEQ ID NO: 42888 - DNA, 75 bp, Artificial Sequence
  Synthetic
tgttagaaaattggctcttggtgaacccgggagcccattttgtgtgcaagattctatcaccatattctcttgaag

SEQ ID NO: 42889 - DNA, 75 bp, Artificial Sequence
  Synthetic
gtcatgagtcgatatcgaagaggaaatgatgtcatttagacgtgatcgaatagagccgtgaggaaccagcatcct

SEQ ID NO: 42890 - DNA, 75 bp, Artificial Sequence
  Synthetic
attctatcaccatattctcttgaagtccttcggaaaatcgagtccctccaacatctgtacaatggcaggttggtg

SEQ ID NO: 42891 - DNA, 75 bp, Artificial Sequence
  Synthetic
tccttcggaaaatcgagtccctccaacatctgtacaatggcaggttggtgcgcctctcccacagtcgaaatagct

SEQ ID NO: 42892 - DNA, 75 bp, Artificial Sequence
  Synthetic
cggctgagatgtactacatctccggggctaggtctaacgtggtgcgcaccacatacatgacgctggccgccttaa

SEQ ID NO: 42893 - DNA, 75 bp, Artificial Sequence
  Synthetic
cagcgttgtcctcccgagtcctgtgttgcccaaaggcacacgggctgacccggctgctagtgtggcatccatgaa

SEQ ID NO: 42894 - DNA, 75 bp, Artificial Sequence
  Synthetic
ttgcccaaaggcacacgggctgacccggctgctagtgtggcatccatgaataccaacgacatgacggaccgtgtt

SEQ ID NO: 42895 - DNA, 75 bp, Artificial Sequence
  Synthetic
tgtaacagggagggcacttgtaacccccgtaggagggtgcccgcttccgtcctacaaaaaacctctgatcatagg

SEQ ID NO: 42896 - DNA, 75 bp, Artificial Sequence
  Synthetic
gaacgcttaatgaacgagaaccgtggaacatggtttgaagatcaacaacacccctacaagagtttcaagtatttt

SEQ ID NO: 42897 - DNA, 75 bp, Artificial Sequence
  Synthetic
atggtcttaagcatcccccccatggaatgggtaagagaagcctgtaaacaaaactggatggcaccagtgctctta

SEQ ID NO: 42898 - DNA, 75 bp, Artificial Sequence
  Synthetic
ggatcgtttgtcaccgatgatgtgaaggtaggagggcaagcggtgaaccccctcgttaggaagatcatgtggcca

SEQ ID NO: 42899 - DNA, 75 bp, Artificial Sequence
  Synthetic
tgggagactctcacgagtgtggtggggttttccatgactgacgtgtcaacctactcacagcagaaggtactgagg

SEQ ID NO: 42900 - DNA, 75 bp, Artificial Sequence
  Synthetic
agtatggggaaagaactcatcttaacctcccaccgttagggagttttgattatcttttctataccatagatgcgc

SEQ ID NO: 42901 - DNA, 75 bp, Artificial Sequence
  Synthetic
gagaaggtggacactgtcatccctccccacccacagcatatacggcgggtcaacaggacgattacaaagcatttt

SEQ ID NO: 42902 - DNA, 75 bp, Artificial Sequence
  Synthetic
atccggttcttcaagaatcgcaacttacgaccgcgtattttatcaaaagaagaattcatcgccaacgttcgaaat

SEQ ID NO: 42903 - DNA, 75 bp, Artificial Sequence
  Synthetic
gatgcggctgtaggatcgtggagcagggatgtgccatggcgagatgtgcaagaagccatacaggaccagtgcttc

SEQ ID NO: 42904 - DNA, 75 bp, Artificial Sequence
  Synthetic
tgggatctcatcggaaaggaacgggccctccatctgcaagggaagtgtgaaatgtgtatctacaacaccatgggc

SEQ ID NO: 42905 - DNA, 75 bp, Artificial Sequence
  Synthetic
aagaaggagaaaaagcccagcctagctggtgaggccaagggctcaaggaccatctggtacatgtggcttgggagc

SEQ ID NO: 42906 - DNA, 75 bp, Artificial Sequence
  Synthetic
catctggtacatgtggcttgggagccggttccttgaatttgaggctctaggctttcttaatgcggatcactgggt

SEQ ID NO: 42907 - DNA, 75 bp, Artificial Sequence
  Synthetic
gctttcttaatgcggatcactgggtcagtagggagcacttccctgggggagttggaggcgttggtgtcaattatt

SEQ ID NO: 42908 - DNA, 75 bp, Artificial Sequence
  Synthetic
cagtagggagcacttccctgggggagttggaggcgttggtgtcaattatttcgggtactacttgaaggacattgc

SEQ ID NO: 42909 - DNA, 75 bp, Artificial Sequence
  Synthetic
tcgggtactacttgaaggacattgccagcagaggaaaataccttttcgcggacgacattgctggatgggacacaa

SEQ ID NO: 42910 - DNA, 75 bp, Artificial Sequence
  Synthetic
aaattagcgcggaggatctggaggatgaggaagctctcctaacagccctcacggaagacccccaccacagagcgt

SEQ ID NO: 42911 - DNA, 75 bp, Artificial Sequence
  Synthetic
tgatggcggctaccatgcgactggcatatcagaacattgtggccatgttcccacgaacacactcaaaatacggca

SEQ ID NO: 42912 - DNA, 75 bp, Artificial Sequence
  Synthetic
caagtagtcacatatgcgctgaacaccataacaaatggtaaggttcaggtggcgagggttttagaaagtgaagga

SEQ ID NO: 42913 - DNA, 75 bp, Artificial Sequence
  Synthetic
ctactgcatgcggatgaatcggtgttggatgcgtggttggaaaaacaccttgaagaagctctcggaaacatggtc

SEQ ID NO: 42914 - DNA, 75 bp, Artificial Sequence
  Synthetic
tgaagaagctctcggaaacatggtcattgctggagacgatgttgttgtgtcgacagacaatcgcgatttttcatc

SEQ ID NO: 42915 - DNA, 75 bp, Artificial Sequence
  Synthetic
tgctctcgaatatctcgagctgacgggaaaaactcggaagaacgtcccacagggagctccctccaggatggagag

SEQ ID NO: 42916 - DNA, 75 bp, Artificial Sequence
  Synthetic
cgactgggaaaaggtggagttttgttctcaccattaccatgaaatgtgcctgaaagacggcagaatcctcatagc

SEQ ID NO: 42917 - DNA, 75 bp, Artificial Sequence
  Synthetic
accttgcagacatgagaacgaagtgcttggtcgtagccgattgcaaaagggaggggtagtcagcatctcggagag

SEQ ID NO: 42918 - DNA, 75 bp, Artificial Sequence
  Synthetic
cttggtcgtagccgattgcaaaagggaggggtagtcagcatctcggagagtgcttgcatggccaaggcctatgcc

SEQ ID NO: 42919 - DNA, 75 bp, Artificial Sequence
  Synthetic
tgcttgcatggccaaggcctatgcccagatgtgggcattgtattttttccacaggcgtgatttacgcctaggttt

SEQ ID NO: 42920 - DNA, 75 bp, Artificial Sequence
  Synthetic
cattgccatctcgtcggctgtgccaaccaattggttccctctaggacgtacctcgtggtcagtccaccagcatca

SEQ ID NO: 42921 - DNA, 75 bp, Artificial Sequence
  Synthetic
cgaatggatgaccactgatgacatgcttcgggtttggaatgacgtgtgggtgcacaacaacccgtggattctaaa

SEQ ID NO: 42922 - DNA, 75 bp, Artificial Sequence
  Synthetic
caaggagtcaattgaatcctgggatgacatcccctacctgcacaagaaacaggacataacctgcggaagcctgat

SEQ ID NO: 42923 - DNA, 75 bp, Artificial Sequence
  Synthetic
aggacataacctgcggaagcctgataggggtcaaggagcgcgcaacgtgggcacgagagattgaaaatagtgtca

SEQ ID NO: 42924 - DNA, 75 bp, Artificial Sequence
  Synthetic
tcagcgtccggaggataatcgacgcagaaactggggtcctgaacacctacaaggacgagctctcagttatgagtc

SEQ ID NO: 42925 - DNA, 75 bp, Artificial Sequence
  Synthetic
agaaactggggtcctgaacacctacaaggacgagctctcagttatgagtcgatatcgaagaggaaatgatgtcat

SEQ ID NO: 42926 - DNA, 75 bp, Artificial Sequence
  Synthetic
aaggacgagctctcagttatgagtcgatatcgaagaggaaatgatgtcatttagacgaaatcgaatagagccgtg

SEQ ID NO: 42927 - DNA, 75 bp, Artificial Sequence
  Synthetic
aggaaccagcatcctcccggccacaggagcagggcatgaaaatgtcgggcatgacgaacccgctcccccgagtcc

SEQ ID NO: 42928 - DNA, 75 bp, Artificial Sequence
  Synthetic
cctggcaacagggtgtgttcccttatggagcacgttcgagcagggcacattagtgtcgggcgtgacgcacccgct

SEQ ID NO: 42929 - DNA, 75 bp, Artificial Sequence
  Synthetic
cccctcagtcccctgtgcaacagggagggcacttgtaacccccgtaggagggtgcccgcttccgtcctacaaaaa

SEQ ID NO: 42930 - DNA, 75 bp, Artificial Sequence
  Synthetic
cctctgatcataggtacctgatctaagatggtggtggcggcccatcttatcatttagctagctgatggtcttaag

SEQ ID NO: 42931 - DNA, 75 bp, Artificial Sequence
  Synthetic
catttagctagctgatggtcttaagcatccctcccatggaatgggtaagagaagcctgcaaacaaaactggatgg

SEQ ID NO: 42932 - DNA, 75 bp, Artificial Sequence
  Synthetic
caccagtgctcttacaaaatggcagccaaagcgatccagagctttcaaaactggacggggcaacagggagaaatc

SEQ ID NO: 42933 - DNA, 75 bp, Artificial Sequence
  Synthetic
ccggggtagcgaacctcctccgttaatgtgaaaaagtatggggaaagaactcatcttaacctcccaccgttaggg

SEQ ID NO: 42934 - DNA, 75 bp, Artificial Sequence
  Synthetic
aaagtatggggaaagaactcatcttaacctcccaccgttagggagttttgattatcttttctataccatagatgc

SEQ ID NO: 42935 - DNA, 75 bp, Artificial Sequence
  Synthetic
gtttataaaaacttcggcttggctacaccacagttttggttacgcttatattttcagagcttaagttgtttttaa

SEQ ID NO: 42936 - DNA, 75 bp, Artificial Sequence
  Synthetic
ttttcagagcttaagttgtttttaatttttgccgagagaccgtgaggttgaacccggcaagaaatgaagaggaag

SEQ ID NO: 42937 - DNA, 75 bp, Artificial Sequence
  Synthetic
gatttagaggcgcgaggaaaagcgccagggagagattcttccaccccgttctggggaagagaaggtaggagaaag

SEQ ID NO: 42938 - DNA, 75 bp, Artificial Sequence
  Synthetic
gacaaggataagggaggggagtctccctcaaatcggcaggtgaccctgaaaacacccatccagagtgggcgtagg

SEQ ID NO: 42939 - DNA, 75 bp, Artificial Sequence
  Synthetic
cctcaaatcggcaggtgaccctgaaaacacccatccagagtgggcgtagggcaggaaaaagacaacgtgttggcc

SEQ ID NO: 42940 - DNA, 75 bp, Artificial Sequence
  Synthetic
tggtgcttcatgccttgtttgcctccatcgaccggcgaattcgctcattatcccgacgtgttaccgctcttgaat

SEQ ID NO: 42941 - DNA, 75 bp, Artificial Sequence
  Synthetic
catcgaccggcgaattcgctcattatcccgacgtgttaccgctcttgaatctcgccgaaccacaggaaatcccat

SEQ ID NO: 42942 - DNA, 75 bp, Artificial Sequence
  Synthetic
gacgctagctttcatcttgggctttctcacagtgttatgtggatgcgtggtgattgacatgcaagtttctaccac

SEQ ID NO: 42943 - DNA, 75 bp, Artificial Sequence
  Synthetic
tagaggcacggaaatttttgaaggggagacgaaccggacagactacttgcatctgctcaagttacccgctgatgg

SEQ ID NO: 42944 - DNA, 75 bp, Artificial Sequence
  Synthetic
tggcaaaggacctcgagtcgacagattgcggatcaacgtggactgagttcacattgcggtatcggagatgcgtcg

SEQ ID NO: 42945 - DNA, 75 bp, Artificial Sequence
  Synthetic
tgaagaaacgtgaaaagcgatcacgtgaacccccgaaagcggatttgctagctgaaatggagatcattgcgttca

SEQ ID NO: 42946 - DNA, 75 bp, Artificial Sequence
  Synthetic
agaccattcgcgaaaataagacaatcttcatcgtggccctattgtgtgtggctatcgcgaagcgttggcccacct

SEQ ID NO: 42947 - DNA, 75 bp, Artificial Sequence
  Synthetic
tacgtcgtggccacgccaaacggtctcctcgagtttaaaacaggaccggcggagatctacggggggcaatggctg

SEQ ID NO: 42948 - DNA, 75 bp, Artificial Sequence
  Synthetic
cgcgagttactcgcagattgccacgtcaacgcatcctattcgactgacgtgtgtcccggtggatcgcagctcaac

SEQ ID NO: 42949 - DNA, 75 bp, Artificial Sequence
  Synthetic
tcaacgcatcctattcgactgacgtgtgtcccggtggatcgcagctcaacatggcagatatcatggccaaggaac

SEQ ID NO: 42950 - DNA, 75 bp, Artificial Sequence
  Synthetic
aagtgggggattggattcgttggaacgtgcgtcgaactccattgcgacagaggattcaacgtttcttctatcgct

SEQ ID NO: 42951 - DNA, 75 bp, Artificial Sequence
  Synthetic
aggtcagctattgttatgaacgttacggctagcttccactccgttagtgacacacaacagatggttggcgacata

SEQ ID NO: 42952 - DNA, 75 bp, Artificial Sequence
  Synthetic
tcggaaacgcggcgatgacctgcaggttggagtctgagcagttgctgcttgattactatcatgttacgggaagct

SEQ ID NO: 42953 - DNA, 75 bp, Artificial Sequence
  Synthetic
cccatgaggggctgtttttgcggtctcaagttgacagttggcctggcgtgcactctactgctagtggtcggcacg

SEQ ID NO: 42954 - DNA, 75 bp, Artificial Sequence
  Synthetic
gcatggagaaagttgttgtgtggggagatgctaggtccaatgagattctagtaaaaaacgtaattgaaccttcgt

SEQ ID NO: 42955 - DNA, 75 bp, Artificial Sequence
  Synthetic
tgtcctgggaagacgcgatcgccactcatggtggattccgtgacatctcctttgtttgtcagattatgctcgaca

SEQ ID NO: 42956 - DNA, 75 bp, Artificial Sequence
  Synthetic
aactagtcagtggagcttttcgagattgtccaggcccaaaaatatccactttttcccaggacggcttcgggtata

SEQ ID NO: 42957 - DNA, 75 bp, Artificial Sequence
  Synthetic
gtggagtggtgataaccaccctcaccgcttcttctaatgagacctgttcgcttagcttaacgtgtcacggttgtc

SEQ ID NO: 42958 - DNA, 75 bp, Artificial Sequence
  Synthetic
tgctgcaatccacaaaaatgatctttctcgcagggaagaccacttctcgggcatttgtcaagtgcgggaaccata

SEQ ID NO: 42959 - DNA, 75 bp, Artificial Sequence
  Synthetic
caagcaccttgctcgttgggagcacttcagtttctattgagtgcgcccttaaccctatctcgcaaggatggcgcc

SEQ ID NO: 42960 - DNA, 75 bp, Artificial Sequence
  Synthetic
tagcccgacacgtggtggatcggtatcgacggtttggcgtgtctggtgttgcgggagtgtggcaggatctggtcg

SEQ ID NO: 42961 - DNA, 75 bp, Artificial Sequence
  Synthetic
gaaagttttcggttggtgccttcttctccaacacagcccttctggtcattctcgtcctcgctgccttgattgaca

SEQ ID NO: 42962 - DNA, 75 bp, Artificial Sequence
  Synthetic
accagacaaagctggctaggggtagaataacagataatgataaattatcatacttaggattaatgatcctatcaa

SEQ ID NO: 42963 - DNA, 75 bp, Artificial Sequence
  Synthetic
tagcgaggcagagagctaacattaccttagaggagttaaggatgattaccccaatatcgacatccaccaatttgg

SEQ ID NO: 42964 - DNA, 75 bp, Artificial Sequence
  Synthetic
ttggcacaggatttggataaaggttcacagtcatggcgacacttcttcggagtctagctctgttcaagaggaaca

SEQ ID NO: 42965 - DNA, 75 bp, Artificial Sequence
  Synthetic
ctcatcgattgagggatcgtaacactcaggtaaagtactcaggtacatcgttaatccgagtagcgaggtatacaa

SEQ ID NO: 42966 - DNA, 75 bp, Artificial Sequence
  Synthetic
aagatagaacacccctaattgcaggttcaggaggagccataagagggattaagcatgttatcgtagtcccagtac

SEQ ID NO: 42967 - DNA, 75 bp, Artificial Sequence
  Synthetic
caatatcgaatgataacttatcattcattatagcagataagaaggtggatacaaatttcatttatcagcaaggaa

SEQ ID NO: 42968 - DNA, 75 bp, Artificial Sequence
  Synthetic
ccggtgattcatcgattgtcactaggtcaagattattggacaggttagtaagacttgctggtgacccttatataa

SEQ ID NO: 42969 - DNA, 75 bp, Artificial Sequence
  Synthetic
tgttgttgggattgggaatcctagaaacatatttcaggttacagacaaatacggggtcctctaatacagtgttac

SEQ ID NO: 42970 - DNA, 75 bp, Artificial Sequence
  Synthetic
gtggacctaagctgacaggcgtcatgatcagtatactatcattgtttgttgaatcacccagtcaactaatacagc

SEQ ID NO: 42971 - DNA, 75 bp, Artificial Sequence
  Synthetic
atctacatgttgaagcagaatgctgtgtaatccctatgactgaccatcccagagtcccaagtcaccgtactgcac

SEQ ID NO: 42972 - DNA, 75 bp, Artificial Sequence
  Synthetic
gaatcactgacgacccagatgtcagcatcagattagttgaagtaatccaaagtgagaagtccctatcagggctca

SEQ ID NO: 42973 - DNA, 75 bp, Artificial Sequence
  Synthetic
ctagcgccaggaaaatgtgcaccaatccattgatctacgataattctccaatcattgagaaggatgcggtacgtc

SEQ ID NO: 42974 - DNA, 75 bp, Artificial Sequence
  Synthetic
cttttgcatccagaggcgctaatatggaggatgaggcggatgactatttctctattcaagcaggggaggaagggg

SEQ ID NO: 42975 - DNA, 75 bp, Artificial Sequence
  Synthetic
tatattcccagagccatagaaagcacctcgtggagtttgttacttggtcaacggggcagctgtatcacgtactag

SEQ ID NO: 42976 - DNA, 75 bp, Artificial Sequence
  Synthetic
acaccagaggaacccattggtttgagaacaaagagatagttgaaattgaggttcaagacccagaagaattcaaca

SEQ ID NO: 42977 - DNA, 75 bp, Artificial Sequence
  Synthetic
cgaaatcaactgctatgtcaatgatcgaattggttaccaaatttgagaaagatcatctgaacgaaatagctgctt

SEQ ID NO: 42978 - DNA, 75 bp, Artificial Sequence
  Synthetic
tactattggcatctattcttgcacaaatttggatcctattagccaaggcagtcactgctccagatactgcagctg

SEQ ID NO: 42979 - DNA, 75 bp, Artificial Sequence
  Synthetic
taataggagacgatgatatcaatagtttcatcactgaattccttctagtagagcctagactatttacagtatact

SEQ ID NO: 42980 - DNA, 75 bp, Artificial Sequence
  Synthetic
actccgagacgaggcggtggattaaatatactcagcaacgccgtgtagtgggtgagtttcggcttgacaagggat

SEQ ID NO: 42981 - DNA, 75 bp, Artificial Sequence
  Synthetic
taggccaatgtgcagctattaattgggctttcgagatacattatcaccgtccttcaggcaagtaccaaatgggag

SEQ ID NO: 42982 - DNA, 75 bp, Artificial Sequence
  Synthetic
ggttggatgctgtgagaaatcggattgcggaggacctatcgttgaggagattcatggtggcattaattttagata

SEQ ID NO: 42983 - DNA, 75 bp, Artificial Sequence
  Synthetic
agttgctcttttcttttttgtgtaggatgagtaaaggtgtttttaaaatccttactaatgctttgagtcatccta

SEQ ID NO: 42984 - DNA, 75 bp, Artificial Sequence
  Synthetic
tcaagagaacaccagggaacaaacccaggattgccgagatgatatgcgacatagacacctatatcgtcgaggcag

SEQ ID NO: 42985 - DNA, 75 bp, Artificial Sequence
  Synthetic
aagtctacaggagattttgggactgtggaataattgagccaatacacggcccctctctagatactcaaaatttac

SEQ ID NO: 42986 - DNA, 75 bp, Artificial Sequence
  Synthetic
gtcttgctagcttcatcctaactatcaaattcgggatcgaaacaatgtacccggccttagggttgcatgaattct

SEQ ID NO: 42987 - DNA, 75 bp, Artificial Sequence
  Synthetic
atctcacggtctgtaacatgatctaccactgttatatgatatatctagatttgctcttgaatgatgagcttgatg

SEQ ID NO: 42988 - DNA, 75 bp, Artificial Sequence
  Synthetic
cgggtgaattaactacagttgagtctctaatgaacctctaccaacagatgggcgagactgcaccgtacatggtaa

SEQ ID NO: 42989 - DNA, 75 bp, Artificial Sequence
  Synthetic
atttcactttcctattgtgcgagagtgatgaagatgtagtcagtgaccggtttgagaatatccaagcaaggtacc

SEQ ID NO: 42990 - DNA, 75 bp, Artificial Sequence
  Synthetic
ttcttgaaaactcaattcagaacaagttcagtgcaggttcatacccgctattatggagctatgcaatgggagttg

SEQ ID NO: 42991 - DNA, 75 bp, Artificial Sequence
  Synthetic
tttgtattcttgcagatctgtactgtaatgcaaaaaactgcccgtcaataagggagcttgcacctataaagaagt

SEQ ID NO: 42992 - DNA, 75 bp, Artificial Sequence
  Synthetic
gagttgaacttgaaaattcaatgggtggacttaattttggtcgttcttacttcgaccctgcatatttcagactgg

SEQ ID NO: 42993 - DNA, 75 bp, Artificial Sequence
  Synthetic
gtgcagtacttacacaattcattaaatcggaagcattaatttctcctggggggttggattggaatgatgaaccga

SEQ ID NO: 42994 - DNA, 75 bp, Artificial Sequence
  Synthetic
gtcaagagatggtcaggagatcagcaggcaaggtgagctcatcgctagccgcagaactagggatcacagccgagg

SEQ ID NO: 42995 - DNA, 75 bp, Artificial Sequence
  Synthetic
tagtagtagaccacttttcttgctccttaacatatctcagaagaggggcggttaaacagatcaggctgagggttg

SEQ ID NO: 42996 - DNA, 75 bp, Artificial Sequence
  Synthetic
acgccaaacttgtctccgagattgctgcgcaggctaatgacgacagagctaatagagcaataggtcccaaacaaa

SEQ ID NO: 42997 - DNA, 75 bp, Artificial Sequence
  Synthetic
atcctgggttcgtatcggaagttctaattgacgcttctgaccataacctgggaccaattaaagctaaggagatta

SEQ ID NO: 42998 - DNA, 75 bp, Artificial Sequence
  Synthetic
accagatatcgtttcttcatcctgacagaggcgatgccagtactccagggaacatccttcgcgcaaacgagggtg

SEQ ID NO: 42999 - DNA, 75 bp, Artificial Sequence
  Synthetic
aattagatagcataaatttctatccccccaaggaagatgttgcacgattactcagtactataggcacagcccagc

SEQ ID NO: 43000 - DNA, 75 bp, Artificial Sequence
  Synthetic
acgggtccacccggatgaaaagaggggggaacattgctacaccaaaagggacaagcatagatcagacatcaacga

SEQ ID NO: 43001 - DNA, 75 bp, Artificial Sequence
  Synthetic
atgatctccccataatcggtactagagtaatcaactatgaagtacacgcttacaggagaatagggttgaactcat

SEQ ID NO: 43002 - DNA, 75 bp, Artificial Sequence
  Synthetic
ctctcagcaaagacactctagacattgatgaacagtccgacaacactgacgacccaattagtatccaaaaatcag

SEQ ID NO: 43003 - DNA, 75 bp, Artificial Sequence
  Synthetic
ctgcttgctacaaggcagtagaagtatcctcggtaatcaagagcatgattgaaccaggagaggatgggttattct

SEQ ID NO: 43004 - DNA, 75 bp, Artificial Sequence
  Synthetic
ctgaggcattagccaagatgagagccatggccaagctattggaaaaccaaggcccgcgtgatgtcactgcgcacg

SEQ ID NO: 43005 - DNA, 75 bp, Artificial Sequence
  Synthetic
tgggtgaaggttcaggttctatgctagtcacgtatagggaaatactcaagcttaaacgttgttattacaacagag

SEQ ID NO: 43006 - DNA, 75 bp, Artificial Sequence
  Synthetic
tttataatgataaagatctacttggctgaacaaaaggatccactctgagcagcgtcagactttgtattttcatca

SEQ ID NO: 43007 - DNA, 75 bp, Artificial Sequence
  Synthetic
gagtgtcagtcgagtctagatctgggcaaagagagatatctccctatccatcagaagttagtcttgttgaacacc

SEQ ID NO: 43008 - DNA, 75 bp, Artificial Sequence
  Synthetic
atattacaaaaaacttaggaccaaagtccaaggaattgacctccacatcatttcatccaccgacaccatccccaa

SEQ ID NO: 43009 - DNA, 75 bp, Artificial Sequence
  Synthetic
aactagggctggatcgtagtgttaaggtattattcaacgggaaaccagaggtgacatgggtaggtaatgtagatt

SEQ ID NO: 43010 - DNA, 75 bp, Artificial Sequence
  Synthetic
atggcagaggagcaggcctatcatgtcaataagggacttgagtgtctcaaatctctcagagaaaatccgcccgat

SEQ ID NO: 43011 - DNA, 75 bp, Artificial Sequence
  Synthetic
gttataagtatatcattagtaatataccatcttcaagtctgggactaatccactcagatatcgagaccttaccaa

SEQ ID NO: 43012 - DNA, 75 bp, Artificial Sequence
  Synthetic
gctgtcgaaattaaggaagcccaaattatccgaagcaaggccgcctgcgaagaatcaagcgagagtcatcaccag

SEQ ID NO: 43013 - DNA, 75 bp, Artificial Sequence
  Synthetic
ataaggacctagttgaaaagctggaagaattaactgccatattgtcgatgacatttattttaggtaaaataggat

SEQ ID NO: 43014 - DNA, 75 bp, Artificial Sequence
  Synthetic
gacaactccgaaaaagacactcttgatttcgacgaatcatgctcttcagcaattagaccagaaacgtaccgcatg

SEQ ID NO: 43015 - DNA, 75 bp, Artificial Sequence
  Synthetic
ctctcctaataatcaagataatgccgacaagcggggacttagttcaaggattcatcggatacaccactccttttt

SEQ ID NO: 43016 - DNA, 75 bp, Artificial Sequence
  Synthetic
ttacttggtgatgatacaggatttagagcaccaggttacatccctaatgaaggagagcccgagccaggagacatc

SEQ ID NO: 43017 - DNA, 75 bp, Artificial Sequence
  Synthetic
ttagagagagcattattgtataccctagatacagtaactttatctccactgagtgttatctagtatttgttgggc

SEQ ID NO: 43018 - DNA, 75 bp, Artificial Sequence
  Synthetic
ggaaaggaggaacctgcagtacgatgttaccatgtttatgatcacggcggtcaagcggttgaaggagtcaaggat

SEQ ID NO: 43019 - DNA, 75 bp, Artificial Sequence
  Synthetic
ttaagtacaatagattaatcaaccctgaaggaataaaacaacaactactaaaattgagcataagaacatcaccgg

SEQ ID NO: 43020 - DNA, 75 bp, Artificial Sequence
  Synthetic
gctgacctgctcgtggttccaacaggcagtgatgatgatgcagaattcagagacggagatgagagctctctcgag

SEQ ID NO: 43021 - DNA, 75 bp, Artificial Sequence
  Synthetic
gatttgtagcacatttgttatctatgaagcaagcaaactacctacaatcccttattggactccctgttcagaaag

SEQ ID NO: 43022 - DNA, 75 bp, Artificial Sequence
  Synthetic
agcgatggtgaatctggcactgttgataccagaggaaattcttcctctaacaggggatctgctcccaggattaag

SEQ ID NO: 43023 - DNA, 75 bp, Artificial Sequence
  Synthetic
gattctttaatagagtgttgagtgggttgaccccgattgaaaaagttcttattaattgcgggttaactgtgaacg

SEQ ID NO: 43024 - DNA, 75 bp, Artificial Sequence
  Synthetic
gtcgagagatcgtctgacgttgagactataagcagtgaagagctacaaggactgattagatctcagagtcaaaaa

SEQ ID NO: 43025 - DNA, 75 bp, Artificial Sequence
  Synthetic
ggcccaaggtatgtaagaacttagtacatcatgatatcgcgtctggatcagagggtcttgtcaactcaactgtta

SEQ ID NO: 43026 - DNA, 75 bp, Artificial Sequence
  Synthetic
cataatggatttggagtagacagattcctaaaggtcccaccaattccaacctcagtgccgctggaccccgctccc

SEQ ID NO: 43027 - DNA, 75 bp, Artificial Sequence
  Synthetic
ttttatacaaagaattggcaaggtttaaggaaaacacaaggagtcaacaaggcatgtttcacgcttatccggttc

SEQ ID NO: 43028 - DNA, 75 bp, Artificial Sequence
  Synthetic
aaatccattaaaaagggcacaggagagagatcagccttatctgggacggagaccgagttttcattgacaggtggt

SEQ ID NO: 43029 - DNA, 75 bp, Artificial Sequence
  Synthetic
ttgcagatagtaggcaaagagaattagtatccagaatcgctaggaagtattgggggtatattatactgtattcaa

SEQ ID NO: 43030 - DNA, 75 bp, Artificial Sequence
  Synthetic
gcaacccgacttgctcaagaatcaagatgggcatcgtcagagtcaagtgcacctgcggagaatgtccgccagtct

SEQ ID NO: 43031 - DNA, 75 bp, Artificial Sequence
  Synthetic
cagaacagggggcgctcaatcaattggtaagaaatcttaaagcgggctacttattatttgatgttcatcacaatt

SEQ ID NO: 43032 - DNA, 75 bp, Artificial Sequence
  Synthetic
gtgacgaatgcagagaggacccagaaacccccacaaggatctggtaccacagcctcccagaaatcccagaacaat

SEQ ID NO: 43033 - DNA, 75 bp, Artificial Sequence
  Synthetic
ttctcgtcaagaatctttccaaatccgaaagggtcttaatacggactcttatcccacggagagagtggttattta

SEQ ID NO: 43034 - DNA, 75 bp, Artificial Sequence
  Synthetic
ggccattctgatgatgagtatgaagatgaactctttatggaggtacaggagattaaaacagcaattacaaagatt

SEQ ID NO: 43035 - DNA, 75 bp, Artificial Sequence
  Synthetic
agcttgagacaagtgagataaaggagtggtttaagttgatagggtacggtgccctcatcagagagtaataactaa

SEQ ID NO: 43036 - DNA, 75 bp, Artificial Sequence
  Synthetic
aatgaagataatcagcagataatatcaaaattggactctataatgctactaaagggtgaaattgaatctatcaag

SEQ ID NO: 43037 - DNA, 75 bp, Artificial Sequence
  Synthetic
tgaagtggacccctgctcctgtccttgtcagagtgatatcagattataattattaagaaaaacaagattcgattt

SEQ ID NO: 43038 - DNA, 75 bp, Artificial Sequence
  Synthetic
aaacagatcaataagcaaaatatcactatatcaactatcgaaggccacctgtccagcataatgatagcaattcca

SEQ ID NO: 43039 - DNA, 75 bp, Artificial Sequence
  Synthetic
tcagagtgatatcagattataattattaagaaaaacaagattcgatttaagtacctatacccagctttgtctggt

SEQ ID NO: 43040 - DNA, 75 bp, Artificial Sequence
  Synthetic
ggattcggtaaagatcccaatgatcctactgcagacgtagaactcaatcccgatctgagacccataattagccgt

SEQ ID NO: 43041 - DNA, 75 bp, Artificial Sequence
  Synthetic
gatgcaggaagagctctagctgaggtcctcaagaggccagcagtcgagagaaatccaaaggtcaccccaaaggtc

SEQ ID NO: 43042 - DNA, 75 bp, Artificial Sequence
  Synthetic
catccaggatccaaggggcagattctgagggatctgcaacttaagccggtagacaggaaaatgagctctgctgtg

SEQ ID NO: 43043 - DNA, 75 bp, Artificial Sequence
  Synthetic
ggatttgtcccaactgatgatctgccgtctcggagtgtgcttcgctccatgattaagtccagcaatcttgaatca

SEQ ID NO: 43044 - DNA, 75 bp, Artificial Sequence
  Synthetic
gaacacaaacgaagcatgatagggctcttgaatgatgtcaaaagtggcaaggatcttggagaattttatcagatg

SEQ ID NO: 43045 - DNA, 75 bp, Artificial Sequence
  Synthetic
gtgaaaaaaatcatcaagtaacataccaacctacatcttattgcttgcttgcctagcttagtagtaatgttagtc

SEQ ID NO: 43046 - DNA, 75 bp, Artificial Sequence
  Synthetic
aaaatgatcaattataaaaaacttaggattcaagactaagttgactaccgtcgaaaatgaccgaggtttacgact

SEQ ID NO: 43047 - DNA, 75 bp, Artificial Sequence
  Synthetic
ttgatagatcagcctgggatgtcaaggggtctattgctcccatagagcccactacttatcccgatggaagactga

SEQ ID NO: 43048 - DNA, 75 bp, Artificial Sequence
  Synthetic
tccctcaagttagagttatagatccaggcttaggtgacagaaaggatgagtgtttcatgtatatcttccttctgg

SEQ ID NO: 43049 - DNA, 75 bp, Artificial Sequence
  Synthetic
gcatattagaggataatgatataatgagccccccaatcgggaggactttcggctcactcccgctcggagtaggac

SEQ ID NO: 43050 - DNA, 75 bp, Artificial Sequence
  Synthetic
gatcgactgctaaacctgaagaactgcttaaagaggccaccgaattggatattgtggtaaggaggacagcggggt

SEQ ID NO: 43051 - DNA, 75 bp, Artificial Sequence
  Synthetic
taaatgagaaactagtcttctacaacaatacaccgcttatgttattgactccgtggaagaaagtacttactgctg

SEQ ID NO: 43052 - DNA, 75 bp, Artificial Sequence
  Synthetic
gaagtgtctttagtgcaaaccaagtctgcaatgctgtcaatcttatcccacttgacactccgcaaaggttcagag

SEQ ID NO: 43053 - DNA, 75 bp, Artificial Sequence
  Synthetic
ttgtctatatgagtataaccagactctcagacaatggatgctatagggttcccagaaagatgctggagttcagat

SEQ ID NO: 43054 - DNA, 75 bp, Artificial Sequence
  Synthetic
ctgctaatgctctggcattcaatatattagtgaccatcagaattgaaaacgccggaattgtaagccgcccataca

SEQ ID NO: 43055 - DNA, 75 bp, Artificial Sequence
  Synthetic
tgagcatgatgagagacccacaggcgactttcatgatccatattgggaacttccgcagaaagaagaatgaggctt

SEQ ID NO: 43056 - DNA, 75 bp, Artificial Sequence
  Synthetic
actctgcagattactgcaagatgaagatagaaaaaatgggcctcgtctttgctcttggcggaatcggagggacca

SEQ ID NO: 43057 - DNA, 75 bp, Artificial Sequence
  Synthetic
gcctacatatcagatgtactgggaagatgagtaagactctacatgctcagttagggtttaagaaaatactctgtt

SEQ ID NO: 43058 - DNA, 75 bp, Artificial Sequence
  Synthetic
accccttaatggatgtcaacgaagaccttaataggtacttgtggcgtgcagaatgcaagattgtgagaatccaag

SEQ ID NO: 43059 - DNA, 75 bp, Artificial Sequence
  Synthetic
ctgttcttcagccatcagtcccgcaggaattcagagtttatgatgatgttattatcaatgatgatcaagggttat

SEQ ID NO: 43060 - DNA, 75 bp, Artificial Sequence
  Synthetic
tcaagattctttaaaaagctaaagaataagacttctcatttcaggctcatagctagttcatccagcagaatcaac

SEQ ID NO: 43061 - DNA, 75 bp, Artificial Sequence
  Synthetic
agagcttatatatattggataaatcagttcaaagctcaatgtagttggagtttgttgtagggttagtattgagag

SEQ ID NO: 43062 - DNA, 75 bp, Artificial Sequence
  Synthetic
ataatggaagtcctgataaaattcaccattcagctaatcaatggtagataattatctgcatgcgcacatagaagc

SEQ ID NO: 43063 - DNA, 75 bp, Artificial Sequence
  Synthetic
ttagagtcttgcttctcatcctgattcttgataattccagcagaacaaagcttcaaacaacactgtactcagttt

SEQ ID NO: 43064 - DNA, 75 bp, Artificial Sequence
  Synthetic
cgaattacctgatcaaccacagatcctctcctcgacaatcaggggttaaacagtcctacatccagtgaccccaaa

SEQ ID NO: 43065 - DNA, 75 bp, Artificial Sequence
  Synthetic
agccaagacgtgacatcactcgcaaccaactgatgcaaattattaaataaaacttaggagtaaagtaattaagac

SEQ ID NO: 43066 - DNA, 75 bp, Artificial Sequence
  Synthetic
tccaagcaacacccgacaacccactacacccaaaaacagacaacgacaaccggcagaacaaacagatctcgcata

SEQ ID NO: 43067 - DNA, 75 bp, Artificial Sequence
  Synthetic
ggcaaagagaccacaccacaattcctcctttgcaatcgaccacaccagccccaggctccatctccaggaccacca

SEQ ID NO: 43068 - DNA, 75 bp, Artificial Sequence
  Synthetic
gtcatccattggctgcaaaaaacaggctcgatcagcatagggcaagccgatattcttgctatccccaatccagat

SEQ ID NO: 43069 - DNA, 75 bp, Artificial Sequence
  Synthetic
ccggttgatgcgctcctgaccaatcaccgcgagcgaccaagaatccagagctctcgatcttgaagacaacttttc

SEQ ID NO: 43070 - DNA, 75 bp, Artificial Sequence
  Synthetic
atctggtcgtcaacattgagtcactgtcgctaggagaaaatccgtagtcaaatattgtcgaaaaggtagcactta

SEQ ID NO: 43071 - DNA, 75 bp, Artificial Sequence
  Synthetic
tccttaggaccccagtactctcattcatggccgctagtaacggcggtgttatgtatcagtcatttctcacaatca

SEQ ID NO: 43072 - DNA, 75 bp, Artificial Sequence
  Synthetic
taatccttgtcattatgactgaagggcaaatccattgggggaatctctccaaaattgggatagttgggacaggaa

SEQ ID NO: 43073 - DNA, 75 bp, Artificial Sequence
  Synthetic
gtgccagctataaagtgatgaccaggcctaaccatcagtatctagttatcaaattgatgccgaatgtaactatga

SEQ ID NO: 43074 - DNA, 75 bp, Artificial Sequence
  Synthetic
ttgacaattgcacaagaactgaagtgacagagtacaggaaactacttaagacagtattagaaccggtcaagaacg

SEQ ID NO: 43075 - DNA, 75 bp, Artificial Sequence
  Synthetic
ctcttacagtgataacaaagaatattaagcctatacagtctttaaccaccagtagaaggagcaagaggtttgcag

SEQ ID NO: 43076 - DNA, 75 bp, Artificial Sequence
  Synthetic
gagtggtcttggcaggtgtggcattgggagttgctactgccgcccagataactgcaggagttgcccttcatcagt

SEQ ID NO: 43077 - DNA, 75 bp, Artificial Sequence
  Synthetic
ccatcatgaactcccagtcaattgataatctaagaacaagtttagaaaagtccaaccaagccatagaagagatta

SEQ ID NO: 43078 - DNA, 75 bp, Artificial Sequence
  Synthetic
gacaagcatcccaagaaactgtcttagctgttcaaggggtccaagacttcatcaacaatgaactgattccatcta

SEQ ID NO: 43079 - DNA, 75 bp, Artificial Sequence
  Synthetic
tgcaccagctgtcttgcgagatgctaggacagaaattgggtctaaaactattaaggtattacacagagatattgt

SEQ ID NO: 43080 - DNA, 75 bp, Artificial Sequence
  Synthetic
ccattttcggacctagcctcagagatcctgtctctgccgaaatatctattcaagcactgagttatgctcttggag

SEQ ID NO: 43081 - DNA, 75 bp, Artificial Sequence
  Synthetic
gagatattaacaaaatcttagaaaagttaggctatagtggtgcagatttacttgcaatactagagagtcgaggga

SEQ ID NO: 43082 - DNA, 75 bp, Artificial Sequence
  Synthetic
taaaagcaaaagttacccatgttgatttagaaggttactttatagtactgagtattgcatacccgactctatcag

SEQ ID NO: 43083 - DNA, 75 bp, Artificial Sequence
  Synthetic
aggtcaagggggtgatagtacacaaattggaggcagtttcctacaacttaggatctcaagagtggtacacaacat

SEQ ID NO: 43084 - DNA, 75 bp, Artificial Sequence
  Synthetic
tacccaaatatgtggcgaccaatggctatctaatctctaattttgatgaatcttcgtgtgcatttatgtcagaag

SEQ ID NO: 43085 - DNA, 75 bp, Artificial Sequence
  Synthetic
tgactatttgtagtcaaaatgcactttaccccatgagtccgttgctccaacaatgtcttagaggatctaccgcat

SEQ ID NO: 43086 - DNA, 75 bp, Artificial Sequence
  Synthetic
catgcgcgcgaagcttagtatctgggacaattgggaatcgattcatattatccaaagggaacttaatcgctaact

SEQ ID NO: 43087 - DNA, 75 bp, Artificial Sequence
  Synthetic
gcgcatcggtactctgcaaatgttactctactggcaccataattagccaggatccagataaactcttaacattcg

SEQ ID NO: 43088 - DNA, 75 bp, Artificial Sequence
  Synthetic
tcgccgcagacaaatgccctttagttgaggtagacggaatcacaatccaagtgggatccagggagtatcctgatt

SEQ ID NO: 43089 - DNA, 75 bp, Artificial Sequence
  Synthetic
cagtttatgtcagtagaattgatctcggcccagctatatcactggagaagttagatgtaggcacaaatctgggca

SEQ ID NO: 43090 - DNA, 75 bp, Artificial Sequence
  Synthetic
gtgccctgacaaaactggacaatgctaaagatctactagactcatcgaatcaaattctagagaatgtcaggagaa

SEQ ID NO: 43091 - DNA, 75 bp, Artificial Sequence
  Synthetic
gttcctttggaggagcaatgtacatagggatccttgtatgtgcaggagctttagtgattctgtgcgtattggtat

SEQ ID NO: 43092 - DNA, 75 bp, Artificial Sequence
  Synthetic
actgttgtaggaggcactgtcgcaaacgtgtccaaacaccccctaaagcaactcccggattaaagcctgatctaa

SEQ ID NO: 43093 - DNA, 75 bp, Artificial Sequence
  Synthetic
caggtactaccaaatcatatgtaagatccttgtgattttaatagttgcatgatggacattccgtaacaccaaaac

SEQ ID NO: 43094 - DNA, 75 bp, Artificial Sequence
  Synthetic
ctaggcaaatatacaaatactggattattggtcatacctgagccattatatatacaatatagagagtctaataaa

SEQ ID NO: 43095 - DNA, 75 bp, Artificial Sequence
  Synthetic
taaataattaaagaaaacttagggtgcaagttgaccaaccatgtcttctccgcgtgacaaggtcgacgcattcta

SEQ ID NO: 43096 - DNA, 75 bp, Artificial Sequence
  Synthetic
caaggacataccaagacctagaaacaatagggttttgctagacaatgagagggttatcatagaaagaccgttgat

SEQ ID NO: 43097 - DNA, 75 bp, Artificial Sequence
  Synthetic
actcgtgggtgtgctagccgttatgtttcttagtctggtaggactacttgccattgcaggagttagactgcaaaa

SEQ ID NO: 43098 - DNA, 75 bp, Artificial Sequence
  Synthetic
agcaacgactaacagcattgaggtgaacagaaaacttagcacaaatttggaaacaaccgtgtctattgaacatca

SEQ ID NO: 43099 - DNA, 75 bp, Artificial Sequence
  Synthetic
tgttaaggatgtcttaactcctttgtttaagatcatcggagacgaagtggggttacggatgccccagaagttaac

SEQ ID NO: 43100 - DNA, 75 bp, Artificial Sequence
  Synthetic
agagataatgcagttcatatcaaacaagatcaaattcctcaacccagatagagaatacgacttcaatgatctaca

SEQ ID NO: 43101 - DNA, 75 bp, Artificial Sequence
  Synthetic
ctggtgtgttaacccccctgatcaagtcaaaattgactatgctcagtactgcaaccacatcgcagccgaggagct

SEQ ID NO: 43102 - DNA, 75 bp, Artificial Sequence
  Synthetic
tatagttactaagttcaaagagttaatgaaccactctctagatatgagtaaaggaaggatattccctcctaagaa

SEQ ID NO: 43103 - DNA, 75 bp, Artificial Sequence
  Synthetic
ttgctcgggctcagtcatcaccagaggtcaaactataaaaccagggctcaccttggttaacatatatacaacaag

SEQ ID NO: 43104 - DNA, 75 bp, Artificial Sequence
  Synthetic
gaacttcgaagtctcctttatggtcacagtaatatctggggggatgtatgggaaaacatattttttgaaaccacc

SEQ ID NO: 43105 - DNA, 75 bp, Artificial Sequence
  Synthetic
cgaacctgatgatccatttgagttccaagcatttaggatctttgaggtaggattagtcagagacgtagggagccg

SEQ ID NO: 43106 - DNA, 75 bp, Artificial Sequence
  Synthetic
tgaacccgtgctgcagatgacaaatttcatggtgattgatgaggacgaaggtctgaatttttgtttgttgtcagt

SEQ ID NO: 43107 - DNA, 75 bp, Artificial Sequence
  Synthetic
cggagaacttagacttgcggctgtctgcgtcagagggagaccagttgttacaaaggacataggaggttacaaaga

SEQ ID NO: 43108 - DNA, 75 bp, Artificial Sequence
  Synthetic
tgagccctttaaagttgttacgttgggcatcatagggggtggtttgagtaatcagaaaactgagatctacccgac

SEQ ID NO: 43109 - DNA, 75 bp, Artificial Sequence
  Synthetic
gattgattcttctatcgagaagttatacataacttctcatagaggtataatccgaaactcaaaagctaggtggtc

SEQ ID NO: 43110 - DNA, 75 bp, Artificial Sequence
  Synthetic
agtacctgcaattagaagtgatgacaaagacaaaatggagaaatgcactcaagcattgtgcaagagtagaccacc

SEQ ID NO: 43111 - DNA, 75 bp, Artificial Sequence
  Synthetic
cccctcatgcaatagttctgattgggagccattgacgagcaaccggatcccagcttatgcatatattgcactaga

SEQ ID NO: 43112 - DNA, 75 bp, Artificial Sequence
  Synthetic
gattaaagaggactcaggtctagagcttgatattacgtcaaactacggacccttgataatccatggagcagggat

SEQ ID NO: 43113 - DNA, 75 bp, Artificial Sequence
  Synthetic
ggacatttacgaaggccccagtagcaatcaagactggctggccattcctcctttgtcacaatcagtactcggtgt

SEQ ID NO: 43114 - DNA, 75 bp, Artificial Sequence
  Synthetic
cattaacaaggtcgattttacagcaggatttgatatcaaaccacatacccttacaactgcagtcgattacgagag

SEQ ID NO: 43115 - DNA, 75 bp, Artificial Sequence
  Synthetic
tggaaaatgctatgtcccggttgagttgtcaggagccaaggatcaggaccttaaattagaatcaaaccttgttgt

SEQ ID NO: 43116 - DNA, 75 bp, Artificial Sequence
  Synthetic
attgcctacaaaggactttggttatgttacagcaacatatgacacctcaagaagtgagcatgcaatagtttatta

SEQ ID NO: 43117 - DNA, 75 bp, Artificial Sequence
  Synthetic
tgtgtatgacacagctaggtcttcatcatatttcttcccattcagaatcaaggcaagaggagagccaatttatct

SEQ ID NO: 43118 - DNA, 75 bp, Artificial Sequence
  Synthetic
gaggatagagtgtttcccctggtccaggcaactctggtgtcatcactactgcatgattaatagtacagtatccaa

SEQ ID NO: 43119 - DNA, 75 bp, Artificial Sequence
  Synthetic
tgagattgtagtggttgataacctagtaagtatcaatatgagctgcagccgttagatgaacgactgttgagcctc

SEQ ID NO: 43120 - DNA, 75 bp, Artificial Sequence
  Synthetic
caccaactgtcccagtatgccgcaccatcagcactcccactctccaatccatcctctaatcagtggtcgctctag

SEQ ID NO: 43121 - DNA, 75 bp, Artificial Sequence
  Synthetic
accccattaagaaaaacttagggaccaggattattgcagagatggagtccatctcaatcaaccagatcctatacc

SEQ ID NO: 43122 - DNA, 75 bp, Artificial Sequence
  Synthetic
ctgaagtgcacctggatagtcctatagtcactaataagttagtagctatactggagtactctcgggtaacccatg

SEQ ID NO: 43123 - DNA, 75 bp, Artificial Sequence
  Synthetic
ggtacattctggaggatcagacattgacaaagaatattcgctatagggtcgagaatggttactccaatcaaatga

SEQ ID NO: 43124 - DNA, 75 bp, Artificial Sequence
  Synthetic
ttataaataacctcgaaattgggaatgtggtaaatctaagactcatgagttacccctaccacaggcacaagatct

SEQ ID NO: 43125 - DNA, 75 bp, Artificial Sequence
  Synthetic
accccgactgtaattatgacctattccatatttctgatcatcaaatttcttccaggctgttaaccctattcaaaa

SEQ ID NO: 43126 - DNA, 75 bp, Artificial Sequence
  Synthetic
agggaaatacaatatatactaagatcagcggaaaaattattgaatgtatgaagggagtgaattcaaggctaggga

SEQ ID NO: 43127 - DNA, 75 bp, Artificial Sequence
  Synthetic
taagcagtgatttaagtaaagaagttacgacagggatcacagatttgggagcctacatgcagagttctcaatggt

SEQ ID NO: 43128 - DNA, 75 bp, Artificial Sequence
  Synthetic
atgggccttttctatattggttcacaattaaaactgagatgcggtccatcatcaaatcagctacacacacaagtc

SEQ ID NO: 43129 - DNA, 75 bp, Artificial Sequence
  Synthetic
atagacataggatagtaccttcatttgtgcatggtgagagatgtgaagttttgatatctagagacttggtaacca

SEQ ID NO: 43130 - DNA, 75 bp, Artificial Sequence
  Synthetic
taattaataaaaggtcacaagatatctactatctcacatttgaaatggtacttatgtactgcgatgtagtggaag

SEQ ID NO: 43131 - DNA, 75 bp, Artificial Sequence
  Synthetic
gaaggttaatgacggaaactgcaatgactgtggaccctaggtacactgagctcctctgtagagtaaagtacctat

SEQ ID NO: 43132 - DNA, 75 bp, Artificial Sequence
  Synthetic
ggaatttgatagacggcttcttccccaccttaggcaactccacatatcaaatcgtggcattattagagccattgt

SEQ ID NO: 43133 - DNA, 75 bp, Artificial Sequence
  Synthetic
ctctggcctatctccagttgaaagatatcacacttgaattgaggggcgcattccttagtcactgttttaatgaaa

SEQ ID NO: 43134 - DNA, 75 bp, Artificial Sequence
  Synthetic
tccatgacattttggagagtagtggagttttaactgaggagacatattctgatgttgtcaatgcattggattaca

SEQ ID NO: 43135 - DNA, 75 bp, Artificial Sequence
  Synthetic
tcttcattactgacgacatccacctgacaggggagatattttcattcttccgaagtttcggtcacccgcgtcttg

SEQ ID NO: 43136 - DNA, 75 bp, Artificial Sequence
  Synthetic
aagctgtaacagcagccaacaatgtgagaaagtatatgaaccaaccaaaagttatcaactacgagactatgatga

SEQ ID NO: 43137 - DNA, 75 bp, Artificial Sequence
  Synthetic
agggtcatgctatattttgtggtattatcattaatgggtaccgtgataggcacggaggtagttggcctccgattt

SEQ ID NO: 43138 - DNA, 75 bp, Artificial Sequence
  Synthetic
cccttccgactcatgcatcttcaatagttaggaatgccctggcttcaggtgagggattgacctacagtcaatgta

SEQ ID NO: 43139 - DNA, 75 bp, Artificial Sequence
  Synthetic
ttgataattggaggtcatttgctggggttaagtttgggtgtttcatgcccttgagcctagatagtgacctgacta

SEQ ID NO: 43140 - DNA, 75 bp, Artificial Sequence
  Synthetic
tgtatctcaaggataaagcactagcagcactcaagaaagaatgggattcggcttacccaaaggaataccttcgtt

SEQ ID NO: 43141 - DNA, 75 bp, Artificial Sequence
  Synthetic
ataatcctcccaagccgacaggatcgagaagactggtcaatgtttttcttgatgactctacatttgatccttaca

SEQ ID NO: 43142 - DNA, 75 bp, Artificial Sequence
  Synthetic
atatgatcctctacgtgataaatggctcctatttggaagaccctgatttcaacttatcttacagcctaaaagaaa

SEQ ID NO: 43143 - DNA, 75 bp, Artificial Sequence
  Synthetic
aagagattaaagaagttgggagactatttgccaaaatgacctaccaaatgagggcttgccaagtcattgcagaga

SEQ ID NO: 43144 - DNA, 75 bp, Artificial Sequence
  Synthetic
atttaatatcaaatggaatagggaagtatttcaaagacaacggtatggccaaagatgaacatgatcttacaaagg

SEQ ID NO: 43145 - DNA, 75 bp, Artificial Sequence
  Synthetic
cactccacacactagcggtttcaggtatacctaagaacaaaaaagattaccatagaggtgaaggtgggagacaga

SEQ ID NO: 43146 - DNA, 75 bp, Artificial Sequence
  Synthetic
ccaatccttggtggtttggtgacaagtcaaagattaataagcgacatggacaaacctcaacggctcattctaatt

SEQ ID NO: 43147 - DNA, 75 bp, Artificial Sequence
  Synthetic
atgctggtgccgggtgcggaatcaagaatggacatgatcaggaggcttacgagactgtcagtgcttttatcacga

SEQ ID NO: 43148 - DNA, 75 bp, Artificial Sequence
  Synthetic
ctgatcttaagaaatactgtttaaattggaggtatgagacaatcagcatatttgcccagagactaaatgagattt

SEQ ID NO: 43149 - DNA, 75 bp, Artificial Sequence
  Synthetic
atgggttgccttcattcttccagtggctacacaagaggttggagaaatcagtcctatatgtaagcgatcctcact

SEQ ID NO: 43150 - DNA, 75 bp, Artificial Sequence
  Synthetic
gtccaccagatcttgatactcatatggatttagatgccgtcccaaactctcaaatatttataaagtacccaatgg

SEQ ID NO: 43151 - DNA, 75 bp, Artificial Sequence
  Synthetic
gagggatcgaaggatactgtcagaagctctggacaataagtacaataccctacctgtacctagcggctcatgaga

SEQ ID NO: 43152 - DNA, 75 bp, Artificial Sequence
  Synthetic
gtggagttaggattgcctcattggttcaaggagacaaccagaccatagccgtcacaaaaagagtcccaagcacct

SEQ ID NO: 43153 - DNA, 75 bp, Artificial Sequence
  Synthetic
ggccctatgatctcaagaagagggaggctacaaaaataactattgagtacttcttaatcctaaggcagcgattgc

SEQ ID NO: 43154 - DNA, 75 bp, Artificial Sequence
  Synthetic
acgatatagggcatcatttgaaagcaaatgaaacaattatatcctcacatttctttgtttactcaaaaggtatat

SEQ ID NO: 43155 - DNA, 75 bp, Artificial Sequence
  Synthetic
attatgatggaatgctgatctctcaatcacttaaaagtgtggctcggtgtgttttctggtcggaaacaattgtgg

SEQ ID NO: 43156 - DNA, 75 bp, Artificial Sequence
  Synthetic
atgaaactagagcagcttgcagtaatatctcgacaactcttgcaaaaagcatagaaaggggatttgaccggtatt

SEQ ID NO: 43157 - DNA, 75 bp, Artificial Sequence
  Synthetic
tggcttactcattgaatgtactcaagattattcaacagatccttatctccctagggtttacaataaacacttcta

SEQ ID NO: 43158 - DNA, 75 bp, Artificial Sequence
  Synthetic
tgactcaagacatagcaatcccattactgcagaatcaagatttgttgattaagatggcactactacctgctccta

SEQ ID NO: 43159 - DNA, 75 bp, Artificial Sequence
  Synthetic
taggtggcctcaattatcttaatatgagcagattattcgtaaggaatataggtgatccagttacgtcctctttag

SEQ ID NO: 43160 - DNA, 75 bp, Artificial Sequence
  Synthetic
ctgacctcaaaagaatgataattgcagggattatgcctgaggagtcgatccaccaagttatgacacaacaaccag

SEQ ID NO: 43161 - DNA, 75 bp, Artificial Sequence
  Synthetic
gggattcctctttcctagattgggcgagtgatccctactcagctaatctaccatgtgtccagagtatcactcggc

SEQ ID NO: 43162 - DNA, 75 bp, Artificial Sequence
  Synthetic
tgcttaagaatataactgcgaggcatgtactaataaatagtcccaatccgatgttaagggggttattccatgcgg

SEQ ID NO: 43163 - DNA, 75 bp, Artificial Sequence
  Synthetic
atagccatgaggtagatgagagtttagcaacttttctcatggatagacacatcatcagacctagagcagctcatg

SEQ ID NO: 43164 - DNA, 75 bp, Artificial Sequence
  Synthetic
agattctcgacaacagcatcgcagtggctcgcgaatcacttgcagggatgctcgatactactaaagggctaataa

SEQ ID NO: 43165 - DNA, 75 bp, Artificial Sequence
  Synthetic
gggctagtatgaaaagaggtggactgaccccacgaatcatcacgagattatcaaattatgattatgatcagtcta

SEQ ID NO: 43166 - DNA, 75 bp, Artificial Sequence
  Synthetic
aaatgggaatatcacttttaactgtgaagaaacggaacaatcttatcgatagggagtcttgctcagtccagctgg

SEQ ID NO: 43167 - DNA, 75 bp, Artificial Sequence
  Synthetic
cccgagccctcagaagtcacatgtgggcgaaactcgcaagaggaaggtcgatatacggacttgaggttcctgttg

SEQ ID NO: 43168 - DNA, 75 bp, Artificial Sequence
  Synthetic
tactagaatcaatgaaagggtacattattaaacgtcatgagtcttgttcattatgtgaaactggctcactgaatt

SEQ ID NO: 43169 - DNA, 75 bp, Artificial Sequence
  Synthetic
atggttggttctttggtcccgccaattgccaattagataatatttccaaggagacatcatctttacgagttccct

SEQ ID NO: 43170 - DNA, 75 bp, Artificial Sequence
  Synthetic
atattgggtcaacaacagaggaaaggacagacatgaaattagcatttgccaagtcccctagtcgctccctcaaat

SEQ ID NO: 43171 - DNA, 75 bp, Artificial Sequence
  Synthetic
ctgccgtgagaattgctacagtgtactcttgggcttatggtgatgacgaccagtcatggcatgaggcatggactc

SEQ ID NO: 43172 - DNA, 75 bp, Artificial Sequence
  Synthetic
acgaagacaaaaaaaccatttaaacgattatatagtagtacacgaacactttaacagaaatcaaaatgagttctc

SEQ ID NO: 43173 - DNA, 75 bp, Artificial Sequence
  Synthetic
aagtattctgcatttctacaggtcaaacagtctccgtatgccttccagcaaatgaagacccagtagagtttccag

SEQ ID NO: 43174 - DNA, 75 bp, Artificial Sequence
  Synthetic
gggcattcttcactccaaatgccaggaaaccgacggtgtacataaaaaaggagacagatctgagtcttttgagga

SEQ ID NO: 43175 - DNA, 75 bp, Artificial Sequence
  Synthetic
gaaaccgacggtgtacataaaaaaggagacagatctgagtcttttgaggagtcacgtttatgacgggattaaaga

SEQ ID NO: 43176 - DNA, 75 bp, Artificial Sequence
  Synthetic
tggttctgtgacagtgtcccagataaattcttatctatacatggttttgaaagatatccgggagaaaccagataa

SEQ ID NO: 43177 - DNA, 75 bp, Artificial Sequence
  Synthetic
aattcttatctatacatggttttgaaagatatccgggagaaaccagataaaaattggacgtcctttggagtcgaa

SEQ ID NO: 43178 - DNA, 75 bp, Artificial Sequence
  Synthetic
ttgggaaaaaagaatgagccaatgggaattttcgatctgttgaatgttgaggatgttaaggggaaagaattggac

SEQ ID NO: 43179 - DNA, 75 bp, Artificial Sequence
  Synthetic
aaaaaagggcaagacacccgactgcccggagatgatctgtggcttccaacgctgatcttcggtctttatcgtgtg

SEQ ID NO: 43180 - DNA, 75 bp, Artificial Sequence
  Synthetic
tccagggcgacacaggtcgaatacaagaagactctgatgaccaatctatatgctcagtgtaaattgcgcacgaag

SEQ ID NO: 43181 - DNA, 75 bp, Artificial Sequence
  Synthetic
gatgcagaggagattgtggatgaaacagcagaattcttcaatgcttgggcaaatgactccaacttcacaaaaatc

SEQ ID NO: 43182 - DNA, 75 bp, Artificial Sequence
  Synthetic
gtagctgctgtggatatgtacttccaccacttcaagaagagtgatcatgctcctattcgtttcggaacaattgtg

SEQ ID NO: 43183 - DNA, 75 bp, Artificial Sequence
  Synthetic
tctagattcaaggactgtgcagcattgtccactctgtcgcacctccaaaaggtcacagggctccccattgaggag

SEQ ID NO: 43184 - DNA, 75 bp, Artificial Sequence
  Synthetic
gtcttcacctgggttttcaataaatcagtacaggatgatttgttgcggatgatgactcctggccaggaaattgac

SEQ ID NO: 43185 - DNA, 75 bp, Artificial Sequence
  Synthetic
caagctgattcctacatgccctatctgatcgacatgggcttgtccacgaagtctccttactcttcaacaaaaaat

SEQ ID NO: 43186 - DNA, 75 bp, Artificial Sequence
  Synthetic
cccagtttccatttctgggggcaactgaccgcattcttggtaaaatccgcaagagcaaagaatgcgttagttcca

SEQ ID NO: 43187 - DNA, 75 bp, Artificial Sequence
  Synthetic
gtcgacatcgcataccatgaactgaccactgctgcactgctttttgcctatgcaattggcagatcgtctgagctg

SEQ ID NO: 43188 - DNA, 75 bp, Artificial Sequence
  Synthetic
gagcagagattcgtgcttaacgggaagaagttcaccaaggagaaggactctcgagatgacaatgacactactccg

SEQ ID NO: 43189 - DNA, 75 bp, Artificial Sequence
  Synthetic
ccatcggagagaaatgttgttgtttggctggcctggtgggaggacattaagcatgaaattactccggacatgaag

SEQ ID NO: 43190 - DNA, 75 bp, Artificial Sequence
  Synthetic
gcctttgccaagagagcagtggaaagggtaggagatattcgagtgaactcagttgcagagtatgccaggaaactc

SEQ ID NO: 43191 - DNA, 75 bp, Artificial Sequence
  Synthetic
tttgcatgatcaaatatgaaaaaaactaacagagatcatggaagactctcaactatatcaagctctcaagaatta

SEQ ID NO: 43192 - DNA, 75 bp, Artificial Sequence
  Synthetic
cccaaagcttcaggacactctcgactcaattgagaatcttgaagatgacacaaagtcagagccatctgagtgtgg

SEQ ID NO: 43193 - DNA, 75 bp, Artificial Sequence
  Synthetic
ttcccccacagagagaggaattcccagctattacctggctgaagaattggatgaatgtgaggaagaagattcgga

SEQ ID NO: 43194 - DNA, 75 bp, Artificial Sequence
  Synthetic
agatgatgatgacaatttacctactgagataccggatcctcctactgttgacatgctggaggcaattatggaaga

SEQ ID NO: 43195 - DNA, 75 bp, Artificial Sequence
  Synthetic
tgagattgatgatacggcttaccaggtacattttgaggccaaacagacttggaaaccggtgatagagacagaggg

SEQ ID NO: 43196 - DNA, 75 bp, Artificial Sequence
  Synthetic
aaatgaaagaggtaagttcaccctttcagtccctcagaatctgagcgctctacaacttctgcagtgggagacagg

SEQ ID NO: 43197 - DNA, 75 bp, Artificial Sequence
  Synthetic
tcagtccctcagaatctgagcgctctacaacttctgcagtgggagacagggattcatgcattggcggagagactt

SEQ ID NO: 43198 - DNA, 75 bp, Artificial Sequence
  Synthetic
tacaacttctgcagtgggagacagggattcatgcattggcggagagacttgggggatgcaggctgttgcagatca

SEQ ID NO: 43199 - DNA, 75 bp, Artificial Sequence
  Synthetic
gcacacggggaacgagggatgggatagagttcactgtaagagaaacgccttgcgtttcacctgcttctgatccaa

SEQ ID NO: 43200 - DNA, 75 bp, Artificial Sequence
  Synthetic
tcccttccacctccagatccagttcaattgcttccaatgtctctaccagacaaaccgaatcacctggctccaaat

SEQ ID NO: 43201 - DNA, 75 bp, Artificial Sequence
  Synthetic
aattgcttccaatgtctctaccagacaaaccgaatcacctggctccaaatccaatacaagtcttgggataccaga

SEQ ID NO: 43202 - DNA, 75 bp, Artificial Sequence
  Synthetic
caaaccgaatcacctggctccaaatccaatacaagtcttgggataccagaagccccggctaatttaatcgacatg

SEQ ID NO: 43203 - DNA, 75 bp, Artificial Sequence
  Synthetic
ggagcaattgataaagaattcatcctggcagctatctctccgtctgacccaccttataagaacactctgagaaac

SEQ ID NO: 43204 - DNA, 75 bp, Artificial Sequence
  Synthetic
accttataagaacactctgagaaacctcttcgggtccggagattcctttgaacagtacaaccagacaggaattta

SEQ ID NO: 43205 - DNA, 75 bp, Artificial Sequence
  Synthetic
ctcttcgggtccggagattcctttgaacagtacaaccagacaggaatttactctcttaaggaactggtcattgct

SEQ ID NO: 43206 - DNA, 75 bp, Artificial Sequence
  Synthetic
ggattgaagagaaaaggaatttataatagaatcagaatcagatgtcatcttgagccccagttcaattgaaatgat

SEQ ID NO: 43207 - DNA, 75 bp, Artificial Sequence
  Synthetic
atagaatcagaatcagatgtcatcttgagccccagttcaattgaaatgatgcacaatatgaaaaaaattaacaga

SEQ ID NO: 43208 - DNA, 75 bp, Artificial Sequence
  Synthetic
tgagccccagttcaattgaaatgatgcacaatatgaaaaaaattaacagaaatctcagattctctgttgtttacc

SEQ ID NO: 43209 - DNA, 75 bp, Artificial Sequence
  Synthetic
actattgcatcaaaatgcaacgtctgaagaaatttatagccaagagagaaaagggcgataaaggaaagatgaaat

SEQ ID NO: 43210 - DNA, 75 bp, Artificial Sequence
  Synthetic
ggaacagctcgatggattatgactccccccctagttaccaagatgtaagaaggggtattttccctacagcgcctt

SEQ ID NO: 43211 - DNA, 75 bp, Artificial Sequence
  Synthetic
tatttggaatggaagatgacatgatggaatttactccatccctggggatccagacattaaagcttcagtataaat

SEQ ID NO: 43212 - DNA, 75 bp, Artificial Sequence
  Synthetic
gtgtagtgaacatcaatgcgatcaatccattcagagattttcgtgaggcaatatcagccatgcagttctgggaag

SEQ ID NO: 43213 - DNA, 75 bp, Artificial Sequence
  Synthetic
ctgactacagtggatacattgggaagaaaccattttatagagcaataattctccatactgctcggcaattgaaaa

SEQ ID NO: 43214 - DNA, 75 bp, Artificial Sequence
  Synthetic
catccaatccaggtattctcgaccgcggagtggtagaatatcatgcaaccactcaaggacgggcattagttttcc

SEQ ID NO: 43215 - DNA, 75 bp, Artificial Sequence
  Synthetic
acagccttggaccttccccttccatgatgtttgtcccagaaacttttactcgagaatggaatattcttacaaaca

SEQ ID NO: 43216 - DNA, 75 bp, Artificial Sequence
  Synthetic
cgagaatggaatattcttacaaacaaggggacaatcaatgtaaagatttggcttggggaaactgatactctgtca

SEQ ID NO: 43217 - DNA, 75 bp, Artificial Sequence
  Synthetic
gaattggaaccgatcctcaacccggtcaatttccgagacgaccgagaaatgattgaaggggcggcaataatgggc

SEQ ID NO: 43218 - DNA, 75 bp, Artificial Sequence
  Synthetic
tcaatttccgagacgaccgagaaatgattgaaggggcggcaataatgggcttggaaattaaaaagcagaaggaca

SEQ ID NO: 43219 - DNA, 75 bp, Artificial Sequence
  Synthetic
acacatggctgatttctaagagccactgaaatgtaccatatgaaaaaaattaacagaattcctacgaattcagaa

SEQ ID NO: 43220 - DNA, 75 bp, Artificial Sequence
  Synthetic
acatgacttcttcagtgacaattagtgtgatccttcttatctcctttattaccccatcatactcatctttgagta

SEQ ID NO: 43221 - DNA, 75 bp, Artificial Sequence
  Synthetic
tgtgatccttcttatctcctttattaccccatcatactcatctttgagtatagcatttccagaaaacaccaaatt

SEQ ID NO: 43222 - DNA, 75 bp, Artificial Sequence
  Synthetic
accccatcatactcatctttgagtatagcatttccagaaaacaccaaattagattggaagccagtcacaagaaat

SEQ ID NO: 43223 - DNA, 75 bp, Artificial Sequence
  Synthetic
actagatactgccctatgggtggggaatggtttctagaaccagggttacaagaagaatctttcttgagctctaca

SEQ ID NO: 43224 - DNA, 75 bp, Artificial Sequence
  Synthetic
ccaattggtgcgaccccctccaagtcagatggatttctctgtcatgcagccaagtgggtgacaacatgtgatttc

SEQ ID NO: 43225 - DNA, 75 bp, Artificial Sequence
  Synthetic
agatggtatggacccaaatatattacacattcaattcataatatcaaacctacccgatcagattgtgatacagcg

SEQ ID NO: 43226 - DNA, 75 bp, Artificial Sequence
  Synthetic
cttgcatcatataaatccgggacattagtgagccctggttttcccccagagtcttgtggttatgcttctgtgact

SEQ ID NO: 43227 - DNA, 75 bp, Artificial Sequence
  Synthetic
gactccgagttcctggtgatcatgattacccctcatcacgtgggtgtggatgactacagaggacattgggtagat

SEQ ID NO: 43228 - DNA, 75 bp, Artificial Sequence
  Synthetic
cctctttttgttggaggagaatgcgaccagtcttattgtgatactatccacaactcctcagtttggattcctgct

SEQ ID NO: 43229 - DNA, 75 bp, Artificial Sequence
  Synthetic
gatcagactaagaagaacatttgcggccagtcctttaccccactgactgtgacggttgcttatgataaaaccaaa

SEQ ID NO: 43230 - DNA, 75 bp, Artificial Sequence
  Synthetic
gaaatcgctgcaggcgcaatagtctttaagagcaaatatcactctcacatggaaggtgctcgaacttgcagattg

SEQ ID NO: 43231 - DNA, 75 bp, Artificial Sequence
  Synthetic
agttattgcggtcggaacggaattaaattccccaatggagagtgggtcagcctggatgttaaaactaagatacaa

SEQ ID NO: 43232 - DNA, 75 bp, Artificial Sequence
  Synthetic
gagaaacctttacttcccttgtttaaagagtgtcctgctgggacagaggtgagatctactcttcaatccgatggg

SEQ ID NO: 43233 - DNA, 75 bp, Artificial Sequence
  Synthetic
gagatctactcttcaatccgatggggctcaagtcttgacctcggagattcagaggattttggattattctttgtg

SEQ ID NO: 43234 - DNA, 75 bp, Artificial Sequence
  Synthetic
gctcaagtcttgacctcggagattcagaggattttggattattctttgtgtcagaacacgtgggacaaagtagaa

SEQ ID NO: 43235 - DNA, 75 bp, Artificial Sequence
  Synthetic
cgcaaagagccgttgtctccattggatctcagctatttggcatctaaatccccggggaaaggtctggcatataca

SEQ ID NO: 43236 - DNA, 75 bp, Artificial Sequence
  Synthetic
gtgataaatgggacattgtcatttgcccataccagatacgtgaggatgtggattgatggcccggtgttgaaagaa

SEQ ID NO: 43237 - DNA, 75 bp, Artificial Sequence
  Synthetic
atgaaaggcaaaagggaatctcctagtgggatctcgagtgatatttggacccaatggttcaaatatggggatatg

SEQ ID NO: 43238 - DNA, 75 bp, Artificial Sequence
  Synthetic
gagataggcccaaacggcctattaaagacagcaggagggtacaaattcccctggcatctgatcggtatgggaatt

SEQ ID NO: 43239 - DNA, 75 bp, Artificial Sequence
  Synthetic
agacagcaggagggtacaaattcccctggcatctgatcggtatgggaattgttgacaatgaactacacgaggtca

SEQ ID NO: 43240 - DNA, 75 bp, Artificial Sequence
  Synthetic
gtgaggcaaaccctttagaccatccacagctacctcatgctcagtctattgccgacgattcagaggagatcttct

SEQ ID NO: 43241 - DNA, 75 bp, Artificial Sequence
  Synthetic
tcggagacactggggtttccaagaatccagtagaactagttacagggtggttcactagctggaaagagagcttag

SEQ ID NO: 43242 - DNA, 75 bp, Artificial Sequence
  Synthetic
ctgccggtgttgttttgatattggtagttgtcctgatttatggtgtcctccgttgtttcccggtgttgtgtacta

SEQ ID NO: 43243 - DNA, 75 bp, Artificial Sequence
  Synthetic
cctgcagaaagcccaaatggaagaaaggggtagagaggtccgatagctttgagatgcggattttcaagcccaaca

SEQ ID NO: 43244 - DNA, 75 bp, Artificial Sequence
  Synthetic
acatgagagccagagtatgagtaaatgtgagtgaatcacaataatcatacgtttggtgtttacgaagtgcaatat

SEQ ID NO: 43245 - DNA, 75 bp, Artificial Sequence
  Synthetic
gtttggtgtttacgaagtgcaatataaaaatgtgatgtcagactgatatgaaaaaaactattcacagtaaaaccg

SEQ ID NO: 43246 - DNA, 75 bp, Artificial Sequence
  Synthetic
ataacagagataatggatctcaacccggtcgatgatgctgcagagttatcagaggagaacttcttctctgggaaa

SEQ ID NO: 43247 - DNA, 75 bp, Artificial Sequence
  Synthetic
ttgtccaaggaatgccgaattagaggattgaattcagttgattacaatctgaactccccgttggtgtccgatgat

SEQ ID NO: 43248 - DNA, 75 bp, Artificial Sequence
  Synthetic
ttgacatacttgctggacaaatttaagggaaaacctgtgcctatccgatggaagatgaagaaatgggactctatt

SEQ ID NO: 43249 - DNA, 75 bp, Artificial Sequence
  Synthetic
ctagaccaactgcgtaaacatgatctggaatatctgagaccctcggatctacaccaatggtttgcagaatggatg

SEQ ID NO: 43250 - DNA, 75 bp, Artificial Sequence
  Synthetic
ttgtactcaaagcatggcagtaagcagggagaagtcttcttaaagacagtagacgaagaggctagtgatacgttt

SEQ ID NO: 43251 - DNA, 75 bp, Artificial Sequence
  Synthetic
gaggttgtaaggtcgttcataaggggatggactggtggagaaatcaactttatcaggaagagcggaaagcatatg

SEQ ID NO: 43252 - DNA, 75 bp, Artificial Sequence
  Synthetic
gggtattgtgcggagttgtgccagaaattcttagatttgcataaattgaccctccttggaaatgccgccaccgat

SEQ ID NO: 43253 - DNA, 75 bp, Artificial Sequence
  Synthetic
aatgagttgttacaactgagcaaaacctttggggatgacaagatctacaagaaacggctaatcaaacttccgagt

SEQ ID NO: 43254 - DNA, 75 bp, Artificial Sequence
  Synthetic
cctttggggatgacaagatctacaagaaacggctaatcaaacttccgagtcttggtcgcgtcatttttgattctg

SEQ ID NO: 43255 - DNA, 75 bp, Artificial Sequence
  Synthetic
gattcttcatcgtcctggatcagcgagttctaatggatcgtaattttatgttgatgatgaaagacgtaataattg

SEQ ID NO: 43256 - DNA, 75 bp, Artificial Sequence
  Synthetic
gaagaatgcaaacagttctgtccatgattagcagatgtgatgataaattcagttccaaggatattgattttctat

SEQ ID NO: 43257 - DNA, 75 bp, Artificial Sequence
  Synthetic
agttccaaggatattgattttctattaaaggtctactcaacaggcgataagatcatacgaaagttgggtaacgat

SEQ ID NO: 43258 - DNA, 75 bp, Artificial Sequence
  Synthetic
gggtatgagttgatcaagaccgtggaacctatgtgtaatcttcgtctatcagacctagccagaaggttccgtcca

SEQ ID NO: 43259 - DNA, 75 bp, Artificial Sequence
  Synthetic
ctcatacctcctttccctcatttcaggagacatattgaatcgactgtagatgaactgagtgcgaagactccattg

SEQ ID NO: 43260 - DNA, 75 bp, Artificial Sequence
  Synthetic
atcagggaattgttctcattgattgatacttctcctaatgtagattcaacgttggtcgtttacggttcatttcgt

SEQ ID NO: 43261 - DNA, 75 bp, Artificial Sequence
  Synthetic
cattggggtcatccttttattaattattttgaaggcctggagaaattgcataagcaagtgacaatggaaaaagaa

SEQ ID NO: 43262 - DNA, 75 bp, Artificial Sequence
  Synthetic
attttgaaggcctggagaaattgcataagcaagtgacaatggaaaaagaaattgatacaaattattcggaagcgt

SEQ ID NO: 43263 - DNA, 75 bp, Artificial Sequence
  Synthetic
tggccagtgatctggctaggatagtcctgactaaagagttcaatgagaaaaaacaatgggctgtagattaccaca

SEQ ID NO: 43264 - DNA, 75 bp, Artificial Sequence
  Synthetic
gagtgcctacaagccatccctttaaaaaccacatccgagacaacacatggccaacagctgcagtgatccaagatt

SEQ ID NO: 43265 - DNA, 75 bp, Artificial Sequence
  Synthetic
ttggagatcactggcatgagctcccattaattcaatgcttcgacatacctgatctgattgatccatccattatct

SEQ ID NO: 43266 - DNA, 75 bp, Artificial Sequence
  Synthetic
actcagataagagccattccatgaatcgatcagaggtgttaaatcatgtaagaaccaagcctcatacaccgattc

SEQ ID NO: 43267 - DNA, 75 bp, Artificial Sequence
  Synthetic
agaaccaagcctcatacaccgattccaagcaagaaagttttggagagtatgatcgacaaaccagcgacaaattgg

SEQ ID NO: 43268 - DNA, 75 bp, Artificial Sequence
  Synthetic
cttgagtttcttgaagagatagacaaaaatggattatctgatgaagatttggtgatcggattaaaagggaaagaa

SEQ ID NO: 43269 - DNA, 75 bp, Artificial Sequence
  Synthetic
agagaactgaagattgcaggtagatttttttcattgatgtcttggaagcttagggaatactttgttgtcacagag

SEQ ID NO: 43270 - DNA, 75 bp, Artificial Sequence
  Synthetic
tatttgatcaagactcactttgtaccattgttccatgggctgaccatggctgatgatatgacagcagtgatcaaa

SEQ ID NO: 43271 - DNA, 75 bp, Artificial Sequence
  Synthetic
cattgttccatgggctgaccatggctgatgatatgacagcagtgatcaaaaagatgctggaaagctcgtctggtc

SEQ ID NO: 43272 - DNA, 75 bp, Artificial Sequence
  Synthetic
tgatgatatgacagcagtgatcaaaaagatgctggaaagctcgtctggtcaagggttaacaaactatgacagcgt

SEQ ID NO: 43273 - DNA, 75 bp, Artificial Sequence
  Synthetic
ttgtattgcaaatcatattgactatgaaaaatggaataatcatcaacgaaaattgtccaatggacctgtgtttaa

SEQ ID NO: 43274 - DNA, 75 bp, Artificial Sequence
  Synthetic
agtcatgggacaatttttgggttatccaaatttgatataccggacacatgagttttttgagaaaagtttaattta

SEQ ID NO: 43275 - DNA, 75 bp, Artificial Sequence
  Synthetic
ctataatgaaagaccggatctcatgaaagtcagaaatgggatcttagaaaatagcacacatcagagggtttgctg

SEQ ID NO: 43276 - DNA, 75 bp, Artificial Sequence
  Synthetic
gaatggacaggcaggtggtttagaaggtttgagacagaaaggatggagtattcttaatctgctggtcatacagag

SEQ ID NO: 43277 - DNA, 75 bp, Artificial Sequence
  Synthetic
agaagcgaaaattcggaataccgcagttaaagtgctagcacaaggcgacaatcaagtcatatgtacgcagtacaa

SEQ ID NO: 43278 - DNA, 75 bp, Artificial Sequence
  Synthetic
gaccaaacaatatcgaaacgatatcgagttgagacaagccttaaaccaaatggcagcaaacaatgatgtcatcat

SEQ ID NO: 43279 - DNA, 75 bp, Artificial Sequence
  Synthetic
gaaggccatagagtcaggaaccaataagttgggtttgttgatcaatcaggatgagacgatgcaatctgctgatta

SEQ ID NO: 43280 - DNA, 75 bp, Artificial Sequence
  Synthetic
aagttgggtttgttgatcaatcaggatgagacgatgcaatctgctgattatctgaattatgggaaggtacctatc

SEQ ID NO: 43281 - DNA, 75 bp, Artificial Sequence
  Synthetic
atgagacgatgcaatctgctgattatctgaattatgggaaggtacctatctttagaggggtaatcagagggctgg

SEQ ID NO: 43282 - DNA, 75 bp, Artificial Sequence
  Synthetic
aaacaaagcgatggtcccgggtcacttgtgtgacaaatgaccaattaccaacgtgtgcaaatctcatgtcatctg

SEQ ID NO: 43283 - DNA, 75 bp, Artificial Sequence
  Synthetic
acgtgtgcaaatctcatgtcatctgtatctacaaatgctttgacagtggcacatttcgatgtacacccattgaat

SEQ ID NO: 43284 - DNA, 75 bp, Artificial Sequence
  Synthetic
gcaatgattcaatttaacttcttcgggaatttcgctcggcttctcttgattatgcacgatccggcgattcgacaa

SEQ ID NO: 43285 - DNA, 75 bp, Artificial Sequence
  Synthetic
tatgcacgatccggcgattcgacaatcattgaatcagttgaaaggaccaaacatcaatgtccattcatatgggtt

SEQ ID NO: 43286 - DNA, 75 bp, Artificial Sequence
  Synthetic
caaagttgcaatgttgtacttggacccttcaataggaggagtgtgtggtacagccctttctcgatttttgattag

SEQ ID NO: 43287 - DNA, 75 bp, Artificial Sequence
  Synthetic
gagtttccctgatcctgtgacggagagtctctcattttggaagcttatccatcatagcaccagtgatatcagatt

SEQ ID NO: 43288 - DNA, 75 bp, Artificial Sequence
  Synthetic
aaaaaatctctcagaacagtttggcaatcctaagatagcagtttttagagaatctcacatagaaaagttgttgga

SEQ ID NO: 43289 - DNA, 75 bp, Artificial Sequence
  Synthetic
agatcctactagtttgaatatatcgatgggaatgagtgctgcaaatttgttgaaaacagagataaagaaaaatct

SEQ ID NO: 43290 - DNA, 75 bp, Artificial Sequence
  Synthetic
cctacaaaagaaatcgagcataggcaaccagatagtcaaagacgccgtatactacatacactctgaagatgagaa

SEQ ID NO: 43291 - DNA, 75 bp, Artificial Sequence
  Synthetic
attgagaacttttttgtggtccatcactccgttgtttcctcggtttctgagcgaatttaaagcagggacgttcat

SEQ ID NO: 43292 - DNA, 75 bp, Artificial Sequence
  Synthetic
actccgttgtttcctcggtttctgagcgaatttaaagcagggacgttcatgggagtagcgagcagcattgtctct

SEQ ID NO: 43293 - DNA, 75 bp, Artificial Sequence
  Synthetic
ttgttccaaaactctcggaccattcgaaatgttttcagagactatatgagtcaaacaattgatgacttgattgtc

SEQ ID NO: 43294 - DNA, 75 bp, Artificial Sequence
  Synthetic
aagagtgaactaacatctctggagcatttgtctaactatactgacaggaaagggagtggtgggatctggagttgc

SEQ ID NO: 43295 - DNA, 75 bp, Artificial Sequence
  Synthetic
tctgcggaacaggctgacaaacttagaagaatgtcctggaagcgtccagtgctagggacaacagttcctcacccg

SEQ ID NO: 43296 - DNA, 75 bp, Artificial Sequence
  Synthetic
ttggaaatgcacggaaggggaacactgaaatctccgctatccaagtgttgcaaggagtctcgaatggattatatt

SEQ ID NO: 43297 - DNA, 75 bp, Artificial Sequence
  Synthetic
tctgtccatattcctgaaggattgaacaaagttttggatggccgaggaagcctaccagcatatttgggttcaaaa

SEQ ID NO: 43298 - DNA, 75 bp, Artificial Sequence
  Synthetic
acatcagagtctacctcgattctccagccttgggagaaggaaagcaaaattcccattataagaagagctactaga

SEQ ID NO: 43299 - DNA, 75 bp, Artificial Sequence
  Synthetic
ctacgggatgcgattcattggtttgtggatccggacagtaacttagcccgaagcatattgaacaatattgagtcc

SEQ ID NO: 43300 - DNA, 75 bp, Artificial Sequence
  Synthetic
ttaactggagaaaagtgggaaggagctttaaaaggatataagagaacgggttctgccctccatagattttccacc

SEQ ID NO: 43301 - DNA, 75 bp, Artificial Sequence
  Synthetic
ttctgccctccatagattttccacctcgagggtaagccatggtggtttttcttcacaaagtcctgcatgtctcac

SEQ ID NO: 43302 - DNA, 75 bp, Artificial Sequence
  Synthetic
cttcacaaagtcctgcatgtctcaccagaatgatggcaactacagacaccatgcgtgattacgctcagctcaatt

SEQ ID NO: 43303 - DNA, 75 bp, Artificial Sequence
  Synthetic
atgacttcatgttccaagcaagtcttctctactctcaaatgaccagctccgtcattttaatgggaaccactgtct

SEQ ID NO: 43304 - DNA, 75 bp, Artificial Sequence
  Synthetic
caaacaccattcatttccatgttgcctgtcgaaaatgtatccgagaaatcacagagccgatgttagaaagtccta

SEQ ID NO: 43305 - DNA, 75 bp, Artificial Sequence
  Synthetic
gagagtacagagggaaggacgttcatttagtcctggcaaaatggaagaattcttcaaatggttggggagaaaccc

SEQ ID NO: 43306 - DNA, 75 bp, Artificial Sequence
  Synthetic
tccaactactaaagccagttgagggagattgggacactatccctcctgttgaaaaatcttatcatgtgggtagga

SEQ ID NO: 43307 - DNA, 75 bp, Artificial Sequence
  Synthetic
tcttgggttttctttatggtgacctaaagagtcaaaattccagtcgtgcagacgacagttcaatcttccccctca

SEQ ID NO: 43308 - DNA, 75 bp, Artificial Sequence
  Synthetic
gcattcaaatgagattaagaggtcgaggctttttacgaggaatccttgacggattagtccgggctagtgcttgtc

SEQ ID NO: 43309 - DNA, 75 bp, Artificial Sequence
  Synthetic
aggctttttacgaggaatccttgacggattagtccgggctagtgcttgtcaggttatccacaggcgaagtgttgc

SEQ ID NO: 43310 - DNA, 75 bp, Artificial Sequence
  Synthetic
tttactttcaaaaccagcaaatgcaatttatggaggattgatttacttgatagacaagataagtgcatccacctc

SEQ ID NO: 43311 - DNA, 75 bp, Artificial Sequence
  Synthetic
gtttacgacactgtgtagggacggacccattagagaagaactatcatctatacctcacaaaattcctacttcgta

SEQ ID NO: 43312 - DNA, 75 bp, Artificial Sequence
  Synthetic
tccaacttcaaattcagatatgggactccacatcagaaattatttgaagtttcagtgcaagacagtcgaattggg

SEQ ID NO: 43313 - DNA, 75 bp, Artificial Sequence
  Synthetic
aaaatatcaatctgatataaaggatttatggttgttctcggatgtgatgacgtcgaatattgcaggaccctttgc

SEQ ID NO: 43314 - DNA, 75 bp, Artificial Sequence
  Synthetic
attgtctacaaaaattttgaagtgcttatacaagcccgctttgtcccagaaagatcgaaataatatcaggaagat

SEQ ID NO: 43315 - DNA, 75 bp, Artificial Sequence
  Synthetic
cagcaatttctctaagatgatgcgatcacaattgaactgggaccccacaagctctgaatttattacatctcaaat

SEQ ID NO: 43316 - DNA, 75 bp, Artificial Sequence
  Synthetic
tcacaattgaactgggaccccacaagctctgaatttattacatctcaaatcctagtatgcaatgaggagattagg

SEQ ID NO: 43317 - DNA, 75 bp, Artificial Sequence
  Synthetic
catgcatgcaagtttggaattccaaaattatcacttaagtttgatgatccagtctggggacccgaggattatgga

SEQ ID NO: 43318 - DNA, 75 bp, Artificial Sequence
  Synthetic
ttgatctggtccattccagttgattattccagtcaatcagttccaaagaacttgaagccctgtcctagaattcaa

SEQ ID NO: 43319 - DNA, 75 bp, Artificial Sequence
  Synthetic
attccagtcaatcagttccaaagaacttgaagccctgtcctagaattcaaaaccctagcatatccggttttaggt

SEQ ID NO: 43320 - DNA, 75 bp, Artificial Sequence
  Synthetic
taggacaacttccaacaggagctcattacaagctgagatcaatcctaaggaagaaaaatatacattacagggatg

SEQ ID NO: 43321 - DNA, 75 bp, Artificial Sequence
  Synthetic
ttacaagctgagatcaatcctaaggaagaaaaatatacattacagggatgcattgtgtgggggtgatgggtcagg

SEQ ID NO: 43322 - DNA, 75 bp, Artificial Sequence
  Synthetic
aggtatgacagcggcagttctacgttataatctaaaggccagggccatatttaatagcatccttgattttgatgg

SEQ ID NO: 43323 - DNA, 75 bp, Artificial Sequence
  Synthetic
atcaacaatgaagggagcttcaccagatccacctagtgcattggaaacagtggtgaacggccggactcggtgcgt

SEQ ID NO: 43324 - DNA, 75 bp, Artificial Sequence
  Synthetic
caacgcggagagttgttgggagaacccgtcagatctgagtgaacagagaacatgggattatttcaaattcttgaa

SEQ ID NO: 43325 - DNA, 75 bp, Artificial Sequence
  Synthetic
aacccatcacggattaaagatagacctgattgtattggacatggaggtgagagactttgcaatctcggcatccat

SEQ ID NO: 43326 - DNA, 75 bp, Artificial Sequence
  Synthetic
agagaagtgtgtccgaaacaatgtatcgtcaatattggaagaagacggagtcctaatatacaagacctatggatc

SEQ ID NO: 43327 - DNA, 75 bp, Artificial Sequence
  Synthetic
aacaattgcagcggaaagtagcaatgcagttgtaaatattggagtattgtttgagagcgtagagttgattcagac

SEQ ID NO: 43328 - DNA, 75 bp, Artificial Sequence
  Synthetic
ttgagagcgtagagttgattcagacggagtatagcagtacatccacttcagaagtgtacatgtattgccgaaaga

SEQ ID NO: 43329 - DNA, 75 bp, Artificial Sequence
  Synthetic
ggagtatagcagtacatccacttcagaagtgtacatgtattgccgaaagattaagagatttgtggacgctcctca

SEQ ID NO: 43330 - DNA, 75 bp, Artificial Sequence
  Synthetic
cccagattggatatcacttgattattattggagcaaattattttgctttagaagttacaaagaagaattcttccg

SEQ ID NO: 43331 - DNA, 75 bp, Artificial Sequence
  Synthetic
atcctacgaagtgtctcgtaaagaatccctaaaaggaatacccaattcattcatccctgacccattggtcaatct

SEQ ID NO: 43332 - DNA, 75 bp, Artificial Sequence
  Synthetic
agagacattacttcagatagcaggagttccttctgggatatcacaccagttggcaattgatattaaggaatcaca

SEQ ID NO: 43333 - DNA, 75 bp, Artificial Sequence
  Synthetic
gctgactcagatcaccgctgcaatggtgctttgcggaatgatcgcaaactacactttggatgtgacaaaaaagag

SEQ ID NO: 43334 - DNA, 75 bp, Artificial Sequence
  Synthetic
agattcatacaatcctccttccgacggaagattaattcgaatgagtgctgctttggtcggaataagtttctggat

SEQ ID NO: 43335 - DNA, 75 bp, Artificial Sequence
  Synthetic
ttccgtcaagtattatgacaaagagttgaatttcgaattggaacagatattatccagatcatttcccataaggtg

SEQ ID NO: 43336 - DNA, 75 bp, Artificial Sequence
  Synthetic
gatgctttcacgcaactatttattctggacaacaaaaaagggttttaggaatgcaaaagacgtaagactatctgg

SEQ ID NO: 43337 - DNA, 75 bp, Artificial Sequence
  Synthetic
tggacaacaaaaaagggttttaggaatgcaaaagacgtaagactatctgggaatatggctaatatagggaattgg

SEQ ID NO: 43338 - DNA, 75 bp, Artificial Sequence
  Synthetic
atgcaaaagacgtaagactatctgggaatatggctaatatagggaattggattcgatgtatggagctcctccatc

SEQ ID NO: 43339 - DNA, 75 bp, Artificial Sequence
  Synthetic
tccccccgggatccctgtccaaggatgaggtcacgaccacttgcgggaaatacattagaagcttgaagtattctg

SEQ ID NO: 43340 - DNA, 75 bp, Artificial Sequence
  Synthetic
tcatactccaacagaccgggatcattgatttgtggaaatcaagggtcgcaagtgatgatcgatcattgatggagg

SEQ ID NO: 43341 - DNA, 75 bp, Artificial Sequence
  Synthetic
tgatttgtggaaatcaagggtcgcaagtgatgatcgatcattgatggaggtcaagaccgaattcattgaatctga

SEQ ID NO: 43342 - DNA, 75 bp, Artificial Sequence
  Synthetic
agtgatgatcgatcattgatggaggtcaagaccgaattcattgaatctgagcattgggtagattaaccatatgaa

SEQ ID NO: 43343 - DNA, 75 bp, Artificial Sequence
  Synthetic
atgaaaaaaactaaggatgataaagcaccatgttgtgtacaatttaatcgtataactggttttgttttcttcgta

SEQ ID NO: 43344 - DNA, 75 bp, Artificial Sequence
  Synthetic
atgagttctaaggtattctgcattgctacaggccagacagtttccgtgtgtcttccagctaatgaagacccggtg

SEQ ID NO: 43345 - DNA, 75 bp, Artificial Sequence
  Synthetic
gaatttccaagcgccttcttcactcctaatgctaaaaaacctacagtctacatcaagaaggaggcagatctgagc

SEQ ID NO: 43346 - DNA, 75 bp, Artificial Sequence
  Synthetic
cagctaaggagtcatgtctacaacgggctcaaagacgggacagtggtgatttctcacatcaattcctacctctac

SEQ ID NO: 43347 - DNA, 75 bp, Artificial Sequence
  Synthetic
ctggtgctcaaggagatcaaggagaaaccggacaagaattggacctcattcggagtggatttggggaagaagaat

SEQ ID NO: 43348 - DNA, 75 bp, Artificial Sequence
  Synthetic
gagccgatgggaatatttgatctcctcaacgtagaggatatcaacgggcagacccttgacaagaagggccaggat

SEQ ID NO: 43349 - DNA, 75 bp, Artificial Sequence
  Synthetic
actagattgcctggagatgacaagtggcttccaacactaatcttcggactctaccgtgtgtccagagctactcag

SEQ ID NO: 43350 - DNA, 75 bp, Artificial Sequence
  Synthetic
gtcgagtacaagaaaacactaatgactaacttgtacgctcaatgtaagatgagaactaaggatgcagaggaaatt

SEQ ID NO: 43351 - DNA, 75 bp, Artificial Sequence
  Synthetic
gtggatgagacggcagagttcttcaatgcctgggcaaatgactctaattttaccaagattgttgctgctgtggac

SEQ ID NO: 43352 - DNA, 75 bp, Artificial Sequence
  Synthetic
atgtacttccacttcttcaaaaagagtgatcatgcccctatcagatttggaactattgtgtcccgatttaaggac

SEQ ID NO: 43353 - DNA, 75 bp, Artificial Sequence
  Synthetic
tgtgctgctctatccactttgtcacacttacaaaaggtgacagggctcccagttgaggaagtgtttacatgggtc

SEQ ID NO: 43354 - DNA, 75 bp, Artificial Sequence
  Synthetic
ttcaataaatcagtgcaagatgacctcttgagaatgatgacccctggtcaggagatcgatcaggcagattcttat

SEQ ID NO: 43355 - DNA, 75 bp, Artificial Sequence
  Synthetic
atgccgtacttgattgatatggggttgtccacaaagtccccgtactcctcgactaaaaatcccagttttcacttc

SEQ ID NO: 43356 - DNA, 75 bp, Artificial Sequence
  Synthetic
tggggtcaactgactgcattcttggtgaaatctgccagagcaaagaatgctcttgttccggtagatattgcatac

SEQ ID NO: 43357 - DNA, 75 bp, Artificial Sequence
  Synthetic
catgagcttactacagcggctcttctgttcgcatacgcaatgggcagatcctccgagctagaacagagatttgtt

SEQ ID NO: 43358 - DNA, 75 bp, Artificial Sequence
  Synthetic
ctaaacgggagaaaattcacgaaagaagcagggtcgagggatgaagatgataatactccaccatcagagagaaat

SEQ ID NO: 43359 - DNA, 75 bp, Artificial Sequence
  Synthetic
gtggtggtgtggctagcttggtgggaagatgtgaagcatgaagtcactcctgacatgaaagcattcgccaaacgg

SEQ ID NO: 43360 - DNA, 75 bp, Artificial Sequence
  Synthetic
gcggtggagcgagttggagacatcagagtaaactctattgcagagtatgccagaaggctcttcgcatgatcacat

SEQ ID NO: 43361 - DNA, 75 bp, Artificial Sequence
  Synthetic
atgaaaaaaactaacagagatcatggaagactctcaactttttcaagcacttaagaattatcccaaattgcagga

SEQ ID NO: 43362 - DNA, 75 bp, Artificial Sequence
  Synthetic
tactctcgattcaattgagaatttggaggatgatgtcaaatcaaattcctccgaatgtggatctcccactgaccg

SEQ ID NO: 43363 - DNA, 75 bp, Artificial Sequence
  Synthetic
agggatacccagttattatctggcagaagaattggatgattgcgaagaggaaaactcagaggatgaggatgatga

SEQ ID NO: 43364 - DNA, 75 bp, Artificial Sequence
  Synthetic
ctttcctgaagaggtgccagatcctccaaatgttgatatgcttgagtcaattatggaagatgaaattgatgacac

SEQ ID NO: 43365 - DNA, 75 bp, Artificial Sequence
  Synthetic
ggcttatcaggtacattttgaggctaaaaagtcttggataccaattatcgaggacaaggagtcgggaaaagacaa

SEQ ID NO: 43366 - DNA, 75 bp, Artificial Sequence
  Synthetic
gttcatactgtctgtcccgcaaaacttaagcgctctccagctcctgcaatgggagtcaggaattcacgctcttgc

SEQ ID NO: 43367 - DNA, 75 bp, Artificial Sequence
  Synthetic
tgaaaaactggggggatgtaggctgatcaagatcagtaccaagggtacgaaagatggaatcgaattcacagtacg

SEQ ID NO: 43368 - DNA, 75 bp, Artificial Sequence
  Synthetic
cgagaccccaagcgtttctcctgctcctgatccagttccgtccaattcccggtcaagctcaatctcatccagtgt

SEQ ID NO: 43369 - DNA, 75 bp, Artificial Sequence
  Synthetic
ctcaactcggcacactgactcccctggatctcgatccaacaccagtctgggaatcccagaggtgccagccaactt

SEQ ID NO: 43370 - DNA, 75 bp, Artificial Sequence
  Synthetic
ggttgacactggggccatagacagggaatttattctcagtccaatggcccctacagatccaccttacaaaaacac

SEQ ID NO: 43371 - DNA, 75 bp, Artificial Sequence
  Synthetic
actgagatcattgtttggatcaggggaatcatttgaacagtacaataaaactggcatctactctcttaaagaact

SEQ ID NO: 43372 - DNA, 75 bp, Artificial Sequence
  Synthetic
cgtcattgcaggcctcaaaaggaaagggatatataatagaattcgaatccgttgtgacttggagccccagtttgt

SEQ ID NO: 43373 - DNA, 75 bp, Artificial Sequence
  Synthetic
gtgatttgtaaatacatatgaaaaaaatcaacagaaatcccagattctctgttattttgactccggctggcaata

SEQ ID NO: 43374 - DNA, 75 bp, Artificial Sequence
  Synthetic
tgcaaagactcaagaagttcattgctcggaaagaaaagggtgataaaggtaagatgaaatggaccaataccatgg

SEQ ID NO: 43375 - DNA, 75 bp, Artificial Sequence
  Synthetic
attatgattctccccccagttaccaggatgctaggagggggattttcccgtctgcgcccttgtttggaatggatg

SEQ ID NO: 43376 - DNA, 75 bp, Artificial Sequence
  Synthetic
ataacatgatggagtattccccatctttagggattcagactctcaagattcagtacaagtgtgtggtaaatatca

SEQ ID NO: 43377 - DNA, 75 bp, Artificial Sequence
  Synthetic
acgccatcaatccattcaaggattttcgtgaggcaatctcggccatgcagttttgggaggccgattatggtgggt

SEQ ID NO: 43378 - DNA, 75 bp, Artificial Sequence
  Synthetic
acatcgggaagaaaccattttaccgggctataatactgcacacagcaagacaactcaaaacatccaatccaggaa

SEQ ID NO: 43379 - DNA, 75 bp, Artificial Sequence
  Synthetic
tcctggatcgaggagtggtcgaatatcatgccacaactcaggggcgagcattagtttttcacagtctgggtcccg

SEQ ID NO: 43380 - DNA, 75 bp, Artificial Sequence
  Synthetic
caccgtccatgatgtttgtaccagaaacattcactcgggaatggaacatcctcactaataaggggacaatcaatg

SEQ ID NO: 43381 - DNA, 75 bp, Artificial Sequence
  Synthetic
tcaagatttggctgggtgagactgacaccctatctgaactggagccaatcttgaatccagttcattatcgggatg

SEQ ID NO: 43382 - DNA, 75 bp, Artificial Sequence
  Synthetic
acagggagatgatcgaaggggcagctataatggggttggaaatcaagaaacagaaagacaacacctggctgattt

SEQ ID NO: 43383 - DNA, 75 bp, Artificial Sequence
  Synthetic
caaaaagttattagagtgtattatatgaaaaaaactaacagagttccaacgaattctacaaaatgttgtcccaag

SEQ ID NO: 43384 - DNA, 75 bp, Artificial Sequence
  Synthetic
tgacttttcaactccttgttgttgggtgtttaatttgccaagcgtactcatccctgagtatagcctttccagaaa

SEQ ID NO: 43385 - DNA, 75 bp, Artificial Sequence
  Synthetic
gcaccaaattggactggaaacctgtgaccaagaacaccaggtactgtcccatgggaggtgaatggttcttagatc

SEQ ID NO: 43386 - DNA, 75 bp, Artificial Sequence
  Synthetic
ctggactacaggaagaatcatttcccagctccactccaattggtgctactccatcaaaatcagatgggttcttat

SEQ ID NO: 43387 - DNA, 75 bp, Artificial Sequence
  Synthetic
gtcatgcagccaagtgggttactacctgcgatttccgttggtatggcccgaagtacattacccactcaattcaca

SEQ ID NO: 43388 - DNA, 75 bp, Artificial Sequence
  Synthetic
acatcaaacccactcgctcagactgcgactccgccttggcatcatacaagtccggcactttaattaatccaggat

SEQ ID NO: 43389 - DNA, 75 bp, Artificial Sequence
  Synthetic
tcccccctgactcctgtggatatgcctcggtcacagattcagagtttcttgtgattatgatcactcctcatcatg

SEQ ID NO: 43390 - DNA, 75 bp, Artificial Sequence
  Synthetic
ttggagtggatgactacaggggccactgggtagacccgttatttgttggaggagagtgtgaccagtcgtactgtg

SEQ ID NO: 43391 - DNA, 75 bp, Artificial Sequence
  Synthetic
atacaattcacaattcctctgtctggatcccagcggacacaaaaaagaagaatatctgtggccagtcatttactc

SEQ ID NO: 43392 - DNA, 75 bp, Artificial Sequence
  Synthetic
ctttaacagtaacagttgcctatgataagacgaaagatattacagcaggggctcttgtcttcaagagcaagtatc

SEQ ID NO: 43393 - DNA, 75 bp, Artificial Sequence
  Synthetic
actcccacatggagggagcgaggacttgcagactgacatactgcggaaggacaggtataaaattccccaacggag

SEQ ID NO: 43394 - DNA, 75 bp, Artificial Sequence
  Synthetic
agtgggtgagcttagatgtcaaaaccaaaatccaggagaagcaacttcttcctctcttcaaggaatgccctgcag

SEQ ID NO: 43395 - DNA, 75 bp, Artificial Sequence
  Synthetic
gaactgaagtaaggtcgacattgcaatcggatggagcccaggtgttgacgtccgagattcaacggctattggatt

SEQ ID NO: 43396 - DNA, 75 bp, Artificial Sequence
  Synthetic
actctttgtgccaaaacacttgggagaaggtggacagaaaagaacctctttctccattggatctcagttacctag

SEQ ID NO: 43397 - DNA, 75 bp, Artificial Sequence
  Synthetic
cctccaaatctcctggaaagggtcttgcttatacggtgataaacgggactctatcatttgctcatactagatatg

SEQ ID NO: 43398 - DNA, 75 bp, Artificial Sequence
  Synthetic
tcaggatgtggattgatggtcctgtgcttaaagaactgaaggggaagagagagtccgcaagcggaatcgccagtg

SEQ ID NO: 43399 - DNA, 75 bp, Artificial Sequence
  Synthetic
acatttggactcaatggttcaaatatggagatatggaaatcgggcctaatggacttttgaaaaccaaaagcggat

SEQ ID NO: 43400 - DNA, 75 bp, Artificial Sequence
  Synthetic
ataaattcccttggcatctgatcgggatgggaattgtggacaacgaactgcatgagttgagtgaagctaatccac

SEQ ID NO: 43401 - DNA, 75 bp, Artificial Sequence
  Synthetic
ttgaccaccctcaacttcctcatgcccaatctatagccgatgactcggaggagatcttcttcggagataccggag

SEQ ID NO: 43402 - DNA, 75 bp, Artificial Sequence
  Synthetic
tctcgaaaaatccagtggaattagttacaggatggttcacaagctggaaggagagtttggcagcaggagttgtcc

SEQ ID NO: 43403 - DNA, 75 bp, Artificial Sequence
  Synthetic
tcatcttgactgtggtccttatctacggagttctccgttgtttcccagtgctatgcatgccatgcaagaaaccaa

SEQ ID NO: 43404 - DNA, 75 bp, Artificial Sequence
  Synthetic
agtggaaaaagggagtggagagatctgacagctttgagatgcggatctttaagccaaataatatgcgggctcgcg

SEQ ID NO: 43405 - DNA, 75 bp, Artificial Sequence
  Synthetic
tgtgattttggtttatcaactgagttaaccagaaattggttgtgataacagagtgcaatattatcatgtgataat

SEQ ID NO: 43406 - DNA, 75 bp, Artificial Sequence
  Synthetic
gaatgatatgaaaaaaactattttaagtaggtacaaaaacaataatattcaacagagataatggatctcaaccct

SEQ ID NO: 43407 - DNA, 75 bp, Artificial Sequence
  Synthetic
gtggatgatgttgccgagatatctgaggagaacttcttctcaggtaaattggcaaaagagtgcagaataagagga

SEQ ID NO: 43408 - DNA, 75 bp, Artificial Sequence
  Synthetic
ttgaattcagttgattacaatctgaattcccctttggtggctgacgatctaacgtatctgttggataaattgaga

SEQ ID NO: 43409 - DNA, 75 bp, Artificial Sequence
  Synthetic
ggaaagccagtgccgatcagatggaaaatgaagaaatgggattcgatattggatcggctaaggaaacatgaagta

SEQ ID NO: 43410 - DNA, 75 bp, Artificial Sequence
  Synthetic
gattatcttagaccgtaccaactgcatcagtggtttgctgagtggatgttacactcaaaccatgagagcaagcaa

SEQ ID NO: 43411 - DNA, 75 bp, Artificial Sequence
  Synthetic
ggagaggagttcttaagaactgtggacagtgaggcaagtgaaacatttgaagtcgttaagtcgtttgtgagaggg

SEQ ID NO: 43412 - DNA, 75 bp, Artificial Sequence
  Synthetic
tggactggtggtgaggtaaattttgtaaagaagagtggaaagcatatgggatattgtgcggatttatgtcagaaa

SEQ ID NO: 43413 - DNA, 75 bp, Artificial Sequence
  Synthetic
tttctagacctacataaactcaccttacttattaatgcagctacagatcaagaactgttacaattgagcagaaca

SEQ ID NO: 43414 - DNA, 75 bp, Artificial Sequence
  Synthetic
tttggagaccctaaaatctataaaaagagaatgatcaagcttccaagtttgggacgagttatctttgactctggg

SEQ ID NO: 43415 - DNA, 75 bp, Artificial Sequence
  Synthetic
ttttttattgtcatggatcagagggtattaatggacagaaacttcatgctaatgatgaaggacgtgattatcgga

SEQ ID NO: 43416 - DNA, 75 bp, Artificial Sequence
  Synthetic
agaatgcagactgtcctgtctatgatcagcagatgtgatgataagttcgtgacaggagacattgacttcttgaga

SEQ ID NO: 43417 - DNA, 75 bp, Artificial Sequence
  Synthetic
aatgtttattctgtgggagacaagataatcaagaaactaggtaatgatggatacgagctcatcaaaacagtggaa

SEQ ID NO: 43418 - DNA, 75 bp, Artificial Sequence
  Synthetic
ccaatgtgcaacttgagattgtcggatttggccagaaagttccgccccttaataccagcattccctcatttcagg

SEQ ID NO: 43419 - DNA, 75 bp, Artificial Sequence
  Synthetic
aggcatatagagacaaccgtcagtgagctgaccgcaaagactactctgatcaaggagttgttttctttgatcgat

SEQ ID NO: 43420 - DNA, 75 bp, Artificial Sequence
  Synthetic
aactctcctaatgtcgattctacactagtagtgtatggctctttccgtcattggggacaccctttcatcaattac

SEQ ID NO: 43421 - DNA, 75 bp, Artificial Sequence
  Synthetic
tttgagggtttggaaaagttgcacaagcaggtgactatggagaaggaaattgatgtatcttactcagaagctttg

SEQ ID NO: 43422 - DNA, 75 bp, Artificial Sequence
  Synthetic
gcaagtgatctggccagaattgtgttgacaaaagaattcaatgagaagaaacaatgggctgtagactatcatcgg

SEQ ID NO: 43423 - DNA, 75 bp, Artificial Sequence
  Synthetic
gtccccgctaatcacccgtttaaaaatcacattcgtgacaatacctggccgactgcagcagtgattcaagatttc

SEQ ID NO: 43424 - DNA, 75 bp, Artificial Sequence
  Synthetic
ggagatcattggcatgagttaccattgatccagtgttttgacatcccagatttgatcgatccttcaatcatttac

SEQ ID NO: 43425 - DNA, 75 bp, Artificial Sequence
  Synthetic
tcagacaaaagtcattccatgaatagatccgaggtattgaatcatgtcagaacaaaacctcatgctcccattccc

SEQ ID NO: 43426 - DNA, 75 bp, Artificial Sequence
  Synthetic
agcaagaaggtgttggaaagtatgatagacaagcctgccacaaattggttggaattcctggacgaggtggataag

SEQ ID NO: 43427 - DNA, 75 bp, Artificial Sequence
  Synthetic
aatggtttatctgatgaggacttggtcatcggcttgaaaggtaaggaaagagaattaaaaatagcagggaggttc

SEQ ID NO: 43428 - DNA, 75 bp, Artificial Sequence
  Synthetic
ttttctttgatgtcatggagactcagggagtattttgtggttactgaatacctaatcaagacacattttgtccca

SEQ ID NO: 43429 - DNA, 75 bp, Artificial Sequence
  Synthetic
ttgttccacggactaacaatggcagatgatatgactgctgtgatcaaaaagatgctggagagctcatcaggacag

SEQ ID NO: 43430 - DNA, 75 bp, Artificial Sequence
  Synthetic
gggctcactaattatgaaagtgtatgtatcgctaatcacatagattatgagaaatggaataatcatcagcggaaa

SEQ ID NO: 43431 - DNA, 75 bp, Artificial Sequence
  Synthetic
ttgtctaatggccctgtctttcgggtaatggggcaattccttggatacccaaatttgatctacaggactcacgag

SEQ ID NO: 43432 - DNA, 75 bp, Artificial Sequence
  Synthetic
ttttttgagaaaagtttgatttattacaatgaacgtccagacctcatgaaggtcaagaatgggattctagaaaat

SEQ ID NO: 43433 - DNA, 75 bp, Artificial Sequence
  Synthetic
agcaccccgcaaagggtctgctggaatggtcaggcgggtggactagaaggtttaaggcagaaaggttggagtatt

SEQ ID NO: 43434 - DNA, 75 bp, Artificial Sequence
  Synthetic
ctcaatttacttgtaatacagagagaggcaaagatcagaaacacagcggtcaaagtgttagctcagggtgacaac

SEQ ID NO: 43435 - DNA, 75 bp, Artificial Sequence
  Synthetic
caggttatatgcactcaatacaaaacaaagcagtttcgcaatgatactgagctgcgacaggccttaaaacagatg

SEQ ID NO: 43436 - DNA, 75 bp, Artificial Sequence
  Synthetic
gctgccaataatgatgtaattatgcaagcaatagagtcaggaacaaacaaattaggacttttaataaaccaagat

SEQ ID NO: 43437 - DNA, 75 bp, Artificial Sequence
  Synthetic
gaaacaatgcaatccgcagattacctgaattatggcaaagttcccatctttagaggcgtaatccgaggccttgag

SEQ ID NO: 43438 - DNA, 75 bp, Artificial Sequence
  Synthetic
actaagcgctggtcccgggtgacgtgtgtgacaaatgaccaattaccgacttgtgcaaatttaatgtcttcggtt

SEQ ID NO: 43439 - DNA, 75 bp, Artificial Sequence
  Synthetic
tccacaaatgcattgacagttgctcattttgatgttcatcctttgaatgcaatgattcagttcaatttttttgga

SEQ ID NO: 43440 - DNA, 75 bp, Artificial Sequence
  Synthetic
aattttgctcgtttattgcttgttatgcatgacccagctatcaggaggtctttgacacaactcgagaagacgacc

SEQ ID NO: 43441 - DNA, 75 bp, Artificial Sequence
  Synthetic
atcaatgtggattcttttggtttcaaaattgccatgttgtacctagatccttcaatagggggtgtatgtggaaca

SEQ ID NO: 43442 - DNA, 75 bp, Artificial Sequence
  Synthetic
gccttgtcgcgatttttaatccgaagctttccagatcctgtgacggaaagtctctcattttggaaggttatatat

SEQ ID NO: 43443 - DNA, 75 bp, Artificial Sequence
  Synthetic
cacagcactaccgatgcaagactgaagaatctcgcggagcagtttggaaatcccaaaatagcgatatttagggag

SEQ ID NO: 43444 - DNA, 75 bp, Artificial Sequence
  Synthetic
tcccacatcgaaaagctgttagaggacccgacaagtttgaacatctccatgggtatgagtgctgcgaacttattg

SEQ ID NO: 43445 - DNA, 75 bp, Artificial Sequence
  Synthetic
aaaacggagataaagaagaacttgctccagaggaaatcaaacatcggaaatcaaattgtcaaagatgctgtttac

SEQ ID NO: 43446 - DNA, 75 bp, Artificial Sequence
  Synthetic
tatatacattcggaagatgaaaagttaagaaccttcttgtggtcgataacacccctgtttccccgatttttaagt

SEQ ID NO: 43447 - DNA, 75 bp, Artificial Sequence
  Synthetic
gagtttaaagccggaacatttatgggcgtcgccagtagcattgtctcattatttcagaactctagaaccatcaga

SEQ ID NO: 43448 - DNA, 75 bp, Artificial Sequence
  Synthetic
aatgtctttcgagattacatgagtcagacaatcgacgagctcataatcaagagtgaattgacgtccctggagcac

SEQ ID NO: 43449 - DNA, 75 bp, Artificial Sequence
  Synthetic
ttgtcaggatataaagaaaaatatggcggaggaggaatgtgggtgtgttctgcggagcaagctgataaactgcga

SEQ ID NO: 43450 - DNA, 75 bp, Artificial Sequence
  Synthetic
cgattgtcatggaaaaggccggttctagggacaacagtgccgcatcctttggaaatgcatgggaaaggaacattg

SEQ ID NO: 43451 - DNA, 75 bp, Artificial Sequence
  Synthetic
aaatcaccactatccaagtgttgcaaagagtccaaaatggattacatatcagttcacattccggaaggattgtct

SEQ ID NO: 43452 - DNA, 75 bp, Artificial Sequence
  Synthetic
catgtaatggacagtcgaggaagtctgcctgcctatttgggctcaaaaacctcagaatctacctctattctccaa

SEQ ID NO: 43453 - DNA, 75 bp, Artificial Sequence
  Synthetic
ccttgggaaaaagagagtaaaattccaataatcaggagagccacacgcttgcgagacgctattcattggttcgtt

SEQ ID NO: 43454 - DNA, 75 bp, Artificial Sequence
  Synthetic
gatccagatagcaatctggcaagaagcatactaaataacatagaagcccttactggggagaagtgggagggagct

SEQ ID NO: 43455 - DNA, 75 bp, Artificial Sequence
  Synthetic
ctcaaagggtataaaaggacaggatccgcacttcatagattttctacctccagagtgagtcatggcggattttct

SEQ ID NO: 43456 - DNA, 75 bp, Artificial Sequence
  Synthetic
tctcagagcccagcctgcttgactcgcatgatggcaacgacagacactatgagagactacgcacagctgaattat

SEQ ID NO: 43457 - DNA, 75 bp, Artificial Sequence
  Synthetic
gatttcatgtttcaagctagtcttctatattctcagatgaccagctctgttgtgttgcttggaacgactgtctcg

SEQ ID NO: 43458 - DNA, 75 bp, Artificial Sequence
  Synthetic
aatacaattcacttccacattagctgtgagaaatgtattcgagagattgccgagccaatgctcgaaagccctagg

SEQ ID NO: 43459 - DNA, 75 bp, Artificial Sequence
  Synthetic
gaatacatgggcaaagatgttcatctggtcttggaaaagtggaagaactcatcaggcggatggggagagactctt

SEQ ID NO: 43460 - DNA, 75 bp, Artificial Sequence
  Synthetic
cagctattgaagccagtagagggggactgggagtccatcccacccgttgagaagtcctaccacgtcggaagaatt

SEQ ID NO: 43461 - DNA, 75 bp, Artificial Sequence
  Synthetic
ttaggctttctctatggagatctgaaaagtcagaattcaagccgtgcagatgatagctctatctttccattaagc

SEQ ID NO: 43462 - DNA, 75 bp, Artificial Sequence
  Synthetic
attcaaatgagacttagaggtcgaggattcctgagaggcattctagatggtctggtcagagcaagtgcttgtcag

SEQ ID NO: 43463 - DNA, 75 bp, Artificial Sequence
  Synthetic
gtgatacataggagaagcgttgcactcttatccaaaccagcaaacgctatatatggaggtctcatttatttgata

SEQ ID NO: 43464 - DNA, 75 bp, Artificial Sequence
  Synthetic
gataagatcagttcttcgacatcattcactaccttatgtagagatggaccaatcagagacgagctctcttcaatt

SEQ ID NO: 43465 - DNA, 75 bp, Artificial Sequence
  Synthetic
ccacacaaaattcctacatcttatcctacctctaattctgatatgggacttcatatccggaattacctcaagttc

SEQ ID NO: 43466 - DNA, 75 bp, Artificial Sequence
  Synthetic
cagtgcaagacagtagagcttgggaaatatcaatccgacatcaaagacctctggttgttctcagatgtcatgacg

SEQ ID NO: 43467 - DNA, 75 bp, Artificial Sequence
  Synthetic
tccaatatcgcaggtccatttgcattgtcgactaaaattctgaagtgcttgtataaaccttctctctctcagaag

SEQ ID NO: 43468 - DNA, 75 bp, Artificial Sequence
  Synthetic
gatcgtaacaacatacgcaaaataagcaatttttccaaaatgatgcgttcacaaatgaattgggatccgaccagt

SEQ ID NO: 43469 - DNA, 75 bp, Artificial Sequence
  Synthetic
tctgagttcataacatcccagattctagtctgtaatgaagagatccgtcatgcttgcaaattcggaattcccaaa

SEQ ID NO: 43470 - DNA, 75 bp, Artificial Sequence
  Synthetic
ctatctcttaaatttgatgagcctatctggggtccagaagattacggattgatttggtctatcccagtcgatttt

SEQ ID NO: 43471 - DNA, 75 bp, Artificial Sequence
  Synthetic
tcaagccaaccagtagacaaagtcttgaagctatgccccagaattcagaacccaagtatttctggttttcggttg

SEQ ID NO: 43472 - DNA, 75 bp, Artificial Sequence
  Synthetic
ggtcaacttccaacaggagctcactataaattaagatccattttaaagaagaagaacattcactaccgagatgct

SEQ ID NO: 43473 - DNA, 75 bp, Artificial Sequence
  Synthetic
ttgtgcggcggtgacgggtcgggcggaatgactgcagctgttctaaggttcaacctcaaatcaagagtaatattt

SEQ ID NO: 43474 - DNA, 75 bp, Artificial Sequence
  Synthetic
aatagcattttggattttgatggatcaactatgaaaggatcatctcctgatccacccagtgccctagagactgtc

SEQ ID NO: 43475 - DNA, 75 bp, Artificial Sequence
  Synthetic
acaaacggtcgcatccggtgtgtaaatgctgaaagttgttgggaaaacccatcagatctgagcgaacaaagaact

SEQ ID NO: 43476 - DNA, 75 bp, Artificial Sequence
  Synthetic
tgggattacttcaaattcctcaaaagtcaacatggtctcaagatcgatcttgtagttctagatatggaagtgaga

SEQ ID NO: 43477 - DNA, 75 bp, Artificial Sequence
  Synthetic
gacttcaaaatctccgcagcgatcgaaaaatgtgtcagacacaacatctcgtctttgttggaggatgatggagtc

SEQ ID NO: 43478 - DNA, 75 bp, Artificial Sequence
  Synthetic
ttgatctacaagacttatggctcaacaattgcatctgaggaaagcaatgcagttgttaatattggagtgttgttc

SEQ ID NO: 43479 - DNA, 75 bp, Artificial Sequence
  Synthetic
gagactgtcgagctgattcagactgagtacagcagcacatcaacatcagaagtatacatgtattgtaagaagatc

SEQ ID NO: 43480 - DNA, 75 bp, Artificial Sequence
  Synthetic
aagaagttcgttgactcgccttgtcccgattggacatctctggactactattggaatcgtctattttgtttccgg

SEQ ID NO: 43481 - DNA, 75 bp, Artificial Sequence
  Synthetic
agttataaggaggaattttttcgatcgtatgaagtgtccaagaaagagtccttacgaggaataccaacatctttt

SEQ ID NO: 43482 - DNA, 75 bp, Artificial Sequence
  Synthetic
attccagatccactcgttaacttagaaacacttctgcagattgcaggggtcccatctgggatttcacatcaatta

SEQ ID NO: 43483 - DNA, 75 bp, Artificial Sequence
  Synthetic
gccattgacatcaaagaattacagttgacccaaatcactgccgcaatggtcttgtgtggtatgatttcgaattac

SEQ ID NO: 43484 - DNA, 75 bp, Artificial Sequence
  Synthetic
actttggacgtaacaaaaaagagagactcttataatcctccatctgatggtcgactaataagaatgagtgctgct

SEQ ID NO: 43485 - DNA, 75 bp, Artificial Sequence
  Synthetic
ttggtgggtattagtttttggatttctgtgaaatattatgacaaggaattgaataaaacattggaagatattttg

SEQ ID NO: 43486 - DNA, 75 bp, Artificial Sequence
  Synthetic
accagatcattccccattcgatggataatctcaaaaagctacttgtcatggaccacaaaaaaaggtctcagaaat

SEQ ID NO: 43487 - DNA, 75 bp, Artificial Sequence
  Synthetic
gcaaaagatgtcagactctctgggagcatggcgaatatcgggaattggatcagatgcatggagttactccatcta

SEQ ID NO: 43488 - DNA, 75 bp, Artificial Sequence
  Synthetic
ccacctggatcgttgtcaaaggatgaagtttcttctgtatgcagtaagtatattcgaaccctcagacactcagtt

SEQ ID NO: 43489 - DNA, 75 bp, Artificial Sequence
  Synthetic
ttagttcatcaaacaggaataattgatctatggaaatccagagtggcagaagatgatagatcattgatggaagtc

SEQ ID NO: 43490 - DNA, 75 bp, Artificial Sequence
  Synthetic
aaaacagacttcattgagtcagaacactgggtagactaagcgtatgaaaaaaactagatgcaataaagcaccatg

SEQ ID NO: 43491 - DNA, 75 bp, Artificial Sequence
  Synthetic
tatgaaaaaaactagatgcaataaagcaccatgttgtgtacgatttaatcatgcatttggttatgttttcttcgt

SEQ ID NO: 43492 - DNA, 75 bp, Artificial Sequence
  Synthetic
gggcgttcttcactccaaatgctaggaaaccgacggtgtacataaagaaggagacagatctgagtcttttgagga

SEQ ID NO: 43493 - DNA, 75 bp, Artificial Sequence
  Synthetic
gaaaccgacggtgtacataaagaaggagacagatctgagtcttttgaggagtcatgtttatgacgggattaagga

SEQ ID NO: 43494 - DNA, 75 bp, Artificial Sequence
  Synthetic
aattcttatctatacatggttttgaaagatatccgggagaaaccagataaaaattggacttctttcggagtcgaa

SEQ ID NO: 43495 - DNA, 75 bp, Artificial Sequence
  Synthetic
aaaaaagggcaagacacccgactgcccggagatgatctatggcttccaacgctgatcctcggtctttatcgcgtg

SEQ ID NO: 43496 - DNA, 75 bp, Artificial Sequence
  Synthetic
tacaacttctccagtgggagacagggattcatgcattggcggagagacttgggggatgcagactgctgcagatca

SEQ ID NO: 43497 - DNA, 75 bp, Artificial Sequence
  Synthetic
caaaccgaatcacctggctccaaatccaatacaagtctcgggataccagaagtcccggctaatttgatcgacata

SEQ ID NO: 43498 - DNA, 75 bp, Artificial Sequence
  Synthetic
ctcttcgggtccggagattcctttgaacagtacaaccagacaggaatttactctcttaaggaactcgtcgttgct

SEQ ID NO: 43499 - DNA, 75 bp, Artificial Sequence
  Synthetic
tgagccccagttcaattgaaatgatgcacaatatgaaaaaaattaacagaaatcccagattctctgttgcttacc

SEQ ID NO: 43500 - DNA, 75 bp, Artificial Sequence
  Synthetic
gccccatcatactcatctttgagtatagcatttccagaaaacaccaaattagattggaagccagtcacaaaaaac

SEQ ID NO: 43501 - DNA, 75 bp, Artificial Sequence
  Synthetic
gctcaagtcttgacctcggagattcagaggattttggattattccttgtgtcagaacacgtgggacaaggtagaa

SEQ ID NO: 43502 - DNA, 75 bp, Artificial Sequence
  Synthetic
agacagcaggagggtacaaattcccctggcatctgatcggtatgggaattgtggacaatgaactacacgagctca

SEQ ID NO: 43503 - DNA, 75 bp, Artificial Sequence
  Synthetic
acatgagagccagagtatgagtaaatgcgagtgaatcataataatcatccatttggtgtttacgaagtgcaatat

SEQ ID NO: 43504 - DNA, 75 bp, Artificial Sequence
  Synthetic
atttggtgtttacgaagtgcaatataaaaatgtgatgtcagactaatatgaaaaaaactatccacaataaaaccg

SEQ ID NO: 43505 - DNA, 75 bp, Artificial Sequence
  Synthetic
aatgagttgttacaactgagcaaaactttcggggatgacaagatttacaagaaacggctaatcaaacttccaagt

SEQ ID NO: 43506 - DNA, 75 bp, Artificial Sequence
  Synthetic
ctttcggggatgacaagatttacaagaaacggctaatcaaacttccaagtcttggtcgcgtcatctttgattctg

SEQ ID NO: 43507 - DNA, 75 bp, Artificial Sequence
  Synthetic
gggtatgagttgatcaagaccgtagaacctatgtgcaatcttcgtctatcagacctggccagaaggttccgtcca

SEQ ID NO: 43508 - DNA, 75 bp, Artificial Sequence
  Synthetic
cttgagtttcttgaagagatcgacaaaaatggattatctgatgaggatttggtgatcggattaaaaggaaaagaa

SEQ ID NO: 43509 - DNA, 75 bp, Artificial Sequence
  Synthetic
tgatgatatgacagcagtgatcaaaaagatgctggaaagctcgtctggtcaagggctaacaaactacgacagcgt

SEQ ID NO: 43510 - DNA, 75 bp, Artificial Sequence
  Synthetic
agaagcgaaaatccggaataccgcagttaaagtgctagcacaaggcgacaatcaagtcatatgtacacagtacaa

SEQ ID NO: 43511 - DNA, 75 bp, Artificial Sequence
  Synthetic
atgagacgatgcaatctgctgattatctgaactatgggaaggtacctatctttagaggagtaatcagagggctgg

SEQ ID NO: 43512 - DNA, 75 bp, Artificial Sequence
  Synthetic
gcaatgatccaatttaacttcttcgggaattttgctcgccttctcttgattatgcacgatccggcgattcgacaa

SEQ ID NO: 43513 - DNA, 75 bp, Artificial Sequence
  Synthetic
tatgcacgatccggcgattcgacaatcattaaatcagttgaaaggaccaaacatcaatgtccattcatacgggtt

SEQ ID NO: 43514 - DNA, 75 bp, Artificial Sequence
  Synthetic
cctacaaaagaaatcaagcatagggaatcagatagtcaaagacgccgtatactacatacactcggaagatgagaa

SEQ ID NO: 43515 - DNA, 75 bp, Artificial Sequence
  Synthetic
attgagaacttttttgtggtccattactccattgtttcctcggtttctgagcgaatttaaagcagggacgttcat

SEQ ID NO: 43516 - DNA, 75 bp, Artificial Sequence
  Synthetic
actccattgtttcctcggtttctgagcgaatttaaagcagggacgttcatgggagtagcgagcagcattgtatct

SEQ ID NO: 43517 - DNA, 75 bp, Artificial Sequence
  Synthetic
ttggaaatgcacggaaggggaacactgaaatccccgctatccaagtgttgcaaggagtcccgaatggattatatt

SEQ ID NO: 43518 - DNA, 75 bp, Artificial Sequence
  Synthetic
acatcagagtctacctcaattcttcagccttgggagaaggaaagcaaaattcccatcataagaagagctactaga

SEQ ID NO: 43519 - DNA, 75 bp, Artificial Sequence
  Synthetic
ttacgagatgcaattcattggtttgtggatccggacagtaacttagcccgaagcatattgaacaatattgaatcc

SEQ ID NO: 43520 - DNA, 75 bp, Artificial Sequence
  Synthetic
cttcacaaagtcctgcatgtctcaccagaatgatggcaaccacagacaccatgcgcgattatgctcagctcaatt

SEQ ID NO: 43521 - DNA, 75 bp, Artificial Sequence
  Synthetic
caaacactattcatttccatgttacctgtcgaaaatgtatccgagaaataacagaaccgatgttagaaagtccta

SEQ ID NO: 43522 - DNA, 75 bp, Artificial Sequence
  Synthetic
aggctttttacgaggaatccttgacggattagtccgagctagtgcttgtcaggttatccacaggagaagtgttgc

SEQ ID NO: 43523 - DNA, 75 bp, Artificial Sequence
  Synthetic
attgtctacgaaaattttgaagtgcttatacaagcctgctttgtcccagaaagatcgaaacaatatcaggaagat

SEQ ID NO: 43524 - DNA, 75 bp, Artificial Sequence
  Synthetic
cagcaatttctccaagatgatgcgatcacaattgagctgggaccccacaagctctgaatttattacatctcaaat

SEQ ID NO: 43525 - DNA, 75 bp, Artificial Sequence
  Synthetic
tcacaattgagctgggaccccacaagctctgaatttattacatctcaaatcctagtatgcaatgaggaaattagg

SEQ ID NO: 43526 - DNA, 75 bp, Artificial Sequence
  Synthetic
ctacaagctgagatcaatcctaaggaagaaaaatatacattacagggatgcactgtgtgggggtgatgggtcagg

SEQ ID NO: 43527 - DNA, 75 bp, Artificial Sequence
  Synthetic
ggagtatagcagtacatccacttcagaagtgtacatgtattgccgaaagattaagaagtttgtggacgctcctca

SEQ ID NO: 43528 - DNA, 75 bp, Artificial Sequence
  Synthetic
atgcaaaagacgtaagactatctgggaatatggctaatatagggaattggattcgatgcatggagctccttcatc

SEQ ID NO: 43529 - DNA, 75 bp, Artificial Sequence
  Synthetic
agtgatgatcgatcattgatggaggttaagaccgaattcattgaatctgagcattgggtagattaatcatatgaa

SEQ ID NO: 43530 - DNA, 75 bp, Artificial Sequence
  Synthetic
agaaatcaacatgagttctaaggtgctctgcattgctacaggccagacagtttccgtgtgtcttccagccaacga

SEQ ID NO: 43531 - DNA, 75 bp, Artificial Sequence
  Synthetic
agacccggtagaatttccaagtgccttcttcactccgaatgctaagaaacctacggtttacatcaagaaggaggc

SEQ ID NO: 43532 - DNA, 75 bp, Artificial Sequence
  Synthetic
agatctgagccagctaaggagtcatgtatacaatggtctcaaagacgggactgtaatgatttcccacatcaactc

SEQ ID NO: 43533 - DNA, 75 bp, Artificial Sequence
  Synthetic
ttacctctacttggtgcttaaagagatcaaggaaaaaccagataagaattggacctcatttggagtggaattggg

SEQ ID NO: 43534 - DNA, 75 bp, Artificial Sequence
  Synthetic
gaaaaagaatgagccaatggggatctttgatcttctcactgtggaagacatcaacgggcagaccctggataagaa

SEQ ID NO: 43535 - DNA, 75 bp, Artificial Sequence
  Synthetic
gggccaagacactagactgccaggagatgataagtggcttccgacactaatttttgggctctaccgtgtgtccag

SEQ ID NO: 43536 - DNA, 75 bp, Artificial Sequence
  Synthetic
ggccactcaggttgaatacaagaaaacactaatgactaatttatatgcccaatgcaaaatgcggactaaggatgc

SEQ ID NO: 43537 - DNA, 75 bp, Artificial Sequence
  Synthetic
ggaggagattgtagatgaaacagcggagtttttcaatgcttgggcaaatgactctaacttcactaagattgttgc

SEQ ID NO: 43538 - DNA, 75 bp, Artificial Sequence
  Synthetic
tgctgtggacatgtatttccacttctttaagaagagtgaccatgctccaataaggtttggaaccattgtctctcg

SEQ ID NO: 43539 - DNA, 75 bp, Artificial Sequence
  Synthetic
ctttaaggactgtgctgctctatcaactctgtcacacctacagaaagtgacaggccttccagtagaggaggtgtt

SEQ ID NO: 43540 - DNA, 75 bp, Artificial Sequence
  Synthetic
cacttgggttttcaataaatcggtccaagatgatcttttgaggatgatgacccctggtcaagagatagaccaagc

SEQ ID NO: 43541 - DNA, 75 bp, Artificial Sequence
  Synthetic
agactcttatatgccatacttgattgatatggggttatccaccaagtctccatactcctctactaagaatcccag

SEQ ID NO: 43542 - DNA, 75 bp, Artificial Sequence
  Synthetic
ttttcacttctggggccaattaactgcattcttggtgaaatcagccagagcaaagaatgctcttgtcccaatgga

SEQ ID NO: 43543 - DNA, 75 bp, Artificial Sequence
  Synthetic
catcgcatatcatgaactaaccacagctgctcttctgttcgcctatgcaatgggcaggtcatccgagctggagca

SEQ ID NO: 43544 - DNA, 75 bp, Artificial Sequence
  Synthetic
gagattcgtgctgaatgggaagaagttcacgaaagaagcaggatccagagatgaagatgacaatactcccccatc

SEQ ID NO: 43545 - DNA, 75 bp, Artificial Sequence
  Synthetic
cgagagaaacgtcgttgtatggctggcttggtgggaggatgtaaagcatgaggtcacacctgacatgaaagcatt

SEQ ID NO: 43546 - DNA, 75 bp, Artificial Sequence
  Synthetic
cgccaaacgagcagtagagcgagtcggggacatccgagtcaactccattgctgagtatgccagaagactctttgc

SEQ ID NO: 43547 - DNA, 75 bp, Artificial Sequence
  Synthetic
atgatcccatatggaaaaaactaacagagatcatggaagactctcaactttttcaagcgctcaagaattatccca

SEQ ID NO: 43548 - DNA, 75 bp, Artificial Sequence
  Synthetic
agttacaggatactcttgactcaattgagaatttagaggatgatgcaaaatcagactcctccgagtgtggatctc

SEQ ID NO: 43549 - DNA, 75 bp, Artificial Sequence
  Synthetic
ctaccgatagggggatacccagctattatttggcagaagaattggatgactgtgaggaggaaggctcagaagagg

SEQ ID NO: 43550 - DNA, 75 bp, Artificial Sequence
  Synthetic
aggatgatgatttccctgcggaagtgccagatcctccgaatgtggatatgcttgagtcaattatggaagatgaga

SEQ ID NO: 43551 - DNA, 75 bp, Artificial Sequence
  Synthetic
ttgatgatacaacttatcaggtgcatttcgaggctaagaaatcttggaaaccaattgttgaggacaaggattccg

SEQ ID NO: 43552 - DNA, 75 bp, Artificial Sequence
  Synthetic
gaaaagagaaattcgtgctgtccgtcccacagaacttgagtgccctccagcttctgcaatgggagtcaggaatcc

SEQ ID NO: 43553 - DNA, 75 bp, Artificial Sequence
  Synthetic
acgcacttgctgagaaactgggaggctgtagactgattaagattagtactaggggaacaagggatggaatcgaat

SEQ ID NO: 43554 - DNA, 75 bp, Artificial Sequence
  Synthetic
tcacagtgcgtgaaactccatgcgtctcccctgctcctaatccagttccgtctacatcccggtccagctcaattt

SEQ ID NO: 43555 - DNA, 75 bp, Artificial Sequence
  Synthetic
cgtccagtgtctcaactcgacacactgactcccctggatctcgatccaacactagtctggggattccggatgtac

SEQ ID NO: 43556 - DNA, 75 bp, Artificial Sequence
  Synthetic
caaccaatttgatagacactggggctattgacaaagaatttatcctcagtccggtcgccccaacagacccacctt

SEQ ID NO: 43557 - DNA, 75 bp, Artificial Sequence
  Synthetic
ataaaaatacactgagatcattgtttggatcaggagaatcctttgagcagtacaacaagaccggcatctactctc

SEQ ID NO: 43558 - DNA, 75 bp, Artificial Sequence
  Synthetic
tcaaagagcttgttatagcaggccttaaaaggaaagggatatacaaccggattcggatccgttgtaacttagagc

SEQ ID NO: 43559 - DNA, 75 bp, Artificial Sequence
  Synthetic
ctcagtttgtgtgatttgtagaaacatatgaaaaaaatcaacagaaatcccagattctctgttattttggctaca

SEQ ID NO: 43560 - DNA, 75 bp, Artificial Sequence
  Synthetic
gttgacaaaatgcaacgactcaagaagttcattgcgagaaaagagaagggtgataaaggtaaaatgagatggaca

SEQ ID NO: 43561 - DNA, 75 bp, Artificial Sequence
  Synthetic
aacaccatggattacgactctcccccaagttatcaagatgccagaaggggaattttcccgtctgcccccctgttc

SEQ ID NO: 43562 - DNA, 75 bp, Artificial Sequence
  Synthetic
gggatggatgatgatatgatggaatattctccatctttgggaatccagactcttaaaattcagtataaatgtgtt

SEQ ID NO: 43563 - DNA, 75 bp, Artificial Sequence
  Synthetic
gtaaacatcaatgcaatcaatcctttcagagattttcgtgaggcgatctctgccatgcaattttgggaagcagat

SEQ ID NO: 43564 - DNA, 75 bp, Artificial Sequence
  Synthetic
tatggtggatacatcgggaaaaaaccattttatcgggcaataattttgcacacagcaagacaactcaagacatcc

SEQ ID NO: 43565 - DNA, 75 bp, Artificial Sequence
  Synthetic
aacccaggaattctagaccgaggagtagttgaatatcatgctacaactcaagggcgggctttggttttccacagc

SEQ ID NO: 43566 - DNA, 75 bp, Artificial Sequence
  Synthetic
ttaggtcctgcaccttctatgatgtttgtaccggaaacattcactcgagagtggaatatcttgacaaacaagggg

SEQ ID NO: 43567 - DNA, 75 bp, Artificial Sequence
  Synthetic
acaataaatgtcaagatttggctgggggagactgataccttgtccgaactggaacccatcttaaaccctatccat

SEQ ID NO: 43568 - DNA, 75 bp, Artificial Sequence
  Synthetic
taccgggatgacagggaaatgattgaaggagcagctatcatgggattggaaatcaagaaacagaaagataacact

SEQ ID NO: 43569 - DNA, 75 bp, Artificial Sequence
  Synthetic
tggttgatttcgaaaagttattagagtacatagtatgaaaaaaaccaacagagttccaacgaattctacaaaatg

SEQ ID NO: 43570 - DNA, 75 bp, Artificial Sequence
  Synthetic
ttgtctcaagtgacattgcaagcttttgttgttatgtgtttaatttatcgggcatactcatctctgagtatagca

SEQ ID NO: 43571 - DNA, 75 bp, Artificial Sequence
  Synthetic
ttcccagagagtacaaagcttgactggaaacctgtgaccaagaacaccaggtattgtccgatgggaggtgaatgg

SEQ ID NO: 43572 - DNA, 75 bp, Artificial Sequence
  Synthetic
tttttagaaccaggcttacaggaagagtcattcctcagctctactcctatcggtgcaactccatcaaagtcagac

SEQ ID NO: 43573 - DNA, 75 bp, Artificial Sequence
  Synthetic
gggtttctgtgccatgcagccaagtgggtcaccacgtgtgatttccgttggtatggaccgaaatacattacccac

SEQ ID NO: 43574 - DNA, 75 bp, Artificial Sequence
  Synthetic
tcaatccataatataaaaccaacccgctcagactgtgattcagctttggcatcctacaagtccgggactctcatc

SEQ ID NO: 43575 - DNA, 75 bp, Artificial Sequence
  Synthetic
aacccgggtttccctcccgactcttgtgggtatgcttcagtcacggactctgagttccttgttataatgattaca

SEQ ID NO: 43576 - DNA, 75 bp, Artificial Sequence
  Synthetic
cctcatcatgttggggtggatgattacagaggccattgggttgatccgctgtttgtggggggagaatgtgaccag

SEQ ID NO: 43577 - DNA, 75 bp, Artificial Sequence
  Synthetic
tcttactgtgacacaattcataattcatctgtttggattccggctgacaccacgaagaagaatatttgtggacag

SEQ ID NO: 43578 - DNA, 75 bp, Artificial Sequence
  Synthetic
tcctttacccctttgactgtgacagtagcttatgataaaaccaaagacatctcagctggggctctagtctttaag

SEQ ID NO: 43579 - DNA, 75 bp, Artificial Sequence
  Synthetic
agtaaatatcactctcacatggagggggcaagaacatgcagactaacgtactgcgggaggacagggatcaaattc

SEQ ID NO: 43580 - DNA, 75 bp, Artificial Sequence
  Synthetic
cccaatggtgaatgggtgagcttagacatcaaaaccaagatccaggataaacaacttcttccactcttcaaagaa

SEQ ID NO: 43581 - DNA, 75 bp, Artificial Sequence
  Synthetic
tgccctgcaggaaccgaagtgaggtcgacattgcaatccgatggagctcaggtgttgacctcagagatccaacgg

SEQ ID NO: 43582 - DNA, 75 bp, Artificial Sequence
  Synthetic
ctcctggactactctctgtgccagaatacttgggaaaaggtagacaggaaagaaccgctctctcctttagatctc

SEQ ID NO: 43583 - DNA, 75 bp, Artificial Sequence
  Synthetic
agctatctggcttctaaatctcctgggaaaggtcttgcttatactgtaataaacggtactctctcatttgcgcat

SEQ ID NO: 43584 - DNA, 75 bp, Artificial Sequence
  Synthetic
accaggtacgtgcggatgtggattgatggtcctgtgctgaaggaactcaaggggaaacgagaatcagcaagtgga

SEQ ID NO: 43585 - DNA, 75 bp, Artificial Sequence
  Synthetic
atagccagtgacatttggactcaatggttcaaatatggagatatggaaatagggcccaacggactcttgaaaaca

SEQ ID NO: 43586 - DNA, 75 bp, Artificial Sequence
  Synthetic
aaaagtgggtacaagtttccttggcatttgattggaatgggtattgtggataatgaattgcatgaattgagcgag

SEQ ID NO: 43587 - DNA, 75 bp, Artificial Sequence
  Synthetic
gccaatccgctcgaccacccacagcttcctcatgcccagtcgattgctgatgattcagaagagatcttttttgga

SEQ ID NO: 43588 - DNA, 75 bp, Artificial Sequence
  Synthetic
gacactggagtttctaaaaatccagttgaattagtgaccggatggtttacaagttggaaagaaagtttagcagca

SEQ ID NO: 43589 - DNA, 75 bp, Artificial Sequence
  Synthetic
ggagttgtccttatactaacagtggtcctaatttacggggtccttcgctgtttcccagtgctctgtatgccatgc

SEQ ID NO: 43590 - DNA, 75 bp, Artificial Sequence
  Synthetic
agaaaaacaaagtggaaaaaggaagtggagaggtctgatagttttgagatgcgaatcttcaagccgaacaacatg

SEQ ID NO: 43591 - DNA, 75 bp, Artificial Sequence
  Synthetic
cgggctcgtgtgtaacacagaatcatcaaccaaggagaccagaaacgggttgtgatagcagagtgcaatattatc

SEQ ID NO: 43592 - DNA, 75 bp, Artificial Sequence
  Synthetic
atgtgataacgaatgatatgaaaaaaactattacaataatctgcaacagagataatggatctcaatccggtggac

SEQ ID NO: 43593 - DNA, 75 bp, Artificial Sequence
  Synthetic
gacattgctgagatatctgaggagaacttcttctctggtaagctggcaaaagaatgcagaataaggggactgaat

SEQ ID NO: 43594 - DNA, 75 bp, Artificial Sequence
  Synthetic
tcagttgattacaacttgaactcacctttggtggccgatgatttgacctatctgttagataagttcaagggacgg

SEQ ID NO: 43595 - DNA, 75 bp, Artificial Sequence
  Synthetic
cctgttcctattagatggaaaatgaagaagtgggattcaattttagatcaattaaggaaacatgatgtggattac

SEQ ID NO: 43596 - DNA, 75 bp, Artificial Sequence
  Synthetic
ctcagaccgtctcaactgcaccaatggttcgccgaatggatgttacattcaaaacacccaagtaaacaaggagaa

SEQ ID NO: 43597 - DNA, 75 bp, Artificial Sequence
  Synthetic
gagttcctaaggaccgtggatggtgaagcaagtgagacctttgaggtggtcaaatcgtttgtgagaggatggact

SEQ ID NO: 43598 - DNA, 75 bp, Artificial Sequence
  Synthetic
ggcggtgaggttaatttcattaaaaagagcggaaagcacatgggatattgtgcagatttgtgtcagaaattctta

SEQ ID NO: 43599 - DNA, 75 bp, Artificial Sequence
  Synthetic
gatttacacaagctcactctgctggtcaacgcagccaccgatcaagagttgttgcaattgagtaaaacatttgga

SEQ ID NO: 43600 - DNA, 75 bp, Artificial Sequence
  Synthetic
gatcccaagatttataaaaagagactaatcagacttccgagcttaggacgagttatttttgactccggatttttt

SEQ ID NO: 43601 - DNA, 75 bp, Artificial Sequence
  Synthetic
attgtcatggatcagagagtactaatggatagaaatttcatgttgatgatgaaggatgtgataattggtagaatg

SEQ ID NO: 43602 - DNA, 75 bp, Artificial Sequence
  Synthetic
cagaccgtattgtctatgatcagcaggtgtgatgataagtttggcccaggagacatcgactttctgaagaatgtt

SEQ ID NO: 43603 - DNA, 75 bp, Artificial Sequence
  Synthetic
tattctgtgggtgataggatcataaagaagttgggaaatgatggatatgagctaatcaagacagtggaaccaatg

SEQ ID NO: 43604 - DNA, 75 bp, Artificial Sequence
  Synthetic
tgcaacctgagactatctgatttggctagaaaattccgtcctatgataccagcattccctcattttaggaggcac

SEQ ID NO: 43605 - DNA, 75 bp, Artificial Sequence
  Synthetic
atagaaacgacagtcaatgagttgactacaaagactacactgatcaaggagttgttctctctgatcgacaactca

SEQ ID NO: 43606 - DNA, 75 bp, Artificial Sequence
  Synthetic
ccaaatgtcgattctacattggtagtgtatggttcattccgtcattggggacatccatttatcaactatttcgaa

SEQ ID NO: 43607 - DNA, 75 bp, Artificial Sequence
  Synthetic
ggtttggaaaaattgcacaaacaggtgacgatggaaaaagaaattgacgtggcttactctgaggcactggcaagt

SEQ ID NO: 43608 - DNA, 75 bp, Artificial Sequence
  Synthetic
gatttggctagaattgtattgacgaaggagttcaatgagaagaagcaatgggcagtggactaccacagagtccca

SEQ ID NO: 43609 - DNA, 75 bp, Artificial Sequence
  Synthetic
tcaaatcatccgttcaaaaatcacatccgtgacaacacctggccaactgcggcagtgatccaggatttcggggac

SEQ ID NO: 43610 - DNA, 75 bp, Artificial Sequence
  Synthetic
cattggcatgaattgccattaatccaatgttttgatatcccagatttaatagatccgtctattatttattctgac

SEQ ID NO: 43611 - DNA, 75 bp, Artificial Sequence
  Synthetic
aagagtcattccatgaaccgatctgaggtattgaatcacgtaaggacaaaacctcatgctcccattcctagtaag

SEQ ID NO: 43612 - DNA, 75 bp, Artificial Sequence
  Synthetic
aaagtgctggaaagcatgatagacaagcctgctacaaactggttggaatttctagatgagatagataaaaacggt

SEQ ID NO: 43613 - DNA, 75 bp, Artificial Sequence
  Synthetic
ctatctgatgaagatctggtcattggtctgaagggcaaagaaagagagttgaagattgccgggaggttcttttct

SEQ ID NO: 43614 - DNA, 75 bp, Artificial Sequence
  Synthetic
ttaatgtcctggaaactgagagagtactttgtggtcacggaatacctgataaaaacacactttgttccgttattt

SEQ ID NO: 43615 - DNA, 75 bp, Artificial Sequence
  Synthetic
catggattaactatggctgatgatatgacggctgtaatcaagaagatgcttgaaagctcatctggacagggatta

SEQ ID NO: 43616 - DNA, 75 bp, Artificial Sequence
  Synthetic
acaaattatgagagtgtatgcattgccaatcacatagattatgaaaagtggaacaatcatcaacgaaaactgtca

SEQ ID NO: 43617 - DNA, 75 bp, Artificial Sequence
  Synthetic
aatggacctgttttccgggtaatgggtcaatttcttggatacccgaatttgatctacaggacccatgagttcttt

SEQ ID NO: 43618 - DNA, 75 bp, Artificial Sequence
  Synthetic
gagaaaagtttaatttattacaatgagcggccagacctaatgaaagtaaaaaatggggttctcgagaatagcact

SEQ ID NO: 43619 - DNA, 75 bp, Artificial Sequence
  Synthetic
ccacaaagagtctgttggaatggccaggccggtggactggaagggttgagacagaaaggatggagtattctcaac

SEQ ID NO: 43620 - DNA, 75 bp, Artificial Sequence
  Synthetic
ttacttgtgattcaaagggaagcaaaaattcgaaacacagcggtcaaagtgctagctcagggagataaccaggtc

SEQ ID NO: 43621 - DNA, 75 bp, Artificial Sequence
  Synthetic
atatgtactcaatacaagacaaaacagtttagaaatgatacagagctgcgacaagcactgaaacaaatggctgcc

SEQ ID NO: 43622 - DNA, 75 bp, Artificial Sequence
  Synthetic
aacaatgatgtaattatgaaggcaatagagtcgggaacaaacagattggggcttctaataaaccaggatgagaca

SEQ ID NO: 43623 - DNA, 75 bp, Artificial Sequence
  Synthetic
atgcagtctgcagactatctgaattacggcaaagttcccattttccgaggtgtcatccgaggtcttgaaactaag

SEQ ID NO: 43624 - DNA, 75 bp, Artificial Sequence
  Synthetic
cgatggtctcgggtaacttgtgtaacgaacgatcagttacccacctgtgcaaacttaatgtcctcagtttccaca

SEQ ID NO: 43625 - DNA, 75 bp, Artificial Sequence
  Synthetic
aatgcattgacagttgcccactttgatgtacatcccttgaatgcaatgattcagttcaatttctttggaaatttt

SEQ ID NO: 43626 - DNA, 75 bp, Artificial Sequence
  Synthetic
gcacgtctattacttgttatgcacgatccagcaataaggaggtctttaacacaactcgaaagaacgactataaca

SEQ ID NO: 43627 - DNA, 75 bp, Artificial Sequence
  Synthetic
gttaactcttacggatttaaaattgcaatgttgtatctggacccatctatagggggtgtatgtgggacagccttg

SEQ ID NO: 43628 - DNA, 75 bp, Artificial Sequence
  Synthetic
tctcgatttctgataaggagcttccctgatccagtgacagaaagtctatcattttggaaagttatctatcaaagt

SEQ ID NO: 43629 - DNA, 75 bp, Artificial Sequence
  Synthetic
actagtgatgtaagactgaagaatttagcagagcaatttggaaatcctaaaatagccatattcagagaatcacac

SEQ ID NO: 43630 - DNA, 75 bp, Artificial Sequence
  Synthetic
attgaaaagttattagaggacccaacaagcttgaatatatcaatgggtatgagtgctgcaaatctattaaaaaca

SEQ ID NO: 43631 - DNA, 75 bp, Artificial Sequence
  Synthetic
gaaataaaaaagaacctactccagaggaaatctaacataggtaatcaaattgtcaaggatgccgtgtattacata

SEQ ID NO: 43632 - DNA, 75 bp, Artificial Sequence
  Synthetic
cactcagaggatgaaaagttgaggacctttttgtggtctataacacccttatttcctagatttctgagtgagttc

SEQ ID NO: 43633 - DNA, 75 bp, Artificial Sequence
  Synthetic
aaggcagggacgttcatgggtgtggcaagtagcatcgtctctctgttccagaactctcgaactattaggaatgta

SEQ ID NO: 43634 - DNA, 75 bp, Artificial Sequence
  Synthetic
ttccgggattatatgagtcagacaatagatgaactcataattaagagtgaattaacatctctagaacatttgtcg

SEQ ID NO: 43635 - DNA, 75 bp, Artificial Sequence
  Synthetic
ggatacaaggagaagcatggcggaggaggaatgtggacttgttccgcagagcaggcagacaaattgagacgatta

SEQ ID NO: 43636 - DNA, 75 bp, Artificial Sequence
  Synthetic
tcctggaaaagaccggtcttagggacaacagttcctcatcctctagagatgcatgggaaaggaaccttgagatcg

SEQ ID NO: 43637 - DNA, 75 bp, Artificial Sequence
  Synthetic
ccattgtctaagtgctgcaaagaatccaagatggattatatatcagttcatatcccagagggtctgtctcatgtg

SEQ ID NO: 43638 - DNA, 75 bp, Artificial Sequence
  Synthetic
atggacagtcgtggtagtttgccggcctacttaggctcgaaaacctcagagtcaacttctattctacaaccatgg

SEQ ID NO: 43639 - DNA, 75 bp, Artificial Sequence
  Synthetic
gaaaaagagagcaagattccaattatcagaagagctacacgtctgcgggatgctatccattggtttgtggatcca

SEQ ID NO: 43640 - DNA, 75 bp, Artificial Sequence
  Synthetic
gaaagtaacctggcaagaagtatactgaataatatcgaggcgttaacaggagagaaatgggaaggtgcattaaag

SEQ ID NO: 43641 - DNA, 75 bp, Artificial Sequence
  Synthetic
ggatacaaaaggaccggatcggcacttcatagattctctacatcacgagtaagtcatggcggattttcatctcag

SEQ ID NO: 43642 - DNA, 75 bp, Artificial Sequence
  Synthetic
agcccggcttgtttgactcgcatgatggcaacaacagacactatgagggactacgcacaattaaattacgatttc

SEQ ID NO: 43643 - DNA, 75 bp, Artificial Sequence
  Synthetic
atgtttcaagccagtcttttgtattctcagatgaccagctccgttgttttgcttgggacaactgtatcaaataca

SEQ ID NO: 43644 - DNA, 75 bp, Artificial Sequence
  Synthetic
attcattttcatattaattgcaaaaaatgtatccgggagattgccgaaccaatgctagaaagtcctcgagagtat

SEQ ID NO: 43645 - DNA, 75 bp, Artificial Sequence
  Synthetic
atgggcaaagatgttcatttggtcttggagaagtggaaaaactcatcaggcggatggggagaaactctccaatta

SEQ ID NO: 43646 - DNA, 75 bp, Artificial Sequence
  Synthetic
ctgaaaccagtggagggggattgggaatcgattccaccggttgagaagtcctatcatgttggaagaatcttaggc

SEQ ID NO: 43647 - DNA, 75 bp, Artificial Sequence
  Synthetic
tttctctacggagatttaaaaagccaaaattctagtcgtgcagatgatagctcaatatttccattaagcattcaa

SEQ ID NO: 43648 - DNA, 75 bp, Artificial Sequence
  Synthetic
atgagacttcgagggaggggatttctcaggggaatcctggacggtctggtccgggcaagtgcgtgtcaagtgata

SEQ ID NO: 43649 - DNA, 75 bp, Artificial Sequence
  Synthetic
cacagaagaagcattgcactcctatctaaaccagcaaatgctatctatggaggtcttatttatctgatagataag

SEQ ID NO: 43650 - DNA, 75 bp, Artificial Sequence
  Synthetic
atcagttcctctacatcctttaccaccctgtgccgggacggaccaatcagagaagagctatcttcaattccccat

SEQ ID NO: 43651 - DNA, 75 bp, Artificial Sequence
  Synthetic
aagattcctacgtcctatcccacttcaaactctgatatgggacttcatatcaggaattatctcaaatttcagtgc

SEQ ID NO: 43652 - DNA, 75 bp, Artificial Sequence
  Synthetic
aagaccgtagagcttggcaagtaccaatcagatatcaaagatctatggttattttcagatgtcatgacatctaat

SEQ ID NO: 43653 - DNA, 75 bp, Artificial Sequence
  Synthetic
atcgcaggtccatttgccttatctactaagattttgagatgtctgtacaagccttcattatctcagaaggatcga

SEQ ID NO: 43654 - DNA, 75 bp, Artificial Sequence
  Synthetic
aacaatatacgcaagataagtaatttctcgaagatgatgagatcacaaatgaattgggatccaactagctctgaa

SEQ ID NO: 43655 - DNA, 75 bp, Artificial Sequence
  Synthetic
ttcataacctctcaaattttagtctgcaacgaagagattcgtcatgcctgcaaattcgggatacctaaattgtct

SEQ ID NO: 43656 - DNA, 75 bp, Artificial Sequence
  Synthetic
ttgaagtttgatgaacccgtttggggtccagaggattatggattgatttggtccattcccgttgatttctctagc

SEQ ID NO: 43657 - DNA, 75 bp, Artificial Sequence
  Synthetic
caacctgtagataaggccttgaaaccatgtcccaggattcaaaacccaagtatctccggctttcggttgggtcag

SEQ ID NO: 43658 - DNA, 75 bp, Artificial Sequence
  Synthetic
cttccgacaggagctcattacaaattgagatcaattttaaagaagaaaaacattcactaccgggatgctctatgt

SEQ ID NO: 43659 - DNA, 75 bp, Artificial Sequence
  Synthetic
ggaggagatggatcgggcgggatgaccgcggcagttttaagattcaacttgaaatccagggtcatctttaatagc

SEQ ID NO: 43660 - DNA, 75 bp, Artificial Sequence
  Synthetic
atcctggatttcgatggatctactatgaaaggagcatcacctgatccgcctagtgcattagagactgtgacgaac

SEQ ID NO: 43661 - DNA, 75 bp, Artificial Sequence
  Synthetic
gggcgcatcaggtgtgttaatgcggaaagttgctgggagaatccatcagatctaagcgaacagagaacctgggat

SEQ ID NO: 43662 - DNA, 75 bp, Artificial Sequence
  Synthetic
tacttcaagttccttaaaatccaacatggcctaaagatagaccttgttgtattggatatggaggtgcgagacttc

SEQ ID NO: 43663 - DNA, 75 bp, Artificial Sequence
  Synthetic
aagatttcagcatcaattgaaaaatgcatcagacacaacatatcatctttgctagaggatgaaggagttctgatc

SEQ ID NO: 43664 - DNA, 75 bp, Artificial Sequence
  Synthetic
tacaaaacgtatggatcgaccattgcttccgaggaaagcaatgctgttgtcaatataggagtgttatttgagaca

SEQ ID NO: 43665 - DNA, 75 bp, Artificial Sequence
  Synthetic
gtagagttgcttcaaacagagtacagcagtacatcaacatcagaagtatatatgtactgcaaaaagatcaaaaaa

SEQ ID NO: 43666 - DNA, 75 bp, Artificial Sequence
  Synthetic
tttgtagactctccatatcctgattggacctccttggattattactggagtcgtctattttgtttccggagctac

SEQ ID NO: 43667 - DNA, 75 bp, Artificial Sequence
  Synthetic
aaagaggaattttttagatcttacgaggtgtccaagaaggaatcgttgaaaggaataccggcttctttcattcct

SEQ ID NO: 43668 - DNA, 75 bp, Artificial Sequence
  Synthetic
gatccacttgtaaacttggaaacattgcttcagatcgctggggttccatcggggatttcgcatcaattggccata

SEQ ID NO: 43669 - DNA, 75 bp, Artificial Sequence
  Synthetic
gatatcaaagaactgcaattgacccaaattactgcggccatggtattgtgtggcatgatttctaactacacttta

SEQ ID NO: 43670 - DNA, 75 bp, Artificial Sequence
  Synthetic
gatgtaacaaaaaagagagactcgtacaatcctccatctgatggtcgactcatccgaatgagctctgccctcgtg

SEQ ID NO: 43671 - DNA, 75 bp, Artificial Sequence
  Synthetic
ggtattagtttctgggtttctgtgaaatattacgacaaagaattgaacaatacattggaaaatattttaacaagg

SEQ ID NO: 43672 - DNA, 75 bp, Artificial Sequence
  Synthetic
tcattccctattagatggataatatcaaagaattacttgtcttggacaaccaagaggggctttaaaaatgcgaaa

SEQ ID NO: 43673 - DNA, 75 bp, Artificial Sequence
  Synthetic
gatgtgcgactgtcaggaagtatggcgaatataggaaattggattaggtgcatggagctactccatctaccacct

SEQ ID NO: 43674 - DNA, 75 bp, Artificial Sequence
  Synthetic
ggatcactgagcagagatgaggtttcctctgtgtgcggaaagtacattcggactctcaagcattcagttttaatc

SEQ ID NO: 43675 - DNA, 75 bp, Artificial Sequence
  Synthetic
catcaaacaggaatagtcgatttatggaaatctaaagtagcaaacgacgatagatcattgatggaagtcaaaaca

SEQ ID NO: 43676 - DNA, 75 bp, Artificial Sequence
  Synthetic
gattttatcgaatcagagcactgggtagattaagagtatgaaaaaaactaagtgaaataaagcaccttgttgtgt

SEQ ID NO: 43677 - DNA, 75 bp, Artificial Sequence
  Synthetic
tatgaaaaaaactaagtgaaataaagcaccttgttgtgtacgatttaatcgtgcagctggttttgttttcttcgt

SEQ ID NO: 43678 - DNA, 75 bp, Artificial Sequence
  Synthetic
gaaaagtatattctacgtgtgcattctgtaacatagttggttggagaagtattttggatataacacgtttgaata

SEQ ID NO: 43679 - DNA, 75 bp, Artificial Sequence
  Synthetic
ctgtaacatagttggttggagaagtattttggatataacacgtttgaataggtttattgtgaatcgaaataccga

SEQ ID NO: 43680 - DNA, 75 bp, Artificial Sequence
  Synthetic
tggcgaataaacccaagaagcccggaagacgggctatcgatatagtgagacgtgcgttgcctcgcgtctcgggac

SEQ ID NO: 43681 - DNA, 75 bp, Artificial Sequence
  Synthetic
aagacgggctatcgatatagtgagacgtgcgttgcctcgcgtctcgggaccgaaaaaggtcttaaagaaggcaac

SEQ ID NO: 43682 - DNA, 75 bp, Artificial Sequence
  Synthetic
acaaacagtcatggaaagcttggctggcatacgggcaaccgttgcctacctgctctacatgacattcctcggcaa

SEQ ID NO: 43683 - DNA, 75 bp, Artificial Sequence
  Synthetic
catgcttgccacatctttcattctgactggatcaattctgctctatttggcaaccacaacagttggagtgtctga

SEQ ID NO: 43684 - DNA, 75 bp, Artificial Sequence
  Synthetic
actggatcaattctgctctatttggcaaccacaacagttggagtgtctgagattgggtgcagccttgacataaca

SEQ ID NO: 43685 - DNA, 75 bp, Artificial Sequence
  Synthetic
caaggtcagcaaggccacgagagctaagtttcgcagtgcgaaaaagagtgatctgataaagatcctcagtagctt

SEQ ID NO: 43686 - DNA, 75 bp, Artificial Sequence
  Synthetic
caagagaacggttacaaaccttctggctagtgtgcaaaagaggaagagaaaggcgaagagatcggtcacgacgcc

SEQ ID NO: 43687 - DNA, 75 bp, Artificial Sequence
  Synthetic
cagcatggctttgattctattgacaatgagttgtatggcttatggagccaccaggttcaccagaaatgggtttgt

SEQ ID NO: 43688 - DNA, 75 bp, Artificial Sequence
  Synthetic
gtacatgaacgtcactgggagtgatgttgggacctggttatccattaagacagcagtcgggaacggatcatgcat

SEQ ID NO: 43689 - DNA, 75 bp, Artificial Sequence
  Synthetic
aaattgagtgtcgttgtgaagaatgccaatggcacatatccacgaggaacgaaatcattaacacgaaacacaaca

SEQ ID NO: 43690 - DNA, 75 bp, Artificial Sequence
  Synthetic
cgttatggctacagatgtggggacttggtgtgaagacactgttacgtatctttgtcccaaattggacggtgctgc

SEQ ID NO: 43691 - DNA, 75 bp, Artificial Sequence
  Synthetic
ggactgcagtatggatggaagtcgtggggtaagacaatgtttgtttcagtgccaatagctgagaacactttcata

SEQ ID NO: 43692 - DNA, 75 bp, Artificial Sequence
  Synthetic
tgagcctgacgacattgattgttggtgtaaagttgtatcagtttatgttacctatggtaggtgtagacgagatgg

SEQ ID NO: 43693 - DNA, 75 bp, Artificial Sequence
  Synthetic
atcgatggaaatgatgaaggagagtgtgcctcagacaaacgcgcttggaatacattcaagatagaggagtttggc

SEQ ID NO: 43694 - DNA, 75 bp, Artificial Sequence
  Synthetic
ggtgagtagacgcagcagacgatctgttgctctcgcaccgcatgggacaggaaaccttcacacaggagaggcacc

SEQ ID NO: 43695 - DNA, 75 bp, Artificial Sequence
  Synthetic
aatgtggaaatcacacactgacgctagtaaatacttgcagcgagtcgaacggtgggctctgagaaatccaggata

SEQ ID NO: 43696 - DNA, 75 bp, Artificial Sequence
  Synthetic
ctgttcatggcgaccctggattgtggatgaccgcttctaaggaatcaggtgactggaaactggaatcattgtcaa

SEQ ID NO: 43697 - DNA, 75 bp, Artificial Sequence
  Synthetic
tcttggaatattagtggctatcggatggctattgggcaggactacagcgcagcgtgtcatctacatcaccctcct

SEQ ID NO: 43698 - DNA, 75 bp, Artificial Sequence
  Synthetic
tgtgttgatcggaccagcatacagtctgcaatgcatagatgtggctaagcgcgattttatccagggagtcagtgg

SEQ ID NO: 43699 - DNA, 75 bp, Artificial Sequence
  Synthetic
gcccgattcgcacaccatttggggaagaggagtgctggagtcaaagctaatcctaccatcaatgttcggaggacc

SEQ ID NO: 43700 - DNA, 75 bp, Artificial Sequence
  Synthetic
tggcacatgggtggacgtcgttttggacgtgcacgggtgtgtgactattgcagcagaaggtaaaccaacagtgga

SEQ ID NO: 43701 - DNA, 75 bp, Artificial Sequence
  Synthetic
agtttctcacatgaacaccagacctggatatgccacgcaattgtcaggaccctggaacaacgtcccattggacgt

SEQ ID NO: 43702 - DNA, 75 bp, Artificial Sequence
  Synthetic
tttcaagttgacgaagttggagatgacgaaacttgcaaaggtgcgagcgtactgcctcactgcctccgtatcaga

SEQ ID NO: 43703 - DNA, 75 bp, Artificial Sequence
  Synthetic
tgtgtttgaggagtgtcctggtaccaaagttgtggtggaaaacaattgcacgaacaggggagaatccatcagatc

SEQ ID NO: 43704 - DNA, 75 bp, Artificial Sequence
  Synthetic
acgaaacttgcaaaggtgcgagcgtactgcctcactgcctccgtatcagacatcacagtcgaaagtggatgtcca

SEQ ID NO: 43705 - DNA, 75 bp, Artificial Sequence
  Synthetic
cgaacaggggagaatccatcagatctaccacagatagcggcaaaatcattccagaatggtgctgccgaaaatgca

SEQ ID NO: 43706 - DNA, 75 bp, Artificial Sequence
  Synthetic
actgcctcactgcctccgtatcagacatcacagtcgaaagtggatgtccaggaacaggcgaaattcataacacca

SEQ ID NO: 43707 - DNA, 75 bp, Artificial Sequence
  Synthetic
aggcaaaggacacctcctacatgtgcaaggtgagctaccctgacagaggttggggaaatggatgtggactgtttg

SEQ ID NO: 43708 - DNA, 75 bp, Artificial Sequence
  Synthetic
tggggaaatggatgtggactgtttggaaaagggtcaatggaaacgtgtgctaaatttgcttgcaccaagcaactg

SEQ ID NO: 43709 - DNA, 75 bp, Artificial Sequence
  Synthetic
gaaaagggtcaatggaaacgtgtgctaaatttgcttgcaccaagcaactgcatggacatgtaattagccgcgaga

SEQ ID NO: 43710 - DNA, 75 bp, Artificial Sequence
  Synthetic
gatgatttttccttagggctcctagtgctaatcatttttgtgcaggagggtcttaaaagaagaatgaccagccgg

SEQ ID NO: 43711 - DNA, 75 bp, Artificial Sequence
  Synthetic
acatcgaagcggaagtggatatttctatccatggacaatcggctcctgattctgacgatgcatccaagcgcaaga

SEQ ID NO: 43712 - DNA, 75 bp, Artificial Sequence
  Synthetic
accggaaggaattagccacggccaccatcactcctcaagctagctcaatagaggcggatatgggtgattttggta

SEQ ID NO: 43713 - DNA, 75 bp, Artificial Sequence
  Synthetic
gaggcggatatgggtgattttggtaaagtgggtatggactgttctctggacattggaattgactttgagcaagtc

SEQ ID NO: 43714 - DNA, 75 bp, Artificial Sequence
  Synthetic
tacttgattatggttggtgtagcatttgcagaaatgaataatgggggagacttgattcatttagctttgatcgcc

SEQ ID NO: 43715 - DNA, 75 bp, Artificial Sequence
  Synthetic
ttgatcgtagacacagcctcacgctggtggatggtcaagagagactggttccaggacttagcacttccatggaca

SEQ ID NO: 43716 - DNA, 75 bp, Artificial Sequence
  Synthetic
acatttaaagtgcaacctggttatctgcttttctttcttcttcgcaaacaatggtcaccacgggaaagtaccatt

SEQ ID NO: 43717 - DNA, 75 bp, Artificial Sequence
  Synthetic
ggtggatggtcaagagagactggttccaggacttagcacttccatggacatcaccgtcagcagacttctggcatg

SEQ ID NO: 43718 - DNA, 75 bp, Artificial Sequence
  Synthetic
atcgtgaccggttagttgaatttggagttccgcatgctacgcgacaatctgtatactccattggagatcaagaag

SEQ ID NO: 43719 - DNA, 75 bp, Artificial Sequence
  Synthetic
agttccgcatgctacgcgacaatctgtatactccattggagatcaagaaggagcatttttcactgccgtggcaaa

SEQ ID NO: 43720 - DNA, 75 bp, Artificial Sequence
  Synthetic
agccccgtcagtcgagtggaactctgacaaagtcaagttagcgaccggattcctgaaatgcagaatcaagcttgg

SEQ ID NO: 43721 - DNA, 75 bp, Artificial Sequence
  Synthetic
gacaaagtcaagttagcgaccggattcctgaaatgcagaatcaagcttggcaacatgaagctgaaagggtcaaca

SEQ ID NO: 43722 - DNA, 75 bp, Artificial Sequence
  Synthetic
tcctgaaatgcagaatcaagcttggcaacatgaagctgaaagggtcaacatacgtcacgtgtgcgcaagcgttca

SEQ ID NO: 43723 - DNA, 75 bp, Artificial Sequence
  Synthetic
gcctgacgccacatgctataagagttagcatggtcacgttagcggcaggcactctcatcaaaggcacaaagggaa

SEQ ID NO: 43724 - DNA, 75 bp, Artificial Sequence
  Synthetic
cctttgcgaagcggccagtggacacaggtcatgggacagtcgtgttccaagtatcatatgctggaacagatgcgc

SEQ ID NO: 43725 - DNA, 75 bp, Artificial Sequence
  Synthetic
catgtaaaataccagtggccgtgactgacaaaccaaacggcgagcatgtcgggagattggtgacagcacacccat

SEQ ID NO: 43726 - DNA, 75 bp, Artificial Sequence
  Synthetic
tcatagcgaaacagaatgagaaggcagtcgttgaagttgaaccaccatttggagacagctatatagagattggag

SEQ ID NO: 43727 - DNA, 75 bp, Artificial Sequence
  Synthetic
taacatgcgctatgatcggggcattaagcggaaacgcaatgaatgacattgctgggccagcggcagctgcctctc

SEQ ID NO: 43728 - DNA, 75 bp, Artificial Sequence
  Synthetic
aagcggaaacgcaatgaatgacattgctgggccagcggcagctgcctctctaatttttgtggcttacgcaataag

SEQ ID NO: 43729 - DNA, 75 bp, Artificial Sequence
  Synthetic
caggaaccacaaaaatctctgaagcctggcacaaacccggaagctccattggtaatgcgttggccttgtcataca

SEQ ID NO: 43730 - DNA, 75 bp, Artificial Sequence
  Synthetic
aaggaatgaaacggataacagcaatgggcgaacacgcatgggactttgggtccatcggaggattcttcagcagca

SEQ ID NO: 43731 - DNA, 75 bp, Artificial Sequence
  Synthetic
tgggaaaagcggtacatcacgtttttggcagtttgttcaggactctatttggaggcattggatggatggcaaaaa

SEQ ID NO: 43732 - DNA, 75 bp, Artificial Sequence
  Synthetic
ttttgattggagcgctgctcatttggctaggaataagcaccagagatcgcatgcttgccacatctttcattctga

SEQ ID NO: 43733 - DNA, 75 bp, Artificial Sequence
  Synthetic
atgcttgccacatctttcattctgactggatcaatcctgctctatttggcaaccacaacagttggagtgtctgaa

SEQ ID NO: 43734 - DNA, 75 bp, Artificial Sequence
  Synthetic
attggatgcagccttgacataacacacagagaaatcaagtgtggagatggcattttcatcttcagggatgcaggg

SEQ ID NO: 43735 - DNA, 75 bp, Artificial Sequence
  Synthetic
ggctggagagacaaatatgtctttcatcctggctctccaaaaaccctagctgcagctatttggaaaggatggaat

SEQ ID NO: 43736 - DNA, 75 bp, Artificial Sequence
  Synthetic
ctctaacgagtggtaacggtaggatggatccatactgggcagatgttcgagaagatctcatcagctacggtgggc

SEQ ID NO: 43737 - DNA, 75 bp, Artificial Sequence
  Synthetic
gatggaatctgtggagttaggtcagccacccgcatggaacatgaaatgtggaaacaaattgaaaatgagctcaat

SEQ ID NO: 43738 - DNA, 75 bp, Artificial Sequence
  Synthetic
gggattctagaagaaaatgacatcaaattgagtgtcgttgtgaagaatgccaatggcacatatccacgaggaacc

SEQ ID NO: 43739 - DNA, 75 bp, Artificial Sequence
  Synthetic
gtttgtcatgtcagatggaactgaggttggggctgtggtgcttgactacccgtcaggcacttcaggatccccaat

SEQ ID NO: 43740 - DNA, 75 bp, Artificial Sequence
  Synthetic
aagtcattaacccgaaacacaacaggactgcagtacggatggaagtcgtggggcaagacaatgtttgtttcagtg

SEQ ID NO: 43741 - DNA, 75 bp, Artificial Sequence
  Synthetic
gttggggctgtggtgcttgactacccgtcaggcacttcaggatccccaatcgtggacaaagatggaaatgtagtt

SEQ ID NO: 43742 - DNA, 75 bp, Artificial Sequence
  Synthetic
ccaatagccgagaacactttcataatcgatggaaatgatgaaggagagtgtgcctcggacaaacgcgcttggaat

SEQ ID NO: 43743 - DNA, 75 bp, Artificial Sequence
  Synthetic
acatttaagatagaggagtttggcacaggaataatgaaaaccaaagtcttcctggatttggctgacgcacaaaca

SEQ ID NO: 43744 - DNA, 75 bp, Artificial Sequence
  Synthetic
aacattacccctgtagtattccacccggacatgctaaaaaagggaaagctgagcgttatggacctacatccagga

SEQ ID NO: 43745 - DNA, 75 bp, Artificial Sequence
  Synthetic
gaatactgcgacacggaactgttgggagctgctgtgaaaggcaacaagtctgttcatggcgaccccggattgtgg

SEQ ID NO: 43746 - DNA, 75 bp, Artificial Sequence
  Synthetic
gagctgctgtgaaaggcaacaagtctgttcatggcgaccccggattgtggatgactgcttctaaggaatcaggcg

SEQ ID NO: 43747 - DNA, 75 bp, Artificial Sequence
  Synthetic
gccccaacgcgtgttgtagctaaggaaatgcacggagctctagctggactaccggtgagataccaaacctcggcc

SEQ ID NO: 43748 - DNA, 75 bp, Artificial Sequence
  Synthetic
actggaaactggaatcattgtcaatgacggagagcaggcggtgcctgtggcccgattcgcacaccatttggggaa

SEQ ID NO: 43749 - DNA, 75 bp, Artificial Sequence
  Synthetic
gacggagagcaggcggtgcctgtggcccgattcgcacaccatttggggaagaggagtgctggagtcaaaactcat

SEQ ID NO: 43750 - DNA, 75 bp, Artificial Sequence
  Synthetic
gttgaaaccaaagggagtggaaatgagctgatagacgtcatgtgtcatgcgacattcacatacagacaattgaca

SEQ ID NO: 43751 - DNA, 75 bp, Artificial Sequence
  Synthetic
cttaccatcaatgttcggaggaccagtttctcacatgaacaccagacctggatatgccacgcaattgtcaggacc

SEQ ID NO: 43752 - DNA, 75 bp, Artificial Sequence
  Synthetic
ccaggaagaatggttaattaccaattgtatgtaatggacgaagcacatttcaccgacccagcttcaattgcggca

SEQ ID NO: 43753 - DNA, 75 bp, Artificial Sequence
  Synthetic
tgtatgtaatggacgaagcacatttcaccgacccagcttcaattgcggcaagaggaataatcgcaacacgcgtca

SEQ ID NO: 43754 - DNA, 75 bp, Artificial Sequence
  Synthetic
ctggaacaatgtcccactggatgttgtgtttgaggagtgtcctggtactaaagttgtggtggaaaacaattgcac

SEQ ID NO: 43755 - DNA, 75 bp, Artificial Sequence
  Synthetic
aagttgtggtggaaaacaattgcacgaacagaggagaatccatcagatctaccacagatagtggcaaaatcattc

SEQ ID NO: 43756 - DNA, 75 bp, Artificial Sequence
  Synthetic
cttgatgcattcccagaatccaatagccatattgaagacgaggaaagggaaattccagacaaagcatggagcacc

SEQ ID NO: 43757 - DNA, 75 bp, Artificial Sequence
  Synthetic
cagaatggtgctgccggaaatgcaccatgccacccctcacttaccgcacgccagatggatgctggtatgccatgg

SEQ ID NO: 43758 - DNA, 75 bp, Artificial Sequence
  Synthetic
ggatttgaatggattacagattatactggcaaaactgtatggtttgttccatcaatccgaactggaaacatcata

SEQ ID NO: 43759 - DNA, 75 bp, Artificial Sequence
  Synthetic
aaatcagaccaaaaaaggcaagcgaagaaagtctgttgcgatcaaaggtttcagctggaacatttcaaggaattg

SEQ ID NO: 43760 - DNA, 75 bp, Artificial Sequence
  Synthetic
agaaagtctgttgcgatcaaaggtttcagctggaacatttcaaggaattgatgatttttccttagggctcctagt

SEQ ID NO: 43761 - DNA, 75 bp, Artificial Sequence
  Synthetic
atcaatccgaactggaaacatcatagcgagctgcctcgcaaggacagggaagaaatgcgttgtgttgaatagcaa

SEQ ID NO: 43762 - DNA, 75 bp, Artificial Sequence
  Synthetic
tcagctggaacatttcaaggaattgatgatttttccttagggctcctagtgctaatcattttcgtgcaggaaggt

SEQ ID NO: 43763 - DNA, 75 bp, Artificial Sequence
  Synthetic
cttaaaagaagaatgaccagccggtacataatgttggctgcactaggactattgctggcagcagtgttgggtgac

SEQ ID NO: 43764 - DNA, 75 bp, Artificial Sequence
  Synthetic
acataatgttggctgcactaggactattgctggcagcagtgttgggtgacctcacatacaatgacatagcaaggt

SEQ ID NO: 43765 - DNA, 75 bp, Artificial Sequence
  Synthetic
ctcacatacaatgacatagcaaggtacgtgatcatggttggtgtagcatttgcagaaatgaacaacgggggagac

SEQ ID NO: 43766 - DNA, 75 bp, Artificial Sequence
  Synthetic
ttgattcatttagccctgattgccacattcaaagtgcaacctggttatctgcttttcttccttcttcgcaaacaa

SEQ ID NO: 43767 - DNA, 75 bp, Artificial Sequence
  Synthetic
tggtcaccacgggaaagtaccattttggcttcagcagcagtcgttctgcaaatttgtgcggctgcatggcaatca

SEQ ID NO: 43768 - DNA, 75 bp, Artificial Sequence
  Synthetic
acaaagtctatgcaagtgctgaatgctcttgctatgggatggctgtacatcagagccattgtggtacccggagct

SEQ ID NO: 43769 - DNA, 75 bp, Artificial Sequence
  Synthetic
tgacatgttaagtgaaacggatggacactttaggctggatatgaccaaacgtgacgtattcaaggatttggtgcg

SEQ ID NO: 43770 - DNA, 75 bp, Artificial Sequence
  Synthetic
ctttccaaagcaatgcccctcatttgcatgtgcgtcccaggcgtgttgagcctgacgccacatgctataagagtc

SEQ ID NO: 43771 - DNA, 75 bp, Artificial Sequence
  Synthetic
gcatgtgcgtcccaggcgtgttgagcctgacgccacatgctataagagtcagcatggttacaatagcggcaggca

SEQ ID NO: 43772 - DNA, 75 bp, Artificial Sequence
  Synthetic
ctctcatcaaaggcacgaagggaacatcagttcggaagcacatgccctattttttaggactagtaggagccgtgg

SEQ ID NO: 43773 - DNA, 75 bp, Artificial Sequence
  Synthetic
atcagttcggaagcacatgccctattttttaggactagtaggagccgtggccggactggatccattaggtatgct

SEQ ID NO: 43774 - DNA, 75 bp, Artificial Sequence
  Synthetic
tggatactccttattaacgtacagcagcggaaagaggtcatggccagcaggagagattatgacggcagtcggtct

SEQ ID NO: 43775 - DNA, 75 bp, Artificial Sequence
  Synthetic
gaggaagatactgcaaccaagatggattgaccaacgcacataccaggagaaaacagcacttaaggctttcattga

SEQ ID NO: 43776 - DNA, 75 bp, Artificial Sequence
  Synthetic
aacatgcgctatgatcggggcattaagcggaaacgcgatgaatgatattgctgggcctgcggcagctgcctctct

SEQ ID NO: 43777 - DNA, 75 bp, Artificial Sequence
  Synthetic
atttgctgagggacgccgaagttatgttcccataatagaggtgctcggcaaacttccacagcatttcgctgacaa

SEQ ID NO: 43778 - DNA, 75 bp, Artificial Sequence
  Synthetic
gttcccataatagaggtgctcggcaaacttccacagcatttcgctgacaaaactattgatgcggctgacaccttc

SEQ ID NO: 43779 - DNA, 75 bp, Artificial Sequence
  Synthetic
gatttttgtggcttacgcaataagtgggagatctgcagacgtgttcttggaaaaggctggtgaaatttcatggat

SEQ ID NO: 43780 - DNA, 75 bp, Artificial Sequence
  Synthetic
tgacgacgcagcagtttctggatcaagtccaagggtggacgtgcaagttaccgacgggggggattttcggcttcg

SEQ ID NO: 43781 - DNA, 75 bp, Artificial Sequence
  Synthetic
ccacgaagccgaggcttcgtggctaaagaatggagtgatggctttctgtctcgttctggctggagtacacccgtt

SEQ ID NO: 43782 - DNA, 75 bp, Artificial Sequence
  Synthetic
agcgattccggtagcggggttgatctggttcggtttcgtaaaaagtgggaggcgtggcacggttctctgggatat

SEQ ID NO: 43783 - DNA, 75 bp, Artificial Sequence
  Synthetic
accacatccgattgcatcatctgccccaagtgtggaggacggatgttacagagtgatgtcaagaaggctcattgg

SEQ ID NO: 43784 - DNA, 75 bp, Artificial Sequence
  Synthetic
tccagaaccaggctcgcagagatcagtgcaagataacacgattgccatggtcctaattggaatactaagcattgc

SEQ ID NO: 43785 - DNA, 75 bp, Artificial Sequence
  Synthetic
ttctacgcaagtaggagtgggagtgatgaaagactcagtgtttcacacaatgtggcacgtcacccgtggcgcctc

SEQ ID NO: 43786 - DNA, 75 bp, Artificial Sequence
  Synthetic
tgtggcacgtcacccgtggcgcctctctaacgagtggtaacggtagaatggatccatattgggcggatgttcgag

SEQ ID NO: 43787 - DNA, 75 bp, Artificial Sequence
  Synthetic
agccccgaccaacaatccctggaagtttgattttagcgtggacttgagaccggcgacatcatgggctctgtacgt

SEQ ID NO: 43788 - DNA, 75 bp, Artificial Sequence
  Synthetic
aagatctcatcagctacggtgggccatggaagctcaacagcacttgggatggatcttctgaagtgcagttaatag

SEQ ID NO: 43789 - DNA, 75 bp, Artificial Sequence
  Synthetic
agtgattgctacaatgcttgggcccattttggagcatgcgatcgtgactcacttcacaagcatatcaattgcagc

SEQ ID NO: 43790 - DNA, 75 bp, Artificial Sequence
  Synthetic
ggatcttctgaagtgcagttaatagcagtgcaaccccagaaaatacccgagaacgttcaaacaactccaggaagg

SEQ ID NO: 43791 - DNA, 75 bp, Artificial Sequence
  Synthetic
cattacgaaccaagcaggaatactgttatcaatggataaaggaacaccatttttcaacttggactggggagtcat

SEQ ID NO: 43792 - DNA, 75 bp, Artificial Sequence
  Synthetic
ttcgtcatgtcagacggaactgaggttggggctgtggtgcttgactacccgtcaggcacttcaggttccccaatc

SEQ ID NO: 43793 - DNA, 75 bp, Artificial Sequence
  Synthetic
tctgttgggagtggggtgttggtctagcataacggggacaaccttgttatgtgcgatcggactctcctgcgttca

SEQ ID NO: 43794 - DNA, 75 bp, Artificial Sequence
  Synthetic
gtggacaaagatggaaatgtggttggactgtatgggaatggtgtcatgcttaacgacagcacctacgctagtgcg

SEQ ID NO: 43795 - DNA, 75 bp, Artificial Sequence
  Synthetic
taacgacagcacctacgctagtgcgatcgcgcagtcagcaggttgtgagaacattacccctgtagtattccaccc

SEQ ID NO: 43796 - DNA, 75 bp, Artificial Sequence
  Synthetic
tttctctatgactctacctggagtcagggccaaagcagcgagagaagctcaaaacagaaccgcagctggagtatc

SEQ ID NO: 43797 - DNA, 75 bp, Artificial Sequence
  Synthetic
atcgcgcagtcagcaggttgtgagaacattacccctgtagtattccacccggacatgttgaaaaagggaaagctg

SEQ ID NO: 43798 - DNA, 75 bp, Artificial Sequence
  Synthetic
aaagaaccccattgtggatggagtcaacaccataaacgtcacagcgcccccaggaatggatcccatgtatgagcg

SEQ ID NO: 43799 - DNA, 75 bp, Artificial Sequence
  Synthetic
agcgttatggacctacatccaggagcgggaaaaacccgcaaggtgttgccacaggttctcaaagaagcagtggcc

SEQ ID NO: 43800 - DNA, 75 bp, Artificial Sequence
  Synthetic
acaggttctcaaagaagcagtggccaagaagttgaaaacccttgtactggccccgacgcgtgttgtagctaagga

SEQ ID NO: 43801 - DNA, 75 bp, Artificial Sequence
  Synthetic
aagaagttgaaaacccttgtactggccccgacgcgtgttgtagctaaggaaatgcacggagctctagctggattg

SEQ ID NO: 43802 - DNA, 75 bp, Artificial Sequence
  Synthetic
ccggtgagataccaaacctcggccgttgaaaccaaagggagtggaaatgagctgatagacgtcatgtgtcatgcg

SEQ ID NO: 43803 - DNA, 75 bp, Artificial Sequence
  Synthetic
acatttacgtacagacaattgacaccaggaagaatggttaattaccaattgtatgtaatggatgaggcacatttc

SEQ ID NO: 43804 - DNA, 75 bp, Artificial Sequence
  Synthetic
caggaagaatggttaattaccaattgtatgtaatggatgaggcacatttcactgacccagcttcaattgcggcaa

SEQ ID NO: 43805 - DNA, 75 bp, Artificial Sequence
  Synthetic
gaggaataatcgcaacacgggtcaagctaggagaagcagctgcgattttcatgacggcaacacctccaggaactc

SEQ ID NO: 43806 - DNA, 75 bp, Artificial Sequence
  Synthetic
atgacggcaacacctccaggaactcttgatgcattcccagaatccaatagccatattgaagatgaggaaagggaa

SEQ ID NO: 43807 - DNA, 75 bp, Artificial Sequence
  Synthetic
attccagacaaggcatggagcaccggattcgaatggattacagattacacaggcaaaactgtgtggtttgttcca

SEQ ID NO: 43808 - DNA, 75 bp, Artificial Sequence
  Synthetic
aggcaaaactgtgtggtttgttccatcaattcgaactgggaacatcatagcgagctgcctcgcgaggacagggaa

SEQ ID NO: 43809 - DNA, 75 bp, Artificial Sequence
  Synthetic
atgggggatgtcacagatttgggatgcggacgaggtggatggtgttattacgcagcagctcaaagaaacgttgta

SEQ ID NO: 43810 - DNA, 75 bp, Artificial Sequence
  Synthetic
gaaatgcgttgtgttgaatagcaaaacattcaatgacgagtttccaaagaccaagagtggaacgtgggactttgt

SEQ ID NO: 43811 - DNA, 75 bp, Artificial Sequence
  Synthetic
tctgtgcgaggcttcactaaaggaggtgacggacacgaagaacctattccagtgcagacttatggatggaacatt

SEQ ID NO: 43812 - DNA, 75 bp, Artificial Sequence
  Synthetic
gatcacaacggacatatctgaaatgggagcaaatttcaaagcctcacgagtcattgactgtagaacgtcaatcaa

SEQ ID NO: 43813 - DNA, 75 bp, Artificial Sequence
  Synthetic
accaacattggcctatgtcccttctgagagagtagtgttgggatctccaaaacccataagcccagctagtgcagc

SEQ ID NO: 43814 - DNA, 75 bp, Artificial Sequence
  Synthetic
aagaagagcggaccctacgcgtgttgaatctgtttgaagagtggatcagaaagagtaagccaacacacttttgtt

SEQ ID NO: 43815 - DNA, 75 bp, Artificial Sequence
  Synthetic
acagcgtagagggagagtgggtcgagaccccactcagcttggtgaccagtacatttacggaggcgaggttggtga

SEQ ID NO: 43816 - DNA, 75 bp, Artificial Sequence
  Synthetic
cgacttctccaacatggtgcactggacagaagcgaagatcttaatggacaacatcatggtaccaggcggtctgta

SEQ ID NO: 43817 - DNA, 75 bp, Artificial Sequence
  Synthetic
ctaatgaaagttcacggaggtgctttggtaagagtgccactctcccgtaacagcacacatgagatgtattgggta

SEQ ID NO: 43818 - DNA, 75 bp, Artificial Sequence
  Synthetic
acatcatggtaccaggcggtctgtacccacagttctacgagccggaggctgacatgctaagtgaaacggatggac

SEQ ID NO: 43819 - DNA, 75 bp, Artificial Sequence
  Synthetic
cccacagttctacgagccggaggctgacatgctaagtgaaacggatggacacttcaggctggatatgaccaaacg

SEQ ID NO: 43820 - DNA, 75 bp, Artificial Sequence
  Synthetic
tgacgtattcaaggatttggtgcgcaaggcagacttacccatatggctggcttatcaggtggccaagcatggtca

SEQ ID NO: 43821 - DNA, 75 bp, Artificial Sequence
  Synthetic
tgaatacaaagacagaagctggtgccatagtgggccatctggacatctcatctacgatgattacggacagacagt

SEQ ID NO: 43822 - DNA, 75 bp, Artificial Sequence
  Synthetic
tgaatacaagcttgtgaatggcgagaggaagatactgcaaccaagatggattgaccaacgcacataccaggagaa

SEQ ID NO: 43823 - DNA, 75 bp, Artificial Sequence
  Synthetic
aacagcactcaaggctttcatcgaatttgctgagggacgccgaagttatgttcctataatagaagtgctcggcaa

SEQ ID NO: 43824 - DNA, 75 bp, Artificial Sequence
  Synthetic
tttgctgagggacgccgaagttatgttcctataatagaagtgctcggcaaacttccacagcatttcgccgacaaa

SEQ ID NO: 43825 - DNA, 75 bp, Artificial Sequence
  Synthetic
aatggagtggtcaaggagctaacacatccatgggacacaaactccggagtgacaaatgtttgcatgacagacaca

SEQ ID NO: 43826 - DNA, 75 bp, Artificial Sequence
  Synthetic
actattgatgcggctgacaccttcaagactgtgcttacagccactccaggaagtagagcatacaggcttgcagtt

SEQ ID NO: 43827 - DNA, 75 bp, Artificial Sequence
  Synthetic
accccttttgggcaacagcgcgttttcaaagaaaaggtggacaccaaagcaatggaacctccaactggaacccga

SEQ ID NO: 43828 - DNA, 75 bp, Artificial Sequence
  Synthetic
tcaaagaaaaggtggacaccaaagcaatggaacctccaactggaacccgagaagtgatgagaattgtgaacagat

SEQ ID NO: 43829 - DNA, 75 bp, Artificial Sequence
  Synthetic
gacaacctacccgatgcagcagagacggcaatattcgtgacgatggtagggttcatgaccatgggaatactaatt

SEQ ID NO: 43830 - DNA, 75 bp, Artificial Sequence
  Synthetic
ttcctgatggcacccaaaggcatgacacgcatgtcgctgggattcatgaccatcatggcagctacgtattttctg

SEQ ID NO: 43831 - DNA, 75 bp, Artificial Sequence
  Synthetic
tgggcttcaggcatggctggatatcaaatagcggcaatgcaattagtggctttcattctcttcgtagtcttggtt

SEQ ID NO: 43832 - DNA, 75 bp, Artificial Sequence
  Synthetic
aaatagcggcaatgcaattagtggctttcattctcttcgtagtcttggttccagaaccaggatcgcagagatcag

SEQ ID NO: 43833 - DNA, 75 bp, Artificial Sequence
  Synthetic
tttcattctcttcgtagtcttggttccagaaccaggatcgcagagatcagtacaagacaatacgattgccatggt

SEQ ID NO: 43834 - DNA, 75 bp, Artificial Sequence
  Synthetic
cctaattggaatactaagcattgcagcattgattgcggcaaatgagacaggactgctggagaagacaaaaaatga

SEQ ID NO: 43835 - DNA, 75 bp, Artificial Sequence
  Synthetic
gagcaaggtacttggaatttgaggccctaggatttctgaacgaagatcattggctctcgagagagaactctaagg

SEQ ID NO: 43836 - DNA, 75 bp, Artificial Sequence
  Synthetic
tttcgtgtctttgttaccggttaaagccccgaacaacaatccctggaagtttgattttagcgtggacttgagacc

SEQ ID NO: 43837 - DNA, 75 bp, Artificial Sequence
  Synthetic
cctaggatttctgaacgaagatcattggctctcgagagagaactctaagggtggggtcgaagggattggattaca

SEQ ID NO: 43838 - DNA, 75 bp, Artificial Sequence
  Synthetic
ggcgacatcatgggctttgtatgtagtgattgctacaatgcttgggcccattttggagcatgcgattgtgactca

SEQ ID NO: 43839 - DNA, 75 bp, Artificial Sequence
  Synthetic
cttcacaagtatatcaattgcagccatcacgaatcaagcaggaatactgctatcaatggataaaggaacgccatt

SEQ ID NO: 43840 - DNA, 75 bp, Artificial Sequence
  Synthetic
ctagaggacgagatggagatcacaaagctgatggcacacacccacaagaaattggccacggccattatgaatctc

SEQ ID NO: 43841 - DNA, 75 bp, Artificial Sequence
  Synthetic
atcacgaatcaagcaggaatactgctatcaatggataaaggaacgccatttttcaacttggactggggcgtcatt

SEQ ID NO: 43842 - DNA, 75 bp, Artificial Sequence
  Synthetic
ctgttgggagtggggtgttggtctagcataacggggacaaccttgttgtgtgcgatcggactctcctgcgttcac

SEQ ID NO: 43843 - DNA, 75 bp, Artificial Sequence
  Synthetic
tgatgaggccaggcaagggaggaaagaccttaatggacatcattagcaggaaggaccagagaggtagcggacagg

SEQ ID NO: 43844 - DNA, 75 bp, Artificial Sequence
  Synthetic
ttctcaatgactctacctggagtcagggctaaagcagcgagagaagctcaaaacagaaccgcagctggagtatca

SEQ ID NO: 43845 - DNA, 75 bp, Artificial Sequence
  Synthetic
aaacagaaccgcagctggagtatcaaagaaccctattgtggatggagtcaacactataaacgtcacagcgccccc

SEQ ID NO: 43846 - DNA, 75 bp, Artificial Sequence
  Synthetic
aggaatggaccccatgtatgagcgcaaacttggactgtggatgctcctgatcatggcggtcatatccacagcggt

SEQ ID NO: 43847 - DNA, 75 bp, Artificial Sequence
  Synthetic
aaacagagacttgactcacttgatggaactaggcatactgggaagcgcagcacttggcccactcatagaagggaa

SEQ ID NO: 43848 - DNA, 75 bp, Artificial Sequence
  Synthetic
gaactaggcatactgggaagcgcagcacttggcccactcatagaagggaactcttccacaatctggaacacctca

SEQ ID NO: 43849 - DNA, 75 bp, Artificial Sequence
  Synthetic
gtggcatcttcactgtgcaacttgatgagaggacagtatctagctggaatacctctgacatacacgctggtcaga

SEQ ID NO: 43850 - DNA, 75 bp, Artificial Sequence
  Synthetic
acaccatttccataagctcagcctaaaggatggaagaacacttacagttccatgcagagaccaggacgaacttat

SEQ ID NO: 43851 - DNA, 75 bp, Artificial Sequence
  Synthetic
aacctctcgctaaaaggggttccccgtagaggagtcaccataagcaacacccgagggatggaatggaaacgcaaa

SEQ ID NO: 43852 - DNA, 75 bp, Artificial Sequence
  Synthetic
ctaaacgcaatgaacaaggaaacctttcagagatacagacgagatgggatagttgaggtggacagaacagcagcg

SEQ ID NO: 43853 - DNA, 75 bp, Artificial Sequence
  Synthetic
cgggaagctttaaagagtggaaatgtaacaggaggtcacgctgtatcccggggttcagcaaagctcagatggctg

SEQ ID NO: 43854 - DNA, 75 bp, Artificial Sequence
  Synthetic
taacaggaggtcacgctgtatcccggggttcagcaaagctcagatggctggtagataaaggatatttacgcctga

SEQ ID NO: 43855 - DNA, 75 bp, Artificial Sequence
  Synthetic
gtagataaaggatatttacgcctgatgggggatgtcacagacttgggatgcgggcgaggtggatggtgttattac

SEQ ID NO: 43856 - DNA, 75 bp, Artificial Sequence
  Synthetic
gcagcagctcaaagaaacgttgtatctgtacgaggcttcaccaaaggaggtgacggacacgaagaacccattccg

SEQ ID NO: 43857 - DNA, 75 bp, Artificial Sequence
  Synthetic
gtgcagacttatggatggaacattgtcactctgcgtagcaaagtggacgttttctacatgcctacacacatgaca

SEQ ID NO: 43858 - DNA, 75 bp, Artificial Sequence
  Synthetic
tttctacatgcctacacacatgacagacactctattgtgtgacattggagagtcatcgtctaacatgctagtaga

SEQ ID NO: 43859 - DNA, 75 bp, Artificial Sequence
  Synthetic
agtcatcgtctaacatgctagtagaagaagagaggaccctacgcgtgctgaatctggttgaagagtggatcagaa

SEQ ID NO: 43860 - DNA, 75 bp, Artificial Sequence
  Synthetic
tacctcgattacctccaagcccaaaatagattcagcattcctgctgaattcaccatgggcaacatattgatctaa

SEQ ID NO: 43861 - DNA, 75 bp, Artificial Sequence
  Synthetic
agagtaagccaactcacttttgttgcaaggttcttgctccatacatgccaaatgtattggagaagatagacaagc

SEQ ID NO: 43862 - DNA, 75 bp, Artificial Sequence
  Synthetic
caaggttcttgctccatacatgccaaatgtattggagaagatagacaagctaatgaaagttcatggaggtgcttt

SEQ ID NO: 43863 - DNA, 75 bp, Artificial Sequence
  Synthetic
aatgtattggagaagatagacaagctaatgaaagttcatggaggtgctttagtgagagtgccactctcccgcaac

SEQ ID NO: 43864 - DNA, 75 bp, Artificial Sequence
  Synthetic
agcacacatgagatgtattgggtatctgatgcaagaggtaatgccatgaatgcagtggcatctctgagtagaaca

SEQ ID NO: 43865 - DNA, 75 bp, Artificial Sequence
  Synthetic
cttttggacaggatgatacacttgacaggaaaagtgcactgggaagatgatgtcaacctgggaactgggactaga

SEQ ID NO: 43866 - DNA, 75 bp, Artificial Sequence
  Synthetic
gcagtgaacagtgtcgctgatccaccaaactgggacaaaattggactccgagtgagaaaacttgaacaagaatac

SEQ ID NO: 43867 - DNA, 75 bp, Artificial Sequence
  Synthetic
aaagcttcatggatgtatgatgcagaacacccctacaagacgtggacctaccatggatcatatgagacttccaca

SEQ ID NO: 43868 - DNA, 75 bp, Artificial Sequence
  Synthetic
tctggaagtgcttcatcaatgataaatggagtggtcaaggagctaacacacccatgggacacaaactccggagtg

SEQ ID NO: 43869 - DNA, 75 bp, Artificial Sequence
  Synthetic
acaaacgtttgcatgacagacacaaccccttttgggcaacagcgcgttttcaaagaaaaggtcgacaccaaagca

SEQ ID NO: 43870 - DNA, 75 bp, Artificial Sequence
  Synthetic
ccccttttgggcaacagcgcgttttcaaagaaaaggtcgacaccaaagcaatggaacctccaactggaaccagag

SEQ ID NO: 43871 - DNA, 75 bp, Artificial Sequence
  Synthetic
aagtgatgaggattgtgaacagatggttgacaaactacctgtctagaacaaagaagcctagactgtgtactccag

SEQ ID NO: 43872 - DNA, 75 bp, Artificial Sequence
  Synthetic
gttgacaaactacctgtctagaacaaagaagcctagactgtgtactccagatgagtttattgctaaggtgaactc

SEQ ID NO: 43873 - DNA, 75 bp, Artificial Sequence
  Synthetic
tgatgcggctctgggaacaatgttcaatgaccaagggaactggccaagcgcaaaagatgcagtgagagaccatgg

SEQ ID NO: 43874 - DNA, 75 bp, Artificial Sequence
  Synthetic
attctggaggcaagtcgacattgagcgacaacaccacttagagggaagatgcgtctcatgtgtctacaacatgat

SEQ ID NO: 43875 - DNA, 75 bp, Artificial Sequence
  Synthetic
gggaaagcgtgaaaagaaattgacggaatttggaagggccaagggcagcagagcaatctggtacatgtggctagg

SEQ ID NO: 43876 - DNA, 75 bp, Artificial Sequence
  Synthetic
agcaaggtacttggaatttgaagccctaggattcctgaacgaagatcattggctctcgagagagaattccaaagg

SEQ ID NO: 43877 - DNA, 75 bp, Artificial Sequence
  Synthetic
tggggtcgaagggattggattacaatacctaggctacatccttgaggatatgggaggaatgacaggaggccaaat

SEQ ID NO: 43878 - DNA, 75 bp, Artificial Sequence
  Synthetic
tgggaggaatgacaggaggccaaatgtatgcagatgacacagccggctgggacaccaagataacgaatgctgacc

SEQ ID NO: 43879 - DNA, 75 bp, Artificial Sequence
  Synthetic
gacaccaagataacgaatgctgacctagaggatgagatggagatcacaaagctgatggcacacacccacaaaaaa

SEQ ID NO: 43880 - DNA, 75 bp, Artificial Sequence
  Synthetic
ttggccacggccattatggatctcacgtacatgaacaaggttgtgagagtgatgaggccaggcaagggaggaaag

SEQ ID NO: 43881 - DNA, 75 bp, Artificial Sequence
  Synthetic
cgtacatgaacaaggttgtgagagtgatgaggccaggcaagggaggaaagacgctaatggacatcattagcagga

SEQ ID NO: 43882 - DNA, 75 bp, Artificial Sequence
  Synthetic
aggaccagagaggtagcggacaggtcgtgacttaccccctcaacacgtggacaaacctcaaggtgcagttgatta

SEQ ID NO: 43883 - DNA, 75 bp, Artificial Sequence
  Synthetic
ggatggctgaaggcgaaggagtgatcctacctgaagacactctgtcactcaccggctgcagtagacgcaatttag

SEQ ID NO: 43884 - DNA, 75 bp, Artificial Sequence
  Synthetic
aaatgtggctggtgaggaacggagaagaacgattaacccggatcgctgctagcggagatgatgtggtggttaagc

SEQ ID NO: 43885 - DNA, 75 bp, Artificial Sequence
  Synthetic
ccattgatgaccgatttgcagaagctctgcactttctcaacagcatggccaagatcagaaaagatatcaatgaat

SEQ ID NO: 43886 - DNA, 75 bp, Artificial Sequence
  Synthetic
aagatcagaaaagatatcaatgaatggaagccctcaacaggctggaacagttgggagggtgtgccgttttgttca

SEQ ID NO: 43887 - DNA, 75 bp, Artificial Sequence
  Synthetic
ttgggagggtgtgccgttttgttcacaccatttccacaagctcagcttaaaggatggaagaacactcacagttcc

SEQ ID NO: 43888 - DNA, 75 bp, Artificial Sequence
  Synthetic
atgcagagatcaggacgaacttattggaagagctagagtgtctcctggagcagggtggacgttgcgagaaaccgc

SEQ ID NO: 43889 - DNA, 75 bp, Artificial Sequence
  Synthetic
aggactcagtaaggcgtatgcgcaaatgtggatgctgatccacttccacagaagggatctacgaaccatcgcgtt

SEQ ID NO: 43890 - DNA, 75 bp, Artificial Sequence
  Synthetic
atgtggatgctgatccacttccacagaagggatctacgaaccatcgcgttcgcaatttgcagtgcagtgcctaaa

SEQ ID NO: 43891 - DNA, 75 bp, Artificial Sequence
  Synthetic
gactgggttcccacaggaaggacatcgtggtccatccatgctcgaggtgaatggatgacgaatgaagacatgttg

SEQ ID NO: 43892 - DNA, 75 bp, Artificial Sequence
  Synthetic
gcggtgtggaatcgagtgtggatcactgagaatccatacatgttcaacaaagaaacaattcacgactggcgagat

SEQ ID NO: 43893 - DNA, 75 bp, Artificial Sequence
  Synthetic
gttccatacctgcggaaacaactggacaaaaattgcggatcaatgataggagtgaggtccagagccacgtgggct

SEQ ID NO: 43894 - DNA, 75 bp, Artificial Sequence
  Synthetic
gaaaacattcgtgtttcagtgaaccaggtacgtggttacattggtaaacatgagaactacctcgattacctccaa

SEQ ID NO: 43895 - DNA, 75 bp, Artificial Sequence
  Synthetic
gcccagaatagattcagcattcctgccgaattcaccatgggcaacatattgatctaagacactgagagaaaagac

SEQ ID NO: 43896 - DNA, 75 bp, Artificial Sequence
  Synthetic
tgaaaaacaattgacgctgagagtcaggcctaaatgccaccggatgatagtagacggtgctgcctgcagctatca

SEQ ID NO: 43897 - DNA, 75 bp, Artificial Sequence
  Synthetic
catataaactggcgccttatatgtttattagccgacagggggacacatgcacccagcagcccgagctggacaagg

SEQ ID NO: 43898 - DNA, 75 bp, Artificial Sequence
  Synthetic
catgtgtactagcggttagaggagacccccccaaaaatgaagggcactatatcgacacttgggaaagaccagagg

SEQ ID NO: 43899 - DNA, 75 bp, Artificial Sequence
  Synthetic
tactcgctgattcaccgccaccagactacacggcacagcgcgccggaaaaggtagtttggaggttgtaaaacaac

SEQ ID NO: 43900 - DNA, 75 bp, Artificial Sequence
  Synthetic
gattcaccgccaccagactacacggcacagcgcgccggaaaaggtagtttggaggttgtaaaacaacaagtatct

SEQ ID NO: 43901 - DNA, 75 bp, Artificial Sequence
  Synthetic
atggcgaataaacccaagaagcccggaagacgggctatcgatatagtgagacgtgcgttgcctcgcgtctcggga

SEQ ID NO: 43902 - DNA, 75 bp, Artificial Sequence
  Synthetic
acatcacagtcgaaagtggatgtccaggaacaggcgaaattcacaacaccaaggccaaggacacctcctacatgt

SEQ ID NO: 43903 - DNA, 75 bp, Artificial Sequence
  Synthetic
ctaaatttgcttgtaccaagcaactgcatggacacgtaattagccgcgagaacatcgaagcggaagtggatatct

SEQ ID NO: 43904 - DNA, 75 bp, Artificial Sequence
  Synthetic
aaagtgggtatggactgttctctggacattggaattgactttgaacaagtcttaatcgtggacacggcctcacgc

SEQ ID NO: 43905 - DNA, 75 bp, Artificial Sequence
  Synthetic
tggtggatggtcaagagagactggttccaggacttagcacttccatggacatcaccatcagcagatttctggcat

SEQ ID NO: 43906 - DNA, 75 bp, Artificial Sequence
  Synthetic
tccaggacttagcacttccatggacatcaccatcagcagatttctggcatgatcgtgaccggttagttgaatttg

SEQ ID NO: 43907 - DNA, 75 bp, Artificial Sequence
  Synthetic
tgtatactccattggagatcaagaaggagcattcttcactgctgtggcaaaagccccgtcagttgagtggaactc

SEQ ID NO: 43908 - DNA, 75 bp, Artificial Sequence
  Synthetic
gcaacatgaagctaaaagggtcaacatacgtcacgtgtgctcaagcgttcacctttgcgaagcgaccagtggaca

SEQ ID NO: 43909 - DNA, 75 bp, Artificial Sequence
  Synthetic
tcgcacagtggatcctaggcgctttttggtcacgcataaatcgtgagcaagaataaacatgggtcaacttgtgag

SEQ ID NO: 43910 - DNA, 75 bp, Artificial Sequence
  Synthetic
tttctttcaggaaattcctaacatcatacaggaagcaatcaacattgctctaatagctgtcagcctcattgctat

SEQ ID NO: 43911 - DNA, 75 bp, Artificial Sequence
  Synthetic
cctaaaagggttggtcaatctgtggaaaagtggtttgtttcaactcctggtcttccttattctagctggaaggtc

SEQ ID NO: 43912 - DNA, 75 bp, Artificial Sequence
  Synthetic
ctgctcattcaaaattggaagatccacagaactccaaaacatcacaataaacatgttaaaggtctttgaggacca

SEQ ID NO: 43913 - DNA, 75 bp, Artificial Sequence
  Synthetic
tcctatttcttgcacagtgaacaaaactctttattacatccgtgaaagtgagaatgcaacatggtgtgtagagat

SEQ ID NO: 43914 - DNA, 75 bp, Artificial Sequence
  Synthetic
tgctgcactggacatgtctgtcttgctctcgccacatgatccacgtgtaatgggcaacctatcaaactgtgttca

SEQ ID NO: 43915 - DNA, 75 bp, Artificial Sequence
  Synthetic
cccagacattaaacatagatcagaacttctaggtctattggagtggattttgagagctctgaaatatgattttct

SEQ ID NO: 43916 - DNA, 75 bp, Artificial Sequence
  Synthetic
aaattatccacccctcttgtgtgaaaaagtgacatcatctgtcaatgaaacacgcattcagataaatgtgagcga

SEQ ID NO: 43917 - DNA, 75 bp, Artificial Sequence
  Synthetic
tagtgcaggttctcatgatttcaaagaaaccatgctccaaaggctggccatactatttggcacaaaattgatgtt

SEQ ID NO: 43918 - DNA, 75 bp, Artificial Sequence
  Synthetic
tgataaaacacctaagcagttcatagttatcagaaatcagacttgggtgaatcagtgcaagtccaatcatgtcaa

SEQ ID NO: 43919 - DNA, 75 bp, Artificial Sequence
  Synthetic
cacgttgcatttgatgatggctaatgctgggcatgctgttaaattaagaagattgcaaggggtgttcacttggac

SEQ ID NO: 43920 - DNA, 75 bp, Artificial Sequence
  Synthetic
gatcacagatgctgctggcaacgacatgcctggaggttattgtttggaaaggtggatgttagtcacatctgacct

SEQ ID NO: 43921 - DNA, 75 bp, Artificial Sequence
  Synthetic
gaaatgttttggcaacactgctcttgcaaagtgtaacttaaatcatgactctgagttctgtgacatgttgaaact

SEQ ID NO: 43922 - DNA, 75 bp, Artificial Sequence
  Synthetic
gtttgaatttaacaaaaaagcaattgagtcattgaatgacaacacaaagaacaaagtcaatctattaacacattc

SEQ ID NO: 43923 - DNA, 75 bp, Artificial Sequence
  Synthetic
cattaatgctttaatttctgacaatcttttgatgaagaatagattaaaagagttattggacactccctactgcaa

SEQ ID NO: 43924 - DNA, 75 bp, Artificial Sequence
  Synthetic
ctacacaaaattctggtatgtcaaccacaccatcacaggagagcattcacttccacgctgttggatggttaaaaa

SEQ ID NO: 43925 - DNA, 75 bp, Artificial Sequence
  Synthetic
caacagctacctcaatgaaagtgaatttagaaatgattggattcttgagagtgaccacttgttgtccgaaatgtt

SEQ ID NO: 43926 - DNA, 75 bp, Artificial Sequence
  Synthetic
gaacaaagagtattttgacagacaagggaaaaccccaataacacttgttgacatctgcttttggagcacactgtt

SEQ ID NO: 43927 - DNA, 75 bp, Artificial Sequence
  Synthetic
cttcacaacaacattgtttctccatctagtaggcttcccaactcacagacacattcagggagaaccttgcccact

SEQ ID NO: 43928 - DNA, 75 bp, Artificial Sequence
  Synthetic
gcctcacaagctcaacagcaatggtggatgcaggtgtggcagatatccagaactcaagaaaccaacaacctggca

SEQ ID NO: 43929 - DNA, 75 bp, Artificial Sequence
  Synthetic
caggaaacactgaacttgagtggctcccaacccaccgtcccgggcatagcccgggacggtgcggcctcccagtcc

SEQ ID NO: 43930 - DNA, 75 bp, Artificial Sequence
  Synthetic
gcggcaaatgccgcggactgggagggcatgggcctatatggcgaatgccggcttcattgtaaacagcagcacttc

SEQ ID NO: 43931 - DNA, 75 bp, Artificial Sequence
  Synthetic
tggtagaagactctgcagtttgatctgtggtggctgcccatctatcaccgactggaacatcagacagtcaagcag

SEQ ID NO: 43932 - DNA, 75 bp, Artificial Sequence
  Synthetic
ggcgcaatgtggttctgttgattgtgaggggtctttgtcttttttcttttttggcaccacaaccccattgtgctt

SEQ ID NO: 43933 - DNA, 75 bp, Artificial Sequence
  Synthetic
cttacagaggtggccgaaatcagaccagacctgctcctcatagtttctggcttgatcagaacttagtttcacatc

SEQ ID NO: 43934 - DNA, 75 bp, Artificial Sequence
  Synthetic
cacgaccttgagatctttgcgaccatgtgtgtctaaaagtcttttgatgtcatcagagccttgggcggttaggac

SEQ ID NO: 43935 - DNA, 75 bp, Artificial Sequence
  Synthetic
catgtcttgtggtaacaaccctatgatgtagctaaggagtccaggttgggccgattccaagtcctttagtagcat

SEQ ID NO: 43936 - DNA, 75 bp, Artificial Sequence
  Synthetic
tccatgtgaatgtctacttccattcttgaatcctttctcatcatgaggttttctgtaacagagtatgtaattacc

SEQ ID NO: 43937 - DNA, 75 bp, Artificial Sequence
  Synthetic
tgattccggttgatataatgctagctcaacagggtcattgctggttccttcaatgtcaatccatgttgtgtggga

SEQ ID NO: 43938 - DNA, 75 bp, Artificial Sequence
  Synthetic
aggattaattttgctcatcgcctctctaacaactgactcttggatctctgtcagatgagagagtctcacatttaa

SEQ ID NO: 43939 - DNA, 75 bp, Artificial Sequence
  Synthetic
ccccactttctcaggtgctttcggtccttgtgttggcttcaagctaagatcaacagttgtattttcccaagacct

SEQ ID NO: 43940 - DNA, 75 bp, Artificial Sequence
  Synthetic
acctttcacttgagacctggagcctatataaggccaaccttcacctgataggcacaatttatataataggttttc

SEQ ID NO: 43941 - DNA, 75 bp, Artificial Sequence
  Synthetic
ataggggttcctgtttcctggtctctcatcgataaacatattttctcttttctttacacccaaaactgtcttgat

SEQ ID NO: 43942 - DNA, 75 bp, Artificial Sequence
  Synthetic
aatggttgagaaattgtctggagtcacctttattgtttctaacatgtttcccccatccagaaaagtggccccggc

SEQ ID NO: 43943 - DNA, 75 bp, Artificial Sequence
  Synthetic
cttaacagctgctgaaaggctgaaattgtatcctgatatattgattgcactttcatccttagtgatgatctgaag

SEQ ID NO: 43944 - DNA, 75 bp, Artificial Sequence
  Synthetic
gcaatcatgttcggcagccaacttttccagatcagctaggtttgggaacttcacagtgtaaaggagacctaatga

SEQ ID NO: 43945 - DNA, 75 bp, Artificial Sequence
  Synthetic
tgttaatgcttggacaacatttcccattgtatcgcccccctgaacggtcatgcaggctattgtcagtgcaggaac

SEQ ID NO: 43946 - DNA, 75 bp, Artificial Sequence
  Synthetic
tgagccgaactggttgttcagtctggtgggatcagccacgtcccaaattctaacaacacctgtggatctcacctg

SEQ ID NO: 43947 - DNA, 75 bp, Artificial Sequence
  Synthetic
tggttgttgaaatcctagtctcctcaaaagatcagttcttttggataactgtgattggctaagattcccaaggta

SEQ ID NO: 43948 - DNA, 75 bp, Artificial Sequence
  Synthetic
gaccccacctacaggagatctctctgtctgtccaactttctttttcaacttttctagatcagatgcaagatccat

SEQ ID NO: 43949 - DNA, 75 bp, Artificial Sequence
  Synthetic
gagctcagatttgttgagatcaccaagcttcaggatggtgttcttctgagcacttttcatggccatcaggttgtc

SEQ ID NO: 43950 - DNA, 75 bp, Artificial Sequence
  Synthetic
cacttctctattgaggtctcttagcttgtccaaatctccatcggttctttttgtttttctaagaactctctgaac

SEQ ID NO: 43951 - DNA, 75 bp, Artificial Sequence
  Synthetic
aagtgcaacttggctaaaatcgagaccatctgcaatcattttagcatcttttagcacgtctgacttcacaggaat

SEQ ID NO: 43952 - DNA, 75 bp, Artificial Sequence
  Synthetic
tgtgaaactgctcaattctcgtcttaaagactgagtccagcggaaacttggaatctcttttgagttgctcatgat

SEQ ID NO: 43953 - DNA, 75 bp, Artificial Sequence
  Synthetic
ttttgagttgctcatgatggaaaggctttctgataagaaattgcttaccaaaaatgcctaggatccactgtgcga

SEQ ID NO: 43954 - DNA, 75 bp, Artificial Sequence
  Synthetic
cgcacagtggatcctaggcgttactaggtcttcaattcttgaactaattgttttcgggtttctactcaagctatg

SEQ ID NO: 43955 - DNA, 75 bp, Artificial Sequence
  Synthetic
ggtaacaccaaaacaaaggacagacagtatcaatcgaactcaagccaacccacaaacacatctgcaccagttctg

SEQ ID NO: 43956 - DNA, 75 bp, Artificial Sequence
  Synthetic
ctgagaaggcaggcagaaccaagtctgtatgggagacacaactgcagatgctgttggtttgcagacacaaaccta

SEQ ID NO: 43957 - DNA, 75 bp, Artificial Sequence
  Synthetic
gtcaattgttccaaccactacctttgccttaaatgtctgaacacaatgttaagaagatccaatctctgtgacata

SEQ ID NO: 43958 - DNA, 75 bp, Artificial Sequence
  Synthetic
tgcggtgaagaacttcccacaacaatcattgttccagtggaaccatcagcaccactgcccggacaataaggcatc

SEQ ID NO: 43959 - DNA, 75 bp, Artificial Sequence
  Synthetic
ctcgaatgcccccggggggccccaatggggccccccgcggggagtccccgggggcgaatgtggagcttactcgat

SEQ ID NO: 43960 - DNA, 75 bp, Artificial Sequence
  Synthetic
ctcctgaatacattggtctcttctgaagggccgacaggtgatgcctttcaaccttaggttacctaggttgtcact

SEQ ID NO: 43961 - DNA, 75 bp, Artificial Sequence
  Synthetic
gacaaccaaatcctgtaggtgcttactataagctacactgaaactagtaaactctatccaactatccatttggca

SEQ ID NO: 43962 - DNA, 75 bp, Artificial Sequence
  Synthetic
tagagactttaacaaagcagttctatgcaaatcataaatcatctcaaagtctgcttgattaaaatcaattgtttt

SEQ ID NO: 43963 - DNA, 75 bp, Artificial Sequence
  Synthetic
ctttatggatttcaaatatggccagagattgcatagcaagttttcaatttctctgtctgtctccagtgctccaag

SEQ ID NO: 43964 - DNA, 75 bp, Artificial Sequence
  Synthetic
agctttcacaatggtatcaccaaaaatctccaccctcatgtatgatagcttctgattatcagccatgaaggcacc

SEQ ID NO: 43965 - DNA, 75 bp, Artificial Sequence
  Synthetic
attttggaacacaatggggttttcctgttcttccggcccaactagaacgtaagagtatttgtccctcagttcatc

SEQ ID NO: 43966 - DNA, 75 bp, Artificial Sequence
  Synthetic
caaaaagtttgagaagtccatgatcacgcattctaacaatttaaaatcattggatgttgccaactcatgttctat

SEQ ID NO: 43967 - DNA, 75 bp, Artificial Sequence
  Synthetic
taaaacttttgctaaattcacactctttgatccattaaagagaggcagtgtaggtatcattgagacaccatctag

SEQ ID NO: 43968 - DNA, 75 bp, Artificial Sequence
  Synthetic
aaaaaggtggttgtttccggcaccagaggcatacaaactcaaagattgtactggaatttttacctcttctcttaa

SEQ ID NO: 43969 - DNA, 75 bp, Artificial Sequence
  Synthetic
atgttcactcagatttattaaaagcagaatcctaaaagtgtacacaacttttcttgaaatgtcaaactttgttga

SEQ ID NO: 43970 - DNA, 75 bp, Artificial Sequence
  Synthetic
tctcctctgatgaacgatctgaatgtttaaccccactttaacaaagtcttctccaagatccctgaaaaaatcaga

SEQ ID NO: 43971 - DNA, 75 bp, Artificial Sequence
  Synthetic
caaatcctgcctcttaaactgtagtgctgccaaatcttgacaagaatcaagggattctaagctgactacttcgtc

SEQ ID NO: 43972 - DNA, 75 bp, Artificial Sequence
  Synthetic
taataaagttgaacaaacatagcccattgtcatgtcatccaaagtcatggccctctcaagattgtatgtcttaat

SEQ ID NO: 43973 - DNA, 75 bp, Artificial Sequence
  Synthetic
agagagtgtgaagtctgtgagttcccccaattctatttgatcatcttcctcaatgcttaaaacctcattaaacca

SEQ ID NO: 43974 - DNA, 75 bp, Artificial Sequence
  Synthetic
aaagaaagacctcaaagttgaagtggacacaatgagagggttaatcattgaggaaagcaaaaattggaccttaaa

SEQ ID NO: 43975 - DNA, 75 bp, Artificial Sequence
  Synthetic
attgtaacaaatttgctgtgggcttaaacccagatcttggtcaacataatcagcttgtcgtacatgagcaccagc

SEQ ID NO: 43976 - DNA, 75 bp, Artificial Sequence
  Synthetic
acactcactttgtttaacaatgtatatggtgttatttctccctctcaggaggtgaccaattatccccaagttctc

SEQ ID NO: 43977 - DNA, 75 bp, Artificial Sequence
  Synthetic
atttaccatatccaatgccacacaaatgtcaagaaactttatcttcgatggatttatcatctgatttgattgaag

SEQ ID NO: 43978 - DNA, 75 bp, Artificial Sequence
  Synthetic
atcactcataaatggagccagatgttcctcaaacaattgaggataattcttctttatcgaatgtagtatatgatt

SEQ ID NO: 43979 - DNA, 75 bp, Artificial Sequence
  Synthetic
caaaccaagcctatcctctatgtgtttgtgtgttctgggttttattgcccagaaaagattggggttatccaaaat

SEQ ID NO: 43980 - DNA, 75 bp, Artificial Sequence
  Synthetic
ggtagccttagttggaagttttacgcttgagaaaacccattcacccaactcacaggcattggttaaaacaagtgt

SEQ ID NO: 43981 - DNA, 75 bp, Artificial Sequence
  Synthetic
gaaataatcccacataattgaccttgtaaactggaagatcttttccactgatttctcacagtacacaacacccct

SEQ ID NO: 43982 - DNA, 75 bp, Artificial Sequence
  Synthetic
ccacactgaacaatgtttacattcgcacgtagtgatcttcttgtaaatgtctttcaagtagatgaaaccaccact

SEQ ID NO: 43983 - DNA, 75 bp, Artificial Sequence
  Synthetic
tccatcccttacacacttgcttcccatactcttgcagaatcctataaaccctgaggccactgatgattgaaaagc

SEQ ID NO: 43984 - DNA, 75 bp, Artificial Sequence
  Synthetic
agatttatttatagactccgctaatatcttctttgcccctttcgtaaagttttttgacattcttgattgtaaagt

SEQ ID NO: 43985 - DNA, 75 bp, Artificial Sequence
  Synthetic
cttcactagactcgggatgctttccctctctaaaactcttttacttgacattatcttggtccttaagactaacct

SEQ ID NO: 43986 - DNA, 75 bp, Artificial Sequence
  Synthetic
cagatcaccaaatgttgatgtgttcacccatctgtatctcaatgcgttctcaatctcatccttatccacttcagc

SEQ ID NO: 43987 - DNA, 75 bp, Artificial Sequence
  Synthetic
atataaaagaaaacctcgcaaggcctcatcacctcccctacctatcaagccaattaagttctcttcaaagatacg

SEQ ID NO: 43988 - DNA, 75 bp, Artificial Sequence
  Synthetic
tccattttttattcctagaaacactttcctagcaccttttctcatcacttctaaaattttagaatctctgaggga

SEQ ID NO: 43989 - DNA, 75 bp, Artificial Sequence
  Synthetic
gttctctatattcctctgcaaacgatagcctctagaaccatcagaccaatcttttacatcttgtttcaccaccga

SEQ ID NO: 43990 - DNA, 75 bp, Artificial Sequence
  Synthetic
aaggaatggtgtttctccaaagcctgaatacttaactaaccgattgactctctctgaaattttagaaacgatgga

SEQ ID NO: 43991 - DNA, 75 bp, Artificial Sequence
  Synthetic
aacactaacaccatttgcgacacattggtcacaaatggtatctacagtttctgccagctgtgtgggtgttttgca

SEQ ID NO: 43992 - DNA, 75 bp, Artificial Sequence
  Synthetic
cctgacattgtgaagagcagctgcaacaaacttagttaacaatggagtttcttcccccataacaaagaacctcga

SEQ ID NO: 43993 - DNA, 75 bp, Artificial Sequence
  Synthetic
cttgaactccgccacaaagttcccaacaacacttttgggactgacaaatttgttcaactttgatgatagatattc

SEQ ID NO: 43994 - DNA, 75 bp, Artificial Sequence
  Synthetic
atgaaaacatacaatttccaaccagtcagggctatcctcgtctatgtgctcatatgcaggcaatttcattataga

SEQ ID NO: 43995 - DNA, 75 bp, Artificial Sequence
  Synthetic
tatctgatcatcactggaagtgtaagataacacatccacatcatacagtttgtaaattgcatagttgagaaactg

SEQ ID NO: 43996 - DNA, 75 bp, Artificial Sequence
  Synthetic
ttccgttattaaagcatataagtcagataagttgtgtaaaattccttgtcccatatctaatacagacataatgtg

SEQ ID NO: 43997 - DNA, 75 bp, Artificial Sequence
  Synthetic
acttggaatttcattttccctttgtaagaagttgtggtagaactgttctgttacacttgatgtttgacattccat

SEQ ID NO: 43998 - DNA, 75 bp, Artificial Sequence
  Synthetic
gagcccaagacttcttttgattttccccacacaatatgcctgagcaacattaaatggtacctcgacaactttatg

SEQ ID NO: 43999 - DNA, 75 bp, Artificial Sequence
  Synthetic
aagatgccatttaaggatgtccaatagtggtccaagattcaacttagctctacttttgggttctgtcaaattgag

SEQ ID NO: 44000 - DNA, 75 bp, Artificial Sequence
  Synthetic
attggctaaaaaggaataaaataatgcagggctcatgtgggggccccattttgaatgatccaatgacatactaat

SEQ ID NO: 44001 - DNA, 75 bp, Artificial Sequence
  Synthetic
atcaccattgttcacagccatcttcatgtcacagatggccctctcaaactctttctctgaatttaaacacgaata

SEQ ID NO: 44002 - DNA, 75 bp, Artificial Sequence
  Synthetic
tctcatagatgatgtgatcatttcagaaaaatcctctactaatctagtcattaattttgtattcaagtcaccaac

SEQ ID NO: 44003 - DNA, 75 bp, Artificial Sequence
  Synthetic
ataaagctccctgttagatccaacttgctccttataacttaatccaaattttagatttcctgtatttgtgcttac

SEQ ID NO: 44004 - DNA, 75 bp, Artificial Sequence
  Synthetic
gcttgtgaactctgtcggtgaatcttctgagtaaaaacagaggtttcttagagctgcacttgtaaaaaacgtttt

SEQ ID NO: 44005 - DNA, 75 bp, Artificial Sequence
  Synthetic
gtcaagctttttggctatggcctctgcattgctttctcttgtgctcactcgggcatcttcctgcactctaagtgc

SEQ ID NO: 44006 - DNA, 75 bp, Artificial Sequence
  Synthetic
ttctgaactcaaacctaatctagacctacttttgtgctcatagctacctaatttttgatcaaaacccccttgtat

SEQ ID NO: 44007 - DNA, 75 bp, Artificial Sequence
  Synthetic
cagcaaatacttgaaacactctaagtagtcagtttcctcataagcaatagttgttagattttttaacaaaaattc

SEQ ID NO: 44008 - DNA, 75 bp, Artificial Sequence
  Synthetic
aagtgggacagatttcaaaggttcctctaagaagaattctaacttgttactggactgatacacctcgtcacacaa

SEQ ID NO: 44009 - DNA, 75 bp, Artificial Sequence
  Synthetic
cttttttacagtttcgtgttcaataatatcaggatcaaagtctttaatctcatgaattgaaacctcatttttaat

SEQ ID NO: 44010 - DNA, 75 bp, Artificial Sequence
  Synthetic
agccctaagaacctggtaaggtgaccagagtgtttccagcagctcacttttgctaaggtgcttattgactttcct

SEQ ID NO: 44011 - DNA, 75 bp, Artificial Sequence
  Synthetic
agaatttcctaaacctacattattacactttgattctttcattctacttaaagtaagctgaacatcttgcttgat

SEQ ID NO: 44012 - DNA, 75 bp, Artificial Sequence
  Synthetic
ctgctcaaatgattccaattgttcttctgataatgtgtcatacaacaaggatagctcttctttcatttgaccttt

SEQ ID NO: 44013 - DNA, 75 bp, Artificial Sequence
  Synthetic
tgaaacactcacactaactaaattggaaaggttcttgaggaccaagaaatctaaggaatctgggtccaagttgta

SEQ ID NO: 44014 - DNA, 75 bp, Artificial Sequence
  Synthetic
ccttcccttcgttttgaacatttcagtaagagttgttacacaagatgagatcatcatttgtttgtcatacttgct

SEQ ID NO: 44015 - DNA, 75 bp, Artificial Sequence
  Synthetic
taaggcattacccaactcatctaacttagggacaacaacacttttattactagataagtccaaagcagtactagt

SEQ ID NO: 44016 - DNA, 75 bp, Artificial Sequence
  Synthetic
gaatgatgggcgaaaagggtcaacttttagatcaccagacacccttaactttcccctgttaaaaagggaaacaca

SEQ ID NO: 44017 - DNA, 75 bp, Artificial Sequence
  Synthetic
gaaactgattaattccttagagactcccggttctttaacatctgatatgttagtcaaatttttctggaaaaacct

SEQ ID NO: 44018 - DNA, 75 bp, Artificial Sequence
  Synthetic
gttaacgctagatgtcataatctcttcttgggcttctgttaaaatcccgcttaaagaaggattaactatgacact

SEQ ID NO: 44019 - DNA, 75 bp, Artificial Sequence
  Synthetic
gttaaaattcagctttggctcaaggaatttctcaaaacacttgatctgatcagttaatctatctggtgtctcctt

SEQ ID NO: 44020 - DNA, 75 bp, Artificial Sequence
  Synthetic
tgtcacaaaatgacacagataactaatattcagtaaaaacttaaaccttctggcaaagccaaaatctttatcatc

SEQ ID NO: 44021 - DNA, 75 bp, Artificial Sequence
  Synthetic
ccctgttgataagaccaattcaaacagtgtcactgctaacctttgcaattgaatctctgaactggacttacactc

SEQ ID NO: 44022 - DNA, 75 bp, Artificial Sequence
  Synthetic
aatctctaattttgacataagatcaacgtgatgagcctgattagcgtaagccattataaaatatctcagcccttg

SEQ ID NO: 44023 - DNA, 75 bp, Artificial Sequence
  Synthetic
gataaatgtttggttcctttttgaaggtgagcagagaaggagcagcaccaaggatctcagcttaggcttaaccag

SEQ ID NO: 44024 - DNA, 75 bp, Artificial Sequence
  Synthetic
ctcaacaagttgttcatcaaagtccaaccagcataccatttcattgcacatggacactatagtgtcttcagaaaa

SEQ ID NO: 44025 - DNA, 75 bp, Artificial Sequence
  Synthetic
aacaggcaaaaagaatctctttggatcacaataaaaggatcctagctcacttaattcaccgttttcagagatata

SEQ ID NO: 44026 - DNA, 75 bp, Artificial Sequence
  Synthetic
aagagaataacaccttgatctctcacccgtcttttgataaaataggtagcctgtgactctacttgagatggggaa

SEQ ID NO: 44027 - DNA, 75 bp, Artificial Sequence
  Synthetic
cctctgaacataacattccttgagcctgacatttccataatagcgagaatagtccttttcattaattaaaagtct

SEQ ID NO: 44028 - DNA, 75 bp, Artificial Sequence
  Synthetic
agaggaaaaagatgttttcatggaattgatcagagagagtgaaacatgtgacaaagctttgagcatggctttgaa

SEQ ID NO: 44029 - DNA, 75 bp, Artificial Sequence
  Synthetic
actttggtcagagatattcaacgagttttgatggagacatcggctttcgttgtccttatggacagtataacgcat

SEQ ID NO: 44030 - DNA, 75 bp, Artificial Sequence
  Synthetic
tatgggtctttcagaaactaaactctttgccaattggaagagcatgtcgaagtcaggttctttaatgtaagtctt

SEQ ID NO: 44031 - DNA, 75 bp, Artificial Sequence
  Synthetic
gacctctttccacatttcttcatcataccttttcaaaactttcccacacacggacagccagtccttactattccc

SEQ ID NO: 44032 - DNA, 75 bp, Artificial Sequence
  Synthetic
taatttatgtcttatcagcttcattgctgcaaggatatcaagagctctatcattgaccaggaccaccatttgacc

SEQ ID NO: 44033 - DNA, 75 bp, Artificial Sequence
  Synthetic
aattataaaaccagcacccctgagagaatctaccactgagtcatcttgtatcatttcatccacaatgaaattcag

SEQ ID NO: 44034 - DNA, 75 bp, Artificial Sequence
  Synthetic
catgattaggtccaaaaacagcaatgtatttctcctagtattgaagatttttgaacctttaatcttattgcaaat

SEQ ID NO: 44035 - DNA, 75 bp, Artificial Sequence
  Synthetic
tgataataaagaagaataggaaatgcacactggctgcttacctccaacctcatcatccttcatttcttcttttga

SEQ ID NO: 44036 - DNA, 75 bp, Artificial Sequence
  Synthetic
atgatctattgacagtttgttggaaagtgtgtaacagagctccagaattttgcatgaacaaaacatgcaatttat

SEQ ID NO: 44037 - DNA, 75 bp, Artificial Sequence
  Synthetic
agtatcactatcttgatgcagaccaattttcagaagatcagataataaattagacttattagttcttttaaattt

SEQ ID NO: 44038 - DNA, 75 bp, Artificial Sequence
  Synthetic
ccctaaacctttattaaaaatttcagtcttataccagagtttgattttgatcagttcctcaattattttcgattc

SEQ ID NO: 44039 - DNA, 75 bp, Artificial Sequence
  Synthetic
tctcacatcatttcttatacccactaataacgatgtgtctagcaattgatcatatgatagcagccttctctttag

SEQ ID NO: 44040 - DNA, 75 bp, Artificial Sequence
  Synthetic
aaactctaggttttcaaaccccatactttgattattggcttttgccaaactgtgtatcagcctttggtattcctg

SEQ ID NO: 44041 - DNA, 75 bp, Artificial Sequence
  Synthetic
atcttcaatttctatttctgaagttgctttcacccctttcaagatttcaatcaatagccatctcaacctctcagt

SEQ ID NO: 44042 - DNA, 75 bp, Artificial Sequence
  Synthetic
agcccattccggaagataacttgtgttgtaacttcctcttccatcaacaacaggaaccatggtgatgccaactct

SEQ ID NO: 44043 - DNA, 75 bp, Artificial Sequence
  Synthetic
agcaaggtcatcttttaatgacatgagtttgctcatatcagctttccacttccgttcaaagtcatttgggttgac

SEQ ID NO: 44044 - DNA, 75 bp, Artificial Sequence
  Synthetic
tcttacaaaagtttccaataagatgagagtcttacccatgagattgaaaccatcgggcgtcactttgggaagagt

SEQ ID NO: 44045 - DNA, 75 bp, Artificial Sequence
  Synthetic
gggacagatcacaccatgatcagagaggatgacatccacaaacttttgctcaaagttgtgtctgcaggcattgac

SEQ ID NO: 44046 - DNA, 75 bp, Artificial Sequence
  Synthetic
cttgcaagactccagttcaactaaaagtgacaacaatttgaagccctcaacaaggaccagtctggggtgcacctg

SEQ ID NO: 44047 - DNA, 75 bp, Artificial Sequence
  Synthetic
tgaaagaagtgcgtctttctggaaagatagctctactaattctgggacatactttcttacaagatccttcaattc

SEQ ID NO: 44048 - DNA, 75 bp, Artificial Sequence
  Synthetic
tacaagatccttcaattccagtaaaaaagtgtccattattcacttagacaaaattcgcctaggatccactgtgcg

SEQ ID NO: 44049 - DNA, 75 bp, Artificial Sequence
  Synthetic
acagcgcctttttgaaggccctgcaacgtgcgtaccccatgtttgaggtggaaccaaggcaggtcacaccgaatg

SEQ ID NO: 44050 - DNA, 75 bp, Artificial Sequence
  Synthetic
atacgaagggctaaaaattcgccccgcctgcccatacaaaattgcagtcataggagtcttcggggtaccaggatc

SEQ ID NO: 44051 - DNA, 75 bp, Artificial Sequence
  Synthetic
accatgctaatgctagagcgttctcgcatctagctataaaactaatagagcaggaaattgaccccgactcaacca

SEQ ID NO: 44052 - DNA, 75 bp, Artificial Sequence
  Synthetic
atcaaagggctgaacaacccctgaatagtaacaaaatataaaaatcaacaaaaatcataaaatagaaaactagaa

SEQ ID NO: 44053 - DNA, 75 bp, Artificial Sequence
  Synthetic
aagttaatgaaaacccgctctatgcatcaacgtcagagcacgtcaacgtactcctaacacgtacggaaggtaaac

SEQ ID NO: 44054 - DNA, 75 bp, Artificial Sequence
  Synthetic
gtctatgctgtacacgcacccacgtcgctataccaccaggcgattaaaggggtccgagtggcgtactgggttggg

SEQ ID NO: 44055 - DNA, 75 bp, Artificial Sequence
  Synthetic
agccttcaaagaagacaaagcatactcacctgaagtagccctgaatgaaatatgcacgcgcatgtatggggtgga

SEQ ID NO: 44056 - DNA, 75 bp, Artificial Sequence
  Synthetic
taaaagcagccgaactcactttgagatgtaggcatagcataccgaactcttccacaattctccgtacccataggg

SEQ ID NO: 44057 - DNA, 75 bp, Artificial Sequence
  Synthetic
aggaaacttcaaagcaactattaaggagtgggaggtggagcacgcatcgataatggcgggcatctgcagtcacca

SEQ ID NO: 44058 - DNA, 75 bp, Artificial Sequence
  Synthetic
aaagccaacgtttgctgggctaagagcttggtccctatcctcgaaacagcggggataaaactaaatgataggcag

SEQ ID NO: 44059 - DNA, 75 bp, Artificial Sequence
  Synthetic
aaggaaaagttcacattccgtttcctctggcaaatgtgacatgcagggtgcctaaagcaaggaaccccaccgtga

SEQ ID NO: 44060 - DNA, 75 bp, Artificial Sequence
  Synthetic
cgaccatttgtgatcaaatgaccggcatccttgctacagaagtcacgccggaggatgcacagaagctgttggtgg

SEQ ID NO: 44061 - DNA, 75 bp, Artificial Sequence
  Synthetic
ttaaccgtgccgactgaagggctcgaggtcacgtggggtaacaatgagccgtacaagtattggccgcagttatcc

SEQ ID NO: 44062 - DNA, 75 bp, Artificial Sequence
  Synthetic
tggtcgcccaagccttcagtaagtgggcaaaggagtgccggaaagacatggaagatgaaaaactcctgggggtca

SEQ ID NO: 44063 - DNA, 75 bp, Artificial Sequence
  Synthetic
ggcaaaggagtgccggaaagacatggaagatgaaaaactcctgggggtcagagaaagaacactgacctgctgctg

SEQ ID NO: 44064 - DNA, 75 bp, Artificial Sequence
  Synthetic
atggcagaaggaattttacaacgcatgtcatgaacaatcaactgaatgcagcctttgtaggacaggccacccgag

SEQ ID NO: 44065 - DNA, 75 bp, Artificial Sequence
  Synthetic
tgtatcctgaccacccaacactcctgtcctaccggaatatgggagaagaaccaaactatcaagaagagtgggtga

SEQ ID NO: 44066 - DNA, 75 bp, Artificial Sequence
  Synthetic
accgacctgatcccatacagcggagacgcccgagaagcccgggacgcagaaaaagaagcagaggaagaacgagaa

SEQ ID NO: 44067 - DNA, 75 bp, Artificial Sequence
  Synthetic
ggagtcctttaaaaacagtgcaacaccagtaggaaccgcaaaaacagttatgtgcggtacgtatccagtaatcca

SEQ ID NO: 44068 - DNA, 75 bp, Artificial Sequence
  Synthetic
tccggcgcctgtgtactcacctccgatcaacgtccgattgtccaaccccaagtcggcagtggcagcatgcaatga

SEQ ID NO: 44069 - DNA, 75 bp, Artificial Sequence
  Synthetic
gttcttagctagaaactatccaactgtctcatcataccaaatcaccgacgagtatgatgcatatctagacatggt

SEQ ID NO: 44070 - DNA, 75 bp, Artificial Sequence
  Synthetic
cgagtcctagtgccctcaggctatgcaatctcgcctgaagacttccagagtctaagcgaaagcgcaacgatggtg

SEQ ID NO: 44071 - DNA, 75 bp, Artificial Sequence
  Synthetic
attcatatctagaagggacacgttttcaccagacggcagtggatatggcagagatatatactatgtggccaaagc

SEQ ID NO: 44072 - DNA, 75 bp, Artificial Sequence
  Synthetic
gttctatgcaactgtctgagactcttaccatgctgctgtaaaacgttggcttttttagccgtaatgagcgtcggt

SEQ ID NO: 44073 - DNA, 75 bp, Artificial Sequence
  Synthetic
cggaccagccctgaacaccgacgaagagtcgtatgagctggtgagggcagagaggacagaacacgagtacgtcta

SEQ ID NO: 44074 - DNA, 75 bp, Artificial Sequence
  Synthetic
tactggtgggcgactggactaatccgccctaccacgaattcgcatatgaagggctaaaaatccgccctgcctgcc

SEQ ID NO: 44075 - DNA, 75 bp, Artificial Sequence
  Synthetic
cccgaaaactgtcccgtgcctttgccgttatgccatgactcctgaacgcgtcacccgacttcgcatgaaccatgt

SEQ ID NO: 44076 - DNA, 75 bp, Artificial Sequence
  Synthetic
cgtttagcaggcactaacttgacaactaggtatgaaggcatacgcgtccctaaagagacacaccacatatagcta

SEQ ID NO: 44077 - DNA, 75 bp, Artificial Sequence
  Synthetic
aatatagatcttccccggagtctgcacaggaagcgagtacaaccacgtcactgacgcatagccaattcgacctaa

SEQ ID NO: 44078 - DNA, 75 bp, Artificial Sequence
  Synthetic
ctgttggacttgatagaggctgcttttggagagatttccagctgtcacctgccgacaggtacgcgcttcaagttc

SEQ ID NO: 44079 - DNA, 75 bp, Artificial Sequence
  Synthetic
accaccgacgtgatgagacagagaggtctagagatatctgcacgtacggttgactcgctgctcttgaatggatgc

SEQ ID NO: 44080 - DNA, 75 bp, Artificial Sequence
  Synthetic
gcgttgacggcgagatactacccgtcccgtcagatctggatgctgacgccccagccctagaaccagccctagacg

SEQ ID NO: 44081 - DNA, 75 bp, Artificial Sequence
  Synthetic
cttcaggcaccgccaagtaccaccatggaactgagccatccaccgatctccttcggagcaccaagcgagacgttc

SEQ ID NO: 44082 - DNA, 75 bp, Artificial Sequence
  Synthetic
ttaaatatgcagccagcaagaaaggcaagtgtgcagtgcattcgatgactaacgccgtcactattcgggaagctg

SEQ ID NO: 44083 - DNA, 75 bp, Artificial Sequence
  Synthetic
aaagtcaactataatcacaacatctgcacccaagtgtaccacaaaagtatctccaggcggtgtacactgcctgtg

SEQ ID NO: 44084 - DNA, 75 bp, Artificial Sequence
  Synthetic
aactcactttgagatgtaggcatagcataccgaactcttccacaattctccgaacccacagggacgtaggagatg

SEQ ID NO: 44085 - DNA, 75 bp, Artificial Sequence
  Synthetic
catggactacccgccctttggcgcaggaagaccaggacaatttggcgatatccaaagtcgcacacctgagagtaa

SEQ ID NO: 44086 - DNA, 75 bp, Artificial Sequence
  Synthetic
ccgatctccttcggagcaccaagcgagacgttccccattacatttggggacttcaacgaaggagaaatcgaaagc

SEQ ID NO: 44087 - DNA, 75 bp, Artificial Sequence
  Synthetic
cttcagagggtgggttaaacaactgcaaattgactatcgtggatacgaggtcatgacagcagccgcatcccaagg

SEQ ID NO: 44088 - DNA, 75 bp, Artificial Sequence
  Synthetic
aatatgaaagcaacaatcatccagagactaaagagaggctgtaaactgtatttaatggcagagaccccgaaagtc

SEQ ID NO: 44089 - DNA, 75 bp, Artificial Sequence
  Synthetic
aggcatagcataccgaactcttccacaattctccgaacccatagggacgtaggagatgttattttgtttttaata

SEQ ID NO: 44090 - DNA, 75 bp, Artificial Sequence
  Synthetic
tagatgcagctgtctccttgaaagccccttacttttgcggagggtttatactgtatgatactgtgacgggaacag

SEQ ID NO: 44091 - DNA, 75 bp, Artificial Sequence
  Synthetic
caaattgactatcgtggatacgaggtcatgacagcagccgcatcccaagggttaaccagaaaaggagtttacgca

SEQ ID NO: 44092 - DNA, 75 bp, Artificial Sequence
  Synthetic
aattgtgtgttcttcgtttccccttccaaagtacaaaatagaaggagtgcaaaaagtcaaatgctccaaggtaat

SEQ ID NO: 44093 - DNA, 75 bp, Artificial Sequence
  Synthetic
aaccactgggataataggcctggagggaagatgttcggatttaaccccgaggcagcatccattctagaaagaaag

SEQ ID NO: 44094 - DNA, 75 bp, Artificial Sequence
  Synthetic
acgtttgttgggctaagagcttggtccctatcctcgaaacagcggggataaaactaaatgataggcagtggtctc

SEQ ID NO: 44095 - DNA, 75 bp, Artificial Sequence
  Synthetic
cagggacgtaggagatgttcaaagtgactataaaaaccctgaacagtaataaaacataaaattaataaggagtac

SEQ ID NO: 44096 - DNA, 75 bp, Artificial Sequence
  Synthetic
tatataacccctgaatagtaacaaaatacaaaatcactaaaaattataaaaaaaaaaaaaaaaaaaaaaaaaaaa

SEQ ID NO: 44097 - DNA, 75 bp, Artificial Sequence
  Synthetic
tatataacccctgaatagtaacaaaatacaaaatcactaaaaattattaaaaaaaaaaaaaaaaaaaaaaaaaaa

SEQ ID NO: 44098 - DNA, 75 bp, Artificial Sequence
  Synthetic
tatataacccctgaatagtaacaaaatacaaaatcactaaaaattatcaaaaaaaaaaaaaaaaaaaaaaaaaaa

SEQ ID NO: 44099 - DNA, 75 bp, Artificial Sequence
  Synthetic
tatataacccctgaatagtaacaaaatacaaaatcactaaaaattatgaaaaaaaaaaaaaaaaaaaaaaaaaaa

SEQ ID NO: 44100 - DNA, 75 bp, Artificial Sequence
  Synthetic
gtatgaaggtatatgtgtcccctaagagacacactgtacatagcaaataatctatagatcaaagggctacgcaac

SEQ ID NO: 44101 - DNA, 75 bp, Artificial Sequence
  Synthetic
aaatcaataaaaatcataaaatagaaaaaccataaacagaagtagtttaaagggctataaaacccctgaatagta

SEQ ID NO: 44102 - DNA, 75 bp, Artificial Sequence
  Synthetic
gagactgctcaaaccgggtggctctctattgatcagagcatatggttacgcagatagaaccagtgaacgagtcat

SEQ ID NO: 44103 - DNA, 75 bp, Artificial Sequence
  Synthetic
aaccctcgcgggttaccgggtgacggtgtttgcaaggcagtatacaaaaaatggccggagtcctttaagaatagt

SEQ ID NO: 44104 - DNA, 75 bp, Artificial Sequence
  Synthetic
ccagtaaaaggggaaagaatggaatggctggttaacaagataaacggccaccacgtgctcctggtcagtggctat

SEQ ID NO: 44105 - DNA, 75 bp, Artificial Sequence
  Synthetic
tagcctaccagtttcttactgctctactctgcttagcaagagacttgagaacccatcatggatcccgtgtacgtg

SEQ ID NO: 44106 - DNA, 75 bp, Artificial Sequence
  Synthetic
gataagtatagatcaaagggccgaataacccctgaatagtaacaaaatatgaaaatcaataaaaatcataaaata

SEQ ID NO: 44107 - DNA, 75 bp, Artificial Sequence
  Synthetic
ggaagatcgtctgacaaaatctgcgtgcgcggccttcatcggcgacgacaacataatacatggagtcgtctccga

SEQ ID NO: 44108 - DNA, 75 bp, Artificial Sequence
  Synthetic
acagggcaggtgggtatatattctcgtcggacactggtccaggtcatttacaacagaagtcagtacgccagtcag

SEQ ID NO: 44109 - DNA, 75 bp, Artificial Sequence
  Synthetic
aaacatccacacaccttttcgcatacaccattaccaacagtgcgtcgaccacgcaatgaaactgcaaatgctcgg

SEQ ID NO: 44110 - DNA, 75 bp, Artificial Sequence
  Synthetic
tcaaatgaataccataattggcaaacggaagagatgtaggtacttaagcttcctaaaagcagccgaactcacttt

SEQ ID NO: 44111 - DNA, 75 bp, Artificial Sequence
  Synthetic
aggaggtaccagcctcgaccctggactccgcgctctactatccaagtcatcaggcccagaccgcgccctcagagg

SEQ ID NO: 44112 - DNA, 75 bp, Artificial Sequence
  Synthetic
atagcataccgaactcttccacgattctccgaacccacagggacgtaggagatgttattttgtttttaatatttc

SEQ ID NO: 44113 - DNA, 75 bp, Artificial Sequence
  Synthetic
gacgctgacagcgcctttttgaaggccctgcaacgtgcgtaccccatgtttgaggtggaaccaaggcaggtcaca

SEQ ID NO: 44114 - DNA, 75 bp, Artificial Sequence
  Synthetic
gtcggataggaagtaccactgcgtttgcccaatgcgcagcgcagaagaccctgagagactcgccaactacgcgag

SEQ ID NO: 44115 - DNA, 75 bp, Artificial Sequence
  Synthetic
tgaacgagtcatctgcgtattgggacgcaagtttagatcgtctagagcgttgaaaccaccatgtgtcaccagcaa

SEQ ID NO: 44116 - DNA, 75 bp, Artificial Sequence
  Synthetic
ggcattcaagaagcagaaaacacacacggtctacaagaggcctgatacccagtcaattcagaaggttcaggccga

SEQ ID NO: 44117 - DNA, 75 bp, Artificial Sequence
  Synthetic
gtcttggacagaaacatctccggaaaaatcggagatctacaagcagtaatggctgtaccagacgcagaaacgccc

SEQ ID NO: 44118 - DNA, 75 bp, Artificial Sequence
  Synthetic
tgcccaatgcgcagcgcagaagaccctgagagactcgccaactacgcgagaaaactagcatctgccgcaggaaaa

SEQ ID NO: 44119 - DNA, 75 bp, Artificial Sequence
  Synthetic
aaatcggagatctacaagcagtaatggctgtaccagacgcagaaacgcccacattctgcttgcacactgacgtct

SEQ ID NO: 44120 - DNA, 75 bp, Artificial Sequence
  Synthetic
gagaagtaggcatagcataccgaactcttccacgattctccgaacccacagggacgtaggagatgttattttgtt

SEQ ID NO: 44121 - DNA, 75 bp, Artificial Sequence
  Synthetic
catgtagacaaagggcggacgtcgctatataccaggacgtctacgccgtgcatgcaccaacatcgctataccacc

SEQ ID NO: 44122 - DNA, 75 bp, Artificial Sequence
  Synthetic
ccgttcatgtataatgccatggcaggtgcatacccctcgtactcgacaaactgggcagatgagcaggtgctgaag

SEQ ID NO: 44123 - DNA, 75 bp, Artificial Sequence
  Synthetic
ggaccaaacttctctaattattcggagtctgaaggggaccgggaattggcagctgcctatcgagaagtcgcaaag

SEQ ID NO: 44124 - DNA, 75 bp, Artificial Sequence
  Synthetic
cagctgatctcagcagttaataaactgacaatgcgcgcggtacctcaacagaagccacgcaggaatcggaagaat

SEQ ID NO: 44125 - DNA, 75 bp, Artificial Sequence
  Synthetic
aagatggagccatgtgaccgcgtactgttctcagtcgggtcaacgctttacccggagagccgtaagcttcttaag

SEQ ID NO: 44126 - DNA, 75 bp, Artificial Sequence
  Synthetic
tgttctcagtcgggtcaacgctttacccggagagccgtaagcttcttaagagttggcacttaccctcagtgttcc

SEQ ID NO: 44127 - DNA, 75 bp, Artificial Sequence
  Synthetic
atctaaaagggaagctcagcttcacgtgccgctgtgatacagtggtttcgtgtgaaggctatgtcgttaagagaa

SEQ ID NO: 44128 - DNA, 75 bp, Artificial Sequence
  Synthetic
acccctgagggggccgaagagtggagtcttgccattccagttatgtgcctgctggcaaataccacgttcccctgc

SEQ ID NO: 44129 - DNA, 75 bp, Artificial Sequence
  Synthetic
taacgattagcccgggcctctacggtaaaaccacagggtacgcagtaacccaccatgcagacggattcctaatgt

SEQ ID NO: 44130 - DNA, 75 bp, Artificial Sequence
  Synthetic
agtagagctgctggatgagcacatctccatagactgcgatattgttcgcgtgcaccctgacagcagcttggcagg

SEQ ID NO: 44131 - DNA, 75 bp, Artificial Sequence
  Synthetic
gcaaaacaaccgatacggtagacggcgagagagtgtcattttcggtatgcacgtacgtacctgcaaccatttgtg

SEQ ID NO: 44132 - DNA, 75 bp, Artificial Sequence
  Synthetic
cgagagagtgtcattttcggtatgcacgtacgtacctgcaaccatttgtgatcaaatgacaggtattcttgccac

SEQ ID NO: 44133 - DNA, 75 bp, Artificial Sequence
  Synthetic
acagggctaatagatgagctggagaaagcggtgtactctaggtacgaagtgcagggtatatcagttgcggtaatg

SEQ ID NO: 44134 - DNA, 75 bp, Artificial Sequence
  Synthetic
ggaggttacaccggaggatgcacagaagctgctggtgggactgaaccagaggatagtggtcaatggcagaacgca

SEQ ID NO: 44135 - DNA, 75 bp, Artificial Sequence
  Synthetic
ggatagtggtcaatggcagaacgcagaggaacacgaacacaatgaagaattacttgcttcctgtggttgcccaag

SEQ ID NO: 44136 - DNA, 75 bp, Artificial Sequence
  Synthetic
tacttgcttcctgtggttgcccaagccttcagtaagtgggcaaaggaatgccggaaagatatggaagatgaaaaa

SEQ ID NO: 44137 - DNA, 75 bp, Artificial Sequence
  Synthetic
ccttcagtaagtgggcaaaggaatgccggaaagatatggaagatgaaaaacttttgggcatcagagaaaggacac

SEQ ID NO: 44138 - DNA, 75 bp, Artificial Sequence
  Synthetic
tgacatgctgctgcctttgggcgttcaagaagcagaagacacacacggtctacaagaggcctgacactcagtcaa

SEQ ID NO: 44139 - DNA, 75 bp, Artificial Sequence
  Synthetic
ccagaacgcgtcacccggcttcgcatgaaccacgtcacaagcataattgtgtgttcttcgtttcccctcccaaag

SEQ ID NO: 44140 - DNA, 75 bp, Artificial Sequence
  Synthetic
caagaagcagaagacacacacggtctacaagaggcctgacactcagtcaattcagaaagtcccagccgaatttga

SEQ ID NO: 44141 - DNA, 75 bp, Artificial Sequence
  Synthetic
cagctttgtggtaccaagtctgtggtcatctggactgtcgatcccgctacggaccagaatcaagtggctgctaag

SEQ ID NO: 44142 - DNA, 75 bp, Artificial Sequence
  Synthetic
agtccaagggaatatagatcttcccaggagtctgcacaggaggcgagtacaatcacgtcactgacgcatagtcaa

SEQ ID NO: 44143 - DNA, 75 bp, Artificial Sequence
  Synthetic
ccttcggagcaccaagcgagacgttccccattacatttggggacttcaacgaaggagaaatcgaaagcttgtctt

SEQ ID NO: 44144 - DNA, 75 bp, Artificial Sequence
  Synthetic
agaagaacgagaagcggagctgactcgcgaggcactaccaccactacaggcggcacaggatgacgtccaggtcga

SEQ ID NO: 44145 - DNA, 75 bp, Artificial Sequence
  Synthetic
cagacgcagagagggcggggctatttgtaagaacatcagcaccgtgcacgattactggaacaatgggacacttca

SEQ ID NO: 44146 - DNA, 75 bp, Artificial Sequence
  Synthetic
tgtaagaacatcagcaccgtgcacgattactggaacaatgggacacttcatcctggcccgatgtccgaaagggga

SEQ ID NO: 44147 - DNA, 75 bp, Artificial Sequence
  Synthetic
cgcgaggcactaccaccactacaggcggcacaggatgacgtccaggtcgaaattgacgtggaacagctcgaagac

SEQ ID NO: 44148 - DNA, 75 bp, Artificial Sequence
  Synthetic
tgcggccgtgtctgactgggtaatgagcaccgtacctgtcgcgccgcccagaagaaggcgagggagaaacctgac

SEQ ID NO: 44149 - DNA, 75 bp, Artificial Sequence
  Synthetic
agagcgttgaaaccaccatgtgtcaccagcaacactgagatgtttttcctattcagcaactttgacaatggcaga

SEQ ID NO: 44150 - DNA, 75 bp, Artificial Sequence
  Synthetic
agccctattaggataacaactgagaatttaacaacctatgttactaaactaaaagggccaaaagcagcagcgcta

SEQ ID NO: 44151 - DNA, 75 bp, Artificial Sequence
  Synthetic
tgcccaaccaacagaccacgtcgtgggagagtacttggtactttccccgcagaccgtgttacgaagccagaagct

SEQ ID NO: 44152 - DNA, 75 bp, Artificial Sequence
  Synthetic
cagcctgatccacgcattggcggaacaagtgaagacatgcacacacagcggacgagcaggaaggtacgcggtcga

SEQ ID NO: 44153 - DNA, 75 bp, Artificial Sequence
  Synthetic
caagtgaagacatgcacacacagcggacgagcaggaaggtacgcggtcgaagcatatgacggcagaatccttgtg

SEQ ID NO: 44154 - DNA, 75 bp, Artificial Sequence
  Synthetic
gcgcctgtgtactcgcctccgatcaacgtccgactgtccaaccccgagtccgcagtggcagcatgcaatgagttc

SEQ ID NO: 44155 - DNA, 75 bp, Artificial Sequence
  Synthetic
ccctcaggctatgcaatatcacctgaagacttccagagcctgagcgaaagtgcgacgatggtgtacaacgaaagg

SEQ ID NO: 44156 - DNA, 75 bp, Artificial Sequence
  Synthetic
atatcgcgttgcacggaccagccctgaacactgacgaggagtcgtacgagctggtaagggcagaaaggacagagc

SEQ ID NO: 44157 - DNA, 75 bp, Artificial Sequence
  Synthetic
gaacactgacgaggagtcgtacgagctggtaagggcagaaaggacagagcatgagtacgtctatgatgtggacca

SEQ ID NO: 44158 - DNA, 75 bp, Artificial Sequence
  Synthetic
aagaaggtgctgcaagaaagaggaggcagccgggctggtactggtcggcgacttgaccaacccgccctaccatga

SEQ ID NO: 44159 - DNA, 75 bp, Artificial Sequence
  Synthetic
gcagccgggctggtactggtcggcgacttgaccaacccgccctaccatgagttcgcatatgaagggctgagaatc

SEQ ID NO: 44160 - DNA, 75 bp, Artificial Sequence
  Synthetic
ttagcctaatatgctgcattagaacagctaaagcggccacataccaagaggctgcggtatacctgtggaacgagc

SEQ ID NO: 44161 - DNA, 75 bp, Artificial Sequence
  Synthetic
accctgctgctacgaaaaagagccggagaaaaccctgcgcatgcttgaagacaacgtcatgagccccgggtacta

SEQ ID NO: 44162 - DNA, 75 bp, Artificial Sequence
  Synthetic
cgccccgcctgcccatacaagaccgcagtaataggggtctttggagtgccaggatccggcaaatcagcaatcatt

SEQ ID NO: 44163 - DNA, 75 bp, Artificial Sequence
  Synthetic
caactggcaccacggagcagtacagtactcaggaggccggttcaccatccctacaggtgcgggcaaaccagggga

SEQ ID NO: 44164 - DNA, 75 bp, Artificial Sequence
  Synthetic
aactggtgctgcagagaccggctgtgggtacggtacatgtgccatactctcaggcaccgtctggctttaagtact

SEQ ID NO: 44165 - DNA, 75 bp, Artificial Sequence
  Synthetic
aagaacctagttaccaggcaagacctagtgaccagtggaaagaaagaaaactgccaagaaatctccaccgacgtg

SEQ ID NO: 44166 - DNA, 75 bp, Artificial Sequence
  Synthetic
ccgcccagaagaaggcgagggagaaacctgactgtgacatgtgacgagagagaagggaatataacacccatggct

SEQ ID NO: 44167 - DNA, 75 bp, Artificial Sequence
  Synthetic
atgcgacagaggaatctggagatatctgcacgcacggtcgactcactgctcttgaacggatgcaacagaccagtc

SEQ ID NO: 44168 - DNA, 75 bp, Artificial Sequence
  Synthetic
ctgcacgcacggtcgactcactgctcttgaacggatgcaacagaccagtcgacgtgttgtacgtcgacgaagcgt

SEQ ID NO: 44169 - DNA, 75 bp, Artificial Sequence
  Synthetic
gcccatttccattgatataccggatgcagccttcaccagggtcgtcgacgcgccctctctaacggacatgtcgtg

SEQ ID NO: 44170 - DNA, 75 bp, Artificial Sequence
  Synthetic
ttgcgtgccattctggcacgctacttgctctgatagccttggtgagaccgaggcagaaagtcgtgctatgcggtg

SEQ ID NO: 44171 - DNA, 75 bp, Artificial Sequence
  Synthetic
atccgaaacagtgcggcttcttcaatatgatgcagatgaaagttaactacaaccataacatctgcacccaagtgt

SEQ ID NO: 44172 - DNA, 75 bp, Artificial Sequence
  Synthetic
ccattccagaacacactacagaatgtactggcagcagccacgaaaagaaactgcaacgtcacacagatgagggaa

SEQ ID NO: 44173 - DNA, 75 bp, Artificial Sequence
  Synthetic
gccaattgtagtggatactacaggctcgacaaaacccgaccccggagaccttgtgctaacatgtttcagagggtg

SEQ ID NO: 44174 - DNA, 75 bp, Artificial Sequence
  Synthetic
tcgacaaaacccgaccccggagaccttgtgctaacatgtttcagagggtgggttaagcaactgcaaattgactac

SEQ ID NO: 44175 - DNA, 75 bp, Artificial Sequence
  Synthetic
gacatagcctcctttgataagagccaagatgattcacttgcgcttactgctttgatgctgttagaggatttaggg

SEQ ID NO: 44176 - DNA, 75 bp, Artificial Sequence
  Synthetic
tcaacgtggagtgtttcaaaaaattcgcatgcaaccaagaatactgggaagaatttgctgccagccctattagga

SEQ ID NO: 44177 - DNA, 75 bp, Artificial Sequence
  Synthetic
cgtggacacgaggtcatgacagcagctgcatctcaggggctaaccagaaaaggggtctatgccgtcaggcaaaaa

SEQ ID NO: 44178 - DNA, 75 bp, Artificial Sequence
  Synthetic
ctgcatctcaggggctaaccagaaaaggggtctatgccgtcaggcaaaaagttaatgaaaaccccctttacgcat

SEQ ID NO: 44179 - DNA, 75 bp, Artificial Sequence
  Synthetic
atcccaacccaaactttttacaataggaggtaccagcctcgaccctggactccgcgccctactatccaagtcatc

SEQ ID NO: 44180 - DNA, 75 bp, Artificial Sequence
  Synthetic
cagcaaggaggatgatgtcggacaggaagtaccactgcgtctgcccgatgcgcagcgcagaagatcccgagagac

SEQ ID NO: 44181 - DNA, 75 bp, Artificial Sequence
  Synthetic
caacatcagagcacgtgaacgtgctactgacgcgtacggaaggcaaactagtatggaagacactttctggagacc

SEQ ID NO: 44182 - DNA, 75 bp, Artificial Sequence
  Synthetic
tgttactaaactaaaagggccaaaagcagcagcgctattcgcaaaaacccataatctactgccactacaggaagt

SEQ ID NO: 44183 - DNA, 75 bp, Artificial Sequence
  Synthetic
accaatggataggttcacagtagatatgaaaagggacgtgaaggtgactcctggtacaaagcatacagaggaaag

SEQ ID NO: 44184 - DNA, 75 bp, Artificial Sequence
  Synthetic
actgacgcgtacggaaggcaaactagtatggaagacactttctggagacccatggataaagacactgcagaaccc

SEQ ID NO: 44185 - DNA, 75 bp, Artificial Sequence
  Synthetic
gccgaaaggaaattttaaagcaacaattaaggaatgggaagtggaacatgcttcaataatggcgggtatctgtaa

SEQ ID NO: 44186 - DNA, 75 bp, Artificial Sequence
  Synthetic
attaaggaatgggaagtggaacatgcttcaataatggcgggtatctgtaaccaccaagtgaccttcgacacgttc

SEQ ID NO: 44187 - DNA, 75 bp, Artificial Sequence
  Synthetic
agtcaccaagtgacctttgacacattccaaaacaaagccaacgtttgctgggctaagagcttggtccctatcctc

SEQ ID NO: 44188 - DNA, 75 bp, Artificial Sequence
  Synthetic
tcctctggcaaatgtgacatgcagggtgcctaaagcaaggaaccccaccgtgacgtacgggaaaaaccaagtcat

SEQ ID NO: 44189 - DNA, 75 bp, Artificial Sequence
  Synthetic
cagaataaagccaatgtctgctgggcgaagagcttagtccccatcctagaaacggcagggataaaattaaacgac

SEQ ID NO: 44190 - DNA, 75 bp, Artificial Sequence
  Synthetic
tatgtgggattcacagagagctggttaggaggctgaacgccgtcctcctacccaatgtacatacactatttgaca

SEQ ID NO: 44191 - DNA, 75 bp, Artificial Sequence
  Synthetic
cgaagagcttagtccccatcctagaaacggcagggataaaattaaacgacaggcagtggtcccagataatccagg

SEQ ID NO: 44192 - DNA, 75 bp, Artificial Sequence
  Synthetic
cttttaaagaagacagagcatactcacccgaggtggccctgaatgagatatgcacgcgcatgtacggggtagacc

SEQ ID NO: 44193 - DNA, 75 bp, Artificial Sequence
  Synthetic
acccgaggtggccctgaatgagatatgcacgcgcatgtacggggtagacctggacagcgggctgttctctaaacc

SEQ ID NO: 44194 - DNA, 75 bp, Artificial Sequence
  Synthetic
tcagctgcaaatctctttctcgacggccttagccagcgccgaattccgcgtacaagtctgttctacacaagtaca

SEQ ID NO: 44195 - DNA, 75 bp, Artificial Sequence
  Synthetic
cagcacacgtaaaggggaccatcgataacgcggacctggccaaactggcctttaagcggtcatctaagtatgacc

SEQ ID NO: 44196 - DNA, 75 bp, Artificial Sequence
  Synthetic
actggtgtccgtgcattatgcggataatcactgggacaacaggccgggagggaagatgttcggattcaaccccga

SEQ ID NO: 44197 - DNA, 75 bp, Artificial Sequence
  Synthetic
aatcactgggacaacaggccgggagggaagatgttcggattcaaccccgaagcggcgtccatactggagaggaaa

SEQ ID NO: 44198 - DNA, 75 bp, Artificial Sequence
  Synthetic
ggacaacttcaatgtctataaagccacaagaccgtacttagctcactgtcccgactgtggagaagggcactcgtg

SEQ ID NO: 44199 - DNA, 75 bp, Artificial Sequence
  Synthetic
tacccgtttacaaaagggaagtggaataccaacaagcaaatctgtgtgactactaggaggattgaagattttaac

SEQ ID NO: 44200 - DNA, 75 bp, Artificial Sequence
  Synthetic
ataccaacaagcaaatctgtgtgactactaggaggattgaagattttaacccgaacaccaacattatacctgcca

SEQ ID NO: 44201 - DNA, 75 bp, Artificial Sequence
  Synthetic
ggcagtggatatggcggagatacatactatgtggccaaagcaaacagaggccaatgagcaagtctgcctatatgc

SEQ ID NO: 44202 - DNA, 75 bp, Artificial Sequence
  Synthetic
acaggagactaccgcattcattggtggccgaacatcgcccggtaaaaggggagaggatggaatggttggtcaaca

SEQ ID NO: 44203 - DNA, 75 bp, Artificial Sequence
  Synthetic
tcgtctccgatgaattgatggcagccagatgtgccacttggatgaacatggaagtgaagatcatagatgcagttg

SEQ ID NO: 44204 - DNA, 75 bp, Artificial Sequence
  Synthetic
tagaaacggacatagcctcctttgataagagccaagatgattcacttgcgcttaccgccttaatgctgttagaag

SEQ ID NO: 44205 - DNA, 75 bp, Artificial Sequence
  Synthetic
ggccgaacatcgcccggtaaaaggggagaggatggaatggttggtcaacaaaataaatggccaccatgtgctcct

SEQ ID NO: 44206 - DNA, 75 bp, Artificial Sequence
  Synthetic
ggtcagcggctacaacctcgttctgcccactaagagagtcacctgggtggcgccgctgggcatccggggagctga

SEQ ID NO: 44207 - DNA, 75 bp, Artificial Sequence
  Synthetic
cggtgggattcactgacagtaggaagattagtcactcatgtacgcacccatttcaccacgaccctcctgtgatag

SEQ ID NO: 44208 - DNA, 75 bp, Artificial Sequence
  Synthetic
cagatgtgccacttggatgaacatggaagtgaagatcatagatgcagttgtatccttgaaagccccttacttttg

SEQ ID NO: 44209 - DNA, 75 bp, Artificial Sequence
  Synthetic
ctaccagcaacgctcggtagatatgacctagtgattataaacatccacacaccctttcgcatacatcattaccaa

SEQ ID NO: 44210 - DNA, 75 bp, Artificial Sequence
  Synthetic
acctagtgattataaacatccacacaccctttcgcatacatcattaccaacagtgcgtggatcacgcaatgaagc

SEQ ID NO: 44211 - DNA, 75 bp, Artificial Sequence
  Synthetic
gtacgaacacgtaacagtgatcccgaacacggtgggagtaccgtataagactctagtcaacagaccgggctacag

SEQ ID NO: 44212 - DNA, 75 bp, Artificial Sequence
  Synthetic
atggcaacgaacagggctaattgatgagctggagaaagcggtatactctaggtacgaagtgcagggtatatcagt

SEQ ID NO: 44213 - DNA, 75 bp, Artificial Sequence
  Synthetic
tgtaagaacgtcagcaccgtgcacgattactggaacaatgggacacttcatcctggcccgatgtccgaaaggaga

SEQ ID NO: 44214 - DNA, 75 bp, Artificial Sequence
  Synthetic
tgcagatgctcggaggagactccctgagactgctcaagccgggtggttcattactgatcagggcatacggctacg

SEQ ID NO: 44215 - DNA, 75 bp, Artificial Sequence
  Synthetic
acccacagggacgtaggagatgttcaaagtggctataaaaccctgaacagtaataaaacataaaattaataagga

SEQ ID NO: 44216 - DNA, 75 bp, Artificial Sequence
  Synthetic
gtcactattcgggaagctgagatagaagttgaagggaattctcagctgcaaatctctttctcgacggccttagcc

SEQ ID NO: 44217 - DNA, 75 bp, Artificial Sequence
  Synthetic
ctgcgtactgggacgcaagtttcgatcatccagagcgttgaaaccgccgtgcgtcactagcaacaccgagatgtt

SEQ ID NO: 44218 - DNA, 75 bp, Artificial Sequence
  Synthetic
gagactgctcaagccgggtggttcattactgatcagggcatacggctacgcagacagaacaagcgaacgagtagt

SEQ ID NO: 44219 - DNA, 75 bp, Artificial Sequence
  Synthetic
gcgtcactagcaacaccgagatgtttttcttgttcagcaactttgataacggcagaaggaactttacaacgcacg

SEQ ID NO: 44220 - DNA, 75 bp, Artificial Sequence
  Synthetic
ccgacagcaagtatctaaacactaatcagctacaatggagttcatcccaacccaaactttttacaataggaggta

SEQ ID NO: 44221 - DNA, 75 bp, Artificial Sequence
  Synthetic
aggttaaccgtgccgactgaagggctcgaggtcacgtggggcaacaacgagccgtacaagtattggccgcagtta

SEQ ID NO: 44222 - DNA, 75 bp, Artificial Sequence
  Synthetic
ctgcaagcccttattccgctggcagccctgattgtcctatgcaactgtctgagactcttaccatgctgttgtaaa

SEQ ID NO: 44223 - DNA, 75 bp, Artificial Sequence
  Synthetic
gtacggcggtcctaaataggtacgcactacagctacctattttgcagaagccgacagcaagtatctaaacactaa

SEQ ID NO: 44224 - DNA, 75 bp, Artificial Sequence
  Synthetic
ttttgttggccaggccacccgagcagggtgtgcaccgtcgtaccgggttaaacgcatggacatcgcaagaacgat

SEQ ID NO: 44225 - DNA, 75 bp, Artificial Sequence
  Synthetic
tcagctacaatggagttcatcccaacccaaactttttacaataggaggtaccagcctcgaccctggactccgcgc

SEQ ID NO: 44226 - DNA, 75 bp, Artificial Sequence
  Synthetic
ttgtgtcagtggcctcgttcgtactcctgtcgatggtgggtgtggcagtggggatgtgcatgtgtgcacgacgca

SEQ ID NO: 44227 - DNA, 75 bp, Artificial Sequence
  Synthetic
cgtctgtaaagcagtatacaaaaaatggccggagtccttcaagaacagtgcaacaccagtgggaaccgcaaagac

SEQ ID NO: 44228 - DNA, 75 bp, Artificial Sequence
  Synthetic
gttaataaactgacaatgcgcgcggtaccccaacagaagccacgcaggaatcggaagaataagaagcaaaagcaa

SEQ ID NO: 44229 - DNA, 75 bp, Artificial Sequence
  Synthetic
atccatgcagtaggacctaatttctcaaattactctgagtccgaaggagaccgggaattggcggctgcttaccga

SEQ ID NO: 44230 - DNA, 75 bp, Artificial Sequence
  Synthetic
gaagtcgctaaggaggtgactagactaggagtaaacagcgtagctataccgctcctttccaccggcgtgtactct

SEQ ID NO: 44231 - DNA, 75 bp, Artificial Sequence
  Synthetic
cacaactggtactgcagagaccgtccgcgggtacggtgcacgtgccgtactctcaggcaccatctggcttcaagt

SEQ ID NO: 44232 - DNA, 75 bp, Artificial Sequence
  Synthetic
ggagggaaagacaggctgactcagtcattaaaccacctttttacagcattagactcaactgatgcagatgtggtt

SEQ ID NO: 44233 - DNA, 75 bp, Artificial Sequence
  Synthetic
gtaggcatagcataccgaactcttccacgattctccgaacccacagggacgtaggagatgttattttgtttttaa

SEQ ID NO: 44234 - DNA, 75 bp, Artificial Sequence
  Synthetic
ggtcatctaagtatgaccttgaatgcgcgcagatacccgtgcacatgaagtccgacgcttcgaagttcacccatg

SEQ ID NO: 44235 - DNA, 75 bp, Artificial Sequence
  Synthetic
atctactgccgcgacaaggagtgggagaagaaaatagccgaggccatacaaatgaggacccaagtggaactacta

SEQ ID NO: 44236 - DNA, 75 bp, Artificial Sequence
  Synthetic
agaagaaaatagccgaggccatacaaatgaggacccaagtggaactactagacgaacacatctctgtagactgcg

SEQ ID NO: 44237 - DNA, 75 bp, Artificial Sequence
  Synthetic
agaaaccggaggggtactacaactggcaccacggagcagtacagtactcaggaggccggttcaccatccctacag

SEQ ID NO: 44238 - DNA, 75 bp, Artificial Sequence
  Synthetic
atatcatccgagtgcaccctgacagcagtttggcaggtagaaaagggtacagcactacagaaggttcactgtact

SEQ ID NO: 44239 - DNA, 75 bp, Artificial Sequence
  Synthetic
cagtttggcaggtagaaaagggtacagcactacagaaggttcactgtactcctacttggaagggacacggttcca

SEQ ID NO: 44240 - DNA, 75 bp, Artificial Sequence
  Synthetic
gaggtcatgacagcagccgcatcccaagggttaaccagaaaaggagtttacgcagttaggcaaaaagttaacgaa

SEQ ID NO: 44241 - DNA, 75 bp, Artificial Sequence
  Synthetic
atgatgcagatgcatcgtcgcccccaaaaaccgtcccgtgcctctgccgttatgccatgacacccgaacgagtca

SEQ ID NO: 44242 - DNA, 75 bp, Artificial Sequence
  Synthetic
tatgccatgacacccgaacgagtcaccaggcttcgtatgaaccatgtcacaagcataatagtgtgctcatcattc

SEQ ID NO: 44243 - DNA, 75 bp, Artificial Sequence
  Synthetic
ccccttccaaagtataaaatagaaggagtgcagaaagtcaagtgttctaaagtgatgctgttcgaccataacgtg

SEQ ID NO: 44244 - DNA, 75 bp, Artificial Sequence
  Synthetic
atccttaacatgttctccccaccgccagcgacgcagcaccaaggacaacttcaatgtctataaagccacaagacc

SEQ ID NO: 44245 - DNA, 75 bp, Artificial Sequence
  Synthetic
atgattggaccaagctgcgttacatggacaatcacatgccagcagacgcagagagggccgggctatttgtaagaa

SEQ ID NO: 44246 - DNA, 75 bp, Artificial Sequence
  Synthetic
gagtgcagaaagtcaagtgttctaaagtgatgctgttcgaccataacgtgccatcacgcgttagtccaagggaat

SEQ ID NO: 44247 - DNA, 75 bp, Artificial Sequence
  Synthetic
ataaatcgcctcaggagactgcacaagaagtaagttcgaccacatcactgacgcacagccaattcgaccttagtg

SEQ ID NO: 44248 - DNA, 75 bp, Artificial Sequence
  Synthetic
catgaaggtatatgtgtcccctaagagacacaccgtatatagctaataatctgtagatcaaagggctatataacc

SEQ ID NO: 44249 - DNA, 75 bp, Artificial Sequence
  Synthetic
ttgacggtgaggtactgcccgctccgtctgacctggaagctgatgctccgattccggagccaacaccagacgaca

SEQ ID NO: 44250 - DNA, 75 bp, Artificial Sequence
  Synthetic
tcgtccgggttgtcaatccctttgaggactagaatcaaatggttgttaagcaaggtgccaaaaaccgacctgatc

SEQ ID NO: 44251 - DNA, 75 bp, Artificial Sequence
  Synthetic
taagcttcctaaaagcagccgaactcactttgagatgtaggcatagcataccgaactcttccacgattctccgaa

SEQ ID NO: 44252 - DNA, 75 bp, Artificial Sequence
  Synthetic
tgtcccctaagagacacaccatatatagctaagaatcaatagataagtatagatcaaagggctgaataacccctg

SEQ ID NO: 44253 - DNA, 75 bp, Artificial Sequence
  Synthetic
gattgaaaatttttcggctgtgtcagactgggtaatgaataccgcgccagtcgcaccacccagaagaagacgtgg

SEQ ID NO: 44254 - DNA, 75 bp, Artificial Sequence
  Synthetic
gactgggtaatgaataccgcgccagtcgcaccacccagaagaagacgtgggaaaaacttgaatgtcacctgcgac

SEQ ID NO: 44255 - DNA, 75 bp, Artificial Sequence
  Synthetic
gagagagaagggaacgtacttcccatggctagcgttcggtttttcagagcggatctgcactccatcgtacaggaa

SEQ ID NO: 44256 - DNA, 75 bp, Artificial Sequence
  Synthetic
gagcggtacttactttgcctcccacgattgaaaatttttcggctgtgtcagactgggtaatgaataccgcgccag

SEQ ID NO: 44257 - DNA, 75 bp, Artificial Sequence
  Synthetic
ggcaaagaacataggattatgttcaacagacctgacggaaggtagacgaggtaaattgtctatcatgagagggaa

SEQ ID NO: 44258 - DNA, 75 bp, Artificial Sequence
  Synthetic
cgtccctccaggcgcccctgagtgtcgctacagaaccaaatcaactgccgatctcatttggagcaccaaacgaga

SEQ ID NO: 44259 - DNA, 75 bp, Artificial Sequence
  Synthetic
tcgctttgagatgtaggcgtagcacaccgaactcttccacgattctccgaacccacagggacgtaggagatgttc

SEQ ID NO: 44260 - DNA, 75 bp, Artificial Sequence
  Synthetic
acggcagagatacgcgatacggccgcgtccctccaggcgcccctgagtgtcgctacagaaccaaatcaactgccg

SEQ ID NO: 44261 - DNA, 75 bp, Artificial Sequence
  Synthetic
ggcccaattgcctagggtttaaactccggacctgcagggcccgagctccagatccaacttcgagaagctcagagg

SEQ ID NO: 44262 - DNA, 75 bp, Artificial Sequence
  Synthetic
tgtcacaacagtccggcaacgtaaagatcacagtcaatggccagacggtgcggtataagtgtaattgcggtggct

SEQ ID NO: 44263 - DNA, 75 bp, Artificial Sequence
  Synthetic
tgatgaaggggagattgaaagcttgtcctctgagttactgacctttggagacttctcgccaggcgaagtggatga

SEQ ID NO: 44264 - DNA, 75 bp, Artificial Sequence
  Synthetic
ccagacacccctgatcgcacattaatgtcacaacagtccggcaacgtaaagatcacagtcaatggccagacggtg

SEQ ID NO: 44265 - DNA, 75 bp, Artificial Sequence
  Synthetic
cggtataagtgtaattgcggtggctcaaatgaaggactaacaactacagacaaagtgattaataactgcaaggtt

SEQ ID NO: 44266 - DNA, 75 bp, Artificial Sequence
  Synthetic
gactagatagggcaggtgggtacatattctcatctgacaccggccccggccacctgcaacagaggtctgtccgtc

SEQ ID NO: 44267 - DNA, 75 bp, Artificial Sequence
  Synthetic
attctcatctgacaccggccccggccacctgcaacagaggtctgtccgtcagacagtactgccggtaaatacctt

SEQ ID NO: 44268 - DNA, 75 bp, Artificial Sequence
  Synthetic
ttaagcttcctaaaagcagccgaactcactttgagatgtaggcatagcataccgaactcttccacaattctccgt

SEQ ID NO: 44269 - DNA, 75 bp, Artificial Sequence
  Synthetic
ccgccaccatggtgagcaagggcgaggagctgttcaccggggtggtgcccatcctggtcgagctggacggcgacg

SEQ ID NO: 44270 - DNA, 75 bp, Artificial Sequence
  Synthetic
ggaggaagttcaagaggagaaatgttacccacctaagttggatgaagtgaaagagcagttgttacttaagaaact

SEQ ID NO: 44271 - DNA, 75 bp, Artificial Sequence
  Synthetic
tacccacctaagttggatgaagtgaaagagcagttgttacttaagaaactccaggaaagtgcgtccatggctaac

SEQ ID NO: 44272 - DNA, 75 bp, Artificial Sequence
  Synthetic
agtttcttactgctctactctgcaaagcaagagattaataacccatcatggatcctgtgtacgtggacatagacg

SEQ ID NO: 44273 - DNA, 75 bp, Artificial Sequence
  Synthetic
cggcgagggcgagggcgatgccacctacggcaagctgaccctgaagttcatctgcaccaccggcaagctgcccgt

SEQ ID NO: 44274 - DNA, 75 bp, Artificial Sequence
  Synthetic
agaagcaggtaccaatcccgcaaagtagagaacatgaaagcaacaatagtccaaaggctgaagggtggttgcaaa

SEQ ID NO: 44275 - DNA, 75 bp, Artificial Sequence
  Synthetic
ggagctgttcaccggggtggtgcccatcctggtcgagctggacggcgacgtaaacggccacaagttcagcgtgtc

SEQ ID NO: 44276 - DNA, 75 bp, Artificial Sequence
  Synthetic
tacggcaagctgaccctgaagttcatctgcaccaccggcaagctgcccgtgccctggcccaccctcgtgaccacc

SEQ ID NO: 44277 - DNA, 75 bp, Artificial Sequence
  Synthetic
ctgacctacggcgtgcagtgcttcagccgctaccccgaccacatgaagcagcacgacttcttcaagtccgccatg

SEQ ID NO: 44278 - DNA, 75 bp, Artificial Sequence
  Synthetic
ccgacaggtacgcgcttcaagttcggcgccatgatgaaatcaggtatgttcctaactctgttcgtcaacacattg

SEQ ID NO: 44279 - DNA, 75 bp, Artificial Sequence
  Synthetic
aagttcctacctaccgaactacatatccggcaccagtgtactcacccccaatcaatatccgactgtccaaccccg

SEQ ID NO: 44280 - DNA, 75 bp, Artificial Sequence
  Synthetic
gccgcagttatctacaaacggtacagcccatggccacccgcatgagataattctgtattattatgagctgtaccc

SEQ ID NO: 44281 - DNA, 75 bp, Artificial Sequence
  Synthetic
ccatcttcttcaaggacgacggcaactacaagacccgcgccgaggtgaagttcgagggcgacaccctggtgaacc

SEQ ID NO: 44282 - DNA, 75 bp, Artificial Sequence
  Synthetic
gttcctagcaaggaactatccgacagttgcgtcgtaccaaatcaccgatgagtacgatgcatacctggacatggt

SEQ ID NO: 44283 - DNA, 75 bp, Artificial Sequence
  Synthetic
agccctaccacctctacaggcagcacaggaagatgttcaggtcgaaatcgacgtggaacagcttgaggacagagc

SEQ ID NO: 44284 - DNA, 75 bp, Artificial Sequence
  Synthetic
ctctatttaatgtcggagaccccgaaagttcctacctaccgaactacatatccggcaccagtgtactcaccccca

SEQ ID NO: 44285 - DNA, 75 bp, Artificial Sequence
  Synthetic
caaggaggacggcaacatcctggggcacaagctggagtacaactacaacagccacaacgtctatatcatggccga

SEQ ID NO: 44286 - DNA, 75 bp, Artificial Sequence
  Synthetic
cgggcgacgttcaatccatcaaagcttagaagttatccaaaacagcactcctaccatgcacccacaatcagaagt

SEQ ID NO: 44287 - DNA, 75 bp, Artificial Sequence
  Synthetic
tccggcaccagtgtactcacccccaatcaatatccgactgtccaaccccgagtctgctgtggcagcgtgcaatga

SEQ ID NO: 44288 - DNA, 75 bp, Artificial Sequence
  Synthetic
gttgcgtcgtaccaaatcaccgatgagtacgatgcatacctggacatggtggacgggtcggaaagctgccttgac

SEQ ID NO: 44289 - DNA, 75 bp, Artificial Sequence
  Synthetic
aacttcaagatccgccacaacatcgaggacggcagcgtgcagctcgccgaccactaccagcagaacacccccatc

SEQ ID NO: 44290 - DNA, 75 bp, Artificial Sequence
  Synthetic
cgttgcagaacgtactggctgctgccacgaaaagaaattgcaacgtcacacagatgagagaactgcctactttgg

SEQ ID NO: 44291 - DNA, 75 bp, Artificial Sequence
  Synthetic
ttagaagttatccaaaacagcactcctaccatgcacccacaatcagaagtgccgtaccttccccgttccagaaca

SEQ ID NO: 44292 - DNA, 75 bp, Artificial Sequence
  Synthetic
cacgaaaagaaattgcaacgtcacacagatgagagaactgcctactttggattcagcggtatttaatgttgagtg

SEQ ID NO: 44293 - DNA, 75 bp, Artificial Sequence
  Synthetic
acaaccactacctgagcacccagtccgccctgagcaaagaccccaacgagaagcgcgatcacatggtcctgctgg

SEQ ID NO: 44294 - DNA, 75 bp, Artificial Sequence
  Synthetic
ctttaaaaaatttgcgtgcaatcaagaatactggaaggaatttgccgccagtccaattaggataacgactgagaa

SEQ ID NO: 44295 - DNA, 75 bp, Artificial Sequence
  Synthetic
ctgttggcaaacaccacgttcccctgctcccagcccccttgcacgccctgctgctacgaaaaggaaccggaggaa

SEQ ID NO: 44296 - DNA, 75 bp, Artificial Sequence
  Synthetic
gccgtaatgagcgtcggtgcccacactgtgagcgcgtacgaacacgtaacagtgatcccgaacacggtgggagta

SEQ ID NO: 44297 - DNA, 75 bp, Artificial Sequence
  Synthetic
aagtgcagggtatatcagttgtggtaatgtccatggccacctttgcaagctccagatccaacttcgagaagctca

SEQ ID NO: 44298 - DNA, 75 bp, Artificial Sequence
  Synthetic
cttgacaacctatgtcacaaaactaaaaggaccaaaagcagcagcattgtttgccaagacacataacctgctacc

SEQ ID NO: 44299 - DNA, 75 bp, Artificial Sequence
  Synthetic
aagcgcgatcacatggtcctgctggagttcgtgaccgccgccgggatcactctcggcatggacgagctgtacaag

SEQ ID NO: 44300 - DNA, 75 bp, Artificial Sequence
  Synthetic
aaaggaccaaaagcagcagcattgtttgccaagacacataacctgctaccactgcaggaggtaccaatggacagg

SEQ ID NO: 44301 - DNA, 75 bp, Artificial Sequence
  Synthetic
tttactgtagacatgaaaagggacgtgaaggtgactccggggacgaagcacactgaggaaagacctaaagtgcag

SEQ ID NO: 44302 - DNA, 75 bp, Artificial Sequence
  Synthetic
gtcatacaggcagccgaacctttggcaacagcatatctgtgtgggatccacagagagttggtcagaaggctgaat

SEQ ID NO: 44303 - DNA, 75 bp, Artificial Sequence
  Synthetic
acctacctgactacagctgtaaggtcttcaccggcgtctacccatttatgtggggcggcgcctactgcttctgcg

SEQ ID NO: 44304 - DNA, 75 bp, Artificial Sequence
  Synthetic
gcagtccttctacctaatgtacacacgctgtttgacatgtctgccgaggactttgacgccattatcgccgcgcac

SEQ ID NO: 44305 - DNA, 75 bp, Artificial Sequence
  Synthetic
ttcaagccaggggacgccgtattggaaaccgatatagcctcctttgacaagagccaagacgactcattggcgctc

SEQ ID NO: 44306 - DNA, 75 bp, Artificial Sequence
  Synthetic
aaaccgatatagcctcctttgacaagagccaagacgactcattggcgctcactgctctaatgttgctagaggatt

SEQ ID NO: 44307 - DNA, 75 bp, Artificial Sequence
  Synthetic
gagccaagacgactcattggcgctcactgctctaatgttgctagaggatttgggggtggatcatcccctgttgga

SEQ ID NO: 44308 - DNA, 75 bp, Artificial Sequence
  Synthetic
atgcaaacggcgaccatgccgtcacagttaaggacgccaaattcattgtggggccaatgtcttcagcctggacac

SEQ ID NO: 44309 - DNA, 75 bp, Artificial Sequence
  Synthetic
cttgatagaggctgccttcggggagatctccagctgccacctaccgacgggcacccgttttaagttcggcgccat

SEQ ID NO: 44310 - DNA, 75 bp, Artificial Sequence
  Synthetic
gtccggtcgtacaagaaacagcggagacgcgtgacacagcaatgtctcttcaggcaccgccgagtaccgccacgg

SEQ ID NO: 44311 - DNA, 75 bp, Artificial Sequence
  Synthetic
ggggatgtgcatgtgtgcacgacgcagatgcatcacaccgtatgaactgacaccaggagctaccgtccctttcct

SEQ ID NO: 44312 - DNA, 75 bp, Artificial Sequence
  Synthetic
ctgttcgtcaatacactgctaaacatcaccatagccagccgagtgctggaggaccgcttgacaaagtctgcgtgc

SEQ ID NO: 44313 - DNA, 75 bp, Artificial Sequence
  Synthetic
agttaaggacgccaaattcattgtggggccaatgtcttcagcctggacacctttcgacaacaaaattgtggtgta

SEQ ID NO: 44314 - DNA, 75 bp, Artificial Sequence
  Synthetic
tcaccatagccagccgagtgctggaggaccgcttgacaaagtctgcgtgcgcggccttcatcggcgacgacaata

SEQ ID NO: 44315 - DNA, 75 bp, Artificial Sequence
  Synthetic
gacgcgtgacacagcaatgtctcttcaggcaccgccgagtaccgccacggaactgaatcatccgccgatctcctt

SEQ ID NO: 44316 - DNA, 75 bp, Artificial Sequence
  Synthetic
gagaaatcgaaagcttgtcttctgagctactaactttcggagacttcctacccggagaagtggatgacttgacag

SEQ ID NO: 44317 - DNA, 75 bp, Artificial Sequence
  Synthetic
taatacatggggttgtctctgacgaactgatggcagcaagatgcgctacatggatgaacatggaagtgaagatca

SEQ ID NO: 44318 - DNA, 75 bp, Artificial Sequence
  Synthetic
gttgcattacgaaggcaaaatgcgcactacgaatgagtacaacaagccgattgtagtggacactacaggctcaac

SEQ ID NO: 44319 - DNA, 75 bp, Artificial Sequence
  Synthetic
tggatgaacatggaagtgaagatcatagatgcggtcgtgtctcagaaagccccgtacttctgcggagggtttata

SEQ ID NO: 44320 - DNA, 75 bp, Artificial Sequence
  Synthetic
cccgtacttctgcggagggtttatactgtatgacacagtagcaggcacggcctgcagagtggcagacccgctaaa

SEQ ID NO: 44321 - DNA, 75 bp, Artificial Sequence
  Synthetic
cccaaaaactgtcccgtgcctttgccgttacgccatgactccagaacgcgtcacccgacttcgcatgaaccacgt

SEQ ID NO: 44322 - DNA, 75 bp, Artificial Sequence
  Synthetic
ctgtatgacacagtagcaggcacggcctgcagagtggcagacccgctaaagcggctgttcaagctgggcaaaccg

SEQ ID NO: 44323 - DNA, 75 bp, Artificial Sequence
  Synthetic
ctgacgcatagccaattcgacctaagcgttgacggcgagatactgcccgtcccgtcagacctggatgctgacgcc

SEQ ID NO: 44324 - DNA, 75 bp, Artificial Sequence
  Synthetic
gggctaattgatgagctagaaaaagcggtacactccaggtatgaagtgcagggcatatctgtcgtggtaatgtct

SEQ ID NO: 44325 - DNA, 75 bp, Artificial Sequence
  Synthetic
cccgtcagacctggatgctgacgccccagccctagaaccagccctagacgacggggcgacacacacgttgccatc

SEQ ID NO: 44326 - DNA, 75 bp, Artificial Sequence
  Synthetic
gggcatatctgtcgtggtaatgtctatggccacctttgcaagctctagatctaactttgagaagctcagaggacc

SEQ ID NO: 44327 - DNA, 75 bp, Artificial Sequence
  Synthetic
cccagtcaattcagaaggttcaggccgagtttgacagctttgtggtaccgagcctgtggtcgtccgggttgtcaa

SEQ ID NO: 44328 - DNA, 75 bp, Artificial Sequence
  Synthetic
catcgtaactctgtacggtggtcctaaataggtacgcactacagctacctatttcgtcagaaaccaatcgcagct

SEQ ID NO: 44329 - DNA, 75 bp, Artificial Sequence
  Synthetic
tttctcgacggccctagccagcgccgaattccgcgtacaagtctgttctacacaagtacactgtgcagccgagtg

SEQ ID NO: 44330 - DNA, 75 bp, Artificial Sequence
  Synthetic
gaaaaggaaccggaggaaaccctacgcatgcttgaggacaacgtcatgagacctgggtactatcagctgctacaa

SEQ ID NO: 44331 - DNA, 75 bp, Artificial Sequence
  Synthetic
atttcgtcagaaaccaatcgcagctacttgcatacctaccagctacaatggagttcatcccgacgcaaactttct

SEQ ID NO: 44332 - DNA, 75 bp, Artificial Sequence
  Synthetic
acaacagaaggtaccaaccccgaccctgggccccacgccccacaattcaagtaattagacctagaccacgtccac

SEQ ID NO: 44333 - DNA, 75 bp, Artificial Sequence
  Synthetic
ctgggccccacgccccacaattcaagtaattagacctagaccacgtccacagaggcaggctgggcaactcgccca

SEQ ID NO: 44334 - DNA, 75 bp, Artificial Sequence
  Synthetic
gctgatctctgcagtcaacaaattgaccatgcgcgcggtacctcaacagaagcctcgcagaaatcggaaaaacaa

SEQ ID NO: 44335 - DNA, 75 bp, Artificial Sequence
  Synthetic
accatgcgcgcggtacctcaacagaagcctcgcagaaatcggaaaaacaagaagcaaaggcagaagaagcaggcg

SEQ ID NO: 44336 - DNA, 75 bp, Artificial Sequence
  Synthetic
ccgcaaaatgacccaaagcaaaagaagcaaccaccacaaaagaagccggctcaaaagaagaagaaaccaggccgt

SEQ ID NO: 44337 - DNA, 75 bp, Artificial Sequence
  Synthetic
agcaaccaccacaaaagaagccggctcaaaagaagaagaaaccaggccgtagagagagaatgtgcatgaagattg

SEQ ID NO: 44338 - DNA, 75 bp, Artificial Sequence
  Synthetic
aataggtatacgtgtcccctaagagacacattgtatgtaggtgataagtatagatcaaagggccgaataacccct

SEQ ID NO: 44339 - DNA, 75 bp, Artificial Sequence
  Synthetic
aaaatgattgcatcttcgaagtcaagcatgaaggcaaagtgatgggctacgcatgcctggtgggggataaagtaa

SEQ ID NO: 44340 - DNA, 75 bp, Artificial Sequence
  Synthetic
gaatttaacaacctatgttactaaactaaaagggccaaaagcagcagcgctattcgcaaaaacccataatctgct

SEQ ID NO: 44341 - DNA, 75 bp, Artificial Sequence
  Synthetic
ggtgcacatgaagtctgatgcctcgaagtttacccacgagaaacccgaggggtactataactggcatcacggagc

SEQ ID NO: 44342 - DNA, 75 bp, Artificial Sequence
  Synthetic
aagtttacccacgagaaacccgaggggtactataactggcatcacggagcagtgcagtattcaggaggccggttt

SEQ ID NO: 44343 - DNA, 75 bp, Artificial Sequence
  Synthetic
actatcccgacgggtgcaggcaagccgggagacagcggcagaccgatcttcgacaacaaaggacgggtggtggcc

SEQ ID NO: 44344 - DNA, 75 bp, Artificial Sequence
  Synthetic
cgggagacagcggcagaccgatcttcgacaacaaaggacgggtggtggccatcgtcctaggaggggccaacgaag

SEQ ID NO: 44345 - DNA, 75 bp, Artificial Sequence
  Synthetic
gtgcccgcacggccctctccgtggtgacgtggaacaaagacatcgtcacaaaaattacccctgagggagccgaag

SEQ ID NO: 44346 - DNA, 75 bp, Artificial Sequence
  Synthetic
gacgtggaacaaagacatcgtcacaaaaattacccctgagggagccgaagagtggagcctcgccctcccggtctt

SEQ ID NO: 44347 - DNA, 75 bp, Artificial Sequence
  Synthetic
tttgtggagggtttatactgcacgatactgtgacgggaacagcttgcagagtggcagacccgctaaaaaggctat

SEQ ID NO: 44348 - DNA, 75 bp, Artificial Sequence
  Synthetic
gtgcctgttggcaaacaccacattcccctgctctcagccgccttgcacaccctgctgctacgaaaaggaaccgga

SEQ ID NO: 44349 - DNA, 75 bp, Artificial Sequence
  Synthetic
gcacgtacgtgccggcgaccatttgtgatcaaatgaccggcatccttgctacagaagtcacgccggaggatgcac

SEQ ID NO: 44350 - DNA, 75 bp, Artificial Sequence
  Synthetic
aagcaccttgcgcatgcttgaggacaacgtgatgagacccggatactaccagctgctaaaagcatcgctgacttg

SEQ ID NO: 44351 - DNA, 75 bp, Artificial Sequence
  Synthetic
actcgctaattatgcgagaaagctcgcatctgccgcaggaaaagtcctggacagaaacatttctggaaagatcgg

SEQ ID NO: 44352 - DNA, 75 bp, Artificial Sequence
  Synthetic
ggccttcagtaagtgggcgaaggagtgccggaaggacatggaagatgagaagcttctgggggtcagagaaagaac

SEQ ID NO: 44353 - DNA, 75 bp, Artificial Sequence
  Synthetic
agctgctaaaagcatcgctgacttgttctccccaccgccaaagacgcagtactaaggacaattttaatgtctata

SEQ ID NO: 44354 - DNA, 75 bp, Artificial Sequence
  Synthetic
ttctccccaccgccaaagacgcagtactaaggacaattttaatgtctataaagccacaagaccatatctagctca

SEQ ID NO: 44355 - DNA, 75 bp, Artificial Sequence
  Synthetic
tgcaccgtcgtaccgggtaaaacgcatggacatcgcgaagaacgatgaagagtgcgtagtcaacgccgctaaccc

SEQ ID NO: 44356 - DNA, 75 bp, Artificial Sequence
  Synthetic
ttgtcctgactgcggagaagggcattcgtgccacagccctatcgcattggagcgcatcagaaatgaagcaacgga

SEQ ID NO: 44357 - DNA, 75 bp, Artificial Sequence
  Synthetic
tcgtgccacagccctatcgcattggagcgcatcagaaatgaagcaacggacggaacgctgaaaatccaggtctct

SEQ ID NO: 44358 - DNA, 75 bp, Artificial Sequence
  Synthetic
ttgcagatcgggataaagacagatgacagccacgattggaccaagctgcgctatatggatagccatacgccagcg

SEQ ID NO: 44359 - DNA, 75 bp, Artificial Sequence
  Synthetic
ggcagcacaggaagatgtccaggtcgaaatcgacgtggaacagcttgaggatagagctggtgctggaataataga

SEQ ID NO: 44360 - DNA, 75 bp, Artificial Sequence
  Synthetic
gatgagcaggtactgaaggctaagaacataggattatgttcaacagacctgacggaaggtagacgaggcaaattg

SEQ ID NO: 44361 - DNA, 75 bp, Artificial Sequence
  Synthetic
taaggacttcagcaccgtgcacgattaccgggaccatgggacactttattctcgcccgatgcccgaaaggagaga

SEQ ID NO: 44362 - DNA, 75 bp, Artificial Sequence
  Synthetic
ctcgcccgatgcccgaaaggagagacgctgacagtgggatttacggacagcagaaagatcagccacacatgtaca

SEQ ID NO: 44363 - DNA, 75 bp, Artificial Sequence
  Synthetic
cacccgttccatcacgaaccacctgtgataggtagggagaggttccactctcgaccacaacatggtaaagagtta

SEQ ID NO: 44364 - DNA, 75 bp, Artificial Sequence
  Synthetic
tgataggtagggagaggttccactctcgaccacaacatggtaaagagttaccttgcagcacgtacgtgcagagca

SEQ ID NO: 44365 - DNA, 75 bp, Artificial Sequence
  Synthetic
ccgctgccactgccgaagagatagaggtgcatatgcccccagatactcctgaccgcacgctgatgacgcagcagt

SEQ ID NO: 44366 - DNA, 75 bp, Artificial Sequence
  Synthetic
aagctgcaggactggtactggtgggcgacttgactaatccgccctaccacgaattcgcatacgaagggctaaaaa

SEQ ID NO: 44367 - DNA, 75 bp, Artificial Sequence
  Synthetic
tgatagccacgattggaccaagctgcgttacatggacaaccacatgccagcagacgcagagagggcggggctatt

SEQ ID NO: 44368 - DNA, 75 bp, Artificial Sequence
  Synthetic
ggcgccacaaaacaacacaaatcaaaagaagcagccacctaaaaagaaaccggctcaaaagaaaaagaagccggg

SEQ ID NO: 44369 - DNA, 75 bp, Artificial Sequence
  Synthetic
tgggcagacggtgcggtacaagtgcaactgcggtggctcaaacgagggactgacaaccacagacaaagtgatcaa

SEQ ID NO: 44370 - DNA, 75 bp, Artificial Sequence
  Synthetic
ggtgcatatgcccccagatactcctgaccgcacgctgatgacgcagcagtctggcaacgtgaagatcacagttaa

SEQ ID NO: 44371 - DNA, 75 bp, Artificial Sequence
  Synthetic
aactgcggtggctcaaacgagggactgacaaccacagacaaagtgatcaataactgcaaaattgatcagtgccat

SEQ ID NO: 44372 - DNA, 75 bp, Artificial Sequence
  Synthetic
gctgcagtcactaatcacaagaagtggcaatacaactcccctttagtcccgcgcaacgctgaactcggggaccgt

SEQ ID NO: 44373 - DNA, 75 bp, Artificial Sequence
  Synthetic
ttcccgtggtcgcccaggccttcagtaagtgggcgaaggagtgccggaaggacatggaagatgagaagcttctgg

SEQ ID NO: 44374 - DNA, 75 bp, Artificial Sequence
  Synthetic
gagtcacttgggtagcgccgttaggtgtccgcggagcggactacacatacaacctagagttgggtctgccagcaa

SEQ ID NO: 44375 - DNA, 75 bp, Artificial Sequence
  Synthetic
tgctgctgtatcctgaccatccgacactcttgtcttaccgtaacatgggacaggaaccaaattaccacgaggagt

SEQ ID NO: 44376 - DNA, 75 bp, Artificial Sequence
  Synthetic
actcttgtcttaccgtaacatgggacaggaaccaaattaccacgaggagtgggtgacacacaagaaggaggttac

SEQ ID NO: 44377 - DNA, 75 bp, Artificial Sequence
  Synthetic
cagaaaacacacacggtctacaagaggcctgatacccagtcaatccagaaggttcaggccgaatttgacagcttt

SEQ ID NO: 44378 - DNA, 75 bp, Artificial Sequence
  Synthetic
cttgaccgtgcctactgagggtctggaggtcacttggggcaacaacgaaccatacaagtactggccgcagatgtc

SEQ ID NO: 44379 - DNA, 75 bp, Artificial Sequence
  Synthetic
gaggtcacttggggcaacaacgaaccatacaagtactggccgcagatgtctacgaacggtactgctcatggtcac

SEQ ID NO: 44380 - DNA, 75 bp, Artificial Sequence
  Synthetic
ccacatgagataatcttgtactattatgagctgtaccccactatgactgtaatcattgtgtcggtggcctcgttc

SEQ ID NO: 44381 - DNA, 75 bp, Artificial Sequence
  Synthetic
atgagctgtaccccactatgactgtaatcattgtgtcggtggcctcgttcgtgcttctgtcgatggtgggcacag

SEQ ID NO: 44382 - DNA, 75 bp, Artificial Sequence
  Synthetic
tgagatgttttttctattcagcaactttgacaatggcagaaggaatttcacaactcatgtcatgaacaatcaact

SEQ ID NO: 44383 - DNA, 75 bp, Artificial Sequence
  Synthetic
gcggaaatgcccaagaagcccaggatgcagaaaaagaagcagaggaagaacgagaagcagaactgactcatgagg

SEQ ID NO: 44384 - DNA, 75 bp, Artificial Sequence
  Synthetic
cagtgggaatgtgtgtgtgcgcacggcgcagatgcattacaccatatgaattaacaccaggagccactgttccct

SEQ ID NO: 44385 - DNA, 75 bp, Artificial Sequence
  Synthetic
ggaaaccttgcggccgtgtctgactgggtaatgagcaccgtacctgtcgcgccgcccagaagaaggcgagggaga

SEQ ID NO: 44386 - DNA, 75 bp, Artificial Sequence
  Synthetic
gagtatgatgcatatctagacatggtggacgggtcggagagttgcctggaccgagcgacattcaatccgtcaaaa

SEQ ID NO: 44387 - DNA, 75 bp, Artificial Sequence
  Synthetic
tgcctactaagagagtcacctgggtagcgccactaggtgtccgcggagcggactatacatacaacctagagctgg

SEQ ID NO: 44388 - DNA, 75 bp, Artificial Sequence
  Synthetic
aggcgctattaaagttactgcccaactaaccgaccacgtcgtgggggagtacctggtactttccccgcagaccgt

SEQ ID NO: 44389 - DNA, 75 bp, Artificial Sequence
  Synthetic
atacaaaaaatggccggagtcctttaagaacagtgcaacaccagtgggaaccgcaaaaacagtcatgtgcggtac

SEQ ID NO: 44390 - DNA, 75 bp, Artificial Sequence
  Synthetic
acgaacaacagcccctgttctggttgcaggctcttatcccgctggccgccttgatcgtcctgtgcaactgtctga

SEQ ID NO: 44391 - DNA, 75 bp, Artificial Sequence
  Synthetic
ctaaccgaccacgtcgtgggggagtacctggtactttccccgcagaccgtattacgcagccagaagctcagcctg

SEQ ID NO: 44392 - DNA, 75 bp, Artificial Sequence
  Synthetic
gcaggctcttatcccgctggccgccttgatcgtcctgtgcaactgtctgaaactcttgccatgctgctgtaagac

SEQ ID NO: 44393 - DNA, 75 bp, Artificial Sequence
  Synthetic
agaaaggcaagtgtgcggtgcattcgatgactaacgccgtcactattcgggaagctgagatagaagttgaaggga

SEQ ID NO: 44394 - DNA, 75 bp, Artificial Sequence
  Synthetic
tcagtagggtcaacgctctacccggaaagccgcaagctacttaagagctggcacctaccatcggtgttccattta

SEQ ID NO: 44395 - DNA, 75 bp, Artificial Sequence
  Synthetic
cgattactggaacaatgggacacttcatcctggcccgatgtccaaaaggggaaactctgacggtgggattcactg

SEQ ID NO: 44396 - DNA, 75 bp, Artificial Sequence
  Synthetic
tcacttgactacatcacgtgcgagtacaaaactgtcatcccctccccgtacgtgaagtgctgtggtacagcagag

SEQ ID NO: 44397 - DNA, 75 bp, Artificial Sequence
  Synthetic
acaaaactgtcatcccctccccgtacgtgaagtgctgtggtacagcagagtgcaaggacaagagcttaccagact

SEQ ID NO: 44398 - DNA, 75 bp, Artificial Sequence
  Synthetic
acagctgcaaggtctttactggagtctacccatttatgtggggcggcgcctactgcttttgcgacgccgaaaata

SEQ ID NO: 44399 - DNA, 75 bp, Artificial Sequence
  Synthetic
cgcaattgagcgaggcacatgtagagaaatccgaatcttgcaaaacagagtttgcatcggcctacagagcccaca

SEQ ID NO: 44400 - DNA, 75 bp, Artificial Sequence
  Synthetic
gaaatccgaatcttgcaaaacagagtttgcatcggcctacagagcccacaccgcatcggcgtcggcgaagctccg

SEQ ID NO: 44401 - DNA, 75 bp, Artificial Sequence
  Synthetic
gagagtgcatccatggccaacagaagcaggtatcagtcgcgcaaagtagaaaacatgaaagcagcaatcatccag

SEQ ID NO: 44402 - DNA, 75 bp, Artificial Sequence
  Synthetic
tagcggaaagaaagaaaactgccaagaaatcagcaccgacgtgatgagacagagaggtctagaaatatctgcacg

SEQ ID NO: 44403 - DNA, 75 bp, Artificial Sequence
  Synthetic
gagatatatactatgtggccaaagcaaacagaggccaatgagcaagtctgcctatatgccctgggggaaagtatt

SEQ ID NO: 44404 - DNA, 75 bp, Artificial Sequence
  Synthetic
atgagcaagtctgcctatatgccctgggggaaagtattgaatcgatcaggcagaaatgcccggtggatgatgcag

SEQ ID NO: 44405 - DNA, 75 bp, Artificial Sequence
  Synthetic
tccgcctggacaccttttgacaacaaaatcgtggtgtacaaaggcgacgtctacaacatggactacccacctttt

SEQ ID NO: 44406 - DNA, 75 bp, Artificial Sequence
  Synthetic
aaatcgtggtgtacaaaggcgacgtctacaacatggactacccaccttttggcgcaggaagaccaggacaatttg

SEQ ID NO: 44407 - DNA, 75 bp, Artificial Sequence
  Synthetic
atcaccatcgccagccgagtgctggaagatcgtctgacaaaatccgcgtgcgcggccttcatcggcgacgacaac

SEQ ID NO: 44408 - DNA, 75 bp, Artificial Sequence
  Synthetic
gtgccatcgcgcgtaagtccaagggaatacagatcttcccaggagtctgtacaggaagtgagtacgacaacgtca

SEQ ID NO: 44409 - DNA, 75 bp, Artificial Sequence
  Synthetic
gtgacattcaaagtcgtacaccggaaagtaaagacgtttatgccaacactcagttggtactacagaggccagcag

SEQ ID NO: 44410 - DNA, 75 bp, Artificial Sequence
  Synthetic
aagtaaagacgtttatgccaacactcagttggtactacagaggccagcagcaggcacggtacatgtaccatactc

SEQ ID NO: 44411 - DNA, 75 bp, Artificial Sequence
  Synthetic
ctttgttttggctacaagcccttattccgctggcagccctgattgtcctatgcaactgtctgagactcttaccat

SEQ ID NO: 44412 - DNA, 75 bp, Artificial Sequence
  Synthetic
tcaggcaccatctggcttcaagtattggctgaaggaacgaggagcatcgctacagcacacggcaccgttcggttg

SEQ ID NO: 44413 - DNA, 75 bp, Artificial Sequence
  Synthetic
tggctgaaggaacgaggagcatcgctacagcacacggcaccgttcggttgccagattgcgacaaacccggtaaga

SEQ ID NO: 44414 - DNA, 75 bp, Artificial Sequence
  Synthetic
gcagtgcggcttcttcaatatgatgcagatgaaagtcaactacaatcataacatctgcactcaagtgtaccacaa

SEQ ID NO: 44415 - DNA, 75 bp, Artificial Sequence
  Synthetic
aagtatctccaggcggtgtacactgcctgtgactgccattgtgtcgtcgttgcattacgaaggcaaaatgcgcac

SEQ ID NO: 44416 - DNA, 75 bp, Artificial Sequence
  Synthetic
agggagaaacctgactgtgacatgtgacgagagagaagggaatataacacccatggctagcgtccgattctttag

SEQ ID NO: 44417 - DNA, 75 bp, Artificial Sequence
  Synthetic
caattcgacctaagcgttgatggcgagatactgcccgtcccgtcagacctggatgctgacgccccagccctagaa

SEQ ID NO: 44418 - DNA, 75 bp, Artificial Sequence
  Synthetic
ccatggctagcgtccgattctttagagcagagctgtgtccggccgtacaagaaacagcggagacgcgtgacacag

SEQ ID NO: 44419 - DNA, 75 bp, Artificial Sequence
  Synthetic
gctgtaaattgcgctgtggggaacataccaatttccatcgacataccggatgcggcctttactagggttgtcgat

SEQ ID NO: 44420 - DNA, 75 bp, Artificial Sequence
  Synthetic
gcaccctctgtaacggacatgtcatgcgaagtaccagcctgcactcactcctccgactttgggggcgtcgccatc

SEQ ID NO: 44421 - DNA, 75 bp, Artificial Sequence
  Synthetic
aacccacagggacgtaggagatgttattttgtttttaatatttcaaaaaaaaaaaaaaaaaaaaaaaaaaaaaaa

SEQ ID NO: 44422 - DNA, 75 bp, Artificial Sequence
  Synthetic
atcaaatatacagctagcaagaaaggtaaatgtgcagtacattcgatgaccaacgccgttaccattcgagaagcc

SEQ ID NO: 44423 - DNA, 75 bp, Artificial Sequence
  Synthetic
gtaaatgtgcagtacattcgatgaccaacgccgttaccattcgagaagccgacgtagaagtagaggggaactccc

SEQ ID NO: 44424 - DNA, 75 bp, Artificial Sequence
  Synthetic
agctgcaaatatccttctcaacagccttggcaagcgctgagtttcgcgtgcaagtgtgctccacacaagtacact

SEQ ID NO: 44425 - DNA, 75 bp, Artificial Sequence
  Synthetic
caagtgtgctccacacaagtacactgcgcagccgcatgccaccctccaaaggaccacatagtcaattacccagca

SEQ ID NO: 44426 - DNA, 75 bp, Artificial Sequence
  Synthetic
aagcacatgtggagaagtctgaatcatgcaaaacagaatttgcatcagcatacagggctcataccgcatccgcat

SEQ ID NO: 44427 - DNA, 75 bp, Artificial Sequence
  Synthetic
ggaccacatagtcaattacccagcatcacacaccacccttggggtccaggatatatccacaacggcaatgtcttg

SEQ ID NO: 44428 - DNA, 75 bp, Artificial Sequence
  Synthetic
tcacacaccacccttggggtccaggatatatccacaacggcaatgtcttgggtgcagaagattacgggaggagta

SEQ ID NO: 44429 - DNA, 75 bp, Artificial Sequence
  Synthetic
aaagacgctgcagaacccaccgaaaggaaacttcaaggcaactattaaggagtgggaggtggagcacgcatcgat

SEQ ID NO: 44430 - DNA, 75 bp, Artificial Sequence
  Synthetic
ggattaattgttgctgttgctgccttaattttaattgtggtgctatgcgtgtcgtttagcaggcactaaaccgat

SEQ ID NO: 44431 - DNA, 75 bp, Artificial Sequence
  Synthetic
taaaagtagaaagtacataaccaggtatatgtgccccctaagaggcacaatatatatagctaagcactattagat

SEQ ID NO: 44432 - DNA, 75 bp, Artificial Sequence
  Synthetic
tatatgtgccccctaagaggcacaatatatatagctaagcactattagatcaaagggctatacaacccctgaata

SEQ ID NO: 44433 - DNA, 75 bp, Artificial Sequence
  Synthetic
cagaagtcagtacgccagtcagtgctgccggtgaacaccctggaggaagtccacgaggagaagtgttacccacct

SEQ ID NO: 44434 - DNA, 75 bp, Artificial Sequence
  Synthetic
cacattgtatgtaggtagtaagtatagatcaaagggctatattaacccctgaatagtaacaaaacacaaaaacaa

SEQ ID NO: 44435 - DNA, 75 bp, Artificial Sequence
  Synthetic
accgtgcgaccgtgtgctgttctcagtagggtcaacgctttacccggaaagccgcatgctacttaagagctggca

SEQ ID NO: 44436 - DNA, 75 bp, Artificial Sequence
  Synthetic
gaatagtaacaaaacacaaaaacaataaaaactacaaaatagaaaatctataaacaaaagtagttcaaagggcta

SEQ ID NO: 44437 - DNA, 75 bp, Artificial Sequence
  Synthetic
ccaacattataccggccaacaggagactaccacactcattagtggccgaacaccgcccagtaaaaggggaaagaa

SEQ ID NO: 44438 - DNA, 75 bp, Artificial Sequence
  Synthetic
acacagatgagggaattacccactttggactcagcagtattcaacgtggagtgttttaaaaaattcgcatgcaac

SEQ ID NO: 44439 - DNA, 75 bp, Artificial Sequence
  Synthetic
caaaacccctgaatagtaacaaaacataaaatgtaataaaaattaagtgtgtacccaaaagaggtacagtaagaa

SEQ ID NO: 44440 - DNA, 75 bp, Artificial Sequence
  Synthetic
caccgcccagtaaaaggggaaagaatggaatggctggttaacaagataaacggacatcatgtgctcctggttagc

SEQ ID NO: 44441 - DNA, 75 bp, Artificial Sequence
  Synthetic
cctgcacccattcctcagacttcgggggcgtcgccattattaaatatgcagccagcaagaaaggcaagtgtgcgg

SEQ ID NO: 44442 - DNA, 75 bp, Artificial Sequence
  Synthetic
tctccgatgaattgatggcagccagatgcgccacttggatgaacatggaagtgaagatcatagatgcagttgtat

SEQ ID NO: 44443 - DNA, 75 bp, Artificial Sequence
  Synthetic
taccaaattaccgacgagtatgatgcatatctagacatggtggacgggtcggagagttgcctggaccgagcgaca

SEQ ID NO: 44444 - DNA, 75 bp, Artificial Sequence
  Synthetic
tagatcacgcaatgaaactgcaaatgctagggggtgactcactgagactgctcaaaccgggtggctctctattga

SEQ ID NO: 44445 - DNA, 75 bp, Artificial Sequence
  Synthetic
gccaccctccgaaggaccacatagtcaactacccggcgtcacataccaccctcggggtccaggacatttccgcta

SEQ ID NO: 44446 - DNA, 75 bp, Artificial Sequence
  Synthetic
gagcattgaaaccaccttgtatcaccagtaatactgagatgtttttcctatttagcagttttgacaatggcagaa

SEQ ID NO: 44447 - DNA, 75 bp, Artificial Sequence
  Synthetic
tggtgctatgcgtgtcgttcagcaggcactgactcgacaactaagtatgaaggtatacgtgtcccctaagagaca

SEQ ID NO: 44448 - DNA, 75 bp, Artificial Sequence
  Synthetic
agaggagctatcaaagttactgcccaaccaacagaccacgtcgtgggagagtacctggtactttccccgcagacc

SEQ ID NO: 44449 - DNA, 75 bp, Artificial Sequence
  Synthetic
cccaacagaagccacgcaggaatcggaagaataagaagcaaaagcaaaagcaacaggcgccacaaaacaacacaa

SEQ ID NO: 44450 - DNA, 75 bp, Artificial Sequence
  Synthetic
aaagacaggctaacccagtcactgaaccacctctttacagccatggactcgacggatgcagacgtggtcatctac

SEQ ID NO: 44451 - DNA, 75 bp, Artificial Sequence
  Synthetic
ggcagtataactcccctctggtcccgcgtaatgctgaacttggggaccgaaaaggaaaaattcacatcccgtttc

SEQ ID NO: 44452 - DNA, 75 bp, Artificial Sequence
  Synthetic
aatgaaaccagcacatgtgaagggaactatcgacaatgccgatctggctaaactggccttcaagcggtcgtctaa

SEQ ID NO: 44453 - DNA, 75 bp, Artificial Sequence
  Synthetic
ctggccaaattggcctttaagcggtcatctaagtacgaccttgaatgcgcgcagatacccgtgcacatgaagtcc

SEQ ID NO: 44454 - DNA, 75 bp, Artificial Sequence
  Synthetic
gtatgtaggtgataagtatagatcaaagggccgaataacccctgaatagtaacaaaatatgaaaatcaataaaaa

SEQ ID NO: 44455 - DNA, 75 bp, Artificial Sequence
  Synthetic
gctaaccgtgccgactgaagggctcgaggtcacgtggggcaacaacgagccgtataagtattggccgcagttatc

SEQ ID NO: 44456 - DNA, 75 bp, Artificial Sequence
  Synthetic
tctcaggcaccatctggctttaagtattggctaaaagaacgaggggcgtcgctgcagcacacagcaccatttggc

SEQ ID NO: 44457 - DNA, 75 bp, Artificial Sequence
  Synthetic
catgagacctgggtactatcagctgctacaagcatccttaacatgttctccccaccgccagcgacgcagcaccaa

SEQ ID NO: 44458 - DNA, 75 bp, Artificial Sequence
  Synthetic
aattgtgtgttcttcatttccccttccaaagtacaagatagaaggagtgcaaaaagtcaaatgctccaaggtaat

SEQ ID NO: 44459 - DNA, 75 bp, Artificial Sequence
  Synthetic
acggttgattcgctgctcttgaatggatgcaatagaccagtcgacgtgttgtacgtagacgaggcgtttgcgtgc

SEQ ID NO: 44460 - DNA, 75 bp, Artificial Sequence
  Synthetic
agccagtttgatctaagcgccgatggcgagacactgcctgtcccgtcagacctggatgctgacgccccagcccta

SEQ ID NO: 44461 - DNA, 75 bp, Artificial Sequence
  Synthetic
ccacgattctccgaacccacagggacgtaggagatgttattttgtttttaatatttcaaaaaaaaaaaaaaaaaa

SEQ ID NO: 44462 - DNA, 75 bp, Artificial Sequence
  Synthetic
gctagcgtccgattctttagagcagagcagtgtccggccgtacaagaaacagcggagacgcgtgacacagctatt

SEQ ID NO: 44463 - DNA, 75 bp, Artificial Sequence
  Synthetic
gacagagctggggcaggaataattgaaactccaagaggagctatcaaagtcactgcccaaccaacagaccacgtc

SEQ ID NO: 44464 - DNA, 75 bp, Artificial Sequence
  Synthetic
cacaacagtccggcaacgtaaagatcacagtcaacggccggacggtgcggtataagtgtaattgcggtggctcaa

SEQ ID NO: 44465 - DNA, 75 bp, Artificial Sequence
  Synthetic
atgccgcggtcaccaatcacaaaaaatggcagtataattcccctctggtcccgcgcaatgctgaactcggggacc

SEQ ID NO: 44466 - DNA, 75 bp, Artificial Sequence
  Synthetic
agacggtgcggtacaagtgtaattgcggtggctcaaatgaaggactaacaactacagacaaagtgattaataact

SEQ ID NO: 44467 - DNA, 75 bp, Artificial Sequence
  Synthetic
gtggtcataaacatccacacaccttttcgcatacaccattaccaacagtgcgtagaccacgcaatgaaactgcaa

SEQ ID NO: 44468 - DNA, 75 bp, Artificial Sequence
  Synthetic
gagagttcgtaaacagaaagctacaccacattgcgatgcacggaccagccctgaacaccgacgaagagtcgtatg

SEQ ID NO: 44469 - DNA, 75 bp, Artificial Sequence
  Synthetic
ccacattgcgatgcacggaccagccctgaacaccgacgaagagtcgtatgagctggtgagggcagagaggacaga

SEQ ID NO: 44470 - DNA, 75 bp, Artificial Sequence
  Synthetic
tgctcaaaccgggtggctctctattgatcagagcatatggttacgcagatagaaccagtgaacgagtcatctgcg

SEQ ID NO: 44471 - DNA, 75 bp, Artificial Sequence
  Synthetic
agggagtttgtaaataggaaattacaccatatcgcgttgcacggaccagccctgaacactgacgaggagtcgtac

SEQ ID NO: 44472 - DNA, 75 bp, Artificial Sequence
  Synthetic
atgtatcaccagtaatactgagatgtttttcctatttagcaattttgacaatggcagaaggaattttacaacgca

SEQ ID NO: 44473 - DNA, 75 bp, Artificial Sequence
  Synthetic
taggacaggccacccgagcaggatgtgcaccgtcgtaccgggtaaaacgcatggacatcgcgaagaacgatgaag

SEQ ID NO: 44474 - DNA, 75 bp, Artificial Sequence
  Synthetic
tccacaaacggtacagcccacggccacccgcatgagataattttgtattattatgagctgtaccctactatgact

SEQ ID NO: 44475 - DNA, 75 bp, Artificial Sequence
  Synthetic
aggagagtgcgtccacggccaatagaagcaggtatcaatcacgcaaagtggaaaatatgaaagcaacaatcattc

SEQ ID NO: 44476 - DNA, 75 bp, Artificial Sequence
  Synthetic
ccaaccctcgcgggttaccgggtgacggtgtttgcaaggcagtatataaaaaatggccggagtcctttaaaaaca

SEQ ID NO: 44477 - DNA, 75 bp, Artificial Sequence
  Synthetic
cacggccacccgcatgagataatcttgtactattatgagctgtaccctactatgactgtagtagttgtgtcagtg

SEQ ID NO: 44478 - DNA, 75 bp, Artificial Sequence
  Synthetic
atgtgcggtacgtatccagtaatccacgccgttggaccaaacttctctaattattcggagtctgaaggggaccgg

SEQ ID NO: 44479 - DNA, 75 bp, Artificial Sequence
  Synthetic
gaattggcagctgcctatcgagaagtcgcaaaggaagtaactagactgggagtaaatagtgtagctatacctctc

SEQ ID NO: 44480 - DNA, 75 bp, Artificial Sequence
  Synthetic
tccgcagtggcagcatgtaatgagttcttagctagaaactacccaactgtttcatcataccaaatcaccgatgag

SEQ ID NO: 44481 - DNA, 75 bp, Artificial Sequence
  Synthetic
aggagctacccgaaacaacatgcttatcacgcgccttctatcagaagcgctgtaccttccccattccagaacaca

SEQ ID NO: 44482 - DNA, 75 bp, Artificial Sequence
  Synthetic
ttggcaggcagaaaaggatacagcaccacggaaggcgcactgtactcatatctagaagggacccgttttcaccag

SEQ ID NO: 44483 - DNA, 75 bp, Artificial Sequence
  Synthetic
aacacttggtaggtatgacctagtggtcataaacatccacacaccttttcgcatacaccattaccaacagtgcgt

SEQ ID NO: 44484 - DNA, 75 bp, Artificial Sequence
  Synthetic
aaaacgcatggacatcgcgaagaacgatgaagagtgcgtggtcaacgccgctaaccctcgcgggttaccgggtga

SEQ ID NO: 44485 - DNA, 75 bp, Artificial Sequence
  Synthetic
atactgggaagaatttgctgccagccctatcaggataacaactgagaatctaacaacctatgtcactaaactaaa

SEQ ID NO: 44486 - DNA, 75 bp, Artificial Sequence
  Synthetic
ggggccaaaagcagcagcgttgtttgcaagaacccataatctgctgccgctgcaggatgtaccaatggataggtt

SEQ ID NO: 44487 - DNA, 75 bp, Artificial Sequence
  Synthetic
taaggacgccaaattcattgtggggccaatgtcttcagcctggacacctttcgacaacaaaatcgtggtgtacaa

SEQ ID NO: 44488 - DNA, 75 bp, Artificial Sequence
  Synthetic
ttgagcgaagcacatgtggagaagtccgaatcatgcaaaacagaatttgcatcagcatacagggctcataccgca

SEQ ID NO: 44489 - DNA, 75 bp, Artificial Sequence
  Synthetic
agacaaagtgattaataactgcaaggttgatcaatgtcatgccgcggtcaccaatcacaaaaagtggcagtataa

SEQ ID NO: 44490 - DNA, 75 bp, Artificial Sequence
  Synthetic
tcactttgagaagtaggcatagcataccgaactcttccacgattctccgaacccacagggacgtagagatgttat

SEQ ID NO: 44491 - DNA, 75 bp, Artificial Sequence
  Synthetic
gcagccgaactcactttgagaagtaggcatagcataccgaactcttccacgattctccgaacccacagggacgta

SEQ ID NO: 44492 - DNA, 75 bp, Artificial Sequence
  Synthetic
tgaaatccggtatgttcctaactctgttcgtcaacacattgttaaatatcaccatcgctagccgggtgttggaag

SEQ ID NO: 44493 - DNA, 75 bp, Artificial Sequence
  Synthetic
ctgaacagtaataaaacataaaattaataaggagtaccataattggcaaacggaagagacgtaggtacttaagct

SEQ ID NO: 44494 - DNA, 75 bp, Artificial Sequence
  Synthetic
ggtactgcagagaccggctgcgggtacggtacacgtgccatactctcaggcaccatctggctttaagtattggct

SEQ ID NO: 44495 - DNA, 75 bp, Artificial Sequence
  Synthetic
cctaccagtttcttactgctctactctgcaaagcaagagattaataacccatcatggatcctgtgtacgtggaca

SEQ ID NO: 44496 - DNA, 75 bp, Artificial Sequence
  Synthetic
gatgcagttgtatcccagaaagctccttacttttgtggagggtttatactgcatgatactgtgacaggaacagct

SEQ ID NO: 44497 - DNA, 75 bp, Artificial Sequence
  Synthetic
cagcttgcagagtggcagacccgctaaaaaggctatttaaactgggcaaaccgttagcggcaggtgacgaacaag

SEQ ID NO: 44498 - DNA, 75 bp, Artificial Sequence
  Synthetic
gccgctaccccgaccacatgaagcagcacgacttcttcaagtccgccatgcccgaaggctacgtccaggagcgca

SEQ ID NO: 44499 - DNA, 75 bp, Artificial Sequence
  Synthetic
aagtaatcagatggcaacgaacagggctaatagatgagctggagaaagcggtgtactctaggtacgaagtgcagg

SEQ ID NO: 44500 - DNA, 75 bp, Artificial Sequence
  Synthetic
gatgtcatgggtgcagaagatcacgggaggtgtgggactggttgtcgctgttgcagcactgattctaatcgtggt

SEQ ID NO: 44501 - DNA, 75 bp, Artificial Sequence
  Synthetic
tttgcagaagccgacagcaggtacctaaataccaatcagccataatggagtttatcccaacccaaactttctaca

SEQ ID NO: 44502 - DNA, 75 bp, Artificial Sequence
  Synthetic
tgctagagcgttctcgcatctagctataaaactaatagagcaggaaattgatcccgactcaaccatcctggatat

SEQ ID NO: 44503 - DNA, 75 bp, Artificial Sequence
  Synthetic
ataggaggtaccagcctcgaccttggactccgcgccctactatccaagttatcagacccagaccgcgtccgcaaa

SEQ ID NO: 44504 - DNA, 75 bp, Artificial Sequence
  Synthetic
acgtaatgaacaaccagctgaatgctgcttttgttggccaggccacccgagcagggtgtgcaccgtcgtaccggg

SEQ ID NO: 44505 - DNA, 75 bp, Artificial Sequence
  Synthetic
cgcgcaagaatcggaagaataagaagcaaaagcaaaagcagcaggcgccacgaaacaatatgaatcaaaagaagc

SEQ ID NO: 44506 - DNA, 75 bp, Artificial Sequence
  Synthetic
aaactggccttcaagcggtcgtctaaatacgatcttgaatgtgcacagataccagtgcacatgaagtctgatgcc

SEQ ID NO: 44507 - DNA, 75 bp, Artificial Sequence
  Synthetic
gcagggtgtgcaccgtcgtaccgggttaaacgcatggacatcgcaaagaacgatgaagagtgcgtagtcaacgcc

SEQ ID NO: 44508 - DNA, 75 bp, Artificial Sequence
  Synthetic
cgatgaagagtgcgtagtcaacgccgccaaccctcgtgggctaccaggcgatggcgtctgtaaagcagtatacaa

SEQ ID NO: 44509 - DNA, 75 bp, Artificial Sequence
  Synthetic
gatgccatcatagccgcacactttaagccaggagacactgttttagaaacggacatagcctcctttgataagagc

SEQ ID NO: 44510 - DNA, 75 bp, Artificial Sequence
  Synthetic
ctacaagacccgcgccgaggtgaagttcgagggcgacaccctggtgaaccgcatcgagctgaagggcatcgactt

SEQ ID NO: 44511 - DNA, 75 bp, Artificial Sequence
  Synthetic
caagatgattcacttgcgcttactgctttgatgctgttagaagatttaggggtggatcactccctgttggacttg

SEQ ID NO: 44512 - DNA, 75 bp, Artificial Sequence
  Synthetic
agtaacaaaacataaaattaataaaaatcaaatgaataccataattggcaaacggaagagatgtaggtacttaag

SEQ ID NO: 44513 - DNA, 75 bp, Artificial Sequence
  Synthetic
cttcctaaaagcagccgaactcactttgagaagtaggcatagcataccgaactcttccacgattctccgaaccca

SEQ ID NO: 44514 - DNA, 75 bp, Artificial Sequence
  Synthetic
gttttaggaggagctaatgaaggagcccgtacagccctctcggtggtgacctggaacaaagacatcgtcacgaaa

SEQ ID NO: 44515 - DNA, 75 bp, Artificial Sequence
  Synthetic
cacaagctggagtacaactacaacagccacaacgtctatatcatggccgacaagcagaagaacggcatcaaggtg

SEQ ID NO: 44516 - DNA, 75 bp, Artificial Sequence
  Synthetic
tgtcctaccggaatatgggagaagaaccaaactatcaagaagagtgggtgacgcataagaaggaagtcgtgctaa

SEQ ID NO: 44517 - DNA, 75 bp, Artificial Sequence
  Synthetic
cacagaagctgttggtggggctgaaccagagaatagtggttaacggcagaacgcaacggaatacgaacaccatga

SEQ ID NO: 44518 - DNA, 75 bp, Artificial Sequence
  Synthetic
tgccatagtcccgtagcgctagaacgcatcagaaacgaagcgacagacgggacgttgaaaatccaggtttccttg

SEQ ID NO: 44519 - DNA, 75 bp, Artificial Sequence
  Synthetic
tgtggtcgtccgggttgtcaatcccgttgaggactagaatcaaatggttgttaagcaaggtgccaaaaaccgacc

SEQ ID NO: 44520 - DNA, 75 bp, Artificial Sequence
  Synthetic
caaatcggaataaagacggatgatagccatgattggaccaagctgcgttatatggacaatcacatgccagcagac

SEQ ID NO: 44521 - DNA, 75 bp, Artificial Sequence
  Synthetic
aggacggcagcgtgcagctcgccgaccactaccagcagaacacccccatcggcgacggccccgtgctgctgcccg

SEQ ID NO: 44522 - DNA, 75 bp, Artificial Sequence
  Synthetic
tggaacaatgggacacttcattctggcccgatgtccgaaaggagaaactctgacggtggggttcactgatggtag

SEQ ID NO: 44523 - DNA, 75 bp, Artificial Sequence
  Synthetic
ctccgtctgacctggaagctgatgctccgattccggagccaacaccagacgacagagcggtacttactttgcctc

SEQ ID NO: 44524 - DNA, 75 bp, Artificial Sequence
  Synthetic
cgtggtgctatgcgtgtcgttcagcaggcactaacttgacaattaagtatgaaggtatatgtgtcccctaagaga

SEQ ID NO: 44525 - DNA, 75 bp, Artificial Sequence
  Synthetic
tgcagcacgtacgcgcagagcaccgctgcaactgccgaggagatagaggtacatatgcccccagacaccccagat

SEQ ID NO: 44526 - DNA, 75 bp, Artificial Sequence
  Synthetic
cgtaaaggaaagattcacatcccattcccattggcaaacgtgacttgcagagtgccaaaagcaagaaaccccaca

SEQ ID NO: 44527 - DNA, 75 bp, Artificial Sequence
  Synthetic
cgcacattaatgtcacaacagtccggcaatgtaaagatcacagtcaatagtcagacggtgcggtacaagtgcaat

SEQ ID NO: 44528 - DNA, 75 bp, Artificial Sequence
  Synthetic
atccgccctgcctgcccatacaaaattgcagtcataggagtcttcggagtaccgggatctggcaagtcagctatt

SEQ ID NO: 44529 - DNA, 75 bp, Artificial Sequence
  Synthetic
gagactttccccataacgttcggggattttgatgaaggggagattgaaagcttgtcctctgagttactgaccttt

SEQ ID NO: 44530 - DNA, 75 bp, Artificial Sequence
  Synthetic
gaccagagaagatgctgtaagaaggaagaagctgcaggactggtactggtgggcgacttgactaatccgccctac

SEQ ID NO: 44531 - DNA, 75 bp, Artificial Sequence
  Synthetic
tggcaaatgtgacatgcagggtgcctaaagcaagaaaccccaccgtgacgtacggaaaaaaccaagtcatcatgt

SEQ ID NO: 44532 - DNA, 75 bp, Artificial Sequence
  Synthetic
tgctgtatcctgaccacccaacgctcctgtcctacaggaatatgggagaagaaccaaactatcaagaagagtggg

SEQ ID NO: 44533 - DNA, 75 bp, Artificial Sequence
  Synthetic
actacagacaaagtgattaataactgcaaggttgatcaatgccatgccgcggtcaccaatcacaaaaaatggcag

SEQ ID NO: 44534 - DNA, 75 bp, Artificial Sequence
  Synthetic
gaggccgcggtatacctgtggaacgagcagcagcctttattttggctgcaagcccttattccgctggcagccctg

SEQ ID NO: 44535 - DNA, 75 bp, Artificial Sequence
  Synthetic
aaccctgaatagtaataaaacataaaattaataaggatcaaatgagtaccataattggcaaacggaagagacgta

SEQ ID NO: 44536 - DNA, 75 bp, Artificial Sequence
  Synthetic
tgcagtcaccaaatgacctttgatacattccaaaacaaagccaacgtttgttgggctaagagcttggtccctatc

SEQ ID NO: 44537 - DNA, 75 bp, Artificial Sequence
  Synthetic
ggtgggagtaccgtataagactctagtcaacagaccgggctacagccccatggtactggagatggagcttctgtc

SEQ ID NO: 44538 - DNA, 75 bp, Artificial Sequence
  Synthetic
gctaaaaccgtgcgaccgtgtgctgttctcagtagggtcaacgctctacccggaaagccgcaagctacttaagag

SEQ ID NO: 44539 - DNA, 75 bp, Artificial Sequence
  Synthetic
cttgattacatcacgtgcgagtataaaaccgttatcccgtctccgtacgtgaaatgctgcggtacagcagagtgt

SEQ ID NO: 44540 - DNA, 75 bp, Artificial Sequence
  Synthetic
agacttccagagtctaagcgaaagcgcaacgatggtgtataacgaaagagagttcgtaaacagaaagctacacca

SEQ ID NO: 44541 - DNA, 75 bp, Artificial Sequence
  Synthetic
gcgaccatgccgtcacagtaaaggacgccaagtttgtcgtgggaccaatgtcctccgcctggacaccttttgaca

SEQ ID NO: 44542 - DNA, 75 bp, Artificial Sequence
  Synthetic
attcatagtggggccaatgtcttcagcctggacacctttcgacaataaaatcgtggtgtacaaaggcgacgtcta

SEQ ID NO: 44543 - DNA, 75 bp, Artificial Sequence
  Synthetic
caacatggactacccgcccttcggcgcaggaagaccaggacaatttggcgacatccaaagtcgcacgcctgagag

SEQ ID NO: 44544 - DNA, 75 bp, Artificial Sequence
  Synthetic
ggagatctccagctgccacctaccgacgggcacccgttttaagttcggcgccatgatgaagtctggtatgtttct

SEQ ID NO: 44545 - DNA, 75 bp, Artificial Sequence
  Synthetic
aatagcaacaaacccggtaagagcgatgaactgcgccgtagggaacatgcctatctccatcgacataccggacgc

SEQ ID NO: 44546 - DNA, 75 bp, Artificial Sequence
  Synthetic
tggaaagatcggggacttacaagcagtaatggccgtgccagacaaggagacgccaacattctgcttacacacaga

SEQ ID NO: 44547 - DNA, 75 bp, Artificial Sequence
  Synthetic
ggggtcagagaaagaacactgacctgctgctgtctatgggcatttaagaagcagaaaacacacacggtctacaag

SEQ ID NO: 44548 - DNA, 75 bp, Artificial Sequence
  Synthetic
ccatctttaacggacatgtcgtgtgaggtatcagcctgcacccattcctcagactttgggggcgtagccatcatt

SEQ ID NO: 44549 - DNA, 75 bp, Artificial Sequence
  Synthetic
accgctggcggcgggagatgaacaagacgacgacagaagacgtgcactggctgacgaagtggtcagatggcaacg

SEQ ID NO: 44550 - DNA, 75 bp, Artificial Sequence
  Synthetic
caccagtgggaaccgcaaaaacagtcatgtgcggtacgtatccagtaatccacgccgttggaccaaacttctcta

SEQ ID NO: 44551 - DNA, 75 bp, Artificial Sequence
  Synthetic
cacaccacccccggggtccaagacatttccgctacggcgatgtcatgggtgcagaagatcacgggaggtgtggga

SEQ ID NO: 44552 - DNA, 75 bp, Artificial Sequence
  Synthetic
gtggataaagacgctgcagaacccaccgaaaggaaacttcaaagcaactattaaggagtgggaggtggagcatgc

SEQ ID NO: 44553 - DNA, 75 bp, Artificial Sequence
  Synthetic
gattcacgctttggcggagcaagtgaagacgtgcacgcacagcggacgagcagggaggtatgcggtcgaagcgta

SEQ ID NO: 44554 - DNA, 75 bp, Artificial Sequence
  Synthetic
agtatgaaggtatatgtgtcccctaagagacacactgtacatagctaataatctatagatcaaagggctacacaa

SEQ ID NO: 44555 - DNA, 75 bp, Artificial Sequence
  Synthetic
atctatagatcaaagggctacacaacccctgaatagtaacaaaatacaaaatcactaaaaattataaaaacagaa

SEQ ID NO: 44556 - DNA, 75 bp, Artificial Sequence
  Synthetic
acaaaatataaaaatcaacaaaaatcataaaatagaaaactagaaatagaagtaggtaagaaggtatatgtgtcc

SEQ ID NO: 44557 - DNA, 75 bp, Artificial Sequence
  Synthetic
gaagatgctgtaagaaggaagaagccgcaggactggtactggtgggcgacttgactaatccgccctaccacgaat

SEQ ID NO: 44558 - DNA, 75 bp, Artificial Sequence
  Synthetic
agtaggtaagaaggtatatgtgtcccctaagagacacaccatatatagctaagaatcaatagataagcatagatc

SEQ ID NO: 44559 - DNA, 75 bp, Artificial Sequence
  Synthetic
cctaagagacacaccatatatagctaagaatcaatagataagcatagatcaaagggctgaataacccctgaataa

SEQ ID NO: 44560 - DNA, 75 bp, Artificial Sequence
  Synthetic
gcctgcccatacaaaattgcagtcataggagtcttcggagtaccaggatctggcaagtcagctattatcaagaac

SEQ ID NO: 44561 - DNA, 75 bp, Artificial Sequence
  Synthetic
aaacggccaccacgtgctcctggtcagtggctataaccttgcactgcctactaagagagtcacttgggtagcgcc

SEQ ID NO: 44562 - DNA, 75 bp, Artificial Sequence
  Synthetic
aatgctatttgaccacaacgtgccatcgcgcgtaagtccaagggaatacagaccttcccaggagtctgtacagga

SEQ ID NO: 44563 - DNA, 75 bp, Artificial Sequence
  Synthetic
atggctgcgtgagacacacgtagcctaccagtttcttactgctctactctgcaaagcaagagatcaataacccat

SEQ ID NO: 44564 - DNA, 75 bp, Artificial Sequence
  Synthetic
atgtctcttcaggcaccgccgagtaccgccacggaactgagtcacccgccgatctccttcggtgcaccaagcgag

SEQ ID NO: 44565 - DNA, 75 bp, Artificial Sequence
  Synthetic
tttacaaaagggaagtggaacatcaacaagcagatctgcgtgactaccaggaggatagaagacttcaaccctacc

SEQ ID NO: 44566 - DNA, 75 bp, Artificial Sequence
  Synthetic
cctctccacaggtgtatactcaggagggaaagacaggctgacccagtcactgaaccacctctttacagccatgga

SEQ ID NO: 44567 - DNA, 75 bp, Artificial Sequence
  Synthetic
gtaccgggatctggcaagtcagctattatcaagaacctagttaccaggcaggacctggtgactagcggaaagaaa

SEQ ID NO: 44568 - DNA, 75 bp, Artificial Sequence
  Synthetic
ccgaacaccgcccagtaaaaggggaaagaatggaatggctggttaacaagataaacggccaccatgtgctcctgg

SEQ ID NO: 44569 - DNA, 75 bp, Artificial Sequence
  Synthetic
tttgcaaaaacccataatctgctgccactgcaggaagtgccaatggataggttcacagtagacatgaaaagggat

SEQ ID NO: 44570 - DNA, 75 bp, Artificial Sequence
  Synthetic
agagatgtaggtatttaagcttcctaaaagcagccgaactcactttgagaagtaggcatagcataccgaactctt

SEQ ID NO: 44571 - DNA, 75 bp, Artificial Sequence
  Synthetic
aatgctatttgaccacaacgtgccatcgcgcgtaagtccaagggaatatagatcttcccaggagtctgcacagga

SEQ ID NO: 44572 - DNA, 75 bp, Artificial Sequence
  Synthetic
ttgacaactaggtatgaaggcatacgcgtccctaaagagacacaccgcatatagctaggaatcaatagataagta

SEQ ID NO: 44573 - DNA, 75 bp, Artificial Sequence
  Synthetic
ggtacgcgcttcaagttcggcgccatgatgaaatctggtatgttcctaactctgttcgtcaacacactgctaaat

SEQ ID NO: 44574 - DNA, 75 bp, Artificial Sequence
  Synthetic
acctgattacagctgtaaggtcttcaccggcgtctacccatttatgtggggcggcgcctactgcttctgcgacac

SEQ ID NO: 44575 - DNA, 75 bp, Artificial Sequence
  Synthetic
tagacagggcaggtgggtatatattctcgtcggacaccggtccaggtcatttacaacagaagtcagtacgccagt

SEQ ID NO: 44576 - DNA, 75 bp, Artificial Sequence
  Synthetic
gactcttgtcaacagaccgggttacagccccatggtattggagatggagctacaatcagtcaccttggaaccaac

SEQ ID NO: 44577 - DNA, 75 bp, Artificial Sequence
  Synthetic
tccgcgtcctttaccaaggaaacaacattaccgtagctgcctacgctaacggcgatcatgccgtcacagtaaagg

SEQ ID NO: 44578 - DNA, 75 bp, Artificial Sequence
  Synthetic
agaggcaagctgggcaacttgcccagctgatctcagcagttaataaactgacaatgcgcgcggtaccccaacaga

SEQ ID NO: 44579 - DNA, 75 bp, Artificial Sequence
  Synthetic
agtgcaaaaagtcaaatgctctaaggtaatgctatttgaccataacgtgccatcgcgcgtaagtccaagggaata

SEQ ID NO: 44580 - DNA, 75 bp, Artificial Sequence
  Synthetic
aaacctgaccctggagacctcgtgttaacgtgcttcagagggtgggttaaacaactgcaaattgactatcgtgga

SEQ ID NO: 44581 - DNA, 75 bp, Artificial Sequence
  Synthetic
agccatggactcgacggatgcagacgtggtcatctactgccgcgacaaagaatgggagaagaaaatatctgaggc

SEQ ID NO: 44582 - DNA, 75 bp, Artificial Sequence
  Synthetic
agtagccctgaatgaaatatgcacgcgcatgtatggggtggatctagacagcgggctattctctaaaccgttggt

SEQ ID NO: 44583 - DNA, 75 bp, Artificial Sequence
  Synthetic
aatagtaacaaaacacaaaaatcaataaaaatcataaaaagaaaaatctcataaacaggtatacgtgtcccctaa

SEQ ID NO: 44584 - DNA, 75 bp, Artificial Sequence
  Synthetic
tccccccaaaactgtcccgtgcctttgccgttacgctatgactccagaacgcgtcacccggcttcgcatgaacca

SEQ ID NO: 44585 - DNA, 75 bp, Artificial Sequence
  Synthetic
taaaaatcataaaaagaaaaatctcataaacaggtatacgtgtcccctaagagacacattgtatgtaggtagtaa

SEQ ID NO: 44586 - DNA, 75 bp, Artificial Sequence
  Synthetic
ggtgacctggaataaagacattgtcactaaaatcacccccgagggggccgaagagtggagtcttgccatcccagt

SEQ ID NO: 44587 - DNA, 75 bp, Artificial Sequence
  Synthetic
ttgcaacttggaatagggacggatgatagccatgattggaccaagctgcgttacatggacaaccacataccagca

SEQ ID NO: 44588 - DNA, 75 bp, Artificial Sequence
  Synthetic
gcggcaggtgacgaacaagatgaagatagaagacgagcgctggctgacgaagtgatcagatggcaacgaacaggg

SEQ ID NO: 44589 - DNA, 75 bp, Artificial Sequence
  Synthetic
gctacaaaacccctgaatagtaacaaaacataaaatgtaataaaaattaagtgtgtacccaaaagaggtacagta

SEQ ID NO: 44590 - DNA, 75 bp, Artificial Sequence
  Synthetic
aactatccaactgtctcatcataccaaattaccgacgagtatgatgcatatctagacatggtggacgggtcggag

SEQ ID NO: 44591 - DNA, 75 bp, Artificial Sequence
  Synthetic
gtgtgtacccaaaagaggtacagtaagaatcagtgaataccacaattggcaacgagaagagacgtaggtatttaa

SEQ ID NO: 44592 - DNA, 75 bp, Artificial Sequence
  Synthetic
gaacatggaagtgaagatcatagatgcagttgtatcccagaaagccccttacttttgtggagggtttatactgca

SEQ ID NO: 44593 - DNA, 75 bp, Artificial Sequence
  Synthetic
ccttgcagcacatacgtgcagagcaccgccgcaactgccgatgagatagaggtacacgtgcccccagacacccct

SEQ ID NO: 44594 - DNA, 75 bp, Artificial Sequence
  Synthetic
caagaaacagcggagacgcgtgacacagcaatgtctcttcaggcaccaccgagtaccgccacggaaccgaatcat

SEQ ID NO: 44595 - DNA, 75 bp, Artificial Sequence
  Synthetic
atggctgcgtgagacacacgtagcctaccagtttcttactgctctactctgcttagcaagagacttgagaaccca

SEQ ID NO: 44596 - DNA, 75 bp, Artificial Sequence
  Synthetic
gcattctcgcatctagctataaaactaatagagcaggaaattgatcccgactcaaccatcctggacataggcagc

SEQ ID NO: 44597 - DNA, 75 bp, Artificial Sequence
  Synthetic
cacgaaggtaaggtaacaggttacgcgtgcctggtgggggacaaagtaatgaaaccagcacacgtaaaggggacc

SEQ ID NO: 44598 - DNA, 75 bp, Artificial Sequence
  Synthetic
gaaactccaggagagtgcatccatggccaacagaagcaggtatcagtcgcgcaaagtagaaaacatgaaagcaac

SEQ ID NO: 44599 - DNA, 75 bp, Artificial Sequence
  Synthetic
tgtaccctactatgactgtagtagttgtgtcagtggccacgttcatactcctgtcgatggtgggtatggcagtgg

SEQ ID NO: 44600 - DNA, 75 bp, Artificial Sequence
  Synthetic
aatcatccagagactaaagagaggctgtagactatacttaatgtcagagaccccaaaagtccctacttaccggac

SEQ ID NO: 44601 - DNA, 75 bp, Artificial Sequence
  Synthetic
attaaaggagtccgtgtagcatactggatagggtttgatacaaccccgttcatgtataatgccatggcaggtgca

SEQ ID NO: 44602 - DNA, 75 bp, Artificial Sequence
  Synthetic
ggcgagacactgcctgtcccgtcagacctggatgctgacgccccagccctagaaccggccctagacgacggggcg

SEQ ID NO: 44603 - DNA, 75 bp, Artificial Sequence
  Synthetic
gaaaccttgcggccgtgtctgactgggtaatgagcaccgtacctgtcgcgccgcctagaagaaggagagggagaa

SEQ ID NO: 44604 - DNA, 75 bp, Artificial Sequence
  Synthetic
gatcttcgacaacaaggggcgcgtggtggccatagttttaggaggagctaatgaaggagcccgtacagccctctc

SEQ ID NO: 44605 - DNA, 75 bp, Artificial Sequence
  Synthetic
caactactacttaagaaactccaggagagtgcgtccatggccaatagaagcaggtatcaatcacgcaaagtggaa

SEQ ID NO: 44606 - DNA, 75 bp, Artificial Sequence
  Synthetic
gtagttgtgtcagtggccacgttcatactcctgtcgatggtgggtatggcagcggggatgtgcatgtgtgcacga

SEQ ID NO: 44607 - DNA, 75 bp, Artificial Sequence
  Synthetic
tgattctaatcgtggtgctatgcgtgtcgttcagcaggcactaacttgacgactaagcatgaaggtatatgtgtc

SEQ ID NO: 44608 - DNA, 75 bp, Artificial Sequence
  Synthetic
gtcgttcagcaggcactaacttgacgactaagcatgaaggtatatgtgtcccctaagagacacaccgtatatagc

SEQ ID NO: 44609 - DNA, 75 bp, Artificial Sequence
  Synthetic
cgtagcactagaacgcatcagaaatgaagcgacagacgggacgctgaaaatccaggtctccttgcaaatcggaat

SEQ ID NO: 44610 - DNA, 75 bp, Artificial Sequence
  Synthetic
ggtattggagatggaactactgtcggtcactttggagccaacactatcgcttgattacatcacgtgcgagtacaa

SEQ ID NO: 44611 - DNA, 75 bp, Artificial Sequence
  Synthetic
gaagagatgtaggtacttaagcttcctaaaagcagccgaactcactttgagatgtaggcatagcataccgaactc

SEQ ID NO: 44612 - DNA, 75 bp, Artificial Sequence
  Synthetic
acaggcggctgaacccttggcaacagcgtacctatgtggaattcacagagaattggttaggagattgaacgccgt

SEQ ID NO: 44613 - DNA, 75 bp, Artificial Sequence
  Synthetic
gtaggctacgtgtgacacacgtagcctaccagtttcttactgctctactctgcaaagcaagagattaataaccca

SEQ ID NO: 44614 - DNA, 75 bp, Artificial Sequence
  Synthetic
aactggtactgcagagaccggctgtgggtacggtacacgtgccatactctcaggcaccatctggctttaagtatt

SEQ ID NO: 44615 - DNA, 75 bp, Artificial Sequence
  Synthetic
gctcactgtcccgactgtggagaagggcactcgtgccatagtcccgtagcactagaacgcatcagaaatgaagcg

SEQ ID NO: 44616 - DNA, 75 bp, Artificial Sequence
  Synthetic
cccgaacacggtgggagtaccgtataagactctagtcaacagaccgggctacagccccatggtattggagatgga

SEQ ID NO: 44617 - DNA, 75 bp, Artificial Sequence
  Synthetic
taactttgtacggcggtcctaaataggtacgcactacagctacctattttgcagaagccgacagcaggtacctaa

SEQ ID NO: 44618 - DNA, 75 bp, Artificial Sequence
  Synthetic
tctgtagatcaaagggctatataacccctgaatagtaacaaaatacaaaatcactaaaaattataaaaaaaaaaa

SEQ ID NO: 44619 - DNA, 75 bp, Artificial Sequence
  Synthetic
aggccgggcaacttgcccagctgatctcagcagttaataaactgacaatgcgcgcggtacctcaacagaagccgc

SEQ ID NO: 44620 - DNA, 75 bp, Artificial Sequence
  Synthetic
aaaatcataaaatagaaaaaccataaacagaagtagttcaaagggctataaaaacccctgaatagtaacaaaaca

SEQ ID NO: 44621 - DNA, 75 bp, Artificial Sequence
  Synthetic
aaaatacataaataggtatacgtgtcccctaagagacacattgtatgtaggtgataagtatagatcaaagggccg

SEQ ID NO: 44622 - DNA, 75 bp, Artificial Sequence
  Synthetic
agggtgcctaaagcaaggaaccccaccgtgacgtacgggaaaaaccaagtcatcatgctactgtatcctgaccac

SEQ ID NO: 44623 - DNA, 75 bp, Artificial Sequence
  Synthetic
ctccgtacccatagggacgtaggagatgttattttgtttttaatatttcaaaaaaaaaaaaaaaaaaaaaaaaaa

SEQ ID NO: 44624 - DNA, 75 bp, Artificial Sequence
  Synthetic
atgtgcggtacatacccggtaatccatgcagtaggacctaatttctcaaattactctgagtccgaaggagaccgg

SEQ ID NO: 44625 - DNA, 75 bp, Artificial Sequence
  Synthetic
atgagccccgggtactatcagctgctacaagcatccttaacatgttctccccgacgccagcggcgcagtattaag

SEQ ID NO: 44626 - DNA, 75 bp, Artificial Sequence
  Synthetic
tcttcctatttagcagttttgacaatggcagaaggaattttacaacgcatgttatgaacaatcaactgaacgcag

SEQ ID NO: 44627 - DNA, 75 bp, Artificial Sequence
  Synthetic
ccgacgccagcggcgcagtattaaggaccacttcaatgtctataaagccacaagaccgtacctagctcactgtcc

SEQ ID NO: 44628 - DNA, 75 bp, Artificial Sequence
  Synthetic
gcgtccctaaagagacacaccgcttatagctaggaatcaacagataagtatagatctaagggctgaacaacccct

SEQ ID NO: 44629 - DNA, 75 bp, Artificial Sequence
  Synthetic
gggtaaagcgcatggacatcgcgaagaacgatgaagagtgcgtggtcaacgccgccaaccctcgcgggttaccgg

SEQ ID NO: 44630 - DNA, 75 bp, Artificial Sequence
  Synthetic
gtggcgtactgggtagggttcgacacaaccccgttcatgtacaacgctatggcgggtgcctacccctcatactcg

SEQ ID NO: 44631 - DNA, 75 bp, Artificial Sequence
  Synthetic
tgaaggctaagaacataggattatgttcaacagacctgacggaaggtagacgaggcaaattgtctattatgagag

SEQ ID NO: 44632 - DNA, 75 bp, Artificial Sequence
  Synthetic
ttaagagttggcacctaccatcggtgttccatctaaagggcaagcttagcttcacatgccgctgtgacacagtgg

SEQ ID NO: 44633 - DNA, 75 bp, Artificial Sequence
  Synthetic
cctagttaccaggcaagacctggtgactagcggaaagaaagaaaactgccaagaaatcagcaccgacgtgatgag

SEQ ID NO: 44634 - DNA, 75 bp, Artificial Sequence
  Synthetic
cggtgaggaactgcccgctccgtctgacttggaagctgacgctccgattccggaaccaacaccagacgacagagc

SEQ ID NO: 44635 - DNA, 75 bp, Artificial Sequence
  Synthetic
tgtcatgaacaatcaactgaatgcagcctttgtaggacaggccacccgagcaggatgtgcaccgtcgtaccgggt

SEQ ID NO: 44636 - DNA, 75 bp, Artificial Sequence
  Synthetic
tcctaaaagtagccgaactcactttgagacgtaggcgtagcataccgaactcttccacaattctccgtacccata

SEQ ID NO: 44637 - DNA, 75 bp, Artificial Sequence
  Synthetic
aaaagtatttccaggcggtgtacactgcctgtgactgccattgtgtcgtcgttgcattacgaaggcaaaatgcgc

SEQ ID NO: 44638 - DNA, 75 bp, Artificial Sequence
  Synthetic
tgtgtcagtggcctcgttcatactcctgtcgatggtgggtgtggcagtggggatgtgcatgtgtgcacgacgcag

SEQ ID NO: 44639 - DNA, 75 bp, Artificial Sequence
  Synthetic
tccatcagacggcagtggacatggcagaagtatacaccatgtggccaaagcagacggaggctaatgaacaagttt

SEQ ID NO: 44640 - DNA, 75 bp, Artificial Sequence
  Synthetic
cagacggaggctaatgaacaagtttgcttgtacgcgttgggggaaagtatagaatcaatcaggcaaaagtgccca

SEQ ID NO: 44641 - DNA, 75 bp, Artificial Sequence
  Synthetic
acagacagcgactggtccacgtgttcagacacggacgacgaattatgactagatagggcaggtgggtacatattc

SEQ ID NO: 44642 - DNA, 75 bp, Artificial Sequence
  Synthetic
tacaagcccttattccgctggcagccctgattgtcctatgcaactgtctgagactcttaccatgctgttgtaaaa

SEQ ID NO: 44643 - DNA, 75 bp, Artificial Sequence
  Synthetic
cccgaaaactgtcccgtgcctctgccgttacgccatgacaccagaacgcgttacccgacttcgcatgaaccatgt

SEQ ID NO: 44644 - DNA, 75 bp, Artificial Sequence
  Synthetic
gaatataaatcgcctcaggagaccgcacaagaagtaagttcgaccacgtcactgacgcacagccaattcgacctt

SEQ ID NO: 44645 - DNA, 75 bp, Artificial Sequence
  Synthetic
aaaaaaacagaaaaatacataaataggtatacgtgtcccctaagagacacattgtatgtaggtgataagtataga

SEQ ID NO: 44646 - DNA, 75 bp, Artificial Sequence
  Synthetic
ggcgtagcacaccgaactcttccataattctccgaacccacagggacgtaggagatgttcaaagtgactataaaa

SEQ ID NO: 44647 - DNA, 75 bp, Artificial Sequence
  Synthetic
gccctgaacactgacgaagagtcgtatgagctggtgagggcagagaggacagaacacgagtacgtctacgacgtg

SEQ ID NO: 44648 - DNA, 75 bp, Artificial Sequence
  Synthetic
caccttggaaccaacgctatcgcttgattacatcacgtgcgagtataaaaccgttatcccgtctccgtacgtgaa

SEQ ID NO: 44649 - DNA, 75 bp, Artificial Sequence
  Synthetic
ggcagagctgtgtccagtcgtacaagaaacagcggagacgcgtgacacagctatgtctcttcaggcaccgccgag

SEQ ID NO: 44650 - DNA, 75 bp, Artificial Sequence
  Synthetic
gtacttaagcttcctaaaagcagccgaactcactttgagaagtaggcatagcataccgaactcttccacgattct

SEQ ID NO: 44651 - DNA, 75 bp, Artificial Sequence
  Synthetic
aactgcagtcataggagtcttcggggtaccaggatctggcaagtcagccattatcaagaacctagttaccaggca

SEQ ID NO: 44652 - DNA, 75 bp, Artificial Sequence
  Synthetic
agacgttccccatcacatttggggacttcaacgaaggagaaatcgaaagcttgtcttctgagctactaactttcg

SEQ ID NO: 44653 - DNA, 75 bp, Artificial Sequence
  Synthetic
atggccgtgccagacacggagacgccaacattctgcttacacacagatgtctcatgtagacagagagcagacgtc

SEQ ID NO: 44654 - DNA, 75 bp, Artificial Sequence
  Synthetic
gatcagagcatacggttacgcagatagaaccagtgaacgagtaatctgcgtactgggacgtaagtttagatcgtc

SEQ ID NO: 44655 - DNA, 75 bp, Artificial Sequence
  Synthetic
tgacccgtggataaagacgctgcagaacccaccgaaaggaaacttcaaagcaactattaaggagtgggaggtgga

SEQ ID NO: 44656 - DNA, 75 bp, Artificial Sequence
  Synthetic
agagctggcacctaccatcggtgttccatttaaagggcaagctcagcttcacatgccgctgtgatacagtggttt

SEQ ID NO: 44657 - DNA, 75 bp, Artificial Sequence
  Synthetic
ggacttgatagaggctgctttcggagagatttccagctgtcatctaccgacaggtacgcgcttcaagttcggcgc

SEQ ID NO: 44658 - DNA, 75 bp, Artificial Sequence
  Synthetic
cgcgccctctttaacggacatgtcgtgcgaggtaccagcctgcacccattcctcagactttgggggcgtcgccat

SEQ ID NO: 44659 - DNA, 75 bp, Artificial Sequence
  Synthetic
ggcgacacacacgctgccatccacaaccggaaaccttgcggccgtgtctgactgggtaatgagcaccgtacctgt

SEQ ID NO: 44660 - DNA, 75 bp, Artificial Sequence
  Synthetic
gagacacaccacatatagctaagaatcaatagataagtatagatcaaagggctgaacaatccctgaatagtaaca

SEQ ID NO: 44661 - DNA, 75 bp, Artificial Sequence
  Synthetic
ccctagaaccagcactagacgacggggcgacacacacgctgccatccacaaccggaaaccttgcggccgtgtctg

SEQ ID NO: 44662 - DNA, 75 bp, Artificial Sequence
  Synthetic
tccccggagggacccccccatttcttactgctctactctgcaaagcaagagattaataacccatcatggatcctg

SEQ ID NO: 44663 - DNA, 75 bp, Artificial Sequence
  Synthetic
taacaagataaacggacaccacgtgctcctggttagcggctataaccttgcactgcctactaagagagtcacctg

SEQ ID NO: 44664 - DNA, 75 bp, Artificial Sequence
  Synthetic
ataaaatagaaaaccataaacagaagtagttcaaagggctatgaaacccctgaatagtaacaaaatataaaacta

SEQ ID NO: 44665 - DNA, 75 bp, Artificial Sequence
  Synthetic
gccttaattttaattgtggtgctatgcgtgtcgtttagcaggcactaaaccgatgataaggcacgaaataactaa

SEQ ID NO: 44666 - DNA, 75 bp, Artificial Sequence
  Synthetic
gtaggcgtagcacaccgaactcttccacgattccccgaacccacagggacgtaggagatgttcaaagtgactata

SEQ ID NO: 44667 - DNA, 75 bp, Artificial Sequence
  Synthetic
atggctgcgtgagacacacgtagcctaccagtttcttactgctctactctgcaaagcaagagattaataacccat

SEQ ID NO: 44668 - DNA, 75 bp, Artificial Sequence
  Synthetic
acgcgtgcttggtgggggacaaagtaatgaaaccagcacacgtaaaggggaccatcgataacgcggacctggcca

SEQ ID NO: 44669 - DNA, 75 bp, Artificial Sequence
  Synthetic
actgcccaaccaacagaccacgtcgtgggagagtacctggtactttccccgcagaccgtactacgtagccagaag

SEQ ID NO: 44670 - DNA, 75 bp, Artificial Sequence
  Synthetic
ctcagcctgattcacgctttggcggagcaagtgaagacgtgcacgcacagcggacgagcagggaggtatgcggtc

SEQ ID NO: 44671 - DNA, 75 bp, Artificial Sequence
  Synthetic
agagtggagtcttgccatcccagttatgtgcctgttggcaaataccacgttcccctgctcccagcccccttgcac

SEQ ID NO: 44672 - DNA, 75 bp, Artificial Sequence
  Synthetic
ccggcgcctgtgtactcgcctccgatcaacgtccgattgtccaatcccgagtccgcagtggcagcatgcaatgag

SEQ ID NO: 44673 - DNA, 75 bp, Artificial Sequence
  Synthetic
gaagcgtacgacggccgagtcctagtgccctcaggctacgcaatctcgcctgaagacttccagagtctaagcgaa

SEQ ID NO: 44674 - DNA, 75 bp, Artificial Sequence
  Synthetic
aggggaccgggaattggcggctgcctatcgagaagtcgcaaaggaagtaactagactgggagtaaatagcgtagc

SEQ ID NO: 44675 - DNA, 75 bp, Artificial Sequence
  Synthetic
attactggaacaatgggacacttcatcctggcccgatgtccgaaaggagaaactctgacggtgggattcactgac

SEQ ID NO: 44676 - DNA, 75 bp, Artificial Sequence
  Synthetic
tcgtcgacgcgccctctttaacggacatgtcgtgcgaggtaccagcctgcacccattcctcagactttgggggcg

SEQ ID NO: 44677 - DNA, 75 bp, Artificial Sequence
  Synthetic
catacagatgcggacccaagtggagctgctggatgagcacatctccatagattgcgatgtcattcgcgtgcaccc

SEQ ID NO: 44678 - DNA, 75 bp, Artificial Sequence
  Synthetic
agtaacgtacggaaaaaaccaagtcaccatgctgctgtatcctgaccatccgacactcttgtcttaccgtaacat

SEQ ID NO: 44679 - DNA, 75 bp, Artificial Sequence
  Synthetic
ggctgtaaactgtatttaatggcagagaccccgaaagtcccgacttatcggaccgtatacccggcgcctgtgtac

SEQ ID NO: 44680 - DNA, 75 bp, Artificial Sequence
  Synthetic
cggagcgagccggattgcttgtaaggacttcagcaccgtgcacgatcaccgggaccatgggacactttattctcg

SEQ ID NO: 44681 - DNA, 75 bp, Artificial Sequence
  Synthetic
aatgtgccatcgcgagtaagtccaagggaatacagatcttcccaggaatctgtacaggaagtgagtacggcaacg

SEQ ID NO: 44682 - DNA, 75 bp, Artificial Sequence
  Synthetic
gaaagcttgtcttctgagctactaactttcggagacttcctacccggtgaagtggatgatttgacagatagcgac

SEQ ID NO: 44683 - DNA, 75 bp, Artificial Sequence
  Synthetic
tccaaaacaaagccaacgtttgttgggctaagagcttggtccctatcctcgaaacagcggggataaaactaaatg

SEQ ID NO: 44684 - DNA, 75 bp, Artificial Sequence
  Synthetic
aaccacaatcggaaaccttgcggccgtgtctgactgggtaatgagcaccgtacctgtcgcgccgcctagaagaag

SEQ ID NO: 44685 - DNA, 75 bp, Artificial Sequence
  Synthetic
agattaataacccatcatggattctgtgtacgtggacatagacgctgacagcgcctttttgaaggccctgcaacg

SEQ ID NO: 44686 - DNA, 75 bp, Artificial Sequence
  Synthetic
atagtaacaaaatatgaaaatcaataaaaatcataaaatagaaaaaccataaacagaagtagttcaaagggctat

SEQ ID NO: 44687 - DNA, 75 bp, Artificial Sequence
  Synthetic
ccgccgatctccttcggagcaccaagcgagacgttccccatcacatttggggacttcgacgaaggagaaatcgaa

SEQ ID NO: 44688 - DNA, 75 bp, Artificial Sequence
  Synthetic
gagctggagaaagcggtatactctaggtacgaagtgcagggtatatcagttgtggtaatgtccatggccaccttt

SEQ ID NO: 44689 - DNA, 75 bp, Artificial Sequence
  Synthetic
tgccaaatagcaacaaacccggtaagagcgatgaactgcgccgtagggaacatgcccatctccatcgacataccg

SEQ ID NO: 44690 - DNA, 75 bp, Artificial Sequence
  Synthetic
tacgccagtcagtgctgccggtaaacaccctggaggaagtccacgaggagaagtgttacccacctaagctggatg

SEQ ID NO: 44691 - DNA, 75 bp, Artificial Sequence
  Synthetic
tgggactggttgtcgctgttgcagcactgattctaatcgtggtgctatgcgtgtcgttcagcaggcactaacttg

SEQ ID NO: 44692 - DNA, 75 bp, Artificial Sequence
  Synthetic
ctacttaagagctggcacctaccatcggtgttccatctaaagggcaaactcagcttcacatgccgctgtgataca

SEQ ID NO: 44693 - DNA, 75 bp, Artificial Sequence
  Synthetic
ggaccgggaattggcggctgcctatcgagaaatcgcaaaggaggtaactagactgggagtaaatagtgtagctat

SEQ ID NO: 44694 - DNA, 75 bp, Artificial Sequence
  Synthetic
tcctgtgtacgtggacatagacgctgacagcgcctttttgaaggccctgcaacgtgcgtaccccatgtttgaggt

SEQ ID NO: 44695 - DNA, 75 bp, Artificial Sequence
  Synthetic
ggggacagcggcagaccgatcttcgacaacaagggacgcgtggtggccatagtcttaggaggagctaatgaagga

SEQ ID NO: 44696 - DNA, 75 bp, Artificial Sequence
  Synthetic
atgggcatttaagaagcagaaaacacacacggtctacaagaggcctgatacccagtcaatccagaaggttcaggc

SEQ ID NO: 44697 - DNA, 75 bp, Artificial Sequence
  Synthetic
gggagaagaaaatatctgaggccatacagatgcggacccaagtggagctgctggatgagcacatctccatagact

SEQ ID NO: 44698 - DNA, 75 bp, Artificial Sequence
  Synthetic
ctgccagccctattaggataacaactgagaatctaacaacctatgtcactaaattaaaggggccgaaagcagcag

SEQ ID NO: 44699 - DNA, 75 bp, Artificial Sequence
  Synthetic
ggcctgtggtcgtccgggttgtcaatcccgttgaggaccagaatcaagtggttgttacgcaaggtgccgaaaacc

SEQ ID NO: 44700 - DNA, 75 bp, Artificial Sequence
  Synthetic
tcaacagaagccgcgcaagaatcggaagaataagaagcaaaagcaaaagcagcaggcgccacgaaacaatacgaa

SEQ ID NO: 44701 - DNA, 75 bp, Artificial Sequence
  Synthetic
actgagaatctaacaacctatgtcactaaactaaaggggccaaaagcagcagcgttgtttgcaagaacccataat

SEQ ID NO: 44702 - DNA, 75 bp, Artificial Sequence
  Synthetic
ccagcaggagattaataacccatcatggatcctccggcgtacgtggacatagacgctgacagcgcctttttgaag

SEQ ID NO: 44703 - DNA, 75 bp, Artificial Sequence
  Synthetic
tgataagagccaagatgactcacttgcgcttactgccttaatgctgttagaagatttgggagtggatcactccct

SEQ ID NO: 44704 - DNA, 75 bp, Artificial Sequence
  Synthetic
tgtgcatacactatttgacatgtctgccgaggacttcgatgccattatagccgcacactttaagccaggagacgc

SEQ ID NO: 44705 - DNA, 75 bp, Artificial Sequence
  Synthetic
tctcgcctgaagacttccagagtctaagcgaaagcgcaacgatggtgtacaacgaaagagagttcgtaaacagaa

SEQ ID NO: 44706 - DNA, 75 bp, Artificial Sequence
  Synthetic
gagacacacgtagcctaccagtttcttactgctctactctgcaaagcaagagattaataacccatcatggatcct

SEQ ID NO: 44707 - DNA, 75 bp, Artificial Sequence
  Synthetic
ttactgctctactctgcaaagcaagagattaataacccatcatggatcctgtgtacgtggacatagacgctgaca

SEQ ID NO: 44708 - DNA, 75 bp, Artificial Sequence
  Synthetic
gttaaatatcaccatcgctagccgggtgttggaagatcgtctgacaaaatctgcatgcgcggccttcatcggcga

SEQ ID NO: 44709 - DNA, 75 bp, Artificial Sequence
  Synthetic
tggatatcggcagtgcgccagcaaggaggatgatgtcggacaggaagtaccactgcgtctgcccgatgcgcagtg

SEQ ID NO: 44710 - DNA, 75 bp, Artificial Sequence
  Synthetic
gaaacagcggagacgcgtgatacagctatgtctcttcaggcaccgccgagtaccgctacggaactgagtcatccg

SEQ ID NO: 44711 - DNA, 75 bp, Artificial Sequence
  Synthetic
aacgtccgattgtccaaccccgagtccgcagtggcagcatgtaatgagttcttagctagaaactacccaactgtt

SEQ ID NO: 44712 - DNA, 75 bp, Artificial Sequence
  Synthetic
ccgctaaaaaggttatttaaactgggcaaaccgttagcggcaggtgacgaacaagacgaagacagaagacgggcg

SEQ ID NO: 44713 - DNA, 75 bp, Artificial Sequence
  Synthetic
gagacttcctacccggagaagtggatgatttgacagatagcgactggtccacgtgctcagacacggacgacgagt

SEQ ID NO: 44714 - DNA, 75 bp, Artificial Sequence
  Synthetic
ctcgacaaactgggcagatgagcaggtactgaaggctaagaacataggattatgttcaacagacctgacggaagg

SEQ ID NO: 44715 - DNA, 75 bp, Artificial Sequence
  Synthetic
ctccagatccaacttcgagaagctcagaggacccgtcataactttgtacggcggtcctaaataggtacgcactac

SEQ ID NO: 44716 - DNA, 75 bp, Artificial Sequence
  Synthetic
caaagggctatattaacccctgaatagtaacaaaacacaaaaacaataaaaactacaaaatagaaaatctataaa

SEQ ID NO: 44717 - DNA, 75 bp, Artificial Sequence
  Synthetic
agactatacttaatgtcagagaccccaaaagtccctacttaccggaccacatatccggcgcctgtgtactcgcct

SEQ ID NO: 44718 - DNA, 75 bp, Artificial Sequence
  Synthetic
gagatagaggtacacatgcccccagacaccccagatcgcacattaatgtcacaacagtccggcaatgtaaagatc

SEQ ID NO: 44719 - DNA, 75 bp, Artificial Sequence
  Synthetic
gagacgtaggtatttaagcttcctaaaagcagccgaactcactttgagacgtaggcatagcataccgaactcttc

SEQ ID NO: 44720 - DNA, 75 bp, Artificial Sequence
  Synthetic
aacagaatttgcatcagcatacagggctcataccgcatccgcatcagctaagctccgcgtcctttaccaaggaaa

SEQ ID NO: 44721 - DNA, 75 bp, Artificial Sequence
  Synthetic
ctggtgacccgtggataaagacgctgcagaacccaccgaaaggaaacttcaaagcaactattaaggagtgggagg

SEQ ID NO: 44722 - DNA, 75 bp, Artificial Sequence
  Synthetic
gagctgctggatgagcacatctccatagactgcgatattgttcgcgtgcaccctgacagcagcttggcaggcaga

SEQ ID NO: 44723 - DNA, 75 bp, Artificial Sequence
  Synthetic
gaaagaaagtacccatttacaaaaggaaagtggaacatcaacaagcagatctgcgtgaccaccaggaggatagaa

SEQ ID NO: 44724 - DNA, 75 bp, Artificial Sequence
  Synthetic
ccggagaaaaccctgcgcatgcttgaagacaacgtcatgagccccgggtactatcagctgctacaagcatcctta

SEQ ID NO: 44725 - DNA, 75 bp, Artificial Sequence
  Synthetic
aacgccgtcctcctacccaatgtgcatacactatttgacatgtctgccgaggatttcgatgccatcatagccgca

SEQ ID NO: 44726 - DNA, 75 bp, Artificial Sequence
  Synthetic
aaattaataatgagtaccataattggcaaatggaagagacgtaggtactaagcttcttaaaagcagccgaactca

SEQ ID NO: 44727 - DNA, 75 bp, Artificial Sequence
  Synthetic
aagcaaaatgccaaagactgatttgatcccttacagcggtgacgccaaagaagcccgcgacgctgaaaaagaagc

SEQ ID NO: 44728 - DNA, 75 bp, Artificial Sequence
  Synthetic
gaaggattaaccactacagataaagtgattaataactgcaaggttgatcaatgccatgccgcggtcaccaatcac

SEQ ID NO: 44729 - DNA, 75 bp, Artificial Sequence
  Synthetic
ccgttggtatctgtgtattacgcggataaccattgggataataggccgggaggaaagatgttcggattcaaccct

SEQ ID NO: 44730 - DNA, 75 bp, Artificial Sequence
  Synthetic
ggctgtagactatacttaatgtcagagaccccaaaagtccctacttaccggactacatatccggcgcctgtgtac

SEQ ID NO: 44731 - DNA, 75 bp, Artificial Sequence
  Synthetic
tggtcccgcgcaatgctgaattcggggaccggaaaggaaaagttcacattccatttcctctggcaaatgtgacat

SEQ ID NO: 44732 - DNA, 75 bp, Artificial Sequence
  Synthetic
cggtgtttgcaaggcagtatataaaaaatggccggagtcctttaaaaacagtgcaacaccagtaggaaccgcaaa

SEQ ID NO: 44733 - DNA, 75 bp, Artificial Sequence
  Synthetic
tctagaaagaaagtatccattcacaaaagggaagtggaacatcaacaagcagatctgcgtgactaccaggaggat

SEQ ID NO: 44734 - DNA, 75 bp, Artificial Sequence
  Synthetic
aagaatcagtgaataccacaattggcaacgagaagagacgtaggtatttatgtgcaactgtctgaagctcttgcc

SEQ ID NO: 44735 - DNA, 75 bp, Artificial Sequence
  Synthetic
accctgacagtagcttggcaggcagaaaaggatacagcaccacggaaggcgcactgtattcatatctagaaggga

SEQ ID NO: 44736 - DNA, 75 bp, Artificial Sequence
  Synthetic
aagcatgaaggtaaggtaacaggttacgcgtgcttggtgggggacaaagtaatgaaaccagcacacgtaaagggg

SEQ ID NO: 44737 - DNA, 75 bp, Artificial Sequence
  Synthetic
ctgcccactaagagagtcacctgggtggcgccgctgggcattcggggagctgactacacatacaacctagagtta

SEQ ID NO: 44738 - DNA, 75 bp, Artificial Sequence
  Synthetic
tatcctcgaaacagcggggataaaactaaatgacaggcagtggtcccagataattcaagccttcaaagaagacaa

SEQ ID NO: 44739 - DNA, 75 bp, Artificial Sequence
  Synthetic
catatagctaggaatcaacagataagtatagatctaagggctgaacaacccctgaataacaaaatataaaaatca

SEQ ID NO: 44740 - DNA, 75 bp, Artificial Sequence
  Synthetic
ttctaaaccgttggtgtctgtgtattacgcggataaccactgggataataggcctggagggaaaatgttcggatt

SEQ ID NO: 44741 - DNA, 75 bp, Artificial Sequence
  Synthetic
gcacattgatgtcacaacagtccggcaatgtaaagatcacagtcaatagtcagacggtgcggtacaagtgtaatt

SEQ ID NO: 44742 - DNA, 75 bp, Artificial Sequence
  Synthetic
gacgggacgctgaaaatccaggtctccttgcaaatcggaataaagacggatgatagccacgattggaccaagctg

SEQ ID NO: 44743 - DNA, 75 bp, Artificial Sequence
  Synthetic
ctccgcgtcctttaccaaggaaataatgttactgtatctgcctatgcaaacggcgaccatgccgtcacagttaag

SEQ ID NO: 44744 - DNA, 75 bp, Artificial Sequence
  Synthetic
cagacgcagagagggccgggctatttgtaagaacatcagcaccgtgcacgattactggaacaatgggacacttca

SEQ ID NO: 44745 - DNA, 75 bp, Artificial Sequence
  Synthetic
ctggtccacgtgcccagacacggacgacgagttatgactagacagggcaggtgggtatatattctcgtcggacac

SEQ ID NO: 44746 - DNA, 75 bp, Artificial Sequence
  Synthetic
taccttgcagcacgtacgtgcagagcaccgccgcaactgccgaggagatagaggtacacatgcccccagacaccc

SEQ ID NO: 44747 - DNA, 75 bp, Artificial Sequence
  Synthetic
ccgcgtaatgctgaactcggggaccgaaaaggaaaaattcacatcccgtttccgctggcaaatgtaacatgcagg

SEQ ID NO: 44748 - DNA, 75 bp, Artificial Sequence
  Synthetic
ctctcagttgcaaatctctttttcgacggccctagccagcgccgaattccgcgtacaagtctgttctacacaagt

SEQ ID NO: 44749 - DNA, 75 bp, Artificial Sequence
  Synthetic
cgtcgacgcgccatctttaacggacatgtcgtgtgaggtatcagcctgcacccattcctcagactttgggggcgt

SEQ ID NO: 44750 - DNA, 75 bp, Artificial Sequence
  Synthetic
acactgtgcagccgagtgccatccaccgaaagaccatatagtcaattacccggcgtcacacaccaccctcggggt

SEQ ID NO: 44751 - DNA, 75 bp, Artificial Sequence
  Synthetic
aagaaaggcaagtgtgcagtgcactcgatgactaacgccgtcactattcgggaagctgaaatagaagtagaaggg

SEQ ID NO: 44752 - DNA, 75 bp, Artificial Sequence
  Synthetic
agttcaaagggctataaaacccctgaatagtaacaaaacataaaactaataaaaatcaaatgaataccataattg

SEQ ID NO: 44753 - DNA, 75 bp, Artificial Sequence
  Synthetic
attaagaacctggttaccaggcaagacctcgtgaccagtggaaagaaagaaaattgccaagaaatctccactgat

SEQ ID NO: 44754 - DNA, 75 bp, Artificial Sequence
  Synthetic
tcaagaatactggaaggaatttgccgccagtcctattaggataacgactgagaacttgacaacttatgtcacaaa

SEQ ID NO: 44755 - DNA, 75 bp, Artificial Sequence
  Synthetic
actaaaaggaccaaaagcagcagcattgtttgccaagacacataacctgctaccactgcaggaggtgccgatgga

SEQ ID NO: 44756 - DNA, 75 bp, Artificial Sequence
  Synthetic
tcagcttcacatgccgctgtgatacagtggtttcgtgtgagggctacgtcgttaagagaataacgatgagcccag

SEQ ID NO: 44757 - DNA, 75 bp, Artificial Sequence
  Synthetic
aactgacaccaggagctaccgtccctttcctgcttagcctaatatgctgcatcagaacagctaaagcggccacat

SEQ ID NO: 44758 - DNA, 75 bp, Artificial Sequence
  Synthetic
accataattggcaaacggaagagacgtaggtacttaagcttcctaaaagcagccgaactcactttgagatgtagg

SEQ ID NO: 44759 - DNA, 75 bp, Artificial Sequence
  Synthetic
tttcctgcttagcctaatatgctgcatcagaacagctaaagcggccacataccaagaggctgcggtatacctgtg

SEQ ID NO: 44760 - DNA, 75 bp, Artificial Sequence
  Synthetic
aatggataggttcacagtagacatgaaaagggatgtgaaggtaactcctggtacaaagcacacagaggaaagacc

SEQ ID NO: 44761 - DNA, 75 bp, Artificial Sequence
  Synthetic
gcagcactgatcctaatcgtggtgctatgcgtgtcgtttagcaggcactaacttgacaactaggtatgaaggcat

SEQ ID NO: 44762 - DNA, 75 bp, Artificial Sequence
  Synthetic
ataaaaatcataaaatagaaaaccagaaacagaagtaggtaagaaggtatatgtgtcccctaagagacacaccat

SEQ ID NO: 44763 - DNA, 75 bp, Artificial Sequence
  Synthetic
caataaaaatcataaaatagaaaaccataaacagaagtagttcaaagggctataaaacccctgaatagtaacaaa

SEQ ID NO: 44764 - DNA, 75 bp, Artificial Sequence
  Synthetic
acgttggcttttttagccgtaatgagcatcggtgcccacactgtgagcgcgtacgaacacgtaacagtgatcccg

SEQ ID NO: 44765 - DNA, 75 bp, Artificial Sequence
  Synthetic
agcatagatcaaagggctgaataacccctgaataataacaaaatataaaaaccaataaaaatcataaaatagaaa

SEQ ID NO: 44766 - DNA, 75 bp, Artificial Sequence
  Synthetic
ctgtcagtcactttggagccaacgctatcgcttgattacatcacgtgcgagtacaaaaccgtcatcccgtctccg

SEQ ID NO: 44767 - DNA, 75 bp, Artificial Sequence
  Synthetic
tatcgcttgattacatcacgtgcgagtacaaaaccgtcatcccgtctccgtacgtgaaatgctgcggtacagcag

SEQ ID NO: 44768 - DNA, 75 bp, Artificial Sequence
  Synthetic
ggagaagtggatgacttgacagacagcgactggtccacgtgctcagacacggacgacgagttatgactagacagg

SEQ ID NO: 44769 - DNA, 75 bp, Artificial Sequence
  Synthetic
agcagccgaactcgctttgatgtaggcatagcacaccgaactcttccacgattctccgaacccacagggacgtag

SEQ ID NO: 44770 - DNA, 75 bp, Artificial Sequence
  Synthetic
gaaaagaaaattaataaacccatcatggatcctgtgtacgtggacatagacgctgacagcgcctttttgaaggcc

SEQ ID NO: 44771 - DNA, 75 bp, Artificial Sequence
  Synthetic
accctgaacagtaataaaatataaaattaataatgagtaccataattggcaaatggaagagatgtaggtactaag

SEQ ID NO: 44772 - DNA, 75 bp, Artificial Sequence
  Synthetic
ctcgctaattatgcgagaaagctagcatctgccgcaggaaaagtcctggacagaaacatctctggaaagatcggg

SEQ ID NO: 44773 - DNA, 75 bp, Artificial Sequence
  Synthetic
ctctggaggaaaagacaggctgactcagtcattaaaccacctatttacagcattagattcaactgatgctgatgt

SEQ ID NO: 44774 - DNA, 75 bp, Artificial Sequence
  Synthetic
tcaaagttactgcccaaccaacagaccacgtcgtgggagagtacctggtactctccccgcagaccgtactacgta

SEQ ID NO: 44775 - DNA, 75 bp, Artificial Sequence
  Synthetic
gcaaagcaagagattaataacccatcatggatcctgtgtacgtggacatagacgctgacagcgcctttttgaagg

SEQ ID NO: 44776 - DNA, 75 bp, Artificial Sequence
  Synthetic
gagcggtgaattgcgccgtagggaacatgcccatctccatcgacataccggatgcggccttcactagggtcgtcg

SEQ ID NO: 44777 - DNA, 75 bp, Artificial Sequence
  Synthetic
caagactaccgacacggttgacggcgaaagagtgtcattctcggtgtgcacgtacgtgccggcgaccatttgtga

SEQ ID NO: 44778 - DNA, 75 bp, Artificial Sequence
  Synthetic
ataaaatagaaaactagaaatagaagtaggtaagaaggtatatgtgtcccctaagagacacaccatatatagcta

SEQ ID NO: 44779 - DNA, 75 bp, Artificial Sequence
  Synthetic
gaaaccggctcaaaagaaaaagaagccgggccgtagagagagaatgtgcatgaaaatcgaaaatgattgcatctt

SEQ ID NO: 44780 - DNA, 75 bp, Artificial Sequence
  Synthetic
aaggaccacatagtcaactacccggcgtcacataccaccctcggggtccaggacatttccgctacggcgatgtca

SEQ ID NO: 44781 - DNA, 75 bp, Artificial Sequence
  Synthetic
cgtcacataccaccctcggggtccaggacatttccgctacggcgatgtcatgggtgcagaagatcacgggaggtg

SEQ ID NO: 44782 - DNA, 75 bp, Artificial Sequence
  Synthetic
taataaaaatcaaatgaataccataattggcaatcggaagagatgtaggtacttaagcttcctaaaagcagccga

SEQ ID NO: 44783 - DNA, 75 bp, Artificial Sequence
  Synthetic
actcgctgctcttgaatggatgcaacagaccagtcgacgtgttgtacgtagacgaggcgtttgcgtgccactctg

SEQ ID NO: 44784 - DNA, 75 bp, Artificial Sequence
  Synthetic
tcccatacagcggaaatgcccaagaagcccaggatgcagaaaaagaagcagaggaagaacgagaagcagaactga

SEQ ID NO: 44785 - DNA, 75 bp, Artificial Sequence
  Synthetic
ggctacgtcgttaagagaataacgatgagcccaggcctttatggaaaaaccacagggtatgcggtaacccaccac

SEQ ID NO: 44786 - DNA, 75 bp, Artificial Sequence
  Synthetic
ccgtcaaaactcaggagctacccgaaacagcacgcttaccacgcgccctccatcagaagcgctgtaccgtcccca

SEQ ID NO: 44787 - DNA, 75 bp, Artificial Sequence
  Synthetic
ccctttctgctcagcctgctatgctgcgtcagaacgaccaaggcggccacatattacgaggctgcggcatatcta

SEQ ID NO: 44788 - DNA, 75 bp, Artificial Sequence
  Synthetic
ttcgccccgcttgtccatacaaaattgcagtcataggagtcttcggggtaccaggatctggtaagtcagccatta

SEQ ID NO: 44789 - DNA, 75 bp, Artificial Sequence
  Synthetic
agtagttcaaagggctataaaacccctgaatagtaacaaaacataaaactaataaaaattaaatgaataccataa

SEQ ID NO: 44790 - DNA, 75 bp, Artificial Sequence
  Synthetic
ttggcaaacggaagagatgtaggtacttaagcttcctaaaagcagccgaactcactttgagatgtaggcatagca

SEQ ID NO: 44791 - DNA, 75 bp, Artificial Sequence
  Synthetic
caggtttccttgcaaatcggaataaagacggatgatagccatgattggaccaagctgcgttacatggacaatcac

SEQ ID NO: 44792 - DNA, 75 bp, Artificial Sequence
  Synthetic
aggaagatgttcaggtcgaaatcgacgtggaacagcttgaggacagagcgggcgcaggaataatagagactccga

SEQ ID NO: 44793 - DNA, 75 bp, Artificial Sequence
  Synthetic
tcatgtacgcacccatttcaccacgaccctcctgtgataggccgggaaaaattccattcccgaccgcagcacggt

SEQ ID NO: 44794 - DNA, 75 bp, Artificial Sequence
  Synthetic
atcataacatctgcacccaagtgtaccacaaaagtatctccaggcggtgtacactgcctgtgactgccattgtgt

SEQ ID NO: 44795 - DNA, 75 bp, Artificial Sequence
  Synthetic
aagcttcctaaaagcagccgaactcactttgagacgtaggcatagcataccgaactcttccactattctccgaac

SEQ ID NO: 44796 - DNA, 75 bp, Artificial Sequence
  Synthetic
cgctggctgacgaagtgatcagatggcaacgaacagggctaattgatgagctggagaaagcggtatactctaggt

SEQ ID NO: 44797 - DNA, 75 bp, Artificial Sequence
  Synthetic
aacagttatgtgcggtacatatccagtaatccacgccgtaggaccaaacttctcaaattactcggagtccgaagg

SEQ ID NO: 44798 - DNA, 75 bp, Artificial Sequence
  Synthetic
aacatcagagcacgtcaacgtactcctaacgcgtacggaaggtaaactggtatggaagacactctctggtgaccc

SEQ ID NO: 44799 - DNA, 75 bp, Artificial Sequence
  Synthetic
acccccgagggggccgaagagtggagtcttgccattccagttatgtgcctgttggcaaacaccacgttcccctgc

SEQ ID NO: 44800 - DNA, 75 bp, Artificial Sequence
  Synthetic
acagctacctattttgcagaagccgacagcaagtatctaaacactaatcagctacaatggagttcatcccaaccc

SEQ ID NO: 44801 - DNA, 75 bp, Artificial Sequence
  Synthetic
gatcgccttggtgagaccaaggcagaaagttgtactttgtggtgacccgaagcagtgcggcttcttcaatatgat

SEQ ID NO: 44802 - DNA, 75 bp, Artificial Sequence
  Synthetic
tacatagcaaataatctatagatcaaagggctacgcaacccctgaatagtaacaaaatacaaaatcactaaaaat

SEQ ID NO: 44803 - DNA, 75 bp, Artificial Sequence
  Synthetic
gaaaacccgctctatgcatcaacgtcagagcacgtcaacgtactcctaacgcgtacggaaggtaaactggtatgg

SEQ ID NO: 44804 - DNA, 75 bp, Artificial Sequence
  Synthetic
caagtaccaccgtggaactgagccatccaccgatctccttcggagcaccaagcgagacgttccccatcacatttg

SEQ ID NO: 44805 - DNA, 75 bp, Artificial Sequence
  Synthetic
ccattctagaaagaaagtacccattcacaaaagggaagtggaacatcaacaagcagatctgcgtgactaccagga

SEQ ID NO: 44806 - DNA, 75 bp, Artificial Sequence
  Synthetic
gtggtggccatagtcttaggaggagctaatgaaggagcccgtacagccctctcggtggtgacctggaataaagac

SEQ ID NO: 44807 - DNA, 75 bp, Artificial Sequence
  Synthetic
ccccctcatcctctcccctctatttaaacaactgctccactactacatccttatctctcacaccccccctctatt

SEQ ID NO: 44808 - DNA, 75 bp, Artificial Sequence
  Synthetic
tattgatcagagcatacggttacgcagatagaaccagtgaacgagtcatctgcgtactgggacgcaagtttagat

SEQ ID NO: 44809 - DNA, 75 bp, Artificial Sequence
  Synthetic
aaacaactgctccactactacatccttatctctcacaccccccctctattccgctaagcgatgtctctacccatc

SEQ ID NO: 44810 - DNA, 75 bp, Artificial Sequence
  Synthetic
tctcaccaatatacatcaacccctccatcactctcctcactttctattccctacccaccttacatccatccccct

SEQ ID NO: 44811 - DNA, 75 bp, Artificial Sequence
  Synthetic
catcactctcctcactttctattccctacccaccttacatccatccccctcacactgctcttatccttccaaacc

SEQ ID NO: 44812 - DNA, 75 bp, Artificial Sequence
  Synthetic
tacctcattaataccccccttaccatattcctctcatcaacatccctcctccacatttcccttcttctatcttct

SEQ ID NO: 44813 - DNA, 75 bp, Artificial Sequence
  Synthetic
tattcctctcatcaacatccctcctccacatttcccttcttctatcttcttatcccttatccttacccacattct

SEQ ID NO: 44814 - DNA, 75 bp, Artificial Sequence
  Synthetic
gggcgtcgctgcagcacacagcaccatttggctgtcaaatagcaacaaacccggtaagagcgatgaactgcgccg

SEQ ID NO: 44815 - DNA, 75 bp, Artificial Sequence
  Synthetic
catctatctttcatcatcacatcttatctatctctcttattcttcttccattattctcctcttttcttttctttt

SEQ ID NO: 44816 - DNA, 75 bp, Artificial Sequence
  Synthetic
atctatctctcttattcttcttccattattctcctcttttcttttcttttctattatctctttcattgttattca

SEQ ID NO: 44817 - DNA, 75 bp, Artificial Sequence
  Synthetic
aagagagtcacttgggtagcgccgttaggtgtccgcggagcggactacacatacaacctagagttgggtctgcca

SEQ ID NO: 44818 - DNA, 75 bp, Artificial Sequence
  Synthetic
taggtgtccgcggagcggactacacatacaacctagagttgggtctgccagcaacgcttggtaggtatgaccttg

SEQ ID NO: 44819 - DNA, 75 bp, Artificial Sequence
  Synthetic
ttttttcccttttctctttccccttctcattcccatacctatttgctttcaccttttattctctgccccaaccac

SEQ ID NO: 44820 - DNA, 75 bp, Artificial Sequence
  Synthetic
ctcattcccatacctatttgctttcaccttttattctctgccccaaccaccctccctaccctctctgcttccagt

SEQ ID NO: 44821 - DNA, 75 bp, Artificial Sequence
  Synthetic
ctttctcctcaccccctctccaaacttcaattcctaacccctttctaacattctaccttccctctacttcctctt

SEQ ID NO: 44822 - DNA, 75 bp, Artificial Sequence
  Synthetic
ttcaattcctaacccctttctaacattctaccttccctctacttcctcttctctatacccctactaaccattccc

SEQ ID NO: 44823 - DNA, 75 bp, Artificial Sequence
  Synthetic
caatctcacactcttaacctcccccatcttccatctacagtctacatccactattccacaactcccctgatcctc

SEQ ID NO: 44824 - DNA, 75 bp, Artificial Sequence
  Synthetic
attccattcccgaccgcagcacggtaaagagctaccttgcagcacgtacgtgcagagcaccgccgcaactaccga

SEQ ID NO: 44825 - DNA, 75 bp, Artificial Sequence
  Synthetic
ctattccacaactcccctgatcctcaatcctctctgtacaatatatcaagcacctgacatagcttctctattttt

SEQ ID NO: 44826 - DNA, 75 bp, Artificial Sequence
  Synthetic
ctattccacaactcccctgatcctcaatcctctctgtactatatatcaagcacctgacatagcttctctattttt

SEQ ID NO: 44827 - DNA, 75 bp, Artificial Sequence
  Synthetic
ctattccacaactcccctgatcctcaatcctctctgtaccatatatcaagcacctgacatagcttctctattttt

SEQ ID NO: 44828 - DNA, 75 bp, Artificial Sequence
  Synthetic
ctattccacaactcccctgatcctcaatcctctctgtacgatatatcaagcacctgacatagcttctctattttt

SEQ ID NO: 44829 - DNA, 75 bp, Artificial Sequence
  Synthetic
cacaacagtccggcaacgtaaagatcacagtcaatggccagacggtgcggtacaagtgtaattgcggtggctcaa

SEQ ID NO: 44830 - DNA, 75 bp, Artificial Sequence
  Synthetic
aatagtaacaaaacacaaaaatcaataaaaatcataaaaagaaaatctcataaacaggtataagtgtcccctaag

SEQ ID NO: 44831 - DNA, 75 bp, Artificial Sequence
  Synthetic
gcaaggcagtatacaaaaaatggccggagtcctttaagaacagtgcaacaccagtgggaaccgcaaaaacagtta

SEQ ID NO: 44832 - DNA, 75 bp, Artificial Sequence
  Synthetic
actagacagggcaggtgggtatatattctcgtcggacactggtccaggccatttacaacagaagtcggtacgcca

SEQ ID NO: 44833 - DNA, 75 bp, Artificial Sequence
  Synthetic
aaaaccataaacagaagtagttcaaagggctataaaacccctgaatagtaacaaaacataaaactaataaaaatt

SEQ ID NO: 44834 - DNA, 75 bp, Artificial Sequence
  Synthetic
cctgcaacgtgcgtaccccatgtttgaggtggaaccaaggcaggtcacaccgaatgaccatgctaatgctagagc

SEQ ID NO: 44835 - DNA, 75 bp, Artificial Sequence
  Synthetic
aaatgaataccataattggcaatcggaagagatgtaggtacttaagcttcctaaaagcagccgaactcgctttga

SEQ ID NO: 44836 - DNA, 75 bp, Artificial Sequence
  Synthetic
gagaaacctgactgtgatatgtgacgagagagaagggaatataacacccatggctagcgtccgattctttagagc

SEQ ID NO: 44837 - DNA, 75 bp, Artificial Sequence
  Synthetic
aagtcgcacacctgagagtaaagacgtctatgctaatacacaactggtactgcagagaccggctgcgggtacggt

SEQ ID NO: 44838 - DNA, 75 bp, Artificial Sequence
  Synthetic
tctactctgcaaagcaagagattaataacccatcatggattctgtgtacgtggacatagacgctgacagcgcctt

SEQ ID NO: 44839 - DNA, 75 bp, Artificial Sequence
  Synthetic
tcccatacagcggggacgcccaagaagcccgggacgcagaaaaagaagcagaggaagaacgagaagcagaactga

SEQ ID NO: 44840 - DNA, 75 bp, Artificial Sequence
  Synthetic
acagggtatgcggtaacccaccacgcagacggattcctgatgtgcaagactaccgacacggttgacggcgaaaga

SEQ ID NO: 44841 - DNA, 75 bp, Artificial Sequence
  Synthetic
tgtgtccggtcgtacaagaaacagcggagacgcgtgacacagcaatgtctcttcaggcaccaccgagtaccgcca

SEQ ID NO: 44842 - DNA, 75 bp, Artificial Sequence
  Synthetic
gtgctgccggtgaacaccctggaggaagtccacgaggagaagtgttacccacctaagctggatgaagcaaaggag

SEQ ID NO: 44843 - DNA, 75 bp, Artificial Sequence
  Synthetic
acctaagctggatgaagcaaaggagcaactattacttaagaaactccaggagagtgcatccatggccaacagaag

SEQ ID NO: 44844 - DNA, 75 bp, Artificial Sequence
  Synthetic
ttgcaaaaacccataatctgctgccactgcaggatgtaccaatggataggttcacagtagatatgaaaagggatg

SEQ ID NO: 44845 - DNA, 75 bp, Artificial Sequence
  Synthetic
agtattcaacgtggagtgtttcaaaaaattcgcatgcaaccaagaatactgggaagaatttgctgccagccctat

SEQ ID NO: 44846 - DNA, 75 bp, Artificial Sequence
  Synthetic
ttgcagcactgattctaatcgtggtgctatgcgtgtcgttcagcaggcactaacttgacgactaagcatgaaggt

SEQ ID NO: 44847 - DNA, 75 bp, Artificial Sequence
  Synthetic
gtcgctgcagcacacagcaccatttggctgccaaatagcaacaaacccggtaagagcggtgaactgcgccgtagg

SEQ ID NO: 44848 - DNA, 75 bp, Artificial Sequence
  Synthetic
gaaagacctaaggtgcaggttatacaggcggctgaacccttggcgacagcatacctatgtgggattcacagagag

SEQ ID NO: 44849 - DNA, 75 bp, Artificial Sequence
  Synthetic
taccagtttcttactgctctactctgcaaagcaagagattaataacccatcatggattctgtgtacgtggacata

SEQ ID NO: 44850 - DNA, 75 bp, Artificial Sequence
  Synthetic
gcgtactgggtagggttcgacacaaccccgttcatgtacaatgccatggcgggtgcctacccctcatactcgaca

SEQ ID NO: 44851 - DNA, 75 bp, Artificial Sequence
  Synthetic
accctaaacagaagtagttcaaagggctataaaacccctgaatagtaacaaaatataaaactaacaaaaatcaaa

SEQ ID NO: 44852 - DNA, 75 bp, Artificial Sequence
  Synthetic
caagtctgttctacacaagtacagtgtgaagctgactgtcaccccccgaaggaccacatagtcaactaccgggcg

SEQ ID NO: 44853 - DNA, 75 bp, Artificial Sequence
  Synthetic
gacagagagcagacgtcgcgatataccaagacgtctatgctgtacacgcacccacgtcgctataccaccaggcga

SEQ ID NO: 44854 - DNA, 75 bp, Artificial Sequence
  Synthetic
agagctggcacttaccatcggtgttccatctaaagggcaaactcagcttcacatgccgctgtgatacagtggttt

SEQ ID NO: 44855 - DNA, 75 bp, Artificial Sequence
  Synthetic
tgccctcaggctatgcaatctcgcctgaagacttccagagtctaagcgaaagcgcaacgatggtgtacaacgaaa

SEQ ID NO: 44856 - DNA, 75 bp, Artificial Sequence
  Synthetic
caaaatatgaaaaattaaaaaaaaaaaaaaaaaaaaaaaaaaaaaaaaaaaaaaaaaaaaaaaaaaaaaaaaaaa

SEQ ID NO: 44857 - DNA, 75 bp, Artificial Sequence
  Synthetic
atcggaataaagacggatgacagccacgattggaccaagctgcgttatatggacaatcacatgccagcagacgca

SEQ ID NO: 44858 - DNA, 75 bp, Artificial Sequence
  Synthetic
cctggtgactagcggaaagaaagaaaactgccaagaaatcagcaccgacgtgatgagacagagaggtctagagat

SEQ ID NO: 44859 - DNA, 75 bp, Artificial Sequence
  Synthetic
tgtagtaccgggcctgtggtcgtccgggttgtcaatcccgttgaggactagaatcaagtggttgttacgcaaggt

SEQ ID NO: 44860 - DNA, 75 bp, Artificial Sequence
  Synthetic
cctaaaaagaaaccggctcaaaagaaaaagaagccgggccgcagagagaggatgtgcatgaaaatcgaaaatgat

SEQ ID NO: 44861 - DNA, 75 bp, Artificial Sequence
  Synthetic
tcgacgtgttgtacgtagacgaggcgtttgcgtgccactctggaacgttacttgctttgatcgccttggtgagac

SEQ ID NO: 44862 - DNA, 75 bp, Artificial Sequence
  Synthetic
gatccacgctttagcggagcaagtgaagacgtgtacgcacagcggacgagcagggaggtatgcggtcgaagcgta

SEQ ID NO: 44863 - DNA, 75 bp, Artificial Sequence
  Synthetic
atggcgtctgacaacgcggaggaatcccaaattcctgagcttccaaaaactgctgtagggttagcacatttatta

SEQ ID NO: 44864 - DNA, 75 bp, Artificial Sequence
  Synthetic
gacattcctttagacgacctgctgctgccttgcacattttgcggcaggtttttatcgttttctgaggtctgtgag

SEQ ID NO: 44865 - DNA, 75 bp, Artificial Sequence
  Synthetic
tttgatgataagaaactgtctttaatttggcacaattatactgtgtccgcgtgttgtcgctgctgctgtgtggca

SEQ ID NO: 44866 - DNA, 75 bp, Artificial Sequence
  Synthetic
acagcaacttatgaattcaatgagttttatgagcaaacagtaaacggacgagagatagagcaggtgacaggactc

SEQ ID NO: 44867 - DNA, 75 bp, Artificial Sequence
  Synthetic
agcatcctgcatctggatgttagatgtcaaaactgtttgaggttcctagataacatagaaaagctagatatatgt

SEQ ID NO: 44868 - DNA, 75 bp, Artificial Sequence
  Synthetic
ggtaggaaccgtccgttccacaaagtaagaaactggtggaagggcatctgcaggcactgtaagtatttattatga

SEQ ID NO: 44869 - DNA, 75 bp, Artificial Sequence
  Synthetic
ttggtaaggacgcggacttgcaagacattattttagagttgagtgagattcagcctgaagggcagccagttgacc

SEQ ID NO: 44870 - DNA, 75 bp, Artificial Sequence
  Synthetic
tgctttgtgaagaggagttaccagctgagcaggagttggaggaggagccaactactgcaaggaccacatttaaag

SEQ ID NO: 44871 - DNA, 75 bp, Artificial Sequence
  Synthetic
ttgtcgctccgtgtggatgctgtgaagcaaacctacgtctgtttgttcgggcaacaacatttggaattagaacct

SEQ ID NO: 44872 - DNA, 75 bp, Artificial Sequence
  Synthetic
tgcaggacatactgacggaggagctgcagctgttgtgcccggagtgtcgcggaaactgcaagcatggcggatcct

SEQ ID NO: 44873 - DNA, 75 bp, Artificial Sequence
  Synthetic
aaaggtagtacctctaaagaagggtgtgatgattggtgtgtcgtggaagcagaatgtagtgatatagagcatgat

SEQ ID NO: 44874 - DNA, 75 bp, Artificial Sequence
  Synthetic
ttggaacaattgtttgatcaagaaacagactcagatatatcgggattgctagatgatgggaacgtggagcaggga

SEQ ID NO: 44875 - DNA, 75 bp, Artificial Sequence
  Synthetic
aatacacgagaactatatcaccaacaggagtgtgaggacagcgaggaacaattacaaaacctaaaacgaaagtat

SEQ ID NO: 44876 - DNA, 75 bp, Artificial Sequence
  Synthetic
cttagtcccaaagctgttgcacagctcagtccgcggctagagtgcatttcgctatcaccgcaacagaaatccaaa

SEQ ID NO: 44877 - DNA, 75 bp, Artificial Sequence
  Synthetic
cgcaggctgtttgcagagcgggacagcggtctggagagtactatttcaaatgaagctgaagatatttcttctgag

SEQ ID NO: 44878 - DNA, 75 bp, Artificial Sequence
  Synthetic
gtggaggtaccggcgttagacaatcggccggagacaggggaggaggcagggaacagattggatattacagacttg

SEQ ID NO: 44879 - DNA, 75 bp, Artificial Sequence
  Synthetic
ttgcggtccaacaacataaaagccacattattgggcaaatttaaggacgcgtttggggtagcttttggtgattta

SEQ ID NO: 44880 - DNA, 75 bp, Artificial Sequence
  Synthetic
acgcggcactttaaaagccaccaaacctgctgtaacaattgggtggtttctgtttatggcgtgcacgatgaacta

SEQ ID NO: 44881 - DNA, 75 bp, Artificial Sequence
  Synthetic
tatgaaagctccaagcaattattgcaacagcattgcgattatgtatgggtttatgcactgggacctatgtcatta

SEQ ID NO: 44882 - DNA, 75 bp, Artificial Sequence
  Synthetic
tacctattgtgttttaaggcgggcaaaaatcgcaagactgtgcataaattgatgacatgcatgctaaatgtgcaa

SEQ ID NO: 44883 - DNA, 75 bp, Artificial Sequence
  Synthetic
gaccagcaaatattatctgagccaccaaaaataagaaatactgccgctgcattgttttggtacaaaggatgtatg

SEQ ID NO: 44884 - DNA, 75 bp, Artificial Sequence
  Synthetic
ggggcacgggccttttcctttggcccataccctgactggatagcacagcaaaccattgtgggtcatcaaagcaca

SEQ ID NO: 44885 - DNA, 75 bp, Artificial Sequence
  Synthetic
gaggcgagtgcgtttgacatgtctgtaatggtacagtgggcatttgaccacaattacgtagatgaagcagacatt

SEQ ID NO: 44886 - DNA, 75 bp, Artificial Sequence
  Synthetic
gcatatcaatatgcaaagcttgcacctgaagatagcaatgctgtggcttggcttgcacataataaccaggcgaga

SEQ ID NO: 44887 - DNA, 75 bp, Artificial Sequence
  Synthetic
tttgttagggagtgcgcagcaatggtaaggttttataaaaagggtgaaatgaaagacatgagtatgtccgaatgg

SEQ ID NO: 44888 - DNA, 75 bp, Artificial Sequence
  Synthetic
atacatacaagactgcaggacatagacggagagggtcagtggtctgaaatagttaagtttttgcgctatcaaggt

SEQ ID NO: 44889 - DNA, 75 bp, Artificial Sequence
  Synthetic
gtaaacttcataatgtttttgtctgcgtttaaggacttcttgcatgcgaccccaaaacgtaattgtatactgttt

SEQ ID NO: 44890 - DNA, 75 bp, Artificial Sequence
  Synthetic
tatgggccaccaaatactgggaaatctgcatttactatgtcactaataagggtattaaaggggagagtgatatct

SEQ ID NO: 44891 - DNA, 75 bp, Artificial Sequence
  Synthetic
tttgttaactccaagagccagttttggttacagcctttatgcgagtgcaaaattgctttgttagatgacgtgaca

SEQ ID NO: 44892 - DNA, 75 bp, Artificial Sequence
  Synthetic
gatccttgctgggtgtatatggacacatatttaagaaatggattagatggccatgttgtctcgttggattgtaag

SEQ ID NO: 44893 - DNA, 75 bp, Artificial Sequence
  Synthetic
cataaagcaccgatgcagacgaaatttccgccccttatgttaacatcaaatataaatgtgcatgaggaggtaaat

SEQ ID NO: 44894 - DNA, 75 bp, Artificial Sequence
  Synthetic
tatagatacttacatagtagaataataggctttgaatttccaaacccctttcctatgaagccagataatactcca

SEQ ID NO: 44895 - DNA, 75 bp, Artificial Sequence
  Synthetic
gagtttaaatttactgaccaaagctggaaatctttttttacaaggctttggacacaattagacctgagtgaccaa

SEQ ID NO: 44896 - DNA, 75 bp, Artificial Sequence
  Synthetic
gaagacgagggcgacaatggagagtctcagcgagcgtttcagtgctctgcaagaccaactaatgaacatatatga

SEQ ID NO: 44897 - DNA, 75 bp, Artificial Sequence
  Synthetic
agctgcaaaaaacactcttgagtctcaaatagagcattggcaattgctacggaaagaagctgttctattatacta

SEQ ID NO: 44898 - DNA, 75 bp, Artificial Sequence
  Synthetic
tgctaggcagaagggtgttataaggcttggataccaacctgtgcccacacaggcaatttctgaaggcaaggctaa

SEQ ID NO: 44899 - DNA, 75 bp, Artificial Sequence
  Synthetic
ggaggcgataggcatggtgctgcatttacaagcactgcaaaagtcacagtttggagcagaaccgtggacattggt

SEQ ID NO: 44900 - DNA, 75 bp, Artificial Sequence
  Synthetic
agataccagtgcagagacatttagaagtgctccagaaggtcactttaaaaaaagtccccaacaagtagaggttgt

SEQ ID NO: 44901 - DNA, 75 bp, Artificial Sequence
  Synthetic
gtatgacaacgatccagacaatgtcaacgtgtacactatgtggagacatgtgtattatgtggatgcagatgacat

SEQ ID NO: 44902 - DNA, 75 bp, Artificial Sequence
  Synthetic
gtggcataaggctgaaagtggggtgaaccggacagggatatattttatgcaagggaactttagacattattacat

SEQ ID NO: 44903 - DNA, 75 bp, Artificial Sequence
  Synthetic
tttgtttgcggacgatgcgcgtagatatagtacatctggacaatgggaggtgaagcttaataaggaaactttgtt

SEQ ID NO: 44904 - DNA, 75 bp, Artificial Sequence
  Synthetic
tgctcccgttaccagctccaacacaggaggaagcagcatcaccaccaccaccaacaccgcggccgagcagcctga

SEQ ID NO: 44905 - DNA, 75 bp, Artificial Sequence
  Synthetic
cactaccaaaccccgaaaacccaacgaaagcaacagacggaggtacgggcgaagagcctccagcccaatcccaag

SEQ ID NO: 44906 - DNA, 75 bp, Artificial Sequence
  Synthetic
gagaccagagccgcaaacgcaccaggggcggcagcagcggaggcggaggtcgcggtctaggtctaggtctaggtc

SEQ ID NO: 44907 - DNA, 75 bp, Artificial Sequence
  Synthetic
caggtcgcctaggcggcagttggggggtggtcctgaaaccgacaccagacagagatccagctcccggtcatccgc

SEQ ID NO: 44908 - DNA, 75 bp, Artificial Sequence
  Synthetic
cacctccacctccacctccagagccgaaaccccacaacggtcacgatcaaggtcacggcgagaaggaagacgcag

SEQ ID NO: 44909 - DNA, 75 bp, Artificial Sequence
  Synthetic
agggggaggagggagccgtggggggagcagaggagggagccgcgggaggcacagaagcaggagcctcgggggggt

SEQ ID NO: 44910 - DNA, 75 bp, Artificial Sequence
  Synthetic
cggaggagggcgccgtggggggagcagaggagggagcagggggcaagggcgagggcggaggcacgggtcagtctc

SEQ ID NO: 44911 - DNA, 75 bp, Artificial Sequence
  Synthetic
tccatccccagagcggcctgttgggcggcgtggcgtctctcctgcggacgtgggaacagcagttcggtcagttgg

SEQ ID NO: 44912 - DNA, 75 bp, Artificial Sequence
  Synthetic
tagacaacattcacgaggacttgacagactactggcggaagctgtcgatcccccagtaattttatgcaaaggaga

SEQ ID NO: 44913 - DNA, 75 bp, Artificial Sequence
  Synthetic
ggcaaacactttaaaatgctttcgcaaccgggctaaagctaagtatttaggactgtacagagcctttagcactac

SEQ ID NO: 44914 - DNA, 75 bp, Artificial Sequence
  Synthetic
gtggtcttgggtggctggacaaggaacagagcgtctaggcaggtccaggctgctaattagtttcgagtcctatag

SEQ ID NO: 44915 - DNA, 75 bp, Artificial Sequence
  Synthetic
ccagcgatcacacttccatcgctttgttaagttccctaaaggcgtggagtggtgcttaggaagcttggacagttt

SEQ ID NO: 44916 - DNA, 75 bp, Artificial Sequence
  Synthetic
gtagggctaccattgctgctttgctactaacacaccgggaccaaccacctgttctcttttgtttgctttttgcta

SEQ ID NO: 44917 - DNA, 75 bp, Artificial Sequence
  Synthetic
tgttatggcgcgtgctaagagaacaaaacgcgattccgtcacaaacatttatagaacctgcaagcaagcaggcac

SEQ ID NO: 44918 - DNA, 75 bp, Artificial Sequence
  Synthetic
ctgccctcctgatgtaattaataaagtggaacaaacaaccattgctgacagcatcttaaagtatggcagtgctgg

SEQ ID NO: 44919 - DNA, 75 bp, Artificial Sequence
  Synthetic
agtatttttgggagggctaggaattggcactgggaaaggtacaggaggcgcgggaggttacgtgccattgggtga

SEQ ID NO: 44920 - DNA, 75 bp, Artificial Sequence
  Synthetic
gggtccagccatccgcgttggcggcacacccactgttgtacgcccaaccattgtccctgatagtatcgggccttc

SEQ ID NO: 44921 - DNA, 75 bp, Artificial Sequence
  Synthetic
agatataattccagtggacacgctgaatcccgtagatgcatccgcctcatccattgtgcctttaacggactccgc

SEQ ID NO: 44922 - DNA, 75 bp, Artificial Sequence
  Synthetic
gggccctgaccttttaccaggtgaaatcgagacaattgcagaggtgcaccctacacaacaagggccctcgctgga

SEQ ID NO: 44923 - DNA, 75 bp, Artificial Sequence
  Synthetic
aacacctgttacaaccaccacccgtggttccagtgcagtactggaggttgctcccgagcctacaccgccatctcg

SEQ ID NO: 44924 - DNA, 75 bp, Artificial Sequence
  Synthetic
cgtcagagtcgggcgcacccaatatcacaacccttctttccaaataataactgaatcaaccccctcgcaaggcga

SEQ ID NO: 44925 - DNA, 75 bp, Artificial Sequence
  Synthetic
aagttctctgtccgatcagattttggtcacttctggttcgggagggcaagctattggtgaacccgagcttattga

SEQ ID NO: 44926 - DNA, 75 bp, Artificial Sequence
  Synthetic
gctacatgaactatcttcacgctattcatttgagatccaggagcccacccctccaagacaaagcagcacaccatt

SEQ ID NO: 44927 - DNA, 75 bp, Artificial Sequence
  Synthetic
gcaaagaccaccgccccgcgctaggcggccggcgctaacaaacaggcgacatttcgagcaagtgcacgtttctaa

SEQ ID NO: 44928 - DNA, 75 bp, Artificial Sequence
  Synthetic
tcccttgtttttggcacggccttcaaggttggttaggtttcagttcgataaccccgcctttgaggaggaggttac

SEQ ID NO: 44929 - DNA, 75 bp, Artificial Sequence
  Synthetic
acaaatctttcagcaagaggtgcagcagttcgaggaaccccctgatagagatttcctagacgtgcgttcgcttgg

SEQ ID NO: 44930 - DNA, 75 bp, Artificial Sequence
  Synthetic
acgcccacagtattcggacacccctcacggttatgtccgtgttagtcgcgttgggcagcgtggcaccatttatac

SEQ ID NO: 44931 - DNA, 75 bp, Artificial Sequence
  Synthetic
acggtcaggtgctcaaattgggtcccaggtgcatttttatcgtgaccttagtagcattgacacagacgaccccat

SEQ ID NO: 44932 - DNA, 75 bp, Artificial Sequence
  Synthetic
tgaattaaggttgctaggccaacattcaggcgatgctaccattgtgcaagggcagaccgagagcacatttgtaga

SEQ ID NO: 44933 - DNA, 75 bp, Artificial Sequence
  Synthetic
cattgcattagatgctgatcctatagctgaggatgtcagcgaggtgtactctgatgcgtttttgttagatgacac

SEQ ID NO: 44934 - DNA, 75 bp, Artificial Sequence
  Synthetic
tcctgaggactttagtgggtcccaacttgttatcgggggacgtcggtctacaactacgtatacagtacccaaatt

SEQ ID NO: 44935 - DNA, 75 bp, Artificial Sequence
  Synthetic
tgaaagcccccgtagcagtacatattatgtgcaggacacacaaggccttcacgtggcgtatcctgaacgccgaat

SEQ ID NO: 44936 - DNA, 75 bp, Artificial Sequence
  Synthetic
cccacttgacattatttttcccatgccggagctccctgttgtaattatttaccctcatgacaatactggggattt

SEQ ID NO: 44937 - DNA, 75 bp, Artificial Sequence
  Synthetic
ttacttacatcctagtctgcacaaacgaaaacggcgtaagcgtaagtatttctaatgttttcttttacagatgtc

SEQ ID NO: 44938 - DNA, 75 bp, Artificial Sequence
  Synthetic
tgtctggcaagccgctactggtaaggtttacctgccaccatccacaccggtggccagagttcaaagcacggatga

SEQ ID NO: 44939 - DNA, 75 bp, Artificial Sequence
  Synthetic
gtacatacaaagaacacaaatatactaccatgcatatagcgaccgtctgcttactgtcggtcacccctactttaa

SEQ ID NO: 44940 - DNA, 75 bp, Artificial Sequence
  Synthetic
tgtctataacaataatggcacagtgcttgaggtccctaaagtatcgggaaaccaacacagagtgttccgtttacg

SEQ ID NO: 44941 - DNA, 75 bp, Artificial Sequence
  Synthetic
tttgccggaccccaatcgttttgctttggctgatatgtccgtatacaacccggacaaggagcgtttagtgtgggc

SEQ ID NO: 44942 - DNA, 75 bp, Artificial Sequence
  Synthetic
ctgtagaggcatagaaattggacgagggcagcctttaggcgttggcagtactggccacccctattttaataaggt

SEQ ID NO: 44943 - DNA, 75 bp, Artificial Sequence
  Synthetic
gggggatactgaaaattccaacacatatagggcccaggcaaattccactgatgacagacaaaacatatcttttga

SEQ ID NO: 44944 - DNA, 75 bp, Artificial Sequence
  Synthetic
tcctaagcaaatacaaatgtttatcattggctgtgccccctgtataggtgagcattgggatagggctttgccatg

SEQ ID NO: 44945 - DNA, 75 bp, Artificial Sequence
  Synthetic
cgtggaacaaaacccacctgcatatgcatgccctcctatagagcttagaaacacagtaatcgaggatggcgatat

SEQ ID NO: 44946 - DNA, 75 bp, Artificial Sequence
  Synthetic
ggctgatataggatatggcaacttaaattttaaggccttgcaacaaaacagatctgatgttagtttagacattgt

SEQ ID NO: 44947 - DNA, 75 bp, Artificial Sequence
  Synthetic
aaatgaaacatgcaagtacccggattttttaagaatgcaaaatgacgtgtatggggattcctgttttttttatgc

SEQ ID NO: 44948 - DNA, 75 bp, Artificial Sequence
  Synthetic
acgtagggagcaatgctatgcaagacattttttcgtccgtggaggcaaaacaggcgatgatattcctggggcaca

SEQ ID NO: 44949 - DNA, 75 bp, Artificial Sequence
  Synthetic
aattgatgaaggcagtatgaccaatgctttttacatacctgctgctaatgcccaagctcagaataatataggcaa

SEQ ID NO: 44950 - DNA, 75 bp, Artificial Sequence
  Synthetic
cgcaatgtatttcccaactgttagtgggtcattggtttctagtgatgcacagctgttcaacaggccattttggtt

SEQ ID NO: 44951 - DNA, 75 bp, Artificial Sequence
  Synthetic
gcagcgtgcacaaggccacaacaatggcatatgttggtttaatcagctatttgtcacagtggtggacaacacccg

SEQ ID NO: 44952 - DNA, 75 bp, Artificial Sequence
  Synthetic
aaataccaactttagcattgctgttagcacagatgaaaaggatatctcaaaaatagcaaactacgattcccagaa

SEQ ID NO: 44953 - DNA, 75 bp, Artificial Sequence
  Synthetic
gtttgcggagtatcttagacacgtagaggagtatgaagtttccttaatattacagctctgtaaggttcccctaaa

SEQ ID NO: 44954 - DNA, 75 bp, Artificial Sequence
  Synthetic
agctgaggttctggcgcaaatcaatgccatgaactcaggtattctggaggactggcaattgggctttgtacccgc

SEQ ID NO: 44955 - DNA, 75 bp, Artificial Sequence
  Synthetic
ccctgataaccccatccatgatacttatcgatatatagactcccttgcaactcgttgccccgataaagagccccc

SEQ ID NO: 44956 - DNA, 75 bp, Artificial Sequence
  Synthetic
caaagaaaaagaggacccttataaacaatacacattttggaatgtggatctcacagagcgtctatccttagattt

SEQ ID NO: 44957 - DNA, 75 bp, Artificial Sequence
  Synthetic
agatcaatactcgctgggtcgtaagtttctctttcaggcaggcctacaacggtcaaccgttaacggtacaaaaaa

SEQ ID NO: 44958 - DNA, 75 bp, Artificial Sequence
  Synthetic
cgcgccagttacatcgcggggggtcaagcgcaaacgtaagagctaactgtaccgttttcggtacctggcacatca

SEQ ID NO: 44959 - DNA, 75 bp, Artificial Sequence
  Synthetic
aggggtgggtgtataaacctaaacagtctcttgtaccgttttcggtaccacatgtgaacttttgcacagtattta

SEQ ID NO: 44960 - DNA, 75 bp, Artificial Sequence
  Synthetic
aaaaatgcctgagtaagcttgcgtgtgagccgggcggccgcacccggtacataaattgctcgcctgtgtcatttt

SEQ ID NO: 44961 - DNA, 75 bp, Artificial Sequence
  Synthetic
atgccaaatgcggcgcgccagctggcatagacccttccgtctctacatgcccggataagacgtctgccaaacgga

SEQ ID NO: 44962 - DNA, 75 bp, Artificial Sequence
  Synthetic
ttatacattttgccaactgcttcgggcgtgttctttctggcaccatagctgtaccagtaacggtaagtacctcaa

SEQ ID NO: 44963 - DNA, 75 bp, Artificial Sequence
  Synthetic
attgtaccgggtgcggctcaaattaatcactcaatgggtaattgttgttgccaacaagcatagtttacaagtact

SEQ ID NO: 44964 - DNA, 75 bp, Artificial Sequence
  Synthetic
tgcctgtaacggattggataatacaacggtcataaatcaatatatatatatatatatatatatatataataaaaa

SEQ ID NO: 44965 - DNA, 75 bp, Artificial Sequence
  Synthetic
tcaatatatatatatatatatatatatatataataaaaatatatatgcaacttggtgtggagatggtgtgcttca

SEQ ID NO: 44966 - DNA, 75 bp, Artificial Sequence
  Synthetic
tcatagatatagtaagcattctgtctttaagggattttctgacaaagttagaaaaaatgatttagacatgaatgt

SEQ ID NO: 44967 - DNA, 75 bp, Artificial Sequence
  Synthetic
tattattcaaaatatgatttttaaaaatttaaaatatattatcacttcaatgacagtagtcaaataacaaacaat

SEQ ID NO: 44968 - DNA, 75 bp, Artificial Sequence
  Synthetic
tgacagtagtcaaataacaaacaataacgataacagacaacaaacaacaccatgagatatattataattctagca

SEQ ID NO: 44969 - DNA, 75 bp, Artificial Sequence
  Synthetic
ttggaaggagtagggattcaccatcacacacttgaagcaggtaacgcggtatatggaaaagttcaacatgattat

SEQ ID NO: 44970 - DNA, 75 bp, Artificial Sequence
  Synthetic
catttttgttttgcaaaccggaatatagtgtccggtacacttttttagtttgtggtgtgcctgaatcgttcgatt

SEQ ID NO: 44971 - DNA, 75 bp, Artificial Sequence
  Synthetic
gatatacggattaatagcgtgtcttatattcgtgacttcatccattgctagtcccctttacattcccgttattcc

SEQ ID NO: 44972 - DNA, 75 bp, Artificial Sequence
  Synthetic
gtcccctttacattcccgttattccacccatttcggaagataaatcgttcaatagtgtagaggtattagtttcct

SEQ ID NO: 44973 - DNA, 75 bp, Artificial Sequence
  Synthetic
atattgaatatggtatccgatactataatgaaaagattatagacgcatttatagagttaggagccgatctaacta

SEQ ID NO: 44974 - DNA, 75 bp, Artificial Sequence
  Synthetic
gccgaatatggttataacaatattactaacataaagataatacgtaaactacttaatcttagcagacatgctcca

SEQ ID NO: 44975 - DNA, 75 bp, Artificial Sequence
  Synthetic
ttgactgaatacgacgaccatatcaatttgtacatcgagcatccgtatgctactagaggtagcaagaagattcct

SEQ ID NO: 44976 - DNA, 75 bp, Artificial Sequence
  Synthetic
atgattccttacacatgtctcctatacgaacgctaatctctagattcttgacgcatttcgtatcgacgatcgttg

SEQ ID NO: 44977 - DNA, 75 bp, Artificial Sequence
  Synthetic
tatatcataatattgaatgtggtgtccgatactataatgaaaagattatagacgcatttatagagttaggagccg

SEQ ID NO: 44978 - DNA, 75 bp, Artificial Sequence
  Synthetic
atatggaatggaaattgggaaacgtagacaaaactatcgttcacaaaaagagatgttattgcggcatcgtaactg

SEQ ID NO: 44979 - DNA, 75 bp, Artificial Sequence
  Synthetic
actacttaatcttagcagacatgctccacataatctatttagagatcgagtcatgcacgattatataagtaatac

SEQ ID NO: 44980 - DNA, 75 bp, Artificial Sequence
  Synthetic
cagaagggtttctcgaaaaaattactccatggagttcggaagtatgtctgacacctaaaaagaatgtatatacat

SEQ ID NO: 44981 - DNA, 75 bp, Artificial Sequence
  Synthetic
aacttcactcatattgcggaatacttattagatcgaggagctgatatatcattaaagacaggcgatggaaaatct

SEQ ID NO: 44982 - DNA, 75 bp, Artificial Sequence
  Synthetic
ggacgcatttatgttatcggtggtcgagatggatcaaattatctaaacactgtagaaagttggaaacctatggat

SEQ ID NO: 44983 - DNA, 75 bp, Artificial Sequence
  Synthetic
tttgattagtcgtctaccgcctaaaagtgtcataagctcactgactaaccatataatagattatgttcttacaaa

SEQ ID NO: 44984 - DNA, 75 bp, Artificial Sequence
  Synthetic
aaaatatatatcattggaggcgttaaacagaagggagaatcaaccaatcaagtcttgagcgtcgatctatcgaca

SEQ ID NO: 44985 - DNA, 75 bp, Artificial Sequence
  Synthetic
ataagacctccaccgacgacagtgtaataagtggtgggatctccttttacgactgatgtggaaccatcttcggat

SEQ ID NO: 44986 - DNA, 75 bp, Artificial Sequence
  Synthetic
taaattataaaagaagcagtgcttccgctgtttccgttaataatactattttcgtaactggcggactattcataa

SEQ ID NO: 44987 - DNA, 75 bp, Artificial Sequence
  Synthetic
tacttgatccatccttttattctagattcagaattgctattgaaagcaaattaaatcaatacgattatcgttggt

SEQ ID NO: 44988 - DNA, 75 bp, Artificial Sequence
  Synthetic
atcattggtcggtgtttggtcttgcttggtgactttgacaataacatcgattcccatatgatgtttgttttcttc

SEQ ID NO: 44989 - DNA, 75 bp, Artificial Sequence
  Synthetic
ttaaatcaatacgattatcgttggttcaattacaatagatatcgtgttaataaaaagtatcgcaaagtcttacat

SEQ ID NO: 44990 - DNA, 75 bp, Artificial Sequence
  Synthetic
acttgactaaatattcataactaatttttattaatgatacaaaaatgaaataaaactgcatattatacactggtt

SEQ ID NO: 44991 - DNA, 75 bp, Artificial Sequence
  Synthetic
ttggtgactttgacaataacatcgattcccatatgatgtttgttttcttcttcggtacacgaggatgaggatgag

SEQ ID NO: 44992 - DNA, 75 bp, Artificial Sequence
  Synthetic
tccttctgttcccctctatcatctactccatgtctattagacgatgtgagaagactgaagaggaaacatggggat

SEQ ID NO: 44993 - DNA, 75 bp, Artificial Sequence
  Synthetic
tacaagtattaaaatctattctcatcgccaataatgtaacactatacgacactattgtaaataatacatcagagt

SEQ ID NO: 44994 - DNA, 75 bp, Artificial Sequence
  Synthetic
atgctgtatttggccggaggtctatcagttaccaaacaatatggtaaattagagagaagcaacgagatatcttgt

SEQ ID NO: 44995 - DNA, 75 bp, Artificial Sequence
  Synthetic
ggcaaagtcttacatgacctcgacacatatatcaaggatgtacaagtattaaaatctacttccatcactaataat

SEQ ID NO: 44996 - DNA, 75 bp, Artificial Sequence
  Synthetic
ttcctgtacgtcgtctaaacaacaaacaattaattaatacagtaaattccaatatatatcatgatcttatcgaaa

SEQ ID NO: 44997 - DNA, 75 bp, Artificial Sequence
  Synthetic
ggaggagaatacctcgacatacgtgtgtgcaatcaaagtggaaagatgctgctgtgccgtgtttgcagattggcc

SEQ ID NO: 44998 - DNA, 75 bp, Artificial Sequence
  Synthetic
ggaaaaacttgacatctataaagacaaacaatggtcgattatagaaatgcctatggctagggtatatcacggtat

SEQ ID NO: 44999 - DNA, 75 bp, Artificial Sequence
  Synthetic
caagtggaggattgataactgaaggcaatggattcagagtagttatacatgatcaatgtacagaaccccatgact

SEQ ID NO: 45000 - DNA, 75 bp, Artificial Sequence
  Synthetic
tagtaatcagtttatgtatatcgcaactaccgggcatatggctatcgacatcgagaacattacccacatgataag

SEQ ID NO: 45001 - DNA, 75 bp, Artificial Sequence
  Synthetic
ctccatgtctattagacgatgtgagaagactgaagaggaaacatggggattgaaaatagggttgtgtataattgc

SEQ ID NO: 45002 - DNA, 75 bp, Artificial Sequence
  Synthetic
aatcatcttatttgagtcgtattcctaatgagatattactcaaaatactatataacctcagcgtctacgatttac

SEQ ID NO: 45003 - DNA, 75 bp, Artificial Sequence
  Synthetic
cgacaaacaattaattaatctcataaaatccaatacatatcataatcttatcgaaaaagttattaaaaatacatt

SEQ ID NO: 45004 - DNA, 75 bp, Artificial Sequence
  Synthetic
gtgccccatctagtattccaaaatgttccagaactctctctatttctgtatattgtgatcaagaggcgggagacc

SEQ ID NO: 45005 - DNA, 75 bp, Artificial Sequence
  Synthetic
taaggtaactatatacaataactaacaatttgtgtatcatatagacaattaattaggtaactgttatctcttttt

SEQ ID NO: 45006 - DNA, 75 bp, Artificial Sequence
  Synthetic
caatggattcagagtagttatacatgatcaatgtacagaaccccatgactttattatcaccgatactcaacaaac

SEQ ID NO: 45007 - DNA, 75 bp, Artificial Sequence
  Synthetic
gagtcgaggtcgatttctacgcagactgaataatgattatatacactacatatttttatgtcattatgactactt

SEQ ID NO: 45008 - DNA, 75 bp, Artificial Sequence
  Synthetic
ctgaataatgattatatacactacatatttttatgtcattatgactacttgtaatattgaaatcgtaatttgata

SEQ ID NO: 45009 - DNA, 75 bp, Artificial Sequence
  Synthetic
ttccagaactctctctatttctgtatattgtgatcaagaggcgggagacctaaaatttgaggagtattctcaaga

SEQ ID NO: 45010 - DNA, 75 bp, Artificial Sequence
  Synthetic
gaaatagatagagagaaagaagaaatactaaaaaatgtagaaatggaaaataataaaaatattaacaagaatcat

SEQ ID NO: 45011 - DNA, 75 bp, Artificial Sequence
  Synthetic
atattatataaactagatgtatctgatttacgtaaactatatacaagatatatgcaagagaatgagaatgagaat

SEQ ID NO: 45012 - DNA, 75 bp, Artificial Sequence
  Synthetic
atctgggtattaatcaaagtttcatgaatgaatgtgttcgaagaattacaacatgggatagagaatcatgtgtcg

SEQ ID NO: 45013 - DNA, 75 bp, Artificial Sequence
  Synthetic
agtaacattagcaatcttttagatgatgatatattatgcgatgtaatcataactattggtgatggagaagaaatt

SEQ ID NO: 45014 - DNA, 75 bp, Artificial Sequence
  Synthetic
gtatctcgccctatagttttattgattactactaaacatggatacagacacaaacgaatacacggatacggattc

SEQ ID NO: 45015 - DNA, 75 bp, Artificial Sequence
  Synthetic
aaattcgaccgtagtgtctacaaaaggtacatactgaagagtaaagcactccatgctaaaacagagttgtaatag

SEQ ID NO: 45016 - DNA, 75 bp, Artificial Sequence
  Synthetic
atgatatattatgcgatgtaatcataactattggtgatggagaagaaattaaagcacataaaactatcttggctg

SEQ ID NO: 45017 - DNA, 75 bp, Artificial Sequence
  Synthetic
gagaatgagaatgatatcgtattagattatcatatagagaatacgaggtctgtttctacacagacatgaataatg

SEQ ID NO: 45018 - DNA, 75 bp, Artificial Sequence
  Synthetic
gacaatcaagatagtgtagcgtcgctaccgtacaagtatctacaagtagtcaataaaagagaacgtagtagattg

SEQ ID NO: 45019 - DNA, 75 bp, Artificial Sequence
  Synthetic
tggggaaatatgaacctgacatgattaagattgctctttcagtggctggtaatttaataagaaatcgagactaca

SEQ ID NO: 45020 - DNA, 75 bp, Artificial Sequence
  Synthetic
tcgttattaataccagtagtaatagtgattccattgataaagaagttatagaatgtattagtcaggatataggaa

SEQ ID NO: 45021 - DNA, 75 bp, Artificial Sequence
  Synthetic
taactcctggataacgtttagcagctgccgttcctattctagaccaaaaattcggtttcatgttttcgaaacggt

SEQ ID NO: 45022 - DNA, 75 bp, Artificial Sequence
  Synthetic
aaaatattctacatatttattctatagatgctgctaatacgaatattatgattttttttctagatagagtattaa

SEQ ID NO: 45023 - DNA, 75 bp, Artificial Sequence
  Synthetic
gtccggatactccgtatcccattccacattttgtttgggaaacacatgccttgcatccggatgatcctttgagaa

SEQ ID NO: 45024 - DNA, 75 bp, Artificial Sequence
  Synthetic
acagattctattgtgagtcgtgttacacgatcgcgtctctacctgattactatcgcatcttccgttacaacttag

SEQ ID NO: 45025 - DNA, 75 bp, Artificial Sequence
  Synthetic
cttatacaatagacatataagttctatgaatgtaatagacgtattaaaatgcgccgactatcttctaatcgatga

SEQ ID NO: 45026 - DNA, 75 bp, Artificial Sequence
  Synthetic
agatctgtatggaattggagaaactgacgactataggttctttgttataaagaatttgggaagagtattcgctcc

SEQ ID NO: 45027 - DNA, 75 bp, Artificial Sequence
  Synthetic
cttgctatcgcataatctggaagcgtatgttcccggaggacacgataaacaacatagatgatggtgtttgtattc

SEQ ID NO: 45028 - DNA, 75 bp, Artificial Sequence
  Synthetic
agaacagcttttgtgtatactgtcctgtatagatatacaaaatctagataagaagtctagactactactctattc

SEQ ID NO: 45029 - DNA, 75 bp, Artificial Sequence
  Synthetic
tttttttctcactctgatccatgtaaaccaaggacgagataagacactctcattcctcatccacaaccccattaa

SEQ ID NO: 45030 - DNA, 75 bp, Artificial Sequence
  Synthetic
ttatgattatacatgaaagcagcaatagcaatatatatgacttcatgatttaataatgtagtagtaattattatc

SEQ ID NO: 45031 - DNA, 75 bp, Artificial Sequence
  Synthetic
tcgtgtatacaatttctattagataataaacagaatagaaacattataccccgccagttatgtttagtgtgtcat

SEQ ID NO: 45032 - DNA, 75 bp, Artificial Sequence
  Synthetic
atagattctttgttttaaagaatctgggaagagtattcgccccaaaggatacggaatcagtcttcgatgcatgcg

SEQ ID NO: 45033 - DNA, 75 bp, Artificial Sequence
  Synthetic
tcactatgataaacacgttagagtttatacactctagaggatttacccatggaaaaatagaaccgaggaatatac

SEQ ID NO: 45034 - DNA, 75 bp, Artificial Sequence
  Synthetic
cgtgcatattagtatataacattaatactatggaatatagtgttatttccaccattcctaatcacataattaatt

SEQ ID NO: 45035 - DNA, 75 bp, Artificial Sequence
  Synthetic
accattcctaatcacataattaattacgcatccgcgattgtagataatgaaataataatagctggaggatataac

SEQ ID NO: 45036 - DNA, 75 bp, Artificial Sequence
  Synthetic
attgcggcatcgtaacggttaattataatagggataaaggattaatgattatttctaaacatggttcggagcttg

SEQ ID NO: 45037 - DNA, 75 bp, Artificial Sequence
  Synthetic
attcatggtaaggtcttagatatagacgaaatattagaaaaagtgtattcatcacctaatgtatcgataattatt

SEQ ID NO: 45038 - DNA, 75 bp, Artificial Sequence
  Synthetic
aagcatccatctaaccaagacggataagaaatatatacttcaattgataaggcacggtagatcatagaacaaacc

SEQ ID NO: 45039 - DNA, 75 bp, Artificial Sequence
  Synthetic
gtttatacaagattgaaattatattcttttttatagagcgcggtgatagttacggatatctattaatattaaact

SEQ ID NO: 45040 - DNA, 75 bp, Artificial Sequence
  Synthetic
atacaatgggtgatgataagtggaagatgttacccgatatgcccatagcattatctagttatggcatgtgtgtat

SEQ ID NO: 45041 - DNA, 75 bp, Artificial Sequence
  Synthetic
tatttcggaagcagtcgcgaacaacaacaaaataataatggaattactattgtctaaacgaccatctttgaaaat

SEQ ID NO: 45042 - DNA, 75 bp, Artificial Sequence
  Synthetic
tacacgctagattattctcaaactcctaattatgacagactacgtagactgtttatacaagattgaaattatatt

SEQ ID NO: 45043 - DNA, 75 bp, Artificial Sequence
  Synthetic
gtttatacaagattgaaattatattcttttttatagagtgtggtagtgttacggatatctaatattaatattaga

SEQ ID NO: 45044 - DNA, 75 bp, Artificial Sequence
  Synthetic
tagatatggaggaggatacaaatatttcaaataaagttatgagatacgacactgtcaataatatatgggagacat

SEQ ID NO: 45045 - DNA, 75 bp, Artificial Sequence
  Synthetic
gtaggctattatcttctttacgtggtaatcgtcgtaaggagagaactcggacatcctatagaacaacgatttaat

SEQ ID NO: 45046 - DNA, 75 bp, Artificial Sequence
  Synthetic
tgttagtgagtagacatttcatatttctcttttctccaatactaattcaaattgttaaattaataatggataata

SEQ ID NO: 45047 - DNA, 75 bp, Artificial Sequence
  Synthetic
aaatcgcatcttctatgaaaggagagaatgtattcatttctccagcgtcaatctcgtcagtattgacaatactgt

SEQ ID NO: 45048 - DNA, 75 bp, Artificial Sequence
  Synthetic
gatgatatatatgttgtatgcgacatcaaagatgaaaaaaatgttaagacttgtatatttagatataacacgaat

SEQ ID NO: 45049 - DNA, 75 bp, Artificial Sequence
  Synthetic
cattgattatacatcggtacatacagtaaatagcatagatatggaggaggatacagatacttcaaataaagttat

SEQ ID NO: 45050 - DNA, 75 bp, Artificial Sequence
  Synthetic
atctcgtcagtattgacaatactgtattatggagctaatggatccactgctgaacagctatcaaaatatgtagaa

SEQ ID NO: 45051 - DNA, 75 bp, Artificial Sequence
  Synthetic
taatagtataatagtataatagtataatagtataatagtataatagtataatagtataatagtataatagtataa

SEQ ID NO: 45052 - DNA, 75 bp, Artificial Sequence
  Synthetic
tctacatactattcttcatgacaataccataatgatgttacattgttatgaatcgtatatgttacaagatacatt

SEQ ID NO: 45053 - DNA, 75 bp, Artificial Sequence
  Synthetic
accataatgatgttacattgttatgaatcgtatatgttacaagatacatttaatgtgtacactcgcgaatggaat

SEQ ID NO: 45054 - DNA, 75 bp, Artificial Sequence
  Synthetic
ctctcgcggagtcgagagacttcgtagaaacaacgaaggattaactccgctaggagcatacagcaagcatagaca

SEQ ID NO: 45055 - DNA, 75 bp, Artificial Sequence
  Synthetic
tcgattgccatggatatcttcagggaaatcgcatcttctatgaaaggagagaatgtattcatttctccagcgtca

SEQ ID NO: 45056 - DNA, 75 bp, Artificial Sequence
  Synthetic
aatgcactagtcttgacgtatacggaagtcgtgtacgcagtattatagcatctattagatatcgtcaaagattaa

SEQ ID NO: 45057 - DNA, 75 bp, Artificial Sequence
  Synthetic
tagggtatatcacggcatcgactcgacatttggaatgttatattttgccggaggtctatccgttaccgaacaata

SEQ ID NO: 45058 - DNA, 75 bp, Artificial Sequence
  Synthetic
aatcgtatatgttacaagatacatttaatgtgtacactcgcgaatggaatcatatgtgtcatcaacattcgaata

SEQ ID NO: 45059 - DNA, 75 bp, Artificial Sequence
  Synthetic
cttagtatgttgatagagtgtttgtgcaattgattatgttttatgaatagataaagtagatggtgtccttcttcc

SEQ ID NO: 45060 - DNA, 75 bp, Artificial Sequence
  Synthetic
aacgattgattttatcattaccgcttcattcttatattctttgcttacggaacctatatttagaaacatctacta

SEQ ID NO: 45061 - DNA, 75 bp, Artificial Sequence
  Synthetic
tacaccacacgaggactatgtttggtatgctcttgaaggtaagtgtgtaacggcgtatttcctattttcgtaacc

SEQ ID NO: 45062 - DNA, 75 bp, Artificial Sequence
  Synthetic
gatacagatacagatgttacaaatgtagaagatatcatgaatgaaatagatagagagaaagaagaaatactaaaa

SEQ ID NO: 45063 - DNA, 75 bp, Artificial Sequence
  Synthetic
tcttgtggatacactagtaaagttgggactgacagatgtgttctattcaactggcgattatagcaatatgtgtaa

SEQ ID NO: 45064 - DNA, 75 bp, Artificial Sequence
  Synthetic
agtcactcataattgctgacgcgataaattcgtaataatctgttttgttcaaatttttataaggaatctacaggc

SEQ ID NO: 45065 - DNA, 75 bp, Artificial Sequence
  Synthetic
gcaataccaatttgtcaagtatgaatacggagtacaaacataaactgaagtttaacattatttatttatgatata

SEQ ID NO: 45066 - DNA, 75 bp, Artificial Sequence
  Synthetic
atatattagagaagcactcgttattaataccagtagtaatagtgattccattgataaagaagttatagaatgtat

SEQ ID NO: 45067 - DNA, 75 bp, Artificial Sequence
  Synthetic
aagaaatggtgtgactctatggatgctatgtttatcgatgtgcacattcccaagtttaaggtaacaggctcgtat

SEQ ID NO: 45068 - DNA, 75 bp, Artificial Sequence
  Synthetic
aatctggtggatgcgctagtaaagttgggactgacagaggtgttcggttcaactggagattatagcaatatgtgt

SEQ ID NO: 45069 - DNA, 75 bp, Artificial Sequence
  Synthetic
gacatggacgtagatattccgtattgtgcgacactagctaccgcaaataaaatatactgtagcgatagtatcgag

SEQ ID NO: 45070 - DNA, 75 bp, Artificial Sequence
  Synthetic
tgtgattaggcatgttgatggcaaaattcttttcgttggtagatattgctctccaacaactaattaagcacattc

SEQ ID NO: 45071 - DNA, 75 bp, Artificial Sequence
  Synthetic
tacttcttggaatgatactgttacgtgtcctaatgcggaatgccaacctcttcaattagaacacggatcgtgtca

SEQ ID NO: 45072 - DNA, 75 bp, Artificial Sequence
  Synthetic
taaaagatgattttcaaactgtaaactttaataatgctaaccaaacaaaggaactaatcaatgaatgggttaaga

SEQ ID NO: 45073 - DNA, 75 bp, Artificial Sequence
  Synthetic
tcatcattatcgtccttatcatcgtccttatcattatcatcatagtctattaaacacaaatcatctacgtttata

SEQ ID NO: 45074 - DNA, 75 bp, Artificial Sequence
  Synthetic
aatactcgtatgacagttgttagcgccgtccattttaaagcaatgtggaaatatccattttctaaacatcttaca

SEQ ID NO: 45075 - DNA, 75 bp, Artificial Sequence
  Synthetic
aagtatttggctattccagatctgtatggaattggagaaaccgatgattatatgttcttcgttataaagaattcg

SEQ ID NO: 45076 - DNA, 75 bp, Artificial Sequence
  Synthetic
atctcataatgatttactttttcataattagagatgtacgaaagaaaaagaaaacagaacaatatatttttttag

SEQ ID NO: 45077 - DNA, 75 bp, Artificial Sequence
  Synthetic
taaactccgtgtttatgatgccggtaaatgtttttatcatcttggacggaatcgattttgtaatatgccatggaa

SEQ ID NO: 45078 - DNA, 75 bp, Artificial Sequence
  Synthetic
acgagtctagtattcgagacattaacaacgaccgataataaaattactagtatcaatccaacaaatgcgccaaag

SEQ ID NO: 45079 - DNA, 75 bp, Artificial Sequence
  Synthetic
ccatgataaattatttaatggagtaataaagtatctcgcgttgtatctccatgggtaatttcgaaatcaagttat

SEQ ID NO: 45080 - DNA, 75 bp, Artificial Sequence
  Synthetic
taggcaatgtaacgcgtatattttatacattttttagttatctgatgaaagataaactagatatataaataatcc

SEQ ID NO: 45081 - DNA, 75 bp, Artificial Sequence
  Synthetic
ggagtcgatcctctcactgttctttacagtctctgtaatgatggacgttagttcttttttgtaccatttgatgtt

SEQ ID NO: 45082 - DNA, 75 bp, Artificial Sequence
  Synthetic
aatcagcgattcctatagccgttcttgtaattgtgggaacataattaggatcttctaatggattgtatggcttga

SEQ ID NO: 45083 - DNA, 75 bp, Artificial Sequence
  Synthetic
tgaaccattattggcctgtatcagatacgccttaatcctagatgatgattttccttctaaagtaaagtatgatat

SEQ ID NO: 45084 - DNA, 75 bp, Artificial Sequence
  Synthetic
gttcttttttgtaccatttgatgttggatacaaagtttaggaatgtaggattctttgcgtatctcagtctatgac

SEQ ID NO: 45085 - DNA, 75 bp, Artificial Sequence
  Synthetic
ttcctccctcttctccctttcccagaaacaaacttttttacccactataaaataaaatgagtatactacctgtta

SEQ ID NO: 45086 - DNA, 75 bp, Artificial Sequence
  Synthetic
aaacatggagacgcctgatatgtaggcattcttcattctattaatgtctgctctataacgctttagttccttatg

SEQ ID NO: 45087 - DNA, 75 bp, Artificial Sequence
  Synthetic
cgctatagagcagacattaatagaatgaagaatgcctacatatcaggcgtctccatgtttgatatattatttaaa

SEQ ID NO: 45088 - DNA, 75 bp, Artificial Sequence
  Synthetic
ttttttatagagtgtggtagtgttacggatatctaatattaatattagactatctctatcgcgctacacgaccaa

SEQ ID NO: 45089 - DNA, 75 bp, Artificial Sequence
  Synthetic
tctcatgtataaatattacaaatagtataaactaaagttgacgcatacattaaaacttaaataataataataata

SEQ ID NO: 45090 - DNA, 75 bp, Artificial Sequence
  Synthetic
taatggttcaggatatagatagcgtatatctctattaaatgcgtcaatcatagtctctagagtgggatggtaact

SEQ ID NO: 45091 - DNA, 75 bp, Artificial Sequence
  Synthetic
aaaaattaaacaatatcgttattatataagtaataccaaaatgatgatatacggattaatagcctgtcttatatt

SEQ ID NO: 45092 - DNA, 75 bp, Artificial Sequence
  Synthetic
gatataatatattagatattttatgggaaaaacgaggagcggataatgatagaattataccgatagataatggta

SEQ ID NO: 45093 - DNA, 75 bp, Artificial Sequence
  Synthetic
cagtaataaatcaactagcttcgttttgttttctcttcggtaactgcttttctggatggccgtattgattatcga

SEQ ID NO: 45094 - DNA, 75 bp, Artificial Sequence
  Synthetic
gaaccaacgctcgacagatgtgggatttggtagacctcctactacgtataatttattgttagcgggtaccccgct

SEQ ID NO: 45095 - DNA, 75 bp, Artificial Sequence
  Synthetic
tccatgaataaagtatatgggcgatattctgccgtgtttaaagattcctttttgagaaaaattggcgataatttc

SEQ ID NO: 45096 - DNA, 75 bp, Artificial Sequence
  Synthetic
ccatattccaataaccgctttgcaaattgtatattattgacatcgaccgcgtaatatagtagagttttattctca

SEQ ID NO: 45097 - DNA, 75 bp, Artificial Sequence
  Synthetic
attgtatattattgacatcgaccgcgtaatatagtagagttttattctcattatcgatcatatctatatcatcca

SEQ ID NO: 45098 - DNA, 75 bp, Artificial Sequence
  Synthetic
tgtagatatctttactgaggggaaaatcaatccactattggatgaaccattgtctcctgatacctgtctcctagc

SEQ ID NO: 45099 - DNA, 75 bp, Artificial Sequence
  Synthetic
gtaatatagtagagttttattctcattatcgatcatatctatatcatccatgtacttgcttagtatatcaaatac

SEQ ID NO: 45100 - DNA, 75 bp, Artificial Sequence
  Synthetic
gagtattctaggtgtttctatagaatgtaagaagccgtcgacattacttacttttttgaccgtgcgtaaaatgac

SEQ ID NO: 45101 - DNA, 75 bp, Artificial Sequence
  Synthetic
ataatatcagaccgtacatacatagacggccattgttagatacgtgatttacagccatgtgtccattattttcca

SEQ ID NO: 45102 - DNA, 75 bp, Artificial Sequence
  Synthetic
ttgttcaaatcagagtctgaggatatcttccaaaagaacatgagtattctaggtgtttctatagaatgtaagaag

SEQ ID NO: 45103 - DNA, 75 bp, Artificial Sequence
  Synthetic
atggcttattatcgaggagactgtctagaagccgtttatgtaacaatgacttataaaaatactaaaactggagag

SEQ ID NO: 45104 - DNA, 75 bp, Artificial Sequence
  Synthetic
cgatgtcttttggataagtaatggtatgtattacgaagaagacgaggacggagacggtagaataagtgtagcaaa

SEQ ID NO: 45105 - DNA, 75 bp, Artificial Sequence
  Synthetic
ttataggtagttgatagaacaaaatacataattttgtaaaaataaatcactttttatactaatatgacacgatta

SEQ ID NO: 45106 - DNA, 75 bp, Artificial Sequence
  Synthetic
gatgagtaatggggttgatggttgattattgattagttttccttattctttttattcacacaaaagaatattttt

SEQ ID NO: 45107 - DNA, 75 bp, Artificial Sequence
  Synthetic
tcgacgaggatggactcacttctcttcattactactgtaaacacatatccacgttccacgaaagcaattattaca

SEQ ID NO: 45108 - DNA, 75 bp, Artificial Sequence
  Synthetic
ttatagatgaaaatcagctgcttcagatgattttggtcagtatgtataatatgaaaaaataaatataacttattt

SEQ ID NO: 45109 - DNA, 75 bp, Artificial Sequence
  Synthetic
gaagattaacgatttccatgtctacattatatggggttactctaaatcgcttgtttagataatccgctagtactc

SEQ ID NO: 45110 - DNA, 75 bp, Artificial Sequence
  Synthetic
accaaacatagtcctcgtgtggtgtatgctcttttatctcgaggagccgatacgaggatacgtaataatcttgat

SEQ ID NO: 45111 - DNA, 75 bp, Artificial Sequence
  Synthetic
gtcgtatactctacacgtgtccacatcctttattaataatttgacaatctctatatctatggttgagcaagacca

SEQ ID NO: 45112 - DNA, 75 bp, Artificial Sequence
  Synthetic
tttatgaccggcaaccatgaatttacagagattatctctggctatatatcttactgcgacatgttcgtggtgtta

SEQ ID NO: 45113 - DNA, 75 bp, Artificial Sequence
  Synthetic
ctatatctatggttgagcaagaccagtagtattggatgggtaaagatcctccttcgtctctgccatggatggaaa

SEQ ID NO: 45114 - DNA, 75 bp, Artificial Sequence
  Synthetic
gtagtattggatgggtaaagatcctccttcgtctctgccatggatggaaacattgttatcgatcaaacatttaat

SEQ ID NO: 45115 - DNA, 75 bp, Artificial Sequence
  Synthetic
tccagaattgtaacaacaatgttgcctcatacctcgtatacatcggatacgacatcaaccttcctactaaagacg

SEQ ID NO: 45116 - DNA, 75 bp, Artificial Sequence
  Synthetic
acacctatcgctatcgtacatacagctacgaaatacgtaaccggtgctgtaacattctgatttaagaagccatag

SEQ ID NO: 45117 - DNA, 75 bp, Artificial Sequence
  Synthetic
tgctatcttgatgatgtcctgtatcagtcgcatcttcagcactcgactgaatattagcgcattcattgtctatta

SEQ ID NO: 45118 - DNA, 75 bp, Artificial Sequence
  Synthetic
aatgagttcattaaaatatgtgatatcaacggaacatatctatataattatactattgctgttagtatgattatt

SEQ ID NO: 45119 - DNA, 75 bp, Artificial Sequence
  Synthetic
ggaaccaattactgataatgaagaagatcatactgtcacatatactagtgaaaatattaatacagtaagtacaac

SEQ ID NO: 45120 - DNA, 75 bp, Artificial Sequence
  Synthetic
tcaacggaacatatctatataattatactattgctgttagtatgattattgattccacggaagaactaccaacag

SEQ ID NO: 45121 - DNA, 75 bp, Artificial Sequence
  Synthetic
ttctacatataattatactatagataatggcactgttagtactactgaagaactaaaagtgactccatcaccaac

SEQ ID NO: 45122 - DNA, 75 bp, Artificial Sequence
  Synthetic
gtaagtcgatattatccgaagacatatacgaatacagatcgaaatcatttatattcgacttgagttcgttggagg

SEQ ID NO: 45123 - DNA, 75 bp, Artificial Sequence
  Synthetic
aataacataactcttttccatttttatcagtatgtatatctatatcaacgtcgtcgttgtagtgaatagtagtca

SEQ ID NO: 45124 - DNA, 75 bp, Artificial Sequence
  Synthetic
atcaacgatctaataacaatgtaagtactatatctattcagatactgagtaaaatattgggagtcaatgaaacag

SEQ ID NO: 45125 - DNA, 75 bp, Artificial Sequence
  Synthetic
cattcggagattctgaagaaccagtaacgtatgatattgatgactacgattgcacatctacaggttgcagcatag

SEQ ID NO: 45126 - DNA, 75 bp, Artificial Sequence
  Synthetic
tttgtacgtcacatcttcatccagtagacgacatagaatacatgcgcaatctctgccgcaatccatagctattct

SEQ ID NO: 45127 - DNA, 75 bp, Artificial Sequence
  Synthetic
ctcaatactattcaacttgttaaattaataatggatagtttaaaatagttattagtagtaataagatagtttaaa

SEQ ID NO: 45128 - DNA, 75 bp, Artificial Sequence
  Synthetic
taatgctaacagggactagttcatccgacaccttcatatcttccaccaatatcactgaatgtttgaaaacattaa

SEQ ID NO: 45129 - DNA, 75 bp, Artificial Sequence
  Synthetic
ttcacgaaaaatgatgaaggcaatcattcctcataagatgataaaaagtaaggtgtgtgtgtgtgtgtgtgtgtg

SEQ ID NO: 45130 - DNA, 75 bp, Artificial Sequence
  Synthetic
tgtgtgtgtgtgtgtgtgtgtgtgtgtgtgtgataaaaagtgtagtgagtgagtgagtgtatgagtgagtgagtg

SEQ ID NO: 45131 - DNA, 75 bp, Artificial Sequence
  Synthetic
aatgtaacatctaattgtgataaatgctcaatgaatttgatggcatccgttattcctgcagttaatgaatttaac

SEQ ID NO: 45132 - DNA, 75 bp, Artificial Sequence
  Synthetic
acaatcagactctggtatttatatatgcattaccacgaacgaaacctactgtgacatgatgtcgttaaatttgac

SEQ ID NO: 45133 - DNA, 75 bp, Artificial Sequence
  Synthetic
ctattataattgtaaactaactacaaattctacatgtgatgagttaatcaatttagatgaagtcattaacaacat

SEQ ID NO: 45134 - DNA, 75 bp, Artificial Sequence
  Synthetic
gatccaagatggtgagatagtcgttctcgttcagaatctttcgcagcataagtagtatgtcgatatacttatcgt

SEQ ID NO: 45135 - DNA, 75 bp, Artificial Sequence
  Synthetic
gtgtatataagacctacctctcttaaaatggttgagaccaagcttcgtcgtagaaacactgaagcggacgatgag

SEQ ID NO: 45136 - DNA, 75 bp, Artificial Sequence
  Synthetic
ctcgttcagaatctttcgcagcataagtagtatgtcgatatacttatcgttgaagactcttccagagacgatagc

SEQ ID NO: 45137 - DNA, 75 bp, Artificial Sequence
  Synthetic
aattctacatgtgatgagttaatcaatttagatgaagtcattaacaacataactctgacaaatattataagtagt

SEQ ID NO: 45138 - DNA, 75 bp, Artificial Sequence
  Synthetic
tgaattttctacatccaaggaattagattgtctttacgaatcatatggtgtaagcgatgatgtaagtcattgttt

SEQ ID NO: 45139 - DNA, 75 bp, Artificial Sequence
  Synthetic
tcgtgaaatataatataggaataattagcaccagaatagctatggattgcggcagagattgcacatgtattctat

SEQ ID NO: 45140 - DNA, 75 bp, Artificial Sequence
  Synthetic
tacaagagaatgaaatatatacatattttagttattgtgatatagattataagtctacagaactcgactttgtag

SEQ ID NO: 45141 - DNA, 75 bp, Artificial Sequence
  Synthetic
tctgtattctacgatagagtgctactttaagatgagacagatccgtgtcatcaaatatatactccattaaaatga

SEQ ID NO: 45142 - DNA, 75 bp, Artificial Sequence
  Synthetic
taatgttaattaattggcacgaatcaaaatacagaaaactagaaaaggaagaaggtcagcatctcttatatctat

SEQ ID NO: 45143 - DNA, 75 bp, Artificial Sequence
  Synthetic
gacaaaaataaaaaccacttatcgcatagagactattccaacctactactagagtatataaaatctcgttacatg

SEQ ID NO: 45144 - DNA, 75 bp, Artificial Sequence
  Synthetic
gcaatgacagggactgaactgggcacaaggagaggccattgtgaaggtagacgaaggttaacctgatggtagacc

SEQ ID NO: 45145 - DNA, 75 bp, Artificial Sequence
  Synthetic
caaggagaggccattgtgaaggtagacgaaggttaacctgatggtagacctgtagccgtctgtgctaatagaggg

SEQ ID NO: 45146 - DNA, 75 bp, Artificial Sequence
  Synthetic
taagggaatcgatcctaactttaaacaagacggatatacagcgttacattattattatttgtgtctcgcacacgt

SEQ ID NO: 45147 - DNA, 75 bp, Artificial Sequence
  Synthetic
aagtactccgtttacagaggcgcttgtgtctacgataaaccaaaagctttctagtgttaaagaggtaacttatgc

SEQ ID NO: 45148 - DNA, 75 bp, Artificial Sequence
  Synthetic
tggagctaatctaaacgcgttagataattgtggtaatacaccattccatttgtatcttagtattgaaatgtgtaa

SEQ ID NO: 45149 - DNA, 75 bp, Artificial Sequence
  Synthetic
gacacgtttacctagtgatagcgatagtgattttgaggatatacaaactgttgttaaggaatataatgaaagata

SEQ ID NO: 45150 - DNA, 75 bp, Artificial Sequence
  Synthetic
cataatagtcttgaaacagtatctatggaaattatggataatcggtactaataaaaaatagtttaactcttttta

SEQ ID NO: 45151 - DNA, 75 bp, Artificial Sequence
  Synthetic
acataatggagatatattccagcagaaaactggataaccgtccaaagtattatttgatatagtagtctttgatat

SEQ ID NO: 45152 - DNA, 75 bp, Artificial Sequence
  Synthetic
aaaactggataaccgtccaaagtattatttgatatagtagtctttgatataatagacgcgaccccgatagcagtt

SEQ ID NO: 45153 - DNA, 75 bp, Artificial Sequence
  Synthetic
tagcataggcaatgtaacgcgtctgttttatacattttttagttatctgatgaaagataaactaaatatataagt

SEQ ID NO: 45154 - DNA, 75 bp, Artificial Sequence
  Synthetic
ttgttaaggaatataatgaaagatatggtagacgagtcagtagaacacagtcatcaagtagtgaaagtgattttg

SEQ ID NO: 45155 - DNA, 75 bp, Artificial Sequence
  Synthetic
ttacctggtgtgaatacaggcagttctattgtgacacctctcaccagaagaggagctactagacgacctaaacgc

SEQ ID NO: 45156 - DNA, 75 bp, Artificial Sequence
  Synthetic
gcaatcatgaaacaatatatcgttctggcatgcatgtgcctggcggcagctgctatgcctgccagtcttcagcaa

SEQ ID NO: 45157 - DNA, 75 bp, Artificial Sequence
  Synthetic
tatataacttccgactacatacaacacgatattcttgtcatgttgatacatcactatgaaacaaatgttggagaa

SEQ ID NO: 45158 - DNA, 75 bp, Artificial Sequence
  Synthetic
acatccttctatgttgacatgtatatatccaggaattcttttattaatgtcaggaaatgtataaactaaaacatt

SEQ ID NO: 45159 - DNA, 75 bp, Artificial Sequence
  Synthetic
agtactctttgacaagattataaaaccctcttacttgagttttagctacgataactgaaaatggcatatatttga

SEQ ID NO: 45160 - DNA, 75 bp, Artificial Sequence
  Synthetic
acaggcagttctatcgtgacacctctcaccagaagaggagctactagacgacctaaacgcccatctacacctcca

SEQ ID NO: 45161 - DNA, 75 bp, Artificial Sequence
  Synthetic
agagtccgagtcagatccagatcccgaggtggaatcatcttctgattccacatcagtcgaggatgtagatcctcc

SEQ ID NO: 45162 - DNA, 75 bp, Artificial Sequence
  Synthetic
ccctcttacttgagttttagctacgataactgaaaatggcatatatttgataaactcctgaaagaataatttcgt

SEQ ID NO: 45163 - DNA, 75 bp, Artificial Sequence
  Synthetic
tcaccagaagaggagctactagacgacctaaacgcccatctacacctccacgcgaagatctaccaccgcttcctc

SEQ ID NO: 45164 - DNA, 75 bp, Artificial Sequence
  Synthetic
tagattatcttatacgtatcaacggagatataaatgcgttaaccgacaataacaaacacgctacccaactcatta

SEQ ID NO: 45165 - DNA, 75 bp, Artificial Sequence
  Synthetic
tgattattcatggccttaatagcattggatattttatcatccatgtttaaaaaatgacctatatgttaatacttg

SEQ ID NO: 45166 - DNA, 75 bp, Artificial Sequence
  Synthetic
tttgctttcgttaactgtttggaggaagaatctttgttattacatttaatctcgaaattcagagtgcacaccttt

SEQ ID NO: 45167 - DNA, 75 bp, Artificial Sequence
  Synthetic
tagtaagtttgtatcccctagacggtgtagaagatcaacctctggagtcgtatgtggtatgatacaatcaagacc

SEQ ID NO: 45168 - DNA, 75 bp, Artificial Sequence
  Synthetic
aactaaatgtcacgacgaaacaatgttgctcaaactgtccactgttctagacactacactatatgcagttttaag

SEQ ID NO: 45169 - DNA, 75 bp, Artificial Sequence
  Synthetic
caacgaccaaaaattgaaccagaatatgcggaggtcggtaatggcttacccaagaacaatgttcctgtgataggc

SEQ ID NO: 45170 - DNA, 75 bp, Artificial Sequence
  Synthetic
ataataacgataagtcctttaaaatatattctaatattatgaatgagagataccttaatgtatattataaagata

SEQ ID NO: 45171 - DNA, 75 bp, Artificial Sequence
  Synthetic
gatgatacctattcacttcttcaacggccaaaaattgaaccagaatatgcggaggttggtaatggtatacccaag

SEQ ID NO: 45172 - DNA, 75 bp, Artificial Sequence
  Synthetic
atgattagtattattaactagatttttactattgatcccttgtctacatattgtgctgaatttgtactatagtag

SEQ ID NO: 45173 - DNA, 75 bp, Artificial Sequence
  Synthetic
ttactattgatcccttgtctacatattgtgctgaatttgtactatagtagtaaaaatcataaactcctgtctctg

SEQ ID NO: 45174 - DNA, 75 bp, Artificial Sequence
  Synthetic
aagaattggtaacgttaaacattagttccaaatttaagtactttatcaatcggatacagacactcaagggaaaac

SEQ ID NO: 45175 - DNA, 75 bp, Artificial Sequence
  Synthetic
aatagacatagtaaaaaatatacatcgacgatgtcaaaaatatcaacaaaatttgataaatctatggcatttgga

SEQ ID NO: 45176 - DNA, 75 bp, Artificial Sequence
  Synthetic
tatgacacatgatttgtattaatatactctgtgaaatgtttatccaatgatgacatacgtagattcagtgatctc

SEQ ID NO: 45177 - DNA, 75 bp, Artificial Sequence
  Synthetic
actctgtgaaatgtttatccaatgatgacatacgtagattcagtgatctcaatgtctttgctgtagtttctttac

SEQ ID NO: 45178 - DNA, 75 bp, Artificial Sequence
  Synthetic
gaaggagtagggattcatcatcacgtacttgaaacaggaaacgctgtatatggaaaagttcaacatgattattct

SEQ ID NO: 45179 - DNA, 75 bp, Artificial Sequence
  Synthetic
gatatatattacctattttcaggacaggagaagccagtagatccagttattaagttttttaacacatacgctgga

SEQ ID NO: 45180 - DNA, 75 bp, Artificial Sequence
  Synthetic
gatccaaacgtgaatttaacgatagtggcattactaggcacaagttgagtgagtgttatattcttgtttggtaga

SEQ ID NO: 45181 - DNA, 75 bp, Artificial Sequence
  Synthetic
tggcattactaggcacaagttgagtgagtgttatattcttgtttggtagatctagattaatagccgtaataccta

SEQ ID NO: 45182 - DNA, 75 bp, Artificial Sequence
  Synthetic
gctagggtatatcacggtatcgactccacattcggaatgttgtatttggccggaggcctatcagttaccaaacaa

SEQ ID NO: 45183 - DNA, 75 bp, Artificial Sequence
  Synthetic
aaattatttaatacatactctggcttattgtccgataataataaaatgggtgtaagaaaatgtttgacgcctggg

SEQ ID NO: 45184 - DNA, 75 bp, Artificial Sequence
  Synthetic
gtatatttaccttcgatattcggagtcatgaaaaatgttatttctacattattaaactgattatctgttggtttt

SEQ ID NO: 45185 - DNA, 75 bp, Artificial Sequence
  Synthetic
tcatgaaaaatgttatttctacattattaaactgattatctgttggtttttgaggagtaacataattagagatag

SEQ ID NO: 45186 - DNA, 75 bp, Artificial Sequence
  Synthetic
tttcttagatgttatcgactcagagatcctatatctaaacacatcaaatttagttctagagtatcaactaaaggt

SEQ ID NO: 45187 - DNA, 75 bp, Artificial Sequence
  Synthetic
aagacaatgtggttaactgggagaaaataggaaagactagacgacctcttaatagacgtgttaaaaacggtgact

SEQ ID NO: 45188 - DNA, 75 bp, Artificial Sequence
  Synthetic
atcctatatctaaacacatcaaatttagttctagagtatcaactaaaggtggcttgtccaataggaacattaaga

SEQ ID NO: 45189 - DNA, 75 bp, Artificial Sequence
  Synthetic
tattgtccgataataataaaatgggtgtaagaaaatgtttgacgcctggggacgacacacttatttatatcgcat

SEQ ID NO: 45190 - DNA, 75 bp, Artificial Sequence
  Synthetic
aattagaactagattaaagtaataggaattacttttcattttgtatcacgattataaaaagataatatatctcaa

SEQ ID NO: 45191 - DNA, 75 bp, Artificial Sequence
  Synthetic
attcagtgcaaagtgtcctcctattgaagacagtcttttatcgcatagatataaagactatgtggttaaatggga

SEQ ID NO: 45192 - DNA, 75 bp, Artificial Sequence
  Synthetic
attataaaaagataatatatctcaataactgctatgaagacacagtatcactttcctatcaatctctgttttttg

SEQ ID NO: 45193 - DNA, 75 bp, Artificial Sequence
  Synthetic
aaatccatgtaggggatactgctcacgttttttctttggtacaaaatttcacacaagtttttatacagacaaatt

SEQ ID NO: 45194 - DNA, 75 bp, Artificial Sequence
  Synthetic
gggtgaattcaaaaaaattaataatacctagaaaatattccacgagcattccttttatcgatatagcatttggat

SEQ ID NO: 45195 - DNA, 75 bp, Artificial Sequence
  Synthetic
agcctgtcaatatcgacatcattgaacaacggattcatcttacacttttcacgaacatcctgagatacattgttc

SEQ ID NO: 45196 - DNA, 75 bp, Artificial Sequence
  Synthetic
atttgtggacattgtccgagtgacacattcacgtcaatatataatcgttctccttggtgtcatagttgtagaggt

SEQ ID NO: 45197 - DNA, 75 bp, Artificial Sequence
  Synthetic
tctcaaacttttattgtacatactacttgcagtattctactaagaacagctacatgggatcagtttagaaacaga

SEQ ID NO: 45198 - DNA, 75 bp, Artificial Sequence
  Synthetic
tcatgcattccaaaaacatatgaactaggtactcatgataagtatggtatagagttatattgtggaattctttac

SEQ ID NO: 45199 - DNA, 75 bp, Artificial Sequence
  Synthetic
gaattaattattcataatccagcattagaagatagcggaagatacgactgttatgttcattacgacgacgttaga

SEQ ID NO: 45200 - DNA, 75 bp, Artificial Sequence
  Synthetic
atgttgtattctaatcccatatttattatttttttctgtaatagttagaaaaatacatttgatggtctatgttct

SEQ ID NO: 45201 - DNA, 75 bp, Artificial Sequence
  Synthetic
tacctttagcaaatacgattttaacgacaccataatagatcctaatggtgtggcgggtcatgctagcttttgtac

SEQ ID NO: 45202 - DNA, 75 bp, Artificial Sequence
  Synthetic
gacaccataatagatcctaatggtgtggcgggtcatgctagcttttgtaccaatagaagcagcaaccaatgtttc

SEQ ID NO: 45203 - DNA, 75 bp, Artificial Sequence
  Synthetic
cattagcaatgttttcctcaatcatagtcatgacattgtatatatcttccatttccttaaatctattgctaaaca

SEQ ID NO: 45204 - DNA, 75 bp, Artificial Sequence
  Synthetic
tggcgggtcatgctagcttttgtaccaatagaagcagcaaccaatgtttctggtcagaacctatgatattggaag

SEQ ID NO: 45205 - DNA, 75 bp, Artificial Sequence
  Synthetic
caaaacatataaatctaaaatggatggatgagttatacgctattaatttagaaaaatatattttaatctgataac

SEQ ID NO: 45206 - DNA, 75 bp, Artificial Sequence
  Synthetic
actggaaaggaattaattattcataatccagagtttgaagatagcggaagatacgactgttacgttcattacgac

SEQ ID NO: 45207 - DNA, 75 bp, Artificial Sequence
  Synthetic
ggatgagttatacgctattaatttagaaaaatatattttaatctgataactttaaacattttttgatggtgataa

SEQ ID NO: 45208 - DNA, 75 bp, Artificial Sequence
  Synthetic
taaaaaagttttatctctttctctcttcgatggtctcacaaaaatattaaacctctttctgatggagtcgtaaaa

SEQ ID NO: 45209 - DNA, 75 bp, Artificial Sequence
  Synthetic
ctcaattggcacgaacaaaaatacgggaaattacaaaaggaagaaggacaccatctactttatctattcataaaa

SEQ ID NO: 45210 - DNA, 75 bp, Artificial Sequence
  Synthetic
agtatataataatatcaaaaagatggatataaagaatttgcttggtgtatgtactattttgtacatcactacatt

SEQ ID NO: 45211 - DNA, 75 bp, Artificial Sequence
  Synthetic
tgatttttcttaccctctagagtttcctacagtcgtgggtcacacatttttttctagacactaaataaaatagta

SEQ ID NO: 45212 - DNA, 75 bp, Artificial Sequence
  Synthetic
aatatttttatgagaccattgaagagagaagagagaaagagaaagagaataaaaatattttttacgactccatca

SEQ ID NO: 45213 - DNA, 75 bp, Artificial Sequence
  Synthetic
ccaccacatgctccggtaaacgggacatgtgaagagggagaatatcttgataggacgcataatcaatgttgtaat

SEQ ID NO: 45214 - DNA, 75 bp, Artificial Sequence
  Synthetic
tctgcacacataactatgataaacgattcaaatcagatattatagttctaatatttaatagtatcagtggtattc

SEQ ID NO: 45215 - DNA, 75 bp, Artificial Sequence
  Synthetic
aaaaatattttttacgactccatcagaaagaggtttaatatttttgtgagaccattgaagagagaaagagaaaga

SEQ ID NO: 45216 - DNA, 75 bp, Artificial Sequence
  Synthetic
gtgatcatatcgtatcacatattgagacagaaaaagaagaagtcgcgagaggtaactttttgtgaatgtaggaac

SEQ ID NO: 45217 - DNA, 75 bp, Artificial Sequence
  Synthetic
accacattgtctagaggaatgccatatagatcaatgtattgcgataacagacgaccaggttgttattatgcagga

SEQ ID NO: 45218 - DNA, 75 bp, Artificial Sequence
  Synthetic
tgaattattattactaacttacgcatccatctataataatggacgaagataagatacgactatctaagtatttgt

SEQ ID NO: 45219 - DNA, 75 bp, Artificial Sequence
  Synthetic
ttcaaatcagatattatagttctaatgtttaataaacacagcggttttccattttggaccatgtacacaggaagt

SEQ ID NO: 45220 - DNA, 75 bp, Artificial Sequence
  Synthetic
aatcagatctgcattatggaccagaaataatgcttaaggaaacatatgacgcaaacagtattgatccacgagtta

SEQ ID NO: 45221 - DNA, 75 bp, Artificial Sequence
  Synthetic
ggtggctttattttatccttgtccaatgtgaattgaatgggagcggatgcgggtttcgtacgtagatagtacatt

SEQ ID NO: 45222 - DNA, 75 bp, Artificial Sequence
  Synthetic
gcaaacagtattgatccacgagttataacaaagtcaaagacgcactttcctactccaataagtgtaaaattcacg

SEQ ID NO: 45223 - DNA, 75 bp, Artificial Sequence
  Synthetic
aagactgaagattgtcgagattgtgtaccaaaaaggagctgtccatgcggatactttggtggaatagataaatta

SEQ ID NO: 45224 - DNA, 75 bp, Artificial Sequence
  Synthetic
tggtatgaacagcgagagtgagagtgagagtgatagtgataatatatcaatcaaaacagaatatgagaatgaata

SEQ ID NO: 45225 - DNA, 75 bp, Artificial Sequence
  Synthetic
tagatacttgaacttaacaatatcgtttataaaaaaatcattcatgggtctgtgtttggacgcttttcatagact

SEQ ID NO: 45226 - DNA, 75 bp, Artificial Sequence
  Synthetic
gcataatatttcgtatacaagtcacgtatttctggtaggttcatgttggaaaatatctccataactaattctttt

SEQ ID NO: 45227 - DNA, 75 bp, Artificial Sequence
  Synthetic
cgataggtgtaagaactctcttcattactatatattgtctcatagagaatctcaatctctatccaaggatgtaat

SEQ ID NO: 45228 - DNA, 75 bp, Artificial Sequence
  Synthetic
catgtacagtgagaaataaaaatgtagactttggatataactatggacatattatttctaatatggtttatgcac

SEQ ID NO: 45229 - DNA, 75 bp, Artificial Sequence
  Synthetic
gcgggtttagacggcaacatagaagcgtgtaaacgaaaactatatactatagtcagcacgcttccatgtcctgca

SEQ ID NO: 45230 - DNA, 75 bp, Artificial Sequence
  Synthetic
aaatatctccataactaattcttttgggatggtattcaagtaagttggttgatcatggtctatgtagtagatgac

SEQ ID NO: 45231 - DNA, 75 bp, Artificial Sequence
  Synthetic
atgaatatgaattctatgatgaaacacaagatcaaagtacacaactagtaggttacgacattaaactcaaaacca

SEQ ID NO: 45232 - DNA, 75 bp, Artificial Sequence
  Synthetic
aatctactagtcaggattatggagatggtaccaactatacatttaaatctgtaaatagatcagatcatgagtgtg

SEQ ID NO: 45233 - DNA, 75 bp, Artificial Sequence
  Synthetic
atattatttctaatatggtttatgcacaatctactagtcaggattatggagatggtaccaaatatacatttaaat

SEQ ID NO: 45234 - DNA, 75 bp, Artificial Sequence
  Synthetic
cgatatcgtgatatatgtttgattcggcaattaattctttatcatagttgccatacactggaatttttatattat

SEQ ID NO: 45235 - DNA, 75 bp, Artificial Sequence
  Synthetic
ttaacgatctttataatatatagtatccacctaccaaagtatagttgtattttttctcatgcgatgtgtgtaaaa

SEQ ID NO: 45236 - DNA, 75 bp, Artificial Sequence
  Synthetic
tatttaacaatatgttgtatatagttattccatccgttatatagatagattttaacgacatggcatcactattat

SEQ ID NO: 45237 - DNA, 75 bp, Artificial Sequence
  Synthetic
tttttctcatgcgatgtgtgtaaaaaaactgatattatataaatattttagtgccgtataatgaagatgacgatg

SEQ ID NO: 45238 - DNA, 75 bp, Artificial Sequence
  Synthetic
aacgtatgaaggtctatgctttagtgttactacatctaaagatcattgtgctacaggtattggttggttaaaatc

SEQ ID NO: 45239 - DNA, 75 bp, Artificial Sequence
  Synthetic
atattcgtagtcttcttcatcgtcttcctctgtatcacgtactaaaatatcatccctctgttgtatcttaaattc

SEQ ID NO: 45240 - DNA, 75 bp, Artificial Sequence
  Synthetic
ttggaaaagcgactggcctgactatgatccatgtaagtcatatattcatatagaatatagagacatatggataga

SEQ ID NO: 45241 - DNA, 75 bp, Artificial Sequence
  Synthetic
attggttttatattacaagatcattggattattactgttcgtaccaagatgattggaaaagcacctggcctgact

SEQ ID NO: 45242 - DNA, 75 bp, Artificial Sequence
  Synthetic
tatagcctccttgaacttggaatagaacgacggaaccattaatattagataactaatgacagttggactaccttc

SEQ ID NO: 45243 - DNA, 75 bp, Artificial Sequence
  Synthetic
aacgacggaaccattaatattagataactaatgacagttggactaccttcccatacatcgcttactttattcatg

SEQ ID NO: 45244 - DNA, 75 bp, Artificial Sequence
  Synthetic
gtatctcactccgatgatccatgtaaaccaaggacgagataagacactctcatttcctcatccacaacccccatt

SEQ ID NO: 45245 - DNA, 75 bp, Artificial Sequence
  Synthetic
attctaatgaatacgtgaataaagaaattagtaacaaattgaatgatctgtacaatgaatacaagaacattatgg

SEQ ID NO: 45246 - DNA, 75 bp, Artificial Sequence
  Synthetic
ttcagtccctgtcattgccacgctactaaggactccctgaataccgtggctgacgtcagacattgtctgactgaa

SEQ ID NO: 45247 - DNA, 75 bp, Artificial Sequence
  Synthetic
cttacacattcgaattcactcatgacaattctaacgaatatgtagataaagaaattagtaacaaattaaatgatc

SEQ ID NO: 45248 - DNA, 75 bp, Artificial Sequence
  Synthetic
aggtaatcgactaatgagaaaactagtccacttacgagcactatatacacgtaatgccaaatagaaaatagtttt

SEQ ID NO: 45249 - DNA, 75 bp, Artificial Sequence
  Synthetic
ttgacttcagagggtagagaaatagcaagtgttaatatagatggtaatctgttagatattgcatatcaagcagat

SEQ ID NO: 45250 - DNA, 75 bp, Artificial Sequence
  Synthetic
caagtgttaatatagatggtaatctgttagatattgcatatcaagcagataaggaaaagatggctgacatacaga

SEQ ID NO: 45251 - DNA, 75 bp, Artificial Sequence
  Synthetic
acatgaagttattagtgtataacggaaatgatataaacgcacgaggtgaagatacacaaatgcgaactccattac

SEQ ID NO: 45252 - DNA, 75 bp, Artificial Sequence
  Synthetic
tatctaaaaaattatagaaatttcgattatccatttttcaggaagttagttttgactaataaacattgtctcaac

SEQ ID NO: 45253 - DNA, 75 bp, Artificial Sequence
  Synthetic
ccgttataatatttattaatatcaaacccgtctagagatctaataatatctagacactcggtatctatgtatgac

SEQ ID NO: 45254 - DNA, 75 bp, Artificial Sequence
  Synthetic
aaagatataaaagacattatagaatccgaagaaggtaagagatgttgtataatagatgttaagaacaatcgtgtt

SEQ ID NO: 45255 - DNA, 75 bp, Artificial Sequence
  Synthetic
attcgacttggtgtttgaaaacagaaacatcttatacaagtcggatgtcattcacgacatcatcagacacagact

SEQ ID NO: 45256 - DNA, 75 bp, Artificial Sequence
  Synthetic
aatctctgaataattccggtttagcatgtttactgagtattaaaagtttacgtagtatctttatattttgtatat

SEQ ID NO: 45257 - DNA, 75 bp, Artificial Sequence
  Synthetic
atgtttactgagtattaaaagtttacgtagtatctttatattttgtatattatcgatattattaatattatggat

SEQ ID NO: 45258 - DNA, 75 bp, Artificial Sequence
  Synthetic
tatccgatactataatgaaaagattatagacgcatttatagaattaggagccgatctaactattccaaataacga

SEQ ID NO: 45259 - DNA, 75 bp, Artificial Sequence
  Synthetic
ctcctagttctataaatgtatctatgattgtttcattgtaatctagaaaattgcttcttgtaaaaccatgtaagt

SEQ ID NO: 45260 - DNA, 75 bp, Artificial Sequence
  Synthetic
atattattagatcgttggatggattcgatatcaatggttactttgaaggacgtacaccacttcattgcgctatac

SEQ ID NO: 45261 - DNA, 75 bp, Artificial Sequence
  Synthetic
taaggaactaaagcgctatagagtagacattaatagaatgaagaatgcctacatatcaggcgtctccatgtttga

SEQ ID NO: 45262 - DNA, 75 bp, Artificial Sequence
  Synthetic
tgtttaaggaatttgataaaaacgtaagtgctattataataaaagaagaagataattatctaaacagttctccga

SEQ ID NO: 45263 - DNA, 75 bp, Artificial Sequence
  Synthetic
cgtacaccacttcattgcgctatacaacataacttcactcagattgctgaatacttattagatcgaggagctgat

SEQ ID NO: 45264 - DNA, 75 bp, Artificial Sequence
  Synthetic
agcaaaatggttgatgccattcgaaaaggaatttaccagtgattatcccttttacgtatcaccaacggaaatggt

SEQ ID NO: 45265 - DNA, 75 bp, Artificial Sequence
  Synthetic
atattgctctccaacaactaattaaatcacattcttaatattagaatattatatagttaagatttttactaattg

SEQ ID NO: 45266 - DNA, 75 bp, Artificial Sequence
  Synthetic
gtcattattttaatattggcaatttatatagcgcgcaataaatacagaaccaggaaatataaaataatgaaagat

SEQ ID NO: 45267 - DNA, 75 bp, Artificial Sequence
  Synthetic
agtcaaattttttattatctaatagataaacatgaactaaagacgatctctgtttcatagtaagataatcgttta

SEQ ID NO: 45268 - DNA, 75 bp, Artificial Sequence
  Synthetic
ataaacatgaactaaagacgatctctgtttcatagtaagataatcgtttagtatatcaatcatttctaaattcat

SEQ ID NO: 45269 - DNA, 75 bp, Artificial Sequence
  Synthetic
gatgtgatagactgaccagtattgatgacgtcagacaatgtttgactgaatatatttattggtcgtcctatgcat

SEQ ID NO: 45270 - DNA, 75 bp, Artificial Sequence
  Synthetic
catagaacaaaatctaacagatacaaattttaagaaatggtgtaactctctggaagctacgtttatcgatgtaca

SEQ ID NO: 45271 - DNA, 75 bp, Artificial Sequence
  Synthetic
atattcacaagtattattaaaaatgagtatcggtagttacattaccatatcatccatgctcatatggatctccat

SEQ ID NO: 45272 - DNA, 75 bp, Artificial Sequence
  Synthetic
cgtgtattagaatactttccgaataagtcttctaaatattgtataattatgaaaaactatgctatgcgattatga

SEQ ID NO: 45273 - DNA, 75 bp, Artificial Sequence
  Synthetic
ccattatataatcgatgatacatgtattagaatactttccgaataagtcttctaaatattgtattaattatgaaa

SEQ ID NO: 45274 - DNA, 75 bp, Artificial Sequence
  Synthetic
cgtcagaatcatttatcataactatgtttaataataattcatcaacgaatatcgataacatgtgtcatttatact

SEQ ID NO: 45275 - DNA, 75 bp, Artificial Sequence
  Synthetic
tcctcgagtatatgatcgcatctcgatctcaatcatcttatttgagtcgtattcctaatgagatattactcaaaa

SEQ ID NO: 45276 - DNA, 75 bp, Artificial Sequence
  Synthetic
cttgagatgctcaattacgtggattataacatcatattccggcgtatgaattgatgagttgtacagcttgacatt

SEQ ID NO: 45277 - DNA, 75 bp, Artificial Sequence
  Synthetic
atggcaaaattcttttcgttggcagatattgctctccaacaactaattaagcacattcttgatattagaatatta

SEQ ID NO: 45278 - DNA, 75 bp, Artificial Sequence
  Synthetic
gtatttgtgtaatgaatatctttccatctcgacgaagtataacatatttgataaaaattcaataatctaccattg

SEQ ID NO: 45279 - DNA, 75 bp, Artificial Sequence
  Synthetic
tgtgttgttttctggattctcaaagtattgagaatgagatggagattcatgatacttcttgctagcaatataaaa

SEQ ID NO: 45280 - DNA, 75 bp, Artificial Sequence
  Synthetic
ttctctattgtttagactgtttgtagaatgctgtgatataaacaaactagtagaaggtacgactccgttacactg

SEQ ID NO: 45281 - DNA, 75 bp, Artificial Sequence
  Synthetic
ttatctaatgaatgaaagatttgaatcatctgttttaaaaaacctattaaaggagtatggaatgaatacgtttaa

SEQ ID NO: 45282 - DNA, 75 bp, Artificial Sequence
  Synthetic
aaggatgaaaaaggacatattcctctacaccactatctgattcattcactatcaatcgataacaagatctttgat

SEQ ID NO: 45283 - DNA, 75 bp, Artificial Sequence
  Synthetic
gatacttcttgctagcaatataaaagtatttgtgtaatgaatatctttccatctcgacgaagtataacatatttg

SEQ ID NO: 45284 - DNA, 75 bp, Artificial Sequence
  Synthetic
attattatatggtttattatcacaattcaaccatggcgattgtgaattagtcctatatagacctacccaataatc

SEQ ID NO: 45285 - DNA, 75 bp, Artificial Sequence
  Synthetic
atgaagttgagaatgatatctttgatatgctttctgatagtatagatagctttagcgaatataaaaatatattaa

SEQ ID NO: 45286 - DNA, 75 bp, Artificial Sequence
  Synthetic
cggatgtcttctgttcttaataccgtatacaggtcggtgtcggagattcgaatctctttgagacgacttatgtca

SEQ ID NO: 45287 - DNA, 75 bp, Artificial Sequence
  Synthetic
gtattactgggtacgggttcgcatttatctgcggaagagacggtgtgagaatatgttccgagaccacacggagaa

SEQ ID NO: 45288 - DNA, 75 bp, Artificial Sequence
  Synthetic
tgtactcggacgaccactaccggtctcagtgaatccatctcaacttcggaactaactattactatgaatcataaa

SEQ ID NO: 45289 - DNA, 75 bp, Artificial Sequence
  Synthetic
acaatttccgaagatggaaatgagatatagacatgcaataaatctaatcgaagacatggttactccttaaaaaaa

SEQ ID NO: 45290 - DNA, 75 bp, Artificial Sequence
  Synthetic
atgctaaacgcccgttcatatttttacaatattcaaacgatgctgtccaattggtagtatcttctgaaaagtaat

SEQ ID NO: 45291 - DNA, 75 bp, Artificial Sequence
  Synthetic
acaatattcaaacgatgctgtccaattggtagtatcttctgaaaagtaataacatatgttgtttatactaatggt

SEQ ID NO: 45292 - DNA, 75 bp, Artificial Sequence
  Synthetic
cccgacacaatcagactctggtatttatatatgcattaccaagaacgagacctactgtgatatgatgtcgttaaa

SEQ ID NO: 45293 - DNA, 75 bp, Artificial Sequence
  Synthetic
ttggtagtatcttctgaaaagtaataacatatgttgtttatactaatggtgtttttaggacatatcttgtatctt

SEQ ID NO: 45294 - DNA, 75 bp, Artificial Sequence
  Synthetic
aaaagaaatttattaaagagttggtaaaatatggagccgatattaataaagtaaataatataggaaatacgcctc

SEQ ID NO: 45295 - DNA, 75 bp, Artificial Sequence
  Synthetic
atatgtatgtaccataagttatatgagatggttcatattccaatagtcaaatatattaaacgtatgctgatgagt

SEQ ID NO: 45296 - DNA, 75 bp, Artificial Sequence
  Synthetic
cttttgtcattgggagctgacttgacaatacaaaacaatgatcgtctaactcccataatggaatatataaaatgt

SEQ ID NO: 45297 - DNA, 75 bp, Artificial Sequence
  Synthetic
acgcatttaaaaaaacagtattcgaaatattattcgatattatttctactaacgacaatgtatatttatacagag

SEQ ID NO: 45298 - DNA, 75 bp, Artificial Sequence
  Synthetic
ctttctctcttcgatggtctcacaaaaatattaaacctctttctgatggagtcgtaaaatatttttattctcatt

SEQ ID NO: 45299 - DNA, 75 bp, Artificial Sequence
  Synthetic
aatactataatgacattacacctctacataatgcttgtatagcgtgcaacgttgatataatgtcttatctcgtat

SEQ ID NO: 45300 - DNA, 75 bp, Artificial Sequence
  Synthetic
acaatactctccgagtgtaaatattactggtatatggttccaccgattcattatttcccaaaatttgagcagttg

SEQ ID NO: 45301 - DNA, 75 bp, Artificial Sequence
  Synthetic
aatgatgtatatattatctcctattgatgtggctgaacagatacctgctacgggcattttcatctttaaaactct

SEQ ID NO: 45302 - DNA, 75 bp, Artificial Sequence
  Synthetic
atcttatcagaaacggactagatatatctttatccgtaatcaaatcattacttagtattattccatatcttccaa

SEQ ID NO: 45303 - DNA, 75 bp, Artificial Sequence
  Synthetic
cgttgatataatgtcttatctcgtatatattggatgtaatatcaatctcccaactaaagacaacaagagtatatt

SEQ ID NO: 45304 - DNA, 75 bp, Artificial Sequence
  Synthetic
ccactttccatcttctggagatcttctttcaatggtaggattataatatctgttgttataatcgtaatatccaca

SEQ ID NO: 45305 - DNA, 75 bp, Artificial Sequence
  Synthetic
gacttttcccatgtacacggacattatagagaattgtaacttacgcatgagacgtaaatataaactcataaatac

SEQ ID NO: 45306 - DNA, 75 bp, Artificial Sequence
  Synthetic
atcaggatctgtaaagcgagctgaatcagtatccgtatctgaatgcggttcagaagttccacctataaggtatat

SEQ ID NO: 45307 - DNA, 75 bp, Artificial Sequence
  Synthetic
acaatttcataaaagaatacaataatcaatgtttaaatcataattacagagaattatttgttaatttcataacat

SEQ ID NO: 45308 - DNA, 75 bp, Artificial Sequence
  Synthetic
tcagtatccgtatctgaatgcggttcagaagttccacctataaggtatatataatcatttacaacggcaagtcca

SEQ ID NO: 45309 - DNA, 75 bp, Artificial Sequence
  Synthetic
tccctcttaaatggactagctttttgattagtcgtctaccgcctaaaagtgtcatatgctcactgactaaccata

SEQ ID NO: 45310 - DNA, 75 bp, Artificial Sequence
  Synthetic
ctcaaacaagaaaactattataatatattaagatatgaagatataaaatattacaacctagttaatgatatctat

SEQ ID NO: 45311 - DNA, 75 bp, Artificial Sequence
  Synthetic
gttattatctgttgatgcatctagttagtgtgtataaataattatttcaatatactagttaaaattttaagattt

SEQ ID NO: 45312 - DNA, 75 bp, Artificial Sequence
  Synthetic
ttttgtattataactatatacattagtagttgtaaaattatatgtctgtttaccacacattatgtatacaatatc

SEQ ID NO: 45313 - DNA, 75 bp, Artificial Sequence
  Synthetic
tacgatttaaatactattttgtatggtcgtaaccatctaaaacattattataaatttaactagatattaatgatg

SEQ ID NO: 45314 - DNA, 75 bp, Artificial Sequence
  Synthetic
cattgagaacaaaatacatgttgaactcccacccatgataaagaatagatgtcgtttttcattggctgtaatcga

SEQ ID NO: 45315 - DNA, 75 bp, Artificial Sequence
  Synthetic
tctcccataagaaagtgagttacgaagatatcatcggttcaacgatcgtcgatacaaaatgcgtcaagaatctag

SEQ ID NO: 45316 - DNA, 75 bp, Artificial Sequence
  Synthetic
ctcccacccatgataaagaatagatgtcgtttttcattggctgtaatcgatgacacaatttatgctataggtggt

SEQ ID NO: 45317 - DNA, 75 bp, Artificial Sequence
  Synthetic
ggattttctaggaacagatggaggcagattttcacatcctagttcgttcagaatatacttcttagataatagctc

SEQ ID NO: 45318 - DNA, 75 bp, Artificial Sequence
  Synthetic
agttaagcgaatacgatttaaatactattttgtacggtcgtaaccatctaaaacattattataaatttaactaga

SEQ ID NO: 45319 - DNA, 75 bp, Artificial Sequence
  Synthetic
gaatatacttcttagataatagctcatctactctaattagtttactaatattttccttgaccatgttgatacgtt

SEQ ID NO: 45320 - DNA, 75 bp, Artificial Sequence
  Synthetic
aagagagaaagagaataaaaatatttttgtaaaacttttttatgagaccattgaagagagaaagagaataaaaat

SEQ ID NO: 45321 - DNA, 75 bp, Artificial Sequence
  Synthetic
atacatcttgttggtatatatgttcgtagtcgtaagtggagacgttccttatgaacacattaatgggaaatgtaa

SEQ ID NO: 45322 - DNA, 75 bp, Artificial Sequence
  Synthetic
actactacattattaaatcatgaagtcatatatattgctattgctgctttcatgtataatcataataaacagcga

SEQ ID NO: 45323 - DNA, 75 bp, Artificial Sequence
  Synthetic
gattttgtgtcgaggtcgtcgttttcaaatatggagctgataatatcaaatgacaaagatataaacgtatcatct

SEQ ID NO: 45324 - DNA, 75 bp, Artificial Sequence
  Synthetic
cattttatttctagacgttgccagaaaatcctgtaatacttttagttttttgggctgtgaataaagtatcgccct

SEQ ID NO: 45325 - DNA, 75 bp, Artificial Sequence
  Synthetic
tatgggagacattgcctaacttctggactggaactataaaaccaggcgtggtctcgcataaagatgatatatatg

SEQ ID NO: 45326 - DNA, 75 bp, Artificial Sequence
  Synthetic
gaaatatactttaactaatatagttctcgagtatatgatctcatctcgatctcaatcatcttatttgagtcgtat

SEQ ID NO: 45327 - DNA, 75 bp, Artificial Sequence
  Synthetic
gaatgtatatgactcattcctgtaataccacttctaatacaaaatgtgacaagtgcctggcacctttacatccat

SEQ ID NO: 45328 - DNA, 75 bp, Artificial Sequence
  Synthetic
tacgtaatctatatacaagatatatgagagagaatgatatcgcagagtatcatatagagaatacgaggtctgttt

SEQ ID NO: 45329 - DNA, 75 bp, Artificial Sequence
  Synthetic
tttgttatatttagagaatctgctagtaccaacatatcctgtacattgtcttcatttatgtccaattcattagta

SEQ ID NO: 45330 - DNA, 75 bp, Artificial Sequence
  Synthetic
ctttatgcctcattcagaaacggtaactgtagtaggagactgtctctctaatctcgatgtatatatagtatatgc

SEQ ID NO: 45331 - DNA, 75 bp, Artificial Sequence
  Synthetic
atgtgtaccacaaacaaagtgtgattctggttacggtgtatatggctactcatctaaaggagatgtaatatgtaa

SEQ ID NO: 45332 - DNA, 75 bp, Artificial Sequence
  Synthetic
tgcttacggaacatctactaacgatttttttatacttgtattattaatgatatgtaacaataccgacttgtcaaa

SEQ ID NO: 45333 - DNA, 75 bp, Artificial Sequence
  Synthetic
aacattcaaatagttatatcatgcacaatatactacccatctactaaatataatagaataaatgagtatgattat

SEQ ID NO: 45334 - DNA, 75 bp, Artificial Sequence
  Synthetic
tcaaatcatgattgtcgtatgaagttagatttatatctgtattaacatcaaactcaaatctatgtttaaagaagc

SEQ ID NO: 45335 - DNA, 75 bp, Artificial Sequence
  Synthetic
tttatcattaccgctgcattcttatattctttgcttacggaacctatatttagaaacgtctactaacgatttttt

SEQ ID NO: 45336 - DNA, 75 bp, Artificial Sequence
  Synthetic
taacaagacctcttgtaattcgagtataggaagtagcagtaccatatcaacttccgagttaacaattactctaaa

SEQ ID NO: 45337 - DNA, 75 bp, Artificial Sequence
  Synthetic
gggtcttgatgttgctgtctttctcttcttcgctacatttgatgttgatagacatttcacagtctttgatcatag

SEQ ID NO: 45338 - DNA, 75 bp, Artificial Sequence
  Synthetic
gagagatctagtaactagagtaaatctacagatgttcgataaagatgccgtcaaaaatattgtacagtacttata

SEQ ID NO: 45339 - DNA, 75 bp, Artificial Sequence
  Synthetic
cttccgagttaacaattactctaaaacatgaggattgtactcctgtctttattggagattactattcagtcgttg

SEQ ID NO: 45340 - DNA, 75 bp, Artificial Sequence
  Synthetic
gttaataggacacatataataatgaatattaaaacactagtatagcaggagtttatacctacaaaacatcataaa

SEQ ID NO: 45341 - DNA, 75 bp, Artificial Sequence
  Synthetic
tgtttccagtgataaaacatagatggcataacgcacacgttgtaaaacataaaggaatatacaaagttagtgcag

SEQ ID NO: 45342 - DNA, 75 bp, Artificial Sequence
  Synthetic
ctcacaacgcagtgcaagattaatctagaaatcaaatgtaattctggaggagaatctagacaactaacacccacg

SEQ ID NO: 45343 - DNA, 75 bp, Artificial Sequence
  Synthetic
agtatcctcttcaaattcctcatcggtattgacatacgcaatatagagatggagatctgatagacagttgcctat

SEQ ID NO: 45344 - DNA, 75 bp, Artificial Sequence
  Synthetic
aagccaggaacatattcagatcatcgatgtgataaatacagcgataccatttgtgggcattgtccgagtgacaca

SEQ ID NO: 45345 - DNA, 75 bp, Artificial Sequence
  Synthetic
gatggatgaaatctttgggcatttggtgaatccaaagtccatgttaagacctccaccgacgacagtgtaataagt

SEQ ID NO: 45346 - DNA, 75 bp, Artificial Sequence
  Synthetic
cttcaggattctttacaggagaaaatagatatcaaaatacttcaaaggtgtgcactctgaatttcgagattaaat

SEQ ID NO: 45347 - DNA, 75 bp, Artificial Sequence
  Synthetic
accgcactacattgctatttgtacaataattactttactaacaacgttctgaaggtattattaaatcatggagtg

SEQ ID NO: 45348 - DNA, 75 bp, Artificial Sequence
  Synthetic
aaagctctaaatccaaattcggatctaattaagatagagactccaaacgagttaagttttttaagaagccttaga

SEQ ID NO: 45349 - DNA, 75 bp, Artificial Sequence
  Synthetic
gaaggtattattaaatcatggagtggatgtaacgatgaaaaccagtagcggacacatgcctatttatatattgct

SEQ ID NO: 45350 - DNA, 75 bp, Artificial Sequence
  Synthetic
ttatcatactagtcatatcctaaatgttgatcatattccaccaaatgattgtaaaagagattgagattaaatcgt

SEQ ID NO: 45351 - DNA, 75 bp, Artificial Sequence
  Synthetic
aactgtgttacatgtgctcctaaaacaaaatgtggtcgtgggtatggagaaaccaaggttgttagttaataatat

SEQ ID NO: 45352 - DNA, 75 bp, Artificial Sequence
  Synthetic
ttctaaacatcttacatatacagacaagttttatatttctaagaatatagttaccagcgttgatatgatggtgag

SEQ ID NO: 45353 - DNA, 75 bp, Artificial Sequence
  Synthetic
cattattgacttaacgatgacgaaagttatcatcatcttaggattcttgattattaatacaaattcattgtctat

SEQ ID NO: 45354 - DNA, 75 bp, Artificial Sequence
  Synthetic
attcgaataaaactataaatatgtattcttcgtgtgtgcaatttctattagataataaaccgaatagaaacatta

SEQ ID NO: 45355 - DNA, 75 bp, Artificial Sequence
  Synthetic
aacagtaattgtcaattcagaagtcgtgataacatctgatgattgttttgtacttagtcgattacaagatgatac

SEQ ID NO: 45356 - DNA, 75 bp, Artificial Sequence
  Synthetic
atgatccatgtaaaccaaggacgagataagacactctcattcctcatccacgaccccattaaaaaaatggaaaat

SEQ ID NO: 45357 - DNA, 75 bp, Artificial Sequence
  Synthetic
taatgtatttgtcttcgaagaaaccgggtggaggataatcatttgcaaacgatgcaacaaataatgatgcgaata

SEQ ID NO: 45358 - DNA, 75 bp, Artificial Sequence
  Synthetic
atattaaacctctttctgatggagtcgtaaaaaaagttttatctctttctctcttcgatggtctcacaaaaatat

SEQ ID NO: 45359 - DNA, 75 bp, Artificial Sequence
  Synthetic
gatgcaacaaataatgatgcgaatattagtattgtgtttatgtttatgtttatcatgatgagtatttatgataac

SEQ ID NO: 45360 - DNA, 75 bp, Artificial Sequence
  Synthetic
tatcgatattccatacgagggaaactctagtatggtgattatactaccggacgacatagaaggtatatataacat

SEQ ID NO: 45361 - DNA, 75 bp, Artificial Sequence
  Synthetic
ttttagcaagatgtgtaatgaaactatcactgtagaaaaatttctacacaagacgtttatagatgttaatgagga

SEQ ID NO: 45362 - DNA, 75 bp, Artificial Sequence
  Synthetic
tttaagatgtcataattcgagaaagttaaaaagatacctcagcgtgttaaaaaaatataataatgataagtcctt

SEQ ID NO: 45363 - DNA, 75 bp, Artificial Sequence
  Synthetic
gccaaagtttaaagtggaaatgacagaaccgtataatctggtacctattctagaaaatttaggacttactaatat

SEQ ID NO: 45364 - DNA, 75 bp, Artificial Sequence
  Synthetic
atgaaatgggtaataccatttgtaagaaatgtcggaagggtacttattcagatattgtatctgactctgatcaat

SEQ ID NO: 45365 - DNA, 75 bp, Artificial Sequence
  Synthetic
atcaaaataacaaatactaacgagtacattctgcaatattgttatcgtaattggaaaattagtgttcgagtgagt

SEQ ID NO: 45366 - DNA, 75 bp, Artificial Sequence
  Synthetic
gatattgtatctgactctgatcaatgtaaaccaatgacaagataagacttactcgcatctactggatagacataa

SEQ ID NO: 45367 - DNA, 75 bp, Artificial Sequence
  Synthetic
actcgcatctactggatagacataaaatatcctcctcgtaataatgaaatataatatacactaattattaatatc

SEQ ID NO: 45368 - DNA, 75 bp, Artificial Sequence
  Synthetic
attaatattatatttttactattttatttagtgtctagaaaaaaatgtgtgacccacgactgtaggaaactctag

SEQ ID NO: 45369 - DNA, 75 bp, Artificial Sequence
  Synthetic
aaaaaatattattttatagaaactttgtctagcgtatttagaacaattttatctcactcactcttcatcagtaag

SEQ ID NO: 45370 - DNA, 75 bp, Artificial Sequence
  Synthetic
ttatgactaacttttcgatggtatatcgtacgaaggtctacataaaccatccattcatgtacatgattaaagaca

SEQ ID NO: 45371 - DNA, 75 bp, Artificial Sequence
  Synthetic
attattaacatataggtcatttttaaatcccttttgggttccgtcccaaacggcgtttcggtctgcgccgccgcc

SEQ ID NO: 45372 - DNA, 75 bp, Artificial Sequence
  Synthetic
tcgtacgaaggtctacataaaccatccattcatgtacatgattaaagacaacacaggacgtatactttttatagg

SEQ ID NO: 45373 - DNA, 75 bp, Artificial Sequence
  Synthetic
aatacgttagtctaaatatcccgataatgcaactaaataaaagagtaacgggaatacgcataacgggatacatat

SEQ ID NO: 45374 - DNA, 75 bp, Artificial Sequence
  Synthetic
tcctccatcgaggacgacttcaactatggcagctcggtggcgtccgccagcgtgcacatacgaatggcatttcta

SEQ ID NO: 45375 - DNA, 75 bp, Artificial Sequence
  Synthetic
atggcagctcggtggcgtccgccagcgtgcacatacgaatggcatttctaagaaaagtttacggtatcctttgtc

SEQ ID NO: 45376 - DNA, 75 bp, Artificial Sequence
  Synthetic
ttagtataaactaaagttaatactacattaaaacttaaaaaataataatatcattattacaaagtataaactata

SEQ ID NO: 45377 - DNA, 75 bp, Artificial Sequence
  Synthetic
tgcatgcggacatttatacaagggagtcctgttctaatattggcatcaatgttcggatctataggcttgattttc

SEQ ID NO: 45378 - DNA, 75 bp, Artificial Sequence
  Synthetic
gtcctgttctaatattggcatcaatgttcggatctataggcttgattttcgcattgactttacacagacataaat

SEQ ID NO: 45379 - DNA, 75 bp, Artificial Sequence
  Synthetic
ctatatgtgattatgtcctctttgtaacatttaccaactagtatatcgtatatgctaatattagttctcgaatta

SEQ ID NO: 45380 - DNA, 75 bp, Artificial Sequence
  Synthetic
agagagaaagagataaaacttttttacgactccatcagaaagaggtttaatatttttgtgagaccatcgaagaga

SEQ ID NO: 45381 - DNA, 75 bp, Artificial Sequence
  Synthetic
cctatttcctttcagggtatcacaaaaatattaaacctctttctgatggtctcataaaaaaagttttacaaaaat

SEQ ID NO: 45382 - DNA, 75 bp, Artificial Sequence
  Synthetic
tgttatctctaatactaactaacttatcaaatgccaaaaacattgcatgactattatcgagaatcgctatatccc

SEQ ID NO: 45383 - DNA, 75 bp, Artificial Sequence
  Synthetic
taacgctggcctctgttgttactttctatgatgtgcatgtcgttatgcaagctttcatgctgactactgcagtgt

SEQ ID NO: 45384 - DNA, 75 bp, Artificial Sequence
  Synthetic
aaattatatatcattggaggtgttaaacagaatggagaatcgtctgatcaaatattgagcgtcgatctatcaaca

SEQ ID NO: 45385 - DNA, 75 bp, Artificial Sequence
  Synthetic
tccagtttccattttatctactttatctattctacatcatggcgcagctggttctacagctgaacaactatcaaa

SEQ ID NO: 45386 - DNA, 75 bp, Artificial Sequence
  Synthetic
tggaaattaaagccctctattagcatagacggctacaggtctaccatcaggttaaccttcgtctaccttcacaat

SEQ ID NO: 45387 - DNA, 75 bp, Artificial Sequence
  Synthetic
ctagtatggataatgtttgtaatggttctttccgtacaacatactttttagatgatagtcgcttagcttggatat

SEQ ID NO: 45388 - DNA, 75 bp, Artificial Sequence
  Synthetic
taaaaaaacatataggtcattttttaaacatggattggaaaccaaggttgttagttaataatatacaagatattt

SEQ ID NO: 45389 - DNA, 75 bp, Artificial Sequence
  Synthetic
atcaaatgccaaaaacattgcatgactattatcgagaatcgctatatccctctccatatactcgatgcatttatt

SEQ ID NO: 45390 - DNA, 75 bp, Artificial Sequence
  Synthetic
cttataaaaatactaaaactggagagactgattatacgtacttctctaatgggggactacccgcatactatcgtg

SEQ ID NO: 45391 - DNA, 75 bp, Artificial Sequence
  Synthetic
tattgatgtctacacatccttttgtaattgacatctatatatccttttgtataatcaactctaatcactttaact

SEQ ID NO: 45392 - DNA, 75 bp, Artificial Sequence
  Synthetic
aatattcttaacaagataccattggtggcccgacaacatattattttccatggttaacattagaggatctacacc

SEQ ID NO: 45393 - DNA, 75 bp, Artificial Sequence
  Synthetic
acagtggagctggtcctgtctgcttttggggcccttgtattctgcggattcattatctatgacacgcactcacta

SEQ ID NO: 45394 - DNA, 75 bp, Artificial Sequence
  Synthetic
tgtaagaagccatcgacatcacttacttttttgacagtgcgtaaaatatctcgagtatttaatagatttccagat

SEQ ID NO: 45395 - DNA, 75 bp, Artificial Sequence
  Synthetic
atgtgttagcctctatcaatttctacttggatatcatcaatctgttcttgcatctgttgcagcttttggaagtat

SEQ ID NO: 45396 - DNA, 75 bp, Artificial Sequence
  Synthetic
tcggattggtggatatatacgtaacgacgcctagtccgagaccagacatagtgctatggcttcttaaatcagaat

SEQ ID NO: 45397 - DNA, 75 bp, Artificial Sequence
  Synthetic
atgaatccatgacaatattggcattagtatgtgagataatagatacatgtaatggtgtcataccagacgtttcac

SEQ ID NO: 45398 - DNA, 75 bp, Artificial Sequence
  Synthetic
agtatgtgagataatagatacatgtaatggtgtcataccagacgtttcacatactgcgttattatatctttctat

SEQ ID NO: 45399 - DNA, 75 bp, Artificial Sequence
  Synthetic
ttataaaaatactaaaactggagagactgattacacatacctctctaatgtggggattcctgaatactatcggtt

SEQ ID NO: 45400 - DNA, 75 bp, Artificial Sequence
  Synthetic
gttacgccaaaaatatagacgatgatatcgcagaattattcaatataatgagagataatctaccagctaaagact

SEQ ID NO: 45401 - DNA, 75 bp, Artificial Sequence
  Synthetic
ctatcgtgcttaattattttgttctataaactgaatatatagctacaattattgacgggtttgtttatgaccggc

SEQ ID NO: 45402 - DNA, 75 bp, Artificial Sequence
  Synthetic
aatggtgtcataccagacgtttcacatactgcgttattatatctttctataatcgcacaatgatatacgtcatgt

SEQ ID NO: 45403 - DNA, 75 bp, Artificial Sequence
  Synthetic
tccatgtaaaccaaggacgagataagacactctcattcctcgtccacgaccccattaaaaaaatggaaattaaag

SEQ ID NO: 45404 - DNA, 75 bp, Artificial Sequence
  Synthetic
gttgtatttttatcacgcgatgtatataaaactgatattatataattatcttagtgccggtatggcgaagataac

SEQ ID NO: 45405 - DNA, 75 bp, Artificial Sequence
  Synthetic
ccctctattagcacagacggctacaggtctaccatcaggttaaccttcgtctaccttcacaatggcctctccttg

SEQ ID NO: 45406 - DNA, 75 bp, Artificial Sequence
  Synthetic
catcctatagaacaacgatttaatcataggcagagatacgtgcagtctgtgtctgatgatgtcgtgaatgacatc

SEQ ID NO: 45407 - DNA, 75 bp, Artificial Sequence
  Synthetic
atcataatcgtatcacactattgagacagaaaaagaagaagtcgcgagaggtaactttttgtgaatgtagttaag

SEQ ID NO: 45408 - DNA, 75 bp, Artificial Sequence
  Synthetic
cacgctactaaggactccctgaataccgtggctgacgtcagacattgtctgactgaatacatcctgtgggtttct

SEQ ID NO: 45409 - DNA, 75 bp, Artificial Sequence
  Synthetic
acactgaataacatctagtcttatatcgttatcggtttctggatctaatatatgaacaacagacaacatagagag

SEQ ID NO: 45410 - DNA, 75 bp, Artificial Sequence
  Synthetic
tgtcattgacatcttgaactctcctatctaatgctggtgtaccacctatagattttgaatattcgaatgctgcat

SEQ ID NO: 45411 - DNA, 75 bp, Artificial Sequence
  Synthetic
cagggtctctctacaggcttctcatctctttcagaactgatgcaacggagctctttggtagcgagttgaaggagt

SEQ ID NO: 45412 - DNA, 75 bp, Artificial Sequence
  Synthetic
tatgaacaacagacaacatagagagatatgtgtgtagtaccgtattaccaatattgtcgggttcatttacatcat

SEQ ID NO: 45413 - DNA, 75 bp, Artificial Sequence
  Synthetic
ctctttcagaactgatgcaacggagctctttggtagcgagttgaaggagttctcggattcacttccgtgggacaa

SEQ ID NO: 45414 - DNA, 75 bp, Artificial Sequence
  Synthetic
aataaagttcataacagatacataaacgaatttactcgcatttccgatacatgacaataaagcggttaaatcatt

SEQ ID NO: 45415 - DNA, 75 bp, Artificial Sequence
  Synthetic
ttcgtgtagtagtagtaacgttaaaagtttaaacgttacgttacgttacgttacttacgttacgtacgtacgtac

SEQ ID NO: 45416 - DNA, 75 bp, Artificial Sequence
  Synthetic
atatttttgtaaaacttttttatgagaccatcgaagagagaaagagaataaaaatattttttgtaaaactttttt

SEQ ID NO: 45417 - DNA, 75 bp, Artificial Sequence
  Synthetic
tatcataggtatattttttactttatcaccatctagcgattctatatatgcgtttgttatttctggattaacatt

SEQ ID NO: 45418 - DNA, 75 bp, Artificial Sequence
  Synthetic
atcaaaatgacgatatacggattaatagcgtgtcttatattcgtgacttcatccatcgctagtccactttacatt

SEQ ID NO: 45419 - DNA, 75 bp, Artificial Sequence
  Synthetic
acacacacacacacacacacacacacacacacacacacacacacacaccttactttttatcatcttatgaggaat

SEQ ID NO: 45420 - DNA, 75 bp, Artificial Sequence
  Synthetic
taaaactctactatattacgcggtcgatgtcaataatatacaatttgcaaagcggttattggaatatggagcgag

SEQ ID NO: 45421 - DNA, 75 bp, Artificial Sequence
  Synthetic
tattgggagtcaatgaaacagaattaactaattatcttattacgcataaaaatgccacggttgacaataacacaa

SEQ ID NO: 45422 - DNA, 75 bp, Artificial Sequence
  Synthetic
gaaaatccatcaggatggattataggattagattttggtgtatactctattttaactagtagaggcggtatcacc

SEQ ID NO: 45423 - DNA, 75 bp, Artificial Sequence
  Synthetic
aaagagaaagagaaagagaataaaaatattttatgactccatcagaaagaggtttaatattttagtgataccctg

SEQ ID NO: 45424 - DNA, 75 bp, Artificial Sequence
  Synthetic
atcataatcgtatcacatattgagacagaaaaagaagaagtcgcgagaggtaactttttgtgaatgtagttaaga

SEQ ID NO: 45425 - DNA, 75 bp, Artificial Sequence
  Synthetic
gattgccttcatcatttttcgtgaaatataatataggaataattagaactagaatagctatggattgcggcagag

SEQ ID NO: 45426 - DNA, 75 bp, Artificial Sequence
  Synthetic
ctgtagccgtctgtgctaatagagggctttaatttccatttttttaatggggttgtggatgaggaatgagagtgt

SEQ ID NO: 45427 - DNA, 75 bp, Artificial Sequence
  Synthetic
tttttagccggaataacatcatcaaaagacttatgatcctctctcattgatttttcgcgggatacatcatctatt

SEQ ID NO: 45428 - DNA, 75 bp, Artificial Sequence
  Synthetic
tttgtggtgtgcctgaatcgttcgattaaccctactcatccaatttcagatgaatagagttatcgattcagacac

SEQ ID NO: 45429 - DNA, 75 bp, Artificial Sequence
  Synthetic
tcgtccatctcgtccatctcatacatttcatcatttactttttcataattagagatgtacgaaagaaaaagaaaa

SEQ ID NO: 45430 - DNA, 75 bp, Artificial Sequence
  Synthetic
ctatccgcttttagcattaaaatcatactaccgatgatatcaatcaatgctgttttactatctgtatactgttga

SEQ ID NO: 45431 - DNA, 75 bp, Artificial Sequence
  Synthetic
agaaaaaacagaacaatatattttttagtaatgtttatgcgagatgatgccggtaaatgtttttatcatcttgga

SEQ ID NO: 45432 - DNA, 75 bp, Artificial Sequence
  Synthetic
atgtaacaatgacttataaaaatactaaaactggagagactgattacacgtacctctctaatggggggttgcctg

SEQ ID NO: 45433 - DNA, 75 bp, Artificial Sequence
  Synthetic
cctccaacgaactcaagtcgaatataaatgatttcgatctgtattcgtatatgtcttcggataatatcgacttac

SEQ ID NO: 45434 - DNA, 75 bp, Artificial Sequence
  Synthetic
catctaattgtgataaatgctcaatgaatctgatgacatccgttattcctgttgttaaagaatttaacaatacgt

SEQ ID NO: 45435 - DNA, 75 bp, Artificial Sequence
  Synthetic
tccatgataaattatttaatggagtaataaagtatttcgcgttgtatctccatgggtaattttgaaatcaagtta

SEQ ID NO: 45436 - DNA, 75 bp, Artificial Sequence
  Synthetic
ctatcaacattattcatctagcgattatgaaaattataatgattattattatgattatgatagaactgttttgga

SEQ ID NO: 45437 - DNA, 75 bp, Artificial Sequence
  Synthetic
attctttttattcacacaaaaagaatatttttataaacatgaaaccactgtctaaatgtaattatgatcttgatt

SEQ ID NO: 45438 - DNA, 75 bp, Artificial Sequence
  Synthetic
atgatgaaacacaatatcaagatacgcaattagtatgcgcagatattaaactaaaaaacaatgaggattttgtcg

SEQ ID NO: 45439 - DNA, 75 bp, Artificial Sequence
  Synthetic
tcgaccacgcgaaaaaagatttaagaatagacagtgttattcctagaggtacaactcatttccaagtaggtgcgt

SEQ ID NO: 45440 - DNA, 75 bp, Artificial Sequence
  Synthetic
aatatatcagttttctaacattaactatagcgtgttcggttaatgatgccatttttgataactataatcaaaaac

SEQ ID NO: 45441 - DNA, 75 bp, Artificial Sequence
  Synthetic
aaaaaaataaacataacatattttgagattaatcgctattgtgcttaattattttgctctataaactgaatatat

SEQ ID NO: 45442 - DNA, 75 bp, Artificial Sequence
  Synthetic
aagaactctcttcattactatatattgtctcatagagaatctcaatctcaatctcaatctctatccaaggatgta

SEQ ID NO: 45443 - DNA, 75 bp, Artificial Sequence
  Synthetic
tgtcagtgttagtagtacataaaaagtttatattattgttacatttttttaaagagatcaaggtataaaaattag

SEQ ID NO: 45444 - DNA, 75 bp, Artificial Sequence
  Synthetic
ttacatttaatctcgaaattcagagtgcacacctttgaaatattttgatatctattttctcctgtaaagaatcct

SEQ ID NO: 45445 - DNA, 75 bp, Artificial Sequence
  Synthetic
attaaatgtttgatcgataacaatgtttccatccatggcagagacgaaggaggatctttacccatccaatactac

SEQ ID NO: 45446 - DNA, 75 bp, Artificial Sequence
  Synthetic
aaagagatcaaggtataaaaattagaagtgttagactattaactaacttataaaactatcttataactattaact

SEQ ID NO: 45447 - DNA, 75 bp, Artificial Sequence
  Synthetic
aggatctttacccatccaatactactggtcttgctcaaccatagatatagagattgtcaaattattaataaagga

SEQ ID NO: 45448 - DNA, 75 bp, Artificial Sequence
  Synthetic
gagtactagcggattatctaaacaagcgatttagagtaaccccatataatgtagacatggaaatcgttaatcttc

SEQ ID NO: 45449 - DNA, 75 bp, Artificial Sequence
  Synthetic
ataggagattgtcatcagttgatacattgtttattatctcatctattagagcacgtctgtttagagctttagcga

SEQ ID NO: 45450 - DNA, 75 bp, Artificial Sequence
  Synthetic
gaatcattcggcaacttttcaatcatagaactgccatatgttggagatactagtatggtggtcattcttccagac

SEQ ID NO: 45451 - DNA, 75 bp, Artificial Sequence
  Synthetic
attgtttattatctcatctattagagcacgtctgtttagagctttagcgacatgctcgtttacttctgtgtaaat

SEQ ID NO: 45452 - DNA, 75 bp, Artificial Sequence
  Synthetic
caggcatatgcatgccaggacgatttgtttcatgattgctgttctagatgattctatttccttaccatacaataa

SEQ ID NO: 45453 - DNA, 75 bp, Artificial Sequence
  Synthetic
attctatttccttaccatacaataaattagaatatattttctacttttacgaaaaattaattattgtatttattt

SEQ ID NO: 45454 - DNA, 75 bp, Artificial Sequence
  Synthetic
caagttgcctgcaggtgttaaaagtactccgtttacagaggcgcttgtgtctacgataaaccaaaagctttctag

SEQ ID NO: 45455 - DNA, 75 bp, Artificial Sequence
  Synthetic
tatgtagaatatgggaagcatgcttgtttttgtctctattatagattaactcatacatggttgtattatgaattt

SEQ ID NO: 45456 - DNA, 75 bp, Artificial Sequence
  Synthetic
taagagattgtatcagtttcgtagtcttgagtattggtattactatatagtatgtagatgtcgacgctagataga

SEQ ID NO: 45457 - DNA, 75 bp, Artificial Sequence
  Synthetic
tagcaccgttattactactgaagaactacaagtgactccatcaccaactccaacatatgcacctgtaacaactcc

SEQ ID NO: 45458 - DNA, 75 bp, Artificial Sequence
  Synthetic
gtttttgtctctattatagattaactcatacatggttgtattatgaattttcatctgcctaatgtactccaattc

SEQ ID NO: 45459 - DNA, 75 bp, Artificial Sequence
  Synthetic
tatagtattagtttgttcctgtaacaaaaataatgaccaatataagttccataaattgctgccgtgaatataaat

SEQ ID NO: 45460 - DNA, 75 bp, Artificial Sequence
  Synthetic
gataatatcagaccgtacatacatagacggccattgttcgatacgtgattaatagccatgtgtccattattttcc

SEQ ID NO: 45461 - DNA, 75 bp, Artificial Sequence
  Synthetic
gaagaatctttgttattacatttaatctcgaaattcagagtgcacacctttgaaatattctgatatctattttgt

SEQ ID NO: 45462 - DNA, 75 bp, Artificial Sequence
  Synthetic
atatattggcgactaataaaaaattaataacacctaattatatgaagttattagtatataacggaaatgatataa

SEQ ID NO: 45463 - DNA, 75 bp, Artificial Sequence
  Synthetic
tttgtgttagtcttgctatcgcataatctggaagcgtatgttcccggaggacacgataaacaacacagattatgg

SEQ ID NO: 45464 - DNA, 75 bp, Artificial Sequence
  Synthetic
ctatgtatgtacggtctgatattatcgagatttaataattgcgggtatcactgttatgaaaccatactgatagat

SEQ ID NO: 45465 - DNA, 75 bp, Artificial Sequence
  Synthetic
agacaatggttctctaagcaatatttctaatattttaagatgtgcttccctacgggcgatgacagatcccctatc

SEQ ID NO: 45466 - DNA, 75 bp, Artificial Sequence
  Synthetic
aaatcacgtatctaacaatggccgtctatgtatgtacggtctgatattatcgagatttaataattgcgggtatca

SEQ ID NO: 45467 - DNA, 75 bp, Artificial Sequence
  Synthetic
gataataacacattgcatggtaatataggatttttggaaataaataattgttacaatgtttctgtgtcagatgct

SEQ ID NO: 45468 - DNA, 75 bp, Artificial Sequence
  Synthetic
aatatgatatccgatactataatgaaaagattatagatacatttatagagttaggagccgatctaactattccaa

SEQ ID NO: 45469 - DNA, 75 bp, Artificial Sequence
  Synthetic
ccatcactcattactgcgttgacatttgctccattttctaatagccatgatactaaatctatataacctgcatag

SEQ ID NO: 45470 - DNA, 75 bp, Artificial Sequence
  Synthetic
ctcgtcgacaacttcctcgtggcgatgatgattattctcgaccacaagttcctcaacgtgattattctcctccac

SEQ ID NO: 45471 - DNA, 75 bp, Artificial Sequence
  Synthetic
ataatatttgtaatggttctttccgtacaacatactgtttagatgatagtcgcttagcttggttatgatattgcg

SEQ ID NO: 45472 - DNA, 75 bp, Artificial Sequence
  Synthetic
acttcctcctaaaccagccggccaagtccctactagagatcaacaagataataataataaaggatttagtaagtt

SEQ ID NO: 45473 - DNA, 75 bp, Artificial Sequence
  Synthetic
agttaccatcccactctagagactatgattgacgcatttaatagagatatacgctatctatatcctgaaccatta

SEQ ID NO: 45474 - DNA, 75 bp, Artificial Sequence
  Synthetic
tgattgacgcatttaatagagatatacgctatctatatcctgaaccattattggcctgtatcagatacgccttaa

SEQ ID NO: 45475 - DNA, 75 bp, Artificial Sequence
  Synthetic
tcagcgcggacctccgccacttcctcctaaaccagttccagctattccacctagagatggtcaaccagataataa

SEQ ID NO: 45476 - DNA, 75 bp, Artificial Sequence
  Synthetic
tttcgataactaacagcagaaaaagacgagatctgaatggtgagtttgaattttccacttccaaggaattagatt

SEQ ID NO: 45477 - DNA, 75 bp, Artificial Sequence
  Synthetic
gtcatagactgagatacgcaaagaatcctacattcctaaactttgtatccaacatcaaatggtacaaaaaagaac

SEQ ID NO: 45478 - DNA, 75 bp, Artificial Sequence
  Synthetic
atgcagatataatatctttatatgtaatatatgcaaacagtctatctactatatactgatcaatattgtctctat

SEQ ID NO: 45479 - DNA, 75 bp, Artificial Sequence
  Synthetic
aacatcaaatggtacaaaaaagaactaacgtccatcattacagagactgtaaagaacagtgagaggatcgactcc

SEQ ID NO: 45480 - DNA, 75 bp, Artificial Sequence
  Synthetic
attaataagtacgtactgttactggacccatccttttattctagattcagaaatgctatcgaaagcaaattaaac

SEQ ID NO: 45481 - DNA, 75 bp, Artificial Sequence
  Synthetic
acccatccttttattctagattcagaaatgctatcgaaagcaaattaaaccaacacgctaatcgttataataggt

SEQ ID NO: 45482 - DNA, 75 bp, Artificial Sequence
  Synthetic
aggagaaatctatcaaatatcttcctatcaacaactggttctagaacataacagtcaacacccaatccatgtttt

SEQ ID NO: 45483 - DNA, 75 bp, Artificial Sequence
  Synthetic
gagagaactccgacatcttgtagaacaacgatttaatcataggtagagatactttcagtctgtggtggatgatgt

SEQ ID NO: 45484 - DNA, 75 bp, Artificial Sequence
  Synthetic
acagtcaacacccaatccatgttttacatagtcatctaccaaagataatgaccaaaagtcgaggtcgtcgtgaaa

SEQ ID NO: 45485 - DNA, 75 bp, Artificial Sequence
  Synthetic
ttccatggcatattacaaaatcgattccgtccaagatgataaaaacatttaccggcatcataaacacggagttta

SEQ ID NO: 45486 - DNA, 75 bp, Artificial Sequence
  Synthetic
acacaattctttctcatgttcgttaaggtcgtacccacgaacaaaatagtaatcactcattctgacgacagcata

SEQ ID NO: 45487 - DNA, 75 bp, Artificial Sequence
  Synthetic
gtaggagataggtccccatttcaaaatgttaaatcacgtgccagtctattggcggaaaaaataatgcctagagta

SEQ ID NO: 45488 - DNA, 75 bp, Artificial Sequence
  Synthetic
ttttatatgtctcgcataaacattactaaaaaaatatattgttctgttttctttttctttcgtacatctctaatt

SEQ ID NO: 45489 - DNA, 75 bp, Artificial Sequence
  Synthetic
ggaggcaaatacgatagtctagtttgaccatcgatggtagtctctaatttattgagtgctttgtcgacgagttta

SEQ ID NO: 45490 - DNA, 75 bp, Artificial Sequence
  Synthetic
ttactgtcttccattcttctaactaaagatctgagataaattatacaatcttcgctatcgaaccatttttgtagt

SEQ ID NO: 45491 - DNA, 75 bp, Artificial Sequence
  Synthetic
attgtgcgcatcgttaacgatagtatgtggtacatacctaacgcatttatggacgacggtgagaatgaaggtcac

SEQ ID NO: 45492 - DNA, 75 bp, Artificial Sequence
  Synthetic
aagatctgagataaattatacaatcttcgctatcgaaccatttttgtagtctaaagccggaagtaatcagccaac

SEQ ID NO: 45493 - DNA, 75 bp, Artificial Sequence
  Synthetic
tctagtagataccgtagtatattgagagtgtgacttccgtatccttgattatgttttatgaatagataaagtaga

SEQ ID NO: 45494 - DNA, 75 bp, Artificial Sequence
  Synthetic
tgtggtacatacctaacgcatttatggacgacggtgagaatgaaggtcacatttctgtcaataatgtctgtcata

SEQ ID NO: 45495 - DNA, 75 bp, Artificial Sequence
  Synthetic
ccgttataaaagtaatgttgtttaattgtaggacggttgttagtataatcacatgaataataatattctaattcc

SEQ ID NO: 45496 - DNA, 75 bp, Artificial Sequence
  Synthetic
gttattaaacactgcgatctgaataaacgactaaaatgtggtaactctccattacattgctatacgatgaataca

SEQ ID NO: 45497 - DNA, 75 bp, Artificial Sequence
  Synthetic
ttgtaggacggttgttagtataatcacatgaataataatattctaattcctcgtattgactacttacagatactc

SEQ ID NO: 45498 - DNA, 75 bp, Artificial Sequence
  Synthetic
tatcatgtgtagatcaaacttaaataatccatttatctctttcctagatactgtatatactattatagatcaaga

SEQ ID NO: 45499 - DNA, 75 bp, Artificial Sequence
  Synthetic
agtttattaccaaccatgaactcgatagatggataaatatcctttccatcaaaggtcataattggataattgtcc

SEQ ID NO: 45500 - DNA, 75 bp, Artificial Sequence
  Synthetic
aaggtaagtgtgtaacggcgtatttccgattttcgtaaccgcgttaatgtttgctccatgatctattatcgtata

SEQ ID NO: 45501 - DNA, 75 bp, Artificial Sequence
  Synthetic
ctagccgtgttagaacatcatcaagtagtagtgattttgaagatatagatactgttgttagggaatatagacaaa

SEQ ID NO: 45502 - DNA, 75 bp, Artificial Sequence
  Synthetic
tagatggataaatatcctttccatcaaaggtcataattggataattgtccagcaatatatctgctgtattagtta

SEQ ID NO: 45503 - DNA, 75 bp, Artificial Sequence
  Synthetic
gacatccgacttgtataagatgtttctgttttcaaacaccaagtcgaataccgtcttaccgtctttagtaggaat

SEQ ID NO: 45504 - DNA, 75 bp, Artificial Sequence
  Synthetic
gacgatgatatattatgcgatgtaatcataactatcagagatggagaagaaattaaagcacataaaactatcttg

SEQ ID NO: 45505 - DNA, 75 bp, Artificial Sequence
  Synthetic
tgctttcgtggaacgtggatatgtgtttacagtagtaatgaagagaagtgagtccatcctcgtcgacgcaattag

SEQ ID NO: 45506 - DNA, 75 bp, Artificial Sequence
  Synthetic
gttgatgtcgtatccgatgtatacgaggtatgaggcaaccttgttgttacaattctggaaggcagtatgaagagg

SEQ ID NO: 45507 - DNA, 75 bp, Artificial Sequence
  Synthetic
gaaagacgaatactataataccatgactcctcttcataccgccttccagaattgtaacaacaatgttgcctcata

SEQ ID NO: 45508 - DNA, 75 bp, Artificial Sequence
  Synthetic
caactaaaagtctatcaggtggtgtagacatagttacaaaacaatcagactattctctattacctggcgttaata

SEQ ID NO: 45509 - DNA, 75 bp, Artificial Sequence
  Synthetic
agacatagttacaaaacaatcagactattctctattacctggcgttaatactggcagttctattgtgtcacctct

SEQ ID NO: 45510 - DNA, 75 bp, Artificial Sequence
  Synthetic
tacagagtccaaatcctcctccccgtaatccccgtcgaccacttcctcaacatgatgattattctcctccacaag

SEQ ID NO: 45511 - DNA, 75 bp, Artificial Sequence
  Synthetic
tacttattgtgggattgtagtttacttagtaattcatctttgaatcctgataaatcatgcatatcaatgatacaa

SEQ ID NO: 45512 - DNA, 75 bp, Artificial Sequence
  Synthetic
tgtaaaattagaggtacgggatagaataatacctcctactatgcaattaccagaagacattgtaacttcactagg

SEQ ID NO: 45513 - DNA, 75 bp, Artificial Sequence
  Synthetic
gactgaaagtatctctacctatgattaaatcgttgttctacaagatgtcggagttctctccctacgacgattact

SEQ ID NO: 45514 - DNA, 75 bp, Artificial Sequence
  Synthetic
agatatctggatatgtacgtaaatagtcgattatatcttttacaatactattagtccctattgcgttatctatat

SEQ ID NO: 45515 - DNA, 75 bp, Artificial Sequence
  Synthetic
ttccccctagaccagcaggtcaattacctcctatagatcaaccagataaaggatttagtaagtttgtatcaccta

SEQ ID NO: 45516 - DNA, 75 bp, Artificial Sequence
  Synthetic
acgcagacctccgccacttcctcctaaaccagtccaaaatccgccacgacttccccctagaccagcaggtcaatt

SEQ ID NO: 45517 - DNA, 75 bp, Artificial Sequence
  Synthetic
cgttctttatgtattccatgatgggtgtacaatcaaaattattacgtatcctcgtatcggctcctctagataaaa

SEQ ID NO: 45518 - DNA, 75 bp, Artificial Sequence
  Synthetic
gagttctctccctacgacgattactacgtaaagaagataatagcctactgcttattaagggacgagtcattcgcg

SEQ ID NO: 45519 - DNA, 75 bp, Artificial Sequence
  Synthetic
cagatttctatacatgaagtaatatcattattgtatgttctgcttattagtatatcatatatagatatagtagaa

SEQ ID NO: 45520 - DNA, 75 bp, Artificial Sequence
  Synthetic
tcgagaatagctgtgttctgcacacataactatgataaacgattcaaatcagatattatagttctaatatttaat

SEQ ID NO: 45521 - DNA, 75 bp, Artificial Sequence
  Synthetic
cgcatttaaaaaaacagtattcgaaatattatttgatattctttctactaacgacaatgtatatttatacagaga

SEQ ID NO: 45522 - DNA, 75 bp, Artificial Sequence
  Synthetic
tatatcatatatagatatagtagaatagttgttaatatatgtagacattaataaactaatattatctcgaatatc

SEQ ID NO: 45523 - DNA, 75 bp, Artificial Sequence
  Synthetic
aataatatcgatatttccagcgttaagtgtaacattaaacagttttaattcacgtgacgtggtatcaattaaata

SEQ ID NO: 45524 - DNA, 75 bp, Artificial Sequence
  Synthetic
tcagcaggccattagccaacagactagatcaactgcgttgagtagaaaagatcagatgagcaatgaagaaaagat

SEQ ID NO: 45525 - DNA, 75 bp, Artificial Sequence
  Synthetic
ccatcattccatacaggctagtatttttagtactacataacgaaaataatgattcgtttttatagcatttatcta

SEQ ID NO: 45526 - DNA, 75 bp, Artificial Sequence
  Synthetic
tacctcgtatacatcggacacgacatcaacattcctactaaagacggcaagacggtattcgacttggtgtttgaa

SEQ ID NO: 45527 - DNA, 75 bp, Artificial Sequence
  Synthetic
tccggaaattatgcgcaatatcataaccaagctaagcgactatcatctaaacagtatgttgtacggaaagaacca

SEQ ID NO: 45528 - DNA, 75 bp, Artificial Sequence
  Synthetic
ctgcgggtatggcgggtggtccaaaactaatgattgcaggaatggctataacggctataactggtataatagata

SEQ ID NO: 45529 - DNA, 75 bp, Artificial Sequence
  Synthetic
cagactgaacatatctctgcctatgattaaatcgttgttctataggatgtccgagttctctccttacgacgatta

SEQ ID NO: 45530 - DNA, 75 bp, Artificial Sequence
  Synthetic
ctctatgaaatattaacatcaatgcagtaagaccctttatagttggtttatcgatactatatccaatagataata

SEQ ID NO: 45531 - DNA, 75 bp, Artificial Sequence
  Synthetic
agagatagataatactcggccgacataatgttgtccattgtagtataaaaattaatatttctatttctatttcta

SEQ ID NO: 45532 - DNA, 75 bp, Artificial Sequence
  Synthetic
acaaacggtggctacgtgaaacgcagtcattccagaaaatggtactatattcttgttatagtactttatcatttg

SEQ ID NO: 45533 - DNA, 75 bp, Artificial Sequence
  Synthetic
atagtaataggaataggaattacttttcatttgtctcactattataaaaagatgttatatctcaatcactgatat

SEQ ID NO: 45534 - DNA, 75 bp, Artificial Sequence
  Synthetic
atatcgcatacagaaacgataccagttttaaacatagtacggatgcgatggctttgtatttcttagatgttatcg

SEQ ID NO: 45535 - DNA, 75 bp, Artificial Sequence
  Synthetic
attcgaatctccgacaccgacttgtatacggtattaagaacagaagacatccggtatcacacctatctcgaagcc

SEQ ID NO: 45536 - DNA, 75 bp, Artificial Sequence
  Synthetic
acaatctcgtccatctcatccatctcataatgatttactttttcataattagagatgtacgaaagaaaaagaaaa

SEQ ID NO: 45537 - DNA, 75 bp, Artificial Sequence
  Synthetic
taaagatcattgtgcctcaaataaggaatggttaaaatcttatggttatgggaaggcagatgctactaaacaacg

SEQ ID NO: 45538 - DNA, 75 bp, Artificial Sequence
  Synthetic
taccatgtttaatactttatcagacatcagacaatctattatgtcgtgatacatataattttgtgcggtacatat

SEQ ID NO: 45539 - DNA, 75 bp, Artificial Sequence
  Synthetic
atcctgaacgtataagatatttaacaacttctatgtttatattgttattgatactcgaatcatatgtcaaatttt

SEQ ID NO: 45540 - DNA, 75 bp, Artificial Sequence
  Synthetic
tatccaagttaagcgactatcatctaaaaagtatgttgtatggaaagaaccattacaaacattatccatactaga

SEQ ID NO: 45541 - DNA, 75 bp, Artificial Sequence
  Synthetic
atactcgaatcatatgtcaaatttttattaacaatacataatctagaaagatatgtgtgtagtactgtattacct

SEQ ID NO: 45542 - DNA, 75 bp, Artificial Sequence
  Synthetic
gacatcgatatttatataatttcgtaacatataattgtgaagacaagttcttccaacactatctttgtaatcaag

SEQ ID NO: 45543 - DNA, 75 bp, Artificial Sequence
  Synthetic
cgttggattattactgttcatacgaagatatttggaaaagcgactggcctgactatgatccatgtaagtcatata

SEQ ID NO: 45544 - DNA, 75 bp, Artificial Sequence
  Synthetic
caaaatagtaatcactcattctgacgacagtataaacagtaactaatttttctatctttagagagtatctcccta

SEQ ID NO: 45545 - DNA, 75 bp, Artificial Sequence
  Synthetic
gattacactattattcagaaaatgttttatgacatctagatcaacatattgagccatttgtatatacagatgcaa

SEQ ID NO: 45546 - DNA, 75 bp, Artificial Sequence
  Synthetic
ttattctctttctctcttcgatggtctcataaaaaagttttacaaaaaatatttttattctctttctctcttcga

SEQ ID NO: 45547 - DNA, 75 bp, Artificial Sequence
  Synthetic
tcaaaatatgtaacaatagtacaatgaatgagtaataagacaatatgaaatctatcttatatacacataattatt

SEQ ID NO: 45548 - DNA, 75 bp, Artificial Sequence
  Synthetic
gagccatttgtatatacagatgcaatatctctggtatattagttatcttgttatcgtccatgtaaatctttataa

SEQ ID NO: 45549 - DNA, 75 bp, Artificial Sequence
  Synthetic
atccaacggaaagtgtaaagacaacgaatacaaacaccatcatctatgttgtttatcgtgtcctccgggaacata

SEQ ID NO: 45550 - DNA, 75 bp, Artificial Sequence
  Synthetic
tttcttcgtctatattcatctcattatatattatataagtcattataggagttaacttcatacaacatctgagat

SEQ ID NO: 45551 - DNA, 75 bp, Artificial Sequence
  Synthetic
tcgcaataatcatttacccgcttgtctaagttgtaacggaagatgcgatagtaatcaggtagagacgcgatcgtg

SEQ ID NO: 45552 - DNA, 75 bp, Artificial Sequence
  Synthetic
aggagaaaatagatatcaaaatatttcaaaggtgtgcactctgaatttcgagattaaatgtaataacaaagattc

SEQ ID NO: 45553 - DNA, 75 bp, Artificial Sequence
  Synthetic
atatattatataagtcattataggagttaacttcatacaacatctgagattcctatcagcacctagttcaataac

SEQ ID NO: 45554 - DNA, 75 bp, Artificial Sequence
  Synthetic
atgtttactgctgcgttaaacattcagacgagtgtaaacactgttgttagagattttgaaaattatgtgaagcag

SEQ ID NO: 45555 - DNA, 75 bp, Artificial Sequence
  Synthetic
actattagctgtatatgaacttttcagtttaatacattttctccatcttaaagtcttggtatcacaacgatatat

SEQ ID NO: 45556 - DNA, 75 bp, Artificial Sequence
  Synthetic
gtaatggagtaattagatgattgttttgttcatttatattctttccacttctacataataattctagtacatctg

SEQ ID NO: 45557 - DNA, 75 bp, Artificial Sequence
  Synthetic
ttgttcatttatattctttccacttctacataataattctagtacatctgtgtctacgtacatattaccgagata

SEQ ID NO: 45558 - DNA, 75 bp, Artificial Sequence
  Synthetic
gtaatcaggtagagacgcgatcgtgtaacacgactcacaatagaatctgtgaatgctctcccggatattattgtc

SEQ ID NO: 45559 - DNA, 75 bp, Artificial Sequence
  Synthetic
tttatacttgtattattaatgatatgtaacaatacagatttgtcaaacatgaatacagtacacacataaactgaa

SEQ ID NO: 45560 - DNA, 75 bp, Artificial Sequence
  Synthetic
gataaacgattcaaatcagatattatagttctaatgtttaataaaatcagcggtgttccattttggagcatgtac

SEQ ID NO: 45561 - DNA, 75 bp, Artificial Sequence
  Synthetic
ctttagcaatcatccatttaaccaattttatgtcgatgcctatcgtgttatgtgctttgaaatatacagagaata

SEQ ID NO: 45562 - DNA, 75 bp, Artificial Sequence
  Synthetic
tgtgctttgaaatatacagagaatatgttactactatatttgccactgttttcataacgactatcctcgtcctca

SEQ ID NO: 45563 - DNA, 75 bp, Artificial Sequence
  Synthetic
tgttactactatatttgccactgttttcataacgactatcctcgtcctcatcatcactatcactattactatcat

SEQ ID NO: 45564 - DNA, 75 bp, Artificial Sequence
  Synthetic
aatgccgtttagatcaacgtattgcgataacagacgacgatcaggttgttattatgcaggaataccatttcatga

SEQ ID NO: 45565 - DNA, 75 bp, Artificial Sequence
  Synthetic
gataacagacgacgatcaggttgttattatgcaggaataccatttcatgaagatagtgtagaagcagatctacat

SEQ ID NO: 45566 - DNA, 75 bp, Artificial Sequence
  Synthetic
ctatcatgttatgaaatgactataatctccttggatacaaaagacgccaaagatgctatagaagatgagatagta

SEQ ID NO: 45567 - DNA, 75 bp, Artificial Sequence
  Synthetic
tcactatcactatcactatcactatcatcatccttatcgtccttattatcatcatagtctattaaacacaaatca

SEQ ID NO: 45568 - DNA, 75 bp, Artificial Sequence
  Synthetic
tcatcctcgtgtaccgaagaagaaaacaaacatcatatgggaatcgatgttattatcaaagtcacaaagcaagac

SEQ ID NO: 45569 - DNA, 75 bp, Artificial Sequence
  Synthetic
cccacgagttataacaaagtcaaagacgcactttcctagtccaataagtgtaaaattcatggctgacaatttagg

SEQ ID NO: 45570 - DNA, 75 bp, Artificial Sequence
  Synthetic
tattaacaaagtagtcgtgtagaggatagttgttgtcagtcgtcttatccatggtcgctccgttatccaacatgc

SEQ ID NO: 45571 - DNA, 75 bp, Artificial Sequence
  Synthetic
cattaattagttctgtagtaatatctttaataatttggctatacatctgttcaatactatctattgatgatttct

SEQ ID NO: 45572 - DNA, 75 bp, Artificial Sequence
  Synthetic
aaatggatatgacaaccctaattcattttgggaagatgctaaaactaagaaacggacatatagtgcaatgacgat

SEQ ID NO: 45573 - DNA, 75 bp, Artificial Sequence
  Synthetic
catactatatagtaataccaatactcaagactacgaaactgatacaatctcttatcatgtgggtaatgttctcga

SEQ ID NO: 45574 - DNA, 75 bp, Artificial Sequence
  Synthetic
catatgtttgatcgtcgtaattaatagtgtggctaatggtactgttaataagtttatagacaatatcatagtatt

SEQ ID NO: 45575 - DNA, 75 bp, Artificial Sequence
  Synthetic
ggtttatctacaatctactagtcaggattatggagatggtaccaaatatacatttaaatccgtaactagatcaga

SEQ ID NO: 45576 - DNA, 75 bp, Artificial Sequence
  Synthetic
aataaattcttgatattaaagtcttctatttctaacactattccatctgtggaaaataatactctgacattatcg

SEQ ID NO: 45577 - DNA, 75 bp, Artificial Sequence
  Synthetic
tttatcaaaacatattctacacgtccggcagattcgataacttatttgatgaataggtttaaaaatatagatatt

SEQ ID NO: 45578 - DNA, 75 bp, Artificial Sequence
  Synthetic
tctttttagaaccagtttggtactggaatttcagttcattcgttgagaatattgatgatttttttaagatgatat

SEQ ID NO: 45579 - DNA, 75 bp, Artificial Sequence
  Synthetic
tgctttagtgttactacatctaaagatcattgtgctacaagtaataatgggttaaaatcttctggctatgggaag

SEQ ID NO: 45580 - DNA, 75 bp, Artificial Sequence
  Synthetic
gaagaaaacaaacatcatatgggaatcgatgttattgtcaaagtcaccaagcaagaccaaacaccgaccaatgat

SEQ ID NO: 45581 - DNA, 75 bp, Artificial Sequence
  Synthetic
tatcattatgtataatcatcactgtcgctatcattattgcgtttgtgtagttctgccctatcatctacatcactg

SEQ ID NO: 45582 - DNA, 75 bp, Artificial Sequence
  Synthetic
ggcctgactatgatccatgtaagtcatatatccatatagagtatagagatacatggatagaatctaacgtgttac

SEQ ID NO: 45583 - DNA, 75 bp, Artificial Sequence
  Synthetic
ttacagagaccgaagacgatgaggtatccgaagatggttccacatcagtcgtaaaaggagatcccaccacttatt

SEQ ID NO: 45584 - DNA, 75 bp, Artificial Sequence
  Synthetic
tcactctcgctatatcttctaaaattacaaacaactggatattcgataacagcatttgtgtagtttttgtctttt

SEQ ID NO: 45585 - DNA, 75 bp, Artificial Sequence
  Synthetic
attattattgatagcattgttattagtactatcataattaaattatcgacattcatgggtgcggaataatcgtta

SEQ ID NO: 45586 - DNA, 75 bp, Artificial Sequence
  Synthetic
tctattgtttagactgtttgtagaatgctgtgatataaacaaactagaaggtacgactccgttacactgttatct

SEQ ID NO: 45587 - DNA, 75 bp, Artificial Sequence
  Synthetic
gtggataaagaaattagtaacaaattaaatgatctgtacaatgcatacaagaagattatggaatatagcgacgga

SEQ ID NO: 45588 - DNA, 75 bp, Artificial Sequence
  Synthetic
ctaaacaaatattagcataatacctatctataagatcaggatccatgttcgagcatactagcatatttgtaactt

SEQ ID NO: 45589 - DNA, 75 bp, Artificial Sequence
  Synthetic
atctataagatcaggatccatgttcgagcatactagcatatttgtaacttcgtcgtaaagcgttagatcaataga

SEQ ID NO: 45590 - DNA, 75 bp, Artificial Sequence
  Synthetic
gtaatattctgttacaaagactggatcacaatctgtactattaacagtaattgtcaattcagaagtcgtgataac

SEQ ID NO: 45591 - DNA, 75 bp, Artificial Sequence
  Synthetic
tatcgtttacataagccattaacggctttaacagatgatctgagtaatatacctctattatacatttaatgttca

SEQ ID NO: 45592 - DNA, 75 bp, Artificial Sequence
  Synthetic
caacaatccaataatatgccggagagtaaacattgacggataaaacaaaaatgctccgcataactctatcatggc

SEQ ID NO: 45593 - DNA, 75 bp, Artificial Sequence
  Synthetic
ttgatatgctttctgatagtatagatagctttagcgaatataaaaatatattaatacactatatatattctaaac

SEQ ID NO: 45594 - DNA, 75 bp, Artificial Sequence
  Synthetic
cctgtgttttgtcagtatattcttcaccattataaagataaaactgatcaaatgtagatttattgtttgtatagt

SEQ ID NO: 45595 - DNA, 75 bp, Artificial Sequence
  Synthetic
gtgtttatgtttatcatgatgagtatttatgataacaaagttttgtattatccggagtggtacagcattgttctt

SEQ ID NO: 45596 - DNA, 75 bp, Artificial Sequence
  Synthetic
agaggtattagtttccttgtttcgagatgagcaaaaagactatacggtaacttcgcagttcaataattacactat

SEQ ID NO: 45597 - DNA, 75 bp, Artificial Sequence
  Synthetic
tatacatgctgacaattaacgatctttataatatatcgtatccacctaccaaagtatagttgtatttgtattttt

SEQ ID NO: 45598 - DNA, 75 bp, Artificial Sequence
  Synthetic
atttttatattatttacacaattaacaatgaattagtttatattactgaattaataatataaaattcccaatctt

SEQ ID NO: 45599 - DNA, 75 bp, Artificial Sequence
  Synthetic
cccttgtgtaacgttagacattctaaatctatattattatctattacagcataaaacacatgcatttttttaaca

SEQ ID NO: 45600 - DNA, 75 bp, Artificial Sequence
  Synthetic
ttaataatataaaattcccaatcttgacataaacacacactgagaaacagcataaacacaaaatccatcaaaaat

SEQ ID NO: 45601 - DNA, 75 bp, Artificial Sequence
  Synthetic
gtgtgtctgaatcgataactctattcatctgaaattggatgagtagggttaatcgaacgattcaggcacaccaca

SEQ ID NO: 45602 - DNA, 75 bp, Artificial Sequence
  Synthetic
tcactattaaagatggagtataatctttatgccgaactaaaaaaaatgacttgtggtcaacccataagtcttttt

SEQ ID NO: 45603 - DNA, 75 bp, Artificial Sequence
  Synthetic
aatcgaacgattcaggcacaccacaaactaaaaaagtgtaccggacactatattccggtttgcaaaacaaaaatg

SEQ ID NO: 45604 - DNA, 75 bp, Artificial Sequence
  Synthetic
tattccggtttgcaaaacaaaaatgttcttaactacattcacaaaaagttacctctcgcgacttcttctttttct

SEQ ID NO: 45605 - DNA, 75 bp, Artificial Sequence
  Synthetic
gaagatatagaatacaatactcttttaatgttaattaattggtatgaatcaaaatacaaaaaactagaaaaggaa

SEQ ID NO: 45606 - DNA, 75 bp, Artificial Sequence
  Synthetic
accagaatcttcgtacctcaaactcgatatatttaaacaagttaatgagatattaacgcgttttatgaatgatga

SEQ ID NO: 45607 - DNA, 75 bp, Artificial Sequence
  Synthetic
ttcacacaagtttttatacagacaaattaattctcgtccatatattttaaaacattgacttttgtactaagaaaa

SEQ ID NO: 45608 - DNA, 75 bp, Artificial Sequence
  Synthetic
cttaacgttacttagttacttagtttacttaattacttaattacttattaatttagtaacgtaaacgtaagttag

SEQ ID NO: 45609 - DNA, 75 bp, Artificial Sequence
  Synthetic
atttagtaacgtaaacgtaagttagtaagtacgtaagtacgatactactacgtatagtagtagtaagtaaggtgt

SEQ ID NO: 45610 - DNA, 75 bp, Artificial Sequence
  Synthetic
gctagagatatcgatggtatgtattgtagatgttatcatggttatattggtattagatgtcagcatatagtatta

SEQ ID NO: 45611 - DNA, 75 bp, Artificial Sequence
  Synthetic
attggcaatttatatagcgcgcaataaatacagaaccaggaaatataaaataatgaaatatgacaataggagcat

SEQ ID NO: 45612 - DNA, 75 bp, Artificial Sequence
  Synthetic
cagagtgagaaaaaaatatcttgtatattattaactaacaaccttggtttccatatagcttaagaaggcatttac

SEQ ID NO: 45613 - DNA, 75 bp, Artificial Sequence
  Synthetic
gtggtgtgtgtgtgtgtgtgtgtgtgtgtgtgtgtgtgtgtgtgtgtgtgtgtgtaaaagtagtagtgagtgagt

SEQ ID NO: 45614 - DNA, 75 bp, Artificial Sequence
  Synthetic
atctccaggtattgtgcttgtattagtaggcattattattacgtgttgtctattatctgtttataggttcactcg

SEQ ID NO: 45615 - DNA, 75 bp, Artificial Sequence
  Synthetic
tctctttctctcttcaatggtctcataaaaaagttttacaaaaatatttttattctctttctctcttcaatggtc

SEQ ID NO: 45616 - DNA, 75 bp, Artificial Sequence
  Synthetic
ataatcggtactaataaaatagtttaactcttttagaaccagtttggtactggaatttcagttcattactcgttg

SEQ ID NO: 45617 - DNA, 75 bp, Artificial Sequence
  Synthetic
aatatttttgtaaaacttttttatgagaccattgaagagagaaagagaatgagaataaaaatattttagtgatgc

SEQ ID NO: 45618 - DNA, 75 bp, Artificial Sequence
  Synthetic
gatatcatatcaacacaaccaaataatataatatatagaaattgtatcatctatcatcttatcagaaacggacta

SEQ ID NO: 45619 - DNA, 75 bp, Artificial Sequence
  Synthetic
tttgtaaatggaacagggtctacagtataagtaccgtctgacttccgtttaagtttcttatacaagtcaatgtta

SEQ ID NO: 45620 - DNA, 75 bp, Artificial Sequence
  Synthetic
agaagaagtcgcgagaggtaactttttgtgaatgtagttaagaacatttttgttttgcaaaccggaatatagtgt

SEQ ID NO: 45621 - DNA, 75 bp, Artificial Sequence
  Synthetic
tccatatatctgtatcatcgtctagtttatcagtgtcccatgctatattcctgttatcatcattagttaatgaaa

SEQ ID NO: 45622 - DNA, 75 bp, Artificial Sequence
  Synthetic
ccgatccgtcgacatacttgaatccatccttgacctcaagttcagatgattccttgcacatgtctcctatacgaa

SEQ ID NO: 45623 - DNA, 75 bp, Artificial Sequence
  Synthetic
ctgttatcatcattagttaatgaaaataactctcgtgcttcagaaaagtcaaatattgtatccatacatacatct

SEQ ID NO: 45624 - DNA, 75 bp, Artificial Sequence
  Synthetic
ggtcgtggatgaggaatgagagtgtcttatctcgtccttggtttacatggatcatcagagtgagaaaaagtatct

SEQ ID NO: 45625 - DNA, 75 bp, Artificial Sequence
  Synthetic
cgtctacatataattatactttcgataatagcaccgttgttactactgaagaactacgaactacaacaccaactc

SEQ ID NO: 45626 - DNA, 75 bp, Artificial Sequence
  Synthetic
gttatttactaacagacattttccagatctattgactataactcctatagtttccacatcaaccaagtaatgatc

SEQ ID NO: 45627 - DNA, 75 bp, Artificial Sequence
  Synthetic
atttaaagtactattttcttgtaaatctaaatgtttaatgattctattaacttcttgattattcatggacttaat

SEQ ID NO: 45628 - DNA, 75 bp, Artificial Sequence
  Synthetic
tctaaatgtttaatgattctattaacttcttgattattcatggacttaataacattggctattatatcatccatg

SEQ ID NO: 45629 - DNA, 75 bp, Artificial Sequence
  Synthetic
ggagcagaccctaattatgcagatgatagaggtaatacttttcttcattacttctgcatctatatgtccgcttat

SEQ ID NO: 45630 - DNA, 75 bp, Artificial Sequence
  Synthetic
taataccacttctaatacaaaatgtgacaagtgcccagatggcacctttacatccattcctaatcatattcccac

SEQ ID NO: 45631 - DNA, 75 bp, Artificial Sequence
  Synthetic
atttggtgaatccaaagtccatcataagacctccaccgacgacggtgtaataagtggtgggatctccttttacga

SEQ ID NO: 45632 - DNA, 75 bp, Artificial Sequence
  Synthetic
cactttctttgatttaaagtctagagtctttgcaaacataatatccttatctgactttatatttcctgtagggtg

SEQ ID NO: 45633 - DNA, 75 bp, Artificial Sequence
  Synthetic
ttttcatttgtctcactattataaaaaaatgttatatcacaaaactttccagatttttctaagatcttgcatatt

SEQ ID NO: 45634 - DNA, 75 bp, Artificial Sequence
  Synthetic
aatgtgacaagtgtccagatgacacctttacatccattcctaatcatattcccacgtgtctaagttgtcgaggca

SEQ ID NO: 45635 - DNA, 75 bp, Artificial Sequence
  Synthetic
gtataattttattttgcctccacatatcggtgtttccaaatatattactagacaatattccatatagttattagt

SEQ ID NO: 45636 - DNA, 75 bp, Artificial Sequence
  Synthetic
atatgatatcagtcctcgtataatatttactcttttgtcattgggagctgatttaacaatacaaaacaatgatcg

SEQ ID NO: 45637 - DNA, 75 bp, Artificial Sequence
  Synthetic
cagtaaccaaaatgaaaacactttagtaattataagaaatatagacggtaacgtcatcatcaacaatccaataat

SEQ ID NO: 45638 - DNA, 75 bp, Artificial Sequence
  Synthetic
taagggtacccaattagaacaagtacgcttattatcatcatttggatcgtatttcataaaagttattgtgttatc

SEQ ID NO: 45639 - DNA, 75 bp, Artificial Sequence
  Synthetic
atttaacaatacaaaacaatgatcgtctaactcctataatggaatatataaaatgtgagtatattgaatacaata

SEQ ID NO: 45640 - DNA, 75 bp, Artificial Sequence
  Synthetic
atttcataaaagttattgtgttatcgatgtcaacacattctacattttttaatcgtctatatagtatttttctga

SEQ ID NO: 45641 - DNA, 75 bp, Artificial Sequence
  Synthetic
aaatgtgagtatattgaatacaatactcttttaatgttaattaattggtacgaatcaaaatatagaaaactagaa

SEQ ID NO: 45642 - DNA, 75 bp, Artificial Sequence
  Synthetic
catctgataataatacatttcatggcaacataggatttctggaaataaataattgctacaatatttctgtatcaa

SEQ ID NO: 45643 - DNA, 75 bp, Artificial Sequence
  Synthetic
ctctgatgtcattccttacataatcaaattcattattaaacagtttaatagtctgcagacctttatcgtcgtaaa

SEQ ID NO: 45644 - DNA, 75 bp, Artificial Sequence
  Synthetic
gatgataaaaacaatacagtatataactattataattgtaaactaactacaaattctacatgtgatgagttaatc

SEQ ID NO: 45645 - DNA, 75 bp, Artificial Sequence
  Synthetic
cacgacgaaggtatactttatgcctcattcagaaacggtaactgtggtaggagactgtctctctaatctcgatgt

SEQ ID NO: 45646 - DNA, 75 bp, Artificial Sequence
  Synthetic
atcgtctctatctttatcgcaatatagtgtatcgacatttttattattattgacctcgtttatcttggaacatgg

SEQ ID NO: 45647 - DNA, 75 bp, Artificial Sequence
  Synthetic
tgatcatggtctatgtagtagatgactttcctcataagattgaatttctctctaataccactaataacatctttc

SEQ ID NO: 45648 - DNA, 75 bp, Artificial Sequence
  Synthetic
taatgaacaacaatttcataaaagaatacaataatcaatgtttaaatcataattacaaagacctatttatcgatt

SEQ ID NO: 45649 - DNA, 75 bp, Artificial Sequence
  Synthetic
tattacacattatacggtatgctgtaacggccaacaccgatcggtaattgtctgccggtgtaatagaatatattc

SEQ ID NO: 45650 - DNA, 75 bp, Artificial Sequence
  Synthetic
cattctgtctttaagggattttctgacaaagttagaaaaaatgatttagacatgaatgtggtaaaagaattactt

SEQ ID NO: 45651 - DNA, 75 bp, Artificial Sequence
  Synthetic
tatcttatgactattaactaacttataaaactatcttataactattaactcatttcaagaagggtgggtggagag

SEQ ID NO: 45652 - DNA, 75 bp, Artificial Sequence
  Synthetic
tatacataataataagttgtggtagtatgatctccatatttataatttaggactttgtattcagtatttttggaa

SEQ ID NO: 45653 - DNA, 75 bp, Artificial Sequence
  Synthetic
tctgatgtaagaagccataacactatgtctggtctcggattaggcgttgttacgtatatatccaccaatccgaga

SEQ ID NO: 45654 - DNA, 75 bp, Artificial Sequence
  Synthetic
gtatacacattttcaaataataaactaaacaaaactgggttaactaataataattatataacaacatctataaaa

SEQ ID NO: 45655 - DNA, 75 bp, Artificial Sequence
  Synthetic
aataacatggtaacgggagtagagatagccgatagatctgttatttcagtcgctgattaatcaattaatagagat

SEQ ID NO: 45656 - DNA, 75 bp, Artificial Sequence
  Synthetic
caatatatcatctatagatcatgtaacaatattacaatacatagatgaaccaaatgatataagactaacagtatg

SEQ ID NO: 45657 - DNA, 75 bp, Artificial Sequence
  Synthetic
ctccggtaggcgtgtgtccggatactccgtatcctattccacattttgtttgggaaacacatgccttgcatccgg

SEQ ID NO: 45658 - DNA, 75 bp, Artificial Sequence
  Synthetic
acaatattacaatacatagatgaaccaaatgatataagactaacagtatgtattatccaaaatattaataacatt

SEQ ID NO: 45659 - DNA, 75 bp, Artificial Sequence
  Synthetic
tcggacttggaaaaaacgtatcgccggaagggactatatgactaacttatctagagatacaggaatacaacaatc

SEQ ID NO: 45660 - DNA, 75 bp, Artificial Sequence
  Synthetic
tattaatgtggttattgattggataaccgatgtgattgttcaatcaatattaagagggttggtaaattggtacat

SEQ ID NO: 45661 - DNA, 75 bp, Artificial Sequence
  Synthetic
acgattagaaaacgatagatactttggtttattggattcgtgtactcatatattttgcataacatgtatcaatat

SEQ ID NO: 45662 - DNA, 75 bp, Artificial Sequence
  Synthetic
tgagtgagtgagtgagtgagtgagtgagtgagtgtatgagtgagatatattgagagtattagtgagagagcatga

SEQ ID NO: 45663 - DNA, 75 bp, Artificial Sequence
  Synthetic
ttccattatacactaataacttcatgtaattaggtgttattaaactttttaaactagccaatacatggagaggag

SEQ ID NO: 45664 - DNA, 75 bp, Artificial Sequence
  Synthetic
gccatggccatgccgagcctctccgcgtgctcctccatcgaggacgacttcaactatggcagctcggtggcgtct

SEQ ID NO: 45665 - DNA, 75 bp, Artificial Sequence
  Synthetic
cgttgctttattatattttataagaatgattgattgtttgacgaatcacgagaactattgagacatatattatta

SEQ ID NO: 45666 - DNA, 75 bp, Artificial Sequence
  Synthetic
gcggtgatcattctccaccacaagttcctcaacgtgattattctccaccacgtagacctcctccaccacttcctc

SEQ ID NO: 45667 - DNA, 75 bp, Artificial Sequence
  Synthetic
atgttggtttaatgatatcatcttcacttaatagtaacgatggaaactttccagcagtgtaacacttatctaaga

SEQ ID NO: 45668 - DNA, 75 bp, Artificial Sequence
  Synthetic
ggtgcgtcggataattgtcctatatgccgtacctgttttagaaacataacaatgagcaagttctataagctagtt

SEQ ID NO: 45669 - DNA, 75 bp, Artificial Sequence
  Synthetic
tctaatttatggagtgctttgtcgacgagtttacttttatacttcatcgatagatggcactgttctatgagatcg

SEQ ID NO: 45670 - DNA, 75 bp, Artificial Sequence
  Synthetic
aggagatttagtatttagcagtgcggatatgatccaagagggcgagatagtcgttctcgttcagaatctttcgca

SEQ ID NO: 45671 - DNA, 75 bp, Artificial Sequence
  Synthetic
atgatggaatctatttcatcgaatgatatatttttcataaatacacttttatagtcctcgtttaaacagaattta

SEQ ID NO: 45672 - DNA, 75 bp, Artificial Sequence
  Synthetic
agcaaatttattagtatcggttacatgaaggactttacgtagagtggtgattccaccatctgtggtacgaacggt

SEQ ID NO: 45673 - DNA, 75 bp, Artificial Sequence
  Synthetic
tgatgtagttcagagaatgactcgtcccttaatacgcaataggctattatcttctttacgtagtaatcgttgtag

SEQ ID NO: 45674 - DNA, 75 bp, Artificial Sequence
  Synthetic
tttcttcccatgtttgagtagatgcgtctttagtagacagttctttatattctacatttggttcattacatatcg

SEQ ID NO: 45675 - DNA, 75 bp, Artificial Sequence
  Synthetic
cgtccgatttcatatcctttgccaaccaatacatatagctaaaatcaggcatatgttccacacatcctgaacaat

SEQ ID NO: 45676 - DNA, 75 bp, Artificial Sequence
  Synthetic
tcgtgaatgacatccgacttgtataagatgtttctgttttcaaacaccaagtcgaataccgtcttaccgtcttta

SEQ ID NO: 45677 - DNA, 75 bp, Artificial Sequence
  Synthetic
ttttatcaaatatgttataatttggagatggaaagatattcattacacaaatacttttatattgctagcaagaag

SEQ ID NO: 45678 - DNA, 75 bp, Artificial Sequence
  Synthetic
aaaataacaattaacaattatcaaattttttctttaatattttacgtggttgaccattcttggtggtaaaataat

SEQ ID NO: 45679 - DNA, 75 bp, Artificial Sequence
  Synthetic
tgaagaggagtcatggtattatagtattcgtctttctgaatatcgaatctatctagtagataccttagtatgttg

SEQ ID NO: 45680 - DNA, 75 bp, Artificial Sequence
  Synthetic
gttgctcgaatattttgtatttgatggtatacggaagattagaaatgtaggtattgtcatcaactgattctatgt

SEQ ID NO: 45681 - DNA, 75 bp, Artificial Sequence
  Synthetic
ctggattagtatccgatagtaataaaatgggtgtaagaaaatgtttgacacctggagaagacacacttatttaca

SEQ ID NO: 45682 - DNA, 75 bp, Artificial Sequence
  Synthetic
tttcatctgggataccacaatttaaaataaactcaacaacgctactttcttttttacacattcccccaaaatagg

SEQ ID NO: 45683 - DNA, 75 bp, Artificial Sequence
  Synthetic
gcttccacgtatattttattttgttttgactcataatactcacgtaattctggattattggcatatcgatgaata

SEQ ID NO: 45684 - DNA, 75 bp, Artificial Sequence
  Synthetic
tctgactgaatacatcctgtgggtttctcatagatggacccatagagaaactgcagggcctctctacaggcttct

SEQ ID NO: 45685 - DNA, 75 bp, Artificial Sequence
  Synthetic
gcgccatgatctattatcgtgttgatgaatcgcttctcggcgtacatcttagtgtacctctttgtctcgtaataa

SEQ ID NO: 45686 - DNA, 75 bp, Artificial Sequence
  Synthetic
atctacgatgttagatatttctctcaatgaatcaatcacacaatctaatgtaggtttatgacataatagcatttt

SEQ ID NO: 45687 - DNA, 75 bp, Artificial Sequence
  Synthetic
ccatgaaaaccgccaaagaacttcgtgcaatcattggactttgtactcaatcagctatcgtctctggaagagtct

SEQ ID NO: 45688 - DNA, 75 bp, Artificial Sequence
  Synthetic
atctgaaccggattctagcagtaaagatactagagattgtttattatatctaacagccttgtgaagaagtgtttc

SEQ ID NO: 45689 - DNA, 75 bp, Artificial Sequence
  Synthetic
tatgtatagcggtatccatcgccttaccctatagttttattgcttactactaaacatggatacagatacagatgt

SEQ ID NO: 45690 - DNA, 75 bp, Artificial Sequence
  Synthetic
tatatcaaagatcttgttatcgattgatagtgaatgaatcagatagtggtgtagaggaatatgtcctttttcatc

SEQ ID NO: 45691 - DNA, 75 bp, Artificial Sequence
  Synthetic
gcattagtcataatatccacgccaccaatcacaaataattcgtcacctaatacagctaaagagtaattatatcta

SEQ ID NO: 45692 - DNA, 75 bp, Artificial Sequence
  Synthetic
cttgcatctgttgcagcttttggaagtatctaataagaaataaagtttaaaatagaattaataaaaacatatagg

SEQ ID NO: 45693 - DNA, 75 bp, Artificial Sequence
  Synthetic
ttatagtactaagaattgggcaagcataagacatgtcacaaagaccctttctgtatgcatcagtgtagaaattat

SEQ ID NO: 45694 - DNA, 75 bp, Artificial Sequence
  Synthetic
ctcactattgcctccagaaatcatacgcgagataatatccaagttaagcgaatacgatttaaatactattttgta

SEQ ID NO: 45695 - DNA, 75 bp, Artificial Sequence
  Synthetic
atggcttaaatcgtgtattcatcgtatagcaatgtaatggagagttaccacattttagtcgtttattcagatcgc

SEQ ID NO: 45696 - DNA, 75 bp, Artificial Sequence
  Synthetic
actcactcactcactcactcactcactcactcactcactcactactactttttacacacacacacacacacacac

SEQ ID NO: 45697 - DNA, 75 bp, Artificial Sequence
  Synthetic
tcgagatgattgacggcatctcccccttccttttttagtagatatttcatcgtgtaagaatcaatattaatattt

SEQ ID NO: 45698 - DNA, 75 bp, Artificial Sequence
  Synthetic
ggaatatttaatgctgaagggtttaatagttttgtactaaactgtccaactgggtctacaccgacatacatcaaa

SEQ ID NO: 45699 - DNA, 75 bp, Artificial Sequence
  Synthetic
cttccttttttagtagatatttcatcgtgtaagaatcaatattaatatttctaaagtatccgtgtatagcctctt

SEQ ID NO: 45700 - DNA, 75 bp, Artificial Sequence
  Synthetic
acacacacacacacacacacacacacacacacacacacccttactttttatcatcttatgaggaatgattgcctt

SEQ ID NO: 45701 - DNA, 75 bp, Artificial Sequence
  Synthetic
ctcaccgtcgtccataaatgcgttaggtatgtaccacatactatcgttaacgatgcgcacaatctcgtccatctc

SEQ ID NO: 45702 - DNA, 75 bp, Artificial Sequence
  Synthetic
atatcgccgaatgtcatatactcaattagtatatgttggaggacatccgagttcattgttttcaatatcaaagag

SEQ ID NO: 45703 - DNA, 75 bp, Artificial Sequence
  Synthetic
ttagtatatgttggaggacatccgagttcattgttttcaatatcaaagagatggtttccttatcatttctccata

SEQ ID NO: 45704 - DNA, 75 bp, Artificial Sequence
  Synthetic
atggattattgtggtagagagtgcactattctatgtcgtctactggatgaagatgtgacgtacaaaaaaataaaa

SEQ ID NO: 45705 - DNA, 75 bp, Artificial Sequence
  Synthetic
ctattctatgtcgtctactggatgaagatgtgacgtacaaaaaaataaaaccagagattgaaacgtgtcataact

SEQ ID NO: 45706 - DNA, 75 bp, Artificial Sequence
  Synthetic
gttaatgatgccattttgataactataatcaaaactgtcagtgttggtattacataaaaagtttatattattgtt

SEQ ID NO: 45707 - DNA, 75 bp, Artificial Sequence
  Synthetic
aatttgaccaaatctaaatctacatctttattgtatctataatcactatttagataatcagccataattcctcga

SEQ ID NO: 45708 - DNA, 75 bp, Artificial Sequence
  Synthetic
ctttattgtatctataatcactatttagataatcagccataattcctcgagtgcaacatgttagatcgtctatat

SEQ ID NO: 45709 - DNA, 75 bp, Artificial Sequence
  Synthetic
ataaaactatcttatgactattaactatcttatgactattaactaacttataaaactatcttataactattaact

SEQ ID NO: 45710 - DNA, 75 bp, Artificial Sequence
  Synthetic
cgatctgtattcgtatatgtcttcggataatatcgacttacgtctactaaaatatctaattgtggataaacggat

SEQ ID NO: 45711 - DNA, 75 bp, Artificial Sequence
  Synthetic
cgactatctcaccctcttggatcatatccgcactgctaaatactaaatcttcttcatgctctctcactaatactc

SEQ ID NO: 45712 - DNA, 75 bp, Artificial Sequence
  Synthetic
atccgactctgaatacagatgagagatgatatacagatgtaatactgtaccgcaatttcgtggttgataatcgtc

SEQ ID NO: 45713 - DNA, 75 bp, Artificial Sequence
  Synthetic
atgatatacagatgtaatactgtaccgcaatttcgtggttgataatcgtcattgtgtgagtgatattcttcatac

SEQ ID NO: 45714 - DNA, 75 bp, Artificial Sequence
  Synthetic
atccattgtctcggattggtggatatatacgtaacaacgcctaatccgagaccagacatagtgttatggcttctt

SEQ ID NO: 45715 - DNA, 75 bp, Artificial Sequence
  Synthetic
ttactttagaaggaaaatcatcatctaggattaaggcgtatctgatacaggccaataatggttcaggatatagat

SEQ ID NO: 45716 - DNA, 75 bp, Artificial Sequence
  Synthetic
ccatgttctaccaatacctgtatcaagccaatatctacatttttggatttcatataggtgaatatattaaagtca

SEQ ID NO: 45717 - DNA, 75 bp, Artificial Sequence
  Synthetic
gcgtttagtataccaagaaatatatcagcgtatgaaggtctatgctttagtgttactacatctaaagatcattgt

SEQ ID NO: 45718 - DNA, 75 bp, Artificial Sequence
  Synthetic
gccacagataatgattggttaaaatctcgtggttatggaaaggcagatgctattaaacaacgtgcctgttttcat

SEQ ID NO: 45719 - DNA, 75 bp, Artificial Sequence
  Synthetic
aaggtaggcaaatgtttatagtactaagaattgggcaagcataagacatgtcacaaagaccctttttgtatgtat

SEQ ID NO: 45720 - DNA, 75 bp, Artificial Sequence
  Synthetic
gtgtattcccctaatggagtaagctgtctccaatttttgtgcaatggattagtaccactgtctagtagtagtttg

SEQ ID NO: 45721 - DNA, 75 bp, Artificial Sequence
  Synthetic
tcttccatttccttaaatctattgctaaacaactcatacatctcaagagcgtttctttcatctatcatataatga

SEQ ID NO: 45722 - DNA, 75 bp, Artificial Sequence
  Synthetic
gtttctttcatctatcatataatgaaagatacgaactgttgcatggcccaagatctcagaatcaaggaagcgagc

SEQ ID NO: 45723 - DNA, 75 bp, Artificial Sequence
  Synthetic
atgtcacaactaatggtattaaatatcatttttgaatgtatttataccaggtcaaaaacttgtacaattattaat

SEQ ID NO: 45724 - DNA, 75 bp, Artificial Sequence
  Synthetic
acttggagcaggattgtttgctgctttgtggattttaattttgtcaggacttttgaggatatttgtgcaaaatga

SEQ ID NO: 45725 - DNA, 75 bp, Artificial Sequence
  Synthetic
ttaacacctccattaactccactttttacaccactggacgatcctccccacattccaccgccaccagatgtataa

SEQ ID NO: 45726 - DNA, 75 bp, Artificial Sequence
  Synthetic
tatatatttcgtatcattatcattatcgttattgctattccacagttacgccatagacatcgaaaatgaaatcac

SEQ ID NO: 45727 - DNA, 75 bp, Artificial Sequence
  Synthetic
ttacaccactggacgatcctccccacattccaccgccaccagatgtataagttttagatcctttactaccgccat

SEQ ID NO: 45728 - DNA, 75 bp, Artificial Sequence
  Synthetic
cctttagaagacatattaataagacttaagagttaagacaagtttaacagtaaaattaatcacaagtactcctac

SEQ ID NO: 45729 - DNA, 75 bp, Artificial Sequence
  Synthetic
agtttatattactgaattaataatataaaattcccaatcttgacataaacacacactgagaaacagcataaacac

SEQ ID NO: 45730 - DNA, 75 bp, Artificial Sequence
  Synthetic
ctaaagtctctagtcacaagagcaatactaccaacctacactattatatgattatagtttctatttttataggaa

SEQ ID NO: 45731 - DNA, 75 bp, Artificial Sequence
  Synthetic
tatcatgttgtctattttattgctttcttctattaacttattcgcgttgtaaattatttgattataaaacttata

SEQ ID NO: 45732 - DNA, 75 bp, Artificial Sequence
  Synthetic
ttgccttttagcccactctgtaaaaactggatgtcttacatatcgtttctttgtatgtttatttatcttgtacat

SEQ ID NO: 45733 - DNA, 75 bp, Artificial Sequence
  Synthetic
atcgatattccatacgagggaaactctagtatggtgattatactaccagacgacatagaaggtctatataacata

SEQ ID NO: 45734 - DNA, 75 bp, Artificial Sequence
  Synthetic
gcatgttggataacggagcgaccatggataagacgacggacaacaactatcctctacacgactactttgttaata

SEQ ID NO: 45735 - DNA, 75 bp, Artificial Sequence
  Synthetic
aactcggaagtagttagccacatatttttattagtggcctcctgtgttttgacagtatattcttcgccattataa

SEQ ID NO: 45736 - DNA, 75 bp, Artificial Sequence
  Synthetic
ttctgatttaagaagccatagcactatgtctggtctcggattaggagtcgttacgtatatatccaccaatccgag

SEQ ID NO: 45737 - DNA, 75 bp, Artificial Sequence
  Synthetic
ttctatatatgatggatacatgctacatgtgtacttataatcgactaatatgaagtacttgatacatatttccag

SEQ ID NO: 45738 - DNA, 75 bp, Artificial Sequence
  Synthetic
caattagatattttagcagacgtaagtctatattatccgaagacatatacgaatacagatcgaaatcatttatat

SEQ ID NO: 45739 - DNA, 75 bp, Artificial Sequence
  Synthetic
gtaacctagatggacataggggatgttgataagcttgacgagtatatgttgttggacgttattgtgtaagatagt

SEQ ID NO: 45740 - DNA, 75 bp, Artificial Sequence
  Synthetic
aaaaaaatattattgtatagaaactttgtacgtgtatttagaacaattttatctcactcacgcttcatcagtaag

SEQ ID NO: 45741 - DNA, 75 bp, Artificial Sequence
  Synthetic
gaataatattttatgagaccatcgaagagagaaagagaataaaaatatttttgtgagaccatcgaagagagaaag

SEQ ID NO: 45742 - DNA, 75 bp, Artificial Sequence
  Synthetic
gccgaacaatcttaatgtctgtatcgcatttattggagacgtaacaatgtagcgcattgtttcctcgtctatcta

SEQ ID NO: 45743 - DNA, 75 bp, Artificial Sequence
  Synthetic
aactagtagaggcggtatcaccgaggcgaccttgtactttgaaaatgttactgaagaatatataggtaatacata

SEQ ID NO: 45744 - DNA, 75 bp, Artificial Sequence
  Synthetic
atacgtgtattagaatactttccgaataagtcttctaaatattgtattaattatgaaaaactatgctatgcgatt

SEQ ID NO: 45745 - DNA, 75 bp, Artificial Sequence
  Synthetic
tcaacatctgtttaagttcatcgagagccacctcctcattttccagatagtcaaacattttgactgaatagaagt

SEQ ID NO: 45746 - DNA, 75 bp, Artificial Sequence
  Synthetic
tatgctttgataagttatgacacgtttcaatctctagttttatttttttgtacgtcacatcttcatccagtagac

SEQ ID NO: 45747 - DNA, 75 bp, Artificial Sequence
  Synthetic
aacattactaaaaaaatatattgttctggttttctttttctttcgtacatctctaattatgaaaaagtaaatcat

SEQ ID NO: 45748 - DNA, 75 bp, Artificial Sequence
  Synthetic
ccaactcacgcatagagaaggtagggaataatggcataatatttattaggttatcatcattgtcattatctacaa

SEQ ID NO: 45749 - DNA, 75 bp, Artificial Sequence
  Synthetic
ctaattattcctatattatatttcacgaaaaatgatgaaggcaatcattcctcataagatgataaaaagtaaggt

SEQ ID NO: 45750 - DNA, 75 bp, Artificial Sequence
  Synthetic
gaatacacatatctggataggtacgtaaatagtagattatatcttttacaatactattagtctttattgcgttat

SEQ ID NO: 45751 - DNA, 75 bp, Artificial Sequence
  Synthetic
ccaaatttttgaaaatatttatttatatgcttaaatctatataatgtagctccttcatcaatcatacatttaata

SEQ ID NO: 45752 - DNA, 75 bp, Artificial Sequence
  Synthetic
gtgtgtgtgtgtgtgtgtgtgtgtgtgtgtgtgtgtgtgtgtgtgtgtgtgtgtgtgtgtgtgtgtgtgtgtgtg

SEQ ID NO: 45753 - DNA, 75 bp, Artificial Sequence
  Synthetic
acatgtttaaataattctctgatgtcattccttacataatcaaattcattattaaacagtttaatagtctgcaga

SEQ ID NO: 45754 - DNA, 75 bp, Artificial Sequence
  Synthetic
ttctcagttcaataactacactatcgataccaaagactggattatcaacgtactatccacacctgatggtctgga

SEQ ID NO: 45755 - DNA, 75 bp, Artificial Sequence
  Synthetic
attccttgcacatgtctccgatacgaacgctaaactctagattcttgacgcattttgtatcgacgatcgttgaac

SEQ ID NO: 45756 - DNA, 75 bp, Artificial Sequence
  Synthetic
gtaaactattacacaattctaaaatataaaacgtatcacggtcgaataatagttgatcaactatataattatcga

SEQ ID NO: 45757 - DNA, 75 bp, Artificial Sequence
  Synthetic
tcgaaattacccatggagatacaacgcgagatactttattactccattaaataatttatcatggagtgataatgt

SEQ ID NO: 45758 - DNA, 75 bp, Artificial Sequence
  Synthetic
tcattcactatcaatcgataacaagatctttgatatactgacggaccgcattgatgactttagaaaatcatccga

SEQ ID NO: 45759 - DNA, 75 bp, Artificial Sequence
  Synthetic
tttacgtaaatagttagatagaatattcattagttcatgaccactatagttactatcgaataacgcgtcaaatat

SEQ ID NO: 45760 - DNA, 75 bp, Artificial Sequence
  Synthetic
acgtcctgtacaaattattgactaaaggatccgatccaaattgtgccgacgaggatggcctcacccctcttcatt

SEQ ID NO: 45761 - DNA, 75 bp, Artificial Sequence
  Synthetic
tgatcgcgggagagtccttaccttgtcctggggacacgctggacaatctagcattcactgtgtttccatcagcgg

SEQ ID NO: 45762 - DNA, 75 bp, Artificial Sequence
  Synthetic
aggatccgatccaaattgtgccgacgaggatggcctcacccctcttcattactactgtaaacacatagtcgtaag

SEQ ID NO: 45763 - DNA, 75 bp, Artificial Sequence
  Synthetic
attgcgtatacaaacggctacgtgaaacgcagtcattccagaaaatggcaatatattattattatagtactttat

SEQ ID NO: 45764 - DNA, 75 bp, Artificial Sequence
  Synthetic
catcttgtgacctagtaataatataataatagagaactgttttacccattctatcatcataatcagtggtgtagt

SEQ ID NO: 45765 - DNA, 75 bp, Artificial Sequence
  Synthetic
ccgtctactaagcccaaaaccaaacgaaccactactcctcgtaaaccagcggctactaaaagatcaaccaaaaag

SEQ ID NO: 45766 - DNA, 75 bp, Artificial Sequence
  Synthetic
tgggtccatctatgagaaacccacaggatgtattcagtcagacaatgtctgacgtcagccacggtgttcagggag

SEQ ID NO: 45767 - DNA, 75 bp, Artificial Sequence
  Synthetic
tgtatccatactgtatgttgctacatgtaggtattcctttatccaataatagtttaaatacatctatattaggat

SEQ ID NO: 45768 - DNA, 75 bp, Artificial Sequence
  Synthetic
aatatatcaaaatcattgatatttttatagtcgactgacgacaataacaaaatcacaacatcgtttttgatatta

SEQ ID NO: 45769 - DNA, 75 bp, Artificial Sequence
  Synthetic
ttatggttatcattatcattatcattatctacaaccaagattccattttttaaaatatactcgacaactttagga

SEQ ID NO: 45770 - DNA, 75 bp, Artificial Sequence
  Synthetic
atcagagtgagaaaaaatatctcttgtatattattaactaacaaccttggtttttccatacccacgaccacattt

SEQ ID NO: 45771 - DNA, 75 bp, Artificial Sequence
  Synthetic
gtatattattaactaacaaccttggtttttccatacccacgaccacattttgttttaggagcacatgtaacacag

SEQ ID NO: 45772 - DNA, 75 bp, Artificial Sequence
  Synthetic
atcaatgattgtgcactgctggcatcgatgttaaatgttttacaactatcatagagtatcttatcgttaaccatg

SEQ ID NO: 45773 - DNA, 75 bp, Artificial Sequence
  Synthetic
gattctatttgtggtaggtgtacaaggtgtgacctctacaactatgacaccaaggagaacgattatattgacgtg

SEQ ID NO: 45774 - DNA, 75 bp, Artificial Sequence
  Synthetic
ggtgtgacctctacaactatgacaccaaggagaacgattatattgacgtgaatgtgtcactcggacaatgtccac

SEQ ID NO: 45775 - DNA, 75 bp, Artificial Sequence
  Synthetic
atagatcatggagcaaacattaacgcggttacgaaaatcggaaatacgccgttacacacttaccttcaacagtat

SEQ ID NO: 45776 - DNA, 75 bp, Artificial Sequence
  Synthetic
tcgataatagcactgttagtactactgaagaactaaaagtgactccatcaccaactccatatgcgactgtaacaa

SEQ ID NO: 45777 - DNA, 75 bp, Artificial Sequence
  Synthetic
ttacatagtttacaacactttaattcttgtgaattataatatgagacaccttgttcacatttcatagacaatgaa

SEQ ID NO: 45778 - DNA, 75 bp, Artificial Sequence
  Synthetic
cttgtgaattataatatgagacaccttgttcacatttcatagacaatgaatttgtattaataatcaagaatccta

SEQ ID NO: 45779 - DNA, 75 bp, Artificial Sequence
  Synthetic
tactgtaacttctcgttttgttagatgtttgcatcgtgctttaacatcaatggtacaaattttatcctcgctttg

SEQ ID NO: 45780 - DNA, 75 bp, Artificial Sequence
  Synthetic
attatatgttaatgtcataaaaactaattgttagacgatttaatctcaatctctttcacaatcatttggtggaat

SEQ ID NO: 45781 - DNA, 75 bp, Artificial Sequence
  Synthetic
aattgtatattcagattatcatgagatgtgtatacgctaacggtatcaataaacggagcacaccatttagtcata

SEQ ID NO: 45782 - DNA, 75 bp, Artificial Sequence
  Synthetic
gaacaaaaatacgggaaattacaaaaggaagaaggacaccatctactttatctattcataaaacataatcaagga

SEQ ID NO: 45783 - DNA, 75 bp, Artificial Sequence
  Synthetic
atgatcaacatttagtatataactagtatgataagcgacgacatccatgtcggaatatattgcgtccgtattggc

SEQ ID NO: 45784 - DNA, 75 bp, Artificial Sequence
  Synthetic
cgtcgttatttttttctcatataatcttcagtattggatggatctccatacaaattaatcccatcagattatatc

SEQ ID NO: 45785 - DNA, 75 bp, Artificial Sequence
  Synthetic
tctacagtgtatggtactagatcctcataagtgtatatatctagagtaatgtttaatttatcaaatggttgataa

SEQ ID NO: 45786 - DNA, 75 bp, Artificial Sequence
  Synthetic
attaactaacgaccttggtttccaaatagcttaagaaggcatttacgtatgacggagatatattccagccgaaaa

SEQ ID NO: 45787 - DNA, 75 bp, Artificial Sequence
  Synthetic
atagcttaagaaggcatttacgtatgacggagatatattccagccgaaaactggataaccatccaaaatattatt

SEQ ID NO: 45788 - DNA, 75 bp, Artificial Sequence
  Synthetic
aactattaactaacttataaaactatcttataactattaactaacttataaaactatcttataactattaactaa

SEQ ID NO: 45789 - DNA, 75 bp, Artificial Sequence
  Synthetic
ctcatacctcgtatacatcggatacgacatcaaccttccgactaaagacgataagacagtattcgacttggtgtt

SEQ ID NO: 45790 - DNA, 75 bp, Artificial Sequence
  Synthetic
aaaactatcttataactattaactaacttataaaactatcttataactattaactaacttataaaactatcttat

SEQ ID NO: 45791 - DNA, 75 bp, Artificial Sequence
  Synthetic
aataaatctaatcgaagacatggttactccttaaaaaaatacgaataatcaccttggctatttagtaagtgtcat

SEQ ID NO: 45792 - DNA, 75 bp, Artificial Sequence
  Synthetic
cataagtgtatatatctagagtaatgtttaatttatcaaatggttgataatatggatcctcatgacaatttccga

SEQ ID NO: 45793 - DNA, 75 bp, Artificial Sequence
  Synthetic
tctaatgaaagtagcttgttttgttttaggcttatccatctattagttttatggttatatacatcaacatcatgt

SEQ ID NO: 45794 - DNA, 75 bp, Artificial Sequence
  Synthetic
tggactcataatctctatacgggattaacggatgttctatatacggggatgagtagttctcttctttaactttat

SEQ ID NO: 45795 - DNA, 75 bp, Artificial Sequence
  Synthetic
taacggatgttctatatacggggatgagtagttctcttctttaactttatactttttactaatcatatttagact

SEQ ID NO: 45796 - DNA, 75 bp, Artificial Sequence
  Synthetic
acagagtatgtgtctgtgcatccggatactactgcgaatttgaaggatcaaacggttgcaggctatgtgtaccac

SEQ ID NO: 45797 - DNA, 75 bp, Artificial Sequence
  Synthetic
gcagtcgtgacataagtcgtctcaaagagattcgaatctccgacaccgacctatatactgtattaagaacagaag

SEQ ID NO: 45798 - DNA, 75 bp, Artificial Sequence
  Synthetic
cttaagagttaagacaagtttaacaataaaattaatcacgagtaccctactaccaacctacactattatatgatt

SEQ ID NO: 45799 - DNA, 75 bp, Artificial Sequence
  Synthetic
tagaacagtgccatctatcgatggagcgtaaaagtaaactcgtcgacaaagcactcaataaattagagtctacca

SEQ ID NO: 45800 - DNA, 75 bp, Artificial Sequence
  Synthetic
tacacacggttactggaccagtggggcaactttggatgtaataaagtgaaattacattttttataaatagatgtt

SEQ ID NO: 45801 - DNA, 75 bp, Artificial Sequence
  Synthetic
agtttgcatccgtagttatcccctttatgtaactgtaaatttctcaacgcgatatctccattaataatgatgtcg

SEQ ID NO: 45802 - DNA, 75 bp, Artificial Sequence
  Synthetic
taatagtaatttactttttcatctttacatactgggtactagttttactatcataagtttataaattccacaagc

SEQ ID NO: 45803 - DNA, 75 bp, Artificial Sequence
  Synthetic
actatgtattatatttcattattatgaggaggatttatgtcatatcatgaaattaataagagaactagattaaag

SEQ ID NO: 45804 - DNA, 75 bp, Artificial Sequence
  Synthetic
atttttttcatctcgttcaattcttgattgcaaagatctatataatcattatagcgtttacttatggactctgga

SEQ ID NO: 45805 - DNA, 75 bp, Artificial Sequence
  Synthetic
attagtagactatcaacgttcagaaaaaccagacactacaacatcatatatcccatctcccggtattgtgcttgt

SEQ ID NO: 45806 - DNA, 75 bp, Artificial Sequence
  Synthetic
ctatatgattggagaagtaggaaacaggaacaagacgacgattactacattattaaatcatgaagtccgtattat

SEQ ID NO: 45807 - DNA, 75 bp, Artificial Sequence
  Synthetic
tactatggaataagccaaccatcttagtataacacacatgtcttaaagtttattaattacatgttgttttatata

SEQ ID NO: 45808 - DNA, 75 bp, Artificial Sequence
  Synthetic
aatgtatcgtatataatagttttctgacgtggagtacagaattttcggttaatgagttcatggtaaggaagggcg

SEQ ID NO: 45809 - DNA, 75 bp, Artificial Sequence
  Synthetic
agtgtaaagacaacgaatacaaacgccataatctgtgttgtttatcgtgtcctccgggaacatacgcttccagat

SEQ ID NO: 45810 - DNA, 75 bp, Artificial Sequence
  Synthetic
tatgaagtacttaatacatattttcagtaacgatttagcctcattacctattaataagtgcctgtcgttggatag

SEQ ID NO: 45811 - DNA, 75 bp, Artificial Sequence
  Synthetic
acggaatatctgatacaatcttccattcattttcaacacggttatacatttccaatttactagaataagtatcat

SEQ ID NO: 45812 - DNA, 75 bp, Artificial Sequence
  Synthetic
ctttaagatgagacatatccgtgtcatcaaaaatatactccattaaaatgattattccggcagcgaacttgatat

SEQ ID NO: 45813 - DNA, 75 bp, Artificial Sequence
  Synthetic
aagatcatatctatgtttcacacaattctttctcatgttcgttaaggtcgtaccccgaacaaaatagtaatcact

SEQ ID NO: 45814 - DNA, 75 bp, Artificial Sequence
  Synthetic
tatactacatccatgtttatctattttgtttatatcatcaatatacggcttacaaagttttagtatcgataacac

SEQ ID NO: 45815 - DNA, 75 bp, Artificial Sequence
  Synthetic
gagccaacaaatataatcgtgtataacatctttgatagaatcagactctaaagaaaacgaatcggctttattata

SEQ ID NO: 45816 - DNA, 75 bp, Artificial Sequence
  Synthetic
ggtcacaccttgtacacctaccacaaatagaatctgtcattgtgactcgaatagttattgtctccttaaagcttc

SEQ ID NO: 45817 - DNA, 75 bp, Artificial Sequence
  Synthetic
aatgagtacactctataaaaacgagaatggcataactaatcataactagttatcaaagtgtctaggacgcgtaat

SEQ ID NO: 45818 - DNA, 75 bp, Artificial Sequence
  Synthetic
gagcgatttcacgttccagatcacgttcagccttcatgcgtctctccctctctctatcgagtttatcagagcagt

SEQ ID NO: 45819 - DNA, 75 bp, Artificial Sequence
  Synthetic
ttgtattgttatttttatattattagtttatattactgaattaataatataaaattcccaatcttgttataaaca

SEQ ID NO: 45820 - DNA, 75 bp, Artificial Sequence
  Synthetic
tacagagtccgagtcagatccagatcccgaggtggaatcagaagatgattccacatcagtcgaggatgtagatcc

SEQ ID NO: 45821 - DNA, 75 bp, Artificial Sequence
  Synthetic
aacgaacataactttagtaaagtcgtctatattaactcttttattttctagccatcgtaatatcatgtttaagat

SEQ ID NO: 45822 - DNA, 75 bp, Artificial Sequence
  Synthetic
cattttcatttttaaccaatactattcataattgagattgatgtaatactttgttactttgaacgtaaagacagt

SEQ ID NO: 45823 - DNA, 75 bp, Artificial Sequence
  Synthetic
tcataattgagattgatgtaatactttgttactttgaacgtaaagacagtacacggatccgtatctccaacaagc

SEQ ID NO: 45824 - DNA, 75 bp, Artificial Sequence
  Synthetic
tgccgcattcggagacggtaactctagtgggcgactgtctatctagcgtcgacgtctacatactatatagtaata

SEQ ID NO: 45825 - DNA, 75 bp, Artificial Sequence
  Synthetic
agtatattctctagttactacgttatcatcgttgtctagaatatcacatactgatctatatccaattttagaaat

SEQ ID NO: 45826 - DNA, 75 bp, Artificial Sequence
  Synthetic
tatatcaattttattatacacacgatagatatctatctaattaatggttctagtcgcacacatatttggaggtat

SEQ ID NO: 45827 - DNA, 75 bp, Artificial Sequence
  Synthetic
gcgtgtccccaggacaaggtaaggactctcccgcgatcactagtgaagaagctctggctatgatcaaagactgcg

SEQ ID NO: 45828 - DNA, 75 bp, Artificial Sequence
  Synthetic
gtccagagggagatggatattgtttacacggtgactgtatccacgctagagatatcgacggtatgtattgtagat

SEQ ID NO: 45829 - DNA, 75 bp, Artificial Sequence
  Synthetic
tttttatagtaccataaataaatacaataattaatttttcgtaaaagtagaaaatatattataatttattgcatg

SEQ ID NO: 45830 - DNA, 75 bp, Artificial Sequence
  Synthetic
gagaaaactagtccacttacgagcactatatacacgtaatgccaaatagaaaatagttttattattataagttcg

SEQ ID NO: 45831 - DNA, 75 bp, Artificial Sequence
  Synthetic
ttataaaaagtttttgattacgacgttataagaggaaagaggacatcattaacatcatacatcatacaaaattac

SEQ ID NO: 45832 - DNA, 75 bp, Artificial Sequence
  Synthetic
tgtatattacacattatacggtattctgtaacggcaaacaccgatcggtaattgtctgccggtgtaacagatata

SEQ ID NO: 45833 - DNA, 75 bp, Artificial Sequence
  Synthetic
ttagatcatccacagaatcagtatatatttttctagatccaaagatgaactctttggcatcctctataatattat

SEQ ID NO: 45834 - DNA, 75 bp, Artificial Sequence
  Synthetic
gtcgatacaaaatgcgtcaagaatctagagtttagtgttcgtatcggagacatgtgcaaggaatcatctgatctt

SEQ ID NO: 45835 - DNA, 75 bp, Artificial Sequence
  Synthetic
ctatcaactataggttcaacgttgacaactgcaggtatgatagctccaccactaatgattgctggaataggtata

SEQ ID NO: 45836 - DNA, 75 bp, Artificial Sequence
  Synthetic
accgcataaaataaaaatccattttcatttttaacacaatactattcataattgagattgatgtaatactttgtt

SEQ ID NO: 45837 - DNA, 75 bp, Artificial Sequence
  Synthetic
caatctgtactattaacagtaattgtcaattcagaagtcgtgataacatctgatgattgttttgtacttagtcga

SEQ ID NO: 45838 - DNA, 75 bp, Artificial Sequence
  Synthetic
aaaaactcactaaacacatttttataaaacggtaagaaaatttcatcacctgtcatgaacgggatggttggacgg

SEQ ID NO: 45839 - DNA, 75 bp, Artificial Sequence
  Synthetic
gatccgtatctccaacaagcacgtagtaatcaaatttggtgttgttaaactttgcaatattcatcaatttagata

SEQ ID NO: 45840 - DNA, 75 bp, Artificial Sequence
  Synthetic
taaaatgggtgtaaggaaatgtttgacgcctggagaagacacacttatttacatcgcatacaaaaacgattccag

SEQ ID NO: 45841 - DNA, 75 bp, Artificial Sequence
  Synthetic
tatccgtactgctaaatactaaatcttcttcatgctctctcactaatactctcactcactcactcactcactcac

SEQ ID NO: 45842 - DNA, 75 bp, Artificial Sequence
  Synthetic
ctttctgatggtctcataaaaaaagttttacaaaaatatttttattctctttctctctttgatggtctcataaaa

SEQ ID NO: 45843 - DNA, 75 bp, Artificial Sequence
  Synthetic
atatagatagacgaggaaacaatgcgctacattgttacgtctccaataaatgcgatacagacattaagattgttc

SEQ ID NO: 45844 - DNA, 75 bp, Artificial Sequence
  Synthetic
acagcggataatattaagaaatacaagtttgtcagaatggcaacgctactatccaaacatccagttattagattg

SEQ ID NO: 45845 - DNA, 75 bp, Artificial Sequence
  Synthetic
cacaataataagttttaagacaatgtttattagtcagaactaatttcttaaagaatggatagtcaaattttttat

SEQ ID NO: 45846 - DNA, 75 bp, Artificial Sequence
  Synthetic
tttttgaatgtatttataccaggtcaaaaacttgtacaattattaataaaaataatttagtgtttaaattttacc

SEQ ID NO: 45847 - DNA, 75 bp, Artificial Sequence
  Synthetic
gatcggtaaagctatcgtagatgtgatgtttcctaaatcgagtataatactcgtttactatcaaacactttcctg

SEQ ID NO: 45848 - DNA, 75 bp, Artificial Sequence
  Synthetic
aaaaaatattaaacctctttctgatggtgtcactaaaatatttttattctcattctcattttctctttctctctt

SEQ ID NO: 45849 - DNA, 75 bp, Artificial Sequence
  Synthetic
aatatctatatacttattgttatcgtattggattctgcatatagatggcttgtatgtcaaagatatagaacacat

SEQ ID NO: 45850 - DNA, 75 bp, Artificial Sequence
  Synthetic
tgaatactatcggttgatgagtaatggggttgatggttgattattgattagtttattcacataaaagaatatttt

SEQ ID NO: 45851 - DNA, 75 bp, Artificial Sequence
  Synthetic
tgtatgtcaaagatatagaacacataaccaatttatagtctcgctttacattctcgaatctaaagttaagagatt

SEQ ID NO: 45852 - DNA, 75 bp, Artificial Sequence
  Synthetic
ttataatccttgactgttaagtcatatccgttagcgaggaaatcttttacaatgtccatatctaaatcatttttt

SEQ ID NO: 45853 - DNA, 75 bp, Artificial Sequence
  Synthetic
cgaatataaatgatttcgatctgtattcgtatatgtcgtcggataatatagacttacgtctgctaaaatatctaa

SEQ ID NO: 45854 - DNA, 75 bp, Artificial Sequence
  Synthetic
caatggagtcataaaatatttttattctctttctctcttcgatggtctcacaaaaatattaaacctctttctgat

SEQ ID NO: 45855 - DNA, 75 bp, Artificial Sequence
  Synthetic
gatacccgcaattattaaatctcgataatatcagaccgtacatacatagacggccattgttagatacgtgattta

SEQ ID NO: 45856 - DNA, 75 bp, Artificial Sequence
  Synthetic
cactatattccggtttgcaaaacaaaaatgttctttaactacattcacaaaaagttacctctcgttacttcttct

SEQ ID NO: 45857 - DNA, 75 bp, Artificial Sequence
  Synthetic
ttatcaacatcccctatgcccatctaggttaccagacaattgtatatcataaaataatgtttataatttacacgt

SEQ ID NO: 45858 - DNA, 75 bp, Artificial Sequence
  Synthetic
gtccaacaacatatactcgtcgagcttatcaacatcccctatgcccatctaggttaccagacaattgtatatcat

SEQ ID NO: 45859 - DNA, 75 bp, Artificial Sequence
  Synthetic
taaaatcatataataaaacgtagatcgtataatattttttggtatataaatgatctagtaaaatccatgtagggg

SEQ ID NO: 45860 - DNA, 75 bp, Artificial Sequence
  Synthetic
tatgatcactattcctattcctattcctattcctattctctcttcgatggtctcataaaaaagttttacaaaaat

SEQ ID NO: 45861 - DNA, 75 bp, Artificial Sequence
  Synthetic
tcaagcgattctctcaattctcggatagtcttcttatcaatttctgatgaatctgaaccatcatctgtcccattt

SEQ ID NO: 45862 - DNA, 75 bp, Artificial Sequence
  Synthetic
cgcaaataggtgcctcgggattccataccatagatccagtagatcctaattcacaatacgatttagattcaccga

SEQ ID NO: 45863 - DNA, 75 bp, Artificial Sequence
  Synthetic
cagacaaattcttgtccatatattttaaaacattgacttttgtactaagaaaaatatctagactatttctctctc

SEQ ID NO: 45864 - DNA, 75 bp, Artificial Sequence
  Synthetic
tgagagtgagagtgataatatatcaatcaaaacagaatatgagaatgaatatgaattctatgatgaaacacaaga

SEQ ID NO: 45865 - DNA, 75 bp, Artificial Sequence
  Synthetic
tagtaaaatccatgtaggggatactgctcacgtttttctttggtacaaaatttcacacaagtttttatacagaca

SEQ ID NO: 45866 - DNA, 75 bp, Artificial Sequence
  Synthetic
tcttcgatggtctcacaaaaatattaaacctctttctgatggagtcgtaaaaaagttttatctctttctctcttc

SEQ ID NO: 45867 - DNA, 75 bp, Artificial Sequence
  Synthetic
tagcatatataggtcccattttttgctttctgtatccaggtagacatagatattctatagtgtctcctatgttgt

SEQ ID NO: 45868 - DNA, 75 bp, Artificial Sequence
  Synthetic
ccagataggttatatccgtacttgcacttaaagtctacattgtcgttgtatgagtatgatcttttaaacccgcta

SEQ ID NO: 45869 - DNA, 75 bp, Artificial Sequence
  Synthetic
ctaacataagagccaatctcaatgttggtttaatgatatcatgttcacataataataacgatggaaactttccag

SEQ ID NO: 45870 - DNA, 75 bp, Artificial Sequence
  Synthetic
tattaaacctctttctgatggagtcgtaaaaaaaagttttatctctttctctcttcgatggtctcacaaaaatat

SEQ ID NO: 45871 - DNA, 75 bp, Artificial Sequence
  Synthetic
taaaatactattatatctttttcgatattaataaatccgtgtcgcccgggttttttatctctttcagtatgtgaa

SEQ ID NO: 45872 - DNA, 75 bp, Artificial Sequence
  Synthetic
ctgaaaagtaatgacatatgttgtttataccaatggtaaggacatattttgaatcttgatattccttcttgaaag

SEQ ID NO: 45873 - DNA, 75 bp, Artificial Sequence
  Synthetic
gaatcttgatattccttcttgaaagtatccatgttccatcgaacatataactaaaaaggaggatataagagatag

SEQ ID NO: 45874 - DNA, 75 bp, Artificial Sequence
  Synthetic
caaaaatattaaacctctttctgatggagtcgtaaaaaagttttatctctttctctcttcgatggtctcacaaaa

SEQ ID NO: 45875 - DNA, 75 bp, Artificial Sequence
  Synthetic
tgattatattatatcatcgctaattagttaatttatttttttgtttttattggtaacgtgacgcataataaaaat

SEQ ID NO: 45876 - DNA, 75 bp, Artificial Sequence
  Synthetic
cctctaaagtttcctacagtcgtgggcacacattttttctagacactaaataaaatagtaaaattaaattaatta

SEQ ID NO: 45877 - DNA, 75 bp, Artificial Sequence
  Synthetic
taatacttttgtgagaccatcgaacgagacgtaagagtataaactttttacgtccatcagaaagaggtttaatat

SEQ ID NO: 45878 - DNA, 75 bp, Artificial Sequence
  Synthetic
tgatatccgctattacaagagtacgttatactagagccaaagtctactccgccaatatcaagttggccattatcg

SEQ ID NO: 45879 - DNA, 75 bp, Artificial Sequence
  Synthetic
gttattttctaacgaatgtaacgaatgggcgttctaatgaaagtagcttgttttgttttaggcgtatccatctat

SEQ ID NO: 45880 - DNA, 75 bp, Artificial Sequence
  Synthetic
ttttgttttaggcgtatccatctattagttttatggttatatacatcaacatcatgtgttgcattagtcataata

SEQ ID NO: 45881 - DNA, 75 bp, Artificial Sequence
  Synthetic
atatttactttttatatgcttgcatcacagaatgatattcacaagtattattaaaaatgagtatcggagttacat

SEQ ID NO: 45882 - DNA, 75 bp, Artificial Sequence
  Synthetic
gtttaatacattgattaaagagtgtccatccagtacctgtacatttagcatatataggtcccattttttgctttc

SEQ ID NO: 45883 - DNA, 75 bp, Artificial Sequence
  Synthetic
tatcatcatcatcatcatcatcactatcatcactatcatcactatcactatcatcatcatcatccttatcgtcct

SEQ ID NO: 45884 - DNA, 75 bp, Artificial Sequence
  Synthetic
tatacaatttgcaaagcggttattggaatatggagcgagcgttaacacaacatcgcgctcgataatcaatacggc

SEQ ID NO: 45885 - DNA, 75 bp, Artificial Sequence
  Synthetic
aagagagaaagagatggttagtcaagatatttttcttagtacaaaagtcaatgttttaaaatatatggacgagaa

SEQ ID NO: 45886 - DNA, 75 bp, Artificial Sequence
  Synthetic
agtttatctatataattatatgatttcgtatcatctctatattctatatttttaaatccattaatacaatatata

SEQ ID NO: 45887 - DNA, 75 bp, Artificial Sequence
  Synthetic
tttttacgactccatcagaaagaggtttaatatttttgtgagaccatcgaagagagaaagagaataaaaatattt

SEQ ID NO: 45888 - DNA, 75 bp, Artificial Sequence
  Synthetic
atctattatgtcataatacatataattttgagcagtgcatatatatgaagttaatggagtataccctaaacaatt

SEQ ID NO: 45889 - DNA, 75 bp, Artificial Sequence
  Synthetic
tgacggaatagtacagcatgatagaacgcatcctattcccaacaatgtcaggaacgtcacgctctccaccttcat

SEQ ID NO: 45890 - DNA, 75 bp, Artificial Sequence
  Synthetic
attatatctatatctatgtatagttagtttatctatataattatatgatttcgtatcatctctatattctatatt

SEQ ID NO: 45891 - DNA, 75 bp, Artificial Sequence
  Synthetic
agagagaaagagaataaaaatattttatgactccattgaagagagaaagagaaaatgagaatgagaataaaaata

SEQ ID NO: 45892 - DNA, 75 bp, Artificial Sequence
  Synthetic
acgcatcctattcccaacaatgtcaggaacgtcacgctctccaccttcatatttatttatccgtaaaaatgttat

SEQ ID NO: 45893 - DNA, 75 bp, Artificial Sequence
  Synthetic
ttattgtctccgtattatcgtaattcagtagccagacaaatggtcaatgatatgatttttaatcaagattcattt

SEQ ID NO: 45894 - DNA, 75 bp, Artificial Sequence
  Synthetic
aagcccatatatgttcgctattgtagaaattgtttttcacagttgctcaaaaacgatggcagtgacttatgagtt

SEQ ID NO: 45895 - DNA, 75 bp, Artificial Sequence
  Synthetic
gttcaaactttgttgttacattagtaatctttttttccaaattagttagccgttgtttgagagtttcctcattgt

SEQ ID NO: 45896 - DNA, 75 bp, Artificial Sequence
  Synthetic
caaagagagaaagagaataaaaatattttgtaaaacttttttatgagaccatcaaagagagaaagagaataaaat

SEQ ID NO: 45897 - DNA, 75 bp, Artificial Sequence
  Synthetic
ttgtaaaacttttttatgagaccatcaaagagagaaagagaataaaaatattttgtaaaacttttttatgagacc

SEQ ID NO: 45898 - DNA, 75 bp, Artificial Sequence
  Synthetic
tagtaaacatatcataatattcgatattacgagttgacatatcgaacaaattccaagtatttgattttggataat

SEQ ID NO: 45899 - DNA, 75 bp, Artificial Sequence
  Synthetic
attacgagttgacatatcgaacaaattccaagtatttgattttggataatattcgtattttgcatctgctataat

SEQ ID NO: 45900 - DNA, 75 bp, Artificial Sequence
  Synthetic
catatatgtcgtaactatcatactgattctcacaatcccgtgatgtagcagtagttggtgcatggtctatatcgt

SEQ ID NO: 45901 - DNA, 75 bp, Artificial Sequence
  Synthetic
ttttgtaaaacttttttatgagaccatcaaagagagaaagagaataaaatatttttgtaaaacttttttttatga

SEQ ID NO: 45902 - DNA, 75 bp, Artificial Sequence
  Synthetic
agtacatgtacaattctatccatttgtcttccttaactatatatttgtacagataattacgagtctcgtgagtaa

SEQ ID NO: 45903 - DNA, 75 bp, Artificial Sequence
  Synthetic
agagagaccctgcagtttctctatgggtccatctatgagaaacccacaggatgtattcagtcagacaatgtctga

SEQ ID NO: 45904 - DNA, 75 bp, Artificial Sequence
  Synthetic
ctatgatgtctaggcatgggagacttttttatccaacgatttttagtgaaacattccacatcgtttaatactaca

SEQ ID NO: 45905 - DNA, 75 bp, Artificial Sequence
  Synthetic
taatagtttaaacacatctacattgggatttgatgttgtcgcgtatttctctacaatattaataccatgtttgat

SEQ ID NO: 45906 - DNA, 75 bp, Artificial Sequence
  Synthetic
aaatgtgagcagtatcccctacatggattttactagatcatttatataccaaaaaatattatacgatctacgttt

SEQ ID NO: 45907 - DNA, 75 bp, Artificial Sequence
  Synthetic
gataaaatctatactgcagaatagattagtgtacgtggaaatgtcatagaaagtgagcaaaaatataggctgtat

SEQ ID NO: 45908 - DNA, 75 bp, Artificial Sequence
  Synthetic
tataaacattattttatgatatacaattgtctggtaacctagatgggcataggggatgttgataagctcgacgag

SEQ ID NO: 45909 - DNA, 75 bp, Artificial Sequence
  Synthetic
tatcgcattagtgagttcagaatatgttataaatttaaatcgaataacgaacataactttagtaaagtcgtctat

SEQ ID NO: 45910 - DNA, 75 bp, Artificial Sequence
  Synthetic
aggggatgttgataagctcgacgagtatatgttgttggacgttattgtttaagaaatagttgatgcatcagaaag

SEQ ID NO: 45911 - DNA, 75 bp, Artificial Sequence
  Synthetic
agattactattctgcaaatttacatttactccgttattgcataaccactctaatatatctatatcaacatccatg

SEQ ID NO: 45912 - DNA, 75 bp, Artificial Sequence
  Synthetic
ggtctatctaccagattattatgtgttataaggtactttttctcataataaactagagtatgagtatgatagtgt

SEQ ID NO: 45913 - DNA, 75 bp, Artificial Sequence
  Synthetic
atagaaaattctaatcctcctattacatataactttccatcattaacacaagtactaacttctgattttaacgac

SEQ ID NO: 45914 - DNA, 75 bp, Artificial Sequence
  Synthetic
agtactaacttctgattttaacgacgacatattagtaactgttttccattttttcgttttaagatctacccgcga

SEQ ID NO: 45915 - DNA, 75 bp, Artificial Sequence
  Synthetic
ttgatggatgtgttacagctataaactttgaaaatatattttaatctgatataactttaaacatggatttttgat

SEQ ID NO: 45916 - DNA, 75 bp, Artificial Sequence
  Synthetic
tgagtacactccgtttaataaactgagtgtaaaactgtatatagatggagtagataatatagaaaattcatatac

SEQ ID NO: 45917 - DNA, 75 bp, Artificial Sequence
  Synthetic
agctgataatatcaaatggcaaagatataaacgtatcatctttaactacatctgtaatattgactgctattgtat

SEQ ID NO: 45918 - DNA, 75 bp, Artificial Sequence
  Synthetic
aattatgtaaaacatttgcattatagaattgtctatctgtattaccgacgattgtccaatattctgttctaggag

SEQ ID NO: 45919 - DNA, 75 bp, Artificial Sequence
  Synthetic
attttagtgacaccatcagaaagaggtttaatattttttatgagaccatcaaagagagaaagagaataaaaatat

SEQ ID NO: 45920 - DNA, 75 bp, Artificial Sequence
  Synthetic
taaagtcatactaccgatgatattaatcaatgcggttttactatctgtatactgttcacgttgtctattatcaat

SEQ ID NO: 45921 - DNA, 75 bp, Artificial Sequence
  Synthetic
tggtatcattaggatctctgtctctcaacatctgtttgagttcatcgagagccacctcctcattttccagatagt

SEQ ID NO: 45922 - DNA, 75 bp, Artificial Sequence
  Synthetic
gatgtaaaatgttgatgatatctacatcgtttggatttttatgtatccactttaataatatcatagctgtaacat

SEQ ID NO: 45923 - DNA, 75 bp, Artificial Sequence
  Synthetic
ataatcagctttttaatcaagtcatgattgtcgtaagaagttagatttatatctgtggtatcgtcaaattcaaat

SEQ ID NO: 45924 - DNA, 75 bp, Artificial Sequence
  Synthetic
gttgttcgctgctatgataatcagatcattcgccgatagcgttaccactatcgacacgacatcgccagaaattac

SEQ ID NO: 45925 - DNA, 75 bp, Artificial Sequence
  Synthetic
ttccacgaaagcaattattacgagacaaagaggtacactaagatgtacgccgagaagcgattcatcaacacgata

SEQ ID NO: 45926 - DNA, 75 bp, Artificial Sequence
  Synthetic
cggatgaatagagttatcgattcagacacacgctttgagttttgttgaatcgatgagtgaagtatcatcggttgc

SEQ ID NO: 45927 - DNA, 75 bp, Artificial Sequence
  Synthetic
ttttagaaaagttaaacatccttatacaatttgtggaattaatattatgaatcatagtttttacacatagatcta

SEQ ID NO: 45928 - DNA, 75 bp, Artificial Sequence
  Synthetic
atatctcaatcactgctataaagatccatcatatactatgataccgtatcagttcctatcaatctctgttttggg

SEQ ID NO: 45929 - DNA, 75 bp, Artificial Sequence
  Synthetic
atgctcttttatctagaggagccgatacgaggatacgtaataattttgattgtacacccatcatggaatacataa

SEQ ID NO: 45930 - DNA, 75 bp, Artificial Sequence
  Synthetic
ttgtttacggtgatgtttatcttcttccagcgcatatagtctaatagcgattcaaacgcgtgatagtttatacca

SEQ ID NO: 45931 - DNA, 75 bp, Artificial Sequence
  Synthetic
tccagcgcatatagtctaatagcgattcaaacgcgtgatagtttataccattcaatataatcgcttcatcattta

SEQ ID NO: 45932 - DNA, 75 bp, Artificial Sequence
  Synthetic
actcactttcttatgagagatgttagacccgagtactggatgggtcttgatgtcgctgtctttctcttcttcgct

SEQ ID NO: 45933 - DNA, 75 bp, Artificial Sequence
  Synthetic
tgttgtctattatctgtttataggttcactcgaagaactaaactacctctacaagatatggttgtgccataattt

SEQ ID NO: 45934 - DNA, 75 bp, Artificial Sequence
  Synthetic
taatacaggttccgtttcagagttacattttacttctatattcagcgtacacatcttggatgtattttgtttttt

SEQ ID NO: 45935 - DNA, 75 bp, Artificial Sequence
  Synthetic
tctattcataaaacataatcaattgcacaaacactctatcaacatactaaggtatctactagatagattcgatat

SEQ ID NO: 45936 - DNA, 75 bp, Artificial Sequence
  Synthetic
atttccttattcacttgtataatttccccattgatagaaaatatcacgctttccattcttgaagtactataagta

SEQ ID NO: 45937 - DNA, 75 bp, Artificial Sequence
  Synthetic
tttgttcaaactttgttgttacattagtaattttttccaaattagttagccgttgtttgagagtttcctcattgt

SEQ ID NO: 45938 - DNA, 75 bp, Artificial Sequence
  Synthetic
aatattctgttacaaagactggatcacaatctgtactattaacagtaattgtcaattcagaagtcgatataacat

SEQ ID NO: 45939 - DNA, 75 bp, Artificial Sequence
  Synthetic
atttcgacattaattcctttttaaatttccgtctatcatctatagaaacatattctatgaatttataaaatgctt

SEQ ID NO: 45940 - DNA, 75 bp, Artificial Sequence
  Synthetic
aagttcattctcagacctccaccgatgatggagtaataagtggtaggaggatctacatcctcgactgatgtggaa

SEQ ID NO: 45941 - DNA, 75 bp, Artificial Sequence
  Synthetic
tttccgtctatcatctatagaaacatattctatgaatttataaaatgcttttacgtgtcctatcgtaggcgatag

SEQ ID NO: 45942 - DNA, 75 bp, Artificial Sequence
  Synthetic
tgcatacacattacaaagtgaataatctaccatcataaaatacttgatacagagctttatcacatcatggttttc

SEQ ID NO: 45943 - DNA, 75 bp, Artificial Sequence
  Synthetic
ttccgacgttgagatggattcactgagaccggtagtggtcgtccgagtacacgatgtgtcgttgacgggatacag

SEQ ID NO: 45944 - DNA, 75 bp, Artificial Sequence
  Synthetic
tagggagagtataaaacattaaatgtccgtacttattaaagtattcagtagccaatcctaactctttcgaatact

SEQ ID NO: 45945 - DNA, 75 bp, Artificial Sequence
  Synthetic
gactaaatttctcgatagcacatcgaatgacgtcatgaccgtgcttagcatgcttgactaatttttattaattat

SEQ ID NO: 45946 - DNA, 75 bp, Artificial Sequence
  Synthetic
tagtttaatatccgcagtcatcttgtctagaatggcaaatctaactgcgggtttaggctttagtttagtttctat

SEQ ID NO: 45947 - DNA, 75 bp, Artificial Sequence
  Synthetic
ggaccacattgacattttcgtggtttatccggtccacatggttgtatctctaccatattgcttaaacaagtaaca

SEQ ID NO: 45948 - DNA, 75 bp, Artificial Sequence
  Synthetic
tatccggtccacatggttgtatctctaccatattgcttaaacaagtaacacatgccgtacataaaccatcttcag

SEQ ID NO: 45949 - DNA, 75 bp, Artificial Sequence
  Synthetic
tattataatcatccggatattcttctacgatctcactaactaatgtttctttggttatactagtatagtcacgat

SEQ ID NO: 45950 - DNA, 75 bp, Artificial Sequence
  Synthetic
gttcaagatagtaatccgcaggacacgtcttaccaaaggttgtatatactaggcaggttacgatagcggataaaa

SEQ ID NO: 45951 - DNA, 75 bp, Artificial Sequence
  Synthetic
tttcccatgtacgacgatctcatagaacagtgccatctatcgatggagcataaaagtaaactcgtcgacaaagca

SEQ ID NO: 45952 - DNA, 75 bp, Artificial Sequence
  Synthetic
tgtatactatcggaatcagttacatgtttaaataattctctgatgtcattccttatacaatcaaattcattatta

SEQ ID NO: 45953 - DNA, 75 bp, Artificial Sequence
  Synthetic
cagacaaataaagaaaatcagatgatcgatgaataatacatttaaattcatcatctgtaagatttttgagatgtc

SEQ ID NO: 45954 - DNA, 75 bp, Artificial Sequence
  Synthetic
cattaaaaaatagaaacgttgtgtagtttatccagaacaattttatctcagtaactcctcatctgtaagtcgtgt

SEQ ID NO: 45955 - DNA, 75 bp, Artificial Sequence
  Synthetic
tgtagatgtcgatgctagatagacagtcgcccactagagttaccgtctccgaatgcggcatgatagtatcattct

SEQ ID NO: 45956 - DNA, 75 bp, Artificial Sequence
  Synthetic
taaacagtatgttgtacggaaagaaccattacaaacattatccatactagaaataaaaatatttaaaaaatatct

SEQ ID NO: 45957 - DNA, 75 bp, Artificial Sequence
  Synthetic
caatgtctatttctacatatgcattagatagatagtaaagtaagagatcttgcacagaattacaattcttaataa

SEQ ID NO: 45958 - DNA, 75 bp, Artificial Sequence
  Synthetic
aagaatgattgtttgacgaatcccgagaactattaagacacattattaggtatatattataaaaaagtttttgat

SEQ ID NO: 45959 - DNA, 75 bp, Artificial Sequence
  Synthetic
tttggcactaatagcgatcattcgcttagcatcttctacattattaactggttgattcaatctatctagcaatgg

SEQ ID NO: 45960 - DNA, 75 bp, Artificial Sequence
  Synthetic
tatattacacattatacggtatgttggtaacgacaaataccgatcggtaattgtctgccggtgtaatagaattat

SEQ ID NO: 45961 - DNA, 75 bp, Artificial Sequence
  Synthetic
atataatagaataaatgagtatgatcattttagataacgattgattttatcattatcgcttcattcttatattct

SEQ ID NO: 45962 - DNA, 75 bp, Artificial Sequence
  Synthetic
ttcttaatcaatgtacatacatcgccgtcatctaccaattcatccaacaacataagctttttaaaatcatcatta

SEQ ID NO: 45963 - DNA, 75 bp, Artificial Sequence
  Synthetic
gtcggtattcgaaatcgcgactccggaaccaattactgataatgaagaagatcacactgacgtcacatatactag

SEQ ID NO: 45964 - DNA, 75 bp, Artificial Sequence
  Synthetic
cgtcatctaccaattcatccaacaacataagctttttaaaatcatcattataataggatggatcgccatcatttc

SEQ ID NO: 45965 - DNA, 75 bp, Artificial Sequence
  Synthetic
gttaaatcaagtagcaccactatgttaatacttattcatattttagtttttaggattgataatcaacataaaaat

SEQ ID NO: 45966 - DNA, 75 bp, Artificial Sequence
  Synthetic
ctgccgttctaatggaggctcaacaaggtaccgaatctagttttgtttttctcgcgaatatcgtcgactcataag

SEQ ID NO: 45967 - DNA, 75 bp, Artificial Sequence
  Synthetic
taggattgataatcaacataaaaattaatacatcatcaattttggaaatacttagtttccacgtagtcaatgaaa

SEQ ID NO: 45968 - DNA, 75 bp, Artificial Sequence
  Synthetic
tggaataggatacggagtatccggacacacgtctgccggagacgtcgtgtgttctccgtgcggtctcggaacata

SEQ ID NO: 45969 - DNA, 75 bp, Artificial Sequence
  Synthetic
acaaatccgataacttttttgacaaattctacgggatccactttaaaagtgtcataccgggttctttttattctt

SEQ ID NO: 45970 - DNA, 75 bp, Artificial Sequence
  Synthetic
atgaaacgtaaatataaactcataaatactgtcattgacaaaatatataatatatcgtcagttgataataacaaa

SEQ ID NO: 45971 - DNA, 75 bp, Artificial Sequence
  Synthetic
atgtcataaattctttaattatatgacactgtgtattttttagttcatccttgttcatcgttaggaatctatcca

SEQ ID NO: 45972 - DNA, 75 bp, Artificial Sequence
  Synthetic
attggtctgattagtttcctttttataaaattgaagtaatatttagtattaattgctgccgtcgcattgcacaaa

SEQ ID NO: 45973 - DNA, 75 bp, Artificial Sequence
  Synthetic
aatatcctcctcgtaataatgaaatataatatacactaattataatatcaatcgattattaacatataggtcatt

SEQ ID NO: 45974 - DNA, 75 bp, Artificial Sequence
  Synthetic
aataacttatccgaactaactgcttctggaggcaaggtattaattactaccatggatggagacaaattatcaaaa

SEQ ID NO: 45975 - DNA, 75 bp, Artificial Sequence
  Synthetic
gtttgtgacaattaacaagagacaaaagagatgccgatactaatacgtaaatagctatatgcgaatccattgtta

SEQ ID NO: 45976 - DNA, 75 bp, Artificial Sequence
  Synthetic
atagctatatgcgaatccattgttacttttttatttcataggtctattaataaatatatgtattacttaagacta

SEQ ID NO: 45977 - DNA, 75 bp, Artificial Sequence
  Synthetic
ttatgttattttgttaaaaataatcatcgaatacttcgtaagatactccttcatgaacataatcagttacaaaac

SEQ ID NO: 45978 - DNA, 75 bp, Artificial Sequence
  Synthetic
gtaatcaagtagagactaaatcgtgtagtaacacacaggacagagtatgtgtctgtgcatccggatactactgcg

SEQ ID NO: 45979 - DNA, 75 bp, Artificial Sequence
  Synthetic
actaaaagtatagacttgtatatgccaaagtttaaactggaaatgacagaaccgtataatctggtacctattcta

SEQ ID NO: 45980 - DNA, 75 bp, Artificial Sequence
  Synthetic
catcatacaaaattacattcttataacatcgtaatcaaaaataattaattgcaattttgatgtataacaactgtc

SEQ ID NO: 45981 - DNA, 75 bp, Artificial Sequence
  Synthetic
tggttgtttctaatataatctgccgtattggatgggttctcaagacaattgcatttagattatattatcatgaat

SEQ ID NO: 45982 - DNA, 75 bp, Artificial Sequence
  Synthetic
tattgatgaagacaagtccttccagcactatctttataatgtagttttactcctggttgtaaaaaggagtaaacg

SEQ ID NO: 45983 - DNA, 75 bp, Artificial Sequence
  Synthetic
tagatgtagaaattaatatgtatcctgttaacaagacctcttgtaattcgagtataggaagcagcagtaccatat

SEQ ID NO: 45984 - DNA, 75 bp, Artificial Sequence
  Synthetic
ctcatacatgtatgaccgttaactacagagtctacactaaaatgattgaacaatagatagtctaccattgcttcg

SEQ ID NO: 45985 - DNA, 75 bp, Artificial Sequence
  Synthetic
cagagtctacactaaaatgattgaacaatagatagtctaccattgcttcgtattcagatagtacagcgtagtaca

SEQ ID NO: 45986 - DNA, 75 bp, Artificial Sequence
  Synthetic
ataacaattataataattataataattataataattataataattataataattataataattataataattata

SEQ ID NO: 45987 - DNA, 75 bp, Artificial Sequence
  Synthetic
gatcctttagtcaataatttgtacagaacgtagtagtttaagctcccattgaatttatatctaagataacacagc

SEQ ID NO: 45988 - DNA, 75 bp, Artificial Sequence
  Synthetic
gaagacgatgagtcagaagaagtcgtaaagggagatcccaccacttattacactgtcgtcggtggaggtcttaac

SEQ ID NO: 45989 - DNA, 75 bp, Artificial Sequence
  Synthetic
atggatcccacttcaacagccatcttaaaatcagtagaatcatattgctttcctttatcattaataatttctaga

SEQ ID NO: 45990 - DNA, 75 bp, Artificial Sequence
  Synthetic
ggtagtatgaagaagtattctccagatgaatgggtgtcacatataaaattttaattagggttaactatagacaat

SEQ ID NO: 45991 - DNA, 75 bp, Artificial Sequence
  Synthetic
tcttaataagaagtgtaagaggactatctccgaatttgttttgtttattaacatccgttgatggaagtaaaagat

SEQ ID NO: 45992 - DNA, 75 bp, Artificial Sequence
  Synthetic
cataaccactctaatatatctatatcaacattcatgttgccgagatacgcgtgtaggataccgtatcctgttttc

SEQ ID NO: 45993 - DNA, 75 bp, Artificial Sequence
  Synthetic
acccatgggtaacaccatttgtaagaaatgccggaaagatacttattccgatactttttctcactccgatgatcc

SEQ ID NO: 45994 - DNA, 75 bp, Artificial Sequence
  Synthetic
gtatttccatcatgatctggttttgagggactaatacctagtttcatcatccatgagattgtagaagcttttgga

SEQ ID NO: 45995 - DNA, 75 bp, Artificial Sequence
  Synthetic
agggactaatacctagtttcatcatccatgagattgtagaagcttttggattgtctgacataagatgtctatgaa

SEQ ID NO: 45996 - DNA, 75 bp, Artificial Sequence
  Synthetic
ctcgggtctaacatctctcataagaaagtgaactacgaagatatcatcggatcaacgatcgtcgatacgaaatgc

SEQ ID NO: 45997 - DNA, 75 bp, Artificial Sequence
  Synthetic
gtatcggagacatgtgcaaggaatcatctgaacttgaggtcaaggatggattcaagtatgtcgacggatcggcat

SEQ ID NO: 45998 - DNA, 75 bp, Artificial Sequence
  Synthetic
atttgacgaattttttatactgatcaaccaacgatttattttttctatccgcttttagcattaaaatcatactac

SEQ ID NO: 45999 - DNA, 75 bp, Artificial Sequence
  Synthetic
aagttgttgtaggtaagtatgtaacggcgtatccccggcatgcgtgactgaattaatgtttgctccgtgttctac

SEQ ID NO: 46000 - DNA, 75 bp, Artificial Sequence
  Synthetic
ttgttaatcttggctccatactgtaccaataaatttattctctctatgacttcatcatctgttcccgagagataa

SEQ ID NO: 46001 - DNA, 75 bp, Artificial Sequence
  Synthetic
atcataagtttataaattccacaagctactatggagtaagccaaccatcttagtatagcacacatgtcttaaagt

SEQ ID NO: 46002 - DNA, 75 bp, Artificial Sequence
  Synthetic
gctcgcatcttagtgtgactccggtgagtgtaataatattgtccgtaacttacgactatgtgtttacagtagtaa

SEQ ID NO: 46003 - DNA, 75 bp, Artificial Sequence
  Synthetic
aatgttcttaactacattcacaaaaagttacctctcgttacttcttctttttctgtctcaatatgtgatacgatt

SEQ ID NO: 46004 - DNA, 75 bp, Artificial Sequence
  Synthetic
tacgactatgtgtttacagtagtaatgaagaggggtgaggccatcctcgtcggcacaatttggatcggatccttt

SEQ ID NO: 46005 - DNA, 75 bp, Artificial Sequence
  Synthetic
tatctcattcaaatccatgaataaagtatatgggcgatattctgccgtgtttaaagattcctttttgggaaaaat

SEQ ID NO: 46006 - DNA, 75 bp, Artificial Sequence
  Synthetic
ttctgtctcaatatgtgatacgattatgatcactattcctatttcctttcagggtctcacaaaaatattaaacct

SEQ ID NO: 46007 - DNA, 75 bp, Artificial Sequence
  Synthetic
gtgttcggttaatgatgccattttgatgactataatcaaaatctgtcagtgttggtagtacataaaaagtttata

SEQ ID NO: 46008 - DNA, 75 bp, Artificial Sequence
  Synthetic
catctagtcctttaattccacaatacgcatgtagaatgtgataatgtccagaaggttcgattgcctgtagcatat

SEQ ID NO: 46009 - DNA, 75 bp, Artificial Sequence
  Synthetic
tttattctctttctctttctctcttcaatggtctcacaaaaatattaaacctctttctgatggagtcgtaaaaat

SEQ ID NO: 46010 - DNA, 75 bp, Artificial Sequence
  Synthetic
cggtccgtcagtatatcaaagatcttgttatcgattgatagtgaatgaatcagatagtggtgtagaggaatatgt

SEQ ID NO: 46011 - DNA, 75 bp, Artificial Sequence
  Synthetic
tgatataatgaattcagtgactgtatcacacgcaccatatactattacttatcacaatgattgggaaccagtaat

SEQ ID NO: 46012 - DNA, 75 bp, Artificial Sequence
  Synthetic
ttttacgactccatcagaaagaggtttaatatttttgtgagaccatcgaagagagaaagagataaaacttttttt

SEQ ID NO: 46013 - DNA, 75 bp, Artificial Sequence
  Synthetic
acatctgtttcatctaagcaactaagaacacgtatacggcagcagcttccttctatactctcatcttttgccaac

SEQ ID NO: 46014 - DNA, 75 bp, Artificial Sequence
  Synthetic
cacaacgaatactcccaaactgcattcgtgttacactatataacaattacactacatttttatcataacactact

SEQ ID NO: 46015 - DNA, 75 bp, Artificial Sequence
  Synthetic
tttctatatctacatctatgtctttatccaacactaaaaatataatagctaatattttattacaatcatccggat

SEQ ID NO: 46016 - DNA, 75 bp, Artificial Sequence
  Synthetic
aactaactacaaattctacatgtgatgagttaatcaatttagatgaagtcattaacaacataactctgacaaata

SEQ ID NO: 46017 - DNA, 75 bp, Artificial Sequence
  Synthetic
taaatgcgttaggtatgtaccacatactatcgttaacgatgcgtacaatctcgtccatctcgcccatctcataat

SEQ ID NO: 46018 - DNA, 75 bp, Artificial Sequence
  Synthetic
ttttctttggtacaaaatttcacacaagtttttatacagacaaattcttgtccatatattttaaaacattgactt

SEQ ID NO: 46019 - DNA, 75 bp, Artificial Sequence
  Synthetic
caatatatttttttagtaatgtttatgcgagacatataaaaataaactccgtgtttatgatgccggtaaatgttt

SEQ ID NO: 46020 - DNA, 75 bp, Artificial Sequence
  Synthetic
tgcgagacatataaaaataaactccgtgtttatgatgccggtaaatgttttatcatcttggacggaatcgatttt

SEQ ID NO: 46021 - DNA, 75 bp, Artificial Sequence
  Synthetic
acaaatctctgatccgtatccatgatggtcatgtttatttctagtccgtatcctgtcaacactatgttagcattt

SEQ ID NO: 46022 - DNA, 75 bp, Artificial Sequence
  Synthetic
ttttgatactatttatttctatacctttcgaaattagtaatttcaataagtctatatcgatgttatcagaacata

SEQ ID NO: 46023 - DNA, 75 bp, Artificial Sequence
  Synthetic
tttgactattacatgtagagtatcgttgagacctcccacaacggatgccgatgtcttttggataagtaatggtat

SEQ ID NO: 46024 - DNA, 75 bp, Artificial Sequence
  Synthetic
acagagaatatgttactactatatttgtcactgttttcataacgactatcctcgtcctcatcatcactatcacta

SEQ ID NO: 46025 - DNA, 75 bp, Artificial Sequence
  Synthetic
taaaaattaatacatcatcaattttggaaatacttagtttccacgtagtcaatgaaacatttgagctcatcgtat

SEQ ID NO: 46026 - DNA, 75 bp, Artificial Sequence
  Synthetic
gtattattaagtatagctgattttatacagtcgatagacaatggttctctaagcactaattctaatattttaaga

SEQ ID NO: 46027 - DNA, 75 bp, Artificial Sequence
  Synthetic
tcgcgttgtatctccatgggtaatttcgaaatcaagttatcgtctgtattaatgttgtccactatggagtcgatc

SEQ ID NO: 46028 - DNA, 75 bp, Artificial Sequence
  Synthetic
aagcactaattctaatattttaagatgtatgtccctacgggcgatgactgatcccctatccactgccacatcaag

SEQ ID NO: 46029 - DNA, 75 bp, Artificial Sequence
  Synthetic
ctatataatcattatagcgttgacttatggactctggaatcttagacgatatacagtcatctataatcatggcat

SEQ ID NO: 46030 - DNA, 75 bp, Artificial Sequence
  Synthetic
tgtcactgttttcataacgactatcctcgtcctcatcatcactatcactatcatcactatcactatcatcactat

SEQ ID NO: 46031 - DNA, 75 bp, Artificial Sequence
  Synthetic
aaaagtcaatgttttaaaatatatggatgagaatatttgtctgtataaaaacttgtgtgaaattttgtaccaaag

SEQ ID NO: 46032 - DNA, 75 bp, Artificial Sequence
  Synthetic
tatacaaactgttgttaaggaatataatgaaagatatggtagacgagtcagtagaacacagtcatcaagtagtga

SEQ ID NO: 46033 - DNA, 75 bp, Artificial Sequence
  Synthetic
gattgatatcttcaatatatgggatacaaagcttacaaatttctaatactgtgggttcatctacaatgaatctcc

SEQ ID NO: 46034 - DNA, 75 bp, Artificial Sequence
  Synthetic
cctctataatattctcagaaaagatattttcgtgttttagtttatcaagatctaacctgttcatatccatgatta

SEQ ID NO: 46035 - DNA, 75 bp, Artificial Sequence
  Synthetic
agagaataaaaatatttttgtaaaactttttttatgagaccatcaaagagagaaagagaataaaaatatttttgt

SEQ ID NO: 46036 - DNA, 75 bp, Artificial Sequence
  Synthetic
gagtcagacttgtattcaacatgcttttctataatcatcttagctatttcggcatcatccaatagtacattttcc

SEQ ID NO: 46037 - DNA, 75 bp, Artificial Sequence
  Synthetic
agtgggatggtaactcagtaataaatcaactagcttcgttttgttttctcttctgtaactacttttctggatggc

SEQ ID NO: 46038 - DNA, 75 bp, Artificial Sequence
  Synthetic
tttaagaaatagttgagacatcagaaagaggtttaatatttttgtaaaacttttttatgagaccatcgaagagag

SEQ ID NO: 46039 - DNA, 75 bp, Artificial Sequence
  Synthetic
cattcccccaaaataggcattcaagcattctattttatatattacagccccatgatctaccataaaatcaacaat

SEQ ID NO: 46040 - DNA, 75 bp, Artificial Sequence
  Synthetic
aaatgtttatagtactaagaattgggcaagcataagacatatcacgaaaaccctgtctgtatgtatcagtgtaga

SEQ ID NO: 46041 - DNA, 75 bp, Artificial Sequence
  Synthetic
aatttgatgtccggaatgaagagaagggaattgttagtgttggtagatgccatatagtcaagcaagagaatcatc

SEQ ID NO: 46042 - DNA, 75 bp, Artificial Sequence
  Synthetic
tgagacagaaaaagaagaagtaacgagaggtaactttttgtgaatgtagttaaagaacatttttgttttgcaaac

SEQ ID NO: 46043 - DNA, 75 bp, Artificial Sequence
  Synthetic
aatttttgtgtaatggattagtgccactgtctagtagtagtttgacaacctcaacattattacaatgctcattga

SEQ ID NO: 46044 - DNA, 75 bp, Artificial Sequence
  Synthetic
ttcttgacgcattttgtatcgacgatcgttgaaccgatgatatcttcgtaactcactttcttatgggagatgtta

SEQ ID NO: 46045 - DNA, 75 bp, Artificial Sequence
  Synthetic
agaattttcggttaatgagttcatggtaaggaagggcgaatgaatgaatgaatgagcctgcctgtatataatata

SEQ ID NO: 46046 - DNA, 75 bp, Artificial Sequence
  Synthetic
tttttctaataccatataaaaatatcattatgtataatcatcactgtcgctatcattattgtgtttgtgtagttc

SEQ ID NO: 46047 - DNA, 75 bp, Artificial Sequence
  Synthetic
ttacatcattaagcatgacggcatgataaaatgaagttttccatccagttttcccatagaacatcagtctccaat

SEQ ID NO: 46048 - DNA, 75 bp, Artificial Sequence
  Synthetic
gagaataaaaatatttttacgactccatcagaaagaggtttaatatttttgtgagaccattgaagagagaaagag

SEQ ID NO: 46049 - DNA, 75 bp, Artificial Sequence
  Synthetic
ttttagttacagaagtgatatcgaatattttatccaaaaagaatgagtaattgattgtcttagaaggagtgtttt

SEQ ID NO: 46050 - DNA, 75 bp, Artificial Sequence
  Synthetic
taatacaatgcggtgtttcctttgtcatcaaattgtgaatcatccattccactgaatagcaaaatctttgctatt

SEQ ID NO: 46051 - DNA, 75 bp, Artificial Sequence
  Synthetic
ctccatcagaaagaggtttaatatttttgtgagaccattgaagagagaaagagaaagagaataaaatatttttac

SEQ ID NO: 46052 - DNA, 75 bp, Artificial Sequence
  Synthetic
atctgccgactccatggtgtgaatcgcactgtcttattcgccattgattttcattttttataactatacacttaa

SEQ ID NO: 46053 - DNA, 75 bp, Artificial Sequence
  Synthetic
aagatttttcaatgctccagcgttcaacaacgtacatactagacgcacgttattatcagctattgcataatacaa

SEQ ID NO: 46054 - DNA, 75 bp, Artificial Sequence
  Synthetic
tcgtttactgtcctccatttttctaactaacgatctaagatgcattatacaatcttcgtcatcgaaccatttttg

SEQ ID NO: 46055 - DNA, 75 bp, Artificial Sequence
  Synthetic
ttcttcatgagtgatcgcgggagagtccttaccttgtcctggggacacgctagacaaccgagcattcactgtgtt

SEQ ID NO: 46056 - DNA, 75 bp, Artificial Sequence
  Synthetic
aagtttaacaataaaattaatcacaagtactcctactaccaacctacgctattatatgattatagtttctatttt

SEQ ID NO: 46057 - DNA, 75 bp, Artificial Sequence
  Synthetic
tattaatcattgattagcttattgctttaattgtttttgtaaactaacattgttaattgaaaagagataacatgt

SEQ ID NO: 46058 - DNA, 75 bp, Artificial Sequence
  Synthetic
attataaagataaaactgatcaaatgtagatttattgtttgtatagttgcattcataataatatgtcaagtcttc

SEQ ID NO: 46059 - DNA, 75 bp, Artificial Sequence
  Synthetic
ttcatatggagtacttgtagaaactcttttaaacatagagaaaaactcactaaacacatttttataaaacggtaa

SEQ ID NO: 46060 - DNA, 75 bp, Artificial Sequence
  Synthetic
acacatttaataaaaataatattcattaaggagattcagattccaccgtacccatcaatataaataaaataatca

SEQ ID NO: 46061 - DNA, 75 bp, Artificial Sequence
  Synthetic
taaacaatattaaggagattccaccttacccataaacaatataaatccagtaatatcatgtctaatgatgaacac

SEQ ID NO: 46062 - DNA, 75 bp, Artificial Sequence
  Synthetic
tgtgcatcactgccatttatttctagattgaagttgaatgcgagtttgtgacagtcaataagagatacaagagat

SEQ ID NO: 46063 - DNA, 75 bp, Artificial Sequence
  Synthetic
aaatggtgtattaaattccagttcttcaggagatgatctagccgtagctaccatgatagtagatgcctccgctac

SEQ ID NO: 46064 - DNA, 75 bp, Artificial Sequence
  Synthetic
tgattgattactgttctttatgattctgcttccttaccatgcaataaattataatatattttctacttttacgaa

SEQ ID NO: 46065 - DNA, 75 bp, Artificial Sequence
  Synthetic
agagcttcttcacgagtgatcgcgggagagtccttaccttgtcctggggacacgctggacaatctagcattcaca

SEQ ID NO: 46066 - DNA, 75 bp, Artificial Sequence
  Synthetic
attatcgatattgaagatgacgatgatatggatgtagaaagcgcataatacgatctataaaaataagtatataaa

SEQ ID NO: 46067 - DNA, 75 bp, Artificial Sequence
  Synthetic
tatataacgggtccctagtcatatgtttaaacgacgccttatctggattaaacatactaggagccatcatttcgg

SEQ ID NO: 46068 - DNA, 75 bp, Artificial Sequence
  Synthetic
atccacgctagagatatcgacggtatgtattgtagatgctctcatggttatacaggcattagatgtcagcatgta

SEQ ID NO: 46069 - DNA, 75 bp, Artificial Sequence
  Synthetic
ctatcgacttaatatccctcttattttcgatagaaaatctagggagtttaagattgtacactttattccctaatt

SEQ ID NO: 46070 - DNA, 75 bp, Artificial Sequence
  Synthetic
ttagtgtctctctgaatcctgataaatcatacatatcaatgatacaactactcagtaaactagtaggaatacaca

SEQ ID NO: 46071 - DNA, 75 bp, Artificial Sequence
  Synthetic
gttgtctattatctgtttataggttcactcgaagaactaataaactacctctacaagatatggttgtgccataat

SEQ ID NO: 46072 - DNA, 75 bp, Artificial Sequence
  Synthetic
tatctggatatgtacgtaaatagttgattatatcttttacaatactattagtgcttattgcattatctatatatc

SEQ ID NO: 46073 - DNA, 75 bp, Artificial Sequence
  Synthetic
gtcatattatcacctattgccaggtacatactaatattagcatccttatacggaaggcgcaccatatcatattct

SEQ ID NO: 46074 - DNA, 75 bp, Artificial Sequence
  Synthetic
aatatcatttttgaatgtatttataccaggtcaaaaacttgtacaattattaataaaaaataatttagtgtttaa

SEQ ID NO: 46075 - DNA, 75 bp, Artificial Sequence
  Synthetic
cttgcaatttagtaactacgttcatcatgggaaccgttttcgtaccgtacttattagtaaaactagcattgcgtg

SEQ ID NO: 46076 - DNA, 75 bp, Artificial Sequence
  Synthetic
agatagataatactctgctgacataatgttgtctattgtagtataaaaattaatatttctatttctatttctatt

SEQ ID NO: 46077 - DNA, 75 bp, Artificial Sequence
  Synthetic
ctgaagactggcaggcatagcagctgccgccaggcacatgcatgccaggacgatatattgtttcatgattgctgt

SEQ ID NO: 46078 - DNA, 75 bp, Artificial Sequence
  Synthetic
gtctatgctaatagagggctttaatttccattttttaatggggttgtggatgaggaatgagagtgtcttatctcg

SEQ ID NO: 46079 - DNA, 75 bp, Artificial Sequence
  Synthetic
tctttatgattcatagtaatagttagttccgacgttgagatggattcgctgagaccggtagtggtcgtccgagta

SEQ ID NO: 46080 - DNA, 75 bp, Artificial Sequence
  Synthetic
actatagaattaattttattaaccgcatctcgtctaaagtttaatctatataggccgaatctatgatattgttga

SEQ ID NO: 46081 - DNA, 75 bp, Artificial Sequence
  Synthetic
tacattgtgtgtttgtgttagtcttgctatcgcataatctggaagcgtatgttcccggaggacacgataaacaac

SEQ ID NO: 46082 - DNA, 75 bp, Artificial Sequence
  Synthetic
agtactacataacgaaaataatgattcgtttttatagcatttatctaaaaatattataatgttatttatagaagg

SEQ ID NO: 46083 - DNA, 75 bp, Artificial Sequence
  Synthetic
tagatcagtgtacgtatatttagatgttttcagcttagctaatcctgatattaattctgtaaatgctggacccag

SEQ ID NO: 46084 - DNA, 75 bp, Artificial Sequence
  Synthetic
atatttctatttctatttctactataatttactctctataacaaatgtcataacttagttcttttatgtcaagaa

SEQ ID NO: 46085 - DNA, 75 bp, Artificial Sequence
  Synthetic
gggattaatctttgttggatcagtctctaagttaacacatgtcacacaggatccatttatagttatatcacatga

SEQ ID NO: 46086 - DNA, 75 bp, Artificial Sequence
  Synthetic
agtgctttgtcgacgagtttacttttatacttcatcgatagatggcactgttctatgagatcgtcgtacatggga

SEQ ID NO: 46087 - DNA, 75 bp, Artificial Sequence
  Synthetic
tgctatcgcataatctggaagcgtatgttcccggaggacacgataaacaacacagattatggcgtttgtattcgt

SEQ ID NO: 46088 - DNA, 75 bp, Artificial Sequence
  Synthetic
ccgtttattttgatttgacgcatatccgcaatttctttttcgcagtcggttataaattctatatatgatggatac

SEQ ID NO: 46089 - DNA, 75 bp, Artificial Sequence
  Synthetic
tttaccttatttttatgtttagtataaaaaattattgatgtctgcacatccttttgtaattgacatctatatatc

SEQ ID NO: 46090 - DNA, 75 bp, Artificial Sequence
  Synthetic
cttttgtaattgacatctatatatccttttgtataatcgactctaatcactttaacttttacagttttccctacc

SEQ ID NO: 46091 - DNA, 75 bp, Artificial Sequence
  Synthetic
tttattattatacatgagagaaacaatatatacgagtataatacggacttcatgatttaataatgtagtaatcgt

SEQ ID NO: 46092 - DNA, 75 bp, Artificial Sequence
  Synthetic
gagacggtgtgagaatatgttccgagaccgcacggagaacacacgacgtctccggcagacgtgtgtccggatact

SEQ ID NO: 46093 - DNA, 75 bp, Artificial Sequence
  Synthetic
tatccatatgcatctgaacactctctgccaagatagctgcagagtgaggatagtcaaaaagatcaatatatagag

SEQ ID NO: 46094 - DNA, 75 bp, Artificial Sequence
  Synthetic
attttctttctatcatggataatatttgtaatggttctttccgtacaacatactgtttagatgatagtcgcttag

SEQ ID NO: 46095 - DNA, 75 bp, Artificial Sequence
  Synthetic
tttattgagtgctttgtcgacgagtttacttttacgctccatcgatagatggcactgttctatgagatcgtcgta

SEQ ID NO: 46096 - DNA, 75 bp, Artificial Sequence
  Synthetic
acaccttttagtaggactagtatcgtacaattcatagctgtattttgaattccaatcacgcataaaaatatcttc

SEQ ID NO: 46097 - DNA, 75 bp, Artificial Sequence
  Synthetic
gataccgtatgtcttctgttcttaatacagtatataggtcggtgtcggagattcgaatctctttgagacgactta

SEQ ID NO: 46098 - DNA, 75 bp, Artificial Sequence
  Synthetic
tttttgattacgatgttataagaggaaagaggacacattaacatcatacatcaattaactacattcttataacat

SEQ ID NO: 46099 - DNA, 75 bp, Artificial Sequence
  Synthetic
tacaattcatagctgtattttgaattccaatcacgcataaaaatatcttccaattgttgacgaagacctaatcca

SEQ ID NO: 46100 - DNA, 75 bp, Artificial Sequence
  Synthetic
tcaattaactacattcttataacatcgtaatcaaaagaattgcaattttgatgtataacaactgtcaatggatta

SEQ ID NO: 46101 - DNA, 75 bp, Artificial Sequence
  Synthetic
tttttcataaatacacttttatagtcctcgtttaaacagaatttactatgtagttccgcgaatgactcgtccctt

SEQ ID NO: 46102 - DNA, 75 bp, Artificial Sequence
  Synthetic
taaatatttttatttctagtatggataatgtttgtaatggttctttccgtacaacatactgtttagatgatagtc

SEQ ID NO: 46103 - DNA, 75 bp, Artificial Sequence
  Synthetic
tggaattggaggatccgcatccggtacaataaacagttttacttctatatctatgtttttagattttagcatggc

SEQ ID NO: 46104 - DNA, 75 bp, Artificial Sequence
  Synthetic
agtatatcatccacatatttataatttaggactttgtattcagtatttttggaatcataaaaaataaaaaaaagt

SEQ ID NO: 46105 - DNA, 75 bp, Artificial Sequence
  Synthetic
gtgttgtcctcgcatgtataagtaccgggtaatatatctttatactctataattaatgaaacatcgttatcagat

SEQ ID NO: 46106 - DNA, 75 bp, Artificial Sequence
  Synthetic
atatcattatctatatcctgatctatatcattatctatatcctgatctatatcatgtatatcatgtatatcatgt

SEQ ID NO: 46107 - DNA, 75 bp, Artificial Sequence
  Synthetic
ataaacgaagatcgttgccagcaactaatcaatagcttaactgacacttgtctgtctatagcggctcttcttaat

SEQ ID NO: 46108 - DNA, 75 bp, Artificial Sequence
  Synthetic
tttctgttttcaaacaccaagtcgaatactgtcttatcgtctttagtcggaaggttgatgtcgtatccgatgtat

SEQ ID NO: 46109 - DNA, 75 bp, Artificial Sequence
  Synthetic
taatcccatcagattatatcatgaataaaaaatagtagcatgcactacttcagccaaatattcttttttgaaacg

SEQ ID NO: 46110 - DNA, 75 bp, Artificial Sequence
  Synthetic
gttttcccatagaacatcagtctccaatttttcttaacaaacagttttaccgtttgcatgttaccactatcaacc

SEQ ID NO: 46111 - DNA, 75 bp, Artificial Sequence
  Synthetic
catcactatcatcactatcatcatccttatcgtccttattatcctcctcatcatcatcatcatcatcatcatcat

SEQ ID NO: 46112 - DNA, 75 bp, Artificial Sequence
  Synthetic
atacagagtgtggaacaccgcttacgttaatactaagaggatgatctgtattataatacgcaggataaaagtttt

SEQ ID NO: 46113 - DNA, 75 bp, Artificial Sequence
  Synthetic
gttaatactaagaggatgatctgtattataatacgcaggataaaagtttttccaattatatggtagattgttaac

SEQ ID NO: 46114 - DNA, 75 bp, Artificial Sequence
  Synthetic
tttatgaatagataaagtagatggtgtccttcttccttttgtaatttcccgtatttttgttcgtgccaattgagt

SEQ ID NO: 46115 - DNA, 75 bp, Artificial Sequence
  Synthetic
tccaattatatggtagattgttaactccaagataccagtatacctcaaaaatttgagtgagatccgctgccaagt

SEQ ID NO: 46116 - DNA, 75 bp, Artificial Sequence
  Synthetic
cattttggaagttccggcttccatgtatttcctggagagcaagtagatgatgaggaaccagatagtttatatccg

SEQ ID NO: 46117 - DNA, 75 bp, Artificial Sequence
  Synthetic
gtattatacacgggtgttaatggggcagtatatacattttcaaataataaactaaacaaaactggtttagctaat

SEQ ID NO: 46118 - DNA, 75 bp, Artificial Sequence
  Synthetic
ctccaatccatgttagcgcttcctaaataaatatgtgtattatcggatatccaaaattttgtatgaagaactcct

SEQ ID NO: 46119 - DNA, 75 bp, Artificial Sequence
  Synthetic
ccatctatcgtagtgaggacacacgtgaacctatgatgagcaaatttattagtatcagttacacgaaggacttta

SEQ ID NO: 46120 - DNA, 75 bp, Artificial Sequence
  Synthetic
cgccgatatttctgaacccgttaatgtatatcttttagccgccgtatattccgatttcaatgacgaagtgacatc

SEQ ID NO: 46121 - DNA, 75 bp, Artificial Sequence
  Synthetic
tccttttatcgatatagcatttggatagcctgtcaatatcgacatcattgaacaacggattcatcttacactttt

SEQ ID NO: 46122 - DNA, 75 bp, Artificial Sequence
  Synthetic
ggagtacagaattttcgattaatgagttcatggtaaggaaatgcgaatgaatgcctgcctgtatataatatacat

SEQ ID NO: 46123 - DNA, 75 bp, Artificial Sequence
  Synthetic
cttatataatggatttgcaccactttctatcaatgattgtgcactacaggcatcaatgttaaatgttttacaact

SEQ ID NO: 46124 - DNA, 75 bp, Artificial Sequence
  Synthetic
tttagttcatccttgttcatcgttaggaatctatccaaaatggcaattatactagaactataactgcgtcgttgt

SEQ ID NO: 46125 - DNA, 75 bp, Artificial Sequence
  Synthetic
tgattttttaacttcgtccgtttccttatgaagatgatgtttggcaccttcataaatttttatttctctattaca

SEQ ID NO: 46126 - DNA, 75 bp, Artificial Sequence
  Synthetic
ttatgaagatgatgtttggcaccttcataaatttttatttctctattacaatttgcatgttgcatgaaataatat

SEQ ID NO: 46127 - DNA, 75 bp, Artificial Sequence
  Synthetic
gataatattattatctacatcttcatacgatccaaattccggaatagatgtatcgcacgctcttgccacccagat

SEQ ID NO: 46128 - DNA, 75 bp, Artificial Sequence
  Synthetic
tagtgtacctctttgtctcgtaataattgctttcgtggaaaaatgatatgtgtctacagtagtaatgaagagaag

SEQ ID NO: 46129 - DNA, 75 bp, Artificial Sequence
  Synthetic
aggggtgttaatcttgggaattatttttctaaccttgttggtagccttcaagacctgactagcaaatccagcctt

SEQ ID NO: 46130 - DNA, 75 bp, Artificial Sequence
  Synthetic
gagatacatatgacagacattgttgacagaaacgtgaccttcattctcaccgtcgtccataaatgcgttaggtat

SEQ ID NO: 46131 - DNA, 75 bp, Artificial Sequence
  Synthetic
tcattatctacaaccaagattccattttttaaaatatactcgacaactttaggatctctattgccaaatttttga

SEQ ID NO: 46132 - DNA, 75 bp, Artificial Sequence
  Synthetic
cgcacaatctcgtccatttcatccatctcataatgatttactttttcataattagagatgtgaaagaaaaagaaa

SEQ ID NO: 46133 - DNA, 75 bp, Artificial Sequence
  Synthetic
gtttaaataatatatcaaacatggagacgcctgatatgtaggcattcttcattctattaatgtctactctatagc

SEQ ID NO: 46134 - DNA, 75 bp, Artificial Sequence
  Synthetic
actgtatgataagatacatattctaacaatagatcttgtatagaatctgtatatcttttaagaattgtggatatt

SEQ ID NO: 46135 - DNA, 75 bp, Artificial Sequence
  Synthetic
gcatagctttccgactggtgcatttggtgtgaaggttcccataagtttggcagctagcagatttagtcttggaac

SEQ ID NO: 46136 - DNA, 75 bp, Artificial Sequence
  Synthetic
agtgaacacacccatacatgaaagcgatgagaaataggattctcatcttgccaaaatatcactagaaaaaattta

SEQ ID NO: 46137 - DNA, 75 bp, Artificial Sequence
  Synthetic
atgtattgtttatattactgaattaataatataaaattcccaatcttgttattaaacgcacgccgagaaaaatag

SEQ ID NO: 46138 - DNA, 75 bp, Artificial Sequence
  Synthetic
aacacattcaatattgtattgttatttttatattatttgtacaatagacaatgtattgtttatattactgaatta

SEQ ID NO: 46139 - DNA, 75 bp, Artificial Sequence
  Synthetic
agaaattgttgctcccatggaatgacccaataagaagactggaactcctggataagtagatttaatagtcaccac

SEQ ID NO: 46140 - DNA, 75 bp, Artificial Sequence
  Synthetic
gcttttttcgaaatggtaatgcgtatgataacggcagcgaagtcactgccgttctaatggaggctcaacaaggta

SEQ ID NO: 46141 - DNA, 75 bp, Artificial Sequence
  Synthetic
tttcaccattacttcttccatgaccaatatgatcatgtgagaatactaaaattcctaacgatgatatattttcag

SEQ ID NO: 46142 - DNA, 75 bp, Artificial Sequence
  Synthetic
ctagttcatcataacgtccagaatgttcaccagctccatgacttatgaataccaatgccttaggatatgtaatag

SEQ ID NO: 46143 - DNA, 75 bp, Artificial Sequence
  Synthetic
ttcaccagctccatgacttatgaataccaatgccttaggatatgtaataggtttccaatatttacaatatatgta

SEQ ID NO: 46144 - DNA, 75 bp, Artificial Sequence
  Synthetic
aactatcaatattaacagttcgtttgatgatcatattatttttatgttttattgataattgtaaaaacatacaat

SEQ ID NO: 46145 - DNA, 75 bp, Artificial Sequence
  Synthetic
gtcctctataatattatcagaaaagatattttcgtgttttagtttatcgagatctaatctgttcatatacgtatc

SEQ ID NO: 46146 - DNA, 75 bp, Artificial Sequence
  Synthetic
tggcgactaaatcagattatgaggatgctgttttttactttgtggatgatgatgaactatgtagtcgtgactcca

SEQ ID NO: 46147 - DNA, 75 bp, Artificial Sequence
  Synthetic
tcatcgatctaatagatgaatatatcacgtggagaaatcatgttatagtgtttaacaaagatattaccagttgtg

SEQ ID NO: 46148 - DNA, 75 bp, Artificial Sequence
  Synthetic
tttatatatttttctctacttacatcatcgagaggatagttatcttcagcatcataatatatattgttcatataa

SEQ ID NO: 46149 - DNA, 75 bp, Artificial Sequence
  Synthetic
cacgtggagaaatcatgttatagtgtttaacaaagatattaccagttgtggaagactgtacaaggaattgatgaa

SEQ ID NO: 46150 - DNA, 75 bp, Artificial Sequence
  Synthetic
ttatttcagcatattaaagtaaaatctagttaccttgaaattgaatacagtgggtggttccgtatcaccagtaag

SEQ ID NO: 46151 - DNA, 75 bp, Artificial Sequence
  Synthetic
ctagttaccttgaaattgaatacagtgggtggttccgtatcaccagtaagaacataatagtcgaatacagtatcc

SEQ ID NO: 46152 - DNA, 75 bp, Artificial Sequence
  Synthetic
ttgtcgagactatgagcgaaggagaccactacatcaatctcacagaagtccatgatcaggaaagtctattcgcta

SEQ ID NO: 46153 - DNA, 75 bp, Artificial Sequence
  Synthetic
ccactacatcaatctcacagaagtccatgatcaggaaagtctattcgctaccataggaatatgtgctaaaatcac

SEQ ID NO: 46154 - DNA, 75 bp, Artificial Sequence
  Synthetic
aaaattatctatctacatcatcgtctattggataacgtctctgtattctacgatagagtgctactttaagatgcg

SEQ ID NO: 46155 - DNA, 75 bp, Artificial Sequence
  Synthetic
cgataatataaacatcttgatactttttctagaaaaaaaattgaattgatgatatagggttcttcataacgcgta

SEQ ID NO: 46156 - DNA, 75 bp, Artificial Sequence
  Synthetic
tactattagtttcgataagatcaatctctagatctatagaatcaaaacacgataggtcagaagataatgaatatc

SEQ ID NO: 46157 - DNA, 75 bp, Artificial Sequence
  Synthetic
tcctatcatgtatttgagagtcttatatgtagcaaacatgatagctgtgatgccaataagctttagatattcacg

SEQ ID NO: 46158 - DNA, 75 bp, Artificial Sequence
  Synthetic
agacagcagtcccatggttccataaacagtgagtttatctttctttgaagcgatattttgtagagatcttataaa

SEQ ID NO: 46159 - DNA, 75 bp, Artificial Sequence
  Synthetic
tttatggcataatgtaatggcgtataaccgttataatatttattaatatcaaacccgtctagagatctaataata

SEQ ID NO: 46160 - DNA, 75 bp, Artificial Sequence
  Synthetic
ctgtaacattctgatttaagaagccatagcaatacttctggtctcggattaggcgtcgttacgtatatatccacc

SEQ ID NO: 46161 - DNA, 75 bp, Artificial Sequence
  Synthetic
ttcaacatcctttaatggtttgttggatttattgacggctactctaacgcgtactcctcttttgggtaattgtac

SEQ ID NO: 46162 - DNA, 75 bp, Artificial Sequence
  Synthetic
tattaacttcgttatttatgtcataaactgtaaatgattctgtagatgccatatcatacatgatattcatgtccc

SEQ ID NO: 46163 - DNA, 75 bp, Artificial Sequence
  Synthetic
acgatgtctatatctatatgagatgacttaatataatattgaagagctgtacaatagtttttatctatagaagac

SEQ ID NO: 46164 - DNA, 75 bp, Artificial Sequence
  Synthetic
aactgtaaatgattctgtagatgccatatcatacatgatattcatgtccctattataatcattattaactttatt

SEQ ID NO: 46165 - DNA, 75 bp, Artificial Sequence
  Synthetic
gtatctatgcttactgtatgctcctagcggagttaatccttcgttgtttctacgaagtctctcgactccgcgaga

SEQ ID NO: 46166 - DNA, 75 bp, Artificial Sequence
  Synthetic
gtctatacaagtcgtccaaacgttgtttactcatatagtattgaacagccatcattacatggtcccgttccgttg

SEQ ID NO: 46167 - DNA, 75 bp, Artificial Sequence
  Synthetic
tagcttgtacgatggattcatcctgttgtctaaatctctttagaatgttatcgatgatgtagtggttatattctc

SEQ ID NO: 46168 - DNA, 75 bp, Artificial Sequence
  Synthetic
tgacataactaaacataacgagatatcaaagaatgtgaatgtctaggacgcgtatttttcatatgatatagatcc

SEQ ID NO: 46169 - DNA, 75 bp, Artificial Sequence
  Synthetic
ttctctatgagacaatatatagtaatgaagagagttcttacacatatcactgtcgtacatacaggtacgaaatac

SEQ ID NO: 46170 - DNA, 75 bp, Artificial Sequence
  Synthetic
cttgtcaaatctatataccatattttctggaagtggatatacatagttgtgatcatcattattgctagcctcatc

SEQ ID NO: 46171 - DNA, 75 bp, Artificial Sequence
  Synthetic
tcaaagaatgtgaatgtctaggacgcgtatttttcatatgatatagatcctgtaagcgttgtctatattctggag

SEQ ID NO: 46172 - DNA, 75 bp, Artificial Sequence
  Synthetic
aaaatgatatgatagttcttacaattagagattgaattctagaatggattctattacaattaccgtcgggaactt

SEQ ID NO: 46173 - DNA, 75 bp, Artificial Sequence
  Synthetic
tgttgctttattatattttataagaatgattgtttgacaatgtcgtagtatagatatattattagaggaggtata

SEQ ID NO: 46174 - DNA, 75 bp, Artificial Sequence
  Synthetic
ctatctgtactatctagagattgtacttcttccagttctggataatatatacgttgatagattagctgagctatt

SEQ ID NO: 46175 - DNA, 75 bp, Artificial Sequence
  Synthetic
gtgtgtgtgtgtgtgtgtgtgtgtgtgtgtgtgtgtgtgtgtgtgtgataaaaagtgtagtgagtgagtgagtga

SEQ ID NO: 46176 - DNA, 75 bp, Artificial Sequence
  Synthetic
gtgtattcttctaatggggtaagctgtctccaatttttgtgtaatggattagtgccactgtctagtagtagtttg

SEQ ID NO: 46177 - DNA, 75 bp, Artificial Sequence
  Synthetic
aggaaatctatctataacatataattattctatcaattttaccaattagttagtatagtgtttaacaaaaatgtt

SEQ ID NO: 46178 - DNA, 75 bp, Artificial Sequence
  Synthetic
tacattttccattattaataagaatgactcctatgtttcccctataatcttcgtctattacaccgcctcctatat

SEQ ID NO: 46179 - DNA, 75 bp, Artificial Sequence
  Synthetic
tttcttcccatgtttgagtagacgcgtctttagtagacagttctttatattctacatttggttcattgcatatca

SEQ ID NO: 46180 - DNA, 75 bp, Artificial Sequence
  Synthetic
acacattatacggtatattgtaacgacccaataccgatcggtaattgtctgccggtgtaatagaattatatatct

SEQ ID NO: 46181 - DNA, 75 bp, Artificial Sequence
  Synthetic
ggagaatctaattagtttttccgcgcataattgacgtacatgagtctgagttccttgtttttactaattatttca

SEQ ID NO: 46182 - DNA, 75 bp, Artificial Sequence
  Synthetic
cctaggagctattctaccatagcagaacttaggcatggacatactaatatctgtcttaattaactgtctttctcc

SEQ ID NO: 46183 - DNA, 75 bp, Artificial Sequence
  Synthetic
aatgatgagttgtggtagtattatctacatatttataatttaggactttgtattcagtatttttggaatcataaa

SEQ ID NO: 46184 - DNA, 75 bp, Artificial Sequence
  Synthetic
tctccaaagaatatatctaataagtagagtcctcatgcttagtaatttaactattttagttaacaactatttttt

SEQ ID NO: 46185 - DNA, 75 bp, Artificial Sequence
  Synthetic
tttttatagtacgttatacaacacataagaaaaatctttcacgaatattaataaaaataaatttagtgtttaaat

SEQ ID NO: 46186 - DNA, 75 bp, Artificial Sequence
  Synthetic
ccacgataaaatcctcctatcaatagcagtttattatccactatgatcaattctggattatccctcggataaata

SEQ ID NO: 46187 - DNA, 75 bp, Artificial Sequence
  Synthetic
gcagtttattatccactatgatcaattctggattatccctcggataaataggatcatctatcagagtccatgtat

SEQ ID NO: 46188 - DNA, 75 bp, Artificial Sequence
  Synthetic
ctaccgaacactaacgcgcatgatttataatgaggataataagtggatggtccaaactgccactgatcatgattg

SEQ ID NO: 46189 - DNA, 75 bp, Artificial Sequence
  Synthetic
ctaaaatattttacttaggagttagaatttatagacgactcatttagtttattactattaatatcattactatta

SEQ ID NO: 46190 - DNA, 75 bp, Artificial Sequence
  Synthetic
gtgtcttatctcgtccttggtttacatggatcatcagagtgagaaaaagatatctcttgtatattattaactaac

SEQ ID NO: 46191 - DNA, 75 bp, Artificial Sequence
  Synthetic
tataatgaggataataagtggatggtccaaactgccactgatcatgattgggtagcaaatattctgtagttgtat

SEQ ID NO: 46192 - DNA, 75 bp, Artificial Sequence
  Synthetic
tattatatttcacgaaaaatgatgaaggcaatcattcctctaagatgataaaaagtaaggtgtgtgtgtgtgtga

SEQ ID NO: 46193 - DNA, 75 bp, Artificial Sequence
  Synthetic
gattcagattccaccgtacccatcaatataaataaaataatgattccttacaccgtacccataatattaataatt

SEQ ID NO: 46194 - DNA, 75 bp, Artificial Sequence
  Synthetic
ctattactattactattactattactattactattactattactatcattatcagtgttagcattattggtattc

SEQ ID NO: 46195 - DNA, 75 bp, Artificial Sequence
  Synthetic
aatcaatattaagaggattagtaaattggtacataaccaatcatcactattctccaaatacacccaataatacaa

SEQ ID NO: 46196 - DNA, 75 bp, Artificial Sequence
  Synthetic
atcatgttgtctattttcttactttgttctattaacttattagcgttgtatattatttgattataaaacttatat

SEQ ID NO: 46197 - DNA, 75 bp, Artificial Sequence
  Synthetic
acagatgtgggatttggtagacctcctactacgtataatttattgttagcgggtaccccgctagcatacagtctg

SEQ ID NO: 46198 - DNA, 75 bp, Artificial Sequence
  Synthetic
cctgatggtagacctgtagccgtctgtgctaatagagggctttaatttccatttttttaatggggttgtggatga

SEQ ID NO: 46199 - DNA, 75 bp, Artificial Sequence
  Synthetic
ttttcgttgtttaagttggatgaatagtatgtcttaataattgttattatttcactaattaatatttagtaatga

SEQ ID NO: 46200 - DNA, 75 bp, Artificial Sequence
  Synthetic
cgctatagcattgttatgtatttcattgttcatccatccaccgatgagatatactatttctccaacatgagtact

SEQ ID NO: 46201 - DNA, 75 bp, Artificial Sequence
  Synthetic
ttgttcatccatccaccgatgagatatactatttctccaacatgagtacttgtacacatatggaatatatctata

SEQ ID NO: 46202 - DNA, 75 bp, Artificial Sequence
  Synthetic
ttctgatgaaacagttaatgatccccacgcaattgtcgatattgtcccacggaagtgaatccgagaactccttca

SEQ ID NO: 46203 - DNA, 75 bp, Artificial Sequence
  Synthetic
ttatttttttctcatataatcttcagtattggatggatctccatacaaattaatcccatcagattatatcatgaa

SEQ ID NO: 46204 - DNA, 75 bp, Artificial Sequence
  Synthetic
gcgtggttgtttatcacaatgaaatattttggtacagtctagtatccattttacattatttatacctctgggtga

SEQ ID NO: 46205 - DNA, 75 bp, Artificial Sequence
  Synthetic
cctccaaattataaaatgctgcataagttatgatatctagacagttgatagcgtctaatctttcttttataaatt

SEQ ID NO: 46206 - DNA, 75 bp, Artificial Sequence
  Synthetic
taaatcaatatagaggaaggagacggatactgtcttttgtgagatagtcatggcgactaaatcagattatgagga

SEQ ID NO: 46207 - DNA, 75 bp, Artificial Sequence
  Synthetic
aatttcgaaaatatattttaatctgataactttaaacatggatttttgatggtggtttaaagtttaaaaaaaaag

SEQ ID NO: 46208 - DNA, 75 bp, Artificial Sequence
  Synthetic
attttggtacagtctagtatccattttacattatttatacctctgggtgaaagataatttgacctgattacattt

SEQ ID NO: 46209 - DNA, 75 bp, Artificial Sequence
  Synthetic
tctatattaactcttttattttctagccatcgtaataccatgtttaagatagtatattctctagttactacgata

SEQ ID NO: 46210 - DNA, 75 bp, Artificial Sequence
  Synthetic
cttaatgacaaaatcaactacataatcctcgtctggaacatttagttcgtcgctttctagaataagtttcataga

SEQ ID NO: 46211 - DNA, 75 bp, Artificial Sequence
  Synthetic
tcctcgtctggaacatttagttcgtcgctttctagaataagtttcatagatagataatcaaaattgtctatgatg

SEQ ID NO: 46212 - DNA, 75 bp, Artificial Sequence
  Synthetic
catacgtttcaatcgctaagtcctcataagtcgtaaactctttgaatattggtcccatatcatcaatgtttagat

SEQ ID NO: 46213 - DNA, 75 bp, Artificial Sequence
  Synthetic
tctgttcttgcatctgttgcagcttttggaagtatctaataagaaataaagtttaaaatagaattaataaaaaca

SEQ ID NO: 46214 - DNA, 75 bp, Artificial Sequence
  Synthetic
gataccatcacccaaatgttctataaacttagtactctcgtccgatttcatatcctttgccaaccaatacatatt

SEQ ID NO: 46215 - DNA, 75 bp, Artificial Sequence
  Synthetic
gttttatgtttattgtttattcacgcacacattttggaagttccggctgccatgtatttcctggagagcaagtag

SEQ ID NO: 46216 - DNA, 75 bp, Artificial Sequence
  Synthetic
taagagattggatagtccgtattctatacccatcatgtaacactcgacacaatattcctttctaaaatctcgtag

SEQ ID NO: 46217 - DNA, 75 bp, Artificial Sequence
  Synthetic
gaacacagtaacttcttatcagacgtaagtacttgatctcccagaattatattcacatactcctccattgtgtaa

SEQ ID NO: 46218 - DNA, 75 bp, Artificial Sequence
  Synthetic
aatattcctttctaaaatctcgtaggataaagtttatacaagtgtagatgataaattctacagaagttaatatag

SEQ ID NO: 46219 - DNA, 75 bp, Artificial Sequence
  Synthetic
acatttgatttcatctgcattaccatatgaatgaacacacccatacatgaacgcaatgagaaataggagtctcat

SEQ ID NO: 46220 - DNA, 75 bp, Artificial Sequence
  Synthetic
aacttagtactctcgtccgatttcatatcctttgccaaccaatacatattgctaaattctggcatatgtttcaca

SEQ ID NO: 46221 - DNA, 75 bp, Artificial Sequence
  Synthetic
tatgaatgaacacacccatacatgaacgcaatgagaaataggagtctcattttctcaagatctcactagaaaaaa

SEQ ID NO: 46222 - DNA, 75 bp, Artificial Sequence
  Synthetic
aatggaacagggtctacagtataagtaccgtctgacttccgtttaagtttcttatacaagtcaatgttatacaaa

SEQ ID NO: 46223 - DNA, 75 bp, Artificial Sequence
  Synthetic
tgatatcactgtttccggagtaggatatattaaagtctttacagatttcgtccgattcaaataaatcactaaata

SEQ ID NO: 46224 - DNA, 75 bp, Artificial Sequence
  Synthetic
atattgcctcctatagcctcaataattgttttgaatttcttagtcatagacaatgctaatatattcttacagtac

SEQ ID NO: 46225 - DNA, 75 bp, Artificial Sequence
  Synthetic
tacgtctagtacagtaacacacgcatcacgtataaatggtttcccatacttttcaatcgctaagtcctcataagt

SEQ ID NO: 46226 - DNA, 75 bp, Artificial Sequence
  Synthetic
tcacgtataaatggtttcccatacttttcaatcgctaagtcctcataagtcgtaaactctttgaatacgggtccc

SEQ ID NO: 46227 - DNA, 75 bp, Artificial Sequence
  Synthetic
acagtattgacaaatatcggcatttatgtttctttaaaagtcaacatctagagaaaaatgattatcttcttgaga

SEQ ID NO: 46228 - DNA, 75 bp, Artificial Sequence
  Synthetic
tcaaaaaaaattaataatacctagaaaatattccacgagcattccttttatcgatatagcatttggatagcctgt

SEQ ID NO: 46229 - DNA, 75 bp, Artificial Sequence
  Synthetic
gttgatacgttcagcatcacctttcatccatatacatagtgcatccatggcttcatcttctgattttgtgtcgag

SEQ ID NO: 46230 - DNA, 75 bp, Artificial Sequence
  Synthetic
tatatcctgcactataccattatctatatcctgcactataccattatctatatcatgcactataccattatctat

SEQ ID NO: 46231 - DNA, 75 bp, Artificial Sequence
  Synthetic
ttctatatatgttttcatcatttcacaattcattcctataagtttaactggaagagccgcagtaagaaattcttg

SEQ ID NO: 46232 - DNA, 75 bp, Artificial Sequence
  Synthetic
gatatttctctcaatgaatcaatcacacaatctaatgtaggtttatgacataatagcatgttcagtagttcaatg

SEQ ID NO: 46233 - DNA, 75 bp, Artificial Sequence
  Synthetic
gcgcgccatcatgaataacagcagtgaattaattgctgttattaatggatttagaaatagtggacgattttgtga

SEQ ID NO: 46234 - DNA, 75 bp, Artificial Sequence
  Synthetic
catgtttaaaaaatgacctatatgttgatacttgatattgatattgatattgatattgatattgatattgatatt

SEQ ID NO: 46235 - DNA, 75 bp, Artificial Sequence
  Synthetic
gtggatgcaataaatgtttaaacatcaaacatgcgaaatcgcagtgtagaccctcgtctctactaattaattcgt

SEQ ID NO: 46236 - DNA, 75 bp, Artificial Sequence
  Synthetic
caaacatgcgaaatcgcagtgtagaccctcgtctctactaattaattcgttggaaaacgtgagtccgggcattag

SEQ ID NO: 46237 - DNA, 75 bp, Artificial Sequence
  Synthetic
ccctcgtctctactaattaattcgttggaaaacgtgagtccgggcattaggccacgctttttaagccaaaatatg

SEQ ID NO: 46238 - DNA, 75 bp, Artificial Sequence
  Synthetic
aagtctctctccataaccggcgctgtcatgtatccacttttgagcccaatcggccttcttttttacacaaggcat

SEQ ID NO: 46239 - DNA, 75 bp, Artificial Sequence
  Synthetic
aactgatatccgctattgcaagagtacgttatgctagagccaaagtctactccactaatatcaatttgaccattt

SEQ ID NO: 46240 - DNA, 75 bp, Artificial Sequence
  Synthetic
gtaataaattgatgacgttatgtctatctatgtatacctttccagtatatgagtaaataactatagaagttagac

SEQ ID NO: 46241 - DNA, 75 bp, Artificial Sequence
  Synthetic
tcattaggacacgttttaccaaatgatgtatatactaggcaggttactatagcggataaaaagatagtattcatc

SEQ ID NO: 46242 - DNA, 75 bp, Artificial Sequence
  Synthetic
tttttttcattactatctttaacataagtatctatcaaaagactatacatttccgaatgaatgttttcaatggcc

SEQ ID NO: 46243 - DNA, 75 bp, Artificial Sequence
  Synthetic
tgtccatccattgcctgtgcatttagcatatatggatcccattttttgctttctgtatccaggtagacattcata

SEQ ID NO: 46244 - DNA, 75 bp, Artificial Sequence
  Synthetic
taaagatccatcatatactatgataccgtatcagttcctatcaatctctgtttttggggtgaattcaaaaaaatt

SEQ ID NO: 46245 - DNA, 75 bp, Artificial Sequence
  Synthetic
tgtactggagccattgtcttaactataatggtgcttgtatcgaaaaactttaatgcagataacggaagctcttcg

SEQ ID NO: 46246 - DNA, 75 bp, Artificial Sequence
  Synthetic
tgtctttgttatcttttgtgtggaatgttatatcacaaaactttccagattttctaagatcatgcatattgctag

SEQ ID NO: 46247 - DNA, 75 bp, Artificial Sequence
  Synthetic
gtttctttcatttcagttatgtatggatttagcacgtttgggaagcatgagctcatatgatttcagtactgtagt

SEQ ID NO: 46248 - DNA, 75 bp, Artificial Sequence
  Synthetic
gtcgcagttcatgatatcaaacatagaatcagatgaaattaattgtttgaatctagcatccttccacaatgtttc

SEQ ID NO: 46249 - DNA, 75 bp, Artificial Sequence
  Synthetic
atacattgtccaataataaaaagtcatgctattgtaggaattgtttttcacagttgctcaaaaacgatgatagcg

SEQ ID NO: 46250 - DNA, 75 bp, Artificial Sequence
  Synthetic
agtatctccctattacctcattatatgataatgtgtaaatagatacttgaacttaacaatatcgtttataaaaaa

SEQ ID NO: 46251 - DNA, 75 bp, Artificial Sequence
  Synthetic
cagttatcatctatatgactgtatttggatcttttatacattgccattgcagctatcactacaataattacaagt

SEQ ID NO: 46252 - DNA, 75 bp, Artificial Sequence
  Synthetic
atctcaatctcaatctctatccaaggatgtaattaaatgtttgatcgataacaatgtttccatccatggcagaga

SEQ ID NO: 46253 - DNA, 75 bp, Artificial Sequence
  Synthetic
atgacttaatataatattgaagagctgtacaatagtttctatctatagaagacggcttgattccatgattaatta

SEQ ID NO: 46254 - DNA, 75 bp, Artificial Sequence
  Synthetic
ctataattttgtgaaaacaggtaacaagaaaactcgtcatcgttcaaatttttaacgatagtaaaccgattaaac

SEQ ID NO: 46255 - DNA, 75 bp, Artificial Sequence
  Synthetic
actgcatccattttctatgaataaatcaataatttcaggaacaggatcatctgtcattacataattttctataac

SEQ ID NO: 46256 - DNA, 75 bp, Artificial Sequence
  Synthetic
tttaacgatagtaaaccgattaaacgtcgagctaatttctaacgctagcgactctgttggatatggatttccaga

SEQ ID NO: 46257 - DNA, 75 bp, Artificial Sequence
  Synthetic
tattttctttgttgtagtatcaggagtacatctggcacaactattgactgcaggtaccgtacattttaatcctgg

SEQ ID NO: 46258 - DNA, 75 bp, Artificial Sequence
  Synthetic
tagcgtgaaggatatgataaaaaatataattgttgtatccatccccattccaatcacattatatgattctgtaaa

SEQ ID NO: 46259 - DNA, 75 bp, Artificial Sequence
  Synthetic
attgttagctatatcatatctatgttccacacacaattctttctcatgttcgttaaggtcgccctgaacaaaata

SEQ ID NO: 46260 - DNA, 75 bp, Artificial Sequence
  Synthetic
tatctataatcatctgtgggaaatggaaggtatttccatttatctactgttcctaatatcatatgtggtggtgta

SEQ ID NO: 46261 - DNA, 75 bp, Artificial Sequence
  Synthetic
atatagatagattttaacgacatgacatcactattataacgatacgcattgtgtaaaacatttatatatttttct

SEQ ID NO: 46262 - DNA, 75 bp, Artificial Sequence
  Synthetic
tttagagagtatctccctattacctcattatatgataatgtgtaaatagatacttcttaataatgtatagatgct

SEQ ID NO: 46263 - DNA, 75 bp, Artificial Sequence
  Synthetic
ataattgttgtatccatccccattccaatcacattatatgattctgtaaaaaaaattatactgtaacacaatgaa

SEQ ID NO: 46264 - DNA, 75 bp, Artificial Sequence
  Synthetic
tttataaaaaaatcattcatgggtctgtgtttggacgcttttcatagactgtagtgagtggtcaatatcacatcc

SEQ ID NO: 46265 - DNA, 75 bp, Artificial Sequence
  Synthetic
ctgtgtttggacgcttttcatagactgtagtgagtggtcaatatcacatcctatgtaatcaatagcagggttagt

SEQ ID NO: 46266 - DNA, 75 bp, Artificial Sequence
  Synthetic
tataagtcagtaggtatattatatttagcaacaatatgatgaataatgcatggagtgtcgtctactctaattaat

SEQ ID NO: 46267 - DNA, 75 bp, Artificial Sequence
  Synthetic
agatgcgatactcctttatatgagccagaatcttcgtacctcaaactcgatatattcaaacaagttaatgagata

SEQ ID NO: 46268 - DNA, 75 bp, Artificial Sequence
  Synthetic
tgcatccgtagttatccccgttatatagttgtagatttctcaacgctatatccccattaataatgatgtcgaatt

SEQ ID NO: 46269 - DNA, 75 bp, Artificial Sequence
  Synthetic
ataaaatgataaatgctctaatgatgttcgtacccatcttgatgcggtttaataaatgtttcgatttcaatttat

SEQ ID NO: 46270 - DNA, 75 bp, Artificial Sequence
  Synthetic
gttcgtacccatcttgatgcggtttaataaatgtttcgatttcaatttattgtaaaaaaagaatcggttttatac

SEQ ID NO: 46271 - DNA, 75 bp, Artificial Sequence
  Synthetic
atggaataagccaaccatcttagtataacacacatgtcttaaagtttattaattaattacatgttgttttatata

SEQ ID NO: 46272 - DNA, 75 bp, Artificial Sequence
  Synthetic
taacacacatgtcttaaagtttattaattaattacatgttgttttatatatcgctacgaatttaaacagagaaat

SEQ ID NO: 46273 - DNA, 75 bp, Artificial Sequence
  Synthetic
aaaggaagaagtggaagaagaagtagttgtagaggaatatcatcaaacaactgaagaaaattctccacctccgtc

SEQ ID NO: 46274 - DNA, 75 bp, Artificial Sequence
  Synthetic
ttttttttactttattgccatctagtgattctatatacaagtttgttatttctggattaatattatctatattgg

SEQ ID NO: 46275 - DNA, 75 bp, Artificial Sequence
  Synthetic
atcgcgtgtctatatcttctttttatatccaatgtatttatatctgatttttcttcatttatcatatataatggt

SEQ ID NO: 46276 - DNA, 75 bp, Artificial Sequence
  Synthetic
tattatatgattatagtttctatttttataggaacgcgtacgagaaaatcaaatgtctaatttctaacggtagta

SEQ ID NO: 46277 - DNA, 75 bp, Artificial Sequence
  Synthetic
ttcttcatttatcatatataatggtccaaattctatacgtgtctcttcatccagatcattaaggttcttataatc

SEQ ID NO: 46278 - DNA, 75 bp, Artificial Sequence
  Synthetic
aatacatgaagaggagtaccgtaaaagatacgcgcgaatcccttaaagtctccacaataataagttttgagacaa

SEQ ID NO: 46279 - DNA, 75 bp, Artificial Sequence
  Synthetic
aagatcatcaagataagctaattcactaaacacatttttggattcggtattgttactcgcagaatagagttcgtt

SEQ ID NO: 46280 - DNA, 75 bp, Artificial Sequence
  Synthetic
aaataaatattcttcataaccggtaagaatagtgaaaagactaaatcttcacattgtaactatgtcagtagtgtt

SEQ ID NO: 46281 - DNA, 75 bp, Artificial Sequence
  Synthetic
tcctttaattccacaatacgcatgtagaatgtgataattatttccagaaggttcgattgcttgcagcatattcct

SEQ ID NO: 46282 - DNA, 75 bp, Artificial Sequence
  Synthetic
ctctattttggtggaggattatatgatataattcgtggataatcattcttaagacacatttcttcattcgtaaat

SEQ ID NO: 46283 - DNA, 75 bp, Artificial Sequence
  Synthetic
atatccgttagcgaggaaatcttttacaatgttcatatctaaatcattttttctgatttcgtcagaatatcccaa

SEQ ID NO: 46284 - DNA, 75 bp, Artificial Sequence
  Synthetic
cggtgtacgtggacggtgctgttcctgttcttgttgtggtctccgactttcgtgtttgcgtttagatccctccat

SEQ ID NO: 46285 - DNA, 75 bp, Artificial Sequence
  Synthetic
acatgcatgtgccattataacacaaataccaatacatgtagacccatatgttgttgttatattaatatctgcgcc

SEQ ID NO: 46286 - DNA, 75 bp, Artificial Sequence
  Synthetic
ttttattaattaaacgtataaaaacgttccgtatctgtatttaagagccagatttcgcctaatagaacaaatagc

SEQ ID NO: 46287 - DNA, 75 bp, Artificial Sequence
  Synthetic
gttccgtatctgtatttaagagccagatttcgcctaatagaacaaatagctacagtaaaaataactagaataatc

SEQ ID NO: 46288 - DNA, 75 bp, Artificial Sequence
  Synthetic
ccaattttagaaattggtctgtgttacatatctcttctatattattgttgatgtattgtcgtagaaaactattac

SEQ ID NO: 46289 - DNA, 75 bp, Artificial Sequence
  Synthetic
aataggtggaacgtatattttatttaaggacttaacaattgtctgtaaaccacaatttgcttccgcggatcctgt

SEQ ID NO: 46290 - DNA, 75 bp, Artificial Sequence
  Synthetic
cgtatgtcataaattctttaattatatgacatgttgtattatttagttcatccttgttcatcgttaggaatctat

SEQ ID NO: 46291 - DNA, 75 bp, Artificial Sequence
  Synthetic
taccattatctatatccggtactataccattatctatatccggtactataccattatctataccatcatctatac

SEQ ID NO: 46292 - DNA, 75 bp, Artificial Sequence
  Synthetic
tacccaataatcaaatgtacccttttatctgagtatcttaggatatgtgtcattaataatacatgctaaacgccc

SEQ ID NO: 46293 - DNA, 75 bp, Artificial Sequence
  Synthetic
tattcctatttcctcagcgatagctcttctatccttttccggaagcaatgaaatcacttcaataaatgattcaac

SEQ ID NO: 46294 - DNA, 75 bp, Artificial Sequence
  Synthetic
tcgatgtgtctgtttacacaatcaatgatattaggatccatgctactaccgggtaaaaatgtagcatcatatacc

SEQ ID NO: 46295 - DNA, 75 bp, Artificial Sequence
  Synthetic
cattggtaaatccttgcagacgataggcggacgctgtacacgctaacgatagtatcaataacgcaatcatgattt

SEQ ID NO: 46296 - DNA, 75 bp, Artificial Sequence
  Synthetic
catgagtgtgaaactaagtcgagaattactcatgcatttgttagttattcggagcgcgcaatttttaaactgtcc

SEQ ID NO: 46297 - DNA, 75 bp, Artificial Sequence
  Synthetic
ttctaaaatataaaacgtatcatgctcagataatagtttatcaactatataattatctattttgtaatttttctt

SEQ ID NO: 46298 - DNA, 75 bp, Artificial Sequence
  Synthetic
tataacctctcctatatgaatagcacaagtgacattagtagggatagaatgttgagctaatttttgtaaataact

SEQ ID NO: 46299 - DNA, 75 bp, Artificial Sequence
  Synthetic
caagtgacattagtagggatagaatgttgagctaatttttgtaaataactatctataaaaagattatacaaagtt

SEQ ID NO: 46300 - DNA, 75 bp, Artificial Sequence
  Synthetic
gaacattcaccgatatccaatttttgtatatctataatgttattaacctccgcatacgcattacagttcttttct

SEQ ID NO: 46301 - DNA, 75 bp, Artificial Sequence
  Synthetic
taataaatttttccaagaaactaattgggtgaagaatggaaacctttaatctatatttatcacagtctgttttgg

SEQ ID NO: 46302 - DNA, 75 bp, Artificial Sequence
  Synthetic
tatatttaattaagtctagttttatacagcgagttctcggtgaattgaaatacgtatatagaatatccatatctc

SEQ ID NO: 46303 - DNA, 75 bp, Artificial Sequence
  Synthetic
ttttagaaatacttagtttccacgtagtcaatgaaacatttgagctcatcgtacagaacgttctcgtacaggacg

SEQ ID NO: 46304 - DNA, 75 bp, Artificial Sequence
  Synthetic
aaaaaatgtttaacgaacataatctgctttttaatcaagtcatgattgttgtaatgatctagatttatatctgta

SEQ ID NO: 46305 - DNA, 75 bp, Artificial Sequence
  Synthetic
atttctggatatgtttttaataaagtatgaacaaagaaatggaaatcgtaataccagttatgttcaactttgaaa

SEQ ID NO: 46306 - DNA, 75 bp, Artificial Sequence
  Synthetic
atttttacaatattcagacgatgctgtccaatttgtggtagtatcgtctgaaaagtaatgacatatgttgtttat

SEQ ID NO: 46307 - DNA, 75 bp, Artificial Sequence
  Synthetic
aaatatatgatccatgcatagatcggcaaagctattgtagatgtgatttttcctaaatctaatataaaactcgtt

SEQ ID NO: 46308 - DNA, 75 bp, Artificial Sequence
  Synthetic
gtcgtttaatgcagatttaatacgttcattaaacacaaactttttatcctttagatgaattattattggttcatt

SEQ ID NO: 46309 - DNA, 75 bp, Artificial Sequence
  Synthetic
cattgggatttgatgtcgtcgcgtatttctctacaatattaataccatgtttgatgctatttatttctagacctt

SEQ ID NO: 46310 - DNA, 75 bp, Artificial Sequence
  Synthetic
aaaaagataaactttatgtattgtaccaaagatttaaatcctaatttgatagctaactctgtatctactttatct

SEQ ID NO: 46311 - DNA, 75 bp, Artificial Sequence
  Synthetic
caatcacatataattcgtcacctaatacagctaaagagtgatgatatctatatttaggtagtttctatatataat

SEQ ID NO: 46312 - DNA, 75 bp, Artificial Sequence
  Synthetic
acagccaacaaatataaaatgataaatgctctaatgatgttcgtacccatcttgatgcggcttaataaatgtttc

SEQ ID NO: 46313 - DNA, 75 bp, Artificial Sequence
  Synthetic
gtagttagttctcttttcatgttcgaaaaagtgaaacatgcggttaaaatagtttataacattaatattactgtt

SEQ ID NO: 46314 - DNA, 75 bp, Artificial Sequence
  Synthetic
ttttaaaacagatcaaggtataaaaattagaagtgttagattatattaattatactataaaaattagaagtgtta

SEQ ID NO: 46315 - DNA, 75 bp, Artificial Sequence
  Synthetic
ttctatatttttatatccattaatacaatatatacctccgttatatgcgataattgcactagtatctgtatatga

SEQ ID NO: 46316 - DNA, 75 bp, Artificial Sequence
  Synthetic
accatgatcgtgggtgatgttatcgcatatttttgtttctatcatttcagttatgtatggatttgacacgagtag

SEQ ID NO: 46317 - DNA, 75 bp, Artificial Sequence
  Synthetic
agtaatttcacgaatttgatactgtcctttctctcgttaaacgcctttagaaaaactttagaagaatatctcaat

SEQ ID NO: 46318 - DNA, 75 bp, Artificial Sequence
  Synthetic
cctttctctcgttaaacgcctttagaaaaactttagaagaatatctcaatgagagttcctggccatccatagttt

SEQ ID NO: 46319 - DNA, 75 bp, Artificial Sequence
  Synthetic
tcgatcagatcaatgtctagatctatagaatcaaaacacgataggtcagaagataatgaatatctgtacgcttct

SEQ ID NO: 46320 - DNA, 75 bp, Artificial Sequence
  Synthetic
aatgttaatttatagtttaatcccatggcccacgcacacacgattaattttttttcgtctccctttagattgttg

SEQ ID NO: 46321 - DNA, 75 bp, Artificial Sequence
  Synthetic
cagcatcatatccaagttaagcgactatcatctaaaaagtatgttgtatggaaagaaccattacaaatattatcc

SEQ ID NO: 46322 - DNA, 75 bp, Artificial Sequence
  Synthetic
tatcatctaaaaagtatgttgtatggaaagaaccattacaaatattatccatgatagaaagaaaaatatttaaaa

SEQ ID NO: 46323 - DNA, 75 bp, Artificial Sequence
  Synthetic
aattaataatatctctaatagatctgattagtagatacatggctatcgcaaaacaacatatacacatttaataaa

SEQ ID NO: 46324 - DNA, 75 bp, Artificial Sequence
  Synthetic
attgctttcctttatcattaataatttctagaatatcatctctatcataaaagatacaaatattaactgtttgat

SEQ ID NO: 46325 - DNA, 75 bp, Artificial Sequence
  Synthetic
atcaatggtacaaattttatcctcactttgtgtatcatattcgtctctgctataaaattgtatattcagattatc

SEQ ID NO: 46326 - DNA, 75 bp, Artificial Sequence
  Synthetic
tttactacatagttatctatcttaaagactataccatatcctcctgtagatatgtgataaaaatcgtcgtttata

SEQ ID NO: 46327 - DNA, 75 bp, Artificial Sequence
  Synthetic
ccgccgtagtttccatgggactatataattttgtggcctcgaatacaaattttactacatagttatctatcttaa

SEQ ID NO: 46328 - DNA, 75 bp, Artificial Sequence
  Synthetic
gtgcgatgtatatacgctaactgtatcaataaacggagaacaccatttagtcataacggtaatccaaaatttttt

SEQ ID NO: 46329 - DNA, 75 bp, Artificial Sequence
  Synthetic
tatgataacaaagttttgtattatccggagtggtacaacattggtcggttggttttattttctttattgtggtat

SEQ ID NO: 46330 - DNA, 75 bp, Artificial Sequence
  Synthetic
ggaaaaatgatgaattaatgtaatcattctcttctatctttagtagtgtttccctattaaaattcttaaaataat

SEQ ID NO: 46331 - DNA, 75 bp, Artificial Sequence
  Synthetic
tccctattaaaattcttaaaataatttaacaatctaactgacggagcccaattttggtgtaaatctaattgtgac

SEQ ID NO: 46332 - DNA, 75 bp, Artificial Sequence
  Synthetic
atttccgaagacggaaataagacatagacacgcaataaatctaattgcggtcatggtctcaaataaaaatacgaa

SEQ ID NO: 46333 - DNA, 75 bp, Artificial Sequence
  Synthetic
tctatgtggagacatccattgatattcaggggatgaatcattggcaacacccatttattgtacaaaaagccccaa

SEQ ID NO: 46334 - DNA, 75 bp, Artificial Sequence
  Synthetic
tagtatactgaattattttatatagatctaacttaacatcattttcatctgggataccacaatttaaaataaact

SEQ ID NO: 46335 - DNA, 75 bp, Artificial Sequence
  Synthetic
aatttactctctataacaaatatcataacttacttcttttatgtcaagaaagcactggtttagttcatctataaa

SEQ ID NO: 46336 - DNA, 75 bp, Artificial Sequence
  Synthetic
gaaactttgtatatgtatccagaacaattttatcttagtcactcttcatctgtaagtcgagcattgataaatgag

SEQ ID NO: 46337 - DNA, 75 bp, Artificial Sequence
  Synthetic
tcaggggatgaatcattggcaacacccatttattgtacaaaaagccccaatttacaaacgaaagtccaggtttga

SEQ ID NO: 46338 - DNA, 75 bp, Artificial Sequence
  Synthetic
tattagtgagagagcatgaagaagatttagtatttagcagtgcggatatgatccaagagggtgagatagtcgttc

SEQ ID NO: 46339 - DNA, 75 bp, Artificial Sequence
  Synthetic
ttttaatttctttggtaatgaaattattcactatatcagtatcttctttatctaccagagattttactaacttga

SEQ ID NO: 46340 - DNA, 75 bp, Artificial Sequence
  Synthetic
gatatacagcgttacattattattatttgtgcctcgcacacgtttataaaccaggtgaatgtagaaaactaatcc

SEQ ID NO: 46341 - DNA, 75 bp, Artificial Sequence
  Synthetic
aataaattaatatctctgtttttttgttatacagatgtatcacagcctcatatattacgtaatagaacgtgtcat

SEQ ID NO: 46342 - DNA, 75 bp, Artificial Sequence
  Synthetic
gttatacagatgtatcacagcctcatatattacgtaatagaacgtgtcatctaccttattaactttcacggcgta

SEQ ID NO: 46343 - DNA, 75 bp, Artificial Sequence
  Synthetic
ttgatatctttttgaattgtttcttttagaagtgattctttgatggtgtcagcatacgaattacaataatgcaga

SEQ ID NO: 46344 - DNA, 75 bp, Artificial Sequence
  Synthetic
agcatacgaattacaataatgcagaaactcagttaacatacaggaattatagtaagccaattccaattgttgtct

SEQ ID NO: 46345 - DNA, 75 bp, Artificial Sequence
  Synthetic
atttttagtctgcatccgtagttatcccctttatgcaactgtaaatttctcaacgctatatctccattaatgatg

SEQ ID NO: 46346 - DNA, 75 bp, Artificial Sequence
  Synthetic
attcacggtgggtcaagactacctcaaactggtagagagtgagatagaaaagcgtatcagacgacttcatgttgt

SEQ ID NO: 46347 - DNA, 75 bp, Artificial Sequence
  Synthetic
gcaatggtgtccttgcgtttctctgatagaatgcgagcagcgattttggcgttatcatttgatgatatgtctgga

SEQ ID NO: 46348 - DNA, 75 bp, Artificial Sequence
  Synthetic
gaattaatgtgtaactttgtcaacttatcgatgttatctctaatgctaactaacttatcaaatgccaaaaacatt

SEQ ID NO: 46349 - DNA, 75 bp, Artificial Sequence
  Synthetic
ttttggtaggacaaagtgaaacaatcaagaagatagcttctcctcctatttgtggaagaaattgaactcctctag

SEQ ID NO: 46350 - DNA, 75 bp, Artificial Sequence
  Synthetic
catgaaatctgccgactccatggtgcgaatcgcactgtcttattcgccattgattttcattttttataattatgt

SEQ ID NO: 46351 - DNA, 75 bp, Artificial Sequence
  Synthetic
atgatctactgacgatagtatctccttgacagatattggaccgaattacagaagtacctggaatgtaaagccctg

SEQ ID NO: 46352 - DNA, 75 bp, Artificial Sequence
  Synthetic
ttttatatatcgctacgaatttaaacagagaaatcagtttaggaagaaaaaaattatctatctacatcatcgtct

SEQ ID NO: 46353 - DNA, 75 bp, Artificial Sequence
  Synthetic
ccaagatagagagctcctttggtgaatccatctctatgtttcagtttaaccaagaaacagtcagctggtttaaaa

SEQ ID NO: 46354 - DNA, 75 bp, Artificial Sequence
  Synthetic
atccatctctatgtttcagtttaaccaagaaacagtcagctggtttaaaatttccatctctatctaatacagcat

SEQ ID NO: 46355 - DNA, 75 bp, Artificial Sequence
  Synthetic
gataacaaagttttgtattatccggagtggtacagcattgttctttttgtactttttttgtagtggtatcaggag

SEQ ID NO: 46356 - DNA, 75 bp, Artificial Sequence
  Synthetic
agtaaatccttaagttcataatcatcactgtcatcagttatgtacgatccaaacaatgtttctaccggcatagtg

SEQ ID NO: 46357 - DNA, 75 bp, Artificial Sequence
  Synthetic
ttttaggagtaggacgcctagtcagtatggaagaggattttctagatcctctcttcaacatctttgatctcaatg

SEQ ID NO: 46358 - DNA, 75 bp, Artificial Sequence
  Synthetic
cgactatcctcgtcctcatcatcactatcatcactatcatcactatcactatcactatcactatcactatcatca

SEQ ID NO: 46359 - DNA, 75 bp, Artificial Sequence
  Synthetic
caatttgaggtacctatatacgccgttttatcggttaccatatatttggcatggtttactctagaatacggaatg

SEQ ID NO: 46360 - DNA, 75 bp, Artificial Sequence
  Synthetic
aatattaataagaacgggtcatttatacacaatctcgggttatcatcatccattaatataaaagaatatgtatat

SEQ ID NO: 46361 - DNA, 75 bp, Artificial Sequence
  Synthetic
aatatctttaataatttggctatacatctgttcaatactatctattgatgatttctttttacgacttgaactaat

SEQ ID NO: 46362 - DNA, 75 bp, Artificial Sequence
  Synthetic
ggtagttcgtaaattttaatgtataacagagccatctgtaaaaagataaactttatgtattgtaccaaagattta

SEQ ID NO: 46363 - DNA, 75 bp, Artificial Sequence
  Synthetic
aatgatgcctctgcctttttatacatattccagatgtcatgatattggattgggaaaataacaaatctatttgga

SEQ ID NO: 46364 - DNA, 75 bp, Artificial Sequence
  Synthetic
tggctgcgttcaagtcataaatcatcttgatactatccagtaaacagtctttaagttctggaatattatcatccc

SEQ ID NO: 46365 - DNA, 75 bp, Artificial Sequence
  Synthetic
tcaatatcgacggacgtcaatactgtaataaaggtggtagtattgtcatcatcgtgataaactacgggaatatgg

SEQ ID NO: 46366 - DNA, 75 bp, Artificial Sequence
  Synthetic
taataaaggtggtagtattgtcatcatcgtgataaactacgggaatatggtcgttagtaggtacggtgactttac

SEQ ID NO: 46367 - DNA, 75 bp, Artificial Sequence
  Synthetic
atcgtgataaactacgggaatatggtcgttagtaggtacggtgactttacacaacgcgatatataactttccttt

SEQ ID NO: 46368 - DNA, 75 bp, Artificial Sequence
  Synthetic
tattatcatcattttgtaattgtgacatcatactagataaatcatttgcgagattgttgttggagacggacatgg

SEQ ID NO: 46369 - DNA, 75 bp, Artificial Sequence
  Synthetic
tacagatctgatgaccgacgataatataaacatcttgatactttttctagaaaaaaaattgaattgatgatatag

SEQ ID NO: 46370 - DNA, 75 bp, Artificial Sequence
  Synthetic
aaatgatatcgagaacagatttgatacgatatttgttggattcctgattatttactataatataatctagacaga

SEQ ID NO: 46371 - DNA, 75 bp, Artificial Sequence
  Synthetic
cataatccattctctcaatcactacatctttaagatttttgttgttaagatatttggctaaactatataattcta

SEQ ID NO: 46372 - DNA, 75 bp, Artificial Sequence
  Synthetic
tatatcgttggtaggataatacatccccattccagtattctcggatactctattgatgacactagttaagaacat

SEQ ID NO: 46373 - DNA, 75 bp, Artificial Sequence
  Synthetic
cacccataatattaataattattccttccaccgtacccgtaaacaatattaaggagattccaccttacccataaa

SEQ ID NO: 46374 - DNA, 75 bp, Artificial Sequence
  Synthetic
gccatagattctttgaccaacgatttaatattgcgtttagcatctgatttttttattaagtcgaatggccggctc

SEQ ID NO: 46375 - DNA, 75 bp, Artificial Sequence
  Synthetic
tctttagtagtgtttccctattaaaattcttaaaataatttaacaatctaactgacggagcccaattttggtgta

SEQ ID NO: 46376 - DNA, 75 bp, Artificial Sequence
  Synthetic
ccatattcgactcccttgtgtaacgttagacattctaaatctatagtattatctattacagcataaaacacatgc

SEQ ID NO: 46377 - DNA, 75 bp, Artificial Sequence
  Synthetic
acacaattaacaatgtattattagtttatattactgaattaataatataaaattcccaatcttgtcataaacaca

SEQ ID NO: 46378 - DNA, 75 bp, Artificial Sequence
  Synthetic
tccacagttattgggccagtatactgttagcaacggtatatcgaatagattactcatgtaacctactagaatgat

SEQ ID NO: 46379 - DNA, 75 bp, Artificial Sequence
  Synthetic
gttagcaacggtatatcgaatagattactcatgtaacctactagaatgatagttcgtgtactagtcataatatct

SEQ ID NO: 46380 - DNA, 75 bp, Artificial Sequence
  Synthetic
tcaaacggatattgccacgtacctttaaaatatatagtattaatgattgcccatagagtattatcgtcgagcata

SEQ ID NO: 46381 - DNA, 75 bp, Artificial Sequence
  Synthetic
aacaaaggtattacccgggtacgtggatatcatatatggtattggtccattatcagtaatagctccataaactga

SEQ ID NO: 46382 - DNA, 75 bp, Artificial Sequence
  Synthetic
gatatcatatatggtattggtccattatcagtaatagctccataaactgatacggcgatggtttttatatgtgtt

SEQ ID NO: 46383 - DNA, 75 bp, Artificial Sequence
  Synthetic
tttaatatcgaacggtaacacatcaatttcgggacgcgtatatgtttctaaattcttaatccaaatataatgatg

SEQ ID NO: 46384 - DNA, 75 bp, Artificial Sequence
  Synthetic
atttcgggacgcgtatatgtttctaaattcttaatccaaatataatgatgacctatatgccctattatcatactg

SEQ ID NO: 46385 - DNA, 75 bp, Artificial Sequence
  Synthetic
gatatatcgatattccgagctagtgttatatacgagtggagcatcataggtatattttttactttatcaccatct

SEQ ID NO: 46386 - DNA, 75 bp, Artificial Sequence
  Synthetic
ctttctctcttcaatggtctcacaaaaatattaaacctctttctgatggagtcactaaaatatttttattctctt

SEQ ID NO: 46387 - DNA, 75 bp, Artificial Sequence
  Synthetic
tatcttataactattatcttataactattatcttatgactattatcttataactattaactaacttataaaacta

SEQ ID NO: 46388 - DNA, 75 bp, Artificial Sequence
  Synthetic
gttaaattttacaaatctataacatgctaaaccttttgacgacagccattcattaatttctgatatggaatctgt

SEQ ID NO: 46389 - DNA, 75 bp, Artificial Sequence
  Synthetic
gctaaaccttttgacgacagccattcattaatttctgatatggaatctgtattctcgataccgtatcgttctaaa

SEQ ID NO: 46390 - DNA, 75 bp, Artificial Sequence
  Synthetic
tatgaaagatatatcactgctcacctctatatttcgtacatttttaaactgtttgtataatatctctctgataca

SEQ ID NO: 46391 - DNA, 75 bp, Artificial Sequence
  Synthetic
attccattaacgcatttcatatccatgtctccaccgagttcgataatctttttaattacgtgtacacaaacattt

SEQ ID NO: 46392 - DNA, 75 bp, Artificial Sequence
  Synthetic
tgtctccaccgagttcgataatctttttaattacgtgtacacaaacatttcctgttatcatgtatgtgtgcaacg

SEQ ID NO: 46393 - DNA, 75 bp, Artificial Sequence
  Synthetic
tctatatttcgtacatttttaaactgtttgtataatatctctctgatacaatcagatatatctattgtgtcggta

SEQ ID NO: 46394 - DNA, 75 bp, Artificial Sequence
  Synthetic
caagttgaccaattcatttctaatagtatcaaactctccatgattaaatattttaatagtatccatttttatatc

SEQ ID NO: 46395 - DNA, 75 bp, Artificial Sequence
  Synthetic
gtatccgattgagattttgcatacaatactagtctagaaagaaatttgtaatcatcttctgtgacgggagtccat

SEQ ID NO: 46396 - DNA, 75 bp, Artificial Sequence
  Synthetic
cataacactatctatgttatcatcgtatattagtataccacgaccttcttcatttcgtgccaaaatgatatacag

SEQ ID NO: 46397 - DNA, 75 bp, Artificial Sequence
  Synthetic
cacaaaaatattaaacctctttctgatggagtcgtaaaatatttttattctctttctctttctctcttcaatggt

SEQ ID NO: 46398 - DNA, 75 bp, Artificial Sequence
  Synthetic
gtctaccaattcatccaacaacataagctttttaaaatcatcattataataggtttgatcgttgtcatttctcca

SEQ ID NO: 46399 - DNA, 75 bp, Artificial Sequence
  Synthetic
acattgtcgttgtatgagtatgatcttttaaacccgctagacaagtatccgtttgttattgaaggatgtgggcat

SEQ ID NO: 46400 - DNA, 75 bp, Artificial Sequence
  Synthetic
aaatttttaacgatttactgtggctagatacccaatctctctcaaatatttttttagcctcgcttacaagctgtt

SEQ ID NO: 46401 - DNA, 75 bp, Artificial Sequence
  Synthetic
agatacccaatctctctcaaatatttttttagcctcgcttacaagctgtttatctatactattaaaactgacgaa

SEQ ID NO: 46402 - DNA, 75 bp, Artificial Sequence
  Synthetic
ctctattttctatttttaattttttaaatttttaacgatttactgtggctagatacccaatctctctcaaatatt

SEQ ID NO: 46403 - DNA, 75 bp, Artificial Sequence
  Synthetic
catattcgtcgtcgactatcaacaattttgtattattctgaatagtgaaaaccttcacagatagatcattttgaa

SEQ ID NO: 46404 - DNA, 75 bp, Artificial Sequence
  Synthetic
gggattccacaccatagatccagtatatcctagttcacaatacgatttagattctccgatcaactgatatccgct

SEQ ID NO: 46405 - DNA, 75 bp, Artificial Sequence
  Synthetic
aatttattgttagcaggtaccccgctagcatacagtctgggactattcatcggaggaattggaatccaattgttt

SEQ ID NO: 46406 - DNA, 75 bp, Artificial Sequence
  Synthetic
atatcccaataggtgttctggagaatcagtaaagaacactccacctataggatttttaatatgatacgcagtgct

SEQ ID NO: 46407 - DNA, 75 bp, Artificial Sequence
  Synthetic
tattggcgtctaataaaaaattaataacacctaattatatgaagttattagtgtataacggaaatgatataaacg

SEQ ID NO: 46408 - DNA, 75 bp, Artificial Sequence
  Synthetic
atattaatgggacgtgacggaatagtacagcatgatagcacgcatcctattcccaacaatgtcaggaacgtcacg

SEQ ID NO: 46409 - DNA, 75 bp, Artificial Sequence
  Synthetic
acgaatttactagcatttctgatacatgacaataaagcggttaaatcattagttctttccatagtacatagttgt

SEQ ID NO: 46410 - DNA, 75 bp, Artificial Sequence
  Synthetic
ggaaatgtccgttatataatctacaaaataatcatcgcatatagtatgcgatagtagagtaaacatttttatagt

SEQ ID NO: 46411 - DNA, 75 bp, Artificial Sequence
  Synthetic
gatccatgctactaccttcgggtaaaattggagaatcgtataccatttctagtactttaggttcattgttatcca

SEQ ID NO: 46412 - DNA, 75 bp, Artificial Sequence
  Synthetic
ctaacgttttaatcgtatgtatagatcctccagtaaatgacgcgtttcctacataacatctttcatcatctgaca

SEQ ID NO: 46413 - DNA, 75 bp, Artificial Sequence
  Synthetic
ataaaaaaatatattatttttatgttattttgttaaaaataatcatcgaatacttcgtaagatactccttcatga

SEQ ID NO: 46414 - DNA, 75 bp, Artificial Sequence
  Synthetic
cttcacggagatataggtgtagttttgcagtggccgtcctggataatattatctatatgatgggtggatatgatc

SEQ ID NO: 46415 - DNA, 75 bp, Artificial Sequence
  Synthetic
cccaaaaacaaccgagtagtagccccacattattttttttatctatgttaacagttataaaatttatatccgggc

SEQ ID NO: 46416 - DNA, 75 bp, Artificial Sequence
  Synthetic
tcttttccctcgttcatctagcaaaactattattttaacccctttttcagatgcctcttttagtttatcaaaaat

SEQ ID NO: 46417 - DNA, 75 bp, Artificial Sequence
  Synthetic
cgatgatatagtacgtactatgccaaatgaatcacgtgttaaacaatgggtgatagatacacttaatgatataat

SEQ ID NO: 46418 - DNA, 75 bp, Artificial Sequence
  Synthetic
atttagtcttacacattcgctcatacatgtatgaccgttaactacagagtctacactaaaatgattgaacaatag

SEQ ID NO: 46419 - DNA, 75 bp, Artificial Sequence
  Synthetic
cggccgagtatgcataataatatgtgggtagtatcatccacatatttataatttaggactttgtattcagtattt

SEQ ID NO: 46420 - DNA, 75 bp, Artificial Sequence
  Synthetic
atctatataccatattttctggaagcggatatacatagtcgtgatcatcattatcactagcctcatcctctatat

SEQ ID NO: 46421 - DNA, 75 bp, Artificial Sequence
  Synthetic
tggagattcatgagacttcttgctagcaatataaaagtatttgtgtaatgaatatctttccatctccaaattata

SEQ ID NO: 46422 - DNA, 75 bp, Artificial Sequence
  Synthetic
tgggagacttttttatccaacgatttttagtgaaacattccacatcgtttaatactacatatttctcatacgtgg

SEQ ID NO: 46423 - DNA, 75 bp, Artificial Sequence
  Synthetic
tataaactccacccattacatatatatcatcgtttacgaataccgatgcgcctgaatatctaggagtaattaagt

SEQ ID NO: 46424 - DNA, 75 bp, Artificial Sequence
  Synthetic
taattaattatatggtttattatcacaattcaaccatggtgattgtgaattagtactacccaataatcaaatgtg

SEQ ID NO: 46425 - DNA, 75 bp, Artificial Sequence
  Synthetic
gccgacgatggcggctgccacagatacgaatatgactaaaccgatgaccatttaaaaaccactctctagctttca

SEQ ID NO: 46426 - DNA, 75 bp, Artificial Sequence
  Synthetic
tatcataatcttatcgaaaaagttattaaaaatacattagagaaatatactttaactaatatagtcctcgagtat

SEQ ID NO: 46427 - DNA, 75 bp, Artificial Sequence
  Synthetic
ttctatttcgaatttaggcttccaaaaatttttcatccgtaaaccgataataatatatatagacttgttaatggt

SEQ ID NO: 46428 - DNA, 75 bp, Artificial Sequence
  Synthetic
ctctagatactgattctggacatagctttccgactggtgcatttggtgtgaaggttcccataagtttggcagcta

SEQ ID NO: 46429 - DNA, 75 bp, Artificial Sequence
  Synthetic
ggagttctgattgggaaaggcgcatagctaaagatttgtcacaatatgaatacactacagttcttctcgaacgac

SEQ ID NO: 46430 - DNA, 75 bp, Artificial Sequence
  Synthetic
tgcaatacttacattctttttgctgtttcgaaactttatcaatacacgttaatacaaacccaggaaggagatatt

SEQ ID NO: 46431 - DNA, 75 bp, Artificial Sequence
  Synthetic
tttcgaaactttatcaatacacgttaatacaaacccaggaaggagatattgaaactgaggctgttgaaaatgaaa

SEQ ID NO: 46432 - DNA, 75 bp, Artificial Sequence
  Synthetic
gcgtagcgaggacacaagtgaacctataattatcaaatttattagtatcagtcacatgaaggactttctgcagag

SEQ ID NO: 46433 - DNA, 75 bp, Artificial Sequence
  Synthetic
gtcagttcatcctttgataattttccaaattctggatcggatgtcactgcagtaatattgttgattatttctgac

SEQ ID NO: 46434 - DNA, 75 bp, Artificial Sequence
  Synthetic
gaaactgaggctgttgaaaatgaaacggcgaatacaatagttcggacaatgtaaaactatgattccgtattctga

SEQ ID NO: 46435 - DNA, 75 bp, Artificial Sequence
  Synthetic
ataattatcaaatttattagtatcagtcacatgaaggactttctgcagagtgacgattctaccatctatggtact

SEQ ID NO: 46436 - DNA, 75 bp, Artificial Sequence
  Synthetic
catcctcgtccgatctcatatcctttgccaaccaatacatgtagctaaaattaggcataaatttcacacatccag

SEQ ID NO: 46437 - DNA, 75 bp, Artificial Sequence
  Synthetic
attttaacaaagcatcgatttgctaatatacaattatccttttgattaattgttattttattcatattcttaaaa

SEQ ID NO: 46438 - DNA, 75 bp, Artificial Sequence
  Synthetic
ttccttattaaaattcttaaaataatttaacaatctaactgatggagcccaattttggtgtaaatctaattggga

SEQ ID NO: 46439 - DNA, 75 bp, Artificial Sequence
  Synthetic
tgttattttattcatattcttaaaaggtttcatatttatcaattcttctacattaaaaatttccatttttaattt

SEQ ID NO: 46440 - DNA, 75 bp, Artificial Sequence
  Synthetic
tgcaacgaaattctccagaagatgctacgatgtttaggttaggacatttgatttcgtcggcattaacatatgggt

SEQ ID NO: 46441 - DNA, 75 bp, Artificial Sequence
  Synthetic
tctatttctactataatttactctctataacaaatgtcataacttagttcttttatgtcaagaaggcactggttt

SEQ ID NO: 46442 - DNA, 75 bp, Artificial Sequence
  Synthetic
ccattttgttcatttcggtacatagattatccaattgagaagtgcatttagtagttttgtacattttaagtttat

SEQ ID NO: 46443 - DNA, 75 bp, Artificial Sequence
  Synthetic
ttattgttgctcgaatattttgaatttgatgtcatatggcagattagaaatgtaggtattatcatcaactgattc

SEQ ID NO: 46444 - DNA, 75 bp, Artificial Sequence
  Synthetic
tgacgaatcgtcgaaaattagttatagttaacattttattatttgataccctgatattaatacccctgccgttac

SEQ ID NO: 46445 - DNA, 75 bp, Artificial Sequence
  Synthetic
gccgtaataatttccttattcacttgtataatttccccattgatagaaaacgtcacgctttccattcttgaagta

SEQ ID NO: 46446 - DNA, 75 bp, Artificial Sequence
  Synthetic
tatttttattagtagcctcctgtgttttgacagtatattcttcgccattataaagacaaaaatgtttaaatgtag

SEQ ID NO: 46447 - DNA, 75 bp, Artificial Sequence
  Synthetic
cactatcatcactatcactatcactatcatcatcatcatcatcatcatcatcatcatcactatcactatcattat

SEQ ID NO: 46448 - DNA, 75 bp, Artificial Sequence
  Synthetic
ggtttcaaccgcgttaacatatgagtgaacacacccatacatgaaagcgatgagaaataggattctcatcttgcc

SEQ ID NO: 46449 - DNA, 75 bp, Artificial Sequence
  Synthetic
agtaatgcatcaacgcttccaaaattgtctattataaactcaccgataatttttttattgcatgttttcatattc

SEQ ID NO: 46450 - DNA, 75 bp, Artificial Sequence
  Synthetic
gtattttgtggttccacaattcatttccatacatgttattatcacactaatattatgatgaactttatccagccg

SEQ ID NO: 46451 - DNA, 75 bp, Artificial Sequence
  Synthetic
tgtctattataaactcaccgataatttttttattgcatgttttcatattcattaggattatcaaatctttaatct

SEQ ID NO: 46452 - DNA, 75 bp, Artificial Sequence
  Synthetic
atcatcatcatcatcatcatcatcatcatcatcactatcactatcattatcatcgtccttatcgtccttattatc

SEQ ID NO: 46453 - DNA, 75 bp, Artificial Sequence
  Synthetic
acttattgttgctcgaatattttgtatttgatggtatacggaagattagaaatgtaggtattatcatcaactgat

SEQ ID NO: 46454 - DNA, 75 bp, Artificial Sequence
  Synthetic
tcatcacctgtcatgaaaggaatagttggacggacatcttttccatcaaacgttataatttgataatcatcaaga

SEQ ID NO: 46455 - DNA, 75 bp, Artificial Sequence
  Synthetic
ggatctccatcaaacgccagacaatcacgtacaaagtacatggaaataggttttgttctattgcgcatcatagat

SEQ ID NO: 46456 - DNA, 75 bp, Artificial Sequence
  Synthetic
attatcattttgtaattgtgacatcatactagataaatcgtttgcgagattgttgtgggaagcgggcatggagga

SEQ ID NO: 46457 - DNA, 75 bp, Artificial Sequence
  Synthetic
aaaactgtacatggaggcactaatgcaaattacttttccggtaaaaagtctgatgagtatctgagcactacagtc

SEQ ID NO: 46458 - DNA, 75 bp, Artificial Sequence
  Synthetic
atatcgcataatattgtagatgcattgttgtatgatttatatatccaccaataaataaatacgtatactactgaa

SEQ ID NO: 46459 - DNA, 75 bp, Artificial Sequence
  Synthetic
tgataatatcaaatggcaaagatagaaacgtatcatctttaactacatgtgtaaaattagttgctgttgtattaa

SEQ ID NO: 46460 - DNA, 75 bp, Artificial Sequence
  Synthetic
acgctagtcacaatcaccactttcatatttagaatatatgtatgtaaaaatatagtagaatttcattttgttttt

SEQ ID NO: 46461 - DNA, 75 bp, Artificial Sequence
  Synthetic
tttgcatctgctcatactccgttttatatcaataccaaagaaggaagatatctggttctaaaagccgttaaagta

SEQ ID NO: 46462 - DNA, 75 bp, Artificial Sequence
  Synthetic
tctggttctaaaagccgttaaagtatgcgatgttagaactgtagaatgcgaaggaagtaaagcttcctgcgtact

SEQ ID NO: 46463 - DNA, 75 bp, Artificial Sequence
  Synthetic
tgcgatgttagaactgtagaatgcgaaggaagtaaagcttcctgcgtactcaaagtagataaaccctcatcaccc

SEQ ID NO: 46464 - DNA, 75 bp, Artificial Sequence
  Synthetic
cgtccagatgcgagagaatgaataaccctggaaaacaagtcccgtttatgagaacggacatgctacaaaatatgt

SEQ ID NO: 46465 - DNA, 75 bp, Artificial Sequence
  Synthetic
gtccggaatgaagagaagggaattattggtgtttgtcgacgtcatatagtcgagcaagagtatcatcatatccac

SEQ ID NO: 46466 - DNA, 75 bp, Artificial Sequence
  Synthetic
atccgtgtcgcccgggttttttatctctttcagtatgtgaatagataggtattttatctctattcatcatcgaat

SEQ ID NO: 46467 - DNA, 75 bp, Artificial Sequence
  Synthetic
tctttcagtatgtgaatagataggtattttatctctattcatcatcgaatttaagagatccgataaacattgttt

SEQ ID NO: 46468 - DNA, 75 bp, Artificial Sequence
  Synthetic
cgagcaagagtatcatcatatccacgtgtccattttttatagtggtgtgaatacaactaaggagaatagccagat

SEQ ID NO: 46469 - DNA, 75 bp, Artificial Sequence
  Synthetic
ctctggcacttatttcatgtaccttccccttatcactaaggagaatagtatttgagaaatatgtatacatgatat

SEQ ID NO: 46470 - DNA, 75 bp, Artificial Sequence
  Synthetic
agtggatatacatagttgtgatcatcattatcgctagcctcatcttctatatcctgcactataccattatctata

SEQ ID NO: 46471 - DNA, 75 bp, Artificial Sequence
  Synthetic
tttgagaaatatgtatacatgatattatcatgaattagatatacagaatttgtaacactctcgaaatcacacgat

SEQ ID NO: 46472 - DNA, 75 bp, Artificial Sequence
  Synthetic
gaatttcagttcattactcgttgagaatattgatgattttttttaagatgatatttactttttatatgcttgcat

SEQ ID NO: 46473 - DNA, 75 bp, Artificial Sequence
  Synthetic
tatcggaacaacgtcaacaacgagaaaaaagatttaatattacggtatcaaaaaatgctgaagcaataatggaat

SEQ ID NO: 46474 - DNA, 75 bp, Artificial Sequence
  Synthetic
atcatctacataatctactatattattatacataaacatcgacaacatactattgtccattatctaagtccagtt

SEQ ID NO: 46475 - DNA, 75 bp, Artificial Sequence
  Synthetic
atacactagacattttttaaagctaaaatagtctttagtagtaacagtaactatgcgattattttcatcgatgat

SEQ ID NO: 46476 - DNA, 75 bp, Artificial Sequence
  Synthetic
ctatatactggtttatatttgttcaagatagatacaaatccgataacttttttgacgaattctacgggatccact

SEQ ID NO: 46477 - DNA, 75 bp, Artificial Sequence
  Synthetic
acatttcatcggcatattattacgcgtaccatcaaagactataccatgtgtatatctaacgtattctagcatagt

SEQ ID NO: 46478 - DNA, 75 bp, Artificial Sequence
  Synthetic
gtatgtcttatgtatatttataaaaatgctaagtatgcgatgtatctatgttatttgtatttatctaaacaatac

SEQ ID NO: 46479 - DNA, 75 bp, Artificial Sequence
  Synthetic
ccagaaaatggtactatattcttgttatagtactttatcatttgacgatgatatgcatcattagtttcgtaatta

SEQ ID NO: 46480 - DNA, 75 bp, Artificial Sequence
  Synthetic
tatctatttgagaaaacatttttatcatgttcaatagttgaaacgtcggatccactatatagatattatctataa

SEQ ID NO: 46481 - DNA, 75 bp, Artificial Sequence
  Synthetic
catgttcaatagttgaaacgtcggatccactatatagatattatctataaagattttaggaactacgttcatggt

SEQ ID NO: 46482 - DNA, 75 bp, Artificial Sequence
  Synthetic
ttatcaccatatagtttctaagatatgggattttacttaatataatattatttcccgtaataaattttattagaa

SEQ ID NO: 46483 - DNA, 75 bp, Artificial Sequence
  Synthetic
tcgtcgatatagattttagacatttttagagagaactaacgcaatcagtaataaaactaatctattttatcattt

SEQ ID NO: 46484 - DNA, 75 bp, Artificial Sequence
  Synthetic
tgggattttacttaatataatattatttcccgtaataaattttattagaaatgccaaatctataagaaaagtcct

SEQ ID NO: 46485 - DNA, 75 bp, Artificial Sequence
  Synthetic
tcactatcactatcactatcactatcactatcactatcactatcatcgtccttattatcatccttatcatcctta

SEQ ID NO: 46486 - DNA, 75 bp, Artificial Sequence
  Synthetic
ttagatatagagaatatgatccgtaacatatacaacttttattatggcgtctaagatattcttccatcaacttat

SEQ ID NO: 46487 - DNA, 75 bp, Artificial Sequence
  Synthetic
ctaagatattcttccatcaacttattaacatttttgactagggaagatacattatgacgtcccattacttttgcc

SEQ ID NO: 46488 - DNA, 75 bp, Artificial Sequence
  Synthetic
atcatccttatcatcgtccttattatcatcatagtctattaaacacaaatcatctacgtctataacaacattctc

SEQ ID NO: 46489 - DNA, 75 bp, Artificial Sequence
  Synthetic
aatttagcatatctcttgccaattcttccattgatgttacattataagaaattttagatgaaattacatttggag

SEQ ID NO: 46490 - DNA, 75 bp, Artificial Sequence
  Synthetic
ttccattgatgttacattataagaaattttagatgaaattacatttggagctttaatagtaagaactcctaatat

SEQ ID NO: 46491 - DNA, 75 bp, Artificial Sequence
  Synthetic
atttagtgtttaaattttaccagttccagattttacacctccgttaacacctccattaaccccactttttacacc

SEQ ID NO: 46492 - DNA, 75 bp, Artificial Sequence
  Synthetic
atttacctatattatatgtttgagtctgtttagaaaagtagctaagtatacgatcttttatttctgatgcagatg

SEQ ID NO: 46493 - DNA, 75 bp, Artificial Sequence
  Synthetic
gtaaatggacgcatttatgttatcggtggtcgagatggatcaaattatctaaacactgtagaaagttggaaacct

SEQ ID NO: 46494 - DNA, 75 bp, Artificial Sequence
  Synthetic
tttgactgaatagaagtgaatgagccgctgtggtctctatacacccgcacaaacaatgccattaaatatcatttt

SEQ ID NO: 46495 - DNA, 75 bp, Artificial Sequence
  Synthetic
aatatgtctttgttaaaaacagttattttctgaatatttctagcttgtaattttaacatatgatattcgttcaca

SEQ ID NO: 46496 - DNA, 75 bp, Artificial Sequence
  Synthetic
ctataatctttaatgtaatattaggaagagtattctgatcaggattcctattcattttgaggatttaaaactctg

SEQ ID NO: 46497 - DNA, 75 bp, Artificial Sequence
  Synthetic
aagagtattctgatcaggattcctattcattttgaggatttaaaactctgattattgtctaatatggtctcaacg

SEQ ID NO: 46498 - DNA, 75 bp, Artificial Sequence
  Synthetic
ctacactattatatgattatagtttctattttataggaaagcgtacgagaaaatcaaatgtctaatttctaacgg

SEQ ID NO: 46499 - DNA, 75 bp, Artificial Sequence
  Synthetic
aaatataaaactactgtctccagagctcgctctatcttttattttatctaattcgatacaaactcctgatactgg

SEQ ID NO: 46500 - DNA, 75 bp, Artificial Sequence
  Synthetic
aaatcaaatgtctaatttctaacggtagtgttgataaacgattatcgtcaatggatacctcctctatcatgtcgt

SEQ ID NO: 46501 - DNA, 75 bp, Artificial Sequence
  Synthetic
ttaggcagtttatggcagcttgataattagatatagtatattccagttcatatttattagataccgcattgccca

SEQ ID NO: 46502 - DNA, 75 bp, Artificial Sequence
  Synthetic
cgatggacattatttttttaaacactctttctgaaggatctgtacacgccaacaacggaccacatccttcttcat

SEQ ID NO: 46503 - DNA, 75 bp, Artificial Sequence
  Synthetic
attagatatagtatattccagttcatatttattagataccgcattgcccagattttgatattctatgaattcctc

SEQ ID NO: 46504 - DNA, 75 bp, Artificial Sequence
  Synthetic
gaagcgatgctacgctagtcacaatcaccactttcatatttagaatatatgtatgtaaaaatatagtagaatttc

SEQ ID NO: 46505 - DNA, 75 bp, Artificial Sequence
  Synthetic
tcctataacttctaatcgtgtaatattcatcatcgacataacactatctatgttatcatcgtatattagtatacc

SEQ ID NO: 46506 - DNA, 75 bp, Artificial Sequence
  Synthetic
atactgtaccaataaatttattctctctatgacttcatcatctgttcccgagagataatatagaggtgttttatg

SEQ ID NO: 46507 - DNA, 75 bp, Artificial Sequence
  Synthetic
actctcttccctctatcatgttcactactggtgtccacgatgataaatatctagagggaatataatatagtccat

SEQ ID NO: 46508 - DNA, 75 bp, Artificial Sequence
  Synthetic
tatttgattataaaacttatattgcttgttagcccaatctgtaaatatcggattattaacatatcgtttctttgt

SEQ ID NO: 46509 - DNA, 75 bp, Artificial Sequence
  Synthetic
ctattctattattattaattttagaagctatatgtaatggataatttccatcatcatccgtctcatttggcgagt

SEQ ID NO: 46510 - DNA, 75 bp, Artificial Sequence
  Synthetic
ccattgtcttattagttacgcttatttttatgtgttttacgttgctttattatattttataagaatgattgtttg

SEQ ID NO: 46511 - DNA, 75 bp, Artificial Sequence
  Synthetic
taaacctaacacaaattatattattagacttttcgtatgtaatgtctttcatgttataagtttttaatcctggaa

SEQ ID NO: 46512 - DNA, 75 bp, Artificial Sequence
  Synthetic
gatgaccaaaaagactatacggtaacttctcagttcaataactacactatcgataccaaagactggactataaac

SEQ ID NO: 46513 - DNA, 75 bp, Artificial Sequence
  Synthetic
agtgaggatagtcaaaaagatcaatgtatagagcataaccattctcgtatactttgccctttaatacatcaccca

SEQ ID NO: 46514 - DNA, 75 bp, Artificial Sequence
  Synthetic
cattgggcaacgaataacaaaatgcaagcatcttgttaacgggctcgtaaattgggataaaaattatgtttttat

SEQ ID NO: 46515 - DNA, 75 bp, Artificial Sequence
  Synthetic
atgttataagtttttaatcctggaatagaatctattttaatgaggcttttaaacgcagagttctccaacgagtca

SEQ ID NO: 46516 - DNA, 75 bp, Artificial Sequence
  Synthetic
cacaattaacaatgaattagtttatattactgaattaataatataaaattcccaatcttgttattaaacgcacgc

SEQ ID NO: 46517 - DNA, 75 bp, Artificial Sequence
  Synthetic
tttctcatatgaaagattaatttgattctaatataatcttcagtattggatgaatctcaattcaaattaattcca

SEQ ID NO: 46518 - DNA, 75 bp, Artificial Sequence
  Synthetic
tttgaatggaataggtttttgaattagtttataattacaacataatagataaggaagtgtgcaaatagtacgcgg

SEQ ID NO: 46519 - DNA, 75 bp, Artificial Sequence
  Synthetic
aactgttttcttaatacattcgatggttggtaatttactcagaataatttccaatatcttaatatataattctgc

SEQ ID NO: 46520 - DNA, 75 bp, Artificial Sequence
  Synthetic
aaaaaacataatagctcccctgttttcatccatggttttaagtaaatgatcactggcttccttagtcaatggata

SEQ ID NO: 46521 - DNA, 75 bp, Artificial Sequence
  Synthetic
atctgtgacagatatcatctttagagaatactagtcgcgttaatagtactaaaatttgtattttttaatctatct

SEQ ID NO: 46522 - DNA, 75 bp, Artificial Sequence
  Synthetic
gacaaataccgatcggtaatcgtctgccggtgtaatagaattatatatatctatctattacaccggccgagtatg

SEQ ID NO: 46523 - DNA, 75 bp, Artificial Sequence
  Synthetic
ttcgaacattaaccgtttcatcatcattggacaaaatccatatttcttaatgtaaagagtaatcaaatcattgtg

SEQ ID NO: 46524 - DNA, 75 bp, Artificial Sequence
  Synthetic
attggacaaaatccatatttcttaatgtaaagagtaatcaaatcattgtgtttattgtaccatcttgttgtaaat

SEQ ID NO: 46525 - DNA, 75 bp, Artificial Sequence
  Synthetic
gatctcgtctaagaattcaactatatcgacatatttcatttgtatacacataaccattactaacgtagaatgtat

SEQ ID NO: 46526 - DNA, 75 bp, Artificial Sequence
  Synthetic
tcgacatatttcatttgtatacacataaccattactaacgtagaatgtataggaagagatgtaacgggaacgggg

SEQ ID NO: 46527 - DNA, 75 bp, Artificial Sequence
  Synthetic
ataataagaataaagtaatgcccgtaaagataaacatcaacattgtttggtaatcattaaaccaattagtatgac

SEQ ID NO: 46528 - DNA, 75 bp, Artificial Sequence
  Synthetic
ttttgtggttccacaattcatttccatacatgttattatcacactaatattatgatgaactttatctagccgctg

SEQ ID NO: 46529 - DNA, 75 bp, Artificial Sequence
  Synthetic
acaactttaggatctctattgccaaatttttgaaaatatttatttatatgcttaaatctatataatgtagctcct

SEQ ID NO: 46530 - DNA, 75 bp, Artificial Sequence
  Synthetic
tacatccaatcatatatctgaagatatacccgaagatatacacactgataaatttgtcatttatgatatttatac

SEQ ID NO: 46531 - DNA, 75 bp, Artificial Sequence
  Synthetic
ttgtacgtaatctattatagatgccaagatatctatataattattttgtaagatgatgttaactatgtgatctat

SEQ ID NO: 46532 - DNA, 75 bp, Artificial Sequence
  Synthetic
tataaagtatgtatgcgcgtgtatgtgtgtatttacaaaaaaaatgctaagtatgcgatgtatcctgtattattt

SEQ ID NO: 46533 - DNA, 75 bp, Artificial Sequence
  Synthetic
atccatgatggtcatgtttatttctagtccgtatccagtcaacactatgttagcatttctgtctatatagctttc

SEQ ID NO: 46534 - DNA, 75 bp, Artificial Sequence
  Synthetic
tttagaaacgtctactaacgattttttatgcttgcattattaatggtatgtaatatgattgattgtgtacggaat

SEQ ID NO: 46535 - DNA, 75 bp, Artificial Sequence
  Synthetic
tatagcatcctcaaaaaatatattcgcatatattcccaagtcttcagttctatcttctaaaaaatcttcagcata

SEQ ID NO: 46536 - DNA, 75 bp, Artificial Sequence
  Synthetic
tggaatataataatctattttgcctcttctgatatcattaatgatatagtttttgacactattttccgtcaattg

SEQ ID NO: 46537 - DNA, 75 bp, Artificial Sequence
  Synthetic
cggatagcgtccctaggacgaactactgccattaatatctctattatagcttctggacataattcatctattata

SEQ ID NO: 46538 - DNA, 75 bp, Artificial Sequence
  Synthetic
ctgccattaatatctctattatagcttctggacataattcatctattataccataattaatgggaactattccgt

SEQ ID NO: 46539 - DNA, 75 bp, Artificial Sequence
  Synthetic
gtacgatgtaatgagtaataagacaataggaaatctatctataacacataattattctatcaattttaccaatta

SEQ ID NO: 46540 - DNA, 75 bp, Artificial Sequence
  Synthetic
ttttacaaaaatgtatatgtatgtcgtatgtatatttataaaaaatgctaagtatgcgatgtatcctgtattatt

SEQ ID NO: 46541 - DNA, 75 bp, Artificial Sequence
  Synthetic
tatattggttcatacatgaaatgatctctattgatgatagtgactatttcattctctgaaaattggtaactcatt

SEQ ID NO: 46542 - DNA, 75 bp, Artificial Sequence
  Synthetic
ttttatcagtatgtatatctatatcaacgtcatcattgtagcgaatagtcgtcattaatttcctatatgaaatgg

SEQ ID NO: 46543 - DNA, 75 bp, Artificial Sequence
  Synthetic
tccaatggagctacagttcttggcttaaacagatatagtttttctggaacgaattctacaacattattataaaga

SEQ ID NO: 46544 - DNA, 75 bp, Artificial Sequence
  Synthetic
ttctcggacatttcagccatcggcaaagcatcacagaatccgagtaagatggtatatgctctgctgctttacatg

SEQ ID NO: 46545 - DNA, 75 bp, Artificial Sequence
  Synthetic
gcctttgtgatagtatggcattcattatctagaaacgctctacgaatatctgtgacagatatcatctttagagaa

SEQ ID NO: 46546 - DNA, 75 bp, Artificial Sequence
  Synthetic
tatctagaaacgctctacgaatatctgtgacagatatcatctttagagaatactagtcgcgttaatagtactaaa

SEQ ID NO: 46547 - DNA, 75 bp, Artificial Sequence
  Synthetic
atattgtttagtagatactcatcaatatcatcaagattatcaagattatcaagataagctaattcactaaacaca

SEQ ID NO: 46548 - DNA, 75 bp, Artificial Sequence
  Synthetic
tggtagccttcaagacctgactagcaaatccagccttaattttttcatgattgactaatgggtcgtattggtatt

SEQ ID NO: 46549 - DNA, 75 bp, Artificial Sequence
  Synthetic
tgacgtaaccaagaagtttatctacagccaatttagctgcattatttttagcatctcgtttagattttccatcgg

SEQ ID NO: 46550 - DNA, 75 bp, Artificial Sequence
  Synthetic
agccaatttagctgcattatttttagcatctcgtttagattttccatcggccttatcgaatactctcccgtcgat

SEQ ID NO: 46551 - DNA, 75 bp, Artificial Sequence
  Synthetic
tactgattctggacatagctttccaacgggcgcatttggtgtgatggctcccataagtttggcagctagcagatt

SEQ ID NO: 46552 - DNA, 75 bp, Artificial Sequence
  Synthetic
ctggtatgaacagcgagagcgagagtgaaagcgagagtgagagtgataatatatcaatcaaaacagaatatgaga

SEQ ID NO: 46553 - DNA, 75 bp, Artificial Sequence
  Synthetic
atctttgctagagagaaagcttttcagctgcttggacttccaagtattaattcgtgacagatccatgtctgaaac

SEQ ID NO: 46554 - DNA, 75 bp, Artificial Sequence
  Synthetic
tacgaaaagaccaatctctcttagttatttggcagtactcattaataatggtgacagggttagcatctttccaat

SEQ ID NO: 46555 - DNA, 75 bp, Artificial Sequence
  Synthetic
aatatctaccaaattatcatgccattatgataagcacccttatattcacaaatatgagggtgatgagcgacaata

SEQ ID NO: 46556 - DNA, 75 bp, Artificial Sequence
  Synthetic
atataaataaaataatgattccttacaccgtacccatcaatataaataaaataatgattccttacaccgtaccca

SEQ ID NO: 46557 - DNA, 75 bp, Artificial Sequence
  Synthetic
gtacaccatagcactacgttgaagatcatacagagctttattaacttctcgcttctccatattaagttgtctagt

SEQ ID NO: 46558 - DNA, 75 bp, Artificial Sequence
  Synthetic
aaaaaaatacgaataatcaccttggctatttagtaagtgtcatttaacactatactcatattaatccatggactc

SEQ ID NO: 46559 - DNA, 75 bp, Artificial Sequence
  Synthetic
tttttcactgtttagtcgcggatatggaatttgatcctaccaaaatcaatatatcatctatagatcatgtaacaa

SEQ ID NO: 46560 - DNA, 75 bp, Artificial Sequence
  Synthetic
aacccgtcatctataggcgatgctggttctggagattctggaggagatggattattatctggaagaatctctgtt

SEQ ID NO: 46561 - DNA, 75 bp, Artificial Sequence
  Synthetic
ctttccttgttttcatgtatcgattgcgttgtaacattaagattgcgaaatgctctaaatttgggaggcttgaag

SEQ ID NO: 46562 - DNA, 75 bp, Artificial Sequence
  Synthetic
ggctctagtttgaatcatcatcggtgtagtattcctacttttacagttaggacacggtgtattgtatttctcgtc

SEQ ID NO: 46563 - DNA, 75 bp, Artificial Sequence
  Synthetic
tccaatcattgggaaacattacagatctgatgaccgacgataatataaacatcttgatactttttctagaaaaaa

SEQ ID NO: 46564 - DNA, 75 bp, Artificial Sequence
  Synthetic
cgacctttgttaatatccacgacaatagacagcaatcccatggttccataaacagtgagtttatctttctttgaa

SEQ ID NO: 46565 - DNA, 75 bp, Artificial Sequence
  Synthetic
gacggtttatttctatatgatagtttgtttctggaatcctttgagtattctataccaatattattctttgattcg

SEQ ID NO: 46566 - DNA, 75 bp, Artificial Sequence
  Synthetic
tctcttatgaatcgtatatcatcatctgaaataatcatgtaaggcatacatttaacaataagagacttgtctcct

SEQ ID NO: 46567 - DNA, 75 bp, Artificial Sequence
  Synthetic
gcgtttctctgatagaatgcgagcagcgattttggcgttatcatttgacgatatttctggaatgacgaatcctgt

SEQ ID NO: 46568 - DNA, 75 bp, Artificial Sequence
  Synthetic
gcattctatatcaagtgttaaaaaaattatcctatcatgtatttgagagtcttatatgtagcaaacatgatagct

SEQ ID NO: 46569 - DNA, 75 bp, Artificial Sequence
  Synthetic
ttgtattacctatattcttgatgtagtactttgatgatttttccatggcccattctattaagtcttccacgatgg

SEQ ID NO: 46570 - DNA, 75 bp, Artificial Sequence
  Synthetic
ttatgttttaaatatcaaccgcgaatcaactcataaaatacaagagaatgaaatacatacatattttagttattg

SEQ ID NO: 46571 - DNA, 75 bp, Artificial Sequence
  Synthetic
cattctattaagtcttccacgatggtattatcatccacatattgtgatagtaactctcggatatcagtagcggct

SEQ ID NO: 46572 - DNA, 75 bp, Artificial Sequence
  Synthetic
gaatcagactctgaatacagatgagagatgatatacatatgcaatactgtaccacaatttcgtagcggataatca

SEQ ID NO: 46573 - DNA, 75 bp, Artificial Sequence
  Synthetic
ttcttcagtattggatgaatctcaattcaaattaattccattagattatatcataaataaaaatagtagcacgca

SEQ ID NO: 46574 - DNA, 75 bp, Artificial Sequence
  Synthetic
agcaagttctataagctagttaactaataaataaaaagtttaattatcgacgacgcatgtcgttatttttctcat

SEQ ID NO: 46575 - DNA, 75 bp, Artificial Sequence
  Synthetic
attttccatttataacacttatgtattaactttgatcatttatattttttcattattatgttgatattaacaaaa

SEQ ID NO: 46576 - DNA, 75 bp, Artificial Sequence
  Synthetic
atatattaaagtcatttatgttgctatatccagtagcttctagtagagccatcgctatatccttattaactttaa

SEQ ID NO: 46577 - DNA, 75 bp, Artificial Sequence
  Synthetic
tctagtattacctgatgcaggcaatagcgacataaacatagaaaacgaatagccaaacggcgagaagacaatatt

SEQ ID NO: 46578 - DNA, 75 bp, Artificial Sequence
  Synthetic
tatcatcatagtctattaaacacaaatcatctacgtttataacaacattctcatcattaattagttctgtagtaa

SEQ ID NO: 46579 - DNA, 75 bp, Artificial Sequence
  Synthetic
gtattgtagttatacggctacaatttcataatgagtggaagtcagtgtcctatgatcaatgacgatctatatagg

SEQ ID NO: 46580 - DNA, 75 bp, Artificial Sequence
  Synthetic
aatggataagaagaggacaaagtttcagaatagagccaaaatggtaaaagaaataaatcagacaataagagcagc

SEQ ID NO: 46581 - DNA, 75 bp, Artificial Sequence
  Synthetic
tgattaggactactactctaaaagatatagcaacatctattccaaatattcagaaaatttataaactattctcgg

SEQ ID NO: 46582 - DNA, 75 bp, Artificial Sequence
  Synthetic
agccaaatattcttttttgaaacgccatctatcgtagtgaggacacacgtgaacctataatgagcaaatttatta

SEQ ID NO: 46583 - DNA, 75 bp, Artificial Sequence
  Synthetic
aattattaataaaaataatttagtgtttaaattttactagttccagattttacacctccgttcacacctccatta

SEQ ID NO: 46584 - DNA, 75 bp, Artificial Sequence
  Synthetic
gtagagtggtgattccaccatctgtggtacgaacggtttcatcttctttgatgccatcacccagatgttctataa

SEQ ID NO: 46585 - DNA, 75 bp, Artificial Sequence
  Synthetic
caaaatgcaagcatcttgttaacgggctcgtaaattgggataaaaattatgtttttattgttttatatctatttt

SEQ ID NO: 46586 - DNA, 75 bp, Artificial Sequence
  Synthetic
tttagctccatgatcagtaaatattaatgagaacatagtgttgcctcccactattatttttttcatctcgttcaa

SEQ ID NO: 46587 - DNA, 75 bp, Artificial Sequence
  Synthetic
tatatatcatttgtacattgtttcatattttttaatagtctacaccttttagtaggactagtatcgtacaattca

SEQ ID NO: 46588 - DNA, 75 bp, Artificial Sequence
  Synthetic
tatccgtaaagtaattccctgtccaatttgaggttcctatatacgccgttttatcggttaccatatatttggcat

SEQ ID NO: 46589 - DNA, 75 bp, Artificial Sequence
  Synthetic
agacaatggattcattggattggacaaactaaaattaaacattgttcacaatatagttgaaccatgtatgcctgt

SEQ ID NO: 46590 - DNA, 75 bp, Artificial Sequence
  Synthetic
ataatatcatatgcttccacgtatattttattttgttttgactcataatactcacgtaattctggattattggca

SEQ ID NO: 46591 - DNA, 75 bp, Artificial Sequence
  Synthetic
ataattaggatcttctaatggattgtatggcttgattccatcatcatcaggttgggtctggacaaccttaactgg

SEQ ID NO: 46592 - DNA, 75 bp, Artificial Sequence
  Synthetic
ccgttatttgatctaatgttgacatctgaaccggattctagcagtaaagatactagagattgtttattatatcta

SEQ ID NO: 46593 - DNA, 75 bp, Artificial Sequence
  Synthetic
tagattttagcatagcgatagatcttaaaaagtttctcataataaacgaagatcgttgccagcaactaatcaata

SEQ ID NO: 46594 - DNA, 75 bp, Artificial Sequence
  Synthetic
cataaaccaacgaggaggaatatcgtcggagctgtacaccatagcactacgttgaagatcgtacagagctttatt

SEQ ID NO: 46595 - DNA, 75 bp, Artificial Sequence
  Synthetic
aaattgttaaattaataatggatagtataaaatagttattagtaataagatagtttaaaatagttattagtaata

SEQ ID NO: 46596 - DNA, 75 bp, Artificial Sequence
  Synthetic
tatatattctatataagatggatacgtatcacatgtgtacttatagtctactaatatgaagtacttgacacacat

SEQ ID NO: 46597 - DNA, 75 bp, Artificial Sequence
  Synthetic
tttataccatttcgtgtcactggctttgtagatttggatatagttaatcccaacaatgatatagcattgcgcata

SEQ ID NO: 46598 - DNA, 75 bp, Artificial Sequence
  Synthetic
tcgtagaaagtatcttatatacacagtagaaaataatatagattttttaaaggatgatacattaagtaaagtaaa

SEQ ID NO: 46599 - DNA, 75 bp, Artificial Sequence
  Synthetic
gtagaaaataatatagattttttaaaggatgatacattaagtaaagtaaacaattttaccctcaatcatgtacta

SEQ ID NO: 46600 - DNA, 75 bp, Artificial Sequence
  Synthetic
tctcaactgtgctctttatacattctatggttggtaatctactcagaatacattccaatatctgaatgtataatt

SEQ ID NO: 46601 - DNA, 75 bp, Artificial Sequence
  Synthetic
ttaataattatggtgtggtgtgtacggccacaatttcataatgagtggaagtcagtgtcctatgatcaatgacga

SEQ ID NO: 46602 - DNA, 75 bp, Artificial Sequence
  Synthetic
cctatatatttattttcagttttattacgcgcataaattttaaaaaatatgttaagtttatgaaaatgtctcgtg

SEQ ID NO: 46603 - DNA, 75 bp, Artificial Sequence
  Synthetic
tgcaagtataacacaaataccaatacacgtataaccacactttgttactatattaatatctgcaccattatctac

SEQ ID NO: 46604 - DNA, 75 bp, Artificial Sequence
  Synthetic
tgtattagctaataccaatttttttgttttcatacatatggtacgatgttgtaaagtgtacgaagcggttttacg

SEQ ID NO: 46605 - DNA, 75 bp, Artificial Sequence
  Synthetic
taagagcagcacaaactcattacgagacattgaaacaaggatacctaaaatttaagagaatgattagaactgcta

SEQ ID NO: 46606 - DNA, 75 bp, Artificial Sequence
  Synthetic
cacgtataaccacactttgttactatattaatatctgcaccattatctactaaccattctactagtatggtatta

SEQ ID NO: 46607 - DNA, 75 bp, Artificial Sequence
  Synthetic
tacgttaaagcattgactaagaattatttatcgtttagtaacgcaatacaatcgtacaaggaaaccgtgcataaa

SEQ ID NO: 46608 - DNA, 75 bp, Artificial Sequence
  Synthetic
atttatatcatcgatatacggcttacaaagttttaatatagataacacatcttcatcatgattattgtgtacgta

SEQ ID NO: 46609 - DNA, 75 bp, Artificial Sequence
  Synthetic
caaagttttaatatagataacacatcttcatcatgattattgtgtacgtagacagggaataatggcataatattt

SEQ ID NO: 46610 - DNA, 75 bp, Artificial Sequence
  Synthetic
gcaaagcatcacagaatccgagtaagatggtatatgctctactgctttacatgttccccaatttgtttggagatg

SEQ ID NO: 46611 - DNA, 75 bp, Artificial Sequence
  Synthetic
aggagaacttataggcgtaaattatgacttagttcttaatccattatttcacggaggggaacccatcaaagatat

SEQ ID NO: 46612 - DNA, 75 bp, Artificial Sequence
  Synthetic
acggaggggaacccatcaaagatatggaaatcatttttttaaaactgtttaagaaaacagacttcaaagttgtta

SEQ ID NO: 46613 - DNA, 75 bp, Artificial Sequence
  Synthetic
ctcaactactttaggatctactttgtgtatattaataaaatattcatttacgtgcttatatctatataatactgc

SEQ ID NO: 46614 - DNA, 75 bp, Artificial Sequence
  Synthetic
tgtatattaataaaatattcatttacgtgcttatatctatataatactgcgccttcatctatcatacatttgata

SEQ ID NO: 46615 - DNA, 75 bp, Artificial Sequence
  Synthetic
gatacaggcatagagtttgtggataatgatagacaagatatatatactctatttcaacaaactggtagaatagtc

SEQ ID NO: 46616 - DNA, 75 bp, Artificial Sequence
  Synthetic
tacagatgagagatgatatacagatgtaatactgtaccgcaatttcgtggttgataatcgtcattgtgtgagtga

SEQ ID NO: 46617 - DNA, 75 bp, Artificial Sequence
  Synthetic
atgatagacaagatatatatactctatttcaacaaactggtagaatagtccatagcaatctaacagaaacgttta

SEQ ID NO: 46618 - DNA, 75 bp, Artificial Sequence
  Synthetic
gatagaatatttgtatcgtttaatactcgtatatattatattatagcgcgccatattaaacaatactaaaatatc

SEQ ID NO: 46619 - DNA, 75 bp, Artificial Sequence
  Synthetic
ctcgtatatattatattatagcgcgccatattaaacaatactaaaatatctttagacccacaaccatctaataat

SEQ ID NO: 46620 - DNA, 75 bp, Artificial Sequence
  Synthetic
ttcactctattaaaaatccaagtttctatttctttcatgactgattttttaacttcgtccgtttccttatgaaga

SEQ ID NO: 46621 - DNA, 75 bp, Artificial Sequence
  Synthetic
gaaagtatagctaatgatgcggatatcgttcttaatagacccgccattaccatgtatgataaaattcttagttat

SEQ ID NO: 46622 - DNA, 75 bp, Artificial Sequence
  Synthetic
ttccatggcccattctattaagtcttccaagttggtatcatccacatattgtgatagtaactctcggatatcagt

SEQ ID NO: 46623 - DNA, 75 bp, Artificial Sequence
  Synthetic
ggtaacttggaatcagtactcggatatgtgtccgatatgcataccgaactcgcgtcaaaatctcaactaatcatt

SEQ ID NO: 46624 - DNA, 75 bp, Artificial Sequence
  Synthetic
tcgttcttaatagacccgccattaccatgtatgataaaattcttagttatatatactctgagataaaacagggac

SEQ ID NO: 46625 - DNA, 75 bp, Artificial Sequence
  Synthetic
taaatagttatgtagaatattcatacgttcattattctgataattattgtcgtacaatgcatcaaatatttcccg

SEQ ID NO: 46626 - DNA, 75 bp, Artificial Sequence
  Synthetic
cgttcattattctgataattattgtcgtacaatgcatcaaatatttcccgtttaacatcgcacctaccaacgtaa

SEQ ID NO: 46627 - DNA, 75 bp, Artificial Sequence
  Synthetic
gatatcagagaacttctgctagaaattatatatgatattcctggagatatcctatctattattgatgcaaaaaac

SEQ ID NO: 46628 - DNA, 75 bp, Artificial Sequence
  Synthetic
ttatatatgatattcctggagatatcctatctattattgatgcaaaaaacgacgattggaaaaaatatttcatta

SEQ ID NO: 46629 - DNA, 75 bp, Artificial Sequence
  Synthetic
cttgagacataactcccattttttggtattcacccacacgtttttcgaaaaaattagttttaccttctaatgata

SEQ ID NO: 46630 - DNA, 75 bp, Artificial Sequence
  Synthetic
gtaagatattaaacagtttatcacgtctatagataatttatctcgtgatctagtgataatataataatagagtgc

SEQ ID NO: 46631 - DNA, 75 bp, Artificial Sequence
  Synthetic
tctatagataatttatctcgtgatctagtgataatataataatagagtgcggttttacctattttatcatctata

SEQ ID NO: 46632 - DNA, 75 bp, Artificial Sequence
  Synthetic
acgtttaacgaggacttattcagagttgttgttcaaatagatcccgaatatttcgataatgaacgaattatgtct

SEQ ID NO: 46633 - DNA, 75 bp, Artificial Sequence
  Synthetic
gtcagtaactttttctattataatctcgtatccgtaagatacattactacacataggaattccctgatcgagcaa

SEQ ID NO: 46634 - DNA, 75 bp, Artificial Sequence
  Synthetic
tcgtatccgtaagatacattactacacataggaattccctgatcgagcaatagtttaaatacatctacatttgga

SEQ ID NO: 46635 - DNA, 75 bp, Artificial Sequence
  Synthetic
tattcttgaattggttcctggtatcattaggatctctatctctcaacatctgtttaagttcatcgagagccacct

SEQ ID NO: 46636 - DNA, 75 bp, Artificial Sequence
  Synthetic
atttatttctagaccttttgcaattagtaatctcaataattctacgtcgatattatcagattctatatattcgaa

SEQ ID NO: 46637 - DNA, 75 bp, Artificial Sequence
  Synthetic
agtaatctcaataattctacgtcgatattatcagattctatatattcgaatatatcaaagtcattgatattttta

SEQ ID NO: 46638 - DNA, 75 bp, Artificial Sequence
  Synthetic
catacctgtttttgcacgagtcggatcccatggtcatagagaacggaatactaaagaaactgtcatctataaaat

SEQ ID NO: 46639 - DNA, 75 bp, Artificial Sequence
  Synthetic
caaacactttcctgatttatcgaccaagacacatatggtttctaaatctatcaagtggtggggatccatagttat

SEQ ID NO: 46640 - DNA, 75 bp, Artificial Sequence
  Synthetic
tcccatggtcatagagaacggaatactaaagaaactgtcatctataaaatccaagagtagacggctgaacttgtt

SEQ ID NO: 46641 - DNA, 75 bp, Artificial Sequence
  Synthetic
atttttcttggtaacgtatgcctttaatgaattttcattacgttctaccaatgattgtgcactgcaggcatcaaa

SEQ ID NO: 46642 - DNA, 75 bp, Artificial Sequence
  Synthetic
aatgaattttcattacgttctaccaatgattgtgcactgcaggcatcaaaagttttacaactatcatagagcata

SEQ ID NO: 46643 - DNA, 75 bp, Artificial Sequence
  Synthetic
gtcttgtgttagatgattataagggagacttgttagttaaaattataaaccatctcaagtctgtggaggatgtat

SEQ ID NO: 46644 - DNA, 75 bp, Artificial Sequence
  Synthetic
catctagcctcggtaatctgtacttctgtacaaaatcgttctgctaaattttcattcactattccgtcactggct

SEQ ID NO: 46645 - DNA, 75 bp, Artificial Sequence
  Synthetic
caatcgccatttgttcgtatgtcataaattctttaattatatgacactgtgtattatttagttcatccttgttca

SEQ ID NO: 46646 - DNA, 75 bp, Artificial Sequence
  Synthetic
tcatttcatttcatttatgtggatttggtacgagcaggcagcatgagctcgtatgatttcagtaccgtagtatca

SEQ ID NO: 46647 - DNA, 75 bp, Artificial Sequence
  Synthetic
taaaaaccctagtattcttccatcgctaatcaaaactattttagctagttataatatttccatcatcgtcctatt

SEQ ID NO: 46648 - DNA, 75 bp, Artificial Sequence
  Synthetic
gtacgatccaaacaatgtttctaccggcatagtggatacgaagatgctatccatcagaatgtttccctgattagt

SEQ ID NO: 46649 - DNA, 75 bp, Artificial Sequence
  Synthetic
ttatacaatcaatgatatttggatccatgctactaccttcgggtaaaattggagcatcgtataccatttctagta

SEQ ID NO: 46650 - DNA, 75 bp, Artificial Sequence
  Synthetic
tttaggactttgtattcagtatttttggaatcataaaaaataaaaaaagttttaccattttaaaatttaaaaagt

SEQ ID NO: 46651 - DNA, 75 bp, Artificial Sequence
  Synthetic
tttgataaatgggaactgctgcaacaattcagactcccaaattaatgaataaagagaatgcagaaatgattttgg

SEQ ID NO: 46652 - DNA, 75 bp, Artificial Sequence
  Synthetic
ttctagaatatcatcggctatatcgctaaaattttcatcaaagtcgacatcacaacctaactcagtcaatatatt

SEQ ID NO: 46653 - DNA, 75 bp, Artificial Sequence
  Synthetic
gaaaataatcctgaatatattgattttcgtaacagatacggagactatagatatctcattataaaaagtgatcat

SEQ ID NO: 46654 - DNA, 75 bp, Artificial Sequence
  Synthetic
atatctcattataaaaagtgatcatgattttgtaaaactatgtaaaaatcatgccgagaaaagttctccagaaac

SEQ ID NO: 46655 - DNA, 75 bp, Artificial Sequence
  Synthetic
atgagatatagacacgcaataaatctaattgcggacatggttactccttaaaaaaatacgaataatcactttgat

SEQ ID NO: 46656 - DNA, 75 bp, Artificial Sequence
  Synthetic
cagatctgatgacggacgataatataaacatcttgatactttttctagaaaaaaaattgaattgatgatataggg

SEQ ID NO: 46657 - DNA, 75 bp, Artificial Sequence
  Synthetic
ctgaagtactattaaaacctatgatgtccatgggtgacataattacatataacggatgtaaagacaatgaatgga

SEQ ID NO: 46658 - DNA, 75 bp, Artificial Sequence
  Synthetic
ttggtagattttcaattatgtatcaatatagcaacagtagttcttgctcctccttgattctagcatcctcttcat

SEQ ID NO: 46659 - DNA, 75 bp, Artificial Sequence
  Synthetic
atttctgagttggatatcatcaaaatactggataaatacgaggacgtgtatagagtaagtaaagaaaaagaatgt

SEQ ID NO: 46660 - DNA, 75 bp, Artificial Sequence
  Synthetic
acacaaatagtaatacatgtaaacccatattttgttattatattaatgtctgcgccattatctattaaccattct

SEQ ID NO: 46661 - DNA, 75 bp, Artificial Sequence
  Synthetic
ttaataatttctagaacatcatctctatcataaaagatacaaatattaactgtttgatccgtaataacattgcta

SEQ ID NO: 46662 - DNA, 75 bp, Artificial Sequence
  Synthetic
tgttaagaaaaggagcagaccctaattatgtagatgataaaggtaatacttttcttcattacttctgcatctata

SEQ ID NO: 46663 - DNA, 75 bp, Artificial Sequence
  Synthetic
agaatgcacaaagaagaattctagatcaagaaacattttttagtagaggtctaagtagaccgttaatgaagaaca

SEQ ID NO: 46664 - DNA, 75 bp, Artificial Sequence
  Synthetic
tcaagaaacattttttagtagaggtctaagtagaccgttaatgaagaacacatatctatttgataattacgcgta

SEQ ID NO: 46665 - DNA, 75 bp, Artificial Sequence
  Synthetic
aaaatgactaattttgtagcattagtatcatgaactctaatcaaaatcttaatatcttcgtcacacgttagctct

SEQ ID NO: 46666 - DNA, 75 bp, Artificial Sequence
  Synthetic
atgctagtgactattatcccatttcgttgggattacttaaaaagtttgagtttctcatgtctctatataaaggtc

SEQ ID NO: 46667 - DNA, 75 bp, Artificial Sequence
  Synthetic
gttgggattacttaaaaagtttgagtttctcatgtctctatataaaggtcctattccagtatatgaagaaaaagt

SEQ ID NO: 46668 - DNA, 75 bp, Artificial Sequence
  Synthetic
atcttagaaagttttctgcccttccaactaacgagtttattagttttttattattgacctccatccctatctata

SEQ ID NO: 46669 - DNA, 75 bp, Artificial Sequence
  Synthetic
aactaacgagtttattagttttttattattgacctccatccctatctataatatcttattctggtttaaaaacac

SEQ ID NO: 46670 - DNA, 75 bp, Artificial Sequence
  Synthetic
tcatctacatcatcatctacataatctacgatattattatacataaacatcgagaacatactattgtccattatc

SEQ ID NO: 46671 - DNA, 75 bp, Artificial Sequence
  Synthetic
caccctaatcttagtagagcaagaagtccatccgattatgagacattagctaatattagtactatattgtacttt

SEQ ID NO: 46672 - DNA, 75 bp, Artificial Sequence
  Synthetic
gtaacagatacggagactatagatctctcattataaaaagtgatcacgagtttgtaaaactatgtaaaaatcatg

SEQ ID NO: 46673 - DNA, 75 bp, Artificial Sequence
  Synthetic
gttccattttgatcttatatccatactgtatcctgctacacgtgggtattcctttatccaataatagtttaaaca

SEQ ID NO: 46674 - DNA, 75 bp, Artificial Sequence
  Synthetic
cacgtctaatctgttctattttgatcttgtatccatactgtatgttgctacacgtaggtattcctttatccaata

SEQ ID NO: 46675 - DNA, 75 bp, Artificial Sequence
  Synthetic
tctctataacaaatatcataacttagttcttttatgtcaagaaggcactggtttagttcatctataaatgtcaca

SEQ ID NO: 46676 - DNA, 75 bp, Artificial Sequence
  Synthetic
gtaaaatgtaggttttgaaccaaacattctttcaaagaatgagatgcataaaactttattatccaatagattgac

SEQ ID NO: 46677 - DNA, 75 bp, Artificial Sequence
  Synthetic
taaacttcgtaaaatattctttgatcactgccgagtttaaaacttctatcgataattgtttcatatgttttaata

SEQ ID NO: 46678 - DNA, 75 bp, Artificial Sequence
  Synthetic
aacaaaatgtggtcgtgggtatggaaagaaaggagaggatgaaatgggtgataccatttgtaagaaatgtcggaa

SEQ ID NO: 46679 - DNA, 75 bp, Artificial Sequence
  Synthetic
cctgcatcttattagaatattaacctaactaaaagacataacataaaactcattacatagttgataaaaagctgt

SEQ ID NO: 46680 - DNA, 75 bp, Artificial Sequence
  Synthetic
atatcgttctccaagttctatagtctctggattatttttattatattcagtaaccaaatacatattagggttatc

SEQ ID NO: 46681 - DNA, 75 bp, Artificial Sequence
  Synthetic
ttaaccttcgtctaccttcacaatggcctctccttgtgcccagttcactccctgtcattgccacgctactaagga

SEQ ID NO: 46682 - DNA, 75 bp, Artificial Sequence
  Synthetic
atcttaatcatattcttatgaaacttggaaacatctcttctagtttcactagtacctttattaattctttcaggt

SEQ ID NO: 46683 - DNA, 75 bp, Artificial Sequence
  Synthetic
tttacaccaatagtgagttcggcggcaaagtaccaataccggtaatcttgtcgaggaggacatatagtattcttg

SEQ ID NO: 46684 - DNA, 75 bp, Artificial Sequence
  Synthetic
tggaaacatctcttctagtttcactagtacctttattaattctttcaggtacagattttgaattcgacgatgccg

SEQ ID NO: 46685 - DNA, 75 bp, Artificial Sequence
  Synthetic
acgctcgacagatgtgggatttggtagacctcctactacgtataatttattgttagcaggtaccccactagcgta

SEQ ID NO: 46686 - DNA, 75 bp, Artificial Sequence
  Synthetic
ttccttacacaattgacgtacatgagtctgagttccttgtttttgctaattatttcatccaatttattattcttg

SEQ ID NO: 46687 - DNA, 75 bp, Artificial Sequence
  Synthetic
atctctatcgtccatataaaatggattacttaatggattggcaaaccgtaacataccgttagataactctgctcc

SEQ ID NO: 46688 - DNA, 75 bp, Artificial Sequence
  Synthetic
atttagtaccgattctagatacaagatcattctacgtcctatggatgtgcaactcttagccgaagcgtatgagta

SEQ ID NO: 46689 - DNA, 75 bp, Artificial Sequence
  Synthetic
tcttgtacgtatactgcatggaatcatagatggccttttcagttgaactggtagcctgttttaacatctttttat

SEQ ID NO: 46690 - DNA, 75 bp, Artificial Sequence
  Synthetic
accactttccaacttatcattatcccaggctatgtttcgtccatcatcattgcgcagagtgaataattcttctgt

SEQ ID NO: 46691 - DNA, 75 bp, Artificial Sequence
  Synthetic
ataatatcaaaacgatggatataaagaatttgctgactgtatgtactattttgtacatcagtacattggttacag

SEQ ID NO: 46692 - DNA, 75 bp, Artificial Sequence
  Synthetic
atagatggccttttcagttgaactggtagcctgttttaacatctttttatatctggctctctctgccaaaaatgt

SEQ ID NO: 46693 - DNA, 75 bp, Artificial Sequence
  Synthetic
tgatgaatctttttacactattaagtttttattgctactaaccgtagtaattttattaatgccgtataaaaaaat

SEQ ID NO: 46694 - DNA, 75 bp, Artificial Sequence
  Synthetic
ccgactaatgtttccggagatagatttccaaaaatacacacattaggatacagactgttataatcaaagattaat

SEQ ID NO: 46695 - DNA, 75 bp, Artificial Sequence
  Synthetic
atcaaattgtgaatcatccattccactgaatagcaaaatctttactattttggtatcttctaatgtggctgcctg

SEQ ID NO: 46696 - DNA, 75 bp, Artificial Sequence
  Synthetic
atttctcaacgcgatatctccattaataatgatgtcgaattcgtgctgtatacccatactgaatggatgaacgaa

SEQ ID NO: 46697 - DNA, 75 bp, Artificial Sequence
  Synthetic
ataaaatttatatccgggcaataactttgtagctctcccagatttcttttccctcgttcatctagcaaaactatt

SEQ ID NO: 46698 - DNA, 75 bp, Artificial Sequence
  Synthetic
tataatgaatctgaactttaattgcttgtacccatttgaaataatttttagtctgcatccgtagttatccccttt

SEQ ID NO: 46699 - DNA, 75 bp, Artificial Sequence
  Synthetic
aatacgttcattaaacacaaactttttatcctttagatgaattattattggttcatttgaatcaaaaagtaatat

SEQ ID NO: 46700 - DNA, 75 bp, Artificial Sequence
  Synthetic
ccaacaatagctttaacagtggacccttgatgactgtactcgctctatattcgaataccatggattgaggaagca

SEQ ID NO: 46701 - DNA, 75 bp, Artificial Sequence
  Synthetic
atctttatttttcgtgtatttttgacgtaaatgtgtgcgaaagtatggagataactttttcaatatcgtagaatt

SEQ ID NO: 46702 - DNA, 75 bp, Artificial Sequence
  Synthetic
gaatattgatttactaaaatatctatgtttaacttttgttctatgacgtccttatcggcggtatcggtacatata

SEQ ID NO: 46703 - DNA, 75 bp, Artificial Sequence
  Synthetic
cacaaatactgacacaagcaagcatcatgaatacagtatctagccatatctaaagctatgtttagattataatcc

SEQ ID NO: 46704 - DNA, 75 bp, Artificial Sequence
  Synthetic
catgaatacagtatctagccatatctaaagctatgtttagattataatccttatacatctgtgctagatcaacgt

SEQ ID NO: 46705 - DNA, 75 bp, Artificial Sequence
  Synthetic
tttaacaagttgaccaattcatttctaatagtatcaaactctccatgattaaatattttaatagtatccatttta

SEQ ID NO: 46706 - DNA, 75 bp, Artificial Sequence
  Synthetic
ggtaacattataaatttttttaaatcccaattcagaaatcaatctatctgcgacgaattctatatatgttttcat

SEQ ID NO: 46707 - DNA, 75 bp, Artificial Sequence
  Synthetic
gttttatgtttattagcgtacacattttggaagttccggcttccatgtatttcctggagagcaagtagaagatga

SEQ ID NO: 46708 - DNA, 75 bp, Artificial Sequence
  Synthetic
tcttcaaacactctaggtataatataattaattatatggtttattatcacaattcaactggtaattgtgaattag

SEQ ID NO: 46709 - DNA, 75 bp, Artificial Sequence
  Synthetic
ttgtacgaatccaatttttcagatttttgaatgaatgaatacagatcgaaaaatatagttccattattgttatta

SEQ ID NO: 46710 - DNA, 75 bp, Artificial Sequence
  Synthetic
tccagagaatataaccactacatcatcgataacattctaaagagatttagacaacaggatgaatccatcgtacaa

SEQ ID NO: 46711 - DNA, 75 bp, Artificial Sequence
  Synthetic
cgaatgacatcgcatttatttctttagctaattcatatatgtcaccatcgtaatatctaacagcatctatcttaa

SEQ ID NO: 46712 - DNA, 75 bp, Artificial Sequence
  Synthetic
tttgaatgaatgaatacagatcgaaaaatatagttccattattgttattaacgtgaaacgtagtattggccatgc

SEQ ID NO: 46713 - DNA, 75 bp, Artificial Sequence
  Synthetic
acagcttcctttttgtctggagatctaaagataatcttctctccggttaataattctagacgattagtaatatat

SEQ ID NO: 46714 - DNA, 75 bp, Artificial Sequence
  Synthetic
ataggtgccaccaataaactatttctaagaccgtatgatctgattttatcttttagagattcccaattccaaaga

SEQ ID NO: 46715 - DNA, 75 bp, Artificial Sequence
  Synthetic
aggtaacgatatagtcgaacgttagttccaacaattgtttagctatttgtagcaaaactatttcagaacacagaa

SEQ ID NO: 46716 - DNA, 75 bp, Artificial Sequence
  Synthetic
gtaaacgtcgtaaggtttatcgtggaaaataatggacacatggctattaatcacgtatctaacaatggccgtcta

SEQ ID NO: 46717 - DNA, 75 bp, Artificial Sequence
  Synthetic
tatacatttccgaatgaatgttttcaatggccatctgaaatccgtagaaacatctagcctcggtaatctgcactt

SEQ ID NO: 46718 - DNA, 75 bp, Artificial Sequence
  Synthetic
cctctatcgacggcttcttgtatttcctgttccgttaacatctcttcattaatgagcgtaaacaataatcgttta

SEQ ID NO: 46719 - DNA, 75 bp, Artificial Sequence
  Synthetic
cctgttccgttaacatctcttcattaatgagcgtaaacaataatcgtttaccacttaaatcgatataacagtaac

SEQ ID NO: 46720 - DNA, 75 bp, Artificial Sequence
  Synthetic
aatgtgaatgtctaggacgcgtaattttcttatgatatagatcctgtaagcgttgtatgtattctggagctattt

SEQ ID NO: 46721 - DNA, 75 bp, Artificial Sequence
  Synthetic
tttattccaatcattgatatctttagatatatctacttcttccactgtccaaaatgatgcctctgcctttttata

SEQ ID NO: 46722 - DNA, 75 bp, Artificial Sequence
  Synthetic
tgacactctatatctagaaataagtacgatcttgggatatcgaatctaggtatttctttagcgaaacagttacgt

SEQ ID NO: 46723 - DNA, 75 bp, Artificial Sequence
  Synthetic
tagttactacgatcacatactgaatctgcatccaattttagaaattggtctgtgttacatatctcttctatatta

SEQ ID NO: 46724 - DNA, 75 bp, Artificial Sequence
  Synthetic
tgttaatctttgtcaaatattgctcgtccaacgagtaacatccgtctggagatatcccgttagaaatataaaacc

SEQ ID NO: 46725 - DNA, 75 bp, Artificial Sequence
  Synthetic
aactaaattaacaatagtagtaaattttttttcagttatcatctatatgactgtatttggatcttttatacattg

SEQ ID NO: 46726 - DNA, 75 bp, Artificial Sequence
  Synthetic
atgttataagtttttaatcctggaatagaatctatcttaatgaggcttttaaacgcagagttctccaacgagtca

SEQ ID NO: 46727 - DNA, 75 bp, Artificial Sequence
  Synthetic
gcggtatctcacccctatagttttattgctttaattgctttaattacttacactaaaacatggacaccgatacag

SEQ ID NO: 46728 - DNA, 75 bp, Artificial Sequence
  Synthetic
tttggctcttctatcaaccacatatctgcgacggagcattttctatctttaatatctagattataacttattgtc

SEQ ID NO: 46729 - DNA, 75 bp, Artificial Sequence
  Synthetic
atattattagaaaagatattttctcgttttagtttatcaagatctaacctgttcatatccatgataacgacacgt

SEQ ID NO: 46730 - DNA, 75 bp, Artificial Sequence
  Synthetic
tcaaaggttatagcgtacaatacatgtacaaattcttggatatatgatataccagagctaaaatatcctcgttct

SEQ ID NO: 46731 - DNA, 75 bp, Artificial Sequence
  Synthetic
tttaacgcctcccattctgattcacaaatgttacgcgcgttcaacattttatggaaactataattttgtgaaaac

SEQ ID NO: 46732 - DNA, 75 bp, Artificial Sequence
  Synthetic
gactttcgaaccaattaatacaccgaacatccatttctagaatttagaaatatattttcatttaaatgaatccca

SEQ ID NO: 46733 - DNA, 75 bp, Artificial Sequence
  Synthetic
acttgatttcaaaattacccatggagatacaacgcgaaatactttattactccattaaataatttatcatggagt

SEQ ID NO: 46734 - DNA, 75 bp, Artificial Sequence
  Synthetic
tttacttttgttatagtggatatcaaatccaatggagctacagttcttggcttaaacagatatagtttttctgga

SEQ ID NO: 46735 - DNA, 75 bp, Artificial Sequence
  Synthetic
gttgttgtcgtggttttggtgtaggagcagtactactaggtagaagaataggagccggtgtaggtgtaggaaccg

SEQ ID NO: 46736 - DNA, 75 bp, Artificial Sequence
  Synthetic
ggaaatggaatgtatttccatctatctagtgttcctaatatcatatatggtggtgtagtagaaccattaagtgtg

SEQ ID NO: 46737 - DNA, 75 bp, Artificial Sequence
  Synthetic
caattcattagtattaatgaacataatcagctttttaatcaagtcatgattgtcgtaagaagttagatttatatc

SEQ ID NO: 46738 - DNA, 75 bp, Artificial Sequence
  Synthetic
tcgtccatcatcattgcgcagagtgaataattcttctgtattcggtagttcaaatatatgatccatacatagatc

SEQ ID NO: 46739 - DNA, 75 bp, Artificial Sequence
  Synthetic
taacttcgcaataagattttgttagataacgcacactaccattcaaatcaatgatattagcctttacagatatat

SEQ ID NO: 46740 - DNA, 75 bp, Artificial Sequence
  Synthetic
ttgatctcccagaattatattcacgtactcctccattatgtaaaatttaatcgtagaagcgaataatcataaaat

SEQ ID NO: 46741 - DNA, 75 bp, Artificial Sequence
  Synthetic
tcattacagaactcaacaataaatttagtgagaataatccgtttaggagagcacatagcgatgattatctaaata

SEQ ID NO: 46742 - DNA, 75 bp, Artificial Sequence
  Synthetic
gatagctatctaattaatggttctggtagcgcacatatttggaggtataccgttaatatcgattttttttcctat

SEQ ID NO: 46743 - DNA, 75 bp, Artificial Sequence
  Synthetic
acacggcatagtttctgtaactatgaattctacccccgttacattcgtataatctttaacaaacagcaagggctc

SEQ ID NO: 46744 - DNA, 75 bp, Artificial Sequence
  Synthetic
gacgatatatatccagaagttttatcctctgtggctagcgctataaccttatcattataataccaaagagtgtga

SEQ ID NO: 46745 - DNA, 75 bp, Artificial Sequence
  Synthetic
acttaaaataaaaaatatccttatcctttaccaccaaataaaattctgattggtcgatgtgaatgtattcactta

SEQ ID NO: 46746 - DNA, 75 bp, Artificial Sequence
  Synthetic
ctttaccaccaaataaaattctgattggtcgatgtgaatgtattcacttaacagttccacaaatttatttattaa

SEQ ID NO: 46747 - DNA, 75 bp, Artificial Sequence
  Synthetic
gtcgtattcgatacatccgcatacacccaacagatataaaatgataaatactctaacaacgttcgtacccatatt

SEQ ID NO: 46748 - DNA, 75 bp, Artificial Sequence
  Synthetic
gcggacagtaacaatgttatcatagagctacctgtaggtgattacggcacagccaaattgtattcggcaacaaaa

SEQ ID NO: 46749 - DNA, 75 bp, Artificial Sequence
  Synthetic
cccaacagatataaaatgataaatactctaacaacgttcgtacccatattgatgcggcttaataaatgttttgat

SEQ ID NO: 46750 - DNA, 75 bp, Artificial Sequence
  Synthetic
cagcatccgtttctaaaaaaatattaacgagttccatttatatcatccaatattattgaaatgacgttgatggac

SEQ ID NO: 46751 - DNA, 75 bp, Artificial Sequence
  Synthetic
caaatccgtggttagcatgcacctcatcaaccggtaatagactatcggactcttctatcattataactcgagaat

SEQ ID NO: 46752 - DNA, 75 bp, Artificial Sequence
  Synthetic
ttgcgtcgacgatgatggactcacttctcttcattactactgtagacacatatcatttttccacgaaagcaatta

SEQ ID NO: 46753 - DNA, 75 bp, Artificial Sequence
  Synthetic
gagttaccaatcaacgaatatccactattgcaactataagttacaacgcttccatcggtataaaaatcctcgtat

SEQ ID NO: 46754 - DNA, 75 bp, Artificial Sequence
  Synthetic
tataatagatagtagctataatatattctatgatggtattgaagaagatgacaatcttggcatattgatcattta

SEQ ID NO: 46755 - DNA, 75 bp, Artificial Sequence
  Synthetic
tttcttcatttatcatatataatggtccaaattctacacgtgcttcgaattcatccagatcattaaggttcttat

SEQ ID NO: 46756 - DNA, 75 bp, Artificial Sequence
  Synthetic
tcatccagatcattaaggttcttataatcgtaatatccttctcctcccgcttctacatcttccttcttattctta

SEQ ID NO: 46757 - DNA, 75 bp, Artificial Sequence
  Synthetic
ggaataagcgtcttctcgatggagtgtccgtataccaacatgtctgatattttgatgtattccattaaattattt

SEQ ID NO: 46758 - DNA, 75 bp, Artificial Sequence
  Synthetic
aatgtttttaatagcctcacacacaatctctgcgtcagaacgttcgtcaatatagatcttagacatttttagaga

SEQ ID NO: 46759 - DNA, 75 bp, Artificial Sequence
  Synthetic
tcttattcttattcttattcttgtcacagaatctaccacaacaggatcccatgacgagcgtcatattaaactaat

SEQ ID NO: 46760 - DNA, 75 bp, Artificial Sequence
  Synthetic
gtccgtataccaacatgtctgatattttgatgtattccattaaattatttagttttttctttttattctcgttaa

SEQ ID NO: 46761 - DNA, 75 bp, Artificial Sequence
  Synthetic
cacttctgtagaatataacaaatcctatgtgttagtaaacgatacttatatgagctatgactatcttgaatcatc

SEQ ID NO: 46762 - DNA, 75 bp, Artificial Sequence
  Synthetic
tagtaatgaccattaaataaaaatattcttcataaccggtaagaaagtgaaaagttcacattgaaactatgtcag

SEQ ID NO: 46763 - DNA, 75 bp, Artificial Sequence
  Synthetic
taatccatcgtctgtgtgtagatcacatcgtacactttttaattctctatagaagagcgacagacatctggaaca

SEQ ID NO: 46764 - DNA, 75 bp, Artificial Sequence
  Synthetic
ctataagttacaacgcttccatcggtataaaaatcctcgtatccgttatgccttccattggttacagatggaggg

SEQ ID NO: 46765 - DNA, 75 bp, Artificial Sequence
  Synthetic
attacagacagcaatttctttattctctacagatgtaagatacttgaagacattcctatgatgatgcagaatttt

SEQ ID NO: 46766 - DNA, 75 bp, Artificial Sequence
  Synthetic
ctgcctatgattaaatcgttgttctataggatggcagagttctctccctacaacgattactacgtaaagaagata

SEQ ID NO: 46767 - DNA, 75 bp, Artificial Sequence
  Synthetic
atctttgttttgatatctatatcagacagcatggtgcgtctgacaacacagggattaagacggaaagatgaaatg

SEQ ID NO: 46768 - DNA, 75 bp, Artificial Sequence
  Synthetic
ctcttctctttttatgaaactctgttgtatatctactgataaaactgggagcaaagaatctgatagaaagaataa

SEQ ID NO: 46769 - DNA, 75 bp, Artificial Sequence
  Synthetic
attctgtttaaacgaggactataaaagtgtatttatgaaaaatatatcattcgatgaaatagattccatcatcga

SEQ ID NO: 46770 - DNA, 75 bp, Artificial Sequence
  Synthetic
attttgacttacataaatgtctgggatagtaaaatctatcatattgagcggaccatctggttcaggaaagacagc

SEQ ID NO: 46771 - DNA, 75 bp, Artificial Sequence
  Synthetic
attagaatattagaatattatatagttaagatttttactaattagttaaccattttttttaaaaaatagaaaaaa

SEQ ID NO: 46772 - DNA, 75 bp, Artificial Sequence
  Synthetic
tgcatggtgatttgtcttctttcttttatcatgatgtaatctctaaattcatcggcaaattgtctatatctaaaa

SEQ ID NO: 46773 - DNA, 75 bp, Artificial Sequence
  Synthetic
agaagacatccggtatcacacctatctcgaagccatacattcagacaaacacatttcatttcccatgtacgacga

SEQ ID NO: 46774 - DNA, 75 bp, Artificial Sequence
  Synthetic
tctcatagaacagtgccatctatcgatgaagtataaaagtaaactcgtcgacaaagcactcaataaattagagtc

SEQ ID NO: 46775 - DNA, 75 bp, Artificial Sequence
  Synthetic
agtatctacatcagttttgtattccaaattaaacatggcaacggatttaattttatattcctctattaagtcctc

SEQ ID NO: 46776 - DNA, 75 bp, Artificial Sequence
  Synthetic
gaagatgctcgttgacaaaatctttaattgtcttgatgaaggtgggactatatctaacatcttgattaataaaat

SEQ ID NO: 46777 - DNA, 75 bp, Artificial Sequence
  Synthetic
aattgtcttgatgaaggtgggactatatctaacatcttgattaataaaatttataacattgtccataggatactt

SEQ ID NO: 46778 - DNA, 75 bp, Artificial Sequence
  Synthetic
atttaaaaaatatctataatgattggagagcaggaacaaggtgataattactactacattattaaatcatgaagt

SEQ ID NO: 46779 - DNA, 75 bp, Artificial Sequence
  Synthetic
ttattacttttcaccatatagatcagtcattagatcatcaaaatacttttcaatcatcttaaagagtatggtgaa

SEQ ID NO: 46780 - DNA, 75 bp, Artificial Sequence
  Synthetic
ctactacattattaaatcatgaagtcatatatattgctattgccattgctgctttcatgtataatcataataaac

SEQ ID NO: 46781 - DNA, 75 bp, Artificial Sequence
  Synthetic
ataaatagttattagtgataagataagatagtaaaaataattattagaataagagtgtagtatcatagataagta

SEQ ID NO: 46782 - DNA, 75 bp, Artificial Sequence
  Synthetic
acgctaacggtatactagtaggtaactcaaagacatcatatatagaatggtagcgcgtctttaactcgtctgtta

SEQ ID NO: 46783 - DNA, 75 bp, Artificial Sequence
  Synthetic
tcatcaaccgttagatctattttaaagttaatcatataggcattgatttttaaaaggtatgtagccttgattaca

SEQ ID NO: 46784 - DNA, 75 bp, Artificial Sequence
  Synthetic
agttaatcatataggcattgatttttaaaaggtatgtagccttgattacattctcattaattaaccattccaagt

SEQ ID NO: 46785 - DNA, 75 bp, Artificial Sequence
  Synthetic
tttagttaacaactattttttatgttaaatcaattagtacaccgctatgtttaatacttattcatattttagttt

SEQ ID NO: 46786 - DNA, 75 bp, Artificial Sequence
  Synthetic
taccaactagaagtctgatcttaactcctctattaatggctgcttctataatggagttgtaaatgtcgggccaat

SEQ ID NO: 46787 - DNA, 75 bp, Artificial Sequence
  Synthetic
aaaggatcatccggatgcaaggcatgtgtttcccaaacaaaatgtggaataggatacggagtatccggacacacg

SEQ ID NO: 46788 - DNA, 75 bp, Artificial Sequence
  Synthetic
ttattatttcaggaggaaagaacctaacattgagaatatcggaattaatagcttccagatacagtgattttggca

SEQ ID NO: 46789 - DNA, 75 bp, Artificial Sequence
  Synthetic
accttttcaatgtttaatttttttgaaataagctttgataaagccttcctcgcaaattccggatacatgaacatg

SEQ ID NO: 46790 - DNA, 75 bp, Artificial Sequence
  Synthetic
actatatcgatgtggaaattaatctgtatcccgtcaacgacacatcgtgtactcggacgaccactaccggtctca

SEQ ID NO: 46791 - DNA, 75 bp, Artificial Sequence
  Synthetic
ttttctgtattttattatttttcaccatatagatcaatcattagatcatcaaaatatgtttcaatcatcctaaag

SEQ ID NO: 46792 - DNA, 75 bp, Artificial Sequence
  Synthetic
caagttctcaataccccaatagatgatagaatatcacccaatgcgtccatgttgtctatttccaacaggtcgcta

SEQ ID NO: 46793 - DNA, 75 bp, Artificial Sequence
  Synthetic
atagaatatcacccaatgcgtccatgttgtctatttccaacaggtcgctatatccaccaatagaagttttcccaa

SEQ ID NO: 46794 - DNA, 75 bp, Artificial Sequence
  Synthetic
aatcagaatatacacctaacgttttaatcgtatgtatagatcctccagtaaatgacgcgtttcctacataacatc

SEQ ID NO: 46795 - DNA, 75 bp, Artificial Sequence
  Synthetic
ttatcctatcatgtatttgagagtcttatatgtagcaaacatgataactgcaatacccataagctttagatattc

SEQ ID NO: 46796 - DNA, 75 bp, Artificial Sequence
  Synthetic
cgcaattcattttcgggtttaaattctttaatatcgacaatttcatacgctcctcttttgaaactaaacttattt

SEQ ID NO: 46797 - DNA, 75 bp, Artificial Sequence
  Synthetic
atataacgtaaccagaattgtaaaattagaggtacgggatagaataatacctcctactatgcaattaccagaagg

SEQ ID NO: 46798 - DNA, 75 bp, Artificial Sequence
  Synthetic
ttaaaatagtataaaatagataagtatttactctcttctataaaaatggattttattcgtagaaagtatcttata

SEQ ID NO: 46799 - DNA, 75 bp, Artificial Sequence
  Synthetic
gcatatagtatgcgatagtagagtaaacatttttatcgtttctactgggttcatacatcgtctacccaattcggt

SEQ ID NO: 46800 - DNA, 75 bp, Artificial Sequence
  Synthetic
ctttaatatcgacaatttcatacgctcctcttttgaaactaaacttatttagaatatccagtgcgtttctacaaa

SEQ ID NO: 46801 - DNA, 75 bp, Artificial Sequence
  Synthetic
tgttgtacaaattcctcggccattttaatatttaagtgatataaaactatctcgacttatttaactctttagtcg

SEQ ID NO: 46802 - DNA, 75 bp, Artificial Sequence
  Synthetic
cgtcttttggataagtaatggtatgtattacgaagaagacgatgaggacggagacggtagaataagtgtagcaaa

SEQ ID NO: 46803 - DNA, 75 bp, Artificial Sequence
  Synthetic
ctcgacttatttaactctttagtcgagatatatggacgcagatagctatatgatagccaactacagaaggcgaac

SEQ ID NO: 46804 - DNA, 75 bp, Artificial Sequence
  Synthetic
aataaatacaataattaatttttcgtaaaagtagaaaatatattctaatttattgtatggtaaggaaatagaatc

SEQ ID NO: 46805 - DNA, 75 bp, Artificial Sequence
  Synthetic
tattgtatggtaaggaaatagaatcatctagaacagcaatcatgaaacaaatcgtcctggcatgcatatgcctgg

SEQ ID NO: 46806 - DNA, 75 bp, Artificial Sequence
  Synthetic
attacttgatatagtaatattaggcacagtcaaacattcaaccactctcgatacattaactctctcattttcttt

SEQ ID NO: 46807 - DNA, 75 bp, Artificial Sequence
  Synthetic
tctaaacatggattttattcgtagaaagtatcttatatacacagtagaaaataatatagattttttaaaggatga

SEQ ID NO: 46808 - DNA, 75 bp, Artificial Sequence
  Synthetic
atacattaactctctcattttctttaacaaattctgcaatatcttcgtaaaaagattcttgaaactttttagaat

SEQ ID NO: 46809 - DNA, 75 bp, Artificial Sequence
  Synthetic
cagatctaaaatccatattttctggtagtgtttctaccagtctacattttgctcccgcaggtgccgatgtaaatg

SEQ ID NO: 46810 - DNA, 75 bp, Artificial Sequence
  Synthetic
aaaatcttcatcaaagtcgacatcacaacctagctcagtcaatatattaagaagttccgtgatatcatcttcatc

SEQ ID NO: 46811 - DNA, 75 bp, Artificial Sequence
  Synthetic
atattttctggaagcggatatacatagtcgtgatcatcattatcactagcctcatcctctatatgatgtactata

SEQ ID NO: 46812 - DNA, 75 bp, Artificial Sequence
  Synthetic
tacataaaggcgcccattttaacagtttctagtgacaaaatgttagcgatcctaggatcctttagaatcacatag

SEQ ID NO: 46813 - DNA, 75 bp, Artificial Sequence
  Synthetic
tttctagtgacaaaatgttagcgatcctaggatcctttagaatcacatagattgacgattcgtctctcttagtaa

SEQ ID NO: 46814 - DNA, 75 bp, Artificial Sequence
  Synthetic
ttattgagttaaaatcagtactaattcccaacccttcagaatatactctgtgtttcatggtaatatcagtagcgt

SEQ ID NO: 46815 - DNA, 75 bp, Artificial Sequence
  Synthetic
tcccaacccttcagaatatactctgtgtttcatggtaatatcagtagcgtatttaagttggtagattttcaatta

SEQ ID NO: 46816 - DNA, 75 bp, Artificial Sequence
  Synthetic
agattcaaaaggggtgcagtgcttccgattccaaatctggtaaaagttaaagttggggaggaaaatgatacagta

SEQ ID NO: 46817 - DNA, 75 bp, Artificial Sequence
  Synthetic
acttgaggagatctaaacaacctagttttgagaacatcgataagttcatcgggaatgacatacatactatcttta

SEQ ID NO: 46818 - DNA, 75 bp, Artificial Sequence
  Synthetic
ttttgagaacatcgataagttcatcgggaatgacatacatactatctttaatagaactcttttcatccagttgaa

SEQ ID NO: 46819 - DNA, 75 bp, Artificial Sequence
  Synthetic
gatattattatacataaacatcgacaacatactattgtcaattatctaagtcctgttgatccaaacccttgagct

SEQ ID NO: 46820 - DNA, 75 bp, Artificial Sequence
  Synthetic
tcttcattattttcttctacatacataagcatgtccaatacgttagacaacacaccgacgatggcggccgccaca

SEQ ID NO: 46821 - DNA, 75 bp, Artificial Sequence
  Synthetic
tccagatgatatgtatgtccattaaagttaaattgtgtagcgcttctttttagtctagcagccaatactttaaca

SEQ ID NO: 46822 - DNA, 75 bp, Artificial Sequence
  Synthetic
agttaaattgtgtagcgcttctttttagtctagcagccaatactttaacatcactaatatcgatatacaaaggag

SEQ ID NO: 46823 - DNA, 75 bp, Artificial Sequence
  Synthetic
aattcctttttgcctgtatcatccagtttgccatcctttgtaaagaaattattttctactagactattaataaga

SEQ ID NO: 46824 - DNA, 75 bp, Artificial Sequence
  Synthetic
gtttgccatcctttgtaaagaaattattttctactagactattaataagactgataaggattcctccataattgc

SEQ ID NO: 46825 - DNA, 75 bp, Artificial Sequence
  Synthetic
tgttattttaggatcatatttacatatttacggtatatcaaagatgttagatatagttaatgggaatcgtctata

SEQ ID NO: 46826 - DNA, 75 bp, Artificial Sequence
  Synthetic
cacccggcgattgcctagtaggagatttagctctgttagtttccttaacaaatctaactggtgagttaatattca

SEQ ID NO: 46827 - DNA, 75 bp, Artificial Sequence
  Synthetic
aaaacttttagcgtgtgtctgaatcgataactctattcatctgaaatttggatgagtagagttaatcgaccgatt

SEQ ID NO: 46828 - DNA, 75 bp, Artificial Sequence
  Synthetic
cgtacttcaggtttcttagcttgtgattttttcttttgcggacattttcttgtgaccaactcatctaccatttca

SEQ ID NO: 46829 - DNA, 75 bp, Artificial Sequence
  Synthetic
attttttcttttgcggacattttcttgtgaccaactcatctaccatttcattgattttagcagtgaaataagctt

SEQ ID NO: 46830 - DNA, 75 bp, Artificial Sequence
  Synthetic
caatatagtagttaaattatccgcacatgcagaagaacaccgcttaggcggattcagtacaatgttatatttttc

SEQ ID NO: 46831 - DNA, 75 bp, Artificial Sequence
  Synthetic
ccatcccatatattccatgaataagtgcgattattgtacacttctatagtatctatatatgatccacgataaaat

SEQ ID NO: 46832 - DNA, 75 bp, Artificial Sequence
  Synthetic
gcaaaacaaaaatgttcttaactacattcacaaaaagttacctctcgcgacttcttctttttctgtctcaatagt

SEQ ID NO: 46833 - DNA, 75 bp, Artificial Sequence
  Synthetic
gccatttaagttcaccaaacaacttttaaatacaaatatatcaatagtagtagaataagaactataaaaaaaata

SEQ ID NO: 46834 - DNA, 75 bp, Artificial Sequence
  Synthetic
ataattaaccaataccaaccccaacaaccggtattattagttgatgtgacagatttctcatcacttagaacagat

SEQ ID NO: 46835 - DNA, 75 bp, Artificial Sequence
  Synthetic
catgtagaatgtgataatttccagaaggttcgatagcttgtagcatattcctaaatacatctaaatttttactat

SEQ ID NO: 46836 - DNA, 75 bp, Artificial Sequence
  Synthetic
tacaccaaatatagcggcgtacaacttatccatttatacattgaatattggcttttctttatcgctatcttcatc

SEQ ID NO: 46837 - DNA, 75 bp, Artificial Sequence
  Synthetic
gtttatggatgccactgctggattacatctaggtttcagaagactcggcatattaacccaagcagcatccccgtg

SEQ ID NO: 46838 - DNA, 75 bp, Artificial Sequence
  Synthetic
ttatccatttatacattgaatattggcttttctttatcgctatcttcatcatattcatcatcaatatcaacaagt

SEQ ID NO: 46839 - DNA, 75 bp, Artificial Sequence
  Synthetic
attatttagttcgtccttgttcatcattaggaatctattcaatatggcaattatactagaactataactgtgttg

SEQ ID NO: 46840 - DNA, 75 bp, Artificial Sequence
  Synthetic
taaaaaagttttacaaaaaatatttttattctctttctctcttcaatggtctcataaaaaaagttttacaaaaaa

SEQ ID NO: 46841 - DNA, 75 bp, Artificial Sequence
  Synthetic
ttcactatctccagagagtccgataacgttagccaccacttctctatcaatgattagtttcttgagcgcgaatgt

SEQ ID NO: 46842 - DNA, 75 bp, Artificial Sequence
  Synthetic
tgctactaccttcgggtaaaaatgtagcatcatatacctctagtacgttaggttcatcgttacccattgcagagg

SEQ ID NO: 46843 - DNA, 75 bp, Artificial Sequence
  Synthetic
ctttctgatggagtcactaaaatatttttattctctttctctcttcgatggtctcataaaaaagtttacaaaaac

SEQ ID NO: 46844 - DNA, 75 bp, Artificial Sequence
  Synthetic
aacctctttactgataggactacaataaaagttttttatcttacgttctctctacgtaatgtactcaattaaaat

SEQ ID NO: 46845 - DNA, 75 bp, Artificial Sequence
  Synthetic
tatctttatacgagctactaatgtataattctttataactaaactgagatatatacactggatctatggtttcca

SEQ ID NO: 46846 - DNA, 75 bp, Artificial Sequence
  Synthetic
tgtgtaacccatgactgtaggaaactctagagtgtaagaaagatcgatcgctttatagagaccatcagaaagagg

SEQ ID NO: 46847 - DNA, 75 bp, Artificial Sequence
  Synthetic
caaagaatttggaatgcgttccttgtgcttaatgtttccatagacagcttctagaagttgatacaacataggact

SEQ ID NO: 46848 - DNA, 75 bp, Artificial Sequence
  Synthetic
taattgagtaaatgaatgctctgcaataactaatggcaaatgtatagaacaacgaaattatactagagttgttaa

SEQ ID NO: 46849 - DNA, 75 bp, Artificial Sequence
  Synthetic
agccgcggtaacttttatttttagaaagtatccatcgcttctatcttgtttagatttatttttataaagtttagt

SEQ ID NO: 46850 - DNA, 75 bp, Artificial Sequence
  Synthetic
cagtaagttttatagagatagacgaacaattagcgtattgagaagcatttagtgtaacatattcgatacattttg

SEQ ID NO: 46851 - DNA, 75 bp, Artificial Sequence
  Synthetic
agagaaagagataaaactttttttacgactccatcagaaagaggtttaatatttttgtgagaccatcgaagagag

SEQ ID NO: 46852 - DNA, 75 bp, Artificial Sequence
  Synthetic
taatatttttgtgagaccatcgaagagagaaagagataaaactttttttacgactccatcagaaagaggtttaat

SEQ ID NO: 46853 - DNA, 75 bp, Artificial Sequence
  Synthetic
tactcaaaatatgtaacaatagtacgatgcaatgagtaagacaataggaaatctatcttatatacacataattat

SEQ ID NO: 46854 - DNA, 75 bp, Artificial Sequence
  Synthetic
atctatcttatatacacataattattctatcaattttaccaattagttagtgtaatgttaacaaaaatgtgggag

SEQ ID NO: 46855 - DNA, 75 bp, Artificial Sequence
  Synthetic
cttgattaccttactcatgattaaacctaaataattgtactttgtaatataatgatatatattttcactttatct

SEQ ID NO: 46856 - DNA, 75 bp, Artificial Sequence
  Synthetic
gtataaaaacttgtgtgaaattttgtaccaaagaaaaaacgtgagcagtatcccctacatggattttactagatc

SEQ ID NO: 46857 - DNA, 75 bp, Artificial Sequence
  Synthetic
tttaaaatagaattaataaaaaacatataggtcattttttaaacatggattggaaaccaaggttgttagttaata

SEQ ID NO: 46858 - DNA, 75 bp, Artificial Sequence
  Synthetic
gtacgtagatagtacattcccgtttttagaccgagactccatccgtaaaaatgcatactcgttagtttggaataa

SEQ ID NO: 46859 - DNA, 75 bp, Artificial Sequence
  Synthetic
ctcggatctgctatatggatattcatagattgactttgatcgatgaaggctcccctgtctgcagccatttttatg

SEQ ID NO: 46860 - DNA, 75 bp, Artificial Sequence
  Synthetic
tagattgactttgatcgatgaaggctcccctgtctgcagccatttttatgatcgtcttttgtggaatttcccaaa

SEQ ID NO: 46861 - DNA, 75 bp, Artificial Sequence
  Synthetic
gatccaccatctgccataatcctattcttgatctcatcattccataattttctctcggttaaaactctaaggaga

SEQ ID NO: 46862 - DNA, 75 bp, Artificial Sequence
  Synthetic
cctgcatcttattagaatattaacctaactaaaagacataacataaaaactcattacatagttgataaaaagcgg

SEQ ID NO: 46863 - DNA, 75 bp, Artificial Sequence
  Synthetic
ttttatgagaccatcaaagagagaaagagaataaaaatatttttgtaaaactttttttatgagaccatcagaaag

SEQ ID NO: 46864 - DNA, 75 bp, Artificial Sequence
  Synthetic
aacattccaaagatcatattgtagaataccgttactggcgtacgatcctacatatgtatcgtatggtccttcctt

SEQ ID NO: 46865 - DNA, 75 bp, Artificial Sequence
  Synthetic
acctttccagtatatgagtaaataactatagaagttagactgtgaatgtcaaggtctagacaaaccctcgtaact

SEQ ID NO: 46866 - DNA, 75 bp, Artificial Sequence
  Synthetic
cactcactcactacactttttatcacacacacacacacacacacacacacacacacacacacacacacacacacc

SEQ ID NO: 46867 - DNA, 75 bp, Artificial Sequence
  Synthetic
atgtctcttattagagatttcagcttctggaataggataataattaatatctataattttattgagatttctgac

SEQ ID NO: 46868 - DNA, 75 bp, Artificial Sequence
  Synthetic
cttactttttatcatcttatgaggaatgattgccttcatcatttttcgtgaaatataatataggaataattagaa

SEQ ID NO: 46869 - DNA, 75 bp, Artificial Sequence
  Synthetic
ttacaaacatgttcaatgcaacagatgccagattacaaacggctacctcattagcatccgcatattgtattattt

SEQ ID NO: 46870 - DNA, 75 bp, Artificial Sequence
  Synthetic
gtttttattgttttacgtacctggatattctattactacaaaaattactccagccgtagaatatctaatggataa

SEQ ID NO: 46871 - DNA, 75 bp, Artificial Sequence
  Synthetic
ggttcctaaattttgttgattactctttttgttacacgcatccttataaagaatgaatggagtaccagtttcaat

SEQ ID NO: 46872 - DNA, 75 bp, Artificial Sequence
  Synthetic
taccaataccggtaatcttgtcgaggaggacatatagtgttcttgtattctgccgaatacccgagagatacgaca

SEQ ID NO: 46873 - DNA, 75 bp, Artificial Sequence
  Synthetic
aatgccacggttccaagtatatggccataactcccggtcgtttgtttcctccctgatctatgtatctagcggtgt

SEQ ID NO: 46874 - DNA, 75 bp, Artificial Sequence
  Synthetic
cataactcccggtcgtttgtttcctccctgatctatgtatctagcggtgttattataaactctcaacattggaat

SEQ ID NO: 46875 - DNA, 75 bp, Artificial Sequence
  Synthetic
aattagcaataagacaataggaaatctatctataacacataattattctatcaattttaccaattagttagtgta

SEQ ID NO: 46876 - DNA, 75 bp, Artificial Sequence
  Synthetic
gaatattactaattgatagacctattccccctgccattttagagattaatgcgcatcgttttaacgtatcataga

SEQ ID NO: 46877 - DNA, 75 bp, Artificial Sequence
  Synthetic
gttaagtagaaaacagctagacatttggtgacgactagttcccgcattaaataaggtaggagaagcgtgcgtaaa

SEQ ID NO: 46878 - DNA, 75 bp, Artificial Sequence
  Synthetic
ccatatattccatgaataagtgcgattattatacacttctatagtatctatatacgaaccacgataaaatcctcc

SEQ ID NO: 46879 - DNA, 75 bp, Artificial Sequence
  Synthetic
taactttgatagccgtagatctttgttccttcgccaacaggttaaagaaattaataaagaatttgttgtttctat

SEQ ID NO: 46880 - DNA, 75 bp, Artificial Sequence
  Synthetic
atgattctacttccttaccatacaataaattagaatatattttctacttttacgagaaattaattattgtattta

SEQ ID NO: 46881 - DNA, 75 bp, Artificial Sequence
  Synthetic
agtaggatttttccaaagttttaaaaccaaaatagttgtatgaaaagtctcgttcgtaaataataaccgagttga

SEQ ID NO: 46882 - DNA, 75 bp, Artificial Sequence
  Synthetic
gtttatccttatatttgttaactatatccatggtgatacttgaaataatcggagaatgtttcccatttttaggat

SEQ ID NO: 46883 - DNA, 75 bp, Artificial Sequence
  Synthetic
aaggctttaaaagtatcaaatcttctacgaagatctgtggccagcgggggataatcagaatatacacctaacgtt

SEQ ID NO: 46884 - DNA, 75 bp, Artificial Sequence
  Synthetic
tccttgtgtagatttgatacggctattctggcggctagaatggcataatccggatgttgtgtagtacaagtggct

SEQ ID NO: 46885 - DNA, 75 bp, Artificial Sequence
  Synthetic
ggctgctataggagagccattcagtgcaaagtgtcctcctattgaagacagtcttttatcgcatagatataaaga

SEQ ID NO: 46886 - DNA, 75 bp, Artificial Sequence
  Synthetic
cggatgttgtgtagtacaagtggctgctatttcggctgccagagtgtccaattctaccgttgttactccattata

SEQ ID NO: 46887 - DNA, 75 bp, Artificial Sequence
  Synthetic
attttaataggatctatatgatcagtgtttaagccataacataattttctaatacgagacgtgattttatcaaac

SEQ ID NO: 46888 - DNA, 75 bp, Artificial Sequence
  Synthetic
aatacgagacgtgattttatcaaacatgacattttccttgtatccatttcgtttaatgacaaacatttttgttgg

SEQ ID NO: 46889 - DNA, 75 bp, Artificial Sequence
  Synthetic
cattaggatacagactgttataatcaaagattaatacattattactaaacattttttgttttggagcaaatacct

SEQ ID NO: 46890 - DNA, 75 bp, Artificial Sequence
  Synthetic
gtgatagatacacttaatggcataatgatgaatgaacacgatgttgctgtatgtgtgggtaccggactacggttc

SEQ ID NO: 46891 - DNA, 75 bp, Artificial Sequence
  Synthetic
agcgtacaaaattatcgttcctggtatatagataaagagtcctatatatttgaaaatcgttacggctcgattaaa

SEQ ID NO: 46892 - DNA, 75 bp, Artificial Sequence
  Synthetic
tgaaaatcgttacggctcgattaaactttaatgattgcattgtgaatatatcattaggatttaactccttgacta

SEQ ID NO: 46893 - DNA, 75 bp, Artificial Sequence
  Synthetic
ctctctgccaagatagcttcagagtgaggatagtcaaaaagatcaatatatagagcataaccattctcgtatact

SEQ ID NO: 46894 - DNA, 75 bp, Artificial Sequence
  Synthetic
atcgcagttagaacagttatagcatccaccatttatatctaaaaattagatcaaagaatatgtgacaaagtccta

SEQ ID NO: 46895 - DNA, 75 bp, Artificial Sequence
  Synthetic
ataattatccttccaccgtacccataatattaataattatccttccaccgtacccataatattaataattatcct

SEQ ID NO: 46896 - DNA, 75 bp, Artificial Sequence
  Synthetic
tattcttattcttagcgtcacagaatctaccacagcaggatcccatgacgagcgtcatattaaactaattcattt

SEQ ID NO: 46897 - DNA, 75 bp, Artificial Sequence
  Synthetic
tataagtatagatacccttccagataatgttctctttgataaaagttccagaaaatgtagaattttttaaaaagt

SEQ ID NO: 46898 - DNA, 75 bp, Artificial Sequence
  Synthetic
atgaccattaaaataaaaatattcttcataaccggtaagaaagtgaaaagttcacattgaaactatgtcagtagt

SEQ ID NO: 46899 - DNA, 75 bp, Artificial Sequence
  Synthetic
aatgtttttaatagcctcacacacaatctctgcgtcagaacgttcgtcgatatagattttagacatttttagaga

SEQ ID NO: 46900 - DNA, 75 bp, Artificial Sequence
  Synthetic
tagtatggataatgtttgtaatggttctttccatacaacatactttttagatgatagtcgcttaacttggatatg

SEQ ID NO: 46901 - DNA, 75 bp, Artificial Sequence
  Synthetic
cattactaaaaaaatatattgttctgtttttgttttctttttctttttctttcgttcatctccaattatgaaaaa

SEQ ID NO: 46902 - DNA, 75 bp, Artificial Sequence
  Synthetic
ataagtgttttctcgatggagtgtccgtataccaacatgtctgatattttgatgtattccattaaattatttagt

SEQ ID NO: 46903 - DNA, 75 bp, Artificial Sequence
  Synthetic
ataacatgtttatttccgacaccaacggttttaatatttcgatgatatacggtagtctctctttcggacttatat

SEQ ID NO: 46904 - DNA, 75 bp, Artificial Sequence
  Synthetic
tattgaaactgaggctgttgaaaatgaaacggtgaatacaataattcagataatgtaaaatcatgattccgtatt

SEQ ID NO: 46905 - DNA, 75 bp, Artificial Sequence
  Synthetic
cttattagatcgaggagctgatatatcattaaagacaggcgatggtaaatctgtatttgatttatcgttatgtag

SEQ ID NO: 46906 - DNA, 75 bp, Artificial Sequence
  Synthetic
gtcaaccaaccgaatggagtaaaataaatatcattaatatatgctctagatattagtatttttatcaatcctttg

SEQ ID NO: 46907 - DNA, 75 bp, Artificial Sequence
  Synthetic
aaatatcattaatatatgctctagatattagtatttttatcaatcctttgattatcatcttctcgtatgcgaatg

SEQ ID NO: 46908 - DNA, 75 bp, Artificial Sequence
  Synthetic
ttagtaaacagtccatcgttgcaataataaaagttatccaagttaaaggatattatgcattcgtttaaagatatc

SEQ ID NO: 46909 - DNA, 75 bp, Artificial Sequence
  Synthetic
tggtaggttttagagactttgaagctacttgtttaacaaagttattcatcgtcgtctactattctatttaatttt

SEQ ID NO: 46910 - DNA, 75 bp, Artificial Sequence
  Synthetic
acacaaatatttgtgtaaatttgtatatcataatattgaatatggtatccgatactataatgaaaagattataga

SEQ ID NO: 46911 - DNA, 75 bp, Artificial Sequence
  Synthetic
gtcgtctactattctatttaattttgtagttaatttatcacatatcacattaattgactttttggtccacttttc

SEQ ID NO: 46912 - DNA, 75 bp, Artificial Sequence
  Synthetic
atagaattaattttattaaccgcatctcgtctaaagtttaatctatatagaccgaatctatgatattgttgataa

SEQ ID NO: 46913 - DNA, 75 bp, Artificial Sequence
  Synthetic
gtagttaatttatcacatatcacattaattgactttttggtccacttttccatacgtttatattcttttaatcct

SEQ ID NO: 46914 - DNA, 75 bp, Artificial Sequence
  Synthetic
cctcgtgtggtgcatgcgcttgtatctcaaggagcggatactaggatacgtaacaatcttgattgcacacccatc

SEQ ID NO: 46915 - DNA, 75 bp, Artificial Sequence
  Synthetic
agccattcttcccatgaatgtttccttttttaccaaaggaaatgcatcgttgattattctcctgtttgacttctc

SEQ ID NO: 46916 - DNA, 75 bp, Artificial Sequence
  Synthetic
atactaatttgttttactctataaaatactaatgcatctatttcatcgttttgtataacgtctttccaagtgtca

SEQ ID NO: 46917 - DNA, 75 bp, Artificial Sequence
  Synthetic
attaacttccacattaatacagcctattttcgcaccaaatgtacattcgaaaaatctgaataaaacatcaatgtc

SEQ ID NO: 46918 - DNA, 75 bp, Artificial Sequence
  Synthetic
ataattaggatcttctaatggattgtatggcttgatagcatcatctttatcattattagggggatggacaacctt

SEQ ID NO: 46919 - DNA, 75 bp, Artificial Sequence
  Synthetic
attatagtgatgaaattcagttggaatattgcctccggagtcataaaaggatactaaacattgttttttatcata

SEQ ID NO: 46920 - DNA, 75 bp, Artificial Sequence
  Synthetic
atattgcctccggagtcataaaaggatactaaacattgttttttatcataaattacacatttccaatgagacaaa

SEQ ID NO: 46921 - DNA, 75 bp, Artificial Sequence
  Synthetic
cacaagatcttctccccgttcaaacttaatcttattagaatattagtggaagaaagattctataataatgaatgc

SEQ ID NO: 46922 - DNA, 75 bp, Artificial Sequence
  Synthetic
tttaagtatatacgataagatatgtttattcataaacgcgtcaaatttttcatgaatcgctaaggagtttaagaa

SEQ ID NO: 46923 - DNA, 75 bp, Artificial Sequence
  Synthetic
tctcatgtcaaattgtcctatataatccacttcggatccataagcaaactgagagactaagttcttaatacttcg

SEQ ID NO: 46924 - DNA, 75 bp, Artificial Sequence
  Synthetic
tatatagaatcaaggtagaatctgaagaagataccctcttcatcaaacagatggtagaacaatgtgtgacatccc

SEQ ID NO: 46925 - DNA, 75 bp, Artificial Sequence
  Synthetic
tcggattttcaccagtatgtattcctttacgtgataaatcatcgattttcaaatccatttgtgagaagtctatcg

SEQ ID NO: 46926 - DNA, 75 bp, Artificial Sequence
  Synthetic
aggagaaactgttttctagatggaaatattgtctacgagctattaaactgtttatcgatgatcacatgcttaata

SEQ ID NO: 46927 - DNA, 75 bp, Artificial Sequence
  Synthetic
aaatccatttgtgagaagtctatcgccttagatactttttcccgtagtcgaggtttaaagaaatacgctaacggt

SEQ ID NO: 46928 - DNA, 75 bp, Artificial Sequence
  Synthetic
catgtatgcctgttcgtaggccagtggctaagatactgtgtaaagaaatggtaaataaatactttgagaatccgc

SEQ ID NO: 46929 - DNA, 75 bp, Artificial Sequence
  Synthetic
atactagtaggtaactcaaagacatcatatatagaatggtagcgcgtctttaactcgtctgttagctctttcttt

SEQ ID NO: 46930 - DNA, 75 bp, Artificial Sequence
  Synthetic
ggtgattgcctagtaggagatttagctctgttagtttccttaacaaatctaactggtgagttaatattcatgttg

SEQ ID NO: 46931 - DNA, 75 bp, Artificial Sequence
  Synthetic
taatggatagtttaaaatagttagtagtaataagatagtttaaaatagtttaaaatagttattagtaataagata

SEQ ID NO: 46932 - DNA, 75 bp, Artificial Sequence
  Synthetic
tagatttatcatatttctccactacatatccgttacaatttgttaagaatttagatacatctatattgctacata

SEQ ID NO: 46933 - DNA, 75 bp, Artificial Sequence
  Synthetic
atatccgttacaatttgttaagaatttagatacatctatattgctacataatccagctagtgaatatatatgaca

SEQ ID NO: 46934 - DNA, 75 bp, Artificial Sequence
  Synthetic
ccagaagttctatcctccgtggctaacgctataaccttatcattatagtaccaaagagtgtgattaatgtgtgac

SEQ ID NO: 46935 - DNA, 75 bp, Artificial Sequence
  Synthetic
tatatctatccatttatcatggaaaagaatttacccgatatcttcttttttccaaactgcgttaatgtattctct

SEQ ID NO: 46936 - DNA, 75 bp, Artificial Sequence
  Synthetic
tcaatagcttaactgacacttgtctgtctatagcggatcttcttaattcatcttctatataaggccaaaacaaaa

SEQ ID NO: 46937 - DNA, 75 bp, Artificial Sequence
  Synthetic
agaatttacccgatatcttcttttttccaaactgcgttaatgtattctcttacaaatattcacaagatgacttca

SEQ ID NO: 46938 - DNA, 75 bp, Artificial Sequence
  Synthetic
acacaaaatgtgaacgctgcccacctcatacatataccacagtacccaattattctaatggatgtcatcaatgta

SEQ ID NO: 46939 - DNA, 75 bp, Artificial Sequence
  Synthetic
taggaaaacccgcacacataaacctaaccgcgaagcaatatatatacagtgaacacacaataagctttgaatgtt

SEQ ID NO: 46940 - DNA, 75 bp, Artificial Sequence
  Synthetic
agaagtgattctttgatggtgtcagcatacgaattacaataatgcagaaactcagttaacatgcaggaattatag

SEQ ID NO: 46941 - DNA, 75 bp, Artificial Sequence
  Synthetic
cctatcatgtatttgagagtcttatatgtagcaaacatgataactgcaatacccataagctttagatattcacgc

SEQ ID NO: 46942 - DNA, 75 bp, Artificial Sequence
  Synthetic
tacagaaatcaattcgttcgatgagtttatattaagaggactattggaagcgggtaatagtttacagatattttc

SEQ ID NO: 46943 - DNA, 75 bp, Artificial Sequence
  Synthetic
ttattcagtatgaagatctattaataataattatcttatttatttcttgatattaatcggtgtcctaataatata

SEQ ID NO: 46944 - DNA, 75 bp, Artificial Sequence
  Synthetic
gtacccaagttattgctttggtttaattatttatttgggggattctctactctagataaaatcactgactttcac

SEQ ID NO: 46945 - DNA, 75 bp, Artificial Sequence
  Synthetic
ccgaaattcgtacccacttcatccgataaactccaataaaaagatgatatatctagtgtttttgtggtattggat

SEQ ID NO: 46946 - DNA, 75 bp, Artificial Sequence
  Synthetic
ctaggatagctttagttagattgcatagcaatactattttaaaatcattgggatttaaggtactaaatggatctc

SEQ ID NO: 46947 - DNA, 75 bp, Artificial Sequence
  Synthetic
cccaaaaaatatggaattgtattttctacccataagttatctctaacaaaactatttagttatggcactcttatt

SEQ ID NO: 46948 - DNA, 75 bp, Artificial Sequence
  Synthetic
tcgcgattgcgtagatgaggtactattttataccttgtaattaaattttttttattaattaaacgtataaaaacg

SEQ ID NO: 46949 - DNA, 75 bp, Artificial Sequence
  Synthetic
ttagatattaataacagttatatatctaatataatttatgaggtgaacgatatcacattagatacaatggatgat

SEQ ID NO: 46950 - DNA, 75 bp, Artificial Sequence
  Synthetic
tcataataagataaatccatcttccagaatggcatacatagaagaagaaaagagaaatttagttactgctataca

SEQ ID NO: 46951 - DNA, 75 bp, Artificial Sequence
  Synthetic
gatgtatactcctcctgatggatcatccggtatagtctttgtggcatccgttgcacagtgtcatgaatataaatc

SEQ ID NO: 46952 - DNA, 75 bp, Artificial Sequence
  Synthetic
ttggattcaccaaatgtcctcagattaaatccatctcagaatccgctgatggaaacacagtgaatgctagattgt

SEQ ID NO: 46953 - DNA, 75 bp, Artificial Sequence
  Synthetic
aaaagtgtattcatcacctaatgtatcgataattatttctactccttatttggaatccagcgttactatacgcaa

SEQ ID NO: 46954 - DNA, 75 bp, Artificial Sequence
  Synthetic
tcgataattatttctactccttatttggaatccagcgttactatacgcaatgttacacacatttatgatatgggt

SEQ ID NO: 46955 - DNA, 75 bp, Artificial Sequence
  Synthetic
tcactactggtgtccacgatgataaatatctagagggaatataatatagtccataggatgccaatctagcaatgt

SEQ ID NO: 46956 - DNA, 75 bp, Artificial Sequence
  Synthetic
ctacatgaagtctatacagcgaatagattcagaatttctacataattatatattatacgctaataaatttaattt

SEQ ID NO: 46957 - DNA, 75 bp, Artificial Sequence
  Synthetic
tgcaaccgatgatacttcactcatcgattcaacaaaactcaaagcgtgtgtctgaatcgataactctattcatcc

SEQ ID NO: 46958 - DNA, 75 bp, Artificial Sequence
  Synthetic
ggcgtacaaaggaatatatagactcgttcgatattagtacagaaacatggaataaattattatccaattattata

SEQ ID NO: 46959 - DNA, 75 bp, Artificial Sequence
  Synthetic
gtgagtgagtgagtgagtgagtgagtgagtgagtgagtgagtgagtgagtgagtgtattagtgagagcatgaagg

SEQ ID NO: 46960 - DNA, 75 bp, Artificial Sequence
  Synthetic
aataaattattatccaattattatatgaagataatagagtatgcgaaactttatgtactaagtcctattctcgct

SEQ ID NO: 46961 - DNA, 75 bp, Artificial Sequence
  Synthetic
ggatactctattgatgacactagttaagaacatgtcttctattctagaaaacgaaaacatcctacatggactcat

SEQ ID NO: 46962 - DNA, 75 bp, Artificial Sequence
  Synthetic
tattcctattcctatttcctttcagggtatcacaaaaatattaaacctctttctgatggtctcataaaaaagttt

SEQ ID NO: 46963 - DNA, 75 bp, Artificial Sequence
  Synthetic
ttctcagttcaataattacacgatcgacaccaacgactggactataaatgtactatccgatggtctggatatacc

SEQ ID NO: 46964 - DNA, 75 bp, Artificial Sequence
  Synthetic
cttttgtagagtattatttggtgtctataacggaacaaacgctactatatattatcatcgccctctaactggata

SEQ ID NO: 46965 - DNA, 75 bp, Artificial Sequence
  Synthetic
aatcaaactctaatgaccacatctttttttagagatgaaaaattttccacatctccttttgtagacacgactaaa

SEQ ID NO: 46966 - DNA, 75 bp, Artificial Sequence
  Synthetic
tcttatctcgtccttggtttacatggatcatcggagtgagaaaaagtatcggaataagtatctttccggcatttc

SEQ ID NO: 46967 - DNA, 75 bp, Artificial Sequence
  Synthetic
tttttagagatgaaaaattttccacatctccttttgtagacacgactaaacattttgcagaaaaaagtttattat

SEQ ID NO: 46968 - DNA, 75 bp, Artificial Sequence
  Synthetic
taaaaggtattcttgctcaatagattggtaaattccatagaatatattaatcctttcttcttgagatcccacatc

SEQ ID NO: 46969 - DNA, 75 bp, Artificial Sequence
  Synthetic
tggtaaattccatagaatatattaatcctttcttcttgagatcccacatcatttcaaccaaagacgttttatcca

SEQ ID NO: 46970 - DNA, 75 bp, Artificial Sequence
  Synthetic
tgccaagatatctatataattattttgtaagatgatgttaactatgtgatctatataagtagtgtaataattcat

SEQ ID NO: 46971 - DNA, 75 bp, Artificial Sequence
  Synthetic
aataatttctggttagataacgcactctaccagtcaagtcaatgatattagcctttacagatatattcatagtag

SEQ ID NO: 46972 - DNA, 75 bp, Artificial Sequence
  Synthetic
tcgtacctggtattcctaccaaacaaaattttacttttagttcttttagaaaattctaaggtagaatctctattt

SEQ ID NO: 46973 - DNA, 75 bp, Artificial Sequence
  Synthetic
cactagcaaaaaatgatagaaatatatattgatacatcgcagctggttttgatctactatactttaaaaaagaat

SEQ ID NO: 46974 - DNA, 75 bp, Artificial Sequence
  Synthetic
tttaccaaaggaaatgcgtcattgattattctcctgtttgacttctctatcgatgcggcacctctcttaagaagt

SEQ ID NO: 46975 - DNA, 75 bp, Artificial Sequence
  Synthetic
cgtattccttcggcatttctttttaatgatatatcttgtttagacaatgataaagttatcatgtccatgagagac

SEQ ID NO: 46976 - DNA, 75 bp, Artificial Sequence
  Synthetic
taaagttatcatgtccatgagagacgcgtctccgtatcgtataaatatttcattagatgttagacgcttcattag

SEQ ID NO: 46977 - DNA, 75 bp, Artificial Sequence
  Synthetic
tgatggatctgtgatgtatgcaatagctgataatagaactcacgcaattattagcaaaaatatattagacaatac

SEQ ID NO: 46978 - DNA, 75 bp, Artificial Sequence
  Synthetic
tgatctctattgatgatagtgactatttcattctctgaaaattggtaactcattctatatatgctttccttgttg

SEQ ID NO: 46979 - DNA, 75 bp, Artificial Sequence
  Synthetic
acactgtttaaaattagcgaggtatttattcataataagataaatccatcttccagaatggcatacatagaagaa

SEQ ID NO: 46980 - DNA, 75 bp, Artificial Sequence
  Synthetic
gaactactatcggatgttgttgggtatctctagtgttacacatggccttactaaagtttgggtaaataactatga

SEQ ID NO: 46981 - DNA, 75 bp, Artificial Sequence
  Synthetic
gaaaagagaaatttagttactgctatacagatgtatactcctcctgatggatcatccggtatagtctttgtggca

SEQ ID NO: 46982 - DNA, 75 bp, Artificial Sequence
  Synthetic
tatctctattaattatagatgcatatatttcattcgtcaaggatattagtatcgacttgctatcgtcattaatac

SEQ ID NO: 46983 - DNA, 75 bp, Artificial Sequence
  Synthetic
atatttcattattatgaggaggaaatttatgtcatatcatgaaacatttattgtaattaataaaaaatctataat

SEQ ID NO: 46984 - DNA, 75 bp, Artificial Sequence
  Synthetic
atgttcatcatataatcgtcgctataattcatattaatactttgacattgactaatttgtaatatagcctcgcca

SEQ ID NO: 46985 - DNA, 75 bp, Artificial Sequence
  Synthetic
aattcatattaatactttgacattgactaatttgtaatatagcctcgccacgaataaagctctcgtattcagttt

SEQ ID NO: 46986 - DNA, 75 bp, Artificial Sequence
  Synthetic
ctaaagttaatactacattaaacttaaaaaataataatatcattattacaattaataagtataaactataaacta

SEQ ID NO: 46987 - DNA, 75 bp, Artificial Sequence
  Synthetic
ttggggcccttgtattctgcggattcattatctatgacacgcactcactaatacataagctctcgcctgaagagt

SEQ ID NO: 46988 - DNA, 75 bp, Artificial Sequence
  Synthetic
agaatactagtcgcgttaatagtactaaaatttgtattttttaatctatctatctcaataaaaaaattaatatgt

SEQ ID NO: 46989 - DNA, 75 bp, Artificial Sequence
  Synthetic
tctgtttgaagaaatccaatgttccaggtcctaatctcttgacaaaaattacgatattcgatcccgatatccttt

SEQ ID NO: 46990 - DNA, 75 bp, Artificial Sequence
  Synthetic
aggtcctaatctcttgacaaaaattacgatattcgatcccgatatcctttgcattctatttaccagcatatcacg

SEQ ID NO: 46991 - DNA, 75 bp, Artificial Sequence
  Synthetic
cgcctccgctaagaaaagttagtatatccatacaatggaatacttcatttctaaaatagtattcgttttctaatt

SEQ ID NO: 46992 - DNA, 75 bp, Artificial Sequence
  Synthetic
tgatgtaagtataacacaaaatatgaatgtaacatctaattgtgataaatgttcaatgaatttgatgacatccgt

SEQ ID NO: 46993 - DNA, 75 bp, Artificial Sequence
  Synthetic
ctaaaatagtattcgttttctaattctttaatgtgaaatcgtatactagaaagggaaaaattatctttgagtttt

SEQ ID NO: 46994 - DNA, 75 bp, Artificial Sequence
  Synthetic
tgctgaattaatggatttacaccaaaaactcatataacttctagatgtagaagcattagctaaaaaattagtaga

SEQ ID NO: 46995 - DNA, 75 bp, Artificial Sequence
  Synthetic
atcagattcttatataccgcctcaaactctattttaaaattattaaacaatactctactattaatcagtcgttct

SEQ ID NO: 46996 - DNA, 75 bp, Artificial Sequence
  Synthetic
ggattgagaatcaatacaaaaattaatgcatcatcaattttggaaatacttagtttccacgtagtcaatgaaaca

SEQ ID NO: 46997 - DNA, 75 bp, Artificial Sequence
  Synthetic
aaactcatataacttctagatgtagaagcattagctaaaaaattagtagaatcaaaggatataagtagatgttcc

SEQ ID NO: 46998 - DNA, 75 bp, Artificial Sequence
  Synthetic
attagaaattcccaagtagatatcctttttcatccgatcattgatgaaaatacgaactttattcggtaagacgat

SEQ ID NO: 46999 - DNA, 75 bp, Artificial Sequence
  Synthetic
gttcaccttctatagatctgagaatggatgattctccagtcgaaacatattctaccatggctccgtttaatttgt

SEQ ID NO: 47000 - DNA, 75 bp, Artificial Sequence
  Synthetic
gtataaattaaaggtgtgttttttgccattaagagacattataattttaccaatattggaattataatataggtg

SEQ ID NO: 47001 - DNA, 75 bp, Artificial Sequence
  Synthetic
gttatctatatgcctgtacttggatcttttgtacatcgatatcgctgcaatcactacaataattacaagtattat

SEQ ID NO: 47002 - DNA, 75 bp, Artificial Sequence
  Synthetic
gcatcggtaaatatagctgtatctaatgttctagtcggtatttcatcatttcgctgtctaataatagcgttttct

SEQ ID NO: 47003 - DNA, 75 bp, Artificial Sequence
  Synthetic
agaagcatttagtgtaacgtattcgatacattttgcattagatttactaatcgattttgcatactctataacacc

SEQ ID NO: 47004 - DNA, 75 bp, Artificial Sequence
  Synthetic
atgttctagtcggtatttcatcatttcgctgtctaataatagcgttttctctatctgtttctagtacagctgcct

SEQ ID NO: 47005 - DNA, 75 bp, Artificial Sequence
  Synthetic
aacaaaaataaaataagatataataaagatgccatttagagatctaattttgttcaacttgtccaaattcctact

SEQ ID NO: 47006 - DNA, 75 bp, Artificial Sequence
  Synthetic
gcagctagccgtgttagaacatcgtcatcaagtagtagtgattttgaagatatagatgaagttgttgcagaatat

SEQ ID NO: 47007 - DNA, 75 bp, Artificial Sequence
  Synthetic
cgaaaattgctatttcagagatgaggttcggtagtctaggttcacaatgaaccgtaatatatctaggaggtggat

SEQ ID NO: 47008 - DNA, 75 bp, Artificial Sequence
  Synthetic
tgttcaacttgtccaaattcctacttacagaagatggggaatcgttggagatagtgtcttccttatgtagaggat

SEQ ID NO: 47009 - DNA, 75 bp, Artificial Sequence
  Synthetic
ctcctcgtcgacaacttcctcgtggcggtgatcattctccaccacaagttcctcaacgtgattattctccaccac

SEQ ID NO: 47010 - DNA, 75 bp, Artificial Sequence
  Synthetic
cggatctatggtttccataattgagtaaataaatgctctgcaataactaatggcaaatgtataaaacaacaaaat

SEQ ID NO: 47011 - DNA, 75 bp, Artificial Sequence
  Synthetic
cataaatatatttctaaggtatttgaacatgtagatttatcggaggaattaagtatggaattccatgatacaact

SEQ ID NO: 47012 - DNA, 75 bp, Artificial Sequence
  Synthetic
tttcgtagagagttattgatatcggaacaacgtcaacaacgagaaaaaagatttaatattacggtatcaaaaaat

SEQ ID NO: 47013 - DNA, 75 bp, Artificial Sequence
  Synthetic
ctgagagatttagtctatcttagattgtacaagtattccaagtatatacggccgtgttataaattaggagataat

SEQ ID NO: 47014 - DNA, 75 bp, Artificial Sequence
  Synthetic
ctaaccattttcaagatgaggtccttgatcatatttctgttgttcccctctatcatttactccatggtcattaga

SEQ ID NO: 47015 - DNA, 75 bp, Artificial Sequence
  Synthetic
aaatgatgacttgatagaatatctcctcaaggaatacactcctcagatttatacatattctaatgagcgcgtccc

SEQ ID NO: 47016 - DNA, 75 bp, Artificial Sequence
  Synthetic
tgcggattttctcaagttacatttatggcgtatacaacgtctcatataacaacaaataaaaaggtagatgttctc

SEQ ID NO: 47017 - DNA, 75 bp, Artificial Sequence
  Synthetic
aacaaataaaaaggtagatgttctcgtttccaaaaaatgtatagatgaactagtcgatccaataaattatcaaat

SEQ ID NO: 47018 - DNA, 75 bp, Artificial Sequence
  Synthetic
tagtcgatccaataaattatcaaatacttcaaaatttatttgataaaggaagcggaacaataaacaaaatactca

SEQ ID NO: 47019 - DNA, 75 bp, Artificial Sequence
  Synthetic
tcagtgtgggtacaaatatgtacattatcgtctacgtcgtattcgatacatccgcatacagccaacaaatataaa

SEQ ID NO: 47020 - DNA, 75 bp, Artificial Sequence
  Synthetic
cgctgaaaataaagataaaaacgaggatattttcccggaagatgtaattattccatctactaagcccaaaaccaa

SEQ ID NO: 47021 - DNA, 75 bp, Artificial Sequence
  Synthetic
gtataatagtataatagtataatagtataatagtataatagtataatagtataagtatttaccctctaaacatgg

SEQ ID NO: 47022 - DNA, 75 bp, Artificial Sequence
  Synthetic
tctatttcggattttagaatttccaaattcaccagcgatttatcggttttggtgaaatccaaggatttattaatg

SEQ ID NO: 47023 - DNA, 75 bp, Artificial Sequence
  Synthetic
tggttaaaacctttgcaaatgcagcggctttgcctttagcgtccgtagtatcgtcaccgatgaacgtcatttctc

SEQ ID NO: 47024 - DNA, 75 bp, Artificial Sequence
  Synthetic
ggctttgcctttagcgtccgtagtatcgtcaccgatgaacgtcatttctctaactcctctatttaatactttacc

SEQ ID NO: 47025 - DNA, 75 bp, Artificial Sequence
  Synthetic
cacctccgtcatcatctcctggagtcggcgacattgtagaaagcgtggccgctgtagagctcgatgatagcgacg

SEQ ID NO: 47026 - DNA, 75 bp, Artificial Sequence
  Synthetic
gtggattgtatttgaaaatggaaacgatgtagttagatagatgagctgcgaagtttcctattagggttccgcgct

SEQ ID NO: 47027 - DNA, 75 bp, Artificial Sequence
  Synthetic
accatcctttaaaaaaaatgataagatatcaacatggagtatatcatactcggattttaattcttctactgcctc

SEQ ID NO: 47028 - DNA, 75 bp, Artificial Sequence
  Synthetic
atatcaacatggagtatatcatactcggattttaattcttctactgcctcactgacattttcacaaatactacaa

SEQ ID NO: 47029 - DNA, 75 bp, Artificial Sequence
  Synthetic
acttaaaatcgttactgctggaaaataaatcactgacgatattagatgataatttatacaaagtatacaatggaa

SEQ ID NO: 47030 - DNA, 75 bp, Artificial Sequence
  Synthetic
taaatcactgacgatattagatgataatttatacaaagtatacaatggaatatttgtggatacaatgagtattta

SEQ ID NO: 47031 - DNA, 75 bp, Artificial Sequence
  Synthetic
tcataaaatacgtaaacggatgggtaaaaaagggagggcatgtaaccctttttatcgatagaggaagtataaaaa

SEQ ID NO: 47032 - DNA, 75 bp, Artificial Sequence
  Synthetic
aaaaaagggagggcatgtaaccctttttatcgatagaggaagtataaaaattaaacaagacgttagagacaagag

SEQ ID NO: 47033 - DNA, 75 bp, Artificial Sequence
  Synthetic
gatatgcaactactaaaaatggcgacgcctggtgaaccagaatccactaaatctataccatctgatgtctgtgat

SEQ ID NO: 47034 - DNA, 75 bp, Artificial Sequence
  Synthetic
agtgtacatcagaaatacaaaatgttaccggatttatggaagaagaaataaaggcagaaatgcaattaaaaatcg

SEQ ID NO: 47035 - DNA, 75 bp, Artificial Sequence
  Synthetic
taccggatttatggaagaagaaataaaggcagaaatgcaattaaaaatcgataaactcacatttcaaatatattt

SEQ ID NO: 47036 - DNA, 75 bp, Artificial Sequence
  Synthetic
tgatggcggtgtacgtggacgaggctgctcctgttcttgttgtggtcgccgactgtcgtgtttgcgtttagatcc

SEQ ID NO: 47037 - DNA, 75 bp, Artificial Sequence
  Synthetic
catggatactagtggtagtatgaagaagtattctccagatgaatgggtgtcacatataaaattttaattagggtt

SEQ ID NO: 47038 - DNA, 75 bp, Artificial Sequence
  Synthetic
tcaacaataatgagaatgttacattattttattgtgatgaacgagacgcagaattcgttatgtgtctagaggcta

SEQ ID NO: 47039 - DNA, 75 bp, Artificial Sequence
  Synthetic
aatatcgatcaacggataatctgaggtttttggagaataatatgactcatgatctatttcgtccataaacaatct

SEQ ID NO: 47040 - DNA, 75 bp, Artificial Sequence
  Synthetic
agggtaaggtaactatatacaataactaacaatttgtgtatcatatagacaattaatcagtaactgttatctctt

SEQ ID NO: 47041 - DNA, 75 bp, Artificial Sequence
  Synthetic
aattaatcagtaactgttatctctttttaactaactaactctatataccacctattaatacatcatagttatagt

SEQ ID NO: 47042 - DNA, 75 bp, Artificial Sequence
  Synthetic
aaacacatttctctaccacaggagaatggccgttaataataagtaccgatcaggatactatgctattcgcgtcta

SEQ ID NO: 47043 - DNA, 75 bp, Artificial Sequence
  Synthetic
acttaaacaaaatacaattgtttagtgattttacaatcgataatatagtcactagtttggcaattaaaaattatt

SEQ ID NO: 47044 - DNA, 75 bp, Artificial Sequence
  Synthetic
tgattttacaatcgataatatagtcactagtttggcaattaaaaattattatagaaagactaactctaccgtaga

SEQ ID NO: 47045 - DNA, 75 bp, Artificial Sequence
  Synthetic
atatcgtctgtgaaacatcacgtaccggaacactagctagaaaaatcattaaaaagatggaggatatggtggtcg

SEQ ID NO: 47046 - DNA, 75 bp, Artificial Sequence
  Synthetic
tacgcgttagaaccacgtaaggagattgatgtttcagaagttaaaactttatcatcttatatagatttcgaaaat

SEQ ID NO: 47047 - DNA, 75 bp, Artificial Sequence
  Synthetic
agataataggataagactaatgcttgaaaatggacgtagaacaagacattttttgtcctatatattagatacagt

SEQ ID NO: 47048 - DNA, 75 bp, Artificial Sequence
  Synthetic
actaaatcagatatcgatgttataaaatctatatcctcgatttttggatattctaacgaaaactgtaacactata

SEQ ID NO: 47049 - DNA, 75 bp, Artificial Sequence
  Synthetic
ttctaacgaaaactgtaacactatagtgttcggcatctataaggataatttactactgagtataaataattcatt

SEQ ID NO: 47050 - DNA, 75 bp, Artificial Sequence
  Synthetic
ctgaaataaccgcgtgattattttttggtataattctacacggcatggtttctgtgactatgaattcaacccccg

SEQ ID NO: 47051 - DNA, 75 bp, Artificial Sequence
  Synthetic
ttactttaacgatagtctgttaataaccaatactaaaagtgataatataataaatataggttactagattaaaaa

SEQ ID NO: 47052 - DNA, 75 bp, Artificial Sequence
  Synthetic
gtaaatgtcgggccaatagtagctattaccgtcgacacgtgtagtgggaactatggccaaatgttcaatatctat

SEQ ID NO: 47053 - DNA, 75 bp, Artificial Sequence
  Synthetic
acacgttgtaaaacataaaggaatatacaaagttagtacagaagcacgtggaaaaaaagtatctcctccatcact

SEQ ID NO: 47054 - DNA, 75 bp, Artificial Sequence
  Synthetic
cgatataaattgattatacgaaaaaaatcattaaaggatgtactcgtcagtgtaaagaacgaatgttgtaggtta

SEQ ID NO: 47055 - DNA, 75 bp, Artificial Sequence
  Synthetic
aatcattaaaggatgtactcgtcagtgtaaagaacgaatgttgtaggttaaaattatctacacaaatagaacctc

SEQ ID NO: 47056 - DNA, 75 bp, Artificial Sequence
  Synthetic
tgtaaagaacgaatgttgtaggttaaaattatctacacaaatagaacctcaacgtaacttaacagtgcaacctct

SEQ ID NO: 47057 - DNA, 75 bp, Artificial Sequence
  Synthetic
gacgtagataatatttctaggaatgagatattggacgatgatagcttcgctggtagtttaatatgggataacgaa

SEQ ID NO: 47058 - DNA, 75 bp, Artificial Sequence
  Synthetic
tatcctttagatgaattattattggttcattggaatcaaaaagtaagatattatcgggtttaagatctgcgtgta

SEQ ID NO: 47059 - DNA, 75 bp, Artificial Sequence
  Synthetic
cctagaggttctattatttttattaattatgccatgtcattaactagtcatttgaatccatcgatagaaaaacat

SEQ ID NO: 47060 - DNA, 75 bp, Artificial Sequence
  Synthetic
attatgccatgtcattaactagtcatttgaatccatcgatagaaaaacatgtgggtatttattatggtacgttat

SEQ ID NO: 47061 - DNA, 75 bp, Artificial Sequence
  Synthetic
agactatagatctctcattataaaaagtgatcacgagtttgtaaagctatgtaaagatcatgcagagaaaagttc

SEQ ID NO: 47062 - DNA, 75 bp, Artificial Sequence
  Synthetic
tgtcctgcgtatagtataccaagaaatatatcagcatatgaaggtctatgctttagtgttgccacatctaaagat

SEQ ID NO: 47063 - DNA, 75 bp, Artificial Sequence
  Synthetic
gtcccattggatcgtttttttgaaggatatcttagtgcaaaagtatacatgttagagaatattcaagttatgaaa

SEQ ID NO: 47064 - DNA, 75 bp, Artificial Sequence
  Synthetic
tactaggtattccatatggatttggtcatgatagaatgtattgttttaaattggtagctgaatgttataaaaatg

SEQ ID NO: 47065 - DNA, 75 bp, Artificial Sequence
  Synthetic
tcatgatagaatgtattgttttaaattggtagctgaatgttataaaaatgccggtgttgatacatcgtctaaacg

SEQ ID NO: 47066 - DNA, 75 bp, Artificial Sequence
  Synthetic
agccaaaacttcacagatgataatagatggataaagatatatgattctaataatttaacactttggcaaattgat

SEQ ID NO: 47067 - DNA, 75 bp, Artificial Sequence
  Synthetic
gatggataaagatatatgattctaataatttaacactttggcaaattgattaccttaaagggtgagttaatatgc

SEQ ID NO: 47068 - DNA, 75 bp, Artificial Sequence
  Synthetic
atttatcatatataatggtccaaattctacacgtgcttcgaattcatccagatcattaaggttcttataatcgta

SEQ ID NO: 47069 - DNA, 75 bp, Artificial Sequence
  Synthetic
tgccatcactctcataatataaagatattctaaaatggtaaacttttgcatatcggacgcagaaattggtataaa

SEQ ID NO: 47070 - DNA, 75 bp, Artificial Sequence
  Synthetic
ttttattatattactattggcaattgtagatataacttctggtaaatatttttctaccttttcaatctcttctat

SEQ ID NO: 47071 - DNA, 75 bp, Artificial Sequence
  Synthetic
gtagatataacttctggtaaatatttttctaccttttcaatctcttctattttcaagccggctatatattctgct

SEQ ID NO: 47072 - DNA, 75 bp, Artificial Sequence
  Synthetic
tattttcttctacatacataagcatgtccaatacgttagacaacacaccgacgatggcggccgccacagacacga

SEQ ID NO: 47073 - DNA, 75 bp, Artificial Sequence
  Synthetic
cgacaccaacggttttaatatttcgatgatatacggtagtctctctttcggacttatatagcttattccacaata

SEQ ID NO: 47074 - DNA, 75 bp, Artificial Sequence
  Synthetic
attcactatatcagttttaactggtagttccattagcctttccacttctgcagaataatcagaaattggttcttt

SEQ ID NO: 47075 - DNA, 75 bp, Artificial Sequence
  Synthetic
tctggcattatctatatgtgcgagaatatcctctagagaatcagtatcctttttgatgatagtggatctcaatga

SEQ ID NO: 47076 - DNA, 75 bp, Artificial Sequence
  Synthetic
agttccattagcctttccacttctgcagaataatcagaaattggttctttaccagaaaatccagctactataata

SEQ ID NO: 47077 - DNA, 75 bp, Artificial Sequence
  Synthetic
cgaatgggaaaaatgaaattatcgacataggtatagaatccggaacattgaacgtattaatacttaattcttttt

SEQ ID NO: 47078 - DNA, 75 bp, Artificial Sequence
  Synthetic
gatgtctactcgtatgttcctccttgtcaatgcactgttcaagaatttatattttccgcattagatgaaaaatgg

SEQ ID NO: 47079 - DNA, 75 bp, Artificial Sequence
  Synthetic
agcatatttcatttccaataattctgctagttcttgagacattgatttatttgatgaatctagttggttctctag

SEQ ID NO: 47080 - DNA, 75 bp, Artificial Sequence
  Synthetic
gctagttcttgagacattgatttatttgatgaatctagttggttctctagatactctaccatttctgccgcatac

SEQ ID NO: 47081 - DNA, 75 bp, Artificial Sequence
  Synthetic
tttttattgttttacgtacctgggtattcaattactacaaaaattactccagccgtagaatatctaatggataaa

SEQ ID NO: 47082 - DNA, 75 bp, Artificial Sequence
  Synthetic
gaatgacatcgaagattgtccaatatttttaatagctgctccttgtccattatttctatatttgactcacaacaa

SEQ ID NO: 47083 - DNA, 75 bp, Artificial Sequence
  Synthetic
tagacagaatatcgtgaacaggtggtatattatattcatcagatatacgaagaacaatgtccaaatctatattgt

SEQ ID NO: 47084 - DNA, 75 bp, Artificial Sequence
  Synthetic
tattcagaattaatagatatatctctcaatacagattgcactatacattttgaaactatgtcaaaaattgtagaa

SEQ ID NO: 47085 - DNA, 75 bp, Artificial Sequence
  Synthetic
caattgtttagctttggactctatatattcagaattaatagatatatctctcaatacagattgcactatacattt

SEQ ID NO: 47086 - DNA, 75 bp, Artificial Sequence
  Synthetic
tataaccgcataaaataaaaatccattttcatttttaacaaatactatctcctctattcataattgagattgatg

SEQ ID NO: 47087 - DNA, 75 bp, Artificial Sequence
  Synthetic
cgacgctgttctgcagccatttaactttaaataatttacaaaaatttaaaatgagcatccgtataaaaatcgata

SEQ ID NO: 47088 - DNA, 75 bp, Artificial Sequence
  Synthetic
ataaatgtagactcgacggatgagttaatgtatatttttgccgccttgggcggatctgtaaacatttgggccatt

SEQ ID NO: 47089 - DNA, 75 bp, Artificial Sequence
  Synthetic
agaggagacgatctactatcaaattcggatcgtaaatctgtttctaaagaacggagaatatctatacatacctga

SEQ ID NO: 47090 - DNA, 75 bp, Artificial Sequence
  Synthetic
cacacacacacacacacacacacacacacacacacacacactactttttatcatcttatgaggaatgattgcctt

SEQ ID NO: 47091 - DNA, 75 bp, Artificial Sequence
  Synthetic
tcgtgtttgtgtagttttcacaatgatgccatcatagatatcgaacctgatctggaaaataatctagtaaaactt

SEQ ID NO: 47092 - DNA, 75 bp, Artificial Sequence
  Synthetic
tctagttatcatgtagtaagtgtcgattgtaacaaggaactgatgcctattaggacagatactactatttgtcta

SEQ ID NO: 47093 - DNA, 75 bp, Artificial Sequence
  Synthetic
agtatagatcaaaagaaatcttacgtgtttaattttcacaagtatgaagaaaaatgttgtggtagaaccgtcatt

SEQ ID NO: 47094 - DNA, 75 bp, Artificial Sequence
  Synthetic
acgaatatctgtgacagatatcatctttagagaatatactagtcgcgttaatagtactacaatttgtatttttta

SEQ ID NO: 47095 - DNA, 75 bp, Artificial Sequence
  Synthetic
atctatctcaataaaaaaattaatatgtatgattcaatgtataactaaactactaactgttattgataactagaa

SEQ ID NO: 47096 - DNA, 75 bp, Artificial Sequence
  Synthetic
tttggctattatgtttaaagatgacaatattattatgaagactcctggtaatactgatgcattttccagggaata

SEQ ID NO: 47097 - DNA, 75 bp, Artificial Sequence
  Synthetic
ctatctcgtctctcaacaaactacgaggattcaaaaagagagtcaatgtttttgaaactagaatcgtaatggata

SEQ ID NO: 47098 - DNA, 75 bp, Artificial Sequence
  Synthetic
aacgcgtctttaactcgtcggttaactctttcttttgatcgagttcgtcgctactattgggtctgctcaggtgcc

SEQ ID NO: 47099 - DNA, 75 bp, Artificial Sequence
  Synthetic
gatagctcccgctaagcttttagaatatgtgcatataggaccgctagcaaaagataaagaggataaagtaaagaa

SEQ ID NO: 47100 - DNA, 75 bp, Artificial Sequence
  Synthetic
cgtgtgagagaagaccttcgtccccgtccagatgcgagagaatgaataaccctggaaaacaagtcccgtttatga

SEQ ID NO: 47101 - DNA, 75 bp, Artificial Sequence
  Synthetic
tatgtgcatataggaccgctagcaaaagataaagaggataaagtaaagaaaagatatccagagtttagattagtc

SEQ ID NO: 47102 - DNA, 75 bp, Artificial Sequence
  Synthetic
aagagctgattatttatttcttcttccaatctattggtactaacaacgacaccgactaatgtttccggagataga

SEQ ID NO: 47103 - DNA, 75 bp, Artificial Sequence
  Synthetic
aaccgcacccaattgctgtcgcacttttaaccgtactcattattggaagaaggatggaaagatatcagataagta

SEQ ID NO: 47104 - DNA, 75 bp, Artificial Sequence
  Synthetic
gaaaatgcgatgttgatttattcgactggtgtcagggggatacgttcgatagaaacatatgccatcagtggatcg

SEQ ID NO: 47105 - DNA, 75 bp, Artificial Sequence
  Synthetic
gagaaaacaaaacgaagctagttgatttattactgagttaccatcccactctagagactatgattgacgcattta

SEQ ID NO: 47106 - DNA, 75 bp, Artificial Sequence
  Synthetic
tgatttttttattaaatcgaatggtcggctctctggtttgctaccccaatgataacaatagtcttgtaaagataa

SEQ ID NO: 47107 - DNA, 75 bp, Artificial Sequence
  Synthetic
tttaagacaacagtccgcagattttaaacagaaatatatgagatgtagttatcccaccagagataagttagaaga

SEQ ID NO: 47108 - DNA, 75 bp, Artificial Sequence
  Synthetic
gtcattaaaatatgctgaacctcgagaatgttgggatccagagtgttcgaatgccaatgttaatttcttgctaac

SEQ ID NO: 47109 - DNA, 75 bp, Artificial Sequence
  Synthetic
gaatgttgggatccagagtgttcgaatgccaatgttaatttcttgctaacacgtaattataataatttaggacta

SEQ ID NO: 47110 - DNA, 75 bp, Artificial Sequence
  Synthetic
aacttcctcattaagattatcctgtggattaagcaatagtgatagattttctactgttcccgtcaatagagcaaa

SEQ ID NO: 47111 - DNA, 75 bp, Artificial Sequence
  Synthetic
agtagttcaacataatattaaacattcgttcgacataaaattgcatttgatcagtttattatctctcttggtaat

SEQ ID NO: 47112 - DNA, 75 bp, Artificial Sequence
  Synthetic
cgacggtgaatacactcagcgaacgtatctcgtctaaattagaacaagaagcgaacgctagtgctcaaacaaaat

SEQ ID NO: 47113 - DNA, 75 bp, Artificial Sequence
  Synthetic
ctcactgttaaaaatatgtgctccgcggacgcggatgctcagttggatgctgtgttatcagccgctacagaaaca

SEQ ID NO: 47114 - DNA, 75 bp, Artificial Sequence
  Synthetic
acacctggaattattaccatagaagatgttagaaaaaatgatgctggttattacacatgtgttttaaaatatata

SEQ ID NO: 47115 - DNA, 75 bp, Artificial Sequence
  Synthetic
tatagcagtagcgagaaagcatcatacgaaaatagattctatgtttttaatgactgccacgttagaggatgacag

SEQ ID NO: 47116 - DNA, 75 bp, Artificial Sequence
  Synthetic
atgaatgttacggagcaccaggatcaccaacaaatttggaatttattaatacaggatctagcaaaggaaattgtg

SEQ ID NO: 47117 - DNA, 75 bp, Artificial Sequence
  Synthetic
gatatacagtcttaaataattacgcaatatctcaatagtttcataattgttagctgttttcatcaagatttgtac

SEQ ID NO: 47118 - DNA, 75 bp, Artificial Sequence
  Synthetic
atataaatcatatttagaaaaaagattgccgtacgatatgtatattattcatggtaaggtcttagatatagacga

SEQ ID NO: 47119 - DNA, 75 bp, Artificial Sequence
  Synthetic
acttattttagcaaataaggaaaacgtccattggactacttacatggacacattctttagaacttctccgatggt

SEQ ID NO: 47120 - DNA, 75 bp, Artificial Sequence
  Synthetic
accccatggtgtaacaaccaacgataaaaataatattgtttttcactttttataattttaccatctgactcatgg

SEQ ID NO: 47121 - DNA, 75 bp, Artificial Sequence
  Synthetic
tgaaaatatattgataatattttaatagattaacatggaagttatcgctgatcgtctagacgatatagtggaaca

SEQ ID NO: 47122 - DNA, 75 bp, Artificial Sequence
  Synthetic
gaggaggagccaatgactgatatatttcgtccgtcactacgtaataaaagtaatgaggaaatcgtataaatacgg

SEQ ID NO: 47123 - DNA, 75 bp, Artificial Sequence
  Synthetic
atcaatgtccctccatacttcgaccattacttaggttgttgattgatatactattatttgttatagtaatttata

SEQ ID NO: 47124 - DNA, 75 bp, Artificial Sequence
  Synthetic
tgatctgtcctacatgaagtctatacagcgaatagattcagaatttctacataattatatattgtacgctaataa

SEQ ID NO: 47125 - DNA, 75 bp, Artificial Sequence
  Synthetic
taggcatttcatctttctccaatactaattcaaattgttaaattaataatggatagtataaatagttattagtgt

SEQ ID NO: 47126 - DNA, 75 bp, Artificial Sequence
  Synthetic
aaattatcaaatgttgttggcgttagtggcgctagtcatcacattaactattttttattactttatactataata

SEQ ID NO: 47127 - DNA, 75 bp, Artificial Sequence
  Synthetic
agcgggtttagatggcaacatagaagcgtgtaaaagaaaactatatactatagtcagcacgcttccatgtcctgc

SEQ ID NO: 47128 - DNA, 75 bp, Artificial Sequence
  Synthetic
tactcatgattaaacctaaataattgtactttgtaatataatgatatatattttcactttatctcatttgagaat

SEQ ID NO: 47129 - DNA, 75 bp, Artificial Sequence
  Synthetic
gcgatgatctgaattatatttattattttttcatcagattatttaacaatttggcatctgatcccaaatacgcaa

SEQ ID NO: 47130 - DNA, 75 bp, Artificial Sequence
  Synthetic
agttatcccactagagataagttagaagagtcattaaaatatgcggaacctcgagaatgttgggatccagagtgt

SEQ ID NO: 47131 - DNA, 75 bp, Artificial Sequence
  Synthetic
gtgattttttatcaaccactcgaaaaagtaattggagtgttcatatcctctacgggctattgtctcatggccgtg

SEQ ID NO: 47132 - DNA, 75 bp, Artificial Sequence
  Synthetic
aaaacaaaattcgttagaatatatgccacgtttatacattgaatataaaataactacagtttgaaaaataacagt

SEQ ID NO: 47133 - DNA, 75 bp, Artificial Sequence
  Synthetic
ccacgtttatacattgaatataaaataactacagtttgaaaaataacagtatcatttaaacatttaacttgcggt

SEQ ID NO: 47134 - DNA, 75 bp, Artificial Sequence
  Synthetic
cagaggattacaacaaaaagatgctatgtatatatatttcttagctagagtgataatttcgttaaaacattcaaa

SEQ ID NO: 47135 - DNA, 75 bp, Artificial Sequence
  Synthetic
tgataatttcgttaaaacattcaaatgttgtcaaatgatcggatctaaaatccatattttctggtagtgtttcta

SEQ ID NO: 47136 - DNA, 75 bp, Artificial Sequence
  Synthetic
ttctaaaacgtatcgatacgcattttcaaaatacatgtcgttcgatgaatacgatggtataataactagatgtca

SEQ ID NO: 47137 - DNA, 75 bp, Artificial Sequence
  Synthetic
tccatgagaaatacgtttagccgcctttaatagaggaaatcccaccgcctttctggatctcaccaacgacgatag

SEQ ID NO: 47138 - DNA, 75 bp, Artificial Sequence
  Synthetic
tttaatagaggaaatcccaccgcctttctggatctcaccaacgacgatagttctgaccagcaactcatttcttca

SEQ ID NO: 47139 - DNA, 75 bp, Artificial Sequence
  Synthetic
tatatcatgtagaagaattcttggataaaagcatccatctaaccaagacggataagaaatatatacttcaattga

SEQ ID NO: 47140 - DNA, 75 bp, Artificial Sequence
  Synthetic
gatcgtattgtagaataccgttactagcgtatgatcctgtgtatgtttcataaggtccttctttttcggctaatt

SEQ ID NO: 47141 - DNA, 75 bp, Artificial Sequence
  Synthetic
gcaatattccttctcgtaggcacacaatctaatattgataaaatctccattctcttctctgcatttattatcttg

SEQ ID NO: 47142 - DNA, 75 bp, Artificial Sequence
  Synthetic
atagtgggcttgcacgtattaaagaatgcggtagtatgagtaaaccgttttaacgaattatatagtctccagaaa

SEQ ID NO: 47143 - DNA, 75 bp, Artificial Sequence
  Synthetic
ccgtatccattgtagattgttgaccgattatcgagtttaaatcattactaatactcaatccttcagaatacaatc

SEQ ID NO: 47144 - DNA, 75 bp, Artificial Sequence
  Synthetic
ttcatttcttcctggtatatttctatcacctcgtttggttggatttttgtctatattatcgtttgtaacatcggt

SEQ ID NO: 47145 - DNA, 75 bp, Artificial Sequence
  Synthetic
aacttctctaaatgagtctactgctagaaaacctcatcgaagaagataccatattttttgcaggaagtatatctg

SEQ ID NO: 47146 - DNA, 75 bp, Artificial Sequence
  Synthetic
ataagaaataaagtttaaaatagaattaataaaaaacatataggtcattttttaaatggattgaaaaccaaggtt

SEQ ID NO: 47147 - DNA, 75 bp, Artificial Sequence
  Synthetic
agtatgatgatttacaaatggttattgccggtgcaaaatccaaatttccaagatctatgctttctatttttaata

SEQ ID NO: 47148 - DNA, 75 bp, Artificial Sequence
  Synthetic
atcatggattaacgcctatactatgttatataacttccgactacatacaacacgatattcttgtcatgttgatac

SEQ ID NO: 47149 - DNA, 75 bp, Artificial Sequence
  Synthetic
tgccggtgcaaaatccaaatttccaagatctatgctttctatttttaatatagtacctagaacgatgtcaaaata

SEQ ID NO: 47150 - DNA, 75 bp, Artificial Sequence
  Synthetic
aattacagacagcaatttctttattctctacagatgtaagatacttgaagacattcctatgatgatgcagaattt

SEQ ID NO: 47151 - DNA, 75 bp, Artificial Sequence
  Synthetic
caatgtataacataagaaacaatttgggtctaggcgatgataaactaactattgaagccattgaaaactatttct

SEQ ID NO: 47152 - DNA, 75 bp, Artificial Sequence
  Synthetic
gggtctaggcgatgataaactaactattgaagccattgaaaactatttcttggatcctaacaatgaggttatgcc

SEQ ID NO: 47153 - DNA, 75 bp, Artificial Sequence
  Synthetic
cacatcaacgaccactctccgtcatccttcactcgtttcataaagagatcaggaatccaaagagctataaataga

SEQ ID NO: 47154 - DNA, 75 bp, Artificial Sequence
  Synthetic
gtaggagaaagaataagaacatggttatcttccgtcaaggatcatcacctatcttgtgtattttcgaaactcgta

SEQ ID NO: 47155 - DNA, 75 bp, Artificial Sequence
  Synthetic
gacgtcagacattgtctgactgaatacatcctgtgggtttctcatagatggacccatagagaaactgcagggtct

SEQ ID NO: 47156 - DNA, 75 bp, Artificial Sequence
  Synthetic
aaaagattaatatttataaagaaaatatggaatccgcgtcgactgagtatacacctatcggagacaacaaggctt

SEQ ID NO: 47157 - DNA, 75 bp, Artificial Sequence
  Synthetic
acacctatcggagacaacaaggctttgatatctaaatatgcaggaattaatatcctgaatgtgtattctccttcc

SEQ ID NO: 47158 - DNA, 75 bp, Artificial Sequence
  Synthetic
acatccatgagattgaatgccatttacggattcaccaataaaaataaactagagaaacttagtactaataaggaa

SEQ ID NO: 47159 - DNA, 75 bp, Artificial Sequence
  Synthetic
acggattcaccaataaaaataaactagagaaacttagtactaataaggaactagaatcgtatagctctagccctc

SEQ ID NO: 47160 - DNA, 75 bp, Artificial Sequence
  Synthetic
aaaaagaatattcctctaacagatattccgacaaaggattgattactataaatggagaatgttcctaatgtatac

SEQ ID NO: 47161 - DNA, 75 bp, Artificial Sequence
  Synthetic
ttccgacaaaggattgattactataaatggagaatgttcctaatgtatactttaatcctgtgtttatagagccca

SEQ ID NO: 47162 - DNA, 75 bp, Artificial Sequence
  Synthetic
ataaatacaataattaatttctcgtaaaagtagaaaatatattctaatttattgtatggtaaggaagtagaatca

SEQ ID NO: 47163 - DNA, 75 bp, Artificial Sequence
  Synthetic
tttgaagtattcgttgtattcattctaatatatgtattttttagatctgaattaaatatgttcttcatgcctaaa

SEQ ID NO: 47164 - DNA, 75 bp, Artificial Sequence
  Synthetic
ataactagaatcagaatctaatgatgacgtaaccaagaagtttatctacagccaatttagctgcattatttttag

SEQ ID NO: 47165 - DNA, 75 bp, Artificial Sequence
  Synthetic
gtttattttcaacaagtaggatttttccaaagttttaaaaccaaaatagttgtatgaaaagtctcgttcgtaaat

SEQ ID NO: 47166 - DNA, 75 bp, Artificial Sequence
  Synthetic
acacacacacactactacctacttactactactacacagactaagtactacgtactactactacttattacttac

SEQ ID NO: 47167 - DNA, 75 bp, Artificial Sequence
  Synthetic
gaagaatatataggtaatacatataaatgtagtggacacaactattattttgataaaacccttacaactacagta

SEQ ID NO: 47168 - DNA, 75 bp, Artificial Sequence
  Synthetic
tgaagacgataaattaatgatctatggattaccatggatgacaactcaaacatctgcgttatcaataaatagtaa

SEQ ID NO: 47169 - DNA, 75 bp, Artificial Sequence
  Synthetic
tcgtgaacaggtggtatattatattcatcagatatacgaagaacaatgttcaaatctagattgtttaatatatta

SEQ ID NO: 47170 - DNA, 75 bp, Artificial Sequence
  Synthetic
gtatagatcattcttttagcacgtgtataatataaaaacattattctatttcgaatttaggcttccaaaaatttt

SEQ ID NO: 47171 - DNA, 75 bp, Artificial Sequence
  Synthetic
aagcttttgcgatcaataaatggatcacaaccagtatctcttaacgatgttcttcgcagatgatgattcattttt

SEQ ID NO: 47172 - DNA, 75 bp, Artificial Sequence
  Synthetic
cacaaccagtatctcttaacgatgttcttcgcagatgatgattcattttttaagtatttggctagtcaagatgat

SEQ ID NO: 47173 - DNA, 75 bp, Artificial Sequence
  Synthetic
gttattattattgatccaatcaaaaaataaattagaagctgtgggtcattgttatgaatctctttcagaggaata

SEQ ID NO: 47174 - DNA, 75 bp, Artificial Sequence
  Synthetic
agtatagatacaacggttactatcaatattattcatctagcgattatgaaaattataatgaatattattatgatt

SEQ ID NO: 47175 - DNA, 75 bp, Artificial Sequence
  Synthetic
gttatgaatctctttcagaggaatacagacaattgacaaaattcacagactctcaagattttaaaaaactgttta

SEQ ID NO: 47176 - DNA, 75 bp, Artificial Sequence
  Synthetic
tgtagcgaagaagagaaagacagcgacatcaagacccatccagtactcgggtctaacatctctcataagaaagtg

SEQ ID NO: 47177 - DNA, 75 bp, Artificial Sequence
  Synthetic
ttgttcgactttgtgattagtttgatgcgattcaaaaaagaatcagctctagctaccaccgcaatagatcctgtt

SEQ ID NO: 47178 - DNA, 75 bp, Artificial Sequence
  Synthetic
agatacatagatcctcgtcgcgatatcgcattttctaacgtgatggatatattaaagtcgaataaagtgaacaat

SEQ ID NO: 47179 - DNA, 75 bp, Artificial Sequence
  Synthetic
tcgcattttctaacgtgatggatatattaaagtcgaataaagtgaacaataattaattctttattgtcatcatga

SEQ ID NO: 47180 - DNA, 75 bp, Artificial Sequence
  Synthetic
cggccccatgttttcaggtaaaagtacagaattaattagacgagttagacgttatcaaatagctcaatataaatg

SEQ ID NO: 47181 - DNA, 75 bp, Artificial Sequence
  Synthetic
gttatcaaatagctcaatataaatgcgtgactataaaatattctaacgataatagatacggaacgggactatgga

SEQ ID NO: 47182 - DNA, 75 bp, Artificial Sequence
  Synthetic
gtcttggaatcaattacagatttctccgtgataggtatcgatgaaggacagttctttccagacattgttgaattc

SEQ ID NO: 47183 - DNA, 75 bp, Artificial Sequence
  Synthetic
ccgtgataggtatcgatgaaggacagttctttccagacattgttgaattctgtgagcgtatggcaaacgaaggaa

SEQ ID NO: 47184 - DNA, 75 bp, Artificial Sequence
  Synthetic
aacggagcaaccatggataagacgacggacaacaactatcctctacacgactactttgttaataataatctcgtc

SEQ ID NO: 47185 - DNA, 75 bp, Artificial Sequence
  Synthetic
aaactaaaaataaacattgattaaattttaatataatacttaaaaatggatgttgtgtcgttagataaaccgttt

SEQ ID NO: 47186 - DNA, 75 bp, Artificial Sequence
  Synthetic
ttttaatataatacttaaaaatggatgttgtgtcgttagataaaccgtttatgtattttgaggaaattgataatg

SEQ ID NO: 47187 - DNA, 75 bp, Artificial Sequence
  Synthetic
aaacaagttccgtttatgaggacggacatgctacaaaatatgttcgcggctaatcgcgataatgtagcttctaga

SEQ ID NO: 47188 - DNA, 75 bp, Artificial Sequence
  Synthetic
cgaacaaaatagtaaccactcattctgacgacagcatacacagtaactaatttttatatctttagagattatctc

SEQ ID NO: 47189 - DNA, 75 bp, Artificial Sequence
  Synthetic
tgacgacagcatacacagtaactaatttttatatctttagagattatctccctattacctcattatgataatgtg

SEQ ID NO: 47190 - DNA, 75 bp, Artificial Sequence
  Synthetic
tatcaaggacagttaaaactattactaggagaattattttttcttagtaagttacagcgacacggtatattagat

SEQ ID NO: 47191 - DNA, 75 bp, Artificial Sequence
  Synthetic
tttgagagatcatttctataatttaggagtgatcatcaaatggatgctaattgacggccgccatcatgatcctat

SEQ ID NO: 47192 - DNA, 75 bp, Artificial Sequence
  Synthetic
ttattgacattgtatggttttaaatattctataacttgagacttgatagatattaatgaagaattgaaaattatt

SEQ ID NO: 47193 - DNA, 75 bp, Artificial Sequence
  Synthetic
aatatctacgatccatcaaaaaacaactgcatccttctaagattattttaatttctgatgtgagatccaaacgag

SEQ ID NO: 47194 - DNA, 75 bp, Artificial Sequence
  Synthetic
actgcatccttctaagattattttaatttctgatgtgagatccaaacgaggaggaaatgaacctagtacggcgga

SEQ ID NO: 47195 - DNA, 75 bp, Artificial Sequence
  Synthetic
ctttctctcttcgatggtctcacaaaaatattaaacctctttctgatggagtcgtaaaaatatttttattctctt

SEQ ID NO: 47196 - DNA, 75 bp, Artificial Sequence
  Synthetic
ccgtggcgtctagtcttaaatggagatgcccgtttccagatcaatggatcaaggacttttatatcccacacggta

SEQ ID NO: 47197 - DNA, 75 bp, Artificial Sequence
  Synthetic
tataaagcgatcgatctttcttacactctagagtttcctacagtcatgggttacacatttttttctagacactaa

SEQ ID NO: 47198 - DNA, 75 bp, Artificial Sequence
  Synthetic
ttaagtatttataccggtgagaacatgagactgactcgagttaccaaatcagacgctgtaaattatgaaaaaaag

SEQ ID NO: 47199 - DNA, 75 bp, Artificial Sequence
  Synthetic
ttatcctaatcaggaatatgactattttcacatgtactttatgctgaggaccgtatactgcaataaaacatttcc

SEQ ID NO: 47200 - DNA, 75 bp, Artificial Sequence
  Synthetic
tgcaagttaaatagaatgctcttaaataatgtcattttcttgtccgctaaaaatttaaagaatgtataaactttt

SEQ ID NO: 47201 - DNA, 75 bp, Artificial Sequence
  Synthetic
ccgtatactgcaataaaacatttcctactactaaagcaaaggtactatttctacaacaatctatatttcgtttct

SEQ ID NO: 47202 - DNA, 75 bp, Artificial Sequence
  Synthetic
ttcaaagatttgaaacttttaggtggagttctagtacacaatatcataaacaaactaataaacatcccgcattca

SEQ ID NO: 47203 - DNA, 75 bp, Artificial Sequence
  Synthetic
cgtaaagtatctagcaaagattctatgtctaaaaacagaaatagcaagagatccgtacgcggtaataaatagaaa

SEQ ID NO: 47204 - DNA, 75 bp, Artificial Sequence
  Synthetic
atctttagtagaccgttctttatattctacatttggttcattgcatatcatattgtagaaagataagtaatcgtc

SEQ ID NO: 47205 - DNA, 75 bp, Artificial Sequence
  Synthetic
aaatactttgagaatccgctacatattattggtaagaatcttcaagagtgcattgactttgttagtgagtaggca

SEQ ID NO: 47206 - DNA, 75 bp, Artificial Sequence
  Synthetic
ttgttgttcgctgctatgataatcagatcattcgccgatagtggtaacgctatcgaaacgacatcgccagaaatt

SEQ ID NO: 47207 - DNA, 75 bp, Artificial Sequence
  Synthetic
gatactggttcagaaagtaattcattaattttcagtcctttatagaagatatttaatatagataatacaaaatct

SEQ ID NO: 47208 - DNA, 75 bp, Artificial Sequence
  Synthetic
accaatcattataacatcgtatcttcaaaaaggtcataacaagtttcctgtaaattttctatacatagatgtggt

SEQ ID NO: 47209 - DNA, 75 bp, Artificial Sequence
  Synthetic
atcctttaagattaacatctttatggcgtttttagactaatactttcaatgagataaatatgggtggcggagtaa

SEQ ID NO: 47210 - DNA, 75 bp, Artificial Sequence
  Synthetic
aagtacatcatctggaattgttactactaaatcaaccaccgatgatgcggatctttatgatacgtacaatgataa

SEQ ID NO: 47211 - DNA, 75 bp, Artificial Sequence
  Synthetic
caaaaaggtcataacaagtttcctgtaaattttctatacatagatgtggtaatatctgacttatttcctagcttt

SEQ ID NO: 47212 - DNA, 75 bp, Artificial Sequence
  Synthetic
aggcgatggtaaaaagactcttcgtcttcccaaaatgttagagacggaaatagttgtcaagattctctatcgtcc

SEQ ID NO: 47213 - DNA, 75 bp, Artificial Sequence
  Synthetic
gaggatagtagagatagagataatataactatcacgacgcggtaaactaattcacgcataataaacatggttaca

SEQ ID NO: 47214 - DNA, 75 bp, Artificial Sequence
  Synthetic
gagtagagatagccgatagatctgttatttcagtcgctgattaatcaattaatagagatgagataagaacattat

SEQ ID NO: 47215 - DNA, 75 bp, Artificial Sequence
  Synthetic
atattaaaatagctaacgctagtaatccaatcggaagccatttgatatctataatagggtatctaatttcctgat

SEQ ID NO: 47216 - DNA, 75 bp, Artificial Sequence
  Synthetic
agtagctactcgtttggaatcacaaacattatttacatctaatttactatctgtaatggagacgtttcccaatga

SEQ ID NO: 47217 - DNA, 75 bp, Artificial Sequence
  Synthetic
cttgatatatttttttttaaagaggctggtaacaacgcatcgcttcgtttacatggctcgtaccaacaataatag

SEQ ID NO: 47218 - DNA, 75 bp, Artificial Sequence
  Synthetic
ctggtaacaacgcatcgcttcgtttacatggctcgtaccaacaataatagggtaatcttgtatctattcctatcc

SEQ ID NO: 47219 - DNA, 75 bp, Artificial Sequence
  Synthetic
acctaaataattgtactttgtaatataatgatatatattttcactttctcatttgagaataaaaatgtttttgtt

SEQ ID NO: 47220 - DNA, 75 bp, Artificial Sequence
  Synthetic
gtaatctctaaggttacgtatagtctatatgatcaaaaagagattaatgctacagatattatcattagtcatgtt

SEQ ID NO: 47221 - DNA, 75 bp, Artificial Sequence
  Synthetic
tacagatattatcattagtcatgttaaaaatgacgacgatatcggtaccgttaaagatggtagactaggtgctat

SEQ ID NO: 47222 - DNA, 75 bp, Artificial Sequence
  Synthetic
atattaacctaactaaaagacataacatagttgataaaaagcggtaggctataaatattatggctgctgccgttc

SEQ ID NO: 47223 - DNA, 75 bp, Artificial Sequence
  Synthetic
aagctttgaatgttatagttttctaaaatgtataacaaatacagaaatcaattcgttcgatgagtatatattaag

SEQ ID NO: 47224 - DNA, 75 bp, Artificial Sequence
  Synthetic
ggcactggggtaaagtaagtatttataaaactcatatagttaagcctgaatttatttcagaaattattcgtttac

SEQ ID NO: 47225 - DNA, 75 bp, Artificial Sequence
  Synthetic
tttatttcagaaattattcgtttactgaatcatatatgtattcactgcggattattgcgttcacgagaaccgtat

SEQ ID NO: 47226 - DNA, 75 bp, Artificial Sequence
  Synthetic
aaaggataaaatattatccaagaaaaagtcatgttggaacagtgaatgtatgcaaccgtatcaaaaaattacttt

SEQ ID NO: 47227 - DNA, 75 bp, Artificial Sequence
  Synthetic
aagtcatgttggaacagtgaatgtatgcaaccgtatcaaaaaattactttttcaaagaaaaaggtttgtttcgtc

SEQ ID NO: 47228 - DNA, 75 bp, Artificial Sequence
  Synthetic
gtcaattgattcttgttcactatatctaagaaacggatagcgtccctaggacgaactactgccattaatatctct

SEQ ID NO: 47229 - DNA, 75 bp, Artificial Sequence
  Synthetic
ccaattccaaagatccgacggtacaacattccaaagatcatattgtagaataccgttactagcgtatgatcctac

SEQ ID NO: 47230 - DNA, 75 bp, Artificial Sequence
  Synthetic
aatttctattcatgaaaagttttggccattattagaaattcatcaatatccagctaacttattttatacagacta

SEQ ID NO: 47231 - DNA, 75 bp, Artificial Sequence
  Synthetic
ccattattagaaattcatcaatatccagctaacttattttatacagactactttcccatccctccgttgattatt

SEQ ID NO: 47232 - DNA, 75 bp, Artificial Sequence
  Synthetic
taacgataagtccttcaaaatatattctaatattatgaatgagagataccttaatgtatattataaagatatgta

SEQ ID NO: 47233 - DNA, 75 bp, Artificial Sequence
  Synthetic
attaacttacttattaggtatgatcgttaagaattgtaacttgaatgctgatgaacaggttatccagaaggcggt

SEQ ID NO: 47234 - DNA, 75 bp, Artificial Sequence
  Synthetic
ctcttatgaatcgtatatcatcatctgaaatgatcatgtaaggcatacacttagcaattagtgacttgtctcctg

SEQ ID NO: 47235 - DNA, 75 bp, Artificial Sequence
  Synthetic
ataacttctttatacagttgaaacaaccgcttagaaataaacgagtatgtgtatgtggtatagatccgtatccta

SEQ ID NO: 47236 - DNA, 75 bp, Artificial Sequence
  Synthetic
aaagacaacacaggacgtatactctttatagggaaatactgttatccgcaataaatataaacaaatagacttttt

SEQ ID NO: 47237 - DNA, 75 bp, Artificial Sequence
  Synthetic
aataatatcgatgaccgcatcttctttgacatctagatagtcgcagttcatgatatcaaacatagaatcagatga

SEQ ID NO: 47238 - DNA, 75 bp, Artificial Sequence
  Synthetic
atgcccgcatatattagaaatacacttacagaaaagatatttgttaatgcctttacagtggataaagttaaacaa

SEQ ID NO: 47239 - DNA, 75 bp, Artificial Sequence
  Synthetic
atactacattaaaacttaaaaaataataatatcattattacaattaataagtataaactataaactataaactaa

SEQ ID NO: 47240 - DNA, 75 bp, Artificial Sequence
  Synthetic
tctggaacgaattctacaacattattataaaggactttgggtagataagtgggatgaaatcctattttaattaat

SEQ ID NO: 47241 - DNA, 75 bp, Artificial Sequence
  Synthetic
ttacagaaaagatatttgttaatgcctttacagtggataaagttaaacaactattagcgtcgaaccaagttaaat

SEQ ID NO: 47242 - DNA, 75 bp, Artificial Sequence
  Synthetic
tttatcaaaaataaaatacatttattgcctggtgattgggtagaagtagctgttcaagaatatacaagtattatt

SEQ ID NO: 47243 - DNA, 75 bp, Artificial Sequence
  Synthetic
tgcctggtgattgggtagaagtagctgttcaagaatatacaagtattatttttggaagacagccgtctctacata

SEQ ID NO: 47244 - DNA, 75 bp, Artificial Sequence
  Synthetic
aaaatatctcccggaattgccaactctcaaaatgctgatttcgacggagatgaagaatggatgatattggagcaa

SEQ ID NO: 47245 - DNA, 75 bp, Artificial Sequence
  Synthetic
tcctcgtttcctgtattctttttaagatcgaggaacgccataatatcagaatgccacggttccaagtatatggcc

SEQ ID NO: 47246 - DNA, 75 bp, Artificial Sequence
  Synthetic
aatcctaaagccgtagttgaacaaagtattcttatgtatccgacgacgttactcaaacacgatattcatggagcc

SEQ ID NO: 47247 - DNA, 75 bp, Artificial Sequence
  Synthetic
caatttatttctaaatctatgagagatcaacgaaaaggaagagtaggaagagttaatcctggtacatacgtctat

SEQ ID NO: 47248 - DNA, 75 bp, Artificial Sequence
  Synthetic
aaaaaaatcattcatgggtctgtgtttggacgcttttcatagactgtagtgagtggtcaatatcacatcctatgt

SEQ ID NO: 47249 - DNA, 75 bp, Artificial Sequence
  Synthetic
cccgtttatggatctattcaagatgaaatcgtagctgcgtattcattgtttaggatacaagatctttgtttagat

SEQ ID NO: 47250 - DNA, 75 bp, Artificial Sequence
  Synthetic
aaatcgtagctgcgtattcattgtttaggatacaagatctttgtttagatgaagtattgaacatcttggggaaat

SEQ ID NO: 47251 - DNA, 75 bp, Artificial Sequence
  Synthetic
atctatacttacttaataggtgaaaagattaattatccgggtctcttaaaggatggtgaaattattgcaaacgac

SEQ ID NO: 47252 - DNA, 75 bp, Artificial Sequence
  Synthetic
ttatctatattgtattctactcctttcttaatgcattttataccgaacaagagatagcgaaggaattctttttcg

SEQ ID NO: 47253 - DNA, 75 bp, Artificial Sequence
  Synthetic
taaggtaggagaagcgtgcgtaaaccatttttcagaaagtagattgtacgtctcaatagctgattctatatccca

SEQ ID NO: 47254 - DNA, 75 bp, Artificial Sequence
  Synthetic
cagatcctaatgcatgttatagatgcggatgcactgcgttacatgagtacttttataattatagatcagtcaacg

SEQ ID NO: 47255 - DNA, 75 bp, Artificial Sequence
  Synthetic
tgcggcatctgtcattggctggactcttatccgatcataagtcgaacgttgaagggataaactttattattaagt

SEQ ID NO: 47256 - DNA, 75 bp, Artificial Sequence
  Synthetic
ttcaaagatctgagaccaaattcgacgttcactaataaattggaggccatcaacgtagaaaaaatagaacttatc

SEQ ID NO: 47257 - DNA, 75 bp, Artificial Sequence
  Synthetic
aagatgtaagagacgggaaaatagttccattatctaaagctttagaggcggactatgtggaatccatgttatcca

SEQ ID NO: 47258 - DNA, 75 bp, Artificial Sequence
  Synthetic
cctctaacgggatatatgaatatgatttcagatactatatttgttcctgtagataataactaaaaatcaaactct

SEQ ID NO: 47259 - DNA, 75 bp, Artificial Sequence
  Synthetic
gatagaagaacatatgagacaaacgctgatagatgatccagataataatctcctgaaaatggccaaagcgggtta

SEQ ID NO: 47260 - DNA, 75 bp, Artificial Sequence
  Synthetic
ttctatacttgttggttaaatggtacagaaaatatcatattcctattatgaaactatatcctacacccgaagaga

SEQ ID NO: 47261 - DNA, 75 bp, Artificial Sequence
  Synthetic
tcctgaaaatggccaaagcgggttataaagtaaatcccacagaactaatgtatattctaggtacttatggacaac

SEQ ID NO: 47262 - DNA, 75 bp, Artificial Sequence
  Synthetic
agtttggattctcgtaagcggccagtatagaaattgttgctcccatggaatgacccaataagaagactggaactc

SEQ ID NO: 47263 - DNA, 75 bp, Artificial Sequence
  Synthetic
agaggatagatggcgaaccagcagagactcgagtattgggtagagtcttaccttactatcttccagactctaagg

SEQ ID NO: 47264 - DNA, 75 bp, Artificial Sequence
  Synthetic
ccttactatcttccagactctaaggatccagaaggaagaggttatattcttaattctttaacaaaaggattaact

SEQ ID NO: 47265 - DNA, 75 bp, Artificial Sequence
  Synthetic
tgcgtgtacattcatcgagtctagattcaagatctctaacacgtcgtcgttcttcctcaagttctctgcgtacta

SEQ ID NO: 47266 - DNA, 75 bp, Artificial Sequence
  Synthetic
ttcccaagtcttcagttctatcttctaaaaaatcttcagcgtatggaatataataatctattttacctcttctga

SEQ ID NO: 47267 - DNA, 75 bp, Artificial Sequence
  Synthetic
attataccaaaattctaggctcagtatgtaaacctgtagatcttatctatccagatgagtccatgacttggtatt

SEQ ID NO: 47268 - DNA, 75 bp, Artificial Sequence
  Synthetic
aataaaacagggattcgtttactctcagaaacagaaacttgcaaagaagacattggcgccgtttaatttcctagt

SEQ ID NO: 47269 - DNA, 75 bp, Artificial Sequence
  Synthetic
atttttcaggaagttagttctgactaataaacattgcctcaacaattattataatataagcgacagcaaatatgg

SEQ ID NO: 47270 - DNA, 75 bp, Artificial Sequence
  Synthetic
acgatatgattcataacgtcattgatgatgtgagagagaaatacttctttaccgtatctaatatagattttatgg

SEQ ID NO: 47271 - DNA, 75 bp, Artificial Sequence
  Synthetic
tcatcctcataaagaacactgcagccattttctatgaataaatcaataatttcaggaacaggatcatctgtcatt

SEQ ID NO: 47272 - DNA, 75 bp, Artificial Sequence
  Synthetic
aaaatgtagaattttttaaaaagttatcttttgctattaccaagattgtggttagacgcttattattaatatgag

SEQ ID NO: 47273 - DNA, 75 bp, Artificial Sequence
  Synthetic
tgatgtgagagagaaatacttctttaccgtatctaatatagattttatggagtatatctttttgactcatctgaa

SEQ ID NO: 47274 - DNA, 75 bp, Artificial Sequence
  Synthetic
agttctatgaaaaactcaattatactctaggtggtggaactcctattggaattatttctgcgcaggtattgtctg

SEQ ID NO: 47275 - DNA, 75 bp, Artificial Sequence
  Synthetic
tatcgcttttatttccacattagatggtaaatccaatagtgaaactatctttttaggaatgtatggactcgcgtt

SEQ ID NO: 47276 - DNA, 75 bp, Artificial Sequence
  Synthetic
ggaaaggatgattcgtcaaacgaataaacaatttcacaaatggatgttaatgtattagtaggaaatttcttgacg

SEQ ID NO: 47277 - DNA, 75 bp, Artificial Sequence
  Synthetic
ggtgcagtcaaacaaaaacttggtttcaacgagtttaataacttgactaatttgagtaagaataagaccgaaatt

SEQ ID NO: 47278 - DNA, 75 bp, Artificial Sequence
  Synthetic
tataatagtcaatagattatacatcaagagagcagaaattaccgaattagtcgtcgaatatatgattgaacgatt

SEQ ID NO: 47279 - DNA, 75 bp, Artificial Sequence
  Synthetic
atcttgactgtctatctctgtaaacacggagtcggtatctccatacacgctacgaaaacgaaatctgtaatctat

SEQ ID NO: 47280 - DNA, 75 bp, Artificial Sequence
  Synthetic
atgacgacttcaatcaaacaaaaaagctcaataagatgactgtagaactcatgaatctaaaagaattgggttctt

SEQ ID NO: 47281 - DNA, 75 bp, Artificial Sequence
  Synthetic
gctcaataagatgactgtagaactcatgaatctaaaagaattgggttctttcgatttggagaacgtcaacgtgta

SEQ ID NO: 47282 - DNA, 75 bp, Artificial Sequence
  Synthetic
aagtcttacatgacatagacatatatatcaaggatgtacaaatattaaaatctatttccatcactaataatataa

SEQ ID NO: 47283 - DNA, 75 bp, Artificial Sequence
  Synthetic
gatacttgtgcgaagccatgttaaacacctatggagaaggtttcgattatctgtatcagccttgtgatcttctcg

SEQ ID NO: 47284 - DNA, 75 bp, Artificial Sequence
  Synthetic
cacctatggagaaggtttcgattatctgtatcagccttgtgatcttctcgctagtttactatgtgctagttacga

SEQ ID NO: 47285 - DNA, 75 bp, Artificial Sequence
  Synthetic
gagctacgttcggagacaataaagcattgttaaacgcggctcttcataaaaagtcagaacctattaacgataata

SEQ ID NO: 47286 - DNA, 75 bp, Artificial Sequence
  Synthetic
gtacaggagttcaattttatatgatagttatcggtgttataatattggcagcgttgtttatgtactatgccaagc

SEQ ID NO: 47287 - DNA, 75 bp, Artificial Sequence
  Synthetic
attgttaaacgcggctcttcataaaaagtcagaacctattaacgataatagtagctgccacttttttagcaaggt

SEQ ID NO: 47288 - DNA, 75 bp, Artificial Sequence
  Synthetic
tatattgcttgttagcccaatctgtaaatatcggattattaacgtatcgtttctttgtatgtttgtttaacttgt

SEQ ID NO: 47289 - DNA, 75 bp, Artificial Sequence
  Synthetic
tcatgagaatggaaaggaaactatctgataagatatcttctcaaaagatcaaggagatggaagaaacagaagact

SEQ ID NO: 47290 - DNA, 75 bp, Artificial Sequence
  Synthetic
tgataagatatcttctcaaaagatcaaggagatggaagaaacagaagacttttaattcttatcaataacatattt

SEQ ID NO: 47291 - DNA, 75 bp, Artificial Sequence
  Synthetic
gcaatttctttttcgcagtcggttatatattctatataagatggatacgtatcacatgtgtacttatagtctact

SEQ ID NO: 47292 - DNA, 75 bp, Artificial Sequence
  Synthetic
agtccctcatagaatgatacacgtataaaaaatatagcataggcgatgactccttatttttagacattagatatg

SEQ ID NO: 47293 - DNA, 75 bp, Artificial Sequence
  Synthetic
tcgttcaacgaattattagtctgtctgtagataaactaggatttaaacaagaaagttatcggaaacatcaagaat

SEQ ID NO: 47294 - DNA, 75 bp, Artificial Sequence
  Synthetic
taaaaaatatagcataggcgatgactccttatttttagacattagatatgccaaaatcatagccccgcttctatt

SEQ ID NO: 47295 - DNA, 75 bp, Artificial Sequence
  Synthetic
aatcttccaagcatgtcgaatatatcagttttctaacattaactatagcgtgttcggttaatgatgccattttga

SEQ ID NO: 47296 - DNA, 75 bp, Artificial Sequence
  Synthetic
aaaacatatttgaacttaacttcagatgatggtgcatccatagcatttttataatttcccaaatacacattattg

SEQ ID NO: 47297 - DNA, 75 bp, Artificial Sequence
  Synthetic
atgatggtgcatccatagcatttttataatttcccaaatacacattattggttacccttgtcattatagtgggag

SEQ ID NO: 47298 - DNA, 75 bp, Artificial Sequence
  Synthetic
tatgttaataattggtattgtagttatacggctacaatttcataatgagtggaagtcagtgtcctatgatcaatg

SEQ ID NO: 47299 - DNA, 75 bp, Artificial Sequence
  Synthetic
agagcagcacaaactcattacgagacattgaaactaggatacataaaatttaagaaaatgattaggactactact

SEQ ID NO: 47300 - DNA, 75 bp, Artificial Sequence
  Synthetic
cttctccctttcccagaaacaaactttttttacccactataaaataaaatgagtatactacctattatatttctt

SEQ ID NO: 47301 - DNA, 75 bp, Artificial Sequence
  Synthetic
agacgtctgataatcaagtctttaatgaattaacgagatatatgcgaattaaaaatacggttaacgattggaaat

SEQ ID NO: 47302 - DNA, 75 bp, Artificial Sequence
  Synthetic
ttaggcgaggtactggagacgcgtggatggttaaaaaggcggcaaaggtcgatccatctgctcaacaattttgtc

SEQ ID NO: 47303 - DNA, 75 bp, Artificial Sequence
  Synthetic
taatgttattacttgtggtaatgagatgttaaatgaattaggttatagcggttattttatgtcaccgcattggtg

SEQ ID NO: 47304 - DNA, 75 bp, Artificial Sequence
  Synthetic
ttcctgtaaggaaccataacagtttagatttaacattaaagatgagcataaacataataaacaaaattacaatca

SEQ ID NO: 47305 - DNA, 75 bp, Artificial Sequence
  Synthetic
ttggtggagaaagtgttgaagatactgtttaaagatttgttcaagagtggagaatacaaagattacagatacgat

SEQ ID NO: 47306 - DNA, 75 bp, Artificial Sequence
  Synthetic
agatttaacattaaagatgagcataaacataataaacaaaattacaatcaaacctataacattaatatcaaacaa

SEQ ID NO: 47307 - DNA, 75 bp, Artificial Sequence
  Synthetic
tctatcggtggcgttatacatcttagttgtaaaagtggttttatactaacgggatctccatcatccacatgtatc

SEQ ID NO: 47308 - DNA, 75 bp, Artificial Sequence
  Synthetic
gagaaaaagtatctcctccatcacttggaaaacccgtttacataaacctaactacgaggcaatatatatacagtg

SEQ ID NO: 47309 - DNA, 75 bp, Artificial Sequence
  Synthetic
atttaggaaatgggtataacaaacccgaaaatttttggaaagacgctaaaagtaagaaaaggacatatagcgcaa

SEQ ID NO: 47310 - DNA, 75 bp, Artificial Sequence
  Synthetic
ttgatcttcatttcgttttcgattctggctatttcaaaataaaatcccgatgatagacctccagactttataatt

SEQ ID NO: 47311 - DNA, 75 bp, Artificial Sequence
  Synthetic
taactctaataatataggctgataagctaacatcataccctcctgtatatgtgaatatggcatgatctttgtcca

SEQ ID NO: 47312 - DNA, 75 bp, Artificial Sequence
  Synthetic
cctatgatgatgcagaattttggataacacggtattgatggtatctgttaccataattcctttgatggctgatag

SEQ ID NO: 47313 - DNA, 75 bp, Artificial Sequence
  Synthetic
tcctgtaataatttctctcatctgtaggatatctattttcttgtcatgcattgccttcaagacgggacgaagaaa

SEQ ID NO: 47314 - DNA, 75 bp, Artificial Sequence
  Synthetic
ctattaactaacttataaaactatcttataactattatcttataactattaactaacttataaaactatcttata

SEQ ID NO: 47315 - DNA, 75 bp, Artificial Sequence
  Synthetic
cgcaagcgggtttagacggcaacatagaagcgtgtaaacgaaaactatatactatagtcagcactcttccatgtc

SEQ ID NO: 47316 - DNA, 75 bp, Artificial Sequence
  Synthetic
ttttctacaacaactacatattctacctttttattttctagctcggtaaaaaatttagaatcccatagggctaaa

SEQ ID NO: 47317 - DNA, 75 bp, Artificial Sequence
  Synthetic
aaatttagaatcccatagggctaaatgtctagcgatatttcttttcgtttcctctgtacacatagtgttacaaaa

SEQ ID NO: 47318 - DNA, 75 bp, Artificial Sequence
  Synthetic
ccctgaaaagaagtgagtatacttgtcatcatctctaatgtttcctccagtccactgtataaacgcataatcctt

SEQ ID NO: 47319 - DNA, 75 bp, Artificial Sequence
  Synthetic
tatattctttgcttacggaacctatatttagaaacgtctactaacgatttttttatgcttgcattattaatggta

SEQ ID NO: 47320 - DNA, 75 bp, Artificial Sequence
  Synthetic
taacttcattgtccttcacatcatcgaacttctgatcattaatatgctcatgaacattaggaaatgtttctgatg

SEQ ID NO: 47321 - DNA, 75 bp, Artificial Sequence
  Synthetic
gaacttctgatcattaatatgctcatgaacattaggaaatgtttctgatggaggtctatcaataactggcacaac

SEQ ID NO: 47322 - DNA, 75 bp, Artificial Sequence
  Synthetic
ggaacacaaacataaactgaagtttaacattatttatttatgaatatatattatatatcgtttcggtatcgttat

SEQ ID NO: 47323 - DNA, 75 bp, Artificial Sequence
  Synthetic
agtgaaatctttaacaaacagcaagggttcgtcaaagacataaaactcattgtttacgatcgaaatagaccccct

SEQ ID NO: 47324 - DNA, 75 bp, Artificial Sequence
  Synthetic
taatttagacgatgtctactcgtatgttcctccttgtcaatgcactgttcaagaatttatattttccgcattaga

SEQ ID NO: 47325 - DNA, 75 bp, Artificial Sequence
  Synthetic
acaactctctaatacgagttatattttcgtctatccattgtttcacattgacatatttcgacaaaaagatataaa

SEQ ID NO: 47326 - DNA, 75 bp, Artificial Sequence
  Synthetic
atgtagatttattggctgtatagtcgcattcataaaaatatgtcaagtcttcatatggagtacttgtaggaactc

SEQ ID NO: 47327 - DNA, 75 bp, Artificial Sequence
  Synthetic
atgagttcttcttcgaatggcatcggatctccaaatctgaaaacgtataaataggagttagaataataatatttg

SEQ ID NO: 47328 - DNA, 75 bp, Artificial Sequence
  Synthetic
ttggaggatttatcacatactagtatttacaatgtagaaattagaaagattaaatccttaaatgattgtattaac

SEQ ID NO: 47329 - DNA, 75 bp, Artificial Sequence
  Synthetic
ctcgatttctatttttagatgtgatggaaaaatgactaattttgtagcattagtatcatgaactctaatcaaaat

SEQ ID NO: 47330 - DNA, 75 bp, Artificial Sequence
  Synthetic
ggaaaaatgactaattttgtagcattagtatcatgaactctaatcaaaatcttaatatcttcgtcacacgttagc

SEQ ID NO: 47331 - DNA, 75 bp, Artificial Sequence
  Synthetic
tctttgaactgtttaagagatgcatcagttggttccacggatggagtaggtgcaacaattttttgttctatacat

SEQ ID NO: 47332 - DNA, 75 bp, Artificial Sequence
  Synthetic
tgtatcattaggtaaagtaggacatgatagtacgactttaaatccattttcccaaatatctttacgaattacttt

SEQ ID NO: 47333 - DNA, 75 bp, Artificial Sequence
  Synthetic
tgcaacaattttttgttctatacatgtatgtattggagccattgtcttaactataatggtacttgtatcgaaaaa

SEQ ID NO: 47334 - DNA, 75 bp, Artificial Sequence
  Synthetic
tgggttctaacgccgatctctgaatggatactagttttctaagttctaatgtgattctctgaaaatgtaaatcca

SEQ ID NO: 47335 - DNA, 75 bp, Artificial Sequence
  Synthetic
ggatactagttttctaagttctaatgtgattctctgaaaatgtaaatccaattcctccggcattatagatgtgta

SEQ ID NO: 47336 - DNA, 75 bp, Artificial Sequence
  Synthetic
agaccagctaacagaatttattgtaacagtattattaatattgccaagttatccgatctaaaaaaaactatctat

SEQ ID NO: 47337 - DNA, 75 bp, Artificial Sequence
  Synthetic
tagtcttaaccaagaaatcgtatataaccacggagatggcgtatttaagagtggattcttctaccgttttgttct

SEQ ID NO: 47338 - DNA, 75 bp, Artificial Sequence
  Synthetic
aaccacggagatggcgtatttaagagtggattcttctaccgttttgttcttggatttcatataagaaactataaa

SEQ ID NO: 47339 - DNA, 75 bp, Artificial Sequence
  Synthetic
taagcatcttggaaacataaaataactctgtagacgatacttgactttcgaataagtttgcagacaaacgaagaa

SEQ ID NO: 47340 - DNA, 75 bp, Artificial Sequence
  Synthetic
tattcatcggtgtatgagtctacaggaatattatatttagtaataacatgatgaattattggcagcgatatatct

SEQ ID NO: 47341 - DNA, 75 bp, Artificial Sequence
  Synthetic
ctctgtagacgatacttgactttcgaataagtttgcagacaaacgaagaaagaacagacctctcttaatttcaga

SEQ ID NO: 47342 - DNA, 75 bp, Artificial Sequence
  Synthetic
aggtaacgacgtagtcgaacgttagttccaacaattgtttagctattcgtaacaaaactatttcagaacatagaa

SEQ ID NO: 47343 - DNA, 75 bp, Artificial Sequence
  Synthetic
aaaaaattaaacaatatcgttattatataagtaatatcaaaaatgatgatatacggattaatagcctgtcttata

SEQ ID NO: 47344 - DNA, 75 bp, Artificial Sequence
  Synthetic
agttaagaattagtcggttaatgttgtatttcattacccaagtttgagatttcataatattatcaaaagacatga

SEQ ID NO: 47345 - DNA, 75 bp, Artificial Sequence
  Synthetic
gtatttcattacccaagtttgagatttcataatattatcaaaagacatgataatattaaagataaagcgctgact

SEQ ID NO: 47346 - DNA, 75 bp, Artificial Sequence
  Synthetic
cattacggaagataaatcgtttaatagtgtagaggtattagtttccttgtttagagatgagcaaaaagactatac

SEQ ID NO: 47347 - DNA, 75 bp, Artificial Sequence
  Synthetic
atacgttgaagtatgtccatcttctctattgtttagactgtttgtagaatgctgtgatataaacaaactagtaga

SEQ ID NO: 47348 - DNA, 75 bp, Artificial Sequence
  Synthetic
tggaaacgataactgtatttttaatcacgtcagcggcatctaaattaaatataggtatatttattccacacactc

SEQ ID NO: 47349 - DNA, 75 bp, Artificial Sequence
  Synthetic
cacagctccatcagttttatatcctttagagtatttctcactagtgtctagcattctagagcattccatgatctg

SEQ ID NO: 47350 - DNA, 75 bp, Artificial Sequence
  Synthetic
tctggagataccattgaccaatataacttattggtcacggtttccaactataggtcatgcattgttcaaatcaga

SEQ ID NO: 47351 - DNA, 75 bp, Artificial Sequence
  Synthetic
cacgtcagcggcatctaaattaaatataggtatatttattccacacactctacaatatgccacaccatcttcata

SEQ ID NO: 47352 - DNA, 75 bp, Artificial Sequence
  Synthetic
taaaaattcacacatttttgataaatgggaactgctgcaacaattcagactcccaccaaattaatgaataaagag

SEQ ID NO: 47353 - DNA, 75 bp, Artificial Sequence
  Synthetic
acagagaatatgttactactatatttgccactgttttcataacgactatcctcgtcctcatcatcatcactatca

SEQ ID NO: 47354 - DNA, 75 bp, Artificial Sequence
  Synthetic
caactttcatagcttccttcaatctaatttgatgctcacacggtgcgaattctactctaacatcccttttccatg

SEQ ID NO: 47355 - DNA, 75 bp, Artificial Sequence
  Synthetic
aatttgatgctcacacggtgcgaattctactctaacatcccttttccatgcctcaggttcatcgatctctataat

SEQ ID NO: 47356 - DNA, 75 bp, Artificial Sequence
  Synthetic
ctgtatagtaactatgtaaatgataactagatagaaagatgtagctatatagatgacgatcctttaagagaggta

SEQ ID NO: 47357 - DNA, 75 bp, Artificial Sequence
  Synthetic
actagatagaaagatgtagctatatagatgacgatcctttaagagaggtataataactttaccccaatcagatag

SEQ ID NO: 47358 - DNA, 75 bp, Artificial Sequence
  Synthetic
gaaatcaattcgttcgatgagtatatattaagaggactattagaagctggtaatagtttacagatattttccaat

SEQ ID NO: 47359 - DNA, 75 bp, Artificial Sequence
  Synthetic
tttccaaatatacgtacttgacatctaaaaaatccttaatgataataggaatggataatccgtctattttataaa

SEQ ID NO: 47360 - DNA, 75 bp, Artificial Sequence
  Synthetic
atggataatccgtctattttataaagaaatacatatcgcacattatacttttttttggaaatgggaataccgatg

SEQ ID NO: 47361 - DNA, 75 bp, Artificial Sequence
  Synthetic
tttaagatgtcataattcgagaaagttaagaagatacctcaacgagttaaaaaaatataataacgataagtcctt

SEQ ID NO: 47362 - DNA, 75 bp, Artificial Sequence
  Synthetic
atagacgactagccaagtctattatttgcgaggatgactctcaaattattacactcacggcattcgttaaccaat

SEQ ID NO: 47363 - DNA, 75 bp, Artificial Sequence
  Synthetic
gtccaaattcttttccaagtacggtaatagattcttcatattgaacggtatcttcttgatctctggttctaattc

SEQ ID NO: 47364 - DNA, 75 bp, Artificial Sequence
  Synthetic
taaacttaacccattataaaacttatgattagtcacgactgaaataacagcatgattattttttggtataattct

SEQ ID NO: 47365 - DNA, 75 bp, Artificial Sequence
  Synthetic
cacctctaacatcatcatttaccaggatactgatcttcttttgtcgtaaatacatgtctaatgtgttaaaaaaaa

SEQ ID NO: 47366 - DNA, 75 bp, Artificial Sequence
  Synthetic
ctattaagtggtaagtttcgtacaaatacagaatccctaaaatattatctaatgttggattaatctttaccataa

SEQ ID NO: 47367 - DNA, 75 bp, Artificial Sequence
  Synthetic
ctttataatatatcgtatccacctaccaaagtatagttgtatttgtatttttttctcatgcgatgtgtgtaaaac

SEQ ID NO: 47368 - DNA, 75 bp, Artificial Sequence
  Synthetic
atctgtagtattcttgtcattgaaggataaactcgtactaatctcttctttaacagtctgttcaaatttatatcc

SEQ ID NO: 47369 - DNA, 75 bp, Artificial Sequence
  Synthetic
accttctacatataattatactatagataatggcaccgttgttactactgaagaactaaaagtgactccatcacc

SEQ ID NO: 47370 - DNA, 75 bp, Artificial Sequence
  Synthetic
tgatattatataattatcttagtgccggtataatgaagatgacgatgaaaatgatggtacatatatatttcgtat

SEQ ID NO: 47371 - DNA, 75 bp, Artificial Sequence
  Synthetic
taacagtctgttcaaatttatatcctatatacgaaaaaatagcaaccagtgtttgatcatccgcgtcaatattct

SEQ ID NO: 47372 - DNA, 75 bp, Artificial Sequence
  Synthetic
cgagtcccttgtgtaacgttagacattctaaatctatattattatctattacagcataaaacacatgcatttttt

SEQ ID NO: 47373 - DNA, 75 bp, Artificial Sequence
  Synthetic
acgttataaaggttgataacgaaaatatttttatttcgtgaaataaagtcatcgtaggattttggacttatattc

SEQ ID NO: 47374 - DNA, 75 bp, Artificial Sequence
  Synthetic
gcgtctagtagatatgcttttatttttggaatgatctcaattagaatagtctctttagagtccatttaaagttac

SEQ ID NO: 47375 - DNA, 75 bp, Artificial Sequence
  Synthetic
attctttattctatacttaaaaaatgaaaataaatacaaaggttcttgagagttgtgttaaattgaaagcgagaa

SEQ ID NO: 47376 - DNA, 75 bp, Artificial Sequence
  Synthetic
gaaaataaatacaaaggttcttgagagttgtgttaaattgaaagcgagaaataatcataaattatttcattatcg

SEQ ID NO: 47377 - DNA, 75 bp, Artificial Sequence
  Synthetic
cggatactagtagtttcacaaagatggctgaaatcagagctcatctaagaaatagcgctgaaaataaagataaaa

SEQ ID NO: 47378 - DNA, 75 bp, Artificial Sequence
  Synthetic
tttttgtttccgttccggatctatagaaaactacaggtgtgataattgccttggccaattgtctttctcttttac

SEQ ID NO: 47379 - DNA, 75 bp, Artificial Sequence
  Synthetic
ttggccaattgtctttctcttttactgagtgcttctagttcaccttctatagatctgagaatggatgattctcca

SEQ ID NO: 47380 - DNA, 75 bp, Artificial Sequence
  Synthetic
gtggaagaagaagtagttatagaggaatatcatcaaacaactgaagaaaattctccacctccgtcatcatctcct

SEQ ID NO: 47381 - DNA, 75 bp, Artificial Sequence
  Synthetic
aaagatcttaagaaaattattactagaatctctgcagtatcgactgttctagaggatgttcaagcagctggtatc

SEQ ID NO: 47382 - DNA, 75 bp, Artificial Sequence
  Synthetic
gaatctctgcagtatcgactgttctagaggatgttcaagcagctggtatctctagacaatttacttctatgacta

SEQ ID NO: 47383 - DNA, 75 bp, Artificial Sequence
  Synthetic
cgaatatccactattgcaactatacgttacaacgcttccatcggtataaaaatcctcgtatccgttatgtcttcc

SEQ ID NO: 47384 - DNA, 75 bp, Artificial Sequence
  Synthetic
gttcgtaaaaaagttaaaacttgtaagaagtaaatgcgtgcacttttttataaagatggtaaactgtttaccgat

SEQ ID NO: 47385 - DNA, 75 bp, Artificial Sequence
  Synthetic
agaagtaaatgcgtgcacttttttataaagatggtaaactgtttaccgataataattttttaaatcctgtatcag

SEQ ID NO: 47386 - DNA, 75 bp, Artificial Sequence
  Synthetic
ttaacagatgtagtagtatatgaacaaacgtgggaagaggcgttaactagattaatttttgtgggaagtgattca

SEQ ID NO: 47387 - DNA, 75 bp, Artificial Sequence
  Synthetic
gatgtcgtcgcttatcatactagtcatatcctaaatgttgatcatattccaccaaatgattgtgaaagagattga

SEQ ID NO: 47388 - DNA, 75 bp, Artificial Sequence
  Synthetic
ctttttataaaattgaagtaatatttagtattaattgctgccgtcgcattgtacaaatggagatattccctgtat

SEQ ID NO: 47389 - DNA, 75 bp, Artificial Sequence
  Synthetic
aaagatgctagtgtaccaatatgtgaatcatttttgcatcatttacgcgcacacaatacagaagatagcaaagag

SEQ ID NO: 47390 - DNA, 75 bp, Artificial Sequence
  Synthetic
tatcaattggcggtttttatgttaatggaaactatgttttttattagatttggtaaaatgaaatatcttaaggag

SEQ ID NO: 47391 - DNA, 75 bp, Artificial Sequence
  Synthetic
tgagtatttttacaaaaaaatgtataaagtgtatgtcttatgtatatttataaaaatgctaagtatgcgatgtat

SEQ ID NO: 47392 - DNA, 75 bp, Artificial Sequence
  Synthetic
aatttgttgttcataagtctaatagactatataaaccgctattgaaactgacggatgattctagtcccgaagaat

SEQ ID NO: 47393 - DNA, 75 bp, Artificial Sequence
  Synthetic
actatataaaccgctattgaaactgacggatgattctagtcccgaagaatttctgttcaacaaactaagtgaacg

SEQ ID NO: 47394 - DNA, 75 bp, Artificial Sequence
  Synthetic
catgagaagccggtagatcctgttgttaaattatttaatacatacgctggattagtatccgatagtaataaaatg

SEQ ID NO: 47395 - DNA, 75 bp, Artificial Sequence
  Synthetic
gaacgtatggagtcaattatacgtttttatataatttttggacaaatgtaaagtccatatctcctcttccgtcac

SEQ ID NO: 47396 - DNA, 75 bp, Artificial Sequence
  Synthetic
aatggtaaaggataaaaattttttagatgtagtatctaaaactacgttcgatgaattcctatctatagtcgtaga

SEQ ID NO: 47397 - DNA, 75 bp, Artificial Sequence
  Synthetic
ataagaatgattgattgtttgacgaatcacgagaactattgagacatatattattagaggtatatattataaaaa

SEQ ID NO: 47398 - DNA, 75 bp, Artificial Sequence
  Synthetic
acctatcaaggaacaaatattgtacggtagaattgataatataaatatgagcattagtatttctgtggattaata

SEQ ID NO: 47399 - DNA, 75 bp, Artificial Sequence
  Synthetic
ggtagaattgataatataaatatgagcattagtatttctgtggattaatagatttctagtatggggatcattaat

SEQ ID NO: 47400 - DNA, 75 bp, Artificial Sequence
  Synthetic
cattagatattatggcattgataatgtctatatttaaacgccatccaaacaataccattttttcagtggataagg

SEQ ID NO: 47401 - DNA, 75 bp, Artificial Sequence
  Synthetic
gtctatatttaaacgccatccaaacaataccattttttcagtggataaggatggtcagtttatgattgatttcga

SEQ ID NO: 47402 - DNA, 75 bp, Artificial Sequence
  Synthetic
tatcaatttatcatatatcacatccggcaaaaataatatgattagaagttatatcgtcgccagacgaaaagatca

SEQ ID NO: 47403 - DNA, 75 bp, Artificial Sequence
  Synthetic
tgaaaaaaaagctattatcaaatactgtacggaatggattcattctcttctctttttatgaaactctgttgtata

SEQ ID NO: 47404 - DNA, 75 bp, Artificial Sequence
  Synthetic
tatctggagatgaatgcaagactcacgcatcaagtatagccgaacaattggcgtgtgtggatattattaaagagg

SEQ ID NO: 47405 - DNA, 75 bp, Artificial Sequence
  Synthetic
cgcatcaagtatagccgaacaattggcgtgtgtggatattattaaagaggatattagcgaatatatcaaaactac

SEQ ID NO: 47406 - DNA, 75 bp, Artificial Sequence
  Synthetic
gagattctataatcgctttccagacgactcgagcctttattatagatttgtatctcctttctctttcgtattgtg

SEQ ID NO: 47407 - DNA, 75 bp, Artificial Sequence
  Synthetic
gtatcagtcgagatacagaaaagcttaaaatagctctagctaaaggcatagattacgaatatataaaagacgctt

SEQ ID NO: 47408 - DNA, 75 bp, Artificial Sequence
  Synthetic
aaaatagaaacatatatggtctatacatacactacaatttagttattaatgtggttattgattggataaccgatg

SEQ ID NO: 47409 - DNA, 75 bp, Artificial Sequence
  Synthetic
agtcgtttataataaaacacgatatggatgctaacgtagtatcatcttctactattgcgacgtatatagacgctt

SEQ ID NO: 47410 - DNA, 75 bp, Artificial Sequence
  Synthetic
tgataatcatcctaagatgataaaaaacttaactcaactgtttaaatttgttccctcggcagaggataactattt

SEQ ID NO: 47411 - DNA, 75 bp, Artificial Sequence
  Synthetic
ttccctcggcagaggataactatttagcaaaattaactgcattagtgaatggatgtgatttctttcctggactct

SEQ ID NO: 47412 - DNA, 75 bp, Artificial Sequence
  Synthetic
ggaagttatcgctgatcgtctagacgatatagtgaaacaaaatatagcggatgaaaaatttgtagattttgttat

SEQ ID NO: 47413 - DNA, 75 bp, Artificial Sequence
  Synthetic
aattagaaagtgatagaggtagacttctagccgctggtaaggatgatatattcgaattcaaatgtgtggatttcg

SEQ ID NO: 47414 - DNA, 75 bp, Artificial Sequence
  Synthetic
caagaatcgtttattcgatttaccgttactaataaggaaggtgtaaaaattagaactaagattccattatctaag

SEQ ID NO: 47415 - DNA, 75 bp, Artificial Sequence
  Synthetic
attatattttataagaatgattgtttgccaaatcacgagaactattaagacatatattattagaggtatatatta

SEQ ID NO: 47416 - DNA, 75 bp, Artificial Sequence
  Synthetic
gtacatggtctagatgtaaaaaatgtacagttagtagatgctatagataacatagtttgggaaaagaaatcatta

SEQ ID NO: 47417 - DNA, 75 bp, Artificial Sequence
  Synthetic
gtgacggaaaatcgtcttcacaaagaatgcttgttgagattatcgacagaggaacgtcatatatttttggattac

SEQ ID NO: 47418 - DNA, 75 bp, Artificial Sequence
  Synthetic
tttatactataatagtactagactgacttctaacaaacatctcacctgccataaataaatgcttgatattaaagt

SEQ ID NO: 47419 - DNA, 75 bp, Artificial Sequence
  Synthetic
catcaacagttacaaatgagttctgtgcagatcatccgttcatctatgtgattaggcatgttgatggcaaaattc

SEQ ID NO: 47420 - DNA, 75 bp, Artificial Sequence
  Synthetic
aaaagttccatatgatgaactaataaaggaattgacgactctctcgcgtcatatatttatggcttctccagagaa

SEQ ID NO: 47421 - DNA, 75 bp, Artificial Sequence
  Synthetic
ctgtttagtcgcggatatggaatttgatcctgccaaaatcaatacatcatctatagatcatgtaacaatattaca

SEQ ID NO: 47422 - DNA, 75 bp, Artificial Sequence
  Synthetic
tcagagttacatcaaaagggttgtattgttattttacacatcttgggtatattattagatatccagttaagagaa

SEQ ID NO: 47423 - DNA, 75 bp, Artificial Sequence
  Synthetic
taataacgtcatttacagtactattttcttgtaaatctaaatttttaatgattctattaacttcttgattattca

SEQ ID NO: 47424 - DNA, 75 bp, Artificial Sequence
  Synthetic
taatagattccgaagtagtagtctttggtgaggcagttaaggataagaactggactgtatatctcattaagctaa

SEQ ID NO: 47425 - DNA, 75 bp, Artificial Sequence
  Synthetic
tagactagaagaaagtaagtatgttgaatctaaactagtggatatttgtgatcggatagtattcaagtcaaagaa

SEQ ID NO: 47426 - DNA, 75 bp, Artificial Sequence
  Synthetic
agtgaagtcgtcgatatgttatctacatatttaccaaagcaaccagaaggtgttattctgttctattcaaaggga

SEQ ID NO: 47427 - DNA, 75 bp, Artificial Sequence
  Synthetic
aactgcaaatgtagtatttaggtacatgtccagtgaaccaattatctttggagagtcgtctatctttatagagta

SEQ ID NO: 47428 - DNA, 75 bp, Artificial Sequence
  Synthetic
tctcgtaggcacacaatctaatattgataaaatctccattctcttctctgcatttattatcttgtctcggtggct

SEQ ID NO: 47429 - DNA, 75 bp, Artificial Sequence
  Synthetic
tttcctaaagaatatggttctggtaagattgtgttatacaacggagttaattatctaaataatatctattgtttg

SEQ ID NO: 47430 - DNA, 75 bp, Artificial Sequence
  Synthetic
taacccattataaaacttatgattagtcacgactgaaataaccgcgtgattattttttggtataattctacacgg

SEQ ID NO: 47431 - DNA, 75 bp, Artificial Sequence
  Synthetic
ttatctaaataatatctattgtttggaatatattaatacacataatgaagtgggtattaagtccgtggttgtacc

SEQ ID NO: 47432 - DNA, 75 bp, Artificial Sequence
  Synthetic
gaatatattaatacacataatgaagtgggtattaagtccgtggttgtacctattaagtttatagcagaattctta

SEQ ID NO: 47433 - DNA, 75 bp, Artificial Sequence
  Synthetic
accaatacctgtaatcttgtcgaggaggacatatagtattcttgtattctaccgaatacccgagagatgcgatac

SEQ ID NO: 47434 - DNA, 75 bp, Artificial Sequence
  Synthetic
taactcagaagactattatggaaatcaacataatatcatagtcgaacatttaagagatcaaagcatcaaaatagg

SEQ ID NO: 47435 - DNA, 75 bp, Artificial Sequence
  Synthetic
ataatgataaatttagattaaatccagaagttagttattttacgaataaacgaactagaggaccgttgggaattt

SEQ ID NO: 47436 - DNA, 75 bp, Artificial Sequence
  Synthetic
tatcgaactacgtcaagactcttcttatttctatgtattgttccaaaacatttttagacgattccaacaaacgaa

SEQ ID NO: 47437 - DNA, 75 bp, Artificial Sequence
  Synthetic
tatttctatgtattgttccaaaacatttttagacgattccaacaaacgaaaggtattggcgattgattttggaaa

SEQ ID NO: 47438 - DNA, 75 bp, Artificial Sequence
  Synthetic
aaagtagatggtatctctgaaagaaagtatgatacaatacttacatcattaagcatgacggcatgataaaatgaa

SEQ ID NO: 47439 - DNA, 75 bp, Artificial Sequence
  Synthetic
cgacggatccggatgctgatgctatagctagaggaaatgaaagatacaacaaattaaattctggaattaaaacca

SEQ ID NO: 47440 - DNA, 75 bp, Artificial Sequence
  Synthetic
ctatggaaattatggataatcggtactaataaaaaaatagtttaactctttttagaaccagtttggtactggaat

SEQ ID NO: 47441 - DNA, 75 bp, Artificial Sequence
  Synthetic
actaccatggatggagacaaattatcaaaattaaccgataaaaagacttttataattcataagaatctacctagt

SEQ ID NO: 47442 - DNA, 75 bp, Artificial Sequence
  Synthetic
atcgttgagacctcccacaacggatgccgatgtcttttggataagtaatggtatgtattacgaagaagacgatga

SEQ ID NO: 47443 - DNA, 75 bp, Artificial Sequence
  Synthetic
ttgaccgattaagttttgattgatttttccgtgtaaggcgtatctagtcagatcgtatagcctatccaataatcc

SEQ ID NO: 47444 - DNA, 75 bp, Artificial Sequence
  Synthetic
tttttatatgcttgcattacagaatgatattcacaggtattattaaaatgagtatcggagttacattaccatatc

SEQ ID NO: 47445 - DNA, 75 bp, Artificial Sequence
  Synthetic
caaaattaaccgataaaaagacttttataattcataagaatctacctagtagtgaaaactatatgtctgtagaaa

SEQ ID NO: 47446 - DNA, 75 bp, Artificial Sequence
  Synthetic
ccaatgactgaatacattatcaaaaagaatgatatagtcagagtgtttaacgaatacggatttgttcttgtagat

SEQ ID NO: 47447 - DNA, 75 bp, Artificial Sequence
  Synthetic
caggatcatctgtcattacataattttctataactgaacgatggttttcgcatttaacactcaagtcaaatccat

SEQ ID NO: 47448 - DNA, 75 bp, Artificial Sequence
  Synthetic
tctacaagaaactttttcgaactaaatagaggagccattaaatgtgaaggtttagatgtcgaagacttacttagt

SEQ ID NO: 47449 - DNA, 75 bp, Artificial Sequence
  Synthetic
atagaggagccattaaatgtgaaggtttagatgtcgaagacttacttagttactatgttgtttatgtcttttcta

SEQ ID NO: 47450 - DNA, 75 bp, Artificial Sequence
  Synthetic
tcagagcacaagatttccaatcttttgcaattttcagtaccattatctttgttttgatatctatatcagacagca

SEQ ID NO: 47451 - DNA, 75 bp, Artificial Sequence
  Synthetic
attaaataattccaatagagcgatttttgttcctataggaccttccaactgtggatactctgtattgttaataga

SEQ ID NO: 47452 - DNA, 75 bp, Artificial Sequence
  Synthetic
tttgttcctataggaccttccaactgtggatactctgtattgttaatagatatattaatacttttgtcgggtaac

SEQ ID NO: 47453 - DNA, 75 bp, Artificial Sequence
  Synthetic
ttagatcaaagaatatgtgacaaagtcctagttgtatattgagaattgacgaaacaatgtttcttacatattttt

SEQ ID NO: 47454 - DNA, 75 bp, Artificial Sequence
  Synthetic
cataaataaaaacttggcgattctatatatactcttattatcaaatctagccattgtcttatagatgtgagctac

SEQ ID NO: 47455 - DNA, 75 bp, Artificial Sequence
  Synthetic
tatatactcttattatcaaatctagccattgtcttatagatgtgagctactgtaggtgtaccatttgattttctt

SEQ ID NO: 47456 - DNA, 75 bp, Artificial Sequence
  Synthetic
aatcttcctgtgtccaaggtaaaatcgtgtttgtgtagttttcacaatgatgccatcatagatatagaacctgat

SEQ ID NO: 47457 - DNA, 75 bp, Artificial Sequence
  Synthetic
taatgatatgtaacaataccgacttgtcaaacatgaatacagtacacaaacataaactgaagtttaacattattt

SEQ ID NO: 47458 - DNA, 75 bp, Artificial Sequence
  Synthetic
taaaatactactgttgagtaaatcagttattttttttatatcgatattgatggacatttttatagttaaggataa

SEQ ID NO: 47459 - DNA, 75 bp, Artificial Sequence
  Synthetic
gttattttttttatatcgatattgatggacatttttatagttaaggataataagtatcccaaagtcgataacgac

SEQ ID NO: 47460 - DNA, 75 bp, Artificial Sequence
  Synthetic
aaaattaacaaaattaaaggagcatgtatttttttctgaatatattgtgactccagataaatatggatctttatg

SEQ ID NO: 47461 - DNA, 75 bp, Artificial Sequence
  Synthetic
tatctactttatctattctgaatcatggagcagctggttctacggctgaacaactatcaaaatatatagagaatg

SEQ ID NO: 47462 - DNA, 75 bp, Artificial Sequence
  Synthetic
gtatttttttctgaatatattgtgactccagataaatatggatctttatgcgtcgaattaaatggatctagtttt

SEQ ID NO: 47463 - DNA, 75 bp, Artificial Sequence
  Synthetic
acaagttagatggtgttctacatccaatcatatatctgaagatatacccgaagatatacacactgataaatttgt

SEQ ID NO: 47464 - DNA, 75 bp, Artificial Sequence
  Synthetic
ttattgtctccgtattatcgtaattcagtagcccggcaaatggtcaatgatatgatgtttaatcaagattcattt

SEQ ID NO: 47465 - DNA, 75 bp, Artificial Sequence
  Synthetic
aaacgtggataaaatgcatgacgtgatagctcccgctaagcttttagaatatgtgcatataggaccgctagcaaa

SEQ ID NO: 47466 - DNA, 75 bp, Artificial Sequence
  Synthetic
acatataacaatagttagatacaaggataccgaagaattaaatctaacgagaatatgttataatagagataagtt

SEQ ID NO: 47467 - DNA, 75 bp, Artificial Sequence
  Synthetic
accgagatagaaataataggaggtaatgatatgtatcaatcggtgtgtagaaagtgttacatcgactcataatat

SEQ ID NO: 47468 - DNA, 75 bp, Artificial Sequence
  Synthetic
ctgtatcacacgcaccatatactattacttatcacaatgattgggaaccagtaatgagtcaattggtagagtttt

SEQ ID NO: 47469 - DNA, 75 bp, Artificial Sequence
  Synthetic
tggtgtcagggggatacgttcgatagaaacatatgccatcagtggatcggttcagcctttaataggagtgataga

SEQ ID NO: 47470 - DNA, 75 bp, Artificial Sequence
  Synthetic
aaagtatctatgttccatcgaacatataactaaaaaggaggatagtagagctagagataatataactatcacgac

SEQ ID NO: 47471 - DNA, 75 bp, Artificial Sequence
  Synthetic
aatcaccaaattttacaaaaaaatcaattaaggagatagcttcatctatatctagattaaccggagtaattgatt

SEQ ID NO: 47472 - DNA, 75 bp, Artificial Sequence
  Synthetic
tctagattaaccggagtaattgattataaaggttataaccttaatataatagacggggttataccctggaattat

SEQ ID NO: 47473 - DNA, 75 bp, Artificial Sequence
  Synthetic
ataaaggttataaccttaatataatagacggggttataccctggaattattacttaagttgtaaattaggagaaa

SEQ ID NO: 47474 - DNA, 75 bp, Artificial Sequence
  Synthetic
catataactaaacacgttagtgttctttattgtttgggtaaaacagatttctctaatatacgggcaaagttagaa

SEQ ID NO: 47475 - DNA, 75 bp, Artificial Sequence
  Synthetic
actattgttttgttggagaacttgatacgccgcattctctgtagtcgacgctctcaaatgggaaacgatctccat

SEQ ID NO: 47476 - DNA, 75 bp, Artificial Sequence
  Synthetic
attatcaacgttttactggaattagacaataaggcacctataaattgggctcaagggtttatttattaatgcttt

SEQ ID NO: 47477 - DNA, 75 bp, Artificial Sequence
  Synthetic
tcaagggtttatttattaatgctttagtgaaattttaacttgtgttctaaatggatgtgactattagaggtaatg

SEQ ID NO: 47478 - DNA, 75 bp, Artificial Sequence
  Synthetic
gttcttaataaggtagcaacttcagggttctttacaggacaaaatagatatcagaatatttcaaaggtgtgcact

SEQ ID NO: 47479 - DNA, 75 bp, Artificial Sequence
  Synthetic
aatgaagatccaagattcgtagaagcatttaaatgcgacgagttagaaagatatattgagaataatccagaatgt

SEQ ID NO: 47480 - DNA, 75 bp, Artificial Sequence
  Synthetic
catttaaatgcgacgagttagaaagatatattgagaataatccagaatgtacactattcgaaagtcttagggatg

SEQ ID NO: 47481 - DNA, 75 bp, Artificial Sequence
  Synthetic
gtaaatgccttcttaagctatttggaaaccaaggttgttagttaataatatacaagatatttttttctccctctg

SEQ ID NO: 47482 - DNA, 75 bp, Artificial Sequence
  Synthetic
tcagaatatttcaaaggtgtgcactctgaatttcgagattaaatgtaataacaaagattcttattcttcctccaa

SEQ ID NO: 47483 - DNA, 75 bp, Artificial Sequence
  Synthetic
tgtctagacgaaatagattatttaacggctattcaagattttattatcgaggtgtcaaactgtgtagctagattc

SEQ ID NO: 47484 - DNA, 75 bp, Artificial Sequence
  Synthetic
tcctcatccacaacaccattaaaaaaatggaaaataaagccctctattagcacagacggctacaggtctaccatc

SEQ ID NO: 47485 - DNA, 75 bp, Artificial Sequence
  Synthetic
tcatgtgggtaatgttctcgatgtcgatagccatatgcccggtagttgcgatatacataaactgattactaattc

SEQ ID NO: 47486 - DNA, 75 bp, Artificial Sequence
  Synthetic
atgaaaatgtaataaaatccatgagatctaatttttcattgactaagtctacaaatagagataaaacaagttttc

SEQ ID NO: 47487 - DNA, 75 bp, Artificial Sequence
  Synthetic
aaacgaacactattagaattaagtagatcatctgaaaatccactaaccagatcgatagacactgccgtatatagg

SEQ ID NO: 47488 - DNA, 75 bp, Artificial Sequence
  Synthetic
gatcatctgaaaatccactaaccagatcgatagacactgccgtatataggagaaaaacaactcttcgggttgtag

SEQ ID NO: 47489 - DNA, 75 bp, Artificial Sequence
  Synthetic
ccaacaaatttggaatttattaatacaggatctagcaaaggaaattgtgccattaaggcgttgatgcaattgacg

SEQ ID NO: 47490 - DNA, 75 bp, Artificial Sequence
  Synthetic
catgataatatagaagattacctattcacttacgtggatatgaataacgatagttattacttttctctacaacga

SEQ ID NO: 47491 - DNA, 75 bp, Artificial Sequence
  Synthetic
cgattggaggatttagttcctgataagttatgggaaccagggtttatttcattcgaagacgctataaaaagagtt

SEQ ID NO: 47492 - DNA, 75 bp, Artificial Sequence
  Synthetic
ctcactaatactctcactcactcatacactcactcatactctcactcactcactcacacactcactcactcacta

SEQ ID NO: 47493 - DNA, 75 bp, Artificial Sequence
  Synthetic
agtcgtaaaaggagatcccaccacttattacactgtcgtcggtggaggtcttaagatggactttggattcaccaa

SEQ ID NO: 47494 - DNA, 75 bp, Artificial Sequence
  Synthetic
taattttacaacggtaccactggtcatagattatgtaacaccttgtgcattatgtaaaaaacgatcgcataaaca

SEQ ID NO: 47495 - DNA, 75 bp, Artificial Sequence
  Synthetic
tatgtaaaaaacgatcgcataaacatccacatcaactatcgttggaaaatggtgctattagaatttacaaaactg

SEQ ID NO: 47496 - DNA, 75 bp, Artificial Sequence
  Synthetic
aattgttccgttggatggaaacaaactgtttaatattgcacaaagaattttagacactaactctgttttattaac

SEQ ID NO: 47497 - DNA, 75 bp, Artificial Sequence
  Synthetic
ctgtttaatattgcacaaagaattttagacactaactctgttttattaaccgaacgaggagatcatatagtttgg

SEQ ID NO: 47498 - DNA, 75 bp, Artificial Sequence
  Synthetic
aattctgtcaataagacatcaactacctaaggaatattcaagcgaattactttgtccgaggaaacgaaagacggt

SEQ ID NO: 47499 - DNA, 75 bp, Artificial Sequence
  Synthetic
agaagctaacatacgagacatgttagtagattcagtagagaccgatacctatccggataaacttccgtttaaaaa

SEQ ID NO: 47500 - DNA, 75 bp, Artificial Sequence
  Synthetic
tatcgtctttgttagcatcacagaatgcataaatttgttcgtccgtcatgataaaaatttaaagtgtaaatataa

SEQ ID NO: 47501 - DNA, 75 bp, Artificial Sequence
  Synthetic
tccaacgaactcacgtcgaatataaatgatttcgatctgtattcgtatatgtcttcggataatatagacttacgt

SEQ ID NO: 47502 - DNA, 75 bp, Artificial Sequence
  Synthetic
tggtgtattggacctggtagacggaatgttttactctggagatgatgctaaaaaatatacgtgtactgtatcaac

SEQ ID NO: 47503 - DNA, 75 bp, Artificial Sequence
  Synthetic
taccagtgtaccaggttctaacaacctatttactggtgctcctgtagcatactttttctttaccttgagaatatc

SEQ ID NO: 47504 - DNA, 75 bp, Artificial Sequence
  Synthetic
atctgagaatggatgattctccagctgaaacatattctaccatggctccgtttaatttgttgatgaagatggatt

SEQ ID NO: 47505 - DNA, 75 bp, Artificial Sequence
  Synthetic
atggcttcttaaatcagaatgttacagcaccggttacgtatttcgtagctgtatgtacgatagcgataggtgtaa

SEQ ID NO: 47506 - DNA, 75 bp, Artificial Sequence
  Synthetic
tgctaccaaaggatgtttaacattcttttttggagaaactgcaactggaaagtcgacaaccaaacgtttgttaaa

SEQ ID NO: 47507 - DNA, 75 bp, Artificial Sequence
  Synthetic
tactacaactagtgaagtcgtcgatatgttgtctacatatttaccaaaacaaccagaaggtgttattctattcta

SEQ ID NO: 47508 - DNA, 75 bp, Artificial Sequence
  Synthetic
gaaaattagatctgataatattaaaaagttgacagaaccttgtgtcattggaagaccgtgtttctccaataaaat

SEQ ID NO: 47509 - DNA, 75 bp, Artificial Sequence
  Synthetic
aagttgacagaaccttgtgtcattggaagaccgtgtttctccaataaaattaataatagaaaccatgcgacaatc

SEQ ID NO: 47510 - DNA, 75 bp, Artificial Sequence
  Synthetic
aatgagaagaattgccgtcgtgcgattcagaacacacttttctcaaccttctggtagagaggctgctgaaaataa

SEQ ID NO: 47511 - DNA, 75 bp, Artificial Sequence
  Synthetic
ttcagaacacacttttctcaaccttctggtagagaggctgctgaaaataatgacgcgtacgataaagtcaaacta

SEQ ID NO: 47512 - DNA, 75 bp, Artificial Sequence
  Synthetic
gcaaatagatagaactaccaatatgtctgtacaaatgttaaacattaattgattaacagaaaaaacaatgttcgt

SEQ ID NO: 47513 - DNA, 75 bp, Artificial Sequence
  Synthetic
gttgttgaatctattttggtcattaaatctttcatttcttcctggtatatttctatcacctcgtttggttggatt

SEQ ID NO: 47514 - DNA, 75 bp, Artificial Sequence
  Synthetic
gctctgtaaagcatattccattaatgacggacctctccaaaaagggatatatattgtacgataatgtggtcactc

SEQ ID NO: 47515 - DNA, 75 bp, Artificial Sequence
  Synthetic
catgtcttaaagttattaattaattacatgttgttttatatatcgctacgaatttaaacagagaaatcagtttag

SEQ ID NO: 47516 - DNA, 75 bp, Artificial Sequence
  Synthetic
atattgtacgataatgtggtcactcttccgttgaatactttccaacagaaaatatccaagtattttaattctaga

SEQ ID NO: 47517 - DNA, 75 bp, Artificial Sequence
  Synthetic
aaatgttagtgatgaatatctgcaatatatattcatagaggatatttcatctccgtaaatatatgctcatatatt

SEQ ID NO: 47518 - DNA, 75 bp, Artificial Sequence
  Synthetic
tatatattcatagaggatatttcatctccgtaaatatatgctcatatatttatagaagatatcacatatctaaat

SEQ ID NO: 47519 - DNA, 75 bp, Artificial Sequence
  Synthetic
ctatattacctcatcagttagctactctagattatctagttagaactatcatagatgagaacagaagcgtgttat

SEQ ID NO: 47520 - DNA, 75 bp, Artificial Sequence
  Synthetic
cgatacatttgtctctagtgtcagagaagtattctattttggaaagtttaatatcatcgactggcagtttgctat

SEQ ID NO: 47521 - DNA, 75 bp, Artificial Sequence
  Synthetic
tgttccatattatgggatcaggtaaaacaataatcgctttgttgttcgccttggtagcttccagatttaaaaagg

SEQ ID NO: 47522 - DNA, 75 bp, Artificial Sequence
  Synthetic
atgggtgtagctatgaacttgtttaatgacgaattcatagctgagaatatctttattcattccacaacaagtttt

SEQ ID NO: 47523 - DNA, 75 bp, Artificial Sequence
  Synthetic
gagtatgttagtggacttgtcaaatctatataccatattttctggaagtggatatacatagttgtgatcatcatt

SEQ ID NO: 47524 - DNA, 75 bp, Artificial Sequence
  Synthetic
tgtttttcgttgtttaagttggttgaatagtatatcttaataattgttattatttcactaattaatatttagtaa

SEQ ID NO: 47525 - DNA, 75 bp, Artificial Sequence
  Synthetic
ataatactggagaacttatgaccgtgataaaaaataaaaacaagattccttttctactattgtctggatctccca

SEQ ID NO: 47526 - DNA, 75 bp, Artificial Sequence
  Synthetic
gataaaaaataaaaacaagattccttttctactattgtctggatctcccattactaacacacctaatacgctggg

SEQ ID NO: 47527 - DNA, 75 bp, Artificial Sequence
  Synthetic
gagatatcaaagaatgtggaatgtctaggacgcgtaattttaatattatatagatcctgtaagcgttgtctatat

SEQ ID NO: 47528 - DNA, 75 bp, Artificial Sequence
  Synthetic
gtattatgtatcatatttcattattatgaggaggaaatttatgtcatatcatgaaacatttattgtaattaataa

SEQ ID NO: 47529 - DNA, 75 bp, Artificial Sequence
  Synthetic
agtagtctattaactcttttattttctagccatcgtaacaccatgtttaagatagtaattctctagttactacga

SEQ ID NO: 47530 - DNA, 75 bp, Artificial Sequence
  Synthetic
tattccccatagactatcgacgattatactctgtattagttctatcggaggatgtgttatctctatagataatga

SEQ ID NO: 47531 - DNA, 75 bp, Artificial Sequence
  Synthetic
gattctataatcgctttccagataactcgagcatttattatagacttgtacctcctttctctttcgtattgtgta

SEQ ID NO: 47532 - DNA, 75 bp, Artificial Sequence
  Synthetic
tgtcttagaaaactattacttagaccattttctttataaaacgaatatatagtactccaattatctttaccgata

SEQ ID NO: 47533 - DNA, 75 bp, Artificial Sequence
  Synthetic
ctagagtagtatattgtcacatgtctaaacttcaagagagagattatatgattactagacgacagctatgttatc

SEQ ID NO: 47534 - DNA, 75 bp, Artificial Sequence
  Synthetic
attactagacgacagctatgttatcatgaaatgtttgataaaaatatgtataacgtgtcgatggcagtattggga

SEQ ID NO: 47535 - DNA, 75 bp, Artificial Sequence
  Synthetic
ggaattgtacccaaatctgaaaataaataatggtgtgttatacggagaagaattggtaacgttaaacattagttc

SEQ ID NO: 47536 - DNA, 75 bp, Artificial Sequence
  Synthetic
ccacctccgtcatcatctcctggagttggtgacattgtagaaagcgtggccgctgtagagctcgatgatagcgac

SEQ ID NO: 47537 - DNA, 75 bp, Artificial Sequence
  Synthetic
tggcggattggtaattaaatatatcatgctcagtaatggatattctgaatataatggttctcagggaactaatcc

SEQ ID NO: 47538 - DNA, 75 bp, Artificial Sequence
  Synthetic
tgaaatcgtctttagaggatctattagatgtgtataattctcctgaaaatgatgatggtagtcaattgatgtttt

SEQ ID NO: 47539 - DNA, 75 bp, Artificial Sequence
  Synthetic
catatttggtttatgactatcccagatactttttctcaatacaaccaaattcttggacgatctattagaaaattc

SEQ ID NO: 47540 - DNA, 75 bp, Artificial Sequence
  Synthetic
aaattcaagaccaaagaaacgaatagaatatactctattcttcaagagatgtctgaaacgtattctcttccacca

SEQ ID NO: 47541 - DNA, 75 bp, Artificial Sequence
  Synthetic
ccataactgtataaaatggagacggagtcataactattttaccgtttgtacttactggaatagatgaaggaataa

SEQ ID NO: 47542 - DNA, 75 bp, Artificial Sequence
  Synthetic
gaatatactctattcttcaagagatgtctgaaacgtattctcttccaccacatccatcaattgtaaaagttttat

SEQ ID NO: 47543 - DNA, 75 bp, Artificial Sequence
  Synthetic
tggtaattaaaccgtacgaggtacccatcagtgatatgcaactgctaaaaatggcaacgcctggtgaaccagaat

SEQ ID NO: 47544 - DNA, 75 bp, Artificial Sequence
  Synthetic
aacgactccaagttacttaaaatggttacatcagttataaaaaataaagaagacgctaggaattacatagatgat

SEQ ID NO: 47545 - DNA, 75 bp, Artificial Sequence
  Synthetic
ccgtttaataatatcttgaatcttattccattatctgaaatggtggtaaaactaactgcagtgtgtatgaaatgc

SEQ ID NO: 47546 - DNA, 75 bp, Artificial Sequence
  Synthetic
taactgtgtgattataactgtatatatccccatcgctacagtatccatcatctggatcataattatttatacgag

SEQ ID NO: 47547 - DNA, 75 bp, Artificial Sequence
  Synthetic
ttacatcagttataaaaaataaagaagacgctaggaattacatagatgatattgtaaacggtcacttctttgtaa

SEQ ID NO: 47548 - DNA, 75 bp, Artificial Sequence
  Synthetic
tttaaggaagcttccttttctaaacgattaggtgcagaaaccgagatagagataatcggaggtaatgatatgtat

SEQ ID NO: 47549 - DNA, 75 bp, Artificial Sequence
  Synthetic
tctaaaaagtatgttgtacggaaagaaccattacaaacattatccatactagaaatgaaatgaaatgaaatgaaa

SEQ ID NO: 47550 - DNA, 75 bp, Artificial Sequence
  Synthetic
attacagtaccgtttagactttcctacgaaccgtttgtttggggagttaactttcgtaaagaatataacgtggta

SEQ ID NO: 47551 - DNA, 75 bp, Artificial Sequence
  Synthetic
aaacttggtttcaacgagtttaataacttgactaatttgagtaaaaataagaccgaaattatcactctggtatcc

SEQ ID NO: 47552 - DNA, 75 bp, Artificial Sequence
  Synthetic
gaccgaaattatcactctggtatccgatgatatctctaaacttcaatctgttaagattaatttcgaatttgtatg

SEQ ID NO: 47553 - DNA, 75 bp, Artificial Sequence
  Synthetic
ctttcgtaaagaatataacgtggtatcttctccataaaactgatgagatatataaagaaataaatgtcgagcttt

SEQ ID NO: 47554 - DNA, 75 bp, Artificial Sequence
  Synthetic
agacataaaaactaatattaggaatgccgtatataagacgtatctccatagagaaattagtggtaaaatggccaa

SEQ ID NO: 47555 - DNA, 75 bp, Artificial Sequence
  Synthetic
catcaacgagttaaaaaagaccagttcattcaagataagcaaacgcgataaggatacgttactaaaatattttac

SEQ ID NO: 47556 - DNA, 75 bp, Artificial Sequence
  Synthetic
gagaaattagtggtaaaatggccaagaaaatagaaattcgtgaagacgtggaattacctctcggcgaaatagtta

SEQ ID NO: 47557 - DNA, 75 bp, Artificial Sequence
  Synthetic
accgaattagtcgtcgaatatatgattgaacgattcatctcctttagcgtcattgtaaaggaatggggtatggaa

SEQ ID NO: 47558 - DNA, 75 bp, Artificial Sequence
  Synthetic
ccatcatctatgttgtttatcgtgtcctccgggaacatacgcttccagattatgcgatagcaagactaacacaaa

SEQ ID NO: 47559 - DNA, 75 bp, Artificial Sequence
  Synthetic
catttcaagaagggtgggtggagagaactctatatgatagcttgtgaaacaattagatccctaatttctaatgga

SEQ ID NO: 47560 - DNA, 75 bp, Artificial Sequence
  Synthetic
cacgttggggatatagtcagaggaacattaaacatcgaagatgaatcaaatgtaactattcaatgtggagattta

SEQ ID NO: 47561 - DNA, 75 bp, Artificial Sequence
  Synthetic
agtaagtttatgatggttcttccgggtgccgccaacaagggcaagattagtaaattcaagattcctatctctgat

SEQ ID NO: 47562 - DNA, 75 bp, Artificial Sequence
  Synthetic
acgaatactatggcaataattgcaaatgttttattcccttcgatatatttttgataatatgaaaaacatgcctct

SEQ ID NO: 47563 - DNA, 75 bp, Artificial Sequence
  Synthetic
ttgataatatgaaaaacatgcctctctcaaatcggacaaccatttcataaaatagttctctcgcgctggcgaggt

SEQ ID NO: 47564 - DNA, 75 bp, Artificial Sequence
  Synthetic
gcggaaccaataacggaaatcccaaatgttggaaaatagacggttccgaagatccaaaacatagaggtagaggat

SEQ ID NO: 47565 - DNA, 75 bp, Artificial Sequence
  Synthetic
caattttgtttttttactttctaatatagtgtttagattctttttcatatgagaatattgatttactaaaatatc

SEQ ID NO: 47566 - DNA, 75 bp, Artificial Sequence
  Synthetic
ggttgatagttgttcctagatatgtaaaataatccaacgtactaggcagcaaattgtctagataaaatactgaat

SEQ ID NO: 47567 - DNA, 75 bp, Artificial Sequence
  Synthetic
ttatcaaacacatatacgaacaatatcttattccggtatctgaagtactattaaaacctatgatgtccatgggtg

SEQ ID NO: 47568 - DNA, 75 bp, Artificial Sequence
  Synthetic
taccgatatagagtataatgatttagttactttaataaccgttagacataaaattgattctatgaaaactgtatt

SEQ ID NO: 47569 - DNA, 75 bp, Artificial Sequence
  Synthetic
ttttttgcctcttcataagaactatattttttcttattccaatgaaccagattaatctctccagagtatttgtat

SEQ ID NO: 47570 - DNA, 75 bp, Artificial Sequence
  Synthetic
attaatctctccagagtatttgtatacatctatcaagtgattggatccataatcgtcttcctttccccaatatat

SEQ ID NO: 47571 - DNA, 75 bp, Artificial Sequence
  Synthetic
ttggggagaaaccctccacttatatatcctcctttaaaattaatccttactagttttccagtattctggatagtg

SEQ ID NO: 47572 - DNA, 75 bp, Artificial Sequence
  Synthetic
atcctcctttaaaattaatccttactagttttccagtattctggatagtggttggtttcgactcattataatgta

SEQ ID NO: 47573 - DNA, 75 bp, Artificial Sequence
  Synthetic
ttaataggagatagttgttgagtcatagtaaaaatgaaatgataactgtttagaaatagctcttagtatgggaat

SEQ ID NO: 47574 - DNA, 75 bp, Artificial Sequence
  Synthetic
tagaaatagctcttagtatgggaattacaatggatgaggaagtgatatttgaaactcctagagaattaatatcta

SEQ ID NO: 47575 - DNA, 75 bp, Artificial Sequence
  Synthetic
tttagaatacgttagagaaaaggctatagttggcgtacaagcagccaagacatcaacacttatattctttgttat

SEQ ID NO: 47576 - DNA, 75 bp, Artificial Sequence
  Synthetic
gcgtgtataacaagtgacggatatccgttaataggagctagaagaacttcattcgcattccaggcgatattatct

SEQ ID NO: 47577 - DNA, 75 bp, Artificial Sequence
  Synthetic
cgttaataggagctagaagaacttcattcgcattccaggcgatattatctcaacaaaattcagattctatcttta

SEQ ID NO: 47578 - DNA, 75 bp, Artificial Sequence
  Synthetic
atctttagacggttgagaaaaggttctatcaacaatatcgatcctcacttcgaagagttaatattattgggtggt

SEQ ID NO: 47579 - DNA, 75 bp, Artificial Sequence
  Synthetic
atacagataatgccaaacacctggcgttggctaggtatatgtatcaaacaggagactataagcctttgtttagtc

SEQ ID NO: 47580 - DNA, 75 bp, Artificial Sequence
  Synthetic
tgtagaaagataagtaatcgtcatattcctttttatttgtggcgcttattgtgttgttttctggattctcaaagt

SEQ ID NO: 47581 - DNA, 75 bp, Artificial Sequence
  Synthetic
cgatacaaagttcgtcgaagacagtccagaaatggaagagttaatgaatatcattaacgatatccaaccattaac

SEQ ID NO: 47582 - DNA, 75 bp, Artificial Sequence
  Synthetic
attgagatggagattcatgagacttcttgctagcaatataaaagtatttgtgtaatgaatatctttccatctcga

SEQ ID NO: 47583 - DNA, 75 bp, Artificial Sequence
  Synthetic
cgcgcgttcaacattttatggaaactataattttgtgaaaacaggtaacaagaaaactcgtcatcgttcaaattt

SEQ ID NO: 47584 - DNA, 75 bp, Artificial Sequence
  Synthetic
tgcatggcatgttttattaatcaatcgttggaggatttatcacatactagtatttacaatgtagaaattagaaag

SEQ ID NO: 47585 - DNA, 75 bp, Artificial Sequence
  Synthetic
attaaatccttaaatgattgtattaacgatgataaatacgaatatctgtcttatatttataatatgctagttaat

SEQ ID NO: 47586 - DNA, 75 bp, Artificial Sequence
  Synthetic
acccaataatcaaatgtgcccttgtattgtatctaccggatatgtgtcattaataatacatgctaaaggcccgta

SEQ ID NO: 47587 - DNA, 75 bp, Artificial Sequence
  Synthetic
cctgtttgttgagacgggtcaaacaattttaacagatgtattggataaaggacctaatccatttatcgctaatat

SEQ ID NO: 47588 - DNA, 75 bp, Artificial Sequence
  Synthetic
tgttgagataagcatagtcttcaacacctctaataggtataatattattatatggtttattatcacaattcaacc

SEQ ID NO: 47589 - DNA, 75 bp, Artificial Sequence
  Synthetic
ggctaaaacacatttctctaccacaggagaatggccgttgataataagtaccgatcaggatactatgctatttgc

SEQ ID NO: 47590 - DNA, 75 bp, Artificial Sequence
  Synthetic
tagtggtatatcttgttctatgtatctaaaataatgtctgacgagatccgttagtttaatatcctcagtcatctt

SEQ ID NO: 47591 - DNA, 75 bp, Artificial Sequence
  Synthetic
ttttattctctttctctcttcaatggtctcataaaaaaagttttacaaaaatatttttattctctttctctcttc

SEQ ID NO: 47592 - DNA, 75 bp, Artificial Sequence
  Synthetic
tgataacaaaatattagtatgtaacagacgagatagttttctctattctgaaataattagaactagaaacatgtc

SEQ ID NO: 47593 - DNA, 75 bp, Artificial Sequence
  Synthetic
taaagtttataatctcatcatcgaagattactcggttaccattgtaataaattggtactctatcataatcatcga

SEQ ID NO: 47594 - DNA, 75 bp, Artificial Sequence
  Synthetic
aaattgattcacgcatgataaacatgattatattatatcatcgctaattagttaatttatttttttgttttttat

SEQ ID NO: 47595 - DNA, 75 bp, Artificial Sequence
  Synthetic
tattccaattatttgaacaaacaggaaagaagtatactatcgtcatttttttctctatatccagctactactgat

SEQ ID NO: 47596 - DNA, 75 bp, Artificial Sequence
  Synthetic
cttatccgatcataagtcgaacgtggaagggataaactttattatcaagtcatcttatgtttttaagagatatct

SEQ ID NO: 47597 - DNA, 75 bp, Artificial Sequence
  Synthetic
cgagttcgtcgctactattgggtctactcaggtgcccagactctactagttccaacatcataccgataggaatac

SEQ ID NO: 47598 - DNA, 75 bp, Artificial Sequence
  Synthetic
actatttcgtaaacgataacgtccaacaacatatactcgtagagcttatcaacatccctatgcccatctaggtta

SEQ ID NO: 47599 - DNA, 75 bp, Artificial Sequence
  Synthetic
gaacgttccagagtgtctatccagggaaatcaaagaagaagttaatatagacaattcttttgtattcatagacac

SEQ ID NO: 47600 - DNA, 75 bp, Artificial Sequence
  Synthetic
aatatctctaacgagtgatcaaattattgatacctttaaaagtaatcatgaaatcaaggatctaatatttttaga

SEQ ID NO: 47601 - DNA, 75 bp, Artificial Sequence
  Synthetic
attctcatctatcatctccacacagtcaaatccgtggttagcatacacctcatcaaccggtaatagactatcgga

SEQ ID NO: 47602 - DNA, 75 bp, Artificial Sequence
  Synthetic
ctttctctcttcaatggtctcacaaaaatattaaacctctttctgatggagtcgtaaaatattttattctctttc

SEQ ID NO: 47603 - DNA, 75 bp, Artificial Sequence
  Synthetic
tccgaattcaggtaatggactccaatacgaaattgcaaaatatgctctagatactgcaaaacttaaatgttacgg

SEQ ID NO: 47604 - DNA, 75 bp, Artificial Sequence
  Synthetic
gattagaaaatataaattaatttaccatcgtgtatttttataacgggattgtctggcatatcatgtagatagtta

SEQ ID NO: 47605 - DNA, 75 bp, Artificial Sequence
  Synthetic
gtctggcatatcatgtagatagttaccgtctacatcgtatactctaccatctacgcctttaaatcctctatttat

SEQ ID NO: 47606 - DNA, 75 bp, Artificial Sequence
  Synthetic
taccaaatattagtaccctcaattagtttattggtaatattttttttagacgatagatcaatggctcttgaaacc

SEQ ID NO: 47607 - DNA, 75 bp, Artificial Sequence
  Synthetic
gtttattggtaatattttttttagacgatagatcaatggctcttgaaaccaaggttttccaaccggactcattgt

SEQ ID NO: 47608 - DNA, 75 bp, Artificial Sequence
  Synthetic
tgccatcaatgtagaaaatgcccaaagggatcatttgataaggtaaagtgtaccggaacacagaacagtaaatgt

SEQ ID NO: 47609 - DNA, 75 bp, Artificial Sequence
  Synthetic
tgtttaaacactctaaacaattggacaaattcttttgatttgctttgaatgatttcaaataggtcttcgtctaca

SEQ ID NO: 47610 - DNA, 75 bp, Artificial Sequence
  Synthetic
ggattttctgataaagttagaaaaaatgatttagacatgaatgtggtaaaagaattactttccaatggcgcatct

SEQ ID NO: 47611 - DNA, 75 bp, Artificial Sequence
  Synthetic
ccattataaagtgcacgtttacatatctacgttctggaggagtaagaacgtgactattgagacgaatggctcttc

SEQ ID NO: 47612 - DNA, 75 bp, Artificial Sequence
  Synthetic
atatcattgattgagaagaaactaataccctcgcctccactagaagagaatacgcatgttttaatgcattctccg

SEQ ID NO: 47613 - DNA, 75 bp, Artificial Sequence
  Synthetic
ttaagttttgattgatctttccgtgtacggcgtatctagtcagatcgtataatctagccaacaatccatcgtcgg

SEQ ID NO: 47614 - DNA, 75 bp, Artificial Sequence
  Synthetic
taccctcgcctccactagaagagaatacgcatgttttaatgcattctccgttagtgtttgattcttggttaaact

SEQ ID NO: 47615 - DNA, 75 bp, Artificial Sequence
  Synthetic
acatattaatacttatctttgacaatcttgctataatcataatataaaaatacttatggacatagtcactcataa

SEQ ID NO: 47616 - DNA, 75 bp, Artificial Sequence
  Synthetic
aatctttggatggtcgcatgtgacttttctctaaaggatgatgttgcccaagatcctctcttaaatgaatccatc

SEQ ID NO: 47617 - DNA, 75 bp, Artificial Sequence
  Synthetic
ttagagataccaaagactttgaaatatagtaataagatttctattcctgactgattaacaaatggttcaaatact

SEQ ID NO: 47618 - DNA, 75 bp, Artificial Sequence
  Synthetic
atagtaataagatttctattcctgactgattaacaaatggttcaaatactagacatttaccatgggatgctaata

SEQ ID NO: 47619 - DNA, 75 bp, Artificial Sequence
  Synthetic
ttgttcgatgtatgtatgtactggagccattgtcttaactataatggtgcttgtatcgaaaaactttaatgcaga

SEQ ID NO: 47620 - DNA, 75 bp, Artificial Sequence
  Synthetic
tatctcttgtgcgtattcgcctggatcacgattttgtctttcaggaaagctatcgaaagtaaacgtagtagccat

SEQ ID NO: 47621 - DNA, 75 bp, Artificial Sequence
  Synthetic
tagccttttgataaatctcttcttgctttttcgacatattaacgtatcgcattaatactgttttcttagcgaatg

SEQ ID NO: 47622 - DNA, 75 bp, Artificial Sequence
  Synthetic
ggtctcacaaaaatattaaacctctttctgatggtctctataaagcgatcgatctttcttaccctctagagtttc

SEQ ID NO: 47623 - DNA, 75 bp, Artificial Sequence
  Synthetic
attaatactgttttcttagcgaatgatgcagacccttctacgtcatcaaaaatagaaaactcgttattaactatg

SEQ ID NO: 47624 - DNA, 75 bp, Artificial Sequence
  Synthetic
tgtatattattcatggtaaggtcttagatatagacgaaatattagagaaagtgtattcatcacctaacgtatcga

SEQ ID NO: 47625 - DNA, 75 bp, Artificial Sequence
  Synthetic
aaatataatattaatgtactaaaacttatatattattaatttatctaactaaagttagtaaattatatatataat

SEQ ID NO: 47626 - DNA, 75 bp, Artificial Sequence
  Synthetic
acgtttattctcaaatagcgattggtgttgtaaggatcctggtcgtagtaagttaaccaacatggtgaattcttg

SEQ ID NO: 47627 - DNA, 75 bp, Artificial Sequence
  Synthetic
aagagacgaaagagataaaactttttttacgactccatcagaaagaccggtttaatatttttgtgagaccatcga

SEQ ID NO: 47628 - DNA, 75 bp, Artificial Sequence
  Synthetic
attatatactgaacgagtaggacggatcttgccatcttctttgattaatgatttagaaatgaagttatggcattc

SEQ ID NO: 47629 - DNA, 75 bp, Artificial Sequence
  Synthetic
atcttgccatcttctttgattaatgatttagaaatgaagttatggcattcatcaatgatgacgcatattctactc

SEQ ID NO: 47630 - DNA, 75 bp, Artificial Sequence
  Synthetic
tcgcctattcctgataagttctttatacagttgaaacaaccgcttagaaataaacgagtatgtgtgtgtggtata

SEQ ID NO: 47631 - DNA, 75 bp, Artificial Sequence
  Synthetic
atcatcgtaattaataaaaatacaatccttcgttatctctggagcgtatctgagtatagtgttcatccaaggatc

SEQ ID NO: 47632 - DNA, 75 bp, Artificial Sequence
  Synthetic
tccttcgttatctctggagcgtatctgagtatagtgttcatccaaggatcttctatcaaagccttttttaccaat

SEQ ID NO: 47633 - DNA, 75 bp, Artificial Sequence
  Synthetic
gccattttatctctaaatttacgaattaagattttaaattttaaacataaagatgaggatacgtatatacacttt

SEQ ID NO: 47634 - DNA, 75 bp, Artificial Sequence
  Synthetic
tacagtagtcattgttttaccgacacccgtttcatggaacaataaaagagaatgcatactgtctaatcctaagaa

SEQ ID NO: 47635 - DNA, 75 bp, Artificial Sequence
  Synthetic
cacgctactagattgtgattttccctatatgcgattatgtcctctttgtaacatttactaactagtatatcgtat

SEQ ID NO: 47636 - DNA, 75 bp, Artificial Sequence
  Synthetic
atttttgtgagaccatcagaaagaggtttaatatttttgtaaaacttttttatgagaccatcgaagagagaatag

SEQ ID NO: 47637 - DNA, 75 bp, Artificial Sequence
  Synthetic
tagagagcttcgtatactctattcgaaaactctaagaacttattaatgaattccgtatccactggatcgtttaaa

SEQ ID NO: 47638 - DNA, 75 bp, Artificial Sequence
  Synthetic
taaaaaatattattttatagaaactttgtctagcgtattcagaacaattttatctcagggacgcttcatctgtaa

SEQ ID NO: 47639 - DNA, 75 bp, Artificial Sequence
  Synthetic
tacacctctaccgaatagagtaggaagtttaataatacaatatttttcgtttacaaaatcaaataatggtcgaaa

SEQ ID NO: 47640 - DNA, 75 bp, Artificial Sequence
  Synthetic
ataatactttacgctattaatctttaaaatttcatagactttatctagatcgctttctggtaacatgatatcgtg

SEQ ID NO: 47641 - DNA, 75 bp, Artificial Sequence
  Synthetic
tcatataatggatcattaccatgacaacacgctactagattgtgattttccctatatgtgattatgtcctctttg

SEQ ID NO: 47642 - DNA, 75 bp, Artificial Sequence
  Synthetic
tgtaaaaagttttaacatatcggttggcattctatttagatcattaactctagaaatctgaagaaagtaattagc

SEQ ID NO: 47643 - DNA, 75 bp, Artificial Sequence
  Synthetic
ctggcaatgtttcataaaatggaagaaggacatgcgtcccctcccggatattttttacaatttcatccatttaca

SEQ ID NO: 47644 - DNA, 75 bp, Artificial Sequence
  Synthetic
aaggacatgcgtcccctcccggatattttttacaatttcatccatttacaactctatagtttgttttcattatta

SEQ ID NO: 47645 - DNA, 75 bp, Artificial Sequence
  Synthetic
ccctagagatacgacacaaaagagtaagactaatttgtaaaccatcttacacaatagtacgatgcaattagcaat

SEQ ID NO: 47646 - DNA, 75 bp, Artificial Sequence
  Synthetic
ataccttatacaggtcattacatacaactaccaattgtttttgtacataatagattggatggttgacatccatgg

SEQ ID NO: 47647 - DNA, 75 bp, Artificial Sequence
  Synthetic
aactaccaattgtttttgtacataatagattggatggttgacatccatggtggaataaactactcgaacagatag

SEQ ID NO: 47648 - DNA, 75 bp, Artificial Sequence
  Synthetic
atatctttggtgtaaagttaaaagttagggttcttgttccattattgctttttgtcagtagttcattataaattc

SEQ ID NO: 47649 - DNA, 75 bp, Artificial Sequence
  Synthetic
gaactattaatcgcatccgataaagcgtgtgcgtgtatagagttaaattcatataaagtagccattcttcccatg

SEQ ID NO: 47650 - DNA, 75 bp, Artificial Sequence
  Synthetic
tcgagatgggtccgttctctgaatatagaacatcatttccaaatctaacttctagtctagaaataatatcggtct

SEQ ID NO: 47651 - DNA, 75 bp, Artificial Sequence
  Synthetic
ttggcctttgattcggctgatctattatctccgttatagacgtttcgttgactagtccaaagacttacaggaata

SEQ ID NO: 47652 - DNA, 75 bp, Artificial Sequence
  Synthetic
acatataggtcattttttaaacatggattggaaaccaaggtagttagttaatacacacaagatatatttttttca

SEQ ID NO: 47653 - DNA, 75 bp, Artificial Sequence
  Synthetic
cagagtgcacacctttgaagtattttgatatctattttctcctgtaaagaatcctgaagttgctaccttattaag

SEQ ID NO: 47654 - DNA, 75 bp, Artificial Sequence
  Synthetic
tgttccaaacattagcagattagtatgaagataaacactcatattatcaggaacattatcaatttttacatacac

SEQ ID NO: 47655 - DNA, 75 bp, Artificial Sequence
  Synthetic
tcatatatataccgagaagttattatctgtagacgagcctagaaatcaacttattcttgataccctggtagaaga

SEQ ID NO: 47656 - DNA, 75 bp, Artificial Sequence
  Synthetic
tgccgcatgaacttcggttactgtcgccgttggttggtttatttgacctattactctcctaggtttctctataaa

SEQ ID NO: 47657 - DNA, 75 bp, Artificial Sequence
  Synthetic
gccgttggttggtttatttgacctattactctcctaggtttctctataaatgatggtttaatttgtacattctta

SEQ ID NO: 47658 - DNA, 75 bp, Artificial Sequence
  Synthetic
ttttgataactataatcaaaaactgtcagtgttggtagtgcataaaaagtttatattattgttacatttttttaa

SEQ ID NO: 47659 - DNA, 75 bp, Artificial Sequence
  Synthetic
gaacgtttcaaagtcgaacgaagagtcacgaataacgatatcggatactggattgaaggtcaccgttacggtaat

SEQ ID NO: 47660 - DNA, 75 bp, Artificial Sequence
  Synthetic
tcacgaataacgatatcggatactggattgaaggtcaccgttacggtaatttttgaatcggatagtttaagactg

SEQ ID NO: 47661 - DNA, 75 bp, Artificial Sequence
  Synthetic
tgagaaataggattctcatcttgccaaaatatcactagaaaaaatttatttatcaattttaaaggtataaaaata

SEQ ID NO: 47662 - DNA, 75 bp, Artificial Sequence
  Synthetic
agtcaatgttttaaaatatatggacaagaatttgtctgtataaaaacttgtgtgaaattttgtaccaaagaaaaa

SEQ ID NO: 47663 - DNA, 75 bp, Artificial Sequence
  Synthetic
agagagaaagagaaagagatagttagtctagatatttttcttagtacaaaagtcaatgttttaaaatatatggac

SEQ ID NO: 47664 - DNA, 75 bp, Artificial Sequence
  Synthetic
agatggttctttaatagtgtcattaggagttaggccaatagaaatatcattaagttcactagaatatccagaatg

SEQ ID NO: 47665 - DNA, 75 bp, Artificial Sequence
  Synthetic
cttatccatttataacgtacaaatggataaaactactttatcagtaaacgcgtgtaatttagaatacgttagaga

SEQ ID NO: 47666 - DNA, 75 bp, Artificial Sequence
  Synthetic
atatagattcgcatttctatacttgttggtgaaatggtacaaaaaatatcatattcctattatgaaactatatcc

SEQ ID NO: 47667 - DNA, 75 bp, Artificial Sequence
  Synthetic
caatttcccaaataacaccgttacacgaagagacagatacgtgattaatacatttatatccaacatatggtacgt

SEQ ID NO: 47668 - DNA, 75 bp, Artificial Sequence
  Synthetic
tcaatttcaaaaagagcttatatggcaacgactattttagaaatggtaaaggataaaaattttttagatgtagta

SEQ ID NO: 47669 - DNA, 75 bp, Artificial Sequence
  Synthetic
aatgtgactgtctgaatgtatggctttaagataggtacgataccggatgtcttctgttcttaatacagtatacag

SEQ ID NO: 47670 - DNA, 75 bp, Artificial Sequence
  Synthetic
gaccgtttaatagagtcatccccaccgatcaaagaattaatgatggtattattcattttctatttaaaatggaaa

SEQ ID NO: 47671 - DNA, 75 bp, Artificial Sequence
  Synthetic
catcaaagagagaaagagaataaaaatatttttgtaaaacttttttatgagaccatcagaaagaggtttaatatt

SEQ ID NO: 47672 - DNA, 75 bp, Artificial Sequence
  Synthetic
atatactattatttgttatagtaatttatatttttacggtacgtctagtaagtagaaattatcaaatgttgttgg

SEQ ID NO: 47673 - DNA, 75 bp, Artificial Sequence
  Synthetic
aaatttttggttcttctctaagagctacgtgagacttaaccatagacgccaatgaatccctacatattttagaac

SEQ ID NO: 47674 - DNA, 75 bp, Artificial Sequence
  Synthetic
aaaaccaaatcttgattacaaaaccaacacttatcaattacactatttgtcttaatagacacatctgccatagat

SEQ ID NO: 47675 - DNA, 75 bp, Artificial Sequence
  Synthetic
atcaagattattacgtatcctcgtatcggctcctcgagataaaagagcatacaccacacgaggactatgtttggt

SEQ ID NO: 47676 - DNA, 75 bp, Artificial Sequence
  Synthetic
ctaaagtaaatcatagtgctagaagcgatgtctctgacctaaaggtggctaccgacaatatcgttaaagatctta

SEQ ID NO: 47677 - DNA, 75 bp, Artificial Sequence
  Synthetic
ttttagttacagaagtgatatcgaatattttatccaaaaagaatgagtaattaattgtcttagaaggagtgtttt

SEQ ID NO: 47678 - DNA, 75 bp, Artificial Sequence
  Synthetic
aaatatttctactacttcattaatcttttctgtactcagatttagtttctcatcttttacttgattgattatttc

SEQ ID NO: 47679 - DNA, 75 bp, Artificial Sequence
  Synthetic
catcttttacttgattgattatttcaaagactaacttataatcctttttatttattctctcgttagccttaagaa

SEQ ID NO: 47680 - DNA, 75 bp, Artificial Sequence
  Synthetic
ttactgattgacaaatcttatcattggtcggtgtttggtcttgctttgtgactttgataataacatcgattccca

SEQ ID NO: 47681 - DNA, 75 bp, Artificial Sequence
  Synthetic
tgtacagaatcgcaactctaaaagagatcgtatttttgttagagtatataacgttatgaaacgaattaattgttt

SEQ ID NO: 47682 - DNA, 75 bp, Artificial Sequence
  Synthetic
tccatgatatccaagagttccgaaataatttctccagaacattgatgagacaataatctccgcaatacatttctc

SEQ ID NO: 47683 - DNA, 75 bp, Artificial Sequence
  Synthetic
taatttctccagaacattgatgagacaataatctccgcaatacatttctcaaatgaataagtttattagacacgt

SEQ ID NO: 47684 - DNA, 75 bp, Artificial Sequence
  Synthetic
ttaccatcattattagtgttggcattattagtattcttcttgtcatcttgttcagaaatatacagcaatgctata

SEQ ID NO: 47685 - DNA, 75 bp, Artificial Sequence
  Synthetic
caaaaaatacaatattcatatccttgttcagatactataccgttgtgtctacaaccgctacataatcgtagattc

SEQ ID NO: 47686 - DNA, 75 bp, Artificial Sequence
  Synthetic
tcttctatataaggccaaaacaaaattttacccgccttcgaataaataataggaataaagttcataacagataca

SEQ ID NO: 47687 - DNA, 75 bp, Artificial Sequence
  Synthetic
atagttatcaagtttgtaggaaaggacaaagtttcacacgaatttgttgttcataagtctaatagactatataaa

SEQ ID NO: 47688 - DNA, 75 bp, Artificial Sequence
  Synthetic
cctgtaatacttttagtttttggggttgtgaataaagtatcgccctaatattgttaccgtcttccgccaatatag

SEQ ID NO: 47689 - DNA, 75 bp, Artificial Sequence
  Synthetic
atagggttgctatctcttgcgcgtattcgcccggatcacgattttgtctttcaggaaagctatcgaacgtaaacg

SEQ ID NO: 47690 - DNA, 75 bp, Artificial Sequence
  Synthetic
actatatagtatatagatgtcgacgctagatagacagtcgcccactagagttaccgtctccgaatgcggcatgat

SEQ ID NO: 47691 - DNA, 75 bp, Artificial Sequence
  Synthetic
atgaagaatactctacagagttgattgtaaatacagatagtgaatcgactatagacgtaatactatctggatcta

SEQ ID NO: 47692 - DNA, 75 bp, Artificial Sequence
  Synthetic
acaatgttatatttttcgtaccaactcatttaaatatcataatctaaaatagttctgtaatatgtctagcgctaa

SEQ ID NO: 47693 - DNA, 75 bp, Artificial Sequence
  Synthetic
tcatttaaatatcataatctaaaatagttctgtaatatgtctagcgctaatatattgatcataatcctgtgcata

SEQ ID NO: 47694 - DNA, 75 bp, Artificial Sequence
  Synthetic
ttagaagatcatcgtcaaagttagcaacgtgattcatcaacatttgctgttttgaggcagcaaatactgaaccat

SEQ ID NO: 47695 - DNA, 75 bp, Artificial Sequence
  Synthetic
aacgtgattcatcaacatttgctgttttgaggcagcaaatactgaaccatcgccattcaaccattcataaaaacc

SEQ ID NO: 47696 - DNA, 75 bp, Artificial Sequence
  Synthetic
ctttacacaaataattacaagaccgataaatggaaatggataagcgtatgaaatctctcgcaatgacagctttct

SEQ ID NO: 47697 - DNA, 75 bp, Artificial Sequence
  Synthetic
tcaatctagcatttctagctcccggattgaaaacagaaagaggatcgtacatccagggtccattttctgtaaata

SEQ ID NO: 47698 - DNA, 75 bp, Artificial Sequence
  Synthetic
ggttcgcatttatctacggaagagacggtgtgagaatatgttccgagaccacacggagaacacacgacgtctccg

SEQ ID NO: 47699 - DNA, 75 bp, Artificial Sequence
  Synthetic
atcaaaaagctgttgtatctaaaattcaagaccaaagaaacgaatagaatatactctattcttcaagagatgtct

SEQ ID NO: 47700 - DNA, 75 bp, Artificial Sequence
  Synthetic
aattggtctccgagtttgtaacagactgcggactttaacctatacatgataccgtttagcatgatttctggtgat

SEQ ID NO: 47701 - DNA, 75 bp, Artificial Sequence
  Synthetic
accgtttagcatgatttctggtgatacgtcaatcggagtatcatctattagagatctaaagccggtgtaacattc

SEQ ID NO: 47702 - DNA, 75 bp, Artificial Sequence
  Synthetic
acgtcaatcggagtatcatctattagagatctaaagccggtgtaacattctccaccaaacatattcttattctga

SEQ ID NO: 47703 - DNA, 75 bp, Artificial Sequence
  Synthetic
aacagcactacccatcacattagttcccaatggatcaatgtgtgtaactccagaacatcttccatagcctatgtt

SEQ ID NO: 47704 - DNA, 75 bp, Artificial Sequence
  Synthetic
cccaatggatcaatgtgtgtaactccagaacatcttccatagcctatgttaggaggagcgaacaccactcttcca

SEQ ID NO: 47705 - DNA, 75 bp, Artificial Sequence
  Synthetic
cggactgtcggatgttgtgatcatcttcataggattaacaacgatgtatggtgccgcctgaagtttcatatcgta

SEQ ID NO: 47706 - DNA, 75 bp, Artificial Sequence
  Synthetic
ttcataggattaacaacgatgtatggtgccgcctgaagtttcatatcgtaactgatgccgttcataggtctagcc

SEQ ID NO: 47707 - DNA, 75 bp, Artificial Sequence
  Synthetic
attaatcattgattcgcttattgttttaattgtttttataaactaacattgttaattgaaaagggataacatgtt

SEQ ID NO: 47708 - DNA, 75 bp, Artificial Sequence
  Synthetic
tatctgttcctcatctgtcataacttgagagcatccagtatgaataatcttcattagatggggatctaccgcatc

SEQ ID NO: 47709 - DNA, 75 bp, Artificial Sequence
  Synthetic
tgagagcatccagtatgaataatcttcattagatggggatctaccgcatcatcatcgttacaataaaaaattccc

SEQ ID NO: 47710 - DNA, 75 bp, Artificial Sequence
  Synthetic
ctgaatctctgtggaaattagatctgatacacctgtaatcactatcggattatcctccgtaagacgattaaccaa

SEQ ID NO: 47711 - DNA, 75 bp, Artificial Sequence
  Synthetic
gatacacctgtaatcactatcggattatcctccgtaagacgattaaccaacaacatataattataagactttact

SEQ ID NO: 47712 - DNA, 75 bp, Artificial Sequence
  Synthetic
aggaaatatcctcacaacttaatgaagatctatttccagatgatgattctccggccactattatcgaaagagtac

SEQ ID NO: 47713 - DNA, 75 bp, Artificial Sequence
  Synthetic
atacgcgttctcgagcgcaggaagtttaataccgaatagtgccatcagaataggatgaatgtagtaattagtttc

SEQ ID NO: 47714 - DNA, 75 bp, Artificial Sequence
  Synthetic
taggatgaatgtagtaattagtttctggttttctataaataaaagacaaatcttgtgaactagacatatcggtaa

SEQ ID NO: 47715 - DNA, 75 bp, Artificial Sequence
  Synthetic
taatcagcgattcctaaaaccgtttttgtaattgtgggaacataatcaggatcttcgaatggattgtatggcgtg

SEQ ID NO: 47716 - DNA, 75 bp, Artificial Sequence
  Synthetic
atacatctctggaaatagaattcacacctagagacaatgaaaaagttccatatgatgaactaataaaggaattga

SEQ ID NO: 47717 - DNA, 75 bp, Artificial Sequence
  Synthetic
atgactcgtcccttaatacgcagtaggctattatcttctttacgtagtaatcgtcgtaaggagagaactcggaca

SEQ ID NO: 47718 - DNA, 75 bp, Artificial Sequence
  Synthetic
ggagagtatattttatctaactctttgagttggtcaccgattctaggactagctcgagaatgaataagtactaaa

SEQ ID NO: 47719 - DNA, 75 bp, Artificial Sequence
  Synthetic
tgagttggtcaccgattctaggactagctcgagaatgaataagtactaaaggatgagtacatttcacagaaacac

SEQ ID NO: 47720 - DNA, 75 bp, Artificial Sequence
  Synthetic
ctccttatctcctccagtagcgtgcggttcttcaataccagtgttagtaataggcttaggcaaatgcttgtcgta

SEQ ID NO: 47721 - DNA, 75 bp, Artificial Sequence
  Synthetic
tttatacggatttctatagttctctgttatataatgtggttttccctcatgattagacgacgacaatagtgttct

SEQ ID NO: 47722 - DNA, 75 bp, Artificial Sequence
  Synthetic
tttctatttgttctgacaatatttagtttattcataatgttaagcatatcctgaatagtaaagttagatgtgtca

SEQ ID NO: 47723 - DNA, 75 bp, Artificial Sequence
  Synthetic
tgtatgtactattttatacattactacattggttacggcagatatacatactccgttaccgccacacgctccggt

SEQ ID NO: 47724 - DNA, 75 bp, Artificial Sequence
  Synthetic
ggcaaccttgttgttacaattctggaaggcggcatgaagaggggttatggtattatagtattcgtctttctgaat

SEQ ID NO: 47725 - DNA, 75 bp, Artificial Sequence
  Synthetic
ttgatcatttcctgcacgtttaggtttggtacgttgatttctagcccctgcggatataaagtcatcgtctacaat

SEQ ID NO: 47726 - DNA, 75 bp, Artificial Sequence
  Synthetic
ttggtacgttgatttctagcccctgcggatataaagtcatcgtctacaatttgggataatgaattgcatacacta

SEQ ID NO: 47727 - DNA, 75 bp, Artificial Sequence
  Synthetic
taatgaattactaaaatatacaaacacgtcgctgtctggcaataaatgatatcttagaatattgtaacaatttat

SEQ ID NO: 47728 - DNA, 75 bp, Artificial Sequence
  Synthetic
atgacaggtgacacaatcgttctttatgtattccatgatgggtgtgcaatcaagattgttacgtatcctagtatc

SEQ ID NO: 47729 - DNA, 75 bp, Artificial Sequence
  Synthetic
aagagtttgattagtataactagattttagtcctgcgttagatgttaaaaaaacatcgctattgaccacggcttc

SEQ ID NO: 47730 - DNA, 75 bp, Artificial Sequence
  Synthetic
tcttattacttttggaatcgttcaaaacctttgactagttgtaaaatttgatctattgccctacgcgtatattcc

SEQ ID NO: 47731 - DNA, 75 bp, Artificial Sequence
  Synthetic
ctaagatagcacagcaatagatcggatgattttctaaagtcatcaatgcggtccgtcagtatatcaaagaccttg

SEQ ID NO: 47732 - DNA, 75 bp, Artificial Sequence
  Synthetic
taggagtacatacagtggccacaataggaggttgaggaggtgtaactgttggagtagtacaagaaatacttccat

SEQ ID NO: 47733 - DNA, 75 bp, Artificial Sequence
  Synthetic
tttattgacaataacttcactatgatcaagtatgtaatatatcatcttttcactaaataagtagtaataatgatt

SEQ ID NO: 47734 - DNA, 75 bp, Artificial Sequence
  Synthetic
cttcaactcgctaccaaagagctccgttgcatcagttctgaaagagatgagaagcctgtagagagaccctgcagt

SEQ ID NO: 47735 - DNA, 75 bp, Artificial Sequence
  Synthetic
ttaatacagatggcttaaatcgtgaattcatcacatagcaatgtaatggagacataccacattttagttgtttat

SEQ ID NO: 47736 - DNA, 75 bp, Artificial Sequence
  Synthetic
attatgtactaaagatgctagtgtgccaatatgtgaatcatttttgcatcatttacgcgctcacaatacagaaga

SEQ ID NO: 47737 - DNA, 75 bp, Artificial Sequence
  Synthetic
attcatcacatagcaatgtaatggagacataccacattttagttgtttattcagatcgcagtgtttaataactag

SEQ ID NO: 47738 - DNA, 75 bp, Artificial Sequence
  Synthetic
catcattatcgctagcctcatcttctatatccggcactataccattatctataccctgcactataccattatcta

SEQ ID NO: 47739 - DNA, 75 bp, Artificial Sequence
  Synthetic
aacataatcaggatcttcggatggattgtatggcgtgattccatcatcaggttgggactggacaaccttaactgg

SEQ ID NO: 47740 - DNA, 75 bp, Artificial Sequence
  Synthetic
tatatgaatagttggttgtagcggttggataggctgtctgctggcggccatcatattatctctagctagttgttc

SEQ ID NO: 47741 - DNA, 75 bp, Artificial Sequence
  Synthetic
tggataggctgtctgctggcggccatcatattatctctagctagttgttctcgcaactgtctttgataatacgac

SEQ ID NO: 47742 - DNA, 75 bp, Artificial Sequence
  Synthetic
gtccatctctcccatctcatacatttcatcatttactttttcataattggagatgaacgaaagaaaaagaaaaag

SEQ ID NO: 47743 - DNA, 75 bp, Artificial Sequence
  Synthetic
atccttttcttcagaataatagattgacgactttggtgtagaggattctgccagcccctgtgagaacttgttaaa

SEQ ID NO: 47744 - DNA, 75 bp, Artificial Sequence
  Synthetic
gaagtccatttaaggctttaaaattgaattgcgattataagattaaatggcagacacagacgatattatcgacta

SEQ ID NO: 47745 - DNA, 75 bp, Artificial Sequence
  Synthetic
atggagagtcactagaaactagtgatatagatcccaaatcttcttataagattgtagaatcagcatccactcata

SEQ ID NO: 47746 - DNA, 75 bp, Artificial Sequence
  Synthetic
tatagatcccaaatcttcttataagattgtagaatcagcatccactcatatagaagatgctcattccaatcttaa

SEQ ID NO: 47747 - DNA, 75 bp, Artificial Sequence
  Synthetic
taagtctatttgaaatagcgggtataatagcagaaagctataacttgcttcaacgaggaagattacctctagttt

SEQ ID NO: 47748 - DNA, 75 bp, Artificial Sequence
  Synthetic
aatagcagaaagctataacttgcttcaacgaggaagattacctctagtttcagaattttctgacgaaacgatgaa

SEQ ID NO: 47749 - DNA, 75 bp, Artificial Sequence
  Synthetic
aaagtttattaatggcgcatctacaatggaagatagaccgtctacaagaaactttttcgaactaaatagaggagc

SEQ ID NO: 47750 - DNA, 75 bp, Artificial Sequence
  Synthetic
ctatagtcatcgaaaagaacggagaattgttgtctgtaaacgactttgacaaagatggtctaaaattccatctag

SEQ ID NO: 47751 - DNA, 75 bp, Artificial Sequence
  Synthetic
aaagatggtctaaaattccatctagactatattatcaaaatttggaaacttcaaaaacgatattagaatttatac

SEQ ID NO: 47752 - DNA, 75 bp, Artificial Sequence
  Synthetic
attgtcgtactttatatcgtgttcattaacgatattttgcaaaatagtaatgattctatcttccttcgatagata

SEQ ID NO: 47753 - DNA, 75 bp, Artificial Sequence
  Synthetic
taacattgtttatagatgcgattgctggattacatctaggtttaagaagactcggcatattaacccaagcagtgt

SEQ ID NO: 47754 - DNA, 75 bp, Artificial Sequence
  Synthetic
gatgtcattattctgaaacagtatgattttaggtagcattttcttaacaaagagaacgtatttattattactcag

SEQ ID NO: 47755 - DNA, 75 bp, Artificial Sequence
  Synthetic
attttaggtagcattttcttaacaaagagaacgtatttattattactcagttgaacagatgatatatccagatta

SEQ ID NO: 47756 - DNA, 75 bp, Artificial Sequence
  Synthetic
ttgtttgtattcattcaatgtctctttttcagaaattagtttagagtcgaatactgcaataattttcaagagata

SEQ ID NO: 47757 - DNA, 75 bp, Artificial Sequence
  Synthetic
aatgaaaaaaaactagtcgtttataataaaacacgatatggatgccaacgtagtatcatcttctactatcgcgac

SEQ ID NO: 47758 - DNA, 75 bp, Artificial Sequence
  Synthetic
tttatagttgtaataaaaagggaaatttgattgtataccttcggttctttaaaagaaactgacttgataaaaatg

SEQ ID NO: 47759 - DNA, 75 bp, Artificial Sequence
  Synthetic
atcttgacgcagtctagtatacatagagttaagagaaattagagtttgtacattgagcaacatgtctctaaatgt

SEQ ID NO: 47760 - DNA, 75 bp, Artificial Sequence
  Synthetic
cttcgtctctgccatggatggaaacattgttatcgatcaaacatttaattacatccttggatagagattgagatt

SEQ ID NO: 47761 - DNA, 75 bp, Artificial Sequence
  Synthetic
ccagaatgaaaaactctgataactacaatatttcatcatagttacgattttatcatcttctatagttggtgtgat

SEQ ID NO: 47762 - DNA, 75 bp, Artificial Sequence
  Synthetic
ctggaatcttagacgatgtacagtcatctataatcatggcatatttaatacattgttttatagcatagtcgttat

SEQ ID NO: 47763 - DNA, 75 bp, Artificial Sequence
  Synthetic
gtataaaaaggtatctgatttgatataatgaattcagtgactgtatcacacgcaccatatactattacttatcac

SEQ ID NO: 47764 - DNA, 75 bp, Artificial Sequence
  Synthetic
aatcaaaatccatatcaacatctgatgcgctaagaccagtctcgcgttcaagattatctttactaatggtgacga

SEQ ID NO: 47765 - DNA, 75 bp, Artificial Sequence
  Synthetic
tgcgctaagaccagtctcgcgttcaagattatctttactaatggtgacgaactcatcgtatagaactctaagttt

SEQ ID NO: 47766 - DNA, 75 bp, Artificial Sequence
  Synthetic
agattatctttactaatggtgacgaactcatcgtatagaactctaagtttgtccattatttatttacagatttag

SEQ ID NO: 47767 - DNA, 75 bp, Artificial Sequence
  Synthetic
gtcggtattatattattaggatctacgttcatatgtatcataatattaatcatccaggtttttataaatctatct

SEQ ID NO: 47768 - DNA, 75 bp, Artificial Sequence
  Synthetic
agaagttgaaccgggatcatcctttaagtttctgatacctaagggattttactcctctccttccgtaaagacgag

SEQ ID NO: 47769 - DNA, 75 bp, Artificial Sequence
  Synthetic
atagatccgtatccgaaagatggaactggtgtaccgttcgaatcaccaaattttacaaaaaaatcaattaaggag

SEQ ID NO: 47770 - DNA, 75 bp, Artificial Sequence
  Synthetic
cgttcatatgtatcataatattaatcatccaggtttttataaatctatctttagcttctgaaataacgtatttaa

SEQ ID NO: 47771 - DNA, 75 bp, Artificial Sequence
  Synthetic
tgatcttttaaacccgctagacaagtatccgtttgatattgtaggatgtggacatttaacaatctgacacgtggg

SEQ ID NO: 47772 - DNA, 75 bp, Artificial Sequence
  Synthetic
gttacattcactgcagcattttgaggatcgcgagtatgaagtacgatgttattgtttactggtatatctggaaag

SEQ ID NO: 47773 - DNA, 75 bp, Artificial Sequence
  Synthetic
gtaaatgtgacgtacttagatgagagatcttcgttaaaaagttttccatctatataaaatccatcggttgttagc

SEQ ID NO: 47774 - DNA, 75 bp, Artificial Sequence
  Synthetic
aaggcaatcattcctcataagatgataaaaagtaagggtgtgtgtgtgtgtgtgtgtgtgtgtgtgtgtgtgtgt

SEQ ID NO: 47775 - DNA, 75 bp, Artificial Sequence
  Synthetic
ggtgggaaaaaatcgattttatcactagactctttcttttttactatcattacctcatgaactatttcttgaatg

SEQ ID NO: 47776 - DNA, 75 bp, Artificial Sequence
  Synthetic
gatcgatcatttgaaattatcaacgttttactggaattagacaacaaggcacctataaattgggctcaagggttt

SEQ ID NO: 47777 - DNA, 75 bp, Artificial Sequence
  Synthetic
acgctttagcgaagaatgcttcagaattagaacagaggtctaccgcatacgaaataaataatgaattggaactag

SEQ ID NO: 47778 - DNA, 75 bp, Artificial Sequence
  Synthetic
tatcagatgtagttcgtaaacgaactatatcatcaccagcacaacatctaactatatgatatccactagtttcct

SEQ ID NO: 47779 - DNA, 75 bp, Artificial Sequence
  Synthetic
tatatcatcaccagcacaacatctaactatatgatatccactagtttcctttagccgtttattatcttgttccat

SEQ ID NO: 47780 - DNA, 75 bp, Artificial Sequence
  Synthetic
ggtagacgaaggttaacctgatggtagacctgtagccgtctgtgctaatagagggctttaatttccattttttta

SEQ ID NO: 47781 - DNA, 75 bp, Artificial Sequence
  Synthetic
atgacattttggattctgttacaactttaccaaaattaaggatatacggacttactatctttttctcaacgtcga

SEQ ID NO: 47782 - DNA, 75 bp, Artificial Sequence
  Synthetic
ttgtcaaatgatcagatctaaaatccatattttctggtagtgtttctaccagcctacattttgctcccgcaggta

SEQ ID NO: 47783 - DNA, 75 bp, Artificial Sequence
  Synthetic
aaacaacaagggatacaatatttccgcatatcatgaaatatattaagaaatcccaccttattatatttccccaaa

SEQ ID NO: 47784 - DNA, 75 bp, Artificial Sequence
  Synthetic
gcatatcatgaaatatattaagaaatcccaccttattatatttccccaaaggatccatgcacgtaaacattatac

SEQ ID NO: 47785 - DNA, 75 bp, Artificial Sequence
  Synthetic
tcccaccttattatatttccccaaaggatccatgcacgtaaacattataccgttatcattaataaagacttcttt

SEQ ID NO: 47786 - DNA, 75 bp, Artificial Sequence
  Synthetic
gataattaataatgatgggttttctattcttattctttgtattttggcatatcctagaccagtaaacagtttcca

SEQ ID NO: 47787 - DNA, 75 bp, Artificial Sequence
  Synthetic
attcttattctttgtattttggcatatcctagaccagtaaacagtttccactttggtaaaatcagcagacttttg

SEQ ID NO: 47788 - DNA, 75 bp, Artificial Sequence
  Synthetic
tttctatgttaggaatatggtttttcactttaatagatatatggtttttggccaaaatgatagatatttttttat

SEQ ID NO: 47789 - DNA, 75 bp, Artificial Sequence
  Synthetic
gccaaaatgatagatatttttttatccgaagatagtaaaatattattagtcgccgtctctataaaaatgaagcta

SEQ ID NO: 47790 - DNA, 75 bp, Artificial Sequence
  Synthetic
tgatattgataattagtataattagtataattagtataattagtataattactatgtattatatttcattattat

SEQ ID NO: 47791 - DNA, 75 bp, Artificial Sequence
  Synthetic
aattgataggagtcgccaaatgtaccttatacgttatatctcccttgatgcgttccatttgtgtatctatatcgg

SEQ ID NO: 47792 - DNA, 75 bp, Artificial Sequence
  Synthetic
tcgctagataatgctaatgtaccatccaagtcccaaatggagagatttaactgttcatcgtttagaataaaatga

SEQ ID NO: 47793 - DNA, 75 bp, Artificial Sequence
  Synthetic
ccaagtcccaaatggagagatttaactgttcatcgtttagaataaaatgattaccggtcatattaataaagtgtt

SEQ ID NO: 47794 - DNA, 75 bp, Artificial Sequence
  Synthetic
ctgttcatcgtttagaataaaatgattaccggtcatattaataaagtgttcatcgtatctagataacaacgactt

SEQ ID NO: 47795 - DNA, 75 bp, Artificial Sequence
  Synthetic
ctctatttttatcgttgatgaggcacataatatctttgggaataatactggagaacttatgaccgtgataaaaaa

SEQ ID NO: 47796 - DNA, 75 bp, Artificial Sequence
  Synthetic
ttagttttagattggtacgaaatatattgttaaactttgattctacagtaatgtccaaatcgagttgtggaaata

SEQ ID NO: 47797 - DNA, 75 bp, Artificial Sequence
  Synthetic
attgttaaactttgattctacagtaatgtccaaatcgagttgtggaaatacttccatcaacattgtttcaaactt

SEQ ID NO: 47798 - DNA, 75 bp, Artificial Sequence
  Synthetic
agactccggataaccagtcggtggaccatcgctaacaataactagatcatccaacaatctactcacatatgcatc

SEQ ID NO: 47799 - DNA, 75 bp, Artificial Sequence
  Synthetic
tccgactctgaatacagatgagagatgatatacagatgcaatacggtaccgcaatttcgtggttgataatcatca

SEQ ID NO: 47800 - DNA, 75 bp, Artificial Sequence
  Synthetic
tatcgcacgctctggccacccagataaccaaaaagtcacacgctccaggatatacattgtataaaaagctatcgt

SEQ ID NO: 47801 - DNA, 75 bp, Artificial Sequence
  Synthetic
ttatcaacgtaactatattccaaattattcttatgagaatagataataatatcgtccttaatatctaacaaattt

SEQ ID NO: 47802 - DNA, 75 bp, Artificial Sequence
  Synthetic
tattcttatgagaatagataataatatcgtccttaatatctaacaaatttcctaaatatccctttaattgagtca

SEQ ID NO: 47803 - DNA, 75 bp, Artificial Sequence
  Synthetic
tttaaatgacttcgtaagaaataatatatgggtgacttctcatctatgtaatcatatggagtgagatatagggct

SEQ ID NO: 47804 - DNA, 75 bp, Artificial Sequence
  Synthetic
atcatatggagtgagatatagggctcgttctacctcctgccccttacccacctgtaataccaattgcggactcac

SEQ ID NO: 47805 - DNA, 75 bp, Artificial Sequence
  Synthetic
ggtaaagtgaaaatctactaccgatgatgtaagtcttacaatgttcgaaccagtaccagatcttaatttggaggc

SEQ ID NO: 47806 - DNA, 75 bp, Artificial Sequence
  Synthetic
gatgtaagtcttacaatgttcgaaccagtaccagatcttaatttggaggcctccgtagaactaggggaggtaaat

SEQ ID NO: 47807 - DNA, 75 bp, Artificial Sequence
  Synthetic
tagtagacgtctattcgcccatagatctaaggatgatgagagaaaactagcactacgattctttttacaaagact

SEQ ID NO: 47808 - DNA, 75 bp, Artificial Sequence
  Synthetic
tctaaggatgatgagagaaaactagcactacgattctttttacaaagactttattttttagatcatagagagatt

SEQ ID NO: 47809 - DNA, 75 bp, Artificial Sequence
  Synthetic
taatccttctagaattagaattacaaaagaaacggctatcactatctttgaaaagttctatgaaaaactcaatta

SEQ ID NO: 47810 - DNA, 75 bp, Artificial Sequence
  Synthetic
tattctattttggaaagtttaatatcatcgactggcagtttgctatccattattctttccatccgagacattatg

SEQ ID NO: 47811 - DNA, 75 bp, Artificial Sequence
  Synthetic
aaaaaataacattatcgtggcgccttatatagcacttttaactatcgcatcaaaaggatgcaaacttacagaaac

SEQ ID NO: 47812 - DNA, 75 bp, Artificial Sequence
  Synthetic
tatatagcacttttaactatcgcatcaaaaggatgcaaacttacagaaacaatgattgaagcattctttccagaa

SEQ ID NO: 47813 - DNA, 75 bp, Artificial Sequence
  Synthetic
catccaagaaaaactaggatatcagtctggaaactatcacgtttatgattttgaaccgtattactctacagtagc

SEQ ID NO: 47814 - DNA, 75 bp, Artificial Sequence
  Synthetic
tctggaaactatcacgtttatgattttgaaccgtattactctacagtagctctggctattcgagatgaacattca

SEQ ID NO: 47815 - DNA, 75 bp, Artificial Sequence
  Synthetic
ctaccccctttagaagacatattaataagacttaagagttaagacaagtttaacaataaaattaatcacgagtac

SEQ ID NO: 47816 - DNA, 75 bp, Artificial Sequence
  Synthetic
tttgcattctatctcaaaataggtactctgttggtctctagctctgtaaagcatattccattaatgacggacctc

SEQ ID NO: 47817 - DNA, 75 bp, Artificial Sequence
  Synthetic
catctcgataacaaaacctgaataatcaatattgaagatttttttttgatctggatcattacttagcatctcagc

SEQ ID NO: 47818 - DNA, 75 bp, Artificial Sequence
  Synthetic
tgaaataacatatagattttatctaattaatctaaaatctgatcttgttcaatggagtgctagtacgggcgctgt

SEQ ID NO: 47819 - DNA, 75 bp, Artificial Sequence
  Synthetic
ttgttctatgtatctaaaataatgtctgactagatccgttagtttaatatccgcagtcatcttgtctagaatggc

SEQ ID NO: 47820 - DNA, 75 bp, Artificial Sequence
  Synthetic
attaatctaaaatctgatcttgttcaatggagtgctagtacgggcgctgtaattaatcaaatggtaaatactgta

SEQ ID NO: 47821 - DNA, 75 bp, Artificial Sequence
  Synthetic
atttacatgttcattggctgtggaatcagaacttccaataaaattacttaaagatagaaatgaattatttacaaa

SEQ ID NO: 47822 - DNA, 75 bp, Artificial Sequence
  Synthetic
cgtttctttgtaggtttatttaacttgtacatcactgtaagcatgtccgtaccatttattttaatttgacgcata

SEQ ID NO: 47823 - DNA, 75 bp, Artificial Sequence
  Synthetic
tacatttaaattcatcatctgtaagatttttgagatgtctcattaaaatattattagggttagtactcattatca

SEQ ID NO: 47824 - DNA, 75 bp, Artificial Sequence
  Synthetic
tattagtattcttcttgtcatcttgttcagaaatatacaacaatgctatacctaatactaaatacattatcatgc

SEQ ID NO: 47825 - DNA, 75 bp, Artificial Sequence
  Synthetic
cgtatcacatgtgtacttatagtcgactaatatgaagtatttaatacaagtttctagtataggtttgttacgaat

SEQ ID NO: 47826 - DNA, 75 bp, Artificial Sequence
  Synthetic
cctaatactaaatacattatcatgcttgcaatggctctaacaacgacgaaccaaaatgaatttggtcgtagcttt

SEQ ID NO: 47827 - DNA, 75 bp, Artificial Sequence
  Synthetic
caatttctgtatatctataatgttattaacctccgcatatgcattacagttcttttctagcttggataccgcact

SEQ ID NO: 47828 - DNA, 75 bp, Artificial Sequence
  Synthetic
gtctacataaatctatggcgccattggctacttgaaatagcgccagtcctcctacagattttaatatagctgtat

SEQ ID NO: 47829 - DNA, 75 bp, Artificial Sequence
  Synthetic
cctacagattttaatatagctgtataacatgacatttattcatcatcaaaagagacagagtcaccgtctgtcata

SEQ ID NO: 47830 - DNA, 75 bp, Artificial Sequence
  Synthetic
tcaatgtggagatttaatctgtaaactaagtagagattcgggtactgtatcatttagcgattcaaagtactgctt

SEQ ID NO: 47831 - DNA, 75 bp, Artificial Sequence
  Synthetic
agtatcctctactcatttcattataatagtttatcatacttagaattttaggacggatcaatgagtaagacttga

SEQ ID NO: 47832 - DNA, 75 bp, Artificial Sequence
  Synthetic
atagtttatcatacttagaattttaggacggatcaatgagtaagacttgactagatcgtccgtagtaatttgtgc

SEQ ID NO: 47833 - DNA, 75 bp, Artificial Sequence
  Synthetic
agtaagtattttgcaatacgtatggtgttgtgctttatggcataatgtaacggcgtataaccgttataatattta

SEQ ID NO: 47834 - DNA, 75 bp, Artificial Sequence
  Synthetic
gattctccatagctatcaagtctttatacaatgacatggaaatatctgtgaatactttatacttctccaacatcg

SEQ ID NO: 47835 - DNA, 75 bp, Artificial Sequence
  Synthetic
atacaatgacatggaaatatctgtgaatactttatacttctccaacatcgatgccttaacatcatcgcctacttt

SEQ ID NO: 47836 - DNA, 75 bp, Artificial Sequence
  Synthetic
gtaaatttctagatactagagtagtatattgtcacatgtctaaacttcaagagagagattatatgattactagac

SEQ ID NO: 47837 - DNA, 75 bp, Artificial Sequence
  Synthetic
tacccgaagatatacacactgataaatttgtcatttatgatatatacacttttgacgctttcaagaataaacgat

SEQ ID NO: 47838 - DNA, 75 bp, Artificial Sequence
  Synthetic
acaacaatgccatcttacacgatgattgcctcaagtctccaatcttttgtttagaacgattagctacagagtcca

SEQ ID NO: 47839 - DNA, 75 bp, Artificial Sequence
  Synthetic
actttaaaagtgtcataccgggttctttttattcttttaaacagatcaatggtatgatgttgattaggtctttta

SEQ ID NO: 47840 - DNA, 75 bp, Artificial Sequence
  Synthetic
ttagaacgattagctacagagtccaatgcttgactgactaacatattattatctttagaaattgtattcttcaat

SEQ ID NO: 47841 - DNA, 75 bp, Artificial Sequence
  Synthetic
gacgacgacaatagtgttctgaatttagatagttgatcagaatgaatgtttattggcgttggaaaaattatccat

SEQ ID NO: 47842 - DNA, 75 bp, Artificial Sequence
  Synthetic
cgttagtcatattacagtctgactgggttgtaatgttatccaacatatcacctatggatacggtacacgtaccag

SEQ ID NO: 47843 - DNA, 75 bp, Artificial Sequence
  Synthetic
ggttgtaatgttatccaacatatcacctatggatacggtacacgtaccagcatttgtaataatcctatctaagat

SEQ ID NO: 47844 - DNA, 75 bp, Artificial Sequence
  Synthetic
atagagaactgttttacccattctattatcataatcaatggtgtagtcgtaatcgcaatctaactcgtcgtccca

SEQ ID NO: 47845 - DNA, 75 bp, Artificial Sequence
  Synthetic
atccaattgattgactatcttttgaaaatatacatttttatgatccgatacttgtaagaatatagcaacaatgat

SEQ ID NO: 47846 - DNA, 75 bp, Artificial Sequence
  Synthetic
cgataaatctactcagattattcttaaatgccttattctctggagaaaagatatcagtgtccatcatttcattaa

SEQ ID NO: 47847 - DNA, 75 bp, Artificial Sequence
  Synthetic
tatccataattctagctaatgagagatatagaagcgcgtttaacgacaatggaatatacatccgtagaactatga

SEQ ID NO: 47848 - DNA, 75 bp, Artificial Sequence
  Synthetic
aaatgccttattctctggagaaaagatatcagtgtccatcatttcattaatagtatacgcagaaaagataccacg

SEQ ID NO: 47849 - DNA, 75 bp, Artificial Sequence
  Synthetic
tttcctctccttcgggagatcctgcatagaaatatctaggacaatagtttctatactgtctgtaactctgataat

SEQ ID NO: 47850 - DNA, 75 bp, Artificial Sequence
  Synthetic
atagaaatatctaggacaatagtttctatactgtctgtaactctgataatctctaaagtcactaactgataccat

SEQ ID NO: 47851 - DNA, 75 bp, Artificial Sequence
  Synthetic
tactacaactagttttcatcaatgtagtgacgatgtattgtttagttactcttggtctaatactgatgatagaga

SEQ ID NO: 47852 - DNA, 75 bp, Artificial Sequence
  Synthetic
agtgacgatgtattgtttagttactcttggtctaatactgatgatagagatattattgcttcccataatggatct

SEQ ID NO: 47853 - DNA, 75 bp, Artificial Sequence
  Synthetic
cttggtatgactcctttctaatatagtacggactacctttgtcacccaactttatacccacataagccataacaa

SEQ ID NO: 47854 - DNA, 75 bp, Artificial Sequence
  Synthetic
tttatctttcctgggaaactctcgtatagtcatagatgaaatactcttcaaagtttctgaaataagattagtaac

SEQ ID NO: 47855 - DNA, 75 bp, Artificial Sequence
  Synthetic
tagtagtgattttgaagatatagatactgttgttagggaatatagacaaaaatatggcaatgcaatggcaaaagg

SEQ ID NO: 47856 - DNA, 75 bp, Artificial Sequence
  Synthetic
ctatcattattagtgttagcattattagtattcttcttgtcatcttgttcagaaatatacagcaatgctatacct

SEQ ID NO: 47857 - DNA, 75 bp, Artificial Sequence
  Synthetic
gatagagcaataagtagtattattgtgattataaagaccgaatacataacaggtagaatttataaacatcatatc

SEQ ID NO: 47858 - DNA, 75 bp, Artificial Sequence
  Synthetic
ctattgatcttcatttcgttttcgattctggctatttcaaaataaaatcccgatgatagacctccagactttata

SEQ ID NO: 47859 - DNA, 75 bp, Artificial Sequence
  Synthetic
gaaaactgtacatggaggcactaatgcaaattacttttccggtaaaaaatctgatgagtatctgagcactacagt

SEQ ID NO: 47860 - DNA, 75 bp, Artificial Sequence
  Synthetic
tggatttggcaactttgatagccgtagatcgttgttccttcgccaacatactaatgaaagtaataaagaatttgt

SEQ ID NO: 47861 - DNA, 75 bp, Artificial Sequence
  Synthetic
gacatcgcatttatatctttagctaattcatatatgttaccatcgtaatatctaaccgcgtctatcttaaacgtt

SEQ ID NO: 47862 - DNA, 75 bp, Artificial Sequence
  Synthetic
accagtctaggaataagagattgatatctcatagaaatagaaaagtttataatctcatcatcgaagaccattctg

SEQ ID NO: 47863 - DNA, 75 bp, Artificial Sequence
  Synthetic
gttggcatagtagtgagatcgacgtttggtaatggcaatgtattaagattaactccataatgtctagcagcatct

SEQ ID NO: 47864 - DNA, 75 bp, Artificial Sequence
  Synthetic
ttgtctaatacctataagattatcaaaatcttgtctgcttaatacaccgttaacaatttttgccttgaattcttt

SEQ ID NO: 47865 - DNA, 75 bp, Artificial Sequence
  Synthetic
tagaggatgttaaacaaataagtattatcaaagttaagatctgggtatttcttttctgctagaacatccattgag

SEQ ID NO: 47866 - DNA, 75 bp, Artificial Sequence
  Synthetic
aaaatgagtcgtcgtctgatttatgttttaaatatcaaccgcgaatcaactcataaaatacaagagaatgaaata

SEQ ID NO: 47867 - DNA, 75 bp, Artificial Sequence
  Synthetic
aaaaatagaaaaaacatgtggtattagtgcaggtcgttattcttccaattgcaattggtaagatgacggccaact

SEQ ID NO: 47868 - DNA, 75 bp, Artificial Sequence
  Synthetic
taataattactttacaaacgatgtactgaagatattattaaatcatggagtggatgtaacgatgaaaaccagtag

SEQ ID NO: 47869 - DNA, 75 bp, Artificial Sequence
  Synthetic
acatactttgtaatctagacatagatgaggaagaacggtagaaactatacgaaatagatattcagagtcctctaa

SEQ ID NO: 47870 - DNA, 75 bp, Artificial Sequence
  Synthetic
cgctcgtataatctccccagaataatatacttctgtgtcgtcgttcaatttatacggatttctatagttctctgt

SEQ ID NO: 47871 - DNA, 75 bp, Artificial Sequence
  Synthetic
tgaggaagaacggtagaaactatacgaaatagatattcagagtcctctaattgatcaagagtaactattgactta

SEQ ID NO: 47872 - DNA, 75 bp, Artificial Sequence
  Synthetic
tcgaatatatcagttttctgacattaactatagcgtgttcggttaatgatgccattttgataactataatcaaaa

SEQ ID NO: 47873 - DNA, 75 bp, Artificial Sequence
  Synthetic
tacaaaacgacttaattacagagttttcagaagataattatccatctaacaaaaattatgaaataactcttcgtc

SEQ ID NO: 47874 - DNA, 75 bp, Artificial Sequence
  Synthetic
aatgctctgcaataactaatggcaaatgtatagaacaacgaaattatactagagttgttaaagttaatattttct

SEQ ID NO: 47875 - DNA, 75 bp, Artificial Sequence
  Synthetic
gggagtagtgtatgataaagataaaagaattcagatgctagaggatgaagtggttaatcttagaaatcaacgatc

SEQ ID NO: 47876 - DNA, 75 bp, Artificial Sequence
  Synthetic
gatgaacgtataacagtaaaagaattcggaaatgtaattctaaaacttactacacgtgataaattatttaataaa

SEQ ID NO: 47877 - DNA, 75 bp, Artificial Sequence
  Synthetic
tatgaagtacgatgttattgtttacttgtatatctggaaagaattctaccagtctaggaataagagattgatatc

SEQ ID NO: 47878 - DNA, 75 bp, Artificial Sequence
  Synthetic
ttgttcggaggatgaaatagatagaatctataaaacgattaaacaatatcatgaaagtagaaaacgaaaaattat

SEQ ID NO: 47879 - DNA, 75 bp, Artificial Sequence
  Synthetic
gatgccatagattctttgaccaacgatttaatattgcgtttagcatctgatttttttattaaatcgaatggtcgg

SEQ ID NO: 47880 - DNA, 75 bp, Artificial Sequence
  Synthetic
tatttaatttaatacattcccatatccagacaacaatcgtctgtcataatctgttcctgtcgtctcatacctgac

SEQ ID NO: 47881 - DNA, 75 bp, Artificial Sequence
  Synthetic
tatcaaaatcttcaaagtatgtcgaatatatcagttttctaacattaactatagcgtgttcggttaatgatgcca

SEQ ID NO: 47882 - DNA, 75 bp, Artificial Sequence
  Synthetic
cccagcattaactgattcgatacctagaagatcgtgattgatctctccgaccattccacgaacttctaattgtcc

SEQ ID NO: 47883 - DNA, 75 bp, Artificial Sequence
  Synthetic
tttccagcattagtaacagcttggacaatctgaccatccattgcgttgaatgatgtagttgctgttgttctacgt

SEQ ID NO: 47884 - DNA, 75 bp, Artificial Sequence
  Synthetic
atattaattatactataaaaattagaagtgttagactattaactaacttataaaactatcttataactattatct

SEQ ID NO: 47885 - DNA, 75 bp, Artificial Sequence
  Synthetic
aagaagttaatatagacaattcttttgtattcatagacactcgtttttttattcatggtatcatagaagatacca

SEQ ID NO: 47886 - DNA, 75 bp, Artificial Sequence
  Synthetic
ggattttgattttggtttacatgtaatacattttgaactctttgattttgtatcacatgcgccggcagtcacatc

SEQ ID NO: 47887 - DNA, 75 bp, Artificial Sequence
  Synthetic
atacattttgaactctttgattttgtatcacatgcgccggcagtcacatctgtttgagaattaagattattgttg

SEQ ID NO: 47888 - DNA, 75 bp, Artificial Sequence
  Synthetic
ctgtggtgtaatcttattaactgtttcgatataatcatcgtaactgcttctaacggctaaattttttttatccgc

SEQ ID NO: 47889 - DNA, 75 bp, Artificial Sequence
  Synthetic
gttcatctatgtgattaggcatgttgatggcaaaattcttttcgttggtagatattgctctccaacaactaatta

SEQ ID NO: 47890 - DNA, 75 bp, Artificial Sequence
  Synthetic
gtataaattttagaaataacattagcaaattgttgtgcgttgatgtcgttattctgaaacagtatgattttaggt

SEQ ID NO: 47891 - DNA, 75 bp, Artificial Sequence
  Synthetic
tcgcgtataggatggcgacggtaactgctacacaaataccgatcaaaagaagaataccaatcatttattgacaat

SEQ ID NO: 47892 - DNA, 75 bp, Artificial Sequence
  Synthetic
acagcagtagtttaactagtcttctctgatgtttgttttcgatacttttcgaatcagaagtcatactagaataaa

SEQ ID NO: 47893 - DNA, 75 bp, Artificial Sequence
  Synthetic
tgctacacaaataccgatcaaaagaagaataccaatcatttattgacaataacttcactattgatcaagtatgca

SEQ ID NO: 47894 - DNA, 75 bp, Artificial Sequence
  Synthetic
aacttcactattgatcaagtatgcaatatatcatcttttcactaaataagtagtaataatgattcaacaatgtcg

SEQ ID NO: 47895 - DNA, 75 bp, Artificial Sequence
  Synthetic
tgcattcgtgttacactatataataatacataaaactatgctacatttttatcataacactacttctgttagatg

SEQ ID NO: 47896 - DNA, 75 bp, Artificial Sequence
  Synthetic
tatgaatgactccgctaactctgtggggtgcgcagtgctttccccacatagaataaattagcattccgactgtga

SEQ ID NO: 47897 - DNA, 75 bp, Artificial Sequence
  Synthetic
gggtgcgcagtgctttccccacatagaataaattagcattccgactgtgataataataccaagtataaacgccat

SEQ ID NO: 47898 - DNA, 75 bp, Artificial Sequence
  Synthetic
caataaaggcaaagatacacgaaagaatcaaaagaatgattccagcgattagcacgccggaaaaataatttccaa

SEQ ID NO: 47899 - DNA, 75 bp, Artificial Sequence
  Synthetic
aatcaaaagaatgattccagcgattagcacgccggaaaaataatttccaatcataagcatcatgtccatttaact

SEQ ID NO: 47900 - DNA, 75 bp, Artificial Sequence
  Synthetic
aaaacaatagtttgtactgcaaaaataatatctatttttgttttcgaagatatggtaaaattaaatagtagtaca

SEQ ID NO: 47901 - DNA, 75 bp, Artificial Sequence
  Synthetic
taatatctatttttgttttcgaagatatggtaaaattaaatagtagtacacagcatgttataactaacagcagca

SEQ ID NO: 47902 - DNA, 75 bp, Artificial Sequence
  Synthetic
ttcttgctcaaataatacgaatatatcacccatccattttatgcgatgtttatatactctaatctttaatagatc

SEQ ID NO: 47903 - DNA, 75 bp, Artificial Sequence
  Synthetic
tatatactctaatctttaatagatctatagacgacgggtttaccaacaatatagattttatcgattcatctaatt

SEQ ID NO: 47904 - DNA, 75 bp, Artificial Sequence
  Synthetic
ttacctgatgaatcggacaatgtactgggccatgtagaataaattatcaacgaattatcgtctacgaacatttat

SEQ ID NO: 47905 - DNA, 75 bp, Artificial Sequence
  Synthetic
ttattattattaattatatcgtatttgtgctatagaatggatgaagatacgcgactatctaggtatttgtatctc

SEQ ID NO: 47906 - DNA, 75 bp, Artificial Sequence
  Synthetic
cgaattatcgtctacgaacatttatatcatttgttttaattttaggacgtgaataaatagatataaaatagaaaa

SEQ ID NO: 47907 - DNA, 75 bp, Artificial Sequence
  Synthetic
ttatcaaattgcatacctataggaatagtctctgtaatcactgcgattgtattatccggattcattttatttgtt

SEQ ID NO: 47908 - DNA, 75 bp, Artificial Sequence
  Synthetic
tttattttatcttttactacaggttctcctggatgtacgtcaccaacggcggacgtagttctagtacaattagac

SEQ ID NO: 47909 - DNA, 75 bp, Artificial Sequence
  Synthetic
gttgtcaaatgatcggatctaaaatccatattttctggtagtgtttctaccagcctacattttgctcccgcaggt

SEQ ID NO: 47910 - DNA, 75 bp, Artificial Sequence
  Synthetic
gtaagttccgcttgggaattttttaacgctaaagagttaacattaatcgtacacccaacgtatttacatctagtt

SEQ ID NO: 47911 - DNA, 75 bp, Artificial Sequence
  Synthetic
tctgaccttccattgcgttgaatgatgtagtagtaactgttgttctacgtctaggagcaccagaagtatttttgg

SEQ ID NO: 47912 - DNA, 75 bp, Artificial Sequence
  Synthetic
ctttgaacatcttgattataatataaccattttctatctctagattcgtcggtgcactcatgtaaccaacatacc

SEQ ID NO: 47913 - DNA, 75 bp, Artificial Sequence
  Synthetic
attttatttttctgtattttattacttttcaccatatagatcagtcattagatcatcaaaatacttttcaatcat

SEQ ID NO: 47914 - DNA, 75 bp, Artificial Sequence
  Synthetic
aattagattttggataattcgcacaccaacaatttctatttcctttatgatcgttacaaaagacgtataatgccg

SEQ ID NO: 47915 - DNA, 75 bp, Artificial Sequence
  Synthetic
tcgttacaaaagacgtataatgccgtatccccaaaagtaaaataatcagggcgaataattctaataaactcggaa

SEQ ID NO: 47916 - DNA, 75 bp, Artificial Sequence
  Synthetic
catatccaatgtagattgttgactgattatcgagtttaaatcagtattaatacccaattcttcagaatacactcg

SEQ ID NO: 47917 - DNA, 75 bp, Artificial Sequence
  Synthetic
acattttgccacgctatcactatcgcccaggagataatccttttttataaaatgacatcgttgcccggatgctat

SEQ ID NO: 47918 - DNA, 75 bp, Artificial Sequence
  Synthetic
cccaggagataatccttttttataaaatgacatcgttgcccggatgctatataatcagtagcgtgttttaaatcc

SEQ ID NO: 47919 - DNA, 75 bp, Artificial Sequence
  Synthetic
acgaaatttgaaagaactacatggttctccacgaattaatacatattgtttagcaaattcaggaactataaaact

SEQ ID NO: 47920 - DNA, 75 bp, Artificial Sequence
  Synthetic
aacgggcatattagtagttctgcgtaaggcataatcgatataggccgcgtgtgatttactcatttatgagtgata

SEQ ID NO: 47921 - DNA, 75 bp, Artificial Sequence
  Synthetic
cctattgcttccatgctactagtatagatcaaatacttgattcctaggtccacacaagctgccaatatagtctgt

SEQ ID NO: 47922 - DNA, 75 bp, Artificial Sequence
  Synthetic
tagcaaattcaggaactataaaactactacaatgatctatcgacataccatctatcaaacaaaatttgggtttaa

SEQ ID NO: 47923 - DNA, 75 bp, Artificial Sequence
  Synthetic
ttaacagctctattatattcaggataattaaaacctaattccatatatttgtctcgtatatctgctattcctgga

SEQ ID NO: 47924 - DNA, 75 bp, Artificial Sequence
  Synthetic
cggctgcccccattcttaataatcgtcagtatttaaactgttaaatgttggtatatcaacatctaccttatttcc

SEQ ID NO: 47925 - DNA, 75 bp, Artificial Sequence
  Synthetic
tgagacataaataaatccaaattttttttacaaacatcactagccaccataatggcgctatctttcaaccagcta

SEQ ID NO: 47926 - DNA, 75 bp, Artificial Sequence
  Synthetic
ttcttttatagtcctgtctttcgatgttcatcacatatgcaaagaacagaataaacaaaataatgtaagaaataa

SEQ ID NO: 47927 - DNA, 75 bp, Artificial Sequence
  Synthetic
gttcatcacatatgcaaagaacagaataaacaaaataatgtaagaaataatattaaatatctgtgaattcgtaaa

SEQ ID NO: 47928 - DNA, 75 bp, Artificial Sequence
  Synthetic
tctcatagtatcgattacacctctaccgaatagagtaggaagtttaataatacaatatttttcgtttacaaaatc

SEQ ID NO: 47929 - DNA, 75 bp, Artificial Sequence
  Synthetic
agaagagaattaaaagaggaaagtgatgaacgtataacagtaaaagaattcggaaatgtaattctaaaacttaca

SEQ ID NO: 47930 - DNA, 75 bp, Artificial Sequence
  Synthetic
ttcccacagtgttgccattacctccacgatacatttgagttactaagcaataggtaataactaagctagtaagag

SEQ ID NO: 47931 - DNA, 75 bp, Artificial Sequence
  Synthetic
acgatacatttgagttactaagcaataggtaataactaagctagtaagaggcaatagaaaagatgagataaatat

SEQ ID NO: 47932 - DNA, 75 bp, Artificial Sequence
  Synthetic
tcaaaccgagtaacgttctaacatcattatttttgaagattcccaaataatcattcattcctccataatcgtttt

SEQ ID NO: 47933 - DNA, 75 bp, Artificial Sequence
  Synthetic
tccggatagagaaatatattgcggcatatacaaagttggaatttgactatcgactgcgaagacattagaccgttt

SEQ ID NO: 47934 - DNA, 75 bp, Artificial Sequence
  Synthetic
attatttttgaagattcccaaataatcattcattcctccataatcgttttgcatcatacctccatctttaggcat

SEQ ID NO: 47935 - DNA, 75 bp, Artificial Sequence
  Synthetic
ccaaagttatatcctcttcaacgcaaagtcgtatctgaagtagtttctaatatgaggaaaatgatcgaatcaaaa

SEQ ID NO: 47936 - DNA, 75 bp, Artificial Sequence
  Synthetic
tatgaggaaaatgatcgaatcaaaacgtcctctatacatcactcttcacttggcgtgtggatttggtaagactat

SEQ ID NO: 47937 - DNA, 75 bp, Artificial Sequence
  Synthetic
ctttaggtgctgaaataaccacatctggaaggcttactcgcttagccatttaattacggaactatttttttatac

SEQ ID NO: 47938 - DNA, 75 bp, Artificial Sequence
  Synthetic
tacccaataaaatgttaatacatcaatggaagacacaggtagaggcagtcggattggaacataagatatctatag

SEQ ID NO: 47939 - DNA, 75 bp, Artificial Sequence
  Synthetic
ggattggaacataagatatctatagatggagtaagtagtctattaaaggaactaaagactcaaagtccggatgta

SEQ ID NO: 47940 - DNA, 75 bp, Artificial Sequence
  Synthetic
cataatcctctaccatagtaacacgttttttagatctcatatgtgctaaaaagttttcccatactaattggttac

SEQ ID NO: 47941 - DNA, 75 bp, Artificial Sequence
  Synthetic
tccagagaatgtaattctttctccgcctattaacgcacctataaagacttttatgttgcctaaacaagatatagt

SEQ ID NO: 47942 - DNA, 75 bp, Artificial Sequence
  Synthetic
caataagcattatgatttgttcatcttggatgaatcacatacatataatctgatgaacaatacagcagttacaag

SEQ ID NO: 47943 - DNA, 75 bp, Artificial Sequence
  Synthetic
tcgctatatgttccagtaatggcggaaaactttttagaaatgttatatataaaagaattttttcgggttccaaac

SEQ ID NO: 47944 - DNA, 75 bp, Artificial Sequence
  Synthetic
taacagtattattaatattgccaagttatccgatctaaaaaaaactatctattcagtagatagtttttttgagcc

SEQ ID NO: 47945 - DNA, 75 bp, Artificial Sequence
  Synthetic
aaaacccttacaactacagtagtattggagtaaatacacaatgcatttttatatacattactgaattattattat

SEQ ID NO: 47946 - DNA, 75 bp, Artificial Sequence
  Synthetic
agggaaacagatgtataattttttatagtgtgaagaatatgataagaatataattattatatactatccatatat

SEQ ID NO: 47947 - DNA, 75 bp, Artificial Sequence
  Synthetic
cggaccagaggttgtatttataggagacgcccaaaatagacgtactccagatatggtcaaatcaatcaaggaact

SEQ ID NO: 47948 - DNA, 75 bp, Artificial Sequence
  Synthetic
gacgcccaaaatagacgtactccagatatggtcaaatcaatcaaggaactaaatagatttatattcgtatccacc

SEQ ID NO: 47949 - DNA, 75 bp, Artificial Sequence
  Synthetic
aaaaaactttacgatagactttaagctaaaatattttctaggatccggtgcccagtctaaaagttctttgttgca

SEQ ID NO: 47950 - DNA, 75 bp, Artificial Sequence
  Synthetic
ttccaaaaagtcgacggcggacatttttaacatggcatctattttaaatacacttaggtttttagaaaaaacatc

SEQ ID NO: 47951 - DNA, 75 bp, Artificial Sequence
  Synthetic
actcgcaaaatcgttaagaagtttaagcgacgatccgcatgctgagcaggccagtgtattacccctcatagtatt

SEQ ID NO: 47952 - DNA, 75 bp, Artificial Sequence
  Synthetic
ccagtgtattacccctcatagtattaatataatccaatgatacttttgtgatgtcggaaatcttaaccaatttag

SEQ ID NO: 47953 - DNA, 75 bp, Artificial Sequence
  Synthetic
atatctctctctttaactccaggaacttgtcaggatggtctactttaacatgttctcgtctaagagatgaaaatc

SEQ ID NO: 47954 - DNA, 75 bp, Artificial Sequence
  Synthetic
gtcttgggcttctttttgcgactcttcattccggaacgcacattggtgctatccatttaggtagtaaaaaataag

SEQ ID NO: 47955 - DNA, 75 bp, Artificial Sequence
  Synthetic
tcgcaaaacaacatatacacatttaataaaaataatattcattaaggagattcagattccaccgtacccataaat

SEQ ID NO: 47956 - DNA, 75 bp, Artificial Sequence
  Synthetic
agcttccgtaaacgccgtctttatctcttagtaagtttattgtatttatgaccttttccttatcttcatagaata

SEQ ID NO: 47957 - DNA, 75 bp, Artificial Sequence
  Synthetic
tataactaaacagtctatcatcgacacaaatgaaattcttgtttagacgtttgtagtttacgtatgcggctcgtt

SEQ ID NO: 47958 - DNA, 75 bp, Artificial Sequence
  Synthetic
acaaatgaaattcttgtttagacgtttgtagtttacgtatgcggctcgttcgcgtctcattttttcagatattgc

SEQ ID NO: 47959 - DNA, 75 bp, Artificial Sequence
  Synthetic
ctcttctctaagagctacgtgagacttaaccatagacgccaatgaatccctacatattttagaacagaaataccc

SEQ ID NO: 47960 - DNA, 75 bp, Artificial Sequence
  Synthetic
tatgcataataataagttgtgggtagtatcatccacatatttataattttaggactttgtattcagtatttttgg

SEQ ID NO: 47961 - DNA, 75 bp, Artificial Sequence
  Synthetic
aagttatcatgacttctagcgctgatttaactaacttaaaagaattacttagtctgtacaaaagtttgagatttt

SEQ ID NO: 47962 - DNA, 75 bp, Artificial Sequence
  Synthetic
gaattagaacagggttctaccgcatacgaaataaataatgaattggaactagtatttattaagccgccattgatt

SEQ ID NO: 47963 - DNA, 75 bp, Artificial Sequence
  Synthetic
tttaactaacttaaaagaattacttagtctgtacaaaagtttgagattttcagattctgcggctatagaaaagta

SEQ ID NO: 47964 - DNA, 75 bp, Artificial Sequence
  Synthetic
aaaaggtagctaatgtcgagacgtccatatctgattattatgatgaggtaaaaaataaaccgtttaatattgatc

SEQ ID NO: 47965 - DNA, 75 bp, Artificial Sequence
  Synthetic
atattttggaagcgtctttatttattcgaagggtaaaaatatggtagaacttggatcgggaaactcttttcaaat

SEQ ID NO: 47966 - DNA, 75 bp, Artificial Sequence
  Synthetic
tgccgtacccgttttagaaacataacaatgagcaagttctataagttagttaactaataaataaaaagtttaatt

SEQ ID NO: 47967 - DNA, 75 bp, Artificial Sequence
  Synthetic
accggatgagatgcgaagtgcgtgtaacaaagtattagacagcgataacggaatagactttctgagatttgtttt

SEQ ID NO: 47968 - DNA, 75 bp, Artificial Sequence
  Synthetic
cagttaatatatttaaactagctagtgagtacggattaaacatacccaactatttagaaattgaaatagaggaag

SEQ ID NO: 47969 - DNA, 75 bp, Artificial Sequence
  Synthetic
tatttagaaattgaaatagaggaagacacattatttgacgacgagttatactctattatagaacgctctttcgat

SEQ ID NO: 47970 - DNA, 75 bp, Artificial Sequence
  Synthetic
ggataaaggattaatgattatttctaaacatggttcggaacttgaaacagaattcactttctccattaaaacaga

SEQ ID NO: 47971 - DNA, 75 bp, Artificial Sequence
  Synthetic
tcaaggtagatcgtataggggataatatttttattcctagcgttataacaaaatcaggaaaaaagatattagtaa

SEQ ID NO: 47972 - DNA, 75 bp, Artificial Sequence
  Synthetic
tatttttattcctagcgttataacaaaatcaggaaaaaagatattagtaaaagatgtagaccatttaatacgatc

SEQ ID NO: 47973 - DNA, 75 bp, Artificial Sequence
  Synthetic
gtagtaagttaaccaacatggtgaattcttgcacactattgacgataggtgtagccgataaacaaatcatcttat

SEQ ID NO: 47974 - DNA, 75 bp, Artificial Sequence
  Synthetic
ccattttatacgactatgatgggaacggaacagaaactagaggagaagtaataaaacgaattatagacactatag

SEQ ID NO: 47975 - DNA, 75 bp, Artificial Sequence
  Synthetic
ataaaacgaattatagacactataggacgagactattatattaacggaaagtatttctctaaggttggtagtgca

SEQ ID NO: 47976 - DNA, 75 bp, Artificial Sequence
  Synthetic
tctacgtatctcgtcgtccaatattttatataaaaacattttatttctagaagttgccagaaaatcctgtaatac

SEQ ID NO: 47977 - DNA, 75 bp, Artificial Sequence
  Synthetic
cgatgagttagttgatgagattaataaatccggaactgtaaaacgaaaaataaaaaaccaatcagcatttgattt

SEQ ID NO: 47978 - DNA, 75 bp, Artificial Sequence
  Synthetic
aaatccggaactgtaaaacgaaaaataaaaaaccaatcagcatttgatttgagcagagaatgtttgggatatcca

SEQ ID NO: 47979 - DNA, 75 bp, Artificial Sequence
  Synthetic
cttataatcgctaatgtatagattgttttcagtgagatgattattagatttaatggcgtctcgttcacgtttgaa

SEQ ID NO: 47980 - DNA, 75 bp, Artificial Sequence
  Synthetic
atcattaggagatgatagctatttgactaatccgttattgtctccgtattatcgtaattcagtagccagacaaat

SEQ ID NO: 47981 - DNA, 75 bp, Artificial Sequence
  Synthetic
ttgtaaggttgtaagtttcaatattgaaaatactaattgtttaaataacccgagtattgaaactatatatggaaa

SEQ ID NO: 47982 - DNA, 75 bp, Artificial Sequence
  Synthetic
gaaaatactaattgtttaaataacccgagtattgaaactatatatggaaactttaaccagttcgtctcaatcttt

SEQ ID NO: 47983 - DNA, 75 bp, Artificial Sequence
  Synthetic
cctttgatataggtgcaaaaaatcctgccagaactgttttagaagtcaaggataactccgttagggtattggata

SEQ ID NO: 47984 - DNA, 75 bp, Artificial Sequence
  Synthetic
cttttggaatcgttcaaaacctttgactagttgtaaaatttgatctattgccctacgcgtatactcccttgcatc

SEQ ID NO: 47985 - DNA, 75 bp, Artificial Sequence
  Synthetic
catcggctgccaaagttatttgcgtctcgcctgtcatgtctggtaattcatatagagatcgaaaaaagagatctg

SEQ ID NO: 47986 - DNA, 75 bp, Artificial Sequence
  Synthetic
ctcgcctgtcatgtctggtaattcatatagagatcgaaaaaagagatctgtcgaagcctttcttgattggatgga

SEQ ID NO: 47987 - DNA, 75 bp, Artificial Sequence
  Synthetic
tagcggatagtttcaatttggctatgcgatacgtattagataaatggaatactaattatacaccttataataggt

SEQ ID NO: 47988 - DNA, 75 bp, Artificial Sequence
  Synthetic
gcgatacgtattagataaatggaatactaattatacaccttataataggtgtaaatctagaaattacataaaaaa

SEQ ID NO: 47989 - DNA, 75 bp, Artificial Sequence
  Synthetic
gaagccgtttatgtaacaatgacttataaaaatactaaaactggagagactgattacacgtacttctctaatggg

SEQ ID NO: 47990 - DNA, 75 bp, Artificial Sequence
  Synthetic
tcatatccgatgatgtattagtttgttgttgtcgtggttttggtgtaggagcagtactactaggtagaagaatag

SEQ ID NO: 47991 - DNA, 75 bp, Artificial Sequence
  Synthetic
catgaaatagaagatagatatgccagaactatttttaactttcatctaataagttgcgatgaaataggagatata

SEQ ID NO: 47992 - DNA, 75 bp, Artificial Sequence
  Synthetic
gaactatttttaactttcatctaataagttgcgatgaaataggagatatatatggtcttatgaaagaacgcattt

SEQ ID NO: 47993 - DNA, 75 bp, Artificial Sequence
  Synthetic
gccattaagaaactagtttattgcgacatccaacttactaaacacattattaatcagaatacgtatccggtattt

SEQ ID NO: 47994 - DNA, 75 bp, Artificial Sequence
  Synthetic
acatccaacttactaaacacattattaatcagaatacgtatccggtatttaacgattcttcacaagtgaaatgtt

SEQ ID NO: 47995 - DNA, 75 bp, Artificial Sequence
  Synthetic
tatgattattgattccacggaagaactaccaacagttactccaattacaacatatgaaccttctacatataatta

SEQ ID NO: 47996 - DNA, 75 bp, Artificial Sequence
  Synthetic
gtagagatatttgagagggaaaagtcatctcttgtatcatatattaaaactaccaataagaagagaaaagtcaat

SEQ ID NO: 47997 - DNA, 75 bp, Artificial Sequence
  Synthetic
attctatatccggtgttaaaaaaaattatcctatcatgtatttgagagtcttatatgtagcaaacatgatagctg

SEQ ID NO: 47998 - DNA, 75 bp, Artificial Sequence
  Synthetic
ttaatcaaccttggatcaaaaccatctctaagaggatgagagtcgatatcattaatcactctatagtaacgcgtg

SEQ ID NO: 47999 - DNA, 75 bp, Artificial Sequence
  Synthetic
attaatcactctatagtaacgcgtggaaaaagctccatattacaaactatagaaattatttttactaatagaaca

SEQ ID NO: 48000 - DNA, 75 bp, Artificial Sequence
  Synthetic
atgtactcacggctacggcattagatgagaaattattcctaattaagaaaatggctgaacacgatgtttatggag

SEQ ID NO: 48001 - DNA, 75 bp, Artificial Sequence
  Synthetic
tgagaaattattcctaattaagaaaatggctgaacacgatgtttatggagttagcaattttaaaatagggatgtt

SEQ ID NO: 48002 - DNA, 75 bp, Artificial Sequence
  Synthetic
ccaccagatgtataagttttagatcctttattactaccatcatgtccatggataaagacactccacatgccgcca

SEQ ID NO: 48003 - DNA, 75 bp, Artificial Sequence
  Synthetic
tagatgaggatagcaaaataaagttttttaaggggaaaaagctcaatattgtagcattacgatctctggaggatt

SEQ ID NO: 48004 - DNA, 75 bp, Artificial Sequence
  Synthetic
ttttaaggggaaaaagctcaatattgtagcattacgatctctggaggattgtataaattacgtgactaaatccga

SEQ ID NO: 48005 - DNA, 75 bp, Artificial Sequence
  Synthetic
atatagaaacggaatcggtagatcgtctaaaagacttgcttctaaaatgaaaaaaaacactgattcagaaatgga

SEQ ID NO: 48006 - DNA, 75 bp, Artificial Sequence
  Synthetic
tctaaaagacttgcttctaaaatgaaaaaaaacactgattcagaaatggatcaacgactcgggtataagtttttg

SEQ ID NO: 48007 - DNA, 75 bp, Artificial Sequence
  Synthetic
tgtatcgtattctaattttatattgcatcgattgcatgaaatcttgaccgtcaagcggccactcttatcgtttaa

SEQ ID NO: 48008 - DNA, 75 bp, Artificial Sequence
  Synthetic
catcgattgcatgaaatcttgaccgtcaagcggccactcttatcgtttaagaataatacagaacgaattatgata

SEQ ID NO: 48009 - DNA, 75 bp, Artificial Sequence
  Synthetic
tttggtctatgccatggatatctttaaagaactaatcttaaaacacacggatgaaaatgttttgatttctccagt

SEQ ID NO: 48010 - DNA, 75 bp, Artificial Sequence
  Synthetic
gagtattaaaggtaagagttatgacgcattagccacgttcactgtaaatatctttaaagaggtaatgaccaaaga

SEQ ID NO: 48011 - DNA, 75 bp, Artificial Sequence
  Synthetic
actctctggaagctacgtttatcgatgtacatattcccaagtttaaggtaacaggctcgtataatctggtggata

SEQ ID NO: 48012 - DNA, 75 bp, Artificial Sequence
  Synthetic
aatctagtagaaaagattacaacatggccaaaatttagggttgttaagccaaactcattcactttctcgttttcc

SEQ ID NO: 48013 - DNA, 75 bp, Artificial Sequence
  Synthetic
ggccaaaatttagggttgttaagccaaactcattcactttctcgttttcctccgtatcccctcctaatgtattac

SEQ ID NO: 48014 - DNA, 75 bp, Artificial Sequence
  Synthetic
ataccgatttcacaacggcaccagatttaaggaaccagaatgaaaaactctgataactacaatatttcatcatag

SEQ ID NO: 48015 - DNA, 75 bp, Artificial Sequence
  Synthetic
gcgtcgaatatatcatcgacaaagacatttataacggtgaatattgttttgctatctcaatatttatctagagtg

SEQ ID NO: 48016 - DNA, 75 bp, Artificial Sequence
  Synthetic
tctcaccttatcaaagtcgtttatatcacattgtatatagtttataaccttaactttcgaggttattggttgtgg

SEQ ID NO: 48017 - DNA, 75 bp, Artificial Sequence
  Synthetic
atatccgatgatgtattagtttgttgtcgtggttttggtgtaggagcagtactactaggtgtaagaataggagca

SEQ ID NO: 48018 - DNA, 75 bp, Artificial Sequence
  Synthetic
agtctagaattcattagacgtagtttatcatacgatatgcctccagaagttgtctatctagtaaacgcgataata

SEQ ID NO: 48019 - DNA, 75 bp, Artificial Sequence
  Synthetic
cggctgtggagttatatgaatagttggttgtagcggttggataggctgtctgctggcggccatcatattatctct

SEQ ID NO: 48020 - DNA, 75 bp, Artificial Sequence
  Synthetic
atacattaatgacctggtggaagctgaacacattaaacaaaaatctcagttaacgattaacgagttcaaatatga

SEQ ID NO: 48021 - DNA, 75 bp, Artificial Sequence
  Synthetic
gaacacattaaacaaaaatctcagttaacgattaacgagttcaaatatgaaatgctgcataactttttacctcat

SEQ ID NO: 48022 - DNA, 75 bp, Artificial Sequence
  Synthetic
actagattatacaatgaactaatatgatccttttctagattatttacaaacttggtatttcttggttctggagga

SEQ ID NO: 48023 - DNA, 75 bp, Artificial Sequence
  Synthetic
acattttttgtaaatgtaacatatttagacgacagatcttcgttaaaaagttttccatctatgtagaatccatcg

SEQ ID NO: 48024 - DNA, 75 bp, Artificial Sequence
  Synthetic
ttttagagatgatgcggaatcagtgttcatcgacgttcgcgagctggtgaaaaatatgccgtgggatgatgtcaa

SEQ ID NO: 48025 - DNA, 75 bp, Artificial Sequence
  Synthetic
ttttggaaatagatccttcaataacttatagttgggtgggaaaaaatcgattttatcactagactctttcttttt

SEQ ID NO: 48026 - DNA, 75 bp, Artificial Sequence
  Synthetic
ttcaaaaagtcagacggtagttatcgaacacatcctcactattcatggatgcagaatatttctattcctagaagt

SEQ ID NO: 48027 - DNA, 75 bp, Artificial Sequence
  Synthetic
tactatcattacctcatgaactatttcttgaatgagtatatgtattttctttcctatatcggacgcgttcattgg

SEQ ID NO: 48028 - DNA, 75 bp, Artificial Sequence
  Synthetic
gaacacatcctcactattcatggatgcagaatatttctattcctagaagtgttggattttatccggatcaagtaa

SEQ ID NO: 48029 - DNA, 75 bp, Artificial Sequence
  Synthetic
gaagacagtccagaaatggaagagttaatgaatatcattaatgatattcaaccattaacaaatgaaaataagaat

SEQ ID NO: 48030 - DNA, 75 bp, Artificial Sequence
  Synthetic
tacttttgttcatcagacgttccggaaagaggtcctcaggtaggtttagtatctcaattgtctgtcttgagttcc

SEQ ID NO: 48031 - DNA, 75 bp, Artificial Sequence
  Synthetic
atttggatttggaaaagaaaatttgtgagtatatcagatcatattataaagatgatataagttactttgaaacag

SEQ ID NO: 48032 - DNA, 75 bp, Artificial Sequence
  Synthetic
atgatatgtgattttgtaactgactttagacgtagaaaacggatgggattcttcggtaacttggaggtaggtatt

SEQ ID NO: 48033 - DNA, 75 bp, Artificial Sequence
  Synthetic
aaattcgcattaatattggagcaggaagattagtcagaccattcttggttgtggataacggagagctcatgatgg

SEQ ID NO: 48034 - DNA, 75 bp, Artificial Sequence
  Synthetic
atgtgtgtccggagttagaaagcagattagacgacatgacattctctgacattcagaaagagtttccgcatgtca

SEQ ID NO: 48035 - DNA, 75 bp, Artificial Sequence
  Synthetic
caccatttagtcataaccgtaatccaaaaatttttaaagtatatcttaacgaaagaagttgtatcatcgttagga

SEQ ID NO: 48036 - DNA, 75 bp, Artificial Sequence
  Synthetic
tcgaaatggtagatatagaacaatttacttttagtaacgtatgtgaatcggttcaaaaatttagaatgatgtcaa

SEQ ID NO: 48037 - DNA, 75 bp, Artificial Sequence
  Synthetic
gatggatatgtagcatcttcactagtgggaatcaatcacaattctggacccagagctattcttggatgtgctcaa

SEQ ID NO: 48038 - DNA, 75 bp, Artificial Sequence
  Synthetic
caatggaattcatttgatgtatccagagaggccaattgtcattagtaaggctttagaaacttcaaagattgcggc

SEQ ID NO: 48039 - DNA, 75 bp, Artificial Sequence
  Synthetic
atagcattaatgtcgtacaaaggtatcaatcaagaggatggaattatcatcaaaaaacaatttattcagagaggc

SEQ ID NO: 48040 - DNA, 75 bp, Artificial Sequence
  Synthetic
atgtaaatgtttaacgttttaaactttgtattcaatgatccattatcatacgctagcatggtcttgtaatattca

SEQ ID NO: 48041 - DNA, 75 bp, Artificial Sequence
  Synthetic
aaactttaataacaaagaaagagataggtctaatgcatattcgaaattagaaagtaatggattagttagactgaa

SEQ ID NO: 48042 - DNA, 75 bp, Artificial Sequence
  Synthetic
aaagtaatggattagttagactgaatgctttcttggaatccggagacgctatggcacgaaatatctcatcaagaa

SEQ ID NO: 48043 - DNA, 75 bp, Artificial Sequence
  Synthetic
atggcacgaaatatctcatcaagaactcttgaagatgattttgctagagataatcagattagcttcgatgtttcc

SEQ ID NO: 48044 - DNA, 75 bp, Artificial Sequence
  Synthetic
tctttccaagtgtcaaattccaaatttttttcattgatagtaccaaattcttctatctctttaactacttgcata

SEQ ID NO: 48045 - DNA, 75 bp, Artificial Sequence
  Synthetic
acttactgacaaagttaaggtgcgagtattaaccatgaaagaaagaagacccattctaggagataaatttaccac

SEQ ID NO: 48046 - DNA, 75 bp, Artificial Sequence
  Synthetic
tcgagaatatttaatttggtcattattaatcaagtcaattatcttatttttaacaaatgtgagtattttactcat

SEQ ID NO: 48047 - DNA, 75 bp, Artificial Sequence
  Synthetic
gtattaaccatgaaagaaagaagacccattctaggagataaatttaccactagaacgagtcaaaagggaacagtc

SEQ ID NO: 48048 - DNA, 75 bp, Artificial Sequence
  Synthetic
accagatgtcattattaattctacatccatcttctctagaaaaactatatctatgttgatagaagttattttaac

SEQ ID NO: 48049 - DNA, 75 bp, Artificial Sequence
  Synthetic
tccatcttctctagaaaaactatatctatgttgatagaagttattttaacagccgcatattctgctaagccgtac

SEQ ID NO: 48050 - DNA, 75 bp, Artificial Sequence
  Synthetic
atccattgatacatatatgcaattcgctaaacaatgttatgagcattcaaatccgaaattgtccgatgaagaatt

SEQ ID NO: 48051 - DNA, 75 bp, Artificial Sequence
  Synthetic
gctaaacaatgttatgagcattcaaatccgaaattgtccgatgaagaattgtcggataaaatcttttgtgaaaag

SEQ ID NO: 48052 - DNA, 75 bp, Artificial Sequence
  Synthetic
gtggtaagaaagtaattcagacacttcttaacgaacgcggtgtgaatgtactcaaggatttgcttaaaggaagaa

SEQ ID NO: 48053 - DNA, 75 bp, Artificial Sequence
  Synthetic
tggaccaatttattatttgcgtctgagacatttaactcaggacaaggcaaccgttagatgtagaggtaaaaagac

SEQ ID NO: 48054 - DNA, 75 bp, Artificial Sequence
  Synthetic
gcagcacaaatcaaaggtattaatacatgtcttagatgttcaaaacttaatctctctcctctcttaacaaaaatt

SEQ ID NO: 48055 - DNA, 75 bp, Artificial Sequence
  Synthetic
cattagataaagttgatctcaagccgtcttttctgaagtaggtttcttattcagtagttgttgtagataatcgtc

SEQ ID NO: 48056 - DNA, 75 bp, Artificial Sequence
  Synthetic
ctataactactttatcatagtctaaagatgactgatattcaggtttcgttggtggttgaggtgtaactgctactt

SEQ ID NO: 48057 - DNA, 75 bp, Artificial Sequence
  Synthetic
ctaatcggttcggtaacgtctgtggatggaggtgctacttctacagaacctgtagcctcagttgtcaacggagat

SEQ ID NO: 48058 - DNA, 75 bp, Artificial Sequence
  Synthetic
agatgactgatattcaggtttcgttggtggttgaggtgtaactgctacttgagataccgaagtctgatattcaga

SEQ ID NO: 48059 - DNA, 75 bp, Artificial Sequence
  Synthetic
tggaggtgctacttctacagaacctgtagcctcagttgtcaacggagatacatcttcaatgcgaggaaatgtata

SEQ ID NO: 48060 - DNA, 75 bp, Artificial Sequence
  Synthetic
atacaaatccattaatgtggaatatcgattcttggtaattaatagattgggtgcagatctagatgcggtgatcag

SEQ ID NO: 48061 - DNA, 75 bp, Artificial Sequence
  Synthetic
gataccgatcacgttctagttctcttttgtagaacttaactttttctttctcagcatctagttgatattccaacc

SEQ ID NO: 48062 - DNA, 75 bp, Artificial Sequence
  Synthetic
ctgtttatatattgcttactagatgttgcaatatttcacatgatgtagtgatagatatgatagacaaagataaaa

SEQ ID NO: 48063 - DNA, 75 bp, Artificial Sequence
  Synthetic
caattcacgttcacatgggttacctccgcagtttttacgagcgatttcacgttccagatcacgttcagccttcat

SEQ ID NO: 48064 - DNA, 75 bp, Artificial Sequence
  Synthetic
cgaagttcagcttctaggacggcgattctttttctttcgaattcacagctggatgtgcaaccgtttcctccgttt

SEQ ID NO: 48065 - DNA, 75 bp, Artificial Sequence
  Synthetic
agctctctcttgtagtaactatcatttttatctgattccctggcacgtttaagatcttcatgcaattgagtcagc

SEQ ID NO: 48066 - DNA, 75 bp, Artificial Sequence
  Synthetic
gaagttggtgcatatctctttcaacattcgacatgagatccttaagggccatatcgtctagattttgttgagatg

SEQ ID NO: 48067 - DNA, 75 bp, Artificial Sequence
  Synthetic
ttttttgagccatattccacagacaatattagacatatggtaaaacgactagatggaccatctaataaatatcat

SEQ ID NO: 48068 - DNA, 75 bp, Artificial Sequence
  Synthetic
ccaccattagatttacaggctgctagttgtcgttcgagatcagaaatacgggttttcttggaattgatttcgtcg

SEQ ID NO: 48069 - DNA, 75 bp, Artificial Sequence
  Synthetic
gttgtcgttcgagatcagaaatacgggttttcttggaattgatttcgtcgatgtacttggcatgattggtatcga

SEQ ID NO: 48070 - DNA, 75 bp, Artificial Sequence
  Synthetic
cgcgtattaatgaatggagttatgtaaaatttttgttgataaaaaattaaaaataacttagttattatcactctc

SEQ ID NO: 48071 - DNA, 75 bp, Artificial Sequence
  Synthetic
ttttgatctttattaaatttagagataatatcctgaacagcattgctcggcgtcaacgctggaaggagtgaattc

SEQ ID NO: 48072 - DNA, 75 bp, Artificial Sequence
  Synthetic
aggaatagaaataaaaattattatagtgatgaaattcagttggaatattgcctccggagtcataaaaggatacta

SEQ ID NO: 48073 - DNA, 75 bp, Artificial Sequence
  Synthetic
cgatgatgtattagtttgttgtcgtggttttggtgtaggagcagtactactaggtagaagaataggagccggtgt

SEQ ID NO: 48074 - DNA, 75 bp, Artificial Sequence
  Synthetic
gatccatgattctatctctgagacgttgcatctctctttccatatcagcattgctttcattattacgtctgcagt

SEQ ID NO: 48075 - DNA, 75 bp, Artificial Sequence
  Synthetic
tatttccacggcattcactcagttgtctttcaagatctgagattctggattggagtctgctaatctcggtaagat

SEQ ID NO: 48076 - DNA, 75 bp, Artificial Sequence
  Synthetic
ctggataggagattgtgtctgtcaagttactgctgtagacgtacatggaaaggaaattatgagaatgagattcaa

SEQ ID NO: 48077 - DNA, 75 bp, Artificial Sequence
  Synthetic
tggagtctgctaatctcggtaagatttcctcctccgctctcgatacagtcagccaacttattctccagttctcta

SEQ ID NO: 48078 - DNA, 75 bp, Artificial Sequence
  Synthetic
gcaatttctgattctagagtactgattctgctcacgtagttactaatagttgtcttggccttatcaagatcctcc

SEQ ID NO: 48079 - DNA, 75 bp, Artificial Sequence
  Synthetic
ttctgctcacgtagttactaatagttgtcttggccttatcaagatcctccttgtatttgtcgcattccttgatat

SEQ ID NO: 48080 - DNA, 75 bp, Artificial Sequence
  Synthetic
cgccgtagtgtcatctccagaggaaatatcctcacaacttaatgaagatctatttccagatgatgattctccggc

SEQ ID NO: 48081 - DNA, 75 bp, Artificial Sequence
  Synthetic
tcagctcggagatcgtcatcgcgttgttttagccacatacgactgagttcaagttctcgttgacaagatccatct

SEQ ID NO: 48082 - DNA, 75 bp, Artificial Sequence
  Synthetic
gaggatcgactccatagtggacaacattaatacagacgataacttgatttcgaaattacccatggagatacaacg

SEQ ID NO: 48083 - DNA, 75 bp, Artificial Sequence
  Synthetic
catggatttggtaactttgatagccgtagatctttgttccttcgccaacaggttaaagaaattaataaagaattt

SEQ ID NO: 48084 - DNA, 75 bp, Artificial Sequence
  Synthetic
gtctgtcgattctttcggttttataaacagaatccctttccaaagtcctaatcttactgagtttatcactaagtt

SEQ ID NO: 48085 - DNA, 75 bp, Artificial Sequence
  Synthetic
aacagaatccctttccaaagtcctaatcttactgagtttatcactaagttctgcattcaattcggtgagttttct

SEQ ID NO: 48086 - DNA, 75 bp, Artificial Sequence
  Synthetic
attgtgggaacataattaggatcttctaatggattgtatggcttgatagcatcatctttatcattattaggggga

SEQ ID NO: 48087 - DNA, 75 bp, Artificial Sequence
  Synthetic
ttctaatggattgtatggcttgatagcatcatctttatcattattaggtgggggatggacaaccttaattggttg

SEQ ID NO: 48088 - DNA, 75 bp, Artificial Sequence
  Synthetic
tattgtctaacacctataagattatcaaaatcttgtctgcttaatacaccgttaacaatttttgccttgaattct

SEQ ID NO: 48089 - DNA, 75 bp, Artificial Sequence
  Synthetic
gacttcaggagttagtagaagaactctgtttctgtatctatcaacgctggaatcaatactcaagttaaggatagc

SEQ ID NO: 48090 - DNA, 75 bp, Artificial Sequence
  Synthetic
ccgaactaaaaaaaatgacttgtggtcaacccataagtctttttaatgaagacggagatttcgtagaagttgaac

SEQ ID NO: 48091 - DNA, 75 bp, Artificial Sequence
  Synthetic
aaggacatattcctctacaccactatctgattcattcactatcaatcgataacaagatctttgatatactgacgg

SEQ ID NO: 48092 - DNA, 75 bp, Artificial Sequence
  Synthetic
agatgtatcacacgctctggccacccagataaccaaaaagtcacacgctccaggatatacattgtataaaaagct

SEQ ID NO: 48093 - DNA, 75 bp, Artificial Sequence
  Synthetic
attttaaactagtctatttcatactattttgtgtgatcaccatggacataaagatagatattagtatttctggtg

SEQ ID NO: 48094 - DNA, 75 bp, Artificial Sequence
  Synthetic
tttcataatatggtcgcatgccttaaatgtcagtgcttccataatatagtctggaacactaatgggtgatgaaaa

SEQ ID NO: 48095 - DNA, 75 bp, Artificial Sequence
  Synthetic
agataccggaccatatgctacgttgataaataactctgagccactaactagataatgattaatgttaaggaaaag

SEQ ID NO: 48096 - DNA, 75 bp, Artificial Sequence
  Synthetic
atgaagtactgttcatacatgatgagatgtttatatgttggcatagtagtgagatcgacgtttggtaatggcaat

SEQ ID NO: 48097 - DNA, 75 bp, Artificial Sequence
  Synthetic
actagaaggtacgactccgttacactgttatctaatgaatgaaggatttgaatcatctgttttaaaaaacctatt

SEQ ID NO: 48098 - DNA, 75 bp, Artificial Sequence
  Synthetic
gcaggaataccaacaaacatattaccacatccgtattttctatgaatatcacatatcatgttaaaaaatcttgat

SEQ ID NO: 48099 - DNA, 75 bp, Artificial Sequence
  Synthetic
cacatccgtattttctatgaatatcacatatcatgttaaaaaatcttgatagaagagcgaatatctcgtctgact

SEQ ID NO: 48100 - DNA, 75 bp, Artificial Sequence
  Synthetic
tactttcctgtagtgttgattctagactccacatcaacaccattattaaaaatagttttatatacatctttaatc

SEQ ID NO: 48101 - DNA, 75 bp, Artificial Sequence
  Synthetic
actccacatcaacaccattattaaaaatagttttatatacatctttaatctgctctccgttaatcgtcgaacgtt

SEQ ID NO: 48102 - DNA, 75 bp, Artificial Sequence
  Synthetic
aattcagtaaatagagagatatcagccgcactagcatcccctcccaatagttctccccttttaaaggtatctaat

SEQ ID NO: 48103 - DNA, 75 bp, Artificial Sequence
  Synthetic
atatcacgaagaatattacgaattacatttcttgtttttcttgagagacctgattcagaactcaactcatcgttc

SEQ ID NO: 48104 - DNA, 75 bp, Artificial Sequence
  Synthetic
ttccagaattgtaacaacaaggttgcctcataccttgtatacatcggatacgacatcaacattcctactaaagac

SEQ ID NO: 48105 - DNA, 75 bp, Artificial Sequence
  Synthetic
atttggtcccgacaccatcaaagaattcttatgatataaggaaacagcttttaggtactcatctactctacaaga

SEQ ID NO: 48106 - DNA, 75 bp, Artificial Sequence
  Synthetic
aatctttggagtgcttggtacatttttcaataaggttcgtgacctccatttattataaaaaaattttattcaaaa

SEQ ID NO: 48107 - DNA, 75 bp, Artificial Sequence
  Synthetic
cataagccataacaacctctttaatagccgtttcatgaggtttatcagccatgagcctgagtagttggaagaatc

SEQ ID NO: 48108 - DNA, 75 bp, Artificial Sequence
  Synthetic
gatcgtagatctcccatgtggcggaatactaccatctatcgcatgtggatggacagtaggtaatggccatgggaa

SEQ ID NO: 48109 - DNA, 75 bp, Artificial Sequence
  Synthetic
tcatagatgaaatactcttcaaagtttctgaaataagattagtaacagtcttacctccgactactctgggtaaca

SEQ ID NO: 48110 - DNA, 75 bp, Artificial Sequence
  Synthetic
atttggataattttaccagaatactatttggtaagactccgtataaatcaacagaagttaataagcgtatagcca

SEQ ID NO: 48111 - DNA, 75 bp, Artificial Sequence
  Synthetic
tatgatccaatgtgtttaatatatgattatcaagtcttatacgatccgcgtcttttttgacaggatcaggttctt

SEQ ID NO: 48112 - DNA, 75 bp, Artificial Sequence
  Synthetic
gttttctttttctttcgtacatctctaattatgaaaaagtaaatcattatgagatgggcgagatggacgagattg

SEQ ID NO: 48113 - DNA, 75 bp, Artificial Sequence
  Synthetic
catcatcatcatcatcatcttcaacttcgatatttattttgctatcttgatgatgtcctgtatcagttgcatttt

SEQ ID NO: 48114 - DNA, 75 bp, Artificial Sequence
  Synthetic
cagcacttgactgaatattagcgcattcattgtctattattaccatatttctaaatccaaaatgtatatgttgaa

SEQ ID NO: 48115 - DNA, 75 bp, Artificial Sequence
  Synthetic
cggttcttaatattgtattgtttatactcaagatattcgttaaacgaattaaaattatttaatttaatacattcc

SEQ ID NO: 48116 - DNA, 75 bp, Artificial Sequence
  Synthetic
cattgtaataaatatccactctgtcatacgtattgatgaagtactgttcatacatgatgagatgtttatatgttg

SEQ ID NO: 48117 - DNA, 75 bp, Artificial Sequence
  Synthetic
tatagcatgaattcgcttatcgttatcgggtttatcttctgtcaccttagcaattccttttttattaaactctac

SEQ ID NO: 48118 - DNA, 75 bp, Artificial Sequence
  Synthetic
ataatcataaccatttctattgtttgttctaatataaacgagtatagcatcattgctaaatttttcaatagtatc

SEQ ID NO: 48119 - DNA, 75 bp, Artificial Sequence
  Synthetic
attgctgtgttatcttagatataaattcaatgggagcttaaactactacgttctgtacaaattattgactaaagg

SEQ ID NO: 48120 - DNA, 75 bp, Artificial Sequence
  Synthetic
taaatgtccaggattctcctaaatacgtaaactttaatagtgcgaaatcattcaaaaatctaccacttatagata

SEQ ID NO: 48121 - DNA, 75 bp, Artificial Sequence
  Synthetic
ttggacaatctgaccatccatcgcattgtacgatgtagtagtaactgttgttctacgtctaggagcaccagaagt

SEQ ID NO: 48122 - DNA, 75 bp, Artificial Sequence
  Synthetic
cgtaaactttaatagtgcgaaatcattcaaaaatctaccacttatagatagatagtacatgaatgcgtatagtag

SEQ ID NO: 48123 - DNA, 75 bp, Artificial Sequence
  Synthetic
gattcatccgcacgatggtagaacacggagcaaacattaattcagtcacgcatgccggggatacgccgttacata

SEQ ID NO: 48124 - DNA, 75 bp, Artificial Sequence
  Synthetic
gatatacatgtgatccgtttacgttaaaccataaatacatgggtgatcctataaacatgaatttatttctaattc

SEQ ID NO: 48125 - DNA, 75 bp, Artificial Sequence
  Synthetic
gataaatctagctctgtattctgtatccgtcaatctaatattaagaaggtgttgagtgaaaggtggaagatcgta

SEQ ID NO: 48126 - DNA, 75 bp, Artificial Sequence
  Synthetic
aaaccataaatacatgggtgatcctataaacatgaatttatttctaattctcagagccatagttaattgaccgtg

SEQ ID NO: 48127 - DNA, 75 bp, Artificial Sequence
  Synthetic
tagtgcggagtcaacaatgaaaatggataagaagaggacaaagtttcagaatagagccaaaatggtaaaagaaat

SEQ ID NO: 48128 - DNA, 75 bp, Artificial Sequence
  Synthetic
cattgctcgttatttcagaatcgtatatataaggactaccatcgtgattcttaccagatattatacaaaatacta

SEQ ID NO: 48129 - DNA, 75 bp, Artificial Sequence
  Synthetic
tatataaaatatattgacccacgttagtaatcatgtaaatgtttaacgttttaaactttgtattcaatgatccat

SEQ ID NO: 48130 - DNA, 75 bp, Artificial Sequence
  Synthetic
acatacttaaaaatctgtgttctagaaattgtatcgatttctacatatacgctgataaatataataacaagaaaa

SEQ ID NO: 48131 - DNA, 75 bp, Artificial Sequence
  Synthetic
tgtgttagccattgcattggggctcctaatggagattttctattctcgtccattttaggatatgctttcataaag

SEQ ID NO: 48132 - DNA, 75 bp, Artificial Sequence
  Synthetic
cattttaggatatgctttcataaagtccctaataacttcatgaataatgtttctatgttttctactgatgcatgt

SEQ ID NO: 48133 - DNA, 75 bp, Artificial Sequence
  Synthetic
ccggtctcagtgaatccatctcaacttcggaactaacgattactatgaatcataaagactgcgatcccgtctttc

SEQ ID NO: 48134 - DNA, 75 bp, Artificial Sequence
  Synthetic
cggtaatgctcgcaacattaacatcttgaaccgttggtacaattccgttccataaatttataatgttcgccattt

SEQ ID NO: 48135 - DNA, 75 bp, Artificial Sequence
  Synthetic
attcaacaatgtcgagatatatggacgataataacttagttcacggaaatatcgctatgattggtatgaatgact

SEQ ID NO: 48136 - DNA, 75 bp, Artificial Sequence
  Synthetic
gaattgctgcaatatattactatggtaaactctttgacatattttgaggaacccaattacgacgagtttcggcgc

SEQ ID NO: 48137 - DNA, 75 bp, Artificial Sequence
  Synthetic
ttgaaccgttggtacaattccgttccataaatttataatgttcgccatttatataactcattttttgaatatact

SEQ ID NO: 48138 - DNA, 75 bp, Artificial Sequence
  Synthetic
aacatcaatctttttagccagagatatcatagccgctcttagagtttcagcgtgattttccaacctaaatagaac

SEQ ID NO: 48139 - DNA, 75 bp, Artificial Sequence
  Synthetic
tgttaaattttctaatggatctagtattattgggtccaacttctgcctgaaatccaaatatggaagcggatacaa

SEQ ID NO: 48140 - DNA, 75 bp, Artificial Sequence
  Synthetic
atagtgtcattgacatcttgaactctcctatctaatgccggtgtaccacctatagatttcgaatattcgaatgct

SEQ ID NO: 48141 - DNA, 75 bp, Artificial Sequence
  Synthetic
ttttgataaatgggaactgctgcaacaattcagactcccaccaaattaatgaataaagaaaatgcagaaatgatt

SEQ ID NO: 48142 - DNA, 75 bp, Artificial Sequence
  Synthetic
gtaaccctggataaaaagtaaacacactgcagccgttgctaccacaataaaaaaaattgatagagagttcattta

SEQ ID NO: 48143 - DNA, 75 bp, Artificial Sequence
  Synthetic
actgcagccgttgctaccacaataaaaaaaattgatagagagttcatttataatctattagaagctgacaaaatt

SEQ ID NO: 48144 - DNA, 75 bp, Artificial Sequence
  Synthetic
taatttaatacattcccatgtccagacaacaatcgtctggattaatctgttcctgtcgtctcataccggacgacg

SEQ ID NO: 48145 - DNA, 75 bp, Artificial Sequence
  Synthetic
gtatcaattaaataattaatgcccaatttggatatagcagcctgaagctcatcttgtttagttacggatcctaat

SEQ ID NO: 48146 - DNA, 75 bp, Artificial Sequence
  Synthetic
catattctcacaccgtctcttccgcagataaatgcgaacccgtacccagtaatacctttaactatatcgatgtgg

SEQ ID NO: 48147 - DNA, 75 bp, Artificial Sequence
  Synthetic
aatggactccatggaagctctagagtatcttagtgaactgaaggaatcaggtgggcggagtcccagaccagaatt

SEQ ID NO: 48148 - DNA, 75 bp, Artificial Sequence
  Synthetic
gtgattatgaatattggctattagagcaccttctaagaaatctataatatctttgaaacacgatttaaaatcaaa

SEQ ID NO: 48149 - DNA, 75 bp, Artificial Sequence
  Synthetic
ttacgcaatagtcagactgtagttcgatcatacttcctacattagaaggaggaacagttttaaagtctcttggtt

SEQ ID NO: 48150 - DNA, 75 bp, Artificial Sequence
  Synthetic
ttaactaactaccttggtttccaaatagcttaagaaggcatttacacataatggagatatattccagcagaaaac

SEQ ID NO: 48151 - DNA, 75 bp, Artificial Sequence
  Synthetic
gcaccttctaagaaatctataatatctttgaaacacgatttaaaatcaaaccacgaatatacttctacgaagaaa

SEQ ID NO: 48152 - DNA, 75 bp, Artificial Sequence
  Synthetic
atccggatctatgatagttttaacattattatattctctattaaatacctccacatctaaaaatgttaattttga

SEQ ID NO: 48153 - DNA, 75 bp, Artificial Sequence
  Synthetic
cctgaactaaacgctataagctctattgtttgcgaactctttaaacgatattcttgaaatacatgtaacaaagtt

SEQ ID NO: 48154 - DNA, 75 bp, Artificial Sequence
  Synthetic
ccatacgatgatctagttacaactatcacaattaaatcattgactgctggagatgccggtacttatgtatgtgca

SEQ ID NO: 48155 - DNA, 75 bp, Artificial Sequence
  Synthetic
caacagaaatatttaatcctccgtttgatacagatgcgccatatttatggatttcggattcacacgttgtttgtc

SEQ ID NO: 48156 - DNA, 75 bp, Artificial Sequence
  Synthetic
atctataatataataatcaaaatcgtataaagttatataattatcgcgttcagattgtgatcttttcaaatagac

SEQ ID NO: 48157 - DNA, 75 bp, Artificial Sequence
  Synthetic
cgattcattatttcccaagatttgagcagttgatgccgttggcataggtgctaccaataaactatttctaagacc

SEQ ID NO: 48158 - DNA, 75 bp, Artificial Sequence
  Synthetic
taaaaaccccatttctctagtaagtatcttatgtatatgtttgtaaaatatcttcatggtgggaatatgctctac

SEQ ID NO: 48159 - DNA, 75 bp, Artificial Sequence
  Synthetic
ctccaatgtttaacaagggccattttacgagattattaaatccttgtttgataaatgtagccaatgagggttcga

SEQ ID NO: 48160 - DNA, 75 bp, Artificial Sequence
  Synthetic
taatgattctattaacttcttgattattcatggccttaatagcattggatattttatcatccatgtttaaaaaat

SEQ ID NO: 48161 - DNA, 75 bp, Artificial Sequence
  Synthetic
tacgagattattaaatccttgtttgataaatgtagccaatgagggttcgagttcaacgacgattgaattctcttc

SEQ ID NO: 48162 - DNA, 75 bp, Artificial Sequence
  Synthetic
tgagtattggattgtatattttattttatattttatattttgtagtaagaatagaatgctaatgtcaagtttatt

SEQ ID NO: 48163 - DNA, 75 bp, Artificial Sequence
  Synthetic
ccattgaagagagaaagagaataaaaatatttttgtaaaacttttttatgagaccatcgaagagagaaagagaaa

SEQ ID NO: 48164 - DNA, 75 bp, Artificial Sequence
  Synthetic
ttctttttcgactttttgtttatattaaatattttaaaatttatagctgatagcaattcatgtactacggataat

SEQ ID NO: 48165 - DNA, 75 bp, Artificial Sequence
  Synthetic
taaatattttaaaatttatagctgatagcaattcatgtactacggataatgtagacgcgtattgcgcatcgatat

SEQ ID NO: 48166 - DNA, 75 bp, Artificial Sequence
  Synthetic
tttttacgactccatcagaaagaggtttaatatttttgtgagaccattgaagagagaaagagaaagagaataaaa

SEQ ID NO: 48167 - DNA, 75 bp, Artificial Sequence
  Synthetic
aggtcttccatttaaatattatataaacatttgtgtttgtatcttattcgtcttttatggaatagttttttacta

SEQ ID NO: 48168 - DNA, 75 bp, Artificial Sequence
  Synthetic
tgctaaaactcggatttgaagaaatcaaaggactgagtaccgatatcacttcagaaattatcgatgtggagatcg

SEQ ID NO: 48169 - DNA, 75 bp, Artificial Sequence
  Synthetic
atagctgaatctgctaaatatacaatagatgcaatgtatcgcctaagacctatatatagaatcaaggtagaatct

SEQ ID NO: 48170 - DNA, 75 bp, Artificial Sequence
  Synthetic
gattaagattaaacataagggaatgtcatttgtattttataagccaaagcattctactgttgttaaatacttgtc

SEQ ID NO: 48171 - DNA, 75 bp, Artificial Sequence
  Synthetic
tcatttgtattttataagccaaagcattctactgttgttaaatacttgtctggaggaggtatatatcatgatgat

SEQ ID NO: 48172 - DNA, 75 bp, Artificial Sequence
  Synthetic
ttatatatataatttactaactttagttagataaattaataatatataagttttagtacattaatattatatttt

SEQ ID NO: 48173 - DNA, 75 bp, Artificial Sequence
  Synthetic
agtaggcatttcatcttttcctttctcaatactattcaacttgttaaattaataatggatagtttaaaatagtta

SEQ ID NO: 48174 - DNA, 75 bp, Artificial Sequence
  Synthetic
aaactctagagggtaagaaagatcgatcgctttatagagaccatcagaaagaggtttaatatttttgtgagacca

SEQ ID NO: 48175 - DNA, 75 bp, Artificial Sequence
  Synthetic
gaggtttaatatttttgtgagaccattgaagagagaaagagaaagagaataaaaatattttagtgactccatcag

SEQ ID NO: 48176 - DNA, 75 bp, Artificial Sequence
  Synthetic
atcttcctattcctttaacttctggaagttccaaactcagaaccaaatgattaagcgcagtaatatactgatccc

SEQ ID NO: 48177 - DNA, 75 bp, Artificial Sequence
  Synthetic
aacgattattggatctagccgtctgtatcatattcaacatgtttaatatatcctttcgtttcccctttacaggca

SEQ ID NO: 48178 - DNA, 75 bp, Artificial Sequence
  Synthetic
aactagattatacaatgaactaatatgatccttttctagattatttacgaacttggtatttattgtttctggagg

SEQ ID NO: 48179 - DNA, 75 bp, Artificial Sequence
  Synthetic
aaatgccttccgaagtttaagaattctattagagtattgcattttgatagtttatcacctacatcatcaaaaata

SEQ ID NO: 48180 - DNA, 75 bp, Artificial Sequence
  Synthetic
tttatcacctacatcatcaaaaataagtaaaaagtgtgctgattttttatgattttgtgcgacagcaatacattt

SEQ ID NO: 48181 - DNA, 75 bp, Artificial Sequence
  Synthetic
tactaacgaaattaatatgatttggccaaatgtatccatcataatctggattataaacgggtgtaaacaagaata

SEQ ID NO: 48182 - DNA, 75 bp, Artificial Sequence
  Synthetic
ccaaatgtatccatcataatctggattataaacgggtgtaaacaagaatatatgtttatattttttaactagtgt

SEQ ID NO: 48183 - DNA, 75 bp, Artificial Sequence
  Synthetic
gtcttgtaattattattaaatatttttggacagtgtttggtatttgtcttagaacaacattttgccacgctatca

SEQ ID NO: 48184 - DNA, 75 bp, Artificial Sequence
  Synthetic
tcttcgtcatagtacttacaatcactgtgggatgatccattgttaccacgtctacactcggcgagctcgcgttta

SEQ ID NO: 48185 - DNA, 75 bp, Artificial Sequence
  Synthetic
ttaaaaccattctaaacggcatttttaataaattttctcttgaaaattgtttttcttgaaaacaattcataatta

SEQ ID NO: 48186 - DNA, 75 bp, Artificial Sequence
  Synthetic
ttttcttgaaaacaattcataattatatttacagttactaaattaatttgataataaatcaaaatatggaaaact

SEQ ID NO: 48187 - DNA, 75 bp, Artificial Sequence
  Synthetic
gctaatctctgtaagatttcctcctccactctcgatgcagtcggccaacttattctctagttctctaatacgcga

SEQ ID NO: 48188 - DNA, 75 bp, Artificial Sequence
  Synthetic
tcttatatgtagcaaacatgatacccgcgataccaataatctttagatattcacgcgtgctatggatggcattat

SEQ ID NO: 48189 - DNA, 75 bp, Artificial Sequence
  Synthetic
tatcaagataagctaattcactaaacacattatcgatttcggtattgttactcgcagaatagagttcgttatgat

SEQ ID NO: 48190 - DNA, 75 bp, Artificial Sequence
  Synthetic
atatttattatcatgatgacaccagaaaacgacgaagagcagacatctgtgttctccgctactgtttacggagac

SEQ ID NO: 48191 - DNA, 75 bp, Artificial Sequence
  Synthetic
aaaacgacgaagagcagacatctgtgttctccgctactgtttacggagacaaaattcagggaaaaaataaacgca

SEQ ID NO: 48192 - DNA, 75 bp, Artificial Sequence
  Synthetic
cgaatgcggcatgatggagtcgtcatcattctttgctttcgttaactgtttggaggaagaataagaatctttgtt

SEQ ID NO: 48193 - DNA, 75 bp, Artificial Sequence
  Synthetic
gtgcacacctttgaaatattctgatatctattttgtcctgtaaagaaccctgaagttgctaccttattaagaacg

SEQ ID NO: 48194 - DNA, 75 bp, Artificial Sequence
  Synthetic
gagagaaagagaataaaatattttacgactccatcagaaagaggtttaatatttttgtgagaccattgaagagag

SEQ ID NO: 48195 - DNA, 75 bp, Artificial Sequence
  Synthetic
cggcagtaatcaacaatatgcaaatagagcaattactagggagggtatgtcgagaaacagaactattagatagga

SEQ ID NO: 48196 - DNA, 75 bp, Artificial Sequence
  Synthetic
catcatctactaatagaaaggttgcttctagcactacacaatataaacacaaagaaagctgtaatggtttatatt

SEQ ID NO: 48197 - DNA, 75 bp, Artificial Sequence
  Synthetic
tttctggaagtggatatacatagttgtgatcatcattatcactaacctcatcatgtatatcattatctatatcct

SEQ ID NO: 48198 - DNA, 75 bp, Artificial Sequence
  Synthetic
ttctagcactacacaatataaacacaaagaaagctgtaatggtttatattaccagggttcttgttatatattcca

SEQ ID NO: 48199 - DNA, 75 bp, Artificial Sequence
  Synthetic
gatctatatcatgtatatcctgatctatatcatgtatatcctgatctatatcatgtatatcctgatctatatcat

SEQ ID NO: 48200 - DNA, 75 bp, Artificial Sequence
  Synthetic
catcaacactacccaataaatccgatgtcttgactacctggctcattgaatatgttgaggatacatggggatctg

SEQ ID NO: 48201 - DNA, 75 bp, Artificial Sequence
  Synthetic
ttattttatgatgcaattgtctggtaacctagatgggcatagggatgttgataagctctacgagtatatgttgtt

SEQ ID NO: 48202 - DNA, 75 bp, Artificial Sequence
  Synthetic
acggtaatccaattacaaaaactacatccgattatcaagattctgatgtatcacaagaagttagaaagtattttt

SEQ ID NO: 48203 - DNA, 75 bp, Artificial Sequence
  Synthetic
tctacataatctacgatattattacacataaacatcggcaacatactattgtccattatctaagtccggttgatc

SEQ ID NO: 48204 - DNA, 75 bp, Artificial Sequence
  Synthetic
catgctctattttgtcattaactttaatgtgtgaaaacagtacgccacatgcttccataacagtgtgtaacactt

SEQ ID NO: 48205 - DNA, 75 bp, Artificial Sequence
  Synthetic
cgcttaatagacaaactgtaagtaggtttaagaagttgtcggtgccggccgctataatgatgatactctcaacca

SEQ ID NO: 48206 - DNA, 75 bp, Artificial Sequence
  Synthetic
gctataatgatgatactctcaaccattattagcggcataggaacatttctgcattacaaagaagaactgatgcct

SEQ ID NO: 48207 - DNA, 75 bp, Artificial Sequence
  Synthetic
agaggatagttatcttcagcatcataatatatattgttcatataacaatattcgtagtcttcttcatcgtcttcc

SEQ ID NO: 48208 - DNA, 75 bp, Artificial Sequence
  Synthetic
taccaacattaaaatgtccacagataatgcagtttatcagtgtcgtaaattacgagctagattgcctagacctga

SEQ ID NO: 48209 - DNA, 75 bp, Artificial Sequence
  Synthetic
aatgcagtttatcagtgtcgtaaattacgagctagattgcctagacctgatactagacatctgagagtattgttt

SEQ ID NO: 48210 - DNA, 75 bp, Artificial Sequence
  Synthetic
atggttagatattaataatgataaagatatagatattagtaaattaacaaattttaaacaactaaacagtacgac

SEQ ID NO: 48211 - DNA, 75 bp, Artificial Sequence
  Synthetic
aagtctggaaaactggttaaaacagtatgtaaaagtactcaatctgtactatgtgttaaaagattctacaagtaa

SEQ ID NO: 48212 - DNA, 75 bp, Artificial Sequence
  Synthetic
atgtgcgggatataaaatattccgacatgcaaaaatgctactttagctataagggtaaaatagttcctcaggatt

SEQ ID NO: 48213 - DNA, 75 bp, Artificial Sequence
  Synthetic
catgcaaaaatgctactttagctataagggtaaaatagttcctcaggattctaatgatttggctagattcaacat

SEQ ID NO: 48214 - DNA, 75 bp, Artificial Sequence
  Synthetic
gcgactatgatatcatgttagatatagaaggtaaacatcagccattttatctattcccatctattgatgttttta

SEQ ID NO: 48215 - DNA, 75 bp, Artificial Sequence
  Synthetic
agaaggtaaacatcagccattttatctattcccatctattgatgtttttaacgctacaatcatagaagcgtataa

SEQ ID NO: 48216 - DNA, 75 bp, Artificial Sequence
  Synthetic
agatgtgtcatacttgttagtagttagatatttagcaattgcattcccatcatttctcaatctcgtactccaatc

SEQ ID NO: 48217 - DNA, 75 bp, Artificial Sequence
  Synthetic
gttgttgttgttgttgttgttcttgttcttccttatctcctccagtagcgtgtggttcttcaataccagtgttag

SEQ ID NO: 48218 - DNA, 75 bp, Artificial Sequence
  Synthetic
tgaaaatgaaattgtcgtttaattcttcattctgtatatcagacggcaatggatggatcataattgatgggaaat

SEQ ID NO: 48219 - DNA, 75 bp, Artificial Sequence
  Synthetic
ttattgtaacagtattattaatattgccaagttatccgatctaaaaaaaactatctatgcagtagatagtttttt

SEQ ID NO: 48220 - DNA, 75 bp, Artificial Sequence
  Synthetic
gcaatagtaattttttatcataaaagttgtaaagtaaataataaaacaataaatattgaactagtagtacgtata

SEQ ID NO: 48221 - DNA, 75 bp, Artificial Sequence
  Synthetic
gcgggaacaatattagtatgttatatattatatatttgtaggaaaaagatacgtactgtctataatgacaataaa

SEQ ID NO: 48222 - DNA, 75 bp, Artificial Sequence
  Synthetic
aggaactattaatcgcattttagttattactaaactacgtgaacatatggtattattctacaaacgattattaga

SEQ ID NO: 48223 - DNA, 75 bp, Artificial Sequence
  Synthetic
attatcatgacaaaattaaaaaagataaagagttctaattccagcaattctagtaaatcaaccgatagcgaatca

SEQ ID NO: 48224 - DNA, 75 bp, Artificial Sequence
  Synthetic
aacactcgacatgagatccttaagggccatatcgtctagattttgttgagatgctgctcctggatttggattttg

SEQ ID NO: 48225 - DNA, 75 bp, Artificial Sequence
  Synthetic
gatagtgttgctggaagcacgctgctaataaataatgatcgtaatgaacagactatttatcagaacactacagta

SEQ ID NO: 48226 - DNA, 75 bp, Artificial Sequence
  Synthetic
aaattagatttcgaacgaaggcctccttcgttttataaaccattagataaagttgatctcaaaccgtcttttctg

SEQ ID NO: 48227 - DNA, 75 bp, Artificial Sequence
  Synthetic
aagtacttaatgaagataccaaacagaatcctagctattcttccaatcctttcgtgaattataataaaaccagta

SEQ ID NO: 48228 - DNA, 75 bp, Artificial Sequence
  Synthetic
tggccacaataggaggttgaggaggtgtaaccgttggagtagtacaagaaatacttccatccgattgttgtgtac

SEQ ID NO: 48229 - DNA, 75 bp, Artificial Sequence
  Synthetic
ttcgtgaattataataaaaccagtatttgtagcaagtcaaatccgttcattacagaactcaacaataaatttagt

SEQ ID NO: 48230 - DNA, 75 bp, Artificial Sequence
  Synthetic
acatattattggattcggtattgttactcgcggaatagatttcgtcagacgtctgatattcggaaatctgtggag

SEQ ID NO: 48231 - DNA, 75 bp, Artificial Sequence
  Synthetic
gtctgatattcggaaatctgtggagtttcaggttttggtggaggtgtaactgctacttgggatactgaagtctga

SEQ ID NO: 48232 - DNA, 75 bp, Artificial Sequence
  Synthetic
agagaagaacgtgtattaaatagaatatttaactcgcaaaatcgttaagaagtttaagcgacgatccacatgctg

SEQ ID NO: 48233 - DNA, 75 bp, Artificial Sequence
  Synthetic
tttgtagcaagtcaaatccgttcattacagaactcaacaataaatttagtgagaataatccgtttagacgagcac

SEQ ID NO: 48234 - DNA, 75 bp, Artificial Sequence
  Synthetic
agatattccctgtattcggcatttctaaaattagcaattttattgctaataatgactgtagatattatatagatg

SEQ ID NO: 48235 - DNA, 75 bp, Artificial Sequence
  Synthetic
attatctatagtacacggaataatgatggtatcattacatgctgtatactctatagtctttgtagatgttataac

SEQ ID NO: 48236 - DNA, 75 bp, Artificial Sequence
  Synthetic
cacacgtggaactcgtgtagcataggcaatgttactcgtctgttatatacattcttcagttatctgatgaaagat

SEQ ID NO: 48237 - DNA, 75 bp, Artificial Sequence
  Synthetic
taaaattagcaattttattgctaataatgactgtagatattatatagatgcagaacatcaaaaaattatatctga

SEQ ID NO: 48238 - DNA, 75 bp, Artificial Sequence
  Synthetic
gagtgggttttggattataatcatcatcgtctatgacatcatcatcatcatcatcatcatcatcatcatcatcat

SEQ ID NO: 48239 - DNA, 75 bp, Artificial Sequence
  Synthetic
ttcgcgaatttagaaaattatgctgtgatatatatcacgcatcaggatataaagaaaaatctaaattaattagag

SEQ ID NO: 48240 - DNA, 75 bp, Artificial Sequence
  Synthetic
atatcgctgtttattatgattatacatgaaagcagcaatagcaatatatatgacttcatgatttaataatgtagt

SEQ ID NO: 48241 - DNA, 75 bp, Artificial Sequence
  Synthetic
agtaattatcacctcgttcccgctctccaatcattatagatattttttaaatattttcatttcatttcatttcat

SEQ ID NO: 48242 - DNA, 75 bp, Artificial Sequence
  Synthetic
aaaaaatgatatgatagttcttacaagtagagattgagttttaaatggattctattacaattaccgtcgggaact

SEQ ID NO: 48243 - DNA, 75 bp, Artificial Sequence
  Synthetic
tgtcttctgctaagtacataaattcgatcatcgagcaagatactttaatccatgtttgtaacctcgaacatccat

SEQ ID NO: 48244 - DNA, 75 bp, Artificial Sequence
  Synthetic
gtcttacaattctctacctatcaaggaacaaatattgtacggtagaattgataatataaatatgagcattagtat

SEQ ID NO: 48245 - DNA, 75 bp, Artificial Sequence
  Synthetic
atgctgctacaaatgaaaaaaaagctgttactaaatactattcagaatgaattcattcttctattctctttttat

SEQ ID NO: 48246 - DNA, 75 bp, Artificial Sequence
  Synthetic
gttatactctattatagaacgctctttcgatgatacatttccaaaaatatccatatcgtatattaagttgggaga

SEQ ID NO: 48247 - DNA, 75 bp, Artificial Sequence
  Synthetic
ctactagctcgtggtattatacacatgcctagtaatagtctctttgcgttgacggaaagcagactagaaataaca

SEQ ID NO: 48248 - DNA, 75 bp, Artificial Sequence
  Synthetic
gacggaaagcagactagaaataacaggctaaaatgttcagacaccataatagttcccaacccagataataacaga

SEQ ID NO: 48249 - DNA, 75 bp, Artificial Sequence
  Synthetic
cgtctttagtcggaaggttgatgtcgtatccgatgtatacgaggtatgaggcaaccttgttgttacaattctgga

SEQ ID NO: 48250 - DNA, 75 bp, Artificial Sequence
  Synthetic
aatgtatccagccaattgatagtagataatgaggtgtacagcgcatgataatttacacagtaaccaaaatgaaaa

SEQ ID NO: 48251 - DNA, 75 bp, Artificial Sequence
  Synthetic
tgacggataaaacaaaaatgctccgcataactctaccatggcaataacacaaccaaatacttgtaagattcctaa

SEQ ID NO: 48252 - DNA, 75 bp, Artificial Sequence
  Synthetic
tcattaaaccaattagtatgacgttgaactaatttcacagtagattttattccagtgttatcctcgcatgtataa

SEQ ID NO: 48253 - DNA, 75 bp, Artificial Sequence
  Synthetic
agagaagattgtcctactgactggataagctataataataaatgtatccatttatctactgatcgaaaaacctgg

SEQ ID NO: 48254 - DNA, 75 bp, Artificial Sequence
  Synthetic
cattaaatctgagcatcataatagtcttgaaacagtatctatggaaattatggataatcggtactaataaaaaat

SEQ ID NO: 48255 - DNA, 75 bp, Artificial Sequence
  Synthetic
tggataatcggtactaataaaaaatagtttaactctttttagaaccagtttggtactggaatttcagttcattac

SEQ ID NO: 48256 - DNA, 75 bp, Artificial Sequence
  Synthetic
tgttgatgaagatagattcatccttaaatgttttctctgtgatagtttccaccgaaagactatgcaaagaatttg

SEQ ID NO: 48257 - DNA, 75 bp, Artificial Sequence
  Synthetic
aaatgatacctttgttatttattttattctattttgctaacggtatcgaatggcataagtttgaaacgagtgaag

SEQ ID NO: 48258 - DNA, 75 bp, Artificial Sequence
  Synthetic
tgatgtggtatatacgggtgttaatggggcggtatatacattttcaaataatgaactaaacaaaactggtttaac

SEQ ID NO: 48259 - DNA, 75 bp, Artificial Sequence
  Synthetic
aggatacattagtatgcggaaccaataacggaaatcccaaatgttggaaaatagacggttcagacgacccaaaac

SEQ ID NO: 48260 - DNA, 75 bp, Artificial Sequence
  Synthetic
aaccactggtggttttattttatccttgtccaatgtaaactgaatgggagaggatgcggctttcgtacgtagata

SEQ ID NO: 48261 - DNA, 75 bp, Artificial Sequence
  Synthetic
taacggaaatcccaaatgttggaaaatagacggttcagacgacccaaaacatagaggtagaggatacgctcctta

SEQ ID NO: 48262 - DNA, 75 bp, Artificial Sequence
  Synthetic
acataaacatatcaaaagaaggaattaaacgatggagaagatttgacggaccatgtggttatgatttatacacgg

SEQ ID NO: 48263 - DNA, 75 bp, Artificial Sequence
  Synthetic
taaacgatggagaagatttgacggaccatgtggttatgatttatacacggcggataacgtaattccaaaagatgg

SEQ ID NO: 48264 - DNA, 75 bp, Artificial Sequence
  Synthetic
acttttgtcatatcgaaccgatggtatgattctaacctagaattacatccgaaaaagttgactatgttcatggtc

SEQ ID NO: 48265 - DNA, 75 bp, Artificial Sequence
  Synthetic
atcttttagaggttcccaattccaaagatccgacggtacaacattccaaagatcatattgtagaataccgttact

SEQ ID NO: 48266 - DNA, 75 bp, Artificial Sequence
  Synthetic
atgattctaacctagaattacatccgaaaaagttgactatgttcatggtcattaagtcattaacaaacaatattc

SEQ ID NO: 48267 - DNA, 75 bp, Artificial Sequence
  Synthetic
ttcttttcactgatactatcggctcaaagagaattgttaaaattccgtatatagcacaaatgtgcctaaacgacg

SEQ ID NO: 48268 - DNA, 75 bp, Artificial Sequence
  Synthetic
aaagagaattgttaaaattccgtatatagcacaaatgtgcctaaacgacgaaggtggtccatcatcattgtctag

SEQ ID NO: 48269 - DNA, 75 bp, Artificial Sequence
  Synthetic
ataaatggtttcgaaaatcttcttattgagatcttgtgcttccaggctatcaaatggataatttaagagaataaa

SEQ ID NO: 48270 - DNA, 75 bp, Artificial Sequence
  Synthetic
gaagaagttatagacaaattattcattctaaaactataaaaacagataatgatacgatactatatgtattcttcg

SEQ ID NO: 48271 - DNA, 75 bp, Artificial Sequence
  Synthetic
acatgatgaattagagaattacataggcaacatcagaaacgacatcatgaacaatcacaagaacagaggcactta

SEQ ID NO: 48272 - DNA, 75 bp, Artificial Sequence
  Synthetic
cgtaaatcttttcacgttaaatgagtgtccatattttgcaatttcttcataggatggcggtgtacgtggacggtg

SEQ ID NO: 48273 - DNA, 75 bp, Artificial Sequence
  Synthetic
aaacaatctttttctacgtcaaaattggaaggatatacaaagcaattgccgtctccagctcctggtatatgtcta

SEQ ID NO: 48274 - DNA, 75 bp, Artificial Sequence
  Synthetic
ctagtctattgagtggaaagttcaaaaagtcagacggtagttatcgaacacatcctcactattcatggatgcaga

SEQ ID NO: 48275 - DNA, 75 bp, Artificial Sequence
  Synthetic
ccacgtttgaagtcatagaaaaatataatgtactagatgatattataaagcctttatctaaccaacctatcttcg

SEQ ID NO: 48276 - DNA, 75 bp, Artificial Sequence
  Synthetic
caaggacaaggatgaaaaggggtgtatacacatgattgacaaattattctatgtctattataatttatttctgtt

SEQ ID NO: 48277 - DNA, 75 bp, Artificial Sequence
  Synthetic
tgatataaaggagaaggaaaatgaacatcgggaatatagaatatacttcataaaagaaaatactatatattcgtt

SEQ ID NO: 48278 - DNA, 75 bp, Artificial Sequence
  Synthetic
ttagataaaaaggcggtcacgtcgtcaaaatatttactaatatcggtagttgtatcatctaccaacggtatatga

SEQ ID NO: 48279 - DNA, 75 bp, Artificial Sequence
  Synthetic
agttagtacatgatcatctccccgctataaaggcattttcaacttctccttattgattgaaaatgaaaatataaa

SEQ ID NO: 48280 - DNA, 75 bp, Artificial Sequence
  Synthetic
tttcagtaatggtaacttcgaaaccgttatttatagcagatatagggataggagtaggaatgccacgaatgaaaa

SEQ ID NO: 48281 - DNA, 75 bp, Artificial Sequence
  Synthetic
aaatacttaaaatgtaatcttatcgagtacacacaacaatgaacaaacctaagacagattatgctggttatgctt

SEQ ID NO: 48282 - DNA, 75 bp, Artificial Sequence
  Synthetic
gctataataataaatgtatccatttatctactgatcgaaaaacctgggaggaaggacgtaatgcatgcaaagctc

SEQ ID NO: 48283 - DNA, 75 bp, Artificial Sequence
  Synthetic
tttttaagaagccttagaagaggctattgggtagaagaatccgaaatattaaaccagacaaccccatataatttt

SEQ ID NO: 48284 - DNA, 75 bp, Artificial Sequence
  Synthetic
cttgatgatgtcctgtatcagttgcattttcagcactcgactgaatattagcgcattcattgtctattattacca

SEQ ID NO: 48285 - DNA, 75 bp, Artificial Sequence
  Synthetic
ctcatttgataaaaattccgctactaataggatacgggaataaaaatccacttgatacagccaagtatcttgttc

SEQ ID NO: 48286 - DNA, 75 bp, Artificial Sequence
  Synthetic
ctatcaaattttttctttaatattttacgtggttgaccattcttggtggtaaaataatctcgtagtgttggaatg

SEQ ID NO: 48287 - DNA, 75 bp, Artificial Sequence
  Synthetic
aaatagaactattgttacaaaagttaataataattattataataattataataattataataattataataatta

SEQ ID NO: 48288 - DNA, 75 bp, Artificial Sequence
  Synthetic
catcgtatattttgacgtatgcagtcacatcttctacgcaatagtcagattgtagttcgatcatacttcctacat

SEQ ID NO: 48289 - DNA, 75 bp, Artificial Sequence
  Synthetic
agtatattctctagttactacgatatcatcgttgtctaaaatatcacatgaatctatatccaattttagaaattg

SEQ ID NO: 48290 - DNA, 75 bp, Artificial Sequence
  Synthetic
gttttcatgaaatcctttgttttatccacttcacattttaaataaatgtccactatacattcttctgttaatttt

SEQ ID NO: 48291 - DNA, 75 bp, Artificial Sequence
  Synthetic
ccacttcacattttaaataaatgtccactatacattcttctgttaattttactagatcgtcatgggtcatagaat

SEQ ID NO: 48292 - DNA, 75 bp, Artificial Sequence
  Synthetic
tattcttggacggacgtatccgtttatccacaattagatattttagtagacgtaagtctatattatccgaagaca

SEQ ID NO: 48293 - DNA, 75 bp, Artificial Sequence
  Synthetic
gtatcgcgattagtgtatacaccaactgtatgaaaattaagaaaacagtttaataaatcaacagaaatatttaat

SEQ ID NO: 48294 - DNA, 75 bp, Artificial Sequence
  Synthetic
cctccgtttgatacagatgcaccatatttatggatttcagattcacacgttgtttgtctaaggggttcgtctagt

SEQ ID NO: 48295 - DNA, 75 bp, Artificial Sequence
  Synthetic
acataccgatttatcatacgctgtttcagttgtttgaaaactaaatggtagacatatcaaaataacaaatactaa

SEQ ID NO: 48296 - DNA, 75 bp, Artificial Sequence
  Synthetic
tttactaagaaagtttctctactgtatctaccacacttctagatatccggatagagattcgatggtttgtcatcg

SEQ ID NO: 48297 - DNA, 75 bp, Artificial Sequence
  Synthetic
gacatatcaaaataacaaatactaacgagtacattccgcaatattgttatcgtaattggaaatttagtgttcaag

SEQ ID NO: 48298 - DNA, 75 bp, Artificial Sequence
  Synthetic
attttgtagtaagaatagaatgctaatgacaagtttattccaatagatgtcttattaaaaaacatatataataaa

SEQ ID NO: 48299 - DNA, 75 bp, Artificial Sequence
  Synthetic
atgacaagtttattccaatagatgtcttattaaaaaacatatataataaataacaatggctgaatggcataaaat

SEQ ID NO: 48300 - DNA, 75 bp, Artificial Sequence
  Synthetic
aaaaagtgtagtgagtgagagtattagtgagtgagtgagtgtgtgagtgagtgagtgagagtatgagtgagtgta

SEQ ID NO: 48301 - DNA, 75 bp, Artificial Sequence
  Synthetic
aggatctcgagtatgaagtacgatgttattgtttacttgtatatctggaaagaattctaccagtctaggaataag

SEQ ID NO: 48302 - DNA, 75 bp, Artificial Sequence
  Synthetic
taatggatgagaacacgtatgctatggagttgcttactgggtacgcccctgtatctccgatcgttatagcgagaa

SEQ ID NO: 48303 - DNA, 75 bp, Artificial Sequence
  Synthetic
tcatcatcatcatcatcatcatcatcatcatcatcatcatcatcatcatcatcatcatcatcatcatcatcttcg

SEQ ID NO: 48304 - DNA, 75 bp, Artificial Sequence
  Synthetic
atgatgaaatggataatatccatattgacgatgtcaataatgccggtattggcatacagctcatcgatttttaga

SEQ ID NO: 48305 - DNA, 75 bp, Artificial Sequence
  Synthetic
ggcatacagctcatcgatttttagatttcattcagaggatgtggaattatgttatgggaatttgtattttgatag

SEQ ID NO: 48306 - DNA, 75 bp, Artificial Sequence
  Synthetic
accccattaaaaaaatggaaattaaagccctctattagcacagacggctacaggtctaccatcaggttaaccttc

SEQ ID NO: 48307 - DNA, 75 bp, Artificial Sequence
  Synthetic
ggaaacttaaaatataatgatatacaatgctcagtaaatgtatcgtgtcttattaaaaatttggcaacgagtaca

SEQ ID NO: 48308 - DNA, 75 bp, Artificial Sequence
  Synthetic
aatgctcagtaaatgtatcgtgtcttattaaaaatttggcaacgagtacatatactatattaacatctaaacaca

SEQ ID NO: 48309 - DNA, 75 bp, Artificial Sequence
  Synthetic
attcccattccaatcacattatatgattctgtaaaaaaattatactgtaacacaatgaagtagtctcatagatgt

SEQ ID NO: 48310 - DNA, 75 bp, Artificial Sequence
  Synthetic
atgacaagtataatgacatctatgattttactgcaatatgtatgctgatagcttctacattgatagtgtcaatat

SEQ ID NO: 48311 - DNA, 75 bp, Artificial Sequence
  Synthetic
ataaaatcaaaattacgattgattcaaaaattggtaatgttgttaccatatcgtataacttggaaaagataacta

SEQ ID NO: 48312 - DNA, 75 bp, Artificial Sequence
  Synthetic
aaaaattggtaatgttgttaccatatcgtataacttggaaaagataactattgatgtcacaccaaaaaagaaaaa

SEQ ID NO: 48313 - DNA, 75 bp, Artificial Sequence
  Synthetic
ttaaagaggaagaaaaaaatattattgatattactgatgacgatggtatggatgtagagagttctgtgatctacg

SEQ ID NO: 48314 - DNA, 75 bp, Artificial Sequence
  Synthetic
aataaaataagtattgattaatactttatactttttatttacggtattcctactgtgtagtgctacctactcgat

SEQ ID NO: 48315 - DNA, 75 bp, Artificial Sequence
  Synthetic
agaacgataatgaatttagaaatgattgatattattaacaaacatacaactattgatgaacgaaagtatatagta

SEQ ID NO: 48316 - DNA, 75 bp, Artificial Sequence
  Synthetic
gttcgaatgccacatcgacgtcaaagataggggagtagttgaaatctagttctgcattgttggtacgcacctcaa

SEQ ID NO: 48317 - DNA, 75 bp, Artificial Sequence
  Synthetic
aataacacaaccaaacacttgtaaaattcctaaattagtagaaaatacaactgatatcgatgtataagcgatttc

SEQ ID NO: 48318 - DNA, 75 bp, Artificial Sequence
  Synthetic
gagatatatacaccggatctatggtttccataattgagtaaatgaatgctcggcaataactaatggcaaatgtat

SEQ ID NO: 48319 - DNA, 75 bp, Artificial Sequence
  Synthetic
ctaaatagaattctcttcatatcattcttgcacgcgtacatttttagcatccatcttggaatcctagatccttgt

SEQ ID NO: 48320 - DNA, 75 bp, Artificial Sequence
  Synthetic
tcttgcacgcgtacatttttagcatccatcttggaatcctagatccttgttctattcccaatggtttcatcaata

SEQ ID NO: 48321 - DNA, 75 bp, Artificial Sequence
  Synthetic
gaagattaaacatatcgtacgaacacgatggagagtaatcgtagcaaaagtaagcatttcctttaatctcagatc

SEQ ID NO: 48322 - DNA, 75 bp, Artificial Sequence
  Synthetic
agactttctctaaataggactattgttacaaaagttaataataattataataattataataattataataattat

SEQ ID NO: 48323 - DNA, 75 bp, Artificial Sequence
  Synthetic
cctacatatacccggctatgcaccgcgtcatcatcgactgtacgatacatgatgttaccgtgttgcttacattgc

SEQ ID NO: 48324 - DNA, 75 bp, Artificial Sequence
  Synthetic
tcgtaaaagactttcgtcaatttgtctccttctccgtaaattccagtgggtcttaggcaacaagtatacaatttt

SEQ ID NO: 48325 - DNA, 75 bp, Artificial Sequence
  Synthetic
caaaattccattggcctcattaactcctaaagcacaacgagagatattttcagcgtggatttctcatagacctgt

SEQ ID NO: 48326 - DNA, 75 bp, Artificial Sequence
  Synthetic
gctccattcatgattacggaattattggctttcataaccagttgctcggccatacgtttactttttgcgtataca

SEQ ID NO: 48327 - DNA, 75 bp, Artificial Sequence
  Synthetic
atgaatcatctactgtgtcaccaacaactgtagaaagcatcacgaaatctataggtaagtatagtactaaagact

SEQ ID NO: 48328 - DNA, 75 bp, Artificial Sequence
  Synthetic
tggctttcataaccagttgctcggccatacgtttactttttgcgtatacatgtcctggtgatatatcataaaggg

SEQ ID NO: 48329 - DNA, 75 bp, Artificial Sequence
  Synthetic
gtatcaagttcggagaaatggagagagactgtttaatagcgcatggtgcagccaatactattacagaagttttga

SEQ ID NO: 48330 - DNA, 75 bp, Artificial Sequence
  Synthetic
tccatgctactagtatagatcaaatacttgattcctaggtccacacaagctgccaatatagtctgtgttccataa

SEQ ID NO: 48331 - DNA, 75 bp, Artificial Sequence
  Synthetic
ccttatcaaagtcgtttatatcacattgtatgtaatttataaccttaacctttgatgtgagtggttgtggatctt

SEQ ID NO: 48332 - DNA, 75 bp, Artificial Sequence
  Synthetic
cataaaaataataacgagtttgccttctttagtagaaacatgaaaccggttttacctcataaggtggattatcta

SEQ ID NO: 48333 - DNA, 75 bp, Artificial Sequence
  Synthetic
tcggaaatctgtggagtttcaggttttggtggaggtgtaacagctacttgagataccgaagtctgatattcagaa

SEQ ID NO: 48334 - DNA, 75 bp, Artificial Sequence
  Synthetic
agataccgaagtctgatattcagaaagctgtggatgttctggttcggcatccaccgatggtgttacaccactact

SEQ ID NO: 48335 - DNA, 75 bp, Artificial Sequence
  Synthetic
tactttgaaccagtccatggaaaagataaagttttaggatcagttattggattaaaatccggaacgtatagtttg

SEQ ID NO: 48336 - DNA, 75 bp, Artificial Sequence
  Synthetic
ataaagttttaggatcagttattggattaaaatccggaacgtatagtttgataattcatcgttacggagatatta

SEQ ID NO: 48337 - DNA, 75 bp, Artificial Sequence
  Synthetic
gatggaggcaccacttctacaggttttggttctgtatcctcagtcgtcaacggagctacttcaatgcgaggaaat

SEQ ID NO: 48338 - DNA, 75 bp, Artificial Sequence
  Synthetic
tttgtaaacagatatggtgtagcatatgtttatttagatacagatgtaaatatatctacaattattggaaaggcg

SEQ ID NO: 48339 - DNA, 75 bp, Artificial Sequence
  Synthetic
tactattattactattaccatcattattagtgttggcattattagtattcttcttgtcatcttgttcagaaatat

SEQ ID NO: 48340 - DNA, 75 bp, Artificial Sequence
  Synthetic
atgtttatttagatacagatgtaaatatatctacaattattggaaaggcgttatctatttcaaaaaatgatcaaa

SEQ ID NO: 48341 - DNA, 75 bp, Artificial Sequence
  Synthetic
cctaacgaaatattattcaaaatattatataaactcgatgtatctgatttacgtaaactatatacaagatatatg

SEQ ID NO: 48342 - DNA, 75 bp, Artificial Sequence
  Synthetic
cattttcttacaattaacgagaatggcgtttgatatatcagttaatgcgtctaaaacaataaatgcattagttta

SEQ ID NO: 48343 - DNA, 75 bp, Artificial Sequence
  Synthetic
gcgtttgatatatcagttaatgcgtctaaaacaataaatgcattagtttacttttctactcagcaaaataaatta

SEQ ID NO: 48344 - DNA, 75 bp, Artificial Sequence
  Synthetic
atatactaggcaggttacgatagcggataaaaagatagtattcatcttcatgctatttaatacatctaatatatg

SEQ ID NO: 48345 - DNA, 75 bp, Artificial Sequence
  Synthetic
atggaacacgattattataaaataacaatagttcctggttcctcttccacgtctactagctcgtggtattataca

SEQ ID NO: 48346 - DNA, 75 bp, Artificial Sequence
  Synthetic
aatttctccaaagctttgattgtttccatagatttccgaacttcagcttctaggacggcgattctttttctttcg

SEQ ID NO: 48347 - DNA, 75 bp, Artificial Sequence
  Synthetic
gcactacacaatatgatcacaaagaaagctgtaatggtttatattaccagggttcttgttatatattccattcag

SEQ ID NO: 48348 - DNA, 75 bp, Artificial Sequence
  Synthetic
aatacgccggttagtatgacttacttgtataataagtatagttttaaactgattttagcagaatatataagacac

SEQ ID NO: 48349 - DNA, 75 bp, Artificial Sequence
  Synthetic
tagtagtagctctatctagtctagtatctaaacattgggaatcgacaaataaaaagtataggtgtatggcattag

SEQ ID NO: 48350 - DNA, 75 bp, Artificial Sequence
  Synthetic
aaaaagtataggtgtatggcattagccgaacatatagctgatagtattccaatatctgagctatctagactacga

SEQ ID NO: 48351 - DNA, 75 bp, Artificial Sequence
  Synthetic
atttgattattttgaagacgatgattcgtctacatgttctgccgtaaccgacagggaaacggatgtataattttt

SEQ ID NO: 48352 - DNA, 75 bp, Artificial Sequence
  Synthetic
gcgtatattctagccgaactaattccgttgttgagatagcatagtcttcaaacactctaggtataatataattaa

SEQ ID NO: 48353 - DNA, 75 bp, Artificial Sequence
  Synthetic
tcgtctacatgttctgccgtaaccgacagggaaacggatgtataattttttttatagtgtgaaggatatgataaa

SEQ ID NO: 48354 - DNA, 75 bp, Artificial Sequence
  Synthetic
ttctttcacgagtcaattccctcctgtagtaactatcggttttgtcagattcacgctctctacgtagactttctt

SEQ ID NO: 48355 - DNA, 75 bp, Artificial Sequence
  Synthetic
ttttctttcacatctctaattatgaaaaagtaaatcattatgagatggatgaaatggacgagattgtgagcatcg

SEQ ID NO: 48356 - DNA, 75 bp, Artificial Sequence
  Synthetic
tcagatactggtttgataaactttttattccacatgagtatgtttgactttatggttagacccgcatactttaac

SEQ ID NO: 48357 - DNA, 75 bp, Artificial Sequence
  Synthetic
ttcgcgatagtatgtggtttatacctaacgtatttatggacgacggtgagaatgaaggtcacgtttctgtcaaca

SEQ ID NO: 48358 - DNA, 75 bp, Artificial Sequence
  Synthetic
tacggttaatcctttgacctcgtcgatttccgaccaatctgggcgtataatgaatctgaactttaatttcttgta

SEQ ID NO: 48359 - DNA, 75 bp, Artificial Sequence
  Synthetic
ctttgatgtggatacatcgtctcatctgtttaagctagttattaaacactgcgatctgaataaacgactaaaatg

SEQ ID NO: 48360 - DNA, 75 bp, Artificial Sequence
  Synthetic
atcaagcactccagcacccgcagagaagtcatcaagcatattgtaatatcttaaataactcatttatatattaaa

SEQ ID NO: 48361 - DNA, 75 bp, Artificial Sequence
  Synthetic
tattcatcatcctctggtggttcgtcgttcctatcgaatgtggctctgattaacccgtcatctataggcgatgct

SEQ ID NO: 48362 - DNA, 75 bp, Artificial Sequence
  Synthetic
gacgctgcatctctctttctgtatcggcattgttctcattattacgtctacagtcgttcagttgtctttcaagat

SEQ ID NO: 48363 - DNA, 75 bp, Artificial Sequence
  Synthetic
ctgtattaaagatattgttacacaacggcgtgaataactttgataacaaggataacaaaggacatattcctctac

SEQ ID NO: 48364 - DNA, 75 bp, Artificial Sequence
  Synthetic
gtcattaaaccctcgatcatgaatggatttatcatcatcgtttttatgttggacatgagcttagtccgtttgtcc

SEQ ID NO: 48365 - DNA, 75 bp, Artificial Sequence
  Synthetic
tcacgcagttgtctttcaagatctgagattttagattggagtctgctaatctctgtaagatttcctcctccgctc

SEQ ID NO: 48366 - DNA, 75 bp, Artificial Sequence
  Synthetic
cacctaccaaagtatagttgtatttttatcacgcgatgtatataaaactgatattatataattatcttagtgccg

SEQ ID NO: 48367 - DNA, 75 bp, Artificial Sequence
  Synthetic
gttgatatttagcaatttctgattctagagtactgattctgctcacgtagttactaatagttgtcttggccttat

SEQ ID NO: 48368 - DNA, 75 bp, Artificial Sequence
  Synthetic
cagtctattttccttagatggtttgatatttttattacccatgatctctataaaggtagacctaatcgtctcgga

SEQ ID NO: 48369 - DNA, 75 bp, Artificial Sequence
  Synthetic
tatgttaggtttacgaaaatgtctcgtggggcattaatcgtttttgaaggattggacaaatctggaaaaacaaca

SEQ ID NO: 48370 - DNA, 75 bp, Artificial Sequence
  Synthetic
gtggggcattaatcgtttttgaaggattggacaaatctggaaaaacaacacaatgtatgaacatcatggaatcga

SEQ ID NO: 48371 - DNA, 75 bp, Artificial Sequence
  Synthetic
actggaaagatgatagatgactatctaactcgtaaaaaaacctataatgatcatatagttaatctattattttgt

SEQ ID NO: 48372 - DNA, 75 bp, Artificial Sequence
  Synthetic
tgggataaaaattatgtttttattattttatatctattttattccagagaatattcaggaatttctttttccggt

SEQ ID NO: 48373 - DNA, 75 bp, Artificial Sequence
  Synthetic
taactcgtaaaaaaacctataatgatcatatagttaatctattattttgtgcaaatagatgggagtttgcatctt

SEQ ID NO: 48374 - DNA, 75 bp, Artificial Sequence
  Synthetic
ccacataatctatttagagatcgagtcatgcacgattatataagtaatacattcgttagaaaataacatttttat

SEQ ID NO: 48375 - DNA, 75 bp, Artificial Sequence
  Synthetic
gcgttctctggagtagcgtatgccgccgctaaaggcgcgtcaatgactctgagtaagagttatgaatctggattg

SEQ ID NO: 48376 - DNA, 75 bp, Artificial Sequence
  Synthetic
tatatatgttaataattgtattgtggttatacggctacaatttcataatgagtggaagtcagtgtccgatgatca

SEQ ID NO: 48377 - DNA, 75 bp, Artificial Sequence
  Synthetic
gagtaagagttatgaatctggattgcctaaacccgacttagttatattcttggaatctggtagcaaagaaattaa

SEQ ID NO: 48378 - DNA, 75 bp, Artificial Sequence
  Synthetic
aaggaattaattattcataatccagagttagaagatagcggaagatacgactgttatgttcattacgacgacgtt

SEQ ID NO: 48379 - DNA, 75 bp, Artificial Sequence
  Synthetic
atgatataatataatcatgtttatcatgcgtgaatcaatttaccgcgtcatgatagttatattatatctatctct

SEQ ID NO: 48380 - DNA, 75 bp, Artificial Sequence
  Synthetic
atgcgtgaatcaatttaccgcgtcatgatagttatattatatctatctcttatatcctcctttttagttatatgt

SEQ ID NO: 48381 - DNA, 75 bp, Artificial Sequence
  Synthetic
tattgggtaggagaatccgaaatattaaaccagacaaccccatataattttatagctaagaatgccacgaagaat

SEQ ID NO: 48382 - DNA, 75 bp, Artificial Sequence
  Synthetic
tccttaccattggtataaacaacatatgtcattacttttcagacgatactaccacaaattggacagcatcgtctg

SEQ ID NO: 48383 - DNA, 75 bp, Artificial Sequence
  Synthetic
tatagttatagaggctatacacacggttacaggaccagtgggacaactttggatgtaataaagtgaaattacatt

SEQ ID NO: 48384 - DNA, 75 bp, Artificial Sequence
  Synthetic
atgtcattacttttcagacgatactaccacaaattggacagcatcgtctgaatattgtaaaaatatacgggcctt

SEQ ID NO: 48385 - DNA, 75 bp, Artificial Sequence
  Synthetic
agtaataggcttaggcaaatgcttgtcgtatgctggcacttcctcatccatcaagtatttataatcgggttctac

SEQ ID NO: 48386 - DNA, 75 bp, Artificial Sequence
  Synthetic
ttttataaatagatgttagtacagtgtgttagaaatggatgaagcatattactctggtaacttggaatcagtact

SEQ ID NO: 48387 - DNA, 75 bp, Artificial Sequence
  Synthetic
ctgacaccaacctgtatactgtattaagaacagaagacatccggtatcgtacctatcttaaagccatacattcag

SEQ ID NO: 48388 - DNA, 75 bp, Artificial Sequence
  Synthetic
atttgattattgggtagtactaattcacaattaccagttgaattgtgataataaaccatataattaattatatta

SEQ ID NO: 48389 - DNA, 75 bp, Artificial Sequence
  Synthetic
ctaagacgtcgcatctctctttctgtttcggcattggtctcattattacgtctacagtcgttcaactgtctttca

SEQ ID NO: 48390 - DNA, 75 bp, Artificial Sequence
  Synthetic
tataaacaaatagacttttatcacgttatctcatgtctaaatattacaaatagtaatagcatacactaaaactta

SEQ ID NO: 48391 - DNA, 75 bp, Artificial Sequence
  Synthetic
ggaatcaatactcaagttaaggatagcgaatacctcatcgtcatcatccgtatcctctgaaacgccatcatatga

SEQ ID NO: 48392 - DNA, 75 bp, Artificial Sequence
  Synthetic
aaagattctataataatgaatgcagatctaataaatggagaataattggaacacaagttgataaaatgttgatag

SEQ ID NO: 48393 - DNA, 75 bp, Artificial Sequence
  Synthetic
gtaaatttcattatgtgtagatcaaacttaaataatccatttatctctttcctagatactgtatatactattata

SEQ ID NO: 48394 - DNA, 75 bp, Artificial Sequence
  Synthetic
agaagttgtaaatgacaatgagatgtaccatcttattccccatagactatcgacgattatactctgtattagttc

SEQ ID NO: 48395 - DNA, 75 bp, Artificial Sequence
  Synthetic
acacgctccggtaaacgggtcatgtgacgagggagaatatcttgataagaggcataatcaatgttgtaatcagtg

SEQ ID NO: 48396 - DNA, 75 bp, Artificial Sequence
  Synthetic
tatgaaggtccgtaaattattgaatttttatcaaatatgttataatttggagatggaaagatattcattacacaa

SEQ ID NO: 48397 - DNA, 75 bp, Artificial Sequence
  Synthetic
cacaattaccagttgaattgtgataataaaccatataattaattatattatacctagagtgtttgaagactatgc

SEQ ID NO: 48398 - DNA, 75 bp, Artificial Sequence
  Synthetic
aattatcgattgtatagttaataagtttatgagcttttataaggataacctagaaaatatagtagatgctatcat

SEQ ID NO: 48399 - DNA, 75 bp, Artificial Sequence
  Synthetic
agatgtagtggtagtgataacacaaaatgtgaacgctgcccacctcatacatataccgcaatccccaattattct

SEQ ID NO: 48400 - DNA, 75 bp, Artificial Sequence
  Synthetic
cacaataagcgacacaaataaaaaggaatatgacgattacttatctttctacaatatgatatgcaatgaaccaaa

SEQ ID NO: 48401 - DNA, 75 bp, Artificial Sequence
  Synthetic
tctatatcatgcactataccattatctatatcatgcactataccattatctatatcatctatatcatctatatca

SEQ ID NO: 48402 - DNA, 75 bp, Artificial Sequence
  Synthetic
cgattactacattattaaatcatgaagtccgtattatactcgtatatattgtttctctcatgtataataataaac

SEQ ID NO: 48403 - DNA, 75 bp, Artificial Sequence
  Synthetic
tagataatgattaatgttaaggaaaagaaaatattcagtgtataggtatgtcttggcgtcatatcttgtactaaa

SEQ ID NO: 48404 - DNA, 75 bp, Artificial Sequence
  Synthetic
agtaattgtcaattcagaagtcgatataacatctgatgattgttttgtacttagtcgattacaagatgatacgtt

SEQ ID NO: 48405 - DNA, 75 bp, Artificial Sequence
  Synthetic
gaatatgacgattacttatctttctacaatatgatatgcaatgaaccaaatgtagaatataaagaactgtctact

SEQ ID NO: 48406 - DNA, 75 bp, Artificial Sequence
  Synthetic
aaaaaataattctatcttgggatattctgatgaaatcagaaaaaatgatttagatatgaacattgtaaaagattt

SEQ ID NO: 48407 - DNA, 75 bp, Artificial Sequence
  Synthetic
tctgatgaaatcagaaaaaatgatttagatatgaacattgtaaaagatttcatcgctaacggatatgacttaaca

SEQ ID NO: 48408 - DNA, 75 bp, Artificial Sequence
  Synthetic
ttccatcaaattgtataggtatgtcttctgccaagtacataaattcgagcatcgagcaagatactttaatctatg

SEQ ID NO: 48409 - DNA, 75 bp, Artificial Sequence
  Synthetic
cataatgaatttagaaatgattgatatactaaacgattatcttactatgaaacagagatcgtctttagttcatgt

SEQ ID NO: 48410 - DNA, 75 bp, Artificial Sequence
  Synthetic
gatcgtcatcgcgttgttttagccacatacgactgagttcaagttctcgttgacaagatccatctacttttccat

SEQ ID NO: 48411 - DNA, 75 bp, Artificial Sequence
  Synthetic
atactaaacgattatcttactatgaaacagagatcgtctttagttcatgtttatctattagataataaaaaattt

SEQ ID NO: 48412 - DNA, 75 bp, Artificial Sequence
  Synthetic
aaacaaattataaaattatatagtataatatttaaacaatctcaggaagatatgctacaagatttaggatacgga

SEQ ID NO: 48413 - DNA, 75 bp, Artificial Sequence
  Synthetic
taatatttaaacaatctcaggaagatatgctacaagatttaggatacggatatataggagacactattagtacat

SEQ ID NO: 48414 - DNA, 75 bp, Artificial Sequence
  Synthetic
aacttattattgtggagactttaagggattaacacgtatcttttacggaactcctctccatgtattggctagttt

SEQ ID NO: 48415 - DNA, 75 bp, Artificial Sequence
  Synthetic
taatataaaagaatatgtatatcaattagttaataatgatcatctagataataggataagactaatgcttgaaaa

SEQ ID NO: 48416 - DNA, 75 bp, Artificial Sequence
  Synthetic
ggattaacacgtatcttttacggaactcctctccatgtattggctagtttaaaaagtttaataacacctaattac

SEQ ID NO: 48417 - DNA, 75 bp, Artificial Sequence
  Synthetic
ttagaagaagtggatagtttcttaactacattatcatccgtaactaaagaatcgcatcaaataaaattattgact

SEQ ID NO: 48418 - DNA, 75 bp, Artificial Sequence
  Synthetic
tactccgttgggaacaccgttacattattacttacatggttttacaagaagcaattttctagattacaatgaaac

SEQ ID NO: 48419 - DNA, 75 bp, Artificial Sequence
  Synthetic
tattacttacatggttttacaagaagcaattttctagattacaatgaaacaatcatagatacatttatagaacta

SEQ ID NO: 48420 - DNA, 75 bp, Artificial Sequence
  Synthetic
tattgataaagatctaaaaattaaagcgggtcctcggtacgtacttaacgctattagtcctaatgcatatgatgt

SEQ ID NO: 48421 - DNA, 75 bp, Artificial Sequence
  Synthetic
agaatcagaatcatacaatgaattaattaagatattgttaaataatggatcagatgtagataaaaaagatacgca

SEQ ID NO: 48422 - DNA, 75 bp, Artificial Sequence
  Synthetic
ggctatccataatattaataatatcgataatatacaaaatataaagatactacgtaaacttttaatactcagtaa

SEQ ID NO: 48423 - DNA, 75 bp, Artificial Sequence
  Synthetic
aaaatctagactctatatctatttctgttatgactccaattaatcccatgttagcggaatcgtgtgattctgtca

SEQ ID NO: 48424 - DNA, 75 bp, Artificial Sequence
  Synthetic
aacagtaatgtttgcatatttatctttcttgctagtattactgcatattgtcccaatgtttcgatgtggtgttct

SEQ ID NO: 48425 - DNA, 75 bp, Artificial Sequence
  Synthetic
ttatttatatttggggcaacacatggattataaatatcgatgttaataacatcagaaaatgtaaagtctatgcat

SEQ ID NO: 48426 - DNA, 75 bp, Artificial Sequence
  Synthetic
tgttatgactccaattaatcccatgttagcggaatcgtgtgattctgtcaataaggcatttaaaaaatttccatc

SEQ ID NO: 48427 - DNA, 75 bp, Artificial Sequence
  Synthetic
cagtgttagtaataggcttaggcaaatgcttgtcgtacgcgggcacttcctcatccatcaagtatttataatcgg

SEQ ID NO: 48428 - DNA, 75 bp, Artificial Sequence
  Synthetic
tctagatattattagatctctagacgggtttgatattaataaatattataacggttatacgccgttacattatgc

SEQ ID NO: 48429 - DNA, 75 bp, Artificial Sequence
  Synthetic
aaaataataacgagtttgccttctttagtagaaacatgaaaccagtactctctcataaagtggattatctcaaag

SEQ ID NO: 48430 - DNA, 75 bp, Artificial Sequence
  Synthetic
cgtcttttttgacaggatcaggttcttctacaggaagaagtttcggcctcttatgatagtcatgtctgggaaacg

SEQ ID NO: 48431 - DNA, 75 bp, Artificial Sequence
  Synthetic
gataatatacaaaatataaagatactacgtaaacttttaatactcagtaaacatgctaaaccggaattatttaga

SEQ ID NO: 48432 - DNA, 75 bp, Artificial Sequence
  Synthetic
gggtttgatattaataaatattataacggttatacgccgttacattatgccataaagcacaacaccatacgtatt

SEQ ID NO: 48433 - DNA, 75 bp, Artificial Sequence
  Synthetic
gaaattgttcttgtagacgaacataatgtaccgctcccgtttggaagtttaggtatacacaaaaagaaagaatat

SEQ ID NO: 48434 - DNA, 75 bp, Artificial Sequence
  Synthetic
atgtaccgctcccgtttggaagtttaggtatacacaaaaagaaagaatataaaaactctaacatgtgtttgttcg

SEQ ID NO: 48435 - DNA, 75 bp, Artificial Sequence
  Synthetic
taataaaactattttctatttggcattacgtgtatatagtgctcgtaagtggactagttttctcattagtcgatt

SEQ ID NO: 48436 - DNA, 75 bp, Artificial Sequence
  Synthetic
ttacgtgtatatagtgctcgtaagtggactagttttctcattagtcgattacctcctaaagaaatcttaggtcca

SEQ ID NO: 48437 - DNA, 75 bp, Artificial Sequence
  Synthetic
atgggaaggtagtccaactgtcattagttatctaatattaatggttccgtcgttctattccaagttcaaggaggc

SEQ ID NO: 48438 - DNA, 75 bp, Artificial Sequence
  Synthetic
agttatctaatattaatggttccgtcgttctattccaagttcaaggaggctatagaatttaagatacaacagagg

SEQ ID NO: 48439 - DNA, 75 bp, Artificial Sequence
  Synthetic
gctacgttgataaatagatctgaaccactaagtagataatgattaatgttaaggaagaggaaatattcagtatat

SEQ ID NO: 48440 - DNA, 75 bp, Artificial Sequence
  Synthetic
ttcgttgatcacatttagataaaaaggcggtcacgtcgtcaaaatatttactaatatcggtagttgtatcatcta

SEQ ID NO: 48441 - DNA, 75 bp, Artificial Sequence
  Synthetic
cactaagtagataatgattaatgttaaggaagaggaaatattcagtatatagatatgccttagcatcatatcttg

SEQ ID NO: 48442 - DNA, 75 bp, Artificial Sequence
  Synthetic
atattgttatatgaacaatatatattatgatgctgaagataactatcctctcgatgatgtaagtagagaaaaata

SEQ ID NO: 48443 - DNA, 75 bp, Artificial Sequence
  Synthetic
tatgatgctgaagataactatcctctcgatgatgtaagtagagaaaaatatataaaagttttacaggatgtgtat

SEQ ID NO: 48444 - DNA, 75 bp, Artificial Sequence
  Synthetic
atggcagattctgccgatttagtagtactaggtgcttactatggtaaaggagcaaagggtggtatcatggcagtc

SEQ ID NO: 48445 - DNA, 75 bp, Artificial Sequence
  Synthetic
tgctcatcgacagccatgaaatctgccgactccatggtgtgaatcgcactgtcttattcgccattgattttcatt

SEQ ID NO: 48446 - DNA, 75 bp, Artificial Sequence
  Synthetic
aataactatatacaacatattgtttaataataatataaaaattccagtgtatggcaactatgataaagaattaat

SEQ ID NO: 48447 - DNA, 75 bp, Artificial Sequence
  Synthetic
aataataatataaaaattccagtgtatggcaactatgataaagaattaattaccgaatcaaacatatatcacgat

SEQ ID NO: 48448 - DNA, 75 bp, Artificial Sequence
  Synthetic
tatgattgattgtgtacggaatacaaacataaactgaagtttaacattatttatttatgatatatattatatatc

SEQ ID NO: 48449 - DNA, 75 bp, Artificial Sequence
  Synthetic
ctgatggaaacacagtgaatgctagattgtccagcgtgtccccaggacaaggtaaggactctcccgcgatcactc

SEQ ID NO: 48450 - DNA, 75 bp, Artificial Sequence
  Synthetic
agaaacgtctactaacgattttttatgcttgcattattaatggtatgtaatatgattgattgtgtacggaataca

SEQ ID NO: 48451 - DNA, 75 bp, Artificial Sequence
  Synthetic
tcccaaaaaaattccagagtggttggtagttaataaaatatatattcccgattttgtagtagaggatccgaaaca

SEQ ID NO: 48452 - DNA, 75 bp, Artificial Sequence
  Synthetic
aatttgatagggacaaagtagttgacacgtttatttcatataatagacataatgactccatagagataagagggg

SEQ ID NO: 48453 - DNA, 75 bp, Artificial Sequence
  Synthetic
ttaaagaactaatcttaaaatacactgatgaaaatgttttgatttctccagtttccattttatctactttatcta

SEQ ID NO: 48454 - DNA, 75 bp, Artificial Sequence
  Synthetic
gaaagtcatctactacatagaccatgatcaaccaacgtacttaaataccatcccaaaagaattagttatggagat

SEQ ID NO: 48455 - DNA, 75 bp, Artificial Sequence
  Synthetic
gatcaaccaacgtacttaaataccatcccaaaagaattagttatggagatattttccaacatgaacctaccagaa

SEQ ID NO: 48456 - DNA, 75 bp, Artificial Sequence
  Synthetic
atacagcgaatggaatatcgattagatttcctagatttactaggattagagaagataaaacgtggaaagaatcta

SEQ ID NO: 48457 - DNA, 75 bp, Artificial Sequence
  Synthetic
tacgaatcatatggtgtaagcgatgatgtaagtcattgttttgcatcacctagacgtagacgatctgacgacaaa

SEQ ID NO: 48458 - DNA, 75 bp, Artificial Sequence
  Synthetic
cagaggataactatttagcaaaattaacggcgttagtgaatggatgtgatttctttcctggactctatggggcat

SEQ ID NO: 48459 - DNA, 75 bp, Artificial Sequence
  Synthetic
cataggatgtgatattgaccactcactacagtctatgaaaagcgtccaaacacagatccatgaatgattttttta

SEQ ID NO: 48460 - DNA, 75 bp, Artificial Sequence
  Synthetic
gactaaatcttaatagttacatacaaactgaaaattaaaataacactatttagttggtggtcgccatggatggtg

SEQ ID NO: 48461 - DNA, 75 bp, Artificial Sequence
  Synthetic
caacgatcgtcgatacaaaatgcgtcaagaatctagagtttagcgttcgtatcggagacatgtgcaaggaatcat

SEQ ID NO: 48462 - DNA, 75 bp, Artificial Sequence
  Synthetic
ctacagtctatgaaaagcgtccaaacacagatccatgaatgatttttttataaacgatattgttaagttcaagta

SEQ ID NO: 48463 - DNA, 75 bp, Artificial Sequence
  Synthetic
ttattgtatactgtctaaacgcgttagtaaaacatggcgaggaaataaatcatataaaaaatgatttcatgatta

SEQ ID NO: 48464 - DNA, 75 bp, Artificial Sequence
  Synthetic
gatataaaaattagttactgtgtatgctgtcgtcagaatgagtgattactattttgttcggggtacgacattaac

SEQ ID NO: 48465 - DNA, 75 bp, Artificial Sequence
  Synthetic
gctgtcgtcagaatgagtgattactattttgttcggggtacgacattaacgatgagaaagaattgtgtgtgaaac

SEQ ID NO: 48466 - DNA, 75 bp, Artificial Sequence
  Synthetic
gtattgtatatactaactctctaatggatgagaacacgtatgctatggagttgcttactgggtacgcccctgtat

SEQ ID NO: 48467 - DNA, 75 bp, Artificial Sequence
  Synthetic
ggacaatctaaaaacaatacagtgattgcagatttgccatatctggataatgctgtatcggatgtatgcaaatca

SEQ ID NO: 48468 - DNA, 75 bp, Artificial Sequence
  Synthetic
ttgcagatttgccatatctggataatgctgtatcggatgtatgcaaatcaatatataaaaagaatgtatcaagaa

SEQ ID NO: 48469 - DNA, 75 bp, Artificial Sequence
  Synthetic
ttttgtgatataacattccacacaaaagataacaacgacattatcgcacacataaggtggttgtagctggatttt

SEQ ID NO: 48470 - DNA, 75 bp, Artificial Sequence
  Synthetic
aagataacaacgacattatcgcacacataaggtggttgtagctggattttctacatactttgctgagatgctaag

SEQ ID NO: 48471 - DNA, 75 bp, Artificial Sequence
  Synthetic
gatcactattcctattctctcttcgatggtctcataaaaaagttttacaaaaatattaaacctctttctgatggt

SEQ ID NO: 48472 - DNA, 75 bp, Artificial Sequence
  Synthetic
aggtggttgcagaatataaacaaaaatatggtggagcagctgctagccgtgttagaacatcgtcatcaagtagta

SEQ ID NO: 48473 - DNA, 75 bp, Artificial Sequence
  Synthetic
ttatcgagatggccattgatttcatatacacaggagtcatggatgatcttgagttggaagatgtagttgaaatgt

SEQ ID NO: 48474 - DNA, 75 bp, Artificial Sequence
  Synthetic
atacacaggagtcatggatgatcttgagttggaagatgtagttgaaatgtttgatcttgctcgcttccttgattc

SEQ ID NO: 48475 - DNA, 75 bp, Artificial Sequence
  Synthetic
tatttttattctctttctctcttcgatggtctcataaaatattaaacctctttctgatggagtcactaaaatatt

SEQ ID NO: 48476 - DNA, 75 bp, Artificial Sequence
  Synthetic
atattatataaacatttgtgtttgtatcttattcgtcttttatggaatagtttttaactagtaaagctgtaatta

SEQ ID NO: 48477 - DNA, 75 bp, Artificial Sequence
  Synthetic
taagaaacgctcttgagatgtatgagttgtttagcaatagatttaaggaaatggaagatatatacgatgtcatga

SEQ ID NO: 48478 - DNA, 75 bp, Artificial Sequence
  Synthetic
gttgtttagcaatagatttaaggaaatggaagatatatacgatgtcatgactatgattgaggaaaaaattgctaa

SEQ ID NO: 48479 - DNA, 75 bp, Artificial Sequence
  Synthetic
acacaaacgtctacatgacgagcttccgagttccaattggttcaagttttacataagtataaagtctgactattg

SEQ ID NO: 48480 - DNA, 75 bp, Artificial Sequence
  Synthetic
ccgagttccaattggttcaagttttacataagtataaagtctgactattgttctatattatatatggtagttgat

SEQ ID NO: 48481 - DNA, 75 bp, Artificial Sequence
  Synthetic
ctgattctatgtttgatatcatgaactgcgactatctagatgtcaaagaagatgcggtcatcgatattattcttg

SEQ ID NO: 48482 - DNA, 75 bp, Artificial Sequence
  Synthetic
tgtattttgtgtttccaaatcatgttttatacgctcgataaatttgttacaattatttactcctatcaacataaa

SEQ ID NO: 48483 - DNA, 75 bp, Artificial Sequence
  Synthetic
ctgcgactatctagatgtcaaagaagatgcggtcatcgatattattcttgattggttaactgagttccctgaaga

SEQ ID NO: 48484 - DNA, 75 bp, Artificial Sequence
  Synthetic
attaacgatgagtgtagatgctgttattttgaaccacagattaagattctcgatagagatgagatgctcaatgga

SEQ ID NO: 48485 - DNA, 75 bp, Artificial Sequence
  Synthetic
tcttgtccatatattttaaaacattgacttttgtactaagaaaaatatctagactaactatctctttctctttct

SEQ ID NO: 48486 - DNA, 75 bp, Artificial Sequence
  Synthetic
tgatgctattttacatggatttatcatatcatggagtgacaagtagtggagcaatttacaaattgggatcatcca

SEQ ID NO: 48487 - DNA, 75 bp, Artificial Sequence
  Synthetic
aaatatacatcggcgatgtcaaaaatatcaacaaaatttgataaatctatggcatttggaacagcaatgttacta

SEQ ID NO: 48488 - DNA, 75 bp, Artificial Sequence
  Synthetic
gtgaaaagtgtaagatgaatccgttgttcaatgatgtcgatattgacaggctatccaaatgctatatcgataaaa

SEQ ID NO: 48489 - DNA, 75 bp, Artificial Sequence
  Synthetic
agattatgctggttatgcttgctgcgtaatatgcggtctaattgttggaattatttttacagcgacactattaaa

SEQ ID NO: 48490 - DNA, 75 bp, Artificial Sequence
  Synthetic
gttcaatgatgtcgatattgacaggctatccaaatgctatatcgataaaaggaatgctcgtggaatattttctag

SEQ ID NO: 48491 - DNA, 75 bp, Artificial Sequence
  Synthetic
ccctctagagtttcctacagtcgtgggtcacactatttttttctagacactaaataaaatagtaaaattaaatta

SEQ ID NO: 48492 - DNA, 75 bp, Artificial Sequence
  Synthetic
tttaataagaaatcgagactacattcccgggagacgcggctatagctactacgtttacggtatagcctctagata

SEQ ID NO: 48493 - DNA, 75 bp, Artificial Sequence
  Synthetic
tgatacattttttgacgacgatgattgatcgctattgcacaattttgtttttttactttctaatatagtgtttag

SEQ ID NO: 48494 - DNA, 75 bp, Artificial Sequence
  Synthetic
gtgatactgtgtcttcatagcagttattgagatatattatctttttataatcgtgatacaaaatgaaaagtaatt

SEQ ID NO: 48495 - DNA, 75 bp, Artificial Sequence
  Synthetic
attgagatatattatctttttataatcgtgatacaaaatgaaaagtaattcctattactttaatctagttctaat

SEQ ID NO: 48496 - DNA, 75 bp, Artificial Sequence
  Synthetic
tcatcgtgtgatatgaacagacattgtattatgatgaatttaccagatataggagaattcggttccagtatattg

SEQ ID NO: 48497 - DNA, 75 bp, Artificial Sequence
  Synthetic
gctatctctaattatgttactcctcaaaaaccaacagataatcagtttaataatgtagaaataacatttttcatg

SEQ ID NO: 48498 - DNA, 75 bp, Artificial Sequence
  Synthetic
aaaaaccaacagataatcagtttaataatgtagaaataacatttttcatgactccgaatatcgaaggtaaatata

SEQ ID NO: 48499 - DNA, 75 bp, Artificial Sequence
  Synthetic
gttagtctagatatttttcttagtacaaaagtcaatgttttaaaatatatggacaagaatttgtctgtataaaaa

SEQ ID NO: 48500 - DNA, 75 bp, Artificial Sequence
  Synthetic
gtaggtattacggctattaatctagatctaccaaacaagaatataacactcactcaacttgtgcctagtaatgcc

SEQ ID NO: 48501 - DNA, 75 bp, Artificial Sequence
  Synthetic
ctagaggaatattttatgtacagaggtctattaggcctcagaataaaatatggacgactctttaacgaaattaga

SEQ ID NO: 48502 - DNA, 75 bp, Artificial Sequence
  Synthetic
atctaccaaacaagaatataacactcactcaacttgtgcctagtaatgccactatcgttaaattcacgtttggat

SEQ ID NO: 48503 - DNA, 75 bp, Artificial Sequence
  Synthetic
ccaaaaaatattatacgatctacgttttattatatgattttaacgtgtaaattataaacattattttatgatata

SEQ ID NO: 48504 - DNA, 75 bp, Artificial Sequence
  Synthetic
tgtaaagaaactacagcaaagacattgagatcactgaatctacgtatgtcatcattggataaacatttcacagag

SEQ ID NO: 48505 - DNA, 75 bp, Artificial Sequence
  Synthetic
tgagatcactgaatctacgtatgtcatcattggataaacatttcacagagtatattaatacaaatcatgtgtcgt

SEQ ID NO: 48506 - DNA, 75 bp, Artificial Sequence
  Synthetic
cactagatctataccatctgatgtctgtgataagtatcctctaaagaaattctatcttttggctggtggttgtcc

SEQ ID NO: 48507 - DNA, 75 bp, Artificial Sequence
  Synthetic
atatctatgataggattgtgtgcgtgtgtggtagatgtttggagaaaggagaaactgttttctagatggaaatat

SEQ ID NO: 48508 - DNA, 75 bp, Artificial Sequence
  Synthetic
acagagacaggagtttatgatttttactactatagtacaaattcagcacaatatgtagacaagggatcaatagta

SEQ ID NO: 48509 - DNA, 75 bp, Artificial Sequence
  Synthetic
actactatagtacaaattcagcacaatatgtagacaagggatcaatagtaaaaatctagttaataatactaatca

SEQ ID NO: 48510 - DNA, 75 bp, Artificial Sequence
  Synthetic
gtagagaaaaattcagttgctggaattgcaagatcgtcatctccggggaaaagagttccgtccatttaaagtaca

SEQ ID NO: 48511 - DNA, 75 bp, Artificial Sequence
  Synthetic
aaattatagattttttattaattacaataaatgtttcatgatatgacataaatttcctcctcataataatgaaat

SEQ ID NO: 48512 - DNA, 75 bp, Artificial Sequence
  Synthetic
atttttttctgtaatagttagaaaaatacattcgatggtctatctaccagattattatgtgttataaggtacttt

SEQ ID NO: 48513 - DNA, 75 bp, Artificial Sequence
  Synthetic
aataaatgtttcatgatatgacataaatttcctcctcataataatgaaatataatacatagtaattatactaatt

SEQ ID NO: 48514 - DNA, 75 bp, Artificial Sequence
  Synthetic
ttttgttcgacacatgtatgtactggagccattgtcttaactataatggtgcttgtatcgaaaaactttaatgca

SEQ ID NO: 48515 - DNA, 75 bp, Artificial Sequence
  Synthetic
aatctaaaattgatggatgagatatacagctattaatttcgaaaatatattttaatctgataactttaaacatgg

SEQ ID NO: 48516 - DNA, 75 bp, Artificial Sequence
  Synthetic
caagtatcaacatataggtcattttttaaacatggatgataaaatatacaatgctattaaggccatgaataatca

SEQ ID NO: 48517 - DNA, 75 bp, Artificial Sequence
  Synthetic
ttaaacatggatgataaaatatacaatgctattaaggccatgaataatcaagaagttaatagaatcattaaaaat

SEQ ID NO: 48518 - DNA, 75 bp, Artificial Sequence
  Synthetic
ttttatgagaccatcagaaagaggtttaatatttttgtgataccctgaaaggaaataggaataggaataggaata

SEQ ID NO: 48519 - DNA, 75 bp, Artificial Sequence
  Synthetic
taacttcatgagagatggagtcctgacgaaattattctttcaggagtttatcaaatatatgccattttcagttat

SEQ ID NO: 48520 - DNA, 75 bp, Artificial Sequence
  Synthetic
acgaaattattctttcaggagtttatcaaatatatgccattttcagttatcgtagctaaaactcaagtaagaggg

SEQ ID NO: 48521 - DNA, 75 bp, Artificial Sequence
  Synthetic
agccgtatgaataatcagatttaccccatctagtgcctctctcaccttatcaaagtcgtttatatcacattgtat

SEQ ID NO: 48522 - DNA, 75 bp, Artificial Sequence
  Synthetic
ggtgtccacctggagaatttgccaaggttagatgtagtggtagctataacacaaaatgtgaacgctgtccacatc

SEQ ID NO: 48523 - DNA, 75 bp, Artificial Sequence
  Synthetic
tgatgatatgggacccgtattcaaagagtttacgacttatgaggacttagcgattgaaaagtatgggaaaccatt

SEQ ID NO: 48524 - DNA, 75 bp, Artificial Sequence
  Synthetic
ttcgtctacatgttctgccgtaaccgacagggaaacggatgtataatttttttatagtgtgaaggatatgataaa

SEQ ID NO: 48525 - DNA, 75 bp, Artificial Sequence
  Synthetic
gagtttacgacttatgaggacttagcgattgaaaagtatgggaaaccatttatacgtgatatgcgcgttactgta

SEQ ID NO: 48526 - DNA, 75 bp, Artificial Sequence
  Synthetic
ctctatctttatcacaatatagtgtatcgacatctttattattattgacctcgtttatcttggaacatggaatgg

SEQ ID NO: 48527 - DNA, 75 bp, Artificial Sequence
  Synthetic
aaaaaaattatactgtaacacaatgaagtagtctcatagatgtatagaggtcagatactggtttgataaactttt

SEQ ID NO: 48528 - DNA, 75 bp, Artificial Sequence
  Synthetic
tgacttgtatacgaaacttaaacagaaatcagacggtactcatagtatagaccctgttcaatttacaaaaactgc

SEQ ID NO: 48529 - DNA, 75 bp, Artificial Sequence
  Synthetic
accctgttcaatttacaaaaactgctatcggggtcgcgtctattatatcaaagactactatatcaaataatactt

SEQ ID NO: 48530 - DNA, 75 bp, Artificial Sequence
  Synthetic
acttcaatgcgaggaaatgtataatttggtaatggtttctcgtgtggatctgaagaagaggtaagatatctacta

SEQ ID NO: 48531 - DNA, 75 bp, Artificial Sequence
  Synthetic
cacccgcttttatcaaacgttccaaaaagtcgacggcggacatttttaacatggcatctattttaaatacactta

SEQ ID NO: 48532 - DNA, 75 bp, Artificial Sequence
  Synthetic
tgttggtaaatattgtgacgacatacgtaatcatagagttggtccttttcctccatgcaaactatctaaatgtaa

SEQ ID NO: 48533 - DNA, 75 bp, Artificial Sequence
  Synthetic
atatttttgatgggtaagccaacaacatccagacgtgatgtgtatagaacgtgtagagatcacgctacccgtgta

SEQ ID NO: 48534 - DNA, 75 bp, Artificial Sequence
  Synthetic
agactttctctaaataggactattgttacaaaagttaataataattattataattataataataataattataat

SEQ ID NO: 48535 - DNA, 75 bp, Artificial Sequence
  Synthetic
tattccatatagatataattttattaatcgcacgttctccgtagatgaactagacgataatgtcttttttacaca

SEQ ID NO: 48536 - DNA, 75 bp, Artificial Sequence
  Synthetic
aatctactgatatcgtctgtgagacctctcgtacaggaacactggctagaaagatcattaaaaagatggaggata

SEQ ID NO: 48537 - DNA, 75 bp, Artificial Sequence
  Synthetic
gcacaattttgttttttttactttctagtatagtgtttagattctttttcatatgagaatattgatttactaaaa

SEQ ID NO: 48538 - DNA, 75 bp, Artificial Sequence
  Synthetic
attttatcgattctaatgaatacgaagttaatctaagtcatttagattatcaaagtgtgaacgatttgatcgatt

SEQ ID NO: 48539 - DNA, 75 bp, Artificial Sequence
  Synthetic
ctttgaatccattttcccaaatatctttatgaattactttacatataatatcatcatcaaccgtcacataattac

SEQ ID NO: 48540 - DNA, 75 bp, Artificial Sequence
  Synthetic
atttcaaaatgttaaatcacgtgccagtctattggcagaaaaaataatgcctagagtacctactactgctaccga

SEQ ID NO: 48541 - DNA, 75 bp, Artificial Sequence
  Synthetic
ctgcgaaagattctgaacgagaacgactatctcaccctcttggatcatatccgcactgctaaatactaaatctcc

SEQ ID NO: 48542 - DNA, 75 bp, Artificial Sequence
  Synthetic
tgcatccggatgatcctttgagaagacaataatatccgggagcgcaatcacagattctattgtgagtcgtgttac

SEQ ID NO: 48543 - DNA, 75 bp, Artificial Sequence
  Synthetic
catcgatcgtagcatattttccgcgtctgatatggaaatgttaaaactacaaaaatgcgtaatgttagcccgtcc

SEQ ID NO: 48544 - DNA, 75 bp, Artificial Sequence
  Synthetic
tatacgctgataaatataataacaagaaaatagaaacagcgtcgtttaacacaatattacgaaatattttgagac

SEQ ID NO: 48545 - DNA, 75 bp, Artificial Sequence
  Synthetic
tcattaacgatgaaaactttaaatacttgacagaggaatcaatgataaaaattttaagcgatgatatgttaaata

SEQ ID NO: 48546 - DNA, 75 bp, Artificial Sequence
  Synthetic
acgaaggattaactccgctaggagtatacagtaagcgtagatacgtcaaatctcagattgtgcatctactgatat

SEQ ID NO: 48547 - DNA, 75 bp, Artificial Sequence
  Synthetic
aaaaatacttattctgattcttctagccatttccgtgttcgttcgaatgccacatcgacgtcaaagataggggag

SEQ ID NO: 48548 - DNA, 75 bp, Artificial Sequence
  Synthetic
tcatttcctagataccatagcatcgagttgatatctatcggtataagtaattcacatgataagatttccataaac

SEQ ID NO: 48549 - DNA, 75 bp, Artificial Sequence
  Synthetic
tcattattacgtctacagtcgttcaactgtctttcaagatctgagattctggattggagtctgctaatctctgta

SEQ ID NO: 48550 - DNA, 75 bp, Artificial Sequence
  Synthetic
aagtgtttggagagttttataggtagttgatagaacaaaatacataattttgtaaaaataaatcactttttatac

SEQ ID NO: 48551 - DNA, 75 bp, Artificial Sequence
  Synthetic
aagacggatatacagcgttacattattattatttgtgtctcgcacacgtttataaaccaggtgagtgtagaaaac

SEQ ID NO: 48552 - DNA, 75 bp, Artificial Sequence
  Synthetic
cattgtaaaggaatggggtatggagacattcattgaggacgaggataatatcagatttactgtctacctaaattt

SEQ ID NO: 48553 - DNA, 75 bp, Artificial Sequence
  Synthetic
gagttcaaaggttatagcgtacaatacctgtactaattcttggatatatgatataccagagctaaaatatcctcg

SEQ ID NO: 48554 - DNA, 75 bp, Artificial Sequence
  Synthetic
tcagatttactgtctacctaaatttcgttgaaccggaggaattgaatcttagtaagtttatgatggttcttccgg

SEQ ID NO: 48555 - DNA, 75 bp, Artificial Sequence
  Synthetic
tccaccacaagttcctcaacgtgattattctcctccaccacttcctccgcgcggacctccgccacttcctcctaa

SEQ ID NO: 48556 - DNA, 75 bp, Artificial Sequence
  Synthetic
tatctatgattaccatgtccgcgtttctcatagtgcgactaaatcaatgcatgtctgctaacgaggctgctatta

SEQ ID NO: 48557 - DNA, 75 bp, Artificial Sequence
  Synthetic
atgctaaaatgcgagagccaaaatgtgatatgggtgtagcgatgttaaacggattaatatatgtcataggcggag

SEQ ID NO: 48558 - DNA, 75 bp, Artificial Sequence
  Synthetic
aaaatgtatatgtatgtcgtatgtatatttataaaaaaatgctaagtatgcgatgtatcctgtattatttgtatt

SEQ ID NO: 48559 - DNA, 75 bp, Artificial Sequence
  Synthetic
tctcatagtgcgactaaatcaatgcatgtctgctaacgaggctgctattactgacgctgctgttgccgttgctgc

SEQ ID NO: 48560 - DNA, 75 bp, Artificial Sequence
  Synthetic
agtccttagctataatccgatatatgatgaatggaccaaattatcatcattaaatattcctagaattaatcccgc

SEQ ID NO: 48561 - DNA, 75 bp, Artificial Sequence
  Synthetic
taaatattcctagaattaatcccgctctatggtcagcgcataataaattatatgtaggaggaggaatatctgatg

SEQ ID NO: 48562 - DNA, 75 bp, Artificial Sequence
  Synthetic
tatatatttattttcagttttattatacgcataaattgtaaaaaatatgttaggtttacgaaaatgtctcgtggg

SEQ ID NO: 48563 - DNA, 75 bp, Artificial Sequence
  Synthetic
acattggataatggtcacgtgttaccacgcaattatataatgtataaatgcgaaccgattaaacataaatatcca

SEQ ID NO: 48564 - DNA, 75 bp, Artificial Sequence
  Synthetic
gagaacaaataataggttgtaatatcatatagacaataactaacaattaattagtaactgttatctctttttaac

SEQ ID NO: 48565 - DNA, 75 bp, Artificial Sequence
  Synthetic
gatacacgttttcaaaatacatgtcattcgataaatacgatagtataataactaaatgtcatgaagaaacaatat

SEQ ID NO: 48566 - DNA, 75 bp, Artificial Sequence
  Synthetic
acacagatatctaaaaaaataggtgatgatgcaactctatcatgtagtagaaataatacaaatgattatgttgtt

SEQ ID NO: 48567 - DNA, 75 bp, Artificial Sequence
  Synthetic
tcatgctgtaatcatatccccactgagtaaatgtgtcgtagttagcaagggtcctacaaccatactggttgttaa

SEQ ID NO: 48568 - DNA, 75 bp, Artificial Sequence
  Synthetic
gtcctacaaccatactggttgttaaagcggatatacccagcaaacgattggtaacatcgtttacaaacgacatac

SEQ ID NO: 48569 - DNA, 75 bp, Artificial Sequence
  Synthetic
aagtgacgtcttgtattttgataattataccaaggataaaatatcttacgattctccatacgatgatctagttac

SEQ ID NO: 48570 - DNA, 75 bp, Artificial Sequence
  Synthetic
tataccaaggataaaatatcttacgattctccatacgatgatctagttacaactatcacaattaaatcattgact

SEQ ID NO: 48571 - DNA, 75 bp, Artificial Sequence
  Synthetic
attattagacgagtcaccgactatttggatagacacatatgcgatcagatatttgctaataataagtggtattcc

SEQ ID NO: 48572 - DNA, 75 bp, Artificial Sequence
  Synthetic
gacgccgcgtttgttattactccaatgggtgtgttgactataacagatacattgtatgatgatctcgatatctca

SEQ ID NO: 48573 - DNA, 75 bp, Artificial Sequence
  Synthetic
tatgtcctctgccaagtacataaattctagcatcgagcaagatactttaatccatgtttgtaacctcgagcatcc

SEQ ID NO: 48574 - DNA, 75 bp, Artificial Sequence
  Synthetic
tccttcgttttataaaccattagataaagttgatctcaaaccgtcttttctggtctaatattgtttagtagatac

SEQ ID NO: 48575 - DNA, 75 bp, Artificial Sequence
  Synthetic
tgttgctcgaatattttgtatttgatggtataaggcaaattagaaatgtaggtattgtcatcaactgattctatg

SEQ ID NO: 48576 - DNA, 75 bp, Artificial Sequence
  Synthetic
atacactagtgatatcattaatacagtaagtacatcatctggagaatccacaacagacgagactccggaaccaat

SEQ ID NO: 48577 - DNA, 75 bp, Artificial Sequence
  Synthetic
caacagacgagactccggaaccaattactgataaagaagaagatcatacagtcacaaacactgtctcatacacta

SEQ ID NO: 48578 - DNA, 75 bp, Artificial Sequence
  Synthetic
ggtggccacaatatattctatgatggtattgaagaagataacaaccttggcatattgatcattcaatacggacat

SEQ ID NO: 48579 - DNA, 75 bp, Artificial Sequence
  Synthetic
tacttccacgtatattttattttgttttgactcataatacgcacgtaattctggattattggcataccgatgaat

SEQ ID NO: 48580 - DNA, 75 bp, Artificial Sequence
  Synthetic
cagtaagtacatctggaattgtcactactaaatcaaccaccgatgatgcggatctttatgatacgtacaatgata

SEQ ID NO: 48581 - DNA, 75 bp, Artificial Sequence
  Synthetic
ttatcatactagttatatactaaatgttgatcatattccaccaaatgattgtgaaagagattgagattaaatcgt

SEQ ID NO: 48582 - DNA, 75 bp, Artificial Sequence
  Synthetic
aagctattatcaaatactgtacggaatggattcattctcttctctttttatgaaactctgttgtatatctactga

SEQ ID NO: 48583 - DNA, 75 bp, Artificial Sequence
  Synthetic
tatgaactaggtactcatgataagtatggaataaacttatactgtggaattctttacgcgaaacattataataat

SEQ ID NO: 48584 - DNA, 75 bp, Artificial Sequence
  Synthetic
atatcagtagatgcacaatctgagatttgacgtatctacgtttactgtatactcctagcggagttaatccttcgt

SEQ ID NO: 48585 - DNA, 75 bp, Artificial Sequence
  Synthetic
ttctacaggttctggttctttatcctcagtcgtcaacggagctacttcaatgcgaggaaatgtataatttggtaa

SEQ ID NO: 48586 - DNA, 75 bp, Artificial Sequence
  Synthetic
tcctcttccacgtctactagctcgtggtattatacacatgcctagtaatagtctctttgcgttgacggaaagcag

SEQ ID NO: 48587 - DNA, 75 bp, Artificial Sequence
  Synthetic
tgtattacgtattatatatgtaataaacgttcacgtaaatacaaaacagaaaacaaagtctagattttgacttac

SEQ ID NO: 48588 - DNA, 75 bp, Artificial Sequence
  Synthetic
aaatatttggtattaccgcattaattatattgtcgaccgtggcaattttctgtattacgtattatatatgtaata

SEQ ID NO: 48589 - DNA, 75 bp, Artificial Sequence
  Synthetic
aagttatgacacgtttcaatctctggttttatttttttgtacgtcacatcttcatccagtagacgacatagaata

SEQ ID NO: 48590 - DNA, 75 bp, Artificial Sequence
  Synthetic
tatggaaagaaaggagaggatgaaatgggtaataccatttgtaagaaatgtcggaaagatacttattcggatact

SEQ ID NO: 48591 - DNA, 75 bp, Artificial Sequence
  Synthetic
tttggatttgtggtgtcccataccactagatttcctcgtcctatggaacgagaaggtgtcgattaccattacgtt

SEQ ID NO: 48592 - DNA, 75 bp, Artificial Sequence
  Synthetic
aaaaacaactcgttattacatagcaggcatggaatccttcaagtattgttttgataacgatggcaagaaatggat

SEQ ID NO: 48593 - DNA, 75 bp, Artificial Sequence
  Synthetic
tactgagtttttaggaaatatttacggaacttctaaaacagctgtgaatacagcggctattaataatcgtatttg

SEQ ID NO: 48594 - DNA, 75 bp, Artificial Sequence
  Synthetic
gttagaagtcttaaaaatacttacctaatgccttactcggtgtatataagacctacctctcttaaaatggttgag

SEQ ID NO: 48595 - DNA, 75 bp, Artificial Sequence
  Synthetic
ctagatcggcaatctttctcaacatttcatccccatgccttttacattcctcgagtctactgtcgtcgaaatatc

SEQ ID NO: 48596 - DNA, 75 bp, Artificial Sequence
  Synthetic
ttaaaggagtatggaatgaatacgtttaatgttcgtgacagtgatggtcacattccattacacaaatatctaact

SEQ ID NO: 48597 - DNA, 75 bp, Artificial Sequence
  Synthetic
tatccgtactgctaaatactaaatcttcttcatgctctctcactaatactctcaatatatctcactcatacactc

SEQ ID NO: 48598 - DNA, 75 bp, Artificial Sequence
  Synthetic
gctactacctcctttagaagacatattaataagacttaagagttaagacaagtttaacagtaaaattaatcacaa

SEQ ID NO: 48599 - DNA, 75 bp, Artificial Sequence
  Synthetic
tcatacattatgaactttcaaggacttgtcttaactgacaattgcaaaaatcaatgggtcgttggaccattaata

SEQ ID NO: 48600 - DNA, 75 bp, Artificial Sequence
  Synthetic
ttgtcttaactgacaattgcaaaaatcaatgggtcgttggaccattaataggaaaaggtggattcggtagtattt

SEQ ID NO: 48601 - DNA, 75 bp, Artificial Sequence
  Synthetic
ggatcattatttactgaacaggcattttatactagagtacttaaaccatccgttatcgaagaatggaaaaaatct

SEQ ID NO: 48602 - DNA, 75 bp, Artificial Sequence
  Synthetic
aacagataaatggaaatacgaaaatccatgcaagaaaatgtgcacagtttctgattatgtctctgaactatatga

SEQ ID NO: 48603 - DNA, 75 bp, Artificial Sequence
  Synthetic
tagagatgagatgctcaatggatcatcgtgtgatatgaacagacattgtattatgatgaatttaccagatatagg

SEQ ID NO: 48604 - DNA, 75 bp, Artificial Sequence
  Synthetic
cgagcaaggatattctcacggagatattaaagcgagcaatatagtcttggatcaaatggataagaataaattata

SEQ ID NO: 48605 - DNA, 75 bp, Artificial Sequence
  Synthetic
tatacgtaacgacgcctaatccgagaccagaagtattgctatggcttcttaaatcagaatgttacagcaccggtt

SEQ ID NO: 48606 - DNA, 75 bp, Artificial Sequence
  Synthetic
ccgactatttggatagacatatatgcgatcagatatttgctaataataagtggtattccattataaccatcgacg

SEQ ID NO: 48607 - DNA, 75 bp, Artificial Sequence
  Synthetic
ggtaactctagtgggcgactgtctatctagcgtcgacatctatatactatatagtaataccaatactcaagacta

SEQ ID NO: 48608 - DNA, 75 bp, Artificial Sequence
  Synthetic
accgtctgatttctgtttaagtttcgtatacaagtcaatgttatagacataatccatatcagagtcagagtcaga

SEQ ID NO: 48609 - DNA, 75 bp, Artificial Sequence
  Synthetic
attaaagcgagcaatatagtcttggatcaaatggataagaataaattatatctagtggattacggattggtttct

SEQ ID NO: 48610 - DNA, 75 bp, Artificial Sequence
  Synthetic
aatggataacggtactctagaatttacacctatagattcgcataaaggatatgttgtatcgagacgtggagatct

SEQ ID NO: 48611 - DNA, 75 bp, Artificial Sequence
  Synthetic
cgcatttatctaaccattcaattagtttattaatgactagttggtaatcagcgattcctaaagccgttcttgtaa

SEQ ID NO: 48612 - DNA, 75 bp, Artificial Sequence
  Synthetic
ttcggaactactccattttattgtggaattatacacggtatctcgcttataaaactatatttggaatcagacaca

SEQ ID NO: 48613 - DNA, 75 bp, Artificial Sequence
  Synthetic
tacctatcaaggaacaaatattgtacggtagaattgataatataaatatgagcattagtatttctgtcaattaat

SEQ ID NO: 48614 - DNA, 75 bp, Artificial Sequence
  Synthetic
aacaatgcgatcctggaatgtatatgactcattcctgtaataccacttctaatacaaaatgtgacaagtgcccag

SEQ ID NO: 48615 - DNA, 75 bp, Artificial Sequence
  Synthetic
cagaaatatgtgaacaatactgcgactttgttaatgaccagtttgcaatatgcacctagagaattgctgcaatat

SEQ ID NO: 48616 - DNA, 75 bp, Artificial Sequence
  Synthetic
actactgatgttatcaaacctgattatcttgagtacgatgacttgttagatagagatgagatgtctactattcta

SEQ ID NO: 48617 - DNA, 75 bp, Artificial Sequence
  Synthetic
agatttctaggtacggatcattaatcatctctaatctctaaatacctccataaaacgaaaatgctgctacaaatg

SEQ ID NO: 48618 - DNA, 75 bp, Artificial Sequence
  Synthetic
taaaacgaaaatgctgctacaaatgaaaaaaaagctattaccaaatactgtacggaatggaatcattctcttctc

SEQ ID NO: 48619 - DNA, 75 bp, Artificial Sequence
  Synthetic
tttttatgaaactctgttgtatatctactgataaaactggaagcaaaaaatctgatagaaagaataagaataaga

SEQ ID NO: 48620 - DNA, 75 bp, Artificial Sequence
  Synthetic
tcggtgggtacgacgagaaccttcatgcatttcctggaatatcatcgacggttgccaatgatgtcaggaaatatt

SEQ ID NO: 48621 - DNA, 75 bp, Artificial Sequence
  Synthetic
tgcatttcctggaatatcatcgacggttgccaatgatgtcaggaaatattctgttgtgtcagtttataataacaa

SEQ ID NO: 48622 - DNA, 75 bp, Artificial Sequence
  Synthetic
tttagtattaaacagatccttaacctttttagtaaatgcatatgtatattttagatctccagatttcataatatg

SEQ ID NO: 48623 - DNA, 75 bp, Artificial Sequence
  Synthetic
aatatctcaattagttattgccaagatagaaactatagataatgatatattaaacaacgacattgtaaatttcat

SEQ ID NO: 48624 - DNA, 75 bp, Artificial Sequence
  Synthetic
atgtggtgttacagtcaggtgaacaagagatatattggagcattgctgcctatgtttgagtgcaatgaatatcta

SEQ ID NO: 48625 - DNA, 75 bp, Artificial Sequence
  Synthetic
atgatcacatgcttgataagataaaatctatactgcagaatagactagtgtatgtggaaatgtcatagaaagtta

SEQ ID NO: 48626 - DNA, 75 bp, Artificial Sequence
  Synthetic
tatgtttgagtgcaatgaatatctacaaattggagatccaatccatgatcaagaaggaaatcaaatctctatcgt

SEQ ID NO: 48627 - DNA, 75 bp, Artificial Sequence
  Synthetic
cgtcaaatatttcccgtttaatatcgcatttgtcaagataataatagagtgtggtatgttcacgataagtataat

SEQ ID NO: 48628 - DNA, 75 bp, Artificial Sequence
  Synthetic
tttttagtaaatgcatatgtatattttagatctccagatttcataatatggtcgcatgccttaaatgtcagtgct

SEQ ID NO: 48629 - DNA, 75 bp, Artificial Sequence
  Synthetic
tagtacacggaataatgatggtatcattacatgctgtatactctatggtctttgtagttgttataacaaccaacg

SEQ ID NO: 48630 - DNA, 75 bp, Artificial Sequence
  Synthetic
agcatcaacaatcaactaatgtatgatataattaatagcgtatctataattctagctaatgagagatatagaagc

SEQ ID NO: 48631 - DNA, 75 bp, Artificial Sequence
  Synthetic
atgcggtctaattgttggaattatttttacagcgacactattaaaagttgtagaacgtaaattagttcatacacc

SEQ ID NO: 48632 - DNA, 75 bp, Artificial Sequence
  Synthetic
cactattcctatttcctttcagggtatcactaaaatattaaacctctttctgatggagtcataaaatatttttat

SEQ ID NO: 48633 - DNA, 75 bp, Artificial Sequence
  Synthetic
gaggtaacatctaaggaagaacgtgtggattatgtactcatgaaacgtttggaatctatacgtcatctgtggtct

SEQ ID NO: 48634 - DNA, 75 bp, Artificial Sequence
  Synthetic
tggattatgtactcatgaaacgtttggaatctatacgtcatctgtggtctgtagtgtatgatcattttgatgttg

SEQ ID NO: 48635 - DNA, 75 bp, Artificial Sequence
  Synthetic
actcccaaactgcattcgtgttacactatataacaattacactacatttttatcataacactacttcggttagat

SEQ ID NO: 48636 - DNA, 75 bp, Artificial Sequence
  Synthetic
ctttctgatgcatcaactatttcttaaacaataacgtccaacaacatatactcgtcgagcttatcaacatcccct

SEQ ID NO: 48637 - DNA, 75 bp, Artificial Sequence
  Synthetic
cctatgctgagtactgtaaaaacaaatttgtacatgaagactatgggagcatgtcttcaaatggactccatggaa

SEQ ID NO: 48638 - DNA, 75 bp, Artificial Sequence
  Synthetic
taccggcatcatctcgcataaacattactaaaaaatatattgttctgttttttctttttctttttctttcgtaca

SEQ ID NO: 48639 - DNA, 75 bp, Artificial Sequence
  Synthetic
tagtatcgataacacttctgactcacgaatagataaggtagggaataatggcataatatttattatgttatcatt

SEQ ID NO: 48640 - DNA, 75 bp, Artificial Sequence
  Synthetic
ccagatggagtggaagacgccggatcaattgagagattggcagaagagttcttcagtagatcagaacttcaggcg

SEQ ID NO: 48641 - DNA, 75 bp, Artificial Sequence
  Synthetic
caattgagagattggcagaagagttcttcagtagatcagaacttcaggcgggtgaatcagtcaaatttggcaatt

SEQ ID NO: 48642 - DNA, 75 bp, Artificial Sequence
  Synthetic
gtttttatacagacaaattcttgtccatatattttaaaacattgacttttgtactaagaaaaatatctagactaa

SEQ ID NO: 48643 - DNA, 75 bp, Artificial Sequence
  Synthetic
atcttttaagaattgtggatattatgatattattacgtaaactattacacaattctaaaatataaaacgtatcat

SEQ ID NO: 48644 - DNA, 75 bp, Artificial Sequence
  Synthetic
ggttgttagttaataatatacaagagatatctttttctcactctgatgatccatgtaaaccaaggacgagataag

SEQ ID NO: 48645 - DNA, 75 bp, Artificial Sequence
  Synthetic
aaatattaaacctctttctgatggagtcgtaaaaaaagttttatctctttcgtctcttcgagtggtctcacaaaa

SEQ ID NO: 48646 - DNA, 75 bp, Artificial Sequence
  Synthetic
atcaagtttggagaaatggagagagactgtttaatagcgcatggtgcagccaatactattacagaagttttgaaa

SEQ ID NO: 48647 - DNA, 75 bp, Artificial Sequence
  Synthetic
aaacttcgattcccatatattctttattgtcagaatcgcataccgatttatcatcatacactgtttgaaaactaa

SEQ ID NO: 48648 - DNA, 75 bp, Artificial Sequence
  Synthetic
ccttttttaccaaaggaaatgcctcgttgattattctcctgtttgatttctctatcgatgcagcacctctcttaa

SEQ ID NO: 48649 - DNA, 75 bp, Artificial Sequence
  Synthetic
ggtcgtcttggaagttttattataagttaaaatatcatggttgtccaatttccatctaatatactttgtcggatt

SEQ ID NO: 48650 - DNA, 75 bp, Artificial Sequence
  Synthetic
tcatcatacactgtttgaaaactaaatggtatacacatcaaaataataaataataacgagtacattctgcaatat

SEQ ID NO: 48651 - DNA, 75 bp, Artificial Sequence
  Synthetic
tagagaacaaataataggttgtaatacatatagacaataactaacaattaattagtaactgttatctctttttaa

SEQ ID NO: 48652 - DNA, 75 bp, Artificial Sequence
  Synthetic
gtttttataaactaacattgttaattgaaaagggataacatgttacagaatataaattatatatggattttttta

SEQ ID NO: 48653 - DNA, 75 bp, Artificial Sequence
  Synthetic
cgataatagatcatggagcaaacattaacgcggttacgaaaataggaaatacgccgttacacacttaccttcaag

SEQ ID NO: 48654 - DNA, 75 bp, Artificial Sequence
  Synthetic
gtacgcctttaatggagtttcaccattatactcatataatggatttgcaccactttctatcaatgattgtgcact

SEQ ID NO: 48655 - DNA, 75 bp, Artificial Sequence
  Synthetic
tgaaaagggataacatgttacagaatataaattatatatggatttttttaaaaaggaaatacttgactggagtat

SEQ ID NO: 48656 - DNA, 75 bp, Artificial Sequence
  Synthetic
tcgttgattacaagactacaaagaatgttctagctgctattcctaacagaacatttgccaagattaatccgggtg

SEQ ID NO: 48657 - DNA, 75 bp, Artificial Sequence
  Synthetic
aaaacaatagttgattttttatctaggtggccaaatttattccatattttagaatatggggaaaatattctacat

SEQ ID NO: 48658 - DNA, 75 bp, Artificial Sequence
  Synthetic
tagttcacaatacgatttagattctccgatcaactgatatccgctattgcaagagtacgttatactagagccaaa

SEQ ID NO: 48659 - DNA, 75 bp, Artificial Sequence
  Synthetic
gtatgaagatctattaataataattatcttatttatttcttgacgatattaatcggtcctaataatataaaatac

SEQ ID NO: 48660 - DNA, 75 bp, Artificial Sequence
  Synthetic
gatacagttaatatctatataagtattttaataaatcatggattttacatagatgctgaagacagttacggttgt

SEQ ID NO: 48661 - DNA, 75 bp, Artificial Sequence
  Synthetic
actcaagcagaaacttagattaaattctgaagagggagcagataactttatagattatataaaggtacaaaaaca

SEQ ID NO: 48662 - DNA, 75 bp, Artificial Sequence
  Synthetic
cgattactacgtaaagaagataatagcctactgcgtattaagggacgagtcattcgcggaactacatcgtaaatt

SEQ ID NO: 48663 - DNA, 75 bp, Artificial Sequence
  Synthetic
atacaatgaattaattaagatattgttaaataatggatcagatgtagataaaaaagatacgcatggaaacacgcc

SEQ ID NO: 48664 - DNA, 75 bp, Artificial Sequence
  Synthetic
tatgtttagagaatgctaatatagactctgtagactttaatggatatacacctcttcattatgtctcatgtcgca

SEQ ID NO: 48665 - DNA, 75 bp, Artificial Sequence
  Synthetic
acttaatcctagtttgattgtctcattatcaggaaacttaaaatataatgatatacaatgctcagtaaatgtatc

SEQ ID NO: 48666 - DNA, 75 bp, Artificial Sequence
  Synthetic
atatacaatgctcagtaaatgtatcgtgtctcattaaaaatttggcaacgagtacatctactatattaacatcta

SEQ ID NO: 48667 - DNA, 75 bp, Artificial Sequence
  Synthetic
tacgattctattatatggtataaagatataaatgacaagtataatgacatctatgattttactgcaatatgtatg

SEQ ID NO: 48668 - DNA, 75 bp, Artificial Sequence
  Synthetic
gggatacctttgagcctaactaacgatagcgtgaaatatattctttcaaccgctgattttttacaaattggatct

SEQ ID NO: 48669 - DNA, 75 bp, Artificial Sequence
  Synthetic
cttcctctcttgcttcttcgtcatagtacttacaatcactatgggatccattgttaccacgtctacactcggcga

SEQ ID NO: 48670 - DNA, 75 bp, Artificial Sequence
  Synthetic
agaggcaaaagatgtcaaggtagaagaaaaaaatattatcgatattgaagatgacgatgatatggatgtagaaag

SEQ ID NO: 48671 - DNA, 75 bp, Artificial Sequence
  Synthetic
ccatctttgaaaattatgataccgtctatgatagcaattactaaacataaacaacataatacagatttattaaaa

SEQ ID NO: 48672 - DNA, 75 bp, Artificial Sequence
  Synthetic
gtatgtactattttttacattactacattggctacggcagatatacctacttcgtcactgccacacgctccggta

SEQ ID NO: 48673 - DNA, 75 bp, Artificial Sequence
  Synthetic
gtatataaatactttttatttactgtactcttactgtgtagtggtgataccctactcgattatttttttaaaaaa

SEQ ID NO: 48674 - DNA, 75 bp, Artificial Sequence
  Synthetic
tgtacagtcgctacagcaatataaatggtatatcttaaaatgtttcgatgaaatagatatcatgaagagatgtta

SEQ ID NO: 48675 - DNA, 75 bp, Artificial Sequence
  Synthetic
gagttctgattcatcctttgagcagatctctagagatcgttcaagatccctgattctagtttttagcctatttac

SEQ ID NO: 48676 - DNA, 75 bp, Artificial Sequence
  Synthetic
atactttaatgagatacggtagacatccttctttcgtgaaatgcactagtctcgacgtatacggaagtcgtgtac

SEQ ID NO: 48677 - DNA, 75 bp, Artificial Sequence
  Synthetic
ctcgacgtatacggaagtcgtgtacgtaatatcatagcatctattagatatcgtcagagattaattagtctatta

SEQ ID NO: 48678 - DNA, 75 bp, Artificial Sequence
  Synthetic
tattatctatatgatgggtggatatgatcaatccccgtataggagttcaaaggttatagcgtacaatacatgtac

SEQ ID NO: 48679 - DNA, 75 bp, Artificial Sequence
  Synthetic
tccatttcctccatgcaaactatctaaatgtaattaattatgattttgatgataatgttaccatacattatatcg

SEQ ID NO: 48680 - DNA, 75 bp, Artificial Sequence
  Synthetic
atataaaatctaagtaggataaaatcacactacatcattgtttccttttagtgctcgacagtgtatactattttt

SEQ ID NO: 48681 - DNA, 75 bp, Artificial Sequence
  Synthetic
aacactcataaataaaaatgaaaacgatttccgttgttacgttgttatgcgtgctacctgctgttgtttattcaa

SEQ ID NO: 48682 - DNA, 75 bp, Artificial Sequence
  Synthetic
atcttttgacgatcttgttataattataatataaaaatacttatggcatagtaactcataattgctgacgcgata

SEQ ID NO: 48683 - DNA, 75 bp, Artificial Sequence
  Synthetic
catgtactgtacccactatgaataacgctaaattaacgtctaccgaaacatcgtttaatgataaacagaaagtta

SEQ ID NO: 48684 - DNA, 75 bp, Artificial Sequence
  Synthetic
gatatagataattctaattgctcgtcggtattcgaaatcgcgactccggaaccaattactgataatgaagaagat

SEQ ID NO: 48685 - DNA, 75 bp, Artificial Sequence
  Synthetic
cgaaacaaaatattttcgttgcgaagaaaaaaatggaaatacttcttggaatgatactgttacgtgtcctaatgc

SEQ ID NO: 48686 - DNA, 75 bp, Artificial Sequence
  Synthetic
aagaatagacagtgttattcctagaggtacaactcatttccaagtaggtgcatctggagcaagtggtggtgttgt

SEQ ID NO: 48687 - DNA, 75 bp, Artificial Sequence
  Synthetic
atgatttcattatcggtgtattttccaaatacatccactagagcagccgtatgaataatcagatttaccccatct

SEQ ID NO: 48688 - DNA, 75 bp, Artificial Sequence
  Synthetic
atttacaaattgggatcgtctatcgatagactttctctaaataggactattgttacaaaagttaataataattat

SEQ ID NO: 48689 - DNA, 75 bp, Artificial Sequence
  Synthetic
tttttatacgatatagatcctgtaagcgttgtatgtattctggagctattttctctatcacattagtgagatcag

SEQ ID NO: 48690 - DNA, 75 bp, Artificial Sequence
  Synthetic
gaggttattggtgcttcgtacataagttgtacggctaattcttggaatgttattccatcatgtcaacaaaaatgt

SEQ ID NO: 48691 - DNA, 75 bp, Artificial Sequence
  Synthetic
gttgtacggctaattcttggaatgttattccatcatgtcaacaaaaatgtgatataccgtctctatctaacggat

SEQ ID NO: 48692 - DNA, 75 bp, Artificial Sequence
  Synthetic
cttcatcatccacatgtatcgatggtaaatggaatcccgtactcccaacatgtgtacgaactaaagaagaatttg

SEQ ID NO: 48693 - DNA, 75 bp, Artificial Sequence
  Synthetic
ttcgtacatctctaattatgaaaaagtaaatcattatgagatggatgagatggacgagattgtgcgcatcgttaa

SEQ ID NO: 48694 - DNA, 75 bp, Artificial Sequence
  Synthetic
aaagacgttgtgcaatatgaacaagaaatagaatcgttagaagcaacttatcatataatcatagtagcgttgaca

SEQ ID NO: 48695 - DNA, 75 bp, Artificial Sequence
  Synthetic
gctatgacaaaaggacgtggttctcctaaaccggatccgttatatagtactgttaagaaaacacctaaaagtata

SEQ ID NO: 48696 - DNA, 75 bp, Artificial Sequence
  Synthetic
aataattaataacgaacaagtatcaaaagattaaagaattgtagctagaatcaattgagatgtcttcttcagtgg

SEQ ID NO: 48697 - DNA, 75 bp, Artificial Sequence
  Synthetic
aaagattaaagaattgtagctagaatcaattgagatgtcttcttcagtggatgttgatatctacgatgctgtcag

SEQ ID NO: 48698 - DNA, 75 bp, Artificial Sequence
  Synthetic
gacaagagatttattgtgtatggaagaagtaacgccatattacataatatatacaggctatttacaagatgcgcc

SEQ ID NO: 48699 - DNA, 75 bp, Artificial Sequence
  Synthetic
aaacactttcctgatctatcaaccaatacacacatggtttctaaatctatcaagtggtggggatccatagttatg

SEQ ID NO: 48700 - DNA, 75 bp, Artificial Sequence
  Synthetic
atgttgctgtatgtgtaggtaccggactacggttcatggaaatgtttttcgattataataaaaataattccaaaa

SEQ ID NO: 48701 - DNA, 75 bp, Artificial Sequence
  Synthetic
agttttactatatacctacctagaaatccggcaccaccagtaaccgcgtacacggccattgctgccactcgtaat

SEQ ID NO: 48702 - DNA, 75 bp, Artificial Sequence
  Synthetic
cacggccattgctgccactcgtaataacagactacttattctattttactaaataatggctgtttgtataataga

SEQ ID NO: 48703 - DNA, 75 bp, Artificial Sequence
  Synthetic
cccatggaaaaatagaaccgaggaatatactgattagaaataaacgtctttcactaattgactattctagaacta

SEQ ID NO: 48704 - DNA, 75 bp, Artificial Sequence
  Synthetic
agcatcctattcgaataatgagtacactccgtttaataaactgagtgtaaaactgtatatagatggagtagataa

SEQ ID NO: 48705 - DNA, 75 bp, Artificial Sequence
  Synthetic
actccgtttaataaactgagtgtaaaactgtatatagatggagtagataatatagaaaattcatatactgataat

SEQ ID NO: 48706 - DNA, 75 bp, Artificial Sequence
  Synthetic
tttggctattaaacagtatggagacattgatctattatttaatgagaaacttaaagtagactccgattctggact

SEQ ID NO: 48707 - DNA, 75 bp, Artificial Sequence
  Synthetic
tattctctttctctcttcgatggtctcataaaaaagttttacaaaaatatttttattctctttctctcttcaatg

SEQ ID NO: 48708 - DNA, 75 bp, Artificial Sequence
  Synthetic
atgatatggatgtagaaagcgcgtaatacgatctataaaaataagtatataataaatactttttatttacggtac

SEQ ID NO: 48709 - DNA, 75 bp, Artificial Sequence
  Synthetic
gtcatgcgacgtcggatttgattccatagatatagatgttataaacgactataaaattcttgatatgtataccat

SEQ ID NO: 48710 - DNA, 75 bp, Artificial Sequence
  Synthetic
cagtcagacaatgtctgacgtctgccacggtagttcagggagtccttagtagcgtggcaatgacagggactgaac

SEQ ID NO: 48711 - DNA, 75 bp, Artificial Sequence
  Synthetic
gatgagcgacaatattctattactgcagagggaaaatgctataaaggaataaaatatgaaataagtatgatgaac

SEQ ID NO: 48712 - DNA, 75 bp, Artificial Sequence
  Synthetic
tatcggaataagtatctttccggcatttcttacaaatggtgttacccatgggtggatgatgtgaaaaaaatatat

SEQ ID NO: 48713 - DNA, 75 bp, Artificial Sequence
  Synthetic
gatgatattctattgagacaacatactcttaaaattggatctactaatatattcgatcgccatggacatagtaat

SEQ ID NO: 48714 - DNA, 75 bp, Artificial Sequence
  Synthetic
agagaagagatttcaacagactgtttatgaactcgaatgccgcctcattgtcacttatattgatgatgtcgaatt

SEQ ID NO: 48715 - DNA, 75 bp, Artificial Sequence
  Synthetic
acttaaaacttgataattaataatataactcgtttttatatgtggctatttcaacgtctaatgtattagttaaat

SEQ ID NO: 48716 - DNA, 75 bp, Artificial Sequence
  Synthetic
ctctcagaatcagttgccgttctggaacattaaatgtattttttatgatatactccaacgcatttatgtgggtat

SEQ ID NO: 48717 - DNA, 75 bp, Artificial Sequence
  Synthetic
aataaatttattatccgtatttccataataaggtttagtataaacagagagcgatgttgccgcatgaacttcggt

SEQ ID NO: 48718 - DNA, 75 bp, Artificial Sequence
  Synthetic
gactgtttatgaactcgaatgccgcctcattgtcgcttatattgatgatgtcgaattctcccaatatcatcactg

SEQ ID NO: 48719 - DNA, 75 bp, Artificial Sequence
  Synthetic
atgtaccagaaggaacatacgacatatccggatttccaaagaatgatttcgtatctttctgggttaaattcgaac

SEQ ID NO: 48720 - DNA, 75 bp, Artificial Sequence
  Synthetic
attcatgtctgggaaacggtggtctagggtgaggctccggtatcggagtgggttttggattataatcatcatcgt

SEQ ID NO: 48721 - DNA, 75 bp, Artificial Sequence
  Synthetic
atccggatttccaaagaatgatttcgtatctttctgggttaaattcgaacaaggcgactataaagtggaagagta

SEQ ID NO: 48722 - DNA, 75 bp, Artificial Sequence
  Synthetic
cactagtgatagcattaatacagtaagtgcatcatctggagaatccacaacagacgagactccggaaccaattac

SEQ ID NO: 48723 - DNA, 75 bp, Artificial Sequence
  Synthetic
ggacaagatggacagtctattttccttagatggtttaatatttttgttacccatgatctataaaggtagacctaa

SEQ ID NO: 48724 - DNA, 75 bp, Artificial Sequence
  Synthetic
ttgtaggaattgtttttcacagttgctcaaaaacgatggtagtgacttacgagttacgttacactttggagtctc

SEQ ID NO: 48725 - DNA, 75 bp, Artificial Sequence
  Synthetic
cagtaatgtatgatattgatgactacgattgcacatctacaggttgcagcatagactttgccacaacagaaaaag

SEQ ID NO: 48726 - DNA, 75 bp, Artificial Sequence
  Synthetic
ccatggagttcggaagtatgtctgacacctaagaagaatgtatttacatgcgctattagatccaaggaagatgta

SEQ ID NO: 48727 - DNA, 75 bp, Artificial Sequence
  Synthetic
agacgaattctacaagatagacagcgtatcagatgtagatgacgcggaacacatatctccgataactaatgatgt

SEQ ID NO: 48728 - DNA, 75 bp, Artificial Sequence
  Synthetic
tatgataaagatatttatccttggggtgtaggtaatggggattaatctttgttggatcagtctctaagttaacac

SEQ ID NO: 48729 - DNA, 75 bp, Artificial Sequence
  Synthetic
cacctaagaagaatgtatttacatgcgctattagatccaaggaagatgtatccaatttcaatgacaaaatgacca

SEQ ID NO: 48730 - DNA, 75 bp, Artificial Sequence
  Synthetic
tttctcggtactacggctaatgatgttactaccgtgcttagcatgctagattaaatattctggacaaattctaaa

SEQ ID NO: 48731 - DNA, 75 bp, Artificial Sequence
  Synthetic
ttactaccgtgcttagcatgctagattaaatattctggacaaattctaaatattttttataaaaattaaaaaatc

SEQ ID NO: 48732 - DNA, 75 bp, Artificial Sequence
  Synthetic
atgttggtggcattgtctagaacagtcgcgatatctcttaaatgctacagaaaggtaggattttataatctttat

SEQ ID NO: 48733 - DNA, 75 bp, Artificial Sequence
  Synthetic
tcgcgatatctcttaaatgctacagaaaggtaggattttataatctttatggatctaatgatagcgagcaggaaa

SEQ ID NO: 48734 - DNA, 75 bp, Artificial Sequence
  Synthetic
caaatattgaactagtagtacgtatattgagcaatcagaaatgatgctggtaccacttatcacggtgaccgtagt

SEQ ID NO: 48735 - DNA, 75 bp, Artificial Sequence
  Synthetic
atactgaatatagacaataacataccctggaaaaatattacagattctattaataactcttttatagagaaatgt

SEQ ID NO: 48736 - DNA, 75 bp, Artificial Sequence
  Synthetic
acacaattgacgtacatgagtctgagttccttgtttttactaattatttcatccaatttattattcttgacaata

SEQ ID NO: 48737 - DNA, 75 bp, Artificial Sequence
  Synthetic
cctggaaaaatattacagattctattaataactcttttatagagaaatgtaataattgctcagataatactatat

SEQ ID NO: 48738 - DNA, 75 bp, Artificial Sequence
  Synthetic
agaatataaaaaaatgattgaagaaggagatattcattggcaaattatttcttctgaattcgaggaagatgtaaa

SEQ ID NO: 48739 - DNA, 75 bp, Artificial Sequence
  Synthetic
atatgccgtgggatgatgtcaaggattgtgtagaaatcatccgttgttatataccggatgagcaaaaaaccatca

SEQ ID NO: 48740 - DNA, 75 bp, Artificial Sequence
  Synthetic
actgacaatagtgtctacttaaatgtatctagtgatatcgtgatcaataaaacaggaaatattactacattcatt

SEQ ID NO: 48741 - DNA, 75 bp, Artificial Sequence
  Synthetic
tatatgcttgcattaagaatgatattcacaggtattattaaaatgagtatcggagttacattaccatatcatcat

SEQ ID NO: 48742 - DNA, 75 bp, Artificial Sequence
  Synthetic
tatctagtgatatcgtgatcaataaaacaggaaatattactacattcattaataatacagttaatggtaatttat

SEQ ID NO: 48743 - DNA, 75 bp, Artificial Sequence
  Synthetic
ttcataatcaattcaacaaactgcgaaggtgtatctgttaagaaggctacggcaatttatgtcaatgatacactg

SEQ ID NO: 48744 - DNA, 75 bp, Artificial Sequence
  Synthetic
aaggtgtatctgttaagaaggctacggcaatttatgtcaatgatacactgagtatatacacagaatcagaacctg

SEQ ID NO: 48745 - DNA, 75 bp, Artificial Sequence
  Synthetic
gagactacctcgacatacgtgtgcgctatcaaagtggaaagatgttgctgtgctgtgtttgcagattggccagaa

SEQ ID NO: 48746 - DNA, 75 bp, Artificial Sequence
  Synthetic
ttctccaaaccaatcaattatgtaaatatctctaatacagagtttaatactaatactactacttgtaagaatgag

SEQ ID NO: 48747 - DNA, 75 bp, Artificial Sequence
  Synthetic
atagccgatatagatattaaacaagtgatacgtaagaatatactacaattgtctaatgatatccgcgaacgatat

SEQ ID NO: 48748 - DNA, 75 bp, Artificial Sequence
  Synthetic
atatctctaatacagagtttaatactaatactactacttgtaagaatgagactgactacacaccaatggacattt

SEQ ID NO: 48749 - DNA, 75 bp, Artificial Sequence
  Synthetic
ttatatagaatcatcggttgtatcattggtctgattagtttcctttttataaaattgaagtaatatttagtatta

SEQ ID NO: 48750 - DNA, 75 bp, Artificial Sequence
  Synthetic
acaaaatatatcaactcatgtgtaaattcgtcactgagtttacagatagcggctgtcagaataccagtattgttt

SEQ ID NO: 48751 - DNA, 75 bp, Artificial Sequence
  Synthetic
attcgtcactgagtttacagatagcggctgtcagaataccagtattgtttaataaaacaatggaccaattaggta

SEQ ID NO: 48752 - DNA, 75 bp, Artificial Sequence
  Synthetic
aaaactacgtatgcagaagtactcggttccagaatagccgatatagatattaaacaagtgatacgtaagaatata

SEQ ID NO: 48753 - DNA, 75 bp, Artificial Sequence
  Synthetic
gttccagaatagccgatatagatattaaacaagtgatacgtaagaatatactacaattgtctgatgatatctgcg

SEQ ID NO: 48754 - DNA, 75 bp, Artificial Sequence
  Synthetic
taaacaagtgatacgtaagaatatactacaattgtctgatgatatctgcgaacgatatttgtgaaaaatatttaa

SEQ ID NO: 48755 - DNA, 75 bp, Artificial Sequence
  Synthetic
tctaattgtgacttgagtattctcttgaacaaggcatcaaaaaatgtaatggatagacaattatcaaaaactcca

SEQ ID NO: 48756 - DNA, 75 bp, Artificial Sequence
  Synthetic
tgaacaaggcatcaaaaaatgtaatggatagacaattatcaaaaactccaacgagacaaaagagatccactgaga

SEQ ID NO: 48757 - DNA, 75 bp, Artificial Sequence
  Synthetic
atgccgtgatatatatcacgcatcaggatataaagaaaaatctaaattaattagagactttataacagataggga

SEQ ID NO: 48758 - DNA, 75 bp, Artificial Sequence
  Synthetic
gtgaatgctagattgtctagcgtgtccccaggacaaggtaaggactctcccgctatcactcgtgaagaagctctg

SEQ ID NO: 48759 - DNA, 75 bp, Artificial Sequence
  Synthetic
gatgattgtaattcgtatgttgataatcgtgttgtaaaaaagattactagagcaagaagatctcctaaaaaggct

SEQ ID NO: 48760 - DNA, 75 bp, Artificial Sequence
  Synthetic
tctatgatcaaagactgtgagatgtctatcaacatcaaatgtagcgaagaagagaaagacagcaacatcaagacc

SEQ ID NO: 48761 - DNA, 75 bp, Artificial Sequence
  Synthetic
tttataacatgaacgataaacaaattataaaattatatagtataatatttaaacaatctcaggaagatatgctac

SEQ ID NO: 48762 - DNA, 75 bp, Artificial Sequence
  Synthetic
atcgtgttgtaaaaaagattactagagcaagaagatctcctaaaaaggctccaaagattatcaaatcagaaccta

SEQ ID NO: 48763 - DNA, 75 bp, Artificial Sequence
  Synthetic
agacctagaatacctagatctacgacagatattcaagttggttatcgtggaactgatggaagcgtaatgggtgat

SEQ ID NO: 48764 - DNA, 75 bp, Artificial Sequence
  Synthetic
cagatattcaagttggttatcgtggaactgatggaagcgtaatgggtgatgagaatatatatgaaacaatacgcg

SEQ ID NO: 48765 - DNA, 75 bp, Artificial Sequence
  Synthetic
gtgtttggtcgatgtaaaatttttgtcgataaaaattaaaaaataacttaatttattattgatctcgtgtgtaca

SEQ ID NO: 48766 - DNA, 75 bp, Artificial Sequence
  Synthetic
aagactttgaacattattaatacccgtctgtttaattttttctacagatattttagttttggcagattctattgt

SEQ ID NO: 48767 - DNA, 75 bp, Artificial Sequence
  Synthetic
gatagtagacgactacctaccgctactagaactattatcggaaacgcgattgaatcaaagatgacaactgcaaac

SEQ ID NO: 48768 - DNA, 75 bp, Artificial Sequence
  Synthetic
agaaaagtatatcaaaagacttcgtgttgtgcatttctgtgagaagaaagaggacatcaagtacgcgtgtcgatt

SEQ ID NO: 48769 - DNA, 75 bp, Artificial Sequence
  Synthetic
ctagaactattatcggaaacgcgattgaatcaaagatgacaactgcaaacgctgttatacaaattgtcaaaaatg

SEQ ID NO: 48770 - DNA, 75 bp, Artificial Sequence
  Synthetic
gagtacaagttcataaaaataataacgagtttgccttctttagtagaaacatgaaaccagtactctctcataaag

SEQ ID NO: 48771 - DNA, 75 bp, Artificial Sequence
  Synthetic
agatttgttcaagagtggagaatacaaagcgtacagatacgatgatgatgtagacaatggattcattggattgga

SEQ ID NO: 48772 - DNA, 75 bp, Artificial Sequence
  Synthetic
atgcctaccgatagaagaagtggactagtcattgattcagaaaatccagtcactggaatattaaacgttcctact

SEQ ID NO: 48773 - DNA, 75 bp, Artificial Sequence
  Synthetic
tagtcattgattcagaaaatccagtcactggaatattaaacgttcctacttcaactggattatattcagaacctt

SEQ ID NO: 48774 - DNA, 75 bp, Artificial Sequence
  Synthetic
taccggacactatattccggtttgcaaaacaaaaatgttcctacattcacaaaaagttacctctcgcgacttctt

SEQ ID NO: 48775 - DNA, 75 bp, Artificial Sequence
  Synthetic
cctctttctgatggtctcataaaaaaagttttacaaaaatatttttattctctttctctttctctcttcaatggt

SEQ ID NO: 48776 - DNA, 75 bp, Artificial Sequence
  Synthetic
caaatatcttcctatcaacaactggttctagaacataacagtcaacacccaatccatgttttacatagtcatcta

SEQ ID NO: 48777 - DNA, 75 bp, Artificial Sequence
  Synthetic
ttgcccaagatcctctcttaaatgaatccatcttatccttggacaagatggacagtctattttccttagatggtt

SEQ ID NO: 48778 - DNA, 75 bp, Artificial Sequence
  Synthetic
actcccaagaatcaagctaggctggaaactatttacgaaactatcaaaatgccgggtacaacaaacaataatgac

SEQ ID NO: 48779 - DNA, 75 bp, Artificial Sequence
  Synthetic
acactggaatttttatattattatttaacaatatgttgtatatagttattccatccgttatatagatagatttta

SEQ ID NO: 48780 - DNA, 75 bp, Artificial Sequence
  Synthetic
aaactatttacgaaactatcaaaatgccgggtacaacaaacaataatgacggaagtagactaacgtctccaatat

SEQ ID NO: 48781 - DNA, 75 bp, Artificial Sequence
  Synthetic
taggtacggatcattaatcatctctaatctcgaaatacctcataaaaacaaaaatgctgctacaaatgaaaaaaa

SEQ ID NO: 48782 - DNA, 75 bp, Artificial Sequence
  Synthetic
tgcgaatcgcactgtcttattcgccattgattttcattttttataattatgtacatgatttccttctattctcaa

SEQ ID NO: 48783 - DNA, 75 bp, Artificial Sequence
  Synthetic
aaagaaccaatatatataaatgatccacgttttgatggtcaacctaatcgtatcggagtacggagatcatcaagt

SEQ ID NO: 48784 - DNA, 75 bp, Artificial Sequence
  Synthetic
cacgttttgatggtcaacctaatcgtatcggagtacggagatcatcaagttcatcatccgatattattgtaacca

SEQ ID NO: 48785 - DNA, 75 bp, Artificial Sequence
  Synthetic
aagatcttttctcaaagatgttatggttgaaatacccaatcgaatagtattctcagagttgacgaatattagtaa

SEQ ID NO: 48786 - DNA, 75 bp, Artificial Sequence
  Synthetic
aaggatatcgtcatggattatcatagacgtaatggtcatcaatcaggaacttatgatgatgttagattatcacca

SEQ ID NO: 48787 - DNA, 75 bp, Artificial Sequence
  Synthetic
accagtttatccctatatttaaaatatctatccatatgcatctgaacactctctgccaagatagctgcagagtga

SEQ ID NO: 48788 - DNA, 75 bp, Artificial Sequence
  Synthetic
gatgatgcactaacgagaaaattagaaggattggtcttaaaagatattaatggagtatacgaaccgggaaagaga

SEQ ID NO: 48789 - DNA, 75 bp, Artificial Sequence
  Synthetic
aacttatgatgatgttagattatcatctagatcaggaacttatgatgatgttggcatatctaatactagaggaga

SEQ ID NO: 48790 - DNA, 75 bp, Artificial Sequence
  Synthetic
gctatcaggagaaagccaggtcatagggaagatgttcaagctgttaatatcaatctcgataaacgtgaacaggct

SEQ ID NO: 48791 - DNA, 75 bp, Artificial Sequence
  Synthetic
gggttgttacgacgatgaatccggtaaatggaagacggtaactaaatgttccggacacgatgataatacgttaag

SEQ ID NO: 48792 - DNA, 75 bp, Artificial Sequence
  Synthetic
gtataagcgatttcgagaaataataagaataaagtaatgcccgtaaagataaacatcaacattgtttggtaatca

SEQ ID NO: 48793 - DNA, 75 bp, Artificial Sequence
  Synthetic
agaacaaagtaatggcgccacgcactcatctattggtaatagacaaataacaaataacaacaataacaataatgt

SEQ ID NO: 48794 - DNA, 75 bp, Artificial Sequence
  Synthetic
gtaaatactcaacgaagaagaatcaacgactcagtaaacttgctggtaaaaacaatcgtatgaatatgatgatgg

SEQ ID NO: 48795 - DNA, 75 bp, Artificial Sequence
  Synthetic
gatgtaataaagtgaaattacattttttataaatagatgttagtacagtgttataaatggatgaagcatattact

SEQ ID NO: 48796 - DNA, 75 bp, Artificial Sequence
  Synthetic
acgactcagtaaacttgctggtaaaaacaatcgtatgaatatgatgatggctgctatcgctgtatccgcacagtc

SEQ ID NO: 48797 - DNA, 75 bp, Artificial Sequence
  Synthetic
tttttatttcatacgtctattaataaatatatgtattacttaagactagaaaaatcaaaagtgagttttttgata

SEQ ID NO: 48798 - DNA, 75 bp, Artificial Sequence
  Synthetic
aagaccaaaaaatagtttcactagttacaactgctcttagtcaggtgggtggcacattggcgataactggtggta

SEQ ID NO: 48799 - DNA, 75 bp, Artificial Sequence
  Synthetic
tacaactgctcttagtcaggtgggtggcacattggcgataactggtggtacaatgggtgccatagcagggatttc

SEQ ID NO: 48800 - DNA, 75 bp, Artificial Sequence
  Synthetic
tgttaatgcgcgtaataaattcggaactactccattttattgtggaattatacacggtatctcgcttataaaact

SEQ ID NO: 48801 - DNA, 75 bp, Artificial Sequence
  Synthetic
gatgacaagactcctaccggtgtatataattattttaaacctaaagatgctattcctgttattatatccatagga

SEQ ID NO: 48802 - DNA, 75 bp, Artificial Sequence
  Synthetic
ttatctctggaacacaaccgcctgttgatccggctatagaaaagttttcaacgtatacacagcatatggaaacaa

SEQ ID NO: 48803 - DNA, 75 bp, Artificial Sequence
  Synthetic
tgatccggctatagaaaagttttcaacgtatacacagcatatggaaacaaaggaagcaggatctatatcctgttt

SEQ ID NO: 48804 - DNA, 75 bp, Artificial Sequence
  Synthetic
tagcatctcagcaaagtatgtagaaaatccagatacaaccaccttatgtgcgataatgtcgttgttatcttttgt

SEQ ID NO: 48805 - DNA, 75 bp, Artificial Sequence
  Synthetic
tgaacacagaggctgagagaaagcgtggagaatacacagatattattccgagtaaagtctactatctaaaaaata

SEQ ID NO: 48806 - DNA, 75 bp, Artificial Sequence
  Synthetic
tggagaatacacagatattattccgagtaaagtctactatctaaaaaatagtttcataagttatacggctacagt

SEQ ID NO: 48807 - DNA, 75 bp, Artificial Sequence
  Synthetic
atataattattttaaacctaaagatgccattcctgttattatatccataggaaaagataaagatgtatgtgaaat

SEQ ID NO: 48808 - DNA, 75 bp, Artificial Sequence
  Synthetic
acacgtacgctacgctgatcaatgataaaaagggtgtaaagtactatttagtgcatggtattctagaacttctat

SEQ ID NO: 48809 - DNA, 75 bp, Artificial Sequence
  Synthetic
taaaaagggtgtaaagtactatttagtgcatggtattctagaacttctatctcatcatcctacatcaacattcac

SEQ ID NO: 48810 - DNA, 75 bp, Artificial Sequence
  Synthetic
gtgatatgcaactactaagattgactacagcaggagaaccagaaacaacaaaggatataccatctaatgtatgtg

SEQ ID NO: 48811 - DNA, 75 bp, Artificial Sequence
  Synthetic
tacagcaggagaaccagaaacaacaaaggatataccatctaatgtatgtgatctttatccacttaagcgattcta

SEQ ID NO: 48812 - DNA, 75 bp, Artificial Sequence
  Synthetic
acgtaacgtgtagtacgttacttagaatggcaacttatcaagagaatagtaatagatggatacttatgaatccgt

SEQ ID NO: 48813 - DNA, 75 bp, Artificial Sequence
  Synthetic
aatggcaacttatcaagagaatagtaatagatggatacttatgaatccgttcttcacaactgaaggagaaaatgt

SEQ ID NO: 48814 - DNA, 75 bp, Artificial Sequence
  Synthetic
tgctcaatggatcatcgtgtgatatgaacagacattgtattatgatgaatttacccgatgtaggcgaatttggat

SEQ ID NO: 48815 - DNA, 75 bp, Artificial Sequence
  Synthetic
taaataaaatgctgaatgctgaagctgtatgcactcaagttgataacggtaactgtttctggtcggaagctatgt

SEQ ID NO: 48816 - DNA, 75 bp, Artificial Sequence
  Synthetic
aaattgcatacctataggaatagtctctgtaatcactgcgatggtattatccggattcattttatttgtttaaaa

SEQ ID NO: 48817 - DNA, 75 bp, Artificial Sequence
  Synthetic
caccatggacataaagatagatattagtatttctggtgataaatttacggtgactactaggagggaaaatgaaga

SEQ ID NO: 48818 - DNA, 75 bp, Artificial Sequence
  Synthetic
tgtatgcactcaagttgataacggtaactgtttctggtcggaagctatgttattggaagatgtaacacaatgcgc

SEQ ID NO: 48819 - DNA, 75 bp, Artificial Sequence
  Synthetic
gtcgcaggtagtttaataagaaatcgagactacattcctggaagacgaggctatagctactacgtttacggtata

SEQ ID NO: 48820 - DNA, 75 bp, Artificial Sequence
  Synthetic
gatgaattccattaaacaatcttttactacgtcaaaattggaaggatatactaagcaattaccatctccagctcc

SEQ ID NO: 48821 - DNA, 75 bp, Artificial Sequence
  Synthetic
cgggatataatagtttcatattaacatgtccatcgggatcagctcctttcatgataagcaatagtagtatatcag

SEQ ID NO: 48822 - DNA, 75 bp, Artificial Sequence
  Synthetic
atgtccatcgggatcagctcctttcatgataagcaatagtagtatatcagtaatacctatgaatacaagaagaac

SEQ ID NO: 48823 - DNA, 75 bp, Artificial Sequence
  Synthetic
actagtctatttcatactattttgtgatcaccatggacataaagatagatattagtatttctggtgataaattta

SEQ ID NO: 48824 - DNA, 75 bp, Artificial Sequence
  Synthetic
tgcataattctaatcctaatttgaaatcagacataatacatttaacgtttacaagtaatagaacgatgtatccaa

SEQ ID NO: 48825 - DNA, 75 bp, Artificial Sequence
  Synthetic
atcagacataatacatttaacgtttacaagtaatagaacgatgtatccaaattataaaaattacaataacgagaa

SEQ ID NO: 48826 - DNA, 75 bp, Artificial Sequence
  Synthetic
agaacgaaaaaaatatctacctctccaaaaagaaaaaactactgatgttatcaaacctgattatcttgagtacga

SEQ ID NO: 48827 - DNA, 75 bp, Artificial Sequence
  Synthetic
tttggtgtgaaggttcccataagtttggcagctagcagatttagtcttggaacagcgtctgcattaactagagga

SEQ ID NO: 48828 - DNA, 75 bp, Artificial Sequence
  Synthetic
caactcattgtaaaagattatctgagaatccaaaatgtaaacatcatcggtatcatattggtaaatggaaaccaa

SEQ ID NO: 48829 - DNA, 75 bp, Artificial Sequence
  Synthetic
gaatccaaaatgtaaacatcatcggtatcatattggtaaatggaaaccaatagaatatagattcacaaaacacaa

SEQ ID NO: 48830 - DNA, 75 bp, Artificial Sequence
  Synthetic
tgttatgtacgtattaattatatcatataatggatcattaccatgacaacacgctactagattgtgattttccct

SEQ ID NO: 48831 - DNA, 75 bp, Artificial Sequence
  Synthetic
gctggttatgcttgctgcgtaatatgcggtctaattatcggaattatttttacagcgacactattaaaaacaata

SEQ ID NO: 48832 - DNA, 75 bp, Artificial Sequence
  Synthetic
atctttagattatctattatccagaggagttattgatattaactatcgtactatatacaacgaaacatctattta

SEQ ID NO: 48833 - DNA, 75 bp, Artificial Sequence
  Synthetic
ctgttgttagcaagatgaaaaagtatttcacgtctcctattaatattaaactggatataagcgatatagacaaag

SEQ ID NO: 48834 - DNA, 75 bp, Artificial Sequence
  Synthetic
tttcacgtctcctattaatattaaactggatataagcgatatagacaaagtatatgacgatccagaagttttctg

SEQ ID NO: 48835 - DNA, 75 bp, Artificial Sequence
  Synthetic
atttcggcatcatccaatagtacattttccagattaacagaatagatattaatgtcgtatttgaacagagcctgt

SEQ ID NO: 48836 - DNA, 75 bp, Artificial Sequence
  Synthetic
tgtttccgtgttcggttatagctggtcatgtaaatattgtcgatttctcacatctaccagttaatgatacaaaga

SEQ ID NO: 48837 - DNA, 75 bp, Artificial Sequence
  Synthetic
tcatgtaaatattgtcgatttctcacatctaccagttaatgatacaaagaatagtgatggctattacgcgagata

SEQ ID NO: 48838 - DNA, 75 bp, Artificial Sequence
  Synthetic
aattgtttatcgatgatcacatgcttaataagataaaatctatgctgcagaatagattagtgtatgtggaaatgt

SEQ ID NO: 48839 - DNA, 75 bp, Artificial Sequence
  Synthetic
ttacttatagaaaagaacatggagataatatagattcaccttatgggaaatgcaaagtatttatcgatatcgaaa

SEQ ID NO: 48840 - DNA, 75 bp, Artificial Sequence
  Synthetic
taatatagattcaccttatgggaaatgcaaagtatttatcgatatcgaaactaaggaattaaaaatacactgtcc

SEQ ID NO: 48841 - DNA, 75 bp, Artificial Sequence
  Synthetic
atatcttgataagacgcataatcgatgttgtaatcggtgtccacctggagaatttgccaaggttagatgtagtgg

SEQ ID NO: 48842 - DNA, 75 bp, Artificial Sequence
  Synthetic
tatgtgttacaatggtaacttctagagatcattgtgctgatcaaagggaacaccactggggcggtgcaggatatt

SEQ ID NO: 48843 - DNA, 75 bp, Artificial Sequence
  Synthetic
agatcattgtgctgatcaaagggaacaccactggggcggtgcaggatattggggttatacatctatacaggctca

SEQ ID NO: 48844 - DNA, 75 bp, Artificial Sequence
  Synthetic
gataaatggtcgtgttttcctaacgaaataaaatataaaatattggaaaactttaacgataacgaactatccaca

SEQ ID NO: 48845 - DNA, 75 bp, Artificial Sequence
  Synthetic
ataatttctgctatcgttatcatacctggaattatccacctgcatatgatgcatgtggatcagcgatgatcttgg

SEQ ID NO: 48846 - DNA, 75 bp, Artificial Sequence
  Synthetic
ctccggtaaacggatcatgtgacgaaggagaatatcttgataagacgcataatcaatgttgtaatcggtgtccac

SEQ ID NO: 48847 - DNA, 75 bp, Artificial Sequence
  Synthetic
aagaaatcagagttagatagatacatggaatcgtatcctcgtcatagatatagtaagcattctgtctttaaggga

SEQ ID NO: 48848 - DNA, 75 bp, Artificial Sequence
  Synthetic
ctggaattatccacctgcatatgatgcatgtggatcagcgatgatcttgggatatgcaccaatatttgtagaaag

SEQ ID NO: 48849 - DNA, 75 bp, Artificial Sequence
  Synthetic
agaatgagtacgctagtagaactatgtatcagaaaatcaagaagttatataacgagtatgatagattgatggaaa

SEQ ID NO: 48850 - DNA, 75 bp, Artificial Sequence
  Synthetic
gtatcagaaaatcaagaagttatataacgagtatgatagattgatggaaatgacttctaacgcgataatagacat

SEQ ID NO: 48851 - DNA, 75 bp, Artificial Sequence
  Synthetic
gcctctccttgtgcccagttcagtccctgtcattgccacgctactaaggactcctgaataccgtggctgacgtca

SEQ ID NO: 48852 - DNA, 75 bp, Artificial Sequence
  Synthetic
gaacgctgtccacctcatacatttaccacagtacccaattattctaatggatgtcatcaatgtatgaaatgccca

SEQ ID NO: 48853 - DNA, 75 bp, Artificial Sequence
  Synthetic
atccaattgctgtttattttagaagaacgataatgaatttagaaatgattgatatcattaacaaacatacaacta

SEQ ID NO: 48854 - DNA, 75 bp, Artificial Sequence
  Synthetic
ttcgtgtcttccgggttggttttgcgctactgattcttcgaagactgaagattgtcgagattgtataccaaaaag

SEQ ID NO: 48855 - DNA, 75 bp, Artificial Sequence
  Synthetic
gactgaatactgattatgtaatgttagagtctctaaaggaagagaataaatacaaactagaggcattacagaatg

SEQ ID NO: 48856 - DNA, 75 bp, Artificial Sequence
  Synthetic
agagtctctaaaggaagagaataaatacaaactagaggcattacagaatgagatagaatctacgcttaatgaaat

SEQ ID NO: 48857 - DNA, 75 bp, Artificial Sequence
  Synthetic
ggtgtatataattattttaaacctaaagatgctattcctgttattatatccataggaaaggataaagatgtctgt

SEQ ID NO: 48858 - DNA, 75 bp, Artificial Sequence
  Synthetic
gctactgattcttcgaagactgaagattgtcgagattgtataccaaaaaggagatgtccatgcggatactttggc

SEQ ID NO: 48859 - DNA, 75 bp, Artificial Sequence
  Synthetic
gccatggacgccgcgtttgttattactccaatgggtgtgttgactataacagatacattgtatgatgatctcgat

SEQ ID NO: 48860 - DNA, 75 bp, Artificial Sequence
  Synthetic
taaacttcgattcccatatattctttattgttagaatcgcataccgatttatcatacgctggttcacttgtttga

SEQ ID NO: 48861 - DNA, 75 bp, Artificial Sequence
  Synthetic
ctataaatactagatgttgtgttattaacgaaacagatgtatacaaatattatccgtttgaaaaatatctatgtg

SEQ ID NO: 48862 - DNA, 75 bp, Artificial Sequence
  Synthetic
atcatacgctggttcacttgtttgaaaactaaatggtagacccatcaaaataataaataatgagtacattctgca

SEQ ID NO: 48863 - DNA, 75 bp, Artificial Sequence
  Synthetic
taacgaaacagatgtatacaaatattatccgtttgaaaaatatctatgtggagaatataatgactatatagtagt

SEQ ID NO: 48864 - DNA, 75 bp, Artificial Sequence
  Synthetic
taataaataatgagtacattctgcaatattgttatcgtaattggaaaattggtattcaagtgagctggattgtgt

SEQ ID NO: 48865 - DNA, 75 bp, Artificial Sequence
  Synthetic
tgaagatctattaataataattatcttatttatttcttgacgatattaatcggtgtcctaataatataaaatact

SEQ ID NO: 48866 - DNA, 75 bp, Artificial Sequence
  Synthetic
ttgctgttattaatggatttagaaatagtggacgattttgtgatattaatatagttattaatgatgaaaggataa

SEQ ID NO: 48867 - DNA, 75 bp, Artificial Sequence
  Synthetic
gaacttataatgcctcaaatgttccagtagttacgtgtttcgagatctctttgatgtcaatttccgaaccagaac

SEQ ID NO: 48868 - DNA, 75 bp, Artificial Sequence
  Synthetic
agtagttacgtgtttcgagatctctttgatgtcaatttccgaaccagaacaaagagaagaactagaatcaacatt

SEQ ID NO: 48869 - DNA, 75 bp, Artificial Sequence
  Synthetic
ttagcttgttcaaattttataaagaatcatattcattaggcatataataaaaaatataatttataatacacttac

SEQ ID NO: 48870 - DNA, 75 bp, Artificial Sequence
  Synthetic
ataagaatcttactagtgaactaggaatgcttctaacaaaaaaagatgaggtagagattattgaaaagcttacaa

SEQ ID NO: 48871 - DNA, 75 bp, Artificial Sequence
  Synthetic
aattaattgctgttattaatggatttagaaatagtggacgattttgtgatattaatatagttattaatgatgaaa

SEQ ID NO: 48872 - DNA, 75 bp, Artificial Sequence
  Synthetic
aatgcttctaacaaaaaaagatgaggtagagattattgaaaagcttacaacaggtaacatggtatcaattgtagt

SEQ ID NO: 48873 - DNA, 75 bp, Artificial Sequence
  Synthetic
ctttgagcctaactaacgataacgtgaaatatattctttcaaccgctgattttttacaaattggatctgccatta

SEQ ID NO: 48874 - DNA, 75 bp, Artificial Sequence
  Synthetic
ataggagaaaaatatataatgtacgtaggcagacaatacaatcagatcgacgttatatgatgttggaaaccattt

SEQ ID NO: 48875 - DNA, 75 bp, Artificial Sequence
  Synthetic
ttgaatccgtcaattttgattccaaaattgaatggactggggatggtctatacaatatatcccttaaaaattatg

SEQ ID NO: 48876 - DNA, 75 bp, Artificial Sequence
  Synthetic
atgttaaatataaaaaatgaggattttgcaccactaattctcattaaatggttagagagtacacaacaaccatgc

SEQ ID NO: 48877 - DNA, 75 bp, Artificial Sequence
  Synthetic
tgttcccctctatcatttactccatggtcattagacgatgtgagaagatggaagaggaaacgtggaaattgaaaa

SEQ ID NO: 48878 - DNA, 75 bp, Artificial Sequence
  Synthetic
ggtcattagacgatgtgagaagatggaagaggaaacgtggaaattgaaaataggaatgtgtatacaggctaaaga

SEQ ID NO: 48879 - DNA, 75 bp, Artificial Sequence
  Synthetic
tagtaaatataaaatataatccgcatattccatatagatataattttattaatcgcacgttaaccgtagatgaat

SEQ ID NO: 48880 - DNA, 75 bp, Artificial Sequence
  Synthetic
gaggattgataacagaaggcaatggattcagagtagtcgttcatgatcaatgtgaagagcccaatccatttatta

SEQ ID NO: 48881 - DNA, 75 bp, Artificial Sequence
  Synthetic
attcagagtagtcgttcatgatcaatgtgaagagcccaatccatttattattgctaccacaaaacaaacccattt

SEQ ID NO: 48882 - DNA, 75 bp, Artificial Sequence
  Synthetic
acttaatgatataatgacgaaggaacacgatgtttctgtaagcgttggcaccggaatactattcatggaaatgtt

SEQ ID NO: 48883 - DNA, 75 bp, Artificial Sequence
  Synthetic
cagagaatatcccagattgtagtaaacatattttgatttctgtatattgtgatcaagaggcaagtggactagatt

SEQ ID NO: 48884 - DNA, 75 bp, Artificial Sequence
  Synthetic
atcaaacatttcaactacatcttccaactcaagatcatccatgactcctgtgtatatgaaatcaatggccatctc

SEQ ID NO: 48885 - DNA, 75 bp, Artificial Sequence
  Synthetic
tccacacattgaaatatgtagaatcaaattatttgcatattacagttaagtatgatacatcatgtattaatcatc

SEQ ID NO: 48886 - DNA, 75 bp, Artificial Sequence
  Synthetic
ttaagttaatgagagcaaaaaattataatgttgtattctaatcccatatttgttatttttttctgtaatagttag

SEQ ID NO: 48887 - DNA, 75 bp, Artificial Sequence
  Synthetic
tgtatatgaaatcaatggccatctcgataacaaaacctgaataatcaatattgaagattttttgatctggatcat

SEQ ID NO: 48888 - DNA, 75 bp, Artificial Sequence
  Synthetic
tataattctagctaatgagagatatagaagcgcttttaacgacgatggtatatacatccgtagaactatgattga

SEQ ID NO: 48889 - DNA, 75 bp, Artificial Sequence
  Synthetic
taaagattcctttttgggaaaaattggcgataagtttcaaactgttgacttcactgattgtcgcactatagatgc

SEQ ID NO: 48890 - DNA, 75 bp, Artificial Sequence
  Synthetic
atatatgaaagtgatactctaacctgtggagcaaaggatatacaaactagagacaaatatcttaagacttgcacc

SEQ ID NO: 48891 - DNA, 75 bp, Artificial Sequence
  Synthetic
atataacactaattacatcaagattataatattgaaatcgtaatttgagttgtctgatcatcatggatatcgaaa

SEQ ID NO: 48892 - DNA, 75 bp, Artificial Sequence
  Synthetic
gtggagcaaaggatatacaaactagagacaaatatcttaagacttgcaccaacacaaaatttgaccggagtgtct

SEQ ID NO: 48893 - DNA, 75 bp, Artificial Sequence
  Synthetic
ctccatcatcgagatgattgacggcgtctcccccttccttttttagtagatatttcatcgtgtaagaatcaatat

SEQ ID NO: 48894 - DNA, 75 bp, Artificial Sequence
  Synthetic
atcagaagatggatggatgaagcatcaacgtcttccaataaaaatgtccaatatgtcgacgattgttcatgccgg

SEQ ID NO: 48895 - DNA, 75 bp, Artificial Sequence
  Synthetic
aaaaaaaagattttgttattgtagtatatgataatatcaaaaagatggatataaagaatttgctgactgtatgta

SEQ ID NO: 48896 - DNA, 75 bp, Artificial Sequence
  Synthetic
atcaggattcatcgttgatatctagtattgatagatggaagccatcaaaaccatattggcagacgtatgctaaaa

SEQ ID NO: 48897 - DNA, 75 bp, Artificial Sequence
  Synthetic
taattggctaatcaatcaggaagtaaatatttttataatattaatccactatcactaatcatcaagcaattttta

SEQ ID NO: 48898 - DNA, 75 bp, Artificial Sequence
  Synthetic
ttttgccgatatattaaaatgtggaaactctactaataatattacattgtgcgactttcaagaggatgcgatata

SEQ ID NO: 48899 - DNA, 75 bp, Artificial Sequence
  Synthetic
tgtccaatatggctacgattgttcatgctggtaagatttatatatctggaggttataacaatagtagtgccgtta

SEQ ID NO: 48900 - DNA, 75 bp, Artificial Sequence
  Synthetic
aacgactataaaattattgatatgtataccattgactcgtctatcattcaacgcagaggtcacacatgcaaaata

SEQ ID NO: 48901 - DNA, 75 bp, Artificial Sequence
  Synthetic
gatataatcgagatagaaagtacaaaagatgtagaatccatgatatggcacgctaaacagttgggtgtggaatca

SEQ ID NO: 48902 - DNA, 75 bp, Artificial Sequence
  Synthetic
aaggtaaagtgtaccggaacacagaacagtaaatgttcgtgtcttcctggttggtattgcgctactgattcttca

SEQ ID NO: 48903 - DNA, 75 bp, Artificial Sequence
  Synthetic
acagtaaatgttcgtgtcttcctggttggtattgcgctactgattcttcacagactgaagattgtcgagattgtg

SEQ ID NO: 48904 - DNA, 75 bp, Artificial Sequence
  Synthetic
ttgtttagaaatttatagaataactaatattaatgcattatcgtatatctacaacaatgtaagaaacttcatatt

SEQ ID NO: 48905 - DNA, 75 bp, Artificial Sequence
  Synthetic
ggaaatcctatttgtaaatcgtgttgtgttggtgaatattgcgactacctacgtaattatagacttgatccattt

SEQ ID NO: 48906 - DNA, 75 bp, Artificial Sequence
  Synthetic
acaacaatgtaagaaacttcatattggataatatactattaatatataaggatccagattttatatatttgccta

SEQ ID NO: 48907 - DNA, 75 bp, Artificial Sequence
  Synthetic
tcataattaaattatctacatccatgggtgctgaataatcgttattatcatcattttgtaattgtgacatcatac

SEQ ID NO: 48908 - DNA, 75 bp, Artificial Sequence
  Synthetic
atcgcttcagtgacagtagtcaaataacaaacaataacgataacggacaacaaacaacaccatgagagctataat

SEQ ID NO: 48909 - DNA, 75 bp, Artificial Sequence
  Synthetic
gtttggagagttttataggtagttgatagaacaaaatacataattttgtaaaaataaatcactttttatacacta

SEQ ID NO: 48910 - DNA, 75 bp, Artificial Sequence
  Synthetic
gaagataatgtggtaaagattatatacacttatatatcttccgatatctacaaggatatttcagatatactaccg

SEQ ID NO: 48911 - DNA, 75 bp, Artificial Sequence
  Synthetic
caaatgagcaaggacgaaaagatattcgaagcagttacaatgactctatcaactataggttcaacgttgacaact

SEQ ID NO: 48912 - DNA, 75 bp, Artificial Sequence
  Synthetic
tacttatggcatagtaactcataattgctgacacgataaattcgtaataatctgttttgttcaaatttttataag

SEQ ID NO: 48913 - DNA, 75 bp, Artificial Sequence
  Synthetic
ggaaagaattctaccagtctaggaataagagattgatatcgcatagaaatacaaaagtccgtaatctcatcatcg

SEQ ID NO: 48914 - DNA, 75 bp, Artificial Sequence
  Synthetic
tagggataaaggattaatgattatttctaaacatggttcggaacttgaaacagaattctcgttctccattaaaac

SEQ ID NO: 48915 - DNA, 75 bp, Artificial Sequence
  Synthetic
attctccatacgatgatctagttacaactatcacaattaaatcattgacttctgaagatgccggtacttatgtat

SEQ ID NO: 48916 - DNA, 75 bp, Artificial Sequence
  Synthetic
gaacgcagtgcatcaacttcttgtgtgtcttcttgattgcgtgtacattcatcgagtctagattcgagatctcta

SEQ ID NO: 48917 - DNA, 75 bp, Artificial Sequence
  Synthetic
acagacgagactccggaaccaattactgataaagaagaagatcacgctgtctcatacactacagtaagtacatca

SEQ ID NO: 48918 - DNA, 75 bp, Artificial Sequence
  Synthetic
acgcgttttatgaatgacgatatatatccagaagttttatcctctgtggctagcgctataaccttatcattataa

SEQ ID NO: 48919 - DNA, 75 bp, Artificial Sequence
  Synthetic
agactccggaatcaattactgataatgaagaagatcacactgtcaaatatacagtaagtacatcatctggaattg

SEQ ID NO: 48920 - DNA, 75 bp, Artificial Sequence
  Synthetic
acagtaagtacatcatctggaattgttactactaaatcaaccatcaatgatgcggatctttatgatacgtacaat

SEQ ID NO: 48921 - DNA, 75 bp, Artificial Sequence
  Synthetic
gttcgtacccatattgatgcggcttaataaatgttttgatttcaatttattgtaaaaaaagaatcggttttatac

SEQ ID NO: 48922 - DNA, 75 bp, Artificial Sequence
  Synthetic
agtggtttgatatttcatatactatttataagagatccatatcatcattgtgtaaactaaataacgtcttctatg

SEQ ID NO: 48923 - DNA, 75 bp, Artificial Sequence
  Synthetic
cgcatgtataagtacctggtaagatatctttatattccataatcaatgagacatcactatctgataacgaatgaa

SEQ ID NO: 48924 - DNA, 75 bp, Artificial Sequence
  Synthetic
tgtaaactaaataacgtcttctatgtatttagtaaggacattggatatgtggaaaagtatgatggtgcatggaag

SEQ ID NO: 48925 - DNA, 75 bp, Artificial Sequence
  Synthetic
taaaggcattttcaacttctccttattgattgaaaatgaaaatataaaatagtttttatgtatagcggtatctac

SEQ ID NO: 48926 - DNA, 75 bp, Artificial Sequence
  Synthetic
agtttttatgtatagcggtatctaccctatagttttattgcttactactaacatggatacagatacagatacaga

SEQ ID NO: 48927 - DNA, 75 bp, Artificial Sequence
  Synthetic
acatggatacagatacagatacagatgttacaaatgtagaagatatcatgaatgaaatagatagagagaaagaag

SEQ ID NO: 48928 - DNA, 75 bp, Artificial Sequence
  Synthetic
aatgaaatagatagagagaaagaagaaatactaaaaaatgtagaaatggaaaataataaaaacattaacaagaat

SEQ ID NO: 48929 - DNA, 75 bp, Artificial Sequence
  Synthetic
tatgtcataggtggaatcgttaaaggtgacacgtgtaccgacgcactagagagtttatcagaagatggatggatg

SEQ ID NO: 48930 - DNA, 75 bp, Artificial Sequence
  Synthetic
ttccaattccaattccaatcacattatatgattctgtaaaaaaattatactgtaacacaatgaagtagtctcata

SEQ ID NO: 48931 - DNA, 75 bp, Artificial Sequence
  Synthetic
aagcatcaacgtcttccaataaaaatatccaatatgtcgacgattgttcatgatggcaagatttatatatctgga

SEQ ID NO: 48932 - DNA, 75 bp, Artificial Sequence
  Synthetic
tagtgattccattgataaagaagttatagaatgtattagtcacgatgtaggaatatagatcatatctactaattt

SEQ ID NO: 48933 - DNA, 75 bp, Artificial Sequence
  Synthetic
tggaatccttcaagtattgttttgataacgatggcaagaaatggattatcggaaatactttatattctggtaatt

SEQ ID NO: 48934 - DNA, 75 bp, Artificial Sequence
  Synthetic
taacgatggcaagaaatggattatcggaaatactttatattctggtaattcaatactctataaggtcagaaaaaa

SEQ ID NO: 48935 - DNA, 75 bp, Artificial Sequence
  Synthetic
ggtctattcgacactattatcattgaagatgatgtgaatttagcatatagtaagttaattcagatactacaggac

SEQ ID NO: 48936 - DNA, 75 bp, Artificial Sequence
  Synthetic
tatatacttagatatattgtagataagaatgtgataagatcgttggtggatcaacttccatctctacctatcttc

SEQ ID NO: 48937 - DNA, 75 bp, Artificial Sequence
  Synthetic
acaagccattgttgtctgaaatacgattctatatatctgtattggatcctttggctatcgacaactggacaaggg

SEQ ID NO: 48938 - DNA, 75 bp, Artificial Sequence
  Synthetic
aaaataggtgatgatgcaactctatcatgtaatcgaaataatacaaatgactacgttgttatgagtgcttggtat

SEQ ID NO: 48939 - DNA, 75 bp, Artificial Sequence
  Synthetic
gtctttcactaattgactattctaaaactaacaaactctacaagagtggaaactcacatatagattacaacgagg

SEQ ID NO: 48940 - DNA, 75 bp, Artificial Sequence
  Synthetic
ggagccacagtttcaagacgaggagatttagaaatgttgggttattgcatgatagaatggttcggtggcaaactt

SEQ ID NO: 48941 - DNA, 75 bp, Artificial Sequence
  Synthetic
aataccatacaatttatgcacgagcaaggatattctcacggagacattaaagcgagcaatatagtcttggatcaa

SEQ ID NO: 48942 - DNA, 75 bp, Artificial Sequence
  Synthetic
gaggactgttttcctgaaggaaatgaacctctggaattagttagatatatagaattagtatacacgctagattat

SEQ ID NO: 48943 - DNA, 75 bp, Artificial Sequence
  Synthetic
taaaaaatttatagctactttctttgaggactgttttcctgaaggaaatgaacctctggaattagttagatatat

SEQ ID NO: 48944 - DNA, 75 bp, Artificial Sequence
  Synthetic
tctcatgtataatattacaaatagtataaactaaagttgacgcatgcattaaaacttaaataataatatttacaa

SEQ ID NO: 48945 - DNA, 75 bp, Artificial Sequence
  Synthetic
attaattatgaaaaactatgctatgcgattatgatgcaaagatgtttaatgatacgatactagattttatctcta

SEQ ID NO: 48946 - DNA, 75 bp, Artificial Sequence
  Synthetic
tctcaaactcctaattatgacagactacgtagactgtttatacaagattgaaaatatatttctttttattgagtg

SEQ ID NO: 48947 - DNA, 75 bp, Artificial Sequence
  Synthetic
gtatcaagacgtggagatctagaaacacttggatattgtatgattagatggttgggaggtatcctgccatggact

SEQ ID NO: 48948 - DNA, 75 bp, Artificial Sequence
  Synthetic
atcggaataagtagacatagccggttttcgttttgctcgtaaccattctaaacaattggggtttccaggatcgtt

SEQ ID NO: 48949 - DNA, 75 bp, Artificial Sequence
  Synthetic
aaagacgaactctttggcgtcctctataatattcccagaaaagatattttcgtgttttagtttatcgagatctga

SEQ ID NO: 48950 - DNA, 75 bp, Artificial Sequence
  Synthetic
atagccacacaacaaaatcgattgccatggatatcttcagggaaatcgcatcttctatgaaaggagagaatgtat

SEQ ID NO: 48951 - DNA, 75 bp, Artificial Sequence
  Synthetic
tatctcattcaagtccatgaataaagtatatggacgatattctgcaatgtttaaagattcctttttgagaaaaat

SEQ ID NO: 48952 - DNA, 75 bp, Artificial Sequence
  Synthetic
tataaaaccaaggactttgtagaaatatttggtattaccgcattaattatattgtcggctgtggcaattttctgt

SEQ ID NO: 48953 - DNA, 75 bp, Artificial Sequence
  Synthetic
attccattacacaaatatctaactcatgatgaagttgagaatgatatctttgatatgctttctgatagtatagat

SEQ ID NO: 48954 - DNA, 75 bp, Artificial Sequence
  Synthetic
agtgcaatgaatatctacaaattggagatccaatccatgatcaagaaggaaatcaaatctctatcgtcacatatc

SEQ ID NO: 48955 - DNA, 75 bp, Artificial Sequence
  Synthetic
cctgtctcctagcaattagtgccgtatactttaaagcaaaatggttgatgccattcgaaaaggaatttaccagtg

SEQ ID NO: 48956 - DNA, 75 bp, Artificial Sequence
  Synthetic
aaagtacgcgataaacggaataataatagatttatctagtttatctttttctatcgctttcatagttagatacat

SEQ ID NO: 48957 - DNA, 75 bp, Artificial Sequence
  Synthetic
tgcgatcaacaagcgtgttgatatctttactgaggggaaaattaatccactattggatgaaccattgtctccaga

SEQ ID NO: 48958 - DNA, 75 bp, Artificial Sequence
  Synthetic
ataatgatggcgtatacagtataggaaaggagtgcatagataatatatacgaagacagacataccgtagacgaat

SEQ ID NO: 48959 - DNA, 75 bp, Artificial Sequence
  Synthetic
tatatagtacactcctatctaaaaaattatagaaatttcgattatccatttttcaggaagttagttctgactaat

SEQ ID NO: 48960 - DNA, 75 bp, Artificial Sequence
  Synthetic
tatagcaatatgtgtaattcagatgtgagtgtcgacgctatgatccacaaaacgtatatagatgtcaatgaagag

SEQ ID NO: 48961 - DNA, 75 bp, Artificial Sequence
  Synthetic
ccacgtctggataggagattgtatctgtcaagttactgctgtagacgtacatggaaaggaaattatgagaatgag

SEQ ID NO: 48962 - DNA, 75 bp, Artificial Sequence
  Synthetic
tccaggacctatcatcgattaccacgtctggataggagattgtgtctgccaagttactgctgtagacgtgcatgg

SEQ ID NO: 48963 - DNA, 75 bp, Artificial Sequence
  Synthetic
tgagtgtcgacgctatgatccacaaaacgtatatagatgtcaatgaagagtatacagaagcagctgcagcaactt

SEQ ID NO: 48964 - DNA, 75 bp, Artificial Sequence
  Synthetic
caaatctggtaaaagttaaagttggggaggaaaatgatacagtaaatctttccacttccatatcagctctcctga

SEQ ID NO: 48965 - DNA, 75 bp, Artificial Sequence
  Synthetic
cgttggtagatattgctctccaacaactaattaagcacattcttgatattagaatattatatagttaagattttt

SEQ ID NO: 48966 - DNA, 75 bp, Artificial Sequence
  Synthetic
aaactagtcgtttataataaaacacgatatggatgccaacgtagtatcatcttctactatcgcgacatatataga

SEQ ID NO: 48967 - DNA, 75 bp, Artificial Sequence
  Synthetic
tctacctatcttcaatataaaatcatttgagaaattcatatcctactgtatacttttagatgacacattttacga

SEQ ID NO: 48968 - DNA, 75 bp, Artificial Sequence
  Synthetic
ttgtttttcactttttataattttaccatctgactcatggattcattaatatctttatacgagctactaatgtat

SEQ ID NO: 48969 - DNA, 75 bp, Artificial Sequence
  Synthetic
gcagcttccttctatactctcatcttttgccaacacagatggtggatatttgttcattggagttgataataatac

SEQ ID NO: 48970 - DNA, 75 bp, Artificial Sequence
  Synthetic
ttagtgagggtcgttattcttccaattgcaattggtaagatgacggccaactttagtacccacgtcttttcacca

SEQ ID NO: 48971 - DNA, 75 bp, Artificial Sequence
  Synthetic
catgcacgattatataagtaatacatatattgatatagagtgtttagatattattagatcactggatgggttcga

SEQ ID NO: 48972 - DNA, 75 bp, Artificial Sequence
  Synthetic
tgactgaatatatttattggtcgtcctatgcattccgcaaccggcaatgcgctggacaattgtatgccacactcc

SEQ ID NO: 48973 - DNA, 75 bp, Artificial Sequence
  Synthetic
cttattagatcgaggagctgatatatcattaaagacaggcgatggaaaatctgtattcgatttatcgttatgtag

SEQ ID NO: 48974 - DNA, 75 bp, Artificial Sequence
  Synthetic
ttgttatataccggatgagcaaaaaaccatcagagagatttcggccatcatcggactttgtgcatatgctgctac

SEQ ID NO: 48975 - DNA, 75 bp, Artificial Sequence
  Synthetic
tcggactttgtgcatatgctgctacttactggggaggtgaagaccatcccactagtaacagtctgaacgcattgt

SEQ ID NO: 48976 - DNA, 75 bp, Artificial Sequence
  Synthetic
cgtgacgtgtatagaacgtgtagagatcacgctacccgtgtacgtgcaactggtaattaaaataaaaagtaatat

SEQ ID NO: 48977 - DNA, 75 bp, Artificial Sequence
  Synthetic
tcacatatagattacaacgaggacatgataacttcaggaaatatcaattatatgtgtgtagacaatcatcttgga

SEQ ID NO: 48978 - DNA, 75 bp, Artificial Sequence
  Synthetic
acgcatgtagattcatcaaggtatataaacctggggaggagactacctcgacatacgtgtgtgctatcaaagtgg

SEQ ID NO: 48979 - DNA, 75 bp, Artificial Sequence
  Synthetic
ttgcagattggccagaatcatggtatatggatactagtggtatcaagaagtattctccagatgaatgggtgtcat

SEQ ID NO: 48980 - DNA, 75 bp, Artificial Sequence
  Synthetic
tgaatgtatcgacaaagggcaatattttgcgtcattcatggagttagaaaacgagccagtaatcttaccatgtcc

SEQ ID NO: 48981 - DNA, 75 bp, Artificial Sequence
  Synthetic
ctaccccaatgataacaatagtcttgtaaagataagccgcaagaaaatttatacgcatccatccaaataactcta

SEQ ID NO: 48982 - DNA, 75 bp, Artificial Sequence
  Synthetic
aattttccacttccaaggaattagattgtctttacgaatcatatggtgtaaacgaggatgtgagtcattgttttg

SEQ ID NO: 48983 - DNA, 75 bp, Artificial Sequence
  Synthetic
cattaccaagaacgagacctactgtgatatgatgtcgttaaatttgacaattgtgtctgtctcagaatcaaatat

SEQ ID NO: 48984 - DNA, 75 bp, Artificial Sequence
  Synthetic
tttgtcgataaaaattaaaaaaataacttaatttattattgatctcgtgtgtacaaccgaaatcatggcgatgtt

SEQ ID NO: 48985 - DNA, 75 bp, Artificial Sequence
  Synthetic
gtaaatgagagatctactggtgaaatggtgtgtcccaatattaatgcatttattgctagtaacgtaaacgcagat

SEQ ID NO: 48986 - DNA, 75 bp, Artificial Sequence
  Synthetic
acaaagaatggtgactgtattcaaggtatagttagatcccatgtacggaaaccttcttcatgcattccagaaatc

SEQ ID NO: 48987 - DNA, 75 bp, Artificial Sequence
  Synthetic
atgacaagtataatgacatctatgattttactgcaatatgtatgctaatagcgtctacattgatagtgacaatat

SEQ ID NO: 48988 - DNA, 75 bp, Artificial Sequence
  Synthetic
caacaagcgtgttgatatctttactgaggggaaaatcaatccactattgactgaacaattgtctcctgatacctg

SEQ ID NO: 48989 - DNA, 75 bp, Artificial Sequence
  Synthetic
ggaattatcaccatagaagatgttagaaaaaatgatgctggttattacacgtgtgttttaaaatatacatacgga

SEQ ID NO: 48990 - DNA, 75 bp, Artificial Sequence
  Synthetic
ttgtaaaattagaggtacgggatagaataatacctcctactatgcaattaccagacggtgttgtaacttcaatag

SEQ ID NO: 48991 - DNA, 75 bp, Artificial Sequence
  Synthetic
tacatagatgccgaagacagttacggttgtacattattacatagatgtatatatcactataagaaatcagaatca

SEQ ID NO: 48992 - DNA, 75 bp, Artificial Sequence
  Synthetic
cgcggttaaacattaatcctgtcaaggaagaagatgctacaacgtttacgtgtatggcgtttactattcctagca

SEQ ID NO: 48993 - DNA, 75 bp, Artificial Sequence
  Synthetic
ggaagaagatgctacaacgtttacgtgtatggcgtttactattcctagcatcagtaaaacagttactattagtat

SEQ ID NO: 48994 - DNA, 75 bp, Artificial Sequence
  Synthetic
atatattttaatctgataactttaaacatggatttttgatgacatagtggtttaaagtttaaacagattttttat

SEQ ID NO: 48995 - DNA, 75 bp, Artificial Sequence
  Synthetic
tgttgttaaataatggatcagatgtagataaaaaagatacgtacggaaacacaccgtttatcctattatgtaaac

SEQ ID NO: 48996 - DNA, 75 bp, Artificial Sequence
  Synthetic
accgataagagacgcgttattacatcgcggttaaacattaatcctgtcaaggaagaagatgctacaacgtttacg

SEQ ID NO: 48997 - DNA, 75 bp, Artificial Sequence
  Synthetic
tgatacagaaaatctttccactgccatatcagctctcctgaattccggcggtggtaccatcgaggtaacctctca

SEQ ID NO: 48998 - DNA, 75 bp, Artificial Sequence
  Synthetic
ttttatacattatcttccaacaagcaattgacgaacgtattgctatgattaactcccacgatactatgcatatta

SEQ ID NO: 48999 - DNA, 75 bp, Artificial Sequence
  Synthetic
aattgacgaacgtattgctatgattaactcccacgatactatgcatattattaatcattaacttgcagactatac

SEQ ID NO: 49000 - DNA, 75 bp, Artificial Sequence
  Synthetic
tgtgaacaaggtgtctcatattataattcacaagaattaaagtgttgtaaactatgtaagccaggaacatattca

SEQ ID NO: 49001 - DNA, 75 bp, Artificial Sequence
  Synthetic
atatcagctctcctgaattccggcggtggtaccatcgaggtaacctctcaagaagaccgcgtgaatcatgtactc

SEQ ID NO: 49002 - DNA, 75 bp, Artificial Sequence
  Synthetic
ttttgatattgtgaatggtaaagaatgctgttatgtgcatatgcattcatctaatcaaaatcctataccgagtac

SEQ ID NO: 49003 - DNA, 75 bp, Artificial Sequence
  Synthetic
ttattaaagtacgtaaatctagctatagttttattatttaattttagataatataccgtctccttatttttaaaa

SEQ ID NO: 49004 - DNA, 75 bp, Artificial Sequence
  Synthetic
tgctgttatgtgcatatgcattcatctaatcaaaatcctataccgagtactgtaaaaacaaatttgtacatgaag

SEQ ID NO: 49005 - DNA, 75 bp, Artificial Sequence
  Synthetic
aatagataatgaacatatagttcgtcatttaataatttttgacgccgttgaatctttagattatctattatccaa

SEQ ID NO: 49006 - DNA, 75 bp, Artificial Sequence
  Synthetic
aatatattgtgaacaacaagagcagatatctataggaaagggtggaatgcgatacattgatctatgtagttttaa

SEQ ID NO: 49007 - DNA, 75 bp, Artificial Sequence
  Synthetic
atatctataggaaagggtggaatgcgatacattgatctatgtagttttaaaacacacgcgaactttgaagaattt

SEQ ID NO: 49008 - DNA, 75 bp, Artificial Sequence
  Synthetic
tagcgaactgaaggaatcaggtggacggagtcccagaccagaaatgcaggaatttgaatatccagatggagtgga

SEQ ID NO: 49009 - DNA, 75 bp, Artificial Sequence
  Synthetic
aatttgaatatccagatggagtggaagacactgaatcaattgagagattggcagaggagttcttcaatagatcag

SEQ ID NO: 49010 - DNA, 75 bp, Artificial Sequence
  Synthetic
atgcggatactttggtggaatagatgaactcggaaatcctctttgtaaatcgtgttgtgttggtgaatattgcga

SEQ ID NO: 49011 - DNA, 75 bp, Artificial Sequence
  Synthetic
cttctatgttgagatgtatatatccaggaattcttttattaatatcgggaaacgtataaactaaaacattgcccg

SEQ ID NO: 49012 - DNA, 75 bp, Artificial Sequence
  Synthetic
accaatacctttgcatgacttgttttgttcggcaacgttagtttaaacttgacgaatggattaattacaatagca

SEQ ID NO: 49013 - DNA, 75 bp, Artificial Sequence
  Synthetic
gaaatagatatcatgaagagatgttatataaaaaataaaactgtattccaattagttttttgtactaaagacatt

SEQ ID NO: 49014 - DNA, 75 bp, Artificial Sequence
  Synthetic
gacgaatggattaattacaatagcatgatccgcgcatctattaagtttttttactttaacgcccttgtatgtttt

SEQ ID NO: 49015 - DNA, 75 bp, Artificial Sequence
  Synthetic
taaaaatgtgtatagaatatactgcgtgtatgaccgattatgatactcttatagatgtacaatcgctacagcaat

SEQ ID NO: 49016 - DNA, 75 bp, Artificial Sequence
  Synthetic
aaagaggacatcaagtacacgtgtcgattcatcaaggtatataaacctggggatgagactacctcgacatacgtg

SEQ ID NO: 49017 - DNA, 75 bp, Artificial Sequence
  Synthetic
cgggatatagaactgaatcacctaccctagatacccaattacattttatcagatccagataataaacaaattttg

SEQ ID NO: 49018 - DNA, 75 bp, Artificial Sequence
  Synthetic
cctagatacccaattacattttatcagatccagataataaacaaattttgtcgccctaactaattctatattgtt

SEQ ID NO: 49019 - DNA, 75 bp, Artificial Sequence
  Synthetic
cgcatcgtcgtacgtttacacaattgtgatttagtgtagtatatctacacatgtatttttccgcactatagtatt

SEQ ID NO: 49020 - DNA, 75 bp, Artificial Sequence
  Synthetic
ctgttattaaattatttaatacatacgctggcttattatccgatagtaataaaatgggggtaagaaaatgtttga

SEQ ID NO: 49021 - DNA, 75 bp, Artificial Sequence
  Synthetic
gttatagttcttaacatctattaatcattgattcgcttctttaattttttataaactaacattgttaattgaaaa

SEQ ID NO: 49022 - DNA, 75 bp, Artificial Sequence
  Synthetic
tgatctttattaaatttagagaccatatcctgaatagaattgctcggtgtcaacggttgaaggagtgaactcggt

SEQ ID NO: 49023 - DNA, 75 bp, Artificial Sequence
  Synthetic
catatttacatatttactggtatatcaaagatgttagattagttaatgggaatcgtctataataatgaatattaa

SEQ ID NO: 49024 - DNA, 75 bp, Artificial Sequence
  Synthetic
cggataatgatagaattataccgatagataatggtagcaatatgctaattctgaacccgacacaatcagactctg

SEQ ID NO: 49025 - DNA, 75 bp, Artificial Sequence
  Synthetic
gtctgatttatgttttaaatatcaaccgcaaatcaactcataaaatacaagagaatgaaatatatacatatttta

SEQ ID NO: 49026 - DNA, 75 bp, Artificial Sequence
  Synthetic
aactatgatctaaacagacgacagcctgtaactgggtataccgcactacactgctatttgtataataattacttt

SEQ ID NO: 49027 - DNA, 75 bp, Artificial Sequence
  Synthetic
tggggaaaatattctacatatttattctatggatgatgctaatacgaatattataattttttttctagatagagt

SEQ ID NO: 49028 - DNA, 75 bp, Artificial Sequence
  Synthetic
gtcgagttacttagatgcctcagaatatcattgctttccccacaagttataaaatcactttatagtcatcaactg

SEQ ID NO: 49029 - DNA, 75 bp, Artificial Sequence
  Synthetic
ttttagaatatatatacagaggtaaaacatataacgtaaccagaattgtaaaattagaggtacgggatagaataa

SEQ ID NO: 49030 - DNA, 75 bp, Artificial Sequence
  Synthetic
agatatgatagacaaagataaaaaccacttatcacatagagactattccaacctactactagagtatataaaatc

SEQ ID NO: 49031 - DNA, 75 bp, Artificial Sequence
  Synthetic
tatacgatgctttaccatgtttaatactttatcagacatcagacaatctattatgtcgtgatacatataattttg

SEQ ID NO: 49032 - DNA, 75 bp, Artificial Sequence
  Synthetic
cataaactgctacaatcgtaaaaaaaatacatgggagatgatatcttcacgtagatataggtgtagtttcgcagt

SEQ ID NO: 49033 - DNA, 75 bp, Artificial Sequence
  Synthetic
tcttccacatcccatataatacaggaatataatcttgttcgaacatacgagaaagtggataaaacaatagttgat

SEQ ID NO: 49034 - DNA, 75 bp, Artificial Sequence
  Synthetic
gatatgaggttattggtgcttcgtacataagttgtacggctaattcttggaatgttattccatcatgtcaacaaa

SEQ ID NO: 49035 - DNA, 75 bp, Artificial Sequence
  Synthetic
tctccatcatccacatgtatcgacggtaaatggaatcccgtactcccaatatgtgtacgatctaacgaagaattt

SEQ ID NO: 49036 - DNA, 75 bp, Artificial Sequence
  Synthetic
cgagttagatagttgcggtaatacaccattccatttgtatcttgcggttgaaacgtgtaataatatccatatgac

SEQ ID NO: 49037 - DNA, 75 bp, Artificial Sequence
  Synthetic
ccattccatttgtatcttgcggttgaaacgtgtaataatatccatatgactaaaatgctattgacttttaatcca

SEQ ID NO: 49038 - DNA, 75 bp, Artificial Sequence
  Synthetic
gtaacaaaaataatgaccaatataagttccataaattgttgccgtgaatataaatccgttaaaataatgaataat

SEQ ID NO: 49039 - DNA, 75 bp, Artificial Sequence
  Synthetic
aacttccgactacatacaacacgatattcttgtcatgttgatacatcactatgaaacaaatgttggagaaattcc

SEQ ID NO: 49040 - DNA, 75 bp, Artificial Sequence
  Synthetic
gataagactttgaatattattaatgcccgtctgtttaattttttctacggatattttagttttggcagattctat

SEQ ID NO: 49041 - DNA, 75 bp, Artificial Sequence
  Synthetic
cacatccggcagattcgataacttatttgatgaataggtttaaaaatatagatatccatacccgttatgaaggaa

SEQ ID NO: 49042 - DNA, 75 bp, Artificial Sequence
  Synthetic
tctatctattaaacagaaatggtgattttgagacgattactactagtggatgtacatgtatttcggaagcagtcg

SEQ ID NO: 49043 - DNA, 75 bp, Artificial Sequence
  Synthetic
tttttataaacatgaaaccactgtctaaatgtaatcatgatcttgatttatagatgaaaatcagctgcttcagat

SEQ ID NO: 49044 - DNA, 75 bp, Artificial Sequence
  Synthetic
tctaaaaaaataggtgatgatgcaactctatcatgtagtcgaaataatacaagtgactacgttgttatgagtgct

SEQ ID NO: 49045 - DNA, 75 bp, Artificial Sequence
  Synthetic
tatatgataaactatttcctgttttcacagataaaaattgtctactaacattactcccttcagaaattatatatg

SEQ ID NO: 49046 - DNA, 75 bp, Artificial Sequence
  Synthetic
tcctattcgaataatgagtatactccgtttaataaactgagtgtaaaactgtatatagatggagtagataatata

SEQ ID NO: 49047 - DNA, 75 bp, Artificial Sequence
  Synthetic
ttcgatgaactcatcgagatattgctctctgtcatattcatacacctgcataaactttctagacatcttacaatc

SEQ ID NO: 49048 - DNA, 75 bp, Artificial Sequence
  Synthetic
taatgaagatgacgatgaaaatgatggtacatatatatttcgtatcattatcattatcgttattgctattccaca

SEQ ID NO: 49049 - DNA, 75 bp, Artificial Sequence
  Synthetic
tcattatcgttattgctattccacagttacgccatagacatcgaaaatgaaatcacagaattcttcaataaaatg

SEQ ID NO: 49050 - DNA, 75 bp, Artificial Sequence
  Synthetic
aatcacagaattcttcaataaaatgaaagatactctaccagctaaagactctaaatggttgaatccagcatgtat

SEQ ID NO: 49051 - DNA, 75 bp, Artificial Sequence
  Synthetic
ctcatacactacagtaagtacatcatctggaattgtcactactaaatcaaccaccgatgatgcggatctttatga

SEQ ID NO: 49052 - DNA, 75 bp, Artificial Sequence
  Synthetic
attatcacttcaacgacaatagtcaaataacagccaacatgagatctgtaattctaacagttttgctaattaata

SEQ ID NO: 49053 - DNA, 75 bp, Artificial Sequence
  Synthetic
agagggaaaatgctataaaggaataaaatatgaaataagtatgatgaacgatgatactctattgagaaaacatac

SEQ ID NO: 49054 - DNA, 75 bp, Artificial Sequence
  Synthetic
tattgctattccatagttacgccatagacatcgaaaatgaaatcacagaattcttcaataaaatgagagatactc

SEQ ID NO: 49055 - DNA, 75 bp, Artificial Sequence
  Synthetic
ttatggatagccaactatacatctaaattcagtaaccgtaggtatttgtgtaccgtaactacaaagaatggtgac

SEQ ID NO: 49056 - DNA, 75 bp, Artificial Sequence
  Synthetic
ggttttacactaacggggtctccatcatccacatgtatcgatggtaaatggaatcccatactcccaacatgtgta

SEQ ID NO: 49057 - DNA, 75 bp, Artificial Sequence
  Synthetic
acatgtgtgatatctacttgttgtatactgctaacttcacattcggagattctgaagaaccagtaacatatgata

SEQ ID NO: 49058 - DNA, 75 bp, Artificial Sequence
  Synthetic
agattcgataacttatttgatgaataggtttaaaaatatagatattcatacccgctatgaaggaaagacattatt

SEQ ID NO: 49059 - DNA, 75 bp, Artificial Sequence
  Synthetic
tctgaagaaccagtaacatatgatatcgatgactacgattgcacgtctacaggttgcagcatagactttgccaca

SEQ ID NO: 49060 - DNA, 75 bp, Artificial Sequence
  Synthetic
ttacgcgaaacattataataatataacttggtataaagataataaggaaattaatatcgatggtattaagtattc

SEQ ID NO: 49061 - DNA, 75 bp, Artificial Sequence
  Synthetic
cgtcgcaagaccacaggtttaaactaatactagatccgaaaatcaacgtaacgataggagaacctgccaatataa

SEQ ID NO: 49062 - DNA, 75 bp, Artificial Sequence
  Synthetic
atgatgagacatctgataataacacattgcatggtaatataggatttttggaaataaataattgctacaatattt

SEQ ID NO: 49063 - DNA, 75 bp, Artificial Sequence
  Synthetic
tgggaaaatccatccggatggcttataggattcgattttgatgtatactctgttttaactagtagaggcggtatc

SEQ ID NO: 49064 - DNA, 75 bp, Artificial Sequence
  Synthetic
gaagaatttgatccagtggatgatggtcccgatgatgagacagatctgagcaaactctcaaaagacgttgtacaa

SEQ ID NO: 49065 - DNA, 75 bp, Artificial Sequence
  Synthetic
ccaatttcaaggacaaaatggccagagttatcaagagaaaatttaataaacagtctcaatcttatttgactaaat

SEQ ID NO: 49066 - DNA, 75 bp, Artificial Sequence
  Synthetic
ctattatacgctggttaacgctattagctctaaccattttcaggatgaggtccctggttatagttctgttgttcc

SEQ ID NO: 49067 - DNA, 75 bp, Artificial Sequence
  Synthetic
tttgtgctatagaatggatgaagatacgcgactatctaggtatttgtatctcaccgatagagaacatataaatgt

SEQ ID NO: 49068 - DNA, 75 bp, Artificial Sequence
  Synthetic
ataatagttttctgacgtggagtacagaattttcggttaatgagttcatggtaaggaagggcgaatgaatgcctg

SEQ ID NO: 49069 - DNA, 75 bp, Artificial Sequence
  Synthetic
catgaccgtgcttagcatgcttgactaatttttattaattatataaaaatgaaaataaaactgtgtattatacgc

SEQ ID NO: 49070 - DNA, 75 bp, Artificial Sequence
  Synthetic
atgggtgatggatacacttaatggtataatgatgaatgaacgcgatattactgtatgtgtgggcaccggactacg

SEQ ID NO: 49071 - DNA, 75 bp, Artificial Sequence
  Synthetic
atatcagatcctaatgcatgttatagatgtggatgtacggctttacatgagtacttttataattatagatcagtc

SEQ ID NO: 49072 - DNA, 75 bp, Artificial Sequence
  Synthetic
caaagaatggtgactgtgttcagggtatagttagatctcatattagaaaacctccttcatgcattccaaaaacat

SEQ ID NO: 49073 - DNA, 75 bp, Artificial Sequence
  Synthetic
tatcatgcacaatatactacccatctactaaataatgagcacgattgattttatcattaccgcttcattcttata

SEQ ID NO: 49074 - DNA, 75 bp, Artificial Sequence
  Synthetic
taaggatacgttactaaaatatttcacttaaaactggagttagaatttatagacgactcatttcgtttatcatta

SEQ ID NO: 49075 - DNA, 75 bp, Artificial Sequence
  Synthetic
taatggccttaatatactatcctatttactaaagaagtttgacatgaaaaacgatgaatactataatgacattac

SEQ ID NO: 49076 - DNA, 75 bp, Artificial Sequence
  Synthetic
cggaacatctactaacgatttttatacttgtattattaatgatatgtaacaataccgatttgtcaaacatgaata

SEQ ID NO: 49077 - DNA, 75 bp, Artificial Sequence
  Synthetic
gatacaatggctactatcaatattattcatctagcgattatgaaaattataatgattactattatgattatgata

SEQ ID NO: 49078 - DNA, 75 bp, Artificial Sequence
  Synthetic
attatatatcgtttcggtatcgttattatttggtctatgccatggatatttttaaagaactaatcttaaaacaca

SEQ ID NO: 49079 - DNA, 75 bp, Artificial Sequence
  Synthetic
tctatgatgaaacacaagatcaaagtacacaactagtaggttacgacattaaactcaaaaccaatgaggatgatt

SEQ ID NO: 49080 - DNA, 75 bp, Artificial Sequence
  Synthetic
atagatgaatcaattaataaagtagtatatggaagagagtcttacgtaagatggcgggatatatggcaagaacat

SEQ ID NO: 49081 - DNA, 75 bp, Artificial Sequence
  Synthetic
agaggcgcttgtgtctacgataaaccaaaagctttctagtgttaaagaggtaacttatgcttcgctcaatctgcc

SEQ ID NO: 49082 - DNA, 75 bp, Artificial Sequence
  Synthetic
ttagttattatcactctcgcgagtgcaaccgaaaacatggcgatgttttacgcacacgctttcggtgggtacgat

SEQ ID NO: 49083 - DNA, 75 bp, Artificial Sequence
  Synthetic
cgaagatagacataccgtagacgaattttataggatagatagtttaacagaagttgatgacacagaccacacatt

SEQ ID NO: 49084 - DNA, 75 bp, Artificial Sequence
  Synthetic
tctcaaagaaacacgtgccgcttacgcccacagtgttctcttgagtgttagcaaaatggaaaacaaaatcgaggt

SEQ ID NO: 49085 - DNA, 75 bp, Artificial Sequence
  Synthetic
tataggtgtctagaagttataaacagtgtgaatgaaaaaacattgcaagacattgaaaatcattccatgactcta

SEQ ID NO: 49086 - DNA, 75 bp, Artificial Sequence
  Synthetic
gcccacagtgttctcttgagtgttagcaaaatggaaaacaaaatcgaggtgaataacaaggatgagatgaacagg

SEQ ID NO: 49087 - DNA, 75 bp, Artificial Sequence
  Synthetic
tggtttgaagagttcaaaaaaggaaatggacttgtggacaccttcacaaactcctactccttttgtgagagtgtt

SEQ ID NO: 49088 - DNA, 75 bp, Artificial Sequence
  Synthetic
ccattccatgctttacagtctatggaacctttgtcaacagcgatagacaactgatctttgacatttacaatgtgc

SEQ ID NO: 49089 - DNA, 75 bp, Artificial Sequence
  Synthetic
ccaaatttggacagatttgtgttccaaatggccggtgccactgatgatgcacaaaaggattccatctatgcatct

SEQ ID NO: 49090 - DNA, 75 bp, Artificial Sequence
  Synthetic
tcctctccgatcaccaccgagagcttgtccctgccagaaaccacaccggagctccctgctacaactggtatagac

SEQ ID NO: 49091 - DNA, 75 bp, Artificial Sequence
  Synthetic
tgtccctgccagaaaccacaccggagctccctgctacaactggtatagactcttcaagtgcaagtggtgtcgatt

SEQ ID NO: 49092 - DNA, 75 bp, Artificial Sequence
  Synthetic
tgaaagttacactgaactaaaagtcgacgtcccgaaaatagaacaacttgccaattaccaacaagctgccttgaa

SEQ ID NO: 49093 - DNA, 75 bp, Artificial Sequence
  Synthetic
ctgcccaacagccctagcacaccatctacaccacaagacacataccatcctgtgagaattctactttcagtcacg

SEQ ID NO: 49094 - DNA, 75 bp, Artificial Sequence
  Synthetic
gctatgaacagactctataatgcttggaacgcttggctctattcactctgacctaaatcttgactgcgtgccgcc

SEQ ID NO: 49095 - DNA, 75 bp, Artificial Sequence
  Synthetic
ccaattaccaacaagctgccttgaagtggagaaaagatataggtttccgtgtcaatgcaaacacagcagctttga

SEQ ID NO: 49096 - DNA, 75 bp, Artificial Sequence
  Synthetic
ctcagcaactagtagccttcatccaatctccgacagactaccaacccctcccgcaacagctcagggacctactga

SEQ ID NO: 49097 - DNA, 75 bp, Artificial Sequence
  Synthetic
gtcaaagagatgctgtctgacatgattaggagaaggaaccaaattctaaacaggggtggtgatgagaatccacgt

SEQ ID NO: 49098 - DNA, 75 bp, Artificial Sequence
  Synthetic
actgtcttcaaatcatacgaaaaaaccctagccacacaatgggttcttttgagctgatccaggcaatctcagagt

SEQ ID NO: 49099 - DNA, 75 bp, Artificial Sequence
  Synthetic
tcggcatgagcaagtttcctcccgaaaatatagacaaagcaagaagggatccgaagaactgggttagcatctctg

SEQ ID NO: 49100 - DNA, 75 bp, Artificial Sequence
  Synthetic
acagcatgataacaaaccttctcaagcacattgccaaggcacaggagctctacaagaattcgtctgcacttcgtg

SEQ ID NO: 49101 - DNA, 75 bp, Artificial Sequence
  Synthetic
gcacattgccaaggcacaggagctctacaagaattcgtctgcacttcgtgcacaaggtgcacagattgacactgc

SEQ ID NO: 49102 - DNA, 75 bp, Artificial Sequence
  Synthetic
tacaagaattcgtctgcacttcgtgcacaaggtgcacagattgacactgccttcagctcatactattggctttac

SEQ ID NO: 49103 - DNA, 75 bp, Artificial Sequence
  Synthetic
cacaaggtgcacagattgacactgccttcagctcatactattggctttacaaggcaggcgtgactccagaaacct

SEQ ID NO: 49104 - DNA, 75 bp, Artificial Sequence
  Synthetic
gaattggtcaaaaaaaacattgatgaagttttacttactgaagatggaaatctgatcttctgctggctgaaaaca

SEQ ID NO: 49105 - DNA, 75 bp, Artificial Sequence
  Synthetic
gagactcaaattcatgaatgtacattctccagaattgatgccggaaaattgtctcttttctagtgaggaattcaa

SEQ ID NO: 49106 - DNA, 75 bp, Artificial Sequence
  Synthetic
tgctttgggacaatccctgtggccaatcctgatgatgctgcccaaggatctggacatactaagtctattctcaac

SEQ ID NO: 49107 - DNA, 75 bp, Artificial Sequence
  Synthetic
caggaacttacaaaatagtgatagataaaaaaaataagttgaatgacagatgcaccttatttaccaactgtgtga

SEQ ID NO: 49108 - DNA, 75 bp, Artificial Sequence
  Synthetic
ctccggactaataccgagaccaacaatccatgtgccaagaccatcgtcaagctgtttgaaattcagaaaacaggg

SEQ ID NO: 49109 - DNA, 75 bp, Artificial Sequence
  Synthetic
gcaatgccaccagtgccaacattatctaaaatgcagaatgctctgtatccaacctctttccctctgaaccaccac

SEQ ID NO: 49110 - DNA, 75 bp, Artificial Sequence
  Synthetic
actgacgaaaagctactacatcaaacaaagatagtttttgctaaaattggtttatctgggaacagttatgacttt

SEQ ID NO: 49111 - DNA, 75 bp, Artificial Sequence
  Synthetic
ctgtatactgttcaaagaagtggcagctgaatgcatgaaaaggtacattggcacaccttatgaaggaatagtaga

SEQ ID NO: 49112 - DNA, 75 bp, Artificial Sequence
  Synthetic
tctcaaagaaatacttgcggcacgtcagtacgtaagtgttaaatttgaggaagtggattgagcatctcagttgca

SEQ ID NO: 49113 - DNA, 75 bp, Artificial Sequence
  Synthetic
aagtggattgagcatctcagttgcagttcacctgtcgacatcatgcatatatcattaatgtatgcagttctttgc

SEQ ID NO: 49114 - DNA, 75 bp, Artificial Sequence
  Synthetic
gttcacctgtcgacatcatgcatatatcattaatgtatgcagttctttgcctacagctgtgtggtctggggggag

SEQ ID NO: 49115 - DNA, 75 bp, Artificial Sequence
  Synthetic
attcattaagaacttatgtagacaggtagaaatacctgctggcagtattaagaagatcttaaatgttcttaggta

SEQ ID NO: 49116 - DNA, 75 bp, Artificial Sequence
  Synthetic
acgctcggtgatggccagagctctgaaccgccagtgagcacggccccatccaccacacacaacccctccactgtc

SEQ ID NO: 49117 - DNA, 75 bp, Artificial Sequence
  Synthetic
aaccgccagtgagcacggccccatccaccacacacaacccctccactgtcacatccacaacaccagctagcgggt

SEQ ID NO: 49118 - DNA, 75 bp, Artificial Sequence
  Synthetic
aggtgtctggaagttataaatagtgtgaatgaaaaaacattgcaagacattgaaaatcattccatgactctacta

SEQ ID NO: 49119 - DNA, 75 bp, Artificial Sequence
  Synthetic
gcaaaagattaacgggaaggagtactggggaaaggctccctagaagcgttagaagcaaggtcatatatgagatgg

SEQ ID NO: 49120 - DNA, 75 bp, Artificial Sequence
  Synthetic
cctacatcacaagacacacaccatcctgtgaggaacctactttcagttacgagccctaggccagaagagacaaca

SEQ ID NO: 49121 - DNA, 75 bp, Artificial Sequence
  Synthetic
gtcttataaaatacgaacctcaaggtgcagagctagcgggagttttttaaatagaagcagtagagaccattttat

SEQ ID NO: 49122 - DNA, 75 bp, Artificial Sequence
  Synthetic
gagccctaggccagaagagacaacagcaccttcaggttcaggcatagagagctcagcaaccagcagcccccatcc

SEQ ID NO: 49123 - DNA, 75 bp, Artificial Sequence
  Synthetic
aaagtaacagtcacaacgccaccgaacatcttgagtccctgacacagtcagcaaccccagatctagtaacctctc

SEQ ID NO: 49124 - DNA, 75 bp, Artificial Sequence
  Synthetic
cacatcttaaagaaacaatccttaatgtgggattagactgtcttgctaacatgcgaaatcttgacggtaagccca

SEQ ID NO: 49125 - DNA, 75 bp, Artificial Sequence
  Synthetic
aggattgaggacaacattgcaaggctttacctgcaaacatccatatactgttcagttagggatgtggaagacaat

SEQ ID NO: 49126 - DNA, 75 bp, Artificial Sequence
  Synthetic
gagggccattttaatgaagttttacaatttagaacgccaggcacagtaagcactacagagtcaacacatgctgga

SEQ ID NO: 49127 - DNA, 75 bp, Artificial Sequence
  Synthetic
tatataagcaaaggactcatggcgttaaacagttacaatcatatgggtcagggtattcaccatgcaacatcttcg

SEQ ID NO: 49128 - DNA, 75 bp, Artificial Sequence
  Synthetic
aatagattcaggttactattcagccaaatgttactcaggaacatctaattcagggcttcagttgatcaatattac

SEQ ID NO: 49129 - DNA, 75 bp, Artificial Sequence
  Synthetic
ccgacattcaactagaatagctgacacacctgggcctaagatcactaacttaaagaccatcaactgcataaactt

SEQ ID NO: 49130 - DNA, 75 bp, Artificial Sequence
  Synthetic
aagacaacgttttcttgtcactaacagataggtggtctaccaagcacagcacaaactatcgtgatagttgtggca

SEQ ID NO: 49131 - DNA, 75 bp, Artificial Sequence
  Synthetic
aaaggcattgaccttcaaagaacacagagaggttgaaatcaatgtgcttctccctcaagttgcagttaatctctc

SEQ ID NO: 49132 - DNA, 75 bp, Artificial Sequence
  Synthetic
gttcagatgattacgcaaagtgtatagtggtgactggtatactatccaaagagctctactcccagtatgatgaaa

SEQ ID NO: 49133 - DNA, 75 bp, Artificial Sequence
  Synthetic
tccctcaagttgcagttaatctctcaaattgtcatgttgtaatcaaatcacatgtctgtgactactctctagaca

SEQ ID NO: 49134 - DNA, 75 bp, Artificial Sequence
  Synthetic
catgtctgtgactactctctagacatcgacgggacggtgaggctccctcacattcatcatgaaggaattttcatc

SEQ ID NO: 49135 - DNA, 75 bp, Artificial Sequence
  Synthetic
agatgctgtcaaatgaaagatagtgccaaaaccttggtgagcgactgctttctcgagttttacagtgagtttatg

SEQ ID NO: 49136 - DNA, 75 bp, Artificial Sequence
  Synthetic
atgtaccctattcaccgactgtgtgataaaaggaagggaggttcgtaaaggccagtcagttttgaagcagtacaa

SEQ ID NO: 49137 - DNA, 75 bp, Artificial Sequence
  Synthetic
ataaaaggaagggaggttcgtaaaggccagtcagttttgaagcagtacaagacagaaatcaggattggcaaggca

SEQ ID NO: 49138 - DNA, 75 bp, Artificial Sequence
  Synthetic
cagagtttgatgcaagcatgccaagtttcatcccaacaagcaatgtataatagtgttcctcttgtcaccaacact

SEQ ID NO: 49139 - DNA, 75 bp, Artificial Sequence
  Synthetic
gagactgcagagatccacggcgataactatggtggcccaggtgacaagataaccatctgcaatggctcaactatt

SEQ ID NO: 49140 - DNA, 75 bp, Artificial Sequence
  Synthetic
aaagacattcaaactatgcgaaaacagtgctacagggaagagttgtgaaatagatagtgtcccagttaaatgcag

SEQ ID NO: 49141 - DNA, 75 bp, Artificial Sequence
  Synthetic
agtgctacagggaagagttgtgaaatagatagtgtcccagttaaatgcaggcagggttattgcctaaaaatcact

SEQ ID NO: 49142 - DNA, 75 bp, Artificial Sequence
  Synthetic
agatgcatgtgacacaagctgtgaagtaatgatacccaaaggcactggtgacatcctagttgactgttcaggtgg

SEQ ID NO: 49143 - DNA, 75 bp, Artificial Sequence
  Synthetic
ccagagttgatgccagaaaactgcctcttttctaacgaagaatttaacgagttgattaagttgaagaaactcctc

SEQ ID NO: 49144 - DNA, 75 bp, Artificial Sequence
  Synthetic
gtaatgatacccaaaggcactggtgacatcctagttgactgttcaggtgggcagcaacattttctgaaagacaat

SEQ ID NO: 49145 - DNA, 75 bp, Artificial Sequence
  Synthetic
gaagcaggttgtatttgatgcagagagcgagcctagattgcagtgggggcatggctgcttgtccattgtttatga

SEQ ID NO: 49146 - DNA, 75 bp, Artificial Sequence
  Synthetic
tctcctcaactcattgacactgctccactgtttcttaaaacatgctcctagtgatgccataatggaggtagagag

SEQ ID NO: 49147 - DNA, 75 bp, Artificial Sequence
  Synthetic
gatccaatctgtactgtgtattctgatagcaggatattacaggtcatttggaggggaaggaaccgagaaacaggt

SEQ ID NO: 49148 - DNA, 75 bp, Artificial Sequence
  Synthetic
ttttacttgttaataattgttggaacactaggaaaaaggctcaagcagtacagagagttaaaacctcagacctgc

SEQ ID NO: 49149 - DNA, 75 bp, Artificial Sequence
  Synthetic
cagacgggcttgctaggcatgtgacacagtgccctaagcggaaggaaaaagtggaggaaactgaattgtacttga

SEQ ID NO: 49150 - DNA, 75 bp, Artificial Sequence
  Synthetic
gctgttcacggtttcattgtcaccggttcagtcagcgcccattagtcatgggaagacagttgaggcataccaggc

SEQ ID NO: 49151 - DNA, 75 bp, Artificial Sequence
  Synthetic
ctctttgtgctgggaagtatcctgtttttagtctcttgtctaatgaaaggactggttgacagtgtcggcaacacc

SEQ ID NO: 49152 - DNA, 75 bp, Artificial Sequence
  Synthetic
ttttagtctcttgtctaatgaaaggactggttgacagtgtcggcaacaccttcttccctggactgtccatttgca

SEQ ID NO: 49153 - DNA, 75 bp, Artificial Sequence
  Synthetic
tggactactcaaatgatagccaacagcaattttaacgtctgtaagactaacgggaaggagtactggagaaaggct

SEQ ID NO: 49154 - DNA, 75 bp, Artificial Sequence
  Synthetic
agttttttttatggtctaaagaacatgcttagtggcatttttggaaatgtttttataggtattttcttgttcctt

SEQ ID NO: 49155 - DNA, 75 bp, Artificial Sequence
  Synthetic
tgctattgcagcttgttttgttgcccatactgtagacactgctctgctaataaagaaattcatcagctgcacttg

SEQ ID NO: 49156 - DNA, 75 bp, Artificial Sequence
  Synthetic
taaagaaattcatcagctgcacttgagcatctgcaaaaaaaggaaaacaggaagcaatgtcatgctggctgtctg

SEQ ID NO: 49157 - DNA, 75 bp, Artificial Sequence
  Synthetic
cagtgatacagagtcaccttaaagtctttgaaaatgagttcaccaacttaaatcttcaattctctgatccgaaca

SEQ ID NO: 49158 - DNA, 75 bp, Artificial Sequence
  Synthetic
ttatccgtagcatcatcaacaccacttttgttttatgcatactgatactagcagtttgtgttgttagcacctcag

SEQ ID NO: 49159 - DNA, 75 bp, Artificial Sequence
  Synthetic
gcaaaccgtgcagtaattgtcaagaccaaattgttttcagcaactgaacaagttcgactatccaacaaccctgca

SEQ ID NO: 49160 - DNA, 75 bp, Artificial Sequence
  Synthetic
cggaacctgggagagagaagaagacctaacaaatttctgtcatcaggaatgccaagttacggatactgaatgcct

SEQ ID NO: 49161 - DNA, 75 bp, Artificial Sequence
  Synthetic
attacactgaccaatgctgttattcatgctgacatctttagttgcatcactactacattatcatcacaatatact

SEQ ID NO: 49162 - DNA, 75 bp, Artificial Sequence
  Synthetic
tagttaaaggcatgaaaaatttgctaaactcaacaagtttggagacaagtttatcaattgaggcaccatggggag

SEQ ID NO: 49163 - DNA, 75 bp, Artificial Sequence
  Synthetic
ttatcaattgaggcaccatggggagcaataaatgttcagtcaacctacaaaccaactgtatcaactgcaaacata

SEQ ID NO: 49164 - DNA, 75 bp, Artificial Sequence
  Synthetic
accaactgtatcaactgcaaacatagcgcttagttggagctcagtagaacacagaggcaataagatactggtttc

SEQ ID NO: 49165 - DNA, 75 bp, Artificial Sequence
  Synthetic
agcctggtgatgggaactgcttctatcacagcatagctgagttaaccatgcccaacaaaacagatcactcatatc

SEQ ID NO: 49166 - DNA, 75 bp, Artificial Sequence
  Synthetic
taactggtccactttgcaaacctaccagtcctctatttctcaaccatttatttcggtttcatcattgttattctt

SEQ ID NO: 49167 - DNA, 75 bp, Artificial Sequence
  Synthetic
tctcaaagatatcaatcccccctttacccacgttgacacagatagctttagtagtgctttcttgcctttgttgga

SEQ ID NO: 49168 - DNA, 75 bp, Artificial Sequence
  Synthetic
tcaactctagaggcatctatgttggctaaagaaatgggcattaccatcatcatttggactgttgctgccagtgat

SEQ ID NO: 49169 - DNA, 75 bp, Artificial Sequence
  Synthetic
gtagtgctttcttgcctttgttggaccatggaacttttgaaaaaccttaactggactcaggtgattgctggtcaa

SEQ ID NO: 49170 - DNA, 75 bp, Artificial Sequence
  Synthetic
ctggactcaggtgattgctggtcaatatgttaccaaccctaggtttaacatctccgactactttgagattgtgcg

SEQ ID NO: 49171 - DNA, 75 bp, Artificial Sequence
  Synthetic
aaagcaacttgtacgggtgattgcccagaaagatgtggctgcacatcatcaacctgcttacataaagaatggccc

SEQ ID NO: 49172 - DNA, 75 bp, Artificial Sequence
  Synthetic
aacatgccggtagttcagatgattacgcaaaatgtatagtggtgactggtatactgtccaaagagctctactccc

SEQ ID NO: 49173 - DNA, 75 bp, Artificial Sequence
  Synthetic
tggctgcacctgttgtggattagacgtgaaagacctctttacagattatatgtttgtcaagtggaaaattgaata

SEQ ID NO: 49174 - DNA, 75 bp, Artificial Sequence
  Synthetic
tgcccaacaaaacagaccactcctaccacaacatcaagcgtctaactgaagcagcagcacggaaatattaccaag

SEQ ID NO: 49175 - DNA, 75 bp, Artificial Sequence
  Synthetic
ccacaacatcaagcgtctaactgaagcagcagcacggaaatattaccaagaagagcctgaagccaagcttattgg

SEQ ID NO: 49176 - DNA, 75 bp, Artificial Sequence
  Synthetic
acatacagcagcagatctggagaatccattggaatcttcattgcagggaaattgcacatccatctctcatctgag

SEQ ID NO: 49177 - DNA, 75 bp, Artificial Sequence
  Synthetic
gatcaactcttgaggcatccatgctggctaaggaaatgggtgttaccatcattatatggactgttgctgctagtg

SEQ ID NO: 49178 - DNA, 75 bp, Artificial Sequence
  Synthetic
aagatttgctagaccatctggatgttggtggacttttgagagctgctttccctggaacaggaatagaaaggcata

SEQ ID NO: 49179 - DNA, 75 bp, Artificial Sequence
  Synthetic
taacccctgctgtgattaaattcatgttcactggactgataaacagctctgtaacctctcctcagagtttgatgc

SEQ ID NO: 49180 - DNA, 75 bp, Artificial Sequence
  Synthetic
atcacattgtcagaaccaagaaacatccagcaaaagctcccttctgaaataatcacactgcatcccaggattgag

SEQ ID NO: 49181 - DNA, 75 bp, Artificial Sequence
  Synthetic
gtgaatcttctacattctgggcagacgcactttgatgcacttagaatactgccacagtttgaggccgacacaaaa

SEQ ID NO: 49182 - DNA, 75 bp, Artificial Sequence
  Synthetic
cgcactttgatgcacttagaatactgccacagtttgaggccgacacaaaagagaccttaagtctggtggacaggg

SEQ ID NO: 49183 - DNA, 75 bp, Artificial Sequence
  Synthetic
gccacagtttgaggccgacacaaaagagaccttaagtctggtggacagggtcatggctgtggaccaattaacatc

SEQ ID NO: 49184 - DNA, 75 bp, Artificial Sequence
  Synthetic
gcgctatcagtcatacctgatagcagcaacccccgattacttaagtttgtgcccctcaaaaaaggtctagcagtg

SEQ ID NO: 49185 - DNA, 75 bp, Artificial Sequence
  Synthetic
gttcataaaattgagccacacttcaatacttcttggatgtcctgggatggttgtgatctagactattattgcaac

SEQ ID NO: 49186 - DNA, 75 bp, Artificial Sequence
  Synthetic
caggttcagaagagccttatagaaagtctagtctagatgaggttactttgtccaaaaagcaggcagaaatactta

SEQ ID NO: 49187 - DNA, 75 bp, Artificial Sequence
  Synthetic
tgcttcatttgtaaacctgctcaacattgaaactgattacacaaaaaacttccactttcactctaaaagggtcac

SEQ ID NO: 49188 - DNA, 75 bp, Artificial Sequence
  Synthetic
ccaaccagagttggcagggtcctggactgcatgtttaactgcaaattgtgtgttgagatttctgccgacaccttg

SEQ ID NO: 49189 - DNA, 75 bp, Artificial Sequence
  Synthetic
gatcttaaggcaagaccaacctatggtgcaggtgagatcactgtattggtggaagttgctgacatggagttacac

SEQ ID NO: 49190 - DNA, 75 bp, Artificial Sequence
  Synthetic
gcagctaggacataaattgctaacacgggacaagcagatcaagcaggaattttccagaatgaagctttacgtcac

SEQ ID NO: 49191 - DNA, 75 bp, Artificial Sequence
  Synthetic
tttccagaatgaagctttacgtcacaaaggatctgcttgaccatctggatgttggtgggttattgagggcagcct

SEQ ID NO: 49192 - DNA, 75 bp, Artificial Sequence
  Synthetic
tataaaagacaatcttgagcaaggtgtggaagaggagattgagttttgcaacaacttgactaagactgtttcaga

SEQ ID NO: 49193 - DNA, 75 bp, Artificial Sequence
  Synthetic
atactagacatttgcactgtatcacttggtgttatgttgtcaacattcctttatggctctaataacaagaataaa

SEQ ID NO: 49194 - DNA, 75 bp, Artificial Sequence
  Synthetic
ttggtgttatgttgtcaacattcctttatggctctaataacaagaataaaaagaagtttatcactaactgtctgc

SEQ ID NO: 49195 - DNA, 75 bp, Artificial Sequence
  Synthetic
caaaaatgtgttaacacaaaacttgagcagccacagagcattttgatcgaacataagggtactataatcgggaag

SEQ ID NO: 49196 - DNA, 75 bp, Artificial Sequence
  Synthetic
taacattgacagaaacacggtgaaaagtgaacttttatggaaatttacgttagacaccaatgtaagcaccacaag

SEQ ID NO: 49197 - DNA, 75 bp, Artificial Sequence
  Synthetic
gggaatgagcttttgtacaagtcgcccagaaaggctctggcaaccgtttgcagtgctttgtttgggaagcaggtg

SEQ ID NO: 49198 - DNA, 75 bp, Artificial Sequence
  Synthetic
ccagaaaggctctggcaaccgtttgcagtgctttgtttgggaagcaggtgaccaagctccagaactgtttcagaa

SEQ ID NO: 49199 - DNA, 75 bp, Artificial Sequence
  Synthetic
gagttttttttacggcctaaagaacatgctcagtggcatttttggcaatgtatttataggcattttcttatttct

SEQ ID NO: 49200 - DNA, 75 bp, Artificial Sequence
  Synthetic
ctcagtgtgcaggattacaatggcatgatagaaaatatgtctaagttagacaacactgatgttgagtttaaccac

SEQ ID NO: 49201 - DNA, 75 bp, Artificial Sequence
  Synthetic
gattggctggtggaattaaggagctttcacttccaatatacacgatattcatgaaatcttatttttttaaagaca

SEQ ID NO: 49202 - DNA, 75 bp, Artificial Sequence
  Synthetic
caacactgatgttgagtttaaccacagggagatagccgacctgaatcagttaacttctcgacttagtacgctaag

SEQ ID NO: 49203 - DNA, 75 bp, Artificial Sequence
  Synthetic
aaagtgagtgcagtaagagagatggtcctagatgctcctttgcagcactattaagtctaatccatgaggattggc

SEQ ID NO: 49204 - DNA, 75 bp, Artificial Sequence
  Synthetic
atggtccaccaagcacagcacaaactatcgtgatagttgtggaaagcagctaacaggtagaataattaccaagta

SEQ ID NO: 49205 - DNA, 75 bp, Artificial Sequence
  Synthetic
tcacccgcagaagcacaagaaacattacaaatgcagaggaatttgttatttctgaattctttaagaaaaaggata

SEQ ID NO: 49206 - DNA, 75 bp, Artificial Sequence
  Synthetic
tactcactggttggacacctttctaggctgctctgtgtccatcaacaggcatactacagttaaagagccttcctt

SEQ ID NO: 49207 - DNA, 75 bp, Artificial Sequence
  Synthetic
atagaagaattgccgaactgttctctacaaaaacacacattggctagaccagctaaaaaggcctaaaataatgtc

SEQ ID NO: 49208 - DNA, 75 bp, Artificial Sequence
  Synthetic
cactacattatcatcacaatatactgcatctaaactgcttcattgtatctgcaaacagactctatgatgcttgaa

SEQ ID NO: 49209 - DNA, 75 bp, Artificial Sequence
  Synthetic
tccgtgaactgcaaaatggggaactttgaagggcaggagtgctttgagttcactattctgaaggacaatagcgca

SEQ ID NO: 49210 - DNA, 75 bp, Artificial Sequence
  Synthetic
ggattgacactgcccaccggtttggaacaggcaatgcgcaaaggattggtcgaaggtgtggtcatctctaaggaa

SEQ ID NO: 49211 - DNA, 75 bp, Artificial Sequence
  Synthetic
cagctcttaatagagatcaagaggctttacgccctacaggaagattctgaggtagagcctatagccataatttgt

SEQ ID NO: 49212 - DNA, 75 bp, Artificial Sequence
  Synthetic
acccaccttgacacagagagctccagtagtagtccttgtctttgcaagaccatggatttcttgaggaaccttgac

SEQ ID NO: 49213 - DNA, 75 bp, Artificial Sequence
  Synthetic
tgaaagagaatttggaccgaataactgatgaattcgagcgaacaaagtttaaacatgaactcacacagaatatta

SEQ ID NO: 49214 - DNA, 75 bp, Artificial Sequence
  Synthetic
ctgtgcaaaagagtgtgaggtcctctttgacgacataagaaactctccaacgcacagcacagcctggaaacatgc

SEQ ID NO: 49215 - DNA, 75 bp, Artificial Sequence
  Synthetic
gcaaacagactctatgatgcttgaaactacctctgctctatttaccctgacttaaatcttgactgcgtgccgcca

SEQ ID NO: 49216 - DNA, 75 bp, Artificial Sequence
  Synthetic
tttgacgacataagaaactctccaacgcacagcacagcctggaaacatgccctccgattgaaggggactgcatat

SEQ ID NO: 49217 - DNA, 75 bp, Artificial Sequence
  Synthetic
gtagtagtccttgtctttgcaagaccatggatttcttgaggaaccttgactggactcaagtgattgctggtcaat

SEQ ID NO: 49218 - DNA, 75 bp, Artificial Sequence
  Synthetic
caaaccttgttccctgacaaattcgaagatttcttggatcgaactcagctacacccagaattcagagacttaaca

SEQ ID NO: 49219 - DNA, 75 bp, Artificial Sequence
  Synthetic
tttctacatgctgaaaggtaacttgatgaacacagagccaacagttgctgagcttgtcagctatggtataaagga

SEQ ID NO: 49220 - DNA, 75 bp, Artificial Sequence
  Synthetic
ttaaagccttcaaacaagctaactactctgcattctcctcaatcaactcaattgcttcaactgatctattttact

SEQ ID NO: 49221 - DNA, 75 bp, Artificial Sequence
  Synthetic
tagcgttgagaatgtgcaaatctccattgatgtaacattgcctgagtctgtggaagcagtgccggtgacagaaag

SEQ ID NO: 49222 - DNA, 75 bp, Artificial Sequence
  Synthetic
actagctcatcgatcctctctttcttagctattcatttcagcttcatcatcatcgttattatcttggggtgtggg

SEQ ID NO: 49223 - DNA, 75 bp, Artificial Sequence
  Synthetic
tcacagtgttctcttgagttttggcaaaatggagaataaaatcgaagtgactagcaaggatgaaatgaacaggtg

SEQ ID NO: 49224 - DNA, 75 bp, Artificial Sequence
  Synthetic
agcatatcatggaaaacttcacacgacttatgcatggagggaaaccttcagcaatgaaaagaaatgcagaaccga

SEQ ID NO: 49225 - DNA, 75 bp, Artificial Sequence
  Synthetic
ctagcaaggatgaaatgaacaggtggtttgaggagttcaagaagagtaatggacttgtggacacctttacaaatt

SEQ ID NO: 49226 - DNA, 75 bp, Artificial Sequence
  Synthetic
gtttgaggagttcaagaagagtaatggacttgtggacacctttacaaattcttactccttttgtgagagtgtccc

SEQ ID NO: 49227 - DNA, 75 bp, Artificial Sequence
  Synthetic
atggctttcaaagattatggagaaaggggcatagttgaggagaatcatatgatatttagcgaagaagatcaacta

SEQ ID NO: 49228 - DNA, 75 bp, Artificial Sequence
  Synthetic
ggggcatagttgaggagaatcatatgatatttagcgaagaagatcaactagaaacgaggcagctactgttagtag

SEQ ID NO: 49229 - DNA, 75 bp, Artificial Sequence
  Synthetic
tcttccagtgatgaactgcaagattatgaagaccttgccttggcactcacaagtgcagaagaatcgtatagacgg

SEQ ID NO: 49230 - DNA, 75 bp, Artificial Sequence
  Synthetic
gcaaaaggcatctcagttgtctaaactggtcaacaaaagccagaacataccgaccagagtcggcagggtcttgga

SEQ ID NO: 49231 - DNA, 75 bp, Artificial Sequence
  Synthetic
aaatggaaagacatactgaaactgttggagctgctagggataaagtgctcattcattgcttgtgcagactgctcg

SEQ ID NO: 49232 - DNA, 75 bp, Artificial Sequence
  Synthetic
attcattgcttgtgcagactgctcgtccacaccaccggacaggtggtggattacagaagatagggtgcgagtctt

SEQ ID NO: 49233 - DNA, 75 bp, Artificial Sequence
  Synthetic
caactggggcataagctgctgacacgagataaacaaatcaagcaggagttctctagaatgaaactctacgtcact

SEQ ID NO: 49234 - DNA, 75 bp, Artificial Sequence
  Synthetic
cagaggtgactgatatagttgttggagccataagtacccaaaaggttagaagttatctaaaagctggaactgcaa

SEQ ID NO: 49235 - DNA, 75 bp, Artificial Sequence
  Synthetic
caaagacccctgtgtcaacaaaggatgttttagaaacctgggaaaagatgaaagaacacatactcaatagaccca

SEQ ID NO: 49236 - DNA, 75 bp, Artificial Sequence
  Synthetic
tactggacatctgcactgtatcacttggtgtcatgctgtcaacattcttgtatggctccaacaataaaaacaaga

SEQ ID NO: 49237 - DNA, 75 bp, Artificial Sequence
  Synthetic
gtcgaaggtgtggtaatttcaaaagaaggttctgagtcatgtataaatatgctaaaagagaatttggaccgaata

SEQ ID NO: 49238 - DNA, 75 bp, Artificial Sequence
  Synthetic
cgctcagggatagcgcttgtcgcaacgggtcttgccaagcttgcagaaactgaagggaaaggagtgtttgatgaa

SEQ ID NO: 49239 - DNA, 75 bp, Artificial Sequence
  Synthetic
cgggtcttgccaagcttgcagaaactgaagggaaaggagtgtttgatgaagccaaaaaaactgtagaggccctta

SEQ ID NO: 49240 - DNA, 75 bp, Artificial Sequence
  Synthetic
gtgtacaaggttcttggtaacctaggaaatgaactgttgtacaaggcacccagaaaggccttagcaactgtctgt

SEQ ID NO: 49241 - DNA, 75 bp, Artificial Sequence
  Synthetic
caccactagtgagaaaatgctattgagttggttgagtgaagacataaagtcaacaagatgtgatgagtgtcttgc

SEQ ID NO: 49242 - DNA, 75 bp, Artificial Sequence
  Synthetic
agttggttgagtgaagacataaagtcaacaagatgtgatgagtgtcttgccaccataaagaagactattgatgaa

SEQ ID NO: 49243 - DNA, 75 bp, Artificial Sequence
  Synthetic
gatagaaaatatgtctaaattagacaacactgatgttgaattcaaccacagggagatagctgatctcaatcaatt

SEQ ID NO: 49244 - DNA, 75 bp, Artificial Sequence
  Synthetic
taccagccattgcgaaaactgtcatcctaacggtattagcattagcaacacatctaatgttggcaagaggtgccc

SEQ ID NO: 49245 - DNA, 75 bp, Artificial Sequence
  Synthetic
cctaacggtattagcattagcaacacatctaatgttggcaagaggtgccctaaattagaggtagtcagtcattgt

SEQ ID NO: 49246 - DNA, 75 bp, Artificial Sequence
  Synthetic
agcactccaatgaagtggggaaagaaactctatgaactctttgctgatgattctttccaggagaacagaatctat

SEQ ID NO: 49247 - DNA, 75 bp, Artificial Sequence
  Synthetic
gcttgttagactcacactaccagggaaaactgagaaagaaagaaggatcaagcgcaatgtggagtacctaataaa

SEQ ID NO: 49248 - DNA, 75 bp, Artificial Sequence
  Synthetic
tacccgcagaagcaccaggaatgttgcaaacgcagaagaatttatcatatccgagttctttaagaagaaggacat

SEQ ID NO: 49249 - DNA, 75 bp, Artificial Sequence
  Synthetic
atgcaccccgctgtgttaacagccggcagaatcagtgagatgggtgtctgcttcggaaccatccctgtagctaac

SEQ ID NO: 49250 - DNA, 75 bp, Artificial Sequence
  Synthetic
aaaactgagaaagaaagaaggatcaagcgcaatgtggagtacctaataaaattgatgatgagcatgtcaggcatc

SEQ ID NO: 49251 - DNA, 75 bp, Artificial Sequence
  Synthetic
gcaaacgcagaagaatttatcatatccgagttctttaagaagaaggacattatgaagttcatcagcacatcaggc

SEQ ID NO: 49252 - DNA, 75 bp, Artificial Sequence
  Synthetic
tgcaaaacacagcaatgaaagcttgagagatagaagtgatgatgaccagagacttgctgagaagatagataccgt

SEQ ID NO: 49253 - DNA, 75 bp, Artificial Sequence
  Synthetic
tagaaaagagctttcagaagctaaactgaaagactattctacttatgcaagaggtgtgatctcaaattcgcttaa

SEQ ID NO: 49254 - DNA, 75 bp, Artificial Sequence
  Synthetic
ctcttgttggaaagcagtctcctttccagaatgcctacaacgtcaaaggcaacgccaccagtgctaacattatct

SEQ ID NO: 49255 - DNA, 75 bp, Artificial Sequence
  Synthetic
gttgtttgctatattgcctcctgactgtgcaagagagtgtgaagtcctcttcgatgacataagaaactctccaac

SEQ ID NO: 49256 - DNA, 75 bp, Artificial Sequence
  Synthetic
ttgaaaagattctatttgatctgaaagtgcctactaaggatgaggaagtactaataaacatcagaaattctctaa

SEQ ID NO: 49257 - DNA, 75 bp, Artificial Sequence
  Synthetic
agtgcctactaaggatgaggaagtactaataaacatcagaaattctctaaaggctagatctgagttcgttagaaa

SEQ ID NO: 49258 - DNA, 75 bp, Artificial Sequence
  Synthetic
attttttcctctaattgcttcaatcaatcgctttttttatccagctttgcttactttgcttttctttcttaatta

SEQ ID NO: 49259 - DNA, 75 bp, Artificial Sequence
  Synthetic
ctggcagtacattccagaagatattaaaccaagcctgaccatgttaatacagactttgtttcctgacaagtttga

SEQ ID NO: 49260 - DNA, 75 bp, Artificial Sequence
  Synthetic
tttgcagcactgttaagcctagttcatgaggattggcagaggataggtaaaaacattcttgttcgtgcaaacaat

SEQ ID NO: 49261 - DNA, 75 bp, Artificial Sequence
  Synthetic
atactcaatccctcaagttgatgaaaaacaagcagcctataccctttcaggctgactgcatactatttaaagaag

SEQ ID NO: 49262 - DNA, 75 bp, Artificial Sequence
  Synthetic
aaacaagcagcctataccctttcaggctgactgcatactatttaaagaagtagcggctgaatgcatgaagaggta

SEQ ID NO: 49263 - DNA, 75 bp, Artificial Sequence
  Synthetic
tatcaaaaagatgatgaagaattgacaaatagctcaagtttaaaacttgggtttttagtgaaatatgctgtcacc

SEQ ID NO: 49264 - DNA, 75 bp, Artificial Sequence
  Synthetic
acacgatgttctgccttaagctcgtgctgctaatcaatcttgccctttgtcagcttcttgaaggcaatgatagag

SEQ ID NO: 49265 - DNA, 75 bp, Artificial Sequence
  Synthetic
atttcaactattctgaatagtacaactcctgcaccaggaccatcaacagatactaccatggagacagttccaagc

SEQ ID NO: 49266 - DNA, 75 bp, Artificial Sequence
  Synthetic
acgtattaacaagattcacttggtttcaagatgtcgtactctacggtaaaatatgtgagacgtttcttaggtgct

SEQ ID NO: 49267 - DNA, 75 bp, Artificial Sequence
  Synthetic
agtgtcgaaaatgtgcaaatctccattgatgcaacgttgcctgaatctgtggaggcagtgccggtgacagaaaga

SEQ ID NO: 49268 - DNA, 75 bp, Artificial Sequence
  Synthetic
ctcctgcaccaggaccatcaacagatactaccatggagacagttccaagcacggccgacagcatgctggaaacac

SEQ ID NO: 49269 - DNA, 75 bp, Artificial Sequence
  Synthetic
gcacagagttcaatagatcaggagttaaattagtgaaggtaagacactgtgacatcaacttgtcagttaaactgc

SEQ ID NO: 49270 - DNA, 75 bp, Artificial Sequence
  Synthetic
aagatgtttcctcttcctgagactccgctaagtgaggtgcattcaatagagcgtataatggacaattttacccgc

SEQ ID NO: 49271 - DNA, 75 bp, Artificial Sequence
  Synthetic
accggagaagcaacatcctctaccactgctgccactgtcagtatgcaggaaacaaaaacacacatgactcagaac

SEQ ID NO: 49272 - DNA, 75 bp, Artificial Sequence
  Synthetic
ctgctgccactgtcagtatgcaggaaacaaaaacacacatgactcagaacacaagatccacagcagacccagaca

SEQ ID NO: 49273 - DNA, 75 bp, Artificial Sequence
  Synthetic
cactaaattatgagcaccgcttctatgcagttttagcacctaaagcacaactaggaggagcaagagatttgttag

SEQ ID NO: 49274 - DNA, 75 bp, Artificial Sequence
  Synthetic
gagctcttgcaagggcctttctacctgaacagaagacaagccgttcttggttcttcatacctttatattgtcatc

SEQ ID NO: 49275 - DNA, 75 bp, Artificial Sequence
  Synthetic
agaacagggcagccagcagagcaccactgaacacgagagctccagcatctctgctttcaaagattacggagagag

SEQ ID NO: 49276 - DNA, 75 bp, Artificial Sequence
  Synthetic
acgtcaccgatcctacaagcaactccaacacccggccacggcaaggcacctacactgccgaacacacaccatctc

SEQ ID NO: 49277 - DNA, 75 bp, Artificial Sequence
  Synthetic
agtacaggtgtctagaagtcataaacagtatgaacgagaagacactgcaggacatcgagaatcactccatgacct

SEQ ID NO: 49278 - DNA, 75 bp, Artificial Sequence
  Synthetic
aaacaaggcagctgttgttggtggaagttggttttcaaactgatatcgatgggaaaataaggacagaccacaaga

SEQ ID NO: 49279 - DNA, 75 bp, Artificial Sequence
  Synthetic
caacacccggccacggcaaggcacctacactgccgaacacacaccatctctccagaagtcttctttcagctgtaa

SEQ ID NO: 49280 - DNA, 75 bp, Artificial Sequence
  Synthetic
ggagctactgggaatcaaatgctcattcatcgcctgtgcagactgctcatctacaccaccagacaggtggtggat

SEQ ID NO: 49281 - DNA, 75 bp, Artificial Sequence
  Synthetic
tcagccccaagcagctcatcgacagctgagaacaacacgatgtttcaaccagctcaagacaccaccaccagtggt

SEQ ID NO: 49282 - DNA, 75 bp, Artificial Sequence
  Synthetic
ctgagaacaacacgatgtttcaaccagctcaagacaccaccaccagtggtgtttcggaacagtacaacccaacaa

SEQ ID NO: 49283 - DNA, 75 bp, Artificial Sequence
  Synthetic
atctggtctatggtttcctcataaaggacaacctattagccaattcccaacaacagaacaaacaactccagatgc

SEQ ID NO: 49284 - DNA, 75 bp, Artificial Sequence
  Synthetic
gtaccagtgactacacctgtcaccacaacctttacacctataaacccaacgaatagatccaagagggagtctaaa

SEQ ID NO: 49285 - DNA, 75 bp, Artificial Sequence
  Synthetic
gctataagtactcaaaaggttagaagttatctaaaggcaggcactgcaacaaaaacccccgtgtcgacaaaagac

SEQ ID NO: 49286 - DNA, 75 bp, Artificial Sequence
  Synthetic
ctggggaaaaagttttccacaagttgtagaagaattgaagacaacatcgcaagactttatctacagacgtcaata

SEQ ID NO: 49287 - DNA, 75 bp, Artificial Sequence
  Synthetic
gtgcaaataattttaacctttcctcaaggtctgaagaagtactacagcaaaatattgaaactcctacacttaact

SEQ ID NO: 49288 - DNA, 75 bp, Artificial Sequence
  Synthetic
gtagaagaattgaagacaacatcgcaagactttatctacagacgtcaatatactgctcagttagagacgtggagg

SEQ ID NO: 49289 - DNA, 75 bp, Artificial Sequence
  Synthetic
aggaacacatactcaacaggccaacaggactgacactgcccaccggtctggaacaggcaatgcgcaaaggactgg

SEQ ID NO: 49290 - DNA, 75 bp, Artificial Sequence
  Synthetic
ccttgcttcacagtctatggcacctttgttaacagtgacagacaattgatctttgacatttacaatgtgcacata

SEQ ID NO: 49291 - DNA, 75 bp, Artificial Sequence
  Synthetic
ctgaaagaaaacttggaccgaataactgatgaattcgagcgaacaaaatttaaacatgagcttacacagaacatc

SEQ ID NO: 49292 - DNA, 75 bp, Artificial Sequence
  Synthetic
tgtacttcagttcaagttgcatgacactcctaccaccactgttccggccctggccgcctcatctacagccatgcc

SEQ ID NO: 49293 - DNA, 75 bp, Artificial Sequence
  Synthetic
actacaagtgaaaagatgctattgagttggttaagtgaggacatcaaatcatcgaggtgtggtgagtgcctcaca

SEQ ID NO: 49294 - DNA, 75 bp, Artificial Sequence
  Synthetic
ttgttaacagtgacagacaattgatctttgacatttacaatgtgcacatatacaacaaggaaatggacaactttg

SEQ ID NO: 49295 - DNA, 75 bp, Artificial Sequence
  Synthetic
tgggagcttgatctgatgaattcactctgttctgatgagaaaagagatgctagaaatgcaaggcttctactgggt

SEQ ID NO: 49296 - DNA, 75 bp, Artificial Sequence
  Synthetic
gctgcttgcttataatctgcaactcactaatcactgcagcaactgtcaccccaatggtgtaaacattagtaacac

SEQ ID NO: 49297 - DNA, 75 bp, Artificial Sequence
  Synthetic
tagaaatgcaaggcttctactgggttgcccaaatgtaaggaaagcagcaaacaaagaagggaagaggctactaaa

SEQ ID NO: 49298 - DNA, 75 bp, Artificial Sequence
  Synthetic
ataaacttgaaggtatcaactgacaaggaacatagcgagcttgagatcaatgtgctcatacctcaggttgctgtt

SEQ ID NO: 49299 - DNA, 75 bp, Artificial Sequence
  Synthetic
cagacaggagatcttacagttcaagcaaaagcagaatccgcagcatttttggaagatacaattctcagaaaaaac

SEQ ID NO: 49300 - DNA, 75 bp, Artificial Sequence
  Synthetic
caaaagcagaatccgcagcatttttggaagatacaattctcagaaaaaaccatttgaactgaggtcaggccttga

SEQ ID NO: 49301 - DNA, 75 bp, Artificial Sequence
  Synthetic
cctagacactgacggagcaatacgcctcccgaaagtcgcatacaacggggtttttatgccagggacttacaaaat

SEQ ID NO: 49302 - DNA, 75 bp, Artificial Sequence
  Synthetic
gtcaattttctgagtacacgcccaacaaagatagtgttttaaaagactgccttcaaattatacggaaaaacccta

SEQ ID NO: 49303 - DNA, 75 bp, Artificial Sequence
  Synthetic
caaagatagtgttttaaaagactgccttcaaattatacggaaaaaccctagccatacaatgggatccttcgaatt

SEQ ID NO: 49304 - DNA, 75 bp, Artificial Sequence
  Synthetic
tagataaggcaagaagagatccaaagaactgggttagcatctctgaggtgacagaaacaacaagtatagttgcat

SEQ ID NO: 49305 - DNA, 75 bp, Artificial Sequence
  Synthetic
gaactgggttagcatctctgaggtgacagaaacaacaagtatagttgcatcacctaaaacacatatgatgttgaa

SEQ ID NO: 49306 - DNA, 75 bp, Artificial Sequence
  Synthetic
aacctctcaaggcaaggtaaatcaaagtgttctgtgccaagatcttggctcgaaaagatactgtttgacttaaag

SEQ ID NO: 49307 - DNA, 75 bp, Artificial Sequence
  Synthetic
gaaaaaataacaatctgcaacggctccacaatcgtggaccaaaggcttggtagcgaactaggttgctacacaatt

SEQ ID NO: 49308 - DNA, 75 bp, Artificial Sequence
  Synthetic
tgcttcgaggtaagctaaaaaaactcggtgccgtctcaacaaatatagaaatcgggaaaagagactgcttggatc

SEQ ID NO: 49309 - DNA, 75 bp, Artificial Sequence
  Synthetic
cggtgccgtctcaacaaatatagaaatcgggaaaagagactgcttggatctgcttagtactgtggatggtctaac

SEQ ID NO: 49310 - DNA, 75 bp, Artificial Sequence
  Synthetic
aaatgcaaacaagggttctgcctcaaagtaacccaagagggcaggggccatgtgaaactatctagaggaacggaa

SEQ ID NO: 49311 - DNA, 75 bp, Artificial Sequence
  Synthetic
tgtccttttaccactggaaagaattgatcaagaaaaacatagatgaagttttgctcacagaggatggaaacctga

SEQ ID NO: 49312 - DNA, 75 bp, Artificial Sequence
  Synthetic
gatcaagaaaaacatagatgaagttttgctcacagaggatggaaacctgatcttctgctggttaaaaacaatatc

SEQ ID NO: 49313 - DNA, 75 bp, Artificial Sequence
  Synthetic
attggtacaccttatgaaggaattgtagacaccttagtttccttgattaatgtgttgacaaggtttacttggttt

SEQ ID NO: 49314 - DNA, 75 bp, Artificial Sequence
  Synthetic
cactggagacatattggtggactgctcaggaggacagcagcacttcttgcaggacaacttgattgacttaggttg

SEQ ID NO: 49315 - DNA, 75 bp, Artificial Sequence
  Synthetic
tcaggaggacagcagcacttcttgcaggacaacttgattgacttaggttgcccaaatgtaccattactaggcaag

SEQ ID NO: 49316 - DNA, 75 bp, Artificial Sequence
  Synthetic
attctccagaactgatgccagaaaactgtctcttttctaatgaggagtttaacgagctgatcaagttaaaaaagc

SEQ ID NO: 49317 - DNA, 75 bp, Artificial Sequence
  Synthetic
ttttttgttctggttcagttttggctatgtcatcacatgcgtagtatgcaaagtgctcttctatctgctaattgt

SEQ ID NO: 49318 - DNA, 75 bp, Artificial Sequence
  Synthetic
atatcttcctgggtcaagtgcataacagcatgtaaggattttgcaaacatcaatgaaaaagttcaaaagttcatt

SEQ ID NO: 49319 - DNA, 75 bp, Artificial Sequence
  Synthetic
agctcttacaggggcctttctatttgaacagaagacaagctgtccttggttcttcatacctttacattgtcatta

SEQ ID NO: 49320 - DNA, 75 bp, Artificial Sequence
  Synthetic
tatgtcatcacatgcgtagtatgcaaagtgctcttctatctgctaattgtcatcgggacactaggaaagaaactt

SEQ ID NO: 49321 - DNA, 75 bp, Artificial Sequence
  Synthetic
tcttcatacctttacattgtcattacactttatatacaagtgctacagcagtataggtgcctggaagtcataaac

SEQ ID NO: 49322 - DNA, 75 bp, Artificial Sequence
  Synthetic
gtcaaagctcaaacaagaacaccccagtgttagcttcactaaggaagaggtcctgataaaaagattggagaaaaa

SEQ ID NO: 49323 - DNA, 75 bp, Artificial Sequence
  Synthetic
ccctgtcaatgcaatagatgctgaaatgcacgagctcaattgcaattacaatatatgcccatactgtgcgtccag

SEQ ID NO: 49324 - DNA, 75 bp, Artificial Sequence
  Synthetic
agtgttagcttcactaaggaagaggtcctgataaaaagattggagaaaaacttcctcaagcagcacaatcaggaa

SEQ ID NO: 49325 - DNA, 75 bp, Artificial Sequence
  Synthetic
actagaggactctttcaaagaactcacttctgcacttgaaggtaggtttgaagaatcttataagatacgaacctc

SEQ ID NO: 49326 - DNA, 75 bp, Artificial Sequence
  Synthetic
actgacttcagatggactagttagacatgtgactcaatgtcccaaaaggaaggaaaaggtcgaggagactgagct

SEQ ID NO: 49327 - DNA, 75 bp, Artificial Sequence
  Synthetic
aagaatcttataagatacgaacctcaaggtgcagagctagtgggaattttttgaatagaagcagcagagaccact

SEQ ID NO: 49328 - DNA, 75 bp, Artificial Sequence
  Synthetic
gtgcttacactataaagcactagagtcttatctagtgaggcatccagagatacttgactgtggttcaaaagagga

SEQ ID NO: 49329 - DNA, 75 bp, Artificial Sequence
  Synthetic
tcttatctagtgaggcatccagagatacttgactgtggttcaaaagaggattataagctaaccctacttgatcta

SEQ ID NO: 49330 - DNA, 75 bp, Artificial Sequence
  Synthetic
tgtctccagttcaatctgctccagtaggtcaggagaaagcaatcgaagtctaccaggtgagagaaagttacacaa

SEQ ID NO: 49331 - DNA, 75 bp, Artificial Sequence
  Synthetic
ggcaaacaacacaagtttgaagcttggctttctagtgaagtacgctgtcactctgttcacatccaatggtgagcc

SEQ ID NO: 49332 - DNA, 75 bp, Artificial Sequence
  Synthetic
ggctttctagtgaagtacgctgtcactctgttcacatccaatggtgagccgttctcactcagcctaaacgatggt

SEQ ID NO: 49333 - DNA, 75 bp, Artificial Sequence
  Synthetic
agtaggcttgtttgtcctaatgagctaggaaaaaagttttcaacaagttgtagaaggattgaagacaatattgca

SEQ ID NO: 49334 - DNA, 75 bp, Artificial Sequence
  Synthetic
aacgaaaatagtctttgctaaaataggcctttcagggaatggttatgacttcatctggaccacccagatgattgc

SEQ ID NO: 49335 - DNA, 75 bp, Artificial Sequence
  Synthetic
caatattaagtgctggaagcaaagagatctatgtcctgaagtgaccattccatgctttacggtctatggaacttt

SEQ ID NO: 49336 - DNA, 75 bp, Artificial Sequence
  Synthetic
gactaagactgtttcagagaacccattaccactcagctgttggtctgaagttcaaaactacattgaagacatagg

SEQ ID NO: 49337 - DNA, 75 bp, Artificial Sequence
  Synthetic
ggcctttcagggaatggttatgacttcatctggaccacccagatgattgcaaatagcaactttaatgtctgcaag

SEQ ID NO: 49338 - DNA, 75 bp, Artificial Sequence
  Synthetic
cactgtgacattaacctatcagtcaaactgccatcgaacaaaaaagagaacatgttatgttgtatatacagtggc

SEQ ID NO: 49339 - DNA, 75 bp, Artificial Sequence
  Synthetic
gatctatgtcctgaagtgaccattccatgctttacggtctatggaacttttatcaacagcgacagacaactgatc

SEQ ID NO: 49340 - DNA, 75 bp, Artificial Sequence
  Synthetic
caaggtcatttatgaaatggtcaaactggtcggagaaacaggcatggcaatactgcaacagttggcttttgcaca

SEQ ID NO: 49341 - DNA, 75 bp, Artificial Sequence
  Synthetic
tgaaggatgtattagcgtcttggaagaaacagcggaaaggcatatgctttgggaactcgatctgatgaactcact

SEQ ID NO: 49342 - DNA, 75 bp, Artificial Sequence
  Synthetic
aggcgactgttgaagcaagcaactcagccctgctcatcagaagcatcataaactccacctttgtgatatgcgtgc

SEQ ID NO: 49343 - DNA, 75 bp, Artificial Sequence
  Synthetic
gaaacagcggaaaggcatatgctttgggaactcgatctgatgaactcactttgttctgacgaaaagagagatact

SEQ ID NO: 49344 - DNA, 75 bp, Artificial Sequence
  Synthetic
tatgcagtattagcacctaaggcacagttgggaggagcaagagatctgttggtgcaagaaactggtacaaaagtt

SEQ ID NO: 49345 - DNA, 75 bp, Artificial Sequence
  Synthetic
gaggaagtgttgatgaacttaatcaaccagtgtaaggcagtaaaagaactcattaacagcacaggactctcagac

SEQ ID NO: 49346 - DNA, 75 bp, Artificial Sequence
  Synthetic
caaagaggggaagaagctgttgaagttaaacagcgacacatccactgacacacagagcattgcttctgaggtgtc

SEQ ID NO: 49347 - DNA, 75 bp, Artificial Sequence
  Synthetic
ttaaacagcgacacatccactgacacacagagcattgcttctgaggtgtcagacagaaggtcctatagctcaagc

SEQ ID NO: 49348 - DNA, 75 bp, Artificial Sequence
  Synthetic
aagaagaccttacaaacttctgccatcaagaatgccaagtgacagagactgagtgtctttgcccgtatgaagcct

SEQ ID NO: 49349 - DNA, 75 bp, Artificial Sequence
  Synthetic
agacgatggactcacaaatcctcacctcaaagagacgattctcaatgtaggattagactgtcttactaacatgcg

SEQ ID NO: 49350 - DNA, 75 bp, Artificial Sequence
  Synthetic
gagtgtctttgcccgtatgaagccttaattctcagaaagccccttttcctggatagcatagccaaggggaagaaa

SEQ ID NO: 49351 - DNA, 75 bp, Artificial Sequence
  Synthetic
ctcaaagagacgattctcaatgtaggattagactgtcttactaacatgcgaaacctcgacggaaagcctataagt

SEQ ID NO: 49352 - DNA, 75 bp, Artificial Sequence
  Synthetic
atttgagttaagatcgggtcttgaggttttcaatgatcctttcaatgattatcagcaagcaataacagacatttg

SEQ ID NO: 49353 - DNA, 75 bp, Artificial Sequence
  Synthetic
gttttcaatgatcctttcaatgattatcagcaagcaataacagacatttgtcagttctctgagtatacaccaaac

SEQ ID NO: 49354 - DNA, 75 bp, Artificial Sequence
  Synthetic
taacaccaaatgggggccaattcactgctgttcctttttctccggtatgatgcagcaggtcctcaagaatattcc

SEQ ID NO: 49355 - DNA, 75 bp, Artificial Sequence
  Synthetic
tataaactgtgcagcaaaggaggcgtggagcaacatagtgaagaggatttgagaaagttgttggtagacaattta

SEQ ID NO: 49356 - DNA, 75 bp, Artificial Sequence
  Synthetic
ctgtttctgtcatggacctgtctcaaatgtattctcctgtctttgagtatctgtcaggtgatagacaagtagaag

SEQ ID NO: 49357 - DNA, 75 bp, Artificial Sequence
  Synthetic
acctagaactcatatgatgctcaaggattgttttaaaattatactaggtactgagaataagaagatagtcaaaat

SEQ ID NO: 49358 - DNA, 75 bp, Artificial Sequence
  Synthetic
ccaatcttctctttctctaccattcatttcagtttcatcatcattattattattctagggtgtggggggaacgat

SEQ ID NO: 49359 - DNA, 75 bp, Artificial Sequence
  Synthetic
aatgtattctcctgtctttgagtatctgtcaggtgatagacaagtagaagagtggccaaaggccacttgcacagg

SEQ ID NO: 49360 - DNA, 75 bp, Artificial Sequence
  Synthetic
aagtaaagggctaatggcactaaacagctacaaccatatgggacagggcatccatcatgcaacttcttcagtgtt

SEQ ID NO: 49361 - DNA, 75 bp, Artificial Sequence
  Synthetic
agctacaaccatatgggacagggcatccatcatgcaacttcttcagtgttaacctcattggctgctgtacttttt

SEQ ID NO: 49362 - DNA, 75 bp, Artificial Sequence
  Synthetic
gcttcgtgggaagctaaagaaactcggtgctatctcaacaaacatagagatcgggaaaagggattgcttagatct

SEQ ID NO: 49363 - DNA, 75 bp, Artificial Sequence
  Synthetic
acgggatatttgaaccctcaaagttgtctttctatcactggaaggaactggtcagaaagaacattgatgaagtac

SEQ ID NO: 49364 - DNA, 75 bp, Artificial Sequence
  Synthetic
acatgttgagcatgctggtagctctgatgactatgcaaagtgcatagtggtaactggcgtgctatctaaggagct

SEQ ID NO: 49365 - DNA, 75 bp, Artificial Sequence
  Synthetic
gtctttctatcactggaaggaactggtcagaaagaacattgatgaagtactacttactgaggatgggaatctgat

SEQ ID NO: 49366 - DNA, 75 bp, Artificial Sequence
  Synthetic
gtggaatatgtaaaaacagaagctataatgtgtgttgagctaactagtcaggaaaggcagtgtagtttaattgag

SEQ ID NO: 49367 - DNA, 75 bp, Artificial Sequence
  Synthetic
acttcacagctgctgtgcagagatgctgtcagatgaaagacagcgcaaaaaccttggtaagtgactgtttccttg

SEQ ID NO: 49368 - DNA, 75 bp, Artificial Sequence
  Synthetic
agaaactcaaatttatgaatgtacattctccagaactgatgccagaaaactgcctcttttctagtgaggagttca

SEQ ID NO: 49369 - DNA, 75 bp, Artificial Sequence
  Synthetic
aagaaatgtccagcaaaggcttccctccgaaatcgttacactgcaccctaagatagaggaaggattctttgattt

SEQ ID NO: 49370 - DNA, 75 bp, Artificial Sequence
  Synthetic
ttctccagaactgatgccagaaaactgcctcttttctagtgaggagttcaacgaattaattaagctaaagaaact

SEQ ID NO: 49371 - DNA, 75 bp, Artificial Sequence
  Synthetic
tccgaaatcgttacactgcaccctaagatagaggaaggattctttgatttgatgcatgtgcaaaaagtactattc

SEQ ID NO: 49372 - DNA, 75 bp, Artificial Sequence
  Synthetic
aagttcatgttcactggactaataaacagttctgtgacctctccccagagtttgatgcaggcatgtcaggtttca

SEQ ID NO: 49373 - DNA, 75 bp, Artificial Sequence
  Synthetic
tatcttcttggatcaagtgcatgacagcttgtaaggattttgcaaacatcaatgacagggttcagaaattcattt

SEQ ID NO: 49374 - DNA, 75 bp, Artificial Sequence
  Synthetic
tttgcaggtctaccatgttggcaacctactgaaaggagacaaggttaatgggcactcaattcacaagatagagtc

SEQ ID NO: 49375 - DNA, 75 bp, Artificial Sequence
  Synthetic
acagttctgtgacctctccccagagtttgatgcaggcatgtcaggtttcatcccagcaagccatgtacaatagtg

SEQ ID NO: 49376 - DNA, 75 bp, Artificial Sequence
  Synthetic
accatctttctgaagagctatatgacataagactgcagcacctggaactgtcaaagctcaagcaagagcacccta

SEQ ID NO: 49377 - DNA, 75 bp, Artificial Sequence
  Synthetic
ctactgaaaggagacaaggttaatgggcactcaattcacaagatagagtctcatttcaacacctcatggatgtca

SEQ ID NO: 49378 - DNA, 75 bp, Artificial Sequence
  Synthetic
ttcaaccatgttgaagatttcatcagaaggtatggtatactaactcttggcactttatctccctttggtaggttg

SEQ ID NO: 49379 - DNA, 75 bp, Artificial Sequence
  Synthetic
atgtacatatactggagtgacacagcacaatcgtgcggcattcgtcaacatgctcaatattgagactgattatac

SEQ ID NO: 49380 - DNA, 75 bp, Artificial Sequence
  Synthetic
cacaatcgtgcggcattcgtcaacatgctcaatattgagactgattatacaaagacttttcacttccattccaag

SEQ ID NO: 49381 - DNA, 75 bp, Artificial Sequence
  Synthetic
tgctgaagttattgctagagcagctcaaacacttcacatgaatagtgtatcaattcaatcaagcagtctgaccac

SEQ ID NO: 49382 - DNA, 75 bp, Artificial Sequence
  Synthetic
aacatatggtgcaggcgaggtcactgttctagtggaggttgcagatctggagctacacactaagaaaatagaagt

SEQ ID NO: 49383 - DNA, 75 bp, Artificial Sequence
  Synthetic
cagagatactcgactgtggatctaaagaggactgtaagctcactttgcttgatctgtcagtttctaagctcttag

SEQ ID NO: 49384 - DNA, 75 bp, Artificial Sequence
  Synthetic
gttctagtggaggttgcagatctggagctacacactaagaaaatagaagtgtcagggttgaagtttgcaagtctg

SEQ ID NO: 49385 - DNA, 75 bp, Artificial Sequence
  Synthetic
gttcattaaagcactaaatagcctcaaatcaacccaggcttgtgaaataatccaaaatagaatcacaggtcttta

SEQ ID NO: 49386 - DNA, 75 bp, Artificial Sequence
  Synthetic
aattcatgtgaatgaaccagatgagttcacagtacacgtgaaaagcaatgatccagacgttgtggcagcaggatc

SEQ ID NO: 49387 - DNA, 75 bp, Artificial Sequence
  Synthetic
aaatcaacccaggcttgtgaaataatccaaaatagaatcacaggtctttactgcaatagcaatgaaggtcccctt

SEQ ID NO: 49388 - DNA, 75 bp, Artificial Sequence
  Synthetic
aagtctgatggcaaggaaaatagagtttggggctgacagcacctttaaagccttttcatcaatgcctaaaaactc

SEQ ID NO: 49389 - DNA, 75 bp, Artificial Sequence
  Synthetic
acaaagatagtttttgctaaaataggtttatctgggaacagttatgactttatctggactactcaaatgatagca

SEQ ID NO: 49390 - DNA, 75 bp, Artificial Sequence
  Synthetic
gttgagagatgggaaaagaagaggaaatttagagttagcaaacagaattcagtctgtgctttgtgttctaatagc

SEQ ID NO: 49391 - DNA, 75 bp, Artificial Sequence
  Synthetic
aatttagagttagcaaacagaattcagtctgtgctttgtgttctaatagcaggttactacaggtcatttggtgga

SEQ ID NO: 49392 - DNA, 75 bp, Artificial Sequence
  Synthetic
gatcattgaagacccaatgatacaactaattccagagaagttaaggagagagctggagaggctaggagtctcaag

SEQ ID NO: 49393 - DNA, 75 bp, Artificial Sequence
  Synthetic
ctaattccagagaagttaaggagagagctggagaggctaggagtctcaagaatggaagttgatgaattgatgcca

SEQ ID NO: 49394 - DNA, 75 bp, Artificial Sequence
  Synthetic
atgcagtcttagcacctaaagcacaactaggaggagcaagagacttgttagtgcaagagactgggactaaggtca

SEQ ID NO: 49395 - DNA, 75 bp, Artificial Sequence
  Synthetic
tcagtcaagagttttttttatggactgaaaaacatgctgggtggcatcttcggcaatgtcttcttaggcatcttc

SEQ ID NO: 49396 - DNA, 75 bp, Artificial Sequence
  Synthetic
cagcctcaatgtttcaacggaagagtactctgctgaagtgtccaggctcaagcaaacactaacagctcgaaatgt

SEQ ID NO: 49397 - DNA, 75 bp, Artificial Sequence
  Synthetic
gaggcttctgttctgtctgaagtgttgcagaaggaccaggggtctgctaaagtataaacaacttaaggatgaaga

SEQ ID NO: 49398 - DNA, 75 bp, Artificial Sequence
  Synthetic
tgcagaaggaccaggggtctgctaaagtataaacaacttaaggatgaagaagaagccgggtacaagaaaatcatc

SEQ ID NO: 49399 - DNA, 75 bp, Artificial Sequence
  Synthetic
caatattcatgaaatcttatttttttaaggacaacgtcttcttatcattaacagataggtggtccaccaagcaca

SEQ ID NO: 49400 - DNA, 75 bp, Artificial Sequence
  Synthetic
gctcgctgacaggaagattgctaaactcttctcaaccaagactcatatagggtgacaaatcagaccagctgccac

SEQ ID NO: 49401 - DNA, 75 bp, Artificial Sequence
  Synthetic
ctgtagtgtcacccgtttttttatgccactgtgtcctttttacaacaaatcatacactaatcatcacttctccac

SEQ ID NO: 49402 - DNA, 75 bp, Artificial Sequence
  Synthetic
actaagtatactcactggttggacacctttctaagctgttctgtttccatcaacagacacactactgtcaaagag

SEQ ID NO: 49403 - DNA, 75 bp, Artificial Sequence
  Synthetic
catttattaagaacctgtgtaggcaggtagaaatacctgctggcagcattaagaagatcttaaatgttcttagat

SEQ ID NO: 49404 - DNA, 75 bp, Artificial Sequence
  Synthetic
ggtagaaatacctgctggcagcattaagaagatcttaaatgttcttagatacagactgtgcagcaaaggaggtgt

SEQ ID NO: 49405 - DNA, 75 bp, Artificial Sequence
  Synthetic
tcttccctatttaactcaaacatcaggtgtgttaacctaatcacttttgaagatggtctgagggagctctcgata

SEQ ID NO: 49406 - DNA, 75 bp, Artificial Sequence
  Synthetic
ggactcaggtgatcgctggtcaatatgtgaccaaccctaggttcaacatctccgactactttgagattgtgcgtc

SEQ ID NO: 49407 - DNA, 75 bp, Artificial Sequence
  Synthetic
acagttgggacggaaacgacacagttaagttcttggttacaacttatataagcaaaggactcatggcgttaaaca

SEQ ID NO: 49408 - DNA, 75 bp, Artificial Sequence
  Synthetic
tcagttctctgatccaaacagacagaaactcaggatagttgaatctagacctgcagagtctgagcttgaagcgaa

SEQ ID NO: 49409 - DNA, 75 bp, Artificial Sequence
  Synthetic
aaactcaggatagttgaatctagacctgcagagtctgagcttgaagcgaatcgtgcagtgattgtcaagactaaa

SEQ ID NO: 49410 - DNA, 75 bp, Artificial Sequence
  Synthetic
catgggttacctgctagatgagtcagcaatttctgaagtcaaacctactaaggttgacttttcgaacttacttaa

SEQ ID NO: 49411 - DNA, 75 bp, Artificial Sequence
  Synthetic
gcaatttctgaagtcaaacctactaaggttgacttttcgaacttacttaaagaccgctttaagataatgcagttt

SEQ ID NO: 49412 - DNA, 75 bp, Artificial Sequence
  Synthetic
atgattacgcaaagtgtatagtggtgactggtatactgtccaaggagctctactctcaatatgatgaaacatttt

SEQ ID NO: 49413 - DNA, 75 bp, Artificial Sequence
  Synthetic
gactggtatactgtccaaggagctctactctcaatatgatgaaacattttggaagcatgcttgtagacttaagaa

SEQ ID NO: 49414 - DNA, 75 bp, Artificial Sequence
  Synthetic
ctcggagaaaaatggtattagccctgatctgcagcaagttgcaaggtattcaaatcacctgaccttgctcagcag

SEQ ID NO: 49415 - DNA, 75 bp, Artificial Sequence
  Synthetic
gatctgcagcaagttgcaaggtattcaaatcacctgaccttgctcagcagaatgatacagcaggcaaagccaact

SEQ ID NO: 49416 - DNA, 75 bp, Artificial Sequence
  Synthetic
ccttagtgagcgactgttttcttgagttttacagtgagtttatgatgggttacagaataactcctgctgtgatta

SEQ ID NO: 49417 - DNA, 75 bp, Artificial Sequence
  Synthetic
gttttacagtgagtttatgatgggttacagaataactcctgctgtgattaagtttatgttcactggactgataaa

SEQ ID NO: 49418 - DNA, 75 bp, Artificial Sequence
  Synthetic
cacagtttgaggccgacacaaaagagaccttaagtctggtggacaaggtcatggctgtagaccagttaacatcat

SEQ ID NO: 49419 - DNA, 75 bp, Artificial Sequence
  Synthetic
agtggctgaacttgtcagttatggcataaaagaaggtaggttttacaggctgtctgacacaggaattgatgcaag

SEQ ID NO: 49420 - DNA, 75 bp, Artificial Sequence
  Synthetic
ataaaagaaggtaggttttacaggctgtctgacacaggaattgatgcaagcacatactctgtaaagtactggaag

SEQ ID NO: 49421 - DNA, 75 bp, Artificial Sequence
  Synthetic
ctcaacaagcaatgtataatagtgtcccacttgtcaccaacactgcctttactctattaaggcagcaaatattct

SEQ ID NO: 49422 - DNA, 75 bp, Artificial Sequence
  Synthetic
ggttcggaagagccttatagaaagtctagtctagatgaggtcaccttttccaaaaaacaagcagaaatgcttagg

SEQ ID NO: 49423 - DNA, 75 bp, Artificial Sequence
  Synthetic
actctattaaggcagcaaatattcttcaatcatgttgaagattttatcagaaggtatggtatattaactcttggg

SEQ ID NO: 49424 - DNA, 75 bp, Artificial Sequence
  Synthetic
caagtcttcactgctcatgagtttcttgaactggagagtgaacatggacattagaactactgactgtccactatc

SEQ ID NO: 49425 - DNA, 75 bp, Artificial Sequence
  Synthetic
aactagagttggcagggttttggactgcatgttcaactgcaaattgtgtgttgaaatttctgccgacaccttggt

SEQ ID NO: 49426 - DNA, 75 bp, Artificial Sequence
  Synthetic
cagctcagcagttgctttggaagatgctgaagtcattgctagagcagctcaaacacttcatatgaacagtgtatc

SEQ ID NO: 49427 - DNA, 75 bp, Artificial Sequence
  Synthetic
gagtttgatggacaggtcattgctaacatccttgccagtgaactgagttctgtgaaacgggattctgagcgtgaa

SEQ ID NO: 49428 - DNA, 75 bp, Artificial Sequence
  Synthetic
gaaaaagccctatttaggaacaacctgcaagtttagcacttggggagattcgaacaggtctgggaaatttacata

SEQ ID NO: 49429 - DNA, 75 bp, Artificial Sequence
  Synthetic
tgcaagtttagcacttggggagattcgaacaggtctgggaaatttacatacagcagcagatctggggagtcgatt

SEQ ID NO: 49430 - DNA, 75 bp, Artificial Sequence
  Synthetic
tgccctactatgtgagactgagagacaagtactatcctggatgagcaaaagaagaactgaagtgataactaagga

SEQ ID NO: 49431 - DNA, 75 bp, Artificial Sequence
  Synthetic
ggtgttatgttgtcaacattcctttatggctctaataacaagaataaaaagaaatttattactaactgcctgctt

SEQ ID NO: 49432 - DNA, 75 bp, Artificial Sequence
  Synthetic
gaagaactgaagtgataactaaggagcagcatcaactattcctaagcctccttcctcagtctcatgagtgcttac

SEQ ID NO: 49433 - DNA, 75 bp, Artificial Sequence
  Synthetic
gaatgagcttttgtacaaatcacctagaaaagctctagcaaccgtttgtagtgccttgtttgggaagcaggtgac

SEQ ID NO: 49434 - DNA, 75 bp, Artificial Sequence
  Synthetic
agaaaagctctagcaaccgtttgtagtgccttgtttgggaagcaggtgaccaagctccagaattgtttcagaacc

SEQ ID NO: 49435 - DNA, 75 bp, Artificial Sequence
  Synthetic
ccccgactgcttaagtttgtgcctctcaagaaagggctggcagtggtgaagatcaaaaaacagattttgacagta

SEQ ID NO: 49436 - DNA, 75 bp, Artificial Sequence
  Synthetic
tcaagaaagggctggcagtggtgaagatcaaaaaacagattttgacagtaaagaaacaaattgtgtttgatgccg

SEQ ID NO: 49437 - DNA, 75 bp, Artificial Sequence
  Synthetic
atcattgaatagagacgacaacaaaatcattgaggatcctatgatacagctaattccagagaagctgaggagaga

SEQ ID NO: 49438 - DNA, 75 bp, Artificial Sequence
  Synthetic
atagaaaatatgtctaagttagacaacactgatgttgagtttaaccacagggagatagccgacttgaatcagtta

SEQ ID NO: 49439 - DNA, 75 bp, Artificial Sequence
  Synthetic
gatgagactgacactcagaccacataccatgagaaccttttaaaggtgaaacaacttgtggactgttctacagat

SEQ ID NO: 49440 - DNA, 75 bp, Artificial Sequence
  Synthetic
gtatcagtcctgatgacaccttagcccagcttgtggcaaaaaaactcatcagcctaaatgtatcgacagaagaat

SEQ ID NO: 49441 - DNA, 75 bp, Artificial Sequence
  Synthetic
accatgagaaccttttaaaggtgaaacaacttgtggactgttctacagatagaaagaagcttttgcctcaatcag

SEQ ID NO: 49442 - DNA, 75 bp, Artificial Sequence
  Synthetic
ccagcttgtggcaaaaaaactcatcagcctaaatgtatcgacagaagaatactcggctgaggtgtctaggctcaa

SEQ ID NO: 49443 - DNA, 75 bp, Artificial Sequence
  Synthetic
acactgatgttgagtttaaccacagggagatagccgacttgaatcagttaacttctcgacttattacgttaagaa

SEQ ID NO: 49444 - DNA, 75 bp, Artificial Sequence
  Synthetic
ctgctccttaattctttgacactgcttcattgtttcctgaagcatgcccccagtgatgccattatggaggtggag

SEQ ID NO: 49445 - DNA, 75 bp, Artificial Sequence
  Synthetic
ttcattgtttcctgaagcatgcccccagtgatgccattatggaggtggagagtaaaagtagcttgctgcataagt

SEQ ID NO: 49446 - DNA, 75 bp, Artificial Sequence
  Synthetic
gggcaatgagtgcaggtaaggttggtaatgtcctctcctatgcacacaacctctatctgagtaagtctagtctaa

SEQ ID NO: 49447 - DNA, 75 bp, Artificial Sequence
  Synthetic
gagaaattgaataaggttgtcataaaggacaatcttgagcaaggcatggaggaggagattgagttttgcaacaac

SEQ ID NO: 49448 - DNA, 75 bp, Artificial Sequence
  Synthetic
gctcttaattgagatcaagaggctgtatgccctacaggaagattctgaggtggagccgatagccataatttgtga

SEQ ID NO: 49449 - DNA, 75 bp, Artificial Sequence
  Synthetic
aggacaatcttgagcaaggcatggaggaggagattgagttttgcaacaacctgactaagactgtttcagaaaacc

SEQ ID NO: 49450 - DNA, 75 bp, Artificial Sequence
  Synthetic
ggcttcaacaatgtgctcgttaacatcgacaggaatacagtgaagagtgaacttctatggaagttcacactagat

SEQ ID NO: 49451 - DNA, 75 bp, Artificial Sequence
  Synthetic
gatggtctgagagaactatcggtgatacagagtcacctcaaagtcttcgaaaatgagttcaccaacttaaacctt

SEQ ID NO: 49452 - DNA, 75 bp, Artificial Sequence
  Synthetic
tgacgacataagaaactctccaacgcacagcacagcctggaaacatgcccttcggttgaaaggaactgcatatga

SEQ ID NO: 49453 - DNA, 75 bp, Artificial Sequence
  Synthetic
aacttagaatagttgagtctagacctgcggaatctgagctagaggcaaaccgtgcagtaattgtcaagactaaat

SEQ ID NO: 49454 - DNA, 75 bp, Artificial Sequence
  Synthetic
ttatgtcagcaccgaaaccattcctaaattcttgcttgcatttcttctttacgaagaagtattaatgaacctaat

SEQ ID NO: 49455 - DNA, 75 bp, Artificial Sequence
  Synthetic
aaccaagtttgaccatgttgatacaaaccttgttccctgacaaattcgaagatttcttggatcgaactcagctac

SEQ ID NO: 49456 - DNA, 75 bp, Artificial Sequence
  Synthetic
aaattcttgcttgcatttcttctttacgaagaagtattaatgaacctaatcaaccagtgcaaggcagttaaggag

SEQ ID NO: 49457 - DNA, 75 bp, Artificial Sequence
  Synthetic
aaccttgttccctgacaaattcgaagatttcttggatcgaactcagctacacccagaattcagagatctgacacc

SEQ ID NO: 49458 - DNA, 75 bp, Artificial Sequence
  Synthetic
tttatgcacttactactttcagaatgagtgcagtaagagagatggacctagatgttccttcgcagcactgttgag

SEQ ID NO: 49459 - DNA, 75 bp, Artificial Sequence
  Synthetic
acgttgaaaatatgcaaatctccattgatgcaacattgcctgagtctgtggaggcagttccggtgacagaaagaa

SEQ ID NO: 49460 - DNA, 75 bp, Artificial Sequence
  Synthetic
tgctcctagtgatgccataatggaggtagagagtaaaagcagcttgctgcacaagtacctcaaatcaggaggtgt

SEQ ID NO: 49461 - DNA, 75 bp, Artificial Sequence
  Synthetic
gagtgcagtaagagagatggacctagatgttccttcgcagcactgttgagtctggttcatgaggactggcaaaag

SEQ ID NO: 49462 - DNA, 75 bp, Artificial Sequence
  Synthetic
ggttgacttctcgaatctacttaaagaccgctttaaaataatgcaattttttccctcagtgttcactttgattaa

SEQ ID NO: 49463 - DNA, 75 bp, Artificial Sequence
  Synthetic
acctgcaacaagttgcaagatactcaaaccatttgaccttactcagtaggatgatacaacaagcaaagccaaccg

SEQ ID NO: 49464 - DNA, 75 bp, Artificial Sequence
  Synthetic
attgaaggttaacatcattttggtgcctctcaaggacatgtctaagccgaaacctgagagagtgatcatagctag

SEQ ID NO: 49465 - DNA, 75 bp, Artificial Sequence
  Synthetic
catatcatggaaaactttacacgacttatgcatgaagggaggccttcggctaagaaaagaaatgcagaaccggca

SEQ ID NO: 49466 - DNA, 75 bp, Artificial Sequence
  Synthetic
cctctcaaggacatgtctaagccgaaacctgagagagtgatcatagctaggaggtcattaaatcatgccttgtct

SEQ ID NO: 49467 - DNA, 75 bp, Artificial Sequence
  Synthetic
aaattgcaagatggggaaccttgaaggacaggagtgttttgaattcactgtcctaaaagatagtagcactaggtt

SEQ ID NO: 49468 - DNA, 75 bp, Artificial Sequence
  Synthetic
ttctgacaccggaatcgatgcaagcacatattctgtgaaatattggaaaattcttcactgcatctctgccatcgg

SEQ ID NO: 49469 - DNA, 75 bp, Artificial Sequence
  Synthetic
ggacaggagtgttttgaattcactgtcctaaaagatagtagcactaggttggactataataaattagttgaccac

SEQ ID NO: 49470 - DNA, 75 bp, Artificial Sequence
  Synthetic
ggcattgttgaggagaatcatatgatatttagcgaagaagatcaactagaaacgaggcaactactattagtagag

SEQ ID NO: 49471 - DNA, 75 bp, Artificial Sequence
  Synthetic
atggaaagatatactgaagttattggagttgctagggataaagtgctcattcattgcctgtgcagattgctcgtc

SEQ ID NO: 49472 - DNA, 75 bp, Artificial Sequence
  Synthetic
agttctaatgttgacaggcaggtctaccaagcccagcaccataacactattttcacgtgaggaagagcagtgcca

SEQ ID NO: 49473 - DNA, 75 bp, Artificial Sequence
  Synthetic
tcattgcctgtgcagattgctcgtccacaccaccggacagatggtggattacagaagacagggtgcgagtcttaa

SEQ ID NO: 49474 - DNA, 75 bp, Artificial Sequence
  Synthetic
accaagcccagcaccataacactattttcacgtgaggaagagcagtgccaagagcaaataagcttagatgacctt

SEQ ID NO: 49475 - DNA, 75 bp, Artificial Sequence
  Synthetic
caaaacaggtaatctcggcttcaactgggactcagattgatcatactactcatgagaatcaacagcatccttgaa

SEQ ID NO: 49476 - DNA, 75 bp, Artificial Sequence
  Synthetic
aagaagccctacttagggacaacttgcaagttcaacacctggggagactcaaacagatctggaaagttcacatac

SEQ ID NO: 49477 - DNA, 75 bp, Artificial Sequence
  Synthetic
ttatctaaaagctggaactgcaacaaagacccctgtgtcaacaaaggatgttctagaaacctgggagaagatgaa

SEQ ID NO: 49478 - DNA, 75 bp, Artificial Sequence
  Synthetic
tgggactcagattgatcatactactcatgagaatcaacagcatccttgaatgttatgaagaaaattttgacaatc

SEQ ID NO: 49479 - DNA, 75 bp, Artificial Sequence
  Synthetic
aagacccctgtgtcaacaaaggatgttctagaaacctgggagaagatgaaagaacacatactcaatagacctaca

SEQ ID NO: 49480 - DNA, 75 bp, Artificial Sequence
  Synthetic
aactatacattggttaactttagctgatccaacacttctattctttaagcattgacctcagtttgattatttcca

SEQ ID NO: 49481 - DNA, 75 bp, Artificial Sequence
  Synthetic
gccctgttgtgtgaaactgaaagacaagtgctctcttggatgagcaagaggaggactgaggtattaaccaaagaa

SEQ ID NO: 49482 - DNA, 75 bp, Artificial Sequence
  Synthetic
aaagcacaaggacggtagcgcgctatcagtcatacctgatagcagcaatcccagactacttaagtttgtgcctct

SEQ ID NO: 49483 - DNA, 75 bp, Artificial Sequence
  Synthetic
ccactagtgaaaaaatgctgctgagttggttgagtgaagacattaagtcaacaagatgtgatgagtgtcttgcca

SEQ ID NO: 49484 - DNA, 75 bp, Artificial Sequence
  Synthetic
tcagtcatacctgatagcagcaatcccagactacttaagtttgtgcctctcaaaaaaggtttggcagtggtgaaa

SEQ ID NO: 49485 - DNA, 75 bp, Artificial Sequence
  Synthetic
ttccaaatctggacagatttgtattccagatggctagtgccactgatgatgcacaaaaggattccatctacgcat

SEQ ID NO: 49486 - DNA, 75 bp, Artificial Sequence
  Synthetic
ttggttgagtgaagacattaagtcaacaagatgtgatgagtgtcttgccactataaagaagaccattgatgaaac

SEQ ID NO: 49487 - DNA, 75 bp, Artificial Sequence
  Synthetic
catggctgcttgtccattgtttatgatgaaactgacacccagaccacataccacgagaatcttttaaaggtgaag

SEQ ID NO: 49488 - DNA, 75 bp, Artificial Sequence
  Synthetic
taacggcattagcattagcaacacatctaatgtcggcaagaggtgcccaaaattagaggtagtcagtcattgcga

SEQ ID NO: 49489 - DNA, 75 bp, Artificial Sequence
  Synthetic
ttccaactaccagcaggctgctctcaagtggaggaaagacataggcttccgtgtcaatgcaaacacagcagcttt

SEQ ID NO: 49490 - DNA, 75 bp, Artificial Sequence
  Synthetic
ttgttagactcacactaccaggaaagactgagaaagaaaggaggatcaagcgcaatgtggaatacctgataaaat

SEQ ID NO: 49491 - DNA, 75 bp, Artificial Sequence
  Synthetic
gactgagaaagaaaggaggatcaagcgcaatgtggaatacctgataaaattgatgatgagcatgtcaggcatcga

SEQ ID NO: 49492 - DNA, 75 bp, Artificial Sequence
  Synthetic
tcaaggatcaagttcaagacagagcttctcctcaactcattgacactgctccactgtttcctaaaacatgctccc

SEQ ID NO: 49493 - DNA, 75 bp, Artificial Sequence
  Synthetic
ctatgattgtaaccatcaaccatgtttattttaactgcttatataatcctgctttattaacttcttcttatttct

SEQ ID NO: 49494 - DNA, 75 bp, Artificial Sequence
  Synthetic
cctcagatcaggaggtgtcagacagcggaacactgaggtgctcttcagagagaagttaaacaagattgttataaa

SEQ ID NO: 49495 - DNA, 75 bp, Artificial Sequence
  Synthetic
caaaacacagcaatgaaagtttgaaagataggagtgatgacgaccagagacttgctgagaagattgataccgtta

SEQ ID NO: 49496 - DNA, 75 bp, Artificial Sequence
  Synthetic
ttattttaactgcttatataatcctgctttattaacttcttcttatttctttcgttttaaacacttaaagggctg

SEQ ID NO: 49497 - DNA, 75 bp, Artificial Sequence
  Synthetic
gaaaagagctatcggaagctaaactgaaggactattccacttacgcaagaggtgtgatctcaaattcgcttaaaa

SEQ ID NO: 49498 - DNA, 75 bp, Artificial Sequence
  Synthetic
gttcaaaactacattgaagacataggcttcaacaatgtacttgttaacattgacagaaacacggtgaaaagtgaa

SEQ ID NO: 49499 - DNA, 75 bp, Artificial Sequence
  Synthetic
tcccgactgtctcacagttcctttttgagttagggaagcagccaaggggtaccaagaaaatgaagaaggcactct

SEQ ID NO: 49500 - DNA, 75 bp, Artificial Sequence
  Synthetic
ctcttatggaaatttacgttagacaccagtgtaagcaccacaagcaccataaaagacatgaggacattggtgtct

SEQ ID NO: 49501 - DNA, 75 bp, Artificial Sequence
  Synthetic
tgaagaagtgttgatgaacctaatcaatcagtgtaaggcagtaaaagaactcatcaacagcacaggactctcaga

SEQ ID NO: 49502 - DNA, 75 bp, Artificial Sequence
  Synthetic
aatcagtgtaaggcagtaaaagaactcatcaacagcacaggactctcagacttggagctagaaagtttgcttaca

SEQ ID NO: 49503 - DNA, 75 bp, Artificial Sequence
  Synthetic
atgtgagacgtttcttaggtgctgcacagagttcaacagatcaggagttaaattagtgaaggtaaggcactgtga

SEQ ID NO: 49504 - DNA, 75 bp, Artificial Sequence
  Synthetic
acagagttcaacagatcaggagttaaattagtgaaggtaaggcactgtgacatcaacttgtcagttaagttgcca

SEQ ID NO: 49505 - DNA, 75 bp, Artificial Sequence
  Synthetic
atctcaaagacatgtctaagccaaagcctgagagagtggtcatagccagaaggtcactgaatcatgctctatcct

SEQ ID NO: 49506 - DNA, 75 bp, Artificial Sequence
  Synthetic
tctgaaggacaatagcgcaaggctagattacaacaagttgattgaccactgtgtagacatggaaaaaaagaggga

SEQ ID NO: 49507 - DNA, 75 bp, Artificial Sequence
  Synthetic
tacaggtgtctagaagtcataaatagcatgaacgagaagacattgcaggacatcgagaatcactccatgaccctg

SEQ ID NO: 49508 - DNA, 75 bp, Artificial Sequence
  Synthetic
agagtcctataagatacgagcttcgaggtgcaaagccagtgggaactttctaaacagaagcagcagagatcactt

SEQ ID NO: 49509 - DNA, 75 bp, Artificial Sequence
  Synthetic
tgcacacgaggatgagcagtgtcaagaccaaataagcttagatgatctgatggcaaatgacacggtgacagactt

SEQ ID NO: 49510 - DNA, 75 bp, Artificial Sequence
  Synthetic
gaccaaataagcttagatgatctgatggcaaatgacacggtgacagacttgcctgacagggaagcggaggccctc

SEQ ID NO: 49511 - DNA, 75 bp, Artificial Sequence
  Synthetic
ctggtttatggtttcctcataaaggacaatctattagccaattcccaacagcagaacaaacaactccagatgctt

SEQ ID NO: 49512 - DNA, 75 bp, Artificial Sequence
  Synthetic
caaagaaatacttgcggcacgtcagtacgtaagtgttaactttgaggaagtggattgagcatcttaattgcagca

SEQ ID NO: 49513 - DNA, 75 bp, Artificial Sequence
  Synthetic
tacgtaagtgttaactttgaggaagtggattgagcatcttaattgcagcatacttgtcaacatcatgcatatatc

SEQ ID NO: 49514 - DNA, 75 bp, Artificial Sequence
  Synthetic
gtatgagccattaacgcccttcaatatctcaagggcgaataaggcagctttaaccgcaccattcattgacatcaa

SEQ ID NO: 49515 - DNA, 75 bp, Artificial Sequence
  Synthetic
attgatgtatgcagttttctgcttgcaactgtgcggtctagggaagactaacggaccacacaatgggactgaaca

SEQ ID NO: 49516 - DNA, 75 bp, Artificial Sequence
  Synthetic
agaagaattgaagacaacatcgcaagactttatctacagacgtcaatatactgctctgttagagatgtggaagat

SEQ ID NO: 49517 - DNA, 75 bp, Artificial Sequence
  Synthetic
acggaccacacaatgggactgaacacaataatacacacgttatgacaacgcctgatgacagtcagagccctgaac

SEQ ID NO: 49518 - DNA, 75 bp, Artificial Sequence
  Synthetic
cattaattaatctcttttactatcccaccaatcctctctttctctactgttcatttcagtttcatcatcattatt

SEQ ID NO: 49519 - DNA, 75 bp, Artificial Sequence
  Synthetic
caataatacacacgttatgacaacgcctgatgacagtcagagccctgaaccgccagtgagcacagccttacctgt

SEQ ID NO: 49520 - DNA, 75 bp, Artificial Sequence
  Synthetic
caccaatcctctctttctctactgttcatttcagtttcatcatcattattatctggggtgtggggggaacgattt

SEQ ID NO: 49521 - DNA, 75 bp, Artificial Sequence
  Synthetic
ttgcttcacagtctatggcaccttcgttaacagtgacagacaactgatctttgacatctacaacgttcacatata

SEQ ID NO: 49522 - DNA, 75 bp, Artificial Sequence
  Synthetic
taaagaccatcaattgcataaacttaaaagcatccgtctttaaagaacatagagaggttgaaatcaatgtgcttc

SEQ ID NO: 49523 - DNA, 75 bp, Artificial Sequence
  Synthetic
aaggctcaggagaggtttacacatcctctccaatcaccaccaagggtttgtctctgccggaggccacatctgagc

SEQ ID NO: 49524 - DNA, 75 bp, Artificial Sequence
  Synthetic
ctctccaatcaccaccaagggtttgtctctgccggaggccacatctgagccccctgcgactaccagcgtggtcac

SEQ ID NO: 49525 - DNA, 75 bp, Artificial Sequence
  Synthetic
gttaacagtgacagacaactgatctttgacatctacaacgttcacatatacaacaaggaaatggacaactttgac

SEQ ID NO: 49526 - DNA, 75 bp, Artificial Sequence
  Synthetic
ggagcttgatctaatgaattcactctgttctgatgagaaaagggatgctagaaatgcaagacttctgctaggttg

SEQ ID NO: 49527 - DNA, 75 bp, Artificial Sequence
  Synthetic
ctacaccaacagtccgcacgagtctgcccagcagccctagcacaccatccacatcacaaggcacacactatcccg

SEQ ID NO: 49528 - DNA, 75 bp, Artificial Sequence
  Synthetic
gaaatgcaagacttctgctaggttgcccaaatgtgagaaaagcagcaaacaaggaagggaaaaagctactaaagt

SEQ ID NO: 49529 - DNA, 75 bp, Artificial Sequence
  Synthetic
gtgcacctatatatgagtgtgcgtgggttagctccactggcattgtgaagaggggacttgaatggttcgaaaaaa

SEQ ID NO: 49530 - DNA, 75 bp, Artificial Sequence
  Synthetic
tgaggagtctgctttcagtcacgagccctaagccagaagaaacaccaacaccgtcaaaatcaggcaaagataact

SEQ ID NO: 49531 - DNA, 75 bp, Artificial Sequence
  Synthetic
acaacagcccagaaacccactgaaaacaacagccacaacaccaccgaacagcttgagtccttaacacacttagca

SEQ ID NO: 49532 - DNA, 75 bp, Artificial Sequence
  Synthetic
cacagacagtcctcccacagagtgttacctctatagccattcaagacattcataccagcccaacaaataggtcta

SEQ ID NO: 49533 - DNA, 75 bp, Artificial Sequence
  Synthetic
aagtattatggcaaaatacttaagctcctgcatctcaccttagaggaagacactgaaggcttgttagagtggtgc

SEQ ID NO: 49534 - DNA, 75 bp, Artificial Sequence
  Synthetic
caaatacatcatggccttcaacccaccatggggggacatcaacaagtcaggccgttcaggaatagcacttgtcgc

SEQ ID NO: 49535 - DNA, 75 bp, Artificial Sequence
  Synthetic
tcctgcatctcaccttagaggaagacactgaaggcttgttagagtggtgcaagagaaatctcggtcttgactgtg

SEQ ID NO: 49536 - DNA, 75 bp, Artificial Sequence
  Synthetic
gccgttcaggaatagcacttgtcgcaacaggccttgccaagcttgcagagactgaaggaaagggagtttttgacg

SEQ ID NO: 49537 - DNA, 75 bp, Artificial Sequence
  Synthetic
aacaggccttgccaagcttgcagagactgaaggaaagggagtttttgacgaagccaaaaagaccgtggaggccct

SEQ ID NO: 49538 - DNA, 75 bp, Artificial Sequence
  Synthetic
tcccgacggtgtcacagttcctctttgagctaggaaagcagccaagaggtactaagaaaatgaagaaggctctgc

SEQ ID NO: 49539 - DNA, 75 bp, Artificial Sequence
  Synthetic
gcagcctggtgatgggaactgcttctatcacagtatagctgagttaaccatgcccaacaaaacagatcactcata

SEQ ID NO: 49540 - DNA, 75 bp, Artificial Sequence
  Synthetic
tggcagaatcagtgaaatgggagtctgctttgggacaatccccgtggccaatcctgatgatgctgcccaaggatc

SEQ ID NO: 49541 - DNA, 75 bp, Artificial Sequence
  Synthetic
atctgtgactattctttagacaccgacggggcaattaggcttcctcaaattcatcatgaaggcacttttatccca

SEQ ID NO: 49542 - DNA, 75 bp, Artificial Sequence
  Synthetic
aagaattaaagcaggaccttttaatatcttcctggatcaagtgcataacagcatgtaaggattttgcaaacatca

SEQ ID NO: 49543 - DNA, 75 bp, Artificial Sequence
  Synthetic
atcttcctggatcaagtgcataacagcatgtaaggattttgcaaacatcaatgaaaaagtgcaaaagttcatcta

SEQ ID NO: 49544 - DNA, 75 bp, Artificial Sequence
  Synthetic
actggttctaggagattgctttccgaagaatctggtgatgactgcatatcaagaactcagctattgaggacagag

SEQ ID NO: 49545 - DNA, 75 bp, Artificial Sequence
  Synthetic
ttccagaacgcctacaacgtcaagggcaatgccaccagtgccaacattatctaaaatgcaaactgctctgtatcc

SEQ ID NO: 49546 - DNA, 75 bp, Artificial Sequence
  Synthetic
ctcaaagaaatacttgcggcacgtcagtacgtaagtgttaactttgagtgtgtgacctgagcatcttagatgcag

SEQ ID NO: 49547 - DNA, 75 bp, Artificial Sequence
  Synthetic
agtacgtaagtgttaactttgagtgtgtgacctgagcatcttagatgcagcatgcccttcaacatcatgtacaca

SEQ ID NO: 49548 - DNA, 75 bp, Artificial Sequence
  Synthetic
catgcccttcaacatcatgtacacaccactattgtgtgctattctttgtttgcagctgtggagcttagaaggaat

SEQ ID NO: 49549 - DNA, 75 bp, Artificial Sequence
  Synthetic
tgcagctgtggagcttagaaggaatttatggattgtccaacaaaacccaacacaatgacactagtaccataaagg

SEQ ID NO: 49550 - DNA, 75 bp, Artificial Sequence
  Synthetic
cgttactgggcaaaatggctatttatatctgcaggatgtcgaatcaccccaagacaaccatggccttcctctttt

SEQ ID NO: 49551 - DNA, 75 bp, Artificial Sequence
  Synthetic
atcacgtcagacccctcctccgccacatccacagcattagccagtggaccagaaggctcaggggacacgagcacc

SEQ ID NO: 49552 - DNA, 75 bp, Artificial Sequence
  Synthetic
tctcaaagacatcaatcccccctttacccacgttgacacagatagctccagtagtggtttctttgtcctcatcaa

SEQ ID NO: 49553 - DNA, 75 bp, Artificial Sequence
  Synthetic
cgcagtgttagcacctaaggcacagttaggaggagcacgagacctgttggtgcaagaaactggaacaaaggttat

SEQ ID NO: 49554 - DNA, 75 bp, Artificial Sequence
  Synthetic
caatagatgctgaaatgcatgatctcaactgcagttacaatatatgtccctattgtgcgtctagactgacttcag

SEQ ID NO: 49555 - DNA, 75 bp, Artificial Sequence
  Synthetic
gtatgtgaccaaccccaggttcaatatctccgattactttgagattgtgcggcagcctggtgatgggaactgctt

SEQ ID NO: 49556 - DNA, 75 bp, Artificial Sequence
  Synthetic
gaggaaaccgaattatacctgaatttagagagaattccctgggttgtaagaaagctattgcaggtgtcagagtcc

SEQ ID NO: 49557 - DNA, 75 bp, Artificial Sequence
  Synthetic
tagagagaattccctgggttgtaagaaagctattgcaggtgtcagagtccactggtacagtgttaaaaaggagca

SEQ ID NO: 49558 - DNA, 75 bp, Artificial Sequence
  Synthetic
aatcaacaaccccaacacatccagacagcccatgccctcaacacaaccagcagctcccaactcagtgacccctcc

SEQ ID NO: 49559 - DNA, 75 bp, Artificial Sequence
  Synthetic
caatcagcacccattggtcacgggaaaacaattgaaacataccgggttagggaagaatacacaagtatttgcctc

SEQ ID NO: 49560 - DNA, 75 bp, Artificial Sequence
  Synthetic
tacaccccagcccaacaaacagatctaaaagaaatcttgaaatggaaataattttgactttatctcaaggtttga

SEQ ID NO: 49561 - DNA, 75 bp, Artificial Sequence
  Synthetic
gtagaaatacctgctggcagcatcaagaagatcttgaatgttcttagatacaaactgtgtagcaaaggaggcgtg

SEQ ID NO: 49562 - DNA, 75 bp, Artificial Sequence
  Synthetic
attttgactttatctcaaggtttgaagaagtactacggcaaggtactaaaacttctggatcttactttagaagaa

SEQ ID NO: 49563 - DNA, 75 bp, Artificial Sequence
  Synthetic
tttgtactaggaagtatcctgtttatagtctcttttctaatgaaaggactggttgacggtgttggcaacatcttc

SEQ ID NO: 49564 - DNA, 75 bp, Artificial Sequence
  Synthetic
caaactgtgtagcaaaggaggcgtggagcaacatagtgaggaggatttgagaaagctgttggtggacaatttaga

SEQ ID NO: 49565 - DNA, 75 bp, Artificial Sequence
  Synthetic
cgatccagtcaagtagcttgactacattagacagcttaggacgtagtaggacaagttctacaattgaagacagca

SEQ ID NO: 49566 - DNA, 75 bp, Artificial Sequence
  Synthetic
cgatgacaacttctttcagaagagaatagaagagttttttttaactggtgaaggtcacttcaatgaagtgttgca

SEQ ID NO: 49567 - DNA, 75 bp, Artificial Sequence
  Synthetic
caccgacagtagaaccctttaaatcttactttgctaaaggcttcctctcaatggactcaggttacttctccgcca

SEQ ID NO: 49568 - DNA, 75 bp, Artificial Sequence
  Synthetic
acgcatgtgtttcagggcaactatggaagtaagcaacaaggccctatttatccgtagcattatcaacaccacttt

SEQ ID NO: 49569 - DNA, 75 bp, Artificial Sequence
  Synthetic
atgttgaacatgctggcagctccgatgattatgcaaagtgcatagtggtgactggcgtgctatctaaagagctat

SEQ ID NO: 49570 - DNA, 75 bp, Artificial Sequence
  Synthetic
accgactagagttggcagggttctggactgcatgtttaactgcaaactatgtgttgaaatatcagctgacactct

SEQ ID NO: 49571 - DNA, 75 bp, Artificial Sequence
  Synthetic
tagagatggaaagcctaccagctgggacctgggaaagagaagaagacctaacaaatttctgccatcaggaatgcc

SEQ ID NO: 49572 - DNA, 75 bp, Artificial Sequence
  Synthetic
gaaaaccatcaattgcataaacttgaaggcattagtcttcaaagagcatagggagattgaaatcaatgttctcct

SEQ ID NO: 49573 - DNA, 75 bp, Artificial Sequence
  Synthetic
agaattggtgaagttatgtcgttgcggcagctagggcacaagttgctaacacgagataaacaaatcaagcaggaa

SEQ ID NO: 49574 - DNA, 75 bp, Artificial Sequence
  Synthetic
tttacagctgctgtgcagagatgctgtcagatgaaagacagtgcgaaaaccttggtaagcgattgtttcctcgag

SEQ ID NO: 49575 - DNA, 75 bp, Artificial Sequence
  Synthetic
ttccctggaacagggatagaaagacatatgcagctgctacactctgaaatgatactagacatttgtactgtgtca

SEQ ID NO: 49576 - DNA, 75 bp, Artificial Sequence
  Synthetic
tgcactttggtcactaactgtgtgataaaaggaagggaaattcgcaaaggccagtcagtgttaaggcaatacaga

SEQ ID NO: 49577 - DNA, 75 bp, Artificial Sequence
  Synthetic
tttgtgtgctttttatttccaaaatgagtgcagtaagagagatggacctaggtgttcattcgcagcactgttaag

SEQ ID NO: 49578 - DNA, 75 bp, Artificial Sequence
  Synthetic
caaccatgttgaagatttcataagaaggtatggtatactaactcttggcaccctatctccctttggtaggctgtt

SEQ ID NO: 49579 - DNA, 75 bp, Artificial Sequence
  Synthetic
taaaaggaagggaaattcgcaaaggccagtcagtgttaaggcaatacagaacagaaattaagattggcaaagcat

SEQ ID NO: 49580 - DNA, 75 bp, Artificial Sequence
  Synthetic
ctgaagtcattgctagagcagctcagacacttcacatgaatagcgtgtcaattcaatcaagtagtttgaccacat

SEQ ID NO: 49581 - DNA, 75 bp, Artificial Sequence
  Synthetic
cagacaagtggaagagtggcctaaagcaacctgcacaggtgactgcccagaaagatgtggctgcacatcatcaac

SEQ ID NO: 49582 - DNA, 75 bp, Artificial Sequence
  Synthetic
ctatggtggtccaggtgacaagataactatctgcaacggttcaactattgtagatcagagactgggcagtgaact

SEQ ID NO: 49583 - DNA, 75 bp, Artificial Sequence
  Synthetic
agtgtgagcgacactaccatcgcttctcatgactcgggatcctcatcttctagcttctctttcgaactcaatagg

SEQ ID NO: 49584 - DNA, 75 bp, Artificial Sequence
  Synthetic
gtgctacaggtaaatcttgtgaaatagatagcaccccagtcagatgtaggcagggtttttgcttgaaaattactc

SEQ ID NO: 49585 - DNA, 75 bp, Artificial Sequence
  Synthetic
gacgcctgtgattcaagctgtgaaataatgataccaaagggcactggggacatcctagttgactgttcaggtggg

SEQ ID NO: 49586 - DNA, 75 bp, Artificial Sequence
  Synthetic
taatgataccaaagggcactggggacatcctagttgactgttcaggtgggcagcaacatttcctaaaagataacc

SEQ ID NO: 49587 - DNA, 75 bp, Artificial Sequence
  Synthetic
tggtaatgtcctttcctatgcacacaacctttatttaagcaagtccagcctaaacatgacttctgaagacatttc

SEQ ID NO: 49588 - DNA, 75 bp, Artificial Sequence
  Synthetic
tacatttgtagaatgtcaaatcatcccaagacaactatgggtttccttttttggtttagctttggttatgtgata

SEQ ID NO: 49589 - DNA, 75 bp, Artificial Sequence
  Synthetic
ttatatgcgctacaggaagattctgaagtagagccaatagccataatttgtgacggcatagaaagcaacatgaag

SEQ ID NO: 49590 - DNA, 75 bp, Artificial Sequence
  Synthetic
tctatctattaatagttgtagggacattagggaaaaagttcaaacagtacagagagttaaaacctcagacctgta

SEQ ID NO: 49591 - DNA, 75 bp, Artificial Sequence
  Synthetic
tgacctagactactactgtaacatgggagactggccttcctgcacatataccggagtcactcagcataaccatgc

SEQ ID NO: 49592 - DNA, 75 bp, Artificial Sequence
  Synthetic
tgcaatagatgctgagatgcacgacctcaactgtagttacaatatatgtccttattgtgcatctaggctgacctc

SEQ ID NO: 49593 - DNA, 75 bp, Artificial Sequence
  Synthetic
cttagaaagaatcccctgggttgttaggaaattactgcaggtgtcagaatccaccggtgtagcactaaagaggag

SEQ ID NO: 49594 - DNA, 75 bp, Artificial Sequence
  Synthetic
aggaaattactgcaggtgtcagaatccaccggtgtagcactaaagaggagtagttggctggttatactacttgtg

SEQ ID NO: 49595 - DNA, 75 bp, Artificial Sequence
  Synthetic
tcctgacttttcgcttacacaaaagattcatttcaaaaagaatcagattcccagtgttgagaatgtgcagatctc

SEQ ID NO: 49596 - DNA, 75 bp, Artificial Sequence
  Synthetic
agagacagtcgaagtatatcaaaccagagaagggtacacaagtatttgcctttttgtactagggagcatcctgtt

SEQ ID NO: 49597 - DNA, 75 bp, Artificial Sequence
  Synthetic
ttccctatttaacccaaacattaggtgcgttaacctaatcacttttgaagatggtttaagggagctctcagtgat

SEQ ID NO: 49598 - DNA, 75 bp, Artificial Sequence
  Synthetic
cagtacatttaaagctttctcagccatgcctaaaacctccctatgtttctacattgtggaaagagaatactgtaa

SEQ ID NO: 49599 - DNA, 75 bp, Artificial Sequence
  Synthetic
tttcccctggcttgtccatttgtaagacatgttctattggcagtataaacggctttgaaattgaatctcacaaat

SEQ ID NO: 49600 - DNA, 75 bp, Artificial Sequence
  Synthetic
gttgctggttagagtcagttaagagttttttttatggtctgaagaatatgctcggtggcatatttggcaatgttt

SEQ ID NO: 49601 - DNA, 75 bp, Artificial Sequence
  Synthetic
aagcgcatgtgctttagggcaactgtggaagtaagcaataaagctttacttatccgaaacatcatcaacaccact

SEQ ID NO: 49602 - DNA, 75 bp, Artificial Sequence
  Synthetic
ggaaacccttgtttttggacagtattgttaaaggcaagaagaacttgctaaattcaacaagcctagaaacaagct

SEQ ID NO: 49603 - DNA, 75 bp, Artificial Sequence
  Synthetic
cttgatggtgaaagacttgctgacagaaagattgctgaactgttctccacaaaaacacacattggctagatcaac

SEQ ID NO: 49604 - DNA, 75 bp, Artificial Sequence
  Synthetic
tatcaattgaggcaccatggggggcaataaatgtccagtcaactttcaaaccaactgtgtcagctgcaaacatag

SEQ ID NO: 49605 - DNA, 75 bp, Artificial Sequence
  Synthetic
ctgcgccggttggtgctgctgctcatgctaattcctttaattgcatccccaccatattaccatcacaatatgcca

SEQ ID NO: 49606 - DNA, 75 bp, Artificial Sequence
  Synthetic
ctaacataaagaaaactgttgatgaaactgccaacctttcagaaaagattgaactgcttgcttataatttgcagc

SEQ ID NO: 49607 - DNA, 75 bp, Artificial Sequence
  Synthetic
ccccaatggtgtgaatgttagcaacatatcaaatgtttacaagaggtgtccaaagatagaagtggttagtcattg

SEQ ID NO: 49608 - DNA, 75 bp, Artificial Sequence
  Synthetic
gtgcacccatatatgaatgtgcttgggtcagctctaccggcattgtgaagaaggggcttgagtggttcgagaaga

SEQ ID NO: 49609 - DNA, 75 bp, Artificial Sequence
  Synthetic
ccctgctatgtgagactgagagacaagtactgtcctggatgagcaaaagaagaactgaggtgataactaaggagc

SEQ ID NO: 49610 - DNA, 75 bp, Artificial Sequence
  Synthetic
tgagaactatgctgagctgaaggttgatgttcccaaaatagaacaacttgccaattaccaacaggctgctctcaa

SEQ ID NO: 49611 - DNA, 75 bp, Artificial Sequence
  Synthetic
agaactgaggtgataactaaggagcaacatcaactgtttctaagcctcctccctcagtcccatgaatgcttgcaa

SEQ ID NO: 49612 - DNA, 75 bp, Artificial Sequence
  Synthetic
ccaattaccaacaggctgctctcaagtggaggaaggacataggtttccgtgtcaatgcaaacacggcagccttaa

SEQ ID NO: 49613 - DNA, 75 bp, Artificial Sequence
  Synthetic
agattcaacttgggtcctgtgaccatcacattgtcagagccaagaaacattcagcaaaagctccctccagaaata

SEQ ID NO: 49614 - DNA, 75 bp, Artificial Sequence
  Synthetic
gtcacattgcatcctaggattgaagaaggcttctttgacttaatgcatatacaaaaagtgctatcagcaagtaca

SEQ ID NO: 49615 - DNA, 75 bp, Artificial Sequence
  Synthetic
aagaaagggctggcagtggtgaagatcaaaaagcagattctgacagtaaagaaacagattgtgtttgatgccgaa

SEQ ID NO: 49616 - DNA, 75 bp, Artificial Sequence
  Synthetic
ggagacaaggtgaacgggcacctgattcacaaaattgaaccacacttcaacacttcctggatgtcttgggacggc

SEQ ID NO: 49617 - DNA, 75 bp, Artificial Sequence
  Synthetic
tgaaactgacactcagaccacataccacgagaacctcttaaaagtgaaacagcttgtggactgctctacagacag

SEQ ID NO: 49618 - DNA, 75 bp, Artificial Sequence
  Synthetic
cacgagaacctcttaaaagtgaaacagcttgtggactgctctacagacagaaaaaagcttttgcctcagtcagta

SEQ ID NO: 49619 - DNA, 75 bp, Artificial Sequence
  Synthetic
gctgcatttgtaaacatgctcaacatcgaaactgattatacaaaaaacttccactttcactctaagagagttaca

SEQ ID NO: 49620 - DNA, 75 bp, Artificial Sequence
  Synthetic
gctcctcaattctctgacactgctccactgtttcttgaagcacgcccccagtgatgccattatggaggtagagag

SEQ ID NO: 49621 - DNA, 75 bp, Artificial Sequence
  Synthetic
cactgtttcttgaagcacgcccccagtgatgccattatggaggtagagagtaaaagtagcttgttgcacaagtac

SEQ ID NO: 49622 - DNA, 75 bp, Artificial Sequence
  Synthetic
cttcaacaatgtgcttgttaacatcgacaggaatacagtgaagagtgaacttttatggaagttcacactagacac

SEQ ID NO: 49623 - DNA, 75 bp, Artificial Sequence
  Synthetic
atgtcagcaccgaaaccattcctaaattcctgcttgcatttcttctttacgaggaagtgttaatgaacctaatta

SEQ ID NO: 49624 - DNA, 75 bp, Artificial Sequence
  Synthetic
aaaaatgtgtcaacacaaagcttgaacaaccacaaagcattttaatcgagcacaaagggacgataattgggaagc

SEQ ID NO: 49625 - DNA, 75 bp, Artificial Sequence
  Synthetic
attcctgcttgcatttcttctttacgaggaagtgttaatgaacctaattaaccagtgcaaagcagttaaggagct

SEQ ID NO: 49626 - DNA, 75 bp, Artificial Sequence
  Synthetic
ttatttcaattgcttacgtaatgctgttttgctaattttatcttgccatttttcatttcaaacacttaaagggct

SEQ ID NO: 49627 - DNA, 75 bp, Artificial Sequence
  Synthetic
gctccttttatcatgctaatacttttcttcatgtttggatggaggatcctgttctgctttaagtgttgcagaaga

SEQ ID NO: 49628 - DNA, 75 bp, Artificial Sequence
  Synthetic
tctcaaagaaatacttgcggcacgtcagtacgtaagtgtaaactttgagagagtggattgagcatcccgaatgca

SEQ ID NO: 49629 - DNA, 75 bp, Artificial Sequence
  Synthetic
cagtacgtaagtgtaaactttgagagagtggattgagcatcccgaatgcaccatgcccaccaacattatgcatac

SEQ ID NO: 49630 - DNA, 75 bp, Artificial Sequence
  Synthetic
tgaaggtcaacattatcttggtgcctcttaaggacatgtctaaacctaaacctgagagggtgatcatagctagga

SEQ ID NO: 49631 - DNA, 75 bp, Artificial Sequence
  Synthetic
acctcaaagacgatgaagaaatcggttacaggaaaatcattgagaggctaaaaaacaaaaaagggaaaaacaaac

SEQ ID NO: 49632 - DNA, 75 bp, Artificial Sequence
  Synthetic
tcttaaggacatgtctaaacctaaacctgagagggtgatcatagctaggaggtcattaaatcatgccttgtcctt

SEQ ID NO: 49633 - DNA, 75 bp, Artificial Sequence
  Synthetic
ctacagctgttgtgtctaggaggagctcatgggcagttaaacacaactgaacacaatggaacaaacaacaccaca

SEQ ID NO: 49634 - DNA, 75 bp, Artificial Sequence
  Synthetic
ctcatgggcagttaaacacaactgaacacaatggaacaaacaacaccacagcacctggcgcaagccaaagcccca

SEQ ID NO: 49635 - DNA, 75 bp, Artificial Sequence
  Synthetic
ttagtaggcttgtctgtcctaatgagttggggaaaaagttttcaacaagttgtagaagaattgaggacaacattg

SEQ ID NO: 49636 - DNA, 75 bp, Artificial Sequence
  Synthetic
actgcaagatggggaaccttgaaggacaggagtgttttgaattcaccgtcctaaaagatagtagtacaaggttgg

SEQ ID NO: 49637 - DNA, 75 bp, Artificial Sequence
  Synthetic
gcagaaagggcctcaagaaatgatgacagtatacttactaatactactgcttgtgctagcaccactgattgtacc

SEQ ID NO: 49638 - DNA, 75 bp, Artificial Sequence
  Synthetic
tgcttgatggtgaaagactagctgataggaagatcgctgagctgttctctacaaaaacacacattggctaaatca

SEQ ID NO: 49639 - DNA, 75 bp, Artificial Sequence
  Synthetic
acacaatggaacaaacaacaccacagcacctggcgcaagccaaagccccaagccacccatgagcacaaccccacc

SEQ ID NO: 49640 - DNA, 75 bp, Artificial Sequence
  Synthetic
cagaaggctcaggggaaacgacttcaaccccaaacaccacccagggcctgtcctcgccagagaccacatcagaac

SEQ ID NO: 49641 - DNA, 75 bp, Artificial Sequence
  Synthetic
acaggagtgttttgaattcaccgtcctaaaagatagtagtacaaggttggattataataaattggttgatcactg

SEQ ID NO: 49642 - DNA, 75 bp, Artificial Sequence
  Synthetic
ttctgatgttgacaggcaggtccaccaaacctagcaccgtaacaccatcttcacgtgaagaagagcaatgccaag

SEQ ID NO: 49643 - DNA, 75 bp, Artificial Sequence
  Synthetic
gtcaagcacagacagcacgaaccccaccacacagatgaccgacaacacccccacactaacagtcagtacaagccc

SEQ ID NO: 49644 - DNA, 75 bp, Artificial Sequence
  Synthetic
ggcaagtgatatagctacagatttgcctgacaaggaggcggaagccctccgaacaggcaatcttggtttcaattg

SEQ ID NO: 49645 - DNA, 75 bp, Artificial Sequence
  Synthetic
atccagcagccccagcacgccatccacaccacaaggcatatatcatcctgcaaggagtctattgtcagtctcgag

SEQ ID NO: 49646 - DNA, 75 bp, Artificial Sequence
  Synthetic
tctcaaagaaacacgtgccgcttacgcccacagtgttaccttgagtgttagcaaaatggagaacaaaatcgaagt

SEQ ID NO: 49647 - DNA, 75 bp, Artificial Sequence
  Synthetic
ctagaactgcaagactgctattaggctgcccaaatgtgaggaaagctgcaaataaagaagggaaaaagctattaa

SEQ ID NO: 49648 - DNA, 75 bp, Artificial Sequence
  Synthetic
gcaaaatggagaacaaaatcgaagtgaacaacaaagatgagctgaacaaatggtttgaggagttcaagaaaggaa

SEQ ID NO: 49649 - DNA, 75 bp, Artificial Sequence
  Synthetic
cggaaaccagcagtcagcactcagccatgagcagaataccaaccccccacacagcaacccgggtctccactgaga

SEQ ID NO: 49650 - DNA, 75 bp, Artificial Sequence
  Synthetic
tcagacaggaggtcctatagctcaagcaagagtagaattcgtagcatttttggaagatacaattctcagaaaaaa

SEQ ID NO: 49651 - DNA, 75 bp, Artificial Sequence
  Synthetic
ctcctattctttctgtgagaacgtgccgaaccttgacaggtttgtattccagatggctggtgcaaccgatgatgc

SEQ ID NO: 49652 - DNA, 75 bp, Artificial Sequence
  Synthetic
atctgaatcctcagcacagcagacaaccccaagcccaatgacttccccagcgcaatcgatccttctaatgagtgc

SEQ ID NO: 49653 - DNA, 75 bp, Artificial Sequence
  Synthetic
gagcctgaagctggacttgttggcttgagtttggaagactacctcaagaggatgctgtctgacaacgagtgggga

SEQ ID NO: 49654 - DNA, 75 bp, Artificial Sequence
  Synthetic
gccctggttgaggccaccaagtactgtgctcccatatatgaatgtgcctgggttagctccacaggtatagtgaag

SEQ ID NO: 49655 - DNA, 75 bp, Artificial Sequence
  Synthetic
gtgctcccatatatgaatgtgcctgggttagctccacaggtatagtgaagagaggccttgagtggtttgaaaaaa

SEQ ID NO: 49656 - DNA, 75 bp, Artificial Sequence
  Synthetic
tttaactctatctcaaggtctaaagaaatactacggtaagatactgaagcttctgcacctcaccttagaagagga

SEQ ID NO: 49657 - DNA, 75 bp, Artificial Sequence
  Synthetic
agccacacaatgggctcttttgagttgatccaggcagtctcagagttcggcatgagtaagtttccccccgaaaat

SEQ ID NO: 49658 - DNA, 75 bp, Artificial Sequence
  Synthetic
gatgtgcccaaaattgaacagcttgccaactatcagcaggccgccctcaagtggaggaaggacataggcttccgc

SEQ ID NO: 49659 - DNA, 75 bp, Artificial Sequence
  Synthetic
ccaactatcagcaggccgccctcaagtggaggaaggacataggcttccgcgttaatgcaaacacagcggccctaa

SEQ ID NO: 49660 - DNA, 75 bp, Artificial Sequence
  Synthetic
atgatgacttctttcaaaagagaatagaagaattcttcatgactggtgagggctacttcaatgaagtcttacaat

SEQ ID NO: 49661 - DNA, 75 bp, Artificial Sequence
  Synthetic
agaagaattcttcatgactggtgagggctacttcaatgaagtcttacaatttaaaacactaagcacactaagccc

SEQ ID NO: 49662 - DNA, 75 bp, Artificial Sequence
  Synthetic
gtcaaagagatgctttcagacatgattagaaggaggaacctgatccttaacagaggaggtgatgagaacccaaga

SEQ ID NO: 49663 - DNA, 75 bp, Artificial Sequence
  Synthetic
ttagaaggaggaacctgatccttaacagaggaggtgatgagaacccaagaggcccagtaagcaaggagcacatag

SEQ ID NO: 49664 - DNA, 75 bp, Artificial Sequence
  Synthetic
gaccagagtcggtagggtcttggattgcatgttcaactgcaaattatgtgttgagatatcagctgatactttaat

SEQ ID NO: 49665 - DNA, 75 bp, Artificial Sequence
  Synthetic
ccctggggtgatgtcaacaagtccggccgctcaggaatagctctagttgctacaggtcttgccaaacttgcagaa

SEQ ID NO: 49666 - DNA, 75 bp, Artificial Sequence
  Synthetic
acacccagctaggatagcagaaacacctggacccaagacaacgagtctgaaaaccatcaactgtataaacctaag

SEQ ID NO: 49667 - DNA, 75 bp, Artificial Sequence
  Synthetic
gccgctcaggaatagctctagttgctacaggtcttgccaaacttgcagaaacagaaggaaagggagtttttgagg

SEQ ID NO: 49668 - DNA, 75 bp, Artificial Sequence
  Synthetic
gatgaggtggacaaggctagtgctgacagcatggtaacaaacctcctcaagcacatcactaaggcccaggaactc

SEQ ID NO: 49669 - DNA, 75 bp, Artificial Sequence
  Synthetic
ctgccatgttgtgatcaattcacatgtctgtgattactctttagacactgatgggccagtgaggcttcctcgcat

SEQ ID NO: 49670 - DNA, 75 bp, Artificial Sequence
  Synthetic
ctcagattgcagtcaacctctcaaactgccatgttgtgatcaattcacatgtctgtgattactctttagacactg

SEQ ID NO: 49671 - DNA, 75 bp, Artificial Sequence
  Synthetic
acagcatggtaacaaacctcctcaagcacatcactaaggcccaggaactctacaaaaactcatcagcactgagag

SEQ ID NO: 49672 - DNA, 75 bp, Artificial Sequence
  Synthetic
tctagaatgaaactctacgtcactaaggatttacttgaccatctagacgttggtgggctcttgagggccgctttc

SEQ ID NO: 49673 - DNA, 75 bp, Artificial Sequence
  Synthetic
aaagcgggcgtgactccagaaaccttccccaccgtctctcaattcctctttgagctgggaaagcagccaagaggc

SEQ ID NO: 49674 - DNA, 75 bp, Artificial Sequence
  Synthetic
tccccaccgtctctcaattcctctttgagctgggaaagcagccaagaggcactaaaaaaatgaagaaggcacttc

SEQ ID NO: 49675 - DNA, 75 bp, Artificial Sequence
  Synthetic
acaggctttaggaaactactgtccgaagagccaggtgatgactgcatatcaagaactcagctattgaggacagaa

SEQ ID NO: 49676 - DNA, 75 bp, Artificial Sequence
  Synthetic
gactctttccagcaaaacaggatctacatgcaccctgctgtgctgacagctggcagaattagtgagatgggtgtt

SEQ ID NO: 49677 - DNA, 75 bp, Artificial Sequence
  Synthetic
acatgcaccctgctgtgctgacagctggcagaattagtgagatgggtgtttgctttggaaccatccctgttgcca

SEQ ID NO: 49678 - DNA, 75 bp, Artificial Sequence
  Synthetic
aagaactcagctattgaggacagaaacagcagagatccatgatgacaactatggtggtccaggtgataaaataac

SEQ ID NO: 49679 - DNA, 75 bp, Artificial Sequence
  Synthetic
tatctgcaacggttcaaccattgtagatcagagactgggcagtgaactagggtgttataccatcaacagggtgaa

SEQ ID NO: 49680 - DNA, 75 bp, Artificial Sequence
  Synthetic
ctccgaacaaatagtgaaactaacaatccttgtgctaaaacgattgtcaaacttttcgaagttcaaaaaacagga

SEQ ID NO: 49681 - DNA, 75 bp, Artificial Sequence
  Synthetic
acactgatgttgaattcaaccacagggagatagctgatctcaatcaattaacttctcggctcatcacattaagaa

SEQ ID NO: 49682 - DNA, 75 bp, Artificial Sequence
  Synthetic
atccttgtgctaaaacgattgtcaaacttttcgaagttcaaaaaacaggattcaacatacaggacatggatattg

SEQ ID NO: 49683 - DNA, 75 bp, Artificial Sequence
  Synthetic
acagcactccggttaagtgcaggcaaggtttttgtttaaaaatcacccaagagggaaggggccacgtaaaattat

SEQ ID NO: 49684 - DNA, 75 bp, Artificial Sequence
  Synthetic
ttgtatcgaagagatgatgaagaactaacaaacggctcaaatttaaaacttgggttcttagtgaagtatgctgtc

SEQ ID NO: 49685 - DNA, 75 bp, Artificial Sequence
  Synthetic
ttccaaaatgcttacaacgtcaaaggcaatgccaccagtgccaacattatctaaatctccagagtttttttctat

SEQ ID NO: 49686 - DNA, 75 bp, Artificial Sequence
  Synthetic
caaacgcggaggagtttgtcatatctgagttctttaagaagaaggacattatgaaattcatcagcacttcaggca

SEQ ID NO: 49687 - DNA, 75 bp, Artificial Sequence
  Synthetic
gagggaaggggccacgtaaaattatctagaggctcagaggttgtcctggatgcttgcgactcaagctgtgaagta

SEQ ID NO: 49688 - DNA, 75 bp, Artificial Sequence
  Synthetic
gcaacatttcttaaaagacaacttaattgacctagggtgcccccatatcccgctattgggtaagatggctattta

SEQ ID NO: 49689 - DNA, 75 bp, Artificial Sequence
  Synthetic
taatgtcctatcctatgcacataatctttatttgagtaagtcaagcttaaatatgacctctgaagacatctcaca

SEQ ID NO: 49690 - DNA, 75 bp, Artificial Sequence
  Synthetic
ctttttgcagttaccaaaacctattttatcttgctttattctattttgcttcatactattatattcttcttttac

SEQ ID NO: 49691 - DNA, 75 bp, Artificial Sequence
  Synthetic
ttatcttgctttattctattttgcttcatactattatattcttcttttacatattaaagggctgtgcggcaacga

SEQ ID NO: 49692 - DNA, 75 bp, Artificial Sequence
  Synthetic
tctcaaagaaatacttgcggcacgtcagtacgtaagtgttaactttgagtgtgtgtgaaaagcgatttgtgagga

SEQ ID NO: 49693 - DNA, 75 bp, Artificial Sequence
  Synthetic
ggttcagctttggctatgttatcacctgtatatcttgcaaggctcttttttattcattgataattattggaacac

SEQ ID NO: 49694 - DNA, 75 bp, Artificial Sequence
  Synthetic
gtgtgtgaaaagcgatttgtgaggaacatgtttctccacttcaaatttgtgttgttgactaacttcttcttttgt

SEQ ID NO: 49695 - DNA, 75 bp, Artificial Sequence
  Synthetic
ttgtttgctatattgcctcctgactgcgcaagagagtgtgaagtcctcttcgatgacataagaaactctccaacg

SEQ ID NO: 49696 - DNA, 75 bp, Artificial Sequence
  Synthetic
ttaccagtggaggtgggaccaatactagctcaacacaagccatcctaatatcttcaaacactccaaatagtacaa

SEQ ID NO: 49697 - DNA, 75 bp, Artificial Sequence
  Synthetic
tccgattaaaagggactgcatacgaaggtctgtttgcaaactgttacggctggcaatacattccagaagacatta

SEQ ID NO: 49698 - DNA, 75 bp, Artificial Sequence
  Synthetic
caactgtagttacaatatatgcccttattgtgcatcaagattgacctccgatgggctagccaggcatgtaacgca

SEQ ID NO: 49699 - DNA, 75 bp, Artificial Sequence
  Synthetic
acgaccatcaatacaccggacacacaggtcaccacagacagtggttctggtgaatccagcacagacccccagacc

SEQ ID NO: 49700 - DNA, 75 bp, Artificial Sequence
  Synthetic
aggtcaccacagacagtggttctggtgaatccagcacagacccccagaccaccaacggagaagtaccttccactt

SEQ ID NO: 49701 - DNA, 75 bp, Artificial Sequence
  Synthetic
gatttcctggatcgaacccagttgcatccagagttcagggatctaactccagacttttcactcacacaaaaggtt

SEQ ID NO: 49702 - DNA, 75 bp, Artificial Sequence
  Synthetic
aaagctattgcaggtgtcagagtccactggtgtggcattaaaacgaagcagctggctgattgtactgcttgtgtt

SEQ ID NO: 49703 - DNA, 75 bp, Artificial Sequence
  Synthetic
gtgtcgaaaatgtgcaaatctccatagatgcaacgttgcctgaatctgtggaagcagtgccggtgacagaaagaa

SEQ ID NO: 49704 - DNA, 75 bp, Artificial Sequence
  Synthetic
ctaagtaccacagctggctcaggtgcatccactccaggcaacaccacatcaaacaaaccagatgtcaacttactc

SEQ ID NO: 49705 - DNA, 75 bp, Artificial Sequence
  Synthetic
agacaatcgaaatatatcagaccagggaaggattcgcaagcatctgtctctttatgttaggaagcattctattta

SEQ ID NO: 49706 - DNA, 75 bp, Artificial Sequence
  Synthetic
ggaaggattcgcaagcatctgtctctttatgttaggaagcattctatttatagtctcttgcttggtgaaagggct

SEQ ID NO: 49707 - DNA, 75 bp, Artificial Sequence
  Synthetic
catcacccagccctagcaaaacatcgacaccgcaaactgcacatcatctctccagaagtcttctctcagcagcaa

SEQ ID NO: 49708 - DNA, 75 bp, Artificial Sequence
  Synthetic
acaaccatgagcagtccaacaacagtcaaaaacagtgcaacagccacaccaacccaaggcatcaccaccagcaac

SEQ ID NO: 49709 - DNA, 75 bp, Artificial Sequence
  Synthetic
ctgaacacgagagcaccagcatctctgcctttaaagactacggagagagagggatagtcgaggaaaaccacatga

SEQ ID NO: 49710 - DNA, 75 bp, Artificial Sequence
  Synthetic
ctttgaaattgaatcgcacaaatgctactgtagcctattttgctgcccctactgcaggcactgctctgctgacag

SEQ ID NO: 49711 - DNA, 75 bp, Artificial Sequence
  Synthetic
agaaattcaccagttacacttgagtatctgcaaaaaaaggaaaacggggagcaatgtcatgctggccgtctgcaa

SEQ ID NO: 49712 - DNA, 75 bp, Artificial Sequence
  Synthetic
aacaacacagagccaacagactgcaacaccagcaataacacctgccaccactgctattgcattcataagccctac

SEQ ID NO: 49713 - DNA, 75 bp, Artificial Sequence
  Synthetic
ggaaaataaggacagatcacaagaagtggaaagatatattaaagctattagagttgctaggaatcaaatgctcat

SEQ ID NO: 49714 - DNA, 75 bp, Artificial Sequence
  Synthetic
gaagcaagcagaagagccctgctcatccgaagcattatcaataccacttttgtaatatgcattctaacattgaca

SEQ ID NO: 49715 - DNA, 75 bp, Artificial Sequence
  Synthetic
aaggcctcaagaaatattatagcaagatactgaaactcctacacctgacgcaagaagaagattctgaaggtctac

SEQ ID NO: 49716 - DNA, 75 bp, Artificial Sequence
  Synthetic
tggagatggaaaaccttccagcaggaacttgggagagggaggaagatctgacaaatttctgtcatcaggaatgcc

SEQ ID NO: 49717 - DNA, 75 bp, Artificial Sequence
  Synthetic
tcggaggacagagtgcgagtcttaaaaaattcagtcagcttcttattcaataaactctccagaaactcacctaca

SEQ ID NO: 49718 - DNA, 75 bp, Artificial Sequence
  Synthetic
acaaatttctgtcatcaggaatgccaggtaactgagacagaatgcctctgtccatacgaagctcttgtgctcaga

SEQ ID NO: 49719 - DNA, 75 bp, Artificial Sequence
  Synthetic
aatgaaaggatagaagaatttttcataaccggaaaaggctacttcaatgatgttttgcagttcaggctgtatgac

SEQ ID NO: 49720 - DNA, 75 bp, Artificial Sequence
  Synthetic
ggagcacatactcaacagaccaacaggactgacactgcccaccagtttggaacaggcaatgcgcaaaggactggt

SEQ ID NO: 49721 - DNA, 75 bp, Artificial Sequence
  Synthetic
agaatacttcgcccacagccaagcctttcaggtcatactatgccaaagggtctctaacctttgactcaggctatt

SEQ ID NO: 49722 - DNA, 75 bp, Artificial Sequence
  Synthetic
tctctaacctttgactcaggctatttctctgctaaatgttatccaagggcatcgaactcaggattgcagctaatt

SEQ ID NO: 49723 - DNA, 75 bp, Artificial Sequence
  Synthetic
atctaatcctaagaccatcaactgtattaacttgaaagtgtcaactgacaaggatcatagcaagcttgagatcaa

SEQ ID NO: 49724 - DNA, 75 bp, Artificial Sequence
  Synthetic
aaacatgaacttacacagaatattaccacaagtgagaagatgctattgagttggctgagtgaggacatcaaatca

SEQ ID NO: 49725 - DNA, 75 bp, Artificial Sequence
  Synthetic
attaacttgaaagtgtcaactgacaaggatcatagcaagcttgagatcaacgtgcttctaccacaagttgctgtt

SEQ ID NO: 49726 - DNA, 75 bp, Artificial Sequence
  Synthetic
tttgaacactgatgggacaataaagctcccgaaaattgcacataatggggcttttataccaggtacttacaaaat

SEQ ID NO: 49727 - DNA, 75 bp, Artificial Sequence
  Synthetic
ctcccgaaaattgcacataatggggcttttataccaggtacttacaaaattgtaatagataagaaaaacaaattg

SEQ ID NO: 49728 - DNA, 75 bp, Artificial Sequence
  Synthetic
tctaatgtgtgcaaaagatgccccaagattgaagtggtcagccattgtgaaaataaaggctttgaggacagcaat

SEQ ID NO: 49729 - DNA, 75 bp, Artificial Sequence
  Synthetic
ctgcacctgctgcggggtggatgtaaaagatctttttacagatcacatgtttgtcaaatggaaagttgaatacat

SEQ ID NO: 49730 - DNA, 75 bp, Artificial Sequence
  Synthetic
ccgaagagggcagtcagctctgaggcagtacagaacagaaataagaatcgggcaaacatttacaggctcgagaag

SEQ ID NO: 49731 - DNA, 75 bp, Artificial Sequence
  Synthetic
cagtacagaacagaaataagaatcgggcaaacatttacaggctcgagaagattgcttgcagagggggggagcaat

SEQ ID NO: 49732 - DNA, 75 bp, Artificial Sequence
  Synthetic
gcagtctgattgaggcaggtactagattcaacttgggccctgtgactattaccctgtctgagccaagaaacattc

SEQ ID NO: 49733 - DNA, 75 bp, Artificial Sequence
  Synthetic
cgtaatgtggaatatcttataaaactgatgatgagcatgtcaggcattgattgtataaaatatcccacaggacag

SEQ ID NO: 49734 - DNA, 75 bp, Artificial Sequence
  Synthetic
ttgtataaaatatcccacaggacagcttatcacccatggaagagtgagtgcaaaacataacgatggaaacttgaa

SEQ ID NO: 49735 - DNA, 75 bp, Artificial Sequence
  Synthetic
tgaagacagttacggtggtcctggcgaaaaaatcacaatttgcaacggctccacaatagtggatcaaaggcttgg

SEQ ID NO: 49736 - DNA, 75 bp, Artificial Sequence
  Synthetic
caaaacataacgatggaaacttgaaagatagaagtgatgacgaccaaagactagctgagaagatagatgctgtta

SEQ ID NO: 49737 - DNA, 75 bp, Artificial Sequence
  Synthetic
ggcttctttgacttgatgcatgtacaaaaagtgttgtctgcaagtacagtgtgtaaactgcagagttgcacacat

SEQ ID NO: 49738 - DNA, 75 bp, Artificial Sequence
  Synthetic
ggctaagagatggtaaaagaagagggaatctagaactagcaaacagaatccaatcggtactatgtgttctaatag

SEQ ID NO: 49739 - DNA, 75 bp, Artificial Sequence
  Synthetic
gaaaaaatcacaatttgcaacggctccacaatagtggatcaaaggcttggcagcgaattaggttgctatacaata

SEQ ID NO: 49740 - DNA, 75 bp, Artificial Sequence
  Synthetic
aaaaagtgttgtctgcaagtacagtgtgtaaactgcagagttgcacacatggtataccaggagatctacaagttt

SEQ ID NO: 49741 - DNA, 75 bp, Artificial Sequence
  Synthetic
ctgtgaaatagacagtgttccagttaaatgcaaacaggggttctgcctcaaaataactcaggaaggtaggggtca

SEQ ID NO: 49742 - DNA, 75 bp, Artificial Sequence
  Synthetic
aaatgcaaacaggggttctgcctcaaaataactcaggaaggtaggggtcatgtgaaattgtctagagggacagaa

SEQ ID NO: 49743 - DNA, 75 bp, Artificial Sequence
  Synthetic
acctctcaaggcaaggtaaatcaaagtgttctgtgccaagatcttggctcgagaagatactgtttgacctaaagg

SEQ ID NO: 49744 - DNA, 75 bp, Artificial Sequence
  Synthetic
cactggggatatattggtggactgctcaggagggcagcaacactttttacaggacaatctaattgacttgggatg

SEQ ID NO: 49745 - DNA, 75 bp, Artificial Sequence
  Synthetic
tgcatttgtaaacttgcttaacattgaaactgattacacgaaaaccttccacttccactctaaaagagttacagc

SEQ ID NO: 49746 - DNA, 75 bp, Artificial Sequence
  Synthetic
tcaggagggcagcaacactttttacaggacaatctaattgacttgggatgcccaaatattccattgctaggtcaa

SEQ ID NO: 49747 - DNA, 75 bp, Artificial Sequence
  Synthetic
acgataaactactcataaggtcaaaagaagaattaaaaaaatgtttcgatgtgcagtcttttaagttgaagaaaa

SEQ ID NO: 49748 - DNA, 75 bp, Artificial Sequence
  Synthetic
ttttctgttttggttcagttttggctatgtcatcacatgtgtagtgtgcaaggtgctcttctatttgctaattgt

SEQ ID NO: 49749 - DNA, 75 bp, Artificial Sequence
  Synthetic
tatgtcatcacatgtgtagtgtgcaaggtgctcttctatttgctaattgtcatcgggacactaggaaaaaggctg

SEQ ID NO: 49750 - DNA, 75 bp, Artificial Sequence
  Synthetic
ttggcacaccttatgagggaattgtagacaccttagtttctctgattaatgtgttaacaaggttcacctggttcc

SEQ ID NO: 49751 - DNA, 75 bp, Artificial Sequence
  Synthetic
ccctgtcaatgcaatagatgctgaaatgcatgatcttaactgcaactacaacatatgcccttactgtgcatccag

SEQ ID NO: 49752 - DNA, 75 bp, Artificial Sequence
  Synthetic
actgacctcagatggcctcgtcaggcacgtaactcaatgtcccaaacggaaagagaaggtcgaagaaactgaact

SEQ ID NO: 49753 - DNA, 75 bp, Artificial Sequence
  Synthetic
cagcacattcaaggccttttcagctatgcccaaaacctctttatgtttttacattgtggagagagaatactgcaa

SEQ ID NO: 49754 - DNA, 75 bp, Artificial Sequence
  Synthetic
gctgtctatatagtagcaacatggaactcttacaaggacccttctacttgaataggagacaagctgtccttggtt

SEQ ID NO: 49755 - DNA, 75 bp, Artificial Sequence
  Synthetic
atgcccaaaacctctttatgtttttacattgtggagagagaatactgcaagagctgcagtgaagatgatacacaa

SEQ ID NO: 49756 - DNA, 75 bp, Artificial Sequence
  Synthetic
tgtcggagtcaacaggagtggctctgaagagaagctgctggataatcacactccttattctgctgactgtttcaa

SEQ ID NO: 49757 - DNA, 75 bp, Artificial Sequence
  Synthetic
gtgtgaatgaaaaaacattgcaagacgttgaaaatcattccatgactctactagaggattcattcaaggaaatca

SEQ ID NO: 49758 - DNA, 75 bp, Artificial Sequence
  Synthetic
ctccttattctgctgactgtttcaatgtcaccagttcagtccgcaccggtaggccacaaaagggcagttgaagtc

SEQ ID NO: 49759 - DNA, 75 bp, Artificial Sequence
  Synthetic
gtatttgcctcttcgtgttaggaggtgttctcttcgcagtctcttggctggtgaaggccctgattgatagcatcg

SEQ ID NO: 49760 - DNA, 75 bp, Artificial Sequence
  Synthetic
tgttctcttcgcagtctcttggctggtgaaggccctgattgatagcatcggcaatagtttcttccctgggctttc

SEQ ID NO: 49761 - DNA, 75 bp, Artificial Sequence
  Synthetic
cagaggcttatttaagtatagacacctcaaagacgatgaggaaacaggctacagaaggattattgaaagactgaa

SEQ ID NO: 49762 - DNA, 75 bp, Artificial Sequence
  Synthetic
cacacaaatgctactgcagtctactctgctgtccttactgtagggcctgctcatcggacaaaatcactcaccgaa

SEQ ID NO: 49763 - DNA, 75 bp, Artificial Sequence
  Synthetic
ctgctgtccttactgtagggcctgctcatcggacaaaatcactcaccgaatgcatttgaatgtgtgcaaaaagag

SEQ ID NO: 49764 - DNA, 75 bp, Artificial Sequence
  Synthetic
ggaaaattgctgagctgttctccacaaaaacacacattggctaactcaacagaaagaacctcgaaggttgacagc

SEQ ID NO: 49765 - DNA, 75 bp, Artificial Sequence
  Synthetic
aaaaacacacattggctaactcaacagaaagaacctcgaaggttgacagcagtatgctgtctagtgtccttgctt

SEQ ID NO: 49766 - DNA, 75 bp, Artificial Sequence
  Synthetic
aagcaactattgaagcaaacaacagggctactttcatcagaaacatcataaactccacttttgtcatatgcatac

SEQ ID NO: 49767 - DNA, 75 bp, Artificial Sequence
  Synthetic
ggctactttcatcagaaacatcataaactccacttttgtcatatgcatactaatcctggtgatctgtgtagttag

SEQ ID NO: 49768 - DNA, 75 bp, Artificial Sequence
  Synthetic
tcacctaatctgcctcattatatccacaaataagctctgtgatgcttgaaactgccctagctctgcttgctctaa

SEQ ID NO: 49769 - DNA, 75 bp, Artificial Sequence
  Synthetic
acaaataagctctgtgatgcttgaaactgccctagctctgcttgctctaaccttaactttgactgcgtgccgcca

SEQ ID NO: 49770 - DNA, 75 bp, Artificial Sequence
  Synthetic
aggaagacctaacaaacttctgtcatcaggagtgtcaagtaacagaaactgaatgcctttgcccatatgaggcct

SEQ ID NO: 49771 - DNA, 75 bp, Artificial Sequence
  Synthetic
tcaggagtgtcaagtaacagaaactgaatgcctttgcccatatgaggccttaatgcttagaaagccactttcctt

SEQ ID NO: 49772 - DNA, 75 bp, Artificial Sequence
  Synthetic
cttaaactggagagtgaacatggacattagagcttctgactgcccattgtctagtcatgaagcaagtatacttag

SEQ ID NO: 49773 - DNA, 75 bp, Artificial Sequence
  Synthetic
aaacgagcttgtcaattgaagctccatggggggcaatcaatgttcaatcaaccttcaaaccaacaatttcagccg

SEQ ID NO: 49774 - DNA, 75 bp, Artificial Sequence
  Synthetic
agagaagggaagaagctgttgaagttaaacagtgaaacatccacagacacacagagcattgcttctgaagtgtca

SEQ ID NO: 49775 - DNA, 75 bp, Artificial Sequence
  Synthetic
gcagcctggtgatgggaactgcttctaccacagcatagctgagttgaccatgcccaacaaaacagctcactcata

SEQ ID NO: 49776 - DNA, 75 bp, Artificial Sequence
  Synthetic
ccaacatagcacttagctggagttcagttgaacacaagggcaacaagatcttagtttcaggcagatcagagtcaa

SEQ ID NO: 49777 - DNA, 75 bp, Artificial Sequence
  Synthetic
agaagaagccttatttgggaacaacctgcaagttcaacacttggggagactcaaacaggtctggtaagtttacat

SEQ ID NO: 49778 - DNA, 75 bp, Artificial Sequence
  Synthetic
gacagaaggtcttatagttcaagtaagagtagaatccgtagtatctttggaagatacaactctcagaagaaacca

SEQ ID NO: 49779 - DNA, 75 bp, Artificial Sequence
  Synthetic
aagatacaactctcagaagaaaccatttgaattaaggtcaggtcttgaggttttcaatgatcctttcaatgatta

SEQ ID NO: 49780 - DNA, 75 bp, Artificial Sequence
  Synthetic
ttatgaaattagaagaaagaactggaatcagctggtgtctaggtgtggaagatgcttctgaatcaaaaacactca

SEQ ID NO: 49781 - DNA, 75 bp, Artificial Sequence
  Synthetic
ctgtttctgttatggatctgtctcaaatgtattctcctgttttcgagtacctgtcaggtgaccgacaggtggagg

SEQ ID NO: 49782 - DNA, 75 bp, Artificial Sequence
  Synthetic
agtggccaaaagcaacctgcacaggtgactgtccagaaagatgtggctgcacttcatcaacctgcctacataagg

SEQ ID NO: 49783 - DNA, 75 bp, Artificial Sequence
  Synthetic
tgactgtccagaaagatgtggctgcacttcatcaacctgcctacataaggagtggccgcactcgaggaactggcg

SEQ ID NO: 49784 - DNA, 75 bp, Artificial Sequence
  Synthetic
tcctcggctactaaaatttgtacctctcaagaaggggctagcagtggtgaagattaaaaaacaaattttgacagt

SEQ ID NO: 49785 - DNA, 75 bp, Artificial Sequence
  Synthetic
ggctagatgtaaaggatctcttcacagactacatgttggttaaatggaaagtggaatatataaaaacagaagcca

SEQ ID NO: 49786 - DNA, 75 bp, Artificial Sequence
  Synthetic
actgggttagcatctctgaagtgacagaaacaacaagtatagttgcatcacctagaactcatatgatgctcaagg

SEQ ID NO: 49787 - DNA, 75 bp, Artificial Sequence
  Synthetic
agactacatgttggttaaatggaaagtggaatatataaaaacagaagccataatatgtgttgagcttactagtca

SEQ ID NO: 49788 - DNA, 75 bp, Artificial Sequence
  Synthetic
tgagaataagaagatagtcaaaatgcttcgagggaagctaaaaaaactcggtgctatctcaacaaacatagagat

SEQ ID NO: 49789 - DNA, 75 bp, Artificial Sequence
  Synthetic
gacatggatgcttgtccattgtttatgatgaaaccgacactcagaccacataccatgaaaacctcttaaaggtga

SEQ ID NO: 49790 - DNA, 75 bp, Artificial Sequence
  Synthetic
ctgtgacaataactctatcagaaccaaggaacgtacagcagaggcttccccccgagatcattacactgcacccta

SEQ ID NO: 49791 - DNA, 75 bp, Artificial Sequence
  Synthetic
aaggaacgtacagcagaggcttccccccgagatcattacactgcaccctaaaatagaagaagggttttttgattt

SEQ ID NO: 49792 - DNA, 75 bp, Artificial Sequence
  Synthetic
gctgtactcacggtgtgcctggagacttacaagtctaccatgttggcaacttgttaaagggggacaaagtcaatg

SEQ ID NO: 49793 - DNA, 75 bp, Artificial Sequence
  Synthetic
cttacaagtctaccatgttggcaacttgttaaagggggacaaagtcaatgggcactcaatccacaagatagaatc

SEQ ID NO: 49794 - DNA, 75 bp, Artificial Sequence
  Synthetic
acagctagggcacaaactgctgacacgagataaacaaattaagcaagaattctctagaatgaaactttatgtcac

SEQ ID NO: 49795 - DNA, 75 bp, Artificial Sequence
  Synthetic
gagactcaaattcatgaatgtacactctccagaattgatgccggaaaattgtctcttttctagtgaggaattcaa

SEQ ID NO: 49796 - DNA, 75 bp, Artificial Sequence
  Synthetic
tttgcaacatgggggactggccctcatgcacatacacaggggtgacacaacacaaccgtgctgcattcatcaaca

SEQ ID NO: 49797 - DNA, 75 bp, Artificial Sequence
  Synthetic
aggagctgaaacaggaccttttgatatcttcttggatcaagtgcataacagcttgtaaagattttgcaagcatca

SEQ ID NO: 49798 - DNA, 75 bp, Artificial Sequence
  Synthetic
tgcttaacattgagactgattacacaaaaacttttcactttcattcaaaaagggtcacagcacacggagacaccc

SEQ ID NO: 49799 - DNA, 75 bp, Artificial Sequence
  Synthetic
aggcttcaacaatgtgcttgtaaacattgacagaaacacagtgaaaagtgaacttctgtggaaatttacgttaga

SEQ ID NO: 49800 - DNA, 75 bp, Artificial Sequence
  Synthetic
aacttctgtggaaatttacgttagacaccaatgtaagtactacaagtaccatcaaggatgtgaggacactggtat

SEQ ID NO: 49801 - DNA, 75 bp, Artificial Sequence
  Synthetic
gttctagtggaagttgcagatttagaactacacacgaagaaaattgaagtgtcgggtctgaaattcgcaagtttg

SEQ ID NO: 49802 - DNA, 75 bp, Artificial Sequence
  Synthetic
caaagcttaagcaagagcatcctagtgtcagcttcacaaaagaagaggtcttaataaagcggttggagaaaaatt

SEQ ID NO: 49803 - DNA, 75 bp, Artificial Sequence
  Synthetic
gtcgggtctgaaattcgcaagtttgacatgctctggatgttatgcttgcagctctggcatctcctgcaaagttag

SEQ ID NO: 49804 - DNA, 75 bp, Artificial Sequence
  Synthetic
aacaagcttcagaattgctttagaaccataagccctgttagcttacttgcattaagaaatctggactttgactgt

SEQ ID NO: 49805 - DNA, 75 bp, Artificial Sequence
  Synthetic
tttgcagccctttcagctccttggtgcttacactataaagcactagagtcttatttggtgagacatccagaaata

SEQ ID NO: 49806 - DNA, 75 bp, Artificial Sequence
  Synthetic
ttcacagtacatgtaaaaagcaatgacccagatgttgtagcagcaggatcaagtctcatggctagaaagatagag

SEQ ID NO: 49807 - DNA, 75 bp, Artificial Sequence
  Synthetic
attaagaaatctggactttgactgtctaagtgtgcaagactataatggcatgatagaaagtatgtccaaattgga

SEQ ID NO: 49808 - DNA, 75 bp, Artificial Sequence
  Synthetic
gcttacactataaagcactagagtcttatttggtgagacatccagaaatacttgactgtggatctaaagaggatt

SEQ ID NO: 49809 - DNA, 75 bp, Artificial Sequence
  Synthetic
agggaaatagctgacctcaatcaattaacatctcggctcattacattaaggaaagagaaagacactgacctcctc

SEQ ID NO: 49810 - DNA, 75 bp, Artificial Sequence
  Synthetic
taccaaaaagatgatgaggagttgacaaatagttcaagtctgaaacttgggtttttagtgaaatatgctgttacc

SEQ ID NO: 49811 - DNA, 75 bp, Artificial Sequence
  Synthetic
ctttttcatcaatgccaaaaaactctctatgtttttacatagtagaaagagattattgtagcagctgtacagatg

SEQ ID NO: 49812 - DNA, 75 bp, Artificial Sequence
  Synthetic
gtttttagtgaaatatgctgttaccttgttcacatccaatggtgaacctttttcgctcagtcttaatgatggtgg

SEQ ID NO: 49813 - DNA, 75 bp, Artificial Sequence
  Synthetic
cttattgaacacaaaggaacgattattggcaagcaaaatgacacctgtccaactaaaacaagctgctggttggaa

SEQ ID NO: 49814 - DNA, 75 bp, Artificial Sequence
  Synthetic
cggtaatattttcttaggcatgctcctgtttcttgctccttttgtattgctaatattgtttttcttcttcgggtg

SEQ ID NO: 49815 - DNA, 75 bp, Artificial Sequence
  Synthetic
ctgtttcttgctccttttgtattgctaatattgtttttcttcttcgggtggagacttctcttttgccttaagtgc

SEQ ID NO: 49816 - DNA, 75 bp, Artificial Sequence
  Synthetic
taatattgtttttcttcttcgggtggagacttctcttttgccttaagtgctgtagaaggactagaaagctgctaa

SEQ ID NO: 49817 - DNA, 75 bp, Artificial Sequence
  Synthetic
tgtatgctcttcaagaagattctgaagtagagccgatagccataatttgtgatggcatagaaagcaatatgaaac

SEQ ID NO: 49818 - DNA, 75 bp, Artificial Sequence
  Synthetic
ctgtgcaagagaatgtgaagtcctctttgatgacataagaaactctccaacgcacagtacagcctggaagcatgc

SEQ ID NO: 49819 - DNA, 75 bp, Artificial Sequence
  Synthetic
gaaaggctaaatgacaagaagggcaaaagtcgattgtttgatggagaaaggcttgcagacagaaagattgccgaa

SEQ ID NO: 49820 - DNA, 75 bp, Artificial Sequence
  Synthetic
aaagtcgattgtttgatggagaaaggcttgcagacagaaagattgccgaactcttttcaactaaaactcatgtag

SEQ ID NO: 49821 - DNA, 75 bp, Artificial Sequence
  Synthetic
tgcaagagactgggactaaagtcatgcatgcaaccactgaaatgtttagtagaaatcttttaaagacaacatcag

SEQ ID NO: 49822 - DNA, 75 bp, Artificial Sequence
  Synthetic
tgctacatactcttcctaaccaaacatgctccaactattgcaccttcaactaccttttatcgctttaaacttgta

SEQ ID NO: 49823 - DNA, 75 bp, Artificial Sequence
  Synthetic
gtgtcttaagggaaagtaagacaatttataccatgccatttgctgacacctgaattttcaaataagtcagctgtt

SEQ ID NO: 49824 - DNA, 75 bp, Artificial Sequence
  Synthetic
acaatcaaccatgctgctcatcaccatcctggcttaacttctcttagacctaaccttgactgcgtgccgccacta

SEQ ID NO: 49825 - DNA, 75 bp, Artificial Sequence
  Synthetic
cctgacttctcgcttacacaaaaggttcacttcaaaaggaatcagatacccagtgttgaaaatgtgcaaatctca

SEQ ID NO: 49826 - DNA, 75 bp, Artificial Sequence
  Synthetic
atcttgacggtaagcccataagtgaaggtagtaacttagtcaatttttacaaagtcatatgcatctcgggtgata

SEQ ID NO: 49827 - DNA, 75 bp, Artificial Sequence
  Synthetic
acccacgttaacacagagagctctagtagtggtctttccctctgcgaaaccatggacttcttgagaaaccttgac

SEQ ID NO: 49828 - DNA, 75 bp, Artificial Sequence
  Synthetic
ttggttaacctttactatcctactattccactttctttgctgttcatgtccattttattatttctggggtgtggg

SEQ ID NO: 49829 - DNA, 75 bp, Artificial Sequence
  Synthetic
catggacttcttgagaaaccttgactggactcaagtgattgctggtcaatatgtgtccaaccctaggttcaacat

SEQ ID NO: 49830 - DNA, 75 bp, Artificial Sequence
  Synthetic
cagcctggtgatgggaactgcttctatcacagcatagctgagttaaccatacctaacaaaacagaccattcatat

SEQ ID NO: 49831 - DNA, 75 bp, Artificial Sequence
  Synthetic
ctcctactccttttgtgagagtgttccaaatctggacaggtttgtgtttcagatggccagtgccaccgatgatgc

SEQ ID NO: 49832 - DNA, 75 bp, Artificial Sequence
  Synthetic
gagcaacatagtgaagaggatctaagaagattgttaacagataatttagacagttgggacgggaacgacacagtt

SEQ ID NO: 49833 - DNA, 75 bp, Artificial Sequence
  Synthetic
tggaacaaggcaaccagcagagcgccgttgaacacgagagcccaagcatctcggccttcaaggactatggagaga

SEQ ID NO: 49834 - DNA, 75 bp, Artificial Sequence
  Synthetic
caggttgtgcagcaaaggaggtgtagagcaacatagtgaagaggatctaagaagattgttaacagataatttaga

SEQ ID NO: 49835 - DNA, 75 bp, Artificial Sequence
  Synthetic
actcccagtatgatgaaacattttggaaacacgcttgtagactcaagaactttacagctgcagtgcaaagatgct

SEQ ID NO: 49836 - DNA, 75 bp, Artificial Sequence
  Synthetic
caggattaacactgcctgccagtttggaacaggctatgcgcaaaggactggttgaaggtgtggtcatctctaagg

SEQ ID NO: 49837 - DNA, 75 bp, Artificial Sequence
  Synthetic
cacaaggtgcacagattgacactgccttcagctcatattactggctctacaaggctggtgtgactccagaaacct

SEQ ID NO: 49838 - DNA, 75 bp, Artificial Sequence
  Synthetic
agctggttgagtgaagatatcaaatcatcgagatgtactgagtgcctcaccaacataaagaaaaccgttgacgag

SEQ ID NO: 49839 - DNA, 75 bp, Artificial Sequence
  Synthetic
ctgaagtcattgctagagcagcccaaacacttcagatgaacagtgtatctatacagtcaagtagcttgaccacat

SEQ ID NO: 49840 - DNA, 75 bp, Artificial Sequence
  Synthetic
caacataaagaaaaccgttgacgagactgccaacctatctgagaagattgagctacttgcatacaaccttcaact

SEQ ID NO: 49841 - DNA, 75 bp, Artificial Sequence
  Synthetic
cccatgactcaggatcgtcatcctcaagcttctcttttgagctcaataggcctctgtctgaaactgaactacagt

SEQ ID NO: 49842 - DNA, 75 bp, Artificial Sequence
  Synthetic
aagcttctcttttgagctcaataggcctctgtctgaaactgaactacagttcattaaagcactaagtagtctcaa

SEQ ID NO: 49843 - DNA, 75 bp, Artificial Sequence
  Synthetic
ctggcaatacattccagaagacattaaaccaagcctgaccatgttgatacagactttgtttcctgacaagtttga

SEQ ID NO: 49844 - DNA, 75 bp, Artificial Sequence
  Synthetic
aaaccaagcctgaccatgttgatacagactttgtttcctgacaagtttgaagatttcttggatcgaacccagttg

SEQ ID NO: 49845 - DNA, 75 bp, Artificial Sequence
  Synthetic
gcaatgccaccagtgccaacattatctgaagctcagaatgctctgcacccagctttcccccttttgcactgctgt

SEQ ID NO: 49846 - DNA, 75 bp, Artificial Sequence
  Synthetic
ggtattacaggtcatttggaggagaaggaaccgagaaacaggtaaaggcatcattgaatagagacgacaataaaa

SEQ ID NO: 49847 - DNA, 75 bp, Artificial Sequence
  Synthetic
aggaaccgagaaacaggtaaaggcatcattgaatagagacgacaataaaatcatagaggatcctatgatacagct

SEQ ID NO: 49848 - DNA, 75 bp, Artificial Sequence
  Synthetic
taaaggatggtaaaagaagagggaatctagaactagcgaataggatccaatctgtactgtgtattctgatagcag

SEQ ID NO: 49849 - DNA, 75 bp, Artificial Sequence
  Synthetic
ctgttttattaacttcttcttattttctttcgttttaaacacttaaagggctgtgcggcaacgatatctttgaga

SEQ ID NO: 49850 - DNA, 75 bp, Artificial Sequence
  Synthetic
ttagaaaggttaggtgtttctagaatggaagtcgatgaactgatgccaagcattagtcctgatgacaccttagcc

SEQ ID NO: 49851 - DNA, 75 bp, Artificial Sequence
  Synthetic
cattagtcctgatgacaccttagcccagcttgtagcgaaaaaactcatcagcctaaatgtttcgacagaagaata

SEQ ID NO: 49852 - DNA, 75 bp, Artificial Sequence
  Synthetic
tgctttggaacaatccctgtggccaatcctgatgatgccgcccagggatccggacacaccaagtccattcttaat

SEQ ID NO: 49853 - DNA, 75 bp, Artificial Sequence
  Synthetic
cagcttgtagcgaaaaaactcatcagcctaaatgtttcgacagaagaatactcagctgaggtgtccagactcaaa

SEQ ID NO: 49854 - DNA, 75 bp, Artificial Sequence
  Synthetic
gttgactgtatactgtttaaagaagtggcagctgagtgcatgaagaggtacattggcacaccttatgaaggaatt

SEQ ID NO: 49855 - DNA, 75 bp, Artificial Sequence
  Synthetic
caagtatactcactggttggacacttttctgggctgctctgtctccatcaacaggcatactactgttaaagagcc

SEQ ID NO: 49856 - DNA, 75 bp, Artificial Sequence
  Synthetic
atatgtgagacctttctgagatgttgtacagagtttaatagatcaggggttaaactagttaagataaggcactgt

SEQ ID NO: 49857 - DNA, 75 bp, Artificial Sequence
  Synthetic
gtacagagtttaatagatcaggggttaaactagttaagataaggcactgtgacattaacctatcagtcaaactac

SEQ ID NO: 49858 - DNA, 75 bp, Artificial Sequence
  Synthetic
acggcctgagagaactatcagtaatacagagtcaccttaaagtctttgaaaatgagttcaccaacttaaatcttc

SEQ ID NO: 49859 - DNA, 75 bp, Artificial Sequence
  Synthetic
tggacataccaagtccattctcaacctccggactaacaccgagaccaacaatccatgtgccaggaccattgtcaa

SEQ ID NO: 49860 - DNA, 75 bp, Artificial Sequence
  Synthetic
cggaaaagaacggccttagtccagatctgcaacaagttgcaagatactcaaaccatttgaccttgctcagcagga

SEQ ID NO: 49861 - DNA, 75 bp, Artificial Sequence
  Synthetic
ttcgttttggcatgcttgcagggcttagtaggcttgtttgccctaatgagctaggaaaaaagttttcaacaagtt

SEQ ID NO: 49862 - DNA, 75 bp, Artificial Sequence
  Synthetic
tccgacaccggaatcgatgcaagcacatactctgtaaaatattggaaaattcttcactgcatctctgccattgga

SEQ ID NO: 49863 - DNA, 75 bp, Artificial Sequence
  Synthetic
agcacaaaaccaggagaagcatcaacaccaacaagcccaggggaagcaagcacagaggccagcagcccacaacca

SEQ ID NO: 49864 - DNA, 75 bp, Artificial Sequence
  Synthetic
tttgctctgacgaaaaaaaagatgccagaaccgcaaggttattactaggttgcccaaatgtgagaaaagctgcaa

SEQ ID NO: 49865 - DNA, 75 bp, Artificial Sequence
  Synthetic
aaactggttaagataaggcactgtgacattaacctatcagtcaaattgccatcaaataagaaagagaatatgtta

SEQ ID NO: 49866 - DNA, 75 bp, Artificial Sequence
  Synthetic
caagttcaacacctggggagactcaaatagatctggaaaattcacatacagcagcagatctggagaatccattgg

SEQ ID NO: 49867 - DNA, 75 bp, Artificial Sequence
  Synthetic
caaagagagcattttgaaggactgtcttcaaatcatacggaagaaccctagccacacaatgggttcttttgagct

SEQ ID NO: 49868 - DNA, 75 bp, Artificial Sequence
  Synthetic
gaactgggtcagcatttctgaagttactgaaacaacaagtatagttgcgtcacctaaaactcatatgatgctcaa

SEQ ID NO: 49869 - DNA, 75 bp, Artificial Sequence
  Synthetic
actgaaacaacaagtatagttgcgtcacctaaaactcatatgatgctcaaagactgctttaaaattatactaggt

SEQ ID NO: 49870 - DNA, 75 bp, Artificial Sequence
  Synthetic
tgcttagagggaagctaaaaaaactcggtgccatctcaacaaacatagagatcgggaaaagggattgcttggatc

SEQ ID NO: 49871 - DNA, 75 bp, Artificial Sequence
  Synthetic
atcgggaaaagggattgcttggatctacttagcacggtagatggtctgacagaccaacagaaagaaaacattgtg

SEQ ID NO: 49872 - DNA, 75 bp, Artificial Sequence
  Synthetic
cagagaagggaagaagctgttgaagttaaacagcgacacatccacagacacacagagcattgcttctgaagtgtc

SEQ ID NO: 49873 - DNA, 75 bp, Artificial Sequence
  Synthetic
gatcagaaagaacattgatgaagttttgcttactgaagatggaaatctgatcttctgctggctaaaaacaatctc

SEQ ID NO: 49874 - DNA, 75 bp, Artificial Sequence
  Synthetic
gtgatgccataatggaggtagagagcaaaagtagcttgctacacaagtacctcaaatcgggaggtgttaggcaac

SEQ ID NO: 49875 - DNA, 75 bp, Artificial Sequence
  Synthetic
caatgtaagcaccacaagtactataaaagacgtgagaacactggtgtcctacgttagcactgagaccatccctaa

SEQ ID NO: 49876 - DNA, 75 bp, Artificial Sequence
  Synthetic
tacttgactgtggatctaaagaggactgtaggcttactttgcttgatctgtcagtttctaagctcttagtttgtt

SEQ ID NO: 49877 - DNA, 75 bp, Artificial Sequence
  Synthetic
gtgtcagcttcacaaaagaagaggtcttaataaagcggctggagaaaaatttccttaagcagcataatctagaga

SEQ ID NO: 49878 - DNA, 75 bp, Artificial Sequence
  Synthetic
gcatctgcaagaaaaggaaaactgggagtaatgtcatgttagccgtctgtaagcgcatgtgctttagggcaactg

SEQ ID NO: 49879 - DNA, 75 bp, Artificial Sequence
  Synthetic
aatgtttctggacgagatgtcattacctgaacttaaatctttatccgtgaactgcaaaatggggaactttgaagg

SEQ ID NO: 49880 - DNA, 75 bp, Artificial Sequence
  Synthetic
cttatttggtgagacatccagaaatacttgactgtggatctaaagaggactgcaaactcactttgcttgatctgt

SEQ ID NO: 49881 - DNA, 75 bp, Artificial Sequence
  Synthetic
tgttgacatggaaaaaaagagggaagcggttagagcagtagaagatttaattttaatgttgacaggtaaagcaat

SEQ ID NO: 49882 - DNA, 75 bp, Artificial Sequence
  Synthetic
gaacagggaatctcggctttaactgggattcagattgaacatgccgcttgtgagccattaatacccatcggtgtc

SEQ ID NO: 49883 - DNA, 75 bp, Artificial Sequence
  Synthetic
tgagccattaatacccatcggtgtctcaaggaaaattgaggcagttttagccgcaccactcattgacatcaaaac

SEQ ID NO: 49884 - DNA, 75 bp, Artificial Sequence
  Synthetic
tcaaggaaaattgaggcagttttagccgcaccactcattgacatcaaaaccttcaaacaagccaactgctctgca

SEQ ID NO: 49885 - DNA, 75 bp, Artificial Sequence
  Synthetic
cttcaaacaagccaactgctctgcattcctctcagtcaactcaattgctttaactgatccactttgcaaacctac

SEQ ID NO: 49886 - DNA, 75 bp, Artificial Sequence
  Synthetic
gaaggtagcaacctggtcaatttctacaaagtcatatgtatctcgggtgataacactaaatggggcccgatacat

SEQ ID NO: 49887 - DNA, 75 bp, Artificial Sequence
  Synthetic
ctctctttctcaaccatttatttcagtttcatcattgttattattttggggtgtggggggaacgatttctttgag

SEQ ID NO: 49888 - DNA, 75 bp, Artificial Sequence
  Synthetic
cttgcagctatatggtctggggggaactcttagatcaaacaacggaaccgaacacaacaaaacaaatgttttgac

SEQ ID NO: 49889 - DNA, 75 bp, Artificial Sequence
  Synthetic
tagagcaatatagtgaagaggatctaaggaaactgttggcagataatttagacagttgggacggaaatgacacag

SEQ ID NO: 49890 - DNA, 75 bp, Artificial Sequence
  Synthetic
ctgttacgccagactcctccactgtcacacccacaacaccagccagtggactggaaggctcgggggaagtgtaca

SEQ ID NO: 49891 - DNA, 75 bp, Artificial Sequence
  Synthetic
cacacccacaacaccagccagtggactggaaggctcgggggaagtgtacacatcccccccaatcaccaccaaggg

SEQ ID NO: 49892 - DNA, 75 bp, Artificial Sequence
  Synthetic
agttacaaccatatgggtcagggtattcaccatgcaacatcttcagtattaacttctctagctgctgtgctcttt

SEQ ID NO: 49893 - DNA, 75 bp, Artificial Sequence
  Synthetic
agttttttttatggactaaagaatatgcttagtggcatttttggcaatgttttcatagggattttcttattcctc

SEQ ID NO: 49894 - DNA, 75 bp, Artificial Sequence
  Synthetic
gcatctcaagtgcaagtggtgtcgatttcagcacacaggcagccagagacacctcaacactaacagttctcacaa

SEQ ID NO: 49895 - DNA, 75 bp, Artificial Sequence
  Synthetic
cctgtgaggagtctactttcagtcacgagccccaggccagaagagacaacagcaccgtcaaaatcaggcaaagag

SEQ ID NO: 49896 - DNA, 75 bp, Artificial Sequence
  Synthetic
cgagccccaggccagaagagacaacagcaccgtcaaaatcaggcaaagagagtccagcagccaacagctctcacc

SEQ ID NO: 49897 - DNA, 75 bp, Artificial Sequence
  Synthetic
atttcacagctgcggtacaaagatgttgtcaaatgaaagatagtgccaaaactttagtgagcgactgtttccttg

SEQ ID NO: 49898 - DNA, 75 bp, Artificial Sequence
  Synthetic
gaaaacagcagccacaacaccaccggtcagcttgagtccatgacacaatcaacaaccctagtcccaatggcctct

SEQ ID NO: 49899 - DNA, 75 bp, Artificial Sequence
  Synthetic
gtcagcttgagtccatgacacaatcaacaaccctagtcccaatggcctctccaacacagacagtcctttcacaaa

SEQ ID NO: 49900 - DNA, 75 bp, Artificial Sequence
  Synthetic
tctaaaagaaaccttgaaatggagataatcttaactttacctcagggtttaaaaaagtactatggtaaggtgctc

SEQ ID NO: 49901 - DNA, 75 bp, Artificial Sequence
  Synthetic
tcaaaatagaattacaggtctttattgcaatagcaacgaaggacctcttgataggcataatgttatttacagcag

SEQ ID NO: 49902 - DNA, 75 bp, Artificial Sequence
  Synthetic
tgctgaagtcattgctagagcagctcaaacacttcacatgaacagtgtatcgatacagtcaagcagcttgaccac

SEQ ID NO: 49903 - DNA, 75 bp, Artificial Sequence
  Synthetic
tgtgatgatactttctttcaaaagagaattgaagaattcttcataactggtgagggtcatttcaatgaagttcta

SEQ ID NO: 49904 - DNA, 75 bp, Artificial Sequence
  Synthetic
cgatacagtcaagcagcttgaccacattagacagcttaggttgcagcaggacaagttccacagttgaagatagca

SEQ ID NO: 49905 - DNA, 75 bp, Artificial Sequence
  Synthetic
gtcaccaacagctgaaccctttaaatcttatttcgctaaaggcttcctttcaatagattcaggttacttctcagc

SEQ ID NO: 49906 - DNA, 75 bp, Artificial Sequence
  Synthetic
ggcctctgtctgaaaccgaactacaattcattaaagcattaagtagcctcaaatccacacaagcctgtgaagtta

SEQ ID NO: 49907 - DNA, 75 bp, Artificial Sequence
  Synthetic
tcagggcttcggctgatcaatgtcactcgacattcaactagaatagctgacacacctgggcccaagatcaccaac

SEQ ID NO: 49908 - DNA, 75 bp, Artificial Sequence
  Synthetic
ttgcatgttcaactgcaaattatgtgttgagatatcagctgacactttaattctaaggccagaatcaaaagagaa

SEQ ID NO: 49909 - DNA, 75 bp, Artificial Sequence
  Synthetic
gataggcacaatgttatttatagcagcagaatggcagattcttgtgattggctgagagatggtaagagaagaggg

SEQ ID NO: 49910 - DNA, 75 bp, Artificial Sequence
  Synthetic
ctccctcaagttgcagtcaacctctcaaactgtcacgttgctatcaagtcacatgtctgtgactattctttagac

SEQ ID NO: 49911 - DNA, 75 bp, Artificial Sequence
  Synthetic
tacaaactatcgtgatagttgtggcaaacaattaacaggtagaataattaccaagtatactcactggttggacac

SEQ ID NO: 49912 - DNA, 75 bp, Artificial Sequence
  Synthetic
catcattgaatagagatgacaacaaaatcattgaggatcccatgatacaattaattccagagaagctgaggagag

SEQ ID NO: 49913 - DNA, 75 bp, Artificial Sequence
  Synthetic
tccaggaacttacaagatagtgatagacaaaaaaaataagctgaatgacagatgtaccctatttaccaactgtgt

SEQ ID NO: 49914 - DNA, 75 bp, Artificial Sequence
  Synthetic
tctgaagaatctggtgacgactgcatatcaagaactcagctactgaggacagagactgcagagatccatggtgat

SEQ ID NO: 49915 - DNA, 75 bp, Artificial Sequence
  Synthetic
tgtagatcaaagactgggtagtgaactggggtgttacactatcaatagagtgaagtcattcaagctgtgcgaaaa

SEQ ID NO: 49916 - DNA, 75 bp, Artificial Sequence
  Synthetic
tggatgcatgcgattcaagctgtgaagtaatgatacctaagggcacaggtgacatctcagtagactgttcaggag

SEQ ID NO: 49917 - DNA, 75 bp, Artificial Sequence
  Synthetic
tttatatttgcagaatgtcgaatcaccctaaaacaaccatggctttcctcttttggttcagttttggctatgtga

SEQ ID NO: 49918 - DNA, 75 bp, Artificial Sequence
  Synthetic
ctgcggaatctgagctagaggcgaaccgtgcagtaattgtcaagaccaaattattctcagcaactgaacaagtac

SEQ ID NO: 49919 - DNA, 75 bp, Artificial Sequence
  Synthetic
atagagagttaaaaccccagacctgtaccatatgtgagacaactcctgcaaatgcaatagatgctgaaatgcatg

SEQ ID NO: 49920 - DNA, 75 bp, Artificial Sequence
  Synthetic
tccctattgtgcatctagactgacctcagatggactcgctaggcatgtgacacaatgccctaagcggaaggagag

SEQ ID NO: 49921 - DNA, 75 bp, Artificial Sequence
  Synthetic
aagtgctttcttggatgagcaagaggaggactgaggtaataactaaagaacagcaccaactgtttctaagtcttc

SEQ ID NO: 49922 - DNA, 75 bp, Artificial Sequence
  Synthetic
taagaaagctgttgcaggtatcggagtccactggtgttgcattaaaaagaagcagctggctgattgtgctacttg

SEQ ID NO: 49923 - DNA, 75 bp, Artificial Sequence
  Synthetic
agcagctggctgattgtgctacttgtgctgttcacagtttcattatcaccagttcaatcagcacccattggttat

SEQ ID NO: 49924 - DNA, 75 bp, Artificial Sequence
  Synthetic
cctctttgtactgggaagtatcttgtttatagtctcttgtctgatgaaagggctggttgacagtattggcaacat

SEQ ID NO: 49925 - DNA, 75 bp, Artificial Sequence
  Synthetic
cttcttccctgggctgaccatctgcaagacatgctctataggtagtatcaatggctttgaaattgagtctcacaa

SEQ ID NO: 49926 - DNA, 75 bp, Artificial Sequence
  Synthetic
gagtttgatggacaagttatcgctaacatacttgcaagtgaattgagctctgtaaaacgagattctgaacgtgaa

SEQ ID NO: 49927 - DNA, 75 bp, Artificial Sequence
  Synthetic
atagagaaattcatcagctgcacttgagcatctgcaaaaaaagaaaaacaggaagtaatgtcatgcttgcagtct

SEQ ID NO: 49928 - DNA, 75 bp, Artificial Sequence
  Synthetic
agttcttgcttgcattcttactttatgaggaagtgttaatgaacttaatcaaccagtgtaaggcagtaaaagaac

SEQ ID NO: 49929 - DNA, 75 bp, Artificial Sequence
  Synthetic
cctaacaaatttctgtcatcaggaatgccaggttacagagactgagtgcctctgcccttatgaagcccttgtgct

SEQ ID NO: 49930 - DNA, 75 bp, Artificial Sequence
  Synthetic
cacagaggtaataatattttggtttcaggcagatcagaatcaattatgaagctggaagaaagaacaggaattagt

SEQ ID NO: 49931 - DNA, 75 bp, Artificial Sequence
  Synthetic
gtgacagacaagtagaagagtggcccaaggcaacctgtacaggtgactgcccagaaagatgtggctgcacatcat

SEQ ID NO: 49932 - DNA, 75 bp, Artificial Sequence
  Synthetic
agtaagagcagcttgctgcacaagtacctcaaaacaggaggtgtcagacagcgaaacactgaaatactcttcaga

SEQ ID NO: 49933 - DNA, 75 bp, Artificial Sequence
  Synthetic
tgtgaaagacctatttatagattatatgttcgtcaagtggaaagttgattacattaaaacagaagccatagtgtg

SEQ ID NO: 49934 - DNA, 75 bp, Artificial Sequence
  Synthetic
agaggagattgagttttgcaacaacctgaccaagactgtatcagagaacccgctaccactcagctgttggtctga

SEQ ID NO: 49935 - DNA, 75 bp, Artificial Sequence
  Synthetic
tcgatcctctctttcttaaccatttatttcagcttcatcatcatcgttattatcttggggtgtggggggaacgat

SEQ ID NO: 49936 - DNA, 75 bp, Artificial Sequence
  Synthetic
caaggttcaatttaggtcctgtgaccatcacattgtcagaaccgaggaacatacaacaaaagctccctcctgaaa

SEQ ID NO: 49937 - DNA, 75 bp, Artificial Sequence
  Synthetic
catcacattgtcagaaccgaggaacatacaacaaaagctccctcctgaaataatcacattgcatcctaggattga

SEQ ID NO: 49938 - DNA, 75 bp, Artificial Sequence
  Synthetic
actaatgtaagcaccacaagcaccattaaagatgtaaggacactggtatcctacgtcagtactgaaaccatcccc

SEQ ID NO: 49939 - DNA, 75 bp, Artificial Sequence
  Synthetic
tttctgtgctttttatttccaaaatgaatgcagtaagagagatggacctagatgttcctctgcagcactactgag

SEQ ID NO: 49940 - DNA, 75 bp, Artificial Sequence
  Synthetic
tataccggagttacccagcacaatcatgcttcatttgtaaacctgctcaacattgaaactgactatacaaaaagc

SEQ ID NO: 49941 - DNA, 75 bp, Artificial Sequence
  Synthetic
caaacaatgagctaggtgatgtgtcactgaaggttaatattgtcctggtacccctcaaggacatgtccaaaccaa

SEQ ID NO: 49942 - DNA, 75 bp, Artificial Sequence
  Synthetic
tagaagttgctgatatggagttacacacgaagaagattgaaataacaggcctcaaatttgcaagcctgacttgca

SEQ ID NO: 49943 - DNA, 75 bp, Artificial Sequence
  Synthetic
gaactgcaaaatggggaactttgaggggcaggagtgctttgagtttactattctaaaagacaacagcacaaggct

SEQ ID NO: 49944 - DNA, 75 bp, Artificial Sequence
  Synthetic
gggcaggagtgctttgagtttactattctaaaagacaacagcacaaggctagattacaataagttgattgaccat

SEQ ID NO: 49945 - DNA, 75 bp, Artificial Sequence
  Synthetic
cagacagtacattcaaagctttctcagccatgcctaaaacttccttatgcttctacattgtcgaaagggagtacc

SEQ ID NO: 49946 - DNA, 75 bp, Artificial Sequence
  Synthetic
tttgcccagcactctcagcgcgccaactataccgcaagaagcacatcacactgcaaggggcctactgtcagtcac

SEQ ID NO: 49947 - DNA, 75 bp, Artificial Sequence
  Synthetic
atggcaagtgatacagcgatagatctgcctgacagggaagcagaagccctcaaaacaggaaaccttggctttaac

SEQ ID NO: 49948 - DNA, 75 bp, Artificial Sequence
  Synthetic
gtctcaagggcaaatgaggcagtccataccatttcagttgctatcatcagagctctcaaacgagctaactgctct

SEQ ID NO: 49949 - DNA, 75 bp, Artificial Sequence
  Synthetic
aaagtttcttttatggtctaaagaacatgcttagtggcatttttggcaatgtttttgtgggcattttcttgtttc

SEQ ID NO: 49950 - DNA, 75 bp, Artificial Sequence
  Synthetic
cctctattgatccattttatcattctgtcattcttctttctctactattcattccagtttcattatttgaagggt

SEQ ID NO: 49951 - DNA, 75 bp, Artificial Sequence
  Synthetic
gctgcttgatggtgaaagacttgccgatagacggattgccgaactattctccacaaaaacacacattggctagat

SEQ ID NO: 49952 - DNA, 75 bp, Artificial Sequence
  Synthetic
gatagacggattgccgaactattctccacaaaaacacacattggctagatcaactaaagaggcttaaaagaatga

SEQ ID NO: 49953 - DNA, 75 bp, Artificial Sequence
  Synthetic
tccccattacactattatcacaatatgctacatctaatctgcttcattgtacctacaaacagactgaaactgcct

SEQ ID NO: 49954 - DNA, 75 bp, Artificial Sequence
  Synthetic
gtgcacctatatacgagtgtgcttgggctagctccactggcattgttaagaagggactggagtggtttgagaaaa

SEQ ID NO: 49955 - DNA, 75 bp, Artificial Sequence
  Synthetic
acatctaatctgcttcattgtacctacaaacagactgaaactgcctttgctctatttactctgacctaaaccttg

SEQ ID NO: 49956 - DNA, 75 bp, Artificial Sequence
  Synthetic
atgcatatatcattaatgtatgcagtcctttgcctacagctgtgtggtctgggagagactcatggatcatacaat

SEQ ID NO: 49957 - DNA, 75 bp, Artificial Sequence
  Synthetic
gaagttcccaaaatagaacaactttccaactaccagcaggctgctctcaagtggaggaaagacataggtttccgt

SEQ ID NO: 49958 - DNA, 75 bp, Artificial Sequence
  Synthetic
gaaactggacacaataaaacagacgttatgacaacgcccggtgataacctgagctctgaacagccagtgagtacg

SEQ ID NO: 49959 - DNA, 75 bp, Artificial Sequence
  Synthetic
ccaactaccagcaggctgctctcaagtggaggaaagacataggtttccgtgtcaatgcaaacacggcagctttga

SEQ ID NO: 49960 - DNA, 75 bp, Artificial Sequence
  Synthetic
gccttgtctatcacacctgacccctccactgttacacccacaacaccagccaatggattagaaggctcaggggaa

SEQ ID NO: 49961 - DNA, 75 bp, Artificial Sequence
  Synthetic
ccgagagcttgtccctgccagaaaccacaccagagctccctgctacagctggtatagacacttcaagtgcaagtg

SEQ ID NO: 49962 - DNA, 75 bp, Artificial Sequence
  Synthetic
gccgttcaggaatagcacttgttgcaacaggccttgccaagcttgcagaaactgaggggaagggggtttttgatg

SEQ ID NO: 49963 - DNA, 75 bp, Artificial Sequence
  Synthetic
caaagagagctcagcaactagtagcccccatccagtctccaacaaaccaccaacccctcccgcaagagcccaggg

SEQ ID NO: 49964 - DNA, 75 bp, Artificial Sequence
  Synthetic
gacgaagttgacaaagcaagtgctgacagcatgataacaaacctccttaagcatattgctaaggcacaagagctt

SEQ ID NO: 49965 - DNA, 75 bp, Artificial Sequence
  Synthetic
gcatattgctaaggcacaagagctttacaaaaactcgtctgctcttcgtgctcagggtgcacagattgacaccgt

SEQ ID NO: 49966 - DNA, 75 bp, Artificial Sequence
  Synthetic
aggagctttcgcttccaatatatacgatattcatgaaatcttacttctttaaagacaacgtcttcttgtcactaa

SEQ ID NO: 49967 - DNA, 75 bp, Artificial Sequence
  Synthetic
tgagcaccccaatgaagtgggggaagaagctttatgagctttttgccgatgattctttccagcagaacaggatct

SEQ ID NO: 49968 - DNA, 75 bp, Artificial Sequence
  Synthetic
taactggtgagggccattttaatgaagtcttacaatttaaaacgccaggcacgttgagtactacagagtcaacac

SEQ ID NO: 49969 - DNA, 75 bp, Artificial Sequence
  Synthetic
cttcggacaaacactgaaaccaataatccgtgtgccaagacaattgttaagttgtttgaaattcagaaaacaggg

SEQ ID NO: 49970 - DNA, 75 bp, Artificial Sequence
  Synthetic
tttcaaaatgcctacaacgtcaaggggaatgccaccagtgccaacatcatctaaggcccagaatacttcgcaatc

SEQ ID NO: 49971 - DNA, 75 bp, Artificial Sequence
  Synthetic
atctaattcagggcttcaattgattaatattacccgacattcaactagaatagttgacacacctgggcctaagat

SEQ ID NO: 49972 - DNA, 75 bp, Artificial Sequence
  Synthetic
ttactttaactgcttgtataatcctgttttattaacattctcttactttcttctgttttaaacatttaaagggct

SEQ ID NO: 49973 - DNA, 75 bp, Artificial Sequence
  Synthetic
cctcaactgcagttacaatatatgtccttattgtgcatctaggttaacctcagatggtcttgccagacatgtaat

SEQ ID NO: 49974 - DNA, 75 bp, Artificial Sequence
  Synthetic
catacttgccagtgaattgagttctgtgaaacgagattctgaacgcgaaggtctaactgatctccttgattatct

SEQ ID NO: 49975 - DNA, 75 bp, Artificial Sequence
  Synthetic
aatctctcaaactgtcacgttgtaatcaaatcacatgtctgtgactattctttagacattgacggtacggtgagg

SEQ ID NO: 49976 - DNA, 75 bp, Artificial Sequence
  Synthetic
agagtgagttaggcatcttgaatgcatcatgcctaccaaattatgtatacactgctagtgtgtgctattctttgt

SEQ ID NO: 49977 - DNA, 75 bp, Artificial Sequence
  Synthetic
tttagacattgacggtacggtgaggcttcctcacatttaccatgaaggagttttcattccaggaacttacaaaat

SEQ ID NO: 49978 - DNA, 75 bp, Artificial Sequence
  Synthetic
tctcaaagaaatacttgcggcacgtcagtcacgtaagtgttagctttgagagagtgagttaggcatcttgaatgc

SEQ ID NO: 49979 - DNA, 75 bp, Artificial Sequence
  Synthetic
atcatgcctaccaaattatgtatacactgctagtgtgtgctattctttgtccacagccgtggagtttggaaggga

SEQ ID NO: 49980 - DNA, 75 bp, Artificial Sequence
  Synthetic
actgtgtgataaaaggaagggaggttcgtaaaggtcaatcagttttgaggcagtacaagacggaaattaggattg

SEQ ID NO: 49981 - DNA, 75 bp, Artificial Sequence
  Synthetic
gcacctggagggagtcaaggccccacgtcgcctgcaagcacagcagtatccctcacaccggaccccttcaccacc

SEQ ID NO: 49982 - DNA, 75 bp, Artificial Sequence
  Synthetic
cgtcgcctgcaagcacagcagtatccctcacaccggaccccttcaccaccgaacccacagcatcagctgtcgaac

SEQ ID NO: 49983 - DNA, 75 bp, Artificial Sequence
  Synthetic
gagcgaacctagattacagtgggggcatggctgcttgtccattgtttatgatgaaactgacactcagaccacata

SEQ ID NO: 49984 - DNA, 75 bp, Artificial Sequence
  Synthetic
tgaggacagagactgcagagatccacggcgacaactatggtggcccgggtgacaaaataaccatctgcaacggct

SEQ ID NO: 49985 - DNA, 75 bp, Artificial Sequence
  Synthetic
ctgacctcgccggaaaccacgccagggctcccaacagtaaccgacacaggagtgtctagcacaagcatcttcggc

SEQ ID NO: 49986 - DNA, 75 bp, Artificial Sequence
  Synthetic
ggctcccaacagtaaccgacacaggagtgtctagcacaagcatcttcggcatcggcatacgggtggctggggaca

SEQ ID NO: 49987 - DNA, 75 bp, Artificial Sequence
  Synthetic
aacagagtgaagtcattcaagctatgcgaaaatagtgccacagggaagagctgtgaaatagaaagtgtcccagtt

SEQ ID NO: 49988 - DNA, 75 bp, Artificial Sequence
  Synthetic
agaagttaaacaaggttgttataaaagacaatcttgagcaaggtgtggaagaggagattgagttttgcaacaacc

SEQ ID NO: 49989 - DNA, 75 bp, Artificial Sequence
  Synthetic
tccacagcacagggcccacatcatgcagtaaggggtttactgtcggtttccagcaccaggccaggagaggcatca

SEQ ID NO: 49990 - DNA, 75 bp, Artificial Sequence
  Synthetic
cagtaaggggtttactgtcggtttccagcaccaggccaggagaggcatcaacaataacagtcccaggagaagcag

SEQ ID NO: 49991 - DNA, 75 bp, Artificial Sequence
  Synthetic
tcaccaacagctgaagccatcactgaagccaacaactccagcaaccccagacaaccagagctctcaacacaacca

SEQ ID NO: 49992 - DNA, 75 bp, Artificial Sequence
  Synthetic
aagccaacaactccagcaaccccagacaaccagagctctcaacacaaccagcaatcccaggcctagtgacctctt

SEQ ID NO: 49993 - DNA, 75 bp, Artificial Sequence
  Synthetic
atggctatttacatttgcagaatgtcgaatcaccccaaaacaaccatggctttcctcttctggttcagctttggc

SEQ ID NO: 49994 - DNA, 75 bp, Artificial Sequence
  Synthetic
atataccccagcccaacaaacagatctaaaagaaaccttgagatggaaataattttgactttatctcaaggtcta

SEQ ID NO: 49995 - DNA, 75 bp, Artificial Sequence
  Synthetic
ctaaaagaaaccttgagatggaaataattttgactttatctcaaggtctaaagaagtactacggtaaaatactaa

SEQ ID NO: 49996 - DNA, 75 bp, Artificial Sequence
  Synthetic
aagcagtatagagagttaaaacctcagacctgcaccatatgtgagacaactcctgtaaatgcaatagatgctgag

SEQ ID NO: 49997 - DNA, 75 bp, Artificial Sequence
  Synthetic
tgtaagagaaatcttggtctgacctgtaatgataatttcttccaagagagaatagaagagttttttctgaccggt

SEQ ID NO: 49998 - DNA, 75 bp, Artificial Sequence
  Synthetic
gtaatgataatttcttccaagagagaatagaagagttttttctgaccggtgaaggccactttaatgaagttttgc

SEQ ID NO: 49999 - DNA, 75 bp, Artificial Sequence
  Synthetic
catgtgacacaatgccctaagcggaaggagaaagtggaagaaactgaactgtacttgaacttagaaagaattcct

SEQ ID NO: 50000 - DNA, 75 bp, Artificial Sequence
  Synthetic
acaccaacagttaaaccctttaaatcttattttgccagaggcttcctttcaatagactcaggctacttctctgcc

SEQ ID NO: 50001 - DNA, 75 bp, Artificial Sequence
  Synthetic
tgtacacgaggacgagcagtgtcaagagcaaataagcttagacgatctgatggcaaacgacacggtaacagactt

SEQ ID NO: 50002 - DNA, 75 bp, Artificial Sequence
  Synthetic
cttattttgccagaggcttcctttcaatagactcaggctacttctctgccaagtgctattcaaagacctctaatt

SEQ ID NO: 50003 - DNA, 75 bp, Artificial Sequence
  Synthetic
aacctgcctacacaaagaatggccccattcaagaaactggagatgcaaccctacttggtgttggggagtcggcac

SEQ ID NO: 50004 - DNA, 75 bp, Artificial Sequence
  Synthetic
acacctggacctaagatcactaatctaaaggctatcaattgtataaacttaaaggcatcagtcttcaaggagcat

SEQ ID NO: 50005 - DNA, 75 bp, Artificial Sequence
  Synthetic
taaaggctatcaattgtataaacttaaaggcatcagtcttcaaggagcatagggagattgagatcaatgtgcttc

SEQ ID NO: 50006 - DNA, 75 bp, Artificial Sequence
  Synthetic
gcaactccttcttccctggactgtccatttgcaagacgtgctccataagcagcattaatggctttgaaattgagt

SEQ ID NO: 50007 - DNA, 75 bp, Artificial Sequence
  Synthetic
catgtctgtgattactctttagacattgatggggcagtaagactacctcatgtccaccacaaaggaacattcata

SEQ ID NO: 50008 - DNA, 75 bp, Artificial Sequence
  Synthetic
ccagtcctctctttctcaaccatttatttcagtttcatcatcattgttattattttggggtgtggggggaacgat

SEQ ID NO: 50009 - DNA, 75 bp, Artificial Sequence
  Synthetic
ttgatggggcagtaagactacctcatgtccaccacaaaggaacattcataccaggaacttataaaatagtaatag

SEQ ID NO: 50010 - DNA, 75 bp, Artificial Sequence
  Synthetic
attaaaggaaaggagattcgtaaaggccagtcagcactaaggcaatacagaacagaaatcagaataggcaaggca

SEQ ID NO: 50011 - DNA, 75 bp, Artificial Sequence
  Synthetic
gccagtcagcactaaggcaatacagaacagaaatcagaataggcaaggcatctgccgggtctagaagattgctgt

SEQ ID NO: 50012 - DNA, 75 bp, Artificial Sequence
  Synthetic
gagactgcagaggtccataatgataactatggtggtccaggtgacaaaattaccatctgcaacggttcaaccatt

SEQ ID NO: 50013 - DNA, 75 bp, Artificial Sequence
  Synthetic
aagaagacctaacaaatttctgtcatcaggaatgtcaggttacagagactgaatgcctctgcccttatgaagctc

SEQ ID NO: 50014 - DNA, 75 bp, Artificial Sequence
  Synthetic
tcaggaatgtcaggttacagagactgaatgcctctgcccttatgaagctctagtactcagaaagcctctattcct

SEQ ID NO: 50015 - DNA, 75 bp, Artificial Sequence
  Synthetic
caagtacatcatggccttcaatccaccttggggagacatcaacaaatcaggtcgttcgggaatagcacttgttgc

SEQ ID NO: 50016 - DNA, 75 bp, Artificial Sequence
  Synthetic
gtagatcagagacttggcagtgaactggggtgttatactatcaacagagtgaagtcattcaagctatgcgaaaat

SEQ ID NO: 50017 - DNA, 75 bp, Artificial Sequence
  Synthetic
aacaggccttgccaagcttgcagagaccgaggggaaaggagtttttgacgaagctaagaagaccgtggaggctct

SEQ ID NO: 50018 - DNA, 75 bp, Artificial Sequence
  Synthetic
gcaaggtttttgcttaaaaatcactcaggaaggaaggggccatgtgaagctatcgagaggctcagaagttgtctt

SEQ ID NO: 50019 - DNA, 75 bp, Artificial Sequence
  Synthetic
caggaaggaaggggccatgtgaagctatcgagaggctcagaagttgtcttagatgcctgcgattcaagctgtgaa

SEQ ID NO: 50020 - DNA, 75 bp, Artificial Sequence
  Synthetic
gcagcaacatttcttaaaagataatttgattgatctaggatgccctaacattccactattaggtaaaatggctat

SEQ ID NO: 50021 - DNA, 75 bp, Artificial Sequence
  Synthetic
aaggccggtgtgactccagagaccttcccaaccatctcacagttccttttcgaactggggaagcagccaaggggg

SEQ ID NO: 50022 - DNA, 75 bp, Artificial Sequence
  Synthetic
tttggttcagttttggttatgtaataacatgtatattttgcaaagtcattttttatttattgatagttgtgggga

SEQ ID NO: 50023 - DNA, 75 bp, Artificial Sequence
  Synthetic
aacatgtatattttgcaaagtcattttttatttattgatagttgtggggacattgggaaaaaagttcaaacagta

SEQ ID NO: 50024 - DNA, 75 bp, Artificial Sequence
  Synthetic
atccatgcgccaagacaattgtcaaattatttgaaatccaaaaaacaggatttaacatacaggacatggacattg

SEQ ID NO: 50025 - DNA, 75 bp, Artificial Sequence
  Synthetic
tttaacatacaggacatggacattgtagcctctgagcacctgctgcaccaatcccttgtcggcaagcagtctcca

SEQ ID NO: 50026 - DNA, 75 bp, Artificial Sequence
  Synthetic
atgcaatagatgctgaaatgcacgatcttaactgcagttacaatatatgtccttattgtgcatctagattaacct

SEQ ID NO: 50027 - DNA, 75 bp, Artificial Sequence
  Synthetic
gattagatgtgaaagacctttttacagattatatgtttgtcaagtggaaagttgaatatattaagacagaggcca

SEQ ID NO: 50028 - DNA, 75 bp, Artificial Sequence
  Synthetic
ccttattgtgcatctagattaacctcggacgggcttgccaggcatgtgacacaatgccctaagcgaaaggaaaaa

SEQ ID NO: 50029 - DNA, 75 bp, Artificial Sequence
  Synthetic
cggacgggcttgccaggcatgtgacacaatgccctaagcgaaaggaaaaagtagaagagactgagttgtacttga

SEQ ID NO: 50030 - DNA, 75 bp, Artificial Sequence
  Synthetic
atgcaatcccacttggtgctggggtgtagggactggctgcacctgttgtggattagatgtgaaagacctttttac

SEQ ID NO: 50031 - DNA, 75 bp, Artificial Sequence
  Synthetic
gcaagcacagtatgtaagttgcagagttgcacacatggtgtaccaggagacctacaggtctaccacatcggaaat

SEQ ID NO: 50032 - DNA, 75 bp, Artificial Sequence
  Synthetic
cagagaggggtatataagtgtttgcctgtttgtgctagggggcatactgtttgtagtctcctgcctgatcaaagg

SEQ ID NO: 50033 - DNA, 75 bp, Artificial Sequence
  Synthetic
agacatgttctatcggcagtgtaaatggctttgaaattgaatcccataaatgttactgtagcttactttgttgcc

SEQ ID NO: 50034 - DNA, 75 bp, Artificial Sequence
  Synthetic
tggctttgaaattgaatcccataaatgttactgtagcttactttgttgcccttattgtagacactgctctactga

SEQ ID NO: 50035 - DNA, 75 bp, Artificial Sequence
  Synthetic
cccacgtttacacagagagctccagtagtggtctttgcctttgcgaaaccatgaacttcttgagaaaccttgact

SEQ ID NO: 50036 - DNA, 75 bp, Artificial Sequence
  Synthetic
ggggcaatgtcatgttggctgtctgcaagcgcatgtgcttcagagcaactatggaagtaagcaacaaggtcctat

SEQ ID NO: 50037 - DNA, 75 bp, Artificial Sequence
  Synthetic
caagcgcatgtgcttcagagcaactatggaagtaagcaacaaggtcctatttatccgaaacatcatcaataccac

SEQ ID NO: 50038 - DNA, 75 bp, Artificial Sequence
  Synthetic
cagtagagatggaaagcctacccgccggcacttgggaaagggaagaagacctaacaaacttctgccaccaagaat

SEQ ID NO: 50039 - DNA, 75 bp, Artificial Sequence
  Synthetic
cggcacttgggaaagggaagaagacctaacaaacttctgccaccaagaatgccaagtcacagagactgaatgtct

SEQ ID NO: 50040 - DNA, 75 bp, Artificial Sequence
  Synthetic
atcccttgttggcaagcagtctccattccaaaatgcctacaacgtcaagggcaatgccaccagtgccaacatcat

SEQ ID NO: 50041 - DNA, 75 bp, Artificial Sequence
  Synthetic
aagtctcatggcaagaaagcttgaatttggaacagacagtacatttaaagctttctcagccatgcctaaaacttc

SEQ ID NO: 50042 - DNA, 75 bp, Artificial Sequence
  Synthetic
tagtcaagggcatgaaaaacctgctaaattcaactaacttggaaacaagcttatcaatcgaagcaccatggggag

SEQ ID NO: 50043 - DNA, 75 bp, Artificial Sequence
  Synthetic
ttccaaaatgcctacaacgtcaagggcaatgccaccagtgccaacatcatctaaaactcaaggtgtttcacattc

SEQ ID NO: 50044 - DNA, 75 bp, Artificial Sequence
  Synthetic
ttatcaatcgaagcaccatggggagcaataaatgtccagtcaacctttaaacccactgtatcaactgcaaacata

SEQ ID NO: 50045 - DNA, 75 bp, Artificial Sequence
  Synthetic
ctaaaactcaaggtgtttcacattcagcttttctcctcctgcatcactacttacagttatgactattaatcacgt

SEQ ID NO: 50046 - DNA, 75 bp, Artificial Sequence
  Synthetic
ttattttaattgcttatataatgctgttttgctaattttatcttgctatctttcatttcaaatacttaaagggct

SEQ ID NO: 50047 - DNA, 75 bp, Artificial Sequence
  Synthetic
ctgttttgctaattttatcttgctatctttcatttcaaatacttaaagggctgtgcggcaacgatatctttgaga

SEQ ID NO: 50048 - DNA, 75 bp, Artificial Sequence
  Synthetic
aggcagatcagagtcaattatgaagctagaagaaaggacaggaatcagctgggatttgggcgtagaagatgcctc

SEQ ID NO: 50049 - DNA, 75 bp, Artificial Sequence
  Synthetic
taaagaacatgcttagtggtatttttggcaatgtttttataggtattttcttgttccttggccccttcatcttgt

SEQ ID NO: 50050 - DNA, 75 bp, Artificial Sequence
  Synthetic
ctcctgtcttcgagtatctgtcaggtgacagacaggtagaggagtggcctaaagcaacctgcacaggcgattgcc

SEQ ID NO: 50051 - DNA, 75 bp, Artificial Sequence
  Synthetic
tgagaaatctagactttgactgtctcagtgtgcaagactataacggtatgatagaaaacatgtctaagttagaca

SEQ ID NO: 50052 - DNA, 75 bp, Artificial Sequence
  Synthetic
tgtagaagaactagaggcctgctcaagtatagacacctcaaggaagatgaagaaactggttatagaaggattatt

SEQ ID NO: 50053 - DNA, 75 bp, Artificial Sequence
  Synthetic
agaaactggttatagaaggattattgaaagactaaacaataaaaaaggaaaaaacaaactgcttgatggtgaaag

SEQ ID NO: 50054 - DNA, 75 bp, Artificial Sequence
  Synthetic
cattcaaggaattggagatgcaaccccacttggtgttggggagtcggcactggatgcacctgctgtgggctagat

SEQ ID NO: 50055 - DNA, 75 bp, Artificial Sequence
  Synthetic
aaactgcttgatggtgaaagacttgctgatagaagaattgccgaactgttctctacaaaaacacacattggctag

SEQ ID NO: 50056 - DNA, 75 bp, Artificial Sequence
  Synthetic
tctcaaagatatcaatccccccgttacccacgttaacacagagagctctagtagtggtctttccttttgtgaaac

SEQ ID NO: 50057 - DNA, 75 bp, Artificial Sequence
  Synthetic
tgtttgtcaagtggaaggttgaatacataaagacagaggccatagtgtgtgttgagctcactagccaagaaaggc

SEQ ID NO: 50058 - DNA, 75 bp, Artificial Sequence
  Synthetic
tctcaaagatatcaatcccccctttacccacattgacacaggcagctccagtagtggttttcccttgtcaaacca

SEQ ID NO: 50059 - DNA, 75 bp, Artificial Sequence
  Synthetic
acccacgttaacacagagagctctagtagtggtctttccttttgtgaaaccatggacttcttgagaagccttgac

SEQ ID NO: 50060 - DNA, 75 bp, Artificial Sequence
  Synthetic
gtagtggttttcccttgtcaaaccatggacttcttgagaaaccttgactggactcaggtgattgctggtcaatat

SEQ ID NO: 50061 - DNA, 75 bp, Artificial Sequence
  Synthetic
atcacgttgtcagagccaagaaacattcagcagaagcttcctcctgaaataatcacattgcatcctagaattgag

SEQ ID NO: 50062 - DNA, 75 bp, Artificial Sequence
  Synthetic
tggacttcttgagaaaccttgactggactcaggtgattgctggtcaatatgtgaccaaccccaggttcaatatct

SEQ ID NO: 50063 - DNA, 75 bp, Artificial Sequence
  Synthetic
ttcagcagaagcttcctcctgaaataatcacattgcatcctagaattgaggaaggctttttcgatctaatgcatg

SEQ ID NO: 50064 - DNA, 75 bp, Artificial Sequence
  Synthetic
catagtattgctgagttgaccatgcccaataaaacggatcactcataccataacattaaacatctaacagagttg

SEQ ID NO: 50065 - DNA, 75 bp, Artificial Sequence
  Synthetic
catggtgttccaggagacttgcaggtctaccacattggcaacttgttaaaaggggataagttaaacgggcatatg

SEQ ID NO: 50066 - DNA, 75 bp, Artificial Sequence
  Synthetic
tctaccacattggcaacttgttaaaaggggataagttaaacgggcatatgattcacaaaattgagccacacttca

SEQ ID NO: 50067 - DNA, 75 bp, Artificial Sequence
  Synthetic
ccaataaaacggatcactcataccataacattaaacatctaacagagttggcagcacgaaagtactaccaagagg

SEQ ID NO: 50068 - DNA, 75 bp, Artificial Sequence
  Synthetic
atgctatctgacaatgagtgggggtcaaccctcgaggcatccatgttggctaaggaaatgggtataactattatc

SEQ ID NO: 50069 - DNA, 75 bp, Artificial Sequence
  Synthetic
tcatttggactgttgctgccagtgatgaagtggaagcaggtataaagttcggagacggtgatgtgtttacagctg

SEQ ID NO: 50070 - DNA, 75 bp, Artificial Sequence
  Synthetic
atgggggattggccctcttgcacatacactggggtgacccaacataaccatgctgcttttgttaacttacttaac

SEQ ID NO: 50071 - DNA, 75 bp, Artificial Sequence
  Synthetic
caaccctcgaggcatccatgttggctaaggaaatgggtataactattatcatttggactgttgctgccagtgatg

SEQ ID NO: 50072 - DNA, 75 bp, Artificial Sequence
  Synthetic
acactggggtgacccaacataaccatgctgcttttgttaacttacttaacatcgaaactgattacacaaagaact

SEQ ID NO: 50073 - DNA, 75 bp, Artificial Sequence
  Synthetic
aatcttctgcactctggacaaacacattttgatgctcttagaatactgccacagtttgaagcagacacaagggag

SEQ ID NO: 50074 - DNA, 75 bp, Artificial Sequence
  Synthetic
gacttgaaagctagaccaacttacggtgcgggtgaaatcactgtactagtggaagttgctgacatggagttacac

SEQ ID NO: 50075 - DNA, 75 bp, Artificial Sequence
  Synthetic
attttgatgctcttagaatactgccacagtttgaagcagacacaagggagaccttaagtttggtggataaggtta

SEQ ID NO: 50076 - DNA, 75 bp, Artificial Sequence
  Synthetic
gaagaccttgcattagcactcacaagtgcagaagaaccatatagacgatcgagcctagatgaagtcactttgtct

SEQ ID NO: 50077 - DNA, 75 bp, Artificial Sequence
  Synthetic
atctcctgtaaagtcaggattcatgtagatgaacctgatgagcttacagtacatgtgaaaagtgaagatccggac

SEQ ID NO: 50078 - DNA, 75 bp, Artificial Sequence
  Synthetic
gtgcagaagaaccatatagacgatcgagcctagatgaagtcactttgtctaagaaacaagcagagatgttgaggc

SEQ ID NO: 50079 - DNA, 75 bp, Artificial Sequence
  Synthetic
agacagcacattcaaggccttctcagccatgcccaaaacctccttgtgcttctacattgtggagagagaatactg

SEQ ID NO: 50080 - DNA, 75 bp, Artificial Sequence
  Synthetic
actagagtcggcagggttctagactgcatgttcaattgcaaactatgtgttgagatatcagctgacactttaatt

SEQ ID NO: 50081 - DNA, 75 bp, Artificial Sequence
  Synthetic
gcatgttcaattgcaaactatgtgttgagatatcagctgacactttaattctgcggcctgaatccaaagagagaa

SEQ ID NO: 50082 - DNA, 75 bp, Artificial Sequence
  Synthetic
gacaaacagattaagcaggaattctctagaatgaaactctacgtcactaaagatttacttgaccatctagatgtt

SEQ ID NO: 50083 - DNA, 75 bp, Artificial Sequence
  Synthetic
ctagaatgaaactctacgtcactaaagatttacttgaccatctagatgttggcgggctattacgggcagccttcc

SEQ ID NO: 50084 - DNA, 75 bp, Artificial Sequence
  Synthetic
ccctggaacaggaatagaaaggcatatgcagctgctacactctgagatgatactggacatctgcactgtatcact

SEQ ID NO: 50085 - DNA, 75 bp, Artificial Sequence
  Synthetic
gagttttttttatggattgaagaacatgcttagtggcatcttcggcaacgtttttataggtattttcttattcct

SEQ ID NO: 50086 - DNA, 75 bp, Artificial Sequence
  Synthetic
atgcttagtggcatcttcggcaacgtttttataggtattttcttattccttgctccttttgttctattgatactc

SEQ ID NO: 50087 - DNA, 75 bp, Artificial Sequence
  Synthetic
tggtgtcatgctgtcaacattcttatatggttctaataataaaaacaagaagaaattcattaccaactgtctgct

SEQ ID NO: 50088 - DNA, 75 bp, Artificial Sequence
  Synthetic
ctggacatctgtacggtgtcacttggtgtcatgctgtcaacattcttatatggctccaacaataaaaacaagaag

SEQ ID NO: 50089 - DNA, 75 bp, Artificial Sequence
  Synthetic
gtgtcatgctgtcaacattcttatatggctccaacaataaaaacaagaagaagttcatcacaaattgtctgctca

SEQ ID NO: 50090 - DNA, 75 bp, Artificial Sequence
  Synthetic
aaccagaggtttattcaagtacagacatctcaaggaagatgaagaatctggttatagaagaatcattgaaagatt

SEQ ID NO: 50091 - DNA, 75 bp, Artificial Sequence
  Synthetic
catctcaaggaagatgaagaatctggttatagaagaatcattgaaagattaaacaacaaaaaaggaaagaacaag

SEQ ID NO: 50092 - DNA, 75 bp, Artificial Sequence
  Synthetic
agtgccttgtttgggaagcagataaacaaacttcagaattgcttcaggaccataagccctgtcagcttacttgca

SEQ ID NO: 50093 - DNA, 75 bp, Artificial Sequence
  Synthetic
aatgagctgctgtacaaggcacccaggaaggccttagcaaccgtctgtagtgccttatttgggaagcagataaac

SEQ ID NO: 50094 - DNA, 75 bp, Artificial Sequence
  Synthetic
tgccttatttgggaagcagataaacaagctgcagaactgcttcagaaccataagccctgttagcttgcttgcatt

SEQ ID NO: 50095 - DNA, 75 bp, Artificial Sequence
  Synthetic
cacaaaaacacatattggttaagccagcagaagaggcctcgaaagggtgatggcagtatactaactaatactatt

SEQ ID NO: 50096 - DNA, 75 bp, Artificial Sequence
  Synthetic
tgcaacatttaatctattttactatatttataggcaagccctgcaatgtttaaaaccaccttagctctaattact

SEQ ID NO: 50097 - DNA, 75 bp, Artificial Sequence
  Synthetic
atttataggcaagccctgcaatgtttaaaaccaccttagctctaattactcagacttaacccttgactgcgtgcc

SEQ ID NO: 50098 - DNA, 75 bp, Artificial Sequence
  Synthetic
tctcaaagatatcaatcccccctttacccacgttgacacagacagcttcagtagtggttttcctgtccttgttta

SEQ ID NO: 50099 - DNA, 75 bp, Artificial Sequence
  Synthetic
caatggttttctgaaggtgatcttacccgcagaagtaccagaaacgttgcaaatgcagaggaatttatcatatct

SEQ ID NO: 50100 - DNA, 75 bp, Artificial Sequence
  Synthetic
gtagtggttttcctgtccttgtttaaccatggactttttgaggaaccttgactggactcaggtaattgctggcca

SEQ ID NO: 50101 - DNA, 75 bp, Artificial Sequence
  Synthetic
tgaaattcattagcacctccggcagagcaatgagtgcaggcaagattggtaatgtcctttcctatgcacataatc

SEQ ID NO: 50102 - DNA, 75 bp, Artificial Sequence
  Synthetic
ctatcatagtatagccgagttaaccatgcccaacaagacagatcattcataccacaacatcaaacacctaacaga

SEQ ID NO: 50103 - DNA, 75 bp, Artificial Sequence
  Synthetic
atgcccaacaagacagatcattcataccacaacatcaaacacctaacagaagtggcagcacggaagtattacaag

SEQ ID NO: 50104 - DNA, 75 bp, Artificial Sequence
  Synthetic
ctcttgattgagatcaagagattgtatgctctacaagaagattctgaagtagagccaatagccataatttgtgat

SEQ ID NO: 50105 - DNA, 75 bp, Artificial Sequence
  Synthetic
atgctctacaagaagattctgaagtagagccaatagccataatttgtgatggcatagagggcaacatgaaacagt

SEQ ID NO: 50106 - DNA, 75 bp, Artificial Sequence
  Synthetic
gatgacataagaaattctccaacgcacagcacagcttggaagcatgctcttcgactgaaggggaccgcatacgaa

SEQ ID NO: 50107 - DNA, 75 bp, Artificial Sequence
  Synthetic
agactttgtttcctgacaagttcgaagatttcctggatcgaacccagttgcatccggagttcagagacctgactc

SEQ ID NO: 50108 - DNA, 75 bp, Artificial Sequence
  Synthetic
accaagtctgaccatgttgatacagactctgtttcctgacaagtttgaggacttcttggaccgaacccagttgca

SEQ ID NO: 50109 - DNA, 75 bp, Artificial Sequence
  Synthetic
actctgtttcctgacaagtttgaggacttcttggaccgaacccagttgcacccagagttcagagatctaactcct

SEQ ID NO: 50110 - DNA, 75 bp, Artificial Sequence
  Synthetic
ccgacttttcgctcacacaaaaggttcactttaaaagaaatcagatacccagtgtcgaaaatgtgcaaatctcca

SEQ ID NO: 50111 - DNA, 75 bp, Artificial Sequence
  Synthetic
agagaccttaagtttggtagataaagtcatagctgtggatcagttgacctcgtcctcaggtgatgaactgcaaga

SEQ ID NO: 50112 - DNA, 75 bp, Artificial Sequence
  Synthetic
tcactttaaaagaaatcagatacccagtgtcgaaaatgtgcaaatctccattgatgcgacgttgcctgaatctgt

SEQ ID NO: 50113 - DNA, 75 bp, Artificial Sequence
  Synthetic
ctatgaagaccttgcattagcacttgcaagtgcagaggaaccgtatagacggtcgagcctagatgaggtcactct

SEQ ID NO: 50114 - DNA, 75 bp, Artificial Sequence
  Synthetic
tgttgaaaatgtgcagatctccattgatgctacattgcctgaatctgtggaggcagtgccagtgacagaaagaaa

SEQ ID NO: 50115 - DNA, 75 bp, Artificial Sequence
  Synthetic
gatgctacattgcctgaatctgtggaggcagtgccagtgacagaaagaaagatgtttcctctacctgagactcca

SEQ ID NO: 50116 - DNA, 75 bp, Artificial Sequence
  Synthetic
aactggttaataaaagtcagaacataccgacaagagtcggcagggttctggactgcatgttcaactgcaaactat

SEQ ID NO: 50117 - DNA, 75 bp, Artificial Sequence
  Synthetic
catgcatggaggaaagccctcagccacaaaaaaggatgaagatctgacagagcaagatagccaacaaaacgccat

SEQ ID NO: 50118 - DNA, 75 bp, Artificial Sequence
  Synthetic
actgaacacgagagttccagcatctctgcctttaaagactacggagagagagggatagtcgaggaaaatcacatg

SEQ ID NO: 50119 - DNA, 75 bp, Artificial Sequence
  Synthetic
acaaaaaaggatgaagatctgacagagcaagatagccaacaaaacgccattgaacatgagagctcgagcatctcg

SEQ ID NO: 50120 - DNA, 75 bp, Artificial Sequence
  Synthetic
agacaaggcagctgttgttggtggaagttggttttcaaactgacatcgatgggaaaataaggacagaccacaaga

SEQ ID NO: 50121 - DNA, 75 bp, Artificial Sequence
  Synthetic
gttcagtgaggaggatcaactggaaacaaggcagctgttgttggtggaagttggttttcaaacagatatcgacgg

SEQ ID NO: 50122 - DNA, 75 bp, Artificial Sequence
  Synthetic
acaaggcagctgttgttggtggaagttggttttcaaacagatatcgacgggaaaataaggacagatcacaaaaaa

SEQ ID NO: 50123 - DNA, 75 bp, Artificial Sequence
  Synthetic
agttggttttcaaactgacatcgatgggaaaataaggacagaccacaagaagtggaaagacatattaaagctatt

SEQ ID NO: 50124 - DNA, 75 bp, Artificial Sequence
  Synthetic
tgtcgcctgtgcagactgctcatctacaccgccagacagatggtggataacggaggacagagtgcgagtcttaaa

SEQ ID NO: 50125 - DNA, 75 bp, Artificial Sequence
  Synthetic
acaccgccagacagatggtggataacggaggacagagtgcgagtcttaaagaactcagtcagcttcctcttcaac

SEQ ID NO: 50126 - DNA, 75 bp, Artificial Sequence
  Synthetic
ctcagcacagctttgtctggaaagaaggtatacaaggttcttggcaacttaggaaatgaactgctgtataaggca

SEQ ID NO: 50127 - DNA, 75 bp, Artificial Sequence
  Synthetic
aggtatacaaggttcttggcaacttaggaaatgaactgctgtataaggcacctagaaaggccttagcaaccgttt

SEQ ID NO: 50128 - DNA, 75 bp, Artificial Sequence
  Synthetic
tataagcactcagaaggtaaggagttacctaaaggcagggactgcaacaaagacccctgtctcaactaaagatgt

SEQ ID NO: 50129 - DNA, 75 bp, Artificial Sequence
  Synthetic
tacctaaaggcagggactgcaacaaagacccctgtctcaactaaagatgttctagagacttgggaaaagatgaaa

SEQ ID NO: 50130 - DNA, 75 bp, Artificial Sequence
  Synthetic
accataagccctgtcagcctgcttgctttaagaaacctggactttgactgtcttagtgtgcaagactacaatggt

SEQ ID NO: 50131 - DNA, 75 bp, Artificial Sequence
  Synthetic
tcttagtgtgcaagactacaatggtatgatagaaaatatgtccaaattagacaacactgatgttgaatttaacca

SEQ ID NO: 50132 - DNA, 75 bp, Artificial Sequence
  Synthetic
acaggcaatgcgcaaaggactagtcgaaggtgtagtcatctctaaggagggctctgaatcatgcatcaacatgtt

SEQ ID NO: 50133 - DNA, 75 bp, Artificial Sequence
  Synthetic
ttgaaggaaaatttggaccgaataactgacgaattcgagcgaacaaaatttaaacatgaacttactcagaatatt

SEQ ID NO: 50134 - DNA, 75 bp, Artificial Sequence
  Synthetic
gaaggtgtagtcatctctaaggagggctctgaatcatgcatcaacatgttgaaagaaaacctagaccgaataact

SEQ ID NO: 50135 - DNA, 75 bp, Artificial Sequence
  Synthetic
atgatagaaaatatgtccaaattagacaacactgatgttgaatttaaccacagggaaatagctgatctcaaccaa

SEQ ID NO: 50136 - DNA, 75 bp, Artificial Sequence
  Synthetic
taaccatgttgaggattttatcagaaggtatggtatactgactcttgggactttgtcaccctttggtaggttgtt

SEQ ID NO: 50137 - DNA, 75 bp, Artificial Sequence
  Synthetic
cactagtgaaaagatgctgttgagctggttaagtgaagatattaagtcatcaaggtgtagtgaatgcctcgtcaa

SEQ ID NO: 50138 - DNA, 75 bp, Artificial Sequence
  Synthetic
tggttaagtgaagatattaagtcatcaaggtgtagtgaatgcctcgtcaacataaagaaaactgttgatgaaact

SEQ ID NO: 50139 - DNA, 75 bp, Artificial Sequence
  Synthetic
aagtcactgtggtaactgtcaccccaatggtgtaaacattagcaatacatccaatgtgtgcaagaggtgtcccaa

SEQ ID NO: 50140 - DNA, 75 bp, Artificial Sequence
  Synthetic
aatggtgtaaacattagcaatacatccaatgtgtgcaagaggtgtcccaagatagaggtagttagtcattgtgaa

SEQ ID NO: 50141 - DNA, 75 bp, Artificial Sequence
  Synthetic
aagtagagccaatagctataatttgcgatggcatagaaagcaatatgaaacagttatttgctatactgcctcctg

SEQ ID NO: 50142 - DNA, 75 bp, Artificial Sequence
  Synthetic
aaactgagaaggagagaagagtcaaacgtaatgtggaatatcttataaaactgatgatgagcatgtcaggcattg

SEQ ID NO: 50143 - DNA, 75 bp, Artificial Sequence
  Synthetic
tgttaggctcacattgccagggaaaactgagaaagaaagaagagttaagcgtaatgtggaatatctgataaaatt

SEQ ID NO: 50144 - DNA, 75 bp, Artificial Sequence
  Synthetic
actgagaaagaaagaagagttaagcgtaatgtggaatatctgataaaattgatgatgaacttgtcaggcatcgac

SEQ ID NO: 50145 - DNA, 75 bp, Artificial Sequence
  Synthetic
ttttgatgacattagaaactctccaacgcacagtacagcttggaagcatgctctccggctaaaagggactgcata

SEQ ID NO: 50146 - DNA, 75 bp, Artificial Sequence
  Synthetic
actagctgagaagatagacactgttaggaaagagctttcagaatctaaactgaaagattattcaacttatgcaag

SEQ ID NO: 50147 - DNA, 75 bp, Artificial Sequence
  Synthetic
aaaacataacgatgggaacttgaaggacaggagtgatgacgaccaaaaactagcagagaagatagacattgttag

SEQ ID NO: 50148 - DNA, 75 bp, Artificial Sequence
  Synthetic
gacaggagtgatgacgaccaaaaactagcagagaagatagacattgttagaaaagagctttcagagaccaagcta

SEQ ID NO: 50149 - DNA, 75 bp, Artificial Sequence
  Synthetic
tctctctaaacaggggaaatcgaagtgttctgtgccaaggtcttggctggaaaagatactgtttgacttaaaagt

SEQ ID NO: 50150 - DNA, 75 bp, Artificial Sequence
  Synthetic
ttataaacatcagaaactcattgaaagctagatccgagtttgttagaaataacgataaactactcataaggtcaa

SEQ ID NO: 50151 - DNA, 75 bp, Artificial Sequence
  Synthetic
gcctactaaagatgaagaagtgctaataaacatcagaaattcattaaaggctaaatctgagtttgttagaaacaa

SEQ ID NO: 50152 - DNA, 75 bp, Artificial Sequence
  Synthetic
tccactaagtgaggtacattcaatagagcgtatcatggaaaacttcactcgcctcatgcatgaaggaaagccttc

SEQ ID NO: 50153 - DNA, 75 bp, Artificial Sequence
  Synthetic
tgcagtcattcaaattgatgaaaaacaagcagcctgtgccttttcaagttgactgtatactatttaaagaagtag

SEQ ID NO: 50154 - DNA, 75 bp, Artificial Sequence
  Synthetic
gtggaacaggacaatcatcagaatgccattgaacatgagagctcaagcatcctggccttcaaggactatggagaa

SEQ ID NO: 50155 - DNA, 75 bp, Artificial Sequence
  Synthetic
caagcagcctgtgccttttcaagttgactgtatactatttaaagaagtagcagctgaatgcatgaaaaggtacat

SEQ ID NO: 50156 - DNA, 75 bp, Artificial Sequence
  Synthetic
ggaaacaaggcagctgctgttggtggaagttggttttcagactgacatcgatgggaaaataaggacagaccacaa

SEQ ID NO: 50157 - DNA, 75 bp, Artificial Sequence
  Synthetic
tattaacaaggttcacttggtttcaagaggtagtgctttatggtaaaatatgtgaaacctttctgagatgctgta

SEQ ID NO: 50158 - DNA, 75 bp, Artificial Sequence
  Synthetic
agaggtagtgctttatggtaaaatatgtgaaacctttctgagatgctgtacagaatttaatagatcaggagttaa

SEQ ID NO: 50159 - DNA, 75 bp, Artificial Sequence
  Synthetic
caaacaaaaaggaaaacatgttgtgttgtgtatacagtagcaacatggagctcttacaaggacctttctttttga

SEQ ID NO: 50160 - DNA, 75 bp, Artificial Sequence
  Synthetic
ctcttacaaggacctttctttttgaacagaaggcaagctgtccttggctcatcatacctttacattgtcattaca

SEQ ID NO: 50161 - DNA, 75 bp, Artificial Sequence
  Synthetic
aagttacctaaaggcagggactgcaacaaaaacccctgtgtcaacaaaagacgttctagagacctgggaaaggat

SEQ ID NO: 50162 - DNA, 75 bp, Artificial Sequence
  Synthetic
tgtaaatgaaaaaacattgcaagacattgagaaccactctatgactctgctagaagatgcattcaaagaacttac

SEQ ID NO: 50163 - DNA, 75 bp, Artificial Sequence
  Synthetic
attgagaaccactctatgactctgctagaagatgcattcaaagaacttacatttgctctcgaaggtagatttgaa

SEQ ID NO: 50164 - DNA, 75 bp, Artificial Sequence
  Synthetic
acaaaaacccctgtgtcaacaaaagacgttctagagacctgggaaaggatgaaagagcacatacttaacaggcca

SEQ ID NO: 50165 - DNA, 75 bp, Artificial Sequence
  Synthetic
gtgcagtaagagagatggccctagatgctcttttgcagcactgttaagcctagttcatgaggattggcagaggat

SEQ ID NO: 50166 - DNA, 75 bp, Artificial Sequence
  Synthetic
ggtcgaaggtgtagtcatctccaaggaaggctctgaatcatgcatcaacatgttaaaggaaaattttgaccaaat

SEQ ID NO: 50167 - DNA, 75 bp, Artificial Sequence
  Synthetic
aaacagaagcagcagagatcactttataagcatcatctcaggcttgaacctagtttatggcttccttataaagga

SEQ ID NO: 50168 - DNA, 75 bp, Artificial Sequence
  Synthetic
ataagcatcatctcaggcttgaacctagtttatggcttccttataaaggataatttattggccaactcccaacaa

SEQ ID NO: 50169 - DNA, 75 bp, Artificial Sequence
  Synthetic
gaaggctctgaatcatgcatcaacatgttaaaggaaaattttgaccaaataactgatgagtttgaacggacaaag

SEQ ID NO: 50170 - DNA, 75 bp, Artificial Sequence
  Synthetic
gagttggctaagtgaggatattaagtcatcgagatgtagtgagtgcctctctagcataaagaaaactgttgatga

SEQ ID NO: 50171 - DNA, 75 bp, Artificial Sequence
  Synthetic
taggcttgtttgtcctaatgagctgggaaaaaagttttcaacgagctgtagaaggattgaggataatattgcaag

SEQ ID NO: 50172 - DNA, 75 bp, Artificial Sequence
  Synthetic
ctagcataaagaaaactgttgatgaaactgccaacttatcagaaaagattgaaatgcttgcttacaatctgcaac

SEQ ID NO: 50173 - DNA, 75 bp, Artificial Sequence
  Synthetic
atattaagcactggaagcaaagagatctatgccctgaggtgaccattccatgttttacagtctatggcacctttg

SEQ ID NO: 50174 - DNA, 75 bp, Artificial Sequence
  Synthetic
ttcctctcagtcaactcaattgctttaactgatccactttgcaaacctaccagtcctctctttctcaaccattta

SEQ ID NO: 50175 - DNA, 75 bp, Artificial Sequence
  Synthetic
tgaaggatgtatcagcgtcttggaagaaacagcagaaaggcacatgctttgggaactcgatctgatgaattcact

SEQ ID NO: 50176 - DNA, 75 bp, Artificial Sequence
  Synthetic
agaaccgcaagactattactaggctgcccaaatgtgaggaaagcagcaaacagagaagggaagaagctgttgaag

SEQ ID NO: 50177 - DNA, 75 bp, Artificial Sequence
  Synthetic
tacccacgttgacacagtcagctccagtggtggctttttgtctctgtggtacaatggacttcttgaggaaccttg

SEQ ID NO: 50178 - DNA, 75 bp, Artificial Sequence
  Synthetic
aacagcagaaaggcatatgctctgggaactcgatctgatgaactcactttgttctgacgagaggaaagatgctag

SEQ ID NO: 50179 - DNA, 75 bp, Artificial Sequence
  Synthetic
atttccgattacttcgagattgtgcggcagcctggtgatgggaactgcttctaccacagcatagctgagttaacc

SEQ ID NO: 50180 - DNA, 75 bp, Artificial Sequence
  Synthetic
aagaagggaaaaagctattgaagctgaacagcgatacatccactgatacacagagcattgcttctgaagtatcag

SEQ ID NO: 50181 - DNA, 75 bp, Artificial Sequence
  Synthetic
ttaggaaggagctttcggaaactaaactaaaggattattcagcttatgcaagaggagtgatctctaattcactaa

SEQ ID NO: 50182 - DNA, 75 bp, Artificial Sequence
  Synthetic
gaacagcgatacatccactgatacacagagcattgcttctgaagtatcagacaggaggtcctacagctcaagcaa

SEQ ID NO: 50183 - DNA, 75 bp, Artificial Sequence
  Synthetic
actaaaggattattcagcttatgcaagaggagtgatctctaattcactaaagaacctttcaaaacaaggtaaatc

SEQ ID NO: 50184 - DNA, 75 bp, Artificial Sequence
  Synthetic
ttgagctaaggtcaggccttgaagtcttcaatgacccctttaatgactatcagcaggcaataacagacatctgcc

SEQ ID NO: 50185 - DNA, 75 bp, Artificial Sequence
  Synthetic
cttcaatgacccctttaatgactatcagcaggcaataacagacatctgccagttttctgagtatacaccaaacaa

SEQ ID NO: 50186 - DNA, 75 bp, Artificial Sequence
  Synthetic
aggtgcccactaaagatgaagaagtgcttataaacatcaggaattcactgaaggctagatctgagtttgttagga

SEQ ID NO: 50187 - DNA, 75 bp, Artificial Sequence
  Synthetic
ccaattttctgagtacacaccaaacaaagaaagcattttgaaagactgtcttcaaatcatacgaaaaaaccctag

SEQ ID NO: 50188 - DNA, 75 bp, Artificial Sequence
  Synthetic
aatcatttggactgttgctgccagtgatgaagtggaggcaggcataaaattcggagacggtgatgtgtttacagc

SEQ ID NO: 50189 - DNA, 75 bp, Artificial Sequence
  Synthetic
acacaatgggatcttttgagctgatccaggcaatttcagaattcggcatgagcaagtttcctcctgagaatatag

SEQ ID NO: 50190 - DNA, 75 bp, Artificial Sequence
  Synthetic
aactgggttagcatctctgaagtaaccgaaacaacaagtatagttgcatcacctagaactcatatgatgctcaag

SEQ ID NO: 50191 - DNA, 75 bp, Artificial Sequence
  Synthetic
acaatgacaaactactcataagatcaaaggaggagttgaaaaaatgtttcgatgtgcaatcctttaaattgatga

SEQ ID NO: 50192 - DNA, 75 bp, Artificial Sequence
  Synthetic
ataaggcaagaagagacccaaagaactgggttagcatatctgaagtgacagaaacaacaagtatagttgcatcgc

SEQ ID NO: 50193 - DNA, 75 bp, Artificial Sequence
  Synthetic
ttcgagggaagctaaaaaaactcggtgccatatcaacaaacatagagatagggaaaagggattgcctggatctac

SEQ ID NO: 50194 - DNA, 75 bp, Artificial Sequence
  Synthetic
atccttctaccattggaaggaattggtcaaaaaaaacattgatgaagttttacttactgaagatggaaatctgat

SEQ ID NO: 50195 - DNA, 75 bp, Artificial Sequence
  Synthetic
gggatatttgagccctcaaagttgtccttctaccattggaaagaattgatcaaaaaaaacattgacgaggtacta

SEQ ID NO: 50196 - DNA, 75 bp, Artificial Sequence
  Synthetic
ccttctaccattggaaagaattgatcaaaaaaaacattgacgaggtactacttactgaggatggaaatctgatct

SEQ ID NO: 50197 - DNA, 75 bp, Artificial Sequence
  Synthetic
tgtctcttttctagtgaggaattcaatgagttaattaagttgaagaaactcctcctcaatgaacaacaagatgaa

SEQ ID NO: 50198 - DNA, 75 bp, Artificial Sequence
  Synthetic
aggctcaagttcatgaatgtgcattctccagagctgatgccagaaaactgtctcttctctagtgaagaatttaat

SEQ ID NO: 50199 - DNA, 75 bp, Artificial Sequence
  Synthetic
ggagctgaagcaagaccttttaatatcttcttggattaagtgcatgacagcctgtaaggattttgcaagcatcaa

SEQ ID NO: 50200 - DNA, 75 bp, Artificial Sequence
  Synthetic
ctttataagcattatttcaggcttaaacttggtctatggcttcctcataaaagacaacttattagctaactcaca

SEQ ID NO: 50201 - DNA, 75 bp, Artificial Sequence
  Synthetic
taataaaacggctggagaaaaactttcttaagcagcacaatccggaaattatggaaacagtaaatctcatattct

SEQ ID NO: 50202 - DNA, 75 bp, Artificial Sequence
  Synthetic
gacaacattaagcactggaagcaaagagatttatgccctgaagtgaccatcccatgttttacagtttatggcacc

SEQ ID NO: 50203 - DNA, 75 bp, Artificial Sequence
  Synthetic
tatctggtgagacatcccgagatacttgactgtggatctaaagaggattgtaagctcaccttgcttgatctgtca

SEQ ID NO: 50204 - DNA, 75 bp, Artificial Sequence
  Synthetic
ttgactgtggatctaaagaggattgtaagctcaccttgcttgatctgtcagtttctaaactcttagtctgtttgt

SEQ ID NO: 50205 - DNA, 75 bp, Artificial Sequence
  Synthetic
atacaataaagagatggacaattttgacgaaggatgtatcagcgtcttggaagaaacagcagaaaggcatatgct

SEQ ID NO: 50206 - DNA, 75 bp, Artificial Sequence
  Synthetic
gacgaaggatgtatcagcgtcttggaagaaacagcagaaaggcatatgctctgggagctcgacctgatgaacaca

SEQ ID NO: 50207 - DNA, 75 bp, Artificial Sequence
  Synthetic
tttttggtaaagtatgctgtcaccttattcacatccaatggtgagcctttttcgcttagtctgaatgatgggggt

SEQ ID NO: 50208 - DNA, 75 bp, Artificial Sequence
  Synthetic
tattcacatccaatggtgagcctttttcgcttagtctgaatgatgggggtttggatcttgatctacataagacca

SEQ ID NO: 50209 - DNA, 75 bp, Artificial Sequence
  Synthetic
ctatccggaaatagttatgacttcatctggaccacccaaatgatagcaaatagcaacttcaacgtctgcaaaagg

SEQ ID NO: 50210 - DNA, 75 bp, Artificial Sequence
  Synthetic
tctggaccacccaaatgatagcaaatagcaacttcaacgtctgcaaaaggttgactggaaggagcaccggagaaa

SEQ ID NO: 50211 - DNA, 75 bp, Artificial Sequence
  Synthetic
gtaggagaaacaggcatggcaatactgcaacaattagcctttgcacaggcgctaaattatgaacaccgcttctat

SEQ ID NO: 50212 - DNA, 75 bp, Artificial Sequence
  Synthetic
ttatcagcaagcaataacagacgtttgtcaattttctgagtatacaccgaacaaagaaagtattttgaaggactg

SEQ ID NO: 50213 - DNA, 75 bp, Artificial Sequence
  Synthetic
tgcaacaattagcctttgcacaggcgctaaattatgaacaccgcttctatgcagttttagcacctaaagcacagc

SEQ ID NO: 50214 - DNA, 75 bp, Artificial Sequence
  Synthetic
tcttcaaattatacgaaagaatcctagccacacaatgggttcttttgagctaattcaagcaatctcagagttcgg

SEQ ID NO: 50215 - DNA, 75 bp, Artificial Sequence
  Synthetic
catgcaactacggaaatgttcagtagaaacctcttgaaaactacacctgatgatggcctaacaaacccgcatctt

SEQ ID NO: 50216 - DNA, 75 bp, Artificial Sequence
  Synthetic
gaaacctcttgaaaactacacctgatgatggcctaacaaacccgcatcttaaggagacaatccttaacgtaggtt

SEQ ID NO: 50217 - DNA, 75 bp, Artificial Sequence
  Synthetic
caaagtcatatgtatctcgggtgataataccaagtggggcccgatacactgctgttctttcttttctggcatgat

SEQ ID NO: 50218 - DNA, 75 bp, Artificial Sequence
  Synthetic
ggtagcaacttggtcaatttctacaaagttatttgcatctcgggtgataataccaagtggggcccgatacactgc

SEQ ID NO: 50219 - DNA, 75 bp, Artificial Sequence
  Synthetic
aagttatttgcatctcgggtgataataccaagtggggcccgatacactgctgctccttcttttctggtatgatgc

SEQ ID NO: 50220 - DNA, 75 bp, Artificial Sequence
  Synthetic
ttggtgctatttcaacaaacatagagatcgggaaaagagattgcctggatttactcagcacggtagatggtctaa

SEQ ID NO: 50221 - DNA, 75 bp, Artificial Sequence
  Synthetic
ggtagaaatacctgctggcagtattaagaagatcttaaatgttcttaggtatagattgtgcagcaagggaggtgt

SEQ ID NO: 50222 - DNA, 75 bp, Artificial Sequence
  Synthetic
ttcatcaagaacttatgtaggcaggtagaaatacctgccggcagcattaagaagatcttaaatgttctcagatac

SEQ ID NO: 50223 - DNA, 75 bp, Artificial Sequence
  Synthetic
cagatcaacagaaagagaatatcgtgaacgggatatttgaaccctcaaagttgtctttttaccactggaaagaat

SEQ ID NO: 50224 - DNA, 75 bp, Artificial Sequence
  Synthetic
gaagatcttaaatgttctcagatacaagttgtgtagcaaaggaggtgtagaacaacacagtgaagaggatctgag

SEQ ID NO: 50225 - DNA, 75 bp, Artificial Sequence
  Synthetic
cattcccctgaactgatgccagaaaactgtctcttttctagtgaggaatttaatgagttgatcaagttaaagaaa

SEQ ID NO: 50226 - DNA, 75 bp, Artificial Sequence
  Synthetic
caaagggcttatggcattaaacagttacaaccatatgggtcaaggtattcatcatgcaacttcttcagtgttaac

SEQ ID NO: 50227 - DNA, 75 bp, Artificial Sequence
  Synthetic
taatgagttgatcaagttaaagaaactcctcctcaacgaacaacaagatgaacaggagataaagcaagatctctt

SEQ ID NO: 50228 - DNA, 75 bp, Artificial Sequence
  Synthetic
aaagcttaccccagacgacagtacatgttgagcatgccggtagttctgatgattacgcaaagtgcatagtggtaa

SEQ ID NO: 50229 - DNA, 75 bp, Artificial Sequence
  Synthetic
cttttatcgcctgtgccgactgctcgtctacaccgccagatagatggtggattacggaggacagagtacgagtct

SEQ ID NO: 50230 - DNA, 75 bp, Artificial Sequence
  Synthetic
tcaatgataaggtccagaaattcatttatcacctttctgaagagctatatgacataaggctgcagcacctggaat

SEQ ID NO: 50231 - DNA, 75 bp, Artificial Sequence
  Synthetic
tgttgagcatgccggtagttctgatgattacgcaaagtgcatagtggtaactggcatactgtcaaaagagcttta

SEQ ID NO: 50232 - DNA, 75 bp, Artificial Sequence
  Synthetic
tcacagctgctgtacagagatgttgtcaaatgaaagacagtgccaagaccttggtgagcgactgtttccttgagt

SEQ ID NO: 50233 - DNA, 75 bp, Artificial Sequence
  Synthetic
cagctctgtgacctctcctcagagtttgatgcaagcatgccaagtttcatcccaacaagcaatgtataatagtgt

SEQ ID NO: 50234 - DNA, 75 bp, Artificial Sequence
  Synthetic
ttggtgagcgactgtttccttgagttttatagtgaatttatgatgggctacagagtgaccccagctgtgattaag

SEQ ID NO: 50235 - DNA, 75 bp, Artificial Sequence
  Synthetic
caacaagctatgtataatagtgttcctcttatcaccaacactgcctttaccctactaaggcaacaaattttcttt

SEQ ID NO: 50236 - DNA, 75 bp, Artificial Sequence
  Synthetic
cttatctccctttggcagactgtttgtaccaacctactcagggttagttagttcagcagttgctctagaagatgc

SEQ ID NO: 50237 - DNA, 75 bp, Artificial Sequence
  Synthetic
gttcagcagttgctctagaagatgctgaagtcattgctagagcagctcagacacttcatatgaacagtgtatcaa

SEQ ID NO: 50238 - DNA, 75 bp, Artificial Sequence
  Synthetic
caaatagcaacttcaatgtctgtaaaaggttgactggaaggagcactggggaaaggcttccaagaagcgtcagga

SEQ ID NO: 50239 - DNA, 75 bp, Artificial Sequence
  Synthetic
acatctaatgtatgcaagaggtgccctaaaatagaagtggttagtcattgtgaaaacaaaggctttgaggacagc

SEQ ID NO: 50240 - DNA, 75 bp, Artificial Sequence
  Synthetic
gaaaggcttccaagaagcgtcaggagcaaggtcatttatgagatggtaaaattggtaggagagacaggcatggca

SEQ ID NO: 50241 - DNA, 75 bp, Artificial Sequence
  Synthetic
tagtgcaagaaactgggaccaaagttatgcatgcaactactgaaatgttcagtagaaacctcctaaagacaacat

SEQ ID NO: 50242 - DNA, 75 bp, Artificial Sequence
  Synthetic
ggatattacaggtcatttggaggggaaggaaccgagaaacaggtaaaggcatcattgaatagagacgacaataaa

SEQ ID NO: 50243 - DNA, 75 bp, Artificial Sequence
  Synthetic
gagagatggtaagagaagagggaatctagaactggcaaatagaatccagtctgtgttatgtgtcctgatagcagg

SEQ ID NO: 50244 - DNA, 75 bp, Artificial Sequence
  Synthetic
aaaacctctcaaagcagggtaagtcaaagtgttctgtgccgaggtcttggcttgaaaagatattgtttgacttaa

SEQ ID NO: 50245 - DNA, 75 bp, Artificial Sequence
  Synthetic
cattgaggatcctatgatacagctaattccagaaaaactgaggagagagttggaaaggttgggagtttctagaat

SEQ ID NO: 50246 - DNA, 75 bp, Artificial Sequence
  Synthetic
ctgttgttctttcttttccggtatgatgcagcaggttctaaaaaatgtccctgactggtgttcattctataagtt

SEQ ID NO: 50247 - DNA, 75 bp, Artificial Sequence
  Synthetic
agcttgtggcaaaaaaactcatcagcctcaatgtttcgacagaagaatactcagctgaagtatctaggctcaaac

SEQ ID NO: 50248 - DNA, 75 bp, Artificial Sequence
  Synthetic
aacattcatcaaaaacttatgtaggcaggtggaaatacctgcaggcagcattaagaagatcttaaatgttcttag

SEQ ID NO: 50249 - DNA, 75 bp, Artificial Sequence
  Synthetic
cctcaatgtttcgacagaagaatactcagctgaagtatctaggctcaaacaaacactaacagcccgaaatgttct

SEQ ID NO: 50250 - DNA, 75 bp, Artificial Sequence
  Synthetic
tattcatgaaatcatacttcttcaaagacaacgtctttttgtcactaacagacagatggtccaccaagcacagca

SEQ ID NO: 50251 - DNA, 75 bp, Artificial Sequence
  Synthetic
agacaacgtctttttgtcactaacagacagatggtccaccaagcacagcacaaactatcgtgacagttgcggtaa

SEQ ID NO: 50252 - DNA, 75 bp, Artificial Sequence
  Synthetic
attcaccatgcaacctcttcagtgttaacttccctagctgctgtactctttgaggagctagcaattttttatctc

SEQ ID NO: 50253 - DNA, 75 bp, Artificial Sequence
  Synthetic
cctccttattcaatccgaacatcagatgtgtgaatctgatcacatttgaggacggcctgagagaactatcagtga

SEQ ID NO: 50254 - DNA, 75 bp, Artificial Sequence
  Synthetic
ttctcagctgttctgtatccattaacaggcataccactgtcaaagagccttccctgtttaatccaaatatcaggt

SEQ ID NO: 50255 - DNA, 75 bp, Artificial Sequence
  Synthetic
caggcataccactgtcaaagagccttccctgtttaatccaaatatcaggtgtgttaacctgatcacattcgaaga

SEQ ID NO: 50256 - DNA, 75 bp, Artificial Sequence
  Synthetic
atgaatttactaacttaaaccttcagttttctgatccgaacagacagaaacttagaatagttgagtctagacctg

SEQ ID NO: 50257 - DNA, 75 bp, Artificial Sequence
  Synthetic
gttttctgatccgaacagacagaaacttagaatagttgagtctagacctgcagaatctgagctggaggccaatcg

SEQ ID NO: 50258 - DNA, 75 bp, Artificial Sequence
  Synthetic
aacagctctgtaacctctcctcagagtctgatgcaagcatgccaggtttcatctcaacaagcaatgtataatagt

SEQ ID NO: 50259 - DNA, 75 bp, Artificial Sequence
  Synthetic
gggctacctattggatgaatcagcaatttctgaagtcaaacctaccaaggttgacttttcgaatctgctcaaaga

SEQ ID NO: 50260 - DNA, 75 bp, Artificial Sequence
  Synthetic
gatgctgacagatgaatcgtcagattcagaaaagagtggccttagtccagatttgcaacaagttgcaagatactc

SEQ ID NO: 50261 - DNA, 75 bp, Artificial Sequence
  Synthetic
tgctagcagatgaatcaacagattcagaaaaaaatggtcttagtccagatctgcagcaagttgcaaggtactcaa

SEQ ID NO: 50262 - DNA, 75 bp, Artificial Sequence
  Synthetic
agaaggtatggtatattaactcttggaaccttgtctccctttggtaggctatttgtaccgacctactcggggttg

SEQ ID NO: 50263 - DNA, 75 bp, Artificial Sequence
  Synthetic
atttgtaccgacctactcggggttggttagctcagcggttgccttggaagatgctgaagtcattgccagggcagc

SEQ ID NO: 50264 - DNA, 75 bp, Artificial Sequence
  Synthetic
actgttttctacatgctaaagggcaacttgatgaatacagagccgacagttgctgagcttgtcagttacggtata

SEQ ID NO: 50265 - DNA, 75 bp, Artificial Sequence
  Synthetic
aaggaaggtaggttttataggctttccgacaccggaattgatgcaagcacatactccataaaatactggaaaatt

SEQ ID NO: 50266 - DNA, 75 bp, Artificial Sequence
  Synthetic
gtcttcactgcttatgagtttcctaaattggagggtgaacatggacattagagcttctgactgtccattgtctag

SEQ ID NO: 50267 - DNA, 75 bp, Artificial Sequence
  Synthetic
aattggagggtgaacatggacattagagcttctgactgtccattgtctagccatgaagcaagtatactaagtgaa

SEQ ID NO: 50268 - DNA, 75 bp, Artificial Sequence
  Synthetic
aggcctctgtctgaaactgaactacaattcattaaggcactaaacagcctcaaatcaactcaagcctgtgaggtg

SEQ ID NO: 50269 - DNA, 75 bp, Artificial Sequence
  Synthetic
aaactcaccaactgaattgttgaagaagaagccttacttagggacaacttgcaagttcaacacctggggagactc

SEQ ID NO: 50270 - DNA, 75 bp, Artificial Sequence
  Synthetic
ctttgctctgacgaaaaaagagatgccagaaccgcaagattattactaggttgcccaaatgtgaggaaagctgca

SEQ ID NO: 50271 - DNA, 75 bp, Artificial Sequence
  Synthetic
aaaacgagactctgaacgagaaggtctaactgatctccttgattacctgaactctcccacagaactgttgaagaa

SEQ ID NO: 50272 - DNA, 75 bp, Artificial Sequence
  Synthetic
ctaactgatctccttgattacctgaactctcccacagaactgttgaagaagaagccttacttagggacaacctgc

SEQ ID NO: 50273 - DNA, 75 bp, Artificial Sequence
  Synthetic
gaatctggaactagcaaacagaatccaatctgtactgtgtgttttgatagcagggtattacaggtcattcggtgg

SEQ ID NO: 50274 - DNA, 75 bp, Artificial Sequence
  Synthetic
caatctgtactgtgtgttttgatagcagggtattacaggtcattcggtggagaagggaccgagaaacaagtgaag

SEQ ID NO: 50275 - DNA, 75 bp, Artificial Sequence
  Synthetic
tagtagatctggggagtccataggcatcttcattgcagggaagctgcacatccatctctcatctgagtccattgc

SEQ ID NO: 50276 - DNA, 75 bp, Artificial Sequence
  Synthetic
atcttcattgcagggaagctgcacatccatctctcatctgagtccattgctctgctatgtgagactgagaggcaa

SEQ ID NO: 50277 - DNA, 75 bp, Artificial Sequence
  Synthetic
aagtctttaatgaccctttcaatgattatcagcaagcaataacagacatttgtcaattttctgagtatacaccaa

SEQ ID NO: 50278 - DNA, 75 bp, Artificial Sequence
  Synthetic
gcaccagttgttcctaagccaccttccccagtctcatgaatgcttacaaaagcacaaggatggcagtgcgctatc

SEQ ID NO: 50279 - DNA, 75 bp, Artificial Sequence
  Synthetic
gctcagcttgtggcaaaaaagctcatcagtctcaatgtttctacggaagaatactctgctgaagtgtctaggctc

SEQ ID NO: 50280 - DNA, 75 bp, Artificial Sequence
  Synthetic
ccccagtctcatgaatgcttacaaaagcacaaggatggcagtgcgctatcagtaatacctgatggcagcaacccc

SEQ ID NO: 50281 - DNA, 75 bp, Artificial Sequence
  Synthetic
ttttgcacgggttagctggaggaattaaggagctctcacttcctatatatacgatattcatgaagtcttacttct

SEQ ID NO: 50282 - DNA, 75 bp, Artificial Sequence
  Synthetic
caaaaagcaaattttgacagttaagaagcaagttgtgtttgatgcagagagcgagcctagattacagtggggaca

SEQ ID NO: 50283 - DNA, 75 bp, Artificial Sequence
  Synthetic
aagcaagttgtgtttgatgcagagagcgagcctagattacagtggggacatggctgcctgtccattgtttatgat

SEQ ID NO: 50284 - DNA, 75 bp, Artificial Sequence
  Synthetic
agcacaaactaccgtgacagctgcggcaaacaactgactggtagaataatcaccaagtatactcactggctagac

SEQ ID NO: 50285 - DNA, 75 bp, Artificial Sequence
  Synthetic
gcttgttgactgctctacagacagaaagaagcttttacctcagtcagtgttttctgactccaaagtcgtcctctc

SEQ ID NO: 50286 - DNA, 75 bp, Artificial Sequence
  Synthetic
ccactgtttcctaaaacatgctcctagtgatgccataatggaggtagagagcaaaagtagcttgctacacaagta

SEQ ID NO: 50287 - DNA, 75 bp, Artificial Sequence
  Synthetic
acttttctgagctgctctgtctccattaacaggcatactgctgtcaaagaaccttccctgtttaatccaaatatt

SEQ ID NO: 50288 - DNA, 75 bp, Artificial Sequence
  Synthetic
tttctgactccaaagtcgtcctctcaaggatcaagttcaaaacggagcttctccttaactcattaacactgctcc

SEQ ID NO: 50289 - DNA, 75 bp, Artificial Sequence
  Synthetic
tgatcagaaagaacattgatgaagttttacttactgaagatggaaatctgatcttctgctggctaaagacaatct

SEQ ID NO: 50290 - DNA, 75 bp, Artificial Sequence
  Synthetic
cgatgctataatggaagtagaaagtaaaagtagcttactacacaagttcctcaaatcaggaggtgtcaggcagcg

SEQ ID NO: 50291 - DNA, 75 bp, Artificial Sequence
  Synthetic
aaaagtagcttactacacaagttcctcaaatcaggaggtgtcaggcagcggaacactgaagtgctttttagagaa

SEQ ID NO: 50292 - DNA, 75 bp, Artificial Sequence
  Synthetic
gaggagattgagttttgcaacaacttgactaagactgtttcagagaacccattaccactcagctgttggtctgaa

SEQ ID NO: 50293 - DNA, 75 bp, Artificial Sequence
  Synthetic
actgttttcagcaactgaacaggttcgactatctaacaaccctgcagttgtcatgggctacttattagatgaatc

SEQ ID NO: 50294 - DNA, 75 bp, Artificial Sequence
  Synthetic
ggagattgagttctgcaataacctaaccaaaactgtttcagagaacccgctgcctctcagctgttggtctgaagt

SEQ ID NO: 50295 - DNA, 75 bp, Artificial Sequence
  Synthetic
tgcctctcagctgttggtctgaagttcaaaattatattgaagatataggcttcaacaatgtgcttgtcaacattg

SEQ ID NO: 50296 - DNA, 75 bp, Artificial Sequence
  Synthetic
aagaccgctttaaattaatgcaatttttcccttctgtattcactctgatcaagatgctgacggatgagtcatcag

SEQ ID NO: 50297 - DNA, 75 bp, Artificial Sequence
  Synthetic
aatgtgagcaccacaagtaccattaaagatgtgaggactcttgtatcttatgtcagcactgaaaccatacctaag

SEQ ID NO: 50298 - DNA, 75 bp, Artificial Sequence
  Synthetic
aaccagtgtaaggcagtaaaagaactcatcaacagcacaggactctcagacttggaactggaaagcttactcact

SEQ ID NO: 50299 - DNA, 75 bp, Artificial Sequence
  Synthetic
tcaaaccatttgactttgcttagtaggatgatacaacaagcaaagccaactgtaaccgttttctacatgctaaag

SEQ ID NO: 50300 - DNA, 75 bp, Artificial Sequence
  Synthetic
ggatgatacaacaagcaaagccaactgtaaccgttttctacatgctaaagggtaacctgatgaacacggaaccga

SEQ ID NO: 50301 - DNA, 75 bp, Artificial Sequence
  Synthetic
ccagtgcaaggcagtgaaggaactcatcaacagcacaggactctcagacttagagcttgaaagcttgcttactct

SEQ ID NO: 50302 - DNA, 75 bp, Artificial Sequence
  Synthetic
atcaacagcacaggactctcagacttagagcttgaaagcttgcttactctgtgtgccttctatttccagagtgag

SEQ ID NO: 50303 - DNA, 75 bp, Artificial Sequence
  Synthetic
ggaaaaaatatccttgttcgtgcaaacaatgagctaggtgatgtgtcactaaaggttaacattgtcttagtgcct

SEQ ID NO: 50304 - DNA, 75 bp, Artificial Sequence
  Synthetic
acctgagctaaaatccttatccgtgaactgcaaaatggggaactttgaagggcaggagtgctttgagttcactat

SEQ ID NO: 50305 - DNA, 75 bp, Artificial Sequence
  Synthetic
gtcactaaatcatgctctgtccttaatgtttttagacgagatgtcattacctgagctaaaatccttatctgtgaa

SEQ ID NO: 50306 - DNA, 75 bp, Artificial Sequence
  Synthetic
atgtttttagacgagatgtcattacctgagctaaaatccttatctgtgaattgcaaaatggggagccttgaaggg

SEQ ID NO: 50307 - DNA, 75 bp, Artificial Sequence
  Synthetic
aggtctaactgatctccttgactacctaaactcacccactgaactgttgaagaagaagccgtatttaggaacaac

SEQ ID NO: 50308 - DNA, 75 bp, Artificial Sequence
  Synthetic
ctacaacaagctaatcgaccactgtgtggacatggaaaaaaagagagacgcagttagagcagtagaagatttgat

SEQ ID NO: 50309 - DNA, 75 bp, Artificial Sequence
  Synthetic
atagtagcagatctggagaatcaattggcattttcattgctggaaagttgcacgttcatctctcttctgagtcca

SEQ ID NO: 50310 - DNA, 75 bp, Artificial Sequence
  Synthetic
gtggacatggaaaaaaagagagacgcagttagagcagtagaagatttgattctgatgttgacgggcaaggcagtc

SEQ ID NO: 50311 - DNA, 75 bp, Artificial Sequence
  Synthetic
tggcaaacgacacggtaacagactttcctgatagggaagcagaagccctcaaaacaggaaatcttggctttaact

SEQ ID NO: 50312 - DNA, 75 bp, Artificial Sequence
  Synthetic
aaaacaggaaatcttggctttaactgggactcagattgaacatgccgcttataagccattaatacctttcggcgt

SEQ ID NO: 50313 - DNA, 75 bp, Artificial Sequence
  Synthetic
gcaaataagcttagacgatctaatggcaagtgacacagtgatagacttgcctgacagggaagcagaagctctcaa

SEQ ID NO: 50314 - DNA, 75 bp, Artificial Sequence
  Synthetic
aggaggactgaagtaataactaaagaacagcatcagttatttctaagcctccttccccagtcacatgaatgtttg

SEQ ID NO: 50315 - DNA, 75 bp, Artificial Sequence
  Synthetic
gcaagtgacacagtgatagacttgcctgacagggaagcagaagctctcaaaacaggtaatcttggcttcaactgg

SEQ ID NO: 50316 - DNA, 75 bp, Artificial Sequence
  Synthetic
tcctcgacttcttaaatttgtgcccctcaagaagggtctggcagtggtgaaaatcaaaaaacaaattttgacagt

SEQ ID NO: 50317 - DNA, 75 bp, Artificial Sequence
  Synthetic
cttgaggacaagtaagactatttgcatcatgccatttgctgacattaaaactttcaaacaaatcaactgctctgc

SEQ ID NO: 50318 - DNA, 75 bp, Artificial Sequence
  Synthetic
attctcctcaatcaactcaattgcttcaactgatctattttactagctcatcgatcctctctttcttagctattc

SEQ ID NO: 50319 - DNA, 75 bp, Artificial Sequence
  Synthetic
aatcaatcccccccttacccacgttgacacagatagctccagtagtggttcgttgtcctcatcaaactatggact

SEQ ID NO: 50320 - DNA, 75 bp, Artificial Sequence
  Synthetic
actattccgccgttcttccctctctatcattcatttcagtttcactatttccagggtgtggggggaacgaatttc

SEQ ID NO: 50321 - DNA, 75 bp, Artificial Sequence
  Synthetic
agcagcttgttgactgctccacagacaggaagaagcttttaccacagtcggtgttttctgactccaaagttgtcc

SEQ ID NO: 50322 - DNA, 75 bp, Artificial Sequence
  Synthetic
attttgagattgtgcggcagcctggtgatgggaactgcttctatcacagtatagctgagttaaccatgcccaaca

SEQ ID NO: 50323 - DNA, 75 bp, Artificial Sequence
  Synthetic
gggagatagctgatctcaatcaattaacttctcggctcatcacattaagaaaggagaaagacactgacctcctca

SEQ ID NO: 50324 - DNA, 75 bp, Artificial Sequence
  Synthetic
ctccattgtttcctgaaacatgctcccagtgatgctatcatggaagtggagagcaaaagtggcttgttacacaag

SEQ ID NO: 50325 - DNA, 75 bp, Artificial Sequence
  Synthetic
aaacagattactcataccacaacatcaaacatctaactgaggtggcagcacggaagtattaccaggaagagcctg

SEQ ID NO: 50326 - DNA, 75 bp, Artificial Sequence
  Synthetic
ccagtgatgctatcatggaagtggagagcaaaagtggcttgttacacaagtacctcaaatcgggaggtgtcaggc

SEQ ID NO: 50327 - DNA, 75 bp, Artificial Sequence
  Synthetic
ggaagactatcttacgaggatgctatctgacaacgaatggggatcgactcttgaggcatccatgttggctaaaga

SEQ ID NO: 50328 - DNA, 75 bp, Artificial Sequence
  Synthetic
ttgcacgggttagctggaggaattaaggagctttcgcttccaatatatacaatattcatgaaatcttacttcttt

SEQ ID NO: 50329 - DNA, 75 bp, Artificial Sequence
  Synthetic
aaggacaacctcgagcaaggtgcagaagaggaaattgagttttgcaacaatctgactaggactgtttcagaaaac

SEQ ID NO: 50330 - DNA, 75 bp, Artificial Sequence
  Synthetic
aggcttcaacaatgtgcttgtcaacattgatagaaacacggttaaaagtgagcttctgtggaaatttacgctgga

SEQ ID NO: 50331 - DNA, 75 bp, Artificial Sequence
  Synthetic
agtctggtagacaaggttatagctgtggaccaattgacctcatcttcaagtgatgaactgcaggactacgaagac

SEQ ID NO: 50332 - DNA, 75 bp, Artificial Sequence
  Synthetic
ctggaaacatgcctgtagacttaagaacttcacagctgcagtacaaagatgttgtcaaatgaaagatagtgccaa

SEQ ID NO: 50333 - DNA, 75 bp, Artificial Sequence
  Synthetic
cttgctttagcacttactagcgcggaggaaccatatagacggtctagcttggatgaggttaccctgtctaagaaa

SEQ ID NO: 50334 - DNA, 75 bp, Artificial Sequence
  Synthetic
caagcagaggtattgaggcagaaggcatctcagttgtctaaactggttaataaaagtcagaacataccgactaga

SEQ ID NO: 50335 - DNA, 75 bp, Artificial Sequence
  Synthetic
tcacactattaaggcaacaaattttctttaaccatgttgaggattttatcagaaggtacggcatattaactcttg

SEQ ID NO: 50336 - DNA, 75 bp, Artificial Sequence
  Synthetic
gcacaagttgctaacacgagataaacaaatcaagcaggaattctcaaaaatgaagctctacgttaccaaagatct

SEQ ID NO: 50337 - DNA, 75 bp, Artificial Sequence
  Synthetic
tgttatcaacattcttatacggatctaacaataaaaacaagaaaaaattcatcaccaactgcctgcttagcacag

SEQ ID NO: 50338 - DNA, 75 bp, Artificial Sequence
  Synthetic
gacaagttccacagttgaagatagcagcagtgtaagcgacaccactgttgcttctcatgattcaggatcgtcatc

SEQ ID NO: 50339 - DNA, 75 bp, Artificial Sequence
  Synthetic
agcagtgtaagcgacaccactgttgcttctcatgattcaggatcgtcatcctccagcttctcttttgagctcaat

SEQ ID NO: 50340 - DNA, 75 bp, Artificial Sequence
  Synthetic
gatgcagtcagagcagtggaagatttggttttaatgttaacaggtagggcagtcaaacctagcactgtgacaccg

SEQ ID NO: 50341 - DNA, 75 bp, Artificial Sequence
  Synthetic
taacaataaaaacaagaaaaaattcatcaccaactgcctgcttagcacagccctgtctggaaagaaggtgtacaa

SEQ ID NO: 50342 - DNA, 75 bp, Artificial Sequence
  Synthetic
ctgttatataaggcgcccagaaaggccttggcaaccgtctgtagtgctctatttggggaacaaataaacaagctt

SEQ ID NO: 50343 - DNA, 75 bp, Artificial Sequence
  Synthetic
aatggcaagtgacacagtggcagacccacctgatgaggaagcagaagccctcagaacaggcaatcttggcttcaa

SEQ ID NO: 50344 - DNA, 75 bp, Artificial Sequence
  Synthetic
ccacctgatgaggaagcagaagccctcagaacaggcaatcttggcttcaactgggattcagactgaatgtgctgt

SEQ ID NO: 50345 - DNA, 75 bp, Artificial Sequence
  Synthetic
tctggactttgactgtcttagtgtgcaggactacaatggtatgatagaaaatatgtccaaattggacaacactga

SEQ ID NO: 50346 - DNA, 75 bp, Artificial Sequence
  Synthetic
ttgcactgtactatttgccgacataaaactttcaaacaagtcaaatactctatatttcccacagtcaattcatct

SEQ ID NO: 50347 - DNA, 75 bp, Artificial Sequence
  Synthetic
ggcttattacgttaagaaaagaaaaggacactgacctccttaagcaatggtttcctgagggtgatctcactcgta

SEQ ID NO: 50348 - DNA, 75 bp, Artificial Sequence
  Synthetic
tagtttgcctttaccatcctgcctttcttctcctttcaccgttcatttcagtttgattatttctagggtgtgggg

SEQ ID NO: 50349 - DNA, 75 bp, Artificial Sequence
  Synthetic
tttaagaagaaggacattatgaaattcattagtacctcaggcagagcaatgagtgcaggcaagattggtaatgtc

SEQ ID NO: 50350 - DNA, 75 bp, Artificial Sequence
  Synthetic
atctcaagactataaactgtataaacttgaaggtatcaactgacaaggaacatagtgagcttgagatcaatgtgc

SEQ ID NO: 50351 - DNA, 75 bp, Artificial Sequence
  Synthetic
cagcctggaagcatgcccttcgactaaagggaactgcatatgagggtttgtttgccaactgctatggatggcaat

SEQ ID NO: 50352 - DNA, 75 bp, Artificial Sequence
  Synthetic
tggaccgaactcaattacatccagagttcagagatttaactcctgacttttcgcttacacaaaagattcacttca

SEQ ID NO: 50353 - DNA, 75 bp, Artificial Sequence
  Synthetic
gattctttccagcagaacaggatctacatgcaccctgctgtgcttacagctggcagaatcagtgaaatgggagtc

SEQ ID NO: 50354 - DNA, 75 bp, Artificial Sequence
  Synthetic
gaaacttagaatagttgagtctagacctgcggaatctgagctagaggcgaaccgtgcagtaattgttaaaaccaa

SEQ ID NO: 50355 - DNA, 75 bp, Artificial Sequence
  Synthetic
tgccagtgacagaaaggaagatgttccctctacctgagactccattaagtgaggtgcattcaatagagcgcatca

SEQ ID NO: 50356 - DNA, 75 bp, Artificial Sequence
  Synthetic
tgagggcccaagcattctggctttcaaggattatggcgaaaggggaatagttgaggagaatcacatgaggtttag

SEQ ID NO: 50357 - DNA, 75 bp, Artificial Sequence
  Synthetic
ttcaaactgatattgatgggaaaataagaacagaccacaaaaaatggaaagatatattaaagctgttggagttac

SEQ ID NO: 50358 - DNA, 75 bp, Artificial Sequence
  Synthetic
ccagatagatggtggattactgaggatagagtgcgagtcttgaagaactcagtcagcttcctctttaacaaactc

SEQ ID NO: 50359 - DNA, 75 bp, Artificial Sequence
  Synthetic
atagagtgcgagtcttgaagaactcagtcagcttcctctttaacaaactctctagaaattcacctacagaggtta

SEQ ID NO: 50360 - DNA, 75 bp, Artificial Sequence
  Synthetic
tcatggattgtccaacaaaacccaacacaatgacactagtaccataaaggcgcccggagagagtcagaaaactag

SEQ ID NO: 50361 - DNA, 75 bp, Artificial Sequence
  Synthetic
cacaatgacactagtaccataaaggcgcccggagagagtcagaaaactagtctgcctgcgaacacagtatcgccc

SEQ ID NO: 50362 - DNA, 75 bp, Artificial Sequence
  Synthetic
aaagcagggactgctacaaaaacccctgtgtcaacaaaagatgttctagagacttgggaaagaatgaaagagcat

SEQ ID NO: 50363 - DNA, 75 bp, Artificial Sequence
  Synthetic
agaaggctcagggggtacgagcacctctccctcagtcaccacacaaagcccgaccctaccagaaaccacgccaga

SEQ ID NO: 50364 - DNA, 75 bp, Artificial Sequence
  Synthetic
tctccctcagtcaccacacaaagcccgaccctaccagaaaccacgccagagcccctcacaacaattgacatcaat

SEQ ID NO: 50365 - DNA, 75 bp, Artificial Sequence
  Synthetic
cactgcctaccagtttggagcaggcaatgcgcaaaggactagtcgagggtgtggtcatctccaaggagggctctg

SEQ ID NO: 50366 - DNA, 75 bp, Artificial Sequence
  Synthetic
cctcacaccaacaacctacaccagtttgcccagcactcccagcgcgccaaccaagccacaggaaacacgtcacac

SEQ ID NO: 50367 - DNA, 75 bp, Artificial Sequence
  Synthetic
ttgcccagcactcccagcgcgccaaccaagccacaggaaacacgtcacactgcaaggggcctactgtcagtcacc

SEQ ID NO: 50368 - DNA, 75 bp, Artificial Sequence
  Synthetic
aaatgctattgtagtctgttttgttgtccttattgcagagcttgctcatctgacaaaatcactcaccgaatgcat

SEQ ID NO: 50369 - DNA, 75 bp, Artificial Sequence
  Synthetic
cacagaggccagcagcccacacccaaccatcagcgagacaccatccccccccccaacagcccaggctcccaccgg

SEQ ID NO: 50370 - DNA, 75 bp, Artificial Sequence
  Synthetic
gtgaatattagcaacatatcaaatgtacacaagaggtgtccaaaaatagaagtggtcagccattgtgaaaataaa

SEQ ID NO: 50371 - DNA, 75 bp, Artificial Sequence
  Synthetic
cagcccccaactcagtgacccctccagtacagccaaccctctctcagagtgaagtttccacggctgttcaaggta

SEQ ID NO: 50372 - DNA, 75 bp, Artificial Sequence
  Synthetic
tattcagcttatgcaagaggagtaatctcgaattcgctaaaaaacctctcaaagcaaggcaaatcaaagtgttct

SEQ ID NO: 50373 - DNA, 75 bp, Artificial Sequence
  Synthetic
tctcgaattcgctaaaaaacctctcaaagcaaggcaaatcaaagtgttctgtgccaaggtcttggcttgagaaga

SEQ ID NO: 50374 - DNA, 75 bp, Artificial Sequence
  Synthetic
atggactcaggttacttctctgccaagtgttatccaaagtcatcaaattcaggacttcagctgatcaatatcacc

SEQ ID NO: 50375 - DNA, 75 bp, Artificial Sequence
  Synthetic
atcagaaattcactgaaggctagatctgagtttgtcagaaacaatgacaaactacttataagatctaaagaagag

SEQ ID NO: 50376 - DNA, 75 bp, Artificial Sequence
  Synthetic
tctgtcatggacctatcccaaatgtattctcccgtctttgagtatctgtcaggtgatagacaggtagaagagtgg

SEQ ID NO: 50377 - DNA, 75 bp, Artificial Sequence
  Synthetic
ctttctgcactttctatttccaaaatgaatgcagtaggagagatggacctagatgttcctttgcagcactattaa

SEQ ID NO: 50378 - DNA, 75 bp, Artificial Sequence
  Synthetic
caaggacctttctatttgaacaggaggcaagctgtccttggctcatcatacctttacatcgttattacactctac

SEQ ID NO: 50379 - DNA, 75 bp, Artificial Sequence
  Synthetic
gtctagaagtcataaacagtgtgaatgagaaaatattgcaagacattgaaaatcactctatgactctgctcgaag

SEQ ID NO: 50380 - DNA, 75 bp, Artificial Sequence
  Synthetic
tgagaaaatattgcaagacattgaaaatcactctatgactctgctcgaagatgcattcaaagaactcacttctgc

SEQ ID NO: 50381 - DNA, 75 bp, Artificial Sequence
  Synthetic
tggttgatctaggatgccccaacattccactattaggcaaaatggccatctacatttgtagaatgtcaaatcatc

SEQ ID NO: 50382 - DNA, 75 bp, Artificial Sequence
  Synthetic
aagctagtgggaattttttaaacagaagcagcagagaccacttcataagtattgtttcaggcttaaacctggttt

SEQ ID NO: 50383 - DNA, 75 bp, Artificial Sequence
  Synthetic
tccactattaggcaaaatggccatctacatttgtagaatgtcaaatcatcccaagacaactatgggttttctttt

SEQ ID NO: 50384 - DNA, 75 bp, Artificial Sequence
  Synthetic
gaagcagttagagcagtagaggatttaattctgatgttaacaggcaaggcagtcaaacctagtactgtgacacaa

SEQ ID NO: 50385 - DNA, 75 bp, Artificial Sequence
  Synthetic
gttagagatgtggaagacaatatcaagcactggaagcaaagagatttgtgccctgaagtgactattccatgtttc

SEQ ID NO: 50386 - DNA, 75 bp, Artificial Sequence
  Synthetic
agcactggaagcaaagagatttgtgccctgaagtgactattccatgtttcacagtctatggcacctttgttaata

SEQ ID NO: 50387 - DNA, 75 bp, Artificial Sequence
  Synthetic
aaagacagtcgaagtgtatcaaaccagagaggggtacacaagtatttgcctttttgtactaggaagcatcctgtt

SEQ ID NO: 50388 - DNA, 75 bp, Artificial Sequence
  Synthetic
tgcctccgttaatctattttgccatcctgccatccttctttctctaatattcataccagtttcattatttgaagg

SEQ ID NO: 50389 - DNA, 75 bp, Artificial Sequence
  Synthetic
gaagtggattgagcatcttaattgcaatatgcctgttagcattatgcatatatcattgatatatgcagttctttg

SEQ ID NO: 50390 - DNA, 75 bp, Artificial Sequence
  Synthetic
aacacaacaggacaaacgttgtggcaacgcccggaggtagccagagccctgaaccgctagtgagcacgaccttgc

SEQ ID NO: 50391 - DNA, 75 bp, Artificial Sequence
  Synthetic
aacgcccggaggtagccagagccctgaaccgctagtgagcacgaccttgcccgtcacgctagactcctccactgt

SEQ ID NO: 50392 - DNA, 75 bp, Artificial Sequence
  Synthetic
tgaccctttcaatgattatcagcaggcaataacagacatttgtcaattttctgagtacacaccaaacaaagaaag

SEQ ID NO: 50393 - DNA, 75 bp, Artificial Sequence
  Synthetic
agtggagatggaaagcctgccagctggcacttgggaaagagaggaagacctgacaaacttctgtcatcaggaatg

SEQ ID NO: 50394 - DNA, 75 bp, Artificial Sequence
  Synthetic
catcccccccaaccaccactgaaggcctgtctccgtcagatgccacgtcagagctccccacaacaactggcatag

SEQ ID NO: 50395 - DNA, 75 bp, Artificial Sequence
  Synthetic
ttccagcacacaggcagccggggacacctccacaccaacagcacgcacaagtctacctgacagccctagcacacc

SEQ ID NO: 50396 - DNA, 75 bp, Artificial Sequence
  Synthetic
ctcacatgatgctaaaggactgctttaaaattatactgggcactgaaaataaaaagatagttaaaatgcttcgag

SEQ ID NO: 50397 - DNA, 75 bp, Artificial Sequence
  Synthetic
ggaagctaaaaaaactcggtgccatctctacaaacatagagatcgggaaaagggactgcttagatctactcagca

SEQ ID NO: 50398 - DNA, 75 bp, Artificial Sequence
  Synthetic
ctctacaaacatagagatcgggaaaagggactgcttagatctactcagcacagttgatggtctaacagatcaaca

SEQ ID NO: 50399 - DNA, 75 bp, Artificial Sequence
  Synthetic
ttctacaacagctcagggacccaccgaaaacaacagccgcaacaccactgtacagcttaaatccgtgacacaatc

SEQ ID NO: 50400 - DNA, 75 bp, Artificial Sequence
  Synthetic
accactggaaagaactggtcaaaaaaaacatagacgaggttttgcttactgaggatggaaatctgatcttctgct

SEQ ID NO: 50401 - DNA, 75 bp, Artificial Sequence
  Synthetic
aaacatagacgaggttttgcttactgaggatggaaatctgatcttctgctggctaaagacaatctcatcttcagt

SEQ ID NO: 50402 - DNA, 75 bp, Artificial Sequence
  Synthetic
ttgagcttactagccaggaaagacaatgtagcttgattgaggcaggcacaagattcaacttgggtcctgtgacta

SEQ ID NO: 50403 - DNA, 75 bp, Artificial Sequence
  Synthetic
aactgatgccagaaaactgtctcttttctagtgaggagttcaatgagttgattaagctaaagaaacttctcctca

SEQ ID NO: 50404 - DNA, 75 bp, Artificial Sequence
  Synthetic
tgagggtcatttcaatgaagttttacaattcagaacaccaggcacattgagcaccacagagtcaacacatgctgg

SEQ ID NO: 50405 - DNA, 75 bp, Artificial Sequence
  Synthetic
ggttcagaaatttatttatcatttgtctgaagagttgtataacataaggctacaacatctggaattatcaaagct

SEQ ID NO: 50406 - DNA, 75 bp, Artificial Sequence
  Synthetic
gaagtttgcaagcttaacttgcacaggctgttatgcttgtagttctggtatctcctgtaaggttagaatccatgt

SEQ ID NO: 50407 - DNA, 75 bp, Artificial Sequence
  Synthetic
tagagagattgaaatcaatgtgcttcttccccaagttgcagtcaacctctcaaactgtcacgttacaatcaaatc

SEQ ID NO: 50408 - DNA, 75 bp, Artificial Sequence
  Synthetic
gaaatgacgaagaactaacaaacagctcaagtttaaaacttgggttcttagtgaagtatgctgtcaccctattta

SEQ ID NO: 50409 - DNA, 75 bp, Artificial Sequence
  Synthetic
tagttgctgctagctcaagtctcatggctaggaagcttgaatttgggacagatagcacatttaaagccttttcag

SEQ ID NO: 50410 - DNA, 75 bp, Artificial Sequence
  Synthetic
ggttgacagtgtcagtgacagcttcttccccggcctgtctgtctgtaagacatgctctattggcagtataaatgg

SEQ ID NO: 50411 - DNA, 75 bp, Artificial Sequence
  Synthetic
tccaggaacttacaagatagtgatagacaaaaaaaataagctgaatgacagatgcaccctgttcaccaactgtgt

SEQ ID NO: 50412 - DNA, 75 bp, Artificial Sequence
  Synthetic
cttgatttgcacaaaaccactgacgagaagttgctacatcaaactaagatagtttttgccaaaattggtctgtcc

SEQ ID NO: 50413 - DNA, 75 bp, Artificial Sequence
  Synthetic
catgctctattggcagtataaatggctttgaaattgaatcgcataaatgctactgtagcctattttgctgcccct

SEQ ID NO: 50414 - DNA, 75 bp, Artificial Sequence
  Synthetic
agtttttgccaaaattggtctgtccgggaacggttatgacttcatctggaccactcaaatgatagcaaatagcaa

SEQ ID NO: 50415 - DNA, 75 bp, Artificial Sequence
  Synthetic
atcaactggctctagaagattgctttctgaagaatctggtgatgactgcatatcaagaactcggctattgagaac

SEQ ID NO: 50416 - DNA, 75 bp, Artificial Sequence
  Synthetic
cttcaacgtctgcaaaagattgactggaaggagtactggggaaaggcttccgagaagcgtcagaagcaaggtcat

SEQ ID NO: 50417 - DNA, 75 bp, Artificial Sequence
  Synthetic
ttactatttgcaacggttcaactattgtagatcaaagactgggaagtgagatggggtgttacactatcaatagag

SEQ ID NO: 50418 - DNA, 75 bp, Artificial Sequence
  Synthetic
gaaacaggaatggcaatattgcaacagttagcttttgcacaggcactaaattatgaacaccgtttttatgcagtt

SEQ ID NO: 50419 - DNA, 75 bp, Artificial Sequence
  Synthetic
acaaaaacacacattggctaagtcagcagaaagggcctcaaggaatgatgacagtatacttgctaatactactgc

SEQ ID NO: 50420 - DNA, 75 bp, Artificial Sequence
  Synthetic
gcagaaagggcctcaaggaatgatgacagtatacttgctaatactactgcttatgctagcaccactgattgtgcc

SEQ ID NO: 50421 - DNA, 75 bp, Artificial Sequence
  Synthetic
ccttacaaacccacaccttaaagagacaatacttaatgtaggattagactgccttaccaacatgcgaaaccttga

SEQ ID NO: 50422 - DNA, 75 bp, Artificial Sequence
  Synthetic
tggatgcatgcgactcaagctgtgaagtaatgatacctaaaggcacaggtgacatcttagtagactgttcaggtg

SEQ ID NO: 50423 - DNA, 75 bp, Artificial Sequence
  Synthetic
ctcaaagatatcaatccccccgttacccacattaatacagagagctccagtagcggtctttgtctgtgtgaagcc

SEQ ID NO: 50424 - DNA, 75 bp, Artificial Sequence
  Synthetic
ttcttctcaggcatgatgcaacaggttcttaaaaatgttccagattggtgttcattctataaattaacatttatt

SEQ ID NO: 50425 - DNA, 75 bp, Artificial Sequence
  Synthetic
taacctgtatactctgcaaggccatcttctacttattaataattgttgggacactagggaaaaggtttaagcagt

SEQ ID NO: 50426 - DNA, 75 bp, Artificial Sequence
  Synthetic
ataacatcaaacgcctaaccgagtcggcagcgcggaagtattaccaagaggagcctgaagcgaaacttgttggcc

SEQ ID NO: 50427 - DNA, 75 bp, Artificial Sequence
  Synthetic
tagtcacaacctatataagcaaggggctcatggcactaaacagttacaaccatatgggtcagggcattcatcatg

SEQ ID NO: 50428 - DNA, 75 bp, Artificial Sequence
  Synthetic
cacaatgccctaagcggaaggagaaagtggaagaaactgaattgtacttgaacttagagaggattccctgggttg

SEQ ID NO: 50429 - DNA, 75 bp, Artificial Sequence
  Synthetic
gcaatattttatcttaagagaagcttacctcagacaacagtacatgttgagcatgcaggcagttctgatgattac

SEQ ID NO: 50430 - DNA, 75 bp, Artificial Sequence
  Synthetic
tacctcagacaacagtacatgttgagcatgcaggcagttctgatgattacgcaaagtgtatagtagtaactggca

SEQ ID NO: 50431 - DNA, 75 bp, Artificial Sequence
  Synthetic
agcagctggctgattgtgctgcttgtgctacttgcagtttcatcatcaccagttcaatcagcacccatcggttat

SEQ ID NO: 50432 - DNA, 75 bp, Artificial Sequence
  Synthetic
caagaaacaagcagagatattaaggcaaaaagcatctcagttgtccaaactggtcaacaaaagtcaaaacatacc

SEQ ID NO: 50433 - DNA, 75 bp, Artificial Sequence
  Synthetic
gaaagatagtgccaaaacattagtaagcgactgttttcttgagttttacagcgagttcatgatgggctacagagt

SEQ ID NO: 50434 - DNA, 75 bp, Artificial Sequence
  Synthetic
tctcaaagaaacacgtgccgctcacgcccacagtgttatcttgagtgtaagcaaaatggagaacaaaatcgaggt

SEQ ID NO: 50435 - DNA, 75 bp, Artificial Sequence
  Synthetic
gcaaaatggagaacaaaatcgaggtgaacagcaaagacgatctgaacaagtggtttgaggagttcaagaaaggaa

SEQ ID NO: 50436 - DNA, 75 bp, Artificial Sequence
  Synthetic
gaacagcaaagacgatctgaacaagtggtttgaggagttcaagaaaggaaatgggcttgtggacaccttcacaaa

SEQ ID NO: 50437 - DNA, 75 bp, Artificial Sequence
  Synthetic
gaggcaacagattttctttaatcatgttgaagactttatcagaaggtatggcatattaactctcggaaccttatc

SEQ ID NO: 50438 - DNA, 75 bp, Artificial Sequence
  Synthetic
gttgaagactttatcagaaggtatggcatattaactctcggaaccttatctccctttggcaggctgtttgtaccg

SEQ ID NO: 50439 - DNA, 75 bp, Artificial Sequence
  Synthetic
tccctttggcaggctgtttgtaccgacctactctggactggtcagctcagcagttgctctggaagatgctgaggt

SEQ ID NO: 50440 - DNA, 75 bp, Artificial Sequence
  Synthetic
agatggccagtgcaaccgatgatgcacagaaggactctatatatgcatctgctcttgttgaagcaaccaagtact

SEQ ID NO: 50441 - DNA, 75 bp, Artificial Sequence
  Synthetic
agcagtctgtgttgttagcacctcagcagtagagatggaaagcctaccagctgggacctgggaaagagaagaaga

SEQ ID NO: 50442 - DNA, 75 bp, Artificial Sequence
  Synthetic
acagaaggactctatatatgcatctgctcttgttgaagcaaccaagtactgtgcaccaatatatgagtgtgcctg

SEQ ID NO: 50443 - DNA, 75 bp, Artificial Sequence
  Synthetic
acacgagcactatcaaatcctgggacgagagctacactgagctgaaggttgacattcccaaaatagagcagctct

SEQ ID NO: 50444 - DNA, 75 bp, Artificial Sequence
  Synthetic
cgagagctacactgagctgaaggttgacattcccaaaatagagcagctctctagttatcagcaggcagccctcaa

SEQ ID NO: 50445 - DNA, 75 bp, Artificial Sequence
  Synthetic
taaactcaacaagtttagaaacaagcttatcgattgaggcaccatggggagcaataaatgttcagtcaacctata

SEQ ID NO: 50446 - DNA, 75 bp, Artificial Sequence
  Synthetic
agcactaaacagcctcaaatcgactcaagcttgtgagataattcagaacaggattacaggcctttattgtaatag

SEQ ID NO: 50447 - DNA, 75 bp, Artificial Sequence
  Synthetic
gcaacaaagtgcttgcagagtacaaggttccaggagagatcttggtgcctgtcaaagagatgctgtcagacatga

SEQ ID NO: 50448 - DNA, 75 bp, Artificial Sequence
  Synthetic
ggttccaggagagatcttggtgcctgtcaaagagatgctgtcagacatgataaggagaaggaacattatccttaa

SEQ ID NO: 50449 - DNA, 75 bp, Artificial Sequence
  Synthetic
aatgttatttacagcagtagaatggcagactcttgtgattggctaagagatggtaagagaagagggaatctagaa

SEQ ID NO: 50450 - DNA, 75 bp, Artificial Sequence
  Synthetic
ctagcaaatagaatccagtctgtactatgtgttctaatagctggttactacagatcatttggaggggaagggact

SEQ ID NO: 50451 - DNA, 75 bp, Artificial Sequence
  Synthetic
agtggtgcagggagttcatcaagggaaagtacattatggccttcaatccaccttggggtgacatcaacaaatcag

SEQ ID NO: 50452 - DNA, 75 bp, Artificial Sequence
  Synthetic
aaagtacattatggccttcaatccaccttggggtgacatcaacaaatcaggtcgctccgggattgcacttgtcgc

SEQ ID NO: 50453 - DNA, 75 bp, Artificial Sequence
  Synthetic
gagaaactgaggagggagttggagaggttaggggtttctagaatggaagtcgatgaactaatgccaagtattagc

SEQ ID NO: 50454 - DNA, 75 bp, Artificial Sequence
  Synthetic
atccagagttcagggacctaactcccgacttttcgctcacacaaaaagttcacttcaagagaaatcagataccta

SEQ ID NO: 50455 - DNA, 75 bp, Artificial Sequence
  Synthetic
aagccaaaaagactgtggaagcactcaaggactaccttgacaaacacagagatgaagtcgacaagacaagtgctg

SEQ ID NO: 50456 - DNA, 75 bp, Artificial Sequence
  Synthetic
caaggactaccttgacaaacacagagatgaagtcgacaagacaagtgctgacaacatggtgacaagccttttgaa

SEQ ID NO: 50457 - DNA, 75 bp, Artificial Sequence
  Synthetic
ccattcaagaaactggagatgtaatcccacttggtgctggggagtgggaactggctgcacttgttgcggattaga

SEQ ID NO: 50458 - DNA, 75 bp, Artificial Sequence
  Synthetic
ctcagggtgcacaaattgacactcctttcagctcgttctactggctctacaaggcaggggtcactccagagacgt

SEQ ID NO: 50459 - DNA, 75 bp, Artificial Sequence
  Synthetic
acattaaaacagatgccatagtgtgtgtggaactcactagtcaagaaaggcaatgcagcttgattgaggcaggta

SEQ ID NO: 50460 - DNA, 75 bp, Artificial Sequence
  Synthetic
gttggctggaggaataaaagagctctcgcttcctatatatacaatattcatgaagtcatacttcttcaaagacaa

SEQ ID NO: 50461 - DNA, 75 bp, Artificial Sequence
  Synthetic
tttcagctcgttctactggctctacaaggcaggggtcactccagagacgttccccactgtttcccagtttctctt

SEQ ID NO: 50462 - DNA, 75 bp, Artificial Sequence
  Synthetic
tcagcactcccatgaagtggggaaagaagctctatgagctctttgcagatgactctttccagcagaacaggatct

SEQ ID NO: 50463 - DNA, 75 bp, Artificial Sequence
  Synthetic
gaagctctatgagctctttgcagatgactctttccagcagaacaggatctacatgcaccctgctgtgctgacagc

SEQ ID NO: 50464 - DNA, 75 bp, Artificial Sequence
  Synthetic
cagtgtgtaagttgcagagttgcacacacggtgtgccaggtgatctacaggtctaccacatcggaaatttattaa

SEQ ID NO: 50465 - DNA, 75 bp, Artificial Sequence
  Synthetic
gtctaccacatcggaaatttattaaaaggggataaagtgaatggacacctaattcataaaattgagccacatttt

SEQ ID NO: 50466 - DNA, 75 bp, Artificial Sequence
  Synthetic
tttaacccgaacatcagatgtgtcaacttgatcacatttgaagatggtctgagggaactttcagtgatacaaagt

SEQ ID NO: 50467 - DNA, 75 bp, Artificial Sequence
  Synthetic
tcattgcctgtgcagactgctcatctacaccaccagacagatggtggatttcggaggatagagtgcgggtcttaa

SEQ ID NO: 50468 - DNA, 75 bp, Artificial Sequence
  Synthetic
acccagatgatgcagcccagggatctggacacaccaagtccattctaaatctaaggacaaacactgagtccaaca

SEQ ID NO: 50469 - DNA, 75 bp, Artificial Sequence
  Synthetic
acttgatcacatttgaagatggtctgagggaactttcagtgatacaaagtcatctcaaagtcttcgagaatgaat

SEQ ID NO: 50470 - DNA, 75 bp, Artificial Sequence
  Synthetic
tggacacaccaagtccattctaaatctaaggacaaacactgagtccaacaatccgtgtgccaggaccattgtcaa

SEQ ID NO: 50471 - DNA, 75 bp, Artificial Sequence
  Synthetic
tggcctctgagcatctgctgcaccaatccctggttgggaagcagtcgcccttccagaatgcctacaatgtcaagg

SEQ ID NO: 50472 - DNA, 75 bp, Artificial Sequence
  Synthetic
atccctggttgggaagcagtcgcccttccagaatgcctacaatgtcaagggcaatgccaccagtgccaacatcat

SEQ ID NO: 50473 - DNA, 75 bp, Artificial Sequence
  Synthetic
ttccactttcactctaaaagggttactgcacatggagatacaccacagttagatctgaaggtaagaccaacctac

SEQ ID NO: 50474 - DNA, 75 bp, Artificial Sequence
  Synthetic
gaagttaaacccaccaaggttgatttttcgaacttacttaaagaccgcttcaaaataatgcagttcttcccttct

SEQ ID NO: 50475 - DNA, 75 bp, Artificial Sequence
  Synthetic
tttcggctgcaactagtaatcatgcttgcttcaaatactgcttcactcaacttttattctttctttgtttttaca

SEQ ID NO: 50476 - DNA, 75 bp, Artificial Sequence
  Synthetic
tttcgaacttacttaaagaccgcttcaaaataatgcagttcttcccttctgttttcactttaatcaaaatgctaa

SEQ ID NO: 50477 - DNA, 75 bp, Artificial Sequence
  Synthetic
ttgcttcaaatactgcttcactcaacttttattctttctttgtttttacacataaagggctgtgcggcaacgata

SEQ ID NO: 50478 - DNA, 75 bp, Artificial Sequence
  Synthetic
acccacgttgacacagacagctccagtggtggttccttgtccttatcaagccatggacttcttaagaaaccttga

SEQ ID NO: 50479 - DNA, 75 bp, Artificial Sequence
  Synthetic
caggttgcaagatactccaaccatttaaccctacttagtagaatgatacaacaagcaaaaccaactgtaactgtt

SEQ ID NO: 50480 - DNA, 75 bp, Artificial Sequence
  Synthetic
taaccctacttagtagaatgatacaacaagcaaaaccaactgtaactgttttctacatgctaaagggtaacttga

SEQ ID NO: 50481 - DNA, 75 bp, Artificial Sequence
  Synthetic
tgctaacctatcagaaaagattgagctgcttgcttataatctgcagctcactaatcactgcagcaactgtcaccc

SEQ ID NO: 50482 - DNA, 75 bp, Artificial Sequence
  Synthetic
tatcacagtatagctgaattaaccatgcccaacaaaacggaccactcgtaccacaacatcaaacatctaactgag

SEQ ID NO: 50483 - DNA, 75 bp, Artificial Sequence
  Synthetic
ggtaggttctataggctttccgacaccggaatcgatgcaagtacatattctgtaaaatactggaagattctccac

SEQ ID NO: 50484 - DNA, 75 bp, Artificial Sequence
  Synthetic
gtaaaagctgcagtaaagaagatacacaaaaatgtgttaacacaaaacttgagcaaccacagagcattttgattg

SEQ ID NO: 50485 - DNA, 75 bp, Artificial Sequence
  Synthetic
ccggaatcgatgcaagtacatattctgtaaaatactggaagattctccactgcatttctgctatcgggtgcctac

SEQ ID NO: 50486 - DNA, 75 bp, Artificial Sequence
  Synthetic
gatcgactcttgaggcatccatgctggctaaagagatgggtgttactatcattatttggactgttgcagctagtg

SEQ ID NO: 50487 - DNA, 75 bp, Artificial Sequence
  Synthetic
ttgccccctttatcttgttaatacttttctttatgtttggatggaggatcctgttttgctttaagtgttgcagaa

SEQ ID NO: 50488 - DNA, 75 bp, Artificial Sequence
  Synthetic
agactctgaacgcgaaggtctaactgatctccttgattacctaaactcacctactgaactgttgaagaagaagcc

SEQ ID NO: 50489 - DNA, 75 bp, Artificial Sequence
  Synthetic
gtgaatcttctgcactccggacagacacattttgatgctctcagaatactgccacagtttgaagctgacacaaga

SEQ ID NO: 50490 - DNA, 75 bp, Artificial Sequence
  Synthetic
ctgttttgctttaagtgttgcagaagaaccaggggcctgtttaagtacagacatctcaaagatgatgaagaaact

SEQ ID NO: 50491 - DNA, 75 bp, Artificial Sequence
  Synthetic
cacattttgatgctctcagaatactgccacagtttgaagctgacacaagagagaccttaagtttagtggacaagg

SEQ ID NO: 50492 - DNA, 75 bp, Artificial Sequence
  Synthetic
ctggtaaatttacatacagtagtaggtctggagagtcaattggcatcttcattgcaggaaaactgcacatccatc

SEQ ID NO: 50493 - DNA, 75 bp, Artificial Sequence
  Synthetic
tatgaagaccttgctttggcacttacaagtgcggaagaaccgtatagacggtctagcctggatgaggttaccctg

SEQ ID NO: 50494 - DNA, 75 bp, Artificial Sequence
  Synthetic
caagtgcggaagaaccgtatagacggtctagcctggatgaggttaccctgtccaagaaacaagcagagatattaa

SEQ ID NO: 50495 - DNA, 75 bp, Artificial Sequence
  Synthetic
gatagaaggattgccgaactattctccacaaaaacacatattggctagattgactaaaaaggcttggaaaatgat

SEQ ID NO: 50496 - DNA, 75 bp, Artificial Sequence
  Synthetic
ccactacactattatcacaatatgctgcatctaatctacttcactgtacctacagatagactgaaactgcctttg

SEQ ID NO: 50497 - DNA, 75 bp, Artificial Sequence
  Synthetic
ccgactagagttggtagagttctagactgcatgtttaattgcaaactatgtgttgagatatcagctgatactcta

SEQ ID NO: 50498 - DNA, 75 bp, Artificial Sequence
  Synthetic
tgcatctaatctacttcactgtacctacagatagactgaaactgcctttgctctatttgctctgacctaaatctt

SEQ ID NO: 50499 - DNA, 75 bp, Artificial Sequence
  Synthetic
actgcatgtttaattgcaaactatgtgttgagatatcagctgatactctaattctgcgtccagaatctaaggaga

SEQ ID NO: 50500 - DNA, 75 bp, Artificial Sequence
  Synthetic
acctgatggtagcaatcctcggctactaaaatttgtgcctctcaagaaggggctagcagtggtgaagattaaaaa

SEQ ID NO: 50501 - DNA, 75 bp, Artificial Sequence
  Synthetic
cgagataaacaaattaagcaagaattctctagaatgaagctctacgttaccaaagatctgcttgaccatctagat

SEQ ID NO: 50502 - DNA, 75 bp, Artificial Sequence
  Synthetic
caaagatctgcttgaccatctagatgtcggtggtctattaagagcaaccttccctggaacggggatagaaagaca

SEQ ID NO: 50503 - DNA, 75 bp, Artificial Sequence
  Synthetic
cttgtctattgtttatgatgaaaccgacactcagaccacataccacgaaaacctcttgaaggtaaagcagcttgt

SEQ ID NO: 50504 - DNA, 75 bp, Artificial Sequence
  Synthetic
ttggcgtcatgttatcaacattcttatacggctctaacaataaaaacaagaaaaaattcatcaccaactgcctgc

SEQ ID NO: 50505 - DNA, 75 bp, Artificial Sequence
  Synthetic
attccaaagttgtcctttcaaggattaaattcaaaacggagctcctccttaactcattgacattgctccactgtt

SEQ ID NO: 50506 - DNA, 75 bp, Artificial Sequence
  Synthetic
taaattcaaaacggagctcctccttaactcattgacattgctccactgtttcctgaaacatgctcccagtgatgc

SEQ ID NO: 50507 - DNA, 75 bp, Artificial Sequence
  Synthetic
taaatagaagcagtagagaccattttataagtgttgtttcaggtttgaacctggtttatggcttcctcataaaag

SEQ ID NO: 50508 - DNA, 75 bp, Artificial Sequence
  Synthetic
ccagaagggccttgacaaccgtctgtagtgccctgtttgggaaacaaataaacaagcttcagagctgcttcagga

SEQ ID NO: 50509 - DNA, 75 bp, Artificial Sequence
  Synthetic
caggaggtgttaggcagcggaatactgaggtgctctttagggaaaagttgaacaaggtagttataaaggataacc

SEQ ID NO: 50510 - DNA, 75 bp, Artificial Sequence
  Synthetic
tagtgccctgtttgggaaacaaataaacaagcttcagagctgcttcaggaccataagtcctgttagcttacttgc

SEQ ID NO: 50511 - DNA, 75 bp, Artificial Sequence
  Synthetic
tgatagaaaatatgtccaagttagataacactgacgttgagttcaaccacagggaaatagccgatctcaaccaac

SEQ ID NO: 50512 - DNA, 75 bp, Artificial Sequence
  Synthetic
tcagctgttggtctgaagttcaaaactatattgaagacataggcttcaacaatgtgcttgtaaacattgacagaa

SEQ ID NO: 50513 - DNA, 75 bp, Artificial Sequence
  Synthetic
tcactcgtagaagcaccaggaacgttgcaaatgcagaagaatttgtcatatctgaattctttaagaagaaggaca

SEQ ID NO: 50514 - DNA, 75 bp, Artificial Sequence
  Synthetic
cactgaaacgattcctaagtttctacttgcatttcttctttatgaagaagtgttgatgaacttaatcagccagtg

SEQ ID NO: 50515 - DNA, 75 bp, Artificial Sequence
  Synthetic
cttgcatttcttctttatgaagaagtgttgatgaacttaatcagccagtgcaaggcagtgaaagaacttattaac

SEQ ID NO: 50516 - DNA, 75 bp, Artificial Sequence
  Synthetic
ctttttacagttaccaagacctattttattttgctttattttattttgcttcatactattatattcttcttttac

SEQ ID NO: 50517 - DNA, 75 bp, Artificial Sequence
  Synthetic
cagcttctgatcgagatcaagaggctatatgctttacaagaagactctgaagtagagccaatagccatcatctgt

SEQ ID NO: 50518 - DNA, 75 bp, Artificial Sequence
  Synthetic
ttattttgctttattttattttgcttcatactattatattcttcttttacatgttgaagggctgtgcggcaacga

SEQ ID NO: 50519 - DNA, 75 bp, Artificial Sequence
  Synthetic
aacatccttgttcgtgcaaacaatgagctgggtgatgtgtcgctgaaggttaacattgtcctggtgcctctcaaa

SEQ ID NO: 50520 - DNA, 75 bp, Artificial Sequence
  Synthetic
cgcacagtacagcttggaagcatgcccttcgattaaaggggactgcatatgagggtctgtttgccaactgctatg

SEQ ID NO: 50521 - DNA, 75 bp, Artificial Sequence
  Synthetic
gaatcatgctctgtccttaatgtttttggatgaaatgtcattacctgagcttaaatccttatctgtgaactgcag

SEQ ID NO: 50522 - DNA, 75 bp, Artificial Sequence
  Synthetic
ttggatgaaatgtcattacctgagcttaaatccttatctgtgaactgcagaatgggaaactttgaagggcaggag

SEQ ID NO: 50523 - DNA, 75 bp, Artificial Sequence
  Synthetic
cagacactgttccctgataaatttgaggaatttttggatcgaactcaactacatccagagttcagggacttaact

SEQ ID NO: 50524 - DNA, 75 bp, Artificial Sequence
  Synthetic
aggaatttttggatcgaactcaactacatccagagttcagggacttaactcctgacttttcacttacgcaaaagg

SEQ ID NO: 50525 - DNA, 75 bp, Artificial Sequence
  Synthetic
caaattagttgaccactgtgtggacatggaaaaaaagagggatgcagttagagcagtggaagatttagttctgat

SEQ ID NO: 50526 - DNA, 75 bp, Artificial Sequence
  Synthetic
atggaaaaaaagagggatgcagttagagcagtggaagatttagttctgatgttgacaggtagggcagtcaaacct

SEQ ID NO: 50527 - DNA, 75 bp, Artificial Sequence
  Synthetic
atagatgcaacattgcctgagtctgtggaagcagtgccagtgacagaaagaaagatgttccctctacctgagact

SEQ ID NO: 50528 - DNA, 75 bp, Artificial Sequence
  Synthetic
aagcctagatgatctaatggcaagtgacacagtgacagacctgcccgatagggaagcagaggccctcaaaacagg

SEQ ID NO: 50529 - DNA, 75 bp, Artificial Sequence
  Synthetic
agcgcatcatggaaaatttcactcgcctcatgcatgaaggaaaatcttcaaccaagaaaaaagatgaagaaccaa

SEQ ID NO: 50530 - DNA, 75 bp, Artificial Sequence
  Synthetic
gacacagtgacagacctgcccgatagggaagcagaggccctcaaaacaggcaatcttggctttaactgggattca

SEQ ID NO: 50531 - DNA, 75 bp, Artificial Sequence
  Synthetic
ggtaagtaagacaatttataccatgccatttgctgacatctgaactttcaaataagtcagttgttctgcagtttt

SEQ ID NO: 50532 - DNA, 75 bp, Artificial Sequence
  Synthetic
gaggtttagtgaagaggatcagctggaaacaagacagctgttgttgattgaagttggttttcaaactgatattga

SEQ ID NO: 50533 - DNA, 75 bp, Artificial Sequence
  Synthetic
tttggatcttgacttacacaaaactactgacgaaaagctgctacatcaaacaaagatagtttttgctaaaattgg

SEQ ID NO: 50534 - DNA, 75 bp, Artificial Sequence
  Synthetic
tctcaaagaaacacgtgccgcttacgcccagtgttctcttgagtgtctgcaaaatggaaaacaagatcgaggtga

SEQ ID NO: 50535 - DNA, 75 bp, Artificial Sequence
  Synthetic
attcattgcctgtgctgactgctcgtctacaccgccagacagatggtggattactgaagacagagtgcgagtctt

SEQ ID NO: 50536 - DNA, 75 bp, Artificial Sequence
  Synthetic
aggctcccaagaagcgtcagaagcaaggtcatttatgagatggtaaaactagtgggagaaacgggcatggcaata

SEQ ID NO: 50537 - DNA, 75 bp, Artificial Sequence
  Synthetic
ggacttatggacactttcacaaactcctactccttttgtgagaatgtaccaaatctggataagtttgtgttccag

SEQ ID NO: 50538 - DNA, 75 bp, Artificial Sequence
  Synthetic
cagaggttactgacatagttgttggggccataagtactcaaaaggtcagaagttacttaaaggcagggactgcca

SEQ ID NO: 50539 - DNA, 75 bp, Artificial Sequence
  Synthetic
cctactccttttgtgagaatgtaccaaatctggataagtttgtgttccagatggccagcgccactgatgatgctc

SEQ ID NO: 50540 - DNA, 75 bp, Artificial Sequence
  Synthetic
cgttctagagacttgggaaagaatgaaagagcatatacttaacaggcctacaggtctgacactgcctgccagttt

SEQ ID NO: 50541 - DNA, 75 bp, Artificial Sequence
  Synthetic
caggtctgacactgcctgccagtttggagcaagcaatgcgaaaaggactagtcgagggtgtggtcatctccaagg

SEQ ID NO: 50542 - DNA, 75 bp, Artificial Sequence
  Synthetic
actgatgaatttgagcggacaaaatttaaacatgagcttacacagaatgttactactagtgaaaagatgctgtta

SEQ ID NO: 50543 - DNA, 75 bp, Artificial Sequence
  Synthetic
taaagaaatgctgtcagacatgattagaaggaggaatctaattctcaacaggggcggtgatgaaaatccgcgcgg

SEQ ID NO: 50544 - DNA, 75 bp, Artificial Sequence
  Synthetic
taacataaagaaaactgttgatgaaactgccaacctatcagaaaagatcgaactgcttgcttataatttgcaact

SEQ ID NO: 50545 - DNA, 75 bp, Artificial Sequence
  Synthetic
agaaggaggaatctaattctcaacaggggcggtgatgaaaatccgcgcggcccagtgagccgtgaacatgtggag

SEQ ID NO: 50546 - DNA, 75 bp, Artificial Sequence
  Synthetic
actgccaacctatcagaaaagatcgaactgcttgcttataatttgcaactcactagtcactgtagcaattgtcac

SEQ ID NO: 50547 - DNA, 75 bp, Artificial Sequence
  Synthetic
caaaatagaggtggttagtcattgtgaaaacaaaggctttgaggatagtaatgaatgcttaacggatttggatag

SEQ ID NO: 50548 - DNA, 75 bp, Artificial Sequence
  Synthetic
atgaatgcttaacggatttggataggcttgttaggcttacattaccgggaaaaactgaaaaagagagaagggtca

SEQ ID NO: 50549 - DNA, 75 bp, Artificial Sequence
  Synthetic
gtcaaatgaaagatagtgccaaaactttagtgagtgattgctttcttgagttttacagtgagtttatgatgggct

SEQ ID NO: 50550 - DNA, 75 bp, Artificial Sequence
  Synthetic
agcatgataacaaacctcctgaagcacattgccaaagcacaagagctttataaaaattcatctgctcttcgtgca

SEQ ID NO: 50551 - DNA, 75 bp, Artificial Sequence
  Synthetic
gactgcataaaatatcctacaggccagcttatcactcatggaagagtaagtgcaaaacataatgatgggaacttg

SEQ ID NO: 50552 - DNA, 75 bp, Artificial Sequence
  Synthetic
agcttatcactcatggaagagtaagtgcaaaacataatgatgggaacttgaaagatagaagtgatgacgatcaaa

SEQ ID NO: 50553 - DNA, 75 bp, Artificial Sequence
  Synthetic
caaggtgcacagattgacacccctttcagctcgttttactggctttacaaggccggtgtgactccagagaccttc

SEQ ID NO: 50554 - DNA, 75 bp, Artificial Sequence
  Synthetic
ctgaaggattattcaacttatgcaagaggagtaatctcaaattccctaaaaaacctctcaaagcagggcaaatca

SEQ ID NO: 50555 - DNA, 75 bp, Artificial Sequence
  Synthetic
gaggagtaatctcaaattccctaaaaaacctctcaaagcagggcaaatcaaaatgttctgtgccaaagtcttggc

SEQ ID NO: 50556 - DNA, 75 bp, Artificial Sequence
  Synthetic
caagaaaatgaaaaaggcactcctgagcactccaatgaagtgggggaagaaactttatgagctctttgctgatga

SEQ ID NO: 50557 - DNA, 75 bp, Artificial Sequence
  Synthetic
agcactccaatgaagtgggggaagaaactttatgagctctttgctgatgactctttccagcagaacagaatctac

SEQ ID NO: 50558 - DNA, 75 bp, Artificial Sequence
  Synthetic
atgcaccctgctgtgttgacagccggtagaatcagtgaaatgggtgtctgctttggaacaatccctgttgccaat

SEQ ID NO: 50559 - DNA, 75 bp, Artificial Sequence
  Synthetic
ctgataaacatcagaaattcactgaaggctagatctgagtttgtaagaaacaacgacaaactactcataagatcc

SEQ ID NO: 50560 - DNA, 75 bp, Artificial Sequence
  Synthetic
ctttggaacaatccctgttgccaatcctgatgacgctgctcagggatctggacataccaagtccattctcaacct

SEQ ID NO: 50561 - DNA, 75 bp, Artificial Sequence
  Synthetic
aaggaagaactaaaaaaatgtttcgatgtgcaatcttttaaattgatgaaaaataagcaacctgtaccttttcaa

SEQ ID NO: 50562 - DNA, 75 bp, Artificial Sequence
  Synthetic
atagacactttagtttccttaatcaatgtgttaacaaggttcatttggtttcaggaggtagtgctatacggtaag

SEQ ID NO: 50563 - DNA, 75 bp, Artificial Sequence
  Synthetic
aatgccaccagtgccaacatcatctaaaactcaaggtgtttcatattcagcttttctcctcctgcatcactactt

SEQ ID NO: 50564 - DNA, 75 bp, Artificial Sequence
  Synthetic
taagctggtcaaggtgagacactgtgacattaatctatcagtcaagctaccttcaaataaaaaagagaatatgct

SEQ ID NO: 50565 - DNA, 75 bp, Artificial Sequence
  Synthetic
ggtattacaggtcatttggaggggaaggaaccgaaaaacaggtaaaggcatcattgaatagagacgacaataaaa

SEQ ID NO: 50566 - DNA, 75 bp, Artificial Sequence
  Synthetic
gtgttgtgtatacagtagtagcatggagctcttacaaggacctttctatttgaacaggagacaagctgtccttgg

SEQ ID NO: 50567 - DNA, 75 bp, Artificial Sequence
  Synthetic
tctcaaagaaacacgtgccgcctacgcccacagtgttctcttgagtgctagcaaaatggagaataaaatcgaggt

SEQ ID NO: 50568 - DNA, 75 bp, Artificial Sequence
  Synthetic
caaggtgcaaagccagcgggaattttttaaacagaagcagtagagaccactttataagtactgtttcaggcttaa

SEQ ID NO: 50569 - DNA, 75 bp, Artificial Sequence
  Synthetic
gtgcacccatatacgagtgtgcctgggttagctccactggcattgtgaagaagggactggagtggttcgaaaaaa

SEQ ID NO: 50570 - DNA, 75 bp, Artificial Sequence
  Synthetic
atgcaggaaccattaaatcttgggatgaaagctacattgagctgaaagttgaggtccctaaaatagaacagcttg

SEQ ID NO: 50571 - DNA, 75 bp, Artificial Sequence
  Synthetic
ccaattaccaacaggctgctctcaagtggaggaaggacataggttttcgtgtcaatgcaaatacggcagccttaa

SEQ ID NO: 50572 - DNA, 75 bp, Artificial Sequence
  Synthetic
gtagaagaattgaagacaacattgcaaggctttacctacaaacatctatatactgctcggttagagatgtggaag

SEQ ID NO: 50573 - DNA, 75 bp, Artificial Sequence
  Synthetic
ccatgttttacagtctatggcacctttgtcaacagcgacagacagctaatttttgacatttacaatgtgcatata

SEQ ID NO: 50574 - DNA, 75 bp, Artificial Sequence
  Synthetic
ggcccagtgagccgtgaacatgtggagtggtgcagggaatttgtcaaaggcaagtacatcatggctttcaacccg

SEQ ID NO: 50575 - DNA, 75 bp, Artificial Sequence
  Synthetic
agaaacagcagaaaggcatatgctttgggagcttgatttgatgaattcactctgttctgacgagaaaagagatgc

SEQ ID NO: 50576 - DNA, 75 bp, Artificial Sequence
  Synthetic
aacaggccttgccaagctcgcagagactgaggggaagggagtgtttgatgaagccaaaaagactgtagaggctct

SEQ ID NO: 50577 - DNA, 75 bp, Artificial Sequence
  Synthetic
aagccaaaaagactgtagaggctctcaacgggtaccttgacaaacacaaggacgaagttgacaaagcaagtgccg

SEQ ID NO: 50578 - DNA, 75 bp, Artificial Sequence
  Synthetic
ataaagaagggaaaaagctgtcaaaattaaacagcgatacatccactgacacacaaagcgttgcttctgaagtgt

SEQ ID NO: 50579 - DNA, 75 bp, Artificial Sequence
  Synthetic
tttgcaacaagttgcaagatactcaaaccatttgaccttgctcagcaggatgatacaacaagcaaagccaaccgt

SEQ ID NO: 50580 - DNA, 75 bp, Artificial Sequence
  Synthetic
acacaaagcgttgcttctgaagtgtcagacaggaggtcctatagctcaagcaggagtaaaattcgtagtatcttt

SEQ ID NO: 50581 - DNA, 75 bp, Artificial Sequence
  Synthetic
tacaaaaactcgtctgcacttcgtgcacagggtgcacagattgacactgctttcagctcatactactggctctac

SEQ ID NO: 50582 - DNA, 75 bp, Artificial Sequence
  Synthetic
tttcagctcatactactggctctacaaggccggcgtgactccagaaaccttcccgactgtctcacagttcctttt

SEQ ID NO: 50583 - DNA, 75 bp, Artificial Sequence
  Synthetic
gaagctttatgagctctttgctgatgactcattccagcaaaacaggatctacatgcaccctgccgtgttgacagc

SEQ ID NO: 50584 - DNA, 75 bp, Artificial Sequence
  Synthetic
gatccaggcagtctcagagtttggcatgagtaagtttcctcctgagaacatagacaaggcaaggagggatccaaa

SEQ ID NO: 50585 - DNA, 75 bp, Artificial Sequence
  Synthetic
tgctttggaacaatccctgtggccaatcccgatgatgctgcccagggatctggacacaccaagtccattcttaac

SEQ ID NO: 50586 - DNA, 75 bp, Artificial Sequence
  Synthetic
ggactgctttaaaattatactgggtactgagaataaaaagatagttaaaatgcttcgagggaagctaaagaaact

SEQ ID NO: 50587 - DNA, 75 bp, Artificial Sequence
  Synthetic
tactcagcacggttgatggtctaacagatcaacagaaagaaaacattgtgaatgggatatttgagccttcaaagt

SEQ ID NO: 50588 - DNA, 75 bp, Artificial Sequence
  Synthetic
ttccagaatgcctacaacgtcaagggcaatgccaccagtgccaacatcatctgaagctccaaatgctttgcattc

SEQ ID NO: 50589 - DNA, 75 bp, Artificial Sequence
  Synthetic
ttgcttactgaggatggaaatctaatcttctgctggcttaaaacaatatcatcctcagttaaaggaagtttgaag

SEQ ID NO: 50590 - DNA, 75 bp, Artificial Sequence
  Synthetic
tttattttaactgcttatataatcctgttttattaacttcttcttgtttctttcgtttaaacacttaaagggctg

SEQ ID NO: 50591 - DNA, 75 bp, Artificial Sequence
  Synthetic
tcttctgctggcttaaaacaatatcatcctcagttaaaggaagtttgaagaagaagcttaagtttatgaacatac

SEQ ID NO: 50592 - DNA, 75 bp, Artificial Sequence
  Synthetic
gaagaagcttttgccccagtcagtgttttctgattccaaagtcgtcctttcaaggatcaagttcaagacagaact

SEQ ID NO: 50593 - DNA, 75 bp, Artificial Sequence
  Synthetic
gcccacagtgttatcttgagtgctaacaaaatggagaacaagatcgaggtgaataacaaagatgagatgaataag

SEQ ID NO: 50594 - DNA, 75 bp, Artificial Sequence
  Synthetic
aatgaattgattaagttgaagaagcttctcctcaacgaacaacaagatgaacaggagttgaagcaagatctttta

SEQ ID NO: 50595 - DNA, 75 bp, Artificial Sequence
  Synthetic
ttttctgattccaaagtcgtcctttcaaggatcaagttcaagacagaacttctcctcaactcattgacactgctc

SEQ ID NO: 50596 - DNA, 75 bp, Artificial Sequence
  Synthetic
ttctcctcaacgaacaacaagatgaacaggagttgaagcaagatcttttaatatcttcttggattaaatgtataa

SEQ ID NO: 50597 - DNA, 75 bp, Artificial Sequence
  Synthetic
ctcctactccttttgtgagagtgttccaaatctggatagatttgtatttcagatggccagtgccactgatgatgc

SEQ ID NO: 50598 - DNA, 75 bp, Artificial Sequence
  Synthetic
ccaaatctggatagatttgtatttcagatggccagtgccactgatgatgcacaaaaggattccatctacgcatca

SEQ ID NO: 50599 - DNA, 75 bp, Artificial Sequence
  Synthetic
taccatctgtctgaggagctatataacataaggctgcagcatctggaattatcaaagcttaagcaggagcaccct

SEQ ID NO: 50600 - DNA, 75 bp, Artificial Sequence
  Synthetic
ggttagctccactggtattgtgaagaagggattggagtggttcgaaaaaaatgcaggaaccattaaatcttggga

SEQ ID NO: 50601 - DNA, 75 bp, Artificial Sequence
  Synthetic
agtgttagcttcactaaggaagaggttctgataaagcggctagagaagaacttcctcaagcaacacaatctagaa

SEQ ID NO: 50602 - DNA, 75 bp, Artificial Sequence
  Synthetic
gaggttcccaaaatagaacagcttgccgattaccaacaggctgctctcaagtggaggaaggacataggtttccgt

SEQ ID NO: 50603 - DNA, 75 bp, Artificial Sequence
  Synthetic
tgtatcgaagagatgacgatgagctaacaaacagtacaagcttaaaactcgggtttttggtgaagtatgctgtca

SEQ ID NO: 50604 - DNA, 75 bp, Artificial Sequence
  Synthetic
aacaggccttgccaagcttgcagagactgaagggaagggagtgtttgatgaagcaaaaaagactgtggaggctct

SEQ ID NO: 50605 - DNA, 75 bp, Artificial Sequence
  Synthetic
caagcccagtgctgtaacacaatttgcatatgaggatgaacagtgtcaagagcaaataagcttagatgatctaat

SEQ ID NO: 50606 - DNA, 75 bp, Artificial Sequence
  Synthetic
caaggtcatttatgagatggtaaaattggtaggagaaacaggcatggcaatattacaacagctggcttttgcaca

SEQ ID NO: 50607 - DNA, 75 bp, Artificial Sequence
  Synthetic
gcatatgaggatgaacagtgtcaagagcaaataagcttagatgatctaatggcaaacgacacagtaacgaacttg

SEQ ID NO: 50608 - DNA, 75 bp, Artificial Sequence
  Synthetic
ggattcagattgaacatgccgcttgtgtgagccattgatgccttacagtgtctcaaggacaaatgaggcagtttt

SEQ ID NO: 50609 - DNA, 75 bp, Artificial Sequence
  Synthetic
agctagggggagcaagagatctattggtgcaagaaaccggcactaaagtcatgcatgcgaccactgaaatgttca

SEQ ID NO: 50610 - DNA, 75 bp, Artificial Sequence
  Synthetic
ggtgcaagaaaccggcactaaagtcatgcatgcgaccactgaaatgttcagtagaaaccttctaaaaacaacatc

SEQ ID NO: 50611 - DNA, 75 bp, Artificial Sequence
  Synthetic
aaccgcaccattcattgacatcaaagccttcaagcaagccaactgctccgcatccttcacagtcaatccaactgc

SEQ ID NO: 50612 - DNA, 75 bp, Artificial Sequence
  Synthetic
catccttcacagtcaatccaactgctttaattgatctatttactatcctaccaatcctcttcctctctaccattc

SEQ ID NO: 50613 - DNA, 75 bp, Artificial Sequence
  Synthetic
gattagactgtcttaccaatatgcgaaaccttgacggaaagcccataagtgaaggtagcaacttggtcaacttct

SEQ ID NO: 50614 - DNA, 75 bp, Artificial Sequence
  Synthetic
cggcagaattagtgagatgggtgtctgctttgggacaatccctgtggccaaccctgatgatgctgcccagggatc

SEQ ID NO: 50615 - DNA, 75 bp, Artificial Sequence
  Synthetic
atcccttgtcggcaaacagtctccattccaaaatgcctacaatgtcaagggcaacgccaccagtgccaacatcat

SEQ ID NO: 50616 - DNA, 75 bp, Artificial Sequence
  Synthetic
ttccaaaatgcctacaatgtcaagggcaacgccaccagtgccaacatcatctgaagtttcaaaacactctgtatt

SEQ ID NO: 50617 - DNA, 75 bp, Artificial Sequence
  Synthetic
tacaaactatgcagcaaaggaggtgtagagcagcacagtgaagaggatttaaggaagttgttggtagacaattta

SEQ ID NO: 50618 - DNA, 75 bp, Artificial Sequence
  Synthetic
cacaaggtgcacagattgacactgctttcagctcatactattggctttacaaggctggcgtgaccccagagacct

SEQ ID NO: 50619 - DNA, 75 bp, Artificial Sequence
  Synthetic
aagcaaagggctcatggcactaaacagttacaaccatatgggtcagggtattcatcatgcaacctcttcagtgct

SEQ ID NO: 50620 - DNA, 75 bp, Artificial Sequence
  Synthetic
gtttattttaactgcttatataatcctgttttattaacttcttcttatttctttcgtttaaacacttaaagggct

SEQ ID NO: 50621 - DNA, 75 bp, Artificial Sequence
  Synthetic
gcccacagtgttctcttgagtgctagcaaaatggagaataaaatcgaggtgaacaacaaagatgagatgaacaag

SEQ ID NO: 50622 - DNA, 75 bp, Artificial Sequence
  Synthetic
aaaggagtttaccccaaacaacagtacatgttgagcatgctggcagctctgatgattatgcaaagtgtatagtag

SEQ ID NO: 50623 - DNA, 75 bp, Artificial Sequence
  Synthetic
tggaagcatgcctgtagacttaagaacttcacagctgctgtacaaagatgttgtcaaatgaaagatagtgccaaa

SEQ ID NO: 50624 - DNA, 75 bp, Artificial Sequence
  Synthetic
ctacagagtgacccctgctgtgatcaaattcatgttcactggattgataaatagctctgtaacctcgcctcaaag

SEQ ID NO: 50625 - DNA, 75 bp, Artificial Sequence
  Synthetic
tgcttatataaccttattttattaacctttctctattttcttttgttctaaacacttaaagggctgtgcggcaac

SEQ ID NO: 50626 - DNA, 75 bp, Artificial Sequence
  Synthetic
aaattcatgttcactggattgataaatagctctgtaacctcgcctcaaagtttgatgcaagcatgtcaggtttca

SEQ ID NO: 50627 - DNA, 75 bp, Artificial Sequence
  Synthetic
gaggtccctaaaatagagcagcttgccaattaccaacaggctgctctaaagtggagaaaggacataggtttccgt

SEQ ID NO: 50628 - DNA, 75 bp, Artificial Sequence
  Synthetic
caccttactaaggcaacagattttcttcaatcatgttgaagactttatcagaaggtatggcatattaactctcgg

SEQ ID NO: 50629 - DNA, 75 bp, Artificial Sequence
  Synthetic
agtccctggtgaaattgtaatgtctgtcaaagaaatgttgtcagatatgattagaaggaggaacttaattctcaa

SEQ ID NO: 50630 - DNA, 75 bp, Artificial Sequence
  Synthetic
acagctagtgagcacggccttgtccattacacctgacccctccactgttacgcccacaacatcagccagtggatt

SEQ ID NO: 50631 - DNA, 75 bp, Artificial Sequence
  Synthetic
tgctgaagtcattgctggggcagctcaaacacttcacatgaacagtgtatcgattcagtcaagcagcttgactac

SEQ ID NO: 50632 - DNA, 75 bp, Artificial Sequence
  Synthetic
attacacctgacccctccactgttacgcccacaacatcagccagtggattagaaggctcgggggaagtttacaca

SEQ ID NO: 50633 - DNA, 75 bp, Artificial Sequence
  Synthetic
cgattcagtcaagcagcttgactacatttgacagtttaggtcgtagtagggcaaattctacagttgaagatagca

SEQ ID NO: 50634 - DNA, 75 bp, Artificial Sequence
  Synthetic
gtcggtcaggaatagcacttgttgcaacaggccttgccaagcttgcagagactgaagggaaaggagtgtttgatg

SEQ ID NO: 50635 - DNA, 75 bp, Artificial Sequence
  Synthetic
gctccctactacaactggtatagacacttcaagtgcaagtgatgtcgattccagtacgcaggcagccggagacac

SEQ ID NO: 50636 - DNA, 75 bp, Artificial Sequence
  Synthetic
aagcaaaaaagactgtggaggctctcaacgggtacctagacaagcataaggacgaggttgacaaagcaagtgccg

SEQ ID NO: 50637 - DNA, 75 bp, Artificial Sequence
  Synthetic
atttattaaggcactaaacagcctcaaatcaactcaagcttgtgagataattcagaataggatcacaggtcttta

SEQ ID NO: 50638 - DNA, 75 bp, Artificial Sequence
  Synthetic
ctacaccacaagacacgcaccatcccatgagaaatctactttcagtcacgagccctgggccagaagaaacatcta

SEQ ID NO: 50639 - DNA, 75 bp, Artificial Sequence
  Synthetic
catgagaaatctactttcagtcacgagccctgggccagaagaaacatctacaccctcaggatcaggcaaagagag

SEQ ID NO: 50640 - DNA, 75 bp, Artificial Sequence
  Synthetic
gcagaatggcagattcttgtgattggcttagagatggtaaaagaagagggaatttagaactagcaaatagaatcc

SEQ ID NO: 50641 - DNA, 75 bp, Artificial Sequence
  Synthetic
gcttagagatggtaaaagaagagggaatttagaactagcaaatagaatccagtctgtgctgtgcgttctgatagc

SEQ ID NO: 50642 - DNA, 75 bp, Artificial Sequence
  Synthetic
caacctcaggcctaatgacctctccaacacagatagtccacccacaaagtgccacctccataaccgttcaagaca

SEQ ID NO: 50643 - DNA, 75 bp, Artificial Sequence
  Synthetic
catcattgaatagggacgacaataaaattatcgaagatcctatgatacagctgattccagagaaactgaggagag

SEQ ID NO: 50644 - DNA, 75 bp, Artificial Sequence
  Synthetic
atcttgactttgtctcagggtttaaaaaagtactatggcaaaatattaaggcttctgcgtctcaccttagaggag

SEQ ID NO: 50645 - DNA, 75 bp, Artificial Sequence
  Synthetic
agtattagctctgatgataccttagcccagcttgtggcaaaaaagctaatcagcctcaatgtttcaacagaagaa

SEQ ID NO: 50646 - DNA, 75 bp, Artificial Sequence
  Synthetic
ctgttgtccttactgcagagcttgctcatctgacaaaatcactcaccgaatgcatttgaatatctgcaagaggag

SEQ ID NO: 50647 - DNA, 75 bp, Artificial Sequence
  Synthetic
gtaagagaaatcttggtcttgattgtgatgacactttctttcaaaagagaattgaagaattcttcataactggtg

SEQ ID NO: 50648 - DNA, 75 bp, Artificial Sequence
  Synthetic
tgatgacactttctttcaaaagagaattgaagaattcttcataactggtgagggccattttaatgaagttttaca

SEQ ID NO: 50649 - DNA, 75 bp, Artificial Sequence
  Synthetic
ttccaaaatgcctacaatgtcaagggcaacgctacaagtgccaacatcatctgaagcgcaaaatgctttgcatcc

SEQ ID NO: 50650 - DNA, 75 bp, Artificial Sequence
  Synthetic
ttatattaaccgcttgtataatcttgttttattaactttttcttattttctttcgttttaaacacttaaagggct

SEQ ID NO: 50651 - DNA, 75 bp, Artificial Sequence
  Synthetic
caaacaattaactggtaggataatcaccaagtacactcactggttagacacttttctaagctgttctgtctccat

SEQ ID NO: 50652 - DNA, 75 bp, Artificial Sequence
  Synthetic
agtggattgagcatcttaattgcagcatacctgtcaacatcatgcatacatctttgatatatgtagttctctgct

SEQ ID NO: 50653 - DNA, 75 bp, Artificial Sequence
  Synthetic
gatgtgttaacctgatcacatttgaagatggtctaagggagctttcagtaatacaaagtcatctaaaagtttttg

SEQ ID NO: 50654 - DNA, 75 bp, Artificial Sequence
  Synthetic
tcacggatcacataatggaactgaacacaataaaacagacgttatgacaacgcccggtgataaccagagccctga

SEQ ID NO: 50655 - DNA, 75 bp, Artificial Sequence
  Synthetic
cacaataaaacagacgttatgacaacgcccggtgataaccagagccctgaaccgctagtgagcacggccctgcct

SEQ ID NO: 50656 - DNA, 75 bp, Artificial Sequence
  Synthetic
agaaggctcaggggaagtttatacatcttcctcaatcaccaccaagggcttatctctgccgaaggctacgtctga

SEQ ID NO: 50657 - DNA, 75 bp, Artificial Sequence
  Synthetic
tcttcctcaatcaccaccaagggcttatctctgccgaaggctacgtctgagctccttgcgactaccggcatggtc

SEQ ID NO: 50658 - DNA, 75 bp, Artificial Sequence
  Synthetic
tgcaccttgtttaccgactgtgtgataaaaggaagggaggttcgtaaaggtcagtcagttttgaggcagtacaag

SEQ ID NO: 50659 - DNA, 75 bp, Artificial Sequence
  Synthetic
catgggttatctattagatgaatcggcaatttctgaagttaaacctactaaggttgatttttcgaatttgcttaa

SEQ ID NO: 50660 - DNA, 75 bp, Artificial Sequence
  Synthetic
ccccacaccaacagtccgcacaagtctgcccaacagccccagcacaccatctacatcgcaagacacacaccatcc

SEQ ID NO: 50661 - DNA, 75 bp, Artificial Sequence
  Synthetic
ctgcccaacagccccagcacaccatctacatcgcaagacacacaccatcctgtaaggaatctactttcagtcacg

SEQ ID NO: 50662 - DNA, 75 bp, Artificial Sequence
  Synthetic
agccctgctcatcagaagcatcataaactccacctttgtgatatgcgtgctgattctagttatctgtgtggtaag

SEQ ID NO: 50663 - DNA, 75 bp, Artificial Sequence
  Synthetic
ctaaccatttaaccttgctcagtaggatgatacaacaagcaaaaccaaccgtaactgttttctacatgcttaagg

SEQ ID NO: 50664 - DNA, 75 bp, Artificial Sequence
  Synthetic
ctcagcaaccaacagccctcacccagccgccagcagactatcaacccctcccacaacagaccagggacccactga

SEQ ID NO: 50665 - DNA, 75 bp, Artificial Sequence
  Synthetic
gccgccagcagactatcaacccctcccacaacagaccagggacccactgaaaacaacaaccacaactccaccgaa

SEQ ID NO: 50666 - DNA, 75 bp, Artificial Sequence
  Synthetic
aacacagacagtacttccacagagtgccacctctatagccactcaagacacacatcccagcccaacgaataggtc

SEQ ID NO: 50667 - DNA, 75 bp, Artificial Sequence
  Synthetic
ctaaactggagggtgaacatggacattagagcttctgattgtccattatctaaccatgaagcaagtgtacttagc

SEQ ID NO: 50668 - DNA, 75 bp, Artificial Sequence
  Synthetic
aaaaatattatggcaaaatacttaagctcctgcatcttactttagaagaagacactgaaggcttgctagaatggt

SEQ ID NO: 50669 - DNA, 75 bp, Artificial Sequence
  Synthetic
catcctagttgactgttcaggtgggcagcaacattttctaaaggacaatttgatagatctaggatgccccaaaat

SEQ ID NO: 50670 - DNA, 75 bp, Artificial Sequence
  Synthetic
tgacaaaattcagaaattcatttaccacctttctgaagagctatatgacataagactgcagcacctggaactgtc

SEQ ID NO: 50671 - DNA, 75 bp, Artificial Sequence
  Synthetic
attgaagaattctttataactggtgagggtcatttcaatgaagttttacaatttagagcaccaggcacattgagc

SEQ ID NO: 50672 - DNA, 75 bp, Artificial Sequence
  Synthetic
caaacagatctggtaagtttacatacagtagcagatctggagagtctattggtatcttcattgcagggaaattgc

SEQ ID NO: 50673 - DNA, 75 bp, Artificial Sequence
  Synthetic
ctactttgctaaaggtttcctttcaatagattcaggttatttctctgccaaatgttattcaagaacatccaattc

SEQ ID NO: 50674 - DNA, 75 bp, Artificial Sequence
  Synthetic
atagattcaggttatttctctgccaaatgttattcaagaacatccaattcagggcttcagttgattaatgttacc

SEQ ID NO: 50675 - DNA, 75 bp, Artificial Sequence
  Synthetic
cgcccggacccaagatcactaacttaaagactatcaattgcataaacttaaaagcatccgtatttaaagaacata

SEQ ID NO: 50676 - DNA, 75 bp, Artificial Sequence
  Synthetic
aaaagcacaaggatggcagcgcactgtcagtcatacctgatggcagcaatcctcgactactaaaatttgtgcctc

SEQ ID NO: 50677 - DNA, 75 bp, Artificial Sequence
  Synthetic
aattgtcacgttgcaatcaaatcacatgtctgcgattattctttggacactgacggggcgattaggctacctcat

SEQ ID NO: 50678 - DNA, 75 bp, Artificial Sequence
  Synthetic
cctcgactactaaaatttgtgcctcttaagaagggactggcagtggtgaagattaaaaaacaaattttgacggtg

SEQ ID NO: 50679 - DNA, 75 bp, Artificial Sequence
  Synthetic
atgtctgcgattattctttggacactgacggggcgattaggctacctcatattcattatgaaggaacttttattc

SEQ ID NO: 50680 - DNA, 75 bp, Artificial Sequence
  Synthetic
gatgaaaccgacactcagaccacataccacgaaaaccttttgaaggtaaagcagcttgtggactgctctacggac

SEQ ID NO: 50681 - DNA, 75 bp, Artificial Sequence
  Synthetic
ctcaagaatcgagttcaaaacggagcttctccttaactcattgacgttgctccactgtttcttaaaacatgctcg

SEQ ID NO: 50682 - DNA, 75 bp, Artificial Sequence
  Synthetic
tccactgtttcttaaaacatgctcgcccttatataggaagcgagagcaaaagtagcctactgcacaagtacctca

SEQ ID NO: 50683 - DNA, 75 bp, Artificial Sequence
  Synthetic
accatctgcaatggttcaactgttgtagatcaaagactgggtagtgaactggggtgttacactatcaatagagtg

SEQ ID NO: 50684 - DNA, 75 bp, Artificial Sequence
  Synthetic
ttgaacaaggttgttataaaggacaaccttgagcaaggtgtagaagaagagattgagttctgcaacaacctgacc

SEQ ID NO: 50685 - DNA, 75 bp, Artificial Sequence
  Synthetic
tgatgatacctaagggcactggtgacattctagtagattgttcaggtgggcagcaacattttttaaaggacaacc

SEQ ID NO: 50686 - DNA, 75 bp, Artificial Sequence
  Synthetic
gaaacacggtgaagagtgaacttttatggaaatttacgttggacaccaatgtgagcactacaagtactatcaagg

SEQ ID NO: 50687 - DNA, 75 bp, Artificial Sequence
  Synthetic
tccattattgggcaaaatggctatttatatctgcagaatgtcgaatcaccccaaaacaaccatggcctttctctt

SEQ ID NO: 50688 - DNA, 75 bp, Artificial Sequence
  Synthetic
ctgcttgcatttcttctttatgaagaagtgttaatgaacttaattaaccagtgcaaggcagtaaaggaactcatt

SEQ ID NO: 50689 - DNA, 75 bp, Artificial Sequence
  Synthetic
tttacttattaataatttttggaacactagggaaaaggttcaagcagtacagagagttgaaaccccagacctgca

SEQ ID NO: 50690 - DNA, 75 bp, Artificial Sequence
  Synthetic
aactagagagcttgcttactttgtgtgccttctatttccagaatgagtgcagcaggagagatgggcctagatgtt

SEQ ID NO: 50691 - DNA, 75 bp, Artificial Sequence
  Synthetic
tgcaatagatgctgaaatgcatgatcttaactgcagttacaatatatgtccctattgtgcgtctaggctaacttc

SEQ ID NO: 50692 - DNA, 75 bp, Artificial Sequence
  Synthetic
gacagacaggtggaagagtggcccaaagcaacttgtacaggtgactgcccagaaagatgtggctgcacatcatca

SEQ ID NO: 50693 - DNA, 75 bp, Artificial Sequence
  Synthetic
tggaagagaccgaattgtacttgaacttagagagaattccttgggttgtaagaaagctattgcaggtgtcagagt

SEQ ID NO: 50694 - DNA, 75 bp, Artificial Sequence
  Synthetic
cttagagagaattccttgggttgtaagaaagctattgcaggtgtcagagtccactggcatagcattaaaaaggag

SEQ ID NO: 50695 - DNA, 75 bp, Artificial Sequence
  Synthetic
tttttggatgaaatgtcattacctgagcttaaatccttatctgtgaattgcagaatggggaactttgaagggcaa

SEQ ID NO: 50696 - DNA, 75 bp, Artificial Sequence
  Synthetic
cagaatggggaactttgaagggcaagagtgctttgagttcaccattttgaaggacaatagcacaaggctagatta

SEQ ID NO: 50697 - DNA, 75 bp, Artificial Sequence
  Synthetic
ttcaatcagcgcccattggtcacgggaagacaattgaagcgtaccgggctagggaggaatacacaagcatttgtc

SEQ ID NO: 50698 - DNA, 75 bp, Artificial Sequence
  Synthetic
tctttgtgctgggaagtgtcttgtttgtggtctcttgtctaatgaaaggactggttgacagtgttggcaatatct

SEQ ID NO: 50699 - DNA, 75 bp, Artificial Sequence
  Synthetic
acgaagacgagcagtgtcaggagcaaataagcctagatgatctaatggcaagtgacacagtgacagacctgcctg

SEQ ID NO: 50700 - DNA, 75 bp, Artificial Sequence
  Synthetic
aataagcctagatgatctaatggcaagtgacacagtgacagacctgcctgatagggaagcagaagctcttaaaac

SEQ ID NO: 50701 - DNA, 75 bp, Artificial Sequence
  Synthetic
agtcaataataccctccaatgtttcaaggtcaagtaagacggtttataccgtgccatttgctgatatctggacct

SEQ ID NO: 50702 - DNA, 75 bp, Artificial Sequence
  Synthetic
ctgcaattctctcaattattcattagcctttaccattctgctattctactttctttgctgttcatgtcagtttca

SEQ ID NO: 50703 - DNA, 75 bp, Artificial Sequence
  Synthetic
gcctttaccattctgctattctactttctttgctgttcatgtcagtttcattacttccagggtgtggggggaacg

SEQ ID NO: 50704 - DNA, 75 bp, Artificial Sequence
  Synthetic
tgcccctatgaagctctagtgctcagaaggcccctatttctagatagtatagtcaaaggtatgaaaaatctgcta

SEQ ID NO: 50705 - DNA, 75 bp, Artificial Sequence
  Synthetic
ggcagatcagaatcaattatgaagctggaagaaaggacaggaatcagctgggatctcggcgtagaagatgcctct

SEQ ID NO: 50706 - DNA, 75 bp, Artificial Sequence
  Synthetic
tcatggacttgtctcagatgtactctcctgtcttcgagtatttatcaggtgacagacaagtggaagagtggccta

SEQ ID NO: 50707 - DNA, 75 bp, Artificial Sequence
  Synthetic
aaaaatgtgttaacacaaaacttgagcaaccacaaagcattttgatcgaacacaagggaactataatcggaaagc

SEQ ID NO: 50708 - DNA, 75 bp, Artificial Sequence
  Synthetic
agaaagatgtggctgcacatcatcaacctgcttacacaaagagtggccccactcaaggaattggagatgtaatcc

SEQ ID NO: 50709 - DNA, 75 bp, Artificial Sequence
  Synthetic
tgaaagaccttttcacagattacatgttcgtcaagtggaaagttgagtacattaagacagaggccatagtatgtg

SEQ ID NO: 50710 - DNA, 75 bp, Artificial Sequence
  Synthetic
gttcgtcaagtggaaagttgagtacattaagacagaggccatagtatgtgtagaactaaccagtcaggaaagaca

SEQ ID NO: 50711 - DNA, 75 bp, Artificial Sequence
  Synthetic
ctacaacaagttgattgaccactgtgtagacatggaaaaaaagagggaagcggttagagcagtagaagatttaat

SEQ ID NO: 50712 - DNA, 75 bp, Artificial Sequence
  Synthetic
cacagggtgcacagattgacactgctttcagctcatactactggctctacaaggcaggcgtgactccagaaacct

SEQ ID NO: 50713 - DNA, 75 bp, Artificial Sequence
  Synthetic
tcaacaaaagctccctcctgaaataatcacactgcatcctagaattgaggaaggtttttttgacctaatgcatgt

SEQ ID NO: 50714 - DNA, 75 bp, Artificial Sequence
  Synthetic
accaagaaaatgaagaaggcactcttgagcaccccaatgaagtgggggaagaagctttatgagctctttgccgat

SEQ ID NO: 50715 - DNA, 75 bp, Artificial Sequence
  Synthetic
actggatgggcctcaaaatgatggaattacactaaccagtgccgttattcatgctaacatctttagttgcaaccc

SEQ ID NO: 50716 - DNA, 75 bp, Artificial Sequence
  Synthetic
ttcacaaaattgaacaacacctcaacacttcttggatgtcctgggatggttgtgatctagactactactgcaata

SEQ ID NO: 50717 - DNA, 75 bp, Artificial Sequence
  Synthetic
tgcaaacctaccagtcctctctttctcaaccatttatttcagtttcatcattgttattattttggggtgtggggg

SEQ ID NO: 50718 - DNA, 75 bp, Artificial Sequence
  Synthetic
tctcaaagatatcaatccccccattacccacgttaactcagagagctccggtagtagtcttagtctttgcgaagc

SEQ ID NO: 50719 - DNA, 75 bp, Artificial Sequence
  Synthetic
gttgtttgaaattcaaaaaacagggtttaacatacaagacatggacattgtagcctctgagcacctgctgcacca

SEQ ID NO: 50720 - DNA, 75 bp, Artificial Sequence
  Synthetic
gcttcatttgtaaacctgctcaacattgaaactgattacacaaaaaccttccactttcactctaaaagggttact

SEQ ID NO: 50721 - DNA, 75 bp, Artificial Sequence
  Synthetic
cagcctggtgatggaaactgcttctaccacagcatagctgagttgaccatgcccaacaaaacagatcactcatat

SEQ ID NO: 50722 - DNA, 75 bp, Artificial Sequence
  Synthetic
gaagttgccgatatggagttacacacaaagaagattgaaatatcaggcttgaagtttgcaagcctatcctgcaca

SEQ ID NO: 50723 - DNA, 75 bp, Artificial Sequence
  Synthetic
gcccaacaaaacagatcactcatatcataacatcaaacgcctgaccgagtcggcagcacggaagtattatcaaga

SEQ ID NO: 50724 - DNA, 75 bp, Artificial Sequence
  Synthetic
gagtgaattgggcatcttgaatgcagaatgcctgccaacattatgtatacactgttagtgtgtgctgttctctgt

SEQ ID NO: 50725 - DNA, 75 bp, Artificial Sequence
  Synthetic
tctcaaagaaatacttgcggcacgtcagtacgtaagtgtaaactttgagagagtgaattgggcatcttgaatgca

SEQ ID NO: 50726 - DNA, 75 bp, Artificial Sequence
  Synthetic
gaatgcctgccaacattatgtatacactgttagtgtgtgctgttctctgtccacagctgtggagtctggaaggga

SEQ ID NO: 50727 - DNA, 75 bp, Artificial Sequence
  Synthetic
ggatgctgtctgacaacgagtggggatcaactctggaggcatctatgttggctaaagaaatgggcattactatca

SEQ ID NO: 50728 - DNA, 75 bp, Artificial Sequence
  Synthetic
gcacctggagagagtcaaggccccatgtcgcctgcgagcacagcagtgcccctcacaccggaacccccaaacacc

SEQ ID NO: 50729 - DNA, 75 bp, Artificial Sequence
  Synthetic
tgtcgcctgcgagcacagcagtgcccctcacaccggaacccccaaacaccaaacctgcagcatcagccagcgaac

SEQ ID NO: 50730 - DNA, 75 bp, Artificial Sequence
  Synthetic
ggagacggtgatgtgtttacagctgtgaatcttttgcattctggacagacacactttgatgcactcagaatacta

SEQ ID NO: 50731 - DNA, 75 bp, Artificial Sequence
  Synthetic
aagggctgcagtaaagaagacacacaaaaatgtgttaacacgaaactcgagcaaccacagagcattttgatcgaa

SEQ ID NO: 50732 - DNA, 75 bp, Artificial Sequence
  Synthetic
ctgacttcgccggaggccacgccggagctcccaacaacaaccgacacaggcgtatcaagcacaagcgtcgtcgac

SEQ ID NO: 50733 - DNA, 75 bp, Artificial Sequence
  Synthetic
tatagctgtggatcagttgacatcatcttctagtgatgaactgcaagattatgaagaccttgccttggcactcac

SEQ ID NO: 50734 - DNA, 75 bp, Artificial Sequence
  Synthetic
agctcccaacaacaaccgacacaggcgtatcaagcacaagcgtcgtcgacattggcacacagatggccaaagaca

SEQ ID NO: 50735 - DNA, 75 bp, Artificial Sequence
  Synthetic
acaagcttggatgaggtcacattgtctaagaaacaagcagagatactgaggcaaaaagcatctcagctgtcgaag

SEQ ID NO: 50736 - DNA, 75 bp, Artificial Sequence
  Synthetic
tccacagcacaaggcacacatcacactataagaggtctgctgtcagttaccagcaccaagccagaagaagcatca

SEQ ID NO: 50737 - DNA, 75 bp, Artificial Sequence
  Synthetic
ctataagaggtctgctgtcagttaccagcaccaagccagaagaagcatcaacaccaacagacccaggaaaggcgg

SEQ ID NO: 50738 - DNA, 75 bp, Artificial Sequence
  Synthetic
tctttatgtttgggtggaggatcctgttttgcttcaagtgttgcagaagaaccagaggcctattcaagtacagac

SEQ ID NO: 50739 - DNA, 75 bp, Artificial Sequence
  Synthetic
gttttgcttcaagtgttgcagaagaaccagaggcctattcaagtacagacacctcaaagacgatgaagaaactgg

SEQ ID NO: 50740 - DNA, 75 bp, Artificial Sequence
  Synthetic
tcaccaacagctgaagctcccactgaaatcaacaactctagcacccccaaacaacccgagccctcaatacaacca

SEQ ID NO: 50741 - DNA, 75 bp, Artificial Sequence
  Synthetic
aaatcaacaactctagcacccccaaacaacccgagccctcaatacaaccagcaaccccaagcctagtgatctctc

SEQ ID NO: 50742 - DNA, 75 bp, Artificial Sequence
  Synthetic
tgcttgatggtgaaaggcttgctgacagaaaaattgccgaactgttctccacaaaaacacacattggctagatca

SEQ ID NO: 50743 - DNA, 75 bp, Artificial Sequence
  Synthetic
cagctggggcataagctgctaacacgagataaacaaatcaagcaagaattctctagaatgaaactctacgttact

SEQ ID NO: 50744 - DNA, 75 bp, Artificial Sequence
  Synthetic
actgaagaggcctgggggggtgatggctttgcactgactggtgttgctattcatgctgtttcctttggctgcatc

SEQ ID NO: 50745 - DNA, 75 bp, Artificial Sequence
  Synthetic
atatactctagcccaacaaacagatctaaaagaaaccttaagatggaaataattttgactttgtctcaaggtcta

SEQ ID NO: 50746 - DNA, 75 bp, Artificial Sequence
  Synthetic
ctaaaagaaaccttaagatggaaataattttgactttgtctcaaggtctaaagaagtactacggtaagatacaaa

SEQ ID NO: 50747 - DNA, 75 bp, Artificial Sequence
  Synthetic
caaacagactctgtaatgctcgaaactgccttcgctctgtttgctttgacctaaatcttgactgcgtgccgccac

SEQ ID NO: 50748 - DNA, 75 bp, Artificial Sequence
  Synthetic
tgtaagagaaatcttggtctgacctgtgatgataatttcttccaaaagagaatagaagagttttttttgaccggt

SEQ ID NO: 50749 - DNA, 75 bp, Artificial Sequence
  Synthetic
gtgatgataatttcttccaaaagagaatagaagagttttttttgaccggtgaaggctacttcaatgaagttttac

SEQ ID NO: 50750 - DNA, 75 bp, Artificial Sequence
  Synthetic
ctatggactttttaagaaaccttgactggactcaggtgattgatggtcagtatgtgaccaaccccaggttcaaca

SEQ ID NO: 50751 - DNA, 75 bp, Artificial Sequence
  Synthetic
gcaccaacagttaaaccctttaaatcttactttgctagaggcttccttacaatagactcaggttacttctctgcc

SEQ ID NO: 50752 - DNA, 75 bp, Artificial Sequence
  Synthetic
aatagactcaggttacttctctgccaagtgctattcaaggacttctaactcaggacttcagttgatcaacgtcac

SEQ ID NO: 50753 - DNA, 75 bp, Artificial Sequence
  Synthetic
aacactgatgttgagttcaaccacagggagatagctgatctcaatcaattaacttctcggcttattacattaaga

SEQ ID NO: 50754 - DNA, 75 bp, Artificial Sequence
  Synthetic
tgaagaccatcaattgtataaacttaaaagcatcagtctttaaagagcatagagagatcgaaatcaatgtgcttc

SEQ ID NO: 50755 - DNA, 75 bp, Artificial Sequence
  Synthetic
gcaaatgcggaggaatttgtcatatctgagtttttcaagaagaaggacataatgaaattcatcagcacttcaggc

SEQ ID NO: 50756 - DNA, 75 bp, Artificial Sequence
  Synthetic
catgtctgtgactactctttagacatcgatgggacaataagactacctcgtatctaccatgaaggaacatttata

SEQ ID NO: 50757 - DNA, 75 bp, Artificial Sequence
  Synthetic
tggagatggtgatgtgtttacagccgtgaatcttctgcactctggacagacacactttgatgctctcagaatact

SEQ ID NO: 50758 - DNA, 75 bp, Artificial Sequence
  Synthetic
tcgatgggacaataagactacctcgtatctaccatgaaggaacatttataccaggaacctataaaatagtaatag

SEQ ID NO: 50759 - DNA, 75 bp, Artificial Sequence
  Synthetic
aatatgacctctgaagacatctcacagctcttgatcgagattaaacgattgtatgccctacaagaagattctgaa

SEQ ID NO: 50760 - DNA, 75 bp, Artificial Sequence
  Synthetic
ataaaaggaagggaggttcgtagaggccagtcagcattaaggcaatacaggacagaaatcagaataggcaaggca

SEQ ID NO: 50761 - DNA, 75 bp, Artificial Sequence
  Synthetic
gccagtcagcattaaggcaatacaggacagaaatcagaataggcaaggcatctgctggctctagaagattgctgt

SEQ ID NO: 50762 - DNA, 75 bp, Artificial Sequence
  Synthetic
gttatttgctatactgcctcccgactgtgcaagagagtgtgaagtcctttttgatgacataagaaactctccaac

SEQ ID NO: 50763 - DNA, 75 bp, Artificial Sequence
  Synthetic
gagactgcagaggtccatggtgacaactatggtggtccaggtgacaaaataactatctgtaatggttcaaccatt

SEQ ID NO: 50764 - DNA, 75 bp, Artificial Sequence
  Synthetic
aaggtctgtttgcaaactgttatggctggcaatacattccagaggacattaaaccaagcctaaccatgttggtac

SEQ ID NO: 50765 - DNA, 75 bp, Artificial Sequence
  Synthetic
gtggatcaaagacttggcagtgaactggggtgttatactatcaatagagtgaagtcattcaagctatgcgaaaat

SEQ ID NO: 50766 - DNA, 75 bp, Artificial Sequence
  Synthetic
catccagagttcagagatctaactcctgacttttcgctcacacaaaaggttcacttcaaaagaaatcagataccc

SEQ ID NO: 50767 - DNA, 75 bp, Artificial Sequence
  Synthetic
gcaacaacatttcttaaaagataacttggttgatctaggatgccctaacattccactattaggtaaaatggctat

SEQ ID NO: 50768 - DNA, 75 bp, Artificial Sequence
  Synthetic
gcgtataatggagaattttacccgcctcatgcatggagaaaaactttctgccaagaaaaaagacggagatcgggc

SEQ ID NO: 50769 - DNA, 75 bp, Artificial Sequence
  Synthetic
ctcatgcatggagaaaaactttctgccaagaaaaaagacggagatcgggcggaacagggcaacaagcagagcacc

SEQ ID NO: 50770 - DNA, 75 bp, Artificial Sequence
  Synthetic
tttggtttagtttcggctatgtaataacatgtatattttgtaaaatcattttttacttgttgatagtcgtgggga

SEQ ID NO: 50771 - DNA, 75 bp, Artificial Sequence
  Synthetic
aacatgtatattttgtaaaatcattttttacttgttgatagtcgtggggacattggggaaaaagttcaaacagta

SEQ ID NO: 50772 - DNA, 75 bp, Artificial Sequence
  Synthetic
gggaatagtcgaggaaaatcatatgaggtttagtgaagaggaccagttagaaacaaggcagctgttgctggtgga

SEQ ID NO: 50773 - DNA, 75 bp, Artificial Sequence
  Synthetic
agtggaaagatatattaaagctgttggagttactgggaatcaaatgctcattcatcgcctgtgcagactgctcat

SEQ ID NO: 50774 - DNA, 75 bp, Artificial Sequence
  Synthetic
cggacgggcttgccaggcatgtgacacaatgccctaagcgaaaagagaaagtagaagagactgaactgtacttga

SEQ ID NO: 50775 - DNA, 75 bp, Artificial Sequence
  Synthetic
acacatggtgtgccaggagatctgcaggtctaccacatcggaaacctattaaaaggggacagagtaaacggacac

SEQ ID NO: 50776 - DNA, 75 bp, Artificial Sequence
  Synthetic
tctaccggtgtggcactgaaaaggagcagttggctaattgtgttacttgtgctacttacagtttcattgtcaccg

SEQ ID NO: 50777 - DNA, 75 bp, Artificial Sequence
  Synthetic
cagagaggggtacacaagtgtttgcctgtttatgctgggaggcatcttgtttgtggtctcctgcctgatgaaagg

SEQ ID NO: 50778 - DNA, 75 bp, Artificial Sequence
  Synthetic
aggagcacatactcaacagaccgactggattgacactgcccactggtttagaacaggcaatgcgcaaaggactag

SEQ ID NO: 50779 - DNA, 75 bp, Artificial Sequence
  Synthetic
aggttccgaatcatgcattaacatgttgaaagagaatttggaccgaataactgatgaattcgagcgaacaaagtt

SEQ ID NO: 50780 - DNA, 75 bp, Artificial Sequence
  Synthetic
ctgatgaattcgagcgaacaaagtttaaacatgaattaacacagaatattaccacaagtgaaaagatgttattaa

SEQ ID NO: 50781 - DNA, 75 bp, Artificial Sequence
  Synthetic
tggctttgaaattgaatcccataaatgttactgtagcttactttgttgcctttattgtagacattgctctgctga

SEQ ID NO: 50782 - DNA, 75 bp, Artificial Sequence
  Synthetic
gcttaaaatttgcaggcctaacttgcacaggttgttatgcttgtagttctggcatctcttgtaaagttagaattc

SEQ ID NO: 50783 - DNA, 75 bp, Artificial Sequence
  Synthetic
atcgagatgtgttgagtgcctcacaaatataaagaaaaccgttgatgaaactaccaacctgtcagagaagattga

SEQ ID NO: 50784 - DNA, 75 bp, Artificial Sequence
  Synthetic
gaggcaatgtcatgctggctgtctgcaagcgcatgtgcctcagagcaactatggaggtaagcaataaggtcctat

SEQ ID NO: 50785 - DNA, 75 bp, Artificial Sequence
  Synthetic
ctaccaacctgtcagagaagattgagctgcttgcttataatctccaactcaataatcactgcagcaactgtcacc

SEQ ID NO: 50786 - DNA, 75 bp, Artificial Sequence
  Synthetic
caagcgcatgtgcctcagagcaactatggaggtaagcaataaggtcctattcatccgaagtattatcaacaccac

SEQ ID NO: 50787 - DNA, 75 bp, Artificial Sequence
  Synthetic
cagtagagatggaaagcctaccagccggcacttgggaaagggaggaagacctgacaaacttctgccaccaggaat

SEQ ID NO: 50788 - DNA, 75 bp, Artificial Sequence
  Synthetic
cggcacttgggaaagggaggaagacctgacaaacttctgccaccaggaatgccaagtcacagagactgaatgtct

SEQ ID NO: 50789 - DNA, 75 bp, Artificial Sequence
  Synthetic
ttatcaattgaagcaccatggggagcaataaacgtccagtcaacctttaaacccaccgtttcaactgcaaacata

SEQ ID NO: 50790 - DNA, 75 bp, Artificial Sequence
  Synthetic
ctcctgtctttgagtacttatcaggtgacagacaggtagaggagtggcccaaagcaacctgcacaggtaattgcc

SEQ ID NO: 50791 - DNA, 75 bp, Artificial Sequence
  Synthetic
aacaagcaacctgtgccctttcaagttgactgtatactgttcaaagaagtggcagctgaatgcatgaagaggtac

SEQ ID NO: 50792 - DNA, 75 bp, Artificial Sequence
  Synthetic
tgtttgtcaagtggaaagttgaatacataaagaccgaggccatagtgtgcgttgagctcaatagccaagaaaggc

SEQ ID NO: 50793 - DNA, 75 bp, Artificial Sequence
  Synthetic
tctcaaagacagacttgcggcacacacaaaaggaaactccagtggtctcgcattgacttgtctgaagatggaagg

SEQ ID NO: 50794 - DNA, 75 bp, Artificial Sequence
  Synthetic
tagacaccttagtttctctgattaatgtgttaacaaggtttgcctggtttcaggaggtggtactatatggcaaaa

SEQ ID NO: 50795 - DNA, 75 bp, Artificial Sequence
  Synthetic
cattgacttgtctgaagatggaagggtcctattggtggctatccctattggccctattggcctggggagcaaacg

SEQ ID NO: 50796 - DNA, 75 bp, Artificial Sequence
  Synthetic
gtcctattggtggctatccctattggccctattggcctggggagcaaacggagagagcaccagcccggctgagac

SEQ ID NO: 50797 - DNA, 75 bp, Artificial Sequence
  Synthetic
ttcagcagaagcttccttctgaaataatcacattgcatcctagaattgaggaaggcttcttcgatctgatgcatg

SEQ ID NO: 50798 - DNA, 75 bp, Artificial Sequence
  Synthetic
gaagaaagatcgtgaaccagagaatcctctcagccatgggcatggactctgatcccagcaacgaagcactcaatg

SEQ ID NO: 50799 - DNA, 75 bp, Artificial Sequence
  Synthetic
cctctcagccatgggcatggactctgatcccagcaacgaagcactcaatggtgtttgccagagcatacactccaa

SEQ ID NO: 50800 - DNA, 75 bp, Artificial Sequence
  Synthetic
catggtgtgccaggagacttacagatctaccacattggcaacttgttaaaaggggatagggtaaatgggcatctg

SEQ ID NO: 50801 - DNA, 75 bp, Artificial Sequence
  Synthetic
tctaccacattggcaacttgttaaaaggggatagggtaaatgggcatctgattcacaaaattgagccacacttca

SEQ ID NO: 50802 - DNA, 75 bp, Artificial Sequence
  Synthetic
acacaaacagctctcagtgttatgatgagatactagtgaaaaaaccctgcagcagcctaacccctgctcacaact

SEQ ID NO: 50803 - DNA, 75 bp, Artificial Sequence
  Synthetic
tgagatactagtgaaaaaaccctgcagcagcctaacccctgctcacaactcacattgggtcccgaggggtcttga

SEQ ID NO: 50804 - DNA, 75 bp, Artificial Sequence
  Synthetic
atgggggattggccctcttgcacatatactggagtgacccaacataaccatgctgcttttgtaaacttacttaac

SEQ ID NO: 50805 - DNA, 75 bp, Artificial Sequence
  Synthetic
atactggagtgacccaacataaccatgctgcttttgtaaacttacttaacatcgaaactgattacacaaagaact

SEQ ID NO: 50806 - DNA, 75 bp, Artificial Sequence
  Synthetic
aaggtgcagaaccagcgggaattttttgaatagaagcagtagagaccactttgtaagcgttgtttcaggcttgaa

SEQ ID NO: 50807 - DNA, 75 bp, Artificial Sequence
  Synthetic
cacagtcaagaaaggtgacctgcctctctgccagtgcactcaatccttcacagtttgtgaaacactttcaggtta

SEQ ID NO: 50808 - DNA, 75 bp, Artificial Sequence
  Synthetic
ctctgccagtgcactcaatccttcacagtttgtgaaacactttcaggttaaaatacaagaaacgagtggccctgc

SEQ ID NO: 50809 - DNA, 75 bp, Artificial Sequence
  Synthetic
gcttgttaggctcacattaccaggaaagactgagaaggagagaagagtcaaacgtaatgtggaatatctgataaa

SEQ ID NO: 50810 - DNA, 75 bp, Artificial Sequence
  Synthetic
gccacaaaggagagaaggaggttgttcatgtcctgcagtcagcagtgccagttaagttgaaaaactgcttggcaa

SEQ ID NO: 50811 - DNA, 75 bp, Artificial Sequence
  Synthetic
tcatgtcctgcagtcagcagtgccagttaagttgaaaaactgcttggcaatgctgaactttaggcagtgctacta

SEQ ID NO: 50812 - DNA, 75 bp, Artificial Sequence
  Synthetic
tagggaaaaagttttcaacaagttgcagaaggattgaagacaacgttgcaaggctttacctacaaacatccatat

SEQ ID NO: 50813 - DNA, 75 bp, Artificial Sequence
  Synthetic
gggaaaagtgggtgacaggagcctacaccatgaccgttgaggttgacaaacatgctgatgggccgtgtgaaatct

SEQ ID NO: 50814 - DNA, 75 bp, Artificial Sequence
  Synthetic
caccatgaccgttgaggttgacaaacatgctgatgggccgtgtgaaatctcgacaacatgcatcacagaaggcag

SEQ ID NO: 50815 - DNA, 75 bp, Artificial Sequence
  Synthetic
cagaaatgtgttaacacaaagcttgagcaaccacaaagcattttaattgagcacaaaggaacaataatcggaaag

SEQ ID NO: 50816 - DNA, 75 bp, Artificial Sequence
  Synthetic
tcatacatgggaaaagaaacaccgggaggaggcttctctcaagcagcaatgcacgccaggaatgcagctcgggca

SEQ ID NO: 50817 - DNA, 75 bp, Artificial Sequence
  Synthetic
gaggaggcttctctcaagcagcaatgcacgccaggaatgcagctcgggcacatttttgggagaggggggcagtgc

SEQ ID NO: 50818 - DNA, 75 bp, Artificial Sequence
  Synthetic
gcccaaatgtgaggaaagcagcaaacaaagaagggaagaagctgttgaagttaaatagcgacacatccacagaca

SEQ ID NO: 50819 - DNA, 75 bp, Artificial Sequence
  Synthetic
gcaatggttctgtggtcaccaagatcaggcttggacaagaacacgggtgctacactgtcagaaggattaaaacat

SEQ ID NO: 50820 - DNA, 75 bp, Artificial Sequence
  Synthetic
atgcttagcggcatcttcggcaacgtttttataggcattttcttattccttgctccttttattctgttaatactc

SEQ ID NO: 50821 - DNA, 75 bp, Artificial Sequence
  Synthetic
caggcttggacaagaacacgggtgctacactgtcagaaggattaaaacatacagaaactgccggccagaagaagg

SEQ ID NO: 50822 - DNA, 75 bp, Artificial Sequence
  Synthetic
aagagcagaatccgtagtatctttggaagatacaactctcagaagaaaccatttgaattgaggtcaggtcttgaa

SEQ ID NO: 50823 - DNA, 75 bp, Artificial Sequence
  Synthetic
gaccagaggcttattcaagtacagatatctcaaggacgacgaagagtctggttacagaagaatcattgaaagatt

SEQ ID NO: 50824 - DNA, 75 bp, Artificial Sequence
  Synthetic
aatgcatgaatgttcatctaagtgtcaaaggcctagtcaaaacgagcagggggagcaacgttcaagtgcactcct

SEQ ID NO: 50825 - DNA, 75 bp, Artificial Sequence
  Synthetic
tatctcaaggacgacgaagagtctggttacagaagaatcattgaaagattaaacaacaaaaaaggaaaaaacaag

SEQ ID NO: 50826 - DNA, 75 bp, Artificial Sequence
  Synthetic
gaagatacaactctcagaagaaaccatttgaattgaggtcaggtcttgaagttttcaatgaccctttcaatgatt

SEQ ID NO: 50827 - DNA, 75 bp, Artificial Sequence
  Synthetic
caaaggcctagtcaaaacgagcagggggagcaacgttcaagtgcactcctgtgacaaagactgtctaattcagat

SEQ ID NO: 50828 - DNA, 75 bp, Artificial Sequence
  Synthetic
taagctagttaaggtaagacactgtgacattaacctatcagtcaagctgccatcaaacaaaaaagagaacatgtt

SEQ ID NO: 50829 - DNA, 75 bp, Artificial Sequence
  Synthetic
taccaaaacacacattggttaaatcagcagaaagggcctcaaaaggatgacggcagtatgttgactaatactatt

SEQ ID NO: 50830 - DNA, 75 bp, Artificial Sequence
  Synthetic
ccacacaatgggttcttttgagctgatccaagcaatctcagagttcggcatgagcaagtttcctcccgagaatat

SEQ ID NO: 50831 - DNA, 75 bp, Artificial Sequence
  Synthetic
actacctagagtctaatgtgcttgatgtagactgtcccatgtacaacaggctcggtggtctgatgctatatttct

SEQ ID NO: 50832 - DNA, 75 bp, Artificial Sequence
  Synthetic
tgtagactgtcccatgtacaacaggctcggtggtctgatgctatatttctgtaggatgtctcacagacccaggac

SEQ ID NO: 50833 - DNA, 75 bp, Artificial Sequence
  Synthetic
tgtaacatttaatctatttcaccacattcgtgagcaagctttgtgatgtttgaaaataccttagctctaattact

SEQ ID NO: 50834 - DNA, 75 bp, Artificial Sequence
  Synthetic
attcgtgagcaagctttgtgatgtttgaaaataccttagctctaattactctgacttaatccccgactgcgtgcc

SEQ ID NO: 50835 - DNA, 75 bp, Artificial Sequence
  Synthetic
tagcaggttacatggtgtactatgccatccttgctttaagcatgttgaccaggtgtctcaagcgcaaatacatgg

SEQ ID NO: 50836 - DNA, 75 bp, Artificial Sequence
  Synthetic
catccttgctttaagcatgttgaccaggtgtctcaagcgcaaatacatggtaaagggagacttctgcctaaagtg

SEQ ID NO: 50837 - DNA, 75 bp, Artificial Sequence
  Synthetic
gcttcgagggaagctaaagaaactcggtgctatctcaacaaatatagagatcgggaaaagggattgcctagatct

SEQ ID NO: 50838 - DNA, 75 bp, Artificial Sequence
  Synthetic
ctacagctgtggaatctaggaggtactcttgtgttcatcaacaggacccaacacaatgaaacaggcaccgtggca

SEQ ID NO: 50839 - DNA, 75 bp, Artificial Sequence
  Synthetic
gctcctataacatctgcccttattgtggtaacaggcttccagaagaaggtctaaggaggcatgtcccaagctgtc

SEQ ID NO: 50840 - DNA, 75 bp, Artificial Sequence
  Synthetic
acggaatatttgaaccctcgaagttgtccttctaccattggaaggaactggttaaaaaaaacattgatgaagttt

SEQ ID NO: 50841 - DNA, 75 bp, Artificial Sequence
  Synthetic
tggtaacaggcttccagaagaaggtctaaggaggcatgtcccaagctgtcccaaaaggaagcaaagattagaaga

SEQ ID NO: 50842 - DNA, 75 bp, Artificial Sequence
  Synthetic
caccaagtcggaccgcccttctgtcggacccgcagcatcgtccagtggactagagggctcaggggaaccgaatac

SEQ ID NO: 50843 - DNA, 75 bp, Artificial Sequence
  Synthetic
caacaaaacaaacaacttcaaatgcttcgttttggtatgcttgcagggcttagtaggcttgtctgtcctaatgag

SEQ ID NO: 50844 - DNA, 75 bp, Artificial Sequence
  Synthetic
cttctgctggctgaaaacaatttcctcttcggtcaaaggaagtctgaagaagagactcaagttcatgaatgtaca

SEQ ID NO: 50845 - DNA, 75 bp, Artificial Sequence
  Synthetic
ctctcagcacagcagtgaagctgggcactttgcttaagaggttgagctgggttactgtcttcctctgcttgttcc

SEQ ID NO: 50846 - DNA, 75 bp, Artificial Sequence
  Synthetic
ggacccgcagcatcgtccagtggactagagggctcaggggaaccgaatacctccccctcaatcaccacaaaaggc

SEQ ID NO: 50847 - DNA, 75 bp, Artificial Sequence
  Synthetic
cactttgcttaagaggttgagctgggttactgtcttcctctgcttgttccttactgctatcgcgcctgtgcaagg

SEQ ID NO: 50848 - DNA, 75 bp, Artificial Sequence
  Synthetic
acgagctgattaagttgaagaaactcctcctcaacgaacaacaagatgaacaggagctgaaacaggaccttttga

SEQ ID NO: 50849 - DNA, 75 bp, Artificial Sequence
  Synthetic
cgctattgcctcctcctgtgtttctcatcttttccgcagttctcatgtccaagactctgaagaggatgggtcctg

SEQ ID NO: 50850 - DNA, 75 bp, Artificial Sequence
  Synthetic
catcttttccgcagttctcatgtccaagactctgaagaggatgggtcctgtaaacaaggtgggtgcggccggaca

SEQ ID NO: 50851 - DNA, 75 bp, Artificial Sequence
  Synthetic
aatgataagattcagaaattcatttaccacctttctgaagagctatatgacataaggctgcagcacctggaactg

SEQ ID NO: 50852 - DNA, 75 bp, Artificial Sequence
  Synthetic
accacctttctgaagagctatatgacataaggctgcagcacctggaactgtcaaaacttaagcaagagcatccta

SEQ ID NO: 50853 - DNA, 75 bp, Artificial Sequence
  Synthetic
tacaataaagaaatggacaattttgacgaaggatgtatcagcgtcttggaagaaacagcagaaaggcatatgctt

SEQ ID NO: 50854 - DNA, 75 bp, Artificial Sequence
  Synthetic
ttgccaacaccaaaagtggccccagagagccacgccggcgcgtagtggtcaaagcattactcatcctaacagcat

SEQ ID NO: 50855 - DNA, 75 bp, Artificial Sequence
  Synthetic
agagccacgccggcgcgtagtggtcaaagcattactcatcctaacagcatcatcagccctccagtccattcatct

SEQ ID NO: 50856 - DNA, 75 bp, Artificial Sequence
  Synthetic
agatgcagctagttcaaggatgcaaccaagagtgctcgctagaagaagatgaatgctcctgtcctgatggccagt

SEQ ID NO: 50857 - DNA, 75 bp, Artificial Sequence
  Synthetic
cttatctggtgagacatccagaaatacttgactgtggatccaaagaggattgcaagctcactttgcttgatctgt

SEQ ID NO: 50858 - DNA, 75 bp, Artificial Sequence
  Synthetic
ccaagagtgctcgctagaagaagatgaatgctcctgtcctgatggccagtcaatgacacggaagttacttttctt

SEQ ID NO: 50859 - DNA, 75 bp, Artificial Sequence
  Synthetic
tcactagtgtgtctatcgatacaccatggggggcaatcaaagtggaatcaacttacaagccgagactcgcctcct

SEQ ID NO: 50860 - DNA, 75 bp, Artificial Sequence
  Synthetic
atggggggcaatcaaagtggaatcaacttacaagccgagactcgcctcctccaacatacagcttgcctggaattc

SEQ ID NO: 50861 - DNA, 75 bp, Artificial Sequence
  Synthetic
gagggttacttcaatgaagtcttacagttcaaggtaccaagcacactgagctccacagagccgactcataccagg

SEQ ID NO: 50862 - DNA, 75 bp, Artificial Sequence
  Synthetic
acaaagatagtttttgctaaaattggtttatctgggaacagttatgatttcatctggactactcaaatgatagca

SEQ ID NO: 50863 - DNA, 75 bp, Artificial Sequence
  Synthetic
tcatcaagctagaagaaaaaacgggcatgcagtggtctctaggctctgagtcagcagcagaggagaagaggctcc

SEQ ID NO: 50864 - DNA, 75 bp, Artificial Sequence
  Synthetic
catgcagtggtctctaggctctgagtcagcagcagaggagaagaggctcctggtgtccatactggattacacaca

SEQ ID NO: 50865 - DNA, 75 bp, Artificial Sequence
  Synthetic
agtggccaaaagccacctgtactggagactgccctgaccggtgcgggtgcagcacatcctcctgcctttacaagt

SEQ ID NO: 50866 - DNA, 75 bp, Artificial Sequence
  Synthetic
agactgccctgaccggtgcgggtgcagcacatcctcctgcctttacaagtcctggccacacagccgtaactggag

SEQ ID NO: 50867 - DNA, 75 bp, Artificial Sequence
  Synthetic
gggttgacattcttagaccctttaacaaatactttgtcaccaaatggaccactgagtatgtaagaacagatgtgc

SEQ ID NO: 50868 - DNA, 75 bp, Artificial Sequence
  Synthetic
caaatactttgtcaccaaatggaccactgagtatgtaagaacagatgtgctggtctgtgttgagctaacagacca

SEQ ID NO: 50869 - DNA, 75 bp, Artificial Sequence
  Synthetic
tatccaccatgaagggactttcataccaggaacttacaaaatagtgatagacaaaaaaaacaagcaaaacgatag

SEQ ID NO: 50870 - DNA, 75 bp, Artificial Sequence
  Synthetic
ctgtgagggtggtagtctctgacccccagaatgttcagactaagcttccatcagagatcctgaccatccaaaaac

SEQ ID NO: 50871 - DNA, 75 bp, Artificial Sequence
  Synthetic
ccagaatgttcagactaagcttccatcagagatcctgaccatccaaaaacttgaaggaaatcaggttgtggatat

SEQ ID NO: 50872 - DNA, 75 bp, Artificial Sequence
  Synthetic
aataccaaatggggcccgattcattgctgctctttcttttctggcatgatgcaacaggttcttaaaaatgtacca

SEQ ID NO: 50873 - DNA, 75 bp, Artificial Sequence
  Synthetic
gctgcacgcacggcagcccaggtgacatgcagatcctccatacagacaacctcatacagcacagtcatgatggtg

SEQ ID NO: 50874 - DNA, 75 bp, Artificial Sequence
  Synthetic
catgcagatcctccatacagacaacctcatacagcacagtcatgatggtggtttaaatcttgccgaccttaaccc

SEQ ID NO: 50875 - DNA, 75 bp, Artificial Sequence
  Synthetic
atatcctcttggatcaagtgtataacagcttgtaaagactttgcaagcatcaatgacaaggttcagaaatttatt

SEQ ID NO: 50876 - DNA, 75 bp, Artificial Sequence
  Synthetic
aagaagatcttaaatgttcttagatacagattgtgcagcaaaggaggtgtagagcagcatagtgaggaggatcta

SEQ ID NO: 50877 - DNA, 75 bp, Artificial Sequence
  Synthetic
actgcactacgggtagttggccgagctgcacctacactggcataaactcagaaaatacagagagctttgacaacc

SEQ ID NO: 50878 - DNA, 75 bp, Artificial Sequence
  Synthetic
ctgcacctacactggcataaactcagaaaatacagagagctttgacaacctcttaaacactgaatccaacctatg

SEQ ID NO: 50879 - DNA, 75 bp, Artificial Sequence
  Synthetic
caagtttttagtcacaacctatataagcaagggactcatggcgttaaacagttacaatcatatgggtcagggtat

SEQ ID NO: 50880 - DNA, 75 bp, Artificial Sequence
  Synthetic
tcatcatgcaacatcttcggtgttaacttccctagctgccgtgctctttgaggaactggcaattttttatcttaa

SEQ ID NO: 50881 - DNA, 75 bp, Artificial Sequence
  Synthetic
ttcagatggaccttaagggaaggcccaacagtggaggtggtgagctatctgtcttagtagatgtgaagggtcttg

SEQ ID NO: 50882 - DNA, 75 bp, Artificial Sequence
  Synthetic
gtgcttacactacaaagcactagagtcttatctggtaagacacccagagatacttgactgtggatctaaggagga

SEQ ID NO: 50883 - DNA, 75 bp, Artificial Sequence
  Synthetic
gagaagtttaccccaaacaacagtacatgttgaacatgctggtagttcagatgattacgcaaagtgtatagtggt

SEQ ID NO: 50884 - DNA, 75 bp, Artificial Sequence
  Synthetic
caacagtggaggtggtgagctatctgtcttagtagatgtgaagggtcttgagttgcattcaaagaaaatatctct

SEQ ID NO: 50885 - DNA, 75 bp, Artificial Sequence
  Synthetic
gactggcatactgtctaaagagctctactcccagtatgatgagacattttggaaacacgcttgtagacttaagaa

SEQ ID NO: 50886 - DNA, 75 bp, Artificial Sequence
  Synthetic
gctctggcttatcctgcactgtggaggtgaggattgagagaccggatgagttcaccgtccaccttagaagtgtca

SEQ ID NO: 50887 - DNA, 75 bp, Artificial Sequence
  Synthetic
ggtgaggattgagagaccggatgagttcaccgtccaccttagaagtgtcagtccagatatagcggtggcggaagg

SEQ ID NO: 50888 - DNA, 75 bp, Artificial Sequence
  Synthetic
cctttgcagttagaaaggttaagaagatctgctttgagattgttgaaaagtcatactgcaaagactgcaagaatg

SEQ ID NO: 50889 - DNA, 75 bp, Artificial Sequence
  Synthetic
gatctgctttgagattgttgaaaagtcatactgcaaagactgcaagaatgaagacaccacaaagtgcattgaggt

SEQ ID NO: 50890 - DNA, 75 bp, Artificial Sequence
  Synthetic
ttaatgcaagcatgtcaagtttcatctcaacaagcaatgtataatagtgtccctcttgttaccaacactgccttc

SEQ ID NO: 50891 - DNA, 75 bp, Artificial Sequence
  Synthetic
ccgtattgcgcatctagattaacctcagatggtcttgccagacatgtaatgcaatgccctaagcggaaggaaaaa

SEQ ID NO: 50892 - DNA, 75 bp, Artificial Sequence
  Synthetic
ttaaccatgttgaggatttcatcagaagatatggtatattaacacttgggactttatcaccttttggtaggctgt

SEQ ID NO: 50893 - DNA, 75 bp, Artificial Sequence
  Synthetic
taaagcgacaaaatgaaacttgtgtttcaggacttcagtgctggacagaatctgcttctagctttgtgtccgggg

SEQ ID NO: 50894 - DNA, 75 bp, Artificial Sequence
  Synthetic
ttcaggacttcagtgctggacagaatctgcttctagctttgtgtccggggttggtagtttttttagaaactacct

SEQ ID NO: 50895 - DNA, 75 bp, Artificial Sequence
  Synthetic
tcctcctcttcttctgttacggagacaagttatttaagctttgcagttgctttcgatgttgtagaggactatcaa

SEQ ID NO: 50896 - DNA, 75 bp, Artificial Sequence
  Synthetic
caagttatttaagctttgcagttgctttcgatgttgtagaggactatcaaggggcaaagtcaggaaggaactcga

SEQ ID NO: 50897 - DNA, 75 bp, Artificial Sequence
  Synthetic
atgcatgcaactactgaaatgttcagtagaaacctcttaaaaacaacatcagatgatggccttacaaacccacac

SEQ ID NO: 50898 - DNA, 75 bp, Artificial Sequence
  Synthetic
cagagaagggtacacaagcttctgcctttttatactaggaagcatcttgtttgtagtctcttgcctagtaaaggg

SEQ ID NO: 50899 - DNA, 75 bp, Artificial Sequence
  Synthetic
tctcatgactcaggatcgtcatcctcaagcttctcttttgagctcaacaggcccctgtctgaaactgaactacag

SEQ ID NO: 50900 - DNA, 75 bp, Artificial Sequence
  Synthetic
tgtttgggaaagaaaaaaaagacgccagaaccatagctctgctgctatctggcaaagggaagaactacaaggaac

SEQ ID NO: 50901 - DNA, 75 bp, Artificial Sequence
  Synthetic
gcccctgtctgaaactgaactacagttcattaaggcactaagtagccttaagtcaacacaagcctgtgaagtaat

SEQ ID NO: 50902 - DNA, 75 bp, Artificial Sequence
  Synthetic
cagaaccatagctctgctgctatctggcaaagggaagaactacaaggaacttgtttgactgccccaaaccccgcc

SEQ ID NO: 50903 - DNA, 75 bp, Artificial Sequence
  Synthetic
gccgctcttcccctgcctccatgctgaccatagccagctagagcatgtctaccgatatgttaaccctttgtgtaa

SEQ ID NO: 50904 - DNA, 75 bp, Artificial Sequence
  Synthetic
ctaagggatggtaaaagaagagggaatctagaactagcaaatagaatccagtccgtactgtgtattctgatagca

SEQ ID NO: 50905 - DNA, 75 bp, Artificial Sequence
  Synthetic
ctctttcactgtggagtttactaatcaattgtcatgtatgttttagtgctagttattatgtgtttataagtttag

SEQ ID NO: 50906 - DNA, 75 bp, Artificial Sequence
  Synthetic
taaaaaaatcttaaatgttcttagatacaaactgtgcagcaaaggaggtgtagagcagcacagtgaagaggattt

SEQ ID NO: 50907 - DNA, 75 bp, Artificial Sequence
  Synthetic
tctcaaagacatcatcccccttatccccaagttaacatggactttcttgaaggaataacgtgggatagtgtctct

SEQ ID NO: 50908 - DNA, 75 bp, Artificial Sequence
  Synthetic
gacagctgggatgggaacgacacagtcaagtttttagtcacaacctatataagcaaggggctcatggcactaaac

SEQ ID NO: 50909 - DNA, 75 bp, Artificial Sequence
  Synthetic
aggaataacgtgggatagtgtctctgatatccaatcggttagcaatccgagcttcaccattactgattactttga

SEQ ID NO: 50910 - DNA, 75 bp, Artificial Sequence
  Synthetic
gatatccaatcggttagcaatccgagcttcaccattactgattactttgaagtggttagacagcctgcggatggc

SEQ ID NO: 50911 - DNA, 75 bp, Artificial Sequence
  Synthetic
atggaagtcgatgaactaatgccaagcattagtcctgatgacaccttagcccagcttgtagcgaaaaaactcatc

SEQ ID NO: 50912 - DNA, 75 bp, Artificial Sequence
  Synthetic
ccacgcatacaggttagtcaaaaatgagctgagggaagctgccgagaagtatttcccgacagagcctgaagctgc

SEQ ID NO: 50913 - DNA, 75 bp, Artificial Sequence
  Synthetic
gagctgagggaagctgccgagaagtatttcccgacagagcctgaagctgctgccactggcatgaggctcgatgag

SEQ ID NO: 50914 - DNA, 75 bp, Artificial Sequence
  Synthetic
aaactcaacaagcttggaaacaagcttatcaattgaggcaccatggggtgcaataaatgtccaatcaaccttcaa

SEQ ID NO: 50915 - DNA, 75 bp, Artificial Sequence
  Synthetic
acaaacactgacagcccgaaatgttctgcacgggctggctggaggaattaaggagctttcgcttccaatatacac

SEQ ID NO: 50916 - DNA, 75 bp, Artificial Sequence
  Synthetic
gatattcatgaaatcctacttctttaaagacaacgtcttcttgtcactaacagacagatggtccaccaagcatag

SEQ ID NO: 50917 - DNA, 75 bp, Artificial Sequence
  Synthetic
agcaatgctctcacgccatctgggactcactgtggttatttggctggtagatggcagcaatagagtcgttggtgc

SEQ ID NO: 50918 - DNA, 75 bp, Artificial Sequence
  Synthetic
ctcactgtggttatttggctggtagatggcagcaatagagtcgttggtgctacaaggtttggtaagggttcactc

SEQ ID NO: 50919 - DNA, 75 bp, Artificial Sequence
  Synthetic
ccaagtatactcactggttggatacctttctaggctgttctgtctccatcaataggcatactactgtcaaagagc

SEQ ID NO: 50920 - DNA, 75 bp, Artificial Sequence
  Synthetic
aaattcatgttcactggactgataaatagctctgtaacctctcctcagagtttgatgcaggcatgccaggtttca

SEQ ID NO: 50921 - DNA, 75 bp, Artificial Sequence
  Synthetic
gcggctactagccacggaagaagacccccagcaggagacaatgacactggtagagaagatggagcttgtggagag

SEQ ID NO: 50922 - DNA, 75 bp, Artificial Sequence
  Synthetic
ccccagcaggagacaatgacactggtagagaagatggagcttgtggagagatttacattgactgagggagaggaa

SEQ ID NO: 50923 - DNA, 75 bp, Artificial Sequence
  Synthetic
tccggaggagccctccaccagcgagcctaggctcagatcgcaggccattttactgcatagactagttagacatgg

SEQ ID NO: 50924 - DNA, 75 bp, Artificial Sequence
  Synthetic
cctaggctcagatcgcaggccattttactgcatagactagttagacatggtgaaaatatccctgtcagagttggt

SEQ ID NO: 50925 - DNA, 75 bp, Artificial Sequence
  Synthetic
agaactgctcattttgaagccagaccggaaggaggccaccgcagagtcaatgagtctcagacagctaggacacaa

SEQ ID NO: 50926 - DNA, 75 bp, Artificial Sequence
  Synthetic
caatttctgaagtcaagcctaccaaggttgacttctcgaatttacttaaagaccgcttcaaaataatgcaatttt

SEQ ID NO: 50927 - DNA, 75 bp, Artificial Sequence
  Synthetic
cggaaggaggccaccgcagagtcaatgagtctcagacagctaggacacaagatgctaacaagagacaagcagcta

SEQ ID NO: 50928 - DNA, 75 bp, Artificial Sequence
  Synthetic
gatgctgacagatgaatcgtcagattcggaaaagaatggccttagtccagatttgcaacaagttgcaagatactc

SEQ ID NO: 50929 - DNA, 75 bp, Artificial Sequence
  Synthetic
tcaagcttctcttttgagctcaataggcctctgtctgagactgaactacaatttatcaaagcactaaacagcctc

SEQ ID NO: 50930 - DNA, 75 bp, Artificial Sequence
  Synthetic
ccatcttgatgttggaggccttctccgatcagctttcccaggtaaaggccttgaaagaaacttgtctctccttca

SEQ ID NO: 50931 - DNA, 75 bp, Artificial Sequence
  Synthetic
cgatcagctttcccaggtaaaggccttgaaagaaacttgtctctccttcactcagagttagtgctggacatttgc

SEQ ID NO: 50932 - DNA, 75 bp, Artificial Sequence
  Synthetic
caaaaacaaacgaagattcatcaccaactgcctgcttggcaccagcctctcaggtaagcgagtttttaaatctct

SEQ ID NO: 50933 - DNA, 75 bp, Artificial Sequence
  Synthetic
aactgcctgcttggcaccagcctctcaggtaagcgagtttttaaatctctcagcaagttgacatccaacttgttg

SEQ ID NO: 50934 - DNA, 75 bp, Artificial Sequence
  Synthetic
acatactccgtaaagtattggaaaattcttcactgcatctctgccatcggatgtttacctttgagtcaagcagac

SEQ ID NO: 50935 - DNA, 75 bp, Artificial Sequence
  Synthetic
taggctcatccaaaagctgagcaactgtttcgcactgatgaatcccattagccttctcgcacttagaaaccttga

SEQ ID NO: 50936 - DNA, 75 bp, Artificial Sequence
  Synthetic
catcattgaatagggacgacaacaaaatcatcgaagatcctatgatacaactgattccagagaaactgaggaggg

SEQ ID NO: 50937 - DNA, 75 bp, Artificial Sequence
  Synthetic
tagagcatccgactgtccactatctagtcatgaggcaagtatattgagtgagtttgatggacaagttattgctaa

SEQ ID NO: 50938 - DNA, 75 bp, Artificial Sequence
  Synthetic
tgtttcgcactgatgaatcccattagccttctcgcacttagaaaccttgactgcgataacatggagctcaaagac

SEQ ID NO: 50939 - DNA, 75 bp, Artificial Sequence
  Synthetic
ttttacacacagagaaattgctgatataaatcagctgacggatagacttcagatattggctggtaggaaaaatcc

SEQ ID NO: 50940 - DNA, 75 bp, Artificial Sequence
  Synthetic
cccagcttgtggcaaaaaaactaatcagcctcaatgtttcgacagaagaatactcggcagaggtatctaggctca

SEQ ID NO: 50941 - DNA, 75 bp, Artificial Sequence
  Synthetic
ataaatcagctgacggatagacttcagatattggctggtaggaaaaatcctgatgtactacttgaatggtacaaa

SEQ ID NO: 50942 - DNA, 75 bp, Artificial Sequence
  Synthetic
gtaagttcaacacctggggagactcaaatagatctggaaagttcacatacagcagcagatccggggagtccattg

SEQ ID NO: 50943 - DNA, 75 bp, Artificial Sequence
  Synthetic
gcacctgatcagcgacttctttaggcggaaagacatcatgaagttcatcagcacgtctggaaaggcctcaagtgc

SEQ ID NO: 50944 - DNA, 75 bp, Artificial Sequence
  Synthetic
cggaaagacatcatgaagttcatcagcacgtctggaaaggcctcaagtgctggaagcctaggcaatgtactatca

SEQ ID NO: 50945 - DNA, 75 bp, Artificial Sequence
  Synthetic
gccttgttgtgtgaaactgaaagacaagtgctctcttggatgagtaagaggaggactgaggtaataactaaagaa

SEQ ID NO: 50946 - DNA, 75 bp, Artificial Sequence
  Synthetic
gccatgcccaaaacctccttgtgcttttatattgtggagagagaatactgtaagagctgcagtagagaggacaca

SEQ ID NO: 50947 - DNA, 75 bp, Artificial Sequence
  Synthetic
ggatgtaacccagctgttaattgagattaagaggctatacaagctccagggcgaccagagtgttgagccaattgc

SEQ ID NO: 50948 - DNA, 75 bp, Artificial Sequence
  Synthetic
attaagaggctatacaagctccagggcgaccagagtgttgagccaattgctctcatctgcgatcggttagaagac

SEQ ID NO: 50949 - DNA, 75 bp, Artificial Sequence
  Synthetic
aaagcacaaggacggtagcgcgctgtcagtcatacctgatagcagcaatccccgactacttaagtttgtgcctct

SEQ ID NO: 50950 - DNA, 75 bp, Artificial Sequence
  Synthetic
tcagtcatacctgatagcagcaatccccgactacttaagtttgtgcctctcaaaaaaggtctagcggtggtgaaa

SEQ ID NO: 50951 - DNA, 75 bp, Artificial Sequence
  Synthetic
tgtgactctctttgaggacattagaaactcaaccagccacagtaccgcttggaagcacgcgctgaggctgaaggg

SEQ ID NO: 50952 - DNA, 75 bp, Artificial Sequence
  Synthetic
aactcaaccagccacagtaccgcttggaagcacgcgctgaggctgaagggcactgcctacgaaggtatgttttcc

SEQ ID NO: 50953 - DNA, 75 bp, Artificial Sequence
  Synthetic
aaacttagaatagttgaatccagacctgcagaatctgagttagaggcaaatcgtgcagtgattgttaagactaaa

SEQ ID NO: 50954 - DNA, 75 bp, Artificial Sequence
  Synthetic
ctgcagaatctgagttagaggcaaatcgtgcagtgattgttaagactaaactgttctcagcaactgaacaggtcc

SEQ ID NO: 50955 - DNA, 75 bp, Artificial Sequence
  Synthetic
tatgctgatccagactctgtttcccgagaagtttgaaatgtttttggacaggacacagctgcaccctgagttcag

SEQ ID NO: 50956 - DNA, 75 bp, Artificial Sequence
  Synthetic
gaaagaaacttttgcctcagtcagtgttctctgattccaaagttgtcttgtcaaggatcaagttcaagacagagc

SEQ ID NO: 50957 - DNA, 75 bp, Artificial Sequence
  Synthetic
gagaagtttgaaatgtttttggacaggacacagctgcaccctgagttcagggatcttacaccagactacgcacta

SEQ ID NO: 50958 - DNA, 75 bp, Artificial Sequence
  Synthetic
ccaaatttcaattggggaaacacttgatgagtctgttgatgctataccccttgaagaaaagaaaatgttccctct

SEQ ID NO: 50959 - DNA, 75 bp, Artificial Sequence
  Synthetic
gatgagtctgttgatgctataccccttgaagaaaagaaaatgttccctctgccagagacacctgttggcgaagtg

SEQ ID NO: 50960 - DNA, 75 bp, Artificial Sequence
  Synthetic
gttatattctacctacttcattatattcgtaatgcttgaaactgctattgcttcattcactctgtcctaaacctt

SEQ ID NO: 50961 - DNA, 75 bp, Artificial Sequence
  Synthetic
ttcgtaatgcttgaaactgctattgcttcattcactctgtcctaaaccttgactgcgtgccgccactatatcttt

SEQ ID NO: 50962 - DNA, 75 bp, Artificial Sequence
  Synthetic
cagggatgactcaaaggccagtgctgaagagggaaaagcatccgactcggctggtgaacagcttgactacaatag

SEQ ID NO: 50963 - DNA, 75 bp, Artificial Sequence
  Synthetic
gaagagggaaaagcatccgactcggctggtgaacagcttgactacaatagccgaatcattatagataaaaataac

SEQ ID NO: 50964 - DNA, 75 bp, Artificial Sequence
  Synthetic
ataaaggaaggtaggttctataggctttccgacaccggaatcgatgcaagtacatattctgtaaaatactggaag

SEQ ID NO: 50965 - DNA, 75 bp, Artificial Sequence
  Synthetic
cttctatggaagttcacgttagacaccaatgtaagcactacaagtaccataaaagacgtgaggacactggtgtcc

SEQ ID NO: 50966 - DNA, 75 bp, Artificial Sequence
  Synthetic
ggaggttggatatcagacagatgttgacagcaaaatcacaactgactacaagaaatggaaagacattctcagact

SEQ ID NO: 50967 - DNA, 75 bp, Artificial Sequence
  Synthetic
gacagcaaaatcacaactgactacaagaaatggaaagacattctcagacttctggagatgctagacatcaagtgt

SEQ ID NO: 50968 - DNA, 75 bp, Artificial Sequence
  Synthetic
tgaagaagtgttaatgaacttaatcaaccagtgtaaggcagtaaaggaactcatcaacagcacaggactctcaga

SEQ ID NO: 50969 - DNA, 75 bp, Artificial Sequence
  Synthetic
gatttctgaggataaggtaaggttgttgaagaattccataagccatctcttcagttgtctgaccaagaactcacc

SEQ ID NO: 50970 - DNA, 75 bp, Artificial Sequence
  Synthetic
ttgaagaattccataagccatctcttcagttgtctgaccaagaactcaccatctgatgttactgacattgtggtg

SEQ ID NO: 50971 - DNA, 75 bp, Artificial Sequence
  Synthetic
agtgtagtaagagagatggccctagatgttcctttgcagcactgttaagtctagttcatgaggattggcagagga

SEQ ID NO: 50972 - DNA, 75 bp, Artificial Sequence
  Synthetic
aactaaaacaccaatatccagtaaagatgtgcaggaaacatgggccagacagcaagagtacattatcaaccgtcc

SEQ ID NO: 50973 - DNA, 75 bp, Artificial Sequence
  Synthetic
gatgtgcaggaaacatgggccagacagcaagagtacattatcaaccgtccgactgggatctctattccaaaaagg

SEQ ID NO: 50974 - DNA, 75 bp, Artificial Sequence
  Synthetic
ttgaaggttaacattatcttggtgcctcttaaggacatgtctaagccaaagcctgagagagtggtcatggccaga

SEQ ID NO: 50975 - DNA, 75 bp, Artificial Sequence
  Synthetic
agactcaagcaaggagtgtgtggctaacataaagaagaatgcagagaggctgacggatgagtatgagagaacaaa

SEQ ID NO: 50976 - DNA, 75 bp, Artificial Sequence
  Synthetic
aacataaagaagaatgcagagaggctgacggatgagtatgagagaacaaagttcaagcacgaactgaactacagc

SEQ ID NO: 50977 - DNA, 75 bp, Artificial Sequence
  Synthetic
aggtataagatgtgataattgtctacatacaatcaaagagactgttgaacagatgaatgaaaactgtgacaggct

SEQ ID NO: 50978 - DNA, 75 bp, Artificial Sequence
  Synthetic
gattacaacaagttgattgaccactgtgtagacatggaaaaaaagagggaagcggttagagcagtggaagattta

SEQ ID NO: 50979 - DNA, 75 bp, Artificial Sequence
  Synthetic
catacaatcaaagagactgttgaacagatgaatgaaaactgtgacaggcttgagtatcttgccagcagctgcctc

SEQ ID NO: 50980 - DNA, 75 bp, Artificial Sequence
  Synthetic
tgtacacgaggatgagcaatgtcaagagcaaataagcttagatgatctaatggcaaacgatacggtaacagactt

SEQ ID NO: 50981 - DNA, 75 bp, Artificial Sequence
  Synthetic
ccaaacaaatgtgcagaaaaggctaccagagatgggactcttgaagcattcagagaacaaaggctttgaagatac

SEQ ID NO: 50982 - DNA, 75 bp, Artificial Sequence
  Synthetic
ccagagatgggactcttgaagcattcagagaacaaaggctttgaagatactaatgaggccattactgacttagac

SEQ ID NO: 50983 - DNA, 75 bp, Artificial Sequence
  Synthetic
gatgaaaccgacactcagaccacataccacgaaaacctcttgaaggtaaagcagcttgttgactgctctacagac

SEQ ID NO: 50984 - DNA, 75 bp, Artificial Sequence
  Synthetic
agttggttttcaaactgacatcgatgggaaaataaggacagatcacaagaagtggaaagatatattaaagctatt

SEQ ID NO: 50985 - DNA, 75 bp, Artificial Sequence
  Synthetic
gggattcagattgaacatgccgcttgcatgcgccattaatgcccttcagtgtctcaagtacaaatgaggcagttt

SEQ ID NO: 50986 - DNA, 75 bp, Artificial Sequence
  Synthetic
gcatgcgccattaatgcccttcagtgtctcaagtacaaatgaggcagttttaattgcaccatattgacatcaaag

SEQ ID NO: 50987 - DNA, 75 bp, Artificial Sequence
  Synthetic
caaaaggaatgtggaactgctgataagacaaatgatgcagcaatctggcattgaatgcataaagctgccatcagg

SEQ ID NO: 50988 - DNA, 75 bp, Artificial Sequence
  Synthetic
agacaaatgatgcagcaatctggcattgaatgcataaagctgccatcaggccagatagtcacacacagactaaca

SEQ ID NO: 50989 - DNA, 75 bp, Artificial Sequence
  Synthetic
ttaattgattcatttcactacattaccaatcctctctttctctctctttctttgccactcatttcagtttcatta

SEQ ID NO: 50990 - DNA, 75 bp, Artificial Sequence
  Synthetic
ccaatcctctctttctctctctttctttgccactcatttcagtttcattaccattgttattattttggggtgtgg

SEQ ID NO: 50991 - DNA, 75 bp, Artificial Sequence
  Synthetic
gagagtaacaaagttaaaaaaggaactatctgaaaagaagctctctcaatactcaaagcacatcaattccactat

SEQ ID NO: 50992 - DNA, 75 bp, Artificial Sequence
  Synthetic
ctatctgaaaagaagctctctcaatactcaaagcacatcaattccactatcgcacactcactggaacgcttggac

SEQ ID NO: 50993 - DNA, 75 bp, Artificial Sequence
  Synthetic
attgagggatctgaaagtgcctaccaaggatgaggacattctgatagggattcaaaggtccatgcaagagaaagt

SEQ ID NO: 50994 - DNA, 75 bp, Artificial Sequence
  Synthetic
aaggatgaggacattctgatagggattcaaaggtccatgcaagagaaagttgggttcacagtcaacaatgacaaa

SEQ ID NO: 50995 - DNA, 75 bp, Artificial Sequence
  Synthetic
caaatcattactggaaactaatgaggaaggtattttccaatctgactgcgtactcttcaaggaggtggtagcaga

SEQ ID NO: 50996 - DNA, 75 bp, Artificial Sequence
  Synthetic
gcttatcacccatggaagagtgagtgcaaaacataacgatggaaacttgaaagatagaagtgatgacgaccaaag

SEQ ID NO: 50997 - DNA, 75 bp, Artificial Sequence
  Synthetic
gaaggtattttccaatctgactgcgtactcttcaaggaggtggtagcagaggctatgtgcaggtacacatccacg

SEQ ID NO: 50998 - DNA, 75 bp, Artificial Sequence
  Synthetic
caagtttgtctggttccaggaatgcatcctgtacggcaaggtgtgtgaaactttcctccggtgttgcacagagtt

SEQ ID NO: 50999 - DNA, 75 bp, Artificial Sequence
  Synthetic
atcctgtacggcaaggtgtgtgaaactttcctccggtgttgcacagagtttagcaggtctggtatcaaattagtc

SEQ ID NO: 51000 - DNA, 75 bp, Artificial Sequence
  Synthetic
aaaagagaatatgctgtgctgcatatacagcaaggacatggagcttatcaagggacctttctttctcaatcgaag

SEQ ID NO: 51001 - DNA, 75 bp, Artificial Sequence
  Synthetic
tacagcaaggacatggagcttatcaagggacctttctttctcaatcgaaggcaggctattttgggagcagcatat

SEQ ID NO: 51002 - DNA, 75 bp, Artificial Sequence
  Synthetic
cctagaggtactaaacaatcatgggcctcgaatactcgagaatataagtaggtgcacaaagacactcctggaaac

SEQ ID NO: 51003 - DNA, 75 bp, Artificial Sequence
  Synthetic
cctcgaatactcgagaatataagtaggtgcacaaagacactcctggaaaccgctactaaggagctgtcattcaca

SEQ ID NO: 51004 - DNA, 75 bp, Artificial Sequence
  Synthetic
tacaaaaactcgtctgctctccgtgcacagggtgcacagattgataccgtcttcagctcgtactactggctctac

SEQ ID NO: 51005 - DNA, 75 bp, Artificial Sequence
  Synthetic
gctcggaggcaacttcctcagcagaagcagcagagaccactttgtctcagtgatctcagggctgaatcttgttta

SEQ ID NO: 51006 - DNA, 75 bp, Artificial Sequence
  Synthetic
agcagcagagaccactttgtctcagtgatctcagggctgaatcttgtttacggactgttgatcagagacaacctt

SEQ ID NO: 51007 - DNA, 75 bp, Artificial Sequence
  Synthetic
catgctctgtggcctaagccgtctttcctgtcctaaagagctaggaaaaaagttttcagcaagctgtcgcaggat

SEQ ID NO: 51008 - DNA, 75 bp, Artificial Sequence
  Synthetic
tgcatgaatcattaatacctctcagtatcttaagggtaagtaagacaatttataccatgccatttgctgacatct

SEQ ID NO: 51009 - DNA, 75 bp, Artificial Sequence
  Synthetic
tcctgtcctaaagagctaggaaaaaagttttcagcaagctgtcgcaggatggaagacaatgttatgaggctttac

SEQ ID NO: 51010 - DNA, 75 bp, Artificial Sequence
  Synthetic
caactggaagctaaaagacctttgtccagaggtcaccataccctgcttttcagtctatgggctctttgtaaatag

SEQ ID NO: 51011 - DNA, 75 bp, Artificial Sequence
  Synthetic
ccagaggtcaccataccctgcttttcagtctatgggctctttgtaaatagtgatagacagttgatttatgacatt

SEQ ID NO: 51012 - DNA, 75 bp, Artificial Sequence
  Synthetic
cttcggacaaacactgagaccaacaatccatgtgccaagacaattgttaagttgtttgaaattcagaaaacaggg

SEQ ID NO: 51013 - DNA, 75 bp, Artificial Sequence
  Synthetic
tataaatgtcctagaggaaactgcagaacgccacatgatgtgggagctcaatctgcttgaaaccctaaacccaaa

SEQ ID NO: 51014 - DNA, 75 bp, Artificial Sequence
  Synthetic
gaacgccacatgatgtgggagctcaatctgcttgaaaccctaaacccaaacactaaagatgaccgtacagcaagg

SEQ ID NO: 51015 - DNA, 75 bp, Artificial Sequence
  Synthetic
tttcaaaatgcctacaacgtcaaggggaacgccaccagtgccaacatcatctaaagcctaaaatgttctgcaatc

SEQ ID NO: 51016 - DNA, 75 bp, Artificial Sequence
  Synthetic
aaagataagaccactattacatgactcagagagtgcagacagcagcagtgaaagctcaaccatctcggggaggcg

SEQ ID NO: 51017 - DNA, 75 bp, Artificial Sequence
  Synthetic
tcagagagtgcagacagcagcagtgaaagctcaaccatctcggggaggcggtcctacggctctagcaaaggcaag

SEQ ID NO: 51018 - DNA, 75 bp, Artificial Sequence
  Synthetic
ttatttaaactgcttatgtaatcttgctttgttaacattttatcattctcttctgttttaaatacttaaagggct

SEQ ID NO: 51019 - DNA, 75 bp, Artificial Sequence
  Synthetic
caagccgggtcttgaagtgagcaacgatccgcttcatgactttcaacaggtcgtgactggaggtagtgcgtattc

SEQ ID NO: 51020 - DNA, 75 bp, Artificial Sequence
  Synthetic
gatccgcttcatgactttcaacaggtcgtgactggaggtagtgcgtattcagagtattcaccgaaccaggatagt

SEQ ID NO: 51021 - DNA, 75 bp, Artificial Sequence
  Synthetic
aaaattcggagacggtgatgtgtttacagctgtgaaccttctgcactctgggcaaacacattttgatgctctcag

SEQ ID NO: 51022 - DNA, 75 bp, Artificial Sequence
  Synthetic
ggggtcatttgagcttatacaggcagtgactgaatttgccaggaccaagtttcctgcagaaggcattgagaaggc

SEQ ID NO: 51023 - DNA, 75 bp, Artificial Sequence
  Synthetic
ataaggttatagctgtggatcagttgacatcatcctctagtgatgagctgcaagactatgaagatcttgctttag

SEQ ID NO: 51024 - DNA, 75 bp, Artificial Sequence
  Synthetic
gtgactgaatttgccaggaccaagtttcctgcagaaggcattgagaaggcaagacgagacccaaagaactgggta

SEQ ID NO: 51025 - DNA, 75 bp, Artificial Sequence
  Synthetic
taggcggtcaagcttggatgaagtcactctgtccaggaaacaagcagagctattgaggcagaaggcatctcagtt

SEQ ID NO: 51026 - DNA, 75 bp, Artificial Sequence
  Synthetic
ccacatgatgttgaaagactgctacaaggttctcttaggtactgaaaataagaaaattgtaaagatgctaagagg

SEQ ID NO: 51027 - DNA, 75 bp, Artificial Sequence
  Synthetic
aaggttctcttaggtactgaaaataagaaaattgtaaagatgctaagagggaagctaaagaagcttggtgccata

SEQ ID NO: 51028 - DNA, 75 bp, Artificial Sequence
  Synthetic
aacataccgactagagtcggcagggtcttggactgcatgtttaactgcaaactatgtgttgagatatcagctgac

SEQ ID NO: 51029 - DNA, 75 bp, Artificial Sequence
  Synthetic
ggttgaaggcctatccgaggagcagaagaagaacatagtcaatggcatcttcgagccttccaaattatcctttta

SEQ ID NO: 51030 - DNA, 75 bp, Artificial Sequence
  Synthetic
aagaagaacatagtcaatggcatcttcgagccttccaaattatccttttaccactggagagaactcatcaagaaa

SEQ ID NO: 51031 - DNA, 75 bp, Artificial Sequence
  Synthetic
aggaattctctagaatgaaactttatgttaccaaagatttgctggaccatctagatgttggtgggctgttgaggg

SEQ ID NO: 51032 - DNA, 75 bp, Artificial Sequence
  Synthetic
gctcaaaactctatccagtgcaataaagggaaggctcaagcgggatctaagattcatgaatcaaaacagccagac

SEQ ID NO: 51033 - DNA, 75 bp, Artificial Sequence
  Synthetic
aagggaaggctcaagcgggatctaagattcatgaatcaaaacagccagaccagcagtcagacagacctctttagc

SEQ ID NO: 51034 - DNA, 75 bp, Artificial Sequence
  Synthetic
gagatgatactggacatctgtactgtgtcacttggcatcatgttgtcaacattcttatacggctctaacaataag

SEQ ID NO: 51035 - DNA, 75 bp, Artificial Sequence
  Synthetic
atcagatgctgaggatgaactgaatgttgatgttctccttgacgcatgggtgaagtgcgcccacaaacccagaga

SEQ ID NO: 51036 - DNA, 75 bp, Artificial Sequence
  Synthetic
gttgatgttctccttgacgcatgggtgaagtgcgcccacaaacccagagatgcctcctccataataaacgagggg

SEQ ID NO: 51037 - DNA, 75 bp, Artificial Sequence
  Synthetic
aaagaaggtgtacaaggttctcggcaacctaggaaatgaactgttgtataaggcacccagaaaggccttagcaac

SEQ ID NO: 51038 - DNA, 75 bp, Artificial Sequence
  Synthetic
gcacctagagcttacaaagctgaagaaagacaatccttctgtgagctttaccaaggaagaagtcaccgttaaaag

SEQ ID NO: 51039 - DNA, 75 bp, Artificial Sequence
  Synthetic
aaagacaatccttctgtgagctttaccaaggaagaagtcaccgttaaaaggatggaaaagcagttcctggctaaa

SEQ ID NO: 51040 - DNA, 75 bp, Artificial Sequence
  Synthetic
aaccacagggagatagctgatctcaatcaattaacttctcggctcattacattaagaaaagagaaagacactgac

SEQ ID NO: 51041 - DNA, 75 bp, Artificial Sequence
  Synthetic
tgctgctccctggtgtgttcattacaaagctcttgaagcctacctcgtcagacacccagaaatactggagttcag

SEQ ID NO: 51042 - DNA, 75 bp, Artificial Sequence
  Synthetic
aaagctcttgaagcctacctcgtcagacacccagaaatactggagttcagtggaagtgcgcccaccgaaagcaag

SEQ ID NO: 51043 - DNA, 75 bp, Artificial Sequence
  Synthetic
ctccttaaacaatggtttcctgagagtgacctcacccgcagaagcaccaggaatatcgcaaacgcagaggaattt

SEQ ID NO: 51044 - DNA, 75 bp, Artificial Sequence
  Synthetic
tagggatgacacatcagacggagtagaagtgaaggtcaggttccttgtcagatacatcataactctatttactgc

SEQ ID NO: 51045 - DNA, 75 bp, Artificial Sequence
  Synthetic
gaagtgaaggtcaggttccttgtcagatacatcataactctatttactgcaaatggagagccattttccctcagt

SEQ ID NO: 51046 - DNA, 75 bp, Artificial Sequence
  Synthetic
ctcaggaagggcaatgagtgcaggcaagattggtaacgtcctttcctatgcacataacctttacttgagtaagtc

SEQ ID NO: 51047 - DNA, 75 bp, Artificial Sequence
  Synthetic
tagtttaaatatgacctctgaggacatatcacagcttctgatcgagatcaagagattgtatgctcttcaagaaga

SEQ ID NO: 51048 - DNA, 75 bp, Artificial Sequence
  Synthetic
actgctacatcagaccaaagttgtctttgccaaaattgggttgtccgggaaaaactatgacttcatctggacagt

SEQ ID NO: 51049 - DNA, 75 bp, Artificial Sequence
  Synthetic
tttgccaaaattgggttgtccgggaaaaactatgacttcatctggacagtacagatgattgcaaacagcaatttc

SEQ ID NO: 51050 - DNA, 75 bp, Artificial Sequence
  Synthetic
aagcgtcagaagcaaggtgatctacgagatggtcaagctagtgggagagacggggatggcaatacttcagcaact

SEQ ID NO: 51051 - DNA, 75 bp, Artificial Sequence
  Synthetic
gagatggtcaagctagtgggagagacggggatggcaatacttcagcaacttgccttcgcccaggctttaaactac

SEQ ID NO: 51052 - DNA, 75 bp, Artificial Sequence
  Synthetic
tagagatcttttggtacaagaaactggcaccaaggttatacatgccaccacagaaatgtttagtcgcaatctcct

SEQ ID NO: 51053 - DNA, 75 bp, Artificial Sequence
  Synthetic
ggcaccaaggttatacatgccaccacagaaatgtttagtcgcaatctcctcaagacaaccaaagacgacgggcta

SEQ ID NO: 51054 - DNA, 75 bp, Artificial Sequence
  Synthetic
gatacctagtgttgaaaatgtgcaaatctccattgatgtaacactgcctgaatctgtggaggcagtgccggtgac

SEQ ID NO: 51055 - DNA, 75 bp, Artificial Sequence
  Synthetic
tcaaactatgagattggtagacggaaagcctgctgctgagggcagcagcctagtaacgttctacaaggtggtctg

SEQ ID NO: 51056 - DNA, 75 bp, Artificial Sequence
  Synthetic
aagcctgctgctgagggcagcagcctagtaacgttctacaaggtggtctgcatatccggcgacaatacgaaatgg

SEQ ID NO: 51057 - DNA, 75 bp, Artificial Sequence
  Synthetic
agaaagaaaaatgttccctctgcctgaaactccactgagtgaggtgcattcaatagagcgcattatggaaaattt

SEQ ID NO: 51058 - DNA, 75 bp, Artificial Sequence
  Synthetic
taaagatgtgcctgactggtgttcattctacaagttaactttcgtaaagaacttgtgcagacaggtagaaattcc

SEQ ID NO: 51059 - DNA, 75 bp, Artificial Sequence
  Synthetic
ctttcagccaaggaaaaagatggagatcttgcagaacaaggcaaccagcaaagcgccgttgaacacgagagtcca

SEQ ID NO: 51060 - DNA, 75 bp, Artificial Sequence
  Synthetic
aagcgccgttgaacacgagagtccaagcatctcggccttcagggactatggagagagaggaatagttgaggagaa

SEQ ID NO: 51061 - DNA, 75 bp, Artificial Sequence
  Synthetic
ttctacaagttaactttcgtaaagaacttgtgcagacaggtagaaattccaacagcaagcacaaaaaaaatcctc

SEQ ID NO: 51062 - DNA, 75 bp, Artificial Sequence
  Synthetic
tgaagaggaaattaggaacaggctctgtgaaaccctagatctctggggcggaaatgacatagtgaagttccttat

SEQ ID NO: 51063 - DNA, 75 bp, Artificial Sequence
  Synthetic
tgtgaaaccctagatctctggggcggaaatgacatagtgaagttccttattactacttacctgagcaagggcatt

SEQ ID NO: 51064 - DNA, 75 bp, Artificial Sequence
  Synthetic
ctcttcagtgctcacatctgtcatggcagaactgttcgaagaactaactgttgattactataagaagcattatcc

SEQ ID NO: 51065 - DNA, 75 bp, Artificial Sequence
  Synthetic
gcagaactgttcgaagaactaactgttgattactataagaagcattatccaaacctttctgtatcggtgacacat

SEQ ID NO: 51066 - DNA, 75 bp, Artificial Sequence
  Synthetic
tgttggagctataagtactcaaaaggttaggagttacctaaaggcaggaactgcaacaaaaacccctgtgtcaac

SEQ ID NO: 51067 - DNA, 75 bp, Artificial Sequence
  Synthetic
gtcaaaagatctgtttgacaagtactctgaaacattctggatgcatacctgcagacttaaaaatttcacagctgc

SEQ ID NO: 51068 - DNA, 75 bp, Artificial Sequence
  Synthetic
tctgaaacattctggatgcatacctgcagacttaaaaatttcacagctgcagtgcagagatgctgtcagatgaaa

SEQ ID NO: 51069 - DNA, 75 bp, Artificial Sequence
  Synthetic
gttcatgatgggttacagagtcacccctgcagtgattaagtttatttttactgggcttataaacagctcagtgac

SEQ ID NO: 51070 - DNA, 75 bp, Artificial Sequence
  Synthetic
cctgcagtgattaagtttatttttactgggcttataaacagctcagtgacttcgccgcagagtctctctcaggcg

SEQ ID NO: 51071 - DNA, 75 bp, Artificial Sequence
  Synthetic
cgaataactgatgaattcgagcgaacaaaatttaagcatgaactaactcagaatgttaccactagtgaaaaaatg

SEQ ID NO: 51072 - DNA, 75 bp, Artificial Sequence
  Synthetic
aaatgcaaccttcactcttttgaggcaacaggttttcttctcacacgttgaagacttcattaggaggtatggact

SEQ ID NO: 51073 - DNA, 75 bp, Artificial Sequence
  Synthetic
caacaggttttcttctcacacgttgaagacttcattaggaggtatggacttttgacgcttggttcactttcaccg

SEQ ID NO: 51074 - DNA, 75 bp, Artificial Sequence
  Synthetic
cctcaccaacataaagaaagccgttgacgagactgccaacttgtctgagaagattgagctgcttgcatataatct

SEQ ID NO: 51075 - DNA, 75 bp, Artificial Sequence
  Synthetic
gacgagactgccaacttgtctgagaagattgagctgcttgcatataatcttcaactcgttagtcattgcagcaac

SEQ ID NO: 51076 - DNA, 75 bp, Artificial Sequence
  Synthetic
ggctctagaagacagtgaaaccatagcaagatcctcctctacactggtggagaacagcatcttccttgaaaccag

SEQ ID NO: 51077 - DNA, 75 bp, Artificial Sequence
  Synthetic
gcaagatcctcctctacactggtggagaacagcatcttccttgaaaccagcagcttatcaataattgatcaaatc

SEQ ID NO: 51078 - DNA, 75 bp, Artificial Sequence
  Synthetic
aactgttgagtcaacacattctgcaagttcatcttcgagcttcacattcgagctgaacagacctctctcggagac

SEQ ID NO: 51079 - DNA, 75 bp, Artificial Sequence
  Synthetic
agttcatcttcgagcttcacattcgagctgaacagacctctctcggagactgagttacagttccttaaaaccttg

SEQ ID NO: 51080 - DNA, 75 bp, Artificial Sequence
  Synthetic
tataaaactgatgatgagcatgtcaggcattgattgcataaaatatcccacaggacagctcatcacccatggaag

SEQ ID NO: 51081 - DNA, 75 bp, Artificial Sequence
  Synthetic
agaactttattctacttcaaaggagggacctcttgacaagtactacttactctacagcagtaaaatagttgactc

SEQ ID NO: 51082 - DNA, 75 bp, Artificial Sequence
  Synthetic
ggacctcttgacaagtactacttactctacagcagtaaaatagttgactcgtgctcgtggctcaaaaagggtcgt

SEQ ID NO: 51083 - DNA, 75 bp, Artificial Sequence
  Synthetic
ctctcattccttttgtgaaagtgtcccaaatctggacaaatttgtgttccagatggctagtgccaccgatgatgc

SEQ ID NO: 51084 - DNA, 75 bp, Artificial Sequence
  Synthetic
gctgattgccggctattatcgctcttttggcagtgatggcactgagaaacaagtcaaggcttgccttaacaggga

SEQ ID NO: 51085 - DNA, 75 bp, Artificial Sequence
  Synthetic
ccaaatctggacaaatttgtgttccagatggctagtgccaccgatgatgcacaaaaggattccatctatgcagct

SEQ ID NO: 51086 - DNA, 75 bp, Artificial Sequence
  Synthetic
tttggcagtgatggcactgagaaacaagtcaaggcttgccttaacagggacgacaacagagtcatagaagatccc

SEQ ID NO: 51087 - DNA, 75 bp, Artificial Sequence
  Synthetic
cattgaaagctagatctgagtttgttagaaacaacgataaactactcataaggtcaaaagaagaattaaaaaaat

SEQ ID NO: 51088 - DNA, 75 bp, Artificial Sequence
  Synthetic
ggttagctccactggcatcgtcaagaaggggctagaatggtttgaaaaaaatgcaggaaccattaaatcttggga

SEQ ID NO: 51089 - DNA, 75 bp, Artificial Sequence
  Synthetic
ggtctccaggatggaggtggatgagttgatgccggccacatctcctgatgataccctatgtcaattagttgcaaa

SEQ ID NO: 51090 - DNA, 75 bp, Artificial Sequence
  Synthetic
aaggggctagaatggtttgaaaaaaatgcaggaaccattaaatcttgggatgagagttataccgagttgaaggtt

SEQ ID NO: 51091 - DNA, 75 bp, Artificial Sequence
  Synthetic
ttgatgccggccacatctcctgatgataccctatgtcaattagttgcaaaaaagctgatcagcctcaacgtgtcc

SEQ ID NO: 51092 - DNA, 75 bp, Artificial Sequence
  Synthetic
aagaagtggcagctgagtgcatgaagaggtacattggcacaccttatgaaggaattatcgacaccttagtttctc

SEQ ID NO: 51093 - DNA, 75 bp, Artificial Sequence
  Synthetic
gtggaggaaggacataggcttccgtgtcaatgcaaatacggcaaccctgagccataaagtccttgcagagtataa

SEQ ID NO: 51094 - DNA, 75 bp, Artificial Sequence
  Synthetic
taggaacgtgttacacgggctagctgggggtataaaagaactgtcactacccatttatactatcttcatgaagtc

SEQ ID NO: 51095 - DNA, 75 bp, Artificial Sequence
  Synthetic
gaggtacattggcacaccttatgaaggaattatcgacaccttagtttctctgattaatgttctgacaaggttcac

SEQ ID NO: 51096 - DNA, 75 bp, Artificial Sequence
  Synthetic
gtcaatgcaaatacggcaaccctgagccataaagtccttgcagagtataaagtacctggtgagattgtgatgtct

SEQ ID NO: 51097 - DNA, 75 bp, Artificial Sequence
  Synthetic
gggggtataaaagaactgtcactacccatttatactatcttcatgaagtcttacttcttcaaagacaatgtgttc

SEQ ID NO: 51098 - DNA, 75 bp, Artificial Sequence
  Synthetic
gatgttgtacagaatttaataggtcaggggttaaactagtcaaggtaaggcactgtgacattaacctatcagtca

SEQ ID NO: 51099 - DNA, 75 bp, Artificial Sequence
  Synthetic
cagaggtggtgatgagaacccacgtggcccagtgagccgtgaacatgtggagtggtgcagggaatttgttaaagg

SEQ ID NO: 51100 - DNA, 75 bp, Artificial Sequence
  Synthetic
cagcacaggcagattgttgacaggcagagtaatcactaagtactcacactggttggacaactttctaaattgtaa

SEQ ID NO: 51101 - DNA, 75 bp, Artificial Sequence
  Synthetic
ggcccagtgagccgtgaacatgtggagtggtgcagggaatttgttaaaggcaagtacataatggcctttaaccct

SEQ ID NO: 51102 - DNA, 75 bp, Artificial Sequence
  Synthetic
agagtaatcactaagtactcacactggttggacaactttctaaattgtaaagtcagtgtcgatagagtccaagag

SEQ ID NO: 51103 - DNA, 75 bp, Artificial Sequence
  Synthetic
aacaggccttgccaagcttgcagaggctgaggggaagggagtgtttgatgaagctaagaagactgtagaggctct

SEQ ID NO: 51104 - DNA, 75 bp, Artificial Sequence
  Synthetic
gatcggtgagaacaaggttagagagctctccatcgtagtaagccacttgaaagtgtttgcgagagagtttgacaa

SEQ ID NO: 51105 - DNA, 75 bp, Artificial Sequence
  Synthetic
ctctccatcgtagtaagccacttgaaagtgtttgcgagagagtttgacaacctgaatctgcaattctctgatttg

SEQ ID NO: 51106 - DNA, 75 bp, Artificial Sequence
  Synthetic
taacggatatctagacaaacataaggacgaagttgacaaatcaagtgctgacagcatgataacaaaccttctcaa

SEQ ID NO: 51107 - DNA, 75 bp, Artificial Sequence
  Synthetic
agaggcaaacaaagtagtaatagtcaagtccaaactcttcagtgcaactgaacatgttagactttcaaacaaccc

SEQ ID NO: 51108 - DNA, 75 bp, Artificial Sequence
  Synthetic
aagtccaaactcttcagtgcaactgaacatgttagactttcaaacaaccctgcagtggtgatgggttaccttcta

SEQ ID NO: 51109 - DNA, 75 bp, Artificial Sequence
  Synthetic
gaacttcttaaacagaagcagtagagaccactttataagcattgtctcaggcttgaacctggtttatggtttcct

SEQ ID NO: 51110 - DNA, 75 bp, Artificial Sequence
  Synthetic
tttcagctcatattactggctctacaaggcaggtgtgactccagaaaccttcccaactgtctcacagttcctttt

SEQ ID NO: 51111 - DNA, 75 bp, Artificial Sequence
  Synthetic
cctgctcaaggacaggttcaaactgatgcaattcttcccatctgtcttttcactcttgaggacactccaggttga

SEQ ID NO: 51112 - DNA, 75 bp, Artificial Sequence
  Synthetic
atgcaattcttcccatctgtcttttcactcttgaggacactccaggttgaatcacgagaaacagagaagttgggt

SEQ ID NO: 51113 - DNA, 75 bp, Artificial Sequence
  Synthetic
tggcagaatcagtgagatgggtgtctgctttgggacaatccctgtggccaatccagatgatgctgccctagggtc

SEQ ID NO: 51114 - DNA, 75 bp, Artificial Sequence
  Synthetic
gctgtgcaggatgattcaacaagcaaggccgtcattgactgtgttctacatgctcaaaagcactcacctcgcaac

SEQ ID NO: 51115 - DNA, 75 bp, Artificial Sequence
  Synthetic
aggccgtcattgactgtgttctacatgctcaaaagcactcacctcgcaacagagccaactgtgtctgagctggtt

SEQ ID NO: 51116 - DNA, 75 bp, Artificial Sequence
  Synthetic
atccatgtgcaaagacaattgtcaagttgtttgagattcagaaaaaaggatttgtaataaaagatatggacattg

SEQ ID NO: 51117 - DNA, 75 bp, Artificial Sequence
  Synthetic
gcttatctttgacatttacaatgtgcatatatacaataaagaaatggataattttgacgaaggatgtatcagcgt

SEQ ID NO: 51118 - DNA, 75 bp, Artificial Sequence
  Synthetic
ggatgccagcacttactcggtaaagtactggaaaattctacactgcatctcagctataggtgagctccctctaag

SEQ ID NO: 51119 - DNA, 75 bp, Artificial Sequence
  Synthetic
gttgtttgagattcagaaaaaaggatttgtaataaaagatatggacattgtggcctctgagcatctgctacacca

SEQ ID NO: 51120 - DNA, 75 bp, Artificial Sequence
  Synthetic
tactggaaaattctacactgcatctcagctataggtgagctccctctaagccccaaggataaaacaacgctgctt

SEQ ID NO: 51121 - DNA, 75 bp, Artificial Sequence
  Synthetic
gtaacgccaccagtgctaacatcatctgaagctaaaaatgttctgtgttccgcttccttgttcctacactgctat

SEQ ID NO: 51122 - DNA, 75 bp, Artificial Sequence
  Synthetic
cccgctttataagaacgaactcagtgttctcagcgagttctcaggtcaggttataataaacactttagctagcga

SEQ ID NO: 51123 - DNA, 75 bp, Artificial Sequence
  Synthetic
gttctcagcgagttctcaggtcaggttataataaacactttagctagcgagttgagctctgtccgaaaggatgga

SEQ ID NO: 51124 - DNA, 75 bp, Artificial Sequence
  Synthetic
ttattcttactgctcatataattctgtcttgtctactcttctttatcttcttttgttttaaacacttaaagggct

SEQ ID NO: 51125 - DNA, 75 bp, Artificial Sequence
  Synthetic
attgctgaagaagaagccctacttaggaacaacggcaaaattctcttcctggggtgattcgaataagagtgggaa

SEQ ID NO: 51126 - DNA, 75 bp, Artificial Sequence
  Synthetic
ggaacaacggcaaaattctcttcctggggtgattcgaataagagtgggaagttcacatatagcagtaggtcaggt

SEQ ID NO: 51127 - DNA, 75 bp, Artificial Sequence
  Synthetic
agagtcaacagggctactatgcgaggtggagcgctgtgtgctaagctggctgtctagacgtagaaccgacatcat

SEQ ID NO: 51128 - DNA, 75 bp, Artificial Sequence
  Synthetic
gtggagcgctgtgtgctaagctggctgtctagacgtagaaccgacatcattacgaaggaacagcatggtcaattt

SEQ ID NO: 51129 - DNA, 75 bp, Artificial Sequence
  Synthetic
tctcaaagatatcaatcccccctttacccacgttgacacagatagctccagtagtggttctttgtccttatcaaa

SEQ ID NO: 51130 - DNA, 75 bp, Artificial Sequence
  Synthetic
aggtgtgcagggtgtctgtgttgaccctagcaacccaagactacttaggttcactgttgccaaaaggcagagccc

SEQ ID NO: 51131 - DNA, 75 bp, Artificial Sequence
  Synthetic
cctagcaacccaagactacttaggttcactgttgccaaaaggcagagcccagtgataaaggtaaagaagcagatt

SEQ ID NO: 51132 - DNA, 75 bp, Artificial Sequence
  Synthetic
gctcaaagattgttttaaaattatactaggtactgagaataagaagatagttaaaatgcttcgagggaagctaaa

SEQ ID NO: 51133 - DNA, 75 bp, Artificial Sequence
  Synthetic
atagagattgggaaaagggattgcttggatctactcagcacggtagatggtctgacagaccaacagaaagaaaac

SEQ ID NO: 51134 - DNA, 75 bp, Artificial Sequence
  Synthetic
gtctgtcaaagagatgttgtcagatatgattaggagaaggaacctgattctcaacagaggtggtgatgaaaaccc

SEQ ID NO: 51135 - DNA, 75 bp, Artificial Sequence
  Synthetic
acagtggggacatggcagcttagccattgtgtatgatgaatgtgagactcagacaacgtaccatgaaaacataat

SEQ ID NO: 51136 - DNA, 75 bp, Artificial Sequence
  Synthetic
attgtgtatgatgaatgtgagactcagacaacgtaccatgaaaacataattaagatcaaacaactaattgacaac

SEQ ID NO: 51137 - DNA, 75 bp, Artificial Sequence
  Synthetic
gataatattggcaaagattaggtttaagagcgacttgctccttaattctctttgcctgctacatgccttcttgcg

SEQ ID NO: 51138 - DNA, 75 bp, Artificial Sequence
  Synthetic
atcatttggactgttgcagctagtgatgaagtggaagcaggcataaagtttggagatggtgatgtgtttacagcc

SEQ ID NO: 51139 - DNA, 75 bp, Artificial Sequence
  Synthetic
aagagcgacttgctccttaattctctttgcctgctacatgccttcttgcgccacacagctacttacgcagtgatg

SEQ ID NO: 51140 - DNA, 75 bp, Artificial Sequence
  Synthetic
ctctcaacgggtatctggacaagcataaggacgaggttgacaaagcaagtgctgacagcatgataacaaaccttc

SEQ ID NO: 51141 - DNA, 75 bp, Artificial Sequence
  Synthetic
tgtacagtttagaagctgttgcactagcataaaagacaaactaaagactaaggagttagacgggttaatcactca

SEQ ID NO: 51142 - DNA, 75 bp, Artificial Sequence
  Synthetic
agcataaaagacaaactaaagactaaggagttagacgggttaatcactcagacattagatgaagaagttgcagtt

SEQ ID NO: 51143 - DNA, 75 bp, Artificial Sequence
  Synthetic
ctggtcagaggtgcaaacctacatcgaggaggttggcttcaacaacgtcctggtgaacgtagacaaaagtcctgc

SEQ ID NO: 51144 - DNA, 75 bp, Artificial Sequence
  Synthetic
gaggaggttggcttcaacaacgtcctggtgaacgtagacaaaagtcctgccaagagtgagttgctatggaggttc

SEQ ID NO: 51145 - DNA, 75 bp, Artificial Sequence
  Synthetic
gaaaaatttcctaaagcagcacaatctggaaattatggagacagtaaaccttatattctttgctgctctttcagc

SEQ ID NO: 51146 - DNA, 75 bp, Artificial Sequence
  Synthetic
acttgttggctatgtcagcaccgaagctgttccaaagtttctgctccctttcatattcttcgaagggctacttgt

SEQ ID NO: 51147 - DNA, 75 bp, Artificial Sequence
  Synthetic
gctgttccaaagtttctgctccctttcatattcttcgaagggctacttgttagcatcattggcaagtgcaagact

SEQ ID NO: 51148 - DNA, 75 bp, Artificial Sequence
  Synthetic
cctgctctgccttattttattctgctttcagaatgactcctttgccagagaggggcctagatgcagtgcctcagc

SEQ ID NO: 51149 - DNA, 75 bp, Artificial Sequence
  Synthetic
tttcagaatgactcctttgccagagaggggcctagatgcagtgcctcagcccttaaacagctgcagtgttgtaat

SEQ ID NO: 51150 - DNA, 75 bp, Artificial Sequence
  Synthetic
aaacttgggtttttagtaaagtatgctgttaccttattcacatccaatggtgaacctttttcgcttagtctaaat

SEQ ID NO: 51151 - DNA, 75 bp, Artificial Sequence
  Synthetic
caatgtaagcttgaaagtcgtcattgtcttgattgatgcgactgagagcaccctggaaagatcgaagcgagtgaa

SEQ ID NO: 51152 - DNA, 75 bp, Artificial Sequence
  Synthetic
gtcttgattgatgcgactgagagcaccctggaaagatcgaagcgagtgaaggtagccaagaggaacctgagcagt

SEQ ID NO: 51153 - DNA, 75 bp, Artificial Sequence
  Synthetic
acatcagacaaagatagtttttgctaaaattggtctgtctggaaatagttatgatttcatctggactactcaaat

SEQ ID NO: 51154 - DNA, 75 bp, Artificial Sequence
  Synthetic
gagggttgcatccagagtcaaggtgtcgagtgacaaagaaaaagagttcttggactttgttcttccatcacagtc

SEQ ID NO: 51155 - DNA, 75 bp, Artificial Sequence
  Synthetic
ccggagaaaggcttccaagaagtgtcagaagcaaggtcatttatgagatggtaaaactagtaggtgagacaggca

SEQ ID NO: 51156 - DNA, 75 bp, Artificial Sequence
  Synthetic
tcgagtgacaaagaaaaagagttcttggactttgttcttccatcacagtctgcttctgaggttgactatcaaacc

SEQ ID NO: 51157 - DNA, 75 bp, Artificial Sequence
  Synthetic
tgcacaggcactaaattacgaacaccgtttctatgcagtcttagcacctaaggcacagctaggaggagcaagaga

SEQ ID NO: 51158 - DNA, 75 bp, Artificial Sequence
  Synthetic
gattgaagatttgctccttacgctcatgggtaaagcaggcacaccaaagtcagaggatgaagaagacctgataca

SEQ ID NO: 51159 - DNA, 75 bp, Artificial Sequence
  Synthetic
tttgatgacataagaaactctccaacgcacagtacagcctggaagcatgcccttcgattaaagggaactgcatat

SEQ ID NO: 51160 - DNA, 75 bp, Artificial Sequence
  Synthetic
atgggtaaagcaggcacaccaaagtcagaggatgaagaagacctgatacaggatagtacagagggacacctctgc

SEQ ID NO: 51161 - DNA, 75 bp, Artificial Sequence
  Synthetic
tgttcagtagaaacctcttaaaaacaacatcagatgatggccttaccaacccgcatcttaaagaaacaatcctta

SEQ ID NO: 51162 - DNA, 75 bp, Artificial Sequence
  Synthetic
tgaagatgaagaacagatcatgaagcgtggttttaagttcaactgggacagtgactgacggtgtggagtgttgct

SEQ ID NO: 51163 - DNA, 75 bp, Artificial Sequence
  Synthetic
caaaccaagtctgaccatgttgatacagacattgtttcctgacaaatttgaggattttttggaccgaactcaatt

SEQ ID NO: 51164 - DNA, 75 bp, Artificial Sequence
  Synthetic
ataagtgaaggtagcaacttggtcaatttctacaaagtcatatgtatctcaggtgataataccaaatggggccca

SEQ ID NO: 51165 - DNA, 75 bp, Artificial Sequence
  Synthetic
ccattaagtgaggtgcattcaatagagcgcatcatggaaaatttcactcgcctcatgcatgaaggaaagtcttca

SEQ ID NO: 51166 - DNA, 75 bp, Artificial Sequence
  Synthetic
aaagtgaaaactttagcaaatgaggcatctgaatcccccactgtaaaatactttcttatattagaagattaaaat

SEQ ID NO: 51167 - DNA, 75 bp, Artificial Sequence
  Synthetic
tctcaaagaaatacttgcggcacgtcagcacgtaagtgttaactttgagtgagtgacttgagcatcctagatgca

SEQ ID NO: 51168 - DNA, 75 bp, Artificial Sequence
  Synthetic
tggagttactgggaatcaaatgctcattcatagcctgtgctgactgctcgtctacaccgccagacagatggtgga

SEQ ID NO: 51169 - DNA, 75 bp, Artificial Sequence
  Synthetic
aacagtacatgttgaacatgccggcagttcagatgattacgcaaagtgcatagtggtaactggtatactatccaa

SEQ ID NO: 51170 - DNA, 75 bp, Artificial Sequence
  Synthetic
tcataactggtgagggtcatttcaatgaagttttacaatttagaacactaggcacattgagtaccacagagtcaa

SEQ ID NO: 51171 - DNA, 75 bp, Artificial Sequence
  Synthetic
tctccaacaactcaggctcctaccgaaaacagcaaccccatcacatccaaacagctcatactctcagcacaacca

SEQ ID NO: 51172 - DNA, 75 bp, Artificial Sequence
  Synthetic
ttaagaacttcacagctgcagtacaaagatgttgtcaaatgaaagatagcgccaagactttagtgagcgactgtt

SEQ ID NO: 51173 - DNA, 75 bp, Artificial Sequence
  Synthetic
actgatgaatttgagcggactaaatttaaacatgagcttacacagaatgttactactggtgaaaagatgctgtta

SEQ ID NO: 51174 - DNA, 75 bp, Artificial Sequence
  Synthetic
attttctttaaccatgttgaggattttatcagaaggtacggcatattaactcttgggactttgtctccctttggt

SEQ ID NO: 51175 - DNA, 75 bp, Artificial Sequence
  Synthetic
ctgaatgacaggtgtaccctattcaccaactgtgtgataaagggaagagaagttcgtaaaggccagtcagtccta

SEQ ID NO: 51176 - DNA, 75 bp, Artificial Sequence
  Synthetic
agcttatcactcatggaagggtaagtgcaaaacacaatgacggaaacttgaaagataggagtgatgacgaccaaa

SEQ ID NO: 51177 - DNA, 75 bp, Artificial Sequence
  Synthetic
atagcagcagtgtgagcgacaccactgttgcttctcatgattcaggatcatcatcctccagcttttcttttgagc

SEQ ID NO: 51178 - DNA, 75 bp, Artificial Sequence
  Synthetic
agcctcaaatccacacaagcttgtgaagtaattcagaatagaattacaggtctttattgcaacagcaatgagggg

SEQ ID NO: 51179 - DNA, 75 bp, Artificial Sequence
  Synthetic
tatgcgaaaacagtgccacagggaagagctgtgaaatagacagtatcccagtcaagtgtaagcagggttattgcc

SEQ ID NO: 51180 - DNA, 75 bp, Artificial Sequence
  Synthetic
actatggtggtccaggtgacaagataaccatctgcaatggttcaactattgtagatcagagattgggcagtgaac

SEQ ID NO: 51181 - DNA, 75 bp, Artificial Sequence
  Synthetic
agagggaatctggaactagcaaataggattcagtctgtgctgtgtgttttgatagcagggtactacagatcattt

SEQ ID NO: 51182 - DNA, 75 bp, Artificial Sequence
  Synthetic
atgtgcagtcttttaaattgatgaaaaacaagcaacctgtgccttttcaggttgattgtatactgtttaaggaag

SEQ ID NO: 51183 - DNA, 75 bp, Artificial Sequence
  Synthetic
taaaggcatcactgaatagagatgacaacaaaatcatcgaagaccccatgatacaattaattccagagaagctga

SEQ ID NO: 51184 - DNA, 75 bp, Artificial Sequence
  Synthetic
gaagttgtcttggatgtatgtgattcaagctgtgaagtgatgatacctaagggcactggtgacattctagtagat

SEQ ID NO: 51185 - DNA, 75 bp, Artificial Sequence
  Synthetic
tattggcacaccttatgaaggaattatagacactttagtttccttaatcaatgtgttaacaagattcacttggtt

SEQ ID NO: 51186 - DNA, 75 bp, Artificial Sequence
  Synthetic
atagacactttagtttccttaatcaatgtgttaacaagattcacttggtttcaggaagtagtgctgtatggtaag

SEQ ID NO: 51187 - DNA, 75 bp, Artificial Sequence
  Synthetic
atgccgagcatcagccctgatgacaccttagcccagcttgtggcaaaaaagcttattagcctcaatgtttcgacg

SEQ ID NO: 51188 - DNA, 75 bp, Artificial Sequence
  Synthetic
aaatgttttgcatgggttggctggaggaattaaggagctatcgctcccaatatacacgatattcatgaaatctta

SEQ ID NO: 51189 - DNA, 75 bp, Artificial Sequence
  Synthetic
tcactaacagacagatggtctaccaagcacagtacaaactatcgtgatagttgcggcaaacaattaaccggtaga

SEQ ID NO: 51190 - DNA, 75 bp, Artificial Sequence
  Synthetic
aacacctgtaaatgcaatagatgctgaaatgcatgatctcaactgcagttacaatatatgtccctattgtgcgtc

SEQ ID NO: 51191 - DNA, 75 bp, Artificial Sequence
  Synthetic
atttgaagacggtctgagagaactatcagtaatacagagtcatctcaaagtctttgagaatgaatttaccaactt

SEQ ID NO: 51192 - DNA, 75 bp, Artificial Sequence
  Synthetic
agcatctgcaagaaaaggaagactgggagtaatgtcatgttggccgtctgtaagcgcatgtgctttagggcaact

SEQ ID NO: 51193 - DNA, 75 bp, Artificial Sequence
  Synthetic
agctgcacttgagcatctgcaaaaaaaggaaaacaggaagtaatgttatgctggctgtttgcaaacgcatgtgtt

SEQ ID NO: 51194 - DNA, 75 bp, Artificial Sequence
  Synthetic
agtccagacttgcaacaagttgcaaggtactcaaaccatttaaccctgctcagcaggatgatacaacaagcaaag

SEQ ID NO: 51195 - DNA, 75 bp, Artificial Sequence
  Synthetic
ttttgttgtgtgcatactgatattagcagtttgtgttgtcagcacctccgcagtggagatggaaagcctgccagc

SEQ ID NO: 51196 - DNA, 75 bp, Artificial Sequence
  Synthetic
ctgacaaatttctgtcatcaagaatgccaagtcactgagactgaatgcctctgtccttacgaagctcttgtgctc

SEQ ID NO: 51197 - DNA, 75 bp, Artificial Sequence
  Synthetic
tctagatagtatagtcaaaggtatgaaaaatctgctaaactcaacaagtctagaaacaagcttatcaattgaggc

SEQ ID NO: 51198 - DNA, 75 bp, Artificial Sequence
  Synthetic
agtgttagcttcaccaaggaggaggtcttaataaagcggctggagaaaaatttccttaagcaacacaatctagaa

SEQ ID NO: 51199 - DNA, 75 bp, Artificial Sequence
  Synthetic
gttgagcttactagccaagagagacaatgtagcttgattgaggcaggcacaagattcaacttaggtcctgtgacc

SEQ ID NO: 51200 - DNA, 75 bp, Artificial Sequence
  Synthetic
tccattggaatcttcattgcaggaaaattgcacatccatctctcatctgagtccattgccttattgtgtgaaact

SEQ ID NO: 51201 - DNA, 75 bp, Artificial Sequence
  Synthetic
gtccattgccttattgtgtgaaactgaaagacaagtgctatcttggatgagcaaaaggagaactgaggtgatgac

SEQ ID NO: 51202 - DNA, 75 bp, Artificial Sequence
  Synthetic
agtgcaagaaactggcaccaaagtcatgcatgcaactactgaaatgttcagtagaaacctcttaaagacaacatc

SEQ ID NO: 51203 - DNA, 75 bp, Artificial Sequence
  Synthetic
aaaccttgacggaaagcccataagtgaaggtagcaacttggtcaacttctacaaagtcatttgcatttcaggtga

SEQ ID NO: 51204 - DNA, 75 bp, Artificial Sequence
  Synthetic
acagtgaagaaacaggtcgtgtttgatgctgagagcgagcctagactgcagtggggacatggttgcttgtccatt

SEQ ID NO: 51205 - DNA, 75 bp, Artificial Sequence
  Synthetic
gttctgtgactattacattgtcagaaccaaggaacattcaacaaaagctccctcctgaaataatcacactgcacc

SEQ ID NO: 51206 - DNA, 75 bp, Artificial Sequence
  Synthetic
agaacccgctaccactcagctgttggtctgaagttcaaaactacattgaagacataggcttcaacaatgtgcttg

SEQ ID NO: 51207 - DNA, 75 bp, Artificial Sequence
  Synthetic
aaaagggttactgcacatggagacacaccacagctagatctgaaggcaaggccaacctatggtgcaggtgagatc

SEQ ID NO: 51208 - DNA, 75 bp, Artificial Sequence
  Synthetic
ttaacattgacagaaacacagtgaaaagtgaacttttgtggaaatttacgttagacactaatgtaagcactacaa

SEQ ID NO: 51209 - DNA, 75 bp, Artificial Sequence
  Synthetic
aactagaggcctatttaagtacagacacctcaaggacgatgaagaaaccggttacaggaaaatcattgagaggct

SEQ ID NO: 51210 - DNA, 75 bp, Artificial Sequence
  Synthetic
cacaaagacacacattggctaaatcagcggaaagggcctcaaggagcgatgacagtgcactcaccaataccactg

SEQ ID NO: 51211 - DNA, 75 bp, Artificial Sequence
  Synthetic
cacgaaactcgaacaaccacagagcattttgatcgaacataagggaactataattggaaagcaaaacaatacttg

SEQ ID NO: 51212 - DNA, 75 bp, Artificial Sequence
  Synthetic
ttcgtgcaaacaatgagctaggcgatgtgtcactgaaggttaatattgtcttggtacccctcaaggacatgtcca

SEQ ID NO: 51213 - DNA, 75 bp, Artificial Sequence
  Synthetic
gttacttttaatccgtttcattatatccgcaagcaagctctgcaatacccaataccgccatcactctatttactc

SEQ ID NO: 51214 - DNA, 75 bp, Artificial Sequence
  Synthetic
tccgcaagcaagctctgcaatacccaataccgccatcactctatttactctgacctaaaccttgactgcgtgccg

SEQ ID NO: 51215 - DNA, 75 bp, Artificial Sequence
  Synthetic
ctatccttaatgtttctggacgagatgtcattgcctgagctgaagtctttgtcagtgaactgcaaaatggggaac

SEQ ID NO: 51216 - DNA, 75 bp, Artificial Sequence
  Synthetic
aaggcagtcaaacctagtactgtgacacaaattgaacacaaggatgagcagtgtcaagagcaaataagcttggat

SEQ ID NO: 51217 - DNA, 75 bp, Artificial Sequence
  Synthetic
gtggcagcacggaagtattaccaagaagaacctgaagctaagcttattggcctgagtctggaagactatcttaag

SEQ ID NO: 51218 - DNA, 75 bp, Artificial Sequence
  Synthetic
acagacagatggtccaccaagcatagcacgaactaccgtgacagttgcggcaaacaattaactggtaggataatc

SEQ ID NO: 51219 - DNA, 75 bp, Artificial Sequence
  Synthetic
gcacgaactaccgtgacagttgcggcaaacaattaactggtaggataatcactaagtacactcactggttggaca

SEQ ID NO: 51220 - DNA, 75 bp, Artificial Sequence
  Synthetic
atcatttggactgttgcagccagtgacgaagtggaagcaggcataaagttcggagatggtgatgtttttacagcc

SEQ ID NO: 51221 - DNA, 75 bp, Artificial Sequence
  Synthetic
tcagctgcctccgttaatctattttgccatcctgccattcttctttctctaacattcataccagtttcattattt

SEQ ID NO: 51222 - DNA, 75 bp, Artificial Sequence
  Synthetic
gccacagtttgaggttgacacaagaggaaccttaagtctggtagacaaggtcatagctgtggatcagttgacctc

SEQ ID NO: 51223 - DNA, 75 bp, Artificial Sequence
  Synthetic
ggaaccttaagtctggtagacaaggtcatagctgtggatcagttgacctcatcctctagtgatgaactgcaggac

SEQ ID NO: 51224 - DNA, 75 bp, Artificial Sequence
  Synthetic
gtctagtctggatgaggtcaccctgtccaagaaacaagcagagatactgaggcagaaggcctctcagttgtctaa

SEQ ID NO: 51225 - DNA, 75 bp, Artificial Sequence
  Synthetic
tccaagaaacaagcagagatactgaggcagaaggcctctcagttgtctaaactggtcaataaaagtcagaacata

SEQ ID NO: 51226 - DNA, 75 bp, Artificial Sequence
  Synthetic
acacaatggaacaaacaccaccacagcacccggcacaagtcaaagccctaagccacccgtgagcaccactctacc

SEQ ID NO: 51227 - DNA, 75 bp, Artificial Sequence
  Synthetic
tgcaagttcaacacttggggagactcaaacaggtctggtaagtttacatacagtagtaggtctggagagtcaatt

SEQ ID NO: 51228 - DNA, 75 bp, Artificial Sequence
  Synthetic
gctctggtggaggcaacaaaattttgtgcacctatatatgagtgtgcatgggttagctccactggcattgtgaag

SEQ ID NO: 51229 - DNA, 75 bp, Artificial Sequence
  Synthetic
cagaaggctcaggggaaacgaccccacccccaaacaccacccagggcctgcccctaccagggaccacaccagaac

SEQ ID NO: 51230 - DNA, 75 bp, Artificial Sequence
  Synthetic
acccccaaacaccacccagggcctgcccctaccagggaccacaccagaacgctccgcaacaaccgccacaagcac

SEQ ID NO: 51231 - DNA, 75 bp, Artificial Sequence
  Synthetic
ccacatcaacagtcagcataggtctatccagcagccccagcatgccatccacatcacaaggcatacattatcccg

SEQ ID NO: 51232 - DNA, 75 bp, Artificial Sequence
  Synthetic
ctaattaccaacaggctgccttgaaatggaggaaagacataggtttccgtgtcaatgcaaacacagcggctctga

SEQ ID NO: 51233 - DNA, 75 bp, Artificial Sequence
  Synthetic
atccagcagccccagcatgccatccacatcacaaggcatacattatcccgtaaggagtctattgtcagtctcgag

SEQ ID NO: 51234 - DNA, 75 bp, Artificial Sequence
  Synthetic
gtcaaagagatgctgtcagacatgattaggagaaggaaccagattctaaacaggggtggtgatgagaatccacgt

SEQ ID NO: 51235 - DNA, 75 bp, Artificial Sequence
  Synthetic
cggaaaccagcagtcagcactcagccatgagcagaataccaaccctctacacagcaacccaggtctccactgaga

SEQ ID NO: 51236 - DNA, 75 bp, Artificial Sequence
  Synthetic
catgagcagaataccaaccctctacacagcaacccaggtctccactgagaacaccaaccgcagcatacctagaca

SEQ ID NO: 51237 - DNA, 75 bp, Artificial Sequence
  Synthetic
ccatggggggacatcaacaagtcaggccgttcaggaatagcacttgttgcaacaggccttgccaagcttgcagag

SEQ ID NO: 51238 - DNA, 75 bp, Artificial Sequence
  Synthetic
ggaaatgaactgttgtataaggcacccagaaaggccttggcaaccgtctgtggtgccctatttgggaaacaaata

SEQ ID NO: 51239 - DNA, 75 bp, Artificial Sequence
  Synthetic
cgcaaacaatccttctgatgagtgctgctcctacagctattcaggacatgcatcccagcccaaaaaacaggtcca

SEQ ID NO: 51240 - DNA, 75 bp, Artificial Sequence
  Synthetic
acctcaaatcaggaggtgttaggcagcggaatactgaggtgctctttagggaaaagttgaacaaggtagttataa

SEQ ID NO: 51241 - DNA, 75 bp, Artificial Sequence
  Synthetic
actaagaaatctggactttgactgtcttagtgtgcaagactacaatggtatgatagaaaatatgtccaaattgga

SEQ ID NO: 51242 - DNA, 75 bp, Artificial Sequence
  Synthetic
tttaactctgtctcaaggtctaaagaaatattacggcaaaatactgaagcttctgcaccttaccttggaagagga

SEQ ID NO: 51243 - DNA, 75 bp, Artificial Sequence
  Synthetic
tgacttctcggcttattacgttgagaaaagaaaaggacactgaccttctcaagcaatggtttcctgagggtaacc

SEQ ID NO: 51244 - DNA, 75 bp, Artificial Sequence
  Synthetic
agaagaattcttcataactggtgagggctacttcaatgaagtcctacaatttaaaacaccaagcacactaagccc

SEQ ID NO: 51245 - DNA, 75 bp, Artificial Sequence
  Synthetic
ggtaatgtcctttcctatgcacataacctttatttgagcaagtccagcctaaacatgacctctgaagacatttca

SEQ ID NO: 51246 - DNA, 75 bp, Artificial Sequence
  Synthetic
atctggaactggagagcttgctcactttgtgtgctttctatttccaaaatgagtgtagtaagagagatggaccta

SEQ ID NO: 51247 - DNA, 75 bp, Artificial Sequence
  Synthetic
agattctggttacttctctgccaaatgttatccaagatcatccacttcagggcttcagctgatcaatgtcaccca

SEQ ID NO: 51248 - DNA, 75 bp, Artificial Sequence
  Synthetic
gtctcttgttggcaagcaatctccattccagaacgcctacaatgtcaagggcaatgccactagtgctaacatcat

SEQ ID NO: 51249 - DNA, 75 bp, Artificial Sequence
  Synthetic
tcaccatgaaggtgctttcataccaggaacttataaaatagtgatagacaaaaaaaataagctaaatgaccgatg

SEQ ID NO: 51250 - DNA, 75 bp, Artificial Sequence
  Synthetic
taaaccaagtttaaccatgttgatacagacattgttccctgacaaatttgaggatttcttagaccgaactcagtt

SEQ ID NO: 51251 - DNA, 75 bp, Artificial Sequence
  Synthetic
ccttaactgcaatgctcaatcatgcttattttacttgcttatataactttattttattaacctttctctatcttc

SEQ ID NO: 51252 - DNA, 75 bp, Artificial Sequence
  Synthetic
aggatttcttagaccgaactcagttacatccagagttcagagatttgactcctgatttttcgcttacacaaaagg

SEQ ID NO: 51253 - DNA, 75 bp, Artificial Sequence
  Synthetic
tctcaaagaaatacttgcggcacgtcagtacgtaagtgttaactttgagtgtgcattaagggcaacttgtaggca

SEQ ID NO: 51254 - DNA, 75 bp, Artificial Sequence
  Synthetic
gtgcattaagggcaacttgtaggcaacacgatgttctgccttaggctcgtgctgctaatcaatcttgccctttgt

SEQ ID NO: 51255 - DNA, 75 bp, Artificial Sequence
  Synthetic
tatcttaagggtaagtaagacaatttataccatgccatttgctgacatctgggctttcgggcaattcagttgttc

SEQ ID NO: 51256 - DNA, 75 bp, Artificial Sequence
  Synthetic
gctgctaatcaatcttgccctttgtcagctccttgagggcaatgatggagttaccagtgcagatgaaatcaattc

SEQ ID NO: 51257 - DNA, 75 bp, Artificial Sequence
  Synthetic
acagcagagatccatgacgacaactatggtggtccaggtgacaaaataactatctgcaatggttcaaccattgtg

SEQ ID NO: 51258 - DNA, 75 bp, Artificial Sequence
  Synthetic
agcgcatcatggaaaatttcactcgcctcatgcatgagggaaagccttcaaccaagaaaaaggatgaagatccaa

SEQ ID NO: 51259 - DNA, 75 bp, Artificial Sequence
  Synthetic
cttccaaccattctgaatagtacaactcctgcaccaggaccatcaatagatgctaccatggaggcagtaccaggc

SEQ ID NO: 51260 - DNA, 75 bp, Artificial Sequence
  Synthetic
ctcctgcaccaggaccatcaatagatgctaccatggaggcagtaccaggcacgaccaacagtgtgctggaaacac

SEQ ID NO: 51261 - DNA, 75 bp, Artificial Sequence
  Synthetic
tctcaaagaaatacttgcggcacgtcagtacgtaagtgttaactttgagtgagtgacttgagcatcttagatgca

SEQ ID NO: 51262 - DNA, 75 bp, Artificial Sequence
  Synthetic
actagggaagcaacaacccccatcactgctgccactgtcagtgcgcaggaaacaaaaacacacatgactcagaac

SEQ ID NO: 51263 - DNA, 75 bp, Artificial Sequence
  Synthetic
ctgctgccactgtcagtgcgcaggaaacaaaaacacacatgactcagaacccaggaaccacagtagatccagaca

SEQ ID NO: 51264 - DNA, 75 bp, Artificial Sequence
  Synthetic
ctcatggactgtccaacaaaacccaacacagtaatacaagcaccacaaaggcgcctgaagtaagccaggaacttg

SEQ ID NO: 51265 - DNA, 75 bp, Artificial Sequence
  Synthetic
tggaaaaataaggacagaccataaaaaatggaaagatatattgaagctattagaattactgggaatcaaatgctc

SEQ ID NO: 51266 - DNA, 75 bp, Artificial Sequence
  Synthetic
gcagcatttcttaaaagacaacttgattgacctagggtgccctcatatcccgctattgggtaagatggccattta

SEQ ID NO: 51267 - DNA, 75 bp, Artificial Sequence
  Synthetic
acacagtaatacaagcaccacaaaggcgcctgaagtaagccaggaacttggattgcctgtgagcacagtatcgac

SEQ ID NO: 51268 - DNA, 75 bp, Artificial Sequence
  Synthetic
acatcaccgaccccacaagcaactccaacacccagctacagcgagacacctacactgccgaacacacatcatctc

SEQ ID NO: 51269 - DNA, 75 bp, Artificial Sequence
  Synthetic
caacacccagctacagcgagacacctacactgccgaacacacatcatctctccagaagtcttctttcagctgtgg

SEQ ID NO: 51270 - DNA, 75 bp, Artificial Sequence
  Synthetic
cagaaggctcaggagacacgaacacctctccctcggtcaccacacaaggcccgactttgccagaaaccacgctgg

SEQ ID NO: 51271 - DNA, 75 bp, Artificial Sequence
  Synthetic
attgacctagggtgccctcatatcccgctattgggtaagatggccatttacatttgcagaatgtcaaatcatccc

SEQ ID NO: 51272 - DNA, 75 bp, Artificial Sequence
  Synthetic
aacccctaacaacaaccgacacagatgcatcaagcactgtcgtcgtcgatgtcagcacacagacggtcaaggaca

SEQ ID NO: 51273 - DNA, 75 bp, Artificial Sequence
  Synthetic
ttggccccaggcggctcatctacagctgagagcaacacaatatccataccagctcaagacaccaccatcagtggt

SEQ ID NO: 51274 - DNA, 75 bp, Artificial Sequence
  Synthetic
ctgagagcaacacaatatccataccagctcaagacaccaccatcagtggtgtttcgaaacaggacaacccaacaa

SEQ ID NO: 51275 - DNA, 75 bp, Artificial Sequence
  Synthetic
caatagatgctgaaatgcatgacctcaaatgtagttacaatatatgcccttattgtgcatcaagattgacctctg

SEQ ID NO: 51276 - DNA, 75 bp, Artificial Sequence
  Synthetic
actacaccacagggtacacatcatactgcaaggggtctactgtcagtcaccagcacaaagccagaagaagcatca

SEQ ID NO: 51277 - DNA, 75 bp, Artificial Sequence
  Synthetic
ctgcaaggggtctactgtcagtcaccagcacaaagccagaagaagcatcaacacaagcaaatccaggaaaaataa

SEQ ID NO: 51278 - DNA, 75 bp, Artificial Sequence
  Synthetic
gcaccagtgaccacacctgccaccgccatctctgcacccacaagcccaacgaacagatccaaaagggagtctaaa

SEQ ID NO: 51279 - DNA, 75 bp, Artificial Sequence
  Synthetic
caggtctgacactgcctgccagtctggagcaggcaatgcgcaaagggttagttgagggtgtggtcatctccaagg

SEQ ID NO: 51280 - DNA, 75 bp, Artificial Sequence
  Synthetic
gtgcaaataattctgacctttcctcaaggtctgaagaaatactacagcaaaatactgaaattcctacacttaact

SEQ ID NO: 51281 - DNA, 75 bp, Artificial Sequence
  Synthetic
gtaaccccaaacccaatgacctctccagtacagccagctctctctcagagtgacacgtccacggccatccaagat

SEQ ID NO: 51282 - DNA, 75 bp, Artificial Sequence
  Synthetic
acaggtatgtgatgatacctacttcaatgagaggataaaagaattttttataactgggaaaggttacttcaatga

SEQ ID NO: 51283 - DNA, 75 bp, Artificial Sequence
  Synthetic
agacaattgaaacatatcagaccagagaaggattcacaagtatctgtctctttatgttaggaagcatcctattca

SEQ ID NO: 51284 - DNA, 75 bp, Artificial Sequence
  Synthetic
tgtacttcagtttaagttgcacgacactcccgctaccaccgttccagccctggccgcctcatctacagccatgcc

SEQ ID NO: 51285 - DNA, 75 bp, Artificial Sequence
  Synthetic
aattttgactttatctcaaggtttgaagaagtactacggcaagatactaaaacttctggaccttactttggaaga

SEQ ID NO: 51286 - DNA, 75 bp, Artificial Sequence
  Synthetic
aacttctggaccttactttggaagaagacactgaaggcctgctagagtggtgtaagagaaatcttggtttggtct

SEQ ID NO: 51287 - DNA, 75 bp, Artificial Sequence
  Synthetic
agacactgaaggcctgctagagtggtgtaagagaaatcttggtttggtctgtgatgacaacttctttcagaagag

SEQ ID NO: 51288 - DNA, 75 bp, Artificial Sequence
  Synthetic
tctctgctaaatgttatccaagagcatcaaactcaggaatgcagctaatcaatgtcacacaacacccaatgaaga

SEQ ID NO: 51289 - DNA, 75 bp, Artificial Sequence
  Synthetic
gatagaagagttttttttgactgggaagggtcacttcaatgaagtcttacagttcaaaacaccaagcacactaag

SEQ ID NO: 51290 - DNA, 75 bp, Artificial Sequence
  Synthetic
ataaacttgaaggtatcaactgacaaggaacatagtgagcttgagatcaatgtgcttatacctcaggttgctgtc

SEQ ID NO: 51291 - DNA, 75 bp, Artificial Sequence
  Synthetic
agcttattactcatggaagagtaagtgcaaaacataatgatgggaacttggaagacaggagtgatgacgaccaaa

SEQ ID NO: 51292 - DNA, 75 bp, Artificial Sequence
  Synthetic
cttacttcgctaaagggttcctttcaatggactcaggctacttctctgccaagtgttatccaagagcatccaatt

SEQ ID NO: 51293 - DNA, 75 bp, Artificial Sequence
  Synthetic
atctgtgttgttagcacctctgcagtagagatggaaaaccttccagcaggcacttgggagagagaggaagacctg

SEQ ID NO: 51294 - DNA, 75 bp, Artificial Sequence
  Synthetic
cctggacactgatggagcaatacgtctcccgaaagtcgcacacaacggggtttttatgccaggaacttacaaaat

SEQ ID NO: 51295 - DNA, 75 bp, Artificial Sequence
  Synthetic
acacctggacccaagatcactaatctgaagaccatcaattgcataaacttaaaggcatcagtctttaaagagcat

SEQ ID NO: 51296 - DNA, 75 bp, Artificial Sequence
  Synthetic
tgaagaccatcaattgcataaacttaaaggcatcagtctttaaagagcatagagagattgaaatcaatgttcttc

SEQ ID NO: 51297 - DNA, 75 bp, Artificial Sequence
  Synthetic
actgtgtcatcaaaggaagagaagttcgaaaggggcagtcaactttgagacagtataaaacagaaataagaattg

SEQ ID NO: 51298 - DNA, 75 bp, Artificial Sequence
  Synthetic
ttaataaacatcagaaattcactgaaggctagatctgagtttgttaggaacaacgacaaactgctcataagatct

SEQ ID NO: 51299 - DNA, 75 bp, Artificial Sequence
  Synthetic
catgtctgtgactactctttggacattgacgggccagtaagactaccccgcatccaccatgaaggaactttcata

SEQ ID NO: 51300 - DNA, 75 bp, Artificial Sequence
  Synthetic
attgcttgcagaaggagtgagcaatgactgtgtttcaaggacccagctaatcaaaacagaagttgcagagattca

SEQ ID NO: 51301 - DNA, 75 bp, Artificial Sequence
  Synthetic
aaagaagagcttaaaaaatgtttcgatgtgcaatcttttaaattgataaaaaacaagcaacctgtgccttttcag

SEQ ID NO: 51302 - DNA, 75 bp, Artificial Sequence
  Synthetic
tcaaaacagaagttgcagagattcatgaagatagttatggtgggcctggagaaaaaataacaatctgcaacggct

SEQ ID NO: 51303 - DNA, 75 bp, Artificial Sequence
  Synthetic
acaaaaaaaacaaacaaaatgatagatgcactttggtcaccaactgtgtaataaaaggaagggaaattcgtaagg

SEQ ID NO: 51304 - DNA, 75 bp, Artificial Sequence
  Synthetic
gaaaaaataacaatctgcaacggctccacaatcgtggaccaaagactcggtagcgaactaggctgctacacaatc

SEQ ID NO: 51305 - DNA, 75 bp, Artificial Sequence
  Synthetic
gacagaaatcaagattggcaaggcatcttctggttccagaagactattgtccgaagagtctggtgatgactgcat

SEQ ID NO: 51306 - DNA, 75 bp, Artificial Sequence
  Synthetic
atagacactttggtttccttaatcaatgtgttaacaaggttcacttggtttcaagaggtggtgctttatggtaag

SEQ ID NO: 51307 - DNA, 75 bp, Artificial Sequence
  Synthetic
ttgtgagatcgatagtgtcccagtcaaatgcaaacaagggttctgcctcaaagtaacccaagagggcaggggcca

SEQ ID NO: 51308 - DNA, 75 bp, Artificial Sequence
  Synthetic
aaatgcaaacaagggttctgcctcaaagtaacccaagagggcaggggccatgtaaaactgtccagaggaacggaa

SEQ ID NO: 51309 - DNA, 75 bp, Artificial Sequence
  Synthetic
taagttagtcaaggtgagacactgtgacattaacctatcagtaaagctgccatcaaacaaaaaagagaatatgtt

SEQ ID NO: 51310 - DNA, 75 bp, Artificial Sequence
  Synthetic
cactggggacatattggtggactgctcaggaggacagcagcactttttgcaggataacttgattgacttaggttg

SEQ ID NO: 51311 - DNA, 75 bp, Artificial Sequence
  Synthetic
tcaggaggacagcagcactttttgcaggataacttgattgacttaggttgtccaaatgtaccattattaggcaag

SEQ ID NO: 51312 - DNA, 75 bp, Artificial Sequence
  Synthetic
agtgccacaggcaaatcctgtgaaatagatagcaccccagtcaaatgcaggcagggtttctgtttgaaaattact

SEQ ID NO: 51313 - DNA, 75 bp, Artificial Sequence
  Synthetic
tgaacaggaggcaagctgtccttggctcatcatatctttatattgtcattacactttacatacaagtattgcagc

SEQ ID NO: 51314 - DNA, 75 bp, Artificial Sequence
  Synthetic
ttttttgttctggtttagctttggctatgtcatcacatgcatagtatgtaaagtgcttttctatctgctaattgt

SEQ ID NO: 51315 - DNA, 75 bp, Artificial Sequence
  Synthetic
ggacgcctgcgattcaagctgtgaaataatgataccaaagggcactggagacatcctagttgactgttcaggtgg

SEQ ID NO: 51316 - DNA, 75 bp, Artificial Sequence
  Synthetic
tatgtcatcacatgcatagtatgtaaagtgcttttctatctgctaattgtcatcgggacactaagtaagaaactt

SEQ ID NO: 51317 - DNA, 75 bp, Artificial Sequence
  Synthetic
ataatgataccaaagggcactggagacatcctagttgactgttcaggtggacagcaacatttcttaaaagataac

SEQ ID NO: 51318 - DNA, 75 bp, Artificial Sequence
  Synthetic
ccctgttaatgcaatagatgctgaaatgcacgagctcaattgtaattacaacatatgcccatactgcgcgtccag

SEQ ID NO: 51319 - DNA, 75 bp, Artificial Sequence
  Synthetic
actaacttcagatggactagtcagacatgtgaatcaatgtcccaaaaggaaagaaaaggtcgaggagactgaact

SEQ ID NO: 51320 - DNA, 75 bp, Artificial Sequence
  Synthetic
ttggggaaaaagttttcaacaagttgtagaagaattgaagacaacattgcaagactttacctacaaacatctata

SEQ ID NO: 51321 - DNA, 75 bp, Artificial Sequence
  Synthetic
tgtcagagtcaacggggatggctctaaagagaagttgctggatgaccacactcctcattctgctagtagtttcat

SEQ ID NO: 51322 - DNA, 75 bp, Artificial Sequence
  Synthetic
tatcgccagttcaatctgctccagttggtcaggggaaagcagtcgaagtctaccgggtgagagaaagctacacaa

SEQ ID NO: 51323 - DNA, 75 bp, Artificial Sequence
  Synthetic
gcagtgccctaagcggaaggaaaaaatagaagaaaccgaattatacttaaacttggaaagaatcccctgggttgt

SEQ ID NO: 51324 - DNA, 75 bp, Artificial Sequence
  Synthetic
ataaagggtttgattgacggtatcggcaacagttttttccctgggctttctgtctgcaaaacatgctctattggc

SEQ ID NO: 51325 - DNA, 75 bp, Artificial Sequence
  Synthetic
caaggaagcttgaatttgggacagatagcatattcaaggcattttcagctatgcccaaaacctctttatgctttt

SEQ ID NO: 51326 - DNA, 75 bp, Artificial Sequence
  Synthetic
gtagttggctggttgtgctacttgtgttacttacagtttcattgtcaccagtacaatcagcacctatcggccatg

SEQ ID NO: 51327 - DNA, 75 bp, Artificial Sequence
  Synthetic
tagaaccgcaagactgctattgggctgcccaaatgtgagaaaagctgcaaataaagaggggaaaaagctattaaa

SEQ ID NO: 51328 - DNA, 75 bp, Artificial Sequence
  Synthetic
ttgttgtccttattgcagagcttgctcatctgacaaaatcactcaccgaatgcatttgaacgtctgcaagaaaag

SEQ ID NO: 51329 - DNA, 75 bp, Artificial Sequence
  Synthetic
aaatgtgttgacacaaaacttgagcagccacagagcatactaattgagcacaaagggacgataattggaaagcag

SEQ ID NO: 51330 - DNA, 75 bp, Artificial Sequence
  Synthetic
ctctttgtactaggaagcatcttatttatagtctcttgcctaatgaaggggttggttgacagtgttggtaacagt

SEQ ID NO: 51331 - DNA, 75 bp, Artificial Sequence
  Synthetic
aggcaactgttgaagcaagcaacacagccttgctcatcaggggtatcataaattccacttttgtgatatgcgtac

SEQ ID NO: 51332 - DNA, 75 bp, Artificial Sequence
  Synthetic
ttttttttatggattgaagaatatgcttggcagtgtttttggtaattttttcgtaggcattttgttattccttgc

SEQ ID NO: 51333 - DNA, 75 bp, Artificial Sequence
  Synthetic
agccttgctcatcaggggtatcataaattccacttttgtgatatgcgtactgatcctggttatctgtgtggtaag

SEQ ID NO: 51334 - DNA, 75 bp, Artificial Sequence
  Synthetic
cttcaaatcatacggaaaaatcccagccacacaatgggctcttttgagttgatccaggcagtctcagagtttggc

SEQ ID NO: 51335 - DNA, 75 bp, Artificial Sequence
  Synthetic
aagaagaccttacaaacttttgccaccaagaatgtcaagtaacagaaactgagtgtctttgcccgtatgaagcct

SEQ ID NO: 51336 - DNA, 75 bp, Artificial Sequence
  Synthetic
gaactgggtcagcatctctgaagtaacggagacaacaagtatagtcgcaacacctaaaactcacatgatgcttaa

SEQ ID NO: 51337 - DNA, 75 bp, Artificial Sequence
  Synthetic
agtctgctaaattctacgaatttagagacaagcctgtcgattgaggccccgtggggagcaatcaatgttcagtca

SEQ ID NO: 51338 - DNA, 75 bp, Artificial Sequence
  Synthetic
aaaaacacacattggctaactcaacagaaagaacctcgaaggttgacagcagcatgccgtccagtgtccttgctt

SEQ ID NO: 51339 - DNA, 75 bp, Artificial Sequence
  Synthetic
agttgaacacaggggcaacaaaatcctagtttcgggcaggtcagagtcaattatgaagctggaagaaaggaccgg

SEQ ID NO: 51340 - DNA, 75 bp, Artificial Sequence
  Synthetic
gcatctaacccgcttcattatatccacaaataagctctgtgatgcccgaaactgtctctgctctgcttgctctga

SEQ ID NO: 51341 - DNA, 75 bp, Artificial Sequence
  Synthetic
tactcagcacggttgatggtctaacagatcaacaaaaggaaaacatcgtaaatggaatattcgagccctcaaagt

SEQ ID NO: 51342 - DNA, 75 bp, Artificial Sequence
  Synthetic
acaaataagctctgtgatgcccgaaactgtctctgctctgcttgctctgaccttaactttgactgcgtgccgcca

SEQ ID NO: 51343 - DNA, 75 bp, Artificial Sequence
  Synthetic
aaattcaacaagcttagaaacaagcttatcaattgaggcaccatggggagcaataaatgtccaatcaaccttcaa

SEQ ID NO: 51344 - DNA, 75 bp, Artificial Sequence
  Synthetic
atgtctttcagcattatgtacacaccacttttgtgtgctgttctttgcttacagctgtggagtttagaagggtct

SEQ ID NO: 51345 - DNA, 75 bp, Artificial Sequence
  Synthetic
aatgtattctcccgtctttgagtatctgtcaggtgatagacaggtagaagagtggccaaaagccacctgcacagg

SEQ ID NO: 51346 - DNA, 75 bp, Artificial Sequence
  Synthetic
acaggggtaataagattttggtttcaggtagatcagagtcaatcatgaagctagaggaaaggacaggaatcagct

SEQ ID NO: 51347 - DNA, 75 bp, Artificial Sequence
  Synthetic
aatggccacactcgagaaactggcgatgcaaccccacttggtgttggggagtggggactggctgcacctgctgtg

SEQ ID NO: 51348 - DNA, 75 bp, Artificial Sequence
  Synthetic
ctgcctcttttctagtgaggagtttaatgaactgattaagttgaaaaaacttctcctcaacgaacaacaagatga

SEQ ID NO: 51349 - DNA, 75 bp, Artificial Sequence
  Synthetic
aatgaactgattaagttgaaaaaacttctcctcaacgaacaacaagatgaacaggagttgaggcaagacctttta

SEQ ID NO: 51350 - DNA, 75 bp, Artificial Sequence
  Synthetic
ggactacatgatggttaagtggaaagtggaatatgtaaaaacagaagctataatgtgtgttgagctaaccagtca

SEQ ID NO: 51351 - DNA, 75 bp, Artificial Sequence
  Synthetic
taatgtgtgttgagctaaccagtcaggagaggcaatgtagtttgattgaagcaggtacaagatttaacctaggcc

SEQ ID NO: 51352 - DNA, 75 bp, Artificial Sequence
  Synthetic
ggagaggcaatgtagtttgattgaagcaggtacaagatttaacctaggccctgtgacaataaccctgtcagagcc

SEQ ID NO: 51353 - DNA, 75 bp, Artificial Sequence
  Synthetic
ccacctggtgttggggagtcggcactggatgtacctgctgtgggctggatgtaaaagacctttttacagattaca

SEQ ID NO: 51354 - DNA, 75 bp, Artificial Sequence
  Synthetic
agatagaagaagggttctttgacttgatgcatgtgcaaaaggtactatctgcaagtacagtctgcaaactacaga

SEQ ID NO: 51355 - DNA, 75 bp, Artificial Sequence
  Synthetic
gatgcatgtgcaaaaggtactatctgcaagtacagtctgcaaactacagagctgcacacacggtgtccctggcga

SEQ ID NO: 51356 - DNA, 75 bp, Artificial Sequence
  Synthetic
ggcactcaatccacaagatagagtcccatttcaacacttcatggatgtcatgggatggatgtgatctagactact

SEQ ID NO: 51357 - DNA, 75 bp, Artificial Sequence
  Synthetic
ttcagcaaaagctccctccagagatagttacattgcaccccagaattgaagaaggtttctttgatttaatgcatg

SEQ ID NO: 51358 - DNA, 75 bp, Artificial Sequence
  Synthetic
aaccccaaacccagtgacccctccagtacagccagccctctctcagagtgacacgtccacggccatccaggatat

SEQ ID NO: 51359 - DNA, 75 bp, Artificial Sequence
  Synthetic
ctgtaagctcactctacttgatctgtcagtttctaaactcttagtgtgtttatttcgaaaagatgacgaagaact

SEQ ID NO: 51360 - DNA, 75 bp, Artificial Sequence
  Synthetic
ccatttcaacacttcatggatgtcatgggatggatgtgatctagactacttctgcaacatgggtgactggccctc

SEQ ID NO: 51361 - DNA, 75 bp, Artificial Sequence
  Synthetic
tcagtttctaaactcttagtgtgtttatttcgaaaagatgacgaagaactaacaaacagctcaagtttaaaactc

SEQ ID NO: 51362 - DNA, 75 bp, Artificial Sequence
  Synthetic
tgctcaatattgagactgattatacaaagactttccacttccattccaagagagtaacggcacatggtgacaccc

SEQ ID NO: 51363 - DNA, 75 bp, Artificial Sequence
  Synthetic
aaagactttccacttccattccaagagagtaacggcacatggtgacacccctcaactggatctgaaggcaaggcc

SEQ ID NO: 51364 - DNA, 75 bp, Artificial Sequence
  Synthetic
ccactgacgagaagttgctacatcaaacaaagatagtttttgccaaaattggtctgtccggaaacagttatgatt

SEQ ID NO: 51365 - DNA, 75 bp, Artificial Sequence
  Synthetic
agctacacaccaagaaaattgaagtgtcaggactgaagtttgcaagtctgacctgctccggttgttacgcctgca

SEQ ID NO: 51366 - DNA, 75 bp, Artificial Sequence
  Synthetic
aggttgaccggaaggagtaccggggaaaggcttccaagaagcgtcaggagcaaggtcatttatgagatggtgaaa

SEQ ID NO: 51367 - DNA, 75 bp, Artificial Sequence
  Synthetic
gtcaggactgaagtttgcaagtctgacctgctccggttgttacgcctgcagctccggtatctcctgcaaagttag

SEQ ID NO: 51368 - DNA, 75 bp, Artificial Sequence
  Synthetic
atccagatgttgtggcagcaggatcaagtttgatggcaaggaaaatagagtttggggctgacagcaccttcaaag

SEQ ID NO: 51369 - DNA, 75 bp, Artificial Sequence
  Synthetic
aagtttgatggcaaggaaaatagagtttggggctgacagcaccttcaaagctttctcatcaatgcctaaaaactc

SEQ ID NO: 51370 - DNA, 75 bp, Artificial Sequence
  Synthetic
atgacactcagaagtgtgttgacacaaagctcgaacatccacaaagcatattaattgagcataagggaacaataa

SEQ ID NO: 51371 - DNA, 75 bp, Artificial Sequence
  Synthetic
gaccaaaacaagctgttggctagaatcagtcaagagttttttttatggactaaaaaacatgctgggtggcatctt

SEQ ID NO: 51372 - DNA, 75 bp, Artificial Sequence
  Synthetic
taaaaaacatgctgggtggcatcttcggtaatgtcttcttaggcatcttcctgttccttgctccttttgcactgc

SEQ ID NO: 51373 - DNA, 75 bp, Artificial Sequence
  Synthetic
caataccaaatggggcccgatacactgctgttcattcttttcaggcatgatgcaacaggttctaaaaaaagttcc

SEQ ID NO: 51374 - DNA, 75 bp, Artificial Sequence
  Synthetic
taaaagctgcagcaaagaagatacacaaaaatgtgtcaacacaaagcttgagcaaccacagagcattttaatcga

SEQ ID NO: 51375 - DNA, 75 bp, Artificial Sequence
  Synthetic
cggtaatgtcttcttaggcatcttcctgttccttgctccttttgcactgctaatattcttcttcttcttcgggtg

SEQ ID NO: 51376 - DNA, 75 bp, Artificial Sequence
  Synthetic
agtataaacaacttaaggacgaagaagaagccgggtacaagaaaatcatcgagaggctaaatgacaaaaaaggca

SEQ ID NO: 51377 - DNA, 75 bp, Artificial Sequence
  Synthetic
gagaggctaaatgacaaaaaaggcaaaagtcgactgtttgacggagagaggcttgcagataggaagattgcagaa

SEQ ID NO: 51378 - DNA, 75 bp, Artificial Sequence
  Synthetic
ggtaacaaatcagaccagctgccacctgtagtgtcatctgccttttttatgccattgtgtcctttttataactga

SEQ ID NO: 51379 - DNA, 75 bp, Artificial Sequence
  Synthetic
ttctttatgtttggatggagaatcctgttctgctttaaatgttgcagaagaactagaggcctttttaagtacaga

SEQ ID NO: 51380 - DNA, 75 bp, Artificial Sequence
  Synthetic
ctgtagtgtcatctgccttttttatgccattgtgtcctttttataactgatcatgcactgatcgtcacttcttcg

SEQ ID NO: 51381 - DNA, 75 bp, Artificial Sequence
  Synthetic
agaggagcttaccccagacaacagtacatgttgagcatgctggcagctctgacgattatgcaaagtgtatagtag

SEQ ID NO: 51382 - DNA, 75 bp, Artificial Sequence
  Synthetic
tcctgcttaacaccactccagcttgatttcatctagacttaaccttgactgcgtgccgccactatatctttgaga

SEQ ID NO: 51383 - DNA, 75 bp, Artificial Sequence
  Synthetic
ataggaagattgctgagctgttctccacaaagacacacattggctaaatcagtggaaagggcctcaaggagcgat

SEQ ID NO: 51384 - DNA, 75 bp, Artificial Sequence
  Synthetic
gaacaacaaaaaagggaaaaacaaactgcttgatggtgaaagattagctgataggaagattgctgagctgttctc

SEQ ID NO: 51385 - DNA, 75 bp, Artificial Sequence
  Synthetic
cacaaagacacacattggctaaatcagtggaaagggcctcaaggagcgatggtagtgcacttaccaataccgctg

SEQ ID NO: 51386 - DNA, 75 bp, Artificial Sequence
  Synthetic
gctacatttaatccgtttcattatatccgcaagcaagctctgcaatgcccaacaccgccattactctatttactc

SEQ ID NO: 51387 - DNA, 75 bp, Artificial Sequence
  Synthetic
tccgcaagcaagctctgcaatgcccaacaccgccattactctatttactctgacctaaaccttgactgcgtgccg

SEQ ID NO: 51388 - DNA, 75 bp, Artificial Sequence
  Synthetic
gtcaatgcaaacacagcggctttgagcaacaaagtcctcgcagagtacaaagttcctggcgagattgtgatgtct

SEQ ID NO: 51389 - DNA, 75 bp, Artificial Sequence
  Synthetic
atgcctattagcatcatgcacatatcattgatgtgtgcagttctttgcctgcagctgtatggtctggggggaacc

SEQ ID NO: 51390 - DNA, 75 bp, Artificial Sequence
  Synthetic
gtcaaagagatgctgtcagacatgattcggagaaggaaccaaattctaaacaggggtggtgatgagaatccacgt

SEQ ID NO: 51391 - DNA, 75 bp, Artificial Sequence
  Synthetic
gcagctgtatggtctggggggaacccatgggtcacacaatggaactgaacacaataagacaaacgctgtgacaac

SEQ ID NO: 51392 - DNA, 75 bp, Artificial Sequence
  Synthetic
ttgggaaaaaagttcaaacagtatagagagttgaaacctcagacctgtaccatatgcgaaacaactcctgttaat

SEQ ID NO: 51393 - DNA, 75 bp, Artificial Sequence
  Synthetic
ttccccttgtcaccaatacctcctttaccttactaaggcaacaaattttctttaatcatgttgaagactttatca

SEQ ID NO: 51394 - DNA, 75 bp, Artificial Sequence
  Synthetic
catatgcgaaacaactcctgttaatgcaatagatgctgaaatgcacgacctcaactgcagttacaatatatgtcc

SEQ ID NO: 51395 - DNA, 75 bp, Artificial Sequence
  Synthetic
caatgggtatctggacaagcacaaggacgaagttgacagggcgagtgctgacagcatgataacaaaccttctcaa

SEQ ID NO: 51396 - DNA, 75 bp, Artificial Sequence
  Synthetic
acccacaaccccagccagcgcaccagaaggctcaggggaagcccacacatcccccccaaacaccaccgaaggccc

SEQ ID NO: 51397 - DNA, 75 bp, Artificial Sequence
  Synthetic
catgggtcacacaatggaactgaacacaataagacaaacgctgtgacaacgtctagtgacagccggagctcagaa

SEQ ID NO: 51398 - DNA, 75 bp, Artificial Sequence
  Synthetic
gaaggctcaggggaagcccacacatcccccccaaacaccaccgaaggcccgtctctgccggagtccacgccagag

SEQ ID NO: 51399 - DNA, 75 bp, Artificial Sequence
  Synthetic
cgatccagtcaagtagcttaactacattagacagtttaggccgtagtaggacaagttctacagttgaagatagca

SEQ ID NO: 51400 - DNA, 75 bp, Artificial Sequence
  Synthetic
accaagaaaatgaagaaggctctgctgagcaccccaatgaagtgggggaagaaactttatgagctctttgccgac

SEQ ID NO: 51401 - DNA, 75 bp, Artificial Sequence
  Synthetic
cagcacacaggcagccagagatacctccacaccaacagtccgcaccggtccacccaacagccccagcataccacc

SEQ ID NO: 51402 - DNA, 75 bp, Artificial Sequence
  Synthetic
tccacaccaacagtccgcaccggtccacccaacagccccagcataccacccacaccacaagaaacacaccatcct

SEQ ID NO: 51403 - DNA, 75 bp, Artificial Sequence
  Synthetic
ggcctctgtctgagactgaactacaatttattaaagcactaaacagcctcaaatcaactcaagcttgtgagataa

SEQ ID NO: 51404 - DNA, 75 bp, Artificial Sequence
  Synthetic
atttattaaagcactaaacagcctcaaatcaactcaagcttgtgagataattcagaacaggattacgggccttta

SEQ ID NO: 51405 - DNA, 75 bp, Artificial Sequence
  Synthetic
accgtcaggatctggcaaagagagtccagcagccaacagccctcacccagtcgccagcagaccaccaaccccctc

SEQ ID NO: 51406 - DNA, 75 bp, Artificial Sequence
  Synthetic
ccagcagccaacagccctcacccagtcgccagcagaccaccaaccccctccacaacagcccaaggacctactgaa

SEQ ID NO: 51407 - DNA, 75 bp, Artificial Sequence
  Synthetic
gcagaatggcagattcctgtgattggctaagagatggcaagagaagagggaatctagaactagcaaacagaatcc

SEQ ID NO: 51408 - DNA, 75 bp, Artificial Sequence
  Synthetic
gctaagagatggcaagagaagagggaatctagaactagcaaacagaatccaatctgtactatgtgttctgatagc

SEQ ID NO: 51409 - DNA, 75 bp, Artificial Sequence
  Synthetic
gctttgagattgaatctcacaaatgttactgtagcctattttgttgcccctactgtagacactgctctgccgata

SEQ ID NO: 51410 - DNA, 75 bp, Artificial Sequence
  Synthetic
ccatagctgcaatactcaaccatgcttattttacttgcttatgtgaccttattttattaacctttctctattttc

SEQ ID NO: 51411 - DNA, 75 bp, Artificial Sequence
  Synthetic
ttattttattaacctttctctattttctcttgtcttaaacacttaaagggctgtgcggcaacgatatctttgaga

SEQ ID NO: 51412 - DNA, 75 bp, Artificial Sequence
  Synthetic
agccctaggcccaatgacctctctaacacagacagacctcccacagagtgtcacctccatagctgttcaagactc

SEQ ID NO: 51413 - DNA, 75 bp, Artificial Sequence
  Synthetic
cgtcattgaatagagacgacaacaaaattattgaagatcctatgatacaactgattccagagaaactaaggagag

SEQ ID NO: 51414 - DNA, 75 bp, Artificial Sequence
  Synthetic
aaaagaaaccttgaaatggaaataatcttaactttacctcagggtttaaaaaaatactatggcaaggtgctcagg

SEQ ID NO: 51415 - DNA, 75 bp, Artificial Sequence
  Synthetic
ttattttacttgcttatgtgaccttattttattaacctttctctattttctcttgtcttaaacacttaaagggct

SEQ ID NO: 51416 - DNA, 75 bp, Artificial Sequence
  Synthetic
acccaacacaatgacactagtaccataaaggtgcccgaagagagtcaaaaaaccagtctgcccgcgaacacagca

SEQ ID NO: 51417 - DNA, 75 bp, Artificial Sequence
  Synthetic
aattattgaagatcctatgatacaactgattccagagaaactaaggagagagttagaaaggttaggagtttctag

SEQ ID NO: 51418 - DNA, 75 bp, Artificial Sequence
  Synthetic
aaccagtctgcccgcgaacacagcatcgcccatcacgtcagaccccccctccaccacatccacagcatcagccag

SEQ ID NO: 51419 - DNA, 75 bp, Artificial Sequence
  Synthetic
ttgaagaattcttcataactggtgagggtcatttcaatgaagttttacaatttagaacaccaggcacattgagca

SEQ ID NO: 51420 - DNA, 75 bp, Artificial Sequence
  Synthetic
ccaccacatccacagcatcagccagtggaccagaaggctcaggggacacgagcacctctcccccagtcaccacac

SEQ ID NO: 51421 - DNA, 75 bp, Artificial Sequence
  Synthetic
tttacatgggttagctggaggaataaaagagctttcgcttcctatatacacaatattcatgaagtcatacttctt

SEQ ID NO: 51422 - DNA, 75 bp, Artificial Sequence
  Synthetic
gccagagccccacacaacaattgacatcgataaatcaagcacagccatcgctgacatcagcacacagacagtcaa

SEQ ID NO: 51423 - DNA, 75 bp, Artificial Sequence
  Synthetic
tagattcaggttacttctcagccaaatgttactcaagaacatctaattcagggcttcagctgatcaatgtcactc

SEQ ID NO: 51424 - DNA, 75 bp, Artificial Sequence
  Synthetic
gggcttcagctgatcaatgtcactcgacattcaactagaatagccgacacacccgggcctaagatcaccaaccta

SEQ ID NO: 51425 - DNA, 75 bp, Artificial Sequence
  Synthetic
agcaagcacagaggccagcagcccacaaccaaccatcagcgagacaccatccccccccccaacagcccaagctcc

SEQ ID NO: 51426 - DNA, 75 bp, Artificial Sequence
  Synthetic
tatggacttgtcacagatgtattctcctgtctttgagtacctatcaggtgatagacaagtggaggaatggcccaa

SEQ ID NO: 51427 - DNA, 75 bp, Artificial Sequence
  Synthetic
aaccagcagctcccaactcagtgacccatccagcacagccaactccctctcagagcgacgtccccacggctgctc

SEQ ID NO: 51428 - DNA, 75 bp, Artificial Sequence
  Synthetic
tcgtgcagtgattgttaagaccaaactgttttcagcaaccgaacaggttcggctatctaacaaccctgcagttgt

SEQ ID NO: 51429 - DNA, 75 bp, Artificial Sequence
  Synthetic
aaaaaaaacaagctgaatgacagatgtaccttattcaccaactgtgtgataaaaggaagagaggttcgtaaaggc

SEQ ID NO: 51430 - DNA, 75 bp, Artificial Sequence
  Synthetic
catgggttatctattagatgaatccgcaatttctgaagttaaacctacaaaggttgatttttcgaatttacttaa

SEQ ID NO: 51431 - DNA, 75 bp, Artificial Sequence
  Synthetic
aactggttctaggagattgctttctgatgagtctggtgatgactgcatatcaaggactcagctattgagaacaga

SEQ ID NO: 51432 - DNA, 75 bp, Artificial Sequence
  Synthetic
gatgagtctggtgatgactgcatatcaaggactcagctattgagaacagagactgcagagatccatggtgacaat

SEQ ID NO: 51433 - DNA, 75 bp, Artificial Sequence
  Synthetic
aaatgctaacagatgagtcgtcagactcagaaaagaatggtcttagtccagatttgcaacaagttgcaagatact

SEQ ID NO: 51434 - DNA, 75 bp, Artificial Sequence
  Synthetic
agggttattgcctaaaaatcactcaggaaggaaggggccatgtgaaattatccaggggctcagaggttgtcttgg

SEQ ID NO: 51435 - DNA, 75 bp, Artificial Sequence
  Synthetic
tccaggggctcagaggttgtcttggatgcatgcgactcaagctgtgaagtaatgatacctaagggcacaggtgac

SEQ ID NO: 51436 - DNA, 75 bp, Artificial Sequence
  Synthetic
gtcacccaacatttaattagaataacagacacacctgggcctaagatcactaatctgaaaaccatcaattgcata

SEQ ID NO: 51437 - DNA, 75 bp, Artificial Sequence
  Synthetic
attctccactgcatttctgctatcggatgcctacctctgagtcaagcagataagtcttcactactcatgagtttc

SEQ ID NO: 51438 - DNA, 75 bp, Artificial Sequence
  Synthetic
taccacataggaaacttgttaaaaggagacaaggtgaatgggcacctgattcacaaaattgaaccacacttcaac

SEQ ID NO: 51439 - DNA, 75 bp, Artificial Sequence
  Synthetic
atgcatgcgactcaagctgtgaagtaatgatacctaagggcacaggtgacatcctagtggactgttcaggtgggc

SEQ ID NO: 51440 - DNA, 75 bp, Artificial Sequence
  Synthetic
tagtcatgaagcaagtatacttagtgaatttgacagtcaagttattgctaacatacttgccagtgaattaagttc

SEQ ID NO: 51441 - DNA, 75 bp, Artificial Sequence
  Synthetic
gaatttgacagtcaagttattgctaacatacttgccagtgaattaagttctgtgaaacgagattctgaacgcgaa

SEQ ID NO: 51442 - DNA, 75 bp, Artificial Sequence
  Synthetic
aatctcatgtttgtgactactctttagacatcgacgggccggtaagactgccccgtatccaccatgaaggaactt

SEQ ID NO: 51443 - DNA, 75 bp, Artificial Sequence
  Synthetic
aatgatacctaagggcacaggtgacatcctagtggactgttcaggtgggcagcaacatttcttgaacgacaactt

SEQ ID NO: 51444 - DNA, 75 bp, Artificial Sequence
  Synthetic
cttgtatagtctgcaaggccatcttttacttcttaataattgttggaacactagggaagaggtttaagcagtata

SEQ ID NO: 51445 - DNA, 75 bp, Artificial Sequence
  Synthetic
tgccctgttgtgtgagactgaaaggcaagtgctctcttggatgagcaaaaggaggactgaggtaataactaaaga

SEQ ID NO: 51446 - DNA, 75 bp, Artificial Sequence
  Synthetic
caagtgctctcttggatgagcaaaaggaggactgaggtaataactaaagaacaacatcaattgttcctgagcctc

SEQ ID NO: 51447 - DNA, 75 bp, Artificial Sequence
  Synthetic
tgtttatcaaggactcagctattgaggacagagaatgcggaaattcacagtgacaactatggtggtccaggtgac

SEQ ID NO: 51448 - DNA, 75 bp, Artificial Sequence
  Synthetic
attgccctaagcggaaggagaaagtaaaagaaactgaattgtacttgaacttagagagaattccctgggttgtaa

SEQ ID NO: 51449 - DNA, 75 bp, Artificial Sequence
  Synthetic
attgccctaagcggaaggagaaagtataagaaactgaattgtacttgaacttagagagaattccctgggttgtaa

SEQ ID NO: 51450 - DNA, 75 bp, Artificial Sequence
  Synthetic
attgccctaagcggaaggagaaagtacaagaaactgaattgtacttgaacttagagagaattccctgggttgtaa

SEQ ID NO: 51451 - DNA, 75 bp, Artificial Sequence
  Synthetic
attgccctaagcggaaggagaaagtagaagaaactgaattgtacttgaacttagagagaattccctgggttgtaa

SEQ ID NO: 51452 - DNA, 75 bp, Artificial Sequence
  Synthetic
ctttgtactgggaagcatcttgtttatagtctcttgtctaacgaaagggctggttaacagtgttggcaacatctt

SEQ ID NO: 51453 - DNA, 75 bp, Artificial Sequence
  Synthetic
ggctgttggctagagtcagtcaagagcttcttttatgggctaaaaaacatgcttagtggcatttttggcaatgtt

SEQ ID NO: 51454 - DNA, 75 bp, Artificial Sequence
  Synthetic
ctcaaggattaagttcaaaacagagcttcttcttaattcattgacgctgcttcactgtttcttgaaacatgctcc

SEQ ID NO: 51455 - DNA, 75 bp, Artificial Sequence
  Synthetic
ttcactgtttcttgaaacatgctcccagtgatgctataatggaagtagagagtaaaagtagcctactacacaagt

SEQ ID NO: 51456 - DNA, 75 bp, Artificial Sequence
  Synthetic
catctgcaaaaaaagaaaaacaggaagtaatgtcatgcttgctgtttgcaagcgcatgtgtttcagagcaactat

SEQ ID NO: 51457 - DNA, 75 bp, Artificial Sequence
  Synthetic
cctcaaggacgatgaagaaaccggttacaggaaaatcattgagaggctgaacaacaaaaaagggaaaaacaaact

SEQ ID NO: 51458 - DNA, 75 bp, Artificial Sequence
  Synthetic
atggacttgtggacaccttcacaaactcctattccttttgcgagagtgttcccaatttggacaggtttgtgtttc

SEQ ID NO: 51459 - DNA, 75 bp, Artificial Sequence
  Synthetic
gctctggtggaggcaacaaagttttgtgcacctatatatgagtgcgcatgggttagctccactggcattgtaaaa

SEQ ID NO: 51460 - DNA, 75 bp, Artificial Sequence
  Synthetic
gtgcacctatatatgagtgcgcatgggttagctccactggcattgtaaaaaagggacttgaatggttcgagaaaa

SEQ ID NO: 51461 - DNA, 75 bp, Artificial Sequence
  Synthetic
atctggaactggagagcttgctcactttgtgtgctttttattttcagaatgagtgcagtaaaagggaggggccta

SEQ ID NO: 51462 - DNA, 75 bp, Artificial Sequence
  Synthetic
gacgtcccgaaaatagagcagcttaccggttaccaacaagctgccttgaagtggagaaaagacataggtttccgt

SEQ ID NO: 51463 - DNA, 75 bp, Artificial Sequence
  Synthetic
ccggttaccaacaagctgccttgaagtggagaaaagacataggtttccgtgtcaatgccaacacagcagctctga

SEQ ID NO: 51464 - DNA, 75 bp, Artificial Sequence
  Synthetic
ttgtaagacatgttctattggcagtataaacggctttgaaattgaatctcacaaatgttactgtagcctattttg

SEQ ID NO: 51465 - DNA, 75 bp, Artificial Sequence
  Synthetic
ataggaaaaaatatccttgttcgtgcaaacaatgagctaggtgatgtgtcactgaaggtcaatattgtcttggtg

SEQ ID NO: 51466 - DNA, 75 bp, Artificial Sequence
  Synthetic
ggcaacctgtacaggtgactgcccagagagatgtggctgtacatcatcaacctgtttgcataaagaatggcccca

SEQ ID NO: 51467 - DNA, 75 bp, Artificial Sequence
  Synthetic
gctgcacctgttgtggtttagatgtgaaagacctttttacagactatatgttcgtcaagtggaaagtcgaataca

SEQ ID NO: 51468 - DNA, 75 bp, Artificial Sequence
  Synthetic
gccgttcaggaatagcacttgttgcaacaggccttgctaagcttgcagagactgaaggaaagggaatatttgatg

SEQ ID NO: 51469 - DNA, 75 bp, Artificial Sequence
  Synthetic
ttaagacagaggccatagtgtgtgtagaacttaccagtcaggaaaggcagtgtagcttaattgaggcgggtacaa

SEQ ID NO: 51470 - DNA, 75 bp, Artificial Sequence
  Synthetic
ctctgcagtggagatggaaaacctgccagcaggcacttgggaaaaagaggaagacctgacaaatttctgtcatca

SEQ ID NO: 51471 - DNA, 75 bp, Artificial Sequence
  Synthetic
gacgaagttgatagagcaagcgccgacagcatgataacaaaccttcttaagcatattgccaaggcacaggagctc

SEQ ID NO: 51472 - DNA, 75 bp, Artificial Sequence
  Synthetic
tgtgtggatatggaaaaaaagagggatgcagttagagcagtggaagacttggttctgatgttgacaggcagggca

SEQ ID NO: 51473 - DNA, 75 bp, Artificial Sequence
  Synthetic
cagcaaaagctccctcctgaaataatcacactgcatcctaggattgaagaaggtttttttgacctgatgcatgta

SEQ ID NO: 51474 - DNA, 75 bp, Artificial Sequence
  Synthetic
ggagcaaataagcctagatgatctaatggcaagtgacacagtgacagaccagcctgatagggaggcagaggcact

SEQ ID NO: 51475 - DNA, 75 bp, Artificial Sequence
  Synthetic
tttcagctcatactattggctttacaaggctggcgtgactcctgaaaccttcccgacggtgtcacagttcctctt

SEQ ID NO: 51476 - DNA, 75 bp, Artificial Sequence
  Synthetic
atggcaagtgacacagtgacagaccagcctgatagggaggcagaggcactcaaaacaggcaatcttggctttaac

SEQ ID NO: 51477 - DNA, 75 bp, Artificial Sequence
  Synthetic
tgtcttaagggcaagtatgacagtttataccatgccatttgccaacctctaaacttccaattaagtcagttgctc

SEQ ID NO: 51478 - DNA, 75 bp, Artificial Sequence
  Synthetic
taccacatcggaaatttactaaaaggagataaagttaacggacacctgattcataaaattgagccacacttcaac

SEQ ID NO: 51479 - DNA, 75 bp, Artificial Sequence
  Synthetic
gtttcaggcagatcagagtcaatcatgaaattagaggaaaggacaggaattagctgggatctgggtgtggaagac

SEQ ID NO: 51480 - DNA, 75 bp, Artificial Sequence
  Synthetic
tggttaacatttaccatcctgctatttcactttctttgctgtttatatcagtttcattatttccagggtgtgggg

SEQ ID NO: 51481 - DNA, 75 bp, Artificial Sequence
  Synthetic
atgcatatatcattaatgtatgcagttctttgcctacagctgtgtggtctgggggagactcatggatcacataat

SEQ ID NO: 51482 - DNA, 75 bp, Artificial Sequence
  Synthetic
gtattctcctgtctttgagtacctatcaggtgatagacaagtggaggaatggcccaaggcaacctgcacaggaga

SEQ ID NO: 51483 - DNA, 75 bp, Artificial Sequence
  Synthetic
gggggagactcatggatcacataatggaactagatacaataatacagacgctacgacaacgcccggtgatagcca

SEQ ID NO: 51484 - DNA, 75 bp, Artificial Sequence
  Synthetic
tctgaaggcaaggccaagctatggcgcaggagagatcaccgtactagtagaggttgctgatatggagttacacac

SEQ ID NO: 51485 - DNA, 75 bp, Artificial Sequence
  Synthetic
gctatttgaagttcaaaaaacagggttcaacattcaggacatggacatagtggcctctgagcacttgctacacca

SEQ ID NO: 51486 - DNA, 75 bp, Artificial Sequence
  Synthetic
gagccctgaaccgccagtgagcacggcctcgtccatcacacacaacccctccactgtcacatccacaacaccaac

SEQ ID NO: 51487 - DNA, 75 bp, Artificial Sequence
  Synthetic
ggcactggatgcacctgttgtgggctggatgtgaaagacctctttacagattacatgtttgtcaagtggaaagtt

SEQ ID NO: 51488 - DNA, 75 bp, Artificial Sequence
  Synthetic
gcaatgccaccagtgctaacatcatttaaaatacaaactgctctgtactcaacttccttccttctgaaccgccat

SEQ ID NO: 51489 - DNA, 75 bp, Artificial Sequence
  Synthetic
ccgagggcctatctccaccggggaccactccagagctcccagccacaaccggtatagacacttcaggtgcaagtg

SEQ ID NO: 51490 - DNA, 75 bp, Artificial Sequence
  Synthetic
aagtttgcaagcttgacttgtacaggttgttatgcttgtagttccggtatctcctgtaaagttaggattcatgtg

SEQ ID NO: 51491 - DNA, 75 bp, Artificial Sequence
  Synthetic
cactccagagctcccagccacaaccggtatagacacttcaggtgcaagtgatgccaaccccagcacacaggcagc

SEQ ID NO: 51492 - DNA, 75 bp, Artificial Sequence
  Synthetic
gcacaccacctatatcacaagacacacaccaccctgtgaggaacctactttcagttacgagccctatgccagaag

SEQ ID NO: 51493 - DNA, 75 bp, Artificial Sequence
  Synthetic
tgcaatcctttgcctacagctgtgtggtctgggagagactcatggatcacacaatgaaactagacacaataaaac

SEQ ID NO: 51494 - DNA, 75 bp, Artificial Sequence
  Synthetic
agagctgcagtgaagaagacacacaaaaatgtgttaacacaaagcttgagcagccacagagcattttgatcgaac

SEQ ID NO: 51495 - DNA, 75 bp, Artificial Sequence
  Synthetic
tcagttacgagccctatgccagaagagacaacagcaccttcgggttcaggcaaggagagctcagcaaccagcagc

SEQ ID NO: 51496 - DNA, 75 bp, Artificial Sequence
  Synthetic
gcacggccttgtctattacacttgacccctccactgtcacacccacaacaccagccagtggattagaaggctcag

SEQ ID NO: 51497 - DNA, 75 bp, Artificial Sequence
  Synthetic
acctgattcacaaaattgaaccacacttcaacacctcctggatgtcttgggacggctgtgacctagactactact

SEQ ID NO: 51498 - DNA, 75 bp, Artificial Sequence
  Synthetic
caccaccgggagcttgcccctgtcggagacaacaccagaactccctgttacaaccggcacagacaccttaagcgc

SEQ ID NO: 51499 - DNA, 75 bp, Artificial Sequence
  Synthetic
ctccagacacacaccccaacccaacaaacagatctaaaagaaaccttgaaatggaaataatcttgaccttgtctc

SEQ ID NO: 51500 - DNA, 75 bp, Artificial Sequence
  Synthetic
ttttgcttcaagtgctgtagaagaaccaggggcctgttcagatataaacatctcgaaaacgatgaagaaactggt

SEQ ID NO: 51501 - DNA, 75 bp, Artificial Sequence
  Synthetic
atggaaataatcttgaccttgtctcagggcttaaaaaaatactacggcaaaatactcagacttctgcatcttacc

SEQ ID NO: 51502 - DNA, 75 bp, Artificial Sequence
  Synthetic
cagtccgcacaagtctacccaacagccctagcacaccatctacaccacaagacacacaccatcctgtgagaaatc

SEQ ID NO: 51503 - DNA, 75 bp, Artificial Sequence
  Synthetic
gttacagcacatggagacacaccacaattagatttaaaagctagaccaacttatggtgcaggtgaaatcactgtg

SEQ ID NO: 51504 - DNA, 75 bp, Artificial Sequence
  Synthetic
acaacaaaaaaggaaaaaacaagctgcttgatggtgaaagacttgctgatagaagaattgccgaactattctcca

SEQ ID NO: 51505 - DNA, 75 bp, Artificial Sequence
  Synthetic
acaggcaaagagagctcagcaaccagtagccctcatccagtctccaacagaccaccaacccctcctgcaacagcc

SEQ ID NO: 51506 - DNA, 75 bp, Artificial Sequence
  Synthetic
gtagccctcatccagtctccaacagaccaccaacccctcctgcaacagcccagggacccactgaaaatgacagtc

SEQ ID NO: 51507 - DNA, 75 bp, Artificial Sequence
  Synthetic
tctcatggctaggaagcttgaatttgggacagatagcacatttaaagccttttcagccatgcccaaaacctcctt

SEQ ID NO: 51508 - DNA, 75 bp, Artificial Sequence
  Synthetic
ccaacgaacaggtctaaaagaaaccttaagatggaaataatcttgactttatctcagggtttaaaaaagtactat

SEQ ID NO: 51509 - DNA, 75 bp, Artificial Sequence
  Synthetic
tcaaatcacatgtctgtgactactctttggacattgacgggacggtgaggctccctcacattcatcatgaaggta

SEQ ID NO: 51510 - DNA, 75 bp, Artificial Sequence
  Synthetic
caggcacgttgagcaccacagagtcaacacctgctgggctgccaacagctgaaccttttaagtcctacttcgcca

SEQ ID NO: 51511 - DNA, 75 bp, Artificial Sequence
  Synthetic
ttatttaaactgcttatgtaatcctgctttattaacattttatcattttcttctgttttaaatacttaaagggct

SEQ ID NO: 51512 - DNA, 75 bp, Artificial Sequence
  Synthetic
gactgcatatcaagaactcaactattgaggacagagactgcagagatccacggcgataactatggtggcccaggt

SEQ ID NO: 51513 - DNA, 75 bp, Artificial Sequence
  Synthetic
cttcaaagaacatagagaggttgaaatcaatgtgcttctcccccaagttgcagttaatctctcaaactgtcacgt

SEQ ID NO: 51514 - DNA, 75 bp, Artificial Sequence
  Synthetic
gactcaagtgattgccggtcaatatgtgtccaaccctaggttcaacatttctgattatttcgagattgtgcggca

SEQ ID NO: 51515 - DNA, 75 bp, Artificial Sequence
  Synthetic
caacatcaaacgcttaaccgagtcggcagcacggaagtattaccaagaggagcctgaagctagacttgttggctt

SEQ ID NO: 51516 - DNA, 75 bp, Artificial Sequence
  Synthetic
acatatgtccctattgtgcatctagactaacctcagacgggcttgctaggcatgtgacacagtgccctaagcgga

SEQ ID NO: 51517 - DNA, 75 bp, Artificial Sequence
  Synthetic
tatcagagtccactggtgtggcattgaaaaggagcagctggctggttgtgctgctggtgctgttgacggtttcat

SEQ ID NO: 51518 - DNA, 75 bp, Artificial Sequence
  Synthetic
aatgtcaaaccaccccaaaacaaccatggctttcctcttctggttcagctttggctatgtaataacctgcatact

SEQ ID NO: 51519 - DNA, 75 bp, Artificial Sequence
  Synthetic
gacaaacaaattaagcaagagttctctagaatgaaactctacgtcactaaggatttacttgaccatctagacgtt

SEQ ID NO: 51520 - DNA, 75 bp, Artificial Sequence
  Synthetic
gcattgaaaagaagcagttggctgattgtgctgcttgtgctattcactgtttcattatcaccagttcaatcagca

SEQ ID NO: 51521 - DNA, 75 bp, Artificial Sequence
  Synthetic
cccattggtcaagggaagacaattgaggcataccgggccagggaagggtacacaagtatatgcctctttgtacta

SEQ ID NO: 51522 - DNA, 75 bp, Artificial Sequence
  Synthetic
cacctcagcagtggagatggaaagcctaccagccgggacctgggagagagaagaagacctaacaaacttctgtca

SEQ ID NO: 51523 - DNA, 75 bp, Artificial Sequence
  Synthetic
ctaccagccgggacctgggagagagaagaagacctaacaaacttctgtcatcaggaatgccaagttgcggatact

SEQ ID NO: 51524 - DNA, 75 bp, Artificial Sequence
  Synthetic
ctcatgcatggagaaaaactttctgccaagaaaaaagatggagatctggcggaacaaggcagcaagcagagcacc

SEQ ID NO: 51525 - DNA, 75 bp, Artificial Sequence
  Synthetic
aagagaagaagacctaacaaatttctgtcatcaggaatgccaggttacagagactgaatgcctctgcccttatga

SEQ ID NO: 51526 - DNA, 75 bp, Artificial Sequence
  Synthetic
aaaaacccccgtgtcgacaaaagacgttctggaaacttgggaaaaaatgaaggagcacatactcaacagaccgac

SEQ ID NO: 51527 - DNA, 75 bp, Artificial Sequence
  Synthetic
agagccgatagccataatttgtgatggcatagaaagcaacatgaaacagttgtttgctatattgcctcctgactg

SEQ ID NO: 51528 - DNA, 75 bp, Artificial Sequence
  Synthetic
agctcagtggaacacagaggcaataagatcttggtttcaggcagatcagaatcaattatgaagctggaagaaagg

SEQ ID NO: 51529 - DNA, 75 bp, Artificial Sequence
  Synthetic
gatgcatgtacaaaaagtgttgtcggcaagcacagtgtgtaagttgcagagttgcacacatggtgtgccaggaga

SEQ ID NO: 51530 - DNA, 75 bp, Artificial Sequence
  Synthetic
gcaagcacagtgtgtaagttgcagagttgcacacatggtgtgccaggagatctacaggtctaccacatcggaaat

SEQ ID NO: 51531 - DNA, 75 bp, Artificial Sequence
  Synthetic
aagatagaaatggtcagccactgtgaaaataaaggctttgaggacagcaatgaatgcttaacagacctagatagg

SEQ ID NO: 51532 - DNA, 75 bp, Artificial Sequence
  Synthetic
ggggtgtagggactggctgcacctgttgtggattagatgtgaaagacctttttacagattatatgtttgtcaagt

SEQ ID NO: 51533 - DNA, 75 bp, Artificial Sequence
  Synthetic
gtataatggaaaactttacccgccttatgcacggaggaaaactttcagccaagaaaaaagatggagatccagcag

SEQ ID NO: 51534 - DNA, 75 bp, Artificial Sequence
  Synthetic
ttgaagcgggcacaaggttcaatttaggtcctgtgaccatcacactgtcagaaccaagaaacatccaacaaaaac

SEQ ID NO: 51535 - DNA, 75 bp, Artificial Sequence
  Synthetic
aagtctcatggcaagaaagcttgaatttggaacagacagtacatttaaagctttttcagccatgcctaaaacttc

SEQ ID NO: 51536 - DNA, 75 bp, Artificial Sequence
  Synthetic
ctactactgcaacatgggagattggccttcttgcacatacacaggggtcacccaacacaatcatgcttcatttgt

SEQ ID NO: 51537 - DNA, 75 bp, Artificial Sequence
  Synthetic
gaggatcttgttttgttttaagtgttgtagaagaaccagaggcctgttcaagtacagacacctgaaagacgatga

SEQ ID NO: 51538 - DNA, 75 bp, Artificial Sequence
  Synthetic
tagagtcagtcaagagttttttttatggcctaaagaacatgcttagtggcatttttggcaatgtctttatgggca

SEQ ID NO: 51539 - DNA, 75 bp, Artificial Sequence
  Synthetic
ttttcttgttccttgcccccttcatcctgttaatactattctttatgtttgggtggaggatcctattctgcttta

SEQ ID NO: 51540 - DNA, 75 bp, Artificial Sequence
  Synthetic
gaaagacttgctgatggaagaattgccgaactgttctctacaaaaacacacattggctagaccaactgaatgggc

SEQ ID NO: 51541 - DNA, 75 bp, Artificial Sequence
  Synthetic
gctctagtggaggcaaccaaattttgcgcacccatatacgagtgtgcctgggttagctccactggcattgtgaag

SEQ ID NO: 51542 - DNA, 75 bp, Artificial Sequence
  Synthetic
cagctgaatgcatgaagaggtacattggcacaccttatgagggaattgtagacaccttagtttctctgattaatg

SEQ ID NO: 51543 - DNA, 75 bp, Artificial Sequence
  Synthetic
cagaggtggcgatgaaaatccacgaggcccggtgagccgtgaacatgtggagtggtgcagggagtttgtcaaagg

SEQ ID NO: 51544 - DNA, 75 bp, Artificial Sequence
  Synthetic
ctcatgtacagccaaacgcaactgaacacaatagaacaaacaccaccacagcacccggcacaagccatagcctca

SEQ ID NO: 51545 - DNA, 75 bp, Artificial Sequence
  Synthetic
acacaatagaacaaacaccaccacagcacccggcacaagccatagcctcaagccacttgtgagcacaaccccacc

SEQ ID NO: 51546 - DNA, 75 bp, Artificial Sequence
  Synthetic
cagaaggctcaggggaagcgaccccactttcaaacaccatccaggccccgtcctcaccagagaccacatcagaac

SEQ ID NO: 51547 - DNA, 75 bp, Artificial Sequence
  Synthetic
actttcaaacaccatccaggccccgtcctcaccagagaccacatcagaacgccccgcaacagctgtcataagcac

SEQ ID NO: 51548 - DNA, 75 bp, Artificial Sequence
  Synthetic
ccacaacaacagtcggcacaagtccatccagcagccccagtacgccatccacaccacaaggcatacaccatcatg

SEQ ID NO: 51549 - DNA, 75 bp, Artificial Sequence
  Synthetic
tttcagctcatactactggctctataaggccggcgtgaccccagaaaccttcccaactgtctcacagtttctttt

SEQ ID NO: 51550 - DNA, 75 bp, Artificial Sequence
  Synthetic
atccagcagccccagtacgccatccacaccacaaggcatacaccatcatgcaaggagtctattgtcagtcacgag

SEQ ID NO: 51551 - DNA, 75 bp, Artificial Sequence
  Synthetic
gcaaatagctcaagtttaaaacttggttttttagtgaaatatgctgtcaccttgttcacatcaaatggtgaacca

SEQ ID NO: 51552 - DNA, 75 bp, Artificial Sequence
  Synthetic
cggaaaccagcaatcaacactcagccatgagcaggacaccaacccaccacacagtaacccaggtctccactgaga

SEQ ID NO: 51553 - DNA, 75 bp, Artificial Sequence
  Synthetic
catgagcaggacaccaacccaccacacagtaacccaggtctccactgagaacaccagccacagcacacccagaca

SEQ ID NO: 51554 - DNA, 75 bp, Artificial Sequence
  Synthetic
cgcaatcaacccttctaatgagtgctgctcctacagctgtccagagcatacatcccagcccaacgaacaggtcta

SEQ ID NO: 51555 - DNA, 75 bp, Artificial Sequence
  Synthetic
aaggctcccaagaagcgttagaagcaaggtcatttatgagatggtaaaactagtgggagaaacaggcatggcaat

SEQ ID NO: 51556 - DNA, 75 bp, Artificial Sequence
  Synthetic
tgctcctacagctgtccagagcatacatcccagcccaacgaacaggtctaagaggaaccttgagacggaaataat

SEQ ID NO: 51557 - DNA, 75 bp, Artificial Sequence
  Synthetic
agattccctcctcttgcactgctatctacaattgtaaccatcaaccatgtttatattagctgcttgtataatcct

SEQ ID NO: 51558 - DNA, 75 bp, Artificial Sequence
  Synthetic
aagtggattgagcatcttaaatgcaacatgcctgttagcattatgcatatattattgatgtgtgcagtactttgc

SEQ ID NO: 51559 - DNA, 75 bp, Artificial Sequence
  Synthetic
ctgcagcagtatggtctgggggagactcatagaccaaacaacggaaccgaacacaacaaaacaaacgttttgaca

SEQ ID NO: 51560 - DNA, 75 bp, Artificial Sequence
  Synthetic
acacccacaacaccagtcagtggactggaaggctcgggggacgtgtacacatcccccccagtcaccaccaagggc

SEQ ID NO: 51561 - DNA, 75 bp, Artificial Sequence
  Synthetic
cacctcaagtgcaagtgatgtcgattccagcacacaggcagccagagacacctcaacactaacagtccgcacaag

SEQ ID NO: 51562 - DNA, 75 bp, Artificial Sequence
  Synthetic
ttgtgaggaatctactttcagtcacgagcccctggccagaagaaacaacagcaccgtcaaaatcaggcaaagaga

SEQ ID NO: 51563 - DNA, 75 bp, Artificial Sequence
  Synthetic
gagcccctggccagaagaaacaacagcaccgtcaaaatcaggcaaagagagtccagtagccaacagccctcaccc

SEQ ID NO: 51564 - DNA, 75 bp, Artificial Sequence
  Synthetic
acagcttgagtccatggcacaatcaacaaccctagtcccaatggcctctccaacacagacagtcctctcacagag

SEQ ID NO: 51565 - DNA, 75 bp, Artificial Sequence
  Synthetic
gccacagggaaagcctgtgaagtggacagcactccggttaagtgcaggcagggtttttgtttaaaaatcacccaa

SEQ ID NO: 51566 - DNA, 75 bp, Artificial Sequence
  Synthetic
caagttctacagctgaagatagcagcagtgtgagtgacactactgctgcttctcatgactcaggatcatcatcct

SEQ ID NO: 51567 - DNA, 75 bp, Artificial Sequence
  Synthetic
ggcttttgcaactcaccttagaggaggacactgaaggcctgctagaatggtgtaagagaaatcttggtcttgatt

SEQ ID NO: 51568 - DNA, 75 bp, Artificial Sequence
  Synthetic
tgcttgcgactcaagctgtgaagtaatgatacctaaaggcactggagatatcctagtggactgttcaggtggaca

SEQ ID NO: 51569 - DNA, 75 bp, Artificial Sequence
  Synthetic
caggaaaaacattgatgaagttttacttactgaagatgggaatctgatcttctgctggttgaaaacaatctcttc

SEQ ID NO: 51570 - DNA, 75 bp, Artificial Sequence
  Synthetic
atgatacctaaaggcactggagatatcctagtggactgttcaggtggacagcaacatttcttaaaggacaactta

SEQ ID NO: 51571 - DNA, 75 bp, Artificial Sequence
  Synthetic
atatgtgagacagctcctgtcaatgcaatagatgctgaaatgcatgaccttaactgtagttacaatatatgccct

SEQ ID NO: 51572 - DNA, 75 bp, Artificial Sequence
  Synthetic
caatagatgctgaaatgcatgaccttaactgtagttacaatatatgcccttattgtgcatcaagattgacctccg

SEQ ID NO: 51573 - DNA, 75 bp, Artificial Sequence
  Synthetic
agagaggttgaaatcaatgtgcttctccctcaagttgcagtcaacctctcaaactgtcacgttactatcaaatca

SEQ ID NO: 51574 - DNA, 75 bp, Artificial Sequence
  Synthetic
atgccccaagcgaaaagagaaagttgaggagactgaactgtacttgaatctggagagaattccttggattgtcag

SEQ ID NO: 51575 - DNA, 75 bp, Artificial Sequence
  Synthetic
ccaggaacttacaagatagtgatagacaaaaaaaacaagctgaatgacagatgtaccctatacaccaactgtgtg

SEQ ID NO: 51576 - DNA, 75 bp, Artificial Sequence
  Synthetic
ctaacgggaaggagtactggggaaaggctccctagaagcgttagaagtaaggtcatatatgagatggtaaaacta

SEQ ID NO: 51577 - DNA, 75 bp, Artificial Sequence
  Synthetic
tccgaagcatcatcaataccacttttgtaatatgtattctaacattaacaatctgtgttgttagcacttctgcag

SEQ ID NO: 51578 - DNA, 75 bp, Artificial Sequence
  Synthetic
cctaagacaaccatggctttcctcttttggttcagttttggctatgtgataacctgtatactctgcaaggccatt

SEQ ID NO: 51579 - DNA, 75 bp, Artificial Sequence
  Synthetic
ctcaacaagtttggaaacaagcttatcaattgaagcaccatggggagcaataaatatccagtcaacctttaaacc

SEQ ID NO: 51580 - DNA, 75 bp, Artificial Sequence
  Synthetic
gcagctggctgattgtgctgcttgtgctgttcgcagtttcattatcacctgttcaatcagcacccattggtcatg

SEQ ID NO: 51581 - DNA, 75 bp, Artificial Sequence
  Synthetic
tacaaccatatgggtcagggtattcaccatgcaacatcttcggtgttaacttccctagctgccgtgctctttgag

SEQ ID NO: 51582 - DNA, 75 bp, Artificial Sequence
  Synthetic
caagcgcatgtgcttcagagcaactatggaagtgagcaataaggccctacttatccgtagcatcatcaacaccac

SEQ ID NO: 51583 - DNA, 75 bp, Artificial Sequence
  Synthetic
tcacagctgcagtgcaaagatgctgtcaaatgaaagatagtgccaaaaccttagtgagcgactgctttcttgagt

SEQ ID NO: 51584 - DNA, 75 bp, Artificial Sequence
  Synthetic
aaactccacaagtttagaaacaagcttgtcgattgaggcaccatggggggcaataaatgttcagtcaacctacaa

SEQ ID NO: 51585 - DNA, 75 bp, Artificial Sequence
  Synthetic
ttgctatgcttgtagctctggcatctcctgtaaagtcaggattcatgtagatgaaccagatgagctcacagtaca

SEQ ID NO: 51586 - DNA, 75 bp, Artificial Sequence
  Synthetic
gcacttagttggagttcagttgaacacagaggtaataagattttggtttcaggcagatcagaatcaattatgaag

SEQ ID NO: 51587 - DNA, 75 bp, Artificial Sequence
  Synthetic
gggatcttggcgttgaagatgcctctgaatctaagctacttactgtctctgtcatggacttgtctcagatgtact

SEQ ID NO: 51588 - DNA, 75 bp, Artificial Sequence
  Synthetic
gcatgcgccattaatgcccttcagtgtctcaagtacaaatgaggcagttttaattgcaccattaattgacatcaa

SEQ ID NO: 51589 - DNA, 75 bp, Artificial Sequence
  Synthetic
ctttaactgatccattttactaccttgctaatcctctctcatcctctctttctttgccactcatttcagtatcat

SEQ ID NO: 51590 - DNA, 75 bp, Artificial Sequence
  Synthetic
tgctaatcctctctcatcctctctttctttgccactcatttcagtatcatcatcattattattattttggggtgt

SEQ ID NO: 51591 - DNA, 75 bp, Artificial Sequence
  Synthetic
aggcataatgttatttacagcagcagaatggcagactcttgcgattggctaaaggatggtaaaagaagagggaat

SEQ ID NO: 51592 - DNA, 75 bp, Artificial Sequence
  Synthetic
ccacttggtgctggggggtggggactggctgcacctgttgtggattagatgtgaaagacctatttacagattata

SEQ ID NO: 51593 - DNA, 75 bp, Artificial Sequence
  Synthetic
gcaaaatggagaataaaatcgaggtgaccagcaaggatgagatgaacaggtggtttgaagagttcaagaagagta

SEQ ID NO: 51594 - DNA, 75 bp, Artificial Sequence
  Synthetic
tctcaaagaaacacgtgccgcttacgcccacagtgttcacttgagtgttggcaaaatggagaataaaatcgaggt

SEQ ID NO: 51595 - DNA, 75 bp, Artificial Sequence
  Synthetic
tggtttgaagagttcaagaagagtaatggacttgtggacaccttcacaaactcttactccttttgtgagagtgtc

SEQ ID NO: 51596 - DNA, 75 bp, Artificial Sequence
  Synthetic
acaaaaggactccatctatgcatctgctctagtagaggcaaccaagttttgtgcacctatatacgagtgtgcatg

SEQ ID NO: 51597 - DNA, 75 bp, Artificial Sequence
  Synthetic
gtgcacctatatacgagtgtgcatgggtcagctccaccggcatagtcaagaaaggccttgagtggttcgaaaaaa

SEQ ID NO: 51598 - DNA, 75 bp, Artificial Sequence
  Synthetic
aaaaacacacattggctaactcaacagaaagaacctcgaaggttgacagcagtgtgctgtccagtgcccttgccc

SEQ ID NO: 51599 - DNA, 75 bp, Artificial Sequence
  Synthetic
ggggtccccaagatagagcagcttgcaaactaccagcaggctgctctgaagtggaggaaggatattggtttccgt

SEQ ID NO: 51600 - DNA, 75 bp, Artificial Sequence
  Synthetic
gcacctgatctgcttcactatatcaaagcaatgtttaaaactgccttagctctgcttgctctgaccttaactttg

SEQ ID NO: 51601 - DNA, 75 bp, Artificial Sequence
  Synthetic
gtcaatgctaatacggcagccttgagcaacaaagtccttgcagagtataaagtccctggtgagattgtaatgtct

SEQ ID NO: 51602 - DNA, 75 bp, Artificial Sequence
  Synthetic
atgggagactggccttcttgcacatataccggagttacccaacacaatcatgcttcatttgtaaacctgctcaac

SEQ ID NO: 51603 - DNA, 75 bp, Artificial Sequence
  Synthetic
agtaagctctgcaacacctgaaatcaccactgctctattcactctgacctaaaccttgactgcgtgccgccacta

SEQ ID NO: 51604 - DNA, 75 bp, Artificial Sequence
  Synthetic
cagaggtggcgatgagaacccacgcggcccggtgagccgtgagcatgtggaatggtgcagggaatttgtcaaggg

SEQ ID NO: 51605 - DNA, 75 bp, Artificial Sequence
  Synthetic
ggcccggtgagccgtgagcatgtggaatggtgcagggaatttgtcaagggcaagtacatcatggctttcaaccca

SEQ ID NO: 51606 - DNA, 75 bp, Artificial Sequence
  Synthetic
gcgcaggagaaatcactgtactggtagaagttgctgatatggagttacacacaaagaagatcgaaataacaggcc

SEQ ID NO: 51607 - DNA, 75 bp, Artificial Sequence
  Synthetic
aacaggtcttgccaagcttgcagagactgaggggaaaggagtgtttgatgaagccaaaaaaactgttgaggacct

SEQ ID NO: 51608 - DNA, 75 bp, Artificial Sequence
  Synthetic
atctcctgcaaagttaggattcacgtggatgaaccagatgagctaacagtacatgttaaaagtgatgacccagat

SEQ ID NO: 51609 - DNA, 75 bp, Artificial Sequence
  Synthetic
gatgaggttgacaaggccagtgctgacggcatggtgacaaacctcctcaagcacattgcaaaggcacaagagctc

SEQ ID NO: 51610 - DNA, 75 bp, Artificial Sequence
  Synthetic
tgatagaaaatatgtccaaattggacaacacagatgttgaattcaaccacagagaaatagccgatctcaaccagt

SEQ ID NO: 51611 - DNA, 75 bp, Artificial Sequence
  Synthetic
tttcagctcattttactggctttacaaggctggcgtatctccagaaaccttcccaactgtttcacagtttctctt

SEQ ID NO: 51612 - DNA, 75 bp, Artificial Sequence
  Synthetic
caagttgctggttagagtcagttaaaagtttcttttatggtctaaagaacatgcttagtggcatttttggcaatg

SEQ ID NO: 51613 - DNA, 75 bp, Artificial Sequence
  Synthetic
atatgcatcctgctgtgttgacagccggcagaatcagtgagatgggggtctgcttcggaaccatccccgtggcta

SEQ ID NO: 51614 - DNA, 75 bp, Artificial Sequence
  Synthetic
tgagcactccaatgaagtgggggaagaagctctatgagctctttgctgatgattctttccagcagaacaggattt

SEQ ID NO: 51615 - DNA, 75 bp, Artificial Sequence
  Synthetic
cttgggacaaacacagagactaacaatccatgtgctaagacaattgttaaactgtttgaaatccaaaagacagga

SEQ ID NO: 51616 - DNA, 75 bp, Artificial Sequence
  Synthetic
tacttgccagtgaattgagttctgtaaaacgagattctgaacgcgaaggtctaactgatctccttgattatctaa

SEQ ID NO: 51617 - DNA, 75 bp, Artificial Sequence
  Synthetic
tcaatcgtttatttaatccagcttcactaactttgcttttttctttaatttaaacacttaaagggctgtgcggca

SEQ ID NO: 51618 - DNA, 75 bp, Artificial Sequence
  Synthetic
tctcaaagatatcaatcccccctctatccacattgtcactggtggcatagatagcaggccttgacctttgtcaaa

SEQ ID NO: 51619 - DNA, 75 bp, Artificial Sequence
  Synthetic
ctacaattgtaaccatcaaccatgtttatattaactgcttgtataatcctgtcttattaaattcttcttattttc

SEQ ID NO: 51620 - DNA, 75 bp, Artificial Sequence
  Synthetic
atagcaggccttgacctttgtcaaacaatggagttcttgaggagccttgactggacccaagtgctggctggtcag

SEQ ID NO: 51621 - DNA, 75 bp, Artificial Sequence
  Synthetic
caatggagttcttgaggagccttgactggacccaagtgctggctggtcagtatgtgacaaatcccagattcagca

SEQ ID NO: 51622 - DNA, 75 bp, Artificial Sequence
  Synthetic
gcagaatggaaaacaaaatcgaggtgaacagcaaagatgagatgaacaagtggtttgaggagttcaagaaaggaa

SEQ ID NO: 51623 - DNA, 75 bp, Artificial Sequence
  Synthetic
ggcccagtgagccgtgaacatgtggagtggtgcagggaatttgtcaaaggcaagtacatcatggctttcaaccca

SEQ ID NO: 51624 - DNA, 75 bp, Artificial Sequence
  Synthetic
taccacagcatagcggagctaaccatgccgaacaagacagaccactcatatcacaacatcaagcacataactaaa

SEQ ID NO: 51625 - DNA, 75 bp, Artificial Sequence
  Synthetic
tgccgaacaagacagaccactcatatcacaacatcaagcacataactaaaacagcagcacagaaatactatttgg

SEQ ID NO: 51626 - DNA, 75 bp, Artificial Sequence
  Synthetic
tcccgactgtctcacagttcctttttgaactagggaagcaaccaaggggtaccaagaaaatgaagaaggcactct

SEQ ID NO: 51627 - DNA, 75 bp, Artificial Sequence
  Synthetic
agcacaaggacggtagcgcgctatctgtcatacctgatagcagcaatccccgattgctcaagtttgtgcctctca

SEQ ID NO: 51628 - DNA, 75 bp, Artificial Sequence
  Synthetic
aggatgtcatctgacaatgagtggggctccactcttgaagcatccatgctggcaaaggaaatgggcataactatc

SEQ ID NO: 51629 - DNA, 75 bp, Artificial Sequence
  Synthetic
gctccactcttgaagcatccatgctggcaaaggaaatgggcataactatcatcatctggactgtaacagccaatg

SEQ ID NO: 51630 - DNA, 75 bp, Artificial Sequence
  Synthetic
gtgaacctcctgcactcagggcagacacactttgatgcactcagagtgctgccacagcttgagactgatgctaga

SEQ ID NO: 51631 - DNA, 75 bp, Artificial Sequence
  Synthetic
cacactttgatgcactcagagtgctgccacagcttgagactgatgctagaggaacactaagtctagtagacaagg

SEQ ID NO: 51632 - DNA, 75 bp, Artificial Sequence
  Synthetic
tacgaagatcttgccctagcgcttgcggatacagaggaaccacgcaggcgaacgagcctggacgaggttactttg

SEQ ID NO: 51633 - DNA, 75 bp, Artificial Sequence
  Synthetic
cggatacagaggaaccacgcaggcgaacgagcctggacgaggttactttgtctagaagacaggcagaagtgctta

SEQ ID NO: 51634 - DNA, 75 bp, Artificial Sequence
  Synthetic
ccacagacaatggctctggtgaacctagcacagatcctccaaccaccaatgagacaaccccccctccctctgcca

SEQ ID NO: 51635 - DNA, 75 bp, Artificial Sequence
  Synthetic
cctactagagttggtagggttttggactgcatgttcaattgcaaattgtgtgttgagataacctctgagactctc

SEQ ID NO: 51636 - DNA, 75 bp, Artificial Sequence
  Synthetic
actgcatgttcaattgcaaattgtgtgttgagataacctctgagactctcatgctgaggccagaatcaaaagaaa

SEQ ID NO: 51637 - DNA, 75 bp, Artificial Sequence
  Synthetic
agagacaaacagatcaagcaagaattttccagaatgaaactacatgtcaccaaggacctacttgatcatctggat

SEQ ID NO: 51638 - DNA, 75 bp, Artificial Sequence
  Synthetic
tttccagaatgaaactacatgtcaccaaggacctacttgatcatctggatgttggtgggctgctcagagctgcct

SEQ ID NO: 51639 - DNA, 75 bp, Artificial Sequence
  Synthetic
atactggacatctgcactgtgtctcttggagtgatgttatccacttttctgtatggctctaacaataaaaacaag

SEQ ID NO: 51640 - DNA, 75 bp, Artificial Sequence
  Synthetic
ttggagtgatgttatccacttttctgtatggctctaacaataaaaacaagaagaagtttataacaaattgcctgc

SEQ ID NO: 51641 - DNA, 75 bp, Artificial Sequence
  Synthetic
agcaacgaactactgtacaaagcacctagaaaagctcttacaattgtctgcagcgccctatttggaaagcaaata

SEQ ID NO: 51642 - DNA, 75 bp, Artificial Sequence
  Synthetic
ctagaaaagctcttacaattgtctgcagcgccctatttggaaagcaaataaacaagctacagaattgcttcagga

SEQ ID NO: 51643 - DNA, 75 bp, Artificial Sequence
  Synthetic
ggtaaaaacatccttgttcgtgcaaacaatgaactaggtgatgtgtcactgaaggttaacattgtcttggtgcct

SEQ ID NO: 51644 - DNA, 75 bp, Artificial Sequence
  Synthetic
cttagtgtgcaggactacaacggtatgatagagaacatgtcgaagttggacaacactgatgttgagttcaatcac

SEQ ID NO: 51645 - DNA, 75 bp, Artificial Sequence
  Synthetic
gtctcttgttggcaagcaatctccattccagaacgcctacaacgtcaagggcaatgccaccagtgctaacattat

SEQ ID NO: 51646 - DNA, 75 bp, Artificial Sequence
  Synthetic
tgatagagaacatgtcgaagttggacaacactgatgttgagttcaatcacagagagatagctgacctcaaccaac

SEQ ID NO: 51647 - DNA, 75 bp, Artificial Sequence
  Synthetic
gcaatgccaccagtgctaacattatctaaaatgcaaactgctctgtatccagctttcttccttctgaaccgccac

SEQ ID NO: 51648 - DNA, 75 bp, Artificial Sequence
  Synthetic
aaacaatggttcccagaagacagcctaactcatagatgtacgagaagtgtcacgaatgcagaagagcatgtaata

SEQ ID NO: 51649 - DNA, 75 bp, Artificial Sequence
  Synthetic
ttattttacttgcttatataaccttattttattaacttttctctattttcttttgtcttaaacacttggagggct

SEQ ID NO: 51650 - DNA, 75 bp, Artificial Sequence
  Synthetic
tctcaaagaaatacttgcggcacgtcagtacgtaagtatcaactttgagggtgctagtggagtgttcagcagtca

SEQ ID NO: 51651 - DNA, 75 bp, Artificial Sequence
  Synthetic
taactcatagatgtacgagaagtgtcacgaatgcagaagagcatgtaatatctgagtttttcaagaagaaggaca

SEQ ID NO: 51652 - DNA, 75 bp, Artificial Sequence
  Synthetic
gtgctagtggagtgttcagcagtcaacatgttgtgtcatatcaaacacatattattgttttgcattatcctttat

SEQ ID NO: 51653 - DNA, 75 bp, Artificial Sequence
  Synthetic
acatgttgtgtcatatcaaacacatattattgttttgcattatcctttatcatcaacaatggaacacaggagctt

SEQ ID NO: 51654 - DNA, 75 bp, Artificial Sequence
  Synthetic
aaacccagtgctgtaacacagtttgtacacgaggacgagcagtgtcaagagcaaataagcttagacgatctaatg

SEQ ID NO: 51655 - DNA, 75 bp, Artificial Sequence
  Synthetic
ggcaatgtgttgtcctatgcgcacaatttgtacctgagcaaaaccagtctgaacatgtcctcggaagacatctca

SEQ ID NO: 51656 - DNA, 75 bp, Artificial Sequence
  Synthetic
atttgtacctgagcaaaaccagtctgaacatgtcctcggaagacatctcacaactcttgatagaaatcaaaaggc

SEQ ID NO: 51657 - DNA, 75 bp, Artificial Sequence
  Synthetic
catcagccaacatccatcaccgcagcctccagccccgggtcgcccgccaccaccgcgccgcccgaaagatcagtc

SEQ ID NO: 51658 - DNA, 75 bp, Artificial Sequence
  Synthetic
cctccagccccgggtcgcccgccaccaccgcgccgcccgaaagatcagtcacaccctcacacactccaaccacct

SEQ ID NO: 51659 - DNA, 75 bp, Artificial Sequence
  Synthetic
gatagtatagaaagcaacatgaggcagcttttcgcaatactaccacctgactgtgcaagagaatgcgaggtcctc

SEQ ID NO: 51660 - DNA, 75 bp, Artificial Sequence
  Synthetic
agcttttcgcaatactaccacctgactgtgcaagagaatgcgaggtcctctttgatgatatcagaaactcaccta

SEQ ID NO: 51661 - DNA, 75 bp, Artificial Sequence
  Synthetic
gccaccgcccagagcccagagccagcaagcgcagcccaaccatcaccaaccataccgaaaccaaccacacccgac

SEQ ID NO: 51662 - DNA, 75 bp, Artificial Sequence
  Synthetic
caagcgcagcccaaccatcaccaaccataccgaaaccaaccacacccgacccgaccagcgaagccctaagcaccc

SEQ ID NO: 51663 - DNA, 75 bp, Artificial Sequence
  Synthetic
gaaggcctgtttgcaagttgctatggctggcaatacattccagaagacatcaaaccgagtctaacaatgttgata

SEQ ID NO: 51664 - DNA, 75 bp, Artificial Sequence
  Synthetic
gctggcaatacattccagaagacatcaaaccgagtctaacaatgttgatacagaccttgttccctgataagtttg

SEQ ID NO: 51665 - DNA, 75 bp, Artificial Sequence
  Synthetic
agcccaagcaagcctgtagagactcaaagcacacgccacactgcaagagagctcctctcagtaacaggcacggag

SEQ ID NO: 51666 - DNA, 75 bp, Artificial Sequence
  Synthetic
aaagcacacgccacactgcaagagagctcctctcagtaacaggcacggaggcagaacagctcatcacacagacaa

SEQ ID NO: 51667 - DNA, 75 bp, Artificial Sequence
  Synthetic
aagggactggagtggttcgaaaaaaatgcaggaaccattaaatcttgggatgaaagctacactgagctgaaagtt

SEQ ID NO: 51668 - DNA, 75 bp, Artificial Sequence
  Synthetic
cctgacttctcattgacacagaaagtgcattttaaaagaaatcagatacctagtgttgaaaatgtgcaagtctca

SEQ ID NO: 51669 - DNA, 75 bp, Artificial Sequence
  Synthetic
tgaaagctacactgagctgaaagttgaggtccctaaaatagaacagcttgccaattaccaacaggctgctctcaa

SEQ ID NO: 51670 - DNA, 75 bp, Artificial Sequence
  Synthetic
tgcattttaaaagaaatcagatacctagtgttgaaaatgtgcaagtctcaattgatgcaacactacctgagtccg

SEQ ID NO: 51671 - DNA, 75 bp, Artificial Sequence
  Synthetic
agcaaccccgaccccacactggcaacaaccagccgctccatcaacagcattaaccccaaggggccagagtcaacc

SEQ ID NO: 51672 - DNA, 75 bp, Artificial Sequence
  Synthetic
caaccagccgctccatcaacagcattaaccccaaggggccagagtcaaccagagccacaccccaatccacatccc

SEQ ID NO: 51673 - DNA, 75 bp, Artificial Sequence
  Synthetic
ccgcttagtgaggtccactctatagagagaattatggagaacttcacccgacttatgtgtgacgcaagaccttct

SEQ ID NO: 51674 - DNA, 75 bp, Artificial Sequence
  Synthetic
agagaattatggagaacttcacccgacttatgtgtgacgcaagaccttctggaggaaaagagggcacagagcagg

SEQ ID NO: 51675 - DNA, 75 bp, Artificial Sequence
  Synthetic
accccaggcactctggaggcaattattcatccaacaaatagatccaaaagaaaccttggtactgagataatcctg

SEQ ID NO: 51676 - DNA, 75 bp, Artificial Sequence
  Synthetic
ttcatccaacaaatagatccaaaagaaaccttggtactgagataatcctgactctcccacaaggtctcaagaaat

SEQ ID NO: 51677 - DNA, 75 bp, Artificial Sequence
  Synthetic
ctctctttcaaagactacagagaaagaggtatagttgaagaaaaccacatgagattcagcgaagaggaccaactt

SEQ ID NO: 51678 - DNA, 75 bp, Artificial Sequence
  Synthetic
gaggtatagttgaagaaaaccacatgagattcagcgaagaggaccaacttgaaaaaagacagctgctgcttgtag

SEQ ID NO: 51679 - DNA, 75 bp, Artificial Sequence
  Synthetic
ctagtgcggaagaaccatgtagacgatctagtctggatgaggttaccctgtccaagaaacaagcagagatgttga

SEQ ID NO: 51680 - DNA, 75 bp, Artificial Sequence
  Synthetic
aatcaatgttcagtcaactttcaaaccaacagtttcagctgctaacatagcacttagctggagttcagttgaaca

SEQ ID NO: 51681 - DNA, 75 bp, Artificial Sequence
  Synthetic
gagggtctgcttgagtggtgtacacggatcttgggacaaacctgtgatgatgattactttcaaaagagaataact

SEQ ID NO: 51682 - DNA, 75 bp, Artificial Sequence
  Synthetic
aagtggaaagacattcttaaactactggagttattaggaattaaatgctcatttattgcgtgtgcagattgctca

SEQ ID NO: 51683 - DNA, 75 bp, Artificial Sequence
  Synthetic
tggagttattaggaattaaatgctcatttattgcgtgtgcagattgctcatccaccccacctgacaggtggtgga

SEQ ID NO: 51684 - DNA, 75 bp, Artificial Sequence
  Synthetic
ggatcttgggacaaacctgtgatgatgattactttcaaaagagaataactgaattcttcataacaggtgttggtt

SEQ ID NO: 51685 - DNA, 75 bp, Artificial Sequence
  Synthetic
gcaccaactcacaaaggagcaccaccaactgagccttttaagtcttactatgctaagggattcatcacaatggat

SEQ ID NO: 51686 - DNA, 75 bp, Artificial Sequence
  Synthetic
caactgagccttttaagtcttactatgctaagggattcatcacaatggattcgggctacttttctgctaaatgct

SEQ ID NO: 51687 - DNA, 75 bp, Artificial Sequence
  Synthetic
aacaagctttctagaaattcacccactgaagttacagacatagttgtcggagctataagcacccagaaggttagg

SEQ ID NO: 51688 - DNA, 75 bp, Artificial Sequence
  Synthetic
ctgaagttacagacatagttgtcggagctataagcacccagaaggttaggagctatcttaaggcaggcactgcaa

SEQ ID NO: 51689 - DNA, 75 bp, Artificial Sequence
  Synthetic
cagtacgtaagtgttaactttgaggaagtggattgagcatctcaattgcaacatgcctgttagcattatgcatat

SEQ ID NO: 51690 - DNA, 75 bp, Artificial Sequence
  Synthetic
tcatctaagatgcccattactccaggcccaaagtactccaatctcaagaacattaactgtataaacctaaaagtg

SEQ ID NO: 51691 - DNA, 75 bp, Artificial Sequence
  Synthetic
aagtggattgagcatctcaattgcaacatgcctgttagcattatgcatatatcattgatgtgtgcagttctttgc

SEQ ID NO: 51692 - DNA, 75 bp, Artificial Sequence
  Synthetic
aaagggcacatactcagtaggccaacaggcttgatgttgccaaacaaccttgagcaggcaatgcgtaaaggcctg

SEQ ID NO: 51693 - DNA, 75 bp, Artificial Sequence
  Synthetic
caggcttgatgttgccaaacaaccttgagcaggcaatgcgtaaaggcctggtggaaggtgttgttatttccaaag

SEQ ID NO: 51694 - DNA, 75 bp, Artificial Sequence
  Synthetic
gcccaaagtactccaatctcaagaacattaactgtataaacctaaaagtgtcaactgataaagaacacaatgaag

SEQ ID NO: 51695 - DNA, 75 bp, Artificial Sequence
  Synthetic
acacaacaaaacaaacgttgtgacaacgcccggtgacagccagagccctgaaccgctagtgagcacgaccctgcc

SEQ ID NO: 51696 - DNA, 75 bp, Artificial Sequence
  Synthetic
catgtcctggttagatcacatgtctgtgactactcccttgatgcagatggaatgataaagcttccccagataact

SEQ ID NO: 51697 - DNA, 75 bp, Artificial Sequence
  Synthetic
acgcccggtgacagccagagccctgaaccgctagtgagcacgaccctgcctgtcacgctggactcctccactgtc

SEQ ID NO: 51698 - DNA, 75 bp, Artificial Sequence
  Synthetic
actgacgaatttgaacagacaaagtacaagcatgagctcacacagaacattgtaacaggtgaaaaaatgctgttg

SEQ ID NO: 51699 - DNA, 75 bp, Artificial Sequence
  Synthetic
acaagcatgagctcacacagaacattgtaacaggtgaaaaaatgctgttgagctggctgactgaggatatcaaat

SEQ ID NO: 51700 - DNA, 75 bp, Artificial Sequence
  Synthetic
gtgactactcccttgatgcagatggaatgataaagcttccccagataactcacgagggaacttttatacctggaa

SEQ ID NO: 51701 - DNA, 75 bp, Artificial Sequence
  Synthetic
atcccccccaatcaccactgagggcctgtctccgtcagaagccacgtcagagctccccgtgacaactggcatagg

SEQ ID NO: 51702 - DNA, 75 bp, Artificial Sequence
  Synthetic
ttgatcaccaactgcgtcataaagggaagagaggtcaggaaggggcagtcggctctcagacagtataagacagag

SEQ ID NO: 51703 - DNA, 75 bp, Artificial Sequence
  Synthetic
gaagagaggtcaggaaggggcagtcggctctcagacagtataagacagagataagagtgggtcaggcatcttctg

SEQ ID NO: 51704 - DNA, 75 bp, Artificial Sequence
  Synthetic
actaccaacctgtcagaaaagattgaattacttgcatacaatatgcagctcaccagtcattgtggaaactgtcat

SEQ ID NO: 51705 - DNA, 75 bp, Artificial Sequence
  Synthetic
tccagcacacaggcagccggagacacctccacaccaacagtacgcacaagtccacctaacagccctagcacacca

SEQ ID NO: 51706 - DNA, 75 bp, Artificial Sequence
  Synthetic
aattacttgcatacaatatgcagctcaccagtcattgtggaaactgtcatcctagtggcgttagcatcaacaaca

SEQ ID NO: 51707 - DNA, 75 bp, Artificial Sequence
  Synthetic
actcagctgatcaagacagaaaatgctgaaatacatggtgatgactatggcgggcccggagagaaaataaccatc

SEQ ID NO: 51708 - DNA, 75 bp, Artificial Sequence
  Synthetic
ctgaaatacatggtgatgactatggcgggcccggagagaaaataaccatctgcaacggctctactattgtagaac

SEQ ID NO: 51709 - DNA, 75 bp, Artificial Sequence
  Synthetic
gagccttaagtcagaagaaacatcagcaccgtcaaaatcaggcaaagagagtccagcagccagcagccctcaccc

SEQ ID NO: 51710 - DNA, 75 bp, Artificial Sequence
  Synthetic
gaaaacaggggctttgaggatagtaacgaatgcctaactgacttagacaggcttgtcaggctcacattaccaggg

SEQ ID NO: 51711 - DNA, 75 bp, Artificial Sequence
  Synthetic
acgaatgcctaactgacttagacaggcttgtcaggctcacattaccagggaaaacagagaaggaaagaagaatca

SEQ ID NO: 51712 - DNA, 75 bp, Artificial Sequence
  Synthetic
cccataacagctcagggacccactgaaaacaacagccataacaccactggacagcttgagtctgtgacacaatcg

SEQ ID NO: 51713 - DNA, 75 bp, Artificial Sequence
  Synthetic
ttcaaactatgcgaaaatagtgcttcaggaaagggttgtgaaattgacagtactccagtaaaatgtaagcaaggc

SEQ ID NO: 51714 - DNA, 75 bp, Artificial Sequence
  Synthetic
gattgtataaaatacccaacaggacaacttatcacacacgggaaagttgctgcaaagctcaaagaaggaagccta

SEQ ID NO: 51715 - DNA, 75 bp, Artificial Sequence
  Synthetic
aacttatcacacacgggaaagttgctgcaaagctcaaagaaggaagcctaagagataagagtgaagagaatcaga

SEQ ID NO: 51716 - DNA, 75 bp, Artificial Sequence
  Synthetic
caggaaagggttgtgaaattgacagtactccagtaaaatgtaagcaaggcttctgtttgaaaataacccaagaag

SEQ ID NO: 51717 - DNA, 75 bp, Artificial Sequence
  Synthetic
tgtcacctccatagccattcaagacacacaccccagcccaacaaataggtctaaaagaaaccttgaaatggagat

SEQ ID NO: 51718 - DNA, 75 bp, Artificial Sequence
  Synthetic
tgcgactcaagctgtgaaatgatgataccaaaagggtctggtgatatcctggtagattgctctggaggacagcag

SEQ ID NO: 51719 - DNA, 75 bp, Artificial Sequence
  Synthetic
taccaaaagggtctggtgatatcctggtagattgctctggaggacagcagcacttcctacaggacaacttggtcg

SEQ ID NO: 51720 - DNA, 75 bp, Artificial Sequence
  Synthetic
ctgaaggaatactccacttatgcgaaaggagtaatttctaactctcttaaaaacatttcgaagcagagcagatca

SEQ ID NO: 51721 - DNA, 75 bp, Artificial Sequence
  Synthetic
aagaaatactatggcaaggtgctcaggcttttgcaactcaccttagaggaggacactgaaggcctactagaatgg

SEQ ID NO: 51722 - DNA, 75 bp, Artificial Sequence
  Synthetic
aaggagtaatttctaactctcttaaaaacatttcgaagcagagcagatcaaagtgttctgtgccaaaatcctggc

SEQ ID NO: 51723 - DNA, 75 bp, Artificial Sequence
  Synthetic
tgcagaatgtcaaaccaccccaagacaaccatggccttcctcttttggttcagctttggctatgtcataacctgc

SEQ ID NO: 51724 - DNA, 75 bp, Artificial Sequence
  Synthetic
caaccatggccttcctcttttggttcagctttggctatgtcataacctgcatcttttgcaaggttatcttttatg

SEQ ID NO: 51725 - DNA, 75 bp, Artificial Sequence
  Synthetic
ctcattaatattagaaactccttgaaggccaggtctgaatttgttagaaataacgataaattacttataaggtcg

SEQ ID NO: 51726 - DNA, 75 bp, Artificial Sequence
  Synthetic
aggccaggtctgaatttgttagaaataacgataaattacttataaggtcgaaggaggagctaaaaaaatactttg

SEQ ID NO: 51727 - DNA, 75 bp, Artificial Sequence
  Synthetic
cttaagcctcagacctgcactatatgtgaagcaactcctgttaatgcaatagatgctgaaatgcatgatcttaac

SEQ ID NO: 51728 - DNA, 75 bp, Artificial Sequence
  Synthetic
gtgaagcaactcctgttaatgcaatagatgctgaaatgcatgatcttaactgtagctacaacatatgcccttatt

SEQ ID NO: 51729 - DNA, 75 bp, Artificial Sequence
  Synthetic
gtcgattgcatactattcaaggaagttgcagcagaatgtatgaaaaggcacatgagtacaccatacgaggggatc

SEQ ID NO: 51730 - DNA, 75 bp, Artificial Sequence
  Synthetic
ttgcagcagaatgtatgaaaaggcacatgagtacaccatacgaggggatcgtggacaccctagtttcacttataa

SEQ ID NO: 51731 - DNA, 75 bp, Artificial Sequence
  Synthetic
cagggcttcagttgatcaatgtcactcgacattcaactagaatagctgatacacctgggcccaagattaccaacc

SEQ ID NO: 51732 - DNA, 75 bp, Artificial Sequence
  Synthetic
cctaagaggaaggaaaagatagaggaaacagagctgtacttaaatttggaaaggataccctggtttgtcagaaag

SEQ ID NO: 51733 - DNA, 75 bp, Artificial Sequence
  Synthetic
aaacagagctgtacttaaatttggaaaggataccctggtttgtcagaaagctcttgcaggtatcagaatcaacag

SEQ ID NO: 51734 - DNA, 75 bp, Artificial Sequence
  Synthetic
atttgtgaaaccttcttgaggtgctgcacggagttcaacaggtcaggcattaagttggttaaggtaaggcattgt

SEQ ID NO: 51735 - DNA, 75 bp, Artificial Sequence
  Synthetic
gcacggagttcaacaggtcaggcattaagttggttaaggtaaggcattgtgacataaacctttctgttaaattgc

SEQ ID NO: 51736 - DNA, 75 bp, Artificial Sequence
  Synthetic
tccctcaagttgcagttaacctctcaaactgtcacgttacaatcaaatcacatgtctgtgactattctttagaca

SEQ ID NO: 51737 - DNA, 75 bp, Artificial Sequence
  Synthetic
acagtatctttgtcgcctgtgcaatcagcacccattggtcaggaaagaacggtagtaacgtaccaagtcagagaa

SEQ ID NO: 51738 - DNA, 75 bp, Artificial Sequence
  Synthetic
cagcacccattggtcaggaaagaacggtagtaacgtaccaagtcagagaaagttacacaggcatgtgtcttttca

SEQ ID NO: 51739 - DNA, 75 bp, Artificial Sequence
  Synthetic
cattcatcatgaaggaacctttattccaggaacttacaagatagtgatagacaaaaaaaataagctgaatgacag

SEQ ID NO: 51740 - DNA, 75 bp, Artificial Sequence
  Synthetic
gaacttttaaaaggccctttttacctaaatagaagacaggctgtcctaggttcatcatacctctacattgtggtt

SEQ ID NO: 51741 - DNA, 75 bp, Artificial Sequence
  Synthetic
taaatagaagacaggctgtcctaggttcatcatacctctacattgtggttacactatacattcaggtgctacagc

SEQ ID NO: 51742 - DNA, 75 bp, Artificial Sequence
  Synthetic
gacagtgttggtaacattttctttcctggactttcagtttgtaaaacatgttccatcggcagcataaatggcttt

SEQ ID NO: 51743 - DNA, 75 bp, Artificial Sequence
  Synthetic
ctggactttcagtttgtaaaacatgttccatcggcagcataaatggctttgaaattgaatcccacaaatgctatt

SEQ ID NO: 51744 - DNA, 75 bp, Artificial Sequence
  Synthetic
gacagagattaggattggcaaggcatcaactggttctagaagattgctttctgaagaatctggtgatgactgcat

SEQ ID NO: 51745 - DNA, 75 bp, Artificial Sequence
  Synthetic
gacatagaaaatcactccatggctctatcagaagatgcattgaaagagcttactgccaccttagagggtagattt

SEQ ID NO: 51746 - DNA, 75 bp, Artificial Sequence
  Synthetic
tatcagaagatgcattgaaagagcttactgccaccttagagggtagatttgaagcatcatacaagatacgctctg

SEQ ID NO: 51747 - DNA, 75 bp, Artificial Sequence
  Synthetic
gctcaccagtctcatttgagtgtttgtaaaaagaggaaaactggaagcaatgtcatgttagctgtctgcaagcgc

SEQ ID NO: 51748 - DNA, 75 bp, Artificial Sequence
  Synthetic
gtaaaaagaggaaaactggaagcaatgtcatgttagctgtctgcaagcgcatgtgttttagagctactttaaagg

SEQ ID NO: 51749 - DNA, 75 bp, Artificial Sequence
  Synthetic
ttcattagtgtcttttctgggctgaacctagtttacggcttcctcatgaaggataacctgcttgcaaactcacaa

SEQ ID NO: 51750 - DNA, 75 bp, Artificial Sequence
  Synthetic
gtagatcaaagactgggtagtgagatggggtgttacactatcaatagggtgaagtcattcaagctgtgcgaaaac

SEQ ID NO: 51751 - DNA, 75 bp, Artificial Sequence
  Synthetic
acctagtttacggcttcctcatgaaggataacctgcttgcaaactcacaacaacagaacaaacaattacaaatgc

SEQ ID NO: 51752 - DNA, 75 bp, Artificial Sequence
  Synthetic
gaagtcattcaagctgtgcgaaaacagtgcaacagggaagagctgtgaaatagacagtatcccagttaagtgcag

SEQ ID NO: 51753 - DNA, 75 bp, Artificial Sequence
  Synthetic
gtgtgcattctaatattagttgtctgtgttgttagcacctcagccgtagagatggagaacttgccagcaggtact

SEQ ID NO: 51754 - DNA, 75 bp, Artificial Sequence
  Synthetic
gtgttgttagcacctcagccgtagagatggagaacttgccagcaggtacttgggagaaggaagaggacctaacaa

SEQ ID NO: 51755 - DNA, 75 bp, Artificial Sequence
  Synthetic
cttggaaagaagttctcaacaagttgcagaagaatcgaggacaacattgctaggctatacttacaaacaactgtc

SEQ ID NO: 51756 - DNA, 75 bp, Artificial Sequence
  Synthetic
gcagaagaatcgaggacaacattgctaggctatacttacaaacaactgtctactgttcggttagggatgtggagg

SEQ ID NO: 51757 - DNA, 75 bp, Artificial Sequence
  Synthetic
tacgaggcttttgtgcttagaaagccactttttttggacagtactgccaagagcatgaaaagcctgttaaattca

SEQ ID NO: 51758 - DNA, 75 bp, Artificial Sequence
  Synthetic
cactttttttggacagtactgccaagagcatgaaaagcctgttaaattcaacaagtttggaaacaagcctgtcaa

SEQ ID NO: 51759 - DNA, 75 bp, Artificial Sequence
  Synthetic
ccctgctttactgtttatggcactttcgtcaacagtgacaggcagctaatatttgacatctacaatgtgcatatt

SEQ ID NO: 51760 - DNA, 75 bp, Artificial Sequence
  Synthetic
tcgtcaacagtgacaggcagctaatatttgacatctacaatgtgcatatttacaacaaggaaatggacaacttcg

SEQ ID NO: 51761 - DNA, 75 bp, Artificial Sequence
  Synthetic
ttccattattgggtaaaatggctatttatatttgcagaatgtcgaatcaccctaagacaaccatggctttcctct

SEQ ID NO: 51762 - DNA, 75 bp, Artificial Sequence
  Synthetic
gcttcgactgcaaatatagcgctcagttggagctcagtagaacacagaggcaataagattcttgttacaggtaga

SEQ ID NO: 51763 - DNA, 75 bp, Artificial Sequence
  Synthetic
gttggagctcagtagaacacagaggcaataagattcttgttacaggtagatcagagtcgattatgaaactggaag

SEQ ID NO: 51764 - DNA, 75 bp, Artificial Sequence
  Synthetic
tgggagcttgatctgatgaactcactctgctctgatgaaaggagagatgagagaactgcaaggttgctgttaggt

SEQ ID NO: 51765 - DNA, 75 bp, Artificial Sequence
  Synthetic
tctgctctgatgaaaggagagatgagagaactgcaaggttgctgttaggttgccctaatgttagaaaggctgcaa

SEQ ID NO: 51766 - DNA, 75 bp, Artificial Sequence
  Synthetic
aagacactcactgtatcagtcatggacttatctcagatgtattccactgtcttcgagtacttatcaggcgaccgg

SEQ ID NO: 51767 - DNA, 75 bp, Artificial Sequence
  Synthetic
atgcaatagatgctgaaatgcatgaccttaactgcagttacaacatatgtccctattgtgcatctagactaacct

SEQ ID NO: 51768 - DNA, 75 bp, Artificial Sequence
  Synthetic
acaaacagcgttgcttcagaggtgtcagataggaggtcttatagctcaagcaagagtagaatccgtagcattttc

SEQ ID NO: 51769 - DNA, 75 bp, Artificial Sequence
  Synthetic
cagataggaggtcttatagctcaagcaagagtagaatccgtagcattttcggaaggtataactctcagaaaaaac

SEQ ID NO: 51770 - DNA, 75 bp, Artificial Sequence
  Synthetic
gacaggagtgatgacgaccaaaaactagcagagaagatagacattgttaggaaagagctttcagaagccaagcta

SEQ ID NO: 51771 - DNA, 75 bp, Artificial Sequence
  Synthetic
acttatctcagatgtattccactgtcttcgagtacttatcaggcgaccggcaagtagaggagtggcctaaagcaa

SEQ ID NO: 51772 - DNA, 75 bp, Artificial Sequence
  Synthetic
ctccacaaggcgtggccccattcaaggaactggaggtgcaaccccacgtggtgttggggagttggaactggttgc

SEQ ID NO: 51773 - DNA, 75 bp, Artificial Sequence
  Synthetic
ggaactggaggtgcaaccccacgtggtgttggggagttggaactggttgcacttgctgtggattggatgtgaaaa

SEQ ID NO: 51774 - DNA, 75 bp, Artificial Sequence
  Synthetic
tatcaacaagcaataactgacgtgtgtcagttctctgagtacactcccagcaaagacagtgttttaaaagattgc

SEQ ID NO: 51775 - DNA, 75 bp, Artificial Sequence
  Synthetic
gtcagttctctgagtacactcccagcaaagacagtgttttaaaagattgcctccaaatcatacgaaagaatccta

SEQ ID NO: 51776 - DNA, 75 bp, Artificial Sequence
  Synthetic
gcagctggctgattgtgctgcttgtgctgttcgcaatttcattatcaccagttcaatcagcacccatcagtcatg

SEQ ID NO: 51777 - DNA, 75 bp, Artificial Sequence
  Synthetic
actgaagccatagtgtgtgttgaactcacaagccaggaaaggcaatgcagtcttatagaagcaggcacaagattt

SEQ ID NO: 51778 - DNA, 75 bp, Artificial Sequence
  Synthetic
tcacaagccaggaaaggcaatgcagtcttatagaagcaggcacaagatttaacttgggccctgttaccatcactt

SEQ ID NO: 51779 - DNA, 75 bp, Artificial Sequence
  Synthetic
atgagcaaatatcctccagaaaacatagacaaggctagaagggatccaaaaaattgggttagcatatctgaagtc

SEQ ID NO: 51780 - DNA, 75 bp, Artificial Sequence
  Synthetic
ctctttgtactaggaagtatcctgtttatagtctcttgtctaatgaaagggctggttgacagtattggcaacatc

SEQ ID NO: 51781 - DNA, 75 bp, Artificial Sequence
  Synthetic
tagacaaggctagaagggatccaaaaaattgggttagcatatctgaagtcacagagacaacaagcatagttgctt

SEQ ID NO: 51782 - DNA, 75 bp, Artificial Sequence
  Synthetic
ttcttccctgggctgtccatttgcaaaacgtgctctataggtagtatcaatggctttgaaattgagtctcataag

SEQ ID NO: 51783 - DNA, 75 bp, Artificial Sequence
  Synthetic
ctgcatccaagagtagaagaaggcttcttcgaccttatgcatgtgcagaaagtgctttctgcaagcactgtgtgt

SEQ ID NO: 51784 - DNA, 75 bp, Artificial Sequence
  Synthetic
acagagaataagaagatagtcaaaatgcttcgaggaaagttgaagaagctaggtgccatctctacaaacgttgaa

SEQ ID NO: 51785 - DNA, 75 bp, Artificial Sequence
  Synthetic
tgcttcgaggaaagttgaagaagctaggtgccatctctacaaacgttgaaattgggaaaagggactgtctagacc

SEQ ID NO: 51786 - DNA, 75 bp, Artificial Sequence
  Synthetic
tcttcgaccttatgcatgtgcagaaagtgctttctgcaagcactgtgtgtaaattgcagagctgcacgcatggtg

SEQ ID NO: 51787 - DNA, 75 bp, Artificial Sequence
  Synthetic
aaaataaatggcaactcatttcacaaaattgagccgaacctaaatacatcatggatgtcttgggacggctgtgat

SEQ ID NO: 51788 - DNA, 75 bp, Artificial Sequence
  Synthetic
aaattgagccgaacctaaatacatcatggatgtcttgggacggctgtgatcttgattactactgcaacatgggag

SEQ ID NO: 51789 - DNA, 75 bp, Artificial Sequence
  Synthetic
aacggcatttttgagccttctaagctatccttttaccactggaaagaattggttaaaaagaacattgaagaagtt

SEQ ID NO: 51790 - DNA, 75 bp, Artificial Sequence
  Synthetic
tatccttttaccactggaaagaattggttaaaaagaacattgaagaagttttgttaacagaagatggaaacctga

SEQ ID NO: 51791 - DNA, 75 bp, Artificial Sequence
  Synthetic
tttgtgaacctgctcaacattgaaactgactatacaaagaacttccactttcactcaaagagagtcacagcacat

SEQ ID NO: 51792 - DNA, 75 bp, Artificial Sequence
  Synthetic
ctgactatacaaagaacttccactttcactcaaagagagtcacagcacatggagagacgccccagctagacctta

SEQ ID NO: 51793 - DNA, 75 bp, Artificial Sequence
  Synthetic
aagaaactaaaattcatgaacatacattcccctgagctcatgcccgacaactgtatcttttcagaagctgagttc

SEQ ID NO: 51794 - DNA, 75 bp, Artificial Sequence
  Synthetic
ctaacaaatttctgtcatcaggaatgccaggttacggagactgagtgcctctgcccttatgaagccctagtactc

SEQ ID NO: 51795 - DNA, 75 bp, Artificial Sequence
  Synthetic
attcccctgagctcatgcccgacaactgtatcttttcagaagctgagttccaagaactaataaagcttaagaagc

SEQ ID NO: 51796 - DNA, 75 bp, Artificial Sequence
  Synthetic
gctgacatggagctgcacactaaaaagattgagatatcaggtttgaaatttgctagcctgacctgcacgggctgc

SEQ ID NO: 51797 - DNA, 75 bp, Artificial Sequence
  Synthetic
agattgagatatcaggtttgaaatttgctagcctgacctgcacgggctgctatgcttgtagctcaggtatctcct

SEQ ID NO: 51798 - DNA, 75 bp, Artificial Sequence
  Synthetic
atttctgcctggaccaagagcataacaacttgcaaggactttgcaaacataaatgacagggtgcaaaaattcata

SEQ ID NO: 51799 - DNA, 75 bp, Artificial Sequence
  Synthetic
caacttgcaaggactttgcaaacataaatgacagggtgcaaaaattcatacaccaactttctgaggaactctacg

SEQ ID NO: 51800 - DNA, 75 bp, Artificial Sequence
  Synthetic
aagagtgatgatccggatgtagttgcagccagctcaagcctgatggccagaaaaattgaatttggaactgatagc

SEQ ID NO: 51801 - DNA, 75 bp, Artificial Sequence
  Synthetic
cagccagctcaagcctgatggccagaaaaattgaatttggaactgatagcacatttaaagctttctcgtccatgc

SEQ ID NO: 51802 - DNA, 75 bp, Artificial Sequence
  Synthetic
agtgtcagtttcaccaaggaggaagtgttaataaaaaggctagaaaagaatttccttaagcaacataatcttgaa

SEQ ID NO: 51803 - DNA, 75 bp, Artificial Sequence
  Synthetic
tgttaataaaaaggctagaaaagaatttccttaagcaacataatcttgaagtaatggagacagtcaacctcattt

SEQ ID NO: 51804 - DNA, 75 bp, Artificial Sequence
  Synthetic
gtcatggacttgtctcagatgtactctcctgtcttcgagtacttatcaggtgacagacaagtagaagagtggccc

SEQ ID NO: 51805 - DNA, 75 bp, Artificial Sequence
  Synthetic
tgcagcaaagaggacacacaaaagtgtgtaaatgcaaaacttgagcagcctcagagtatacttattgaacataaa

SEQ ID NO: 51806 - DNA, 75 bp, Artificial Sequence
  Synthetic
tcttacctggtcagacatccagaaatacttgactgtgggctgaaagaagactgtaggctccccctgctggatctg

SEQ ID NO: 51807 - DNA, 75 bp, Artificial Sequence
  Synthetic
tacttgactgtgggctgaaagaagactgtaggctccccctgctggatctgtctgtttcaaaactattggtgtctc

SEQ ID NO: 51808 - DNA, 75 bp, Artificial Sequence
  Synthetic
gtgtaaatgcaaaacttgagcagcctcagagtatacttattgaacataaaggcaccataattgggaagcaaaatg

SEQ ID NO: 51809 - DNA, 75 bp, Artificial Sequence
  Synthetic
ttttatggactaaaaaacatgttgggtggtatcttcggcaacgttatcttgggcatcatcatgttccttgctcct

SEQ ID NO: 51810 - DNA, 75 bp, Artificial Sequence
  Synthetic
gtggtatcttcggcaacgttatcttgggcatcatcatgttccttgctccttttgccttgttactgctcttcttcc

SEQ ID NO: 51811 - DNA, 75 bp, Artificial Sequence
  Synthetic
gggtttctggtgaagtatgctgtcacattgttcacatcaaacggcgagccattctcactcagcctgaatgatggt

SEQ ID NO: 51812 - DNA, 75 bp, Artificial Sequence
  Synthetic
cattgttcacatcaaacggcgagccattctcactcagcctgaatgatggtgggctggaccttgatctccataaaa

SEQ ID NO: 51813 - DNA, 75 bp, Artificial Sequence
  Synthetic
gggctatttaagtacaaacacatcaaagatgatgaagaatcaggctacaaaaggattattgaaaggttaaataac

SEQ ID NO: 51814 - DNA, 75 bp, Artificial Sequence
  Synthetic
gtggaactcaccagtcaggaaaggcagtgtagcttgattgaggcgggcacaaggttcaatttaggttctgtgacc

SEQ ID NO: 51815 - DNA, 75 bp, Artificial Sequence
  Synthetic
ggcttatcaggaaatggatatgatttcatctggacaactcaaatgattgcaaatagcaatttcaacgtttgtaag

SEQ ID NO: 51816 - DNA, 75 bp, Artificial Sequence
  Synthetic
tcatctggacaactcaaatgattgcaaatagcaatttcaacgtttgtaagaggttgacaggcaggagtaccggag

SEQ ID NO: 51817 - DNA, 75 bp, Artificial Sequence
  Synthetic
aagatgatgaagaatcaggctacaaaaggattattgaaaggttaaataacaagaaaggtaagaacaagttatttg

SEQ ID NO: 51818 - DNA, 75 bp, Artificial Sequence
  Synthetic
acacacattggctaatacagactagacttaacagggcgcaacagcagcaaaccccttccccgtcgcactactaaa

SEQ ID NO: 51819 - DNA, 75 bp, Artificial Sequence
  Synthetic
acttaacagggcgcaacagcagcaaaccccttccccgtcgcactactaaatcaactgggcaaccacacactcttt

SEQ ID NO: 51820 - DNA, 75 bp, Artificial Sequence
  Synthetic
ctggtaggtgaaacgggcatggccatactccagcagttggcttttgcgcaagcgcttaattacgaacatcgcttt

SEQ ID NO: 51821 - DNA, 75 bp, Artificial Sequence
  Synthetic
tactccagcagttggcttttgcgcaagcgcttaattacgaacatcgcttttatgcagtgctggcaccaaaagcac

SEQ ID NO: 51822 - DNA, 75 bp, Artificial Sequence
  Synthetic
agtatatatataaccagtgtatagcgtttcacagtatgtgttctcttcctccacactgcagcgtatgtgacactg

SEQ ID NO: 51823 - DNA, 75 bp, Artificial Sequence
  Synthetic
acacttcctggatgtcctgggatggctgtgacctagactactactgcaacatgggagactggccttcttgtacat

SEQ ID NO: 51824 - DNA, 75 bp, Artificial Sequence
  Synthetic
atgcatgctaccactgaaatgtttagcaggaatcttttgaaaacaacctctgatgatggtctcactaacccacat

SEQ ID NO: 51825 - DNA, 75 bp, Artificial Sequence
  Synthetic
ccacactgcagcgtatgtgacactgtttccatttagatcttgacctaactttgactgcgtgccgccactatatct

SEQ ID NO: 51826 - DNA, 75 bp, Artificial Sequence
  Synthetic
gcaggaatcttttgaaaacaacctctgatgatggtctcactaacccacatcttaaagaaaccattctgaatgtgg

SEQ ID NO: 51827 - DNA, 75 bp, Artificial Sequence
  Synthetic
tccactttcactctaaaagggttactgcacacggagacacaccacaattagatctgaaggcaagaccaacctacg

SEQ ID NO: 51828 - DNA, 75 bp, Artificial Sequence
  Synthetic
gaaggtagcaatctagttaatttctacaaagttatttgcatctccggagataacaccaagtggggcccaatacac

SEQ ID NO: 51829 - DNA, 75 bp, Artificial Sequence
  Synthetic
acaaagttatttgcatctccggagataacaccaagtggggcccaatacactgctgttccttcttttctggtatga

SEQ ID NO: 51830 - DNA, 75 bp, Artificial Sequence
  Synthetic
ggagcctgaagctagacttgttggcctgagcctggaagactacctcaagaggatgctgtctgacaacgagtgggg

SEQ ID NO: 51831 - DNA, 75 bp, Artificial Sequence
  Synthetic
gtttttataaagaatttatgcagacaggtagaaatacctgctggtagcatcaagaagattttaaacgtgcttaga

SEQ ID NO: 51832 - DNA, 75 bp, Artificial Sequence
  Synthetic
taaaatttgcaagcctgacttgcacaggctgttatgcttgtagttctggcatttcctgcaaagttaggattcatg

SEQ ID NO: 51833 - DNA, 75 bp, Artificial Sequence
  Synthetic
aggtagaaatacctgctggtagcatcaagaagattttaaacgtgcttagatacaagttgtgttctaagggaggcg

SEQ ID NO: 51834 - DNA, 75 bp, Artificial Sequence
  Synthetic
gtagtagcagctagctcaagtctcatggcaaggaagcttgagtttggaacagacagtacatttaaagctttctca

SEQ ID NO: 51835 - DNA, 75 bp, Artificial Sequence
  Synthetic
gacagctgggatggaaatgacactgttaagttcttagtgactacctacataagcaagggactcatggcgcttaat

SEQ ID NO: 51836 - DNA, 75 bp, Artificial Sequence
  Synthetic
ttaagttcttagtgactacctacataagcaagggactcatggcgcttaatagctacaatcacatgggacaaggaa

SEQ ID NO: 51837 - DNA, 75 bp, Artificial Sequence
  Synthetic
agtttttagttacaacctatataagcaaagggcttatggcattaaacagttacaaccatatgggtcaaggtattc

SEQ ID NO: 51838 - DNA, 75 bp, Artificial Sequence
  Synthetic
taagagctgcagtaaagaagacacacaaaaatgtgttaacacaaaacttgagcaaccacagagcattttgatcga

SEQ ID NO: 51839 - DNA, 75 bp, Artificial Sequence
  Synthetic
gaagagttaaccatctactaccttaagagaagcatgcctcaaacaaccattcacgttgagcatgcaggtagttct

SEQ ID NO: 51840 - DNA, 75 bp, Artificial Sequence
  Synthetic
agagaagcatgcctcaaacaaccattcacgttgagcatgcaggtagttctgatgattatgcaaaatgtatagtgg

SEQ ID NO: 51841 - DNA, 75 bp, Artificial Sequence
  Synthetic
tggaaacatgcatgcaggttgaagaatttcacagcggcagtacaaaggtgctgccaaatgaaagacagtgccaaa

SEQ ID NO: 51842 - DNA, 75 bp, Artificial Sequence
  Synthetic
atttcacagcggcagtacaaaggtgctgccaaatgaaagacagtgccaaaaccttagtaagtgactgctttcttg

SEQ ID NO: 51843 - DNA, 75 bp, Artificial Sequence
  Synthetic
aaattcatattcacgggacttataaatagctcagtaacttctccacaaagtctaatgcaagcatgtcatgtttcc

SEQ ID NO: 51844 - DNA, 75 bp, Artificial Sequence
  Synthetic
atagctcagtaacttctccacaaagtctaatgcaagcatgtcatgtttcctctcagcaggcaatgtacaacagtg

SEQ ID NO: 51845 - DNA, 75 bp, Artificial Sequence
  Synthetic
atagaagaattgccgaactattctccacaaaaacacacattggctagatcaactaaaatggcttgaaagaatgat

SEQ ID NO: 51846 - DNA, 75 bp, Artificial Sequence
  Synthetic
ttcaatcacgttgaggatttcatcagaaggtatggaatcctgactcttgggacactatcccctttcggtagactg

SEQ ID NO: 51847 - DNA, 75 bp, Artificial Sequence
  Synthetic
cccagctacactattatcacaatatgctacatctaatctacttcactgtacccacatgtagactgaaactgcctt

SEQ ID NO: 51848 - DNA, 75 bp, Artificial Sequence
  Synthetic
gaaggtatggaatcctgactcttgggacactatcccctttcggtagactgttcgtcccaacatactcaggtctgg

SEQ ID NO: 51849 - DNA, 75 bp, Artificial Sequence
  Synthetic
cccacatgtagactgaaactgcctttgctctacttactctgacctaaatcttgactgcgtgccgccactatatct

SEQ ID NO: 51850 - DNA, 75 bp, Artificial Sequence
  Synthetic
caaactctcagcatgaacagtgtatcgatccagtcaagtagtttgaccacactagatggattagaacgaaaccga

SEQ ID NO: 51851 - DNA, 75 bp, Artificial Sequence
  Synthetic
cgatccagtcaagtagtttgaccacactagatggattagaacgaaaccgagcaagctcatcagttgatgatagca

SEQ ID NO: 51852 - DNA, 75 bp, Artificial Sequence
  Synthetic
ctcctattccttttgtgagagtgttccaaatttggacaagtttgtgttccaaatggccagtgccaccgatgatgc

SEQ ID NO: 51853 - DNA, 75 bp, Artificial Sequence
  Synthetic
tcaagtttctctttcgagctgaaccggcccctgtctgaaacagagatacagtttataaaggcacttagcagtctg

SEQ ID NO: 51854 - DNA, 75 bp, Artificial Sequence
  Synthetic
ggcccctgtctgaaacagagatacagtttataaaggcacttagcagtctgaggtcaatccaggcgtgtgagatag

SEQ ID NO: 51855 - DNA, 75 bp, Artificial Sequence
  Synthetic
ctgcctttaaagactacggagagagagggatagtcgaggaaaatcacatgaggtttagtgaagaagatcagctag

SEQ ID NO: 51856 - DNA, 75 bp, Artificial Sequence
  Synthetic
gacaggcacaatgtcatatatagcagtagaatggcagactcatgtgattggctgagagacgggaaaagaagagga

SEQ ID NO: 51857 - DNA, 75 bp, Artificial Sequence
  Synthetic
gtagaatggcagactcatgtgattggctgagagacgggaaaagaagaggaaactttgaattggcaaatagaatac

SEQ ID NO: 51858 - DNA, 75 bp, Artificial Sequence
  Synthetic
ctacaccaccagacagatggtggatttcggaggacagagtgcgagtcctaaaaaattcagtcagcttcttgttca

SEQ ID NO: 51859 - DNA, 75 bp, Artificial Sequence
  Synthetic
gaaggaacagaaaagcaagttaaagcatcactaaacagggatgataacaagataattgaagaccccatgattcaa

SEQ ID NO: 51860 - DNA, 75 bp, Artificial Sequence
  Synthetic
catcactaaacagggatgataacaagataattgaagaccccatgattcaactgatacctgagaaattgagaagag

SEQ ID NO: 51861 - DNA, 75 bp, Artificial Sequence
  Synthetic
agtatcaacccagatgatactcttgcacagcttgtggcaaaaaagcttattagtttgaatgtgtcgacagaagaa

SEQ ID NO: 51862 - DNA, 75 bp, Artificial Sequence
  Synthetic
cacagcttgtggcaaaaaagcttattagtttgaatgtgtcgacagaagaatattcagccgaagtttcaaggctca

SEQ ID NO: 51863 - DNA, 75 bp, Artificial Sequence
  Synthetic
atcgagatgtggtgagtgcctctcaaatataaagaaaaccgttgatgaaactgccaatctatcagaaaagattga

SEQ ID NO: 51864 - DNA, 75 bp, Artificial Sequence
  Synthetic
aaggagctttcccttcctatatatacaatattcatgaagtcttacttctttaaagataatgttttcctgtctctt

SEQ ID NO: 51865 - DNA, 75 bp, Artificial Sequence
  Synthetic
caatattcatgaagtcttacttctttaaagataatgttttcctgtctcttacagacaggtggtcaactaaacaca

SEQ ID NO: 51866 - DNA, 75 bp, Artificial Sequence
  Synthetic
actaaatatacccactggctggacacattcttaagctgctctgtctccatcaatagacataccaccgtcaaggag

SEQ ID NO: 51867 - DNA, 75 bp, Artificial Sequence
  Synthetic
cattcttaagctgctctgtctccatcaatagacataccaccgtcaaggagccatcattattcaatcccaatatca

SEQ ID NO: 51868 - DNA, 75 bp, Artificial Sequence
  Synthetic
attcaaagccacctgaaagtctttgaaaatgagtttacgaatttgaatcttcaattttcggaccccaatagacag

SEQ ID NO: 51869 - DNA, 75 bp, Artificial Sequence
  Synthetic
aaaatgagtttacgaatttgaatcttcaattttcggaccccaatagacagaaacttaggatagtagaatcaagac

SEQ ID NO: 51870 - DNA, 75 bp, Artificial Sequence
  Synthetic
gctgtttgaaattcagaaaacagggttcaacattcaggacatggacatagtggcctctgagcacttgctgcacca

SEQ ID NO: 51871 - DNA, 75 bp, Artificial Sequence
  Synthetic
tggcctctgagcacttgctgcaccagtctcttgttggcaagcaatctccattccagaacgcctacaacgtcaagg

SEQ ID NO: 51872 - DNA, 75 bp, Artificial Sequence
  Synthetic
ctgttctcagcaactgagcaggtccgcctctccaacaatcccgcagttgtcataggttatctgttagatgaatct

SEQ ID NO: 51873 - DNA, 75 bp, Artificial Sequence
  Synthetic
gcctctccaacaatcccgcagttgtcataggttatctgttagatgaatctgcaatctcagaagtcaagccaacta

SEQ ID NO: 51874 - DNA, 75 bp, Artificial Sequence
  Synthetic
ttattttacttgcttatataaccttattttattaacctttctctattttctcttgttttaaacacttaaagggct

SEQ ID NO: 51875 - DNA, 75 bp, Artificial Sequence
  Synthetic
ttcccttcagtattcaccctaattagaatgcttacggatgagtcaacagactctgagaaaagtggccttagccct

SEQ ID NO: 51876 - DNA, 75 bp, Artificial Sequence
  Synthetic
gaatgcttacggatgagtcaacagactctgagaaaagtggccttagccctgacttgcatcaggttgctaagtatt

SEQ ID NO: 51877 - DNA, 75 bp, Artificial Sequence
  Synthetic
gcaaaatggaaaacaaaatcgaggtgaataataaagatgagatgaacaagtggttcgaggagttcaagaaaggaa

SEQ ID NO: 51878 - DNA, 75 bp, Artificial Sequence
  Synthetic
gttactgttttctacatgttgaaaggcaacctgatgaatacagagccgaccgttgcagaacttgtcagttatggc

SEQ ID NO: 51879 - DNA, 75 bp, Artificial Sequence
  Synthetic
gcaacctgatgaatacagagccgaccgttgcagaacttgtcagttatggcatcaaggaaggtagattttacaggc

SEQ ID NO: 51880 - DNA, 75 bp, Artificial Sequence
  Synthetic
atcctccactgtatatctgcaataggtgggctccctttaagtcaaacagacaaatcctcattgctcatgagtttt

SEQ ID NO: 51881 - DNA, 75 bp, Artificial Sequence
  Synthetic
ggctagctccactggcattgttaagaaggggctggagtggttcgaaaaaaatgcaggaaccattaaatcttggga

SEQ ID NO: 51882 - DNA, 75 bp, Artificial Sequence
  Synthetic
gtgggctccctttaagtcaaacagacaaatcctcattgctcatgagttttttgaactggagagtgaacatggaca

SEQ ID NO: 51883 - DNA, 75 bp, Artificial Sequence
  Synthetic
ttcgcaagcaagctctgcaatacctaaagccgccattactctatttactctgaccaaaaccttgactgcgtgccg

SEQ ID NO: 51884 - DNA, 75 bp, Artificial Sequence
  Synthetic
gaatttgatgggcaggttattgcaaacatacttgctagcgagttaagctctgtgaagcgtgactctgagcgtgaa

SEQ ID NO: 51885 - DNA, 75 bp, Artificial Sequence
  Synthetic
acatacttgctagcgagttaagctctgtgaagcgtgactctgagcgtgaagggttgactgatctcttggactacc

SEQ ID NO: 51886 - DNA, 75 bp, Artificial Sequence
  Synthetic
actattccgccgttcttccttctctatcattcatttcagtttcactatttctagggtgtggggggaacgatttct

SEQ ID NO: 51887 - DNA, 75 bp, Artificial Sequence
  Synthetic
tgtaagttcaacacttggggagacacaaacagaactggaaagttcacatacagtagtaggtcaggggagtcaatt

SEQ ID NO: 51888 - DNA, 75 bp, Artificial Sequence
  Synthetic
caaacagaactggaaagttcacatacagtagtaggtcaggggagtcaattggaatattcattgctggaaaattgc

SEQ ID NO: 51889 - DNA, 75 bp, Artificial Sequence
  Synthetic
agtggtgtagggaatttatcaaaggcaagtacataatggcttttaacccaccttggggggacatcaacaagtcag

SEQ ID NO: 51890 - DNA, 75 bp, Artificial Sequence
  Synthetic
ttagaagaaggaacctgattctcaacagaggtggtgatgaaaacccacgcggcccagtcagccgtgaacatgtgg

SEQ ID NO: 51891 - DNA, 75 bp, Artificial Sequence
  Synthetic
caggtgctgtcttggatgagtaaaaggaggacggaagtggtaaccaaagagcagcatcaactattcttgagcctt

SEQ ID NO: 51892 - DNA, 75 bp, Artificial Sequence
  Synthetic
ggaggacggaagtggtaaccaaagagcagcatcaactattcttgagccttcttcctcaatctcacgagtgtctac

SEQ ID NO: 51893 - DNA, 75 bp, Artificial Sequence
  Synthetic
ccccggcttctcaagtttgtgcctctcaagaaaggcttagcagttgtaaaaataaagaaacaaattttgacggtg

SEQ ID NO: 51894 - DNA, 75 bp, Artificial Sequence
  Synthetic
tcaagaaaggcttagcagttgtaaaaataaagaaacaaattttgacggtgaagaagcagattgtgtttgatgcag

SEQ ID NO: 51895 - DNA, 75 bp, Artificial Sequence
  Synthetic
agagactcaaattcatgaatgtacattctccagaattgatgccggaaaactgtctcttttctagtgaggaattca

SEQ ID NO: 51896 - DNA, 75 bp, Artificial Sequence
  Synthetic
cacagggtgcacagattgacaccgtcttcagctcatactactggctctacaaggccggtgtgactccagacacct

SEQ ID NO: 51897 - DNA, 75 bp, Artificial Sequence
  Synthetic
caggagctgaaacaagatcttttgatatcttcttggatcaagtgcataacagcttgtaaagattttgcaagcatc

SEQ ID NO: 51898 - DNA, 75 bp, Artificial Sequence
  Synthetic
gatgaaactgacacacagactacctaccatgaaaacctactgaaggttaaacaactagtggactgctccactgac

SEQ ID NO: 51899 - DNA, 75 bp, Artificial Sequence
  Synthetic
accatgaaaacctactgaaggttaaacaactagtggactgctccactgacaggaaaaaacttttgcctcagtcag

SEQ ID NO: 51900 - DNA, 75 bp, Artificial Sequence
  Synthetic
ttgcttcttaattccttgacattattacactgctttctgaaacatgctcctagtgacgccataatggaagtggaa

SEQ ID NO: 51901 - DNA, 75 bp, Artificial Sequence
  Synthetic
tacactgctttctgaaacatgctcctagtgacgccataatggaagtggaaagcaagagtagcctattacacaaat

SEQ ID NO: 51902 - DNA, 75 bp, Artificial Sequence
  Synthetic
tgctttggaacaatccctgtggccaatcctgatgatgctgctttaggatctggacacaccaagtccattctcaac

SEQ ID NO: 51903 - DNA, 75 bp, Artificial Sequence
  Synthetic
tttcaaaatgcctacaatgtcaaggggaatgccaccagtgccaacatcatctaaagcccagtatgttctgcaatc

SEQ ID NO: 51904 - DNA, 75 bp, Artificial Sequence
  Synthetic
cttcggacaaacactgagaccaacaatccgtgtgccaagacaattgttaagttgtttgagattcagaaaacagga

SEQ ID NO: 51905 - DNA, 75 bp, Artificial Sequence
  Synthetic
gagaagctggacaaagtggtgataaaagacaatctagaacaagggatagaagaagaaattgagttttgcaataat

SEQ ID NO: 51906 - DNA, 75 bp, Artificial Sequence
  Synthetic
aagacaatctagaacaagggatagaagaagaaattgagttttgcaataatctgacaaagacagtgtcagaaaacc

SEQ ID NO: 51907 - DNA, 75 bp, Artificial Sequence
  Synthetic
tagtacgtaagtgttaactttgagtgagtgacttgagcatcttagatgcagcatgtctttcaacattatgtacac

SEQ ID NO: 51908 - DNA, 75 bp, Artificial Sequence
  Synthetic
tagtgggagaaacaggcatggcaatactacaacaattagcttttgcacaggcactaaattatgagcaccgcttct

SEQ ID NO: 51909 - DNA, 75 bp, Artificial Sequence
  Synthetic
tttcaaaatgcctacaacgtcaaggggaacgccaccagtgccaacatcatctaaagctgaggatgctctgcaatc

SEQ ID NO: 51910 - DNA, 75 bp, Artificial Sequence
  Synthetic
ggcttcaacaacgtcctggtgaatatcgacaagaacacagtcaaaagtgaacttttgtggaagttcacgctagac

SEQ ID NO: 51911 - DNA, 75 bp, Artificial Sequence
  Synthetic
tcgacaagaacacagtcaaaagtgaacttttgtggaagttcacgctagacactaatgtaagtactacaagcacca

SEQ ID NO: 51912 - DNA, 75 bp, Artificial Sequence
  Synthetic
ttcatggactgtccaacgaaacccaacatggtaatgcaagcaccataaaggcgcccgaagtgagccaaggacttg

SEQ ID NO: 51913 - DNA, 75 bp, Artificial Sequence
  Synthetic
acatggtaatgcaagcaccataaaggcgcccgaagtgagccaaggacttggattgcctgtgagcacagcaccacc

SEQ ID NO: 51914 - DNA, 75 bp, Artificial Sequence
  Synthetic
ttcttttaactgtttatgtaatcctgttctattaacattttgttactttcttctgttttaaatacttaaagggct

SEQ ID NO: 51915 - DNA, 75 bp, Artificial Sequence
  Synthetic
aagtttttactctcatttcttctctatgaggaagtactgatgaacttgatccagcaatgcaaggcaaccaaagag

SEQ ID NO: 51916 - DNA, 75 bp, Artificial Sequence
  Synthetic
cagtacgtaagtgttaactttgagtgagtgacttgagcattttagacgcatcatgcccgtcaacactatgcacac

SEQ ID NO: 51917 - DNA, 75 bp, Artificial Sequence
  Synthetic
cagaaggttcaggagacacgaacacctctcctccggtcaccacacaaggcttgactttgccagaaaccacactgg

SEQ ID NO: 51918 - DNA, 75 bp, Artificial Sequence
  Synthetic
atgaggaagtactgatgaacttgatccagcaatgcaaggcaaccaaagagctcattaacagtacagggctttcgg

SEQ ID NO: 51919 - DNA, 75 bp, Artificial Sequence
  Synthetic
ctctcctccggtcaccacacaaggcttgactttgccagaaaccacactggaactcctcacaacaaccaacacagg

SEQ ID NO: 51920 - DNA, 75 bp, Artificial Sequence
  Synthetic
ctcgtggactgtcaaatgaaactcaacacaatgaaacaggtatcacaagagcacctgaagggagccaaggaccca

SEQ ID NO: 51921 - DNA, 75 bp, Artificial Sequence
  Synthetic
gagcgcagtaagcgaggaggaccgaggtgttctttcacagcactgctaggcttaatccacgaagactggcaaaag

SEQ ID NO: 51922 - DNA, 75 bp, Artificial Sequence
  Synthetic
cccccgtgtcaacagcccacacaagcccgcccggcacccccagcgcgccaaccacaccacagggcacacatcaca

SEQ ID NO: 51923 - DNA, 75 bp, Artificial Sequence
  Synthetic
acacaatgaaacaggtatcacaagagcacctgaagggagccaaggacccagtttgcctgtaagcacagcatcacc

SEQ ID NO: 51924 - DNA, 75 bp, Artificial Sequence
  Synthetic
ggtgttctttcacagcactgctaggcttaatccacgaagactggcaaaagataggaaagaacatccttgttcgtg

SEQ ID NO: 51925 - DNA, 75 bp, Artificial Sequence
  Synthetic
cccgcccggcacccccagcgcgccaaccacaccacagggcacacatcacactgcaaggggtctactgtcagtcac

SEQ ID NO: 51926 - DNA, 75 bp, Artificial Sequence
  Synthetic
tagaaggctcaggggacacgactcccccagccatcacacaaggcccgaccccaccagagaccacgccggaaccct

SEQ ID NO: 51927 - DNA, 75 bp, Artificial Sequence
  Synthetic
gagaagcttacctcagacaacagtacatgttgaacatgccggtagttcagatgattacgcaaagtgtatagtggt

SEQ ID NO: 51928 - DNA, 75 bp, Artificial Sequence
  Synthetic
ccacacaaagatatgtccaggcctaaatcggaaaggatcgtcactgccagaagatcactgaatcatgctttgacc

SEQ ID NO: 51929 - DNA, 75 bp, Artificial Sequence
  Synthetic
gcatggagaccaacagcccgggcccagccaccagcgaaacaccatccccctctccaacaacccaggcccccaccg

SEQ ID NO: 51930 - DNA, 75 bp, Artificial Sequence
  Synthetic
cccagccatcacacaaggcccgaccccaccagagaccacgccggaaccctccacaacaaccggcacaaacgcatt

SEQ ID NO: 51931 - DNA, 75 bp, Artificial Sequence
  Synthetic
aatcggaaaggatcgtcactgccagaagatcactgaatcatgctttgaccttgatgttcttagaagaggtcacat

SEQ ID NO: 51932 - DNA, 75 bp, Artificial Sequence
  Synthetic
caccgacagtccaaacaagtccacctagcactcccgacgcatctaccataccacagggcacacatcacaccgcaa

SEQ ID NO: 51933 - DNA, 75 bp, Artificial Sequence
  Synthetic
ggacaagaatgctttgagttcacgattctaaaagacaacagtaccaagctggactacaacaaactgattgaccac

SEQ ID NO: 51934 - DNA, 75 bp, Artificial Sequence
  Synthetic
gcaaccccaagcccagtgacctctccagcactgctagcctcctctcagggtgacacgtctacggctgttcaagat

SEQ ID NO: 51935 - DNA, 75 bp, Artificial Sequence
  Synthetic
tagcactcccgacgcatctaccataccacagggcacacatcacaccgcaaggggtctgctgtcagtcaccgtcac

SEQ ID NO: 51936 - DNA, 75 bp, Artificial Sequence
  Synthetic
ttctaaaagacaacagtaccaagctggactacaacaaactgattgaccactgtgtagacatggaaaagaagaaag

SEQ ID NO: 51937 - DNA, 75 bp, Artificial Sequence
  Synthetic
agaccaatagcccacgcctagcaactagcaagacaccgtccccctctccaacagctcaggttaccactgaaaaca

SEQ ID NO: 51938 - DNA, 75 bp, Artificial Sequence
  Synthetic
gtgaggcccagcattgtgactccagcagcgcctgagtttgagcagtgtcaggagcagataagcctggatgactta

SEQ ID NO: 51939 - DNA, 75 bp, Artificial Sequence
  Synthetic
tagcaagacaccgtccccctctccaacagctcaggttaccactgaaaacagcaaccctaatacctccagacagct

SEQ ID NO: 51940 - DNA, 75 bp, Artificial Sequence
  Synthetic
cagcgcctgagtttgagcagtgtcaggagcagataagcctggatgacttaatggcgtgtgacataacagtggtgc

SEQ ID NO: 51941 - DNA, 75 bp, Artificial Sequence
  Synthetic
agctgatcttcgtgcagagtgctactaccgtagccgttcaagatgcacacccaagcccaacaaacaggtccaaaa

SEQ ID NO: 51942 - DNA, 75 bp, Artificial Sequence
  Synthetic
tgggattcagactgagcatggttttgagtttacaaaagggctgtctacttctcacatggaattcacggaacccag

SEQ ID NO: 51943 - DNA, 75 bp, Artificial Sequence
  Synthetic
agtttaaaacaccaagcacactaagccccacggaaccagctcgagctgggtcaccaacagttgaacccttcaaat

SEQ ID NO: 51944 - DNA, 75 bp, Artificial Sequence
  Synthetic
taccgtagccgttcaagatgcacacccaagcccaacaaacaggtccaaaagaaaccttgagatggaagtaatttt

SEQ ID NO: 51945 - DNA, 75 bp, Artificial Sequence
  Synthetic
gagtttacaaaagggctgtctacttctcacatggaattcacggaacccagcatgtctatgctcaacactccgcat

SEQ ID NO: 51946 - DNA, 75 bp, Artificial Sequence
  Synthetic
ccccacggaaccagctcgagctgggtcaccaacagttgaacccttcaaatcttatttcgccagaggcctcctttc

SEQ ID NO: 51947 - DNA, 75 bp, Artificial Sequence
  Synthetic
tggaccttaccttagaagaagacaccgaaggactgctggagtggtgtaagagaaatcttggtctaacctgtgacg

SEQ ID NO: 51948 - DNA, 75 bp, Artificial Sequence
  Synthetic
tattcccaaacactttgaccatctaacttactctgtctcacatccatttgtttcttttacctccaccctagtatt

SEQ ID NO: 51949 - DNA, 75 bp, Artificial Sequence
  Synthetic
caggacttcagttgatcaacatcacccaacattcagctagaataacagacacacctggacccaagatcactaatc

SEQ ID NO: 51950 - DNA, 75 bp, Artificial Sequence
  Synthetic
cgaaggactgctggagtggtgtaagagaaatcttggtctaacctgtgacgataacttctttcagaagaggataga

SEQ ID NO: 51951 - DNA, 75 bp, Artificial Sequence
  Synthetic
acttactctgtctcacatccatttgtttcttttacctccaccctagtattatgcctgttatttgcaaggatgtgg

SEQ ID NO: 51952 - DNA, 75 bp, Artificial Sequence
  Synthetic
ccaacattcagctagaataacagacacacctggacccaagatcactaatctaaaaaccatcaattgcataaactt

SEQ ID NO: 51953 - DNA, 75 bp, Artificial Sequence
  Synthetic
aaaccccaagcacactgagctctacagaatctgctagtgtagggttaccaacagttgagcccttcaaatcttact

SEQ ID NO: 51954 - DNA, 75 bp, Artificial Sequence
  Synthetic
agaatctgctagtgtagggttaccaacagttgagcccttcaaatcttactttgctaaaggctttctttcaataga

SEQ ID NO: 51955 - DNA, 75 bp, Artificial Sequence
  Synthetic
tccctcaagtcgcagtcaacctctcaagctgccacgtactgatcaaatcgcatgtctgtgactactctttggaca

SEQ ID NO: 51956 - DNA, 75 bp, Artificial Sequence
  Synthetic
ttcagttaatcaatgtcactcaacattcagctagaatagcagacacacctggacctaagatcacaaatctgaaaa

SEQ ID NO: 51957 - DNA, 75 bp, Artificial Sequence
  Synthetic
ccaggaacttacaaaatagttatagacaaaaaaaacaaacagaacgacaggtgcactatagtcaccaactgtgta

SEQ ID NO: 51958 - DNA, 75 bp, Artificial Sequence
  Synthetic
attgaaatcaatgttcttctccctcaagtcgcagtcaatctctcaaactgccatgtccacatcaaatcgcatgtc

SEQ ID NO: 51959 - DNA, 75 bp, Artificial Sequence
  Synthetic
gagactgcggaaattcacagtgatagctatggtggaccaggtgataagataaccatctgcaatggttcaactgtt

SEQ ID NO: 51960 - DNA, 75 bp, Artificial Sequence
  Synthetic
acttacaaaatagtgatagacaaaaaaaacaaacaaaacgatagatgcaacttggttaccaattgtgtaataaaa

SEQ ID NO: 51961 - DNA, 75 bp, Artificial Sequence
  Synthetic
aaagtcatttaagctttgcgagaacagtgccacaggtaaatcctgtgaaatagatagcaccccagttaaatgcag

SEQ ID NO: 51962 - DNA, 75 bp, Artificial Sequence
  Synthetic
aatcaggatcggcaaggcatcttctggctccagaagactgctgtccgaagagtctggtgaagactgtatatcaag

SEQ ID NO: 51963 - DNA, 75 bp, Artificial Sequence
  Synthetic
tagatagcaccccagttaaatgcaggcagggtttttgcttaaaaattactcaggagggaaggggccacgtgaagc

SEQ ID NO: 51964 - DNA, 75 bp, Artificial Sequence
  Synthetic
ggctccagaagactgctgtccgaagagtctggtgaagactgtatatcaaggactcagctattgaggacagaaact

SEQ ID NO: 51965 - DNA, 75 bp, Artificial Sequence
  Synthetic
ataatgataccaaagggcactggagacatcctagttgactgttcaggtgggcagcaacatttcttaaaagataac

SEQ ID NO: 51966 - DNA, 75 bp, Artificial Sequence
  Synthetic
ctgcaatggttcaaccattgtagatcaaaggctgggtagtgaactggggtgttacactatcaatagggtgaagtc

SEQ ID NO: 51967 - DNA, 75 bp, Artificial Sequence
  Synthetic
ttcttcactgcatctctgccattggatgtttacctttgagtcaagcagacaagtcttcactacttatgagcttct

SEQ ID NO: 51968 - DNA, 75 bp, Artificial Sequence
  Synthetic
acaggtaagtcctgtgaaatagataacactccagtaaaatgcaagcaaggtttttgcttgaaaataacccaagaa

SEQ ID NO: 51969 - DNA, 75 bp, Artificial Sequence
  Synthetic
agtcatgaagcaagtatactgagtgagtttgatggacaagttatcgctaatatacttgccagtgaattaagttct

SEQ ID NO: 51970 - DNA, 75 bp, Artificial Sequence
  Synthetic
ataccaaagggcactggagacatcctggttgactgctcaggtgggcagcagcacttcttaaaagacaacctgatt

SEQ ID NO: 51971 - DNA, 75 bp, Artificial Sequence
  Synthetic
gcaatgccaccagtgccaacattatctaaaatgcagaatgctctgtatccaacctctctccttccgaaccaccac

SEQ ID NO: 51972 - DNA, 75 bp, Artificial Sequence
  Synthetic
acaactatggcttttcttttttggtttagctttggttatgtgataacctgcatactttgtaaagtcattttttat

SEQ ID NO: 51973 - DNA, 75 bp, Artificial Sequence
  Synthetic
acttagaaaggatcccttgggttgttaggaaattactgcaggtgtcagaatctaccggtgtggcactaaagagga

SEQ ID NO: 51974 - DNA, 75 bp, Artificial Sequence
  Synthetic
gttaaaacctcagacctgcacaatatgtgaaacaactcctgtcaatgcaatagatgctgagatgcacgatctcaa

SEQ ID NO: 51975 - DNA, 75 bp, Artificial Sequence
  Synthetic
ctcaaagaaatacttgcggcacgtcagtacgtaagtgttaactttgagtgagtggcttgagcattttggattcag

SEQ ID NO: 51976 - DNA, 75 bp, Artificial Sequence
  Synthetic
gtacaatcagcacctatcggccatggaaagacagttgaaacatatcagatcagagaagggtacacaagtgtttgc

SEQ ID NO: 51977 - DNA, 75 bp, Artificial Sequence
  Synthetic
tgtgaaacaactcctgtcaatgcaatagatgctgagatgcacgatctcaattgtagttacaatatatgtccttat

SEQ ID NO: 51978 - DNA, 75 bp, Artificial Sequence
  Synthetic
cagagaagggtacacaagtgtttgcctttttgtactagggagcatcttgtttatagtctcttgcctaatgaaagg

SEQ ID NO: 51979 - DNA, 75 bp, Artificial Sequence
  Synthetic
tacagctgtggaatctaggaggtactcttgtgcccactaacaggacccaacacaataaaacaggcaccatggcga

SEQ ID NO: 51980 - DNA, 75 bp, Artificial Sequence
  Synthetic
tcctaagcggaaggaaaaaatagaagaaaccgaattatacctgaacttagaaagaatcccttgggttgtcagaaa

SEQ ID NO: 51981 - DNA, 75 bp, Artificial Sequence
  Synthetic
gaaaccgaattatacctgaacttagaaagaatcccttgggttgtcagaaaactactgcaggtgtcagaatccact

SEQ ID NO: 51982 - DNA, 75 bp, Artificial Sequence
  Synthetic
cacagtttcattgtcaccagtacaatcagcacctatcggtcatgggaagaccatagaaacgtatcaaactagaga

SEQ ID NO: 51983 - DNA, 75 bp, Artificial Sequence
  Synthetic
gtgctaggaagcattttgtttatagtttctcacctaatgaaggggctggttgacagtgttggtaacagttttttt

SEQ ID NO: 51984 - DNA, 75 bp, Artificial Sequence
  Synthetic
gcatcaagcacaggggtcgtcaatgtcagcacgcagatgaccaaggacatccctatgtcgacggcctacacgaat

SEQ ID NO: 51985 - DNA, 75 bp, Artificial Sequence
  Synthetic
tcagcacgcagatgaccaaggacatccctatgtcgacggcctacacgaatccacccagcacccctagcgcaccat

SEQ ID NO: 51986 - DNA, 75 bp, Artificial Sequence
  Synthetic
tgtagcctattttgttgcccctactgtagacactgctctgccgataaagaaatccataagttgcatttgagcatc

SEQ ID NO: 51987 - DNA, 75 bp, Artificial Sequence
  Synthetic
agtacgaagtcagaagaagtatcaatgtcaacaagcccaggaaaaacaagcacagagaccagcagcccaccccca

SEQ ID NO: 51988 - DNA, 75 bp, Artificial Sequence
  Synthetic
ctgataaatttctgtcatcaggaatgccaagtcactgagactgaatgtctctgtccttacgaagctcttgtgctc

SEQ ID NO: 51989 - DNA, 75 bp, Artificial Sequence
  Synthetic
ctccaacaactcaggctcccaccggaaacaataaccctaacacctccagacaacctacgccctcagcacagccag

SEQ ID NO: 51990 - DNA, 75 bp, Artificial Sequence
  Synthetic
catgtgttttagggcaactatggaagtgagcaacaaggctctactcatccgaagtgtcatcaacactacttttgt

SEQ ID NO: 51991 - DNA, 75 bp, Artificial Sequence
  Synthetic
gtgagcaacaaggctctactcatccgaagtgtcatcaacactacttttgttgtatgcatactaatattagcagtt

SEQ ID NO: 51992 - DNA, 75 bp, Artificial Sequence
  Synthetic
gccccccccactgctgatcaaggcgtacaccccggcccaacaaacagatccaagaggaaccttgaaatggaaata

SEQ ID NO: 51993 - DNA, 75 bp, Artificial Sequence
  Synthetic
ttgggagagagaggaagacctaacaaacttctgccatcaagaatgccaggtcactgaaactgaatgtctctgtcc

SEQ ID NO: 51994 - DNA, 75 bp, Artificial Sequence
  Synthetic
acagaggtaataagattttggtttcaggcagatcagagtcgatcatgaagctagaggaaaggacaggaatcagct

SEQ ID NO: 51995 - DNA, 75 bp, Artificial Sequence
  Synthetic
aacttctgccatcaagaatgccaggtcactgaaactgaatgtctctgtccctatgaagctcttgtactcagaaag

SEQ ID NO: 51996 - DNA, 75 bp, Artificial Sequence
  Synthetic
gaaagtactacggcaagatactgaagtttctggaccttaccttagaagaggacactgaaggcctgctagaatggt

SEQ ID NO: 51997 - DNA, 75 bp, Artificial Sequence
  Synthetic
gacactgaaggcctgctagaatggtgtaaaagaaatctcggtctaacctgtgatgataacttctttcagaagaga

SEQ ID NO: 51998 - DNA, 75 bp, Artificial Sequence
  Synthetic
aacaagcttagaaacaagcttatcaattgaggcaccatggggagcaataaacgttcaatctactttcaaacctac

SEQ ID NO: 51999 - DNA, 75 bp, Artificial Sequence
  Synthetic
attgaggcaccatggggagcaataaacgttcaatctactttcaaacctactgtgtcaactgcaaacatagcactt

SEQ ID NO: 52000 - DNA, 75 bp, Artificial Sequence
  Synthetic
atcagagtcaatcatgaagctagaagaaagaacaggaatcagctgggatttgggagtagaagatgcctctgagtc

SEQ ID NO: 52001 - DNA, 75 bp, Artificial Sequence
  Synthetic
ctacttggtgttggggagtcggcactggatgtacctgctgtgggctagacgtaaaagacctttttactgattaca

SEQ ID NO: 52002 - DNA, 75 bp, Artificial Sequence
  Synthetic
atgaactcaggctacttctctgctaaatgttatccaaggacatccaactcgggacttcagttgatcaatgtcacc

SEQ ID NO: 52003 - DNA, 75 bp, Artificial Sequence
  Synthetic
aatgttatccaaggacatccaactcgggacttcagttgatcaatgtcaccaaacattcagctaaaatagcagaca

SEQ ID NO: 52004 - DNA, 75 bp, Artificial Sequence
  Synthetic
gaaagaacaggaatcagctgggatttgggagtagaagatgcctctgagtccaaattacttactgtttccgtcatg

SEQ ID NO: 52005 - DNA, 75 bp, Artificial Sequence
  Synthetic
acaagtagaggaatggccaaaggcaacctgtacaggcgattgcccggaaagatgtggctgcacatcatcaacctg

SEQ ID NO: 52006 - DNA, 75 bp, Artificial Sequence
  Synthetic
agggcatcagtcttcaaagaacatagagaggttgagatcaatgtacttctccctcaagtcgcagtcaacctctca

SEQ ID NO: 52007 - DNA, 75 bp, Artificial Sequence
  Synthetic
gagaggttgagatcaatgtacttctccctcaagtcgcagtcaacctctcaaactgccacgcacaaattaaatcgc

SEQ ID NO: 52008 - DNA, 75 bp, Artificial Sequence
  Synthetic
ggtgttggggagtcggcaccggatgcacctgttgtggactagatgtaaaggacctttttacagattacatgtttg

SEQ ID NO: 52009 - DNA, 75 bp, Artificial Sequence
  Synthetic
agtgtgcaagctacagagttgcacacatggtgtgccaggggacctacaggtctaccacataggaaacttgttaaa

SEQ ID NO: 52010 - DNA, 75 bp, Artificial Sequence
  Synthetic
caggaacttacaaaatagtgatagacaaaaaaaacaagcaaaacgataggtgtaccttggtcacaaattgtgtga

SEQ ID NO: 52011 - DNA, 75 bp, Artificial Sequence
  Synthetic
cttactagccaagaaagacaatgtagcttgattgaggcaggcacaagattcaacttaggtcctgtgactatcaca

SEQ ID NO: 52012 - DNA, 75 bp, Artificial Sequence
  Synthetic
gcttgattgaggcaggcacaagattcaacttaggtcctgtgactatcacattatcagagccaagaaacattcagc

SEQ ID NO: 52013 - DNA, 75 bp, Artificial Sequence
  Synthetic
acagaaatcaggattggcaaggcatcttctggttccagaagactgctgtccgaggagtctgatggtgactgtata

SEQ ID NO: 52014 - DNA, 75 bp, Artificial Sequence
  Synthetic
cttctggttccagaagactgctgtccgaggagtctgatggtgactgtatatcaagaactcaactattgaggacag

SEQ ID NO: 52015 - DNA, 75 bp, Artificial Sequence
  Synthetic
ttttttgacttaatgcatgtacagaaggtactatcagcaagcacagtgtgcaagctacagagttgcacacatggc

SEQ ID NO: 52016 - DNA, 75 bp, Artificial Sequence
  Synthetic
aggtactatcagcaagcacagtgtgcaagctacagagttgcacacatggcgtaccaggagacttacaggtctacc

SEQ ID NO: 52017 - DNA, 75 bp, Artificial Sequence
  Synthetic
gcaatgccaccagtgccaacatcatctgaggctcagagtgctctgcactcggccttccccctttttgcactgctg

SEQ ID NO: 52018 - DNA, 75 bp, Artificial Sequence
  Synthetic
actatctgcaatggttcaactattgtagatcaaagactaggcagtgaactggggtgttatactatcaatagggta

SEQ ID NO: 52019 - DNA, 75 bp, Artificial Sequence
  Synthetic
aaagttgaaccacatttcaacacctcctggatgtcttgggacggctgtgacctagattactactgcaatatgggg

SEQ ID NO: 52020 - DNA, 75 bp, Artificial Sequence
  Synthetic
cctggatgtcttgggacggctgtgacctagattactactgcaatatgggggattggccctcttgcacgtatactg

SEQ ID NO: 52021 - DNA, 75 bp, Artificial Sequence
  Synthetic
gtgccacaggaaaatcttgtgaaatagatagcaccccagttaagtgcagacaaggtttttgcttgaaaatcactc

SEQ ID NO: 52022 - DNA, 75 bp, Artificial Sequence
  Synthetic
tagatgaaccagatgagcttacagtacatgtgaagagtgaagacccagacatagttgctgctagctcaagtctca

SEQ ID NO: 52023 - DNA, 75 bp, Artificial Sequence
  Synthetic
actgattacacaaagaacttccactttcactctaagagagtcactgcacatggggacactccacaattagattta

SEQ ID NO: 52024 - DNA, 75 bp, Artificial Sequence
  Synthetic
taatgataccaaagggcaccggagacatcttagttgactgttcaggtggacaacaacatttcttaaaagataatt

SEQ ID NO: 52025 - DNA, 75 bp, Artificial Sequence
  Synthetic
caaaaatgtgtcaacacaaagcttgagcaaccacagagcatcttaatcgagcataaagggacgataattggaaag

SEQ ID NO: 52026 - DNA, 75 bp, Artificial Sequence
  Synthetic
tgctgacatggagttacacacaaagaaaattgagatatcaggtttgaagtttgcaagcctaacttgcacaggttg

SEQ ID NO: 52027 - DNA, 75 bp, Artificial Sequence
  Synthetic
tacatttgcagaatgtccaatcatcctaaaacaaccatggcctttctcttttggtttagctttggttatgtgata

SEQ ID NO: 52028 - DNA, 75 bp, Artificial Sequence
  Synthetic
aagttttttttatggactaaagaacatgcttagtggcatttttggcaatgttttcatagggattttcttattcct

SEQ ID NO: 52029 - DNA, 75 bp, Artificial Sequence
  Synthetic
gaagagtgaagacccagacatagttgctgctagctcaagtctcatggcaagaaagcttgaattcgggacggatag

SEQ ID NO: 52030 - DNA, 75 bp, Artificial Sequence
  Synthetic
agtagggaaaaagttcaaacagtatagagagttgagacctcagacctgcaccatatgtgaaacaactcctgtcaa

SEQ ID NO: 52031 - DNA, 75 bp, Artificial Sequence
  Synthetic
ttgttgagagagaatactgtaaaagctgcagtaaagaagacacacaaaagtgtgttaacgcaaagcttgagcgac

SEQ ID NO: 52032 - DNA, 75 bp, Artificial Sequence
  Synthetic
tgtgttaacgcaaagcttgagcgaccacagagcattttaattgagcacaaaggaacgataattggaaagcagaac

SEQ ID NO: 52033 - DNA, 75 bp, Artificial Sequence
  Synthetic
cacaaaaacacacgttggctaaatcagcggaaagggcctcaaggagcgataacagtgcactcaccaacgccacta

SEQ ID NO: 52034 - DNA, 75 bp, Artificial Sequence
  Synthetic
aggaaattattgcaagtttcagagtctaccggtgtggcattgaagaggagcagttggctgacagtgctgcttgtg

SEQ ID NO: 52035 - DNA, 75 bp, Artificial Sequence
  Synthetic
agtggcatttttggcaatgttttcatagggattttcttattccttgctccttttatcctgttaatacttttcttt

SEQ ID NO: 52036 - DNA, 75 bp, Artificial Sequence
  Synthetic
gttacattcaacccgccccattatattcgcaagcaagctctgcaatacctaaagccgccattactctatttactc

SEQ ID NO: 52037 - DNA, 75 bp, Artificial Sequence
  Synthetic
aaagacaattgaaacatatcaggccagagaggggtatacaagcttctgcctttttatactaggaagcatcttgtt

SEQ ID NO: 52038 - DNA, 75 bp, Artificial Sequence
  Synthetic
agagaggggtatacaagcttctgcctttttatactaggaagcatcttgtttatagtctcttgcctagtaaagggt

SEQ ID NO: 52039 - DNA, 75 bp, Artificial Sequence
  Synthetic
aggcctatttaagtacagacacctcaaagatgatgaagaaaccggttataggaaaatcattgagagactaaacaa

SEQ ID NO: 52040 - DNA, 75 bp, Artificial Sequence
  Synthetic
acccacgttgacacagacagctccagtagtggttctctgtccttattaaaccatggacttcttaagaaaccttga

SEQ ID NO: 52041 - DNA, 75 bp, Artificial Sequence
  Synthetic
aaagatgatgaagaaaccggttataggaaaatcattgagagactaaacaacaaaaaaggtaaaaacaagctgctt

SEQ ID NO: 52042 - DNA, 75 bp, Artificial Sequence
  Synthetic
tctcaaagacaaacatgccgcagacgccccacgttttcatccttttgagagcaaaaccggtcgcctcacaacatc

SEQ ID NO: 52043 - DNA, 75 bp, Artificial Sequence
  Synthetic
gacatgctctattggcagtgtaaatggttttgagattgaatcccacaaatgttactgtagtctattttgttgccc

SEQ ID NO: 52044 - DNA, 75 bp, Artificial Sequence
  Synthetic
gcaaaaccggtcgcctcacaacatcagcgagaatggagaacaagattgttgccagtactaaggaagagttcaaca

SEQ ID NO: 52045 - DNA, 75 bp, Artificial Sequence
  Synthetic
aacacacattggctgaaacaacagaagaggcctcaaggaatgatgataatgtgcttactaatactattgcttatg

SEQ ID NO: 52046 - DNA, 75 bp, Artificial Sequence
  Synthetic
ggttttgagattgaatcccacaaatgttactgtagtctattttgttgcccttattgtagacactgctctgccgat

SEQ ID NO: 52047 - DNA, 75 bp, Artificial Sequence
  Synthetic
gtagtggttctctgtccttattaaaccatggacttcttaagaaaccttgactggactcaggtgattgatagtcag

SEQ ID NO: 52048 - DNA, 75 bp, Artificial Sequence
  Synthetic
tgcccaacaaaacagatcactcataccataacatcaaacatctgactgaggtggcagcacggaagtattatcagg

SEQ ID NO: 52049 - DNA, 75 bp, Artificial Sequence
  Synthetic
gagcaatgtcatgtcggccgtctgcaagcgcatgtgctttagagcaaccatagaagttagcaatagggctttact

SEQ ID NO: 52050 - DNA, 75 bp, Artificial Sequence
  Synthetic
ttcctcagctcgacacctacaagtacaagatggagctagccagcacggacaatgagagggacgccatctacagct

SEQ ID NO: 52051 - DNA, 75 bp, Artificial Sequence
  Synthetic
tttaacctgtctcatcgtactcacaagtaagctctgcaacacctgaaatcaccactgctctattcactctgacct

SEQ ID NO: 52052 - DNA, 75 bp, Artificial Sequence
  Synthetic
agcgagaatggagaacaagattgttgccagtactaaggaagagttcaacacctggtacaagcagtttgctgagaa

SEQ ID NO: 52053 - DNA, 75 bp, Artificial Sequence
  Synthetic
tttgctgtgtgtatactaacactagcagtttgtgttgtcagcacctctgcagtggagatggaaagtctaccagcc

SEQ ID NO: 52054 - DNA, 75 bp, Artificial Sequence
  Synthetic
tctcaaagatatcaatcccccctttacccacattgtcgcagacggctccagtagtggttctttgtccttgtcaaa

SEQ ID NO: 52055 - DNA, 75 bp, Artificial Sequence
  Synthetic
agtggagatggaaagtctaccagccggcacctgggagagagaggaagacctaacaaacttctgtcatcaggaatg

SEQ ID NO: 52056 - DNA, 75 bp, Artificial Sequence
  Synthetic
gtagtggttctttgtccttgtcaaactatggatttcctgagaagcctcgactggactcaggtgattgctggtcag

SEQ ID NO: 52057 - DNA, 75 bp, Artificial Sequence
  Synthetic
taacaaacttctgtcatcaggaatgccaagtcactgagactgaatgcctctgtccttacgaagcccttgtactca

SEQ ID NO: 52058 - DNA, 75 bp, Artificial Sequence
  Synthetic
ggctaaggaaatgggtgttactatcatcatttggactgttgcagccagcgacgaagtggaagcaggcataaagtt

SEQ ID NO: 52059 - DNA, 75 bp, Artificial Sequence
  Synthetic
aaagaggtctggaatggttcgacaaaaacaaagactctgacaccgtgaaggtctgggatgccaactaccaaaagc

SEQ ID NO: 52060 - DNA, 75 bp, Artificial Sequence
  Synthetic
ctatggatttcctgagaagcctcgactggactcaggtgattgctggtcagtacgtgaccaatccaaggttcaata

SEQ ID NO: 52061 - DNA, 75 bp, Artificial Sequence
  Synthetic
tatcacagtatagctgagttgaccatgcccaacaaaacagatcactcataccataacatcaagcacctaactgag

SEQ ID NO: 52062 - DNA, 75 bp, Artificial Sequence
  Synthetic
gcttctccattggggagtacaccagtatactaaaaaaggcagtggcggcagagtataaggtgccagggacagtga

SEQ ID NO: 52063 - DNA, 75 bp, Artificial Sequence
  Synthetic
tatcaattgaagcaccatggggtgcaataaatgtccaatcaaccttcaaacctactgtgtcagctgcaaacatag

SEQ ID NO: 52064 - DNA, 75 bp, Artificial Sequence
  Synthetic
cacactttgatgccctcagaatactgccacagtttgaagctgacacaagagagaccttaagtctggtagacaaag

SEQ ID NO: 52065 - DNA, 75 bp, Artificial Sequence
  Synthetic
tatgaagatcttgctttagcacttacaagtgcggaagaaccatgcagacggtctagcctggatgaggtcacccta

SEQ ID NO: 52066 - DNA, 75 bp, Artificial Sequence
  Synthetic
aggagcctgaagctaagcttattggcctgagtttggaggattatcttaagaggatgctatctgacaacgaatggg

SEQ ID NO: 52067 - DNA, 75 bp, Artificial Sequence
  Synthetic
aggatgctatctgacaacgaatggggatcgactcttgaggcatctatgttggctaaagaaatgggagttactatc

SEQ ID NO: 52068 - DNA, 75 bp, Artificial Sequence
  Synthetic
ggcaggtcagaatcaatcatgaagctggaggaaaggacaggaatcagctgggatctgggagtagaagacgcctct

SEQ ID NO: 52069 - DNA, 75 bp, Artificial Sequence
  Synthetic
cgccaaagagagggcctgttgggcgtgagcatcttgactggtgcagagagtttgcctcaggcaaatttttgaatg

SEQ ID NO: 52070 - DNA, 75 bp, Artificial Sequence
  Synthetic
tggaggaaaggacaggaatcagctgggatctgggagtagaagacgcctctgagtccaaattgctcaccgtctctg

SEQ ID NO: 52071 - DNA, 75 bp, Artificial Sequence
  Synthetic
tatactaaaaaaggcagtggcggcagagtataaggtgccagggacagtgatcaataacatcaaagaaatgctcag

SEQ ID NO: 52072 - DNA, 75 bp, Artificial Sequence
  Synthetic
tgagcatcttgactggtgcagagagtttgcctcaggcaaatttttgaatgctttcaaccctccttggggagagat

SEQ ID NO: 52073 - DNA, 75 bp, Artificial Sequence
  Synthetic
gtgaacctcctgcactccggacagacacactttgacgctctcagaatgctgccacagtttgaagctgatacaaga

SEQ ID NO: 52074 - DNA, 75 bp, Artificial Sequence
  Synthetic
gatagacaggtagaagagtggcccaaggcgacctgtacaggcgattgcccagaaagatgtggctgcacatcatca

SEQ ID NO: 52075 - DNA, 75 bp, Artificial Sequence
  Synthetic
agctggttgagctagaggggaaagacgtgatggacaaggccaaggcaagcattgcacaacttgaaggatgggtca

SEQ ID NO: 52076 - DNA, 75 bp, Artificial Sequence
  Synthetic
tgttgaaatatcagctgacactctaattctgcgaccagaatctaaagaaagaattggtgaagttatgtcgttgcg

SEQ ID NO: 52077 - DNA, 75 bp, Artificial Sequence
  Synthetic
cgagataaacaaattaagcaggagttctctagaatgaagctctatgttaccaaagatctgcttgaccatctggat

SEQ ID NO: 52078 - DNA, 75 bp, Artificial Sequence
  Synthetic
cacactttgacgctctcagaatgctgccacagtttgaagctgatacaagagagaccttaagtttggtagacaagg

SEQ ID NO: 52079 - DNA, 75 bp, Artificial Sequence
  Synthetic
cacttggtgttggggggtcggcactggatgcacctgttgtggactagatgtaaaagacctctttacagattacat

SEQ ID NO: 52080 - DNA, 75 bp, Artificial Sequence
  Synthetic
tatgaagaccttgccttagcacttactagtgcggaagaaccatgtagacgatctagtctggatgaggttaccctg

SEQ ID NO: 52081 - DNA, 75 bp, Artificial Sequence
  Synthetic
ccctggctctggcaaagctgtcgaacgccttccgtgcccagggagctcaaatagacactgtgttcagcagctact

SEQ ID NO: 52082 - DNA, 75 bp, Artificial Sequence
  Synthetic
caaagatctgcttgaccatctggatgttggtgggttattaagagcagccttccctggaacagggatagaaagaca

SEQ ID NO: 52083 - DNA, 75 bp, Artificial Sequence
  Synthetic
cgtgatggacaaggccaaggcaagcattgcacaacttgaaggatgggtcaaagagaacaaagaccaagtcgacca

SEQ ID NO: 52084 - DNA, 75 bp, Artificial Sequence
  Synthetic
cgccttccgtgcccagggagctcaaatagacactgtgttcagcagctactactggccttggaaggcaggagtgac

SEQ ID NO: 52085 - DNA, 75 bp, Artificial Sequence
  Synthetic
atgtagcttgattgaagcaggcacaagattcaatttaggtcctgtgactatcacattgtcagagccaagaaacat

SEQ ID NO: 52086 - DNA, 75 bp, Artificial Sequence
  Synthetic
accccaagggacagaaaaaaatgcaaaaggcactcatcaacacccctctcaaatggggaaaaaggctcattgaac

SEQ ID NO: 52087 - DNA, 75 bp, Artificial Sequence
  Synthetic
actgtatgtttaactgcaaactgtgtgttgaaatatcagctgacactctgattctgcgaccagagtccaaggaaa

SEQ ID NO: 52088 - DNA, 75 bp, Artificial Sequence
  Synthetic
atacggctctaacaacaaaaacaagaaaaaattcatcaccaactgcttgcttagcacagccttgtctgggaagaa

SEQ ID NO: 52089 - DNA, 75 bp, Artificial Sequence
  Synthetic
aaaggcactcatcaacacccctctcaaatggggaaaaaggctcattgaactgtttgctgataacgacttcacaga

SEQ ID NO: 52090 - DNA, 75 bp, Artificial Sequence
  Synthetic
aaggcttttttgacttaatgcatgtgcaaaaagtgctgtcagcaagcacagtgtgcaagctacagagttgcacac

SEQ ID NO: 52091 - DNA, 75 bp, Artificial Sequence
  Synthetic
cgggacaaacaaataaagcaagaattctctagaatgaagctctacgttaccaaggatttgcttgaccatctagat

SEQ ID NO: 52092 - DNA, 75 bp, Artificial Sequence
  Synthetic
ctagaaaggccttggcaaccgtctgtggtgccctgtttggaaaacaggtaaacaagcttcagaactgcttcagga

SEQ ID NO: 52093 - DNA, 75 bp, Artificial Sequence
  Synthetic
atggtgttccaggagacctacaggtctaccacatcggaaacttgttaaaaggagacaaggtaaacgggcatctga

SEQ ID NO: 52094 - DNA, 75 bp, Artificial Sequence
  Synthetic
agcttggaatatcgtttggagccgtgcccgtcaccagtcccgatgatgccgcccaagggtccgggcacacaaagg

SEQ ID NO: 52095 - DNA, 75 bp, Artificial Sequence
  Synthetic
cttagtgtgcaagactacaatagtatgatagaaaatatgtccaaattggacaacacagatgttgaattcaaccac

SEQ ID NO: 52096 - DNA, 75 bp, Artificial Sequence
  Synthetic
gttggtgggttattgagagcagccttccctggaacagggatagaaagacacatgcagttactacactctgaaatg

SEQ ID NO: 52097 - DNA, 75 bp, Artificial Sequence
  Synthetic
gcccgtcaccagtcccgatgatgccgcccaagggtccgggcacacaaaggcagtcctcaactataagaccaagac

SEQ ID NO: 52098 - DNA, 75 bp, Artificial Sequence
  Synthetic
tgtgacctagactactactgcaatatgggggactggccttcttgcacatacactggagtaacccaacataaccat

SEQ ID NO: 52099 - DNA, 75 bp, Artificial Sequence
  Synthetic
atacggctctaacaacaaaaacaagaagaagttcatcaccaactgcctgcttagcacagccttgtctgggaagaa

SEQ ID NO: 52100 - DNA, 75 bp, Artificial Sequence
  Synthetic
aaaaagcaggttatgacattgagagcatggacatagtcgcctctgaacatcttctccatcaatctcttgtgggga

SEQ ID NO: 52101 - DNA, 75 bp, Artificial Sequence
  Synthetic
tgggggactggccttcttgcacatacactggagtaacccaacataaccatgctgcatttgtaaatttgctcaata

SEQ ID NO: 52102 - DNA, 75 bp, Artificial Sequence
  Synthetic
catggacatagtcgcctctgaacatcttctccatcaatctcttgtggggaagcgctcgcccttccaaaacgccta

SEQ ID NO: 52103 - DNA, 75 bp, Artificial Sequence
  Synthetic
gggaatgaactgttgtataaggcacccagaaaggccttagcaactgtctgtagtgccctgtttgggaaacagata

SEQ ID NO: 52104 - DNA, 75 bp, Artificial Sequence
  Synthetic
gcacatggagacacaccacagttagacttgaaggccagaccaacttatggtgcaggggaggtcactgtactagtg

SEQ ID NO: 52105 - DNA, 75 bp, Artificial Sequence
  Synthetic
aggttcactgccaacacatctctactgctgtttttcttctgcattgctttgcttctattcttactttcattccta

SEQ ID NO: 52106 - DNA, 75 bp, Artificial Sequence
  Synthetic
tgctgtttttcttctgcattgctttgcttctattcttactttcattcctattctattctgttttgtaaaatttgg

SEQ ID NO: 52107 - DNA, 75 bp, Artificial Sequence
  Synthetic
caaagaaaattgagatatcaggcttgaagtttgcaagcctatcttgcacaggctgctatgcttgtagctctggta

SEQ ID NO: 52108 - DNA, 75 bp, Artificial Sequence
  Synthetic
cagcttctaatcgagattaagaggttgtatgctctacaagaagattctgaagtagagccaatagccataatttgt

SEQ ID NO: 52109 - DNA, 75 bp, Artificial Sequence
  Synthetic
aagcaatggtttcctgagggtgacctcactcgtagaagcaccaggaacgttgcaaatgcagaagaatttgtcata

SEQ ID NO: 52110 - DNA, 75 bp, Artificial Sequence
  Synthetic
gatagtacattcaaagccttttcagccatgcccaaaacctccttgtgcttttacattgtggagagagaatactgt

SEQ ID NO: 52111 - DNA, 75 bp, Artificial Sequence
  Synthetic
ccatgcccaaaacctccttgtgcttttacattgtggagagagaatactgtaagagctgcagtagagaagacacac

SEQ ID NO: 52112 - DNA, 75 bp, Artificial Sequence
  Synthetic
ccttcgattaaaggggaccgcatatgagggtctatttgccaactgttatggatggcagtatatcccggaagacat

SEQ ID NO: 52113 - DNA, 75 bp, Artificial Sequence
  Synthetic
caagatggagctagccagcacggacaatgagagggacgccatctacagctcagcactcattgaggccacccgatt

SEQ ID NO: 52114 - DNA, 75 bp, Artificial Sequence
  Synthetic
cataaaggaacgattattggaaagcaaaacgacacttgcacagctaaagcaagctgctggctagagtcagtcaaa

SEQ ID NO: 52115 - DNA, 75 bp, Artificial Sequence
  Synthetic
agctccctgccacaactggtatagacacctcaagtgcaagtgatgttgattccagtacgcaggcagccggagaca

SEQ ID NO: 52116 - DNA, 75 bp, Artificial Sequence
  Synthetic
cacctcaagtgcaagtgatgttgattccagtacgcaggcagccggagacacttccacactaacagtccgcacaag

SEQ ID NO: 52117 - DNA, 75 bp, Artificial Sequence
  Synthetic
tatatgctctacaggaagattctgaagtagagccaatagccataatttgtgacggcatagagagcaacatgaagc

SEQ ID NO: 52118 - DNA, 75 bp, Artificial Sequence
  Synthetic
tttcatagggattttcttattcattgctccttttgtcctgttaatacttttctttatgtttgggtggaggattct

SEQ ID NO: 52119 - DNA, 75 bp, Artificial Sequence
  Synthetic
ctatgagaaatctactttcagtcacgagccctgggccagaagaaacatctacaccttccggatcaggcaaagaga

SEQ ID NO: 52120 - DNA, 75 bp, Artificial Sequence
  Synthetic
tttgatgacattagaaactctccaacgcacagtacagcctggaagcatgcccttcgattaaaggggaccgcatat

SEQ ID NO: 52121 - DNA, 75 bp, Artificial Sequence
  Synthetic
acctcaaggacgatgaagaaaccggttacaggaaaatcattgagaggctaaataacaaaaagggaaaaaacaaac

SEQ ID NO: 52122 - DNA, 75 bp, Artificial Sequence
  Synthetic
agcgcatcatggaaaatttcactcgcctcatgcatgaaggaaagctttcaaccaagagaaaagacgaagattcaa

SEQ ID NO: 52123 - DNA, 75 bp, Artificial Sequence
  Synthetic
cccgcaacggcccaaggacctactgaagataacagtcacaacgccactgaacaccccgagcacctgacacagtca

SEQ ID NO: 52124 - DNA, 75 bp, Artificial Sequence
  Synthetic
caaaccaagtctgaccatgctgatacagacgttgttccctgacaaattcgaggatttcctggaccgaactcaact

SEQ ID NO: 52125 - DNA, 75 bp, Artificial Sequence
  Synthetic
acaaaatcacatatcggctaacttaatggaaaaagcctcaaaaggtgatgacagtatacccactaatactatagc

SEQ ID NO: 52126 - DNA, 75 bp, Artificial Sequence
  Synthetic
ttgacttttaaggactatggagagaggggaatagttgaggagaatcacatgatgttcagtgaggaggatcagctg

SEQ ID NO: 52127 - DNA, 75 bp, Artificial Sequence
  Synthetic
aggatttcctggaccgaactcaactacatccagagttcagagatttaactcctgacttttcgcttacacagaagg

SEQ ID NO: 52128 - DNA, 75 bp, Artificial Sequence
  Synthetic
atggaaaaagcctcaaaaggtgatgacagtatacccactaatactatagcttgtgttaacatcattaattgtgcc

SEQ ID NO: 52129 - DNA, 75 bp, Artificial Sequence
  Synthetic
ggggaatagttgaggagaatcacatgatgttcagtgaggaggatcagctggaaacaagacagttgttgttggtag

SEQ ID NO: 52130 - DNA, 75 bp, Artificial Sequence
  Synthetic
aaatggaaagatatattaaagctgttagagttactaggaattaagtgctcattcattgcctgtgctgactgttcg

SEQ ID NO: 52131 - DNA, 75 bp, Artificial Sequence
  Synthetic
attcattgcctgtgctgactgttcgtctacaccgccagacagatggtggattactgaggacagagtacgagtctt

SEQ ID NO: 52132 - DNA, 75 bp, Artificial Sequence
  Synthetic
agcgcatcatggaaaatttcactcgcctcatgcatgaaggaaagcctcaaaccaagagaaaaggtaaagatctaa

SEQ ID NO: 52133 - DNA, 75 bp, Artificial Sequence
  Synthetic
aaacaaagactctgacaccgtgaaggtctgggatgccaactaccaaaagctaagaacagagacaccgcctgctga

SEQ ID NO: 52134 - DNA, 75 bp, Artificial Sequence
  Synthetic
ttggctttcaaggactatggagagaggggaatagttgaggagaatcacatgaggtttagtgaagaggatcagctg

SEQ ID NO: 52135 - DNA, 75 bp, Artificial Sequence
  Synthetic
aaagagcatatacttaacaggcctacaggtttaacactgcctgccagtttggagcaggcaatgcgcaaaggatta

SEQ ID NO: 52136 - DNA, 75 bp, Artificial Sequence
  Synthetic
tgggaaaataaggacagaccataaaaaatggaaagacatactaaagctgttagagttactgggaatcaaatgctc

SEQ ID NO: 52137 - DNA, 75 bp, Artificial Sequence
  Synthetic
caggtttaacactgcctgccagtttggagcaggcaatgcgcaaaggattagtcgagggtgtggttatctccaagg

SEQ ID NO: 52138 - DNA, 75 bp, Artificial Sequence
  Synthetic
ttactgaagacagagtacgagtcttgaagaactcagtcagcttcctcttcaacaaactctctagaaattcaccta

SEQ ID NO: 52139 - DNA, 75 bp, Artificial Sequence
  Synthetic
gaagaactcagtcagcttcctcttcaacaaactctctagaaattcacctacagaagttactgacatcgttgttgg

SEQ ID NO: 52140 - DNA, 75 bp, Artificial Sequence
  Synthetic
caaaaactcctgtatcaacaaaagatgtcctagagacttgggaaaggatgaaagagcacatactcaacaggccta

SEQ ID NO: 52141 - DNA, 75 bp, Artificial Sequence
  Synthetic
gtcagtcagttttgaggcagtacaagacggaaatcaggattggcaaggcatcaaccggctctagaagattgcttt

SEQ ID NO: 52142 - DNA, 75 bp, Artificial Sequence
  Synthetic
tgtcctagagacttgggaaaggatgaaagagcacatactcaacaggcctacaggtttgacactgcctgccagttt

SEQ ID NO: 52143 - DNA, 75 bp, Artificial Sequence
  Synthetic
tatcaaatgtatgcaagaggtgtcccaagatagaagtagttagtcattgtgagaacaaaggttttgaggatagca

SEQ ID NO: 52144 - DNA, 75 bp, Artificial Sequence
  Synthetic
agggttctgaatcatgcatcaacatgttaaaggagaatttggaccggataactgatgagtttgagcggacaaaat

SEQ ID NO: 52145 - DNA, 75 bp, Artificial Sequence
  Synthetic
aaaactgagaaagagagaagagtcaagcgtaatgtagaatatctgataaaattgatgatgagcatgtcaggcatc

SEQ ID NO: 52146 - DNA, 75 bp, Artificial Sequence
  Synthetic
agcgtaatgtagaatatctgataaaattgatgatgagcatgtcaggcatcgactgtataaagtatcctacaggac

SEQ ID NO: 52147 - DNA, 75 bp, Artificial Sequence
  Synthetic
gaagtcattcaagctatgtgaaaatagtgccactgggaagagctgtgtgatagacagtgtcccagttaaatgcag

SEQ ID NO: 52148 - DNA, 75 bp, Artificial Sequence
  Synthetic
agttggctgagtgaagacatcaaatcatcaagatgtagtgaatgccttgctaacataaaaaagactgttgatgaa

SEQ ID NO: 52149 - DNA, 75 bp, Artificial Sequence
  Synthetic
aaagataggagtgatgacgaccaaagactggctgagaagatagacactgttaggaaagagctttcagaaaccaag

SEQ ID NO: 52150 - DNA, 75 bp, Artificial Sequence
  Synthetic
tactagtcactgtagtaactgtcaccccaacggtgtgaacattagcaacatatcaaatgtgtgcaagaggtgtcc

SEQ ID NO: 52151 - DNA, 75 bp, Artificial Sequence
  Synthetic
cccaacggtgtgaacattagcaacatatcaaatgtgtgcaagaggtgtcccagaatagaagtagtcagccattgt

SEQ ID NO: 52152 - DNA, 75 bp, Artificial Sequence
  Synthetic
gaggggtaatctcaaattcgctaaaaaacctctcgaagcaaggtaaatcaaagtgctctgtgccaagatcttggc

SEQ ID NO: 52153 - DNA, 75 bp, Artificial Sequence
  Synthetic
gcttgttaggctcacattaccggggaaaactgagaaggaaagaagagtaaaacggaatgtggaatgtctgattaa

SEQ ID NO: 52154 - DNA, 75 bp, Artificial Sequence
  Synthetic
aaaactgagaaggaaagaagagtaaaacggaatgtggaatgtctgattaaattgatgatgagcatgtcaggcatc

SEQ ID NO: 52155 - DNA, 75 bp, Artificial Sequence
  Synthetic
gtgtacaaggttctcggcaacctaggaaatgaactgttgtacaaggcacctagaaaggccttagcaactgtctgt

SEQ ID NO: 52156 - DNA, 75 bp, Artificial Sequence
  Synthetic
aaggaagaacttaaaaaatgtttcgatgcgcagtcttttaagttgatgaaaaacaaacaacctgtgccttttcag

SEQ ID NO: 52157 - DNA, 75 bp, Artificial Sequence
  Synthetic
tgtaaaatacaatgatggaaacttgaaagataggagtgatgacgaccaaagactggctgagaagatagatattgt

SEQ ID NO: 52158 - DNA, 75 bp, Artificial Sequence
  Synthetic
aaagataggagtgatgacgaccaaagactggctgagaagatagatattgttaggaaagaactttcggaaaccaaa

SEQ ID NO: 52159 - DNA, 75 bp, Artificial Sequence
  Synthetic
atagacactttagtctctttaatcaatgtgttaacaagattcacttggtttcaggaggtagtgctatatgggaag

SEQ ID NO: 52160 - DNA, 75 bp, Artificial Sequence
  Synthetic
aaacctctcaaagcaaggcaaatcaaaatgttctgtgccaaggtcttggcttgagaagatattgttcgatttaaa

SEQ ID NO: 52161 - DNA, 75 bp, Artificial Sequence
  Synthetic
ggtgcctactaaagatgaggaagtgctgataaatatcagaaattcactgaaggctagatcagaatttattagaaa

SEQ ID NO: 52162 - DNA, 75 bp, Artificial Sequence
  Synthetic
taagctagtcaaggtgagacactgtgatattaacttatcagtcaagctgccatcaaacaaaaaagagaatatgtt

SEQ ID NO: 52163 - DNA, 75 bp, Artificial Sequence
  Synthetic
tgaacaggaggcaagctgtccttggctcatcatacctttacattgtcattacgctttacatacaagtgctgcagc

SEQ ID NO: 52164 - DNA, 75 bp, Artificial Sequence
  Synthetic
tattggcacaccttatgaaggaattatagacactttagtttccttaatcaatgtgttaacaaggttcacttggtt

SEQ ID NO: 52165 - DNA, 75 bp, Artificial Sequence
  Synthetic
taagctagtcaaggtgagacactgtgacattaacctatcagttaagctgccatcaaataaaaaggagaacatgtt

SEQ ID NO: 52166 - DNA, 75 bp, Artificial Sequence
  Synthetic
tgaataggaggcaagctgtccttggttcatcatacctttatattgttattacactttacatacaagtgttgcagc

SEQ ID NO: 52167 - DNA, 75 bp, Artificial Sequence
  Synthetic
gacattgaaaatcactctatgactctgctagaagatgcattcaaagaactcacttctgcacttgagggtagattt

SEQ ID NO: 52168 - DNA, 75 bp, Artificial Sequence
  Synthetic
tgctagaagatgcattcaaagaactcacttctgcacttgagggtagatttgaagagtcttacaaaatacgaactt

SEQ ID NO: 52169 - DNA, 75 bp, Artificial Sequence
  Synthetic
ataatatcaagcactggaagcagagagacctgtgccctgaagtgaccattccatgttttacagtctatggaacct

SEQ ID NO: 52170 - DNA, 75 bp, Artificial Sequence
  Synthetic
agacctgtgccctgaagtgaccattccatgttttacagtctatggaacctttatcaacagcgacagacagctgat

SEQ ID NO: 52171 - DNA, 75 bp, Artificial Sequence
  Synthetic
cttaaacagaagcagcagagaccactttataagtattgtttcaggactaaacctggtttatggcttcctcataaa

SEQ ID NO: 52172 - DNA, 75 bp, Artificial Sequence
  Synthetic
agaaacagcagagaggcacatgctttgggagcttgatctgatgaattcactctgttctgacgaaaaaagagatgc

SEQ ID NO: 52173 - DNA, 75 bp, Artificial Sequence
  Synthetic
gtagaagaattgaagacaacattgcaagactttacctacaaacatctatatactgctcagttagagatgtggaag

SEQ ID NO: 52174 - DNA, 75 bp, Artificial Sequence
  Synthetic
acaacattaagcactggaaacaaagggatttgtgtcctgaagtaactatcccatgttttacagtctacggcacct

SEQ ID NO: 52175 - DNA, 75 bp, Artificial Sequence
  Synthetic
acgaaggatgtatcagcgtcttggaagaaacagcagaaaggcacatgctttgggagcttgatctgatgaattcac

SEQ ID NO: 52176 - DNA, 75 bp, Artificial Sequence
  Synthetic
tgggagcttgatctgatgaattcactctgttccgacgagaaaagagatgctagaaccgcaagactgctattgggc

SEQ ID NO: 52177 - DNA, 75 bp, Artificial Sequence
  Synthetic
tctgttccgacgagaaaagagatgctagaaccgcaagactgctattgggctgtccaaatgtgaggaaagctgcaa

SEQ ID NO: 52178 - DNA, 75 bp, Artificial Sequence
  Synthetic
tagacaaggcaaggagggatccaaagaactgggtcagcatctctgaagtaacagagacaacaagtatagtcgcat

SEQ ID NO: 52179 - DNA, 75 bp, Artificial Sequence
  Synthetic
tgcttcgagggaagctaaagaaacttggtgctatctctacaaacatagagatcggaaaaagggattgcctggatc

SEQ ID NO: 52180 - DNA, 75 bp, Artificial Sequence
  Synthetic
tactcagcacggttgacggtctaacagatcaacaaaaagaaaacatcgtgaatgggattttcgaaccctcaaagc

SEQ ID NO: 52181 - DNA, 75 bp, Artificial Sequence
  Synthetic
agtataaagaaaaccgttgatgaaactgccaatctatcagaaaagattgagttgctcgcttataatctgcaactc

SEQ ID NO: 52182 - DNA, 75 bp, Artificial Sequence
  Synthetic
ctgcttactgaggatggaaatctaatcttctgctggctaaaaacaatctcatcctcagttaaaggaagcttgaag

SEQ ID NO: 52183 - DNA, 75 bp, Artificial Sequence
  Synthetic
tcttctgctggctaaaaacaatctcatcctcagttaaaggaagcttgaagaaaaggctcaggtttatgaatatac

SEQ ID NO: 52184 - DNA, 75 bp, Artificial Sequence
  Synthetic
gaactgggtcagcatctctgaagtaacagagacaacaagtatagttgcatcacctaaaactcatatgatgctaaa

SEQ ID NO: 52185 - DNA, 75 bp, Artificial Sequence
  Synthetic
tgctccgagggaagctaaaaaaactcggtgccatctctaccaacatagagatcggtaaaagagactgcttggatc

SEQ ID NO: 52186 - DNA, 75 bp, Artificial Sequence
  Synthetic
cggtgccatctctaccaacatagagatcggtaaaagagactgcttggatctactcagcacggtcgatggtctgac

SEQ ID NO: 52187 - DNA, 75 bp, Artificial Sequence
  Synthetic
ttctcctcaacgaacaacaagatgagcaggagttgaagcaagatcttttaatatcttcttggattaagtgtataa

SEQ ID NO: 52188 - DNA, 75 bp, Artificial Sequence
  Synthetic
tatcatctgtctgaagagctatataacataaggctgcaacatctggaactatcaaagcttaagcaggagcatcca

SEQ ID NO: 52189 - DNA, 75 bp, Artificial Sequence
  Synthetic
tatccttctatcactggaaggagttagtcaaaaaaaacatagatgaggttttgcttactgaggatggaaatctaa

SEQ ID NO: 52190 - DNA, 75 bp, Artificial Sequence
  Synthetic
agtcaaaaaaaacatagatgaggttttgcttactgaggatggaaatctaatcttttgctggctaaaaacaatctc

SEQ ID NO: 52191 - DNA, 75 bp, Artificial Sequence
  Synthetic
acataaggctgcaacatctggaactatcaaagcttaagcaggagcatccaagtgtcagcttcactaaggaggagg

SEQ ID NO: 52192 - DNA, 75 bp, Artificial Sequence
  Synthetic
attatggaaacagtaaaccttatattctttgctgcactttcagctccttggtgtctacactataaagcactagag

SEQ ID NO: 52193 - DNA, 75 bp, Artificial Sequence
  Synthetic
attctccagaactaatgccagaaaactgcctcttttctagtgaggagtttaatgagctggtgaagttgaagaaac

SEQ ID NO: 52194 - DNA, 75 bp, Artificial Sequence
  Synthetic
aatgagctggtgaagttgaagaaacttctcctcaacgaacaacaggatgaacaggagttgaagcaggacctttta

SEQ ID NO: 52195 - DNA, 75 bp, Artificial Sequence
  Synthetic
ttgtaggctcactctacttgatctgtcagtttctaaactattagtttgtttgtatcgaagagatgatgaagaact

SEQ ID NO: 52196 - DNA, 75 bp, Artificial Sequence
  Synthetic
tcagtttctaaactattagtttgtttgtatcgaagagatgatgaagaactaacaaacagctcaagtttgaaactc

SEQ ID NO: 52197 - DNA, 75 bp, Artificial Sequence
  Synthetic
aaatgacaaggttcagaaatttatttatcatctgtctgaagagctatataacataaggctgcaacatctggaatt

SEQ ID NO: 52198 - DNA, 75 bp, Artificial Sequence
  Synthetic
tttctcgcttagtctgaacgacggaggtttggaccttgatttacacaaaaccactgacgagaagttgctacatca

SEQ ID NO: 52199 - DNA, 75 bp, Artificial Sequence
  Synthetic
aactggatgggcctcaaaatgatggaatcacaccaaccaatgccgttactcatgctgacatctttagttgcaacc

SEQ ID NO: 52200 - DNA, 75 bp, Artificial Sequence
  Synthetic
atcatggaaacagtgaacctcatattctttgctgctctttcagctccttggtgcttacactacaaagcactagag

SEQ ID NO: 52201 - DNA, 75 bp, Artificial Sequence
  Synthetic
tctttgctgctctttcagctccttggtgcttacactacaaagcactagagtcttacctggtgagacatccagaga

SEQ ID NO: 52202 - DNA, 75 bp, Artificial Sequence
  Synthetic
aaatagcaactttaatgtctgcaaaagattgaccggaaggagtaccggggaaaggcttccaagaagtgtcaggag

SEQ ID NO: 52203 - DNA, 75 bp, Artificial Sequence
  Synthetic
cagactctatactgcttgaaactgcctttactctatttactttgacctaaatctcgactgcgtgccgccactata

SEQ ID NO: 52204 - DNA, 75 bp, Artificial Sequence
  Synthetic
atgtgttaacctgatcacgttcgaggatggcctgagggaactatcagtgatacagagtcaccttaaagtctttga

SEQ ID NO: 52205 - DNA, 75 bp, Artificial Sequence
  Synthetic
tcagtttctaaactcttagtttgtttatatcgaagagatgacgaagaactaacgaacagctcgagcttaaaactc

SEQ ID NO: 52206 - DNA, 75 bp, Artificial Sequence
  Synthetic
tatatcgaagagatgacgaagaactaacgaacagctcgagcttaaaactcgggttcttagtaaagtatgctgtca

SEQ ID NO: 52207 - DNA, 75 bp, Artificial Sequence
  Synthetic
ggcactaaattatgaacaccgcttttatgcagttttagcacctaaagcacagctaggaggagcaagagatctgtt

SEQ ID NO: 52208 - DNA, 75 bp, Artificial Sequence
  Synthetic
ggcttggaccttgatttgcataaaaccactgacgagaagctgctacatcagacaaaaatagtttttgcgaagatt

SEQ ID NO: 52209 - DNA, 75 bp, Artificial Sequence
  Synthetic
gaatagcaactttaatgtctgcaagagattaaccggaaggagtactggagaaagacttccaagaagcgtcaggag

SEQ ID NO: 52210 - DNA, 75 bp, Artificial Sequence
  Synthetic
agattaaccggaaggagtactggagaaagacttccaagaagcgtcaggagcaaggtcatttatgagatggtaaaa

SEQ ID NO: 52211 - DNA, 75 bp, Artificial Sequence
  Synthetic
caataccaaatggggcccaatacactgctgttccttcttttcaggtatgatgcagcaggttcttaaaaatgttcc

SEQ ID NO: 52212 - DNA, 75 bp, Artificial Sequence
  Synthetic
attttgtgcacctatatatgagtgtgcgtgggttagctccactggcattgtgaaaaggggacttgaatggttcga

SEQ ID NO: 52213 - DNA, 75 bp, Artificial Sequence
  Synthetic
tatgcagttttagcacctaaggcacagctagggggagcaagagatctgttagtgcaagaaactggaaccaaagtc

SEQ ID NO: 52214 - DNA, 75 bp, Artificial Sequence
  Synthetic
aagtagaaataccagcaggcagtatcaaaaagatcttaaatgttcttagatacaaactatgcagcaaaggaggtg

SEQ ID NO: 52215 - DNA, 75 bp, Artificial Sequence
  Synthetic
tacaaactatgcagcaaaggaggtgtagagcagcacagtgaagaggacctgaggaagttgttggtagacaatttg

SEQ ID NO: 52216 - DNA, 75 bp, Artificial Sequence
  Synthetic
gattagactgccttaccaacatgcgaaaccttgatgggaaacccataagtgagggtagcaacttggtcaatttct

SEQ ID NO: 52217 - DNA, 75 bp, Artificial Sequence
  Synthetic
aagcaaggggctcatggcactaaacagctacaaccatatgggtcaaggcattcaccatgcaacctcttcagtgtt

SEQ ID NO: 52218 - DNA, 75 bp, Artificial Sequence
  Synthetic
gaaacagcagaaaggcacatgctttgggaactcgatctgatgaattcactctgttctgacgaaaaaagagatact

SEQ ID NO: 52219 - DNA, 75 bp, Artificial Sequence
  Synthetic
agaggagcttaccccagacaacagtacatgttgagcatgccggcagctctgatgattatgcaaagtgcatagtag

SEQ ID NO: 52220 - DNA, 75 bp, Artificial Sequence
  Synthetic
taaaaagattttaaatgttcttagatacaaactgtgcagtaaaggaggtgtggagcagcacagtgaagaggattt

SEQ ID NO: 52221 - DNA, 75 bp, Artificial Sequence
  Synthetic
ctatagagtgacccctgctgtgattaaatttatgtttactggactgataaatagctctgtaacttctcctcagag

SEQ ID NO: 52222 - DNA, 75 bp, Artificial Sequence
  Synthetic
aaatttatgtttactggactgataaatagctctgtaacttctcctcagagcttgatgcaggcatgccaagtttca

SEQ ID NO: 52223 - DNA, 75 bp, Artificial Sequence
  Synthetic
aaagaaagcattttgaaagactgtcttcaaatcatacggaaaaaccctagccacacaatgggttcttttgagctg

SEQ ID NO: 52224 - DNA, 75 bp, Artificial Sequence
  Synthetic
aagcaaagggctcatggcactaaacagttacaaccatatgggtcaaggtattcaccatgcaacctcttcagtgtt

SEQ ID NO: 52225 - DNA, 75 bp, Artificial Sequence
  Synthetic
agaggagcttgcctcagacaacagtacatgttgagcatgccggtagctctgatgattatgcaaaatgtatagtgg

SEQ ID NO: 52226 - DNA, 75 bp, Artificial Sequence
  Synthetic
tttaatcatgttgaagactttatcagaaggtatggcatattaactctcggaaccttgtctccctttggtaggcta

SEQ ID NO: 52227 - DNA, 75 bp, Artificial Sequence
  Synthetic
tggaagcacgcctgtagacttaagaatttcacagctgctgtacaaagatgttgtcaaatgaaagatagtgccaaa

SEQ ID NO: 52228 - DNA, 75 bp, Artificial Sequence
  Synthetic
atttcacagctgctgtacaaagatgttgtcaaatgaaagatagtgccaaaaccttagtgagtgactgctttttag

SEQ ID NO: 52229 - DNA, 75 bp, Artificial Sequence
  Synthetic
tgctgaagtcattgccagagcagctcaaacacttcatatgaacagtgtgtcaatccagtcaagtagcttgactac

SEQ ID NO: 52230 - DNA, 75 bp, Artificial Sequence
  Synthetic
gagtctgctttgggacaatccccgtggccaatcctgatgatgctgcccaaggatctggacataccaagtctattc

SEQ ID NO: 52231 - DNA, 75 bp, Artificial Sequence
  Synthetic
caatccagtcaagtagcttgactacattagatagtttaggtcatagcagaacaagttccacagttgaagatagca

SEQ ID NO: 52232 - DNA, 75 bp, Artificial Sequence
  Synthetic
aaattcatgttcactggactgataaacagctctgtaacctctccccagagtttgatgcaagcatgccaggtttct

SEQ ID NO: 52233 - DNA, 75 bp, Artificial Sequence
  Synthetic
actcagcacagtagatggtctaacagaccagcaaaaagaaaatattgtgaatgggatatttgaaccctcaaagtt

SEQ ID NO: 52234 - DNA, 75 bp, Artificial Sequence
  Synthetic
tacctcttgtcactaatactacctttaccttactaagacaacaaattttcttcaatcatgttgaagactttatca

SEQ ID NO: 52235 - DNA, 75 bp, Artificial Sequence
  Synthetic
tttgtaccgacctactctggattagtcagctcagcagttgctttggaagatgctgaagttattgctagggcagct

SEQ ID NO: 52236 - DNA, 75 bp, Artificial Sequence
  Synthetic
gcagaatggcagattcttgtgactggctgaaagatggtaagagaagagggaatctagaactggcaaacagaatcc

SEQ ID NO: 52237 - DNA, 75 bp, Artificial Sequence
  Synthetic
tcagctcagcagttgctttggaagatgctgaagttattgctagggcagctcaaacactccacatgaacagtgtgt

SEQ ID NO: 52238 - DNA, 75 bp, Artificial Sequence
  Synthetic
gctgaaagatggtaagagaagagggaatctagaactggcaaacagaatccaatctgtactgtgtgttttgatagc

SEQ ID NO: 52239 - DNA, 75 bp, Artificial Sequence
  Synthetic
acaagttcaacagttgaagatagcagcagtgtgagtgacaccactgctgcttctcatgattcgggatcatcatca

SEQ ID NO: 52240 - DNA, 75 bp, Artificial Sequence
  Synthetic
catcattaaatagggatgacaataaaatcatcgaagatcctatgatacaattgattccggagaaactgaggagag

SEQ ID NO: 52241 - DNA, 75 bp, Artificial Sequence
  Synthetic
gcagtgtgagtgacaccactgctgcttctcatgattcgggatcatcatcatcaagtttctcttttgagcttaata

SEQ ID NO: 52242 - DNA, 75 bp, Artificial Sequence
  Synthetic
aaatcaactcaagcctgtgagataattcagaacaggatcacaggcctttattgcaacagcaatgagggacctctt

SEQ ID NO: 52243 - DNA, 75 bp, Artificial Sequence
  Synthetic
agcattagccctgatgatactttagcccaacttgtggcaaaaaagctaattagcctcaatgtttcgacagaagaa

SEQ ID NO: 52244 - DNA, 75 bp, Artificial Sequence
  Synthetic
ttcagaacaggatcacaggcctttattgcaacagcaatgagggacctcttgatagacacaatgttatttacagca

SEQ ID NO: 52245 - DNA, 75 bp, Artificial Sequence
  Synthetic
aatctagaactagcaaatagaatccaatctgtgctatgtgttctgatagcaggttactacagatcatttggaggg

SEQ ID NO: 52246 - DNA, 75 bp, Artificial Sequence
  Synthetic
ttgcccctgccggggacaacaccggagctccctgctacaaccggcacagacacttcaagtgcaagtgatgtcgat

SEQ ID NO: 52247 - DNA, 75 bp, Artificial Sequence
  Synthetic
aatctgtgctatgtgttctgatagcaggttactacagatcatttggaggggaagggactgagaaacaggtaaagg

SEQ ID NO: 52248 - DNA, 75 bp, Artificial Sequence
  Synthetic
aaagaactctcgcttcctatatatacaatattcatgaagtcatacttcttcaaagacaacgtctttttgtcactt

SEQ ID NO: 52249 - DNA, 75 bp, Artificial Sequence
  Synthetic
taaacaattgactggtaggataatcaccaagtacactcactggttggacacttttctaagctgctctgtttccat

SEQ ID NO: 52250 - DNA, 75 bp, Artificial Sequence
  Synthetic
ctgattccagagaaactaaggagggagttggaaagactaggagtctctagaatggaagtcgatgaactgatgcca

SEQ ID NO: 52251 - DNA, 75 bp, Artificial Sequence
  Synthetic
agttggaaagactaggagtctctagaatggaagtcgatgaactgatgccaagtgttagccctgacgataccttgg

SEQ ID NO: 52252 - DNA, 75 bp, Artificial Sequence
  Synthetic
gatgtgtcaacctgatcacatttgaagacggtttgagggagctttcggtgatacaaagtcatctcaaagtttttg

SEQ ID NO: 52253 - DNA, 75 bp, Artificial Sequence
  Synthetic
tactcagcagaggtatccaggctcaaacaaacactaactgctcgaaatgttttgcacgggttagctggaggaata

SEQ ID NO: 52254 - DNA, 75 bp, Artificial Sequence
  Synthetic
gcaaccacaggcccaatgacctctccaacacagatagtccatccacaaagtgccacccccataaccgttcaagac

SEQ ID NO: 52255 - DNA, 75 bp, Artificial Sequence
  Synthetic
aaggtcatttatgagatggtaaaactagtaggtgaaacaggcatggcaatactacaacaattagcttttgcacag

SEQ ID NO: 52256 - DNA, 75 bp, Artificial Sequence
  Synthetic
acacatcctagcccaacgaacaggtctaaaagaaaccttgagatggaaataatcttgactttgtctcagggttta

SEQ ID NO: 52257 - DNA, 75 bp, Artificial Sequence
  Synthetic
gcacaaactaccgtgatagttgtggcaaacaattaactggtaagataataactaaatacactcactggctggaca

SEQ ID NO: 52258 - DNA, 75 bp, Artificial Sequence
  Synthetic
catgggttatctattagatgagtcagcaatttctgaagtcaaacctaccaaggttgatttttcgaatttacttaa

SEQ ID NO: 52259 - DNA, 75 bp, Artificial Sequence
  Synthetic
ccttcccttttcaaccccaacatcagatgtgtcaacttgatcacatttgaagacggcctgagggaactttcagtg

SEQ ID NO: 52260 - DNA, 75 bp, Artificial Sequence
  Synthetic
gatgtgtcaacttgatcacatttgaagacggcctgagggaactttcagtgatacaaagtcatcttaaagtttttg

SEQ ID NO: 52261 - DNA, 75 bp, Artificial Sequence
  Synthetic
attggactgtcttgctaacatgcgaaatcttgacggtaagcccataagtgaaggtagtaacttagttaattttta

SEQ ID NO: 52262 - DNA, 75 bp, Artificial Sequence
  Synthetic
atacaaagtcatcttaaagtttttgagaatgaattcaccaacctaaaccttcagttctctgatccaaacagacag

SEQ ID NO: 52263 - DNA, 75 bp, Artificial Sequence
  Synthetic
aatgatacaacaagcaaagccaactgtaactgttttctatatgctaaagggtaacttaatgaacacagaaccgac

SEQ ID NO: 52264 - DNA, 75 bp, Artificial Sequence
  Synthetic
gcaacaggttctaaaaaatgtaccagattggtgttcattttataaattaacattcattaagaacttgtgtagaca

SEQ ID NO: 52265 - DNA, 75 bp, Artificial Sequence
  Synthetic
ctgttttcagcaaccgaacaggttcggctatctaacaaccctgcagttgtcatgggttatcttttagatgaatca

SEQ ID NO: 52266 - DNA, 75 bp, Artificial Sequence
  Synthetic
gatgcctacctctgagtcaagcagataagtcttcactactcatgagtttcctaaattggagggtgaacatggaca

SEQ ID NO: 52267 - DNA, 75 bp, Artificial Sequence
  Synthetic
agaccgctttaaaataatgcaattcttcccctctgtgttcactttaatcaaaatgttaacagatgagtcatcaga

SEQ ID NO: 52268 - DNA, 75 bp, Artificial Sequence
  Synthetic
ttcccctctgtgttcactttaatcaaaatgttaacagatgagtcatcagactcagaaaaaaacggtcttagtcca

SEQ ID NO: 52269 - DNA, 75 bp, Artificial Sequence
  Synthetic
gaatttgacggacaagttattgctaatatacttgccagtgaattaagttctgtaaaacgagactctgaacgcgaa

SEQ ID NO: 52270 - DNA, 75 bp, Artificial Sequence
  Synthetic
aatgatacaacaagcaaagccaactgtgactgttttttatatgctaaagggcaacttaatgaacacggaaccaac

SEQ ID NO: 52271 - DNA, 75 bp, Artificial Sequence
  Synthetic
gtcagtcagttttgagacagtacaagacggaagtcaggattggcaaagcatcaaccggctccagaagattgcttt

SEQ ID NO: 52272 - DNA, 75 bp, Artificial Sequence
  Synthetic
gtgactgttttttatatgctaaagggcaacttaatgaacacggaaccaacagtagctgagcttgtcagttacggc

SEQ ID NO: 52273 - DNA, 75 bp, Artificial Sequence
  Synthetic
tacatattctgtaaaatactggaagattcttcactgcatttctgctattggatgcctacctctgagtcaagcaga

SEQ ID NO: 52274 - DNA, 75 bp, Artificial Sequence
  Synthetic
attcttcactgcatttctgctattggatgcctacctctgagtcaagcagacaagtcttcattactcatgagtttc

SEQ ID NO: 52275 - DNA, 75 bp, Artificial Sequence
  Synthetic
acatccatctttcatctgagtctgttgccctgttgtgtgagactgaaaggcaagtgctctcttggatgagcaaaa

SEQ ID NO: 52276 - DNA, 75 bp, Artificial Sequence
  Synthetic
tgtcaaatgaaagatagtgccaaaaccttagtgagcgactgctttcttgagttttacagtgagtttatgatgggc

SEQ ID NO: 52277 - DNA, 75 bp, Artificial Sequence
  Synthetic
tagccatgaagcaagtatacttagtgagtttgacggacaagtcattgctaatatacttgccagtgaattgagttc

SEQ ID NO: 52278 - DNA, 75 bp, Artificial Sequence
  Synthetic
gtcagtcatacctgatagcagcaatcctcgactactaaaatttgtgcctctcaagaaggggctggcagtggtgaa

SEQ ID NO: 52279 - DNA, 75 bp, Artificial Sequence
  Synthetic
taaattcacccactgaactgttgaaaaagaagccctacttaggaacaacctgcaagttcaacacttggggagact

SEQ ID NO: 52280 - DNA, 75 bp, Artificial Sequence
  Synthetic
aaagcgagcccaggttgcaatgggggcatggctgcttgtccattgtttatgatgaaaccgacactcagaccacat

SEQ ID NO: 52281 - DNA, 75 bp, Artificial Sequence
  Synthetic
gcatggctgcttgtccattgtttatgatgaaaccgacactcagaccacataccatgaaaaccttttgaaggtgaa

SEQ ID NO: 52282 - DNA, 75 bp, Artificial Sequence
  Synthetic
tgttttctgattccaaagtcgtcctctcaagaattaagttcaaaacggagctccttcttaactcattgacgttgc

SEQ ID NO: 52283 - DNA, 75 bp, Artificial Sequence
  Synthetic
ctcaagaattaagttcaaaacggagctccttcttaactcattgacgttgctccactgtttcttgaaacatgcccc

SEQ ID NO: 52284 - DNA, 75 bp, Artificial Sequence
  Synthetic
cagtgtgagcgacactactgctgcttcccatgactcaggatcgtcatcctcaagcttctcttttgagctcaatag

SEQ ID NO: 52285 - DNA, 75 bp, Artificial Sequence
  Synthetic
gtcagtcatacctgataacagcaatcctcgattacttaaatttgtgcctctaaaaaaaggactggcagtggtgaa

SEQ ID NO: 52286 - DNA, 75 bp, Artificial Sequence
  Synthetic
gcctctgtctgaaactgaactacagttcattaaagcactaagtagtctcaagtcaacacaagcctgtgaagtgat

SEQ ID NO: 52287 - DNA, 75 bp, Artificial Sequence
  Synthetic
gcggaatactgaggtgctcttcagagaaaagttgaacaaggtagttataaaggacaaccttgagcaaggagtaga

SEQ ID NO: 52288 - DNA, 75 bp, Artificial Sequence
  Synthetic
aaagtgagcccaggctacagtggggacatggctgcttgtccatcgtttatgatgaaaccgacactcagaccacat

SEQ ID NO: 52289 - DNA, 75 bp, Artificial Sequence
  Synthetic
acatggctgcttgtccatcgtttatgatgaaaccgacactcagaccacataccacgaaaacctcctcaaggtgaa

SEQ ID NO: 52290 - DNA, 75 bp, Artificial Sequence
  Synthetic
cgctaccactcagctgttggtctgaagttcaaagctatattgaagacataggcttcaacaacgtgcttgtgaata

SEQ ID NO: 52291 - DNA, 75 bp, Artificial Sequence
  Synthetic
taaagaaattcataagctgcacttgagcatctgcaaaaaaaggaaaacaggaagtaatgtcatgttggctgtctg

SEQ ID NO: 52292 - DNA, 75 bp, Artificial Sequence
  Synthetic
ttttttccgattccaaggtcgtcctttcgaggattaagtttaaaacggagcttctcctcaactcactgacgttgc

SEQ ID NO: 52293 - DNA, 75 bp, Artificial Sequence
  Synthetic
tccactgtttcttgaaacatgctcccagtgatgccataatggaagtggagagtaaaagtagcctactacacaaat

SEQ ID NO: 52294 - DNA, 75 bp, Artificial Sequence
  Synthetic
caaacaatgagctgggtgacgtgtcactgaaggtcaatattgtactggtgcccctcaaggacatgtccaagccaa

SEQ ID NO: 52295 - DNA, 75 bp, Artificial Sequence
  Synthetic
gcttctgtggaaatttacgttagataccaatgtaagtactacaagtaccatcaaggacataaggacactagtatc

SEQ ID NO: 52296 - DNA, 75 bp, Artificial Sequence
  Synthetic
ggattacaacaaactaattgaccactgtgtggacatggaaaaaaagagggacgcagttagagcagtggaagattt

SEQ ID NO: 52297 - DNA, 75 bp, Artificial Sequence
  Synthetic
tttgtgcgctttctatttccagaatgagtgcagtaagagagatgggcctagatgctcattcgcagcactgttgag

SEQ ID NO: 52298 - DNA, 75 bp, Artificial Sequence
  Synthetic
agtgtagcttgattgaagcgggcacaaggttcaatttgggtcctgtgaccatcacactgtcagaaccaagaaaca

SEQ ID NO: 52299 - DNA, 75 bp, Artificial Sequence
  Synthetic
caaacaatgagctgggtgatgtatcactgaaggtcaatattgtcttggtgcctcttaaggacatgtccaagccaa

SEQ ID NO: 52300 - DNA, 75 bp, Artificial Sequence
  Synthetic
ggagcaaataagcctggatgatctaatggcaagtgacacagtgacagacctgcctgacagggaagcagaggccct

SEQ ID NO: 52301 - DNA, 75 bp, Artificial Sequence
  Synthetic
cctcttaaggacatgtccaagccaaagcctgaaagggtggttatagccagaaggtcactaaatcatgctctgtcc

SEQ ID NO: 52302 - DNA, 75 bp, Artificial Sequence
  Synthetic
ttaatttttttggatgaaatgtcattacctgagcttaaatctttgtctgtaaattgcagaatggggaactttgaa

SEQ ID NO: 52303 - DNA, 75 bp, Artificial Sequence
  Synthetic
tgtgtaaattattgatacctttcaatgtccggagggcaagtaaggcaatttataccatgccatttgctgacattt

SEQ ID NO: 52304 - DNA, 75 bp, Artificial Sequence
  Synthetic
agattacaacaaattagttgaccattgtgtggatatggaaaaaaagagggatgcagttagagcagtggaagactt

SEQ ID NO: 52305 - DNA, 75 bp, Artificial Sequence
  Synthetic
atttcactacaatgttctcaactattggtcaacctttaatatccaactactccactctctttgctgctcatgtca

SEQ ID NO: 52306 - DNA, 75 bp, Artificial Sequence
  Synthetic
tgtgtggatatggaaaaaaagagggatgcagttagagcagtggaagacttagttctaatgctgacaggcagggca

SEQ ID NO: 52307 - DNA, 75 bp, Artificial Sequence
  Synthetic
tggtcaacctttaatatccaactactccactctctttgctgctcatgtcagttctgtcaatttcagggtgtgggg

SEQ ID NO: 52308 - DNA, 75 bp, Artificial Sequence
  Synthetic
aagaaacacgtgccgcttacgcccacagtgttctctgagtgttggcaaaatggaaaacaaaatcgaggtgaacag

SEQ ID NO: 52309 - DNA, 75 bp, Artificial Sequence
  Synthetic
agagcaaataagcctggatgatctaatggcaagtgacacagtgacagacctgcctgatagggaagcagaggctct

SEQ ID NO: 52310 - DNA, 75 bp, Artificial Sequence
  Synthetic
atggcaagtgacacagtgacagacctgcctgatagggaagcagaggctctcaaaacgggcaatcttggttttaac

SEQ ID NO: 52311 - DNA, 75 bp, Artificial Sequence
  Synthetic
tgtcttaaaggcaagtgagacagtttataccatgccacctgccaacctccgaaccttcagccaagttagctgctc

SEQ ID NO: 52312 - DNA, 75 bp, Artificial Sequence
  Synthetic
taaactggagggttaacatggacattagaacatctgactgtccactgtctagtcatgaggcaagtatattgagtg

SEQ ID NO: 52313 - DNA, 75 bp, Artificial Sequence
  Synthetic
tggccaatctttgctatactgctattacactttctttattgttctcatcagttttattatttaattgtttccagg

SEQ ID NO: 52314 - DNA, 75 bp, Artificial Sequence
  Synthetic
gcatcatactgaccaatgccgtcacccgtgccgacatctccagccgcaaccccactacattatcatcacaatata

SEQ ID NO: 52315 - DNA, 75 bp, Artificial Sequence
  Synthetic
gagcgagcctagattacagtgggggcatggctgcttgtccattgtttatgatgaaactgacactcagaccacata

SEQ ID NO: 52316 - DNA, 75 bp, Artificial Sequence
  Synthetic
tctcaaagaaatacttgcggcacgtcagtacgtaagtgttaactttgaggaagtggattgagcatcttaattgca

SEQ ID NO: 52317 - DNA, 75 bp, Artificial Sequence
  Synthetic
aagtggattgagcatcttaattgcagcatacctgtcaacatcatgcatatatcattaatgtatgcagtcctttgc

SEQ ID NO: 52318 - DNA, 75 bp, Artificial Sequence
  Synthetic
gacggtgatgtgtttacagctgtgaaccttttgcactctggacaaacacactttgatgcgctcagaatactgcca

SEQ ID NO: 52319 - DNA, 75 bp, Artificial Sequence
  Synthetic
tgttggcaagcagtctccatttcaaaatgcctacaacgtcaaggggaacgccaccagtgccaacatcatctaaag

SEQ ID NO: 52320 - DNA, 75 bp, Artificial Sequence
  Synthetic
aaccagtgtaaggcagtaaaagaactcatcaacagtacaggactctcagacttggaattggaaagcttacttact

SEQ ID NO: 52321 - DNA, 75 bp, Artificial Sequence
  Synthetic
gagcaaataagcttagacgacctaatggcaaacgacacggtaacagacttgcctgatagggaagcagaagccctc

SEQ ID NO: 52322 - DNA, 75 bp, Artificial Sequence
  Synthetic
aaatgttactcaggaacatctaattcagggcttcaattgattaatattacccgacattcaactagaatagttgac

SEQ ID NO: 52323 - DNA, 75 bp, Artificial Sequence
  Synthetic
taaagaccatcaactgcataaacttgaaggcatcgatcttcaaagaacatagagaggttgaaatcaatgtgcttc

SEQ ID NO: 52324 - DNA, 75 bp, Artificial Sequence
  Synthetic
agcagtgccggtgacagaaagaaagatgttccctcttcctgagactccgctaagtgaggtgcattcaatagagcg

SEQ ID NO: 52325 - DNA, 75 bp, Artificial Sequence
  Synthetic
taagtgaggtgcattcaatagagcgtataatggaaaactttacccgcctcatgcatggaggaagactttcggcca

SEQ ID NO: 52326 - DNA, 75 bp, Artificial Sequence
  Synthetic
tatctaggggctcagaggttgtcttagatgcatgtgatacaagctgtgaaataatgatacctaagggcactggtg

SEQ ID NO: 52327 - DNA, 75 bp, Artificial Sequence
  Synthetic
gattccttccagcagaacaggatctacatgcaccctgctgtgctgacagctggcagaattagtgagatgggtgtc

SEQ ID NO: 52328 - DNA, 75 bp, Artificial Sequence
  Synthetic
acatgcaccctgctgtgctgacagctggcagaattagtgagatgggtgtctgctttgggacaatccctgtggcca

SEQ ID NO: 52329 - DNA, 75 bp, Artificial Sequence
  Synthetic
cactagggaaaaggttcaagcagtatagagagttaaaacctcagacctgcaccatatgtgagacaactcctgtaa

SEQ ID NO: 52330 - DNA, 75 bp, Artificial Sequence
  Synthetic
ttccaaaatgcctacaatgtcaagggcaacgccaccagtgccaacatcatctgaagttcaaaatactctgtattc

SEQ ID NO: 52331 - DNA, 75 bp, Artificial Sequence
  Synthetic
cagatgggcttgctaggcatgtgacacaatgccctaagcggaaggagaaagtggaagaaactgaactgtacttga

SEQ ID NO: 52332 - DNA, 75 bp, Artificial Sequence
  Synthetic
gcaacgccaccagtgccaacatcatctgaagttcaaaatactctgtattcaacttctctcctcttgcactgttgt

SEQ ID NO: 52333 - DNA, 75 bp, Artificial Sequence
  Synthetic
tctcaaagaaatacttgcggcacgtcagtacgtaagtgttaactttgagtgtgtgtaaagagcagcttgtgatca

SEQ ID NO: 52334 - DNA, 75 bp, Artificial Sequence
  Synthetic
gtgtgtaaagagcagcttgtgatcaacatgttattccactttaaatttatgttgctgattaattttattctttgt

SEQ ID NO: 52335 - DNA, 75 bp, Artificial Sequence
  Synthetic
acatgttattccactttaaatttatgttgctgattaattttattctttgtcatctcctttgggggggtggtggag

SEQ ID NO: 52336 - DNA, 75 bp, Artificial Sequence
  Synthetic
ccaccagtcacctcaaacagcacaactccaggtccatcaacagacactgccacggagacagcgtcaagcatgacc

SEQ ID NO: 52337 - DNA, 75 bp, Artificial Sequence
  Synthetic
actagcacgccggacacacaagtaaccacagacaatggctctggtgagcctagcacagatcctctaaccaccaat

SEQ ID NO: 52338 - DNA, 75 bp, Artificial Sequence
  Synthetic
ccacagacaatggctctggtgagcctagcacagatcctctaaccaccaatgaggcaaccccccctctctctgtca

SEQ ID NO: 52339 - DNA, 75 bp, Artificial Sequence
  Synthetic
acctcgacaaatccagatgccaccaccccgagtatcaccatattgagtgcatcaaatactagcttgcccatatca

SEQ ID NO: 52340 - DNA, 75 bp, Artificial Sequence
  Synthetic
tcagtgcatgcaagcccatcacccagctccagtgaagaaccaacaccacaaaatgcacaccatctctccagaagt

SEQ ID NO: 52341 - DNA, 75 bp, Artificial Sequence
  Synthetic
cgcagccaaagagattacaaccaaaaatagcccgccaacagccggaaatgacacaatggtcacatcagctccaaa

SEQ ID NO: 52342 - DNA, 75 bp, Artificial Sequence
  Synthetic
aatagcccgccaacagccggaaatgacacaatggtcacatcagctccaaacggcaatatacgcaacactccagaa

SEQ ID NO: 52343 - DNA, 75 bp, Artificial Sequence
  Synthetic
aagattattcaacttatgcaaggggagtgatatcaaattcactaaaaaacctctcaaggcaaggtaaatcaaagt

SEQ ID NO: 52344 - DNA, 75 bp, Artificial Sequence
  Synthetic
agtgatatcaaattcactaaaaaacctctcaaggcaaggtaaatcaaagtgttctgtgccaagatcttggctcga

SEQ ID NO: 52345 - DNA, 75 bp, Artificial Sequence
  Synthetic
aaaccaacagaccgttacaccagaggctacacctatcaccacaatcactgcactcacagacctaacaaacaggtc

SEQ ID NO: 52346 - DNA, 75 bp, Artificial Sequence
  Synthetic
gctacacctatcaccacaatcactgcactcacagacctaacaaacaggtccaaaagggactccaaggtacagaaa

SEQ ID NO: 52347 - DNA, 75 bp, Artificial Sequence
  Synthetic
actcttgcaattaacacaagaagaagattctgaaggtctgcttgagtggtgcacacgggtgctggaacaagcatg

SEQ ID NO: 52348 - DNA, 75 bp, Artificial Sequence
  Synthetic
gattctgaaggtctgcttgagtggtgcacacgggtgctggaacaagcatgtgatgatgactacttcaataagagg

SEQ ID NO: 52349 - DNA, 75 bp, Artificial Sequence
  Synthetic
tgagtctaaactgcttacagtctctgtcatggacttgtctcagatgtactctcctgtcttcgagtacttatcagg

SEQ ID NO: 52350 - DNA, 75 bp, Artificial Sequence
  Synthetic
gttcaggttacatgacgcacttagcaacaccgagcctgcccagaccacttcacctacagctgtacccttcaaatc

SEQ ID NO: 52351 - DNA, 75 bp, Artificial Sequence
  Synthetic
aacaccgagcctgcccagaccacttcacctacagctgtacccttcaaatcttactatgccaaagggtctctaacc

SEQ ID NO: 52352 - DNA, 75 bp, Artificial Sequence
  Synthetic
tggctgcacctgttgtggattagatgtgaaagacctttttacagattatatgtttgtcaagtggaaagttgaata

SEQ ID NO: 52353 - DNA, 75 bp, Artificial Sequence
  Synthetic
aggattgcagctgattaatgtcacacaacaccctgtaaaaatagctaacactccaggtccaaaattatctaatct

SEQ ID NO: 52354 - DNA, 75 bp, Artificial Sequence
  Synthetic
caacaccctgtaaaaatagctaacactccaggtccaaaattatctaatctcaagaccattaactgcataaacctg

SEQ ID NO: 52355 - DNA, 75 bp, Artificial Sequence
  Synthetic
caggagacaagctgtccttggttcttcatacctttacattgtcattacactttatatacaagtgctgcagcagta

SEQ ID NO: 52356 - DNA, 75 bp, Artificial Sequence
  Synthetic
acctcaggttgccgttaatctctcaaactgtcatgtttccattaagtcacatgtttgtgattattccttggacac

SEQ ID NO: 52357 - DNA, 75 bp, Artificial Sequence
  Synthetic
aactgtcatgtttccattaagtcacatgtttgtgattattccttggacaccgatggagcaataaaactccctaga

SEQ ID NO: 52358 - DNA, 75 bp, Artificial Sequence
  Synthetic
ttgaaaatcattccatgactctactagaagattcattcagggaaatcacttttgctcttgaaggtaggtttgaag

SEQ ID NO: 52359 - DNA, 75 bp, Artificial Sequence
  Synthetic
caaaaaaaacaacctaaatgataggtgtacattaatcaccaattgtgtcataaagggaagagaagtccgaaaagg

SEQ ID NO: 52360 - DNA, 75 bp, Artificial Sequence
  Synthetic
tgtacattaatcaccaattgtgtcataaagggaagagaagtccgaaaagggcagtcggctttgaggcagtataaa

SEQ ID NO: 52361 - DNA, 75 bp, Artificial Sequence
  Synthetic
agaaggaggaagcagtgactgcatttcaagaactcagctagttaaaacggaggttgcagaaattcatgaggacag

SEQ ID NO: 52362 - DNA, 75 bp, Artificial Sequence
  Synthetic
atactggacatctgtactgtatcacttggcatcatgttgtcaacattcttatatggctctaacaataagaacaag

SEQ ID NO: 52363 - DNA, 75 bp, Artificial Sequence
  Synthetic
tcaagaactcagctagttaaaacggaggttgcagaaattcatgaggacagttacggtgggcctggtgagaaaata

SEQ ID NO: 52364 - DNA, 75 bp, Artificial Sequence
  Synthetic
ctttacctgcagacatccatatactgttcagttagggatgtggaggacaatgttaagcactggaaacaaagagat

SEQ ID NO: 52365 - DNA, 75 bp, Artificial Sequence
  Synthetic
gggctgttatacaatcaacagagtaagatcctacaagctatgcgagaacagtgcctcagggaaaagctgtgaaat

SEQ ID NO: 52366 - DNA, 75 bp, Artificial Sequence
  Synthetic
taaaatttgcaagcttgacttgcacaggttgttatgcttgtagctctggcatctcatgcaaagttagaattcatg

SEQ ID NO: 52367 - DNA, 75 bp, Artificial Sequence
  Synthetic
ctatgtcctgaagtgaccattccatgctttacagtctatggaacctttgtcaacagcgatagacaactgatcttt

SEQ ID NO: 52368 - DNA, 75 bp, Artificial Sequence
  Synthetic
agatcctacaagctatgcgagaacagtgcctcagggaaaagctgtgaaatagatagcatcccagtcaaatgcaaa

SEQ ID NO: 52369 - DNA, 75 bp, Artificial Sequence
  Synthetic
tggatgaaccagatgaacttacagtacatgttaaaagtgatgatccagatgtagttgcagctagctcaagtctca

SEQ ID NO: 52370 - DNA, 75 bp, Artificial Sequence
  Synthetic
gtccagagggacagaaattgttctagatgtctgtgattccagctgtgagctgatgatacccaagggcactggaga

SEQ ID NO: 52371 - DNA, 75 bp, Artificial Sequence
  Synthetic
ataaagaaatggacaactttgatgaaggatgtatcagcgtcttggaagaaacagcagaaaggcatatgctttggg

SEQ ID NO: 52372 - DNA, 75 bp, Artificial Sequence
  Synthetic
gatgtctgtgattccagctgtgagctgatgatacccaagggcactggagacattttagtggattgctcaggaggg

SEQ ID NO: 52373 - DNA, 75 bp, Artificial Sequence
  Synthetic
cccattactgggtaaaatggccatatatgtctgcagaatgtcaaaccacccaaaaactaccatggcatttctgtt

SEQ ID NO: 52374 - DNA, 75 bp, Artificial Sequence
  Synthetic
tatgtctgcagaatgtcaaaccacccaaaaactaccatggcatttctgttctggttcagctttggctatgtcatt

SEQ ID NO: 52375 - DNA, 75 bp, Artificial Sequence
  Synthetic
agtagggaaaaagctaaaacagtatagagagctgaaaccacaaacatgcattgtctgtgaatctgtccctgttaa

SEQ ID NO: 52376 - DNA, 75 bp, Artificial Sequence
  Synthetic
agagagctgaaaccacaaacatgcattgtctgtgaatctgtccctgttaatgcaatagatgctgaaatgcatgag

SEQ ID NO: 52377 - DNA, 75 bp, Artificial Sequence
  Synthetic
agcaagcaataacggacatttgccagttttctgagtacacaccaaacaaagaaagcattttgaaagactgtcttc

SEQ ID NO: 52378 - DNA, 75 bp, Artificial Sequence
  Synthetic
agacgggctcatcaggcacgtaactcagtgtcccaaacggagggagaaggtggaagagactgagctattcttgaa

SEQ ID NO: 52379 - DNA, 75 bp, Artificial Sequence
  Synthetic
cagtgtcccaaacggagggagaaggtggaagagactgagctattcttgaacttggaaagaataccttggctggtg

SEQ ID NO: 52380 - DNA, 75 bp, Artificial Sequence
  Synthetic
ctgttggatgatcacactcctcattctactattggtttcgatatcaccagtccaatctgcaccggtaggcaaaga

SEQ ID NO: 52381 - DNA, 75 bp, Artificial Sequence
  Synthetic
gagggcaatcgagacctatcaagcaagagaaacctacacaggcatatgcctctttgtgttaggaagtgttctctt

SEQ ID NO: 52382 - DNA, 75 bp, Artificial Sequence
  Synthetic
tatgaacagactctataatgcttggaactgcctttgctctattcactctgacctaaatcttgactgcgtgccgcc

SEQ ID NO: 52383 - DNA, 75 bp, Artificial Sequence
  Synthetic
ggaaaagggattgcctagatctactcagcacagtagatgggctaacagaccagcaaaaagaaaatattgtgaatg

SEQ ID NO: 52384 - DNA, 75 bp, Artificial Sequence
  Synthetic
tctcccctggactttctgtctgcaagacatgctccattggtagtataaatggatttgaaatagagtctcataaat

SEQ ID NO: 52385 - DNA, 75 bp, Artificial Sequence
  Synthetic
gacatgctccattggtagtataaatggatttgaaatagagtctcataaatgctattgcagtctattctgttgtcc

SEQ ID NO: 52386 - DNA, 75 bp, Artificial Sequence
  Synthetic
atgtttgcaaaaaaaggaagatgggtagcaatgtcatgctggctgtctgtaaacgtatgtgctttagagcaacca

SEQ ID NO: 52387 - DNA, 75 bp, Artificial Sequence
  Synthetic
tagcaatgtcatgctggctgtctgtaaacgtatgtgctttagagcaaccattgaggcaagcaataaggctttact

SEQ ID NO: 52388 - DNA, 75 bp, Artificial Sequence
  Synthetic
tagacaaggcaaggagagacccgaagaactgggtcagcatttctgaagttactgaaacaacaagtatagttgcat

SEQ ID NO: 52389 - DNA, 75 bp, Artificial Sequence
  Synthetic
caatctgtgtggtaagcacctccgcagttgatatggaaaatttgcctgcaggcatctgggagaaagaagaagatc

SEQ ID NO: 52390 - DNA, 75 bp, Artificial Sequence
  Synthetic
gaacctcttgcactctggacaaacacactttgacgcgctcagaatactgccacagtttgaaacagacaagagaga

SEQ ID NO: 52391 - DNA, 75 bp, Artificial Sequence
  Synthetic
tgcccgtatgaggccatggtactcaggaagccactcttcctggatagcacagccaagggaatgaaaagcctgttg

SEQ ID NO: 52392 - DNA, 75 bp, Artificial Sequence
  Synthetic
aaggctgcagcacctggaactgtcaaagcttaagcaagagcaccctagtgtcagcttcacaaaagaagaggtctt

SEQ ID NO: 52393 - DNA, 75 bp, Artificial Sequence
  Synthetic
cttctagtgatgagctgcaagattatgaagaccttgccttggcactcacaagcacagaggaatcgtatagacggt

SEQ ID NO: 52394 - DNA, 75 bp, Artificial Sequence
  Synthetic
tgaagaccttgccttggcactcacaagcacagaggaatcgtatagacggtcgagcttggatgaggtcactttgtc

SEQ ID NO: 52395 - DNA, 75 bp, Artificial Sequence
  Synthetic
ccaacagtttcagctgctaacatagcacttagctggagttcagttgaacacaggggcaacaaaattttagtttca

SEQ ID NO: 52396 - DNA, 75 bp, Artificial Sequence
  Synthetic
tggtcaacaaaagtcagaacataccgaccagagtcggaagggttttggactgcatgttcaactgtaaattatgtg

SEQ ID NO: 52397 - DNA, 75 bp, Artificial Sequence
  Synthetic
gaatctgggtgtagaagatgcttctgagtcaaagacgcttactgtttccgtcatggacctgtcacaaatgtactc

SEQ ID NO: 52398 - DNA, 75 bp, Artificial Sequence
  Synthetic
gagtcaaagacgcttactgtttccgtcatggacctgtcacaaatgtactctcctgtttttgagtacttgtcaggt

SEQ ID NO: 52399 - DNA, 75 bp, Artificial Sequence
  Synthetic
aatagctcaagtttaaaacttgggtttttagtgaaatatgctgtcaccttgttcacatccaatggtgaacctttt

SEQ ID NO: 52400 - DNA, 75 bp, Artificial Sequence
  Synthetic
tctaaggccagaatcaaaagagaaaattggtgaaatcatgtcattgcggcagctggggcacaagctgctgacacg

SEQ ID NO: 52401 - DNA, 75 bp, Artificial Sequence
  Synthetic
agagagatgcggctgcacttcgtcaacctgcttacataaagagtggccacattcaagaaactggcgatgtaatcc

SEQ ID NO: 52402 - DNA, 75 bp, Artificial Sequence
  Synthetic
acctgcttacataaagagtggccacattcaagaaactggcgatgtaatcctacctggtgttggggggtggggact

SEQ ID NO: 52403 - DNA, 75 bp, Artificial Sequence
  Synthetic
cctggaacaggaatagaaaggcatatgcagctgctacactctgagatgatactggatatctgcactgtatcactt

SEQ ID NO: 52404 - DNA, 75 bp, Artificial Sequence
  Synthetic
gctggtaaaatggaaagtggaatatataaagacagaagctatagtgtgtgtcgagctgactagtcaagagaggca

SEQ ID NO: 52405 - DNA, 75 bp, Artificial Sequence
  Synthetic
ataaagacagaagctatagtgtgtgtcgagctgactagtcaagagaggcagtgtagtttaattgaagcaggcaca

SEQ ID NO: 52406 - DNA, 75 bp, Artificial Sequence
  Synthetic
gaaattcatcaccaactgtttgctcagtacagctctgtctggaaagaaggtgtacaaggttcttggtaacctagg

SEQ ID NO: 52407 - DNA, 75 bp, Artificial Sequence
  Synthetic
ccagcagaggcttcctcccgaaattgtaacactgcatcctaaaatagaggaaggtttttttgatttgatgcatgt

SEQ ID NO: 52408 - DNA, 75 bp, Artificial Sequence
  Synthetic
gtaacactgcatcctaaaatagaggaaggtttttttgatttgatgcatgtacaaaaaatactgtctgcaagcaca

SEQ ID NO: 52409 - DNA, 75 bp, Artificial Sequence
  Synthetic
caaacttcagaattgcttcaggaccataagccctgttagcttacttgctttaagaaatctagactttgactgtct

SEQ ID NO: 52410 - DNA, 75 bp, Artificial Sequence
  Synthetic
tccagcttctcttttgagctcaataggcctctgtctgaaaccgaactacaattcattaaagcattaagtagcctc

SEQ ID NO: 52411 - DNA, 75 bp, Artificial Sequence
  Synthetic
ctaccatgtcggtaacctgctgaggggagacaaggttaatggacactcaattcacaagatagaaccacattttaa

SEQ ID NO: 52412 - DNA, 75 bp, Artificial Sequence
  Synthetic
ggagacaaggttaatggacactcaattcacaagatagaaccacattttaatacttcatggatgtcatgggatggt

SEQ ID NO: 52413 - DNA, 75 bp, Artificial Sequence
  Synthetic
atagaaaatatgtctaaattagacaacactgatgttgaattcaatcaccgggagatagctgatctcaatcaatta

SEQ ID NO: 52414 - DNA, 75 bp, Artificial Sequence
  Synthetic
ggagatagctgatctcaatcaattaacttctcggctcattacgttaagaaaggagaaagacactgaccttctcag

SEQ ID NO: 52415 - DNA, 75 bp, Artificial Sequence
  Synthetic
aggagaaagacactgaccttctcagacaatggtatcctgaaagtgacctcacccgcagaagtactaggaatgctg

SEQ ID NO: 52416 - DNA, 75 bp, Artificial Sequence
  Synthetic
cactggagtgacacagcataaccgtgctgcatttatcaacatgctcaacattgagactgactatacaaaaacttt

SEQ ID NO: 52417 - DNA, 75 bp, Artificial Sequence
  Synthetic
gctgcatttatcaacatgctcaacattgagactgactatacaaaaactttccactttcattcgaagagggtcacg

SEQ ID NO: 52418 - DNA, 75 bp, Artificial Sequence
  Synthetic
atgaaattcatcagcacttcaggcagggcaatgagtgcaggcaagattggtaatgtcctttcctatgcccataat

SEQ ID NO: 52419 - DNA, 75 bp, Artificial Sequence
  Synthetic
agaaatacctgctggcagtattaagaagatcttaaatgttcttagatacagattgtgcagcaaaggaggtgtaga

SEQ ID NO: 52420 - DNA, 75 bp, Artificial Sequence
  Synthetic
tgctggcgaggtcactgttctagtggaggttgcagacttggagttgcacacaaagaaccttgaagtgtcaggttt

SEQ ID NO: 52421 - DNA, 75 bp, Artificial Sequence
  Synthetic
gaggttgcagacttggagttgcacacaaagaaccttgaagtgtcaggtttgaaaattgcaagtttgacctgctct

SEQ ID NO: 52422 - DNA, 75 bp, Artificial Sequence
  Synthetic
gcttctgatcgagatcaagcgattgtatgctttgcaagaagactctgaagtggaaccgatagccataatctgtga

SEQ ID NO: 52423 - DNA, 75 bp, Artificial Sequence
  Synthetic
aaatgaaccagatgaatttacagtacatgtaagaagtagcgacccagatgttgtagcagcaggatcaagtcttat

SEQ ID NO: 52424 - DNA, 75 bp, Artificial Sequence
  Synthetic
catgtaagaagtagcgacccagatgttgtagcagcaggatcaagtcttatggcaaggaaaatagagtttggggct

SEQ ID NO: 52425 - DNA, 75 bp, Artificial Sequence
  Synthetic
ttacatagtagaaaaggattactgcagcagctgcaccgacgatgacacacaaaagtgtgtcaacacgaagcttga

SEQ ID NO: 52426 - DNA, 75 bp, Artificial Sequence
  Synthetic
aggtctgtttgcaaactgttacggctggcaatacattccagaagatattaaaccaagcctgaccatgctgataca

SEQ ID NO: 52427 - DNA, 75 bp, Artificial Sequence
  Synthetic
agcagctgcaccgacgatgacacacaaaagtgtgtcaacacgaagcttgaccatccacagagcatactcattgag

SEQ ID NO: 52428 - DNA, 75 bp, Artificial Sequence
  Synthetic
aagctgctggctagaatcagttaagggttttttctatgggctaaaaaacatgctaagtggcatctttggaaatgt

SEQ ID NO: 52429 - DNA, 75 bp, Artificial Sequence
  Synthetic
ttttttaggcatcttcttattccttgctccttttgtgctactgatattttttttcttttttgggtggaggcttct

SEQ ID NO: 52430 - DNA, 75 bp, Artificial Sequence
  Synthetic
agatgttccctcttcctgagactccgctaagtgaagtgcattcaatagagcgtataatggaaaattttacccgcc

SEQ ID NO: 52431 - DNA, 75 bp, Artificial Sequence
  Synthetic
gttttgtctcaaatgttgcagaagaactagaggactgttgaaatacaagcaccttaaggatgaagaggaggctgg

SEQ ID NO: 52432 - DNA, 75 bp, Artificial Sequence
  Synthetic
actagaggactgttgaaatacaagcaccttaaggatgaagaggaggctggatacaaaaaaatcattgaaaggcta

SEQ ID NO: 52433 - DNA, 75 bp, Artificial Sequence
  Synthetic
gaacaaggcagccagcaaagcaccactgaatacgagggctccagcatctctgccttcaaggactacggagagaga

SEQ ID NO: 52434 - DNA, 75 bp, Artificial Sequence
  Synthetic
gtatggtatactgactcttgggactttgtcaccctttggtaggttgttcgtaccaacctactctggattagtcag

SEQ ID NO: 52435 - DNA, 75 bp, Artificial Sequence
  Synthetic
caggaagattgctgagcttttttctactaaaattcacataggttaacaaaccaggcaaagctctagctgcagcag

SEQ ID NO: 52436 - DNA, 75 bp, Artificial Sequence
  Synthetic
ccaggcaaagctctagctgcagcagcacctgccctatcaacgctgtcacatggtttgcttaacaaaacatggctt

SEQ ID NO: 52437 - DNA, 75 bp, Artificial Sequence
  Synthetic
ctctctttttttacttctagttgattatgctgcctgacactactcctgccaaacttcatttagacttaaccttga

SEQ ID NO: 52438 - DNA, 75 bp, Artificial Sequence
  Synthetic
atggacttgtggacacttacacaaactcctattctttttgtgaaagtgttccaaatctggatagatttgtatttc

SEQ ID NO: 52439 - DNA, 75 bp, Artificial Sequence
  Synthetic
ctcctattctttttgtgaaagtgttccaaatctggatagatttgtatttcagatggctggtgccactgatgatgc

SEQ ID NO: 52440 - DNA, 75 bp, Artificial Sequence
  Synthetic
aaacacgaactcacacagaatattaccacgagtgaaaagatgctattgagttggttgagtgaagatatcaaatca

SEQ ID NO: 52441 - DNA, 75 bp, Artificial Sequence
  Synthetic
acgagatgtggtgaatgcctcacaaacataaagaaaaccgttgatgaaactgctaacctatcagaaaagattgag

SEQ ID NO: 52442 - DNA, 75 bp, Artificial Sequence
  Synthetic
gttaaagagatgttgtcagatatgattagaaggaggaacttgatcctcaacagaggtggtgacgagaacccacgc

SEQ ID NO: 52443 - DNA, 75 bp, Artificial Sequence
  Synthetic
tccaatgtgtgcaagagatgtcccaagatagaagtggtcagccactgtgaaaataaaggctttgaggacagcaat

SEQ ID NO: 52444 - DNA, 75 bp, Artificial Sequence
  Synthetic
gccgttctggaatagcacttgttgcaacaggccttgccaagcttgcagagactgaagggaaaggagtctttgacg

SEQ ID NO: 52445 - DNA, 75 bp, Artificial Sequence
  Synthetic
caattaacaggtagaataattaccaagtatactcactggttggacacttttctgggctgctctgtctccatcaac

SEQ ID NO: 52446 - DNA, 75 bp, Artificial Sequence
  Synthetic
gacgaagttgacaaagcaagtgccgacaacatggtaacaaaccttcttaagcatgtcgctaaggcacaagagctt

SEQ ID NO: 52447 - DNA, 75 bp, Artificial Sequence
  Synthetic
cttcagctcatactactggctttacaaggctggtgtgactccagaaaccttcccaactgtctcacagttcctttt

SEQ ID NO: 52448 - DNA, 75 bp, Artificial Sequence
  Synthetic
tataaacattagaaactcactgaaagctagatccgagtttgttagaaataatgataaactgctcataaggtcaaa

SEQ ID NO: 52449 - DNA, 75 bp, Artificial Sequence
  Synthetic
gctagatccgagtttgttagaaataatgataaactgctcataaggtcaaaagaagaactaaaaaaatgttttgat

SEQ ID NO: 52450 - DNA, 75 bp, Artificial Sequence
  Synthetic
agacaccttagtttctctgattaatgtgttaacaaggttcacttggtttcaggaggtggtgctatatggtaaaat

SEQ ID NO: 52451 - DNA, 75 bp, Artificial Sequence
  Synthetic
atgtgagaccttcctaagatgctgcacagaatttaataggtcaggggttaaactggttaagataaggcactgtga

SEQ ID NO: 52452 - DNA, 75 bp, Artificial Sequence
  Synthetic
acagaatttaataggtcaggggttaaactggttaagataaggcactgtgacatcaacctatcggtcaaactgcca

SEQ ID NO: 52453 - DNA, 75 bp, Artificial Sequence
  Synthetic
tttcaaaatgcctacaacgtcaaggggaatgccaccagcgccaacatcatctaaagttcagaatgctctgcagac

SEQ ID NO: 52454 - DNA, 75 bp, Artificial Sequence
  Synthetic
ttattttaattgcttatgtaatcctgctttattaatatcttcttattttcttctgttttaaacacttaaagggct

SEQ ID NO: 52455 - DNA, 75 bp, Artificial Sequence
  Synthetic
gctcttacaaggacctttctatttaaataggagacaggctgtccttggttcttcatacctttatattgtcattac

SEQ ID NO: 52456 - DNA, 75 bp, Artificial Sequence
  Synthetic
ccgaagaagattgaaatatcaggcctaaaatttgcaagcctgacttgcacaggctgttatgcttgtagttctggc

SEQ ID NO: 52457 - DNA, 75 bp, Artificial Sequence
  Synthetic
aagccttacttagggacaacttgtaagttcaacacctggggagactcgaatagatctggaaagttcacatacagc

SEQ ID NO: 52458 - DNA, 75 bp, Artificial Sequence
  Synthetic
catctcaaagacgatgaagaaactggttacaggaggatcattgaaagactgaacaacaagaaggggaagaacaag

SEQ ID NO: 52459 - DNA, 75 bp, Artificial Sequence
  Synthetic
gaaggatgtatcagcgtcttggaagaaacagcagaaagacatatgctttgggaactcgatctgatgaactcactt

SEQ ID NO: 52460 - DNA, 75 bp, Artificial Sequence
  Synthetic
cttgttgactgctctacagataggaaaaagcttttgccccagtcagtgttttctgactccaaagttgtcctttca

SEQ ID NO: 52461 - DNA, 75 bp, Artificial Sequence
  Synthetic
gacagaagatcctatagctcaagtaagagtagaatccgtagcatctttggaagatacaactctcagaaaaaacca

SEQ ID NO: 52462 - DNA, 75 bp, Artificial Sequence
  Synthetic
cctagaactcatatgatgctcaaagattgttttaaaatcatactaggtactgagaataagaagatagtcaaaatg

SEQ ID NO: 52463 - DNA, 75 bp, Artificial Sequence
  Synthetic
tgggaaaagggattgtctagatctactcagcacagtagatggtctaacggaccaaccaaaagaaaatattgtaaa

SEQ ID NO: 52464 - DNA, 75 bp, Artificial Sequence
  Synthetic
tgagagagtggtcatggctagaaggtcactaaatcatgctctatccttgatgtttctggacgagatgtcattacc

SEQ ID NO: 52465 - DNA, 75 bp, Artificial Sequence
  Synthetic
gtcctcttggatcaagtgtataacagcttgtaaggattttgcaagcatcaatgacaagattcagaaattcattta

SEQ ID NO: 52466 - DNA, 75 bp, Artificial Sequence
  Synthetic
ccacctttctgaagagctatatgacataagactgcaacacctggaactgtcaaaacttaagcaagagcacccaag

SEQ ID NO: 52467 - DNA, 75 bp, Artificial Sequence
  Synthetic
tcctaaagcagcataatctggaaatcatggaaacagtgaatcttatattctttgcagccctctcagctccctggt

SEQ ID NO: 52468 - DNA, 75 bp, Artificial Sequence
  Synthetic
gcctacactataaagcactagaatcttatctggtaagacatccggaaatacttgactgtggatccaaagaggatt

SEQ ID NO: 52469 - DNA, 75 bp, Artificial Sequence
  Synthetic
aaggacaaatgaggcagttttagctgcaccattcattgacattaaagccttcaaacaagctaaccactctgcata

SEQ ID NO: 52470 - DNA, 75 bp, Artificial Sequence
  Synthetic
gaggtcattcaagctatgcgaaaacagtgccacagggaagaattgtgaaatagacagtgtcccagttaaatgcag

SEQ ID NO: 52471 - DNA, 75 bp, Artificial Sequence
  Synthetic
aacctctctttcttaaccattcatttcagcttcattgtcatcgttattatcttggggtgtggggggaacgatttc

SEQ ID NO: 52472 - DNA, 75 bp, Artificial Sequence
  Synthetic
tttggatcttgacttacacaaaactactgacgaaaagctgttacatcaaacaaagatagtttttgctaaaattgg

SEQ ID NO: 52473 - DNA, 75 bp, Artificial Sequence
  Synthetic
ctaggaggagcaagagatttgttagtgcaagagactgggactaaagtcatgcatgcaaccactgaaatgtttagt

SEQ ID NO: 52474 - DNA, 75 bp, Artificial Sequence
  Synthetic
acatcaggcacagacaacatgaactccaccacacagatgaccgacaacacccccacactaacagccagcacaagt

SEQ ID NO: 52475 - DNA, 75 bp, Artificial Sequence
  Synthetic
atgatggcctcacaaacccacatctcaaagaaacaatccttaacgtgggattagactgtcttgctaacatgcgaa

SEQ ID NO: 52476 - DNA, 75 bp, Artificial Sequence
  Synthetic
ataccaagtggggcccgatacactgctgttctttcttctccggcatgatgcagcaggttctaaaaaatgtaccag

SEQ ID NO: 52477 - DNA, 75 bp, Artificial Sequence
  Synthetic
gtagaaatacctgctggcagcataaagaagatcttaaatgttcttagatacagattgtgtagcaaaggaggtgtg

SEQ ID NO: 52478 - DNA, 75 bp, Artificial Sequence
  Synthetic
gagcaacatagtgaagaggatctaaggagattgttgacagataatttagacagttgggacggaaacgacacagtc

SEQ ID NO: 52479 - DNA, 75 bp, Artificial Sequence
  Synthetic
acttttgttgtgtgcatactgatactagcagtctgtgttgttagcacttcagcagtagagatggaaagcctacca

SEQ ID NO: 52480 - DNA, 75 bp, Artificial Sequence
  Synthetic
tgatgatgacttctttcaaaagaggatagaagaattcttcataactggtgagggctacttcaatgaagtcctaca

SEQ ID NO: 52481 - DNA, 75 bp, Artificial Sequence
  Synthetic
atggaagtaagtaacagagccctgtttatccgtagcatcatcaacaccacttttgttttgtgcatactgatacta

SEQ ID NO: 52482 - DNA, 75 bp, Artificial Sequence
  Synthetic
ttatccgtagcatcatcaacaccacttttgttttgtgcatactgatactagcagtttgtgttgttagcacctcag

SEQ ID NO: 52483 - DNA, 75 bp, Artificial Sequence
  Synthetic
atagattcgggttacttttctgccaaatgttatccaagatcatccacttcagggcttcagctgatcaatgttact

SEQ ID NO: 52484 - DNA, 75 bp, Artificial Sequence
  Synthetic
tagcactcagttggagctcagtggaacacagaggcaataagattttggtctcaggcagatcagaatcaattatga

SEQ ID NO: 52485 - DNA, 75 bp, Artificial Sequence
  Synthetic
gaaaaccatcaactgcatcaatctaagagcatctgtcttcaaagaacacagagaagttgaaatcaatgtgcttct

SEQ ID NO: 52486 - DNA, 75 bp, Artificial Sequence
  Synthetic
cttagtgagcgactgctttcttgagttttacagtgaatttatgatgggctacagagtaacccctgctgtgattaa

SEQ ID NO: 52487 - DNA, 75 bp, Artificial Sequence
  Synthetic
ccctattaaggcagcaaatattctttaaccatgttgaagattttatcagaaggtatggtatactaacccttggga

SEQ ID NO: 52488 - DNA, 75 bp, Artificial Sequence
  Synthetic
atacagtcaagtagcttgaccacattagacagcctagatcgtagtaggacaagttccacagctgaagatagcagc

SEQ ID NO: 52489 - DNA, 75 bp, Artificial Sequence
  Synthetic
acacctcctggatgtcctgggatggttgtgacctagactactactgcaacatgggagattggccttcttgcacat

SEQ ID NO: 52490 - DNA, 75 bp, Artificial Sequence
  Synthetic
aggaaccgaaaaacaggtaaaggcatcactgaatagagacgacaataagatcattgaggatcctatgatacagct

SEQ ID NO: 52491 - DNA, 75 bp, Artificial Sequence
  Synthetic
acctgtatactttgcaaggctcttttttattcattgataattattgggacactagggaaaaaaatcaagcaatat

SEQ ID NO: 52492 - DNA, 75 bp, Artificial Sequence
  Synthetic
tttctaggctgctctgtgtccatcaacaggcatactacagttaaagagccttccttattcaatccaaatatcaga

SEQ ID NO: 52493 - DNA, 75 bp, Artificial Sequence
  Synthetic
ggcaagttgctggttagagtcagttaagagttttttttatggtctgaagaatatgcttagtggcatttttggcaa

SEQ ID NO: 52494 - DNA, 75 bp, Artificial Sequence
  Synthetic
gttgacttctcgaatttacttaaagaccgcttcaaaataatgcaattttttccctcagtgttcactctgatcaag

SEQ ID NO: 52495 - DNA, 75 bp, Artificial Sequence
  Synthetic
gcattacactgaacaatgctgtcattcatgctgacatctttagttgcaaccctactacattatcatcacaatata

SEQ ID NO: 52496 - DNA, 75 bp, Artificial Sequence
  Synthetic
taatgcttgaaactgcctttgctctatttactctgacctaaatcttgactgcgtgccgccactatatctttgaga

SEQ ID NO: 52497 - DNA, 75 bp, Artificial Sequence
  Synthetic
ttgctgagcttgtcagctatggtataaaggaaggtaggttttataggctttccgacaccggaatcgatgcaagca

SEQ ID NO: 52498 - DNA, 75 bp, Artificial Sequence
  Synthetic
tccgacaccggaatcgatgcaagcacatactctgtaaagtattggaaaattcttcactgcatctctgccatcgga

SEQ ID NO: 52499 - DNA, 75 bp, Artificial Sequence
  Synthetic
cagaggcaacaagatcttagtcacaggcaggtctgaatcaattatgaaactagaggaaaggacaggagtcagctg

SEQ ID NO: 52500 - DNA, 75 bp, Artificial Sequence
  Synthetic
acatgcaccctgccgtgttgacagctggcagaatcagtgaaatgggtgtctgctttggaacaatccctgtggcca

SEQ ID NO: 52501 - DNA, 75 bp, Artificial Sequence
  Synthetic
attcatctctcatctgaatccgttgccctgctgtgtgaaactgaaagacaagtgctctcttggatgagcaagagg

SEQ ID NO: 52502 - DNA, 75 bp, Artificial Sequence
  Synthetic
cagtacgtaagtgtcaactttgagagagtggattgtgcatcccgaatgcaccatgcccatcaacattatgcatac

SEQ ID NO: 52503 - DNA, 75 bp, Artificial Sequence
  Synthetic
ccctgctgtgtgaaactgaaagacaagtgctctcttggatgagcaagaggagaaccgaggtaataactaaagaac

SEQ ID NO: 52504 - DNA, 75 bp, Artificial Sequence
  Synthetic
ctcatggacagtcaaacgcaactgaacacaatggaacaaacaccaccacagcacccggcacaagtcaaagcccca

SEQ ID NO: 52505 - DNA, 75 bp, Artificial Sequence
  Synthetic
aagcacaaagacggtagtgcactatcagtcatacctgatagcagcaatccccgactacttaagtttgtgcctctt

SEQ ID NO: 52506 - DNA, 75 bp, Artificial Sequence
  Synthetic
cagtcatacctgatagcagcaatccccgactacttaagtttgtgcctcttaaaaaaggcctagcagtggtgaaaa

SEQ ID NO: 52507 - DNA, 75 bp, Artificial Sequence
  Synthetic
aaactcaccacaccaacaagcgaaacagaaggctcaggggaaacgaccccacccacaaacaccacccaggactcg

SEQ ID NO: 52508 - DNA, 75 bp, Artificial Sequence
  Synthetic
ctacagctgttgggtctaggaggagctcatggacagtcaaacgcaactgaacacaacggaacaaacaccaccaca

SEQ ID NO: 52509 - DNA, 75 bp, Artificial Sequence
  Synthetic
ggggatagagtaaacgggcatctaattcacaaaattgaaccacatttcaacacctcttggatgtcctgggatggt

SEQ ID NO: 52510 - DNA, 75 bp, Artificial Sequence
  Synthetic
gtcaggcacagacaacatgaattccaccacacagatgaccgataacacccccacatcaacagtcagcacaagtct

SEQ ID NO: 52511 - DNA, 75 bp, Artificial Sequence
  Synthetic
ctcatggacagtcaaacgcaactgaacacaacggaacaaacaccaccacagcacccagcacaagtcaaagcccca

SEQ ID NO: 52512 - DNA, 75 bp, Artificial Sequence
  Synthetic
taaggagtctattgtcagtctcgagccccaagacagcaacaacaccaacaccaatgagccctggagagatgagct

SEQ ID NO: 52513 - DNA, 75 bp, Artificial Sequence
  Synthetic
aaacccaccacaccagcaagcgaaacagaaggctcaggggaaacgaccccacccccaaacaccacccagggcccg

SEQ ID NO: 52514 - DNA, 75 bp, Artificial Sequence
  Synthetic
cacaggagtgacccagcataatcatgctgcatttgtaaacttgcttaacattgaaactgattacacgaaaacctt

SEQ ID NO: 52515 - DNA, 75 bp, Artificial Sequence
  Synthetic
taaaagtagcttgctacataagtacctcaaatcaggaggtgtcagacagcggaacactgaagtgctcttcagaga

SEQ ID NO: 52516 - DNA, 75 bp, Artificial Sequence
  Synthetic
tctccaccagagaccacaccagaacgccccgcaacaactgccacaagtacgccaagcacagacaacacgaattcc

SEQ ID NO: 52517 - DNA, 75 bp, Artificial Sequence
  Synthetic
gtctgagtcctcagcacagccggcaacccaaagcccagtgacttccccagcgcaatcaatccttctgatgagtgc

SEQ ID NO: 52518 - DNA, 75 bp, Artificial Sequence
  Synthetic
acaccacaaggcatacatcatcctgcaaggaatctattgtcagtctcgagccctaagacagcaacaacaccaaca

SEQ ID NO: 52519 - DNA, 75 bp, Artificial Sequence
  Synthetic
tttaactctgtctcaaggtctgaagaaatactatggtaaaatactgaagcttctgcaccttaccttggaagagga

SEQ ID NO: 52520 - DNA, 75 bp, Artificial Sequence
  Synthetic
ttttatggaaatttacgttagacaccaatgtgagcaccacaagtaccataaaagacgtgaggacactagtgtcct

SEQ ID NO: 52521 - DNA, 75 bp, Artificial Sequence
  Synthetic
catgagcagaacatcaaccctctacacagcaacccaggtctccactgaaaatgccaaccacagcgcacctagaca

SEQ ID NO: 52522 - DNA, 75 bp, Artificial Sequence
  Synthetic
gtctgagtcctcagcacagccgacaaccacaagcccaatgacttccccagcacaatcaatccttgtaatgagtgc

SEQ ID NO: 52523 - DNA, 75 bp, Artificial Sequence
  Synthetic
accagtgtaaggcagtgaaagaactcattaacagcacaggactctcagacttggaactagagagcttacttactt

SEQ ID NO: 52524 - DNA, 75 bp, Artificial Sequence
  Synthetic
agaggaaccttgagatggaaataattttaactctgtctcaaggtctaaagaaatactacggtaagatactgaagc

SEQ ID NO: 52525 - DNA, 75 bp, Artificial Sequence
  Synthetic
ccaacagcggaacccttcaaatcttacttcgctaagggcttcctttcaatagattcgggttacttctctgccaaa

SEQ ID NO: 52526 - DNA, 75 bp, Artificial Sequence
  Synthetic
agctttttttatggattgaagaatatgcttggcagtgtctttggtaattttttcataggcattttgttattcctt

SEQ ID NO: 52527 - DNA, 75 bp, Artificial Sequence
  Synthetic
ttctgcacctcaccttggaagaggacactgaaggcctgttagaatggtgtaagagaaaccttgggtcaaactgtg

SEQ ID NO: 52528 - DNA, 75 bp, Artificial Sequence
  Synthetic
tctcaaggacatgtctaagccaaagcctgagagagtagtcctggctagaaggtcactaaatcatgctctatcctt

SEQ ID NO: 52529 - DNA, 75 bp, Artificial Sequence
  Synthetic
acttcgctaagggcttcctttcaatagattcaggttacttctctgccaaatgttatccaagatcatctacttcag

SEQ ID NO: 52530 - DNA, 75 bp, Artificial Sequence
  Synthetic
tgcttgatggtgaaaggttggctgataggaaaattgccgagctgttttctacaaaaacacacattggctaactca

SEQ ID NO: 52531 - DNA, 75 bp, Artificial Sequence
  Synthetic
ggaacttataaaatagtgatagacagaaaaaataagctaaatgaccgatgtacgctagtcaccaactgtgtgata

SEQ ID NO: 52532 - DNA, 75 bp, Artificial Sequence
  Synthetic
tacgctagtcaccaactgtgtgataaaaggaagagaagttcgtaagggccaatcagtgctgaggcagtacaaaac

SEQ ID NO: 52533 - DNA, 75 bp, Artificial Sequence
  Synthetic
gaaattgagatcaatgtgcttcttcctcagattgcagtcaacctctcaaattgccatgttgtaatcaattcacat

SEQ ID NO: 52534 - DNA, 75 bp, Artificial Sequence
  Synthetic
ccacaaataggctctgtgatgcttgaaactgccctggctctgcttgctctgacctaaaccttgactgcgtgccgc

SEQ ID NO: 52535 - DNA, 75 bp, Artificial Sequence
  Synthetic
ggcaaacgacacggtaacagacttacctgatagagaagcagaagccctcaaaacaggaaatctaggctttgactg

SEQ ID NO: 52536 - DNA, 75 bp, Artificial Sequence
  Synthetic
aatcagtgctgaggcagtacaaaacagaaatcaagataggcaaggcatcaacaggctctaggaaactactgtccg

SEQ ID NO: 52537 - DNA, 75 bp, Artificial Sequence
  Synthetic
cactattgggtaagatggccatttacatttgcagaatgtcaaatcatcctaaaacaaccatggcttttctcttct

SEQ ID NO: 52538 - DNA, 75 bp, Artificial Sequence
  Synthetic
atgatacctaaaggcactggagatatcctggtggactgttcaggtggacagcaacatttcttaaaagacaactta

SEQ ID NO: 52539 - DNA, 75 bp, Artificial Sequence
  Synthetic
ggttcagctttggctatgtgatcacctgtatattttgcaaggctcttttttattcattgataattattgggacac

SEQ ID NO: 52540 - DNA, 75 bp, Artificial Sequence
  Synthetic
atgggctagctaggcatgtaaagcaatgccctaagcgaaaggagaaagtcgaggagactgagctgtacctgaacc

SEQ ID NO: 52541 - DNA, 75 bp, Artificial Sequence
  Synthetic
gttggctgattgtgctgcttgtgttactcacagtttcattgtcaccggttcaatcagcacctgttggtcatggta

SEQ ID NO: 52542 - DNA, 75 bp, Artificial Sequence
  Synthetic
gaggagactgagctgtacttgaacctggaaagaattccttggattgtcagaaagctattgcaagtgtcagagtcc

SEQ ID NO: 52543 - DNA, 75 bp, Artificial Sequence
  Synthetic
tggaaagaattccttggattgtcagaaagctattgcaagtgtcagagtccactggtgtggcattgaaacgaagca

SEQ ID NO: 52544 - DNA, 75 bp, Artificial Sequence
  Synthetic
tttatgttaggaagcatcctattcatagtctcttgcttggtgaaagggctggttgacagtgtcagtgacagcttc

SEQ ID NO: 52545 - DNA, 75 bp, Artificial Sequence
  Synthetic
ctttgaaattgaatcgcataaatgctactgtagcttattttgctgcccctattgtagacactgctctgctgacag

SEQ ID NO: 52546 - DNA, 75 bp, Artificial Sequence
  Synthetic
attgtagacactgctctgctgacagagaaattcaccaattgcacttgaatatctgcaaaaaaagaaaaacgggga

SEQ ID NO: 52547 - DNA, 75 bp, Artificial Sequence
  Synthetic
cacctgggagagagaggaagacctgacaaatttttgtcatcaggaatgccaggtaaccgagacggaatgcctttg

SEQ ID NO: 52548 - DNA, 75 bp, Artificial Sequence
  Synthetic
gcaatgtcatgctggctgtctgcaaacgcatgtgctttagggcaaccatagaagcaagcagaagagccctgctca

SEQ ID NO: 52549 - DNA, 75 bp, Artificial Sequence
  Synthetic
tccatacgaagctcttgtgctcaggaaacctcttttcttagacagtatagtcaaaggtatgaaaaatttgctaaa

SEQ ID NO: 52550 - DNA, 75 bp, Artificial Sequence
  Synthetic
ctcaacaagcttagaaacaagcttatcaattgaggcaccatggggagcaataaatgtccagtcaaccttcaaacc

SEQ ID NO: 52551 - DNA, 75 bp, Artificial Sequence
  Synthetic
ggacgcctgcgattcaagctgtgaaataatgataccaaagggcaccggagacatcttagttgactgttcaggtgg

SEQ ID NO: 52552 - DNA, 75 bp, Artificial Sequence
  Synthetic
acaaatttctgtcatcaggaatgccaggtaaccgagacggagtgcctctgtccatacgaagctcttgtgctcaga

SEQ ID NO: 52553 - DNA, 75 bp, Artificial Sequence
  Synthetic
atggatttgtcacagatgtattccccagtttttgagtacttgtcaggggacagacaggttgaagaatggcccaaa

SEQ ID NO: 52554 - DNA, 75 bp, Artificial Sequence
  Synthetic
ctgcttgcataaagaatggcctcattcaagaaactggagatgtaatcccacttggtgctggggagtgggaactgg

SEQ ID NO: 52555 - DNA, 75 bp, Artificial Sequence
  Synthetic
cacaaaattgaaccacatttcaacacctcttggatgtcctgggatggttgtgacttagactactactgcaacatg

SEQ ID NO: 52556 - DNA, 75 bp, Artificial Sequence
  Synthetic
caggtgagatcactgtgctggttgaggttgctgacatggagttgcataccaagaaagttgagatatcaggcttga

SEQ ID NO: 52557 - DNA, 75 bp, Artificial Sequence
  Synthetic
tcctgtaaagtcaggattcatgtagatgaaccagatgagctcacagtgcatgtaaagagcagtgatccagatgtg

SEQ ID NO: 52558 - DNA, 75 bp, Artificial Sequence
  Synthetic
caaggaagcttgaatttgggacagacagcacattcaaggccttttcagctatgcccaaaacctctttatgttttt

SEQ ID NO: 52559 - DNA, 75 bp, Artificial Sequence
  Synthetic
tggctttgaaattgagtctcataagtgctattgtagcttgttttgttgcccttactgtaggcactgctctgctga

SEQ ID NO: 52560 - DNA, 75 bp, Artificial Sequence
  Synthetic
caaaggaacgataattggaaagcagaatgatacttgcacagccaaggcaagctgttggctagagtcagtcaagag

SEQ ID NO: 52561 - DNA, 75 bp, Artificial Sequence
  Synthetic
tttgctttaaatgttgcaggaggaccagaggcttgtttaagtatagacacctcaaagacgatgaggaaacaggct

SEQ ID NO: 52562 - DNA, 75 bp, Artificial Sequence
  Synthetic
tcataggcattttgttattccttgccccttttgtcctgttggtgcttttctttatgtttggatggaaaatcttgt

SEQ ID NO: 52563 - DNA, 75 bp, Artificial Sequence
  Synthetic
ggaaaattgctgagctgttctccacaaaaacacacattggttaactcaacagaaataacctcgaaggttgacagc

SEQ ID NO: 52564 - DNA, 75 bp, Artificial Sequence
  Synthetic
agtatgccgtctagtgcccttgcttattctagtttcgttcatcgcatccatactttacagacactgcaacacact

SEQ ID NO: 52565 - DNA, 75 bp, Artificial Sequence
  Synthetic
acaaataggctctgtaatgcttgaaactgccctagctctgcttgctctgaccttacctttgactgcgtgccgcca

SEQ ID NO: 52566 - DNA, 75 bp, Artificial Sequence
  Synthetic
tcacaacatcaaacatctgaccgagttggcagcaaggaagtattaccaagaggagcctgaggctaagcttgttgg

SEQ ID NO: 52567 - DNA, 75 bp, Artificial Sequence
  Synthetic
aggagcctgaggctaagcttgttggcctgagtttggaagattaccttaagaggatgctgtctgacaacgagtggg

SEQ ID NO: 52568 - DNA, 75 bp, Artificial Sequence
  Synthetic
ggtcaactcttgaggcatccatgctggccaaagaaatgggcattacaataatcatttggactgttgctgccagtg

SEQ ID NO: 52569 - DNA, 75 bp, Artificial Sequence
  Synthetic
tgtatgcagtcctttgcctacagctgtgtggtctaggagagactcatagatcacacaatgaaactgtacacaata

SEQ ID NO: 52570 - DNA, 75 bp, Artificial Sequence
  Synthetic
gaattggcgaagtcatgtcattgcggcagctagggcacaaattgctgacacgagacaaacaaattaagcaggaat

SEQ ID NO: 52571 - DNA, 75 bp, Artificial Sequence
  Synthetic
tctctaggatgaaactttacgtcaccaaagatttgctagaccatctagatgttggtgggctgttgagggctgctt

SEQ ID NO: 52572 - DNA, 75 bp, Artificial Sequence
  Synthetic
taacttctcggctcattacattgagaaaagagaaagacactgacctcctcaaacaatggtttcctggaagtgacc

SEQ ID NO: 52573 - DNA, 75 bp, Artificial Sequence
  Synthetic
tctgagttcttcaaaaagaaggatattatgaaattcatcagcacctcaggaagggcaatgagtgcaggcaagatt

SEQ ID NO: 52574 - DNA, 75 bp, Artificial Sequence
  Synthetic
agctgaaccttttaagtcctacttcgccaaaggcttccttacaatagattcaggttactattcagccaaatgtta

SEQ ID NO: 52575 - DNA, 75 bp, Artificial Sequence
  Synthetic
ctgtgcaagagagtgtgaggtcctctttgatgacataagaaactctccaacgcacagtacagcttggaagcatgc

SEQ ID NO: 52576 - DNA, 75 bp, Artificial Sequence
  Synthetic
ccctttacccacgttaacacagacagctttagtagtgtttttcctgtccttgtttaaccatggactttttgagaa

SEQ ID NO: 52577 - DNA, 75 bp, Artificial Sequence
  Synthetic
tgtttaaccatggactttttgagaaaccttgactggactcaggtaattgctggccaatatgttaccaatcctagg

SEQ ID NO: 52578 - DNA, 75 bp, Artificial Sequence
  Synthetic
gagggtctgtttgcaaactgctacggatggcaatacattccagaagatatcaaaccaagcctgaccatgttgata

SEQ ID NO: 52579 - DNA, 75 bp, Artificial Sequence
  Synthetic
ttaaccatgcccaacaaaacagatcactcatatcataacatcaaacacctaacagaggtggcagcacggaagtat

SEQ ID NO: 52580 - DNA, 75 bp, Artificial Sequence
  Synthetic
gcatccagagttcagagatttaactcctgacttttcgcttacacaaaaggttcatttcaaaagaaatcagatacc

SEQ ID NO: 52581 - DNA, 75 bp, Artificial Sequence
  Synthetic
tattaaaaggatgctatctgacaacgagtggggatcgactcttgaggcatcaatgctggctaaagaaatgggcgt

SEQ ID NO: 52582 - DNA, 75 bp, Artificial Sequence
  Synthetic
ccactgagtgaggtgcattcaatagagcgcattatggaaaatttttcccgccttatgcatggtggaagactttca

SEQ ID NO: 52583 - DNA, 75 bp, Artificial Sequence
  Synthetic
taaaattcggagatggtgatgtattcacagctgtaaatctattgcactctggacaaacgcattttgacgctctta

SEQ ID NO: 52584 - DNA, 75 bp, Artificial Sequence
  Synthetic
cacagctgtaaatctattgcactctggacaaacgcattttgacgctcttagattactgccacagtttgaagctga

SEQ ID NO: 52585 - DNA, 75 bp, Artificial Sequence
  Synthetic
cagaagtaactgacatagttgttggagctataagtactcaaaaggttaggagttacctaaaggcaggaactgcaa

SEQ ID NO: 52586 - DNA, 75 bp, Artificial Sequence
  Synthetic
gcaagactatgaagatcttgcattagcacttacaagtgtagaggaaccgtatagacggtctagcctagatgaggt

SEQ ID NO: 52587 - DNA, 75 bp, Artificial Sequence
  Synthetic
aaggttctgaatcatgcatcaacatgttgaaagaaaatttggaccgaataactgatgaattcgagcgaacaaaat

SEQ ID NO: 52588 - DNA, 75 bp, Artificial Sequence
  Synthetic
aaagagagaattggtgaagttatgtcgttgcggcagctagggcataagttactaacacgagacaaacaaattaag

SEQ ID NO: 52589 - DNA, 75 bp, Artificial Sequence
  Synthetic
actaacacgagacaaacaaattaagcaagaattctctagaatgaagctttatgtcaccaaggatttgcttgacca

SEQ ID NO: 52590 - DNA, 75 bp, Artificial Sequence
  Synthetic
gcagctttccctggaacagggatagaaagacacatgcagttgctgcactccgagatgatactagacatttgtact

SEQ ID NO: 52591 - DNA, 75 bp, Artificial Sequence
  Synthetic
aaagacacatgcagttgctgcactccgagatgatactagacatttgtactgtatcacttggcatcatgttgtcaa

SEQ ID NO: 52592 - DNA, 75 bp, Artificial Sequence
  Synthetic
tgtctgctcagcacagctttgtccggaaagaaggtgtacaaagttcttggcaacttaggaaatgaactgttgtat

SEQ ID NO: 52593 - DNA, 75 bp, Artificial Sequence
  Synthetic
gaaagaaggtgtacaaagttcttggcaacttaggaaatgaactgttgtataaggcacctagaaaagccctagcaa

SEQ ID NO: 52594 - DNA, 75 bp, Artificial Sequence
  Synthetic
tagaaaagagctttctgaatccaaactaaaagattattcaacttatgcaagaggggtgatttcaaattcactgaa

SEQ ID NO: 52595 - DNA, 75 bp, Artificial Sequence
  Synthetic
tgcttgcattaagaaatctggactttgactgtcttagtgtgcaagactacaatggtatgatagaaaatatgtcta

SEQ ID NO: 52596 - DNA, 75 bp, Artificial Sequence
  Synthetic
aaacctctcaaagcaaggcaagtcaaagtgttctgtgccgagatcttggcttgaaaagatattgtttgacttaaa

SEQ ID NO: 52597 - DNA, 75 bp, Artificial Sequence
  Synthetic
aatggtatgatagaaaatatgtctaaattagacaacactgatgttgagtttaaccatagagagatagctgatctt

SEQ ID NO: 52598 - DNA, 75 bp, Artificial Sequence
  Synthetic
atgaatgcttaacagatctagacaggcttgttaggctcacattaccaggaaaaactgagaaggagagaagagtca

SEQ ID NO: 52599 - DNA, 75 bp, Artificial Sequence
  Synthetic
cctcctcaagcaatggtttcctgaaggtgatctcactcgtagaagcaccaggaacgttgcaaatgcagaagaatt

SEQ ID NO: 52600 - DNA, 75 bp, Artificial Sequence
  Synthetic
tatcatatctgagttctttaagaagaaggacatcatgaaattcattagcacctcaggcagagcaatgagtgcagg

SEQ ID NO: 52601 - DNA, 75 bp, Artificial Sequence
  Synthetic
ggctagccgagaagatagacactgttaggaaagagctttcagaatccaaactaaaagattattcaacttatgcaa

SEQ ID NO: 52602 - DNA, 75 bp, Artificial Sequence
  Synthetic
ctagtctaaatatgacttctgaggacatctcacagctcttaatcgagatcaagagactgtatgctctacaagaag

SEQ ID NO: 52603 - DNA, 75 bp, Artificial Sequence
  Synthetic
ggttctctttgacgacatcagaaactctccaacacacagtacagcttggaagcatgcccttcgactaaaagggac

SEQ ID NO: 52604 - DNA, 75 bp, Artificial Sequence
  Synthetic
aagacatcaaacctagcctgaccatgttgatacagactttgttccctgacaagtttgaggatttcttggatcgaa

SEQ ID NO: 52605 - DNA, 75 bp, Artificial Sequence
  Synthetic
gttgatacagactttgttccctgacaagtttgaggatttcttggatcgaacccaactgcatccagagttcagaga

SEQ ID NO: 52606 - DNA, 75 bp, Artificial Sequence
  Synthetic
agatacctagtgttgagaatgtgcagatctccatcgatgcaacattgcctgaatctgtggaggcagtaccagtga

SEQ ID NO: 52607 - DNA, 75 bp, Artificial Sequence
  Synthetic
cttaaacaggagtagtagagaccactttataagcattgtctcaggcttaaatctggtttatggcttcctcataaa

SEQ ID NO: 52608 - DNA, 75 bp, Artificial Sequence
  Synthetic
ttcttcatacctttatattgtcattacactttacatacaagtattgcagcagtataggtgtctagaagttataaa

SEQ ID NO: 52609 - DNA, 75 bp, Artificial Sequence
  Synthetic
gaaccggcagaacaggataactatcaaaatgccatcgaacatgagagttcaagcatcatggccttcaaggactac

SEQ ID NO: 52610 - DNA, 75 bp, Artificial Sequence
  Synthetic
tgcacaaagaatggccccactcaagaaattggagatgcaatcccacttggtgctggggtgtagggactggctgca

SEQ ID NO: 52611 - DNA, 75 bp, Artificial Sequence
  Synthetic
gacattgaaaatcactccatgactttgctagaagatgcattcaaggaactcacttttgctcttgagggtaggttt

SEQ ID NO: 52612 - DNA, 75 bp, Artificial Sequence
  Synthetic
acatcgatgggaaaataaggacagaccacaaaaaatggaaagatatattaaagctgttagagttactgggaatta

SEQ ID NO: 52613 - DNA, 75 bp, Artificial Sequence
  Synthetic
tggtggattactgaagacagagtacgagttttaaagaactcagtcagctttctcttcaacaagctctctaggaac

SEQ ID NO: 52614 - DNA, 75 bp, Artificial Sequence
  Synthetic
gtgttatcagcaagcacagtgtgtaagttgcagagttgcacacatggtgtaccaggagacctacaggtctaccac

SEQ ID NO: 52615 - DNA, 75 bp, Artificial Sequence
  Synthetic
acacaaagcattgcttctgaggtgtcagacagaaggtcttatagctcaagcaagagtagaatccgtagtattttt

SEQ ID NO: 52616 - DNA, 75 bp, Artificial Sequence
  Synthetic
actgcaacaaaaacccctgtgtcaacaaaagacgttctagagacttgggaaagaatgaaagagcacatagtcaac

SEQ ID NO: 52617 - DNA, 75 bp, Artificial Sequence
  Synthetic
tattgttcagtcagagacgtggaagacaatattaagcactggaagcaaagagatctatgccctgaagtgaccatt

SEQ ID NO: 52618 - DNA, 75 bp, Artificial Sequence
  Synthetic
aggattggtcgaaggtgtggtcatctccaaggagggctctgattcatgcatcaacatgttaaaggaaaatttgga

SEQ ID NO: 52619 - DNA, 75 bp, Artificial Sequence
  Synthetic
tccaaggagggctctgattcatgcatcaacatgttaaaggaaaatttggaccgaataactgatgagtttgaacgg

SEQ ID NO: 52620 - DNA, 75 bp, Artificial Sequence
  Synthetic
gctattgagttggctaagtgaagatattaagtcatcgagatgtactgagtgcctctccagcataaagagaactgt

SEQ ID NO: 52621 - DNA, 75 bp, Artificial Sequence
  Synthetic
gcctctccagcataaagagaactgttgatgaaactaccaatttatcagagaagattgaactgctcgcttataatc

SEQ ID NO: 52622 - DNA, 75 bp, Artificial Sequence
  Synthetic
acacaaagcattacttccgaggtgtcagacagaaggtcctacagctcaagcaagagtagaatccgtagtattttt

SEQ ID NO: 52623 - DNA, 75 bp, Artificial Sequence
  Synthetic
agcaacgtatcaaatgtgtgcaagaggtgtcccaagatagaggtagttagtcattgtgaaaacaaaggctttgag

SEQ ID NO: 52624 - DNA, 75 bp, Artificial Sequence
  Synthetic
tcattgtgaaaacaaaggctttgaggatagcaatgaatgcttaacggatttagataggcttgttaggctcacatt

SEQ ID NO: 52625 - DNA, 75 bp, Artificial Sequence
  Synthetic
tgataaaattgatgatgagtatgtcaggcatcgactgcataaaatatcccacaggccagctcatcacccatggaa

SEQ ID NO: 52626 - DNA, 75 bp, Artificial Sequence
  Synthetic
aggcatcgactgcataaaatatcccacaggccagctcatcacccatggaagagtaagtgccaaacttaacgatgg

SEQ ID NO: 52627 - DNA, 75 bp, Artificial Sequence
  Synthetic
tttatggtctaaaggacatgcttagtggcatttttggcaatgtctttataggtattttcttattccttgccccct

SEQ ID NO: 52628 - DNA, 75 bp, Artificial Sequence
  Synthetic
acgctgttaggaaggagctttcagaaactaaactaaaggattattcaacttatgcaagaggagtaatctctaact

SEQ ID NO: 52629 - DNA, 75 bp, Artificial Sequence
  Synthetic
aactaaactaaaggattattcaacttatgcaagaggagtaatctctaactcactaaagaacctttcaaagcaagg

SEQ ID NO: 52630 - DNA, 75 bp, Artificial Sequence
  Synthetic
caccacctttctgaagagctgtatgacataaggctgcagcacctggaactgtcaaagcttaaacaagagcacccc

SEQ ID NO: 52631 - DNA, 75 bp, Artificial Sequence
  Synthetic
acctaaaggtgcccactaaagacgaagaagtgctcataaatatcaggaattcactgaaggctagatctgagtttg

SEQ ID NO: 52632 - DNA, 75 bp, Artificial Sequence
  Synthetic
ttagaaacaacgataaactacttataagatcaaaggaggagttaaaaaaatgtttcgatgtgcagtcctttaaac

SEQ ID NO: 52633 - DNA, 75 bp, Artificial Sequence
  Synthetic
attgctgaactgttctccacaaaaacacacattggttagaccaactggatgggcctcaaaatgatggaatcacac

SEQ ID NO: 52634 - DNA, 75 bp, Artificial Sequence
  Synthetic
attccccggaactgatgccagagaactgtctcttttctagtgaagaattcaatgagttgatcaaactgaagaagc

SEQ ID NO: 52635 - DNA, 75 bp, Artificial Sequence
  Synthetic
aaagaagtggcagctgaatgtatgaaaagatatattggtacaccttatgaaggaattatagacactttggtttcc

SEQ ID NO: 52636 - DNA, 75 bp, Artificial Sequence
  Synthetic
aggaattatagacactttggtttccttaatcaatgtattaacaagattcacttggtttcaagaggtaatactata

SEQ ID NO: 52637 - DNA, 75 bp, Artificial Sequence
  Synthetic
gggtttttagtaaagtatgcagttaccctattcacatccaatggtgaacctttttcgcttagtctgaatgatggg

SEQ ID NO: 52638 - DNA, 75 bp, Artificial Sequence
  Synthetic
atatcttcttggattaagtgcataacagcctgtaaagattttgcaagcatcaatgacaaggttcagaaattcatt

SEQ ID NO: 52639 - DNA, 75 bp, Artificial Sequence
  Synthetic
agatgctgtacagaatttaatagatcaggggttaaattagtcaaggtaaggcactgtgacattaacctatcggtc

SEQ ID NO: 52640 - DNA, 75 bp, Artificial Sequence
  Synthetic
caatgacaaggttcagaaattcatttaccacctttctgaagagctgtatgacataaggctgcagcacctggaact

SEQ ID NO: 52641 - DNA, 75 bp, Artificial Sequence
  Synthetic
caggggttaaattagtcaaggtaaggcactgtgacattaacctatcggtcaagctgccatcaaacaaaaaagaga

SEQ ID NO: 52642 - DNA, 75 bp, Artificial Sequence
  Synthetic
gtcaaagcttaagcaagaacaccctagtgtcagcttcactaaggaagaggtcttaataaagcgactagagaaaaa

SEQ ID NO: 52643 - DNA, 75 bp, Artificial Sequence
  Synthetic
ttctatttgaatagaagacaagctgtccttggctcatcatacctttacattgttataacactttacatacaagtt

SEQ ID NO: 52644 - DNA, 75 bp, Artificial Sequence
  Synthetic
tccttggctcatcatacctttacattgttataacactttacatacaagttttacagcagcataggtgtctagagg

SEQ ID NO: 52645 - DNA, 75 bp, Artificial Sequence
  Synthetic
ttgactctgctggaagatgcattcaaagaacttacttctgctcttgaaggtagattcgaagaatcttacaaaata

SEQ ID NO: 52646 - DNA, 75 bp, Artificial Sequence
  Synthetic
agaccactttataagcattgtttcaggcttaaacttggtatatggcttcctcataaaagacaacttgttggctaa

SEQ ID NO: 52647 - DNA, 75 bp, Artificial Sequence
  Synthetic
gaaggtagcaacttggtcaatttctacaaggtcatatgcatctcgggtgataacactaaatggggcccgatacac

SEQ ID NO: 52648 - DNA, 75 bp, Artificial Sequence
  Synthetic
cagggctcagtaggctcgtttgtcctaatgaattaggtaaaaagttttcaacaagttgcagaagaattgaagaca

SEQ ID NO: 52649 - DNA, 75 bp, Artificial Sequence
  Synthetic
agattggtgttcattttataaattaacatttattaagaacttgtgtaggcaggtagagatacctgctggtagcat

SEQ ID NO: 52650 - DNA, 75 bp, Artificial Sequence
  Synthetic
aattttgacgaaggatgcatcagcgtcttagaagaaacagcagaaaggcatatgctctgggagcttgacctgatg

SEQ ID NO: 52651 - DNA, 75 bp, Artificial Sequence
  Synthetic
aacttctctagctgctgtgctctttgaggagctggcaattttttatcttaagaaaagcttaccccagacaacagt

SEQ ID NO: 52652 - DNA, 75 bp, Artificial Sequence
  Synthetic
actaggctgcccaaatgtgaggaaagctgcgaataaagaagggaaaaaacttttaaagttaaacagcgacacttc

SEQ ID NO: 52653 - DNA, 75 bp, Artificial Sequence
  Synthetic
ttgccagtggaggcaggaccaataccagctcaacacaaaccaccctaatatcttcaaacactttaaatagtacaa

SEQ ID NO: 52654 - DNA, 75 bp, Artificial Sequence
  Synthetic
cactgacacacaaagcgttgcttctgaagtgtcagacaggaggtcttatagctcaagcaagagtagaatccgtag

SEQ ID NO: 52655 - DNA, 75 bp, Artificial Sequence
  Synthetic
gaagtgtcagacaggaggtcttatagctcaagcaagagtagaatccgtagcatttttgggagatacaactctcag

SEQ ID NO: 52656 - DNA, 75 bp, Artificial Sequence
  Synthetic
gccttgaagtttttaatgatccattcaatgattatcagcaagcaataacagacatttgtcaattttctgaataca

SEQ ID NO: 52657 - DNA, 75 bp, Artificial Sequence
  Synthetic
aggtcaccacagacagtggttctggtgaatccagcacagacccccagaccaccagcaaagaagtaccttccactt

SEQ ID NO: 52658 - DNA, 75 bp, Artificial Sequence
  Synthetic
ccaagtaccacggctggctcaggtgcatccactccaagcaacaccacatcaaacaaaccagatgtcaactcactc

SEQ ID NO: 52659 - DNA, 75 bp, Artificial Sequence
  Synthetic
atccaaaaaattgggttagcatctcagaagttacagaaacaacaagtatagttgcatcacctaaaactcatatga

SEQ ID NO: 52660 - DNA, 75 bp, Artificial Sequence
  Synthetic
catcacccagccctagtaaaacatcgatgccgcaaactgcacatcatctctccagaagtcttctctcagcagcaa

SEQ ID NO: 52661 - DNA, 75 bp, Artificial Sequence
  Synthetic
agaagttacagaaacaacaagtatagttgcatcacctaaaactcatatgatgcttaaagactgctttaagattat

SEQ ID NO: 52662 - DNA, 75 bp, Artificial Sequence
  Synthetic
gtctaacagatcaacaaaaagagaacatcgtgaacgggatatttgagccctcaaagttgtccttttaccactgga

SEQ ID NO: 52663 - DNA, 75 bp, Artificial Sequence
  Synthetic
aaattcatgttcactggacttataaacagctctgtgacctctcctcagagtttgatgcaggcatgccaagtttcg

SEQ ID NO: 52664 - DNA, 75 bp, Artificial Sequence
  Synthetic
aacaacacagagtcaacagactgcaacaccagcaatcgcacctgccaccactgctattgcattcataagccctac

SEQ ID NO: 52665 - DNA, 75 bp, Artificial Sequence
  Synthetic
aatctgatattctgctggctaaaaacgatctcctcttcagtcaagggaagcttgaagaagagacttaagttcatg

SEQ ID NO: 52666 - DNA, 75 bp, Artificial Sequence
  Synthetic
attcatttatcacctttctgaagagctatatgacataaggctgcagcacctggaattgtcaaagcttaaacagga

SEQ ID NO: 52667 - DNA, 75 bp, Artificial Sequence
  Synthetic
agaaaaatttccttaagcagcacaatttagaaatcatggaaacggtgaatcttatattctttgctgctctttcag

SEQ ID NO: 52668 - DNA, 75 bp, Artificial Sequence
  Synthetic
ttgcaatagcaatgaggggcctcttgataggcacaatgttgtttacagcagcagaatggcagattcttgcgattg

SEQ ID NO: 52669 - DNA, 75 bp, Artificial Sequence
  Synthetic
ccagaaatacttgactgcgggtctaaagaggattgtaggctccctttgctcgatctgtcagtttccaaactctta

SEQ ID NO: 52670 - DNA, 75 bp, Artificial Sequence
  Synthetic
aagaggattgtaggctccctttgctcgatctgtcagtttccaaactcttagtttgtttgtatcaaaaagatgatg

SEQ ID NO: 52671 - DNA, 75 bp, Artificial Sequence
  Synthetic
aagaactagcaagtggcttgggtttaaaacttgggtttttagtaaagtatgctgtcaccttattcacatccaatg

SEQ ID NO: 52672 - DNA, 75 bp, Artificial Sequence
  Synthetic
cacaagactactgatgaaaagttgctacatcaaacaaagatagtttttgctaaaatcggtctgtccgggaatggc

SEQ ID NO: 52673 - DNA, 75 bp, Artificial Sequence
  Synthetic
ttgtaaaaggttgactggaaggagtactggggaaaggcttccaagaagcgtcaggagtaaggtcatttatgagat

SEQ ID NO: 52674 - DNA, 75 bp, Artificial Sequence
  Synthetic
ttgcacaggcactaaattatgaacaccgtttttatgcagttttggcacctaaagcacagctaggaggagcaagag

SEQ ID NO: 52675 - DNA, 75 bp, Artificial Sequence
  Synthetic
accaagtacactcactggttggacacctttctaggctgctcggtctccattaacaggcatactactgttaaagaa

SEQ ID NO: 52676 - DNA, 75 bp, Artificial Sequence
  Synthetic
agttgctgagcttgtcagctatggtataaaggaaggtaggttttataggctctcagacactggaatcgatgcaag

SEQ ID NO: 52677 - DNA, 75 bp, Artificial Sequence
  Synthetic
aatgtggggttagactgtcttaccaacatgcgaaaccttgacggaaggcccataaatgagggtagcaacttagtc

SEQ ID NO: 52678 - DNA, 75 bp, Artificial Sequence
  Synthetic
attcttcactgtatttctgccattggatgtttgcctttgagtcaagcagacaagtcttcactacttatgagtttc

SEQ ID NO: 52679 - DNA, 75 bp, Artificial Sequence
  Synthetic
gactatccaacaatcctgcagttgtcatgggctatttattggatgaatcagcaatttctgaagtcaaacccacca

SEQ ID NO: 52680 - DNA, 75 bp, Artificial Sequence
  Synthetic
taagttaacattcgtaaaaaacttatgtagacaggtggaaatacctgcgggcagcattaagaagatcctaaatgt

SEQ ID NO: 52681 - DNA, 75 bp, Artificial Sequence
  Synthetic
gcaatttctgaagtcaaacccaccaaagttgacttctcaaatttacttaaagatcgctttaaaataatgcagttt

SEQ ID NO: 52682 - DNA, 75 bp, Artificial Sequence
  Synthetic
aagttgacttctcaaatttacttaaagatcgctttaaaataatgcagtttttcccctcggtgttcactttgatca

SEQ ID NO: 52683 - DNA, 75 bp, Artificial Sequence
  Synthetic
aggatttgaggaagctattggtagataatttagatagttgggatggaaatgacacagtcaagtttttagttacaa

SEQ ID NO: 52684 - DNA, 75 bp, Artificial Sequence
  Synthetic
cagggcattcaccatgcaacctcttcagtgttaacttccttagctgctgtactctttgaggagttggcaattttt

SEQ ID NO: 52685 - DNA, 75 bp, Artificial Sequence
  Synthetic
aaaagcacaaggacggcagcgcactttcagtcatacctgacagcagcaacccccgactactcaaatttgtacctc

SEQ ID NO: 52686 - DNA, 75 bp, Artificial Sequence
  Synthetic
cagttccgatgattacgcaaaatgtatagtggtaactggtataatttctaaagagctttattcccagtatgatga

SEQ ID NO: 52687 - DNA, 75 bp, Artificial Sequence
  Synthetic
ttagaacttctgactgtccactatctagtcatgaggcaagtatactgagtgagtttgatggacaagttatcgcta

SEQ ID NO: 52688 - DNA, 75 bp, Artificial Sequence
  Synthetic
aaagatgctgtcaaatgaaagatagtgctaaaactttggtgagcgactgcttccttgaattttacagcgagttca

SEQ ID NO: 52689 - DNA, 75 bp, Artificial Sequence
  Synthetic
gaagaagccctatttagggacaacttgcaagttcaacacctggggtgactcaaatagatctgggaaatttacata

SEQ ID NO: 52690 - DNA, 75 bp, Artificial Sequence
  Synthetic
ctcagagtctgatgcaagcatgccaggtttcatctcaacaagccatgtataatagtgttccccttgtcaccaata

SEQ ID NO: 52691 - DNA, 75 bp, Artificial Sequence
  Synthetic
tttatcagaaggtatggtatattgactcttggaaccttgtctccctttggcaggctgtttgtaccgacctactct

SEQ ID NO: 52692 - DNA, 75 bp, Artificial Sequence
  Synthetic
caggctgtttgtaccgacctactctgggttagttagctcagcggttgccctagaagatgctgaagtcattgctag

SEQ ID NO: 52693 - DNA, 75 bp, Artificial Sequence
  Synthetic
aaaagcacaaggatggcagcgcactatcggtcatacctgacagcagcaacccccgactacttaaatttgtacctc

SEQ ID NO: 52694 - DNA, 75 bp, Artificial Sequence
  Synthetic
tgactacattagacagtttaggtcgtagtaggacaagttccacagttgaagacagtagcagtgtgagtgacacaa

SEQ ID NO: 52695 - DNA, 75 bp, Artificial Sequence
  Synthetic
gtcatcgtcgagcttctcttttgagctcaataggcctctgtcggaaactgaactacaattcattaaggcactaaa

SEQ ID NO: 52696 - DNA, 75 bp, Artificial Sequence
  Synthetic
tagccttaagtcaactcaagcctgtgaggtaatccagaatagaattacaggtctttattgtaatagcaatgaagg

SEQ ID NO: 52697 - DNA, 75 bp, Artificial Sequence
  Synthetic
gcagcttgttgactgctctacagataggaagaagcttttaccccagtcagtgttttctgattccaaagtcgttct

SEQ ID NO: 52698 - DNA, 75 bp, Artificial Sequence
  Synthetic
gaggtaatccagaatagaattacaggtctttattgtaatagcaatgaagggcctcttgacaggcacaatgtcatc

SEQ ID NO: 52699 - DNA, 75 bp, Artificial Sequence
  Synthetic
cctagttcatgaggattggcaaaagatagggaaaaatatccttgttcgtgcaaacaatgagctaggcgatgtgtc

SEQ ID NO: 52700 - DNA, 75 bp, Artificial Sequence
  Synthetic
tgttttctgattccaaagtcgttctctcaaggatcaagttcaagacagagcttctccttaattcactgacactgc

SEQ ID NO: 52701 - DNA, 75 bp, Artificial Sequence
  Synthetic
agaatccaatctgtactgtgtgttttgatagcggggtattacagatcattcggtggagaagggactgagaaacaa

SEQ ID NO: 52702 - DNA, 75 bp, Artificial Sequence
  Synthetic
aagacaatctcgaacaaggtgtagaagaggaaattgagttttgcaacaacctgaccaagaccgtttcagagaacc

SEQ ID NO: 52703 - DNA, 75 bp, Artificial Sequence
  Synthetic
gatacaactgattccagagaaactgaggagagagctagaaaggttaggagtttccaggatggaagtcgatgaact

SEQ ID NO: 52704 - DNA, 75 bp, Artificial Sequence
  Synthetic
aagttcttgcttgcattccttctttacgaagaagtattgatgaacttaatcaaccagtgtaaggcagtaaaggaa

SEQ ID NO: 52705 - DNA, 75 bp, Artificial Sequence
  Synthetic
tgggattcagattgaacatgccatctgtacgagccattaatgtctttcaatgtcccaggggcaaacgagacagtc

SEQ ID NO: 52706 - DNA, 75 bp, Artificial Sequence
  Synthetic
ctagacacctttctgagctgctctgtctccattaacaggcacaccgctgtcaaggaaccttccctgtttaatcca

SEQ ID NO: 52707 - DNA, 75 bp, Artificial Sequence
  Synthetic
tgcatttctcacagtcaactcagctgcccctattgatctattttgccatcctaccgttcttctttctctactatt

SEQ ID NO: 52708 - DNA, 75 bp, Artificial Sequence
  Synthetic
gcccctattgatctattttgccatcctaccgttcttctttctctactattcataccagtttcattatttaaaggg

SEQ ID NO: 52709 - DNA, 75 bp, Artificial Sequence
  Synthetic
ttcagtgatacaaagtcatctcaaagttttcgagagtgaattcaccaacttaaatcttcagttctctgatccaaa

SEQ ID NO: 52710 - DNA, 75 bp, Artificial Sequence
  Synthetic
tgctacatactcttgctaaccaaacatgctccaactattgcaccttcagctaccttttatcgctttgaacttgta

SEQ ID NO: 52711 - DNA, 75 bp, Artificial Sequence
  Synthetic
taaatcttcagttctctgatccaaatagacagaagctcaaaatagttgagtccagacctgcagaatctgagctgg

SEQ ID NO: 52712 - DNA, 75 bp, Artificial Sequence
  Synthetic
acaatcaactatgctgctcttcaccatcctggcttgacttcacttagacctaaccttgactgcgtgccgccacta

SEQ ID NO: 52713 - DNA, 75 bp, Artificial Sequence
  Synthetic
tacttaaagaccgcttcaaaataatgcaattttttccttctgtattcactctgatcaaaatgctgacagatgagt

SEQ ID NO: 52714 - DNA, 75 bp, Artificial Sequence
  Synthetic
ttagtaggatgatacaacaagcaaagccaactgtaactgttttctacatgctaaagggcaatctgatgaacacgg

SEQ ID NO: 52715 - DNA, 75 bp, Artificial Sequence
  Synthetic
taaaacaggaaaccttggctttaactgggattcagattgaacacgccatctgtactagccattaatgtctttcaa

SEQ ID NO: 52716 - DNA, 75 bp, Artificial Sequence
  Synthetic
tgtactagccattaatgtctttcaatgtctcaagagcaaacgagacagtccatgccatatcagttgccaacaaca

SEQ ID NO: 52717 - DNA, 75 bp, Artificial Sequence
  Synthetic
catgccatatcagttgccaacaacaaagcactcaaacaagctaactgctctgtacttctcactgtcaattcagct

SEQ ID NO: 52718 - DNA, 75 bp, Artificial Sequence
  Synthetic
tataggctctctgatactggaatcgacgcaagcacatattctgtgaaatactggaagattcttcactgcatttct

SEQ ID NO: 52719 - DNA, 75 bp, Artificial Sequence
  Synthetic
ctggaagattcttcactgcatttctgccatcggatgcctacctttaagtcaagcagataagtcttcgctgcttat

SEQ ID NO: 52720 - DNA, 75 bp, Artificial Sequence
  Synthetic
gcctccgttaatctatttgccatcctgccattcttctttctctaatattcatactagtttcattatttgcagggt

SEQ ID NO: 52721 - DNA, 75 bp, Artificial Sequence
  Synthetic
atggacattagagcttctgactgtccactttctaaccatgaagcaagcatactaagtgaatttgatggacaagtc

SEQ ID NO: 52722 - DNA, 75 bp, Artificial Sequence
  Synthetic
cactttctaaccatgaagcaagcatactaagtgaatttgatggacaagtcattgctaatatacttgccagtgaac

SEQ ID NO: 52723 - DNA, 75 bp, Artificial Sequence
  Synthetic
gattacctaaattcacccaccgaactgttgaagaagaagccgtatttagggacaacctgcaagttcaacacatgg

SEQ ID NO: 52724 - DNA, 75 bp, Artificial Sequence
  Synthetic
tgttgaagaagaagccgtatttagggacaacctgcaagttcaacacatggggggactcaaatagatctgggaagt

SEQ ID NO: 52725 - DNA, 75 bp, Artificial Sequence
  Synthetic
aagttacacattcatctctcctctgagtccattgccttgttgtgtgaaactgaaaggcaagtgctatcttggatg

SEQ ID NO: 52726 - DNA, 75 bp, Artificial Sequence
  Synthetic
gatcttaaagctagaccaacttacggtgcgggtgaaatcactgttctggtggaggttgctgacatggagttacac

SEQ ID NO: 52727 - DNA, 75 bp, Artificial Sequence
  Synthetic
agcaaaaggaggactgaagtaataactaaagaacagcatcagttatttctaagtctccttccccaatcacacgaa

SEQ ID NO: 52728 - DNA, 75 bp, Artificial Sequence
  Synthetic
gatgctgaaagcgagcccagattgcagtggggacatggctgcttgtcaattgtttatgatgagactgacactcag

SEQ ID NO: 52729 - DNA, 75 bp, Artificial Sequence
  Synthetic
agatggccggtgctactgatgatgcacaaaaggattccatctacgcatcagctctagtggaggcaactaaatttt

SEQ ID NO: 52730 - DNA, 75 bp, Artificial Sequence
  Synthetic
tgtttatgatgagactgacactcagaccacataccacgagaaccttctgaaggtaaagcagcttgttgactgctc

SEQ ID NO: 52731 - DNA, 75 bp, Artificial Sequence
  Synthetic
ctacatttgtagaatgtcaaatcatcctaaaacgactatggcttttcttttttggtttagctttggttatgtggt

SEQ ID NO: 52732 - DNA, 75 bp, Artificial Sequence
  Synthetic
atgctcccagtgatgctatcatggaagtagagagcaaaagtagcttgttacacaagtacctcaaatcaggaggtg

SEQ ID NO: 52733 - DNA, 75 bp, Artificial Sequence
  Synthetic
gtcaaagaaatgttgtcagatatgattagaaggaggaacttgattctcaacagaggtggcgatgaaaatccacga

SEQ ID NO: 52734 - DNA, 75 bp, Artificial Sequence
  Synthetic
gttataaaggacaacctagagcaaggtgtagaagaggaaattgagttctgcaacaatctgactaagactgtttcg

SEQ ID NO: 52735 - DNA, 75 bp, Artificial Sequence
  Synthetic
agacataggcttcaacaatgtgcttgtcaacattgacagaaacacggtgaaaagtgagcttctgtggaagtttac

SEQ ID NO: 52736 - DNA, 75 bp, Artificial Sequence
  Synthetic
ttataaacatcagaaactcattgaaagctagatccgagtttgttagaaataacgacaaactgcttataaggtcaa

SEQ ID NO: 52737 - DNA, 75 bp, Artificial Sequence
  Synthetic
tggtatcttatgtcagtactgaaactatccctaagtttctgcttgcatttcttctttatgaagaagttttaatga

SEQ ID NO: 52738 - DNA, 75 bp, Artificial Sequence
  Synthetic
tatccctaagtttctgcttgcatttcttctttatgaagaagttttaatgaacttgatcaaccagtgtaaagcagt

SEQ ID NO: 52739 - DNA, 75 bp, Artificial Sequence
  Synthetic
tgctcactttgtgtgctttctacttccagaatgagtgcagtaagagagacgggcctaggtgttccttcgcagcac

SEQ ID NO: 52740 - DNA, 75 bp, Artificial Sequence
  Synthetic
ccagaatgagtgcagtaagagagacgggcctaggtgttccttcgcagcacttttaagtctagttcatgaggattg

SEQ ID NO: 52741 - DNA, 75 bp, Artificial Sequence
  Synthetic
gtgtgcgtgaaacgtcctgcatgcaatatgccggatcacttcatacttctgttgcttatgtacactgttttccat

SEQ ID NO: 52742 - DNA, 75 bp, Artificial Sequence
  Synthetic
tctcaaagaaatacttgcggcacgtcagttcgtaagtatcagtcttgagagtgtgcgtgaaacgtcctgcatgca

SEQ ID NO: 52743 - DNA, 75 bp, Artificial Sequence
  Synthetic
atatgccggatcacttcatacttctgttgcttatgtacactgttttccatcaacacccacaggatgtcagtgcaa

SEQ ID NO: 52744 - DNA, 75 bp, Artificial Sequence
  Synthetic
aaggtgcagagccagtgggaattttctgaacaggagcagcagagaccactttataagcgttgtttcaggcttgaa

SEQ ID NO: 52745 - DNA, 75 bp, Artificial Sequence
  Synthetic
atgtgtcactgaaggttaacattatcttagtgcctctcaaagacatgtctaagtcaaagcctgagagagtagtca

SEQ ID NO: 52746 - DNA, 75 bp, Artificial Sequence
  Synthetic
ttcaacccagtgcacaatgcaaccaccgatggtcaaaagcagtctactagcacaacaactatggctcggccaagc

SEQ ID NO: 52747 - DNA, 75 bp, Artificial Sequence
  Synthetic
ccgatggtcaaaagcagtctactagcacaacaactatggctcggccaagcacagtgactcagatcactacagcac

SEQ ID NO: 52748 - DNA, 75 bp, Artificial Sequence
  Synthetic
atgtcattacctgagctgaaatccttatcagtaaactgcagaatggggaactttgaagggcaagagtgctttgag

SEQ ID NO: 52749 - DNA, 75 bp, Artificial Sequence
  Synthetic
acccctactccagctgaaacaactacacatgccaatcagaagtcagcttcaaccatgggtacactcaccacgagt

SEQ ID NO: 52750 - DNA, 75 bp, Artificial Sequence
  Synthetic
cacatgccaatcagaagtcagcttcaaccatgggtacactcaccacgagtctggaggacactgcgctgatgactc

SEQ ID NO: 52751 - DNA, 75 bp, Artificial Sequence
  Synthetic
tgatcactgtgtggatatggagaagaaaagggacgcagtcagagcagtggaagatttggttttaatgttaacagg

SEQ ID NO: 52752 - DNA, 75 bp, Artificial Sequence
  Synthetic
aaaagggacgcagtcagagcagtggaagatttggttttaatgttaacaggcagggcagtcaaacctagtactgtg

SEQ ID NO: 52753 - DNA, 75 bp, Artificial Sequence
  Synthetic
agaaccagtaagccccaaacaccacgaagcacaaaccaacccctgagaaagctcctctccgcagtaagcaccgaa

SEQ ID NO: 52754 - DNA, 75 bp, Artificial Sequence
  Synthetic
gaagcacaaaccaacccctgagaaagctcctctccgcagtaagcaccgaagcagcaccccaaacctcaccaacag

SEQ ID NO: 52755 - DNA, 75 bp, Artificial Sequence
  Synthetic
tgatctaatggcaagtgacacaacagcagacctgcctgataaggaagcggaagccctcagaacaggcaatcttgg

SEQ ID NO: 52756 - DNA, 75 bp, Artificial Sequence
  Synthetic
gcagacctgcctgataaggaagcggaagccctcagaacaggcaatcttggcttcaactgggattcagattgaaca

SEQ ID NO: 52757 - DNA, 75 bp, Artificial Sequence
  Synthetic
gacacctccccatccactccaacccaggtcacgtcctcagctggcagcagttcgagtaacacatcaaaccactcc

SEQ ID NO: 52758 - DNA, 75 bp, Artificial Sequence
  Synthetic
aggtcacgtcctcagctggcagcagttcgagtaacacatcaaaccactccaagacaacaccccagctaacatcct

SEQ ID NO: 52759 - DNA, 75 bp, Artificial Sequence
  Synthetic
gtcagtttgcaccatgccattttccgacgttaaggccttcaaattagtcaactgctctatatatttcccacaatc

SEQ ID NO: 52760 - DNA, 75 bp, Artificial Sequence
  Synthetic
gccctggtcaccccaaccgcacacatcagcccgacaaatagatccaaaaggaactctgaagtggaaataatcctc

SEQ ID NO: 52761 - DNA, 75 bp, Artificial Sequence
  Synthetic
ttctaccattagtttgcttttactgtcttaccattcttcttcctttgccattcatttcagtttgattatttctag

SEQ ID NO: 52762 - DNA, 75 bp, Artificial Sequence
  Synthetic
tctcaaagaaacacgtgccgcttacgcccacagtgttctcttgagtgtctgcaaaatggaaaacaagatcgaggt

SEQ ID NO: 52763 - DNA, 75 bp, Artificial Sequence
  Synthetic
tcagcccgacaaatagatccaaaaggaactctgaagtggaaataatcctcacactccctcaaggccttaagaaat

SEQ ID NO: 52764 - DNA, 75 bp, Artificial Sequence
  Synthetic
acggcatggtgacaaacctcctcaagcacattgcaaaggcacaagagctctacaaaaattcatctgcactccgtg

SEQ ID NO: 52765 - DNA, 75 bp, Artificial Sequence
  Synthetic
gaaggcttactggagtggtgcactagaacactgaaacaggcatgtgatgacggctacttccaggaaagaataaag

SEQ ID NO: 52766 - DNA, 75 bp, Artificial Sequence
  Synthetic
gaacactgaaacaggcatgtgatgacggctacttccaggaaagaataaaggaattctttttgacaggggaaggtt

SEQ ID NO: 52767 - DNA, 75 bp, Artificial Sequence
  Synthetic
gggtcacctctcgcaagcccccccacagctgagcccttcaagtctttttatgctaaagggttcttgataatggat

SEQ ID NO: 52768 - DNA, 75 bp, Artificial Sequence
  Synthetic
cagctgagcccttcaagtctttttatgctaaagggttcttgataatggattcaggttacttctctgctaaatgct

SEQ ID NO: 52769 - DNA, 75 bp, Artificial Sequence
  Synthetic
tcaattaaagtagttaacaccccaggaccaaagtattccaacttaaagactgttaactgtataaatttgaaggtg

SEQ ID NO: 52770 - DNA, 75 bp, Artificial Sequence
  Synthetic
gaccaaagtattccaacttaaagactgttaactgtataaatttgaaggtgtcaactgacaaggatcacagtgaac

SEQ ID NO: 52771 - DNA, 75 bp, Artificial Sequence
  Synthetic
catgtccttatcaagtcccatgtttgcgactattccttggatacagacggaatgataaggctaccacaagtcacc

SEQ ID NO: 52772 - DNA, 75 bp, Artificial Sequence
  Synthetic
gcgactattccttggatacagacggaatgataaggctaccacaagtcacccatgaaggcacctttataccgggaa

SEQ ID NO: 52773 - DNA, 75 bp, Artificial Sequence
  Synthetic
atgaccaccaactgtgtgatcaaaggaaaagaagttcggaagggacagtcaacccttaggcaatataggacagaa

SEQ ID NO: 52774 - DNA, 75 bp, Artificial Sequence
  Synthetic
gaaaagaagttcggaagggacagtcaacccttaggcaatataggacagaaataagggttggtcaaatgtcttctg

SEQ ID NO: 52775 - DNA, 75 bp, Artificial Sequence
  Synthetic
agtccctggtgaaattgtaatgtctgtcaaagaaatgttgtcagatatgattagaagaaggaacttgattctcaa

SEQ ID NO: 52776 - DNA, 75 bp, Artificial Sequence
  Synthetic
actcaactgataaaaacagaaactgcggaggtgcacggagacgattacggtggacctggcgagaaaattaccatc

SEQ ID NO: 52777 - DNA, 75 bp, Artificial Sequence
  Synthetic
cggaggtgcacggagacgattacggtggacctggcgagaaaattaccatctgcaatggttcaaccatcgttgatc

SEQ ID NO: 52778 - DNA, 75 bp, Artificial Sequence
  Synthetic
gctgaagtcattgctagagcagcccaaacacttcaaatgaacagtgtatcaatacagtcaagtagcttgaccaca

SEQ ID NO: 52779 - DNA, 75 bp, Artificial Sequence
  Synthetic
ttcaaactatgcgagaatagtgcccagggcaagaactgtgagatagacagtgcaccagtacaatgcaggcaaggt

SEQ ID NO: 52780 - DNA, 75 bp, Artificial Sequence
  Synthetic
agggcaagaactgtgagatagacagtgcaccagtacaatgcaggcaaggttattgcttgaaaattagtcaagagg

SEQ ID NO: 52781 - DNA, 75 bp, Artificial Sequence
  Synthetic
acaacatgataacaaaccttctcaaacacattgccaaggcacaggagctttacaaaaactcgtctgcacttcgtg

SEQ ID NO: 52782 - DNA, 75 bp, Artificial Sequence
  Synthetic
tgtgacacaagctgtgagataatgattcctaagggcacaggtgacatcttagtagactgctcaggagggcagcag

SEQ ID NO: 52783 - DNA, 75 bp, Artificial Sequence
  Synthetic
accaagaaaatgaagaaggcacttttgagcaccccaatgaagtgggggaagaagctttatgagctttttgctgat

SEQ ID NO: 52784 - DNA, 75 bp, Artificial Sequence
  Synthetic
ttcctaagggcacaggtgacatcttagtagactgctcaggagggcagcagcattttctacagagcaacttagttg

SEQ ID NO: 52785 - DNA, 75 bp, Artificial Sequence
  Synthetic
tgcagaatgtcaaatcaccctaaaacaaccatggctttccttttttggttcagctttggctacgtgatcacttgt

SEQ ID NO: 52786 - DNA, 75 bp, Artificial Sequence
  Synthetic
caaccatggctttccttttttggttcagctttggctacgtgatcacttgtatattgtgcaagacacttttttaca

SEQ ID NO: 52787 - DNA, 75 bp, Artificial Sequence
  Synthetic
ctacggacaaacaccgagaccaacaatccgtgtgccaagacaattgtcaagttgtttgaaattcaaaaaacaggg

SEQ ID NO: 52788 - DNA, 75 bp, Artificial Sequence
  Synthetic
atccgtgtgccaagacaattgtcaagttgtttgaaattcaaaaaacagggtttaacatacaagacatggacattg

SEQ ID NO: 52789 - DNA, 75 bp, Artificial Sequence
  Synthetic
ctgaaaccccaaacatgtaccatatgtgaatcagtaccggttaatgcaatagatgctgaaatgcatgacctcaac

SEQ ID NO: 52790 - DNA, 75 bp, Artificial Sequence
  Synthetic
gtgaatcagtaccggttaatgcaatagatgctgaaatgcatgacctcaactgcagctacaacatatgcccttatt

SEQ ID NO: 52791 - DNA, 75 bp, Artificial Sequence
  Synthetic
ttccagaatgcctacaatgtcaagggcaatgccaccagtgccaacatcatctgaggctccagatgctttgcactc

SEQ ID NO: 52792 - DNA, 75 bp, Artificial Sequence
  Synthetic
actatccaacaaccctgcagttgtcatgggctacctattggatgaatcagcaatttctgaagtcaagcctaccaa

SEQ ID NO: 52793 - DNA, 75 bp, Artificial Sequence
  Synthetic
cccaaaaggaaagagaaggtagaagagacagagttatacctgaacctggaaaggatcccctggattgttaggaag

SEQ ID NO: 52794 - DNA, 75 bp, Artificial Sequence
  Synthetic
agacagagttatacctgaacctggaaaggatcccctggattgttaggaagctcctacaggtatctgagtcaacag

SEQ ID NO: 52795 - DNA, 75 bp, Artificial Sequence
  Synthetic
gcccacagtgttctcttgagtgttggcaaaatggaaaacaaaatcgaggtgaataacaaagatgagatgaacaag

SEQ ID NO: 52796 - DNA, 75 bp, Artificial Sequence
  Synthetic
atagtctctatgtcaccggttcaatctgcaccaataagtcaggagagaacagttgccctctatcaatccagagaa

SEQ ID NO: 52797 - DNA, 75 bp, Artificial Sequence
  Synthetic
tgaaagttatactgagctaaaagttgacgtcccgaaaatagaacaacttgccaattaccaacaagctgccttgaa

SEQ ID NO: 52798 - DNA, 75 bp, Artificial Sequence
  Synthetic
agtcatgaagcaagtatattgagtgaatttgatggacaagttatcgccaacatacttgccagtgaattgagttct

SEQ ID NO: 52799 - DNA, 75 bp, Artificial Sequence
  Synthetic
ctgcaccaataagtcaggagagaacagttgccctctatcaatccagagaagattatatgggcatttgccttgtca

SEQ ID NO: 52800 - DNA, 75 bp, Artificial Sequence
  Synthetic
gacagcattagcagtaccttttttcctggattatctgtttgcaggacatgccatatcggtagcataaatggtttt

SEQ ID NO: 52801 - DNA, 75 bp, Artificial Sequence
  Synthetic
ctggattatctgtttgcaggacatgccatatcggtagcataaatggttttgagattgagtctcataagtgctact

SEQ ID NO: 52802 - DNA, 75 bp, Artificial Sequence
  Synthetic
gcccaccagttccatctaagtgtctgtaagaagagaaaggcaggaagcaacgtcatgttggctgtctgtaagcgt

SEQ ID NO: 52803 - DNA, 75 bp, Artificial Sequence
  Synthetic
gtaagaagagaaaggcaggaagcaacgtcatgttggctgtctgtaagcgtatgtgtttcaaggcaattatcgaag

SEQ ID NO: 52804 - DNA, 75 bp, Artificial Sequence
  Synthetic
gtatgcatacttgtgatggtggcctgcatagccagttcggccgctgtagagatggaaaacctaccggcaggaacc

SEQ ID NO: 52805 - DNA, 75 bp, Artificial Sequence
  Synthetic
gcatagccagttcggccgctgtagagatggaaaacctaccggcaggaacctgggaacgagaagaagagctcacaa

SEQ ID NO: 52806 - DNA, 75 bp, Artificial Sequence
  Synthetic
tatgagtctttcatacttaggaaaccactttttttggatagcatagctaaaggtgttaagaacctcttgaactca

SEQ ID NO: 52807 - DNA, 75 bp, Artificial Sequence
  Synthetic
cactttttttggatagcatagctaaaggtgttaagaacctcttgaactcaacaagcctggaaactagcttgtcaa

SEQ ID NO: 52808 - DNA, 75 bp, Artificial Sequence
  Synthetic
gcatcaagtgctaatattgctctaacatggagctcagtggaacacaggggcaacaagatcttggtctcaggcagg

SEQ ID NO: 52809 - DNA, 75 bp, Artificial Sequence
  Synthetic
aggtagatcagagtcaatcatgaagctagaggaaaggacaggaatcagctgggatctaggggtagaagatgcttc

SEQ ID NO: 52810 - DNA, 75 bp, Artificial Sequence
  Synthetic
catggagctcagtggaacacaggggcaacaagatcttggtctcaggcaggtctgaatcaattatgaaacttgaag

SEQ ID NO: 52811 - DNA, 75 bp, Artificial Sequence
  Synthetic
cagatggtcttgccagacatgtaatgcagtgccctaagcggaaggaaaaaatagaagaaaccgaattatacttaa

SEQ ID NO: 52812 - DNA, 75 bp, Artificial Sequence
  Synthetic
agaacactcaccatctccgtcatggatctatcacagatgtattcccctgtctttgagtacctgtcaggagatcgt

SEQ ID NO: 52813 - DNA, 75 bp, Artificial Sequence
  Synthetic
tctcaaagaaacacgtgccgcttacgcccccagtgttctcttgagtgttagcaaatggaaaacaaaattgaggtg

SEQ ID NO: 52814 - DNA, 75 bp, Artificial Sequence
  Synthetic
atctatcacagatgtattcccctgtctttgagtacctgtcaggagatcgtcaggtggaggaatggccaaaggcaa

SEQ ID NO: 52815 - DNA, 75 bp, Artificial Sequence
  Synthetic
ggtttgaagagttcaaaaaaggaaatggacttgtggacaccttcacaaactcctattccttttgtgagagtgttc

SEQ ID NO: 52816 - DNA, 75 bp, Artificial Sequence
  Synthetic
ctttacaaggagtggccacattcgagaaactggagatgcaaccccacctggtgttggggggttgggactggctgc

SEQ ID NO: 52817 - DNA, 75 bp, Artificial Sequence
  Synthetic
gaaactggagatgcaaccccacctggtgttggggggttgggactggctgcacatgctgtggactagatgtcaaag

SEQ ID NO: 52818 - DNA, 75 bp, Artificial Sequence
  Synthetic
acagaggccatagtgtgtgttgagcttaccagtcaagaaaggcagtgcagtttgattgaagcaggtacgagattt

SEQ ID NO: 52819 - DNA, 75 bp, Artificial Sequence
  Synthetic
ttaccagtcaagaaaggcagtgcagtttgattgaagcaggtacgagatttagcttaggaccagtaacaatcacct

SEQ ID NO: 52820 - DNA, 75 bp, Artificial Sequence
  Synthetic
ttacacccaaagatagaagacggctactttgacttaatgcatgttcaaaaggttatgtccgccagtacagtgtgc

SEQ ID NO: 52821 - DNA, 75 bp, Artificial Sequence
  Synthetic
actttgacttaatgcatgttcaaaaggttatgtccgccagtacagtgtgcaagctgcaaagttgcacacacggtg

SEQ ID NO: 52822 - DNA, 75 bp, Artificial Sequence
  Synthetic
agagtgaatgggcacctgatccacaaggttgagccacacctgaacacatcctggatgtcgtgggatggttgtgac

SEQ ID NO: 52823 - DNA, 75 bp, Artificial Sequence
  Synthetic
aggttgagccacacctgaacacatcctggatgtcgtgggatggttgtgacttagactatttctgcaatatggggg

SEQ ID NO: 52824 - DNA, 75 bp, Artificial Sequence
  Synthetic
tttgcaaatctgcttaacattgaaaccgactatacaaagactttccatttccactccaaaagagtgacggcccat

SEQ ID NO: 52825 - DNA, 75 bp, Artificial Sequence
  Synthetic
ccgactatacaaagactttccatttccactccaaaagagtgacggcccatggagacacaccacagctggacttga

SEQ ID NO: 52826 - DNA, 75 bp, Artificial Sequence
  Synthetic
gctgatatggagttacatacaaagaaggtcgaggtaacaggcttaaaatttgcaagcctaacttgttcaggatgc

SEQ ID NO: 52827 - DNA, 75 bp, Artificial Sequence
  Synthetic
aggtcgaggtaacaggcttaaaatttgcaagcctaacttgttcaggatgctatgcctgtagttcaggtatctcct

SEQ ID NO: 52828 - DNA, 75 bp, Artificial Sequence
  Synthetic
aaaagcagcgacccagacattgtggcagccagctcaagtctcatggcaaggaagattgagtttggggttgacagt

SEQ ID NO: 52829 - DNA, 75 bp, Artificial Sequence
  Synthetic
cagccagctcaagtctcatggcaaggaagattgagtttggggttgacagtactttcaaagcgttctcctctatgc

SEQ ID NO: 52830 - DNA, 75 bp, Artificial Sequence
  Synthetic
aagaggaaccttgagatggaaataattttaactctgtctcaaggtctaaagaaatactatggtaagatactgaag

SEQ ID NO: 52831 - DNA, 75 bp, Artificial Sequence
  Synthetic
tgcaaaaatgaggaaacacagaggtgtgtgaacgcaaagcttgaacagccacagagcatcctcatcgaacataca

SEQ ID NO: 52832 - DNA, 75 bp, Artificial Sequence
  Synthetic
gtgtgaacgcaaagcttgaacagccacagagcatcctcatcgaacatacaggtacaatcattggcaagcagaacg

SEQ ID NO: 52833 - DNA, 75 bp, Artificial Sequence
  Synthetic
ttttatggactaaagagcatgttgagcggcatttttggtaatgtctttctaggcatcttcttgtttcttgccccc

SEQ ID NO: 52834 - DNA, 75 bp, Artificial Sequence
  Synthetic
gcggcatttttggtaatgtctttctaggcatcttcttgtttcttgccccctttgctctgctgctgtttttctttt

SEQ ID NO: 52835 - DNA, 75 bp, Artificial Sequence
  Synthetic
ggcctgtttaaatacagacacatcaaggacgatgaagaggttggctacaaaaaaatcatcgaaagactgaacaat

SEQ ID NO: 52836 - DNA, 75 bp, Artificial Sequence
  Synthetic
aggacgatgaagaggttggctacaaaaaaatcatcgaaagactgaacaataaaaaaggcaaacacagacttcttg

SEQ ID NO: 52837 - DNA, 75 bp, Artificial Sequence
  Synthetic
cataactgcaatgctcagtcatgcttattttacttacttatataaccttattttattaacctttctctattttct

SEQ ID NO: 52838 - DNA, 75 bp, Artificial Sequence
  Synthetic
tattttacttacttatataaccttattttattaacctttctctattttctcttgtttaaacacttaaagggctgt

SEQ ID NO: 52839 - DNA, 75 bp, Artificial Sequence
  Synthetic
tagaagaaaccgaattatatttaaacttagaaagaatcccttgggttgttaggaaattactgcaggtgtcagaat

SEQ ID NO: 52840 - DNA, 75 bp, Artificial Sequence
  Synthetic
acacacattggataatggagttggtggagcctcaccatccatataaaacaacagctctaccaatcccccatcccc

SEQ ID NO: 52841 - DNA, 75 bp, Artificial Sequence
  Synthetic
ggagcctcaccatccatataaaacaacagctctaccaatcccccatccccaaaccctgtaaatcttgcttcaact

SEQ ID NO: 52842 - DNA, 75 bp, Artificial Sequence
  Synthetic
agcatcatctccctctgacacactaacttaacaaaataccgcactgcacgatgctgcctcagcttccacttactc

SEQ ID NO: 52843 - DNA, 75 bp, Artificial Sequence
  Synthetic
tttaccatgaagggactttcataccaggaacttataaaatagtgatagacaaaaaaaataagctaaatgaccgat

SEQ ID NO: 52844 - DNA, 75 bp, Artificial Sequence
  Synthetic
acttaacaaaataccgcactgcacgatgctgcctcagcttccacttactcgtagataacttcaactgcgtgccgc

SEQ ID NO: 52845 - DNA, 75 bp, Artificial Sequence
  Synthetic
cagggttatagctgtggatcagttgacatcatcttctagtgatgaactgcaagactatgaagaccttgccttggc

SEQ ID NO: 52846 - DNA, 75 bp, Artificial Sequence
  Synthetic
acatctgcagaatgtcaaatcatcctagaacaactatggcttttctcttctggttcagctttggctatgtgatca

SEQ ID NO: 52847 - DNA, 75 bp, Artificial Sequence
  Synthetic
agacggtcaagcttggatgaggtcacattgtccaagaagcaagcagagatactaaggcaaaaagcatctcagttg

SEQ ID NO: 52848 - DNA, 75 bp, Artificial Sequence
  Synthetic
aggacactgaaggtctactggaatggtgtaagagaaatcttggtcttgattgtgatgacactttctttcaaaaga

SEQ ID NO: 52849 - DNA, 75 bp, Artificial Sequence
  Synthetic
ttgcggcagttggggcataaactgctgacacgagacaaacagattaagcaagagttctccagaatgaaactctac

SEQ ID NO: 52850 - DNA, 75 bp, Artificial Sequence
  Synthetic
tgcaggtgaaatcactgtgctggtagaggttgctgacatggagttgcatacaaagaaaattgagatatcaggttt

SEQ ID NO: 52851 - DNA, 75 bp, Artificial Sequence
  Synthetic
tcaatcagcacctgttggtcatggtaagacaatcgaaacatatcagaccagagaaggattcacaagtatctgtct

SEQ ID NO: 52852 - DNA, 75 bp, Artificial Sequence
  Synthetic
acctaggaaatgaactgttgtacaaggcacctagaaaggccttagcaactgtctgcagtgccttgtttgggaagc

SEQ ID NO: 52853 - DNA, 75 bp, Artificial Sequence
  Synthetic
attcgcaaacaagctcttctgctcttttcactctgacataaaccttgactgcgtgccgccactatatctttgaga

SEQ ID NO: 52854 - DNA, 75 bp, Artificial Sequence
  Synthetic
acataatctttatttgagtaagtcaagcctaaatatgacctctgaagacatctcacagcttttgatcgagattaa

SEQ ID NO: 52855 - DNA, 75 bp, Artificial Sequence
  Synthetic
catggatttgtcacaaatgtattcccctgtttttgagtacttgtcaggagacagacaggttgaagaatggcccaa

SEQ ID NO: 52856 - DNA, 75 bp, Artificial Sequence
  Synthetic
gaaaggtgtggttgcacatcatcaacctgcttgcataaagaatggcctcactcaagaaactggagatgtaatccc

SEQ ID NO: 52857 - DNA, 75 bp, Artificial Sequence
  Synthetic
aaaagacctttttacagatcacatgtttgtcaaatggaaggttgaatatataaaaactgaagccatagtatgtgt

SEQ ID NO: 52858 - DNA, 75 bp, Artificial Sequence
  Synthetic
gtccactggtgtggcattgaaaagaagcagctggctgattgtgctgcttgtgctgttcacggtttcattgtcacc

SEQ ID NO: 52859 - DNA, 75 bp, Artificial Sequence
  Synthetic
attggacatctgcactgtatcacttggtgtcatgctgtcaacattcttatatggttctaacaataaaaacaagaa

SEQ ID NO: 52860 - DNA, 75 bp, Artificial Sequence
  Synthetic
gggaagacaattgaggcataccgggccagggagggatacacaagtatatgtctctttgtactaggaagtatccta

SEQ ID NO: 52861 - DNA, 75 bp, Artificial Sequence
  Synthetic
cttaaaagcaaggccgacctacggtgcaggtgagatcactgtgctggttgaggttgctgacatggagttgcatac

SEQ ID NO: 52862 - DNA, 75 bp, Artificial Sequence
  Synthetic
aaagacgttctggagacttgggaaaagatgaaggagcacatactcaacagaccaacaggactgacactgcccacc

SEQ ID NO: 52863 - DNA, 75 bp, Artificial Sequence
  Synthetic
taaactcaacaagtttagaaacaagtttatcaattgaggcaccatggggggcaataaatgttcagtcaacctaca

SEQ ID NO: 52864 - DNA, 75 bp, Artificial Sequence
  Synthetic
tgggatctcggcgtagaagacgcctctgagtctaaactgcttacagtctctgtcatggacttgtctcagatgtac

SEQ ID NO: 52865 - DNA, 75 bp, Artificial Sequence
  Synthetic
attgtgaaaataaaggctttgaggacagcaatgaatgcttaacagacctagataggcttgttaggctcacattac

SEQ ID NO: 52866 - DNA, 75 bp, Artificial Sequence
  Synthetic
taaactctccagaaactcacctacagaagtaactgacatagttgttggagctataagtactcaaaaggttagaag

SEQ ID NO: 52867 - DNA, 75 bp, Artificial Sequence
  Synthetic
ataaaactgatgatgagcatgtcaggcattgattgtataaaatatcccacagggcagcttatcacccatggaaga

SEQ ID NO: 52868 - DNA, 75 bp, Artificial Sequence
  Synthetic
ggttccgaatcatgcatcaatatgttgaaagaaaatttagaccgaataactgatgaattcgagcggaccaaattt

SEQ ID NO: 52869 - DNA, 75 bp, Artificial Sequence
  Synthetic
caaggttcaatttaggtcctgtgaccatcacactgtcagaaccaagaaacatccaacagaagctccctcctgaaa

SEQ ID NO: 52870 - DNA, 75 bp, Artificial Sequence
  Synthetic
gtactttacagacgctgcaacacactgcacctaatctgcttcgttatatctccaaataagctctatgatgcttga

SEQ ID NO: 52871 - DNA, 75 bp, Artificial Sequence
  Synthetic
gcttcgttatatctccaaataagctctatgatgcttgaagctgccttagctctgcttactctgaccttaactttg

SEQ ID NO: 52872 - DNA, 75 bp, Artificial Sequence
  Synthetic
aagtgcttataaacatcagaaactcattgaaagctagatccgagtttgttagaaataacgataaactactcataa

SEQ ID NO: 52873 - DNA, 75 bp, Artificial Sequence
  Synthetic
gacgtcccgaaaatagaacagcttgccaattaccaacaggctgccttgaaatggaggaaagacataggtttccgt

SEQ ID NO: 52874 - DNA, 75 bp, Artificial Sequence
  Synthetic
ttccactttcactctaaaagggtcactgcacacggagacacaccacaactagatcttaaggcaagaccaacctat

SEQ ID NO: 52875 - DNA, 75 bp, Artificial Sequence
  Synthetic
agatcttaaggcaagaccaacctatggtgcaggtgagatcactgtactggtagaagttgctgacatggagttaca

SEQ ID NO: 52876 - DNA, 75 bp, Artificial Sequence
  Synthetic
atgctgcacagaatttaataggtcaggggtcaaactggttaagataaggcactgtaacattaacctatcagtcaa

SEQ ID NO: 52877 - DNA, 75 bp, Artificial Sequence
  Synthetic
caggttgttatgcttgtagctctggcatctcatgcaaagttagaattcatgtggatgaaccagatgaacttacag

SEQ ID NO: 52878 - DNA, 75 bp, Artificial Sequence
  Synthetic
gctagatccgagtttgttagaaataacgataaactactcataagatcaaaagaagaattaaaaaaatgtttcgat

SEQ ID NO: 52879 - DNA, 75 bp, Artificial Sequence
  Synthetic
tgtagttgcagctagctcaagtctcatggcaagaaagcttgaatttggaacagacagtacatttaaagctttctc

SEQ ID NO: 52880 - DNA, 75 bp, Artificial Sequence
  Synthetic
ataaaagataacttactagccaactctcagcaacagaacaaacaactacagatgcttcgttttggcatgcttgca

SEQ ID NO: 52881 - DNA, 75 bp, Artificial Sequence
  Synthetic
ctcagcaacagaacaaacaactacagatgcttcgttttggcatgcttgcagggcttagtaggcttgtttgtccta

SEQ ID NO: 52882 - DNA, 75 bp, Artificial Sequence
  Synthetic
gacattttgtgtcacgaacgttcaccctgcgttcagcatcatgtttggatatctgcagctcatcaaccccaccac

SEQ ID NO: 52883 - DNA, 75 bp, Artificial Sequence
  Synthetic
tgacatttacattaaagattatggaaacttttctgggattgttgcacaccaagcttatgaccctgtccgccgaga

SEQ ID NO: 52884 - DNA, 75 bp, Artificial Sequence
  Synthetic
ccatatgcttttgagatcaatgaaattgcactttggaccaaattcaaaattactatggctaggcgattttcacgc

SEQ ID NO: 52885 - DNA, 75 bp, Artificial Sequence
  Synthetic
catcaccctgtcacatgcaaatatgatatttggagcaagctcggtcggatttaagggcgttaatgtgtctacttt

SEQ ID NO: 52886 - DNA, 75 bp, Artificial Sequence
  Synthetic
gccccctgacaccctgacgactggcattcgccctcgccccgtagtcacaatggattttgcacagctaaaaggttt

SEQ ID NO: 52887 - DNA, 75 bp, Artificial Sequence
  Synthetic
ttacagcgacttagctcagaaggaggattacatcatgtatttccatgacatggtgaagtttgtcagccagacagg

SEQ ID NO: 52888 - DNA, 75 bp, Artificial Sequence
  Synthetic
aggtgctcctgtatcattgagagatgtgttcttgtggattagtgaaagcgtgaccgggcctgttgtcattcggac

SEQ ID NO: 52889 - DNA, 75 bp, Artificial Sequence
  Synthetic
agattgtgttacgggctgcaacaacttatggccaagtggtagtggacacttttatttcccttatgagaggaagac

SEQ ID NO: 52890 - DNA, 75 bp, Artificial Sequence
  Synthetic
caaattcaggtatggcacgtttgttgagtgtggcaaaaatttgacttggtccgaagggcctcagtgggatgtgaa

SEQ ID NO: 52891 - DNA, 75 bp, Artificial Sequence
  Synthetic
gagttatgttgtgggctttaactttgtcacacgagcgaactcgctgcttggtgggggttttgacgaggtttgcta

SEQ ID NO: 52892 - DNA, 75 bp, Artificial Sequence
  Synthetic
tcgattgatgatgcaggcggaagtgcctcggcaggttgcagagcaaggattgacacttgaacaagcagttcggaa

SEQ ID NO: 52893 - DNA, 75 bp, Artificial Sequence
  Synthetic
gttggcgtcagaacatcacatgtctagaccgcaattgacttcacgccgagtgcctggaatcacagaccagacaaa

SEQ ID NO: 52894 - DNA, 75 bp, Artificial Sequence
  Synthetic
gtatgaggcttacgtggtatgtggtcctttccgaactggacaggtagtggctgattctttgcagatggctgaaga

SEQ ID NO: 52895 - DNA, 75 bp, Artificial Sequence
  Synthetic
tctggcgtggcgagagatgcttggtactctgaaaacattgattcacgatgaagcgcgtcaaaccaagggctgctg

SEQ ID NO: 52896 - DNA, 75 bp, Artificial Sequence
  Synthetic
ttgacggtgttggcctggtgagctgtacctcattaacatcgagagtgcaggctttcgtgaaggagcttcagcggc

SEQ ID NO: 52897 - DNA, 75 bp, Artificial Sequence
  Synthetic
tgcggcttaccaggcgggctttttgcgtgctttttatgggtgtctgaatacatctgtgtgttccttttcgtcttt

SEQ ID NO: 52898 - DNA, 75 bp, Artificial Sequence
  Synthetic
ggatgatgggttgaggtggctgtgcacacgattgagcacaaaatccattggcgcaaaaggacgaaccgtggttct

SEQ ID NO: 52899 - DNA, 75 bp, Artificial Sequence
  Synthetic
gtttggatgtcactcggagggtgaggtactggcagatggattcggaaaaacatattcagcagcagaggcgcgtga

SEQ ID NO: 52900 - DNA, 75 bp, Artificial Sequence
  Synthetic
gcaggtagccctgtcgggaaaaatcggtgggagtgctcaagtgattgttgtgtggcaacgttgtcgtgagtccaa

SEQ ID NO: 52901 - DNA, 75 bp, Artificial Sequence
  Synthetic
actccaaaggttgctgcctgaattggctatggtgtcttatgtgccagaggaggttgttgcaggctttaagcgagt

SEQ ID NO: 52902 - DNA, 75 bp, Artificial Sequence
  Synthetic
gcgggagcttgagacctacccccaatggtgtctatggttatatagaagtatgattgagtctatggggggtattga

SEQ ID NO: 52903 - DNA, 75 bp, Artificial Sequence
  Synthetic
tgttggcgtgcgcgacgcatctccgttaactgagagcggggttgtttatcaggtggaggctgctcagtacggaat

SEQ ID NO: 52904 - DNA, 75 bp, Artificial Sequence
  Synthetic
gcgaacgacgcgagtgaggagggcagatggcacgcttgattaccagggtctgagttggacatcgttgttgatgct

SEQ ID NO: 52905 - DNA, 75 bp, Artificial Sequence
  Synthetic
gttgttgggtcactatggggctgaccagacgtatgaggctcttcgcgtcagttccatgttcatccgtgctcgtga

SEQ ID NO: 52906 - DNA, 75 bp, Artificial Sequence
  Synthetic
agtcggctggcgcaagagggggaccttttcctgcatagtatccacatgatgtgacacaccctcatatagggaatc

SEQ ID NO: 52907 - DNA, 75 bp, Artificial Sequence
  Synthetic
gcgcaagagggggaccttttcctgcatagtatccacatgatgtgacacaccctcatatagggaatccttgcagtc

SEQ ID NO: 52908 - DNA, 75 bp, Artificial Sequence
  Synthetic
gacattttgtctcagaacgatgccctgtaatcgcgctgttttcggagccttcgtattagcgttactcataagcct

SEQ ID NO: 52909 - DNA, 75 bp, Artificial Sequence
  Synthetic
acagtcagtatatttcaaactttacgaattttacaagaataacgaaactgcaagaaatacgagtgtcgccgggtt

SEQ ID NO: 52910 - DNA, 75 bp, Artificial Sequence
  Synthetic
tttgaaacgtcacgaagttgctgtcaacgtgattgttgagttctcttttgacattttgttctttctttgtggact

SEQ ID NO: 52911 - DNA, 75 bp, Artificial Sequence
  Synthetic
actcggatttgagttaagcccaaccgctcgacgccttatttttagacgaacagctagtgcagaaaaagctgatac

SEQ ID NO: 52912 - DNA, 75 bp, Artificial Sequence
  Synthetic
tgttgaacttgaacatgtgtcgtcacgacgacggaatgactctagagatgattcgacagtacgcaatgtctcgaa

SEQ ID NO: 52913 - DNA, 75 bp, Artificial Sequence
  Synthetic
gacatcaccacttgcctcccaacgctcccgtgatcactttgacggagatccacgagaacccgcccccccagctta

SEQ ID NO: 52914 - DNA, 75 bp, Artificial Sequence
  Synthetic
ttctcccgccgacttctatcctccgccagcctctcctcacatatgtgagaccccgctctcgacgcgtgtggcgcc

SEQ ID NO: 52915 - DNA, 75 bp, Artificial Sequence
  Synthetic
ctctgctcctagcgctagtttgtttactgctggtggtattggtcttccttagattttatgcgtgacgggcagggt

SEQ ID NO: 52916 - DNA, 75 bp, Artificial Sequence
  Synthetic
agtcgctgaggacctcgccggcttacggaatgatgacgtcctagcatcattctcccgggacgggtaattgcagtc

SEQ ID NO: 52917 - DNA, 75 bp, Artificial Sequence
  Synthetic
gacattttgagatgctcaagcgtccggcttactacaacattttcttgcttcctactgggcgacgactggcaaaaa

SEQ ID NO: 52918 - DNA, 75 bp, Artificial Sequence
  Synthetic
cttacaatatactagagaatttaatcaccctacccaaaaccgattggaaactgtacgagaccattgaacagaaac

SEQ ID NO: 52919 - DNA, 75 bp, Artificial Sequence
  Synthetic
tgaaatggatgattcaagaatatcgaagtgattggcgagatagactttctcatcatgaaagatatggtatgaaag

SEQ ID NO: 52920 - DNA, 75 bp, Artificial Sequence
  Synthetic
ttaggttgacctaccgatctgaaagcgagcgaacgaaacttgaagagaaaatcactgatttagttatatctcatg

SEQ ID NO: 52921 - DNA, 75 bp, Artificial Sequence
  Synthetic
gtaagaaagcttcgaccgttcatttctgtacacgtgagtcatacaaagggagagttcgtgctaaccaaattttaa

SEQ ID NO: 52922 - DNA, 75 bp, Artificial Sequence
  Synthetic
ttttgttggagcctgagggtttaggcgaagttgagggtttgaccgttcgagcggaaggcaattggatgtctttag

SEQ ID NO: 52923 - DNA, 75 bp, Artificial Sequence
  Synthetic
ttacacattgtttatttatcttaggctctacacttacctgttttggtttcgtggacccagctagaggttgtcgtt

SEQ ID NO: 52924 - DNA, 75 bp, Artificial Sequence
  Synthetic
ttaatctgctaccgtatataaagacattacatcctaacgacaaatggttgcttgatcttcaggcgagttggcggc

SEQ ID NO: 52925 - DNA, 75 bp, Artificial Sequence
  Synthetic
ttgaatacggagtctctcgatccatagaggaaggtgcactttatgatttttttgctgagtcacatactctgtacg

SEQ ID NO: 52926 - DNA, 75 bp, Artificial Sequence
  Synthetic
ctgtccggacttggcctggatgtgagaaatacttgggagctttggaggcgttcgttgggagattggctgttctac

SEQ ID NO: 52927 - DNA, 75 bp, Artificial Sequence
  Synthetic
ctgcgcaagttttgacctctaaggagcatgattttcagtctaaattaatgagtaaagctaaaaagacaggatttc

SEQ ID NO: 52928 - DNA, 75 bp, Artificial Sequence
  Synthetic
attatttgtattatttggtttctttcaccatgaaaacgtccctgacggaccgcatcgtcaaggaggcattggcta

SEQ ID NO: 52929 - DNA, 75 bp, Artificial Sequence
  Synthetic
cagtgaaagtgttcagtttcgtcgttgggcgagatcacttgcctgctgtgggcgtctattcgggtgaagacttca

SEQ ID NO: 52930 - DNA, 75 bp, Artificial Sequence
  Synthetic
gtaagcaattcttatcaatggctgtaggaacgatggatacaccgagtaggtatgccataactattgtgtccggaa

SEQ ID NO: 52931 - DNA, 75 bp, Artificial Sequence
  Synthetic
tgcaggttgatgtggatgtgaaaagtgttactggcattgctagctttaaggatgggactcagcatacgattgttg

SEQ ID NO: 52932 - DNA, 75 bp, Artificial Sequence
  Synthetic
atgagatactactgcagccggcacgtttggtattgttgggtcggaaaggaggcggtaaatcaaggttgtcgaaga

SEQ ID NO: 52933 - DNA, 75 bp, Artificial Sequence
  Synthetic
tcttttcagaattgggatacaatgtgttagattcagacacttacggaaaagtgcttacacttgtggcagatcggg

SEQ ID NO: 52934 - DNA, 75 bp, Artificial Sequence
  Synthetic
gagaggatggtttagatgacgcattaaagaagtttgtgcgattgactccagatgaaaggaaagcggttccttcta

SEQ ID NO: 52935 - DNA, 75 bp, Artificial Sequence
  Synthetic
tattcgagactgagatggatagattatgtgaagtttttggttctagaggccttcgcccttatgcccagcgatgtc

SEQ ID NO: 52936 - DNA, 75 bp, Artificial Sequence
  Synthetic
agcaacaggctggtcgattgcattgggagttgtacgctgcatttcaggagttttatgatcgaacgatacgagtca

SEQ ID NO: 52937 - DNA, 75 bp, Artificial Sequence
  Synthetic
tcactccggataagtttcgattcgcttattttgcagagttagagcgtggtgggtttgatgacaatggattaactt

SEQ ID NO: 52938 - DNA, 75 bp, Artificial Sequence
  Synthetic
tttctcctgagttgaagactgttgtgttcgttcattctatgcctgagctgttcgaggccatgggtggatgtgttg

SEQ ID NO: 52939 - DNA, 75 bp, Artificial Sequence
  Synthetic
ctgagatagttccgacccacagtaccagattagctatactactccggggccaaggtttgtcagttaatgctgagc

SEQ ID NO: 52940 - DNA, 75 bp, Artificial Sequence
  Synthetic
ttcatctgcatgatttttatgttgctcttaatcagaatggtgcgcggaaagtctctttagggtggttagtacacg

SEQ ID NO: 52941 - DNA, 75 bp, Artificial Sequence
  Synthetic
ccttgaacgagttgttaaaaatgaggtagtaagccggtgggattggtgaccggtgcaggatgctgatctcccttg

SEQ ID NO: 52942 - DNA, 75 bp, Artificial Sequence
  Synthetic
aacgagttgttaaaaatgaggtagtaagccggtgggattggtgaccggtgcaggatgctgatctcccttgcagtc

SEQ ID NO: 52943 - DNA, 75 bp, Artificial Sequence
  Synthetic
gacattttgtcgcgctaggatgagagccgacagacagagtaccgctaagctacgcccatccttacatgctgtgat

SEQ ID NO: 52944 - DNA, 75 bp, Artificial Sequence
  Synthetic
tcaaactggaaatttaaatgcgttcaattttaccgttgaaggggttgattgcccaacgcccgcggatctaagtag

SEQ ID NO: 52945 - DNA, 75 bp, Artificial Sequence
  Synthetic
atactgtgttgcaaatggctggttctttaaaattggtaaccaggttatcatacctgttctgcgaaatttccctgc

SEQ ID NO: 52946 - DNA, 75 bp, Artificial Sequence
  Synthetic
attcaactacaacactgacattggaaggtttacctcttttccttttgaaactcttgaagatgtgacaaagctaca

SEQ ID NO: 52947 - DNA, 75 bp, Artificial Sequence
  Synthetic
tgatttagctaatggagatttggtcccacattttgcttttgttgaggatggatccccagtagttgctgccatatg

SEQ ID NO: 52948 - DNA, 75 bp, Artificial Sequence
  Synthetic
tgatagacatgataatgtagtcactctgcgcttccgagatagtggagggcgaatcataacggttgaagagttgct

SEQ ID NO: 52949 - DNA, 75 bp, Artificial Sequence
  Synthetic
agctggtgagcaacgagacttgaatctatatcaaggtttagaccaactggcagatgaggctggaattcggcctga

SEQ ID NO: 52950 - DNA, 75 bp, Artificial Sequence
  Synthetic
agatattgatcaagcggctttagcggctcaagctgttgctgatgcaggaggtggggttgcacaacaacaggcggc

SEQ ID NO: 52951 - DNA, 75 bp, Artificial Sequence
  Synthetic
tgcagcggcggcaggtgtgcaggctcaagaggatttaccagttgggcgtgaagatgaacttagaccagaagatgt

SEQ ID NO: 52952 - DNA, 75 bp, Artificial Sequence
  Synthetic
agcagatgctcgtggacaagcggctgctccacctcaggcacaggcaccagcaccacctgatgccgcactacaacg

SEQ ID NO: 52953 - DNA, 75 bp, Artificial Sequence
  Synthetic
tcaacgcgagcaagcaattctgcggcaggttcccaacttgcatgtcttgcctcagcctcgacagcaattaatcga

SEQ ID NO: 52954 - DNA, 75 bp, Artificial Sequence
  Synthetic
tcggctggctcaggtacgtgaggcggagcagaaattcattaatgaaatgattcaagaagtgggcgtaattgagca

SEQ ID NO: 52955 - DNA, 75 bp, Artificial Sequence
  Synthetic
acagagagatgtggcggcggctggaatgcgattggagttgtgtcggtccgtgcatcgggttgatggaattttacg

SEQ ID NO: 52956 - DNA, 75 bp, Artificial Sequence
  Synthetic
ggcttaccaagagcgagtgaatccgttcagattaggtttgaattatagacctcctatcttgctcgaggaagagat

SEQ ID NO: 52957 - DNA, 75 bp, Artificial Sequence
  Synthetic
tagagttgaagagaatgctcgtcgtttaggtggtgaaatcggtctacatgattttgaaattgcagagaggccaga

SEQ ID NO: 52958 - DNA, 75 bp, Artificial Sequence
  Synthetic
aagagctctcttacatgccgagtacttggggaatctaatgcatgttgaacaggaaaagttattaacaactggtcg

SEQ ID NO: 52959 - DNA, 75 bp, Artificial Sequence
  Synthetic
tacgtttgtagcccatattcatcaggctgggtactgtaatccagagggatggtgttgtttgcaagatgttgaggt

SEQ ID NO: 52960 - DNA, 75 bp, Artificial Sequence
  Synthetic
gcaagtccaagggattgagcccgagagtctcttgcctgcgttggctgttcgcacaaattgtcgaggattggtgct

SEQ ID NO: 52961 - DNA, 75 bp, Artificial Sequence
  Synthetic
ccgagccccgcttccgatcatacgggttttgactcagataattcaccacccctcaggtctcgaccgactcgaagc

SEQ ID NO: 52962 - DNA, 75 bp, Artificial Sequence
  Synthetic
gaccttgaatgtattacttactgacatgcgtgagcgagtttcgactttgacgacagctgattctacgagacgtat

SEQ ID NO: 52963 - DNA, 75 bp, Artificial Sequence
  Synthetic
tcgtgtaaatgatgctcatgatcttgcagccatgacagcgccgttaggtcacgtatatgctatgctgtctagatg

SEQ ID NO: 52964 - DNA, 75 bp, Artificial Sequence
  Synthetic
gagggacaacgtggccaggttgagggcgagcgctcaacatcaattgatagctcaggaacttgctcgtaagtatgc

SEQ ID NO: 52965 - DNA, 75 bp, Artificial Sequence
  Synthetic
ggagtggcgtccagggcaacactacaccattcctggtagagtattaaatttatttgcaaatcgtcagctgcgata

SEQ ID NO: 52966 - DNA, 75 bp, Artificial Sequence
  Synthetic
tcaatcccagcttgaatgggtgtatcctcatctatggatagccgacaggaatttggcaggagcatggattctcaa

SEQ ID NO: 52967 - DNA, 75 bp, Artificial Sequence
  Synthetic
cggtgttgttccaacgtatcggaatcttggtgagtgggtgcctgatattgcctttattggcttggttcaattttt

SEQ ID NO: 52968 - DNA, 75 bp, Artificial Sequence
  Synthetic
ggagttctgggaggagtttgtgacatggttccctcattatggggttggaccaattaatcgtggagttccagtgtt

SEQ ID NO: 52969 - DNA, 75 bp, Artificial Sequence
  Synthetic
ccctactgtgttttctcctagaatgtcatcgttagcggtgcggcttctttaggctctcgcgcacggggaatttgc

SEQ ID NO: 52970 - DNA, 75 bp, Artificial Sequence
  Synthetic
actgtgttttctcctagaatgtcatcgttagcggtgcggcttctttaggctctcgcgcacggggaatttgcagtc

SEQ ID NO: 52971 - DNA, 75 bp, Artificial Sequence
  Synthetic
gacattttgtcacccgtcagaatggggaaccgagtgtcaacatacagccctcaattcatcacaatcaatggaaat

SEQ ID NO: 52972 - DNA, 75 bp, Artificial Sequence
  Synthetic
aataatgcactggatacaaaaacgatggaacgctttgatcagactaattcggtagacgcagccgttaaattaccc

SEQ ID NO: 52973 - DNA, 75 bp, Artificial Sequence
  Synthetic
gatggaatcaatccaactagagctgaattctcaactgtgaatgacatgcgtgcatttctcggactgcgagatgat

SEQ ID NO: 52974 - DNA, 75 bp, Artificial Sequence
  Synthetic
ttgctatgtgaggatgatgatatcttcgaagatatgtttgatcagatggttggttcagaaggtaaaatcaaaggt

SEQ ID NO: 52975 - DNA, 75 bp, Artificial Sequence
  Synthetic
gtggtgtctggtacattggatggctatgaaaagatccgaaaagcagcgaattggctcggtggaacgtatagccga

SEQ ID NO: 52976 - DNA, 75 bp, Artificial Sequence
  Synthetic
ccgtggagagttgaaacaagggaaatgtctgagattcagaagcggattgatactgcgttacctgccatgacatca

SEQ ID NO: 52977 - DNA, 75 bp, Artificial Sequence
  Synthetic
atcattggagggacctttggacccggtgcagccagagtaggaggggatcatatgctcgtgcgacctgagcagtgg

SEQ ID NO: 52978 - DNA, 75 bp, Artificial Sequence
  Synthetic
gttaatgtaaggggtgatttctttctggggcatgatgatggatttgagtcgaggcatatcgcagtagggacggat

SEQ ID NO: 52979 - DNA, 75 bp, Artificial Sequence
  Synthetic
gcgtttcagtgtgttcgcctaggaagattgatgccagaatttggtgatgcagtgcgcggtggaggttgggcaaat

SEQ ID NO: 52980 - DNA, 75 bp, Artificial Sequence
  Synthetic
ggtgtaagttatttgatgggtcagcccttgtttcagattgcatatggtcgagtggtgaatgatgtagatcgtccg

SEQ ID NO: 52981 - DNA, 75 bp, Artificial Sequence
  Synthetic
attcaaatcttgtggcaggcagctttaaggacggcagcttcgagtgagggagatgtcccagtggcggaggcttta

SEQ ID NO: 52982 - DNA, 75 bp, Artificial Sequence
  Synthetic
aaaattcttggggcgatgacaaagagcacgttttcctggatggtgtcgattgtagggacggagtactcaatggag

SEQ ID NO: 52983 - DNA, 75 bp, Artificial Sequence
  Synthetic
gctacagcggagaggccaatgtttccaatgacgcaccttacgtccgctgattatgagctcttgcatagacttttt

SEQ ID NO: 52984 - DNA, 75 bp, Artificial Sequence
  Synthetic
gttatgtggttgaagggcgatgtcatgcattcgcgattttttgatgtcgttgcgaatctcgaatcgtttacttct

SEQ ID NO: 52985 - DNA, 75 bp, Artificial Sequence
  Synthetic
ggaatgtgctttttaaaccgagttagattggccttgcaattgtttgttactaagttggatgaggagacgaagtcg

SEQ ID NO: 52986 - DNA, 75 bp, Artificial Sequence
  Synthetic
cgtcaagattattggtgtgatatgttaaatcagcttatggaggtgcactcctgccctttgctatatacagctttt

SEQ ID NO: 52987 - DNA, 75 bp, Artificial Sequence
  Synthetic
cttctaagtggtggatggaatgatgaggtgtctatgaaagtggagcccattgacggtgtggtgctggaacgattg

SEQ ID NO: 52988 - DNA, 75 bp, Artificial Sequence
  Synthetic
gaattctccggccgctatttgtggatgtcttggaggaatgctgctacgtattctgagtatgtgcgaatgcatgca

SEQ ID NO: 52989 - DNA, 75 bp, Artificial Sequence
  Synthetic
gagggaggggatggtgatgatgatatcttaggcttgttgaagcgaggtgcagcccagatgaaagggatggtggcg

SEQ ID NO: 52990 - DNA, 75 bp, Artificial Sequence
  Synthetic
ggacatcttcggccagttctgaatgaggcggcgggagcggctgaacgcgtgatgaccggttgggcaaaacagaag

SEQ ID NO: 52991 - DNA, 75 bp, Artificial Sequence
  Synthetic
gctggtacgttaaagcaagcggtgacgaacgcgatggctggggtgttattggacacgaagagggaggcccaggcg

SEQ ID NO: 52992 - DNA, 75 bp, Artificial Sequence
  Synthetic
gaagctaatgtgtacgggagcatggttggtggtcggcatgttttggctcttccccctacggatcatttgcaaaaa

SEQ ID NO: 52993 - DNA, 75 bp, Artificial Sequence
  Synthetic
ttggcgcctttagtcccaccaggtgctgctgacacggttattgatgatgtgaaacgggttggtcaccatgtcgga

SEQ ID NO: 52994 - DNA, 75 bp, Artificial Sequence
  Synthetic
ttggctatcatggagagaggggagccagtgagagagccggttgtcgagaatcatgtggtgcatgagatggtaaac

SEQ ID NO: 52995 - DNA, 75 bp, Artificial Sequence
  Synthetic
aggacaaagactggagtcggccagattggcgaggttaggagggagttagcaaagtgttctgaagttatgaaggat

SEQ ID NO: 52996 - DNA, 75 bp, Artificial Sequence
  Synthetic
gtatcagtggagaagatggtagctagaccggatgaggtgcggggaacatcatttccgatacacactcgggggtat

SEQ ID NO: 52997 - DNA, 75 bp, Artificial Sequence
  Synthetic
catgtatctttagttgatgggtgtgacaagcatgcgatgaaggacccgacgaataatctcgctgcaggggcgact

SEQ ID NO: 52998 - DNA, 75 bp, Artificial Sequence
  Synthetic
ttctcttgtcaaggattagtgacggggaaacttaaaacatgtttttcagtgacgttagcaaaagctcatcataac

SEQ ID NO: 52999 - DNA, 75 bp, Artificial Sequence
  Synthetic
agagaaacatctccgactacgttgcatgtcatttcagggggtttcttctcctatgacccggcagctgttcacata

SEQ ID NO: 53000 - DNA, 75 bp, Artificial Sequence
  Synthetic
ggagggcaagatggtgggggaccagatcatgatatgaatattaacgttgtagtgacagcggcagtgaagaagtcc

SEQ ID NO: 53001 - DNA, 75 bp, Artificial Sequence
  Synthetic
acatcggagacggcatgtaaggtgtacgttggtgctattgctaagtctccgaatacgactcatcacacaaccaac

SEQ ID NO: 53002 - DNA, 75 bp, Artificial Sequence
  Synthetic
aatggggttggatttgttccagcgattgacgacaaggggcagacatattttacgacatcgggagtgtttgtgggg

SEQ ID NO: 53003 - DNA, 75 bp, Artificial Sequence
  Synthetic
agactttctttcaatatttccgcactgctgaggggtggattaacaggtgtgacctcttgtccctgggatggtacc

SEQ ID NO: 53004 - DNA, 75 bp, Artificial Sequence
  Synthetic
tttgctttcgttgtagcttgtggatgttcgaattatgggagcagtggttgtacgcatgttgaactcgtgcaatta

SEQ ID NO: 53005 - DNA, 75 bp, Artificial Sequence
  Synthetic
ggtgttgagtttggggagtgcattattgtgccgagggggctggatcgatattacatatttaatcgggttcggtac

SEQ ID NO: 53006 - DNA, 75 bp, Artificial Sequence
  Synthetic
tatgacaagaccatttttgatttcataggtcgggttgatgcaactgtcgctgtttcagaatctcctttagatgta

SEQ ID NO: 53007 - DNA, 75 bp, Artificial Sequence
  Synthetic
gtgagtgcgtggtcggagttaatcagtcccttggtggtgtatcttccattgatggtgcacgaattgaagagcgct

SEQ ID NO: 53008 - DNA, 75 bp, Artificial Sequence
  Synthetic
aacactttagccctcgtgaagactcggtatcgtgcatggctgaagaaggttggtttgaaaatgggtgaaaacaat

SEQ ID NO: 53009 - DNA, 75 bp, Artificial Sequence
  Synthetic
ccttttagaactgatgaagactgtgatggctgggtgtgtgcagcaattttggcgatgcctatgtggatgcgttac

SEQ ID NO: 53010 - DNA, 75 bp, Artificial Sequence
  Synthetic
gcaggtggcaatcctttaattattatgactcaagatgatcgaaaggcgtcggcgataatgttgttgtctactgct

SEQ ID NO: 53011 - DNA, 75 bp, Artificial Sequence
  Synthetic
aaggccatgcttcctcttagtgcatttcagttggtggatggatccttgtctcgtgctgcagccaaaggacttaag

SEQ ID NO: 53012 - DNA, 75 bp, Artificial Sequence
  Synthetic
tgggcggctgatcgtgagattatggggtaggtatgtgacattcattcccagggtgcattcttgatgtgaagacaa

SEQ ID NO: 53013 - DNA, 75 bp, Artificial Sequence
  Synthetic
ctgatcgtgagattatggggtaggtatgtgacattcattcccagggtgcattcttgatgtgaagacaatgcagtc

SEQ ID NO: 53014 - DNA, 75 bp, Artificial Sequence
  Synthetic
cacattttgtctctgtgatccccgcacagacgttccactatgccggctcttgctataatcggtgatactctcttg

SEQ ID NO: 53015 - DNA, 75 bp, Artificial Sequence
  Synthetic
aatgcctctcttattgataaatacacaccgccctcaagcaatgctcaaaaccaaggatttacaacatacgtgcac

SEQ ID NO: 53016 - DNA, 75 bp, Artificial Sequence
  Synthetic
tctgttaaacctctgattccccagataattggcatacccgaagatgctctcaagcagtggactttatttactgat

SEQ ID NO: 53017 - DNA, 75 bp, Artificial Sequence
  Synthetic
tgggcaaaactaaatgacattgatttgaatgctgatgagacatttaaagagattttgaccattggtaagagattg

SEQ ID NO: 53018 - DNA, 75 bp, Artificial Sequence
  Synthetic
gtatcaggtgacatcacccagtttgtgtatcggcagtttcgtggaaaattggaagttggatacttcgggaagacg

SEQ ID NO: 53019 - DNA, 75 bp, Artificial Sequence
  Synthetic
gacaatgttcgtgaaaaaccatctttctttccgctgttgggagcaggacaaattgagagtttgaaggatctcctt

SEQ ID NO: 53020 - DNA, 75 bp, Artificial Sequence
  Synthetic
tcacgccacttcgaggtctgggtctactttgcgccaaagcctgtgattgattggatgatccgtcatgagatagat

SEQ ID NO: 53021 - DNA, 75 bp, Artificial Sequence
  Synthetic
ctggccacagtggagtttgatgttcgtaacatgctgaaaatgttgtccaacaatccaatcaagtgggagacgttg

SEQ ID NO: 53022 - DNA, 75 bp, Artificial Sequence
  Synthetic
cttgagaaaatcgccaatgtagctgaaagtcggattacggcagatcgggacgaggttggtgaatggcgcccctgg

SEQ ID NO: 53023 - DNA, 75 bp, Artificial Sequence
  Synthetic
gtgattggcctgttaatgatattcggtcagtcattgaagattggtggcttgatggctgttttgaagtggaggcag

SEQ ID NO: 53024 - DNA, 75 bp, Artificial Sequence
  Synthetic
ttggggcccgtttgctacaggaacttatcgcgcgtatgaagagtgaccctggagccgtgccgcatcttcaatttg

SEQ ID NO: 53025 - DNA, 75 bp, Artificial Sequence
  Synthetic
ttaacaatgagttgaaggtcgggtggaaggtcgcgccgatacgtcgtgatgggcgaaactactccattcgtctca

SEQ ID NO: 53026 - DNA, 75 bp, Artificial Sequence
  Synthetic
atgctcgtaatcctcagttaggcggtgcttttacgattgagagcggagcctttaaggtgtagtgtgaacggggct

SEQ ID NO: 53027 - DNA, 75 bp, Artificial Sequence
  Synthetic
ggtgcttttacgattgagagcggagcctttaaggtgtagtgtgaacggggctaaggcctggatacaaatgcagtg

SEQ ID NO: 53028 - DNA, 75 bp, Artificial Sequence
  Synthetic
gacattttgtcctgaagactgagactgcgtcttgttttctgccgtgcttttgctcaactcacttaccaaatctca

SEQ ID NO: 53029 - DNA, 75 bp, Artificial Sequence
  Synthetic
acatgttcaccaacaaagcaattcttgccgtttaccaactccctgaagaatgtactttggaactggtcgtgcgtg

SEQ ID NO: 53030 - DNA, 75 bp, Artificial Sequence
  Synthetic
atggaactggtaaccttgtgaattcatgctatgtggagacattccagcacagaggaaacattaaattcggtgacc

SEQ ID NO: 53031 - DNA, 75 bp, Artificial Sequence
  Synthetic
gtcaggctcaagtgatctctcatttcaatcaagtcattgatttgctaagaacatcagtcagcgacagtattgaca

SEQ ID NO: 53032 - DNA, 75 bp, Artificial Sequence
  Synthetic
gtatgattaggtacgttggtgagcagggaaatgatgacactcgagcccttgttgttcgtgctatgaatgacttct

SEQ ID NO: 53033 - DNA, 75 bp, Artificial Sequence
  Synthetic
ttccagccaaggtcggggaggctgtgtttcaggctgttcaggcggcgcttcaaggaccaggcatgctgacaacgt

SEQ ID NO: 53034 - DNA, 75 bp, Artificial Sequence
  Synthetic
tgatgaccagacaactggagtttcttggaaatacgacgctttacaacactcgtatgctggaggcgattctgcaca

SEQ ID NO: 53035 - DNA, 75 bp, Artificial Sequence
  Synthetic
tcgtggataccaagcgagctccagctcaagatgtggcacctgttgattatatcaatgggccagcgaagacaccgt

SEQ ID NO: 53036 - DNA, 75 bp, Artificial Sequence
  Synthetic
tgtgggagccctatgttgttcaatgtcctgatctggcgcccactggtcgggttgatgttcctgatatgcatgtca

SEQ ID NO: 53037 - DNA, 75 bp, Artificial Sequence
  Synthetic
ctcataatggccagccattgaccactgcatggtacccgccccctgcttccctgagaccgcttcttcctgatggaa

SEQ ID NO: 53038 - DNA, 75 bp, Artificial Sequence
  Synthetic
ctgttggtgcaaatcctgagccgtccgctgctggtgccaactttgagcctccctcagcttctagccgcaatcccg

SEQ ID NO: 53039 - DNA, 75 bp, Artificial Sequence
  Synthetic
atgatggtgggtcaactccggttgatacagtcgagctccgctctgcgacagatgtgcccgagaacgatcatgctc

SEQ ID NO: 53040 - DNA, 75 bp, Artificial Sequence
  Synthetic
taaggcttcttgaggagatagctcgtagtcatctgcctagccatcagcagacgcataatatgattgtgcctcaga

SEQ ID NO: 53041 - DNA, 75 bp, Artificial Sequence
  Synthetic
aagatggtgcccagggtgtggttgtgacgccagattatgcaaaatctggatgcaaggtggacatgcagccgttcc

SEQ ID NO: 53042 - DNA, 75 bp, Artificial Sequence
  Synthetic
actcatatggaggtccgaatgaatctcatttcgcaccgatggggatcatgttgaattatgacaaatatgactgtg

SEQ ID NO: 53043 - DNA, 75 bp, Artificial Sequence
  Synthetic
gttttgtcattcctttggaagatcctcgtcacacagattgcaacttgtggaccgaaatgccaaccatgcgggatg

SEQ ID NO: 53044 - DNA, 75 bp, Artificial Sequence
  Synthetic
actttgcacgccaaggtcgtttttggaggtatgatttgaatgtggatcatttccgggagtgcattgctcgacaca

SEQ ID NO: 53045 - DNA, 75 bp, Artificial Sequence
  Synthetic
ctcacgtgtacgcagacggggccaggttgatgggaacatttgtgttcgaactggtgaaaggggagagatggactc

SEQ ID NO: 53046 - DNA, 75 bp, Artificial Sequence
  Synthetic
tagagatttgctcgtaccgagatcgacaatttagatctgctcttttggctcgagcgaccccccgcctcatgcacg

SEQ ID NO: 53047 - DNA, 75 bp, Artificial Sequence
  Synthetic
ctctcggttatgggacaaattttggccggttcatcatcgctatggacccgagaatgaacttgtctgactttcctg

SEQ ID NO: 53048 - DNA, 75 bp, Artificial Sequence
  Synthetic
tggacgtgatgagacctgcagagggacgtcggccttgtgtatgtcaggagtcacgtggtgctgggcctttgatgg

SEQ ID NO: 53049 - DNA, 75 bp, Artificial Sequence
  Synthetic
atgagctcgatttctattttgaaaagaactggaatgagcttgaacgtcgtgctcaagaaggtggagagcctaaga

SEQ ID NO: 53050 - DNA, 75 bp, Artificial Sequence
  Synthetic
cgctgacccggccgaccgaactgatagaggcgttaactgcactgggcaagggtactgctttctctctcacgccgc

SEQ ID NO: 53051 - DNA, 75 bp, Artificial Sequence
  Synthetic
agaagggatcatgtgttccaacaacaatggcccgaatgttgagagatcgcggagcggatgagtgggccgttatct

SEQ ID NO: 53052 - DNA, 75 bp, Artificial Sequence
  Synthetic
tggagaagatggcaacatctcttgcattggcggcggcgaaggagggtaacccggcagaggccttctatcgtgaca

SEQ ID NO: 53053 - DNA, 75 bp, Artificial Sequence
  Synthetic
tgtcctcatggaccaatgatgagaggagcagggcgatgcagcttatcacctggaagcggctggcaattaattttg

SEQ ID NO: 53054 - DNA, 75 bp, Artificial Sequence
  Synthetic
gtgtcaaggtttcaatgcgtgcactgggagtgagaaatggctatcgtgtctctcgggcggcgattccaaaaggcg

SEQ ID NO: 53055 - DNA, 75 bp, Artificial Sequence
  Synthetic
ttatggcgttgaacaattgtgaattgttcggtggtgggcacgtgtgtcctgagtgtcattctgtgtttcagagtg

SEQ ID NO: 53056 - DNA, 75 bp, Artificial Sequence
  Synthetic
ctggcgagagaaagatgtgcacgactttggatctgatgtttcaccagctgttcctattatcaacgggtgatgttt

SEQ ID NO: 53057 - DNA, 75 bp, Artificial Sequence
  Synthetic
ggcttggagcgttggtgattcatgatccccgaagtcatgtctctaagacgatgaagggtgtcaacagaggagcga

SEQ ID NO: 53058 - DNA, 75 bp, Artificial Sequence
  Synthetic
atggtggtgtcaagtatgaggagattcgcaaggtgaggcagttcatggtcaagtttccgtttggccgaacttgtc

SEQ ID NO: 53059 - DNA, 75 bp, Artificial Sequence
  Synthetic
ctcattgagattggatattttctaagactgcttgcttaaaggtgtgaaaatcaattgtcggtgtaatctgacgca

SEQ ID NO: 53060 - DNA, 75 bp, Artificial Sequence
  Synthetic
tgcttaaaggtgtgaaaatcaattgtcggtgtaatctgacgcaggggttcagtctgtgttcggatgcatgcagtc

SEQ ID NO: 53061 - DNA, 75 bp, Artificial Sequence
  Synthetic
gacattttgtaagaatggcagcctcgggatggaacgcagtgataccaaagacctcaagttatgattatattactg

SEQ ID NO: 53062 - DNA, 75 bp, Artificial Sequence
  Synthetic
tttcaatacaacctgctcaacaagataacaagaaaaatttggtaatagagttcccaccagtctcgtacttctatg

SEQ ID NO: 53063 - DNA, 75 bp, Artificial Sequence
  Synthetic
gtgtctattggactacagatgatatgattattgttagacttccagcttcaaccacttcctcacaagatttaagca

SEQ ID NO: 53064 - DNA, 75 bp, Artificial Sequence
  Synthetic
aaatggtcacaattacaaagttacggtggactttccaaaaccagaaatttacgtgtagtgttggcagtgatctgg

SEQ ID NO: 53065 - DNA, 75 bp, Artificial Sequence
  Synthetic
catttcggataattatgacttgtaacgttggtacgatgtattttactgctacctttctgttaaatacattaacat

SEQ ID NO: 53066 - DNA, 75 bp, Artificial Sequence
  Synthetic
ccactgggactaaggtatatggtatgttcaattatgtgtctttatcaagtttggtggtcgttgtaactggtaatg

SEQ ID NO: 53067 - DNA, 75 bp, Artificial Sequence
  Synthetic
atgctgcacatgtggaagcattaatcgctgttgaaggtgctgcagtccgtaaccaagtagcaaaattaattttgt

SEQ ID NO: 53068 - DNA, 75 bp, Artificial Sequence
  Synthetic
ggtctgtaactgagacaactaattatttgagttttgaaaaactgatttctaaggcgggtaaggatgttgagtcag

SEQ ID NO: 53069 - DNA, 75 bp, Artificial Sequence
  Synthetic
gctactataaaggtgatacaaaaacaaagcgggccattcaagcactttcgatctctcagggtgagtcgtggtact

SEQ ID NO: 53070 - DNA, 75 bp, Artificial Sequence
  Synthetic
acaccgaactgtgtactagttccccattagatgttggtggctcagggttagctttcttcatgcgtattcgcggag

SEQ ID NO: 53071 - DNA, 75 bp, Artificial Sequence
  Synthetic
tcggactacggtcagaggcaggggtaacaccttggaaggtgagtgaaatttttaagcctctcacttctcgtttgg

SEQ ID NO: 53072 - DNA, 75 bp, Artificial Sequence
  Synthetic
aatcggacttttcttattcaattcatccagaagcacaggaagatgacagtgtggtggttcataaggctcatttac

SEQ ID NO: 53073 - DNA, 75 bp, Artificial Sequence
  Synthetic
tggcccagaacattattcgggatttgggatataagacggtagcggagttggatacagcagaggattcccatttac

SEQ ID NO: 53074 - DNA, 75 bp, Artificial Sequence
  Synthetic
ccgtagggtcggctgattgtttggctgctttgctcgatttattatatcgtaggtcggaggaaatgacattagcat

SEQ ID NO: 53075 - DNA, 75 bp, Artificial Sequence
  Synthetic
taaatcgagaatataagcctcgtagacggcgagctgctattgctccgcaaatccaagacccagctgttcccgcga

SEQ ID NO: 53076 - DNA, 75 bp, Artificial Sequence
  Synthetic
tccagacttatcaaaatctggtggcggggatgttaggagagcttaacaagtcgcaacaggaggtgcttgcgttta

SEQ ID NO: 53077 - DNA, 75 bp, Artificial Sequence
  Synthetic
aaggaaaatttgagcagttggagaggaaagtgaataaccatttagccgtcaatccgcttacgaagctaagtcgga

SEQ ID NO: 53078 - DNA, 75 bp, Artificial Sequence
  Synthetic
taaagcagagaatggatcagtttgaaactagccttgcgggtgtctcatccgtagtgaatgaggtgcagggattac

SEQ ID NO: 53079 - DNA, 75 bp, Artificial Sequence
  Synthetic
gtaactcccacggtcagttgtctacagagattaatagaattaaggaggctgagggtcatttcttgaatgatctag

SEQ ID NO: 53080 - DNA, 75 bp, Artificial Sequence
  Synthetic
agagtgtgcgccgtcatttgcaaggtgagactggtcatttaaggagtcaacttgggaattctctcgtgacaattt

SEQ ID NO: 53081 - DNA, 75 bp, Artificial Sequence
  Synthetic
ttaagccaataattaagatgatatcgagagatataggaatgtgtctgaaagttggcagtgctgatcaatctcaga

SEQ ID NO: 53082 - DNA, 75 bp, Artificial Sequence
  Synthetic
atgatgtggtggctctttcgtctcgaattgataggctgactcaggaagtagtagctttacaaaatagtgagaagc

SEQ ID NO: 53083 - DNA, 75 bp, Artificial Sequence
  Synthetic
cgaggttattctatcttcatgataaaagtgagattaaggctgcagcaggagcattagaggccgtagctgcgcatg

SEQ ID NO: 53084 - DNA, 75 bp, Artificial Sequence
  Synthetic
tgtacttagggtggatgagtcagcgtttcatttgcccccctgttttgggaaccgtgtaccatcatgaccgatata

SEQ ID NO: 53085 - DNA, 75 bp, Artificial Sequence
  Synthetic
ttcagggtgtatattataaattggtggcgtgtactattgaaatggttcaccttgataaagggacgatgatcctgt

SEQ ID NO: 53086 - DNA, 75 bp, Artificial Sequence
  Synthetic
taattcgtgatgaaattctgccggtgggtgttctgcatgaagtcgaatcaaacattgtgttggaccaatgtgatc

SEQ ID NO: 53087 - DNA, 75 bp, Artificial Sequence
  Synthetic
atgttcccgggattgttcggttgtctcgagatcgggtgtctcctgtggattatattgaagtttatgaagttgtag

SEQ ID NO: 53088 - DNA, 75 bp, Artificial Sequence
  Synthetic
atccgggagtgtttactttgtctttttcccatgttattgcgatctatatcccgagatgttccgggctgaggttgc

SEQ ID NO: 53089 - DNA, 75 bp, Artificial Sequence
  Synthetic
atctatatcccgagatgttccgggctgaggttgcttccgtgatggcggtgcaccacgccatacacaattgcagtc

SEQ ID NO: 53090 - DNA, 75 bp, Artificial Sequence
  Synthetic
gacattttgtcatggcacagctgttgttcaggaaaacgactcaagacttccgagattgctttggactgaaacacg

SEQ ID NO: 53091 - DNA, 75 bp, Artificial Sequence
  Synthetic
aaatacttgcatcaatttacaacgaaaaaagcaccttctctagtgaaaacgggtcaatccaaatattggaagaag

SEQ ID NO: 53092 - DNA, 75 bp, Artificial Sequence
  Synthetic
cagaagttaatgctctaggtgagttagtaagagatggcacggtcgcaatttcattcggacctgggatttattcac

SEQ ID NO: 53093 - DNA, 75 bp, Artificial Sequence
  Synthetic
gtatgttttctcatttacgtgatgattctgattatcggtctgcccttactgactgcgtggctcatgggtggaagc

SEQ ID NO: 53094 - DNA, 75 bp, Artificial Sequence
  Synthetic
aaactcgagatgcgagggatgttcgagagtggcaacgatctgctgcgattatgtgcgcggagaggtatatgtata

SEQ ID NO: 53095 - DNA, 75 bp, Artificial Sequence
  Synthetic
aggtgaggcaggcgtataagagggtggttgaaaacttggatcatatgtacgcctggcattacttgaccgaagggc

SEQ ID NO: 53096 - DNA, 75 bp, Artificial Sequence
  Synthetic
cctccgagcatgtctttattctgccagctatgtatgaatctgtacggcatgaaactacttctgaggcgtatggaa

SEQ ID NO: 53097 - DNA, 75 bp, Artificial Sequence
  Synthetic
tgcaatgtggtggtatcatcggaggaaatgtatcattgatgcttcctagagacgagcaatacacaactttattta

SEQ ID NO: 53098 - DNA, 75 bp, Artificial Sequence
  Synthetic
aagcgtggttgatgtctctggcgaaaatgagtttgtctgagcttcgcgagccccattggaacggtgttcgggtgc

SEQ ID NO: 53099 - DNA, 75 bp, Artificial Sequence
  Synthetic
aactatcgagggatcatagaatcttgtactatggtgatttattaccaagtgatggagacattacatacctagtga

SEQ ID NO: 53100 - DNA, 75 bp, Artificial Sequence
  Synthetic
ataaattagagtatcacactatctggtttccagaaggagatttcgagaccatgatgggtgcaatgcttcgagatt

SEQ ID NO: 53101 - DNA, 75 bp, Artificial Sequence
  Synthetic
cgtttccagcaggttgtcatgcacacttaaatattccagtgcctcattatttcgtatttgatactgatgatgatt

SEQ ID NO: 53102 - DNA, 75 bp, Artificial Sequence
  Synthetic
tgatattgaggtgttggaagggtgtgcgggatacatggattaagttgcggctcggttatgaggagggaggagtga

SEQ ID NO: 53103 - DNA, 75 bp, Artificial Sequence
  Synthetic
acgattctcgtatgagcgaggctttaattgtgaatagagatttacctgctgatttaagtgagtctttattctgtt

SEQ ID NO: 53104 - DNA, 75 bp, Artificial Sequence
  Synthetic
gttgtctagctcgaggtgtgtcacgtgatcaagtgcggacgctgaaggatgtacggaatgtagctcaggcgcaga

SEQ ID NO: 53105 - DNA, 75 bp, Artificial Sequence
  Synthetic
ttaggcacgttgtttcagggcagggcgtatggtgggagcatatggtgcggggtcaacctctggcatgttcaatca

SEQ ID NO: 53106 - DNA, 75 bp, Artificial Sequence
  Synthetic
gacctggtaaggtggtgctagttgtagattacgaggatggacctcttcacgtgtctattcgtgttaggcttttga

SEQ ID NO: 53107 - DNA, 75 bp, Artificial Sequence
  Synthetic
atgtacattatgctagagagttgggcatgaaagcgagcgatgttgtagttcggattcccacatcgaatcgtccac

SEQ ID NO: 53108 - DNA, 75 bp, Artificial Sequence
  Synthetic
ggtgggttgagactaaggagtatgagcgatctttgagattttatgagttccgacctggcccaattactacagagt

SEQ ID NO: 53109 - DNA, 75 bp, Artificial Sequence
  Synthetic
tccaccatgtctttgctttttattgttactggggatgtggtcgggtggaaaagcgacgccacctttatcagattc

SEQ ID NO: 53110 - DNA, 75 bp, Artificial Sequence
  Synthetic
gagaagtgagaaggggaaatctatatagtagatctaggtttttaagaaggattgccgaggacggagagaaagtga

SEQ ID NO: 53111 - DNA, 75 bp, Artificial Sequence
  Synthetic
aagttcaaggtcgaacacatgtgactgcgacgagggctgtccagcatgagaaatgtaatccgaatgaggatatca

SEQ ID NO: 53112 - DNA, 75 bp, Artificial Sequence
  Synthetic
tctactcaagggaatttgctcgggaactggcgctgacgggaaaaatcaaggaggctggggcgctagctgtgattt

SEQ ID NO: 53113 - DNA, 75 bp, Artificial Sequence
  Synthetic
atacttgcatgcaaacgttaggtgtagatatagatcctcctgctggttgggtgcgtgaaggtcgaccgaaacaga

SEQ ID NO: 53114 - DNA, 75 bp, Artificial Sequence
  Synthetic
gaaccgctaagctttgtcatcttttgactagaatattgacagcattcttttcttaccgtggcgggtcgtcaagtt

SEQ ID NO: 53115 - DNA, 75 bp, Artificial Sequence
  Synthetic
tggtgtgcagtgttatggttgtaattttttccatcatattatattacttgcgtttgaagcatgtggatcaagagg

SEQ ID NO: 53116 - DNA, 75 bp, Artificial Sequence
  Synthetic
ttcgatatgatgagctaacattgatctggtatggggatggcggggttgagctgcagcgtatcttgcgtgaagtgt

SEQ ID NO: 53117 - DNA, 75 bp, Artificial Sequence
  Synthetic
cgatgacgaggtttgttgctgtggccggtgatccagctacgccagagtatatagcgcaggcaaagctttgggcta

SEQ ID NO: 53118 - DNA, 75 bp, Artificial Sequence
  Synthetic
acaagaagagtaatatagtggtgttcaattacgcgcgtccatatgagaggggtccagtttttgagaatctgattc

SEQ ID NO: 53119 - DNA, 75 bp, Artificial Sequence
  Synthetic
gtgatacagtttctcttcgggaagcggcggaggtttttattttgagaacagatgactcttggagtcaatacggaa

SEQ ID NO: 53120 - DNA, 75 bp, Artificial Sequence
  Synthetic
atacagtagttgccatgctgggagagggtgatttttgtgatctagtccattttggtgcctcgtgcgatccgatgg

SEQ ID NO: 53121 - DNA, 75 bp, Artificial Sequence
  Synthetic
agcattattttgttcatatttctcaaccccctggtacaaaccctggctatgaaccggcgaatcaggaagagcctt

SEQ ID NO: 53122 - DNA, 75 bp, Artificial Sequence
  Synthetic
ttgaggagtggttgtatgagacccaggctatggagcgagtaattccgacaacgtgggaatcagaaattgtcgatg

SEQ ID NO: 53123 - DNA, 75 bp, Artificial Sequence
  Synthetic
cgcgtgggatgctagtgtcaatcttaacgtttcattttcgcttcgcggggtggtttgagctggatgtcccggggg

SEQ ID NO: 53124 - DNA, 75 bp, Artificial Sequence
  Synthetic
atgatattggtcgtggcctgcagttgatgggaagcattaacaaggttgtgcatgttagctgtttcgtacaaaacg

SEQ ID NO: 53125 - DNA, 75 bp, Artificial Sequence
  Synthetic
gtagacgttattttcggctatcggtcgatttagatgttgatcgagtcttgaggaatatgagacatgaaggtgatg

SEQ ID NO: 53126 - DNA, 75 bp, Artificial Sequence
  Synthetic
cattaatggcggcagagttatttgtcaccgacgcggtgttagtgtgtgaggggcttgtcgtaggtgagatgcatc

SEQ ID NO: 53127 - DNA, 75 bp, Artificial Sequence
  Synthetic
ggttacaacgaacctaccgatcagtaaatgcaatggtgtatcatcaagggatgactaactttattgtgtatgaat

SEQ ID NO: 53128 - DNA, 75 bp, Artificial Sequence
  Synthetic
ggatgaggcgcgttctcttaactaatttgttagatgagatgttagtttttgatattgggggacggaatggcgagt

SEQ ID NO: 53129 - DNA, 75 bp, Artificial Sequence
  Synthetic
tgtcgggatgggtggtgcaggatgtaaaagttcattacttttgtgtcgatcctgcgggggaagaggccattccta

SEQ ID NO: 53130 - DNA, 75 bp, Artificial Sequence
  Synthetic
aaggtcaacgcgttaggctgccgggtgggagagcgatatgggatatagcggaaaccgttgagcagaatgttgctc

SEQ ID NO: 53131 - DNA, 75 bp, Artificial Sequence
  Synthetic
gttatctagaagttgtcggaaaaccacagactccagccgaaggcataatactaattttctcaaatagcattgtgg

SEQ ID NO: 53132 - DNA, 75 bp, Artificial Sequence
  Synthetic
cggcgtatgaggcggctggtcgcaacaacagaaaccaggtagcgaatttgtatcaacaattacaggcttggggtg

SEQ ID NO: 53133 - DNA, 75 bp, Artificial Sequence
  Synthetic
gtcgtgttttcattcgtgatcagttggttccgacgcgagcaaaccccggggattattggattcaggcggcttttc

SEQ ID NO: 53134 - DNA, 75 bp, Artificial Sequence
  Synthetic
ccggtaatgtttatcctcccggtttatgtgaggatttcaatattgatcctgatgcggggattttgcctctgagat

SEQ ID NO: 53135 - DNA, 75 bp, Artificial Sequence
  Synthetic
atcctgatactggtcaaggtgctaccgatgttgttctagctaacggtagattggggcacttaacctcatcgtggt

SEQ ID NO: 53136 - DNA, 75 bp, Artificial Sequence
  Synthetic
ttcagagtctgtattgtggggccgcaagaggttttatcctgaatgggtttggcagattgatttggccaatctatt

SEQ ID NO: 53137 - DNA, 75 bp, Artificial Sequence
  Synthetic
ttggccaatctattgtcggcatgtcgtagttctggcaaccaggccatgatcgcgtagtctccgcgagttgcagtc

SEQ ID NO: 53138 - DNA, 75 bp, Artificial Sequence
  Synthetic
gacattttgtccacatcacgaacatggcagctcgacttcctatcgacgccttcggcatgtcagtgattcaacaaa

SEQ ID NO: 53139 - DNA, 75 bp, Artificial Sequence
  Synthetic
atggtctcaaagtatacacaatcctaccaacaagcaacttgtccaatctgagtgatcaaatatctcaaaacaaac

SEQ ID NO: 53140 - DNA, 75 bp, Artificial Sequence
  Synthetic
tctatgctgtaagtgaacgacacgttcgtgaacttgatcaaagagataaaggaaaagtcaagaaaattaaattta

SEQ ID NO: 53141 - DNA, 75 bp, Artificial Sequence
  Synthetic
tagtcacatctaagtcggttgattatgaaaattggtttggcccagacacagacacagaaattatacagtatcttg

SEQ ID NO: 53142 - DNA, 75 bp, Artificial Sequence
  Synthetic
aagaaggaggtttgtaccatgcactttacaacgcctgcaaagaacagaaaagtactccatcttttgttgccagcc

SEQ ID NO: 53143 - DNA, 75 bp, Artificial Sequence
  Synthetic
cctcaaaccctgctcctgtgtcacttaagcaaaaagaaattttatcgaactggaagctgggcactatcgtggaat

SEQ ID NO: 53144 - DNA, 75 bp, Artificial Sequence
  Synthetic
tctgtcaagctgttggtttgaatcgaacacctgaggaaccatggcgtcagctagctcgatcctatggattgattt

SEQ ID NO: 53145 - DNA, 75 bp, Artificial Sequence
  Synthetic
tcattagtgaagttggtgcattggcatccactcatgttgcctctctagacgctgatttggcaaaattcgagcagc

SEQ ID NO: 53146 - DNA, 75 bp, Artificial Sequence
  Synthetic
gcgagcaacgttggatgaaaatggtcgactacaaggagtcttttgcacatcttggcactgatttcaacagatatg

SEQ ID NO: 53147 - DNA, 75 bp, Artificial Sequence
  Synthetic
ctttctgccctttgataccacctccttgtcctgaagattctgaagaagcgattttgattcatggctcgtgggtaa

SEQ ID NO: 53148 - DNA, 75 bp, Artificial Sequence
  Synthetic
gaagtgaagagcatgacggaggcttgtttgtgctattcaaacgtgtgacgattatggaccggcaccaagtgatgg

SEQ ID NO: 53149 - DNA, 75 bp, Artificial Sequence
  Synthetic
gagcgagagcgcctagcgaggatgaggaagagagctctgacccaacagaaggttcaatggatgaggtgacccacc

SEQ ID NO: 53150 - DNA, 75 bp, Artificial Sequence
  Synthetic
agactgaaaccttgtccctagactcgataccccctccagatttctctagggctccagtgattgtgactgggatga

SEQ ID NO: 53151 - DNA, 75 bp, Artificial Sequence
  Synthetic
cgagtgccaaagcatcaacatcgtatagtcgagatgagccacctgaggacgaaggaaaccgtgcaagtgctcgac

SEQ ID NO: 53152 - DNA, 75 bp, Artificial Sequence
  Synthetic
ccaaatctagtccatgtgatacgtgtactgacgactcgtctttgcttcagtccttgctcagtacagattgggtta

SEQ ID NO: 53153 - DNA, 75 bp, Artificial Sequence
  Synthetic
cttcggtcagtacacctcttcatggccctacactgcctatagatgcggcgaaggatttgtcagtagcttcagagt

SEQ ID NO: 53154 - DNA, 75 bp, Artificial Sequence
  Synthetic
cggaggacgaagtctcgatgtctcaaagtgatgcccctcccgaaacggcaatggatgtatccgccaatcataagc

SEQ ID NO: 53155 - DNA, 75 bp, Artificial Sequence
  Synthetic
cgaacaccgattctgcccattgtgccccctctcccttgcctcagcgtgcgcgaaagattagaccaacggaagcgc

SEQ ID NO: 53156 - DNA, 75 bp, Artificial Sequence
  Synthetic
ggcgtcgagcagagagagagaaaagaaaattgaagccttattatcggtctatggaagagtgttttgttccagcgt

SEQ ID NO: 53157 - DNA, 75 bp, Artificial Sequence
  Synthetic
gcgatattgaatcatatcgtactagtgtaattgttcaaccattgccgcagaatgttttgccgttccctggtactc

SEQ ID NO: 53158 - DNA, 75 bp, Artificial Sequence
  Synthetic
agttgacgcgagagactgttttacgcaaggcattggtacgagagtgtgagcgtgttgctcctagtcaggcgcctg

SEQ ID NO: 53159 - DNA, 75 bp, Artificial Sequence
  Synthetic
atccagaagagttgctagactcggatacagtaaagatttgtgagggcagagcgaaggtgatgtatgagtccattc

SEQ ID NO: 53160 - DNA, 75 bp, Artificial Sequence
  Synthetic
cttctcatcttcgtggagttgaaattgagtcagttgctcctgagtctaacgaggtctcagtcatctatcctcgac

SEQ ID NO: 53161 - DNA, 75 bp, Artificial Sequence
  Synthetic
ctcagatttctatgcctgataatttttcattgggtaacgaggaggagagaattcgcacatacgtaaggaaaagga

SEQ ID NO: 53162 - DNA, 75 bp, Artificial Sequence
  Synthetic
ctattatggagcgagaatctggaggttacgcgatgcttcgtcctggttatggagctgaggcattagagcatgcga

SEQ ID NO: 53163 - DNA, 75 bp, Artificial Sequence
  Synthetic
gatatgtctctgcagccggcgtaccgattcctgaactcagggggcaagttttgcgttctagagcttcgcgagaga

SEQ ID NO: 53164 - DNA, 75 bp, Artificial Sequence
  Synthetic
tgatgagtcagactgatttgcgtttgttagaactgatgatgcctgtagtgaatgtaccacctgaaggagttgata

SEQ ID NO: 53165 - DNA, 75 bp, Artificial Sequence
  Synthetic
aggacctgttggcggtgtacaaagcaacagtgatggatattttaaccggttaggcgtggatgagtggggctgcgc

SEQ ID NO: 53166 - DNA, 75 bp, Artificial Sequence
  Synthetic
tggatattttaaccggttaggcgtggatgagtggggctgcgcagtgtgtgacgagtgggtagaacggttgcagtc

SEQ ID NO: 53167 - DNA, 75 bp, Artificial Sequence
  Synthetic
gacattttgttcctgaccgcaacagccgtagtcgttaaggcagcaatgtccgcccgtaccaaagagaaaaccaaa

SEQ ID NO: 53168 - DNA, 75 bp, Artificial Sequence
  Synthetic
gacaaaactaaaaatgatgaacaaacagtctctaccgaagctagtgcagccgatcgtaatgatcgagaaaaatcg

SEQ ID NO: 53169 - DNA, 75 bp, Artificial Sequence
  Synthetic
tcgtcttctgaacctgaagacaatgcaaaggaaacacttacgaagaaagactcgtcatccaagaaatctgttgat

SEQ ID NO: 53170 - DNA, 75 bp, Artificial Sequence
  Synthetic
gtattggccgcaatgattgagcagaaagttcaaatgtctggaagcgctggtctgggtgagttttttggtcgtatg

SEQ ID NO: 53171 - DNA, 75 bp, Artificial Sequence
  Synthetic
agacccgaaattactgatgcattttttgcggcattagagcgagaggctgatgtgtccaaggtagttccaagctcg

SEQ ID NO: 53172 - DNA, 75 bp, Artificial Sequence
  Synthetic
ctttccaagctagatgatggacaagtggtggatttactgtctgtaggcgaggagcgtactttaagccaatcttta

SEQ ID NO: 53173 - DNA, 75 bp, Artificial Sequence
  Synthetic
ttccagttagaagtagttacatccattccccacttttaccagctcactgctaaacaaattggagcattgggagca

SEQ ID NO: 53174 - DNA, 75 bp, Artificial Sequence
  Synthetic
caaggtggatacctgaaagcttatcatggcgaacaagtgtacccgtttattgaccctgtggctaaccagtttggg

SEQ ID NO: 53175 - DNA, 75 bp, Artificial Sequence
  Synthetic
cgtggatttgatttggcatatgttcgcattaacacgtctggacaaggtgttgagttgtttattgatccttttgac

SEQ ID NO: 53176 - DNA, 75 bp, Artificial Sequence
  Synthetic
ttcgataaggtttcgtgtaaggtgggtggtgagtcgttgacgggcattggactctcgaacgctgttggtgttgat

SEQ ID NO: 53177 - DNA, 75 bp, Artificial Sequence
  Synthetic
gagattacttatgatgacgtgaagacgcctgaacaaatgatggagttcgtcgtactcctgattgctggagcagca

SEQ ID NO: 53178 - DNA, 75 bp, Artificial Sequence
  Synthetic
aagatgggacgtttttgttctagtggcgtcgacgccagaaggaggaggaaattgttcaaaacttgggtgcgccgt

SEQ ID NO: 53179 - DNA, 75 bp, Artificial Sequence
  Synthetic
cctgtatcggacaattttcgccacgttcagggttggctgctggaagatgattatgagaactatccgcacgttcct

SEQ ID NO: 53180 - DNA, 75 bp, Artificial Sequence
  Synthetic
gaggccctgactgtatttagtgaatatcaatggtttgcacgagaggttgccgataacatgacggataatggacta

SEQ ID NO: 53181 - DNA, 75 bp, Artificial Sequence
  Synthetic
ggtacatctgtgcagatggaggatgggccaaatattgagtcgttttttaatcggaagtatcgggaggcagcgatt

SEQ ID NO: 53182 - DNA, 75 bp, Artificial Sequence
  Synthetic
tgtaatttggattttattacagctgaggcgcatgcaaatgttatggaggagttgcaaaatgagaagatgaatgtc

SEQ ID NO: 53183 - DNA, 75 bp, Artificial Sequence
  Synthetic
agtgcttatgttgatcttttgcagtcatgtcaaatgggaatttttgacattgaaggtgatactgatactattaag

SEQ ID NO: 53184 - DNA, 75 bp, Artificial Sequence
  Synthetic
ctgaaagtgtatatgcgtgaagtggaggattatgaggcagagttaacgagaatgatgttgtttccgggtgaccag

SEQ ID NO: 53185 - DNA, 75 bp, Artificial Sequence
  Synthetic
ctttacgtcgactgtctccgtacagcggcattagtgtctcctaacattcggcaatttattctcagtgtcctgatt

SEQ ID NO: 53186 - DNA, 75 bp, Artificial Sequence
  Synthetic
caacaagcgacgtcgcgtgttggtctgattgagttgctccctgttgctgagatgactgcatctctgacttcacgt

SEQ ID NO: 53187 - DNA, 75 bp, Artificial Sequence
  Synthetic
gataacatttctgtctcccataacatggctttgactttggcaatcggtgagtggaaagaattgcttcgtctgacg

SEQ ID NO: 53188 - DNA, 75 bp, Artificial Sequence
  Synthetic
aatcctcagcagatctgtcagaaaattgtgtgtgacattatggcaccattcgttgatgggttgcgaatggaagat

SEQ ID NO: 53189 - DNA, 75 bp, Artificial Sequence
  Synthetic
tctttaggggttccgacacctagcaaactggttttttcgctgcttggtgcaaaggtcgcactgattctgactcca

SEQ ID NO: 53190 - DNA, 75 bp, Artificial Sequence
  Synthetic
aacctatatgattataacctgcatcttaaggctcatttggttactatgattctttcttgcttcttcccggatcag

SEQ ID NO: 53191 - DNA, 75 bp, Artificial Sequence
  Synthetic
tatggggcattgatagcttcccgtggatatggtcatgatgttaccggaaaccgaatcgacagcattcgagacggt

SEQ ID NO: 53192 - DNA, 75 bp, Artificial Sequence
  Synthetic
gagcgaacgaagaagaactgcagatttgcaacttacacagtgctcgatccgattcctaacggtcctccagatagg

SEQ ID NO: 53193 - DNA, 75 bp, Artificial Sequence
  Synthetic
acgagaagaaagtggttattgatgaagcgagttcaggagtggcttttgcggaatgatcttgttaggcgtcgtgag

SEQ ID NO: 53194 - DNA, 75 bp, Artificial Sequence
  Synthetic
atacgtgacatcatatatcgtccatatgccaatgtgttgcgtttgccgggacaaacatatttaccgaggcgacaa

SEQ ID NO: 53195 - DNA, 75 bp, Artificial Sequence
  Synthetic
gcggctggagcgcctttaccttgtgaagttttgttgaatgatgctatcgccatactggaggagtatcggaccgtg

SEQ ID NO: 53196 - DNA, 75 bp, Artificial Sequence
  Synthetic
ttccatcatcccaatgacaggaatcaaggacctcaggaccgtcatgcactgacgactctttctaatttgctccgc

SEQ ID NO: 53197 - DNA, 75 bp, Artificial Sequence
  Synthetic
tggtacacacgcgggtttgctgagtggtttcactgggtctatcgtcctttgtacttacagattgcattgcatcca

SEQ ID NO: 53198 - DNA, 75 bp, Artificial Sequence
  Synthetic
attatcttctggtctcatcgtctcggacagggagtatggaggcaatttccagctgtgcgagaggatcgtgagcgg

SEQ ID NO: 53199 - DNA, 75 bp, Artificial Sequence
  Synthetic
cggtttgataaccacttggagggtgtgcctttcgattcacctgttattgctgcgtttgagccagacgttgcgttg

SEQ ID NO: 53200 - DNA, 75 bp, Artificial Sequence
  Synthetic
aatccgtttactttacgtcaaggtgcggacttgcttggacgtgtgcatgcgcaggggtctacatttcggggtgga

SEQ ID NO: 53201 - DNA, 75 bp, Artificial Sequence
  Synthetic
gcatatgatagtgcgtcagtgattctcttgtcagaatatgaggctctttatcgaatgactgactccgaggggatg

SEQ ID NO: 53202 - DNA, 75 bp, Artificial Sequence
  Synthetic
gtggatgaatatattaagactttgatggcatctcgtcaactccttgagggactgagacttgtagccgaactttca

SEQ ID NO: 53203 - DNA, 75 bp, Artificial Sequence
  Synthetic
actggagagttgctgagggatactcccatactggactatatccggactgctttctgtgagggtcgttttccatcc

SEQ ID NO: 53204 - DNA, 75 bp, Artificial Sequence
  Synthetic
cacatattcttcaagattctcaatctgttcggggttaaaattaaccatggtgtgctggctcaggttggagagcgg

SEQ ID NO: 53205 - DNA, 75 bp, Artificial Sequence
  Synthetic
tcaattgaacatagactgcgaggtgactaccgtgtgtattaccctagacctgggtttttggaccctgctttggaa

SEQ ID NO: 53206 - DNA, 75 bp, Artificial Sequence
  Synthetic
tttattcctgacagaattgtggtggttgatcctgttcgaccgtccgtccgtcggaatgtcaagttgataatggat

SEQ ID NO: 53207 - DNA, 75 bp, Artificial Sequence
  Synthetic
gctgtatttgatcctgaattcgggatgatcaaaatgaggaaaggagtaactttctcgttgcggcccacaaatgac

SEQ ID NO: 53208 - DNA, 75 bp, Artificial Sequence
  Synthetic
ctaactttttcatcatttcatgagattcctcctattcaagtcgagatgactgggaatgtgaactacgtgtatgat

SEQ ID NO: 53209 - DNA, 75 bp, Artificial Sequence
  Synthetic
tctgaaactgcacgtactcgagcggagtatgatgtccaagtccgttgggaagcacctgggcggattattaccatg

SEQ ID NO: 53210 - DNA, 75 bp, Artificial Sequence
  Synthetic
aatctcttggttacaagcagttatgagattcttagtagtatggaggatattcttgggcgcgaagttcgtgcattt

SEQ ID NO: 53211 - DNA, 75 bp, Artificial Sequence
  Synthetic
tcctttgttgtacaggatgtttcaaagtttagtggcatttactatgatttcatgttgtctgctgtgcggaaagaa

SEQ ID NO: 53212 - DNA, 75 bp, Artificial Sequence
  Synthetic
catgctatcgtttggttcccaaacctgcgaggtatattgcaccatcatgctatttctattgaaaaggttgagacg

SEQ ID NO: 53213 - DNA, 75 bp, Artificial Sequence
  Synthetic
tgttttaaagcggcagagttggcgcaattttcttcgttcttaagtttgcgaccaactgctttaattaagcttaat

SEQ ID NO: 53214 - DNA, 75 bp, Artificial Sequence
  Synthetic
gtggttcaaacaaccaatattcgaggtgggatattgcccccatctgtctcgaagcctattctgccttgtgagggg

SEQ ID NO: 53215 - DNA, 75 bp, Artificial Sequence
  Synthetic
gttcatccttcttttatctttgctctgatgtcaatgtggcgacgcatcggattcgcgggactaccatccagataa

SEQ ID NO: 53216 - DNA, 75 bp, Artificial Sequence
  Synthetic
gaaagttttttccgcctttggtgaaggatgcaagtggtcgaccacgagtgactgatgaaaatggcgtagtagtga

SEQ ID NO: 53217 - DNA, 75 bp, Artificial Sequence
  Synthetic
atgggctggagaaccatccctacgggcttagatctcttgtttttgtgtatcattttgatcctaccttccgaccta

SEQ ID NO: 53218 - DNA, 75 bp, Artificial Sequence
  Synthetic
agatatgctcagtattacgttgacacagtctgtcaaagacggctgctggctgtccggtgagactcgggaatgaga

SEQ ID NO: 53219 - DNA, 75 bp, Artificial Sequence
  Synthetic
cagtattacgttgacacagtctgtcaaagacggctgctggctgtccggtgagactcgggaatgagagttgcagtc

SEQ ID NO: 53220 - DNA, 75 bp, Artificial Sequence
  Synthetic
gacattttgcgagatggcacgccgtccttcgaaagagtggagagagagattcaatgccttatccctgaaatgcaa

SEQ ID NO: 53221 - DNA, 75 bp, Artificial Sequence
  Synthetic
gcaactaatacattcatcaattacaaatgattttacaacaactgacaaagcacaacaaagtaccttttattcctc

SEQ ID NO: 53222 - DNA, 75 bp, Artificial Sequence
  Synthetic
ttctggtttaatggatgttcgtaagaggttatcgatctctgaaagtttggaagtgtttggtagcctgattgataa

SEQ ID NO: 53223 - DNA, 75 bp, Artificial Sequence
  Synthetic
ttgggatcttgttcagctagttggaactcgagcggagccttttgtgttgaataaccctgcttcttatttattggt

SEQ ID NO: 53224 - DNA, 75 bp, Artificial Sequence
  Synthetic
taatcaattattggccttagcgggacaagctcattctgcagcttctatggtgtttctaaattcgttgatgtatga

SEQ ID NO: 53225 - DNA, 75 bp, Artificial Sequence
  Synthetic
tgatgcacttgatcatgtgaatctatggccttatgaagttgagcgtccaatccctcagatcactagagaagtttt

SEQ ID NO: 53226 - DNA, 75 bp, Artificial Sequence
  Synthetic
gtcacccccacctttcagtgtcaattcatattacttgcagagagacatcgatgtcattaaggcgaagacaaaagc

SEQ ID NO: 53227 - DNA, 75 bp, Artificial Sequence
  Synthetic
cgcggtatatatcgagaattatcgagcaggcgacgtttttgcgaagaagcgaagtattagtaaaggagccacatt

SEQ ID NO: 53228 - DNA, 75 bp, Artificial Sequence
  Synthetic
tgaagagagagtctatcatggtgctgtgactatgttgcaacgaatggttaagctacgaggatctaccatccaaga

SEQ ID NO: 53229 - DNA, 75 bp, Artificial Sequence
  Synthetic
atgctttgtcatcgctatttcgtcctatcgatgttcagattgtgttcggcgaatgatggcatccgagtctggtac

SEQ ID NO: 53230 - DNA, 75 bp, Artificial Sequence
  Synthetic
tggcgcaatccatgaaatggatcatatttgcattatgcgatctaacgcacttagatggctgcaagctgcgtttag

SEQ ID NO: 53231 - DNA, 75 bp, Artificial Sequence
  Synthetic
tgactttccagaatttccgtttttaatgacgcgtgatggtgtaaagtttgcctcaaattgtggtgcagtaagtac

SEQ ID NO: 53232 - DNA, 75 bp, Artificial Sequence
  Synthetic
gcaggttcctttgctgtttttccaaacactagagatgatggtgttaactatggatgggacattaagctcaacatg

SEQ ID NO: 53233 - DNA, 75 bp, Artificial Sequence
  Synthetic
ggaaggatgggtgtgttgtgagtggtatgacagggcgagagttggtttgttttccgagatgtttgatcggcgggg

SEQ ID NO: 53234 - DNA, 75 bp, Artificial Sequence
  Synthetic
agttgtagcccatctgagagaagccattttgcgtcagagtcgattgcttcgatatcagagtcgcggcttgcattt

SEQ ID NO: 53235 - DNA, 75 bp, Artificial Sequence
  Synthetic
ggcttcggtgtctaattttcctaagagaagcgtgagcgctgatggtttggatgatcgaataattgagggtttgca

SEQ ID NO: 53236 - DNA, 75 bp, Artificial Sequence
  Synthetic
aaaattcaacagtaaggtgtgctcttttatccagtcatggattttccagattgatttggttgatgaacctgctag

SEQ ID NO: 53237 - DNA, 75 bp, Artificial Sequence
  Synthetic
gtggctagcggttatgataaaaacgtttgcaagtgcattgttatacgttatgggtgcaacatctctatctttgga

SEQ ID NO: 53238 - DNA, 75 bp, Artificial Sequence
  Synthetic
acaatcagcacaaggtactttaggtattggagatccaatatcgtttccaagacaagagattttgttagaagggga

SEQ ID NO: 53239 - DNA, 75 bp, Artificial Sequence
  Synthetic
atggattgcagtggactggtactatcctgacccagatttagcggacatgcgtgagatgggaatggcattagtgga

SEQ ID NO: 53240 - DNA, 75 bp, Artificial Sequence
  Synthetic
taacgcatctccagagtacacggactgggaatatgggttcttcaatgtgcagactactaatagtgcaggtaatgt

SEQ ID NO: 53241 - DNA, 75 bp, Artificial Sequence
  Synthetic
gaaagaggtaattgaagagcgaagaaagcagttggttgccgagtttggggatcaaggaaaattgctggcgaaagt

SEQ ID NO: 53242 - DNA, 75 bp, Artificial Sequence
  Synthetic
cgagaacacacgtatccttgatgctgttcaaaaaatcacttccacatttcagaatcctcaagatttctgtgattc

SEQ ID NO: 53243 - DNA, 75 bp, Artificial Sequence
  Synthetic
tgccgataatgtacgtaaagctggtgagaggcatcaagttggtcggcggcctagagtgatacagatggttggtac

SEQ ID NO: 53244 - DNA, 75 bp, Artificial Sequence
  Synthetic
tgagggtcaattgtccgcatttgtattgcacaatgtacttcgtcctgcctataaggctactaggtttactacgtc

SEQ ID NO: 53245 - DNA, 75 bp, Artificial Sequence
  Synthetic
aggcaagaattctggggatataagagatatgaacattgtgcttgaaatttcaggcgagcttggatataagtcttc

SEQ ID NO: 53246 - DNA, 75 bp, Artificial Sequence
  Synthetic
tctggatgtaaaaggtatggattcgtctacgaagccttttcagactaatttgtcacttagttgtgtgtttcatcg

SEQ ID NO: 53247 - DNA, 75 bp, Artificial Sequence
  Synthetic
tcttaggggagaggttctcggttatccagcgtttttcttgggatcgacgtcgtcttccaaagataattatgtagt

SEQ ID NO: 53248 - DNA, 75 bp, Artificial Sequence
  Synthetic
gacgagaacacggtatcgtgatgagcatggggggatcctcgttgaagaagagtataagttgacttatccgcagta

SEQ ID NO: 53249 - DNA, 75 bp, Artificial Sequence
  Synthetic
cgttttattgctgggagcgatacactggacgagtccaaccaggtttactgatggttactttcaggagttcgtcat

SEQ ID NO: 53250 - DNA, 75 bp, Artificial Sequence
  Synthetic
gacatctcgaactgtttttaggtcaggtttgttaaatactgcggatcagcatacgtttcttggcgtgattatgta

SEQ ID NO: 53251 - DNA, 75 bp, Artificial Sequence
  Synthetic
tgcccttttggagaaaagattgaggcaacgatggtatggcaagcatggtaaggagatgcgggaaaagattggcca

SEQ ID NO: 53252 - DNA, 75 bp, Artificial Sequence
  Synthetic
gcggagagaagcgcttgaagagtatgaggagcatgttaagttgctcggttctgtacttggtgatgatcaggttgc

SEQ ID NO: 53253 - DNA, 75 bp, Artificial Sequence
  Synthetic
tggagctttttgtcaaggaattgtagatgaagaagttattttaaggattacgagggatttgtgcgatgagacaaa

SEQ ID NO: 53254 - DNA, 75 bp, Artificial Sequence
  Synthetic
gtttttgatggaaaggttaggttatgagtgtgagccggagatatctgaatattctgctgagtttcttaaacagaa

SEQ ID NO: 53255 - DNA, 75 bp, Artificial Sequence
  Synthetic
gggagtgcttggagcgcctgaattgtttccagagcggctgcttttattttcgtcggaaagaggtgatatggctgg

SEQ ID NO: 53256 - DNA, 75 bp, Artificial Sequence
  Synthetic
gtcacttcctcttgatcgagttaaaatcatgttgagtatgacggatgagaagattggccgcgcgcgatgtccttt

SEQ ID NO: 53257 - DNA, 75 bp, Artificial Sequence
  Synthetic
gccttatgcgtcattaatgttgttcacatcctgggtgtcggggactgcttctttttcaattggtgaagaaggtcg

SEQ ID NO: 53258 - DNA, 75 bp, Artificial Sequence
  Synthetic
gctgttatatcggactggtagaaattggaagaaggtatttgcatctaaaagagccgcatccgttgcatggaagga

SEQ ID NO: 53259 - DNA, 75 bp, Artificial Sequence
  Synthetic
tcaattcacgtccgatggagtgtttgacgtccgatggaatggttttgggatgttctataaagagtgggcttctgc

SEQ ID NO: 53260 - DNA, 75 bp, Artificial Sequence
  Synthetic
aaataccaagacgatcttacttggatgcgggttattgtgggcttgcagtgacgcgcttggagttccgttccctcc

SEQ ID NO: 53261 - DNA, 75 bp, Artificial Sequence
  Synthetic
cctggtgcaaaaagatgagattctatgtccgggaacgtcggtatatacgattccttcgaacgcaatgacacacta

SEQ ID NO: 53262 - DNA, 75 bp, Artificial Sequence
  Synthetic
tctcctctgggcaacacgtagagatcgagcagacgcagaacgtatgtggcgggcagtccgagacgatttacttcg

SEQ ID NO: 53263 - DNA, 75 bp, Artificial Sequence
  Synthetic
tggtgacaatgatccattggaaagctacattgaatatgtagataagatgtttgccgaagtgggagttattgacat

SEQ ID NO: 53264 - DNA, 75 bp, Artificial Sequence
  Synthetic
tcctttttcagcgcttcatatttacggagttgggatgggattcgtcgctggagtaatgcctgtacctatggaagt

SEQ ID NO: 53265 - DNA, 75 bp, Artificial Sequence
  Synthetic
gtggtatgattttggcttgtttggaaaagtaggagggtttgggacgtggattgcagaacttgtttttaaggacat

SEQ ID NO: 53266 - DNA, 75 bp, Artificial Sequence
  Synthetic
ccggattgaccgtgagaaatacgatttacctcggctgtctatgtggaagaatgcggccaaccattcactgccgag

SEQ ID NO: 53267 - DNA, 75 bp, Artificial Sequence
  Synthetic
tgaggttcgtagggcgagtttgtatgcacgggatacgttgcatgaaaagtatggaatggtagtcccgtcagctgt

SEQ ID NO: 53268 - DNA, 75 bp, Artificial Sequence
  Synthetic
tctagttgctgaacgtccaggatgtaagatcgatcaggcgctgtttgaggtccgacgagtcgggatggaggatgt

SEQ ID NO: 53269 - DNA, 75 bp, Artificial Sequence
  Synthetic
tagagaacttgagaaagtgcttgatgagctaacacgcttgaaccacctggagcggaagtttactaagaggctggc

SEQ ID NO: 53270 - DNA, 75 bp, Artificial Sequence
  Synthetic
gatgggcttatttatcgttgagaaattgactgagcgtagaactgggtatggccctgcaatagcaagtaatggatg

SEQ ID NO: 53271 - DNA, 75 bp, Artificial Sequence
  Synthetic
ggggcatattgccgcgccatatagctttcaggcacgattgctagagtgtttggcgtttccaatgtacaatgggtt

SEQ ID NO: 53272 - DNA, 75 bp, Artificial Sequence
  Synthetic
caactacgaagcagtacgtgaaagagtgtttgttgatgggaagctcccgggtgaccctaaattgtatctaaagat

SEQ ID NO: 53273 - DNA, 75 bp, Artificial Sequence
  Synthetic
agggaggcaggcattatcctatagtgaagaggcgtataaccttgtatctgcttcaatggggttgtcaagcagaca

SEQ ID NO: 53274 - DNA, 75 bp, Artificial Sequence
  Synthetic
agctgcggacatgcgcgacatgatcttggagggaattaacgggctagaggaagcacgatttgccctaaatcctcg

SEQ ID NO: 53275 - DNA, 75 bp, Artificial Sequence
  Synthetic
taagacatttctgtttgatgtttcgcgcagaaagggtgcaggttttttccaaactcctcaccggcggaagactaa

SEQ ID NO: 53276 - DNA, 75 bp, Artificial Sequence
  Synthetic
tcaggcatattgtgagatgatgggtatggcgctactgttaatggaaccatggaaattcagtagtggagattggcg

SEQ ID NO: 53277 - DNA, 75 bp, Artificial Sequence
  Synthetic
aatgtctttctctcatcgcttgcgcgcaattcttgggaggaggtaggaatctgagctctccatcgctttgcagtc

SEQ ID NO: 53278 - DNA, 75 bp, Artificial Sequence
  Synthetic
cgcaccggggatcctaggcgacacgtgataatggatgaaaagatctcctctttgaaagattttgttagaaaacag

SEQ ID NO: 53279 - DNA, 75 bp, Artificial Sequence
  Synthetic
atacctgatagaccagagttcttctatcagaaagaagcacttttatctcaagtggaggtcagcctcatactcact

SEQ ID NO: 53280 - DNA, 75 bp, Artificial Sequence
  Synthetic
gagggtttcaaactgatgtcatgcctggttgaggtggaatcttgtgagaaaaattcctgtgtgcacaacagcgaa

SEQ ID NO: 53281 - DNA, 75 bp, Artificial Sequence
  Synthetic
cagaagtttgttgacaccattttggcagagaatggtatagtaggtccaacactgccaaaagtaatgccagatggt

SEQ ID NO: 53282 - DNA, 75 bp, Artificial Sequence
  Synthetic
tacaggtattttaacaaaactttgcttttgttggaggtctttgttagagtgaggcctgacgaattcgagaagaag

SEQ ID NO: 53283 - DNA, 75 bp, Artificial Sequence
  Synthetic
tggaagtctgatatgggaaagctgctaagcttaaaggatgatctgcttaggtgtggaatttcacttgtgccaatt

SEQ ID NO: 53284 - DNA, 75 bp, Artificial Sequence
  Synthetic
gttgacggcaggtgcagctacaacactagtataattccggagtgggcaacagagcggttcaggtggttacttatt

SEQ ID NO: 53285 - DNA, 75 bp, Artificial Sequence
  Synthetic
gagcttctgaaagagtccaaagaagccatggattttgaaattgaagaccaagaatatcagagactaatccacagt

SEQ ID NO: 53286 - DNA, 75 bp, Artificial Sequence
  Synthetic
ctgtccagaacatgcaatcaaagtctgggatttgaaaatatcgaacagttaaaaaaggttcatctcaattatgaa

SEQ ID NO: 53287 - DNA, 75 bp, Artificial Sequence
  Synthetic
gatagactcaatgaagtcatacttgcaggtctcaactcagatcttaaagaatctgtgataagagaagaactaatt

SEQ ID NO: 53288 - DNA, 75 bp, Artificial Sequence
  Synthetic
aaactgaaagcctggtataaaaaagaggtgtttgaaaagggacatgggaactttgtgagaactaatcagacttct

SEQ ID NO: 53289 - DNA, 75 bp, Artificial Sequence
  Synthetic
ttattaaagactctacaggagataggatcacatgctggcacaactgtgcctgaatgccctatgtgttgtagtaaa

SEQ ID NO: 53290 - DNA, 75 bp, Artificial Sequence
  Synthetic
gtttttgatttatgctatcaaatgatgctgaagattgaaggaaaggagtctctaaatagtagtgtgtcttcagac

SEQ ID NO: 53291 - DNA, 75 bp, Artificial Sequence
  Synthetic
aacaacaatcctcagatttctttggttgggagggaatatttatatgttctctcagtctgcaacaagatcaaaggg

SEQ ID NO: 53292 - DNA, 75 bp, Artificial Sequence
  Synthetic
aagaaaattttcaacacgagaagaaatactttactattcttagacttaattatacttaattttgtcaccgaagtt

SEQ ID NO: 53293 - DNA, 75 bp, Artificial Sequence
  Synthetic
ttcaaaaaagtgccgttggggatacaatctttgaaggttgaaggattgataattggccaaatgttgttgttaacc

SEQ ID NO: 53294 - DNA, 75 bp, Artificial Sequence
  Synthetic
aatgatagggcacttgacatcctctcagctagaagattgctcataaagaaaattgaatgtaatgaaagttgggtt

SEQ ID NO: 53295 - DNA, 75 bp, Artificial Sequence
  Synthetic
aaaaaatgcggagacactctgagaagagtggagccctctttttggaccagtgtgtgcaattatgtaaaattgcca

SEQ ID NO: 53296 - DNA, 75 bp, Artificial Sequence
  Synthetic
gattttgaatccctacttctattggcggaggttctatgctcagatgcacctttactgaggtatgagcctgtgcaa

SEQ ID NO: 53297 - DNA, 75 bp, Artificial Sequence
  Synthetic
gtggaagaaagccattgcacacacaaggactttcagttgctaaacattaatcaacaggactgtctttttgaatgc

SEQ ID NO: 53298 - DNA, 75 bp, Artificial Sequence
  Synthetic
ctatcacatatatctctctcattaatcaactcaatgaagacttccttctcatcaagacttctaattaacgaaaaa

SEQ ID NO: 53299 - DNA, 75 bp, Artificial Sequence
  Synthetic
gattacaaaagatattttggaaccgtaaggctaaaagaatgttatgtgcaaagattcctattcacagaggggaag

SEQ ID NO: 53300 - DNA, 75 bp, Artificial Sequence
  Synthetic
tgtggtttcctgttctatcagaaaaccggagaaaggtcaaggtgcttttcaatttatttatctgaaaacggacag

SEQ ID NO: 53301 - DNA, 75 bp, Artificial Sequence
  Synthetic
ctcacagagttaggctcattctatgctgaccccaagaggtattttctaccaatattttctgggtgtgtgttacga

SEQ ID NO: 53302 - DNA, 75 bp, Artificial Sequence
  Synthetic
tctatgtgttcagagatgatcacatggttagattttgatgaggaactaatgcatgttgtcaaacctcagctaagg

SEQ ID NO: 53303 - DNA, 75 bp, Artificial Sequence
  Synthetic
tccttggtactaagtattctctgttcacccacaaaaagggctcagaattttttgcagggtcttagatattttatc

SEQ ID NO: 53304 - DNA, 75 bp, Artificial Sequence
  Synthetic
atggcatttgtgaaccaagctcatcataagcaattgatgtctaaattaattgtagaatgtaaatcagcttctgat

SEQ ID NO: 53305 - DNA, 75 bp, Artificial Sequence
  Synthetic
gtcttgatccagaggttagctaccaaagtcttttatacaatattgaccttcggggaggatcctgggatccacatg

SEQ ID NO: 53306 - DNA, 75 bp, Artificial Sequence
  Synthetic
acaaggaagttcaaatttcttttgaatgtcagttatttatgccatttgattacaaaagaaacccctgacagactc

SEQ ID NO: 53307 - DNA, 75 bp, Artificial Sequence
  Synthetic
actgatcaaataaaatgttttgagaagtttttggaaccgaagttagagtttggcagtgttgttgtcaacccgtca

SEQ ID NO: 53308 - DNA, 75 bp, Artificial Sequence
  Synthetic
ctcaatggaatcctggatccaaaacaagaagataacatgctcaatgggttggaaaaacttttctccaaaagtctc

SEQ ID NO: 53309 - DNA, 75 bp, Artificial Sequence
  Synthetic
tatgatgttgaagacctgaagaggccaggtatatccaaagatgtcctaaattattgtttatcgcttttcacccga

SEQ ID NO: 53310 - DNA, 75 bp, Artificial Sequence
  Synthetic
ggcaaactgaaagtgacaggtgtcttaaagacagatccattcaagcccagtttcacaagtacagcgttggactta

SEQ ID NO: 53311 - DNA, 75 bp, Artificial Sequence
  Synthetic
tcaagcaacaaaagtgttgttgtcccaaaattagacgaattgggcaacattgtgtctgtttatgacaagcaaaaa

SEQ ID NO: 53312 - DNA, 75 bp, Artificial Sequence
  Synthetic
ctcatttcctcctgtgtagcctccatggcagaaaggttcagaactaaaggaaggttcaatttggaccctgacaca

SEQ ID NO: 53313 - DNA, 75 bp, Artificial Sequence
  Synthetic
attgacttcctaattatgaagaacttaaccaacttgctctcaattagtggtgagagtccaaaggcatcagaagaa

SEQ ID NO: 53314 - DNA, 75 bp, Artificial Sequence
  Synthetic
ctttcattgctttatgagaacctacctgaagaaatcacccaagtctatgatgaaatcaagaatgacattcaggta

SEQ ID NO: 53315 - DNA, 75 bp, Artificial Sequence
  Synthetic
accttggggaaaatcggagctaaggggagctacaaacaaaagaatgggaaagagggaaaagctggatcccccagc

SEQ ID NO: 53316 - DNA, 75 bp, Artificial Sequence
  Synthetic
aatgctgagactcttgagtcaatttgggcaccttttggagtgcttagagagatcaagattgaaacatcaacccat

SEQ ID NO: 53317 - DNA, 75 bp, Artificial Sequence
  Synthetic
gaaatcaaggactttgatcctggtctgctgtccatggatatttatgaaaagctgtgtacaacagtttttgagtct

SEQ ID NO: 53318 - DNA, 75 bp, Artificial Sequence
  Synthetic
tccttaaaatccagtttttttatagatgaggtcttaagtatatgcccactcgaattattattaaagaacctgact

SEQ ID NO: 53319 - DNA, 75 bp, Artificial Sequence
  Synthetic
acaaagtcattcaaggaaaacgacttttttgagtgcttcaaatacattttaatacaagcaggttatgaccagagg

SEQ ID NO: 53320 - DNA, 75 bp, Artificial Sequence
  Synthetic
ctgggtacctatgagcacagaagtagggccagatttggatttagagaagaggtggtaaggttgagagatgatgtt

SEQ ID NO: 53321 - DNA, 75 bp, Artificial Sequence
  Synthetic
agggtgagtgatagagaaagcaattctgaagccattgccaagcgacttgatagaagtttttttacaagtgctgct

SEQ ID NO: 53322 - DNA, 75 bp, Artificial Sequence
  Synthetic
ttgagaaatctttgcttttattcagaagaatcacctactgagtatacatgtgtgagttctaatacaggcaacatg

SEQ ID NO: 53323 - DNA, 75 bp, Artificial Sequence
  Synthetic
aaatttgggctcagttataaagagcaggtagggtctaacagagaactgtatgttggtgatttgaatacaaaaatg

SEQ ID NO: 53324 - DNA, 75 bp, Artificial Sequence
  Synthetic
atgactaggctagttgaggattttgctgaggctgtgtgcaattctatgcattacacgtgtctcaattcagagtca

SEQ ID NO: 53325 - DNA, 75 bp, Artificial Sequence
  Synthetic
gaatttgatagggcaatatgtgacatgaagatggcagtgaacaatggtgacctatgcctctcaatggatcattca

SEQ ID NO: 53326 - DNA, 75 bp, Artificial Sequence
  Synthetic
aaatgggggcctttcatgagccccgcacttttccacagatttttaagtggggccaaactgaaaaccatgagactt

SEQ ID NO: 53327 - DNA, 75 bp, Artificial Sequence
  Synthetic
ggggacagtgtggatactaagcctgtattgaatgttttgaaatggcacatccataaggttgttgaagtgccttac

SEQ ID NO: 53328 - DNA, 75 bp, Artificial Sequence
  Synthetic
aatgtagctgaagcttactgcactgggatgttgaaaagaagattgggtttaatgagtctccaaactcaaagtatt

SEQ ID NO: 53329 - DNA, 75 bp, Artificial Sequence
  Synthetic
agtgaggcattctttcatcaagaaatccagacaaaaaaagaagttcccagtcacataatgtcagtactagatatg

SEQ ID NO: 53330 - DNA, 75 bp, Artificial Sequence
  Synthetic
ggacaagggatactccataatttatctgacttatatggcttgattagtgaacagttcttgaattactgtttagac

SEQ ID NO: 53331 - DNA, 75 bp, Artificial Sequence
  Synthetic
ttcctctatgatgctatcccaacatcctacacctcaagtgatgatcaaataacaatgataaggatgcctcagcaa

SEQ ID NO: 53332 - DNA, 75 bp, Artificial Sequence
  Synthetic
tctatggagactgcagaagaaggaaacgcagattggctggagttgttatgtttccatgatttcctatcatctaaa

SEQ ID NO: 53333 - DNA, 75 bp, Artificial Sequence
  Synthetic
ctcaataagtttgtaagccccaagactgtgtgtggaacttttgctgctgagtttaaatccaggttctttgtaatg

SEQ ID NO: 53334 - DNA, 75 bp, Artificial Sequence
  Synthetic
ggtgaagaaacaccacttttgacaaagtttgtgtctgcagcacttcataatgtgaagtgtaaaaccccttcccag

SEQ ID NO: 53335 - DNA, 75 bp, Artificial Sequence
  Synthetic
ctagctgaaaccattgacacaatttgtgatcaatgtgttgcaaatggggttggggtgagtattgtgtctgagatc

SEQ ID NO: 53336 - DNA, 75 bp, Artificial Sequence
  Synthetic
tcaaaaagagtcaaccgtctgattaagtattccgggtaccccttgaacccctttctcgctgtggaaaaccaggat

SEQ ID NO: 53337 - DNA, 75 bp, Artificial Sequence
  Synthetic
gtgaaggattgggtggatggatctagagggtaccgtttgcaaaggaacattgagagctgttccattcaggaatca

SEQ ID NO: 53338 - DNA, 75 bp, Artificial Sequence
  Synthetic
gtactcaaacaggtgagaaaattcgcaaaggatgtgttcctgaaaataaaaagaggacaggtttttgaggaacac

SEQ ID NO: 53339 - DNA, 75 bp, Artificial Sequence
  Synthetic
ctaatacagttaattggtgctgatggtgacagtgccatggagggtttcttatcttatgttgactgtgacaaggac

SEQ ID NO: 53340 - DNA, 75 bp, Artificial Sequence
  Synthetic
aaacttagagagatactcgagcaccgttggttgaatctctcagccaatggagatttgagactcgttttgagaaca

SEQ ID NO: 53341 - DNA, 75 bp, Artificial Sequence
  Synthetic
aagttgatgtctagcaaaagagtattagaaaaagaacaaatcccaacattggtgaaaacacttcaatcaaagctt

SEQ ID NO: 53342 - DNA, 75 bp, Artificial Sequence
  Synthetic
tccaaaagctttacgaagggtgctaaaaagatattggctgaatcaataaacaaatcagccttccaggcatcagtc

SEQ ID NO: 53343 - DNA, 75 bp, Artificial Sequence
  Synthetic
gcttcaggattcattgggttctgtgagagtgtcggaagcaagtgtgttagagatggcagtggaggattcttatac

SEQ ID NO: 53344 - DNA, 75 bp, Artificial Sequence
  Synthetic
attagagaggtggtgagtaaaataattagctgccagtgcaccttatgttcagcaaacccaggaatcatcttttgc

SEQ ID NO: 53345 - DNA, 75 bp, Artificial Sequence
  Synthetic
aaaaatgcattgtctaatgtgtccaatttttcaagaccaatcttgtgggattacttctctcttgttttaacaaat

SEQ ID NO: 53346 - DNA, 75 bp, Artificial Sequence
  Synthetic
gcttgtgaactaggggagtgggtgttttctcctaccaaaaggcctcaacagccaaatttactacaaaaccctaac

SEQ ID NO: 53347 - DNA, 75 bp, Artificial Sequence
  Synthetic
ctcttttgggctgtgaaacccaagagtgtccgccttatagaagatcagttaggcttaggacatgtattgcagtcg

SEQ ID NO: 53348 - DNA, 75 bp, Artificial Sequence
  Synthetic
ataaggagaagttatcccaaaatttttgaagaacacctgattccgtttatgagtgacctacaggtgaataggaca

SEQ ID NO: 53349 - DNA, 75 bp, Artificial Sequence
  Synthetic
attgattttactagattgaagtatctggatgtatgtgtggctatcgacatgatgaatgaaaatttggggattgtg

SEQ ID NO: 53350 - DNA, 75 bp, Artificial Sequence
  Synthetic
tcacacctgctgaaaagaaaagataattcagtttatattgtcaaacagaatgagtgttccgttgcacatgtgaga

SEQ ID NO: 53351 - DNA, 75 bp, Artificial Sequence
  Synthetic
gaggtgcaatatgttgaccatgacattggcctaagccctcaacaggtttgcactaattttaagctccagttagtg

SEQ ID NO: 53352 - DNA, 75 bp, Artificial Sequence
  Synthetic
ttatcctctatgataagtccccttgtaataagcacctcagttctaaaaagcttcttttggtataatgaagttcta

SEQ ID NO: 53353 - DNA, 75 bp, Artificial Sequence
  Synthetic
aagttagaggataacagtttgattgacattggtgaactcacagactttgttatcttgaacaaaagctatggtgtg

SEQ ID NO: 53354 - DNA, 75 bp, Artificial Sequence
  Synthetic
gagagggtcatgtatctggaagacatggcaatgggatatgttgtctctagtgttgatgagcctgagattcacttg

SEQ ID NO: 53355 - DNA, 75 bp, Artificial Sequence
  Synthetic
attaatgcttgggtcctcactgaacatgatgtcaaaaagctagaatcaggctccaaggtaggggacaaagatggc

SEQ ID NO: 53356 - DNA, 75 bp, Artificial Sequence
  Synthetic
aaggcactggccatcactctcaacattcagtttagacataggaggcactcaacaaagtatcattttaccaaaggt

SEQ ID NO: 53357 - DNA, 75 bp, Artificial Sequence
  Synthetic
gttgtatattcattcacagtggagttccaggttcctccctcacttcagggtccaaatctgaacactgtgcctgtg

SEQ ID NO: 53358 - DNA, 75 bp, Artificial Sequence
  Synthetic
agggagatggtgttgaacgcatcagggatgttgggggaccaccagtctctggatggggttcctctggttgcgtct

SEQ ID NO: 53359 - DNA, 75 bp, Artificial Sequence
  Synthetic
caccctcttatgaccgggaaaaaacctattgatttgctaaccttattgtcagagagtgatattcaaatctctgac

SEQ ID NO: 53360 - DNA, 75 bp, Artificial Sequence
  Synthetic
gacacaggtcaactgatggctgtgtacttggatttcagtgaatttcaatcactgattgaggacaagtattctttt

SEQ ID NO: 53361 - DNA, 75 bp, Artificial Sequence
  Synthetic
aaaattgtggggcctgagagattggacactccaattatactaaagggaggggtttatatgtctgaaggtaagagg

SEQ ID NO: 53362 - DNA, 75 bp, Artificial Sequence
  Synthetic
ctatcaaccttaatggttgaactttcaggtaatgtgattgtcaaagcattgggtgctatagaaacagacaaagag

SEQ ID NO: 53363 - DNA, 75 bp, Artificial Sequence
  Synthetic
gttgggagtctgctgctcggcctatggccctacatcaaaaccactggtcagaagatcaaaatggatcaaaatgac

SEQ ID NO: 53364 - DNA, 75 bp, Artificial Sequence
  Synthetic
tttctgcttttgtatgagtcacatagggaacttcttcttaaatcacttgagggattgggtgggtggctagatttc

SEQ ID NO: 53365 - DNA, 75 bp, Artificial Sequence
  Synthetic
ttggatttcagtgtgtgtttcagcaagagtctctcagatctggttatatctgacaacactggcagtctgagactg

SEQ ID NO: 53366 - DNA, 75 bp, Artificial Sequence
  Synthetic
aagggtgtcacttgcagacccatccacaacccgaggattgtggaggacatcgactaacatgacagccgccaccga

SEQ ID NO: 53367 - DNA, 75 bp, Artificial Sequence
  Synthetic
cggaggcccgggggacccacggggacccccccggaccgggggggccccgggccgctggcgctgtggcggaactta

SEQ ID NO: 53368 - DNA, 75 bp, Artificial Sequence
  Synthetic
ttcggagggagcggttggctccgttggcaccgagatgcgagttggtaggggcttccagcagatgttgcagagatt

SEQ ID NO: 53369 - DNA, 75 bp, Artificial Sequence
  Synthetic
ggaagtccttagcatcacatttaagcacctcaagcagagataatggtcagagcaattgataagatttctatctgc

SEQ ID NO: 53370 - DNA, 75 bp, Artificial Sequence
  Synthetic
aaaccaacagcatttacagttgtatctaccgtagagactgttcaccgcagctcttctaaattcagcttcagttgg

SEQ ID NO: 53371 - DNA, 75 bp, Artificial Sequence
  Synthetic
ctcaggagtctgggtgttagggcagattggatgtgattcttgctttgacctacagttgcccatgttggcggtcta

SEQ ID NO: 53372 - DNA, 75 bp, Artificial Sequence
  Synthetic
tgcccatgttggcggtctatgataaaagaggtggaatagtatgtagtgctagttacgcctaggatccccggtgcg

SEQ ID NO: 53373 - DNA, 75 bp, Artificial Sequence
  Synthetic
cgcacagtggatcctaggcgacattgacgacgcattgcttggagattcttaacaatgggccagttagtgagcttc

SEQ ID NO: 53374 - DNA, 75 bp, Artificial Sequence
  Synthetic
tttcaggagataccagtgttctttcaggaagctctgaatatagccttggctgttgtcaccctactggccatcgtc

SEQ ID NO: 53375 - DNA, 75 bp, Artificial Sequence
  Synthetic
aagggggttctgaatctctggaaatcaggtctcttccagctgttgatgtttttaatcttggcaggaaggtcatgc

SEQ ID NO: 53376 - DNA, 75 bp, Artificial Sequence
  Synthetic
tcttttagaattgggtatcacaccagctttgagtctttcaccatgaccattgggggtgttttccatgagttaccc

SEQ ID NO: 53377 - DNA, 75 bp, Artificial Sequence
  Synthetic
gctctgtgcaaggtgaatgacacctataacttggttaggctctctcataatagcagtttggcactctcagttgag

SEQ ID NO: 53378 - DNA, 75 bp, Artificial Sequence
  Synthetic
tacggcgacactggcacagttatgtgtgaacatgggcatgtggttagtggaaactacaccgaatgcactggagct

SEQ ID NO: 53379 - DNA, 75 bp, Artificial Sequence
  Synthetic
tccgaggaatacaactgggttcttgactgggtcctgagaggtctacaacatgattttagcagagatccggtaatc

SEQ ID NO: 53380 - DNA, 75 bp, Artificial Sequence
  Synthetic
tgttgcgagccaaagaagaaaacaaatgctgagtttcagtttcgattaaacctgacgcagcgtcataagggtgac

SEQ ID NO: 53381 - DNA, 75 bp, Artificial Sequence
  Synthetic
cattatcagaacaaaattaagacagcgttgacccatctatttggcccatttgcatacaatgagaaagacccgaag

SEQ ID NO: 53382 - DNA, 75 bp, Artificial Sequence
  Synthetic
atattcgttaccatgaggaataccacatggacgaatcagtgtgtcatgagtcatactgactcattaaggttgcta

SEQ ID NO: 53383 - DNA, 75 bp, Artificial Sequence
  Synthetic
gccagtaatgggggcaattcattctcagggagaggactcaaagccttcttcagttggtctttgtcagattcaaca

SEQ ID NO: 53384 - DNA, 75 bp, Artificial Sequence
  Synthetic
ggtgttgacatgccaggtggttattgtctagaaaagtggatgttgattgcttctgaattgaagtgttttgggaac

SEQ ID NO: 53385 - DNA, 75 bp, Artificial Sequence
  Synthetic
acagcattggctaaatgcaatttgaagcatgattcagaattctgtgatatgatcaaactctttgatttcaacaaa

SEQ ID NO: 53386 - DNA, 75 bp, Artificial Sequence
  Synthetic
aatgcaatcagtaaacttaataataacacaattgaggctgtcaatcagttgacaaaaacagtcaacagcctcatc

SEQ ID NO: 53387 - DNA, 75 bp, Artificial Sequence
  Synthetic
tctgataatctactgatgaagaatagattaagggagcttttgaaagttccttactgcaactatactagattctgg

SEQ ID NO: 53388 - DNA, 75 bp, Artificial Sequence
  Synthetic
tatgtaaaccacacaagaactggagaacattcccttccaaagtgctggttggtcaacaacggaagctaccttaat

SEQ ID NO: 53389 - DNA, 75 bp, Artificial Sequence
  Synthetic
gaaagtgattttagaaatgagtggattttggaaagtgaccaccttatttcggaaatgttgagcaaggaatatcaa

SEQ ID NO: 53390 - DNA, 75 bp, Artificial Sequence
  Synthetic
gagagacaggggaggaccccactgacacttgtggacctctgtttctggagtgccgtcttctacacgactacactc

SEQ ID NO: 53391 - DNA, 75 bp, Artificial Sequence
  Synthetic
ttcctccatctagtgggtttcccaacccacagacacatctcaggtgagccttgtccactcccccacagactcaac

SEQ ID NO: 53392 - DNA, 75 bp, Artificial Sequence
  Synthetic
aggcatggtgcctgtaactgcgggcgcttcaagagactaaaaaagcctttagtttggtataaacatcattgaatc

SEQ ID NO: 53393 - DNA, 75 bp, Artificial Sequence
  Synthetic
tctatccccaaatctcaccggcccgggctttgcccgggtcggtggggcgcctcccagcccgcggcagagccgcgg

SEQ ID NO: 53394 - DNA, 75 bp, Artificial Sequence
  Synthetic
gctgggagggcatacgcctacatcacgaatgctggtttggcctgatgcaccaggttgtcggggagtagtggctta

SEQ ID NO: 53395 - DNA, 75 bp, Artificial Sequence
  Synthetic
aggctggtgtctggaagatgaccatctagcactgattggaacatgatgcaatccagaagagcacagtgaggctct

SEQ ID NO: 53396 - DNA, 75 bp, Artificial Sequence
  Synthetic
ttttgaatgttggattccttattctttttcttagggacaatgaccccattgtgagctctgcataaggagttgtat

SEQ ID NO: 53397 - DNA, 75 bp, Artificial Sequence
  Synthetic
ctttcccacacttgttgttcaaaaattcttgactgctcatttgtgagcctcacatccacaagtttaatgtctttc

SEQ ID NO: 53398 - DNA, 75 bp, Artificial Sequence
  Synthetic
cttccatggacatccaagagttttcttatgtcatctgcaccctgcgtcgtgatgacaatgttctgagggagtaaa

SEQ ID NO: 53399 - DNA, 75 bp, Artificial Sequence
  Synthetic
cccaagatgtagctcaagagaccaggttgagcgtcctcaagatcctttagtagaataccgtgagaatgtctgcta

SEQ ID NO: 53400 - DNA, 75 bp, Artificial Sequence
  Synthetic
ccatttttgaaccccttttcatcatgaggtttcctgaaacagtggaaatagtagccacttgtaggttggaaaaca

SEQ ID NO: 53401 - DNA, 75 bp, Artificial Sequence
  Synthetic
gctagctctactgggtctgtaggtggaccttcaatgtccatccagatggtgtttgtcggatcaagtttttgcatg

SEQ ID NO: 53402 - DNA, 75 bp, Artificial Sequence
  Synthetic
gcctctttgatgactgcttcttgcatttcagtgaggttgctaagtcttaaattttgcccatttttctcaggcgcc

SEQ ID NO: 53403 - DNA, 75 bp, Artificial Sequence
  Synthetic
ctgggcccagggtccggcttggggttaaggtcaacactggtgttatcccatgacctaccgttgatttgtgacctt

SEQ ID NO: 53404 - DNA, 75 bp, Artificial Sequence
  Synthetic
gaacctatgtagggccaaccttctccggagagacaaactttgtaaaggagattctcataaggatttctgtttcca

SEQ ID NO: 53405 - DNA, 75 bp, Artificial Sequence
  Synthetic
ggtctttcgtcgacaaacatgttctcttttcttttggcagtcaaagtggcctttattatggaggagaagttattg

SEQ ID NO: 53406 - DNA, 75 bp, Artificial Sequence
  Synthetic
ggtgtgactcttatagtctccagcatatttcctccatcaataagtgaggctcctgctttcacagctgcagatagg

SEQ ID NO: 53407 - DNA, 75 bp, Artificial Sequence
  Synthetic
ctaaagttgtagcctgagatgttcactgcactttcatcccttgtaattatttggaggcagtcgtgctcctgtgtc

SEQ ID NO: 53408 - DNA, 75 bp, Artificial Sequence
  Synthetic
agtttttccaaatcctccaaattcgggtatttgactgtgtataaaagcccaagggatgttaaagcttgcaccaca

SEQ ID NO: 53409 - DNA, 75 bp, Artificial Sequence
  Synthetic
ttattcatggtttcacctccttgaactgtcatacaggctattgtaagtgctggcattgacccaaactgattgttt

SEQ ID NO: 53410 - DNA, 75 bp, Artificial Sequence
  Synthetic
agtttagctgggttggagacatcccagagtctaacaactcctctactgaccccagtctgctgctggaaccccagg

SEQ ID NO: 53411 - DNA, 75 bp, Artificial Sequence
  Synthetic
acccttaaaatttgtgtcctcttgtctagttgtgactgtgtaaggtttcccatgtaggggcgaggaccatccctg

SEQ ID NO: 53412 - DNA, 75 bp, Artificial Sequence
  Synthetic
ccactgtcaccaattttccgcttcaatttttccagatctgttgctagatccatgagctcgtctttccccaggtct

SEQ ID NO: 53413 - DNA, 75 bp, Artificial Sequence
  Synthetic
ccaagtttaagaattgtgtttttttgcacactcttcataaccataagtttgtccacctcttgatttagatccctt

SEQ ID NO: 53414 - DNA, 75 bp, Artificial Sequence
  Synthetic
agtttgtctagatcagcatcgctcctcttagctttccggaggactctttgtacctgagacacctgattgaagtcc

SEQ ID NO: 53415 - DNA, 75 bp, Artificial Sequence
  Synthetic
aggctatcagctatcattttagcatcctttaagacgagtgtcttggtttgctgtgtgtagctactcagttctctt

SEQ ID NO: 53416 - DNA, 75 bp, Artificial Sequence
  Synthetic
ctcagagattgagtccagcgaaagctgggaacctctttggagagagacattttgtgaaaggtttccgcctcaagt

SEQ ID NO: 53417 - DNA, 75 bp, Artificial Sequence
  Synthetic
ctctttggagagagacattttgtgaaaggtttccgcctcaagtgaaagacaaaaatgcctaggatccactgtgcg

SEQ ID NO: 53418 - DNA, 75 bp, Artificial Sequence
  Synthetic
gaaaagtttttaaaaacttcggcttggttacaccgcagattggttacacctacacaaggcttgagttgtttataa

SEQ ID NO: 53419 - DNA, 75 bp, Artificial Sequence
  Synthetic
atatcgtggtcagtccaccaacacgctgaatggatgacgacacaggacatgctagaagtgtggaacaccgtgtgg

SEQ ID NO: 53420 - DNA, 75 bp, Artificial Sequence
  Synthetic
tagtcgtttttctcgcagaaatgggaaaggacgacggtaagaggaagaaggggccaggctcctctggatggttgc

SEQ ID NO: 53421 - DNA, 75 bp, Artificial Sequence
  Synthetic
taccaccggagcgcgctggcttaggaaggaaggaggagaaaaagaagaaggagaagaggaatgtgcggagcacat

SEQ ID NO: 53422 - DNA, 75 bp, Artificial Sequence
  Synthetic
aaggaaggaggagaaaaagaagaaggagaagaggaatgtgcggagcacatcccagctggtctccggcggtgcgca

SEQ ID NO: 53423 - DNA, 75 bp, Artificial Sequence
  Synthetic
gtcgaagaatatcgtggccacagttagcacaactcgacgaatcatcgagcaagaagctggaagtcagaagttcac

SEQ ID NO: 53424 - DNA, 75 bp, Artificial Sequence
  Synthetic
aagaagctggaagtcagaagttcacggaagggttgcggatacttgggcgataccgagctccaaccgacgacgtgt

SEQ ID NO: 53425 - DNA, 75 bp, Artificial Sequence
  Synthetic
gcatcgtcgcggaggcggaacaggtcctagggccggaggtctactaggacgtttgggaattggttggggatcgat

SEQ ID NO: 53426 - DNA, 75 bp, Artificial Sequence
  Synthetic
tctccaagaggacattgtgcaggcactcatgcacctagtgctggtgctgcacactgttttcaccgcaattgaccg

SEQ ID NO: 53427 - DNA, 75 bp, Artificial Sequence
  Synthetic
gtaaggaaggacaaggctgtccttgagtactaacgacactccggccccagttcccagagccagggttttagctcc

SEQ ID NO: 53428 - DNA, 75 bp, Artificial Sequence
  Synthetic
gtgactgcccttgaggctaaacgctctgcgaagaacgctgtacgaattgcattcatgctcactggcgtgatgatg

SEQ ID NO: 53429 - DNA, 75 bp, Artificial Sequence
  Synthetic
ttcccagagccagggttttagctccacggtgctggaagtcaccctcgcagccatggctgcacgacgcgcgcaagg

SEQ ID NO: 53430 - DNA, 75 bp, Artificial Sequence
  Synthetic
gtacaactcgacgaatcatcgagcaagaagctggaagtcagaagttcacggaagggttgcggatacttgggcgat

SEQ ID NO: 53431 - DNA, 75 bp, Artificial Sequence
  Synthetic
gtgctgggcgccgttgtcattgacatgcaggtatccacgttgaaagggacacagatcttcgaggggaagaccaat

SEQ ID NO: 53432 - DNA, 75 bp, Artificial Sequence
  Synthetic
aaggacatggctgtccttgggtactaacgacaccccgcccccagttctcaaggttagagttataacctcagggtg

SEQ ID NO: 53433 - DNA, 75 bp, Artificial Sequence
  Synthetic
aacgacaccccgcccccagttctcaaggttagagttataacctcagggtgttggaagacatccaggccatagtag

SEQ ID NO: 53434 - DNA, 75 bp, Artificial Sequence
  Synthetic
ggccatcgcaagggaggattttcctcgggtactgaccataccccgaccccagtccgataggtcatggaatgaccc

SEQ ID NO: 53435 - DNA, 75 bp, Artificial Sequence
  Synthetic
atcatggacggaattcactttgcgctaccatcgatgcgtgccaaagaagcgtgaacgacgagttgccaacaccaa

SEQ ID NO: 53436 - DNA, 75 bp, Artificial Sequence
  Synthetic
ccagaagctagactttctagcggaggtggaactggtgacgttcaaagctataagggaaaacaagaccatcgctat

SEQ ID NO: 53437 - DNA, 75 bp, Artificial Sequence
  Synthetic
gacaacggtgaagggagaatttgtcgaaccattgtacacactaaaagcggagaagatgactatgttgcagacaat

SEQ ID NO: 53438 - DNA, 75 bp, Artificial Sequence
  Synthetic
cgggctcctccggatggttgctaccaccggggcgcgctggcttaggaaggaaggaggagaaaaagaagaaggaga

SEQ ID NO: 53439 - DNA, 75 bp, Artificial Sequence
  Synthetic
gaaccattgtacacactaaaagcggagaagatgactatgttgcagacaataatgcgaccagacgaaagctacgtc

SEQ ID NO: 53440 - DNA, 75 bp, Artificial Sequence
  Synthetic
atttccacgccgaacggacttcttgagtttcgcaccggagcagccgagatatatggcggccaatggatgcgtgaa

SEQ ID NO: 53441 - DNA, 75 bp, Artificial Sequence
  Synthetic
gctggtctccggcggtgcgcagcatcgtcgcggaggcggaacaggtcctagggccggaggtctactaggaagttt

SEQ ID NO: 53442 - DNA, 75 bp, Artificial Sequence
  Synthetic
ttgctcgccgattgtcacgtaaatgcgtcattctcgactgacgtgtgccctggaggatctcagttgaacatgggt

SEQ ID NO: 53443 - DNA, 75 bp, Artificial Sequence
  Synthetic
cgtcattctcgactgacgtgtgccctggaggatctcagttgaacatgggtgagatcaacggtaaagaacgtgttt

SEQ ID NO: 53444 - DNA, 75 bp, Artificial Sequence
  Synthetic
tgcacttagtgctggtgctgcactctgttttcatcgcgattgatcgacgcttgcgctcactgacgcggcgcgtga

SEQ ID NO: 53445 - DNA, 75 bp, Artificial Sequence
  Synthetic
gctcaacccagccctacaatcgtggatggggaactggatgcttcaagtggggaatcgggtttgtcgccacgtgca

SEQ ID NO: 53446 - DNA, 75 bp, Artificial Sequence
  Synthetic
atgctcactggcgtgatgatggtgcttggcgccgtcgtcattgacatgcaggtctccacggtgaaagggacgcag

SEQ ID NO: 53447 - DNA, 75 bp, Artificial Sequence
  Synthetic
agaggagtgtgcggagcacatctcagctggtctccggcggtgcgcagcatcgccgcggaggcggaacagatctta

SEQ ID NO: 53448 - DNA, 75 bp, Artificial Sequence
  Synthetic
acttttcgatttgcaaaactgggcaatgccgctgttacttgccgactggaatcagaacgattgcttctcgactac

SEQ ID NO: 53449 - DNA, 75 bp, Artificial Sequence
  Synthetic
atgccgctgttacttgccgactggaatcagaacgattgcttctcgactactatcacgtgacaggcaagcaccacg

SEQ ID NO: 53450 - DNA, 75 bp, Artificial Sequence
  Synthetic
atcagaacgattgcttctcgactactatcacgtgacaggcaagcaccacgaaggactgtttgtgcggtcgcaaat

SEQ ID NO: 53451 - DNA, 75 bp, Artificial Sequence
  Synthetic
atgctcactggcgtgatgatggtgctgggcgccgtcgtcattgacatgcaggtctccacggttaaagggacgcag

SEQ ID NO: 53452 - DNA, 75 bp, Artificial Sequence
  Synthetic
tgatgagtggcccggagcgcacgccactgctagtggaagggctggtttggaacggattgtggtttggggagacgc

SEQ ID NO: 53453 - DNA, 75 bp, Artificial Sequence
  Synthetic
atcttcgaggggaagactaatcgcactgatcatgtgcacttgttcaagctccccacagatggttgctggagtggc

SEQ ID NO: 53454 - DNA, 75 bp, Artificial Sequence
  Synthetic
cagggctaatgaagttttggtgaaaaacatcttggaacctcagctcgtatgggataatgccattgccacgcagga

SEQ ID NO: 53455 - DNA, 75 bp, Artificial Sequence
  Synthetic
aagctagattttctagcggaggtagaactggtgacgttcaaagctataagggagaacaagaccattgctatcatc

SEQ ID NO: 53456 - DNA, 75 bp, Artificial Sequence
  Synthetic
ctgatcatgtgcacttgttcaagctccccacagatggttgctggagtggcacattggtgatgaaaaagtgtccca

SEQ ID NO: 53457 - DNA, 75 bp, Artificial Sequence
  Synthetic
tggacggaattcactttgcgctaccatcgatgcgtgccaaagaagcgtgaacgacgtgtagccagcaccacccag

SEQ ID NO: 53458 - DNA, 75 bp, Artificial Sequence
  Synthetic
ttagcggcagtttcaaggattgcccggggatcaagtcttcagtctttgtccaaagcggtttcggatacgacggag

SEQ ID NO: 53459 - DNA, 75 bp, Artificial Sequence
  Synthetic
tcgcaccggagcagccgagatatatggcggccaatggatgcgtgaattgctcgctgattgtcacgtaaacgcgtc

SEQ ID NO: 53460 - DNA, 75 bp, Artificial Sequence
  Synthetic
tggtgatgacaagcttgtctaaagcaactaatgagagctgctcggtggggctgacgtgccacggatgttaccttc

SEQ ID NO: 53461 - DNA, 75 bp, Artificial Sequence
  Synthetic
tcgcgacgaagatggtgttcggacctggaacttcgaccgcaagagcgtttgttgggtgtggaaatcacaccggaa

SEQ ID NO: 53462 - DNA, 75 bp, Artificial Sequence
  Synthetic
tcgggtttgttgccacgtgtgttgaactgcattgcggagaggggtataacgtgtcgtcaatcgctaggtcatcca

SEQ ID NO: 53463 - DNA, 75 bp, Artificial Sequence
  Synthetic
cacttgtgattggagggacgacaatccacgttgagtgcgtgttgaacccgatctcgcaaggttggcgaatggcca

SEQ ID NO: 53464 - DNA, 75 bp, Artificial Sequence
  Synthetic
tcgcaccggagcagccgaaatatatggcggccaatggatgcgtgaattgctcgctgactgtcatgttaacgcgtc

SEQ ID NO: 53465 - DNA, 75 bp, Artificial Sequence
  Synthetic
tcgggtttgttgccacgtgtgttgaactgcattgcggagaggggtacaacgtgtcgtcgatcgctagatcatcca

SEQ ID NO: 53466 - DNA, 75 bp, Artificial Sequence
  Synthetic
tttcattgtttagcctgttgtccagctcgacgattctcgttgggctggctgctctggtgctgcttgacaaacgga

SEQ ID NO: 53467 - DNA, 75 bp, Artificial Sequence
  Synthetic
tcgtggttctgctacttttgtgcggatactttgtttacaccaaggcagatgtgggttgcggatttgaccccgaga

SEQ ID NO: 53468 - DNA, 75 bp, Artificial Sequence
  Synthetic
gaaaggtcgtatcctgcggatcaggagggttcgtgtggaaaagcttgtcacagtggccgactcgggaacattcag

SEQ ID NO: 53469 - DNA, 75 bp, Artificial Sequence
  Synthetic
gattgtggtctggggagacgccagggctaatgaagttttagtgaaaaacatcttggaacctcagctcgtatggga

SEQ ID NO: 53470 - DNA, 75 bp, Artificial Sequence
  Synthetic
agggttcgtgtggaaaagcttgtcacagtggccgactcgggaacattcagttgaactcgatgaccaacacctgat

SEQ ID NO: 53471 - DNA, 75 bp, Artificial Sequence
  Synthetic
tcttggaacctcagctcgtatgggataatgccattgccacgcaggacggttttcgtgatgttggcttttcttgtc

SEQ ID NO: 53472 - DNA, 75 bp, Artificial Sequence
  Synthetic
cacggctcttgtttcggaacagttgaagaagacgaacaaggtgtgcattatttgtgaggatgtcttgcaatgcgc

SEQ ID NO: 53473 - DNA, 75 bp, Artificial Sequence
  Synthetic
cggtagttttaaggattgcccggggatcaagtcttcagtcttcgtccaaagcggttttgggtacgacggagtggt

SEQ ID NO: 53474 - DNA, 75 bp, Artificial Sequence
  Synthetic
tttgtgaggatgtcttgcaatgcgctgccgctcgtagtgctgttggggagatcacccacgttgacaatgagattg

SEQ ID NO: 53475 - DNA, 75 bp, Artificial Sequence
  Synthetic
gcggtttcggatacgacggagtggtgatgacaagcttgtccaaagcaactaatgagagctgctcggtggggctga

SEQ ID NO: 53476 - DNA, 75 bp, Artificial Sequence
  Synthetic
gatgacaagcttgtccaaagcaactaatgagagctgctcggtggggctgacgtgccacggttgctacctcctcgc

SEQ ID NO: 53477 - DNA, 75 bp, Artificial Sequence
  Synthetic
tgacaggacttttcctcgaattccgaagaaggttcatggcgtgaaaatcggtgacctaacaatgcagctagccct

SEQ ID NO: 53478 - DNA, 75 bp, Artificial Sequence
  Synthetic
ggccgacccgggaacattcagttgaactcgatgaccaacacttgatcacggctcttgttacagaacaattgaaaa

SEQ ID NO: 53479 - DNA, 75 bp, Artificial Sequence
  Synthetic
cgcagaaaccagtgaacacaaggtcatccgtgttataacaagtgcctctccatacgagaagatctgtgagcaagc

SEQ ID NO: 53480 - DNA, 75 bp, Artificial Sequence
  Synthetic
gtttgcgctgcagtacggttttgttcggttcacccgcagggtgttcggttcaaatgtcgtggtcaagcccgtggc

SEQ ID NO: 53481 - DNA, 75 bp, Artificial Sequence
  Synthetic
acgattctcgtcgggctagcagctctggtgttgcttgacaaacgggttgtgttcttgctacttttgtgcggatac

SEQ ID NO: 53482 - DNA, 75 bp, Artificial Sequence
  Synthetic
aaaaccaacagactactgccccacatacctagccggatcgttcgtaaaaaatgacataggtgcgtacaccgatgg

SEQ ID NO: 53483 - DNA, 75 bp, Artificial Sequence
  Synthetic
gcgctgcagtacggtttcgtccggttcacccgcagggtgttcggttcaaatgttgtggtcaagcccgtggcgaag

SEQ ID NO: 53484 - DNA, 75 bp, Artificial Sequence
  Synthetic
gatgatgtggatgaagagtaagaaggtgaacggaacgtggacattggttgacctggaactaacgcagagccatca

SEQ ID NO: 53485 - DNA, 75 bp, Artificial Sequence
  Synthetic
ccaacagattactgccccacgtacctagccggatcatttgtgaaaaatgacataggcgcgtacaccgatgggatg

SEQ ID NO: 53486 - DNA, 75 bp, Artificial Sequence
  Synthetic
atgcatttggccccaagcgtacacgtttgatttgacggcctttaatgattcgtcgctgttcatgccggcacaata

SEQ ID NO: 53487 - DNA, 75 bp, Artificial Sequence
  Synthetic
tagccggatcatttgtgaaaaatgacataggcgcgtacaccgatgggatgatgtggatgaagagtaggaaagtga

SEQ ID NO: 53488 - DNA, 75 bp, Artificial Sequence
  Synthetic
cggcgctccgatgtccaaagcgaaccacattcctggttacaagacgcaaacagagtttccttggtacaaggcaga

SEQ ID NO: 53489 - DNA, 75 bp, Artificial Sequence
  Synthetic
ggaactgacgcagagccatcaatgtatttggccccaagcttatacgtttgatttgacggctttcaatgactcgtc

SEQ ID NO: 53490 - DNA, 75 bp, Artificial Sequence
  Synthetic
cgtcaacacttcgttgtcttttgaaaggacttttcctcgcattccgaagaaggttcatggcgtgaaaattggtga

SEQ ID NO: 53491 - DNA, 75 bp, Artificial Sequence
  Synthetic
catcgtgttgcgcgagggggtggtccctggaacgcaggttgaggagagcccgtcttgtgacaaccgcgggtccgc

SEQ ID NO: 53492 - DNA, 75 bp, Artificial Sequence
  Synthetic
aggacttttcctcgcattccgaagaaggttcatggcgtgaaaattggtgacctaacgatgcagctagccatagct

SEQ ID NO: 53493 - DNA, 75 bp, Artificial Sequence
  Synthetic
tgtgaaagttgaccctgccatcgccaagaagtggtgttgcaagacatgcttctcagctgacaagcgggtgtttca

SEQ ID NO: 53494 - DNA, 75 bp, Artificial Sequence
  Synthetic
tcggttgggggagcggttgatgccagccaatatggtgagttgagcagtgggttcctgagccgcaccaagatcgcg

SEQ ID NO: 53495 - DNA, 75 bp, Artificial Sequence
  Synthetic
tctcagctgacaagcgggtgtttcacttcaaggtcgacaacgattacttctaccccatggagattcgaccagcgg

SEQ ID NO: 53496 - DNA, 75 bp, Artificial Sequence
  Synthetic
gaagccagtgaacacaaggtaatccgtgtgataacaagtgcctctccatacgagaagatatgtgagcaggcgttc

SEQ ID NO: 53497 - DNA, 75 bp, Artificial Sequence
  Synthetic
cgctgatggcgaagacatggacgagatgacatcgatgttcgggacaatgaaggcagtcgtaccgccggtggaagg

SEQ ID NO: 53498 - DNA, 75 bp, Artificial Sequence
  Synthetic
gtcctatccggatttccggctcagcccatccatggagggagtttctcccctactggtgggcgcgcttttgcacct

SEQ ID NO: 53499 - DNA, 75 bp, Artificial Sequence
  Synthetic
ggaactgacgcagagccatcaatgcatttggccccaagcttatacgtttgatttgacggcctttaatgactcgtc

SEQ ID NO: 53500 - DNA, 75 bp, Artificial Sequence
  Synthetic
gaccggatggagtggaattcacgaacttgacggacaacagtagagtgtcgacagggttgctggtttacgtcggct

SEQ ID NO: 53501 - DNA, 75 bp, Artificial Sequence
  Synthetic
atttgacggcctttaatgactcgtcgctgttcatgccggcacaatacggcgctccgatgtctaaagcaaaccaca

SEQ ID NO: 53502 - DNA, 75 bp, Artificial Sequence
  Synthetic
ggattttgttcctcctgtttggagtgccatccaacacctatgtcgggtggtcttggattggattgtcgtactcgc

SEQ ID NO: 53503 - DNA, 75 bp, Artificial Sequence
  Synthetic
gccatccaacacctatgtcgggtggtcttggattggattgtcgtactcgcttgctgctgttccgaatggtacggc

SEQ ID NO: 53504 - DNA, 75 bp, Artificial Sequence
  Synthetic
ttcctggttacaagacgcaaacagagtttccttggtacaaatctgacatcgtgttgcgcgagggggtggtccctg

SEQ ID NO: 53505 - DNA, 75 bp, Artificial Sequence
  Synthetic
gcttgttggtggacaaacgcgcccgagtggctgcctctttacgtggctggagtatcggtttttcgatccaacgag

SEQ ID NO: 53506 - DNA, 75 bp, Artificial Sequence
  Synthetic
tctgttggtgcatttctggctggcagttcagttctcatcatcgcacttgttctttttgggatgggcgctacggca

SEQ ID NO: 53507 - DNA, 75 bp, Artificial Sequence
  Synthetic
gttcagttctcatcatcgcacttgttctttttgggatgggcgctacggcaacgtgtacgatcatcagttggatac

SEQ ID NO: 53508 - DNA, 75 bp, Artificial Sequence
  Synthetic
gcattgaccgtgttcttcgccgagtggcttctcttgaagttacggcagctgtgggaatcgacatacctcctcgac

SEQ ID NO: 53509 - DNA, 75 bp, Artificial Sequence
  Synthetic
ggcttctcttgaagttacggcagctgtgggaatcgacatacctcctcgaccacgtgctgttcccaatgtacgtga

SEQ ID NO: 53510 - DNA, 75 bp, Artificial Sequence
  Synthetic
gacggcgaagacatggacgagatgacatcaatgttcgggacaatgaaggcagtcgtgccgccagtggaagggtcc

SEQ ID NO: 53511 - DNA, 75 bp, Artificial Sequence
  Synthetic
ggcgatgtttaccgggacatggcttcttatggcggatcgtggaacattgctgattcctccgagagctcagtggtt

SEQ ID NO: 53512 - DNA, 75 bp, Artificial Sequence
  Synthetic
gttcgcgtcgtgcagaacgatgggagcgtgttgtgtgccagaagctccacggcaagtattagcatcgatggaaag

SEQ ID NO: 53513 - DNA, 75 bp, Artificial Sequence
  Synthetic
accattcgaaccaaacatcggtgggcccaacgcacatgtggaacttggactttgttcctcctgtttggagtgcca

SEQ ID NO: 53514 - DNA, 75 bp, Artificial Sequence
  Synthetic
attcgcgtgtacaagagctggggatgctctccgaacttgtggaggagtggacttcgcgcttcgaggcgctcatta

SEQ ID NO: 53515 - DNA, 75 bp, Artificial Sequence
  Synthetic
tccaacacctatgttgggtggtcttggattggattgtcgtactcgctcgcttctgttccgaatggtacggctctg

SEQ ID NO: 53516 - DNA, 75 bp, Artificial Sequence
  Synthetic
tcagtggtgttcctgggaggactgctgatcgggatagtgaccaggatggctcctccaacgcacttggagttggtt

SEQ ID NO: 53517 - DNA, 75 bp, Artificial Sequence
  Synthetic
gatcacaagcggagaagtcaccgcagaggaaagctctgaggaagacacactttctcgccggttcgtggattcgca

SEQ ID NO: 53518 - DNA, 75 bp, Artificial Sequence
  Synthetic
tggattgcgaggaagagcccacaacacttccgtctggattagaaggaacttacggaccggatggagtggaattca

SEQ ID NO: 53519 - DNA, 75 bp, Artificial Sequence
  Synthetic
acttccgtctggattagaaggaacttacggaccggatggagtggaattcacgaacttgacggacaacagtagagt

SEQ ID NO: 53520 - DNA, 75 bp, Artificial Sequence
  Synthetic
gatactgacgcccactcgagttgttaaggatgaggttgtgcgggcgattgctgaggcgtgtcctggagtggtggt

SEQ ID NO: 53521 - DNA, 75 bp, Artificial Sequence
  Synthetic
cgaacttgacggacaacagtagagtgtcaacggggttgctggtttacgtcggctgcatgggaatcatggccatta

SEQ ID NO: 53522 - DNA, 75 bp, Artificial Sequence
  Synthetic
gtcaacggggttgctggtttacgtcggctgcatgggaatcatggccattaacacctacgtgggggtcatcctgat

SEQ ID NO: 53523 - DNA, 75 bp, Artificial Sequence
  Synthetic
cgtgctctcaacgtgtctcgagctgtatcagatgccgacgacggcatcggttgtgttcctaggaggattgctgat

SEQ ID NO: 53524 - DNA, 75 bp, Artificial Sequence
  Synthetic
gtgtgtttgttggtggacaaacgcgcccgagtggctaccgctttacgtggctggagtatcggtcttccgagctaa

SEQ ID NO: 53525 - DNA, 75 bp, Artificial Sequence
  Synthetic
ttctccaccatcataatggacgaatgtcacttcctggaccccttgtccatctcctgccgtggggtcatggattac

SEQ ID NO: 53526 - DNA, 75 bp, Artificial Sequence
  Synthetic
gcatgggaatcatggccatgaatacctacgtcggggtcatcctgatgtgtgcttgttggtggacaaacgcgcccg

SEQ ID NO: 53527 - DNA, 75 bp, Artificial Sequence
  Synthetic
gcccgacggaacataccaggtggttgctcgctcgctgttcatgaccagccacgtgggagcaggctacgctaaaga

SEQ ID NO: 53528 - DNA, 75 bp, Artificial Sequence
  Synthetic
ctacgtcggggtcatcctgatgtgtgcttgttggtggacaaacgcgcccgagtggctacctctttacgtggctgg

SEQ ID NO: 53529 - DNA, 75 bp, Artificial Sequence
  Synthetic
cggtgtgttcaacacgctctggcatgtgacatctggtggaagcctcacatggcaggggagaaacgtgcgcctaca

SEQ ID NO: 53530 - DNA, 75 bp, Artificial Sequence
  Synthetic
ctctggtgatgtgtaccgggacatggcctcgtatggcggatcgtggaacattgctgattcccccgagagttcagt

SEQ ID NO: 53531 - DNA, 75 bp, Artificial Sequence
  Synthetic
ctcttggcgcctgaaagtcgaccccggttcatcaacttcatcaagaaggatgtcccagtctggcttgcttggcac

SEQ ID NO: 53532 - DNA, 75 bp, Artificial Sequence
  Synthetic
ggttgttcgtgtcgtgcagaacgatggaagcgtattgtgtgctagaagctctacggcaagtatcagcatcgacgg

SEQ ID NO: 53533 - DNA, 75 bp, Artificial Sequence
  Synthetic
ggaagcgtattgtgtgctagaagctctacggcaagtatcagcatcgacggaaagcgtgtccaggtcattggctat

SEQ ID NO: 53534 - DNA, 75 bp, Artificial Sequence
  Synthetic
atggaaaaggatcgtcaggatctccggtgcatgcgttggatggtcgtgtcgttggactgtacggttatggatttt

SEQ ID NO: 53535 - DNA, 75 bp, Artificial Sequence
  Synthetic
ctccggtgcatgcgttggatggtcgtgtcgttgggctgtacggttatggatttttcatcggatggaagtaccact

SEQ ID NO: 53536 - DNA, 75 bp, Artificial Sequence
  Synthetic
gaggaaaactttgaagaagacacagtttcgcgccggttcgttgattggcatccaggaaaagggaagaccagacgc

SEQ ID NO: 53537 - DNA, 75 bp, Artificial Sequence
  Synthetic
ccttgatcacaagcggagaagtcaccgcagaggaaagttttgaggaaaacacagtttctcgcaggttcgttgatt

SEQ ID NO: 53538 - DNA, 75 bp, Artificial Sequence
  Synthetic
tccaagatcatgctgtacctcaagcagcggagcaatttcaacttcgacttggggggcgttttgtatgggctattt

SEQ ID NO: 53539 - DNA, 75 bp, Artificial Sequence
  Synthetic
gtgttggttgaagaggccaaatctcacatcgcaaaagagaaacgtctgctgatactgacgcccactcgagttgtt

SEQ ID NO: 53540 - DNA, 75 bp, Artificial Sequence
  Synthetic
acagtttctcgcaggttcgttgattggcatccaggaaaggggaagaccagacgcgttttggttgaagaggcaaaa

SEQ ID NO: 53541 - DNA, 75 bp, Artificial Sequence
  Synthetic
ggcatccaggaaaggggaagaccagacgcgttttggttgaagaggcaaaatctcacatcgcgaaagaaaaacggc

SEQ ID NO: 53542 - DNA, 75 bp, Artificial Sequence
  Synthetic
tgctaatactgacgcccactcgagttgttaaggatgaggttgtgcgggcgattgctgaggcgtgcccgggggtcg

SEQ ID NO: 53543 - DNA, 75 bp, Artificial Sequence
  Synthetic
aggaatgccatcacggtggcttgccacgcgacgctaacgcagtatctgatggagaagggcattgacagcattcga

SEQ ID NO: 53544 - DNA, 75 bp, Artificial Sequence
  Synthetic
tggtaggatcaaacctagcgatgtaccgtaggaacgccatcacggtggcttgccacgcaacgctaacgcagtatc

SEQ ID NO: 53545 - DNA, 75 bp, Artificial Sequence
  Synthetic
ggagaagggcattgacagcattcgattctccaccatcataatggacgaatgtcacttcctggaccccctgtccat

SEQ ID NO: 53546 - DNA, 75 bp, Artificial Sequence
  Synthetic
tcaatggtgatggctatcggaccactatgcgcggtggttgctggcatccctcccgccttcgtttttgttgcggtg

SEQ ID NO: 53547 - DNA, 75 bp, Artificial Sequence
  Synthetic
tgatggagaagggcattgacagcatccgattctccaccatcataatggacgagtgccacttcttggaccccctgt

SEQ ID NO: 53548 - DNA, 75 bp, Artificial Sequence
  Synthetic
tctacatgagtgcgactccccccggatgtgttgggaacaacggatcaaatcatcccatcgatgacgtggcgacac

SEQ ID NO: 53549 - DNA, 75 bp, Artificial Sequence
  Synthetic
ccatcgcctgtcgtggggtcatggattactacaatgggaaaggggtggccgtggtctacatgagtgcgactcccc

SEQ ID NO: 53550 - DNA, 75 bp, Artificial Sequence
  Synthetic
gtggtctacatgagtgcgactccccccggatgtgctggaaacaacggatcaaatcatcccatcgatgacgtggcg

SEQ ID NO: 53551 - DNA, 75 bp, Artificial Sequence
  Synthetic
ccggatgtgctggaaacaacggatcaaatcatcccatcgatgacgtggcgacgcaatttccgcgcgaattaacag

SEQ ID NO: 53552 - DNA, 75 bp, Artificial Sequence
  Synthetic
ggatctccttcccaacattcgacgggatctaggttacctcctggaaaggatcgccgcgaggcaagagccggacat

SEQ ID NO: 53553 - DNA, 75 bp, Artificial Sequence
  Synthetic
aaatcatcccatcgatgacgtggcgacgcaatttccgcgcgaattaacagcagcgtgggtccgtggacaagcgac

SEQ ID NO: 53554 - DNA, 75 bp, Artificial Sequence
  Synthetic
cccacaagcagctttcgcgcggccagaggttctggagttgcacatcacatcccttcctggagcgctggttgtgag

SEQ ID NO: 53555 - DNA, 75 bp, Artificial Sequence
  Synthetic
tggcaagacgataatattcgtccccacacagcaccaagccaacactttggctagtgaacttggaggagtttcact

SEQ ID NO: 53556 - DNA, 75 bp, Artificial Sequence
  Synthetic
agtaaagcctgtcattagcgaaggttccgtcatgctagagaaagttggcatcacacaggcgtcggccatccagcg

SEQ ID NO: 53557 - DNA, 75 bp, Artificial Sequence
  Synthetic
cagcgaaatgggagcaaatctcggtgtgcagacggttattgacacgcgtgtggcagtgaagcctgtcattagcga

SEQ ID NO: 53558 - DNA, 75 bp, Artificial Sequence
  Synthetic
tggcagtgaagcctgtcattagcgagggttccgtcatgctggagaaagttggaatcacacaagcgtcagctatcc

SEQ ID NO: 53559 - DNA, 75 bp, Artificial Sequence
  Synthetic
agcgccgtggaagaacaggacgcagggaagcaggaaagtatatctatcccattgggtctgagctggaaaacgatg

SEQ ID NO: 53560 - DNA, 75 bp, Artificial Sequence
  Synthetic
gaacttccagccacagggcagatacctcttggcgcctgaaagtcgacctcggttcatcaacttcatcaagaagga

SEQ ID NO: 53561 - DNA, 75 bp, Artificial Sequence
  Synthetic
ccactgagtgggcgtgttggactgaagctcagatgattttagaccagatggcgtgcggaccgatgcgcgaggaga

SEQ ID NO: 53562 - DNA, 75 bp, Artificial Sequence
  Synthetic
tgggcgaatgcgtttgaacacaagcactcagtgctgtttcaaggacagaatgcgactagcttgaaaatcaggacg

SEQ ID NO: 53563 - DNA, 75 bp, Artificial Sequence
  Synthetic
tttctggtaggtgctagtttactgttttggttcgtggcgcatcagtcacgcatggcgctacggtcgctggtgaag

SEQ ID NO: 53564 - DNA, 75 bp, Artificial Sequence
  Synthetic
tttggttcgtggcgcatcagtcacgcatggcgctacggtcgctggtgaagacagatgcttgcggactgggataca

SEQ ID NO: 53565 - DNA, 75 bp, Artificial Sequence
  Synthetic
gtaccttttggcgcctgaaagtcgaccccggttcatcaatttcatcaagaaagatgtcccagtttggttggcgtg

SEQ ID NO: 53566 - DNA, 75 bp, Artificial Sequence
  Synthetic
tccaagatcatgctgtacctcaagcagcggagcaatttcaactttgacttggggggcgttctgtacggactattt

SEQ ID NO: 53567 - DNA, 75 bp, Artificial Sequence
  Synthetic
gcactgggcgaatgcgtttgaacataagcattcagtgctatttcaaggacagaacgcgacgagcttgaagatcag

SEQ ID NO: 53568 - DNA, 75 bp, Artificial Sequence
  Synthetic
gtggctttccgtgacacgaacctagagcggcttggtacatcttaccgctcggcgattgagattctccatgaaatc

SEQ ID NO: 53569 - DNA, 75 bp, Artificial Sequence
  Synthetic
aagcattcagtgctatttcaaggacagaacgcgacgagcttgaagatcaggactgaggctggtgatcacaagtat

SEQ ID NO: 53570 - DNA, 75 bp, Artificial Sequence
  Synthetic
cggtttgaagatggatgagcttatcaagaagttccaatgggaaccaaagggggctgcacttgacctaggatgtgg

SEQ ID NO: 53571 - DNA, 75 bp, Artificial Sequence
  Synthetic
gctccccgattccatgacgatcgtttcgaaaagaacaacgagttggacaaacgctccaagatcatgctgtacctc

SEQ ID NO: 53572 - DNA, 75 bp, Artificial Sequence
  Synthetic
gtgatggacactagggtcaactccgtgacggggttgacgctgggaggagctaatcgggaaaatcccctaccgttt

SEQ ID NO: 53573 - DNA, 75 bp, Artificial Sequence
  Synthetic
aagcagcggagcaatttcaactttgacttggggggcgttctgtatgggctatttgtggctttccgtgacacgaac

SEQ ID NO: 53574 - DNA, 75 bp, Artificial Sequence
  Synthetic
gatcgtgaagtggctgttcggtggaaaggcaactgcacaacaaagccccccgtactcaagcttcccaacgttaca

SEQ ID NO: 53575 - DNA, 75 bp, Artificial Sequence
  Synthetic
ttagagcggcttggcacatcttaccgctcggcgattgagatccttcatgagatctctaacgttgatgatccaatg

SEQ ID NO: 53576 - DNA, 75 bp, Artificial Sequence
  Synthetic
tatgtgcggtggttgctggcattcctcccgccttcgtttttgttgcggtgttgggattgttcgtgataatgtgct

SEQ ID NO: 53577 - DNA, 75 bp, Artificial Sequence
  Synthetic
gtttcaaacgtggtgatgggaaagtcgctacaagcttgggcggctgttatcattggaatggtcactgggattgtg

SEQ ID NO: 53578 - DNA, 75 bp, Artificial Sequence
  Synthetic
gtagcgccaataacgtgcaccgggcttacactactgacaccgtcacgctcgttgtcatcggtgtttgcgtgtgtg

SEQ ID NO: 53579 - DNA, 75 bp, Artificial Sequence
  Synthetic
ctactcgtcatgtttgtggtggtttgtcggatcgtaaagtggctgttcggtggaaaggcaactgcacaacaaagt

SEQ ID NO: 53580 - DNA, 75 bp, Artificial Sequence
  Synthetic
gttgtcatcggtgtttgcgtgtgtgtcatgggagttgttgcgtgggaaatggatctccttcccaacattcgacgg

SEQ ID NO: 53581 - DNA, 75 bp, Artificial Sequence
  Synthetic
cccccgtactcgagcttcccaacgttacaaacagcgggattttgtcaattcggctcaatggtgatggctatcgga

SEQ ID NO: 53582 - DNA, 75 bp, Artificial Sequence
  Synthetic
gacctgggttacatcctggaaaggatcgccgcgaggcaagagccggacatcccacaagcatctttcgcacggcca

SEQ ID NO: 53583 - DNA, 75 bp, Artificial Sequence
  Synthetic
cgtacgcgcagcaaaaaattcttcgtgagagggtggacactctgacgcttgaaccagaccagcgaacccgagcta

SEQ ID NO: 53584 - DNA, 75 bp, Artificial Sequence
  Synthetic
ccactgtgtgcggtggtagctggcatcccccccgccttcgtttttgttgcggtgttgggactgttcgtgataatg

SEQ ID NO: 53585 - DNA, 75 bp, Artificial Sequence
  Synthetic
cccacaagcatctttcgcacggccagaggtactagagttgcacatcacatctcttcctggagcgttggtcgtgag

SEQ ID NO: 53586 - DNA, 75 bp, Artificial Sequence
  Synthetic
ctttgccatcgctatcgttgggggggtcattgttaactgtctgtccgacagcggatttctgcgcaagttgttttc

SEQ ID NO: 53587 - DNA, 75 bp, Artificial Sequence
  Synthetic
ggtgttgggactgttcgtgataatgtgctgcagcgccaataacgtgcatcgggcttacaccaccgacaccgtcac

SEQ ID NO: 53588 - DNA, 75 bp, Artificial Sequence
  Synthetic
ctctgcgatgttcaaacggcgaggattggctccgagaatcctcactccggtagagtacatgaacaatgtgaaaag

SEQ ID NO: 53589 - DNA, 75 bp, Artificial Sequence
  Synthetic
gctcgttgtcatcggtgtttgcgtgtgtgtcatgggggttgttgcgtgggaaatggatctccttcccaacattcg

SEQ ID NO: 53590 - DNA, 75 bp, Artificial Sequence
  Synthetic
atcggaggcattcagctcgctttgatttcctgggagacgatggtgccaatcgcttttgctgggttcttcgcaacc

SEQ ID NO: 53591 - DNA, 75 bp, Artificial Sequence
  Synthetic
agttgtgcgtgtttaacacaatgggcaaaaaggagaagaagccgtcctctttcggcgaggcacgaggatcgagga

SEQ ID NO: 53592 - DNA, 75 bp, Artificial Sequence
  Synthetic
cgcttttgctgggttcttcgcaaccacgttcgtgacgaagatctatgggtgcatggtgggaggaatttacctggt

SEQ ID NO: 53593 - DNA, 75 bp, Artificial Sequence
  Synthetic
acgggacctaggttacatcttggaaaggctcgccacgaggcaagaaccggacatcccacaagcatcgtttgtgcg

SEQ ID NO: 53594 - DNA, 75 bp, Artificial Sequence
  Synthetic
gcatggtgggaggaatttacctggttctagctcactatgaccggaagtatgcctttacagtgaaggcgaccaagg

SEQ ID NO: 53595 - DNA, 75 bp, Artificial Sequence
  Synthetic
gccagaggttctagagttgcacatcacgtctcttcctggagcgctggttgtgagctttgccattgcgatcgttgg

SEQ ID NO: 53596 - DNA, 75 bp, Artificial Sequence
  Synthetic
tagcgaggaagaactttccatgcggagttggcggggtcggagtgaactactttggatactatctccaggaaatca

SEQ ID NO: 53597 - DNA, 75 bp, Artificial Sequence
  Synthetic
gggggtcattgttaactgtctgtccgacagcggatttctacgcaagttgttttcaaacgaagaacagtccgcaac

SEQ ID NO: 53598 - DNA, 75 bp, Artificial Sequence
  Synthetic
agatctcgacgatgagataacaggacgagacggagtgacgcgaggccggccgaccttttacgcgctacaaatatg

SEQ ID NO: 53599 - DNA, 75 bp, Artificial Sequence
  Synthetic
ggtaatcggaggcattcagctcgctttgatttcctgggagacgatggtaccgatcgcctttgctgggttctttgc

SEQ ID NO: 53600 - DNA, 75 bp, Artificial Sequence
  Synthetic
cgatcgcctttgctgggttctttgcaaccacgttcgtcacgaagatctatgggtgcatggtggggggaatttacc

SEQ ID NO: 53601 - DNA, 75 bp, Artificial Sequence
  Synthetic
gatcttcgctgaacctgggcaggttattctggtaggtgctagtttactgttttggttcgtggcgcaccagtcacg

SEQ ID NO: 53602 - DNA, 75 bp, Artificial Sequence
  Synthetic
ggaaagatctcgatgatgagataacaggacgagacggagtgactcgaggccgaccaaccttctacgcgctacaaa

SEQ ID NO: 53603 - DNA, 75 bp, Artificial Sequence
  Synthetic
acagacgcttgcggactgggatacagatggaaggaaatgctcaacgcgctggacaaaaatgcgtttgacaagtac

SEQ ID NO: 53604 - DNA, 75 bp, Artificial Sequence
  Synthetic
gatggaaggaaatgctcaacgcgctggacaaaaatgcgtttgacaagtaccgatcccgaggagtgaacgagacag

SEQ ID NO: 53605 - DNA, 75 bp, Artificial Sequence
  Synthetic
ctccgtgtcgtgaccaacacgagatcattggtcgagcacggatccagaaaggggggatcgtggacatgtcagcag

SEQ ID NO: 53606 - DNA, 75 bp, Artificial Sequence
  Synthetic
ggacaaaaatgcgtttgacaagtaccgatcccgaggagtgaacgagacagacaagggtgatttcgtctcgcgggg

SEQ ID NO: 53607 - DNA, 75 bp, Artificial Sequence
  Synthetic
acaagggtgatttcgtctcgcggggcggtttgaagatggatgagcttatcaggaagttccaatgggaaccaaagg

SEQ ID NO: 53608 - DNA, 75 bp, Artificial Sequence
  Synthetic
tatgttgttccctgctgtggactgtcacgtcgcctagcctgaagcacgcggtcgtgagtgtggtggtgattgtgt

SEQ ID NO: 53609 - DNA, 75 bp, Artificial Sequence
  Synthetic
caacaaccggctgctcgtcacgtttgactattctagcgtgttgttgattttgatgatcttcgctgaacctgggca

SEQ ID NO: 53610 - DNA, 75 bp, Artificial Sequence
  Synthetic
ccgggtgcctagcaaaggcacatgcccaaatgtgggcattgtactacttccaccggagagatttgcgtctcggat

SEQ ID NO: 53611 - DNA, 75 bp, Artificial Sequence
  Synthetic
cacgtcgcctagcctgaagcacgcggtcgtgagtgtggtggtgattgtgtttgcattcctcacatttcgtcgtcc

SEQ ID NO: 53612 - DNA, 75 bp, Artificial Sequence
  Synthetic
ccaaatgtgggcattgtactacttccaccggagagatttgcgtctcggatttgccgccatcacgtcggccgtccc

SEQ ID NO: 53613 - DNA, 75 bp, Artificial Sequence
  Synthetic
gactattctagcgtgttgttgattttgatgatcttcgctgaacctgggcaggtctttctggtaggtgctagtttg

SEQ ID NO: 53614 - DNA, 75 bp, Artificial Sequence
  Synthetic
acgattgtgtgtgacataggcgagagtgacccccggcctgaagtggagaagacaagaacgctgaaagtgctgatg

SEQ ID NO: 53615 - DNA, 75 bp, Artificial Sequence
  Synthetic
tatcaggaagttccaatgggaaccaaagggggctgcacttgacctaggttgtggccgcggagggtggacccaacg

SEQ ID NO: 53616 - DNA, 75 bp, Artificial Sequence
  Synthetic
taccgagctccaaccgacggcgtgttctggtgagaatcacgcgactcgtagagaacaacgtctctagaaaaggtt

SEQ ID NO: 53617 - DNA, 75 bp, Artificial Sequence
  Synthetic
tttggtgatggataccagggtcaactccgtgatggggttgacgctgggtggcgcgaatcgggaaaatcccctacc

SEQ ID NO: 53618 - DNA, 75 bp, Artificial Sequence
  Synthetic
gtgctacgcaagctagagatgcttcagcacaagcacaatggaaaattggttaggttgtccttgagccggaactcc

SEQ ID NO: 53619 - DNA, 75 bp, Artificial Sequence
  Synthetic
agtgctaacgacactccggccccagttcccagagcaagggtttttgctccacggtgctggaagacaccctcgcgg

SEQ ID NO: 53620 - DNA, 75 bp, Artificial Sequence
  Synthetic
tgtacgcgcttgagccgcgagactgcaacacgatcgtgtgtgacataggcgagagtgacccccggcctgaggtgg

SEQ ID NO: 53621 - DNA, 75 bp, Artificial Sequence
  Synthetic
caacacgatcgtgtgtgacataggcgagagtgacccccggcctgaggtggagaaaacaagaacgctgaaagtgct

SEQ ID NO: 53622 - DNA, 75 bp, Artificial Sequence
  Synthetic
gtaaggtgctgtctccgtaccacctcgaagtgctgcgcaagctggaaatgcttcagcacaagcacaatggaaagt

SEQ ID NO: 53623 - DNA, 75 bp, Artificial Sequence
  Synthetic
gaagaggttgcgagaggaaaacgctagtacgtggtttgtggaccgtgaacacccttaccaatcgttcaactacca

SEQ ID NO: 53624 - DNA, 75 bp, Artificial Sequence
  Synthetic
tggtcaggttgtccttgagccggaactccactgcagaaatgtactacgtctcaggtccgcgagcgaacatcgtcg

SEQ ID NO: 53625 - DNA, 75 bp, Artificial Sequence
  Synthetic
tctccaggagggcagactgtcaacccgatgatgcgccgaataatgtggccgtgggatttcctctcccgtgtgacg

SEQ ID NO: 53626 - DNA, 75 bp, Artificial Sequence
  Synthetic
gctcagtttatcacgtcctaggagctctaattgggcgcttcaagcgaaatgacccggtgcagcaggatgctcctc

SEQ ID NO: 53627 - DNA, 75 bp, Artificial Sequence
  Synthetic
caaaactcgagatgggcactcgaagtgaccctcgggcgaaagtgaagctgcaggaccaaacaatcgttgctggcc

SEQ ID NO: 53628 - DNA, 75 bp, Artificial Sequence
  Synthetic
tggagtacatgaacaacgtgaaaagcggagccgccattggagggtggagcaaggagatgccatggaacaaggtgc

SEQ ID NO: 53629 - DNA, 75 bp, Artificial Sequence
  Synthetic
gcgtgaagaggctgcgagaggaaaacgccggtacatggttcgtggaccgtgaacacccttaccaatcattcaact

SEQ ID NO: 53630 - DNA, 75 bp, Artificial Sequence
  Synthetic
cgccggtacatggttcgtggaccgtgaacacccttaccaatcattcaactaccacggatcgtttgtcactgacga

SEQ ID NO: 53631 - DNA, 75 bp, Artificial Sequence
  Synthetic
aagaagctttagctgaccctgtcttctggcgtatggtggctgatgaacgcgcccggcacctgcgtggagattgtg

SEQ ID NO: 53632 - DNA, 75 bp, Artificial Sequence
  Synthetic
gcccggcacctgcgtggagattgtgagttgtgcgtgttcaacacaatgggcaagaaggagaagaagccgtcctct

SEQ ID NO: 53633 - DNA, 75 bp, Artificial Sequence
  Synthetic
tatctctccgggagggcagacggtcaacccgatgatgcgccgaataatgtggccgtgggattttctctcccgtgt

SEQ ID NO: 53634 - DNA, 75 bp, Artificial Sequence
  Synthetic
aacccgatgatgcgccgaataatgtggccgtgggattttctctcccgtgtaacgacgttcatgatgacagatgtg

SEQ ID NO: 53635 - DNA, 75 bp, Artificial Sequence
  Synthetic
aagacgaaaggacacaacctagccgtgctaaaagccggtgttgacgtgtacgcgactgagccgcgagactgcaac

SEQ ID NO: 53636 - DNA, 75 bp, Artificial Sequence
  Synthetic
gctcgaaccggaccagcggacccgagctatcaatcggctgatcatgcggcacttctctgctatgtccaaacggcg

SEQ ID NO: 53637 - DNA, 75 bp, Artificial Sequence
  Synthetic
tagcgaggaagaactttccgtgcggagttggcggggttggagtgaattactttgggtactatctccaggaaatca

SEQ ID NO: 53638 - DNA, 75 bp, Artificial Sequence
  Synthetic
aggattggctccgagaatcctcactccggtggagtacatgagcaacgtgaaaagcggagccgccattggagggtg

SEQ ID NO: 53639 - DNA, 75 bp, Artificial Sequence
  Synthetic
tgcaaaaaggtaagtggatgattgctgatgacaccgccggtggggacacgcgcataactgaagctgacctggagg

SEQ ID NO: 53640 - DNA, 75 bp, Artificial Sequence
  Synthetic
tcttttggcgtatggtagctgatgaacgtgcccggcacctgcgtggagagtgtgagttgtgcgtgttcaacacaa

SEQ ID NO: 53641 - DNA, 75 bp, Artificial Sequence
  Synthetic
tggggaagaaggagaagaagccgtcctctttcggcgaggcacgaggatcgaggattatctggtatatgtggctcg

SEQ ID NO: 53642 - DNA, 75 bp, Artificial Sequence
  Synthetic
atcgatgcgtgccaaagaagcgtgaacgacgagttgccagcaccaaccagaagctagattttctggcggaggtgg

SEQ ID NO: 53643 - DNA, 75 bp, Artificial Sequence
  Synthetic
ccagtctaaggtacattaccgccgcgtcaaaaacgcgcaagaacttgcaatcgaccgagccttccccgaggtaca

SEQ ID NO: 53644 - DNA, 75 bp, Artificial Sequence
  Synthetic
ttcccatcactaccatcctctcgtgctgcaggacggtcgtgagatcattgccccgtgtcgtgaccaacacgagat

SEQ ID NO: 53645 - DNA, 75 bp, Artificial Sequence
  Synthetic
tcgctgattgtcacgtaaacgcgtcattctcgactgatgtgtgtcctggaggatctcagctgaacatggctgaga

SEQ ID NO: 53646 - DNA, 75 bp, Artificial Sequence
  Synthetic
gaggacgagttatggttcttgctggaccaagtgaatgacccctaccacgcacagttgatacgtgttgtgtttaag

SEQ ID NO: 53647 - DNA, 75 bp, Artificial Sequence
  Synthetic
ccccgtgtcgtgaccaacacgagatcattggtcgagcacggatccagaaaggagggatcgtggacatgtcagcag

SEQ ID NO: 53648 - DNA, 75 bp, Artificial Sequence
  Synthetic
gtttcacgcacagaccaacgcggatctgggcaagtgaccacttacgctctcaacactgtgacgaatgggaagaac

SEQ ID NO: 53649 - DNA, 75 bp, Artificial Sequence
  Synthetic
caggttgggagaatgctggaagctgaagggctactggacgcgccattggagatgatcgatgggtggctaggttcc

SEQ ID NO: 53650 - DNA, 75 bp, Artificial Sequence
  Synthetic
ctgaatggatgacgacacaggacatgctagaagtgtggaacaccgtgtggattgtcaacaacccatggatggcgg

SEQ ID NO: 53651 - DNA, 75 bp, Artificial Sequence
  Synthetic
gctagaagtgtggaacaccgtgtggattgtcaacaacccatggatggcggtgaaagacccggtgaagacatggtc

SEQ ID NO: 53652 - DNA, 75 bp, Artificial Sequence
  Synthetic
catctggaagagatcttgagtggaatggtcgtggctggggatgatgtggttgtggcaaccaacaatgaaaacttc

SEQ ID NO: 53653 - DNA, 75 bp, Artificial Sequence
  Synthetic
agagataccatatctcccgaaaacgaaggacataaactgtggaagtttgatcggtgagcgggatagggcagcgtg

SEQ ID NO: 53654 - DNA, 75 bp, Artificial Sequence
  Synthetic
cacactagtctaaggtacatcaccgccgcgtcaaaaacgcgtaagaacttgcaaccgaccgagccatccccaagg

SEQ ID NO: 53655 - DNA, 75 bp, Artificial Sequence
  Synthetic
ggaagggttgcggatacttgggcgataccgagctccaaccgacgacgtgttctggtgagaatcacgcgactcgta

SEQ ID NO: 53656 - DNA, 75 bp, Artificial Sequence
  Synthetic
tacacaaactgggaacatgtcgaattctgttcccatcactaccatcctctcgtgctgcaggacggccgtgagatt

SEQ ID NO: 53657 - DNA, 75 bp, Artificial Sequence
  Synthetic
gagaacaacatctctagaagaggttaacgttgcgaagcaacaggaaccccgtaaggaaggacaaggctgtccttg

SEQ ID NO: 53658 - DNA, 75 bp, Artificial Sequence
  Synthetic
attgccccgtgtcgtgaccaacacgagatcattgggcgggcacggatccagaaaggggggatcgtggacatgtcg

SEQ ID NO: 53659 - DNA, 75 bp, Artificial Sequence
  Synthetic
agtgctaacggcactccggccccagttcccagagccagggtattagctccacggtgttggaagacaccctcgcag

SEQ ID NO: 53660 - DNA, 75 bp, Artificial Sequence
  Synthetic
gcagctgggtgcctagcaaaggctcacgctcaaatgtgggcattgtattacttccaccggagggatttgcggctc

SEQ ID NO: 53661 - DNA, 75 bp, Artificial Sequence
  Synthetic
acggtgttggaagacaccctcgcagccatggctgcacgacgcgcgcaaggaaggacatggctgtccttgggtact

SEQ ID NO: 53662 - DNA, 75 bp, Artificial Sequence
  Synthetic
cttccaccggagggatttgcggctcggatttgccgctatcacgtcggctgtcccggtgaactggatccccacggg

SEQ ID NO: 53663 - DNA, 75 bp, Artificial Sequence
  Synthetic
ggatttgccgctatcacgtcggctgtcccggtgaactggatccccacggggcggatatcatggtcagtccaccag

SEQ ID NO: 53664 - DNA, 75 bp, Artificial Sequence
  Synthetic
ttggaagacatccgggccagggcagggccatcgcaagggaggattttcctcgggtactgaccataccccgacccc

SEQ ID NO: 53665 - DNA, 75 bp, Artificial Sequence
  Synthetic
ggccatcgcaagggaggattttcctcgggtactgaccataccccgaccccagtccgacaggtcatggcatgaccc

SEQ ID NO: 53666 - DNA, 75 bp, Artificial Sequence
  Synthetic
gcggtgaaggacccagtgaagacatggtcagagataccatacctcccgaagacgaaggacataaactgtggaagc

SEQ ID NO: 53667 - DNA, 75 bp, Artificial Sequence
  Synthetic
ctgatcggtgaacgggatagggcagcgtggtcgaagaatatcgtggccacagttagcacaacccgacgaatcatc

SEQ ID NO: 53668 - DNA, 75 bp, Artificial Sequence
  Synthetic
ttgggattgttcgtgataatgtgctgtagcgctaataacgtgcaccgggcttacaccactgacaccgtcacgctc

SEQ ID NO: 53669 - DNA, 75 bp, Artificial Sequence
  Synthetic
tcacggaaggattgcggatacttgggcgataccgagctccaaccgacgatgtgttctggtgagaaccacgcgacc

SEQ ID NO: 53670 - DNA, 75 bp, Artificial Sequence
  Synthetic
ctgctcttgaggctaaacgctctgcgaagaacgctgtacggatcgcattcatgctcactggcgtgatgatggtgc

SEQ ID NO: 53671 - DNA, 75 bp, Artificial Sequence
  Synthetic
gcgataccgagctccaaccgacgatgtgttctggtgagaaccacgcgacccgtagagaacaacatctctaggaaa

SEQ ID NO: 53672 - DNA, 75 bp, Artificial Sequence
  Synthetic
ggttaacgttgcgaggcaacgggaaccccgcaaggaaggacaaggctgtccttgggtgctaacgacactccggcc

SEQ ID NO: 53673 - DNA, 75 bp, Artificial Sequence
  Synthetic
tgggcgccgtcgtcattgatatgcaggtctccacggtgaaagggacacagatcttcgaggggaagaccaatcgca

SEQ ID NO: 53674 - DNA, 75 bp, Artificial Sequence
  Synthetic
atcttcgaggggaagaccaatcgcactgatcatgtgcacttgttcaagctccccacggatggctgctggagtggc

SEQ ID NO: 53675 - DNA, 75 bp, Artificial Sequence
  Synthetic
ccagttccaagagccagggttttggctccacggtgttggaagacaccctcgcagccatggctgcatgatgcgcgc

SEQ ID NO: 53676 - DNA, 75 bp, Artificial Sequence
  Synthetic
ctgatcatgtgcacttgttcaagctccccacggatggctgctggagtggcacattggtcatgaaaaagtgtccca

SEQ ID NO: 53677 - DNA, 75 bp, Artificial Sequence
  Synthetic
aggttgctgatcttgcgaaggatctggaaggagtggattgtggttcatcatggacggaatttactttgcgctacc

SEQ ID NO: 53678 - DNA, 75 bp, Artificial Sequence
  Synthetic
gcaaggccgtcgcaagggaggattttcctcgggtactgaccacaccccgaccccagtccgataggtcatggaatg

SEQ ID NO: 53679 - DNA, 75 bp, Artificial Sequence
  Synthetic
tcctcgggtactgaccacaccccgaccccagtccgataggtcatggaatgaccccatggtgctgagagggcatcc

SEQ ID NO: 53680 - DNA, 75 bp, Artificial Sequence
  Synthetic
tgagcattgacaacgctccggccccagtcccccaggttatggaggaataaccccgacgtgctgaaagggcacgaa

SEQ ID NO: 53681 - DNA, 75 bp, Artificial Sequence
  Synthetic
tcaccgcaaggtgagggcgcacaggatagaatccaggtgactgacgccacctcccgaaatgtgtatagtaacaga

SEQ ID NO: 53682 - DNA, 75 bp, Artificial Sequence
  Synthetic
ctcattagtgatgttcccgtgacttttcgatttgcaaagctgggcaatgccgctgttacttgtcggctagaatca

SEQ ID NO: 53683 - DNA, 75 bp, Artificial Sequence
  Synthetic
agtaacagagcatgcctgcagcagcaggtctccaccgttaggagacttgttgtgggcaagcttttgttcacgtct

SEQ ID NO: 53684 - DNA, 75 bp, Artificial Sequence
  Synthetic
taccaccggggcgcgctggcttaggaaggaaggaggagaaaaagaagaaggagaagaggagtgtgcggagcacat

SEQ ID NO: 53685 - DNA, 75 bp, Artificial Sequence
  Synthetic
gagaagaggagtgtgcggagcacatctcagctggtctccggcggtgcgcagcatcgccgcggaggcggaacaggt

SEQ ID NO: 53686 - DNA, 75 bp, Artificial Sequence
  Synthetic
aatgagagctgctcggtggggctgacgtgccacggatgctacctcctcgcgacgaagatggtgttcggacctgga

SEQ ID NO: 53687 - DNA, 75 bp, Artificial Sequence
  Synthetic
cgtttttctcgcaaaaatgggaaaggacgacggtaagaagaagaaggagctaggctcctccggatggttgttacc

SEQ ID NO: 53688 - DNA, 75 bp, Artificial Sequence
  Synthetic
ctcagctggtctccggcggtgcgcagcatcgccgcggaggcggaacaggtcctagggccggaggtctactaggac

SEQ ID NO: 53689 - DNA, 75 bp, Artificial Sequence
  Synthetic
ggcatgactttgttggaaagttttcattgttcagcctgttgtccagctcgacgattctcgtcgggctcgccgctc

SEQ ID NO: 53690 - DNA, 75 bp, Artificial Sequence
  Synthetic
tggtgtttcttgacaaacggattgtgttcttgctacttttgtgcggatactttgtctacaccaaggcagatgtgg

SEQ ID NO: 53691 - DNA, 75 bp, Artificial Sequence
  Synthetic
attcatgctcactggcgtgatgatggtgctgggcgccgtcgtcattgacatgcaggtctccacggtgaaagggac

SEQ ID NO: 53692 - DNA, 75 bp, Artificial Sequence
  Synthetic
agacgaacaaggtgtgtatcatttgtgaggatgtcttgcaatgcgccgccgctcgtagtgctgttggggagatta

SEQ ID NO: 53693 - DNA, 75 bp, Artificial Sequence
  Synthetic
tgcaggtctccacggtgaaagggactcagatcttcgaggggaagaccaatcgcactgatcatgtgcacttgttca

SEQ ID NO: 53694 - DNA, 75 bp, Artificial Sequence
  Synthetic
tcttggaacctcagctcgtctgggataatgccattgccacgcaggacggttttcgtgatgttggctattcgtgcc

SEQ ID NO: 53695 - DNA, 75 bp, Artificial Sequence
  Synthetic
cccaaggttgctgatcttgcgaaggatctggaaggagtggattgtggttcatcatggacggaattcactttgcgc

SEQ ID NO: 53696 - DNA, 75 bp, Artificial Sequence
  Synthetic
ccagaagctagattttctagcggaggtggaactggtgacgttcaaagctataagggagaacaagaccatcgctat

SEQ ID NO: 53697 - DNA, 75 bp, Artificial Sequence
  Synthetic
ttcctgggtacaagacgcaaacagagttcccttggtacaaagctgatatcgtgttgcgcgagggggtggtacccg

SEQ ID NO: 53698 - DNA, 75 bp, Artificial Sequence
  Synthetic
gaaccattgtacacactaaaagcggaaaagatgaccatgttgcagacaataatgcgaccagacgaaagctacgtg

SEQ ID NO: 53699 - DNA, 75 bp, Artificial Sequence
  Synthetic
ggtgggcgcgcttttgcacctgctgaccattcgaaccaaacatcggtgggctcaacgcacatgtggaacttggat

SEQ ID NO: 53700 - DNA, 75 bp, Artificial Sequence
  Synthetic
ttgctcgctgattgtcacgtgaacgcgtcattctcgactgacgtgtgtcctggaggatctcagctgaacatgggt

SEQ ID NO: 53701 - DNA, 75 bp, Artificial Sequence
  Synthetic
cgtcattctcgactgacgtgtgtcctggaggatctcagctgaacatgggtgagatcaatggtaaagaacgtgttt

SEQ ID NO: 53702 - DNA, 75 bp, Artificial Sequence
  Synthetic
cgggatagtgaccaggatggctcctccagcgcacttggagttggttccggtggctggagtgggagtgccgttgga

SEQ ID NO: 53703 - DNA, 75 bp, Artificial Sequence
  Synthetic
atggggaactggatgcttcaagtgggggatcgggtttgttgccacgtgtgttgaactgcattgcggagaggggta

SEQ ID NO: 53704 - DNA, 75 bp, Artificial Sequence
  Synthetic
tccatcgtgatgaacatcacagcgaaattccactcagtggatgacgtccagcaactcattagtgatgttcccgtg

SEQ ID NO: 53705 - DNA, 75 bp, Artificial Sequence
  Synthetic
aattccactcagtggatgacgtccagcaactcattagtgatgttcccgtgacttttcgatttgcaaagctgggca

SEQ ID NO: 53706 - DNA, 75 bp, Artificial Sequence
  Synthetic
acttttcgatttgcaaagctgggcaatgccgctgttacttgccggctagaatcagagcgattgcttcttgactac

SEQ ID NO: 53707 - DNA, 75 bp, Artificial Sequence
  Synthetic
cgatgagtggcccggagcgcacgccactgctagtggaagggccggtttggaacggattgtggtctggggagacgc

SEQ ID NO: 53708 - DNA, 75 bp, Artificial Sequence
  Synthetic
aacggattgtggtctggggagacgccagggctaatgaagttttggtgaaaaacgtcttggaacctcagctcgtgt

SEQ ID NO: 53709 - DNA, 75 bp, Artificial Sequence
  Synthetic
gggataatgccattgccacgcaggacggttttcgtgatgttggcttttcttgtcagatcatgcttgacaaactgg

SEQ ID NO: 53710 - DNA, 75 bp, Artificial Sequence
  Synthetic
actgcagaaatgtactacgtctcaggtccgcgagcgaacatcgtcggctcagtttttcacgtcttaggggctcta

SEQ ID NO: 53711 - DNA, 75 bp, Artificial Sequence
  Synthetic
ttagcggtggttttaaagattgcccgggaatcaagtcttcagtctttgtccaaagcggtttcggatacgacggag

SEQ ID NO: 53712 - DNA, 75 bp, Artificial Sequence
  Synthetic
tggtgatgacaagcttgtccaaagcaactaatgagagctgctcagtggggctgacgtgccacggatgctacctcc

SEQ ID NO: 53713 - DNA, 75 bp, Artificial Sequence
  Synthetic
agtgaagcctgtcattagcgaaggttccgtcatgctggaaaaagttggcatcacacaggcgtcagccattcagcg

SEQ ID NO: 53714 - DNA, 75 bp, Artificial Sequence
  Synthetic
acccctaccaatcgttcaactaccacgggtcatttgtcactgacgacatctctcccggaggacagactgtaaacc

SEQ ID NO: 53715 - DNA, 75 bp, Artificial Sequence
  Synthetic
gaagctggtgaccacaagtacgctccccgattccatgacgatcgtttcgaaaagaacaacgagttggacaaacgc

SEQ ID NO: 53716 - DNA, 75 bp, Artificial Sequence
  Synthetic
gtgtggcatgactttgttggaaagttttcattgttcagcctgttgtccagctcgacgattctcgtcgggctggct

SEQ ID NO: 53717 - DNA, 75 bp, Artificial Sequence
  Synthetic
agcggagcaatttcaactttgacttggggggcgttctgtatggactatttgtggctttccgtgacacgaacctag

SEQ ID NO: 53718 - DNA, 75 bp, Artificial Sequence
  Synthetic
ctccgtgtcgtgaccaacacgagatcattggtcgagcacggatccagaaaggggggatcgtggacatgtcagctg

SEQ ID NO: 53719 - DNA, 75 bp, Artificial Sequence
  Synthetic
gctctggtttttcttgacaaacgaattgtgttcttgctacttttgtgcggatactttgtctacaccaaggcagat

SEQ ID NO: 53720 - DNA, 75 bp, Artificial Sequence
  Synthetic
atactttgtctacaccaaggcagatgtgggttgcggatttgaccctgagagaaaggttgtgtcctgcggatcagg

SEQ ID NO: 53721 - DNA, 75 bp, Artificial Sequence
  Synthetic
gtagcgctaataacgtgcaccgggcttacaccactgacaccgtcacgctcgttgtaatcggtgtctgcgtgtgtg

SEQ ID NO: 53722 - DNA, 75 bp, Artificial Sequence
  Synthetic
cacggctcttgtttcggaacagttgaagaagacgaacaaggtgtgtatcatttgtgaggatgtcttgcaatgcgc

SEQ ID NO: 53723 - DNA, 75 bp, Artificial Sequence
  Synthetic
tttgtgaggatgtcttgcaatgcgccgccgctcgtagtgctgttggggagattacccacgttgacaatgagattg

SEQ ID NO: 53724 - DNA, 75 bp, Artificial Sequence
  Synthetic
tcatgggagttgttgcgtgggaaatggatctacttcccaacattcgacgggatctaggttacatcctggaaagga

SEQ ID NO: 53725 - DNA, 75 bp, Artificial Sequence
  Synthetic
attacccacgttgacaatgagattgtttacgttaacacttcgttgtcttttgacaggacttttcctcgaattccg

SEQ ID NO: 53726 - DNA, 75 bp, Artificial Sequence
  Synthetic
cgccgctcgtagtgctgttggggagattacccacgttgacaatgagattgtttacgttaacacttcgttgtcttt

SEQ ID NO: 53727 - DNA, 75 bp, Artificial Sequence
  Synthetic
gtgacctaaccatgcagctagccctagcttcagttgggggagcggttgatgccagccaatacggtgagttgagca

SEQ ID NO: 53728 - DNA, 75 bp, Artificial Sequence
  Synthetic
ttgttccctgctgtggacagtcacgtcgcctagcctgaagcatgctgtcgtgagtgtggtggtgatcgtgtttgc

SEQ ID NO: 53729 - DNA, 75 bp, Artificial Sequence
  Synthetic
caaatgttgtggtcaagcccgtggcaaaaccaacagattactgccccacgtacctagccggatcgtttgtgaaaa

SEQ ID NO: 53730 - DNA, 75 bp, Artificial Sequence
  Synthetic
atgacataggcgcgtacaccgatgggatgatgtggatgaagagcaggaaggtgaacggaacgtggacattggtcg

SEQ ID NO: 53731 - DNA, 75 bp, Artificial Sequence
  Synthetic
acctggaactgacgcagagtcatcaatgcatttggccccaagcttacacgtttgatttgacggcctttaatgact

SEQ ID NO: 53732 - DNA, 75 bp, Artificial Sequence
  Synthetic
cggtttgaagatggatgagcttatcaggaagttccaatgggaaccgaagggggctgcacttgacttaggatgtgg

SEQ ID NO: 53733 - DNA, 75 bp, Artificial Sequence
  Synthetic
cagagtttccttggtacaaagctgatatcgtgttgcgcgaaggggtggtccccggaactcaggttgaagagagcc

SEQ ID NO: 53734 - DNA, 75 bp, Artificial Sequence
  Synthetic
accagacaatcgttgctggccgcgtgaagaggttgcgagaggaaaacgccagcacatggttcgtggaccgtgaac

SEQ ID NO: 53735 - DNA, 75 bp, Artificial Sequence
  Synthetic
gtcctatccggatttccggctcagcccatctgtggagggagtttctcccctactggtgggcgcgcttttgcacct

SEQ ID NO: 53736 - DNA, 75 bp, Artificial Sequence
  Synthetic
ccatctgtggagggagtttctcccctactggtgggcgcgcttttgcacctgctgaccattcgaaccaaacatcgg

SEQ ID NO: 53737 - DNA, 75 bp, Artificial Sequence
  Synthetic
gaaccagaccagcggacccgagctatcaataggttgatcatgcggcatttctctgcgatgttcaaacggcgagga

SEQ ID NO: 53738 - DNA, 75 bp, Artificial Sequence
  Synthetic
tgttggcgttcaatctgaaatcacagttcgtgcctgtggactcgatggtactgctgaactatgttgtgacgcatc

SEQ ID NO: 53739 - DNA, 75 bp, Artificial Sequence
  Synthetic
gttcgtgcctgtggactcgatggtactgctgaactatgttgtgacgcatcctgcagttgcgacggccatggtaac

SEQ ID NO: 53740 - DNA, 75 bp, Artificial Sequence
  Synthetic
gtggctggaatgtgcttggcggggttgtacgtgctctcaacgtgtctcgagctgtatcagatgccgacgacggca

SEQ ID NO: 53741 - DNA, 75 bp, Artificial Sequence
  Synthetic
tcggtggtgttcctaggaggactgctgatcgggatagtgaccaggatggctcctccagcgcacttggagttggtt

SEQ ID NO: 53742 - DNA, 75 bp, Artificial Sequence
  Synthetic
acacctacgtcggggtcatcctgatgtgtgcttgttggtggacaaatgcgcctgagtggctacctctttacgtgg

SEQ ID NO: 53743 - DNA, 75 bp, Artificial Sequence
  Synthetic
caccggagagatttgcggctcggatttgccgctatcacgtcggccgtcccggtgaactggatccccacggggcgg

SEQ ID NO: 53744 - DNA, 75 bp, Artificial Sequence
  Synthetic
tgaggtgaatgacgtcctcatcacccctccagagtatgagcaggaagcacagctaagtaacgacttcgggcattt

SEQ ID NO: 53745 - DNA, 75 bp, Artificial Sequence
  Synthetic
ttggtgagcgggacagggcagcgtggtcgaagaatatcgtggccacagttagtacaactcgacgaatcatcgagc

SEQ ID NO: 53746 - DNA, 75 bp, Artificial Sequence
  Synthetic
gcccgacggaacataccgggtggttgctcgctcgctgttcatgaccagccacgtgggagcaggctacgccaaaga

SEQ ID NO: 53747 - DNA, 75 bp, Artificial Sequence
  Synthetic
gctcgctcgctgttcatgaccagccacgtgggagcaggctacgccaaagacggagtgttcaacacgctttggcat

SEQ ID NO: 53748 - DNA, 75 bp, Artificial Sequence
  Synthetic
cggagtgttcaacacgctttggcatgtaacatccggtgggagcctcacatggcaagggagaaacgtgcgcctaca

SEQ ID NO: 53749 - DNA, 75 bp, Artificial Sequence
  Synthetic
gagaacaacatctctagaaaaggttaacgttgcgaagcaacgggaaccccgtaaggaaggacaaggctgtccttg

SEQ ID NO: 53750 - DNA, 75 bp, Artificial Sequence
  Synthetic
gtaaggaaggacaaggctgtccttgagtactaacgacactccggccccagttcccagagccagggtttagctcca

SEQ ID NO: 53751 - DNA, 75 bp, Artificial Sequence
  Synthetic
ttgctgattcccccgagagctcagtggttgttcgtatcgtgcagaacgatgggagcgtactgtgtgccagaagct

SEQ ID NO: 53752 - DNA, 75 bp, Artificial Sequence
  Synthetic
cggtgctggaagacaccctcgcagccatggctgcacgacgcgcgcaaggaaggacatggctgtccttgggtacta

SEQ ID NO: 53753 - DNA, 75 bp, Artificial Sequence
  Synthetic
ccacggcaagtattagcatcgatggaaagcgtgttcaggtcattggccatgactatggaaaaggatcgtcaggat

SEQ ID NO: 53754 - DNA, 75 bp, Artificial Sequence
  Synthetic
aaagcgtgttcaggtcattggccatgactatggaaaaggatcgtcaggatctccggtgcatgcgttggatggtcg

SEQ ID NO: 53755 - DNA, 75 bp, Artificial Sequence
  Synthetic
gactatggaaaaggatcgtcaggatctccggtgcatgcgttggatggtcgtgttgttggactgtatggttatgga

SEQ ID NO: 53756 - DNA, 75 bp, Artificial Sequence
  Synthetic
cgcagaggaaatctctgaggaagacacagtttcgcgccggttcgtagattggcacccaggaaaggggaagaccag

SEQ ID NO: 53757 - DNA, 75 bp, Artificial Sequence
  Synthetic
acagtttcgcgccggttcgtagattggcacccaggaaaggggaagaccagacgcgtgttggttgaagaggccaaa

SEQ ID NO: 53758 - DNA, 75 bp, Artificial Sequence
  Synthetic
tctcacatcgcaaaagagaaacgtctgctgatactgacgcccactcgagttgttaaggatgaggttgtgcgggcg

SEQ ID NO: 53759 - DNA, 75 bp, Artificial Sequence
  Synthetic
tggtaggatcaaacctagcgatgtaccgaaggaatgccatcacggtggcttgccacgcgacgctaacgcagtatc

SEQ ID NO: 53760 - DNA, 75 bp, Artificial Sequence
  Synthetic
tcgattctccaccatcataatggacgaatgtcacttcctggatcccctgtccatcgcctgtcgtggagtcatgga

SEQ ID NO: 53761 - DNA, 75 bp, Artificial Sequence
  Synthetic
ttactacaatggaaaaggggttgccgtggtctacatgagtgcgactccccccggatgtgctggaaacaacggatc

SEQ ID NO: 53762 - DNA, 75 bp, Artificial Sequence
  Synthetic
gggccggaggtctactaggacgtttgggaattggctggggatcgattctccaggaggacattgtgcaggcactca

SEQ ID NO: 53763 - DNA, 75 bp, Artificial Sequence
  Synthetic
tgcacttagtgctggtgctgcactctgttttcatcgcaattgatcgacgcttgcgctcactgacacggcgcgtga

SEQ ID NO: 53764 - DNA, 75 bp, Artificial Sequence
  Synthetic
ttgcgctcactgacacggcgcgtgactgcccttgaggctagacgctctgcgaagaacgctgtacggatcgcattc

SEQ ID NO: 53765 - DNA, 75 bp, Artificial Sequence
  Synthetic
acacagcatcaagccaacactttggctagtgagcttggaggagtttcactgacccgcgaatcgtttgacgtcgcg

SEQ ID NO: 53766 - DNA, 75 bp, Artificial Sequence
  Synthetic
cacagttcatcgtgtcgacagacatcagcgaaatgggagcaaatctcggtgtgcagacggtcattgacacgcgtg

SEQ ID NO: 53767 - DNA, 75 bp, Artificial Sequence
  Synthetic
acattggttatgaaaaagtgtcccaaggttgctgatcttgcgaaggatctggaaggagtggattgtggttcatca

SEQ ID NO: 53768 - DNA, 75 bp, Artificial Sequence
  Synthetic
tggcagtaaagcctatcattagcgaaggttccgtcatgctggagaaggttggcatcacacaggcgtcagccatcc

SEQ ID NO: 53769 - DNA, 75 bp, Artificial Sequence
  Synthetic
agcgccgtggaagaacaggacgcagagaagcaggaaagtatgtctaccccattgggtctgagctggaaaacgagg

SEQ ID NO: 53770 - DNA, 75 bp, Artificial Sequence
  Synthetic
ccactgagtgggcttgttggactgaagctcaaatgattctagaccagatggcgtgcggaccgatgcgtgaggaga

SEQ ID NO: 53771 - DNA, 75 bp, Artificial Sequence
  Synthetic
gcgtgcggaccgatgcgtgaggagatcgagaacttccagccacagggcagatacctcttggcgcctgaaagtcga

SEQ ID NO: 53772 - DNA, 75 bp, Artificial Sequence
  Synthetic
tcgagaacttccagccacagggcagatacctcttggcgcctgaaagtcgaccccggttcatcaacttcatcaaga

SEQ ID NO: 53773 - DNA, 75 bp, Artificial Sequence
  Synthetic
atacctcttggcgcctgaaagtcgaccccggttcatcaacttcatcaagaaggatgttccagtctggcttgcgtg

SEQ ID NO: 53774 - DNA, 75 bp, Artificial Sequence
  Synthetic
gcactgggcgaatgcgtttgaacacaagcactcagtgctgtttcaaggacagaatgcgacgagcttgaagatcag

SEQ ID NO: 53775 - DNA, 75 bp, Artificial Sequence
  Synthetic
ttcgatttgcaaagctgggcaacgccgctgttacttgccggctagaatcagagcgactgcttcttgactactatc

SEQ ID NO: 53776 - DNA, 75 bp, Artificial Sequence
  Synthetic
gctcggcgattgagattctccatgaaatctctaacgttgatgatccaatggtttcaaacgtggtgatgggaaagt

SEQ ID NO: 53777 - DNA, 75 bp, Artificial Sequence
  Synthetic
cattgggatggtcactgggattgtgctactcgtcatgtttgtagtggtttgtcggatcgtgaagtggctgttcgg

SEQ ID NO: 53778 - DNA, 75 bp, Artificial Sequence
  Synthetic
ctactcgtcatgtttgtagtggtttgtcggatcgtgaagtggctgttcggtggaaaggcaactgcacaacaaagc

SEQ ID NO: 53779 - DNA, 75 bp, Artificial Sequence
  Synthetic
tggaaaggcaactgcacaacaaagcaccccgtactcaagcttcccaacgttacagacagcaggattttgtcaatt

SEQ ID NO: 53780 - DNA, 75 bp, Artificial Sequence
  Synthetic
taatgccattgccacgcaggacggttttcgtgatgttggcttttcttgtcagatcatgcttgacaagctggttag

SEQ ID NO: 53781 - DNA, 75 bp, Artificial Sequence
  Synthetic
cggtagtttcaaggattgcccggggatcaagtcttcagtcttcgtccaaagcggtttcggatacgacggtgtggt

SEQ ID NO: 53782 - DNA, 75 bp, Artificial Sequence
  Synthetic
atcaagtcttcagtcttcgtccaaagcggtttcggatacgacggtgtggtgatgacaagcttgtccaaggcaact

SEQ ID NO: 53783 - DNA, 75 bp, Artificial Sequence
  Synthetic
ggtgttgggattgttcgtgataatgtgctgtagcgccaataacgtgcaccgagcttacactactgacaccgtcac

SEQ ID NO: 53784 - DNA, 75 bp, Artificial Sequence
  Synthetic
acttcgaccgcaagggcatttgttgggtgtgggaaccacaccggaacccttgtggttggaggaacaacaatccac

SEQ ID NO: 53785 - DNA, 75 bp, Artificial Sequence
  Synthetic
aggatcgccgcgaggcaagagccggacatcccacaagcatctttcgcgcggccagaggttctagagttgcacatc

SEQ ID NO: 53786 - DNA, 75 bp, Artificial Sequence
  Synthetic
tgagctttgctatcgctatcgttgggggggtcattgttaactgtctgtccgacagcggatttctgcgcaagttgt

SEQ ID NO: 53787 - DNA, 75 bp, Artificial Sequence
  Synthetic
ggaactgctggagttggaggcgtgtggcatgactttgttggaaagttttcattgttcagcctgttgtccagctcg

SEQ ID NO: 53788 - DNA, 75 bp, Artificial Sequence
  Synthetic
gacagcggatttctgcgcaagttgttttcgaacgaagaacagtccgcaacggtaatcggaggcattcagctcgct

SEQ ID NO: 53789 - DNA, 75 bp, Artificial Sequence
  Synthetic
attgttcagcctgttgtccagctcgacgattctcgtcgggctggccgctctggtgtttcttgacaaacggattgt

SEQ ID NO: 53790 - DNA, 75 bp, Artificial Sequence
  Synthetic
tttcgaacgaagaacagtccgcaacggtaatcggaggcattcagctcgctttgatttcctgggagacgatggtgc

SEQ ID NO: 53791 - DNA, 75 bp, Artificial Sequence
  Synthetic
ttgatttcctgggagacgatggtgccgatcgcttttgctgggttcttcgcaaccacgttcgtgacgaagatctat

SEQ ID NO: 53792 - DNA, 75 bp, Artificial Sequence
  Synthetic
gttgcggatttgaccctgagagaaaggttgtgtcctgcggatcaggagggttcgtgtggaaaagcctgtcgcaat

SEQ ID NO: 53793 - DNA, 75 bp, Artificial Sequence
  Synthetic
cgatcgcttttgctgggttcttcgcaaccacgttcgtgacgaagatctatggatgcatggtgggaggaatctacc

SEQ ID NO: 53794 - DNA, 75 bp, Artificial Sequence
  Synthetic
tggttctagctcactatgaccggaagtatgcctttacagtgaaggcgaccaaggtcctcatcgcgcgcaccagca

SEQ ID NO: 53795 - DNA, 75 bp, Artificial Sequence
  Synthetic
ttgcattcctcacatttcgtcgtcccaataacaggctgctcgtcacgtttgactattctagcgtgctgttggtct

SEQ ID NO: 53796 - DNA, 75 bp, Artificial Sequence
  Synthetic
caataacaggctgctcgtcacgtttgactattctagcgtgctgttggtcttgatgatcttcgctgaacctgggca

SEQ ID NO: 53797 - DNA, 75 bp, Artificial Sequence
  Synthetic
tgatgatcttcgctgaacctgggcaggtttttctggtaggtgctagtttactgttttggttcgtggcgcatcagt

SEQ ID NO: 53798 - DNA, 75 bp, Artificial Sequence
  Synthetic
ctgttttggttcgtggcgcatcagtcacgcatggcgctacggtcgctggtgaagacagacgcttgcgggctggga

SEQ ID NO: 53799 - DNA, 75 bp, Artificial Sequence
  Synthetic
tacagatggaaggaaatgctgaacgcgctggacaaaaatgcgtttgacaagtaccgatctcgaggagtgaacgag

SEQ ID NO: 53800 - DNA, 75 bp, Artificial Sequence
  Synthetic
tgttgtggtcaagcccgtggcaaaaccgacagattactgccccacgtacctagccggatcgtttgttaaaaatga

SEQ ID NO: 53801 - DNA, 75 bp, Artificial Sequence
  Synthetic
actgacaagggtgatttcgtctcacggggcggtctgaagatggatgagcttatcaggaagttccaatgggaacca

SEQ ID NO: 53802 - DNA, 75 bp, Artificial Sequence
  Synthetic
ggggcggtctgaagatggatgagcttatcaggaagttccaatgggaaccaaagggggctgcactagacttaggat

SEQ ID NO: 53803 - DNA, 75 bp, Artificial Sequence
  Synthetic
gtggccgcggaggatggacccaacgtctggtgatggacactagggtcaactccgtgacggggttgacgctgggtg

SEQ ID NO: 53804 - DNA, 75 bp, Artificial Sequence
  Synthetic
tctggtgatggacactagggtcaactccgtgacggggttgacgctgggtggagcaaaccgggaaaatcccctacc

SEQ ID NO: 53805 - DNA, 75 bp, Artificial Sequence
  Synthetic
tccgtgacggggttgacgctgggtggagcaaaccgggaaaatcccctaccgtttaagacgaagggacacaaccta

SEQ ID NO: 53806 - DNA, 75 bp, Artificial Sequence
  Synthetic
gtttaagacgaagggacacaacctagccgtgctaaaagccggtgttgacgtgtacgcgcttgagccgcgagactg

SEQ ID NO: 53807 - DNA, 75 bp, Artificial Sequence
  Synthetic
caacacgattgtgtgtgacataggcgagagtgacccccggcctgaggtggagaagacaagaacgctgaaagtgct

SEQ ID NO: 53808 - DNA, 75 bp, Artificial Sequence
  Synthetic
gtgttacgcgagggggtggtccccgggactcaggttgaagagagcccatcttgtgacaaccgtgggtctgctgtg

SEQ ID NO: 53809 - DNA, 75 bp, Artificial Sequence
  Synthetic
gatgatgctcgagaaatggttagttcacaatccaggtgcggcgttctgttgtaaggtgttgtctccgtaccacct

SEQ ID NO: 53810 - DNA, 75 bp, Artificial Sequence
  Synthetic
gtaaggtgttgtctccgtaccacctcgaagtgctgcgcaagctagagatgcttcagcacaagcacaatggaaaat

SEQ ID NO: 53811 - DNA, 75 bp, Artificial Sequence
  Synthetic
cgaagtgctgcgcaagctagagatgcttcagcacaagcacaatggaaaattggtcaggttgtccttgagccggaa

SEQ ID NO: 53812 - DNA, 75 bp, Artificial Sequence
  Synthetic
ggtgggcgcgcttttgcacctgctgacaattcgaaccaaacatcggtgggctcaacgtacatgtggaacttggat

SEQ ID NO: 53813 - DNA, 75 bp, Artificial Sequence
  Synthetic
ctccactgcagaaatgtactacgtctcaggtccgcgagcaaacatcgtcggctcagttttttacgtcttaggagc

SEQ ID NO: 53814 - DNA, 75 bp, Artificial Sequence
  Synthetic
tctaattgggcgcttcaagcgtaatgacccggtgcagcaggatgctcctccaaagctcgagatgggcactcgaag

SEQ ID NO: 53815 - DNA, 75 bp, Artificial Sequence
  Synthetic
gacccggtgcagcaggatgctcctccaaagctcgagatgggcactcgaagtgacccccgggcaaaagtgaagctg

SEQ ID NO: 53816 - DNA, 75 bp, Artificial Sequence
  Synthetic
tgacccccgggcaaaagtgaagctgcaggaccagacaatcgttgctggtcgcgtgaagaggttgcgagaggaaaa

SEQ ID NO: 53817 - DNA, 75 bp, Artificial Sequence
  Synthetic
gcgtgaagaggttgcgagaggaaaacgccagcacatggttcgtggaccgtgaacacccttaccaatcgttcaact

SEQ ID NO: 53818 - DNA, 75 bp, Artificial Sequence
  Synthetic
accacgggtcattcgtcactgacgatatctctccaggagggcagactgtcaacccgatgatgcgtcgaataatgt

SEQ ID NO: 53819 - DNA, 75 bp, Artificial Sequence
  Synthetic
aacccgatgatgcgtcgaataatgtggccgtgggatttcctctcccgtgtgacgacgttcatgatgacagatgtg

SEQ ID NO: 53820 - DNA, 75 bp, Artificial Sequence
  Synthetic
ggccgtgggatttcctctcccgtgtgacgacgttcatgatgacagatgtgtcaacgtacgcgcagcagaaaattc

SEQ ID NO: 53821 - DNA, 75 bp, Artificial Sequence
  Synthetic
agtggctacctctttacgtggctggagtatcggtctttcgatctaatgaggtgaatgatgtcctcatcacccctc

SEQ ID NO: 53822 - DNA, 75 bp, Artificial Sequence
  Synthetic
agtatcggtctttcgatctaatgaggtgaatgatgtcctcatcacccctccagagtatgagcaggaagcacagct

SEQ ID NO: 53823 - DNA, 75 bp, Artificial Sequence
  Synthetic
gatggaacataccaggtggttgctcgctcgctgttcatgaccagccacgtgggggcaggttacgccaaagacggt

SEQ ID NO: 53824 - DNA, 75 bp, Artificial Sequence
  Synthetic
atttctctgcgatgttcaaacggcgaggattggctccgagaatcctcactccggtagagtacatgaacaacgtaa

SEQ ID NO: 53825 - DNA, 75 bp, Artificial Sequence
  Synthetic
tgggcaagaaggagaagaagccgtcctctttcggcgaggcacgaggatcaaggattatctggtacatgtggctcg

SEQ ID NO: 53826 - DNA, 75 bp, Artificial Sequence
  Synthetic
ggtgcatgcgttggatggtcgtgtagttggactgtacggttatggatttttcattggatggaagtaccactccct

SEQ ID NO: 53827 - DNA, 75 bp, Artificial Sequence
  Synthetic
gatcacaagcggagaagttaccgcagaggaaaactttgaggaagacacagtttcgcgccggttcgttgattggca

SEQ ID NO: 53828 - DNA, 75 bp, Artificial Sequence
  Synthetic
atcatgcaaaaaggcaagtggatgattgcagatgatgttgccggatgggacacgcgcataactgaagctgacctg

SEQ ID NO: 53829 - DNA, 75 bp, Artificial Sequence
  Synthetic
tccgggaaaggggaagaccagacgcgtgttggttgaagaggccaaatctcacatcgcaaaagagaaacgcctgct

SEQ ID NO: 53830 - DNA, 75 bp, Artificial Sequence
  Synthetic
cacgcgcataactgaagctgacctggaggacgagttgtggttcttgctggaccaagtgactgacccctaccacgc

SEQ ID NO: 53831 - DNA, 75 bp, Artificial Sequence
  Synthetic
accaagtgactgacccctaccacgcacagttgatacgtgttgtgttcaagttctgctacatgaacatggtcgcct

SEQ ID NO: 53832 - DNA, 75 bp, Artificial Sequence
  Synthetic
tatactgacgcccactcgagttgttaaggatgaagttgtgcgagcgattgctgaggcgtgccctggagttgtggt

SEQ ID NO: 53833 - DNA, 75 bp, Artificial Sequence
  Synthetic
gtttcacgcacagaccaacgcgggtctgggcaagtgaccacctacgctctcaacaccgtgacgaatgggaagaac

SEQ ID NO: 53834 - DNA, 75 bp, Artificial Sequence
  Synthetic
aatttccgcgcgaattaacagcatcgtgggtccgtggacaagcgaatggcaagacgataatattcgttcccacac

SEQ ID NO: 53835 - DNA, 75 bp, Artificial Sequence
  Synthetic
cacaccagtctaaggtacatcaccgccgcgtcaaaaacgcgcaagaacttgcaaccgaccgagccttccccgagg

SEQ ID NO: 53836 - DNA, 75 bp, Artificial Sequence
  Synthetic
tacacaaactgggaacatgttgaattctgttcccatcactaccatcctctcgtgctgcaggacggtcgtgagatc

SEQ ID NO: 53837 - DNA, 75 bp, Artificial Sequence
  Synthetic
tctgttcccatcactaccatcctctcgtgctgcaggacggtcgtgagatcattgctccgtgtcgtgaccaacacg

SEQ ID NO: 53838 - DNA, 75 bp, Artificial Sequence
  Synthetic
gcagccgggtgcctagcaaaggcacatgctcaaatgtgggcattgtactacttccaccggagggatttgcggctc

SEQ ID NO: 53839 - DNA, 75 bp, Artificial Sequence
  Synthetic
cacgctgaatggatgacgacacaggacatgctagaagtgtggaacaccgtgtggattgtcaacaacccatggatg

SEQ ID NO: 53840 - DNA, 75 bp, Artificial Sequence
  Synthetic
tgcgacgagcttgaagatcaggacggaagctggtgatcacaagtacgctccccgattccatgacgatcgtttcga

SEQ ID NO: 53841 - DNA, 75 bp, Artificial Sequence
  Synthetic
gtggctttccgtgacacgaacctagaacggcttggtacatcttatcgctcggcgattgagattctacatgaaatc

SEQ ID NO: 53842 - DNA, 75 bp, Artificial Sequence
  Synthetic
gcgataccgagctccaactgacgacgtgttctggtaagaatcacgcgactcgtagagaacaacttctctagaaaa

SEQ ID NO: 53843 - DNA, 75 bp, Artificial Sequence
  Synthetic
gggatggtcactggaattgtgctgctcgtcatgtttgtagtggtttgtcggatcgtgaagtggttgttcggtgga

SEQ ID NO: 53844 - DNA, 75 bp, Artificial Sequence
  Synthetic
ggttaacgttgcgaagcaacgggaaccccgtaaggaaggacaaggctgtccttgagtgctaacgacactccggcc

SEQ ID NO: 53845 - DNA, 75 bp, Artificial Sequence
  Synthetic
cttgagtgctaacgacactccggccccagttcccagagccagggttttagctccgcggtgctggaagacaccctc

SEQ ID NO: 53846 - DNA, 75 bp, Artificial Sequence
  Synthetic
aaggaaggacatggctgtccttgggtactaacgacaccccgcccccagttctcaaggttagagttataacctcag

SEQ ID NO: 53847 - DNA, 75 bp, Artificial Sequence
  Synthetic
tactaacgacaccccgcccccagttctcaaggttagagttataacctcagggtgttggaagacatccaggccaga

SEQ ID NO: 53848 - DNA, 75 bp, Artificial Sequence
  Synthetic
cccacaagcatctttcgcgcggccagaggttctagagttgcacatcacatctcttcctggagcgctggttgtgag

SEQ ID NO: 53849 - DNA, 75 bp, Artificial Sequence
  Synthetic
tcctcatcgcgcgcaccagcaagaaagatctcgacgatgagataacaggacgagacggggtgacgcggggccggc

SEQ ID NO: 53850 - DNA, 75 bp, Artificial Sequence
  Synthetic
caaccttttacgcgctacaaatatgttgttccctgctgtggacagtcacgtcgcctagcctgaagcatgctgtcg

SEQ ID NO: 53851 - DNA, 75 bp, Artificial Sequence
  Synthetic
agtttttaaaaactttggcttggttacaccgctgattggttacacctacataaggcttgagttgtttataatagt

SEQ ID NO: 53852 - DNA, 75 bp, Artificial Sequence
  Synthetic
tcgcctagcctgaagcatgctgtcgtgagtgtggtggtgattgtgttcgcattcctcacgtttcgtcgtcccaat

SEQ ID NO: 53853 - DNA, 75 bp, Artificial Sequence
  Synthetic
taaggcttgagttgtttataatagtcgtttttctcgcaaaaatgggaaaggacgacggtaagaagaagaaggagc

SEQ ID NO: 53854 - DNA, 75 bp, Artificial Sequence
  Synthetic
taggctcctccaggtggttgctaccatcggagcgcgctggcttaggaaggaaggaggagaaaaagaagaaggaga

SEQ ID NO: 53855 - DNA, 75 bp, Artificial Sequence
  Synthetic
gatcttcgctgaacctgggcaggtttttctggtaggtgctagtttactgttttggttcgtggcgcatcagtcacg

SEQ ID NO: 53856 - DNA, 75 bp, Artificial Sequence
  Synthetic
agagaagtgtgcggagcacacctcagctagtctccggcggtgcgcagcatcgtcgcggaggcggaacgggtccta

SEQ ID NO: 53857 - DNA, 75 bp, Artificial Sequence
  Synthetic
gggccagaggtctgctaggacgcttgggaattggttggggatcgattctccaggaggacattgtgcaggccctca

SEQ ID NO: 53858 - DNA, 75 bp, Artificial Sequence
  Synthetic
tgcacttggtgctggtgctgcactctgttttcatcgcaattgaccgccgcttacgctcactgacacgacgcgtga

SEQ ID NO: 53859 - DNA, 75 bp, Artificial Sequence
  Synthetic
ctgcccttgaggctaaacgctctgcgaagaacgctgtacgaatcacgctcatactcactggcttgatgatggtgc

SEQ ID NO: 53860 - DNA, 75 bp, Artificial Sequence
  Synthetic
tcggcgccgtcgtcattgacatgcaggtttccacggcgaaagggacgcagattttcgaggggaagaccaatcgca

SEQ ID NO: 53861 - DNA, 75 bp, Artificial Sequence
  Synthetic
ccgatcatgtgcacttgttcaagcttcccacggatggctgctggagtggcacattggtgatgaaaaagtgtccca

SEQ ID NO: 53862 - DNA, 75 bp, Artificial Sequence
  Synthetic
acgattgtgtgcgacataggcgagagtgatccccggcctgaggtggagaaaacaagaacgctgaaagtgctgacg

SEQ ID NO: 53863 - DNA, 75 bp, Artificial Sequence
  Synthetic
aggttgctgatctcgcgaaagatcttgaaggagtggattgtggttcatcatggacggaattcactctgcgttacc

SEQ ID NO: 53864 - DNA, 75 bp, Artificial Sequence
  Synthetic
accggtgtgtgccgaagaagcgtgagcgacgagctgccaacaccaaccagaagctagactttctagcagaggtgg

SEQ ID NO: 53865 - DNA, 75 bp, Artificial Sequence
  Synthetic
aactggtgacgttcaaggccataagggagaacaagaccatcgctatcatcgtcttgttgtgcgtggccattgcga

SEQ ID NO: 53866 - DNA, 75 bp, Artificial Sequence
  Synthetic
agaggtggccgatgtgggtggtaatactacttgcaattggaacgtggaccacggtgaagggagaatttgttgagc

SEQ ID NO: 53867 - DNA, 75 bp, Artificial Sequence
  Synthetic
cgttatacacgctgaaggcggaaaagatgaccatgctgcagacaatcatgcgaccagacgaaagctacgtgattt

SEQ ID NO: 53868 - DNA, 75 bp, Artificial Sequence
  Synthetic
ccacgccgaacggacttcttgagttccgcactggagcagccgagatatatggcggccaatggatgcgtgagttgc

SEQ ID NO: 53869 - DNA, 75 bp, Artificial Sequence
  Synthetic
tcgctgattgtcatgcaaatgcgtcttattcgactgatgtgtgtcccggaggatcgcagttgaacatgggtgaga

SEQ ID NO: 53870 - DNA, 75 bp, Artificial Sequence
  Synthetic
aaggagatgccatggaacaaggtgcaagaagcattagctgaccccgtcttttggcgtatggtggctgatgaacgc

SEQ ID NO: 53871 - DNA, 75 bp, Artificial Sequence
  Synthetic
tcaacggcaaagaacgcgtttgctcaacccagccctacaatcgtggatggggaactggatgtttcaagtggggga

SEQ ID NO: 53872 - DNA, 75 bp, Artificial Sequence
  Synthetic
tcgggtttgttgccacttgtgttgaactgcactgcgaagaaggttacaatgtctcgtcaatcgctaggtcatcca

SEQ ID NO: 53873 - DNA, 75 bp, Artificial Sequence
  Synthetic
aattgtgcgtgttcaacacaatgggcaagaaggagaagaagccgtcctctttcggcgaagcacgaggatcaagga

SEQ ID NO: 53874 - DNA, 75 bp, Artificial Sequence
  Synthetic
tcgtgatgaacatcacagcgaagttccactcagtggatgacgtccagcaactcatcagtgatgttcctgtgactt

SEQ ID NO: 53875 - DNA, 75 bp, Artificial Sequence
  Synthetic
ttcggtttgcaaaattgggcaatgccgctgtcacttgccggctggaatctgagcgattgcttttggactactacc

SEQ ID NO: 53876 - DNA, 75 bp, Artificial Sequence
  Synthetic
atgtgacgggcaaataccacgaaggattgtttgtgcggtcgcaaattgatgagtggccaggagcgcacgccactg

SEQ ID NO: 53877 - DNA, 75 bp, Artificial Sequence
  Synthetic
cgagtggaagagctggtttggaacgaatcgtggtttggggagacgccagggctaatgaagttcttgtgaagaaca

SEQ ID NO: 53878 - DNA, 75 bp, Artificial Sequence
  Synthetic
gctactggatgcgccgttggagatgatcgatgggtggctaggttcccatctggaagagattttgagtggaatggt

SEQ ID NO: 53879 - DNA, 75 bp, Artificial Sequence
  Synthetic
tcctggaacctcaacttatatgggacaacgctattgccactcaagacggttttcgtgatgttggcttctcttgcc

SEQ ID NO: 53880 - DNA, 75 bp, Artificial Sequence
  Synthetic
agatcatgcttgacaagttggttagcggcagtttcaaggattgtccggggatcaaatcttcggtgtttgtccaaa

SEQ ID NO: 53881 - DNA, 75 bp, Artificial Sequence
  Synthetic
gtggtttcggctatgatggagtggtgatgacaagtttgtccaaggcgactaacgaaagctgctcggttgggttga

SEQ ID NO: 53882 - DNA, 75 bp, Artificial Sequence
  Synthetic
ggggggatcgtggacatgtcagcagccgggtgtctagcaaaggcacatgctcaaatgtgggcactgtactacttc

SEQ ID NO: 53883 - DNA, 75 bp, Artificial Sequence
  Synthetic
cgtgccatggatgctacctcctcgcgacgaagatggtgttcggacctggaacttcgactgcaaaggctttcgttg

SEQ ID NO: 53884 - DNA, 75 bp, Artificial Sequence
  Synthetic
gacgaagatggtgttcggacctggaacttcgactgcaaaggctttcgttgggtgtggaaatcacaccgggaccct

SEQ ID NO: 53885 - DNA, 75 bp, Artificial Sequence
  Synthetic
caccggagggatttgcggctcggatttgccgctatcacgtcggccgtcccggtgaactggatccccacggggcgg

SEQ ID NO: 53886 - DNA, 75 bp, Artificial Sequence
  Synthetic
tgtgattggaggaacgacaatccacgttgagtgcgtgttgaatccgatttcgcaaggttggagaatggccaaaca

SEQ ID NO: 53887 - DNA, 75 bp, Artificial Sequence
  Synthetic
tgtggttgacaaataccggaggtttggcaccgctggagtaggaggtgtatggtacgattttgttggaaagttttc

SEQ ID NO: 53888 - DNA, 75 bp, Artificial Sequence
  Synthetic
agagataccatacctcccgaagacgaaggacataaactgtggaagtttgatcggtgagcgggacagggcagcgtg

SEQ ID NO: 53889 - DNA, 75 bp, Artificial Sequence
  Synthetic
attgttcagcctgctgtccagctcgacgattctcgttgggctagctgctttggtgttgctcgacaaacggattgt

SEQ ID NO: 53890 - DNA, 75 bp, Artificial Sequence
  Synthetic
tttcttgctgctgttgtgcggatacttcatctacaccaaggccgatgtgggttgcggatttgaccccgagagaaa

SEQ ID NO: 53891 - DNA, 75 bp, Artificial Sequence
  Synthetic
ggtcgtgtcctgcggatccggagggttcgtgtggaaaagcttgtctcagtggccgacccgagaacactctgttga

SEQ ID NO: 53892 - DNA, 75 bp, Artificial Sequence
  Synthetic
actcgatgaccagcacctgatcacggctcttgtctcggaacagttgaagaagacgaacaaggtgtgcatcatctg

SEQ ID NO: 53893 - DNA, 75 bp, Artificial Sequence
  Synthetic
agtgccaacgacgctccggccccagttcccagagccagggttttagctccacggtgctggaagacaccctcgcgg

SEQ ID NO: 53894 - DNA, 75 bp, Artificial Sequence
  Synthetic
agacgaacaaggtgtgcatcatctgtgaggatgtcctacaatgcgccgccgctcgtggtgctgttggagacatta

SEQ ID NO: 53895 - DNA, 75 bp, Artificial Sequence
  Synthetic
aacgacaccccgcccccagttctcaaggttagagttataacctcagggtgttggaagacatccaggccagagcag

SEQ ID NO: 53896 - DNA, 75 bp, Artificial Sequence
  Synthetic
cccacgttgacaatgaaattgtttacgttaacacttcgttgtcttttgacaggacttttcctcgaattccgaaaa

SEQ ID NO: 53897 - DNA, 75 bp, Artificial Sequence
  Synthetic
ttggaagacatccaggccagagcagggccatcgcaagggaggattttcctcgggtactgaccataccccgacccc

SEQ ID NO: 53898 - DNA, 75 bp, Artificial Sequence
  Synthetic
aagtccatggcgttaagatcggtgacctaacaatgcagctagccctggcttcagttgggggagcggtcgatccga

SEQ ID NO: 53899 - DNA, 75 bp, Artificial Sequence
  Synthetic
gctggtctccggcggtgcgcagcaccgccgcggaggcggaacaggtcctagggccggaggtctactaggacgttt

SEQ ID NO: 53900 - DNA, 75 bp, Artificial Sequence
  Synthetic
gccaatatggtgagctgagtagtgggttcttgagccgcaccaagatcgcggaaactggtgagcacaaggtcatcc

SEQ ID NO: 53901 - DNA, 75 bp, Artificial Sequence
  Synthetic
gcgtgataactagtgcctctccatatgaaaagatctgcgagcaagcgtttgctctgcagtacggtttcgtccgat

SEQ ID NO: 53902 - DNA, 75 bp, Artificial Sequence
  Synthetic
ttacccgcagggtgtttggctcaaatgtcgtggtcaagcccgtggcaaaaccgacagattactgccccacgtacc

SEQ ID NO: 53903 - DNA, 75 bp, Artificial Sequence
  Synthetic
tagcagggtcgtttgtgaagaatgacataggcgcgtacactgacgggatgatgtggatgaagagcaagaaagtga

SEQ ID NO: 53904 - DNA, 75 bp, Artificial Sequence
  Synthetic
acggaacgtggactttggttgacctggagctgacacagagccatcaatgcatttggccccaagcgtacacgtttg

SEQ ID NO: 53905 - DNA, 75 bp, Artificial Sequence
  Synthetic
atttgacagcctttaacgactcgtctctgttcatgccggcgcaatacggagctccgatgtccaaagccaaccaca

SEQ ID NO: 53906 - DNA, 75 bp, Artificial Sequence
  Synthetic
taccgggctacaagacgcaaacagagttcccttggtacaaggcagatatcgtgttgcgcgaaggagtggtccctg

SEQ ID NO: 53907 - DNA, 75 bp, Artificial Sequence
  Synthetic
gatgaccatgttgcagacaataatgcgaccagacgaaagctacgtgatttccacgccgaatggacttctcgagtt

SEQ ID NO: 53908 - DNA, 75 bp, Artificial Sequence
  Synthetic
gaacgcaggttgaagagagcccatcttgtgataatcgcgggtccgcagtgaaagttgatcccgctatcgcaaaaa

SEQ ID NO: 53909 - DNA, 75 bp, Artificial Sequence
  Synthetic
agtggtgttgtaagacgtgcctctcagctgacaaacgggtgtttcacttcaaggtcgacaacgattacttctacc

SEQ ID NO: 53910 - DNA, 75 bp, Artificial Sequence
  Synthetic
caatggagatccgaccagcggcgacccaaccagaagtgaccattgacgctgacggtgaagacatggacgagatgg

SEQ ID NO: 53911 - DNA, 75 bp, Artificial Sequence
  Synthetic
catcaatgttcgggacaatgaaagcagtcgtgccgccagtggaagggtcctatccggatttccggctaagcccat

SEQ ID NO: 53912 - DNA, 75 bp, Artificial Sequence
  Synthetic
acgtgacaggcaaacaccacgaaggattgtttgtgcggtctcaaatcgatgagtggcccggagcgcacgccactg

SEQ ID NO: 53913 - DNA, 75 bp, Artificial Sequence
  Synthetic
ccgtggagggagtttctcccctactggtgggcgctcttttgcatctgctgaccattcgaaccaaacatcgatggg

SEQ ID NO: 53914 - DNA, 75 bp, Artificial Sequence
  Synthetic
cccaacgcacatgtggaacttggattttgttcctcctgtttggagtgccatcaaacacctatgccgggtggtctt

SEQ ID NO: 53915 - DNA, 75 bp, Artificial Sequence
  Synthetic
agatcatgcttgacaaactggttagcggtagttttaaggattgcccggggatcaagtcttcagtcttcgtccaaa

SEQ ID NO: 53916 - DNA, 75 bp, Artificial Sequence
  Synthetic
ggattggattgtcgtactcgctcgctgctgttccgaatggttcagcactgttggtgcacttctggctggcagttc

SEQ ID NO: 53917 - DNA, 75 bp, Artificial Sequence
  Synthetic
agctctcgtcatcgcacttgttctttttgggatgggcactacggcaacgtgtacgatcatcagttgggtacgcat

SEQ ID NO: 53918 - DNA, 75 bp, Artificial Sequence
  Synthetic
acgattctcgtcgggctggctgctctggtgtttcttgacaaacggattgtgttcttgctacttttgtgcggatac

SEQ ID NO: 53919 - DNA, 75 bp, Artificial Sequence
  Synthetic
cccacgttgacaatgagattgtttacgttaacacctcgttgtcttttgacaggacttttcctcgaattccgaaga

SEQ ID NO: 53920 - DNA, 75 bp, Artificial Sequence
  Synthetic
agttgcgacggccacggtaacaggaggtgccctggtgatttgttccattcgcgtgtacaagaactggggatgctc

SEQ ID NO: 53921 - DNA, 75 bp, Artificial Sequence
  Synthetic
tccgaacttgtggaggagtggacttcgagcttcgaagccctcattactagctggaatgtgcttagcgggattgta

SEQ ID NO: 53922 - DNA, 75 bp, Artificial Sequence
  Synthetic
cgtgctctcaacgtgtctcgagttttatcagatgccgacgacggcatcagtggtgttcctggggggactgctaat

SEQ ID NO: 53923 - DNA, 75 bp, Artificial Sequence
  Synthetic
cgggatagtgaccaggatggctcctccaacacacctggagttggttccagtggctggaacaggggtgccgttgga

SEQ ID NO: 53924 - DNA, 75 bp, Artificial Sequence
  Synthetic
ccaacacacctggagttggttccagtggctggaacaggggtgccgttggactgcgaggaagagcccacaacactt

SEQ ID NO: 53925 - DNA, 75 bp, Artificial Sequence
  Synthetic
aaggtcgacaacgattacttctaccccatggagattcgaccagcggctgttcaaccagaggtgaccattgacgct

SEQ ID NO: 53926 - DNA, 75 bp, Artificial Sequence
  Synthetic
ccgtctggattagaaggaacttacggtccggatggagtggaattcacgaacttgacggacaacagtagagtatca

SEQ ID NO: 53927 - DNA, 75 bp, Artificial Sequence
  Synthetic
atggggttgttggtttacgttggctgcatgggagtcatggccatgaacacctacgttggagtcatcctgatgtgc

SEQ ID NO: 53928 - DNA, 75 bp, Artificial Sequence
  Synthetic
gcttgctggtggacgaacgctcctgagtggctgcctctttacgtagctggatcatcgatctttcgatccaacgag

SEQ ID NO: 53929 - DNA, 75 bp, Artificial Sequence
  Synthetic
gtgaacgacgttcttattacccctccagagtacgagcaggaagcgcagttaagcaacgacttcgggcacctgcca

SEQ ID NO: 53930 - DNA, 75 bp, Artificial Sequence
  Synthetic
gacggaacatatcgggtagtcgctcgctcactgttcatgaccagccacgtgggagcaggttatgccaaggacggt

SEQ ID NO: 53931 - DNA, 75 bp, Artificial Sequence
  Synthetic
gtgttcaacacgctatggcatgtgacatctggtggaagtctcacttggcaagggagacacgtacgcctacactcc

SEQ ID NO: 53932 - DNA, 75 bp, Artificial Sequence
  Synthetic
cgtatggcggatcgtggaacattgctgattcccccgagagctcagtggttgtgcgtgtcgtgcagaacgatggca

SEQ ID NO: 53933 - DNA, 75 bp, Artificial Sequence
  Synthetic
ggtgatgtttatcgagacatggcctcgtatggtggaccgtggaacatcgctgattcacctgagagctcggtggtt

SEQ ID NO: 53934 - DNA, 75 bp, Artificial Sequence
  Synthetic
cgtgtccaggtcattggccatgactatggaaaaggatcgtcaggatctccggtgcatgcgttggatggtcgtgtc

SEQ ID NO: 53935 - DNA, 75 bp, Artificial Sequence
  Synthetic
gtccgcgttgtgcagaacgatggtagtgtgttgtgtgctagaagttctacggctagcattagcgttgatgggaag

SEQ ID NO: 53936 - DNA, 75 bp, Artificial Sequence
  Synthetic
cgtgttcaggtcatcggccatgactatggaaaaggatcgtcaggatctccggtgcatgcgttggatggccgcgtt

SEQ ID NO: 53937 - DNA, 75 bp, Artificial Sequence
  Synthetic
gttggtctgtatgggtatggatttttcatcggatggaagtatcactccttgatcacaagtggagaagtcgttgca

SEQ ID NO: 53938 - DNA, 75 bp, Artificial Sequence
  Synthetic
gaggacactgttgaggaagacacggtttctcggcggttcgttgattggcacccaggaaaaggaaagaccagacgg

SEQ ID NO: 53939 - DNA, 75 bp, Artificial Sequence
  Synthetic
gtgggtccgtggacaagcgaatggcaagacgataatattcgttcccacacagcaccaagccaacactttggctag

SEQ ID NO: 53940 - DNA, 75 bp, Artificial Sequence
  Synthetic
tgaacttggaggagtttcactgacccgcgaatcgtttgacgttgcgatcggaaaagcccgcaagcaggagacaca

SEQ ID NO: 53941 - DNA, 75 bp, Artificial Sequence
  Synthetic
cgcgaatcgtttgacgttgcgatcggaaaagcccgcaagcaggagacacagttcatcgtgtcgacagacatcagc

SEQ ID NO: 53942 - DNA, 75 bp, Artificial Sequence
  Synthetic
gtattggtcgaggaggctaaatcccacatcgcaaaagagaaacgtctgctaattctcacgcccactcgagttgtc

SEQ ID NO: 53943 - DNA, 75 bp, Artificial Sequence
  Synthetic
aaggatgaggttgtgcgggccatcgctgaggcgtgccctggagtcgtggtagggtcaaacctagcgatgtaccgg

SEQ ID NO: 53944 - DNA, 75 bp, Artificial Sequence
  Synthetic
agacggtcattgacacgcgtgtggcagtaaagcctgtcattagcgaaggttccgtcatgctggagaaagttggca

SEQ ID NO: 53945 - DNA, 75 bp, Artificial Sequence
  Synthetic
aggaatgccatcacggtggcttgccacgcgacgctaacgcagtatctgatggaaaagggcattgacagcattcgg

SEQ ID NO: 53946 - DNA, 75 bp, Artificial Sequence
  Synthetic
ttctccaccatcataatggatgaatgccatttcctggaccccctgtctattgcttgccgtggggtcatggattac

SEQ ID NO: 53947 - DNA, 75 bp, Artificial Sequence
  Synthetic
tacaatgggaaaggagtggccgtggtgtacatgagtgcgaccccccctggatgcgccggaaacaacggatcaaat

SEQ ID NO: 53948 - DNA, 75 bp, Artificial Sequence
  Synthetic
catcccattgccgacgtagcaacgcaatttccgcgtgagttgacagcatcgtgggttcgtggacaagcgaatggc

SEQ ID NO: 53949 - DNA, 75 bp, Artificial Sequence
  Synthetic
aagacgataatatttgttcccacgcagcaccaggctaacactttggctagtgagcttggaggagtttcactaacc

SEQ ID NO: 53950 - DNA, 75 bp, Artificial Sequence
  Synthetic
cgcgaatcgtttgacgtggcgatcgggaaggctcgcagacaggagacacagttcatcgtgtcgacagacatcagt

SEQ ID NO: 53951 - DNA, 75 bp, Artificial Sequence
  Synthetic
tcgtcatgttcgtggtggtttgtcggatcgtgaagtggctgttcggtggaaaggcaaccgcacaacaaagccctc

SEQ ID NO: 53952 - DNA, 75 bp, Artificial Sequence
  Synthetic
gagatgggagcaaatctcggtgtgcagacggttattgacacgcgtgtggcagtgaaacctgtcattagcgaaggt

SEQ ID NO: 53953 - DNA, 75 bp, Artificial Sequence
  Synthetic
tatgtgcggtggttgctggcattcctcccgccttcgttttcgttgcggtgctgggattgttcgtgataatgtgct

SEQ ID NO: 53954 - DNA, 75 bp, Artificial Sequence
  Synthetic
tctgttatgctggagaaggttggcatcacacaagcatcagctatccagcgccgtggaaggacaggacgtagggag

SEQ ID NO: 53955 - DNA, 75 bp, Artificial Sequence
  Synthetic
gcaggaaagtacgtttaccccattgggtctgagttggagaacgaagccactgagtgggcctgctggactgaagcc

SEQ ID NO: 53956 - DNA, 75 bp, Artificial Sequence
  Synthetic
caaatgatcttagatcagatggcgtgcggaccgatgcgtgaggagatcgaaaacttccagccacagggtacatat

SEQ ID NO: 53957 - DNA, 75 bp, Artificial Sequence
  Synthetic
ctcttggcacctgaaagccgaccccggttcatcaacttcatcaagaaagatgttccagtttggcttgcatggcac

SEQ ID NO: 53958 - DNA, 75 bp, Artificial Sequence
  Synthetic
tttcctgggagacgatggtgccaatcgcctttgctgggttcttcgcaaccacgtttgtgacgaagatctacgggt

SEQ ID NO: 53959 - DNA, 75 bp, Artificial Sequence
  Synthetic
tgggcgaacgcgtttgagcataagcattcagtgctgttccaaggacagaacgctacgagcttaaagatcaggaca

SEQ ID NO: 53960 - DNA, 75 bp, Artificial Sequence
  Synthetic
gaagctggtgatcacaagtacgcccctcgattccatgatgatcgtttcgaaaagaacaatgagttggacaaacgc

SEQ ID NO: 53961 - DNA, 75 bp, Artificial Sequence
  Synthetic
tccaagatcatgctgtatctcaaacagcggagcaatttcaacttcgatctggggggcgttctgtatgggctgttc

SEQ ID NO: 53962 - DNA, 75 bp, Artificial Sequence
  Synthetic
gtggcattccgtgacacgaacctggagcgacttggcacttcctaccgctcggcgattgagattctccatgagatc

SEQ ID NO: 53963 - DNA, 75 bp, Artificial Sequence
  Synthetic
tccaacgttgatgatccaatggtttcaaacgtggtgatgggaaagtcattgcaagcttgggcggccgtcatcatt

SEQ ID NO: 53964 - DNA, 75 bp, Artificial Sequence
  Synthetic
gggatggtcactggcatcgtgctgctggttgtgtttgtggtggtttgtcgctgcgtgaagaggctgttcggtgga

SEQ ID NO: 53965 - DNA, 75 bp, Artificial Sequence
  Synthetic
cggtttgaagatggatgagcttatcaggaagttccaatgggaaccaaagggggctgcacttgacttaggatgtgg

SEQ ID NO: 53966 - DNA, 75 bp, Artificial Sequence
  Synthetic
aaggccgcggcgcagcaaagccccccgtactcaagcttcccaacagtacaagcggccggattttgccaattcgga

SEQ ID NO: 53967 - DNA, 75 bp, Artificial Sequence
  Synthetic
tcaatggtgatggccatcggaccactgtgtgcagtggttgctggcatcccccccgcctttgtttttgttgcagtg

SEQ ID NO: 53968 - DNA, 75 bp, Artificial Sequence
  Synthetic
aagacgaagggacacaacctagccgtgctaaaagccggtgttgacgtgtacgcgcttgagccgcgagactgcaac

SEQ ID NO: 53969 - DNA, 75 bp, Artificial Sequence
  Synthetic
ctggggctgttcgtgataatgtgttgtagcgcgaacaacgtgcaccgggcttacaccactgacaccgtcacgctt

SEQ ID NO: 53970 - DNA, 75 bp, Artificial Sequence
  Synthetic
atgctcgagaaatggttagtccacaatccaggtgctgcgttctgttgtaaggtgttgtctccgtaccacctcgaa

SEQ ID NO: 53971 - DNA, 75 bp, Artificial Sequence
  Synthetic
gttgtcatcggcgtctgcgtgtgtgttatgggggttgtcgcatgggagatggacctccttcctaacattcgacgg

SEQ ID NO: 53972 - DNA, 75 bp, Artificial Sequence
  Synthetic
gtgctgcgcaagctagagatgcttcagcacaagcacaatggaaagttggtcaggttgtccttgagccggaactcc

SEQ ID NO: 53973 - DNA, 75 bp, Artificial Sequence
  Synthetic
gacttgggttacctcttggaaaggttcgctgcaaagcaagagccggacatcccacaagcatcctttgcacgacca

SEQ ID NO: 53974 - DNA, 75 bp, Artificial Sequence
  Synthetic
accgcagaaatgtactacgtctcaggcccgcgagcgaacatcgtcggctcagtttttcacgtcttaggagctcta

SEQ ID NO: 53975 - DNA, 75 bp, Artificial Sequence
  Synthetic
gaagttccagagttgcacataacgtctcttccaggggcattggttgtaagctttgccatcgcgatcgttggaggg

SEQ ID NO: 53976 - DNA, 75 bp, Artificial Sequence
  Synthetic
gttattgctaactgtctgtccgacagcgggttcttgcgcaagttgttttcgaacgaagagcagtccgctacggta

SEQ ID NO: 53977 - DNA, 75 bp, Artificial Sequence
  Synthetic
ccccgggcaaaagtaaagctgcaggacccgacaatcgttgctggtcgcgtgaagaggttgcgagaggaaaacgcc

SEQ ID NO: 53978 - DNA, 75 bp, Artificial Sequence
  Synthetic
atcggaggcattcagctcgccttgatttcctgggagacgatggtgccaatcgcttttgctggattctttgcaaca

SEQ ID NO: 53979 - DNA, 75 bp, Artificial Sequence
  Synthetic
acgtttgtgacgaagatctatggatgcatggtgggagggatttacctagttctagcccactatgatcggaagtat

SEQ ID NO: 53980 - DNA, 75 bp, Artificial Sequence
  Synthetic
gccttcacagtgaaggcgacaaaggtcctcatcgctcgtaccagcaggaaagatctcgacgatgagataacagga

SEQ ID NO: 53981 - DNA, 75 bp, Artificial Sequence
  Synthetic
cgagacggagtcacgcgagggcggccaactttctacgctctgcaaatatgttgttccctgctgtggacagtcaca

SEQ ID NO: 53982 - DNA, 75 bp, Artificial Sequence
  Synthetic
tcgcctagtctgaagcacgtggtcgtgagcgttgcagtgatcgtgtttgcattcctcacatttcgtcgtccgaac

SEQ ID NO: 53983 - DNA, 75 bp, Artificial Sequence
  Synthetic
ttggcgtatggtggctgatgaacgcgcccggcatctgcgtggagattgtgagttgtgcgtgttcaacacgatggg

SEQ ID NO: 53984 - DNA, 75 bp, Artificial Sequence
  Synthetic
aaccggctgctcgtcacgtttgattattcgagtgtgttgttgatcctgatgatcttcgctgaacctgggcaggtt

SEQ ID NO: 53985 - DNA, 75 bp, Artificial Sequence
  Synthetic
tttctagtgggtgctagtctactgttttggttcgtggcgcaccagtcacgcatggcactacgatcgttggtgaag

SEQ ID NO: 53986 - DNA, 75 bp, Artificial Sequence
  Synthetic
acggacgcttgtggactgggatacagatggaaggagatgctcaacgctctggacaagaatgcgtttgacaagtac

SEQ ID NO: 53987 - DNA, 75 bp, Artificial Sequence
  Synthetic
cgctcccggggggtgaatgaaaccgataagggtgatttcgtttcgcgagggggcctgaagatggatgagctcatc

SEQ ID NO: 53988 - DNA, 75 bp, Artificial Sequence
  Synthetic
aggaagttccaatgggaaccaaggggggccgcgcttgacttggggtgtggccgtggaggatggacccagcgattg

SEQ ID NO: 53989 - DNA, 75 bp, Artificial Sequence
  Synthetic
atcgataggtggttaggttcccatctggaggagattttgagtggaatggtcgtggccggggatgacgtcgtcgtg

SEQ ID NO: 53990 - DNA, 75 bp, Artificial Sequence
  Synthetic
gtaatggacactagggtcaactccgtgacggggttgaccctgggcggagcgagccgggagaatcccttaccgttc

SEQ ID NO: 53991 - DNA, 75 bp, Artificial Sequence
  Synthetic
aaaacgaaggggcacaacttagctgtgttaaaagctggtgttgacgtgtacgcgcttgagccgcgagattgcaac

SEQ ID NO: 53992 - DNA, 75 bp, Artificial Sequence
  Synthetic
acgatcgtgtgtgacataggtgagagtgatccccgaccggaggttgagaagacaagaacgctgaaagtgctaacg

SEQ ID NO: 53993 - DNA, 75 bp, Artificial Sequence
  Synthetic
atgcttgaaaagtggttaatccacaacccaggggctgcgttctgttgtaaggtgttgtctccgtaccaccttgaa

SEQ ID NO: 53994 - DNA, 75 bp, Artificial Sequence
  Synthetic
gtattgcgcaaattggagatgcttcagcataagcacgatggaaagttggttaggttgtccttgagtcggaactcc

SEQ ID NO: 53995 - DNA, 75 bp, Artificial Sequence
  Synthetic
tgaaagacccagtgaagacatggtcagagataccatacctcccgaagacgaaggacataaactgtggaagtttga

SEQ ID NO: 53996 - DNA, 75 bp, Artificial Sequence
  Synthetic
tcggtgagcgggacagggcagcgtggtcgaagaatatcgtggccacagttagtacaactcgacgaatcatcgagc

SEQ ID NO: 53997 - DNA, 75 bp, Artificial Sequence
  Synthetic
actgctgaaatgtactacgtctcaggtccgcgagcaaacatcgttggttcagtttttcacgttttaggagcacta

SEQ ID NO: 53998 - DNA, 75 bp, Artificial Sequence
  Synthetic
attgggcgattcaaacgtaatgatccggtgcagcgagacgctcctccaaagctcgagatgggcactcgaagcgat

SEQ ID NO: 53999 - DNA, 75 bp, Artificial Sequence
  Synthetic
ccccgggcaaaagtgaagctgcaagacccaacaatcgttgcaggtcgcgtgaagcggttgcgagaggaaaacgcc

SEQ ID NO: 54000 - DNA, 75 bp, Artificial Sequence
  Synthetic
aacgttgcgaagcaacgggaaccccgtaagggaggacaaggctgtccttgagtgctaacgacactccggccccag

SEQ ID NO: 54001 - DNA, 75 bp, Artificial Sequence
  Synthetic
agcacatggttcgtagatcgtgaacacccttatcaatcgttcaactatcacgggtcatttgtcactgacgacatc

SEQ ID NO: 54002 - DNA, 75 bp, Artificial Sequence
  Synthetic
ttcccagagccagggctttagctccacggtgctggaagacaccctcgcagccatagctgcacgatgcgcgcaagg

SEQ ID NO: 54003 - DNA, 75 bp, Artificial Sequence
  Synthetic
tctccaggagggcagacggtcaacccgatgatgcgccgaataatgtggccgtgggattttctttctcgtgtgacg

SEQ ID NO: 54004 - DNA, 75 bp, Artificial Sequence
  Synthetic
acgttcatgatgacagacgtgtcaacgtacgctcagcagaagattctgcgtgaaaaggttgacacgctgacgctt

SEQ ID NO: 54005 - DNA, 75 bp, Artificial Sequence
  Synthetic
gttcgtgtcgtgcagaacgatgggagcgtattgtgtgctagaagctccacggcaagtattagcatcgatggaaag

SEQ ID NO: 54006 - DNA, 75 bp, Artificial Sequence
  Synthetic
gaaccagaccagcggactcgggctatcaatcggttgatcatgcggcatttctctgcgatgttcaaacggcgcgga

SEQ ID NO: 54007 - DNA, 75 bp, Artificial Sequence
  Synthetic
gcgtattgtgtgctagaagctccacggcaagtattagcatcgatggaaagcgtgtccaggtcattggccatgact

SEQ ID NO: 54008 - DNA, 75 bp, Artificial Sequence
  Synthetic
ttggccccgcgaattctcactccggtggagtacatgagtaacgtgaaaagcggagctgccattggagggtggagc

SEQ ID NO: 54009 - DNA, 75 bp, Artificial Sequence
  Synthetic
aaggagatgccatggaacaaggtgcaggaggctttagctgaccctgtcttttggcgcatggtggctgacgagcga

SEQ ID NO: 54010 - DNA, 75 bp, Artificial Sequence
  Synthetic
cggtgcagcaggatgctcctccaaagctcgagatgggtactcgaagtgacccccgggcaaaagtgaagctgcagg

SEQ ID NO: 54011 - DNA, 75 bp, Artificial Sequence
  Synthetic
gcccggcatctgcgtggggactgtgagctgtgtgtgttcaacacaatgggcaagaaggaaaagaagccctcctct

SEQ ID NO: 54012 - DNA, 75 bp, Artificial Sequence
  Synthetic
ttcggcgaggcgcgaggatcacggattatctggtacatgtggctcggaagtcggtttttggagtacgaagcactt

SEQ ID NO: 54013 - DNA, 75 bp, Artificial Sequence
  Synthetic
ggatttctcaacgaagaccattgggtagcgaggaaaaacttcccgtgcggagttggcggggtcggagtgaactac

SEQ ID NO: 54014 - DNA, 75 bp, Artificial Sequence
  Synthetic
tttggatactacctcaaggaaatcatgcaaaaagggaagtggatgattgcggatgatgttgccgggtgggacacg

SEQ ID NO: 54015 - DNA, 75 bp, Artificial Sequence
  Synthetic
cgcataactgaagctgacttagaggacgagttgtggttcctgctggaccaagtgaccgatccctaccacgccaag

SEQ ID NO: 54016 - DNA, 75 bp, Artificial Sequence
  Synthetic
actgctagtggaagggccggtttggaacggattgtggtttggggagacgccagagccaatgaagttttagtgaaa

SEQ ID NO: 54017 - DNA, 75 bp, Artificial Sequence
  Synthetic
ttgatacgcgttgtgtttaagttctgctacatgaacatggtcgcgctatttccaaggaaccatccgcagttccga

SEQ ID NO: 54018 - DNA, 75 bp, Artificial Sequence
  Synthetic
agcggaacagtttttgacgtcgtttcacggacggaccaacgcgggtctgggcaagtgaccacttacgctctcaac

SEQ ID NO: 54019 - DNA, 75 bp, Artificial Sequence
  Synthetic
agggatcaagtcctcagtcttcgtccaaagcggtttcggatacgacggagtggtgatgacaagcttgtccaaagc

SEQ ID NO: 54020 - DNA, 75 bp, Artificial Sequence
  Synthetic
caaagcggtttcggatacgacggagtggtgatgacaagcttgtccaaagcaaccaatgagagttgctcggtgggg

SEQ ID NO: 54021 - DNA, 75 bp, Artificial Sequence
  Synthetic
actgtgacgaatgggaagaaccaggttgggagaatgttggaagccgaagggctattggatgcaccgttggaagtg

SEQ ID NO: 54022 - DNA, 75 bp, Artificial Sequence
  Synthetic
atcgatggttggctaagttcccaccttgaagacgtcttgagtggaatggttgtggctggggatgatgtggttgtg

SEQ ID NO: 54023 - DNA, 75 bp, Artificial Sequence
  Synthetic
gcaactaacaacgaaaacttccacaccagtcttcggtacatcactgctgcgtcaaaaacgcgcaagaacttgcaa

SEQ ID NO: 54024 - DNA, 75 bp, Artificial Sequence
  Synthetic
cctaccgaaccgtccccgaggtatacaagctgggaacatgtcgaattctgttcccaccactaccatcctctcgtg

SEQ ID NO: 54025 - DNA, 75 bp, Artificial Sequence
  Synthetic
ctgcaggatggtcgtgagatcattgccccgtgtcgtgaccaacacgagattatcggtcgggcgcggatccagaaa

SEQ ID NO: 54026 - DNA, 75 bp, Artificial Sequence
  Synthetic
ttgaactcgatgaccaacacttgatcacggctcttgtttcggaacagttgaagaagacgaataaagtgtgcatca

SEQ ID NO: 54027 - DNA, 75 bp, Artificial Sequence
  Synthetic
ggaggaatcgtggacatgtccgcagccgggtgcctagcgaaggctcacgcccagatgtgggcgttgtactacttc

SEQ ID NO: 54028 - DNA, 75 bp, Artificial Sequence
  Synthetic
aagaaggttcatggcgtgaaaattggtgacctaacgatgcagctagccctagcttcagttgggggagcggttgat

SEQ ID NO: 54029 - DNA, 75 bp, Artificial Sequence
  Synthetic
catcggagagatctgcgactcggattcgccgccatcacgtcggccgtcccggtaaattggatccccacggggcgg

SEQ ID NO: 54030 - DNA, 75 bp, Artificial Sequence
  Synthetic
atatcgtggtcggttcaccaacacgctgaatggatgacgacacaggacatgctagaggtgtggaacacggtgtgg

SEQ ID NO: 54031 - DNA, 75 bp, Artificial Sequence
  Synthetic
cgcggaaaccagtgaacacaaggtcatccgtgtgataacaagtgcttctccatacgagaagatatgtgagcaagc

SEQ ID NO: 54032 - DNA, 75 bp, Artificial Sequence
  Synthetic
gttcgcgctgcagtacggtttcgtccggttcacccgcagggtgttcggttcaaatgttgtggtcaagcccgtggc

SEQ ID NO: 54033 - DNA, 75 bp, Artificial Sequence
  Synthetic
attgtcaacaacccatggatggcgacgaaggatcaggtgaaggcttggtcagagataccatacctcccgaagacg

SEQ ID NO: 54034 - DNA, 75 bp, Artificial Sequence
  Synthetic
aaggacatcaactgtggaagtttgatcggtgagcgggatagggcagcgtggtcaaagaatatcgtggccaccgtc

SEQ ID NO: 54035 - DNA, 75 bp, Artificial Sequence
  Synthetic
atgcatttggccccaagcctatacgtttgatttgacggctttcaatgattcgtcgctgttcatgccggcacaata

SEQ ID NO: 54036 - DNA, 75 bp, Artificial Sequence
  Synthetic
agcacaacccggcgaatcatcgagcaagaggcaggaagccaaaagttcacggaagggctgcggatacttgggcga

SEQ ID NO: 54037 - DNA, 75 bp, Artificial Sequence
  Synthetic
cggcgctccgatgtctaaagcaaaccatattcctgggtacaagacgcaaacagagtttccttggtacaaagctga

SEQ ID NO: 54038 - DNA, 75 bp, Artificial Sequence
  Synthetic
taccgagctccagccgacgacgtgttctggtgaggatcacgcaggtcgtagaaaactacctctctagaaacggtt

SEQ ID NO: 54039 - DNA, 75 bp, Artificial Sequence
  Synthetic
catcgtgttgcgcgagggagttgtccctgggacgcaggttgaagagagcccatcttgtgacaaccgcgggtccgc

SEQ ID NO: 54040 - DNA, 75 bp, Artificial Sequence
  Synthetic
aacgttgcgaagcaacgggaaccccgcaaggaaggactaggctgtccttgggtgctaacgacactccggccccag

SEQ ID NO: 54041 - DNA, 75 bp, Artificial Sequence
  Synthetic
tgtgaaagttgaccctgccattgccaagaagtggtgttgcaagacgtgcttctcagctgacaagcgggtgtttca

SEQ ID NO: 54042 - DNA, 75 bp, Artificial Sequence
  Synthetic
ttcccagagtcagggtttttgctccacggtgttggaagacaccctcgcggccatggctgcacaatgcgcgcaagg

SEQ ID NO: 54043 - DNA, 75 bp, Artificial Sequence
  Synthetic
aaggacatggctgtccttgggtactaacgacaccccgcccccagttctcaaggttggagttacaacctcaggatg

SEQ ID NO: 54044 - DNA, 75 bp, Artificial Sequence
  Synthetic
ttggaagacatccaggccagagcagggccatcgcaagggaggattttcctcgggtactgaccacaccccgacccc

SEQ ID NO: 54045 - DNA, 75 bp, Artificial Sequence
  Synthetic
agtccaataggtcatggaatggccccgtggtgctgaaagggcatccaaacaagctgagcatcttggagtctgctc

SEQ ID NO: 54046 - DNA, 75 bp, Artificial Sequence
  Synthetic
ccgtaaggaaagcgcaagctttgagcattgacgacgctccggccccagtcccccaggttatggaggaataacccc

SEQ ID NO: 54047 - DNA, 75 bp, Artificial Sequence
  Synthetic
cattgacgacgctccggccccagtcccccaggttatggaggaataaccccgacgtgttggaaggacacgaatcac

SEQ ID NO: 54048 - DNA, 75 bp, Artificial Sequence
  Synthetic
gcttcgtatggcggatcgtggaacattgctgattcccccgagagctcagtggttgttcgtgtcgtgcagaacgat

SEQ ID NO: 54049 - DNA, 75 bp, Artificial Sequence
  Synthetic
ctcagctggtctccggcggtgcgcagcaccgtcgcggaggcggaacaggtcctagggccggaggtctactaggac

SEQ ID NO: 54050 - DNA, 75 bp, Artificial Sequence
  Synthetic
gcttgggaattggctggggatcgattctccaggaggacattgtgcaagcactcatgcacttagtgctggtgctgc

SEQ ID NO: 54051 - DNA, 75 bp, Artificial Sequence
  Synthetic
tgttaaggatgaggttgtgcgggcgatcgctgaggcgtgccccggagttgtagtaggatcaaacctagcgatgta

SEQ ID NO: 54052 - DNA, 75 bp, Artificial Sequence
  Synthetic
acgcttacgctcactgacacggcgcgtgactgcccttgaggcaaaacgctctgcgaagaacgctgcacggattgc

SEQ ID NO: 54053 - DNA, 75 bp, Artificial Sequence
  Synthetic
cgcactgatcatgtgcatttgttcaaactccccacggacggctgctggagtggcacactggttatgaaaaagtgt

SEQ ID NO: 54054 - DNA, 75 bp, Artificial Sequence
  Synthetic
taccatcgatgcgtgccgaagaagcgtgaacgacgagttgccagcaccaaccagaagctagactttttggcggag

SEQ ID NO: 54055 - DNA, 75 bp, Artificial Sequence
  Synthetic
ccagaagctagactttttggcggaggtggaactggtgacgttcaaggctataagggagaacaagaccatcgccat

SEQ ID NO: 54056 - DNA, 75 bp, Artificial Sequence
  Synthetic
catcgtcttgttgtgcgtggctattgcgaagagatggccgatgtgggtggtgatactactcgcaattggaacgtg

SEQ ID NO: 54057 - DNA, 75 bp, Artificial Sequence
  Synthetic
tggcagttaagcctgtcattagcgaaggttccgtcatgctggagaaagttggcatcacacaggcgtcagccatcc

SEQ ID NO: 54058 - DNA, 75 bp, Artificial Sequence
  Synthetic
gcgaagagatggccgatgtgggtggtgatactactcgcaattggaacgtggactacggtgaagggagaatttgtt

SEQ ID NO: 54059 - DNA, 75 bp, Artificial Sequence
  Synthetic
agcgccgtggaagaacaggacgtagggaagcaggaaagtatgtctaccccattgggtctgagttggaaaacgagg

SEQ ID NO: 54060 - DNA, 75 bp, Artificial Sequence
  Synthetic
tcgagaacttccagccacagggccgatacctcttggctcctgaaagtcgaccccggttcattaacttcatcaaga

SEQ ID NO: 54061 - DNA, 75 bp, Artificial Sequence
  Synthetic
atacctcttggctcctgaaagtcgaccccggttcattaacttcatcaagaaggatgttccagtttggcttgcgtg

SEQ ID NO: 54062 - DNA, 75 bp, Artificial Sequence
  Synthetic
atggggaactggatgcttcaagtggggaatcgggtttgtcgccacgtgtgttgaactgcactgtggagaagggta

SEQ ID NO: 54063 - DNA, 75 bp, Artificial Sequence
  Synthetic
caacgtgtcgtcagtcgctaggtcatccatcgtgatgaacatcacggcgaaattccactcagtggatgacgtcca

SEQ ID NO: 54064 - DNA, 75 bp, Artificial Sequence
  Synthetic
tcgaaaagaacaacgagttggacaaacgctccaagatcatgctgtacctcaagcagcggagcaatttcaacttcg

SEQ ID NO: 54065 - DNA, 75 bp, Artificial Sequence
  Synthetic
acttttcgatttgcaaagctgggcaatgccgctgtcacatgccggctagaatcagagcgattgcttcttgactac

SEQ ID NO: 54066 - DNA, 75 bp, Artificial Sequence
  Synthetic
actgctagtggaagggccggtttggaacggattgtggtttggggagacgccagggctaatgaagtgttggtgaaa

SEQ ID NO: 54067 - DNA, 75 bp, Artificial Sequence
  Synthetic
aacatcttggaacctcagctcatatgggataatgctattgccacgcaggacggttttcgtgatgttggcttttcc

SEQ ID NO: 54068 - DNA, 75 bp, Artificial Sequence
  Synthetic
cggttttcgtgatgttggcttttcctgtcagatcatgcttgacaagctggttagcggtagttttaaggattgccc

SEQ ID NO: 54069 - DNA, 75 bp, Artificial Sequence
  Synthetic
agggatcaaatcttcagtcttcgtccaaagcggtttcggatatgacggagtggtgatgacaagcttgtccaaagc

SEQ ID NO: 54070 - DNA, 75 bp, Artificial Sequence
  Synthetic
tacaggtggaaggaaatgcttaacgcgctggacaaaaacgcgtttgacaagtaccgatctcgaggagtgaacgag

SEQ ID NO: 54071 - DNA, 75 bp, Artificial Sequence
  Synthetic
caaagcggtttcggatatgacggagtggtgatgacaagcttgtccaaagccaccaatgagagctgctcggtgggg

SEQ ID NO: 54072 - DNA, 75 bp, Artificial Sequence
  Synthetic
ctgacgtgccacggatgctacctcctcgcgacgaagatggtgttcggacctggaacttcgaccgcaagggcattt

SEQ ID NO: 54073 - DNA, 75 bp, Artificial Sequence
  Synthetic
ggggcggcttgaagatggatgagcttatcaggaagttccaatgggaaccgaagggggctgcacttgacttgggat

SEQ ID NO: 54074 - DNA, 75 bp, Artificial Sequence
  Synthetic
cccttgtgattggaggaacgacaatccacgttgagtgcgtgttgaacccgatttcgcaaggttggagaatggcca

SEQ ID NO: 54075 - DNA, 75 bp, Artificial Sequence
  Synthetic
agcatgtggttgataagtaccgaaggtttggaactgctggagtgggaggcgtgtggcatgactttgttggaaagt

SEQ ID NO: 54076 - DNA, 75 bp, Artificial Sequence
  Synthetic
gtttggaactgctggagtgggaggcgtgtggcatgactttgttggaaagttttcattgttcagcctgttgtccag

SEQ ID NO: 54077 - DNA, 75 bp, Artificial Sequence
  Synthetic
gctctggtgttgcttgacaaacggattgttttcttgctacttgtgtgcggatactttgtctacaccaaggcagat

SEQ ID NO: 54078 - DNA, 75 bp, Artificial Sequence
  Synthetic
agggttcgtgtggaaaagcttgtcacaatggccgacccgggaacattcagttgaactcgatgaccaacacttgat

SEQ ID NO: 54079 - DNA, 75 bp, Artificial Sequence
  Synthetic
ctccaccgcagaaatgtactacgtctcaggcccacgagcgaacattgtcggctcagtttttcacgtcttgggagc

SEQ ID NO: 54080 - DNA, 75 bp, Artificial Sequence
  Synthetic
ttgaactcgatgaccaacacttgatcacggctcttgtttcggaacagttgaagaagacaaacaaagtgtgcatca

SEQ ID NO: 54081 - DNA, 75 bp, Artificial Sequence
  Synthetic
gaacacccttaccaatcattcaactaccacgggtcattcgtcaccgacgatatctctccaggagggcagactgtt

SEQ ID NO: 54082 - DNA, 75 bp, Artificial Sequence
  Synthetic
tgacaggacttttcctcgaattccgaagaaggttcatggcgtaaaaattggtgacctaacaatgcagctagccct

SEQ ID NO: 54083 - DNA, 75 bp, Artificial Sequence
  Synthetic
agcttcagttgggggagcggttgatgccagccaatatggtgagttgagcagtgggttcctgagccgcaccaagat

SEQ ID NO: 54084 - DNA, 75 bp, Artificial Sequence
  Synthetic
cgcggaaaccagtgaacacaaggtcatccgtgtgataacaagtgcctctccatacgagaagatatgtgagcaggc

SEQ ID NO: 54085 - DNA, 75 bp, Artificial Sequence
  Synthetic
gtgcaagaagctttagctgaccctgtcttttggcgtatggtagctgacgaacgcgcccggcacctgcggggagat

SEQ ID NO: 54086 - DNA, 75 bp, Artificial Sequence
  Synthetic
tgggtggcgaggaagaactttccgtgcggagttggcggagtcggagtgaattattttggatactacctccaggaa

SEQ ID NO: 54087 - DNA, 75 bp, Artificial Sequence
  Synthetic
acctggaactgacgcagagccatcaatgcatttggccccaagcctatacgtttgatttgacggcctttaatgatt

SEQ ID NO: 54088 - DNA, 75 bp, Artificial Sequence
  Synthetic
cagagtttccttggtacaaagccgacatcgtgttgcgcgagggagtggtccctggaacgcaggttgaagagagcc

SEQ ID NO: 54089 - DNA, 75 bp, Artificial Sequence
  Synthetic
catctggaagagattttgagtggaatggtcgtggccggggatgacgtggtcgtggcaactaacaatgaaaacttc

SEQ ID NO: 54090 - DNA, 75 bp, Artificial Sequence
  Synthetic
gtcctatccggatttccggctcagcccatctgtggagggagtttctcccctgctggtgggcgcgcttttgcacct

SEQ ID NO: 54091 - DNA, 75 bp, Artificial Sequence
  Synthetic
tgttggcgttcaatctgaaatcacagttcgtacctgtggactcgatggtactgctgaactatgttgtgacgcatc

SEQ ID NO: 54092 - DNA, 75 bp, Artificial Sequence
  Synthetic
ctgcagttgcgacggccatggtaacaggaggtgccctggtgatttattccattcgcgtgtacaagagctggggat

SEQ ID NO: 54093 - DNA, 75 bp, Artificial Sequence
  Synthetic
acatgctagaagtgtggaacaccgtgtggattgtcaacaacccatggatggcggtgaaagacccagtgaagacat

SEQ ID NO: 54094 - DNA, 75 bp, Artificial Sequence
  Synthetic
gtggctggaatgtgcttggcggggttgtacgtgctctcaacgtgtctcgagctgtatcagatgccgacgacggcg

SEQ ID NO: 54095 - DNA, 75 bp, Artificial Sequence
  Synthetic
ccggtggctggaatgggagtgccgttggattgcgaggaagagcccacaacacttccgtctggattagaaggaact

SEQ ID NO: 54096 - DNA, 75 bp, Artificial Sequence
  Synthetic
cgaacttgacggacaacagtagagtgtcaacggggttgctggtttacgtcggctgcatgggaatcatggccatga

SEQ ID NO: 54097 - DNA, 75 bp, Artificial Sequence
  Synthetic
gcgataccgggccccaaccgacgacgtgttctggtgagaatcacgcaactagtagagaacaacatctctagaaaa

SEQ ID NO: 54098 - DNA, 75 bp, Artificial Sequence
  Synthetic
atacctacgtcggggtcatcctgatgtgtgtttgctggtggacaaacgcgcccgagtggctacccctttacgtgg

SEQ ID NO: 54099 - DNA, 75 bp, Artificial Sequence
  Synthetic
gtgtgtttgctggtggacaaacgcgcccgagtggctacccctttacgtggctggagtgtcggtatttcgatctaa

SEQ ID NO: 54100 - DNA, 75 bp, Artificial Sequence
  Synthetic
tgaggtgaacgatgtcctcatcacccctccagagtatgagcaggaagcacagctaagcaacgacttcgggcacct

SEQ ID NO: 54101 - DNA, 75 bp, Artificial Sequence
  Synthetic
ccagttcccagagccagggttttggctccacggtgctggaagacaccctcgcagccatggctgtatgacgagcgc

SEQ ID NO: 54102 - DNA, 75 bp, Artificial Sequence
  Synthetic
cggtgtgttcaacacgctttggcatgtgacatctggtggaagcctcacatggcaagggagaaacgtgcgtctaca

SEQ ID NO: 54103 - DNA, 75 bp, Artificial Sequence
  Synthetic
ctccggcgatgtctaccgggacatggcttcgtatggcggatcgtggaacattgctgactcccccgagagctcagt

SEQ ID NO: 54104 - DNA, 75 bp, Artificial Sequence
  Synthetic
tgagcattgacaacgctccggccccagtcccccaggttatgggagaataaccccgacgtgctgaaagggcacgaa

SEQ ID NO: 54105 - DNA, 75 bp, Artificial Sequence
  Synthetic
ggttgttcgtgttgtgcagaacgatgggagcgtgttgtgtgctagaagctccacggcaagtatcagcatcgatgg

SEQ ID NO: 54106 - DNA, 75 bp, Artificial Sequence
  Synthetic
ccacggcaagtatcagcatcgatggaaagcgtgtccaggtcattggccatgattatggaaaaggatcgtcaggat

SEQ ID NO: 54107 - DNA, 75 bp, Artificial Sequence
  Synthetic
cgcagaggaaaactctgaggaagacacagtttctcgccggttcgttgattggcatccaggaaaggggaagaccag

SEQ ID NO: 54108 - DNA, 75 bp, Artificial Sequence
  Synthetic
acagtttctcgccggttcgttgattggcatccaggaaaggggaagaccagacgcgtgttggttgaagaggccaaa

SEQ ID NO: 54109 - DNA, 75 bp, Artificial Sequence
  Synthetic
ggcatccaggaaaggggaagaccagacgcgtgttggttgaagaggccaaatctcacatcgcaaaagagaaacgtt

SEQ ID NO: 54110 - DNA, 75 bp, Artificial Sequence
  Synthetic
tgctgatactgacgcctactcgagttgtcaaggatgaggttgtgcgggcgatcgctgaggcgtgccctggagttg

SEQ ID NO: 54111 - DNA, 75 bp, Artificial Sequence
  Synthetic
ccggaggaatgccatcacggtggcttgccacgcgacgctaacgcagtatctgatggagaagggcattgacagcat

SEQ ID NO: 54112 - DNA, 75 bp, Artificial Sequence
  Synthetic
ttgaactgcattgcggagaggggtataacgtgtcgtcaatcgctaggtcatccatcgtgatgaacatcacagcga

SEQ ID NO: 54113 - DNA, 75 bp, Artificial Sequence
  Synthetic
ccatcgcctgtcgtggggtcatggattactacaatgggaaaggggtggccgtggtctacatgagcgcgactcccc

SEQ ID NO: 54114 - DNA, 75 bp, Artificial Sequence
  Synthetic
atcagaacgattgcttctcgattactatcacgtgacaggcaagcaccacgaaggactgtttgtgcggtctcaaat

SEQ ID NO: 54115 - DNA, 75 bp, Artificial Sequence
  Synthetic
ctggatgtgctggaaacaacggatcaaatcatcccatcgatgacgtggcgacgcaatttccgcgcgaactaacag

SEQ ID NO: 54116 - DNA, 75 bp, Artificial Sequence
  Synthetic
tggcaagacgataatattcgttcccacacagcaccaagccaacactctggccagtgaacttggaggagtttcact

SEQ ID NO: 54117 - DNA, 75 bp, Artificial Sequence
  Synthetic
ccactgagtgggcttgttggactgaagcacagatgattttagaccagatggcgtgcggaccgatgcgtgaggaga

SEQ ID NO: 54118 - DNA, 75 bp, Artificial Sequence
  Synthetic
agaatgcgacgagcttgaagatcaggacggaggctggtgaccacaagtatgctccccgattccatgacgatcgtt

SEQ ID NO: 54119 - DNA, 75 bp, Artificial Sequence
  Synthetic
gtttcaaacgtggtgatgggtaagtcgctgcaagcttgggcggctgtcatcattgggatggtcactgggattgtg

SEQ ID NO: 54120 - DNA, 75 bp, Artificial Sequence
  Synthetic
ctactcgtcatgtttgtggtggtttgtcgtgtcgtgaagtggctgttcggtggaaaggcaactgcacaacaaagt

SEQ ID NO: 54121 - DNA, 75 bp, Artificial Sequence
  Synthetic
cccccgtactcaagcttcccaacgttacaaacagcaggattttgtcaattcggctcaatggtgatggctatcgga

SEQ ID NO: 54122 - DNA, 75 bp, Artificial Sequence
  Synthetic
ccactgtgtgcggtggttgctggcatcccccccgcattcgtttttgttgcggtgttgggattgttcgtgataatg

SEQ ID NO: 54123 - DNA, 75 bp, Artificial Sequence
  Synthetic
acgcgttttggttgaagaggcaaaatctcacatcgcaaaagagaaacggctgctaatactgacgcccactcgagt

SEQ ID NO: 54124 - DNA, 75 bp, Artificial Sequence
  Synthetic
tgttaaggatgaggttgtgcgggcgattgctgaggcgtgccctggggtcgtggtaggatcaaacctagcgatgta

SEQ ID NO: 54125 - DNA, 75 bp, Artificial Sequence
  Synthetic
gctcgttgtcattggtgtttgcgtgtgtgtcatgggggttgttgcgtgggagatggatctccttcccaacattcg

SEQ ID NO: 54126 - DNA, 75 bp, Artificial Sequence
  Synthetic
acatctctgcctggagcgttggttgtaagctttgccatcgcgatcgttgggggggtcattgttaactgtctgtcc

SEQ ID NO: 54127 - DNA, 75 bp, Artificial Sequence
  Synthetic
ctagtgaacttggaggagtttcactaacccgcgaatcgtttgacgtcgcgatcggaaaagcccgtaagcaggaga

SEQ ID NO: 54128 - DNA, 75 bp, Artificial Sequence
  Synthetic
gacagcggatttctacgcaagttgttttcgaacgaagaacagtcagcgacggtaatcggaggcattcagctcgct

SEQ ID NO: 54129 - DNA, 75 bp, Artificial Sequence
  Synthetic
gcgtgcggaccgatgcgcgaggagatcgagaacttccagccacagggcaggtaccttttggcgcctgaaagtcga

SEQ ID NO: 54130 - DNA, 75 bp, Artificial Sequence
  Synthetic
agaaagatctcgacgatgagataacaggacgagacggggtgacgcgaggccggccaacattttacgcgctgcaaa

SEQ ID NO: 54131 - DNA, 75 bp, Artificial Sequence
  Synthetic
tatgttgttccctgctgtggacagtcacgtcgcctagcctgaagcacgctgtcgtgagtgtggtggtgattgtgt

SEQ ID NO: 54132 - DNA, 75 bp, Artificial Sequence
  Synthetic
cacgtcgcctagcctgaagcacgctgtcgtgagtgtggtggtgattgtgtttgcattcctcacatttcgtcgtcc

SEQ ID NO: 54133 - DNA, 75 bp, Artificial Sequence
  Synthetic
gtcgtgagtgtggtggtgattgtgtttgcattcctcacatttcgtcgtcccaataacaggctgctcgtcacgttt

SEQ ID NO: 54134 - DNA, 75 bp, Artificial Sequence
  Synthetic
caataacaggctgctcgtcacgtttgactactctagcgtgttgttggtcttgatgatcttcgctgaacctgggca

SEQ ID NO: 54135 - DNA, 75 bp, Artificial Sequence
  Synthetic
gtaccgatcccgaggagtgaacgagacagacaagggtgatttcgtctcgcggggcggcctgaagatggatgagct

SEQ ID NO: 54136 - DNA, 75 bp, Artificial Sequence
  Synthetic
ggtttttctggtaggtgccagtctactgttttggttcgtggcgcatcagtcacgcatggcgctacggtcgctggt

SEQ ID NO: 54137 - DNA, 75 bp, Artificial Sequence
  Synthetic
gaagacagacgcctgcggattgggatacaggtggaaggaaatgcttaacgcgctggacaaaaacgcgtttgacaa

SEQ ID NO: 54138 - DNA, 75 bp, Artificial Sequence
  Synthetic
tacaggtggaaggaaatgcttaacgcgctggacaaaaacgcgtttgacaagtaccggtcccgaggagtgaacgag

SEQ ID NO: 54139 - DNA, 75 bp, Artificial Sequence
  Synthetic
acagataagggtgatttcgtctcgcggggcggcttgaagatggatgagcttatcaggaagttccaatgggaacca

SEQ ID NO: 54140 - DNA, 75 bp, Artificial Sequence
  Synthetic
tctggtgatggacactagggtcaactccgtgacggggttgacgctgggtggcgcaaaccgggaaaatcccctacc

SEQ ID NO: 54141 - DNA, 75 bp, Artificial Sequence
  Synthetic
gctcgaaccggaccagcggacccgagctatcaatcggctgatcatgcggcatttctctgctatgttcaaacggcg

SEQ ID NO: 54142 - DNA, 75 bp, Artificial Sequence
  Synthetic
gtttaagacgaagggacacaacctagccgtgctaaaagccggtgtcgacgtgtacgcgcttgagccgcgagactg

SEQ ID NO: 54143 - DNA, 75 bp, Artificial Sequence
  Synthetic
gcggagttggtggggtcggagtgaattactttggatactacctccaggaaatcatgcaaaaaggcaagtggatga

SEQ ID NO: 54144 - DNA, 75 bp, Artificial Sequence
  Synthetic
ctccactgcagaaatgtactacgtctcaggtccgcgagcgaacattgtcggctcagtttttcacgtcttaggagc

SEQ ID NO: 54145 - DNA, 75 bp, Artificial Sequence
  Synthetic
gacccggtgcagcaggatgcccctccaaagctcgagatgggcactcgaagcgacccccgggcaaaagtaaagctg

SEQ ID NO: 54146 - DNA, 75 bp, Artificial Sequence
  Synthetic
ctcatgcacctagtgctggtgctgcacactgttttcaccgcaattgaccgacgcttgcgctcactgacacggcgc

SEQ ID NO: 54147 - DNA, 75 bp, Artificial Sequence
  Synthetic
gctatcaataggttgatcatgcggcatttctctgcgatgttcaaacggcgaggattggctccgagaatcctcact

SEQ ID NO: 54148 - DNA, 75 bp, Artificial Sequence
  Synthetic
aaagcggagccgccattggagggtggagcaaggagatgccatggaacaaggtgcaagaagctttagctgaccctg

SEQ ID NO: 54149 - DNA, 75 bp, Artificial Sequence
  Synthetic
atcagaacgattgcttctcgactactatcacgtgacaggcaagcaccacgagggactgtttgtgcggtctcaaat

SEQ ID NO: 54150 - DNA, 75 bp, Artificial Sequence
  Synthetic
tgtcagatcatgctcgacaagttggttagcggtagtttcaaggattgcccggggatcaagtcttcagtctttgtc

SEQ ID NO: 54151 - DNA, 75 bp, Artificial Sequence
  Synthetic
ggagtcggtttttggagtacgaggcacttggattcctaaacgaggaccattgggttgcgaggaagaactttccgt

SEQ ID NO: 54152 - DNA, 75 bp, Artificial Sequence
  Synthetic
ttgcagatgatgttgccggatgggacacgcgcataaccgaagctgatctggaggacgagttgtggttcctactgg

SEQ ID NO: 54153 - DNA, 75 bp, Artificial Sequence
  Synthetic
ttctgctacatgaacatggtcgccttgtttccaaggaaccatccgcagttccggagcgggacagtttttgacgtc

SEQ ID NO: 54154 - DNA, 75 bp, Artificial Sequence
  Synthetic
caacaccgtgacgaatgggaagaaccaggttggaagaatgctggaagctgaagggctattggacgcgccgttgga

SEQ ID NO: 54155 - DNA, 75 bp, Artificial Sequence
  Synthetic
gatgatcgatgggtggttaggttcccatctggaagagattttgagtggaatggtcgtggccggggatgatgtggt

SEQ ID NO: 54156 - DNA, 75 bp, Artificial Sequence
  Synthetic
tggtcgtggccggggatgatgtggttgtggcaactaacaatgaaaacttccacactagtctaaggtacattaccg

SEQ ID NO: 54157 - DNA, 75 bp, Artificial Sequence
  Synthetic
ccgcgtcaaaaacgcgtaagaacttgcaaccgaccgagccttccccgaggtacacaaactgggaacatgtcgaat

SEQ ID NO: 54158 - DNA, 75 bp, Artificial Sequence
  Synthetic
gcaaccgaccgagccttccccgaggtacacaaactgggaacatgtcgaattctgttcccatcactaccatcctct

SEQ ID NO: 54159 - DNA, 75 bp, Artificial Sequence
  Synthetic
attgccccgtgccgtgaccaacacgagatcatcggtcgagcacggatccagaaagggggtatcgtggacatgtca

SEQ ID NO: 54160 - DNA, 75 bp, Artificial Sequence
  Synthetic
tcccggtgaactggatccccacggggcggatatcgtggtcagtccaccaacacgctgaatggatgacgacacagg

SEQ ID NO: 54161 - DNA, 75 bp, Artificial Sequence
  Synthetic
acatgctagaagtgtggaacaccgtgtggattgtcaacaacccgtggatggcagtgaaagacccagtgaagacat

SEQ ID NO: 54162 - DNA, 75 bp, Artificial Sequence
  Synthetic
gacgatgctcgaaaaatggttagtccacaatccaggtgctgcgttctgttgtaaggtgctgtctccgtaccacct

SEQ ID NO: 54163 - DNA, 75 bp, Artificial Sequence
  Synthetic
ttgatcggtgagcgggacagggcagcgtggtcaaagaatatcgtggccacagttagcacaacacgacgaatcata

SEQ ID NO: 54164 - DNA, 75 bp, Artificial Sequence
  Synthetic
gagcaagaagctggaagtcagaagttcacggaggggttgcggatacttgggcgataccgggccccaaccgacgac

SEQ ID NO: 54165 - DNA, 75 bp, Artificial Sequence
  Synthetic
gcgataccgggccccaaccgacgacgtgttctggtgagaatcacgcgactggtagagaacaacatctctagaaaa

SEQ ID NO: 54166 - DNA, 75 bp, Artificial Sequence
  Synthetic
ggttaacgttgcgaggcaacgggaaccccgtaaggaaggacaaggctgtccttgagtgctaacgacactccggcc

SEQ ID NO: 54167 - DNA, 75 bp, Artificial Sequence
  Synthetic
ccagttcccagagccagggtttcggctccacggtgttggaagacaccctcgcagccatggctgcatgacgcgcgc

SEQ ID NO: 54168 - DNA, 75 bp, Artificial Sequence
  Synthetic
gcgataccgagctccaaccgacgacgtgttctggtgagaaccacgcgacccgtagagaacaaaatctctagtaaa

SEQ ID NO: 54169 - DNA, 75 bp, Artificial Sequence
  Synthetic
accccatggtgctgagagggcatccaaacaagctgagcatcttggattctgctcccgtaaggaaagcgcaagctt

SEQ ID NO: 54170 - DNA, 75 bp, Artificial Sequence
  Synthetic
agtaacagagcatgcctgcagcagcaggtctccaccgttaggagacttgttgtgggcaagctcttgttcacgtct

SEQ ID NO: 54171 - DNA, 75 bp, Artificial Sequence
  Synthetic
agtttttaaaaacttcggcttggttacaccgcagattggttacacctacacaaggcttgagttgtttataatagt

SEQ ID NO: 54172 - DNA, 75 bp, Artificial Sequence
  Synthetic
caaggcttgagttgtttataatagtcgtttttctcgcagaaatgggaaaggacgacggtaagaagaagaaggggc

SEQ ID NO: 54173 - DNA, 75 bp, Artificial Sequence
  Synthetic
accggggcgcgctggcttaggaaggaaggaggagaaaaagaagaaggagaagaggggtgtgcggagcacatctca

SEQ ID NO: 54174 - DNA, 75 bp, Artificial Sequence
  Synthetic
gggccggaggtctactaggacgtttgggagttggctggggatcgattctccaggaggacattgtgcacgcactca

SEQ ID NO: 54175 - DNA, 75 bp, Artificial Sequence
  Synthetic
caaggcttgagttgtttataatagtcgttttctcgcagaaatgggaaaggacgacagtaagaagaagaaggggcc

SEQ ID NO: 54176 - DNA, 75 bp, Artificial Sequence
  Synthetic
ctgatcatgtgcacttgtttaagctccccacggatggctgctggagtggcacattggttatgaaaaagtgcccca

SEQ ID NO: 54177 - DNA, 75 bp, Artificial Sequence
  Synthetic
aactggtgacgttcaaagctataagggagaacaaaaccatcgctatcatcgtcttgttgtgcgtggctattgcga

SEQ ID NO: 54178 - DNA, 75 bp, Artificial Sequence
  Synthetic
gaaggagtggattgtggttcatcatggacggaattcactttgcgctaccatcgatgcgtgccaaagaagcgtgaa

SEQ ID NO: 54179 - DNA, 75 bp, Artificial Sequence
  Synthetic
ggacggaattcactttgcgctaccatcgatgcgtgccaaagaagcgtgaacgacgagttgccagcaccaaccaga

SEQ ID NO: 54180 - DNA, 75 bp, Artificial Sequence
  Synthetic
tcaatggtaaagaacgtgtttgctcaacccagccctacaatcgtggatggggaactggatgcttcaagtggggaa

SEQ ID NO: 54181 - DNA, 75 bp, Artificial Sequence
  Synthetic
gagcgattgcttcttgactactatcacgtgacaggcaaacaccacgaaggactgtttgtgcggtctcaaatcgat

SEQ ID NO: 54182 - DNA, 75 bp, Artificial Sequence
  Synthetic
gattgtggtctggggagacgccagggctaatgaagttttggtgaaaaacattttggaaccccagctcgtctggga

SEQ ID NO: 54183 - DNA, 75 bp, Artificial Sequence
  Synthetic
gacgaagatggtgttcggacctggaacttcgaccgcaagggcatttgttgggtgtgggaatcacaccggaaccct

SEQ ID NO: 54184 - DNA, 75 bp, Artificial Sequence
  Synthetic
tgtggttggaggaacgacaatccacgttgagtgtgtgttgaacccgatttcgcaaggttggagaatggccaagca

SEQ ID NO: 54185 - DNA, 75 bp, Artificial Sequence
  Synthetic
gttgagtgtgtgttgaacccgatttcgcaaggttggagaatggccaagcatgtggttgacaagtaccggaggttt

SEQ ID NO: 54186 - DNA, 75 bp, Artificial Sequence
  Synthetic
cgcaaggttggagaatggccaagcatgtggttgacaagtaccggaggtttggaactgctggagtgggaggcgtgt

SEQ ID NO: 54187 - DNA, 75 bp, Artificial Sequence
  Synthetic
ggcatgactttgttggaaagttttcattgttcagcctgttgtctagctcgacgattctcgtcggactcgccgctc

SEQ ID NO: 54188 - DNA, 75 bp, Artificial Sequence
  Synthetic
ggccgacccgggaacattcagttgaactcgatgaccaacacttgatcacggctcttgttacggaacagttgaaga

SEQ ID NO: 54189 - DNA, 75 bp, Artificial Sequence
  Synthetic
aggttcatggcgtgaaaattggtgacttaaccatgcagctagccctagcttcagttgggggagcggttgacgcca

SEQ ID NO: 54190 - DNA, 75 bp, Artificial Sequence
  Synthetic
gccaatatggtgagttgagcagcgggttcttgagccgcaccaagatcgcggaaaccagtgaacacaaggtcatcc

SEQ ID NO: 54191 - DNA, 75 bp, Artificial Sequence
  Synthetic
gttaacacttcgttgtcttttgacaggacttttcctcgaattccgaagaaggttcatggcgtgaaaattggtgac

SEQ ID NO: 54192 - DNA, 75 bp, Artificial Sequence
  Synthetic
tgttgtggtcaagcccgtggcaaaaccaacagattactgccccacgtacctggccggatcgtttgtgaaaaatga

SEQ ID NO: 54193 - DNA, 75 bp, Artificial Sequence
  Synthetic
ttaacgatgcagctagccctagcttcagttgggggagcggttgatgccagccaatatggtgagttgagcagtggg

SEQ ID NO: 54194 - DNA, 75 bp, Artificial Sequence
  Synthetic
acggaacgtggacattggtcgacctggaactgacgcagagccatcaatgcatttggccccaagcttatacgtttg

SEQ ID NO: 54195 - DNA, 75 bp, Artificial Sequence
  Synthetic
gctgttcatgccggcacaatacggcgctccgatgtctaaagcaaaccacattcctgggtacaagacgcaaacaga

SEQ ID NO: 54196 - DNA, 75 bp, Artificial Sequence
  Synthetic
gctccgatgtctaaagcaaaccacattcctgggtacaagacgcaaacagagttcccttggtacaaagctgatatc

SEQ ID NO: 54197 - DNA, 75 bp, Artificial Sequence
  Synthetic
gttcccttggtacaaagctgatatcgtgttgcgcgagggggtggtccccggaactcaggttgaagagagcccatc

SEQ ID NO: 54198 - DNA, 75 bp, Artificial Sequence
  Synthetic
gaactcaggttgaagagagcccatcttgtgacaaccgcgggtccgctgtgaaagttgaccctgccattgccaaga

SEQ ID NO: 54199 - DNA, 75 bp, Artificial Sequence
  Synthetic
tgtggatgaagagcaggaaggtgaacggaacgtggacattggtcgacctggaactgacgcagagccatcaatgca

SEQ ID NO: 54200 - DNA, 75 bp, Artificial Sequence
  Synthetic
agtggtgttgcaagacgtgcttctcagctgacaagcgggtatttcacttcaaggtcgacaacgattacttctacc

SEQ ID NO: 54201 - DNA, 75 bp, Artificial Sequence
  Synthetic
tccaacacctatgtcgggtggtcttggattggattatcgtactcgcttgctgctgttccgaatggtacggctctg

SEQ ID NO: 54202 - DNA, 75 bp, Artificial Sequence
  Synthetic
gcttgttggtggacaaacgcgcccgagtggctacctctctacgtggctggagtatcggtctttcgatccaatgag

SEQ ID NO: 54203 - DNA, 75 bp, Artificial Sequence
  Synthetic
gtgaatgatgtcctcatcacccctccagagtatgagcaggaagcacagctaagcaacgacttcgggcacctgccc

SEQ ID NO: 54204 - DNA, 75 bp, Artificial Sequence
  Synthetic
tgcgaggaagagcccacaacacttccgtctggattagaaggaacttacggaccggatggagtggaattcacgaac

SEQ ID NO: 54205 - DNA, 75 bp, Artificial Sequence
  Synthetic
gtgttcaacacgctttggcatgtgacatctggtggaagcctcacatggcaagggagaaacgtgcgcctacactct

SEQ ID NO: 54206 - DNA, 75 bp, Artificial Sequence
  Synthetic
agggagaaacgtgcgcctacactctggtgatgtttaccgggacatggcttcgtatggcggatcgtggaacattgc

SEQ ID NO: 54207 - DNA, 75 bp, Artificial Sequence
  Synthetic
cgtatggcggatcgtggaacattgctgattccctcgaggactcagtggttgttcgtgtcgtgcagaacgatggta

SEQ ID NO: 54208 - DNA, 75 bp, Artificial Sequence
  Synthetic
cgtgtccaggtcattggccatgactatggaaaaggatcgtcaggatctcctgtgcacgcgttggatggtcgtgtc

SEQ ID NO: 54209 - DNA, 75 bp, Artificial Sequence
  Synthetic
gttggactgtacggttatggatttttcattggatggaagtaccactccttgatcacaagcggagaagtcaccgca

SEQ ID NO: 54210 - DNA, 75 bp, Artificial Sequence
  Synthetic
gaggaaaactttgaggaagacacagtgtctcgccggttcgttgattggcatccaggaaaggggaagaccagacgc

SEQ ID NO: 54211 - DNA, 75 bp, Artificial Sequence
  Synthetic
aggatcaaacctagcgatgtaccgaaggaatgccatcacggtggcttgccacgcgacgctaacgcagtatctgat

SEQ ID NO: 54212 - DNA, 75 bp, Artificial Sequence
  Synthetic
aggaatgccatcacggtggcttgccacgcgacgctaacgcagtatctgatggagaaaggcattgacagcattcga

SEQ ID NO: 54213 - DNA, 75 bp, Artificial Sequence
  Synthetic
ttctccaccatcataatggacgaatgtcacttcctggaccccctgtccatcgcctgtcgtggggtcatggattac

SEQ ID NO: 54214 - DNA, 75 bp, Artificial Sequence
  Synthetic
tacaatggaaaaggggttgccgtggtgtacatgagtgcgactccccccggatgtgctggaaacaacggatcaaat

SEQ ID NO: 54215 - DNA, 75 bp, Artificial Sequence
  Synthetic
aggatgaggttgtgcgggcgattgctgaggcgtgccctggagttgtggtaggatcaaacctagcgatgtaccgaa

SEQ ID NO: 54216 - DNA, 75 bp, Artificial Sequence
  Synthetic
atgtgctggaaacaacggatcaaatcatcccatcgatgacgtggcgacacaatttccgcgcgaattaacagcatc

SEQ ID NO: 54217 - DNA, 75 bp, Artificial Sequence
  Synthetic
aagacgataatattcgttcccacacagcaccaagccaacactttggctagtgaacttggaggagtttcactgacc

SEQ ID NO: 54218 - DNA, 75 bp, Artificial Sequence
  Synthetic
tcacacaggcgtcagccatccagcgccgtggaagaacaggacgcagagaagcaggaaagtatgtctaccccattg

SEQ ID NO: 54219 - DNA, 75 bp, Artificial Sequence
  Synthetic
tgttccagtctggcttgcgtggcactgggcgaatgcgtttgaacacaagcactcagtgctgtttcaaggacagaa

SEQ ID NO: 54220 - DNA, 75 bp, Artificial Sequence
  Synthetic
tgggcgaatgcgtttgaacacaagcactcagtgctgtttcaaggacagaatgcgacgagcttgaagatcaggacg

SEQ ID NO: 54221 - DNA, 75 bp, Artificial Sequence
  Synthetic
tctaacgttgatgatccaatggtttcaaacgtggtgatgggaaagtcgctacaagcttgggcggctgtcatcatt

SEQ ID NO: 54222 - DNA, 75 bp, Artificial Sequence
  Synthetic
caaacgtggtgatgggaaagtcgctacaagcttgggcggctgtcatcattgggatggtcactgggattgtgctac

SEQ ID NO: 54223 - DNA, 75 bp, Artificial Sequence
  Synthetic
tcaatggtgatggctatcggaccactatgtgcggtggttgctggcattcctcccgctttcgtttttgttgcggtg

SEQ ID NO: 54224 - DNA, 75 bp, Artificial Sequence
  Synthetic
acagcaggattttgtcaattcggctcaatggtgatggctatcggaccactatgtgcggtggttgctggcattcct

SEQ ID NO: 54225 - DNA, 75 bp, Artificial Sequence
  Synthetic
cccacaagcatctttcgcgcggccagaggttctagagttgcacatcacatctcttcctggagcgttggttgtgag

SEQ ID NO: 54226 - DNA, 75 bp, Artificial Sequence
  Synthetic
tttcctgggagacgatggtgccaatcgcttttgctgggttcttcgcaactacgttcgtgacgaagatctatgggt

SEQ ID NO: 54227 - DNA, 75 bp, Artificial Sequence
  Synthetic
cgcttttgctgggttcttcgcaactacgttcgtgacgaagatctatgggtgcatggtaggaggaatctacctggt

SEQ ID NO: 54228 - DNA, 75 bp, Artificial Sequence
  Synthetic
tcttcctggagcgttggttgtgagctttgccatcgctatcgttgggggggttattgttaactgtctgtccgacag

SEQ ID NO: 54229 - DNA, 75 bp, Artificial Sequence
  Synthetic
ttgttccctgctgtggacagtcacgtcgcctagcctgaagcatgctgtcgtgagtgtggtggtgattgtgtttgc

SEQ ID NO: 54230 - DNA, 75 bp, Artificial Sequence
  Synthetic
attctagcgtgctgttggtcttgatgatcttcgctgaacctggtcaggtttttctggtaggtgctagtttactgt

SEQ ID NO: 54231 - DNA, 75 bp, Artificial Sequence
  Synthetic
cctcatcgcgcgcaccagcaagaaagatctcgacgatgagataacaggacgagacggggtgacgcgaggccggcc

SEQ ID NO: 54232 - DNA, 75 bp, Artificial Sequence
  Synthetic
catggcgctacggtcgctggtgaagacagacgcttgcggactgggatacagatggaaggaaatgcttaacgcgct

SEQ ID NO: 54233 - DNA, 75 bp, Artificial Sequence
  Synthetic
gatggaaggaaatgcttaacgcgcttgacaaaaatgcgtttgacaagtaccgatcccgaggagtgaacgagacag

SEQ ID NO: 54234 - DNA, 75 bp, Artificial Sequence
  Synthetic
aggaagttccaatgggaaccgaagggggctgcacttgacttaggatgtggccgcggaggatggactcaacgtctg

SEQ ID NO: 54235 - DNA, 75 bp, Artificial Sequence
  Synthetic
ttctggtaggtgctagtttactgttttggttcgtggcgcatcagtcccgcatggcgctacggtcgctggtgaaga

SEQ ID NO: 54236 - DNA, 75 bp, Artificial Sequence
  Synthetic
gtgacccccggcctgaggtggagaagacaagaacgctgaaagtgctgacgatgctcgagaaatggttagtccaca

SEQ ID NO: 54237 - DNA, 75 bp, Artificial Sequence
  Synthetic
atgctcgagaaatggttagtccacaatccaggtgctgcgttctgttgtaaggtgctgtctccgtaccacctcgaa

SEQ ID NO: 54238 - DNA, 75 bp, Artificial Sequence
  Synthetic
aaccgggaaaatcccctaccgttcaagacgaaaggacacaacctagccgtgctaaaagccggtgttgacgtgtac

SEQ ID NO: 54239 - DNA, 75 bp, Artificial Sequence
  Synthetic
acgttcatgatgacagatgtgtcaacgtacgcgcagcagaaaattctccgtgagaaggtggacacactgacgctt

SEQ ID NO: 54240 - DNA, 75 bp, Artificial Sequence
  Synthetic
gcacatggttcgtggaccgtgaacacccctaccaatcgttcaactaccacgggtcatttgtcactgacgacatct

SEQ ID NO: 54241 - DNA, 75 bp, Artificial Sequence
  Synthetic
tcaataggttgatcatgcggcatttctctgctatgttcaaacggcgaggattggctccgagaatcctcaccccag

SEQ ID NO: 54242 - DNA, 75 bp, Artificial Sequence
  Synthetic
gagaaggtggacacactgacgcttgaaccagaccagcggacccgagctatcaataggttgatcatgcggcatttc

SEQ ID NO: 54243 - DNA, 75 bp, Artificial Sequence
  Synthetic
gctcggcacctgcgtggagattgtgagttgtgcgtgttcaacacaatgggcaagaaggagaagaagccgtcctct

SEQ ID NO: 54244 - DNA, 75 bp, Artificial Sequence
  Synthetic
caataggttgatcatgcggcatttctctgcgatgttcaaacggcgaggattggctccgagaatcctcactccggt

SEQ ID NO: 54245 - DNA, 75 bp, Artificial Sequence
  Synthetic
ttatctggtacatgtggctcggaagtcggtttttggagtacgaagcacttggattcctaaacgaggaccattggg

SEQ ID NO: 54246 - DNA, 75 bp, Artificial Sequence
  Synthetic
tagcgaggaagaactttccgtgcggagttggcggggtcggagtgaattactttggatactatctccaggaaatca

SEQ ID NO: 54247 - DNA, 75 bp, Artificial Sequence
  Synthetic
aggagatgccatggaacaaggtgcaagaagctttagctgaccctgtcttttggcgtatggtggctgatgaacgcg

SEQ ID NO: 54248 - DNA, 75 bp, Artificial Sequence
  Synthetic
agatgatgttgccggatgggacacgcgcataactgaagctgacctggaggacgagttgtggttcctgctggacca

SEQ ID NO: 54249 - DNA, 75 bp, Artificial Sequence
  Synthetic
cggtttttggagtacgaagcacttggattcctaaacgaggaccattgggtagcgaggaagaactttccgtgcgga

SEQ ID NO: 54250 - DNA, 75 bp, Artificial Sequence
  Synthetic
tggaagagattttgagtggaatggtcgtggccggggatgatgtggttgtggcaaccaacaatgaaaacttccaca

SEQ ID NO: 54251 - DNA, 75 bp, Artificial Sequence
  Synthetic
gcaaccaacaatgaaaacttccacaccagtctaaggtacatcaccgccgcgtcaaaaacgcgcaagaacttgcaa

SEQ ID NO: 54252 - DNA, 75 bp, Artificial Sequence
  Synthetic
ccgtgacgaatgggaagaaccaggttgggagaatgctggaggctgaagggctactggacgcgccgttggagatga

SEQ ID NO: 54253 - DNA, 75 bp, Artificial Sequence
  Synthetic
caaactgggaacatgttgaattctgttcccatcactaccatcctctcgtgctgcaagacggtcgtgagatcattg

SEQ ID NO: 54254 - DNA, 75 bp, Artificial Sequence
  Synthetic
tcgatgggtggttaggttcccacctggaagagattttgagcggaatggtcgtggccggggatgatgtagttgtgg

SEQ ID NO: 54255 - DNA, 75 bp, Artificial Sequence
  Synthetic
ggggggatcgtggacatgtcagctgccgggtgcttagcaaaggcacatgcccaaatgtgggcattgtactacttc

SEQ ID NO: 54256 - DNA, 75 bp, Artificial Sequence
  Synthetic
aacaatgagaggagcgaagagaatggccattttaggtgacacagcctgggattttggatccctgggaggagtgtt

SEQ ID NO: 54257 - DNA, 75 bp, Artificial Sequence
  Synthetic
tttccacaccatgtggcacgtcacaagaggggcagtgttgacacacaatgggaaaagactggaaccaaactgggc

SEQ ID NO: 54258 - DNA, 75 bp, Artificial Sequence
  Synthetic
gaaactggtgatggcttttatagcattcctaagatttctagccatacctccaacagcaggaattttggctagatg

SEQ ID NO: 54259 - DNA, 75 bp, Artificial Sequence
  Synthetic
gcaggacccatgccagtgacccactctagtgcagcacaaagaagagggagaataggaagaaatccaaagaatgaa

SEQ ID NO: 54260 - DNA, 75 bp, Artificial Sequence
  Synthetic
aagaaatctcaaacatgttgaacataatgaacaggagaaaaagatctgtgaccatgctcctcatgctgctgccca

SEQ ID NO: 54261 - DNA, 75 bp, Artificial Sequence
  Synthetic
ggagtcactggaaacactcatgcttgtagccctactaggtgctatgacagccggtatcttcctgtttttcatgca

SEQ ID NO: 54262 - DNA, 75 bp, Artificial Sequence
  Synthetic
tggtgcaagctgacatggggtgtgtcataaactggaaaggcaaagaactcaaatgtggaagtggaattttcgtca

SEQ ID NO: 54263 - DNA, 75 bp, Artificial Sequence
  Synthetic
ctagtggcttgctctgggtagcagaaattcagccccagtggatagcagcttcaatcatactggagttttttctta

SEQ ID NO: 54264 - DNA, 75 bp, Artificial Sequence
  Synthetic
agaataacagaggatgatcttcagaatgaggctaaaatcactgacattatggagcctgaacatgctctattggct

SEQ ID NO: 54265 - DNA, 75 bp, Artificial Sequence
  Synthetic
taaggaaactatgcattgaggggaaaatcaccaacgtaacaaccgactcaaggtgccccacccaaggggaagcga

SEQ ID NO: 54266 - DNA, 75 bp, Artificial Sequence
  Synthetic
agacatgggtgacctatggaacatgttctcaaactggtgaacaccgacgagacaaacgttccgttgcactggcac

SEQ ID NO: 54267 - DNA, 75 bp, Artificial Sequence
  Synthetic
aagacggttgctggtatggtatggaaatcagacccatcagtgagaaagaagagaacatggtaaagtctttagtct

SEQ ID NO: 54268 - DNA, 75 bp, Artificial Sequence
  Synthetic
ttctcaaactggtgaacaccgacgagacaaacgttccgttgcactggcaccacacgtagggcttggtctagaaac

SEQ ID NO: 54269 - DNA, 75 bp, Artificial Sequence
  Synthetic
tggagaactaacactcgattgtgaacccaggtctggaattgactttaatgagatgattctgatgaaaatgaaaaa

SEQ ID NO: 54270 - DNA, 75 bp, Artificial Sequence
  Synthetic
aaccaaacatgcagtgtcgagaggaacagccaaactgagatggtttgtggagaggaacctcgtgaaaccagaagg

SEQ ID NO: 54271 - DNA, 75 bp, Artificial Sequence
  Synthetic
ccaccactattctgactcccatgctgagacacaccatagagaacacgtctgccaacctatctctagcagccattg

SEQ ID NO: 54272 - DNA, 75 bp, Artificial Sequence
  Synthetic
tttctagcacatgccataggaacatccatcacccagaaagggattattttcattttgctgatgctggtgactcca

SEQ ID NO: 54273 - DNA, 75 bp, Artificial Sequence
  Synthetic
caattttcatgacagcaacaccccctggaacagctgatgcctttcctcagagcaacgctccaattcaagatgaag

SEQ ID NO: 54274 - DNA, 75 bp, Artificial Sequence
  Synthetic
aacactggacattgaactcctgaagacggaggtcacaaaccctgccgtcctgcgcaaactgtgtatagaagctaa

SEQ ID NO: 54275 - DNA, 75 bp, Artificial Sequence
  Synthetic
gtgaaaacggggggcagttacgtgacccgacaaagacagatctttgagggagctaagctcaacgtagttctaaca

SEQ ID NO: 54276 - DNA, 75 bp, Artificial Sequence
  Synthetic
tgactttggccacaggaccaatcatgaccttgtgggagggcaacccgggaaggttttggaacacgaccatagctg

SEQ ID NO: 54277 - DNA, 75 bp, Artificial Sequence
  Synthetic
gtgcatagctgttggaggaatcactctgtttctgggcttcacagttcaagcagacatgggttgtgtggtgtcatg

SEQ ID NO: 54278 - DNA, 75 bp, Artificial Sequence
  Synthetic
gaccttgtgggagggcaacccgggaaggttttggaacacgaccatagctgtatccacagccaacatttttagagg

SEQ ID NO: 54279 - DNA, 75 bp, Artificial Sequence
  Synthetic
cagcaccaagttggaaatgagactacagaacatggaacaattgcaaccataacacctcaagctcctacgtcggaa

SEQ ID NO: 54280 - DNA, 75 bp, Artificial Sequence
  Synthetic
cctttagagacctgggaagagtgatggttatggtgggcgctaccatgacggatgacataggtatgggagtgactt

SEQ ID NO: 54281 - DNA, 75 bp, Artificial Sequence
  Synthetic
ggttgatgtgttctacaaacccactgagcaggtggacaccctgctctgtgacattggggagtcatcctctaatcc

SEQ ID NO: 54282 - DNA, 75 bp, Artificial Sequence
  Synthetic
taccaaattccttggaggagctgggggatggacttgcaatgggcattatgattttaaaattattgactgactttc

SEQ ID NO: 54283 - DNA, 75 bp, Artificial Sequence
  Synthetic
tcaagttagagaaggaagtggctgagacccagcatggaactgttctagtacaggtcaaatacgaaggaacagatg

SEQ ID NO: 54284 - DNA, 75 bp, Artificial Sequence
  Synthetic
tggagcaacggagtgctagagagtgaaatgataattccaaagaatctggctggaccagtgtcgcagcataactac

SEQ ID NO: 54285 - DNA, 75 bp, Artificial Sequence
  Synthetic
cttgcttaacacagttctaacagtttgtttaaatagagagcagatctctggaaaaatgaaccaacgaaaaaaggt

SEQ ID NO: 54286 - DNA, 75 bp, Artificial Sequence
  Synthetic
aacagttgacgaagagattctcacttggaatgctacaagggaaagggccattaaagttgtttatggccctagtgg

SEQ ID NO: 54287 - DNA, 75 bp, Artificial Sequence
  Synthetic
tggggaacgattaaaaaatcaaaagccatcaatgtgttaagaggattcagaaaggaaatcgggagaatgctgaac

SEQ ID NO: 54288 - DNA, 75 bp, Artificial Sequence
  Synthetic
tggggatggcattgctcttggaagagatgcttagaaccagagtaggaacaaagcacgccttgctgctagtggcga

SEQ ID NO: 54289 - DNA, 75 bp, Artificial Sequence
  Synthetic
aaagccgattaaacgcactggggaaaagtgaatttcagatctacaagaaaagtggaatccaggaagtggatagaa

SEQ ID NO: 54290 - DNA, 75 bp, Artificial Sequence
  Synthetic
gagagacagcactaatggtaataggaatggccatgacaacggtgctttcaattccacatgacctcatggaactca

SEQ ID NO: 54291 - DNA, 75 bp, Artificial Sequence
  Synthetic
atattgaacagaagacgcagaacaacaggtcttctcatcatgattatcccaacagtgatggcattccacttgacc

SEQ ID NO: 54292 - DNA, 75 bp, Artificial Sequence
  Synthetic
gagcctcctcttcaaaacggaagatggaatgaacatgtgcaccctcatggccatggatctgggcgagctgtgtga

SEQ ID NO: 54293 - DNA, 75 bp, Artificial Sequence
  Synthetic
tggacagagcaatacaaattccaggctgactccccaaagagactatcagcagccattgggaaggcatgggaggag

SEQ ID NO: 54294 - DNA, 75 bp, Artificial Sequence
  Synthetic
ggaatgaacatgtgcaccctcatggccatggatctgggcgagctgtgtgaggacaccattacatacaagtgtcct

SEQ ID NO: 54295 - DNA, 75 bp, Artificial Sequence
  Synthetic
aagagaagtcaaaggcctaacaaaaggaggaccaggacacgaagaacctatccccatgtcaacatatgggtggaa

SEQ ID NO: 54296 - DNA, 75 bp, Artificial Sequence
  Synthetic
tacttcaaaggaattgttgatggcaaccatcggagtcgtcctcctctctcagagtaacataccaggaacagtttt

SEQ ID NO: 54297 - DNA, 75 bp, Artificial Sequence
  Synthetic
atcaacctgggtgacctatgggacatgtagcacaacaggagaacacaggagggagaaaagatcagtagcacttgt

SEQ ID NO: 54298 - DNA, 75 bp, Artificial Sequence
  Synthetic
tctgtcaggagctacgtgggttgatgtggtgctcgagcacggtgggtgtgtgaccaccatggctaagaacaagcc

SEQ ID NO: 54299 - DNA, 75 bp, Artificial Sequence
  Synthetic
cagaaggagcatggaaacaagcccaacgaattgagacatggattctgaggcacccagggttcaccctcatggcag

SEQ ID NO: 54300 - DNA, 75 bp, Artificial Sequence
  Synthetic
gccacgataactcccaggtcaccatcggtagaagtcaaattgccggactatggagaactaacactcgattgtgaa

SEQ ID NO: 54301 - DNA, 75 bp, Artificial Sequence
  Synthetic
cacccagggttcaccctcatggcagcgattttggcgtacacaataggaacaacacacttccaaaaaattttgatc

SEQ ID NO: 54302 - DNA, 75 bp, Artificial Sequence
  Synthetic
tatatcaaacagagacttcgtggagggagtctcaggaggaagctgggttgacatcgtcctagaacatggaagctg

SEQ ID NO: 54303 - DNA, 75 bp, Artificial Sequence
  Synthetic
gagaacttggtcaactctttggtcacagccggacatggacagattgataacttttcactaggagtcttgggaatg

SEQ ID NO: 54304 - DNA, 75 bp, Artificial Sequence
  Synthetic
cctggatgtcggctgaaggagcttggagacaagtcgagaaggtagagacatgggcccttaggcacccagggttca

SEQ ID NO: 54305 - DNA, 75 bp, Artificial Sequence
  Synthetic
gccgttttcacagaggagaaccaatgggacagcgcgaaagctgctgttgaggatgaggatttttggaaacttgtg

SEQ ID NO: 54306 - DNA, 75 bp, Artificial Sequence
  Synthetic
ccaacactagactttgagttgataaagacagaagcaaaacaaccagcaacacttaggaaattctgcattgaagcc

SEQ ID NO: 54307 - DNA, 75 bp, Artificial Sequence
  Synthetic
acttaggaaattctgcattgaagccaaattgaccaacacgacaacggaatctcgttgcccaactcaaggtgaacc

SEQ ID NO: 54308 - DNA, 75 bp, Artificial Sequence
  Synthetic
atggcagaaacacagcatgggacaacagtggtgaaagtcaagtatgaaggcgctggagctccgtgtaaagtcccc

SEQ ID NO: 54309 - DNA, 75 bp, Artificial Sequence
  Synthetic
gggagctaagctcaacgtagttctaacagttttttgattagagagcagatctctgatgaataaccaacggaaaaa

SEQ ID NO: 54310 - DNA, 75 bp, Artificial Sequence
  Synthetic
ggtctataggatcaagcagcaaggaatttttggaaagacccaagtgggggttggagtacaaaaagaaggagtttt

SEQ ID NO: 54311 - DNA, 75 bp, Artificial Sequence
  Synthetic
aaattgaccaacacgacaacggaatctcgttgcccaactcaaggtgaacccagcttagtggaggagcaagacaaa

SEQ ID NO: 54312 - DNA, 75 bp, Artificial Sequence
  Synthetic
gcggtaatggacattatatccaggaaagaccaaagaggtagtggacaggttggaacatatggtttaaacacattc

SEQ ID NO: 54313 - DNA, 75 bp, Artificial Sequence
  Synthetic
gcgctcaagggaatgccaataaggtaccaaacaacagcagtgaagagtgaacacacaggaaaagagatagttgac

SEQ ID NO: 54314 - DNA, 75 bp, Artificial Sequence
  Synthetic
tggtctgttcgggaaaggaggtgttgtgacctgtgcgatgttcacatgcttaaagaacatggaagggaaagttgt

SEQ ID NO: 54315 - DNA, 75 bp, Artificial Sequence
  Synthetic
aaagggttgaaagaaagagttgagaaatggctgaaagagtgtggcgtcgacaggttgaagaggatggcaatcagt

SEQ ID NO: 54316 - DNA, 75 bp, Artificial Sequence
  Synthetic
aaagaggcagtgggcaagtcggcacctatggccttaacactttcaccaatatggaagcccaattaattagacaga

SEQ ID NO: 54317 - DNA, 75 bp, Artificial Sequence
  Synthetic
aggaacatgctgtagggaatgacacaggcaagcatggcaaggaggtcaagataacgccccaaagttctatcaccg

SEQ ID NO: 54318 - DNA, 75 bp, Artificial Sequence
  Synthetic
acaggcctagacttcaatgagatggtcctgttgcaaatggagaataaagcatggttagtacacagacagtggttc

SEQ ID NO: 54319 - DNA, 75 bp, Artificial Sequence
  Synthetic
cagtggttgtaacagtccacaatggagacacccatgctgtaggaaatgacacatccaaccatggagtgacagcca

SEQ ID NO: 54320 - DNA, 75 bp, Artificial Sequence
  Synthetic
agacacccatgctgtaggaaatgacacatccaaccatggagtgacagccacgataacccccaggtcaccatcggt

SEQ ID NO: 54321 - DNA, 75 bp, Artificial Sequence
  Synthetic
ctggacttacctttaccatggctccctggagctgacacgcaagggtctaactggattcaaaaagagatgctggta

SEQ ID NO: 54322 - DNA, 75 bp, Artificial Sequence
  Synthetic
acatccaaccatggagtgacagccacgataacccccaggtcaccatcggttgaagttaaattaccggactatgga

SEQ ID NO: 54323 - DNA, 75 bp, Artificial Sequence
  Synthetic
acattcaaaaatccccatgcaaagaagcaggacgttgtcgtcctggggtcccaagaaggcgccatgcacacagca

SEQ ID NO: 54324 - DNA, 75 bp, Artificial Sequence
  Synthetic
agcaggacgttgtcgtcctggggtcccaagaaggcgccatgcacacagcacttacaggagccacagaaatacaaa

SEQ ID NO: 54325 - DNA, 75 bp, Artificial Sequence
  Synthetic
ggtccggaattgactttaatgagatgattctgatgaaaatgaaaacgaaaacgtggctcgtgcacaagcaatggt

SEQ ID NO: 54326 - DNA, 75 bp, Artificial Sequence
  Synthetic
gctttgatggccactttcagaatgagaccaatgttcgcagtcgggctattatttcgcagattaacatctagagaa

SEQ ID NO: 54327 - DNA, 75 bp, Artificial Sequence
  Synthetic
atggacaagctgcaactcaaaggaatgtcatattccatgtgcacaggaaagttcaaagttgtcaaagaaatagct

SEQ ID NO: 54328 - DNA, 75 bp, Artificial Sequence
  Synthetic
gtactcctgctagtcacgcattatgctatcataggtccaggattgcaggcaaaagccactcgtgaagctcaaaaa

SEQ ID NO: 54329 - DNA, 75 bp, Artificial Sequence
  Synthetic
tgtcatattccatgtgcacaggaaagttcaaagttgtcaaagaaatagctgagacgcagcatggaacaatagtca

SEQ ID NO: 54330 - DNA, 75 bp, Artificial Sequence
  Synthetic
atcatggacttggaaaagaagcacgtcttagggcgattaatcacggtcaatcctatagtaacagagaaagacagc

SEQ ID NO: 54331 - DNA, 75 bp, Artificial Sequence
  Synthetic
tatcaggactttttcccgtgtcaataccaatcacggcagctgcatggtacctgtgggaagtgaaaaaacaacgag

SEQ ID NO: 54332 - DNA, 75 bp, Artificial Sequence
  Synthetic
tctctaacatttgtcaaaacaactctttcactgcactatgcatggaagacaatggccatgatactgtcaattgta

SEQ ID NO: 54333 - DNA, 75 bp, Artificial Sequence
  Synthetic
tttttattagagagcagatctctgatgaacaaccaacggaaaaagacgggtcgaccgtctttcaatatgctgaaa

SEQ ID NO: 54334 - DNA, 75 bp, Artificial Sequence
  Synthetic
catttggtgacagctacatcgtcataggagtagaaccaggacagttgaaactcaattggttcaaaaaagggagct

SEQ ID NO: 54335 - DNA, 75 bp, Artificial Sequence
  Synthetic
gcggggtgaagcaaggaaaacgttcgtggagctcatgagaagaggagatctacctgtctggctatcctacaaagt

SEQ ID NO: 54336 - DNA, 75 bp, Artificial Sequence
  Synthetic
cagctgaaggcatcaactacgcagacagaaggtggtgttttgatggaattaagaacaaccaaatactggaagaaa

SEQ ID NO: 54337 - DNA, 75 bp, Artificial Sequence
  Synthetic
agataagagatgtgaacaaggaaaaagtggttgggcgcatcatctcatccaccccttttgctgagaataccaaca

SEQ ID NO: 54338 - DNA, 75 bp, Artificial Sequence
  Synthetic
aatgagaggagccaaaagaatggccatcctgggagacacagcttgggattttggatccctggggggagtgttcac

SEQ ID NO: 54339 - DNA, 75 bp, Artificial Sequence
  Synthetic
ccggagacccactaaaaaatgatgaagatcatgcccactggacagaagcaaagatgttgcttgacaatatctaca

SEQ ID NO: 54340 - DNA, 75 bp, Artificial Sequence
  Synthetic
taatatcgtatggaggaggctggaagctagaaggagaatggaaggaaggagaagaagtccaagtcctggcattag

SEQ ID NO: 54341 - DNA, 75 bp, Artificial Sequence
  Synthetic
ctttcagcggagtctcgtggaccatgaagatcctcataggagtgattataacatggatagggatgaattcccgca

SEQ ID NO: 54342 - DNA, 75 bp, Artificial Sequence
  Synthetic
caaagcatcacaagaagggcctctaccagagattgaagacgaggtgttcaggaaaagaaacttaacaataatgga

SEQ ID NO: 54343 - DNA, 75 bp, Artificial Sequence
  Synthetic
tggtgcaggctgatagtggttgcgttgtgagctggaaaaacaaagaactgaaatgtggcagcgggatcttcatca

SEQ ID NO: 54344 - DNA, 75 bp, Artificial Sequence
  Synthetic
gaagatcctcataggagtgattataacatggatagggatgaattcccgcagcacttccctgtcagtgacactggt

SEQ ID NO: 54345 - DNA, 75 bp, Artificial Sequence
  Synthetic
gtggctgcgttgtgagctggaagaacaaagaactgaaatgcggaagtgggattttcgtgactgacaatgtgcaca

SEQ ID NO: 54346 - DNA, 75 bp, Artificial Sequence
  Synthetic
tcatgctctcagtgaactgccggagaccctagagacactgcttttactgacacttctggctacagtcacaggagg

SEQ ID NO: 54347 - DNA, 75 bp, Artificial Sequence
  Synthetic
agtgagaaggctcattgggaatgagaattatttagactacatgacatcaatgaagagattcaagaatgagagtga

SEQ ID NO: 54348 - DNA, 75 bp, Artificial Sequence
  Synthetic
aatgcgttgcataggaatatcaaatagagactttgtggaaggggtttcaggaggaagttgggttgacatagtctt

SEQ ID NO: 54349 - DNA, 75 bp, Artificial Sequence
  Synthetic
cctggacggagcaatacaaattccaaccagactccccttcaaagttagcctctgccatccaaaaagcccacgaag

SEQ ID NO: 54350 - DNA, 75 bp, Artificial Sequence
  Synthetic
caaacttcaaagctgaaagagtgatagatccaaggagatgtatgaagccagttatactgacagacggtgaagagc

SEQ ID NO: 54351 - DNA, 75 bp, Artificial Sequence
  Synthetic
aggcaaatagcaccagaactgaatcacatcttatacgaaaatgaagtcaaactaaccattatgacaggagacatc

SEQ ID NO: 54352 - DNA, 75 bp, Artificial Sequence
  Synthetic
acatcttatacgaaaatgaagtcaaactaaccattatgacaggagacatcaaaggaatcatgcaggcagggaaaa

SEQ ID NO: 54353 - DNA, 75 bp, Artificial Sequence
  Synthetic
cacttggacagaacagtacaaatttcaaccagagtctccagcgcgactggcgtcggcaatactgaatgcccacaa

SEQ ID NO: 54354 - DNA, 75 bp, Artificial Sequence
  Synthetic
ggccagtgtcaaaaaagacttgatctcatatggaggaggttggaggtttcaaggatcctggaacacgggagaaga

SEQ ID NO: 54355 - DNA, 75 bp, Artificial Sequence
  Synthetic
gggaaagcaaaaatactctcaacagagctccagaatcaaaccttcctcatagacggtcctgaaacaacagaatgc

SEQ ID NO: 54356 - DNA, 75 bp, Artificial Sequence
  Synthetic
agctccagaatcaaaccttcctcatagacggtcctgaaacaacagaatgccctaacagcaacagggcctggaatt

SEQ ID NO: 54357 - DNA, 75 bp, Artificial Sequence
  Synthetic
ggaagcaaataaccaatgagttaaactatgttctctgggaaggaggacatgacctcactgtagtggccggggatg

SEQ ID NO: 54358 - DNA, 75 bp, Artificial Sequence
  Synthetic
caccatcaatggccatgcgatgcgtgggaataggcaacagagacttcgttgaaggactgtcaggagcaacgtggg

SEQ ID NO: 54359 - DNA, 75 bp, Artificial Sequence
  Synthetic
ctcaagctaaaagaaaaacaagacacgttctgtgactcaaagctgatgtcagccgctgtcaaggacaacagagca

SEQ ID NO: 54360 - DNA, 75 bp, Artificial Sequence
  Synthetic
agccgctgtcaaggacaacagagcagttcatgctgacatgggctattggatagagagcagattaaatgacacatg

SEQ ID NO: 54361 - DNA, 75 bp, Artificial Sequence
  Synthetic
tcccctccttgccattggatgctattcacaagtcaaccctataactctcacagcagctcttcttttactggtagc

SEQ ID NO: 54362 - DNA, 75 bp, Artificial Sequence
  Synthetic
gatcacacaccctctggagcaatggagtcctagagagtgaaatgataataccaaagaacttggccggaccagtat

SEQ ID NO: 54363 - DNA, 75 bp, Artificial Sequence
  Synthetic
agccatcaaagggatggcatgattggcaacaggtccctttctgctcccaccactttcatgaattgatcatgaaag

SEQ ID NO: 54364 - DNA, 75 bp, Artificial Sequence
  Synthetic
acatccaggatcgggaaaaacaagaagataccttccagccatagtccgtgaggccataaaaagaaagctgcgcac

SEQ ID NO: 54365 - DNA, 75 bp, Artificial Sequence
  Synthetic
cacaacacaattacagacccggctactatacacaaacagccggaccatggcacttgggcaaacttgagttggatt

SEQ ID NO: 54366 - DNA, 75 bp, Artificial Sequence
  Synthetic
catatctagggaagagagaagaccaatggtgcggatcactcattggtctcacttccagagcaacctgggcccaga

SEQ ID NO: 54367 - DNA, 75 bp, Artificial Sequence
  Synthetic
gacaacagcagtgaagagtgaacacacgggaaaggagatagttgaccttatgtgtcacgccactttcactatgcg

SEQ ID NO: 54368 - DNA, 75 bp, Artificial Sequence
  Synthetic
tcaaagagtttgcagcaggaagaagaagtgtctcaggtgacctaatattagaaatagggaaacttccacaacatt

SEQ ID NO: 54369 - DNA, 75 bp, Artificial Sequence
  Synthetic
tatgccacgcagaccgtgggcccatggcacttgggcaaattggagatagactttggagaatgccccggaacaaca

SEQ ID NO: 54370 - DNA, 75 bp, Artificial Sequence
  Synthetic
acggatgctggtacggaatggaaattagacctttgagagagaaggaagaaaacctggtgaactcattggtcacag

SEQ ID NO: 54371 - DNA, 75 bp, Artificial Sequence
  Synthetic
agagggagccatttggtaaacgcaggaagtgaaaaagaggcaaactgtcaggccaccttaagccacagtacggaa

SEQ ID NO: 54372 - DNA, 75 bp, Artificial Sequence
  Synthetic
tagacctttgagagagaaggaagaaaacctggtgaactcattggtcacagccgggcatggtcagattgataactt

SEQ ID NO: 54373 - DNA, 75 bp, Artificial Sequence
  Synthetic
ctgggacaggttatgctcctggttttgtgcgcagttcaacttttgttaatgagaacatcatgggccttgtgtgaa

SEQ ID NO: 54374 - DNA, 75 bp, Artificial Sequence
  Synthetic
ccagaatggggacgaaacatgctctattgttggtagcgatttctttcgtaacactgatcaccggcaatctgtctt

SEQ ID NO: 54375 - DNA, 75 bp, Artificial Sequence
  Synthetic
tgcctcccttaagatttttaggagaggatggatgctggtatgggatggaaatcaggcccttgaatgaaaaagaag

SEQ ID NO: 54376 - DNA, 75 bp, Artificial Sequence
  Synthetic
acactgatcaccggcaatctgtctttcaaagacctaggaagagtgatagtcatggtaggagctgccatgacggat

SEQ ID NO: 54377 - DNA, 75 bp, Artificial Sequence
  Synthetic
agccgcgcatgattgtggggaagaatgaaagaggaaaatccctactttttaagacagcctctggaatcaacatgt

SEQ ID NO: 54378 - DNA, 75 bp, Artificial Sequence
  Synthetic
atgatgggaaaacgtgagaaaaaattaggagagtttggcagagccaagggaagccgagcaatctggtacatgtgg

SEQ ID NO: 54379 - DNA, 75 bp, Artificial Sequence
  Synthetic
cagctgaaggtatcaattacgcagacagaagatggtgctttgatggagtcaagaacaaccaaatcttggaagaaa

SEQ ID NO: 54380 - DNA, 75 bp, Artificial Sequence
  Synthetic
taggcccaccttcgcagcagggttgctcctgaggaaactcacttcaaaagagctgatgatgacgaccataggagt

SEQ ID NO: 54381 - DNA, 75 bp, Artificial Sequence
  Synthetic
atgcaatagcattgggaataatggtcctaaaaatggtgaggagcatggaaaagtaccagttgtcagtgaccatca

SEQ ID NO: 54382 - DNA, 75 bp, Artificial Sequence
  Synthetic
gtagaatggggggacagattcatctagccatcatggcagtgttcaagatgtcaccaggatacgtgttgggtatat

SEQ ID NO: 54383 - DNA, 75 bp, Artificial Sequence
  Synthetic
aagtccctgaccctgaatctaatcacagagatgggtaggctcccaaccttcatgacccagaaagcaaggaatgca

SEQ ID NO: 54384 - DNA, 75 bp, Artificial Sequence
  Synthetic
aagatggtccagagcgtgtcattctagccggaccgatgccagtgactgtggctagtgccgcccagaggagaggaa

SEQ ID NO: 54385 - DNA, 75 bp, Artificial Sequence
  Synthetic
cataatactccaacatgcatggaaagtgagctgtgctatattagcagcagtttcagcatcaccactgcttttaac

SEQ ID NO: 54386 - DNA, 75 bp, Artificial Sequence
  Synthetic
gggatgtagctccatcgtggggattgtagctccatcgtggggatgaatcttcatcgtggggatgtagctccatcg

SEQ ID NO: 54387 - DNA, 75 bp, Artificial Sequence
  Synthetic
acgcccattggacagaagcaaaaatgctccttgacaatataaacacaccagaagggatcatcccagccctctttg

SEQ ID NO: 54388 - DNA, 75 bp, Artificial Sequence
  Synthetic
gtgagctgtgctatattagcagcagtttcagcatcaccactgcttttaacttcctcacaccaaaagacggattgg

SEQ ID NO: 54389 - DNA, 75 bp, Artificial Sequence
  Synthetic
taggctgtggaagaggaggctggtcatattactgtgcaggactgaaaaaagttacagaagtgcgaggatacacaa

SEQ ID NO: 54390 - DNA, 75 bp, Artificial Sequence
  Synthetic
gaagggatcatcccagccctctttgagccggaaagagaaaagagtgctgcaatagacggggagtacagactacgg

SEQ ID NO: 54391 - DNA, 75 bp, Artificial Sequence
  Synthetic
tcaaattttagaggagaacatggatgtggaaatctggacaaaggaaggagaaaggaaaaaattgagacctaggtg

SEQ ID NO: 54392 - DNA, 75 bp, Artificial Sequence
  Synthetic
gacaaccttatctagacccaacaaaacaagaagttggcctctcaacgaagccatcatggcagtgggaatggtgag

SEQ ID NO: 54393 - DNA, 75 bp, Artificial Sequence
  Synthetic
cgtatctctggacttttcccctggaacgtcaggatctccaatcgtcgacagaaaaggaaaagttgtgggtcttta

SEQ ID NO: 54394 - DNA, 75 bp, Artificial Sequence
  Synthetic
ccatcatggcagtgggaatggtgagcatactggccagttctcttttgaaaaatgacattccaatgacaggaccac

SEQ ID NO: 54395 - DNA, 75 bp, Artificial Sequence
  Synthetic
tcaataatgatcgaagaggtgatgagatccagatggagtagaaaaatgctgatgactggaacactggctgtgttc

SEQ ID NO: 54396 - DNA, 75 bp, Artificial Sequence
  Synthetic
gaaggtggtgctttgatggggaaaggaacaaccaggtgttggaggagaacatggacgtggagatctggacaaaag

SEQ ID NO: 54397 - DNA, 75 bp, Artificial Sequence
  Synthetic
gaacaaccaggtgttggaggagaacatggacgtggagatctggacaaaagaaggagaaagaaagaaactgcgacc

SEQ ID NO: 54398 - DNA, 75 bp, Artificial Sequence
  Synthetic
gcggacttggagctggaaaaggcggcagaggtgaaatgggaggatcaagctgagatatcaggaagcagtccaatt

SEQ ID NO: 54399 - DNA, 75 bp, Artificial Sequence
  Synthetic
tcagaggggaacaaaggaagacttttgtggaattaatgaggagaggagaccttccggtgtggctgagctataagg

SEQ ID NO: 54400 - DNA, 75 bp, Artificial Sequence
  Synthetic
tgagatatcaggaagcagtccaattctatcagtcactatatcagaggatggtagcatgtcaataaagaatgagga

SEQ ID NO: 54401 - DNA, 75 bp, Artificial Sequence
  Synthetic
aggagacccaccatagagaaagatgtggatttaggagcaggaacccgacatgtcaatgcggaaccagaaacaccc

SEQ ID NO: 54402 - DNA, 75 bp, Artificial Sequence
  Synthetic
aagcgtctcaggtgacctaatattagaaatagggaaacttccacaacatctaacgcaaagggcccagaaggcctt

SEQ ID NO: 54403 - DNA, 75 bp, Artificial Sequence
  Synthetic
gactgggactatgttgtcacaacagacatttccgaaatgggagcaaatttccgggccgacagggtaatagaccca

SEQ ID NO: 54404 - DNA, 75 bp, Artificial Sequence
  Synthetic
ggataatctggttatgctgcacaactctgaacaaggaggaaaagcttatagacacgccatggaagaattgccaga

SEQ ID NO: 54405 - DNA, 75 bp, Artificial Sequence
  Synthetic
aaacatgggcctatcatggatcatatgaggtcaagccatcaggatcagcctcatccatggtcaatggcgtggtga

SEQ ID NO: 54406 - DNA, 75 bp, Artificial Sequence
  Synthetic
gacacgccatggaagaattgccagacaccatagagacaataatgctcctagctttgatagctgtgctgactggtg

SEQ ID NO: 54407 - DNA, 75 bp, Artificial Sequence
  Synthetic
tgggagacaaaaaagcagagggccggagtgctgtgggatgttccttctcctcctcccgtgggaagggctgagtta

SEQ ID NO: 54408 - DNA, 75 bp, Artificial Sequence
  Synthetic
aataggtgctggagtgtacaaggagggaacattccacacgatgtggcacgtcacacgtggagctgtcttaatgca

SEQ ID NO: 54409 - DNA, 75 bp, Artificial Sequence
  Synthetic
tgggcagatgtgaggaaagacctgatatcatatggaggaggttggaaactggaaggagaatggaaagaaggcgaa

SEQ ID NO: 54410 - DNA, 75 bp, Artificial Sequence
  Synthetic
tatcatatggaggaggttggaaactggaaggagaatggaaagaaggcgaagaagttcaagtcctggcactggaac

SEQ ID NO: 54411 - DNA, 75 bp, Artificial Sequence
  Synthetic
acagcgcactccacaagacaaccagttagcatatgtggtgataggtttgctattcatgatattgacagtggcagc

SEQ ID NO: 54412 - DNA, 75 bp, Artificial Sequence
  Synthetic
aggatggccatcttgggagacaccgcatgggacttcggttctataggaggagtgttcacgtctgtgggaaaactg

SEQ ID NO: 54413 - DNA, 75 bp, Artificial Sequence
  Synthetic
aacacaggagcaataggagccgtgtccttggacttctccccaggaacatcaggttccccaatcattgacaagaaa

SEQ ID NO: 54414 - DNA, 75 bp, Artificial Sequence
  Synthetic
aggttccccaatcattgacaagaaagggaaggtagtaggtctctatggaaatggtgttgtgacaagaagcggaac

SEQ ID NO: 54415 - DNA, 75 bp, Artificial Sequence
  Synthetic
gatatcatacggtgggggatggaggctcggagacaaatgggataaagaagaagatgttcaagttctagctataga

SEQ ID NO: 54416 - DNA, 75 bp, Artificial Sequence
  Synthetic
aaaaaacagcatattgacgctgggagagaccagagatcctgctgtctcctcagcatcattccaggcacagaacgc

SEQ ID NO: 54417 - DNA, 75 bp, Artificial Sequence
  Synthetic
gcaacacacagttttgcgtaaaagtcctcaacccttacatgccatcagtcatagagagaatggaagcattgcaga

SEQ ID NO: 54418 - DNA, 75 bp, Artificial Sequence
  Synthetic
aaattgaggacgacatattccgaaagaaaaggctaaccattatggacttacacccaggggctggaaagacaaaac

SEQ ID NO: 54419 - DNA, 75 bp, Artificial Sequence
  Synthetic
agcaataagaagaggcctgagaacactgatcctcgcccctaccagagtagtggctgcagaaatggaggaagcctt

SEQ ID NO: 54420 - DNA, 75 bp, Artificial Sequence
  Synthetic
acagcagcggtactgatgctagtagcccattatgccataattggaccaggactgcaagcaaaagccactagagaa

SEQ ID NO: 54421 - DNA, 75 bp, Artificial Sequence
  Synthetic
tggctgcagaaatggaggaagccttacgggggctccctatccgttatcaaaccccagctatcaaagcagaacaca

SEQ ID NO: 54422 - DNA, 75 bp, Artificial Sequence
  Synthetic
accccagctatcaaagcagaacacacaggacgcgaaatcgtggacctaatgtgccatgccacgtttaccatgagg

SEQ ID NO: 54423 - DNA, 75 bp, Artificial Sequence
  Synthetic
attacaacctgatcataatggatgaggctcattttacagacccagccagcatagcagcccgaggatacatatcca

SEQ ID NO: 54424 - DNA, 75 bp, Artificial Sequence
  Synthetic
cccgggtggaaatgggagaagccgccggaatatttatgacagccacccctccaggcagcagagacccgtttccac

SEQ ID NO: 54425 - DNA, 75 bp, Artificial Sequence
  Synthetic
ggtcttattacatggcgacactcaagaacgtgactgaagtgaaagggtatacaaaaggaggtccaggacatgaag

SEQ ID NO: 54426 - DNA, 75 bp, Artificial Sequence
  Synthetic
acctctgaccacgctttgggagggatctccaggaaaattctggaacaccacgatagcggtgtccatggcaaacat

SEQ ID NO: 54427 - DNA, 75 bp, Artificial Sequence
  Synthetic
tggaattccgggcatgaatggataacaaattttgaggggaaaacagtgtggtttgttccaagcataagggctgga

SEQ ID NO: 54428 - DNA, 75 bp, Artificial Sequence
  Synthetic
aatctctgggaggaggtaggagagggacgggagcccaaggggaaacattgggagaaaagtggaaaagacagctga

SEQ ID NO: 54429 - DNA, 75 bp, Artificial Sequence
  Synthetic
gacaggatggggatgggaacaacgtacctagccttgatggctactttcaaaatgagaccaatgttcgctgttggg

SEQ ID NO: 54430 - DNA, 75 bp, Artificial Sequence
  Synthetic
ccaattacggcagcagcatggtacctgtgggaagtgaagaaacaacgggctggagtgttgtgggacgtcccttca

SEQ ID NO: 54431 - DNA, 75 bp, Artificial Sequence
  Synthetic
agaatgggaagagagtcatccaactcagcagaaagacttttgactcagaatacgttaaaacgagaacaaatgact

SEQ ID NO: 54432 - DNA, 75 bp, Artificial Sequence
  Synthetic
ctggccactgaatgagggagtgatggctgttggacttgtgagcattctagctagttctctccttaggaatgacgt

SEQ ID NO: 54433 - DNA, 75 bp, Artificial Sequence
  Synthetic
gcggaaagagtgatagatccgagaagatgcatgaagccagttatactgacggatggtgaagagcgagtgatctta

SEQ ID NO: 54434 - DNA, 75 bp, Artificial Sequence
  Synthetic
gatgcatgaagccagttatactgacggatggtgaagagcgagtgatcttagcaggacccatgccagtaacccact

SEQ ID NO: 54435 - DNA, 75 bp, Artificial Sequence
  Synthetic
cggtgggtgtgtgactaccatggctaagaacaagcccacgctggacatagagcttcagaagaccgaggccaccca

SEQ ID NO: 54436 - DNA, 75 bp, Artificial Sequence
  Synthetic
aatgaccaatacatctacatgggggaacccctggagaatgatgaggactgcgcccattggaaggaagcaaagatg

SEQ ID NO: 54437 - DNA, 75 bp, Artificial Sequence
  Synthetic
ggacattgaactcttgaagacggaggtcacgaaccctgccgtcttgcgcaaactgtgcattgaagctaaaatatc

SEQ ID NO: 54438 - DNA, 75 bp, Artificial Sequence
  Synthetic
ttcaataatactggagttttttctcatagttttgctcattccagaaccagaaaaacagagaacaccccaagacaa

SEQ ID NO: 54439 - DNA, 75 bp, Artificial Sequence
  Synthetic
acatcttgacagtgcttttgaaaacagcactactaatagtgtcaggcatctttccatactccattcccgcgacac

SEQ ID NO: 54440 - DNA, 75 bp, Artificial Sequence
  Synthetic
catgaggaaccgatcccaatggcaacctatggatggaacctagtaaagctacactccggaaaagatgtattcttt

SEQ ID NO: 54441 - DNA, 75 bp, Artificial Sequence
  Synthetic
aacccctggagaatgatgaggactgcgcccattggaaggaagcaaagatgctcctcgacaacattaacacacctg

SEQ ID NO: 54442 - DNA, 75 bp, Artificial Sequence
  Synthetic
tggaagaacaagacgcgaactttgtgtgtcgccgaacgtttgtggacagaggctggggtaatggctgcggactat

SEQ ID NO: 54443 - DNA, 75 bp, Artificial Sequence
  Synthetic
atagacggggagtacaggttaagaggagaagcaaggaagaccttcgtggatttgatgagaagaggagatctacca

SEQ ID NO: 54444 - DNA, 75 bp, Artificial Sequence
  Synthetic
aagccgagcaatctggtacatgtggctgggagcgcggtttctggaatttgaagccctgggttttttgaatgaaga

SEQ ID NO: 54445 - DNA, 75 bp, Artificial Sequence
  Synthetic
aagtggaacctgaagacattgactgctggtgcaaccttacatcgacatgggtgacttatggaacgtgcaatcaag

SEQ ID NO: 54446 - DNA, 75 bp, Artificial Sequence
  Synthetic
aaaagtggtgcaacatgagaacctcaaatacaccgtcatcatcacagtgcacacaggagaccaacaccaggtggg

SEQ ID NO: 54447 - DNA, 75 bp, Artificial Sequence
  Synthetic
gcctgtttggggaagtcttacgcccaaatgtggagcctgatgtacttccacagacgtgacctcaggctggcggca

SEQ ID NO: 54448 - DNA, 75 bp, Artificial Sequence
  Synthetic
ttgatttctgcgaagggactacagtggtggtaaccgaggactgtggaaacagagggccttctttaagaacaacca

SEQ ID NO: 54449 - DNA, 75 bp, Artificial Sequence
  Synthetic
gcgttgcccaacacaaggggaacccaccctgaatgaagagcaggacaaaaggtttgtctgcaaacattccatggt

SEQ ID NO: 54450 - DNA, 75 bp, Artificial Sequence
  Synthetic
agtcacacactctatggagtaatggagtgctagaaagcgagatggtaattccaaagaatttcgctggaccagtgt

SEQ ID NO: 54451 - DNA, 75 bp, Artificial Sequence
  Synthetic
aacaatcagatcctggaggagaacatggaagtggaggtttggacgaaagaaggcgagaggaagaagttgaaacct

SEQ ID NO: 54452 - DNA, 75 bp, Artificial Sequence
  Synthetic
cagccagaaaacctggaatacactgtcgtgataacacctcactcaggggaagaacatgcagtcggaaatgacaca

SEQ ID NO: 54453 - DNA, 75 bp, Artificial Sequence
  Synthetic
aatctggtcagttctctggtcacagccggacatgggcagattgataatttctcattaggaatcttgggaatggca

SEQ ID NO: 54454 - DNA, 75 bp, Artificial Sequence
  Synthetic
aatctgggaggccacaaaccatggaagctgtacgcatggcgtagtggactagcggttagaggagacccctccctt

SEQ ID NO: 54455 - DNA, 75 bp, Artificial Sequence
  Synthetic
caaggagtttgcagccggaagaaaatctctaaccctgagcctgatcacagaggtgggacggctcccaactttcat

SEQ ID NO: 54456 - DNA, 75 bp, Artificial Sequence
  Synthetic
catccagagaagtacttctcctcacaattggattaagcctggtggcatccgtggagctaccaaattctctagagg

SEQ ID NO: 54457 - DNA, 75 bp, Artificial Sequence
  Synthetic
ggaaaattggttgaacaataacacccaattttgcataaaggttctcaacccatacatgccctcagtcatagaaaa

SEQ ID NO: 54458 - DNA, 75 bp, Artificial Sequence
  Synthetic
cagaagcaggaggaagagcttacaaccacgctcttagtgaattgcctgagaccctggaaacattactcctgttag

SEQ ID NO: 54459 - DNA, 75 bp, Artificial Sequence
  Synthetic
ccacgctcttagtgaattgcctgagaccctggaaacattactcctgttaggcctcttagccacagtcacaggagg

SEQ ID NO: 54460 - DNA, 75 bp, Artificial Sequence
  Synthetic
taatgtcagctgccatcaaggacagcaaggcagttcatgctgacatggggtactggatagaaagtgaaaagaacg

SEQ ID NO: 54461 - DNA, 75 bp, Artificial Sequence
  Synthetic
aggactagaggttataggagaccccccgcttgcgaaaacagcatattgacgctgggagagaccagagatcctgtc

SEQ ID NO: 54462 - DNA, 75 bp, Artificial Sequence
  Synthetic
gaatgtgctgcatagtcacggcaagcggcctcctgtggtacgcacagatacagcctcattggatagcagcctcaa

SEQ ID NO: 54463 - DNA, 75 bp, Artificial Sequence
  Synthetic
ggcccatctccacactgtgggaaggaaatccagggaggttttggaacactaccattgcagtgtcaatggctaaca

SEQ ID NO: 54464 - DNA, 75 bp, Artificial Sequence
  Synthetic
ccaaacaaccctttcattggattatgcatggaagacaatggccatggtgttgtcaatcgtatctctctttccttt

SEQ ID NO: 54465 - DNA, 75 bp, Artificial Sequence
  Synthetic
agattgataacagccaatcccatagttactgacaaagaaaaaccagtcaacattgagacagaaccaccttttggt

SEQ ID NO: 54466 - DNA, 75 bp, Artificial Sequence
  Synthetic
cggaagcttgcttaacgtagtgctaacagttttttattagagagcagatctctgatgaacaaccaacggaagaag

SEQ ID NO: 54467 - DNA, 75 bp, Artificial Sequence
  Synthetic
agcggttagaggagacccctcccttacaaatcgcagcaacaatgggggcccaaggtgagatgaagctgtagtctc

SEQ ID NO: 54468 - DNA, 75 bp, Artificial Sequence
  Synthetic
caaagaacacctcaggacaaccaattgacctatgtggtcatagccattttgacactagtggcagcaaccatggca

SEQ ID NO: 54469 - DNA, 75 bp, Artificial Sequence
  Synthetic
catgttcctcataacagaaaataaaatctggggaaggaaaagttggcccctcaacgaaggaattatggcagttgg

SEQ ID NO: 54470 - DNA, 75 bp, Artificial Sequence
  Synthetic
ccacagttgttgtggatgaacattgtggaaatcgaggaccatctcttagaaccacaacagtcacaggaaagataa

SEQ ID NO: 54471 - DNA, 75 bp, Artificial Sequence
  Synthetic
tggcacaacacaacaactagaggcaaatattctggacatagatcttcgacctgcatcagcatggacactatacgc

SEQ ID NO: 54472 - DNA, 75 bp, Artificial Sequence
  Synthetic
aatattctggacatagatcttcgacctgcatcagcatggacactatacgcagtggccaccacgttcatcacacca

SEQ ID NO: 54473 - DNA, 75 bp, Artificial Sequence
  Synthetic
ttcaagaagaatggagcaatcaaagtgttacggggtttcaaaaaagagatctcaagcatgttgaacataatgaac

SEQ ID NO: 54474 - DNA, 75 bp, Artificial Sequence
  Synthetic
caacatgatgggaaagagagagaaaaaattaggagagttcggaaaggcaaaaggaagtcgcgcaatatggtacat

SEQ ID NO: 54475 - DNA, 75 bp, Artificial Sequence
  Synthetic
cactgccagaggtgcaaggcgcatggccatcttgggagacacagcctgggactttggatcagtgggtggtgtttt

SEQ ID NO: 54476 - DNA, 75 bp, Artificial Sequence
  Synthetic
catagccaaccaggccacggtgttgatgggcctaggaaaaggttggccattgtcaaaaatggacataggagttcc

SEQ ID NO: 54477 - DNA, 75 bp, Artificial Sequence
  Synthetic
catggacatcaggagctacaacagaaacaccaacctggaacaggaaggagcttcttgtgacattcaaaaacgcac

SEQ ID NO: 54478 - DNA, 75 bp, Artificial Sequence
  Synthetic
cttcttgtgacattcaaaaacgcacatgcgaaaaaacaagaagtagttgtccttggatcgcaagagggagcaatg

SEQ ID NO: 54479 - DNA, 75 bp, Artificial Sequence
  Synthetic
ccaatgagatggggctaattgaaaaaacaaaaacggattttgggttttaccaggtaaaagcagaaaccaccatcc

SEQ ID NO: 54480 - DNA, 75 bp, Artificial Sequence
  Synthetic
caaaccgtcctccctgtagctccgtcgtggggacgtaaaccctgggaggctccaacctgtggaacctgtacgccc

SEQ ID NO: 54481 - DNA, 75 bp, Artificial Sequence
  Synthetic
ttgatgtggacttgagaccagcttcagcatggacgctttatgcagtagctaccactatcttgactcccatgctga

SEQ ID NO: 54482 - DNA, 75 bp, Artificial Sequence
  Synthetic
ctatgccatcataggtcccggactccaagcaaaagccaccagggaggcacaaaaaagagcagcagctggtatcat

SEQ ID NO: 54483 - DNA, 75 bp, Artificial Sequence
  Synthetic
cagcattgctgctgttagtggcacactatgccatcataggtcccggactccaagcaaaagccaccagggaggcac

SEQ ID NO: 54484 - DNA, 75 bp, Artificial Sequence
  Synthetic
cggaaccagatgacgttgactgttggtgcaatgccacggagacatgggtgacctatggaacatgttctcaaactg

SEQ ID NO: 54485 - DNA, 75 bp, Artificial Sequence
  Synthetic
ggacaacatcaacacaccagaagggatcataccagctctctttgaaccagaaagggagaagtcagccgccataga

SEQ ID NO: 54486 - DNA, 75 bp, Artificial Sequence
  Synthetic
acagtgattgatctggaaccaattccttacgatcctaaatttgaaaagcagttgggacaagtgatgcttttggtt

SEQ ID NO: 54487 - DNA, 75 bp, Artificial Sequence
  Synthetic
tcagagatatatcaaagattccagggggaaatatgtatgcagatgacacagccggatgggacacaagaataacag

SEQ ID NO: 54488 - DNA, 75 bp, Artificial Sequence
  Synthetic
ctgggggatggacttgcaatgggcattatgattttaaaattattgactgactttcagtcacatcagctgtgggct

SEQ ID NO: 54489 - DNA, 75 bp, Artificial Sequence
  Synthetic
ctatgcgtgacacaggtgctgatgatgaggactacgtgggccttgtgtgaagccttaaccctagcaactggaccc

SEQ ID NO: 54490 - DNA, 75 bp, Artificial Sequence
  Synthetic
accttcaccaacatggaggcccaactaataagacaaatggagtctgaaggaatctttttacccagcgaattggaa

SEQ ID NO: 54491 - DNA, 75 bp, Artificial Sequence
  Synthetic
agcagtctccatggctaatatattcaggggaagctacttagccggagccggacttctcttttccatcatgaagaa

SEQ ID NO: 54492 - DNA, 75 bp, Artificial Sequence
  Synthetic
ccatgcgatgcgtgggaataggcaacagagacttcgttgaaggactgtcaggagcaacgtgggtggacgtggtat

SEQ ID NO: 54493 - DNA, 75 bp, Artificial Sequence
  Synthetic
acacagccctattcagtggagtctcttgggtgatgaaaattggaataggtgtcctcttgacttggatagggttga

SEQ ID NO: 54494 - DNA, 75 bp, Artificial Sequence
  Synthetic
caataaacaggcatattgacggctgggagagaccagagatcctgctgtctctacagcatcattccaggcacagaa

SEQ ID NO: 54495 - DNA, 75 bp, Artificial Sequence
  Synthetic
ggcaccacaggtgagaccctaggagaaaaatggaagagccgacttaatacattggggagaagtgaatttcaaata

SEQ ID NO: 54496 - DNA, 75 bp, Artificial Sequence
  Synthetic
tataaaaaggggagaaactgatcaccacgcggtttcacggggctccgcaaagttgagatggttcgtcgaaagaaa

SEQ ID NO: 54497 - DNA, 75 bp, Artificial Sequence
  Synthetic
agttgagatggttcgtcgaaagaaacatggtagccccagaaggaaaagtggtagatcttggttgtggcaggggag

SEQ ID NO: 54498 - DNA, 75 bp, Artificial Sequence
  Synthetic
acaaggagaagccacgctggtggaagaacaagacacgaactttgtgtgtcgacgaacattcgtggacagaggctg

SEQ ID NO: 54499 - DNA, 75 bp, Artificial Sequence
  Synthetic
ggtagggccagagtgtcacaaggcgccggatggagcttgagagaaactgcatgtctaggcaagtcgtatgcacaa

SEQ ID NO: 54500 - DNA, 75 bp, Artificial Sequence
  Synthetic
caaaaatgtgaaagaagtcaaaggtctgacgaaaggaggaccagggcatgaagaacccataccaatgtcaacgta

SEQ ID NO: 54501 - DNA, 75 bp, Artificial Sequence
  Synthetic
tgtccagagggaccagcaagattagatggattgttgaaagagggatggtaaagccaaaagggaaagttgtggatc

SEQ ID NO: 54502 - DNA, 75 bp, Artificial Sequence
  Synthetic
agatctggagtgctatgggacacacctagccctccagaagtggaaagagcagttcttgatgatggtatctataga

SEQ ID NO: 54503 - DNA, 75 bp, Artificial Sequence
  Synthetic
caccggagagatgtgacacactactgtgtgacataggggagtcatcaccaaaccccacagtagaggctggacgga

SEQ ID NO: 54504 - DNA, 75 bp, Artificial Sequence
  Synthetic
ggactgctcacctagaacagggctggactttaatgagatggtgctattgacaatgaaagaaaaatcatggcttgt

SEQ ID NO: 54505 - DNA, 75 bp, Artificial Sequence
  Synthetic
ttctgcgtgaaagttcttaacccctacatgccatcagttatagagagaatggaggcattgcaaaggaaatttgga

SEQ ID NO: 54506 - DNA, 75 bp, Artificial Sequence
  Synthetic
acatgccatcagttatagagagaatggaggcattgcaaaggaaatttggaggcgccctggtgcgcaacccactct

SEQ ID NO: 54507 - DNA, 75 bp, Artificial Sequence
  Synthetic
ccacaaacaatggtttctagacttaccattgccttggacttcgggggcttcaacatcccaagagacctggaacag

SEQ ID NO: 54508 - DNA, 75 bp, Artificial Sequence
  Synthetic
attgtgtcttccgtgaacacaatctcaagaatgttactaaacagattcacgatgagacacaaaaaagccacttat

SEQ ID NO: 54509 - DNA, 75 bp, Artificial Sequence
  Synthetic
agcaatgcacactgcgttgactggggcgacagaaatccagacgtcaggaacgacaacaatctttgcaggacatct

SEQ ID NO: 54510 - DNA, 75 bp, Artificial Sequence
  Synthetic
gatgagacacaaaaaagccacttatgagcccgacgttgatcttggaagtggaacgcgcaacattggaatagaatg

SEQ ID NO: 54511 - DNA, 75 bp, Artificial Sequence
  Synthetic
gtaagagctatgctgcctgtgagccccgtccaaggacgtaaaatgaagtcaggccgaaagccacggtttgagcaa

SEQ ID NO: 54512 - DNA, 75 bp, Artificial Sequence
  Synthetic
tgaccaagatcatccttacaaaacatgggcataccacggcagttacgagacgaaacagacgggatcagcctcatc

SEQ ID NO: 54513 - DNA, 75 bp, Artificial Sequence
  Synthetic
gaacaacaacagtgtcagggaagttgatacacgaatggtgttgccgctcgtgcacacttcctcccctgcgataca

SEQ ID NO: 54514 - DNA, 75 bp, Artificial Sequence
  Synthetic
ctcaaaaatgatgtgccgctagctgggccactaatagctggaggcatgctaatagcatgttatgttatatctgga

SEQ ID NO: 54515 - DNA, 75 bp, Artificial Sequence
  Synthetic
ccatggtcacacaaatggcaatgacagacacaaccccctttggacagcagcgcgtgttcaaagaaaaagttgaca

SEQ ID NO: 54516 - DNA, 75 bp, Artificial Sequence
  Synthetic
cactgacaaagaaaaaccagtcaacattgagacagaaccaccttttggtgagagctacatcgtggtaggggcagg

SEQ ID NO: 54517 - DNA, 75 bp, Artificial Sequence
  Synthetic
cgttaatcacagggaacatgtcttttagagacctgggaagagtgatggttatggtgggtgccaccatgacagatg

SEQ ID NO: 54518 - DNA, 75 bp, Artificial Sequence
  Synthetic
cgagaacccaagaaccaaaggagggtacgaaaaaactgatgagaatcacagcggagtggctttggaacgaactgg

SEQ ID NO: 54519 - DNA, 75 bp, Artificial Sequence
  Synthetic
aacaaccaaatcttggaagaaaatgtggaagtggaaatctggacaaaagaaggggaaaggaagaaattaaaaccc

SEQ ID NO: 54520 - DNA, 75 bp, Artificial Sequence
  Synthetic
tggggtagcagaatagcggcgagaggagaccggacggataaataccctgtccaggagttggtgtctattaccttt

SEQ ID NO: 54521 - DNA, 75 bp, Artificial Sequence
  Synthetic
gtgagaagcaacgcagctctgggggccgtgtttactgatgaaaacaagtggaagtcggcacgtgaagccgtcgaa

SEQ ID NO: 54522 - DNA, 75 bp, Artificial Sequence
  Synthetic
cctttcctcagagcaacgctccaattcaagatgaagaaagggacataccagaacgctcatggaattcaggtaatg

SEQ ID NO: 54523 - DNA, 75 bp, Artificial Sequence
  Synthetic
aactaggggaattcggcaaggcaaaaggcagcagagccatatggtacatgtggctgggtgcccgcttcttggagt

SEQ ID NO: 54524 - DNA, 75 bp, Artificial Sequence
  Synthetic
tccctaagtggagtagagggagaaggactgcacaagctgggctacatcctgagagacatcagcaaaaaagaagga

SEQ ID NO: 54525 - DNA, 75 bp, Artificial Sequence
  Synthetic
ggaaaggcatgggaggagggcgtgtgtggaattcgatcagccacgcgtcttgagaacatcatgtggaagcaaata

SEQ ID NO: 54526 - DNA, 75 bp, Artificial Sequence
  Synthetic
acagttttttattagagagcagatctctgatgaacaaccaacggaaaaagacgggaaaaccgtctatcaatatgc

SEQ ID NO: 54527 - DNA, 75 bp, Artificial Sequence
  Synthetic
tgaagacctgaagaatgaggaaatgatcacagaccagatggaaggtaaacataagaagttggcagaggccatttt

SEQ ID NO: 54528 - DNA, 75 bp, Artificial Sequence
  Synthetic
atcacagaccagatggaaggtaaacataagaagttggcagaggccatttttaagctaacatatcagaacaaggta

SEQ ID NO: 54529 - DNA, 75 bp, Artificial Sequence
  Synthetic
ttgagagggttcaggaaagagattggaaggatgctgaacatcttgaataggagacgcagatctgcaggcgtgatc

SEQ ID NO: 54530 - DNA, 75 bp, Artificial Sequence
  Synthetic
aagaagagatcaaagaggcagtggacaagtgggaacgtatggcctcaacacctttaccaacatggaagcacaact

SEQ ID NO: 54531 - DNA, 75 bp, Artificial Sequence
  Synthetic
caagtgggaacgtatggcctcaacacctttaccaacatggaagcacaactgattaggcagatggaaggagaagga

SEQ ID NO: 54532 - DNA, 75 bp, Artificial Sequence
  Synthetic
cgcttggctggctagagaagggcgtgagcgcctcacaagaatggccatcagcggagatgattgtgtcgtgaaacc

SEQ ID NO: 54533 - DNA, 75 bp, Artificial Sequence
  Synthetic
gagcgcctcacaagaatggccatcagcggagatgattgtgtcgtgaaaccactagatgacaggttcgccaaggca

SEQ ID NO: 54534 - DNA, 75 bp, Artificial Sequence
  Synthetic
ggagccctcaaaagggtggaatgactggactcaagtacccttttgctcccaccacttccatgaactgataatgaa

SEQ ID NO: 54535 - DNA, 75 bp, Artificial Sequence
  Synthetic
gaaaacccaagtaggggttggagtacagaaagaaggagtcttccacaccatgtggcacgtcacaagaggggcagt

SEQ ID NO: 54536 - DNA, 75 bp, Artificial Sequence
  Synthetic
caggcagccatattgatgggacttgacaagggatggccgatatcgaagatggatataggggttccacttctcgcc

SEQ ID NO: 54537 - DNA, 75 bp, Artificial Sequence
  Synthetic
tgcagaagtcaagatgaattgattggcagagcgcgaatctctcagggggcaggatggtccttgagagagacagca

SEQ ID NO: 54538 - DNA, 75 bp, Artificial Sequence
  Synthetic
gcagagcgcgaatctctcagggggcaggatggtccttgagagagacagcatgcctgggaaaatcatacgcccaga

SEQ ID NO: 54539 - DNA, 75 bp, Artificial Sequence
  Synthetic
gaaccaaactgggctagcgtgaaaaaagatctgatttcatacggaggaggatggagattgagtgcacaatggcaa

SEQ ID NO: 54540 - DNA, 75 bp, Artificial Sequence
  Synthetic
caggcacagaacgccagaaaatggaatggtgctgttaaatcaacaggtactggacatatagtttccccgggaagg

SEQ ID NO: 54541 - DNA, 75 bp, Artificial Sequence
  Synthetic
acaaatgcagaaccagatggaccgacaccagagttggaagaagagatgttcaaaaagcgaaatctaaccataatg

SEQ ID NO: 54542 - DNA, 75 bp, Artificial Sequence
  Synthetic
gatgctagtggctcactatgccataattggacctggattgcaagcaaaagccactagagaagctcaaaaaaggac

SEQ ID NO: 54543 - DNA, 75 bp, Artificial Sequence
  Synthetic
gctatttgttcagcagttccatcacactgggtcccaaccagcaggaccacttggtccatacatgccactcatgaa

SEQ ID NO: 54544 - DNA, 75 bp, Artificial Sequence
  Synthetic
actgggtcccaaccagcaggaccacttggtccatacatgccactcatgaatggatgacaactgaagacatgttgg

SEQ ID NO: 54545 - DNA, 75 bp, Artificial Sequence
  Synthetic
ggggaacggatgtggtttgtttggtaagggaagcttggtaacatgtgcgaaatttcaatgcctggaaccaataga

SEQ ID NO: 54546 - DNA, 75 bp, Artificial Sequence
  Synthetic
tatggaggaccaatatctcagcacaactatagaccagggtatttcacacaaacagcagggccatggcacctaggc

SEQ ID NO: 54547 - DNA, 75 bp, Artificial Sequence
  Synthetic
aaggttcctcatgccaagagacaggatgtgacagtgctaggatctcaggaaggagccatgcattctgccctcacc

SEQ ID NO: 54548 - DNA, 75 bp, Artificial Sequence
  Synthetic
acttttgttgaatcatgggaggacataccgtacctaggaaaaagagaggaccagtggtgtggctccttgattggc

SEQ ID NO: 54549 - DNA, 75 bp, Artificial Sequence
  Synthetic
taccgtacctaggaaaaagagaggaccagtggtgtggctccttgattggcttgacaagcagagccacttgggcaa

SEQ ID NO: 54550 - DNA, 75 bp, Artificial Sequence
  Synthetic
ctggctactggacccttgaccactctctgggagggatctccaggaaaattctggaacaccacgatagcagtgtcc

SEQ ID NO: 54551 - DNA, 75 bp, Artificial Sequence
  Synthetic
gaaatcggcgcgtgaggctgttgaagatagtaggttttgggagctggttgacaaggaaagaaacctccatcttga

SEQ ID NO: 54552 - DNA, 75 bp, Artificial Sequence
  Synthetic
aacaccccaagacaaccaattgacctacgttgtcatagccatcctcacagtggtggccgcaaccatggcaaacga

SEQ ID NO: 54553 - DNA, 75 bp, Artificial Sequence
  Synthetic
gaatacatagactacatgccttcaatgaagagattcaggagagaagaagaggaggcaggagttctgtggtagatg

SEQ ID NO: 54554 - DNA, 75 bp, Artificial Sequence
  Synthetic
ttcagtcaacatggtatccagattgctactgaacagattcacgatgacacacaggagacccaccatagagaaaga

SEQ ID NO: 54555 - DNA, 75 bp, Artificial Sequence
  Synthetic
ggggaagcgattttacctgaggagcaggaccagaactacgtgtgtaagcacacatacgtggacagaggctgggga

SEQ ID NO: 54556 - DNA, 75 bp, Artificial Sequence
  Synthetic
ggtaggagaggtacaggggctcaaggggaaacgctaggagaaaaatggaaaagacagctgaaccaactgagtaag

SEQ ID NO: 54557 - DNA, 75 bp, Artificial Sequence
  Synthetic
gaccgacaagaacagtttcgaatcggaagcttgcttaacgtagttctaacagttttttattagagagcagatctc

SEQ ID NO: 54558 - DNA, 75 bp, Artificial Sequence
  Synthetic
ggaggcaggagttctgtggtagatgaccaaggagaaagtaaaacaaggccagaagtcaggtcgcactaagccata

SEQ ID NO: 54559 - DNA, 75 bp, Artificial Sequence
  Synthetic
gacccagccagtatagcggctagagggtacatatcaactcgtgtaggaatgggagaggcagccgcaattttcatg

SEQ ID NO: 54560 - DNA, 75 bp, Artificial Sequence
  Synthetic
aaccgactcaaggtgtcccacccaaggggaagcgattttacctgaggagcaggaccagaactacgtgtgtaagca

SEQ ID NO: 54561 - DNA, 75 bp, Artificial Sequence
  Synthetic
atgtggattacatgccagccatgaaaagatacagcgctcatttcgagagtgaaggagttctgtaatcaccaacaa

SEQ ID NO: 54562 - DNA, 75 bp, Artificial Sequence
  Synthetic
tgaagacactgtcacgtataaatgtcctctactggttaacaccgaacctgaagacattgattgctggtgcaatct

SEQ ID NO: 54563 - DNA, 75 bp, Artificial Sequence
  Synthetic
atgggaacaacgtacctagccttgatggctactttcaaaatgagaccaatgttcgctgttgggctattatttcgc

SEQ ID NO: 54564 - DNA, 75 bp, Artificial Sequence
  Synthetic
cttaagatggacaaattagaactcaaggggatgagctatgcaatgtgcacgaatacctttgtgttgaagaaagaa

SEQ ID NO: 54565 - DNA, 75 bp, Artificial Sequence
  Synthetic
gtctcagaaacgcagcatgggacaatacttatcaaggtcgagtacaaaggggaagatgtaccttgcaagattcct

SEQ ID NO: 54566 - DNA, 75 bp, Artificial Sequence
  Synthetic
taggaggagtgttcacgtctgttggaaaactagtacaccagatttttggaactgcatatggagttttgttcagcg

SEQ ID NO: 54567 - DNA, 75 bp, Artificial Sequence
  Synthetic
cacccaggcttcaccctcatggcagcaattttagcgtacacaatagggacaacacacttccaaaaaatcctgatc

SEQ ID NO: 54568 - DNA, 75 bp, Artificial Sequence
  Synthetic
gacaactgacatttcagaaatgggggccaatttcaaagcagatagagtgatcgacccaagaagatgtctcaaacc

SEQ ID NO: 54569 - DNA, 75 bp, Artificial Sequence
  Synthetic
gtagctccacctgaggaggtgtaaaaaacctgggaggcacacaaagcatggaagctgtactcatggcgtagtgga

SEQ ID NO: 54570 - DNA, 75 bp, Artificial Sequence
  Synthetic
agtaattggaattggagacaacgccttgaaaatcaactggtacaagaagggaagctctattgggaagatgttcga

SEQ ID NO: 54571 - DNA, 75 bp, Artificial Sequence
  Synthetic
tgaaggatgggagggaaatagtggtgccatgccgcaaccaagatgaacttgtgggcagggccagagtatcgcaag

SEQ ID NO: 54572 - DNA, 75 bp, Artificial Sequence
  Synthetic
agatggacaaattggaactcaaggggatgagctatgcaatgtgcttgaatgccttcgtgttgaagaaagaagtct

SEQ ID NO: 54573 - DNA, 75 bp, Artificial Sequence
  Synthetic
gagacacccatgcagtaggaaatgacacatccaatcatggagtgacagccacgataactcctaggtcaccatcgg

SEQ ID NO: 54574 - DNA, 75 bp, Artificial Sequence
  Synthetic
aggaacatgctgtagggaatgatacaggcaagcatggtaaggaggtcaagataacgccccaaagttccatcactg

SEQ ID NO: 54575 - DNA, 75 bp, Artificial Sequence
  Synthetic
attccaagcagactccccaaaaagattggcgacagccattgcaggcgcttgggagaatggagtgtgcggaattag

SEQ ID NO: 54576 - DNA, 75 bp, Artificial Sequence
  Synthetic
ttggcgacagccattgcaggcgcttgggagaatggagtgtgcggaattaggtcaacaaccagaatggagaatctc

SEQ ID NO: 54577 - DNA, 75 bp, Artificial Sequence
  Synthetic
cacacaatgtggcacgtcaccaggggagctgtccttatgtaccaagggaagaggctggaaccaagctgggccagt

SEQ ID NO: 54578 - DNA, 75 bp, Artificial Sequence
  Synthetic
tcttgaattgactgatgcgttagccttaggcatgatggtcctcaaaatggtaagaaacatggaaaagtatcaatt

SEQ ID NO: 54579 - DNA, 75 bp, Artificial Sequence
  Synthetic
atggaacacgggagaagaagtgcaggtgatagctgttgaaccaggaaaaaaccccaaaaatgtacagacaacgcc

SEQ ID NO: 54580 - DNA, 75 bp, Artificial Sequence
  Synthetic
gtatgccgatgatacagcaggatgggacacaagaatcacactagaagacttaaaaaatgaagaaatggtaacaaa

SEQ ID NO: 54581 - DNA, 75 bp, Artificial Sequence
  Synthetic
ctgccagaggagcacgaaggatggccatactgggagacactgcatgggactttggttctataggaggagtgttca

SEQ ID NO: 54582 - DNA, 75 bp, Artificial Sequence
  Synthetic
gatggtgttgctcataccagaaccagaaaagcagagaactccccaagacaaccaactcgcatatgtcgtgatagg

SEQ ID NO: 54583 - DNA, 75 bp, Artificial Sequence
  Synthetic
actgttggccacagtcacgggaggaatctttctattcctgatgagcggaaggggtatagggaagatgaccctggg

SEQ ID NO: 54584 - DNA, 75 bp, Artificial Sequence
  Synthetic
aatgccaataagatatcagacaacagcagtgaagagtgaacacacaggaagggagatagttgacctcatgtgcca

SEQ ID NO: 54585 - DNA, 75 bp, Artificial Sequence
  Synthetic
gatgacacagccggatgggatacaaggataacagaggatgatcttcagaatgaggccaaaattactgacatcatg

SEQ ID NO: 54586 - DNA, 75 bp, Artificial Sequence
  Synthetic
ctatctcgcaacacaactacaggcccgggtaccacacccagacggcgggaccttggcatttaggaaaattagagc

SEQ ID NO: 54587 - DNA, 75 bp, Artificial Sequence
  Synthetic
gcgtctgcaatattgaatgcccacaaagatggggtctgtggaatcagatcaaccacgaggctggaaaatgttatg

SEQ ID NO: 54588 - DNA, 75 bp, Artificial Sequence
  Synthetic
attagaacaggattgcttgtgatctcaggactctttccggtatcaataccaatcacagcagcagcatggtacctg

SEQ ID NO: 54589 - DNA, 75 bp, Artificial Sequence
  Synthetic
tgggtatgggtgaagcagctgcgatctttatgacagccactcccccaggatcggtagaggcctttccacagagca

SEQ ID NO: 54590 - DNA, 75 bp, Artificial Sequence
  Synthetic
cttttagcggggtctcgtggaccatgaagatcctcataggggtgattataacatggatagggatgaattctcgca

SEQ ID NO: 54591 - DNA, 75 bp, Artificial Sequence
  Synthetic
gaagatcctcataggggtgattataacatggatagggatgaattctcgcagcacctccctgtcagtgacacttgt

SEQ ID NO: 54592 - DNA, 75 bp, Artificial Sequence
  Synthetic
ggaggtaggagaggtacgggagctcaaggggaaacactgggagaaaaatggaaaagacagctaaaccaactgagc

SEQ ID NO: 54593 - DNA, 75 bp, Artificial Sequence
  Synthetic
tctaacagttttttattagagagcagatctctgatgaacaaccaacggaaaaagacggctcgaccgtctttcaat

SEQ ID NO: 54594 - DNA, 75 bp, Artificial Sequence
  Synthetic
cgtactgggatcacaggaaggagcaatgcacactgcgttgactggggcgacagaaatccagacgtcaggaacgac

SEQ ID NO: 54595 - DNA, 75 bp, Artificial Sequence
  Synthetic
atctttagagggagctatttagcaggagctgggcttgctttttctatcatgaaatcagttggaacaggaaagaga

SEQ ID NO: 54596 - DNA, 75 bp, Artificial Sequence
  Synthetic
aagcaaataacaccagaattgaatcacatcctatatgaaaatgaagtcaaactaactatcatgacaggagacatc

SEQ ID NO: 54597 - DNA, 75 bp, Artificial Sequence
  Synthetic
acatcctatatgaaaatgaagtcaaactaactatcatgacaggagacatcaaaggaattatgcaggcagggaaaa

SEQ ID NO: 54598 - DNA, 75 bp, Artificial Sequence
  Synthetic
gtgcacaggctcatttaagctagagaaggaagtggctgagacccagcatggaactgtcctagtgcaggttaaata

SEQ ID NO: 54599 - DNA, 75 bp, Artificial Sequence
  Synthetic
ctgcccagaggagaggaagaattggaaggaaccaaaacaaggaaggtgatcagtatgtttacatgggacagcctt

SEQ ID NO: 54600 - DNA, 75 bp, Artificial Sequence
  Synthetic
ggtcattcaacttagtaggaagacttttgacacagaatatcagaagactaaactgaatgattgggactttgtggt

SEQ ID NO: 54601 - DNA, 75 bp, Artificial Sequence
  Synthetic
cattaatctccttaacgtgttcaaatacaatttttacgttgactgttgcctggagaacagccaccctgattttgg

SEQ ID NO: 54602 - DNA, 75 bp, Artificial Sequence
  Synthetic
attggtgagtcctctccaaatccaactatagaagaaggaagaacattacgtgttctaaagatggtggaaccatgg

SEQ ID NO: 54603 - DNA, 75 bp, Artificial Sequence
  Synthetic
tgctccttctctcagggcaaataacatggagagacatggcgcacacactcataatgattgggtccaacgcctctg

SEQ ID NO: 54604 - DNA, 75 bp, Artificial Sequence
  Synthetic
ctcaagctaaaagaaaagcaagacacgttttgtgactcaaaattgatgtcagctgccgtcaaggacaatagagca

SEQ ID NO: 54605 - DNA, 75 bp, Artificial Sequence
  Synthetic
tgtgctatcatcctaggaggtctcacatggatggacttactacgagcccttatcatgttaggggacactatgtct

SEQ ID NO: 54606 - DNA, 75 bp, Artificial Sequence
  Synthetic
gaatcttcaccaagcccaacagtggaagaaagcagaactataagagttttgaagatggttgaaccatggctaaaa

SEQ ID NO: 54607 - DNA, 75 bp, Artificial Sequence
  Synthetic
gtcagcagacaagagaaagggaaaagtctcttgtttaaaacagaggatggtgtgaacatgtgtaccctcatggcc

SEQ ID NO: 54608 - DNA, 75 bp, Artificial Sequence
  Synthetic
aacaaccagttttgcattaaagtattgaacccttacatgccaactgtgattgagcacctagaaagactacaaagg

SEQ ID NO: 54609 - DNA, 75 bp, Artificial Sequence
  Synthetic
agcatcagaagggatcaaatatacagatagaaaatggtgctttgatggacaacgtaataatcaaattttagagga

SEQ ID NO: 54610 - DNA, 75 bp, Artificial Sequence
  Synthetic
agctgccgtcaaggacaatagagcagttcatgctgatatgggttattggatagagagcaggttaaatgacacatg

SEQ ID NO: 54611 - DNA, 75 bp, Artificial Sequence
  Synthetic
ccagtcttcgagtatgaggaaaacagactggcttccaatgacagtggcagctatgggagttccacctctaccact

SEQ ID NO: 54612 - DNA, 75 bp, Artificial Sequence
  Synthetic
gatagcgtgctacgtcataactggcacgtcagcagacctcaccgtagaaaaagcagcagatgtaacatgggagga

SEQ ID NO: 54613 - DNA, 75 bp, Artificial Sequence
  Synthetic
cacagcacaattacaggcctggctactacacacaaaccgccggaccatggcacttgggcagacttgagttggatt

SEQ ID NO: 54614 - DNA, 75 bp, Artificial Sequence
  Synthetic
gaggatcagtgatctgccatgagactgggagactggagccatcttgggctgacgtcaggaacgacatgatatcat

SEQ ID NO: 54615 - DNA, 75 bp, Artificial Sequence
  Synthetic
catggaggaactaccagacaccatagaaacattgatgcttctagctttgatagctgtgttgactggtggagtgac

SEQ ID NO: 54616 - DNA, 75 bp, Artificial Sequence
  Synthetic
caaatgggacaaagaagaagatgttcaggttctagctatagaaccaggaaaaaatccgaaacatgtccaaacgaa

SEQ ID NO: 54617 - DNA, 75 bp, Artificial Sequence
  Synthetic
cagacctttgagagagaaggaagaaaacctggtgaactcattggtcacagccggacatggacagattgacaactt

SEQ ID NO: 54618 - DNA, 75 bp, Artificial Sequence
  Synthetic
aggactagaggttagaggagaccccccgcacaacaacaaacagcatattgacgctgggagagaccagagatcctg

SEQ ID NO: 54619 - DNA, 75 bp, Artificial Sequence
  Synthetic
ccagaatggggacaaaacatgctctattgttggtagcgatttccttcgtgacactgatcaccggcaatctgtcct

SEQ ID NO: 54620 - DNA, 75 bp, Artificial Sequence
  Synthetic
aagaatgatgttcctttagccggcccaatggtggcaggaggcttgcttctagcggcttacgtaatgagtggcagc

SEQ ID NO: 54621 - DNA, 75 bp, Artificial Sequence
  Synthetic
acactgatcaccggcaatctgtccttcaaggatctcggaagagtgatagttatggtaggagctgctatgacggat

SEQ ID NO: 54622 - DNA, 75 bp, Artificial Sequence
  Synthetic
atgtggtgataggtttgttattcatgatactgacagtggcagccaatgagatgggattattggaaaccacaaaga

SEQ ID NO: 54623 - DNA, 75 bp, Artificial Sequence
  Synthetic
ggagccggaaagacaaaaagaattctcccatcaatagtcagagaagccttaaaaaggaggctgcgaaccttgatt

SEQ ID NO: 54624 - DNA, 75 bp, Artificial Sequence
  Synthetic
ggggaggaggtgcaggttattgccgtagagcctgggaagaacccaaagaactttcaaaccatgccaggcactttt

SEQ ID NO: 54625 - DNA, 75 bp, Artificial Sequence
  Synthetic
attatcatggatgaagcacattttaccgatccagccagcatagcggccagagggtacatctcaacccgagtgggt

SEQ ID NO: 54626 - DNA, 75 bp, Artificial Sequence
  Synthetic
tccagtcacaatggcactatggtatatttggcaagtgaaaacacaaagatcaggagctctgtgggacgtcccctc

SEQ ID NO: 54627 - DNA, 75 bp, Artificial Sequence
  Synthetic
aatatcaaatagagactttgtggaaggggtttcaggaggaagctgggttgacatagtcttagaacatggaagctg

SEQ ID NO: 54628 - DNA, 75 bp, Artificial Sequence
  Synthetic
acgctaccacccttacgtttcaaaggagaagatgggtgttggtacggtatggaaatcagaccagtcaaggaaaag

SEQ ID NO: 54629 - DNA, 75 bp, Artificial Sequence
  Synthetic
ttattggtagcgcattatgccatcatagggccaggacttcaagcaaaagcaaccagagaagctcagaaaagagca

SEQ ID NO: 54630 - DNA, 75 bp, Artificial Sequence
  Synthetic
tgcaaagagggttgttcgggaaaactcaggttggagtagggatacacatggaaggtgtatttcacacaatgtggc

SEQ ID NO: 54631 - DNA, 75 bp, Artificial Sequence
  Synthetic
gaaggtgtatttcacacaatgtggcatgtaacaagaggatcagtgatctgccatgagacagggagattagagcca

SEQ ID NO: 54632 - DNA, 75 bp, Artificial Sequence
  Synthetic
atggatcttcatcctgggtcaggaaagacacggaaataccttccagctattgttagagaggcaatcaagagacgt

SEQ ID NO: 54633 - DNA, 75 bp, Artificial Sequence
  Synthetic
gacaactttatccagacccaacaaaacaaggagttggcctctcaacgaagccatcatggcagtaggaatggtgag

SEQ ID NO: 54634 - DNA, 75 bp, Artificial Sequence
  Synthetic
gtctcaatccgactgctattttcttaacaactctgtctagacccaataaaataagaagttggcctcttaatgaag

SEQ ID NO: 54635 - DNA, 75 bp, Artificial Sequence
  Synthetic
gcaatagacttggatcctgtggtttatgatgcaaaatttgaaaaacagctaggccaaataatgttactgatactt

SEQ ID NO: 54636 - DNA, 75 bp, Artificial Sequence
  Synthetic
ggcagtggacaggtgggaacttatggtctgaatacattcaccaacatggaagcccagttagtcagacaaatggaa

SEQ ID NO: 54637 - DNA, 75 bp, Artificial Sequence
  Synthetic
aaggactagaggttagaggagacccccccaaaacaaaaacagcatattgacgctgggaaagaccagagatcctgc

SEQ ID NO: 54638 - DNA, 75 bp, Artificial Sequence
  Synthetic
atggagtctgaaggaattttctcacccagcgaattggaaacccccaatctagctaagagagttcttgactggttg

SEQ ID NO: 54639 - DNA, 75 bp, Artificial Sequence
  Synthetic
gcaaccagaaaacttggagtacaccattgtgataacacctcactcaggggaagagaatgcagtcggaaatgacac

SEQ ID NO: 54640 - DNA, 75 bp, Artificial Sequence
  Synthetic
ccatcatggcagtaggaatggtgagcattctggccagttctcttttaaagaatgacatcccaatgacaggaccat

SEQ ID NO: 54641 - DNA, 75 bp, Artificial Sequence
  Synthetic
ttagacctgccgttaccatggctgcccggagcagacacacaaggatcaaattggatacagaaggagacattggtc

SEQ ID NO: 54642 - DNA, 75 bp, Artificial Sequence
  Synthetic
agttttttaattagagagcagatctctgatgaataaccaacgaaaaaaggcgagaagtacgcctttcaatatgct

SEQ ID NO: 54643 - DNA, 75 bp, Artificial Sequence
  Synthetic
tgggactatgttgtcacaacagacatatccgaaatgggagcaaacttccgagccgacagggtaatagacccaagg

SEQ ID NO: 54644 - DNA, 75 bp, Artificial Sequence
  Synthetic
caacgcagttatccaagatgaggaaagagacattcctgagagatcatggaactcaggctatgagtggatcactga

SEQ ID NO: 54645 - DNA, 75 bp, Artificial Sequence
  Synthetic
gaaagtcactgaagtgaagggatacacaaaaggaggacctggacatgaggaacctatcccaatggcgacctatgg

SEQ ID NO: 54646 - DNA, 75 bp, Artificial Sequence
  Synthetic
aaactccacgcacgaaatgtactggatatccaatggtacaggcaacatcgtctcttcagtcaacatggtatccag

SEQ ID NO: 54647 - DNA, 75 bp, Artificial Sequence
  Synthetic
tcacgggccagcctctcaacaatgatgaagaccatgctcactggacagaagcaaaaatgctgctggacaacatta

SEQ ID NO: 54648 - DNA, 75 bp, Artificial Sequence
  Synthetic
cggccttctgtggtatgcacagatacagccccattggatagcagcttcaataatactagagttctttctcatagt

SEQ ID NO: 54649 - DNA, 75 bp, Artificial Sequence
  Synthetic
tcacagaagagatcttagactagcatccaacgccatatgttcagcagtaccagtccactgggtccccacgagcag

SEQ ID NO: 54650 - DNA, 75 bp, Artificial Sequence
  Synthetic
tttcgtggaactcatgaggaggggtgaccttccagtctggttagcccataaagtagcatcagaagggatcaaata

SEQ ID NO: 54651 - DNA, 75 bp, Artificial Sequence
  Synthetic
tagccattgcggtagctagtggcttgctctgggtagcagaaatccagccccagtggatagcggcctcaatcatac

SEQ ID NO: 54652 - DNA, 75 bp, Artificial Sequence
  Synthetic
acaaagacagattctttgagggagctgagctcaacgtagttctaacagttttttaattagagagcagatctctga

SEQ ID NO: 54653 - DNA, 75 bp, Artificial Sequence
  Synthetic
ggcaggaagtcaatagcccttgatcttgtgacagaaataggaagagtgcctacacacctagctcatagaacgaga

SEQ ID NO: 54654 - DNA, 75 bp, Artificial Sequence
  Synthetic
agctgtcctaatggggcttggaaaaggatggccgctccacagaatggacctcggtgtgccgctgttggcaatggg

SEQ ID NO: 54655 - DNA, 75 bp, Artificial Sequence
  Synthetic
aaaacgggaaaagagttatccagctcagcagaaagacctttgactcagaatatgttaaaacgagaacaaatgact

SEQ ID NO: 54656 - DNA, 75 bp, Artificial Sequence
  Synthetic
tggacagagcaatacaaattccaggccgactcccccaagagactatcagcggccattgggaaggcatgggaggag

SEQ ID NO: 54657 - DNA, 75 bp, Artificial Sequence
  Synthetic
aacccctggagaatgacgaggactgcgcccactggaaggaagcaaagatgctccttgacaacatcaatacacctg

SEQ ID NO: 54658 - DNA, 75 bp, Artificial Sequence
  Synthetic
aacagctaggccaaataatgttgttgatactttgcacatcacagattctcctaatgcggaccacatgggccttgt

SEQ ID NO: 54659 - DNA, 75 bp, Artificial Sequence
  Synthetic
atcatttccatgagttaatcatgaaagacggtcgcgtacttgtagttccatgtagaaaccaggatgaattaattg

SEQ ID NO: 54660 - DNA, 75 bp, Artificial Sequence
  Synthetic
tcttcagaatgaggctaaaatcactgaaatcatggagcctgaacatgctctattggctacgtcaatttttaagct

SEQ ID NO: 54661 - DNA, 75 bp, Artificial Sequence
  Synthetic
tatggtgggcgccactatgacggatgacataggcatgggcgtgacttatcttgccctattagcagccttcaaagt

SEQ ID NO: 54662 - DNA, 75 bp, Artificial Sequence
  Synthetic
acactgggagagaagtggaagagacagctaaactcactagataggaaggagtttgaagagtacaaaagaagtgga

SEQ ID NO: 54663 - DNA, 75 bp, Artificial Sequence
  Synthetic
attgatcacagggaacatgtctttccgagacctggggagagtgatggttatggtgggggctgctatgacggatga

SEQ ID NO: 54664 - DNA, 75 bp, Artificial Sequence
  Synthetic
aatctctaggaggaggtaggagaggcacaggagcccaaggagaaacgctgggagaaaaatggaaaagacagctaa

SEQ ID NO: 54665 - DNA, 75 bp, Artificial Sequence
  Synthetic
agagactatacttgaactgactgatgcgttggccttgggcaggatgattctcaagatagtgagaaatatggaaaa

SEQ ID NO: 54666 - DNA, 75 bp, Artificial Sequence
  Synthetic
caccacgatagctgtttccatggcgaacatttttagagggagctatttagcaggagctgggcttgctttctctat

SEQ ID NO: 54667 - DNA, 75 bp, Artificial Sequence
  Synthetic
gtatcaattagcagtgactatcatggctatcttatgtgttccaaatgcagtgatattacaaaatgcatggaaagt

SEQ ID NO: 54668 - DNA, 75 bp, Artificial Sequence
  Synthetic
cagaaacgggaggaagagcttataaccacgctcttagtgaattacctgaaaccctggaaacattactcctgttag

SEQ ID NO: 54669 - DNA, 75 bp, Artificial Sequence
  Synthetic
gaaaagacataccgcagtgggaaccttcaaaaggatggaatgattggcagcaagtgcctttctgttcacaccatt

SEQ ID NO: 54670 - DNA, 75 bp, Artificial Sequence
  Synthetic
caaagaggactgttgggcaggtcccaagtaggagtgggagttttccaagatggcgtgttccacacaatgtggcac

SEQ ID NO: 54671 - DNA, 75 bp, Artificial Sequence
  Synthetic
tgcagtgtcaatggctaacatttttagagggagttacctggccggagctggacttctcttttctatcatgaagaa

SEQ ID NO: 54672 - DNA, 75 bp, Artificial Sequence
  Synthetic
ccacgctcttagtgaattacctgaaaccctggaaacattactcctgttaggccttttagccacagtcacaggggg

SEQ ID NO: 54673 - DNA, 75 bp, Artificial Sequence
  Synthetic
gagtcttaaagatggtggagccatggctctcttcaaaacctgagttctgcatcaaagtcctcaacccctacatgc

SEQ ID NO: 54674 - DNA, 75 bp, Artificial Sequence
  Synthetic
ggggaaaggaacaaccaggtgttggaggagaacatggacgtggagatctggacaaaagaaggagaaagaaagaaa

SEQ ID NO: 54675 - DNA, 75 bp, Artificial Sequence
  Synthetic
caaagaacgcctcaggataatcaattgacctatgtgatcatagccattttgacactagtggcagcgaccatggca

SEQ ID NO: 54676 - DNA, 75 bp, Artificial Sequence
  Synthetic
caggacacgaagaaccagtacctatgtccacatatggatggaacatagttaagttaatgagtggaaaggatgtgt

SEQ ID NO: 54677 - DNA, 75 bp, Artificial Sequence
  Synthetic
gagccacctgggccaccaacatacaagtggccataaaccaagtgagaaggctcattgggaatgagaattatctag

SEQ ID NO: 54678 - DNA, 75 bp, Artificial Sequence
  Synthetic
tgatcagattatgcatcatggttggagccaacgcttccgacaggatggggatgggaacgacgtacctagccctga

SEQ ID NO: 54679 - DNA, 75 bp, Artificial Sequence
  Synthetic
cttggcactatgatcaggaaaacccatacagaacctgggcgtatcatggaagctatgaagctccttcgacaggct

SEQ ID NO: 54680 - DNA, 75 bp, Artificial Sequence
  Synthetic
aggggcactctggtgagtcaacatactcatgaagtaaaggaaaatagaagatcaaacaaagtaagaagtcaggcc

SEQ ID NO: 54681 - DNA, 75 bp, Artificial Sequence
  Synthetic
acaaggaaaggaatctccatcttgaaggaaagtgtgagacatgtgtgtataacatgatgggaaagagagagaaga

SEQ ID NO: 54682 - DNA, 75 bp, Artificial Sequence
  Synthetic
cactttcacgaaactccacgcacgaaatgtactggatatccaatggcacaggtaacattgtcgcttcagtcaaca

SEQ ID NO: 54683 - DNA, 75 bp, Artificial Sequence
  Synthetic
taagccatagtacggtaagagctatgctgcctgtgagccccgtccaaggacgtaaaatgaagtcaggccgaaagc

SEQ ID NO: 54684 - DNA, 75 bp, Artificial Sequence
  Synthetic
gaggatacacaaaaggcggcccaggacatgaagaaccagtacctatgtctacatatggatggaacatagtcaagt

SEQ ID NO: 54685 - DNA, 75 bp, Artificial Sequence
  Synthetic
ctatgtgtgacacaggtgctgatgatgagaacaacgtgggccctgtgtgaagccttaactctagcaactggaccc

SEQ ID NO: 54686 - DNA, 75 bp, Artificial Sequence
  Synthetic
gaactcttgagtgagcagcgggtctccatcaccaggcaaagctataccctgatcgcaaggaatagaggctacagg

SEQ ID NO: 54687 - DNA, 75 bp, Artificial Sequence
  Synthetic
atgtgaatcgtgtgtctataacatgatgggaaaacgtgagaaaaaattaggagagtttggtagggccaagggaag

SEQ ID NO: 54688 - DNA, 75 bp, Artificial Sequence
  Synthetic
tcaaggaggagcataattcaacatggcactacgatgacgaaaacccctacaaaacgtgggcttaccatggatctt

SEQ ID NO: 54689 - DNA, 75 bp, Artificial Sequence
  Synthetic
gggcccgagcactgagggaagctgtacctccttgcaaaggactagaggttagaggagaccccccgcaaataaaaa

SEQ ID NO: 54690 - DNA, 75 bp, Artificial Sequence
  Synthetic
caccaccatgccacaatgctggacgtagacttacatccagcttcagcctggaccctctatgcagtggccacaaca

SEQ ID NO: 54691 - DNA, 75 bp, Artificial Sequence
  Synthetic
gcctcaagaagatcttggcctctcaacgagggcataatggctgtgggtttggttagtctcttaggaagcgccctt

SEQ ID NO: 54692 - DNA, 75 bp, Artificial Sequence
  Synthetic
ggcaccacaggtgagactctaggagaaaaatggaagagccgacttaacgcactgggaagaagtgaatttcaaata

SEQ ID NO: 54693 - DNA, 75 bp, Artificial Sequence
  Synthetic
aaactcctcactaaaccatgggatgtggtgcccatggtgacacagatggcaatgacagatacaactccatttggc

SEQ ID NO: 54694 - DNA, 75 bp, Artificial Sequence
  Synthetic
ctcctccatgataaatggagtcgtgaaactcctcactaaaccatgggatgtggtgcccatggtgacacagatggc

SEQ ID NO: 54695 - DNA, 75 bp, Artificial Sequence
  Synthetic
cagagaaaactcatggagtggagtggaaggggaaggtctgcatagattgggatatatcctggaggacatagacaa

SEQ ID NO: 54696 - DNA, 75 bp, Artificial Sequence
  Synthetic
gagtggtggcggccgagatggaagaggccctacgtggactgccaatccgttatcagaccccagctgtgaaatcag

SEQ ID NO: 54697 - DNA, 75 bp, Artificial Sequence
  Synthetic
accaggggagctgtcctcatgtaccaagggaagagattggaaccaagttgggccagtgtcaaaaaagacttgatc

SEQ ID NO: 54698 - DNA, 75 bp, Artificial Sequence
  Synthetic
gctagtggctcattacgccataattggacctggactgcaagcaaaagctactagagaagctcaaaaaaggacagc

SEQ ID NO: 54699 - DNA, 75 bp, Artificial Sequence
  Synthetic
acaatgacacataggagacccaccatagagaaagatgtggatttaggagcggggacccgacatgtcaatgcggaa

SEQ ID NO: 54700 - DNA, 75 bp, Artificial Sequence
  Synthetic
atgtgagtgccatagcccagactgaaaaaagcattgaagacaatccagagattgaagatgacatctttcggaaaa

SEQ ID NO: 54701 - DNA, 75 bp, Artificial Sequence
  Synthetic
accagagcgtgaaaaagtggatgccattgatggtgaataccgcttgagaggagaagcaaggaaaacctttgtgga

SEQ ID NO: 54702 - DNA, 75 bp, Artificial Sequence
  Synthetic
cccagccatcagagctgagcacactgggcgagaaatcgtggatttaatgtgtcatgccacatttaccatgaggct

SEQ ID NO: 54703 - DNA, 75 bp, Artificial Sequence
  Synthetic
caccggagagatgtgacacactgctgtgcgatataggggaatcatcaccaaaccccacagtagaggccggacgga

SEQ ID NO: 54704 - DNA, 75 bp, Artificial Sequence
  Synthetic
agcggtgtttcctggaccatgaaaataggaataggggttctgctgacatggctaggattaaactcaaggagcacg

SEQ ID NO: 54705 - DNA, 75 bp, Artificial Sequence
  Synthetic
agcaaaaggcagtagagctatatggtacatgtggttgggagccaggtaccttgagttcgaagcccttggattctt

SEQ ID NO: 54706 - DNA, 75 bp, Artificial Sequence
  Synthetic
caccaggacacctagacccatgccaggaacaagaaaggttatggagatcacagcggaatggctttggagaaccct

SEQ ID NO: 54707 - DNA, 75 bp, Artificial Sequence
  Synthetic
aaagggaaatccctgaacgttcgtggaattctggacatgagtgggttacagattttaaagggaagactgtttggt

SEQ ID NO: 54708 - DNA, 75 bp, Artificial Sequence
  Synthetic
agatcttcatgaaggatggccgctcactagttgttccatgtagaaaccaggatgaactgatagggagagccagaa

SEQ ID NO: 54709 - DNA, 75 bp, Artificial Sequence
  Synthetic
aagagaaagttgacacgcgcacaccaagagcaaaacgaggcacagcacaaattatggaggtgacagccaagtggt

SEQ ID NO: 54710 - DNA, 75 bp, Artificial Sequence
  Synthetic
gtagtcgtactggggtcacaagaaggagcaatgcacactgcgttgactggggcgacagaaatccagacgtcagga

SEQ ID NO: 54711 - DNA, 75 bp, Artificial Sequence
  Synthetic
gatgagacacaaaaaagccacctatgagcccgacgttgatcttgggagtggaacacgcaacattggaatagaatg

SEQ ID NO: 54712 - DNA, 75 bp, Artificial Sequence
  Synthetic
aagaacatgaaacgtcatggcactatgaccaagatcatccatacaaaacatgggcataccacggcagttacgaga

SEQ ID NO: 54713 - DNA, 75 bp, Artificial Sequence
  Synthetic
cgcccatcatcagtggatgaccactgaagatatgctcaaagtgtggaacagagtgtggatagaagacaaccctaa

SEQ ID NO: 54714 - DNA, 75 bp, Artificial Sequence
  Synthetic
tggccataagcggggatgactgcgtagtgaaaccaatcgatgacaggttcgctaatgccctgctcgctctgaacg

SEQ ID NO: 54715 - DNA, 75 bp, Artificial Sequence
  Synthetic
gtgagaagcaatgcagctctgggggctgtgttcactgatgaaaacaagtggaagtcagcacgtgaagctgttgaa

SEQ ID NO: 54716 - DNA, 75 bp, Artificial Sequence
  Synthetic
aatgatattcccatgacaggaccactagtggctggagggcttctcactgtgtgttacgtgctcactggaagatcg

SEQ ID NO: 54717 - DNA, 75 bp, Artificial Sequence
  Synthetic
gatcatgaaagatggaagaaagttggtggttccctgcagaccccaggacgaactaataggaagagcaagaatctc

SEQ ID NO: 54718 - DNA, 75 bp, Artificial Sequence
  Synthetic
gaaggcattaactatgcagacagaaggtggtgttttgatggaatcaagaacaaccaaatcttggaagaaaatgtg

SEQ ID NO: 54719 - DNA, 75 bp, Artificial Sequence
  Synthetic
agaccactggttctccagagaaaattcactaagtggagtagagggagaaggattgcacaagctggggtacatcct

SEQ ID NO: 54720 - DNA, 75 bp, Artificial Sequence
  Synthetic
tcactaagtggagtagagggagaaggattgcacaagctggggtacatcctaagagacatcagcagaaaagaagga

SEQ ID NO: 54721 - DNA, 75 bp, Artificial Sequence
  Synthetic
tgaagacttgaagaatgaggaaaagataacaaaccagatggaaggaaaacacaagaagttggcagaggccatttt

SEQ ID NO: 54722 - DNA, 75 bp, Artificial Sequence
  Synthetic
gagagaagaccaatggtgcggatcacttattggtctcacttccagagcaacctgggcccagaacatacccacagc

SEQ ID NO: 54723 - DNA, 75 bp, Artificial Sequence
  Synthetic
ataacaaaccagatggaaggaaaacacaagaagttggcagaggccattttcaaactaacataccagaacaaagtg

SEQ ID NO: 54724 - DNA, 75 bp, Artificial Sequence
  Synthetic
cttttggccacagtcaccggcggaatctttttattcttgatgagtggaaaaggtatagggaaaatgaccctggga

SEQ ID NO: 54725 - DNA, 75 bp, Artificial Sequence
  Synthetic
tctttttattcttgatgagtggaaaaggtatagggaaaatgaccctgggaatgtgctgcataatcacggccagta

SEQ ID NO: 54726 - DNA, 75 bp, Artificial Sequence
  Synthetic
gggaaaagaatagaaaaaataaaacaagagcatgaaacatcatggcactatgaccaagatcacccatacaaaacg

SEQ ID NO: 54727 - DNA, 75 bp, Artificial Sequence
  Synthetic
gacctaatatcatatggaggaggctggaagctagaaggagaatggaaggaaggagaggaagtccaagtcctggca

SEQ ID NO: 54728 - DNA, 75 bp, Artificial Sequence
  Synthetic
acctgggaggctgcaaactgtggaagctgtacgcacggtgtagcagactagcggttagaggagacccctcccatg

SEQ ID NO: 54729 - DNA, 75 bp, Artificial Sequence
  Synthetic
atagtgtcatcagtgaacatgatttcaaggatgttgattaacagattcacaatgagacacaagaaagccacatac

SEQ ID NO: 54730 - DNA, 75 bp, Artificial Sequence
  Synthetic
tttttattagagagcagatctctgatgaacaaccaacggaagaagacgggaaaaccgtctatcaatatgctgaaa

SEQ ID NO: 54731 - DNA, 75 bp, Artificial Sequence
  Synthetic
gcggttagaggagacccctcccatgacacaacgcagcagcggggcccgagcactgagggaagctgtacctccttg

SEQ ID NO: 54732 - DNA, 75 bp, Artificial Sequence
  Synthetic
agcattactaatagtgtcaggcatttttccatactccatacccgcaacactgttggtctggcacacttggcaaaa

SEQ ID NO: 54733 - DNA, 75 bp, Artificial Sequence
  Synthetic
atgaagagtttctggactacatgccttcaatgaagagattcaggaaggaggaggagtcagagggagccatttggt

SEQ ID NO: 54734 - DNA, 75 bp, Artificial Sequence
  Synthetic
gcatcagcatggaccctgtatgcagtggccacaacatttatcacaccaatgttgagacatagcattgaaaattcc

SEQ ID NO: 54735 - DNA, 75 bp, Artificial Sequence
  Synthetic
gcagagcgcgaatctcccagggggcaggatggtccttaagagagacagcatgcttaggaaagtcatacgcccaaa

SEQ ID NO: 54736 - DNA, 75 bp, Artificial Sequence
  Synthetic
cccccgcaaataaaaacagcatattgacgctgggagagaccagagatcctgctgtctcctcagcatcattccagg

SEQ ID NO: 54737 - DNA, 75 bp, Artificial Sequence
  Synthetic
ccagtgaatgtgtctctaacagccattgccaatcaagccacagtgttaatgggtcttgggaagggatggccattg

SEQ ID NO: 54738 - DNA, 75 bp, Artificial Sequence
  Synthetic
ttgttcagcggtgtttcttggaccatgaaaataggaatagggattctgctgacatggttgggattaaattcaagg

SEQ ID NO: 54739 - DNA, 75 bp, Artificial Sequence
  Synthetic
gatactttgcacatcacagattctcctgatgcggaccacatgggccttgtgtgaatccatcacactagccactgg

SEQ ID NO: 54740 - DNA, 75 bp, Artificial Sequence
  Synthetic
gtgaccatgctccttatgctgatgcctacagccttggcgttccatttgactacacgagggggagagccgcacatg

SEQ ID NO: 54741 - DNA, 75 bp, Artificial Sequence
  Synthetic
gacccgagcgcgtgatcctggcgggaccaatgccagtcaccgtagcgagcgctgcgcaaaggagagggagagttg

SEQ ID NO: 54742 - DNA, 75 bp, Artificial Sequence
  Synthetic
ggcacatctggatctcccattgtgaacagagagggaaaaatagtgggtctttatggaaatggagtggtgacaaca

SEQ ID NO: 54743 - DNA, 75 bp, Artificial Sequence
  Synthetic
tcgttccacatgtgggaatgggactggagacacgaactgaaacatggatgtcatcagaaggggcctggaaacatg

SEQ ID NO: 54744 - DNA, 75 bp, Artificial Sequence
  Synthetic
tggtgttgctgcagatggaaaataaagcttggctggtgcacaggcaatggttcctagacctgccgttaccatggt

SEQ ID NO: 54745 - DNA, 75 bp, Artificial Sequence
  Synthetic
gattttcatcttactgacagctgtcgctccttcaatgacaatgcgttgcataggaatatcaaatagagactttgt

SEQ ID NO: 54746 - DNA, 75 bp, Artificial Sequence
  Synthetic
ccacggacaggtttggatttcaatgagatgatcttactgacaatgaagaacaaagcatggatgggacatagacaa

SEQ ID NO: 54747 - DNA, 75 bp, Artificial Sequence
  Synthetic
tacacaaaaggaggacctggacatgaggaacctatcccaatggcgacctatggatggaacctagtaaagctacac

SEQ ID NO: 54748 - DNA, 75 bp, Artificial Sequence
  Synthetic
atcagcctggaacaggaaagaaccttttgtgacattcaaaaacgcacatacaaaaaaacaagaagtggttgtcct

SEQ ID NO: 54749 - DNA, 75 bp, Artificial Sequence
  Synthetic
aataatgattgaagaagtgatgagatccagatggagtagaaagatgctgatgactggaacactggctgtttttct

SEQ ID NO: 54750 - DNA, 75 bp, Artificial Sequence
  Synthetic
gttgaccggagcgacagaaatccaaacgtctggaacgacaacaatttttgcaggacacttgaaatgcagactaaa

SEQ ID NO: 54751 - DNA, 75 bp, Artificial Sequence
  Synthetic
gatgttccatatctaggaaaaagggaagatcagtggtgtggatccctgataggcttaacagcaagggccacctgg

SEQ ID NO: 54752 - DNA, 75 bp, Artificial Sequence
  Synthetic
gcttccggtgctgttaggatcttttggatgcaaaccattaaccatgtttcttataacagaaaacaaaatctgggg

SEQ ID NO: 54753 - DNA, 75 bp, Artificial Sequence
  Synthetic
cgtggaccgacaagaacagtttcgaatcggaagcttgcttaacgtaggttctaacagttttttattagagagcag

SEQ ID NO: 54754 - DNA, 75 bp, Artificial Sequence
  Synthetic
agcatagggaaaatgtttgaggcaactgccagaggagcacgaaggatggccatactgggagacaccgcatgggac

SEQ ID NO: 54755 - DNA, 75 bp, Artificial Sequence
  Synthetic
aacatggaagcccagttaatcagacaaatggaaggagaaggtgtgttgtcgaaggcagacctcgagaaccctcat

SEQ ID NO: 54756 - DNA, 75 bp, Artificial Sequence
  Synthetic
cagaacactctggtacctcacacaacatgttagtagaggtccaagatgatggaactatgaaaataaaagatgaag

SEQ ID NO: 54757 - DNA, 75 bp, Artificial Sequence
  Synthetic
gaactatctagactacatgacatcaatgaagagattcaaaaacgagagtgatcccgaaggggcactctggtgagc

SEQ ID NO: 54758 - DNA, 75 bp, Artificial Sequence
  Synthetic
gtatttgggagttatggtgcaggccgatagtggttgcgttgtgagctggaaaaacaaagaactgaaatgtggcag

SEQ ID NO: 54759 - DNA, 75 bp, Artificial Sequence
  Synthetic
gttcatggccctggtggctttccttcgtttcctaacaatcccaccaacagcagggatattgaagagatggggaac

SEQ ID NO: 54760 - DNA, 75 bp, Artificial Sequence
  Synthetic
tagatgacaggtttgcaagcgctttaacagctctaaatgacatgggaaaggttaggaaagacatacaacaatggg

SEQ ID NO: 54761 - DNA, 75 bp, Artificial Sequence
  Synthetic
gagaagacggctgctggtatggcatggaaattagacccatcagtgagaaagaagagaacatggtaaagtctttag

SEQ ID NO: 54762 - DNA, 75 bp, Artificial Sequence
  Synthetic
gtggaaacaaataacaccagaattgaatcacattctatcagaaaatgaggtgaagttgactattatgacaggaga

SEQ ID NO: 54763 - DNA, 75 bp, Artificial Sequence
  Synthetic
agagcccgaatttcccagggagccgggtggtctttgcgggagacggcctgtctggggaagtcttacgcccaaatg

SEQ ID NO: 54764 - DNA, 75 bp, Artificial Sequence
  Synthetic
catggctcttaaactgataacacaatttgaaacatatcaattatggacggcattagtctccctaacgtgttcaaa

SEQ ID NO: 54765 - DNA, 75 bp, Artificial Sequence
  Synthetic
tgcgacccatggaagctgtacgcatggggtagcagactagtggttagaggagaccccctccctagacataacgca

SEQ ID NO: 54766 - DNA, 75 bp, Artificial Sequence
  Synthetic
aaatcccacactctatggagcaatggagttctggaaagtgaaatgataattccaaagatctatggaggaccaata

SEQ ID NO: 54767 - DNA, 75 bp, Artificial Sequence
  Synthetic
gtttaagtgtgtgacaaaattggaaggaaagatagtccaatatgaaaacttaaaatactcagtgatcgttaccgt

SEQ ID NO: 54768 - DNA, 75 bp, Artificial Sequence
  Synthetic
gagttctggaaagtgaaatgataattccaaagatctatggaggaccaatatctcagcacaactacaggccaggat

SEQ ID NO: 54769 - DNA, 75 bp, Artificial Sequence
  Synthetic
actggtggaagaacaagacgcgaactttgtgtgtcgacgaacgtttgtggacagaggctggggcaatggctgtgg

SEQ ID NO: 54770 - DNA, 75 bp, Artificial Sequence
  Synthetic
ccagtcttcgagcatgaggaaaacagattggctcccaatgactgtggcagctatgggagttccacccctaccact

SEQ ID NO: 54771 - DNA, 75 bp, Artificial Sequence
  Synthetic
ctagaggtttagaggagaccccccgcacaacaacaaactggcatattgaccgctgggagagaccagaagattctg

SEQ ID NO: 54772 - DNA, 75 bp, Artificial Sequence
  Synthetic
gacggtgtggtttgtccctagcatcaaagccggaaatgacatagcaaactgcctgcggaaaaatggaaaaaaggt

SEQ ID NO: 54773 - DNA, 75 bp, Artificial Sequence
  Synthetic
aaccagatgacgttgattgttggtgcaatgccacagacacatgggtgacctatggaacatgttcccaaactggcg

SEQ ID NO: 54774 - DNA, 75 bp, Artificial Sequence
  Synthetic
ccgggccgatagggtaatagacccaaggcggtgcttgaaaccggtaatactaaaagatggtccagagcgcgtcat

SEQ ID NO: 54775 - DNA, 75 bp, Artificial Sequence
  Synthetic
tgagtctagtggcatctgtggagttaccaaattccttggaggagctgggggatggacttgcaatgggcattatga

SEQ ID NO: 54776 - DNA, 75 bp, Artificial Sequence
  Synthetic
cttcaataggactcatttgtgttattgtttccagtggcatgttatggatggctgatgtcccacttcaatggatcg

SEQ ID NO: 54777 - DNA, 75 bp, Artificial Sequence
  Synthetic
agtcacaggaaagataatccatgaatggtgctgcagatcctgcacgctaccccccttacgcttcagaggagaaga

SEQ ID NO: 54778 - DNA, 75 bp, Artificial Sequence
  Synthetic
aggctgctatcaccagttagagtgccaaactacaacctgattatcatggacgaagcccatttcacagacccagca

SEQ ID NO: 54779 - DNA, 75 bp, Artificial Sequence
  Synthetic
gggttccaaattacaacttgataataatggatgaggcccatttcacagacccagccagtatagcggctagagggt

SEQ ID NO: 54780 - DNA, 75 bp, Artificial Sequence
  Synthetic
ctaatagctggaggcatgctaatagcatgttatgttatatctggaagctcagccgacctatcattagagaaagcg

SEQ ID NO: 54781 - DNA, 75 bp, Artificial Sequence
  Synthetic
caaggaatttgcagctggaagaaagtccttgaccctgaacctaatcacagaaatgggtaggcttccaactttcat

SEQ ID NO: 54782 - DNA, 75 bp, Artificial Sequence
  Synthetic
acatcatgtggaagcaaatatcaaatgaattaaaccacatcttacttgaaaatgacatgaaatttacagtggtcg

SEQ ID NO: 54783 - DNA, 75 bp, Artificial Sequence
  Synthetic
ccagtatcgataccaattacggcagcagcatggtacctgtgggaagtaaagaaacaacgggctggagtactgtgg

SEQ ID NO: 54784 - DNA, 75 bp, Artificial Sequence
  Synthetic
gtgaacagagaaggaaaaatagtaggtctttatggaaatggagtggtgacaacaagtggaacctacgtcagtgcc

SEQ ID NO: 54785 - DNA, 75 bp, Artificial Sequence
  Synthetic
tcaaggaggagcatagttcaacatggcactatgatgatgaaaatccttataaaacgtgggcttaccatggatcct

SEQ ID NO: 54786 - DNA, 75 bp, Artificial Sequence
  Synthetic
attaggcccttgagtgaaaaagaagagaacatggttaaatcacaggtgacggccggacagggcacatcggaaact

SEQ ID NO: 54787 - DNA, 75 bp, Artificial Sequence
  Synthetic
gtcaccaggggagctgtactcatgtatcaagggaagagattggaaccgagctgggccagtgtcaaaaaagacctg

SEQ ID NO: 54788 - DNA, 75 bp, Artificial Sequence
  Synthetic
atcatgggcggacgtcaagaaagacctaatatcatatggaggaggctggaagctagaaggagaatggaaggaagg

SEQ ID NO: 54789 - DNA, 75 bp, Artificial Sequence
  Synthetic
tttaaacccggcacatctggatctcccatcgtgaacagagaaggaaaaatagtaggtctttatggaaatggagta

SEQ ID NO: 54790 - DNA, 75 bp, Artificial Sequence
  Synthetic
gatgaccaaagagcatggaacatttgggaagttgaggactatggatttggaattttcacgacaaacatatggctg

SEQ ID NO: 54791 - DNA, 75 bp, Artificial Sequence
  Synthetic
gaacactctggtgcctcacacaacatactagtggaggtccaagatgatggaaccatgaaaataaaagatgaagag

SEQ ID NO: 54792 - DNA, 75 bp, Artificial Sequence
  Synthetic
gcttacgtagttctacagttttttattagagagcagatctctgatgaacaaccaacggaaaaagacgggtcgacc

SEQ ID NO: 54793 - DNA, 75 bp, Artificial Sequence
  Synthetic
agctcattcaagaagaatggagcgatcaaagtgttacggggtttcaaaaaagagatctcaagcatgttgaacata

SEQ ID NO: 54794 - DNA, 75 bp, Artificial Sequence
  Synthetic
gttgaagactacggctttggagtgttcaccaccaatatatggctaaaattgaaagaaaaacaggatgcattctgc

SEQ ID NO: 54795 - DNA, 75 bp, Artificial Sequence
  Synthetic
ggtaatgagatccagatggagcaggaaaatgctgatgactggaacattggctgtgttcctccttctcacaatggg

SEQ ID NO: 54796 - DNA, 75 bp, Artificial Sequence
  Synthetic
caagggaagaggctggaaccaagttgggccagtgtcaaaaaagacttgatctcatatggaggaggttggaggttt

SEQ ID NO: 54797 - DNA, 75 bp, Artificial Sequence
  Synthetic
gcagactagcggttagaggagacccctccatgacacaacgcagcagcggggcccgagcactgagggaagctgtac

SEQ ID NO: 54798 - DNA, 75 bp, Artificial Sequence
  Synthetic
tctcgctggaccagtgtctcaacacaactatagaccaggctaccatacacaaatagcaggaccatggcatctagg

SEQ ID NO: 54799 - DNA, 75 bp, Artificial Sequence
  Synthetic
gaaacagatacaaaaagtggagacttgggccctgagacacccaggattcacggtgatagccctttttctagcaca

SEQ ID NO: 54800 - DNA, 75 bp, Artificial Sequence
  Synthetic
atcatggaactcaggctatgagtggatcactgacttcccaggtaaaacagtttggtttgttccaagcattaaatc

SEQ ID NO: 54801 - DNA, 75 bp, Artificial Sequence
  Synthetic
atgtgtaatcaattggaagggcagagaacttttatgtggaactggcatttttgtcactaatgaggtccacacttg

SEQ ID NO: 54802 - DNA, 75 bp, Artificial Sequence
  Synthetic
gaacttttatgtggaactggcatttttgtcactaatgaggtccacacttggacagatccatacaaattccaggct

SEQ ID NO: 54803 - DNA, 75 bp, Artificial Sequence
  Synthetic
aatgaccaatacatattcacgggccagcctctcaacaatgatgaagaccatgctcactggacagaagcaaaaatg

SEQ ID NO: 54804 - DNA, 75 bp, Artificial Sequence
  Synthetic
taacagatggtgaagagcgggtgatcctggcaggacctatgccagtgacccactctagtgcagcacaaagaagag

SEQ ID NO: 54805 - DNA, 75 bp, Artificial Sequence
  Synthetic
ccaccaacagcaggagtcttggctagatggggaaccttcaagaagtcgggggccattaaggtcctgaaaggcttc

SEQ ID NO: 54806 - DNA, 75 bp, Artificial Sequence
  Synthetic
tttgacctttacaagaaatccggaatcactgaagtggatagaacagaagccaaagaagggttgaaaagaggagaa

SEQ ID NO: 54807 - DNA, 75 bp, Artificial Sequence
  Synthetic
aaagattccggggggaaatatgtatgcagatgatacagccggatgggacacaagaataacagaggatgatcttca

SEQ ID NO: 54808 - DNA, 75 bp, Artificial Sequence
  Synthetic
acagaagatggtgctttgacggggaaaggaacaaccaggtgttggaggagaacatggacgtggagatctggacaa

SEQ ID NO: 54809 - DNA, 75 bp, Artificial Sequence
  Synthetic
gctggaacaagacatgtggcagtggaaccagaggtagccaacctagatatcattggccagaggatagagaacata

SEQ ID NO: 54810 - DNA, 75 bp, Artificial Sequence
  Synthetic
tgactgctggtgcaatgccacagacacatgggtgacctatgggacgtgttctcaaactggcgaacaccgacgaga

SEQ ID NO: 54811 - DNA, 75 bp, Artificial Sequence
  Synthetic
cgatccatgcccaccatcaatggatgacaacagaagacatgttgtcagtgtggaatagggtttggatagaggaaa

SEQ ID NO: 54812 - DNA, 75 bp, Artificial Sequence
  Synthetic
agaagtggaaagagcagttcttgatgatggtatctatagaattatgcagagaggactgttgggcaggtcccaagt

SEQ ID NO: 54813 - DNA, 75 bp, Artificial Sequence
  Synthetic
gtgttggtacggcatggaaatcagaccagtgaaggacaaggaagagaacctggtcaaatcaatggtctctgcagg

SEQ ID NO: 54814 - DNA, 75 bp, Artificial Sequence
  Synthetic
gacagccaagtggttatggggtttcctttccagaaacaaaaaacccagaatctgcacaagagaggagttcacaag

SEQ ID NO: 54815 - DNA, 75 bp, Artificial Sequence
  Synthetic
cagacaacgcactccgcaggacaaccagctggcatatgtggtgataggtttgttattcatgatactgacagtagc

SEQ ID NO: 54816 - DNA, 75 bp, Artificial Sequence
  Synthetic
aaaaaggtcagacccatcgcagccatgggcgccgttttcacacagagagaccaatgggacagtgcgaaagctgct

SEQ ID NO: 54817 - DNA, 75 bp, Artificial Sequence
  Synthetic
tagactttggagaatgccccggaacaacagtcacaattcaggaggattgtgaccatagaggcccatctttgagga

SEQ ID NO: 54818 - DNA, 75 bp, Artificial Sequence
  Synthetic
taagcctggtggcatccgtggagctaccaaattctttggaggagctaggggatggacttgcaatgggcatcatga

SEQ ID NO: 54819 - DNA, 75 bp, Artificial Sequence
  Synthetic
catccagcttcagcctggactctctacgcagtggccacaacgattatcactcccatgatgagacacacaattgaa

SEQ ID NO: 54820 - DNA, 75 bp, Artificial Sequence
  Synthetic
ctcattatgccataattggaccaggactgcaagcaaaagccactagagaagctcaaaaaaggacagcagccggaa

SEQ ID NO: 54821 - DNA, 75 bp, Artificial Sequence
  Synthetic
acctagccatcatggcagtgttcaagatgtcaccaggatatgtgctgggtgtgtttttaaggaaactcacttcaa

SEQ ID NO: 54822 - DNA, 75 bp, Artificial Sequence
  Synthetic
tggagccccattggatagcggcctccatcatactagagttttttctgatggtgctgcttattccagagccagaca

SEQ ID NO: 54823 - DNA, 75 bp, Artificial Sequence
  Synthetic
gaagctcaaaaaaggacagcggccggaataatgaaaaatccaaccgttgatggaattgttgcaatagatttggac

SEQ ID NO: 54824 - DNA, 75 bp, Artificial Sequence
  Synthetic
aatactttcaccaacatggaggtccaactaataagacagatggagtctgaaggaatctttttacccagcgaattg

SEQ ID NO: 54825 - DNA, 75 bp, Artificial Sequence
  Synthetic
gtgtcacgccactttcaccatgcgcctcctgtctcccgtgagagttcccaattacaacatgattatcatggatga

SEQ ID NO: 54826 - DNA, 75 bp, Artificial Sequence
  Synthetic
gaggtggatagatctgaagccaaggaggggttgaaaagaggagaaacaaccaaacacgcagtgtcgagaggaacg

SEQ ID NO: 54827 - DNA, 75 bp, Artificial Sequence
  Synthetic
acgcccaaatgtggagtctcatgtattttcacagaagagatctcagactagcatccaacgccatatgttcagcag

SEQ ID NO: 54828 - DNA, 75 bp, Artificial Sequence
  Synthetic
gctgaaatggaggaagctctcagaggacttccaataagataccaaaccccagccatcagagctgagcacactggg

SEQ ID NO: 54829 - DNA, 75 bp, Artificial Sequence
  Synthetic
tcatggactatgaaaatcctcataggagtcattatcacatggataggaatgaattcacgtagcacctcactgtct

SEQ ID NO: 54830 - DNA, 75 bp, Artificial Sequence
  Synthetic
gtgctgactggtggagtgacgctgttcttcctatcaggaagaggcttagggaaaacatccattggcctactctgc

SEQ ID NO: 54831 - DNA, 75 bp, Artificial Sequence
  Synthetic
ttggaaagaactaggaaagaaaaagacacctaggatgtgtaccagagaagaattcacaagaaaagtgagaagcaa

SEQ ID NO: 54832 - DNA, 75 bp, Artificial Sequence
  Synthetic
ggatggccagtgtggagccccattggatagcggcctctatcatactggagttctttctgatggtgttgcttattc

SEQ ID NO: 54833 - DNA, 75 bp, Artificial Sequence
  Synthetic
gattggaaagacttcaataggactcatttgtgtagttgcttccagcggcatgttatggatggctgatatcccact

SEQ ID NO: 54834 - DNA, 75 bp, Artificial Sequence
  Synthetic
gacacacagaagacctaccattgagaaagatgtggatttaggagcaggaactcgacatgttaatgcggaaccaga

SEQ ID NO: 54835 - DNA, 75 bp, Artificial Sequence
  Synthetic
tgtattgggtttcatgtggaacaggaaacattgtgtcagcagtaaacatgacatctagaatgttgctaaatcgat

SEQ ID NO: 54836 - DNA, 75 bp, Artificial Sequence
  Synthetic
agttgttagtctacgtggaccgacaagaacagtttcgaatcggaagcttgcttaacgtagttctgacagtttttt

SEQ ID NO: 54837 - DNA, 75 bp, Artificial Sequence
  Synthetic
aaccagaggtagccaacctagatatcattggccagaggatagagaacataaaacatgaacataagtcaacatggc

SEQ ID NO: 54838 - DNA, 75 bp, Artificial Sequence
  Synthetic
cttcagcatggacgctctatgcggtagccaccacaattctgactcctatgctgagacacaccatagaaaacacgt

SEQ ID NO: 54839 - DNA, 75 bp, Artificial Sequence
  Synthetic
atagacctcggttgtggaagaggtggctggtcatattattgcgctgggctgaagaaagtcacagaagtgaaggga

SEQ ID NO: 54840 - DNA, 75 bp, Artificial Sequence
  Synthetic
tgcttaacgtagttctaacagttttttattagagagcggatctctgatgaacaaccaacggaaaaagacggctcg

SEQ ID NO: 54841 - DNA, 75 bp, Artificial Sequence
  Synthetic
agatataccacaatgggaaccttcaaaaggatggaatgactggcaacaagtgcctttttgttcacaccacttcca

SEQ ID NO: 54842 - DNA, 75 bp, Artificial Sequence
  Synthetic
acacaaacagcagggccatggcacctaggcaagttggaactagattttgacttgtgtgaaggcaccacagttgtt

SEQ ID NO: 54843 - DNA, 75 bp, Artificial Sequence
  Synthetic
ctgggccagtgtcacaacacaactacagaccaggctaccacacacaaacagcaggaccttggcatctaggtaagc

SEQ ID NO: 54844 - DNA, 75 bp, Artificial Sequence
  Synthetic
gattgacaacttttcactaggagtcttgggaatggcactgttcctggaagaaatgctcaggacccgagtaggaac

SEQ ID NO: 54845 - DNA, 75 bp, Artificial Sequence
  Synthetic
cctgcgcgagtttaaagagtttgcagcaggaagaagaagcgtctcaggtgatctaatattagaaatagggaaact

SEQ ID NO: 54846 - DNA, 75 bp, Artificial Sequence
  Synthetic
gctggtcaacaccgaacctgaagacattgattgctggtgtaatctcacgtctgcctgggtcatgtatgggacatg

SEQ ID NO: 54847 - DNA, 75 bp, Artificial Sequence
  Synthetic
tacaaaaggagtggaattatggaggtggacagatccgaagccaaagagggactgaaaagaggagaaacaaccaaa

SEQ ID NO: 54848 - DNA, 75 bp, Artificial Sequence
  Synthetic
cacaaaatgccacagcttgagtaaactgtgcagcctgtagctccacctgaggaggtgtaaaaaacctgggaggcc

SEQ ID NO: 54849 - DNA, 75 bp, Artificial Sequence
  Synthetic
ttcacggtgatagccctttttctagcacatgccataggaacatccatcacccagaaagggattattttcattttg

SEQ ID NO: 54850 - DNA, 75 bp, Artificial Sequence
  Synthetic
gttggaacatatggtttgaacacattcaccaacatggaagttcaactcatccgccaaatggaagctgaaggagtc

SEQ ID NO: 54851 - DNA, 75 bp, Artificial Sequence
  Synthetic
tcacaccacttccaccagctgattatgaaggatgggagggaaatagtggtgccatgccgcaaccaagatgaactt

SEQ ID NO: 54852 - DNA, 75 bp, Artificial Sequence
  Synthetic
gagttcgaagcccttggtttcatgaatgaagatcactggttcagtagagagaattcactcagtggagtggaagga

SEQ ID NO: 54853 - DNA, 75 bp, Artificial Sequence
  Synthetic
gtcgcgaggctcagcaaaactgagatggttcgttgagagaaatatggtcacaccagaagggaaagtagtggacct

SEQ ID NO: 54854 - DNA, 75 bp, Artificial Sequence
  Synthetic
acataacgcagcagcggggcccaacaccaggggaagctgtaccctggtggtaaggactagaggttagaggagacc

SEQ ID NO: 54855 - DNA, 75 bp, Artificial Sequence
  Synthetic
catcttgcctgaatatggaacccttgggctagaatgttcaccacggacaggtttggatttcaatgaaatgatctt

SEQ ID NO: 54856 - DNA, 75 bp, Artificial Sequence
  Synthetic
gcgagaatctctcaaggagcaggatggagccttaaagaaactgcatgcctagggaaagcctacgcccaaatgtgg

SEQ ID NO: 54857 - DNA, 75 bp, Artificial Sequence
  Synthetic
cactaggattgctatgcatatcaataataatcgaagaggtgatgagatccagatggattagaaaaatgctgatga

SEQ ID NO: 54858 - DNA, 75 bp, Artificial Sequence
  Synthetic
gagattgaagacgaggtgtttaggaaaagaaacttaacaataatggacctacatccaggatcgggaaaaacaaga

SEQ ID NO: 54859 - DNA, 75 bp, Artificial Sequence
  Synthetic
ctgcaacccatggaagctgtacgcatggggtagcagactagtggttagaggagacccctcccgaaacataacgca

SEQ ID NO: 54860 - DNA, 75 bp, Artificial Sequence
  Synthetic
tcacagttggcgaagagattctcaaaaggattgctctcaggccaaggacccatgaaattggtgatggctttcata

SEQ ID NO: 54861 - DNA, 75 bp, Artificial Sequence
  Synthetic
gttaggtcaaacgcagccattggagcagtgttcgttgatgaaaatcaatggaactcagcaaaagaagcagtggaa

SEQ ID NO: 54862 - DNA, 75 bp, Artificial Sequence
  Synthetic
atcggcaagatgtttgagtccacatacagaggcgcaaagcgtatggccattctaggtgaaacagcttgggatttt

SEQ ID NO: 54863 - DNA, 75 bp, Artificial Sequence
  Synthetic
tgatgcggaccacatgggccttgtgtgaatccatcacactggctactggacccctgaccactctctgggagggat

SEQ ID NO: 54864 - DNA, 75 bp, Artificial Sequence
  Synthetic
aagtcaaaggcctaacaaaaggaggaccaggacacgaagaacccatccccatgtcaacatatgggtggaatctag

SEQ ID NO: 54865 - DNA, 75 bp, Artificial Sequence
  Synthetic
cggaagcttgcttaacgtagtgctaacagtttttttattagagagcagatctctgatgaacaaccaacggaagaa

SEQ ID NO: 54866 - DNA, 75 bp, Artificial Sequence
  Synthetic
cactaggactgctatgcatatcaataatgatcgaagaggtaatgagatccagatggagtagaaaaatgctgatga

SEQ ID NO: 54867 - DNA, 75 bp, Artificial Sequence
  Synthetic
ttttggctttgggattcttcctgaggaaactgacatccagagaaaatttattgctgggagttgggttggccatgg

SEQ ID NO: 54868 - DNA, 75 bp, Artificial Sequence
  Synthetic
actcatgtatccagttgggaagaagttccatacctagggaaaagggaagatcaatggtgtggatccctgataggc

SEQ ID NO: 54869 - DNA, 75 bp, Artificial Sequence
  Synthetic
cggaagcttgcttaacacagttctaacagtttgttttaaatagagagcagatctctggaaaaatgaaccaacgaa

SEQ ID NO: 54870 - DNA, 75 bp, Artificial Sequence
  Synthetic
tcctttccatcccgccaacagcagggattctgaaaagatggggacagttgaaaaagaataaggccatcaagatac

SEQ ID NO: 54871 - DNA, 75 bp, Artificial Sequence
  Synthetic
taccagagaccattcttgaactgactgatgcgttagccttgggcatgatggtcctcaaaatagtgagaaatatgg

SEQ ID NO: 54872 - DNA, 75 bp, Artificial Sequence
  Synthetic
ttgggaaaaagagaagaccaatggtgcggctcattgattgggttaacaagcagggctacatgggcaaagaacatc

SEQ ID NO: 54873 - DNA, 75 bp, Artificial Sequence
  Synthetic
tggatgtggattatttggaaagggaggcattgtgacctgtgctatgttcacatgcaaaaagaacatggaaggaaa

SEQ ID NO: 54874 - DNA, 75 bp, Artificial Sequence
  Synthetic
gtagcagactagtggttagaggagacccctcccgaaacataacgcagcagcggggcccaacaccaggggaagctg

SEQ ID NO: 54875 - DNA, 75 bp, Artificial Sequence
  Synthetic
ctgggctgaagaaagtcacggaatacgcatcagcaggacttgcaattattgtccctctcccattggacacctatg

SEQ ID NO: 54876 - DNA, 75 bp, Artificial Sequence
  Synthetic
aaaatgccacagcttgagtaaactgtgcagcctgtagctccacctgaggaggtgtaaaaaaaaaaaaaaaagggg

SEQ ID NO: 54877 - DNA, 75 bp, Artificial Sequence
  Synthetic
aattgttgcaatagatttggaccctgtggtttatgatgcaaaatttgagaaacaactaggccaaataatgttgtt

SEQ ID NO: 54878 - DNA, 75 bp, Artificial Sequence
  Synthetic
aacccctccccccccaaagaaaaaaaaacgggggggcaaaggggaaaataatccccccccccccgggaggggtta

SEQ ID NO: 54879 - DNA, 75 bp, Artificial Sequence
  Synthetic
atccccccccccccgggaggggttaaagggttccccccccccccccccaaaaaaaaaacagcccttttgccgggg

SEQ ID NO: 54880 - DNA, 75 bp, Artificial Sequence
  Synthetic
ggaggaggatggagattgagcgcacaatggcaaaagggggaggaagtgcaggttattgccgtagagcctgggaag

SEQ ID NO: 54881 - DNA, 75 bp, Artificial Sequence
  Synthetic
caacccatggaacacaaatactcgtggaaaagttggggaaaagccaaaatcattggagcagatgttcagaacact

SEQ ID NO: 54882 - DNA, 75 bp, Artificial Sequence
  Synthetic
tgtaccaccacaggagaacacagaagagaaaaaagatcagtggcactcgttccacatgtgggaatgggactggag

SEQ ID NO: 54883 - DNA, 75 bp, Artificial Sequence
  Synthetic
cccactagccctgcgcgagtttaaagagtttgcagcagggagaagaagcgtctcaggtgatttaatattagaaat

SEQ ID NO: 54884 - DNA, 75 bp, Artificial Sequence
  Synthetic
tttcttgcccattacataggcacttccctgacccagaaagtggttatttttatactactaatgctggtcactcca

SEQ ID NO: 54885 - DNA, 75 bp, Artificial Sequence
  Synthetic
atggaagacaaaactccagtggaatcatgggaagaagtcccatacttggggaaaagagaagaccaatggtgcggc

SEQ ID NO: 54886 - DNA, 75 bp, Artificial Sequence
  Synthetic
tgatgtccctctagctggcccaatggtggcaggaggcttacttctggcagcctacgtgatgagcggtagctcagc

SEQ ID NO: 54887 - DNA, 75 bp, Artificial Sequence
  Synthetic
atgacacaacgcagcagcggggcccgagcactgagggaagctgtacctccctgcaaagctgagacacgcaacagg

SEQ ID NO: 54888 - DNA, 75 bp, Artificial Sequence
  Synthetic
attatggaagtggacagatccgaagccaaagagggactgaaaagaggagaaacaaccaaacatgcagtgtcgaga

SEQ ID NO: 54889 - DNA, 75 bp, Artificial Sequence
  Synthetic
taatggtgttgtcacaaggagtggagcatatgtgagtgctatagcccagaccgaaaaaagcattgaagacaatcc

SEQ ID NO: 54890 - DNA, 75 bp, Artificial Sequence
  Synthetic
aagtgagaagactaattgggaatgagaattatttagattacatgacatcaatgaagagattcaagaacgagagtg

SEQ ID NO: 54891 - DNA, 75 bp, Artificial Sequence
  Synthetic
gaagggatatacaaaaggaggacctggacatgaggaaccaatcccaatggcgacctatggatggaacctagtaaa

SEQ ID NO: 54892 - DNA, 75 bp, Artificial Sequence
  Synthetic
ctcagtaacaagattggagaatctgatgtggaaacaaataacaccagaattgaatcacattctatcagaaaatga

SEQ ID NO: 54893 - DNA, 75 bp, Artificial Sequence
  Synthetic
tgatctgatcagttatgcatcatgttggagccacgcttccgacaggatgcggatgggaacgacgtacctagcttt

SEQ ID NO: 54894 - DNA, 75 bp, Artificial Sequence
  Synthetic
tctcatggatgattagaatcctaattgggttcttagtattgtggattggcacgaattcaagaaatacttcaatgg

SEQ ID NO: 54895 - DNA, 75 bp, Artificial Sequence
  Synthetic
tctcattgatggccccgaaacagcagaatgccccaacacaaacagagcttggaactcgctggaagttgaagacta

SEQ ID NO: 54896 - DNA, 75 bp, Artificial Sequence
  Synthetic
gggaaccttcaagaagtcgggggctattaaggtcctgagaggcttcaagaaggagatctcaaacatgctgagcat

SEQ ID NO: 54897 - DNA, 75 bp, Artificial Sequence
  Synthetic
tccatcacactggccactggacctctgaccacgctttgggagggatctccaggaaaattttggaacaccacgata

SEQ ID NO: 54898 - DNA, 75 bp, Artificial Sequence
  Synthetic
acaccagttatggactaccttactgtctctgacattcatcaaaacaactctttcattggattatgcatggaagac

SEQ ID NO: 54899 - DNA, 75 bp, Artificial Sequence
  Synthetic
aggactagactttaatgaaatggtgttgttgacaatgaaagaaaaatcatggctagtccacaaacaatggtttct

SEQ ID NO: 54900 - DNA, 75 bp, Artificial Sequence
  Synthetic
gcaacagagggtgtttaaagagaaagttgacacacgcacaccaaaagcaaaacgaggtacagcacaaatcatgga

SEQ ID NO: 54901 - DNA, 75 bp, Artificial Sequence
  Synthetic
tagctccatcgtggggatgtagctccatcgtggggatgtagctccatcgtggggatgtagctccatcgtggggat

SEQ ID NO: 54902 - DNA, 75 bp, Artificial Sequence
  Synthetic
acaagaacagtttcgaatcggaagcttgcttacgtagttctaacagttttttatttagagagcggatctctgatg

SEQ ID NO: 54903 - DNA, 75 bp, Artificial Sequence
  Synthetic
aattaacatgtgcacactcatagccatggatttgggagagatgtgtgatgacacggtcacttacaaatgccccct

SEQ ID NO: 54904 - DNA, 75 bp, Artificial Sequence
  Synthetic
acgggcctcgacttcaatgagatggtgttgctgcaaatggaaaacaaagcttggctggtgcacaggcaatggttc

SEQ ID NO: 54905 - DNA, 75 bp, Artificial Sequence
  Synthetic
ggaagtcgtgcaatatggtacatgtggttgggagcacgctttctagagtttgaagcccttggtttcatgaatgaa

SEQ ID NO: 54906 - DNA, 75 bp, Artificial Sequence
  Synthetic
ggaatagttagcattctactaagctcacttctcaaaaatgatgtgccactagctggcccattaatagctggaggc

SEQ ID NO: 54907 - DNA, 75 bp, Artificial Sequence
  Synthetic
aggagttcacaaaaaaggtcagaaccaacgcagctatgggcgccgttttcacagaggagaaccaatgggacagtg

SEQ ID NO: 54908 - DNA, 75 bp, Artificial Sequence
  Synthetic
aagactatggatttggcatgttcacgaccaacatatggatgaaattccgagaaggaagttcagaagtgtgtgacc

SEQ ID NO: 54909 - DNA, 75 bp, Artificial Sequence
  Synthetic
gcgacagaaatccagacgtcaggaacgacaacaatctttgcaggacacctgaaatgcagactaaaaatggataaa

SEQ ID NO: 54910 - DNA, 75 bp, Artificial Sequence
  Synthetic
acctgagaaatgtgacacccttttgtgtgatattggtgagtcctctccaaacccaactatagaggaaggaagaac

SEQ ID NO: 54911 - DNA, 75 bp, Artificial Sequence
  Synthetic
tgtggagcaatggggtgctggaaagtcagatgctcattccaagatcatatgcaggccctttttcacagcacaatt

SEQ ID NO: 54912 - DNA, 75 bp, Artificial Sequence
  Synthetic
taatgggtcttgggaaaggatggccattgtcaaagatggacatcggagttcccctccttgccattggatgctact

SEQ ID NO: 54913 - DNA, 75 bp, Artificial Sequence
  Synthetic
tgaaaaagaagagaacatggtcaaatcacaggtaacagccggacagggtacatcagaaactttttctatggggct

SEQ ID NO: 54914 - DNA, 75 bp, Artificial Sequence
  Synthetic
tcggcctactctgcgtgatggcttcaagcgtactgctatggatggccagtgtggagccccattggatagcggcct

SEQ ID NO: 54915 - DNA, 75 bp, Artificial Sequence
  Synthetic
catggtcacactgtacctaggagtcatggttcaagcggactcgggatgtgtaatcaactggaagggcagagaact

SEQ ID NO: 54916 - DNA, 75 bp, Artificial Sequence
  Synthetic
attggaactcaaggggatgagctatgcaatgtgcttaaatgcctttgtgttgaagaaagaagtctccgaaacaca

SEQ ID NO: 54917 - DNA, 75 bp, Artificial Sequence
  Synthetic
tctacaagaaaagtggaatccaggaagtggatagaaccttagcaaaagaaggcatcaaaagaggagaaacggacc

SEQ ID NO: 54918 - DNA, 75 bp, Artificial Sequence
  Synthetic
cattgctaaccaagccacagtgctaatgggtcttgggaaaggatggccattgtcaaagatggacattggagttcc

SEQ ID NO: 54919 - DNA, 75 bp, Artificial Sequence
  Synthetic
aaaaggtctagggaaaacatccattggcctactctgtgtgatggcctcaagcgtactgttatggatggccagtgt

SEQ ID NO: 54920 - DNA, 75 bp, Artificial Sequence
  Synthetic
catcatcacagtgcacacaggagaccaacaccaggtgggaaatgaaacgcagggagtcacggctgagataacacc

SEQ ID NO: 54921 - DNA, 75 bp, Artificial Sequence
  Synthetic
ttactaggagctatgacagcaggcatcttcttgttcttcatgcaaggaaaaggaatggggaaattgtcaatgggt

SEQ ID NO: 54922 - DNA, 75 bp, Artificial Sequence
  Synthetic
acggttgtcattacagaaaactgtgggacaagaggcccatcattaagaacaacaacagtgtcagggaagttaata

SEQ ID NO: 54923 - DNA, 75 bp, Artificial Sequence
  Synthetic
agccacagaaatccaaaactcaggaggcacaagcatttttgcggggcacttaaaatgtagacttaagatggacaa

SEQ ID NO: 54924 - DNA, 75 bp, Artificial Sequence
  Synthetic
gctgctgggatcatgaagaaccccacggtggacgggataacagttatagatctagaaccaatatcctatgaccca

SEQ ID NO: 54925 - DNA, 75 bp, Artificial Sequence
  Synthetic
tataggatcatgcaaagagggctgtttgggaaaactcaggttggagtagggatacacatggaaggtgtattccac

SEQ ID NO: 54926 - DNA, 75 bp, Artificial Sequence
  Synthetic
gtccaaattgagaaccttgaatacacagtggttgtgacagtccacaatggagacacccatgcagtaggaaatgac

SEQ ID NO: 54927 - DNA, 75 bp, Artificial Sequence
  Synthetic
ccattagtggctggagggctcctcactgtgtgctacgtgctcactggacgatcggccgatttggaactggagaga

SEQ ID NO: 54928 - DNA, 75 bp, Artificial Sequence
  Synthetic
cagctaacattttcaggggaagctacctggcgggagctggattggccttctcgctcataaagaatacacaaaccc

SEQ ID NO: 54929 - DNA, 75 bp, Artificial Sequence
  Synthetic
cgacctcccaaaaaacaacatggcttccggtgctgttgggatctcttggatgcaaaccactaaccatgtttctta

SEQ ID NO: 54930 - DNA, 75 bp, Artificial Sequence
  Synthetic
atggcttgtccacaaacaatggtttctagacttaccactgccttggacttcgggggcttcaacatcccaagagac

SEQ ID NO: 54931 - DNA, 75 bp, Artificial Sequence
  Synthetic
cacaggaagagagattgtggacctcatgtgccatgcaaccttcacaacaagacttttgtcatcaaccagagttcc

SEQ ID NO: 54932 - DNA, 75 bp, Artificial Sequence
  Synthetic
gaggctgcgaaccttgattttggctcccacgagagtggtggcggccgagatggaagaggccctacgcggactgcc

SEQ ID NO: 54933 - DNA, 75 bp, Artificial Sequence
  Synthetic
caaacacaccggagtgtccaaatgcctcaagagcatggaatgtgtgggaggtggaagattacgggttcggagtct

SEQ ID NO: 54934 - DNA, 75 bp, Artificial Sequence
  Synthetic
agaggaccatccttgagaacaaccactgcctcaggaaaactcataactgagtggtgctgcagatcatgcacatta

SEQ ID NO: 54935 - DNA, 75 bp, Artificial Sequence
  Synthetic
gaatgtgtgggaggtggaagattacgggttcggagtcttcacaaccaacatatggctgaaactccgagaggtgta

SEQ ID NO: 54936 - DNA, 75 bp, Artificial Sequence
  Synthetic
cccacattaccgaagtggaacctgaagacattgactgctggtgcaacctcacatcaacatgggtgacttatggaa

SEQ ID NO: 54937 - DNA, 75 bp, Artificial Sequence
  Synthetic
gggccgtacatgccgacatgggctattggatagaaagccaaaagaatggaagttggaagctagaaaaagcatccc

SEQ ID NO: 54938 - DNA, 75 bp, Artificial Sequence
  Synthetic
gaaaacccacttatgagaaggacgcagaccttggagcaggaacgagaagtgtctccactgaaacagaaaaaccag

SEQ ID NO: 54939 - DNA, 75 bp, Artificial Sequence
  Synthetic
aaaattagagctggacttcaactattgtgaaggaacaacagttgtcatcacagaaaactgtgggacaagaggccc

SEQ ID NO: 54940 - DNA, 75 bp, Artificial Sequence
  Synthetic
ctttgacacagagtatccaaagacgaaactcacggactgggattttgtggtcaccacagacatatctgaaatggg

SEQ ID NO: 54941 - DNA, 75 bp, Artificial Sequence
  Synthetic
tcaccacagacatatctgaaatgggggccaattttagagctgggagagtgatagaccccaggagatgcctcaagc

SEQ ID NO: 54942 - DNA, 75 bp, Artificial Sequence
  Synthetic
cagttatcctaacagatgggccagagagagttattctagcaggtccaatcccagtaactccagcaagtgccgctc

SEQ ID NO: 54943 - DNA, 75 bp, Artificial Sequence
  Synthetic
gcctgattacagtcaacccaatcgtaacagaaaaagatagcccagtcaacatagaagcagaacctccattcggag

SEQ ID NO: 54944 - DNA, 75 bp, Artificial Sequence
  Synthetic
ggaggagtcggagggagccatttggtgaacgtaggaagctctgagacacgcaacaggggataggcaaggacacac

SEQ ID NO: 54945 - DNA, 75 bp, Artificial Sequence
  Synthetic
cccccccaaaacaaaaaacagcatattgacgctgggaaagaccagagatcctgcttctcctcagcatcatccagg

SEQ ID NO: 54946 - DNA, 75 bp, Artificial Sequence
  Synthetic
gctgcgcaaaggagagggagagttggcaggaacccacaaaaggaaaatgaccagtacatattcacgggccagccc

SEQ ID NO: 54947 - DNA, 75 bp, Artificial Sequence
  Synthetic
gaccaatgtttgccgtcgggctattattccgcagactaacatctagagaagttcttcttcttacaattggattga

SEQ ID NO: 54948 - DNA, 75 bp, Artificial Sequence
  Synthetic
aataacgtgtgctaagtttaagtgtgtgacaaaactggaaggaaagatagtccaatatgaaaacttgaaatattc

SEQ ID NO: 54949 - DNA, 75 bp, Artificial Sequence
  Synthetic
cacaatgggaaaagactggaaccaaactgggctagcgtgaaaaaagatctgatttcatacggaggaggatggaga

SEQ ID NO: 54950 - DNA, 75 bp, Artificial Sequence
  Synthetic
ggagaacagccaccctgattttggccggagtttcgcttttaccagtgtgccagtcttcgagcatgaggaaaacag

SEQ ID NO: 54951 - DNA, 75 bp, Artificial Sequence
  Synthetic
tgagaattatctagattatatgacatcaatgaagagattcaagaacgagagtgatcccgaaggggcactctggtg

SEQ ID NO: 54952 - DNA, 75 bp, Artificial Sequence
  Synthetic
aggaaaacatggcaaggaaatcaaaataacaccacagagttccatcacagaagcagaactgacaggctatggcac

SEQ ID NO: 54953 - DNA, 75 bp, Artificial Sequence
  Synthetic
ttgggttctaccaggtaaaaacagaaaccaccattcttgatgtggatttgagaccagcctcagcatggacactct

SEQ ID NO: 54954 - DNA, 75 bp, Artificial Sequence
  Synthetic
cactctggtgcctcacacaatatactagtggaggtccaagatgatggaaccatgaagataaaggatgaagagaga

SEQ ID NO: 54955 - DNA, 75 bp, Artificial Sequence
  Synthetic
agatcaatggtgtggatccctgataggcttaacagcaagggccacctgggccaccaacatacaagtggccataaa

SEQ ID NO: 54956 - DNA, 75 bp, Artificial Sequence
  Synthetic
ccatcataaacagagagggaaaggtagtgggactgtatggcaatggagtggttacaaagaatggtggctacgtca

SEQ ID NO: 54957 - DNA, 75 bp, Artificial Sequence
  Synthetic
aactccttggtcacagccggacatgggcagattgacaacttttcactaggagtcttgggaatggcattgttcctg

SEQ ID NO: 54958 - DNA, 75 bp, Artificial Sequence
  Synthetic
tgcaaaccaggcagctatattgatgggacttgacaagggatggccaatatcgaagatggacataggagttccact

SEQ ID NO: 54959 - DNA, 75 bp, Artificial Sequence
  Synthetic
caagtgcagcacagagaagagggagaataggaaggaatcccaaaaatgagaacgaccaatatatttacatgggag

SEQ ID NO: 54960 - DNA, 75 bp, Artificial Sequence
  Synthetic
atagacggtgaataccggttaaggggggaagcaaggaaaacctttgtggacctgatgaaaagaggagacctacca

SEQ ID NO: 54961 - DNA, 75 bp, Artificial Sequence
  Synthetic
ctgccctaagagatggatctaaaatcaagcatgcggtgtccagagggtctagtaagatcagatggattgttgaaa

SEQ ID NO: 54962 - DNA, 75 bp, Artificial Sequence
  Synthetic
gaagatggagcctacagaatcaagcaaaaaggaattcttggatattcccagatcggagccggagtttacaaagaa

SEQ ID NO: 54963 - DNA, 75 bp, Artificial Sequence
  Synthetic
ggtctttcccagcgtcaatatgctgtttttgtgttgggggggtctcctctaacctctagtccttccaccaggagt

SEQ ID NO: 54964 - DNA, 75 bp, Artificial Sequence
  Synthetic
acacccaggattcacggtgatagccctttttttagcacatgccataggaacatccatcactcagaaagggatcat

SEQ ID NO: 54965 - DNA, 75 bp, Artificial Sequence
  Synthetic
ctgcaggcatgatcatcatgctgattccaacagtgatggcgttccatctaaccacacgcaacggagaaccacaca

SEQ ID NO: 54966 - DNA, 75 bp, Artificial Sequence
  Synthetic
aggaaatgacattgctaactgtttaagaaagaacggaaaacgggtgatccaattgagcagaaaaacctttgacac

SEQ ID NO: 54967 - DNA, 75 bp, Artificial Sequence
  Synthetic
cctcttctcaggcagaatgagccagaagacatagactgttggtgcaactccacgtctacgtgggtaacctatggg

SEQ ID NO: 54968 - DNA, 75 bp, Artificial Sequence
  Synthetic
gaatgacatgggaaaggtaagaaaagacataccgcagtgggaaccttcaaaaggatggaatgattggcaacaagt

SEQ ID NO: 54969 - DNA, 75 bp, Artificial Sequence
  Synthetic
ttagaggagacccctcccatgacacaacgcagcagcggggcccgagcactgagggaagctgtacctcctctgaga

SEQ ID NO: 54970 - DNA, 75 bp, Artificial Sequence
  Synthetic
aagaaccgaaacgtggatgtcctctgaaggcgcctggaaacaaatacaaaaagtggagacttgggccttgagaca

SEQ ID NO: 54971 - DNA, 75 bp, Artificial Sequence
  Synthetic
agacaccatagaaacattgatgctcctagctttgatagctgtgctgactggtggagtgacgctgttcttcctatc

SEQ ID NO: 54972 - DNA, 75 bp, Artificial Sequence
  Synthetic
catttaagctagagaaggaagtggctgagacccagcatggaactgttctagtgcaggtcaaatacgaaggaacag

SEQ ID NO: 54973 - DNA, 75 bp, Artificial Sequence
  Synthetic
ccgggcgggagatcgtggacctaatgtgtcatgccacatttaccatgaggctgctatcaccagtcagagtgccaa

SEQ ID NO: 54974 - DNA, 75 bp, Artificial Sequence
  Synthetic
gtgtcatgccacatttaccatgaggctgctatcaccagtcagagtgccaaattacaacctgatcatcatggacga

SEQ ID NO: 54975 - DNA, 75 bp, Artificial Sequence
  Synthetic
actgtcaggagcaacgtgggtggatgtggtactggagcatggaagctgcgtcaccaccatggcaaaaaataaacc

SEQ ID NO: 54976 - DNA, 75 bp, Artificial Sequence
  Synthetic
ctcctagataacatcaacacacctgaaggaatcattcctagcatgttcgagccagagcgtgaaaaggtggatgcc

SEQ ID NO: 54977 - DNA, 75 bp, Artificial Sequence
  Synthetic
agccaacgcttccgacaggatggggatgggaacgacgtacctagctctgatggccacttttaaaatgagaccaat

SEQ ID NO: 54978 - DNA, 75 bp, Artificial Sequence
  Synthetic
atgatgaggacaatccatataaaacatgggcctatcatggatcatatgaggtcaagccatcaggatcagcctcat

SEQ ID NO: 54979 - DNA, 75 bp, Artificial Sequence
  Synthetic
gttatgtcatatccggaagctcggccgatttatcactggagaaagcggctgaggtctcctgggaagaagaagcag

SEQ ID NO: 54980 - DNA, 75 bp, Artificial Sequence
  Synthetic
gtcggccatagtcctggagttttttatgatggtgttgcttataccagaaccagaaaagcagagaaccccccaaga

SEQ ID NO: 54981 - DNA, 75 bp, Artificial Sequence
  Synthetic
cagttttttattagagagcagatctctgatgaacaaccaacggaaaaagacgggtcgaccgtctttcaatatgct

SEQ ID NO: 54982 - DNA, 75 bp, Artificial Sequence
  Synthetic
agagcgggtgatcctggcaggacctatgccagtgacccactctagtgcagcacaaagaagagggagaataggaag

SEQ ID NO: 54983 - DNA, 75 bp, Artificial Sequence
  Synthetic
caggattgcaggcaaaagccactcgtgaagctcagaaaaggacagctgctggaataatgaagaatccaacggtgg

SEQ ID NO: 54984 - DNA, 75 bp, Artificial Sequence
  Synthetic
gggaaacatgtatgcagatgacacagccggatgggatacaaggataacagaggatgatcttcagaatgaggccaa

SEQ ID NO: 54985 - DNA, 75 bp, Artificial Sequence
  Synthetic
ccagaatgggagattgataacagccaatcccatagtcactgacaaagaaaaaccagtcaacattgagacagaacc

SEQ ID NO: 54986 - DNA, 75 bp, Artificial Sequence
  Synthetic
acttttcaaaaccaacaccggaaccataggtgccgtatctctggacttttcccctggaacgtcaggatctccaat

SEQ ID NO: 54987 - DNA, 75 bp, Artificial Sequence
  Synthetic
gggcaccttcaagacccctgaaggtgaagttggagccattgccctagattttaaacccggcacatctggatctcc

SEQ ID NO: 54988 - DNA, 75 bp, Artificial Sequence
  Synthetic
ttaaatcaattatcccggaaagagtttgacctttacaagaaatctggaatcactgaagtggatagaacagaagcc

SEQ ID NO: 54989 - DNA, 75 bp, Artificial Sequence
  Synthetic
cactgaagtggatagaacagaagccaaagaagggttgaaaagaggagaaataacacatcatgccgtgtccagagg

SEQ ID NO: 54990 - DNA, 75 bp, Artificial Sequence
  Synthetic
cagcccggaatcggaagcttgatagagatagatcaaacagtgtttaattcaagagcagatctctgatgaacaacc

SEQ ID NO: 54991 - DNA, 75 bp, Artificial Sequence
  Synthetic
gaaaacatggagggatgctagtgcgaaacccactctcaagaaattctacccatgaaatgtattgggtttcatgtg

SEQ ID NO: 54992 - DNA, 75 bp, Artificial Sequence
  Synthetic
tccagatggagtagaaagatgctgatgactggaacactggctgttttcctccttcttataatgggacaactgaca

SEQ ID NO: 54993 - DNA, 75 bp, Artificial Sequence
  Synthetic
gtgtggtgtcgacaggttaaagaggatggcaatcagtggagacgattgcgtggtgaagcccctagatgagaggtt

SEQ ID NO: 54994 - DNA, 75 bp, Artificial Sequence
  Synthetic
aaaaatgattaggccacaacccatggaacacaaatactcatggaaaagctggggaaaagctaaaatcataggagc

SEQ ID NO: 54995 - DNA, 75 bp, Artificial Sequence
  Synthetic
ggacaatccatggatggaagacaagacccccgtggaatcatgggaagacataccatacctagggaaaagggaaga

SEQ ID NO: 54996 - DNA, 75 bp, Artificial Sequence
  Synthetic
ccaagccacagtgttaatgggtcttgggaaaggatggccattgtcaaagatggacatcggagttccccttctcgc

SEQ ID NO: 54997 - DNA, 75 bp, Artificial Sequence
  Synthetic
gcagaaaaagaaacagagatcaggagtgttatgggacacacccagccctccagaagtggaaagagcagttcttga

SEQ ID NO: 54998 - DNA, 75 bp, Artificial Sequence
  Synthetic
gccatgccgcaaccaagatgaacttgtgggtagggctagagtatcacaaggcgccggatggagcctgagagaaac

SEQ ID NO: 54999 - DNA, 75 bp, Artificial Sequence
  Synthetic
acactcaagtgggaaccttagctctttccttgactttcataagatcaacaatgccattggtcatggcttggagga

SEQ ID NO: 55000 - DNA, 75 bp, Artificial Sequence
  Synthetic
ttatcagtgtggaatagggtttggatagaggaaaacccatggatggaggacaaaactcatgtgtccagttgggaa

SEQ ID NO: 55001 - DNA, 75 bp, Artificial Sequence
  Synthetic
aaagaaacttaacaataatggacctacatccaggatcaggaaaaacaagaagatatcttccagccatagtccgtg

SEQ ID NO: 55002 - DNA, 75 bp, Artificial Sequence
  Synthetic
tggcttggagcacgcttcttagagtttgaagccctaggatttttgaatgaagaccattggttctccagagagaac

SEQ ID NO: 55003 - DNA, 75 bp, Artificial Sequence
  Synthetic
tggataccattagcattgacaatcaagggtctcaatccaacagctatttttctaacaaccctctcaagaaccaac

SEQ ID NO: 55004 - DNA, 75 bp, Artificial Sequence
  Synthetic
tgtgctaagttcaagtgtgtgacaaaactagaaggaaagatagttcaatatgaaaacttaaaatattcagtgata

SEQ ID NO: 55005 - DNA, 75 bp, Artificial Sequence
  Synthetic
gcaaagagggttattcgggaaaactcaggttggagtagggatacacatggaaggtgtgtttcacacaatgtggca

SEQ ID NO: 55006 - DNA, 75 bp, Artificial Sequence
  Synthetic
agtgtgacacattgttgtgtgacataggggagtcgtcaccaaatcccacggtagaagcaggacgaacactcagag

SEQ ID NO: 55007 - DNA, 75 bp, Artificial Sequence
  Synthetic
atggacgtggagatctggacaaaggaaggagaaagaaagaaattacgaccccgctggctggatgccagaacatac

SEQ ID NO: 55008 - DNA, 75 bp, Artificial Sequence
  Synthetic
aggatacacaaaaggaggacctggacatgaggaaccaatcccaatggcaacctatggatggaacctagtaaagct

SEQ ID NO: 55009 - DNA, 75 bp, Artificial Sequence
  Synthetic
agacagaaaagagtttgaagagtacaaaagaagtggaatactagaagtggacaggactgaagccaagtctgccct

SEQ ID NO: 55010 - DNA, 75 bp, Artificial Sequence
  Synthetic
aagaagctgtgctgcctgtgagccccgtccaaggacgttaaaagaagaagtcaggccccaaagccccggtttgag

SEQ ID NO: 55011 - DNA, 75 bp, Artificial Sequence
  Synthetic
gcaacaacgttacaactgccagaggacattgaacaaatggcaaatggaatcgctctggggctcatggctcttaaa

SEQ ID NO: 55012 - DNA, 75 bp, Artificial Sequence
  Synthetic
agagtgacatgatcatcccaaagagtctagctggtcctatttcgcaacacaaccacaggcccgggtaccacaccc

SEQ ID NO: 55013 - DNA, 75 bp, Artificial Sequence
  Synthetic
aaggagtggagaggttaaaaagaatggccattagcggggatgattgcgtggtgaaaccaatcgatgacaggttcg

SEQ ID NO: 55014 - DNA, 75 bp, Artificial Sequence
  Synthetic
aacagctgatgcctttcctcagagcaatgctccaattcaagatgaagaaagagacataccagaacgctcatggaa

SEQ ID NO: 55015 - DNA, 75 bp, Artificial Sequence
  Synthetic
tgcaaactgtggaagctgtacgcacagtgtacgcagactagcggttagaggagacccctcccatgacacaacgca

SEQ ID NO: 55016 - DNA, 75 bp, Artificial Sequence
  Synthetic
atagaaaaaataaaacaagagcatgaaacatcatggcactatgaccaagaccacccatacaaaacgtgggcttac

SEQ ID NO: 55017 - DNA, 75 bp, Artificial Sequence
  Synthetic
accatcgtgataacacctcactcaggagaagagcacgctgtaggtaatgacacaggaaaacatggcaaggaaatc

SEQ ID NO: 55018 - DNA, 75 bp, Artificial Sequence
  Synthetic
gaccattagtggccgggggcttgctgatagcgtgctacgtcataactggcacgtcagcagacctcactgtagaaa

SEQ ID NO: 55019 - DNA, 75 bp, Artificial Sequence
  Synthetic
gttccatctgactacacgagggggagagccgcatatgatagttaccaagcaggaaagaggaaagtcacttttgtt

SEQ ID NO: 55020 - DNA, 75 bp, Artificial Sequence
  Synthetic
cactcagagtcctcaacttagtggaaaattggttgaacaataacacccaattttgcataaaggtcctcaacccat

SEQ ID NO: 55021 - DNA, 75 bp, Artificial Sequence
  Synthetic
ttttgggagctggttgacaaggaaaggaatctccatcttgaaggaaagtgtgaaacatgtgtgtacaacatgatg

SEQ ID NO: 55022 - DNA, 75 bp, Artificial Sequence
  Synthetic
tctggatctcccatcgtgaacagagagggaaaaatagtaggtctttatggaaatggagtggtgacaacaagtgga

SEQ ID NO: 55023 - DNA, 75 bp, Artificial Sequence
  Synthetic
aagaaaagaaacttaacaataatggacctgcatccaggatcaggaaaaacaagaagatatcttccagccatagtc

SEQ ID NO: 55024 - DNA, 75 bp, Artificial Sequence
  Synthetic
taagctcaacgtagttctaacagtttttgattagagagcagatctctgatgaataaccaacggaaaaaggcgaga

SEQ ID NO: 55025 - DNA, 75 bp, Artificial Sequence
  Synthetic
ctgagggaagctgtacctccttgcaaaggactagaggttagaggagaccccccgcaaataaaaacagcatattga

SEQ ID NO: 55026 - DNA, 75 bp, Artificial Sequence
  Synthetic
aaggactagaggttagaggagaccccccgcaaataaaaacagcatattgacgctgggagagaccagagatcctgc

SEQ ID NO: 55027 - DNA, 75 bp, Artificial Sequence
  Synthetic
gcagatctctggaaaaatgaaccaacgaaaaaaggtggtcagaccacctttcaatatgctgaaacgcgagagaaa

SEQ ID NO: 55028 - DNA, 75 bp, Artificial Sequence
  Synthetic
ccctccatgacacaacgcagcagcggggcccgagcactgagggaagctgtacctccctgcctgagactaccaagg

SEQ ID NO: 55029 - DNA, 75 bp, Artificial Sequence
  Synthetic
tcacaatggctcacaggaaaccaacatatgaaagagacgtggacttaggcgccggaacaagacatgtggcagtgg

SEQ ID NO: 55030 - DNA, 75 bp, Artificial Sequence
  Synthetic
ggaagaagagatgttcaaaaagcgaaatctaaccataatggatcttcatcctgggtcaggaaagacacggaaata

SEQ ID NO: 55031 - DNA, 75 bp, Artificial Sequence
  Synthetic
gtattggtgggcgtcgtgacactgtacctgggagctatggtgcaagctgatagtggttgcgttgtgagctggaaa

SEQ ID NO: 55032 - DNA, 75 bp, Artificial Sequence
  Synthetic
tctagaaacaaaaaacccagaatctgcacaagagaggagttcacaagaaaagttaggtcaaacgcagcaattgga

SEQ ID NO: 55033 - DNA, 75 bp, Artificial Sequence
  Synthetic
agtcttgaagatggtggagccatggctctcttcaaaacctgaattctgcatcaaagtccttaacccctacatgcc

SEQ ID NO: 55034 - DNA, 75 bp, Artificial Sequence
  Synthetic
tggactatgaaaataggaatagggattctgctgacatggctgggattaaattcaaggagcacgtcactttcgatg

SEQ ID NO: 55035 - DNA, 75 bp, Artificial Sequence
  Synthetic
caattgagcagaaaaacctttgacactgagtaccagaaaacaaaaaacaatgactgggactatgttgtcacaaca

SEQ ID NO: 55036 - DNA, 75 bp, Artificial Sequence
  Synthetic
agcagactagcggttagaggagacccctccatgacacaacgcagcagcggggcccagcactgagggaagctgtac

SEQ ID NO: 55037 - DNA, 75 bp, Artificial Sequence
  Synthetic
gtcggattaagccatagtacggaaaaaactatgctacctgtggagccccgcccagggacgttaaaagaagtcagg

SEQ ID NO: 55038 - DNA, 75 bp, Artificial Sequence
  Synthetic
tagttgtgggtgatataattggggtcttagagcaagggaaaagaacactaacaccacaacccatggagctaaaat

SEQ ID NO: 55039 - DNA, 75 bp, Artificial Sequence
  Synthetic
caccctgagaaggtggttagaaaaaccgggggaggcaacaaaacccatggaaggcttttccccaatgggcgtaaa

SEQ ID NO: 55040 - DNA, 75 bp, Artificial Sequence
  Synthetic
tttgacttagccggttatgaaggaagcacccccccccctttaaaaaatttgcgaggcaaaaaattgggggggccc

SEQ ID NO: 55041 - DNA, 75 bp, Artificial Sequence
  Synthetic
atcagtgggtggtgttctgaactcattaggcaaaatggtgcaccaaatatttggaagtgcttacacagccctatt

SEQ ID NO: 55042 - DNA, 75 bp, Artificial Sequence
  Synthetic
agttgttagtactacgtggaccgacaagaatcagtttcgaatcggaagcttgccggttaacgtagttctaacagt

SEQ ID NO: 55043 - DNA, 75 bp, Artificial Sequence
  Synthetic
agagctggatactcagaaacccaggatttgcgctcttggcaggatttatggcttatatgattgggcaaacaggaa

SEQ ID NO: 55044 - DNA, 75 bp, Artificial Sequence
  Synthetic
agagtgacatgatcatcccaaagagtctggctggtcctatctcgcaacacaactacaggcccggataccacaccc

SEQ ID NO: 55045 - DNA, 75 bp, Artificial Sequence
  Synthetic
gtgacctgtgctatgttcacatgcaaaaagaacatggaaggaaaaatcgtgcaaccagaaaacttggaatacacc

SEQ ID NO: 55046 - DNA, 75 bp, Artificial Sequence
  Synthetic
aacatcctcacagcagaaagcggattggataccactggcattgacgataaaaggtctcaatccaacagccatttt

SEQ ID NO: 55047 - DNA, 75 bp, Artificial Sequence
  Synthetic
ctagagagtgacatgatcatcccaaagagtctagctggtcctatttcgcaacacaactacaggcccgggtaccac

SEQ ID NO: 55048 - DNA, 75 bp, Artificial Sequence
  Synthetic
aaacataactacggcaacaagatgtccaacgcaaggagagccttacctgaaagaggaacaggaccaacagtacat

SEQ ID NO: 55049 - DNA, 75 bp, Artificial Sequence
  Synthetic
actaagttcactcctcaaaaatgatgtgccgctagccggcccactaatagctggaggcatgctaatagcatgtta

SEQ ID NO: 55050 - DNA, 75 bp, Artificial Sequence
  Synthetic
attgcaacatttaaaattcagccatttttggctttgggattcttcctgaggaaactgacatctagagaaaattta

SEQ ID NO: 55051 - DNA, 75 bp, Artificial Sequence
  Synthetic
caatcaacatagaagcagaacctccatttggtgatagctacattgtcataggagtggagccaggacagctgaaat

SEQ ID NO: 55052 - DNA, 75 bp, Artificial Sequence
  Synthetic
tcgattgtgaacccaggtctggaattgactttaatgagatgatcctaatgaaaatgaaaaagaaaacatggctcg

SEQ ID NO: 55053 - DNA, 75 bp, Artificial Sequence
  Synthetic
caaaaaagcaagaagtagttgtccttggatcgcaagagggagcaatgcacacagcgctgacaggagctacagaga

SEQ ID NO: 55054 - DNA, 75 bp, Artificial Sequence
  Synthetic
ctggccactgaatgagggggtgatggccgttggacttgtgagcattctagcaagttctctccttaggaatgacgt

SEQ ID NO: 55055 - DNA, 75 bp, Artificial Sequence
  Synthetic
agaagccataaaacgtggcttgagaacattaatcctggctcccactagagtcgtggcagctgaaatggaggaagc

SEQ ID NO: 55056 - DNA, 75 bp, Artificial Sequence
  Synthetic
gaaaatcacacaatggttggaaaccaaaggagtggagaggttaaaaagaatggccatcagcggagatgattgcgt

SEQ ID NO: 55057 - DNA, 75 bp, Artificial Sequence
  Synthetic
ctgagaataccaacagtgtaaccaacatagaattagaacccccttttggggacagctacatagtgataggtgttg

SEQ ID NO: 55058 - DNA, 75 bp, Artificial Sequence
  Synthetic
gttcaggaaagggagttccattggcaagatgtttgagtccacatacagaggtgcaaaacgaatggccattctagg

SEQ ID NO: 55059 - DNA, 75 bp, Artificial Sequence
  Synthetic
ttggaactggattttgatttgtgtgagggtaccacagttgttgtggatgaacattgtggaaatcgaggaccatct

SEQ ID NO: 55060 - DNA, 75 bp, Artificial Sequence
  Synthetic
ctggcattgggttgctattcacaagtgaacccactaactctaacagcggcagtactcttgctgatcacacattat

SEQ ID NO: 55061 - DNA, 75 bp, Artificial Sequence
  Synthetic
ggagtctcatggatgattagaatcctaattgggttcttagttttgtggattggcacgaactcaaggaacacttca

SEQ ID NO: 55062 - DNA, 75 bp, Artificial Sequence
  Synthetic
aatactttcactaatatggaggtccaactaataagacaaatggagtctgaaggaatctttttacccagcgaattg

SEQ ID NO: 55063 - DNA, 75 bp, Artificial Sequence
  Synthetic
ctaatattggaaatagggaaacttccacaacatttgacgctaagagcccagaatgctctggataacttggtcatg

SEQ ID NO: 55064 - DNA, 75 bp, Artificial Sequence
  Synthetic
tcattcaagaagaatggagcgatcaaagtgctacggggtttcaagaaagaaatctcaaacatgttgaacataatg

SEQ ID NO: 55065 - DNA, 75 bp, Artificial Sequence
  Synthetic
aattggtacaccaggtttttggaaccgcatatggggttctgttcagcggtgtttcttggaccatgaaaataggaa

SEQ ID NO: 55066 - DNA, 75 bp, Artificial Sequence
  Synthetic
aggttagaggagaccccccgcaaataaaaacagcatattcacgctgggagagaccagagatcctgctgtctcctc

SEQ ID NO: 55067 - DNA, 75 bp, Artificial Sequence
  Synthetic
aaattggatacagaaagaaacattggtcactttcaaaaatccccatgcgaaaaaacaggatgttgttgttttagg

SEQ ID NO: 55068 - DNA, 75 bp, Artificial Sequence
  Synthetic
gtcactttcaaaaatccccatgcgaaaaaacaggatgttgttgttttaggatcccaagaaggggccatgcataca

SEQ ID NO: 55069 - DNA, 75 bp, Artificial Sequence
  Synthetic
aacgtgtgccaagttcaagtgtgtgacaaaactggaaggaaagatagttcaatatgaaaacttgaaatattcagt

SEQ ID NO: 55070 - DNA, 75 bp, Artificial Sequence
  Synthetic
aagggaatgtcatacacgatgtgctcaggaaagttctcaattgataaagagatggcagaaacacagcatggaaca

SEQ ID NO: 55071 - DNA, 75 bp, Artificial Sequence
  Synthetic
atggactttgatttctgcgaaggaactacagtggtggtgactgaggactgtggaaatagaggaccctctttaaga

SEQ ID NO: 55072 - DNA, 75 bp, Artificial Sequence
  Synthetic
gtcaatggtctctgcagggtcaggagaagtggacagtttttcattaggaatactatgcgtatcaataatgattga

SEQ ID NO: 55073 - DNA, 75 bp, Artificial Sequence
  Synthetic
atctttgaggaccaccactgcatctggaaaactagtcacgcaatggtgttgccgctcctgcacgatgcccccctt

SEQ ID NO: 55074 - DNA, 75 bp, Artificial Sequence
  Synthetic
aggttagaggagaccccccgcacaacaacaaacagcatattgacgctgggagagaccagagatcctgctgtctct

SEQ ID NO: 55075 - DNA, 75 bp, Artificial Sequence
  Synthetic
aacttggtcatgttgcacaattccgaacaaggaggaaaagcctacagacatgctatggaagaactaccagacacc

SEQ ID NO: 55076 - DNA, 75 bp, Artificial Sequence
  Synthetic
ccagaaaatggaatgctgctgttgaatcacggactagtatttatacatgacagccatgccgcatccgagatgata

SEQ ID NO: 55077 - DNA, 75 bp, Artificial Sequence
  Synthetic
agtttttcaagaaaacgtgttccacacaatgtggcatgtcaccaggggagctgtactcatgtatcaagggaagag

SEQ ID NO: 55078 - DNA, 75 bp, Artificial Sequence
  Synthetic
gggacactatgtctggtagaataggaggacagacccacctagccatcatggcagtgttcaagatgtcaccaggat

SEQ ID NO: 55079 - DNA, 75 bp, Artificial Sequence
  Synthetic
aaaggatgtgttttatcttccacctgaaaagtgtgacactctattgtgtgacattggagaatcttcaccaagccc

SEQ ID NO: 55080 - DNA, 75 bp, Artificial Sequence
  Synthetic
agcaactctgctagcagtttcaggggtgtacccattatcaataccagcgaccctttttgtgtggtacttttggca

SEQ ID NO: 55081 - DNA, 75 bp, Artificial Sequence
  Synthetic
aaggatgctgaacatcttgaacaggagacgcaggacagcaggcgtgattattatgttgattccaacagcgatggc

SEQ ID NO: 55082 - DNA, 75 bp, Artificial Sequence
  Synthetic
atatgataacccttttggtgaaactggcactgataacagtgtcaggtctctaccccttggcaattccagtcacaa

SEQ ID NO: 55083 - DNA, 75 bp, Artificial Sequence
  Synthetic
tagaggaaaacccatggatggaggacaaaacccatgtatccagttgggaagatgttccatatttaggaaaaaggg

SEQ ID NO: 55084 - DNA, 75 bp, Artificial Sequence
  Synthetic
gttaaaaagaatggccatcagcggggatgattgcgtggtgaaaccaatcgacgacaggttcgccaatgccctgct

SEQ ID NO: 55085 - DNA, 75 bp, Artificial Sequence
  Synthetic
atacagccacactggatagcagcttcaataatactggagttttttctcatagttttgctcattccagaaccagaa

SEQ ID NO: 55086 - DNA, 75 bp, Artificial Sequence
  Synthetic
gctgtgctgcctgtgagccccgtcaaggacgttaaaagaagaagtcaggccccaaagccacggtttgagcaaacc

SEQ ID NO: 55087 - DNA, 75 bp, Artificial Sequence
  Synthetic
aaagaccagcaaaaaatggaaccgtgatggatgtcatatccagacgtgaccagagaggaagtggacaggtcggaa

SEQ ID NO: 55088 - DNA, 75 bp, Artificial Sequence
  Synthetic
gagcaacgccccaatagtggacgaggaaagagagattcccgaacgctcatggaattccggacatgaatggataac

SEQ ID NO: 55089 - DNA, 75 bp, Artificial Sequence
  Synthetic
aaaaccaatggaactcagcaaaagaagcagtggaagacgaaaggttttgggatctcgtgcacagagagagggagc

SEQ ID NO: 55090 - DNA, 75 bp, Artificial Sequence
  Synthetic
tgctatggaggaactaccagacaccatagaaacattgatgctactagctttgatagctgtgttgactggtggagt

SEQ ID NO: 55091 - DNA, 75 bp, Artificial Sequence
  Synthetic
gagatggaagaggccctacgtggactgccaatccgttaccagaccccagctgtgaaatcagaacacacaggaaga

SEQ ID NO: 55092 - DNA, 75 bp, Artificial Sequence
  Synthetic
tatactggggattggaggtagagtaagggggaattggtctgggcaaaaacgggatccgacaggggaggagcatct

SEQ ID NO: 55093 - DNA, 75 bp, Artificial Sequence
  Synthetic
ggacaagctgtcttcaaaagcagtcccattgggtggaaataacagcactcatcctgggagcccaggctctgccag

SEQ ID NO: 55094 - DNA, 75 bp, Artificial Sequence
  Synthetic
tcaccgatccttccagtgtcgcggctagaggatacatttcgaccagggtggaaatgggagaggcagcagctatct

SEQ ID NO: 55095 - DNA, 75 bp, Artificial Sequence
  Synthetic
caagtggccataaaccaagtgagaaggctcatcgggaatgagaattatctagattacatgacatcaatgaagaga

SEQ ID NO: 55096 - DNA, 75 bp, Artificial Sequence
  Synthetic
aagtggtgctttgatggaatcagaaataatcagatcctggaggagaacatggaagtggaagtttggacgaaagaa

SEQ ID NO: 55097 - DNA, 75 bp, Artificial Sequence
  Synthetic
gacttctcttttccattatgaagaacacaacaaacacaagaagaggaactggcaacataggagagacacttggag

SEQ ID NO: 55098 - DNA, 75 bp, Artificial Sequence
  Synthetic
aaacctttgatacagaatatccaaaaacgaaactcacggactgggactttgtggtcactacagacatatctgaaa

SEQ ID NO: 55099 - DNA, 75 bp, Artificial Sequence
  Synthetic
ggagaccccccgcacaacaacaaacagcatattgacgctgggagagaccagagatcctgctgtctctacagcatc

SEQ ID NO: 55100 - DNA, 75 bp, Artificial Sequence
  Synthetic
tagacataaccctggagcccgggcccacacctgggtgagttgtcccttggagtgcactgactagagtgtagagaa

SEQ ID NO: 55101 - DNA, 75 bp, Artificial Sequence
  Synthetic
gatgtacagaacaccaccttcatcatcgacggcccaaacaccccagaatgccctgatgaccaaagagcatggaac

SEQ ID NO: 55102 - DNA, 75 bp, Artificial Sequence
  Synthetic
gggaaaaaacccaagccattgatggagagtttcgcctcagaggggaacaaaggaagacttttgtggaattaatga

SEQ ID NO: 55103 - DNA, 75 bp, Artificial Sequence
  Synthetic
cataattggacctggactgcaagcaaaagctactagagaagctcaaaaaaggacagcggccggaataatgaaaaa

SEQ ID NO: 55104 - DNA, 75 bp, Artificial Sequence
  Synthetic
agcgcaaagaagagggagaataggaagaaatccaaaaaatgaaaatgaccagtacatatacatgggggaacctct

SEQ ID NO: 55105 - DNA, 75 bp, Artificial Sequence
  Synthetic
gatgggacacaagaataacagaggatgatcttcagaatgaggctaaaatcactgacatcatggagcctgaacatg

SEQ ID NO: 55106 - DNA, 75 bp, Artificial Sequence
  Synthetic
tggatagggttgaattcaaaaaacacatccatgtcattttcatgcattgtgataggaatcattacactctatctg

SEQ ID NO: 55107 - DNA, 75 bp, Artificial Sequence
  Synthetic
aaagctcatgaagagggcatttgtggaatccgctcagtgacaagattggagaatctgatgtggaaacaaataaca

SEQ ID NO: 55108 - DNA, 75 bp, Artificial Sequence
  Synthetic
ggtgctatgacagcaggtatcttcctgtttttcatgcaagggaaaggaatagggaaattgtcaatgggtttgata

SEQ ID NO: 55109 - DNA, 75 bp, Artificial Sequence
  Synthetic
taccagaaccagaaaaacaaaggaccccacaagacaatcaattgatctacgtcatattgaccattctcaccatta

SEQ ID NO: 55110 - DNA, 75 bp, Artificial Sequence
  Synthetic
agggaaaactgtgtggtttgttcccagcataaaagctggaaatgacattgcaaattgcttgagaaaatcgggaaa

SEQ ID NO: 55111 - DNA, 75 bp, Artificial Sequence
  Synthetic
ggggctgatagaaaaaacaaaaacggattttgggttttaccaggtaaaaacagaaaccaccatcctcgatgtgga

SEQ ID NO: 55112 - DNA, 75 bp, Artificial Sequence
  Synthetic
ctccgggaaagacgtattctttacaccacctgagaaatgtgacacccttttgtgtgatattggtgagtcctctcc

SEQ ID NO: 55113 - DNA, 75 bp, Artificial Sequence
  Synthetic
attaatcagacagatggagggagaaggagtttttaaaaacattcagcacctgacagtcacagaagaaatcgccgt

SEQ ID NO: 55114 - DNA, 75 bp, Artificial Sequence
  Synthetic
gctggtcatactattgcgctgggctgaagaaagtcacagaagtgaagggatacacaaaaggaggacctggacatg

SEQ ID NO: 55115 - DNA, 75 bp, Artificial Sequence
  Synthetic
caggattgcaggcaaaagccacaagagaggcccagaaaaggacagctgctggaatcatgaaaaatcccacagtgg

SEQ ID NO: 55116 - DNA, 75 bp, Artificial Sequence
  Synthetic
atggctgggattaaattcaaggagcacgtcactttcgatgacgtgcattgcagttggcatggttacactgtacct

SEQ ID NO: 55117 - DNA, 75 bp, Artificial Sequence
  Synthetic
gtggacctaggcgctggaactagacatgtggcagtggaaccagaggtagccaacctggatatcattggccagagg

SEQ ID NO: 55118 - DNA, 75 bp, Artificial Sequence
  Synthetic
actcttgatgagaacaacatgggctttctgtgaagtcttgactttggccacaggaccaatcttgaccttgtggga

SEQ ID NO: 55119 - DNA, 75 bp, Artificial Sequence
  Synthetic
aaagtttaaagttgtgaaggaaatagcagaaacacaacatggaacaatagttatcagagtacaatatgaagggga

SEQ ID NO: 55120 - DNA, 75 bp, Artificial Sequence
  Synthetic
ataaagaatgcacaaacccctaggaggggaactgggaccacaggagagacactgggagagaagtggaagagacag

SEQ ID NO: 55121 - DNA, 75 bp, Artificial Sequence
  Synthetic
gtcggaacttatggcttaaatactttcaccaacatggaggtccaactaataagacaaatggagtctgaaggaatc

SEQ ID NO: 55122 - DNA, 75 bp, Artificial Sequence
  Synthetic
tagtcttagaacatggaagttgtgtgacgacgatggcaaaaaacaaaccaacattggactttgaactgataaaaa

SEQ ID NO: 55123 - DNA, 75 bp, Artificial Sequence
  Synthetic
cacattgggttccaacaagtcgaacaacctggtccatacacgccaaacatgaatggatgacaacggaagacatgc

SEQ ID NO: 55124 - DNA, 75 bp, Artificial Sequence
  Synthetic
tacatgccaagtgtggtggaaactctggagcaaatgcaaagaaaacatggaggaatgctagtgcgaaatccactc

SEQ ID NO: 55125 - DNA, 75 bp, Artificial Sequence
  Synthetic
acaaaaacagcatattgacgctgggaaagaccagagatcctgctgtctctgcaacatcaatccaggcacagagcg

SEQ ID NO: 55126 - DNA, 75 bp, Artificial Sequence
  Synthetic
tggccatggaccttggtgaattgtgtgaagacacaatcacgtacaagtgtcctcttctcaggcagaatgagccag

SEQ ID NO: 55127 - DNA, 75 bp, Artificial Sequence
  Synthetic
catcttctaatccaacaatagaggaaggaagaacattaagagttttgaagatggtggagccatggctctcttcaa

SEQ ID NO: 55128 - DNA, 75 bp, Artificial Sequence
  Synthetic
aggaagaacattaagagttttgaagatggtggagccatggctctcttcaaaacctgaattctgcatcaaagtcct

SEQ ID NO: 55129 - DNA, 75 bp, Artificial Sequence
  Synthetic
cccgctgtccaggaactccacccatgagatgtattgggtgtcaggagcgtcgggaaacattgtgagctctgtgaa

SEQ ID NO: 55130 - DNA, 75 bp, Artificial Sequence
  Synthetic
taggggcaggtgaaaaagctttgaaactaagctggttcaagaaaggaagcagcatagggaaaatgtttgaagcaa

SEQ ID NO: 55131 - DNA, 75 bp, Artificial Sequence
  Synthetic
ctaccaaaataaggtggtgagggtacagagaccagcaaaaaatggaaccgtgatggatgtcatatccagacgtga

SEQ ID NO: 55132 - DNA, 75 bp, Artificial Sequence
  Synthetic
acaggggccacagaaatccagatgtcatcaggaaacttactgttcacaggacatctcaagtgcaggctgagaatg

SEQ ID NO: 55133 - DNA, 75 bp, Artificial Sequence
  Synthetic
atgaaaggagcctcaagaagatcttggcctcttaacgagggcataatggctgtgggtttggttagtctcttagga

SEQ ID NO: 55134 - DNA, 75 bp, Artificial Sequence
  Synthetic
ctacgtggaccgacaaagacagattctttgagggagctaagctcaacgtagttctaacagttttttaattagaga

SEQ ID NO: 55135 - DNA, 75 bp, Artificial Sequence
  Synthetic
ggaaaaacatggcgtcgaaaggctgaaaagaatggcaatcagcggagatgactgcgtggtgaaaccaattgatga

SEQ ID NO: 55136 - DNA, 75 bp, Artificial Sequence
  Synthetic
acagaacctgggcgtatcatggaagctatgaagctccttcgacaggctctgcatcctccatggtgaacggggtgg

SEQ ID NO: 55137 - DNA, 75 bp, Artificial Sequence
  Synthetic
aaaaggacagctgctgggatcatgaagaaccccacggtggacgggataacagtaatagatctagaaccaatatcc

SEQ ID NO: 55138 - DNA, 75 bp, Artificial Sequence
  Synthetic
ggcaacaaagagtgttcaaagagaaggtggataccagaacaccgcaaccaaaaccaggcacacgaatggttatga

SEQ ID NO: 55139 - DNA, 75 bp, Artificial Sequence
  Synthetic
ctgtatccacagccaacatttttagaggaagctacttggcgggagctggactagctttttcgctcataaagaatg

SEQ ID NO: 55140 - DNA, 75 bp, Artificial Sequence
  Synthetic
gagacccatttcctcagagcaatgcaccaatcatggatgaggaaagagaaatccctgagcgttcgtggaactctg

SEQ ID NO: 55141 - DNA, 75 bp, Artificial Sequence
  Synthetic
ctagacctgccgttgccatggctgcccggagcggacacacaaggatcaaattggatacagaaagagacattggtc

SEQ ID NO: 55142 - DNA, 75 bp, Artificial Sequence
  Synthetic
tggctgtggcttgtttggaaaaggaggagttgtgacatgtgcgaagttctcatgctcggggaagataacaggcaa

SEQ ID NO: 55143 - DNA, 75 bp, Artificial Sequence
  Synthetic
agaggggacttaccagtctggttggcttacagagtggcagctgaaggcatcaactatgcagacagaaggtggtgt

SEQ ID NO: 55144 - DNA, 75 bp, Artificial Sequence
  Synthetic
tagataccaccgtgtctccgactcagactctcctacgtggaccgacaaaagacagattctttgagggagctaagc

SEQ ID NO: 55145 - DNA, 75 bp, Artificial Sequence
  Synthetic
gagaaaattcatggagtggagtggaaggggaaggtctgcacagattgggatacatcctggaggagatagacaaga

SEQ ID NO: 55146 - DNA, 75 bp, Artificial Sequence
  Synthetic
tacatcctggaggagatagacaagaaggatggagacctaatgtatgctgatgacacagcaggctgggacacaaga

SEQ ID NO: 55147 - DNA, 75 bp, Artificial Sequence
  Synthetic
aggatggagacctaatgtatgctgatgacacagcaggctgggacacaagaatcactgaggatgaccttcaaaatg

SEQ ID NO: 55148 - DNA, 75 bp, Artificial Sequence
  Synthetic
gcacctaggcaagttggaattggattttgatttgtgtgagggtaccacagttgttgtggatgaacattgtggaaa

SEQ ID NO: 55149 - DNA, 75 bp, Artificial Sequence
  Synthetic
taagcttgagatggactttgatttctgcgaaggaaccacagtggtggtgactgaggactgtggaaatagaggacc

SEQ ID NO: 55150 - DNA, 75 bp, Artificial Sequence
  Synthetic
aatgaaatgggattgttggaaactacaaagagagatttaggaatgtctaaggagccaggtgttgtttctccaacc

SEQ ID NO: 55151 - DNA, 75 bp, Artificial Sequence
  Synthetic
aaggagaatggaaggaaggagaagaagtccaggtcttggcattggagcctggaaaaaatccaagagccgtccaaa

SEQ ID NO: 55152 - DNA, 75 bp, Artificial Sequence
  Synthetic
taacaagcagggccacctgggcaaagaacattcaaacagccataaaccaagtcagagccctcattggtgaggagg

SEQ ID NO: 55153 - DNA, 75 bp, Artificial Sequence
  Synthetic
tcccacactctatggagcaatggagttctggaaagtgaaatgataatcccaaagatatatggaggaccaatatct

SEQ ID NO: 55154 - DNA, 75 bp, Artificial Sequence
  Synthetic
agttgttagtctacgtggaccgacaaagacagattctttgaggaagctaagcttaacgtagttctaacagttttt

SEQ ID NO: 55155 - DNA, 75 bp, Artificial Sequence
  Synthetic
tcttaggtcgcctgattacagtcaacccaattgtcacagaaaaagacagcccagtcaacatagaagcagaacctc

SEQ ID NO: 55156 - DNA, 75 bp, Artificial Sequence
  Synthetic
aaaagagaggatttgtggtgtggatccctgattggactttcttctagagccacctgggcgaagaacattcacacg

SEQ ID NO: 55157 - DNA, 75 bp, Artificial Sequence
  Synthetic
gaagttaaaagctgccactggccaaagtcacacaccctctggagtaatggagtgctagaaagtgagatgataatt

SEQ ID NO: 55158 - DNA, 75 bp, Artificial Sequence
  Synthetic
agtcacacaccctctggagtaatggagtgctagaaagtgagatgataattccaaagaatttcgctggaccagtgt

SEQ ID NO: 55159 - DNA, 75 bp, Artificial Sequence
  Synthetic
tcggaaaagaggaatacgtggattacatgccagtcatgaaaagatacagtgctccttcagagagtgaaggagttc

SEQ ID NO: 55160 - DNA, 75 bp, Artificial Sequence
  Synthetic
tgtgacgacgatggcgaaaaataaaccaacattggattttgaactgataaaaacagaagccaaacatcccgccac

SEQ ID NO: 55161 - DNA, 75 bp, Artificial Sequence
  Synthetic
ggcaacagagacttcgttgaaggactgtcaggagcaacgtgggtggatgtggtactggagcatggaagctgcgtc

SEQ ID NO: 55162 - DNA, 75 bp, Artificial Sequence
  Synthetic
aagagacgcactggacaacttagctgtgctgcatacggctgaggcaggtggaagggcgtacaatcatgctctcag

SEQ ID NO: 55163 - DNA, 75 bp, Artificial Sequence
  Synthetic
agccaacccagtggtgactaagaaggaggagcctgtcaatattgaggctgaacctccttttggggaaagcaacat

SEQ ID NO: 55164 - DNA, 75 bp, Artificial Sequence
  Synthetic
gaagctgtactcctggtggaaggactagaggttagaggagacccccccaacacaaaaacagcatattgacgctgg

SEQ ID NO: 55165 - DNA, 75 bp, Artificial Sequence
  Synthetic
gaacaaccaacgaaaaaagacgggaaaaccgtctatcaatatgctgaaacgcgtgagaaaccgtgtgtcaactgg

SEQ ID NO: 55166 - DNA, 75 bp, Artificial Sequence
  Synthetic
aattgatgatgaccaccataggaatcgtactcctctcccagagcaccataccagagactatacttgaactgactg

SEQ ID NO: 55167 - DNA, 75 bp, Artificial Sequence
  Synthetic
ccaagaaggggctatgcatacagcactcacaggggccacggaaatccagatgtcatcaggaaacttactgttcac

SEQ ID NO: 55168 - DNA, 75 bp, Artificial Sequence
  Synthetic
gactcggaagcttgcttaacgtagtgctaacagttttttattagagagcagatttctgatgaacaaccaacgaaa

SEQ ID NO: 55169 - DNA, 75 bp, Artificial Sequence
  Synthetic
agggccaggacttcaagcaaaagcaaccagagaagctcagaaaagagcagcagcaggcatcatgaaaaacccaac

SEQ ID NO: 55170 - DNA, 75 bp, Artificial Sequence
  Synthetic
ggagtggtgacaacaagtggaacctacgtcagtgccatagctcaagctaaagcatcacaagaagggcctctacca

SEQ ID NO: 55171 - DNA, 75 bp, Artificial Sequence
  Synthetic
gatcccttataggcaatgaggaatacacagattacatgccatccatgaaaagattcagaagagaagaggaagagg

SEQ ID NO: 55172 - DNA, 75 bp, Artificial Sequence
  Synthetic
gccattgatggtgaataccgcttgagaggagaagcaaggaaaacctttgtggacctaatgagaagaggagaccta

SEQ ID NO: 55173 - DNA, 75 bp, Artificial Sequence
  Synthetic
tttttatactactaatgctggtcactccatccatgacaatgagatgcgtgggagtaggaaacagagattttgtgg

SEQ ID NO: 55174 - DNA, 75 bp, Artificial Sequence
  Synthetic
gaagtcaggccacttgtgccacggcttgagcaaaccgtgctgcctgtagctccgccaataatgggaggcgtaaaa

SEQ ID NO: 55175 - DNA, 75 bp, Artificial Sequence
  Synthetic
cagcggtgtttcttggaccatgaaaataggaatagggattctgctgacatggctaggattaaattcaaggagcac

SEQ ID NO: 55176 - DNA, 75 bp, Artificial Sequence
  Synthetic
tattttgtgactcaaaactcatgtcagcagccataaaagacaacagagccgtccacgccgatatgggttattgga

SEQ ID NO: 55177 - DNA, 75 bp, Artificial Sequence
  Synthetic
actctgacccactggcgctaaaggaattcaaggagtttgcagctggaagaaagtccctgaccctgaacctaatca

SEQ ID NO: 55178 - DNA, 75 bp, Artificial Sequence
  Synthetic
agttgttagtctacgtggaccgacaaagacagattctttgagggagctaagctcaacgtagttctaacagttttt

SEQ ID NO: 55179 - DNA, 75 bp, Artificial Sequence
  Synthetic
aaggaatcattcccagcatgttcgaaccagagcgtgaaaaggtggacgccattgatggtgaataccgcttgagag

SEQ ID NO: 55180 - DNA, 75 bp, Artificial Sequence
  Synthetic
tgtggtttgtttggaaaaggaagcttggtgacatgcgcgaaatttcaatgtctagaaccaatagagggaaaagtg

SEQ ID NO: 55181 - DNA, 75 bp, Artificial Sequence
  Synthetic
acgcagggagtcacggttgagataacaccccaggcatcaaccgttgaagctgtcttgcctgagtatggaaccctt

SEQ ID NO: 55182 - DNA, 75 bp, Artificial Sequence
  Synthetic
cccgagtaggaacgaaacatgcaatattactagttgcagtttctttcgtgacattgatcacagggaacatgtcct

SEQ ID NO: 55183 - DNA, 75 bp, Artificial Sequence
  Synthetic
aacagcgatggcgttccatttaaccacacgcaatggagaaccacacatgatcgttggtaggcaggagaaagggaa

SEQ ID NO: 55184 - DNA, 75 bp, Artificial Sequence
  Synthetic
atggtacataggcaatggttctttgacctacccctaccatggacatcaggagctacaacagagacaccaacttgg

SEQ ID NO: 55185 - DNA, 75 bp, Artificial Sequence
  Synthetic
agggaatttgtgggatccgctcagtaacaagattggagaacctaatgtggaaacaaataacaccagaattgaatc

SEQ ID NO: 55186 - DNA, 75 bp, Artificial Sequence
  Synthetic
tccagtccattcgtgggaagacataccttacctagggaaaagagaggatttgtggtgtggatccctgattggact

SEQ ID NO: 55187 - DNA, 75 bp, Artificial Sequence
  Synthetic
aaagaatgtaaaagaagtcaaaggcctaacaaaaggaggaccaggacacgaagaacctattcccatgtcaacata

SEQ ID NO: 55188 - DNA, 75 bp, Artificial Sequence
  Synthetic
ccatgacaggtccattagtggctggagggctccttactgtgtgttacgtgctcactggacgatcggccgatttgg

SEQ ID NO: 55189 - DNA, 75 bp, Artificial Sequence
  Synthetic
ccttgacccagaaagtggttatttttatactactaatgctggtcaccccatccatgacaatgagatgtgtgggag

SEQ ID NO: 55190 - DNA, 75 bp, Artificial Sequence
  Synthetic
aagaaaaggagctggccactaaatgaagctatcatggcagtcgggatggtgagcattttagccagttctctccta

SEQ ID NO: 55191 - DNA, 75 bp, Artificial Sequence
  Synthetic
aaaatgaagaggaagaacaaacactgaccatactcatcagaacgggattgttggtgatctcaggagtctttccag

SEQ ID NO: 55192 - DNA, 75 bp, Artificial Sequence
  Synthetic
tcagccgctatagacggtgaataccgcctgaagggtgagtccaggaagactttcgtggaactcatgaggaggggt

SEQ ID NO: 55193 - DNA, 75 bp, Artificial Sequence
  Synthetic
ttcgcagactaacatccagagaggttctccttctcacaattggactaagcctggtggcatccgtggagctaccaa

SEQ ID NO: 55194 - DNA, 75 bp, Artificial Sequence
  Synthetic
agaggtgcaaggcgcatggccatcttgggagacacagcctgggactttggttcagtgggtggtgttctaaattca

SEQ ID NO: 55195 - DNA, 75 bp, Artificial Sequence
  Synthetic
ctcacaggggctacggaaatccagatgtcatcaggaaacttactgttcacaggacatcttaagtgcaggctgaga

SEQ ID NO: 55196 - DNA, 75 bp, Artificial Sequence
  Synthetic
agggcatttgtggaatccgctcagtaacaagactggagaatctgatgtggaaacaaataacaccagaactgaatc

SEQ ID NO: 55197 - DNA, 75 bp, Artificial Sequence
  Synthetic
tcatatgtgatgtgcacaggctcattcaagctagagaaggaagtggctgagacccagcatggaaccgttctagtg

SEQ ID NO: 55198 - DNA, 75 bp, Artificial Sequence
  Synthetic
gaactcaaatgtggaagtggaatttttgtcactaatgaggtccacacctggacagagcaatacaaatttcaagca

SEQ ID NO: 55199 - DNA, 75 bp, Artificial Sequence
  Synthetic
gaggagctaagctcaacgtagttctaacagtttttttaattagagagcagatctctgatgaataaccaacggaaa

SEQ ID NO: 55200 - DNA, 75 bp, Artificial Sequence
  Synthetic
gaatcggaagctggctaacgtagttctaacagtttttattagagagcagttctctgatgaacacccaacggaaaa

SEQ ID NO: 55201 - DNA, 75 bp, Artificial Sequence
  Synthetic
acattgatcacagggaacatgtcctttcgagatttggggagagtgatggttatggtgggcgctactatgacggat

SEQ ID NO: 55202 - DNA, 75 bp, Artificial Sequence
  Synthetic
ggaacattccacacaatgtggcacgtcacacgtggtgctgtcctaatgcataaagggaagagaattgaaccatca

SEQ ID NO: 55203 - DNA, 75 bp, Artificial Sequence
  Synthetic
gcttgcttaacgtagttctaacagttttttattagagagcagatctctgatgaacaaccaacggaaaaagacggg

SEQ ID NO: 55204 - DNA, 75 bp, Artificial Sequence
  Synthetic
tagcagaaaacaaaatctggggaaggaaaagttggcctctcaatgaaggaatcatggctgttggaatagtcagca

SEQ ID NO: 55205 - DNA, 75 bp, Artificial Sequence
  Synthetic
ctgcgcgagtttaaagagttcgcagcaggaagaagaagtgtctcaggtgacctaatattggaaatagggaaactt

SEQ ID NO: 55206 - DNA, 75 bp, Artificial Sequence
  Synthetic
ccttctcgctatcgggtgctattcacaagtcaaccccataactctcacagcagcccttctcttattggtagcaca

SEQ ID NO: 55207 - DNA, 75 bp, Artificial Sequence
  Synthetic
ctcaacccatatatgccttcagtcatagaaaaaatggaagcattacaaaggaaatatggaggagccttagtgagg

SEQ ID NO: 55208 - DNA, 75 bp, Artificial Sequence
  Synthetic
ctttgaccctgaacctaatcacagaaatgggtaggcttccaactttcatgactcagaaggcaagagacgcactgg

SEQ ID NO: 55209 - DNA, 75 bp, Artificial Sequence
  Synthetic
aaattggctgaacaacaacacccaattttgcataaaggttctcaacccatatatgccctcagttatagaaaaaat

SEQ ID NO: 55210 - DNA, 75 bp, Artificial Sequence
  Synthetic
gagaagcgaggaaaacttttgtggacctaatgagaagaggagacctaccagtctggctagcctacagagtggcag

SEQ ID NO: 55211 - DNA, 75 bp, Artificial Sequence
  Synthetic
acccgagtgggtatgggtgaagcagctgcgatcttcatgacagccactcccccaggatcagtggaggcctttcca

SEQ ID NO: 55212 - DNA, 75 bp, Artificial Sequence
  Synthetic
tttttgtcaccaatgaagttcacacttggacagagcaatacaaatttcaagctgattccccaaagagactatcag

SEQ ID NO: 55213 - DNA, 75 bp, Artificial Sequence
  Synthetic
acaggtcggaacttatggcttaaacactttcaccaacatggaggcccaactaataagacaaatggagtctgaggg

SEQ ID NO: 55214 - DNA, 75 bp, Artificial Sequence
  Synthetic
attgatgggacttgacaaaggatggccaatatcgaagatggacataggagttccacttctcgccttagggtgcta

SEQ ID NO: 55215 - DNA, 75 bp, Artificial Sequence
  Synthetic
ggaaaggatggccattgtcaaagatggacatcggagttccccttcttgccattggatgctactcacaagtcaacc

SEQ ID NO: 55216 - DNA, 75 bp, Artificial Sequence
  Synthetic
gtgagaagcaatgcagccttaggtgccatattcactgatgagaacaagtggaagtcggcacgtgaggctgttgaa

SEQ ID NO: 55217 - DNA, 75 bp, Artificial Sequence
  Synthetic
caataaatcaagtcagatcccttataggcaatgaggaatacacagactacatgccatccatgaagagattcagaa

SEQ ID NO: 55218 - DNA, 75 bp, Artificial Sequence
  Synthetic
cccaggtgaacccattgacactgacagcggcggtgttgatgttagtggctcattatgccataatcggacctggac

SEQ ID NO: 55219 - DNA, 75 bp, Artificial Sequence
  Synthetic
agttagatccctaataggcaatgaggaatacacagattacatgccatccatgaaaagattcagaagagaagagga

SEQ ID NO: 55220 - DNA, 75 bp, Artificial Sequence
  Synthetic
tgcaggttattgccgtagagcctgggaagaacccaaaaaactttcaaaccatgccgggcatttttcagacaacaa

SEQ ID NO: 55221 - DNA, 75 bp, Artificial Sequence
  Synthetic
tgggtatccaatgctaccgggaacatagtgtcatcagtgaacatgatttcaaggatgttgatcaacagattcaca

SEQ ID NO: 55222 - DNA, 75 bp, Artificial Sequence
  Synthetic
gcagaactgacaggctatggcactgtcacgatggagtgctctccgagaacgggcctcgacttcaatgagatggtg

SEQ ID NO: 55223 - DNA, 75 bp, Artificial Sequence
  Synthetic
cagaaccagacggaccgacaccggaattggaagaagaaatgttcaaaaagcgaaatctaactataatggatcttc

SEQ ID NO: 55224 - DNA, 75 bp, Artificial Sequence
  Synthetic
atatcttccagccatcgtcagagaagcaatcaagagacgcttaagaactctaattttggcaccaacaagagtggt

SEQ ID NO: 55225 - DNA, 75 bp, Artificial Sequence
  Synthetic
aactggttagcaagagtggggcgtgaaaggctatcaagaatggccatcagtggagatgattgtgttgtaaaacct

SEQ ID NO: 55226 - DNA, 75 bp, Artificial Sequence
  Synthetic
caaacaggaatccagcgaactgtcttctttgtcctaatgatgctggtcgccccatcctacggaatgcgatgcgta

SEQ ID NO: 55227 - DNA, 75 bp, Artificial Sequence
  Synthetic
accaagaccacccatacaaaacgtgggcataccatggcagctatgaaacaaaacagactggatcagcatcatcca

SEQ ID NO: 55228 - DNA, 75 bp, Artificial Sequence
  Synthetic
gaagatggagcctatagaatcaagcaaagagggattcttggatattctcagattggagccggagtttacaaagaa

SEQ ID NO: 55229 - DNA, 75 bp, Artificial Sequence
  Synthetic
cccgtggagcacgaaggatggccatcctgggagacaccgcatgggacttcggttctataggaggagtgttcacgt

SEQ ID NO: 55230 - DNA, 75 bp, Artificial Sequence
  Synthetic
ggaattcaggcaatgaatggattaccgactttgttgggaagacggtgtggtttgtccctagcatcaaagccggaa

SEQ ID NO: 55231 - DNA, 75 bp, Artificial Sequence
  Synthetic
agcttgaaagacacactcaaaaggagaagctggccactgaatgagggggtgatggctgttgggcttgtgagcatt

SEQ ID NO: 55232 - DNA, 75 bp, Artificial Sequence
  Synthetic
gatggctgttgggcttgtgagcattctggccagttctctccttaggaatgatgtgcccatggctggaccattagt

SEQ ID NO: 55233 - DNA, 75 bp, Artificial Sequence
  Synthetic
gacagattctccgagggagctaagcttaacgtagttctaaaagttttttaattagagggcagttttccgatgaat

SEQ ID NO: 55234 - DNA, 75 bp, Artificial Sequence
  Synthetic
attagagggcagttttccgatgaatatccaacgaaaaaaggcgagaaatacacctttcaatagggtgacacgtga

SEQ ID NO: 55235 - DNA, 75 bp, Artificial Sequence
  Synthetic
gaaagtttcatggacgaggaccattgaaactgttcatggccctgttggcattccttcgtttcttaacaatcccac

SEQ ID NO: 55236 - DNA, 75 bp, Artificial Sequence
  Synthetic
aactgacatttcagaaatgggggccaatttcaaagcagacagagtgatcgacccaagaagatgtctcaaaccagt

SEQ ID NO: 55237 - DNA, 75 bp, Artificial Sequence
  Synthetic
aagagattggaaggatgttgaacatcttgaataggagacgcagaactgtaggcatgatcatcatgctgattccaa

SEQ ID NO: 55238 - DNA, 75 bp, Artificial Sequence
  Synthetic
aaatggtgctttgatggagaacgtaataatcaaattttagaggagaacatggatgtggaaatctggacaaaggaa

SEQ ID NO: 55239 - DNA, 75 bp, Artificial Sequence
  Synthetic
ccatttggacaacagcgcgttttcaaagagaaagtggacacgagaacccaagaaccgaaggaaggcacaaagaaa

SEQ ID NO: 55240 - DNA, 75 bp, Artificial Sequence
  Synthetic
cactccaatggatcgcgtcagctatagtcctggaatttttcatgatggtgttgctcataccagaaccagaaaaac

SEQ ID NO: 55241 - DNA, 75 bp, Artificial Sequence
  Synthetic
agtcctggaatttttcatgatggtgttgctcataccagaaccagaaaaacaaagaactccccaagacaaccaact

SEQ ID NO: 55242 - DNA, 75 bp, Artificial Sequence
  Synthetic
tgtgtgacataggggagtcgtcaccaaatcccacgatagaagcaggacgaacactcagagtcctcaacttagtgg

SEQ ID NO: 55243 - DNA, 75 bp, Artificial Sequence
  Synthetic
gcagcactgacaggctatggcactgtcacaatggaatgctctcccagaacgggcctcaacttccatgagatggtg

SEQ ID NO: 55244 - DNA, 75 bp, Artificial Sequence
  Synthetic
gagaggttatcaagaatggccatcagtggagatgattgtgttgtgaaacccttagatgacaggtttgcaagtgct

SEQ ID NO: 55245 - DNA, 75 bp, Artificial Sequence
  Synthetic
agaagcaagaaatagcacatttttaatagacggaccagacacctctgaatgccccaatgaacgaagagcatggaa

SEQ ID NO: 55246 - DNA, 75 bp, Artificial Sequence
  Synthetic
gaaaaagacggctcgaccgtctttcaatatgctgaaacgcgcgagaaaccgcgtgtcaactgtttcacagttggc

SEQ ID NO: 55247 - DNA, 75 bp, Artificial Sequence
  Synthetic
gtggagtctcatgtattttcacagaagagatctcagactagcatccaacgccatatgttcagcagtaccagtcca

SEQ ID NO: 55248 - DNA, 75 bp, Artificial Sequence
  Synthetic
ttaaagttgtgtggggaatagcaagaacacaacatggaacaatagttcatagagtacaatatgaaggagacggtt

SEQ ID NO: 55249 - DNA, 75 bp, Artificial Sequence
  Synthetic
agaaaaagacagcccagtcaacatagaagcagaacctccattcggagacagctacatcattataggagtagagcc

SEQ ID NO: 55250 - DNA, 75 bp, Artificial Sequence
  Synthetic
ttatcccggaaagagtttgacctttacaagaaatctggaatcactgaagtggatagaacagaagccaaagaaggg

SEQ ID NO: 55251 - DNA, 75 bp, Artificial Sequence
  Synthetic
tcataggagtcgtcatcacatggataggaatgaattcacgcagcacctcactgtctgtgtcgctagtattggtgg

SEQ ID NO: 55252 - DNA, 75 bp, Artificial Sequence
  Synthetic
acttcaatggttcgtggagaggaacatggtcattcccgaaggaagagtcatagacttaggctgtggaagaggagg

SEQ ID NO: 55253 - DNA, 75 bp, Artificial Sequence
  Synthetic
gcaatcaagagacgcttaagaactctaattttggcaccgacaagggtggttgcagctgagatggaagaagcattg

SEQ ID NO: 55254 - DNA, 75 bp, Artificial Sequence
  Synthetic
acctgaaaagtgtgacaccctattgtgtgacattggagaatcttcaccaagcccaacagtggaagaaagcagaac

SEQ ID NO: 55255 - DNA, 75 bp, Artificial Sequence
  Synthetic
aagagatctcaagcatgttgaacataatgaacaggagaaaaagatccgtgaccatgctccttatgctgctgccca

SEQ ID NO: 55256 - DNA, 75 bp, Artificial Sequence
  Synthetic
gggagttatggtgcaggctgatagtggttgtgttgtgagttggaaaaacaaagaactgaaatgtggcagtgggat

SEQ ID NO: 55257 - DNA, 75 bp, Artificial Sequence
  Synthetic
tgtagctccatcgtggggatgtaaaagcctgggaggctgcaacccatggaagctgtacgcatggggtagcagact

SEQ ID NO: 55258 - DNA, 75 bp, Artificial Sequence
  Synthetic
cacaaggcgctggatggagcctgagagaaactgcatgcctaggcaagtcatatgcacaaatgtggcagctgatgt

SEQ ID NO: 55259 - DNA, 75 bp, Artificial Sequence
  Synthetic
cagttttttaattagagagcagatctctgatgaataaccaacggaaaaaggcgaaaaacacgcctttcaatatgc

SEQ ID NO: 55260 - DNA, 75 bp, Artificial Sequence
  Synthetic
tgagaggaaaatttgggaagaaacacatgattgcaggggttctcttcacgtttgtgctccttctctcagggcaaa

SEQ ID NO: 55261 - DNA, 75 bp, Artificial Sequence
  Synthetic
aatggctttggagaaccctgggaaggaacaaaaaacccagattgtgcacaagggaagagttcacaaaaaaggtca

SEQ ID NO: 55262 - DNA, 75 bp, Artificial Sequence
  Synthetic
aagagaatgcagttggaaatgacacaggaaaacatggcaaggaaatcaaagtaacaccacagagttccattacag

SEQ ID NO: 55263 - DNA, 75 bp, Artificial Sequence
  Synthetic
attcttggatactctcagattggagccggagtttacaaagaaggaacattccatacaatgtggcacgtcacacgt

SEQ ID NO: 55264 - DNA, 75 bp, Artificial Sequence
  Synthetic
agaacgtgaactccacaaattgggcaagtgtggaagctgcgtctacaacatgatgggcaagagagagaagaaact

SEQ ID NO: 55265 - DNA, 75 bp, Artificial Sequence
  Synthetic
cataggtatgggcgtgacttatcttgccctactagcagctttcaaagttagaccaacttttgcagctggactact

SEQ ID NO: 55266 - DNA, 75 bp, Artificial Sequence
  Synthetic
tgaccatcatggacctccatccaggagcaggaaagacaaaaagataccttccagccatagtcagagaagccataa

SEQ ID NO: 55267 - DNA, 75 bp, Artificial Sequence
  Synthetic
aagaggagaaacaaccaaacatgcagtgtcgagaggaaccgccaaactgaggtggtttgtggagaggaaccttgt

SEQ ID NO: 55268 - DNA, 75 bp, Artificial Sequence
  Synthetic
gacctgcacaatgaggaaaaaatcacacagcaaatggaccctgaacacagacaattagcgaacgccatatttaag

SEQ ID NO: 55269 - DNA, 75 bp, Artificial Sequence
  Synthetic
aagttcaacgaccaactccaaaaggcacggtaatggacatcatatctaggaaagaccaaagaggtagtggacagg

SEQ ID NO: 55270 - DNA, 75 bp, Artificial Sequence
  Synthetic
aagattggcgacagccattgcaggcgcttgggagaatggagtgtgcggaattaggtcaacaaccagaatggagaa

SEQ ID NO: 55271 - DNA, 75 bp, Artificial Sequence
  Synthetic
ggcgacctatggatggaacctagtaaagctacactctggaaaagatgtattttttatgccacctgagaaatgtga

SEQ ID NO: 55272 - DNA, 75 bp, Artificial Sequence
  Synthetic
gtccataacaatatccgaagatggcagcatgtccataaaaaaccaagaggaaaaacaaacactgaccatcctcat

SEQ ID NO: 55273 - DNA, 75 bp, Artificial Sequence
  Synthetic
cagcaaaaaatggaaccgtgatggatgttatatccagacgtgaccagagaggaagtggccaggtcggaacttatg

SEQ ID NO: 55274 - DNA, 75 bp, Artificial Sequence
  Synthetic
actgaggtggtttgtggagaggaaccttgtgaaaccagaagggaaagtcatagacctcggttgtggaagaggtgg

SEQ ID NO: 55275 - DNA, 75 bp, Artificial Sequence
  Synthetic
tgttaaaattattgactgaatttcagccacaccagttatggaccaccttactgtctctgacatttatcaaaacaa

SEQ ID NO: 55276 - DNA, 75 bp, Artificial Sequence
  Synthetic
gcacctcactgtctgtgtcactagtattagtgggagtcgtgacattgtatttgggagttatggtgcaggctgata

SEQ ID NO: 55277 - DNA, 75 bp, Artificial Sequence
  Synthetic
caacttttgttaatgagaacatcatgggccttgtgtgaagctttaactctagccacaggaccaataacaacactc

SEQ ID NO: 55278 - DNA, 75 bp, Artificial Sequence
  Synthetic
tcttggaggacatagataagaaggatggagacctgatatatgctgacgacacagcaggctgggacacgagaatca

SEQ ID NO: 55279 - DNA, 75 bp, Artificial Sequence
  Synthetic
gcaacagccttaacagctctgaatgatatgggaaaagtaagaaaagatataccacaatgggaaccttcaaaagga

SEQ ID NO: 55280 - DNA, 75 bp, Artificial Sequence
  Synthetic
gagaacatcatgtggaagcaaatatcaaatgaactgaaccacatcttacttgaaaatgacatgaaattcacagtg

SEQ ID NO: 55281 - DNA, 75 bp, Artificial Sequence
  Synthetic
ggatagaaagtgcactcaatgacacatggaagatagagaaagcctctttcattgaagtaaaaaactgccactggc

SEQ ID NO: 55282 - DNA, 75 bp, Artificial Sequence
  Synthetic
atacaacaatgggaaccttcaagaggatggaacgattggacacaagtgcctttctgttcacaccatttccatgag

SEQ ID NO: 55283 - DNA, 75 bp, Artificial Sequence
  Synthetic
ttccttcgtttcctaacaatcccaccaacagcagggatattaaaaagatggggaacaatcaaaaaatcaaaggct

SEQ ID NO: 55284 - DNA, 75 bp, Artificial Sequence
  Synthetic
atggttggatgctaggatctattctgacccactggcactaaaagaattcaaggaatttgcagctggaagaaaatc

SEQ ID NO: 55285 - DNA, 75 bp, Artificial Sequence
  Synthetic
tgggaagttgaggactatgggtttggaattttcacgacaaacatatggctgaaattgcgtgactcctacacccaa

SEQ ID NO: 55286 - DNA, 75 bp, Artificial Sequence
  Synthetic
ctccagtcacaacttgggaagatgttccatacctagggaagagagaagatcaatggtgcggatcactcattggtc

SEQ ID NO: 55287 - DNA, 75 bp, Artificial Sequence
  Synthetic
tcacttccagagcaacctgggcccagaacatactcacagcaatccaacaggtgagaagccttataggcgatgaag

SEQ ID NO: 55288 - DNA, 75 bp, Artificial Sequence
  Synthetic
ggtgtcgtcacaagaagtggaacatatgtgagtgccatagcccagactgaaaaaagcattgaagacaatccagag

SEQ ID NO: 55289 - DNA, 75 bp, Artificial Sequence
  Synthetic
ctgctgacaaaaccttgggacgtcctccccatggtgacacagatggcaatgacagacacgactccatttggacaa

SEQ ID NO: 55290 - DNA, 75 bp, Artificial Sequence
  Synthetic
gtgagaagccttataggcgatgaagaatttctggactacatgccttcgatgaagagattcaggaaggaggaggag

SEQ ID NO: 55291 - DNA, 75 bp, Artificial Sequence
  Synthetic
tgatggtatctatagaatcttgcaaagaggactgttgggtaggtcccaagtaggagtgggagtttttcaagacgg

SEQ ID NO: 55292 - DNA, 75 bp, Artificial Sequence
  Synthetic
tggaaaaacaaagaactgaaatgtggcagtgggattttcatcacagacaacgtgcacacatggacagaacaatac

SEQ ID NO: 55293 - DNA, 75 bp, Artificial Sequence
  Synthetic
agtgctagaaagtgagatgataattccaaagaattttgctggaccagtatcacaacacaattacagaccaggcta

SEQ ID NO: 55294 - DNA, 75 bp, Artificial Sequence
  Synthetic
cgtggggacgtaaagcctgcgaggctgcaatccgtggaagctgtacgcacggtgtagcagactagcggttagaag

SEQ ID NO: 55295 - DNA, 75 bp, Artificial Sequence
  Synthetic
gggctcattcaagaagaatggagcgattaaagtgttacggggtttcaagaaagaaatctcaaacatgttgaatat

SEQ ID NO: 55296 - DNA, 75 bp, Artificial Sequence
  Synthetic
agggatctttttattcttgatgagcgggaggggtatagggaagatgaccctgggaatgtgctgcataatcacggc

SEQ ID NO: 55297 - DNA, 75 bp, Artificial Sequence
  Synthetic
gtacggtatggaaatcagaccagtcaaggaaaaggaagagaatctagtcaaatcaatggtctctgcagggtcagg

SEQ ID NO: 55298 - DNA, 75 bp, Artificial Sequence
  Synthetic
gtcgggatggtgagcattttagccagttctctcctaaagaatgacattcccatgacaggtccattagtggctgga

SEQ ID NO: 55299 - DNA, 75 bp, Artificial Sequence
  Synthetic
cctcaatatcaaacataaccacggcaacaagatgtccaacgcaaggagagccttatctaaaagaggaacaagacc

SEQ ID NO: 55300 - DNA, 75 bp, Artificial Sequence
  Synthetic
atggacttgggagagttatgtgaggacacaatgacttacaaatgtcctcgaatcactgaggcggaaccagatgac

SEQ ID NO: 55301 - DNA, 75 bp, Artificial Sequence
  Synthetic
tctctctttcctttatgcctgtctacgacctctcaaaaaacaacatggcttccggtgctgttaggatcttttgga

SEQ ID NO: 55302 - DNA, 75 bp, Artificial Sequence
  Synthetic
tgacggatgacataggtatgggcgtgacttatcttgccctactagcagccttcaaagttagaccaacttttgcag

SEQ ID NO: 55303 - DNA, 75 bp, Artificial Sequence
  Synthetic
gacccgctggcgctcaaagaattcaaagagtttgcagctggaagaaaatccctgaccctgaatttaatcacagaa

SEQ ID NO: 55304 - DNA, 75 bp, Artificial Sequence
  Synthetic
aagagtttgcagctggaagaaaatccctgaccctgaatttaatcacagaaatgggtaggcttccaacttttatga

SEQ ID NO: 55305 - DNA, 75 bp, Artificial Sequence
  Synthetic
atgggtaggcttccaacttttatgactcagaaagcaaggaacgcactggacaacttagcagtcctgcatacggct

SEQ ID NO: 55306 - DNA, 75 bp, Artificial Sequence
  Synthetic
cgtctgcaatattgaatgcccacaaagatggggtctgtggaattagatcaaccacgaggctggaaaatgtcatgt

SEQ ID NO: 55307 - DNA, 75 bp, Artificial Sequence
  Synthetic
gagagcactcacacccccagtgaatgatctgaaatattcatggaagacatggggaaaagcaaaaatcttcacccc

SEQ ID NO: 55308 - DNA, 75 bp, Artificial Sequence
  Synthetic
ctggacaactactcttgatgagaacaacatgggctttctgtgaagtcttgactttggccacaggaccaatcttga

SEQ ID NO: 55309 - DNA, 75 bp, Artificial Sequence
  Synthetic
aatatgaaaacttgaaatattcagtaatagtcaccgtccacactggagaccagcaccaggtgggaaatgaaagca

SEQ ID NO: 55310 - DNA, 75 bp, Artificial Sequence
  Synthetic
ttgaagtgaaaacatgtctgtggcccaagacccacacattgtggagcaatggagtgctggaaagccagatgctca

SEQ ID NO: 55311 - DNA, 75 bp, Artificial Sequence
  Synthetic
atacttggcaaaagcaaacccaaagatctggcgtcctatgggacgtacccagccccccagaaacacagaaagcag

SEQ ID NO: 55312 - DNA, 75 bp, Artificial Sequence
  Synthetic
caggagagacactgggagagaagtggaagagacagctaaactcattagacagaaaagagtttgaagagtataaaa

SEQ ID NO: 55313 - DNA, 75 bp, Artificial Sequence
  Synthetic
catcacaaaatgccacagcttgagcaaactgtgcagcctgtagctccacctgaggaggtgtaaaaacctgggagg

SEQ ID NO: 55314 - DNA, 75 bp, Artificial Sequence
  Synthetic
tgaaggcgaagttggagccatagctctagattttaaacccggcacatctggatctcccatcgtgaacagagaggg

SEQ ID NO: 55315 - DNA, 75 bp, Artificial Sequence
  Synthetic
acatcctgaacggaagaaagaggtcaacaatgactctgttatgtctgatccccaccataatggcattccacttat

SEQ ID NO: 55316 - DNA, 75 bp, Artificial Sequence
  Synthetic
aacaatgactctgttatgtctgatccccaccataatggcattccacttatcgtcaagagacggcgaacccctcat

SEQ ID NO: 55317 - DNA, 75 bp, Artificial Sequence
  Synthetic
aaggaatcaacaaatgcactctcattgccatggacgtgggtgaaatgtgtgaggacaccgtcacatataaatgcc

SEQ ID NO: 55318 - DNA, 75 bp, Artificial Sequence
  Synthetic
tgccatggacgtgggtgaaatgtgtgaggacaccgtcacatataaatgccccctactggtcaacactgagcctga

SEQ ID NO: 55319 - DNA, 75 bp, Artificial Sequence
  Synthetic
agcatacatacgtagacagaggctgggggaacggttgtggtttgtttggcaagggaagcttggtaacatgtgcga

SEQ ID NO: 55320 - DNA, 75 bp, Artificial Sequence
  Synthetic
tacaatatgaaggggacggctctccatgtaaaatcccttttgagataatggatttggaaaaaagatatgtcttag

SEQ ID NO: 55321 - DNA, 75 bp, Artificial Sequence
  Synthetic
cgtgtacccagagtggggaacggagacgggagaagcgctcagtggcactggcaccacattcaggaatgggattgg

SEQ ID NO: 55322 - DNA, 75 bp, Artificial Sequence
  Synthetic
acgggagaagcgctcagtggcactggcaccacattcaggaatgggattggaaaccaggacagagacgtggatgtc

SEQ ID NO: 55323 - DNA, 75 bp, Artificial Sequence
  Synthetic
atgtcctctgaaggcgcttggaaacagatacaaagagtggagacttgggccctgagacacccaggattcacggtg

SEQ ID NO: 55324 - DNA, 75 bp, Artificial Sequence
  Synthetic
agagagagggagcttcacaaacagggaaaatgtgccacgtgtgtttacaacatgatggggaagagagagaaaaaa

SEQ ID NO: 55325 - DNA, 75 bp, Artificial Sequence
  Synthetic
acacagatggcaatgacagatacaactccatttggccagcaaagagtctttaaagagaaagtggacaccaggaca

SEQ ID NO: 55326 - DNA, 75 bp, Artificial Sequence
  Synthetic
gaaatccaggatttgcactcttggcaggatttatggcttacatgattggacagacaggaattcaacgaacagtct

SEQ ID NO: 55327 - DNA, 75 bp, Artificial Sequence
  Synthetic
aggatttatggcttacatgattggacagacaggaattcaacgaacagtcttctttgtcctcatgatgttggtcgc

SEQ ID NO: 55328 - DNA, 75 bp, Artificial Sequence
  Synthetic
aacttgataataatggatgaagcccatttcacagacccagccagtatagcggctagagggtacatatcaactcgt

SEQ ID NO: 55329 - DNA, 75 bp, Artificial Sequence
  Synthetic
accaggaaaaaatcctaaacatgtccaaacgaaacccggccttttcaagaccctaactggagaaattggagcagt

SEQ ID NO: 55330 - DNA, 75 bp, Artificial Sequence
  Synthetic
aaggagtctcaggaggaacatgggtcgacctggtgctggaacacggaggatgtgttacaaccatggcacagggaa

SEQ ID NO: 55331 - DNA, 75 bp, Artificial Sequence
  Synthetic
aggaaaagccctccaccaagtctttggagcaatctatggagctgccttcagtggggtttcatggactatgaaaat

SEQ ID NO: 55332 - DNA, 75 bp, Artificial Sequence
  Synthetic
cgacctggtgctggaacacggaggatgtgttacaaccatggcacagggaaagccaaccttggattttgaattgat

SEQ ID NO: 55333 - DNA, 75 bp, Artificial Sequence
  Synthetic
atacaacttagtaggaagacttttgattctgagtatgtcaagactagaaccaatgactgggatttcgtggttaca

SEQ ID NO: 55334 - DNA, 75 bp, Artificial Sequence
  Synthetic
ggatgtgtaattaactggaaaggcagagaactcaaatgtggaagtggcatttttgtcaccaatgaagttcacact

SEQ ID NO: 55335 - DNA, 75 bp, Artificial Sequence
  Synthetic
tggaactctggacatgagtgggttacagattttaaagggaagactgtttggtttgttccgagtataaaagcagga

SEQ ID NO: 55336 - DNA, 75 bp, Artificial Sequence
  Synthetic
gaaggagaaggactgcacaagctaggctatatattaagggacatttccaagatacccggaggagctatgtatgct

SEQ ID NO: 55337 - DNA, 75 bp, Artificial Sequence
  Synthetic
aacaagatgtccaacacaaggagaaccttatcttaaagaggaacaagaccagcagtacatttgcagaagagacgt

SEQ ID NO: 55338 - DNA, 75 bp, Artificial Sequence
  Synthetic
ttgtaacatgcgcaaagttttcatgctcggggaaaataacaggcaacctggtccaagttgaaaaccttgaataca

SEQ ID NO: 55339 - DNA, 75 bp, Artificial Sequence
  Synthetic
ctcggggaaaataacaggcaacctggtccaagttgaaaaccttgaatacacagtggttgtgacagttcataatgg

SEQ ID NO: 55340 - DNA, 75 bp, Artificial Sequence
  Synthetic
tcaaagagaaggtggataccagaacaccacaaccaaaacccggtacacgaatggttatgaccacgacagccaatt

SEQ ID NO: 55341 - DNA, 75 bp, Artificial Sequence
  Synthetic
atgattaggccacaacccatggaatacaaatactcgtggaaaagctggggaaaagctaaaatcataggggcagat

SEQ ID NO: 55342 - DNA, 75 bp, Artificial Sequence
  Synthetic
caataacccccaggtcaccatcggtagaagttaaactaccagattatggggaactgacactcgattgcgaaccca

SEQ ID NO: 55343 - DNA, 75 bp, Artificial Sequence
  Synthetic
ggtccggaatcgactttaacgaaatgatcctgatgaaaatgaaaggaaaaacatggcttgtgcacaaacaatggt

SEQ ID NO: 55344 - DNA, 75 bp, Artificial Sequence
  Synthetic
tgggaagttgaggactatggatttggaattttcacgacaaacatatggttgaaattgcgtgactcctacacccaa

SEQ ID NO: 55345 - DNA, 75 bp, Artificial Sequence
  Synthetic
attttgacagatggacccgagcgagtgatcctggctggaccaatgccagtcaccgcagcgagcgctgcgcaaagg

SEQ ID NO: 55346 - DNA, 75 bp, Artificial Sequence
  Synthetic
caacacgccctgaacgaactcccggagtcactggaaacacttatgcttgtagctttactaggtgctatgacagca

SEQ ID NO: 55347 - DNA, 75 bp, Artificial Sequence
  Synthetic
tgacgttcaaagtacctcatgccaagagacaggatgtcacagtgctaggatcccaggaaggagccatgcactctg

SEQ ID NO: 55348 - DNA, 75 bp, Artificial Sequence
  Synthetic
tcattaatgaaatctttaggaggaggtaggagaggcacgggagcccaaggggaaacactgggagagaaatggaaa

SEQ ID NO: 55349 - DNA, 75 bp, Artificial Sequence
  Synthetic
gaagaccatgctcactggacagaagcaaaaatgctgctagacaacatcaacacaccagaagggatcataccagct

SEQ ID NO: 55350 - DNA, 75 bp, Artificial Sequence
  Synthetic
gaaggtggtgctttgatggagaaaggaacaaccaggtgttggaggagaacatggacgtggagatctggacaaagg

SEQ ID NO: 55351 - DNA, 75 bp, Artificial Sequence
  Synthetic
gcagggcacctaaagtgcaaagtgcgcatggaaaaattgaggatcaagggaatgtcatacacgatgtgctcagga

SEQ ID NO: 55352 - DNA, 75 bp, Artificial Sequence
  Synthetic
aaagatatatggaggaccaatatctcagcacaactacagaccaggatatttcacacaaacagcagggccgtggca

SEQ ID NO: 55353 - DNA, 75 bp, Artificial Sequence
  Synthetic
ccgctggttggatgccagaacatactctgatccactggccctgcgcgagtttaaagagtttgcagcaggaagaag

SEQ ID NO: 55354 - DNA, 75 bp, Artificial Sequence
  Synthetic
gcatggaaaaattgaggatcaagggaatgtcatacacgatgtgctcaggaaagttttccatcgacaaggaaatgg

SEQ ID NO: 55355 - DNA, 75 bp, Artificial Sequence
  Synthetic
cctagccaaagccattttcaaactaacctatcaaaacaaagtggtgaaagtcctcagacccacaccgagaggagc

SEQ ID NO: 55356 - DNA, 75 bp, Artificial Sequence
  Synthetic
ggggctccatgcaaaattccaatagaaataaaagacatgaataaggaaaaagtggttggacgcattatttcatct

SEQ ID NO: 55357 - DNA, 75 bp, Artificial Sequence
  Synthetic
gccatcctcacagtggtggccgcaaccatggcaaacgagatgggtttcctagaaaaaacgaagaaagatcttgga

SEQ ID NO: 55358 - DNA, 75 bp, Artificial Sequence
  Synthetic
aatgtcggcagccgtcaaggatgagagggccgtgcatgccgacatgggctattggatagaaagccaaaagaatgg

SEQ ID NO: 55359 - DNA, 75 bp, Artificial Sequence
  Synthetic
aaataaaagacatgaataaggaaaaagtggttggacgcattatttcatctattccctttgctgaaaacaccaaca

SEQ ID NO: 55360 - DNA, 75 bp, Artificial Sequence
  Synthetic
ataggcgctggagacagtgcattgacactccattggtttaggaagggaagttctatcgggaagatgtttgagtcc

SEQ ID NO: 55361 - DNA, 75 bp, Artificial Sequence
  Synthetic
cactccattggtttaggaagggaagttctatcgggaagatgtttgagtccacttatagaggtgcaaaaagaatgg

SEQ ID NO: 55362 - DNA, 75 bp, Artificial Sequence
  Synthetic
acccttacggatggtgttggcattcattacgtttttgcgagttctttccatcccaccaacagcagggattctgaa

SEQ ID NO: 55363 - DNA, 75 bp, Artificial Sequence
  Synthetic
acatcattagggaaagctgtgcatcaggtttttggcagtgtctacacaacaatgtttggaggagtctcatggatg

SEQ ID NO: 55364 - DNA, 75 bp, Artificial Sequence
  Synthetic
aggtttttggcagtgtctacacaacaatgtttggaggagtctcatggatgatcagaattctcattgggattttag

SEQ ID NO: 55365 - DNA, 75 bp, Artificial Sequence
  Synthetic
tattcatgatactgacagtggcagccaatgagatgggattattggaaaccacaaagaaagacctggggattggcc

SEQ ID NO: 55366 - DNA, 75 bp, Artificial Sequence
  Synthetic
agtggacacgagaacccaagaaccgaaagaaggcacgaagaaactaatgaaaatcacagcagagtggctgtggaa

SEQ ID NO: 55367 - DNA, 75 bp, Artificial Sequence
  Synthetic
tcacgtttgtgctccttctctcagggcaaataacatggagagacatggcgcacacactaataatgattgggtcca

SEQ ID NO: 55368 - DNA, 75 bp, Artificial Sequence
  Synthetic
atagctgttggaggaatcaccttatttcttggttttacggtccaagcagacatgggctgtgttgtgtcatggagt

SEQ ID NO: 55369 - DNA, 75 bp, Artificial Sequence
  Synthetic
ttcttggttttacggtccaagcagacatgggctgtgttgtgtcatggagtggaagagaattgaagtgtggaagtg

SEQ ID NO: 55370 - DNA, 75 bp, Artificial Sequence
  Synthetic
ggccgctcactagttgttccatgtagaaaccaggatgaactgatagggagagccagaatctcgcagggagctgga

SEQ ID NO: 55371 - DNA, 75 bp, Artificial Sequence
  Synthetic
ccacacgcaatggagaaccacacatgatcgttggtagacaggagaaagggaaaagtcttctgttcaaaacagagg

SEQ ID NO: 55372 - DNA, 75 bp, Artificial Sequence
  Synthetic
caaccagagtccccagcgagattagcgtccgctatactgaatgcccataaggatggggtctgtggagttagatca

SEQ ID NO: 55373 - DNA, 75 bp, Artificial Sequence
  Synthetic
cgtccgctatactgaatgcccataaggatggggtctgtggagttagatcaaccacaagactggaaaatgtgatgt

SEQ ID NO: 55374 - DNA, 75 bp, Artificial Sequence
  Synthetic
gacccagttagccatgacagacacaaccccttttgggcaacaaagagtgttcaaagagaaggtggataccagaac

SEQ ID NO: 55375 - DNA, 75 bp, Artificial Sequence
  Synthetic
gtggaacagagtgtggatagaagacaaccctaatatgactgacaagactccagtccattcgtgggaagatatacc

SEQ ID NO: 55376 - DNA, 75 bp, Artificial Sequence
  Synthetic
gacctaactgtggtaactggagatgtgaaaggggtgttgaccaaaggcaagagagtgattgcacctccggtgagt

SEQ ID NO: 55377 - DNA, 75 bp, Artificial Sequence
  Synthetic
agaaaagagcagcagcaggcatcatgaaaaacccaactgtggatggaataacagtgattgacctagatccaatac

SEQ ID NO: 55378 - DNA, 75 bp, Artificial Sequence
  Synthetic
taacaccacattcaggaatgggattggaaacaagggctgagacatggatgtcatcggaaggagcttggaaacacg

SEQ ID NO: 55379 - DNA, 75 bp, Artificial Sequence
  Synthetic
tgaaaggggtgttgaccaaaggcaagagagtgattgcacctccggtgagtgatttgaaatattcatggaaaacat

SEQ ID NO: 55380 - DNA, 75 bp, Artificial Sequence
  Synthetic
atagatggaccagatacctctgaatgccccaatgagcgaagagcgtggaatttccttgaggtagatgactatgga

SEQ ID NO: 55381 - DNA, 75 bp, Artificial Sequence
  Synthetic
gccccaatgagcgaagagcgtggaatttccttgaggtagatgactatggatttggcatgttcacgaccaacatat

SEQ ID NO: 55382 - DNA, 75 bp, Artificial Sequence
  Synthetic
aaagagcatggaacatttgggaagttgaggactatggatttggaattttcacgacaaacatatggttgaaattgc

SEQ ID NO: 55383 - DNA, 75 bp, Artificial Sequence
  Synthetic
tcagcggcagtcaaagatcagagggccgtgcatgctgacatgggctactggatagagagctcgaagaatcagacc

SEQ ID NO: 55384 - DNA, 75 bp, Artificial Sequence
  Synthetic
ccgtgcatgctgacatgggctactggatagagagctcgaagaatcagacctggcagatagagaaagcatccctta

SEQ ID NO: 55385 - DNA, 75 bp, Artificial Sequence
  Synthetic
ggagtgctagaaagccagatgctcattcccaaaacgtatgcaggtccctcttcacaacacaattaccgccaaggc

SEQ ID NO: 55386 - DNA, 75 bp, Artificial Sequence
  Synthetic
taagttcaagtgtgtgacaaaactggaaggaaagatagttcaatatgaaaacttgaaatattcagtaatagtcac

SEQ ID NO: 55387 - DNA, 75 bp, Artificial Sequence
  Synthetic
ttcccaaaacgtatgcaggtccctcttcacaacacaattaccgccaaggctatgctacgcagaccatgggcccgt

SEQ ID NO: 55388 - DNA, 75 bp, Artificial Sequence
  Synthetic
gctgcggcttgtttgggaaaggaggagttgtgacatgtgcgaagttttcatgctcaggaaaaataacgggcaact

SEQ ID NO: 55389 - DNA, 75 bp, Artificial Sequence
  Synthetic
agccatagtacggaaaaaactatgctacctgtgagccccgtccaaggacgttaaaagaagtcaggccatcacaaa

SEQ ID NO: 55390 - DNA, 75 bp, Artificial Sequence
  Synthetic
gtcacaattcaggagaattgtggccacagaggtccatctctgagaaccaccacagcatctggaaaactggtcaca

SEQ ID NO: 55391 - DNA, 75 bp, Artificial Sequence
  Synthetic
aggagctgggcttgctttttctatcatgaaatcagttggaacaggaaggagaggaacggggtcacaaggcgaaac

SEQ ID NO: 55392 - DNA, 75 bp, Artificial Sequence
  Synthetic
acagaggtccatctctgagaaccaccacagcatctggaaaactggtcacacagtggtgctgccgttcctgcacaa

SEQ ID NO: 55393 - DNA, 75 bp, Artificial Sequence
  Synthetic
aaggactattttttagaggagacccccccgaaataaaaaacagcatattgacgctgggaaagaccaggcgccaga

SEQ ID NO: 55394 - DNA, 75 bp, Artificial Sequence
  Synthetic
atcagaccctcaagtgagaaagaagagaacatggtcaaatcacaggtggcggctgggcaaggtccatcagaaact

SEQ ID NO: 55395 - DNA, 75 bp, Artificial Sequence
  Synthetic
agaacatggtcaaatcacaggtggcggctgggcaaggtccatcagaaactttctctatggggttgttgtgtttga

SEQ ID NO: 55396 - DNA, 75 bp, Artificial Sequence
  Synthetic
atactggttgtggtagctaccctctgtgccatcattttgggaggtctcacgtggatggacttagtacgagccatt

SEQ ID NO: 55397 - DNA, 75 bp, Artificial Sequence
  Synthetic
gtgccatcattttgggaggtctcacgtggatggacttagtacgagccattatcatgttgggagataccatgtttg

SEQ ID NO: 55398 - DNA, 75 bp, Artificial Sequence
  Synthetic
tcaccaggttacgtgctcggtgtgtttttgagaaagctcacttcaagagagacagcactgatggtgataggaatg

SEQ ID NO: 55399 - DNA, 75 bp, Artificial Sequence
  Synthetic
ttttgagaaagctcacttcaagagagacagcactgatggtgataggaatggcaatgacaacggtgttttcaattc

SEQ ID NO: 55400 - DNA, 75 bp, Artificial Sequence
  Synthetic
gagccagatgttgacctcggaagcggaacccgcaacatcggaattgaaagtgagataccaaacctagacataatt

SEQ ID NO: 55401 - DNA, 75 bp, Artificial Sequence
  Synthetic
ctgaaaatggtagtgcattttgacaatgctcaattgggaactctagctctttctttaactttcataaaaacaaca

SEQ ID NO: 55402 - DNA, 75 bp, Artificial Sequence
  Synthetic
atgctcaattgggaactctagctctttctttaactttcataaaaacaacaatgccattgatcatggcttggagga

SEQ ID NO: 55403 - DNA, 75 bp, Artificial Sequence
  Synthetic
agttgtctccagaagcagtcccactgggtagaaataacagcaatcatcttgggagctcaagccttgccggtgtat

SEQ ID NO: 55404 - DNA, 75 bp, Artificial Sequence
  Synthetic
gggtagaaataacagcaatcatcttgggagctcaagccttgccggtgtatttgatgaccctcatgaagggggctt

SEQ ID NO: 55405 - DNA, 75 bp, Artificial Sequence
  Synthetic
gtaatgctcctaatcctctgcgtgactcaagtattgatgatgaggactacatgggctttgtgtgaggctctaacc

SEQ ID NO: 55406 - DNA, 75 bp, Artificial Sequence
  Synthetic
acctgattatcatggatgaagcccatttcacagacccagcaagtatagcagctagaggatacatctcaactcgag

SEQ ID NO: 55407 - DNA, 75 bp, Artificial Sequence
  Synthetic
agcctcctgggaagcgccctgctaaagaacgacgttcccctggctggtccaatggtggcgggaggtttactccta

SEQ ID NO: 55408 - DNA, 75 bp, Artificial Sequence
  Synthetic
agaacgacgttcccctggctggtccaatggtggcgggaggtttactcctagcggcttacgtgatgagcggtagtt

SEQ ID NO: 55409 - DNA, 75 bp, Artificial Sequence
  Synthetic
aaatgacattgccaactgcttaagaaagaatgggaaacgggtgattcaattgagcaggaaaacctttgacacaga

SEQ ID NO: 55410 - DNA, 75 bp, Artificial Sequence
  Synthetic
ccactccatgggttttcttgaatccacaccctgttccagactgtcagcatgtcttccgctgtcatccattcatgt

SEQ ID NO: 55411 - DNA, 75 bp, Artificial Sequence
  Synthetic
gcggacataacaggctcaagtccagtcatagaggttaaacaagatgaagatggctcattctcaatacgggatgtt

SEQ ID NO: 55412 - DNA, 75 bp, Artificial Sequence
  Synthetic
gtcttccgctgtcatccattcatgtttggcgtgtatggaccaggttgttctacttgttggaacccaatgtgatgg

SEQ ID NO: 55413 - DNA, 75 bp, Artificial Sequence
  Synthetic
aaagtctttagtctcagcagggagtggaaaggtggacaacttcacaatgggtgtcttgtgtttggcaatcctctt

SEQ ID NO: 55414 - DNA, 75 bp, Artificial Sequence
  Synthetic
tcatagaggttaaacaagatgaagatggctcattctcaatacgggatgttgaggaaactaacttgataaccctac

SEQ ID NO: 55415 - DNA, 75 bp, Artificial Sequence
  Synthetic
aaacagttttttaattagagagcagatctctgatgaataaccaacggaaaaaggcgaaaaatacgcctttcaata

SEQ ID NO: 55416 - DNA, 75 bp, Artificial Sequence
  Synthetic
gatccatttcctcagagtaatgcaccaattatggacgaagaaagagaaattccggaacgttcatggaactccggg

SEQ ID NO: 55417 - DNA, 75 bp, Artificial Sequence
  Synthetic
ccagtcacaatggctttgtggtacatgtggcaagtgaaaacgcaaagatcaggagccttgtgggatgttccctca

SEQ ID NO: 55418 - DNA, 75 bp, Artificial Sequence
  Synthetic
ggagcaatgtacgccgacgacacagcaggatgggacacaagaatcacactagaggacttaaaaaatgaagaaatg

SEQ ID NO: 55419 - DNA, 75 bp, Artificial Sequence
  Synthetic
tgtggcaagtgaaaacgcaaagatcaggagccttgtgggatgttccctcaccagccaccgctcaaaaagccatgt

SEQ ID NO: 55420 - DNA, 75 bp, Artificial Sequence
  Synthetic
aagagagcactcgcacctccagtgaatgacctgaaatattcatggaagacatggggaaaagcaaagatctttact

SEQ ID NO: 55421 - DNA, 75 bp, Artificial Sequence
  Synthetic
caggttggggtaggagtacacgtggagggtgtgttccacaccatgtggcatgtgacaagaggatcggtgatctgt

SEQ ID NO: 55422 - DNA, 75 bp, Artificial Sequence
  Synthetic
agggtgtgttccacaccatgtggcatgtgacaagaggatcggtgatctgtcatgagactggaagactggagccat

SEQ ID NO: 55423 - DNA, 75 bp, Artificial Sequence
  Synthetic
tgataacacaatttgaaacataccaactatggacggcattagtctccctaatgtgttcaaacacaattttcacgt

SEQ ID NO: 55424 - DNA, 75 bp, Artificial Sequence
  Synthetic
acaaaactgttgatggacttattcaccactccagagggaatcttaccgtctcactttgatccacatggggagaat

SEQ ID NO: 55425 - DNA, 75 bp, Artificial Sequence
  Synthetic
ctcggtgaaaaatgggacaaagaagaggatgtgcaggtcctggccgtggaaccgggaaaaaatccaaaacacgtc

SEQ ID NO: 55426 - DNA, 75 bp, Artificial Sequence
  Synthetic
accgggaaaaaatccaaaacacgtccaaacgaaacctggcctttttaagactcttactggggaaataggagcagt

SEQ ID NO: 55427 - DNA, 75 bp, Artificial Sequence
  Synthetic
aaatggagtggttaccaaatcaggtgattacgtcagtgccataacgcaagctgaaaagatcggcgagccggacta

SEQ ID NO: 55428 - DNA, 75 bp, Artificial Sequence
  Synthetic
tggatagaaccttggcaaaagaaggcatcaaaagaggagaaacagaccatcacgctgtgtcgcgaggctcggcga

SEQ ID NO: 55429 - DNA, 75 bp, Artificial Sequence
  Synthetic
tacatcctggagctggcaaaacaaaaagaatcctaccatcaattgtcagagaagctctgaaaaggagactgcgga

SEQ ID NO: 55430 - DNA, 75 bp, Artificial Sequence
  Synthetic
ggctactttgctgtctttaacatttgtcaaaacaactctttcactgcactatgcatggaagacaatggccatgat

SEQ ID NO: 55431 - DNA, 75 bp, Artificial Sequence
  Synthetic
gaagctctgaaaaggagactgcggaccctgattctggctcccacgagagtagtggcagctgaaatggaagaggct

SEQ ID NO: 55432 - DNA, 75 bp, Artificial Sequence
  Synthetic
gatttctagccatacccccaacagcaggaattttggctagatggggctcattcaagaagaatggagcgatcaaag

SEQ ID NO: 55433 - DNA, 75 bp, Artificial Sequence
  Synthetic
tcaatgacaatgcgttgcataggaatatcaaatagagactttgtagaaggggtttcaggaggaagctgggttgac

SEQ ID NO: 55434 - DNA, 75 bp, Artificial Sequence
  Synthetic
gttcaaaaagcgaaatctaaccataatggatcttcatcctgggtcaggaaagacgcggaaatatcttccagccat

SEQ ID NO: 55435 - DNA, 75 bp, Artificial Sequence
  Synthetic
aatgagacacaagaaggccacatacgagccagatgttgacctcggaagtggaacccgcaacatcggaattgaaag

SEQ ID NO: 55436 - DNA, 75 bp, Artificial Sequence
  Synthetic
atgtgccatgcaaccttcacgacaagactcctgtcatcaaccagagttccaaattacaacctcatagtaatggat

SEQ ID NO: 55437 - DNA, 75 bp, Artificial Sequence
  Synthetic
taccagagtggaaatgggagaggcagcggctatcttcatgactgcaacaccccctggaacaatagacccttttcc

SEQ ID NO: 55438 - DNA, 75 bp, Artificial Sequence
  Synthetic
gcggctatcttcatgactgcaacaccccctggaacaatagacccttttccccagagcaacagcccaatagaagat

SEQ ID NO: 55439 - DNA, 75 bp, Artificial Sequence
  Synthetic
tagttctaacagtttttaattagagagcagatctctgatgaataaccaacggaaaaaggcgagaagtacgccttt

SEQ ID NO: 55440 - DNA, 75 bp, Artificial Sequence
  Synthetic
aatggcaaaagggagaggaggtgcaggttattgccgtagagcctgggaagaacccaaagaactttcaaaccatgc

SEQ ID NO: 55441 - DNA, 75 bp, Artificial Sequence
  Synthetic
cacggattaccaagggaagacggtgtggtttgttcccagcataaaagctggaaatgacattgcaaactgcttaag

SEQ ID NO: 55442 - DNA, 75 bp, Artificial Sequence
  Synthetic
tggtttgttcccagcataaaagctggaaatgacattgcaaactgcttaagaaagtctggaaagaaggtgatccag

SEQ ID NO: 55443 - DNA, 75 bp, Artificial Sequence
  Synthetic
agcaatgtatgccgatgactccgcaggctgggacacaagaatcacactagaggatttaaaaaatgaagaaaggat

SEQ ID NO: 55444 - DNA, 75 bp, Artificial Sequence
  Synthetic
atagcagcttcaataatattggagttctttctcatagtcttgctcattccagaaccagaaaagcagaggacaccc

SEQ ID NO: 55445 - DNA, 75 bp, Artificial Sequence
  Synthetic
aagtgagaaggctcatcgggaatgagaattatctagattacatgacatcaatgaagagattcaagaatgagagtg

SEQ ID NO: 55446 - DNA, 75 bp, Artificial Sequence
  Synthetic
tattgacgtacccaaacaaggtggtgcgtgtgcaaagaccaacaccagtaggcacggtaatggacatcatatcga

SEQ ID NO: 55447 - DNA, 75 bp, Artificial Sequence
  Synthetic
gcaaagagggattcttggatattctcagatcggagccggagtttacaaagaaggaacattccatacaatgtggca

SEQ ID NO: 55448 - DNA, 75 bp, Artificial Sequence
  Synthetic
caacactcaagtgggaaccttagccctttccttgaccttcataaaatcaacaatgccattggtcatggcttggag

SEQ ID NO: 55449 - DNA, 75 bp, Artificial Sequence
  Synthetic
acagatgggccagagagggttgttttggcagggcctatcccagtgactccggcaagtgctgcccagagaagaggg

SEQ ID NO: 55450 - DNA, 75 bp, Artificial Sequence
  Synthetic
agttggtacctatggcctcaatactttcaccaacctggaagggccacgaattaggcaaatggagggggaggaatc

SEQ ID NO: 55451 - DNA, 75 bp, Artificial Sequence
  Synthetic
catggctaagaacaagcccacgctggatatagagcttcagaagaccgaggccacccaactggcgaccctaaggaa

SEQ ID NO: 55452 - DNA, 75 bp, Artificial Sequence
  Synthetic
ggaacaaccaaattttagaagaaaacatggaggttgagatctggaccagagagggagaaaagaaaaagcttagac

SEQ ID NO: 55453 - DNA, 75 bp, Artificial Sequence
  Synthetic
catggaggttgagatctggaccagagagggagaaaagaaaaagcttagaccaaaatggttggatgctcgagtcta

SEQ ID NO: 55454 - DNA, 75 bp, Artificial Sequence
  Synthetic
catctgctcggcagtcccgtcacactgggttccaacaagccggacaacctggtccatacacgccagccatgaatg

SEQ ID NO: 55455 - DNA, 75 bp, Artificial Sequence
  Synthetic
agtcaacatagaagcagaacctccattcggagacagctacatcatcataggagtagagccgggacaattgaagct

SEQ ID NO: 55456 - DNA, 75 bp, Artificial Sequence
  Synthetic
aaagtataaccctggacattctgacagagattgccagcttgccgacctacctatcctctagggccaaactcgctc

SEQ ID NO: 55457 - DNA, 75 bp, Artificial Sequence
  Synthetic
agagattgccagcttgccgacctacctatcctctagggccaaactcgctcttgacaacatagtcatgctacacac

SEQ ID NO: 55458 - DNA, 75 bp, Artificial Sequence
  Synthetic
aatcattggagacactcatgctcatcgccctgttaggtgccatgacagcaggcattttcctattttttatgcagg

SEQ ID NO: 55459 - DNA, 75 bp, Artificial Sequence
  Synthetic
cgccctgttaggtgccatgacagcaggcattttcctattttttatgcaggggaaagggatagggaaactatcaat

SEQ ID NO: 55460 - DNA, 75 bp, Artificial Sequence
  Synthetic
ttttgtgtgatattggtgagtcctctccgaacccaaccatagaagaaggaagaacgttacgtgtcctaaagatgg

SEQ ID NO: 55461 - DNA, 75 bp, Artificial Sequence
  Synthetic
tccaacctcaatggatagcggcctcaatcatactggagttttttctcatggtacttttaataccagagccagaaa

SEQ ID NO: 55462 - DNA, 75 bp, Artificial Sequence
  Synthetic
aatcatactggagttttttctcatggtacttttaataccagagccagaaaagcaaagaaccccacaagacaacca

SEQ ID NO: 55463 - DNA, 75 bp, Artificial Sequence
  Synthetic
gacactcctggcaacagtcacaggaggaatcttcttattcttaatgagcggaaaaggtgtagggaagatgaccct

SEQ ID NO: 55464 - DNA, 75 bp, Artificial Sequence
  Synthetic
tggagcagatgcaaagaaaacatggaggaatgctagtgcgaaatccactctcaagaaattccactcatgaaatgt

SEQ ID NO: 55465 - DNA, 75 bp, Artificial Sequence
  Synthetic
ccgatgacacagcaggatgggacacaagaatcacactagaagacttaaaaaatgaagaaatggtaacaaaccaca

SEQ ID NO: 55466 - DNA, 75 bp, Artificial Sequence
  Synthetic
ccaatgagatggggttgattgaaaaaactaaaacggattttgggttctaccaggaaaaaccagagaccactatcc

SEQ ID NO: 55467 - DNA, 75 bp, Artificial Sequence
  Synthetic
aactaaaacggattttgggttctaccaggaaaaaccagagaccactatccttgatgtggatctgcgacctgcttc

SEQ ID NO: 55468 - DNA, 75 bp, Artificial Sequence
  Synthetic
gacatactatagaaaacacatctgctaacctgtctttggctgccattgccaatcaagcagctgtcctgatgggcc

SEQ ID NO: 55469 - DNA, 75 bp, Artificial Sequence
  Synthetic
tcggaaaaggatggccgcttcacaggatggaccttagtgtgccattgctagcattgggatgttactctcaagtga

SEQ ID NO: 55470 - DNA, 75 bp, Artificial Sequence
  Synthetic
tatgtgatgtgcacaggctcattcaagctagagaaagaagtggctgagacccagcatggaaccgttctagtgcag

SEQ ID NO: 55471 - DNA, 75 bp, Artificial Sequence
  Synthetic
cacacaggaagagagatcgtagacctcatgtgtcatgcaaccttcacaacaagacttttatcatcaaccagggtt

SEQ ID NO: 55472 - DNA, 75 bp, Artificial Sequence
  Synthetic
ccaatgggatagtgcgagagctgctgttgaggacgaggaattctggaaacttgtggacagagaacgtgaactcca

SEQ ID NO: 55473 - DNA, 75 bp, Artificial Sequence
  Synthetic
cccaaagtttgaaaaacaattagggcaggtcatgcttttagtcctgtgtgctggacagttactcttgatgaggac

SEQ ID NO: 55474 - DNA, 75 bp, Artificial Sequence
  Synthetic
caggtcatgcttttagtcctgtgtgctggacagttactcttgatgaggacaacctgggctttctgtgaggttttg

SEQ ID NO: 55475 - DNA, 75 bp, Artificial Sequence
  Synthetic
attctggaacacaactatagctgtatccacagccaacatctttagaggaagctatttagccggagctggactggc

SEQ ID NO: 55476 - DNA, 75 bp, Artificial Sequence
  Synthetic
tccacagccaacatctttagaggaagctatttagccggagctggactggccttctcactcataaaaaacacacaa

SEQ ID NO: 55477 - DNA, 75 bp, Artificial Sequence
  Synthetic
catgaagtgaggacggtatacgccatagcacggaaaaagatatggtacaagagagcggcgaccacacacgttaaa

SEQ ID NO: 55478 - DNA, 75 bp, Artificial Sequence
  Synthetic
gaaaagacagttaaattcactagataggaaggaatttgaagaatacaagaggagtggaatactagaagtagacag

SEQ ID NO: 55479 - DNA, 75 bp, Artificial Sequence
  Synthetic
aggaaggaatttgaagaatacaagaggagtggaatactagaagtagacaggactgaagccaaactagccttgaaa

SEQ ID NO: 55480 - DNA, 75 bp, Artificial Sequence
  Synthetic
acatcatgggccttgtgtgaagctctaaccctagccacaggaccaataacaacactctgggaaggatcacctggg

SEQ ID NO: 55481 - DNA, 75 bp, Artificial Sequence
  Synthetic
atggattgttgagagagggatgataaagccaaaagggaaagtcgtggatcttggttgtggaagaggaggatggtc

SEQ ID NO: 55482 - DNA, 75 bp, Artificial Sequence
  Synthetic
cactaggagtcttgggaatggcattgttcctggaagaaatgctcaggacccgagtaggaacgaaacatgcaatac

SEQ ID NO: 55483 - DNA, 75 bp, Artificial Sequence
  Synthetic
cgagtaggaacgaaacatgcaatactactagttgcagtttcttttgtgacattgatcacagggaacatgtccttt

SEQ ID NO: 55484 - DNA, 75 bp, Artificial Sequence
  Synthetic
ctattacgtggcgacactcaagaatgtgaccgaagtgagggggttcacgaaaggaggaccaggacacgaagaacc

SEQ ID NO: 55485 - DNA, 75 bp, Artificial Sequence
  Synthetic
catgccctactggctacgtcaatctttaagctgacctaccaaaataaggtggtgagggtgcagagaccagcaaaa

SEQ ID NO: 55486 - DNA, 75 bp, Artificial Sequence
  Synthetic
aggaaaacgtttgtggagctcatgagaagaggagatctacctgtctggctatcctacaaagttgcctcagaaggc

SEQ ID NO: 55487 - DNA, 75 bp, Artificial Sequence
  Synthetic
gcaggtggacaccctgctctgtgacattggagaatcatcctctaatccaacaatagaggaaggaagaacactaag

SEQ ID NO: 55488 - DNA, 75 bp, Artificial Sequence
  Synthetic
aacctgggaggccacaaaccatggaagctgtacgcatggtgtagtgaactagcgtctagaggagacccctcgctt

SEQ ID NO: 55489 - DNA, 75 bp, Artificial Sequence
  Synthetic
tggggatgtagctccatcgtggggatgtagctccatcgtggccacggcttgagccatcgtgctgcctgtagctcc

SEQ ID NO: 55490 - DNA, 75 bp, Artificial Sequence
  Synthetic
ttaaagtccttaacccctacatgccaacagtcatagaggaactagaaaagctacaaagaaagtatggtggaaatc

SEQ ID NO: 55491 - DNA, 75 bp, Artificial Sequence
  Synthetic
aacagtcatagaggaactagaaaagctacaaagaaagtatggtggaaatcttatcagatgcccactgtccaggaa

SEQ ID NO: 55492 - DNA, 75 bp, Artificial Sequence
  Synthetic
gttctgtgaacacagtatcaaagatgctgttaaacaggtttaccacgaaacatagaaaacccacctacgaaaagg

SEQ ID NO: 55493 - DNA, 75 bp, Artificial Sequence
  Synthetic
agctccatcgtgggatgtagctccatcgtgggatgtagctccatcgtgggatgtagctccatctggggatgtagc

SEQ ID NO: 55494 - DNA, 75 bp, Artificial Sequence
  Synthetic
gctgttaaacaggtttaccacgaaacatagaaaacccacctacgaaaaggacgtggaccttggggcaggaacaag

SEQ ID NO: 55495 - DNA, 75 bp, Artificial Sequence
  Synthetic
tcgtgggatgtagctccatcgtgggatgtagctccatctggggatgtagctccatctggggatgtagctccatct

SEQ ID NO: 55496 - DNA, 75 bp, Artificial Sequence
  Synthetic
acatgggtgacctatggaacatgttcccaaactggtgagcaccgacgagacaaacgttccgtcgcactggcccca

SEQ ID NO: 55497 - DNA, 75 bp, Artificial Sequence
  Synthetic
caaccctttcaagaactaacaagaaaaggagctggccactaaatgaggctatcatggcagtcgggatggtgagca

SEQ ID NO: 55498 - DNA, 75 bp, Artificial Sequence
  Synthetic
ggctccagcgattgcaagaagaacacaaagagacttggcactatgatcaagagaatccatacagaacctgggcgt

SEQ ID NO: 55499 - DNA, 75 bp, Artificial Sequence
  Synthetic
caaagagacttggcactatgatcaagagaatccatacagaacctgggcgtatcatgggagctatgaagccccctc

SEQ ID NO: 55500 - DNA, 75 bp, Artificial Sequence
  Synthetic
agaccagatttctttgagggaagctaagcttaaaggtagttctaacagtttttttaattagagagcagatctctg

SEQ ID NO: 55501 - DNA, 75 bp, Artificial Sequence
  Synthetic
ggccatcaaaatactgactggattcaggaaggagataggccgcatgctgaacatcttgaatggaaggaaaaggtc

SEQ ID NO: 55502 - DNA, 75 bp, Artificial Sequence
  Synthetic
gacccagttagctatgacagacacaactccctttgggcaacagagagtgtttaaggagaaagtggacaccagaac

SEQ ID NO: 55503 - DNA, 75 bp, Artificial Sequence
  Synthetic
ggctatgggcattgctcggaagaaagaagaaccctaggctgtgcacgagagaagagtttatctcaaaagttagat

SEQ ID NO: 55504 - DNA, 75 bp, Artificial Sequence
  Synthetic
gaagaaccctaggctgtgcacgagagaagagtttatctcaaaagttagatcgaatgcagctataggtgcagtttt

SEQ ID NO: 55505 - DNA, 75 bp, Artificial Sequence
  Synthetic
agacctctcttgtttaagacaacagagggaatcaacaaatgcactcttattgccatggacctgggtgaaatgtgt

SEQ ID NO: 55506 - DNA, 75 bp, Artificial Sequence
  Synthetic
ggttctggaaattggttgacaaggaaagagccttacatcaggaagggaagtgtgaatcgtgtgtctacaacatga

SEQ ID NO: 55507 - DNA, 75 bp, Artificial Sequence
  Synthetic
ccctactggtcaataccgaacctgaggacattgactgctggtgcaatctcacgtctgcctgggtcatgtatggaa

SEQ ID NO: 55508 - DNA, 75 bp, Artificial Sequence
  Synthetic
aagagccttacatcaggaagggaagtgtgaatcgtgtgtctacaacatgatgggaaaacgtgagaaaaaactagg

SEQ ID NO: 55509 - DNA, 75 bp, Artificial Sequence
  Synthetic
gcataaaagcaggaaatgatatagcagcttgcctgagaaaaaatggaaagaaagtgatacaacttagtaggaaga

SEQ ID NO: 55510 - DNA, 75 bp, Artificial Sequence
  Synthetic
gagcacggtttctggaatttgaagctctgggattcttaaatgaagatcactggtttggaagagacaattcatgga

SEQ ID NO: 55511 - DNA, 75 bp, Artificial Sequence
  Synthetic
tctgggattcttaaatgaagatcactggtttggaagagacaattcatggagtggagtggaaggagaaggtctaca

SEQ ID NO: 55512 - DNA, 75 bp, Artificial Sequence
  Synthetic
ggaacccaggattcgctctcttggcaggatttatggcctatatgattgggcagacaggaatccaacgagcagtct

SEQ ID NO: 55513 - DNA, 75 bp, Artificial Sequence
  Synthetic
acccctcccaaaacacaacgcagcagcggggcccaacaccaggggaagctgtaccctggtggtaaggactagagg

SEQ ID NO: 55514 - DNA, 75 bp, Artificial Sequence
  Synthetic
tgtacgctgatgatacagcaggttgggacacaagaatcactgaagatgacctcctgaatgaagagctgattacgg

SEQ ID NO: 55515 - DNA, 75 bp, Artificial Sequence
  Synthetic
cagcaataaaccaagtcagatccctcattggcaatgaggaatacacagattacatgccatccatgaaaagattta

SEQ ID NO: 55516 - DNA, 75 bp, Artificial Sequence
  Synthetic
ggacacaagaatcactgaagatgacctcctgaatgaagagctgattacggagcagatggcccctggtcataagat

SEQ ID NO: 55517 - DNA, 75 bp, Artificial Sequence
  Synthetic
agcaggagcagacacatcagaagttcactggaattacaaagagagaatggtgacattcaaggttcctcatgccaa

SEQ ID NO: 55518 - DNA, 75 bp, Artificial Sequence
  Synthetic
tccttagaccgaccccaaagggagcagtgatggacatcatttccagaaaagaccaaaggggcagtggacaagttg

SEQ ID NO: 55519 - DNA, 75 bp, Artificial Sequence
  Synthetic
agtgatggacatcatttccagaaaagaccaaaggggcagtggacaagttggaacatatggattgaacacattcac

SEQ ID NO: 55520 - DNA, 75 bp, Artificial Sequence
  Synthetic
agctttcctcagatttctagccattccaccaacagcaggagtcttggctagatggggaaccttcaagaagtcggg

SEQ ID NO: 55521 - DNA, 75 bp, Artificial Sequence
  Synthetic
cacaagatgatatgcagaacccaaaagggctgaaggaaaaagttgagaaatggctaaaagagtgtggtgttgaca

SEQ ID NO: 55522 - DNA, 75 bp, Artificial Sequence
  Synthetic
agggctgaaggaaaaagttgagaaatggctaaaagagtgtggtgttgacaggctgaagaggatggcaattagtgg

SEQ ID NO: 55523 - DNA, 75 bp, Artificial Sequence
  Synthetic
agtggttgggcgtgtcatctcatccacccctctagctgagaataccaacagtgtgaccaacatagaactggaacc

SEQ ID NO: 55524 - DNA, 75 bp, Artificial Sequence
  Synthetic
tcttcctgaacgacatgggaaaggtgagaaaagacatcccgcagtgggaaccctccaagggatggaaaaattggc

SEQ ID NO: 55525 - DNA, 75 bp, Artificial Sequence
  Synthetic
ctggaatcaacatgtgcacactcatagccatggacttgggagagatgtgtgatgacacggtcacttacaaatgcc

SEQ ID NO: 55526 - DNA, 75 bp, Artificial Sequence
  Synthetic
ccaactatctactcagcatcattctaggcacagaacgccagaaaatggaatggtgctgttgaatcaacaggttct

SEQ ID NO: 55527 - DNA, 75 bp, Artificial Sequence
  Synthetic
gagaaaagacatcccgcagtgggaaccctccaagggatggaaaaattggcaagaagttcctttttgctcccatca

SEQ ID NO: 55528 - DNA, 75 bp, Artificial Sequence
  Synthetic
ggtccggaattgacttcaatgagatgattctgatgaaaatgaaaaagaaaacgtggcttgtgcacaagcaatggt

SEQ ID NO: 55529 - DNA, 75 bp, Artificial Sequence
  Synthetic
gaaaccaggatgagctaatagggagggctaggatttcgcaaggggcgggatggagcttaaaagaaacagcctgcc

SEQ ID NO: 55530 - DNA, 75 bp, Artificial Sequence
  Synthetic
ggctaggatttcgcaaggggcgggatggagcttaaaagaaacagcctgcctggggaaggcttacgctcagatgtg

SEQ ID NO: 55531 - DNA, 75 bp, Artificial Sequence
  Synthetic
tatgttcagcggttccagtggagtgggttccaacaagtagaacaacatggtcgattcacgcccaccatcagtgga

SEQ ID NO: 55532 - DNA, 75 bp, Artificial Sequence
  Synthetic
ggttccaacaagtagaacaacatggtcgattcacgcccaccatcagtggatgaccactgaggacatgctcaaagt

SEQ ID NO: 55533 - DNA, 75 bp, Artificial Sequence
  Synthetic
cagtctattcttgggaagacataccttacctaggaaaaagagaggatctatggtgtggctccctgattggactca

SEQ ID NO: 55534 - DNA, 75 bp, Artificial Sequence
  Synthetic
aatgtcatacacgatgtgctcaggaaagttctcaattgacaaagagatggcagaaacacagcatgggacaacagt

SEQ ID NO: 55535 - DNA, 75 bp, Artificial Sequence
  Synthetic
agaaacttgattgggaaagaggagtatgtggattacatgccagccatgaaaagatacagcgctcccctagaaagt

SEQ ID NO: 55536 - DNA, 75 bp, Artificial Sequence
  Synthetic
aatgctgatgactggaacactggctgtgttcctccttctcataatgggacaattgacatggaatgatctgatcag

SEQ ID NO: 55537 - DNA, 75 bp, Artificial Sequence
  Synthetic
ataggtgttggagacagtgcattaacactccattggttcaggaaagggagttccattggcaagatgtttgagtcc

SEQ ID NO: 55538 - DNA, 75 bp, Artificial Sequence
  Synthetic
atggtacatgtggttgggagcacgctttctagagtttgaagctcttggtttcatgaacgaagaccactggttcag

SEQ ID NO: 55539 - DNA, 75 bp, Artificial Sequence
  Synthetic
aaacacgaaagggggagacctctcttgtttaagacaacagagggaatcaacaaatgcactcttattgccatggac

SEQ ID NO: 55540 - DNA, 75 bp, Artificial Sequence
  Synthetic
agacctgccgttaccatggctacccggagcagacacacaaggatcaaattggatacagaaagagacattggtcac

SEQ ID NO: 55541 - DNA, 75 bp, Artificial Sequence
  Synthetic
tggggtctcatggactatgaaaatcctcataggagtcatcatcacatggataggaatgaattcacgcagcacctc

SEQ ID NO: 55542 - DNA, 75 bp, Artificial Sequence
  Synthetic
acctacctctaccatggacatcaggagctacaacggaaacaccaacctggaacaggaaggagcttcttgtgacat

SEQ ID NO: 55543 - DNA, 75 bp, Artificial Sequence
  Synthetic
gaacgtgcaatcaagctggggagcatagacgcgacaagagatcagtggcgttagctccccatgtcggcatgggac

SEQ ID NO: 55544 - DNA, 75 bp, Artificial Sequence
  Synthetic
gtgccacgtgtgtttacaacatgatggggaagagagagaaaaaactaggagagttcggaaaggcaaaaggaagtc

SEQ ID NO: 55545 - DNA, 75 bp, Artificial Sequence
  Synthetic
gatctgaaatattcatggaagacatggggaaaagcaaaaatctttactccagaaacaaaaaatagcacatttcta

SEQ ID NO: 55546 - DNA, 75 bp, Artificial Sequence
  Synthetic
ccatggcccagggaaaaccaaccttggattttgaactgatcaagacaacagccaaggaagtggctctgttaagaa

SEQ ID NO: 55547 - DNA, 75 bp, Artificial Sequence
  Synthetic
tgggaagatgttcgaggccactgccagaggtgcaaggcgcatggccatcttgggagacacagcttgggactttgg

SEQ ID NO: 55548 - DNA, 75 bp, Artificial Sequence
  Synthetic
caagccgtgctgcctgtggctccatcgtggggatgtaaaaaacccgggaggctgcaacccatggaagctgtacgc

SEQ ID NO: 55549 - DNA, 75 bp, Artificial Sequence
  Synthetic
ttttctatggggctgttatgcctgaccttgtttgtggaagaatgcttgaggagaagagtcactaggaaacacatg

SEQ ID NO: 55550 - DNA, 75 bp, Artificial Sequence
  Synthetic
agagccagaatctcgcaaggggctggatggagtttaagagaaacagcctgtctgggcaaagcttacgcccagatg

SEQ ID NO: 55551 - DNA, 75 bp, Artificial Sequence
  Synthetic
aaggaagttccatcggccaaatgtttgagacaacaatgagaggagcgaagagaatggccattttaggtgacacag

SEQ ID NO: 55552 - DNA, 75 bp, Artificial Sequence
  Synthetic
tgtcatagccatcctcacagtggtggccgcaaccatggcaaacgagatgggtttcctggaaaaaaccaagaaaga

SEQ ID NO: 55553 - DNA, 75 bp, Artificial Sequence
  Synthetic
atggatggacttactacgagccctcatcatgttaggggacaccatgtctggtagaatgggaggtcagattcactt

SEQ ID NO: 55554 - DNA, 75 bp, Artificial Sequence
  Synthetic
agattacatgacatcaatgaagagattcaagaacgagagtgatcccgaaggggcactctggtgagtcaacacatt

SEQ ID NO: 55555 - DNA, 75 bp, Artificial Sequence
  Synthetic
ggaaaggatggccattgtcaaagatggacattggagttcccctccttgccattggatgctattcacaagtcaacc

SEQ ID NO: 55556 - DNA, 75 bp, Artificial Sequence
  Synthetic
tgaaatgtggaagcggaatctttgtaattgacaacgtgcacacttggacagaacagtacaaatttcaaccagagt

SEQ ID NO: 55557 - DNA, 75 bp, Artificial Sequence
  Synthetic
aattgacaacgtgcacacttggacagaacagtacaaatttcaaccagagtctccagcgagactagcgtccgcaat

SEQ ID NO: 55558 - DNA, 75 bp, Artificial Sequence
  Synthetic
cagcagacctgtcactagagaaggccgccaatgtgcagtgggatgagatggcagacataacaggctcaagcccaa

SEQ ID NO: 55559 - DNA, 75 bp, Artificial Sequence
  Synthetic
aagtggaaaggtggacaacttcacaatgggtgtcttgtgtttggcaatcctctttgaagaggtgatgagaggaaa

SEQ ID NO: 55560 - DNA, 75 bp, Artificial Sequence
  Synthetic
cagacacctccgaatgccccaatgaacgaagagcatggaattttcttgaggtagaagactatggatttggcatgt

SEQ ID NO: 55561 - DNA, 75 bp, Artificial Sequence
  Synthetic
gagaagcaatgcagccttgggggccatattcactgatgagaacaagtggaagtcggcacgtgaggctgttgaaga

SEQ ID NO: 55562 - DNA, 75 bp, Artificial Sequence
  Synthetic
aagatgttcaggttctagctatagaaccaggaaaaaacccgaagcacgtccaaacgaagcccggtcttttcaaaa

SEQ ID NO: 55563 - DNA, 75 bp, Artificial Sequence
  Synthetic
acgttgactgttgcctggagaacagccaccctgattttggccggagtttcgcttttaccagtgtgccagtcttcg

SEQ ID NO: 55564 - DNA, 75 bp, Artificial Sequence
  Synthetic
agagccagatgctcatcccaaaagcatatgcaggccctttttcacagcacaattaccgccagggctatgccacgc

SEQ ID NO: 55565 - DNA, 75 bp, Artificial Sequence
  Synthetic
tctggttctcccatcattaacaggaaaggaaaagtcatcggactctacggaaatggagtggtcactaaatcaggt

SEQ ID NO: 55566 - DNA, 75 bp, Artificial Sequence
  Synthetic
aagggaaaagtcttctgttcaaaacagaggatggtgtgaacatgtgcaccctcatggccatggaccttggtgaat

SEQ ID NO: 55567 - DNA, 75 bp, Artificial Sequence
  Synthetic
gaagaacaaagcatggatggtacatagacaatggttttttgacctacctctaccatggacatcaggagctacaac

SEQ ID NO: 55568 - DNA, 75 bp, Artificial Sequence
  Synthetic
gcgtgtgcaaagaccaacaccaagaggcacagtaatggatatcatatcgagaagagaccaaagaggtagtggaca

SEQ ID NO: 55569 - DNA, 75 bp, Artificial Sequence
  Synthetic
aaggtttttgggagaggatggatgctggtatgggatggaaattaggcccttgagtgaaaaagaagagaacatggt

SEQ ID NO: 55570 - DNA, 75 bp, Artificial Sequence
  Synthetic
ccacaggagaacacagaagggaaaaaagatcagtggcactcgtcccacatgtgggaatgggattggagacacgaa

SEQ ID NO: 55571 - DNA, 75 bp, Artificial Sequence
  Synthetic
aggctggcggcaaatgccatttgctcggcagtgccatcacactgggttccaacaagtcgaacaacctggtccata

SEQ ID NO: 55572 - DNA, 75 bp, Artificial Sequence
  Synthetic
gaaacctggatcttgagacatccaggttttaccataatggcagcaatcttggcatacaccataggaacgacatat

SEQ ID NO: 55573 - DNA, 75 bp, Artificial Sequence
  Synthetic
actcacttcaagagagacagcactaatggtgataggaatggccatgacaacggtgctttcaattccacatgacct

SEQ ID NO: 55574 - DNA, 75 bp, Artificial Sequence
  Synthetic
ctccttaacatgttcaaacacaattttcacgttgactgttgcctggagaacagccaccttgattctggccggagt

SEQ ID NO: 55575 - DNA, 75 bp, Artificial Sequence
  Synthetic
tacatgccttcaatgaagagattcaggaaggaggaggagtcggagggagccatttggtaaacgtaggaagtgaaa

SEQ ID NO: 55576 - DNA, 75 bp, Artificial Sequence
  Synthetic
gctgtgggtttggtcagtctcttgggaagcgccctcctaaagaatgatgtccctttagctggcccaatggtggca

SEQ ID NO: 55577 - DNA, 75 bp, Artificial Sequence
  Synthetic
tcgacttcaatgagatggtgttgctgcaaatggaaaataaggcttggctggtgcacaggcaatggttcttagacc

SEQ ID NO: 55578 - DNA, 75 bp, Artificial Sequence
  Synthetic
cggtgtggctgagctataaggtagcttctgctggtatctcttacaaagaccgggaatggtgcttcacaggggaaa

SEQ ID NO: 55579 - DNA, 75 bp, Artificial Sequence
  Synthetic
caacagcaacaaaatctgaacacacaggaagagagattgttgatctaatgtgccacgcaacgttcacaatgcgtc

SEQ ID NO: 55580 - DNA, 75 bp, Artificial Sequence
  Synthetic
caaaaaacagcatattgacgctgggaaagaccagagatcctgcagcatcattccaggcacagaacgccagaaaat

SEQ ID NO: 55581 - DNA, 75 bp, Artificial Sequence
  Synthetic
aaatgacatagcaaactgcttgcgaaaaaacgggaaaaaggtcattcaacttagtaggaagacttttgacacaga

SEQ ID NO: 55582 - DNA, 75 bp, Artificial Sequence
  Synthetic
tgatcgtcggtatacaggagaaagggaaaagtcttctgtttaaaacagaggatggtgtgaacatgtgcaccctca

SEQ ID NO: 55583 - DNA, 75 bp, Artificial Sequence
  Synthetic
gcctcacacaacatactagtggaggtccaagatgatggaaccatgaagataaaggatgaagagagagatgacacg

SEQ ID NO: 55584 - DNA, 75 bp, Artificial Sequence
  Synthetic
cagaagggaagaggaagaggcaggtgtcctgtggtagaaggcaaaactaacacgaaacaaggctaaaagtcaggt

SEQ ID NO: 55585 - DNA, 75 bp, Artificial Sequence
  Synthetic
gggaggagcatgcggtcggaaatgacacaggaaaacacggcatggaaatcaaagtaacaccacagagttccatca

SEQ ID NO: 55586 - DNA, 75 bp, Artificial Sequence
  Synthetic
aaggacgttaaaagaagtcaggccatcacaaaatgccacggcttgagtaaaccgtgcagcctgtagctccacctg

SEQ ID NO: 55587 - DNA, 75 bp, Artificial Sequence
  Synthetic
agaaattggagcagtgacattggacttcaaacccggaacatccggttctcccatcattaacaggaaaggaaaagt

SEQ ID NO: 55588 - DNA, 75 bp, Artificial Sequence
  Synthetic
agatggcaatgacagacacgactccatttggacaacagcgtgtttttaaagaaaaagtggacacgagaacccaag

SEQ ID NO: 55589 - DNA, 75 bp, Artificial Sequence
  Synthetic
tggtgagccagattatgaagtggatgaggacatttttcgaaagaaaagattaactataatggacttacaccccgg

SEQ ID NO: 55590 - DNA, 75 bp, Artificial Sequence
  Synthetic
ataataggtccaggattgcaggcaaaagccacaagagaggctcagaaaaggacagctgctgggatcatgaagaac

SEQ ID NO: 55591 - DNA, 75 bp, Artificial Sequence
  Synthetic
aaaggaggctgcgaaccttgattttggctcccacgagagtggtggcggccgagatggaagaggccctacgtggac

SEQ ID NO: 55592 - DNA, 75 bp, Artificial Sequence
  Synthetic
tccccctcaaagctggcttcagctatccagaaagctcatgaagaaggcatttgtggaatccgctcagtaacaaga

SEQ ID NO: 55593 - DNA, 75 bp, Artificial Sequence
  Synthetic
atcaaccagggttccaaattacaacctcatagtgatggatgaagcacatttcacagacccttctagtgtcgcggc

SEQ ID NO: 55594 - DNA, 75 bp, Artificial Sequence
  Synthetic
tagaatgctcaccacggacaggtttggatttcaatgaaatgatcttgttgacaatgaagaacaaagcatggatgg

SEQ ID NO: 55595 - DNA, 75 bp, Artificial Sequence
  Synthetic
ggatgtggaaatctggacaaaggaaggagaaaagaaaaaattgagacctaggtggcttgatgcccgcacttattc

SEQ ID NO: 55596 - DNA, 75 bp, Artificial Sequence
  Synthetic
gacagatcccttcccccagagcaacagcccaatagaagacatcgagagagaaattccagaaaggtcatggaacac

SEQ ID NO: 55597 - DNA, 75 bp, Artificial Sequence
  Synthetic
aacaaatggcaaatggaatcgctctggggctcatggctcttaaactgataacacaatttgaaacataccaattat

SEQ ID NO: 55598 - DNA, 75 bp, Artificial Sequence
  Synthetic
gggactttggatcagtgggtggtgttctaaactcattaggcaaaatggtgcaccaaatattcggaagtgcttaca

SEQ ID NO: 55599 - DNA, 75 bp, Artificial Sequence
  Synthetic
aagggattggaaagacttcaataggactcatttgtgtaattgcttccagcggcatgttgtggatggccgaaatcc

SEQ ID NO: 55600 - DNA, 75 bp, Artificial Sequence
  Synthetic
aatgaacaggaggaaaagatctgtgaccatgctcctcatgctgctgcccacagccctggcgttccatctgaccac

SEQ ID NO: 55601 - DNA, 75 bp, Artificial Sequence
  Synthetic
aaggaggtccaggacatgaagaaccgattcccatggctacctatggctggaatttggtcaaactccattcaggag

SEQ ID NO: 55602 - DNA, 75 bp, Artificial Sequence
  Synthetic
cacttttgtttaagacctctgcaggtgtcaacatgtgcacccttattgcaatggatttgggagagttatgtgagg

SEQ ID NO: 55603 - DNA, 75 bp, Artificial Sequence
  Synthetic
aagagtggggcgcgaaaggttgtcaagaatggccatcagtggagatgattgtgttgtgaaacctttagatgacag

SEQ ID NO: 55604 - DNA, 75 bp, Artificial Sequence
  Synthetic
acacaatgacctacaaatgcccccggatcactgagacggaaccagatgacgttgactgttggtgcaatgccacgg

SEQ ID NO: 55605 - DNA, 75 bp, Artificial Sequence
  Synthetic
aaggaggtccaggacatgaagaaccgattcccatggctacctatggctggaacttggtcaaactccattcagggg

SEQ ID NO: 55606 - DNA, 75 bp, Artificial Sequence
  Synthetic
actgtcaggagctacgtgggtggatgtggtactggagcatggaagttgcgtcactaccatggcaaaagacaaacc

SEQ ID NO: 55607 - DNA, 75 bp, Artificial Sequence
  Synthetic
gtggtactggagcatggaagttgcgtcactaccatggcaaaagacaaaccaacactggacattgaactcttgaag

SEQ ID NO: 55608 - DNA, 75 bp, Artificial Sequence
  Synthetic
acggaggtcacaaaccctgccgtcctgcgcaaactgtgcattgaagctaaaatatcaaacaccaccaccgattcg

SEQ ID NO: 55609 - DNA, 75 bp, Artificial Sequence
  Synthetic
tgcgcaaactgtgcattgaagctaaaatatcaaacaccaccaccgattcgagatgtccaacacaaggagaagcca

SEQ ID NO: 55610 - DNA, 75 bp, Artificial Sequence
  Synthetic
tgttgtgtgacataggggagtcatcaccaaatcccacagtggaagcaggacgaacactcagagtccttaatttag

SEQ ID NO: 55611 - DNA, 75 bp, Artificial Sequence
  Synthetic
ttctttgagggagctaagctcaacgtagttctaacagttttttaattagagagcagatctctgatgaataaccaa

SEQ ID NO: 55612 - DNA, 75 bp, Artificial Sequence
  Synthetic
ggctattcggaaaaggtagcttaataacgtgtgctaagtttaagtgtgtgacaaaactggaaggaaagatagtcc

SEQ ID NO: 55613 - DNA, 75 bp, Artificial Sequence
  Synthetic
ggttttgggaactggttgacaaagaaagggctctgcaccaggaagggaaatgtgaatcgtgtgtctataacatga

SEQ ID NO: 55614 - DNA, 75 bp, Artificial Sequence
  Synthetic
ctggttcaagaaaggaagcagcatagggaaaatgttcgaagcaaccgcccgaggagcacgaaggatggctatcct

SEQ ID NO: 55615 - DNA, 75 bp, Artificial Sequence
  Synthetic
aagggaaaagtcttctgttcaaaacagaggatggtgttaacatgtgtaccctcatggccatggaccttggtgaat

SEQ ID NO: 55616 - DNA, 75 bp, Artificial Sequence
  Synthetic
cagcaccaagttggaaatgagaccacagaacatggaacaactgcaaccataacacctcaagctcccacgtcggaa

SEQ ID NO: 55617 - DNA, 75 bp, Artificial Sequence
  Synthetic
aaccctgggacgtgattccaatggtgacccagttggctatgacagacacaaccccttttgggcaacagagagtgt

SEQ ID NO: 55618 - DNA, 75 bp, Artificial Sequence
  Synthetic
agagaaactgcatgcctaggcaagtcatatgcacaaatgtggcagctgatgtacttccacaggagagacctgaga

SEQ ID NO: 55619 - DNA, 75 bp, Artificial Sequence
  Synthetic
ggggcttcaacatcccaagagacttggaatagacaagacttgctggtcacatttaagacagctcatgcaaaaaag

SEQ ID NO: 55620 - DNA, 75 bp, Artificial Sequence
  Synthetic
ggaccactagtggctggagggctcctcactgtgtgctacgtgctcactggacgatcggccgacttggaactggag

SEQ ID NO: 55621 - DNA, 75 bp, Artificial Sequence
  Synthetic
aatcgaagcttgcttacgtagtctaacagttcttattagagagcagatctctgatgaacagacaacgaaaaaaag

SEQ ID NO: 55622 - DNA, 75 bp, Artificial Sequence
  Synthetic
gttccatttgaccacacgagggggagagccacacatgatagtcagcaagcaggaaagaggaaagtcactcttgtt

SEQ ID NO: 55623 - DNA, 75 bp, Artificial Sequence
  Synthetic
aatgaaagaaaaatcatggcttgtccacaaacaatggtttctagacttaccactgccttggacttcgggggcttc

SEQ ID NO: 55624 - DNA, 75 bp, Artificial Sequence
  Synthetic
acttggtctagaaacaagaactgaaacgtggatgtcctctgaaggcgcctggaaacaaatacaaaaagtggagac

SEQ ID NO: 55625 - DNA, 75 bp, Artificial Sequence
  Synthetic
acacccaacatggatgtcattggggaaagaataaaaaggatcaaggaggagcataattcaacatggcactatgat

SEQ ID NO: 55626 - DNA, 75 bp, Artificial Sequence
  Synthetic
gaaacccaggattcgcgctcttggcaggatttatggcctatatgatcgggcaaacaggaatccagcgaacagtct

SEQ ID NO: 55627 - DNA, 75 bp, Artificial Sequence
  Synthetic
gttgactgctggtgcaatgccacagacacatgggtgacctacggaacgtgttctcaaactggcgaacaccgacga

SEQ ID NO: 55628 - DNA, 75 bp, Artificial Sequence
  Synthetic
ctaaactcactagataggaaggagtttgaagagtacaaaagaagtggaatactagaagtggacaggactgaagcc

SEQ ID NO: 55629 - DNA, 75 bp, Artificial Sequence
  Synthetic
aggagtcatggttcaggcggactcgggatgtgtaatcaactggaaaggcagagaactcaaatgtggaagcggcat

SEQ ID NO: 55630 - DNA, 75 bp, Artificial Sequence
  Synthetic
aaatcaagcatgcagtgtccagagggtccagcaagattagatggattgttgaaagagggatggtaaaaccaaaag

SEQ ID NO: 55631 - DNA, 75 bp, Artificial Sequence
  Synthetic
ttaaaaacgcacatgcgaagaaacaagaagtagttgtccttggatcgcaagagggagcaatgcataccgcattga

SEQ ID NO: 55632 - DNA, 75 bp, Artificial Sequence
  Synthetic
tatggtaatggtgttgtcacaaggagtggagcatatgtgagtgctatagcccaaactgaaaaaagcattgaagac

SEQ ID NO: 55633 - DNA, 75 bp, Artificial Sequence
  Synthetic
atttttgcggggcacttaaaatgtagacttaagatggacaaattggaactcaaggggatgagctatgcaatgtgc

SEQ ID NO: 55634 - DNA, 75 bp, Artificial Sequence
  Synthetic
aaccctaacatgactgacaagaccccagtccattcgtgggaagacataccttacctagggaaaagagaggacttg

SEQ ID NO: 55635 - DNA, 75 bp, Artificial Sequence
  Synthetic
ttgtgtgaaggtaccacagttgttgtggatgaacattgtggaaatcgaggtccatctctcagaactacaacagtc

SEQ ID NO: 55636 - DNA, 75 bp, Artificial Sequence
  Synthetic
atgattaggccacaacccatggaacacaaatactcgtggaaaagctggggaaaagccaaaatcataggagcagat

SEQ ID NO: 55637 - DNA, 75 bp, Artificial Sequence
  Synthetic
ctttggagtattcactaccaacatatggctaagattgagagaaaagcaggatgtattttgtgactcaaaactcat

SEQ ID NO: 55638 - DNA, 75 bp, Artificial Sequence
  Synthetic
acggcccaaacaccccagaatgccctgataaccaaagagcatggaacatttgggaagttgaagactatggatttg

SEQ ID NO: 55639 - DNA, 75 bp, Artificial Sequence
  Synthetic
gactattcggaaaaggaagcctactgacgtgtgctaagttcaagtgtgtgacaaaacttgaaggaaagatagttc

SEQ ID NO: 55640 - DNA, 75 bp, Artificial Sequence
  Synthetic
tggagagtttggcaaagcaaaaggcagtagagctatatggtacatgtggttgggagccaggtaccttgagttcga

SEQ ID NO: 55641 - DNA, 75 bp, Artificial Sequence
  Synthetic
atgtattttgtgactcaaaactcatgtcagcggccataaaggataacagagccgtccatgctgatatgggttatt

SEQ ID NO: 55642 - DNA, 75 bp, Artificial Sequence
  Synthetic
gaaagtgaaaagaacgagacttggaagttggcaagagcctccttcatagaagttaagacatgcatctggccaaaa

SEQ ID NO: 55643 - DNA, 75 bp, Artificial Sequence
  Synthetic
tggcccaagggaaaaaaatgattaggccacaacccatggaacacaaatactcatggaaaagttggggaaaagcta

SEQ ID NO: 55644 - DNA, 75 bp, Artificial Sequence
  Synthetic
gacatttccaagatacccggaggagctatgtatgctgatgacacagctggttgggacacaagaataacagaagat

SEQ ID NO: 55645 - DNA, 75 bp, Artificial Sequence
  Synthetic
agcagaactggaagaaggggtctataggatcaaacaacaaggaatttttgggaaaacccaagtaggggttggagt

SEQ ID NO: 55646 - DNA, 75 bp, Artificial Sequence
  Synthetic
aggaacctgatcggaaaagaggagtatgtggattacatgccagtcatgaaaagatacagcgctcccttcgagagt

SEQ ID NO: 55647 - DNA, 75 bp, Artificial Sequence
  Synthetic
gggtgctggtacggcatggaaatcagaccagtcaaggagaaggaagagaacctagttaagtcaatggtctctgca

SEQ ID NO: 55648 - DNA, 75 bp, Artificial Sequence
  Synthetic
aggctattgaagtcaggccacttgtgccacggcttgagcaaaccgtgctgcctgtagctccgccaataacgggag

SEQ ID NO: 55649 - DNA, 75 bp, Artificial Sequence
  Synthetic
aatgagatgtgtgggagtaggaaacagagattttgtggaaggtctatcaggagctacgtgggttgacgtggtgct

SEQ ID NO: 55650 - DNA, 75 bp, Artificial Sequence
  Synthetic
accccttttgctgagaataccaacagtgtgaccaatatagaattggaacccccttttggggatagctacatagta

SEQ ID NO: 55651 - DNA, 75 bp, Artificial Sequence
  Synthetic
agatggagcagaaaaatgctgatgactggaacattggctgtgttcctccttctcacaatgggacaattgacatgg

SEQ ID NO: 55652 - DNA, 75 bp, Artificial Sequence
  Synthetic
ccacgacagccaactggctgtgggctctcctcgggaagaagaaaaatcccagactgtgcacaagggaagagttca

SEQ ID NO: 55653 - DNA, 75 bp, Artificial Sequence
  Synthetic
agactgtgcacaagggaagagttcatctcaaaagttaggtcaaacgcagccataggcgcagtctttcaggaagaa

SEQ ID NO: 55654 - DNA, 75 bp, Artificial Sequence
  Synthetic
aacatggaggttgaaatttggactagagagggagaaaagaaaaaactcaggccaaaatggttagatgcacgtgta

SEQ ID NO: 55655 - DNA, 75 bp, Artificial Sequence
  Synthetic
gtctggtggcatctgtagaactaccaaattccttagaggagctaggggatggacttgcaatgggcatcatgatgt

SEQ ID NO: 55656 - DNA, 75 bp, Artificial Sequence
  Synthetic
tatgtttggaggagtctcatggatggttagaatcctaatcgggttcttagtgttgtggattggcacgaattcaag

SEQ ID NO: 55657 - DNA, 75 bp, Artificial Sequence
  Synthetic
acatcagctatgggctaccttgctgtctttaacatttgtcaaaacaactttttcattgcactatgcatggaagac

SEQ ID NO: 55658 - DNA, 75 bp, Artificial Sequence
  Synthetic
attctgtcaataacaatatcagaagatggcagcatgtcgataaagaatgaagaggaagagcaaacactgactata

SEQ ID NO: 55659 - DNA, 75 bp, Artificial Sequence
  Synthetic
agctgtgaaatcagaacacacaggaagagagattgtagacctcatgtgtcatgcaaccttcacaacaagactttt

SEQ ID NO: 55660 - DNA, 75 bp, Artificial Sequence
  Synthetic
gtgtacccaatgtcaataccagcaactctttttgtgtggtatttttggcagaaaaagaaacagagatcaggagtg

SEQ ID NO: 55661 - DNA, 75 bp, Artificial Sequence
  Synthetic
tccggtgttgctgggatctcttggatgcaaaccactaaccatgtttcttataacagaaaacaaaatctggggaag

SEQ ID NO: 55662 - DNA, 75 bp, Artificial Sequence
  Synthetic
atcttgagggagctagctcaacgtagcctgaacagtttttaattagagagcagatctctgatgaataaccaacgg

SEQ ID NO: 55663 - DNA, 75 bp, Artificial Sequence
  Synthetic
ttggaacaccacgatagctgtttccatggcgaacatttttagagggagctatttagcaggagctgggcttgcttt

SEQ ID NO: 55664 - DNA, 75 bp, Artificial Sequence
  Synthetic
cattttgttaatgctggtaacaccatccatggccatgcgatgtgtgggaataggcagcagggactttgtggaagg

SEQ ID NO: 55665 - DNA, 75 bp, Artificial Sequence
  Synthetic
gatagagagctcaaaaaaccagacctggcagatagagaaagcatccctcattgaagtgaaaacatgtctgtggcc

SEQ ID NO: 55666 - DNA, 75 bp, Artificial Sequence
  Synthetic
gaggtctcctgggaagaagaagcagaacactctggtgcctcacacaacatactagtggaggtccaagatgatgga

SEQ ID NO: 55667 - DNA, 75 bp, Artificial Sequence
  Synthetic
gctggacttcaactattgtgaaggaacaacagttgtcatcacagaaaactgtgggacaagaggcccatcattgag

SEQ ID NO: 55668 - DNA, 75 bp, Artificial Sequence
  Synthetic
agtgtggtgtcgacaggttaaagaggatggcaatcagtggagacgattgtgtggtgaagcctctggatgagaggt

SEQ ID NO: 55669 - DNA, 75 bp, Artificial Sequence
  Synthetic
aagccatcttgcctgaatatggaacccttgggctagaatgctcaccacggacaggtttggatttcaatgaaatga

SEQ ID NO: 55670 - DNA, 75 bp, Artificial Sequence
  Synthetic
caaagcaactctgctagcaatctcaggggtatacccaatgtcaataccggcgaccctctttgtgtggtatttttg

SEQ ID NO: 55671 - DNA, 75 bp, Artificial Sequence
  Synthetic
tgatggcatttatagaattctccaaagaggattgttgggcaggtctcaagtaggagtaggagtttttcaagaagg

SEQ ID NO: 55672 - DNA, 75 bp, Artificial Sequence
  Synthetic
agatttcggattgggaagcattgcaacccagcaacccgagagcaacatcctggacatagatctacgtcctgcatc

SEQ ID NO: 55673 - DNA, 75 bp, Artificial Sequence
  Synthetic
taggagtaggagtttttcaagaaggcgtgttccacacaatgtggcacgtcaccaggggagctgtcctcatgtacc

SEQ ID NO: 55674 - DNA, 75 bp, Artificial Sequence
  Synthetic
agtgcaggtgattgctgttgaaccggggaagaaccccaaaaatgtacagacagcgccgggtaccttcaagacccc

SEQ ID NO: 55675 - DNA, 75 bp, Artificial Sequence
  Synthetic
gctgagctataaggtagcatctgctggcatttcttacaaagatcgggaatggtgcttcactggggaaagaaataa

SEQ ID NO: 55676 - DNA, 75 bp, Artificial Sequence
  Synthetic
gccataacccaggtcaggaacctgatcgggaaagaggagtatgtggattacatgccagtcatgaaaagatacagc

SEQ ID NO: 55677 - DNA, 75 bp, Artificial Sequence
  Synthetic
agataccttccagccatagtccgtgaggccataaaaagaaagctgcgcacgctagtcttagctcccacaagagtt

SEQ ID NO: 55678 - DNA, 75 bp, Artificial Sequence
  Synthetic
attccaggcacagaacgccagaaaatggaatggtgctgttgaatcaacaggttctgacgaatacctgagactcca

SEQ ID NO: 55679 - DNA, 75 bp, Artificial Sequence
  Synthetic
cccagggaggccatgcgccacggaagctgtacgcgtggcatattggactagcggttagaggagacccctcccatc

SEQ ID NO: 55680 - DNA, 75 bp, Artificial Sequence
  Synthetic
ccagagaagctcagaaaagagcagcagcaggcatcatgaaaaacccaacagtcgatggaataacagtgattgacc

SEQ ID NO: 55681 - DNA, 75 bp, Artificial Sequence
  Synthetic
aagcacatttcaccgatccagccagcatagcagccagagggtatatctcaacccgagtgggtatgggtgaagcag

SEQ ID NO: 55682 - DNA, 75 bp, Artificial Sequence
  Synthetic
aaatggggtagttaccaaatcaggtgattacgtcagtgccataacacaagctgaaagaattggtgagccagatta

SEQ ID NO: 55683 - DNA, 75 bp, Artificial Sequence
  Synthetic
gcccgaagccaggaggaagctgtactcctggtggaaggactagaggttagaggagacccccccaacacaaaaaca

SEQ ID NO: 55684 - DNA, 75 bp, Artificial Sequence
  Synthetic
atccccatggtcacacaaatagccatgactgacaccacaccctttggacaacagagggtgtttaaagagaaagtt

SEQ ID NO: 55685 - DNA, 75 bp, Artificial Sequence
  Synthetic
acggattttgggttttaccaagtaaaaacagaaaccaccatcctcgatgtggacttgagaccagcttcagcatgg

SEQ ID NO: 55686 - DNA, 75 bp, Artificial Sequence
  Synthetic
tgtgagacatgtgtgtacaacatgatgggaaaaagagagaagaagttaggggaattcggcaaggcaaaaggcagc

SEQ ID NO: 55687 - DNA, 75 bp, Artificial Sequence
  Synthetic
cgacctctcaaaaaacaacatggcttccggtgctgttaggatcttttggatgcaaaccactaaccatgtttctta

SEQ ID NO: 55688 - DNA, 75 bp, Artificial Sequence
  Synthetic
ttgagcagaaaaacctttgacacagagtatccaaaaacgaaactcacggactgggattttgtggttaccacagac

SEQ ID NO: 55689 - DNA, 75 bp, Artificial Sequence
  Synthetic
aaattggatacagaaagagacattggtcactttcaaaaatccccatgcgaagaaacaggatgtcgttgttttagg

SEQ ID NO: 55690 - DNA, 75 bp, Artificial Sequence
  Synthetic
tgatgtgccactagctggcccactaatagctggaggcatgctaatagcatgttatgtcatatccggaagctcagc

SEQ ID NO: 55691 - DNA, 75 bp, Artificial Sequence
  Synthetic
gatcttgagacatccaggctttaccataatggcagcaatcctggcatacaccataggaacgacacatttccaaag

SEQ ID NO: 55692 - DNA, 75 bp, Artificial Sequence
  Synthetic
agtcttgctcattccagaaccagaaaagcagaggacaccccaggataatcaattgacttatgtcatcatagccat

SEQ ID NO: 55693 - DNA, 75 bp, Artificial Sequence
  Synthetic
attatttcgcagactaacatccagagaagttcttcttctaacaattggattgagcctagtggcatctgtggagtt

SEQ ID NO: 55694 - DNA, 75 bp, Artificial Sequence
  Synthetic
ccatgcagaaaccaagatgaactgattggcagagcccgaatttcccagggagccgggtggtctttgaaggagacg

SEQ ID NO: 55695 - DNA, 75 bp, Artificial Sequence
  Synthetic
agttttccaagacggcgtgttccacacaatgtggcacgtcaccaggggagctgtccttatgtaccaagggaagag

SEQ ID NO: 55696 - DNA, 75 bp, Artificial Sequence
  Synthetic
tgtctggctatcctacaaagttgcctcagaaggcttccagtactccgacagaaggtggtgctttgatggggaaag

SEQ ID NO: 55697 - DNA, 75 bp, Artificial Sequence
  Synthetic
accgacaccagaattggaagaagagatgttcaaaaagcgaaatctaaccataatggatcttcatcctgggtcagg

SEQ ID NO: 55698 - DNA, 75 bp, Artificial Sequence
  Synthetic
gcaaacaggaatccagcgaactgttttctttgtcctgatgatgctagtcgccccatcctacggaatgcgatgcgt

SEQ ID NO: 55699 - DNA, 75 bp, Artificial Sequence
  Synthetic
tggcgttccttcgtttcctaacaatcccaccaacagcagggatactaaaaagatggggaacaatcaaaaaatcaa

SEQ ID NO: 55700 - DNA, 75 bp, Artificial Sequence
  Synthetic
actaccataggaattgtactcctctcccaaagcactataccagagaccgttcttgaattgactgatgcgttagcc

SEQ ID NO: 55701 - DNA, 75 bp, Artificial Sequence
  Synthetic
caacacgccctgaacgaactcccagagtcactagaaacactcatgcttgtagctttactaggagccatgacagca

SEQ ID NO: 55702 - DNA, 75 bp, Artificial Sequence
  Synthetic
aacattgttgtgcttgattcccaccgtaatggcgtttcacttgtcaacaagagatggcgaacccctcatgatagt

SEQ ID NO: 55703 - DNA, 75 bp, Artificial Sequence
  Synthetic
ggcatcttcttgttcttcatgcaaggaaaaggaatagggaaattgtcaatgggtttgatagccattgcggtagct

SEQ ID NO: 55704 - DNA, 75 bp, Artificial Sequence
  Synthetic
ggaaccccattggatagcggcctctatcatactggagttctttctgatggtgttgcttattccagagccggacag

SEQ ID NO: 55705 - DNA, 75 bp, Artificial Sequence
  Synthetic
tacaccattgtgataacacctcactcaggggaagagaatgcagtcggaaatgacacaggaaaacacggcaaggaa

SEQ ID NO: 55706 - DNA, 75 bp, Artificial Sequence
  Synthetic
actggcaacataggagaaacgctaggagagaaatggaaaagcagactgaacgcattggggaaaagtgaattccag

SEQ ID NO: 55707 - DNA, 75 bp, Artificial Sequence
  Synthetic
tattcatgatattgacagtggcagccaatgagatgggattactggaaaccacaaagaaggacctggggattggtc

SEQ ID NO: 55708 - DNA, 75 bp, Artificial Sequence
  Synthetic
aggtccggaattgattttaatgagatgatcctgatgaaaatgaaaaagaaaacgtggcttgtgcataagcaatgg

SEQ ID NO: 55709 - DNA, 75 bp, Artificial Sequence
  Synthetic
gcaatgggatgctattcccaagtgaacccaacgactttaacagcatccttagtcatgcttctagtccattatgca

SEQ ID NO: 55710 - DNA, 75 bp, Artificial Sequence
  Synthetic
aacacaacggcaaatatttccctgacagctattgcaaaccaggcagctatattgatgggacttgacaagggatgg

SEQ ID NO: 55711 - DNA, 75 bp, Artificial Sequence
  Synthetic
gtgagcaagaaagaaggaggagcaatgtacgccgacgacacagcaggatgggatacaagaatcacactagaggac

SEQ ID NO: 55712 - DNA, 75 bp, Artificial Sequence
  Synthetic
actgcaagcaaaagctactagagaagctcaaaaaaggacagcagccggaataatgaaaaacccaactgtcgacgg

SEQ ID NO: 55713 - DNA, 75 bp, Artificial Sequence
  Synthetic
taatagtatcaggaatctttccatactccatacccgcaacattgttggtctggcatacttggcaaaagcaaaccc

SEQ ID NO: 55714 - DNA, 75 bp, Artificial Sequence
  Synthetic
aaatgacattgccaactgtttaagaaagaacgggaaacgggtgatccaattgagcagaaaaacctttgacactga

SEQ ID NO: 55715 - DNA, 75 bp, Artificial Sequence
  Synthetic
gtggtttacgatgcaaaatttgaaaaacagctaggccaaataatgttgttgatactttgcacatcacagatcctc

SEQ ID NO: 55716 - DNA, 75 bp, Artificial Sequence
  Synthetic
gagttccacctctaccactttttatttttagcttgaaagacacactcaaaaggagaagctggccactgaatgaag

SEQ ID NO: 55717 - DNA, 75 bp, Artificial Sequence
  Synthetic
agtcaacccaattgtcacagaaaaagacagcccagtcaacatagaagcagaacctccattcggagacagctacat

SEQ ID NO: 55718 - DNA, 75 bp, Artificial Sequence
  Synthetic
acatgggcttaccatggcagctatgaaacaaaacagactggatcagcatcatccatggtgaacggagtagtcaga

SEQ ID NO: 55719 - DNA, 75 bp, Artificial Sequence
  Synthetic
gacacacaaggatcaaattggatacagaaagagacattggtcactttcaaaaatccccacgcgaagaaacaggat

SEQ ID NO: 55720 - DNA, 75 bp, Artificial Sequence
  Synthetic
gacagcccagtcaacatagaagcagaacctccattcggagacagctacatcattataggagtagaaccgggacaa

SEQ ID NO: 55721 - DNA, 75 bp, Artificial Sequence
  Synthetic
cgatagcggtgtccatggcaaacatttttaggggaagttatctagcaggagcaggtctggccttttcattaatga

SEQ ID NO: 55722 - DNA, 75 bp, Artificial Sequence
  Synthetic
tggaacttcaggatctcctatcataaacagagagggaaaggtagtgggactgtatggcaatggagtggttacaaa

SEQ ID NO: 55723 - DNA, 75 bp, Artificial Sequence
  Synthetic
cccagagacacagaaagcagaactggaagaaggggtctataggatcaaacagcaaggaatttttgggaaaaccca

SEQ ID NO: 55724 - DNA, 75 bp, Artificial Sequence
  Synthetic
ccacctgagaaatgtgacacccttctgtgtgatattggtgagtcctctccgaatccaactatagaagaaggaaga

SEQ ID NO: 55725 - DNA, 75 bp, Artificial Sequence
  Synthetic
ggaggagcaatgtatgccgatgacaccgcaggctgggacacaagaatcacaatagaggatttaaaaaatgaagaa

SEQ ID NO: 55726 - DNA, 75 bp, Artificial Sequence
  Synthetic
attctttgagggagctaagctcaacgtagttctaacagtttttaattagagagcagatctctgatgaataaccaa

SEQ ID NO: 55727 - DNA, 75 bp, Artificial Sequence
  Synthetic
gactccagcgattgcaagaagagcacaaagaaacctggcactatgatcaggaaaatccatacagaacctgggcgt

SEQ ID NO: 55728 - DNA, 75 bp, Artificial Sequence
  Synthetic
tccgaacaaggaggaaaagcctatagacatgctatggaagaactaccagacaccatagaaacattgatgctccta

SEQ ID NO: 55729 - DNA, 75 bp, Artificial Sequence
  Synthetic
accccttttgggcaacagagagtgttcaaagagaaagttgacaccagaacaccacagccaaaacccggtacacga

SEQ ID NO: 55730 - DNA, 75 bp, Artificial Sequence
  Synthetic
atcttgagggagctaagctcaacgtagtctaacagttttaattagagagcagatctctgatgaataaccaacgaa

SEQ ID NO: 55731 - DNA, 75 bp, Artificial Sequence
  Synthetic
caatggctcacaggaagccaacatatgaaagagacgtggacttaggcgctggaacaagacatgtggcagtagaac

SEQ ID NO: 55732 - DNA, 75 bp, Artificial Sequence
  Synthetic
gcataacaataaacagcatattgacgctgggagagaccagagatcctgctgtctctacagcatcattccaggcaa

SEQ ID NO: 55733 - DNA, 75 bp, Artificial Sequence
  Synthetic
gaacacaagtcaacatggcattatgatgaggacaatccatacaaaacatgggcctatcatggatcatatgaggtc

SEQ ID NO: 55734 - DNA, 75 bp, Artificial Sequence
  Synthetic
aggatgtattttgtgactcaaaactcatgtcagcggccataaaagacaacagagccgtccatgccgatatgggtt

SEQ ID NO: 55735 - DNA, 75 bp, Artificial Sequence
  Synthetic
ttacatgccaactgtgattgagcacctagaaagactacaaaggaaacatggaggaatgcttgtgagaaacccact

SEQ ID NO: 55736 - DNA, 75 bp, Artificial Sequence
  Synthetic
agagccgtccatgccgatatgggttattggatagaaagcgcactcaatgacacatggaagatagagaaagcctct

SEQ ID NO: 55737 - DNA, 75 bp, Artificial Sequence
  Synthetic
ggagcaatggagtattagaaagtgagatgataatcccaaaaaattttgccgggccagtgtcacaacacaactaca

SEQ ID NO: 55738 - DNA, 75 bp, Artificial Sequence
  Synthetic
ggacacaagaatcactgaagatgaccttctgaatgaagagctgatcacggaacagatggcccctcatcataagat

SEQ ID NO: 55739 - DNA, 75 bp, Artificial Sequence
  Synthetic
tctagaaacaaaaaacccagaatctgcacaagagaggagttcacaagaaaagtcaggtcaaacgcagctattgga

SEQ ID NO: 55740 - DNA, 75 bp, Artificial Sequence
  Synthetic
catatgtggtgataggtttgttattcatgatactgacagtagcagccaatgagatgggactactggaaaccacaa

SEQ ID NO: 55741 - DNA, 75 bp, Artificial Sequence
  Synthetic
gaggaatacacagattacatgccatccatgaaaagattcagaagagaagaggaagaggcaggagttttgtggtag

SEQ ID NO: 55742 - DNA, 75 bp, Artificial Sequence
  Synthetic
gtggttgggagcgcgctttttagagtttgaagcccttggtttcatgaatgaagatcactggttcagcagagagaa

SEQ ID NO: 55743 - DNA, 75 bp, Artificial Sequence
  Synthetic
cgaacatttttagagggagctatttagcaggagctgggcttgctttttctattatgaaatcagttggaacaggaa

SEQ ID NO: 55744 - DNA, 75 bp, Artificial Sequence
  Synthetic
gactcaaaactcatgtcagcggccataaaagacaacagagccgtccatgccgatatgggttattggatagaaagt

SEQ ID NO: 55745 - DNA, 75 bp, Artificial Sequence
  Synthetic
ctagaggttagaggagacccccccaaaacaaaaaacagcatattgacgctgggaaagaccagagatcctgctgtc

SEQ ID NO: 55746 - DNA, 75 bp, Artificial Sequence
  Synthetic
ggagaaaaatggaaaagacagctaaaccaactgagcaagtcagaattcaacacttacaaaaggagtgggattatg

SEQ ID NO: 55747 - DNA, 75 bp, Artificial Sequence
  Synthetic
ggctgaagaaggtcacagaagtgaagggatacacaaaaggaggacctggacatgaggaacctatcccaatggcaa

SEQ ID NO: 55748 - DNA, 75 bp, Artificial Sequence
  Synthetic
tgggaatgggcgttacctacctagctttaattgcaacattcaaaatccagccattcttggctttgggatttttcc

SEQ ID NO: 55749 - DNA, 75 bp, Artificial Sequence
  Synthetic
agcaacatcctggacatagatctacgtcctgcatcagcatggacgctgtatgccgtggctacaacatttatcaca

SEQ ID NO: 55750 - DNA, 75 bp, Artificial Sequence
  Synthetic
cttgagatggactttgatttttgcgaaggaactacagtggtggtgactgaggactgtggaaatagaggaccctct

SEQ ID NO: 55751 - DNA, 75 bp, Artificial Sequence
  Synthetic
tcttgcgcaaactgtgcattgaagctaaaatatcaaacaccaccaccgactcaagatgtccaacacaaggagagg

SEQ ID NO: 55752 - DNA, 75 bp, Artificial Sequence
  Synthetic
atggatgacaacagaagacatgttgtcagtgtggaatagggtttggatagaggaaaacccatggatggaggacaa

SEQ ID NO: 55753 - DNA, 75 bp, Artificial Sequence
  Synthetic
gacaaggacagttccaaatggaaggctcgccctacacagttttaccagtttgtttagaaaaaaagcagattttgg

SEQ ID NO: 55754 - DNA, 75 bp, Artificial Sequence
  Synthetic
tgtggaagtggcatttttgtcaccaatgaagtccacacttggacagagcaatacaaatttcaagctgactcccca

SEQ ID NO: 55755 - DNA, 75 bp, Artificial Sequence
  Synthetic
atcaatacacccgaaggaatcattcctagtatgttcgaaccagagcgtgaaaaagtggatgccattgatggtgaa

SEQ ID NO: 55756 - DNA, 75 bp, Artificial Sequence
  Synthetic
tgtttagaaaaaaagcagattttgggaaaaatgaaccgacacgaaaaaggtgtcagaccacctttcaatatgctg

SEQ ID NO: 55757 - DNA, 75 bp, Artificial Sequence
  Synthetic
atggccattctaggtgaaacagcttgggattttggttccgttggtggactgttcacatcattgggaaaggctgta

SEQ ID NO: 55758 - DNA, 75 bp, Artificial Sequence
  Synthetic
tgtcagaccacctttcaatatgctgaaacgcgagagaaaccgcgtatccaccccttcaagggtggtgaagagatt

SEQ ID NO: 55759 - DNA, 75 bp, Artificial Sequence
  Synthetic
agccaagtggttatggggtttcctttctagaaacaaaaaacccagaatctgcacaagagaggagttcacaagaaa

SEQ ID NO: 55760 - DNA, 75 bp, Artificial Sequence
  Synthetic
ttttgcataaaggttctcaacccatatatgccttcagttatagaaaaaatggaagcgctacaaaggaaatatgga

SEQ ID NO: 55761 - DNA, 75 bp, Artificial Sequence
  Synthetic
tattggtagcacattatgccattatagggccaggacttcaagcaaaagcaaccagagaagcccagaaaagagcag

SEQ ID NO: 55762 - DNA, 75 bp, Artificial Sequence
  Synthetic
caaacagcatattgacgctgggagagaccagagatcctgctgtctctacagcatcattccaggcacagaacgcca

SEQ ID NO: 55763 - DNA, 75 bp, Artificial Sequence
  Synthetic
tggtgcaactccacgtccacgtgggtaacctatgggacttgtaccaccacgggagaacatagaagagaaaaaaga

SEQ ID NO: 55764 - DNA, 75 bp, Artificial Sequence
  Synthetic
ctgaagacattgactgctggtgcaatctcacgtccacctgggtcatgtatgggacatgtacccagagcggagaac

SEQ ID NO: 55765 - DNA, 75 bp, Artificial Sequence
  Synthetic
aatcactgacatcatggagcctgaacatgctctattggctacgtcaatctttaagctgacctaccaaaataaggt

SEQ ID NO: 55766 - DNA, 75 bp, Artificial Sequence
  Synthetic
aatccaagagccgtccaaacgaaacctggacttttcaaaaccaacaccggaaccataggcgccgtatctctggac

SEQ ID NO: 55767 - DNA, 75 bp, Artificial Sequence
  Synthetic
gtaaggactagaggttagaggagaccccccgcataacaataaacagcatattgacgctgggaaagaccagagatc

SEQ ID NO: 55768 - DNA, 75 bp, Artificial Sequence
  Synthetic
acatgtcctttagagacctgggaagagtgatggttatggtgggcgctaccatgacggatgacataggtatgggag

SEQ ID NO: 55769 - DNA, 75 bp, Artificial Sequence
  Synthetic
agagtgccaaattacaacctgatcatcatggacgaagcccacttcacagacccagcaagtatagcagctagagga

SEQ ID NO: 55770 - DNA, 75 bp, Artificial Sequence
  Synthetic
aaggatggccactccacagaatggacctcggtgtgccgctgttagcaatgggatgttattctcaagtgaacccaa

SEQ ID NO: 55771 - DNA, 75 bp, Artificial Sequence
  Synthetic
agaaggggaaaggaagaaattaaaacccagatggttggatgctaggatctactctgacccactggcactgaaaga

SEQ ID NO: 55772 - DNA, 75 bp, Artificial Sequence
  Synthetic
ctcagagcaatgcaccaatcatggatgaagaaagagaaatccctgaacgttcatggaattctggacatgagtggg

SEQ ID NO: 55773 - DNA, 75 bp, Artificial Sequence
  Synthetic
taaatgaggctatcatggctgtcgggatggtgagcattttagccagttctctcttaaagaatgacattcccatga

SEQ ID NO: 55774 - DNA, 75 bp, Artificial Sequence
  Synthetic
ccaagagacaggatgtgacagtgctagggtctcaggaaggagctatgcattctgccctcaccggagctacagaag

SEQ ID NO: 55775 - DNA, 75 bp, Artificial Sequence
  Synthetic
catcgtggggatgtagctccatcgtggggatgtagctccatcgtggggatgtagctccatccccacgatggagct

SEQ ID NO: 55776 - DNA, 75 bp, Artificial Sequence
  Synthetic
ttcggcctgacttcattttacgtccttagacgggctcacaggcagcatagctcttaccgtactatggcttaatcc

SEQ ID NO: 55777 - DNA, 75 bp, Artificial Sequence
  Synthetic
aggcatacttacattggctgcaataatagcagccaatgaaatgggattgttggaaactacaaagagagatttagg

SEQ ID NO: 55778 - DNA, 75 bp, Artificial Sequence
  Synthetic
acgaggaggagagccacacatgatagttagcaagcaggaaagaggaaagtcactcttgttcaagacctctgcagg

SEQ ID NO: 55779 - DNA, 75 bp, Artificial Sequence
  Synthetic
aatgtgtcatgccacatttaccatgaggctgttatcaccagtcagagtgccaaattacaacctgatcatcatgga

SEQ ID NO: 55780 - DNA, 75 bp, Artificial Sequence
  Synthetic
gcaggcaggaaaacgatctctgcggcctcagcccactgagctaaagtattcatggaaaacatggggtaaagcaaa

SEQ ID NO: 55781 - DNA, 75 bp, Artificial Sequence
  Synthetic
aggaaatgacattgctaactgtttaagaaagaacggaaaacgggtaatccaattgagcagaaaaacctttgacac

SEQ ID NO: 55782 - DNA, 75 bp, Artificial Sequence
  Synthetic
aacagtctggtttgttccaagcatcaaatcaggaaatgacattgccaactgtttaagaaagaacgggaaacgggt

SEQ ID NO: 55783 - DNA, 75 bp, Artificial Sequence
  Synthetic
aaacactttcaccaacatggaagcccagctgataagacaaatggagtctgagggaatcttttcacccagcgaatt

SEQ ID NO: 55784 - DNA, 75 bp, Artificial Sequence
  Synthetic
cagctgataagacaaatggagtctgagggaatcttttcacccagcgaattagagaccccaaatttagccgagaga

SEQ ID NO: 55785 - DNA, 75 bp, Artificial Sequence
  Synthetic
cagaccattgaaagagaaagaagagaacttggtcaactccttggtcacagccggacatggacagattgacaactt

SEQ ID NO: 55786 - DNA, 75 bp, Artificial Sequence
  Synthetic
tggctatcttgtgcgtcccaaatgcagtgatattacaaaacgcatggaaagtgagctgcacaacattggcagtgg

SEQ ID NO: 55787 - DNA, 75 bp, Artificial Sequence
  Synthetic
cacgcagtggtgctgccgctcctgcacgatgcctcccttaaggtttttgggagaggatgggtgttggtatgggat

SEQ ID NO: 55788 - DNA, 75 bp, Artificial Sequence
  Synthetic
gaattcactcagtggagtggaaggagaaggactccacaaacttggatacatactcagagacatatcaaagattcc

SEQ ID NO: 55789 - DNA, 75 bp, Artificial Sequence
  Synthetic
catgatattggttgtggtgaccaccctttgtgccatcatcctaggaggtctcacatggatggacttactacgagc

SEQ ID NO: 55790 - DNA, 75 bp, Artificial Sequence
  Synthetic
tgcagccggaagaaagtctctgaccctgaacctaatcacagaaatgggtaggcttccaacattcatgactcagaa

SEQ ID NO: 55791 - DNA, 75 bp, Artificial Sequence
  Synthetic
ttgacgctgggagagaccagagatcctgctgtctcctcagcatcattccaggcacagaacgccagaaaatggaat

SEQ ID NO: 55792 - DNA, 75 bp, Artificial Sequence
  Synthetic
cggattttaaagggaagactgtttggtttgttccaagtataaaagcaggaaatgatatagcagcttgcctgagga

SEQ ID NO: 55793 - DNA, 75 bp, Artificial Sequence
  Synthetic
ctaggaagtggaacccgcaacattggaattgaaagtgagataccaaatctagacataataggaaagagaatagag

SEQ ID NO: 55794 - DNA, 75 bp, Artificial Sequence
  Synthetic
ctcttcttgaacgacatgggaaaggtgaggaaagacatcccgcagtgggaaccatccaagggatggaaaaactgg

SEQ ID NO: 55795 - DNA, 75 bp, Artificial Sequence
  Synthetic
acagccatttttctaacaaccctctcaagaaccaacaagaaaaggagctggccactaaatgaggctatcatggca

SEQ ID NO: 55796 - DNA, 75 bp, Artificial Sequence
  Synthetic
tgggaaatgaaagcacagaacatgggacaactgcaactataacacctcaagctcccacgacggaaatacagctga

SEQ ID NO: 55797 - DNA, 75 bp, Artificial Sequence
  Synthetic
agaaggcacgaagaaactaatgaaaatcacggcagaatggctctggaaagaactaggaaagaaaaagacacctag

SEQ ID NO: 55798 - DNA, 75 bp, Artificial Sequence
  Synthetic
atggtacatgtggcttggagcacgcttcttagagtttgaagccctaggattcttgaatgaagatcactggttctc

SEQ ID NO: 55799 - DNA, 75 bp, Artificial Sequence
  Synthetic
aggtagagacatgggctcttaggcacccagggttcaccatactagctctatttcttgcccattacataggcactt

SEQ ID NO: 55800 - DNA, 75 bp, Artificial Sequence
  Synthetic
aactaataagacaaatggagtctgaaggaatctttttacccagcgaattggaaacccccaatctagctgagagag

SEQ ID NO: 55801 - DNA, 75 bp, Artificial Sequence
  Synthetic
ccatcatggacctccacccaggagcgggaaagacgaaaagataccttccggccatagtcagagaagctataaaac

SEQ ID NO: 55802 - DNA, 75 bp, Artificial Sequence
  Synthetic
acccccccgaaataaaaaacagcatattgacgctgggaaagaccagagatcctgctgtctcctcagcatcattcc

SEQ ID NO: 55803 - DNA, 75 bp, Artificial Sequence
  Synthetic
gagtacaaaggggaagatgcaccttgcaagattcctttctccacagaggatggacaagggaaagctcacaatggc

SEQ ID NO: 55804 - DNA, 75 bp, Artificial Sequence
  Synthetic
ttcagcggtgtttcttggaccatgaaaataggaatagggattctgctgacatggctgggattaaattcaaggagc

SEQ ID NO: 55805 - DNA, 75 bp, Artificial Sequence
  Synthetic
agaagaaaaatcccagactgtgcacaagggaagagttcatctcaaaagttagatcaaatgcagccataggcgcag

SEQ ID NO: 55806 - DNA, 75 bp, Artificial Sequence
  Synthetic
aacacacaggaagagaaattgtggacctcatgtgccatgcaaccttcacagcaaatcctttgtcatcaactagag

SEQ ID NO: 55807 - DNA, 75 bp, Artificial Sequence
  Synthetic
tgtaccaccacaggagaacacagaagagaaaaaagatcagtggcacttgttccacatgtgggtatgggactggag

SEQ ID NO: 55808 - DNA, 75 bp, Artificial Sequence
  Synthetic
tctattgtcgcggccagaggatacatctcaaccagggtggaaatgggagaggcggcagctatctttatgactgcc

SEQ ID NO: 55809 - DNA, 75 bp, Artificial Sequence
  Synthetic
catcacattgggttccaacaagtcgaacaacctggtccatacacgccagacatgagtggatgacaacggaagaca

SEQ ID NO: 55810 - DNA, 75 bp, Artificial Sequence
  Synthetic
gataaccctcttggtgaaactggcgctgataacagtatcaggtctctaccccttggcaattccagtcacaatggc

SEQ ID NO: 55811 - DNA, 75 bp, Artificial Sequence
  Synthetic
aggttagaggagaccccccgcaaataaaaacagcatatgacgcgggagagagaccagagttcctgctgtctcctc

SEQ ID NO: 55812 - DNA, 75 bp, Artificial Sequence
  Synthetic
acagagtacccaaaaacgaaactcacagactgggattttgtggtcaccacagacatatctgaaatgggggccaac

SEQ ID NO: 55813 - DNA, 75 bp, Artificial Sequence
  Synthetic
ccaggcacagaacgccagaaaatggaatggtgctgttgaatcaccaggctctggtcaactttttgatacgggaac

SEQ ID NO: 55814 - DNA, 75 bp, Artificial Sequence
  Synthetic
ccatcttgaaggaaagtgtgaaacatgtgtgtacaacatgatgggaaagagagaaaagaaactaggggagttcgg

SEQ ID NO: 55815 - DNA, 75 bp, Artificial Sequence
  Synthetic
aaaagctaaaatcataggagcagacatacaaaataccaccttcatcatcgacggcccagacaccccagaatgtcc

SEQ ID NO: 55816 - DNA, 75 bp, Artificial Sequence
  Synthetic
gaagagtgatggttatggtgggcgctaccatgacggatgacataggtatgggagtgacttaccttgccctattag

SEQ ID NO: 55817 - DNA, 75 bp, Artificial Sequence
  Synthetic
gacagccaggtggttatggggttttctttccagaaacaaaaaaccaagaatttgtacaagagaggagttcacaag

SEQ ID NO: 55818 - DNA, 75 bp, Artificial Sequence
  Synthetic
ttatcccggaaagagtttgacctttacaagaaatctggaattactgaagtggatagaacagaagccaaagaaggg

SEQ ID NO: 55819 - DNA, 75 bp, Artificial Sequence
  Synthetic
gcgtctcttatccccagtgagagttcccaattacaacatgattatcatggatgaagcacattttaccgatccagc

SEQ ID NO: 55820 - DNA, 75 bp, Artificial Sequence
  Synthetic
catggcgtcgaaaggttgaaaagaatggcaatcagcggagatgactgtgtggtgaaaccaactgatgacaggttc

SEQ ID NO: 55821 - DNA, 75 bp, Artificial Sequence
  Synthetic
acctggccttttcaagaccctaactggagaaattggagcagtaacattagatttcaaacccggaacgtctggttc

SEQ ID NO: 55822 - DNA, 75 bp, Artificial Sequence
  Synthetic
aatcttcttattcttaatgagcggaaaaggtatagggaagatgaccctgggaatgtgttgcataatcacggctag

SEQ ID NO: 55823 - DNA, 75 bp, Artificial Sequence
  Synthetic
cgtagttctaacagttttttaattagagagcagatctctgatgaataaccaacggaaaaaggcgagaagtacgcc

SEQ ID NO: 55824 - DNA, 75 bp, Artificial Sequence
  Synthetic
acaacagaaacaccaacctggaacaagaaagagcttcttgtgacattcaaaaacgcacacgcaaaaaaacaagaa

SEQ ID NO: 55825 - DNA, 75 bp, Artificial Sequence
  Synthetic
gcattattcctggaagaaatgctcaggacacgagtaggaacgaaacatgcaatactactagttacagtttctttt

SEQ ID NO: 55826 - DNA, 75 bp, Artificial Sequence
  Synthetic
agatgggaagatcaggcagagatatcaggaagcagtccaattctgtcaataacaatatcggaagatggcagcatg

SEQ ID NO: 55827 - DNA, 75 bp, Artificial Sequence
  Synthetic
cttccgagagtgaaggagttctgtaattattaacagcaaacaccaaagagacattgaagtcaggccacttgtgcc

SEQ ID NO: 55828 - DNA, 75 bp, Artificial Sequence
  Synthetic
tggaacactaccattgcagtgtcaatggctaacatctttagagggagttacttggctggagctggacttctcttt

SEQ ID NO: 55829 - DNA, 75 bp, Artificial Sequence
  Synthetic
atagctggaggcatgctaatagcatgttatgtcatatccggaagctcagccgatttatcattggagaaagcggct

SEQ ID NO: 55830 - DNA, 75 bp, Artificial Sequence
  Synthetic
agcctgtagctccacctgagaaggtgtaaaaaatctgggaggccacaaaccatggaagctgtacgcatggcgtag

SEQ ID NO: 55831 - DNA, 75 bp, Artificial Sequence
  Synthetic
cccactagagttgtggcagctgaaatggaggaagctcttagaggacttccaataagataccaaaccccagccatc

SEQ ID NO: 55832 - DNA, 75 bp, Artificial Sequence
  Synthetic
gccatgtccacagggtccatcaagatcagagggattgatgaaagagggatggtaaaacccaaaggaaaagttgtg

SEQ ID NO: 55833 - DNA, 75 bp, Artificial Sequence
  Synthetic
acacatgagatgtactgggtatccaatgcttccgggaacatagtgtcatcagtgaacatgatttcaaggatgttg

SEQ ID NO: 55834 - DNA, 75 bp, Artificial Sequence
  Synthetic
ggtgtcaggtgtgtcgggaaacatcgtgagctctgtgaacacaacatcaaagatgttgttaaacaggtttaccac

SEQ ID NO: 55835 - DNA, 75 bp, Artificial Sequence
  Synthetic
aaggcacagaaaacctacttatgagaaggatgtagaccttggagcagggacgagaagtgtctccattgagacaga

SEQ ID NO: 55836 - DNA, 75 bp, Artificial Sequence
  Synthetic
aaggatgtagaccttggagcagggacgagaagtgtctccattgagacagaaaaaccagacatgacgattattggg

SEQ ID NO: 55837 - DNA, 75 bp, Artificial Sequence
  Synthetic
gtgaggacactgtcacgtataaatgccccctactggtcaataccgaacctgaagacattgattgctggtgcaacc

SEQ ID NO: 55838 - DNA, 75 bp, Artificial Sequence
  Synthetic
ccatggaccttggtgaactgtgtgaagacacaatcacttataattgtcctcttctcaggcagaatgaaccagaag

SEQ ID NO: 55839 - DNA, 75 bp, Artificial Sequence
  Synthetic
agacacaatcacttataattgtcctcttctcaggcagaatgaaccagaagacatagactgttggtgcaactccac

SEQ ID NO: 55840 - DNA, 75 bp, Artificial Sequence
  Synthetic
aaaagaatggcaatcagcggagatgactgcgtagtgaaaccaattgatgataggtttgcaacagccttaacagct

SEQ ID NO: 55841 - DNA, 75 bp, Artificial Sequence
  Synthetic
taaggaagttatgcattgagggaaaaattaccaacataacaaccgactcaaggtgtcccacccagggggaagcga

SEQ ID NO: 55842 - DNA, 75 bp, Artificial Sequence
  Synthetic
aataagaaagagcttcttgtgacattcaaaaacgcacatgcaaaaaaacaagaagtagtagtccttggatcgcaa

SEQ ID NO: 55843 - DNA, 75 bp, Artificial Sequence
  Synthetic
cacaaccccttttgggcaacagagagagttcaaagagaaggtgtatacctctacaccccaccccaaaccttggac

SEQ ID NO: 55844 - DNA, 75 bp, Artificial Sequence
  Synthetic
gagaattgaaacttggatcttgagacatccaggcttcaccataatggcagcaatcctggcatacaccataggaac

SEQ ID NO: 55845 - DNA, 75 bp, Artificial Sequence
  Synthetic
taaaaacagaagccaaacatcccgccactctaaggaagtattgtatagaggcaaagctgaccaacacaacaacag

SEQ ID NO: 55846 - DNA, 75 bp, Artificial Sequence
  Synthetic
tcaacattgaggcagaacctccttttggggaaagtaatatagtaattggaattggagacaaagccttgaaaatca

SEQ ID NO: 55847 - DNA, 75 bp, Artificial Sequence
  Synthetic
ctcgctgcccaacacaaggagaacctagcctaaacgaagaacaggacaaaagattcgtctgcaaacactccatgg

SEQ ID NO: 55848 - DNA, 75 bp, Artificial Sequence
  Synthetic
aagagaatgcagtcggaaatgacacaggaaaacatggcaaggaaattaaagtaacaccacagagttccatcacag

SEQ ID NO: 55849 - DNA, 75 bp, Artificial Sequence
  Synthetic
ccacagacgtgacctcaggctggcggcaaacgccatttgctcggcagtcccgtcacattgggttccaacaagtcg

SEQ ID NO: 55850 - DNA, 75 bp, Artificial Sequence
  Synthetic
tcctcagatttctagccattccaccgacagcgggaatcttggctagatggggaaccttcaagaagtcgggggcta

SEQ ID NO: 55851 - DNA, 75 bp, Artificial Sequence
  Synthetic
aacagaaaacaaaatctggggaaggaaaagttggcccctcaatgaaggaattatggctattggaatagttagcat

SEQ ID NO: 55852 - DNA, 75 bp, Artificial Sequence
  Synthetic
cccaattgtcacagaaaaagacagcccagtcaacatagaagcagaacctccatttggagacagttacatcattat

SEQ ID NO: 55853 - DNA, 75 bp, Artificial Sequence
  Synthetic
gacgtgggtgacctacggaacgtgcaaccaagctggagagcatagacgcgataagagatcggtggcgttagctcc

SEQ ID NO: 55854 - DNA, 75 bp, Artificial Sequence
  Synthetic
tcagtgagaaagaagagaacatggtaaagtctttagtctcagcagggagtggaaaggtggacaacttcacaatgg

SEQ ID NO: 55855 - DNA, 75 bp, Artificial Sequence
  Synthetic
agttccattggcaagatgtttgagtccacatacagaggtgcaaaacgaatggccattctaggtgaaacagcttgg

SEQ ID NO: 55856 - DNA, 75 bp, Artificial Sequence
  Synthetic
atcacattctatcagaaaatgaggtaaagttgactatcatgacaggagacattaaaggaatcatgcaggcaggaa

SEQ ID NO: 55857 - DNA, 75 bp, Artificial Sequence
  Synthetic
aacactccattggttcaggaaagggagttccattggcaagatgtttgagtccacatacagaggtgcaaaacgaat

SEQ ID NO: 55858 - DNA, 75 bp, Artificial Sequence
  Synthetic
tgggaaaggatggccattgtcaaaaatggacattggagttccccttctcgccatcgggtgctattcacaagtcaa

SEQ ID NO: 55859 - DNA, 75 bp, Artificial Sequence
  Synthetic
aagcattgcaacccaggaacctgagagcaacatcctggacatagatctacgtcctgcgtcagcatggacgctgta

SEQ ID NO: 55860 - DNA, 75 bp, Artificial Sequence
  Synthetic
atgtggtagacagagggtggggcaatggctgtggcttgtttggaaaaggaggagttgtgacatgtgcgaagtttt

SEQ ID NO: 55861 - DNA, 75 bp, Artificial Sequence
  Synthetic
gtcattggacaacagaaaaggaaaacctctttcttcaaaacaaagaagggtcacgacatgtgtaccctcatggcc

SEQ ID NO: 55862 - DNA, 75 bp, Artificial Sequence
  Synthetic
cacacttggacagaacagtacaaatttcaaccagagtccccagcgagactagcgtctgcaatattaaatgcccac

SEQ ID NO: 55863 - DNA, 75 bp, Artificial Sequence
  Synthetic
cggattttaaagggaagactgtttggtttgttccaagcataaaagcaggaaatgatatagcagcttgcctgagaa

SEQ ID NO: 55864 - DNA, 75 bp, Artificial Sequence
  Synthetic
acagagggtgttcaaagagaaagttgacacacgcacaccaaaagcaaaacgaggcacagcacaaattatggaggt

SEQ ID NO: 55865 - DNA, 75 bp, Artificial Sequence
  Synthetic
ttaccaccgctaaggtacagaggtgaggatggatgctggtatggaatggaaatcagaccattgaaagagaaagaa

SEQ ID NO: 55866 - DNA, 75 bp, Artificial Sequence
  Synthetic
atgacctcactgtagtggctggggatgtgaagggggtgttgaccaaaggcaagagagcactcacacccccagtga

SEQ ID NO: 55867 - DNA, 75 bp, Artificial Sequence
  Synthetic
gggcgctaccatgacggatgacataggtatgggagtgacttatcttgccctactggcagctttcaaagttagacc

SEQ ID NO: 55868 - DNA, 75 bp, Artificial Sequence
  Synthetic
tactggcagctttcaaagttagaccaacttttgcagctggactactactgagaaagctgacctccaaggaattaa

SEQ ID NO: 55869 - DNA, 75 bp, Artificial Sequence
  Synthetic
cccaacacaaacagagcttggaactcactagaagttgaagactatggctttggagtattcaccactaacatatgg

SEQ ID NO: 55870 - DNA, 75 bp, Artificial Sequence
  Synthetic
gatttggcatgttcacgaccaacatatggatgaaattccgagaaggaagttcagaagtgtgtgaccacaggttaa

SEQ ID NO: 55871 - DNA, 75 bp, Artificial Sequence
  Synthetic
caaaaggaagtcgtgcaatatggtacatgtggctgggagcacgctttctagagttcgaagctcttggtttcatga

SEQ ID NO: 55872 - DNA, 75 bp, Artificial Sequence
  Synthetic
cgtgctgcctgtagctccgtcgtggggacgtaaagcctgggaggctgcaaaccgtggaagctgtacgcacggtgt

SEQ ID NO: 55873 - DNA, 75 bp, Artificial Sequence
  Synthetic
gaagttaaaagctgccactggccaaagtcacacactctctggagtaatggagtgctggaaagtgagatgataatt

SEQ ID NO: 55874 - DNA, 75 bp, Artificial Sequence
  Synthetic
ggaagaacaagacgcgaactttgtgtgtcgacgaacgttcgtggacagaggctggggtaatggctgtggactatt

SEQ ID NO: 55875 - DNA, 75 bp, Artificial Sequence
  Synthetic
ttttcacagcacaattaccgccagggctatgccacgcaaaccgtgggcccatggcacttaggcaaattagagata

SEQ ID NO: 55876 - DNA, 75 bp, Artificial Sequence
  Synthetic
ccataggcgcagtctttcaggaagaacagggatggacatcagccagtgaagctgtgaatgacagccggttttggg

SEQ ID NO: 55877 - DNA, 75 bp, Artificial Sequence
  Synthetic
agtctgtggaatcaggtcaacaaccagaatggagaatctattgtggaagcaaatagctaatgagctgaactacat

SEQ ID NO: 55878 - DNA, 75 bp, Artificial Sequence
  Synthetic
ttgatttctgcgaaggaaccacagtggtggtgactgaggactgtggaaatagaggaccctccttaagaacaacta

SEQ ID NO: 55879 - DNA, 75 bp, Artificial Sequence
  Synthetic
aatgaatagaaggaaaagatctgtgaccatgctccttatgctgatgcccacagccttggcgttccatttgactac

SEQ ID NO: 55880 - DNA, 75 bp, Artificial Sequence
  Synthetic
ggcagcagcatggtacctgtgggaagtgaagaaacaacgggctggagtattgtgggacgtcccttcacccccacc

SEQ ID NO: 55881 - DNA, 75 bp, Artificial Sequence
  Synthetic
ccatcaatgtcttgagagggttcaggaaagagattggaaggatgctgaacatcttgaacaggagacgcagaactg

SEQ ID NO: 55882 - DNA, 75 bp, Artificial Sequence
  Synthetic
agcctggaaagaatccaagagccgtccaaacaaaacccggtctttttaaaactaacactggaaccataggcgccg

SEQ ID NO: 55883 - DNA, 75 bp, Artificial Sequence
  Synthetic
agtgatattgcaaaatgcatggaaagtgagctgcacaacactggcagtggtgtccgtttccccactgcttttaac

SEQ ID NO: 55884 - DNA, 75 bp, Artificial Sequence
  Synthetic
gcccaaggtgagatgaagctgtagtctcactggaaggactagaggttagaggagacccccccaaaacaaaaaaaa

SEQ ID NO: 55885 - DNA, 75 bp, Artificial Sequence
  Synthetic
atggagtgctctccgagaacgggcctcgacttcaatgagatggtgttgctgcagatggaaaacaaagcttggctg

SEQ ID NO: 55886 - DNA, 75 bp, Artificial Sequence
  Synthetic
aacacaacaacagaatctcgttgcccaacacaaggggaacccagtctaaatgaagagcaggacaaaaggttcgtc

SEQ ID NO: 55887 - DNA, 75 bp, Artificial Sequence
  Synthetic
gtggaaggactagaggttagaggagacccccccaacacaaaacagcatattgacgctgggaaagaccagagatcc

SEQ ID NO: 55888 - DNA, 75 bp, Artificial Sequence
  Synthetic
ctcagcagatctgtcactagagaaggccgccaatgtgcagtgggatgaaatggcagacataacaggctcaagccc

SEQ ID NO: 55889 - DNA, 75 bp, Artificial Sequence
  Synthetic
gagtgtggatagaagacaaccccaatatgactgacaagactccagtccattcgtgggaagatataccttacctag

SEQ ID NO: 55890 - DNA, 75 bp, Artificial Sequence
  Synthetic
tggcagacataacaggctcaagcccaatcatagaagtgaagcaggatgaagatggctctttctccatacgggacg

SEQ ID NO: 55891 - DNA, 75 bp, Artificial Sequence
  Synthetic
aatcatagaagtgaagcaggatgaagatggctctttctccatacgggacgtcgaggaaaccaatatgataaccct

SEQ ID NO: 55892 - DNA, 75 bp, Artificial Sequence
  Synthetic
caaagcatggatggtacacagacaatggttttttgacctacctctaccatggacatcaggagctacaacggaaac

SEQ ID NO: 55893 - DNA, 75 bp, Artificial Sequence
  Synthetic
tctggcggcttacgtgatgagtggtagctcagcagatctgtcactagagaaggccgccaatgtgcagtgggatga

SEQ ID NO: 55894 - DNA, 75 bp, Artificial Sequence
  Synthetic
aggctgctatcaccaattagagtgccaaattacaacctgattatcatggatgaagcccatttcacagacccagca

SEQ ID NO: 55895 - DNA, 75 bp, Artificial Sequence
  Synthetic
acctgcacatggccaaaatcacacactctctggagcaatggtgtgttggagagtgacatgatcatcccaaaaagt

SEQ ID NO: 55896 - DNA, 75 bp, Artificial Sequence
  Synthetic
gaggttagaggagactccccgcacaaaaataaacaccttttgacgctgggaggaaccggagatctgctgtcccta

SEQ ID NO: 55897 - DNA, 75 bp, Artificial Sequence
  Synthetic
ttacggattttaaagggaagactgtttggtttgttccaagtataaaagcaggaaatgatatagcagcttgcctga

SEQ ID NO: 55898 - DNA, 75 bp, Artificial Sequence
  Synthetic
ctcaggttggagtagggatacacatggaaggtgtatttcacacaatgtggcatgtaacaagaggatcagtgatct

SEQ ID NO: 55899 - DNA, 75 bp, Artificial Sequence
  Synthetic
atcttgggctgacgtcaggaatgacatgatatcatacggtgggggatggaggcttggagacaaatgggacaaaga

SEQ ID NO: 55900 - DNA, 75 bp, Artificial Sequence
  Synthetic
gaaaggaaaagtcatcggactctatggaaatggagtagttaccaaatcaggtgattacgtcagtgccataacgca

SEQ ID NO: 55901 - DNA, 75 bp, Artificial Sequence
  Synthetic
ggtatggcatggaaatcagaccagttaaggagaaggaagagaacctagtcaggtcaatggtctctgcagggtcag

SEQ ID NO: 55902 - DNA, 75 bp, Artificial Sequence
  Synthetic
gagaagtggacagtttttcattaggactactatgcgtatcaataatgattgaagaagtgatgagatccagatgga

SEQ ID NO: 55903 - DNA, 75 bp, Artificial Sequence
  Synthetic
gaaaagattgaccatcatggacctccacccaggagcaggaaaaacaaagagataccttccagcaatagtcagaga

SEQ ID NO: 55904 - DNA, 75 bp, Artificial Sequence
  Synthetic
cttacaccccggagctggaaagacaaaaagaattcttccatcaatagtgagagaagccttaaaaaggaggctgcg

SEQ ID NO: 55905 - DNA, 75 bp, Artificial Sequence
  Synthetic
cagaggacttccaataagataccaaaccccagctatcagagctgagcacactgggcgggagattgtggatctaat

SEQ ID NO: 55906 - DNA, 75 bp, Artificial Sequence
  Synthetic
attgaacaaatggcgaatggaatagccttggggctcatggctctcaaattgataacacaatttgaaacataccaa

SEQ ID NO: 55907 - DNA, 75 bp, Artificial Sequence
  Synthetic
agactaacatccagagaagttcttcttctcacaattggattaagcctggtggcatccgtggagctaccaaattct

SEQ ID NO: 55908 - DNA, 75 bp, Artificial Sequence
  Synthetic
caaacagcaataaaccaagttagatccttaataggcagtgaggaatacacagactacatgccatccatgaaaaga

SEQ ID NO: 55909 - DNA, 75 bp, Artificial Sequence
  Synthetic
agacatcgagagggaaattccggaaaggtcatggaacacagggttcgactggataacagactaccaagggaaaac

SEQ ID NO: 55910 - DNA, 75 bp, Artificial Sequence
  Synthetic
cgagtaggaacgaaacatgcaatattactagtcgcagtttctttcgtgacgttaatcacagggaacatgtctttt

SEQ ID NO: 55911 - DNA, 75 bp, Artificial Sequence
  Synthetic
aactgtgcattgaagctaaaatatcaaacaccaccaccgattcaagatgtccaacacaaggagaagccacactgg

SEQ ID NO: 55912 - DNA, 75 bp, Artificial Sequence
  Synthetic
agacatatctgaaatgggggccaattttagagctgggagagtgatagaccctagaagatgcctcaagccagttat

SEQ ID NO: 55913 - DNA, 75 bp, Artificial Sequence
  Synthetic
tagggaagatgaccctgggaatgtgctgcataatcacggctagtatcctcctatggtatgcacagatacaaccac

SEQ ID NO: 55914 - DNA, 75 bp, Artificial Sequence
  Synthetic
ttttgtgtggtatttttggcagaaaaagaaacagagatcaggagtgttatgggacacacccagccctccagaagt

SEQ ID NO: 55915 - DNA, 75 bp, Artificial Sequence
  Synthetic
atcatgcccactggacagaagcaaagatgctgcttgacaatatctacaccccagaagggatcattccaacattgt

SEQ ID NO: 55916 - DNA, 75 bp, Artificial Sequence
  Synthetic
ggaaagagcagttcttgatgatggtatctatagaatcttgcaaagaggactgttgggcaggtcccaagtaggagt

SEQ ID NO: 55917 - DNA, 75 bp, Artificial Sequence
  Synthetic
gtacaccagatttttggaactgcatatggagttttgttcagcggtgtttcctggaccatgaaaataggaataggg

SEQ ID NO: 55918 - DNA, 75 bp, Artificial Sequence
  Synthetic
aagaaaaagggaaaagctttttgtttaagacaaaggatggccacgacatgtgtaccttcatggccatggaccttg

SEQ ID NO: 55919 - DNA, 75 bp, Artificial Sequence
  Synthetic
agtttgaaaagcagttgggacaagtaatgctactagtcctctgcgtgactcaagtattgatgatgaggactacat

SEQ ID NO: 55920 - DNA, 75 bp, Artificial Sequence
  Synthetic
ttaccaggtaaaaacagaaaccaccatcctcgatgtggacttgagaccagcttcagcatggacgctctatgcagt

SEQ ID NO: 55921 - DNA, 75 bp, Artificial Sequence
  Synthetic
aggttagaggagaccccccgcacatcaacaaacagcatattgacgctggaagagaccagagatcctgctgtctct

SEQ ID NO: 55922 - DNA, 75 bp, Artificial Sequence
  Synthetic
gctgtgtgacataggggagtcgtcaccaaaccccacggttgaggcaggacgaacactcagagttctaaacttagt

SEQ ID NO: 55923 - DNA, 75 bp, Artificial Sequence
  Synthetic
gacaacttagcagtcctgcatacggctgaagcaggcggaagggcgtacaatcatgctcttagtgaactgccggag

SEQ ID NO: 55924 - DNA, 75 bp, Artificial Sequence
  Synthetic
tcatatggaggaggttggaagctagaaggagaatggaaagaaggagaagaagtccaggtcttggcattggagcct

SEQ ID NO: 55925 - DNA, 75 bp, Artificial Sequence
  Synthetic
taacttatgttgtcatagccatccttacagtagtggccgcaaccatggcaaacgagatgggtttcctggaaaaaa

SEQ ID NO: 55926 - DNA, 75 bp, Artificial Sequence
  Synthetic
aacccagtggtgactaagaaggaggagcctgtcaatattgaggctgaacctccttttggggaaagtaatatagtg

SEQ ID NO: 55927 - DNA, 75 bp, Artificial Sequence
  Synthetic
agccaacgagatggggctgattgaaaaaacaaaaacggattttgggttttaccaggtaaaaacagaaaccaccat

SEQ ID NO: 55928 - DNA, 75 bp, Artificial Sequence
  Synthetic
aacatcctggacatagatctacgtcctgcatcagcttggactctatatgccgtggcaacaactttcatcacacca

SEQ ID NO: 55929 - DNA, 75 bp, Artificial Sequence
  Synthetic
actgattttcagtcacaccagttatggactaccttactgtctctgacattcatcaaaacaactctttcactggat

SEQ ID NO: 55930 - DNA, 75 bp, Artificial Sequence
  Synthetic
tcacgacaaacatatggttgaaattgcgtgactcctacacccaagtgtgtgaccaccggctaatgtcagctgcca

SEQ ID NO: 55931 - DNA, 75 bp, Artificial Sequence
  Synthetic
acggaaatccagatgtcatcaggaaacttgctgttcacaggacatctcaaatgcaggctgagaatggacaaatta

SEQ ID NO: 55932 - DNA, 75 bp, Artificial Sequence
  Synthetic
atgcaggctgagaatggacaaattacagcttaaagggatgtcatactccatgtgcacaggaaagtttaaagttgt

SEQ ID NO: 55933 - DNA, 75 bp, Artificial Sequence
  Synthetic
cagttttttaattagagagcagatctctgatgaataaccaacggaaaaaggcgagaagtacgcctttcaatatgc

SEQ ID NO: 55934 - DNA, 75 bp, Artificial Sequence
  Synthetic
gagttttttctcatggtgctgttgataccagaaccagaaaaacaaaggaccccacaagacaatcaattgatctac

SEQ ID NO: 55935 - DNA, 75 bp, Artificial Sequence
  Synthetic
ttctcacttggaatgctgcaaggacgaggaccgttaaaactgtttatggcccttgtggcgttccttcgtttccta

SEQ ID NO: 55936 - DNA, 75 bp, Artificial Sequence
  Synthetic
acagtgattgacctagatccaataccctatgatccaaagtttgaaaagcagttgggacaagtaatgctcttagtc

SEQ ID NO: 55937 - DNA, 75 bp, Artificial Sequence
  Synthetic
gtggaaccatggctcagaggaaaccaattttgcataaaaattctgaatccctacatgccaagtgtggtggaaact

SEQ ID NO: 55938 - DNA, 75 bp, Artificial Sequence
  Synthetic
acagcctgggattttggatctctgggaggagtgttcacatcaataggaaaggctctccaccaggtttttggagca

SEQ ID NO: 55939 - DNA, 75 bp, Artificial Sequence
  Synthetic
cactggccctccgcgagtttaaagagttttcagcaaaaagaaaaagtgttttaggggacctaaaattagaaatag

SEQ ID NO: 55940 - DNA, 75 bp, Artificial Sequence
  Synthetic
cgcagcaacaacgggggcccaaggtgagatgaagctgtaatctcactggaaggactagaggttagaggagacccc

SEQ ID NO: 55941 - DNA, 75 bp, Artificial Sequence
  Synthetic
aggggaaaggaagaaattgaaacccagatggttggatgctaggatctactctgacccactggcgctcaaagaatt

SEQ ID NO: 55942 - DNA, 75 bp, Artificial Sequence
  Synthetic
aggagcaggaccagaactacgtgtgtaagcacacatacgtagacagaggctgggggaacggatgtggtttgtttg

SEQ ID NO: 55943 - DNA, 75 bp, Artificial Sequence
  Synthetic
cacgctgtgtcgcgaggctcagcgaaactgagatggttcgtcgagagaaacctggtcacaccagaagggaaagta

SEQ ID NO: 55944 - DNA, 75 bp, Artificial Sequence
  Synthetic
cccaagaaccgaaggaaggcacaaagaaactgatgaaaatcacggcagagtggctttggaaagaactaggaaaga

SEQ ID NO: 55945 - DNA, 75 bp, Artificial Sequence
  Synthetic
tggcaacaagtgcctttttgttcacaccacttccaccagctgatcatgaaggatgggagggaaatagtggtgcca

SEQ ID NO: 55946 - DNA, 75 bp, Artificial Sequence
  Synthetic
ggtcaagccatcaggatcagcctcatccatggtcaatggcgtggtgaaactgctcaccaaaccatgggatgtcat

SEQ ID NO: 55947 - DNA, 75 bp, Artificial Sequence
  Synthetic
gctatggatggccagtgtggagccccattggatagcggcctccatcatactagagttctttctgatggtgctgct

SEQ ID NO: 55948 - DNA, 75 bp, Artificial Sequence
  Synthetic
aaaaggaggtccaggacatgaagaaccgattcccatggctacttatggctggaatttggtcaaactccattcagg

SEQ ID NO: 55949 - DNA, 75 bp, Artificial Sequence
  Synthetic
aaagctcatgaagagggcatttgtggaatccgctcagtaacaagactggaaaatcttatgtggaaacagataaca

SEQ ID NO: 55950 - DNA, 75 bp, Artificial Sequence
  Synthetic
gaggaatacacagactacatgccatccatgaaaagattcagaagagaagaggaagaggcaggggtcttgtggtag

SEQ ID NO: 55951 - DNA, 75 bp, Artificial Sequence
  Synthetic
accttcaagacccctgaaggcgaagttggagccatagccctagatttcaaacctggcacatctggatctcccatc

SEQ ID NO: 55952 - DNA, 75 bp, Artificial Sequence
  Synthetic
ccattggaattataaagagagaatggtgacattcaaagttcctcatgccaagagacaggatgtgacagtgctagg

SEQ ID NO: 55953 - DNA, 75 bp, Artificial Sequence
  Synthetic
aaaataaaccaacactggattttgaactgataaaaacagaagccaaacaacctgccactctaaggaagtactgta

SEQ ID NO: 55954 - DNA, 75 bp, Artificial Sequence
  Synthetic
gggacacaagaatcacactagaggacttaaaaaatgaagaaatggtgacaaaccacatggaaggagaacacaaga

SEQ ID NO: 55955 - DNA, 75 bp, Artificial Sequence
  Synthetic
ggcataggaaacccacttatgagaaggacgtagatcttggggcaggaacgagaagtgtctccactgaaacagaaa

SEQ ID NO: 55956 - DNA, 75 bp, Artificial Sequence
  Synthetic
gaagatcactggttcagcagagagaattcactcagcggagtggaaggagaaggactccacaaacttggatatata

SEQ ID NO: 55957 - DNA, 75 bp, Artificial Sequence
  Synthetic
gcaggcggggttcaatctcaggaaacagatgtaccttggtggtaaggactagaggttagtggagacccgttcgga

SEQ ID NO: 55958 - DNA, 75 bp, Artificial Sequence
  Synthetic
ggaagggaaggaatcatcgagcaacagagcaacgtgaaccctttcgagtaatagaagagcaatggattcttgtga

SEQ ID NO: 55959 - DNA, 75 bp, Artificial Sequence
  Synthetic
agacataccatagagaattccacagcaaatgtgtccctggcagctatagccaaccaggcagtggtcctgatgggt

SEQ ID NO: 55960 - DNA, 75 bp, Artificial Sequence
  Synthetic
tgaccaagaccacccatacaaaacgtgggcctaccatggcagctacgaaacaaaacagactggatcagcatcatc

SEQ ID NO: 55961 - DNA, 75 bp, Artificial Sequence
  Synthetic
aaatcaaaataacaccacagagtcccatcacagaagcagaactgacaggctatggcacagtcacgatggagtgct

SEQ ID NO: 55962 - DNA, 75 bp, Artificial Sequence
  Synthetic
aattgtgagtccgatagggaatctcaccaacccactgttgagtgggagacaacaagtcggtatgcgtgtaaattg

SEQ ID NO: 55963 - DNA, 75 bp, Artificial Sequence
  Synthetic
gaaaattctggaacaccacgatagcagtgtccatggcaaacatcttcaggggaagttatctagcaggagcaggtc

SEQ ID NO: 55964 - DNA, 75 bp, Artificial Sequence
  Synthetic
ctaacaaaaccttgggacgtcatccctatggtgacacagatggcaatgacagacacgactccatttggacaacag

SEQ ID NO: 55965 - DNA, 75 bp, Artificial Sequence
  Synthetic
cgcgaagaaacaggatgtcgttgttttaggatctcaagaaggggccatgcacacggcactcacaggggccacaga

SEQ ID NO: 55966 - DNA, 75 bp, Artificial Sequence
  Synthetic
ttaaggtaaccgtaacaaagaaacaagtttcgactcggaagcttgcttaacgtagtgctaacagtttttattaga

SEQ ID NO: 55967 - DNA, 75 bp, Artificial Sequence
  Synthetic
tttcaggaagaacagggatggacatcagccagtgaagctgtgaatgacagccggttttgggaactggttgacaaa

SEQ ID NO: 55968 - DNA, 75 bp, Artificial Sequence
  Synthetic
ctattcacaggacatctcaagtgcaggctgagaatggacaaactacagctcaaaggaatgtcatactctatgtgc

SEQ ID NO: 55969 - DNA, 75 bp, Artificial Sequence
  Synthetic
ccaactatagaagaaggaagaacgttacgtgttctaaagatggtggaaccatggctcagaggaaaccaattttgc

SEQ ID NO: 55970 - DNA, 75 bp, Artificial Sequence
  Synthetic
gtgtggtttgtccccagcattaaagccggaaatgacatagcaaactgcttgcgaaaaaacgggaaaaaggtcatt

SEQ ID NO: 55971 - DNA, 75 bp, Artificial Sequence
  Synthetic
acgttgtcgtcttgggatcgcaagagggcgccatgcacacagcactcacaggagcaacagaaattcaaatgtcat

SEQ ID NO: 55972 - DNA, 75 bp, Artificial Sequence
  Synthetic
acagttaacccgatcgtaacagaaaaagatagcccagtcaacatagaagcagaacctccattcggagacagctac

SEQ ID NO: 55973 - DNA, 75 bp, Artificial Sequence
  Synthetic
gaaagcggattggataccattagcattgacgatcaaaggtctcaatccaacagccatttttctaacaaccctttc

SEQ ID NO: 55974 - DNA, 75 bp, Artificial Sequence
  Synthetic
aagtatcaattggcagtgactatcatggctatcttgtgcgtcccaaatgcagtgatattacaaaatgcatggaaa

SEQ ID NO: 55975 - DNA, 75 bp, Artificial Sequence
  Synthetic
gaattcaaggactttgcggctggcagaaagtcaatcgcccttgatcttgtgacagaaataggaagagtgccttca

SEQ ID NO: 55976 - DNA, 75 bp, Artificial Sequence
  Synthetic
tgatacaaatggcaaacattcttagagggagttacctggctggagctggacctcttttttccatcatggagaaca

SEQ ID NO: 55977 - DNA, 75 bp, Artificial Sequence
  Synthetic
cacacaagatgacatgcagaacccaaaagggttgaaagaaagagttgagaaatggctgaaagagtgtggtgtcga

SEQ ID NO: 55978 - DNA, 75 bp, Artificial Sequence
  Synthetic
aaagggttgaaagaaagagttgagaaatggctgaaagagtgtggtgtcgacaggttaaagaggatggcaatcagt

SEQ ID NO: 55979 - DNA, 75 bp, Artificial Sequence
  Synthetic
ctccatacgggacgtcgaggaaaccaatatgataacccttttggtgaaactggcactgataacagtgtcaggtct

SEQ ID NO: 55980 - DNA, 75 bp, Artificial Sequence
  Synthetic
tagaaaccaggatgaactgatagggagagccagaatctcgcagggggctggatggagcttaagagaaacagcctg

SEQ ID NO: 55981 - DNA, 75 bp, Artificial Sequence
  Synthetic
tgcagaaaccaagatgaactgattggcagggcccgaatttcccagggagccgggtggtccttgcgggaaacagcc

SEQ ID NO: 55982 - DNA, 75 bp, Artificial Sequence
  Synthetic
gcagggcccgaatttcccagggagccgggtggtccttgcgggaaacagcctgtctggggaagtcctacgcccaaa

SEQ ID NO: 55983 - DNA, 75 bp, Artificial Sequence
  Synthetic
taccacacccaaacggcaggaccctggcacttaggaaaattggagctggacttcaactattgtgaaggaacaaca

SEQ ID NO: 55984 - DNA, 75 bp, Artificial Sequence
  Synthetic
tcctgatgggtttggacaaaggatggccaatatcaaaaatggacttaggagtacccctactggcattgggttgct

SEQ ID NO: 55985 - DNA, 75 bp, Artificial Sequence
  Synthetic
gggatctgcgtttagcctccatggccatatgctcagcagttccaacggaatggtttccaacaagcagaacaacat

SEQ ID NO: 55986 - DNA, 75 bp, Artificial Sequence
  Synthetic
cagaatgccccaacacaaacagagcttggaactcgctggaagttgaagactatggttttggagttttcaccacca

SEQ ID NO: 55987 - DNA, 75 bp, Artificial Sequence
  Synthetic
tggatgacaacagaagacatgttgacagtctggaacagggtgtggattcaagaaaacccatggatggaagacaaa

SEQ ID NO: 55988 - DNA, 75 bp, Artificial Sequence
  Synthetic
catagctcagactgaaaaaagcattgaagactatccagaggttgagatggacatctttcggaagaagaggttgac

SEQ ID NO: 55989 - DNA, 75 bp, Artificial Sequence
  Synthetic
cagaggagaaccaatgggacagtgctagagctgccgttgaagatgaagaattctggaaactcgtggacagagaac

SEQ ID NO: 55990 - DNA, 75 bp, Artificial Sequence
  Synthetic
gcctgggaagaacccaaagaactttcaaaccatgccaggcattttccagacaacaacaggggagataggagcgat

SEQ ID NO: 55991 - DNA, 75 bp, Artificial Sequence
  Synthetic
ataacaccccaaagctctattgctgaagctgaactgacaggttatggcacgatcacgatggaatgctccccacga

SEQ ID NO: 55992 - DNA, 75 bp, Artificial Sequence
  Synthetic
aaagccaaaaggaaaggtcgtggatcttggttgcgggaggggaggatggtcctattacatggcgacactcaagaa

SEQ ID NO: 55993 - DNA, 75 bp, Artificial Sequence
  Synthetic
gttcaaagttgtcaaagagatagcggaaacacaacatggaacaatagtcatcagagtgcagtatgaaggagatga

SEQ ID NO: 55994 - DNA, 75 bp, Artificial Sequence
  Synthetic
gacatttcagaaatgggagccaatttcaaagcagacagagtgatcgacccaagaagatgtctcaagccagtgatt

SEQ ID NO: 55995 - DNA, 75 bp, Artificial Sequence
  Synthetic
agttgttagtctgtgtggaccgacaaggacagttccaaatcggaagcttgcttaacacagttctaacagtttgtt

SEQ ID NO: 55996 - DNA, 75 bp, Artificial Sequence
  Synthetic
atggaaatcagaccattaaaagagaaagaagagaatttggtcaactccttggtcacagccggacatgggcagatt

SEQ ID NO: 55997 - DNA, 75 bp, Artificial Sequence
  Synthetic
aatgagaggagctaaaagaatggccatcttgggagacacagcttgggactttggatctatagggggagtgttcac

SEQ ID NO: 55998 - DNA, 75 bp, Artificial Sequence
  Synthetic
aaccccttttgggcaacaaagagtgttcaaagagaaggtggataccagaacaccacaaccaaaacccggcacacg

SEQ ID NO: 55999 - DNA, 75 bp, Artificial Sequence
  Synthetic
tggaagtggaaatctggacaaaggaaggggaaaggaaaaaattgaaacctagatggttggatgctaggatctact

SEQ ID NO: 56000 - DNA, 75 bp, Artificial Sequence
  Synthetic
aagtcagaatttaatacttacaaaaggagtggaattatggaggtggacagatctgaagccaaggagggactgaaa

SEQ ID NO: 56001 - DNA, 75 bp, Artificial Sequence
  Synthetic
tccatgccaggaacaagaagggtcatggggatcacagcggagtggctctggagaaccctgggaaggaacaaaaaa

SEQ ID NO: 56002 - DNA, 75 bp, Artificial Sequence
  Synthetic
aatgctctccacagaactccacaatcagaccttcctcattgatggtcccgaaacagcagaatgccccaacacaaa

SEQ ID NO: 56003 - DNA, 75 bp, Artificial Sequence
  Synthetic
ggaatagggtctggatagaggaaaacccatggatggaggacaaaactcatgtatccagttgggaagatgttccat

SEQ ID NO: 56004 - DNA, 75 bp, Artificial Sequence
  Synthetic
aaacagcagaatgccccaacacaaacagagcttggaattcactagaagttgaggactatggctttggagtattca

SEQ ID NO: 56005 - DNA, 75 bp, Artificial Sequence
  Synthetic
ccagagagagtcattttagcaggtcccattccagtgactccagcaagcgctgctcagagaagagggcgaatagga

SEQ ID NO: 56006 - DNA, 75 bp, Artificial Sequence
  Synthetic
gtgctcactggacgatcggccgatttggaactggagagagccgccgatgtaaaatgggaagatcaggcagaaata

SEQ ID NO: 56007 - DNA, 75 bp, Artificial Sequence
  Synthetic
agcaatgtatgccgatgacaccgcaggctgggacacaagaatcacactaggggctttaaaaaatgaaagaaagtg

SEQ ID NO: 56008 - DNA, 75 bp, Artificial Sequence
  Synthetic
aagcttctttcattgaagtcaaaagttgccactggccaaagtcacacactctatggagtaatggagtgctagaaa

SEQ ID NO: 56009 - DNA, 75 bp, Artificial Sequence
  Synthetic
aatggcgtaaccaaaacagggtggtgggggtgcaaggcccaacaccaggaggcacggtaatggacatcatatcga

SEQ ID NO: 56010 - DNA, 75 bp, Artificial Sequence
  Synthetic
aggacctataccagtctacttaggctataagtggccaggcgaaggtatcaactacgcagacagtagattgtgttt

SEQ ID NO: 56011 - DNA, 75 bp, Artificial Sequence
  Synthetic
gggggtgcaaggcccaacaccaggaggcacggtaatggacatcatatcgaggaagaaccaaaggggtagtggaca

SEQ ID NO: 56012 - DNA, 75 bp, Artificial Sequence
  Synthetic
tgtggtagaaactctggagcaaatgcaaagaaaacatggagggatgctagtgcgaaacccactctcaagaaattc

SEQ ID NO: 56013 - DNA, 75 bp, Artificial Sequence
  Synthetic
actccagtggaatcatgggaggaaatcccatatttggggaaaagagaagaccaatggtgcggctcattgattggg

SEQ ID NO: 56014 - DNA, 75 bp, Artificial Sequence
  Synthetic
aggtccattagtggctggagggctccttactgtgtgctacgtgctcactggacgatcggccgatttggaactgga

SEQ ID NO: 56015 - DNA, 75 bp, Artificial Sequence
  Synthetic
ttaggcaaatggagggggagggattcttcatagaacatcagcacttgacagcctcagaagaaaatgctgtgcaag

SEQ ID NO: 56016 - DNA, 75 bp, Artificial Sequence
  Synthetic
cgtagacttacatccagcttcagcctggaccctctatgcagtggccacaacaattatcactcccatgatgaggca

SEQ ID NO: 56017 - DNA, 75 bp, Artificial Sequence
  Synthetic
tgaggaaagacatcccgcaatgggaaccatccaagggatggaaaaactggcaagaggttcctttttgctcccacc

SEQ ID NO: 56018 - DNA, 75 bp, Artificial Sequence
  Synthetic
agagcccgaatttcccagggagctgggtggtctttcggtgagactgcctgtttggggaagtcttacgcccaaatg

SEQ ID NO: 56019 - DNA, 75 bp, Artificial Sequence
  Synthetic
acaaagaaggaacattccatacaatgtggcacgtcacacgtggcgctgttctgatgcatagagggaagaggattg

SEQ ID NO: 56020 - DNA, 75 bp, Artificial Sequence
  Synthetic
cccaaaagccacggtttgagcaaaccgtgctgcctgtagctccgtcgtggggacgtaaaacctgggaggctgcaa

SEQ ID NO: 56021 - DNA, 75 bp, Artificial Sequence
  Synthetic
ttgcagctggactgctcttgagaaaactgacctccaaggaattaatgatgaccaccataggaatcgttcttctct

SEQ ID NO: 56022 - DNA, 75 bp, Artificial Sequence
  Synthetic
cgcaaccatggcaaacgaaatgggctttctggaaaaaacaaagaaagatctcggactgggaaacattgcaactca

SEQ ID NO: 56023 - DNA, 75 bp, Artificial Sequence
  Synthetic
tttcacacgatgtggcacgtcacacgtggagctgtcctagtgcacaaagggaaaagaattgagccatcatgggca

SEQ ID NO: 56024 - DNA, 75 bp, Artificial Sequence
  Synthetic
caggactattcccagtatcaatcccaatcacagctgcggcctggtacctatgggagacaaaaaagcagagggccg

SEQ ID NO: 56025 - DNA, 75 bp, Artificial Sequence
  Synthetic
ctctagaaataacgcaacagcggggcccagcacacgggtaagatgtcccttggacgtaaggacttatagcttaca

SEQ ID NO: 56026 - DNA, 75 bp, Artificial Sequence
  Synthetic
aaaatccatggatggaagacaaaactcccgtggaatcatgggaggaaatcccatacctggaaaaaagagaagacc

SEQ ID NO: 56027 - DNA, 75 bp, Artificial Sequence
  Synthetic
tcaaaaccaacaccggaaccataggcgccgtatctttggacttttcccctggaacatcaggatctccaattgtcg

SEQ ID NO: 56028 - DNA, 75 bp, Artificial Sequence
  Synthetic
atagaaaaggaaaagttgtgggtctttatggcaatggtgttgtcacaaggagtggagcatacgtgagtgctatag

SEQ ID NO: 56029 - DNA, 75 bp, Artificial Sequence
  Synthetic
atctcaggagggagctatgcattctgccctcgccggagccacagaagtggattctggtaatggaaatcacatgtt

SEQ ID NO: 56030 - DNA, 75 bp, Artificial Sequence
  Synthetic
gagagagaaaaaattaggagagtttggaaaggcaaaaggaagtcgtgcaatatggtacatgtggctgggagcacg

SEQ ID NO: 56031 - DNA, 75 bp, Artificial Sequence
  Synthetic
agtggctgagacccagcatggaaccgttctagtgcagattaaatacgaaggaacagatgcaccatgcaagatccc

SEQ ID NO: 56032 - DNA, 75 bp, Artificial Sequence
  Synthetic
cagccgcaccacctggtcgatccatgcccaccaccaatggatgacaacagaagacatgttgtcagtgtggaatag

SEQ ID NO: 56033 - DNA, 75 bp, Artificial Sequence
  Synthetic
gtttgtcccgagcataagagctggaaacgacatagcagcctgtttgaggaaaaatggaaaaagagtgatccagct

SEQ ID NO: 56034 - DNA, 75 bp, Artificial Sequence
  Synthetic
agaagtcaaagcattaacaataggagggccaggacacgaagaacctatcctcatgtcaacatatgggcggaattt

SEQ ID NO: 56035 - DNA, 75 bp, Artificial Sequence
  Synthetic
ggattgaaccatcatgggcggacgtcaagaaagacttaatatcatatggaggaggttggaagctagaaggagaat

SEQ ID NO: 56036 - DNA, 75 bp, Artificial Sequence
  Synthetic
gtattgtggattggcacgaattcaagaaacacttcaatggcaatgacgtgcatagctgttggaggaatcactctg

SEQ ID NO: 56037 - DNA, 75 bp, Artificial Sequence
  Synthetic
cataggcgccgtatctctggacttttcccctgggacgtcaggatctccaatcgttgacaaaaaaggaaaagttgt

SEQ ID NO: 56038 - DNA, 75 bp, Artificial Sequence
  Synthetic
aaatgatgaagactgtgcacactggaaagaagctaaaatgctcctagataacatcaacacacctgaaggaatcat

SEQ ID NO: 56039 - DNA, 75 bp, Artificial Sequence
  Synthetic
accaaacaacagcaacaaaatctgaacacacaggaagagagattgttgatctaatgtgccacgcaacattcacaa

SEQ ID NO: 56040 - DNA, 75 bp, Artificial Sequence
  Synthetic
caccaatgttgagacatagcattgaaaattcctcagtgaatgtgtccctaacagccattgccaaccaagccacag

SEQ ID NO: 56041 - DNA, 75 bp, Artificial Sequence
  Synthetic
aaaaatgatgaagatcatgcccactggacagaagcaaagatgctgcttgacaatatctacaccccagaaggaatc

SEQ ID NO: 56042 - DNA, 75 bp, Artificial Sequence
  Synthetic
ttgcactatgcatggaagacaatggctatggtactgtcaattgtatctctcttccccttatgcctgtccacgacc

SEQ ID NO: 56043 - DNA, 75 bp, Artificial Sequence
  Synthetic
gtcggcggcaatcaaagatcagaaagctgtgcatgctgacatgggttattggatagagagctcaaaaaaccagac

SEQ ID NO: 56044 - DNA, 75 bp, Artificial Sequence
  Synthetic
tgatggtcccgaaacagcagaatgccccaacacaaacagagcttggaattcactggaagttgaggactacggctt

SEQ ID NO: 56045 - DNA, 75 bp, Artificial Sequence
  Synthetic
ctgttcagccgttccagttgattgggtcccaaccagccgcaccacttggtcgatccatgcccatcatcaatggat

SEQ ID NO: 56046 - DNA, 75 bp, Artificial Sequence
  Synthetic
cgctagcactcaaagagttcaaggaatttgcggccggaaggaagtctctaaccttgagtttgatcacagaaatgg

SEQ ID NO: 56047 - DNA, 75 bp, Artificial Sequence
  Synthetic
ccaacaccaggggaagctgtaccctggtggtaaggactagaggttagaggagaccccccgcacaacaataaacag

SEQ ID NO: 56048 - DNA, 75 bp, Artificial Sequence
  Synthetic
tcttaacatcctcacagcagaaagcggattggataccactggcattgacgataaaaggtctcaatccaacagcca

SEQ ID NO: 56049 - DNA, 75 bp, Artificial Sequence
  Synthetic
ggatagagagctcaaaaaaccagacctggcagatagagaaagcatcccttattgaagtgaaaacatgtctgtggc

SEQ ID NO: 56050 - DNA, 75 bp, Artificial Sequence
  Synthetic
tgggaaagaccagagatcctgctgtctctgcaacatcaatccaggcacagagcgccgcagatggattggtgttgt

SEQ ID NO: 56051 - DNA, 75 bp, Artificial Sequence
  Synthetic
gcgtacaatcatgctctcagtgaactgccggagaccctggagacactacttttactgacactcctggctacagtc

SEQ ID NO: 56052 - DNA, 75 bp, Artificial Sequence
  Synthetic
gattattatgttgattccaacagcgatggcgttccatttaaccacacgtaatggagaaccacacatgatcgttgg

SEQ ID NO: 56053 - DNA, 75 bp, Artificial Sequence
  Synthetic
agtggttgcgttgtgagctggaaaaataaagaactgaaatgtggcagcgggatcttcatcacagataacgtacac

SEQ ID NO: 56054 - DNA, 75 bp, Artificial Sequence
  Synthetic
caagaaagaaggaggagcaatgtatgccgatgacaccgcaggctgggacacaagaatcacactagaggatttaaa

SEQ ID NO: 56055 - DNA, 75 bp, Artificial Sequence
  Synthetic
gggagagttatgtgaggacacaatgacctacaaatgcccccggatcactgaggcggaaccagatgacgttgactg

SEQ ID NO: 56056 - DNA, 75 bp, Artificial Sequence
  Synthetic
gaagcgctcagtagctttaacaccacattcaggaatgggattggaaacaagagctgagacatggatgtcatcgga

SEQ ID NO: 56057 - DNA, 75 bp, Artificial Sequence
  Synthetic
aacaaacaaggtggtgcgggtgcaaagaccaacaccgggaggcacgttaatggacatcatatcgagaaagaccca

SEQ ID NO: 56058 - DNA, 75 bp, Artificial Sequence
  Synthetic
ttggacatagacctccgacctgcatcagcgtggacactatatgcagtggctactacgtttttcacgccaatgctg

SEQ ID NO: 56059 - DNA, 75 bp, Artificial Sequence
  Synthetic
tggaagccccacctattagacagatggagggaaaaggagttttcaaagggcatcagcaccgaacagcctcagaag

SEQ ID NO: 56060 - DNA, 75 bp, Artificial Sequence
  Synthetic
atcctgcagctcacagcactctccataaaccaagtgagaaggctaattgggaatgagaattatctagattatatg

SEQ ID NO: 56061 - DNA, 75 bp, Artificial Sequence
  Synthetic
gtcaccaggatatgtgctgggtgtgtttttaaggaaacttacttcaagagagacagcgctaatggtaataggaat

SEQ ID NO: 56062 - DNA, 75 bp, Artificial Sequence
  Synthetic
ggagggaaaaggagttttcaaagggcatcagcaccgaacagcctcagaagaaaacgctgtgcaagattggctagc

SEQ ID NO: 56063 - DNA, 75 bp, Artificial Sequence
  Synthetic
atctggacaaaggaaggggaaaggaaaaaattgaaacctagatggttagatgctaggatctactccgacccactg

SEQ ID NO: 56064 - DNA, 75 bp, Artificial Sequence
  Synthetic
acttgggctttgagacacccaggattcacggtgatagccttttttttagcacatgctataggaacatccatcact

SEQ ID NO: 56065 - DNA, 75 bp, Artificial Sequence
  Synthetic
gagagaaaccgcgtgtcaacaatacaacagttgacgaagagattctcacttggaatgctacaagggagagggcca

SEQ ID NO: 56066 - DNA, 75 bp, Artificial Sequence
  Synthetic
ttgtgtgaggctctaaccttagcgaccgggcccatctccacattgtgggaaggtaatccagggagattttggaac

SEQ ID NO: 56067 - DNA, 75 bp, Artificial Sequence
  Synthetic
taggagcccaggctttgccagtgtacctaatgactctcatgaaaggagcctcaagaagatcttggcctcttaatg

SEQ ID NO: 56068 - DNA, 75 bp, Artificial Sequence
  Synthetic
tggctattttgtgcgtcccaaatgctgtgatattacagaacgcatggaaagtgagttgcacaatattggcagtgg

SEQ ID NO: 56069 - DNA, 75 bp, Artificial Sequence
  Synthetic
gcttggagagaaatggaaaagccgattgaacgcactggggaaaagtgaatttcagatttacaagaaaagtggaat

SEQ ID NO: 56070 - DNA, 75 bp, Artificial Sequence
  Synthetic
caagccggaaaacctggccaatacacgccagccatgattggatgacaacagaagtcatgctgacagtttggaaca

SEQ ID NO: 56071 - DNA, 75 bp, Artificial Sequence
  Synthetic
atatcaggtaaagggattggaaagactacaataggactcatttgtgttattgtttccagtggcatgttatggatg

SEQ ID NO: 56072 - DNA, 75 bp, Artificial Sequence
  Synthetic
gagaacattaatcctggcccccactagagtcgtggcagctgaaatggaggaagctcttagaggacttccaataag

SEQ ID NO: 56073 - DNA, 75 bp, Artificial Sequence
  Synthetic
cgccagccatgattggatgacaacagaagtcatgctgacagtttggaacaaattgtggttccaagaaaatccatg

SEQ ID NO: 56074 - DNA, 75 bp, Artificial Sequence
  Synthetic
agaaggaaagatagttcaatatgaaaacttaaaatattcagtgatagtcactgtccacactggggaccagcacca

SEQ ID NO: 56075 - DNA, 75 bp, Artificial Sequence
  Synthetic
aaaaagggaaagaccaatggggcggctcacttattgggctgacaagcagacccccctgggcgaagaacttccagc

SEQ ID NO: 56076 - DNA, 75 bp, Artificial Sequence
  Synthetic
aatgaaaatgaaaaagaaaacatggctcgtgcataagcaatggtttttggatctacctcttccatggacagcagg

SEQ ID NO: 56077 - DNA, 75 bp, Artificial Sequence
  Synthetic
cttaacagctctgaatgacatgggaaaagtaagaaaagacataccacaatgggaaccttcaaaaggatggaatga

SEQ ID NO: 56078 - DNA, 75 bp, Artificial Sequence
  Synthetic
gccgatctggaattagagagagctaccgatgtcaaatgggatgaccaggcagagatatcaggtagcagtccaatt

SEQ ID NO: 56079 - DNA, 75 bp, Artificial Sequence
  Synthetic
gagtggaaaggtggataacttcacaatgggtgtcttgtgtttggcaatcctctttgaagaggtgatgagaggaaa

SEQ ID NO: 56080 - DNA, 75 bp, Artificial Sequence
  Synthetic
tggaagaaatgcttaggacccgagtaggaacgaaacatgcaatactgctagttgcagtatcttttgtgacattga

SEQ ID NO: 56081 - DNA, 75 bp, Artificial Sequence
  Synthetic
atggcggtagggcctacaggcatgcggtggaggaactaccagagacaatggaaacactcctactcttgggactca

SEQ ID NO: 56082 - DNA, 75 bp, Artificial Sequence
  Synthetic
tatcacagacaatgtacacacatggacagaacaatacaaattccaaccagaatccccctcaaagctggcttcagc

SEQ ID NO: 56083 - DNA, 75 bp, Artificial Sequence
  Synthetic
gccacaccagttatggaccaccttactgtctctgacatttgtcaaaacaactctttcattggattatgcatggaa

SEQ ID NO: 56084 - DNA, 75 bp, Artificial Sequence
  Synthetic
ctctttcattggattatgcatggaaaacaacggctatggtactgtcaatcgtatctctctttcctttatgcctgt

SEQ ID NO: 56085 - DNA, 75 bp, Artificial Sequence
  Synthetic
ctatcatgacaggagacatcaaaggaatcatgcaggcaggaaaacgatccctgcggcctcagcccactgagctga

SEQ ID NO: 56086 - DNA, 75 bp, Artificial Sequence
  Synthetic
actgtgcagcctgtaagctccacctgaaggaggtgtaaaaaaccttcgggtaggccacaaaccatgggaagctgt

SEQ ID NO: 56087 - DNA, 75 bp, Artificial Sequence
  Synthetic
ccaagtgctgatgatgaggactacgtgggctttgtgtgaagccttaactctagcaaccggacccgtgtccacatt

SEQ ID NO: 56088 - DNA, 75 bp, Artificial Sequence
  Synthetic
accctaactggagaaattggagcagtaactctggatttcaaacccggaacgtctggctctcccatcattaacaag

SEQ ID NO: 56089 - DNA, 75 bp, Artificial Sequence
  Synthetic
gtatgttaagactagagccaatgattgggactttgtggtcacaactgacatttcagaaatgggtgccaacttcaa

SEQ ID NO: 56090 - DNA, 75 bp, Artificial Sequence
  Synthetic
aaatgaaaatgaccagtacatatacatgggggaacctctggaaaatgatgaagactgtgcacattggaaagaagc

SEQ ID NO: 56091 - DNA, 75 bp, Artificial Sequence
  Synthetic
acaggtctcgatttcgatgagatggtcctgctgcaaatggagaacaaagcatggctagttcatagacagtggttt

SEQ ID NO: 56092 - DNA, 75 bp, Artificial Sequence
  Synthetic
ataacacctcaagctcccacgtcggaaatacagctgaccgactacggagctcttacattggattgttcacctaga

SEQ ID NO: 56093 - DNA, 75 bp, Artificial Sequence
  Synthetic
agaaagtgcactcaatgacacatggaagatagagaaagcctctttcattgaagttaaaagctgccactggccaaa

SEQ ID NO: 56094 - DNA, 75 bp, Artificial Sequence
  Synthetic
ttggaagtgtgtatacaaccatgtttggaggagtctcatggatgattagaatcctaattgggttcttagtgttgt

SEQ ID NO: 56095 - DNA, 75 bp, Artificial Sequence
  Synthetic
aggatgctgaatatcttaaacaggagacgtagaactgcaggcatgatcatcatgctgattccaacagtgatggcg

SEQ ID NO: 56096 - DNA, 75 bp, Artificial Sequence
  Synthetic
atgaagtggatgaggacatttttcgaaagaaaagattaactataatggacttacaccctggagctggaaagacaa

SEQ ID NO: 56097 - DNA, 75 bp, Artificial Sequence
  Synthetic
gagtcttaggaatggcactattcctggaagaaatgctcaggacacgagtaggaacgaaacatgcaatactgctag

SEQ ID NO: 56098 - DNA, 75 bp, Artificial Sequence
  Synthetic
ggacaatctggtcatgctgcacaactctgaacaaggaggaaaagcctacagacacgccatggaagaactaccaga

SEQ ID NO: 56099 - DNA, 75 bp, Artificial Sequence
  Synthetic
agcagactgaacgcattggggaaaagtgaattccagatctacaaaaaaagtggaattcaagaagtggacagaacc

SEQ ID NO: 56100 - DNA, 75 bp, Artificial Sequence
  Synthetic
aggatgtgtaccagagaagaattcacaagaaaagtgagaagcaatgcagccttgggggccatattcactgatgag

SEQ ID NO: 56101 - DNA, 75 bp, Artificial Sequence
  Synthetic
gtgcaactccacgtccacatgggtaacttatgggacatgtaccaccacaggagagcacagaagagaaaaaagatc

SEQ ID NO: 56102 - DNA, 75 bp, Artificial Sequence
  Synthetic
ctcaccatgcaagattccttttgagatcatggacttggaaaagaaacatgttttagggcgactgattacggtcaa

SEQ ID NO: 56103 - DNA, 75 bp, Artificial Sequence
  Synthetic
ttcgatgacgtgcattgcagttggcatggtcacactgtacctaggagtcatggttcaagcggattcgggatgtgt

SEQ ID NO: 56104 - DNA, 75 bp, Artificial Sequence
  Synthetic
atggtcacactgtacctaggagtcatggttcaagcggattcgggatgtgtaatcaactggaagggcagagaactt

SEQ ID NO: 56105 - DNA, 75 bp, Artificial Sequence
  Synthetic
gtttctggacttacctctaccatggcttcctggagcagacacacaagggtccaattggatccagaaagagatgct

SEQ ID NO: 56106 - DNA, 75 bp, Artificial Sequence
  Synthetic
catttggtgatagctacattgtcataggagtggagccaggacagctgaaattaaactggttcaaaaaaggaagct

SEQ ID NO: 56107 - DNA, 75 bp, Artificial Sequence
  Synthetic
actggacacacgcacccaaacctggatgtcggctgaaggagcttggagacaagtcgagaaggtagagacatgggc

SEQ ID NO: 56108 - DNA, 75 bp, Artificial Sequence
  Synthetic
aggaggcacaagtatttttgcggggcacttaaaatgtagactcaagatggacaaattggaactcaaggggatgag

SEQ ID NO: 56109 - DNA, 75 bp, Artificial Sequence
  Synthetic
aacagatgggccagagagagttattctagcaggtccaattccagtaactccagcaagtgccgctcagagaagagg

SEQ ID NO: 56110 - DNA, 75 bp, Artificial Sequence
  Synthetic
gttagtaggaatcgtgacactatacctgggagtgatggtgcaagcggacagtggttgtgttgtaagctggaagaa

SEQ ID NO: 56111 - DNA, 75 bp, Artificial Sequence
  Synthetic
cctgcatcagcatggacgctgtatgccgtggccacaacatttgtcacaccaatgttgagacatagcattgaaaat

SEQ ID NO: 56112 - DNA, 75 bp, Artificial Sequence
  Synthetic
acactgattacagggaatatgtccttcaaggatttaggaagagtgataattatggtgggagcagccatgacggac

SEQ ID NO: 56113 - DNA, 75 bp, Artificial Sequence
  Synthetic
aaattcacagtggttgtaggagatgttgctgggatcttggctcaaggaaaaaagatgattaggccacaacccatg

SEQ ID NO: 56114 - DNA, 75 bp, Artificial Sequence
  Synthetic
agctctataggacaaatgtttgaaacaacaatgagaggagctaaaagaatggccatcttgggagacacagcttgg

SEQ ID NO: 56115 - DNA, 75 bp, Artificial Sequence
  Synthetic
tggggcgtgaaaggctatcaagaatggccatcagtggagatgattgtgttgtaaaacctttagatgacagatttg

SEQ ID NO: 56116 - DNA, 75 bp, Artificial Sequence
  Synthetic
gccattgatggagagtttcgcctcagaggggaacaaaggaagacttttgtggaattgatgaggagaggagacctt

SEQ ID NO: 56117 - DNA, 75 bp, Artificial Sequence
  Synthetic
cagagattgccactttgccaacttacctttcctctaaggccaagctagcccttgacaacatagtcatgctccaca

SEQ ID NO: 56118 - DNA, 75 bp, Artificial Sequence
  Synthetic
tttgcataaaaattctgaatccctacatgccaagtgtggtggaaaccctggagcaaatgcaaagaaaacatggag

SEQ ID NO: 56119 - DNA, 75 bp, Artificial Sequence
  Synthetic
tgtggaagctgtacgcacagtgtagcagactagcggttagaggacgaccccctcccatgacacaacgcagcagcg

SEQ ID NO: 56120 - DNA, 75 bp, Artificial Sequence
  Synthetic
cggaaatccagatgtcatcaggaaacctgctgttcacaggacatctcaagtgcaggctgagaatggacaaattac

SEQ ID NO: 56121 - DNA, 75 bp, Artificial Sequence
  Synthetic
tagccctactaggtgctatgacagccggcatcttcctgtttttcatgcaggggaaaggaatagggaaattgtcaa

SEQ ID NO: 56122 - DNA, 75 bp, Artificial Sequence
  Synthetic
agagaagaccaatggtgcggctcattgattgggctaacaagcagggctacctgggcaaagaacatccaaacagca

SEQ ID NO: 56123 - DNA, 75 bp, Artificial Sequence
  Synthetic
ccggagcggacacacaaggatcaaattggatacagaaggagacattggtcactttcaaaaatccccatgcgaaga

SEQ ID NO: 56124 - DNA, 75 bp, Artificial Sequence
  Synthetic
cattgaagacaatccagagatcgaagatgacattttccgaaagaaaagattgaccatcatggacctccatccagg

SEQ ID NO: 56125 - DNA, 75 bp, Artificial Sequence
  Synthetic
gcaatgaggaatacacagattacatgccatccatgaagagattcagaagggaagaggaagaggcaggtgtcctgt

SEQ ID NO: 56126 - DNA, 75 bp, Artificial Sequence
  Synthetic
gactttcataagatcaacaatgtcattggtcatggcttggaggaccattatggctgtgttgtttgtggtcacact

SEQ ID NO: 56127 - DNA, 75 bp, Artificial Sequence
  Synthetic
gaagtcaaaagttgccactggccaaagtcacacactctctggagtaatggagtgctagaaagtgagatgataatt

SEQ ID NO: 56128 - DNA, 75 bp, Artificial Sequence
  Synthetic
aatgggtatcatgatgttaaaattgttgactgaatttcagccacaccagttatggaccaccttattgtctctgac

SEQ ID NO: 56129 - DNA, 75 bp, Artificial Sequence
  Synthetic
acaggatggggatgggaacgacgtacctagctctgatggccacttttaaaatgagaccaatgtttgctgtagggc

SEQ ID NO: 56130 - DNA, 75 bp, Artificial Sequence
  Synthetic
cggaaccataggcgccgtgtctctagacttttctcctggaacgtcaggatctccaattgtcgacaaaaaaggaaa

SEQ ID NO: 56131 - DNA, 75 bp, Artificial Sequence
  Synthetic
atggaagctgtacgcatggcgtagtggactagcggttagaggagacccctcccttacaaatcgcagcaataacgg

SEQ ID NO: 56132 - DNA, 75 bp, Artificial Sequence
  Synthetic
cccttacaaatcgcagcaataacgggggcccaaggtgagatgaagctgtagtctcactggaaggactagaggtta

SEQ ID NO: 56133 - DNA, 75 bp, Artificial Sequence
  Synthetic
atggtgttgccgatcctgcacattaccaccactaagatacagaggtgaggatggatgctggtacggaatggaaat

SEQ ID NO: 56134 - DNA, 75 bp, Artificial Sequence
  Synthetic
ccactttcatgaattgatcatgaaagatggaagaaagttggtggttccctgcagaccccaggacgaattaatagg

SEQ ID NO: 56135 - DNA, 75 bp, Artificial Sequence
  Synthetic
aacccatatatgccctcagtcatagaaaaaatggaaacactgcaaaggaaatatggaggagccttagtgaggaat

SEQ ID NO: 56136 - DNA, 75 bp, Artificial Sequence
  Synthetic
cagaccaacttttgcagctggactactcttgagaaagctgacctccaaggaattgatgatgaccaccataggaat

SEQ ID NO: 56137 - DNA, 75 bp, Artificial Sequence
  Synthetic
ccccacggtggacgggataacagtaatagatctagaaccaatatcctatgacccaaaatttgaaaagcaattagg

SEQ ID NO: 56138 - DNA, 75 bp, Artificial Sequence
  Synthetic
cagttggcgaagagattctcaagaggattgctgaacggccaaggaccaatgaaattggtcatggcgttcatagct

SEQ ID NO: 56139 - DNA, 75 bp, Artificial Sequence
  Synthetic
gtgagctgcacaacactggcagtggtgtccgtttccccactgctcttaacatcctcacagcagaaagcggattgg

SEQ ID NO: 56140 - DNA, 75 bp, Artificial Sequence
  Synthetic
gaagaggtttaggaaggaggaggagtcggagggagccatttggtaaacgtaggaagtgaaaaagaggctaactgt

SEQ ID NO: 56141 - DNA, 75 bp, Artificial Sequence
  Synthetic
acatctccgaaatgggagctaatttccgagccgacagggtgatagacccaagacggtgtctgaaaccggtaatac

SEQ ID NO: 56142 - DNA, 75 bp, Artificial Sequence
  Synthetic
caacatgggctctctgcgaagtattgactttggcaacaggaccaatcatgaccttgtgggagggcaacccgggaa

SEQ ID NO: 56143 - DNA, 75 bp, Artificial Sequence
  Synthetic
atctgggagctgtggtgcaagctgacatgggatgtgttataaactggaaaggcaaagaactcaaatgtggaagtg

SEQ ID NO: 56144 - DNA, 75 bp, Artificial Sequence
  Synthetic
gtgtccacattgtgggaaggaaatccagggagattctggaacacaaccattgcagtgtcaatggcaaacatcttt

SEQ ID NO: 56145 - DNA, 75 bp, Artificial Sequence
  Synthetic
agtgatattacaaaatgcatggaaagtgagttgcacaatactggcagtggtgtccgtttccccactgcttttaac

SEQ ID NO: 56146 - DNA, 75 bp, Artificial Sequence
  Synthetic
ggaaagaaagtgatacaactcagcaggaagacctttgattctgaatacatcaagactaggaccaatgattgggac

SEQ ID NO: 56147 - DNA, 75 bp, Artificial Sequence
  Synthetic
caagactaggaccaatgattgggactttgtggtcacgactgacatttcagaaatgggtgctaacttcaaggctga

SEQ ID NO: 56148 - DNA, 75 bp, Artificial Sequence
  Synthetic
acacggtcacttacaaatgccccctcattactgaagtggagcctgaagacattgactgctggtgcaaccttacat

SEQ ID NO: 56149 - DNA, 75 bp, Artificial Sequence
  Synthetic
cattactgaagtggagcctgaagacattgactgctggtgcaaccttacatcgacatgggtgacctacggaacgtg

SEQ ID NO: 56150 - DNA, 75 bp, Artificial Sequence
  Synthetic
gaacaaaagtcaggtcggattaagccatagtacgggaaaaactatgctacctgtgagccccgtccaaggacgtta

SEQ ID NO: 56151 - DNA, 75 bp, Artificial Sequence
  Synthetic
cggcgtcctatgggacgtacccagccccccagagacacagaaagcagaactggaagaaggggtttataggatcaa

SEQ ID NO: 56152 - DNA, 75 bp, Artificial Sequence
  Synthetic
cccaagatgaaatgaagctgtaacctcactggaagggcctagagggttaggaggagtcccccccaaaacaaaaga

SEQ ID NO: 56153 - DNA, 75 bp, Artificial Sequence
  Synthetic
tcactggaagggcctagagggttaggaggagtcccccccaaaacaaaagacagcatattgacgctgggaaagtcc

SEQ ID NO: 56154 - DNA, 75 bp, Artificial Sequence
  Synthetic
gaatttggtcaaactccattcaggggttgatgtgttctacaaacccactgagcaggtggacaccctgctctgtga

SEQ ID NO: 56155 - DNA, 75 bp, Artificial Sequence
  Synthetic
caggggtgtacccaatgtcaataccagcaaccctttttgtgtggtatttttggcagaaaaagaaacagagatcag

SEQ ID NO: 56156 - DNA, 75 bp, Artificial Sequence
  Synthetic
ggactgccaatccgttatcagaccccagctgtgaaatcagaacacacaggaagagagattgtagacctcatgtgc

SEQ ID NO: 56157 - DNA, 75 bp, Artificial Sequence
  Synthetic
gataccttccagcaatagtcagagaagccataaaacgaggcttgagaacattaatcctggcccccactagagttg

SEQ ID NO: 56158 - DNA, 75 bp, Artificial Sequence
  Synthetic
ttgggaatggcactgttccttgaagaaatgctcaggactcgagtaggaacgaaacatgcaatattactagtcgca

SEQ ID NO: 56159 - DNA, 75 bp, Artificial Sequence
  Synthetic
atgacaggagacattaaaggaatcatgcaggcaggaaaacgatccttgcggcctcagcccactgagctgaagtac

SEQ ID NO: 56160 - DNA, 75 bp, Artificial Sequence
  Synthetic
ttaggacaagtaatgctcctaatcctctgcgtgactcaagtattaatgatgaggactacatgggctctgtgtgag

SEQ ID NO: 56161 - DNA, 75 bp, Artificial Sequence
  Synthetic
acacagggttcgactggataacagactaccaagggaaaactgtgtggtttgttcccagcataaaagctggaaatg

SEQ ID NO: 56162 - DNA, 75 bp, Artificial Sequence
  Synthetic
cctgaaggcgaagtcggagccatagccctagactttaaacccggcacatctggatctcccatcgtaaacagagag

SEQ ID NO: 56163 - DNA, 75 bp, Artificial Sequence
  Synthetic
aaatcaaacaaggcaagaagtcaggccggattaagccatagtacggtaagagctatgctgcctgtgagccccgtc

SEQ ID NO: 56164 - DNA, 75 bp, Artificial Sequence
  Synthetic
aaagcatcacaagaagggcctctaccagagattgaggacgaggtgtttaggaaaagaaacttaacaataatggac

SEQ ID NO: 56165 - DNA, 75 bp, Artificial Sequence
  Synthetic
tgtcatactccatgtgcacaggaaagtttaaagttgtgaaggaaatagcagaaacacaacatggaacaatagtca

SEQ ID NO: 56166 - DNA, 75 bp, Artificial Sequence
  Synthetic
cagagaacaccccaagataaccaattaacttatgttgtcatagccatcctcacagtggtggccgcaaccatggca

SEQ ID NO: 56167 - DNA, 75 bp, Artificial Sequence
  Synthetic
agaaaagtcccagactgtgcacaagggaagagttcatctcaaaagttaggtcaaatgcagccataggcgcagtct

SEQ ID NO: 56168 - DNA, 75 bp, Artificial Sequence
  Synthetic
ggagtaacccagaatgggagattgataacagccaaccccatagtcactgacaaagaaaaaccagtcaacattgag

SEQ ID NO: 56169 - DNA, 75 bp, Artificial Sequence
  Synthetic
tggtgcttcacaggggaaagaaataaccaaattttagaagaaaacatggaggttgaaatttggactagagaggga

SEQ ID NO: 56170 - DNA, 75 bp, Artificial Sequence
  Synthetic
atatatgctgacgacacagcaggctgggacacgagaatcactgaggatgaccttttaaatgaagaactgatcaca

SEQ ID NO: 56171 - DNA, 75 bp, Artificial Sequence
  Synthetic
gtcctcagacccacaccgaaaggagcggtaatggacatcatatccaggaaagaccaaagaggtagtggacaggtt

SEQ ID NO: 56172 - DNA, 75 bp, Artificial Sequence
  Synthetic
gtgcaaggcgcatggccatcttgggagacacagcctgggactttggatcagtaggtggtgttttaaattcattag

SEQ ID NO: 56173 - DNA, 75 bp, Artificial Sequence
  Synthetic
caccagaagggaaagtggtggacctcggttgcggtagagggggctggtcatactattgtgggggactaaagaatg

SEQ ID NO: 56174 - DNA, 75 bp, Artificial Sequence
  Synthetic
gaatagggaaattgtcaatgggtttgataaccattgcggtggctagtggcttgctctgggtagcagaaattcaac

SEQ ID NO: 56175 - DNA, 75 bp, Artificial Sequence
  Synthetic
cacaggagagacgcttggagagaaatggaaaaaccgattgaattcattggggaagagtgaattccagatctacaa

SEQ ID NO: 56176 - DNA, 75 bp, Artificial Sequence
  Synthetic
acacgggagaagaagtgcaggtgattgctgttgaaccggggaagaacccaaaaaatgtacagacagcgccaggta

SEQ ID NO: 56177 - DNA, 75 bp, Artificial Sequence
  Synthetic
tgaccctgggaatgtgctgcataatcacggctagcatccttctatggtacgcacagatacagccacactggatag

SEQ ID NO: 56178 - DNA, 75 bp, Artificial Sequence
  Synthetic
gagccagaatctcgcagggggctggatggagcttgagagaaacagcctgtctgggcaaagcttacgcccagatgt

SEQ ID NO: 56179 - DNA, 75 bp, Artificial Sequence
  Synthetic
tgaagccctaggattcttgaatgaagatcactggttctccagagagaactccctgagtggagtggaaggagaagg

SEQ ID NO: 56180 - DNA, 75 bp, Artificial Sequence
  Synthetic
tagacggcgaataccgcctgaagggtgagtccaggaagaccttcgtggaactcatgaggaggggtgacctcccag

SEQ ID NO: 56181 - DNA, 75 bp, Artificial Sequence
  Synthetic
tggagaacctcctgtggaagcaaatagctaatgaactgaactacatattatgggaaaacaacatcaaattaacga

SEQ ID NO: 56182 - DNA, 75 bp, Artificial Sequence
  Synthetic
caccatagaaacgttgatgctcctagctttgatagctgtgttaactggtggagtgacgttgttcttcctatcagg

SEQ ID NO: 56183 - DNA, 75 bp, Artificial Sequence
  Synthetic
cagcaggaagaagaagcgtctcaggtgacctaatattagaaatagggaaacttccacaacatctaacgcaaaggg

SEQ ID NO: 56184 - DNA, 75 bp, Artificial Sequence
  Synthetic
acacagatggcaatgacagacacgactccatttggacaacagcgcgttttcaaagagaaagtggacacgagaacc

SEQ ID NO: 56185 - DNA, 75 bp, Artificial Sequence
  Synthetic
aacctgcacatggccaaaatcacacactctttggagcaatggtgtgctagagagtgacatgatcatcccaaagag

SEQ ID NO: 56186 - DNA, 75 bp, Artificial Sequence
  Synthetic
caggaaaattttggaacacaacaatagcagtctctatggctaacattttcagagggagttatttggctggagctg

SEQ ID NO: 56187 - DNA, 75 bp, Artificial Sequence
  Synthetic
atggagtaatggagttttggaaagtgaaatgataatcccaaagatatatggaggaccaatatctcagcacaacta

SEQ ID NO: 56188 - DNA, 75 bp, Artificial Sequence
  Synthetic
agcagtctctatggctaacattttcagagggagttatttggctggagctggactcctcttttccatcatgaggaa

SEQ ID NO: 56189 - DNA, 75 bp, Artificial Sequence
  Synthetic
ggttagaggagacccctcccatcactgacaaaacgcagcaaaaaagggggcccgaagccaggaggaagctgtact

SEQ ID NO: 56190 - DNA, 75 bp, Artificial Sequence
  Synthetic
cagaaaattgtgggacaagaggcccatcactgaggacaacaacagtgtcagggaagttgatacacgaatggtgtt

SEQ ID NO: 56191 - DNA, 75 bp, Artificial Sequence
  Synthetic
gccaactttaaagctgagagggttatagaccccagacgctgcatgaaaccagttatattgacagacggcgaagag

SEQ ID NO: 56192 - DNA, 75 bp, Artificial Sequence
  Synthetic
tccgtggagctaccaaattctttagaggagctaggggatggacttgcaatgggtatcatgatgttaaaattattg

SEQ ID NO: 56193 - DNA, 75 bp, Artificial Sequence
  Synthetic
tgggaaggaggacatgacctcactgtagtggctggggatgtgaagggggtgttgaccaaaggcaagagagcactc

SEQ ID NO: 56194 - DNA, 75 bp, Artificial Sequence
  Synthetic
atagccaaccaggcagtggtcctgatgggtttagacaaaggatggccaatatcgaaaatggacttaggcgtacca

SEQ ID NO: 56195 - DNA, 75 bp, Artificial Sequence
  Synthetic
gatgggaaagagagagaagaagataggggaattcggcaaagcaaaaggcagcagagccatatggtacatgtggct

SEQ ID NO: 56196 - DNA, 75 bp, Artificial Sequence
  Synthetic
ccgcatcagcttggacgctgtatgccgtggctacaacatttgttacaccaatgctgagacatagcattgagaatt

SEQ ID NO: 56197 - DNA, 75 bp, Artificial Sequence
  Synthetic
acgtcagaacatggcggtagggcctacaggcatgcggtggaggaactaccagaaacaatggaaacactcctactc

SEQ ID NO: 56198 - DNA, 75 bp, Artificial Sequence
  Synthetic
gagcggagtggaaggagaagggctgcacaagctgggttacattctaagagaagtgagcaagaaagaaggaggagc

SEQ ID NO: 56199 - DNA, 75 bp, Artificial Sequence
  Synthetic
tggtatgggatggagattaggcccttgagtgaaaaagaagagaacatggtcaaatcacaggtgacggccggacag

SEQ ID NO: 56200 - DNA, 75 bp, Artificial Sequence
  Synthetic
agagatgcactagacaacttggcggtgctgcacacggctgaagcgggtggaaaggcatacaatcatgctctcagt

SEQ ID NO: 56201 - DNA, 75 bp, Artificial Sequence
  Synthetic
tcagcggccatcaaagacaacagagccgttcatgccgatatgggttattggatagaaagtgcactcaatgacaca

SEQ ID NO: 56202 - DNA, 75 bp, Artificial Sequence
  Synthetic
gaagaaatcgctgtacagaactggttagcaagagtggggcgtgaaaggctatcaagaatggccatcagtggagat

SEQ ID NO: 56203 - DNA, 75 bp, Artificial Sequence
  Synthetic
gtctggttggcctacaaagtggcagctgaaggcatcaactacgcagacagaaggtggtgttttgatggaattaag

SEQ ID NO: 56204 - DNA, 75 bp, Artificial Sequence
  Synthetic
ttactacgagccctcatcatgttgggggacactatgtctggtagaataggaggacagatccacctagccatcatg

SEQ ID NO: 56205 - DNA, 75 bp, Artificial Sequence
  Synthetic
caagaggatggaatgattggacacaagtgcctttctgttcacaccactttcatgagttaatcatgaaagacggtc

SEQ ID NO: 56206 - DNA, 75 bp, Artificial Sequence
  Synthetic
gggtgattcaattgagcaggaaaacctttgacacagagtaccaaaaaacaaaaaataacgactgggactacgtcg

SEQ ID NO: 56207 - DNA, 75 bp, Artificial Sequence
  Synthetic
caatgcttccgggaacatagtgtcatcagtgaacatgatttcaagaatgctgattaacagattcaccatgagaca

SEQ ID NO: 56208 - DNA, 75 bp, Artificial Sequence
  Synthetic
atggtaataggaatggccatgacaacggtgctttcaattccacatgaccttatggaactcattgatggaatatca

SEQ ID NO: 56209 - DNA, 75 bp, Artificial Sequence
  Synthetic
accaatatgggagcccaactaatcagacagatggagggagaaggagtctttaaaggcatccagcatctgacagcc

SEQ ID NO: 56210 - DNA, 75 bp, Artificial Sequence
  Synthetic
catagccatcctcacagtggtggccgcaaccatggcaaacgaaatgggttttctggaaaaaacaaagaaagacct

SEQ ID NO: 56211 - DNA, 75 bp, Artificial Sequence
  Synthetic
gaacccgcaacatcggaattgaaagtgagacaccaaacctagacataattgggaaaagaatagaaaaaataaaac

SEQ ID NO: 56212 - DNA, 75 bp, Artificial Sequence
  Synthetic
caggctcaagcccaatcatagaagtgaagcaggatgaagatggctctttctccatacgggacgtcgaggaaacca

SEQ ID NO: 56213 - DNA, 75 bp, Artificial Sequence
  Synthetic
gtccctaacagccatagctaaccaagccacagtgctaatgggtctcggaaaaggatggccattgtcaaagatgga

SEQ ID NO: 56214 - DNA, 75 bp, Artificial Sequence
  Synthetic
ctctggaaagaactaggaaagaaaaagacacctagaatgtgcaccagagaagaattcacaaaaaaggtgagaagc

SEQ ID NO: 56215 - DNA, 75 bp, Artificial Sequence
  Synthetic
ttttgggagctggttgacaaggaaagaaacctccatcttgaagggaaatgtgaaacatgtgtatacaacatgatg

SEQ ID NO: 56216 - DNA, 75 bp, Artificial Sequence
  Synthetic
ggacttcaagcctggaacttcaggatctcctatcataaacagagagggaaaggtagtgggactgtatggcaatgg

SEQ ID NO: 56217 - DNA, 75 bp, Artificial Sequence
  Synthetic
tcaccgatccttctagtgtcgcggctagaggatacatctcgaccagggtggaaatgggagaggcagcagccatct

SEQ ID NO: 56218 - DNA, 75 bp, Artificial Sequence
  Synthetic
atctaaccataatggatctccatcccgggtcaggaaagacgcggaaatatcttccagctattgttagagaggcaa

SEQ ID NO: 56219 - DNA, 75 bp, Artificial Sequence
  Synthetic
gaagggaaagtagtggaccttggttgtggcagagggggctggtcatactattgtggaggattaaagaatgtaaga

SEQ ID NO: 56220 - DNA, 75 bp, Artificial Sequence
  Synthetic
aagtgtggaagctgcgtttacaacatgatgggcaagagagagaagaaacttggagagtttggcaaagcaaaaggc

SEQ ID NO: 56221 - DNA, 75 bp, Artificial Sequence
  Synthetic
attgtgttgtgaaacctttagatgatagatttgcaagagctctaacagctctaaatgacatgggaaaggttagga

SEQ ID NO: 56222 - DNA, 75 bp, Artificial Sequence
  Synthetic
gtacaacatgatgggaaaaagagagaagaaacttggagaatttggcaaagcaaaaggcagcagagccatatggta

SEQ ID NO: 56223 - DNA, 75 bp, Artificial Sequence
  Synthetic
ttcttaacccgtacatgccctcagtcattgaaagaatggaaaccttacaacggaaatacggaggagccttggtga

SEQ ID NO: 56224 - DNA, 75 bp, Artificial Sequence
  Synthetic
ggaagacttttgacacagaatatcaaaagactaaactgaatgattgggactttgtggtgacaacagacatttcag

SEQ ID NO: 56225 - DNA, 75 bp, Artificial Sequence
  Synthetic
accatggaagctgtacgcatggtgtagtggactagcggttagaggagacccctcccttaaaaatcgcagcaaaaa

SEQ ID NO: 56226 - DNA, 75 bp, Artificial Sequence
  Synthetic
cagcctgtagctccacctgggaaggtgtaagaaaatccgggaggccacaaaccatggaagctgtacgcatggtgt

SEQ ID NO: 56227 - DNA, 75 bp, Artificial Sequence
  Synthetic
gaagccaaagagggactaaaaagaggagaaacaaccaaacatgcagtgtcgagaggaacagccaaactgaggtgg

SEQ ID NO: 56228 - DNA, 75 bp, Artificial Sequence
  Synthetic
tgtggatccctgataggcttgacagcgagggccacctgggccaccaacatacaagtagccataaaccaagtgaga

SEQ ID NO: 56229 - DNA, 75 bp, Artificial Sequence
  Synthetic
ttcacaaaaaaggtgagaagcaatgcagccttgggggccatattcaccgatgagaacaagtggaaatcggcgcgt

SEQ ID NO: 56230 - DNA, 75 bp, Artificial Sequence
  Synthetic
ccaatgggacagcgcgaaagctgctgttgaggatgaagatttttggaaacttgtggacagagaacgtgaactcca

SEQ ID NO: 56231 - DNA, 75 bp, Artificial Sequence
  Synthetic
tgtaaacaaggaaaaagtggttgggcgcgttatctcatccacccctttggctgagaataccaacagtgtaaccaa

SEQ ID NO: 56232 - DNA, 75 bp, Artificial Sequence
  Synthetic
catagaattagaacccccctttggggacagctacatagtgataggtgttggaaacagcgcattaacactccattg

SEQ ID NO: 56233 - DNA, 75 bp, Artificial Sequence
  Synthetic
cagtggaggaactaccagaaacaatggaaacactcctactcctgggactcatgatcctgttaacaggtggagcaa

SEQ ID NO: 56234 - DNA, 75 bp, Artificial Sequence
  Synthetic
atttgtgtagttgcttccagcggtatgttatggatggctgatgtcccactccaatggatcgcgtcggccatagtc

SEQ ID NO: 56235 - DNA, 75 bp, Artificial Sequence
  Synthetic
aataaaaacagcatattgacgctgggagagaccagagatcctgctgtctcctcagcatcatccaggcacagaacg

SEQ ID NO: 56236 - DNA, 75 bp, Artificial Sequence
  Synthetic
ggacagcctttaaacaatgatgaggaccacgctcattggacagaagcaaaaatgctccttgacaatataaacaca

SEQ ID NO: 56237 - DNA, 75 bp, Artificial Sequence
  Synthetic
tcaatatgctgaaacgcgcgagaaaccgcgtgtcaactggttcacagttggcgaagagattctcaaaaggactgc

SEQ ID NO: 56238 - DNA, 75 bp, Artificial Sequence
  Synthetic
tggctgcaatagtagcagccaatgaaatgggactgttggaaaccacaaagagagatttaggaatgtccaaagaac

SEQ ID NO: 56239 - DNA, 75 bp, Artificial Sequence
  Synthetic
ggaagcacaactaattaggcaaatggagggggaaggaatcttcaaaagcatccagcacttgacagcctcagaaga

SEQ ID NO: 56240 - DNA, 75 bp, Artificial Sequence
  Synthetic
actttttcaaagcaaaaggaccccttctaatgttaaatacacccgcagttcggaagcttgcttaacacagttcta

SEQ ID NO: 56241 - DNA, 75 bp, Artificial Sequence
  Synthetic
ttttggaactgcatatggagttttgttcagcggtgtttcttggaccatgaaaataggaataggggttctgctgac

SEQ ID NO: 56242 - DNA, 75 bp, Artificial Sequence
  Synthetic
atcacatggataggaatgaactcacgcagcacctcactgtctgtgtcactagtattggtgggaattgtgacactg

SEQ ID NO: 56243 - DNA, 75 bp, Artificial Sequence
  Synthetic
tagaaagagtgtgagcaaattacatgtacttgtgcataaattcagcagtaatgtataatgatctaaattaaataa

SEQ ID NO: 56244 - DNA, 75 bp, Artificial Sequence
  Synthetic
actaggaaacacatgatattagctgtggtaatcactctttgtgctatcatcctgggaggcctcacatggatggac

SEQ ID NO: 56245 - DNA, 75 bp, Artificial Sequence
  Synthetic
ctaacataaaacaaggctagaagtcaggtcggattaagccatagtacggaaaaaactatgctacctgtgagcccc

SEQ ID NO: 56246 - DNA, 75 bp, Artificial Sequence
  Synthetic
atgtataatgatctaaattaaataaaaaatttaaatagttttttaaatatgaggatgctgattttgagagccact

SEQ ID NO: 56247 - DNA, 75 bp, Artificial Sequence
  Synthetic
ctgtacgcatccatggatgctgtacagcttccatggaagctgtacgcatccatggatgcgtacagcttccatgga

SEQ ID NO: 56248 - DNA, 75 bp, Artificial Sequence
  Synthetic
agaaaaataaggccatcaagatactgattggattcaggaaggagataggccgcatgctgaacatcttgaacggga

SEQ ID NO: 56249 - DNA, 75 bp, Artificial Sequence
  Synthetic
cccagatgagcaaggcgcatgcccttctcggaggaccaacctagggacttggttcaggtgggtggtgttttaatt

SEQ ID NO: 56250 - DNA, 75 bp, Artificial Sequence
  Synthetic
agcttccatggaagctgtacgcatccatggatgcgtacagcttccatggatgcgtacagcttttccatggatgct

SEQ ID NO: 56251 - DNA, 75 bp, Artificial Sequence
  Synthetic
ggtgagagttacatcgtgataggagcaggtgaaaaagctttgaaactaagctggttcaagaaaggaagcagcata

SEQ ID NO: 56252 - DNA, 75 bp, Artificial Sequence
  Synthetic
gctttttctatcatgaaatcagttggaacaggaaagagagggacagggtcacagggtgaaaccttgggagaaaag

SEQ ID NO: 56253 - DNA, 75 bp, Artificial Sequence
  Synthetic
tggccatgcgtacagcttccatggccatgcgtacagcttccatggaagctgtacgcatggccatggatgcgtacg

SEQ ID NO: 56254 - DNA, 75 bp, Artificial Sequence
  Synthetic
catgcgtacagcttccatggaagctgtacgcatggccatggatgcgtacgcatggatggattgcgtacacgcttc

SEQ ID NO: 56255 - DNA, 75 bp, Artificial Sequence
  Synthetic
gctgagagggttatagaccccagacgctgcatgaaaccagtcatactaacagacggtgaagagcgggtgattctg

SEQ ID NO: 56256 - DNA, 75 bp, Artificial Sequence
  Synthetic
gacagctcatgcaaagaagcaggaagtagtcgtactaggatcacaagaaggagcaatgcacactgcgttgaccgg

SEQ ID NO: 56257 - DNA, 75 bp, Artificial Sequence
  Synthetic
tggcattgggttgctattcacaagtgaacccactgactctaacagcggcagtacttttgctaatcacacattatg

SEQ ID NO: 56258 - DNA, 75 bp, Artificial Sequence
  Synthetic
tggaagttgtgtgacgacgatggcaaaaaacaaaccaacattggattttgaactgataaaaacagaagccaaaca

SEQ ID NO: 56259 - DNA, 75 bp, Artificial Sequence
  Synthetic
aacagtggaagaaagcagaaccataagagtcttgaagatggttgaaccatggctaaaaaataaccagttttgcat

SEQ ID NO: 56260 - DNA, 75 bp, Artificial Sequence
  Synthetic
cgacctatggatggaacctagtaaaactgcactccgggaaagatgtattctttacaccacctgagaaatgtgaca

SEQ ID NO: 56261 - DNA, 75 bp, Artificial Sequence
  Synthetic
tgagctaaagtattcatggaaaacatggggtaaagcaaaaatgctctccacagagtctcataaccaaacctttct

SEQ ID NO: 56262 - DNA, 75 bp, Artificial Sequence
  Synthetic
tacaaaggaaacatggaggaatgcttgtgagaaatccactctcacgaaactccacgcacgaaatgtactggatat

SEQ ID NO: 56263 - DNA, 75 bp, Artificial Sequence
  Synthetic
gcatagacaacagagccgttcatgccgatatgggttattggatggaaagtgcaccctctgattcatgcaagatgg

SEQ ID NO: 56264 - DNA, 75 bp, Artificial Sequence
  Synthetic
cactaatgaggtccacacctggacagagcaatacaaatttcaagcagactcccctaagagactggcgacagccat

SEQ ID NO: 56265 - DNA, 75 bp, Artificial Sequence
  Synthetic
ataggagacccaccatagagaaagatgtggatttaggagcggggacccgacatgtcaatgcggaaccagaaacac

SEQ ID NO: 56266 - DNA, 75 bp, Artificial Sequence
  Synthetic
agttgttagtctacgtggaccgacaaagaacagtttctttgaggaagctttgcttaacgtagttctaacagtttt

SEQ ID NO: 56267 - DNA, 75 bp, Artificial Sequence
  Synthetic
tgtactcctctcccagagcaccataccagagaccatacttgaactgactgatgcgttggccttgggcatgatggt

SEQ ID NO: 56268 - DNA, 75 bp, Artificial Sequence
  Synthetic
atggagtcgtgaaactcctcacgaaaccatgggatgtggtgcccatggtgacacagatggcaatgacggatacaa

SEQ ID NO: 56269 - DNA, 75 bp, Artificial Sequence
  Synthetic
accccatagttactgacaaagaaaaaccagtcaacattgaggcagaaccgccttttggtgagagttacatcgtga

SEQ ID NO: 56270 - DNA, 75 bp, Artificial Sequence
  Synthetic
aagaacagtttctttgaggaagctttgcttaacgtagttctaacagtttttgattagagagcagatctctgatga

SEQ ID NO: 56271 - DNA, 75 bp, Artificial Sequence
  Synthetic
accaacagcagggatactgaagagatggggaacgatcaaaaaatcaaaggctatcagtgtactgagaggatttag

SEQ ID NO: 56272 - DNA, 75 bp, Artificial Sequence
  Synthetic
cattttagccagttctctcttgaagaatgacattcccatgacaggaccattagtggctggagggcttctcactgt

SEQ ID NO: 56273 - DNA, 75 bp, Artificial Sequence
  Synthetic
ctatcagtgtactgagaggatttagaaaggaaattgggaggatgctgaacattttgaacaggagacgcagaacag

SEQ ID NO: 56274 - DNA, 75 bp, Artificial Sequence
  Synthetic
aaaggaatcatgcaggcaggaaaacgatctctgcggcctcagcccactgagctgaagtattcatggaaaacatgg

SEQ ID NO: 56275 - DNA, 75 bp, Artificial Sequence
  Synthetic
acacgcaatggggagccacacatgattgtcagcaagaatgagaaaggaaagagcctcctttttaaaacagagaat

SEQ ID NO: 56276 - DNA, 75 bp, Artificial Sequence
  Synthetic
ttgtcagcaagaatgagaaaggaaagagcctcctttttaaaacagagaatggaataaacatgtgcacccttatgg

SEQ ID NO: 56277 - DNA, 75 bp, Artificial Sequence
  Synthetic
actgtggaaatagaggaccctctttaagaacaactactgcctctggaaaactcataacagaatggtgctgccgat

SEQ ID NO: 56278 - DNA, 75 bp, Artificial Sequence
  Synthetic
ctcggattcttaaatgaagaccattggttctcgcgtgaaaactcttacagtggagtagaaggagaaggactgcat

SEQ ID NO: 56279 - DNA, 75 bp, Artificial Sequence
  Synthetic
ctctgcgtgactcaagtattgatgatgaggactacatgggctttatgtgaagctctaaccttagcgaccgggccc

SEQ ID NO: 56280 - DNA, 75 bp, Artificial Sequence
  Synthetic
atcaacctgggtgacgtacgggacgtgtagctcgacaggagagcataggagggagaaaaggtcagtcgcacttgt

SEQ ID NO: 56281 - DNA, 75 bp, Artificial Sequence
  Synthetic
ggaacaagacatgtggcagtggaaccagaggtagccaacctagacatcattggccagaggatagagaacataaaa

SEQ ID NO: 56282 - DNA, 75 bp, Artificial Sequence
  Synthetic
cccacacgtaggaatggggctggaaacgagaactgaaacatggatgtcatcagaaggagcatggaaacaagccca

SEQ ID NO: 56283 - DNA, 75 bp, Artificial Sequence
  Synthetic
ctgcctctggaaaactcataacagaatggtgctgccgatcttgcacattaccaccgctaagatacagaggtgagg

SEQ ID NO: 56284 - DNA, 75 bp, Artificial Sequence
  Synthetic
tgactcccatgctgagacacaccatagaaaacacgtcggccaacctatctctagcagccattgccaaccaggcag

SEQ ID NO: 56285 - DNA, 75 bp, Artificial Sequence
  Synthetic
ctgttttggcgtacacaatagggacaacacatttccaaagagccctaatctttatccttttaactgccgttgctc

SEQ ID NO: 56286 - DNA, 75 bp, Artificial Sequence
  Synthetic
cgtcacaacaatggccaagaacaaaccaacattagactttgaactaataaaaacagaggccaagcaactagcaac

SEQ ID NO: 56287 - DNA, 75 bp, Artificial Sequence
  Synthetic
atgacaggtttgccaatgccctgcttgccctgaatgacatgggaaaagttaggaaggacatacctcaatggcagc

SEQ ID NO: 56288 - DNA, 75 bp, Artificial Sequence
  Synthetic
agggagtcacggctgagataacaccccaggcatcaaccgttgaagccatcttgcctgaatatggaacccttgggc

SEQ ID NO: 56289 - DNA, 75 bp, Artificial Sequence
  Synthetic
ttcaagcggacatgggttgtgtggtgtcatggagtgggagagaattgaagtgtggaagcggaatttttgtggttg

SEQ ID NO: 56290 - DNA, 75 bp, Artificial Sequence
  Synthetic
ctcgctgcccaacccaaggtgaacccagcctagtagaggagcaggacaaaagattcgtttgcaggcattcgatgg

SEQ ID NO: 56291 - DNA, 75 bp, Artificial Sequence
  Synthetic
tggatagaggttggggtaatggatgtggtctgtttgggaaaggaggcattgtgacctgtgcgatgttcacatgct

SEQ ID NO: 56292 - DNA, 75 bp, Artificial Sequence
  Synthetic
tttcatgaattgatcatgaaagatggaagaaagttggtagttccctgcagaccccaggatgaattaatcgggaga

SEQ ID NO: 56293 - DNA, 75 bp, Artificial Sequence
  Synthetic
tgggcctatcatggcagctacgaaacaaaacagactggatcagcatcatccatggtgaacggagtggttaggctg

SEQ ID NO: 56294 - DNA, 75 bp, Artificial Sequence
  Synthetic
tgaagaaaatggagggaaaagttgtgcagccagaaaacctagagtacaccatagtcataacaccccattcaggag

SEQ ID NO: 56295 - DNA, 75 bp, Artificial Sequence
  Synthetic
gcagccagaaaacctagagtacaccatagtcataacaccccattcaggagaggaacatgctgtggggaatgatac

SEQ ID NO: 56296 - DNA, 75 bp, Artificial Sequence
  Synthetic
ggcatggaaatcagaccagtaaaggagaaggaggagaatctagttaggtcaatggtctctgcagggtcaggagaa

SEQ ID NO: 56297 - DNA, 75 bp, Artificial Sequence
  Synthetic
agatcctagccaaagctattttcaaactaacctatcaaaacaaagtggtgaaagtcctcagacccacaccgagag

SEQ ID NO: 56298 - DNA, 75 bp, Artificial Sequence
  Synthetic
ttggatccagaaagagatgctagtaacattcaaaaatccccatgcgaaaagacaagacgttgtcgtcttgggatc

SEQ ID NO: 56299 - DNA, 75 bp, Artificial Sequence
  Synthetic
tctggactacatgccttcaatgaagagattcaggaaggaggaggagtcagagggagccatttggtaaacgcagga

SEQ ID NO: 56300 - DNA, 75 bp, Artificial Sequence
  Synthetic
ctgtcaataacaatatcagaagatggtagcatgtcgataaaaaatgaagaggaagaacaaacactgaccatactc

SEQ ID NO: 56301 - DNA, 75 bp, Artificial Sequence
  Synthetic
aagtcacagaagtgcgaggatacacaaaaggcggcccaggacacgaagaaccagtacctatgtctacatatggat

SEQ ID NO: 56302 - DNA, 75 bp, Artificial Sequence
  Synthetic
accatttccatgagttaatcatgaaggacggtcgtgtacttgtagttccatgtagaaaccaagatgaactgattg

SEQ ID NO: 56303 - DNA, 75 bp, Artificial Sequence
  Synthetic
gtggggatgtagctccatcgtggggatgtagctccatcgtgggggatgtagctccatcgtggggatgtagctcca

SEQ ID NO: 56304 - DNA, 75 bp, Artificial Sequence
  Synthetic
atgtagctccatcgtgggggatgtagctccatcgtggggatgtagctccatcgtggggatgtagctccatcgtgg

SEQ ID NO: 56305 - DNA, 75 bp, Artificial Sequence
  Synthetic
aagaacaaccaaatcctggaagaaaatgtggaagttgaaatctggacaaaagaaggagaaaggaagaaattgaaa

SEQ ID NO: 56306 - DNA, 75 bp, Artificial Sequence
  Synthetic
tagctccatcgtggggatgtagctccatctgggggatgtagctccatctggggatgtagctccatctgggggatg

SEQ ID NO: 56307 - DNA, 75 bp, Artificial Sequence
  Synthetic
acggtagttgtgggcgacataattggggtcttagagcaaggaaaaagaacactaacaccacaacccatggagcta

SEQ ID NO: 56308 - DNA, 75 bp, Artificial Sequence
  Synthetic
aggcttcaagaaggagatctcaaacatgctgagcataatcaacaaacggaaaaagacatcgttctgtctcatgat

SEQ ID NO: 56309 - DNA, 75 bp, Artificial Sequence
  Synthetic
cagagatcctgctgtctcctcagcatcattccaggcacagaacgccagaaaatggaatggtgctgttgaatcaac

SEQ ID NO: 56310 - DNA, 75 bp, Artificial Sequence
  Synthetic
ttggatccatagggggagtgttcacatcagtagggaaagcactacatcaagtttttggcgcaatctatggcgccg

SEQ ID NO: 56311 - DNA, 75 bp, Artificial Sequence
  Synthetic
tagcctccatggccatatgctcagcagttccaacggaatggtttccaacaagcagaacaacatggtcaatccacg

SEQ ID NO: 56312 - DNA, 75 bp, Artificial Sequence
  Synthetic
aagacagattcttttagggagcaaagctcaacgtagttctaacagttttttaattagagagcagatctctgatga

SEQ ID NO: 56313 - DNA, 75 bp, Artificial Sequence
  Synthetic
tgtgcaacagctgacaaagagattctcacttggaatgctgcagggacgaggaccattaaaactgttcatggccct

SEQ ID NO: 56314 - DNA, 75 bp, Artificial Sequence
  Synthetic
tacgcctttcaatatgctgaaacgcgagagaaaccgcgtgtcaactgtgcaacagctgacaaagagattctcact

SEQ ID NO: 56315 - DNA, 75 bp, Artificial Sequence
  Synthetic
gaaaaaagcattgaagacaacccagagatcgaagatgacattttccgaaagagaagactgaccatcatggacctc

SEQ ID NO: 56316 - DNA, 75 bp, Artificial Sequence
  Synthetic
cttggacggaacaatacaaatttcaaccagactccccttcaaagctggcttccgcaattcaaaaagctcatgagg

SEQ ID NO: 56317 - DNA, 75 bp, Artificial Sequence
  Synthetic
accagactccccttcaaagctggcttccgcaattcaaaaagctcatgaggaaggaatctgtggaatccgttcagt

SEQ ID NO: 56318 - DNA, 75 bp, Artificial Sequence
  Synthetic
acatcctatccgaaaatgaagtcaaactgaccatcatgacaggagagattaaggggattatgcaagcagggagaa

SEQ ID NO: 56319 - DNA, 75 bp, Artificial Sequence
  Synthetic
ggaagcttgcttaacgtagttctaacagtttttattagagagcagatctctgatgaacaaccaacgaaaaaagac

SEQ ID NO: 56320 - DNA, 75 bp, Artificial Sequence
  Synthetic
agacggtcctgaaacaactgaatgccctaatagcaatagagcctggaactctttggaagttgaggattatggctt

SEQ ID NO: 56321 - DNA, 75 bp, Artificial Sequence
  Synthetic
ctttggaagttgaggattatggctttgggatttttaccactaacatatggctaaagttgagagagaaacaagaca

SEQ ID NO: 56322 - DNA, 75 bp, Artificial Sequence
  Synthetic
acaactgacatttcagaaatgggtgccaacttcaaggctgagagggttatagaccccagacgctgcatgaaacca

SEQ ID NO: 56323 - DNA, 75 bp, Artificial Sequence
  Synthetic
agcagctgttaaggacgacagagcagttcatgctgatatgggctattggatagagagcagactgaatgacacatg

SEQ ID NO: 56324 - DNA, 75 bp, Artificial Sequence
  Synthetic
gttcatgctgatatgggctattggatagagagcagactgaatgacacatggaagatggaaaaagcatcatttatt

SEQ ID NO: 56325 - DNA, 75 bp, Artificial Sequence
  Synthetic
gaagaagagatgttcaaaaagcgaaatctaactataatggatctccatcccgggtcaggaaagacgcggaaatac

SEQ ID NO: 56326 - DNA, 75 bp, Artificial Sequence
  Synthetic
tcagcaggtgtcaacatgtgcacccttatagcgatggatttgggagagttatgtgaggacacaatgacttacaaa

SEQ ID NO: 56327 - DNA, 75 bp, Artificial Sequence
  Synthetic
catttgggcaaactcgagatggatttcgagttttgtgaaggaaccacggtagtggtgaccgaggattgcggaaac

SEQ ID NO: 56328 - DNA, 75 bp, Artificial Sequence
  Synthetic
tcgagttttgtgaaggaaccacggtagtggtgaccgaggattgcggaaacagaggaccatccttgagaacaacca

SEQ ID NO: 56329 - DNA, 75 bp, Artificial Sequence
  Synthetic
tgaagacactgtcacgtataaatgtcctctactggtcaacaccgaacctgaagacattgattgctggtgcaatct

SEQ ID NO: 56330 - DNA, 75 bp, Artificial Sequence
  Synthetic
atgacatagcaaactgcctgcggaaaaatgggaaaaaggtcattcaacttagtaggaagacttttgacacagaat

SEQ ID NO: 56331 - DNA, 75 bp, Artificial Sequence
  Synthetic
ccaccactaagatatagaggagaggatggatgttggtacggaatggaaattagaccactgaaagaaagagaagag

SEQ ID NO: 56332 - DNA, 75 bp, Artificial Sequence
  Synthetic
atggatgttggtacggaatggaaattagaccactgaaagaaagagaagagaacctggtgaactcattggttacag

SEQ ID NO: 56333 - DNA, 75 bp, Artificial Sequence
  Synthetic
ccattcttggctttgggattcttcctgaggaaattgacatccagagaaaatttgctgttgggagttgggttggcc

SEQ ID NO: 56334 - DNA, 75 bp, Artificial Sequence
  Synthetic
agatctctgatgaacaaccaacggaaaaagacgggtcgaccgtctttcaatatgctgaaacgcgcgagaaaccgc

SEQ ID NO: 56335 - DNA, 75 bp, Artificial Sequence
  Synthetic
gccgcccagaggagaggaagaattggaaggaaccacaataaggaaggtgatcagtacatctacatgggacagcct

SEQ ID NO: 56336 - DNA, 75 bp, Artificial Sequence
  Synthetic
ggaggcctttccacagagcaatgcagttatccaagatgaggaaagagacattcctgagagatcatggaactcagg

SEQ ID NO: 56337 - DNA, 75 bp, Artificial Sequence
  Synthetic
aacctggtccatacacgccaaacatgaatggatgacaacggaagacatgctgacagtctggaacagggtgtggat

SEQ ID NO: 56338 - DNA, 75 bp, Artificial Sequence
  Synthetic
tccaggaagaccttcgtggaactcatgaggaggggtgaccttccagtttggctagcccataaagtagcatcagaa

SEQ ID NO: 56339 - DNA, 75 bp, Artificial Sequence
  Synthetic
tatggtgggagcagccatgacggacgagatgggtatgggcgtgacatacttggcattactagctgctttcagagt

SEQ ID NO: 56340 - DNA, 75 bp, Artificial Sequence
  Synthetic
ctttcaccaatatggaagcccaattaatcagacagatggagggagaaggagtctttaaaaacattcagcacctga

SEQ ID NO: 56341 - DNA, 75 bp, Artificial Sequence
  Synthetic
aaataccagctagcagtgaccgtcatggctatgctatgtattccaaatgtcatgatactccagcatgcatggaaa

SEQ ID NO: 56342 - DNA, 75 bp, Artificial Sequence
  Synthetic
aatgggtcacggattttaaagggaagactgtttggtttgttccaagtataaaagcaggaaatgacatagcagctt

SEQ ID NO: 56343 - DNA, 75 bp, Artificial Sequence
  Synthetic
acttggcaaaagcaaacccaaagatccggcgttctatgggacgtacccagccccccagagacacagaaagcagaa

SEQ ID NO: 56344 - DNA, 75 bp, Artificial Sequence
  Synthetic
ggaaggcctatcaggagctacgtgggttgacgtggtgctcgaacacggtgggtgtgtgactaccatggctaagaa

SEQ ID NO: 56345 - DNA, 75 bp, Artificial Sequence
  Synthetic
tttctgtatcaccactcctcttgacttcctcacaacaaaaaacggactggataccgttagtcctcacaataaaag

SEQ ID NO: 56346 - DNA, 75 bp, Artificial Sequence
  Synthetic
ttcctcacaacaaaaaacggactggataccgttagtcctcacaataaaaggtctcaatccgactgctatcttctt

SEQ ID NO: 56347 - DNA, 75 bp, Artificial Sequence
  Synthetic
ataccgttagtcctcacaataaaaggtctcaatccgactgctatcttcttaacaactctgtctagacccaataaa

SEQ ID NO: 56348 - DNA, 75 bp, Artificial Sequence
  Synthetic
agtttgcagcaggaagaagaagcgtctcaggtgatctaatattagaaatagggaaacttccacaacacttgacgc

SEQ ID NO: 56349 - DNA, 75 bp, Artificial Sequence
  Synthetic
gaattcaaaaaacacatccatgtcattttcatgcattgcgataggaatcattacactctatctgggagctgtggt

SEQ ID NO: 56350 - DNA, 75 bp, Artificial Sequence
  Synthetic
catactagctagttcccttctgaaaaatgacattccaatgacgggaccactggtggcaggaggacttctcacagt

SEQ ID NO: 56351 - DNA, 75 bp, Artificial Sequence
  Synthetic
aatgacattccaatgacgggaccactggtggcaggaggacttctcacagtgtgctatgtgcttactggcagatcg

SEQ ID NO: 56352 - DNA, 75 bp, Artificial Sequence
  Synthetic
gaatcggaaagcttgcttacggtaggtctaacagtttttattagagagcagatctcggtggaccaccaccgaaaa

SEQ ID NO: 56353 - DNA, 75 bp, Artificial Sequence
  Synthetic
tgagatatctgggagtagcccaatcctatcagtcactatatcagaagatggtagtatgtcaataaagaatgagga

SEQ ID NO: 56354 - DNA, 75 bp, Artificial Sequence
  Synthetic
cagtactccgacagaaggtggtgctttgatggggaaaggaacaaccaggtgttggaggagaacatggacgtggag

SEQ ID NO: 56355 - DNA, 75 bp, Artificial Sequence
  Synthetic
caagcaaaagcaaccagagaagctcagaaaagagcagcggcgggcatcatgaaaaacccaactgtcgatggaata

SEQ ID NO: 56356 - DNA, 75 bp, Artificial Sequence
  Synthetic
gagtgctgtgggacgttccttcacctccaccaatggaaaaagctgagctagaagatggcgcttacagaatcaaac

SEQ ID NO: 56357 - DNA, 75 bp, Artificial Sequence
  Synthetic
caagaagtagttgtccttggatcgcaagagggagcaatgcacacagcactgacaggagctacagagatccaaacc

SEQ ID NO: 56358 - DNA, 75 bp, Artificial Sequence
  Synthetic
catggacagaacaatacaagttccaaccagaatccccttcaaaactagcttcagctatccaaaaagctcatgaag

SEQ ID NO: 56359 - DNA, 75 bp, Artificial Sequence
  Synthetic
tcacacgtggagctgtcctagtgcacaaagggaaaagaattgagccatcatgggcagacgtgaagaaagacttga

SEQ ID NO: 56360 - DNA, 75 bp, Artificial Sequence
  Synthetic
gaagttcaggttttggcgctggaacctggaaaaaacccgagagcagtgcaaacaaaacccggcctcttcaaaacc

SEQ ID NO: 56361 - DNA, 75 bp, Artificial Sequence
  Synthetic
ctggaaaaaacccgagagcagtgcaaacaaaacccggcctcttcaaaaccaatacaggaacaataggagccgtat

SEQ ID NO: 56362 - DNA, 75 bp, Artificial Sequence
  Synthetic
ggaaaggtcgtgggtctctacggaaatggcgtcgtgacaagaagcggaacctatgtgagctccatagcccaaaca

SEQ ID NO: 56363 - DNA, 75 bp, Artificial Sequence
  Synthetic
ctatgtgagctccatagcccaaacagagaaaagcgtggaggacaatccagagattgaagatgatatatttcggaa

SEQ ID NO: 56364 - DNA, 75 bp, Artificial Sequence
  Synthetic
gaaggcatgggaggagggtgtgtgtggaattcgatcagccactcgtctcgagaatatcatgtggaagcaaatatc

SEQ ID NO: 56365 - DNA, 75 bp, Artificial Sequence
  Synthetic
gctggtcatactattgtggaggactaaagaatgtaagagaagtcaaaggcctaacaaaaggaggaccaggacacg

SEQ ID NO: 56366 - DNA, 75 bp, Artificial Sequence
  Synthetic
aaaatccttacaaaacgtgggcttaccatggatcttatgaagtcaaggccacaggctcagcctcctccatgataa

SEQ ID NO: 56367 - DNA, 75 bp, Artificial Sequence
  Synthetic
gatacctcccagccatagttagagaagcaataagaagaggcctgagaacactgattctggcccccaccagagtag

SEQ ID NO: 56368 - DNA, 75 bp, Artificial Sequence
  Synthetic
agcaataagaagaggcctgagaacactgattctggcccccaccagagtagtggctgcagaaatggaggaagccct

SEQ ID NO: 56369 - DNA, 75 bp, Artificial Sequence
  Synthetic
tggaccgacaagaacagtttcgactcggaagcttgcttaacgtagtgctaacagttttattagagagcagatctc

SEQ ID NO: 56370 - DNA, 75 bp, Artificial Sequence
  Synthetic
tgctccacacaacagaaagaggagggagggcctatcaacacgccctgaacgaacttccggagtcactggaaacac

SEQ ID NO: 56371 - DNA, 75 bp, Artificial Sequence
  Synthetic
atttgtcaaaacaaccttttcattgcactacgcatggaagacaatggctatgatactgtcaattgtatctctctt

SEQ ID NO: 56372 - DNA, 75 bp, Artificial Sequence
  Synthetic
cagggcgcgaaatcgtagacctaatgtgtcatgccacattcaccatgaggttactgtcaccaattagggtaccaa

SEQ ID NO: 56373 - DNA, 75 bp, Artificial Sequence
  Synthetic
agcaggacaaaaggttcgtctgcaaacactccatggtagacagaggatggggaaatggatgtggattatttggaa

SEQ ID NO: 56374 - DNA, 75 bp, Artificial Sequence
  Synthetic
cccgagtagaaatgggagaagctgctggaatatttatgacagccactcctccaggcagcagggacccttttccac

SEQ ID NO: 56375 - DNA, 75 bp, Artificial Sequence
  Synthetic
ggagtctcctggataatgaaaattggaataggtgtcctcttaacctggatagggttgaattcaaaaaacacttct

SEQ ID NO: 56376 - DNA, 75 bp, Artificial Sequence
  Synthetic
actgtcaggggcaacgtgggtggatgtggtactagagcacggaagttgcgttaccactatggcaaaaaataaacc

SEQ ID NO: 56377 - DNA, 75 bp, Artificial Sequence
  Synthetic
agccattgcaggcgcctgggagaatggagtgtgcggaatcaggtcgacaaccagaatggagaacctcttgtggaa

SEQ ID NO: 56378 - DNA, 75 bp, Artificial Sequence
  Synthetic
ttcgtggaaggactctcaggagctacgtgggtggatgtggtgctggagcatggaagttgcgtcactaccatggca

SEQ ID NO: 56379 - DNA, 75 bp, Artificial Sequence
  Synthetic
ccggacatgggcagattgacaacttttcactaggagtcttgggaatggcactgttcctggaagaaatgctcagga

SEQ ID NO: 56380 - DNA, 75 bp, Artificial Sequence
  Synthetic
gggacttcgtagtcacgactgacatctcagaaatgggggcaaacttcaaagctgaaagagtgatagatccaagga

SEQ ID NO: 56381 - DNA, 75 bp, Artificial Sequence
  Synthetic
agatggtgaagagcgtgtggttctggcaggacccatgccagtcactcactcaagtgcagcacagagaagagggag

SEQ ID NO: 56382 - DNA, 75 bp, Artificial Sequence
  Synthetic
aaccttcacaacaagacttttgtcatcaaccagggttccaaattacaaccttatagtgatggatgaagcacattt

SEQ ID NO: 56383 - DNA, 75 bp, Artificial Sequence
  Synthetic
gaacgttcgtggacagaggctggggcaatggttgtgggctattcggaaaaggtagcttaataacgtgtgctaagt

SEQ ID NO: 56384 - DNA, 75 bp, Artificial Sequence
  Synthetic
aacctttagagaatgatgaagactgtgctcactggaaggaggcaaagatgctccttgataacatcaacacacctg

SEQ ID NO: 56385 - DNA, 75 bp, Artificial Sequence
  Synthetic
ctatgtgaccacaggctaatgtcggcagccgttaaggatgagagagccgtacacgccgacatgggctattggata

SEQ ID NO: 56386 - DNA, 75 bp, Artificial Sequence
  Synthetic
ctcttgagaaaactgacctccaaggaattaatgatggccaccataggaatcgcactcctttcccaaagcaccata

SEQ ID NO: 56387 - DNA, 75 bp, Artificial Sequence
  Synthetic
ttgctctactagcagctttcaaagtcagaccaacttttgcagctggactactcttgagaaaactgacctccaagg

SEQ ID NO: 56388 - DNA, 75 bp, Artificial Sequence
  Synthetic
atagacggtgaataccggctaaggggggaagcaaggaagacttttgtggatctgatgaaaagaggagacctacca

SEQ ID NO: 56389 - DNA, 75 bp, Artificial Sequence
  Synthetic
cagcataaaagctggaaatgacattgcaaattgtttgagaaagtcgggaaagaaagttatccagttgagtagaaa

SEQ ID NO: 56390 - DNA, 75 bp, Artificial Sequence
  Synthetic
aaatggacttaggcgtaccgctactggcactgggctgctattcacaagtgaacccactgactctcacagcggcag

SEQ ID NO: 56391 - DNA, 75 bp, Artificial Sequence
  Synthetic
cctaggaaaattggagctggacttcaactattgtgaaggaacaacagttgtcatcacagaaaattgtgggacaag

SEQ ID NO: 56392 - DNA, 75 bp, Artificial Sequence
  Synthetic
aatatctacaccccagaagggatcattccaacattgtttggtccggaaagggaaaaaacccaagccattgatgga

SEQ ID NO: 56393 - DNA, 75 bp, Artificial Sequence
  Synthetic
gcagttcaacttttgttaatgagaacatcatgggccttgtgtgaagctctaaccctagccacaggaccaataaca

SEQ ID NO: 56394 - DNA, 75 bp, Artificial Sequence
  Synthetic
aacatgatgggaaaaagagagaagaaactaggggagttcggcaaggcaaaaggcagcagagccatatggtacatg

SEQ ID NO: 56395 - DNA, 75 bp, Artificial Sequence
  Synthetic
gacaacttggctgtactgcactctgcagaaatgggtggaagagcctataaccatgctctcagtgaattgccagaa

SEQ ID NO: 56396 - DNA, 75 bp, Artificial Sequence
  Synthetic
gacccaaaagacaagagatgccctggacaacttggctgtactgcactctgcagaaatgggtggaagagcctataa

SEQ ID NO: 56397 - DNA, 75 bp, Artificial Sequence
  Synthetic
ccatagtcactgacaaagaaaaaccagtcaacattgaggcagaaccaccttttggtgagagctacatcgtggtag

SEQ ID NO: 56398 - DNA, 75 bp, Artificial Sequence
  Synthetic
gtctcctggccacagtcacagggggaatctttttgttcttgatgagtggaagaggtgtagggaaaatgaccctcg

SEQ ID NO: 56399 - DNA, 75 bp, Artificial Sequence
  Synthetic
tttggtgagagctacatcgtggtaggagcaggtgaaaaagctttgaaactaagctggttcaagaagggaagcagc

SEQ ID NO: 56400 - DNA, 75 bp, Artificial Sequence
  Synthetic
atacaacaatgggaaccttcaagaggatggaacgattggacacaagtgcccttctgttcacaccatttccatgag

SEQ ID NO: 56401 - DNA, 75 bp, Artificial Sequence
  Synthetic
tgaaatgataatcccaaagatatatggaggaccaatatctcagcacaactacagaccagggtatttcacacaaac

SEQ ID NO: 56402 - DNA, 75 bp, Artificial Sequence
  Synthetic
caggagctctgtgggacgtcccctcacccgctgccactcataaagccacactgtctgaaggggtgtataggatta

SEQ ID NO: 56403 - DNA, 75 bp, Artificial Sequence
  Synthetic
gagtattgtgggacgtcccttcacccccaccagtgggaaaggccgaactggaagatggagcctatagaatcaagc

SEQ ID NO: 56404 - DNA, 75 bp, Artificial Sequence
  Synthetic
tggacacaagtgcccttctgttcacaccatttccatgagttaatcatgaaagacggtcgcgtactcgttgttcca

SEQ ID NO: 56405 - DNA, 75 bp, Artificial Sequence
  Synthetic
tgacctatgtggtcatagccatcctgacattagtggcagccaccatggcaaacgaaatgggttttctagaaaaga

SEQ ID NO: 56406 - DNA, 75 bp, Artificial Sequence
  Synthetic
tgcaaagagggttgttcgggaaaactcaggttggagtggggatacacatggaaggtgtattccacacagtggggc

SEQ ID NO: 56407 - DNA, 75 bp, Artificial Sequence
  Synthetic
aatatcttggacatagacctccgacctgcatcagcgtggacactatatgcagtggctactacgtttgtcacgcca

SEQ ID NO: 56408 - DNA, 75 bp, Artificial Sequence
  Synthetic
actctaattttggcaccgacaagggtggttgcagctgagatggaagaagcattgaaagggctcccaataaggtac

SEQ ID NO: 56409 - DNA, 75 bp, Artificial Sequence
  Synthetic
tatagcaaatcaggccacggtgcttatgggcttgggaaaaggttggccactatcaaaaatggacataggagttcc

SEQ ID NO: 56410 - DNA, 75 bp, Artificial Sequence
  Synthetic
agaaaacccatggatggaagacaaaactccagtggaatcatgggaggaaatcccatacttggggaaaagagaaga

SEQ ID NO: 56411 - DNA, 75 bp, Artificial Sequence
  Synthetic
ccccttacgcttcagaggagaagacggatgttggtatggcatggaaatcagaccagttaaggagaaggaggagaa

SEQ ID NO: 56412 - DNA, 75 bp, Artificial Sequence
  Synthetic
tatcaaaaatggacataggagttcctcttcttgccattggatgctactcgcaggtgaatcccataaccctcacag

SEQ ID NO: 56413 - DNA, 75 bp, Artificial Sequence
  Synthetic
ccaaacgaaaccaggccttttcaagaccttaactggagaaattggagcagtaactctggatttcaaacccggaac

SEQ ID NO: 56414 - DNA, 75 bp, Artificial Sequence
  Synthetic
cctctgcaggtgtcaatatgtgcactctcattgcgatggacttgggagagttgtgtgaggacacaatgacctaca

SEQ ID NO: 56415 - DNA, 75 bp, Artificial Sequence
  Synthetic
caagcaaaggctaccagagaggcgcagaaaagagcagcagccggcatcatgaagaatccaacagtagatgggatt

SEQ ID NO: 56416 - DNA, 75 bp, Artificial Sequence
  Synthetic
agaaaagagcagcagccggcatcatgaagaatccaacagtagatgggattacagtgattgacctagaaccaatac

SEQ ID NO: 56417 - DNA, 75 bp, Artificial Sequence
  Synthetic
ttcgaagcaaccgcccgaggagcacgaaggatggctatcctgggagacaccgcatgggacttcggctctatagga

SEQ ID NO: 56418 - DNA, 75 bp, Artificial Sequence
  Synthetic
ctttgtgtgacacaggtgctgatgatgagaaccacgtgggctctatgcgaagccctaaccctagcaacagggccc

SEQ ID NO: 56419 - DNA, 75 bp, Artificial Sequence
  Synthetic
atttttgggaaaacccaagtgggggttggagtacagaaagaaggagttttccacaccatgtggcacgtcacaaga

SEQ ID NO: 56420 - DNA, 75 bp, Artificial Sequence
  Synthetic
aaaaacaacatggcttccggtgctgttaggatcttttggatgcaaaccattaaccatgtttcttataacagaaaa

SEQ ID NO: 56421 - DNA, 75 bp, Artificial Sequence
  Synthetic
ggcaccataggtgaaactttaggagaaaaatggaagagtcggctaaatgcactgggaagaagtgaattccagata

SEQ ID NO: 56422 - DNA, 75 bp, Artificial Sequence
  Synthetic
cacctagaacagggctagactttaatgagatggtgttgttgacaatgaaagaaaaatcatggctcgtccacaaac

SEQ ID NO: 56423 - DNA, 75 bp, Artificial Sequence
  Synthetic
tagacagaaccctggcgaaggaaggcataaaaagaggagaaacagaccaccatgccgtttcacggggctctgcaa

SEQ ID NO: 56424 - DNA, 75 bp, Artificial Sequence
  Synthetic
ccgggaagtagagacccatttcctcagagcaatgcaccaatcatggatgaggaaagagaaatccctgagcgttcg

SEQ ID NO: 56425 - DNA, 75 bp, Artificial Sequence
  Synthetic
gtagaccttggttgtggcagaggaggatggtcatattactgtggtggactaaaaaatgtgagagaagtcaaaggc

SEQ ID NO: 56426 - DNA, 75 bp, Artificial Sequence
  Synthetic
gatggtcatattactgtggtggactaaaaaatgtgagagaagtcaaaggcctgacaaaaggaggaccaggacatg

SEQ ID NO: 56427 - DNA, 75 bp, Artificial Sequence
  Synthetic
ctgcgtgatgtcctcaagtgcactgttatggatggccagtgtggagccccattggatagcggcctctatcatact

SEQ ID NO: 56428 - DNA, 75 bp, Artificial Sequence
  Synthetic
agtggagtggatgtattctttactccaccagagagatgcgacacactgctatgcgacataggagaatcgtcacca

SEQ ID NO: 56429 - DNA, 75 bp, Artificial Sequence
  Synthetic
caccagagagatgcgacacactgctatgcgacataggagaatcgtcaccaaaccccacagtggaggccggacgaa

SEQ ID NO: 56430 - DNA, 75 bp, Artificial Sequence
  Synthetic
cggctaatgtcagctgccatcaaggacagcaaggcagtccatgctgacatggggtactggatagaaagtgaaaag

SEQ ID NO: 56431 - DNA, 75 bp, Artificial Sequence
  Synthetic
acatgctggcagtctggaacagggtgtggatccaagaaaacccatggatggaagacaaaactccagtggaatcat

SEQ ID NO: 56432 - DNA, 75 bp, Artificial Sequence
  Synthetic
ctgggtgtccaacgcttctggaaatattgtgtcttctgtgaacatgatttcaaggatgttgataaatagattcac

SEQ ID NO: 56433 - DNA, 75 bp, Artificial Sequence
  Synthetic
ctcaggccaaggacccatgaaattggtgatggcttttatagcattcctaagatttctagccatacccccaacagc

SEQ ID NO: 56434 - DNA, 75 bp, Artificial Sequence
  Synthetic
gcccttgacaacatagtcatgctccacacaacagaaagaggagggagggcctaccaacacgccctgaacgaactt

SEQ ID NO: 56435 - DNA, 75 bp, Artificial Sequence
  Synthetic
gttcttcttctcacaattggattaagcctggtggcatccgtggatctaccaaattccttagaggagctgggggat

SEQ ID NO: 56436 - DNA, 75 bp, Artificial Sequence
  Synthetic
aaaggaaaagttgtgggtctttatggcaatggtgttgtcacaaggagtggagcatatgtgagtgctatagcccag

SEQ ID NO: 56437 - DNA, 75 bp, Artificial Sequence
  Synthetic
acatcagttatgggctaccttgctgtctttgacatttatcaaaacaactctttcgttgcattatgcatggaagac

SEQ ID NO: 56438 - DNA, 75 bp, Artificial Sequence
  Synthetic
tgaccaagatcatccatacaaaacatgggcataccacggcagttatgagacgaaacaaacaggatcagcatcatc

SEQ ID NO: 56439 - DNA, 75 bp, Artificial Sequence
  Synthetic
ccttagtcatgcttttagtccattatgcaataataggcccaggattgcaggcaaaagccacaagagaggctcaga

SEQ ID NO: 56440 - DNA, 75 bp, Artificial Sequence
  Synthetic
ccatggtgacgcaaatggcaatgacagacacaaccccctttggacagcagcgtgttttcaaggaaaaagtagaca

SEQ ID NO: 56441 - DNA, 75 bp, Artificial Sequence
  Synthetic
ctcttggatgcaaaccactaaccatgtttcttataacagaaaacaaaatctggggaaggaaaagttggcctctca

SEQ ID NO: 56442 - DNA, 75 bp, Artificial Sequence
  Synthetic
gtgagaagcaacgcagctctgggggctgtgttcactgatgagaacaagtggaagtcagcacgcgaagcggtcgaa

SEQ ID NO: 56443 - DNA, 75 bp, Artificial Sequence
  Synthetic
cctgtaccttgctggtaaggactagagattagaggagaccccccgcccatcaacaaacagcatatggacgctggg

SEQ ID NO: 56444 - DNA, 75 bp, Artificial Sequence
  Synthetic
gaagtcagcacgcgaagcggtcgaagatgaaagattttgggaactggtggaaaaagagagaaaccttcaccttga

SEQ ID NO: 56445 - DNA, 75 bp, Artificial Sequence
  Synthetic
atggaactcaggctatgactggatcactgattttccaggtaaaacagtttggtttgttccaagcatcaaatcagg

SEQ ID NO: 56446 - DNA, 75 bp, Artificial Sequence
  Synthetic
atggaacatctgggaagttgaagactatggatttggaattttcacgacaaacatatggttgaaattgcgtgactc

SEQ ID NO: 56447 - DNA, 75 bp, Artificial Sequence
  Synthetic
gatgtagctccatcgtggggatgtagctccatcgtggggatgtagctccatcgtgggatgtagctccatttgggg

SEQ ID NO: 56448 - DNA, 75 bp, Artificial Sequence
  Synthetic
aaaagggatgtcatatgtgatgtgcacaggctcatttaagctagagaaggaagtggctgagacccagcatggaac

SEQ ID NO: 56449 - DNA, 75 bp, Artificial Sequence
  Synthetic
agaccattggttctctagagaaaactctctaagtggagtggaaggagaaggactgcacaagctgggctacatcct

SEQ ID NO: 56450 - DNA, 75 bp, Artificial Sequence
  Synthetic
gactgcacaagctgggctacatcctaagagacattagcagaaaagcaggaggagcaatgtacgcagatgacactg

SEQ ID NO: 56451 - DNA, 75 bp, Artificial Sequence
  Synthetic
gcaagtcatgctactagtcctgtgtgttggacaattacttttgatgagaacaacatgggctctctgcgaagtact

SEQ ID NO: 56452 - DNA, 75 bp, Artificial Sequence
  Synthetic
tgaggatctaaagaatgaagaaatgataacagaccaaatggaagggagacataagaagctggcagaggccatatt

SEQ ID NO: 56453 - DNA, 75 bp, Artificial Sequence
  Synthetic
gaggcacggtgatggatatcatttcaaggagagaccaaagaggcagtgggcaggtggggacgtacggtctcaata

SEQ ID NO: 56454 - DNA, 75 bp, Artificial Sequence
  Synthetic
accagaaccagaaaagcagagaaccccccaagacaaccaactcgcatatgtcgtgataggcatacttacattggc

SEQ ID NO: 56455 - DNA, 75 bp, Artificial Sequence
  Synthetic
ctctggacttttctcctggaacgtcaggatctccaatcgtcgacaaaaaaggaaaagttgtgggtctttatggca

SEQ ID NO: 56456 - DNA, 75 bp, Artificial Sequence
  Synthetic
aatagacctagatcctgtaatatatgattcaaaatttgaaaagcaactaggacaggttatgctcctggttctgtg

SEQ ID NO: 56457 - DNA, 75 bp, Artificial Sequence
  Synthetic
ggaaaagttgtgggtctttatggcaatggtgtcgtcacaaggagtggaacatatgtgagtgccatagcccagact

SEQ ID NO: 56458 - DNA, 75 bp, Artificial Sequence
  Synthetic
caccccaagaggaaacagctgtccacgcttggctagttagagagggacgcgaacgcctcgcaagaatggcaatca

SEQ ID NO: 56459 - DNA, 75 bp, Artificial Sequence
  Synthetic
cgcttggctagttagagagggacgcgaacgcctcgcaagaatggcaatcagtggagatgactgcgtcgtgaaacc

SEQ ID NO: 56460 - DNA, 75 bp, Artificial Sequence
  Synthetic
caacatctcaagagacttggaacagacaagatttgctggtcacatttaagacagctcatgcaaagaagcaggaag

SEQ ID NO: 56461 - DNA, 75 bp, Artificial Sequence
  Synthetic
aagtgaggaaagacatacaacagtgggaaccctcaaaaggatggagtgattggacccaagtgcccttttgctctc

SEQ ID NO: 56462 - DNA, 75 bp, Artificial Sequence
  Synthetic
gaaaggaaaagtcatcggactctatggaaatggagtggttaccaaatcaggtgattacgtcagtgccataacgca

SEQ ID NO: 56463 - DNA, 75 bp, Artificial Sequence
  Synthetic
tgcagtgtcaatggctaacatctttagggggagctacttggccggagctggacttctcttttccatcatgaagaa

SEQ ID NO: 56464 - DNA, 75 bp, Artificial Sequence
  Synthetic
cttaggctgtggaagaggaggctggtcatattactgtgcaggactgaaaaaagttacagaagtgcgaggatacac

SEQ ID NO: 56465 - DNA, 75 bp, Artificial Sequence
  Synthetic
ggaaccctcaaaaggatggagtgattggacccaagtgcccttttgctctcaccactttcatgaattaataatgaa

SEQ ID NO: 56466 - DNA, 75 bp, Artificial Sequence
  Synthetic
gcagagaactccccaagacaatcaactcgcatatgtcgtgataggcatacttacattggctgcaatagtagcagc

SEQ ID NO: 56467 - DNA, 75 bp, Artificial Sequence
  Synthetic
gcagagcgcgtatctcccagggggcaggatggtccttgagagagacagcctgtttggggaagtcatatgcccaga

SEQ ID NO: 56468 - DNA, 75 bp, Artificial Sequence
  Synthetic
acgtaaaacctgggaggctgcaaactgtggaagctgtacgcacagtgtagcagactagcggttagaggagacccc

SEQ ID NO: 56469 - DNA, 75 bp, Artificial Sequence
  Synthetic
tcccacaagagttgtcgcctctgaaatggcagaggcgctcaagggaatgccaataagatatcagacaacagcagt

SEQ ID NO: 56470 - DNA, 75 bp, Artificial Sequence
  Synthetic
aggatggtccttgagagagacagcctgtttggggaagtcatatgcccagatgtggagcctgatgtacttccacag

SEQ ID NO: 56471 - DNA, 75 bp, Artificial Sequence
  Synthetic
gttggattgagtctggtggcatctgtagaactaccaaattccttagaggagctaggggatggacttgcaatgggc

SEQ ID NO: 56472 - DNA, 75 bp, Artificial Sequence
  Synthetic
ggagcgaagagaatggccattttaggtgacacagcctgggattttggatccctgggaggagtgttcacatctata

SEQ ID NO: 56473 - DNA, 75 bp, Artificial Sequence
  Synthetic
attgggttccaactagcaggacaacttggtctatacatgctagtcatgaatggatgacgacggaagacatgttag

SEQ ID NO: 56474 - DNA, 75 bp, Artificial Sequence
  Synthetic
taggaatgaattcacgtagcacctcactgtctgtgtcactagtattagtgggagtcgtgacattgtacttgggag

SEQ ID NO: 56475 - DNA, 75 bp, Artificial Sequence
  Synthetic
gcttgatgcccgcacttattcagatcccttagcactcaaggaattcaaggactttgcggctggtagaaagtcaat

SEQ ID NO: 56476 - DNA, 75 bp, Artificial Sequence
  Synthetic
taggaaagaaaaagacacctaggatgtgtaccagagaagaattcacaagaaaggtgagaagcaatgcagccttgg

SEQ ID NO: 56477 - DNA, 75 bp, Artificial Sequence
  Synthetic
ctcgtcagatgcccgctatccaggaattctacccatgagatgtattgggtgtcaggtgcgtcgggaaacatcgtg

SEQ ID NO: 56478 - DNA, 75 bp, Artificial Sequence
  Synthetic
catggaagacaatggctatgatactgtcaattgtatctctcttccctttatgcctgtccacgacttctcaaaaaa

SEQ ID NO: 56479 - DNA, 75 bp, Artificial Sequence
  Synthetic
gttatgtgaggacacaatgacttacaaatgccctcgaatcactgaggcggaaccagatgacgttgattgttggtg

SEQ ID NO: 56480 - DNA, 75 bp, Artificial Sequence
  Synthetic
gagggagcttcataaacaaggaaaatgtgccacgtgtgtctacaacatgatgggaaagagagagaaaaaattagg

SEQ ID NO: 56481 - DNA, 75 bp, Artificial Sequence
  Synthetic
agtggagttgacgttttcttcaccccgccagaaaagtgtgatacattgttgtgtgacataggggagtcgtcacca

SEQ ID NO: 56482 - DNA, 75 bp, Artificial Sequence
  Synthetic
ctctttcattggattatgcatggaagacaatggctatggcactgtcaatcgtatctctctttcctttgtgtctgt

SEQ ID NO: 56483 - DNA, 75 bp, Artificial Sequence
  Synthetic
agtcagagctctcattggtgaggaggaatacacggactacatgccctcaatgaaaaggttcaggagtgaagagga

SEQ ID NO: 56484 - DNA, 75 bp, Artificial Sequence
  Synthetic
gagaccccaaacttagccgagagagttctcgactggctggaaaaacatggcgtcgaaaggctgaaaagaatggca

SEQ ID NO: 56485 - DNA, 75 bp, Artificial Sequence
  Synthetic
acaggctcagcctcctccatgataaatggagtcgtgaaactcctcacaaaaccatgggatgtggtgcccatggtg

SEQ ID NO: 56486 - DNA, 75 bp, Artificial Sequence
  Synthetic
gctttaacagctctaaatgacatgggaaaagttaggaaagacatacaacaatgggaaccttcaagaggatggaac

SEQ ID NO: 56487 - DNA, 75 bp, Artificial Sequence
  Synthetic
tagaagtcaggtcattttaagccatagtacggaacaaactatgctacctgtgagccccgtcctaggacgttaaaa

SEQ ID NO: 56488 - DNA, 75 bp, Artificial Sequence
  Synthetic
gtgggaaccttcaaaaggatggaacgattggacacaagtgcctttctgttcacaccatttccatgagctaatcat

SEQ ID NO: 56489 - DNA, 75 bp, Artificial Sequence
  Synthetic
taacagatgggccagagagagtcatcttagcaggtcccattccagtgactccagcaagcgctgcccaaagaagag

SEQ ID NO: 56490 - DNA, 75 bp, Artificial Sequence
  Synthetic
cgacaggctcagcatcctccatggtgaacggggtagtaaaactgctgacaaaaccttgggatgtgattccaatgg

SEQ ID NO: 56491 - DNA, 75 bp, Artificial Sequence
  Synthetic
ggaagagttcatctcaaaagttaggtcaaatgcagccataggcgcagtcttccaggaagaacagggatggacatc

SEQ ID NO: 56492 - DNA, 75 bp, Artificial Sequence
  Synthetic
tggggatcacagcggagtggctctggagaaccctgggaaggaacaaaaaacccaggttatgcacaagggaagagt

SEQ ID NO: 56493 - DNA, 75 bp, Artificial Sequence
  Synthetic
gtacgcatggtgtagtggactagcggttagaggagacccctcccttaagaatcgcagcaaaatgggggcccaagg

SEQ ID NO: 56494 - DNA, 75 bp, Artificial Sequence
  Synthetic
catttgaccacacgagggggagagccacacatgatagttagtaagcaggaaagaggaaagtcactcttgtttaag

SEQ ID NO: 56495 - DNA, 75 bp, Artificial Sequence
  Synthetic
tgagataccaaacctagacataataggaaagagaatagagaaaataaagcaagagcatgaaacatcatggcacta

SEQ ID NO: 56496 - DNA, 75 bp, Artificial Sequence
  Synthetic
gccaaaatggttagatgcacgtgtatacgctgaccccatggctttgaaggatttcaaggagtttgccagtggaag

SEQ ID NO: 56497 - DNA, 75 bp, Artificial Sequence
  Synthetic
tgctccggagaagaagatgtaaaatgtcagggacgccaaaaactgtggcagttgtccacatgtcgaagcgtacca

SEQ ID NO: 56498 - DNA, 75 bp, Artificial Sequence
  Synthetic
gtcagggacgccaaaaactgtggcagttgtccacatgtcgaagcgtaccagctgatagagaacactcctctctta

SEQ ID NO: 56499 - DNA, 75 bp, Artificial Sequence
  Synthetic
ccttgacaacatagtcatgctccacacaacagaaagaggagggagggcctatcaacacgccctgaacgaacttcc

SEQ ID NO: 56500 - DNA, 75 bp, Artificial Sequence
  Synthetic
tggcacaggtaacattgtcgcttcagtcaacatggtatctagactgctactgaacaggttcacgatgacacacag

SEQ ID NO: 56501 - DNA, 75 bp, Artificial Sequence
  Synthetic
ctggaactactagctgactgagacgaccccaaaaaaaaaaaaatcaccctgttgacgctgagaaatactggagtt

SEQ ID NO: 56502 - DNA, 75 bp, Artificial Sequence
  Synthetic
accccaaaaaaaaaaaaatcaccctgttgacgctgagaaatactggagttcctgcagcctcatcagcatcactgc

SEQ ID NO: 56503 - DNA, 75 bp, Artificial Sequence
  Synthetic
gacagagcaatacaaatttcaagcagactcccccaaaagactggcgacagccattgcaggcgcctgggaaaatgg

SEQ ID NO: 56504 - DNA, 75 bp, Artificial Sequence
  Synthetic
agcttgagagaaactgcatgtctaggcaagtcgtatgcacaaatgtggcagctgatgtacttccacaggagagac

SEQ ID NO: 56505 - DNA, 75 bp, Artificial Sequence
  Synthetic
cagagaattgaaacctggatcttgagacatccaggttttaccataatggcagcaatcctggcatacaccatagga

SEQ ID NO: 56506 - DNA, 75 bp, Artificial Sequence
  Synthetic
atggacaaactacagctcaaaggaatgtcatattctatgtgtacaggaaagtttaaagttgtaaaggaaatagca

SEQ ID NO: 56507 - DNA, 75 bp, Artificial Sequence
  Synthetic
gagaagaaaattacacaatggttggaaaccaaaggagtggagaggttaaaaagaatggccatcagcggggatgat

SEQ ID NO: 56508 - DNA, 75 bp, Artificial Sequence
  Synthetic
aagagacgtgagcaagaaggaagggggagcaatgtacgccgatgatacagcaggatgggacacaagaatcacact

SEQ ID NO: 56509 - DNA, 75 bp, Artificial Sequence
  Synthetic
gaacgatatgggaaaggttcggaaggacatacctcaatggcagccatcaaagggatggcatgattggcaacaggt

SEQ ID NO: 56510 - DNA, 75 bp, Artificial Sequence
  Synthetic
gtaacaaaccacatgaaaggagaacacaagaaactagccgaggccatattcaaattaacgtaccaaaacaaggtg

SEQ ID NO: 56511 - DNA, 75 bp, Artificial Sequence
  Synthetic
agctgctgttgaggatgaggatttttggaaacttgtggacagagaacgtgaactccacaaattgggcaagtgtgg

SEQ ID NO: 56512 - DNA, 75 bp, Artificial Sequence
  Synthetic
caaattaacgtaccaaaacaaggtggtgcgtgtgcaaagaccaacaccaagaggcacagtaatggatatcatatc

SEQ ID NO: 56513 - DNA, 75 bp, Artificial Sequence
  Synthetic
cttcgttgaaggactgtcaggagcaacgtgggtggacgtggtattggagcatggaagctgcgtcaccaccatggc

SEQ ID NO: 56514 - DNA, 75 bp, Artificial Sequence
  Synthetic
atgggaacaacgtacctagccttgatggccactttcaaaatgagaccgatgttcgctgttgggctattatttcgc

SEQ ID NO: 56515 - DNA, 75 bp, Artificial Sequence
  Synthetic
caaaaagaacatggaaggaaaagtcgtgcagccagaaaatttggaatacaccatcgtgataacacctcactcagg

SEQ ID NO: 56516 - DNA, 75 bp, Artificial Sequence
  Synthetic
aggacacccaaacccatgccaggaacaagaaaggttatggagatcacagcggaatggctttggagaaccctggga

SEQ ID NO: 56517 - DNA, 75 bp, Artificial Sequence
  Synthetic
caagaaaggttatggagatcacagcggaatggctttggagaaccctgggaaggaacaaaagacccagattatgca

SEQ ID NO: 56518 - DNA, 75 bp, Artificial Sequence
  Synthetic
gttgacgatcaaaggcctcaatccaacagccatttttctaacaaccctctcaagaactagcaagaaaaggagctg

SEQ ID NO: 56519 - DNA, 75 bp, Artificial Sequence
  Synthetic
gggtagaaataacagcactcatcctaggagcccaagctctgccagtgtacctaatgactctcatgaaaggagcct

SEQ ID NO: 56520 - DNA, 75 bp, Artificial Sequence
  Synthetic
ttctctcagggcaaataacatggagagatatggcgcacacactcataatgattgggtccaacgcttctgacagga

SEQ ID NO: 56521 - DNA, 75 bp, Artificial Sequence
  Synthetic
catattgacgctgggaaagaccagagatcctgctgtctctgcaacatcaatccaggcacagagcgccgcaagatg

SEQ ID NO: 56522 - DNA, 75 bp, Artificial Sequence
  Synthetic
ccaaaacaaagtggtcaaagttcaacgaccgactccaacaggcacggtaatggacatcatatctaggaaagacca

SEQ ID NO: 56523 - DNA, 75 bp, Artificial Sequence
  Synthetic
tgacaaaactagaaggaaagatagttcaatatgaaaacctaaaatattcagtgatagtcactgtccacactgggg

SEQ ID NO: 56524 - DNA, 75 bp, Artificial Sequence
  Synthetic
atggcaacaacgttacaactgccagaggacattgaacaaatggcgaatggaattgctctggggctcatggctctt

SEQ ID NO: 56525 - DNA, 75 bp, Artificial Sequence
  Synthetic
aggacattgaacaaatggcgaatggaattgctctggggctcatggctcttaaactgataacacaatttgagacat

SEQ ID NO: 56526 - DNA, 75 bp, Artificial Sequence
  Synthetic
cgggtggtctttgaaggagacggcctgtttggggaagtcttacgcccaaatgtggaccctgatgtacttccacag

SEQ ID NO: 56527 - DNA, 75 bp, Artificial Sequence
  Synthetic
taaacacaccagaagggattatcccagccctctttgagccagagagagaaaagagtgcagcaatagacggggaat

SEQ ID NO: 56528 - DNA, 75 bp, Artificial Sequence
  Synthetic
gctctgtctcatgatgatgttaccagcaacacttgctttccacttgacttcacgcgatggagagccgcgcatgat

SEQ ID NO: 56529 - DNA, 75 bp, Artificial Sequence
  Synthetic
gaaaggctgaattggaagatggagcctacagaatcaagcaaaaaggaatcctaggatattcccagatcggagctg

SEQ ID NO: 56530 - DNA, 75 bp, Artificial Sequence
  Synthetic
agccaaagaggggttgaaaagaggagaaacgactaaacacgcggtgtcgagaggaacggccaaactgaggtggtt

SEQ ID NO: 56531 - DNA, 75 bp, Artificial Sequence
  Synthetic
ggggatgtaaaaacccgggaggctgcaacccatggaagctgtacgcatggggtagcagactagcggttagaggag

SEQ ID NO: 56532 - DNA, 75 bp, Artificial Sequence
  Synthetic
cggaagcttgcttaacgtagttctaacagtttttttattagagagcagatctctgatgaacaaccaacggaaaaa

SEQ ID NO: 56533 - DNA, 75 bp, Artificial Sequence
  Synthetic
agaggccggtgtcctgtggtagaaggcaaaactaacatgaaacaaggctaaaagtcaggtcggattaagccatag

SEQ ID NO: 56534 - DNA, 75 bp, Artificial Sequence
  Synthetic
ttcttttgtgacattgatcacagggaacatgtccttcaaagacctaggaagagtggtggttatggtaggcgctac

SEQ ID NO: 56535 - DNA, 75 bp, Artificial Sequence
  Synthetic
ttgacactgagtaccagaaaacaaaaaacaatgactgggactatgttgtcacaacagacatttccgaaatgggag

SEQ ID NO: 56536 - DNA, 75 bp, Artificial Sequence
  Synthetic
aggtcgcatgttaaacatcttgaataggagaagaaggtcaacaatgacattgctgtgtttgattcccaccgtaat

SEQ ID NO: 56537 - DNA, 75 bp, Artificial Sequence
  Synthetic
ttgacgctgggaaagaccagagatcctgctgtctcacaacatcaatccaggcacagagcgccgcaagatggattg

SEQ ID NO: 56538 - DNA, 75 bp, Artificial Sequence
  Synthetic
aaacatggaggaatgctagtgcgaaatccactctcaagaaactccactcatgaaatgtactgggtttcatgtgga

SEQ ID NO: 56539 - DNA, 75 bp, Artificial Sequence
  Synthetic
gagaacagccaccttgattttggccggagtttcgcttttaccagtgtgccagtcttcgagcatgaggaaaacaga

SEQ ID NO: 56540 - DNA, 75 bp, Artificial Sequence
  Synthetic
accaaattctttagaggagctaggggatggacttgcaatgggcatcatgatgttaaaattattgactgactttca

SEQ ID NO: 56541 - DNA, 75 bp, Artificial Sequence
  Synthetic
gtgagactgctaaccaaaccatgggatgtcatccccatggtcacacaaatagccatgactgacactacacccttt

SEQ ID NO: 56542 - DNA, 75 bp, Artificial Sequence
  Synthetic
tgcagctgagatggaagaagcattgaaagggctcccaataaggtatcaaacaactgcaacaaaatctgaacacac

SEQ ID NO: 56543 - DNA, 75 bp, Artificial Sequence
  Synthetic
agaggtggctggtcatattactgcgctgggctgaagaaagtcactgaagtgaagggatacacaaaaggaggacct

SEQ ID NO: 56544 - DNA, 75 bp, Artificial Sequence
  Synthetic
caactgcaacaaaatctgaacacacaggaagggagattgttgatctaatgtgccacgcaacgttcacaatgcgct

SEQ ID NO: 56545 - DNA, 75 bp, Artificial Sequence
  Synthetic
tcatgtggaagcaaatatcaaatgaattgaaccacattctacttgaaaatgacatgaaattcacagtggttgtag

SEQ ID NO: 56546 - DNA, 75 bp, Artificial Sequence
  Synthetic
gataccttccagcaatagtcagagaggccataaaacgaggcttgagaacattaatcctggcccccactagagtcg

SEQ ID NO: 56547 - DNA, 75 bp, Artificial Sequence
  Synthetic
atggcctcaagcgcactgttatggatggccagtgtggagccccattggatagcggcctccatcatactagagttc

SEQ ID NO: 56548 - DNA, 75 bp, Artificial Sequence
  Synthetic
agtcagagggagccatttggtaaacgcaggaagtgaaaaaagaggcaaactgtcaggccactttaagccacagta

SEQ ID NO: 56549 - DNA, 75 bp, Artificial Sequence
  Synthetic
ttgaagttaaaagctgccactggccaaagtcacacaccctttggagcaatggagtattagaaagtgagatgataa

SEQ ID NO: 56550 - DNA, 75 bp, Artificial Sequence
  Synthetic
tatcaataccaatcacggcagcagcatggtacctgtgggaagtgaagaaacaacgggccggagtattgtgggacg

SEQ ID NO: 56551 - DNA, 75 bp, Artificial Sequence
  Synthetic
gagtatcacaaggcgccggatggagcctgagagaaactgcttgcctaggcaagtcatacgcacaaatgtggcagc

SEQ ID NO: 56552 - DNA, 75 bp, Artificial Sequence
  Synthetic
tggaaaaggaggagttgtgacatgtgcgaagtttttatgctcggggaagataacaggcaatctggttcaaattga

SEQ ID NO: 56553 - DNA, 75 bp, Artificial Sequence
  Synthetic
cctctggagcaatggagtattagaaagtgagatgataattccaaaaaattttgccgggccagtgtcacaacacaa

SEQ ID NO: 56554 - DNA, 75 bp, Artificial Sequence
  Synthetic
tcatatgtaatgtgcacaggctcattcaagctagagaaggaagtggctgagacccagcatggaactgttctagtg

SEQ ID NO: 56555 - DNA, 75 bp, Artificial Sequence
  Synthetic
atgacatagcaaactgcttgcggaaaaatggaaaaaaggtcattcaacttagtaggaagacttttgatacagaat

SEQ ID NO: 56556 - DNA, 75 bp, Artificial Sequence
  Synthetic
acagtccacaatggagacacccatgcagtaggaaatgacacatccaatcatggagtgacagccacgataactccc

SEQ ID NO: 56557 - DNA, 75 bp, Artificial Sequence
  Synthetic
gcctgtagctccatcgtggggatgtaaaaacccgggaggctgcaacccatggaagctgtacgcatggggtagcag

SEQ ID NO: 56558 - DNA, 75 bp, Artificial Sequence
  Synthetic
taccacctctaagatacagaggtgaggatggatgctggtacgggatggaaatcagaccattgaaagagaaagaag

SEQ ID NO: 56559 - DNA, 75 bp, Artificial Sequence
  Synthetic
atacatactcagagacatatcaaagattccagggggaaatatgtatgcagatgacacagccggatgggacacaag

SEQ ID NO: 56560 - DNA, 75 bp, Artificial Sequence
  Synthetic
tatatcaagactaggaccaatgattgggactttgtggtcacgactgacatttcagaaatgggtgctaattttaaa

SEQ ID NO: 56561 - DNA, 75 bp, Artificial Sequence
  Synthetic
atactgctagttgcagtatcttttgtgacattgattactgggaacatgtcttttagagacctgggaagagtgatg

SEQ ID NO: 56562 - DNA, 75 bp, Artificial Sequence
  Synthetic
aggcatcaaaagaggagaaacggaccaccatgctgtgtcgcgaggctcagcaaaactgagatggttcgtcgagag

SEQ ID NO: 56563 - DNA, 75 bp, Artificial Sequence
  Synthetic
ggaagtggacaggttggaacctatggcttaaacaccttcaccaacatggaggcccaactaataagacaaatggag

SEQ ID NO: 56564 - DNA, 75 bp, Artificial Sequence
  Synthetic
actcatggaaaacatggggaaaggcgaaaatgctctccacagagtctcacaatcagacctttctcattgatggcc

SEQ ID NO: 56565 - DNA, 75 bp, Artificial Sequence
  Synthetic
ggaaaaagacatcgctctgtctcatgatgatattgccagcaacacttgctttccacttgacttcacgagatggag

SEQ ID NO: 56566 - DNA, 75 bp, Artificial Sequence
  Synthetic
ggtgaaaccaattgatgacaggttcgcaacagccttaacagctttgaatgacatgggaaaggtaagaaaagacat

SEQ ID NO: 56567 - DNA, 75 bp, Artificial Sequence
  Synthetic
ttggtggactgttcacatcactgggaaaggctgtacaccaagtttttggaagtgtgtatacaaccatgtttggag

SEQ ID NO: 56568 - DNA, 75 bp, Artificial Sequence
  Synthetic
tatgctattataggtccaggattgcaggcaaaagccactcgtgaagctcaaaaaaggacagctgctggaataatg

SEQ ID NO: 56569 - DNA, 75 bp, Artificial Sequence
  Synthetic
caagtataaaagcaggaaatgacatagcagcttgtctcaggaaaaatggaaagaaagtgatacaactcagtagga

SEQ ID NO: 56570 - DNA, 75 bp, Artificial Sequence
  Synthetic
ctcaacccatatatgccctcagttatagaaaaaatggaagcactgcaaaggaaatatggaggagccttagtgaga

SEQ ID NO: 56571 - DNA, 75 bp, Artificial Sequence
  Synthetic
ctgcaacccatggaagctgtacgcatggggtagcaggccagtgtttagaggagacccctcatcacacataacgct

SEQ ID NO: 56572 - DNA, 75 bp, Artificial Sequence
  Synthetic
ggaaaatgttatgtggaagcaaataaccaacgagctaaactatgttctctgggaaggaggacatgacctcactgt

SEQ ID NO: 56573 - DNA, 75 bp, Artificial Sequence
  Synthetic
cagttcggaagcttgcttaacacagttctaacagtttatttgaatagagagcagatctctggaaaatgaaccaac

SEQ ID NO: 56574 - DNA, 75 bp, Artificial Sequence
  Synthetic
aggttagaggagcccccccgcacaacatcaaacagcatattgacgctggaagagaccacaaatcctgctgtctct

SEQ ID NO: 56575 - DNA, 75 bp, Artificial Sequence
  Synthetic
ggcagtctcaggagtgtacccaatgtcaataccagcaactctttttgtgtggtacttttggcagaaaaagaaaca

SEQ ID NO: 56576 - DNA, 75 bp, Artificial Sequence
  Synthetic
acatgccctcagttatagaaaaaatggaagcgctgcaaaggaaatacggaggagctttggtgaggaatccactct

SEQ ID NO: 56577 - DNA, 75 bp, Artificial Sequence
  Synthetic
ttcaaggatcctggaacacgggagaagaagtgcaggtgattgctgttgaaccaggaaaaaaccccaaaaatgtac

SEQ ID NO: 56578 - DNA, 75 bp, Artificial Sequence
  Synthetic
ttgagggagctaagctcaacgtagttctacagtttttttaattagagagcagatctctgatgaataaccaacgaa

SEQ ID NO: 56579 - DNA, 75 bp, Artificial Sequence
  Synthetic
attagagagcagatctctgatgaacaaccaacggaaaaagacggctcgaccgtctttcaatatgctgaaacgcgc

SEQ ID NO: 56580 - DNA, 75 bp, Artificial Sequence
  Synthetic
tctttgaggaccaccactgcatctggaaaactggtcacgcagtggtgctgccgctcctgcacgatgcctccctta

SEQ ID NO: 56581 - DNA, 75 bp, Artificial Sequence
  Synthetic
tgatattggtgagtcctctccgaatccaactatagaagaaggaagaacgttacgtgttctaaagatggtggaacc

SEQ ID NO: 56582 - DNA, 75 bp, Artificial Sequence
  Synthetic
gatgtcatatccagacgtgaccagagaggaagtggacaggtcggaacttatggcttaaacactttcaccaatatg

SEQ ID NO: 56583 - DNA, 75 bp, Artificial Sequence
  Synthetic
taagagaagtcaaaggcctaacaaaaggaggaccaggacacgaagaacccatccctatgtcaacatatgggtgga

SEQ ID NO: 56584 - DNA, 75 bp, Artificial Sequence
  Synthetic
cacggtaatggacatcatatctaggaaagaccaaagaggcagtggacaggtggggacttatggtctgaatacatt

SEQ ID NO: 56585 - DNA, 75 bp, Artificial Sequence
  Synthetic
tggaagcccaattaattagacagatggagggagaaggaatcttcaaaagcattcagcacctgacagtcacagaag

SEQ ID NO: 56586 - DNA, 75 bp, Artificial Sequence
  Synthetic
ggatggccattgtcaaagatggacatcggagttccccttctcgccattggatgttactcacaagtcaatcccata

SEQ ID NO: 56587 - DNA, 75 bp, Artificial Sequence
  Synthetic
atatgcacaaatgtggcagctgatgtacttccacaggagagacctgagactagcggctaatgctatctgttcagc

SEQ ID NO: 56588 - DNA, 75 bp, Artificial Sequence
  Synthetic
atggaactcattgatggaatatcattggggttgatattactaaaaatagtaacacactttgataacacccaagtg

SEQ ID NO: 56589 - DNA, 75 bp, Artificial Sequence
  Synthetic
caagcgcactgctatggatggccagtgtggagccccattggatagcggcctccatcatactggagttcttcctga

SEQ ID NO: 56590 - DNA, 75 bp, Artificial Sequence
  Synthetic
caccaagaccaaaacgaggcacagcacaaattatggaggtgacagccaagtggatgtggggtttcctctttagaa

SEQ ID NO: 56591 - DNA, 75 bp, Artificial Sequence
  Synthetic
catggcttggaggaccatcatggctgtgttctttgtggtcacactcattcctttgtgcaggacaagctgtcttca

SEQ ID NO: 56592 - DNA, 75 bp, Artificial Sequence
  Synthetic
gtggagtctcatgtattttcacagaagagatcttagactagcatccaacgccatatgttcagcagtaccagtcca

SEQ ID NO: 56593 - DNA, 75 bp, Artificial Sequence
  Synthetic
tgaaccaactgagcaagtcagaattcaacacttataaaaggagtgggatcatggaagtggacagatccgaagcca

SEQ ID NO: 56594 - DNA, 75 bp, Artificial Sequence
  Synthetic
ctggacaaaagaaggggaaaggaagaaattaaaacccagatggttggatgctaggatctactctgacccactggc

SEQ ID NO: 56595 - DNA, 75 bp, Artificial Sequence
  Synthetic
gaaccagagcgtgaaaaagtggatgccattgatggtgaataccgtttgagaggagaagcaaggaaaacctttgtg

SEQ ID NO: 56596 - DNA, 75 bp, Artificial Sequence
  Synthetic
tggaagctgtacgcatggggtagcagactagtggttagaggagacccctcccaagacacaacgcagcagcggggc

SEQ ID NO: 56597 - DNA, 75 bp, Artificial Sequence
  Synthetic
cgcacaacaacaaacagcatattgacgctgggagagaccagagatcctgctgtctctacagcatcattccaggca

SEQ ID NO: 56598 - DNA, 75 bp, Artificial Sequence
  Synthetic
agtatgaaggtgctggagctccgtgtaaagtccccatagagataagagatgtgaacaaggaaaaagtggttgggc

SEQ ID NO: 56599 - DNA, 75 bp, Artificial Sequence
  Synthetic
tttgttgttgggagttgggttggccatggcaacaacgttacaactgccagaggacattgaacaaatggcgaatgg

SEQ ID NO: 56600 - DNA, 75 bp, Artificial Sequence
  Synthetic
tacttgctacgtcaatcttcaagctgaccttccaaataagtgtggtaagggtgcaaagaccagcaaaaagtggaa

SEQ ID NO: 56601 - DNA, 75 bp, Artificial Sequence
  Synthetic
tttagcgggagctacttggccggagctggactacacgtcccgctccggaaaaacacactccgcacaagaagagga

SEQ ID NO: 56602 - DNA, 75 bp, Artificial Sequence
  Synthetic
ttaccaaatcaggtgattacgtcagtgccataacgcaagccgaaagaattggtgagccagattatgaagtggatg

SEQ ID NO: 56603 - DNA, 75 bp, Artificial Sequence
  Synthetic
agactgatcacagctaacccagtggtgaccaagaaggaagagcctgtcaatattgaggcagaacctccttttggg

SEQ ID NO: 56604 - DNA, 75 bp, Artificial Sequence
  Synthetic
ccattaattctggctccccctagagtcgtgccagctgaaatggaggaacctcttagaggcctcccaataagatac

SEQ ID NO: 56605 - DNA, 75 bp, Artificial Sequence
  Synthetic
gctttgatagctgtgctgactggtggagtgacgctgttcttcctatcaggaaaaggtctagggaaaacatccatt

SEQ ID NO: 56606 - DNA, 75 bp, Artificial Sequence
  Synthetic
caagggatggccaatatcgaagatggacataggagttccacttctcgccttagggtgctattcccaggtgaaccc

SEQ ID NO: 56607 - DNA, 75 bp, Artificial Sequence
  Synthetic
cactagagaagctcaaaaaaggacagcggccggaataatgaaaaatccaaccgtagacgggattgttgcaataga

SEQ ID NO: 56608 - DNA, 75 bp, Artificial Sequence
  Synthetic
tgggccttgtgtgaatccatcacactggctactggacccctgaccactctttgggagggatctccaggaaaattc

SEQ ID NO: 56609 - DNA, 75 bp, Artificial Sequence
  Synthetic
gatacagaggtgaggatggatgctggtacgggatggaaatcagaccattgaaagagaaagaagagaatttggtca

SEQ ID NO: 56610 - DNA, 75 bp, Artificial Sequence
  Synthetic
ttccaacattgtttggtccggaaagggaaaaaacccaagccattgatggagagttccgcctcagaggggaacaaa

SEQ ID NO: 56611 - DNA, 75 bp, Artificial Sequence
  Synthetic
gcaaaagacaaaccaacattggacattgaactcttgaagacggaagtcacaaaccctgccgtcctgcgcaaactg

SEQ ID NO: 56612 - DNA, 75 bp, Artificial Sequence
  Synthetic
tggggcatttgaagtgtagactgaggatggacaagctgcaactcaaagggatgtcgtactccatgtgcacaggaa

SEQ ID NO: 56613 - DNA, 75 bp, Artificial Sequence
  Synthetic
gaaaaagctaaggccaaaatggttagatgcacgtgtgtacgctgaccccatggctttgaaggatttcaaggagtt

SEQ ID NO: 56614 - DNA, 75 bp, Artificial Sequence
  Synthetic
tggctgtgggctcttcggaaaaggaagcctaataacgtgtgctaagttcaagtgtgtgacaaaactggaaggaaa

SEQ ID NO: 56615 - DNA, 75 bp, Artificial Sequence
  Synthetic
gagagatttaggaatgtctaaagaaccaggtgttgtttctccaaccagctatttagatgtagacttgcacccagc

SEQ ID NO: 56616 - DNA, 75 bp, Artificial Sequence
  Synthetic
cagcaataggagcagtgttcgttgatgaaaaccaatggaactcagcaaaagaagcagtggaagacgaaaggtttt

SEQ ID NO: 56617 - DNA, 75 bp, Artificial Sequence
  Synthetic
tgaaagacacgctcaaaaggagaagctggccactgaatgagggggtgatggccgttggacttgtgagcattctag

SEQ ID NO: 56618 - DNA, 75 bp, Artificial Sequence
  Synthetic
gagaattatctagattacatgacatcaatgaagagattcaagaatgagagtgatcccgaaggggcactctggtga

SEQ ID NO: 56619 - DNA, 75 bp, Artificial Sequence
  Synthetic
catgaaatgtactgggtttcatgtggaacaggaaacattgtgtcggcagtgaacatgacatccagaatgttgctg

SEQ ID NO: 56620 - DNA, 75 bp, Artificial Sequence
  Synthetic
attctgcataaaaattctaaatccttacatgccaagtgtggtagaaactctggagcaaatgcaaagaaaacatgg

SEQ ID NO: 56621 - DNA, 75 bp, Artificial Sequence
  Synthetic
ctctgccagtgtacctaatgactcttatgaaaggagcctcaagaagatcttggcctcttaatgagggcataatgg

SEQ ID NO: 56622 - DNA, 75 bp, Artificial Sequence
  Synthetic
ggaagacaaaaccccagtggaatcatgggaggaaatcccatacttgggaaaaagagaagaccaatggtgcggctc

SEQ ID NO: 56623 - DNA, 75 bp, Artificial Sequence
  Synthetic
gtcaccagttagagttccaaactataacttgataataatggatgaggctcatttcacagacccagccagtatagc

SEQ ID NO: 56624 - DNA, 75 bp, Artificial Sequence
  Synthetic
aaaggaatcatgcaggcaggaaaacgatctttgcggcctcagcccactgagctgaagtactcatggaaaacatgg

SEQ ID NO: 56625 - DNA, 75 bp, Artificial Sequence
  Synthetic
gatcacagccaacccagtggtgaccaagaaggaggagcctgtcaacattgaggctgaacctccttttggggaaag

SEQ ID NO: 56626 - DNA, 75 bp, Artificial Sequence
  Synthetic
cgcccttgatcttgtgacagaaataggaagagtgccttcacacttagcccacagaacgagaaacgctctggacaa

SEQ ID NO: 56627 - DNA, 75 bp, Artificial Sequence
  Synthetic
ggatgttatccccatggtcacacaaatagctatgactgataccacacccttcggacaacagagagtgtttaaaga

SEQ ID NO: 56628 - DNA, 75 bp, Artificial Sequence
  Synthetic
tttaagagacgtgagcaagaaagaaggaggagcaatgtatgccgatgacaccgcaggatgggacacaagaatcac

SEQ ID NO: 56629 - DNA, 75 bp, Artificial Sequence
  Synthetic
ttaagctgacctaccaaaacaaggtggtaagggtgcaaagaccagcaaaaaatggaaccgtgatggatgttatat

SEQ ID NO: 56630 - DNA, 75 bp, Artificial Sequence
  Synthetic
caggtgttgtttctccaaccagctatttggatgtggatttgcacccagcatcagcctggacattgtacgctgtgg

SEQ ID NO: 56631 - DNA, 75 bp, Artificial Sequence
  Synthetic
ttaagggaatgccaataaggtatcagacaacagcagtgaagagtgaacacacgggaaaggagatagttgacctta

SEQ ID NO: 56632 - DNA, 75 bp, Artificial Sequence
  Synthetic
aaaatggacttaggcgtaccactattggcactgggttgctattcacaagtgaacccactaactctcacagcggca

SEQ ID NO: 56633 - DNA, 75 bp, Artificial Sequence
  Synthetic
taccaaaacaaggtggtgcgtgtgcaaagaccaacaccaagaggcacagtaatggacatcatatcgagaagagac

SEQ ID NO: 56634 - DNA, 75 bp, Artificial Sequence
  Synthetic
ctacttatggctggaatttggtcaaactccattcaggggttgatgtgttctacaaacccactgagcaggtggaca

SEQ ID NO: 56635 - DNA, 75 bp, Artificial Sequence
  Synthetic
aagccctgggttttttgaatgaagatcactggtttggcagagaaaactcatggagtggagtggaaggggaaggtc

SEQ ID NO: 56636 - DNA, 75 bp, Artificial Sequence
  Synthetic
gggaaccttcaaaaggatggaatgactggcagcaagtgcctttctgttcacaccatttccaccagctgatcatga

SEQ ID NO: 56637 - DNA, 75 bp, Artificial Sequence
  Synthetic
ttggagcaatggtgtactagagagtgacatgatcatcccaaagagtctagctggtcctatttcacaacacaacca

SEQ ID NO: 56638 - DNA, 75 bp, Artificial Sequence
  Synthetic
tgcattgaggggaaaattaccaacataacaactgactcaagatgtcctacccaaggggaagcggctttgcctgag

SEQ ID NO: 56639 - DNA, 75 bp, Artificial Sequence
  Synthetic
cacgccaaacatgaatggatgacaacggaagacatgctgacagtctggaacagggtgtggatccaagaaaaccct

SEQ ID NO: 56640 - DNA, 75 bp, Artificial Sequence
  Synthetic
taacgcaaagggcccagaatgctttggacaatctggttatgctgcacaactctgaacaaggaggaaaagcttata

SEQ ID NO: 56641 - DNA, 75 bp, Artificial Sequence
  Synthetic
atgaagagattcaagaatgagagtgatcccgaaggggcactctggtaagtcaacacactcatgaaataaaggaaa

SEQ ID NO: 56642 - DNA, 75 bp, Artificial Sequence
  Synthetic
ggtggacaacttcacaatgggagtcctgtgtttggcaatcctctttgaagaggtgatgagaggaaaatttgggaa

SEQ ID NO: 56643 - DNA, 75 bp, Artificial Sequence
  Synthetic
cagaaaggagataggccgtatgctgaacatcttgaatggaaggaaaaggtcaacaataacattgttgtgcttgat

SEQ ID NO: 56644 - DNA, 75 bp, Artificial Sequence
  Synthetic
attgatgggacttgataagggatggccaatatcaaagatggatataggagttccacttctcgccttggggtgcta

SEQ ID NO: 56645 - DNA, 75 bp, Artificial Sequence
  Synthetic
gtacatgtggctgggggcgcggttcctggaatttgaagccctgggttttttgaatgaagatcactggtttagcag

SEQ ID NO: 56646 - DNA, 75 bp, Artificial Sequence
  Synthetic
aatagaggaccctctttaagaacgactactgcctctggaaaactcataacagaatggtgctgccgatcctgcaca

SEQ ID NO: 56647 - DNA, 75 bp, Artificial Sequence
  Synthetic
aacatgattatcatggatgaagcacatttcaccgatccatccagcatagcggccagagggtacatctcaacccga

SEQ ID NO: 56648 - DNA, 75 bp, Artificial Sequence
  Synthetic
cgaaggcagacctcgagaaccctcatctgctagagaagaaaatcacacaatggttggaaaccaaaggagtggaga

SEQ ID NO: 56649 - DNA, 75 bp, Artificial Sequence
  Synthetic
aatctctaggaggaggtaggagagggacgggagcccaaggggaaacactgggagaaaagtggaaaagacagctaa

SEQ ID NO: 56650 - DNA, 75 bp, Artificial Sequence
  Synthetic
gtttcaagaaagaaatctcaaacatgttgaatataatgaatagaaggaaaagatctgtgaccatgctccttatgc

SEQ ID NO: 56651 - DNA, 75 bp, Artificial Sequence
  Synthetic
acaccgaaaggagcggtaatggacattatatccaggaaagaccaaagaggtagtggacaggttggaacatatggt

SEQ ID NO: 56652 - DNA, 75 bp, Artificial Sequence
  Synthetic
aggagtggggaacagagactttgtggaaggagtctcaggtggagcatgggtcgatctggtgctagaacatggagg

SEQ ID NO: 56653 - DNA, 75 bp, Artificial Sequence
  Synthetic
tggaacccttgggctagaatgctcaccacggacaggtttggatttcaatgaaatgattttattgacaatgaagaa

SEQ ID NO: 56654 - DNA, 75 bp, Artificial Sequence
  Synthetic
gaaggagtctcaggtggagcatgggtcgatctggtgctagaacatggaggatgtgtcacaaccatggcccaggga

SEQ ID NO: 56655 - DNA, 75 bp, Artificial Sequence
  Synthetic
tactaatagtatcaggcatctttccatactccatacccgccacactgttggtctggcatacttggcaaaagcaaa

SEQ ID NO: 56656 - DNA, 75 bp, Artificial Sequence
  Synthetic
tggatagcggcctcaattatactggagttttttctcatggtgctgttgataccagaaccagaaaaacaaaggacc

SEQ ID NO: 56657 - DNA, 75 bp, Artificial Sequence
  Synthetic
aagttaggaaagatatacaacaatgggaaccctcaagaggatggaatgattggacacaagtgcctttctgttcac

SEQ ID NO: 56658 - DNA, 75 bp, Artificial Sequence
  Synthetic
ctggaacagggtgtggatagaggacaatccatggatggaagacaaaactccagtcacaacttgggaagatgttcc

SEQ ID NO: 56659 - DNA, 75 bp, Artificial Sequence
  Synthetic
caatggctcacaggaagccaacatatgaaagagatgtggacttgggcgctggaacaagacatgtggcagtagaac

SEQ ID NO: 56660 - DNA, 75 bp, Artificial Sequence
  Synthetic
cgtggaaggactgtcaggagcaacctgggtagatgtggtactggaacatggaagttgcgtcaccaccatggcaaa

SEQ ID NO: 56661 - DNA, 75 bp, Artificial Sequence
  Synthetic
taggattaaactcaaggagcacgtccctttcgatgacgtgcattgcagttggcctagtaacactatacctaggag

SEQ ID NO: 56662 - DNA, 75 bp, Artificial Sequence
  Synthetic
acctgggcgaagaacattcacacggccataacccaggtcaggaatctgatcggaaaagaggaatacgtggattac

SEQ ID NO: 56663 - DNA, 75 bp, Artificial Sequence
  Synthetic
ggtttgtcccaagcataagagctggaaacgacatagcagcctgcttaaggaaaaatgggaaaagagtgattcagc

SEQ ID NO: 56664 - DNA, 75 bp, Artificial Sequence
  Synthetic
gaaaatagaaaaagcatctttcattgaagtcaaaagctgccactggccaaggtcacatactctttggagcaacgg

SEQ ID NO: 56665 - DNA, 75 bp, Artificial Sequence
  Synthetic
atgccagtcatgaaaagatacagcgctcctttcgagagtgaaggagttctgtaattattaacaacaaacaccaaa

SEQ ID NO: 56666 - DNA, 75 bp, Artificial Sequence
  Synthetic
ctgttaagaacctattgcattgaagcctcaatatcaaacataaccacggcaacaagatgtccaacgcaaggagag

SEQ ID NO: 56667 - DNA, 75 bp, Artificial Sequence
  Synthetic
gacatttatcaaaacaacgttttccttgcactatgcatggaagacaatggctatggtactgtcaattgtatctct

SEQ ID NO: 56668 - DNA, 75 bp, Artificial Sequence
  Synthetic
acaataatggacctacatccaggatcggggaaaacaagaagatatcttccagccatagtccgtgaggccataaaa

SEQ ID NO: 56669 - DNA, 75 bp, Artificial Sequence
  Synthetic
gagataagagatgtgaacaaggaaaaagtggttgggcgtatcatctcatctactccttttgctgagaataccaac

SEQ ID NO: 56670 - DNA, 75 bp, Artificial Sequence
  Synthetic
actattgacagcaattaccttcgtgacactgatcaccgggaatctttcttacaaagacctagggagggtgataat

SEQ ID NO: 56671 - DNA, 75 bp, Artificial Sequence
  Synthetic
acactgatcaccgggaatctttcttacaaagacctagggagggtgataataatggtgggagctgccatgacagat

SEQ ID NO: 56672 - DNA, 75 bp, Artificial Sequence
  Synthetic
aagtcaggccatcacaaaatgccacggcttgagtaaaccgtgcagcctgtagctccacctgaggaggtgtaaaaa

SEQ ID NO: 56673 - DNA, 75 bp, Artificial Sequence
  Synthetic
tagaccaacctttgcagtgggactcgtgttgcggaaactcacttcaaaagagctgatgatggccactataggaat

SEQ ID NO: 56674 - DNA, 75 bp, Artificial Sequence
  Synthetic
ggttagaattctaattgggttcttagtgttgtggattggcacgaattcaagaaacacctcaatggcaatgtcatg

SEQ ID NO: 56675 - DNA, 75 bp, Artificial Sequence
  Synthetic
ggaagtggtgctttgatggaatcagaaacaatcagatcctggaggagaacatggaagtggaagtttggacgaaag

SEQ ID NO: 56676 - DNA, 75 bp, Artificial Sequence
  Synthetic
ggtgacaacagacatttcagaaatgggagccaactttaaagcagatagagtgattgacccaagaagatgtctcaa

SEQ ID NO: 56677 - DNA, 75 bp, Artificial Sequence
  Synthetic
acgcattggctttagggataatgattctgaaattagtacggaagatggagaaatatcaattggcagcaactgtga

SEQ ID NO: 56678 - DNA, 75 bp, Artificial Sequence
  Synthetic
caaagagcatggaacatttgggaagttgaggactatgggtttggaattttcacgacaaacatatggctgaaattg

SEQ ID NO: 56679 - DNA, 75 bp, Artificial Sequence
  Synthetic
agagagcattagcacctccagtgaatgatttgaaatattcatggaagacatggggaaaagcaaagatcttcactc

SEQ ID NO: 56680 - DNA, 75 bp, Artificial Sequence
  Synthetic
gatacagaatatcaaaagaccagactgaatgattgggacttcgtggtgacaacagatatttcagaaatgggagct

SEQ ID NO: 56681 - DNA, 75 bp, Artificial Sequence
  Synthetic
ccaagagacttggaacagacaagatttgctggtcacattcaagacagctcatgcaaagaagcaggaagtagtcgt

SEQ ID NO: 56682 - DNA, 75 bp, Artificial Sequence
  Synthetic
ggcacccagggttcaccatactagccctatttcttgcccattacataggcacttccttgacccagaaagtggtta

SEQ ID NO: 56683 - DNA, 75 bp, Artificial Sequence
  Synthetic
aaatccaaacgtctggaacgacaacaatttttgcaggacacctgaaatgtagactaaaaatggacaaactgactc

SEQ ID NO: 56684 - DNA, 75 bp, Artificial Sequence
  Synthetic
cctcggtgaatgtgtcattaacggccattgccaaccaggctaccgttttaatggggcttgggaaaggatggccgt

SEQ ID NO: 56685 - DNA, 75 bp, Artificial Sequence
  Synthetic
agacctggaagctggcaagagcttctttcatagaagttaaaacatgtatctggccaaaatcccacactctatgga

SEQ ID NO: 56686 - DNA, 75 bp, Artificial Sequence
  Synthetic
aggaacagatgcaccatgcaagatccccttttcgacccaagatgagaaaggagtgacccagaatagattgataac

SEQ ID NO: 56687 - DNA, 75 bp, Artificial Sequence
  Synthetic
ccccaccacaagatcctagccaaagccattttcaaactaacctatcaaaacaaagtggtgaaagtcctcagaccc

SEQ ID NO: 56688 - DNA, 75 bp, Artificial Sequence
  Synthetic
cgtagacagaggctgggggaacggttgtggtttgtttggcaagggaagcttggtaacatgtgcgaaatttcaatg

SEQ ID NO: 56689 - DNA, 75 bp, Artificial Sequence
  Synthetic
agacagcactaatggtgataggaatggccatgacaacggtgctttcaattccacatgaccttatggaattcattg

SEQ ID NO: 56690 - DNA, 75 bp, Artificial Sequence
  Synthetic
agaggagacccctcccatgacacaacgcagcagcggggcccgagcactgagggaagctgtacctccctgcaaaag

SEQ ID NO: 56691 - DNA, 75 bp, Artificial Sequence
  Synthetic
aggcggtgcctgaaaccggtaatactaaaagatggtccagagcgtgtcattctagccggaccgatgccagtgact

SEQ ID NO: 56692 - DNA, 75 bp, Artificial Sequence
  Synthetic
catggaacacaaatactcatggaaaagctggggaaaagccaaaatcataggagcagacatacagaacaccacctt

SEQ ID NO: 56693 - DNA, 75 bp, Artificial Sequence
  Synthetic
tggacaccaggacacccaggcccatgccagggacaagaaaggttatggagatcacagcggaatggctttggagaa

SEQ ID NO: 56694 - DNA, 75 bp, Artificial Sequence
  Synthetic
gaaggtgtgtttcacacaatgtggcatgtaacaagaggatcagtgatttgccatgagagtgggagactggagcca

SEQ ID NO: 56695 - DNA, 75 bp, Artificial Sequence
  Synthetic
ccattatgaagaacacaaccaacacaagaaggggaactggcaacataggagagacgcttggagagaaatggaaaa

SEQ ID NO: 56696 - DNA, 75 bp, Artificial Sequence
  Synthetic
gcagtttcaggggtgtacccattatcaataccagcgacccttttcgtgtggtacttttggcagaaaaagaaacag

SEQ ID NO: 56697 - DNA, 75 bp, Artificial Sequence
  Synthetic
tgattacgtcagtgccataacacaagctgaaagaattggcgaaccagattatgaagtggatgaggacatctttcg

SEQ ID NO: 56698 - DNA, 75 bp, Artificial Sequence
  Synthetic
tacccatgaaatgtattgggtttcatgtggaacaggaaacattgtgtcagcagtaaacatgacatccagaatgtt

SEQ ID NO: 56699 - DNA, 75 bp, Artificial Sequence
  Synthetic
acaaaattcctctttcataatagacgggccaaacacaccggagtgtccaagtgcctcaagagcatggaatgtgtg

SEQ ID NO: 56700 - DNA, 75 bp, Artificial Sequence
  Synthetic
aaagaattcttccatcaatcgttagagaagctttaaaaaggaggctacgaaccctgattctggcacccacgagag

SEQ ID NO: 56701 - DNA, 75 bp, Artificial Sequence
  Synthetic
agaagctttaaaaaggaggctacgaaccctgattctggcacccacgagagtggtagcggccgaaatggaagaagc

SEQ ID NO: 56702 - DNA, 75 bp, Artificial Sequence
  Synthetic
tgacatggaatgatctgatcaggttatgcatcatggttggagccaatgcttcagacaggatggggatgggaacaa

SEQ ID NO: 56703 - DNA, 75 bp, Artificial Sequence
  Synthetic
gatcatgaaagatggaagaaagttggtggttccctgcagaccccaggacgaactaataggaagagcgagaatttc

SEQ ID NO: 56704 - DNA, 75 bp, Artificial Sequence
  Synthetic
tgcaaaccgtggaagctgtacgcacgttgtagcagactagcggttaggagagaacccctccatgacacaacgcag

SEQ ID NO: 56705 - DNA, 75 bp, Artificial Sequence
  Synthetic
gaagagcctatagacatgcaatggaagaactgccagacaccatagaaacgttgatgctcctagctttgatagctg

SEQ ID NO: 56706 - DNA, 75 bp, Artificial Sequence
  Synthetic
tgttgccgctcgtgcacacttcctcccctgcgatacatgggagaagacggctgctggtatggcatggaaattaga

SEQ ID NO: 56707 - DNA, 75 bp, Artificial Sequence
  Synthetic
aacaagacgcgaactttgtgtgccgacgaacgtttgtggacagaggctggggcaatggctgtgggctcttcggaa

SEQ ID NO: 56708 - DNA, 75 bp, Artificial Sequence
  Synthetic
cccagagcaacagcccaatagaagatatcgagagggaaattccagaaaggtcatggaacacagggtttgactgga

SEQ ID NO: 56709 - DNA, 75 bp, Artificial Sequence
  Synthetic
tggaagacaatggctatggtactgtcaattgtatctctcttccccttatgcctgtccacgacctcccaaaaaaca

SEQ ID NO: 56710 - DNA, 75 bp, Artificial Sequence
  Synthetic
tggggatgtaaaaacctgggaggctgcaacccatggaagctgtacgcatggggtagcagtctcgggaatcgatga

SEQ ID NO: 56711 - DNA, 75 bp, Artificial Sequence
  Synthetic
ggaagagagagaaaaaactaggagagtttggaaaggcaaaaggaagtcgtgcaatatggtacatgtggttgggag

SEQ ID NO: 56712 - DNA, 75 bp, Artificial Sequence
  Synthetic
gtagttctaacagttttttaattagagagcagatctctgatgaataaccaacgaaaaaaggcgagaagtacgcct

SEQ ID NO: 56713 - DNA, 75 bp, Artificial Sequence
  Synthetic
agaagtcaggccttcaatgccacagcttgagcaaactgtgcagcctgtagctccacctgggaaggtgtaaaaaat

SEQ ID NO: 56714 - DNA, 75 bp, Artificial Sequence
  Synthetic
ggaaaaggaatggggaaattgtcaatgggtttgatagccatcgcggtagctagtggcttgctctgggtagcagaa

SEQ ID NO: 56715 - DNA, 75 bp, Artificial Sequence
  Synthetic
ggccatttttaaattaacgtaccaaaacaaggtggtgcgtgtgcaaagaccaacaccaagaggcacagtaatgga

SEQ ID NO: 56716 - DNA, 75 bp, Artificial Sequence
  Synthetic
ttagaggagaccccccgcataacaataaacagcatattgacgctgggagagaccagagatcctgcttctctacag

SEQ ID NO: 56717 - DNA, 75 bp, Artificial Sequence
  Synthetic
cagcatggacgctctatgcagtagccaccactatcttgactcccatgctgagacacaccatagaaaacacgtctg

SEQ ID NO: 56718 - DNA, 75 bp, Artificial Sequence
  Synthetic
gtcaccagtcagagttccaaactataacttgataataatggatgaggctcatttcacagacccagctagcatagc

SEQ ID NO: 56719 - DNA, 75 bp, Artificial Sequence
  Synthetic
ggcacgaacatgtgtactctcatggccatggaccttggtgagttgtgtgaagacacaatcacgtataaatgtcct

SEQ ID NO: 56720 - DNA, 75 bp, Artificial Sequence
  Synthetic
cacggtttgagcaaaccgtgctgcctgtagctccatcgtggggatgtaaaaacctgggaggctgcaacccatgga

SEQ ID NO: 56721 - DNA, 75 bp, Artificial Sequence
  Synthetic
attttggatccctgggaggagtgttcacatctataggaaaggctctccaccaagttttcggagcaatctatgggg

SEQ ID NO: 56722 - DNA, 75 bp, Artificial Sequence
  Synthetic
aagacaacagagccgtccatgccgacatgggttattggatagaaagtgcactcaatgacacatggaagatagaga

SEQ ID NO: 56723 - DNA, 75 bp, Artificial Sequence
  Synthetic
gcttgagatggactttgatttctgcgatggaaccacagtggtggtgactgaggactgcggaaatagaggaccctc

SEQ ID NO: 56724 - DNA, 75 bp, Artificial Sequence
  Synthetic
gtcattctagccggaccgatgccagtgactgtggccagtgctgcccagaggagaggaagaattggaaggaaccaa

SEQ ID NO: 56725 - DNA, 75 bp, Artificial Sequence
  Synthetic
acaggagagacactgggagaaaagtggaagagacaactgaactcactagataggaaggagtttgaagagtacaaa

SEQ ID NO: 56726 - DNA, 75 bp, Artificial Sequence
  Synthetic
gatggggatgggaacaacgtacctagccttgatggctacttttaaaatgagaccaatgttcgctgttgggctatt

SEQ ID NO: 56727 - DNA, 75 bp, Artificial Sequence
  Synthetic
gagcgctgcgcaaaggagagggagagttggcaggaacccacaaaaagaaaatgaccagtacatattcacgggcca

SEQ ID NO: 56728 - DNA, 75 bp, Artificial Sequence
  Synthetic
cgctcaagggaatgccaataagataccaaacaacagcagtgaagagtgaacatacaggaaaagagatagttgacc

SEQ ID NO: 56729 - DNA, 75 bp, Artificial Sequence
  Synthetic
gttggaaaaacatggcgccgaaaggctgaaaagaatggcaattagcggagatgattgcgtggtgaaaccaattga

SEQ ID NO: 56730 - DNA, 75 bp, Artificial Sequence
  Synthetic
cgtgactgaggtgaaagggtacacaaaaggaggtccaggacatgaagaaccgattcccatggccacctatggctg

SEQ ID NO: 56731 - DNA, 75 bp, Artificial Sequence
  Synthetic
acgtagttctaacagttttttattagagagcagatctctgatgaacaaccaacggaaaaagacggctcgaccgtc

SEQ ID NO: 56732 - DNA, 75 bp, Artificial Sequence
  Synthetic
taaaaacccgggaggctgcaacccatggaagctgtacgcatggggtagcagactagtggttagaggagacccctc

SEQ ID NO: 56733 - DNA, 75 bp, Artificial Sequence
  Synthetic
caaccaggcagccgtcctaatggggcttggaaaaggatggccacttcacagaatggacctcggtgtgccgctgtt

SEQ ID NO: 56734 - DNA, 75 bp, Artificial Sequence
  Synthetic
gtgacaaaactggaaggaaagatagtccaatatgaaaacttgaaatattcagtaatagtcaccgtccacactgga

SEQ ID NO: 56735 - DNA, 75 bp, Artificial Sequence
  Synthetic
ggattgaaccatcatgggcggacgtcaaaaaagatctaatatcatatggaggaggctggaagctagaaggagaat

SEQ ID NO: 56736 - DNA, 75 bp, Artificial Sequence
  Synthetic
agcatcagcctggacattgtacgccgtggccactacagtaataacaccaatgttgagacataccatagagaattc

SEQ ID NO: 56737 - DNA, 75 bp, Artificial Sequence
  Synthetic
ggatgtcatccccatggtcacacaaatagctatgactgataccacacccttcggacaacagagagtgtttaaaga

SEQ ID NO: 56738 - DNA, 75 bp, Artificial Sequence
  Synthetic
aagatccgtgaccatgctcctcatgctgctgcccacagccctggcgttccatttgaccacacgagggggagagcc

SEQ ID NO: 56739 - DNA, 75 bp, Artificial Sequence
  Synthetic
atgttgttgatactatgcacatcacagatcctcttgatgcggactacatgggccttgtgtgaatccatcacactg

SEQ ID NO: 56740 - DNA, 75 bp, Artificial Sequence
  Synthetic
aaagttgacacacgcacaccaaaagcaaaacgaggcacagcacaaatcatggaggtgacagccaagtggttatgg

SEQ ID NO: 56741 - DNA, 75 bp, Artificial Sequence
  Synthetic
gatgccagtgactgtggccagtgctgcccagaggagaggaagaattggaaggaaccacaataaggaaggtgatca

SEQ ID NO: 56742 - DNA, 75 bp, Artificial Sequence
  Synthetic
tcctagccaaagccattttcaaactaacttatcaaaacaaagtggtaaaagtcctcagacccacaccgaagggag

SEQ ID NO: 56743 - DNA, 75 bp, Artificial Sequence
  Synthetic
caatggtgtgttagagagtgacatgatcattccaaagagtctagctggtcctatctcgcaacacaactacaggcc

SEQ ID NO: 56744 - DNA, 75 bp, Artificial Sequence
  Synthetic
tccaggaagactttcgtggaactcatgaggaggggtgaccttccagtttggttagcccataaagtagcatcagaa

SEQ ID NO: 56745 - DNA, 75 bp, Artificial Sequence
  Synthetic
aaactcacggattgggattttgtggtcaccacagacatatctgaaatgggggccaattttagagctgggagagtg

SEQ ID NO: 56746 - DNA, 75 bp, Artificial Sequence
  Synthetic
tgagacacccaggattcacggtgatagctctttttctagcacatgccataggaacatccatcacccagaaaggga

SEQ ID NO: 56747 - DNA, 75 bp, Artificial Sequence
  Synthetic
actacatgacatcaatgaagagattcaagaatgagagtgatcccgaaggagccctctggtaagccaacacactca

SEQ ID NO: 56748 - DNA, 75 bp, Artificial Sequence
  Synthetic
cagcttgagcaaactgtgcagcctgtagctccacctgagaaggtgtaaaaaaatctgggaggccacaaaccatgg

SEQ ID NO: 56749 - DNA, 75 bp, Artificial Sequence
  Synthetic
ggatgagaggttcagcacttccctcctcttcttaaacgacatgggaaaggtgaggaaagacatcccgcaatggga

SEQ ID NO: 56750 - DNA, 75 bp, Artificial Sequence
  Synthetic
ttgagaaccttgaatacacagtggttgtgacagtccacaatggagacacccatgcagtaggaaatgacacatcca

SEQ ID NO: 56751 - DNA, 75 bp, Artificial Sequence
  Synthetic
aggaaccaggatgaactgatagggagagccagaatctcgcaaggagctggatggagtttaagagagacagcctgt

SEQ ID NO: 56752 - DNA, 75 bp, Artificial Sequence
  Synthetic
aagttatctagcaggagcaggtctggccttctcattaatgaaatctctaggaggaggtaggagaggtacgggagc

SEQ ID NO: 56753 - DNA, 75 bp, Artificial Sequence
  Synthetic
atatgggtggaacctagtgcgtcttcaaagtggagttgacgttttcttcatcccgccagaaaagtgtgacacatt

SEQ ID NO: 56754 - DNA, 75 bp, Artificial Sequence
  Synthetic
ggaagggcgtacaatcatgctctcagtgaactgccggagaccctggagacactgcttttactgacacttctggct

SEQ ID NO: 56755 - DNA, 75 bp, Artificial Sequence
  Synthetic
gtggtgtggatccttgattggactctcttctagggccacctgggcgaagaacattcacacagccataacccaggt

SEQ ID NO: 56756 - DNA, 75 bp, Artificial Sequence
  Synthetic
tttcactaggactgctatgcatatcaataatgattgaagaggtgatgagatccagatggagtagaaaaatgttga

SEQ ID NO: 56757 - DNA, 75 bp, Artificial Sequence
  Synthetic
ctggtttggcagagaaaactcatggagtggagtggaaggggaaggtctgcatagattgggatacatcctggagga

SEQ ID NO: 56758 - DNA, 75 bp, Artificial Sequence
  Synthetic
atcttgaggagctaaagctcaacgtagtgaacagtttttaattagagagcagatctctgatgaataaccaacgga

SEQ ID NO: 56759 - DNA, 75 bp, Artificial Sequence
  Synthetic
caccctttggacaacagagggtgtttaaagagaaagttgacacgcgcacaccaaaagcaaaacgaggcacagcac

SEQ ID NO: 56760 - DNA, 75 bp, Artificial Sequence
  Synthetic
aaaaaatcaaaagctattaatgttttgagagggttcaggaaagagattggaaggatgctgaacatcttgaacagg

SEQ ID NO: 56761 - DNA, 75 bp, Artificial Sequence
  Synthetic
aatcagaccattgaaagagaaagaagaaaatctggttaactccttggtcacagccggacatgggcagattgacaa

SEQ ID NO: 56762 - DNA, 75 bp, Artificial Sequence
  Synthetic
caaaccgtgctgcctgtagctccatcgtggggatgtaaaaacccgggaggctgcaacccatggaagctgtacgca

SEQ ID NO: 56763 - DNA, 75 bp, Artificial Sequence
  Synthetic
agtatagcagctagaggatacatctcaactcgagtggagatgggtgaggcagctgggattttcatgacagccact

SEQ ID NO: 56764 - DNA, 75 bp, Artificial Sequence
  Synthetic
ccagtctggttggcttacaaagtggcagctgaaggcatcaattacgcagacagaaagtggtgttttgatggaatt

SEQ ID NO: 56765 - DNA, 75 bp, Artificial Sequence
  Synthetic
tgaacacattcaccaacatggaagcccagttaatcagacaaatggaaggagaaggtgtgctgtcaaaggcagacc

SEQ ID NO: 56766 - DNA, 75 bp, Artificial Sequence
  Synthetic
gtgagaagccttataggcaatgaagagtttctggactacatgccttcgatgaagagattcaggaaggaggaggag

SEQ ID NO: 56767 - DNA, 75 bp, Artificial Sequence
  Synthetic
ttggctggtgcacaggcaatggttcttagacctgccgttaccatggctacccggagcggacacacaaggatcaaa

SEQ ID NO: 56768 - DNA, 75 bp, Artificial Sequence
  Synthetic
gagaactcaaatgtggaagtggcatttttgtcactaatgaagtccacacttggacagagcaatacaaattccagg

SEQ ID NO: 56769 - DNA, 75 bp, Artificial Sequence
  Synthetic
cccccgcataacaataaacagcatattgacgctgggagagaccagagatcctgcttctctacagcaaaacaccac

SEQ ID NO: 56770 - DNA, 75 bp, Artificial Sequence
  Synthetic
ctcacgaaactccacgcatgaaatgtactgggtatctaatgctaccgggaacatagtgtcatcagtgaacatgat

SEQ ID NO: 56771 - DNA, 75 bp, Artificial Sequence
  Synthetic
aggttatggagatcacagcggagtggctctggagaaccctgggaaggaacaaaagacccagattatgcacaaggg

SEQ ID NO: 56772 - DNA, 75 bp, Artificial Sequence
  Synthetic
aaaggaaaataagaaatcaaacaaggcaagaagtcaggccggattaagccatagtacggtaagagctatgctgcc

SEQ ID NO: 56773 - DNA, 75 bp, Artificial Sequence
  Synthetic
gcaagaagtcaggccggattaagccatagtacggtaagagctatgctgcctgtgagccccgtccaaggacgtaaa

SEQ ID NO: 56774 - DNA, 75 bp, Artificial Sequence
  Synthetic
acagaggagaaccaatgggacagtgcgaaagctgctgttgaggatgaagaattttggaaacttgtggacagagaa

SEQ ID NO: 56775 - DNA, 75 bp, Artificial Sequence
  Synthetic
tatactactaatgctggtcaccccatccatgacaatgagatgcgtgggagtaggaaacagagattttgtggaagg

SEQ ID NO: 56776 - DNA, 75 bp, Artificial Sequence
  Synthetic
cttggattcttaaatgaagaccactggttctcgcgtgaaaactcttacagtggagtagaaggagaaggactgcac

SEQ ID NO: 56777 - DNA, 75 bp, Artificial Sequence
  Synthetic
taagacctcagcaggtgtcaacatgtgcacccttatagcgatggatttgggagagttatgtgaggacacaatgac

SEQ ID NO: 56778 - DNA, 75 bp, Artificial Sequence
  Synthetic
gttgactgttggtgcaatgccacggacacatgggtgacctatggaacgtgctctcaaactggcgaacaccgacga

SEQ ID NO: 56779 - DNA, 75 bp, Artificial Sequence
  Synthetic
ttagcgaacgctatattcaagctcacataccaaaacaaagtggtcaaagttcaacgaccgactccaacgggcacg

SEQ ID NO: 56780 - DNA, 75 bp, Artificial Sequence
  Synthetic
tcaacgaccgactccaacgggcacggtaatggacattatatctaggaaagaccaaaggggcagtggacaagtggg

SEQ ID NO: 56781 - DNA, 75 bp, Artificial Sequence
  Synthetic
acaatgaagaacaaagcatggatggtacataggcaatggttctttgacctacccctaccatggacatcaggagct

SEQ ID NO: 56782 - DNA, 75 bp, Artificial Sequence
  Synthetic
agggaaaggaatagggaaattgtcaatgggtttgataaccattgcggtagctagtggcttgctctgggtagcaga

SEQ ID NO: 56783 - DNA, 75 bp, Artificial Sequence
  Synthetic
ataacaccacagagttccatcacagaagcagaactgacaggctatggcactgtcacgatggaatgctctccgaga

SEQ ID NO: 56784 - DNA, 75 bp, Artificial Sequence
  Synthetic
tgtgcacactcatagctatggacttgggagagatgtgtgatgacacggtcacttataaatgccccctcattgccg

SEQ ID NO: 56785 - DNA, 75 bp, Artificial Sequence
  Synthetic
agatctctgatgaataaccaacggaaaaaggcgagaaatacgcctttcaatatgctgaaacgcgagagaaaccgc

SEQ ID NO: 56786 - DNA, 75 bp, Artificial Sequence
  Synthetic
cacggtcacttacaaatgcccccacattaccgaagtggaacctgaagacattgactgctggtgcaaccttacatc

SEQ ID NO: 56787 - DNA, 75 bp, Artificial Sequence
  Synthetic
ccatgccacaatgctggacgtagacttacatccagcttcagcctggaccctctatgcagtggccacaacaattat

SEQ ID NO: 56788 - DNA, 75 bp, Artificial Sequence
  Synthetic
taggatcacaagaaggagcaatgcacactgcgctgaccggagcgacagaaatccaaacgtctggaacgacaacaa

SEQ ID NO: 56789 - DNA, 75 bp, Artificial Sequence
  Synthetic
gtggccgcaaccatggcaaacgagatgggtttcctggaaaaaaccaagaaagacctcggattgggaagcattaca

SEQ ID NO: 56790 - DNA, 75 bp, Artificial Sequence
  Synthetic
cattgatggccccgaaacagcagaatgccccaacacaaatagagcttggaactcgttggaagttgaagactacgg

SEQ ID NO: 56791 - DNA, 75 bp, Artificial Sequence
  Synthetic
aacacctcaagctcctacgtcggaaatacagctgaccgactacggaacccttacattagattgttcacctaggac

SEQ ID NO: 56792 - DNA, 75 bp, Artificial Sequence
  Synthetic
ggagaacacagaagggaaaaaagatcagtggcactcgttccacatgtgggaatgggactggagacacgaactgaa

SEQ ID NO: 56793 - DNA, 75 bp, Artificial Sequence
  Synthetic
ttggtgaattgtgtgaagacacaatcacgtacaagtgtccccttctcaggcagaatgaaccagaagacatagatt

SEQ ID NO: 56794 - DNA, 75 bp, Artificial Sequence
  Synthetic
cagaatgaaccagaagacatagattgttggtgcaactctacgtccacatgggtaacttatgggacatgtaccacc

SEQ ID NO: 56795 - DNA, 75 bp, Artificial Sequence
  Synthetic
ccaccttaagccacagtacggaagaagctgtgctgcctgtgagccccgtccaaggacgttaaaagaagaagtcag

SEQ ID NO: 56796 - DNA, 75 bp, Artificial Sequence
  Synthetic
tagagggaaaagtggtgcaatatgagaacctcaaatacaccgtcatcatcacagtgcacacaggagaccaacacc

SEQ ID NO: 56797 - DNA, 75 bp, Artificial Sequence
  Synthetic
ctggaaggacagaggttaaaggagacccccccaaaccaaaaaacagcatattgacgctgggaaaagacagagatc

SEQ ID NO: 56798 - DNA, 75 bp, Artificial Sequence
  Synthetic
atatcaaattaacggtagttgtgggcgatataattggggtcttagagcaaggaaaaagaacactaacaccacaac

SEQ ID NO: 56799 - DNA, 75 bp, Artificial Sequence
  Synthetic
ataccagagaccattcttgaactgaccgatgcgttagctttaggcatgatggtcctcaagatggtgagaaacatg

SEQ ID NO: 56800 - DNA, 75 bp, Artificial Sequence
  Synthetic
aacccaatcgtaacagaaaaagatagcccagtcaacatagaagcagaacctccatttggagacagctacatcatc

SEQ ID NO: 56801 - DNA, 75 bp, Artificial Sequence
  Synthetic
aggccatcatggcggttgggatggtgagtatcttggccagctctctcttaaagaatgacatccccatgacaggac

SEQ ID NO: 56802 - DNA, 75 bp, Artificial Sequence
  Synthetic
agaaaatccatggatggaagacaaaactccagtggaatcatgggaggaaatcccatatctgggaaaaagagaaga

SEQ ID NO: 56803 - DNA, 75 bp, Artificial Sequence
  Synthetic
ttgccagtgtgccagtcttcgagcatgaggaaaacagattggcttccaatgactgtggcagctatgggagttcca

SEQ ID NO: 56804 - DNA, 75 bp, Artificial Sequence
  Synthetic
ggtagatagagggtggggcaacggctgtggcttgtttgggaaaggaggagttgtgacatgtgcgaagttttcatg

SEQ ID NO: 56805 - DNA, 75 bp, Artificial Sequence
  Synthetic
agacacccatgctgtaggaaatgacacatccaaccacggagtgacagctacgataacccccaggtcaccatcggt

SEQ ID NO: 56806 - DNA, 75 bp, Artificial Sequence
  Synthetic
gatcggagccggagtttacaaagaaggaacattccacacaatgtggcacgtcacacgtggtgctgttctaatgca

SEQ ID NO: 56807 - DNA, 75 bp, Artificial Sequence
  Synthetic
agataagagatgtgaacaaggaaaaagtggttgggcgcatcatctcatctaccccttttgctgagaataccaaca

SEQ ID NO: 56808 - DNA, 75 bp, Artificial Sequence
  Synthetic
acctacctagctttaattgcaacatttaaaatccagccattcttggctttgggatttttcctaagaaaactgaca

SEQ ID NO: 56809 - DNA, 75 bp, Artificial Sequence
  Synthetic
cgttcagtgtcgatatatgaagtggacatggtcctaagtcactgtcacagcataccgtgctgcgcgtagctacat

SEQ ID NO: 56810 - DNA, 75 bp, Artificial Sequence
  Synthetic
tgttgtggattggcacgaattcaagaaacacttcaatggctatgtcgtgcatagctgttggaggaatcaccctgt

SEQ ID NO: 56811 - DNA, 75 bp, Artificial Sequence
  Synthetic
cataccgtgctgcgcgtagctacatcgcgactatggagccctcgcaggctgcaaactgcggatgctgtacgcgca

SEQ ID NO: 56812 - DNA, 75 bp, Artificial Sequence
  Synthetic
aggaaggagataggtcgcatgctgaacatcttgaacgggaggaagaggtcaacagtaacattactatgcttgatt

SEQ ID NO: 56813 - DNA, 75 bp, Artificial Sequence
  Synthetic
accggagtgtccaagtgcctcaagagcatggaatgtgtgggaggtggaagattacgggttcggagtcttcacaac

SEQ ID NO: 56814 - DNA, 75 bp, Artificial Sequence
  Synthetic
agtgagaaatatggaaaagtaccaattggcagtgactatcatggctatctcgtgtgtcccaaatgcagtgatact

SEQ ID NO: 56815 - DNA, 75 bp, Artificial Sequence
  Synthetic
acaaaggccggttttttgaaggaagtaagctccacgttgttgttaccgtttttttaattagagagcagatctctg

SEQ ID NO: 56816 - DNA, 75 bp, Artificial Sequence
  Synthetic
aaacaaagaaagacctcggactgggaaacattgcaactcagcaacctgagagcaacattctggacatagatctac

SEQ ID NO: 56817 - DNA, 75 bp, Artificial Sequence
  Synthetic
cacagtggtggccgcaaccatggcaaacgagatgggtttcctggaaaaaacgaagaaagatttcggattgggaag

SEQ ID NO: 56818 - DNA, 75 bp, Artificial Sequence
  Synthetic
cagcggctcttcttttattggtagcacattatgccatcataggaccgggacttcaagccaaagcaaccagagaag

SEQ ID NO: 56819 - DNA, 75 bp, Artificial Sequence
  Synthetic
catggcttgtccacaaacaatggtttctagacttaccactgccttggacctcgggggcttcaacatcccaagaga

SEQ ID NO: 56820 - DNA, 75 bp, Artificial Sequence
  Synthetic
gtgaaggaacaacagttgtcatcacagaaaactgtgggacaagaggcccatcattgagaacaacaacagtgtcag

SEQ ID NO: 56821 - DNA, 75 bp, Artificial Sequence
  Synthetic
gcctggtggcatccgtggagctaccaagttccctagaggagctgggggatggacttgcaataggcatcatgatgt

SEQ ID NO: 56822 - DNA, 75 bp, Artificial Sequence
  Synthetic
taacacctcactcaggggaagagcatgcggtcggaaatgacacaggaaaacatggcaaggaaatcaaagtaacac

SEQ ID NO: 56823 - DNA, 75 bp, Artificial Sequence
  Synthetic
tgtccgtttctccactgctcttaacatcctcacagcagaaagcggattggataccattggcattgacgatcaaag

SEQ ID NO: 56824 - DNA, 75 bp, Artificial Sequence
  Synthetic
aggattcatggcctatatgatcgggcaaacaggaatccagcgaactgtcttctttgttctgatgatgctcgttgc

SEQ ID NO: 56825 - DNA, 75 bp, Artificial Sequence
  Synthetic
aggttagaggagaccccccgcataacaataaacagcatattgacggctggagagacccagagatcctgctgtctc

SEQ ID NO: 56826 - DNA, 75 bp, Artificial Sequence
  Synthetic
ggagcaggaccagaactacgtgtgtaagcacacatacgtggatagaggttggggaaacggttgtggtttgtttgg

SEQ ID NO: 56827 - DNA, 75 bp, Artificial Sequence
  Synthetic
ttgtgacatgtgcaaagttctcatgctcagggaagataacaggcaacttggttcaaattgaaaaccttgaataca

SEQ ID NO: 56828 - DNA, 75 bp, Artificial Sequence
  Synthetic
acatctaaccatggagtgacagccacgataactcctaggtcaccatcagtggaagttgaattaccggactatgga

SEQ ID NO: 56829 - DNA, 75 bp, Artificial Sequence
  Synthetic
gacagacacaactcctttcggacaacagcgcgtcttcaaagagaaggtggatacgagaacccaagaaccaaaaga

SEQ ID NO: 56830 - DNA, 75 bp, Artificial Sequence
  Synthetic
gattctgatgaagatggaaaagaagacgtggcttgtgcacaagcaatggtttttggacttgcctctgccatggac

SEQ ID NO: 56831 - DNA, 75 bp, Artificial Sequence
  Synthetic
aatcttcctattcttgatgagcggaaagggtatagggaagatgaccctgggaatgtgctgcataatcacggccag

SEQ ID NO: 56832 - DNA, 75 bp, Artificial Sequence
  Synthetic
tcgtcagtagacaagagaaagggaaaagtcttctgtttaaaacagaggatggcgtgaacatgtgcaccctcatgg

SEQ ID NO: 56833 - DNA, 75 bp, Artificial Sequence
  Synthetic
ggcgtgaacatgtgcaccctcatggccatggaccttggtgaattgtgtgaagacacaatcacgtacaagtgtccc

SEQ ID NO: 56834 - DNA, 75 bp, Artificial Sequence
  Synthetic
agcaagtgctgctcagagaagagggcgaataggtaggaacccagcacaagaagatgaccaatatgtcttctccgg

SEQ ID NO: 56835 - DNA, 75 bp, Artificial Sequence
  Synthetic
tctcaggaaggagccatgcactctgccctcaccggagccacagaagtggattcaggtgatggaaatcacatgttc

SEQ ID NO: 56836 - DNA, 75 bp, Artificial Sequence
  Synthetic
cttgaactgactgacgcgttggctttggggatgatggttctcaaaatagtgagaaacatggaaaagtatcaacta

SEQ ID NO: 56837 - DNA, 75 bp, Artificial Sequence
  Synthetic
agatggaaggagaaggcgtgttgtcgaaggcagacctcgagaacccccatccgctagagaagaaaatcacacaat

SEQ ID NO: 56838 - DNA, 75 bp, Artificial Sequence
  Synthetic
aggtgccgtatctctggacttttcccctggaacgtcaggatctccaatcatcgacaaaaaaggaaaagttgtggg

SEQ ID NO: 56839 - DNA, 75 bp, Artificial Sequence
  Synthetic
agataagggatgtgaacaaagaaaaagtggttgggcgcatcatttcatctactccatttgctgagaataccaaca

SEQ ID NO: 56840 - DNA, 75 bp, Artificial Sequence
  Synthetic
ctttcctctagggctaagctcgcccttgacaacatagtcatgctccacacaacagaaagaggagggaaggcctac

SEQ ID NO: 56841 - DNA, 75 bp, Artificial Sequence
  Synthetic
tccgaacccaaccatagaagaaggaagaacgttacgtgttctaaagatggtggaaccatggctcagaggaaacca

SEQ ID NO: 56842 - DNA, 75 bp, Artificial Sequence
  Synthetic
acatagtcttagaacatggaagctgtgtgacgacgatggcaaaaaacaaaccaacattggattttgaactgataa

SEQ ID NO: 56843 - DNA, 75 bp, Artificial Sequence
  Synthetic
acatacagaggcgcaaagcggatggccattctaggtgaaacagcttgggactttggttctgttggtggactgttc

SEQ ID NO: 56844 - DNA, 75 bp, Artificial Sequence
  Synthetic
cctaaggaagtattgcatagaagcaaagctaaccaacacaacaacagaatctcgttgcccaacacaaggggaacc

SEQ ID NO: 56845 - DNA, 75 bp, Artificial Sequence
  Synthetic
catgtttggaggagtctcatggatggttagaatcctaatcgggctcctggtgctgtggatcggcacgaactcaag

SEQ ID NO: 56846 - DNA, 75 bp, Artificial Sequence
  Synthetic
gttagaatcctaatcgggctcctggtgctgtggatcggcacgaactcaagaaacactccaatggcgatgacgtgc

SEQ ID NO: 56847 - DNA, 75 bp, Artificial Sequence
  Synthetic
tgattaacagattcacaatgaaacacaagaaagccacctacgagccagatgttgacctaggaagcggaacccgca

SEQ ID NO: 56848 - DNA, 75 bp, Artificial Sequence
  Synthetic
tgaagatcactggttttccagagagaactccctgagtggagtggaaggagaagggctgcacaagctaggttacat

SEQ ID NO: 56849 - DNA, 75 bp, Artificial Sequence
  Synthetic
catgggttgtgtagtgtcatggaccgggaaagaactaaaatgtggaagtggaatttttgtgactgacaacgtgca

SEQ ID NO: 56850 - DNA, 75 bp, Artificial Sequence
  Synthetic
atggaactcaggctatgactggatcactgattttccaggtaaaacagtctggtttgttccaagcatcaaatcagg

SEQ ID NO: 56851 - DNA, 75 bp, Artificial Sequence
  Synthetic
caacaagagatggcgaacccctcatgatagtggcaaaacacgaaagggggagacctctcttgtttaagacaacag

SEQ ID NO: 56852 - DNA, 75 bp, Artificial Sequence
  Synthetic
aatataaacacaccagaagggattatcccagccctcttcgagccggagagagaaaagagtgcagcaatagacggg

SEQ ID NO: 56853 - DNA, 75 bp, Artificial Sequence
  Synthetic
agccggaccgatgccagtgactgtggccagtgccgcccagaggagaggaagaattggaaggaaccaaaacaagga

SEQ ID NO: 56854 - DNA, 75 bp, Artificial Sequence
  Synthetic
gccagtgccgcccagaggagaggaagaattggaaggaaccaaaacaaggaaggtgatcagtatatttacatggga

SEQ ID NO: 56855 - DNA, 75 bp, Artificial Sequence
  Synthetic
caggcacagaacgccagaaaatggaatgggtgctgttgaatccagcaggttctggtctagtccttctttccagaa

SEQ ID NO: 56856 - DNA, 75 bp, Artificial Sequence
  Synthetic
gccccaatgaacggagagcatggaactttcttgaggtagaggactatggatttggcatgttcacgaccagcatat

SEQ ID NO: 56857 - DNA, 75 bp, Artificial Sequence
  Synthetic
aatgagggagtgatggctgttgggcttgtgagcattctagccagttctctccttaggaatgatgtgcccatggct

SEQ ID NO: 56858 - DNA, 75 bp, Artificial Sequence
  Synthetic
ctttcttgaggtagaggactatggatttggcatgttcacgaccagcatatggatgaaattccgagaaggaagctc

SEQ ID NO: 56859 - DNA, 75 bp, Artificial Sequence
  Synthetic
ttgacgtgttctacaaacccactgagcaagtggacaccctgctctgtgatattggggagtcatcttctaatccga

SEQ ID NO: 56860 - DNA, 75 bp, Artificial Sequence
  Synthetic
aattagcagtgactatcatggctatcttgtgcgtcccaaacgcagtgatattacaaaacgcatggaaagtgagtt

SEQ ID NO: 56861 - DNA, 75 bp, Artificial Sequence
  Synthetic
ctgcagagaaaacatggtggaagtcttgtcagatgcccgctatccaggaattccactcatgagatgtattgggtg

SEQ ID NO: 56862 - DNA, 75 bp, Artificial Sequence
  Synthetic
atcatggaagctatgaagctccttcgacaggctcagcatcctccatggtgaacggggtagttaaactgctgacaa

SEQ ID NO: 56863 - DNA, 75 bp, Artificial Sequence
  Synthetic
gaaatagggaaacttccacaacatttgacgcaaagggcccagaatgctttggacaacttggtcatgttgcacaat

SEQ ID NO: 56864 - DNA, 75 bp, Artificial Sequence
  Synthetic
gccatcaaggacagcaaggcagtccatgctgacatggggtactggatagaaagtgaaaagaacgagacctggaag

SEQ ID NO: 56865 - DNA, 75 bp, Artificial Sequence
  Synthetic
tgcctcctttaaggtttttgggagaggatgggtgttggtatgggatggaaattaggcctttaagtgaaagagaag

SEQ ID NO: 56866 - DNA, 75 bp, Artificial Sequence
  Synthetic
ccctggcagctatagccaaccaggcagtggtcctgatgggtttggacaaaggatggccaatatcaaaaatggact

SEQ ID NO: 56867 - DNA, 75 bp, Artificial Sequence
  Synthetic
agtcggaagcttgcttaacacagttctaacagtttgtttaaatagagagcagatctctggaaaaatgaaccaacg

SEQ ID NO: 56868 - DNA, 75 bp, Artificial Sequence
  Synthetic
ttttccatggggctgttatgtctgaccctgttcatagaagaatgcttgagaagaaaagttactaggaaacacatg

SEQ ID NO: 56869 - DNA, 75 bp, Artificial Sequence
  Synthetic
aatatgctgaaacgcgagagaaaccgcgtatcaacccctcaagggttggtgaagagattctcaaccggacttttt

SEQ ID NO: 56870 - DNA, 75 bp, Artificial Sequence
  Synthetic
gtggatggacttactacgagccattatcatgctaggggacaccatgcttagtagggtgggaggacagactcatct

SEQ ID NO: 56871 - DNA, 75 bp, Artificial Sequence
  Synthetic
atcatgctaggggacaccatgcttagtagggtgggaggacagactcatctagctatcatgatagtgttcaagatg

SEQ ID NO: 56872 - DNA, 75 bp, Artificial Sequence
  Synthetic
aacagcactaatggtgataggaatggccatgacaacggtgttttcaattccacatgaccttatggaacttattga

SEQ ID NO: 56873 - DNA, 75 bp, Artificial Sequence
  Synthetic
actcaaggaattcaaggattttgcagctggcagaaagtcaatcgcccttgatcttgtgacagaaataggaagagt

SEQ ID NO: 56874 - DNA, 75 bp, Artificial Sequence
  Synthetic
acacccaagtgggaactttagccctttccttaactttcataagatcgacaatgccattgaccatggcttggagaa

SEQ ID NO: 56875 - DNA, 75 bp, Artificial Sequence
  Synthetic
gaacaataggtgccgtatctctggacttttctcctggaacgtcaggatctccaatcattgacaaaaaaggaaaag

SEQ ID NO: 56876 - DNA, 75 bp, Artificial Sequence
  Synthetic
cttgccctactagcagctttcaaagttagaccaacttttgcagctggactactcttgagaaaactgacctccaag

SEQ ID NO: 56877 - DNA, 75 bp, Artificial Sequence
  Synthetic
cacactcattcctttatgtaggacaagctgcctgcaaaaacaatctcactgggtagagataacagcaatcatctt

SEQ ID NO: 56878 - DNA, 75 bp, Artificial Sequence
  Synthetic
gggcataatggctgtgggcttggtcagtctcttaggaagtgcccttctgaagaatgatgtccctttggctggtcc

SEQ ID NO: 56879 - DNA, 75 bp, Artificial Sequence
  Synthetic
agacatggatgtcatcggaaggggcttggaagcatgctcagagagtagagagctggatactcagaaacccaggat

SEQ ID NO: 56880 - DNA, 75 bp, Artificial Sequence
  Synthetic
agtgctagaaagtgagatgataattccaaagaatctcgctggaccagtgtctcaacacaactatagaccaggcta

SEQ ID NO: 56881 - DNA, 75 bp, Artificial Sequence
  Synthetic
tcaagagacgcttaaggactctaattttggcaccaacaagggtggttgcagctgagatggaagaagcactgaaag

SEQ ID NO: 56882 - DNA, 75 bp, Artificial Sequence
  Synthetic
ttgatttctgcgaaggaactacagtggtagtgactgaggactgcggaaatagaggaccctctttgagaacaacca

SEQ ID NO: 56883 - DNA, 75 bp, Artificial Sequence
  Synthetic
gaggaaaccaacatgataacccttttggtgaaactggcactgataaccgtgtcaggtctttaccccctggcaatt

SEQ ID NO: 56884 - DNA, 75 bp, Artificial Sequence
  Synthetic
aaacacttcaatggcaatgacgtgcatagctgttggaggaatcactctgtttctgggtttcacagttcaagcaga

SEQ ID NO: 56885 - DNA, 75 bp, Artificial Sequence
  Synthetic
aggagccctgtgggacgttccctcacccgccaccgctcagaaagccacactgactgaaggagtgtacagaatcat

SEQ ID NO: 56886 - DNA, 75 bp, Artificial Sequence
  Synthetic
acatggaggaatgcttgtgagaaatccactttcacgaaactccacgcacgaaatgtactggatatctaatggcac

SEQ ID NO: 56887 - DNA, 75 bp, Artificial Sequence
  Synthetic
ggctgctattcacaagtgaacccactgactctcacagcggcagtacttctgctagttacacattatgccattata

SEQ ID NO: 56888 - DNA, 75 bp, Artificial Sequence
  Synthetic
taatgaagtccacacttggacagagcaatacaaattccaggctgactccccaaaaagactgtcagcagccattgg

SEQ ID NO: 56889 - DNA, 75 bp, Artificial Sequence
  Synthetic
cttgggctgacgtcaggaacgacatgatatcatatggtggagggtggaggcttggggacaagtgggacaaagaag

SEQ ID NO: 56890 - DNA, 75 bp, Artificial Sequence
  Synthetic
gagagcactcacacctccagtgaatgatctgaaatattcatggaagacatgggggaaagcaaaaatctttacccc

SEQ ID NO: 56891 - DNA, 75 bp, Artificial Sequence
  Synthetic
gccggactatggagaactaacactcgattgtgaacccaggtctggaattgactttaatgagatgatcctaatgaa

SEQ ID NO: 56892 - DNA, 75 bp, Artificial Sequence
  Synthetic
agcattgaaaattcctcagtgaatgtgtctctaacagccattgccaaccaagccacagtgttaatgggtcttggg

SEQ ID NO: 56893 - DNA, 75 bp, Artificial Sequence
  Synthetic
tcaagaaattccacccatgaaatgtactgggtttcatgtggaacaggaaacattgtgtcagcagtaaacatgaca

SEQ ID NO: 56894 - DNA, 75 bp, Artificial Sequence
  Synthetic
gtgagttgcacaatactggcagtggtgtccgtttccccactgcttttgacatcctcacagcaaaaaacggattgg

SEQ ID NO: 56895 - DNA, 75 bp, Artificial Sequence
  Synthetic
tacaccccggggctggcaagacaaaaagaattctcccttccatagtcagagaagctctaaaaaggaggttacgaa

SEQ ID NO: 56896 - DNA, 75 bp, Artificial Sequence
  Synthetic
aagaattctcccttccatagtcagagaagctctaaaaaggaggttacgaaccctgattttggctcctacgagagt

SEQ ID NO: 56897 - DNA, 75 bp, Artificial Sequence
  Synthetic
tattggtagcacattatgctatcatagggccaggactccaagcgaaagcaactagagaggcccagaaaagagcag

SEQ ID NO: 56898 - DNA, 75 bp, Artificial Sequence
  Synthetic
aaatcacatgtttgcaggacatctcaagtgcaaagtccgtatggagaaattgagaatcaagggaatgtcatacac

SEQ ID NO: 56899 - DNA, 75 bp, Artificial Sequence
  Synthetic
tagacataattgggaaaagaatagaaaaaataaagcaagagcatgaaacatcatggcactacgaccaagaccacc

SEQ ID NO: 56900 - DNA, 75 bp, Artificial Sequence
  Synthetic
gctcaccaaaccatgggatgttatccccatggtcacacaaatagccatgactgataccacaccctttggacaaca

SEQ ID NO: 56901 - DNA, 75 bp, Artificial Sequence
  Synthetic
tagggaagatgaccctgggaatgtgctgcataatcacggctagcatcctcctatggtacgcacaaatacagccac

SEQ ID NO: 56902 - DNA, 75 bp, Artificial Sequence
  Synthetic
ctcccggggcaacagatccattcccccaaagcaacagccccatagaagacattgagagagaaattccagaaaggt

SEQ ID NO: 56903 - DNA, 75 bp, Artificial Sequence
  Synthetic
aagaaggggaactggcaacacaggagagacgcttggagagaaatggaaaaaccggttgaatgcactggggaagag

SEQ ID NO: 56904 - DNA, 75 bp, Artificial Sequence
  Synthetic
gtgactcaagtattaatgatgaggactacatgggctttgtgtgaggctctaaccttagcgaccgggcccatctcc

SEQ ID NO: 56905 - DNA, 75 bp, Artificial Sequence
  Synthetic
gaagatggagcctacagaatcaagcaaaaagggattcttggatattcccagatcggagctggagtttacaaagaa

SEQ ID NO: 56906 - DNA, 75 bp, Artificial Sequence
  Synthetic
agaagaacaaacactgaccatactcatcagaacaggactgctggtgatatcaggactttttcctgtgtcaatacc

SEQ ID NO: 56907 - DNA, 75 bp, Artificial Sequence
  Synthetic
gatcggagctggagtttacaaagaaggaacattccatacaatgtggcatgtcacacgtggcgctgtcctaatgca

SEQ ID NO: 56908 - DNA, 75 bp, Artificial Sequence
  Synthetic
gagctatctagcaggagctgggcttgctttttctatcatgaaatcagttggaacaggaaagagaggaacagggtc

SEQ ID NO: 56909 - DNA, 75 bp, Artificial Sequence
  Synthetic
ctgtgtcgcgaggttcagcaaaactgagatggttcgtcgagagaaatatggtcacaccggaagggaaggtggtgg

SEQ ID NO: 56910 - DNA, 75 bp, Artificial Sequence
  Synthetic
tatcatatggaggaggctggaagttagaaggagaatggaaggaaggagaagaagtccaggtgctggcattggagc

SEQ ID NO: 56911 - DNA, 75 bp, Artificial Sequence
  Synthetic
aagtgtggaagcggaatttttgtggttgacaacgtgcacacttggacagaacagtacaaattccaaccagagtcc

SEQ ID NO: 56912 - DNA, 75 bp, Artificial Sequence
  Synthetic
aaatcttcaccccagaagcaagaaacagcacatttttaatagacggaccagacacctctgaatgccccaatgaac

SEQ ID NO: 56913 - DNA, 75 bp, Artificial Sequence
  Synthetic
gttttttttactccgccagaaaagtgtgacacattgctgtgtgacataggggagtcgtcaccaaaccccacggtt

SEQ ID NO: 56914 - DNA, 75 bp, Artificial Sequence
  Synthetic
agatccattgaaaaacgacgaagatcacgcccactggacagaagcaaaaatgctgcttgacaatatctacacccc

SEQ ID NO: 56915 - DNA, 75 bp, Artificial Sequence
  Synthetic
taacggtagttgtgggcgatataattggggtcttagagcaaggaaaaagaacactaacaccacaacccatggagc

SEQ ID NO: 56916 - DNA, 75 bp, Artificial Sequence
  Synthetic
ggaaggaggacatgatctcactgtagtggctggggatgtgaagggggtgttgaccaaaggcaagagagcactcac

SEQ ID NO: 56917 - DNA, 75 bp, Artificial Sequence
  Synthetic
aagtcttctgtttaaaacagaggatggtgtgaacatgtgcaccctcatggccatggaccttggtgaattgtgtga

SEQ ID NO: 56918 - DNA, 75 bp, Artificial Sequence
  Synthetic
cacccaggagcgggaaagacgaaaagataccttccggccatagtcagagaagctataaaacggggtttgagaaca

SEQ ID NO: 56919 - DNA, 75 bp, Artificial Sequence
  Synthetic
tgataagacaaatggagtctgagggaatctttttacccagcgaattggaaaccccaaatctagccggaagagttc

SEQ ID NO: 56920 - DNA, 75 bp, Artificial Sequence
  Synthetic
caggacaaccagctggcatatgtggtgataggtttgttattcatgatactgacagtggcagccaatgagatggga

SEQ ID NO: 56921 - DNA, 75 bp, Artificial Sequence
  Synthetic
tgctgaccccatggctttgaaggacttcaaggaatttgctagtggaagaaagagcataacccttgatatcctgac

SEQ ID NO: 56922 - DNA, 75 bp, Artificial Sequence
  Synthetic
agatggttggatgctaggatctactctgacccactggcgctcaaagaattcaaggaattcgcagccggaagaaag

SEQ ID NO: 56923 - DNA, 75 bp, Artificial Sequence
  Synthetic
ccagagagagaaaagagtgcagcaatagacggggagtacagactgcggggagaagcaaggaaaacgttcgtggag

SEQ ID NO: 56924 - DNA, 75 bp, Artificial Sequence
  Synthetic
aaagatcagaaagctgtgcatgctgacatgggttattggatagagagctcaaaaaaccagacctggcagatagag

SEQ ID NO: 56925 - DNA, 75 bp, Artificial Sequence
  Synthetic
ctgggcgggaaattgtggatctaatgtgtcatgccacatttaccatgaggctgctatcaccagttagagtgccaa

SEQ ID NO: 56926 - DNA, 75 bp, Artificial Sequence
  Synthetic
atgacacagctggttgggacacaagaataacagaagatgacctgcacaatgaggaaaaaatcacacagcaaatgg

SEQ ID NO: 56927 - DNA, 75 bp, Artificial Sequence
  Synthetic
catcagtgaacatgatttcaaggatgttgatcaacagattcacaatgagacacaagaaagccacttacgagccgg

SEQ ID NO: 56928 - DNA, 75 bp, Artificial Sequence
  Synthetic
gtgttgttgatcccagaaccagaaaaacagaggaccccacaagacaaccagttgatttatgtcatactggctatt

SEQ ID NO: 56929 - DNA, 75 bp, Artificial Sequence
  Synthetic
tctccaggaaaattttggaacaccacgatagcggtttccatggcaaacattttcaggggaagttatctagcagga

SEQ ID NO: 56930 - DNA, 75 bp, Artificial Sequence
  Synthetic
tatgtcaagactagaaccaatgattgggatttcgtggttacaactgacatttcagaaatgggtgccaatttcaag

SEQ ID NO: 56931 - DNA, 75 bp, Artificial Sequence
  Synthetic
cataagatcaacaatgccattggtcatggcttggaggaccattatggctgtgttgtttgtggtcacactcattcc

SEQ ID NO: 56932 - DNA, 75 bp, Artificial Sequence
  Synthetic
agcatggacgctctacgctgtagccaccaccattctgactcccatgctaagacacaccatagaaaatacatctgc

SEQ ID NO: 56933 - DNA, 75 bp, Artificial Sequence
  Synthetic
aaatggagtggttaccaaatcaggtgattatgtcagtgccataacgcaagccgagagaattggtgagccagatta

SEQ ID NO: 56934 - DNA, 75 bp, Artificial Sequence
  Synthetic
ctgcaggcatgatcatcatgctgattccaacagtgatggcgtttcatctgaccacacgcaacggagaaccacaca

SEQ ID NO: 56935 - DNA, 75 bp, Artificial Sequence
  Synthetic
tccagcttcagcctggaccctctatgcagtagccacaacaattatcactcccatgatgagacacacaattgaaaa

SEQ ID NO: 56936 - DNA, 75 bp, Artificial Sequence
  Synthetic
attacaacctgatcatcatggacgaagcccattttacagacccagcaagcatagcagctagaggatacatttcaa

SEQ ID NO: 56937 - DNA, 75 bp, Artificial Sequence
  Synthetic
tggaagcccaactgatcagacagatggagggagaaggagtcttcaaaagcatccagcaactgacagtcacagaag

SEQ ID NO: 56938 - DNA, 75 bp, Artificial Sequence
  Synthetic
atttcacagacccagccagtatagcggctagagggtacatatcaactcgtgttggaatgggagaagcagccgcaa

SEQ ID NO: 56939 - DNA, 75 bp, Artificial Sequence
  Synthetic
agaatggccatcagtggagatgattgtgttgtgaaacccttagatgacaggtttgcaagcgctctaacagctcta

SEQ ID NO: 56940 - DNA, 75 bp, Artificial Sequence
  Synthetic
tccactgccaacattttcaggggaagctacttggcgggagctggactggctttctcactcataaagaatgcacag

SEQ ID NO: 56941 - DNA, 75 bp, Artificial Sequence
  Synthetic
aacgacgcatttccaaagagtcctgatattcatcctactgacagccatcgctccttcaatgacaatgcgctgcat

SEQ ID NO: 56942 - DNA, 75 bp, Artificial Sequence
  Synthetic
caaagaatttgcagccggaagaaagtctctgaccctgaacctaatcacagaaatgggtaggcttccaacattcat

SEQ ID NO: 56943 - DNA, 75 bp, Artificial Sequence
  Synthetic
ctccttcaatgacaatgcgctgcataggaatatcaaatagggactttgtggaaggagtgtcaggagggagttggg

SEQ ID NO: 56944 - DNA, 75 bp, Artificial Sequence
  Synthetic
gaagagacaactaaactcattagataggaaggagtttgaagagtacaagagaagtggaatattggaggtggacag

SEQ ID NO: 56945 - DNA, 75 bp, Artificial Sequence
  Synthetic
ccagagaattgaaacttggattctgagacatccaggctttaccataatggccgcaatcctggcatacaccatagg

SEQ ID NO: 56946 - DNA, 75 bp, Artificial Sequence
  Synthetic
acaaagacagattctttgagggagctaagctcaacgtagttctaacagtttttttaattagagagcagatctctg

SEQ ID NO: 56947 - DNA, 75 bp, Artificial Sequence
  Synthetic
gacaaacgttccgtcgcactggccccacacgtgggacttggtctagaaacaagaaccgaaacgtggatgtcctct

SEQ ID NO: 56948 - DNA, 75 bp, Artificial Sequence
  Synthetic
cttgagtaaactatgctgcctgtagctccacctgagaaggtgttaaaaatctgggaggccacaaaccctggaagc

SEQ ID NO: 56949 - DNA, 75 bp, Artificial Sequence
  Synthetic
atggattgttgaaagagggatggtaaagccaaaagggaaagttgtggatcttggttgcgggagaggaggatggtc

SEQ ID NO: 56950 - DNA, 75 bp, Artificial Sequence
  Synthetic
ggtccaagatgatggaactatgaaaataaaagatgaagagagggatgacacactcactatactccttaaagcaac

SEQ ID NO: 56951 - DNA, 75 bp, Artificial Sequence
  Synthetic
tcaggggaagttatctagcaggagcaggtctggccttctcattaatgaaatctttaggaggaggtaggagaggta

SEQ ID NO: 56952 - DNA, 75 bp, Artificial Sequence
  Synthetic
ccgaatctcccaaggagcagggtggtctttgcgggagacggcctgtttggggaagtcctacgcccaaatgtggag

SEQ ID NO: 56953 - DNA, 75 bp, Artificial Sequence
  Synthetic
tccatggccatgcgatgtgtgggaataggcaacagggacttcgtggaaggactgtcaggagcaacgtgggtagat

SEQ ID NO: 56954 - DNA, 75 bp, Artificial Sequence
  Synthetic
atgtggattgtttggaaaaggaggcatcgtgacctgtgctatgttcacatgcaaaaagaacatggaaggaaaaat

SEQ ID NO: 56955 - DNA, 75 bp, Artificial Sequence
  Synthetic
agacccactaaaaaatgatgaagatcatgctcactggacagaagcaaagatgctgcttgacaatatctacacccc

SEQ ID NO: 56956 - DNA, 75 bp, Artificial Sequence
  Synthetic
gaagctgtacgcacggtgtagcagactagcggttagaggagacccctcccatgacacaacgcagcagcggggccc

SEQ ID NO: 56957 - DNA, 75 bp, Artificial Sequence
  Synthetic
gggaagaacatgcagtcggaaatgacacaggaaaacatggtaaagaagtcaagataacaccacagagctccatca

SEQ ID NO: 56958 - DNA, 75 bp, Artificial Sequence
  Synthetic
tcaaggtcctcaatccctacatgccaacagttatagaagaactggagaaactgcagagaaagcatggtggaagtc

SEQ ID NO: 56959 - DNA, 75 bp, Artificial Sequence
  Synthetic
tcagcctggaccctctatgcagtagccacaacagttatcactcccatgatgagacacacaattgaaaatacaacg

SEQ ID NO: 56960 - DNA, 75 bp, Artificial Sequence
  Synthetic
cgtggccacaacatttgtcacaccaatgctgagacatagcattgagaattcctcagtgaatgtatccctaacagc

SEQ ID NO: 56961 - DNA, 75 bp, Artificial Sequence
  Synthetic
gatacacaaaaggaggacccggtcatgaggaacctatcccaatggcgacttatggatggaacctagtgaagctac

SEQ ID NO: 56962 - DNA, 75 bp, Artificial Sequence
  Synthetic
tcaggtgcgtcgggaaacattgtgagctctgtgaatacaacatcaaaaatgctgttgaataggtttactacgagg

SEQ ID NO: 56963 - DNA, 75 bp, Artificial Sequence
  Synthetic
gtgaactgccggagaccctggagacactgcttctactgacactcctggcaacagtcacaggaggaatcttcttat

SEQ ID NO: 56964 - DNA, 75 bp, Artificial Sequence
  Synthetic
atagccatgactgacaccacaccctttggacaacagagagtgtttaaagagaaagttgacacgcgcacaccaaga

SEQ ID NO: 56965 - DNA, 75 bp, Artificial Sequence
  Synthetic
gtttcatctgaccacccggggaggagagccgcacatgatagttagcaagcaggaaagaggaaaatcacttttgtt

SEQ ID NO: 56966 - DNA, 75 bp, Artificial Sequence
  Synthetic
acagtgattgatctagatccaataccttatgatccaaagtttgaaaagcagttgggacaagtaatgctcctagtc

SEQ ID NO: 56967 - DNA, 75 bp, Artificial Sequence
  Synthetic
atgctcactggacagaagcaaaaatgctgctggacaacattaacacaccagaagggatcataccagctctctttg

SEQ ID NO: 56968 - DNA, 75 bp, Artificial Sequence
  Synthetic
ctctgcgtgactcaagtattgatgatgaggactacatgggctctgtgtgaggccttaaccttagctaccgggcct

SEQ ID NO: 56969 - DNA, 75 bp, Artificial Sequence
  Synthetic
cggctctccatgcaagatcccttttgagataatggatctggaaaaaagacatgttttgggccgcctgatcacagt

SEQ ID NO: 56970 - DNA, 75 bp, Artificial Sequence
  Synthetic
ttaaagagaaggtggacaccagaacaccacagccaaaactaggcacacgagtggttatgaccacaacagccaatt

SEQ ID NO: 56971 - DNA, 75 bp, Artificial Sequence
  Synthetic
caacccatggaagctgtacgcatggggtagcagactagtggttagaggagacccctcccaaaacataacgcagca

SEQ ID NO: 56972 - DNA, 75 bp, Artificial Sequence
  Synthetic
tttgccaacttacctttcctctagggccaagctcgcccttgacaacatagtcatgctccacacaacagaaagagg

SEQ ID NO: 56973 - DNA, 75 bp, Artificial Sequence
  Synthetic
ccaatgagatggggctgattgaaaaaacaaaaactgactttgggttttaccaggtaaaaacagaaacaactattc

SEQ ID NO: 56974 - DNA, 75 bp, Artificial Sequence
  Synthetic
aagtggagacttgggccttgagacacccaggattcacggtgatagccctttttctagcacatgccataggaacat

SEQ ID NO: 56975 - DNA, 75 bp, Artificial Sequence
  Synthetic
aagggctctgcaccaagaagggaaatgtgaatcgtgcgtctacaacatgatggggaaacgtgagaaaaaactggg

SEQ ID NO: 56976 - DNA, 75 bp, Artificial Sequence
  Synthetic
atcacatggataggaatgaactcacgtagcacatcactgtctgtgtcactggtattagtgggaatcgtgacactg

SEQ ID NO: 56977 - DNA, 75 bp, Artificial Sequence
  Synthetic
gggcgcggtttctagaatttgaagccctgggtttcctaaatgaagatcactggtttggtagagaaaattcatgga

SEQ ID NO: 56978 - DNA, 75 bp, Artificial Sequence
  Synthetic
cctgggtttcctaaatgaagatcactggtttggtagagaaaattcatggagtggagtggaaggagagggtctgca

SEQ ID NO: 56979 - DNA, 75 bp, Artificial Sequence
  Synthetic
acaagagaggagttcacaagaaaagttaggtcaaacgcagcaattggagcagtgttcgttgatgaaaaccaatgg

SEQ ID NO: 56980 - DNA, 75 bp, Artificial Sequence
  Synthetic
gtagcacatcactgtctgtgtcactggtattagtgggaatcgtgacactgtacttgggagttatggtgcaagccg

SEQ ID NO: 56981 - DNA, 75 bp, Artificial Sequence
  Synthetic
gaacaaagaactaaaatgtggcagtggaatattcgtcacagataacgtgcatacatggacagaacaatacaagtt

SEQ ID NO: 56982 - DNA, 75 bp, Artificial Sequence
  Synthetic
ggaatattcgtcacagataacgtgcatacatggacagaacaatacaagttccaaccagaatccccttcaaaactg

SEQ ID NO: 56983 - DNA, 75 bp, Artificial Sequence
  Synthetic
tgtatgctgatgacacggcaggttgggacacaagaatcactgaagatgaccttctaaatgaagaactaatcacag

SEQ ID NO: 56984 - DNA, 75 bp, Artificial Sequence
  Synthetic
gtgtgacataggggagtcatcaccaaaccccacagtggaagcaggacgaacactcagagtccttaatttagtaga

SEQ ID NO: 56985 - DNA, 75 bp, Artificial Sequence
  Synthetic
cttctaaatgaagaactaatcacagaacagatggctcctcaccacaggatcttagccaaagccattttcaaactg

SEQ ID NO: 56986 - DNA, 75 bp, Artificial Sequence
  Synthetic
agtggagttgacgttttcttcatcccgccagaaaagtgtgacacattgttgtgtgacataggggagtcatcacca

SEQ ID NO: 56987 - DNA, 75 bp, Artificial Sequence
  Synthetic
ttccagtgactccagcaagcgctgctcagagaagagggcgaataggaaggaacccagcacaagaagacgaccaat

SEQ ID NO: 56988 - DNA, 75 bp, Artificial Sequence
  Synthetic
gttttgggatcttgtgcacagagagagggagcttcataaacagggaaaatgtgccacgtgtgtctacaacatgat

SEQ ID NO: 56989 - DNA, 75 bp, Artificial Sequence
  Synthetic
gacgggattgttgcaatagatttggatcctgtggtttatgatgcaaaatttgaaaaacagctaggccaaataatg

SEQ ID NO: 56990 - DNA, 75 bp, Artificial Sequence
  Synthetic
atcaaaggaatcatgcaggtaggaaaacgatctctgcggcctcaacccactgagttgaggtattcatggaaaaca

SEQ ID NO: 56991 - DNA, 75 bp, Artificial Sequence
  Synthetic
tacaaatgcccccggatcactgaggcggaaccagatgacgttgactgctggtgcaatgccacagacacatgggtg

SEQ ID NO: 56992 - DNA, 75 bp, Artificial Sequence
  Synthetic
agtttcgcctcagaggggaacaaaggaagacttttgtggaattaatgaggagaggagaccttccggtgtggctga

SEQ ID NO: 56993 - DNA, 75 bp, Artificial Sequence
  Synthetic
gatgagaggttcagtacttccctcctcttcttgaatgacatgggaaaagtaaggaaagacattccacagtgggaa

SEQ ID NO: 56994 - DNA, 75 bp, Artificial Sequence
  Synthetic
gaaaaatggaaaaagaagttaaatcaattatcccggaaagagtttgacctttacaagaaatctggaatcactgaa

SEQ ID NO: 56995 - DNA, 75 bp, Artificial Sequence
  Synthetic
gctctgatggccacttttaaaatgagaccaatgtttgctgtcgggctattattccgcagactaacatctagagaa

SEQ ID NO: 56996 - DNA, 75 bp, Artificial Sequence
  Synthetic
tgaaaaaagtcacagaagtgcgaggatacacaaaaggcggtccaggacacgaagaaccagtacctatgtccacat

SEQ ID NO: 56997 - DNA, 75 bp, Artificial Sequence
  Synthetic
cccccccaaaacaaaaaacagcatattgacgctgggaaagaccagagatcctgctgtctcctcagcatcatccag

SEQ ID NO: 56998 - DNA, 75 bp, Artificial Sequence
  Synthetic
tggcatctaggcaagcttgagatggactttgatttctgcgaagggaccacagtggtggtaaccgaggaatgtgga

SEQ ID NO: 56999 - DNA, 75 bp, Artificial Sequence
  Synthetic
tatgctcagcagttccaacagaatggtttccaacaagcagaacaacatggtcaatccacgcccaccatcaatgga

SEQ ID NO: 57000 - DNA, 75 bp, Artificial Sequence
  Synthetic
caggatgggacacaagaatcacactagaagacctaaaaaatgaagaaatggtaacaaaccacatggaaggagaac

SEQ ID NO: 57001 - DNA, 75 bp, Artificial Sequence
  Synthetic
ggttatggtgggtgccaccatgacagatgacataggcatgggtgtgacttatcttgctctactagcagccttcaa

SEQ ID NO: 57002 - DNA, 75 bp, Artificial Sequence
  Synthetic
gatgacataggcatgggtgtgacttatcttgctctactagcagccttcaaagtcagaccaacctttgcagctgga

SEQ ID NO: 57003 - DNA, 75 bp, Artificial Sequence
  Synthetic
ggaattacaaagagagaatggtgacatttaaggttcctcatgccaagagacaggatgtgacagtgctgggatctc

SEQ ID NO: 57004 - DNA, 75 bp, Artificial Sequence
  Synthetic
ggaaacactgcaaaggaaatatggaggagccttagtgaggaatccactctcacgaaactccacacatgagatgta

SEQ ID NO: 57005 - DNA, 75 bp, Artificial Sequence
  Synthetic
gaaaacccatacagaacctgggcgtatcatggaagctatgaagctccttcgacaggctcagcatcctccatggtg

SEQ ID NO: 57006 - DNA, 75 bp, Artificial Sequence
  Synthetic
catgacagatacaaccccttttgggcaacaaagagtgttcaaagagaaggtggataccagaacaccacaaccaaa

SEQ ID NO: 57007 - DNA, 75 bp, Artificial Sequence
  Synthetic
agtccattatgcaataataggcccaggattgcaggcaaaagccacaagagaggcccagaaaaggacagctgctgg

SEQ ID NO: 57008 - DNA, 75 bp, Artificial Sequence
  Synthetic
gaaaggttatcaagaatggccatcagtggagatgattgtgttgtgaaacctttagatgacaggtttgcaagcgct

SEQ ID NO: 57009 - DNA, 75 bp, Artificial Sequence
  Synthetic
tggtgtctgtttcccccctgctcttgacatcctcacagcagaaagcggactggataccattagcgttgacgatca

SEQ ID NO: 57010 - DNA, 75 bp, Artificial Sequence
  Synthetic
aagaaaaggagctggcctttaaacgaggccatcatggcggttgggatggtgagtatcttggccagctctctcttg

SEQ ID NO: 57011 - DNA, 75 bp, Artificial Sequence
  Synthetic
tgggagagaagtggaagagacagctaaactcattagacaggaaagagtttgaagagtataaaagaagtggaatac

SEQ ID NO: 57012 - DNA, 75 bp, Artificial Sequence
  Synthetic
tctcaggactctttccggtatcaataccaattacagcagcagcatggtacctgtgggaagtaaagaaacaacggg

SEQ ID NO: 57013 - DNA, 75 bp, Artificial Sequence
  Synthetic
atcaagcatgcagtatctagagggtccagtaagatcagatggattgttgagagagggatggtaaagccaaaaggg

SEQ ID NO: 57014 - DNA, 75 bp, Artificial Sequence
  Synthetic
ccaatggtgcggctcactgattgggttaacaagcagggccacatgggcaaagaacatccaagcagcaataaatca

SEQ ID NO: 57015 - DNA, 75 bp, Artificial Sequence
  Synthetic
tgttttgtgactcaaaactcatgtcggcagccataaaagacaacagagccgtccatgccgatatgggttattgga

SEQ ID NO: 57016 - DNA, 75 bp, Artificial Sequence
  Synthetic
acgtcacacgtggcgcagtcctaatgcataaggggaagaggattgaaccatcatgggcggacgtcaagaaagact

SEQ ID NO: 57017 - DNA, 75 bp, Artificial Sequence
  Synthetic
aattcgatcagccacgcgtcttgagaacatcatgtggaagcaaatatcaaatgaattgaaccacattctacttga

SEQ ID NO: 57018 - DNA, 75 bp, Artificial Sequence
  Synthetic
gcctttcaatatgctgaaacgcgagagaaaccgcgtgtcaactgtacaacagttgacaaagagattctcacttgg

SEQ ID NO: 57019 - DNA, 75 bp, Artificial Sequence
  Synthetic
ggagaaggaagagaacctagtcaagtcaatggtctctgcagggtcaggagaagtggacagtttttcactaggact

SEQ ID NO: 57020 - DNA, 75 bp, Artificial Sequence
  Synthetic
tggagttttcaccaccaacatatggctaaaattgagagaaaaacaggatgtattttgtgactcaaaactcatgtc

SEQ ID NO: 57021 - DNA, 75 bp, Artificial Sequence
  Synthetic
taacgtagttctaacagttttttattagagagcagatctctgatgaacaaccaacggaaaaagacggctcgaccg

SEQ ID NO: 57022 - DNA, 75 bp, Artificial Sequence
  Synthetic
caatgcttcagacaagatggggatgggaacaacgtacctagctttgatggccactttcagaatgagaccaatgtt

SEQ ID NO: 57023 - DNA, 75 bp, Artificial Sequence
  Synthetic
ggaaggactagaggttagaggagacccccccgaaacaaaaaacagcatattgacgctgggaaagaccagagatcc

SEQ ID NO: 57024 - DNA, 75 bp, Artificial Sequence
  Synthetic
acgctcattggacagaagcaaaaatgctccttgataatataaacacaccagaagggattatcccagccctctttg

SEQ ID NO: 57025 - DNA, 75 bp, Artificial Sequence
  Synthetic
aagacagattcttttagggagcaaagctcaacgtagttctaacagtttttaattagagagcagatctctgatgaa

SEQ ID NO: 57026 - DNA, 75 bp, Artificial Sequence
  Synthetic
gaggagctaggggatggacttgcaatgggcatcatgatgttgaaattactgactgattttcagtcacatcagcta

SEQ ID NO: 57027 - DNA, 75 bp, Artificial Sequence
  Synthetic
tcgtggcagctgaaatggaggaagcccttagaggacttccaataagataccaaactccagccatcagggctgagc

SEQ ID NO: 57028 - DNA, 75 bp, Artificial Sequence
  Synthetic
tgctggaaagccagatgctcattccaaaatcatatgcgggccctttttcacagcacaattaccgccagggctatg

SEQ ID NO: 57029 - DNA, 75 bp, Artificial Sequence
  Synthetic
attgtggaaatcgaggtccttctctcagaactacaacagttacaggaaagataatccatgaatggtgttgcagat

SEQ ID NO: 57030 - DNA, 75 bp, Artificial Sequence
  Synthetic
gtctcaatccaacagccatttttctaacaactctttcgagaaccagcaagaaaaggagctggccgctaaatgagg

SEQ ID NO: 57031 - DNA, 75 bp, Artificial Sequence
  Synthetic
aaaaacaacatggcttccggtgttgctgggatctcttggatgcaaaccactaaccatgtttcttataacagaaaa

SEQ ID NO: 57032 - DNA, 75 bp, Artificial Sequence
  Synthetic
cgaagcccattttacagatccagcaagcatagcagctaggggatacatctcaactcgagtggagatgggtgaggc

SEQ ID NO: 57033 - DNA, 75 bp, Artificial Sequence
  Synthetic
atgcggtcggaaatgacacaggaaaacacggcaaggaaatcaaagtaacaccacagagttccatcacagaagcag

SEQ ID NO: 57034 - DNA, 75 bp, Artificial Sequence
  Synthetic
aacactctggtgcctcacacaacatactagtggaggtccaagatgatggaactatgaaaataaaagatgaagaga

SEQ ID NO: 57035 - DNA, 75 bp, Artificial Sequence
  Synthetic
ttagtgttgtggattggcacgaattcaaggaacacttcaatggccatgacgtgcatagctgttggaggaatcact

SEQ ID NO: 57036 - DNA, 75 bp, Artificial Sequence
  Synthetic
ggcgttagctccccatgtcggcatgggactggacacacgcacccaaacctggatgtcggctgaaggagcttggag

SEQ ID NO: 57037 - DNA, 75 bp, Artificial Sequence
  Synthetic
actccagtgcagcacaaagaagagggagaataggaaggaatccaaggaatgaaaatgatcaatacatatatatgg

SEQ ID NO: 57038 - DNA, 75 bp, Artificial Sequence
  Synthetic
agcttcagaagaccgaggccacccaactggcgaccctaaggaagctatgcattgaggggaaaattaccaacataa

SEQ ID NO: 57039 - DNA, 75 bp, Artificial Sequence
  Synthetic
ctgaaggaatcattcccagcatgttcgagccagagcgtgaaaaggtggatgccattgacggtgaatatcgcttga

SEQ ID NO: 57040 - DNA, 75 bp, Artificial Sequence
  Synthetic
ggacctaatgagaagaggagacctaccagtctggttggcttataaagtggcagctgaaggtatcaactacgcaga

SEQ ID NO: 57041 - DNA, 75 bp, Artificial Sequence
  Synthetic
cattggatttcgaactgataaaaacggaagccaaacagcctgccaccctaaggaagtactgcatagaagcaaagc

SEQ ID NO: 57042 - DNA, 75 bp, Artificial Sequence
  Synthetic
gttgcacaactccgaacaaggaggaagagcctatagacatgcaatggaagaactgccagacaccatagaaacgtt

SEQ ID NO: 57043 - DNA, 75 bp, Artificial Sequence
  Synthetic
ccagtctggttggcttataaagtggcagctgaaggtatcaactacgcagacagaagatggtgttttgacggaacc

SEQ ID NO: 57044 - DNA, 75 bp, Artificial Sequence
  Synthetic
aacctcaggaggcacaagtatttttgcggggcacttaaaatgcagactcaagatggacaaattggaactcaaggg

SEQ ID NO: 57045 - DNA, 75 bp, Artificial Sequence
  Synthetic
aacatggtcattcccgaaggaagagtcatagacttgggctgtggaagaggaggctggtcatattactgtgcagga

SEQ ID NO: 57046 - DNA, 75 bp, Artificial Sequence
  Synthetic
aagtccttaaccctgaacctaatcacagagatgggcagactcccaacttttatgactcagaaggccagagatgca

SEQ ID NO: 57047 - DNA, 75 bp, Artificial Sequence
  Synthetic
tgggaatgtgctgcataatcacggccagcatactcttatggtatgcacaaatacaaccacattggatagcagctt

SEQ ID NO: 57048 - DNA, 75 bp, Artificial Sequence
  Synthetic
tcggagacagctacatcatcataggagtggaaccaggacaattgaagctggactggttcaagaaaggaagttcca

SEQ ID NO: 57049 - DNA, 75 bp, Artificial Sequence
  Synthetic
atagcagctagaggatacatttcaactcgagtagagatgggtgaagcagctgggatttttatgacagccactcct

SEQ ID NO: 57050 - DNA, 75 bp, Artificial Sequence
  Synthetic
actggaagggctacctggttagaggagaccccccaaaacaaaaatcagcatattgacgctgggaaagaccagaga

SEQ ID NO: 57051 - DNA, 75 bp, Artificial Sequence
  Synthetic
aaaaggacttgatctcatatggaggaggttggaggtttcaaggatcatggaacacgggagaagaagtgcaggtga

SEQ ID NO: 57052 - DNA, 75 bp, Artificial Sequence
  Synthetic
gagaacaggcctcgacttcaatgagatggtgctgctgcagatggaaaataaagcttggctggtgcataggcaatg

SEQ ID NO: 57053 - DNA, 75 bp, Artificial Sequence
  Synthetic
acttcaatggttcgtggagagaaacatggtcattcccgaaggaagagtcatagacttgggctgtggaagaggagg

SEQ ID NO: 57054 - DNA, 75 bp, Artificial Sequence
  Synthetic
tgccgtggcaacaacatttatcacaccaatgttgagacatagcattgaaaattcctcagtaaatgtgtccctaac

SEQ ID NO: 57055 - DNA, 75 bp, Artificial Sequence
  Synthetic
gacaggatgggaatgggcgttacctacctagctttaattgcaacatttaaaatccagccattcttggctttggga

SEQ ID NO: 57056 - DNA, 75 bp, Artificial Sequence
  Synthetic
tgtgtgtggaattcgatcagccactcgtctcgagaatatcatgtggaagcaaatatcaaatgaactgaaccacat

SEQ ID NO: 57057 - DNA, 75 bp, Artificial Sequence
  Synthetic
accccaaatttggccgagagagttctcgactggttggaaaaatatggcgtcgaaaggctgaaaagaatggcaatc

SEQ ID NO: 57058 - DNA, 75 bp, Artificial Sequence
  Synthetic
aaagaactgaaatgtggcagcgggatcttcattacagataacgtgcacacatggacagaacaatacaagttccaa

SEQ ID NO: 57059 - DNA, 75 bp, Artificial Sequence
  Synthetic
cgcggctagaggatacatttcgaccagggtggaaatgggagaggcagcagctatcttcatgaccgcaacccctcc

SEQ ID NO: 57060 - DNA, 75 bp, Artificial Sequence
  Synthetic
gccttgatagctgtgctgactggtggagttacgttgtttttcctatcaggaaaaggtctagggaaaacatccatt

SEQ ID NO: 57061 - DNA, 75 bp, Artificial Sequence
  Synthetic
caaaactgagatggttcgttgaaagaaatttggtcacaccagaagggaaagtagtggaccttggttgcggcagag

SEQ ID NO: 57062 - DNA, 75 bp, Artificial Sequence
  Synthetic
atgctgacatggggtactggatagaaagtgaaaagaacgagacctggaagctggcaagagcctccttcatagaag

SEQ ID NO: 57063 - DNA, 75 bp, Artificial Sequence
  Synthetic
gtggacctcggttgtggcagagggggctggtcatactattgtgggggactaaagaatgtaagagaagtcaaaggc

SEQ ID NO: 57064 - DNA, 75 bp, Artificial Sequence
  Synthetic
ggcttaacaaaaggaggaccaggacacgaagaacctatccctatgtcaacatatgggtggaatctagtacgctta

SEQ ID NO: 57065 - DNA, 75 bp, Artificial Sequence
  Synthetic
gcggccataaaagacaacagagccgtccatgccgatatgggttattggatagaaagtgcactcaatgacacatgg

SEQ ID NO: 57066 - DNA, 75 bp, Artificial Sequence
  Synthetic
tcatatggaggaggttggaggcttcaaggatcctggaacacgggagaagaagtgcaggtgattgctgttgaaccg

SEQ ID NO: 57067 - DNA, 75 bp, Artificial Sequence
  Synthetic
actaacatacaagtggccataaaccaagtgagaaggctaattgggaatgagaattatctagattacatgacatca

SEQ ID NO: 57068 - DNA, 75 bp, Artificial Sequence
  Synthetic
tagttttacagtttttatagaggagcagatctctgatgaccaccaacgaaaaagacgggtcaaccgtctttcaat

SEQ ID NO: 57069 - DNA, 75 bp, Artificial Sequence
  Synthetic
actaacaccacaacccatggagctaaaatattcatggaaaacatggggaaaggcaaaaatagtgacagctgaaac

SEQ ID NO: 57070 - DNA, 75 bp, Artificial Sequence
  Synthetic
tgcagtgatactgcaaaacgcatggaaggtgagttgcacaatattggcagcggtgtccgtttctccactgctctt

SEQ ID NO: 57071 - DNA, 75 bp, Artificial Sequence
  Synthetic
acagcggcggtgttgatgttagtggctcattatgccataatcggacctggactgcaagcaaaagctactagagaa

SEQ ID NO: 57072 - DNA, 75 bp, Artificial Sequence
  Synthetic
gtcgcttccgaaatggcagaggcgctcaagggaatgccaataaggtatcagacaacagcagtgaagagtgaacac

SEQ ID NO: 57073 - DNA, 75 bp, Artificial Sequence
  Synthetic
tcaagggaatgccaataaggtatcagacaacagcagtgaagagtgaacacacaggaaaggagatagttgacctca

SEQ ID NO: 57074 - DNA, 75 bp, Artificial Sequence
  Synthetic
gcggaacccgcaacattggaattgaaagtgagacaccgaacctagacataattgggaaaagaatagaaaaaataa

SEQ ID NO: 57075 - DNA, 75 bp, Artificial Sequence
  Synthetic
ccaggcacagaacgccagaaaatggaatggtgctgttgaatcaacaggttctggtcatagctgtttcctgaaccc

SEQ ID NO: 57076 - DNA, 75 bp, Artificial Sequence
  Synthetic
tgcagtgtcaatggctaacatttttagaggaagttacttggctggagctggacttctcttttccatcatgaagaa

SEQ ID NO: 57077 - DNA, 75 bp, Artificial Sequence
  Synthetic
ggaagcaaatatcaaatgaattgaaccacatcttacttgaaaatgacatgaaattcacagtggttgtaggagatg

SEQ ID NO: 57078 - DNA, 75 bp, Artificial Sequence
  Synthetic
ccgccccctcacactgatttttatcatatttaacaaactgctctatacaagttaagtatgaatggcatcacccct

SEQ ID NO: 57079 - DNA, 75 bp, Artificial Sequence
  Synthetic
atttcagaaatgggtgccaacttcaaggctgagagggttatagaccccagacgttgcatgaaaccagtcatacta

SEQ ID NO: 57080 - DNA, 75 bp, Artificial Sequence
  Synthetic
atatttaacaaactgctctatacaagttaagtatgaatggcatcacccctcatgaattctgccaccccgcaaacg

SEQ ID NO: 57081 - DNA, 75 bp, Artificial Sequence
  Synthetic
ccggagacacacaccctaaacccacattaccttttcccctcttaatccccctcctcccatcactaattctccccc

SEQ ID NO: 57082 - DNA, 75 bp, Artificial Sequence
  Synthetic
attaccttttcccctcttaatccccctcctcccatcactaattctcccccccccccctctcacccctacccttct

SEQ ID NO: 57083 - DNA, 75 bp, Artificial Sequence
  Synthetic
gctagaacatggaggatgcgtcacaaccatggcccagggaaaaccaaccttggattttgaactgaccaagacaac

SEQ ID NO: 57084 - DNA, 75 bp, Artificial Sequence
  Synthetic
aggaggtaggagaggcacgggagcccaaggggaaacactgggagaaaaatggaaaagacagctaaaccaattgag

SEQ ID NO: 57085 - DNA, 75 bp, Artificial Sequence
  Synthetic
tgaaggaaaatgtgaaacatgtgtatacaacatgatgggaaaaagagagaaaaaactaggagagtttggtaaagc

SEQ ID NO: 57086 - DNA, 75 bp, Artificial Sequence
  Synthetic
agtcagatccctcataggcaatgaggaatacacagattacatgccatccatgaagagattcagaagggaagagga

SEQ ID NO: 57087 - DNA, 75 bp, Artificial Sequence
  Synthetic
tatgttatatctggaagctcagccgacttatcactagagaaagcggctgaggtctcctgggaagaagaagcagaa

SEQ ID NO: 57088 - DNA, 75 bp, Artificial Sequence
  Synthetic
agtttgaagccctaggatttttgaatgaagaccattggttctccagagagaactccctgagtggagtggaaggag

SEQ ID NO: 57089 - DNA, 75 bp, Artificial Sequence
  Synthetic
tggggaacaatcaaaaagtcaaaggccatcaatgtcttgagagggttcaggaaagagattggaaggatgctgaac

SEQ ID NO: 57090 - DNA, 75 bp, Artificial Sequence
  Synthetic
acgaggaccattaaaactgttcatggccctggtggcgttccttcgtttcctaacaatcccaccaacagcagggat

SEQ ID NO: 57091 - DNA, 75 bp, Artificial Sequence
  Synthetic
aaaaggatggccgctccacagaatggacctcggtgtgccgctgttagcaatgggatgctattctcaagtgaaccc

SEQ ID NO: 57092 - DNA, 75 bp, Artificial Sequence
  Synthetic
gatggagcctacagaatcaagcaaaaaggaatccttggatattcccagatcggagctggagtttacaaagaagga

SEQ ID NO: 57093 - DNA, 75 bp, Artificial Sequence
  Synthetic
gttttttattagagagcagatctctgatgaacaaccaacggaaaaagacggctcgaccgtctttcaatatgctga

SEQ ID NO: 57094 - DNA, 75 bp, Artificial Sequence
  Synthetic
cagcatgtcgataaaaaatgaagaggaagaacaaacactgactatactcatcagaacgggattgctggtgatctc

SEQ ID NO: 57095 - DNA, 75 bp, Artificial Sequence
  Synthetic
tggccacaggaccaatcttgaccttgtgggagggcaacccgggaaggttttggaacacgaccatagccgtatcca

SEQ ID NO: 57096 - DNA, 75 bp, Artificial Sequence
  Synthetic
cgtgaaaggttgtcaagaatggccatcagtggagatgattgtgttgtgaaacctttagatgatagatttgcaaaa

SEQ ID NO: 57097 - DNA, 75 bp, Artificial Sequence
  Synthetic
atgggagccctcaagaggatggaacgactggacacaggtgcccttctgttcacaccattttcacgagttaattat

SEQ ID NO: 57098 - DNA, 75 bp, Artificial Sequence
  Synthetic
acctcccggccatagtcagagaggccataaaaagaggtttgagaacactaatcctagcccccactagagtcgtgg

SEQ ID NO: 57099 - DNA, 75 bp, Artificial Sequence
  Synthetic
agccaagtggttgtggggattcctctctagaaataaaaaacccagaatctgcacaagagaggagttcacaagaaa

SEQ ID NO: 57100 - DNA, 75 bp, Artificial Sequence
  Synthetic
gacatagcagcctgcctgagaaagaatggaaagagggtgatacaactcagtaggaagacctttgattctgaatat

SEQ ID NO: 57101 - DNA, 75 bp, Artificial Sequence
  Synthetic
atcatggaacctgaacatgccctactggccacgtcaatctttaagctaacctaccaaaacaaggtagtaagggtg

SEQ ID NO: 57102 - DNA, 75 bp, Artificial Sequence
  Synthetic
tggccacgtcaatctttaagctaacctaccaaaacaaggtagtaagggtgcagagaccagcaaaaaatggaaccg

SEQ ID NO: 57103 - DNA, 75 bp, Artificial Sequence
  Synthetic
aaaatgattaggccacaacccatggaacacaaatactcatggaaaagctggggaaaggctaaaatcataggggca

SEQ ID NO: 57104 - DNA, 75 bp, Artificial Sequence
  Synthetic
ctagaggttagaggagacccccccaaaaacaaaaaacagcatattgacgctgggaaagaccagagatcctgctgt

SEQ ID NO: 57105 - DNA, 75 bp, Artificial Sequence
  Synthetic
ggcaaagcgaaaatgctctccacagagcctcataaccagacctttctcattgatggccccgaaacagcagaatgt

SEQ ID NO: 57106 - DNA, 75 bp, Artificial Sequence
  Synthetic
aaaagaatggcaatcagtggagatgactgtgtggtgaaaccaattgatgacagatttgcaacagccttaacagct

SEQ ID NO: 57107 - DNA, 75 bp, Artificial Sequence
  Synthetic
tggggtattcaccaccaacatatggctgaagttgaaagaaaggcaggatgtgttttgtgactcaaaactcatgtc

SEQ ID NO: 57108 - DNA, 75 bp, Artificial Sequence
  Synthetic
aacaattgcaaccataacacctcaagctcctacgtcggaaatacagctgaccgactacggagcccttacattgga

SEQ ID NO: 57109 - DNA, 75 bp, Artificial Sequence
  Synthetic
caagttctctccttagaaatgacgtacccatggctggaccattagtggccgggggcttgctgatagcgtgctacg

SEQ ID NO: 57110 - DNA, 75 bp, Artificial Sequence
  Synthetic
taggaaaaagggaagatcaatggtgtggatccctaataggcttaacagcacgagccacctgggccaccaacatac

SEQ ID NO: 57111 - DNA, 75 bp, Artificial Sequence
  Synthetic
ccatagaaacgttgatgctcctagctttgatagctgtgttgactggtggagtgacgctgttcttcctatcaggaa

SEQ ID NO: 57112 - DNA, 75 bp, Artificial Sequence
  Synthetic
gatacaaggataacagaggatgaccttcagaatgaggccaaaattactgacatcatggaacccgaacatgcccta

SEQ ID NO: 57113 - DNA, 75 bp, Artificial Sequence
  Synthetic
aaagaatggcaatcagcggagatgattgcgtggtgaaaccaattgacgacaggttcgcaacagccttaacagctc

SEQ ID NO: 57114 - DNA, 75 bp, Artificial Sequence
  Synthetic
gtgtggaccgacaaggacagttccaaatcggaagcttgcttaacacagttctaacagtttgtttagatagagagc

SEQ ID NO: 57115 - DNA, 75 bp, Artificial Sequence
  Synthetic
caaatcatatgcacaaatgtggcagctgatgtacttccacaggagagacctgagactagccgctaatgctatctg

SEQ ID NO: 57116 - DNA, 75 bp, Artificial Sequence
  Synthetic
agaagtcaggccattataaatgccatagcttgagtaaactgtgctgcctgtagctccacctgagaaggtgtaaaa

SEQ ID NO: 57117 - DNA, 75 bp, Artificial Sequence
  Synthetic
gacaaacgttccgtcgcattggcaccacacgtagggcttggtctagaaacaagaaccgaaacgtggatgtcctct

SEQ ID NO: 57118 - DNA, 75 bp, Artificial Sequence
  Synthetic
agtgtcaatggcaaacatctttagagggagttacctggctggagctggacttctcttttctatcatgaagaacac

SEQ ID NO: 57119 - DNA, 75 bp, Artificial Sequence
  Synthetic
gatggaacaatgagaataaaagatgatgagactgagaacatcctaacagtgcttttgaaaacagcattactaata

SEQ ID NO: 57120 - DNA, 75 bp, Artificial Sequence
  Synthetic
cacacggccataactcaggtcaggaacctgatcggaaaagaggaatacgtggattacatgccagtcatgaaaaga

SEQ ID NO: 57121 - DNA, 75 bp, Artificial Sequence
  Synthetic
tcatgctctcagtgaactgccggagaccctggagacattgcttttactgacactcctggccacagtcacaggagg

SEQ ID NO: 57122 - DNA, 75 bp, Artificial Sequence
  Synthetic
gaaaccaagatgaactgattggcagagcccgaatctcccaaggagcagggtggtctttgcgggagacggcctgtt

SEQ ID NO: 57123 - DNA, 75 bp, Artificial Sequence
  Synthetic
aatgcttaaagaagacccttccttagatattgcggactagaggggcgcaacacccagggaagctgtgccttgaag

SEQ ID NO: 57124 - DNA, 75 bp, Artificial Sequence
  Synthetic
attacaacttgatcattatggatgaagcccatttcacagacccagcaagcatagcagctagaggatacatttcaa

SEQ ID NO: 57125 - DNA, 75 bp, Artificial Sequence
  Synthetic
cagagaagtgtgacacattgttgtgtgacataggggaatcatcaccaaatcccacggtagaagcaggacgaacac

SEQ ID NO: 57126 - DNA, 75 bp, Artificial Sequence
  Synthetic
cggcaacaagatgtccaacgcaaggagagccttatctgaaagaggaacaggaccaacagtacatttgccggagag

SEQ ID NO: 57127 - DNA, 75 bp, Artificial Sequence
  Synthetic
ctggaccaatgccagtcaccgcagcgagtgctgcgcaaaggagagggagagttggcaggaacccacaaaaagaaa

SEQ ID NO: 57128 - DNA, 75 bp, Artificial Sequence
  Synthetic
caggcggattcaggatgtgtaattaattggaaaggtagagaactcaaatgtggaagtggcatttttgtcaccaat

SEQ ID NO: 57129 - DNA, 75 bp, Artificial Sequence
  Synthetic
gagacccccccaaaacaaaaaacagcatattgacgctgggaagtaccagagatcctgctcgtgggctcagcatca

SEQ ID NO: 57130 - DNA, 75 bp, Artificial Sequence
  Synthetic
ccaagatgagaagggagtgacccagaatgggagattgataacagccaaccccatagtcactgacaaagaaaaacc

SEQ ID NO: 57131 - DNA, 75 bp, Artificial Sequence
  Synthetic
tgggacgtacccagtcccccagagacacagaaagcagaactggaagaaggggtctataggatcaagcagcaagga

SEQ ID NO: 57132 - DNA, 75 bp, Artificial Sequence
  Synthetic
gcgaagagaatggccattttgggtgacacagcctgggacttcggatccctgggaggagtgtttacatctatagga

SEQ ID NO: 57133 - DNA, 75 bp, Artificial Sequence
  Synthetic
ctgaagcaggcggaagggcgtacaatcatgctctcagtgaactgccggagactctggagacattgcttttgctga

SEQ ID NO: 57134 - DNA, 75 bp, Artificial Sequence
  Synthetic
aaagagagaatggtgacatttaaggttcctcatgccaagagacaggatgtgacagtgctaggatctcaggaagga

SEQ ID NO: 57135 - DNA, 75 bp, Artificial Sequence
  Synthetic
ttcctcatgccaagagacaggatgtgacagtgctaggatctcaggaaggagccatgcattcagccctcgccggag

SEQ ID NO: 57136 - DNA, 75 bp, Artificial Sequence
  Synthetic
ttttgaactgataaaaacagaagccaaacaacctgccactctaaggaagtactgtatagaggcaaagctgaccaa

SEQ ID NO: 57137 - DNA, 75 bp, Artificial Sequence
  Synthetic
tcatgctctcagtgaactgccagagactctggagacattgcttttgctgacacttttggccacagtcacgggcgg

SEQ ID NO: 57138 - DNA, 75 bp, Artificial Sequence
  Synthetic
gaatgtgctgcataatcacggccagtattctcctatggtacgcacaaatacagccacactggatagcagcttcaa

SEQ ID NO: 57139 - DNA, 75 bp, Artificial Sequence
  Synthetic
acaaagacagattctttgagggagctaagctcaacgtagttctaccagtttttcaactagagagcggatctctga

SEQ ID NO: 57140 - DNA, 75 bp, Artificial Sequence
  Synthetic
gcctttccccagagcaacgctccaattcaagatgaagaaagggatattccggaacgctcatggaattcaggcaat

SEQ ID NO: 57141 - DNA, 75 bp, Artificial Sequence
  Synthetic
gaggttggagatttcaaggatcatggaacacgggagaagaagtgcaggtgatagctgttgaaccaggaaaaaacc

SEQ ID NO: 57142 - DNA, 75 bp, Artificial Sequence
  Synthetic
aaggctgtacaccaggtttttggcagtgtgtacacaactatgtttggaggagtctcatggatggtcagaatccta

SEQ ID NO: 57143 - DNA, 75 bp, Artificial Sequence
  Synthetic
tgtacgcatggcgtagtggactagcggttagaggagacccctctctaacacgtcgcccagacaacctgcccaagc

SEQ ID NO: 57144 - DNA, 75 bp, Artificial Sequence
  Synthetic
ttgtggatgaacattgtggaaatcgaggaccatctcttagaaccacaacagtcacaggaaagataatccatgaat

SEQ ID NO: 57145 - DNA, 75 bp, Artificial Sequence
  Synthetic
ccagagaattgaaacttggatcctgagacatccaggcttcaccataatggcagcaatcctggcatacaccatagg

SEQ ID NO: 57146 - DNA, 75 bp, Artificial Sequence
  Synthetic
aaggaaaagttggcccctcaatgaaggaatcatggctgttggaatagtcagcattctactaagttcactcctcaa

SEQ ID NO: 57147 - DNA, 75 bp, Artificial Sequence
  Synthetic
tccaagatgatggaaccatgaagataaaagatgaagagagagatgacacgctaaccattctccttaaagcaactc

SEQ ID NO: 57148 - DNA, 75 bp, Artificial Sequence
  Synthetic
agcagaatgccccaacacaaacagagcttggaactcgctggaagttgaagactatggttttggagtttttaccac

SEQ ID NO: 57149 - DNA, 75 bp, Artificial Sequence
  Synthetic
gagcccgaatttcccagggagctgggtggtctttacgggagacggcctgtttggggaagtcttacgcccaaatgt

SEQ ID NO: 57150 - DNA, 75 bp, Artificial Sequence
  Synthetic
gtggtctttacgggagacggcctgtttggggaagtcttacgcccaaatgtggagcttgatgtacttccacagacg

SEQ ID NO: 57151 - DNA, 75 bp, Artificial Sequence
  Synthetic
caatggagtgctggaaagccagatgcttattccaaaatcatatgcgggccctttttcacagcacaattaccgcca

SEQ ID NO: 57152 - DNA, 75 bp, Artificial Sequence
  Synthetic
gaccaggctaccacacacaaacagcaggaccttggcatctaggtaagcttgagatggactttgatttctgcgaag

SEQ ID NO: 57153 - DNA, 75 bp, Artificial Sequence
  Synthetic
gcacagcacaaatcatggaggtgacggccaagtggttatggggtttcctctccagaaacaaaaaacccagaatct

SEQ ID NO: 57154 - DNA, 75 bp, Artificial Sequence
  Synthetic
tggtagacagaggatggggaaatggatgtggattatttggaaagggaggcattgtgacctgtgctatgttcacat

SEQ ID NO: 57155 - DNA, 75 bp, Artificial Sequence
  Synthetic
gaccacagaagacatgcttactgtctggaacagggtgtggatagaggacaatccatggatggaagacaaaactcc

SEQ ID NO: 57156 - DNA, 75 bp, Artificial Sequence
  Synthetic
ggtggatgccattgatggtgaataccgcttgagaggagaagcaaggaaaacctttgtggacctaatgagaagagg

SEQ ID NO: 57157 - DNA, 75 bp, Artificial Sequence
  Synthetic
ctgcaacccatggaagctgtacgcatggggtagcacaactcctggctagaggtgacccctcccgaaacataacgc

SEQ ID NO: 57158 - DNA, 75 bp, Artificial Sequence
  Synthetic
ccataggaatcgcactcctttcccaaagcaccataccagagaccattcttgaactgactgatgcgttagccttgg

SEQ ID NO: 57159 - DNA, 75 bp, Artificial Sequence
  Synthetic
gcactcacaggagccacagaaatccaaatgtcgtcaggaaacttgctcttcactggacatctcaagtgcaggctg

SEQ ID NO: 57160 - DNA, 75 bp, Artificial Sequence
  Synthetic
agaggagaccccccgcataacaataaacagcatattgacgctgggagagaccagagatcctgctgtctctacagc

SEQ ID NO: 57161 - DNA, 75 bp, Artificial Sequence
  Synthetic
tgagacacccaggattcacggtgatagccctttttctagcacatgccataggaacatccatcactcagaaaggga

SEQ ID NO: 57162 - DNA, 75 bp, Artificial Sequence
  Synthetic
tccacctgagaaggtgtaaaaaatctgggaggccacaaaccatggaagctgtacgcatggcgtagtggactagcg

SEQ ID NO: 57163 - DNA, 75 bp, Artificial Sequence
  Synthetic
gccattccaccaacagcaggagttttggctagatggggaaccttcaagaagtcaggggctattaaggtcctaaaa

SEQ ID NO: 57164 - DNA, 75 bp, Artificial Sequence
  Synthetic
tgggaggccacaaaccatggaagctgtacgcatggcgtagtggactagcggttagaggagacccctcccttacaa

SEQ ID NO: 57165 - DNA, 75 bp, Artificial Sequence
  Synthetic
cacaggaccaataacaacactctgggaaggatcacctggaaagttttggaacaccacgatagctgtttccatggc

SEQ ID NO: 57166 - DNA, 75 bp, Artificial Sequence
  Synthetic
ataggaggagtgttcacatctgtgggaaaattggtacaccaggtttttggaaccgcatatggggttctgttcagc

SEQ ID NO: 57167 - DNA, 75 bp, Artificial Sequence
  Synthetic
gttctattggccaaatgtttgagacaacgatgagaggggcgaagagaatggccattttgggtgacacagcctggg

SEQ ID NO: 57168 - DNA, 75 bp, Artificial Sequence
  Synthetic
ggccccttaacgagggtataatggctgtgggcttggtcagtctcttaggaagcgccctcctaaagaatgatgtcc

SEQ ID NO: 57169 - DNA, 75 bp, Artificial Sequence
  Synthetic
atgctgaaacgcgtgagaaaccgtgtgtcaactggatcacagttggcgaagagattctcaagaggattgctgaac

SEQ ID NO: 57170 - DNA, 75 bp, Artificial Sequence
  Synthetic
agttagcaagcaggaaagaggaaagtcacttttgtttaagacctctgcaggtgtcaacatgtgcacccttattgc

SEQ ID NO: 57171 - DNA, 75 bp, Artificial Sequence
  Synthetic
agaatggagaatctcttgtggaagcaaatagccaatgaactgaactacatattatgggaaaacaacatcaaatta

SEQ ID NO: 57172 - DNA, 75 bp, Artificial Sequence
  Synthetic
gacaacagcagtgaaaagtgaacacacgggaaaggagatagttgaccttatgtgtcacgccacttttaccatgcg

SEQ ID NO: 57173 - DNA, 75 bp, Artificial Sequence
  Synthetic
tgaagaaagaagtctcagaaacgcagcatgggacaatactcattaaggttgagtacaaaggggaagatgcacctt

SEQ ID NO: 57174 - DNA, 75 bp, Artificial Sequence
  Synthetic
caagagccgaaacgtggatgtcctctgaaggcgcttggaaacaaatacaaaaagtggagacttgggctctgagac

SEQ ID NO: 57175 - DNA, 75 bp, Artificial Sequence
  Synthetic
gatccaataccctatgatccaaagtttgaaaagcagttgggacaagtaatgctcctagtcctctgcgtgactcaa

SEQ ID NO: 57176 - DNA, 75 bp, Artificial Sequence
  Synthetic
ggtaacaagattggagaacctaatgtggaaacaaataacaccagaattgaatcacattctagcagaaaatgaggt

SEQ ID NO: 57177 - DNA, 75 bp, Artificial Sequence
  Synthetic
ccccggatcgatggaggcctttccacagagcaatgcagctatccaagatgaggaaagagacattcctgaaaggtc

SEQ ID NO: 57178 - DNA, 75 bp, Artificial Sequence
  Synthetic
cttcaatgacaatgcgttgtataggaatatcaaatagagactttgtggaaggggtttcaggaggaagctgggttg

SEQ ID NO: 57179 - DNA, 75 bp, Artificial Sequence
  Synthetic
atccatggccatgcgatgcgtgggaataggcaacagagacttcgtggaaggactgtcaggagcaacgtgggtgga

SEQ ID NO: 57180 - DNA, 75 bp, Artificial Sequence
  Synthetic
tctaaggaagtattgtatagaggcaaagctgaccaacacaacaacagcatctcgctgcccaacacaaggggaacc

SEQ ID NO: 57181 - DNA, 75 bp, Artificial Sequence
  Synthetic
aagctgaccaacacaacaacagcatctcgctgcccaacacaaggggaacccagcctaaatgaagagcaggacaaa

SEQ ID NO: 57182 - DNA, 75 bp, Artificial Sequence
  Synthetic
caaaagaaggcattaaaagaggagaaacggaccatcacgctgtgtcgcgaggctcagcaaaactgagatggttcg

SEQ ID NO: 57183 - DNA, 75 bp, Artificial Sequence
  Synthetic
agcttatgagaagaggagatctacctgtctggctatcctacaaagttgcctcagaaggcttccagtactccgaca

SEQ ID NO: 57184 - DNA, 75 bp, Artificial Sequence
  Synthetic
agggaaagcctacgctcaaatgtgggctctcatgtattttcacagaagagatcttagactagcatccaacgccat

SEQ ID NO: 57185 - DNA, 75 bp, Artificial Sequence
  Synthetic
ccaatccgttatcagaccccagctgtgaaatcagaacacacaggaagagagatcgtagacctcatgtgtcatgca

SEQ ID NO: 57186 - DNA, 75 bp, Artificial Sequence
  Synthetic
gtggacaccaggacacccaggcccatgccagggacaagaaaggttatggagattacagcggaatggctttggaga

SEQ ID NO: 57187 - DNA, 75 bp, Artificial Sequence
  Synthetic
ggaaccataggcgccgtatctctggacttttcccctggaacgtcaggatctccaattgtcgacagaaaaggaaaa

SEQ ID NO: 57188 - DNA, 75 bp, Artificial Sequence
  Synthetic
catagtgatggatgaagcgcatttcacagacccttctagtgttgcagctagaggatatatctcaaccagggtgga

SEQ ID NO: 57189 - DNA, 75 bp, Artificial Sequence
  Synthetic
gacacgccatggaagaactaccagacaccatagaaacgttaatgcttctggctttgatagctgtgctgactggtg

SEQ ID NO: 57190 - DNA, 75 bp, Artificial Sequence
  Synthetic
atacaaaacgtgggcttaccatggcagctatgaaacaaaacaaactggatcagcatcatccatggtgaacggagt

SEQ ID NO: 57191 - DNA, 75 bp, Artificial Sequence
  Synthetic
gccggagctggacttctcttttccatcatgaagaacacaacaaacacaagaagaggaactggcaacataggagag

SEQ ID NO: 57192 - DNA, 75 bp, Artificial Sequence
  Synthetic
ggatgtcatcagaaggggcctggaaacatgcccagagaattgaaacttggatcctgagacatccaggcttcacca

SEQ ID NO: 57193 - DNA, 75 bp, Artificial Sequence
  Synthetic
gaatgatgaagatcatgcccactggactgaagcaaagatgcttcttgataatatctacaccccagaagggatcat

SEQ ID NO: 57194 - DNA, 75 bp, Artificial Sequence
  Synthetic
catggctatttcgtgtgtcccaaatgcagtgatactgcaaaacgcatggaaggtgagttgcacaatattggcagc

SEQ ID NO: 57195 - DNA, 75 bp, Artificial Sequence
  Synthetic
gcagttggcatggttacactgtacctaggagtcatggttcaggcggactcgggatgtgtaattaactggaaaggc

SEQ ID NO: 57196 - DNA, 75 bp, Artificial Sequence
  Synthetic
gatcgttgcaatagatttggaccctgtagtttacgatgcaaaatttgaaaaacagctaggtcaaataatgctgtt

SEQ ID NO: 57197 - DNA, 75 bp, Artificial Sequence
  Synthetic
ggccataactcaggtcaggaatctgatcggaaaagaggaatacgtggattacatgccagtaatgaaaagatacag

SEQ ID NO: 57198 - DNA, 75 bp, Artificial Sequence
  Synthetic
agcaaaaagggattcttggatattctcagatcggagctggagtttacaaagaaggaacttttcatacaatgtggc

SEQ ID NO: 57199 - DNA, 75 bp, Artificial Sequence
  Synthetic
aatcaatggaactcagcaaaagaagcagtggaagatgagcggttctgggaccttgtgcacagagagagggagctt

SEQ ID NO: 57200 - DNA, 75 bp, Artificial Sequence
  Synthetic
agcggctgaggtctcctgggaagaagaagcagaacactctggtgcctcacacaacatattagtggaggtccaaga

SEQ ID NO: 57201 - DNA, 75 bp, Artificial Sequence
  Synthetic
gcccatggctggaccactagtggccgggggcttgctgatagcgtgctatgtcataactggcacgtcagcagacct

SEQ ID NO: 57202 - DNA, 75 bp, Artificial Sequence
  Synthetic
ttcttctaagttcacttctcaaaaatgatgtaccactagctggcccactaatagctggaggcatgctgatagcat

SEQ ID NO: 57203 - DNA, 75 bp, Artificial Sequence
  Synthetic
aaaataaagcaagagcatgaaacatcatggcactatgaccaagaccacccatacaaaacgtgggcttaccatggc

SEQ ID NO: 57204 - DNA, 75 bp, Artificial Sequence
  Synthetic
acaagaaggggaactggcaacataggagagacgcttggagagaaatggaaaagccgattgaacgcactgggaaaa

SEQ ID NO: 57205 - DNA, 75 bp, Artificial Sequence
  Synthetic
ggatgtagctccatcgtgggggatgtagctccatccgtgggggatgtagctccatcgtgggggatgtagctccaa

SEQ ID NO: 57206 - DNA, 75 bp, Artificial Sequence
  Synthetic
tcgtgggggatgtagctccatcgtgggggatgtagctccatcgtgggggatgtagctcatcggtgggatgtagct

SEQ ID NO: 57207 - DNA, 75 bp, Artificial Sequence
  Synthetic
gccttgggggccatattcactgatgagaacaaatggaaatcggcacgtgaggctgttgaagatagtaggttttgg

SEQ ID NO: 57208 - DNA, 75 bp, Artificial Sequence
  Synthetic
ggagttcctgaattcctccaactccggccaaaacggccgtcaccctgccaaacatgacgagccggaacgaggaag

SEQ ID NO: 57209 - DNA, 75 bp, Artificial Sequence
  Synthetic
aagtatcaattagcagtgactatcatggctatcttgtgcgtcccaaatgcagtgatattacaaaacgcatggaaa

SEQ ID NO: 57210 - DNA, 75 bp, Artificial Sequence
  Synthetic
aaggagaagttggcccctcaatgaaggaatcatggctgttggaatagtcagcatcttactaagttcactcctcaa

SEQ ID NO: 57211 - DNA, 75 bp, Artificial Sequence
  Synthetic
aacaaccctttcaagaactagcaagaaaaggagctggccactaaatgaggctatcatggcagtcgggatggtgag

SEQ ID NO: 57212 - DNA, 75 bp, Artificial Sequence
  Synthetic
tttgtgctccttctctcagggcaaataacatggagagatatggcacacacactcataatgattgggtccaacgct

SEQ ID NO: 57213 - DNA, 75 bp, Artificial Sequence
  Synthetic
ctggaatttggtcaaactccattcaggggttgacgtgttctacaaacccacagagcaggtggacaccctgctctg

SEQ ID NO: 57214 - DNA, 75 bp, Artificial Sequence
  Synthetic
agagatatcaggaagcagtccaattctgtcaataacaatatcggaagatggtagcatgtcgataaaaaatgaaga

SEQ ID NO: 57215 - DNA, 75 bp, Artificial Sequence
  Synthetic
gcagagtgccccaacacaaatagagcttggaactcgttggaggttgaagactacggctttggagtgttcaccacc

SEQ ID NO: 57216 - DNA, 75 bp, Artificial Sequence
  Synthetic
cagggacttcgtggaaggactgtcaggagcaacttgggtagatgtggtactggaacatggaagttgcgtcaccac

SEQ ID NO: 57217 - DNA, 75 bp, Artificial Sequence
  Synthetic
atgcaccatgcaagatccctttttcgacccaagatgaaaaaggagtaacccagaatgggagactgataacagcta

SEQ ID NO: 57218 - DNA, 75 bp, Artificial Sequence
  Synthetic
atatgtgagtgccatagcccagactgaaaaaagcattgaagacaatccagagattgaagatgacatctttcgaaa

SEQ ID NO: 57219 - DNA, 75 bp, Artificial Sequence
  Synthetic
cctatggactcaatactttcaccaatatggaagcccaactaatcagacagatggagggagaaggagtctttaaaa

SEQ ID NO: 57220 - DNA, 75 bp, Artificial Sequence
  Synthetic
tcgacatgtcaatgcggaaccagaaacacccaacatggatgtcattggggaaagaataaaaaggatcaaggagga

SEQ ID NO: 57221 - DNA, 75 bp, Artificial Sequence
  Synthetic
aagctaatgagtggaaaggacgtgttttatcttccacctgaaaagtgtgacaccctattgtgtgacattggagaa

SEQ ID NO: 57222 - DNA, 75 bp, Artificial Sequence
  Synthetic
ccgggaagcagagacccatttcctcagagcaatgcaccaatcatggatgaagaaagggaaatccctgaacgttcg

SEQ ID NO: 57223 - DNA, 75 bp, Artificial Sequence
  Synthetic
tggcagtggtgtccgtttccccactgctcttaacatcctcacagcaaaaaacggattggataccattagcattga

SEQ ID NO: 57224 - DNA, 75 bp, Artificial Sequence
  Synthetic
gggaaccttcaaaaggatggaatgattggcaacaagtgcctttctgttcacaccatttccaccagctgatcatga

SEQ ID NO: 57225 - DNA, 75 bp, Artificial Sequence
  Synthetic
ggatgcaaaccactaaccatgtttcttataacagaaaacaaaatctggggaaggaaaagttggcccctcaatgaa

SEQ ID NO: 57226 - DNA, 75 bp, Artificial Sequence
  Synthetic
aatggatgaggcccatttcacagaccccgccagtatagcggctagagggtacatatcaactcgtgtaggaatggg

SEQ ID NO: 57227 - DNA, 75 bp, Artificial Sequence
  Synthetic
accagagcgtgaaaaggtggatgccattgatggtgaataccgcttaagaggagaagcgaggaaaacctttgtgga

SEQ ID NO: 57228 - DNA, 75 bp, Artificial Sequence
  Synthetic
gaacgctcatggaattcaggcaatgaatggattaccgactttgttgggaagacggtgtggtttgtccctagcatc

SEQ ID NO: 57229 - DNA, 75 bp, Artificial Sequence
  Synthetic
tagccggaccgatgccagtgactgtggccagtgccgcccagaggagaggaagaattggaaggaaccaaaataagg

SEQ ID NO: 57230 - DNA, 75 bp, Artificial Sequence
  Synthetic
gtggaactcatgaggaggggtgacctcccagtttggctagcccataaagtagcctcagaagggatcaaatacaca

SEQ ID NO: 57231 - DNA, 75 bp, Artificial Sequence
  Synthetic
cccgaatttcccagggagctgggtggtctttgaaggagacggcctgtttggggaagtcttacgcccaaatgtgga

SEQ ID NO: 57232 - DNA, 75 bp, Artificial Sequence
  Synthetic
gacagaggctggggaaacggttgtggtttgtttggcaagggaagcttggtaacatgcgcaaaatttcaatgtttg

SEQ ID NO: 57233 - DNA, 75 bp, Artificial Sequence
  Synthetic
caagtcaaccccataactctcacagcagcccttcttttattggtagcacattatgctatcatagggccaggactc

SEQ ID NO: 57234 - DNA, 75 bp, Artificial Sequence
  Synthetic
atcggaaggatgctgaacatcttgaataggagacgcaggtctgcaggcatgatcattatgctgattccaacagta

SEQ ID NO: 57235 - DNA, 75 bp, Artificial Sequence
  Synthetic
agagattaaaaagaatggccatcagcggggatgattgcgtggtgaaaccaatcgatgacaggtttgccaatgccc

SEQ ID NO: 57236 - DNA, 75 bp, Artificial Sequence
  Synthetic
ggaaaaatgaaccaacgaaaaaaggtggttagaccacctttcaatatgctgaaacgcgagagaaaccgcgtatca

SEQ ID NO: 57237 - DNA, 75 bp, Artificial Sequence
  Synthetic
atctccacattgtgggaaggaaatccagggagattttggaatacaactattgcagtgtcaatggctaacattttt

SEQ ID NO: 57238 - DNA, 75 bp, Artificial Sequence
  Synthetic
aagggatctgcgcttagcctccatggccatatgctcagcagttccaacggaatggtttccaacaagcagaacaac

SEQ ID NO: 57239 - DNA, 75 bp, Artificial Sequence
  Synthetic
tacagccaacacaagaaggggaactggcaacacaggagagacgcttggagagaaatggaaaaaccgattgaatgc

SEQ ID NO: 57240 - DNA, 75 bp, Artificial Sequence
  Synthetic
tctgcaaacactccatggtagacagaggatggggaaatggatgtggattatttggaaagggaggcatcgtgacct

SEQ ID NO: 57241 - DNA, 75 bp, Artificial Sequence
  Synthetic
cttatgatagtggcgaaacacgaaagggggagacctctcttgtttaagacaacagaaggaatcaacaagtgcact

SEQ ID NO: 57242 - DNA, 75 bp, Artificial Sequence
  Synthetic
gtctcctcagcatcattccaggcacagaacgccagaaaatggaatggtgctgttgaatcaacaggttctggtcat

SEQ ID NO: 57243 - DNA, 75 bp, Artificial Sequence
  Synthetic
atgccctttactggtcaataccgaacccgaagacattgattgctggtgcaatctcacgtctgcctgggtcatgta

SEQ ID NO: 57244 - DNA, 75 bp, Artificial Sequence
  Synthetic
gcaagattcctttctccacggaggatggacaagggaaagcccacaatggcagactgatcacagctaacccagtgg

SEQ ID NO: 57245 - DNA, 75 bp, Artificial Sequence
  Synthetic
aactgagatggttcgtcgagagaaacctggtcacaccagaggggaaagtagtggacctcggttgcggcagagggg

SEQ ID NO: 57246 - DNA, 75 bp, Artificial Sequence
  Synthetic
gagacaaagccttgaaaatcaattggtacaagaagggaagctcgattgggaagatgttcgaggccactgccagag

SEQ ID NO: 57247 - DNA, 75 bp, Artificial Sequence
  Synthetic
actcagaaacccaggattcgcgctcttggcaggatttatggcctacatgattgggcaaacaggaatccagcgaac

SEQ ID NO: 57248 - DNA, 75 bp, Artificial Sequence
  Synthetic
ttcctcaagcaaaacgagccggaggatatagactgctggtgcaattccacatcaacctgggtgacgtacgggaca

SEQ ID NO: 57249 - DNA, 75 bp, Artificial Sequence
  Synthetic
gtcataaactggaaaggcaaagaactcaaatgtggaagtggaattttcgttactaatgaggtccacacctggaca

SEQ ID NO: 57250 - DNA, 75 bp, Artificial Sequence
  Synthetic
tgttattcatgatattgacagtggcagccaatgagatgggattattggaaaccacaaagaaagacctggggattg

SEQ ID NO: 57251 - DNA, 75 bp, Artificial Sequence
  Synthetic
ttacatgccaactgtgattgagcacctagaaagactacaaagaaaatatggaggaatgcttgtgagaaacccact

SEQ ID NO: 57252 - DNA, 75 bp, Artificial Sequence
  Synthetic
acagcatcattccaggcacagaacgccagaaaatggaatgctgctgttgaatcaaggtcatatggatattccgga

SEQ ID NO: 57253 - DNA, 75 bp, Artificial Sequence
  Synthetic
aatagacggggagtacagactgcggggagaagcaaggaaaacgtttgtggagctcatgagaagaggagatctacc

SEQ ID NO: 57254 - DNA, 75 bp, Artificial Sequence
  Synthetic
aaggggaaacactgggagagaaatggaaaagacagctaaaccaactgagcaagtcagaattcaacacctacaaaa

SEQ ID NO: 57255 - DNA, 75 bp, Artificial Sequence
  Synthetic
aatgtctaaggaaccaggtgttgtttctccaaccagctatttagatgtggacttgcacccagcatcagcctggac

SEQ ID NO: 57256 - DNA, 75 bp, Artificial Sequence
  Synthetic
agctacgataactcctaggtcaccatcagtagaggtcaaattaccggactatggagaattaacacttgactgtga

SEQ ID NO: 57257 - DNA, 75 bp, Artificial Sequence
  Synthetic
cgagaacccaagaaccgaaagaaggcacgaagaaactaatgaaaatcacggcagaatggctctggaaagaactag

SEQ ID NO: 57258 - DNA, 75 bp, Artificial Sequence
  Synthetic
gagatgattctaatgaaaatgaaaaagaaaacgtggcttgtgcacaagcaatggtttttggatctacctctacca

SEQ ID NO: 57259 - DNA, 75 bp, Artificial Sequence
  Synthetic
ccatgaaaagattcagaagagaagaggaagaagcaggagtcctgtggtaaaaagcagaactaacataaaacaagg

SEQ ID NO: 57260 - DNA, 75 bp, Artificial Sequence
  Synthetic
tagggtctcaggaaggagccatgcattcagccctcaccggagccacagaagtggattccggtgatggaaaccaca

SEQ ID NO: 57261 - DNA, 75 bp, Artificial Sequence
  Synthetic
atcagttgtggacagcattagtctccttaacatgttcaaacacaattttcacgctgactgttgcctggagaacag

SEQ ID NO: 57262 - DNA, 75 bp, Artificial Sequence
  Synthetic
agttcgtatggagaaattgaggatcaagggaatgtcatacacgatgtgctcaggaaagttctcaattgacaaaga

SEQ ID NO: 57263 - DNA, 75 bp, Artificial Sequence
  Synthetic
aaaacaaaaacagcatattgacgctgggaaagaccagagatcctgctgtctcctcagcatcattccaggcacaga

SEQ ID NO: 57264 - DNA, 75 bp, Artificial Sequence
  Synthetic
aagctgaactgacagattatggcacgatcacgatggaatgctccccacgaacaggtctcgattttaatgagatgg

SEQ ID NO: 57265 - DNA, 75 bp, Artificial Sequence
  Synthetic
tgcacaagagaggagttcacaagaaaagtcaggtcaaacgcagctattggagcagtgttcgttgatgaaaatcaa

SEQ ID NO: 57266 - DNA, 75 bp, Artificial Sequence
  Synthetic
cactctatctgggagccgtggtacaagctgacatggggtgtgtcataaactggaaaggaaaagaactcaaatgtg

SEQ ID NO: 57267 - DNA, 75 bp, Artificial Sequence
  Synthetic
ggaaaggtggataacttcacaatgggtgtcttgtgtcttgcaatcctcttcgaagaggtaatgagaggaaaattc

SEQ ID NO: 57268 - DNA, 75 bp, Artificial Sequence
  Synthetic
ctttcaccaatatggaagcccaactaatcagacagatggagggagaaggagtcttcaaaagcatccagcacctga

SEQ ID NO: 57269 - DNA, 75 bp, Artificial Sequence
  Synthetic
aatcagacagatggagggagaaggagtcttcaaaagcatccagcacctgacagtcacagaagaaattgcagtgca

SEQ ID NO: 57270 - DNA, 75 bp, Artificial Sequence
  Synthetic
aaatccaagagccgtccaaacaaaacctggtcttttcaaaaccaacaccggaacaataggtgccgtatctctgga

SEQ ID NO: 57271 - DNA, 75 bp, Artificial Sequence
  Synthetic
gcagacatgggttgtgcggtgtcatggagtgggaaagaattgaaatgtggaagcggaatttttgtaattgacaac

SEQ ID NO: 57272 - DNA, 75 bp, Artificial Sequence
  Synthetic
atatcaggtaaagggattggaaagacttcaataggactcatttgtgtaattgcttccagtggcatgttgtggatg

SEQ ID NO: 57273 - DNA, 75 bp, Artificial Sequence
  Synthetic
gaagatcctcataggggtggttataacatggataggaatgaactcccgcagcacttccctgtcagtgaccctggt

SEQ ID NO: 57274 - DNA, 75 bp, Artificial Sequence
  Synthetic
acgtgacctcaggctggcggcaaatgctatttgctcggcagtcccatcacattgggttccaacaagtcgaacaac

SEQ ID NO: 57275 - DNA, 75 bp, Artificial Sequence
  Synthetic
acatgggaggaagaggctgagcaaacaggagtgtcccacaatttaatgatcacagttgatgatgatggaacaatg

SEQ ID NO: 57276 - DNA, 75 bp, Artificial Sequence
  Synthetic
aaagtggtcaaagttcaacgaccaactccaaaaggcacggtaatggacatcatatctaggaaagaccaaagaggc

SEQ ID NO: 57277 - DNA, 75 bp, Artificial Sequence
  Synthetic
attttcatcttactgacagctgtcgctccttcaatgacaatgcgttgtataggaatatcaaatagagactttgta

SEQ ID NO: 57278 - DNA, 75 bp, Artificial Sequence
  Synthetic
tggaactttcttgaggtagaagactatggatttggcatgtttacgaccaacatatggatgaaatttcgagaagga

SEQ ID NO: 57279 - DNA, 75 bp, Artificial Sequence
  Synthetic
cctatcccctgtgtgccttgcctatcccctgttgcgtgtctcagtggaccgacaagaacagtttcgactcggaag

SEQ ID NO: 57280 - DNA, 75 bp, Artificial Sequence
  Synthetic
gcaggactaacatgagacaaggttagaagtcaggtcggattaagccatagtacggaaaaaactatgctacctgtg

SEQ ID NO: 57281 - DNA, 75 bp, Artificial Sequence
  Synthetic
ggaaaagcgaaggtactatcaacagaactccaaaatcagactttcctcatagacggtcctgaaacaactgaatgc

SEQ ID NO: 57282 - DNA, 75 bp, Artificial Sequence
  Synthetic
acccccacctgtgggaaaggccgaactggaagatggagcctatagaatcaagcagaaagggattcttggatactc

SEQ ID NO: 57283 - DNA, 75 bp, Artificial Sequence
  Synthetic
ggaaccttcaagaggatggaacgattggacacaagtgcctttctgttcacaccattttcatgagttaatcatgaa

SEQ ID NO: 57284 - DNA, 75 bp, Artificial Sequence
  Synthetic
ttttcacagaagagatcttagactagcatccaacgccatttgttcagcagtaccagtccattggatccccacaag

SEQ ID NO: 57285 - DNA, 75 bp, Artificial Sequence
  Synthetic
tccggtgctactgggatctcttggatgcaaaccactaaccatgtttctcatagcagaaaacaaaatctggggaag

SEQ ID NO: 57286 - DNA, 75 bp, Artificial Sequence
  Synthetic
cttgactttgtttgtggaagaatgcttgaggagaagagtcaccaggaaacacatgatattggttgtggtgaccac

SEQ ID NO: 57287 - DNA, 75 bp, Artificial Sequence
  Synthetic
ggaaatgacattgccaactgcttaagaaagaatgggaaacgggtgattcaattgagcaggaaaacctttgataca

SEQ ID NO: 57288 - DNA, 75 bp, Artificial Sequence
  Synthetic
ttgaggagaagagtcaccaggaaacacatgatattggttgtggtgaccaccctttgtgccatcatcttaggaggt

SEQ ID NO: 57289 - DNA, 75 bp, Artificial Sequence
  Synthetic
cacctagccatcatggcagtgttcaagatgtcaccaggatacgtgctgggtatatttttgaggaaactcacctca

SEQ ID NO: 57290 - DNA, 75 bp, Artificial Sequence
  Synthetic
gaaacacaacatggaacaatagttatcagagtacaatatgaaggggatggctctccatgtaagatcccttttgag

SEQ ID NO: 57291 - DNA, 75 bp, Artificial Sequence
  Synthetic
aactaaaacccagatggttggatgctaggatctattctgacccactggcactaaaagaattcaaggaatttgcag

SEQ ID NO: 57292 - DNA, 75 bp, Artificial Sequence
  Synthetic
ccaattatggacgaagaaagagaaattccggaacgttcatggaactccgggcacgagtgggtcacggattttaaa

SEQ ID NO: 57293 - DNA, 75 bp, Artificial Sequence
  Synthetic
ttcaggcaatgattggattaccgactttgccggaaagactgtgtggtttgtccccagcatcaaagctgggaatga

SEQ ID NO: 57294 - DNA, 75 bp, Artificial Sequence
  Synthetic
gacaagaacagtttcgactcggaagcttgcttaacgtagtgctgacagttttttattagagagcagatttctgat

SEQ ID NO: 57295 - DNA, 75 bp, Artificial Sequence
  Synthetic
acgcaatagcattgggaataatggttcttaaaatagtgaggagcatggaaaaataccagctagcagtgaccgtca

SEQ ID NO: 57296 - DNA, 75 bp, Artificial Sequence
  Synthetic
tcatggaaaacatggggcaaagcgaaaatgctctctacagagtctcataaccagacctttctcattgatggcccc

SEQ ID NO: 57297 - DNA, 75 bp, Artificial Sequence
  Synthetic
agtggaattttcgtcaccaacgaggtccatacctggacagagcaatacaaattccaagcagactccccaaaaaga

SEQ ID NO: 57298 - DNA, 75 bp, Artificial Sequence
  Synthetic
caactcgagtagagatgggtgaagcagctgggattttcatgacagccactcctccgggaagcagagacccatttc

SEQ ID NO: 57299 - DNA, 75 bp, Artificial Sequence
  Synthetic
agctgggattttcatgacagccactcctccgggaagcagagacccatttcctcagagcaatgcaccaatcatgga

SEQ ID NO: 57300 - DNA, 75 bp, Artificial Sequence
  Synthetic
caattccagtcacaatgaccctatggtacatgtggcaagtgaaaacacaaagatcaggagccctgtgggacgtcc

SEQ ID NO: 57301 - DNA, 75 bp, Artificial Sequence
  Synthetic
tgaggaggggtgacctcccagtttggctagcccataaagtagcatcagaaggaatcaaatacacagacagaaaat

SEQ ID NO: 57302 - DNA, 75 bp, Artificial Sequence
  Synthetic
cctcacctgctgccgctcagaaagccacactgactgaaggagtgtacaggatcatgcaaagagggttgtttggga

SEQ ID NO: 57303 - DNA, 75 bp, Artificial Sequence
  Synthetic
agaagagcagactttaaccatactgataaggacaggactgttagtaatatcaggactattcccagtatcaatccc

SEQ ID NO: 57304 - DNA, 75 bp, Artificial Sequence
  Synthetic
tgggagacaaaaaagcagagggccggagtgctgtgggacgttccttcacctccaccaatgggaaaagctgagcta

SEQ ID NO: 57305 - DNA, 75 bp, Artificial Sequence
  Synthetic
actttgcggctggtagaaagtcgatcgcccttgatcttgtgacagaaataggaagagtgccttcacatttagctc

SEQ ID NO: 57306 - DNA, 75 bp, Artificial Sequence
  Synthetic
taaaaacagaagccaaacagcctgccaccctaaggaagtactgcatagaagcaaagctaaccaacacaacaacag

SEQ ID NO: 57307 - DNA, 75 bp, Artificial Sequence
  Synthetic
cacggtgggagggcctacaggcatgcagtggaggaattaccagaaacaatggaaacactcttactcctgggactc

SEQ ID NO: 57308 - DNA, 75 bp, Artificial Sequence
  Synthetic
aggacgtaaaatgaagtcaggccgaaagccacggcttgagcaaaccgtgctgcctgtagctccatcgtggggatg

SEQ ID NO: 57309 - DNA, 75 bp, Artificial Sequence
  Synthetic
cgaaaggctgaaaagaatggcaattagcggagatgattgtgtggtgaaaccaattgatgacaggttcgcaacagc

SEQ ID NO: 57310 - DNA, 75 bp, Artificial Sequence
  Synthetic
agcggagatgattgtgtggtgaaaccaattgatgacaggttcgcaacagccttaatagctctgaatgacatggga

SEQ ID NO: 57311 - DNA, 75 bp, Artificial Sequence
  Synthetic
tcagcctggacattgtacgctgtggccacaacagtaataacaccaatgttgagacataccatagagaattccaca

SEQ ID NO: 57312 - DNA, 75 bp, Artificial Sequence
  Synthetic
ttctagtgtcgcagctagaggatacatctcaaccagggtggaaatgggagaggctgcagctatcttcatgactgc

SEQ ID NO: 57313 - DNA, 75 bp, Artificial Sequence
  Synthetic
ttactgtcaccaattagggtaccaaactacaacctaatcataatggatgaagcccatttcacagacccagctagc

SEQ ID NO: 57314 - DNA, 75 bp, Artificial Sequence
  Synthetic
gtactcctgctagtcacgcattatgctattataggtccaggattgcaggcaaaagccactcgtgaagctcaaaaa

SEQ ID NO: 57315 - DNA, 75 bp, Artificial Sequence
  Synthetic
atcacattctagcagaaaatgaggtgaagttgactatcatgacaggagacatcaaaggaatcatgcaggcaggaa

SEQ ID NO: 57316 - DNA, 75 bp, Artificial Sequence
  Synthetic
gaccagagatctgctgtctctacagcatcattccaggcacagaacgccagaaaatggaatggtgctgttgaatca

SEQ ID NO: 57317 - DNA, 75 bp, Artificial Sequence
  Synthetic
caacaccaggtgggaaatgacacgcagggagtcacggttgagataacaccccaggcatcaaccgttgaagctgtc

SEQ ID NO: 57318 - DNA, 75 bp, Artificial Sequence
  Synthetic
aaaaacagcatattgacgctgggagagaccagagatcctgcttctcctcatcatattccacgcacagacccagaa

SEQ ID NO: 57319 - DNA, 75 bp, Artificial Sequence
  Synthetic
ttaacaggtggagcaatgcttttcttgatatcaggtaaagggattggaaagacttcaataggactcatttgtgtt

SEQ ID NO: 57320 - DNA, 75 bp, Artificial Sequence
  Synthetic
acaacagaaacaccaacttggaacaggaaagagcttcttgtgacattcaaaaatgcacatgcaaaaaagcaagaa

SEQ ID NO: 57321 - DNA, 75 bp, Artificial Sequence
  Synthetic
atctacaagaaaagcggaatccaggaagtggatagaaccttggcaaaagaaggcattaaaagaggagaaacggac

SEQ ID NO: 57322 - DNA, 75 bp, Artificial Sequence
  Synthetic
ccacctggtcgatccatgcccatcatcaatggatgacaacagaagacatgctgtcagtgtggaatagggtttgga

SEQ ID NO: 57323 - DNA, 75 bp, Artificial Sequence
  Synthetic
aggatttcaaggagtttgccagtggaagaaagagcataaccctcgacatcctaacagaaattgccagtttgccaa

SEQ ID NO: 57324 - DNA, 75 bp, Artificial Sequence
  Synthetic
ggcaaggcaaaaggcagcagagccatatggtacatgtggcttggagcacgcttcttagagtttgaagccctagga

SEQ ID NO: 57325 - DNA, 75 bp, Artificial Sequence
  Synthetic
acatgtgcaccctcatggccatagaccttggtgaattgtgtgaagatacaatcacgtacaagtgccccctcctca

SEQ ID NO: 57326 - DNA, 75 bp, Artificial Sequence
  Synthetic
acagaacatggaacaattgcaaccataacacctcaagctcctacgtcggaaatacagctgaccgactacggagct

SEQ ID NO: 57327 - DNA, 75 bp, Artificial Sequence
  Synthetic
cgtcacaacagacatctccgaaatgggagcaaacttccgggccgacagggtgatagacccaagacggtgtctgaa

SEQ ID NO: 57328 - DNA, 75 bp, Artificial Sequence
  Synthetic
tgcacacggctgaagcaggtggaagggcgtacaatcatgctctcagtgaactgccggagaccctagagacattgc

SEQ ID NO: 57329 - DNA, 75 bp, Artificial Sequence
  Synthetic
gttgtgtgacataggggagtcgtcaccaaatcccacggttgaagcaggacgaacactcagagtcctaaacttggt

SEQ ID NO: 57330 - DNA, 75 bp, Artificial Sequence
  Synthetic
gtcactaccatggcaaaagacaaaccaacattggacattgaactcttgaagacggaagtcacaaaccctgccgtc

SEQ ID NO: 57331 - DNA, 75 bp, Artificial Sequence
  Synthetic
gtggggatgtaaaaacctgggaggctgcaacccatggaagctgtacgcatggggtagcagactagtggttagagg

SEQ ID NO: 57332 - DNA, 75 bp, Artificial Sequence
  Synthetic
agcaccaggtgggaaatgaaagcacagaacatgggacaactgcaactataacacctcaagctccttcgacggaaa

SEQ ID NO: 57333 - DNA, 75 bp, Artificial Sequence
  Synthetic
ttgccaaccaagcagccgtcttgatggggcttggaaaaggatggccgctccacagaatggaccttggtgtgccgc

SEQ ID NO: 57334 - DNA, 75 bp, Artificial Sequence
  Synthetic
caaactgaatgattgggactttgtggtgacgactgacatttcagaaatgggggccaatttcaaagcagatagagt

SEQ ID NO: 57335 - DNA, 75 bp, Artificial Sequence
  Synthetic
tttttaattagagagcagatctctgatgaataaccaacggaaaaaggcgagaagtacgcctttcaatatgctgaa

SEQ ID NO: 57336 - DNA, 75 bp, Artificial Sequence
  Synthetic
tggcggcaaatgccatttgctcggcagtcccgtcacattgggttccaacaagtcgaacaacctggtccatacacg

SEQ ID NO: 57337 - DNA, 75 bp, Artificial Sequence
  Synthetic
ggaaggttttggaacacgactatagccgtgtccactgccaacattttcaggggaagctatttggcgggagctgga

SEQ ID NO: 57338 - DNA, 75 bp, Artificial Sequence
  Synthetic
aaattggctgggaagcaatacacagttttgcgtaaaagtccttaacccttacatgccatcagtcatagagagaat

SEQ ID NO: 57339 - DNA, 75 bp, Artificial Sequence
  Synthetic
ttttgcgtaaaagtccttaacccttacatgccatcagtcatagagagaatggaaacactacagagaaagtttgga

SEQ ID NO: 57340 - DNA, 75 bp, Artificial Sequence
  Synthetic
tgctgtcaccagtcagggttccaaattacaatttgataataatggatgaggcccatttcacagatccagccagta

SEQ ID NO: 57341 - DNA, 75 bp, Artificial Sequence
  Synthetic
agagtgacatgatcatcccaaagagtctggctggtcctatttcgcaacacaaccacaggcccggataccacaccc

SEQ ID NO: 57342 - DNA, 75 bp, Artificial Sequence
  Synthetic
aaaatgccacagcttgagcaaactgtgcagcctgtagctccacctgaggaggtgtaaaaacctgggaggccacaa

SEQ ID NO: 57343 - DNA, 75 bp, Artificial Sequence
  Synthetic
attagatggattgttgaaagagggatggtaaagccaaaagggaaagttgtggaccttggttgcgggagaggagga

SEQ ID NO: 57344 - DNA, 75 bp, Artificial Sequence
  Synthetic
acaggtccctttctgctcccaccactttcatgaattgattatgaaagatggaagaaagttggtagtcccctgcag

SEQ ID NO: 57345 - DNA, 75 bp, Artificial Sequence
  Synthetic
ggcgctctagtccgcaatccactctcaaggaattccacgcacgagatgtactgggtgtccaacgcttctggaaat

SEQ ID NO: 57346 - DNA, 75 bp, Artificial Sequence
  Synthetic
aaagtcaggtcggattaagccatagtacggaaaaaactatgctacctgtgagccccgtccaaggacgttaaaaga

SEQ ID NO: 57347 - DNA, 75 bp, Artificial Sequence
  Synthetic
gatggtgctagcattcatcacgtttttgcgagtcctttccatcccaccaacagcagggattctgaaaagatgggg

SEQ ID NO: 57348 - DNA, 75 bp, Artificial Sequence
  Synthetic
cagcagggattctgaaaagatggggacagttgaagaaaaataaggccatcaagatactgattggattcaggaagg

SEQ ID NO: 57349 - DNA, 75 bp, Artificial Sequence
  Synthetic
gagcctgatgttgatcttggaagtggaacacgcaacatcggaattgagtgtgaaacgccaaatatggacataatt

SEQ ID NO: 57350 - DNA, 75 bp, Artificial Sequence
  Synthetic
accagagatcctgctgtctcctcagcatcattccaggcacagaacgccagaaaatggaatggtgctgttgaatca

SEQ ID NO: 57351 - DNA, 75 bp, Artificial Sequence
  Synthetic
cctagaacatactacttaataatgaaagagacgtctaaggctaaaaaaatcaggacaggtcacgaagtattcatc

SEQ ID NO: 57352 - DNA, 75 bp, Artificial Sequence
  Synthetic
aagtcttgtcagatgcccgctatccaggaattccactcatgagatgtattgggtgtcaggtgtgtcaggaaacat

SEQ ID NO: 57353 - DNA, 75 bp, Artificial Sequence
  Synthetic
caagaacccaggaaccaaaagagggcacgaaaaaattgatgagaatcacagcagagtggctttggggtgagttag

SEQ ID NO: 57354 - DNA, 75 bp, Artificial Sequence
  Synthetic
cacaacacaactacagaccaggctatcatacacaaacggcaggaccctggcatctaggtaagcttgagatggact

SEQ ID NO: 57355 - DNA, 75 bp, Artificial Sequence
  Synthetic
caaaaaaggtcagaaccaacgcggctatgggagctgttttcacagaggagaaccaatgggatagtgcgagagctg

SEQ ID NO: 57356 - DNA, 75 bp, Artificial Sequence
  Synthetic
caggactttttcccgtatcaataccaatcacagcagcagcatggtacctgtgggaagtgaagaaacaacgggctg

SEQ ID NO: 57357 - DNA, 75 bp, Artificial Sequence
  Synthetic
ggaagcttgcttaacgtagtgcttaacagtttttattagagagcagatctctgatgaacaaccaacggaagaaga

SEQ ID NO: 57358 - DNA, 75 bp, Artificial Sequence
  Synthetic
tccttaccactttttatcttcagcttgaaagatacactcaaaaggaggagctggccactgaatgagggggtgatg

SEQ ID NO: 57359 - DNA, 75 bp, Artificial Sequence
  Synthetic
atttccgggccgacagggtgatagacccaagacggtgtttgaaaccggtaatactaaaagatggtccagagcgtg

SEQ ID NO: 57360 - DNA, 75 bp, Artificial Sequence
  Synthetic
cacatgaccttatggaactcattgatggaatatcactaggactaattttgctaaaaatagtaacacagtttgaca

SEQ ID NO: 57361 - DNA, 75 bp, Artificial Sequence
  Synthetic
aaggagagaccaaagaggcagtgggcaggtggggacgtacggtctcaacaccttcaccaatatggaagcacaact

SEQ ID NO: 57362 - DNA, 75 bp, Artificial Sequence
  Synthetic
ggagaaacggaccatcacgctgtgtcgcgaggctcagcaaaactgagatggttcgtcgagagaaatatggtcaca

SEQ ID NO: 57363 - DNA, 75 bp, Artificial Sequence
  Synthetic
tgatgtgccactagctggcccattaatagctggaggcatgctgatagcatgttatgtcatatccggaagctcggc

SEQ ID NO: 57364 - DNA, 75 bp, Artificial Sequence
  Synthetic
aattgcagtgtcaatggccaacatctttagagggagctacttggctggagctggacttcttttttccatcatgaa

SEQ ID NO: 57365 - DNA, 75 bp, Artificial Sequence
  Synthetic
ggttgggacaccaagattcccgaagatgaccttctgaaggaaaaaccgatcccgggaccaatggcccctcatcaa

SEQ ID NO: 57366 - DNA, 75 bp, Artificial Sequence
  Synthetic
atgaccttctgaaggaaaaaccgatcccgggaccaatggcccctcatcaaaggatcccagccagagccattttca

SEQ ID NO: 57367 - DNA, 75 bp, Artificial Sequence
  Synthetic
agcttcgatatcaaacataaccacggcaacaagatgtccaacgcaaggagagccttatctcaaagaggaacaaga

SEQ ID NO: 57368 - DNA, 75 bp, Artificial Sequence
  Synthetic
ggggtatacccaatgtcaataccggcgactctctttgtgtggtatttttggcagaaaaagaaacagagatcagga

SEQ ID NO: 57369 - DNA, 75 bp, Artificial Sequence
  Synthetic
ggagcagtgatggacatcatatctaggaaagaacaaagaggtagtggacaggttggaacatatggtttgaacaca

SEQ ID NO: 57370 - DNA, 75 bp, Artificial Sequence
  Synthetic
aaaaaggacagctgctggaataatgaagaatccaacggtggatgggataatgacaatagacctagatcctgtaat

SEQ ID NO: 57371 - DNA, 75 bp, Artificial Sequence
  Synthetic
ctcaccatcagtggatgactacagaagacatgcttactgtctggaacagggtgtggatagaggacaatccatgga

SEQ ID NO: 57372 - DNA, 75 bp, Artificial Sequence
  Synthetic
ccgacgagacaaacgttccgtggcactggccccacacgtgggacttggtctagaaacaagaaccgaaacatggat

SEQ ID NO: 57373 - DNA, 75 bp, Artificial Sequence
  Synthetic
gggaaccatccaagggatggaaaaactggcaagaggttcctttttgctcccaccactttcacaagatctttatga

SEQ ID NO: 57374 - DNA, 75 bp, Artificial Sequence
  Synthetic
ggagtggtcagactgctgacaaaaccttgggacgtcgtccccatggtgacacagatggcaatgacagacacgact

SEQ ID NO: 57375 - DNA, 75 bp, Artificial Sequence
  Synthetic
gtacgcatggtgtagtggactagcggttagaggagacccctcccttaagaatcgcagcatgaatgggggcccaag

SEQ ID NO: 57376 - DNA, 75 bp, Artificial Sequence
  Synthetic
gtttttggacctacctctaccatggacagcaggagcagacacatcagaagttcattggaattataaagagagaat

SEQ ID NO: 57377 - DNA, 75 bp, Artificial Sequence
  Synthetic
tgtgaaggaaatagcagaaacacaacatggaacaatagttatcagagtacaatatgaaggggacggctctccatg

SEQ ID NO: 57378 - DNA, 75 bp, Artificial Sequence
  Synthetic
gacccagaaagcaaggaatgcactggacaacttagcagtcctgcatacggctgaagcaggcggaagggcgtacaa

SEQ ID NO: 57379 - DNA, 75 bp, Artificial Sequence
  Synthetic
gactccagttcattcgtgggaagacataccttacctagggaaaagagaggatttgtggtgtggatccttgattgg

SEQ ID NO: 57380 - DNA, 75 bp, Artificial Sequence
  Synthetic
ccatggctaaaaaacaaccagttttgcattaaagtattaaacccttacatgccaactgtgattgagcacctagaa

SEQ ID NO: 57381 - DNA, 75 bp, Artificial Sequence
  Synthetic
aggtcaggaacttgatcgggatagaggggtatgtggattactttctactcataaaatggtacagcgctcctttcg

SEQ ID NO: 57382 - DNA, 75 bp, Artificial Sequence
  Synthetic
ctaatagctggaggcatgctgatagcatgttatgtcatatccggaagctcagccgatttatcattggagaaagcg

SEQ ID NO: 57383 - DNA, 75 bp, Artificial Sequence
  Synthetic
ctcaaggtgtcctacccaaggggaagcgattctacctgaggagcaggaccagaactacgtatgtaagcacacata

SEQ ID NO: 57384 - DNA, 75 bp, Artificial Sequence
  Synthetic
agaacatggaacaattgcaaccataacacctcaagctcccacgtcggaaatacagctgactgactacggagccct

SEQ ID NO: 57385 - DNA, 75 bp, Artificial Sequence
  Synthetic
tctttgaagaggtgatgagaggaaaatttgggaagaaacacatgattgcaggggttctcttcacgtttgtgctcc

SEQ ID NO: 57386 - DNA, 75 bp, Artificial Sequence
  Synthetic
tcgacggcccaaacaccccagaatgccctgatgatcaaagagcatggaatatttgggaagttgaggactatggat

SEQ ID NO: 57387 - DNA, 75 bp, Artificial Sequence
  Synthetic
aataatgatcgaagaggtgatgagatccagatggagtagaaagatgctgatgactggaacactggctgtgttcct

SEQ ID NO: 57388 - DNA, 75 bp, Artificial Sequence
  Synthetic
gcaagagtagggcgcgaaaggttatcaagaatggccatcagtggagatgattgtgttgtgaaacctttagatgac

SEQ ID NO: 57389 - DNA, 75 bp, Artificial Sequence
  Synthetic
gacaacagcagtgaagagtgaacacacgggaaaggagatagttgacctcatgtgccacgccactttcaccatgcg

SEQ ID NO: 57390 - DNA, 75 bp, Artificial Sequence
  Synthetic
cagcaggatgggacacaagaatcacactagaagacttaaaaaatgaagaaatggtgacaaaccacatggaaggag

SEQ ID NO: 57391 - DNA, 75 bp, Artificial Sequence
  Synthetic
tgtccctttagctggcccaatggtggcaggaggcttacttctggcggcttacgtaatgagtggcagctcagcaga

SEQ ID NO: 57392 - DNA, 75 bp, Artificial Sequence
  Synthetic
ggggaaaagagaagaccaatggtgcggctcattgattgggctaacaagcagggccacctgggcaaagaacatcca

SEQ ID NO: 57393 - DNA, 75 bp, Artificial Sequence
  Synthetic
aataatgaaaaatccaactgtagacgggattgttgcaatagacttggatcctgtggtttatgatgcaaaatttga

SEQ ID NO: 57394 - DNA, 75 bp, Artificial Sequence
  Synthetic
ccatagaggcccatctttgaggaccaccactgcatctggaaaactggtcacgcaatggtgctgccgctcctgcac

SEQ ID NO: 57395 - DNA, 75 bp, Artificial Sequence
  Synthetic
ctttttctatggggttgctatgcctgaccttgttcgtggaagaatgcttaaggagaagagtcactaggaaacaca

SEQ ID NO: 57396 - DNA, 75 bp, Artificial Sequence
  Synthetic
gagcaacgctccaattcaagatgaagaaagggacataccagaacgctcatggaattcaggcaatgaatggattac

SEQ ID NO: 57397 - DNA, 75 bp, Artificial Sequence
  Synthetic
gctgtacctccttgcaaaggactagaggttagaggagaccccccgcaaataaaaacagcatattgacgctgggag

SEQ ID NO: 57398 - DNA, 75 bp, Artificial Sequence
  Synthetic
tgaataaccaacggaaaaaggcgagaaatacgcctttcaatatgctgaaacgcgagagaaaccgcgtgtcaactg

SEQ ID NO: 57399 - DNA, 75 bp, Artificial Sequence
  Synthetic
aacagtttcgactcggaagcttgcttaacgtagtgctgacagttttttattagagagcagatctctgatgaacaa

SEQ ID NO: 57400 - DNA, 75 bp, Artificial Sequence
  Synthetic
ttttgttagagagcagatctctgatgaacaaccaacggaaaaagacggctcgaccgtctttcaatatgctgaaac

SEQ ID NO: 57401 - DNA, 75 bp, Artificial Sequence
  Synthetic
agctgggattttcatgacagccactcctccgggaagtagagacccatttcctcagagcaatgcaccaatcataga

SEQ ID NO: 57402 - DNA, 75 bp, Artificial Sequence
  Synthetic
cgccgacatgggctattggatagaaagccaaaagaatggaagttggaagctagaaaaagcatccctcatagaggt

SEQ ID NO: 57403 - DNA, 75 bp, Artificial Sequence
  Synthetic
acggctgaggcaggtggaagggcgtacaatcatgctctcagtgaactgccggagaccctggagacactgctttta

SEQ ID NO: 57404 - DNA, 75 bp, Artificial Sequence
  Synthetic
aatcgtatctctctttcctttatgtctgtctacgacctcccaaaaaacaacatggcttccggtgctgttaggatc

SEQ ID NO: 57405 - DNA, 75 bp, Artificial Sequence
  Synthetic
accttcaccaacatggaggcccaactaataagacaaatggagtctgaaggaatcttttcacccagcgaattggaa

SEQ ID NO: 57406 - DNA, 75 bp, Artificial Sequence
  Synthetic
aacagcgatggcgttccatttaaccacacgcaacggagaaccacacatgatcgtcagcagacaagagaaagggaa

SEQ ID NO: 57407 - DNA, 75 bp, Artificial Sequence
  Synthetic
cagagatcctgctgtctctacagcatcattccaggcacagaacgccagaaaatggaatggtgctgttgaatcaac

SEQ ID NO: 57408 - DNA, 75 bp, Artificial Sequence
  Synthetic
gatgctattctcaagtgaacccaacaaccctgacagcatccttagtcatgcttttagtccattatgcaataatag

SEQ ID NO: 57409 - DNA, 75 bp, Artificial Sequence
  Synthetic
aaactgtgcagcctgtagctccacctgagaaggtgtaaaaaatctgggaggccacaaaccatggaagctgtacgc

SEQ ID NO: 57410 - DNA, 75 bp, Artificial Sequence
  Synthetic
tatcgggagctacgtgggttgacgtggtgctcgagcacggtgggtgtgtgactaccatggctaagaacaagccca

SEQ ID NO: 57411 - DNA, 75 bp, Artificial Sequence
  Synthetic
tactcattaaggtcgagtacaaaggggaagatgcaccttgcaagattcctttctccacagaggatggacaaggga

SEQ ID NO: 57412 - DNA, 75 bp, Artificial Sequence
  Synthetic
atgaagcacatttcactgacccttgtagtgtcgcggctagaggatacatttcaaccagggtggaaatgggagagg

SEQ ID NO: 57413 - DNA, 75 bp, Artificial Sequence
  Synthetic
ataagtgtccctttctcaagcaaaacgagccagaggatatagactgctggtgcaactccacatcaacctgggtga

SEQ ID NO: 57414 - DNA, 75 bp, Artificial Sequence
  Synthetic
ggtgttgttgacaatgaaagaaaaatcatggctagtccacaaacaatggtttctagacttaccactgccttggac

SEQ ID NO: 57415 - DNA, 75 bp, Artificial Sequence
  Synthetic
gtatgctgatgacacagctggttgggacacaagaataacagaagatgacctacacaatgaggaaaaaatcacaca

SEQ ID NO: 57416 - DNA, 75 bp, Artificial Sequence
  Synthetic
cacttttggccacagtcacgggcggaatcttcctgttcttgatgagcggaaaaggtatagggaagatgaccctgg

SEQ ID NO: 57417 - DNA, 75 bp, Artificial Sequence
  Synthetic
tccactgaaacagaaaaaccagacatgacaatcattgggagaaggcttcagcgattgcaagaagagcacaaagaa

SEQ ID NO: 57418 - DNA, 75 bp, Artificial Sequence
  Synthetic
actttgtggagggagtttcaggaggaagctgggttgatatcgtcttagaacatggaagctgcgtcacaacaatgg

SEQ ID NO: 57419 - DNA, 75 bp, Artificial Sequence
  Synthetic
tccaacagtgatggcgttccatttaaccacacgcaacggagaaccacacatgatcgtcagtagacaagagaaagg

SEQ ID NO: 57420 - DNA, 75 bp, Artificial Sequence
  Synthetic
tagtagtaggctccctaaaaagcactatactgaagatggcaacactagaagaactccaaaaggagatcaatagcc

SEQ ID NO: 57421 - DNA, 75 bp, Artificial Sequence
  Synthetic
tatactgaagatggcaacactagaagaactccaaaaggagatcaatagccatgaaggccaactggtgatagccag

SEQ ID NO: 57422 - DNA, 75 bp, Artificial Sequence
  Synthetic
tagtagtagactccctaaaaagcactatactaaagatggcaacactagaggaactccaaaaagagatcaatagcc

SEQ ID NO: 57423 - DNA, 75 bp, Artificial Sequence
  Synthetic
aatacctcctttattaccataactcctagtcctttattacgtgggtatttctatatcctgcggagcatactacta

SEQ ID NO: 57424 - DNA, 75 bp, Artificial Sequence
  Synthetic
gcagaaggtgaaggatgcagaaaagcagtatgaaaaggaccctgatgaccttaacaaaagggcattgagtgaccg

SEQ ID NO: 57425 - DNA, 75 bp, Artificial Sequence
  Synthetic
atgagggccaactggtgatagccaggcagaaggtgaaggatgcagaaaagcagtatgagaaggaccctgatgacc

SEQ ID NO: 57426 - DNA, 75 bp, Artificial Sequence
  Synthetic
ggaaagtgtcgcacagtcaatccagagcaagattgatgaattaaggagacagctggctgaccgtgtggctgcagg

SEQ ID NO: 57427 - DNA, 75 bp, Artificial Sequence
  Synthetic
ttaacaaaagagcattgagtgaccgagaaagcgttgcacagtcaattcagggtaaaatcgatgaactgaggagac

SEQ ID NO: 57428 - DNA, 75 bp, Artificial Sequence
  Synthetic
agctggctgaccgtgtggctgcagggaaaaacatcggtaaggagagggatccaactggactggaccctggtgatc

SEQ ID NO: 57429 - DNA, 75 bp, Artificial Sequence
  Synthetic
atcttaaagaaaaatcaatgctcagttatgggaatgttatcgatctcaaccaccttgacattgatgaaccaactg

SEQ ID NO: 57430 - DNA, 75 bp, Artificial Sequence
  Synthetic
acctgaaggagaaatcaatgctcagttacgggaatgtaatcgaccttaaccatctggacattgatgaaccgacag

SEQ ID NO: 57431 - DNA, 75 bp, Artificial Sequence
  Synthetic
ggcagactgctgattggctaagtattgtggtctatttaacatcttttgtggtcccgatactcttaaaggctcttt

SEQ ID NO: 57432 - DNA, 75 bp, Artificial Sequence
  Synthetic
ggcaaactgctgactggctaagcattgtggtctatctgacatcttttgtggttccaatactattgaaagctcttt

SEQ ID NO: 57433 - DNA, 75 bp, Artificial Sequence
  Synthetic
atatgttaacaactagagggagacagactactaaggacaacaagggaatgaggattcgcttcaaggatgacagct

SEQ ID NO: 57434 - DNA, 75 bp, Artificial Sequence
  Synthetic
acatgttaacaactaggggaagacagactactaaggacaacaaagggatgagaattcgattcaaggatgacagct

SEQ ID NO: 57435 - DNA, 75 bp, Artificial Sequence
  Synthetic
aggattcgcttcaaggatgacagctcgtttgaggatgtgaacgggatccggaaaccaaaacatttattcctgtca

SEQ ID NO: 57436 - DNA, 75 bp, Artificial Sequence
  Synthetic
catttgaagatgtgaatgggatccggaagccaaagcacttattcttgtcaatgcccaatgcccagtccagtatga

SEQ ID NO: 57437 - DNA, 75 bp, Artificial Sequence
  Synthetic
atgcctaatgctcagtccagtatgaaggcagatgaaattacacctggccgattcagaactgcaatttgtggatta

SEQ ID NO: 57438 - DNA, 75 bp, Artificial Sequence
  Synthetic
aagcagatgagattacacctggtcggtttaggactgcagtttgtggattatatccagctcaggtcaaagcaagga

SEQ ID NO: 57439 - DNA, 75 bp, Artificial Sequence
  Synthetic
tatccagctcaggttaaagcaagaaatttggttagtcctgtcatgagtgtgattggttttttggcccttgcaaag

SEQ ID NO: 57440 - DNA, 75 bp, Artificial Sequence
  Synthetic
acctggttagccctgtcatgagtgtgattggctttttagcccttgcaaagaactggacagaacgggttgaagact

SEQ ID NO: 57441 - DNA, 75 bp, Artificial Sequence
  Synthetic
aactggacagagagggttgaagagtggttagatcttccatgtaagctgctatctgagccatctccaacatctttg

SEQ ID NO: 57442 - DNA, 75 bp, Artificial Sequence
  Synthetic
ggcttgacctcccatgcaagctgctatctgagccatcaccgacatctttgaccaaaggcccatcaaccaaccgtg

SEQ ID NO: 57443 - DNA, 75 bp, Artificial Sequence
  Synthetic
accaaaggcccatccaccaaccgtgattacttaaaccaacggcaaggagcacttgcaaaaatggagacaaaagaa

SEQ ID NO: 57444 - DNA, 75 bp, Artificial Sequence
  Synthetic
actacctgaatcaaaggcagggagcccttgcaaagatggaaacaaaggaagctcaggctgtgaggaaacatgcca

SEQ ID NO: 57445 - DNA, 75 bp, Artificial Sequence
  Synthetic
gctcaggcagtgaggaagcatgccatagatgctggttgtaacatcattgatcacatcgactcaccatcatcaatt

SEQ ID NO: 57446 - DNA, 75 bp, Artificial Sequence
  Synthetic
tagatgctggttgtaacatcattgaccacattgactcaccatcatcaatttgggtttttgctggagcacctgata

SEQ ID NO: 57447 - DNA, 75 bp, Artificial Sequence
  Synthetic
tgggtttttgctggggcacctgataggtgcccccctacctgcctgtttattgcaggcatggcagagttaggtgca

SEQ ID NO: 57448 - DNA, 75 bp, Artificial Sequence
  Synthetic
gatgcccccccacctgcctgttcattgcaggcatggctgagttaggtgcattctttgctgtccttcaggatatga

SEQ ID NO: 57449 - DNA, 75 bp, Artificial Sequence
  Synthetic
ttcttttctgtcctccaggacatgaggaatacaatcatggcatcaaaaaccatcgggacttctgaggagaagttg

SEQ ID NO: 57450 - DNA, 75 bp, Artificial Sequence
  Synthetic
catcgggacttctgaggagaagttgagaaagaaatcatcattctaccagtcttaccttcgaaggacacaatcaat

SEQ ID NO: 57451 - DNA, 75 bp, Artificial Sequence
  Synthetic
ggaatacaatcatggcatccaagactatcgggacatcagaagagaagctgaggaagaaatcctcattttatcaat

SEQ ID NO: 57452 - DNA, 75 bp, Artificial Sequence
  Synthetic
cttaccttcgaaggacacaatcaatgggaatccagctggaccagcgcattattgtgctttttatggtggactggg

SEQ ID NO: 57453 - DNA, 75 bp, Artificial Sequence
  Synthetic
cttaccttcgaaggacacagtctatggggatccagctggaccagcgcattattgttctgttcatggtggactggg

SEQ ID NO: 57454 - DNA, 75 bp, Artificial Sequence
  Synthetic
gcaaagaagcagttgacagtttccatctaggcgatgatatggacccagagcttcggggtctggcacaggcattga

SEQ ID NO: 57455 - DNA, 75 bp, Artificial Sequence
  Synthetic
gcaaagaggcagttgacagcttccatctaggtgatgacatggatccagagcttcggggcctggcacaggcattga

SEQ ID NO: 57456 - DNA, 75 bp, Artificial Sequence
  Synthetic
caatcaagagccactcaaactttaaatccatgtatcccatgctttgtgcaattccacatatgctgcattaagtgc

SEQ ID NO: 57457 - DNA, 75 bp, Artificial Sequence
  Synthetic
ttgaccaaaaagtgaaggagatatctaatcaggagccgcttaagctttaattataggtatactgcattatcccat

SEQ ID NO: 57458 - DNA, 75 bp, Artificial Sequence
  Synthetic
attccacatatgctgcattaagtgctttgtgtaatcccacatatgctgcattaaatgcttgaactggaatcatta

SEQ ID NO: 57459 - DNA, 75 bp, Artificial Sequence
  Synthetic
tttgtgtaatcccacatatgctgcattaaatgcttgaactggaatcattatactactgattattgaatgtatttg

SEQ ID NO: 57460 - DNA, 75 bp, Artificial Sequence
  Synthetic
gctttatgtagccccacatatgctgcattaaccgcttaaactggaatcattatactactaatcagtgaatgtatt

SEQ ID NO: 57461 - DNA, 75 bp, Artificial Sequence
  Synthetic
tactactgattattgaatgtatttgcactaggggacgggttgggtgggccatttatcaattatgtaatctcaggg

SEQ ID NO: 57462 - DNA, 75 bp, Artificial Sequence
  Synthetic
tgcactaggggatgggttgggtgggccatttatccattatataatctcagggtgggttaggacgtcaccttaagt

SEQ ID NO: 57463 - DNA, 75 bp, Artificial Sequence
  Synthetic
ctttttctgtatatatggatgtagatttcaactgatctgtactaacatcttattttcctcctttcctttctttac

SEQ ID NO: 57464 - DNA, 75 bp, Artificial Sequence
  Synthetic
gactattttctgtatatatagatgtagatttcaattgatctgtactaacatcttattttcctcttttcttttctc

SEQ ID NO: 57465 - DNA, 75 bp, Artificial Sequence
  Synthetic
agatttcaattgatctgtactaacatcttattttcctcttttcttttctctactaacaacaactctctacctcaa

SEQ ID NO: 57466 - DNA, 75 bp, Artificial Sequence
  Synthetic
taacaacaactatctacctcaaaacaacaacactacctcaacaaccactacctcattaatttgcttcctgaatgt

SEQ ID NO: 57467 - DNA, 75 bp, Artificial Sequence
  Synthetic
tagtagtagactccctaaagagcactacactaaagatggcaacactagaggaactccaaaaagaaataaatagcc

SEQ ID NO: 57468 - DNA, 75 bp, Artificial Sequence
  Synthetic
tgaggaacaccatcatggcatcaaaaaccatcggaacatctgaggaaaagctaaagaaaaaatcatctttttacc

SEQ ID NO: 57469 - DNA, 75 bp, Artificial Sequence
  Synthetic
atgagggccaactagtgatagccagacagaaggtaaaggatgcagaaaagcagtatgagaaagaccctgatgacc

SEQ ID NO: 57470 - DNA, 75 bp, Artificial Sequence
  Synthetic
ttaacaaaagggcattgagtgaccgggaaagcgttgcacagtcaatccagagtaaaatcgatgaactaaggagac

SEQ ID NO: 57471 - DNA, 75 bp, Artificial Sequence
  Synthetic
tagtagtagactccgcaagaaacagcagttaaataacagcatgatcatgtggggtctactattgacaatgatttt

SEQ ID NO: 57472 - DNA, 75 bp, Artificial Sequence
  Synthetic
agctggctgaccgtgtggctgcagggaaaaacattggcaaagagagggatccaactggactagaccctggtgacc

SEQ ID NO: 57473 - DNA, 75 bp, Artificial Sequence
  Synthetic
aatgtttatgacatgaagatagaatgcccacattcaatcaactttggggagagcagtgtaacaggtaaggtggaa

SEQ ID NO: 57474 - DNA, 75 bp, Artificial Sequence
  Synthetic
accttaaagagaagtcaatgctcagttatgggaatgtcattgatctcaaccaccttgacattgatgaaccgactg

SEQ ID NO: 57475 - DNA, 75 bp, Artificial Sequence
  Synthetic
ttaccaccccttctgctcacagatgcagaggccttggtcccggagagttcttgtaacatggacaaccatcagtct

SEQ ID NO: 57476 - DNA, 75 bp, Artificial Sequence
  Synthetic
ggcaaactgctgattggctgagcattgtggtctatttgacatcttttgtggttccgatactcttaaaggctcttt

SEQ ID NO: 57477 - DNA, 75 bp, Artificial Sequence
  Synthetic
atgtcaattatacaaaaagtgacaaaagtgagttggagaaaaaaggcagacaaagcccaagctgccaaggactca

SEQ ID NO: 57478 - DNA, 75 bp, Artificial Sequence
  Synthetic
acatgttgacaaccagaggaaggcaaactactaaggacaataagggaatgaggattcgctttaaggatgacagct

SEQ ID NO: 57479 - DNA, 75 bp, Artificial Sequence
  Synthetic
tttgagacaacatcaagcgaggttaatctgaaggggacatgcacattgagtcataggatggttgaagaatcctac

SEQ ID NO: 57480 - DNA, 75 bp, Artificial Sequence
  Synthetic
cattcgaggatgtaaatggaatccggaagccaaaacacctgttcttgtcaatgcctaatgctcaatccagcatga

SEQ ID NO: 57481 - DNA, 75 bp, Artificial Sequence
  Synthetic
aggaataggagatcagtgatatgctatgacttgtcttgcaattcaacacattgtaagccaacgatgcatatgatt

SEQ ID NO: 57482 - DNA, 75 bp, Artificial Sequence
  Synthetic
aagcagatgagattacacctggccgattcaggactgcaatttgtggattatacccagctcaggtcaaagcaagaa

SEQ ID NO: 57483 - DNA, 75 bp, Artificial Sequence
  Synthetic
gtgcctgtgcactcatgcaacatgatgaaaagctgtctggttgggcttgggccttatcgaatccaagttgtctat

SEQ ID NO: 57484 - DNA, 75 bp, Artificial Sequence
  Synthetic
atttggtcagtcctgtcatgagtgtgattggctttttagcccttgcaaagaactggacagaaagagttgaagagt

SEQ ID NO: 57485 - DNA, 75 bp, Artificial Sequence
  Synthetic
gaaagaacctactgtacaactggtatactaacagaagggaagtgttttgtgccagaccagagtattgtcagtgtc

SEQ ID NO: 57486 - DNA, 75 bp, Artificial Sequence
  Synthetic
ggcttgaccttccatgcaagctactatctgagccatctccaacatctctgaccaaaggcccgtccaccaaccgtg

SEQ ID NO: 57487 - DNA, 75 bp, Artificial Sequence
  Synthetic
atcaagaatggggtttttgacattgcaagtgtgagcattgtctgtttttttatcagagttaaaggaactaactac

SEQ ID NO: 57488 - DNA, 75 bp, Artificial Sequence
  Synthetic
attacttgaaccaacgacaagcagcacttgcaaaaatggagacaaaggaagctcaggctgtgagaaaacatgcca

SEQ ID NO: 57489 - DNA, 75 bp, Artificial Sequence
  Synthetic
aagataatggcgagtattaaaacagcaactgcaaataactgtaatgacactgacaataaggttcaaggatattac

SEQ ID NO: 57490 - DNA, 75 bp, Artificial Sequence
  Synthetic
caactgcaaataactgtaatgacactgacaataaggttcaaggatattacctttgtattgttgggggaaattctt

SEQ ID NO: 57491 - DNA, 75 bp, Artificial Sequence
  Synthetic
tagatgctggttgtactatcattgatcacattgactcaccatcatcaatctgggtctttgctggggcacctgata

SEQ ID NO: 57492 - DNA, 75 bp, Artificial Sequence
  Synthetic
ggtgcccccccacctgcctgtttattgcaggcatggcagagttgggtgcatttttttctgtcctccaggacatga

SEQ ID NO: 57493 - DNA, 75 bp, Artificial Sequence
  Synthetic
gctagccttttaagagctcctcatggtgaggaccatgatttatctggagaagaggttgcaacttattcaattgcc

SEQ ID NO: 57494 - DNA, 75 bp, Artificial Sequence
  Synthetic
ggaatacgattatggcatcaaaaactgtcggaacttcagaggagaagctgaggaagaagtcatcattttatcaat

SEQ ID NO: 57495 - DNA, 75 bp, Artificial Sequence
  Synthetic
gggcaaattgaaggcaaaatcccacatactgcaaatgcagcaaacatgctatttactgcattctcaggaattcct

SEQ ID NO: 57496 - DNA, 75 bp, Artificial Sequence
  Synthetic
cttacctccgaagaacacaatctatgggaatccagctggaccagcgcattattgtgcttttcatggtggactggg

SEQ ID NO: 57497 - DNA, 75 bp, Artificial Sequence
  Synthetic
agttactcttcattgagtgtttttattggaagtcaagatgggcctattatttatagcccaggattgtttcccaag

SEQ ID NO: 57498 - DNA, 75 bp, Artificial Sequence
  Synthetic
gcaaagaagcagttgatagtttccatctaggtgatgatatggacccagagcttcgaggcctggcacaggcattga

SEQ ID NO: 57499 - DNA, 75 bp, Artificial Sequence
  Synthetic
ttgaaccaatcttcatgtgataaggtcgcactaccattgatatgggaagggtacatagatctacctggctattat

SEQ ID NO: 57500 - DNA, 75 bp, Artificial Sequence
  Synthetic
ttgaccagaaagtgaaggagatatctaaccgagagccgcttaagctttaagtatatatattacgatatcccatgc

SEQ ID NO: 57501 - DNA, 75 bp, Artificial Sequence
  Synthetic
gaaacagttcacccgtgtaatgtcttttgtgtgctatctggcccaggagcatcatgtgaggcattctcagaaggt

SEQ ID NO: 57502 - DNA, 75 bp, Artificial Sequence
  Synthetic
tttatgtaatcccacatatgctgcattaactgcttgaactggaatccataatactactgatcagtaaatgtattt

SEQ ID NO: 57503 - DNA, 75 bp, Artificial Sequence
  Synthetic
ggtattttcaatattacatcccctacatgccttgtgtcaaagcaaaatcggttcagggcagctgagcagcaagtc

SEQ ID NO: 57504 - DNA, 75 bp, Artificial Sequence
  Synthetic
gcactaggggacgggttgggtgggccatttatcaattatataatctcagggtggtttaggatgtcaccttaagtg

SEQ ID NO: 57505 - DNA, 75 bp, Artificial Sequence
  Synthetic
aatttcgtatgccagcgagtcgaccaagacattattatctactgtaatggacaaaagaagacaattttgaccaag

SEQ ID NO: 57506 - DNA, 75 bp, Artificial Sequence
  Synthetic
acttttttctgtatatatggatgtagatttcatttgatcagtactaacaccttactttctttctttcctttcttt

SEQ ID NO: 57507 - DNA, 75 bp, Artificial Sequence
  Synthetic
acattagtgattgggcagtgtatttattcagtgactagtttgttttcaataatgcctggggtagcacattcaatt

SEQ ID NO: 57508 - DNA, 75 bp, Artificial Sequence
  Synthetic
actaacaacaactatctacctcaaaacaacaacactacctcaacaactactacctcattgatttgcttcctgaat

SEQ ID NO: 57509 - DNA, 75 bp, Artificial Sequence
  Synthetic
gcaatcgaattatgtgtaccagggttccatggctgggcaactgctgctcttctcaccacattctgctttggctgg

SEQ ID NO: 57510 - DNA, 75 bp, Artificial Sequence
  Synthetic
aacaacaacactacctcaacaactactacctcattgatttgcttcctgaatgtctctttagggagcctactacta

SEQ ID NO: 57511 - DNA, 75 bp, Artificial Sequence
  Synthetic
atactgatcccttccatcacattggctgtattggttgtcttaaagttttttgcagcaatcttacataatagctct

SEQ ID NO: 57512 - DNA, 75 bp, Artificial Sequence
  Synthetic
caagaaaaccgttttaaaattatcctaaggaagattaaagaagaatttgaaaagactaagggctcaatggtttgt

SEQ ID NO: 57513 - DNA, 75 bp, Artificial Sequence
  Synthetic
aacaacaacactacctcaacaactactacctcattgatttgcttcctgaatgtctttttagggagcctactacta

SEQ ID NO: 57514 - DNA, 75 bp, Artificial Sequence
  Synthetic
tagtagtaggctccctaaagagcactatactgaagatggcaacactagaggaactccaaaaagagatcaatagcc

SEQ ID NO: 57515 - DNA, 75 bp, Artificial Sequence
  Synthetic
tatactgaagatggcaacactagaggaactccaaaaagagatcaatagccacgagggccaactggtgatagccag

SEQ ID NO: 57516 - DNA, 75 bp, Artificial Sequence
  Synthetic
ccttattgctttacacattgtgagcctacagaatctgccttccaggcacattataaagtgtgccaggcaacacac

SEQ ID NO: 57517 - DNA, 75 bp, Artificial Sequence
  Synthetic
gcagaaggtgaaagatgcagagaaacaatacgaaaaagatcctgatgaccttaataaaagggcattgagtgatag

SEQ ID NO: 57518 - DNA, 75 bp, Artificial Sequence
  Synthetic
aggtttagagatgatttgaagaaaacaataacacctcaatctacaagcccgggttgttaccggacattaaatctc

SEQ ID NO: 57519 - DNA, 75 bp, Artificial Sequence
  Synthetic
agaaagcattgcacaatcaatccagggcaaaattgatgagctaaggagacagctggctgatcgtgtggctgcagg

SEQ ID NO: 57520 - DNA, 75 bp, Artificial Sequence
  Synthetic
tttaggtataaaagtaggtgttacatttttacagtgtgggtcaccctgctaatcattgaatcaatcatgtgggca

SEQ ID NO: 57521 - DNA, 75 bp, Artificial Sequence
  Synthetic
aaaaaacattggcagggagagggacccaactggactagatcctggtgatcaccttaaagagaaatcaatgcttag

SEQ ID NO: 57522 - DNA, 75 bp, Artificial Sequence
  Synthetic
gctagcgcatcagaaaatgttttggagccaagctggaatgacaacgcacatggtgttggtgttgtcccaatgcat

SEQ ID NO: 57523 - DNA, 75 bp, Artificial Sequence
  Synthetic
ttatggaaatgtcattgacctcaatcatcttgacattgatgaaccaacagggcaaactgctgactggctaagcat

SEQ ID NO: 57524 - DNA, 75 bp, Artificial Sequence
  Synthetic
actgatctggaactagatttttctcttccgtcaagttctaagtacacatataaaagaaaactgacaagtccatta

SEQ ID NO: 57525 - DNA, 75 bp, Artificial Sequence
  Synthetic
tgtgatctatctgacatctttcgtagtcccaatactcctgaaggctctttacatgttgacaactagagggaggca

SEQ ID NO: 57526 - DNA, 75 bp, Artificial Sequence
  Synthetic
gactactaaagacaataagggaatgaggattcgatttaaggatgatagttcttttgaggatgtgaatggaattcg

SEQ ID NO: 57527 - DNA, 75 bp, Artificial Sequence
  Synthetic
cattggtttgatgggagacttaatttaaagacatcttttcattgttatggtgcatgtactaagtatgaatatcct

SEQ ID NO: 57528 - DNA, 75 bp, Artificial Sequence
  Synthetic
cttttgaggatgtgaatggaattcgaaaaccaaaacatctgttcttgtcaatgcccaatgcccaatccagtatga

SEQ ID NO: 57529 - DNA, 75 bp, Artificial Sequence
  Synthetic
tggcatacagcaaaatgccactttgaaagggatttcgagtatgagaacagctggggctgtaatcctgctgattgc

SEQ ID NO: 57530 - DNA, 75 bp, Artificial Sequence
  Synthetic
aagcagatgagattacacctggcaggttcagaactgcagtctgtggattatacccagcccaggttaaagcaagga

SEQ ID NO: 57531 - DNA, 75 bp, Artificial Sequence
  Synthetic
cctgggattggtacgggctgtactgcatgcggactatacattgaccaacttaaacctgtaggcagtgcatacaag

SEQ ID NO: 57532 - DNA, 75 bp, Artificial Sequence
  Synthetic
atttgatcagccccgtcatgagtgtgattggtttcttaacccttgcaaagaattggacggaacgggttgaggagt

SEQ ID NO: 57533 - DNA, 75 bp, Artificial Sequence
  Synthetic
ctaatcacagtccgttacagccgtaaagtatgtgttcagtttggtgaagaaaacctatgtaagacaattgacatg

SEQ ID NO: 57534 - DNA, 75 bp, Artificial Sequence
  Synthetic
ggcttgacctcccttgcaagctattatctgaaccatctccaacatctttaaccaaggggccttccactaaccgtg

SEQ ID NO: 57535 - DNA, 75 bp, Artificial Sequence
  Synthetic
aatgattgctttgttacaagacatgtcaaagtatgcattataggtacagtttcaaagttctcacaaggtgatacc

SEQ ID NO: 57536 - DNA, 75 bp, Artificial Sequence
  Synthetic
attatctgagtcaaagacagggagcacttgcgaagatggaaacaaaagaagcccaggctgtgagaaaacatgcca

SEQ ID NO: 57537 - DNA, 75 bp, Artificial Sequence
  Synthetic
ctagtattcctgggccctatggaaggtgggggcttaatatttaaggattggtgcactagcacatgccaatttggt

SEQ ID NO: 57538 - DNA, 75 bp, Artificial Sequence
  Synthetic
tagatgctggttgtaacatcattgaccatattgactcaccgtcatcaatctgggtttttgctggggcacctgata

SEQ ID NO: 57539 - DNA, 75 bp, Artificial Sequence
  Synthetic
gatcctggggacattatgagtcctaaagacaaagggtttagctgccctgacttcacaggccacttccggaaaaaa

SEQ ID NO: 57540 - DNA, 75 bp, Artificial Sequence
  Synthetic
ggtgtccccctacctgcctgttcattgcaggcatggcagagttaggtgcattctttgctgtcctccaggatatga

SEQ ID NO: 57541 - DNA, 75 bp, Artificial Sequence
  Synthetic
tgcaactttgcaacaacacctgtatgcgagtatgatggtaatatggtctctaggtataagaaagtaatggcaact

SEQ ID NO: 57542 - DNA, 75 bp, Artificial Sequence
  Synthetic
ttctttgctgtcctccaggatatgaggaatacaatcatggcatcaaaaactattggaacatcagaggagaagttg

SEQ ID NO: 57543 - DNA, 75 bp, Artificial Sequence
  Synthetic
tattggaacatcagaggagaagttgaggaagaagtcttcattctaccaatcttacctccggaggacacagtctat

SEQ ID NO: 57544 - DNA, 75 bp, Artificial Sequence
  Synthetic
attgattcctttcagtcatttaacactagctcaattcattacacagatgaaaggattgaacggaaggaccctgat

SEQ ID NO: 57545 - DNA, 75 bp, Artificial Sequence
  Synthetic
gggtattcaactggaccagcgcatcattgtgctttttatgatagaatggggtaaagaggcagttgatagtttcca

SEQ ID NO: 57546 - DNA, 75 bp, Artificial Sequence
  Synthetic
gggatgcttaaggaccatctcaatatacttgtcacaaaagacattgactttgaaaaccttggggagaacccgtgc

SEQ ID NO: 57547 - DNA, 75 bp, Artificial Sequence
  Synthetic
cctaggtgatgatatggatccagaaattcgaagtctagcacaggcattgatcgatcaaaaggtaaaggaaatatc

SEQ ID NO: 57548 - DNA, 75 bp, Artificial Sequence
  Synthetic
aaagtagggcttcaaacatcatcaatagaaggtgcatggggctctggggttggtttcacccttacttgtcaaatc

SEQ ID NO: 57549 - DNA, 75 bp, Artificial Sequence
  Synthetic
taatcaggagccgctcaagctttaaataggtatatcatattatccatgctttatgtagtcccacatatgctgcag

SEQ ID NO: 57550 - DNA, 75 bp, Artificial Sequence
  Synthetic
tcactgacagaatgttctcgctttctgacatccattaaagcatgtgacatggcaatctgttatggtgcacaaagt

SEQ ID NO: 57551 - DNA, 75 bp, Artificial Sequence
  Synthetic
taattgcttaagctggaatcattatactactgattaatgaatgtatttgcactaggggaagggttgggtgggcca

SEQ ID NO: 57552 - DNA, 75 bp, Artificial Sequence
  Synthetic
gtcacactcattagaggccaaaatacagtgaaggtttccgggaagggtgggcatagtggctcttcattcaagtgt

SEQ ID NO: 57553 - DNA, 75 bp, Artificial Sequence
  Synthetic
tttatccattatataatctcagggtggtttaggatgtcaccttaagtgactatttctgtatatatggatgtagat

SEQ ID NO: 57554 - DNA, 75 bp, Artificial Sequence
  Synthetic
tgtcaagggacagattgctctcagcaggggctacaagcaagcgcaccacacctagacaaagtcaatggaattgtt

SEQ ID NO: 57555 - DNA, 75 bp, Artificial Sequence
  Synthetic
ttcaattgatccgtactaacatcttattttcctcttttcctttctctactaacaacaactacctacctcaaaaca

SEQ ID NO: 57556 - DNA, 75 bp, Artificial Sequence
  Synthetic
gaacaagatagtgaaaaagtctatgatgatggtgcaccacaatgtggcatttcatgctggtttgttaagtctggg

SEQ ID NO: 57557 - DNA, 75 bp, Artificial Sequence
  Synthetic
aacaacaacactacctcaacaatcactacctcattgatttgcttcctgaatgtctctttagggagcctactacta

SEQ ID NO: 57558 - DNA, 75 bp, Artificial Sequence
  Synthetic
cactacactaaagatggcaacattagaggaactccaaaaggaaatcaacaaccatgaaggtcaattggtgatagc

SEQ ID NO: 57559 - DNA, 75 bp, Artificial Sequence
  Synthetic
gagtggataacaggaatctttaatggaaactggattgtcattgttgtgcttgttttcttcatactatccttaatc

SEQ ID NO: 57560 - DNA, 75 bp, Artificial Sequence
  Synthetic
caggcagaaggtgaaggatgcagaaaagcagtatgaaaaggaccctgacgacctgaataaaagggcattgagtga

SEQ ID NO: 57561 - DNA, 75 bp, Artificial Sequence
  Synthetic
ttacttagtcttttatgccccattcgtaagcataagcgctcataagtaaatactagagaaacctattagcatgtc

SEQ ID NO: 57562 - DNA, 75 bp, Artificial Sequence
  Synthetic
aagcagtatgaaaaggaccctgacgacctgaataaaagggcattgagtgatcgggaaagcattgcacaatcaatt

SEQ ID NO: 57563 - DNA, 75 bp, Artificial Sequence
  Synthetic
cctatatatagcctttaacaatgcaattttatatatcagtttaaacttctgtacttattaattttttacatttat

SEQ ID NO: 57564 - DNA, 75 bp, Artificial Sequence
  Synthetic
taacctagttatctaaaaaaaataactccttcattactataaatcttagtccttagtatgtgggtatttctatat

SEQ ID NO: 57565 - DNA, 75 bp, Artificial Sequence
  Synthetic
gacccaactgggctagaccctggagatcacctcaaagagaagtcaatgctcagttatggaaatgtcattgacctc

SEQ ID NO: 57566 - DNA, 75 bp, Artificial Sequence
  Synthetic
tagtagtagactccctaaagagcactacactaaagatggcaacattagaggaactccaaaaggaaatcaacaacc

SEQ ID NO: 57567 - DNA, 75 bp, Artificial Sequence
  Synthetic
aaataactccttcattactataaatcttagtccttagtatgtgggtatttctatatcttgcggagtctactacta

SEQ ID NO: 57568 - DNA, 75 bp, Artificial Sequence
  Synthetic
aaccatcttgacattgatgaacctacagggcaaactgcagactggctaagcattgtgatctacctgacatcattc

SEQ ID NO: 57569 - DNA, 75 bp, Artificial Sequence
  Synthetic
gtggtcccaatactgttgaaggctctttacatgcttaccaccagagggagacaaactactaaagacaataaggga

SEQ ID NO: 57570 - DNA, 75 bp, Artificial Sequence
  Synthetic
ggaaagcattgcacaatcaattcagggaaaaatcgatgaattaaggagacagctggctgatcgtgtggcagcagg

SEQ ID NO: 57571 - DNA, 75 bp, Artificial Sequence
  Synthetic
acaaactactaaagacaataagggaatgaggattcgatttaaggatgacagctcttttgaagatgtgaatgggat

SEQ ID NO: 57572 - DNA, 75 bp, Artificial Sequence
  Synthetic
agctggctgatcgtgtggcagcagggaaaaacatcggcaaagaaagggacccaactgggctagaccctggagatc

SEQ ID NO: 57573 - DNA, 75 bp, Artificial Sequence
  Synthetic
ccaactgggctagaccctggagatcacctcaaagagaagtcaatgctcagttatggaaatgtcattgacctcaac

SEQ ID NO: 57574 - DNA, 75 bp, Artificial Sequence
  Synthetic
tcggttcaggactgcaatctgtggactatacccagcccaggttaaggcaaggaacttaatcagtcctgtgatgag

SEQ ID NO: 57575 - DNA, 75 bp, Artificial Sequence
  Synthetic
tgtgattgggtttgtagcccttgcaaagaactggacagaacgggttgaagaatggcttgacctcccgtgcaagct

SEQ ID NO: 57576 - DNA, 75 bp, Artificial Sequence
  Synthetic
aatggcttgacctcccgtgcaagctactatctgagccatctccaacgtctttgaccaaaggcccatccaccaatc

SEQ ID NO: 57577 - DNA, 75 bp, Artificial Sequence
  Synthetic
aggattcgatttaaggatgacagctcttttgaagatgtgaatgggattcgaaagccaaagcacctgttcttgtca

SEQ ID NO: 57578 - DNA, 75 bp, Artificial Sequence
  Synthetic
actatctgagccatctccaacgtctttgaccaaaggcccatccaccaatcgtgactacttgaatcaaagacaagg

SEQ ID NO: 57579 - DNA, 75 bp, Artificial Sequence
  Synthetic
gtgactacttgaatcaaagacaaggagcgcttgcaaaaatggaaacgaaggaagctcaggctgtgaggaaacatg

SEQ ID NO: 57580 - DNA, 75 bp, Artificial Sequence
  Synthetic
aaagccaaagcacctgttcttgtcaatgcccaatgcacaatctagtatgaaggcagatgagattacaccaggtcg

SEQ ID NO: 57581 - DNA, 75 bp, Artificial Sequence
  Synthetic
agcgcttgcaaaaatggaaacgaaggaagctcaggctgtgaggaaacatgccatagatgctggttgcaacctcat

SEQ ID NO: 57582 - DNA, 75 bp, Artificial Sequence
  Synthetic
tgaccatatagactcaccatcatcaatctgggtctttgcaggagcacccgatagatgccctcctacctgcctgtt

SEQ ID NO: 57583 - DNA, 75 bp, Artificial Sequence
  Synthetic
aatcttacctacggaggacacaatctatggggatacaactggaccagcgcatcattgtgctttttatggttgact

SEQ ID NO: 57584 - DNA, 75 bp, Artificial Sequence
  Synthetic
ggggaaaagaggcagttgatagttttcatcttggtgatgatatggatcctgagctccggggcctggcacaggcat

SEQ ID NO: 57585 - DNA, 75 bp, Artificial Sequence
  Synthetic
gatgccctcctacctgcctgtttattgcaggcatggcagagctaggtgcattctttgcttgcctccaggacatga

SEQ ID NO: 57586 - DNA, 75 bp, Artificial Sequence
  Synthetic
gagctccggggcctggcacaggcattgattgaccaaaaagtgaaggaaatatctaatcaggagccgcttaagctt

SEQ ID NO: 57587 - DNA, 75 bp, Artificial Sequence
  Synthetic
taagtgtattgtcgcattatcccatgctttatgtaatcccacatatgctgcattaactgcttggactggaattat

SEQ ID NO: 57588 - DNA, 75 bp, Artificial Sequence
  Synthetic
gctttatgtaatcccacatatgctgcattaactgcttggactggaattattatactactgattggtgaatgtatt

SEQ ID NO: 57589 - DNA, 75 bp, Artificial Sequence
  Synthetic
ggtggtttaggatgtcaccttaagtgacttttttctgtatatatggatgtagatttcatttgatctgtactaaca

SEQ ID NO: 57590 - DNA, 75 bp, Artificial Sequence
  Synthetic
ctccggggcctggcacaggcattgattgaccaaaaagtgaaggaaatatctaatcaggagccgcttaagctttaa

SEQ ID NO: 57591 - DNA, 75 bp, Artificial Sequence
  Synthetic
atggatgtagatttcatttgatctgtactaacatcttatttccttcttttcctttctttactaacaacaactacc

SEQ ID NO: 57592 - DNA, 75 bp, Artificial Sequence
  Synthetic
tggcaacattggaggaactccaaaaggaaatcaacagccatgaaggccaactggtgatcgccaggcggaaggtga

SEQ ID NO: 57593 - DNA, 75 bp, Artificial Sequence
  Synthetic
gtgtattgtcgcattatccatgcttatgtaatcccacatatgctgcattaactgcttggactggaattattgtac

SEQ ID NO: 57594 - DNA, 75 bp, Artificial Sequence
  Synthetic
ggaaatcaacagccatgaaggccaactggtgatcgccaggcggaaggtgaaggatgcagaaaagcaatatgagaa

SEQ ID NO: 57595 - DNA, 75 bp, Artificial Sequence
  Synthetic
ggaccctgatgacctgaataaaagggcattaagcgatcgggaaagtgttgcacagtcaatccaagggaaaattga

SEQ ID NO: 57596 - DNA, 75 bp, Artificial Sequence
  Synthetic
tgagttgcggagacagctggctgaccgtgtggctgcaggaaaaaatattggaaaagaaagggatccaactggact

SEQ ID NO: 57597 - DNA, 75 bp, Artificial Sequence
  Synthetic
agaccctggtgatcatctcaaagagaagtcgatgctcagttacggaaatgtaattgatcttaatcacttggacat

SEQ ID NO: 57598 - DNA, 75 bp, Artificial Sequence
  Synthetic
acgagggccaattggtgatagccaggcagaaggtgaaagatgcagaaaagcagtatgaaaaggaccccgacgacc

SEQ ID NO: 57599 - DNA, 75 bp, Artificial Sequence
  Synthetic
tgatgaaccaacagggcaaactgctgactggttgagcattgtggtctatcttacatcatttgtggttccaatact

SEQ ID NO: 57600 - DNA, 75 bp, Artificial Sequence
  Synthetic
tctgaaggctctttacatgctaacaaccagagggagacaaactactaaagacaataaagggatgaggattcgatt

SEQ ID NO: 57601 - DNA, 75 bp, Artificial Sequence
  Synthetic
taaggatgacagttcttttgaggatgtgaacgggattcgaaagccaaagcacctgtttctgtcaatgcccaatgc

SEQ ID NO: 57602 - DNA, 75 bp, Artificial Sequence
  Synthetic
acaatccagtatgaaagcagatgagatcacaccaggtcgattcaggactgcagtttgtggactatatccagctca

SEQ ID NO: 57603 - DNA, 75 bp, Artificial Sequence
  Synthetic
caccttgacattgatgaacctacagggcaaaccgcagactggctgagcattgtggtctacctgacatcatttgtg

SEQ ID NO: 57604 - DNA, 75 bp, Artificial Sequence
  Synthetic
cagtttgtggactatatccagctcaggttaaagcaaggaatttggtcagtcctgtaatgagtgtgattgggtttg

SEQ ID NO: 57605 - DNA, 75 bp, Artificial Sequence
  Synthetic
tatccctcgctaaaaactggacagagcgggttgaggaatggcttgatctcccatgcaagctactatctgagccat

SEQ ID NO: 57606 - DNA, 75 bp, Artificial Sequence
  Synthetic
aggcagatgagattacaccaggtcggttcaggactgcaatttgtggactatatccagcccaggttaaggcaagga

SEQ ID NO: 57607 - DNA, 75 bp, Artificial Sequence
  Synthetic
ctcccacgtctttgactaaaggcccatccactaatcgtgactacttgaatcaaagacagggggcgcttgcaaaaa

SEQ ID NO: 57608 - DNA, 75 bp, Artificial Sequence
  Synthetic
tgtaaccttgttgatcacattgattcaccatcatcaatttgggtctttgcaggagcacctgatagatgcccccct

SEQ ID NO: 57609 - DNA, 75 bp, Artificial Sequence
  Synthetic
acctgcttatttgttgcaggcatggcagagctaggtgcattttttgctgtccttcaagatatgaggaacaccatc

SEQ ID NO: 57610 - DNA, 75 bp, Artificial Sequence
  Synthetic
atggcatcgaagactattgggacatcagaggagaagttgcggaagaaatcctctttctaccagtcatatcttaga

SEQ ID NO: 57611 - DNA, 75 bp, Artificial Sequence
  Synthetic
ggaacaccatcatggcatcaaaaaccatcggaacatctgaggagaagctaaagaagaagtcatctttctaccaat

SEQ ID NO: 57612 - DNA, 75 bp, Artificial Sequence
  Synthetic
agaacacaatctatgggaatacaactggatcagcgtattattgtgcttttcatggtggactggggtaaggaagca

SEQ ID NO: 57613 - DNA, 75 bp, Artificial Sequence
  Synthetic
cttacttacggaggacacaatctatggggatacaactggaccagcgcatcatcgtgctctttatggttgactggg

SEQ ID NO: 57614 - DNA, 75 bp, Artificial Sequence
  Synthetic
tggatcagcgtattattgtgcttttcatggtggactggggtaaggaagcagttgacagtttccatcttggtgatg

SEQ ID NO: 57615 - DNA, 75 bp, Artificial Sequence
  Synthetic
gttgacagtttccatcttggtgatgatatggacccagagcttcgaggcctggcacaggcactgattgagcaaaaa

SEQ ID NO: 57616 - DNA, 75 bp, Artificial Sequence
  Synthetic
atatggacccagagcttcgaggcctggcacaggcactgattgagcaaaaagtgaaggagatatctaaccaggagc

SEQ ID NO: 57617 - DNA, 75 bp, Artificial Sequence
  Synthetic
cgcttaagctttaaatgtatgtattgcttgtacccctgctttaagtaatcccacatatgctgcattaattgcttg

SEQ ID NO: 57618 - DNA, 75 bp, Artificial Sequence
  Synthetic
ttgtattgttgcattatcccgtgcttcatgtaatcccacatatgctgcattaactgcttggactggaattattat

SEQ ID NO: 57619 - DNA, 75 bp, Artificial Sequence
  Synthetic
ccacatatgctgcattaattgcttgaactggaattattatactactggttggtgaatatatttgcactagggaat

SEQ ID NO: 57620 - DNA, 75 bp, Artificial Sequence
  Synthetic
gggttgggtgggccatttatccgttatgtaatctcagggtggtttaggacgtcaccttaagtgactattttttgt

SEQ ID NO: 57621 - DNA, 75 bp, Artificial Sequence
  Synthetic
gatcgattttgggacatccttgaggaatgtttatgacatgaaaatagaatgcccacattcaatcaacttcgggga

SEQ ID NO: 57622 - DNA, 75 bp, Artificial Sequence
  Synthetic
gagcagtgtgacaggtaaggtggagctgccaccccttctgctcacagatgcagaggccttggttccagagagttc

SEQ ID NO: 57623 - DNA, 75 bp, Artificial Sequence
  Synthetic
ttgtaacatggataaccatcagtccatgtcaattatacaaaaagtaacaaaagtgagctggagaaaaaaagcaga

SEQ ID NO: 57624 - DNA, 75 bp, Artificial Sequence
  Synthetic
caaagcccaagctgccaaggactcatttgaaacaacatcaagtgaggtcaatctaaaagggacatgtacattgag

SEQ ID NO: 57625 - DNA, 75 bp, Artificial Sequence
  Synthetic
tagaaagccaaagcacctgttcttgtcaatgcccaatgcgcagtctagcatgaaggcagatgagattacaccagg

SEQ ID NO: 57626 - DNA, 75 bp, Artificial Sequence
  Synthetic
ccacaggatggttgaagaatcctacaggaataggagatcagtgatatgctatgacttgtcttgtaattcaacaca

SEQ ID NO: 57627 - DNA, 75 bp, Artificial Sequence
  Synthetic
ggaacttaatcagtcctgtgatgagtgtgattgggtttttagcccttgcaaagaactggacagaacgggttgaag

SEQ ID NO: 57628 - DNA, 75 bp, Artificial Sequence
  Synthetic
ttgcaagccaacaatgcatatgattgtacctgtgcactcatgcaatatgatgaaaagctgcttggttggactcgg

SEQ ID NO: 57629 - DNA, 75 bp, Artificial Sequence
  Synthetic
gccttatcgaattcaagttgtctacgagagaacctactgtacaactggtatactaacagaaggaaaatgttttgt

SEQ ID NO: 57630 - DNA, 75 bp, Artificial Sequence
  Synthetic
gccagaccaaagtatcgttaatgtcatcaaaaacggggtatttgatattgcaagtgtgagcattgtctgtttttt

SEQ ID NO: 57631 - DNA, 75 bp, Artificial Sequence
  Synthetic
atagatgccctcctacctgcctgtttattgcaggcatggcagagctaggtgcgttctttgctgtcctccaggaca

SEQ ID NO: 57632 - DNA, 75 bp, Artificial Sequence
  Synthetic
cattagagtcaaagggacaaactacaaaataatggcaagtattaaaacggcaactgcaaataactgtaatgacac

SEQ ID NO: 57633 - DNA, 75 bp, Artificial Sequence
  Synthetic
caactgcaaataactgtaatgacactgacaataaggttcaagggtattatctttgtattgttggtgggaattctt

SEQ ID NO: 57634 - DNA, 75 bp, Artificial Sequence
  Synthetic
atcattgtgctttttatggttgactggggaaaagaggcagttgatagttttcatctcggtgacgatatggatcct

SEQ ID NO: 57635 - DNA, 75 bp, Artificial Sequence
  Synthetic
ggacagattgaaggcaaaattccacacactgcaaatgcagcaaacatgctgtttactgcattctcaggtattcct

SEQ ID NO: 57636 - DNA, 75 bp, Artificial Sequence
  Synthetic
agttactcttcattaagtgtctatattggaagtcaggatgggcctgtcgtttatagcccaggattatttcctaag

SEQ ID NO: 57637 - DNA, 75 bp, Artificial Sequence
  Synthetic
ttttttctgtatatatggatgtagatttcatttgatctgtactaacatcttcttccttctttccttctatacaaa

SEQ ID NO: 57638 - DNA, 75 bp, Artificial Sequence
  Synthetic
ttgaaccaatcttcatgtgataaggttgcattaccattgatatgggaagggtatatagatctgcctggctattat

SEQ ID NO: 57639 - DNA, 75 bp, Artificial Sequence
  Synthetic
gaaacagttcacccatgtaatgttttttgtgtgctgtctggcccaggggcatcatgtgaggcattttcagaaggt

SEQ ID NO: 57640 - DNA, 75 bp, Artificial Sequence
  Synthetic
ggtattttcaatattacatcccctacttgccttgtgtcaaagcaaaataggttcagagctgctgagcagcaagta

SEQ ID NO: 57641 - DNA, 75 bp, Artificial Sequence
  Synthetic
aattttgtgtgccagcgagttgaccaagacattgttatctactgtaatggacaaaaaaagacaattttgactaag

SEQ ID NO: 57642 - DNA, 75 bp, Artificial Sequence
  Synthetic
acaaaaaaagacaattttgactaagacattagtgattgggcagtgtatttattcagtgacaagtctattttcaat

SEQ ID NO: 57643 - DNA, 75 bp, Artificial Sequence
  Synthetic
cttcggggtctggcacaggcattgattgaccagaaagtgaaggagatatccaatcaagagccgctcaaactttaa

SEQ ID NO: 57644 - DNA, 75 bp, Artificial Sequence
  Synthetic
ttgaccagaaagtgaaggagatatccaatcaagagccgctcaaactttaaatccatatatcccatgctttgtgca

SEQ ID NO: 57645 - DNA, 75 bp, Artificial Sequence
  Synthetic
caatcaagagccgctcaaactttaaatccatatatcccatgctttgtgcaatcccatatatgctgcattaagtgc

SEQ ID NO: 57646 - DNA, 75 bp, Artificial Sequence
  Synthetic
tcttaccacattctgctttggatggatattgatcccttccattacattagctgtattggtggtcttaaagttttt

SEQ ID NO: 57647 - DNA, 75 bp, Artificial Sequence
  Synthetic
ctgtattggtggtcttaaagttttttgcagcaatcttacataatagctctcaagaaaaccgttttaagattatcc

SEQ ID NO: 57648 - DNA, 75 bp, Artificial Sequence
  Synthetic
aacaacaacactacctcaacaaccactacctcattaatttgcttcctgaatgtctttttagggagcctactacta

SEQ ID NO: 57649 - DNA, 75 bp, Artificial Sequence
  Synthetic
cagggaaagagcttaaagcccacaatttgtcctgccctcagtcacagtgtccttattgttttacacattgtgagc

SEQ ID NO: 57650 - DNA, 75 bp, Artificial Sequence
  Synthetic
ctacagaatctgcctttcaggcacattataaagtgtgccaggcaacacacagatttagggatgatttgaagaaga

SEQ ID NO: 57651 - DNA, 75 bp, Artificial Sequence
  Synthetic
caataacacctcagtctacaagccctgggtgttatcggacattaaatctctttagatataaaagtaggtgttaca

SEQ ID NO: 57652 - DNA, 75 bp, Artificial Sequence
  Synthetic
tctttacagtatgggtaaccctgctaatcattgaatcaatcatgtgggcagctagtgcatcagaaaatgtcttag

SEQ ID NO: 57653 - DNA, 75 bp, Artificial Sequence
  Synthetic
aaccaagctggaatgacaatgcacatggtgttggtgttgtcccaatgcatactgacctggaactagatttttccc

SEQ ID NO: 57654 - DNA, 75 bp, Artificial Sequence
  Synthetic
atcattgtgctttttatggttgactggggaaaagaggcagttgatagctttcatctcggtgatgatatggatcct

SEQ ID NO: 57655 - DNA, 75 bp, Artificial Sequence
  Synthetic
tagtagtagactccgcaagaaatagcagttaaataacagcatgatcatgtggggtttactattgacactgagcct

SEQ ID NO: 57656 - DNA, 75 bp, Artificial Sequence
  Synthetic
ttccatcaagctctaagtatacatataaaagaaaattgacaagtccattaaatcaagaacaatcagttgatcttc

SEQ ID NO: 57657 - DNA, 75 bp, Artificial Sequence
  Synthetic
gatcagtcttggggcatccctgaggaatgtgtatgacctcagaatagagtgtccacactcaatcaactttggaga

SEQ ID NO: 57658 - DNA, 75 bp, Artificial Sequence
  Synthetic
acatagagatagaaagtcaggggatttccacaagtgttcatgcattaggacattggtttgatgggaggcttaact

SEQ ID NO: 57659 - DNA, 75 bp, Artificial Sequence
  Synthetic
gagcagtgtaacaggtaaggtggaattaccccccatcccacttactgatgcagagacgttagtccctgaaagctc

SEQ ID NO: 57660 - DNA, 75 bp, Artificial Sequence
  Synthetic
taaagacatcttttcattgttatggtgcatgtactaagtatgaatacccctggcatacagcgaaatgtcactttg

SEQ ID NO: 57661 - DNA, 75 bp, Artificial Sequence
  Synthetic
ttaccccccatcccacttactgatgcagagacgttagtccctgaaagctcctgcaacatggacaaccaccagtca

SEQ ID NO: 57662 - DNA, 75 bp, Artificial Sequence
  Synthetic
aaagagacttcgagtatgagaacagttggggctgtaatcctgctgattgccctgggattggtactggttgtactg

SEQ ID NO: 57663 - DNA, 75 bp, Artificial Sequence
  Synthetic
cagagacgttagtccctgaaagctcctgcaacatggacaaccaccagtcattatcaattacacaaaaagtgacaa

SEQ ID NO: 57664 - DNA, 75 bp, Artificial Sequence
  Synthetic
aggtgagttggagaaaaaaagcagacaaagttcaggcagccaaggattcatttgaaaccacatcaagtgaaatca

SEQ ID NO: 57665 - DNA, 75 bp, Artificial Sequence
  Synthetic
ttggggctgtaatcctgctgattgccctgggattggtactggttgtactgcatgcggactatatattgaccagct

SEQ ID NO: 57666 - DNA, 75 bp, Artificial Sequence
  Synthetic
atcttaaagggacatgcacactggcacataggatggttgaagaatcttacaggagcagaaagtcagtcatatgct

SEQ ID NO: 57667 - DNA, 75 bp, Artificial Sequence
  Synthetic
aaacctatgcaagacaattgacatgaatgattgctttgtcacaagacatgtcaaagtatgcatcataggcacagt

SEQ ID NO: 57668 - DNA, 75 bp, Artificial Sequence
  Synthetic
atgacttatcctgtaattcaacacactgtaaaccaacaatgtatatgattgttcctgtccattcatgcaatatga

SEQ ID NO: 57669 - DNA, 75 bp, Artificial Sequence
  Synthetic
ttcaaaattttcacaaggtgatactctagtattcctgggtcctatggaaggtgggggcttgatatttaaggattg

SEQ ID NO: 57670 - DNA, 75 bp, Artificial Sequence
  Synthetic
tgaaaagctgccttgtgggtttaggaccttaccggattcaggttgtttatgaaagaacatactgcacaactggta

SEQ ID NO: 57671 - DNA, 75 bp, Artificial Sequence
  Synthetic
accttaccggattcaggttgtttatgaaagaacatactgcacaactggtatattgatagagggcaagtgctttgt

SEQ ID NO: 57672 - DNA, 75 bp, Artificial Sequence
  Synthetic
gtgcactagtacatgtcaattcggtgatccaggagatattatgagtcccaaagataaaggtttcagctgccctga

SEQ ID NO: 57673 - DNA, 75 bp, Artificial Sequence
  Synthetic
gaaagaacatactgcacaactggtatattgatagagggcaagtgctttgtaccagaccagagcattattagtgtg

SEQ ID NO: 57674 - DNA, 75 bp, Artificial Sequence
  Synthetic
ataaaaaatggggtttttgacattgcaagtgtcagtattgtctgcttcttcattcgcataaagggaaacagctat

SEQ ID NO: 57675 - DNA, 75 bp, Artificial Sequence
  Synthetic
ttttacaggccatttccggaaaaaatgcaacttcgcaacaacacctgtgtgcgagtatgatggcaacatggtctc

SEQ ID NO: 57676 - DNA, 75 bp, Artificial Sequence
  Synthetic
aagataatgacaaatataaaaacagcaaatccaaacaactgtaatgatactgacaataaagtacagggttattat

SEQ ID NO: 57677 - DNA, 75 bp, Artificial Sequence
  Synthetic
aagataatgacaaatataataacagcaaatccaaacaactgtaatgatactgacaataaagtacagggttattat

SEQ ID NO: 57678 - DNA, 75 bp, Artificial Sequence
  Synthetic
aagataatgacaaatataacaacagcaaatccaaacaactgtaatgatactgacaataaagtacagggttattat

SEQ ID NO: 57679 - DNA, 75 bp, Artificial Sequence
  Synthetic
aagataatgacaaatataagaacagcaaatccaaacaactgtaatgatactgacaataaagtacagggttattat

SEQ ID NO: 57680 - DNA, 75 bp, Artificial Sequence
  Synthetic
cgggtataagaaagtaatggcaaccattgattcctttcaatcatttaacactagttcaattcattatacagatga

SEQ ID NO: 57681 - DNA, 75 bp, Artificial Sequence
  Synthetic
ctctgcattgtaggagccaactcttcccctgtttatgcaccctcaaccactgattttaggtcaatggaggtactt

SEQ ID NO: 57682 - DNA, 75 bp, Artificial Sequence
  Synthetic
aaggattgaatggaaagaccctgatggaatgctcaaggaccaccttaatatacttgtcacaaaggatattgactt

SEQ ID NO: 57683 - DNA, 75 bp, Artificial Sequence
  Synthetic
tgattttaggtcaatggaggtacttgccagcctgctgagatctcctcatggtgaagaccatgatttgtctggtga

SEQ ID NO: 57684 - DNA, 75 bp, Artificial Sequence
  Synthetic
cgaaaaccttggggagaacccgtgcaaggtaggactccaaacatcatcaatagaaggtgcatggggttctggggt

SEQ ID NO: 57685 - DNA, 75 bp, Artificial Sequence
  Synthetic
ggaagttgcaacttattcaattgctggtcaggttgagggcaaagttccgcacactgaaaatgcagcaaatatgct

SEQ ID NO: 57686 - DNA, 75 bp, Artificial Sequence
  Synthetic
tggtttcaccctcacttgccaaatctcactgactgaatgttcacgctttctaacatcaattaaagcatgtgacat

SEQ ID NO: 57687 - DNA, 75 bp, Artificial Sequence
  Synthetic
atttactgcattctcaggaatccctagctactcttcactgagtgtatttgctggaaatcaagacggaactgtaat

SEQ ID NO: 57688 - DNA, 75 bp, Artificial Sequence
  Synthetic
ggcaatttgttatggtgcacaaagtgttacactcatcagaggccaaaatacagtaaaggtttccgggaaaggtgg

SEQ ID NO: 57689 - DNA, 75 bp, Artificial Sequence
  Synthetic
ctatagccctggtttgttccctaaattaaaccaatcctcatgtgaaaaagttgcattgcctttgatatgggaagg

SEQ ID NO: 57690 - DNA, 75 bp, Artificial Sequence
  Synthetic
gcatagtggctcttcattcaagtgttgccatggaacagattgctctcaacaagggctgcaagcaagtgcaccaca

SEQ ID NO: 57691 - DNA, 75 bp, Artificial Sequence
  Synthetic
atatatagacttgcctggctactatgaaacaattcacccttgtaatgtcttctgtgttttgtctggcccaggggc

SEQ ID NO: 57692 - DNA, 75 bp, Artificial Sequence
  Synthetic
cctggataaagtcaatgggattgttgaacaagagagtgaaaaagtgtatgatgatggtgcaccacagtgtggcat

SEQ ID NO: 57693 - DNA, 75 bp, Artificial Sequence
  Synthetic
atcctgtgaggcattttcagaaggtggtatcttcaatataacatccccgacatgtttggtttcaaaacagaatcg

SEQ ID NO: 57694 - DNA, 75 bp, Artificial Sequence
  Synthetic
gttcagggctgcagagcaacagattaactttgtgtgccagcgagttgatcaagacattgtgatttactgcaacgg

SEQ ID NO: 57695 - DNA, 75 bp, Artificial Sequence
  Synthetic
tatttttttcttcatactatccctaattttgcttagtcttttgtgtcccattcgtaagcataagcgttcataaat

SEQ ID NO: 57696 - DNA, 75 bp, Artificial Sequence
  Synthetic
aactttgtgtgccagcgagttgatcaagacattgtgatttactgcaacggacagaagaagaccatcctgacaaag

SEQ ID NO: 57697 - DNA, 75 bp, Artificial Sequence
  Synthetic
acactagtgattggacaatgcatctactcagtaacaagcctgttttcaattatgcccggtgtagcacattctatt

SEQ ID NO: 57698 - DNA, 75 bp, Artificial Sequence
  Synthetic
acataccagagaaacccattagtatattcctgtatatagcctttaacaatgcaattttatacaccagtttaaact

SEQ ID NO: 57699 - DNA, 75 bp, Artificial Sequence
  Synthetic
gcaattgaattatgtgtacctggttttcatggatgggctactgctgctctcctgaccacattttgcttcggttgg

SEQ ID NO: 57700 - DNA, 75 bp, Artificial Sequence
  Synthetic
tctatacttattaactttttacatttattaacctagttatctaaaaaaaataactccttcattactataaatctc

SEQ ID NO: 57701 - DNA, 75 bp, Artificial Sequence
  Synthetic
cctgaccacattttgcttcggttggatactaatcccttctatcacactagctatactgattgtcttaaagttttt

SEQ ID NO: 57702 - DNA, 75 bp, Artificial Sequence
  Synthetic
aataactccttcattactataaatctcagtcctttagtacgtgggtatttctatatcttgcggagcatactacta

SEQ ID NO: 57703 - DNA, 75 bp, Artificial Sequence
  Synthetic
atactaatcccttctatcacactagctatactgattgtcttaaagttttttgctgcaatcttgcacaacagttct

SEQ ID NO: 57704 - DNA, 75 bp, Artificial Sequence
  Synthetic
cagtatgagaaagaccctgatgatctgaacaaaagggcattgagtgaccgggaaagcattgcacaatcaatccag

SEQ ID NO: 57705 - DNA, 75 bp, Artificial Sequence
  Synthetic
caagaaaatcggtttaaagtcattttgagaaagataaaggaggagtttgaaaaaactaaaggctcaatggtatgt

SEQ ID NO: 57706 - DNA, 75 bp, Artificial Sequence
  Synthetic
ggaaaaatcgatgaactaaggagacagctggctgatcgtgtagcagcagggaaaaacatcggcaaagagagggac

SEQ ID NO: 57707 - DNA, 75 bp, Artificial Sequence
  Synthetic
gaagtgtgtaaatatgaatgtgaaacaggaaaggaactcaaagcacacaatttgtcctgcccacaatcacagtgt

SEQ ID NO: 57708 - DNA, 75 bp, Artificial Sequence
  Synthetic
caggaaaggaactcaaagcacacaatttgtcctgcccacaatcacagtgtccatactgctttacacactgtgaac

SEQ ID NO: 57709 - DNA, 75 bp, Artificial Sequence
  Synthetic
tcacggaatctgcatttcaggcacactatagagtctgccaggctacacatagatttagggatgacttgaagaaaa

SEQ ID NO: 57710 - DNA, 75 bp, Artificial Sequence
  Synthetic
catcttgatattgatgagcctacagggcaaaccgcagactggctgagcattgtggtatacttgacatcattcgtg

SEQ ID NO: 57711 - DNA, 75 bp, Artificial Sequence
  Synthetic
caataacacctcagtcaacaagtccaggttgctatcgcacactaaatctttttagatataagagcaggtgttata

SEQ ID NO: 57712 - DNA, 75 bp, Artificial Sequence
  Synthetic
gttccaatactgttgaaggctctttacatgcttaccaccagagggagacaaactactaaagacaataagggaatg

SEQ ID NO: 57713 - DNA, 75 bp, Artificial Sequence
  Synthetic
tttttactgtctgggtggttcttcttatcattgaatcaattctttgggctgccagtgcatcagagattgtcttgg

SEQ ID NO: 57714 - DNA, 75 bp, Artificial Sequence
  Synthetic
gttcaggactgcaatttgtggactatacccagcccaggtcaaagcaaggaacttaatcagtcctgtgatgagtgt

SEQ ID NO: 57715 - DNA, 75 bp, Artificial Sequence
  Synthetic
aaccaagttggaatgataatgcacatggtgttggtgttgtcccaatgcacaccgatttggaattggatttttctc

SEQ ID NO: 57716 - DNA, 75 bp, Artificial Sequence
  Synthetic
acttaatcagtcctgtgatgagtgtgattgggtttttagcccttgcaaaaaattggacagagcgggttgaggaat

SEQ ID NO: 57717 - DNA, 75 bp, Artificial Sequence
  Synthetic
ttccatcaagctccaaatacacatacaagagaaaattgacaagtcccattaaccaagaacaatcagtagaccttc

SEQ ID NO: 57718 - DNA, 75 bp, Artificial Sequence
  Synthetic
caagagaaaattgacaagtcccattaaccaagaacaatcagtagaccttcatattgagatagaaagtcaaaggat

SEQ ID NO: 57719 - DNA, 75 bp, Artificial Sequence
  Synthetic
actacttgaatcaaagacaaggagcgcttgcgaaaatggaaacaaaggaagctcaggctgtaaggaaacatgcca

SEQ ID NO: 57720 - DNA, 75 bp, Artificial Sequence
  Synthetic
aaccaagaacaatcagtagaccttcatattgagatagaaagtcaaaggatttctacaagtgtacatgctttaggc

SEQ ID NO: 57721 - DNA, 75 bp, Artificial Sequence
  Synthetic
cattggtttgatggaagattgaacttaaaaacatcctttcattgctatggtgcatgcaccaaatatgaatatccc

SEQ ID NO: 57722 - DNA, 75 bp, Artificial Sequence
  Synthetic
tagatgctggctgtaaccttattgaccatatagactcaccatcatcaatttgggtcttcgcaggagcacccgaca

SEQ ID NO: 57723 - DNA, 75 bp, Artificial Sequence
  Synthetic
tggcacacagcaagatgtcattttgaaagggactttgagtatgaaaacagttggagttgtaaccctgcagactgt

SEQ ID NO: 57724 - DNA, 75 bp, Artificial Sequence
  Synthetic
gatgccctcctacctgccttttcattgcaggcatggcagagctaggtgcattctttgctgtcctccaggatatga

SEQ ID NO: 57725 - DNA, 75 bp, Artificial Sequence
  Synthetic
ccaggcataggtactggctgcactgcatgtggtctataccttgaccagctcaagcctgttgggagtgcttataaa

SEQ ID NO: 57726 - DNA, 75 bp, Artificial Sequence
  Synthetic
ggaacaccatcatggcatcaaaaaccattggaacatctgaggagaagctaaagaagaagtcatctttttatcaat

SEQ ID NO: 57727 - DNA, 75 bp, Artificial Sequence
  Synthetic
cattggaacatctgaggagaagctaaagaagaagtcatctttttatcaatctttactacggaggacacaatctat

SEQ ID NO: 57728 - DNA, 75 bp, Artificial Sequence
  Synthetic
ttgattacagttcgttacagtaggaaagtctgtgttcaatttggtgaagaaaacctttgtaaaatcattgatatg

SEQ ID NO: 57729 - DNA, 75 bp, Artificial Sequence
  Synthetic
aaacctttgtaaaatcattgatatgaatgattgctttgtatcaaggcatgtgaaagtatgcattataggcactgt

SEQ ID NO: 57730 - DNA, 75 bp, Artificial Sequence
  Synthetic
ttcaaagttctcacaaggtgacaccctggtgtttctcggtcccatggagggtggaggtttaatatttaaggattg

SEQ ID NO: 57731 - DNA, 75 bp, Artificial Sequence
  Synthetic
ttgaccaaaaagtgaaggaaatatctaatcaggagccgcttaagctttaagtgtatttgttgcattatcccatgc

SEQ ID NO: 57732 - DNA, 75 bp, Artificial Sequence
  Synthetic
gtgcacaacaacatgtcagtttggtgatcctggggatataatgagtcccaaggataaaggttttagctgtcctga

SEQ ID NO: 57733 - DNA, 75 bp, Artificial Sequence
  Synthetic
gatcctggggatataatgagtcccaaggataaaggttttagctgtcctgatttcacaggtcatttcaggaaaaaa

SEQ ID NO: 57734 - DNA, 75 bp, Artificial Sequence
  Synthetic
aggataaaggttttagctgtcctgatttcacaggtcatttcaggaaaaaatgtaactttgctactacccctgtgt

SEQ ID NO: 57735 - DNA, 75 bp, Artificial Sequence
  Synthetic
tactactgattggtgaatgtatttgcactaggggttgggttgggtgggccatttatccgttatataatctcaggg

SEQ ID NO: 57736 - DNA, 75 bp, Artificial Sequence
  Synthetic
gtgagtatgatggcaatatggtttctggatacaaaaaagtaatggcaactattgattcttttcaagcattcaaca

SEQ ID NO: 57737 - DNA, 75 bp, Artificial Sequence
  Synthetic
ccagctacatacattatactgatgaacggattgagtggaaagacccggatgggatgcttaaagaccatataaaca

SEQ ID NO: 57738 - DNA, 75 bp, Artificial Sequence
  Synthetic
ctccctaaaaagcactacactaaagatggcaacattagaggaactccaaaaagaaatcaacaaccacgagggcca

SEQ ID NO: 57739 - DNA, 75 bp, Artificial Sequence
  Synthetic
ctccctaaatagcactacactaaagatggcaacattagaggaactccaaaaagaaatcaacaaccacgagggcca

SEQ ID NO: 57740 - DNA, 75 bp, Artificial Sequence
  Synthetic
ctccctaaacagcactacactaaagatggcaacattagaggaactccaaaaagaaatcaacaaccacgagggcca

SEQ ID NO: 57741 - DNA, 75 bp, Artificial Sequence
  Synthetic
ctccctaaagagcactacactaaagatggcaacattagaggaactccaaaaagaaatcaacaaccacgagggcca

SEQ ID NO: 57742 - DNA, 75 bp, Artificial Sequence
  Synthetic
cctacctcaaaacaacaacactacctcaacaactactacctcattgatttgcttcctgaatgtctatttagggag

SEQ ID NO: 57743 - DNA, 75 bp, Artificial Sequence
  Synthetic
cctacctcaaaacaacaacactacctcaacaactactacctcattgatttgcttcctgaatgtctttttagggag

SEQ ID NO: 57744 - DNA, 75 bp, Artificial Sequence
  Synthetic
cctacctcaaaacaacaacactacctcaacaactactacctcattgatttgcttcctgaatgtctctttagggag

SEQ ID NO: 57745 - DNA, 75 bp, Artificial Sequence
  Synthetic
cctacctcaaaacaacaacactacctcaacaactactacctcattgatttgcttcctgaatgtctgtttagggag

SEQ ID NO: 57746 - DNA, 75 bp, Artificial Sequence
  Synthetic
tagtagtagactccgcaagaaatagcagttaaataacagcatgatcatgtggggtttactattgacaatgagttt

SEQ ID NO: 57747 - DNA, 75 bp, Artificial Sequence
  Synthetic
tacttgttacaaaggacattgattttgaaaatcttggagaaaacccatgtaaagttgggctacaaacagcatcta

SEQ ID NO: 57748 - DNA, 75 bp, Artificial Sequence
  Synthetic
tagagggtgcatggggttctggagttgggttcacccttacctgccagatctcattaactgaatgttcacgcttct

SEQ ID NO: 57749 - DNA, 75 bp, Artificial Sequence
  Synthetic
gatcaatcttggggcatccctgaggaatgtgtatgacatgaaaatagaatgtccacactccatcaattttggaga

SEQ ID NO: 57750 - DNA, 75 bp, Artificial Sequence
  Synthetic
tgggttcacccttacctgccagatctcattaactgaatgttcacgcttcttaacgtctattaaggcatgtgatat

SEQ ID NO: 57751 - DNA, 75 bp, Artificial Sequence
  Synthetic
aagcagtgttacaggtaaagtggaattaccccccattctgcttactgatgcagaggctctggttcctgaaagctc

SEQ ID NO: 57752 - DNA, 75 bp, Artificial Sequence
  Synthetic
ggccatttgctatggggcgcagagtgttacacttgttagaggacagaatacagtgaaggtatctgggaaaggtgg

SEQ ID NO: 57753 - DNA, 75 bp, Artificial Sequence
  Synthetic
ctgcaatatggacaaccaccagtccttgtcaatcacacaaaaagtgacaaaggtgagttggaggaagaaggcaga

SEQ ID NO: 57754 - DNA, 75 bp, Artificial Sequence
  Synthetic
acatagtggatcctccttcaagtgctgtcatggtactgactgctcccagcaagggcttcaagcaagtgctccgca

SEQ ID NO: 57755 - DNA, 75 bp, Artificial Sequence
  Synthetic
ccaggtccaagcagctaaggattcttttgaaactacatcaaatgagattaatctcaagggaacatgtacactgac

SEQ ID NO: 57756 - DNA, 75 bp, Artificial Sequence
  Synthetic
cctggacaaggtcaacggtattgttgagcaagaaagcacacaagtatatgatgatggtgcacctcaatgtggaat

SEQ ID NO: 57757 - DNA, 75 bp, Artificial Sequence
  Synthetic
acatagaatggttgaagaatcttaccgaaacagaaaatcagtcatatgctatgacctatcttgcaattcaacaca

SEQ ID NO: 57758 - DNA, 75 bp, Artificial Sequence
  Synthetic
atgatggtgcacctcaatgtggaatctcttgctggtttataaaatctggagagtggataaagggtatctttaatg

SEQ ID NO: 57759 - DNA, 75 bp, Artificial Sequence
  Synthetic
gaaactggattgttattgttgtgttaattttcttcttcatattgtctttgatattactcagttttctatgcccta

SEQ ID NO: 57760 - DNA, 75 bp, Artificial Sequence
  Synthetic
ttgtaagcctacaatgcatatgattgttcctgttcattcctgtaacatgatgaaaagctgtcttgtggggttagg

SEQ ID NO: 57761 - DNA, 75 bp, Artificial Sequence
  Synthetic
tccgtaaacacaagcgctcctaagtatatatcatgttgaactctatcccatatcctatatcatatatattacttt

SEQ ID NO: 57762 - DNA, 75 bp, Artificial Sequence
  Synthetic
accttaccgagttcaagtcgtttatgaaagaacatactgtacaactggtatactgacagaaggaaaatgctttgt

SEQ ID NO: 57763 - DNA, 75 bp, Artificial Sequence
  Synthetic
tatcctatatcatatatattacttttgtacactccatattactaatttgcttactatgtttacacctagttatta

SEQ ID NO: 57764 - DNA, 75 bp, Artificial Sequence
  Synthetic
gccagatcagagtatcatcagtgtgataaaaaatggagtgtttgatatagcaagtgtcagtattgtttgcttctt

SEQ ID NO: 57765 - DNA, 75 bp, Artificial Sequence
  Synthetic
acctatatatctaaaaaaaatacctcctttactactataattcctagtcctttatcacgtgggtgtttctatatc

SEQ ID NO: 57766 - DNA, 75 bp, Artificial Sequence
  Synthetic
catccgagtaaagggaactagctataaaataatggcaagtataaagacatcaaatccaaacaactgcaatgatac

SEQ ID NO: 57767 - DNA, 75 bp, Artificial Sequence
  Synthetic
aatacctcctttactactataattcctagtcctttatcacgtgggtgtttctatatcttgcggagcctactacta

SEQ ID NO: 57768 - DNA, 75 bp, Artificial Sequence
  Synthetic
tgacaataaagttcaaggctactatctctgtattgtaggtgctaactcttctcccgtctatgcaccctcaactac

SEQ ID NO: 57769 - DNA, 75 bp, Artificial Sequence
  Synthetic
tagtagtagactccggaagagacaaactactataaagatggaaaaatacagagaaattcatagggatctacaatc

SEQ ID NO: 57770 - DNA, 75 bp, Artificial Sequence
  Synthetic
tgatttcagatcaacagaagcacttgctagcctactgagatctccccatggtgaagatcatgatctgtctggaga

SEQ ID NO: 57771 - DNA, 75 bp, Artificial Sequence
  Synthetic
ctttccagttgggtcactgacagcagtagagtgtatagactacctggatcgtctctatgcaataaggcatgacat

SEQ ID NO: 57772 - DNA, 75 bp, Artificial Sequence
  Synthetic
agaggttgcaacttattcaattgctgggcagattgagggcaaaatcccacatactgcaaatgcagcaaatatggc

SEQ ID NO: 57773 - DNA, 75 bp, Artificial Sequence
  Synthetic
tgttgatcagatgataaagcatgactggtcagataacaaggattcagaggaatctataggaaaggttttgctgtt

SEQ ID NO: 57774 - DNA, 75 bp, Artificial Sequence
  Synthetic
attcactgcattctcaggaatccctagctattcttcattgagtgtatttgcaggaaatcaggatggaaccataat

SEQ ID NO: 57775 - DNA, 75 bp, Artificial Sequence
  Synthetic
tgctggggtgcctaataatgttataactgcaatggaaaaaaagatcattcctgaccacccaagtggtaaaacact

SEQ ID NO: 57776 - DNA, 75 bp, Artificial Sequence
  Synthetic
ttttagccctggcctatttcctaaactaaatcaatcttcatgtgacaaagttgctttacccttaatatgggaagg

SEQ ID NO: 57777 - DNA, 75 bp, Artificial Sequence
  Synthetic
tcgttccttcttcaagatgacacctgataattataagattacagggtcaacgattgagtttgtagaagtaacagt

SEQ ID NO: 57778 - DNA, 75 bp, Artificial Sequence
  Synthetic
atatatagacctacctggttactatgaaacaattcatccttgcaacgtcttttgtgtcttgtctggcccaggagc

SEQ ID NO: 57779 - DNA, 75 bp, Artificial Sequence
  Synthetic
tactgttgatgttgacaaaggaatcagagagaaaaggctcaagtatgaggcagggctaaagtacattgaacaaga

SEQ ID NO: 57780 - DNA, 75 bp, Artificial Sequence
  Synthetic
atcatgtgaggcattttcagaaggtggtatattcaacataacatccccaacctgtttagtttctaaacagaacag

SEQ ID NO: 57781 - DNA, 75 bp, Artificial Sequence
  Synthetic
actgcataatcattttcttagaggagatattccacaaccttataagataacatttcaggttgtctccgttagaac

SEQ ID NO: 57782 - DNA, 75 bp, Artificial Sequence
  Synthetic
attcagggctgcagagcagcaaattaattttgtgtgtcaaagagttgatcaagatattgtgatatattgcaatgg

SEQ ID NO: 57783 - DNA, 75 bp, Artificial Sequence
  Synthetic
agatggttctaatatctctacacaatggcctagccggaggaatgatggtgttgttcaatacatgaggcttgtaca

SEQ ID NO: 57784 - DNA, 75 bp, Artificial Sequence
  Synthetic
gcagaagaaaaccatcttaacaaagacactggttatcggccagtgcatttattcagtaacgagtttattttcaat

SEQ ID NO: 57785 - DNA, 75 bp, Artificial Sequence
  Synthetic
agctgaaattagttatgttcgagagcacttgatacggcaggaggaaagggctgctctagaagcaatgttcaatct

SEQ ID NO: 57786 - DNA, 75 bp, Artificial Sequence
  Synthetic
aatgcccagtgtagcacactctatcgcaattgaactgtgtgtacccgggttccatggttgggccactgctgctct

SEQ ID NO: 57787 - DNA, 75 bp, Artificial Sequence
  Synthetic
aaaattcaatataagcaacataaaaaatcaaccatattatattcctgattacagaggaatcccattaatacatcc

SEQ ID NO: 57788 - DNA, 75 bp, Artificial Sequence
  Synthetic
cttaaccacattttgctttggttggatattgatcccttcaattacactggccgtgttaattgtcttaaaattctt

SEQ ID NO: 57789 - DNA, 75 bp, Artificial Sequence
  Synthetic
aaatattaatgacttagttgtatacatgagggattggttatcaaaaagccataaattttcatttcatgagggaaa

SEQ ID NO: 57790 - DNA, 75 bp, Artificial Sequence
  Synthetic
tgctgcaattctgcacaatagttcccaagaaaatcggttcaaaataattctgagaaaaataaaggaggagtttga

SEQ ID NO: 57791 - DNA, 75 bp, Artificial Sequence
  Synthetic
ggtccctgctgtgtttgactgttttaatgagaatgaacttgagcatgctgttaaatatcctatttcaaggcatcc

SEQ ID NO: 57792 - DNA, 75 bp, Artificial Sequence
  Synthetic
gaaaaccaaagggtcaatggtctgtgaagtctgtaaatatgaatgtgagacagggaaggaactcaaagcacataa

SEQ ID NO: 57793 - DNA, 75 bp, Artificial Sequence
  Synthetic
aaggaactttttattgatccagtgctcactactgtcatcctacaacccagctacaatcctttctgatcaggtcga

SEQ ID NO: 57794 - DNA, 75 bp, Artificial Sequence
  Synthetic
tttatcttgtccacagtcacagtgtccttactgctttacacattgtgaacttactgaatcagcatttcaggcaca

SEQ ID NO: 57795 - DNA, 75 bp, Artificial Sequence
  Synthetic
cagcagacgggcatgtaactctgtgttgaacttgatccctgaaacaccaacctccttcttaatacatgatatggc

SEQ ID NO: 57796 - DNA, 75 bp, Artificial Sequence
  Synthetic
ctatagagtctgtcaggctacacatagattcagggatgacttaaagaaaacaataacacctcagtcaacaagccc

SEQ ID NO: 57797 - DNA, 75 bp, Artificial Sequence
  Synthetic
atataggtatatcaatttgacaagagaagatatggtttcattttatgcacccaaaacccaattcatacccacaca

SEQ ID NO: 57798 - DNA, 75 bp, Artificial Sequence
  Synthetic
tggttgttatcgcacattaaatctttttagatacaagagcaggtgttatatcttcacagtgtgggttgtcctcct

SEQ ID NO: 57799 - DNA, 75 bp, Artificial Sequence
  Synthetic
gaatgtaaaagaacctggaacttttaagctgactgctaactcgatgaggcctgagtcaaaggcaatgttagacat

SEQ ID NO: 57800 - DNA, 75 bp, Artificial Sequence
  Synthetic
catcattgagtcaatcttatgggctgctagtgcatcagaacttgtactggagccaaattggaatgacaatgcaca

SEQ ID NO: 57801 - DNA, 75 bp, Artificial Sequence
  Synthetic
gttgggtagccatgagcctggtgaaaagaaaggtgccctaattgagagtttaaacctaagcagccatatagtaca

SEQ ID NO: 57802 - DNA, 75 bp, Artificial Sequence
  Synthetic
tggtgtcggtatagtcccaatgcacactgatttggagttggatttctctctcccttccagttccaagtacacgta

SEQ ID NO: 57803 - DNA, 75 bp, Artificial Sequence
  Synthetic
gtctgaatgcgtcagcctgattactaaaatactttctgaccttgagctcaacataagtgaacccacaagtcatgg

SEQ ID NO: 57804 - DNA, 75 bp, Artificial Sequence
  Synthetic
caaaagaaaattaacaagccctataaaccaagaacaatcaatagaccttcatattgagatagaaagtcaagggat

SEQ ID NO: 57805 - DNA, 75 bp, Artificial Sequence
  Synthetic
ctcctttacaactaaacatacatatgtagataatgttcttgagaagttttttcaaaatgaaattcaaagatattt

SEQ ID NO: 57806 - DNA, 75 bp, Artificial Sequence
  Synthetic
ttctacaagtgtgcatgctttaggccactggtttgatgggaggttgaacttaaaaacatccttccattgttatgg

SEQ ID NO: 57807 - DNA, 75 bp, Artificial Sequence
  Synthetic
attagatgttctaaaaaagacaactgcatggcatattgggcatctcattcgggatataacagaaagcttaattgc

SEQ ID NO: 57808 - DNA, 75 bp, Artificial Sequence
  Synthetic
tgcatgtactaaatatgaatacccttggcacacagcaaaatgtcattttgaaagggattttgagtatgaaaataa

SEQ ID NO: 57809 - DNA, 75 bp, Artificial Sequence
  Synthetic
tcattcaggtctcaaaagatcaaagtactggtcagtacatgcatacaacaatgggaatgtcattttattcatact

SEQ ID NO: 57810 - DNA, 75 bp, Artificial Sequence
  Synthetic
ttggagttgtaaccctccagactgtccaggcattggtactggctgcaccgcatgtggtttatatctggaccagct

SEQ ID NO: 57811 - DNA, 75 bp, Artificial Sequence
  Synthetic
cccatctaaatcattggaggtagcagggtcttacataaggtttgtgacagtttttcgaatgggtccagggctagt

SEQ ID NO: 57812 - DNA, 75 bp, Artificial Sequence
  Synthetic
taaacctgttggaagtgcctataaactgataacagttcgctatagtcgaaaagtgtgtgttcaatttggtgaaga

SEQ ID NO: 57813 - DNA, 75 bp, Artificial Sequence
  Synthetic
cgataaagacaatctggatacaattctgactgatcaggatgttacctggggggtttcaaaggttatgagtattga

SEQ ID NO: 57814 - DNA, 75 bp, Artificial Sequence
  Synthetic
aaacctttgtaaaactattgacatgaatgattgctttgtaaccaggcatgtgaaggtatgcatcataggtactgt

SEQ ID NO: 57815 - DNA, 75 bp, Artificial Sequence
  Synthetic
tttgaacaggttactagcgctcaatattgcatttgaaaaggcattaattgctacagccacatggtttcaatacta

SEQ ID NO: 57816 - DNA, 75 bp, Artificial Sequence
  Synthetic
ttcaaagttctcacaaggtgacaccctagtgttccttggtcccatggaagggggaggtctaatattcaaagattg

SEQ ID NO: 57817 - DNA, 75 bp, Artificial Sequence
  Synthetic
tacagaggatcaaggccagttccccctacaacatgcaataaggtcagtttttgcttaccatttgttgttagctgt

SEQ ID NO: 57818 - DNA, 75 bp, Artificial Sequence
  Synthetic
gtgcacaacaacatgtcagtttggggatccaggagatatcatgagtcccaaggataagggtttcagctgtcctga

SEQ ID NO: 57819 - DNA, 75 bp, Artificial Sequence
  Synthetic
gtgccagaagatgaagttgtgtgccatttttgacaacttacgatatttaatacctgctgttacatcactttactc

SEQ ID NO: 57820 - DNA, 75 bp, Artificial Sequence
  Synthetic
ttttacaggccattttagaaaaaaatgtaattttgcaactacacctgtgtgtgaatatgatggcaatatggtttc

SEQ ID NO: 57821 - DNA, 75 bp, Artificial Sequence
  Synthetic
tggattcccctctcttataaataagttattcgagcgcccctttaagagtgctctggaagtatatgtttattataa

SEQ ID NO: 57822 - DNA, 75 bp, Artificial Sequence
  Synthetic
tggttacaaaaaggtaatggcaaccattgattcttttcaagcatttaatactagctatatacactatactgatga

SEQ ID NO: 57823 - DNA, 75 bp, Artificial Sequence
  Synthetic
tattaagagtctacttgtggcccttgcacaaaataacaaggctagattttattcaaaagtaaaacttttaggtct

SEQ ID NO: 57824 - DNA, 75 bp, Artificial Sequence
  Synthetic
gcagattgagtggaaagatcctgatgggatgcttaaagatcatttaaacatacttgttacaaaagacattgactt

SEQ ID NO: 57825 - DNA, 75 bp, Artificial Sequence
  Synthetic
aacagtagatcaatcaactgttggagcaagtggaatctacccgtcattcatgtcccgtgtcatttacaagcacta

SEQ ID NO: 57826 - DNA, 75 bp, Artificial Sequence
  Synthetic
tgaaaacctcggagaaaacccatgtagagttgggctgcaaacagcatctatagagggtgcatggggctctggagt

SEQ ID NO: 57827 - DNA, 75 bp, Artificial Sequence
  Synthetic
ccgtagcttaatatcagaagtaacaacttgtttctttctgtttgaaaagggtttacatggtaacatgaatgagga

SEQ ID NO: 57828 - DNA, 75 bp, Artificial Sequence
  Synthetic
tggatttactcttacttgccagatttcactgactgaatgctcacgctttttgacatccatcaaggcatgtgatat

SEQ ID NO: 57829 - DNA, 75 bp, Artificial Sequence
  Synthetic
agcaaagattcaccttgaaactgtggagtgggccctaaaatttaggcaaaaagaagaccaatatggagaatccat

SEQ ID NO: 57830 - DNA, 75 bp, Artificial Sequence
  Synthetic
ggccatctgttatggcgcacagagtgttacacttgttagagggcagaatacagtaaaggtttctgggaagggggg

SEQ ID NO: 57831 - DNA, 75 bp, Artificial Sequence
  Synthetic
ggttgaaaatggttacacaataggtgaactcaatgataatcaagatttagttgaacaacaactatattgtcaaga

SEQ ID NO: 57832 - DNA, 75 bp, Artificial Sequence
  Synthetic
gcatagcggctcctcctttaagtgttgtcatggcaatgactgctctcaacaagggcttcaagcaagtgctccaca

SEQ ID NO: 57833 - DNA, 75 bp, Artificial Sequence
  Synthetic
tgctgtagaacttgctgctgtagaacttaataagattttatcaacaaaatctcaggttgttgccaatagcattct

SEQ ID NO: 57834 - DNA, 75 bp, Artificial Sequence
  Synthetic
tttggacaaggtcaatggcattgttgagcaagagagcacacaggtttatgatgatggtgcaccacaatgtggcat

SEQ ID NO: 57835 - DNA, 75 bp, Artificial Sequence
  Synthetic
taataaatattgggaggttccgtattttagtcagactaggaatataagtttaaaggggatgtcaggccaagttca

SEQ ID NO: 57836 - DNA, 75 bp, Artificial Sequence
  Synthetic
ttcatgttggttcataaagtctggggagtggataaaaggtatcttcagtggaaactggattgtcattgttgtgtt

SEQ ID NO: 57837 - DNA, 75 bp, Artificial Sequence
  Synthetic
agaagatggacatcttgctgcatctgttacaatcatagaggcaatacgttatctctcatcttcacagaacaatcc

SEQ ID NO: 57838 - DNA, 75 bp, Artificial Sequence
  Synthetic
aattgtccttttcatactgtccttaatattactgagtttcctgtgccctatccgcaagcataagcgctcataagt

SEQ ID NO: 57839 - DNA, 75 bp, Artificial Sequence
  Synthetic
aagtgttctacaactttatgaagagactagaaaagtgaaagctcaagcacgaattgttagaaaatatcagagaac

SEQ ID NO: 57840 - DNA, 75 bp, Artificial Sequence
  Synthetic
atgtattaaattgaacttcatgccatattccttattatgtacactgctttttttataatccatattactgctgta

SEQ ID NO: 57841 - DNA, 75 bp, Artificial Sequence
  Synthetic
agaggctgatagaggtttttttattacaacactcccaacacgatgtaggttagaaataattgaagattattacga

SEQ ID NO: 57842 - DNA, 75 bp, Artificial Sequence
  Synthetic
ctaattatatattatatatagtcattaatatgtatatctaaaaaaaatacctcctttatcactataattcctagt

SEQ ID NO: 57843 - DNA, 75 bp, Artificial Sequence
  Synthetic
tgccatctcaaaaaatgtggctgaagagtacatctcctatggtggtgaaaggaaaattttatgtattcaatcagc

SEQ ID NO: 57844 - DNA, 75 bp, Artificial Sequence
  Synthetic
aatacctcctttatcactataattcctagtcctttatcacgtgggtatttctatatcttgcggagcatactacta

SEQ ID NO: 57845 - DNA, 75 bp, Artificial Sequence
  Synthetic
tatactgaagatggcaacactagaggaactccaaaaggagatcaatagccacgagggccaattggtgatagccag

SEQ ID NO: 57846 - DNA, 75 bp, Artificial Sequence
  Synthetic
tttagaaaaagcacttagatgggcttctggagagagctttattgaacttagcaacggaaagtttataaggatgaa

SEQ ID NO: 57847 - DNA, 75 bp, Artificial Sequence
  Synthetic
aagaaaattgatgtatgtgagtgctgatgcaacgaaatggtctcctggagataactcagctaaattcagaagatt

SEQ ID NO: 57848 - DNA, 75 bp, Artificial Sequence
  Synthetic
cacagcagctctacataatggactacctgatgaccgtttaaaaaattgtgtaattgatgcattaaggaatgttta

SEQ ID NO: 57849 - DNA, 75 bp, Artificial Sequence
  Synthetic
caaaactgacttctatatgtccaggaaattaagggcttatatagataacatgaatgggcatgagccagctgttaa

SEQ ID NO: 57850 - DNA, 75 bp, Artificial Sequence
  Synthetic
gaatttcctggaattcttccctgatggtcattgtggagaagtgcggggcaattggttgcagggaaatctaaataa

SEQ ID NO: 57851 - DNA, 75 bp, Artificial Sequence
  Synthetic
aactactaaagacaataagggaatgaggattcgatttaaggatgacagttcttttgaggatgtgaatggaattcg

SEQ ID NO: 57852 - DNA, 75 bp, Artificial Sequence
  Synthetic
gtgttcatctctttttggtgtaggaatgtcgttgctatttaagcaactttggaatgaattattccctgaattaga

SEQ ID NO: 57853 - DNA, 75 bp, Artificial Sequence
  Synthetic
cttttgaggatgtgaatggaattcgaaaaccaaaacatctgttcttgtcgatgcccaatgcccagtccagcatga

SEQ ID NO: 57854 - DNA, 75 bp, Artificial Sequence
  Synthetic
ctgcttctttgaatttgctcaccactcagatgatgcgctctttatatatggttaccttgaaccaattgatgatgg

SEQ ID NO: 57855 - DNA, 75 bp, Artificial Sequence
  Synthetic
aactgattggtttctatatgtgtctcaacagatccaagcaggtcatttacactggtttagtgtgaacacagaaat

SEQ ID NO: 57856 - DNA, 75 bp, Artificial Sequence
  Synthetic
attatctgagtcaaagacaaggagcacttgcgaagatggaaacaaaagaagcccaggttgttagaaaacatgcca

SEQ ID NO: 57857 - DNA, 75 bp, Artificial Sequence
  Synthetic
gtggaaaagtatgttcaatctgcatgaacacgtacttctcctaggttccataaagatatcccccaagaagacaac

SEQ ID NO: 57858 - DNA, 75 bp, Artificial Sequence
  Synthetic
actatcaccaactaatgcggaattcctctctacgttctttgaaagctgtgctgtgtcaataccctttatcaaaat

SEQ ID NO: 57859 - DNA, 75 bp, Artificial Sequence
  Synthetic
attgttaggttctctatcagatttgcctggtttaggttactttgatgaccttgctgctgctcaaagtagatgtgt

SEQ ID NO: 57860 - DNA, 75 bp, Artificial Sequence
  Synthetic
caaagcaatggaccttggtgcatcaccacaagttgcccaacttgctgttgcactatgcacaaataaggttgaaag

SEQ ID NO: 57861 - DNA, 75 bp, Artificial Sequence
  Synthetic
attatatgggacagctgttggtatgataaaacatccatcaacatatcttcaagtcaagcatggtgatacacctat

SEQ ID NO: 57862 - DNA, 75 bp, Artificial Sequence
  Synthetic
tcctctaggtggaagtggtgccatgtcaataatggagctagcaactgctggtattggtatgtctgataaaaatct

SEQ ID NO: 57863 - DNA, 75 bp, Artificial Sequence
  Synthetic
cttaaaaagggcacttttaggctacatacataaaaggcaaaaaaatatggcatatattcttggcctttttaaatt

SEQ ID NO: 57864 - DNA, 75 bp, Artificial Sequence
  Synthetic
cttaatgaacttatcaaaagatacattccagcatgaaagattgggtgagttttcattcatagggaaagtgcaatg

SEQ ID NO: 57865 - DNA, 75 bp, Artificial Sequence
  Synthetic
gaaaatatttataccgaaatcagagtttgagttttttgacatgtacacaccaaaattcttaaagctatggagtga

SEQ ID NO: 57866 - DNA, 75 bp, Artificial Sequence
  Synthetic
acaacatgttacttatgattacattattccaaagggtagagataatctattaatctatcttgttaggaaaataaa

SEQ ID NO: 57867 - DNA, 75 bp, Artificial Sequence
  Synthetic
tgatccaagcatagtcactgctatgacaatgcaatcaccactccagttaagattcagaatgcaagcaaagcaaca

SEQ ID NO: 57868 - DNA, 75 bp, Artificial Sequence
  Synthetic
catgaaagtttgcaaattggatgatgactgggttacatttagggagatcttagctgcagcaaatagttttgcaca

SEQ ID NO: 57869 - DNA, 75 bp, Artificial Sequence
  Synthetic
attgtatgaggtaactcaagaagatcttgatctttttcagacactaacaagttgtacattttcaaaggaatatgc

SEQ ID NO: 57870 - DNA, 75 bp, Artificial Sequence
  Synthetic
atggaaagatttcttgaatggggtgcagtgtgatgttattcctacgaagcagatccagagggcaaaagtggccag

SEQ ID NO: 57871 - DNA, 75 bp, Artificial Sequence
  Synthetic
aacattcactgtgagagaaaaagatcagatcattcaaaatagtatcccagctgtgattgggtataaatttgcagt

SEQ ID NO: 57872 - DNA, 75 bp, Artificial Sequence
  Synthetic
aacagttgatgaaatgtcagatgttttggattctgcaaagttccctgactctctagctgtagatctgaagacaat

SEQ ID NO: 57873 - DNA, 75 bp, Artificial Sequence
  Synthetic
gaaagatggggtttatagggaacttgggttggatatctcacaggctgaagtaatgaagaaggttgcacctatgct

SEQ ID NO: 57874 - DNA, 75 bp, Artificial Sequence
  Synthetic
atataagagctcaaagtcaagggttgttattgttcaaggaaatgtggagggcacagcagaggctatctgtggtta

SEQ ID NO: 57875 - DNA, 75 bp, Artificial Sequence
  Synthetic
ctggttacgtaccatgtcccttgtgaaaactattagggttaaaccgcataaagaagtattgaaagctgtatccat

SEQ ID NO: 57876 - DNA, 75 bp, Artificial Sequence
  Synthetic
ctttaacagaaaagaggatattgggcaacaaaaagaccttgctgcattgcgattgtgcatagaagtttggcgctg

SEQ ID NO: 57877 - DNA, 75 bp, Artificial Sequence
  Synthetic
gtgtaaagcaaataatgcaccctatcaagaatggtttcatgctctgtggtttgaagacaaaacattttctgagtg

SEQ ID NO: 57878 - DNA, 75 bp, Artificial Sequence
  Synthetic
gcttgatagattcatccgtgtcggtgtccctccagtggacccagagatccagtgtgctgcactaatgattgcaga

SEQ ID NO: 57879 - DNA, 75 bp, Artificial Sequence
  Synthetic
tatcagaggtgatctatctgtcctacaagtacaggcaaatagaagagcttattcaggtaaacaatatgatgccta

SEQ ID NO: 57880 - DNA, 75 bp, Artificial Sequence
  Synthetic
ttgtgttcagacatataacgaagaaacaaagctctatgaaggtgaccttcgagtcacattcaattttggactaga

SEQ ID NO: 57881 - DNA, 75 bp, Artificial Sequence
  Synthetic
ctgtgcccgccttgaaatattctgggacaaacaaacatacatccttgagacttcaataacacaaaaacatgtttt

SEQ ID NO: 57882 - DNA, 75 bp, Artificial Sequence
  Synthetic
gaagatcatgatggatgaagtaacaaaagagttgttaaggtgtggaatgaggtttaaaactgaacaagtgtctaa

SEQ ID NO: 57883 - DNA, 75 bp, Artificial Sequence
  Synthetic
tgtgaaacacctagttttgttcaagacagaggcaggttttgagtggggaaagcctaatattccttgcattgtata

SEQ ID NO: 57884 - DNA, 75 bp, Artificial Sequence
  Synthetic
taaaaactgtgcactacgtacaggtttaagagcaaaccaaactgttaaccacaaattcatgatatcaattaagga

SEQ ID NO: 57885 - DNA, 75 bp, Artificial Sequence
  Synthetic
taacggccttagagctattgcacaatatgatgatgaaagtcctcggtttttacttgcacatgcatttcatacaat

SEQ ID NO: 57886 - DNA, 75 bp, Artificial Sequence
  Synthetic
aagggatattagataccaggcagtagatgctgtaagtaatgtgtggtttatccataaggggataaaactattcct

SEQ ID NO: 57887 - DNA, 75 bp, Artificial Sequence
  Synthetic
taacccaattatttcatcaggtttattagaaaatttcatgaaaaatttaccagcagcaatacctcctgctgcata

SEQ ID NO: 57888 - DNA, 75 bp, Artificial Sequence
  Synthetic
ctcattaatcatgaatagagctaagatatctgttgatctattcatgttcaatgatttacttaggctcatcaaccc

SEQ ID NO: 57889 - DNA, 75 bp, Artificial Sequence
  Synthetic
atcaaatacgcttgacctatccggtttgcagccaactgaagatgggtttagcactgtaagcagtatgtcaagcag

SEQ ID NO: 57890 - DNA, 75 bp, Artificial Sequence
  Synthetic
attatggtctgaagaggttagttttgttgatgaagatgaagagattgatgatgagttcacaatagacttgcagga

SEQ ID NO: 57891 - DNA, 75 bp, Artificial Sequence
  Synthetic
tgtggattttgaaaacattgatgtggaagctgatattgaacatttcttacaagatgaaagttcatatacaggtga

SEQ ID NO: 57892 - DNA, 75 bp, Artificial Sequence
  Synthetic
cttactcattatgtcagaagaaactgaagtcaagaagatgagaggaattataaaactgctagagcctgttagact

SEQ ID NO: 57893 - DNA, 75 bp, Artificial Sequence
  Synthetic
tataaaaagctgggtttccaaaggtttatgtattgagaaggtatatagcccaaccaatattatattgatgactag

SEQ ID NO: 57894 - DNA, 75 bp, Artificial Sequence
  Synthetic
atatctttcaaaaaatttcaatttttctggtagacaagtttcccttttagacccatatgacttgactgagtttga

SEQ ID NO: 57895 - DNA, 75 bp, Artificial Sequence
  Synthetic
aagcattgttaaaggttggggagaatgtgttgttgatcagttcagtacatttgatcaggagacacagcttttggt

SEQ ID NO: 57896 - DNA, 75 bp, Artificial Sequence
  Synthetic
atctcagaaaggcatctgcccagaggatgtggtacctgattcccttttttcatttaggcatactatagttctctt

SEQ ID NO: 57897 - DNA, 75 bp, Artificial Sequence
  Synthetic
acgtagactttttcctcaggactctgtttcaactttctactaattgtttatatttattttcattttccggagcat

SEQ ID NO: 57898 - DNA, 75 bp, Artificial Sequence
  Synthetic
ctttttcctcaggactctgtttcaactttctactaattgtttatatttattttcattttccggagcatactacta

SEQ ID NO: 57899 - DNA, 75 bp, Artificial Sequence
  Synthetic
cagttaaataacagcatgatcatgtggggtttactattgacaatgattttgatcgattttggggcatccttaagg

SEQ ID NO: 57900 - DNA, 75 bp, Artificial Sequence
  Synthetic
aatgtctatgacatgaaaatagaatgcccacattcaatcaactttggggagagtagtgtaacaggtaaggtggag

SEQ ID NO: 57901 - DNA, 75 bp, Artificial Sequence
  Synthetic
ctgccaccccttctgcttacagatgcagaggccttggtcccggaaagttcttgtaacatggacaaccatcagtcc

SEQ ID NO: 57902 - DNA, 75 bp, Artificial Sequence
  Synthetic
atgtcaattatacaaaaagtgacaaaagtaagctggagaaaaaaggcagacaaagcccaagctgccaaggactca

SEQ ID NO: 57903 - DNA, 75 bp, Artificial Sequence
  Synthetic
tttgagacaacatcaagtgaggttaacttaaagggaacatgtgcattgagtcataggatggttgaagaatcttac

SEQ ID NO: 57904 - DNA, 75 bp, Artificial Sequence
  Synthetic
agaaataggagatcagtaatatgttatgacttgtcttgcaattcaacacattgcaagccaacgatgcatatgatt

SEQ ID NO: 57905 - DNA, 75 bp, Artificial Sequence
  Synthetic
gtacctgtgcactcatgcaacatgatgaaaagctgcctggttgggcttgggccttatagaatccaaatcgtctat

SEQ ID NO: 57906 - DNA, 75 bp, Artificial Sequence
  Synthetic
gagagaacctactgtacaactggtatactaacagaagggaagtgttttgtgccagaccagagtattgttaatgtt

SEQ ID NO: 57907 - DNA, 75 bp, Artificial Sequence
  Synthetic
atcaagaatggggtgttcgacatcgcaagtgtgagcattgtctgttttttcatcagagttaaagggaccaactac

SEQ ID NO: 57908 - DNA, 75 bp, Artificial Sequence
  Synthetic
aagataatggcaagtattaaaacagcaactgcaaataactgtaatgacactgacaacaaggttcaaggatattac

SEQ ID NO: 57909 - DNA, 75 bp, Artificial Sequence
  Synthetic
caactgcaaataactgtaatgacactgacaacaaggttcaaggatattacctttgtattgtcgggggaaattctt

SEQ ID NO: 57910 - DNA, 75 bp, Artificial Sequence
  Synthetic
ctcctgtgtatgcaccttcaaccactgattttagatctatggaggcacttgctagccttttaagagctcctcatg

SEQ ID NO: 57911 - DNA, 75 bp, Artificial Sequence
  Synthetic
gtgaagaccatgatttatctggagaagaggtggcaacttactcaattgccgggcaaattgaaggcaaaatcccac

SEQ ID NO: 57912 - DNA, 75 bp, Artificial Sequence
  Synthetic
atactgcaaatgcagcaaacatgctgtttactgcattctcaggaatccctagttactcttcattaagtgttttta

SEQ ID NO: 57913 - DNA, 75 bp, Artificial Sequence
  Synthetic
tcggaagtcaggacggacctgttatatatagcccaggattgtttcctaggttgaaccaatcttcatgtgataaga

SEQ ID NO: 57914 - DNA, 75 bp, Artificial Sequence
  Synthetic
ttgcactaccattaatatgggaaggatatatagatctgcctggctattatgaaacagttcacccatgtaatgtct

SEQ ID NO: 57915 - DNA, 75 bp, Artificial Sequence
  Synthetic
tttgtgtgttatctggcccaggggcatcatgtgaggcattctcagaaggtggtattttcaacattacatccccta

SEQ ID NO: 57916 - DNA, 75 bp, Artificial Sequence
  Synthetic
cttgccttgtgtcaaagcaaaataggttcagagctgctgagcagcaagtcaactttgtgtgccagcgagttgacc

SEQ ID NO: 57917 - DNA, 75 bp, Artificial Sequence
  Synthetic
aagatattgtcatctactgtaatggacaaaagaagacaattttaactaagacattagtgattgggcagtgtattt

SEQ ID NO: 57918 - DNA, 75 bp, Artificial Sequence
  Synthetic
acaaaagaagacaattttaactaagacattagtgattgggcagtgtatttactcagtgactagtttattttcaat

SEQ ID NO: 57919 - DNA, 75 bp, Artificial Sequence
  Synthetic
aatgcctggggtagcacattcaattgcaattgaattatgtgtaccagggttccatggttgggcaactgctgctct

SEQ ID NO: 57920 - DNA, 75 bp, Artificial Sequence
  Synthetic
tctcactacattctgctttggctggatactgatcctttccattacattagctgtgttggttgtcctgaagttttt

SEQ ID NO: 57921 - DNA, 75 bp, Artificial Sequence
  Synthetic
ctgtgttggttgtcctgaagttttttgccgcaatcttacataatagctctcaagaaaaccggtttaaaattatct

SEQ ID NO: 57922 - DNA, 75 bp, Artificial Sequence
  Synthetic
taagaaagattaaagaagaatttgaaaagactaaaggctcaatggtctgtgaagtgtgcaagtatgagtgtgaaa

SEQ ID NO: 57923 - DNA, 75 bp, Artificial Sequence
  Synthetic
gaagtgtgcaagtatgagtgtgaaacagggaaggagcttaaagcccataatttatcttgccctcagtcacagtgt

SEQ ID NO: 57924 - DNA, 75 bp, Artificial Sequence
  Synthetic
ccttattgctttacacactgtgagcctacagaatctgcctttcaagcacattataaagtgtgccaagcaacacac

SEQ ID NO: 57925 - DNA, 75 bp, Artificial Sequence
  Synthetic
agatttagggatgatttaaagaaaacaataacacctcaatcaacaagcccaggttgttaccggacattaaatctt

SEQ ID NO: 57926 - DNA, 75 bp, Artificial Sequence
  Synthetic
tttaggtataaaagtagatgttacatctttacagtgtgggtgaccttactaatcattgaatcaatcatgtgggca

SEQ ID NO: 57927 - DNA, 75 bp, Artificial Sequence
  Synthetic
gctagtgcatcagaaactgtcttggagccaagctggaatgacaatgcacatggtgttggcgttgtcccaatgcat

SEQ ID NO: 57928 - DNA, 75 bp, Artificial Sequence
  Synthetic
actgacctggaacttgatttctctcttccatcaagttctaagtacacatataagagaaaactgacaagtccattg

SEQ ID NO: 57929 - DNA, 75 bp, Artificial Sequence
  Synthetic
aatcaagaacaatcagtagatcttcacatagagatagagagtcaagggatctctacaagtgttcatgcattaggt

SEQ ID NO: 57930 - DNA, 75 bp, Artificial Sequence
  Synthetic
cattggtttgatggaaggcttaacctaaagacatcttttcattgttatggtgcatgtactaagtatgaataccct

SEQ ID NO: 57931 - DNA, 75 bp, Artificial Sequence
  Synthetic
tggcacacggcaaaatgccactttgaaagagatttcgaatatgagaacaattgggggtgtaatcctgctgattgc

SEQ ID NO: 57932 - DNA, 75 bp, Artificial Sequence
  Synthetic
ttgggggtgtaatcctgctgattgccctgggattggtactggctgtactgcatgcgggctatacattgaccagct

SEQ ID NO: 57933 - DNA, 75 bp, Artificial Sequence
  Synthetic
taaacctgtaggcagtgcatataagctgatcacagtccgttacagccgtaaagtatgtgttcagtttggtgaaga

SEQ ID NO: 57934 - DNA, 75 bp, Artificial Sequence
  Synthetic
aaatctatgcaagacaattgatatgaatgattgctttgttacaagacatgttaaagtatgtatcatcggtacagt

SEQ ID NO: 57935 - DNA, 75 bp, Artificial Sequence
  Synthetic
ttcaaagttctcgcaaggtgataccctagtattcctaggccctatggaaggtgggggtttgatatttaaggattg

SEQ ID NO: 57936 - DNA, 75 bp, Artificial Sequence
  Synthetic
gtgcactagcacatgccaatttggtgatccaggagacattatgagtcctaaagacaaaggtttcagctgccctga

SEQ ID NO: 57937 - DNA, 75 bp, Artificial Sequence
  Synthetic
cttcacaggccatttccggaaaaaatgcaactttgcaacaacacctgtgtgcgagtatgatggtaatatggtctc

SEQ ID NO: 57938 - DNA, 75 bp, Artificial Sequence
  Synthetic
tgggtataagaaagtaatggcaactattgattcctttcaatcatttaacactagttcaattcattatacagatga

SEQ ID NO: 57939 - DNA, 75 bp, Artificial Sequence
  Synthetic
aaggattgagtggaaagacccggatggaatgcttaaggaccaccttaatatacttgtcacaaaggatattgactt

SEQ ID NO: 57940 - DNA, 75 bp, Artificial Sequence
  Synthetic
tgaaaaccttggagagaacccgtgtaaagtaggacttcaaacatcatcaatagaaggtgcatggggttctggggt

SEQ ID NO: 57941 - DNA, 75 bp, Artificial Sequence
  Synthetic
tggtttcactctcacttgtcaaatctcactgacagagtgttcacgctttctaacatcaatcaaagcatgtgacat

SEQ ID NO: 57942 - DNA, 75 bp, Artificial Sequence
  Synthetic
ggcaatttgttatggtgcacaaagtgttacactcattagaggccaaaacacagtgaaggtttccgggaagggtgg

SEQ ID NO: 57943 - DNA, 75 bp, Artificial Sequence
  Synthetic
gcatagtggctcttcattcaagtgttgccatggaacagattgctctcaacaggggctacaagcaagtgcaccgca

SEQ ID NO: 57944 - DNA, 75 bp, Artificial Sequence
  Synthetic
cctggataaggtcaatgggattgttgaacaagagagtgagaaggtttatgatgatggtgcaccacaatgtggcat

SEQ ID NO: 57945 - DNA, 75 bp, Artificial Sequence
  Synthetic
ttcatgctggtttgttaagtctggggagtggataacaggaattttcaatgggaattggattgtcatagttgtgct

SEQ ID NO: 57946 - DNA, 75 bp, Artificial Sequence
  Synthetic
tgttttcttcttcatattgtccttaatcttacttagtcttctatgtcccattcgtaagcataaacgctcataagt

SEQ ID NO: 57947 - DNA, 75 bp, Artificial Sequence
  Synthetic
acatattagcttgtccttgtatatagctttcaacaatgcaattttatatatcagtttaaacttctgtacttatta

SEQ ID NO: 57948 - DNA, 75 bp, Artificial Sequence
  Synthetic
actttttacatttatcaacctagttatctaaaaaaaataactccttcattactataaaccttagtcctttagtac

SEQ ID NO: 57949 - DNA, 75 bp, Artificial Sequence
  Synthetic
aataactccttcattactataaaccttagtcctttagtacgtgggtatttctatatcttgcggagcatactacta

SEQ ID NO: 57950 - DNA, 75 bp, Artificial Sequence
  Synthetic
tagtagtaggctccctaaaaagcactacactaaagatggcaacattagaggaactccaaaaagaaatcaacaacc

SEQ ID NO: 57951 - DNA, 75 bp, Artificial Sequence
  Synthetic
tacactaaagatggcaacattagaggaactccaaaaagaaatcaacaaccacgagggccaattggtgatagccag

SEQ ID NO: 57952 - DNA, 75 bp, Artificial Sequence
  Synthetic
gaactccaaaaagaaatcaacaaccacgagggccaattggtgatagccaggcagaaggtgaaagatgcagaaaag

SEQ ID NO: 57953 - DNA, 75 bp, Artificial Sequence
  Synthetic
acgagggccaattggtgatagccaggcagaaggtgaaagatgcagaaaagcagtatgaaaaggatcctgacgacc

SEQ ID NO: 57954 - DNA, 75 bp, Artificial Sequence
  Synthetic
tgaataaaagggcattgagtgaccgggaaagcattgcacaatcaattcagggaaaaatagatgaattaaggagac

SEQ ID NO: 57955 - DNA, 75 bp, Artificial Sequence
  Synthetic
ggaaaaatagatgaattaaggagacagctggctgatcgtgtggcagcagggaaaaacattggcaaagagagggac

SEQ ID NO: 57956 - DNA, 75 bp, Artificial Sequence
  Synthetic
ttatggaaatgtcattgacctcaaccatcttgacattgatgaacctacagggcaaaccgcagactggctgagcat

SEQ ID NO: 57957 - DNA, 75 bp, Artificial Sequence
  Synthetic
catcttgacattgatgaacctacagggcaaaccgcagactggctgagcattgtggtctacctgacatcattcgtg

SEQ ID NO: 57958 - DNA, 75 bp, Artificial Sequence
  Synthetic
aactactaaagacaataagggaatgagaattcgatttaaggatgacagctcttttgaagatgtgaatgggattag

SEQ ID NO: 57959 - DNA, 75 bp, Artificial Sequence
  Synthetic
gttcaggactgcaatttgtggactatacccagcccaggtgaaggcaaggaacttaatcagtcctgtgatgagtgt

SEQ ID NO: 57960 - DNA, 75 bp, Artificial Sequence
  Synthetic
acttaatcagtcctgtgatgagtgtgattgggtttttagcccttgcaaagaactggacagagcgggttgaggaat

SEQ ID NO: 57961 - DNA, 75 bp, Artificial Sequence
  Synthetic
actacttgaatcaaagacaaggagcgcttgcaaaaatggaaacaaaagaagctcaggctgtgaggaaacatgcca

SEQ ID NO: 57962 - DNA, 75 bp, Artificial Sequence
  Synthetic
gcttgcaaaaatggaaacaaaagaagctcaggctgtgaggaaacatgccatagatgctggctgcaaccttatcga

SEQ ID NO: 57963 - DNA, 75 bp, Artificial Sequence
  Synthetic
ccatatagactcaccatcatcaatctgggtctttgcaggagcacccgacagatgccctcctacctgcctgttcat

SEQ ID NO: 57964 - DNA, 75 bp, Artificial Sequence
  Synthetic
gatgccctcctacctgcctgttcattgcaggcatggcagagctaggtgcattctttgctgttctccaggatatga

SEQ ID NO: 57965 - DNA, 75 bp, Artificial Sequence
  Synthetic
ggaacaccatcatggcgtcaaaaactatcggaacatctgaggagaagctaaagaagaaatcatctttttaccaat

SEQ ID NO: 57966 - DNA, 75 bp, Artificial Sequence
  Synthetic
tatcggaacatctgaggagaagctaaagaagaaatcatctttttaccaatcttacctacggaggacacaatctat

SEQ ID NO: 57967 - DNA, 75 bp, Artificial Sequence
  Synthetic
ggggatacaactggaccagcgcatcatcgtgctcttcatggttgactggggaaaagaggcagttgatagttttca

SEQ ID NO: 57968 - DNA, 75 bp, Artificial Sequence
  Synthetic
gaaaagaggcagttgatagttttcatcttggtgatgatatggatcctgagctccggggcctggcacaggcattaa

SEQ ID NO: 57969 - DNA, 75 bp, Artificial Sequence
  Synthetic
ttgatcaaaaagtgaaggaaatatctaatcaggaaccgcttaagctttaattgtatttgttgcattatcccatgc

SEQ ID NO: 57970 - DNA, 75 bp, Artificial Sequence
  Synthetic
tttatgtaatcccacgtatgctgcattaactgcttggactggaattattatactactgattggtgaatgtatttg

SEQ ID NO: 57971 - DNA, 75 bp, Artificial Sequence
  Synthetic
tagtagtatgctccctaaagagcactatactgaagatggcaacactagaagaactccaaaaggagatcaatagcc

SEQ ID NO: 57972 - DNA, 75 bp, Artificial Sequence
  Synthetic
agctggctgaccgtgtggctgcaggaaaaaacattggtaaagaaagggatccaactggactagaccctggtgatc

SEQ ID NO: 57973 - DNA, 75 bp, Artificial Sequence
  Synthetic
tggtttaggatgtcaccttaagtgactttttctgtatatatggatgtagatttcaactgatctgtactaacatct

SEQ ID NO: 57974 - DNA, 75 bp, Artificial Sequence
  Synthetic
tgtagtagactccggaaaagacaagttactagaaagatggagaagtacagagaaattcatagggatttgcaatcc

SEQ ID NO: 57975 - DNA, 75 bp, Artificial Sequence
  Synthetic
tttcaagttgagtcacttactgcagttgaatgtatagattatttagacagactgtatgcaataaggcatgacatt

SEQ ID NO: 57976 - DNA, 75 bp, Artificial Sequence
  Synthetic
gttgaccagatgataaagcatgactggtcagataacaaggattcagaagaatctataggaaaggtcttattattt

SEQ ID NO: 57977 - DNA, 75 bp, Artificial Sequence
  Synthetic
gccggagtgcccaataatgtcataacagcaatggagaaaaagataatcccagaccacccaagtggtaaaacactt

SEQ ID NO: 57978 - DNA, 75 bp, Artificial Sequence
  Synthetic
cgatcattctttaagatgacacctgataactacaagatcacaggctctacaattgaattcgttgaagtgacagtc

SEQ ID NO: 57979 - DNA, 75 bp, Artificial Sequence
  Synthetic
acagttgatgttgacaaagggattagagagaaagggcttaagtatgaggcagggttaaaatatattgaacaagag

SEQ ID NO: 57980 - DNA, 75 bp, Artificial Sequence
  Synthetic
ctctatactcatttcttaaaaggggatattctacagccttacaagataacatttcaggttgtctcagtaagaaca

SEQ ID NO: 57981 - DNA, 75 bp, Artificial Sequence
  Synthetic
gatggttctaatatttccacacagtggcctagcagaagaaatgatggtgttgtacagtatatgaggttagttcag

SEQ ID NO: 57982 - DNA, 75 bp, Artificial Sequence
  Synthetic
gctgaaattagttatgttagggaacatttgataagacaggaagaaagggcagcactggaggcaatgtttaattta

SEQ ID NO: 57983 - DNA, 75 bp, Artificial Sequence
  Synthetic
aaatttaacataagtaatataaaaaatcagccgtactacattcctgattatcggggaatccctttaattcaccct

SEQ ID NO: 57984 - DNA, 75 bp, Artificial Sequence
  Synthetic
aacatcaatgatctagtgatttatatgaaagattggttgtcaaaaaaacatgagttttcgtttcatgaagtaaag

SEQ ID NO: 57985 - DNA, 75 bp, Artificial Sequence
  Synthetic
ggacctgctgtttttgattgcttcaatgaaaatgaagttaaccatgctttaaaatatcctatctcaagacatcca

SEQ ID NO: 57986 - DNA, 75 bp, Artificial Sequence
  Synthetic
aggaatttcttgcttatacaatgttcactgttgtcttcttatagcccagctacaatcctttctgatcaagtagat

SEQ ID NO: 57987 - DNA, 75 bp, Artificial Sequence
  Synthetic
agtaggagggcatgtagttcagttctgaacctgatccctgaaacaccgacgtcatttctaattcatgacatggca

SEQ ID NO: 57988 - DNA, 75 bp, Artificial Sequence
  Synthetic
tatagatacatcaacttaacaagagaagatatggtctcattttatgccccaaaaacacagttcatccctacacaa

SEQ ID NO: 57989 - DNA, 75 bp, Artificial Sequence
  Synthetic
aatgtgaaggaacctggaacctttaaattaactgcaaattccatgaggcctgaatcgaaggcaatgttagacata

SEQ ID NO: 57990 - DNA, 75 bp, Artificial Sequence
  Synthetic
ataagcagccatgaacctggtgagaagaaaggtgttttgattgaaagtttgaacttaagtagccatatagtgcaa

SEQ ID NO: 57991 - DNA, 75 bp, Artificial Sequence
  Synthetic
tcagaatgtgtgagccttatcacgaagatactttctgatcttgaattaaatataagcgaaccaacaagtcacagt

SEQ ID NO: 57992 - DNA, 75 bp, Artificial Sequence
  Synthetic
tctttcaccacaaaacacacatatgtagacaatgttctcgagaagttttttcagaatgagatccaaagatactta

SEQ ID NO: 57993 - DNA, 75 bp, Artificial Sequence
  Synthetic
ttagatgttctaaagaagacaactgcttggcatattgggcaccttatcagggatatgactgaaagtttaattgct

SEQ ID NO: 57994 - DNA, 75 bp, Artificial Sequence
  Synthetic
cactctggcttaaagaggtcaaagtactggtcaatacatgcctataataatggaaatgttattatattcatactc

SEQ ID NO: 57995 - DNA, 75 bp, Artificial Sequence
  Synthetic
ccatctaagtcactagaggttgctggttcttatataaggtttataacagttttccggatgggacctgttttagta

SEQ ID NO: 57996 - DNA, 75 bp, Artificial Sequence
  Synthetic
gacaaagataatttggatactgttttaacagatcaggatgttacttggggggtgtcaaaggtcatgagtattgac

SEQ ID NO: 57997 - DNA, 75 bp, Artificial Sequence
  Synthetic
ttaaatcggttattggcactaaacattgcatttgaaaaatcacttattgctacagctacatggtttcaatactat

SEQ ID NO: 57998 - DNA, 75 bp, Artificial Sequence
  Synthetic
acagaagaccaaggccaattccccttacagcatgctataaggtcagtatttgcatatcatctattactgtctgta

SEQ ID NO: 57999 - DNA, 75 bp, Artificial Sequence
  Synthetic
tgtcaaaaaatgaaattgtgtgcaatttttgataatcttagatatttgatccctgcagtcacatcactttattct

SEQ ID NO: 58000 - DNA, 75 bp, Artificial Sequence
  Synthetic
ggattcccatcactaattaataaactctttgaacgtccctttaagagtgccttagaagtatatatatattacaat

SEQ ID NO: 58001 - DNA, 75 bp, Artificial Sequence
  Synthetic
attaaaagcctacttgtggcccttgcacagaataacaaggctagattctattctaaagttaaactgttaggctta

SEQ ID NO: 58002 - DNA, 75 bp, Artificial Sequence
  Synthetic
acagtggaccagtctactgttggtgcaagtgggatttatccctccttcatgtctcgtgttatttataagcattat

SEQ ID NO: 58003 - DNA, 75 bp, Artificial Sequence
  Synthetic
cggagtctaatctctgaagtaacaacatgtttctttttatttgaaaagggtttacatggtaatatgaatgaagaa

SEQ ID NO: 58004 - DNA, 75 bp, Artificial Sequence
  Synthetic
gcaaagatccacttggagactgtagaatgggctcttaagtttaaacagaaggaggaccaatatggagaatctatg

SEQ ID NO: 58005 - DNA, 75 bp, Artificial Sequence
  Synthetic
gttgagaatggttatacaataggtgaactcaatgataatcaagaccttgttgaacaacagttatattgccaagat

SEQ ID NO: 58006 - DNA, 75 bp, Artificial Sequence
  Synthetic
gcagtagaacttgccgctatggaattaaataaaatactatcaacaaagtcccaagttatagctaacagcatactt

SEQ ID NO: 58007 - DNA, 75 bp, Artificial Sequence
  Synthetic
aacaagtactgggaagtcccttactttagtcaaactaggaacataagtttaaaagggatgtcaggtcaggttcaa

SEQ ID NO: 58008 - DNA, 75 bp, Artificial Sequence
  Synthetic
gaagatggacatcttgcagcatctgttactataatagaagccatacgttacctttcatcttctcaaatcaatcca

SEQ ID NO: 58009 - DNA, 75 bp, Artificial Sequence
  Synthetic
agtgtgttacaactttatgaagaaacaagaaaaataaaggctcaagcccgtattgttaggaagtatcaaagaact

SEQ ID NO: 58010 - DNA, 75 bp, Artificial Sequence
  Synthetic
gaggcagataggggcttttttattacaacacttccaacaagatgtagactagaaataattgaagactattttgat

SEQ ID NO: 58011 - DNA, 75 bp, Artificial Sequence
  Synthetic
gctatatcgaagaatgtagctgaagagtacatttcttatggtggtgaaagaaaaatattatgtattcagtctgca

SEQ ID NO: 58012 - DNA, 75 bp, Artificial Sequence
  Synthetic
ttagagaaggcactcaggtgggcatctggggaaagtttcattgaactaagtaatggaaaattcatacggatgaag

SEQ ID NO: 58013 - DNA, 75 bp, Artificial Sequence
  Synthetic
agaaagctgatgtatgtaagtgctgatgcaacaaaatggtctcctggggataactcggctaaattcagacggttt

SEQ ID NO: 58014 - DNA, 75 bp, Artificial Sequence
  Synthetic
acttcagctttacataatgggttaccagatgatcgtctaaaaaattgtgtgattgatgcattaaggaatgtttac

SEQ ID NO: 58015 - DNA, 75 bp, Artificial Sequence
  Synthetic
aaaactgatttctatatgtctagaaaattaaggacatatatcgacaacatgaatggacatgagccagctgttagg

SEQ ID NO: 58016 - DNA, 75 bp, Artificial Sequence
  Synthetic
cagttcttggaattctttccagatggtcactgtggggaagttcgaggtaattggttgcagggtaacttaaacaaa

SEQ ID NO: 58017 - DNA, 75 bp, Artificial Sequence
  Synthetic
tgctcatctttatttggtgtaggaatgtcacttcttttcaagcaattatggaatagcctattcccagaactggac

SEQ ID NO: 58018 - DNA, 75 bp, Artificial Sequence
  Synthetic
tgcttttttgaatttgctcaccattcagatgatgcattatttatatatgggtaccttgaacctatcgatgatgga

SEQ ID NO: 58019 - DNA, 75 bp, Artificial Sequence
  Synthetic
accgattggtttctgtatgtctcacagcagattcaagccgggcaactacattggtttagtgttaatacggaaatg

SEQ ID NO: 58020 - DNA, 75 bp, Artificial Sequence
  Synthetic
tggaaaagcatgtttaatcttcatgaacatgtcttacttcttggatctattaagatatctcctaagaaaacaaca

SEQ ID NO: 58021 - DNA, 75 bp, Artificial Sequence
  Synthetic
ttatctcctaccaatgcagaatttctatcaacattttttgaaggatgtgctgtgtcaatcccctttattaaaatc

SEQ ID NO: 58022 - DNA, 75 bp, Artificial Sequence
  Synthetic
ttgttaggttcattatctgatctaccaggtttaggttactttgacgatcttgcagctgctcagagtaggtgtgtg

SEQ ID NO: 58023 - DNA, 75 bp, Artificial Sequence
  Synthetic
aaagcaatggacctaggtgcatcaccacaagtggctcagcttgcagtggcactgtgtacaaataaagttgaaagg

SEQ ID NO: 58024 - DNA, 75 bp, Artificial Sequence
  Synthetic
ttatatggtacagctgttggtatggtgaatcatccatcaacatatctccaagttaaacatagtgacacacctatt

SEQ ID NO: 58025 - DNA, 75 bp, Artificial Sequence
  Synthetic
ccactaggcggaagtggagctatgtcaattatggagctagcaactgcaggtataggcatgtctgacaaaaacctt

SEQ ID NO: 58026 - DNA, 75 bp, Artificial Sequence
  Synthetic
ctaaaaagagcccttttaggttacatccacaagcggcagaagaatatggcctatatccttggcttgttcaaattt

SEQ ID NO: 58027 - DNA, 75 bp, Artificial Sequence
  Synthetic
ctgatgaacctatcgaaagacacatttcaacatgaaagactaggtgagttctcattcataggaaaagtgcagtgg

SEQ ID NO: 58028 - DNA, 75 bp, Artificial Sequence
  Synthetic
aaaatattcatacccaaatcagaatttgaattttttgatatgtatacacccaaatttcttaaactttggagtgaa

SEQ ID NO: 58029 - DNA, 75 bp, Artificial Sequence
  Synthetic
cagcatgttacttatgattacatcattcccaagggtagagacaacttacttatttaccttatccggaagataaat

SEQ ID NO: 58030 - DNA, 75 bp, Artificial Sequence
  Synthetic
gacccaagtatagtgactgccatgaccatgcagtcacctcttcagctaaggtttagaatgcaagcaaagcagcac

SEQ ID NO: 58031 - DNA, 75 bp, Artificial Sequence
  Synthetic
atgaaggtatgtaaacttgatgatgagtgggtaacgtttagagagatcttagctgcagcaaatagttttgcacaa

SEQ ID NO: 58032 - DNA, 75 bp, Artificial Sequence
  Synthetic
tcatatgaggtaacccaggaagatctggacctttttcagacattaactagctgcacattctctaaagagtatgct

SEQ ID NO: 58033 - DNA, 75 bp, Artificial Sequence
  Synthetic
tggaaggatttcttgaatggggtgcaatgtgatgtcattccaacaaagcaagtccagagagcaaaagtagcaaga

SEQ ID NO: 58034 - DNA, 75 bp, Artificial Sequence
  Synthetic
actttcactgtgagagagaaggatcgaattatccagaacagtatcccagctgtgattgggtacaagttcgcagtg

SEQ ID NO: 58035 - DNA, 75 bp, Artificial Sequence
  Synthetic
acagttgatgaaatgtcagatgttctagactctgcaaaatttcctgattctcttgctgtagatctaaagacaatg

SEQ ID NO: 58036 - DNA, 75 bp, Artificial Sequence
  Synthetic
aaagatggggtttacagggaacttgggttggatatttcacaagctgaggtgatgaaaaaagttgcaccaatgctt

SEQ ID NO: 58037 - DNA, 75 bp, Artificial Sequence
  Synthetic
tacaagagttctaaatcaagagttgtcattgtccaaggaaatgttgaaggaacagcagaggctatctgtgggtat

SEQ ID NO: 58038 - DNA, 75 bp, Artificial Sequence
  Synthetic
tggttacgtaccatgtctcttgtcaagacaataagggtcaaaccacataaggaggtactaaaggctgtgtcaatt

SEQ ID NO: 58039 - DNA, 75 bp, Artificial Sequence
  Synthetic
tttaatagaaaggaggatattggacaacaaaaagacctggctgcattaaggttatgtatagaagtttggcgttgg

SEQ ID NO: 58040 - DNA, 75 bp, Artificial Sequence
  Synthetic
tgcaaggcaaataatgctccctatcatgactggttccatgcattgtggtttgaagacaaaacattttccgagtgg

SEQ ID NO: 58041 - DNA, 75 bp, Artificial Sequence
  Synthetic
ttggaccgatttatccgtgttggtgttccgccagttgacccagagattcaatgtgctgcattgatgatagcagat

SEQ ID NO: 58042 - DNA, 75 bp, Artificial Sequence
  Synthetic
gtaagaggagacctatctgttttacaagtacaggcaaacagaagagcatactcagggaaacaatatgatgcatac

SEQ ID NO: 58043 - DNA, 75 bp, Artificial Sequence
  Synthetic
tgtgttcaaacatacaatgaagaaacaaaactttatgaaggtgacctccgggttacatttaattttgggttagac

SEQ ID NO: 58044 - DNA, 75 bp, Artificial Sequence
  Synthetic
tgtgcacggttagaaatattttgggacaaacaaacatatatacttgaaacctcaataacacagaaacatgtctta

SEQ ID NO: 58045 - DNA, 75 bp, Artificial Sequence
  Synthetic
aagattatgatggatgaggtcacgaaagagttactgaaatgtgggatgagatttaagacagagcaagtatctaat

SEQ ID NO: 58046 - DNA, 75 bp, Artificial Sequence
  Synthetic
gtgaaacacttagtcctattcaagacagaggcaggatttgaatggggaaaacccaatataccttgtattgtatat

SEQ ID NO: 58047 - DNA, 75 bp, Artificial Sequence
  Synthetic
aaaaattgtgcactacgtacaggcctgagaacaaatcagacaatcaatcacaagtttatgatatcaattaaagat

SEQ ID NO: 58048 - DNA, 75 bp, Artificial Sequence
  Synthetic
aatggcctcagagctattgcccaatgtgatgatgaaagcccaaggtttttactagcacatgcttttcatactatc

SEQ ID NO: 58049 - DNA, 75 bp, Artificial Sequence
  Synthetic
agagacattaggtatcaggcagtggatgctgtaagcaacgtgtggttcatccataaggggattaagcttttcctt

SEQ ID NO: 58050 - DNA, 75 bp, Artificial Sequence
  Synthetic
aatccaatcatttcatcaggtctgttagaaaactttatgaaaaacttaccagcagcaatacctcctgctgcttac

SEQ ID NO: 58051 - DNA, 75 bp, Artificial Sequence
  Synthetic
tcattaatcatgaatagagcaaaaatctctgttgacttgtttatgttcaatgatttgcttaggcttattaatcca

SEQ ID NO: 58052 - DNA, 75 bp, Artificial Sequence
  Synthetic
tctaatacattagacttatctgggttgcagccaactgaagacgggtttagtactgtaagtagtatgtcaagcagg

SEQ ID NO: 58053 - DNA, 75 bp, Artificial Sequence
  Synthetic
ctgtggtctgaagaggttagcttcgtcgatgaggatgaagagattgatgatgagtttacaatagacttagaggat

SEQ ID NO: 58054 - DNA, 75 bp, Artificial Sequence
  Synthetic
gttgactttgaaaacattgatgttgaggctgacattgagcatttcttacaggatgaaagctcttatacaggtgat

SEQ ID NO: 58055 - DNA, 75 bp, Artificial Sequence
  Synthetic
ttgcttattatgtcagaggagactgaggtgaagaaaatgagaggaattgtaaagctattagaacctgtccgacta

SEQ ID NO: 58056 - DNA, 75 bp, Artificial Sequence
  Synthetic
ataaagagttgggtatcgaagggcttgtgtatagaaaaggtgtatagtccaaccaatatcatattgatgactagg

SEQ ID NO: 58057 - DNA, 75 bp, Artificial Sequence
  Synthetic
tatctgtcaaaaaattttaatttttctggaaggcaagtttctcttttagacccttacgacctaactgagcttgaa

SEQ ID NO: 58058 - DNA, 75 bp, Artificial Sequence
  Synthetic
agcatcgttaagggctgggggaagtgtgttgttgatcagttcaccacatttgatcaagaagcacagcttttagtt

SEQ ID NO: 58059 - DNA, 75 bp, Artificial Sequence
  Synthetic
tcccagaagggaatttgcccagaagatgtggtacccgattccctgttttcatttagacatactatagtcctccta

SEQ ID NO: 58060 - DNA, 75 bp, Artificial Sequence
  Synthetic
cgcagacttttccctcaggattctatttcaaccttctactaattgtttatatttatttcattttccggagcatac

SEQ ID NO: 58061 - DNA, 75 bp, Artificial Sequence
  Synthetic
tttccctcaggattctatttcaaccttctactaattgtttatatttatttcattttccggagcatactactacta

SEQ ID NO: 58062 - DNA, 75 bp, Artificial Sequence
  Synthetic
tagtagtagacaccgcaagaaagagcagttaaataacagcataatcatgtggggtttactattgacaatgatttt

SEQ ID NO: 58063 - DNA, 75 bp, Artificial Sequence
  Synthetic
gatcgatttcggggcaacccttaggaatgtctatgacatgaggatagaatgcccacattctgtcaacttcgggga

SEQ ID NO: 58064 - DNA, 75 bp, Artificial Sequence
  Synthetic
aagcagtgtatcagggaaagtggagctaccaccagttctacttagtgaggtagagacgcttgtcccagaaagctc

SEQ ID NO: 58065 - DNA, 75 bp, Artificial Sequence
  Synthetic
ttgcaatatggataatcaccaatcaatgtcaatcatacaaaaagtcactcaactaacttggagaaagaaggctga

SEQ ID NO: 58066 - DNA, 75 bp, Artificial Sequence
  Synthetic
taaagcgcaggcagcaaaagactcattcgaaattacctcaggtgaagtcagcttgaaaggtacatgcaccttaac

SEQ ID NO: 58067 - DNA, 75 bp, Artificial Sequence
  Synthetic
acatagaatggttgaggactctcataggaatagaaagtcaataatatgttatgacctatcctgtaattcaaccca

SEQ ID NO: 58068 - DNA, 75 bp, Artificial Sequence
  Synthetic
ttgtaaaccaacaatgcacatgatagttcccattcactcatgtaatatgatgaagagctgcctggtaggccttgg

SEQ ID NO: 58069 - DNA, 75 bp, Artificial Sequence
  Synthetic
accttaccgcatccaggttgtttatgaaagaacatactgcacaactggtatcctaacggaaggaaaatgctttgt

SEQ ID NO: 58070 - DNA, 75 bp, Artificial Sequence
  Synthetic
ccctgatcagagcattgtgaatgtcataaaaaatggtgtgtttgatattgccagtgttagtattgtttgcttctt

SEQ ID NO: 58071 - DNA, 75 bp, Artificial Sequence
  Synthetic
cgtgagagtgaagggtacaaattacaagataatggctagcatcaaaacagctacatcaaataattgtaatgacac

SEQ ID NO: 58072 - DNA, 75 bp, Artificial Sequence
  Synthetic
tggcaataaagtgcaggggtattatctgtgtattgtgggtggaaattcttcaccagtgtatgtaccatcaactac

SEQ ID NO: 58073 - DNA, 75 bp, Artificial Sequence
  Synthetic
tgatttccgttcaatggaagcacttgcaagtatgcttagagcaccccatggtgaagatcatgatttagctggaga

SEQ ID NO: 58074 - DNA, 75 bp, Artificial Sequence
  Synthetic
agaagttgcaacatattcaattgctggtcaagttgaaggtaaagtcccccacactgcaagtacagcaaacatgct

SEQ ID NO: 58075 - DNA, 75 bp, Artificial Sequence
  Synthetic
cctcactgcattctcaggcattcctagctattcttcactcagcgtcttcactggcagtcaggatggccctattgt

SEQ ID NO: 58076 - DNA, 75 bp, Artificial Sequence
  Synthetic
atatagtcctggattgtttcctaaactgaaccaatcatcatgtgataaggttgggctgcctctaatatgggaagg

SEQ ID NO: 58077 - DNA, 75 bp, Artificial Sequence
  Synthetic
ttacattgacttgccaggttactatgaaacagtacatcagtgcaatgttttctgtgttctttcaggccctggagc

SEQ ID NO: 58078 - DNA, 75 bp, Artificial Sequence
  Synthetic
atcatgtgaggcattctcagagggtggaatattcaacataacatctccaaactgtatggtctctaaacaaaatag

SEQ ID NO: 58079 - DNA, 75 bp, Artificial Sequence
  Synthetic
gttccgggctgctgaacaacaggttaactttgcatgccaaagggttgaccaggacattttaatcttctgtaatgg

SEQ ID NO: 58080 - DNA, 75 bp, Artificial Sequence
  Synthetic
tcagaagaaaacaatcctgacaaaaacattagtcattggtcaatgtatctactcaataacaagtttattttcaat

SEQ ID NO: 58081 - DNA, 75 bp, Artificial Sequence
  Synthetic
catgccaggtgtagcacattcaattgcaattgaattatgtgtgccaggtttccatgggtgggcaacagctgccct

SEQ ID NO: 58082 - DNA, 75 bp, Artificial Sequence
  Synthetic
cctcacaacattctgctttggttgggtattaatcccatctattaccttggctgtacttgttgtcttaaagttttt

SEQ ID NO: 58083 - DNA, 75 bp, Artificial Sequence
  Synthetic
tgctgcaatcttacacaatagttcccaggaaaaccggttcaagctcatcttgaaaaagatcaaggaagagtttga

SEQ ID NO: 58084 - DNA, 75 bp, Artificial Sequence
  Synthetic
aaaaacaaagggttcaatggtttgtgaggtatgcaagtatgagtgtgagacagggaaggaattaaaagcacataa

SEQ ID NO: 58085 - DNA, 75 bp, Artificial Sequence
  Synthetic
tctatcctgcccgcaatcacagtgtccctattgtttcacacactgtgaaccaactgagtcagcatttcaagctca

SEQ ID NO: 58086 - DNA, 75 bp, Artificial Sequence
  Synthetic
ttataaggtgtgccaggcaacacatagatttagagatgatctgaaaaagactataacacctcaatctactagccc

SEQ ID NO: 58087 - DNA, 75 bp, Artificial Sequence
  Synthetic
tgggtgttaccggaccttgaacttgttcaggtacaaaagtaggtgttatatattcacagtgtgggtagttctcct

SEQ ID NO: 58088 - DNA, 75 bp, Artificial Sequence
  Synthetic
tgttgtagagtcagtgatgtgggcagccagtgcttcagagacagtattagagccctcatggaatgataacgcaca

SEQ ID NO: 58089 - DNA, 75 bp, Artificial Sequence
  Synthetic
tggagttggtgtagtgcctatgcatacagacttggaattagatttttctctcccatcaagctcgaagtatacgta

SEQ ID NO: 58090 - DNA, 75 bp, Artificial Sequence
  Synthetic
taaaagaaagctaacgagccctataaatcaggaacaatctgttgacctacacattgagatagagagccaaggaat

SEQ ID NO: 58091 - DNA, 75 bp, Artificial Sequence
  Synthetic
ttctacaagtgtccatgctttaggccattggtttgatggtaggttaaacctaaagacatcatttcactgttacgg

SEQ ID NO: 58092 - DNA, 75 bp, Artificial Sequence
  Synthetic
tgcctgtacaaagtatgaatacccttggcatactgcaagatgtcactttgaaagagattttgagtatgagaatag

SEQ ID NO: 58093 - DNA, 75 bp, Artificial Sequence
  Synthetic
ttggggttgtaatccagctgactgccctggtattggtacaggttgtacagcatgtggcatctatatcgaccagtt

SEQ ID NO: 58094 - DNA, 75 bp, Artificial Sequence
  Synthetic
gaagcctgtgggcagtgcatacaagctgattacagtccgttatagccgcaaagtctgtgtccagtttggagagga

SEQ ID NO: 58095 - DNA, 75 bp, Artificial Sequence
  Synthetic
aaacttatgtaaaactattgacatgaatgactgttttgtcacaaggcatgtgaaagtctgtattattgggacagt

SEQ ID NO: 58096 - DNA, 75 bp, Artificial Sequence
  Synthetic
ctcaaaattctctcaaggggacacactggtatttttaggtcctatggagggtggagggctaatatttaaagactg

SEQ ID NO: 58097 - DNA, 75 bp, Artificial Sequence
  Synthetic
gtgtacaagcacatgtcagtttggagatccaggagacattatgagtcccaaggataagggatttagttgtccaga

SEQ ID NO: 58098 - DNA, 75 bp, Artificial Sequence
  Synthetic
attcactggtcacttccgcaaaaagtgcaactttgcaacgacacctgtatgtgaatatgatgggaatatggtatc

SEQ ID NO: 58099 - DNA, 75 bp, Artificial Sequence
  Synthetic
tggatataagaaggtcatggcaactattgattcttttcaagcatttaacacaagttctatccattacacagatga

SEQ ID NO: 58100 - DNA, 75 bp, Artificial Sequence
  Synthetic
gcggattgaatggaaagatccagatgggatgttgaaggaccatcttaatatattggttacaaaagatattgattt

SEQ ID NO: 58101 - DNA, 75 bp, Artificial Sequence
  Synthetic
tgaaaaccttggagacaatccgtgtaaggtgggacttcagactgtttccattgaaggtgcatggggttcaggggt

SEQ ID NO: 58102 - DNA, 75 bp, Artificial Sequence
  Synthetic
tgggttcactttaacatgccaggtttctttaactgaatgctctcgtttcttgacctcaatcaaagcttgtgacaa

SEQ ID NO: 58103 - DNA, 75 bp, Artificial Sequence
  Synthetic
ggcaatatgctatggcgcacagagtagcaccctcattcgaggacaaaatacagtaaaagtgtctgggaagggagg

SEQ ID NO: 58104 - DNA, 75 bp, Artificial Sequence
  Synthetic
acatagtggttcatcctttaagtgttgccatggaactgattgctcacagcaaggattgcaagctagtgcacccca

SEQ ID NO: 58105 - DNA, 75 bp, Artificial Sequence
  Synthetic
tcttgacaagattaatggtattgtagaacaagaaaatgaaaaagtttatgacgatggtgcaccacagtgtggtat

SEQ ID NO: 58106 - DNA, 75 bp, Artificial Sequence
  Synthetic
ttcatgctggtttgtgaagtctggagaatggattcaaggtatcttcaatgggaattggattgtaattgttgtcct

SEQ ID NO: 58107 - DNA, 75 bp, Artificial Sequence
  Synthetic
aatctttttcttcatcctatcattgatattgctcagcatcttttgtccaattcgaaagcataaacgctcctagca

SEQ ID NO: 58108 - DNA, 75 bp, Artificial Sequence
  Synthetic
tggaactgtatatggattgatgctgcttgcttgttaatctgctttttttaataatgccattttatacttactaac

SEQ ID NO: 58109 - DNA, 75 bp, Artificial Sequence
  Synthetic
ctatatttctaaaaaaaatagactctttactactagatttcctagtcctttattacgtgggtatttctatatctt

SEQ ID NO: 58110 - DNA, 75 bp, Artificial Sequence
  Synthetic
aatagactctttactactagatttcctagtcctttattacgtgggtatttctatatcttgcggagcatactacta

SEQ ID NO: 58111 - DNA, 75 bp, Artificial Sequence
  Synthetic
tagtagtatgctccctaaaaagcactacactaaagatggcaacattggaggaactccaaaaggaaattaacaacc

SEQ ID NO: 58112 - DNA, 75 bp, Artificial Sequence
  Synthetic
atgaaggccaactggtgatcgccagacagaaggtaaaggatgcagagaagcagtatgagaaggaccctgatgacc

SEQ ID NO: 58113 - DNA, 75 bp, Artificial Sequence
  Synthetic
ccaactggactagaccctggtgatcatctcaaagagaagtcgatgctcagttacgggaatgtaattgatcttaat

SEQ ID NO: 58114 - DNA, 75 bp, Artificial Sequence
  Synthetic
atctcaaagagaagtcgatgctcagttacgggaatgtaattgatcttaatcacttggatattgatgaaccaacag

SEQ ID NO: 58115 - DNA, 75 bp, Artificial Sequence
  Synthetic
gttccaatacttctgaaggctctttacatgctaacaaccagagggagacaaactactaaagacaataaaggaatg

SEQ ID NO: 58116 - DNA, 75 bp, Artificial Sequence
  Synthetic
acatgctaacaaccagagggagacaaactactaaagacaataaaggaatgaggattcggttcaaggatgacagtt

SEQ ID NO: 58117 - DNA, 75 bp, Artificial Sequence
  Synthetic
actacttgaatcaaagacagggggcgcttgcaaaaatggaaacaaaggaagctcaggctgtaaggaagcatgcca

SEQ ID NO: 58118 - DNA, 75 bp, Artificial Sequence
  Synthetic
tagatgctggttgtaaccttgttgatcacattgattcaccatcatcaatttgggtctttgcaggagcacctgata

SEQ ID NO: 58119 - DNA, 75 bp, Artificial Sequence
  Synthetic
tctcggtgatgacatggaccctgagcttcgaggcctggcacaggcactgattgatcagaaagtgaaggagatatc

SEQ ID NO: 58120 - DNA, 75 bp, Artificial Sequence
  Synthetic
cttcgaggcctggcacaggcactgattgatcagaaagtgaaggagatatctaatcaggagccgcttaagctttaa

SEQ ID NO: 58121 - DNA, 75 bp, Artificial Sequence
  Synthetic
tttatgtaatcccacatatgctgcattaattgcttgaactggaattattatcactaggggatgggttgggtgggc

SEQ ID NO: 58122 - DNA, 75 bp, Artificial Sequence
  Synthetic
actattttttgtatatatggatgtagatttcaattgatctgtactaacaccttacttctttcttttcctttcttt

SEQ ID NO: 58123 - DNA, 75 bp, Artificial Sequence
  Synthetic
tagtagtagactccgcaagaaatagcagttgaataacagcatgatcatgtggggtttactattgacaatgagcct

SEQ ID NO: 58124 - DNA, 75 bp, Artificial Sequence
  Synthetic
cagagacgttagtccctgaaagctcctgcaacatggacaaccaccagtcattatcgatcacacaaaaagtgacaa

SEQ ID NO: 58125 - DNA, 75 bp, Artificial Sequence
  Synthetic
gagagaacatactgcacaactggtatattgatagagggcaagtgctttgtaccagaccagagcattatcagtgtg

SEQ ID NO: 58126 - DNA, 75 bp, Artificial Sequence
  Synthetic
tgattttaggtcaatggaggtacttgccagtctgctgagatctccccatggtgaagaccatgatctgtccggtga

SEQ ID NO: 58127 - DNA, 75 bp, Artificial Sequence
  Synthetic
ctacagccctggtttgttccctaaattaaaccaatcctcatgtgagaaagttgcattgcccttgatatgggaagg

SEQ ID NO: 58128 - DNA, 75 bp, Artificial Sequence
  Synthetic
atatatagacttgcctggctactatgaaacaattcacccttgcaatgtcttctgtgttttgtccggcccaggggc

SEQ ID NO: 58129 - DNA, 75 bp, Artificial Sequence
  Synthetic
aactttgtgtgccagcgagttgatcaagacattgtgatttactgcaatggacagaagaagaccattttgacaaag

SEQ ID NO: 58130 - DNA, 75 bp, Artificial Sequence
  Synthetic
atactaatcccttctatcacactagctatactgattgtcttaaagttctttgctgcaatcctacacaacagttct

SEQ ID NO: 58131 - DNA, 75 bp, Artificial Sequence
  Synthetic
caggaaaggaactcaaagcacacaatttatcctgcccacaatcacagtgtccatactgttttacacactgtgaac

SEQ ID NO: 58132 - DNA, 75 bp, Artificial Sequence
  Synthetic
aatcaagaacaatcagtagaccttcatattgagatagaaagtcaaaggatttctacaagtgtgcatgctttaggc

SEQ ID NO: 58133 - DNA, 75 bp, Artificial Sequence
  Synthetic
aaacctttgtaaaatcattgatatgaatgattgctttgtatcacggcatgtgaaagtatgcattataggtactgt

SEQ ID NO: 58134 - DNA, 75 bp, Artificial Sequence
  Synthetic
aggataaaggttttagctgtcctgatttcacaggtcatttcaggaaaaaatgtaattttgccactacccctgtgt

SEQ ID NO: 58135 - DNA, 75 bp, Artificial Sequence
  Synthetic
tagagggtgcatggggttctggagttgggtttacccttacctgccagatctcattaactgaatgttcacgctttt

SEQ ID NO: 58136 - DNA, 75 bp, Artificial Sequence
  Synthetic
tgggtttacccttacctgccagatctcattaactgaatgttcacgctttttaacatctattaaggcatgtgatat

SEQ ID NO: 58137 - DNA, 75 bp, Artificial Sequence
  Synthetic
cctggataaggtcaacggtattgttgagcaagagagcacacaagtgtatgatgatggtgcacctcaatgtggaat

SEQ ID NO: 58138 - DNA, 75 bp, Artificial Sequence
  Synthetic
atgatggtgcacctcaatgtggaatttcttgctggtttataaaatctggagagtggataaagggtatcttcaatg

SEQ ID NO: 58139 - DNA, 75 bp, Artificial Sequence
  Synthetic
tccgtaaacacaagcgttcctaagtatatatcatgttaaactctatcccatatcctatatcatatatattacttt

SEQ ID NO: 58140 - DNA, 75 bp, Artificial Sequence
  Synthetic
tatcctatatcatatatattacttttttacactccatatcactaatttgcttgctatgtttatacctagttatta

SEQ ID NO: 58141 - DNA, 75 bp, Artificial Sequence
  Synthetic
aatacctcctttactactataattcctagtcctttatcacgtgggtatttctatatcttgcggagcatactacta

SEQ ID NO: 58142 - DNA, 75 bp, Artificial Sequence
  Synthetic
tagtagtagactccggaagagacaaactactataaaaatggagaaatacagagaaattcacagggatttacaatc

SEQ ID NO: 58143 - DNA, 75 bp, Artificial Sequence
  Synthetic
ctttccagttgggtcattgacagcagtagagtgcatagactacctggatcgtctctatgcaataaggcatgatat

SEQ ID NO: 58144 - DNA, 75 bp, Artificial Sequence
  Synthetic
tgttgaccaaatgataaagcatgactgggcagataacaaggattcagaagaatctataggaaaggttttattgtt

SEQ ID NO: 58145 - DNA, 75 bp, Artificial Sequence
  Synthetic
tgctggggtacctaataatgtcataactgcaatggaaaagaaaatcatccctgaccacccaagtggtaagacact

SEQ ID NO: 58146 - DNA, 75 bp, Artificial Sequence
  Synthetic
ccgatccttttttaagatgacacctgataattataagataacaggttcaacaattgaatttgttgaggtgacggt

SEQ ID NO: 58147 - DNA, 75 bp, Artificial Sequence
  Synthetic
cactgttgatgttgataaggggattagggaaaagaagttgaagtatgaagcaggcttaaagtaccttgaacaaga

SEQ ID NO: 58148 - DNA, 75 bp, Artificial Sequence
  Synthetic
attgcataaccattttctaaaaggagatattccacagccttataaaataacattccaggttgtttcagttaggac

SEQ ID NO: 58149 - DNA, 75 bp, Artificial Sequence
  Synthetic
agacggatctaacatctctacacagtggcccagcaggagaaatgacggggttgttcaatacatgaggctggtgca

SEQ ID NO: 58150 - DNA, 75 bp, Artificial Sequence
  Synthetic
ggctgagattagttatgtcagagaacacttaatacggcaagaggaaagagctgcattagaagcaatgttcaattt

SEQ ID NO: 58151 - DNA, 75 bp, Artificial Sequence
  Synthetic
aaaatttaatataagcaatgtaaaaaatcaaccgtactatattcctgattatcgtggaattgcattaattcaccc

SEQ ID NO: 58152 - DNA, 75 bp, Artificial Sequence
  Synthetic
aaacattgatgacttagttacctatatgaagaactggttgtcaaaaagtcataaattctcattccatgaagtaaa

SEQ ID NO: 58153 - DNA, 75 bp, Artificial Sequence
  Synthetic
gggtcctgctgtatttgactgtttcaatgaaaatgagatcgaacatgctataaaatatcccatttcgcggcaccc

SEQ ID NO: 58154 - DNA, 75 bp, Artificial Sequence
  Synthetic
gagaaactttttattgatacagtgctcgctactatcttcgtatagtccagctacaattctttctgatcaggttga

SEQ ID NO: 58155 - DNA, 75 bp, Artificial Sequence
  Synthetic
tagtagaagggcatgtaattctgtactaaacttgatccctgaaacaccaacttcatttcttatacatgatatggc

SEQ ID NO: 58156 - DNA, 75 bp, Artificial Sequence
  Synthetic
ttatcggtatattaatctaaccagagaagacatggtttcattctatgcacccaagacccagttcatacctacaca

SEQ ID NO: 58157 - DNA, 75 bp, Artificial Sequence
  Synthetic
aaatgtaaaagagcctgggacttttaagctgacagccaattccatgaggccagagtctaaagcaatgtttgacat

SEQ ID NO: 58158 - DNA, 75 bp, Artificial Sequence
  Synthetic
gttaggtagtcatgaaccaggtgaaaagaaaggtgctttaattgagagcttgaatttaagcagccatatagttca

SEQ ID NO: 58159 - DNA, 75 bp, Artificial Sequence
  Synthetic
atctgaatgtgtaagcctgatcactaaaatactttctgatcttgaactcaatataagtgaaccgacaagccacag

SEQ ID NO: 58160 - DNA, 75 bp, Artificial Sequence
  Synthetic
ttcttttactactaaacatacatatgttgataacgtcttagaaaagttttttcaaaatgaaattcagaggtactt

SEQ ID NO: 58161 - DNA, 75 bp, Artificial Sequence
  Synthetic
gttagatgttctaaagaagacaactgcatggcatatcgggcatcttgttcgggatataacagaaagtttaattgc

SEQ ID NO: 58162 - DNA, 75 bp, Artificial Sequence
  Synthetic
tcattcaggtcttaaaagatcaaagtattggtcaatacatgcgtataataacgggaatgtgatcttattcatact

SEQ ID NO: 58163 - DNA, 75 bp, Artificial Sequence
  Synthetic
cccgtctaaatcattagaggttgcagggtcatatataaggtttgtaacagtttttcggatgggaccgggtctagt

SEQ ID NO: 58164 - DNA, 75 bp, Artificial Sequence
  Synthetic
tgataaagataatctggatacaatattgactgatcaagatattacttggggagtctcaaaggttatgagtattga

SEQ ID NO: 58165 - DNA, 75 bp, Artificial Sequence
  Synthetic
cttgaatagattattagcacttaatatcgcatttgagaaggcactaattgccacagctacgtggtttcagtacta

SEQ ID NO: 58166 - DNA, 75 bp, Artificial Sequence
  Synthetic
tacagaagatcaaggtcagttccctttgcagcatgctataaggtcaatctttgcttatcatttgttattagctgt

SEQ ID NO: 58167 - DNA, 75 bp, Artificial Sequence
  Synthetic
gtgtcaaaagatgaaattgtgtgctatttttgataatttacgttatttaatacctgctgtcacatctctctactc

SEQ ID NO: 58168 - DNA, 75 bp, Artificial Sequence
  Synthetic
tggtttcccctctctggtaaataagttatttgaacgccctttcaaaagtgccttagaggtgtatgtctattacaa

SEQ ID NO: 58169 - DNA, 75 bp, Artificial Sequence
  Synthetic
tattaagagtttacttgttgcccttgcacagaacaacaaggcaaggttttattccaaagtgaaacttttaggctt

SEQ ID NO: 58170 - DNA, 75 bp, Artificial Sequence
  Synthetic
aacagtagaccaatctactgttggtgcaagtggtatttacccatcatttatgtctcgtgtcatttataaacatta

SEQ ID NO: 58171 - DNA, 75 bp, Artificial Sequence
  Synthetic
aacagtagaccaatctactgttggtgcaagtggtatttacccttcatttatgtctcgtgtcatttataaacatta

SEQ ID NO: 58172 - DNA, 75 bp, Artificial Sequence
  Synthetic
aacagtagaccaatctactgttggtgcaagtggtatttacccctcatttatgtctcgtgtcatttataaacatta

SEQ ID NO: 58173 - DNA, 75 bp, Artificial Sequence
  Synthetic
aacagtagaccaatctactgttggtgcaagtggtatttacccgtcatttatgtctcgtgtcatttataaacatta

SEQ ID NO: 58174 - DNA, 75 bp, Artificial Sequence
  Synthetic
tcgtagtcttatatcagaagtaacaacatgttttttcttatttgagaaggggctgcatggcaacatgaatgagga

SEQ ID NO: 58175 - DNA, 75 bp, Artificial Sequence
  Synthetic
ggcaaaaatacaccttgagaccgtagaatgggccctcaagtttagacagaaagaagatcaatatggagaatctat

SEQ ID NO: 58176 - DNA, 75 bp, Artificial Sequence
  Synthetic
ggttgagaatggttatacaataggtgaacttaatgacaacccagatttggttgaacagcagctctactgtcaaga

SEQ ID NO: 58177 - DNA, 75 bp, Artificial Sequence
  Synthetic
tgccgtagaacttgcggctgtagaacttaacaagatactatcaacaaagtcccaggttgtagccaatagtatcct

SEQ ID NO: 58178 - DNA, 75 bp, Artificial Sequence
  Synthetic
caataaatattgggaagtcccttattttagccaaaccaggaatataagtttgaaagggatgtcagggcaagtcca

SEQ ID NO: 58179 - DNA, 75 bp, Artificial Sequence
  Synthetic
agaagatgggcatcttgctgcatctgttacaattatagaggcaatacgttacttgtcatcctcacagcacaaccc

SEQ ID NO: 58180 - DNA, 75 bp, Artificial Sequence
  Synthetic
agatgatgggcatcttgctgcatctgttacaattatagaggcaatacgttacttgtcatcctcacagcacaaccc

SEQ ID NO: 58181 - DNA, 75 bp, Artificial Sequence
  Synthetic
agacgatgggcatcttgctgcatctgttacaattatagaggcaatacgttacttgtcatcctcacagcacaaccc

SEQ ID NO: 58182 - DNA, 75 bp, Artificial Sequence
  Synthetic
agaggatgggcatcttgctgcatctgttacaattatagaggcaatacgttacttgtcatcctcacagcacaaccc

SEQ ID NO: 58183 - DNA, 75 bp, Artificial Sequence
  Synthetic
tagtgtacaacaactttatgaagagactagaaaggtcaaagcccaagcccgcattgttcgaaaataccaaagaac

SEQ ID NO: 58184 - DNA, 75 bp, Artificial Sequence
  Synthetic
tagtgtactacaactttatgaagagactagaaaggtcaaagcccaagcccgcattgttcgaaaataccaaagaac

SEQ ID NO: 58185 - DNA, 75 bp, Artificial Sequence
  Synthetic
tagtgtaccacaactttatgaagagactagaaaggtcaaagcccaagcccgcattgttcgaaaataccaaagaac

SEQ ID NO: 58186 - DNA, 75 bp, Artificial Sequence
  Synthetic
tagtgtacgacaactttatgaagagactagaaaggtcaaagcccaagcccgcattgttcgaaaataccaaagaac

SEQ ID NO: 58187 - DNA, 75 bp, Artificial Sequence
  Synthetic
agaggctgatcgaggttttttcatcacaacacttccaacaaggtgtagattagaaataattgaagattattatga

SEQ ID NO: 58188 - DNA, 75 bp, Artificial Sequence
  Synthetic
tgccatatcaaaaaatgtggctgaggagtacatttcttatggtggtgaacggaaaattctatgtattcagtcagc

SEQ ID NO: 58189 - DNA, 75 bp, Artificial Sequence
  Synthetic
actggaaaaggcacttagatgggcctctggagaaagtttcattgagctgagtaatgggaagtttatacgaatgaa

SEQ ID NO: 58190 - DNA, 75 bp, Artificial Sequence
  Synthetic
gagaaagttaatgtatgtaagtgctgatgcaacaaaatggtcccctggagataactcagctaaattcagaagatt

SEQ ID NO: 58191 - DNA, 75 bp, Artificial Sequence
  Synthetic
cactgcagctttacataatgggctgcctgatgatcgtttaaaaaattgcgtaattgatgctctcagaaatgttta

SEQ ID NO: 58192 - DNA, 75 bp, Artificial Sequence
  Synthetic
caaaacagacttctatatgtctagaaagctgagggcttatatagataatatgaatggacttgagcctgctgtcaa

SEQ ID NO: 58193 - DNA, 75 bp, Artificial Sequence
  Synthetic
aagttttttagaattctttcctgatggtcactgtggagaagtccggggtaactggctacaggggaacctaaataa

SEQ ID NO: 58194 - DNA, 75 bp, Artificial Sequence
  Synthetic
gtgttcatctctctttggtgtgggaatgtcattacttttcaagcagttgtggagtgaattatttccagagttaga

SEQ ID NO: 58195 - DNA, 75 bp, Artificial Sequence
  Synthetic
ttgcttttttgaatttgctcatcattcagatgatgcactgttcatatatggttacctcgaaccgattgatgatgg

SEQ ID NO: 58196 - DNA, 75 bp, Artificial Sequence
  Synthetic
gactgactggtttctttatgtttctcagcaaattcaagcaggccatttacactggtttagtgtaaatactgaaat

SEQ ID NO: 58197 - DNA, 75 bp, Artificial Sequence
  Synthetic
gtggaaaagcatgtttaatcttcatgaacatgtactactgttaggctccattaagatatcccctaagaaaacaac

SEQ ID NO: 58198 - DNA, 75 bp, Artificial Sequence
  Synthetic
attgtctcctaccaatgcagaatttctttctacattttttgaaggttgtgctgtgtcaataccctttgttaagat

SEQ ID NO: 58199 - DNA, 75 bp, Artificial Sequence
  Synthetic
cttattgggttctttatcagatctaccaggcctgggttattttgatgatcttgcagcagcccaaagtaggtgtgt

SEQ ID NO: 58200 - DNA, 75 bp, Artificial Sequence
  Synthetic
taaggcaatggatcttggcgcatcgccacaagttgctcagcttgcagttgcactatgcacaaataaagttgagag

SEQ ID NO: 58201 - DNA, 75 bp, Artificial Sequence
  Synthetic
gttgtacggtacagctgttggtatggtaaatcatccatcaacatatcttcaggtcaaacatggtgatacacctat

SEQ ID NO: 58202 - DNA, 75 bp, Artificial Sequence
  Synthetic
tcccctaggtgggagtggtgctatgtcaataatggaactagcaacggctggaataggtatgtccgataagaacct

SEQ ID NO: 58203 - DNA, 75 bp, Artificial Sequence
  Synthetic
tcttaaaagggctcttctaggttacatacacaaaaggcaaaagaacatggcatatatccttggcctttttaagtt

SEQ ID NO: 58204 - DNA, 75 bp, Artificial Sequence
  Synthetic
tttgatgaatttatcaaaggacacttttcaacatgagaggctgggtgagttttcatttattggaaaagtacaatg

SEQ ID NO: 58205 - DNA, 75 bp, Artificial Sequence
  Synthetic
gaaaatattcatacctaaatcagaatttgagttttttgacatgtatacacctaaatttttaaagctctggagtga

SEQ ID NO: 58206 - DNA, 75 bp, Artificial Sequence
  Synthetic
gcaacatgtaacatatgattacattatccctaagggcagagacaatttactaatttaccttgttaggaaaataaa

SEQ ID NO: 58207 - DNA, 75 bp, Artificial Sequence
  Synthetic
tgatccaagtatagttactgctatgacaatgcagtcaccacttcagttaaggtttagaatgcaagcaaaacaaca

SEQ ID NO: 58208 - DNA, 75 bp, Artificial Sequence
  Synthetic
catgaaagtatgtaagcttgatgataactgggttacatttagggaggttttagctgcagcgaatagctttgcaca

SEQ ID NO: 58209 - DNA, 75 bp, Artificial Sequence
  Synthetic
catgaaagtttgtaagcttgatgataactgggttacatttagggaggttttagctgcagcgaatagctttgcaca

SEQ ID NO: 58210 - DNA, 75 bp, Artificial Sequence
  Synthetic
catgaaagtctgtaagcttgatgataactgggttacatttagggaggttttagctgcagcgaatagctttgcaca

SEQ ID NO: 58211 - DNA, 75 bp, Artificial Sequence
  Synthetic
catgaaagtgtgtaagcttgatgataactgggttacatttagggaggttttagctgcagcgaatagctttgcaca

SEQ ID NO: 58212 - DNA, 75 bp, Artificial Sequence
  Synthetic
atcatatgaggtgactcaggaagatcttgaccttttccaaaccttaacaagctgtacattctcaaaagaatatgc

SEQ ID NO: 58213 - DNA, 75 bp, Artificial Sequence
  Synthetic
atcttatgaggtgactcaggaagatcttgaccttttccaaaccttaacaagctgtacattctcaaaagaatatgc

SEQ ID NO: 58214 - DNA, 75 bp, Artificial Sequence
  Synthetic
atcctatgaggtgactcaggaagatcttgaccttttccaaaccttaacaagctgtacattctcaaaagaatatgc

SEQ ID NO: 58215 - DNA, 75 bp, Artificial Sequence
  Synthetic
atcgtatgaggtgactcaggaagatcttgaccttttccaaaccttaacaagctgtacattctcaaaagaatatgc

SEQ ID NO: 58216 - DNA, 75 bp, Artificial Sequence
  Synthetic
ctggaaggacttcctaaatggtgtacaatgtgatgtcattccaacaaaacagattcaaagagcaaaggtagctag

SEQ ID NO: 58217 - DNA, 75 bp, Artificial Sequence
  Synthetic
gactttcactgtaagggagaaggaccaaatcattcagaatagcattccagccgtcatcggttacaagtttgcagt

SEQ ID NO: 58218 - DNA, 75 bp, Artificial Sequence
  Synthetic
gacagttgacgaaatgtcagatgtcttagactcagcaaaattccctgactcactagctgtagacttaaaaactat

SEQ ID NO: 58219 - DNA, 75 bp, Artificial Sequence
  Synthetic
gaaagatggggtctacagagaacttggattagatatctcacaggctgaggcaatgaaaaaggttgcaccaatgct

SEQ ID NO: 58220 - DNA, 75 bp, Artificial Sequence
  Synthetic
ttataaaagttcaaagtcaagggtggttattgtgcaaggaaatgtagaaggtacagctgaggctatctgtggcta

SEQ ID NO: 58221 - DNA, 75 bp, Artificial Sequence
  Synthetic
ctggttgcgcacaatgtccctcgtgaaaacaattagagtgaagccgcacaaagaagtattgaaagctgtatctat

SEQ ID NO: 58222 - DNA, 75 bp, Artificial Sequence
  Synthetic
ttttaatagaaaggaagatattggtcagcagaaagaccttgctgcactgagattatgtatagaagtttggcgctg

SEQ ID NO: 58223 - DNA, 75 bp, Artificial Sequence
  Synthetic
gtgtaaagcaaataatgcaccttatcaagaatggtttcatgctttgtggtttgaagataagacattctctgaatg

SEQ ID NO: 58224 - DNA, 75 bp, Artificial Sequence
  Synthetic
gttggataggttcatccgtataggtgtccctccagtggatccagagattcaatgtgccgcattgatgattgcaga

SEQ ID NO: 58225 - DNA, 75 bp, Artificial Sequence
  Synthetic
tatcagaggtgatctgtctgttttacagatacaggcaaataggagagcttattcgggtaaacagtatgatgcata

SEQ ID NO: 58226 - DNA, 75 bp, Artificial Sequence
  Synthetic
ttgtattcaaacatacaatgaagaaacaaagctatatgagggtgacctccgagtcaccttcaattttggattgga

SEQ ID NO: 58227 - DNA, 75 bp, Artificial Sequence
  Synthetic
ctgtgcccgtcttgaaatcttttgggacaagcaaacatatatcctggaaacttcaataacacaaaaacatgtact

SEQ ID NO: 58228 - DNA, 75 bp, Artificial Sequence
  Synthetic
taagatcatgatggatgaagtgacaaaagaattattgagatgtggtatgagatttaaaactgaacaagtttctag

SEQ ID NO: 58229 - DNA, 75 bp, Artificial Sequence
  Synthetic
tgtgaaacaccttgtattgtttaaaacagaggcaggttttgaatggggaaaacctaacatcccatgtattgtata

SEQ ID NO: 58230 - DNA, 75 bp, Artificial Sequence
  Synthetic
taaaaattgtgcattgcgtacagggcttagaacaactcagactgtcaatcataaatttatgatatcaattaaaga

SEQ ID NO: 58231 - DNA, 75 bp, Artificial Sequence
  Synthetic
caatggtcttagggccattgctcaatatgatgatgaaagtcctaggtttttacttgcacatgcatttcatacaat

SEQ ID NO: 58232 - DNA, 75 bp, Artificial Sequence
  Synthetic
aagagacatcaggtaccaagcagttgatgctgtgagtaatgtatggtttgtccataaagggataaaactctttct

SEQ ID NO: 58233 - DNA, 75 bp, Artificial Sequence
  Synthetic
taatccgatcatatcatcaggcttattagagaatttcatgaaaaatctaccggcagcaataccccctgctgcata

SEQ ID NO: 58234 - DNA, 75 bp, Artificial Sequence
  Synthetic
ctcactaattatgaatagagcaaaaatatctgttgatttgtttatgtttaatgatttgctcaggcttattaaccc

SEQ ID NO: 58235 - DNA, 75 bp, Artificial Sequence
  Synthetic
agcaaatacattggacctatctggtttgcagccaactgaggacggatttagtactgtgagcagtatgtcaagtag

SEQ ID NO: 58236 - DNA, 75 bp, Artificial Sequence
  Synthetic
actatggtcagaagaagttagctttgttgatgaggatgaggaggttgatgatgaatttacaatagatttacagga

SEQ ID NO: 58237 - DNA, 75 bp, Artificial Sequence
  Synthetic
tgtggattttgagaatattgatgtagaagctgatattgaacattttttacaagatgagagctcacatacaggtga

SEQ ID NO: 58238 - DNA, 75 bp, Artificial Sequence
  Synthetic
cttacttattatgtcagaagaaactgaagttaaaaagatgagaggcattataaaactattagaacctgtcaggct

SEQ ID NO: 58239 - DNA, 75 bp, Artificial Sequence
  Synthetic
cataaagagttgggtatctaaaggcttatgtattgaaaaggtttatagcccaactaatattatattaatgactag

SEQ ID NO: 58240 - DNA, 75 bp, Artificial Sequence
  Synthetic
atatttatcaaagaattttagtttttctggtagacaggtttcccttctagacccatatgatttgacagaatttga

SEQ ID NO: 58241 - DNA, 75 bp, Artificial Sequence
  Synthetic
aagcgttgtcaaaggatggggagagtgtgttgttgatcagtttagcacatttgatcaggaggcacagcttctagt

SEQ ID NO: 58242 - DNA, 75 bp, Artificial Sequence
  Synthetic
atctcagaaaggtatttgtccagaagatgtggtacctgattctctattttcattcagacatactatagttctcct

SEQ ID NO: 58243 - DNA, 75 bp, Artificial Sequence
  Synthetic
atctcagaaaggtatttgtccagaagatgtggtacctgattctcttttttcattcagacatactatagttctcct

SEQ ID NO: 58244 - DNA, 75 bp, Artificial Sequence
  Synthetic
atctcagaaaggtatttgtccagaagatgtggtacctgattctctcttttcattcagacatactatagttctcct

SEQ ID NO: 58245 - DNA, 75 bp, Artificial Sequence
  Synthetic
atctcagaaaggtatttgtccagaagatgtggtacctgattctctgttttcattcagacatactatagttctcct

SEQ ID NO: 58246 - DNA, 75 bp, Artificial Sequence
  Synthetic
gcgtagacttttccctcaggattctgtttcaacattctattaattgtttatattcattttcattttccggagcat

SEQ ID NO: 58247 - DNA, 75 bp, Artificial Sequence
  Synthetic
cttttccctcaggattctgtttcaacattctattaattgtttatattcattttcattttccggagcatactacta

SEQ ID NO: 58248 - DNA, 75 bp, Artificial Sequence
  Synthetic
gatcaatctcggtgcatctctgaggaatgtgtatgacatgaaaatagaatgtccacactcaatcaattttggaga

SEQ ID NO: 58249 - DNA, 75 bp, Artificial Sequence
  Synthetic
gagcagtgtaacaggtaagggcgaattaccccccctcttgctcactgatgcagagactctggttcctgagagctc

SEQ ID NO: 58250 - DNA, 75 bp, Artificial Sequence
  Synthetic
ttgtaatatggataaccatcagtccctatcaattacacagaaagtgacaaaggttagctggagaaaaaaggcaga

SEQ ID NO: 58251 - DNA, 75 bp, Artificial Sequence
  Synthetic
caaagtccaagctgcaaaggattcatttgaaaccacatcaagtgaagtgaatcttaaagggacatgcacattgac

SEQ ID NO: 58252 - DNA, 75 bp, Artificial Sequence
  Synthetic
tcacaggatggttgaagaatcttacagaagtagaaagtcagtcatatgctatgacctttcttgtaattcaacaca

SEQ ID NO: 58253 - DNA, 75 bp, Artificial Sequence
  Synthetic
ctgtaagccgactatgcacatgattgttcctgtccattcatgtaatatgatgaaaagctgccttgtggggctagg

SEQ ID NO: 58254 - DNA, 75 bp, Artificial Sequence
  Synthetic
gccttaccggatccaagttgtttatgaaagaacatactgcacaactggcatattgacagaagggaaatgctttgt

SEQ ID NO: 58255 - DNA, 75 bp, Artificial Sequence
  Synthetic
accagaccaaagtattatcagtgtaataaaaaatggggtttttgatattgcaagtgtaagcattgtctgtttctt

SEQ ID NO: 58256 - DNA, 75 bp, Artificial Sequence
  Synthetic
tatccggataaagggaactagctataaaataatgacaagcataaaggaatcaaatccaaataactgcaatgacac

SEQ ID NO: 58257 - DNA, 75 bp, Artificial Sequence
  Synthetic
cgacaataaagttcagggctattacttgtgcattgtaggagctaactcctctcctgtttatgcaccctcaactac

SEQ ID NO: 58258 - DNA, 75 bp, Artificial Sequence
  Synthetic
tgattttaggtcagtggaggcacttgctagtttattaagatctccttatggtgaggatcatgatttagcaggaga

SEQ ID NO: 58259 - DNA, 75 bp, Artificial Sequence
  Synthetic
agaggttgcaacatattcaattgctggtcaggttgaaggcaaagtcccacacactgcaaatgcagcaaatatgct

SEQ ID NO: 58260 - DNA, 75 bp, Artificial Sequence
  Synthetic
attcactgcattttcaggaattcctagctattcttcatttagtgtctttactgggaaccaggatggaaatgtgat

SEQ ID NO: 58261 - DNA, 75 bp, Artificial Sequence
  Synthetic
ttatagtcctgggctgttcccaaaattaaaccaatcatcatgcgaaaaggttgcattgcctttgatttgggaggg

SEQ ID NO: 58262 - DNA, 75 bp, Artificial Sequence
  Synthetic
atacatagacttacctggctattatgaaacagtccacccttgtaatgttttctgtgtgtcgtctggtccaggagc

SEQ ID NO: 58263 - DNA, 75 bp, Artificial Sequence
  Synthetic
atcatgtgaggcattttcagaaggtggtatcttcaacataacatctccaacctgtctggtttcaaaacagaacag

SEQ ID NO: 58264 - DNA, 75 bp, Artificial Sequence
  Synthetic
gttcagggctgcagagcagcaaattaattttgtgtgtcaacgggttgatcaagacattgtaatatactgtaatgg

SEQ ID NO: 58265 - DNA, 75 bp, Artificial Sequence
  Synthetic
gcagaagaaaaccatcttaacaaagacattggtaattggacaatgcatctattcagtgacaagtctgttttcaat

SEQ ID NO: 58266 - DNA, 75 bp, Artificial Sequence
  Synthetic
aatgccaggtgtagcccactctatagcaattgaattatgtgtgcctggttttcatggctgggccactgctgccct

SEQ ID NO: 58267 - DNA, 75 bp, Artificial Sequence
  Synthetic
cctaactacattctgctttgggtggatattgataccgtctattacactggctatattgattgtcttaaagttctt

SEQ ID NO: 58268 - DNA, 75 bp, Artificial Sequence
  Synthetic
tgctgcattattgcataatagctctcaagaaaatcgatttaaaataattttgaagaagattaaggaggaatttga

SEQ ID NO: 58269 - DNA, 75 bp, Artificial Sequence
  Synthetic
aaaaactaaaggatcaatggtttgtgaggtatgtaagtatgaatgtgagacaggaaaagaactcaaagcacataa

SEQ ID NO: 58270 - DNA, 75 bp, Artificial Sequence
  Synthetic
cttatcctgcccacaatcacaatgtccttattgctttacacattgtgagctcacagaatctgcatttcaagcaca

SEQ ID NO: 58271 - DNA, 75 bp, Artificial Sequence
  Synthetic
ctatcgagtttgccaggccacacatagatttagggatgacttgaagaagacaataacacctcagtcaacgagccc

SEQ ID NO: 58272 - DNA, 75 bp, Artificial Sequence
  Synthetic
tgggtgttatcgtacattgaatcttttcagatacaaaagtaggtgttatatctttacagtgtgggtgattctcct

SEQ ID NO: 58273 - DNA, 75 bp, Artificial Sequence
  Synthetic
catcattgagtctatcttatgggctgcaagtgcatcagaaattgtcttagaaccaagttggaatgacaatgcaca

SEQ ID NO: 58274 - DNA, 75 bp, Artificial Sequence
  Synthetic
tggtgttggtgtggtcccaatgcacactgatctggaactagatttttcccttccttccagttcgaaatacacata

SEQ ID NO: 58275 - DNA, 75 bp, Artificial Sequence
  Synthetic
taagaggaagttaacaagtcctattaatcaagaacaatcagtagaccttcatattgagatagagagtcaaggaat

SEQ ID NO: 58276 - DNA, 75 bp, Artificial Sequence
  Synthetic
ttccacgagtgtgcatgctttaggccactggtttgatgggaggttaaatttaaaaacatctttccactgttatgg

SEQ ID NO: 58277 - DNA, 75 bp, Artificial Sequence
  Synthetic
tgcatgtaccaaatatgaatatccttggcatacagcaaaatgtcactttgagagagattttgagtatgagaacag

SEQ ID NO: 58278 - DNA, 75 bp, Artificial Sequence
  Synthetic
ttggagctgtaaccctgcagactgcccagggattggtactggttgcactgcatgtgggttatatcttgaccaact

SEQ ID NO: 58279 - DNA, 75 bp, Artificial Sequence
  Synthetic
taagccagttggaagtgcttataaactaattacagtccgttatagtcggaaagtttgtgtccaatttggtgaaga

SEQ ID NO: 58280 - DNA, 75 bp, Artificial Sequence
  Synthetic
aaacctttgtaaaactattgacatgaatgattgctttgtgactagacatgtgaaggtttgcatcataggcacagt

SEQ ID NO: 58281 - DNA, 75 bp, Artificial Sequence
  Synthetic
ttcaaaattttcacagggtgataccctagtgtttcttggtcccatggagggtggaggtttaatattcaaagactg

SEQ ID NO: 58282 - DNA, 75 bp, Artificial Sequence
  Synthetic
gtgtacaacaacgtgtcagttcggggatccaggggacatcatgagtcctaaggataagggtttcagctgtcctga

SEQ ID NO: 58283 - DNA, 75 bp, Artificial Sequence
  Synthetic
cttcacaggtcattttagaaaaaaatgcaattttgctaccacacctgtatgtgaatatgatggcaacatggtttc

SEQ ID NO: 58284 - DNA, 75 bp, Artificial Sequence
  Synthetic
tggctacaagaaagtgatggcaactattgattcttttcaagcatttaatactagtaacatacattatactgatga

SEQ ID NO: 58285 - DNA, 75 bp, Artificial Sequence
  Synthetic
gcggatcgaatggaaagatccagatgggatgcttaaagaccatttgaacatacttgttacaaaagacattgattt

SEQ ID NO: 58286 - DNA, 75 bp, Artificial Sequence
  Synthetic
tgaaaatctgggtgaaaacccctgtaaagttgggctacagacagcttctatagatggtgcctggggttctggggt

SEQ ID NO: 58287 - DNA, 75 bp, Artificial Sequence
  Synthetic
tggttttactcttacttgccagatctcactgactgaatgttcacgcttcttgacatcaattaaggcatgtgatat

SEQ ID NO: 58288 - DNA, 75 bp, Artificial Sequence
  Synthetic
ggctatttgctatggtgcacaaagtgttacacttgttagagggcaaaataccgtgagggtttccggaaagggtgg

SEQ ID NO: 58289 - DNA, 75 bp, Artificial Sequence
  Synthetic
gcacagtggctcttcctttaagtgctgtcatggcactgattgttcacaccaagggcttcaagcaagtgctccaca

SEQ ID NO: 58290 - DNA, 75 bp, Artificial Sequence
  Synthetic
cttagacaaggttaatggcattgttgaacaagagagtacacaggtatatgatgatggtgcacctcaatgtggcat

SEQ ID NO: 58291 - DNA, 75 bp, Artificial Sequence
  Synthetic
ttcatgctggtttataaaatctggagagtggataaaaggtatcttcagtggaaattggattgtcattgttgtatt

SEQ ID NO: 58292 - DNA, 75 bp, Artificial Sequence
  Synthetic
aatcttccttttcttactttctttgatattacttagttttctgtgccctattcgcaagcataagcgctcataggt

SEQ ID NO: 58293 - DNA, 75 bp, Artificial Sequence
  Synthetic
gtatattgtatcaagctcttttcatgtttaatgttatcacatattgctttcacataacctggattactgctatgc

SEQ ID NO: 58294 - DNA, 75 bp, Artificial Sequence
  Synthetic
taattattttttatacatagttactaatatgtatctctaaaaaaaatacctcctttattaccataactcctagtc

SEQ ID NO: 58295 - DNA, 75 bp, Artificial Sequence
  Synthetic
gaaaagtatattctgtgtgtgcgtcttggtacacagttagtagtgagagtggaaggaaaagaatacactttgaaa

SEQ ID NO: 58296 - DNA, 75 bp, Artificial Sequence
  Synthetic
acataacgcattagaataggtttgaaagagttgaatcaatgagatcaatggtctttcgagctaggaggcccgtta

SEQ ID NO: 58297 - DNA, 75 bp, Artificial Sequence
  Synthetic
aacgggccgtcgatataataaaacgtaagctgccttacgttccgccaccaatgagggtggccaaaatggcagcga

SEQ ID NO: 58298 - DNA, 75 bp, Artificial Sequence
  Synthetic
agaaagtgatgatgggaattggaagcttgaaagcatttttggctctgtttttgttcatgactttcactggccgga

SEQ ID NO: 58299 - DNA, 75 bp, Artificial Sequence
  Synthetic
aaatttctaacgaacaacataagagattccggtcgatagacaagactaaagcaatgaaggtgttggcgacattta

SEQ ID NO: 58300 - DNA, 75 bp, Artificial Sequence
  Synthetic
agaaaattcttggaaatctgatgaaaacccttcaaacccggaaaaagagaccgaatagacgatctgctgggagta

SEQ ID NO: 58301 - DNA, 75 bp, Artificial Sequence
  Synthetic
atggaatgatgatgctagccttgattgggactgctatggcagccacgagtatgactaaagacgataccatctaca

SEQ ID NO: 58302 - DNA, 75 bp, Artificial Sequence
  Synthetic
tgaccgtggaaccaaaagatgtagggacttggctctctatccgcacacgcctaggcaatggatcgtgtatagtca

SEQ ID NO: 58303 - DNA, 75 bp, Artificial Sequence
  Synthetic
acgcaatggatgttggcacaatgtgtgaagataaggtgacatatgaatgtccgaagattgatggatcatctgacc

SEQ ID NO: 58304 - DNA, 75 bp, Artificial Sequence
  Synthetic
ctgaagatgttgactgttggtgtaaggggatttctgttgtactgacctatggaaggtgcaagactaattccacta

SEQ ID NO: 58305 - DNA, 75 bp, Artificial Sequence
  Synthetic
ccccggcacctcagcgtcgcagatcaagaagatctatcatgatacctacacacagtacgggtggattgcaccaag

SEQ ID NO: 58306 - DNA, 75 bp, Artificial Sequence
  Synthetic
gaaccgaaggatggcacaggaccaataatgtgaagaacttcctcatgcgagttgagaaatggtcactgagaaatc

SEQ ID NO: 58307 - DNA, 75 bp, Artificial Sequence
  Synthetic
cagggtacactgccttgatagccattctaggatggactcttggcacaacaaccgcccaaaaggtcatttttatag

SEQ ID NO: 58308 - DNA, 75 bp, Artificial Sequence
  Synthetic
ctttgctcttgatgatcgcacctgtctacggaagccagtgttcagggatcgacaaacgtgacttcatacaagggg

SEQ ID NO: 58309 - DNA, 75 bp, Artificial Sequence
  Synthetic
tgtcaggaggtacctgggtagatgtggtcttggaccgtaaaggatgcgtgacaatatcagcaaccggaaaaccga

SEQ ID NO: 58310 - DNA, 75 bp, Artificial Sequence
  Synthetic
ccatagacgtacggatggttaagatggaagcctccaatttggcatccgtgcgaacatactgtctggaagcttcca

SEQ ID NO: 58311 - DNA, 75 bp, Artificial Sequence
  Synthetic
cctcggaaatttcatccgttaatggttgcccctcaactacagaagcacataatgataagcggaaagactcaactt

SEQ ID NO: 58312 - DNA, 75 bp, Artificial Sequence
  Synthetic
atctgtgcgagagaagctaccctgataggggatggggcaatggatgtggactttttgggagaggctctttggata

SEQ ID NO: 58313 - DNA, 75 bp, Artificial Sequence
  Synthetic
cgtgcgtcaagtttgcatgcagtaagaaaatggcaggacatgcaatctcaagagagaacatcgtcataactgctg

SEQ ID NO: 58314 - DNA, 75 bp, Artificial Sequence
  Synthetic
cagtgtctgttcacggacactctggcgctgagagtgacgacgactcgcaaaggaaatcgcgtaaggaactggcag

SEQ ID NO: 58315 - DNA, 75 bp, Artificial Sequence
  Synthetic
agctcaccataactcctaaaagctccattgttgaagcagatttgggagattacggcaaagtgcaatttgaatgcc

SEQ ID NO: 58316 - DNA, 75 bp, Artificial Sequence
  Synthetic
tgatggactttgggattgatttggatgacgtttacacggccgatatgtcaggaaagtggtggttggttaagcgtg

SEQ ID NO: 58317 - DNA, 75 bp, Artificial Sequence
  Synthetic
attggtatcatgacattgctctcccatggacagcaccctccgctgacttttggcatgacatggacagattggtgg

SEQ ID NO: 58318 - DNA, 75 bp, Artificial Sequence
  Synthetic
aatttagcacaccacatgccactaagcagagtgtgtataccctaggtgaccaagaaggagccatgtccactgccc

SEQ ID NO: 58319 - DNA, 75 bp, Artificial Sequence
  Synthetic
taggtgatgcggccgttattgaatacatgtcatcaggaagcaaggtggtctttcgtacagggttcctaaaatgta

SEQ ID NO: 58320 - DNA, 75 bp, Artificial Sequence
  Synthetic
gagtcaagatggaaaatctgagattgaaaggctccacatatatgcaatgttccaaggagttctctattctgaaga

SEQ ID NO: 58321 - DNA, 75 bp, Artificial Sequence
  Synthetic
ggcccaccgccaccccgtatggaactgtcatcatgcaggtgaagtacgcgcagactgatgtcccgtgtcgtgtgc

SEQ ID NO: 58322 - DNA, 75 bp, Artificial Sequence
  Synthetic
cagtgggcgttcatgagaggccaggtggtgagcaagttggacgtattataacagcccatcctatcattcttaaac

SEQ ID NO: 58323 - DNA, 75 bp, Artificial Sequence
  Synthetic
agaacgatgcacttgttatcgaagttgaacccccgtttggagatagtgtcatagaaattggtctaggcaccacga

SEQ ID NO: 58324 - DNA, 75 bp, Artificial Sequence
  Synthetic
aaatagtggaacaatggcatagagatggcagctcgattggagcggcattcacatccaccatgaaaggtgtggaac

SEQ ID NO: 58325 - DNA, 75 bp, Artificial Sequence
  Synthetic
gaatggctctattgggagaacacgcttgggatttcgggtccgtcgggggttttttcaacagtatgggcaaggcta

SEQ ID NO: 58326 - DNA, 75 bp, Artificial Sequence
  Synthetic
tccactccgtgtttggaggtttgttccgggcggtatttggaggtatgagctggatttccaaagtgcttatcggtg

SEQ ID NO: 58327 - DNA, 75 bp, Artificial Sequence
  Synthetic
caatcttgatgtggttgggagttagcgcacgggaaaaaaccctcgctatgtctctaatcacggtgggggctatcc

SEQ ID NO: 58328 - DNA, 75 bp, Artificial Sequence
  Synthetic
ttttgtatctgtctaccatgaccaatgctgtgtccgaggtagggtgtagtttggatttgtcccgccatgaaataa

SEQ ID NO: 58329 - DNA, 75 bp, Artificial Sequence
  Synthetic
aatgcggcgatggagtgtttttatttcgagacgtcagcaactggcgtgacaaatacgtgttccatcctggttcac

SEQ ID NO: 58330 - DNA, 75 bp, Artificial Sequence
  Synthetic
cacgtactcttgcagcatccgtttggtcggcttggaacaatggaatttgtggcgtacgctcaaccacacgtatgg

SEQ ID NO: 58331 - DNA, 75 bp, Artificial Sequence
  Synthetic
aacacgaaatgtggaaacaagttgagaatgagatcaacggaatatttgaagagaatgccattgcccttagtgtcg

SEQ ID NO: 58332 - DNA, 75 bp, Artificial Sequence
  Synthetic
ttgttaagaatgcgaacggaacatttccgcgtgggcacaaacgcctcccagtcaacacaacaggactacagcacg

SEQ ID NO: 58333 - DNA, 75 bp, Artificial Sequence
  Synthetic
gatggaagacatggggaaagaccaagttgatgcaggttccattggcaaaggacgtttttatcattgatggaaacg

SEQ ID NO: 58334 - DNA, 75 bp, Artificial Sequence
  Synthetic
atgagggtgaatgcgtgtctacaaatagatcatggaacacttttagggttgaggagtttggcacgggaatcatga

SEQ ID NO: 58335 - DNA, 75 bp, Artificial Sequence
  Synthetic
aaacaaaagtgtttttggatataaacccgactttaacgagatactgcgataccgaattgcttggagcagctgtga

SEQ ID NO: 58336 - DNA, 75 bp, Artificial Sequence
  Synthetic
aaggaaaccattctgctcatggtgatcctggtttgtggatggtctctgagaaagaaggaagtgagtggaaactca

SEQ ID NO: 58337 - DNA, 75 bp, Artificial Sequence
  Synthetic
cgagcctgtcactatccgagagtaggaggtgtttgtggcctgattctcatactgtctggggacgtggagttgaag

SEQ ID NO: 58338 - DNA, 75 bp, Artificial Sequence
  Synthetic
agaccaaactcatccttcctgccaatcttggagggccagtgtcacacatgaacactagatatggctactcaaccc

SEQ ID NO: 58339 - DNA, 75 bp, Artificial Sequence
  Synthetic
agatctctggaccatggaacaatgttccactagacgtggtctttgagacctgtcctggaacgacggttaatgtca

SEQ ID NO: 58340 - DNA, 75 bp, Artificial Sequence
  Synthetic
ctagaacatgtgtggggagatcggcatcggcaaggtcaacaactgacagtgggaagatcataccggagtggtgtt

SEQ ID NO: 58341 - DNA, 75 bp, Artificial Sequence
  Synthetic
gcagagcctgcaccatgcctcccttgacataccggacacccgatggatgctggtacgccatggaaatccagccaa

SEQ ID NO: 58342 - DNA, 75 bp, Artificial Sequence
  Synthetic
tgaacaccaaggaggagagtatcctgagagcgagagtttcagcaggagcagttcacggactagacaacttttcac

SEQ ID NO: 58343 - DNA, 75 bp, Artificial Sequence
  Synthetic
tgggattgttggtcatgatgttggtcacgcaagaaggactgaagagaagattcactagcaaacatatcatgttgg

SEQ ID NO: 58344 - DNA, 75 bp, Artificial Sequence
  Synthetic
caggaatagggcttctcatctgtgttattatgggtgacctcacatacacagatctggctcggtatgcagtactac

SEQ ID NO: 58345 - DNA, 75 bp, Artificial Sequence
  Synthetic
tcgggacaacgttcgcagagatgaactcgggtggagatgtcatgcacctcgcgctggttgccacatttaaagtca

SEQ ID NO: 58346 - DNA, 75 bp, Artificial Sequence
  Synthetic
aaccagcatacctgttgggtttcctctttaggatgcgttggtctccaagagaaagtttcatgttggtatgtggtg

SEQ ID NO: 58347 - DNA, 75 bp, Artificial Sequence
  Synthetic
ccattctcatgcagaccggaatgggagttctggcctgccatcacatgatggattatgtccacgcatgtgcccttg

SEQ ID NO: 58348 - DNA, 75 bp, Artificial Sequence
  Synthetic
gttggttgcttgtcagatctttagttgtccctggaatggtttcgaaagccttaccccttttatgttgtctggctc

SEQ ID NO: 58349 - DNA, 75 bp, Artificial Sequence
  Synthetic
cgttgcctttagctgttatgactaacgccacgagagctagtgtggcaactttggcagttggaaccatgttggccg

SEQ ID NO: 58350 - DNA, 75 bp, Artificial Sequence
  Synthetic
gtgccaagggcaagtcagtgaaaaaatccctaccatggttttcagctttgattgcatcttggatggggtgcaatc

SEQ ID NO: 58351 - DNA, 75 bp, Artificial Sequence
  Synthetic
cacttggcatgatggtgttcgccagttttatgaggaaacatggcaagagatcctggccagctggagaggtgatgg

SEQ ID NO: 58352 - DNA, 75 bp, Artificial Sequence
  Synthetic
cagctgtaggcatcgtatgcgctctagcaggtgccatcacagaaaaccagggagaagtggctgggccagccgctg

SEQ ID NO: 58353 - DNA, 75 bp, Artificial Sequence
  Synthetic
ctgcggcccttatattcaccgcatatgccataagcggcaaggccaacgacatattccttgagaaagctggtgaga

SEQ ID NO: 58354 - DNA, 75 bp, Artificial Sequence
  Synthetic
tgacatggagccatgatgctcagctatctggatcaagtccaagagtggacgtcaaagttggtgagagtggggatt

SEQ ID NO: 58355 - DNA, 75 bp, Artificial Sequence
  Synthetic
ttcggcttcgccacgagtctgaagactcgtggctgaaaacaggcgtaacagctggctgtctcatcatggccggct

SEQ ID NO: 58356 - DNA, 75 bp, Artificial Sequence
  Synthetic
tccatccccttgccataccggttgcgggattgatttggtatggatatgtgaaacatgaccgtagaggtggagtct

SEQ ID NO: 58357 - DNA, 75 bp, Artificial Sequence
  Synthetic
tgtgggacattccacacccatcaacatccaaagccggagacactgagacaggagtataccgcatcatgtccaaac

SEQ ID NO: 58358 - DNA, 75 bp, Artificial Sequence
  Synthetic
gtctgtttggggccacccagataggtgtgggggtgatgtatgagagtgtcttccacaccatgtggcatgtcacca

SEQ ID NO: 58359 - DNA, 75 bp, Artificial Sequence
  Synthetic
gaggagcttctctgatgagtggagaaggtagaattgatccatattgggctgacgtccgtgaggatctcatcagct

SEQ ID NO: 58360 - DNA, 75 bp, Artificial Sequence
  Synthetic
atggtggaccatggagattgaatggaacgtgggacgggactactgaagtgcaacttatagcagtgtcacctggca

SEQ ID NO: 58361 - DNA, 75 bp, Artificial Sequence
  Synthetic
aagttcctatcaacgtccaaacgaaacctggaaaattcgtgctcactgatggacgtgagataggagcagttgtgt

SEQ ID NO: 58362 - DNA, 75 bp, Artificial Sequence
  Synthetic
tggactatccgcccggaacatcaggatcccctgtaatcgatcaggaggggaaaatcgtgggtctgtatggcaatg

SEQ ID NO: 58363 - DNA, 75 bp, Artificial Sequence
  Synthetic
gagtgatgctcaacgaacaaacgttcgcaagctccatagcacagactctgccacgaacatgtgaggttccacatg

SEQ ID NO: 58364 - DNA, 75 bp, Artificial Sequence
  Synthetic
catttcatgacgggatgttgagtaaggggactctaagcgtcttggatttgcatccaggcgctggtaagactaggc

SEQ ID NO: 58365 - DNA, 75 bp, Artificial Sequence
  Synthetic
gagtcctacctgagatactgcgtgaagctgtgaagaaaaatctgaagacattggtccttgcacccacacgggttg

SEQ ID NO: 58366 - DNA, 75 bp, Artificial Sequence
  Synthetic
ttgcacgagagatggctgaagcattagctggactaccagtgcggtaccaaacaccatctgtcagtcaagactcaa

SEQ ID NO: 58367 - DNA, 75 bp, Artificial Sequence
  Synthetic
ccggtcgtgaactaatagacttgatgtgtcatgcaacattcacgtatcgtcagttgactcctggacggatggtga

SEQ ID NO: 58368 - DNA, 75 bp, Artificial Sequence
  Synthetic
attaccaattgtacgtcatggatgaggcccatttcacggatcctgcgagtattgccgcacggggaatcatttcaa

SEQ ID NO: 58369 - DNA, 75 bp, Artificial Sequence
  Synthetic
caagagtcagtcttggggaagctgcagccatgttcatgacagccactcctccgggaacgacagacgctttccctg

SEQ ID NO: 58370 - DNA, 75 bp, Artificial Sequence
  Synthetic
agtcaaacgggcatatagaagatgaagaaagggaagtgcctgatgctgcttggagtgctggctttgattggataa

SEQ ID NO: 58371 - DNA, 75 bp, Artificial Sequence
  Synthetic
ccgaattcaacggcaaaaccatttggttcgccccatccattaaaacttccaatatactagccagttgtctttgta

SEQ ID NO: 58372 - DNA, 75 bp, Artificial Sequence
  Synthetic
gagctgggaagaaagtgatcattctcaacagcagaactttcaatgaggaatacgggaagaccaaaagtggagatt

SEQ ID NO: 58373 - DNA, 75 bp, Artificial Sequence
  Synthetic
gggattttgtcataaccaccgacatctcagaaatgggggctaacatcaaggccgatagagtcattgatagtcgtt

SEQ ID NO: 58374 - DNA, 75 bp, Artificial Sequence
  Synthetic
tatctataaaaccagttttggtcacgacccccacagaacgaattgtgttgagtgggcccaagccagttagtgctg

SEQ ID NO: 58375 - DNA, 75 bp, Artificial Sequence
  Synthetic
ccagtgctgcacagcgtagaggacgtgtcggtcgtgaccccacgaaacatggtgaccagtatatatttggtgggc

SEQ ID NO: 58376 - DNA, 75 bp, Artificial Sequence
  Synthetic
ccatatcaacggatgatggagacatggcgcattggattgaggctaagattctcatggacaacatcacagtgcctg

SEQ ID NO: 58377 - DNA, 75 bp, Artificial Sequence
  Synthetic
ggggactttatcctcaattctatgaacctgagcgaatgaaatgtccagcgaccgatgggtttcacagacttgatg

SEQ ID NO: 58378 - DNA, 75 bp, Artificial Sequence
  Synthetic
acaagaaaagggctgttcttcgcgatctcataaggcgcgcagatctccctgtgtggctatcataccaagttgcaa

SEQ ID NO: 58379 - DNA, 75 bp, Artificial Sequence
  Synthetic
aaaatgggtacacttacgaggaccgaacctggtgccactcagggccatcgtcacaccttgtgtttgatgactttg

SEQ ID NO: 58380 - DNA, 75 bp, Artificial Sequence
  Synthetic
gccagacagtcgagtaccgttcatctaatggtgagaaaagaattctccagcccaagtggatagaccaacgagtct

SEQ ID NO: 58381 - DNA, 75 bp, Artificial Sequence
  Synthetic
accaggaacgtgcttctttgaaaagtttcacggaatttgcagagggcagaaggagttacatgcctattttagatg

SEQ ID NO: 58382 - DNA, 75 bp, Artificial Sequence
  Synthetic
tggttgggaaactgccccagcattttagtgatcgtgccattgatgcagctgacactattcgaactgttctcacag

SEQ ID NO: 58383 - DNA, 75 bp, Artificial Sequence
  Synthetic
ccaatcctgactcacgatcttaccgactggcaatagacaatctgccggaagcggctgaaactgctatgcttatag

SEQ ID NO: 58384 - DNA, 75 bp, Artificial Sequence
  Synthetic
gcatgctggtttctgtcaccatgggttccatcatgtttttgatgatgcccaaaggcataacccggatgtccttgg

SEQ ID NO: 58385 - DNA, 75 bp, Artificial Sequence
  Synthetic
gattgattgtcatgattatggcaacttggttcatgtggacgtcagggatggcaggctatcagatagctgctgtcc

SEQ ID NO: 58386 - DNA, 75 bp, Artificial Sequence
  Synthetic
aacttttggcatttgtgttctttctcgttctggtgccagagcctggaaaccaacgatcgatacaagataatcaaa

SEQ ID NO: 58387 - DNA, 75 bp, Artificial Sequence
  Synthetic
ttgccatggtgttgtttgggttgttggcagtcattggtggaatagctgctaatgagatgggaatgcttgaacgga

SEQ ID NO: 58388 - DNA, 75 bp, Artificial Sequence
  Synthetic
ctaaagccgacataggaacactgttcagccggagtagtccgacccacactagttggagtgggtggaacattgact

SEQ ID NO: 58389 - DNA, 75 bp, Artificial Sequence
  Synthetic
tgtcagtcgacctcaagccttcagtgtcatggtctgtgtacatagtcttaacaacgcttgtcggaccaatgctgg

SEQ ID NO: 58390 - DNA, 75 bp, Artificial Sequence
  Synthetic
agcatgccatagttactgattatgctagtctgtctcttgcggccatcgcgtcccaagctggagtgttgctgtcta

SEQ ID NO: 58391 - DNA, 75 bp, Artificial Sequence
  Synthetic
tggacaaggggctcccattcatgagtttggaatggggggtgatcctgctcggtgttggaagttggactggcatca

SEQ ID NO: 58392 - DNA, 75 bp, Artificial Sequence
  Synthetic
cagcgttggctttgattgctggcatggtcatgacgttgatgcacttcgcccttatcctacccggattgaaagcta

SEQ ID NO: 58393 - DNA, 75 bp, Artificial Sequence
  Synthetic
aagctgcccgggaagcacaaagtaggaccgccgctggaatctcaaaaaatcctttgatagatggtgtgaatacta

SEQ ID NO: 58394 - DNA, 75 bp, Artificial Sequence
  Synthetic
cggcgattccactcccatcagccattgaccctatgtttgagaaaaaactcggactgtggatgttgcttatagttt

SEQ ID NO: 58395 - DNA, 75 bp, Artificial Sequence
  Synthetic
cgtctctagcggtgcttcttaatcgaagcacgctgcatatgactgaacttggaatccttggctcagctgctatat

SEQ ID NO: 58396 - DNA, 75 bp, Artificial Sequence
  Synthetic
ctcctctaatagagggacaagcttcggccatctggaacacttcagttgcagcctccgtgtgtaacttgatgcgtg

SEQ ID NO: 58397 - DNA, 75 bp, Artificial Sequence
  Synthetic
ggagctatttgggagggatccctctgacgtacacggtcataagaaatttgcaacagaagcagccgagcaggcgag

SEQ ID NO: 58398 - DNA, 75 bp, Artificial Sequence
  Synthetic
gcaagaaagtggaatacactctgggtattaaatggaaaaacagactcaacgcaatggacaagagagaattctcag

SEQ ID NO: 58399 - DNA, 75 bp, Artificial Sequence
  Synthetic
tatataaacgggatggaattttagaggtcaatcggacaccagcccaagaggcgttgaaaagtggaaatgtgactg

SEQ ID NO: 58400 - DNA, 75 bp, Artificial Sequence
  Synthetic
gaggccacgccgtctcacgaggctctgcaaaactgcgttggctacatgagaaaggttacgtggatttgtctggac

SEQ ID NO: 58401 - DNA, 75 bp, Artificial Sequence
  Synthetic
acatggttgatcttggctgcggacgcggaggatggtcttactacgcagctgcacagaagaagattgtgcgcgtca

SEQ ID NO: 58402 - DNA, 75 bp, Artificial Sequence
  Synthetic
aaggatacacaaaaggtggaccaggacatgaggaaccagtgcccgttcaatcatacgggtggaacctcgtaacga

SEQ ID NO: 58403 - DNA, 75 bp, Artificial Sequence
  Synthetic
tgaggtccaacgttgatgtgttctacttagggactgagaaatgcgacacgctggtttgtgacataggagaatcat

SEQ ID NO: 58404 - DNA, 75 bp, Artificial Sequence
  Synthetic
catctagctacatggttgaagaggaacgcacattgcgtgtgctcaacatgtttgagacatggctgaaagaacagc

SEQ ID NO: 58405 - DNA, 75 bp, Artificial Sequence
  Synthetic
atcctgagaattttgtgtgcaaagtgttggccccctacatgccggccgtcattgaaaagattgacgtactaatga

SEQ ID NO: 58406 - DNA, 75 bp, Artificial Sequence
  Synthetic
agaacttcggtggagcattagtgcgggttcctctatcacgaaacagtacacacgagatgtattgggtgtctgggg

SEQ ID NO: 58407 - DNA, 75 bp, Artificial Sequence
  Synthetic
ccaaaggaaacgccatgaatgctgtaagctcattgagcaggcagctcatagctagaatggagaagcccaagtatg

SEQ ID NO: 58408 - DNA, 75 bp, Artificial Sequence
  Synthetic
ttatgtgtctagaggaagatgttaacctgggtactggaactagggcggtcacttgtgaggctgaacctcccaata

SEQ ID NO: 58409 - DNA, 75 bp, Artificial Sequence
  Synthetic
tggacaaaataggacatcgagtggaacgccttagaaaagagtacaaacagacttggttctacgataatgagcacc

SEQ ID NO: 58410 - DNA, 75 bp, Artificial Sequence
  Synthetic
cgtatcgcacttgggtgtaccatggtagttatgaaaccaagaccactgggagcgcttcgtccatgttgaatggtg

SEQ ID NO: 58411 - DNA, 75 bp, Artificial Sequence
  Synthetic
tagtgaaagagatgtcaaaaccgtgggacacgatttatggagttacaagtgtttgcatgacagacactactccat

SEQ ID NO: 58412 - DNA, 75 bp, Artificial Sequence
  Synthetic
tcggtcagcagcgcgtgtttaaggagaaggtggacaccaaggctagtgaaccaaaggcaggcatccgtgaggtta

SEQ ID NO: 58413 - DNA, 75 bp, Artificial Sequence
  Synthetic
tgcgcataactaaccgttggctcctcaatgaactgtctagagaaaagacccctagactttgcacacctgatgagt

SEQ ID NO: 58414 - DNA, 75 bp, Artificial Sequence
  Synthetic
tcatagctaaagtcaatagtgatgctgctttgggagtcatgttctcagaccagggtgactggacaactgctaaag

SEQ ID NO: 58415 - DNA, 75 bp, Artificial Sequence
  Synthetic
aagctgtgagagatccacgcttctggaagctggttgatgctgagagagaggaacatctccagggccggtgcacaa

SEQ ID NO: 58416 - DNA, 75 bp, Artificial Sequence
  Synthetic
catgcatttacaacatgatgggtaagagagagaagaaaagcactgaatttggaagggcgaaaggcagccgagcca

SEQ ID NO: 58417 - DNA, 75 bp, Artificial Sequence
  Synthetic
tctggttcatgtggctaggggctcgataccttgagttcgaggccttaggcttcctgaatgaggatcactggctcg

SEQ ID NO: 58418 - DNA, 75 bp, Artificial Sequence
  Synthetic
aacgctccaattcacatggtggagtggaagggattggattacaataccttgggtatgtgattgaagaaatgagcc

SEQ ID NO: 58419 - DNA, 75 bp, Artificial Sequence
  Synthetic
acattcctgggggaaacttctatgctgatgatactgctggatgggacaccaagataacaaacgctgacttggaag

SEQ ID NO: 58420 - DNA, 75 bp, Artificial Sequence
  Synthetic
atgaacttatgatagtggagcgtatgggtaagacacacagacgtctagcccagtctatcatggaattaacataca

SEQ ID NO: 58421 - DNA, 75 bp, Artificial Sequence
  Synthetic
tgaacaaagtggttagagtcatgagacctggaaccagaggcaaaaccatgatggacgtcatctcacgtaaagatc

SEQ ID NO: 58422 - DNA, 75 bp, Artificial Sequence
  Synthetic
agcgtggctcaggacaggttgtcacatacccattgaatacctggactaacctaaaagtccagcttatacgcatgg

SEQ ID NO: 58423 - DNA, 75 bp, Artificial Sequence
  Synthetic
ctgaatctgaaggcgtcattcatggagatgacgttgaaacactatctagcagtgggcgtataaacttggaaatgt

SEQ ID NO: 58424 - DNA, 75 bp, Artificial Sequence
  Synthetic
ggcttgtcatgaacggggcagaccgtcttaagcgcatggcatgcagtggtgatgatgtcgttgtaaaaccaattg

SEQ ID NO: 58425 - DNA, 75 bp, Artificial Sequence
  Synthetic
acgatagatttgctggtgcgctggtattcttgaatggcatggccaaaactcgaaaggatatcaatgaatggaaac

SEQ ID NO: 58426 - DNA, 75 bp, Artificial Sequence
  Synthetic
cctctgttgggtggcataactgggaaggagtcccgttttgctctcatcacttccaccagttatggctaagagatg

SEQ ID NO: 58427 - DNA, 75 bp, Artificial Sequence
  Synthetic
gaagaagcatcattgtgccttgccgtgatcaggatgagttaatagggagggcccgtgtctcccctggggttggat

SEQ ID NO: 58428 - DNA, 75 bp, Artificial Sequence
  Synthetic
ggactctcaaggagacagctggacttagcaaggcctacgcacagatgtggcttctcatgcatttccatcggagag

SEQ ID NO: 58429 - DNA, 75 bp, Artificial Sequence
  Synthetic
atctgcgcatgatggcttttgccatttgcagctcggttcctgtcaattgggtcccgactggacgcacttcatggt

SEQ ID NO: 58430 - DNA, 75 bp, Artificial Sequence
  Synthetic
ctctccatgcccgaggagaatggatgacaacggaagacatgctccaagtttggaacagagtatggattgatgaca

SEQ ID NO: 58431 - DNA, 75 bp, Artificial Sequence
  Synthetic
atccacacatgatgaagaaaactcacgtccatgactggagggacataccatactcatgcaaaggccaggacatct

SEQ ID NO: 58432 - DNA, 75 bp, Artificial Sequence
  Synthetic
cctgcggttcgctcatagggacacggtctagagctacctgggctgataacatcaagacagcagtcaatcaagtcc

SEQ ID NO: 58433 - DNA, 75 bp, Artificial Sequence
  Synthetic
gtggaatcataggaagggacgaaaagtatatggactatttggccattcaaaatcgcttcatgccccctctccaat

SEQ ID NO: 58434 - DNA, 75 bp, Artificial Sequence
  Synthetic
ttagattgggaagcgtcctgtaaatactcacaggttgaggggttttgcagtcaggcctcacgaatgtgagccacc

SEQ ID NO: 58435 - DNA, 75 bp, Artificial Sequence
  Synthetic
ggatgggactagacggtgctgcctgcgcgtccccccacgcaatcaagctagatggttgtcatgggcgtaatgttg

SEQ ID NO: 58436 - DNA, 75 bp, Artificial Sequence
  Synthetic
ttctagcaatttagggggccagatgtcatgtctctcaagcctaggagacactagacactctggactatcggttag

SEQ ID NO: 58437 - DNA, 75 bp, Artificial Sequence
  Synthetic
aggaaacccccccaaaaatgtataggctattatatcgacacctaggaaagactggagatacctttggttcttcga

SEQ ID NO: 58438 - DNA, 75 bp, Artificial Sequence
  Synthetic
gttcttcgacactaactcctaatggcacagagcgccataagaaacggagttagtatggaaaaaacataagtatct

SEQ ID NO: 58439 - DNA, 75 bp, Artificial Sequence
  Synthetic
tctcaaagacaaacgtgccgcagtcgcccgattgtactttgaagaagcaagatggagaatcagatcaaggcaaac

SEQ ID NO: 58440 - DNA, 75 bp, Artificial Sequence
  Synthetic
tagaagatatggactaataacgcttggggcagtctcgccatttggcagacttttcttacctaggttttcaggact

SEQ ID NO: 58441 - DNA, 75 bp, Artificial Sequence
  Synthetic
aataaaaaagagtttgatgagtggtttaaaccttttagtgaaaagctccaattaaggtcaaacctcacaaactct

SEQ ID NO: 58442 - DNA, 75 bp, Artificial Sequence
  Synthetic
ggtcagttcatcagtggccctagaagacagtgaaactatctcaaaagcagctgctgagattaactccaatgacat

SEQ ID NO: 58443 - DNA, 75 bp, Artificial Sequence
  Synthetic
gcatccctgtgtgatagagtacctgacctagctctagcagaaatgaaaatggcccttgccacagatgataaagaa

SEQ ID NO: 58444 - DNA, 75 bp, Artificial Sequence
  Synthetic
tttcttcaatacaagtagtctaagcaaccttgacaaattagaacaaagtcctgatagttcaggtttagatgatga

SEQ ID NO: 58445 - DNA, 75 bp, Artificial Sequence
  Synthetic
tagtgtagtaagtacaactacagtagagtcatcagactcaaaaggatcatcatcaagtttcacttttgacttaaa

SEQ ID NO: 58446 - DNA, 75 bp, Artificial Sequence
  Synthetic
ccgtccgctgtcggagactgaggtcaaatttttgaagcttttgagagaattgacatcaacaactgcatgtgaaat

SEQ ID NO: 58447 - DNA, 75 bp, Artificial Sequence
  Synthetic
tgcagtacaggcgtagtgcagaagagcttaagctggtttgataagaacaaagacttcatcaagctctgggacgca

SEQ ID NO: 58448 - DNA, 75 bp, Artificial Sequence
  Synthetic
aagtacatggatctcagaaagggtatccctgaaccagagcaactagtttcataccagcaggcggcccaaaagtgg

SEQ ID NO: 58449 - DNA, 75 bp, Artificial Sequence
  Synthetic
gctacaagaaaagataaacactctctacaatgattctagagaaggccctttggataggcataacatcttacaaaa

SEQ ID NO: 58450 - DNA, 75 bp, Artificial Sequence
  Synthetic
agaaaggacgttggttatgaaattaaccaattcacaaggtctctcacacatccagttgttgcagagtacaaagtg

SEQ ID NO: 58451 - DNA, 75 bp, Artificial Sequence
  Synthetic
ctgtagattgtctgagtcatgtgattggttgcttgacggtaagaagaggggtctgcttgaattatcaagaaggat

SEQ ID NO: 58452 - DNA, 75 bp, Artificial Sequence
  Synthetic
cctggagaaattgctgttgatgtcaaagaaatgctgtctgacatgatcaggcgcaggaatgtcctgctgaacgga

SEQ ID NO: 58453 - DNA, 75 bp, Artificial Sequence
  Synthetic
gtcttgtctgctcaatgttttgattgcaggttattataggtcatttggaagtgaaggaacagaaaaacaggtaaa

SEQ ID NO: 58454 - DNA, 75 bp, Artificial Sequence
  Synthetic
gcgcaggaatgtcctgctgaacggagacggagaaaatgctgggaaaaaaggtcctatcagcagagagcatgtctc

SEQ ID NO: 58455 - DNA, 75 bp, Artificial Sequence
  Synthetic
ggcctcctggtctagagacgacaatagagttattgaagatcctatgattcaacttataccagagaagctaagaag

SEQ ID NO: 58456 - DNA, 75 bp, Artificial Sequence
  Synthetic
ttggggccgtgagttggcaggaggaaagttccaagttgtgtttaatcctccttggggggatataaacaagtgtgg

SEQ ID NO: 58457 - DNA, 75 bp, Artificial Sequence
  Synthetic
agagctagaaagacttggtttatcaaggatggaagtggatgagttaatgccagctgtaggccctgatgagagcct

SEQ ID NO: 58458 - DNA, 75 bp, Artificial Sequence
  Synthetic
taaatcaggcattcctctagcagctactgccatggtgaaggttgctgagctagatgggtcaaagaagcttgaaga

SEQ ID NO: 58459 - DNA, 75 bp, Artificial Sequence
  Synthetic
actgccatggtgaaggttgctgagctagatgggtcaaagaagcttgaagatataaggcaggcccttctagatcta

SEQ ID NO: 58460 - DNA, 75 bp, Artificial Sequence
  Synthetic
ttctcaattagtagcaaagaaactcatcagcttgaatgtatcaactgaggagtattcagctgaggtgtcaaggtt

SEQ ID NO: 58461 - DNA, 75 bp, Artificial Sequence
  Synthetic
aagaaatgggttgaagataacaaggatgcactagaggatgggaaaggcaatgagctcgtccagactatgacaaag

SEQ ID NO: 58462 - DNA, 75 bp, Artificial Sequence
  Synthetic
atgcactagaggatgggaaaggcaatgagctcgtccagactatgacaaagcatctggctcaagcagtggaactat

SEQ ID NO: 58463 - DNA, 75 bp, Artificial Sequence
  Synthetic
gaagcagactttaactgccaggaatgtgctacatgggttagctggcggaattaaggagttatcattacctatata

SEQ ID NO: 58464 - DNA, 75 bp, Artificial Sequence
  Synthetic
caccatattcatgaagccttacttcttcaaagacaatgtgttcctggacttagaagacagatggagctctaggca

SEQ ID NO: 58465 - DNA, 75 bp, Artificial Sequence
  Synthetic
ccaaaaagtccaatgccctgcgtgcacaaggagcacaaatagacactcctttctcagcctattattgggcttgga

SEQ ID NO: 58466 - DNA, 75 bp, Artificial Sequence
  Synthetic
cagtactaattacagagacagcacaggtaaaatgttgacagggaaagtagtaaccaagtttacccactggttgga

SEQ ID NO: 58467 - DNA, 75 bp, Artificial Sequence
  Synthetic
gcgctggtgttaagccagagacatttttcactttgtctcaattcctctttgagatgggccagagtgctagaggag

SEQ ID NO: 58468 - DNA, 75 bp, Artificial Sequence
  Synthetic
tactttcttgtcctgtgttgtgagtgccaaccgttcacaagagattaaagaatgctctcttttcaacccaaatct

SEQ ID NO: 58469 - DNA, 75 bp, Artificial Sequence
  Synthetic
gcaaaaaaatgatcaaagcactgacttccacaccactaaggtggggcaagggattgattaacctgtttgcagatg

SEQ ID NO: 58470 - DNA, 75 bp, Artificial Sequence
  Synthetic
tagatgtgtgaatataatggtgaaaggaaacggtataaaggaactgtcttacattagaagccatttatcagtgct

SEQ ID NO: 58471 - DNA, 75 bp, Artificial Sequence
  Synthetic
atgactttttgggcaacagactatacatgcatcctgcagttctgactcctggtcgaatgagtgaaatgggtgcat

SEQ ID NO: 58472 - DNA, 75 bp, Artificial Sequence
  Synthetic
ttctgttgaatttgagaatttgaacctgcaattttctgatgtgaacaggcaaaagcttaaaattgttgaaagtag

SEQ ID NO: 58473 - DNA, 75 bp, Artificial Sequence
  Synthetic
gctttggggttattcctgttgcaagcccagaagatgcaatcctaggttcaggacactcaaaaaacatactgaact

SEQ ID NO: 58474 - DNA, 75 bp, Artificial Sequence
  Synthetic
cccagaagatgcaatcctaggttcaggacactcaaaaaacatactgaacttcaaaattgacaccagtgtgcagaa

SEQ ID NO: 58475 - DNA, 75 bp, Artificial Sequence
  Synthetic
accaccggagtgtgaattggaagcaaataaggcagttattatcaaatccaaattatttagtgcagtagaacatgt

SEQ ID NO: 58476 - DNA, 75 bp, Artificial Sequence
  Synthetic
tagactttcaaataaccctgctgttgtaatgggttacctcttggaagagtcttcaatatcagaggtcaaacctac

SEQ ID NO: 58477 - DNA, 75 bp, Artificial Sequence
  Synthetic
gtctactgaacatcttttgcaccagtcatttgttggtaaaagatgcccaacccagaatgcttacaaggtgagagg

SEQ ID NO: 58478 - DNA, 75 bp, Artificial Sequence
  Synthetic
taaggttgacttttcaaatctgctgaaacataggtttaaacttatgcagttcttcccttctgtctttactttact

SEQ ID NO: 58479 - DNA, 75 bp, Artificial Sequence
  Synthetic
aaatgcaaccaatgttaacatcatctaaaagctggcattgtgtggccttccctaacatcttaaacaagttgcaca

SEQ ID NO: 58480 - DNA, 75 bp, Artificial Sequence
  Synthetic
gaggtctttacaatctgaatcaaaagaattagaaaaactaggtgagccagttgacatgcatcaggtttcaaaata

SEQ ID NO: 58481 - DNA, 75 bp, Artificial Sequence
  Synthetic
taaaagctggcattgtgtggccttccctaacatcttaaacaagttgcacatcagcgaaaggccactaaaagcttt

SEQ ID NO: 58482 - DNA, 75 bp, Artificial Sequence
  Synthetic
tcagcgaaaggccactaaaagcttttttcttgcttatctttccatttttccttctttatatattagttttgcttt

SEQ ID NO: 58483 - DNA, 75 bp, Artificial Sequence
  Synthetic
tgctaatcatctgactctgctctgtagaatgatacagcagtcaaaaccctcattgactgtcttttatatgctgaa

SEQ ID NO: 58484 - DNA, 75 bp, Artificial Sequence
  Synthetic
tttgactaacatactaacatagtgtaagtcgtaatcaatctgctaattctgcttaacacaggggggctgcgcggc

SEQ ID NO: 58485 - DNA, 75 bp, Artificial Sequence
  Synthetic
gggtagccaaatgaatacggaaccaacagtttctgaattagtaagctatggaattaaagaaggtcggttcttgaa

SEQ ID NO: 58486 - DNA, 75 bp, Artificial Sequence
  Synthetic
tctcaaagacaaacgtgccgcagtcccgactgtactttgaagaggcaagatggagaatcagatcaaggcaaacaa

SEQ ID NO: 58487 - DNA, 75 bp, Artificial Sequence
  Synthetic
acatagtgtaagtcgtaatcaatctgctaattctgcttaacacaggggggctgcgcggcaacgatctctttgaga

SEQ ID NO: 58488 - DNA, 75 bp, Artificial Sequence
  Synthetic
gctacctgagatagggttggatgctagtacatattctgtaaggtattggaaaatattacactgcatctcagcaat

SEQ ID NO: 58489 - DNA, 75 bp, Artificial Sequence
  Synthetic
tggagagctccctttgagcagcgaagataaaacttctctacttataagtttcttaaattggaaagtaacttctga

SEQ ID NO: 58490 - DNA, 75 bp, Artificial Sequence
  Synthetic
ttgtgttgatgattgttgcccattagaaaaatatgataaggccatagtaagtgaattttcaggacaagtattaat

SEQ ID NO: 58491 - DNA, 75 bp, Artificial Sequence
  Synthetic
caacactttagctagtgaactgagttctgttagaaaggaccaagaaagagagggcctaactgacctgattgatta

SEQ ID NO: 58492 - DNA, 75 bp, Artificial Sequence
  Synthetic
cagtacaggtgtagtgcagaagagcttaagctggtttgataagaacaaagacttcatcaaactctgggacgcaaa

SEQ ID NO: 58493 - DNA, 75 bp, Artificial Sequence
  Synthetic
cattaattcaccaagtgaactgttgaaaaagaagccttatttaggtacaacctgcaggttccaatgctggggaga

SEQ ID NO: 58494 - DNA, 75 bp, Artificial Sequence
  Synthetic
aggagccaaatctggaaagttcacttacagcagtagaactggagaagccatcggcatctttgtggctggcaaatt

SEQ ID NO: 58495 - DNA, 75 bp, Artificial Sequence
  Synthetic
aaaggacgttggttatgaaattaaccaattcacaaggtctctcacacatccagttgttgcagagtacaaagtgcc

SEQ ID NO: 58496 - DNA, 75 bp, Artificial Sequence
  Synthetic
gcacatccatcttacttctgactcacctggtttgctttgtgaagtcgagaggcaggtcttaagctggcttggtaa

SEQ ID NO: 58497 - DNA, 75 bp, Artificial Sequence
  Synthetic
tggagaattgctgttgatgtcaagaatgctgtctgacatgatcaggcgcaggaatgtcctgctgaacggagacgg

SEQ ID NO: 58498 - DNA, 75 bp, Artificial Sequence
  Synthetic
gagaagaactgatgtgctaacaaaggaacaacatcagttcttcttagacttccttccaaaccttagtgaggtggt

SEQ ID NO: 58499 - DNA, 75 bp, Artificial Sequence
  Synthetic
ggaatgtcctgctgaacggagacggagaaaatgctgggaaaaaggtccttatcagcagagagcatgtctcttggg

SEQ ID NO: 58500 - DNA, 75 bp, Artificial Sequence
  Synthetic
gcaaaaaaacagagatggtgctattttgggtgttacaatagacagcacaaatgtcagaatgctgaagtatgtccc

SEQ ID NO: 58501 - DNA, 75 bp, Artificial Sequence
  Synthetic
tcctaagagaaatactcctgtgattaagatcaagaaacaaatactaacagttaagaaacaaacaactttggatgt

SEQ ID NO: 58502 - DNA, 75 bp, Artificial Sequence
  Synthetic
ggaaagtgagccaagaatagtctggggacatggtcaattatcgatagtgtatgatgaatgcgaaactgaaaccac

SEQ ID NO: 58503 - DNA, 75 bp, Artificial Sequence
  Synthetic
ctagaggatgggaaaggcaatgagctcgtccagactatgacaaagcatctggctaagcatgtggaactatccaaa

SEQ ID NO: 58504 - DNA, 75 bp, Artificial Sequence
  Synthetic
atatcatgaaaacttaatcaaagttaaaaaacttgttgatctggcatcaggaacaacagacaaactcccaacagc

SEQ ID NO: 58505 - DNA, 75 bp, Artificial Sequence
  Synthetic
tatcttttcagacacaaggatcacattagccagagtgaagtttaagacagagctcctgttgaattcactatgttt

SEQ ID NO: 58506 - DNA, 75 bp, Artificial Sequence
  Synthetic
gcttcactgcttcctaaagcacactagccaagatgccatccaagaagttgagagcaagtgtaatgtgctggaaag

SEQ ID NO: 58507 - DNA, 75 bp, Artificial Sequence
  Synthetic
gtatctaagatccggtggtgtacaatttagaccgatgagtgagtcattggacaaaaaagtaactaaacttccttt

SEQ ID NO: 58508 - DNA, 75 bp, Artificial Sequence
  Synthetic
acagtgtcagtctgataaagacgttgataaagagattaacttctgtgaggacttgactagagtcttttctaatga

SEQ ID NO: 58509 - DNA, 75 bp, Artificial Sequence
  Synthetic
aaatgtgccattgagttcatggtcagaggtccagtcttacatagaagaggttggttttggtaatgtgcttgtaca

SEQ ID NO: 58510 - DNA, 75 bp, Artificial Sequence
  Synthetic
aagatgcaatcctaggttcaggacactcaaaaaacatactgaacttcaaaattgataccagtgtacagaacccat

SEQ ID NO: 58511 - DNA, 75 bp, Artificial Sequence
  Synthetic
attgataccagtgtacagaacccatgtgcatccacaatcgtgcaactgatacagaatccagaaatctggctttga

SEQ ID NO: 58512 - DNA, 75 bp, Artificial Sequence
  Synthetic
tattgagaaaaatccaacaagaagtgatttaatatggcggttttcaatagactcaatcagcggaaatttcggacc

SEQ ID NO: 58513 - DNA, 75 bp, Artificial Sequence
  Synthetic
gtgcatccacaatcgtgcaactgatacagaatccagaaatctggctttgatctagaagcttagaagtagtgtcta

SEQ ID NO: 58514 - DNA, 75 bp, Artificial Sequence
  Synthetic
aataaaggacattagaacattagtgacttatatgagcactgaaacagtaccaaagtttctactaccctttctgct

SEQ ID NO: 58515 - DNA, 75 bp, Artificial Sequence
  Synthetic
ctttgaggagcagcttaagcacctcatagctggctgtgtagaattaagagatgcactaaacagctcagggataaa

SEQ ID NO: 58516 - DNA, 75 bp, Artificial Sequence
  Synthetic
gaaaggccactaaaagcttttttcttacttatctttccatttttttcttctttatatattagttttgctttttga

SEQ ID NO: 58517 - DNA, 75 bp, Artificial Sequence
  Synthetic
tgaccgagaaattgcaattgttgcgctatttacttgtttttattaccaatctgactcagttaagaggcaagggcc

SEQ ID NO: 58518 - DNA, 75 bp, Artificial Sequence
  Synthetic
ctaacatactaacatagtgtaagttgtaatcaatctgctaattctgcttaacacaggggggcgtgtggtaacgat

SEQ ID NO: 58519 - DNA, 75 bp, Artificial Sequence
  Synthetic
tgtatgctcaatatcctcattttgtagtttaataggagatgatttactgccacttgacaacagacttcaagccag

SEQ ID NO: 58520 - DNA, 75 bp, Artificial Sequence
  Synthetic
aaagactcaatcttttctaatgctctggtggaggcaacacgtttctgtgctccaatctatgagtgtgcttggacc

SEQ ID NO: 58521 - DNA, 75 bp, Artificial Sequence
  Synthetic
agttcttcctgaacaggacaatgttaaacttcacttcaaactcaatctcacaacagacagtgcattaggcaaaaa

SEQ ID NO: 58522 - DNA, 75 bp, Artificial Sequence
  Synthetic
tccaatctatgagtgtgcttggacctgcagtacaggcgtagtgcagaagagcttaagctggtttgataagaacaa

SEQ ID NO: 58523 - DNA, 75 bp, Artificial Sequence
  Synthetic
tgcagtacaggcgtagtgcagaagagcttaagctggtttgataagaacaaagacttcatcaaactctgggactca

SEQ ID NO: 58524 - DNA, 75 bp, Artificial Sequence
  Synthetic
agacaaagcaattcaagctaaaaaaatcatcagcagatatttaaggctcatattcacagaagatgacatggattt

SEQ ID NO: 58525 - DNA, 75 bp, Artificial Sequence
  Synthetic
catagtgtaagttgtaatcaatctgctaattctgcttaacacaggggggcgtgtggtaacgatttctctttgaga

SEQ ID NO: 58526 - DNA, 75 bp, Artificial Sequence
  Synthetic
aaagagactcaaaagtgatgccaccaaagtaaaactgtcgtctgaaaaggagtgtgaattcttagaattttgcct

SEQ ID NO: 58527 - DNA, 75 bp, Artificial Sequence
  Synthetic
acacagtgacctttcttatgccttgaactacagagtactattagaacatcttatagacttagaagacagagctaa

SEQ ID NO: 58528 - DNA, 75 bp, Artificial Sequence
  Synthetic
aaaaactgcttgtgtgctcattgaagaatttattctgatgctaacaggaaggttgatgatctcaagtacaattga

SEQ ID NO: 58529 - DNA, 75 bp, Artificial Sequence
  Synthetic
cccatgtgcatccacaatcgtgcaactgtacagaatccagaaatctggctttgatctggaaagcttagaagtagt

SEQ ID NO: 58530 - DNA, 75 bp, Artificial Sequence
  Synthetic
ctcagatagcaaaaggacattagaggatgatgccctctgtttggaggatctgcttgatagtgacaatgaggcatc

SEQ ID NO: 58531 - DNA, 75 bp, Artificial Sequence
  Synthetic
cagctcaaagtctgacaatgaagaacagatagcactacaaactggtaaatttaacttcaactgggattcagactg

SEQ ID NO: 58532 - DNA, 75 bp, Artificial Sequence
  Synthetic
agctcggttgccattaacagtaacctactaactaaatctgtcaacttttctcatctttaactagccatttattaa

SEQ ID NO: 58533 - DNA, 75 bp, Artificial Sequence
  Synthetic
acatagtataagttgtaatcaatctgctaattctgcttaacacaggggggctgtgcggcaacgatctctttgaga

SEQ ID NO: 58534 - DNA, 75 bp, Artificial Sequence
  Synthetic
tttgactaacatactaacatagtataagttgtaatcaatctgctaattctgcttaacacaggggggctgtgcggc

SEQ ID NO: 58535 - DNA, 75 bp, Artificial Sequence
  Synthetic
tctcaaagacatacctgcggcacatacaagtgttaaaggtgttcacaatgtctaagagggtactgatcatagccg

SEQ ID NO: 58536 - DNA, 75 bp, Artificial Sequence
  Synthetic
actaaatctgtcaacttttctcatctttaactagccatttattaataggggtgtgggggaacgatttctttgaga

SEQ ID NO: 58537 - DNA, 75 bp, Artificial Sequence
  Synthetic
tagtggtttatctggtattcaccactcaaaaccagataaccggcaaccacacaacaatcaacagcagcagcccgt

SEQ ID NO: 58538 - DNA, 75 bp, Artificial Sequence
  Synthetic
ccacaacagaggcaagcagcacgccaacagtcagcagaactccacaaacaaccaccacctccactgcagtatcca

SEQ ID NO: 58539 - DNA, 75 bp, Artificial Sequence
  Synthetic
ccaccatcaccgcaaccaccactccaacagcttcatggaccacacagagtcaatattttaataaaacaacacaac

SEQ ID NO: 58540 - DNA, 75 bp, Artificial Sequence
  Synthetic
accattggagagaagaaaccatgatctcaaggaatcctactgtgctggacagacagagcagagcaagttctgtga

SEQ ID NO: 58541 - DNA, 75 bp, Artificial Sequence
  Synthetic
gagaactactcaacaccaagttcttaatgttgttaggtttcattccaaagggtgaagtcaatcacctagaaaatg

SEQ ID NO: 58542 - DNA, 75 bp, Artificial Sequence
  Synthetic
cctgcaacagggaagggaaaaactgcacagaattaatactgaaagaaaggatagctcggttcttttctgagacag

SEQ ID NO: 58543 - DNA, 75 bp, Artificial Sequence
  Synthetic
aaaaagagtcatgttataacacttacctagaaaaacaccttcgcagtgttagccctgaagttagtctcacccctt

SEQ ID NO: 58544 - DNA, 75 bp, Artificial Sequence
  Synthetic
tctcaaagacatcaatcccccttttccccaaaacttaaacatggacttcttagacagtctaatttgggaaagggt

SEQ ID NO: 58545 - DNA, 75 bp, Artificial Sequence
  Synthetic
acagggtcctcgggctaagagaagacattttgctgaaagaaattgaccgtagaatcatcagatttgaaacagact

SEQ ID NO: 58546 - DNA, 75 bp, Artificial Sequence
  Synthetic
tgttgatgaacaatatatcactaacccaacattttgtgttagtgactattttgaagttatcagacagccagggga

SEQ ID NO: 58547 - DNA, 75 bp, Artificial Sequence
  Synthetic
cccaaagagtgacctgtctctcagcatctctgctaaaacctgatgtctttattagggaacagagaattgatgcta

SEQ ID NO: 58548 - DNA, 75 bp, Artificial Sequence
  Synthetic
tggcaactgtttttaccatagcattgcagaactgttctttgatgtcaaaacaccatctagctttagaaaagtaaa
